United States Patent 7,300,788 (METHOD FOR GENOTYPING POLYMORPHISMS IN HUMANS) - sequence listing, part 2

SEQ ID NO: 39872 - DNA, 25 bp, Homo sapien
cacagtctgaaggggaattatgtta

SEQ ID NO: 39873 - DNA, 25 bp, Homo sapien
cacagtctgaatgggaattatgtta

SEQ ID NO: 39874 - DNA, 25 bp, Homo sapien
cacagtgactcatagtagatcattt

SEQ ID NO: 39875 - DNA, 25 bp, Homo sapien
cacagtgactcatattagatcattt

SEQ ID NO: 39876 - DNA, 25 bp, Homo sapien
cacagtgagttacatgacctggtag

SEQ ID NO: 39877 - DNA, 25 bp, Homo sapien
cacagtgagttatatgacctggtag

SEQ ID NO: 39878 - DNA, 25 bp, Homo sapien
cacagtgcacaggaaagtccctacc

SEQ ID NO: 39879 - DNA, 25 bp, Homo sapien
cacagtgcacaggacagtccctacc

SEQ ID NO: 39880 - DNA, 25 bp, Homo sapien
cacagtgcagaaatggttatattta

SEQ ID NO: 39881 - DNA, 25 bp, Homo sapien
cacagtgcatttgagtaactgaaat

SEQ ID NO: 39882 - DNA, 25 bp, Homo sapien
cacagtgccgaaatggttatattta

SEQ ID NO: 39883 - DNA, 25 bp, Homo sapien
cacagtgcctttgagtaactgaaat

SEQ ID NO: 39884 - DNA, 25 bp, Homo sapien
cacagtgctcagctgaacagcagtg

SEQ ID NO: 39885 - DNA, 25 bp, Homo sapien
cacagtgctcagctgaccagcagtg

SEQ ID NO: 39886 - DNA, 25 bp, Homo sapien
cacagtggaacctcatctctacaaa

SEQ ID NO: 39887 - DNA, 25 bp, Homo sapien
cacagtgggacctcatctctacaaa

SEQ ID NO: 39888 - DNA, 25 bp, Homo sapien
cacagttaattccagggctgcctgc

SEQ ID NO: 39889 - DNA, 25 bp, Homo sapien
cacagttaattctagggctgcctgc

SEQ ID NO: 39890 - DNA, 25 bp, Homo sapien
cacagttacaggagctagaggtttg

SEQ ID NO: 39891 - DNA, 25 bp, Homo sapien
cacagttataggagctagaggtttg

SEQ ID NO: 39892 - DNA, 25 bp, Homo sapien
cacagttatgcctgtcattgaacca

SEQ ID NO: 39893 - DNA, 25 bp, Homo sapien
cacagttatgcctgtcgttgaacca

SEQ ID NO: 39894 - DNA, 25 bp, Homo sapien
cacagttatttttcaagtactttta

SEQ ID NO: 39895 - DNA, 25 bp, Homo sapien
cacagttattttttaagtactttta

SEQ ID NO: 39896 - DNA, 25 bp, Homo sapien
cacagttctccatacgtagcttcaa

SEQ ID NO: 39897 - DNA, 25 bp, Homo sapien
cacagttctccatatgtagcttcaa

SEQ ID NO: 39898 - DNA, 25 bp, Homo sapien
cacagttctccatctcatcccttgg

SEQ ID NO: 39899 - DNA, 25 bp, Homo sapien
cacagttctccatctcgtcccttgg

SEQ ID NO: 39900 - DNA, 25 bp, Homo sapien
cacagttggataccaatacagcagg

SEQ ID NO: 39901 - DNA, 25 bp, Homo sapien
cacagttggatgccaatacagcagg

SEQ ID NO: 39902 - DNA, 25 bp, Homo sapien
cacagttgtacatgattttgatcat

SEQ ID NO: 39903 - DNA, 25 bp, Homo sapien
cacagttgtacgtgattttgatcat

SEQ ID NO: 39904 - DNA, 25 bp, Homo sapien
cacagtttacacgagcacagagttc

SEQ ID NO: 39905 - DNA, 25 bp, Homo sapien
cacagtttacatgagcacagagttc

SEQ ID NO: 39906 - DNA, 25 bp, Homo sapien
cacagtttcttctctgtgcatgtga

SEQ ID NO: 39907 - DNA, 25 bp, Homo sapien
cacagtttcttctttgtgcatgtga

SEQ ID NO: 39908 - DNA, 25 bp, Homo sapien
cacagtttgcttcaaggtctacaac

SEQ ID NO: 39909 - DNA, 25 bp, Homo sapien
cacagtttgctttaaggtctacaac

SEQ ID NO: 39910 - DNA, 25 bp, Homo sapien
cacataaaaaaaattcaacaccact

SEQ ID NO: 39911 - DNA, 25 bp, Homo sapien
cacataaaaaacattcaacaccact

SEQ ID NO: 39912 - DNA, 25 bp, Homo sapien
cacataaaccaacaatcctgcttct

SEQ ID NO: 39913 - DNA, 25 bp, Homo sapien
cacataaaccaacaattctgcttct

SEQ ID NO: 39914 - DNA, 25 bp, Homo sapien
cacataaaccaggggggaatgctta

SEQ ID NO: 39915 - DNA, 25 bp, Homo sapien
cacataaactaggggggaatgctta

SEQ ID NO: 39916 - DNA, 25 bp, Homo sapien
cacataaagcctgtgcattataagc

SEQ ID NO: 39917 - DNA, 25 bp, Homo sapien
cacataaagcctgtgcgttataagc

SEQ ID NO: 39918 - DNA, 25 bp, Homo sapien
cacataaagtagataaatgttccta

SEQ ID NO: 39919 - DNA, 25 bp, Homo sapien
cacataaagtaggtaaatgttccta

SEQ ID NO: 39920 - DNA, 25 bp, Homo sapien
cacataaatacaacgaacaaatcca

SEQ ID NO: 39921 - DNA, 25 bp, Homo sapien
cacataaatacaatgaacaaatcca

SEQ ID NO: 39922 - DNA, 25 bp, Homo sapien
cacataagaaatgcatactgattgc

SEQ ID NO: 39923 - DNA, 25 bp, Homo sapien
cacataagaaatgcttactgattgc

SEQ ID NO: 39924 - DNA, 25 bp, Homo sapien
cacataatgtaccattccattttac

SEQ ID NO: 39925 - DNA, 25 bp, Homo sapien
cacataatgtactattccattttac

SEQ ID NO: 39926 - DNA, 25 bp, Homo sapien
cacataattactaaaaactgtggca

SEQ ID NO: 39927 - DNA, 25 bp, Homo sapien
cacataattactgaaaactgtggca

SEQ ID NO: 39928 - DNA, 25 bp, Homo sapien
cacatacaacgctttgataaactct

SEQ ID NO: 39929 - DNA, 25 bp, Homo sapien
cacatacaatgctttgataaactct

SEQ ID NO: 39930 - DNA, 25 bp, Homo sapien
cacatacacacaagagacatgcctt

SEQ ID NO: 39931 - DNA, 25 bp, Homo sapien
cacatacacccaagagacatgcctt

SEQ ID NO: 39932 - DNA, 25 bp, Homo sapien
cacatacactattttaatttgactc

SEQ ID NO: 39933 - DNA, 25 bp, Homo sapien
cacatacagaaaccaatccaaaaag

SEQ ID NO: 39934 - DNA, 25 bp, Homo sapien
cacatacagaaatcaatccaaaaag

SEQ ID NO: 39935 - DNA, 25 bp, Homo sapien
cacatacattattttaatttgactc

SEQ ID NO: 39936 - DNA, 25 bp, Homo sapien
cacatactaggagcttgctctatgc

SEQ ID NO: 39937 - DNA, 25 bp, Homo sapien
cacatactctcatcttctgacaaaa

SEQ ID NO: 39938 - DNA, 25 bp, Homo sapien
cacatactctcgtcttctgacaaaa

SEQ ID NO: 39939 - DNA, 25 bp, Homo sapien
cacatactctctgcgatggctaatt

SEQ ID NO: 39940 - DNA, 25 bp, Homo sapien
cacatactgggagcttgctctatgc

SEQ ID NO: 39941 - DNA, 25 bp, Homo sapien
cacatactgtctgcgatggctaatt

SEQ ID NO: 39942 - DNA, 25 bp, Homo sapien
cacatacttttatcttttacttcta

SEQ ID NO: 39943 - DNA, 25 bp, Homo sapien
cacatacttttgtcttttacttcta

SEQ ID NO: 39944 - DNA, 25 bp, Homo sapien
cacatagaagacaatttaggagcct

SEQ ID NO: 39945 - DNA, 25 bp, Homo sapien
cacatagaagacgatttaggagcct

SEQ ID NO: 39946 - DNA, 25 bp, Homo sapien
cacatagaatagttttctcagaact

SEQ ID NO: 39947 - DNA, 25 bp, Homo sapien
cacatagaatatttttctcagaact

SEQ ID NO: 39948 - DNA, 25 bp, Homo sapien
cacatagcaaactctatgaactact

SEQ ID NO: 39949 - DNA, 25 bp, Homo sapien
cacatagcaaactttatgaactact

SEQ ID NO: 39950 - DNA, 25 bp, Homo sapien
cacataggcaggctggaaagtcaga

SEQ ID NO: 39951 - DNA, 25 bp, Homo sapien
cacataggcaggctgggaagtcaga

SEQ ID NO: 39952 - DNA, 25 bp, Homo sapien
cacatataaatggacgcatgcagtt

SEQ ID NO: 39953 - DNA, 25 bp, Homo sapien
cacatataaatggatgcatgcagtt

SEQ ID NO: 39954 - DNA, 25 bp, Homo sapien
cacatatacacatccgggcagcttc

SEQ ID NO: 39955 - DNA, 25 bp, Homo sapien
cacatatacacatctgggcagcttc

SEQ ID NO: 39956 - DNA, 25 bp, Homo sapien
cacatatattttcttcaggccagct

SEQ ID NO: 39957 - DNA, 25 bp, Homo sapien
cacatatattttcttcgggccagct

SEQ ID NO: 39958 - DNA, 25 bp, Homo sapien
cacatatcgtcatggcagaacatag

SEQ ID NO: 39959 - DNA, 25 bp, Homo sapien
cacatatcgtcgtggcagaacatag

SEQ ID NO: 39960 - DNA, 25 bp, Homo sapien
cacatatctctctgcggctaaagta

SEQ ID NO: 39961 - DNA, 25 bp, Homo sapien
cacatatctctctgtggctaaagta

SEQ ID NO: 39962 - DNA, 25 bp, Homo sapien
cacatatgaatgcctaatatgcaca

SEQ ID NO: 39963 - DNA, 25 bp, Homo sapien
cacatatgaatgcctagtatgcaca

SEQ ID NO: 39964 - DNA, 25 bp, Homo sapien
cacatatgcaacaagaagcggctgg

SEQ ID NO: 39965 - DNA, 25 bp, Homo sapien
cacatatgtaacaagaagcggctgg

SEQ ID NO: 39966 - DNA, 25 bp, Homo sapien
cacatatgtgacccgtttagtgtca

SEQ ID NO: 39967 - DNA, 25 bp, Homo sapien
cacatatgtgacctgtttagtgtca

SEQ ID NO: 39968 - DNA, 25 bp, Homo sapien
cacatatttccattttgtactggag

SEQ ID NO: 39969 - DNA, 25 bp, Homo sapien
cacatattttcattttgtactggag

SEQ ID NO: 39970 - DNA, 25 bp, Homo sapien
cacatcagagccacgctaggaaatg

SEQ ID NO: 39971 - DNA, 25 bp, Homo sapien
cacatcagagccatgctaggaaatg

SEQ ID NO: 39972 - DNA, 25 bp, Homo sapien
cacatcagtaacctcacggccactt

SEQ ID NO: 39973 - DNA, 25 bp, Homo sapien
cacatcagtaacctcagggccactt

SEQ ID NO: 39974 - DNA, 25 bp, Homo sapien
cacatcatatcaaaatgcatgggat

SEQ ID NO: 39975 - DNA, 25 bp, Homo sapien
cacatcatgtcaaaatgcatgggat

SEQ ID NO: 39976 - DNA, 25 bp, Homo sapien
cacatccagaggttaattaagccat

SEQ ID NO: 39977 - DNA, 25 bp, Homo sapien
cacatccataggttaattaagccat

SEQ ID NO: 39978 - DNA, 25 bp, Homo sapien
cacatccctgacaaaaacttagcca

SEQ ID NO: 39979 - DNA, 25 bp, Homo sapien
cacatccctgacaaaaccttagcca

SEQ ID NO: 39980 - DNA, 25 bp, Homo sapien
cacatcctaaaaacggtactggtgc

SEQ ID NO: 39981 - DNA, 25 bp, Homo sapien
cacatcctgaaaacggtactggtgc

SEQ ID NO: 39982 - DNA, 25 bp, Homo sapien
cacatcctgaaccctggttagtcct

SEQ ID NO: 39983 - DNA, 25 bp, Homo sapien
cacatcctgaactctggttagtcct

SEQ ID NO: 39984 - DNA, 25 bp, Homo sapien
cacatctaaaattgcatttattgtg

SEQ ID NO: 39985 - DNA, 25 bp, Homo sapien
cacatctaaaattgtatttattgtg

SEQ ID NO: 39986 - DNA, 25 bp, Homo sapien
cacatcttctgaacttcgacttcgc

SEQ ID NO: 39987 - DNA, 25 bp, Homo sapien
cacatcttctgaactttgacttcgc

SEQ ID NO: 39988 - DNA, 25 bp, Homo sapien
cacatcttcttgcctgggctcagca

SEQ ID NO: 39989 - DNA, 25 bp, Homo sapien
cacatcttcttgtctgggctcagca

SEQ ID NO: 39990 - DNA, 25 bp, Homo sapien
cacatctttttgaatctactacacc

SEQ ID NO: 39991 - DNA, 25 bp, Homo sapien
cacatctttttggatctactacacc

SEQ ID NO: 39992 - DNA, 25 bp, Homo sapien
cacatgaaacactttatttattaca

SEQ ID NO: 39993 - DNA, 25 bp, Homo sapien
cacatgaagcactttatttattaca

SEQ ID NO: 39994 - DNA, 25 bp, Homo sapien
cacatgacacagattctaaaccctt

SEQ ID NO: 39995 - DNA, 25 bp, Homo sapien
cacatgacacagtttctaaaccctt

SEQ ID NO: 39996 - DNA, 25 bp, Homo sapien
cacatgacacttctgacaccagctg

SEQ ID NO: 39997 - DNA, 25 bp, Homo sapien
cacatgacacttttgacaccagctg

SEQ ID NO: 39998 - DNA, 25 bp, Homo sapien
cacatgaccaactgagatttatctc

SEQ ID NO: 39999 - DNA, 25 bp, Homo sapien
cacatgaccaactgggatttatctc

SEQ ID NO: 40000 - DNA, 25 bp, Homo sapien
cacatgaccatcccagttttctccc

SEQ ID NO: 40001 - DNA, 25 bp, Homo sapien
cacatgaccgtcccagttttctccc

SEQ ID NO: 40002 - DNA, 25 bp, Homo sapien
cacatgactttaaccggtcgatctc

SEQ ID NO: 40003 - DNA, 25 bp, Homo sapien
cacatgactttaactggtcgatctc

SEQ ID NO: 40004 - DNA, 25 bp, Homo sapien
cacatgactttacctggtcgatctc

SEQ ID NO: 40005 - DNA, 25 bp, Homo sapien
cacatgagcagaagagttaaagctt

SEQ ID NO: 40006 - DNA, 25 bp, Homo sapien
cacatgagcagaggagttaaagctt

SEQ ID NO: 40007 - DNA, 25 bp, Homo sapien
cacatgagttgcctactgacatgtt

SEQ ID NO: 40008 - DNA, 25 bp, Homo sapien
cacatgagttgtctactgacatgtt

SEQ ID NO: 40009 - DNA, 25 bp, Homo sapien
cacatgcaagtattgacatagagga

SEQ ID NO: 40010 - DNA, 25 bp, Homo sapien
cacatgcaattattgacatagagga

SEQ ID NO: 40011 - DNA, 25 bp, Homo sapien
cacatgccaccatatctggctaatc

SEQ ID NO: 40012 - DNA, 25 bp, Homo sapien
cacatgccaccatttctggctaatc

SEQ ID NO: 40013 - DNA, 25 bp, Homo sapien
cacatgcccactttcatttctctag

SEQ ID NO: 40014 - DNA, 25 bp, Homo sapien
cacatgcccacttttatttctctag

SEQ ID NO: 40015 - DNA, 25 bp, Homo sapien
cacatgccctcaagcgatgcctttt

SEQ ID NO: 40016 - DNA, 25 bp, Homo sapien
cacatgccctcaagtgatgcctttt

SEQ ID NO: 40017 - DNA, 25 bp, Homo sapien
cacatgctgtgagaccacaaggcca

SEQ ID NO: 40018 - DNA, 25 bp, Homo sapien
cacatgctgtgggaccacaaggcca

SEQ ID NO: 40019 - DNA, 25 bp, Homo sapien
cacatggaaaattagggagaaaggc

SEQ ID NO: 40020 - DNA, 25 bp, Homo sapien
cacatggaaccttcaactataaatt

SEQ ID NO: 40021 - DNA, 25 bp, Homo sapien
cacatggaatcttcaactataaatt

SEQ ID NO: 40022 - DNA, 25 bp, Homo sapien
cacatggagaattagggagaaaggc

SEQ ID NO: 40023 - DNA, 25 bp, Homo sapien
cacatggatgaaagattgcagtaac

SEQ ID NO: 40024 - DNA, 25 bp, Homo sapien
cacatggatgaatgattgcagtaac

SEQ ID NO: 40025 - DNA, 25 bp, Homo sapien
cacatggcaaaggtatggtggccaa

SEQ ID NO: 40026 - DNA, 25 bp, Homo sapien
cacatggcagaggtatggtggccaa

SEQ ID NO: 40027 - DNA, 25 bp, Homo sapien
cacatggcccaccttgcactgccct

SEQ ID NO: 40028 - DNA, 25 bp, Homo sapien
cacatggcccagcttgcactgccct

SEQ ID NO: 40029 - DNA, 25 bp, Homo sapien
cacatggggtttaataaggtttcaa

SEQ ID NO: 40030 - DNA, 25 bp, Homo sapien
cacatggggtttgataaggtttcaa

SEQ ID NO: 40031 - DNA, 25 bp, Homo sapien
cacatggtctttccttggtgtgtgc

SEQ ID NO: 40032 - DNA, 25 bp, Homo sapien
cacatggtcttttcttggtgtgtgc

SEQ ID NO: 40033 - DNA, 25 bp, Homo sapien
cacatggtgacgagtgaatggctca

SEQ ID NO: 40034 - DNA, 25 bp, Homo sapien
cacatggtgacgagtgcatggctca

SEQ ID NO: 40035 - DNA, 25 bp, Homo sapien
cacatggtgttgctagaagtattat

SEQ ID NO: 40036 - DNA, 25 bp, Homo sapien
cacatggtgttgctagcagtattat

SEQ ID NO: 40037 - DNA, 25 bp, Homo sapien
cacatgtaatgtcatcacatttttc

SEQ ID NO: 40038 - DNA, 25 bp, Homo sapien
cacatgtaatgtcgtcacatttttc

SEQ ID NO: 40039 - DNA, 25 bp, Homo sapien
cacatgtcacctaacagcatgtggc

SEQ ID NO: 40040 - DNA, 25 bp, Homo sapien
cacatgtcacctaatagcatgtggc

SEQ ID NO: 40041 - DNA, 25 bp, Homo sapien
cacatgtcttcgctgtgcagataag

SEQ ID NO: 40042 - DNA, 25 bp, Homo sapien
cacatgtcttcgttgtgcagataag

SEQ ID NO: 40043 - DNA, 25 bp, Homo sapien
cacatgtgacaaaagaaaagaattg

SEQ ID NO: 40044 - DNA, 25 bp, Homo sapien
cacatgtgacaaaggaaaagaattg

SEQ ID NO: 40045 - DNA, 25 bp, Homo sapien
cacattaaatttcagtcttggcttc

SEQ ID NO: 40046 - DNA, 25 bp, Homo sapien
cacattaaattttagtcttggcttc

SEQ ID NO: 40047 - DNA, 25 bp, Homo sapien
cacattaagagagctactattcatt

SEQ ID NO: 40048 - DNA, 25 bp, Homo sapien
cacattaatagagctactattcatt

SEQ ID NO: 40049 - DNA, 25 bp, Homo sapien
cacattaatatcctagtacctctcc

SEQ ID NO: 40050 - DNA, 25 bp, Homo sapien
cacattaatatccttgtacctctcc

SEQ ID NO: 40051 - DNA, 25 bp, Homo sapien
cacattacaggctccatggacagga

SEQ ID NO: 40052 - DNA, 25 bp, Homo sapien
cacattacctacattacttataaaa

SEQ ID NO: 40053 - DNA, 25 bp, Homo sapien
cacattacgggctccatggacagga

SEQ ID NO: 40054 - DNA, 25 bp, Homo sapien
cacattacttacattacttataaaa

SEQ ID NO: 40055 - DNA, 25 bp, Homo sapien
cacattatatacatgacacattcct

SEQ ID NO: 40056 - DNA, 25 bp, Homo sapien
cacattatgaggtccaaaaattggt

SEQ ID NO: 40057 - DNA, 25 bp, Homo sapien
cacattatgaggttcaaaaattggt

SEQ ID NO: 40058 - DNA, 25 bp, Homo sapien
cacattatgtacatgacacattcct

SEQ ID NO: 40059 - DNA, 25 bp, Homo sapien
cacattcacctttcttcgtgtacct

SEQ ID NO: 40060 - DNA, 25 bp, Homo sapien
cacattcacctttctttgtgtacct

SEQ ID NO: 40061 - DNA, 25 bp, Homo sapien
cacattcagcctggcctatcttatc

SEQ ID NO: 40062 - DNA, 25 bp, Homo sapien
cacattcagccttgcctatcttatc

SEQ ID NO: 40063 - DNA, 25 bp, Homo sapien
cacattcataattgcaaaattcaga

SEQ ID NO: 40064 - DNA, 25 bp, Homo sapien
cacattcatcacagtaatgacaatg

SEQ ID NO: 40065 - DNA, 25 bp, Homo sapien
cacattcatcacggtaatgacaatg

SEQ ID NO: 40066 - DNA, 25 bp, Homo sapien
cacattcatcattgcaaaattcaga

SEQ ID NO: 40067 - DNA, 25 bp, Homo sapien
cacattcatctcttcttatgggaat

SEQ ID NO: 40068 - DNA, 25 bp, Homo sapien
cacattcatctgttcttatgggaat

SEQ ID NO: 40069 - DNA, 25 bp, Homo sapien
cacattccaacatatattagtctgc

SEQ ID NO: 40070 - DNA, 25 bp, Homo sapien
cacattccaacatgtattagtctgc

SEQ ID NO: 40071 - DNA, 25 bp, Homo sapien
cacattcccaatggtgtcctctgag

SEQ ID NO: 40072 - DNA, 25 bp, Homo sapien
cacattcccgatggtgtcctctgag

SEQ ID NO: 40073 - DNA, 25 bp, Homo sapien
cacattccctgtcaatttcttgagt

SEQ ID NO: 40074 - DNA, 25 bp, Homo sapien
cacattccctgttaatttcttgagt

SEQ ID NO: 40075 - DNA, 25 bp, Homo sapien
cacattctcactttgtcctcactcg

SEQ ID NO: 40076 - DNA, 25 bp, Homo sapien
cacattctcactttgttctcactcg

SEQ ID NO: 40077 - DNA, 25 bp, Homo sapien
cacattctcagcgtttaatgcctaa

SEQ ID NO: 40078 - DNA, 25 bp, Homo sapien
cacattctcagtgtttaatgcctaa

SEQ ID NO: 40079 - DNA, 25 bp, Homo sapien
cacattctgcacaccagtccaagtc

SEQ ID NO: 40080 - DNA, 25 bp, Homo sapien
cacattctgtgagtttccatttaat

SEQ ID NO: 40081 - DNA, 25 bp, Homo sapien
cacattctgtgagttttcatttaat

SEQ ID NO: 40082 - DNA, 25 bp, Homo sapien
cacattcttcacaccagtccaagtc

SEQ ID NO: 40083 - DNA, 25 bp, Homo sapien
cacattgaacgggttcatctgaaat

SEQ ID NO: 40084 - DNA, 25 bp, Homo sapien
cacattgaatgggttcatctgaaat

SEQ ID NO: 40085 - DNA, 25 bp, Homo sapien
cacattgatttgtgcatctgtaaaa

SEQ ID NO: 40086 - DNA, 25 bp, Homo sapien
cacattgatttgtgtatctgtaaaa

SEQ ID NO: 40087 - DNA, 25 bp, Homo sapien
cacattggctaggaaaatgaatatt

SEQ ID NO: 40088 - DNA, 25 bp, Homo sapien
cacattggctaggaaagtgaatatt

SEQ ID NO: 40089 - DNA, 25 bp, Homo sapien
cacattggctccactgttggtcaag

SEQ ID NO: 40090 - DNA, 25 bp, Homo sapien
cacattggctccgctgttggtcaag

SEQ ID NO: 40091 - DNA, 25 bp, Homo sapien
cacattgtacgacaatcaatcctac

SEQ ID NO: 40092 - DNA, 25 bp, Homo sapien
cacattgtatgacaatcaatcctac

SEQ ID NO: 40093 - DNA, 25 bp, Homo sapien
cacattgtattcaccttgggagctt

SEQ ID NO: 40094 - DNA, 25 bp, Homo sapien
cacattgtattgaccttgggagctt

SEQ ID NO: 40095 - DNA, 25 bp, Homo sapien
cacattgtcatttgatctttgtaaa

SEQ ID NO: 40096 - DNA, 25 bp, Homo sapien
cacattgtcatttgatgtttgtaaa

SEQ ID NO: 40097 - DNA, 25 bp, Homo sapien
cacattgtcttccttgtgctgtgat

SEQ ID NO: 40098 - DNA, 25 bp, Homo sapien
cacattgtcttctttgtgctgtgat

SEQ ID NO: 40099 - DNA, 25 bp, Homo sapien
cacattgttttcttgggatagcaag

SEQ ID NO: 40100 - DNA, 25 bp, Homo sapien
cacattgttttctttggatagcaag

SEQ ID NO: 40101 - DNA, 25 bp, Homo sapien
cacatttagttgcgttgaactcaaa

SEQ ID NO: 40102 - DNA, 25 bp, Homo sapien
cacatttagttgggttgaactcaaa

SEQ ID NO: 40103 - DNA, 25 bp, Homo sapien
cacatttatgatctcacagttctgc

SEQ ID NO: 40104 - DNA, 25 bp, Homo sapien
cacatttatgatttcacagttctgc

SEQ ID NO: 40105 - DNA, 25 bp, Homo sapien
cacatttcaacaacggctaaaaaca

SEQ ID NO: 40106 - DNA, 25 bp, Homo sapien
cacatttcaacaagggctaaaaaca

SEQ ID NO: 40107 - DNA, 25 bp, Homo sapien
cacatttcacggaccgtgcatctca

SEQ ID NO: 40108 - DNA, 25 bp, Homo sapien
cacatttcatcggcaggcactcagt

SEQ ID NO: 40109 - DNA, 25 bp, Homo sapien
cacatttcatctgcaggcactcagt

SEQ ID NO: 40110 - DNA, 25 bp, Homo sapien
cacatttcatggaccgtgcatctca

SEQ ID NO: 40111 - DNA, 25 bp, Homo sapien
cacatttccctggcttgatttctta

SEQ ID NO: 40112 - DNA, 25 bp, Homo sapien
cacatttccgtggcttgatttctta

SEQ ID NO: 40113 - DNA, 25 bp, Homo sapien
cacatttctctctgacagtcccatt

SEQ ID NO: 40114 - DNA, 25 bp, Homo sapien
cacatttctctcttacagtcccatt

SEQ ID NO: 40115 - DNA, 25 bp, Homo sapien
cacatttctttcactaagttatcac

SEQ ID NO: 40116 - DNA, 25 bp, Homo sapien
cacatttctttcgctaagttatcac

SEQ ID NO: 40117 - DNA, 25 bp, Homo sapien
cacatttgtgcataaatacacaggc

SEQ ID NO: 40118 - DNA, 25 bp, Homo sapien
cacatttgtgcgtaaatacacaggc

SEQ ID NO: 40119 - DNA, 25 bp, Homo sapien
cacattttaataagttgcatatttt

SEQ ID NO: 40120 - DNA, 25 bp, Homo sapien
cacattttaatgagttgcatatttt

SEQ ID NO: 40121 - DNA, 25 bp, Homo sapien
cacattttacactcactgactgtgt

SEQ ID NO: 40122 - DNA, 25 bp, Homo sapien
cacattttacacttactgactgtgt

SEQ ID NO: 40123 - DNA, 25 bp, Homo sapien
cacattttactcattctttactgag

SEQ ID NO: 40124 - DNA, 25 bp, Homo sapien
cacattttactcgttctttactgag

SEQ ID NO: 40125 - DNA, 25 bp, Homo sapien
cacattttatatgacacgagaaaaa

SEQ ID NO: 40126 - DNA, 25 bp, Homo sapien
cacattttatatgacatgagaaaaa

SEQ ID NO: 40127 - DNA, 25 bp, Homo sapien
cacattttcaactggctgccaagca

SEQ ID NO: 40128 - DNA, 25 bp, Homo sapien
cacattttcatactctcagaagaga

SEQ ID NO: 40129 - DNA, 25 bp, Homo sapien
cacattttcatattctcagaagaga

SEQ ID NO: 40130 - DNA, 25 bp, Homo sapien
cacatttttaactggctgccaagca

SEQ ID NO: 40131 - DNA, 25 bp, Homo sapien
cacatttttagaatcacttaacttc

SEQ ID NO: 40132 - DNA, 25 bp, Homo sapien
cacatttttagacgatattgcattt

SEQ ID NO: 40133 - DNA, 25 bp, Homo sapien
cacatttttagatgatattgcattt

SEQ ID NO: 40134 - DNA, 25 bp, Homo sapien
cacatttttcacatttgattttgcc

SEQ ID NO: 40135 - DNA, 25 bp, Homo sapien
cacatttttcagatttgattttgcc

SEQ ID NO: 40136 - DNA, 25 bp, Homo sapien
cacattttttccgacctcaaacctt

SEQ ID NO: 40137 - DNA, 25 bp, Homo sapien
cacattttttctgacctcaaacctt

SEQ ID NO: 40138 - DNA, 25 bp, Homo sapien
cacattttttgaatcacttaacttc

SEQ ID NO: 40139 - DNA, 25 bp, Homo sapien
caccaaaaaaaaagtggatgtgtgg

SEQ ID NO: 40140 - DNA, 25 bp, Homo sapien
caccaaaaaaaatgtggatgtgtgg

SEQ ID NO: 40141 - DNA, 25 bp, Homo sapien
caccaaaaacgaaacaacccagtgt

SEQ ID NO: 40142 - DNA, 25 bp, Homo sapien
caccaaaaacgaaacagcccagtgt

SEQ ID NO: 40143 - DNA, 25 bp, Homo sapien
caccaaacatactaaatgaggtacc

SEQ ID NO: 40144 - DNA, 25 bp, Homo sapien
caccaaacctgatcgcaggctcgtg

SEQ ID NO: 40145 - DNA, 25 bp, Homo sapien
caccaaacctgatctcaggctcgtg

SEQ ID NO: 40146 - DNA, 25 bp, Homo sapien
caccaaacgtactaaatgaggtacc

SEQ ID NO: 40147 - DNA, 25 bp, Homo sapien
caccaaagaaagaaaaaatcttaaa

SEQ ID NO: 40148 - DNA, 25 bp, Homo sapien
caccaaagaaagagaaaatcttaaa

SEQ ID NO: 40149 - DNA, 25 bp, Homo sapien
caccaaagagcagatagaaataggt

SEQ ID NO: 40150 - DNA, 25 bp, Homo sapien
caccaaagagcatatagaaataggt

SEQ ID NO: 40151 - DNA, 25 bp, Homo sapien
caccaaaggatttaaatgtatagat

SEQ ID NO: 40152 - DNA, 25 bp, Homo sapien
caccaaaggcgacataaggcactag

SEQ ID NO: 40153 - DNA, 25 bp, Homo sapien
caccaaaggcggcataaggcactag

SEQ ID NO: 40154 - DNA, 25 bp, Homo sapien
caccaaaggttttaaatgtatagat

SEQ ID NO: 40155 - DNA, 25 bp, Homo sapien
caccaaagtatcatcctagttttgt

SEQ ID NO: 40156 - DNA, 25 bp, Homo sapien
caccaaagtgtcatcctagttttgt

SEQ ID NO: 40157 - DNA, 25 bp, Homo sapien
caccaaatcatgagttccttgagtg

SEQ ID NO: 40158 - DNA, 25 bp, Homo sapien
caccaaatcatgagtttcttgagtg

SEQ ID NO: 40159 - DNA, 25 bp, Homo sapien
caccaaatcctaacagcagaacttt

SEQ ID NO: 40160 - DNA, 25 bp, Homo sapien
caccaaatcctagcagcagaacttt

SEQ ID NO: 40161 - DNA, 25 bp, Homo sapien
caccaacaacaataaatcaggagca

SEQ ID NO: 40162 - DNA, 25 bp, Homo sapien
caccaacaataataaatcaggagca

SEQ ID NO: 40163 - DNA, 25 bp, Homo sapien
caccaacattctgaacagtaccatt

SEQ ID NO: 40164 - DNA, 25 bp, Homo sapien
caccaacattctgaaccgtaccatt

SEQ ID NO: 40165 - DNA, 25 bp, Homo sapien
caccaaccacatttaggaagcgtca

SEQ ID NO: 40166 - DNA, 25 bp, Homo sapien
caccaaccacatttgggaagcgtca

SEQ ID NO: 40167 - DNA, 25 bp, Homo sapien
caccaaccaggccaaaataaacagc

SEQ ID NO: 40168 - DNA, 25 bp, Homo sapien
caccaaccaggtcaaaataaacagc

SEQ ID NO: 40169 - DNA, 25 bp, Homo sapien
caccaactccctagattatgttgag

SEQ ID NO: 40170 - DNA, 25 bp, Homo sapien
caccaactccctggattatgttgag

SEQ ID NO: 40171 - DNA, 25 bp, Homo sapien
caccaagaacacgcttccttgtagc

SEQ ID NO: 40172 - DNA, 25 bp, Homo sapien
caccaagaacatgcttccttgtagc

SEQ ID NO: 40173 - DNA, 25 bp, Homo sapien
caccaagaacgaaagggacgatatt

SEQ ID NO: 40174 - DNA, 25 bp, Homo sapien
caccaagaatgaaagggacgatatt

SEQ ID NO: 40175 - DNA, 25 bp, Homo sapien
caccaagcacctctatgaatggagg

SEQ ID NO: 40176 - DNA, 25 bp, Homo sapien
caccaagcgcctctatgaatggagg

SEQ ID NO: 40177 - DNA, 25 bp, Homo sapien
caccaagtaattgcagcaatgccac

SEQ ID NO: 40178 - DNA, 25 bp, Homo sapien
caccaagtaattgcggcaatgccac

SEQ ID NO: 40179 - DNA, 25 bp, Homo sapien
caccaagtggagaaattgaagatcc

SEQ ID NO: 40180 - DNA, 25 bp, Homo sapien
caccaagtggaggaattgaagatcc

SEQ ID NO: 40181 - DNA, 25 bp, Homo sapien
caccaagtttctcctaaaaacacag

SEQ ID NO: 40182 - DNA, 25 bp, Homo sapien
caccaagtttctcttaaaaacacag

SEQ ID NO: 40183 - DNA, 25 bp, Homo sapien
caccaatcaagagggacatgagaat

SEQ ID NO: 40184 - DNA, 25 bp, Homo sapien
caccaatcaagaggtacatgagaat

SEQ ID NO: 40185 - DNA, 25 bp, Homo sapien
caccaatcacaggagtctatcacag

SEQ ID NO: 40186 - DNA, 25 bp, Homo sapien
caccaatcacaggagtttatcacag

SEQ ID NO: 40187 - DNA, 25 bp, Homo sapien
caccaatcagatcatgtatgtgtta

SEQ ID NO: 40188 - DNA, 25 bp, Homo sapien
caccaatcagattatgtatgtgtta

SEQ ID NO: 40189 - DNA, 25 bp, Homo sapien
caccaatcatgttatacctgggcat

SEQ ID NO: 40190 - DNA, 25 bp, Homo sapien
caccaatcgtgttatacctgggcat

SEQ ID NO: 40191 - DNA, 25 bp, Homo sapien
caccaatggttgccagcatacactg

SEQ ID NO: 40192 - DNA, 25 bp, Homo sapien
caccaatggttgtcagcatacactg

SEQ ID NO: 40193 - DNA, 25 bp, Homo sapien
caccaatgtggagttgaattctgac

SEQ ID NO: 40194 - DNA, 25 bp, Homo sapien
caccaatgtggggttgaattctgac

SEQ ID NO: 40195 - DNA, 25 bp, Homo sapien
caccacaagaaagatcactgaaggt

SEQ ID NO: 40196 - DNA, 25 bp, Homo sapien
caccacaaggaagatcactgaaggt

SEQ ID NO: 40197 - DNA, 25 bp, Homo sapien
caccacaatcgattttatattttca

SEQ ID NO: 40198 - DNA, 25 bp, Homo sapien
caccacaattgattttatattttca

SEQ ID NO: 40199 - DNA, 25 bp, Homo sapien
caccacagagaatatcagttctgga

SEQ ID NO: 40200 - DNA, 25 bp, Homo sapien
caccacagagactatcagttctgga

SEQ ID NO: 40201 - DNA, 25 bp, Homo sapien
caccacagatgccagagccttaatc

SEQ ID NO: 40202 - DNA, 25 bp, Homo sapien
caccacagattcctataaacaccaa

SEQ ID NO: 40203 - DNA, 25 bp, Homo sapien
caccacagattcttataaacaccaa

SEQ ID NO: 40204 - DNA, 25 bp, Homo sapien
caccacagctgccagagccttaatc

SEQ ID NO: 40205 - DNA, 25 bp, Homo sapien
caccacataccaggatgttttgggt

SEQ ID NO: 40206 - DNA, 25 bp, Homo sapien
caccacataccgggatgttttgggt

SEQ ID NO: 40207 - DNA, 25 bp, Homo sapien
caccacatacttttatcttttactt

SEQ ID NO: 40208 - DNA, 25 bp, Homo sapien
caccacatacttttgtcttttactt

SEQ ID NO: 40209 - DNA, 25 bp, Homo sapien
caccacatgagctctggcggaatac

SEQ ID NO: 40210 - DNA, 25 bp, Homo sapien
caccacatgaggtctggcggaatac

SEQ ID NO: 40211 - DNA, 25 bp, Homo sapien
caccaccacaaaccgaaagctatgg

SEQ ID NO: 40212 - DNA, 25 bp, Homo sapien
caccaccacaaactgaaagctatgg

SEQ ID NO: 40213 - DNA, 25 bp, Homo sapien
caccaccacagagaatatcagttct

SEQ ID NO: 40214 - DNA, 25 bp, Homo sapien
caccaccacagagactatcagttct

SEQ ID NO: 40215 - DNA, 25 bp, Homo sapien
caccaccattatgattatgccaggt

SEQ ID NO: 40216 - DNA, 25 bp, Homo sapien
caccaccattatgattgtgccaggt

SEQ ID NO: 40217 - DNA, 25 bp, Homo sapien
caccactatgccgtgctaatttttt

SEQ ID NO: 40218 - DNA, 25 bp, Homo sapien
caccactatgccttgctaatttttt

SEQ ID NO: 40219 - DNA, 25 bp, Homo sapien
caccactctcgtaaaagtattcctg

SEQ ID NO: 40220 - DNA, 25 bp, Homo sapien
caccactcttgtaaaagtattcctg

SEQ ID NO: 40221 - DNA, 25 bp, Homo sapien
caccactggcttaagaaactcccgg

SEQ ID NO: 40222 - DNA, 25 bp, Homo sapien
caccactggcttaggaaactcccgg

SEQ ID NO: 40223 - DNA, 25 bp, Homo sapien
caccacttcattccagcttgagtga

SEQ ID NO: 40224 - DNA, 25 bp, Homo sapien
caccacttcattccggcttgagtga

SEQ ID NO: 40225 - DNA, 25 bp, Homo sapien
caccacttcccaacaggatcagacc

SEQ ID NO: 40226 - DNA, 25 bp, Homo sapien
caccacttcccaataggatcagacc

SEQ ID NO: 40227 - DNA, 25 bp, Homo sapien
caccactttctctcttacctcttgt

SEQ ID NO: 40228 - DNA, 25 bp, Homo sapien
caccactttctttcttacctcttgt

SEQ ID NO: 40229 - DNA, 25 bp, Homo sapien
caccacttttaaataacagcaatat

SEQ ID NO: 40230 - DNA, 25 bp, Homo sapien
caccacttttaagtaacagcaatat

SEQ ID NO: 40231 - DNA, 25 bp, Homo sapien
caccagacagtatacctgagtcact

SEQ ID NO: 40232 - DNA, 25 bp, Homo sapien
caccagacagtgtacctgagtcact

SEQ ID NO: 40233 - DNA, 25 bp, Homo sapien
caccagacatgtgaggaaatctaac

SEQ ID NO: 40234 - DNA, 25 bp, Homo sapien
caccagacgtgtgaggaaatctaac

SEQ ID NO: 40235 - DNA, 25 bp, Homo sapien
caccagactcttccttgggtgacag

SEQ ID NO: 40236 - DNA, 25 bp, Homo sapien
caccagactctttcttgggtgacag

SEQ ID NO: 40237 - DNA, 25 bp, Homo sapien
caccagagcaggatgagctgaaagc

SEQ ID NO: 40238 - DNA, 25 bp, Homo sapien
caccagagtaggatgagctgaaagc

SEQ ID NO: 40239 - DNA, 25 bp, Homo sapien
caccagataagctatgctaacaatg

SEQ ID NO: 40240 - DNA, 25 bp, Homo sapien
caccagataggctatgctaacaatg

SEQ ID NO: 40241 - DNA, 25 bp, Homo sapien
caccagatccaaaatgccatagaaa

SEQ ID NO: 40242 - DNA, 25 bp, Homo sapien
caccagatccaaagtgccatagaaa

SEQ ID NO: 40243 - DNA, 25 bp, Homo sapien
caccagcagaacgaagaaaaaatag

SEQ ID NO: 40244 - DNA, 25 bp, Homo sapien
caccagcagaatgaagaaaaaatag

SEQ ID NO: 40245 - DNA, 25 bp, Homo sapien
caccagctgggaagaagatgacccc

SEQ ID NO: 40246 - DNA, 25 bp, Homo sapien
caccagctgggaggaagatgacccc

SEQ ID NO: 40247 - DNA, 25 bp, Homo sapien
caccagcttaggcggctatagagtg

SEQ ID NO: 40248 - DNA, 25 bp, Homo sapien
caccagcttaggtggctatagagtg

SEQ ID NO: 40249 - DNA, 25 bp, Homo sapien
caccagcttgtgagtacaaataaaa

SEQ ID NO: 40250 - DNA, 25 bp, Homo sapien
caccagcttgtgagtataaataaaa

SEQ ID NO: 40251 - DNA, 25 bp, Homo sapien
caccaggctttacctgtatcactcg

SEQ ID NO: 40252 - DNA, 25 bp, Homo sapien
caccaggctttatctgtatcactcg

SEQ ID NO: 40253 - DNA, 25 bp, Homo sapien
caccagggataccaacaggaacaag

SEQ ID NO: 40254 - DNA, 25 bp, Homo sapien
caccagggataccaccaggaacaag

SEQ ID NO: 40255 - DNA, 25 bp, Homo sapien
caccaggtactatgctatatcttat

SEQ ID NO: 40256 - DNA, 25 bp, Homo sapien
caccaggtactatgctgtatcttat

SEQ ID NO: 40257 - DNA, 25 bp, Homo sapien
caccagtaatatctaaactatgcat

SEQ ID NO: 40258 - DNA, 25 bp, Homo sapien
caccagtaatatttaaactatgcat

SEQ ID NO: 40259 - DNA, 25 bp, Homo sapien
caccagtagaaattcctccttatca

SEQ ID NO: 40260 - DNA, 25 bp, Homo sapien
caccagtagaatttcctccttatca

SEQ ID NO: 40261 - DNA, 25 bp, Homo sapien
caccagtcaggaacggatggtactt

SEQ ID NO: 40262 - DNA, 25 bp, Homo sapien
caccagtcaggaatggatggtactt

SEQ ID NO: 40263 - DNA, 25 bp, Homo sapien
caccataaaaaatctaccagttagt

SEQ ID NO: 40264 - DNA, 25 bp, Homo sapien
caccataaaaaatttaccagttagt

SEQ ID NO: 40265 - DNA, 25 bp, Homo sapien
caccataaaatgatacattctatgg

SEQ ID NO: 40266 - DNA, 25 bp, Homo sapien
caccataactggcactatttctgag

SEQ ID NO: 40267 - DNA, 25 bp, Homo sapien
caccataactggcactgtttctgag

SEQ ID NO: 40268 - DNA, 25 bp, Homo sapien
caccataagatgatacattctatgg

SEQ ID NO: 40269 - DNA, 25 bp, Homo sapien
caccatacaaggagaagttccttga

SEQ ID NO: 40270 - DNA, 25 bp, Homo sapien
caccatacgaggagaagttccttga

SEQ ID NO: 40271 - DNA, 25 bp, Homo sapien
caccatactgtaagcaaaattccac

SEQ ID NO: 40272 - DNA, 25 bp, Homo sapien
caccatactgtaagcagaattccac

SEQ ID NO: 40273 - DNA, 25 bp, Homo sapien
caccatacttcctcctattctctta

SEQ ID NO: 40274 - DNA, 25 bp, Homo sapien
caccatacttcctcttattctctta

SEQ ID NO: 40275 - DNA, 25 bp, Homo sapien
caccatcaatgcagtcgaggtgtgc

SEQ ID NO: 40276 - DNA, 25 bp, Homo sapien
caccatcagtgataacattgaaagt

SEQ ID NO: 40277 - DNA, 25 bp, Homo sapien
caccatcagtgataacgttgaaagt

SEQ ID NO: 40278 - DNA, 25 bp, Homo sapien
caccatcagtgcagtcgaggtgtgc

SEQ ID NO: 40279 - DNA, 25 bp, Homo sapien
caccatcatccatacagagagggca

SEQ ID NO: 40280 - DNA, 25 bp, Homo sapien
caccatcattcatacagagagggca

SEQ ID NO: 40281 - DNA, 25 bp, Homo sapien
caccatccttgaaatcctgtgctca

SEQ ID NO: 40282 - DNA, 25 bp, Homo sapien
caccatccttgaaatcgtgtgctca

SEQ ID NO: 40283 - DNA, 25 bp, Homo sapien
caccatcgagagcactaacgagaat

SEQ ID NO: 40284 - DNA, 25 bp, Homo sapien
caccatcgagagtactaacgagaat

SEQ ID NO: 40285 - DNA, 25 bp, Homo sapien
caccatctcggttagctgtgggacc

SEQ ID NO: 40286 - DNA, 25 bp, Homo sapien
caccatcttggttagctgtgggacc

SEQ ID NO: 40287 - DNA, 25 bp, Homo sapien
caccatgaacgtaatgaatcttcct

SEQ ID NO: 40288 - DNA, 25 bp, Homo sapien
caccatgaatgtaatgaatcttcct

SEQ ID NO: 40289 - DNA, 25 bp, Homo sapien
caccatgcaatagaaaagatttgag

SEQ ID NO: 40290 - DNA, 25 bp, Homo sapien
caccatgcattagaaaagatttgag

SEQ ID NO: 40291 - DNA, 25 bp, Homo sapien
caccatgccagcctaaggtttgtag

SEQ ID NO: 40292 - DNA, 25 bp, Homo sapien
caccatgccaggctaaggtttgtag

SEQ ID NO: 40293 - DNA, 25 bp, Homo sapien
caccatgcttggctaacttttgtat

SEQ ID NO: 40294 - DNA, 25 bp, Homo sapien
caccatgcttgggtaacttttgtat

SEQ ID NO: 40295 - DNA, 25 bp, Homo sapien
caccattatagcttgattatttgtt

SEQ ID NO: 40296 - DNA, 25 bp, Homo sapien
caccattataggttgattatttgtt

SEQ ID NO: 40297 - DNA, 25 bp, Homo sapien
caccattatgattatgccaggttac

SEQ ID NO: 40298 - DNA, 25 bp, Homo sapien
caccattatgattgtgccaggttac

SEQ ID NO: 40299 - DNA, 25 bp, Homo sapien
caccattccatagaacaatagtaaa

SEQ ID NO: 40300 - DNA, 25 bp, Homo sapien
caccattcgatagaacaatagtaaa

SEQ ID NO: 40301 - DNA, 25 bp, Homo sapien
caccattgagtgaattcattaccca

SEQ ID NO: 40302 - DNA, 25 bp, Homo sapien
caccattgagtgaattgattaccca

SEQ ID NO: 40303 - DNA, 25 bp, Homo sapien
caccattgtcaaaggtagtatgagc

SEQ ID NO: 40304 - DNA, 25 bp, Homo sapien
caccattgtcaaaggtggtatgagc

SEQ ID NO: 40305 - DNA, 25 bp, Homo sapien
caccatttaatctttaaaacaagca

SEQ ID NO: 40306 - DNA, 25 bp, Homo sapien
caccatttgatctttaaaacaagca

SEQ ID NO: 40307 - DNA, 25 bp, Homo sapien
cacccaaacagccagttgttagtac

SEQ ID NO: 40308 - DNA, 25 bp, Homo sapien
cacccaaatagccagttgttagtac

SEQ ID NO: 40309 - DNA, 25 bp, Homo sapien
cacccaaccttcgttctggtcacac

SEQ ID NO: 40310 - DNA, 25 bp, Homo sapien
cacccaacctttgttctggtcacac

SEQ ID NO: 40311 - DNA, 25 bp, Homo sapien
cacccaagggacataaactgaggac

SEQ ID NO: 40312 - DNA, 25 bp, Homo sapien
cacccaagggagataaactgaggac

SEQ ID NO: 40313 - DNA, 25 bp, Homo sapien
cacccacaaatagaaacacctacat

SEQ ID NO: 40314 - DNA, 25 bp, Homo sapien
cacccacaaatagaaagacctacat

SEQ ID NO: 40315 - DNA, 25 bp, Homo sapien
cacccacaaccacattttcctgctc

SEQ ID NO: 40316 - DNA, 25 bp, Homo sapien
cacccacaaccaccttttcctgctc

SEQ ID NO: 40317 - DNA, 25 bp, Homo sapien
cacccacaagcagcatgagggcagg

SEQ ID NO: 40318 - DNA, 25 bp, Homo sapien
cacccacaagcggcatgagggcagg

SEQ ID NO: 40319 - DNA, 25 bp, Homo sapien
cacccagatcttcaccggactggct

SEQ ID NO: 40320 - DNA, 25 bp, Homo sapien
cacccagatcttcacctgactggct

SEQ ID NO: 40321 - DNA, 25 bp, Homo sapien
cacccagtaccgactgatgaagtgg

SEQ ID NO: 40322 - DNA, 25 bp, Homo sapien
cacccagtaccggctgatgaagtgg

SEQ ID NO: 40323 - DNA, 25 bp, Homo sapien
cacccagtgggtcacgatgtttatc

SEQ ID NO: 40324 - DNA, 25 bp, Homo sapien
cacccagtgggtcaggatgtttatc

SEQ ID NO: 40325 - DNA, 25 bp, Homo sapien
cacccatcagacggagagttggtct

SEQ ID NO: 40326 - DNA, 25 bp, Homo sapien
cacccatcagatggagagttggtct

SEQ ID NO: 40327 - DNA, 25 bp, Homo sapien
cacccatcctcagagctccaggttc

SEQ ID NO: 40328 - DNA, 25 bp, Homo sapien
cacccatcttcagagctccaggttc

SEQ ID NO: 40329 - DNA, 25 bp, Homo sapien
cacccatggaaagttatggaatctt

SEQ ID NO: 40330 - DNA, 25 bp, Homo sapien
cacccatgggaagttatggaatctt

SEQ ID NO: 40331 - DNA, 25 bp, Homo sapien
cacccattcacacttgtactttttt

SEQ ID NO: 40332 - DNA, 25 bp, Homo sapien
cacccattcacgcttgtactttttt

SEQ ID NO: 40333 - DNA, 25 bp, Homo sapien
cacccattgcctccttactcaagca

SEQ ID NO: 40334 - DNA, 25 bp, Homo sapien
cacccatttcctccttactcaagca

SEQ ID NO: 40335 - DNA, 25 bp, Homo sapien
cacccccaacacacacaaaacatga

SEQ ID NO: 40336 - DNA, 25 bp, Homo sapien
cacccccaacacacacgaaacatga

SEQ ID NO: 40337 - DNA, 25 bp, Homo sapien
caccccctactcagccaatgtggta

SEQ ID NO: 40338 - DNA, 25 bp, Homo sapien
caccccctactcagccgatgtggta

SEQ ID NO: 40339 - DNA, 25 bp, Homo sapien
caccccgagtcctgccattactact

SEQ ID NO: 40340 - DNA, 25 bp, Homo sapien
caccccgagtcttgccattactact

SEQ ID NO: 40341 - DNA, 25 bp, Homo sapien
cacccctcttttcctacttcctcta

SEQ ID NO: 40342 - DNA, 25 bp, Homo sapien
cacccctcttttcctatttcctcta

SEQ ID NO: 40343 - DNA, 25 bp, Homo sapien
cacccgaatttcacatcccaggaaa

SEQ ID NO: 40344 - DNA, 25 bp, Homo sapien
cacccgaatttcatatcccaggaaa

SEQ ID NO: 40345 - DNA, 25 bp, Homo sapien
cacccgatatcaaagaatccaaaat

SEQ ID NO: 40346 - DNA, 25 bp, Homo sapien
cacccgatatcaaataatccaaaat

SEQ ID NO: 40347 - DNA, 25 bp, Homo sapien
cacccgtttatacttggtgtcccac

SEQ ID NO: 40348 - DNA, 25 bp, Homo sapien
cacccgtttttacttggtgtcccac

SEQ ID NO: 40349 - DNA, 25 bp, Homo sapien
caccctagaggccactgtacttttt

SEQ ID NO: 40350 - DNA, 25 bp, Homo sapien
caccctagaggccgctgtacttttt

SEQ ID NO: 40351 - DNA, 25 bp, Homo sapien
caccctataccaaagctctctcccc

SEQ ID NO: 40352 - DNA, 25 bp, Homo sapien
caccctatcctagtatgacttcacc

SEQ ID NO: 40353 - DNA, 25 bp, Homo sapien
caccctatcttagtatgacttcacc

SEQ ID NO: 40354 - DNA, 25 bp, Homo sapien
caccctattccaaagctctctcccc

SEQ ID NO: 40355 - DNA, 25 bp, Homo sapien
caccctcacttctgtggctactgtt

SEQ ID NO: 40356 - DNA, 25 bp, Homo sapien
caccctcacttgtgtggctactgtt

SEQ ID NO: 40357 - DNA, 25 bp, Homo sapien
caccctccaaacgtaaccctctatc

SEQ ID NO: 40358 - DNA, 25 bp, Homo sapien
caccctccaaatgtaaccctctatc

SEQ ID NO: 40359 - DNA, 25 bp, Homo sapien
caccctccacaacaatttctttttt

SEQ ID NO: 40360 - DNA, 25 bp, Homo sapien
caccctccacaaccatttctttttt

SEQ ID NO: 40361 - DNA, 25 bp, Homo sapien
caccctgagagcattttgagtgggt

SEQ ID NO: 40362 - DNA, 25 bp, Homo sapien
caccctgagtgcattttgagtgggt

SEQ ID NO: 40363 - DNA, 25 bp, Homo sapien
caccctggagtacttcaacatttag

SEQ ID NO: 40364 - DNA, 25 bp, Homo sapien
caccctggagtgcttcaacatttag

SEQ ID NO: 40365 - DNA, 25 bp, Homo sapien
cacccttacttacggcacagaatta

SEQ ID NO: 40366 - DNA, 25 bp, Homo sapien
cacccttacttatggcacagaatta

SEQ ID NO: 40367 - DNA, 25 bp, Homo sapien
cacccttgaacctggtttcttcggt

SEQ ID NO: 40368 - DNA, 25 bp, Homo sapien
cacccttgagcctggtttcttcggt

SEQ ID NO: 40369 - DNA, 25 bp, Homo sapien
cacccttgtataatctatccataag

SEQ ID NO: 40370 - DNA, 25 bp, Homo sapien
cacccttgtataatctctccataag

SEQ ID NO: 40371 - DNA, 25 bp, Homo sapien
caccgaatgttgacaacgatgctga

SEQ ID NO: 40372 - DNA, 25 bp, Homo sapien
caccgaatgttgacaaggatgctga

SEQ ID NO: 40373 - DNA, 25 bp, Homo sapien
caccgagttggtggtgatttgttac

SEQ ID NO: 40374 - DNA, 25 bp, Homo sapien
caccgagtttgtggtgatttgttac

SEQ ID NO: 40375 - DNA, 25 bp, Homo sapien
caccgtggacccttcatgttaatcc

SEQ ID NO: 40376 - DNA, 25 bp, Homo sapien
caccgtggacctttcatgttaatcc

SEQ ID NO: 40377 - DNA, 25 bp, Homo sapien
caccgttgaacacagactcagctca

SEQ ID NO: 40378 - DNA, 25 bp, Homo sapien
caccgttgaacacagattcagctca

SEQ ID NO: 40379 - DNA, 25 bp, Homo sapien
cacctaaacattcaaaaccaagatg

SEQ ID NO: 40380 - DNA, 25 bp, Homo sapien
cacctaaacattcaaagccaagatg

SEQ ID NO: 40381 - DNA, 25 bp, Homo sapien
cacctaaagcccaaaccaaaaaatc

SEQ ID NO: 40382 - DNA, 25 bp, Homo sapien
cacctaaagcccaacccaaaaaatc

SEQ ID NO: 40383 - DNA, 25 bp, Homo sapien
cacctaaagttcaatttaagattcc

SEQ ID NO: 40384 - DNA, 25 bp, Homo sapien
cacctaaagttctatttaagattcc

SEQ ID NO: 40385 - DNA, 25 bp, Homo sapien
cacctaactaaatagcctttcatct

SEQ ID NO: 40386 - DNA, 25 bp, Homo sapien
cacctaactaaatagcttttcatct

SEQ ID NO: 40387 - DNA, 25 bp, Homo sapien
cacctaattctcgtcaggccagtca

SEQ ID NO: 40388 - DNA, 25 bp, Homo sapien
cacctaattcttgtcaggccagtca

SEQ ID NO: 40389 - DNA, 25 bp, Homo sapien
cacctacaaaatgtagataattatc

SEQ ID NO: 40390 - DNA, 25 bp, Homo sapien
cacctacaacttatagaaactcatc

SEQ ID NO: 40391 - DNA, 25 bp, Homo sapien
cacctacaagatgtagataattatc

SEQ ID NO: 40392 - DNA, 25 bp, Homo sapien
cacctacatcttatagaaactcatc

SEQ ID NO: 40393 - DNA, 25 bp, Homo sapien
cacctacgctaagtcaacttgtgca

SEQ ID NO: 40394 - DNA, 25 bp, Homo sapien
cacctacgctaagtcatcttgtgca

SEQ ID NO: 40395 - DNA, 25 bp, Homo sapien
cacctactatgagtcacgagccagg

SEQ ID NO: 40396 - DNA, 25 bp, Homo sapien
cacctactgtgagtcacgagccagg

SEQ ID NO: 40397 - DNA, 25 bp, Homo sapien
cacctagaaaaacgggacactctgg

SEQ ID NO: 40398 - DNA, 25 bp, Homo sapien
cacctagaaaaatgggacactctgg

SEQ ID NO: 40399 - DNA, 25 bp, Homo sapien
cacctagaatccacagtttacaacg

SEQ ID NO: 40400 - DNA, 25 bp, Homo sapien
cacctagaatccatagtttacaacg

SEQ ID NO: 40401 - DNA, 25 bp, Homo sapien
cacctagtgtgtccagtagaaacac

SEQ ID NO: 40402 - DNA, 25 bp, Homo sapien
cacctagtgtgtgcagtagaaacac

SEQ ID NO: 40403 - DNA, 25 bp, Homo sapien
cacctataggaactagaaaatcaag

SEQ ID NO: 40404 - DNA, 25 bp, Homo sapien
cacctataggagctagaaaatcaag

SEQ ID NO: 40405 - DNA, 25 bp, Homo sapien
cacctatatcatccagacaattcta

SEQ ID NO: 40406 - DNA, 25 bp, Homo sapien
cacctatattatccagacaattcta

SEQ ID NO: 40407 - DNA, 25 bp, Homo sapien
cacctatatttcgaaggtgacacat

SEQ ID NO: 40408 - DNA, 25 bp, Homo sapien
cacctatattttgaaggtgacacat

SEQ ID NO: 40409 - DNA, 25 bp, Homo sapien
cacctatcaaggggacaatgatggc

SEQ ID NO: 40410 - DNA, 25 bp, Homo sapien
cacctatcacggggacaatgatggc

SEQ ID NO: 40411 - DNA, 25 bp, Homo sapien
cacctattcaaaaggcgaatccgat

SEQ ID NO: 40412 - DNA, 25 bp, Homo sapien
cacctattcgaaaggcgaatccgat

SEQ ID NO: 40413 - DNA, 25 bp, Homo sapien
cacctattttacaggtggctgaata

SEQ ID NO: 40414 - DNA, 25 bp, Homo sapien
cacctattttagaggtggctgaata

SEQ ID NO: 40415 - DNA, 25 bp, Homo sapien
cacctcaaaggcctatttcaggaca

SEQ ID NO: 40416 - DNA, 25 bp, Homo sapien
cacctcaaatgcctatttcaggaca

SEQ ID NO: 40417 - DNA, 25 bp, Homo sapien
cacctcaccatgttagagaaaagaa

SEQ ID NO: 40418 - DNA, 25 bp, Homo sapien
cacctcaccgtgttagagaaaagaa

SEQ ID NO: 40419 - DNA, 25 bp, Homo sapien
cacctcagagccttcccgagcaggt

SEQ ID NO: 40420 - DNA, 25 bp, Homo sapien
cacctcagagccttcctgagcaggt

SEQ ID NO: 40421 - DNA, 25 bp, Homo sapien
cacctcaggatccaattactcccat

SEQ ID NO: 40422 - DNA, 25 bp, Homo sapien
cacctcaggatcgaattactcccat

SEQ ID NO: 40423 - DNA, 25 bp, Homo sapien
cacctcagtattatgtgtatgaagt

SEQ ID NO: 40424 - DNA, 25 bp, Homo sapien
cacctcagtgccgagtaaagtgtga

SEQ ID NO: 40425 - DNA, 25 bp, Homo sapien
cacctcagtgccgagtgaagtgtga

SEQ ID NO: 40426 - DNA, 25 bp, Homo sapien
cacctcagtgttatgtgtatgaagt

SEQ ID NO: 40427 - DNA, 25 bp, Homo sapien
cacctccaacagttttgctccactg

SEQ ID NO: 40428 - DNA, 25 bp, Homo sapien
cacctccaacttatatcaaccccat

SEQ ID NO: 40429 - DNA, 25 bp, Homo sapien
cacctccaacttgtatcaaccccat

SEQ ID NO: 40430 - DNA, 25 bp, Homo sapien
cacctccaatagttttgctccactg

SEQ ID NO: 40431 - DNA, 25 bp, Homo sapien
cacctccacggttagaggcattcct

SEQ ID NO: 40432 - DNA, 25 bp, Homo sapien
cacctccacggttagatgcattcct

SEQ ID NO: 40433 - DNA, 25 bp, Homo sapien
cacctccctttgtatctcactctgc

SEQ ID NO: 40434 - DNA, 25 bp, Homo sapien
cacctccctttgtctctcactctgc

SEQ ID NO: 40435 - DNA, 25 bp, Homo sapien
cacctcctctttgtaatgctttcac

SEQ ID NO: 40436 - DNA, 25 bp, Homo sapien
cacctcctttttgtaatgctttcac

SEQ ID NO: 40437 - DNA, 25 bp, Homo sapien
cacctctagagtaagatgtgatggt

SEQ ID NO: 40438 - DNA, 25 bp, Homo sapien
cacctctagagtcagatgtgatggt

SEQ ID NO: 40439 - DNA, 25 bp, Homo sapien
cacctctgaattacttgtaatacct

SEQ ID NO: 40440 - DNA, 25 bp, Homo sapien
cacctctgagttacttgtaatacct

SEQ ID NO: 40441 - DNA, 25 bp, Homo sapien
cacctcttcaccttccacaaattat

SEQ ID NO: 40442 - DNA, 25 bp, Homo sapien
cacctcttgaccttccacaaattat

SEQ ID NO: 40443 - DNA, 25 bp, Homo sapien
cacctcttgatgagagaagctgtaa

SEQ ID NO: 40444 - DNA, 25 bp, Homo sapien
cacctcttgatgggagaagctgtaa

SEQ ID NO: 40445 - DNA, 25 bp, Homo sapien
cacctgaaagagctaagagttacct

SEQ ID NO: 40446 - DNA, 25 bp, Homo sapien
cacctgaaagagctaatagttacct

SEQ ID NO: 40447 - DNA, 25 bp, Homo sapien
cacctgaataaaggatccaaaaacc

SEQ ID NO: 40448 - DNA, 25 bp, Homo sapien
cacctgaataaagggtccaaaaacc

SEQ ID NO: 40449 - DNA, 25 bp, Homo sapien
cacctgaatggcatggctttccatc

SEQ ID NO: 40450 - DNA, 25 bp, Homo sapien
cacctgaatggcgtggctttccatc

SEQ ID NO: 40451 - DNA, 25 bp, Homo sapien
cacctgatctagcacctgggtctta

SEQ ID NO: 40452 - DNA, 25 bp, Homo sapien
cacctgatgtcagcatgtctcagag

SEQ ID NO: 40453 - DNA, 25 bp, Homo sapien
cacctgatgtccgcatgtctcagag

SEQ ID NO: 40454 - DNA, 25 bp, Homo sapien
cacctgattcctaccaccttccagt

SEQ ID NO: 40455 - DNA, 25 bp, Homo sapien
cacctgattcctacgaccttccagt

SEQ ID NO: 40456 - DNA, 25 bp, Homo sapien
cacctgatttagcacctgggtctta

SEQ ID NO: 40457 - DNA, 25 bp, Homo sapien
cacctgcacagtcggcagtctgtgt

SEQ ID NO: 40458 - DNA, 25 bp, Homo sapien
cacctgcacagttggcagtctgtgt

SEQ ID NO: 40459 - DNA, 25 bp, Homo sapien
cacctgccaactctatgatgttaaa

SEQ ID NO: 40460 - DNA, 25 bp, Homo sapien
cacctgccaactctgtgatgttaaa

SEQ ID NO: 40461 - DNA, 25 bp, Homo sapien
cacctgccttgctagctgcatttct

SEQ ID NO: 40462 - DNA, 25 bp, Homo sapien
cacctgccttgttagctgcatttct

SEQ ID NO: 40463 - DNA, 25 bp, Homo sapien
cacctgctaacagtacccatggtaa

SEQ ID NO: 40464 - DNA, 25 bp, Homo sapien
cacctgctaacattacccatggtaa

SEQ ID NO: 40465 - DNA, 25 bp, Homo sapien
cacctggaacttccaaactcagccc

SEQ ID NO: 40466 - DNA, 25 bp, Homo sapien
cacctggagcttccaaactcagccc

SEQ ID NO: 40467 - DNA, 25 bp, Homo sapien
cacctggatcatcgcaataactgtc

SEQ ID NO: 40468 - DNA, 25 bp, Homo sapien
cacctggatcattgcaataactgtc

SEQ ID NO: 40469 - DNA, 25 bp, Homo sapien
cacctggcttctaattcacccacac

SEQ ID NO: 40470 - DNA, 25 bp, Homo sapien
cacctggcttctagttcacccacac

SEQ ID NO: 40471 - DNA, 25 bp, Homo sapien
cacctggtttagtccacgaactccg

SEQ ID NO: 40472 - DNA, 25 bp, Homo sapien
cacctggtttagtccatgaactccg

SEQ ID NO: 40473 - DNA, 25 bp, Homo sapien
cacctgtcgataacatttgcattgt

SEQ ID NO: 40474 - DNA, 25 bp, Homo sapien
cacctgtcgatagcatttgcattgt

SEQ ID NO: 40475 - DNA, 25 bp, Homo sapien
cacctgtgcttcaccacatcttgac

SEQ ID NO: 40476 - DNA, 25 bp, Homo sapien
cacctgtgcttcaccatatcttgac

SEQ ID NO: 40477 - DNA, 25 bp, Homo sapien
cacctgttacccaagacggttattc

SEQ ID NO: 40478 - DNA, 25 bp, Homo sapien
cacctgttacccaagatggttattc

SEQ ID NO: 40479 - DNA, 25 bp, Homo sapien
cacctgttagtcgttctggcactta

SEQ ID NO: 40480 - DNA, 25 bp, Homo sapien
cacctgttagtctttctggcactta

SEQ ID NO: 40481 - DNA, 25 bp, Homo sapien
cacctgttgtatcccttgctgtgtt

SEQ ID NO: 40482 - DNA, 25 bp, Homo sapien
cacctgttgtatcctttgctgtgtt

SEQ ID NO: 40483 - DNA, 25 bp, Homo sapien
cacctgtttatgtaaataatgtttt

SEQ ID NO: 40484 - DNA, 25 bp, Homo sapien
cacctgtttttgtaaataatgtttt

SEQ ID NO: 40485 - DNA, 25 bp, Homo sapien
caccttaaaacctgctgatgacttc

SEQ ID NO: 40486 - DNA, 25 bp, Homo sapien
caccttaacacctgctgatgacttc

SEQ ID NO: 40487 - DNA, 25 bp, Homo sapien
caccttccactggggtcttcagatg

SEQ ID NO: 40488 - DNA, 25 bp, Homo sapien
caccttccgctggggtcttcagatg

SEQ ID NO: 40489 - DNA, 25 bp, Homo sapien
caccttgatgagagccatattttag

SEQ ID NO: 40490 - DNA, 25 bp, Homo sapien
caccttgatgagagccttattttag

SEQ ID NO: 40491 - DNA, 25 bp, Homo sapien
caccttgatgaggcagaaagagcta

SEQ ID NO: 40492 - DNA, 25 bp, Homo sapien
caccttgatgaggtagaaagagcta

SEQ ID NO: 40493 - DNA, 25 bp, Homo sapien
caccttgtatgacccttagagaaag

SEQ ID NO: 40494 - DNA, 25 bp, Homo sapien
caccttgtatgactcttagagaaag

SEQ ID NO: 40495 - DNA, 25 bp, Homo sapien
caccttgttaggctgcttctttgcc

SEQ ID NO: 40496 - DNA, 25 bp, Homo sapien
caccttgttaggcttcttctttgcc

SEQ ID NO: 40497 - DNA, 25 bp, Homo sapien
caccttgttctcacgtcttctaaga

SEQ ID NO: 40498 - DNA, 25 bp, Homo sapien
caccttgttctcatgtcttctaaga

SEQ ID NO: 40499 - DNA, 25 bp, Homo sapien
cacctttaaccatatctcatgtgaa

SEQ ID NO: 40500 - DNA, 25 bp, Homo sapien
cacctttaatcaacagcatacattg

SEQ ID NO: 40501 - DNA, 25 bp, Homo sapien
cacctttaatcatatctcatgtgaa

SEQ ID NO: 40502 - DNA, 25 bp, Homo sapien
cacctttagtcaacagcatacattg

SEQ ID NO: 40503 - DNA, 25 bp, Homo sapien
cacctttcaactatgatattgcctt

SEQ ID NO: 40504 - DNA, 25 bp, Homo sapien
cacctttcaactctgatattgcctt

SEQ ID NO: 40505 - DNA, 25 bp, Homo sapien
cacctttccgtgaactctaggggac

SEQ ID NO: 40506 - DNA, 25 bp, Homo sapien
cacctttccgtggactctaggggac

SEQ ID NO: 40507 - DNA, 25 bp, Homo sapien
cacctttgaatagttgccatctttg

SEQ ID NO: 40508 - DNA, 25 bp, Homo sapien
cacctttgaatatttgccatctttg

SEQ ID NO: 40509 - DNA, 25 bp, Homo sapien
cacctttgatgagtggccatcttcc

SEQ ID NO: 40510 - DNA, 25 bp, Homo sapien
cacctttgttgagtggccatcttcc

SEQ ID NO: 40511 - DNA, 25 bp, Homo sapien
caccttttagaattcaaaccattat

SEQ ID NO: 40512 - DNA, 25 bp, Homo sapien
caccttttagaattcagaccattat

SEQ ID NO: 40513 - DNA, 25 bp, Homo sapien
caccttttgtggaaggaaggactat

SEQ ID NO: 40514 - DNA, 25 bp, Homo sapien
caccttttgtggcaggaaggactat

SEQ ID NO: 40515 - DNA, 25 bp, Homo sapien
cacgaaacaatgacttctcttctca

SEQ ID NO: 40516 - DNA, 25 bp, Homo sapien
cacgaaacgatgacttctcttctca

SEQ ID NO: 40517 - DNA, 25 bp, Homo sapien
cacgaaagcaataaagtcaagacag

SEQ ID NO: 40518 - DNA, 25 bp, Homo sapien
cacgaaagcaatgaagtcaagacag

SEQ ID NO: 40519 - DNA, 25 bp, Homo sapien
cacgaacagcatggatttcccctgc

SEQ ID NO: 40520 - DNA, 25 bp, Homo sapien
cacgaacaggatggatttcccctgc

SEQ ID NO: 40521 - DNA, 25 bp, Homo sapien
cacgaacaggtgataggtcctttct

SEQ ID NO: 40522 - DNA, 25 bp, Homo sapien
cacgaacaggtgttaggtcctttct

SEQ ID NO: 40523 - DNA, 25 bp, Homo sapien
cacgaactagaactaggtttcatct

SEQ ID NO: 40524 - DNA, 25 bp, Homo sapien
cacgaactagaagtaggtttcatct

SEQ ID NO: 40525 - DNA, 25 bp, Homo sapien
cacgaatagctcatgaatttgttca

SEQ ID NO: 40526 - DNA, 25 bp, Homo sapien
cacgaatagctcgtgaatttgttca

SEQ ID NO: 40527 - DNA, 25 bp, Homo sapien
cacgacagaagacaagtatgaatgt

SEQ ID NO: 40528 - DNA, 25 bp, Homo sapien
cacgacagaggacaagtatgaatgt

SEQ ID NO: 40529 - DNA, 25 bp, Homo sapien
cacgagagagaatcgccttgtctgc

SEQ ID NO: 40530 - DNA, 25 bp, Homo sapien
cacgagagagattcgccttgtctgc

SEQ ID NO: 40531 - DNA, 25 bp, Homo sapien
cacgagattgttaacacgtgtgagg

SEQ ID NO: 40532 - DNA, 25 bp, Homo sapien
cacgagattgttaacatgtgtgagg

SEQ ID NO: 40533 - DNA, 25 bp, Homo sapien
cacgatttatcttcctttttcaggc

SEQ ID NO: 40534 - DNA, 25 bp, Homo sapien
cacgatttctactcagcttcaaact

SEQ ID NO: 40535 - DNA, 25 bp, Homo sapien
cacgatttctacttagcttcaaact

SEQ ID NO: 40536 - DNA, 25 bp, Homo sapien
cacgatttctcttcctttttcaggc

SEQ ID NO: 40537 - DNA, 25 bp, Homo sapien
cacgcaataaaatatgcgcttgtgt

SEQ ID NO: 40538 - DNA, 25 bp, Homo sapien
cacgcaataaaatatgtgcttgtgt

SEQ ID NO: 40539 - DNA, 25 bp, Homo sapien
cacgcacacatcatgaatgactcaa

SEQ ID NO: 40540 - DNA, 25 bp, Homo sapien
cacgcacacatcgtgaatgactcaa

SEQ ID NO: 40541 - DNA, 25 bp, Homo sapien
cacgcagagattaagaagtgactgt

SEQ ID NO: 40542 - DNA, 25 bp, Homo sapien
cacgcagagattaggaagtgactgt

SEQ ID NO: 40543 - DNA, 25 bp, Homo sapien
cacgcagggtttatcgtatcgtgaa

SEQ ID NO: 40544 - DNA, 25 bp, Homo sapien
cacgcagggtttattgtatcgtgaa

SEQ ID NO: 40545 - DNA, 25 bp, Homo sapien
cacgccaatgcatttaccactctgg

SEQ ID NO: 40546 - DNA, 25 bp, Homo sapien
cacgccaatgcgtttaccactctgg

SEQ ID NO: 40547 - DNA, 25 bp, Homo sapien
cacgcctcactgccccacttctctc

SEQ ID NO: 40548 - DNA, 25 bp, Homo sapien
cacgcctcattgccccacttctctc

SEQ ID NO: 40549 - DNA, 25 bp, Homo sapien
cacgcctggcaatcatgacctcttc

SEQ ID NO: 40550 - DNA, 25 bp, Homo sapien
cacgcctggcagtcatgacctcttc

SEQ ID NO: 40551 - DNA, 25 bp, Homo sapien
cacgctaacaacgtaaacggctcaa

SEQ ID NO: 40552 - DNA, 25 bp, Homo sapien
cacgctaacaatgtaaacggctcaa

SEQ ID NO: 40553 - DNA, 25 bp, Homo sapien
cacgctaatagaaaaaaagccaaac

SEQ ID NO: 40554 - DNA, 25 bp, Homo sapien
cacgctaatagagaaaaagccaaac

SEQ ID NO: 40555 - DNA, 25 bp, Homo sapien
cacgctcacacatcggtattcaaat

SEQ ID NO: 40556 - DNA, 25 bp, Homo sapien
cacgctcacacatctgtattcaaat

SEQ ID NO: 40557 - DNA, 25 bp, Homo sapien
cacgctcatttgttcaaagcacagc

SEQ ID NO: 40558 - DNA, 25 bp, Homo sapien
cacgctcattttttcaaagcacagc

SEQ ID NO: 40559 - DNA, 25 bp, Homo sapien
cacgctgattattcatcctacgttg

SEQ ID NO: 40560 - DNA, 25 bp, Homo sapien
cacgctgattattcttcctacgttg

SEQ ID NO: 40561 - DNA, 25 bp, Homo sapien
cacgctgccatcgtgttccctcagt

SEQ ID NO: 40562 - DNA, 25 bp, Homo sapien
cacgctgccgtcgtgttccctcagt

SEQ ID NO: 40563 - DNA, 25 bp, Homo sapien
cacggaaatatgattgcatcagaca

SEQ ID NO: 40564 - DNA, 25 bp, Homo sapien
cacggaaatatgtttgcatcagaca

SEQ ID NO: 40565 - DNA, 25 bp, Homo sapien
cacggaagagaaaaattcaggaatc

SEQ ID NO: 40566 - DNA, 25 bp, Homo sapien
cacggaagagaagaattcaggaatc

SEQ ID NO: 40567 - DNA, 25 bp, Homo sapien
cacggaggacaccaccctgaaagga

SEQ ID NO: 40568 - DNA, 25 bp, Homo sapien
cacggaggacaccatcctgaaagga

SEQ ID NO: 40569 - DNA, 25 bp, Homo sapien
cacggatttgaacatgtgatatgaa

SEQ ID NO: 40570 - DNA, 25 bp, Homo sapien
cacggatttgaatatgtgatatgaa

SEQ ID NO: 40571 - DNA, 25 bp, Homo sapien
cacggcatcacacccagtcctctcc

SEQ ID NO: 40572 - DNA, 25 bp, Homo sapien
cacggcatcgcacccagtcctctcc

SEQ ID NO: 40573 - DNA, 25 bp, Homo sapien
cacggccaagataaaaaatcccagg

SEQ ID NO: 40574 - DNA, 25 bp, Homo sapien
cacggccaagataaaagatcccagg

SEQ ID NO: 40575 - DNA, 25 bp, Homo sapien
cacggctgctcgcacgctactacag

SEQ ID NO: 40576 - DNA, 25 bp, Homo sapien
cacggctgctctcacgctactacag

SEQ ID NO: 40577 - DNA, 25 bp, Homo sapien
cacgggaaggtcaaagttctagctt

SEQ ID NO: 40578 - DNA, 25 bp, Homo sapien
cacgggaaggtcagagttctagctt

SEQ ID NO: 40579 - DNA, 25 bp, Homo sapien
cacgggaattgacaggagagttgct

SEQ ID NO: 40580 - DNA, 25 bp, Homo sapien
cacgggaattgagaggagagttgct

SEQ ID NO: 40581 - DNA, 25 bp, Homo sapien
cacgggcaatggaatgagaccccca

SEQ ID NO: 40582 - DNA, 25 bp, Homo sapien
cacgggcaatggagtgagaccccca

SEQ ID NO: 40583 - DNA, 25 bp, Homo sapien
cacgggttgaccctacagaaaagaa

SEQ ID NO: 40584 - DNA, 25 bp, Homo sapien
cacgggttgaccttacagaaaagaa

SEQ ID NO: 40585 - DNA, 25 bp, Homo sapien
cacggtataagccaccacagcggtt

SEQ ID NO: 40586 - DNA, 25 bp, Homo sapien
cacggtataggccaccacagcggtt

SEQ ID NO: 40587 - DNA, 25 bp, Homo sapien
cacggtgcttcatacagctctagtt

SEQ ID NO: 40588 - DNA, 25 bp, Homo sapien
cacggtgcttcatatagctctagtt

SEQ ID NO: 40589 - DNA, 25 bp, Homo sapien
cacggttaaggaaagaagctggtta

SEQ ID NO: 40590 - DNA, 25 bp, Homo sapien
cacggttaaggaaataagctggtta

SEQ ID NO: 40591 - DNA, 25 bp, Homo sapien
cacggtttacgttttcacaccacaa

SEQ ID NO: 40592 - DNA, 25 bp, Homo sapien
cacggtttatgttttcacaccacaa

SEQ ID NO: 40593 - DNA, 25 bp, Homo sapien
cacggtttttcaagagaagatactg

SEQ ID NO: 40594 - DNA, 25 bp, Homo sapien
cacggtttttcaggagaagatactg

SEQ ID NO: 40595 - DNA, 25 bp, Homo sapien
cacgtaaatctcaatctggaaggaa

SEQ ID NO: 40596 - DNA, 25 bp, Homo sapien
cacgtaaatcttaatctggaaggaa

SEQ ID NO: 40597 - DNA, 25 bp, Homo sapien
cacgtaacgtctttcgatgccacat

SEQ ID NO: 40598 - DNA, 25 bp, Homo sapien
cacgtaacgtcttttgatgccacat

SEQ ID NO: 40599 - DNA, 25 bp, Homo sapien
cacgtatgggccctttcgtcacctg

SEQ ID NO: 40600 - DNA, 25 bp, Homo sapien
cacgtatgggcccttttgtcacctg

SEQ ID NO: 40601 - DNA, 25 bp, Homo sapien
cacgtattctcctgcaacaactggc

SEQ ID NO: 40602 - DNA, 25 bp, Homo sapien
cacgtattctcttgcaacaactggc

SEQ ID NO: 40603 - DNA, 25 bp, Homo sapien
cacgtcacatgcacatatggatttt

SEQ ID NO: 40604 - DNA, 25 bp, Homo sapien
cacgtcacatgtacatatggatttt

SEQ ID NO: 40605 - DNA, 25 bp, Homo sapien
cacgtgagaaacctaggccattata

SEQ ID NO: 40606 - DNA, 25 bp, Homo sapien
cacgtgagaaacttaggccattata

SEQ ID NO: 40607 - DNA, 25 bp, Homo sapien
cacgtgatcaagcatcatagtcctc

SEQ ID NO: 40608 - DNA, 25 bp, Homo sapien
cacgtgatcaagtatcatagtcctc

SEQ ID NO: 40609 - DNA, 25 bp, Homo sapien
cacgtgggtattacggttcacaatg

SEQ ID NO: 40610 - DNA, 25 bp, Homo sapien
cacgtgggtattatggttcacaatg

SEQ ID NO: 40611 - DNA, 25 bp, Homo sapien
cacgtggtcaaacccagagaagagg

SEQ ID NO: 40612 - DNA, 25 bp, Homo sapien
cacgtggtcaaatccagagaagagg

SEQ ID NO: 40613 - DNA, 25 bp, Homo sapien
cacgtggtctgccagggctgctctt

SEQ ID NO: 40614 - DNA, 25 bp, Homo sapien
cacgtggtttgccagggctgctctt

SEQ ID NO: 40615 - DNA, 25 bp, Homo sapien
cacgtgtaagacgagtacctcttca

SEQ ID NO: 40616 - DNA, 25 bp, Homo sapien
cacgtgtaagactagtacctcttca

SEQ ID NO: 40617 - DNA, 25 bp, Homo sapien
cacgtgtacataggcatacccactc

SEQ ID NO: 40618 - DNA, 25 bp, Homo sapien
cacgtgtacattggcatacccactc

SEQ ID NO: 40619 - DNA, 25 bp, Homo sapien
cacgtgttcttcagtcagcttttgg

SEQ ID NO: 40620 - DNA, 25 bp, Homo sapien
cacgtgttctttagtcagcttttgg

SEQ ID NO: 40621 - DNA, 25 bp, Homo sapien
cacgttacattataaccactcagag

SEQ ID NO: 40622 - DNA, 25 bp, Homo sapien
cacgttacgttataaccactcagag

SEQ ID NO: 40623 - DNA, 25 bp, Homo sapien
cacgttcagccaacacatctctaaa

SEQ ID NO: 40624 - DNA, 25 bp, Homo sapien
cacgttcagccaacgcatctctaaa

SEQ ID NO: 40625 - DNA, 25 bp, Homo sapien
cacgttcttcctcttggaccccaag

SEQ ID NO: 40626 - DNA, 25 bp, Homo sapien
cacgttcttcctgttggaccccaag

SEQ ID NO: 40627 - DNA, 25 bp, Homo sapien
cacgttcttcttttatcttgccaca

SEQ ID NO: 40628 - DNA, 25 bp, Homo sapien
cacgttcttcttttctcttgccaca

SEQ ID NO: 40629 - DNA, 25 bp, Homo sapien
cacgtttctcccgtgctcactctct

SEQ ID NO: 40630 - DNA, 25 bp, Homo sapien
cacgtttctcctgtgctcactctct

SEQ ID NO: 40631 - DNA, 25 bp, Homo sapien
cacgtttttagactccacagcttcg

SEQ ID NO: 40632 - DNA, 25 bp, Homo sapien
cacgtttttagactccgcagcttcg

SEQ ID NO: 40633 - DNA, 25 bp, Homo sapien
cacgtttttagtctctccactcatt

SEQ ID NO: 40634 - DNA, 25 bp, Homo sapien
cacgtttttagtttctccactcatt

SEQ ID NO: 40635 - DNA, 25 bp, Homo sapien
cacgttttttgctagacagaactat

SEQ ID NO: 40636 - DNA, 25 bp, Homo sapien
cacgttttttgctggacagaactat

SEQ ID NO: 40637 - DNA, 25 bp, Homo sapien
cactaaaaccttcaatgaagaaaat

SEQ ID NO: 40638 - DNA, 25 bp, Homo sapien
cactaaaaccttcattgaagaaaat

SEQ ID NO: 40639 - DNA, 25 bp, Homo sapien
cactaaacataaaacgatacacaaa

SEQ ID NO: 40640 - DNA, 25 bp, Homo sapien
cactaaacataaaatgatacacaaa

SEQ ID NO: 40641 - DNA, 25 bp, Homo sapien
cactaaacataagcaatagtaattc

SEQ ID NO: 40642 - DNA, 25 bp, Homo sapien
cactaaacgtaagcaatagtaattc

SEQ ID NO: 40643 - DNA, 25 bp, Homo sapien
cactaaatgcccacagaagacagca

SEQ ID NO: 40644 - DNA, 25 bp, Homo sapien
cactaaatgcccacggaagacagca

SEQ ID NO: 40645 - DNA, 25 bp, Homo sapien
cactaacagcagagatattattaat

SEQ ID NO: 40646 - DNA, 25 bp, Homo sapien
cactaacagcagatatattattaat

SEQ ID NO: 40647 - DNA, 25 bp, Homo sapien
cactaaccaaagattatttaacttt

SEQ ID NO: 40648 - DNA, 25 bp, Homo sapien
cactaaccatcttgacttgagttct

SEQ ID NO: 40649 - DNA, 25 bp, Homo sapien
cactaaccgaagattatttaacttt

SEQ ID NO: 40650 - DNA, 25 bp, Homo sapien
cactaaccgtcttgacttgagttct

SEQ ID NO: 40651 - DNA, 25 bp, Homo sapien
cactaacctttctgattccctttct

SEQ ID NO: 40652 - DNA, 25 bp, Homo sapien
cactaacctttcttattccctttct

SEQ ID NO: 40653 - DNA, 25 bp, Homo sapien
cactaagaaaaatccgtagactgtg

SEQ ID NO: 40654 - DNA, 25 bp, Homo sapien
cactaagaaaaatctgtagactgtg

SEQ ID NO: 40655 - DNA, 25 bp, Homo sapien
cactaagaaattcactattcaagat

SEQ ID NO: 40656 - DNA, 25 bp, Homo sapien
cactaagaaatttactattcaagat

SEQ ID NO: 40657 - DNA, 25 bp, Homo sapien
cactaagaatcaaacgaatggttat

SEQ ID NO: 40658 - DNA, 25 bp, Homo sapien
cactaagaatcaaatgaatggttat

SEQ ID NO: 40659 - DNA, 25 bp, Homo sapien
cactaataggtgcgttgaagggatc

SEQ ID NO: 40660 - DNA, 25 bp, Homo sapien
cactaataggtgtgttgaagggatc

SEQ ID NO: 40661 - DNA, 25 bp, Homo sapien
cactaatatctgattttccctttca

SEQ ID NO: 40662 - DNA, 25 bp, Homo sapien
cactaatatttgattttccctttca

SEQ ID NO: 40663 - DNA, 25 bp, Homo sapien
cactaatgcctttggatgccttgcc

SEQ ID NO: 40664 - DNA, 25 bp, Homo sapien
cactaatgtctttggatgccttgcc

SEQ ID NO: 40665 - DNA, 25 bp, Homo sapien
cactacaaaagattgaagcaaaaag

SEQ ID NO: 40666 - DNA, 25 bp, Homo sapien
cactacaaaggattgaagcaaaaag

SEQ ID NO: 40667 - DNA, 25 bp, Homo sapien
cactacactgtcatcacatgtgatt

SEQ ID NO: 40668 - DNA, 25 bp, Homo sapien
cactacactgtcgtcacatgtgatt

SEQ ID NO: 40669 - DNA, 25 bp, Homo sapien
cactacataaaaggattcagaaagt

SEQ ID NO: 40670 - DNA, 25 bp, Homo sapien
cactacataaaatgattcagaaagt

SEQ ID NO: 40671 - DNA, 25 bp, Homo sapien
cactacattagttagttaagcttac

SEQ ID NO: 40672 - DNA, 25 bp, Homo sapien
cactacattagttatttaagcttac

SEQ ID NO: 40673 - DNA, 25 bp, Homo sapien
cactaccaatgggccgaatggggca

SEQ ID NO: 40674 - DNA, 25 bp, Homo sapien
cactaccaatgggctgaatggggca

SEQ ID NO: 40675 - DNA, 25 bp, Homo sapien
cactacgctctctgccatcccaaat

SEQ ID NO: 40676 - DNA, 25 bp, Homo sapien
cactacgctctgtgccatcccaaat

SEQ ID NO: 40677 - DNA, 25 bp, Homo sapien
cactactaattccaggtcagactta

SEQ ID NO: 40678 - DNA, 25 bp, Homo sapien
cactactacttccaggtcagactta

SEQ ID NO: 40679 - DNA, 25 bp, Homo sapien
cactactctcaaaaatcagaaagtt

SEQ ID NO: 40680 - DNA, 25 bp, Homo sapien
cactactctcagaaatcagaaagtt

SEQ ID NO: 40681 - DNA, 25 bp, Homo sapien
cactagaccaactgtaagagtgaga

SEQ ID NO: 40682 - DNA, 25 bp, Homo sapien
cactagacctagagagcacctggct

SEQ ID NO: 40683 - DNA, 25 bp, Homo sapien
cactagacctagagagtacctggct

SEQ ID NO: 40684 - DNA, 25 bp, Homo sapien
cactagactaactgtaagagtgaga

SEQ ID NO: 40685 - DNA, 25 bp, Homo sapien
cactagcacatcctgaatgacaagg

SEQ ID NO: 40686 - DNA, 25 bp, Homo sapien
cactagcacatcttgaatgacaagg

SEQ ID NO: 40687 - DNA, 25 bp, Homo sapien
cactagcaggtatatttggcatctg

SEQ ID NO: 40688 - DNA, 25 bp, Homo sapien
cactagcatgtatatttggcatctg

SEQ ID NO: 40689 - DNA, 25 bp, Homo sapien
cactagctgcatatataatcctgtg

SEQ ID NO: 40690 - DNA, 25 bp, Homo sapien
cactagctgcatatgtaatcctgtg

SEQ ID NO: 40691 - DNA, 25 bp, Homo sapien
cactaggcttgctgctgctgcgtgg

SEQ ID NO: 40692 - DNA, 25 bp, Homo sapien
cactaggcttgttgctgctgcgtgg

SEQ ID NO: 40693 - DNA, 25 bp, Homo sapien
cactagggccagttagcccacttac

SEQ ID NO: 40694 - DNA, 25 bp, Homo sapien
cactagggccagttagtccacttac

SEQ ID NO: 40695 - DNA, 25 bp, Homo sapien
cactaggtctgcagtagaggctgtg

SEQ ID NO: 40696 - DNA, 25 bp, Homo sapien
cactaggtctgcggtagaggctgtg

SEQ ID NO: 40697 - DNA, 25 bp, Homo sapien
cactagtataaagttgtacaggcca

SEQ ID NO: 40698 - DNA, 25 bp, Homo sapien
cactagtataacgttgtacaggcca

SEQ ID NO: 40699 - DNA, 25 bp, Homo sapien
cactagtatttaagacactatttgc

SEQ ID NO: 40700 - DNA, 25 bp, Homo sapien
cactagtatttcagacactatttgc

SEQ ID NO: 40701 - DNA, 25 bp, Homo sapien
cactataggaggcgctggaaatgta

SEQ ID NO: 40702 - DNA, 25 bp, Homo sapien
cactataggaggtgctggaaatgta

SEQ ID NO: 40703 - DNA, 25 bp, Homo sapien
cactatagtgaatgtggtagcttct

SEQ ID NO: 40704 - DNA, 25 bp, Homo sapien
cactatagtgaatgtgttagcttct

SEQ ID NO: 40705 - DNA, 25 bp, Homo sapien
cactatcactggcctgactaccact

SEQ ID NO: 40706 - DNA, 25 bp, Homo sapien
cactatcactggcttgactaccact

SEQ ID NO: 40707 - DNA, 25 bp, Homo sapien
cactatcatttacatagcttaaaaa

SEQ ID NO: 40708 - DNA, 25 bp, Homo sapien
cactatcatttcttgcctggattat

SEQ ID NO: 40709 - DNA, 25 bp, Homo sapien
cactatcatttcttgcttggattat

SEQ ID NO: 40710 - DNA, 25 bp, Homo sapien
cactatcatttgcatagcttaaaaa

SEQ ID NO: 40711 - DNA, 25 bp, Homo sapien
cactatccagtttagacagagtctg

SEQ ID NO: 40712 - DNA, 25 bp, Homo sapien
cactatccagtttagatagagtctg

SEQ ID NO: 40713 - DNA, 25 bp, Homo sapien
cactatccatagagaagtttgtttg

SEQ ID NO: 40714 - DNA, 25 bp, Homo sapien
cactatccatagggaagtttgtttg

SEQ ID NO: 40715 - DNA, 25 bp, Homo sapien
cactatgaggccacggaaagggtgg

SEQ ID NO: 40716 - DNA, 25 bp, Homo sapien
cactatgaggccatggaaagggtgg

SEQ ID NO: 40717 - DNA, 25 bp, Homo sapien
cactatgccctttcactctttgtct

SEQ ID NO: 40718 - DNA, 25 bp, Homo sapien
cactatgcctacttgtaataagagc

SEQ ID NO: 40719 - DNA, 25 bp, Homo sapien
cactatgcctatttgtaataagagc

SEQ ID NO: 40720 - DNA, 25 bp, Homo sapien
cactatgcctctccactcgcaaagt

SEQ ID NO: 40721 - DNA, 25 bp, Homo sapien
cactatgcctctctactcgcaaagt

SEQ ID NO: 40722 - DNA, 25 bp, Homo sapien
cactatgccttttcactctttgtct

SEQ ID NO: 40723 - DNA, 25 bp, Homo sapien
cactatgtgccaatcctctaagtcc

SEQ ID NO: 40724 - DNA, 25 bp, Homo sapien
cactatgtgccaattctctaagtcc

SEQ ID NO: 40725 - DNA, 25 bp, Homo sapien
cactatgtgttaattgcttagtaca

SEQ ID NO: 40726 - DNA, 25 bp, Homo sapien
cactatgtgtttattgcttagtaca

SEQ ID NO: 40727 - DNA, 25 bp, Homo sapien
cactattataaaatgacgacatatt

SEQ ID NO: 40728 - DNA, 25 bp, Homo sapien
cactattataaaatgatgacatatt

SEQ ID NO: 40729 - DNA, 25 bp, Homo sapien
cactattcctgaattacttttaata

SEQ ID NO: 40730 - DNA, 25 bp, Homo sapien
cactattcctgaattatttttaata

SEQ ID NO: 40731 - DNA, 25 bp, Homo sapien
cactattctctaatgaaaaggatca

SEQ ID NO: 40732 - DNA, 25 bp, Homo sapien
cactattctcttatgaaaaggatca

SEQ ID NO: 40733 - DNA, 25 bp, Homo sapien
cactattggaaagggcctccgaaca

SEQ ID NO: 40734 - DNA, 25 bp, Homo sapien
cactattggcaagggcctccgaaca

SEQ ID NO: 40735 - DNA, 25 bp, Homo sapien
cactattgtaaattggcagtgtgta

SEQ ID NO: 40736 - DNA, 25 bp, Homo sapien
cactattgtaaattggtagtgtgta

SEQ ID NO: 40737 - DNA, 25 bp, Homo sapien
cactatttccacatctcattggcct

SEQ ID NO: 40738 - DNA, 25 bp, Homo sapien
cactatttccacgtctcattggcct

SEQ ID NO: 40739 - DNA, 25 bp, Homo sapien
cactcaacagtagtttttgtttcat

SEQ ID NO: 40740 - DNA, 25 bp, Homo sapien
cactcaacattagtttttgtttcat

SEQ ID NO: 40741 - DNA, 25 bp, Homo sapien
cactcaataaaacctgttaataact

SEQ ID NO: 40742 - DNA, 25 bp, Homo sapien
cactcaataaatcctgttaataact

SEQ ID NO: 40743 - DNA, 25 bp, Homo sapien
cactcacaaaggacgtgtctctcac

SEQ ID NO: 40744 - DNA, 25 bp, Homo sapien
cactcacaaaggatgtgtctctcac

SEQ ID NO: 40745 - DNA, 25 bp, Homo sapien
cactcactataatttctgatattgc

SEQ ID NO: 40746 - DNA, 25 bp, Homo sapien
cactcactgtaatttctgatattgc

SEQ ID NO: 40747 - DNA, 25 bp, Homo sapien
cactcagatttaatacattttaaca

SEQ ID NO: 40748 - DNA, 25 bp, Homo sapien
cactcagatttgatacattttaaca

SEQ ID NO: 40749 - DNA, 25 bp, Homo sapien
cactcagctcaagtcttcactgacc

SEQ ID NO: 40750 - DNA, 25 bp, Homo sapien
cactcagctcaagttttcactgacc

SEQ ID NO: 40751 - DNA, 25 bp, Homo sapien
cactcaggatgccggatgacgggca

SEQ ID NO: 40752 - DNA, 25 bp, Homo sapien
cactcaggatgctggatgacgggca

SEQ ID NO: 40753 - DNA, 25 bp, Homo sapien
cactcagtgatacaacccttttata

SEQ ID NO: 40754 - DNA, 25 bp, Homo sapien
cactcagtgatacgacccttttata

SEQ ID NO: 40755 - DNA, 25 bp, Homo sapien
cactcataaacaaaggaagctagga

SEQ ID NO: 40756 - DNA, 25 bp, Homo sapien
cactcataaacaagggaagctagga

SEQ ID NO: 40757 - DNA, 25 bp, Homo sapien
cactcatagttttctactggacccc

SEQ ID NO: 40758 - DNA, 25 bp, Homo sapien
cactcatagttttctattggacccc

SEQ ID NO: 40759 - DNA, 25 bp, Homo sapien
cactcatctctgtaacagttcaagt

SEQ ID NO: 40760 - DNA, 25 bp, Homo sapien
cactcatctttgtaacagttcaagt

SEQ ID NO: 40761 - DNA, 25 bp, Homo sapien
cactcattcagggttagaatcatgg

SEQ ID NO: 40762 - DNA, 25 bp, Homo sapien
cactcattcattacctgccattcaa

SEQ ID NO: 40763 - DNA, 25 bp, Homo sapien
cactcattcattacgtgccattcaa

SEQ ID NO: 40764 - DNA, 25 bp, Homo sapien
cactcattccgggttagaatcatgg

SEQ ID NO: 40765 - DNA, 25 bp, Homo sapien
cactcatttttaaaaaagcacaaat

SEQ ID NO: 40766 - DNA, 25 bp, Homo sapien
cactcatttttaatattttttccaa

SEQ ID NO: 40767 - DNA, 25 bp, Homo sapien
cactcatttttaatgttttttccaa

SEQ ID NO: 40768 - DNA, 25 bp, Homo sapien
cactcattttttaaaaagcacaaat

SEQ ID NO: 40769 - DNA, 25 bp, Homo sapien
cactccaaaaatccaacttcctaaa

SEQ ID NO: 40770 - DNA, 25 bp, Homo sapien
cactccaaaaatccaagttcctaaa

SEQ ID NO: 40771 - DNA, 25 bp, Homo sapien
cactccaaataaaactgtatttatg

SEQ ID NO: 40772 - DNA, 25 bp, Homo sapien
cactccaaatataactgtatttatg

SEQ ID NO: 40773 - DNA, 25 bp, Homo sapien
cactccaactcaaaacgagaagaag

SEQ ID NO: 40774 - DNA, 25 bp, Homo sapien
cactccaactcaaaactagaagaag

SEQ ID NO: 40775 - DNA, 25 bp, Homo sapien
cactccaagaagctttatcttctag

SEQ ID NO: 40776 - DNA, 25 bp, Homo sapien
cactccaagaagttttatcttctag

SEQ ID NO: 40777 - DNA, 25 bp, Homo sapien
cactccagtccccaaagattgatct

SEQ ID NO: 40778 - DNA, 25 bp, Homo sapien
cactccagtccgcaaagattgatct

SEQ ID NO: 40779 - DNA, 25 bp, Homo sapien
cactccattagagtgacggaagtga

SEQ ID NO: 40780 - DNA, 25 bp, Homo sapien
cactccattagagtgatggaagtga

SEQ ID NO: 40781 - DNA, 25 bp, Homo sapien
cactcccagatacgtacccaagaga

SEQ ID NO: 40782 - DNA, 25 bp, Homo sapien
cactcccagatatgtacccaagaga

SEQ ID NO: 40783 - DNA, 25 bp, Homo sapien
cactccctcaacaatgacattaatt

SEQ ID NO: 40784 - DNA, 25 bp, Homo sapien
cactccctcaacagtgacattaatt

SEQ ID NO: 40785 - DNA, 25 bp, Homo sapien
cactcctatgtctatatctaagaga

SEQ ID NO: 40786 - DNA, 25 bp, Homo sapien
cactcctatgtctgtatctaagaga

SEQ ID NO: 40787 - DNA, 25 bp, Homo sapien
cactcctatttgctaggcatcgacc

SEQ ID NO: 40788 - DNA, 25 bp, Homo sapien
cactcctatttgctgggcatcgacc

SEQ ID NO: 40789 - DNA, 25 bp, Homo sapien
cactcctcactgcactgtgtgttac

SEQ ID NO: 40790 - DNA, 25 bp, Homo sapien
cactcctcactgcactttgtgttac

SEQ ID NO: 40791 - DNA, 25 bp, Homo sapien
cactcctcattgacattattaattt

SEQ ID NO: 40792 - DNA, 25 bp, Homo sapien
cactcctcattggcattattaattt

SEQ ID NO: 40793 - DNA, 25 bp, Homo sapien
cactcctgactacagaagatcactc

SEQ ID NO: 40794 - DNA, 25 bp, Homo sapien
cactcctgactacataagatcactc

SEQ ID NO: 40795 - DNA, 25 bp, Homo sapien
cactcctgagtcctttcgaaaccac

SEQ ID NO: 40796 - DNA, 25 bp, Homo sapien
cactcctgagtccttttgaaaccac

SEQ ID NO: 40797 - DNA, 25 bp, Homo sapien
cactccttactagctgtgtgatctt

SEQ ID NO: 40798 - DNA, 25 bp, Homo sapien
cactccttactatctgtgtgatctt

SEQ ID NO: 40799 - DNA, 25 bp, Homo sapien
cactcggtaaagcacagtaaggcag

SEQ ID NO: 40800 - DNA, 25 bp, Homo sapien
cactcggtgaagcacagtaaggcag

SEQ ID NO: 40801 - DNA, 25 bp, Homo sapien
cactctaatcatgagaataattgta

SEQ ID NO: 40802 - DNA, 25 bp, Homo sapien
cactctaatcatgggaataattgta

SEQ ID NO: 40803 - DNA, 25 bp, Homo sapien
cactctaccaaaaaaaggcaaaatg

SEQ ID NO: 40804 - DNA, 25 bp, Homo sapien
cactctaccaacaaaaggcaaaatg

SEQ ID NO: 40805 - DNA, 25 bp, Homo sapien
cactctattgcacggaatatatagt

SEQ ID NO: 40806 - DNA, 25 bp, Homo sapien
cactctattgcatggaatatatagt

SEQ ID NO: 40807 - DNA, 25 bp, Homo sapien
cactctcagcaattccacttaagaa

SEQ ID NO: 40808 - DNA, 25 bp, Homo sapien
cactctcagcacttccacttaagaa

SEQ ID NO: 40809 - DNA, 25 bp, Homo sapien
cactctcagtgtctccgtaaatttg

SEQ ID NO: 40810 - DNA, 25 bp, Homo sapien
cactctcagtgtttccgtaaatttg

SEQ ID NO: 40811 - DNA, 25 bp, Homo sapien
cactctcagttgaagacctcactta

SEQ ID NO: 40812 - DNA, 25 bp, Homo sapien
cactctcagttgaagatctcactta

SEQ ID NO: 40813 - DNA, 25 bp, Homo sapien
cactctcatctttgctctaggcact

SEQ ID NO: 40814 - DNA, 25 bp, Homo sapien
cactctcatctttgctttaggcact

SEQ ID NO: 40815 - DNA, 25 bp, Homo sapien
cactctccccaatacgcacagtaat

SEQ ID NO: 40816 - DNA, 25 bp, Homo sapien
cactctccccagtacgcacagtaat

SEQ ID NO: 40817 - DNA, 25 bp, Homo sapien
cactctctggtggcataaaacagaa

SEQ ID NO: 40818 - DNA, 25 bp, Homo sapien
cactctctggtggcgtaaaacagaa

SEQ ID NO: 40819 - DNA, 25 bp, Homo sapien
cactctgagaaccactggtttgttt

SEQ ID NO: 40820 - DNA, 25 bp, Homo sapien
cactctgagaaccgctggtttgttt

SEQ ID NO: 40821 - DNA, 25 bp, Homo sapien
cactctgcaagatattgtaggaaat

SEQ ID NO: 40822 - DNA, 25 bp, Homo sapien
cactctgcaaggtattgtaggaaat

SEQ ID NO: 40823 - DNA, 25 bp, Homo sapien
cactctgcattttggacgtgccagc

SEQ ID NO: 40824 - DNA, 25 bp, Homo sapien
cactctgcattttggatgtgccagc

SEQ ID NO: 40825 - DNA, 25 bp, Homo sapien
cactctggcaaaatgggatgagttc

SEQ ID NO: 40826 - DNA, 25 bp, Homo sapien
cactctggcaagatgggatgagttc

SEQ ID NO: 40827 - DNA, 25 bp, Homo sapien
cactctgtcatgcttgaaaagtttt

SEQ ID NO: 40828 - DNA, 25 bp, Homo sapien
cactctgtcattcttgaaaagtttt

SEQ ID NO: 40829 - DNA, 25 bp, Homo sapien
cactctgtttcatcctagttttttt

SEQ ID NO: 40830 - DNA, 25 bp, Homo sapien
cactctgtttcttcctagttttttt

SEQ ID NO: 40831 - DNA, 25 bp, Homo sapien
cactcttaacaagcttgagataaaa

SEQ ID NO: 40832 - DNA, 25 bp, Homo sapien
cactcttaataagcttgagataaaa

SEQ ID NO: 40833 - DNA, 25 bp, Homo sapien
cactcttaatagaaactgctgctaa

SEQ ID NO: 40834 - DNA, 25 bp, Homo sapien
cactcttacattttaactcattctg

SEQ ID NO: 40835 - DNA, 25 bp, Homo sapien
cactcttactaccatactcaaaata

SEQ ID NO: 40836 - DNA, 25 bp, Homo sapien
cactcttagattttaactcattctg

SEQ ID NO: 40837 - DNA, 25 bp, Homo sapien
cactcttagtaccatactcaaaata

SEQ ID NO: 40838 - DNA, 25 bp, Homo sapien
cactcttagtagaaactgctgctaa

SEQ ID NO: 40839 - DNA, 25 bp, Homo sapien
cactcttcatgtaatttgtgtgtga

SEQ ID NO: 40840 - DNA, 25 bp, Homo sapien
cactcttcgtgtaatttgtgtgtga

SEQ ID NO: 40841 - DNA, 25 bp, Homo sapien
cactcttctgtcccatttctacggg

SEQ ID NO: 40842 - DNA, 25 bp, Homo sapien
cactcttctgtcccgtttctacggg

SEQ ID NO: 40843 - DNA, 25 bp, Homo sapien
cactcttgaataactaataggagtt

SEQ ID NO: 40844 - DNA, 25 bp, Homo sapien
cactcttgaatcactaataggagtt

SEQ ID NO: 40845 - DNA, 25 bp, Homo sapien
cactcttggggtatcaatgagagaa

SEQ ID NO: 40846 - DNA, 25 bp, Homo sapien
cactcttggggtatcagtgagagaa

SEQ ID NO: 40847 - DNA, 25 bp, Homo sapien
cactcttgtgcagtaagcgttcagt

SEQ ID NO: 40848 - DNA, 25 bp, Homo sapien
cactcttgttcagtaagcgttcagt

SEQ ID NO: 40849 - DNA, 25 bp, Homo sapien
cactctttgacatgtagggcaaaat

SEQ ID NO: 40850 - DNA, 25 bp, Homo sapien
cactctttggcatgtagggcaaaat

SEQ ID NO: 40851 - DNA, 25 bp, Homo sapien
cactctttgtacaacaaattacagg

SEQ ID NO: 40852 - DNA, 25 bp, Homo sapien
cactctttgtacaataaattacagg

SEQ ID NO: 40853 - DNA, 25 bp, Homo sapien
cactcttttcattttgctaagtttg

SEQ ID NO: 40854 - DNA, 25 bp, Homo sapien
cactcttttcattttggtaagtttg

SEQ ID NO: 40855 - DNA, 25 bp, Homo sapien
cactgaaaaccaaaactaagaaata

SEQ ID NO: 40856 - DNA, 25 bp, Homo sapien
cactgaaaaccagaactaagaaata

SEQ ID NO: 40857 - DNA, 25 bp, Homo sapien
cactgaaacgtgggtcagatgttga

SEQ ID NO: 40858 - DNA, 25 bp, Homo sapien
cactgaaatgtgggtcagatgttga

SEQ ID NO: 40859 - DNA, 25 bp, Homo sapien
cactgaaattggtaaagatacatta

SEQ ID NO: 40860 - DNA, 25 bp, Homo sapien
cactgaaattggtgaagatacatta

SEQ ID NO: 40861 - DNA, 25 bp, Homo sapien
cactgaacttagaaaagactcttca

SEQ ID NO: 40862 - DNA, 25 bp, Homo sapien
cactgaacttagaaaatactcttca

SEQ ID NO: 40863 - DNA, 25 bp, Homo sapien
cactgaagaagatttgtttatgctc

SEQ ID NO: 40864 - DNA, 25 bp, Homo sapien
cactgaagaggatttgtttatgctc

SEQ ID NO: 40865 - DNA, 25 bp, Homo sapien
cactgaagatttgagaaacataatt

SEQ ID NO: 40866 - DNA, 25 bp, Homo sapien
cactgaaggtttgagaaacataatt

SEQ ID NO: 40867 - DNA, 25 bp, Homo sapien
cactgaatactactgagtttcttct

SEQ ID NO: 40868 - DNA, 25 bp, Homo sapien
cactgaatactatctgcgaaatccc

SEQ ID NO: 40869 - DNA, 25 bp, Homo sapien
cactgaatattactgagtttcttct

SEQ ID NO: 40870 - DNA, 25 bp, Homo sapien
cactgaatcctatctgcgaaatccc

SEQ ID NO: 40871 - DNA, 25 bp, Homo sapien
cactgaatcttgtgtacctgtgact

SEQ ID NO: 40872 - DNA, 25 bp, Homo sapien
cactgaattaccatatgtcccagca

SEQ ID NO: 40873 - DNA, 25 bp, Homo sapien
cactgaattaccgtatgtcccagca

SEQ ID NO: 40874 - DNA, 25 bp, Homo sapien
cactgaattttgtgtacctgtgact

SEQ ID NO: 40875 - DNA, 25 bp, Homo sapien
cactgacagcaatacatttccctct

SEQ ID NO: 40876 - DNA, 25 bp, Homo sapien
cactgacagcaatgcatttccctct

SEQ ID NO: 40877 - DNA, 25 bp, Homo sapien
cactgacagtattagacagaccatc

SEQ ID NO: 40878 - DNA, 25 bp, Homo sapien
cactgacagtattagatagaccatc

SEQ ID NO: 40879 - DNA, 25 bp, Homo sapien
cactgacatgtttcctcactttctt

SEQ ID NO: 40880 - DNA, 25 bp, Homo sapien
cactgacatttttcctcactttctt

SEQ ID NO: 40881 - DNA, 25 bp, Homo sapien
cactgagttattcttgagaatccta

SEQ ID NO: 40882 - DNA, 25 bp, Homo sapien
cactgagttatttttgagaatccta

SEQ ID NO: 40883 - DNA, 25 bp, Homo sapien
cactgatgactgttataattttagg

SEQ ID NO: 40884 - DNA, 25 bp, Homo sapien
cactgatggctgttataattttagg

SEQ ID NO: 40885 - DNA, 25 bp, Homo sapien
cactgatgtaaacgtacaaaattca

SEQ ID NO: 40886 - DNA, 25 bp, Homo sapien
cactgatgtaaatgtacaaaattca

SEQ ID NO: 40887 - DNA, 25 bp, Homo sapien
cactgattcctaacagggttatttt

SEQ ID NO: 40888 - DNA, 25 bp, Homo sapien
cactgattcctagcagggttatttt

SEQ ID NO: 40889 - DNA, 25 bp, Homo sapien
cactgattgtccagaattcagacca

SEQ ID NO: 40890 - DNA, 25 bp, Homo sapien
cactgattgtccggaattcagacca

SEQ ID NO: 40891 - DNA, 25 bp, Homo sapien
cactgcaaacatacttcttccagat

SEQ ID NO: 40892 - DNA, 25 bp, Homo sapien
cactgcaaccatacttcttccagat

SEQ ID NO: 40893 - DNA, 25 bp, Homo sapien
cactgcacaccatcttcctgaacaa

SEQ ID NO: 40894 - DNA, 25 bp, Homo sapien
cactgcacactcgtgaaacagttcc

SEQ ID NO: 40895 - DNA, 25 bp, Homo sapien
cactgcacacttgtgaaacagttcc

SEQ ID NO: 40896 - DNA, 25 bp, Homo sapien
cactgcacgccatcttcctgaacaa

SEQ ID NO: 40897 - DNA, 25 bp, Homo sapien
cactgcactccaacaaacagagcca

SEQ ID NO: 40898 - DNA, 25 bp, Homo sapien
cactgcactccatcaaacagagcca

SEQ ID NO: 40899 - DNA, 25 bp, Homo sapien
cactgcacttgcatgagggacttgg

SEQ ID NO: 40900 - DNA, 25 bp, Homo sapien
cactgcacttgcttgagggacttgg

SEQ ID NO: 40901 - DNA, 25 bp, Homo sapien
cactgcagcaataaggaagtaatac

SEQ ID NO: 40902 - DNA, 25 bp, Homo sapien
cactgcagcaatagggaagtaatac

SEQ ID NO: 40903 - DNA, 25 bp, Homo sapien
cactgcatactactgatctttaaaa

SEQ ID NO: 40904 - DNA, 25 bp, Homo sapien
cactgcatactattgatctttaaaa

SEQ ID NO: 40905 - DNA, 25 bp, Homo sapien
cactgcatgtgctcatgggacacta

SEQ ID NO: 40906 - DNA, 25 bp, Homo sapien
cactgcatgtgctcgtgggacacta

SEQ ID NO: 40907 - DNA, 25 bp, Homo sapien
cactgcattgtcaaacctgaattcc

SEQ ID NO: 40908 - DNA, 25 bp, Homo sapien
cactgcattgtcgaacctgaattcc

SEQ ID NO: 40909 - DNA, 25 bp, Homo sapien
cactgcatttggacccacaggtaat

SEQ ID NO: 40910 - DNA, 25 bp, Homo sapien
cactgcatttggacccgcaggtaat

SEQ ID NO: 40911 - DNA, 25 bp, Homo sapien
cactgcctagctaacacaggaaatt

SEQ ID NO: 40912 - DNA, 25 bp, Homo sapien
cactgcctagctgacacaggaaatt

SEQ ID NO: 40913 - DNA, 25 bp, Homo sapien
cactgcgtaacagcaaaccacttca

SEQ ID NO: 40914 - DNA, 25 bp, Homo sapien
cactgcgtaacagtaaaccacttca

SEQ ID NO: 40915 - DNA, 25 bp, Homo sapien
cactgcgtgcacaccgggctctgca

SEQ ID NO: 40916 - DNA, 25 bp, Homo sapien
cactgcgtgcacactgggctctgca

SEQ ID NO: 40917 - DNA, 25 bp, Homo sapien
cactgctaactctagctaaccatct

SEQ ID NO: 40918 - DNA, 25 bp, Homo sapien
cactgctaactctggctaaccatct

SEQ ID NO: 40919 - DNA, 25 bp, Homo sapien
cactgctataggtaaagggacatac

SEQ ID NO: 40920 - DNA, 25 bp, Homo sapien
cactgctataggtaaatggacatac

SEQ ID NO: 40921 - DNA, 25 bp, Homo sapien
cactgctgctttcctatgattggtt

SEQ ID NO: 40922 - DNA, 25 bp, Homo sapien
cactgctgttttcctatgattggtt

SEQ ID NO: 40923 - DNA, 25 bp, Homo sapien
cactgcttagcataataattggcat

SEQ ID NO: 40924 - DNA, 25 bp, Homo sapien
cactgcttagcatagtaattggcat

SEQ ID NO: 40925 - DNA, 25 bp, Homo sapien
cactgcttctggttgaatcatgaca

SEQ ID NO: 40926 - DNA, 25 bp, Homo sapien
cactgctttcagagctgcatttacc

SEQ ID NO: 40927 - DNA, 25 bp, Homo sapien
cactgctttcagagcttcatttacc

SEQ ID NO: 40928 - DNA, 25 bp, Homo sapien
cactgcttttggttgaatcatgaca

SEQ ID NO: 40929 - DNA, 25 bp, Homo sapien
cactggaaagcatccgacttcttaa

SEQ ID NO: 40930 - DNA, 25 bp, Homo sapien
cactggaaagcatccggcttcttaa

SEQ ID NO: 40931 - DNA, 25 bp, Homo sapien
cactggaatcagatgttcccaacct

SEQ ID NO: 40932 - DNA, 25 bp, Homo sapien
cactggaatcaggtgttcccaacct

SEQ ID NO: 40933 - DNA, 25 bp, Homo sapien
cactggaattataacagacatgtgc

SEQ ID NO: 40934 - DNA, 25 bp, Homo sapien
cactggaattataatagacatgtgc

SEQ ID NO: 40935 - DNA, 25 bp, Homo sapien
cactggacaatcgaacaatgtgatt

SEQ ID NO: 40936 - DNA, 25 bp, Homo sapien
cactggacaatctaacaatgtgatt

SEQ ID NO: 40937 - DNA, 25 bp, Homo sapien
cactggacaatttacataagggtat

SEQ ID NO: 40938 - DNA, 25 bp, Homo sapien
cactggacaatttagataagggtat

SEQ ID NO: 40939 - DNA, 25 bp, Homo sapien
cactggagagtccgcagtgaccaat

SEQ ID NO: 40940 - DNA, 25 bp, Homo sapien
cactggagagtctgcagtgaccaat

SEQ ID NO: 40941 - DNA, 25 bp, Homo sapien
cactggagtacgaaaaaaaactcct

SEQ ID NO: 40942 - DNA, 25 bp, Homo sapien
cactggagtacgaaaacaaactcct

SEQ ID NO: 40943 - DNA, 25 bp, Homo sapien
cactggccatccagaactaatgccc

SEQ ID NO: 40944 - DNA, 25 bp, Homo sapien
cactggccatccggaactaatgccc

SEQ ID NO: 40945 - DNA, 25 bp, Homo sapien
cactggggtttcaatcagttcctct

SEQ ID NO: 40946 - DNA, 25 bp, Homo sapien
cactggggtttgaatcagttcctct

SEQ ID NO: 40947 - DNA, 25 bp, Homo sapien
cactggtcaaatccaactggaaccc

SEQ ID NO: 40948 - DNA, 25 bp, Homo sapien
cactggtcaaatccaattggaaccc

SEQ ID NO: 40949 - DNA, 25 bp, Homo sapien
cactggttttgcgggagcaggattt

SEQ ID NO: 40950 - DNA, 25 bp, Homo sapien
cactggttttgtgggagcaggattt

SEQ ID NO: 40951 - DNA, 25 bp, Homo sapien
cactgtaacaaaactgaagggttag

SEQ ID NO: 40952 - DNA, 25 bp, Homo sapien
cactgtaacaaaattgaagggttag

SEQ ID NO: 40953 - DNA, 25 bp, Homo sapien
cactgtaataacgtcactaaagctg

SEQ ID NO: 40954 - DNA, 25 bp, Homo sapien
cactgtaataaggtcactaaagctg

SEQ ID NO: 40955 - DNA, 25 bp, Homo sapien
cactgtacattcaatgttttttggg

SEQ ID NO: 40956 - DNA, 25 bp, Homo sapien
cactgtacattcattgttttttggg

SEQ ID NO: 40957 - DNA, 25 bp, Homo sapien
cactgtagacttttccagataggat

SEQ ID NO: 40958 - DNA, 25 bp, Homo sapien
cactgtagactttttcagataggat

SEQ ID NO: 40959 - DNA, 25 bp, Homo sapien
cactgtatcagctcatcatctgcag

SEQ ID NO: 40960 - DNA, 25 bp, Homo sapien
cactgtatcagctcgtcatctgcag

SEQ ID NO: 40961 - DNA, 25 bp, Homo sapien
cactgtattaagcgtccagtcagat

SEQ ID NO: 40962 - DNA, 25 bp, Homo sapien
cactgtattaagtgtccagtcagat

SEQ ID NO: 40963 - DNA, 25 bp, Homo sapien
cactgtattcacacacttcttttgg

SEQ ID NO: 40964 - DNA, 25 bp, Homo sapien
cactgtattcacatacttcttttgg

SEQ ID NO: 40965 - DNA, 25 bp, Homo sapien
cactgtcaagaccggagtttcagtg

SEQ ID NO: 40966 - DNA, 25 bp, Homo sapien
cactgtcaagacctgagtttcagtg

SEQ ID NO: 40967 - DNA, 25 bp, Homo sapien
cactgtcacctgaatgagactatga

SEQ ID NO: 40968 - DNA, 25 bp, Homo sapien
cactgtcacctgagtgagactatga

SEQ ID NO: 40969 - DNA, 25 bp, Homo sapien
cactgtcacttgtactcacacctga

SEQ ID NO: 40970 - DNA, 25 bp, Homo sapien
cactgtcatttgtactcacacctga

SEQ ID NO: 40971 - DNA, 25 bp, Homo sapien
cactgtctcgactaatgtaccttta

SEQ ID NO: 40972 - DNA, 25 bp, Homo sapien
cactgtcttgactaatgtaccttta

SEQ ID NO: 40973 - DNA, 25 bp, Homo sapien
cactgtgaacacgtttcttgtgtat

SEQ ID NO: 40974 - DNA, 25 bp, Homo sapien
cactgtgaacatgtttcttgtgtat

SEQ ID NO: 40975 - DNA, 25 bp, Homo sapien
cactgtgagaaagtcaggcttcagc

SEQ ID NO: 40976 - DNA, 25 bp, Homo sapien
cactgtgagaaagtcatgcttcagc

SEQ ID NO: 40977 - DNA, 25 bp, Homo sapien
cactgtgaggataagcaagaaaaaa

SEQ ID NO: 40978 - DNA, 25 bp, Homo sapien
cactgtgaggatgagcaagaaaaaa

SEQ ID NO: 40979 - DNA, 25 bp, Homo sapien
cactgtgctaagcagtgaagtcctc

SEQ ID NO: 40980 - DNA, 25 bp, Homo sapien
cactgtgctaagtagtgaagtcctc

SEQ ID NO: 40981 - DNA, 25 bp, Homo sapien
cactgtgctctcaatttcaatacat

SEQ ID NO: 40982 - DNA, 25 bp, Homo sapien
cactgtgctctcgatttcaatacat

SEQ ID NO: 40983 - DNA, 25 bp, Homo sapien
cactgtggatctgtacatttcctta

SEQ ID NO: 40984 - DNA, 25 bp, Homo sapien
cactgtggatctgtacgtttcctta

SEQ ID NO: 40985 - DNA, 25 bp, Homo sapien
cactgtggcaaaataggtggtgttc

SEQ ID NO: 40986 - DNA, 25 bp, Homo sapien
cactgtggcgaaataggtggtgttc

SEQ ID NO: 40987 - DNA, 25 bp, Homo sapien
cactgtggctgcagcaccgccactc

SEQ ID NO: 40988 - DNA, 25 bp, Homo sapien
cactgtggctgcggcaccgccactc

SEQ ID NO: 40989 - DNA, 25 bp, Homo sapien
cactgtggtggattccactgttcct

SEQ ID NO: 40990 - DNA, 25 bp, Homo sapien
cactgtggtggatttcactgttcct

SEQ ID NO: 40991 - DNA, 25 bp, Homo sapien
cactgttcaatgtccatattcctac

SEQ ID NO: 40992 - DNA, 25 bp, Homo sapien
cactgttcaatgttcatattcctac

SEQ ID NO: 40993 - DNA, 25 bp, Homo sapien
cactgtttcctcacgtggcagaaag

SEQ ID NO: 40994 - DNA, 25 bp, Homo sapien
cactgtttcctcacttggcagaaag

SEQ ID NO: 40995 - DNA, 25 bp, Homo sapien
cactgtttcgtgtaaggctttttcc

SEQ ID NO: 40996 - DNA, 25 bp, Homo sapien
cactgtttcgttccacacggtatct

SEQ ID NO: 40997 - DNA, 25 bp, Homo sapien
cactgtttctgctctgctccagagg

SEQ ID NO: 40998 - DNA, 25 bp, Homo sapien
cactgtttctgttctgctccagagg

SEQ ID NO: 40999 - DNA, 25 bp, Homo sapien
cactgtttggttccacacggtatct

SEQ ID NO: 41000 - DNA, 25 bp, Homo sapien
cactgttttattcgtccagaaagac

SEQ ID NO: 41001 - DNA, 25 bp, Homo sapien
cactgttttatttgtccagaaagac

SEQ ID NO: 41002 - DNA, 25 bp, Homo sapien
cactgttttcctgaagtgggaagag

SEQ ID NO: 41003 - DNA, 25 bp, Homo sapien
cactgttttgtgtaaggctttttcc

SEQ ID NO: 41004 - DNA, 25 bp, Homo sapien
cactgtttttctgaagtgggaagag

SEQ ID NO: 41005 - DNA, 25 bp, Homo sapien
cacttaaacacacccagtgctcaaa

SEQ ID NO: 41006 - DNA, 25 bp, Homo sapien
cacttaaacacacctagtgctcaaa

SEQ ID NO: 41007 - DNA, 25 bp, Homo sapien
cacttacaaactgcatctcaatttc

SEQ ID NO: 41008 - DNA, 25 bp, Homo sapien
cacttacaaactgtatctcaatttc

SEQ ID NO: 41009 - DNA, 25 bp, Homo sapien
cacttacaattattactaggtgctt

SEQ ID NO: 41010 - DNA, 25 bp, Homo sapien
cacttacaatttttactaggtgctt

SEQ ID NO: 41011 - DNA, 25 bp, Homo sapien
cacttacactctctcacatattcac

SEQ ID NO: 41012 - DNA, 25 bp, Homo sapien
cacttacactctttcacatattcac

SEQ ID NO: 41013 - DNA, 25 bp, Homo sapien
cacttacagacaatcgttatcttgc

SEQ ID NO: 41014 - DNA, 25 bp, Homo sapien
cacttacagacaattgttatcttgc

SEQ ID NO: 41015 - DNA, 25 bp, Homo sapien
cacttaccatgaatagagcttgcag

SEQ ID NO: 41016 - DNA, 25 bp, Homo sapien
cacttaccatgaatggagcttgcag

SEQ ID NO: 41017 - DNA, 25 bp, Homo sapien
cacttaccatttatcatttttgagt

SEQ ID NO: 41018 - DNA, 25 bp, Homo sapien
cacttaccgtttatcatttttgagt

SEQ ID NO: 41019 - DNA, 25 bp, Homo sapien
cacttacctggggatgtaaagacta

SEQ ID NO: 41020 - DNA, 25 bp, Homo sapien
cacttacctgggtatgtaaagacta

SEQ ID NO: 41021 - DNA, 25 bp, Homo sapien
cacttactccatatggttgaatata

SEQ ID NO: 41022 - DNA, 25 bp, Homo sapien
cacttactgcatatggttgaatata

SEQ ID NO: 41023 - DNA, 25 bp, Homo sapien
cacttacttcagtgtctgagcttta

SEQ ID NO: 41024 - DNA, 25 bp, Homo sapien
cacttactttagtgtctgagcttta

SEQ ID NO: 41025 - DNA, 25 bp, Homo sapien
cacttagaagagaccatatatgatt

SEQ ID NO: 41026 - DNA, 25 bp, Homo sapien
cacttagaagaggccatatatgatt

SEQ ID NO: 41027 - DNA, 25 bp, Homo sapien
cacttagcagagacgaaataccaaa

SEQ ID NO: 41028 - DNA, 25 bp, Homo sapien
cacttagcagagatgaaataccaaa

SEQ ID NO: 41029 - DNA, 25 bp, Homo sapien
cacttagctgaaaccaccatataga

SEQ ID NO: 41030 - DNA, 25 bp, Homo sapien
cacttagctgaatccaccatataga

SEQ ID NO: 41031 - DNA, 25 bp, Homo sapien
cacttatagtaaacattttctgttc

SEQ ID NO: 41032 - DNA, 25 bp, Homo sapien
cacttatattaaacattttctgttc

SEQ ID NO: 41033 - DNA, 25 bp, Homo sapien
cacttatccgagtctgctcatctct

SEQ ID NO: 41034 - DNA, 25 bp, Homo sapien
cacttatctgagtctgctcatctct

SEQ ID NO: 41035 - DNA, 25 bp, Homo sapien
cacttatctgtgacaggtataccct

SEQ ID NO: 41036 - DNA, 25 bp, Homo sapien
cacttatctgtggcaggtataccct

SEQ ID NO: 41037 - DNA, 25 bp, Homo sapien
cacttatgccagctcttgaggcagg

SEQ ID NO: 41038 - DNA, 25 bp, Homo sapien
cacttatgtcagctcttgaggcagg

SEQ ID NO: 41039 - DNA, 25 bp, Homo sapien
cacttattgattccacaccacttac

SEQ ID NO: 41040 - DNA, 25 bp, Homo sapien
cacttattgatttcacaccacttac

SEQ ID NO: 41041 - DNA, 25 bp, Homo sapien
cacttcaactgtaaccttttaagag

SEQ ID NO: 41042 - DNA, 25 bp, Homo sapien
cacttcaactgtaatcttttaagag

SEQ ID NO: 41043 - DNA, 25 bp, Homo sapien
cacttcacaactacagagtaaccta

SEQ ID NO: 41044 - DNA, 25 bp, Homo sapien
cacttcacaactgcagagtaaccta

SEQ ID NO: 41045 - DNA, 25 bp, Homo sapien
cacttcaccaacacgtttgccctgt

SEQ ID NO: 41046 - DNA, 25 bp, Homo sapien
cacttcaccaacccgtttgccctgt

SEQ ID NO: 41047 - DNA, 25 bp, Homo sapien
cacttcataagcttcatcagggcag

SEQ ID NO: 41048 - DNA, 25 bp, Homo sapien
cacttcatctccaagaataagtctc

SEQ ID NO: 41049 - DNA, 25 bp, Homo sapien
cacttcatctccaataataagtctc

SEQ ID NO: 41050 - DNA, 25 bp, Homo sapien
cacttcatgagcttcatcagggcag

SEQ ID NO: 41051 - DNA, 25 bp, Homo sapien
cacttcatgcagtaatttcaccctt

SEQ ID NO: 41052 - DNA, 25 bp, Homo sapien
cacttcatgcagtactttcaccctt

SEQ ID NO: 41053 - DNA, 25 bp, Homo sapien
cacttcatgtctatctctattatag

SEQ ID NO: 41054 - DNA, 25 bp, Homo sapien
cacttcattccagcttgagtgacag

SEQ ID NO: 41055 - DNA, 25 bp, Homo sapien
cacttcattccggcttgagtgacag

SEQ ID NO: 41056 - DNA, 25 bp, Homo sapien
cacttcatttctatctctattatag

SEQ ID NO: 41057 - DNA, 25 bp, Homo sapien
cacttcctattggagtcttttggtg

SEQ ID NO: 41058 - DNA, 25 bp, Homo sapien
cacttcctctgcatcactcttaacc

SEQ ID NO: 41059 - DNA, 25 bp, Homo sapien
cacttcctctgcatcattcttaacc

SEQ ID NO: 41060 - DNA, 25 bp, Homo sapien
cacttcctgttggagtcttttggtg

SEQ ID NO: 41061 - DNA, 25 bp, Homo sapien
cacttcgacctggaggccagtggag

SEQ ID NO: 41062 - DNA, 25 bp, Homo sapien
cacttcgacttggaggccagtggag

SEQ ID NO: 41063 - DNA, 25 bp, Homo sapien
cacttctacaacatttaatttagcc

SEQ ID NO: 41064 - DNA, 25 bp, Homo sapien
cacttctactacatttaatttagcc

SEQ ID NO: 41065 - DNA, 25 bp, Homo sapien
cacttctattcatttccttttacat

SEQ ID NO: 41066 - DNA, 25 bp, Homo sapien
cacttctattcatttctttttacat

SEQ ID NO: 41067 - DNA, 25 bp, Homo sapien
cacttctcacttctgcctctgcttc

SEQ ID NO: 41068 - DNA, 25 bp, Homo sapien
cacttctcatgttttcttagcactt

SEQ ID NO: 41069 - DNA, 25 bp, Homo sapien
cacttctcgcttctgcctctgcttc

SEQ ID NO: 41070 - DNA, 25 bp, Homo sapien
cacttctcgtgttttcttagcactt

SEQ ID NO: 41071 - DNA, 25 bp, Homo sapien
cacttctgaaatgcaactttctgga

SEQ ID NO: 41072 - DNA, 25 bp, Homo sapien
cacttctgaaatgcgactttctgga

SEQ ID NO: 41073 - DNA, 25 bp, Homo sapien
cacttctgattttgcatttcatttc

SEQ ID NO: 41074 - DNA, 25 bp, Homo sapien
cacttctgattttgtatttcatttc

SEQ ID NO: 41075 - DNA, 25 bp, Homo sapien
cacttctgccgtcaattacgaagtt

SEQ ID NO: 41076 - DNA, 25 bp, Homo sapien
cacttctgccgtcagttacgaagtt

SEQ ID NO: 41077 - DNA, 25 bp, Homo sapien
cacttctgccttaaccgaagagctc

SEQ ID NO: 41078 - DNA, 25 bp, Homo sapien
cacttctgccttaatcgaagagctc

SEQ ID NO: 41079 - DNA, 25 bp, Homo sapien
cacttgagtagtcactggtaaagag

SEQ ID NO: 41080 - DNA, 25 bp, Homo sapien
cacttgagtagtgactggtaaagag

SEQ ID NO: 41081 - DNA, 25 bp, Homo sapien
cacttgagtgaacgggtgaaaaaca

SEQ ID NO: 41082 - DNA, 25 bp, Homo sapien
cacttgagtgaatgggtgaaaaaca

SEQ ID NO: 41083 - DNA, 25 bp, Homo sapien
cacttgcattatatgccaaatgaaa

SEQ ID NO: 41084 - DNA, 25 bp, Homo sapien
cacttgcattatttgccaaatgaaa

SEQ ID NO: 41085 - DNA, 25 bp, Homo sapien
cacttgctcagaccagaaactctga

SEQ ID NO: 41086 - DNA, 25 bp, Homo sapien
cacttgctcagatcagaaactctga

SEQ ID NO: 41087 - DNA, 25 bp, Homo sapien
cacttgctctttcggaaaggtgtgc

SEQ ID NO: 41088 - DNA, 25 bp, Homo sapien
cacttgctcttttggaaaggtgtgc

SEQ ID NO: 41089 - DNA, 25 bp, Homo sapien
cacttgctgttgtctctgtgcattt

SEQ ID NO: 41090 - DNA, 25 bp, Homo sapien
cacttgcttttctgttacatctatc

SEQ ID NO: 41091 - DNA, 25 bp, Homo sapien
cacttgcttttctgttgcatctatc

SEQ ID NO: 41092 - DNA, 25 bp, Homo sapien
cacttgcttttgtctctgtgcattt

SEQ ID NO: 41093 - DNA, 25 bp, Homo sapien
cacttggaaaacggtaaatgtaatc

SEQ ID NO: 41094 - DNA, 25 bp, Homo sapien
cacttggaaaatggtaaatgtaatc

SEQ ID NO: 41095 - DNA, 25 bp, Homo sapien
cacttggagaacgtttttttgtgtg

SEQ ID NO: 41096 - DNA, 25 bp, Homo sapien
cacttggagaatgtttttttgtgtg

SEQ ID NO: 41097 - DNA, 25 bp, Homo sapien
cacttggcaaaactagtgatggagg

SEQ ID NO: 41098 - DNA, 25 bp, Homo sapien
cacttggcaaagctagtgatggagg

SEQ ID NO: 41099 - DNA, 25 bp, Homo sapien
cacttggctttccgatagcatggga

SEQ ID NO: 41100 - DNA, 25 bp, Homo sapien
cacttggctttctgatagcatggga

SEQ ID NO: 41101 - DNA, 25 bp, Homo sapien
cacttggctttttaagtgatagctt

SEQ ID NO: 41102 - DNA, 25 bp, Homo sapien
cacttggctttttaggtgatagctt

SEQ ID NO: 41103 - DNA, 25 bp, Homo sapien
cacttggtaaaatattggtctatac

SEQ ID NO: 41104 - DNA, 25 bp, Homo sapien
cacttggtagaatattggtctatac

SEQ ID NO: 41105 - DNA, 25 bp, Homo sapien
cacttgtaaagacgagtgatgttat

SEQ ID NO: 41106 - DNA, 25 bp, Homo sapien
cacttgtaaagatgagtgatgttat

SEQ ID NO: 41107 - DNA, 25 bp, Homo sapien
cacttgtcacgtcacaatgttcaac

SEQ ID NO: 41108 - DNA, 25 bp, Homo sapien
cacttgtcatgtcacaatgttcaac

SEQ ID NO: 41109 - DNA, 25 bp, Homo sapien
cacttgttaccctaacactactctg

SEQ ID NO: 41110 - DNA, 25 bp, Homo sapien
cacttgttcagcaatttcctagctg

SEQ ID NO: 41111 - DNA, 25 bp, Homo sapien
cacttgttcagcactttcctagctg

SEQ ID NO: 41112 - DNA, 25 bp, Homo sapien
cacttgttccggctctaatctggtt

SEQ ID NO: 41113 - DNA, 25 bp, Homo sapien
cacttgttctggctctaatctggtt

SEQ ID NO: 41114 - DNA, 25 bp, Homo sapien
cacttgtttccctaacactactctg

SEQ ID NO: 41115 - DNA, 25 bp, Homo sapien
cactttaaatatgtgcaccttattg

SEQ ID NO: 41116 - DNA, 25 bp, Homo sapien
cactttaaatatgtgcgccttattg

SEQ ID NO: 41117 - DNA, 25 bp, Homo sapien
cactttaatctacataacactggaa

SEQ ID NO: 41118 - DNA, 25 bp, Homo sapien
cactttaatctacgtaacactggaa

SEQ ID NO: 41119 - DNA, 25 bp, Homo sapien
cactttactaacaaccatattaata

SEQ ID NO: 41120 - DNA, 25 bp, Homo sapien
cactttactaacaagcatattaata

SEQ ID NO: 41121 - DNA, 25 bp, Homo sapien
cactttatacctactgacctggcgt

SEQ ID NO: 41122 - DNA, 25 bp, Homo sapien
cactttatacctactgccctggcgt

SEQ ID NO: 41123 - DNA, 25 bp, Homo sapien
cactttcaaatacagagaggccctc

SEQ ID NO: 41124 - DNA, 25 bp, Homo sapien
cactttcaaatagagagaggccctc

SEQ ID NO: 41125 - DNA, 25 bp, Homo sapien
cactttcacctgggttatctcattc

SEQ ID NO: 41126 - DNA, 25 bp, Homo sapien
cactttcacctgtgttatctcattc

SEQ ID NO: 41127 - DNA, 25 bp, Homo sapien
cactttcatatcaaatatatcactt

SEQ ID NO: 41128 - DNA, 25 bp, Homo sapien
cactttcatgtcaaatatatcactt

SEQ ID NO: 41129 - DNA, 25 bp, Homo sapien
cactttccaaaggcaggtggttcta

SEQ ID NO: 41130 - DNA, 25 bp, Homo sapien
cactttccaaaggcagttggttcta

SEQ ID NO: 41131 - DNA, 25 bp, Homo sapien
cactttccacagatttttgctcatg

SEQ ID NO: 41132 - DNA, 25 bp, Homo sapien
cactttccacagctttttgctcatg

SEQ ID NO: 41133 - DNA, 25 bp, Homo sapien
cactttccatagaactctagcttgt

SEQ ID NO: 41134 - DNA, 25 bp, Homo sapien
cactttcccaatatccctggaggaa

SEQ ID NO: 41135 - DNA, 25 bp, Homo sapien
cactttcccgatatccctggaggaa

SEQ ID NO: 41136 - DNA, 25 bp, Homo sapien
cactttccgtagaactctagcttgt

SEQ ID NO: 41137 - DNA, 25 bp, Homo sapien
cactttctctcttacctcttgttca

SEQ ID NO: 41138 - DNA, 25 bp, Homo sapien
cactttcttaacagtgttttttgaa

SEQ ID NO: 41139 - DNA, 25 bp, Homo sapien
cactttcttaacggtgttttttgaa

SEQ ID NO: 41140 - DNA, 25 bp, Homo sapien
cactttcttaccatacacgacaggg

SEQ ID NO: 41141 - DNA, 25 bp, Homo sapien
cactttcttaccgtacacgacaggg

SEQ ID NO: 41142 - DNA, 25 bp, Homo sapien
cactttctttcttacctcttgttca

SEQ ID NO: 41143 - DNA, 25 bp, Homo sapien
cactttgatttcagatttctaacct

SEQ ID NO: 41144 - DNA, 25 bp, Homo sapien
cactttgatttcagctttctaacct

SEQ ID NO: 41145 - DNA, 25 bp, Homo sapien
cactttgcaacatttgaacaatgat

SEQ ID NO: 41146 - DNA, 25 bp, Homo sapien
cactttgcaacatttggacaatgat

SEQ ID NO: 41147 - DNA, 25 bp, Homo sapien
cactttgccgaacatggatcacagt

SEQ ID NO: 41148 - DNA, 25 bp, Homo sapien
cactttgctgaacatggatcacagt

SEQ ID NO: 41149 - DNA, 25 bp, Homo sapien
cactttggcttttaacaacatggta

SEQ ID NO: 41150 - DNA, 25 bp, Homo sapien
cactttggctttttacaacatggta

SEQ ID NO: 41151 - DNA, 25 bp, Homo sapien
cactttgggagactgcagttggagg

SEQ ID NO: 41152 - DNA, 25 bp, Homo sapien
cactttgggagactgcggttggagg

SEQ ID NO: 41153 - DNA, 25 bp, Homo sapien
cactttgtcacatgccagatactat

SEQ ID NO: 41154 - DNA, 25 bp, Homo sapien
cactttgtcacttgccagatactat

SEQ ID NO: 41155 - DNA, 25 bp, Homo sapien
cactttgtcagagccttatcccagc

SEQ ID NO: 41156 - DNA, 25 bp, Homo sapien
cactttgtcagatccttatcccagc

SEQ ID NO: 41157 - DNA, 25 bp, Homo sapien
cactttgtcctcactcggtctttcc

SEQ ID NO: 41158 - DNA, 25 bp, Homo sapien
cactttgtgccactctgatgctaac

SEQ ID NO: 41159 - DNA, 25 bp, Homo sapien
cactttgtgtcactctgatgctaac

SEQ ID NO: 41160 - DNA, 25 bp, Homo sapien
cactttgttctcactcggtctttcc

SEQ ID NO: 41161 - DNA, 25 bp, Homo sapien
cacttttctatagttactgaacatt

SEQ ID NO: 41162 - DNA, 25 bp, Homo sapien
cacttttctatagttattgaacatt

SEQ ID NO: 41163 - DNA, 25 bp, Homo sapien
cacttttgatttcctctttaactca

SEQ ID NO: 41164 - DNA, 25 bp, Homo sapien
cacttttgatttcttctttaactca

SEQ ID NO: 41165 - DNA, 25 bp, Homo sapien
cacttttgcagaataatttcgcagg

SEQ ID NO: 41166 - DNA, 25 bp, Homo sapien
cacttttgccatggtcctggtgtgt

SEQ ID NO: 41167 - DNA, 25 bp, Homo sapien
cacttttgccattgtcctggtgtgt

SEQ ID NO: 41168 - DNA, 25 bp, Homo sapien
cacttttgcggaataatttcgcagg

SEQ ID NO: 41169 - DNA, 25 bp, Homo sapien
cacttttgttctgaggatagtggcc

SEQ ID NO: 41170 - DNA, 25 bp, Homo sapien
cacttttgttctgagggtagtggcc

SEQ ID NO: 41171 - DNA, 25 bp, Homo sapien
cactttttaaatgaagtttcacaat

SEQ ID NO: 41172 - DNA, 25 bp, Homo sapien
cactttttctcaacgtatcaataac

SEQ ID NO: 41173 - DNA, 25 bp, Homo sapien
cactttttctcaatgtatcaataac

SEQ ID NO: 41174 - DNA, 25 bp, Homo sapien
cactttttgcccaccttaatgataa

SEQ ID NO: 41175 - DNA, 25 bp, Homo sapien
cactttttgccccccttaatgataa

SEQ ID NO: 41176 - DNA, 25 bp, Homo sapien
cacttttttaatgaagtttcacaat

SEQ ID NO: 41177 - DNA, 25 bp, Homo sapien
cacttttttttgcagtgcatttatt

SEQ ID NO: 41178 - DNA, 25 bp, Homo sapien
cacttttttttgcattgcatttatt

SEQ ID NO: 41179 - DNA, 25 bp, Homo sapien
cagaaaaaaacatcacttgacattc

SEQ ID NO: 41180 - DNA, 25 bp, Homo sapien
cagaaaaaaacatcccttgacattc

SEQ ID NO: 41181 - DNA, 25 bp, Homo sapien
cagaaaaaaatgttccctctgagag

SEQ ID NO: 41182 - DNA, 25 bp, Homo sapien
cagaaaaaacaaagctggaaaacag

SEQ ID NO: 41183 - DNA, 25 bp, Homo sapien
cagaaaaaattgttccctctgagag

SEQ ID NO: 41184 - DNA, 25 bp, Homo sapien
cagaaaaacgccaggacccaagaga

SEQ ID NO: 41185 - DNA, 25 bp, Homo sapien
cagaaaaacttctggtactcattag

SEQ ID NO: 41186 - DNA, 25 bp, Homo sapien
cagaaaaacttctgttactcattag

SEQ ID NO: 41187 - DNA, 25 bp, Homo sapien
cagaaaaagaccacctaagatcagg

SEQ ID NO: 41188 - DNA, 25 bp, Homo sapien
cagaaaaagaccgcctaagatcagg

SEQ ID NO: 41189 - DNA, 25 bp, Homo sapien
cagaaaaagactagaccaggtgtca

SEQ ID NO: 41190 - DNA, 25 bp, Homo sapien
cagaaaaagcaaagctggaaaacag

SEQ ID NO: 41191 - DNA, 25 bp, Homo sapien
cagaaaaatactagaccaggtgtca

SEQ ID NO: 41192 - DNA, 25 bp, Homo sapien
cagaaaaatatagaaggaaactgaa

SEQ ID NO: 41193 - DNA, 25 bp, Homo sapien
cagaaaaatatagagggaaactgaa

SEQ ID NO: 41194 - DNA, 25 bp, Homo sapien
cagaaaaatgccaggacccaagaga

SEQ ID NO: 41195 - DNA, 25 bp, Homo sapien
cagaaaacaatcataaagaaggcaa

SEQ ID NO: 41196 - DNA, 25 bp, Homo sapien
cagaaaacaatcgtaaagaaggcaa

SEQ ID NO: 41197 - DNA, 25 bp, Homo sapien
cagaaaacaccatttatagtcatgc

SEQ ID NO: 41198 - DNA, 25 bp, Homo sapien
cagaaaacaccctttatagtcatgc

SEQ ID NO: 41199 - DNA, 25 bp, Homo sapien
cagaaaacactagtcagccatcttt

SEQ ID NO: 41200 - DNA, 25 bp, Homo sapien
cagaaaaccggcattctggctgttg

SEQ ID NO: 41201 - DNA, 25 bp, Homo sapien
cagaaaacgctagtcagccatcttt

SEQ ID NO: 41202 - DNA, 25 bp, Homo sapien
cagaaaactgaaacatctgtactgt

SEQ ID NO: 41203 - DNA, 25 bp, Homo sapien
cagaaaactgaaacgtctgtactgt

SEQ ID NO: 41204 - DNA, 25 bp, Homo sapien
cagaaaactggcattctggctgttg

SEQ ID NO: 41205 - DNA, 25 bp, Homo sapien
cagaaaagactgatgagtactgtga

SEQ ID NO: 41206 - DNA, 25 bp, Homo sapien
cagaaaagactggtgagtactgtga

SEQ ID NO: 41207 - DNA, 25 bp, Homo sapien
cagaaaagcacggttggctgtagcc

SEQ ID NO: 41208 - DNA, 25 bp, Homo sapien
cagaaaagcactgttggctgtagcc

SEQ ID NO: 41209 - DNA, 25 bp, Homo sapien
cagaaaagcatcagatctgggaaaa

SEQ ID NO: 41210 - DNA, 25 bp, Homo sapien
cagaaaagcattagatctgggaaaa

SEQ ID NO: 41211 - DNA, 25 bp, Homo sapien
cagaaaagtctcagtgttttaggat

SEQ ID NO: 41212 - DNA, 25 bp, Homo sapien
cagaaaagtctcggtgttttaggat

SEQ ID NO: 41213 - DNA, 25 bp, Homo sapien
cagaaaataagggacaaatattgca

SEQ ID NO: 41214 - DNA, 25 bp, Homo sapien
cagaaaataagggagaaatattgca

SEQ ID NO: 41215 - DNA, 25 bp, Homo sapien
cagaaaatagtgaaaaatgaaaatc

SEQ ID NO: 41216 - DNA, 25 bp, Homo sapien
cagaaaatagtgagaaatgaaaatc

SEQ ID NO: 41217 - DNA, 25 bp, Homo sapien
cagaaaatcgtaagtagctgaattt

SEQ ID NO: 41218 - DNA, 25 bp, Homo sapien
cagaaaatgaacgaatgtgccttga

SEQ ID NO: 41219 - DNA, 25 bp, Homo sapien
cagaaaatgaatgaatgtgccttga

SEQ ID NO: 41220 - DNA, 25 bp, Homo sapien
cagaaaatgcggttttgttttctat

SEQ ID NO: 41221 - DNA, 25 bp, Homo sapien
cagaaaatggacatttgttagtttt

SEQ ID NO: 41222 - DNA, 25 bp, Homo sapien
cagaaaatgtggttttgttttctat

SEQ ID NO: 41223 - DNA, 25 bp, Homo sapien
cagaaaattgacatttgttagtttt

SEQ ID NO: 41224 - DNA, 25 bp, Homo sapien
cagaaaattgtaagtagctgaattt

SEQ ID NO: 41225 - DNA, 25 bp, Homo sapien
cagaaacaattaacaatatggcgtt

SEQ ID NO: 41226 - DNA, 25 bp, Homo sapien
cagaaacaattaaccatatggcgtt

SEQ ID NO: 41227 - DNA, 25 bp, Homo sapien
cagaaacaatttgaaccttagcttg

SEQ ID NO: 41228 - DNA, 25 bp, Homo sapien
cagaaacacaaaatgagggtgacaa

SEQ ID NO: 41229 - DNA, 25 bp, Homo sapien
cagaaacacaaattgagggtgacaa

SEQ ID NO: 41230 - DNA, 25 bp, Homo sapien
cagaaacacagcgagtggccctgtg

SEQ ID NO: 41231 - DNA, 25 bp, Homo sapien
cagaaacacagtgagtggccctgtg

SEQ ID NO: 41232 - DNA, 25 bp, Homo sapien
cagaaacaggtggcatctttggtag

SEQ ID NO: 41233 - DNA, 25 bp, Homo sapien
cagaaacagttggcatctttggtag

SEQ ID NO: 41234 - DNA, 25 bp, Homo sapien
cagaaacagtttgaaccttagcttg

SEQ ID NO: 41235 - DNA, 25 bp, Homo sapien
cagaaacatgtaataggccctctac

SEQ ID NO: 41236 - DNA, 25 bp, Homo sapien
cagaaacatttaataggccctctac

SEQ ID NO: 41237 - DNA, 25 bp, Homo sapien
cagaaacggacccagcagagcagga

SEQ ID NO: 41238 - DNA, 25 bp, Homo sapien
cagaaacggactcagcagagcagga

SEQ ID NO: 41239 - DNA, 25 bp, Homo sapien
cagaaactagttcactcgaaaatgc

SEQ ID NO: 41240 - DNA, 25 bp, Homo sapien
cagaaactagttcacttgaaaatgc

SEQ ID NO: 41241 - DNA, 25 bp, Homo sapien
cagaaactcaataaatacttgctag

SEQ ID NO: 41242 - DNA, 25 bp, Homo sapien
cagaaactcaatgaatacttgctag

SEQ ID NO: 41243 - DNA, 25 bp, Homo sapien
cagaaagacagaaacagacaggaac

SEQ ID NO: 41244 - DNA, 25 bp, Homo sapien
cagaaagacagaaatagacaggaac

SEQ ID NO: 41245 - DNA, 25 bp, Homo sapien
cagaaagacagaacagagaaaatgg

SEQ ID NO: 41246 - DNA, 25 bp, Homo sapien
cagaaagacgcatggagagttgttg

SEQ ID NO: 41247 - DNA, 25 bp, Homo sapien
cagaaagacggaacagagaaaatgg

SEQ ID NO: 41248 - DNA, 25 bp, Homo sapien
cagaaagagctttcaataaaatcaa

SEQ ID NO: 41249 - DNA, 25 bp, Homo sapien
cagaaagaggttgggtcttagtgtc

SEQ ID NO: 41250 - DNA, 25 bp, Homo sapien
cagaaagagtttgggtcttagtgtc

SEQ ID NO: 41251 - DNA, 25 bp, Homo sapien
cagaaagagttttcaataaaatcaa

SEQ ID NO: 41252 - DNA, 25 bp, Homo sapien
cagaaagatgcatggagagttgttg

SEQ ID NO: 41253 - DNA, 25 bp, Homo sapien
cagaaagctaaataaacgcctatgt

SEQ ID NO: 41254 - DNA, 25 bp, Homo sapien
cagaaagctaaataaatgcctatgt

SEQ ID NO: 41255 - DNA, 25 bp, Homo sapien
cagaaaggtcttgcctctaaagccc

SEQ ID NO: 41256 - DNA, 25 bp, Homo sapien
cagaaaggtcttgtctctaaagccc

SEQ ID NO: 41257 - DNA, 25 bp, Homo sapien
cagaaaggttattagagatagttgg

SEQ ID NO: 41258 - DNA, 25 bp, Homo sapien
cagaaaggttattggagatagttgg

SEQ ID NO: 41259 - DNA, 25 bp, Homo sapien
cagaaagtaacccgaggacttgaag

SEQ ID NO: 41260 - DNA, 25 bp, Homo sapien
cagaaagtaacctgaggacttgaag

SEQ ID NO: 41261 - DNA, 25 bp, Homo sapien
cagaaagtaggtctgagcagtgaaa

SEQ ID NO: 41262 - DNA, 25 bp, Homo sapien
cagaaagtaggtttgagcagtgaaa

SEQ ID NO: 41263 - DNA, 25 bp, Homo sapien
cagaaagtgatcatcaatttaaatc

SEQ ID NO: 41264 - DNA, 25 bp, Homo sapien
cagaaagtgatcatcattttaaatc

SEQ ID NO: 41265 - DNA, 25 bp, Homo sapien
cagaaagttctcagtagattggtcg

SEQ ID NO: 41266 - DNA, 25 bp, Homo sapien
cagaaagttctcggtagattggtcg

SEQ ID NO: 41267 - DNA, 25 bp, Homo sapien
cagaaagtttatggcaataataggt

SEQ ID NO: 41268 - DNA, 25 bp, Homo sapien
cagaaagtttatgggaataataggt

SEQ ID NO: 41269 - DNA, 25 bp, Homo sapien
cagaaataatgttttccaataattc

SEQ ID NO: 41270 - DNA, 25 bp, Homo sapien
cagaaatagctgcaaagttacaaat

SEQ ID NO: 41271 - DNA, 25 bp, Homo sapien
cagaaatagctgcatagttacaaat

SEQ ID NO: 41272 - DNA, 25 bp, Homo sapien
cagaaatagtgttttccaataattc

SEQ ID NO: 41273 - DNA, 25 bp, Homo sapien
cagaaatattgtcacatctaatttg

SEQ ID NO: 41274 - DNA, 25 bp, Homo sapien
cagaaatattgtcccatctaatttg

SEQ ID NO: 41275 - DNA, 25 bp, Homo sapien
cagaaatcaattatgcctgtgttgt

SEQ ID NO: 41276 - DNA, 25 bp, Homo sapien
cagaaatcaggctacggttccagct

SEQ ID NO: 41277 - DNA, 25 bp, Homo sapien
cagaaatcaggctatggttccagct

SEQ ID NO: 41278 - DNA, 25 bp, Homo sapien
cagaaatcagtaacaaagcctatat

SEQ ID NO: 41279 - DNA, 25 bp, Homo sapien
cagaaatcagtaaccaagcctatat

SEQ ID NO: 41280 - DNA, 25 bp, Homo sapien
cagaaatcagttatgcctgtgttgt

SEQ ID NO: 41281 - DNA, 25 bp, Homo sapien
cagaaatccaacaaagaatggaaat

SEQ ID NO: 41282 - DNA, 25 bp, Homo sapien
cagaaatccaagaaagaatggaaat

SEQ ID NO: 41283 - DNA, 25 bp, Homo sapien
cagaaatgaagaagctgcataatga

SEQ ID NO: 41284 - DNA, 25 bp, Homo sapien
cagaaatgaagaagttgcataatga

SEQ ID NO: 41285 - DNA, 25 bp, Homo sapien
cagaaatgagcaggcttggtggcag

SEQ ID NO: 41286 - DNA, 25 bp, Homo sapien
cagaaatgatgttggtatcactact

SEQ ID NO: 41287 - DNA, 25 bp, Homo sapien
cagaaatgatgtttgtatcactact

SEQ ID NO: 41288 - DNA, 25 bp, Homo sapien
cagaaatgcagtaggtagtctcttt

SEQ ID NO: 41289 - DNA, 25 bp, Homo sapien
cagaaatgcagtaggtggtctcttt

SEQ ID NO: 41290 - DNA, 25 bp, Homo sapien
cagaaatgccaacggctacagacaa

SEQ ID NO: 41291 - DNA, 25 bp, Homo sapien
cagaaatgccaatggctacagacaa

SEQ ID NO: 41292 - DNA, 25 bp, Homo sapien
cagaaatgtgcaggcttggtggcag

SEQ ID NO: 41293 - DNA, 25 bp, Homo sapien
cagaaatgtgcttgcagagaggaaa

SEQ ID NO: 41294 - DNA, 25 bp, Homo sapien
cagaaatgtgcttgcatagaggaaa

SEQ ID NO: 41295 - DNA, 25 bp, Homo sapien
cagaaatttggggaagttgataaaa

SEQ ID NO: 41296 - DNA, 25 bp, Homo sapien
cagaaatttgggtaagttgataaaa

SEQ ID NO: 41297 - DNA, 25 bp, Homo sapien
cagaacaaaaacagagaaaaggcaa

SEQ ID NO: 41298 - DNA, 25 bp, Homo sapien
cagaacaaaaatagagaaaaggcaa

SEQ ID NO: 41299 - DNA, 25 bp, Homo sapien
cagaacaaaatcattcaagcccatg

SEQ ID NO: 41300 - DNA, 25 bp, Homo sapien
cagaacaaaatcgttcaagcccatg

SEQ ID NO: 41301 - DNA, 25 bp, Homo sapien
cagaacacagtgacacgtttctgag

SEQ ID NO: 41302 - DNA, 25 bp, Homo sapien
cagaacacagtgacacttttctgag

SEQ ID NO: 41303 - DNA, 25 bp, Homo sapien
cagaacaccaagcaccatgtgttct

SEQ ID NO: 41304 - DNA, 25 bp, Homo sapien
cagaacaccaagcaccgtgtgttct

SEQ ID NO: 41305 - DNA, 25 bp, Homo sapien
cagaacaccctgagagcattttgag

SEQ ID NO: 41306 - DNA, 25 bp, Homo sapien
cagaacaccctgagtgcattttgag

SEQ ID NO: 41307 - DNA, 25 bp, Homo sapien
cagaacactagcagcgagaaagagt

SEQ ID NO: 41308 - DNA, 25 bp, Homo sapien
cagaacactagcggcgagaaagagt

SEQ ID NO: 41309 - DNA, 25 bp, Homo sapien
cagaacagctggatccaagtattca

SEQ ID NO: 41310 - DNA, 25 bp, Homo sapien
cagaacaggtggatccaagtattca

SEQ ID NO: 41311 - DNA, 25 bp, Homo sapien
cagaacatactccttataaatgcta

SEQ ID NO: 41312 - DNA, 25 bp, Homo sapien
cagaacatgctccttataaatgcta

SEQ ID NO: 41313 - DNA, 25 bp, Homo sapien
cagaaccacgagctaattaatggtg

SEQ ID NO: 41314 - DNA, 25 bp, Homo sapien
cagaaccatgagctaattaatggtg

SEQ ID NO: 41315 - DNA, 25 bp, Homo sapien
cagaacccaaggctcaattttaatc

SEQ ID NO: 41316 - DNA, 25 bp, Homo sapien
cagaacccgaggctcaattttaatc

SEQ ID NO: 41317 - DNA, 25 bp, Homo sapien
cagaacgacgcagttgaaggaggaa

SEQ ID NO: 41318 - DNA, 25 bp, Homo sapien
cagaacgatgcagttgaaggaggaa

SEQ ID NO: 41319 - DNA, 25 bp, Homo sapien
cagaacgcatagaacagttgtgagg

SEQ ID NO: 41320 - DNA, 25 bp, Homo sapien
cagaacgcatataacagttgtgagg

SEQ ID NO: 41321 - DNA, 25 bp, Homo sapien
cagaacgtagtctatgctggacact

SEQ ID NO: 41322 - DNA, 25 bp, Homo sapien
cagaacgtagtctatgttggacact

SEQ ID NO: 41323 - DNA, 25 bp, Homo sapien
cagaacgttgtttctacgagtagag

SEQ ID NO: 41324 - DNA, 25 bp, Homo sapien
cagaacgttgtttctatgagtagag

SEQ ID NO: 41325 - DNA, 25 bp, Homo sapien
cagaactaaattatgattatatctg

SEQ ID NO: 41326 - DNA, 25 bp, Homo sapien
cagaactaaattctgattatatctg

SEQ ID NO: 41327 - DNA, 25 bp, Homo sapien
cagaactatccaaagaaggcataag

SEQ ID NO: 41328 - DNA, 25 bp, Homo sapien
cagaactatccaaagatggcataag

SEQ ID NO: 41329 - DNA, 25 bp, Homo sapien
cagaagaaaaagataacagccaatt

SEQ ID NO: 41330 - DNA, 25 bp, Homo sapien
cagaagaaaactttccagcaagtag

SEQ ID NO: 41331 - DNA, 25 bp, Homo sapien
cagaagaaacctttccagcaagtag

SEQ ID NO: 41332 - DNA, 25 bp, Homo sapien
cagaagaaattacttgaaagttagc

SEQ ID NO: 41333 - DNA, 25 bp, Homo sapien
cagaagaacaaccacagatgcaagg

SEQ ID NO: 41334 - DNA, 25 bp, Homo sapien
cagaagaacaactacagatgcaagg

SEQ ID NO: 41335 - DNA, 25 bp, Homo sapien
cagaagaagaagataacagccaatt

SEQ ID NO: 41336 - DNA, 25 bp, Homo sapien
cagaagaagagagaagtcagggtat

SEQ ID NO: 41337 - DNA, 25 bp, Homo sapien
cagaagaagagggaagtcagggtat

SEQ ID NO: 41338 - DNA, 25 bp, Homo sapien
cagaagaaggcatccttgaagtcca

SEQ ID NO: 41339 - DNA, 25 bp, Homo sapien
cagaagaaggcgtccttgaagtcca

SEQ ID NO: 41340 - DNA, 25 bp, Homo sapien
cagaagaagttacttgaaagttagc

SEQ ID NO: 41341 - DNA, 25 bp, Homo sapien
cagaagaattccaaataatcatgga

SEQ ID NO: 41342 - DNA, 25 bp, Homo sapien
cagaagaattccgaataatcatgga

SEQ ID NO: 41343 - DNA, 25 bp, Homo sapien
cagaagacaagagaagcctgtaaat

SEQ ID NO: 41344 - DNA, 25 bp, Homo sapien
cagaagacaagagaaggctgtaaat

SEQ ID NO: 41345 - DNA, 25 bp, Homo sapien
cagaagacatctgcaggttctaatg

SEQ ID NO: 41346 - DNA, 25 bp, Homo sapien
cagaagacatctggaggttctaatg

SEQ ID NO: 41347 - DNA, 25 bp, Homo sapien
cagaagagacaagctgagaaaagaa

SEQ ID NO: 41348 - DNA, 25 bp, Homo sapien
cagaagagacaatctgagaaaagaa

SEQ ID NO: 41349 - DNA, 25 bp, Homo sapien
cagaagagagaaagcaatgtgacaa

SEQ ID NO: 41350 - DNA, 25 bp, Homo sapien
cagaagagagaaagcagtgtgacaa

SEQ ID NO: 41351 - DNA, 25 bp, Homo sapien
cagaagagtaacgataactgttctt

SEQ ID NO: 41352 - DNA, 25 bp, Homo sapien
cagaagagtaatgataactgttctt

SEQ ID NO: 41353 - DNA, 25 bp, Homo sapien
cagaagatgaaagacgcttaataat

SEQ ID NO: 41354 - DNA, 25 bp, Homo sapien
cagaagatgaaagatgcttaataat

SEQ ID NO: 41355 - DNA, 25 bp, Homo sapien
cagaagattcttgcactcaaccatg

SEQ ID NO: 41356 - DNA, 25 bp, Homo sapien
cagaagattcttgccctcaaccatg

SEQ ID NO: 41357 - DNA, 25 bp, Homo sapien
cagaagcattgccagtgctaagagt

SEQ ID NO: 41358 - DNA, 25 bp, Homo sapien
cagaagcattgtcagtgctaagagt

SEQ ID NO: 41359 - DNA, 25 bp, Homo sapien
cagaagctaatcataaagtggaccc

SEQ ID NO: 41360 - DNA, 25 bp, Homo sapien
cagaagctaatcgtaaagtggaccc

SEQ ID NO: 41361 - DNA, 25 bp, Homo sapien
cagaagctacggtacatttctatat

SEQ ID NO: 41362 - DNA, 25 bp, Homo sapien
cagaagctacggtatatttctatat

SEQ ID NO: 41363 - DNA, 25 bp, Homo sapien
cagaagctccgcaagaaacatgaca

SEQ ID NO: 41364 - DNA, 25 bp, Homo sapien
cagaagcttcgcaagaaacatgaca

SEQ ID NO: 41365 - DNA, 25 bp, Homo sapien
cagaaggaacctcagcaaatttttt

SEQ ID NO: 41366 - DNA, 25 bp, Homo sapien
cagaaggaacctcggcaaatttttt

SEQ ID NO: 41367 - DNA, 25 bp, Homo sapien
cagaagggatgtatatgtaatttta

SEQ ID NO: 41368 - DNA, 25 bp, Homo sapien
cagaagggccactccaaactcttga

SEQ ID NO: 41369 - DNA, 25 bp, Homo sapien
cagaagggccactctaaactcttga

SEQ ID NO: 41370 - DNA, 25 bp, Homo sapien
cagaagggcttctccaggaatgctc

SEQ ID NO: 41371 - DNA, 25 bp, Homo sapien
cagaagggttgtatatgtaatttta

SEQ ID NO: 41372 - DNA, 25 bp, Homo sapien
cagaagggtttctccaggaatgctc

SEQ ID NO: 41373 - DNA, 25 bp, Homo sapien
cagaaggtagacatttactctcccc

SEQ ID NO: 41374 - DNA, 25 bp, Homo sapien
cagaaggtagacgtttactctcccc

SEQ ID NO: 41375 - DNA, 25 bp, Homo sapien
cagaaggtagagattcagttgctgg

SEQ ID NO: 41376 - DNA, 25 bp, Homo sapien
cagaaggtagaggttcagttgctgg

SEQ ID NO: 41377 - DNA, 25 bp, Homo sapien
cagaaggtggagacatatgtgtcaa

SEQ ID NO: 41378 - DNA, 25 bp, Homo sapien
cagaaggtggagacgtatgtgtcaa

SEQ ID NO: 41379 - DNA, 25 bp, Homo sapien
cagaaggttgtctcatcactgctaa

SEQ ID NO: 41380 - DNA, 25 bp, Homo sapien
cagaaggttgtctcatgactgctaa

SEQ ID NO: 41381 - DNA, 25 bp, Homo sapien
cagaagtaagtttctatgttaggtt

SEQ ID NO: 41382 - DNA, 25 bp, Homo sapien
cagaagtatgtttctatgttaggtt

SEQ ID NO: 41383 - DNA, 25 bp, Homo sapien
cagaagtattaatagcagaagagac

SEQ ID NO: 41384 - DNA, 25 bp, Homo sapien
cagaagtattaatggcagaagagac

SEQ ID NO: 41385 - DNA, 25 bp, Homo sapien
cagaagtgaaaatgatatgtagaat

SEQ ID NO: 41386 - DNA, 25 bp, Homo sapien
cagaagtgaaaattatatgtagaat

SEQ ID NO: 41387 - DNA, 25 bp, Homo sapien
cagaagtgcgcatgcagattttatt

SEQ ID NO: 41388 - DNA, 25 bp, Homo sapien
cagaagtggatgagcagtaaaatga

SEQ ID NO: 41389 - DNA, 25 bp, Homo sapien
cagaagtggatgtgcagtaaaatga

SEQ ID NO: 41390 - DNA, 25 bp, Homo sapien
cagaagtggtcaaaagcagaattta

SEQ ID NO: 41391 - DNA, 25 bp, Homo sapien
cagaagtggtcaaaagtagaattta

SEQ ID NO: 41392 - DNA, 25 bp, Homo sapien
cagaagtggttgcacatggttcttt

SEQ ID NO: 41393 - DNA, 25 bp, Homo sapien
cagaagtggttgtacatggttcttt

SEQ ID NO: 41394 - DNA, 25 bp, Homo sapien
cagaagtgtgacctaaaccggtgat

SEQ ID NO: 41395 - DNA, 25 bp, Homo sapien
cagaagtgtgagctaaaccggtgat

SEQ ID NO: 41396 - DNA, 25 bp, Homo sapien
cagaagtgtgcatgcagattttatt

SEQ ID NO: 41397 - DNA, 25 bp, Homo sapien
cagaagtttgcataagtctgtccat

SEQ ID NO: 41398 - DNA, 25 bp, Homo sapien
cagaagtttgcatgagtctgtccat

SEQ ID NO: 41399 - DNA, 25 bp, Homo sapien
cagaataaagtcagcttgtgaggta

SEQ ID NO: 41400 - DNA, 25 bp, Homo sapien
cagaataaagtcagtttgtgaggta

SEQ ID NO: 41401 - DNA, 25 bp, Homo sapien
cagaataagtccaattgctttttca

SEQ ID NO: 41402 - DNA, 25 bp, Homo sapien
cagaataagtccagttgctttttca

SEQ ID NO: 41403 - DNA, 25 bp, Homo sapien
cagaatacagaagtacatcggtgaa

SEQ ID NO: 41404 - DNA, 25 bp, Homo sapien
cagaatacagactaaaatccttata

SEQ ID NO: 41405 - DNA, 25 bp, Homo sapien
cagaatacagattaaaatccttata

SEQ ID NO: 41406 - DNA, 25 bp, Homo sapien
cagaatacctgggatatctgggata

SEQ ID NO: 41407 - DNA, 25 bp, Homo sapien
cagaatacctgggttatctgggata

SEQ ID NO: 41408 - DNA, 25 bp, Homo sapien
cagaatacggaagtacatcggtgaa

SEQ ID NO: 41409 - DNA, 25 bp, Homo sapien
cagaatagatgtattagcaggcatg

SEQ ID NO: 41410 - DNA, 25 bp, Homo sapien
cagaatagatgtgttagcaggcatg

SEQ ID NO: 41411 - DNA, 25 bp, Homo sapien
cagaatagtcctgcaaagccagagt

SEQ ID NO: 41412 - DNA, 25 bp, Homo sapien
cagaatagtccttcaaagccagagt

SEQ ID NO: 41413 - DNA, 25 bp, Homo sapien
cagaatagttcaagtgcagtaaata

SEQ ID NO: 41414 - DNA, 25 bp, Homo sapien
cagaatagttcaagtgtagtaaata

SEQ ID NO: 41415 - DNA, 25 bp, Homo sapien
cagaatatgctccttatccaaggtc

SEQ ID NO: 41416 - DNA, 25 bp, Homo sapien
cagaatatgttccttatccaaggtc

SEQ ID NO: 41417 - DNA, 25 bp, Homo sapien
cagaatatttttaagtcaaatggac

SEQ ID NO: 41418 - DNA, 25 bp, Homo sapien
cagaatatttttaggtcaaatggac

SEQ ID NO: 41419 - DNA, 25 bp, Homo sapien
cagaatcagaactgttcaacttcca

SEQ ID NO: 41420 - DNA, 25 bp, Homo sapien
cagaatcagaactgtttaacttcca

SEQ ID NO: 41421 - DNA, 25 bp, Homo sapien
cagaatccataagcgattaagtggt

SEQ ID NO: 41422 - DNA, 25 bp, Homo sapien
cagaatccataagtgattaagtggt

SEQ ID NO: 41423 - DNA, 25 bp, Homo sapien
cagaatcttgagtccaataattagg

SEQ ID NO: 41424 - DNA, 25 bp, Homo sapien
cagaatcttgagtgcaataattagg

SEQ ID NO: 41425 - DNA, 25 bp, Homo sapien
cagaatgacatggataaatctcaaa

SEQ ID NO: 41426 - DNA, 25 bp, Homo sapien
cagaatgacatggttaaatctcaaa

SEQ ID NO: 41427 - DNA, 25 bp, Homo sapien
cagaatgcacggtcccaaacaattc

SEQ ID NO: 41428 - DNA, 25 bp, Homo sapien
cagaatgcatggtcccaaacaattc

SEQ ID NO: 41429 - DNA, 25 bp, Homo sapien
cagaatggatctttaaaaggcaggc

SEQ ID NO: 41430 - DNA, 25 bp, Homo sapien
cagaatgggccaagcttaggtaact

SEQ ID NO: 41431 - DNA, 25 bp, Homo sapien
cagaatgggtcaagcttaggtaact

SEQ ID NO: 41432 - DNA, 25 bp, Homo sapien
cagaatgggtctttaaaaggcaggc

SEQ ID NO: 41433 - DNA, 25 bp, Homo sapien
cagaatgtatcattgttgcatttga

SEQ ID NO: 41434 - DNA, 25 bp, Homo sapien
cagaatgtatcatttttgcatttga

SEQ ID NO: 41435 - DNA, 25 bp, Homo sapien
cagaatgtttgctgccctccaaaat

SEQ ID NO: 41436 - DNA, 25 bp, Homo sapien
cagaatgtttgttgccctccaaaat

SEQ ID NO: 41437 - DNA, 25 bp, Homo sapien
cagaattaagcatagtagatatgta

SEQ ID NO: 41438 - DNA, 25 bp, Homo sapien
cagaattaagcgtagtagatatgta

SEQ ID NO: 41439 - DNA, 25 bp, Homo sapien
cagaattacggtgttgttagaagag

SEQ ID NO: 41440 - DNA, 25 bp, Homo sapien
cagaattacggttttgttagaagag

SEQ ID NO: 41441 - DNA, 25 bp, Homo sapien
cagaattagcaggtggcagacccca

SEQ ID NO: 41442 - DNA, 25 bp, Homo sapien
cagaattagcagttggcagacccca

SEQ ID NO: 41443 - DNA, 25 bp, Homo sapien
cagaattccggagttgagggtgcta

SEQ ID NO: 41444 - DNA, 25 bp, Homo sapien
cagaattcgtacgggcttagttcca

SEQ ID NO: 41445 - DNA, 25 bp, Homo sapien
cagaattcgtatgggcttagttcca

SEQ ID NO: 41446 - DNA, 25 bp, Homo sapien
cagaattctggagttgagggtgcta

SEQ ID NO: 41447 - DNA, 25 bp, Homo sapien
cagaattcttacagcccgttttaag

SEQ ID NO: 41448 - DNA, 25 bp, Homo sapien
cagaattcttacagcctgttttaag

SEQ ID NO: 41449 - DNA, 25 bp, Homo sapien
cagaattgaactaatggtggcttgt

SEQ ID NO: 41450 - DNA, 25 bp, Homo sapien
cagaattgaactgatggtggcttgt

SEQ ID NO: 41451 - DNA, 25 bp, Homo sapien
cagaattgccgtccacgctaagcct

SEQ ID NO: 41452 - DNA, 25 bp, Homo sapien
cagaattgccgtctacgctaagcct

SEQ ID NO: 41453 - DNA, 25 bp, Homo sapien
cagaatttacactggagcctaagta

SEQ ID NO: 41454 - DNA, 25 bp, Homo sapien
cagaatttacattggagcctaagta

SEQ ID NO: 41455 - DNA, 25 bp, Homo sapien
cagaatttcccacgtgtagcattca

SEQ ID NO: 41456 - DNA, 25 bp, Homo sapien
cagaatttcccatgtgtagcattca

SEQ ID NO: 41457 - DNA, 25 bp, Homo sapien
cagaattttcactgacagaaagata

SEQ ID NO: 41458 - DNA, 25 bp, Homo sapien
cagaattttcattgacagaaagata

SEQ ID NO: 41459 - DNA, 25 bp, Homo sapien
cagacaaaaacaaagttttcattta

SEQ ID NO: 41460 - DNA, 25 bp, Homo sapien
cagacaaaagcaaagttttcattta

SEQ ID NO: 41461 - DNA, 25 bp, Homo sapien
cagacaaactacatgactggcttct

SEQ ID NO: 41462 - DNA, 25 bp, Homo sapien
cagacaaactacctgactggcttct

SEQ ID NO: 41463 - DNA, 25 bp, Homo sapien
cagacaaatctgccattgtaaagag

SEQ ID NO: 41464 - DNA, 25 bp, Homo sapien
cagacaaatctgccgttgtaaagag

SEQ ID NO: 41465 - DNA, 25 bp, Homo sapien
cagacaactgtacgctaacagaaaa

SEQ ID NO: 41466 - DNA, 25 bp, Homo sapien
cagacaactgtatgctaacagaaaa

SEQ ID NO: 41467 - DNA, 25 bp, Homo sapien
cagacaagaaatgcctccatagagt

SEQ ID NO: 41468 - DNA, 25 bp, Homo sapien
cagacaagaaatgccttcatagagt

SEQ ID NO: 41469 - DNA, 25 bp, Homo sapien
cagacaagacaaaaagcgttactag

SEQ ID NO: 41470 - DNA, 25 bp, Homo sapien
cagacaagacaaaaagtgttactag

SEQ ID NO: 41471 - DNA, 25 bp, Homo sapien
cagacaagagataaaaagataataa

SEQ ID NO: 41472 - DNA, 25 bp, Homo sapien
cagacaagagatagaaagataataa

SEQ ID NO: 41473 - DNA, 25 bp, Homo sapien
cagacaagagcatggaatcaagaaa

SEQ ID NO: 41474 - DNA, 25 bp, Homo sapien
cagacaagagcatggactcaagaaa

SEQ ID NO: 41475 - DNA, 25 bp, Homo sapien
cagacaaggaagctcagaggaggaa

SEQ ID NO: 41476 - DNA, 25 bp, Homo sapien
cagacaaggaagttcagaggaggaa

SEQ ID NO: 41477 - DNA, 25 bp, Homo sapien
cagacaagtaaacacatgagtataa

SEQ ID NO: 41478 - DNA, 25 bp, Homo sapien
cagacaagtaaacagatgagtataa

SEQ ID NO: 41479 - DNA, 25 bp, Homo sapien
cagacaagttacctaacatctctgc

SEQ ID NO: 41480 - DNA, 25 bp, Homo sapien
cagacaagttacttaacatctctgc

SEQ ID NO: 41481 - DNA, 25 bp, Homo sapien
cagacaatcgttatcttgctatgtt

SEQ ID NO: 41482 - DNA, 25 bp, Homo sapien
cagacaattgttatcttgctatgtt

SEQ ID NO: 41483 - DNA, 25 bp, Homo sapien
cagacaatttgcaaaagaagatatt

SEQ ID NO: 41484 - DNA, 25 bp, Homo sapien
cagacaatttgcgaaagaagatatt

SEQ ID NO: 41485 - DNA, 25 bp, Homo sapien
cagacacaaaacgctacatatcgtc

SEQ ID NO: 41486 - DNA, 25 bp, Homo sapien
cagacacaaaaggctacatatcgtc

SEQ ID NO: 41487 - DNA, 25 bp, Homo sapien
cagacacaaaagtgcaaacaaaagg

SEQ ID NO: 41488 - DNA, 25 bp, Homo sapien
cagacacagaagtgcaaacaaaagg

SEQ ID NO: 41489 - DNA, 25 bp, Homo sapien
cagacacagtcagatccgttagcaa

SEQ ID NO: 41490 - DNA, 25 bp, Homo sapien
cagacacagtcaggtccgttagcaa

SEQ ID NO: 41491 - DNA, 25 bp, Homo sapien
cagacacccaaacagccagttgtta

SEQ ID NO: 41492 - DNA, 25 bp, Homo sapien
cagacacccaaatagccagttgtta

SEQ ID NO: 41493 - DNA, 25 bp, Homo sapien
cagacactaatgcctttggatgcct

SEQ ID NO: 41494 - DNA, 25 bp, Homo sapien
cagacactaatgtctttggatgcct

SEQ ID NO: 41495 - DNA, 25 bp, Homo sapien
cagacagactggaaaactcttaatt

SEQ ID NO: 41496 - DNA, 25 bp, Homo sapien
cagacagactgggaaactcttaatt

SEQ ID NO: 41497 - DNA, 25 bp, Homo sapien
cagacagagaaagagaaaatgtgac

SEQ ID NO: 41498 - DNA, 25 bp, Homo sapien
cagacagagaaagataaaatgtgac

SEQ ID NO: 41499 - DNA, 25 bp, Homo sapien
cagacagagggcttctcaagtataa

SEQ ID NO: 41500 - DNA, 25 bp, Homo sapien
cagacagagggcttgtcaagtataa

SEQ ID NO: 41501 - DNA, 25 bp, Homo sapien
cagacagcttatcttcagctcagtt

SEQ ID NO: 41502 - DNA, 25 bp, Homo sapien
cagacagcttattttcagctcagtt

SEQ ID NO: 41503 - DNA, 25 bp, Homo sapien
cagacaggactgaatggcaaagtga

SEQ ID NO: 41504 - DNA, 25 bp, Homo sapien
cagacaggacttaatggcaaagtga

SEQ ID NO: 41505 - DNA, 25 bp, Homo sapien
cagacagggagaggcaacaaatgca

SEQ ID NO: 41506 - DNA, 25 bp, Homo sapien
cagacagggagatgcaacaaatgca

SEQ ID NO: 41507 - DNA, 25 bp, Homo sapien
cagacagtatacctgagtcactgcc

SEQ ID NO: 41508 - DNA, 25 bp, Homo sapien
cagacagtgtacctgagtcactgcc

SEQ ID NO: 41509 - DNA, 25 bp, Homo sapien
cagacagttctgcgtaggcggccag

SEQ ID NO: 41510 - DNA, 25 bp, Homo sapien
cagacagttctgtgtaggcggccag

SEQ ID NO: 41511 - DNA, 25 bp, Homo sapien
cagacataaagaagaaggcatgggg

SEQ ID NO: 41512 - DNA, 25 bp, Homo sapien
cagacataaagaagcaggcatgggg

SEQ ID NO: 41513 - DNA, 25 bp, Homo sapien
cagacatagagatcctcgtcattga

SEQ ID NO: 41514 - DNA, 25 bp, Homo sapien
cagacatagagatccttgtcattga

SEQ ID NO: 41515 - DNA, 25 bp, Homo sapien
cagacatcacaaaccagacacagag

SEQ ID NO: 41516 - DNA, 25 bp, Homo sapien
cagacatcgcaaaccagacacagag

SEQ ID NO: 41517 - DNA, 25 bp, Homo sapien
cagacatctagtgccactttccact

SEQ ID NO: 41518 - DNA, 25 bp, Homo sapien
cagacatctagtgccattttccact

SEQ ID NO: 41519 - DNA, 25 bp, Homo sapien
cagacattattttatcatttctgtc

SEQ ID NO: 41520 - DNA, 25 bp, Homo sapien
cagacattattttatcgtttctgtc

SEQ ID NO: 41521 - DNA, 25 bp, Homo sapien
cagaccaagaatttaaaaatagata

SEQ ID NO: 41522 - DNA, 25 bp, Homo sapien
cagaccaaggatttaaaaatagata

SEQ ID NO: 41523 - DNA, 25 bp, Homo sapien
cagaccaataactattctcagtcta

SEQ ID NO: 41524 - DNA, 25 bp, Homo sapien
cagaccaatgactattctcagtcta

SEQ ID NO: 41525 - DNA, 25 bp, Homo sapien
cagaccactatctacacggaagctg

SEQ ID NO: 41526 - DNA, 25 bp, Homo sapien
cagaccactctctacacggaagctg

SEQ ID NO: 41527 - DNA, 25 bp, Homo sapien
cagaccactgtgcatttcacaaatt

SEQ ID NO: 41528 - DNA, 25 bp, Homo sapien
cagaccactgtgcttttcacaaatt

SEQ ID NO: 41529 - DNA, 25 bp, Homo sapien
cagaccattccgcgtcagttggtga

SEQ ID NO: 41530 - DNA, 25 bp, Homo sapien
cagaccattccgtgtcagttggtga

SEQ ID NO: 41531 - DNA, 25 bp, Homo sapien
cagacccaaaatttttgctctaaac

SEQ ID NO: 41532 - DNA, 25 bp, Homo sapien
cagacccagaatttttgctctaaac

SEQ ID NO: 41533 - DNA, 25 bp, Homo sapien
cagacccagtcattgaagcaagcac

SEQ ID NO: 41534 - DNA, 25 bp, Homo sapien
cagacccagtcgttgaagcaagcac

SEQ ID NO: 41535 - DNA, 25 bp, Homo sapien
cagacccgataaggatgctcaatcc

SEQ ID NO: 41536 - DNA, 25 bp, Homo sapien
cagacccgctaaggatgctcaatcc

SEQ ID NO: 41537 - DNA, 25 bp, Homo sapien
cagaccctatcactcctctactcaa

SEQ ID NO: 41538 - DNA, 25 bp, Homo sapien
cagaccctatcagtcctctactcaa

SEQ ID NO: 41539 - DNA, 25 bp, Homo sapien
cagaccctctcagccacgaattaac

SEQ ID NO: 41540 - DNA, 25 bp, Homo sapien
cagaccctctcagccatgaattaac

SEQ ID NO: 41541 - DNA, 25 bp, Homo sapien
cagacctagattgacccgttagctc

SEQ ID NO: 41542 - DNA, 25 bp, Homo sapien
cagacctagattgacctgttagctc

SEQ ID NO: 41543 - DNA, 25 bp, Homo sapien
cagacctagtcccgattcttgcttc

SEQ ID NO: 41544 - DNA, 25 bp, Homo sapien
cagacctagtcctgattcttgcttc

SEQ ID NO: 41545 - DNA, 25 bp, Homo sapien
cagacctcctgccgctggacttttt

SEQ ID NO: 41546 - DNA, 25 bp, Homo sapien
cagacctcctgctgctggacttttt

SEQ ID NO: 41547 - DNA, 25 bp, Homo sapien
cagacctcctgtgtatccttcacca

SEQ ID NO: 41548 - DNA, 25 bp, Homo sapien
cagacctcctgtgtgtccttcacca

SEQ ID NO: 41549 - DNA, 25 bp, Homo sapien
cagacctgggtcgcaacgtgccctt

SEQ ID NO: 41550 - DNA, 25 bp, Homo sapien
cagacctgggttgcaacgtgccctt

SEQ ID NO: 41551 - DNA, 25 bp, Homo sapien
cagaccttcacacttatacagcaat

SEQ ID NO: 41552 - DNA, 25 bp, Homo sapien
cagaccttcacatttatacagcaat

SEQ ID NO: 41553 - DNA, 25 bp, Homo sapien
cagacctttgaagttacggctcttc

SEQ ID NO: 41554 - DNA, 25 bp, Homo sapien
cagacctttgaagttatggctcttc

SEQ ID NO: 41555 - DNA, 25 bp, Homo sapien
cagacgtctgaaactggtgttcctg

SEQ ID NO: 41556 - DNA, 25 bp, Homo sapien
cagacgtctgatactggtgttcctg

SEQ ID NO: 41557 - DNA, 25 bp, Homo sapien
cagacgtgtgtaggagcataaatgg

SEQ ID NO: 41558 - DNA, 25 bp, Homo sapien
cagacgtgtgtgggagcataaatgg

SEQ ID NO: 41559 - DNA, 25 bp, Homo sapien
cagactaattttgtccagacctaga

SEQ ID NO: 41560 - DNA, 25 bp, Homo sapien
cagactaattttttccagacctaga

SEQ ID NO: 41561 - DNA, 25 bp, Homo sapien
cagactacataattgaagagtttat

SEQ ID NO: 41562 - DNA, 25 bp, Homo sapien
cagactacgtaattgaagagtttat

SEQ ID NO: 41563 - DNA, 25 bp, Homo sapien
cagactcaattatataaaagccatt

SEQ ID NO: 41564 - DNA, 25 bp, Homo sapien
cagactcaattatttaaaagccatt

SEQ ID NO: 41565 - DNA, 25 bp, Homo sapien
cagactccacaatcatgtgaaccaa

SEQ ID NO: 41566 - DNA, 25 bp, Homo sapien
cagactccacattcatgtgaaccaa

SEQ ID NO: 41567 - DNA, 25 bp, Homo sapien
cagactctatgaaaaaaaaatatat

SEQ ID NO: 41568 - DNA, 25 bp, Homo sapien
cagactctatgagaaaaaaatatat

SEQ ID NO: 41569 - DNA, 25 bp, Homo sapien
cagactctgtcagtgccttgcccta

SEQ ID NO: 41570 - DNA, 25 bp, Homo sapien
cagactctgtcggtgccttgcccta

SEQ ID NO: 41571 - DNA, 25 bp, Homo sapien
cagactcttccttgggtgacagtgt

SEQ ID NO: 41572 - DNA, 25 bp, Homo sapien
cagactcttggattcaggcttagga

SEQ ID NO: 41573 - DNA, 25 bp, Homo sapien
cagactcttggatttaggcttagga

SEQ ID NO: 41574 - DNA, 25 bp, Homo sapien
cagactctttcttgggtgacagtgt

SEQ ID NO: 41575 - DNA, 25 bp, Homo sapien
cagactgccatgtcaaagtttcaca

SEQ ID NO: 41576 - DNA, 25 bp, Homo sapien
cagactgctatgtcaaagtttcaca

SEQ ID NO: 41577 - DNA, 25 bp, Homo sapien
cagactgcttccattctgaggcttg

SEQ ID NO: 41578 - DNA, 25 bp, Homo sapien
cagactgcttccgttctgaggcttg

SEQ ID NO: 41579 - DNA, 25 bp, Homo sapien
cagactggaaaactcttaattcatg

SEQ ID NO: 41580 - DNA, 25 bp, Homo sapien
cagactgggaaactcttaattcatg

SEQ ID NO: 41581 - DNA, 25 bp, Homo sapien
cagacttacatttagtagaattttc

SEQ ID NO: 41582 - DNA, 25 bp, Homo sapien
cagacttatatttagtagaattttc

SEQ ID NO: 41583 - DNA, 25 bp, Homo sapien
cagacttccaaaacatcccctgtga

SEQ ID NO: 41584 - DNA, 25 bp, Homo sapien
cagacttccaaaagatcccctgtga

SEQ ID NO: 41585 - DNA, 25 bp, Homo sapien
cagacttcctgtcgatgggccaaac

SEQ ID NO: 41586 - DNA, 25 bp, Homo sapien
cagacttcctgttgatgggccaaac

SEQ ID NO: 41587 - DNA, 25 bp, Homo sapien
cagacttgaaatcagcactattagg

SEQ ID NO: 41588 - DNA, 25 bp, Homo sapien
cagacttgaaattagcactattagg

SEQ ID NO: 41589 - DNA, 25 bp, Homo sapien
cagacttggtcattaaggttattgg

SEQ ID NO: 41590 - DNA, 25 bp, Homo sapien
cagacttggtcgttaaggttattgg

SEQ ID NO: 41591 - DNA, 25 bp, Homo sapien
cagactttctggaagaaataaaagt

SEQ ID NO: 41592 - DNA, 25 bp, Homo sapien
cagactttctgggagaaataaaagt

SEQ ID NO: 41593 - DNA, 25 bp, Homo sapien
cagactttgtgctggttacagttca

SEQ ID NO: 41594 - DNA, 25 bp, Homo sapien
cagactttttgctggttacagttca

SEQ ID NO: 41595 - DNA, 25 bp, Homo sapien
cagagaaaaaccttcgatttatgtc

SEQ ID NO: 41596 - DNA, 25 bp, Homo sapien
cagagaaaaaccttggatttatgtc

SEQ ID NO: 41597 - DNA, 25 bp, Homo sapien
cagagaaaccacaaattactggagc

SEQ ID NO: 41598 - DNA, 25 bp, Homo sapien
cagagaaaccacaacttactggagc

SEQ ID NO: 41599 - DNA, 25 bp, Homo sapien
cagagaaagagcatcaaatgtgctt

SEQ ID NO: 41600 - DNA, 25 bp, Homo sapien
cagagaaagagcatcagatgtgctt

SEQ ID NO: 41601 - DNA, 25 bp, Homo sapien
cagagaaagggaccttaaaaagatc

SEQ ID NO: 41602 - DNA, 25 bp, Homo sapien
cagagaaagggagcttaaaaagatc

SEQ ID NO: 41603 - DNA, 25 bp, Homo sapien
cagagaagactgttcccttcatttc

SEQ ID NO: 41604 - DNA, 25 bp, Homo sapien
cagagaagacttttcctttgagtaa

SEQ ID NO: 41605 - DNA, 25 bp, Homo sapien
cagagaagcctgttcccttcatttc

SEQ ID NO: 41606 - DNA, 25 bp, Homo sapien
cagagaagccttttcctttgagtaa

SEQ ID NO: 41607 - DNA, 25 bp, Homo sapien
cagagaaggaggattgcattgtgag

SEQ ID NO: 41608 - DNA, 25 bp, Homo sapien
cagagaaggagggttgcattgtgag

SEQ ID NO: 41609 - DNA, 25 bp, Homo sapien
cagagaagtctgaggaggataagga

SEQ ID NO: 41610 - DNA, 25 bp, Homo sapien
cagagaagtttgaggaggataagga

SEQ ID NO: 41611 - DNA, 25 bp, Homo sapien
cagagaatagaatagtggttatcag

SEQ ID NO: 41612 - DNA, 25 bp, Homo sapien
cagagaatagaatggtggttatcag

SEQ ID NO: 41613 - DNA, 25 bp, Homo sapien
cagagaatatggaacaacttacttt

SEQ ID NO: 41614 - DNA, 25 bp, Homo sapien
cagagaatatggagcaacttacttt

SEQ ID NO: 41615 - DNA, 25 bp, Homo sapien
cagagaatcctgctaagcaataccc

SEQ ID NO: 41616 - DNA, 25 bp, Homo sapien
cagagaatcctgttaagcaataccc

SEQ ID NO: 41617 - DNA, 25 bp, Homo sapien
cagagaatgctcaaatagattttct

SEQ ID NO: 41618 - DNA, 25 bp, Homo sapien
cagagaatgctcgaatagattttct

SEQ ID NO: 41619 - DNA, 25 bp, Homo sapien
cagagaattggaatcagaagaagaa

SEQ ID NO: 41620 - DNA, 25 bp, Homo sapien
cagagaattggagtcagaagaagaa

SEQ ID NO: 41621 - DNA, 25 bp, Homo sapien
cagagaattgggcatgagtttagag

SEQ ID NO: 41622 - DNA, 25 bp, Homo sapien
cagagaattgggcgtgagtttagag

SEQ ID NO: 41623 - DNA, 25 bp, Homo sapien
cagagacaaaacaacagctggaaag

SEQ ID NO: 41624 - DNA, 25 bp, Homo sapien
cagagacaaaacgacagctggaaag

SEQ ID NO: 41625 - DNA, 25 bp, Homo sapien
cagagacaaccaccaatagtgaggg

SEQ ID NO: 41626 - DNA, 25 bp, Homo sapien
cagagacaatcaccaatagtgaggg

SEQ ID NO: 41627 - DNA, 25 bp, Homo sapien
cagagacacgtttcctgaatttatg

SEQ ID NO: 41628 - DNA, 25 bp, Homo sapien
cagagacatgtttcctgaatttatg

SEQ ID NO: 41629 - DNA, 25 bp, Homo sapien
cagagaccctgtgagcaacaggcct

SEQ ID NO: 41630 - DNA, 25 bp, Homo sapien
cagagaccctgtgggcaacaggcct

SEQ ID NO: 41631 - DNA, 25 bp, Homo sapien
cagagaccttgatttttgttaagag

SEQ ID NO: 41632 - DNA, 25 bp, Homo sapien
cagagaccttggtttttgttaagag

SEQ ID NO: 41633 - DNA, 25 bp, Homo sapien
cagagactacgtggacagcaaatct

SEQ ID NO: 41634 - DNA, 25 bp, Homo sapien
cagagactacgtgggcagcaaatct

SEQ ID NO: 41635 - DNA, 25 bp, Homo sapien
cagagactgagatcaacgctttatt

SEQ ID NO: 41636 - DNA, 25 bp, Homo sapien
cagagactgagatcaatgctttatt

SEQ ID NO: 41637 - DNA, 25 bp, Homo sapien
cagagactgggatacaaaaaacaat

SEQ ID NO: 41638 - DNA, 25 bp, Homo sapien
cagagactgggatacagaaaacaat

SEQ ID NO: 41639 - DNA, 25 bp, Homo sapien
cagagagaaaaatcattactatctt

SEQ ID NO: 41640 - DNA, 25 bp, Homo sapien
cagagagaaaaatccttactatctt

SEQ ID NO: 41641 - DNA, 25 bp, Homo sapien
cagagagaaataaactagtccatgc

SEQ ID NO: 41642 - DNA, 25 bp, Homo sapien
cagagagaaatacactagtccatgc

SEQ ID NO: 41643 - DNA, 25 bp, Homo sapien
cagagagaatggtgtcatggcttgt

SEQ ID NO: 41644 - DNA, 25 bp, Homo sapien
cagagagaatggtttcatggcttgt

SEQ ID NO: 41645 - DNA, 25 bp, Homo sapien
cagagagagagtattcaaaatagct

SEQ ID NO: 41646 - DNA, 25 bp, Homo sapien
cagagagagcacggactgtgaacgg

SEQ ID NO: 41647 - DNA, 25 bp, Homo sapien
cagagagagccttattctgtggcag

SEQ ID NO: 41648 - DNA, 25 bp, Homo sapien
cagagagagccttattttgtggcag

SEQ ID NO: 41649 - DNA, 25 bp, Homo sapien
cagagagagctgagtggataagaag

SEQ ID NO: 41650 - DNA, 25 bp, Homo sapien
cagagagagggtattcaaaatagct

SEQ ID NO: 41651 - DNA, 25 bp, Homo sapien
cagagagaggtgagtggataagaag

SEQ ID NO: 41652 - DNA, 25 bp, Homo sapien
cagagagagtacggactgtgaacgg

SEQ ID NO: 41653 - DNA, 25 bp, Homo sapien
cagagaggcgtgaaagtagatatgt

SEQ ID NO: 41654 - DNA, 25 bp, Homo sapien
cagagagggagtcccgggtgcgaga

SEQ ID NO: 41655 - DNA, 25 bp, Homo sapien
cagagagggagtccggggtgcgaga

SEQ ID NO: 41656 - DNA, 25 bp, Homo sapien
cagagaggtgtgaaagtagatatgt

SEQ ID NO: 41657 - DNA, 25 bp, Homo sapien
cagagagtggtatgtgaatcatttt

SEQ ID NO: 41658 - DNA, 25 bp, Homo sapien
cagagagtggtgtgtgaatcatttt

SEQ ID NO: 41659 - DNA, 25 bp, Homo sapien
cagagatcttgtatatttggacaat

SEQ ID NO: 41660 - DNA, 25 bp, Homo sapien
cagagatcttgtgtatttggacaat

SEQ ID NO: 41661 - DNA, 25 bp, Homo sapien
cagagatgatttgaacagccatgcc

SEQ ID NO: 41662 - DNA, 25 bp, Homo sapien
cagagatgatttgagcagccatgcc

SEQ ID NO: 41663 - DNA, 25 bp, Homo sapien
cagagattaagaagtgactgtccat

SEQ ID NO: 41664 - DNA, 25 bp, Homo sapien
cagagattaggaagtgactgtccat

SEQ ID NO: 41665 - DNA, 25 bp, Homo sapien
cagagattcattgtaccttgtcaca

SEQ ID NO: 41666 - DNA, 25 bp, Homo sapien
cagagattcattgtgccttgtcaca

SEQ ID NO: 41667 - DNA, 25 bp, Homo sapien
cagagattggatttaggtgatgtgg

SEQ ID NO: 41668 - DNA, 25 bp, Homo sapien
cagagatttgaagctacatctgaat

SEQ ID NO: 41669 - DNA, 25 bp, Homo sapien
cagagatttgaagctatatctgaat

SEQ ID NO: 41670 - DNA, 25 bp, Homo sapien
cagagatttgatttaggtgatgtgg

SEQ ID NO: 41671 - DNA, 25 bp, Homo sapien
cagagcaacataatgcgtgaggccc

SEQ ID NO: 41672 - DNA, 25 bp, Homo sapien
cagagcaacataatgcttgaggccc

SEQ ID NO: 41673 - DNA, 25 bp, Homo sapien
cagagcaatagtcaatgcatagcat

SEQ ID NO: 41674 - DNA, 25 bp, Homo sapien
cagagcaatagtcgatgcatagcat

SEQ ID NO: 41675 - DNA, 25 bp, Homo sapien
cagagcaatattgtcttggctatga

SEQ ID NO: 41676 - DNA, 25 bp, Homo sapien
cagagcaatattttcttggctatga

SEQ ID NO: 41677 - DNA, 25 bp, Homo sapien
cagagcaatgtaaaaatcacagcac

SEQ ID NO: 41678 - DNA, 25 bp, Homo sapien
cagagcaatgtagaaatcacagcac

SEQ ID NO: 41679 - DNA, 25 bp, Homo sapien
cagagcacaaaaacaatcatcagcc

SEQ ID NO: 41680 - DNA, 25 bp, Homo sapien
cagagcacaaaagcaatcatcagcc

SEQ ID NO: 41681 - DNA, 25 bp, Homo sapien
cagagcacaatgtaacgcacatttt

SEQ ID NO: 41682 - DNA, 25 bp, Homo sapien
cagagcacaatgttacgcacatttt

SEQ ID NO: 41683 - DNA, 25 bp, Homo sapien
cagagcacatcaacctagtaagaat

SEQ ID NO: 41684 - DNA, 25 bp, Homo sapien
cagagcacatcagcctagtaagaat

SEQ ID NO: 41685 - DNA, 25 bp, Homo sapien
cagagcataaaaaaatggtgttctc

SEQ ID NO: 41686 - DNA, 25 bp, Homo sapien
cagagcataaaaaattggtgttctc

SEQ ID NO: 41687 - DNA, 25 bp, Homo sapien
cagagcattagatacaaagaggcct

SEQ ID NO: 41688 - DNA, 25 bp, Homo sapien
cagagcattagatagaaagaggcct

SEQ ID NO: 41689 - DNA, 25 bp, Homo sapien
cagagcattccctactctatcctat

SEQ ID NO: 41690 - DNA, 25 bp, Homo sapien
cagagcattccttactctatcctat

SEQ ID NO: 41691 - DNA, 25 bp, Homo sapien
cagagcatttcaaatttcagatttt

SEQ ID NO: 41692 - DNA, 25 bp, Homo sapien
cagagcatttcagatttcagatttt

SEQ ID NO: 41693 - DNA, 25 bp, Homo sapien
cagagccaaaggctgcatgacctac

SEQ ID NO: 41694 - DNA, 25 bp, Homo sapien
cagagccaagggctgcatgacctac

SEQ ID NO: 41695 - DNA, 25 bp, Homo sapien
cagagccacgctaggaaatgtctct

SEQ ID NO: 41696 - DNA, 25 bp, Homo sapien
cagagccagacatatattccgcaat

SEQ ID NO: 41697 - DNA, 25 bp, Homo sapien
cagagccagacatttattccgcaat

SEQ ID NO: 41698 - DNA, 25 bp, Homo sapien
cagagccaggactcagaagcaggtc

SEQ ID NO: 41699 - DNA, 25 bp, Homo sapien
cagagccaggactcagcagcaggtc

SEQ ID NO: 41700 - DNA, 25 bp, Homo sapien
cagagccatgctaggaaatgtctct

SEQ ID NO: 41701 - DNA, 25 bp, Homo sapien
cagagcccagaacagcagaatataa

SEQ ID NO: 41702 - DNA, 25 bp, Homo sapien
cagagcccagaatagcagaatataa

SEQ ID NO: 41703 - DNA, 25 bp, Homo sapien
cagagccccttacgtggcacagctg

SEQ ID NO: 41704 - DNA, 25 bp, Homo sapien
cagagccccttatgtggcacagctg

SEQ ID NO: 41705 - DNA, 25 bp, Homo sapien
cagagccctgagacagcaaatgtct

SEQ ID NO: 41706 - DNA, 25 bp, Homo sapien
cagagccctgagagagcaaatgtct

SEQ ID NO: 41707 - DNA, 25 bp, Homo sapien
cagagcccttgagctgcggcatctg

SEQ ID NO: 41708 - DNA, 25 bp, Homo sapien
cagagcccttgagctgtggcatctg

SEQ ID NO: 41709 - DNA, 25 bp, Homo sapien
cagagccttccaaggagcgcggccc

SEQ ID NO: 41710 - DNA, 25 bp, Homo sapien
cagagccttcccgagcaggtgaaca

SEQ ID NO: 41711 - DNA, 25 bp, Homo sapien
cagagccttccgaggagcgcggccc

SEQ ID NO: 41712 - DNA, 25 bp, Homo sapien
cagagccttcctgagcaggtgaaca

SEQ ID NO: 41713 - DNA, 25 bp, Homo sapien
cagagctaagcattgttgggctata

SEQ ID NO: 41714 - DNA, 25 bp, Homo sapien
cagagctaagcgttgttgggctata

SEQ ID NO: 41715 - DNA, 25 bp, Homo sapien
cagagctcaccacatctacttaaac

SEQ ID NO: 41716 - DNA, 25 bp, Homo sapien
cagagctcgccacatctacttaaac

SEQ ID NO: 41717 - DNA, 25 bp, Homo sapien
cagagctcgtgttatctaacctgtt

SEQ ID NO: 41718 - DNA, 25 bp, Homo sapien
cagagctcgtgttgtctaacctgtt

SEQ ID NO: 41719 - DNA, 25 bp, Homo sapien
cagagctcttgttacctaaccatct

SEQ ID NO: 41720 - DNA, 25 bp, Homo sapien
cagagctcttgttatctaaccatct

SEQ ID NO: 41721 - DNA, 25 bp, Homo sapien
cagagctggaacggtgtactaagtt

SEQ ID NO: 41722 - DNA, 25 bp, Homo sapien
cagagctggaatggtgtactaagtt

SEQ ID NO: 41723 - DNA, 25 bp, Homo sapien
cagagctttgagcaatacacatgct

SEQ ID NO: 41724 - DNA, 25 bp, Homo sapien
cagagctttgagcagtacacatgct

SEQ ID NO: 41725 - DNA, 25 bp, Homo sapien
cagaggaaaatctgaactgtcctga

SEQ ID NO: 41726 - DNA, 25 bp, Homo sapien
cagaggaaactctaatattctttct

SEQ ID NO: 41727 - DNA, 25 bp, Homo sapien
cagaggaacattgtccaactctttg

SEQ ID NO: 41728 - DNA, 25 bp, Homo sapien
cagaggaacattttccaactctttg

SEQ ID NO: 41729 - DNA, 25 bp, Homo sapien
cagaggaagctctaatattctttct

SEQ ID NO: 41730 - DNA, 25 bp, Homo sapien
cagaggaatatctgaactgtcctga

SEQ ID NO: 41731 - DNA, 25 bp, Homo sapien
cagaggacaccatcgggaatgtgct

SEQ ID NO: 41732 - DNA, 25 bp, Homo sapien
cagaggacaccattgggaatgtgct

SEQ ID NO: 41733 - DNA, 25 bp, Homo sapien
cagaggaccaggaaagttgtgactt

SEQ ID NO: 41734 - DNA, 25 bp, Homo sapien
cagaggaccagggaagttgtgactt

SEQ ID NO: 41735 - DNA, 25 bp, Homo sapien
cagaggagcattcatgacactgaaa

SEQ ID NO: 41736 - DNA, 25 bp, Homo sapien
cagaggagcattcatgccactgaaa

SEQ ID NO: 41737 - DNA, 25 bp, Homo sapien
cagaggaggagactttggtagtcaa

SEQ ID NO: 41738 - DNA, 25 bp, Homo sapien
cagaggaggaggctttggtagtcaa

SEQ ID NO: 41739 - DNA, 25 bp, Homo sapien
cagaggaggtaaaaagatgacaaac

SEQ ID NO: 41740 - DNA, 25 bp, Homo sapien
cagaggaggtaaaaagctgacaaac

SEQ ID NO: 41741 - DNA, 25 bp, Homo sapien
cagaggataaacaggacagtgataa

SEQ ID NO: 41742 - DNA, 25 bp, Homo sapien
cagaggataaataggacagtgataa

SEQ ID NO: 41743 - DNA, 25 bp, Homo sapien
cagaggataaattaatctcttcaac

SEQ ID NO: 41744 - DNA, 25 bp, Homo sapien
cagaggataaattattgttttcatt

SEQ ID NO: 41745 - DNA, 25 bp, Homo sapien
cagaggataaattatttttttcatt

SEQ ID NO: 41746 - DNA, 25 bp, Homo sapien
cagaggatagaccacggcttcagcc

SEQ ID NO: 41747 - DNA, 25 bp, Homo sapien
cagaggatagaccatggcttcagcc

SEQ ID NO: 41748 - DNA, 25 bp, Homo sapien
cagaggatccagatttccctgtggc

SEQ ID NO: 41749 - DNA, 25 bp, Homo sapien
cagaggatccagctttccctgtggc

SEQ ID NO: 41750 - DNA, 25 bp, Homo sapien
cagaggatgaattaatctcttcaac

SEQ ID NO: 41751 - DNA, 25 bp, Homo sapien
cagaggatttctagtacagtagcaa

SEQ ID NO: 41752 - DNA, 25 bp, Homo sapien
cagaggatttctagtatagtagcaa

SEQ ID NO: 41753 - DNA, 25 bp, Homo sapien
cagaggatttttccttgcactttat

SEQ ID NO: 41754 - DNA, 25 bp, Homo sapien
cagaggatttttctttgcactttat

SEQ ID NO: 41755 - DNA, 25 bp, Homo sapien
cagaggcacgctgatcaggaatgac

SEQ ID NO: 41756 - DNA, 25 bp, Homo sapien
cagaggcatgctgatcaggaatgac

SEQ ID NO: 41757 - DNA, 25 bp, Homo sapien
cagaggccagctaagctcaatctgg

SEQ ID NO: 41758 - DNA, 25 bp, Homo sapien
cagaggccagctcagctcaatctgg

SEQ ID NO: 41759 - DNA, 25 bp, Homo sapien
cagaggcctcccaagacagtctcct

SEQ ID NO: 41760 - DNA, 25 bp, Homo sapien
cagaggcctcccaggacagtctcct

SEQ ID NO: 41761 - DNA, 25 bp, Homo sapien
cagaggctatgtatcacacagtgca

SEQ ID NO: 41762 - DNA, 25 bp, Homo sapien
cagaggctatgtatcagacagtgca

SEQ ID NO: 41763 - DNA, 25 bp, Homo sapien
cagaggctattacgaacagcactat

SEQ ID NO: 41764 - DNA, 25 bp, Homo sapien
cagaggctattatgaacagcactat

SEQ ID NO: 41765 - DNA, 25 bp, Homo sapien
cagaggctcctctctactcaggctg

SEQ ID NO: 41766 - DNA, 25 bp, Homo sapien
cagaggctggcaacagattgtgaac

SEQ ID NO: 41767 - DNA, 25 bp, Homo sapien
cagaggctggcaacaggttgtgaac

SEQ ID NO: 41768 - DNA, 25 bp, Homo sapien
cagaggcttcaaacgactggtttat

SEQ ID NO: 41769 - DNA, 25 bp, Homo sapien
cagaggcttcaaatgactggtttat

SEQ ID NO: 41770 - DNA, 25 bp, Homo sapien
cagaggcttcagcataagatcccac

SEQ ID NO: 41771 - DNA, 25 bp, Homo sapien
cagaggcttcagcgtaagatcccac

SEQ ID NO: 41772 - DNA, 25 bp, Homo sapien
cagaggcttctctctactcaggctg

SEQ ID NO: 41773 - DNA, 25 bp, Homo sapien
cagagggaaaaatggctgctaaaat

SEQ ID NO: 41774 - DNA, 25 bp, Homo sapien
cagagggaaatatacagctgcaaat

SEQ ID NO: 41775 - DNA, 25 bp, Homo sapien
cagagggaaatatatagctgcaaat

SEQ ID NO: 41776 - DNA, 25 bp, Homo sapien
cagagggagaaatggctgctaaaat

SEQ ID NO: 41777 - DNA, 25 bp, Homo sapien
cagagggaggtttacaaatgcaaaa

SEQ ID NO: 41778 - DNA, 25 bp, Homo sapien
cagagggatgtttacaaatgcaaaa

SEQ ID NO: 41779 - DNA, 25 bp, Homo sapien
cagagggcatcagattgtgagacag

SEQ ID NO: 41780 - DNA, 25 bp, Homo sapien
cagagggccactaccttctgagaaa

SEQ ID NO: 41781 - DNA, 25 bp, Homo sapien
cagagggccactactttctgagaaa

SEQ ID NO: 41782 - DNA, 25 bp, Homo sapien
cagagggcgtcagattgtgagacag

SEQ ID NO: 41783 - DNA, 25 bp, Homo sapien
cagagggtctccaacaggatgggct

SEQ ID NO: 41784 - DNA, 25 bp, Homo sapien
cagagggtctccaataggatgggct

SEQ ID NO: 41785 - DNA, 25 bp, Homo sapien
cagaggtaactgtggccaagattca

SEQ ID NO: 41786 - DNA, 25 bp, Homo sapien
cagaggtaactgtgtccaagattca

SEQ ID NO: 41787 - DNA, 25 bp, Homo sapien
cagaggtaattacacatgttgtttt

SEQ ID NO: 41788 - DNA, 25 bp, Homo sapien
cagaggtaattatacatgttgtttt

SEQ ID NO: 41789 - DNA, 25 bp, Homo sapien
cagaggtcactacgagtcttatgga

SEQ ID NO: 41790 - DNA, 25 bp, Homo sapien
cagaggtcactatgagtcttatgga

SEQ ID NO: 41791 - DNA, 25 bp, Homo sapien
cagaggtctgaatttgatgacagac

SEQ ID NO: 41792 - DNA, 25 bp, Homo sapien
cagaggtctgaatttggtgacagac

SEQ ID NO: 41793 - DNA, 25 bp, Homo sapien
cagaggtgactgacttcgtttgcag

SEQ ID NO: 41794 - DNA, 25 bp, Homo sapien
cagaggtgactgactttgtttgcag

SEQ ID NO: 41795 - DNA, 25 bp, Homo sapien
cagaggttcatccaaggcgctcgat

SEQ ID NO: 41796 - DNA, 25 bp, Homo sapien
cagaggttcgtccaaggcgctcgat

SEQ ID NO: 41797 - DNA, 25 bp, Homo sapien
cagaggttgccatctagccttcctc

SEQ ID NO: 41798 - DNA, 25 bp, Homo sapien
cagaggttgccgtctagccttcctc

SEQ ID NO: 41799 - DNA, 25 bp, Homo sapien
cagaggtttgccctagagtaggtat

SEQ ID NO: 41800 - DNA, 25 bp, Homo sapien
cagaggtttgccctagcgtaggtat

SEQ ID NO: 41801 - DNA, 25 bp, Homo sapien
cagaggtttggctacacagatgatg

SEQ ID NO: 41802 - DNA, 25 bp, Homo sapien
cagaggtttggttacacagatgatg

SEQ ID NO: 41803 - DNA, 25 bp, Homo sapien
cagagtagccttgtgtttactttga

SEQ ID NO: 41804 - DNA, 25 bp, Homo sapien
cagagtaggcttgtgtttactttga

SEQ ID NO: 41805 - DNA, 25 bp, Homo sapien
cagagtagtgttttatagtggctac

SEQ ID NO: 41806 - DNA, 25 bp, Homo sapien
cagagtagtgttttgtagtggctac

SEQ ID NO: 41807 - DNA, 25 bp, Homo sapien
cagagtatgcgataagagatagaaa

SEQ ID NO: 41808 - DNA, 25 bp, Homo sapien
cagagtatgctactttccgaggcaa

SEQ ID NO: 41809 - DNA, 25 bp, Homo sapien
cagagtatgcttctttccgaggcaa

SEQ ID NO: 41810 - DNA, 25 bp, Homo sapien
cagagtatgtgataagagatagaaa

SEQ ID NO: 41811 - DNA, 25 bp, Homo sapien
cagagtccaagaactgttgatctca

SEQ ID NO: 41812 - DNA, 25 bp, Homo sapien
cagagtccaagtactgttgatctca

SEQ ID NO: 41813 - DNA, 25 bp, Homo sapien
cagagtggaccacaaaaataaaaaa

SEQ ID NO: 41814 - DNA, 25 bp, Homo sapien
cagagtggaccagaaaaataaaaaa

SEQ ID NO: 41815 - DNA, 25 bp, Homo sapien
cagagtggagccgataatcggaatg

SEQ ID NO: 41816 - DNA, 25 bp, Homo sapien
cagagtggagctgataatcggaatg

SEQ ID NO: 41817 - DNA, 25 bp, Homo sapien
cagagtggatatgttgttagccagc

SEQ ID NO: 41818 - DNA, 25 bp, Homo sapien
cagagtggatattttgttagccagc

SEQ ID NO: 41819 - DNA, 25 bp, Homo sapien
cagagtgtgacacttcataagcatc

SEQ ID NO: 41820 - DNA, 25 bp, Homo sapien
cagagtgtgacagttcataagcatc

SEQ ID NO: 41821 - DNA, 25 bp, Homo sapien
cagagttatcaaaatgaatgctaca

SEQ ID NO: 41822 - DNA, 25 bp, Homo sapien
cagagttatcaagatgaatgctaca

SEQ ID NO: 41823 - DNA, 25 bp, Homo sapien
cagagttgaagcaccaagaagcaga

SEQ ID NO: 41824 - DNA, 25 bp, Homo sapien
cagagttgaggcaccaagaagcaga

SEQ ID NO: 41825 - DNA, 25 bp, Homo sapien
cagagtttcggaatcagtaggtctg

SEQ ID NO: 41826 - DNA, 25 bp, Homo sapien
cagagtttgacacacaataggcact

SEQ ID NO: 41827 - DNA, 25 bp, Homo sapien
cagagtttgacatacaataggcact

SEQ ID NO: 41828 - DNA, 25 bp, Homo sapien
cagagttttggaatcagtaggtctg

SEQ ID NO: 41829 - DNA, 25 bp, Homo sapien
cagataaaacatttggaaagtgaca

SEQ ID NO: 41830 - DNA, 25 bp, Homo sapien
cagataaaacattttgaaagtgaca

SEQ ID NO: 41831 - DNA, 25 bp, Homo sapien
cagataaaactgtttttttcctaag

SEQ ID NO: 41832 - DNA, 25 bp, Homo sapien
cagataaaattgccatggttatctc

SEQ ID NO: 41833 - DNA, 25 bp, Homo sapien
cagataaaattgccttggttatctc

SEQ ID NO: 41834 - DNA, 25 bp, Homo sapien
cagataaaattgtttttttcctaag

SEQ ID NO: 41835 - DNA, 25 bp, Homo sapien
cagataaacagggaggaaatgacag

SEQ ID NO: 41836 - DNA, 25 bp, Homo sapien
cagataaaccatagagaaaattaat

SEQ ID NO: 41837 - DNA, 25 bp, Homo sapien
cagataaaccatggagaaaattaat

SEQ ID NO: 41838 - DNA, 25 bp, Homo sapien
cagataaagagggaggaaatgacag

SEQ ID NO: 41839 - DNA, 25 bp, Homo sapien
cagataaagcatagcgaaggatggg

SEQ ID NO: 41840 - DNA, 25 bp, Homo sapien
cagataaagcatagtgaaggatggg

SEQ ID NO: 41841 - DNA, 25 bp, Homo sapien
cagataaatgatcaataacagtgtc

SEQ ID NO: 41842 - DNA, 25 bp, Homo sapien
cagataaatgattaataacagtgtc

SEQ ID NO: 41843 - DNA, 25 bp, Homo sapien
cagataagttagctacccaatgaca

SEQ ID NO: 41844 - DNA, 25 bp, Homo sapien
cagataagttagctactcaatgaca

SEQ ID NO: 41845 - DNA, 25 bp, Homo sapien
cagataatatcatcgtccaggaggg

SEQ ID NO: 41846 - DNA, 25 bp, Homo sapien
cagataatatcatcttccaggaggg

SEQ ID NO: 41847 - DNA, 25 bp, Homo sapien
cagataatatttccaacgtgactct

SEQ ID NO: 41848 - DNA, 25 bp, Homo sapien
cagataatatttccaatgtgactct

SEQ ID NO: 41849 - DNA, 25 bp, Homo sapien
cagatacaaagctggtttttttttt

SEQ ID NO: 41850 - DNA, 25 bp, Homo sapien
cagatacaagattaatatgcaaaaa

SEQ ID NO: 41851 - DNA, 25 bp, Homo sapien
cagatacaagattagtatgcaaaaa

SEQ ID NO: 41852 - DNA, 25 bp, Homo sapien
cagatacaaggctggtttttttttt

SEQ ID NO: 41853 - DNA, 25 bp, Homo sapien
cagatacagaggttcaatcctaggg

SEQ ID NO: 41854 - DNA, 25 bp, Homo sapien
cagatacagaggttcagtcctaggg

SEQ ID NO: 41855 - DNA, 25 bp, Homo sapien
cagatacaggtacttgtttttctgt

SEQ ID NO: 41856 - DNA, 25 bp, Homo sapien
cagatacaggtatttgtttttctgt

SEQ ID NO: 41857 - DNA, 25 bp, Homo sapien
cagataccaagaagacaaaaaactc

SEQ ID NO: 41858 - DNA, 25 bp, Homo sapien
cagataccaagaaggcaaaaaactc

SEQ ID NO: 41859 - DNA, 25 bp, Homo sapien
cagatactaggcaagaaccaggaac

SEQ ID NO: 41860 - DNA, 25 bp, Homo sapien
cagatactcggcaagaaccaggaac

SEQ ID NO: 41861 - DNA, 25 bp, Homo sapien
cagatactgggaaggcacaatggga

SEQ ID NO: 41862 - DNA, 25 bp, Homo sapien
cagatactgggttttccgtccaaca

SEQ ID NO: 41863 - DNA, 25 bp, Homo sapien
cagatactgtgaaggcacaatggga

SEQ ID NO: 41864 - DNA, 25 bp, Homo sapien
cagatactgtgttttccgtccaaca

SEQ ID NO: 41865 - DNA, 25 bp, Homo sapien
cagatagaatcacagcaaccttagg

SEQ ID NO: 41866 - DNA, 25 bp, Homo sapien
cagatagaatcatagcaaccttagg

SEQ ID NO: 41867 - DNA, 25 bp, Homo sapien
cagatagactacgcattctcttatt

SEQ ID NO: 41868 - DNA, 25 bp, Homo sapien
cagatagactatgcattctcttatt

SEQ ID NO: 41869 - DNA, 25 bp, Homo sapien
cagatagatgacagaataagaaaca

SEQ ID NO: 41870 - DNA, 25 bp, Homo sapien
cagatagatgacaggataagaaaca

SEQ ID NO: 41871 - DNA, 25 bp, Homo sapien
cagataggagagaaacaacgaagat

SEQ ID NO: 41872 - DNA, 25 bp, Homo sapien
cagataggagagaagcaacgaagat

SEQ ID NO: 41873 - DNA, 25 bp, Homo sapien
cagataggtgaaaaaaacagcttat

SEQ ID NO: 41874 - DNA, 25 bp, Homo sapien
cagataggtgaaaaaagcagcttat

SEQ ID NO: 41875 - DNA, 25 bp, Homo sapien
cagatagtccagcgttaaatgcctc

SEQ ID NO: 41876 - DNA, 25 bp, Homo sapien
cagatagtccagggttaaatgcctc

SEQ ID NO: 41877 - DNA, 25 bp, Homo sapien
cagatatagtcaaatgtttgtctcc

SEQ ID NO: 41878 - DNA, 25 bp, Homo sapien
cagatatattagagaaaaaaatgtc

SEQ ID NO: 41879 - DNA, 25 bp, Homo sapien
cagatatattagggaaaaaaatgtc

SEQ ID NO: 41880 - DNA, 25 bp, Homo sapien
cagatatattcaaatgtttgtctcc

SEQ ID NO: 41881 - DNA, 25 bp, Homo sapien
cagatatcgaacttataaactacaa

SEQ ID NO: 41882 - DNA, 25 bp, Homo sapien
cagatatcgaatttataaactacaa

SEQ ID NO: 41883 - DNA, 25 bp, Homo sapien
cagatatgattatagagaaaagagc

SEQ ID NO: 41884 - DNA, 25 bp, Homo sapien
cagatatgatttcagttgggccagt

SEQ ID NO: 41885 - DNA, 25 bp, Homo sapien
cagatatgatttcatttgggccagt

SEQ ID NO: 41886 - DNA, 25 bp, Homo sapien
cagatatggttatagagaaaagagc

SEQ ID NO: 41887 - DNA, 25 bp, Homo sapien
cagatattccctttgccgatggttg

SEQ ID NO: 41888 - DNA, 25 bp, Homo sapien
cagatattccctttgctgatggttg

SEQ ID NO: 41889 - DNA, 25 bp, Homo sapien
cagatattcctcacctatggttttt

SEQ ID NO: 41890 - DNA, 25 bp, Homo sapien
cagatattccttacctatggttttt

SEQ ID NO: 41891 - DNA, 25 bp, Homo sapien
cagatattgaggcttaagagtcatg

SEQ ID NO: 41892 - DNA, 25 bp, Homo sapien
cagatattgagtcttaagagtcatg

SEQ ID NO: 41893 - DNA, 25 bp, Homo sapien
cagatattgtttgaagcccaccacg

SEQ ID NO: 41894 - DNA, 25 bp, Homo sapien
cagatattgtttgaagtccaccacg

SEQ ID NO: 41895 - DNA, 25 bp, Homo sapien
cagatatttgacatggcttcctcct

SEQ ID NO: 41896 - DNA, 25 bp, Homo sapien
cagatatttgacgtggcttcctcct

SEQ ID NO: 41897 - DNA, 25 bp, Homo sapien
cagatcaaaacacagtgtgcctttg

SEQ ID NO: 41898 - DNA, 25 bp, Homo sapien
cagatcaaaacagagtgtgcctttg

SEQ ID NO: 41899 - DNA, 25 bp, Homo sapien
cagatcaaagaacaactgaatggaa

SEQ ID NO: 41900 - DNA, 25 bp, Homo sapien
cagatcaaagaaccactgaatggaa

SEQ ID NO: 41901 - DNA, 25 bp, Homo sapien
cagatcactcacactgtttgcattt

SEQ ID NO: 41902 - DNA, 25 bp, Homo sapien
cagatcactcatactgtttgcattt

SEQ ID NO: 41903 - DNA, 25 bp, Homo sapien
cagatcagagagagctgagtggata

SEQ ID NO: 41904 - DNA, 25 bp, Homo sapien
cagatcagagagaggtgagtggata

SEQ ID NO: 41905 - DNA, 25 bp, Homo sapien
cagatcccttacaaatggcttggtg

SEQ ID NO: 41906 - DNA, 25 bp, Homo sapien
cagatcccttacgaatggcttggtg

SEQ ID NO: 41907 - DNA, 25 bp, Homo sapien
cagatcctcatgattttaccaaaga

SEQ ID NO: 41908 - DNA, 25 bp, Homo sapien
cagatcctcctcactggctgttgag

SEQ ID NO: 41909 - DNA, 25 bp, Homo sapien
cagatcctcgagtgctaacattatg

SEQ ID NO: 41910 - DNA, 25 bp, Homo sapien
cagatcctcgtgattttaccaaaga

SEQ ID NO: 41911 - DNA, 25 bp, Homo sapien
cagatcctcttcactggctgttgag

SEQ ID NO: 41912 - DNA, 25 bp, Homo sapien
cagatcctgccagattgcaccttat

SEQ ID NO: 41913 - DNA, 25 bp, Homo sapien
cagatcctgccagtttgcaccttat

SEQ ID NO: 41914 - DNA, 25 bp, Homo sapien
cagatccttaatatcatcacatctg

SEQ ID NO: 41915 - DNA, 25 bp, Homo sapien
cagatccttaatgtcatcacatctg

SEQ ID NO: 41916 - DNA, 25 bp, Homo sapien
cagatccttgagtgctaacattatg

SEQ ID NO: 41917 - DNA, 25 bp, Homo sapien
cagatctacctcacatttaaaactg

SEQ ID NO: 41918 - DNA, 25 bp, Homo sapien
cagatctacgtaaacggaatcatct

SEQ ID NO: 41919 - DNA, 25 bp, Homo sapien
cagatctatctcacatttaaaactg

SEQ ID NO: 41920 - DNA, 25 bp, Homo sapien
cagatctatgtaaacggaatcatct

SEQ ID NO: 41921 - DNA, 25 bp, Homo sapien
cagatctccttgccctagcctagga

SEQ ID NO: 41922 - DNA, 25 bp, Homo sapien
cagatctccttgcgctagcctagga

SEQ ID NO: 41923 - DNA, 25 bp, Homo sapien
cagatcttaaagtggctgagcaatg

SEQ ID NO: 41924 - DNA, 25 bp, Homo sapien
cagatcttcaagtggctgagcaatg

SEQ ID NO: 41925 - DNA, 25 bp, Homo sapien
cagatcttcaccggactggcttcct

SEQ ID NO: 41926 - DNA, 25 bp, Homo sapien
cagatcttcacctgactggcttcct

SEQ ID NO: 41927 - DNA, 25 bp, Homo sapien
cagatcttcgcatgtttttcagata

SEQ ID NO: 41928 - DNA, 25 bp, Homo sapien
cagatctttgcatgtttttcagata

SEQ ID NO: 41929 - DNA, 25 bp, Homo sapien
cagatgaaacgaatcactctaactc

SEQ ID NO: 41930 - DNA, 25 bp, Homo sapien
cagatgaaacgagtcactctaactc

SEQ ID NO: 41931 - DNA, 25 bp, Homo sapien
cagatgaaagacaaaagtacctctg

SEQ ID NO: 41932 - DNA, 25 bp, Homo sapien
cagatgaaagacgaaagtacctctg

SEQ ID NO: 41933 - DNA, 25 bp, Homo sapien
cagatgaaagctatccctaaaccac

SEQ ID NO: 41934 - DNA, 25 bp, Homo sapien
cagatgaaggctatccctaaaccac

SEQ ID NO: 41935 - DNA, 25 bp, Homo sapien
cagatgacaggctgaaaggtttggt

SEQ ID NO: 41936 - DNA, 25 bp, Homo sapien
cagatgacgggctgaaaggtttggt

SEQ ID NO: 41937 - DNA, 25 bp, Homo sapien
cagatgacttcagatacagaaatct

SEQ ID NO: 41938 - DNA, 25 bp, Homo sapien
cagatgacttcaggtacagaaatct

SEQ ID NO: 41939 - DNA, 25 bp, Homo sapien
cagatgaggaaaccaagttatggtc

SEQ ID NO: 41940 - DNA, 25 bp, Homo sapien
cagatgaggaaaccgagttatggtc

SEQ ID NO: 41941 - DNA, 25 bp, Homo sapien
cagatgataagaaacatttgagatc

SEQ ID NO: 41942 - DNA, 25 bp, Homo sapien
cagatgataaggaacatttgagatc

SEQ ID NO: 41943 - DNA, 25 bp, Homo sapien
cagatgatactcccaaaacttaggt

SEQ ID NO: 41944 - DNA, 25 bp, Homo sapien
cagatgatactcctaaaacttaggt

SEQ ID NO: 41945 - DNA, 25 bp, Homo sapien
cagatgatcagctaattccacaaat

SEQ ID NO: 41946 - DNA, 25 bp, Homo sapien
cagatgatcagctagttccacaaat

SEQ ID NO: 41947 - DNA, 25 bp, Homo sapien
cagatgattttgcttgtccttagat

SEQ ID NO: 41948 - DNA, 25 bp, Homo sapien
cagatgattttggttgtccttagat

SEQ ID NO: 41949 - DNA, 25 bp, Homo sapien
cagatgcagggctgaacccagtcta

SEQ ID NO: 41950 - DNA, 25 bp, Homo sapien
cagatgcagggctggacccagtcta

SEQ ID NO: 41951 - DNA, 25 bp, Homo sapien
cagatgcctattgtattaccgagag

SEQ ID NO: 41952 - DNA, 25 bp, Homo sapien
cagatgcctattttattaccgagag

SEQ ID NO: 41953 - DNA, 25 bp, Homo sapien
cagatgctgaaagaacatttactag

SEQ ID NO: 41954 - DNA, 25 bp, Homo sapien
cagatgctgaagtcagagtctacat

SEQ ID NO: 41955 - DNA, 25 bp, Homo sapien
cagatgctgaagtcggagtctacat

SEQ ID NO: 41956 - DNA, 25 bp, Homo sapien
cagatgctggaagaacatttactag

SEQ ID NO: 41957 - DNA, 25 bp, Homo sapien
cagatgcttcactccaatttctacc

SEQ ID NO: 41958 - DNA, 25 bp, Homo sapien
cagatgcttcactccagtttctacc

SEQ ID NO: 41959 - DNA, 25 bp, Homo sapien
cagatgctttctgctctatctttag

SEQ ID NO: 41960 - DNA, 25 bp, Homo sapien
cagatgctttctggtctatctttag

SEQ ID NO: 41961 - DNA, 25 bp, Homo sapien
cagatggaaatgtgccaagtcacac

SEQ ID NO: 41962 - DNA, 25 bp, Homo sapien
cagatggaaatgtgccgagtcacac

SEQ ID NO: 41963 - DNA, 25 bp, Homo sapien
cagatggcaattttcacaaagaaag

SEQ ID NO: 41964 - DNA, 25 bp, Homo sapien
cagatggcaggaagtaatctttctg

SEQ ID NO: 41965 - DNA, 25 bp, Homo sapien
cagatggcagttttcacaaagaaag

SEQ ID NO: 41966 - DNA, 25 bp, Homo sapien
cagatggcatgaagtaatctttctg

SEQ ID NO: 41967 - DNA, 25 bp, Homo sapien
cagatggctatgcaataggttccct

SEQ ID NO: 41968 - DNA, 25 bp, Homo sapien
cagatggctatgtaataggttccct

SEQ ID NO: 41969 - DNA, 25 bp, Homo sapien
cagatggttttacaatgaaactgtt

SEQ ID NO: 41970 - DNA, 25 bp, Homo sapien
cagatggttttacgatgaaactgtt

SEQ ID NO: 41971 - DNA, 25 bp, Homo sapien
cagatgtaaattacggacctcgaga

SEQ ID NO: 41972 - DNA, 25 bp, Homo sapien
cagatgtaaattatggacctcgaga

SEQ ID NO: 41973 - DNA, 25 bp, Homo sapien
cagatgtccttttgatcacatttcc

SEQ ID NO: 41974 - DNA, 25 bp, Homo sapien
cagatgtccttttggtcacatttcc

SEQ ID NO: 41975 - DNA, 25 bp, Homo sapien
cagatgtgagcacagagattcaggg

SEQ ID NO: 41976 - DNA, 25 bp, Homo sapien
cagatgtgggcacagagattcaggg

SEQ ID NO: 41977 - DNA, 25 bp, Homo sapien
cagatgtttaaaaaagtgaccttcc

SEQ ID NO: 41978 - DNA, 25 bp, Homo sapien
cagatgtttaaacaagtgaccttcc

SEQ ID NO: 41979 - DNA, 25 bp, Homo sapien
cagatgtttctgaacgacacaaaac

SEQ ID NO: 41980 - DNA, 25 bp, Homo sapien
cagatgtttgcaataatcataatta

SEQ ID NO: 41981 - DNA, 25 bp, Homo sapien
cagatgtttgcagtaatcataatta

SEQ ID NO: 41982 - DNA, 25 bp, Homo sapien
cagatgtttttgaacgacacaaaac

SEQ ID NO: 41983 - DNA, 25 bp, Homo sapien
cagattaaaccttagaatgtgaacg

SEQ ID NO: 41984 - DNA, 25 bp, Homo sapien
cagattaaaccttagagtgtgaacg

SEQ ID NO: 41985 - DNA, 25 bp, Homo sapien
cagattacattaatacagcttctca

SEQ ID NO: 41986 - DNA, 25 bp, Homo sapien
cagattacattattacagcttctca

SEQ ID NO: 41987 - DNA, 25 bp, Homo sapien
cagattacatttatcggtttgtgta

SEQ ID NO: 41988 - DNA, 25 bp, Homo sapien
cagattacatttattggtttgtgta

SEQ ID NO: 41989 - DNA, 25 bp, Homo sapien
cagattactagcccgggtgcccaac

SEQ ID NO: 41990 - DNA, 25 bp, Homo sapien
cagattactagcctgggtgcccaac

SEQ ID NO: 41991 - DNA, 25 bp, Homo sapien
cagattatcataaccagttccacca

SEQ ID NO: 41992 - DNA, 25 bp, Homo sapien
cagattatcataatcagttccacca

SEQ ID NO: 41993 - DNA, 25 bp, Homo sapien
cagattcaaacggacctctgcaact

SEQ ID NO: 41994 - DNA, 25 bp, Homo sapien
cagattcaaacggagctctgcaact

SEQ ID NO: 41995 - DNA, 25 bp, Homo sapien
cagattcaaagggtatgttgttttt

SEQ ID NO: 41996 - DNA, 25 bp, Homo sapien
cagattcaaggggtatgttgttttt

SEQ ID NO: 41997 - DNA, 25 bp, Homo sapien
cagattcgttcacttgaacatcata

SEQ ID NO: 41998 - DNA, 25 bp, Homo sapien
cagattcgttcatttgaacatcata

SEQ ID NO: 41999 - DNA, 25 bp, Homo sapien
cagattctccattcattcttaagtg

SEQ ID NO: 42000 - DNA, 25 bp, Homo sapien
cagattctccattcgttcttaagtg

SEQ ID NO: 42001 - DNA, 25 bp, Homo sapien
cagattctctaattacatgctacca

SEQ ID NO: 42002 - DNA, 25 bp, Homo sapien
cagattctctaatttcatgctacca

SEQ ID NO: 42003 - DNA, 25 bp, Homo sapien
cagattctggatacttgcagccagc

SEQ ID NO: 42004 - DNA, 25 bp, Homo sapien
cagattctggatactttcagccagc

SEQ ID NO: 42005 - DNA, 25 bp, Homo sapien
cagattctgtttacggagaacagaa

SEQ ID NO: 42006 - DNA, 25 bp, Homo sapien
cagattctgtttatggagaacagaa

SEQ ID NO: 42007 - DNA, 25 bp, Homo sapien
cagattgaagtcccggaagaaaaaa

SEQ ID NO: 42008 - DNA, 25 bp, Homo sapien
cagattgaagtcctggaagaaaaaa

SEQ ID NO: 42009 - DNA, 25 bp, Homo sapien
cagattgagacagaaagagagaatg

SEQ ID NO: 42010 - DNA, 25 bp, Homo sapien
cagattgagacagtaagagagaatg

SEQ ID NO: 42011 - DNA, 25 bp, Homo sapien
cagattgagttaatcttttgagcta

SEQ ID NO: 42012 - DNA, 25 bp, Homo sapien
cagattgagttaattttttgagcta

SEQ ID NO: 42013 - DNA, 25 bp, Homo sapien
cagattgccttagaagacttttaaa

SEQ ID NO: 42014 - DNA, 25 bp, Homo sapien
cagattgccttaggagacttttaaa

SEQ ID NO: 42015 - DNA, 25 bp, Homo sapien
cagattggcttgaacagagaggttg

SEQ ID NO: 42016 - DNA, 25 bp, Homo sapien
cagattggcttgagcagagaggttg

SEQ ID NO: 42017 - DNA, 25 bp, Homo sapien
cagattgtcagaaaagtagctttag

SEQ ID NO: 42018 - DNA, 25 bp, Homo sapien
cagattgtcagataagtagctttag

SEQ ID NO: 42019 - DNA, 25 bp, Homo sapien
cagattgttggtaagaggaattcca

SEQ ID NO: 42020 - DNA, 25 bp, Homo sapien
cagattgtttgtaagaggaattcca

SEQ ID NO: 42021 - DNA, 25 bp, Homo sapien
cagatttacaacactgtattataac

SEQ ID NO: 42022 - DNA, 25 bp, Homo sapien
cagatttaccacactgtattataac

SEQ ID NO: 42023 - DNA, 25 bp, Homo sapien
cagatttatgcctgtagaaaaaaca

SEQ ID NO: 42024 - DNA, 25 bp, Homo sapien
cagatttatgcttgtagaaaaaaca

SEQ ID NO: 42025 - DNA, 25 bp, Homo sapien
cagatttcggaacgtgctgatctca

SEQ ID NO: 42026 - DNA, 25 bp, Homo sapien
cagatttcggaatgtgctgatctca

SEQ ID NO: 42027 - DNA, 25 bp, Homo sapien
cagatttgatataagaggacagaag

SEQ ID NO: 42028 - DNA, 25 bp, Homo sapien
cagatttggtataagaggacagaag

SEQ ID NO: 42029 - DNA, 25 bp, Homo sapien
cagattttctggccatgtgtctact

SEQ ID NO: 42030 - DNA, 25 bp, Homo sapien
cagattttctggccgtgtgtctact

SEQ ID NO: 42031 - DNA, 25 bp, Homo sapien
cagattttgctattcagtatttata

SEQ ID NO: 42032 - DNA, 25 bp, Homo sapien
cagattttgctatttagtatttata

SEQ ID NO: 42033 - DNA, 25 bp, Homo sapien
cagatttttggaattctgtattttt

SEQ ID NO: 42034 - DNA, 25 bp, Homo sapien
cagattttttgaattctgtattttt

SEQ ID NO: 42035 - DNA, 25 bp, Homo sapien
cagcaaaaatcacttgggcatcatc

SEQ ID NO: 42036 - DNA, 25 bp, Homo sapien
cagcaaaaatcatttgggcatcatc

SEQ ID NO: 42037 - DNA, 25 bp, Homo sapien
cagcaaaacctggcctttcctgaat

SEQ ID NO: 42038 - DNA, 25 bp, Homo sapien
cagcaaaaggcatgatcttgctggg

SEQ ID NO: 42039 - DNA, 25 bp, Homo sapien
cagcaaaaggcatggtcttgctggg

SEQ ID NO: 42040 - DNA, 25 bp, Homo sapien
cagcaaaatctggcctttcctgaat

SEQ ID NO: 42041 - DNA, 25 bp, Homo sapien
cagcaaaatgactttcaaaagagga

SEQ ID NO: 42042 - DNA, 25 bp, Homo sapien
cagcaaaatgattttcaaaagagga

SEQ ID NO: 42043 - DNA, 25 bp, Homo sapien
cagcaaacaacaatttcttccgtga

SEQ ID NO: 42044 - DNA, 25 bp, Homo sapien
cagcaaacaaccatttcttccgtga

SEQ ID NO: 42045 - DNA, 25 bp, Homo sapien
cagcaaacacactctcttgacccga

SEQ ID NO: 42046 - DNA, 25 bp, Homo sapien
cagcaaacacactgtcttgacccga

SEQ ID NO: 42047 - DNA, 25 bp, Homo sapien
cagcaaacatgatctattcccctga

SEQ ID NO: 42048 - DNA, 25 bp, Homo sapien
cagcaaacatgttctattcccctga

SEQ ID NO: 42049 - DNA, 25 bp, Homo sapien
cagcaaactctgaaggggcccattc

SEQ ID NO: 42050 - DNA, 25 bp, Homo sapien
cagcaaactctgagggggcccattc

SEQ ID NO: 42051 - DNA, 25 bp, Homo sapien
cagcaaagcattccctgaccacacg

SEQ ID NO: 42052 - DNA, 25 bp, Homo sapien
cagcaaagcattccttgaccacacg

SEQ ID NO: 42053 - DNA, 25 bp, Homo sapien
cagcaaagcgctgtaactatggcct

SEQ ID NO: 42054 - DNA, 25 bp, Homo sapien
cagcaaagtgctgtaactatggcct

SEQ ID NO: 42055 - DNA, 25 bp, Homo sapien
cagcaaataagcaacggaaccagaa

SEQ ID NO: 42056 - DNA, 25 bp, Homo sapien
cagcaaataagcaatggaaccagaa

SEQ ID NO: 42057 - DNA, 25 bp, Homo sapien
cagcaaatgtaaagcaggcagaata

SEQ ID NO: 42058 - DNA, 25 bp, Homo sapien
cagcaaatgtaaaggaggcagaata

SEQ ID NO: 42059 - DNA, 25 bp, Homo sapien
cagcaaattcaatgaaggaaatcca

SEQ ID NO: 42060 - DNA, 25 bp, Homo sapien
cagcaaattcattgaaggaaatcca

SEQ ID NO: 42061 - DNA, 25 bp, Homo sapien
cagcaacaatcaaagaaagttcttg

SEQ ID NO: 42062 - DNA, 25 bp, Homo sapien
cagcaacaatcagagaaagttcttg

SEQ ID NO: 42063 - DNA, 25 bp, Homo sapien
cagcaacaatttgaaaaatctgtaa

SEQ ID NO: 42064 - DNA, 25 bp, Homo sapien
cagcaacaatttgcaaaatctgtaa

SEQ ID NO: 42065 - DNA, 25 bp, Homo sapien
cagcaacacccaagtttagcagcag

SEQ ID NO: 42066 - DNA, 25 bp, Homo sapien
cagcaacacccaggtttagcagcag

SEQ ID NO: 42067 - DNA, 25 bp, Homo sapien
cagcaacagaaacctattaagatcc

SEQ ID NO: 42068 - DNA, 25 bp, Homo sapien
cagcaacagaaatctattaagatcc

SEQ ID NO: 42069 - DNA, 25 bp, Homo sapien
cagcaacctatttatacacataagc

SEQ ID NO: 42070 - DNA, 25 bp, Homo sapien
cagcaacctatttatatacataagc

SEQ ID NO: 42071 - DNA, 25 bp, Homo sapien
cagcaactactgaatgtgaggcatt

SEQ ID NO: 42072 - DNA, 25 bp, Homo sapien
cagcaactattgaatgtgaggcatt

SEQ ID NO: 42073 - DNA, 25 bp, Homo sapien
cagcaagaaaggcctggggcaagaa

SEQ ID NO: 42074 - DNA, 25 bp, Homo sapien
cagcaagaaaggtctggggcaagaa

SEQ ID NO: 42075 - DNA, 25 bp, Homo sapien
cagcaagagagaccaaaactcactg

SEQ ID NO: 42076 - DNA, 25 bp, Homo sapien
cagcaagagagaccaacactcactg

SEQ ID NO: 42077 - DNA, 25 bp, Homo sapien
cagcaagatgactacagatgccata

SEQ ID NO: 42078 - DNA, 25 bp, Homo sapien
cagcaagatgactatagatgccata

SEQ ID NO: 42079 - DNA, 25 bp, Homo sapien
cagcaagcaaatcgtggtcctggaa

SEQ ID NO: 42080 - DNA, 25 bp, Homo sapien
cagcaagcaaattgtggtcctggaa

SEQ ID NO: 42081 - DNA, 25 bp, Homo sapien
cagcaagcagagtatgcgataagag

SEQ ID NO: 42082 - DNA, 25 bp, Homo sapien
cagcaagcagagtatgtgataagag

SEQ ID NO: 42083 - DNA, 25 bp, Homo sapien
cagcaagcagtcttcctgcaatggt

SEQ ID NO: 42084 - DNA, 25 bp, Homo sapien
cagcaagcagtctttctgcaatggt

SEQ ID NO: 42085 - DNA, 25 bp, Homo sapien
cagcaagcccgtgggagcgcaggga

SEQ ID NO: 42086 - DNA, 25 bp, Homo sapien
cagcaagcctgtgggagcgcaggga

SEQ ID NO: 42087 - DNA, 25 bp, Homo sapien
cagcaaggaaacgagggccactatg

SEQ ID NO: 42088 - DNA, 25 bp, Homo sapien
cagcaaggaaatgagggccactatg

SEQ ID NO: 42089 - DNA, 25 bp, Homo sapien
cagcaagttccagccttatttttat

SEQ ID NO: 42090 - DNA, 25 bp, Homo sapien
cagcaagttccagcgttatttttat

SEQ ID NO: 42091 - DNA, 25 bp, Homo sapien
cagcaataaggaagtaatacagtgc

SEQ ID NO: 42092 - DNA, 25 bp, Homo sapien
cagcaatagatgaggacattttgga

SEQ ID NO: 42093 - DNA, 25 bp, Homo sapien
cagcaatagatgatgacattttgga

SEQ ID NO: 42094 - DNA, 25 bp, Homo sapien
cagcaatagcatctaaagacaatat

SEQ ID NO: 42095 - DNA, 25 bp, Homo sapien
cagcaatagcatctgaagacaatat

SEQ ID NO: 42096 - DNA, 25 bp, Homo sapien
cagcaatagggaagtaatacagtgc

SEQ ID NO: 42097 - DNA, 25 bp, Homo sapien
cagcaatatcctctttcagaactag

SEQ ID NO: 42098 - DNA, 25 bp, Homo sapien
cagcaatatcctgtttcagaactag

SEQ ID NO: 42099 - DNA, 25 bp, Homo sapien
cagcaatcagtcctccaaggactca

SEQ ID NO: 42100 - DNA, 25 bp, Homo sapien
cagcaatcggtcctccaaggactca

SEQ ID NO: 42101 - DNA, 25 bp, Homo sapien
cagcaatgcatgtggtggtgtaatg

SEQ ID NO: 42102 - DNA, 25 bp, Homo sapien
cagcaatgcgtgtggtggtgtaatg

SEQ ID NO: 42103 - DNA, 25 bp, Homo sapien
cagcaatttcactgcttagaactta

SEQ ID NO: 42104 - DNA, 25 bp, Homo sapien
cagcaatttcacttcttagaactta

SEQ ID NO: 42105 - DNA, 25 bp, Homo sapien
cagcacaaacagatgggtgggtgaa

SEQ ID NO: 42106 - DNA, 25 bp, Homo sapien
cagcacaaatagatgggtgggtgaa

SEQ ID NO: 42107 - DNA, 25 bp, Homo sapien
cagcacaaatcacccaaacaaattt

SEQ ID NO: 42108 - DNA, 25 bp, Homo sapien
cagcacaaatcagccaaacaaattt

SEQ ID NO: 42109 - DNA, 25 bp, Homo sapien
cagcacacggcatcacacccagtcc

SEQ ID NO: 42110 - DNA, 25 bp, Homo sapien
cagcacacggcatcgcacccagtcc

SEQ ID NO: 42111 - DNA, 25 bp, Homo sapien
cagcacagaaaaaactaccatttat

SEQ ID NO: 42112 - DNA, 25 bp, Homo sapien
cagcacagaaaaaattaccatttat

SEQ ID NO: 42113 - DNA, 25 bp, Homo sapien
cagcacagaaagaaagacttcattt

SEQ ID NO: 42114 - DNA, 25 bp, Homo sapien
cagcacagcaagaaagacttcattt

SEQ ID NO: 42115 - DNA, 25 bp, Homo sapien
cagcacagcgaagacacggatcttc

SEQ ID NO: 42116 - DNA, 25 bp, Homo sapien
cagcacagggtcttgtattcaaaac

SEQ ID NO: 42117 - DNA, 25 bp, Homo sapien
cagcacagtgaagacacggatcttc

SEQ ID NO: 42118 - DNA, 25 bp, Homo sapien
cagcacagtgtcttgtattcaaaac

SEQ ID NO: 42119 - DNA, 25 bp, Homo sapien
cagcacatatgcaacaagaagcggc

SEQ ID NO: 42120 - DNA, 25 bp, Homo sapien
cagcacatatgtaacaagaagcggc

SEQ ID NO: 42121 - DNA, 25 bp, Homo sapien
cagcacatgagttgcctactgacat

SEQ ID NO: 42122 - DNA, 25 bp, Homo sapien
cagcacatgagttgtctactgacat

SEQ ID NO: 42123 - DNA, 25 bp, Homo sapien
cagcacatgtgtcctgaagaaatga

SEQ ID NO: 42124 - DNA, 25 bp, Homo sapien
cagcacatgtgtcctgcagaaatga

SEQ ID NO: 42125 - DNA, 25 bp, Homo sapien
cagcacattcccaatggtgtcctct

SEQ ID NO: 42126 - DNA, 25 bp, Homo sapien
cagcacattcccgatggtgtcctct

SEQ ID NO: 42127 - DNA, 25 bp, Homo sapien
cagcaccaaaaatcgaatgtagctc

SEQ ID NO: 42128 - DNA, 25 bp, Homo sapien
cagcaccaaaaatcgagtgtagctc

SEQ ID NO: 42129 - DNA, 25 bp, Homo sapien
cagcaccacttcccaacaggatcag

SEQ ID NO: 42130 - DNA, 25 bp, Homo sapien
cagcaccacttcccaataggatcag

SEQ ID NO: 42131 - DNA, 25 bp, Homo sapien
cagcaccatgcaatagaaaagattt

SEQ ID NO: 42132 - DNA, 25 bp, Homo sapien
cagcaccatgcattagaaaagattt

SEQ ID NO: 42133 - DNA, 25 bp, Homo sapien
cagcacccattattcttccttatgg

SEQ ID NO: 42134 - DNA, 25 bp, Homo sapien
cagcacccattgcctccttactcaa

SEQ ID NO: 42135 - DNA, 25 bp, Homo sapien
cagcacccatttcctccttactcaa

SEQ ID NO: 42136 - DNA, 25 bp, Homo sapien
cagcacccgaatttcacatcccagg

SEQ ID NO: 42137 - DNA, 25 bp, Homo sapien
cagcacccgaatttcatatcccagg

SEQ ID NO: 42138 - DNA, 25 bp, Homo sapien
cagcaccctttattcttccttatgg

SEQ ID NO: 42139 - DNA, 25 bp, Homo sapien
cagcacctactgtcaatgtaggcct

SEQ ID NO: 42140 - DNA, 25 bp, Homo sapien
cagcacctgctgtcaatgtaggcct

SEQ ID NO: 42141 - DNA, 25 bp, Homo sapien
cagcacgggcaatggaatgagaccc

SEQ ID NO: 42142 - DNA, 25 bp, Homo sapien
cagcacgggcaatggagtgagaccc

SEQ ID NO: 42143 - DNA, 25 bp, Homo sapien
cagcactcactataatttctgatat

SEQ ID NO: 42144 - DNA, 25 bp, Homo sapien
cagcactcactgtaatttctgatat

SEQ ID NO: 42145 - DNA, 25 bp, Homo sapien
cagcactctgcagacttcactttcc

SEQ ID NO: 42146 - DNA, 25 bp, Homo sapien
cagcactctgcaggcttcactttcc

SEQ ID NO: 42147 - DNA, 25 bp, Homo sapien
cagcactttcaacacagaaacatac

SEQ ID NO: 42148 - DNA, 25 bp, Homo sapien
cagcacttttaacacagaaacatac

SEQ ID NO: 42149 - DNA, 25 bp, Homo sapien
cagcagaacgaagaaaaaatagaga

SEQ ID NO: 42150 - DNA, 25 bp, Homo sapien
cagcagaacgttaatcgacacgcgt

SEQ ID NO: 42151 - DNA, 25 bp, Homo sapien
cagcagaatgaagaaaaaatagaga

SEQ ID NO: 42152 - DNA, 25 bp, Homo sapien
cagcagaatgcactaggacctgcaa

SEQ ID NO: 42153 - DNA, 25 bp, Homo sapien
cagcagaatgcagtaggacctgcaa

SEQ ID NO: 42154 - DNA, 25 bp, Homo sapien
cagcagaatgttaatcgacacgcgt

SEQ ID NO: 42155 - DNA, 25 bp, Homo sapien
cagcagagaatacatgtgttttttt

SEQ ID NO: 42156 - DNA, 25 bp, Homo sapien
cagcagagaatgcatgtgttttttt

SEQ ID NO: 42157 - DNA, 25 bp, Homo sapien
cagcagagacacgtttcctgaattt

SEQ ID NO: 42158 - DNA, 25 bp, Homo sapien
cagcagagacatgtttcctgaattt

SEQ ID NO: 42159 - DNA, 25 bp, Homo sapien
cagcagagcaggcagagccgttctt

SEQ ID NO: 42160 - DNA, 25 bp, Homo sapien
cagcagagcaggtagagccgttctt

SEQ ID NO: 42161 - DNA, 25 bp, Homo sapien
cagcagagcattccctactctatcc

SEQ ID NO: 42162 - DNA, 25 bp, Homo sapien
cagcagagcattccttactctatcc

SEQ ID NO: 42163 - DNA, 25 bp, Homo sapien
cagcagagctcgtgttatctaacct

SEQ ID NO: 42164 - DNA, 25 bp, Homo sapien
cagcagagctcgtgttgtctaacct

SEQ ID NO: 42165 - DNA, 25 bp, Homo sapien
cagcagatactatgatatccaacat

SEQ ID NO: 42166 - DNA, 25 bp, Homo sapien
cagcagatactctgatatccaacat

SEQ ID NO: 42167 - DNA, 25 bp, Homo sapien
cagcagatcattcagctctttcctg

SEQ ID NO: 42168 - DNA, 25 bp, Homo sapien
cagcagatctttcagctctttcctg

SEQ ID NO: 42169 - DNA, 25 bp, Homo sapien
cagcagcaatggaagggataaggac

SEQ ID NO: 42170 - DNA, 25 bp, Homo sapien
cagcagcacaaacagatgggtgggt

SEQ ID NO: 42171 - DNA, 25 bp, Homo sapien
cagcagcacaaatagatgggtgggt

SEQ ID NO: 42172 - DNA, 25 bp, Homo sapien
cagcagcacagggaatgaggaagca

SEQ ID NO: 42173 - DNA, 25 bp, Homo sapien
cagcagcacagtgaatgaggaagca

SEQ ID NO: 42174 - DNA, 25 bp, Homo sapien
cagcagcactgcaaacatagtagct

SEQ ID NO: 42175 - DNA, 25 bp, Homo sapien
cagcagcactggaagggataaggac

SEQ ID NO: 42176 - DNA, 25 bp, Homo sapien
cagcagcactttcaacacagaaaca

SEQ ID NO: 42177 - DNA, 25 bp, Homo sapien
cagcagcacttttaacacagaaaca

SEQ ID NO: 42178 - DNA, 25 bp, Homo sapien
cagcagcagagccagtagaaaagaa

SEQ ID NO: 42179 - DNA, 25 bp, Homo sapien
cagcagcagagcccgtagaaaagaa

SEQ ID NO: 42180 - DNA, 25 bp, Homo sapien
cagcagcattgcaaacatagtagct

SEQ ID NO: 42181 - DNA, 25 bp, Homo sapien
cagcagccaaacccagacagaggtg

SEQ ID NO: 42182 - DNA, 25 bp, Homo sapien
cagcagccaaaccgagacagaggtg

SEQ ID NO: 42183 - DNA, 25 bp, Homo sapien
cagcagccaacagtaattttttaaa

SEQ ID NO: 42184 - DNA, 25 bp, Homo sapien
cagcagccaacggtaattttttaaa

SEQ ID NO: 42185 - DNA, 25 bp, Homo sapien
cagcagctaaccctagtcactggga

SEQ ID NO: 42186 - DNA, 25 bp, Homo sapien
cagcagctatccctagtcactggga

SEQ ID NO: 42187 - DNA, 25 bp, Homo sapien
cagcaggcaagaaagcgtttgcagg

SEQ ID NO: 42188 - DNA, 25 bp, Homo sapien
cagcaggcaagagagcgtttgcagg

SEQ ID NO: 42189 - DNA, 25 bp, Homo sapien
cagcagggacatgcctctcagcttc

SEQ ID NO: 42190 - DNA, 25 bp, Homo sapien
cagcagggacatggctctcagcttc

SEQ ID NO: 42191 - DNA, 25 bp, Homo sapien
cagcagggatgaaaacaaaattaat

SEQ ID NO: 42192 - DNA, 25 bp, Homo sapien
cagcagggatgaaagcaaaattaat

SEQ ID NO: 42193 - DNA, 25 bp, Homo sapien
cagcagtaaaatgatcaaacaattt

SEQ ID NO: 42194 - DNA, 25 bp, Homo sapien
cagcagtaaaatgttcaaacaattt

SEQ ID NO: 42195 - DNA, 25 bp, Homo sapien
cagcagtccaagaacttgcccacct

SEQ ID NO: 42196 - DNA, 25 bp, Homo sapien
cagcagtccgagaacttgcccacct

SEQ ID NO: 42197 - DNA, 25 bp, Homo sapien
cagcagtctgtatgacctctaattc

SEQ ID NO: 42198 - DNA, 25 bp, Homo sapien
cagcagtctgtatggcctctaattc

SEQ ID NO: 42199 - DNA, 25 bp, Homo sapien
cagcagtcttgctatcgagtcctcg

SEQ ID NO: 42200 - DNA, 25 bp, Homo sapien
cagcagtcttgctgtcgagtcctcg

SEQ ID NO: 42201 - DNA, 25 bp, Homo sapien
cagcagtgatgccattgggtactag

SEQ ID NO: 42202 - DNA, 25 bp, Homo sapien
cagcagtgatgtcattgggtactag

SEQ ID NO: 42203 - DNA, 25 bp, Homo sapien
cagcagttgctcttccactgatctc

SEQ ID NO: 42204 - DNA, 25 bp, Homo sapien
cagcagttgctcttcctctgatctc

SEQ ID NO: 42205 - DNA, 25 bp, Homo sapien
cagcagtttatgtgcgaggtattta

SEQ ID NO: 42206 - DNA, 25 bp, Homo sapien
cagcagtttatgtgtgaggtattta

SEQ ID NO: 42207 - DNA, 25 bp, Homo sapien
cagcataagatagctcatttacaaa

SEQ ID NO: 42208 - DNA, 25 bp, Homo sapien
cagcataagatggctcatttacaaa

SEQ ID NO: 42209 - DNA, 25 bp, Homo sapien
cagcatactcttttcgttcagcctt

SEQ ID NO: 42210 - DNA, 25 bp, Homo sapien
cagcatactctttttgttcagcctt

SEQ ID NO: 42211 - DNA, 25 bp, Homo sapien
cagcatagaagcatagaacgtttag

SEQ ID NO: 42212 - DNA, 25 bp, Homo sapien
cagcatagaagcgtagaacgtttag

SEQ ID NO: 42213 - DNA, 25 bp, Homo sapien
cagcatagacacaattgcagtgttg

SEQ ID NO: 42214 - DNA, 25 bp, Homo sapien
cagcatagacacgattgcagtgttg

SEQ ID NO: 42215 - DNA, 25 bp, Homo sapien
cagcatagagcacataagctttcac

SEQ ID NO: 42216 - DNA, 25 bp, Homo sapien
cagcatagagcacgtaagctttcac

SEQ ID NO: 42217 - DNA, 25 bp, Homo sapien
cagcatatctgattggctacaaagt

SEQ ID NO: 42218 - DNA, 25 bp, Homo sapien
cagcatatctggttggctacaaagt

SEQ ID NO: 42219 - DNA, 25 bp, Homo sapien
cagcatcaacagtagaaagatctat

SEQ ID NO: 42220 - DNA, 25 bp, Homo sapien
cagcatcaatagtagaaagatctat

SEQ ID NO: 42221 - DNA, 25 bp, Homo sapien
cagcatcaatcacacctgtcctcta

SEQ ID NO: 42222 - DNA, 25 bp, Homo sapien
cagcatcaatcatacctgtcctcta

SEQ ID NO: 42223 - DNA, 25 bp, Homo sapien
cagcatcactccctttaaaggataa

SEQ ID NO: 42224 - DNA, 25 bp, Homo sapien
cagcatcactccttttaaaggataa

SEQ ID NO: 42225 - DNA, 25 bp, Homo sapien
cagcatcagactcctatacctgcat

SEQ ID NO: 42226 - DNA, 25 bp, Homo sapien
cagcatcagacttctatacctgcat

SEQ ID NO: 42227 - DNA, 25 bp, Homo sapien
cagcatcagagaatcaatgtattcc

SEQ ID NO: 42228 - DNA, 25 bp, Homo sapien
cagcatcagagaatcagtgtattcc

SEQ ID NO: 42229 - DNA, 25 bp, Homo sapien
cagcatccaccacggaaatcgtatt

SEQ ID NO: 42230 - DNA, 25 bp, Homo sapien
cagcatccaccatggaaatcgtatt

SEQ ID NO: 42231 - DNA, 25 bp, Homo sapien
cagcatctaggataagacgaaaacg

SEQ ID NO: 42232 - DNA, 25 bp, Homo sapien
cagcatctaggatgagacgaaaacg

SEQ ID NO: 42233 - DNA, 25 bp, Homo sapien
cagcatctgtgagattatttcatta

SEQ ID NO: 42234 - DNA, 25 bp, Homo sapien
cagcatctttgagattatttcatta

SEQ ID NO: 42235 - DNA, 25 bp, Homo sapien
cagcatgccgtgagagtcactctga

SEQ ID NO: 42236 - DNA, 25 bp, Homo sapien
cagcatgctgtgagagtcactctga

SEQ ID NO: 42237 - DNA, 25 bp, Homo sapien
cagcatggccaccgtggaattcacc

SEQ ID NO: 42238 - DNA, 25 bp, Homo sapien
cagcatggccactgtggaattcacc

SEQ ID NO: 42239 - DNA, 25 bp, Homo sapien
cagcattaaacagctctgaggcctt

SEQ ID NO: 42240 - DNA, 25 bp, Homo sapien
cagcattaaccagctctgaggcctt

SEQ ID NO: 42241 - DNA, 25 bp, Homo sapien
cagcattaccgagccactagtgtat

SEQ ID NO: 42242 - DNA, 25 bp, Homo sapien
cagcattactgagccactagtgtat

SEQ ID NO: 42243 - DNA, 25 bp, Homo sapien
cagcattattcacaatacccaatat

SEQ ID NO: 42244 - DNA, 25 bp, Homo sapien
cagcattattcacagtacccaatat

SEQ ID NO: 42245 - DNA, 25 bp, Homo sapien
cagcattcctacttcaccaaaaccc

SEQ ID NO: 42246 - DNA, 25 bp, Homo sapien
cagcattctgatcttcaccctgaat

SEQ ID NO: 42247 - DNA, 25 bp, Homo sapien
cagcattctgatcttctccctgaat

SEQ ID NO: 42248 - DNA, 25 bp, Homo sapien
cagcattcttacttcaccaaaaccc

SEQ ID NO: 42249 - DNA, 25 bp, Homo sapien
cagcatttacatgtttaacaagcta

SEQ ID NO: 42250 - DNA, 25 bp, Homo sapien
cagcatttacatttttaacaagcta

SEQ ID NO: 42251 - DNA, 25 bp, Homo sapien
cagcatttcccacatgagcactgca

SEQ ID NO: 42252 - DNA, 25 bp, Homo sapien
cagcatttcccatatgagcactgca

SEQ ID NO: 42253 - DNA, 25 bp, Homo sapien
cagccaaagagctagttctcctcag

SEQ ID NO: 42254 - DNA, 25 bp, Homo sapien
cagccaaagagctggttctcctcag

SEQ ID NO: 42255 - DNA, 25 bp, Homo sapien
cagccaacacatctctaaaaattag

SEQ ID NO: 42256 - DNA, 25 bp, Homo sapien
cagccaacagtaattttttaaaaat

SEQ ID NO: 42257 - DNA, 25 bp, Homo sapien
cagccaacgcatctctaaaaattag

SEQ ID NO: 42258 - DNA, 25 bp, Homo sapien
cagccaacggtaattttttaaaaat

SEQ ID NO: 42259 - DNA, 25 bp, Homo sapien
cagccaatacgtgtcaggattcatc

SEQ ID NO: 42260 - DNA, 25 bp, Homo sapien
cagccaatacgtgtgaggattcatc

SEQ ID NO: 42261 - DNA, 25 bp, Homo sapien
cagccaatcatccaagcctgtgcaa

SEQ ID NO: 42262 - DNA, 25 bp, Homo sapien
cagccaatcatcccagcctgtgcaa

SEQ ID NO: 42263 - DNA, 25 bp, Homo sapien
cagccaatcctcagttaatagacat

SEQ ID NO: 42264 - DNA, 25 bp, Homo sapien
cagccaatccttagttaatagacat

SEQ ID NO: 42265 - DNA, 25 bp, Homo sapien
cagccacaaattagtcattaatatg

SEQ ID NO: 42266 - DNA, 25 bp, Homo sapien
cagccacaatttagtcattaatatg

SEQ ID NO: 42267 - DNA, 25 bp, Homo sapien
cagccacagacagctcccgatgcgc

SEQ ID NO: 42268 - DNA, 25 bp, Homo sapien
cagccacagacggctcccgatgcgc

SEQ ID NO: 42269 - DNA, 25 bp, Homo sapien
cagccacatttatgatctcacagtt

SEQ ID NO: 42270 - DNA, 25 bp, Homo sapien
cagccacatttatgatttcacagtt

SEQ ID NO: 42271 - DNA, 25 bp, Homo sapien
cagccaccatgccaaacactttata

SEQ ID NO: 42272 - DNA, 25 bp, Homo sapien
cagccaccgtgccaaacactttata

SEQ ID NO: 42273 - DNA, 25 bp, Homo sapien
cagccacctgctttctgtcattata

SEQ ID NO: 42274 - DNA, 25 bp, Homo sapien
cagccacctgctttgtgtcattata

SEQ ID NO: 42275 - DNA, 25 bp, Homo sapien
cagccacttggctccgctgtatttc

SEQ ID NO: 42276 - DNA, 25 bp, Homo sapien
cagccacttggctctgctgtatttc

SEQ ID NO: 42277 - DNA, 25 bp, Homo sapien
cagccagacagagcctttggaagac

SEQ ID NO: 42278 - DNA, 25 bp, Homo sapien
cagccagacagaggctttggaagac

SEQ ID NO: 42279 - DNA, 25 bp, Homo sapien
cagccagacttacatttagtagaat

SEQ ID NO: 42280 - DNA, 25 bp, Homo sapien
cagccagacttatatttagtagaat

SEQ ID NO: 42281 - DNA, 25 bp, Homo sapien
cagccagactttgtgctggttacag

SEQ ID NO: 42282 - DNA, 25 bp, Homo sapien
cagccagactttttgctggttacag

SEQ ID NO: 42283 - DNA, 25 bp, Homo sapien
cagccagagaagtctgaggaggata

SEQ ID NO: 42284 - DNA, 25 bp, Homo sapien
cagccagagaagtttgaggaggata

SEQ ID NO: 42285 - DNA, 25 bp, Homo sapien
cagccagctacaggagagtttgggt

SEQ ID NO: 42286 - DNA, 25 bp, Homo sapien
cagccagctacaggagcgtttgggt

SEQ ID NO: 42287 - DNA, 25 bp, Homo sapien
cagccaggaactaagaaagaagatt

SEQ ID NO: 42288 - DNA, 25 bp, Homo sapien
cagccaggaactactaaaaagacat

SEQ ID NO: 42289 - DNA, 25 bp, Homo sapien
cagccaggaactgctaaaaagacat

SEQ ID NO: 42290 - DNA, 25 bp, Homo sapien
cagccaggatctaagaaagaagatt

SEQ ID NO: 42291 - DNA, 25 bp, Homo sapien
cagccagggtcattgccatcccaca

SEQ ID NO: 42292 - DNA, 25 bp, Homo sapien
cagccagggtcgttgccatcccaca

SEQ ID NO: 42293 - DNA, 25 bp, Homo sapien
cagccaggtatcacagagtgcttaa

SEQ ID NO: 42294 - DNA, 25 bp, Homo sapien
cagccaggtatcatagagtgcttaa

SEQ ID NO: 42295 - DNA, 25 bp, Homo sapien
cagccagtgcggtggatttcatatt

SEQ ID NO: 42296 - DNA, 25 bp, Homo sapien
cagccagtgtggtggatttcatatt

SEQ ID NO: 42297 - DNA, 25 bp, Homo sapien
cagccatacttgggtaacagaatta

SEQ ID NO: 42298 - DNA, 25 bp, Homo sapien
cagccatatttgggtaacagaatta

SEQ ID NO: 42299 - DNA, 25 bp, Homo sapien
cagccatcctcagtagactttaaac

SEQ ID NO: 42300 - DNA, 25 bp, Homo sapien
cagccatcctcggtagactttaaac

SEQ ID NO: 42301 - DNA, 25 bp, Homo sapien
cagccatggtggttacggtgaaaga

SEQ ID NO: 42302 - DNA, 25 bp, Homo sapien
cagccatggtggttgcggtgaaaga

SEQ ID NO: 42303 - DNA, 25 bp, Homo sapien
cagccattaaacatgaacctgggtc

SEQ ID NO: 42304 - DNA, 25 bp, Homo sapien
cagccattacaaagttaggaaaaac

SEQ ID NO: 42305 - DNA, 25 bp, Homo sapien
cagccattacaaggttaggaaaaac

SEQ ID NO: 42306 - DNA, 25 bp, Homo sapien
cagccattagacatgaacctgggtc

SEQ ID NO: 42307 - DNA, 25 bp, Homo sapien
cagccattatcattatccattatca

SEQ ID NO: 42308 - DNA, 25 bp, Homo sapien
cagccattgcagttccactttgccc

SEQ ID NO: 42309 - DNA, 25 bp, Homo sapien
cagccattgcagttccgctttgccc

SEQ ID NO: 42310 - DNA, 25 bp, Homo sapien
cagccattgtcattatccattatca

SEQ ID NO: 42311 - DNA, 25 bp, Homo sapien
cagcccaaaccgtcacagttaacca

SEQ ID NO: 42312 - DNA, 25 bp, Homo sapien
cagcccaaaccgtcactgttaacca

SEQ ID NO: 42313 - DNA, 25 bp, Homo sapien
cagcccacacatggggcacagtgag

SEQ ID NO: 42314 - DNA, 25 bp, Homo sapien
cagcccacgcatggggcacagtgag

SEQ ID NO: 42315 - DNA, 25 bp, Homo sapien
cagcccagacaggtcatggaaactg

SEQ ID NO: 42316 - DNA, 25 bp, Homo sapien
cagcccagagaggtcatggaaactg

SEQ ID NO: 42317 - DNA, 25 bp, Homo sapien
cagcccagatgcggagtcacagagt

SEQ ID NO: 42318 - DNA, 25 bp, Homo sapien
cagcccagatgtggagtcacagagt

SEQ ID NO: 42319 - DNA, 25 bp, Homo sapien
cagcccatcatactgtaggaatgtc

SEQ ID NO: 42320 - DNA, 25 bp, Homo sapien
cagcccatcatattgtaggaatgtc

SEQ ID NO: 42321 - DNA, 25 bp, Homo sapien
cagcccatgcccacttcaatctgtt

SEQ ID NO: 42322 - DNA, 25 bp, Homo sapien
cagcccatgccctcttcaatctgtt

SEQ ID NO: 42323 - DNA, 25 bp, Homo sapien
cagccctagtaagcgtggattcact

SEQ ID NO: 42324 - DNA, 25 bp, Homo sapien
cagccctagtaagtgtggattcact

SEQ ID NO: 42325 - DNA, 25 bp, Homo sapien
cagccctcctaatttacttcacatt

SEQ ID NO: 42326 - DNA, 25 bp, Homo sapien
cagccctcctaatttatttcacatt

SEQ ID NO: 42327 - DNA, 25 bp, Homo sapien
cagccctgatgaatgattttgaagg

SEQ ID NO: 42328 - DNA, 25 bp, Homo sapien
cagccctgatgcatgattttgaagg

SEQ ID NO: 42329 - DNA, 25 bp, Homo sapien
cagccctgttggacggaactttgct

SEQ ID NO: 42330 - DNA, 25 bp, Homo sapien
cagccctgttggatggaactttgct

SEQ ID NO: 42331 - DNA, 25 bp, Homo sapien
cagcccttacggttcaacaagcttc

SEQ ID NO: 42332 - DNA, 25 bp, Homo sapien
cagcccttacggttcagcaagcttc

SEQ ID NO: 42333 - DNA, 25 bp, Homo sapien
cagccgtagtttcgtcatttcatat

SEQ ID NO: 42334 - DNA, 25 bp, Homo sapien
cagccgtagtttcttcatttcatat

SEQ ID NO: 42335 - DNA, 25 bp, Homo sapien
cagccgtctctccatgacttggtgc

SEQ ID NO: 42336 - DNA, 25 bp, Homo sapien
cagccgtctctccatggcttggtgc

SEQ ID NO: 42337 - DNA, 25 bp, Homo sapien
cagcctacagatggcaattttcaca

SEQ ID NO: 42338 - DNA, 25 bp, Homo sapien
cagcctacagatggcagttttcaca

SEQ ID NO: 42339 - DNA, 25 bp, Homo sapien
cagcctacattttaactaactcttg

SEQ ID NO: 42340 - DNA, 25 bp, Homo sapien
cagcctaccttttaactaactcttg

SEQ ID NO: 42341 - DNA, 25 bp, Homo sapien
cagcctactattgccaggtagctgg

SEQ ID NO: 42342 - DNA, 25 bp, Homo sapien
cagcctactgttgccaggtagctgg

SEQ ID NO: 42343 - DNA, 25 bp, Homo sapien
cagcctatctcagcccttatcatgc

SEQ ID NO: 42344 - DNA, 25 bp, Homo sapien
cagcctatctcagctcttatcatgc

SEQ ID NO: 42345 - DNA, 25 bp, Homo sapien
cagcctattcagaattaggatgaca

SEQ ID NO: 42346 - DNA, 25 bp, Homo sapien
cagcctattcaggattaggatgaca

SEQ ID NO: 42347 - DNA, 25 bp, Homo sapien
cagcctcagaataggaatagcataa

SEQ ID NO: 42348 - DNA, 25 bp, Homo sapien
cagcctcagaattggaatagcataa

SEQ ID NO: 42349 - DNA, 25 bp, Homo sapien
cagcctccaacccacgttctcctca

SEQ ID NO: 42350 - DNA, 25 bp, Homo sapien
cagcctccaacccatgttctcctca

SEQ ID NO: 42351 - DNA, 25 bp, Homo sapien
cagcctccatcaatattagagaaat

SEQ ID NO: 42352 - DNA, 25 bp, Homo sapien
cagcctccatcaatgttagagaaat

SEQ ID NO: 42353 - DNA, 25 bp, Homo sapien
cagcctcctgatctatgagaaataa

SEQ ID NO: 42354 - DNA, 25 bp, Homo sapien
cagcctcctgatttatgagaaataa

SEQ ID NO: 42355 - DNA, 25 bp, Homo sapien
cagcctctaaaaactcacaaagaac

SEQ ID NO: 42356 - DNA, 25 bp, Homo sapien
cagcctctaaaaactcccaaagaac

SEQ ID NO: 42357 - DNA, 25 bp, Homo sapien
cagcctctcagcgatctctcgtcag

SEQ ID NO: 42358 - DNA, 25 bp, Homo sapien
cagcctctcagtgatctctcgtcag

SEQ ID NO: 42359 - DNA, 25 bp, Homo sapien
cagcctgccaaggttccaataaatg

SEQ ID NO: 42360 - DNA, 25 bp, Homo sapien
cagcctgccaatgttccaataaatg

SEQ ID NO: 42361 - DNA, 25 bp, Homo sapien
cagcctggcatgagttaagttcagt

SEQ ID NO: 42362 - DNA, 25 bp, Homo sapien
cagcctgggatgagttaagttcagt

SEQ ID NO: 42363 - DNA, 25 bp, Homo sapien
cagcctggtcaacacgatgaaaccc

SEQ ID NO: 42364 - DNA, 25 bp, Homo sapien
cagcctggtcaatacgatgaaaccc

SEQ ID NO: 42365 - DNA, 25 bp, Homo sapien
cagccttaaaagagatccttaaaag

SEQ ID NO: 42366 - DNA, 25 bp, Homo sapien
cagccttaacagagatccttaaaag

SEQ ID NO: 42367 - DNA, 25 bp, Homo sapien
cagccttagctctggtccctctcga

SEQ ID NO: 42368 - DNA, 25 bp, Homo sapien
cagccttagctcttgtccctctcga

SEQ ID NO: 42369 - DNA, 25 bp, Homo sapien
cagccttattctagttaaatgtaaa

SEQ ID NO: 42370 - DNA, 25 bp, Homo sapien
cagccttattctggttaaatgtaaa

SEQ ID NO: 42371 - DNA, 25 bp, Homo sapien
cagccttcactcaacagtagttttt

SEQ ID NO: 42372 - DNA, 25 bp, Homo sapien
cagccttcactcaacattagttttt

SEQ ID NO: 42373 - DNA, 25 bp, Homo sapien
cagccttgctgacagcttgatttcg

SEQ ID NO: 42374 - DNA, 25 bp, Homo sapien
cagccttgtagttcgaggagaggaa

SEQ ID NO: 42375 - DNA, 25 bp, Homo sapien
cagccttgtagttggaggagaggaa

SEQ ID NO: 42376 - DNA, 25 bp, Homo sapien
cagccttgttgacagcttgatttcg

SEQ ID NO: 42377 - DNA, 25 bp, Homo sapien
cagcctttacataacagtagtcata

SEQ ID NO: 42378 - DNA, 25 bp, Homo sapien
cagcctttacataatagtagtcata

SEQ ID NO: 42379 - DNA, 25 bp, Homo sapien
cagcctttgccacagagcgagatcc

SEQ ID NO: 42380 - DNA, 25 bp, Homo sapien
cagcctttgccatagagcgagatcc

SEQ ID NO: 42381 - DNA, 25 bp, Homo sapien
cagcctttggcacgtgaagataatt

SEQ ID NO: 42382 - DNA, 25 bp, Homo sapien
cagcctttggcatgtgaagataatt

SEQ ID NO: 42383 - DNA, 25 bp, Homo sapien
cagcgaaaacttctaaggatggaat

SEQ ID NO: 42384 - DNA, 25 bp, Homo sapien
cagcgaaaacttgtaaggatggaat

SEQ ID NO: 42385 - DNA, 25 bp, Homo sapien
cagcgagccacacctggatcacagt

SEQ ID NO: 42386 - DNA, 25 bp, Homo sapien
cagcgagccacgcctggatcacagt

SEQ ID NO: 42387 - DNA, 25 bp, Homo sapien
cagcgataccacgctcttccacgta

SEQ ID NO: 42388 - DNA, 25 bp, Homo sapien
cagcgataccactctcttccacgta

SEQ ID NO: 42389 - DNA, 25 bp, Homo sapien
cagcgatctgcaacatttcatttaa

SEQ ID NO: 42390 - DNA, 25 bp, Homo sapien
cagcgatctgcaacttttcatttaa

SEQ ID NO: 42391 - DNA, 25 bp, Homo sapien
cagcgctagttgacggctagcccaa

SEQ ID NO: 42392 - DNA, 25 bp, Homo sapien
cagcgctagttgatggctagcccaa

SEQ ID NO: 42393 - DNA, 25 bp, Homo sapien
cagcgctgtgacatgggaagggccc

SEQ ID NO: 42394 - DNA, 25 bp, Homo sapien
cagcgctgtgacgtgggaagggccc

SEQ ID NO: 42395 - DNA, 25 bp, Homo sapien
cagctaaactcacattccttctagt

SEQ ID NO: 42396 - DNA, 25 bp, Homo sapien
cagctaaactcatattccttctagt

SEQ ID NO: 42397 - DNA, 25 bp, Homo sapien
cagctaacacatgacattgggcctg

SEQ ID NO: 42398 - DNA, 25 bp, Homo sapien
cagctaacacatggcattgggcctg

SEQ ID NO: 42399 - DNA, 25 bp, Homo sapien
cagctaactttattgtatacaaact

SEQ ID NO: 42400 - DNA, 25 bp, Homo sapien
cagctaactttattgtgtacaaact

SEQ ID NO: 42401 - DNA, 25 bp, Homo sapien
cagctaagactagcagagactctta

SEQ ID NO: 42402 - DNA, 25 bp, Homo sapien
cagctaagagacgaagaccatccct

SEQ ID NO: 42403 - DNA, 25 bp, Homo sapien
cagctaagagactaagaccatccct

SEQ ID NO: 42404 - DNA, 25 bp, Homo sapien
cagctaagattagcagagactctta

SEQ ID NO: 42405 - DNA, 25 bp, Homo sapien
cagctaatatccagaaagggtaaaa

SEQ ID NO: 42406 - DNA, 25 bp, Homo sapien
cagctaatatcctgaaagggtaaaa

SEQ ID NO: 42407 - DNA, 25 bp, Homo sapien
cagctaattgactagtgactaaaat

SEQ ID NO: 42408 - DNA, 25 bp, Homo sapien
cagctaatttactagtgactaaaat

SEQ ID NO: 42409 - DNA, 25 bp, Homo sapien
cagctacaacaacttaaagagattg

SEQ ID NO: 42410 - DNA, 25 bp, Homo sapien
cagctacaacaatttaaagagattg

SEQ ID NO: 42411 - DNA, 25 bp, Homo sapien
cagctacaccattattatgttttaa

SEQ ID NO: 42412 - DNA, 25 bp, Homo sapien
cagctacactattattatgttttaa

SEQ ID NO: 42413 - DNA, 25 bp, Homo sapien
cagctacaggagagtttgggtcagc

SEQ ID NO: 42414 - DNA, 25 bp, Homo sapien
cagctacaggagcgtttgggtcagc

SEQ ID NO: 42415 - DNA, 25 bp, Homo sapien
cagctacagtgcaagctaaaaacat

SEQ ID NO: 42416 - DNA, 25 bp, Homo sapien
cagctacagtgcgagctaaaaacat

SEQ ID NO: 42417 - DNA, 25 bp, Homo sapien
cagctacccattatcaattaccttc

SEQ ID NO: 42418 - DNA, 25 bp, Homo sapien
cagctacccattattaattaccttc

SEQ ID NO: 42419 - DNA, 25 bp, Homo sapien
cagctactatctggtttttgtctca

SEQ ID NO: 42420 - DNA, 25 bp, Homo sapien
cagctactatctgttttttgtctca

SEQ ID NO: 42421 - DNA, 25 bp, Homo sapien
cagctactctaaccattgatccttt

SEQ ID NO: 42422 - DNA, 25 bp, Homo sapien
cagctactctaatcattgatccttt

SEQ ID NO: 42423 - DNA, 25 bp, Homo sapien
cagctagaagacacttaccagcttt

SEQ ID NO: 42424 - DNA, 25 bp, Homo sapien
cagctagaggatcgaaggccaaccc

SEQ ID NO: 42425 - DNA, 25 bp, Homo sapien
cagctagaggattgaaggccaaccc

SEQ ID NO: 42426 - DNA, 25 bp, Homo sapien
cagctagatgacacttaccagcttt

SEQ ID NO: 42427 - DNA, 25 bp, Homo sapien
cagctagcacagaagaaagaacttt

SEQ ID NO: 42428 - DNA, 25 bp, Homo sapien
cagctagcacagtagaaagaacttt

SEQ ID NO: 42429 - DNA, 25 bp, Homo sapien
cagctagtaaatagtagacccagga

SEQ ID NO: 42430 - DNA, 25 bp, Homo sapien
cagctagtaaatggtagacccagga

SEQ ID NO: 42431 - DNA, 25 bp, Homo sapien
cagctagtaacaaacgcaagcttag

SEQ ID NO: 42432 - DNA, 25 bp, Homo sapien
cagctagtaacaaatgcaagcttag

SEQ ID NO: 42433 - DNA, 25 bp, Homo sapien
cagctagtgaagtaggaagagaatg

SEQ ID NO: 42434 - DNA, 25 bp, Homo sapien
cagctagttaagtaggaagagaatg

SEQ ID NO: 42435 - DNA, 25 bp, Homo sapien
cagctataggtgactagatgttcga

SEQ ID NO: 42436 - DNA, 25 bp, Homo sapien
cagctataggttactagatgttcga

SEQ ID NO: 42437 - DNA, 25 bp, Homo sapien
cagctatgattatggatattgagat

SEQ ID NO: 42438 - DNA, 25 bp, Homo sapien
cagctatgattgtggatattgagat

SEQ ID NO: 42439 - DNA, 25 bp, Homo sapien
cagctatttgtttacattccacttg

SEQ ID NO: 42440 - DNA, 25 bp, Homo sapien
cagctatttgtttagattccacttg

SEQ ID NO: 42441 - DNA, 25 bp, Homo sapien
cagctcaatcaagagaacagtcaaa

SEQ ID NO: 42442 - DNA, 25 bp, Homo sapien
cagctcaatcaagataacagtcaaa

SEQ ID NO: 42443 - DNA, 25 bp, Homo sapien
cagctcacaggaaccacggcctcag

SEQ ID NO: 42444 - DNA, 25 bp, Homo sapien
cagctcacaggaaccatggcctcag

SEQ ID NO: 42445 - DNA, 25 bp, Homo sapien
cagctcagaatggaaaacgcatttg

SEQ ID NO: 42446 - DNA, 25 bp, Homo sapien
cagctcagagtggaaaacgcatttg

SEQ ID NO: 42447 - DNA, 25 bp, Homo sapien
cagctcagatgtcactttctcagaa

SEQ ID NO: 42448 - DNA, 25 bp, Homo sapien
cagctcagatgtcgctttctcagaa

SEQ ID NO: 42449 - DNA, 25 bp, Homo sapien
cagctcaggccatttttctacttgc

SEQ ID NO: 42450 - DNA, 25 bp, Homo sapien
cagctcaggtcatttttctacttgc

SEQ ID NO: 42451 - DNA, 25 bp, Homo sapien
cagctcatagaaacagaagacatga

SEQ ID NO: 42452 - DNA, 25 bp, Homo sapien
cagctcatagaagcagaagacatga

SEQ ID NO: 42453 - DNA, 25 bp, Homo sapien
cagctcatggtcctgtgcaaattaa

SEQ ID NO: 42454 - DNA, 25 bp, Homo sapien
cagctcatggtcttgtgcaaattaa

SEQ ID NO: 42455 - DNA, 25 bp, Homo sapien
cagctcatgtacacattttttttgg

SEQ ID NO: 42456 - DNA, 25 bp, Homo sapien
cagctcatgtacactttttttttgg

SEQ ID NO: 42457 - DNA, 25 bp, Homo sapien
cagctccaaccagaatactgcgata

SEQ ID NO: 42458 - DNA, 25 bp, Homo sapien
cagctccaatgttttcactctacat

SEQ ID NO: 42459 - DNA, 25 bp, Homo sapien
cagctccacccagaatactgcgata

SEQ ID NO: 42460 - DNA, 25 bp, Homo sapien
cagctccagtgttttcactctacat

SEQ ID NO: 42461 - DNA, 25 bp, Homo sapien
cagctccatttccaagccactgcta

SEQ ID NO: 42462 - DNA, 25 bp, Homo sapien
cagctccatttccaggccactgcta

SEQ ID NO: 42463 - DNA, 25 bp, Homo sapien
cagctcccaaaccaaatcctattca

SEQ ID NO: 42464 - DNA, 25 bp, Homo sapien
cagctcccaaatcaaatcctattca

SEQ ID NO: 42465 - DNA, 25 bp, Homo sapien
cagctccctgcaccagtacttggct

SEQ ID NO: 42466 - DNA, 25 bp, Homo sapien
cagctccctgcgccagtacttggct

SEQ ID NO: 42467 - DNA, 25 bp, Homo sapien
cagctcttacaggctcttcaaggta

SEQ ID NO: 42468 - DNA, 25 bp, Homo sapien
cagctcttacagtctcttcaaggta

SEQ ID NO: 42469 - DNA, 25 bp, Homo sapien
cagctcttctctcatggtaatacaa

SEQ ID NO: 42470 - DNA, 25 bp, Homo sapien
cagctcttctcttatggtaatacaa

SEQ ID NO: 42471 - DNA, 25 bp, Homo sapien
cagctcttggaaaaaaggtctgttt

SEQ ID NO: 42472 - DNA, 25 bp, Homo sapien
cagctcttggacaaaaggtctgttt

SEQ ID NO: 42473 - DNA, 25 bp, Homo sapien
cagctgaaattcaaacccaggtggt

SEQ ID NO: 42474 - DNA, 25 bp, Homo sapien
cagctgaaattcgaacccaggtggt

SEQ ID NO: 42475 - DNA, 25 bp, Homo sapien
cagctgatgatattcaaggatgttt

SEQ ID NO: 42476 - DNA, 25 bp, Homo sapien
cagctgatgatgttcaaggatgttt

SEQ ID NO: 42477 - DNA, 25 bp, Homo sapien
cagctgattcactcagttgaaacat

SEQ ID NO: 42478 - DNA, 25 bp, Homo sapien
cagctgattcacttagttgaaacat

SEQ ID NO: 42479 - DNA, 25 bp, Homo sapien
cagctgccacttaatgactttacct

SEQ ID NO: 42480 - DNA, 25 bp, Homo sapien
cagctgccagtagtgccctctgcct

SEQ ID NO: 42481 - DNA, 25 bp, Homo sapien
cagctgccgcttaatgactttacct

SEQ ID NO: 42482 - DNA, 25 bp, Homo sapien
cagctgccggtagtgccctctgcct

SEQ ID NO: 42483 - DNA, 25 bp, Homo sapien
cagctgcctatttcacacatacaga

SEQ ID NO: 42484 - DNA, 25 bp, Homo sapien
cagctgcctatttcgcacatacaga

SEQ ID NO: 42485 - DNA, 25 bp, Homo sapien
cagctgctacactacagcgccacac

SEQ ID NO: 42486 - DNA, 25 bp, Homo sapien
cagctgctacattacagcgccacac

SEQ ID NO: 42487 - DNA, 25 bp, Homo sapien
cagctgcttagtgaaggtgatttcc

SEQ ID NO: 42488 - DNA, 25 bp, Homo sapien
cagctgcttagtgatggtgatttcc

SEQ ID NO: 42489 - DNA, 25 bp, Homo sapien
cagctgcttgaaggcaaggatgatg

SEQ ID NO: 42490 - DNA, 25 bp, Homo sapien
cagctgcttgaaggcagggatgatg

SEQ ID NO: 42491 - DNA, 25 bp, Homo sapien
cagctgggaagaagatgacccccaa

SEQ ID NO: 42492 - DNA, 25 bp, Homo sapien
cagctgggaggaagatgacccccaa

SEQ ID NO: 42493 - DNA, 25 bp, Homo sapien
cagctggggtgctcagaggacgcct

SEQ ID NO: 42494 - DNA, 25 bp, Homo sapien
cagctggggtgttcagaggacgcct

SEQ ID NO: 42495 - DNA, 25 bp, Homo sapien
cagctgggtttagagacagctgatt

SEQ ID NO: 42496 - DNA, 25 bp, Homo sapien
cagctgggtttagagatagctgatt

SEQ ID NO: 42497 - DNA, 25 bp, Homo sapien
cagctgtaaatatctcagtgctatt

SEQ ID NO: 42498 - DNA, 25 bp, Homo sapien
cagctgtaaatatttcagtgctatt

SEQ ID NO: 42499 - DNA, 25 bp, Homo sapien
cagctgtattgcgtccatttaacat

SEQ ID NO: 42500 - DNA, 25 bp, Homo sapien
cagctgtattgtgtccatttaacat

SEQ ID NO: 42501 - DNA, 25 bp, Homo sapien
cagctgtcacatatttccattttgt

SEQ ID NO: 42502 - DNA, 25 bp, Homo sapien
cagctgtcacatattttcattttgt

SEQ ID NO: 42503 - DNA, 25 bp, Homo sapien
cagctgtgaacagatggataaggtc

SEQ ID NO: 42504 - DNA, 25 bp, Homo sapien
cagctgtgaacaggtggataaggtc

SEQ ID NO: 42505 - DNA, 25 bp, Homo sapien
cagctgtgacattagactctcacag

SEQ ID NO: 42506 - DNA, 25 bp, Homo sapien
cagctgtggcattagactctcacag

SEQ ID NO: 42507 - DNA, 25 bp, Homo sapien
cagctgtggcctgataaaggcaaat

SEQ ID NO: 42508 - DNA, 25 bp, Homo sapien
cagctgtggtctgataaaggcaaat

SEQ ID NO: 42509 - DNA, 25 bp, Homo sapien
cagctgtgtcacatgccttagttta

SEQ ID NO: 42510 - DNA, 25 bp, Homo sapien
cagctgtgtcatatgccttagttta

SEQ ID NO: 42511 - DNA, 25 bp, Homo sapien
cagctgttagtatgatatgctgata

SEQ ID NO: 42512 - DNA, 25 bp, Homo sapien
cagctgttagtgtgatatgctgata

SEQ ID NO: 42513 - DNA, 25 bp, Homo sapien
cagctgtttgacgctcaatggatcc

SEQ ID NO: 42514 - DNA, 25 bp, Homo sapien
cagctgtttgatgctcaatggatcc

SEQ ID NO: 42515 - DNA, 25 bp, Homo sapien
cagcttaacattttaacccagccaa

SEQ ID NO: 42516 - DNA, 25 bp, Homo sapien
cagcttaatattttaacccagccaa

SEQ ID NO: 42517 - DNA, 25 bp, Homo sapien
cagcttaattagccaggtgtcctgc

SEQ ID NO: 42518 - DNA, 25 bp, Homo sapien
cagcttaattagcgaggtgtcctgc

SEQ ID NO: 42519 - DNA, 25 bp, Homo sapien
cagcttaccaggactttaaactctt

SEQ ID NO: 42520 - DNA, 25 bp, Homo sapien
cagcttaccaggattttaaactctt

SEQ ID NO: 42521 - DNA, 25 bp, Homo sapien
cagcttaccatattttcagagttat

SEQ ID NO: 42522 - DNA, 25 bp, Homo sapien
cagcttaccatgttttcagagttat

SEQ ID NO: 42523 - DNA, 25 bp, Homo sapien
cagcttataaacaacattgaaataa

SEQ ID NO: 42524 - DNA, 25 bp, Homo sapien
cagcttataaactacattgaaataa

SEQ ID NO: 42525 - DNA, 25 bp, Homo sapien
cagcttatcttcagctcagttaagt

SEQ ID NO: 42526 - DNA, 25 bp, Homo sapien
cagcttattttcagctcagttaagt

SEQ ID NO: 42527 - DNA, 25 bp, Homo sapien
cagcttcatatgccggaaattaaga

SEQ ID NO: 42528 - DNA, 25 bp, Homo sapien
cagcttcatatgctggaaattaaga

SEQ ID NO: 42529 - DNA, 25 bp, Homo sapien
cagcttcctaccactatggtccaga

SEQ ID NO: 42530 - DNA, 25 bp, Homo sapien
cagcttcctaccgctatggtccaga

SEQ ID NO: 42531 - DNA, 25 bp, Homo sapien
cagcttctacgtaccacgctcaaat

SEQ ID NO: 42532 - DNA, 25 bp, Homo sapien
cagcttctaggagctcagcaggaag

SEQ ID NO: 42533 - DNA, 25 bp, Homo sapien
cagcttctatgtaccacgctcaaat

SEQ ID NO: 42534 - DNA, 25 bp, Homo sapien
cagcttctcaacgtgttacttgtct

SEQ ID NO: 42535 - DNA, 25 bp, Homo sapien
cagcttctcaatgtgttacttgtct

SEQ ID NO: 42536 - DNA, 25 bp, Homo sapien
cagcttctgggagctcagcaggaag

SEQ ID NO: 42537 - DNA, 25 bp, Homo sapien
cagcttcttaaatctgtagactcat

SEQ ID NO: 42538 - DNA, 25 bp, Homo sapien
cagcttcttaactctgtagactcat

SEQ ID NO: 42539 - DNA, 25 bp, Homo sapien
cagcttgaagcatctgtgacatctg

SEQ ID NO: 42540 - DNA, 25 bp, Homo sapien
cagcttgaagcatttgtgacatctg

SEQ ID NO: 42541 - DNA, 25 bp, Homo sapien
cagcttgccgcaatcttggtctccc

SEQ ID NO: 42542 - DNA, 25 bp, Homo sapien
cagcttgctgcaatcttggtctccc

SEQ ID NO: 42543 - DNA, 25 bp, Homo sapien
cagcttggcagaaaatgtaatgctt

SEQ ID NO: 42544 - DNA, 25 bp, Homo sapien
cagcttggcaggaaatgtaatgctt

SEQ ID NO: 42545 - DNA, 25 bp, Homo sapien
cagcttggcattgatcaaacacttt

SEQ ID NO: 42546 - DNA, 25 bp, Homo sapien
cagcttggcattgttcaaacacttt

SEQ ID NO: 42547 - DNA, 25 bp, Homo sapien
cagcttgggtatggctatgtctggg

SEQ ID NO: 42548 - DNA, 25 bp, Homo sapien
cagcttggttatggctatgtctggg

SEQ ID NO: 42549 - DNA, 25 bp, Homo sapien
cagcttgtgagtacaaataaaatca

SEQ ID NO: 42550 - DNA, 25 bp, Homo sapien
cagcttgtgagtataaataaaatca

SEQ ID NO: 42551 - DNA, 25 bp, Homo sapien
cagcttgtggctccaaaaaagactc

SEQ ID NO: 42552 - DNA, 25 bp, Homo sapien
cagcttgtggctcgaaaaaagactc

SEQ ID NO: 42553 - DNA, 25 bp, Homo sapien
cagctttaagtctaagtagaagcga

SEQ ID NO: 42554 - DNA, 25 bp, Homo sapien
cagctttaagtctatgtagaagcga

SEQ ID NO: 42555 - DNA, 25 bp, Homo sapien
cagctttatcaacgggtccaaagtt

SEQ ID NO: 42556 - DNA, 25 bp, Homo sapien
cagctttatcaatgggtccaaagtt

SEQ ID NO: 42557 - DNA, 25 bp, Homo sapien
cagctttccaagagaaataagcagt

SEQ ID NO: 42558 - DNA, 25 bp, Homo sapien
cagctttccaagagaattaagcagt

SEQ ID NO: 42559 - DNA, 25 bp, Homo sapien
cagctttctgtcgggaaatcctctt

SEQ ID NO: 42560 - DNA, 25 bp, Homo sapien
cagctttctgttgggaaatcctctt

SEQ ID NO: 42561 - DNA, 25 bp, Homo sapien
cagctttgatcaaaacactcaaatc

SEQ ID NO: 42562 - DNA, 25 bp, Homo sapien
cagctttgatcgaaacactcaaatc

SEQ ID NO: 42563 - DNA, 25 bp, Homo sapien
cagctttgctctacattcttttcaa

SEQ ID NO: 42564 - DNA, 25 bp, Homo sapien
cagctttgctctacgttcttttcaa

SEQ ID NO: 42565 - DNA, 25 bp, Homo sapien
cagctttggcaccaaggccagggag

SEQ ID NO: 42566 - DNA, 25 bp, Homo sapien
cagctttggcactaaggccagggag

SEQ ID NO: 42567 - DNA, 25 bp, Homo sapien
cagcttttatttcgtctctacaggc

SEQ ID NO: 42568 - DNA, 25 bp, Homo sapien
cagcttttatttcttctctacaggc

SEQ ID NO: 42569 - DNA, 25 bp, Homo sapien
cagcttttcattgaagctactacat

SEQ ID NO: 42570 - DNA, 25 bp, Homo sapien
cagcttttcgttgaagctactacat

SEQ ID NO: 42571 - DNA, 25 bp, Homo sapien
cagcttttctctacctcttcccacc

SEQ ID NO: 42572 - DNA, 25 bp, Homo sapien
cagcttttctctagctcttcccacc

SEQ ID NO: 42573 - DNA, 25 bp, Homo sapien
cagctttttcgcccacagcaagaaa

SEQ ID NO: 42574 - DNA, 25 bp, Homo sapien
cagctttttcgcctacagcaagaaa

SEQ ID NO: 42575 - DNA, 25 bp, Homo sapien
caggaaaaatatagccctgaggatt

SEQ ID NO: 42576 - DNA, 25 bp, Homo sapien
caggaaaaatatggccctgaggatt

SEQ ID NO: 42577 - DNA, 25 bp, Homo sapien
caggaaaatagataacattacaatg

SEQ ID NO: 42578 - DNA, 25 bp, Homo sapien
caggaaaataggaagaagaaatgga

SEQ ID NO: 42579 - DNA, 25 bp, Homo sapien
caggaaaatcacctgatgaagcatt

SEQ ID NO: 42580 - DNA, 25 bp, Homo sapien
caggaaaatcacttgatgaagcatt

SEQ ID NO: 42581 - DNA, 25 bp, Homo sapien
caggaaaatcgataacattacaatg

SEQ ID NO: 42582 - DNA, 25 bp, Homo sapien
caggaaaatgataacagagtaccct

SEQ ID NO: 42583 - DNA, 25 bp, Homo sapien
caggaaaatgataagagagtaccct

SEQ ID NO: 42584 - DNA, 25 bp, Homo sapien
caggaaaatgggaagaagaaatgga

SEQ ID NO: 42585 - DNA, 25 bp, Homo sapien
caggaaacaatgtcatattcagcac

SEQ ID NO: 42586 - DNA, 25 bp, Homo sapien
caggaaactatgtcatattcagcac

SEQ ID NO: 42587 - DNA, 25 bp, Homo sapien
caggaaacttcaataaactatcctg

SEQ ID NO: 42588 - DNA, 25 bp, Homo sapien
caggaaacttcaataacctatcctg

SEQ ID NO: 42589 - DNA, 25 bp, Homo sapien
caggaaagacagtcataaatttctg

SEQ ID NO: 42590 - DNA, 25 bp, Homo sapien
caggaaagagccacatgttcagtga

SEQ ID NO: 42591 - DNA, 25 bp, Homo sapien
caggaaagagccagatgttcagtga

SEQ ID NO: 42592 - DNA, 25 bp, Homo sapien
caggaaaggaaaggagacagggaga

SEQ ID NO: 42593 - DNA, 25 bp, Homo sapien
caggaaaggaaaggcgacagggaga

SEQ ID NO: 42594 - DNA, 25 bp, Homo sapien
caggaaaggcagtcataaatttctg

SEQ ID NO: 42595 - DNA, 25 bp, Homo sapien
caggaaagggtgtcggcagggagaa

SEQ ID NO: 42596 - DNA, 25 bp, Homo sapien
caggaaagggtgttggcagggagaa

SEQ ID NO: 42597 - DNA, 25 bp, Homo sapien
caggaaagtccatggagaagcccac

SEQ ID NO: 42598 - DNA, 25 bp, Homo sapien
caggaaagtccgtggagaagcccac

SEQ ID NO: 42599 - DNA, 25 bp, Homo sapien
caggaaatgtatacgcccgcttagc

SEQ ID NO: 42600 - DNA, 25 bp, Homo sapien
caggaaatgtatatgcccgcttagc

SEQ ID NO: 42601 - DNA, 25 bp, Homo sapien
caggaacacaaaatgcagatgtggg

SEQ ID NO: 42602 - DNA, 25 bp, Homo sapien
caggaacacaaaatgctgatgtggg

SEQ ID NO: 42603 - DNA, 25 bp, Homo sapien
caggaacagatgcccaaaaacagtc

SEQ ID NO: 42604 - DNA, 25 bp, Homo sapien
caggaacagatgtccaaaaacagtc

SEQ ID NO: 42605 - DNA, 25 bp, Homo sapien
caggaacattcaaattcaggaaaca

SEQ ID NO: 42606 - DNA, 25 bp, Homo sapien
caggaacattcaaatttaggaaaca

SEQ ID NO: 42607 - DNA, 25 bp, Homo sapien
caggaaccacggcctcagcacaaac

SEQ ID NO: 42608 - DNA, 25 bp, Homo sapien
caggaaccatggcctcagcacaaac

SEQ ID NO: 42609 - DNA, 25 bp, Homo sapien
caggaacctggacagtgataggact

SEQ ID NO: 42610 - DNA, 25 bp, Homo sapien
caggaacctgggcagtgataggact

SEQ ID NO: 42611 - DNA, 25 bp, Homo sapien
caggaactcttaatcattcctggaa

SEQ ID NO: 42612 - DNA, 25 bp, Homo sapien
caggaactcttattcattcctggaa

SEQ ID NO: 42613 - DNA, 25 bp, Homo sapien
caggaactttaggaatatactgtgt

SEQ ID NO: 42614 - DNA, 25 bp, Homo sapien
caggaactttagggatatactgtgt

SEQ ID NO: 42615 - DNA, 25 bp, Homo sapien
caggaagaaaaccagacttagagaa

SEQ ID NO: 42616 - DNA, 25 bp, Homo sapien
caggaagaaaactagacttagagaa

SEQ ID NO: 42617 - DNA, 25 bp, Homo sapien
caggaagagaaagcataggacaagg

SEQ ID NO: 42618 - DNA, 25 bp, Homo sapien
caggaagagaaagcgtaggacaagg

SEQ ID NO: 42619 - DNA, 25 bp, Homo sapien
caggaagcagactgtggacttagtt

SEQ ID NO: 42620 - DNA, 25 bp, Homo sapien
caggaagcagattgtggacttagtt

SEQ ID NO: 42621 - DNA, 25 bp, Homo sapien
caggaagcatttggaaatgactggg

SEQ ID NO: 42622 - DNA, 25 bp, Homo sapien
caggaagcatttggaattgactggg

SEQ ID NO: 42623 - DNA, 25 bp, Homo sapien
caggaagccattaagagattattat

SEQ ID NO: 42624 - DNA, 25 bp, Homo sapien
caggaagccattaggagattattat

SEQ ID NO: 42625 - DNA, 25 bp, Homo sapien
caggaagctgaacaaattgagaaca

SEQ ID NO: 42626 - DNA, 25 bp, Homo sapien
caggaagctgaacgaattgagaaca

SEQ ID NO: 42627 - DNA, 25 bp, Homo sapien
caggaagctggacaggagcgaagag

SEQ ID NO: 42628 - DNA, 25 bp, Homo sapien
caggaagctggactggagcgaagag

SEQ ID NO: 42629 - DNA, 25 bp, Homo sapien
caggaaggcgccagagacacgatga

SEQ ID NO: 42630 - DNA, 25 bp, Homo sapien
caggaaggctgttcctaaatggact

SEQ ID NO: 42631 - DNA, 25 bp, Homo sapien
caggaaggctgtttctaaatggact

SEQ ID NO: 42632 - DNA, 25 bp, Homo sapien
caggaaggtgccagagacacgatga

SEQ ID NO: 42633 - DNA, 25 bp, Homo sapien
caggaagtgccaccaaacctctgat

SEQ ID NO: 42634 - DNA, 25 bp, Homo sapien
caggaagtgccgccaaacctctgat

SEQ ID NO: 42635 - DNA, 25 bp, Homo sapien
caggaagtgccttacacgttcacgc

SEQ ID NO: 42636 - DNA, 25 bp, Homo sapien
caggaagtgccttacatgttcacgc

SEQ ID NO: 42637 - DNA, 25 bp, Homo sapien
caggaagtgtgtcatacgctgccaa

SEQ ID NO: 42638 - DNA, 25 bp, Homo sapien
caggaagtgtgtcataggctgccaa

SEQ ID NO: 42639 - DNA, 25 bp, Homo sapien
caggaagtgttggattcagacacgc

SEQ ID NO: 42640 - DNA, 25 bp, Homo sapien
caggaagtgttggatttagacacgc

SEQ ID NO: 42641 - DNA, 25 bp, Homo sapien
caggaatgaagctgagtcccaaggc

SEQ ID NO: 42642 - DNA, 25 bp, Homo sapien
caggaatgacttgagtagtcaaagg

SEQ ID NO: 42643 - DNA, 25 bp, Homo sapien
caggaatgacttgcgtagtcaaagg

SEQ ID NO: 42644 - DNA, 25 bp, Homo sapien
caggaatgaggctgagtcccaaggc

SEQ ID NO: 42645 - DNA, 25 bp, Homo sapien
caggaatgggaataatgtgatgaaa

SEQ ID NO: 42646 - DNA, 25 bp, Homo sapien
caggaatgggaatattgtgatgaaa

SEQ ID NO: 42647 - DNA, 25 bp, Homo sapien
caggaatttgcaacacttacacatt

SEQ ID NO: 42648 - DNA, 25 bp, Homo sapien
caggaatttgcaatacttacacatt

SEQ ID NO: 42649 - DNA, 25 bp, Homo sapien
caggacaaaacttgaaatgaggtta

SEQ ID NO: 42650 - DNA, 25 bp, Homo sapien
caggacaaacaccgaaaagaataga

SEQ ID NO: 42651 - DNA, 25 bp, Homo sapien
caggacaaacactgaaaagaataga

SEQ ID NO: 42652 - DNA, 25 bp, Homo sapien
caggacaaaccttgaaatgaggtta

SEQ ID NO: 42653 - DNA, 25 bp, Homo sapien
caggacaatataagcaggcaacttg

SEQ ID NO: 42654 - DNA, 25 bp, Homo sapien
caggacaatatatgcaggcaacttg

SEQ ID NO: 42655 - DNA, 25 bp, Homo sapien
caggacactattaccaggcaaatat

SEQ ID NO: 42656 - DNA, 25 bp, Homo sapien
caggacactattactaggcaaatat

SEQ ID NO: 42657 - DNA, 25 bp, Homo sapien
caggacagctgccagtagtgccctc

SEQ ID NO: 42658 - DNA, 25 bp, Homo sapien
caggacagctgccggtagtgccctc

SEQ ID NO: 42659 - DNA, 25 bp, Homo sapien
caggacatccgctagcaaatctagg

SEQ ID NO: 42660 - DNA, 25 bp, Homo sapien
caggacatctgctagcaaatctagg

SEQ ID NO: 42661 - DNA, 25 bp, Homo sapien
caggaccacaatttgcttgctgttt

SEQ ID NO: 42662 - DNA, 25 bp, Homo sapien
caggaccacagagcgagcaagcagc

SEQ ID NO: 42663 - DNA, 25 bp, Homo sapien
caggaccacagagctagcaagcagc

SEQ ID NO: 42664 - DNA, 25 bp, Homo sapien
caggaccacgatttgcttgctgttt

SEQ ID NO: 42665 - DNA, 25 bp, Homo sapien
caggacccattcccactcatcatgt

SEQ ID NO: 42666 - DNA, 25 bp, Homo sapien
caggacccattcccgctcatcatgt

SEQ ID NO: 42667 - DNA, 25 bp, Homo sapien
caggaccgggttgctcagccttggc

SEQ ID NO: 42668 - DNA, 25 bp, Homo sapien
caggaccgggtttctcagccttggc

SEQ ID NO: 42669 - DNA, 25 bp, Homo sapien
caggactagaaccatcactagaaac

SEQ ID NO: 42670 - DNA, 25 bp, Homo sapien
caggactagaaccgtcactagaaac

SEQ ID NO: 42671 - DNA, 25 bp, Homo sapien
caggactcctctttaagcagagagc

SEQ ID NO: 42672 - DNA, 25 bp, Homo sapien
caggactcttctttaagcagagagc

SEQ ID NO: 42673 - DNA, 25 bp, Homo sapien
caggactgaaacgttatgtaacttt

SEQ ID NO: 42674 - DNA, 25 bp, Homo sapien
caggactgaaatgttatgtaacttt

SEQ ID NO: 42675 - DNA, 25 bp, Homo sapien
caggactgagctgcgactcaggctg

SEQ ID NO: 42676 - DNA, 25 bp, Homo sapien
caggactgagctgtgactcaggctg

SEQ ID NO: 42677 - DNA, 25 bp, Homo sapien
caggactttgctcgcattactatta

SEQ ID NO: 42678 - DNA, 25 bp, Homo sapien
caggactttgctctcattactatta

SEQ ID NO: 42679 - DNA, 25 bp, Homo sapien
caggagaaaagcaagaagacaggat

SEQ ID NO: 42680 - DNA, 25 bp, Homo sapien
caggagaaagaagacaaccagccag

SEQ ID NO: 42681 - DNA, 25 bp, Homo sapien
caggagaaagatgacaaccagccag

SEQ ID NO: 42682 - DNA, 25 bp, Homo sapien
caggagaacagcaagaagacaggat

SEQ ID NO: 42683 - DNA, 25 bp, Homo sapien
caggagaagatctcagcgcagctcc

SEQ ID NO: 42684 - DNA, 25 bp, Homo sapien
caggagaagatctcagtgcagctcc

SEQ ID NO: 42685 - DNA, 25 bp, Homo sapien
caggagaagtgggcttcaggcacga

SEQ ID NO: 42686 - DNA, 25 bp, Homo sapien
caggagaattgggcttcaggcacga

SEQ ID NO: 42687 - DNA, 25 bp, Homo sapien
caggagacaagggttagagactatt

SEQ ID NO: 42688 - DNA, 25 bp, Homo sapien
caggagacaaggtttagagactatt

SEQ ID NO: 42689 - DNA, 25 bp, Homo sapien
caggagacaagtcgccaaaaattct

SEQ ID NO: 42690 - DNA, 25 bp, Homo sapien
caggagacaagtcgcccaaaattct

SEQ ID NO: 42691 - DNA, 25 bp, Homo sapien
caggagacatttgagtccaattctc

SEQ ID NO: 42692 - DNA, 25 bp, Homo sapien
caggagacgtttgagtccaattctc

SEQ ID NO: 42693 - DNA, 25 bp, Homo sapien
caggagagaagtttatatatctgtc

SEQ ID NO: 42694 - DNA, 25 bp, Homo sapien
caggagagaagtttgtatatctgtc

SEQ ID NO: 42695 - DNA, 25 bp, Homo sapien
caggagaggagacggcgcaggatca

SEQ ID NO: 42696 - DNA, 25 bp, Homo sapien
caggagaggagatggcgcaggatca

SEQ ID NO: 42697 - DNA, 25 bp, Homo sapien
caggagagggaaacaaatgaccaaa

SEQ ID NO: 42698 - DNA, 25 bp, Homo sapien
caggagagggaagcaaatgaccaaa

SEQ ID NO: 42699 - DNA, 25 bp, Homo sapien
caggagcagcaccttcaagacccag

SEQ ID NO: 42700 - DNA, 25 bp, Homo sapien
caggagcagcatcttcaagacccag

SEQ ID NO: 42701 - DNA, 25 bp, Homo sapien
caggagccactgcaaatgatgatga

SEQ ID NO: 42702 - DNA, 25 bp, Homo sapien
caggagccattgcaaatgatgatga

SEQ ID NO: 42703 - DNA, 25 bp, Homo sapien
caggagctcgaaaggagaaggagag

SEQ ID NO: 42704 - DNA, 25 bp, Homo sapien
caggagcttgaaaggagaaggagag

SEQ ID NO: 42705 - DNA, 25 bp, Homo sapien
caggagggatcgcagaaagaaggtg

SEQ ID NO: 42706 - DNA, 25 bp, Homo sapien
caggagggatcgcggaaagaaggtg

SEQ ID NO: 42707 - DNA, 25 bp, Homo sapien
caggagggtcatctcagccccagga

SEQ ID NO: 42708 - DNA, 25 bp, Homo sapien
caggagggtcatgtcagccccagga

SEQ ID NO: 42709 - DNA, 25 bp, Homo sapien
caggaggtggacataatttaccctc

SEQ ID NO: 42710 - DNA, 25 bp, Homo sapien
caggaggtggacgtaatttaccctc

SEQ ID NO: 42711 - DNA, 25 bp, Homo sapien
caggagtatcagacgcatttatttc

SEQ ID NO: 42712 - DNA, 25 bp, Homo sapien
caggagtatcagatgcatttatttc

SEQ ID NO: 42713 - DNA, 25 bp, Homo sapien
caggagtatgtagaattgaattctg

SEQ ID NO: 42714 - DNA, 25 bp, Homo sapien
caggagtatgtggaattgaattctg

SEQ ID NO: 42715 - DNA, 25 bp, Homo sapien
caggagtgccctgtatataagtcct

SEQ ID NO: 42716 - DNA, 25 bp, Homo sapien
caggagtgctctgtatataagtcct

SEQ ID NO: 42717 - DNA, 25 bp, Homo sapien
caggagttccgagagacacccaggc

SEQ ID NO: 42718 - DNA, 25 bp, Homo sapien
caggagttcggagagacacccaggc

SEQ ID NO: 42719 - DNA, 25 bp, Homo sapien
caggataatgagaacgttctctggc

SEQ ID NO: 42720 - DNA, 25 bp, Homo sapien
caggataatgagaatgttctctggc

SEQ ID NO: 42721 - DNA, 25 bp, Homo sapien
caggataatgtgaaatatggcctaa

SEQ ID NO: 42722 - DNA, 25 bp, Homo sapien
caggataatgtgaactatggcctaa

SEQ ID NO: 42723 - DNA, 25 bp, Homo sapien
caggatatatatcattctcagctgg

SEQ ID NO: 42724 - DNA, 25 bp, Homo sapien
caggatatatatcgttctcagctgg

SEQ ID NO: 42725 - DNA, 25 bp, Homo sapien
caggatatgaacggagtattcaagg

SEQ ID NO: 42726 - DNA, 25 bp, Homo sapien
caggatatgaactgagtattcaagg

SEQ ID NO: 42727 - DNA, 25 bp, Homo sapien
caggatattggtggaactaggagtt

SEQ ID NO: 42728 - DNA, 25 bp, Homo sapien
caggatatttgtggaactaggagtt

SEQ ID NO: 42729 - DNA, 25 bp, Homo sapien
caggatcacacaacattctaggttc

SEQ ID NO: 42730 - DNA, 25 bp, Homo sapien
caggatcacacagcattctaggttc

SEQ ID NO: 42731 - DNA, 25 bp, Homo sapien
caggatccagtaacctcccaccagg

SEQ ID NO: 42732 - DNA, 25 bp, Homo sapien
caggatcccagcgccttcttccatc

SEQ ID NO: 42733 - DNA, 25 bp, Homo sapien
caggatcccagtgccttcttccatc

SEQ ID NO: 42734 - DNA, 25 bp, Homo sapien
caggatccggtaacctcccaccagg

SEQ ID NO: 42735 - DNA, 25 bp, Homo sapien
caggatctgcttgaatatttgaggc

SEQ ID NO: 42736 - DNA, 25 bp, Homo sapien
caggatctgcttggatatttgaggc

SEQ ID NO: 42737 - DNA, 25 bp, Homo sapien
caggatctggccacgccaaattgga

SEQ ID NO: 42738 - DNA, 25 bp, Homo sapien
caggatctggccatgccaaattgga

SEQ ID NO: 42739 - DNA, 25 bp, Homo sapien
caggatgccggatgacgggcaggag

SEQ ID NO: 42740 - DNA, 25 bp, Homo sapien
caggatgccttgggtcattggtccc

SEQ ID NO: 42741 - DNA, 25 bp, Homo sapien
caggatgccttgggtcgttggtccc

SEQ ID NO: 42742 - DNA, 25 bp, Homo sapien
caggatgctggatgacgggcaggag

SEQ ID NO: 42743 - DNA, 25 bp, Homo sapien
caggatgtgtaaaacacttcacata

SEQ ID NO: 42744 - DNA, 25 bp, Homo sapien
caggatgtgtaagacacttcacata

SEQ ID NO: 42745 - DNA, 25 bp, Homo sapien
caggattatctcatgattaaattat

SEQ ID NO: 42746 - DNA, 25 bp, Homo sapien
caggattatctcgtgattaaattat

SEQ ID NO: 42747 - DNA, 25 bp, Homo sapien
caggattcagaggaggtatcaaaaa

SEQ ID NO: 42748 - DNA, 25 bp, Homo sapien
caggattcagaggatgtatcaaaaa

SEQ ID NO: 42749 - DNA, 25 bp, Homo sapien
caggattcatgttcttataatggag

SEQ ID NO: 42750 - DNA, 25 bp, Homo sapien
caggattcatgttcttttaatggag

SEQ ID NO: 42751 - DNA, 25 bp, Homo sapien
caggattcatttccatcttttctca

SEQ ID NO: 42752 - DNA, 25 bp, Homo sapien
caggattccaacacgaacacaatgt

SEQ ID NO: 42753 - DNA, 25 bp, Homo sapien
caggattccaacacgagcacaatgt

SEQ ID NO: 42754 - DNA, 25 bp, Homo sapien
caggattcgtttccatcttttctca

SEQ ID NO: 42755 - DNA, 25 bp, Homo sapien
caggatttagtcacccttgatgcag

SEQ ID NO: 42756 - DNA, 25 bp, Homo sapien
caggatttagtcattcagcacagta

SEQ ID NO: 42757 - DNA, 25 bp, Homo sapien
caggatttagtcgttcagcacagta

SEQ ID NO: 42758 - DNA, 25 bp, Homo sapien
caggatttagttacccttgatgcag

SEQ ID NO: 42759 - DNA, 25 bp, Homo sapien
caggatttcaaggccaacctgggca

SEQ ID NO: 42760 - DNA, 25 bp, Homo sapien
caggatttcaaggtcaacctgggca

SEQ ID NO: 42761 - DNA, 25 bp, Homo sapien
caggattttctcattgcctggctgg

SEQ ID NO: 42762 - DNA, 25 bp, Homo sapien
caggattttctcgttgcctggctgg

SEQ ID NO: 42763 - DNA, 25 bp, Homo sapien
caggattttgtacgtggatgagatt

SEQ ID NO: 42764 - DNA, 25 bp, Homo sapien
caggattttgtatgtggatgagatt

SEQ ID NO: 42765 - DNA, 25 bp, Homo sapien
caggcaaaaaaaagagtcatgttct

SEQ ID NO: 42766 - DNA, 25 bp, Homo sapien
caggcaaaaaaaggagtcatgttct

SEQ ID NO: 42767 - DNA, 25 bp, Homo sapien
caggcaaaacttgcaatcccgattg

SEQ ID NO: 42768 - DNA, 25 bp, Homo sapien
caggcaaaactttcaatcccgattg

SEQ ID NO: 42769 - DNA, 25 bp, Homo sapien
caggcaaaattttcaccgggaagtg

SEQ ID NO: 42770 - DNA, 25 bp, Homo sapien
caggcaaaattttcactgggaagtg

SEQ ID NO: 42771 - DNA, 25 bp, Homo sapien
caggcaaagacattgattccaaggc

SEQ ID NO: 42772 - DNA, 25 bp, Homo sapien
caggcaaagacgttgattccaaggc

SEQ ID NO: 42773 - DNA, 25 bp, Homo sapien
caggcaaatgatcctgatcttatct

SEQ ID NO: 42774 - DNA, 25 bp, Homo sapien
caggcaaatgatcctggtcttatct

SEQ ID NO: 42775 - DNA, 25 bp, Homo sapien
caggcaacatgttacatatagtatg

SEQ ID NO: 42776 - DNA, 25 bp, Homo sapien
caggcaaccaaagcaacaattgaca

SEQ ID NO: 42777 - DNA, 25 bp, Homo sapien
caggcaacccaagcaacaattgaca

SEQ ID NO: 42778 - DNA, 25 bp, Homo sapien
caggcaacgtgttacatatagtatg

SEQ ID NO: 42779 - DNA, 25 bp, Homo sapien
caggcaactatactattatgccaaa

SEQ ID NO: 42780 - DNA, 25 bp, Homo sapien
caggcaactatattattatgccaaa

SEQ ID NO: 42781 - DNA, 25 bp, Homo sapien
caggcaactgacaatcatggcagaa

SEQ ID NO: 42782 - DNA, 25 bp, Homo sapien
caggcaactgacagtcatggcagaa

SEQ ID NO: 42783 - DNA, 25 bp, Homo sapien
caggcaagaaagcgtttgcagggga

SEQ ID NO: 42784 - DNA, 25 bp, Homo sapien
caggcaagagagcgtttgcagggga

SEQ ID NO: 42785 - DNA, 25 bp, Homo sapien
caggcacaaacatcccgaggggtgt

SEQ ID NO: 42786 - DNA, 25 bp, Homo sapien
caggcacaaacatcgcgaggggtgt

SEQ ID NO: 42787 - DNA, 25 bp, Homo sapien
caggcacatagcacgaagcatcacc

SEQ ID NO: 42788 - DNA, 25 bp, Homo sapien
caggcacatagcaggaagcatcacc

SEQ ID NO: 42789 - DNA, 25 bp, Homo sapien
caggcaccagctgtgaccaccatgc

SEQ ID NO: 42790 - DNA, 25 bp, Homo sapien
caggcaccagggcttcaatgaaacg

SEQ ID NO: 42791 - DNA, 25 bp, Homo sapien
caggcaccaggtcttcaatgaaacg

SEQ ID NO: 42792 - DNA, 25 bp, Homo sapien
caggcaccatctcggttagctgtgg

SEQ ID NO: 42793 - DNA, 25 bp, Homo sapien
caggcaccatcttggttagctgtgg

SEQ ID NO: 42794 - DNA, 25 bp, Homo sapien
caggcaccggctgtgaccaccatgc

SEQ ID NO: 42795 - DNA, 25 bp, Homo sapien
caggcacctggcaatccaaattgtc

SEQ ID NO: 42796 - DNA, 25 bp, Homo sapien
caggcacctggcagtccaaattgtc

SEQ ID NO: 42797 - DNA, 25 bp, Homo sapien
caggcacttacactctctcacatat

SEQ ID NO: 42798 - DNA, 25 bp, Homo sapien
caggcacttacactctttcacatat

SEQ ID NO: 42799 - DNA, 25 bp, Homo sapien
caggcagaagaattccaaataatca

SEQ ID NO: 42800 - DNA, 25 bp, Homo sapien
caggcagaagaattccgaataatca

SEQ ID NO: 42801 - DNA, 25 bp, Homo sapien
caggcagccctagaattaactgtgc

SEQ ID NO: 42802 - DNA, 25 bp, Homo sapien
caggcagccctggaattaactgtgc

SEQ ID NO: 42803 - DNA, 25 bp, Homo sapien
caggcaggagctcgaaaggagaagg

SEQ ID NO: 42804 - DNA, 25 bp, Homo sapien
caggcaggagcttgaaaggagaagg

SEQ ID NO: 42805 - DNA, 25 bp, Homo sapien
caggcagtcacacggaaagctcttg

SEQ ID NO: 42806 - DNA, 25 bp, Homo sapien
caggcagtcacatggaaagctcttg

SEQ ID NO: 42807 - DNA, 25 bp, Homo sapien
caggcatacctagcgtcagattctt

SEQ ID NO: 42808 - DNA, 25 bp, Homo sapien
caggcatacctagcttcagattctt

SEQ ID NO: 42809 - DNA, 25 bp, Homo sapien
caggcatacctcaatttatttcact

SEQ ID NO: 42810 - DNA, 25 bp, Homo sapien
caggcatacctcattttatttcact

SEQ ID NO: 42811 - DNA, 25 bp, Homo sapien
caggcatcacagataggaagatgta

SEQ ID NO: 42812 - DNA, 25 bp, Homo sapien
caggcatctcagataggaagatgta

SEQ ID NO: 42813 - DNA, 25 bp, Homo sapien
caggcatgaaagaaaaggcctggaa

SEQ ID NO: 42814 - DNA, 25 bp, Homo sapien
caggcatgaaagcaaaggcctggaa

SEQ ID NO: 42815 - DNA, 25 bp, Homo sapien
caggcattacaggagggagcaatgc

SEQ ID NO: 42816 - DNA, 25 bp, Homo sapien
caggcattagaggagggagcaatgc

SEQ ID NO: 42817 - DNA, 25 bp, Homo sapien
caggcatttatatcaggtctcttca

SEQ ID NO: 42818 - DNA, 25 bp, Homo sapien
caggcatttatatctggtctcttca

SEQ ID NO: 42819 - DNA, 25 bp, Homo sapien
caggcatttccagctgactcacagt

SEQ ID NO: 42820 - DNA, 25 bp, Homo sapien
caggcatttccagttgactcacagt

SEQ ID NO: 42821 - DNA, 25 bp, Homo sapien
caggcatttcttcttcaagtaatca

SEQ ID NO: 42822 - DNA, 25 bp, Homo sapien
caggcatttctttttcaagtaatca

SEQ ID NO: 42823 - DNA, 25 bp, Homo sapien
caggccacaatgctaggaggaagcc

SEQ ID NO: 42824 - DNA, 25 bp, Homo sapien
caggccacacagaatggtctccctg

SEQ ID NO: 42825 - DNA, 25 bp, Homo sapien
caggccacagagaatggtctccctg

SEQ ID NO: 42826 - DNA, 25 bp, Homo sapien
caggccacagtgctaggaggaagcc

SEQ ID NO: 42827 - DNA, 25 bp, Homo sapien
caggccactggggtttcaatcagtt

SEQ ID NO: 42828 - DNA, 25 bp, Homo sapien
caggccactggggtttgaatcagtt

SEQ ID NO: 42829 - DNA, 25 bp, Homo sapien
caggccagagacagctatcctttga

SEQ ID NO: 42830 - DNA, 25 bp, Homo sapien
caggccagagactgctatcctttga

SEQ ID NO: 42831 - DNA, 25 bp, Homo sapien
caggccagcttgtcacctgggactg

SEQ ID NO: 42832 - DNA, 25 bp, Homo sapien
caggccagcttgtcacgtgggactg

SEQ ID NO: 42833 - DNA, 25 bp, Homo sapien
caggccatgtgtcccgatgttccat

SEQ ID NO: 42834 - DNA, 25 bp, Homo sapien
caggccatgtgtcctgatgttccat

SEQ ID NO: 42835 - DNA, 25 bp, Homo sapien
caggcccagagctcaccacatctac

SEQ ID NO: 42836 - DNA, 25 bp, Homo sapien
caggcccagagctcgccacatctac

SEQ ID NO: 42837 - DNA, 25 bp, Homo sapien
caggccctgcttagtcatcattagt

SEQ ID NO: 42838 - DNA, 25 bp, Homo sapien
caggccctgcttagtcctcattagt

SEQ ID NO: 42839 - DNA, 25 bp, Homo sapien
caggcctcggccgctgagggtctgc

SEQ ID NO: 42840 - DNA, 25 bp, Homo sapien
caggcctcggctgctgagggtctgc

SEQ ID NO: 42841 - DNA, 25 bp, Homo sapien
caggcctctttacttttggttatgc

SEQ ID NO: 42842 - DNA, 25 bp, Homo sapien
caggcctctttagttttggttatgc

SEQ ID NO: 42843 - DNA, 25 bp, Homo sapien
caggccttgtagaacatgttgaaga

SEQ ID NO: 42844 - DNA, 25 bp, Homo sapien
caggccttgtagaatatgttgaaga

SEQ ID NO: 42845 - DNA, 25 bp, Homo sapien
caggcgcgcatcaccatgcatagct

SEQ ID NO: 42846 - DNA, 25 bp, Homo sapien
caggcgcgcatcactatgcatagct

SEQ ID NO: 42847 - DNA, 25 bp, Homo sapien
caggcgctgttgaatctgagtcccc

SEQ ID NO: 42848 - DNA, 25 bp, Homo sapien
caggcgctgttgactctgagtcccc

SEQ ID NO: 42849 - DNA, 25 bp, Homo sapien
caggcgtgacccactgtgcctagtc

SEQ ID NO: 42850 - DNA, 25 bp, Homo sapien
caggcgtgacctactgtgcctagtc

SEQ ID NO: 42851 - DNA, 25 bp, Homo sapien
caggctaatgcttacttgtggtatt

SEQ ID NO: 42852 - DNA, 25 bp, Homo sapien
caggctaattcttacttgtggtatt

SEQ ID NO: 42853 - DNA, 25 bp, Homo sapien
caggctactcccagccaatgactga

SEQ ID NO: 42854 - DNA, 25 bp, Homo sapien
caggctactcccggccaatgactga

SEQ ID NO: 42855 - DNA, 25 bp, Homo sapien
caggctagtgctaaaagcaaagtga

SEQ ID NO: 42856 - DNA, 25 bp, Homo sapien
caggctagtgctcaaagcaaagtga

SEQ ID NO: 42857 - DNA, 25 bp, Homo sapien
caggctatgattgacaattaccatg

SEQ ID NO: 42858 - DNA, 25 bp, Homo sapien
caggctatgattgataattaccatg

SEQ ID NO: 42859 - DNA, 25 bp, Homo sapien
caggctcaaaaaaacaccgagtctt

SEQ ID NO: 42860 - DNA, 25 bp, Homo sapien
caggctcaaaaacacaccgagtctt

SEQ ID NO: 42861 - DNA, 25 bp, Homo sapien
caggctcttttcaacaactagttct

SEQ ID NO: 42862 - DNA, 25 bp, Homo sapien
caggctcttttcagcaactagttct

SEQ ID NO: 42863 - DNA, 25 bp, Homo sapien
caggctgcatgaatcactttcaaga

SEQ ID NO: 42864 - DNA, 25 bp, Homo sapien
caggctgccctgcttgtgccttagt

SEQ ID NO: 42865 - DNA, 25 bp, Homo sapien
caggctgccctgtttgtgccttagt

SEQ ID NO: 42866 - DNA, 25 bp, Homo sapien
caggctgcctctcacttgttgttac

SEQ ID NO: 42867 - DNA, 25 bp, Homo sapien
caggctgcctctcgcttgttgttac

SEQ ID NO: 42868 - DNA, 25 bp, Homo sapien
caggctgcgtgaatcactttcaaga

SEQ ID NO: 42869 - DNA, 25 bp, Homo sapien
caggctgctccttcctcgggctgcc

SEQ ID NO: 42870 - DNA, 25 bp, Homo sapien
caggctgctcctttctcgggctgcc

SEQ ID NO: 42871 - DNA, 25 bp, Homo sapien
caggctggaaagtcagatgataaag

SEQ ID NO: 42872 - DNA, 25 bp, Homo sapien
caggctggctggactctcgctgttc

SEQ ID NO: 42873 - DNA, 25 bp, Homo sapien
caggctgggaagtcagatgataaag

SEQ ID NO: 42874 - DNA, 25 bp, Homo sapien
caggctggttggactctcgctgttc

SEQ ID NO: 42875 - DNA, 25 bp, Homo sapien
caggcttaaaaacaaattacacgcc

SEQ ID NO: 42876 - DNA, 25 bp, Homo sapien
caggcttaaaaataaattacacgcc

SEQ ID NO: 42877 - DNA, 25 bp, Homo sapien
caggcttaaataaatgcaagaactt

SEQ ID NO: 42878 - DNA, 25 bp, Homo sapien
caggcttaaatacatgcaagaactt

SEQ ID NO: 42879 - DNA, 25 bp, Homo sapien
caggcttatttttccgctcataatg

SEQ ID NO: 42880 - DNA, 25 bp, Homo sapien
caggcttatttttctgctcataatg

SEQ ID NO: 42881 - DNA, 25 bp, Homo sapien
caggcttgtagaagtagcttccagc

SEQ ID NO: 42882 - DNA, 25 bp, Homo sapien
caggcttgtagaattagcttccagc

SEQ ID NO: 42883 - DNA, 25 bp, Homo sapien
caggctttacctgtatcactcgtat

SEQ ID NO: 42884 - DNA, 25 bp, Homo sapien
caggctttatctgtatcactcgtat

SEQ ID NO: 42885 - DNA, 25 bp, Homo sapien
cagggaaaatactataacacaatga

SEQ ID NO: 42886 - DNA, 25 bp, Homo sapien
cagggaaaatactgtaacacaatga

SEQ ID NO: 42887 - DNA, 25 bp, Homo sapien
cagggaaaattatagatgtccataa

SEQ ID NO: 42888 - DNA, 25 bp, Homo sapien
cagggaaaattatggatgtccataa

SEQ ID NO: 42889 - DNA, 25 bp, Homo sapien
cagggaaagtccacagtgcaaagta

SEQ ID NO: 42890 - DNA, 25 bp, Homo sapien
cagggaaagtccgcagtgcaaagta

SEQ ID NO: 42891 - DNA, 25 bp, Homo sapien
cagggaacaaccttgtacatacatc

SEQ ID NO: 42892 - DNA, 25 bp, Homo sapien
cagggaaccaccttgtacatacatc

SEQ ID NO: 42893 - DNA, 25 bp, Homo sapien
cagggaacccagaaggacagatggg

SEQ ID NO: 42894 - DNA, 25 bp, Homo sapien
cagggaacccagcaggacagatggg

SEQ ID NO: 42895 - DNA, 25 bp, Homo sapien
cagggaagagagcagtaccatggga

SEQ ID NO: 42896 - DNA, 25 bp, Homo sapien
cagggaagatagcagtaccatggga

SEQ ID NO: 42897 - DNA, 25 bp, Homo sapien
cagggaagatatacaacagaatgca

SEQ ID NO: 42898 - DNA, 25 bp, Homo sapien
cagggaagatatagaacagaatgca

SEQ ID NO: 42899 - DNA, 25 bp, Homo sapien
cagggaagccaggcataagcagcta

SEQ ID NO: 42900 - DNA, 25 bp, Homo sapien
cagggaagccaggcgtaagcagcta

SEQ ID NO: 42901 - DNA, 25 bp, Homo sapien
cagggacacgtgtgaccgctgaaat

SEQ ID NO: 42902 - DNA, 25 bp, Homo sapien
cagggacacgtgtgactgctgaaat

SEQ ID NO: 42903 - DNA, 25 bp, Homo sapien
cagggaccacggtataagccaccac

SEQ ID NO: 42904 - DNA, 25 bp, Homo sapien
cagggaccacggtataggccaccac

SEQ ID NO: 42905 - DNA, 25 bp, Homo sapien
cagggacctttccggccgctgtgtg

SEQ ID NO: 42906 - DNA, 25 bp, Homo sapien
cagggacctttctggccgctgtgtg

SEQ ID NO: 42907 - DNA, 25 bp, Homo sapien
cagggactttgaatgtcccaggatg

SEQ ID NO: 42908 - DNA, 25 bp, Homo sapien
cagggactttgagtgtcccaggatg

SEQ ID NO: 42909 - DNA, 25 bp, Homo sapien
cagggagaatattgtcacacactca

SEQ ID NO: 42910 - DNA, 25 bp, Homo sapien
cagggagaatattttcacacactca

SEQ ID NO: 42911 - DNA, 25 bp, Homo sapien
cagggagaatgtcgtggatctggca

SEQ ID NO: 42912 - DNA, 25 bp, Homo sapien
cagggagaatgttgtggatctggca

SEQ ID NO: 42913 - DNA, 25 bp, Homo sapien
cagggagaggcaacaaatgcaagga

SEQ ID NO: 42914 - DNA, 25 bp, Homo sapien
cagggagatgcaacaaatgcaagga

SEQ ID NO: 42915 - DNA, 25 bp, Homo sapien
cagggagcctcattcttcctaaatc

SEQ ID NO: 42916 - DNA, 25 bp, Homo sapien
cagggagcctcatttttcctaaatc

SEQ ID NO: 42917 - DNA, 25 bp, Homo sapien
cagggaggattaaaaagcactggtc

SEQ ID NO: 42918 - DNA, 25 bp, Homo sapien
cagggaggattaacaagcactggtc

SEQ ID NO: 42919 - DNA, 25 bp, Homo sapien
cagggagtagagcagcttctgcaga

SEQ ID NO: 42920 - DNA, 25 bp, Homo sapien
cagggagtatagcagcttctgcaga

SEQ ID NO: 42921 - DNA, 25 bp, Homo sapien
cagggagtgataccacaataaacga

SEQ ID NO: 42922 - DNA, 25 bp, Homo sapien
cagggagtgataccacgataaacga

SEQ ID NO: 42923 - DNA, 25 bp, Homo sapien
cagggagttggtatgacactgtctt

SEQ ID NO: 42924 - DNA, 25 bp, Homo sapien
cagggagtttgtatgacactgtctt

SEQ ID NO: 42925 - DNA, 25 bp, Homo sapien
cagggataccaacaggaacaagaca

SEQ ID NO: 42926 - DNA, 25 bp, Homo sapien
cagggataccaccaggaacaagaca

SEQ ID NO: 42927 - DNA, 25 bp, Homo sapien
cagggatcctttcgatgcactgacc

SEQ ID NO: 42928 - DNA, 25 bp, Homo sapien
cagggatccttttgatgcactgacc

SEQ ID NO: 42929 - DNA, 25 bp, Homo sapien
cagggatgaaaacaaaattaattta

SEQ ID NO: 42930 - DNA, 25 bp, Homo sapien
cagggatgaaagcaaaattaattta

SEQ ID NO: 42931 - DNA, 25 bp, Homo sapien
cagggatgcttccaagacaattggc

SEQ ID NO: 42932 - DNA, 25 bp, Homo sapien
cagggatgcttccaaggcaattggc

SEQ ID NO: 42933 - DNA, 25 bp, Homo sapien
cagggattaggatgtgaacgcagct

SEQ ID NO: 42934 - DNA, 25 bp, Homo sapien
cagggattctaactctcggcttcac

SEQ ID NO: 42935 - DNA, 25 bp, Homo sapien
cagggattctaactcttggcttcac

SEQ ID NO: 42936 - DNA, 25 bp, Homo sapien
cagggattgaatctcacgttaatag

SEQ ID NO: 42937 - DNA, 25 bp, Homo sapien
cagggattgaatctcaggttaatag

SEQ ID NO: 42938 - DNA, 25 bp, Homo sapien
cagggattgctacttcctgtcaatc

SEQ ID NO: 42939 - DNA, 25 bp, Homo sapien
cagggattgctagttcctgtcaatc

SEQ ID NO: 42940 - DNA, 25 bp, Homo sapien
cagggattgggatgtgaacgcagct

SEQ ID NO: 42941 - DNA, 25 bp, Homo sapien
cagggcaaacgtcaactccactgta

SEQ ID NO: 42942 - DNA, 25 bp, Homo sapien
cagggcaaatgtcaactccactgta

SEQ ID NO: 42943 - DNA, 25 bp, Homo sapien
cagggcacaaaacaaagtcctcccc

SEQ ID NO: 42944 - DNA, 25 bp, Homo sapien
cagggcacaaagcaaagtcctcccc

SEQ ID NO: 42945 - DNA, 25 bp, Homo sapien
cagggcagttctatagtcttcacca

SEQ ID NO: 42946 - DNA, 25 bp, Homo sapien
cagggcagttctgtagtcttcacca

SEQ ID NO: 42947 - DNA, 25 bp, Homo sapien
cagggcatagctgcacacattccac

SEQ ID NO: 42948 - DNA, 25 bp, Homo sapien
cagggcatagctgcgcacattccac

SEQ ID NO: 42949 - DNA, 25 bp, Homo sapien
cagggcattttgataaataaaggaa

SEQ ID NO: 42950 - DNA, 25 bp, Homo sapien
cagggcattttggtaaataaaggaa

SEQ ID NO: 42951 - DNA, 25 bp, Homo sapien
cagggccaggcgaggagcttgcagc

SEQ ID NO: 42952 - DNA, 25 bp, Homo sapien
cagggccaggcgtggagcttgcagc

SEQ ID NO: 42953 - DNA, 25 bp, Homo sapien
cagggcctcccaacatgtggtcttt

SEQ ID NO: 42954 - DNA, 25 bp, Homo sapien
cagggcctcccgacatgtggtcttt

SEQ ID NO: 42955 - DNA, 25 bp, Homo sapien
cagggcctctagggtgacacagtca

SEQ ID NO: 42956 - DNA, 25 bp, Homo sapien
cagggcctctaggttgacacagtca

SEQ ID NO: 42957 - DNA, 25 bp, Homo sapien
cagggcctgacttggcatccaacca

SEQ ID NO: 42958 - DNA, 25 bp, Homo sapien
cagggcctgtcttggcatccaacca

SEQ ID NO: 42959 - DNA, 25 bp, Homo sapien
cagggcctttcacattatttttctt

SEQ ID NO: 42960 - DNA, 25 bp, Homo sapien
cagggcctttcatattatttttctt

SEQ ID NO: 42961 - DNA, 25 bp, Homo sapien
cagggctaattgctatatatggtta

SEQ ID NO: 42962 - DNA, 25 bp, Homo sapien
cagggctaattgctatgtatggtta

SEQ ID NO: 42963 - DNA, 25 bp, Homo sapien
cagggctccaacttcatatttcccc

SEQ ID NO: 42964 - DNA, 25 bp, Homo sapien
cagggctccgacttcatatttcccc

SEQ ID NO: 42965 - DNA, 25 bp, Homo sapien
cagggctgaacccagtctaaatact

SEQ ID NO: 42966 - DNA, 25 bp, Homo sapien
cagggctgcgctaattagattgctt

SEQ ID NO: 42967 - DNA, 25 bp, Homo sapien
cagggctgctctaattagattgctt

SEQ ID NO: 42968 - DNA, 25 bp, Homo sapien
cagggctggacccagtctaaatact

SEQ ID NO: 42969 - DNA, 25 bp, Homo sapien
cagggctggcagtcccaggagtctc

SEQ ID NO: 42970 - DNA, 25 bp, Homo sapien
cagggctggtagtcccaggagtctc

SEQ ID NO: 42971 - DNA, 25 bp, Homo sapien
cagggcttaccttggtacctgagta

SEQ ID NO: 42972 - DNA, 25 bp, Homo sapien
cagggcttagcttggtacctgagta

SEQ ID NO: 42973 - DNA, 25 bp, Homo sapien
cagggcttcctttatggacaccttt

SEQ ID NO: 42974 - DNA, 25 bp, Homo sapien
cagggcttggctagatcacagctct

SEQ ID NO: 42975 - DNA, 25 bp, Homo sapien
cagggcttggctaggtcacagctct

SEQ ID NO: 42976 - DNA, 25 bp, Homo sapien
cagggctttctttatggacaccttt

SEQ ID NO: 42977 - DNA, 25 bp, Homo sapien
caggggaaatgaacctgcaggaaaa

SEQ ID NO: 42978 - DNA, 25 bp, Homo sapien
caggggaaatgaacgtgcaggaaaa

SEQ ID NO: 42979 - DNA, 25 bp, Homo sapien
caggggaaatgcagtccaagtgcca

SEQ ID NO: 42980 - DNA, 25 bp, Homo sapien
caggggaagtgcagtccaagtgcca

SEQ ID NO: 42981 - DNA, 25 bp, Homo sapien
caggggcacactaaacataagcaat

SEQ ID NO: 42982 - DNA, 25 bp, Homo sapien
caggggcacactaaacgtaagcaat

SEQ ID NO: 42983 - DNA, 25 bp, Homo sapien
caggggcatcagataccagtaaaag

SEQ ID NO: 42984 - DNA, 25 bp, Homo sapien
caggggcatcaggtaccagtaaaag

SEQ ID NO: 42985 - DNA, 25 bp, Homo sapien
caggggccaatgtcagaacatgggt

SEQ ID NO: 42986 - DNA, 25 bp, Homo sapien
caggggccagtgtcagaacatgggt

SEQ ID NO: 42987 - DNA, 25 bp, Homo sapien
caggggcctaaaacctagactctgc

SEQ ID NO: 42988 - DNA, 25 bp, Homo sapien
caggggcctaaaagctagactctgc

SEQ ID NO: 42989 - DNA, 25 bp, Homo sapien
cagggggtaaggatgtctcatatca

SEQ ID NO: 42990 - DNA, 25 bp, Homo sapien
cagggggtaaggttgtctcatatca

SEQ ID NO: 42991 - DNA, 25 bp, Homo sapien
caggggtagacacaatagcctcagg

SEQ ID NO: 42992 - DNA, 25 bp, Homo sapien
caggggtagacacgatagcctcagg

SEQ ID NO: 42993 - DNA, 25 bp, Homo sapien
caggggtgacacaaggcatgcagaa

SEQ ID NO: 42994 - DNA, 25 bp, Homo sapien
caggggtgacacaaggtatgcagaa

SEQ ID NO: 42995 - DNA, 25 bp, Homo sapien
caggggtgtgacaatgactgcaaag

SEQ ID NO: 42996 - DNA, 25 bp, Homo sapien
caggggtgtgagaatgactgcaaag

SEQ ID NO: 42997 - DNA, 25 bp, Homo sapien
cagggtaactttaattcttcctact

SEQ ID NO: 42998 - DNA, 25 bp, Homo sapien
cagggtaactttaatttttcctact

SEQ ID NO: 42999 - DNA, 25 bp, Homo sapien
cagggtcactggaaataccctcaca

SEQ ID NO: 43000 - DNA, 25 bp, Homo sapien
cagggtcactggaaattccctcaca

SEQ ID NO: 43001 - DNA, 25 bp, Homo sapien
cagggtggccgagaggaagaaaaga

SEQ ID NO: 43002 - DNA, 25 bp, Homo sapien
cagggtggcggagaggaagaaaaga

SEQ ID NO: 43003 - DNA, 25 bp, Homo sapien
cagggttagaacaaagataataatc

SEQ ID NO: 43004 - DNA, 25 bp, Homo sapien
cagggttagaacagagataataatc

SEQ ID NO: 43005 - DNA, 25 bp, Homo sapien
cagggttcacaagcatcagaggcag

SEQ ID NO: 43006 - DNA, 25 bp, Homo sapien
cagggttcacaagcgtcagaggcag

SEQ ID NO: 43007 - DNA, 25 bp, Homo sapien
cagggttcatctattcagtacttca

SEQ ID NO: 43008 - DNA, 25 bp, Homo sapien
cagggttcatctgttcagtacttca

SEQ ID NO: 43009 - DNA, 25 bp, Homo sapien
cagggtttagggacgctcagcaggc

SEQ ID NO: 43010 - DNA, 25 bp, Homo sapien
cagggtttagggatgctcagcaggc

SEQ ID NO: 43011 - DNA, 25 bp, Homo sapien
cagggtttcatgattaccaagtggc

SEQ ID NO: 43012 - DNA, 25 bp, Homo sapien
cagggtttcatgattagcaagtggc

SEQ ID NO: 43013 - DNA, 25 bp, Homo sapien
caggtaaaagaacagagctccagaa

SEQ ID NO: 43014 - DNA, 25 bp, Homo sapien
caggtaaaagaagaccagtagaatc

SEQ ID NO: 43015 - DNA, 25 bp, Homo sapien
caggtaaaagaagagagctccagaa

SEQ ID NO: 43016 - DNA, 25 bp, Homo sapien
caggtaaaagaggaccagtagaatc

SEQ ID NO: 43017 - DNA, 25 bp, Homo sapien
caggtaagattacacgaagagttaa

SEQ ID NO: 43018 - DNA, 25 bp, Homo sapien
caggtaagattacatgaagagttaa

SEQ ID NO: 43019 - DNA, 25 bp, Homo sapien
caggtaagccaagtgggcaagataa

SEQ ID NO: 43020 - DNA, 25 bp, Homo sapien
caggtaaggcaagtgggcaagataa

SEQ ID NO: 43021 - DNA, 25 bp, Homo sapien
caggtaagtggtacagctatcatta

SEQ ID NO: 43022 - DNA, 25 bp, Homo sapien
caggtaagtggtacagttatcatta

SEQ ID NO: 43023 - DNA, 25 bp, Homo sapien
caggtaagtttgaaaaatgtcttaa

SEQ ID NO: 43024 - DNA, 25 bp, Homo sapien
caggtaagtttgagaaatgtcttaa

SEQ ID NO: 43025 - DNA, 25 bp, Homo sapien
caggtaattctgaagcaagtaatac

SEQ ID NO: 43026 - DNA, 25 bp, Homo sapien
caggtaattttgaagcaagtaatac

SEQ ID NO: 43027 - DNA, 25 bp, Homo sapien
caggtaccaaaatgattcactagtt

SEQ ID NO: 43028 - DNA, 25 bp, Homo sapien
caggtaccagaatgattcactagtt

SEQ ID NO: 43029 - DNA, 25 bp, Homo sapien
caggtactatgctatatcttatatg

SEQ ID NO: 43030 - DNA, 25 bp, Homo sapien
caggtactatgctgtatcttatatg

SEQ ID NO: 43031 - DNA, 25 bp, Homo sapien
caggtagagggactctcattctggc

SEQ ID NO: 43032 - DNA, 25 bp, Homo sapien
caggtagagggattctcattctggc

SEQ ID NO: 43033 - DNA, 25 bp, Homo sapien
caggtagccgtttacagcccttgtt

SEQ ID NO: 43034 - DNA, 25 bp, Homo sapien
caggtagccgtttatagcccttgtt

SEQ ID NO: 43035 - DNA, 25 bp, Homo sapien
caggtagctggaatacattggtcca

SEQ ID NO: 43036 - DNA, 25 bp, Homo sapien
caggtagctggaatccattggtcca

SEQ ID NO: 43037 - DNA, 25 bp, Homo sapien
caggtagtcacaattgctaggggtc

SEQ ID NO: 43038 - DNA, 25 bp, Homo sapien
caggtagtcacatttgctaggggtc

SEQ ID NO: 43039 - DNA, 25 bp, Homo sapien
caggtagtgagaacactaggaaaat

SEQ ID NO: 43040 - DNA, 25 bp, Homo sapien
caggtagtgagaatactaggaaaat

SEQ ID NO: 43041 - DNA, 25 bp, Homo sapien
caggtataaaacacctagagaatag

SEQ ID NO: 43042 - DNA, 25 bp, Homo sapien
caggtataaaacgcctagagaatag

SEQ ID NO: 43043 - DNA, 25 bp, Homo sapien
caggtatcacagagtgcttaagttc

SEQ ID NO: 43044 - DNA, 25 bp, Homo sapien
caggtatcatagagtgcttaagttc

SEQ ID NO: 43045 - DNA, 25 bp, Homo sapien
caggtcagccgaaggatgaaggaag

SEQ ID NO: 43046 - DNA, 25 bp, Homo sapien
caggtcagctgaaggatgaaggaag

SEQ ID NO: 43047 - DNA, 25 bp, Homo sapien
caggtcatccaaccctgtaagccag

SEQ ID NO: 43048 - DNA, 25 bp, Homo sapien
caggtcatccaaccctttaagccag

SEQ ID NO: 43049 - DNA, 25 bp, Homo sapien
caggtccagcagctatcttgggcca

SEQ ID NO: 43050 - DNA, 25 bp, Homo sapien
caggtccagcagttatcttgggcca

SEQ ID NO: 43051 - DNA, 25 bp, Homo sapien
caggtccatgttttcagaggccagg

SEQ ID NO: 43052 - DNA, 25 bp, Homo sapien
caggtccattttttcagaggccagg

SEQ ID NO: 43053 - DNA, 25 bp, Homo sapien
caggtcccattttctctacaggact

SEQ ID NO: 43054 - DNA, 25 bp, Homo sapien
caggtccccttttctctacaggact

SEQ ID NO: 43055 - DNA, 25 bp, Homo sapien
caggtcctcaaacttggtcacccat

SEQ ID NO: 43056 - DNA, 25 bp, Homo sapien
caggtccttaaacttggtcacccat

SEQ ID NO: 43057 - DNA, 25 bp, Homo sapien
caggtccttaacttcccggaggatc

SEQ ID NO: 43058 - DNA, 25 bp, Homo sapien
caggtcctttacttcccggaggatc

SEQ ID NO: 43059 - DNA, 25 bp, Homo sapien
caggtctcatgaacccagccattcg

SEQ ID NO: 43060 - DNA, 25 bp, Homo sapien
caggtctcatgaccccagccattcg

SEQ ID NO: 43061 - DNA, 25 bp, Homo sapien
caggtctccttaccggcaagtgttt

SEQ ID NO: 43062 - DNA, 25 bp, Homo sapien
caggtctccttactggcaagtgttt

SEQ ID NO: 43063 - DNA, 25 bp, Homo sapien
caggtctcttcacaaacgtggggta

SEQ ID NO: 43064 - DNA, 25 bp, Homo sapien
caggtctcttcacaaatgtggggta

SEQ ID NO: 43065 - DNA, 25 bp, Homo sapien
caggtctgagctcaaacatcccaag

SEQ ID NO: 43066 - DNA, 25 bp, Homo sapien
caggtctgagctcaaagatcccaag

SEQ ID NO: 43067 - DNA, 25 bp, Homo sapien
caggtctgatttaactcacctttct

SEQ ID NO: 43068 - DNA, 25 bp, Homo sapien
caggtctgatttgactcacctttct

SEQ ID NO: 43069 - DNA, 25 bp, Homo sapien
caggtctgcgatggcggcaaacagc

SEQ ID NO: 43070 - DNA, 25 bp, Homo sapien
caggtctgcgatggtggcaaacagc

SEQ ID NO: 43071 - DNA, 25 bp, Homo sapien
caggtgaaaggtcagcaacctagaa

SEQ ID NO: 43072 - DNA, 25 bp, Homo sapien
caggtgaaatgtcagcaacctagaa

SEQ ID NO: 43073 - DNA, 25 bp, Homo sapien
caggtgaattcataaacaaactgtg

SEQ ID NO: 43074 - DNA, 25 bp, Homo sapien
caggtgaattcgtaaacaaactgtg

SEQ ID NO: 43075 - DNA, 25 bp, Homo sapien
caggtgagcccttgctttgcccagt

SEQ ID NO: 43076 - DNA, 25 bp, Homo sapien
caggtgagcccttgttttgcccagt

SEQ ID NO: 43077 - DNA, 25 bp, Homo sapien
caggtgagtgacactgtccagcaca

SEQ ID NO: 43078 - DNA, 25 bp, Homo sapien
caggtgagtgatactgtccagcaca

SEQ ID NO: 43079 - DNA, 25 bp, Homo sapien
caggtgatcctgcggaagagctccc

SEQ ID NO: 43080 - DNA, 25 bp, Homo sapien
caggtgatcctgcggatgagctccc

SEQ ID NO: 43081 - DNA, 25 bp, Homo sapien
caggtgattggcatcctgaattttg

SEQ ID NO: 43082 - DNA, 25 bp, Homo sapien
caggtgattggtatcctgaattttg

SEQ ID NO: 43083 - DNA, 25 bp, Homo sapien
caggtgattttaaggcaggaggtcc

SEQ ID NO: 43084 - DNA, 25 bp, Homo sapien
caggtgattttaatgcaggaggtcc

SEQ ID NO: 43085 - DNA, 25 bp, Homo sapien
caggtgcagactcctgagtaaatat

SEQ ID NO: 43086 - DNA, 25 bp, Homo sapien
caggtgcagactcctgggtaaatat

SEQ ID NO: 43087 - DNA, 25 bp, Homo sapien
caggtgccaataggcagccgatatg

SEQ ID NO: 43088 - DNA, 25 bp, Homo sapien
caggtgccaatgggcagccgatatg

SEQ ID NO: 43089 - DNA, 25 bp, Homo sapien
caggtggactgacgctgatttccaa

SEQ ID NO: 43090 - DNA, 25 bp, Homo sapien
caggtggactgatgctgatttccaa

SEQ ID NO: 43091 - DNA, 25 bp, Homo sapien
caggtgggcagtagtcatattaaaa

SEQ ID NO: 43092 - DNA, 25 bp, Homo sapien
caggtgggcagtagtcgtattaaaa

SEQ ID NO: 43093 - DNA, 25 bp, Homo sapien
caggtgggtcatttgagcccaggag

SEQ ID NO: 43094 - DNA, 25 bp, Homo sapien
caggtgggttatttgagcccaggag

SEQ ID NO: 43095 - DNA, 25 bp, Homo sapien
caggtgtaagcagaaaagaggatct

SEQ ID NO: 43096 - DNA, 25 bp, Homo sapien
caggtgtaagcagaaatgaggatct

SEQ ID NO: 43097 - DNA, 25 bp, Homo sapien
caggtgtattagacaaacgagactt

SEQ ID NO: 43098 - DNA, 25 bp, Homo sapien
caggtgtattagaccaacgagactt

SEQ ID NO: 43099 - DNA, 25 bp, Homo sapien
caggtgtcagacatacattgcagca

SEQ ID NO: 43100 - DNA, 25 bp, Homo sapien
caggtgtcagacatgcattgcagca

SEQ ID NO: 43101 - DNA, 25 bp, Homo sapien
caggtgtgaaccagtgcagtgccag

SEQ ID NO: 43102 - DNA, 25 bp, Homo sapien
caggtgtgaccattttcctgggcca

SEQ ID NO: 43103 - DNA, 25 bp, Homo sapien
caggtgtgaccatttttctgggcca

SEQ ID NO: 43104 - DNA, 25 bp, Homo sapien
caggtgtgacccagtgcagtgccag

SEQ ID NO: 43105 - DNA, 25 bp, Homo sapien
caggtgttcactagttcctatcctc

SEQ ID NO: 43106 - DNA, 25 bp, Homo sapien
caggtgttcgctagttcctatcctc

SEQ ID NO: 43107 - DNA, 25 bp, Homo sapien
caggtgttgaccctctaccattctg

SEQ ID NO: 43108 - DNA, 25 bp, Homo sapien
caggtgtttaccctctaccattctg

SEQ ID NO: 43109 - DNA, 25 bp, Homo sapien
caggttaataaagcccaattgagag

SEQ ID NO: 43110 - DNA, 25 bp, Homo sapien
caggttaataaagcccgattgagag

SEQ ID NO: 43111 - DNA, 25 bp, Homo sapien
caggttaatttactccagttcctcc

SEQ ID NO: 43112 - DNA, 25 bp, Homo sapien
caggttaatttactccggttcctcc

SEQ ID NO: 43113 - DNA, 25 bp, Homo sapien
caggttacttcatggtctcaaatag

SEQ ID NO: 43114 - DNA, 25 bp, Homo sapien
caggttacttcattgtctcaaatag

SEQ ID NO: 43115 - DNA, 25 bp, Homo sapien
caggttagacaacagtgatgcaaca

SEQ ID NO: 43116 - DNA, 25 bp, Homo sapien
caggttagagaacagtgatgcaaca

SEQ ID NO: 43117 - DNA, 25 bp, Homo sapien
caggttaggccaagttgagagtcct

SEQ ID NO: 43118 - DNA, 25 bp, Homo sapien
caggttaggccgagttgagagtcct

SEQ ID NO: 43119 - DNA, 25 bp, Homo sapien
caggttcacataggtcagctccaca

SEQ ID NO: 43120 - DNA, 25 bp, Homo sapien
caggttcacattgctttccactcat

SEQ ID NO: 43121 - DNA, 25 bp, Homo sapien
caggttcacattgttttccactcat

SEQ ID NO: 43122 - DNA, 25 bp, Homo sapien
caggttcacgtaggtcagctccaca

SEQ ID NO: 43123 - DNA, 25 bp, Homo sapien
caggttccaattctgcacaaatatg

SEQ ID NO: 43124 - DNA, 25 bp, Homo sapien
caggttccaattcttcacaaatatg

SEQ ID NO: 43125 - DNA, 25 bp, Homo sapien
caggttccagcccatgctgaggttc

SEQ ID NO: 43126 - DNA, 25 bp, Homo sapien
caggttccagcccgtgctgaggttc

SEQ ID NO: 43127 - DNA, 25 bp, Homo sapien
caggttcccgataatgtttgtcgca

SEQ ID NO: 43128 - DNA, 25 bp, Homo sapien
caggttcctgataatgtttgtcgca

SEQ ID NO: 43129 - DNA, 25 bp, Homo sapien
caggttctggtcaaagtcctattct

SEQ ID NO: 43130 - DNA, 25 bp, Homo sapien
caggttctggtcaaggtcctattct

SEQ ID NO: 43131 - DNA, 25 bp, Homo sapien
caggttcttctggacactagattaa

SEQ ID NO: 43132 - DNA, 25 bp, Homo sapien
caggttcttctgggcactagattaa

SEQ ID NO: 43133 - DNA, 25 bp, Homo sapien
caggttctttctatcttcctgacaa

SEQ ID NO: 43134 - DNA, 25 bp, Homo sapien
caggttctttctgtcttcctgacaa

SEQ ID NO: 43135 - DNA, 25 bp, Homo sapien
caggttgaggtataagacaacaggg

SEQ ID NO: 43136 - DNA, 25 bp, Homo sapien
caggttgaggtataaggcaacaggg

SEQ ID NO: 43137 - DNA, 25 bp, Homo sapien
caggttgcaatagtacctagtcttg

SEQ ID NO: 43138 - DNA, 25 bp, Homo sapien
caggttgcagtagtacctagtcttg

SEQ ID NO: 43139 - DNA, 25 bp, Homo sapien
caggttgccaagcgccacccttcca

SEQ ID NO: 43140 - DNA, 25 bp, Homo sapien
caggttgccaagtgccacccttcca

SEQ ID NO: 43141 - DNA, 25 bp, Homo sapien
caggttgtcatcttggaacacatga

SEQ ID NO: 43142 - DNA, 25 bp, Homo sapien
caggttgtcatcttgggacacatga

SEQ ID NO: 43143 - DNA, 25 bp, Homo sapien
caggttgttttgatacttaagtgtg

SEQ ID NO: 43144 - DNA, 25 bp, Homo sapien
caggttgttttggtacttaagtgtg

SEQ ID NO: 43145 - DNA, 25 bp, Homo sapien
caggtttaaagtttctcaggcttgt

SEQ ID NO: 43146 - DNA, 25 bp, Homo sapien
caggtttagagtttctcaggcttgt

SEQ ID NO: 43147 - DNA, 25 bp, Homo sapien
caggtttgattttacgcaagaaacc

SEQ ID NO: 43148 - DNA, 25 bp, Homo sapien
caggtttgattttatgcaagaaacc

SEQ ID NO: 43149 - DNA, 25 bp, Homo sapien
caggtttgccatactggagcaagta

SEQ ID NO: 43150 - DNA, 25 bp, Homo sapien
caggtttgccatagtggagcaagta

SEQ ID NO: 43151 - DNA, 25 bp, Homo sapien
caggttttcctcttctacctctagc

SEQ ID NO: 43152 - DNA, 25 bp, Homo sapien
caggttttccttttctacctctagc

SEQ ID NO: 43153 - DNA, 25 bp, Homo sapien
caggttttcttattggttttcatag

SEQ ID NO: 43154 - DNA, 25 bp, Homo sapien
caggttttcttatttgttttcatag

SEQ ID NO: 43155 - DNA, 25 bp, Homo sapien
cagtaaaaagtcttcccatggcttc

SEQ ID NO: 43156 - DNA, 25 bp, Homo sapien
cagtaaaaagtcttcctatggcttc

SEQ ID NO: 43157 - DNA, 25 bp, Homo sapien
cagtaaaaatacgacctaaaattat

SEQ ID NO: 43158 - DNA, 25 bp, Homo sapien
cagtaaaaatatgacctaaaattat

SEQ ID NO: 43159 - DNA, 25 bp, Homo sapien
cagtaaaagaagagtaacaaaccag

SEQ ID NO: 43160 - DNA, 25 bp, Homo sapien
cagtaaaagaagtgtaacaaaccag

SEQ ID NO: 43161 - DNA, 25 bp, Homo sapien
cagtaaaaggaaagagtaagccaag

SEQ ID NO: 43162 - DNA, 25 bp, Homo sapien
cagtaaaatgaaagagtaagccaag

SEQ ID NO: 43163 - DNA, 25 bp, Homo sapien
cagtaaatatatagtgaaaaaaact

SEQ ID NO: 43164 - DNA, 25 bp, Homo sapien
cagtaaatatatagtgtaaaaaact

SEQ ID NO: 43165 - DNA, 25 bp, Homo sapien
cagtaaatgcagcgagaagaatgag

SEQ ID NO: 43166 - DNA, 25 bp, Homo sapien
cagtaaatgcagtgagaagaatgag

SEQ ID NO: 43167 - DNA, 25 bp, Homo sapien
cagtaaatgtgcaaaagagacaggt

SEQ ID NO: 43168 - DNA, 25 bp, Homo sapien
cagtaaatgtgcgaaagagacaggt

SEQ ID NO: 43169 - DNA, 25 bp, Homo sapien
cagtaaccacgatggcagctggccc

SEQ ID NO: 43170 - DNA, 25 bp, Homo sapien
cagtaaccatgatggcagctggccc

SEQ ID NO: 43171 - DNA, 25 bp, Homo sapien
cagtaacctcacggccacttagcaa

SEQ ID NO: 43172 - DNA, 25 bp, Homo sapien
cagtaacctcagggccacttagcaa

SEQ ID NO: 43173 - DNA, 25 bp, Homo sapien
cagtaacttcctataagctgaaagt

SEQ ID NO: 43174 - DNA, 25 bp, Homo sapien
cagtaacttcctgtaagctgaaagt

SEQ ID NO: 43175 - DNA, 25 bp, Homo sapien
cagtaagattttcaaggcagaatga

SEQ ID NO: 43176 - DNA, 25 bp, Homo sapien
cagtaagattttcagggcagaatga

SEQ ID NO: 43177 - DNA, 25 bp, Homo sapien
cagtaagtcattcatttggacaata

SEQ ID NO: 43178 - DNA, 25 bp, Homo sapien
cagtaagtcatttatttggacaata

SEQ ID NO: 43179 - DNA, 25 bp, Homo sapien
cagtaatactattcataacaaccct

SEQ ID NO: 43180 - DNA, 25 bp, Homo sapien
cagtaatactattcctaacaaccct

SEQ ID NO: 43181 - DNA, 25 bp, Homo sapien
cagtaatagtaataataatagtagt

SEQ ID NO: 43182 - DNA, 25 bp, Homo sapien
cagtaatagtagtaataatagtagt

SEQ ID NO: 43183 - DNA, 25 bp, Homo sapien
cagtaatatctaaactatgcattat

SEQ ID NO: 43184 - DNA, 25 bp, Homo sapien
cagtaatatttaaactatgcattat

SEQ ID NO: 43185 - DNA, 25 bp, Homo sapien
cagtaatcttggagtgctatgtctt

SEQ ID NO: 43186 - DNA, 25 bp, Homo sapien
cagtaatcttggagtgttatgtctt

SEQ ID NO: 43187 - DNA, 25 bp, Homo sapien
cagtaatgccaacgttctgttagca

SEQ ID NO: 43188 - DNA, 25 bp, Homo sapien
cagtaatgccaaggttctgttagca

SEQ ID NO: 43189 - DNA, 25 bp, Homo sapien
cagtaatggtaaaatagctcctttg

SEQ ID NO: 43190 - DNA, 25 bp, Homo sapien
cagtaatggtaaagtagctcctttg

SEQ ID NO: 43191 - DNA, 25 bp, Homo sapien
cagtaatgtccaagtaatcaacatg

SEQ ID NO: 43192 - DNA, 25 bp, Homo sapien
cagtaatgtccacgtaatcaacatg

SEQ ID NO: 43193 - DNA, 25 bp, Homo sapien
cagtaattacctatgtcttttctgc

SEQ ID NO: 43194 - DNA, 25 bp, Homo sapien
cagtaattacctatgtgttttctgc

SEQ ID NO: 43195 - DNA, 25 bp, Homo sapien
cagtaattattatctccaaaccaat

SEQ ID NO: 43196 - DNA, 25 bp, Homo sapien
cagtaattattatttccaaaccaat

SEQ ID NO: 43197 - DNA, 25 bp, Homo sapien
cagtaattatttataggaatccaaa

SEQ ID NO: 43198 - DNA, 25 bp, Homo sapien
cagtaattatttgtaggaatccaaa

SEQ ID NO: 43199 - DNA, 25 bp, Homo sapien
cagtacagacagtcttcatgcaaag

SEQ ID NO: 43200 - DNA, 25 bp, Homo sapien
cagtacagacattcttcatgcaaag

SEQ ID NO: 43201 - DNA, 25 bp, Homo sapien
cagtacatgataacgcgatttcaaa

SEQ ID NO: 43202 - DNA, 25 bp, Homo sapien
cagtacatgatatcgcgatttcaaa

SEQ ID NO: 43203 - DNA, 25 bp, Homo sapien
cagtaccgactgatgaagtggtcta

SEQ ID NO: 43204 - DNA, 25 bp, Homo sapien
cagtaccggctgatgaagtggtcta

SEQ ID NO: 43205 - DNA, 25 bp, Homo sapien
cagtactgagagatctcggttgtga

SEQ ID NO: 43206 - DNA, 25 bp, Homo sapien
cagtactgagagatctgggttgtga

SEQ ID NO: 43207 - DNA, 25 bp, Homo sapien
cagtactttacagccttcctacagc

SEQ ID NO: 43208 - DNA, 25 bp, Homo sapien
cagtactttgcattgtaggatcaga

SEQ ID NO: 43209 - DNA, 25 bp, Homo sapien
cagtactttgcattgtgggatcaga

SEQ ID NO: 43210 - DNA, 25 bp, Homo sapien
cagtacttttcagccttcctacagc

SEQ ID NO: 43211 - DNA, 25 bp, Homo sapien
cagtactttttgccatccactctat

SEQ ID NO: 43212 - DNA, 25 bp, Homo sapien
cagtactttttgccattcactctat

SEQ ID NO: 43213 - DNA, 25 bp, Homo sapien
cagtagactcacctgacacataaag

SEQ ID NO: 43214 - DNA, 25 bp, Homo sapien
cagtagactcatctgacacataaag

SEQ ID NO: 43215 - DNA, 25 bp, Homo sapien
cagtagacttcagtgccgattttct

SEQ ID NO: 43216 - DNA, 25 bp, Homo sapien
cagtagacttcagtgctgattttct

SEQ ID NO: 43217 - DNA, 25 bp, Homo sapien
cagtagagacgaaaaagtagtaagc

SEQ ID NO: 43218 - DNA, 25 bp, Homo sapien
cagtagagatgaaaaagtagtaagc

SEQ ID NO: 43219 - DNA, 25 bp, Homo sapien
cagtagagtagcatccagagcagtt

SEQ ID NO: 43220 - DNA, 25 bp, Homo sapien
cagtagagtagcatccggagcagtt

SEQ ID NO: 43221 - DNA, 25 bp, Homo sapien
cagtagatgactcccctttcttctt

SEQ ID NO: 43222 - DNA, 25 bp, Homo sapien
cagtagatgactctcctttcttctt

SEQ ID NO: 43223 - DNA, 25 bp, Homo sapien
cagtagattcccagatccagggctg

SEQ ID NO: 43224 - DNA, 25 bp, Homo sapien
cagtagattcccaggtccagggctg

SEQ ID NO: 43225 - DNA, 25 bp, Homo sapien
cagtagcaaccactgcattgtattt

SEQ ID NO: 43226 - DNA, 25 bp, Homo sapien
cagtagcaaccattgcattgtattt

SEQ ID NO: 43227 - DNA, 25 bp, Homo sapien
cagtagcacataagatcccatccct

SEQ ID NO: 43228 - DNA, 25 bp, Homo sapien
cagtagcacgtaagatcccatccct

SEQ ID NO: 43229 - DNA, 25 bp, Homo sapien
cagtagccactagatatcagccctc

SEQ ID NO: 43230 - DNA, 25 bp, Homo sapien
cagtagccattagatatcagccctc

SEQ ID NO: 43231 - DNA, 25 bp, Homo sapien
cagtagcctgaattctggaatagag

SEQ ID NO: 43232 - DNA, 25 bp, Homo sapien
cagtagcctgatttctggaatagag

SEQ ID NO: 43233 - DNA, 25 bp, Homo sapien
cagtagcttctctaaccattttgca

SEQ ID NO: 43234 - DNA, 25 bp, Homo sapien
cagtagcttctgtaaccattttgca

SEQ ID NO: 43235 - DNA, 25 bp, Homo sapien
cagtaggtagtctctttctcctttc

SEQ ID NO: 43236 - DNA, 25 bp, Homo sapien
cagtaggtcacaaggagtacacaca

SEQ ID NO: 43237 - DNA, 25 bp, Homo sapien
cagtaggtcacaaggattacacaca

SEQ ID NO: 43238 - DNA, 25 bp, Homo sapien
cagtaggtggtctctttctcctttc

SEQ ID NO: 43239 - DNA, 25 bp, Homo sapien
cagtagtctttatatcaccaaagca

SEQ ID NO: 43240 - DNA, 25 bp, Homo sapien
cagtagtctttatatcgccaaagca

SEQ ID NO: 43241 - DNA, 25 bp, Homo sapien
cagtagtggtgctgagaggttcctc

SEQ ID NO: 43242 - DNA, 25 bp, Homo sapien
cagtagtggtgcttagaggttcctc

SEQ ID NO: 43243 - DNA, 25 bp, Homo sapien
cagtagtgtcaaagagtttgctttt

SEQ ID NO: 43244 - DNA, 25 bp, Homo sapien
cagtagtgtcaaggagtttgctttt

SEQ ID NO: 43245 - DNA, 25 bp, Homo sapien
cagtatacaatgggaaatcatgcct

SEQ ID NO: 43246 - DNA, 25 bp, Homo sapien
cagtatacagtgggaaatcatgcct

SEQ ID NO: 43247 - DNA, 25 bp, Homo sapien
cagtatacatagagccttgtaaacc

SEQ ID NO: 43248 - DNA, 25 bp, Homo sapien
cagtatacatagagtcttgtaaacc

SEQ ID NO: 43249 - DNA, 25 bp, Homo sapien
cagtatagaagaaaaaacgcaggct

SEQ ID NO: 43250 - DNA, 25 bp, Homo sapien
cagtatagaaggaaaaacgcaggct

SEQ ID NO: 43251 - DNA, 25 bp, Homo sapien
cagtatagacaaccatccaatttca

SEQ ID NO: 43252 - DNA, 25 bp, Homo sapien
cagtatagacagccatccaatttca

SEQ ID NO: 43253 - DNA, 25 bp, Homo sapien
cagtatagacgctggagccagactg

SEQ ID NO: 43254 - DNA, 25 bp, Homo sapien
cagtatagatgctggagccagactg

SEQ ID NO: 43255 - DNA, 25 bp, Homo sapien
cagtatagtaatctgttacgctctg

SEQ ID NO: 43256 - DNA, 25 bp, Homo sapien
cagtatagtaatcttttacgctctg

SEQ ID NO: 43257 - DNA, 25 bp, Homo sapien
cagtatcatttatcatgagaagtgc

SEQ ID NO: 43258 - DNA, 25 bp, Homo sapien
cagtatcatttatcctgagaagtgc

SEQ ID NO: 43259 - DNA, 25 bp, Homo sapien
cagtatcccgtgccttctggaggta

SEQ ID NO: 43260 - DNA, 25 bp, Homo sapien
cagtatcccgtgctttctggaggta

SEQ ID NO: 43261 - DNA, 25 bp, Homo sapien
cagtatctggaaacattttttggtt

SEQ ID NO: 43262 - DNA, 25 bp, Homo sapien
cagtatctggaaacgttttttggtt

SEQ ID NO: 43263 - DNA, 25 bp, Homo sapien
cagtatcttcagttcttacagtggg

SEQ ID NO: 43264 - DNA, 25 bp, Homo sapien
cagtatcttcatttcttacagtggg

SEQ ID NO: 43265 - DNA, 25 bp, Homo sapien
cagtattaaaataggctggaaatta

SEQ ID NO: 43266 - DNA, 25 bp, Homo sapien
cagtattaacaatttttccataagc

SEQ ID NO: 43267 - DNA, 25 bp, Homo sapien
cagtattaacagtttttccataagc

SEQ ID NO: 43268 - DNA, 25 bp, Homo sapien
cagtattaacataggctggaaatta

SEQ ID NO: 43269 - DNA, 25 bp, Homo sapien
cagtattagaacacagacatcctta

SEQ ID NO: 43270 - DNA, 25 bp, Homo sapien
cagtattaggacacagacatcctta

SEQ ID NO: 43271 - DNA, 25 bp, Homo sapien
cagtattatagctggtacataaaga

SEQ ID NO: 43272 - DNA, 25 bp, Homo sapien
cagtattatagttggtacataaaga

SEQ ID NO: 43273 - DNA, 25 bp, Homo sapien
cagtattgagccaagcagcttaaaa

SEQ ID NO: 43274 - DNA, 25 bp, Homo sapien
cagtattgagccaagctgcttaaaa

SEQ ID NO: 43275 - DNA, 25 bp, Homo sapien
cagtattgcttaaccctgaaggagt

SEQ ID NO: 43276 - DNA, 25 bp, Homo sapien
cagtattgcttggttggagcatttt

SEQ ID NO: 43277 - DNA, 25 bp, Homo sapien
cagtattgtttaaccctgaaggagt

SEQ ID NO: 43278 - DNA, 25 bp, Homo sapien
cagtattgtttggttggagcatttt

SEQ ID NO: 43279 - DNA, 25 bp, Homo sapien
cagtatttcaacataggttctattt

SEQ ID NO: 43280 - DNA, 25 bp, Homo sapien
cagtatttcaacgtaggttctattt

SEQ ID NO: 43281 - DNA, 25 bp, Homo sapien
cagtatttctgcacgaaggatttaa

SEQ ID NO: 43282 - DNA, 25 bp, Homo sapien
cagtatttctggacgaaggatttaa

SEQ ID NO: 43283 - DNA, 25 bp, Homo sapien
cagtcaaaaggccctaagaggaaag

SEQ ID NO: 43284 - DNA, 25 bp, Homo sapien
cagtcaaaaggtcctaagaggaaag

SEQ ID NO: 43285 - DNA, 25 bp, Homo sapien
cagtcaaaagtccattgataataaa

SEQ ID NO: 43286 - DNA, 25 bp, Homo sapien
cagtcaaatgtccattgataataaa

SEQ ID NO: 43287 - DNA, 25 bp, Homo sapien
cagtcaagagaaaaaatgttattta

SEQ ID NO: 43288 - DNA, 25 bp, Homo sapien
cagtcaagggaaaaaatgttattta

SEQ ID NO: 43289 - DNA, 25 bp, Homo sapien
cagtcacactgctgtacttaaactg

SEQ ID NO: 43290 - DNA, 25 bp, Homo sapien
cagtcacattgctgtacttaaactg

SEQ ID NO: 43291 - DNA, 25 bp, Homo sapien
cagtcactaatggggcttcatccca

SEQ ID NO: 43292 - DNA, 25 bp, Homo sapien
cagtcactactggggcttcatccca

SEQ ID NO: 43293 - DNA, 25 bp, Homo sapien
cagtcactgccctaattttccacat

SEQ ID NO: 43294 - DNA, 25 bp, Homo sapien
cagtcactgccttaattttccacat

SEQ ID NO: 43295 - DNA, 25 bp, Homo sapien
cagtcagaaactggttccccgcctt

SEQ ID NO: 43296 - DNA, 25 bp, Homo sapien
cagtcagaagctggttccccgcctt

SEQ ID NO: 43297 - DNA, 25 bp, Homo sapien
cagtcagactatgaagccagcagca

SEQ ID NO: 43298 - DNA, 25 bp, Homo sapien
cagtcagactatgaggccagcagca

SEQ ID NO: 43299 - DNA, 25 bp, Homo sapien
cagtcagagttgaagcaccaagaag

SEQ ID NO: 43300 - DNA, 25 bp, Homo sapien
cagtcagagttgaggcaccaagaag

SEQ ID NO: 43301 - DNA, 25 bp, Homo sapien
cagtcagcatgacaagagtgaaacc

SEQ ID NO: 43302 - DNA, 25 bp, Homo sapien
cagtcagcgtgacaagagtgaaacc

SEQ ID NO: 43303 - DNA, 25 bp, Homo sapien
cagtcagctacaattcagagtttac

SEQ ID NO: 43304 - DNA, 25 bp, Homo sapien
cagtcagctgcaattcagagtttac

SEQ ID NO: 43305 - DNA, 25 bp, Homo sapien
cagtcagctgtcacttcggaaacca

SEQ ID NO: 43306 - DNA, 25 bp, Homo sapien
cagtcagctgtcatttcggaaacca

SEQ ID NO: 43307 - DNA, 25 bp, Homo sapien
cagtcaggaacccatcagcagaaaa

SEQ ID NO: 43308 - DNA, 25 bp, Homo sapien
cagtcaggaactcatcagcagaaaa

SEQ ID NO: 43309 - DNA, 25 bp, Homo sapien
cagtcaggattttctcattgcctgg

SEQ ID NO: 43310 - DNA, 25 bp, Homo sapien
cagtcaggattttctcgttgcctgg

SEQ ID NO: 43311 - DNA, 25 bp, Homo sapien
cagtcaggtgaaacttaaaagatga

SEQ ID NO: 43312 - DNA, 25 bp, Homo sapien
cagtcaggtgacacttaaaagatga

SEQ ID NO: 43313 - DNA, 25 bp, Homo sapien
cagtcagtctcatactttcaggttg

SEQ ID NO: 43314 - DNA, 25 bp, Homo sapien
cagtcagtctcatcctttcaggttg

SEQ ID NO: 43315 - DNA, 25 bp, Homo sapien
cagtcagtctcctagaacatacatc

SEQ ID NO: 43316 - DNA, 25 bp, Homo sapien
cagtcagtctcctggaacatacatc

SEQ ID NO: 43317 - DNA, 25 bp, Homo sapien
cagtcagtcttcctccctggtgaga

SEQ ID NO: 43318 - DNA, 25 bp, Homo sapien
cagtcagtcttgctccctggtgaga

SEQ ID NO: 43319 - DNA, 25 bp, Homo sapien
cagtcagttgttgcgataagatcta

SEQ ID NO: 43320 - DNA, 25 bp, Homo sapien
cagtcagttgttgggataagatcta

SEQ ID NO: 43321 - DNA, 25 bp, Homo sapien
cagtcatcaagaacaactagaaatt

SEQ ID NO: 43322 - DNA, 25 bp, Homo sapien
cagtcatcaggaacaactagaaatt

SEQ ID NO: 43323 - DNA, 25 bp, Homo sapien
cagtcatgtatttccacagatgggg

SEQ ID NO: 43324 - DNA, 25 bp, Homo sapien
cagtcatgtctttccacagatgggg

SEQ ID NO: 43325 - DNA, 25 bp, Homo sapien
cagtcatttgctattctcattgcac

SEQ ID NO: 43326 - DNA, 25 bp, Homo sapien
cagtcatttgctgttctcattgcac

SEQ ID NO: 43327 - DNA, 25 bp, Homo sapien
cagtccaaaagcggtctctcaaaag

SEQ ID NO: 43328 - DNA, 25 bp, Homo sapien
cagtccaaaagctgtctctcaaaag

SEQ ID NO: 43329 - DNA, 25 bp, Homo sapien
cagtccacaaacatgagtgtctatt

SEQ ID NO: 43330 - DNA, 25 bp, Homo sapien
cagtccacaaatatgagtgtctatt

SEQ ID NO: 43331 - DNA, 25 bp, Homo sapien
cagtccactgtttctgctctgctcc

SEQ ID NO: 43332 - DNA, 25 bp, Homo sapien
cagtccactgtttctgttctgctcc

SEQ ID NO: 43333 - DNA, 25 bp, Homo sapien
cagtccagctaaattagaaatataa

SEQ ID NO: 43334 - DNA, 25 bp, Homo sapien
cagtccagttaaattagaaatataa

SEQ ID NO: 43335 - DNA, 25 bp, Homo sapien
cagtccatttctcaggtgaggaaaa

SEQ ID NO: 43336 - DNA, 25 bp, Homo sapien
cagtccatttctcgggtgaggaaaa

SEQ ID NO: 43337 - DNA, 25 bp, Homo sapien
cagtccatttggtcaactcctcatt

SEQ ID NO: 43338 - DNA, 25 bp, Homo sapien
cagtccatttggttaactcctcatt

SEQ ID NO: 43339 - DNA, 25 bp, Homo sapien
cagtcccaaaagaaatgttgcctgt

SEQ ID NO: 43340 - DNA, 25 bp, Homo sapien
cagtcccaaaataaatgttgcctgt

SEQ ID NO: 43341 - DNA, 25 bp, Homo sapien
cagtcccaggaaggagatatgtgag

SEQ ID NO: 43342 - DNA, 25 bp, Homo sapien
cagtcccaggaaggaggtatgtgag

SEQ ID NO: 43343 - DNA, 25 bp, Homo sapien
cagtccctcaggaggaactcaagtt

SEQ ID NO: 43344 - DNA, 25 bp, Homo sapien
cagtccctctggaggaactcaagtt

SEQ ID NO: 43345 - DNA, 25 bp, Homo sapien
cagtcctagtcaagatggccacacc

SEQ ID NO: 43346 - DNA, 25 bp, Homo sapien
cagtcctagtcgagatggccacacc

SEQ ID NO: 43347 - DNA, 25 bp, Homo sapien
cagtcctcagcaaccacagggagga

SEQ ID NO: 43348 - DNA, 25 bp, Homo sapien
cagtcctcagcaactacagggagga

SEQ ID NO: 43349 - DNA, 25 bp, Homo sapien
cagtcctcatcaacacacaaagtga

SEQ ID NO: 43350 - DNA, 25 bp, Homo sapien
cagtcctcgtcaacacacaaagtga

SEQ ID NO: 43351 - DNA, 25 bp, Homo sapien
cagtcctctctcattgtccttgaag

SEQ ID NO: 43352 - DNA, 25 bp, Homo sapien
cagtcctctgtcattgtccttgaag

SEQ ID NO: 43353 - DNA, 25 bp, Homo sapien
cagtcctggtgacaatctgagtagg

SEQ ID NO: 43354 - DNA, 25 bp, Homo sapien
cagtcctggtgacaatttgagtagg

SEQ ID NO: 43355 - DNA, 25 bp, Homo sapien
cagtccttatccacattttgccaaa

SEQ ID NO: 43356 - DNA, 25 bp, Homo sapien
cagtccttgtacacggtatagctca

SEQ ID NO: 43357 - DNA, 25 bp, Homo sapien
cagtccttgtacatggtatagctca

SEQ ID NO: 43358 - DNA, 25 bp, Homo sapien
cagtccttgtcaacaaaatggatgt

SEQ ID NO: 43359 - DNA, 25 bp, Homo sapien
cagtccttgtccacattttgccaaa

SEQ ID NO: 43360 - DNA, 25 bp, Homo sapien
cagtccttgtcgacaaaatggatgt

SEQ ID NO: 43361 - DNA, 25 bp, Homo sapien
cagtctaggattctgatgaatgggg

SEQ ID NO: 43362 - DNA, 25 bp, Homo sapien
cagtctagggttctgatgaatgggg

SEQ ID NO: 43363 - DNA, 25 bp, Homo sapien
cagtctagtcgggttagatagaaat

SEQ ID NO: 43364 - DNA, 25 bp, Homo sapien
cagtctagttgggttagatagaaat

SEQ ID NO: 43365 - DNA, 25 bp, Homo sapien
cagtctataatatataacccttgca

SEQ ID NO: 43366 - DNA, 25 bp, Homo sapien
cagtctatgatatataacccttgca

SEQ ID NO: 43367 - DNA, 25 bp, Homo sapien
cagtctcacacagaaatattaactt

SEQ ID NO: 43368 - DNA, 25 bp, Homo sapien
cagtctcacacggaaatattaactt

SEQ ID NO: 43369 - DNA, 25 bp, Homo sapien
cagtctcactcctaccactacaaga

SEQ ID NO: 43370 - DNA, 25 bp, Homo sapien
cagtctcactcctaccgctacaaga

SEQ ID NO: 43371 - DNA, 25 bp, Homo sapien
cagtctcactgcttcatctaccacc

SEQ ID NO: 43372 - DNA, 25 bp, Homo sapien
cagtctcagaaaccatggagccata

SEQ ID NO: 43373 - DNA, 25 bp, Homo sapien
cagtctcagaaatcatggagccata

SEQ ID NO: 43374 - DNA, 25 bp, Homo sapien
cagtctcagcttgccgcaatcttgg

SEQ ID NO: 43375 - DNA, 25 bp, Homo sapien
cagtctcagcttgctgcaatcttgg

SEQ ID NO: 43376 - DNA, 25 bp, Homo sapien
cagtctcaggccagtcactttcttt

SEQ ID NO: 43377 - DNA, 25 bp, Homo sapien
cagtctcaggccggtcactttcttt

SEQ ID NO: 43378 - DNA, 25 bp, Homo sapien
cagtctcagttcaggtcttctagct

SEQ ID NO: 43379 - DNA, 25 bp, Homo sapien
cagtctcagttcgggtcttctagct

SEQ ID NO: 43380 - DNA, 25 bp, Homo sapien
cagtctcatacacgcaattgtgtga

SEQ ID NO: 43381 - DNA, 25 bp, Homo sapien
cagtctcatacatgcaattgtgtga

SEQ ID NO: 43382 - DNA, 25 bp, Homo sapien
cagtctcattgcttcatctaccacc

SEQ ID NO: 43383 - DNA, 25 bp, Homo sapien
cagtctccaaaaagcaaagtcataa

SEQ ID NO: 43384 - DNA, 25 bp, Homo sapien
cagtctccagaaagcaaagtcataa

SEQ ID NO: 43385 - DNA, 25 bp, Homo sapien
cagtctctaaataacttcaccagaa

SEQ ID NO: 43386 - DNA, 25 bp, Homo sapien
cagtctctaaatagcttcaccagaa

SEQ ID NO: 43387 - DNA, 25 bp, Homo sapien
cagtctctggaacgtgggatctaat

SEQ ID NO: 43388 - DNA, 25 bp, Homo sapien
cagtctctggaatgtgggatctaat

SEQ ID NO: 43389 - DNA, 25 bp, Homo sapien
cagtctctgtctaatgatgcttcaa

SEQ ID NO: 43390 - DNA, 25 bp, Homo sapien
cagtctctgtctgatgatgcttcaa

SEQ ID NO: 43391 - DNA, 25 bp, Homo sapien
cagtctgaaggggaattatgttaga

SEQ ID NO: 43392 - DNA, 25 bp, Homo sapien
cagtctgaatgggaattatgttaga

SEQ ID NO: 43393 - DNA, 25 bp, Homo sapien
cagtctgcatggctggattcacaga

SEQ ID NO: 43394 - DNA, 25 bp, Homo sapien
cagtctgcatggcttgattcacaga

SEQ ID NO: 43395 - DNA, 25 bp, Homo sapien
cagtctgggtcggcccaaagcaaac

SEQ ID NO: 43396 - DNA, 25 bp, Homo sapien
cagtctgggtctgcccaaagcaaac

SEQ ID NO: 43397 - DNA, 25 bp, Homo sapien
cagtctgtaatgaatcagttgaatt

SEQ ID NO: 43398 - DNA, 25 bp, Homo sapien
cagtctgtaatgaatcggttgaatt

SEQ ID NO: 43399 - DNA, 25 bp, Homo sapien
cagtctgtagccaaagacccgcgag

SEQ ID NO: 43400 - DNA, 25 bp, Homo sapien
cagtctgtagccaaaggcccgcgag

SEQ ID NO: 43401 - DNA, 25 bp, Homo sapien
cagtctgtggggtgtcctttttcta

SEQ ID NO: 43402 - DNA, 25 bp, Homo sapien
cagtctgtggggtgtcttttttcta

SEQ ID NO: 43403 - DNA, 25 bp, Homo sapien
cagtctgttctcagttttcttttgc

SEQ ID NO: 43404 - DNA, 25 bp, Homo sapien
cagtctgttctccgttttcttttgc

SEQ ID NO: 43405 - DNA, 25 bp, Homo sapien
cagtcttacgatttctattttaatg

SEQ ID NO: 43406 - DNA, 25 bp, Homo sapien
cagtcttagtatttatctggttccc

SEQ ID NO: 43407 - DNA, 25 bp, Homo sapien
cagtcttagtatttctctggttccc

SEQ ID NO: 43408 - DNA, 25 bp, Homo sapien
cagtcttatgatttctattttaatg

SEQ ID NO: 43409 - DNA, 25 bp, Homo sapien
cagtcttcacctccatcttcacatg

SEQ ID NO: 43410 - DNA, 25 bp, Homo sapien
cagtcttcatccataaggcatgagg

SEQ ID NO: 43411 - DNA, 25 bp, Homo sapien
cagtcttcatccataatgcatgagg

SEQ ID NO: 43412 - DNA, 25 bp, Homo sapien
cagtcttcatctactttctcagtct

SEQ ID NO: 43413 - DNA, 25 bp, Homo sapien
cagtcttcgcctccatcttcacatg

SEQ ID NO: 43414 - DNA, 25 bp, Homo sapien
cagtcttcgtctactttctcagtct

SEQ ID NO: 43415 - DNA, 25 bp, Homo sapien
cagtcttgaatcaccaatgccacca

SEQ ID NO: 43416 - DNA, 25 bp, Homo sapien
cagtcttgaatcgccaatgccacca

SEQ ID NO: 43417 - DNA, 25 bp, Homo sapien
cagtcttttaggttgtttgactgaa

SEQ ID NO: 43418 - DNA, 25 bp, Homo sapien
cagtcttttagtttgtttgactgaa

SEQ ID NO: 43419 - DNA, 25 bp, Homo sapien
cagtgaaaaactcaggctaggatga

SEQ ID NO: 43420 - DNA, 25 bp, Homo sapien
cagtgaaaaactcaggttaggatga

SEQ ID NO: 43421 - DNA, 25 bp, Homo sapien
cagtgaaaactaccgaaaacacaaa

SEQ ID NO: 43422 - DNA, 25 bp, Homo sapien
cagtgaaaactacggaaaacacaaa

SEQ ID NO: 43423 - DNA, 25 bp, Homo sapien
cagtgaaagaccagaggattaaatg

SEQ ID NO: 43424 - DNA, 25 bp, Homo sapien
cagtgaaagaccggaggattaaatg

SEQ ID NO: 43425 - DNA, 25 bp, Homo sapien
cagtgaacattgatcacaagattga

SEQ ID NO: 43426 - DNA, 25 bp, Homo sapien
cagtgaaccaaaatagggccactgc

SEQ ID NO: 43427 - DNA, 25 bp, Homo sapien
cagtgaaccgaaatagggccactgc

SEQ ID NO: 43428 - DNA, 25 bp, Homo sapien
cagtgaacgttgatcacaagattga

SEQ ID NO: 43429 - DNA, 25 bp, Homo sapien
cagtgaagacagtaacacagcagga

SEQ ID NO: 43430 - DNA, 25 bp, Homo sapien
cagtgaagacagttacacagcagga

SEQ ID NO: 43431 - DNA, 25 bp, Homo sapien
cagtgaaggccagactgaagaggtc

SEQ ID NO: 43432 - DNA, 25 bp, Homo sapien
cagtgaaggccagacttaagaggtc

SEQ ID NO: 43433 - DNA, 25 bp, Homo sapien
cagtgaatacaaactcattctcaga

SEQ ID NO: 43434 - DNA, 25 bp, Homo sapien
cagtgaatataaactcattctcaga

SEQ ID NO: 43435 - DNA, 25 bp, Homo sapien
cagtgaatgaagcgtgagaatatgc

SEQ ID NO: 43436 - DNA, 25 bp, Homo sapien
cagtgaatgaagtgtgagaatatgc

SEQ ID NO: 43437 - DNA, 25 bp, Homo sapien
cagtgacaagaaggaacaagatggt

SEQ ID NO: 43438 - DNA, 25 bp, Homo sapien
cagtgacaagagggaacaagatggt

SEQ ID NO: 43439 - DNA, 25 bp, Homo sapien
cagtgacaccatgcttctgagaaga

SEQ ID NO: 43440 - DNA, 25 bp, Homo sapien
cagtgacaccatgcttttgagaaga

SEQ ID NO: 43441 - DNA, 25 bp, Homo sapien
cagtgacacgtttctgagtgtttct

SEQ ID NO: 43442 - DNA, 25 bp, Homo sapien
cagtgacacttttctgagtgtttct

SEQ ID NO: 43443 - DNA, 25 bp, Homo sapien
cagtgacataaaacggaaatataag

SEQ ID NO: 43444 - DNA, 25 bp, Homo sapien
cagtgacataaaatggaaatataag

SEQ ID NO: 43445 - DNA, 25 bp, Homo sapien
cagtgacatattcggtgttcacatt

SEQ ID NO: 43446 - DNA, 25 bp, Homo sapien
cagtgacatatttggtgttcacatt

SEQ ID NO: 43447 - DNA, 25 bp, Homo sapien
cagtgaccatatgttgcctgtttct

SEQ ID NO: 43448 - DNA, 25 bp, Homo sapien
cagtgaccatattttgcctgtttct

SEQ ID NO: 43449 - DNA, 25 bp, Homo sapien
cagtgacctagtaacatccaaaagg

SEQ ID NO: 43450 - DNA, 25 bp, Homo sapien
cagtgacctggtaacatccaaaagg

SEQ ID NO: 43451 - DNA, 25 bp, Homo sapien
cagtgactcatagtagatcatttgt

SEQ ID NO: 43452 - DNA, 25 bp, Homo sapien
cagtgactcatattagatcatttgt

SEQ ID NO: 43453 - DNA, 25 bp, Homo sapien
cagtgagagaagacgcacctcaggg

SEQ ID NO: 43454 - DNA, 25 bp, Homo sapien
cagtgagagaagatgcacctcaggg

SEQ ID NO: 43455 - DNA, 25 bp, Homo sapien
cagtgagatgcgaactaaaagggct

SEQ ID NO: 43456 - DNA, 25 bp, Homo sapien
cagtgagatgcggactaaaagggct

SEQ ID NO: 43457 - DNA, 25 bp, Homo sapien
cagtgagcctgctcaaacatccagt

SEQ ID NO: 43458 - DNA, 25 bp, Homo sapien
cagtgagcctgttcaaacatccagt

SEQ ID NO: 43459 - DNA, 25 bp, Homo sapien
cagtgaggatacacttacaacgaac

SEQ ID NO: 43460 - DNA, 25 bp, Homo sapien
cagtgaggatacactttcaacgaac

SEQ ID NO: 43461 - DNA, 25 bp, Homo sapien
cagtgaggctgaacaactaacttgc

SEQ ID NO: 43462 - DNA, 25 bp, Homo sapien
cagtgaggctgaataactaacttgc

SEQ ID NO: 43463 - DNA, 25 bp, Homo sapien
cagtgagtagcttagtatcaggtat

SEQ ID NO: 43464 - DNA, 25 bp, Homo sapien
cagtgagtagcttggtatcaggtat

SEQ ID NO: 43465 - DNA, 25 bp, Homo sapien
cagtgagtcatccaatgccctataa

SEQ ID NO: 43466 - DNA, 25 bp, Homo sapien
cagtgagtcatgcaatgccctataa

SEQ ID NO: 43467 - DNA, 25 bp, Homo sapien
cagtgagtcgtgatggagccgctgc

SEQ ID NO: 43468 - DNA, 25 bp, Homo sapien
cagtgagtcgtgattgagccgctgc

SEQ ID NO: 43469 - DNA, 25 bp, Homo sapien
cagtgatgccattgggtactaggct

SEQ ID NO: 43470 - DNA, 25 bp, Homo sapien
cagtgatggctgagtgctggccaca

SEQ ID NO: 43471 - DNA, 25 bp, Homo sapien
cagtgatgtcattgggtactaggct

SEQ ID NO: 43472 - DNA, 25 bp, Homo sapien
cagtgatgtctgagtgctggccaca

SEQ ID NO: 43473 - DNA, 25 bp, Homo sapien
cagtgatgttttatatactgtcagc

SEQ ID NO: 43474 - DNA, 25 bp, Homo sapien
cagtgatgttttctatactgtcagc

SEQ ID NO: 43475 - DNA, 25 bp, Homo sapien
cagtgattcctgagagaggagaacc

SEQ ID NO: 43476 - DNA, 25 bp, Homo sapien
cagtgattcctgagagcggagaacc

SEQ ID NO: 43477 - DNA, 25 bp, Homo sapien
cagtgcaagaaacggcagtcatcaa

SEQ ID NO: 43478 - DNA, 25 bp, Homo sapien
cagtgcaagaaatggcagtcatcaa

SEQ ID NO: 43479 - DNA, 25 bp, Homo sapien
cagtgcacaggaaagtccctacccc

SEQ ID NO: 43480 - DNA, 25 bp, Homo sapien
cagtgcacaggacagtccctacccc

SEQ ID NO: 43481 - DNA, 25 bp, Homo sapien
cagtgccaattgaaacacatatacc

SEQ ID NO: 43482 - DNA, 25 bp, Homo sapien
cagtgccacgtaaagttctttgatt

SEQ ID NO: 43483 - DNA, 25 bp, Homo sapien
cagtgccagctctgtgacagtgctt

SEQ ID NO: 43484 - DNA, 25 bp, Homo sapien
cagtgccagctttgtgacagtgctt

SEQ ID NO: 43485 - DNA, 25 bp, Homo sapien
cagtgccagttgaaacacatatacc

SEQ ID NO: 43486 - DNA, 25 bp, Homo sapien
cagtgccatgtaaagttctttgatt

SEQ ID NO: 43487 - DNA, 25 bp, Homo sapien
cagtgccgagtaaagtgtgatacaa

SEQ ID NO: 43488 - DNA, 25 bp, Homo sapien
cagtgccgagtgaagtgtgatacaa

SEQ ID NO: 43489 - DNA, 25 bp, Homo sapien
cagtgcctaaccgggtgccttcagt

SEQ ID NO: 43490 - DNA, 25 bp, Homo sapien
cagtgcctaactgggtgccttcagt

SEQ ID NO: 43491 - DNA, 25 bp, Homo sapien
cagtgctaacaggaaagtttatagt

SEQ ID NO: 43492 - DNA, 25 bp, Homo sapien
cagtgctaacagtaaagtttatagt

SEQ ID NO: 43493 - DNA, 25 bp, Homo sapien
cagtgctactgtagagattcatcgg

SEQ ID NO: 43494 - DNA, 25 bp, Homo sapien
cagtgctactgtagagtttcatcgg

SEQ ID NO: 43495 - DNA, 25 bp, Homo sapien
cagtgctataagacagtggaaagaa

SEQ ID NO: 43496 - DNA, 25 bp, Homo sapien
cagtgctataaggcagtggaaagaa

SEQ ID NO: 43497 - DNA, 25 bp, Homo sapien
cagtgctcaatggaatcccgtgatt

SEQ ID NO: 43498 - DNA, 25 bp, Homo sapien
cagtgctcagctgaacagcagtgag

SEQ ID NO: 43499 - DNA, 25 bp, Homo sapien
cagtgctcagctgaccagcagtgag

SEQ ID NO: 43500 - DNA, 25 bp, Homo sapien
cagtgctcagtggaatcccgtgatt

SEQ ID NO: 43501 - DNA, 25 bp, Homo sapien
cagtgctcctttcgcgagggcatta

SEQ ID NO: 43502 - DNA, 25 bp, Homo sapien
cagtgctccttttgcgagggcatta

SEQ ID NO: 43503 - DNA, 25 bp, Homo sapien
cagtgctgagatgattcgatttgca

SEQ ID NO: 43504 - DNA, 25 bp, Homo sapien
cagtgctgagatgatttgatttgca

SEQ ID NO: 43505 - DNA, 25 bp, Homo sapien
cagtgctgttcatgactcaatttcg

SEQ ID NO: 43506 - DNA, 25 bp, Homo sapien
cagtgctgttcgtgactcaatttcg

SEQ ID NO: 43507 - DNA, 25 bp, Homo sapien
cagtggaacctttcacattcttttt

SEQ ID NO: 43508 - DNA, 25 bp, Homo sapien
cagtggaagctttcacattcttttt

SEQ ID NO: 43509 - DNA, 25 bp, Homo sapien
cagtggacaggagactttccataca

SEQ ID NO: 43510 - DNA, 25 bp, Homo sapien
cagtggacaggagagtttccataca

SEQ ID NO: 43511 - DNA, 25 bp, Homo sapien
cagtggactatataatgtagttgat

SEQ ID NO: 43512 - DNA, 25 bp, Homo sapien
cagtggactgtataatgtagttgat

SEQ ID NO: 43513 - DNA, 25 bp, Homo sapien
cagtggaggcgacacagcccaagag

SEQ ID NO: 43514 - DNA, 25 bp, Homo sapien
cagtggaggcggcacagcccaagag

SEQ ID NO: 43515 - DNA, 25 bp, Homo sapien
cagtggaggtttgccactaggattt

SEQ ID NO: 43516 - DNA, 25 bp, Homo sapien
cagtggaggtttgtcactaggattt

SEQ ID NO: 43517 - DNA, 25 bp, Homo sapien
cagtggagtagagcacgtagcagta

SEQ ID NO: 43518 - DNA, 25 bp, Homo sapien
cagtggagtagagcacttagcagta

SEQ ID NO: 43519 - DNA, 25 bp, Homo sapien
cagtggatactcccgatgttcaaaa

SEQ ID NO: 43520 - DNA, 25 bp, Homo sapien
cagtggatactctcgatgttcaaaa

SEQ ID NO: 43521 - DNA, 25 bp, Homo sapien
cagtggctctcctacctccttttcc

SEQ ID NO: 43522 - DNA, 25 bp, Homo sapien
cagtggctctcttacctccttttcc

SEQ ID NO: 43523 - DNA, 25 bp, Homo sapien
cagtggctgatcacactcaatttgt

SEQ ID NO: 43524 - DNA, 25 bp, Homo sapien
cagtggctgatcatactcaatttgt

SEQ ID NO: 43525 - DNA, 25 bp, Homo sapien
cagtggctgcacgttgtagttctac

SEQ ID NO: 43526 - DNA, 25 bp, Homo sapien
cagtggctgtacgttgtagttctac

SEQ ID NO: 43527 - DNA, 25 bp, Homo sapien
cagtgggcaaaaacctaccaacaca

SEQ ID NO: 43528 - DNA, 25 bp, Homo sapien
cagtgggcaaaaagctaccaacaca

SEQ ID NO: 43529 - DNA, 25 bp, Homo sapien
cagtgggccttccataaaagtttgt

SEQ ID NO: 43530 - DNA, 25 bp, Homo sapien
cagtgggccttccatagaagtttgt

SEQ ID NO: 43531 - DNA, 25 bp, Homo sapien
cagtggggctcaagagaaagtaaga

SEQ ID NO: 43532 - DNA, 25 bp, Homo sapien
cagtggggctcaagaggaagtaaga

SEQ ID NO: 43533 - DNA, 25 bp, Homo sapien
cagtgggtctctcactcactgcctt

SEQ ID NO: 43534 - DNA, 25 bp, Homo sapien
cagtgggtctctcattcactgcctt

SEQ ID NO: 43535 - DNA, 25 bp, Homo sapien
cagtggtaaaacgagattatgtaca

SEQ ID NO: 43536 - DNA, 25 bp, Homo sapien
cagtggtaaaatgagattatgtaca

SEQ ID NO: 43537 - DNA, 25 bp, Homo sapien
cagtggtaataggaggtgcatctga

SEQ ID NO: 43538 - DNA, 25 bp, Homo sapien
cagtggtaataggcggtgcatctga

SEQ ID NO: 43539 - DNA, 25 bp, Homo sapien
cagtggtagacacgaaaatgggaag

SEQ ID NO: 43540 - DNA, 25 bp, Homo sapien
cagtggtagacatgaaaatgggaag

SEQ ID NO: 43541 - DNA, 25 bp, Homo sapien
cagtggttgttaagttttcatttat

SEQ ID NO: 43542 - DNA, 25 bp, Homo sapien
cagtggttgttacgttttcatttat

SEQ ID NO: 43543 - DNA, 25 bp, Homo sapien
cagtgtaaacccatgtagactggag

SEQ ID NO: 43544 - DNA, 25 bp, Homo sapien
cagtgtaaacccctgtagactggag

SEQ ID NO: 43545 - DNA, 25 bp, Homo sapien
cagtgtactgaacgatgcaggctat

SEQ ID NO: 43546 - DNA, 25 bp, Homo sapien
cagtgtactgaatgatgcaggctat

SEQ ID NO: 43547 - DNA, 25 bp, Homo sapien
cagtgtagatcgaacagccttctgc

SEQ ID NO: 43548 - DNA, 25 bp, Homo sapien
cagtgtagatcgaccagccttctgc

SEQ ID NO: 43549 - DNA, 25 bp, Homo sapien
cagtgtatccattttatgtcatttg

SEQ ID NO: 43550 - DNA, 25 bp, Homo sapien
cagtgtatctattttatgtcatttg

SEQ ID NO: 43551 - DNA, 25 bp, Homo sapien
cagtgtatgatatttagggtgtaat

SEQ ID NO: 43552 - DNA, 25 bp, Homo sapien
cagtgtatgatttttagggtgtaat

SEQ ID NO: 43553 - DNA, 25 bp, Homo sapien
cagtgtcacagcacaaagaaactag

SEQ ID NO: 43554 - DNA, 25 bp, Homo sapien
cagtgtcacggcacaaagaaactag

SEQ ID NO: 43555 - DNA, 25 bp, Homo sapien
cagtgtcactgcagccagatcccta

SEQ ID NO: 43556 - DNA, 25 bp, Homo sapien
cagtgtcactgcagccggatcccta

SEQ ID NO: 43557 - DNA, 25 bp, Homo sapien
cagtgtctaatctgatgttaaactt

SEQ ID NO: 43558 - DNA, 25 bp, Homo sapien
cagtgtctacacatttgatgataat

SEQ ID NO: 43559 - DNA, 25 bp, Homo sapien
cagtgtctacatatttgatgataat

SEQ ID NO: 43560 - DNA, 25 bp, Homo sapien
cagtgtctagtctgatgttaaactt

SEQ ID NO: 43561 - DNA, 25 bp, Homo sapien
cagtgtctcatacttcttacctttc

SEQ ID NO: 43562 - DNA, 25 bp, Homo sapien
cagtgtctcatatttcttacctttc

SEQ ID NO: 43563 - DNA, 25 bp, Homo sapien
cagtgtctcgttttcccttttacat

SEQ ID NO: 43564 - DNA, 25 bp, Homo sapien
cagtgtctctaattgtcccggttat

SEQ ID NO: 43565 - DNA, 25 bp, Homo sapien
cagtgtctctagttgtcccggttat

SEQ ID NO: 43566 - DNA, 25 bp, Homo sapien
cagtgtcttgttttcccttttacat

SEQ ID NO: 43567 - DNA, 25 bp, Homo sapien
cagtgtctttcgtccagccaggctt

SEQ ID NO: 43568 - DNA, 25 bp, Homo sapien
cagtgtctttcgtctagccaggctt

SEQ ID NO: 43569 - DNA, 25 bp, Homo sapien
cagtgtgaaatatggcagtttgcat

SEQ ID NO: 43570 - DNA, 25 bp, Homo sapien
cagtgtgaaatatggcggtttgcat

SEQ ID NO: 43571 - DNA, 25 bp, Homo sapien
cagtgtgactgaacggtactgtgaa

SEQ ID NO: 43572 - DNA, 25 bp, Homo sapien
cagtgtgactgaatggtactgtgaa

SEQ ID NO: 43573 - DNA, 25 bp, Homo sapien
cagtgtgagtttacgaggtatttta

SEQ ID NO: 43574 - DNA, 25 bp, Homo sapien
cagtgtgagtttatgaggtatttta

SEQ ID NO: 43575 - DNA, 25 bp, Homo sapien
cagtgtgggaacatgcacttgtgtt

SEQ ID NO: 43576 - DNA, 25 bp, Homo sapien
cagtgtggtaacatgcacttgtgtt

SEQ ID NO: 43577 - DNA, 25 bp, Homo sapien
cagtgtgtacaaattgtgggaagaa

SEQ ID NO: 43578 - DNA, 25 bp, Homo sapien
cagtgtgtacatattgtgggaagaa

SEQ ID NO: 43579 - DNA, 25 bp, Homo sapien
cagtgtgtgacagggagagaaacag

SEQ ID NO: 43580 - DNA, 25 bp, Homo sapien
cagtgtgtgcccactttcctttgtt

SEQ ID NO: 43581 - DNA, 25 bp, Homo sapien
cagtgtgtgcccgctttcctttgtt

SEQ ID NO: 43582 - DNA, 25 bp, Homo sapien
cagtgtgttacagggagagaaacag

SEQ ID NO: 43583 - DNA, 25 bp, Homo sapien
cagtgttgaactcagtatgtttaat

SEQ ID NO: 43584 - DNA, 25 bp, Homo sapien
cagtgttgaactcggtatgtttaat

SEQ ID NO: 43585 - DNA, 25 bp, Homo sapien
cagtgttggcaaaggcacggggaaa

SEQ ID NO: 43586 - DNA, 25 bp, Homo sapien
cagtgttggcaacggcacggggaaa

SEQ ID NO: 43587 - DNA, 25 bp, Homo sapien
cagtgtttcaataaacataggatgc

SEQ ID NO: 43588 - DNA, 25 bp, Homo sapien
cagtgtttcgataaacataggatgc

SEQ ID NO: 43589 - DNA, 25 bp, Homo sapien
cagtgtttctgaggcccctttgaca

SEQ ID NO: 43590 - DNA, 25 bp, Homo sapien
cagtgtttctggggcccctttgaca

SEQ ID NO: 43591 - DNA, 25 bp, Homo sapien
cagtgtttgtgttgtacgctgttat

SEQ ID NO: 43592 - DNA, 25 bp, Homo sapien
cagtgtttgtgttttacgctgttat

SEQ ID NO: 43593 - DNA, 25 bp, Homo sapien
cagttaaaacacagtatgcatgaag

SEQ ID NO: 43594 - DNA, 25 bp, Homo sapien
cagttaaaacatagtatgcatgaag

SEQ ID NO: 43595 - DNA, 25 bp, Homo sapien
cagttaacaacatacttactgatga

SEQ ID NO: 43596 - DNA, 25 bp, Homo sapien
cagttaacatcatacttactgatga

SEQ ID NO: 43597 - DNA, 25 bp, Homo sapien
cagttaagccagaggacgacccacc

SEQ ID NO: 43598 - DNA, 25 bp, Homo sapien
cagttaagccagtggacgacccacc

SEQ ID NO: 43599 - DNA, 25 bp, Homo sapien
cagttaatcggtaatatctcctaga

SEQ ID NO: 43600 - DNA, 25 bp, Homo sapien
cagttaatgtgacttttgtttttag

SEQ ID NO: 43601 - DNA, 25 bp, Homo sapien
cagttaatgtgatttttgtttttag

SEQ ID NO: 43602 - DNA, 25 bp, Homo sapien
cagttaattggtaatatctcctaga

SEQ ID NO: 43603 - DNA, 25 bp, Homo sapien
cagttaattggtgacaggccaaata

SEQ ID NO: 43604 - DNA, 25 bp, Homo sapien
cagttaattggtgagaggccaaata

SEQ ID NO: 43605 - DNA, 25 bp, Homo sapien
cagttacaccctacgcacatgaaga

SEQ ID NO: 43606 - DNA, 25 bp, Homo sapien
cagttacaccctatgcacatgaaga

SEQ ID NO: 43607 - DNA, 25 bp, Homo sapien
cagttacagccaatatgaacacaca

SEQ ID NO: 43608 - DNA, 25 bp, Homo sapien
cagttacagccgatatgaacacaca

SEQ ID NO: 43609 - DNA, 25 bp, Homo sapien
cagttacattcaatgaatattttct

SEQ ID NO: 43610 - DNA, 25 bp, Homo sapien
cagttacattcagtgaatattttct

SEQ ID NO: 43611 - DNA, 25 bp, Homo sapien
cagttaccagctcatcttcccaggc

SEQ ID NO: 43612 - DNA, 25 bp, Homo sapien
cagttaccagcttatcttcccaggc

SEQ ID NO: 43613 - DNA, 25 bp, Homo sapien
cagttagaacagagtgctgagagca

SEQ ID NO: 43614 - DNA, 25 bp, Homo sapien
cagttagaccagagtgctgagagca

SEQ ID NO: 43615 - DNA, 25 bp, Homo sapien
cagttagagaggtccggcatgtgag

SEQ ID NO: 43616 - DNA, 25 bp, Homo sapien
cagttagagaggtctggcatgtgag

SEQ ID NO: 43617 - DNA, 25 bp, Homo sapien
cagttagcaccaatcttgtacatat

SEQ ID NO: 43618 - DNA, 25 bp, Homo sapien
cagttagcaccgatcttgtacatat

SEQ ID NO: 43619 - DNA, 25 bp, Homo sapien
cagttataaccatgccaagtggagc

SEQ ID NO: 43620 - DNA, 25 bp, Homo sapien
cagttataaccgtgccaagtggagc

SEQ ID NO: 43621 - DNA, 25 bp, Homo sapien
cagttatgtttctcggaagcagttt

SEQ ID NO: 43622 - DNA, 25 bp, Homo sapien
cagttatgtttcttggaagcagttt

SEQ ID NO: 43623 - DNA, 25 bp, Homo sapien
cagttatttttcaagtacttttata

SEQ ID NO: 43624 - DNA, 25 bp, Homo sapien
cagttattttttaagtacttttata

SEQ ID NO: 43625 - DNA, 25 bp, Homo sapien
cagttcaacagtcaaaagacaggtt

SEQ ID NO: 43626 - DNA, 25 bp, Homo sapien
cagttcaacagtgaaaagacaggtt

SEQ ID NO: 43627 - DNA, 25 bp, Homo sapien
cagttcaatcccaatagtttcttga

SEQ ID NO: 43628 - DNA, 25 bp, Homo sapien
cagttcaatcccagtagtttcttga

SEQ ID NO: 43629 - DNA, 25 bp, Homo sapien
cagttcagctgacattcaaactatc

SEQ ID NO: 43630 - DNA, 25 bp, Homo sapien
cagttcagctgagattcaaactatc

SEQ ID NO: 43631 - DNA, 25 bp, Homo sapien
cagttcagctgcttcaaacatagaa

SEQ ID NO: 43632 - DNA, 25 bp, Homo sapien
cagttcaggcagccctgtcatttgt

SEQ ID NO: 43633 - DNA, 25 bp, Homo sapien
cagttcaggtagccctgtcatttgt

SEQ ID NO: 43634 - DNA, 25 bp, Homo sapien
cagttcagttgcttcaaacatagaa

SEQ ID NO: 43635 - DNA, 25 bp, Homo sapien
cagttcatcgtgtttcaaatattcc

SEQ ID NO: 43636 - DNA, 25 bp, Homo sapien
cagttcattgtgtttcaaatattcc

SEQ ID NO: 43637 - DNA, 25 bp, Homo sapien
cagttcatttttttccctcaaagct

SEQ ID NO: 43638 - DNA, 25 bp, Homo sapien
cagttcattttttttcctcaaagct

SEQ ID NO: 43639 - DNA, 25 bp, Homo sapien
cagttccaaaaaggttagaagagat

SEQ ID NO: 43640 - DNA, 25 bp, Homo sapien
cagttccaaaaaggtttgaagagat

SEQ ID NO: 43641 - DNA, 25 bp, Homo sapien
cagttccaaaccaaagcaaggatta

SEQ ID NO: 43642 - DNA, 25 bp, Homo sapien
cagttccaaaccaaggcaaggatta

SEQ ID NO: 43643 - DNA, 25 bp, Homo sapien
cagttccaagttagaggtccacatt

SEQ ID NO: 43644 - DNA, 25 bp, Homo sapien
cagttccaagttggaggtccacatt

SEQ ID NO: 43645 - DNA, 25 bp, Homo sapien
cagttccaccaatagcgtgtgaatg

SEQ ID NO: 43646 - DNA, 25 bp, Homo sapien
cagttccaccaatagcttgtgaatg

SEQ ID NO: 43647 - DNA, 25 bp, Homo sapien
cagttccagcagccctactagtcag

SEQ ID NO: 43648 - DNA, 25 bp, Homo sapien
cagttccagcagccctgctagtcag

SEQ ID NO: 43649 - DNA, 25 bp, Homo sapien
cagttcccaaataggcgttctccct

SEQ ID NO: 43650 - DNA, 25 bp, Homo sapien
cagttcccaaataggctttctccct

SEQ ID NO: 43651 - DNA, 25 bp, Homo sapien
cagttcctccacgcgtaaatacaaa

SEQ ID NO: 43652 - DNA, 25 bp, Homo sapien
cagttcctccatgcgtaaatacaaa

SEQ ID NO: 43653 - DNA, 25 bp, Homo sapien
cagttccttcttggaaatctttcag

SEQ ID NO: 43654 - DNA, 25 bp, Homo sapien
cagttcctttttggaaatctttcag

SEQ ID NO: 43655 - DNA, 25 bp, Homo sapien
cagttctaacggcttccatttgcct

SEQ ID NO: 43656 - DNA, 25 bp, Homo sapien
cagttctaatggcttccatttgcct

SEQ ID NO: 43657 - DNA, 25 bp, Homo sapien
cagttctaggcagactcagaactac

SEQ ID NO: 43658 - DNA, 25 bp, Homo sapien
cagttctaggcagagtcagaactac

SEQ ID NO: 43659 - DNA, 25 bp, Homo sapien
cagttctattacaacaatgtgtagc

SEQ ID NO: 43660 - DNA, 25 bp, Homo sapien
cagttctattataacaatgtgtagc

SEQ ID NO: 43661 - DNA, 25 bp, Homo sapien
cagttctccatacgtagcttcaaga

SEQ ID NO: 43662 - DNA, 25 bp, Homo sapien
cagttctccatatgtagcttcaaga

SEQ ID NO: 43663 - DNA, 25 bp, Homo sapien
cagttctcccaacccaggaaaaagg

SEQ ID NO: 43664 - DNA, 25 bp, Homo sapien
cagttctcccaacctaggaaaaagg

SEQ ID NO: 43665 - DNA, 25 bp, Homo sapien
cagttctgcgtaggcggccaggttt

SEQ ID NO: 43666 - DNA, 25 bp, Homo sapien
cagttctgtgatctgcaaaatttct

SEQ ID NO: 43667 - DNA, 25 bp, Homo sapien
cagttctgtgatttgcaaaatttct

SEQ ID NO: 43668 - DNA, 25 bp, Homo sapien
cagttctgtgtaggcggccaggttt

SEQ ID NO: 43669 - DNA, 25 bp, Homo sapien
cagttctttgtagtctcataacacc

SEQ ID NO: 43670 - DNA, 25 bp, Homo sapien
cagttctttgtagtttcataacacc

SEQ ID NO: 43671 - DNA, 25 bp, Homo sapien
cagttgaaccttattaacttatttt

SEQ ID NO: 43672 - DNA, 25 bp, Homo sapien
cagttgaacctttttaacttatttt

SEQ ID NO: 43673 - DNA, 25 bp, Homo sapien
cagttgatagtagtacatagtctga

SEQ ID NO: 43674 - DNA, 25 bp, Homo sapien
cagttgatggtagtacatagtctga

SEQ ID NO: 43675 - DNA, 25 bp, Homo sapien
cagttgcctaaaccacttatctggg

SEQ ID NO: 43676 - DNA, 25 bp, Homo sapien
cagttgcctaaatcacttatctggg

SEQ ID NO: 43677 - DNA, 25 bp, Homo sapien
cagttgcctccataagttaagattt

SEQ ID NO: 43678 - DNA, 25 bp, Homo sapien
cagttgcctccgtaagttaagattt

SEQ ID NO: 43679 - DNA, 25 bp, Homo sapien
cagttgcgtttctgtgatttgcagc

SEQ ID NO: 43680 - DNA, 25 bp, Homo sapien
cagttgcgtttttgtgatttgcagc

SEQ ID NO: 43681 - DNA, 25 bp, Homo sapien
cagttgctgtgaactgccatctctt

SEQ ID NO: 43682 - DNA, 25 bp, Homo sapien
cagttgctgtgagctgccatctctt

SEQ ID NO: 43683 - DNA, 25 bp, Homo sapien
cagttggagaatacaaggtggatgg

SEQ ID NO: 43684 - DNA, 25 bp, Homo sapien
cagttggagaatgcaaggtggatgg

SEQ ID NO: 43685 - DNA, 25 bp, Homo sapien
cagttggagacattaacagcaaaaa

SEQ ID NO: 43686 - DNA, 25 bp, Homo sapien
cagttggaggcattaacagcaaaaa

SEQ ID NO: 43687 - DNA, 25 bp, Homo sapien
cagttggataccaatacagcaggat

SEQ ID NO: 43688 - DNA, 25 bp, Homo sapien
cagttggatgccaatacagcaggat

SEQ ID NO: 43689 - DNA, 25 bp, Homo sapien
cagttggattttgcttccattaatg

SEQ ID NO: 43690 - DNA, 25 bp, Homo sapien
cagttggattttgtttccattaatg

SEQ ID NO: 43691 - DNA, 25 bp, Homo sapien
cagttggcacagtggaaacaaaaga

SEQ ID NO: 43692 - DNA, 25 bp, Homo sapien
cagttggctcagtggaaacaaaaga

SEQ ID NO: 43693 - DNA, 25 bp, Homo sapien
cagttggtattcaccggtgtgaccc

SEQ ID NO: 43694 - DNA, 25 bp, Homo sapien
cagttggtattcactggtgtgaccc

SEQ ID NO: 43695 - DNA, 25 bp, Homo sapien
cagttggtcaacatgcagatgacta

SEQ ID NO: 43696 - DNA, 25 bp, Homo sapien
cagttggtcaacgtgcagatgacta

SEQ ID NO: 43697 - DNA, 25 bp, Homo sapien
cagttggtccttaaaagtgggcttt

SEQ ID NO: 43698 - DNA, 25 bp, Homo sapien
cagttggtccttagaagtgggcttt

SEQ ID NO: 43699 - DNA, 25 bp, Homo sapien
cagttgtaaggaatatacattggac

SEQ ID NO: 43700 - DNA, 25 bp, Homo sapien
cagttgtaaggagtatacattggac

SEQ ID NO: 43701 - DNA, 25 bp, Homo sapien
cagttgtacatgattttgatcatag

SEQ ID NO: 43702 - DNA, 25 bp, Homo sapien
cagttgtacgtgattttgatcatag

SEQ ID NO: 43703 - DNA, 25 bp, Homo sapien
cagttgtgcattaaatagttacttg

SEQ ID NO: 43704 - DNA, 25 bp, Homo sapien
cagttgtgcgttaaatagttacttg

SEQ ID NO: 43705 - DNA, 25 bp, Homo sapien
cagttgttacatatttgtgtatagc

SEQ ID NO: 43706 - DNA, 25 bp, Homo sapien
cagttgttatatatttgtgtatagc

SEQ ID NO: 43707 - DNA, 25 bp, Homo sapien
cagttgttttctcacgactcattgt

SEQ ID NO: 43708 - DNA, 25 bp, Homo sapien
cagttgttttctcatgactcattgt

SEQ ID NO: 43709 - DNA, 25 bp, Homo sapien
cagtttaacgtagccccagaattta

SEQ ID NO: 43710 - DNA, 25 bp, Homo sapien
cagtttaatagctgagaaataagta

SEQ ID NO: 43711 - DNA, 25 bp, Homo sapien
cagtttaatggctgagaaataagta

SEQ ID NO: 43712 - DNA, 25 bp, Homo sapien
cagtttaatgtagccccagaattta

SEQ ID NO: 43713 - DNA, 25 bp, Homo sapien
cagtttagacagagtctgcttttct

SEQ ID NO: 43714 - DNA, 25 bp, Homo sapien
cagtttagatagagtctgcttttct

SEQ ID NO: 43715 - DNA, 25 bp, Homo sapien
cagtttagccagtggaataatattt

SEQ ID NO: 43716 - DNA, 25 bp, Homo sapien
cagtttagcctagcctaccttaaat

SEQ ID NO: 43717 - DNA, 25 bp, Homo sapien
cagtttagctagtggaataatattt

SEQ ID NO: 43718 - DNA, 25 bp, Homo sapien
cagtttagctgaggatcattctgct

SEQ ID NO: 43719 - DNA, 25 bp, Homo sapien
cagtttagctgaggctcattctgct

SEQ ID NO: 43720 - DNA, 25 bp, Homo sapien
cagtttagtcagagtcaagagcaag

SEQ ID NO: 43721 - DNA, 25 bp, Homo sapien
cagtttagtctagcctaccttaaat

SEQ ID NO: 43722 - DNA, 25 bp, Homo sapien
cagtttagttagagtcaagagcaag

SEQ ID NO: 43723 - DNA, 25 bp, Homo sapien
cagtttatatacaggcttatggttt

SEQ ID NO: 43724 - DNA, 25 bp, Homo sapien
cagtttatatataggcttatggttt

SEQ ID NO: 43725 - DNA, 25 bp, Homo sapien
cagtttatatggcaaaagattataa

SEQ ID NO: 43726 - DNA, 25 bp, Homo sapien
cagtttatatggcaaaggattataa

SEQ ID NO: 43727 - DNA, 25 bp, Homo sapien
cagtttatccaagtccaagaagtag

SEQ ID NO: 43728 - DNA, 25 bp, Homo sapien
cagtttatccaggtccaagaagtag

SEQ ID NO: 43729 - DNA, 25 bp, Homo sapien
cagtttattcacatgtaatctcgta

SEQ ID NO: 43730 - DNA, 25 bp, Homo sapien
cagtttattcacgtgtaatctcgta

SEQ ID NO: 43731 - DNA, 25 bp, Homo sapien
cagtttattttccttctattgaatt

SEQ ID NO: 43732 - DNA, 25 bp, Homo sapien
cagtttattttctttctattgaatt

SEQ ID NO: 43733 - DNA, 25 bp, Homo sapien
cagtttcaggcatagaataagaggc

SEQ ID NO: 43734 - DNA, 25 bp, Homo sapien
cagtttcaggcatagactaagaggc

SEQ ID NO: 43735 - DNA, 25 bp, Homo sapien
cagtttcagttccgactctaacttg

SEQ ID NO: 43736 - DNA, 25 bp, Homo sapien
cagtttcagttccgcctctaacttg

SEQ ID NO: 43737 - DNA, 25 bp, Homo sapien
cagtttccagggcttagaatgtgga

SEQ ID NO: 43738 - DNA, 25 bp, Homo sapien
cagtttccagggtttagaatgtgga

SEQ ID NO: 43739 - DNA, 25 bp, Homo sapien
cagtttcctcacacggcaccatggc

SEQ ID NO: 43740 - DNA, 25 bp, Homo sapien
cagtttcctcacagggcaccatggc

SEQ ID NO: 43741 - DNA, 25 bp, Homo sapien
cagtttctacatagcgtttgaaaac

SEQ ID NO: 43742 - DNA, 25 bp, Homo sapien
cagtttctacatagtgtttgaaaac

SEQ ID NO: 43743 - DNA, 25 bp, Homo sapien
cagtttcttcatgcatatccacatc

SEQ ID NO: 43744 - DNA, 25 bp, Homo sapien
cagtttcttcatgcatgtccacatc

SEQ ID NO: 43745 - DNA, 25 bp, Homo sapien
cagtttcttccaacaagttacttct

SEQ ID NO: 43746 - DNA, 25 bp, Homo sapien
cagtttcttccaaccagttacttct

SEQ ID NO: 43747 - DNA, 25 bp, Homo sapien
cagtttcttctctgtgcatgtgata

SEQ ID NO: 43748 - DNA, 25 bp, Homo sapien
cagtttcttctttgtgcatgtgata

SEQ ID NO: 43749 - DNA, 25 bp, Homo sapien
cagtttgaacagttggtcacctttg

SEQ ID NO: 43750 - DNA, 25 bp, Homo sapien
cagtttgaagagttggtcacctttg

SEQ ID NO: 43751 - DNA, 25 bp, Homo sapien
cagtttgcaaaaccttcaatcatct

SEQ ID NO: 43752 - DNA, 25 bp, Homo sapien
cagtttgcaaaagcttcaatcatct

SEQ ID NO: 43753 - DNA, 25 bp, Homo sapien
cagtttgcccaccactttgccagcg

SEQ ID NO: 43754 - DNA, 25 bp, Homo sapien
cagtttgcccagcactttgccagcg

SEQ ID NO: 43755 - DNA, 25 bp, Homo sapien
cagtttgcccatgatgtggtggtgg

SEQ ID NO: 43756 - DNA, 25 bp, Homo sapien
cagtttgcccatggtgtggtggtgg

SEQ ID NO: 43757 - DNA, 25 bp, Homo sapien
cagtttggattaaagaatcgcaaac

SEQ ID NO: 43758 - DNA, 25 bp, Homo sapien
cagtttggattagagaatcgcaaac

SEQ ID NO: 43759 - DNA, 25 bp, Homo sapien
cagtttgtctcagccaagaactaga

SEQ ID NO: 43760 - DNA, 25 bp, Homo sapien
cagtttgtgggatagttagttgtgt

SEQ ID NO: 43761 - DNA, 25 bp, Homo sapien
cagtttgtggggtagttagttgtgt

SEQ ID NO: 43762 - DNA, 25 bp, Homo sapien
cagtttgtttcagccaagaactaga

SEQ ID NO: 43763 - DNA, 25 bp, Homo sapien
cagttttaagatgcagaattatacc

SEQ ID NO: 43764 - DNA, 25 bp, Homo sapien
cagttttagaaccctcaagaaataa

SEQ ID NO: 43765 - DNA, 25 bp, Homo sapien
cagttttagaagcctcaagaaataa

SEQ ID NO: 43766 - DNA, 25 bp, Homo sapien
cagttttaggatgcagaattatacc

SEQ ID NO: 43767 - DNA, 25 bp, Homo sapien
cagttttatagccgtattacttcaa

SEQ ID NO: 43768 - DNA, 25 bp, Homo sapien
cagttttatagctgtattacttcaa

SEQ ID NO: 43769 - DNA, 25 bp, Homo sapien
cagttttatccacgctttactgcac

SEQ ID NO: 43770 - DNA, 25 bp, Homo sapien
cagttttatccatgctttactgcac

SEQ ID NO: 43771 - DNA, 25 bp, Homo sapien
cagttttatggctgcagtatttaaa

SEQ ID NO: 43772 - DNA, 25 bp, Homo sapien
cagttttatggttgcagtatttaaa

SEQ ID NO: 43773 - DNA, 25 bp, Homo sapien
cagttttcttgcatacattctctct

SEQ ID NO: 43774 - DNA, 25 bp, Homo sapien
cagttttcttgcatacgttctctct

SEQ ID NO: 43775 - DNA, 25 bp, Homo sapien
cagttttgtgttgaatgtgttcaag

SEQ ID NO: 43776 - DNA, 25 bp, Homo sapien
cagttttgtgttgagtgtgttcaag

SEQ ID NO: 43777 - DNA, 25 bp, Homo sapien
cagtttttaaaacctgatggacctt

SEQ ID NO: 43778 - DNA, 25 bp, Homo sapien
cagtttttaaaacttgatggacctt

SEQ ID NO: 43779 - DNA, 25 bp, Homo sapien
cagtttttaatctgtgaacgtgtaa

SEQ ID NO: 43780 - DNA, 25 bp, Homo sapien
cagtttttaatttgtgaacgtgtaa

SEQ ID NO: 43781 - DNA, 25 bp, Homo sapien
cagtttttacgtcacttaaatgtga

SEQ ID NO: 43782 - DNA, 25 bp, Homo sapien
cagtttttagtgcgacctggcacta

SEQ ID NO: 43783 - DNA, 25 bp, Homo sapien
cagtttttagtgtgacctggcacta

SEQ ID NO: 43784 - DNA, 25 bp, Homo sapien
cagtttttatctatctgaagttgtg

SEQ ID NO: 43785 - DNA, 25 bp, Homo sapien
cagtttttatgtcacttaaatgtga

SEQ ID NO: 43786 - DNA, 25 bp, Homo sapien
cagtttttcacagcaccttgatgaa

SEQ ID NO: 43787 - DNA, 25 bp, Homo sapien
cagtttttcacggcaccttgatgaa

SEQ ID NO: 43788 - DNA, 25 bp, Homo sapien
cagtttttctatcaccattgcaaac

SEQ ID NO: 43789 - DNA, 25 bp, Homo sapien
cagtttttctatcaccgttgcaaac

SEQ ID NO: 43790 - DNA, 25 bp, Homo sapien
cagtttttcttacaccatctcagtc

SEQ ID NO: 43791 - DNA, 25 bp, Homo sapien
cagtttttcttataccatctcagtc

SEQ ID NO: 43792 - DNA, 25 bp, Homo sapien
cagtttttgtctatctgaagttgtg

SEQ ID NO: 43793 - DNA, 25 bp, Homo sapien
cagtttttgttactattgtttatta

SEQ ID NO: 43794 - DNA, 25 bp, Homo sapien
cagtttttgttcctattgtttatta

SEQ ID NO: 43795 - DNA, 25 bp, Homo sapien
cataaaaaaaattcaacaccactga

SEQ ID NO: 43796 - DNA, 25 bp, Homo sapien
cataaaaaacattcaacaccactga

SEQ ID NO: 43797 - DNA, 25 bp, Homo sapien
cataaaaacagagaaacaacatgcc

SEQ ID NO: 43798 - DNA, 25 bp, Homo sapien
cataaaaacagggaaacaacatgcc

SEQ ID NO: 43799 - DNA, 25 bp, Homo sapien
cataaaaacatctatacgaacaaca

SEQ ID NO: 43800 - DNA, 25 bp, Homo sapien
cataaaaacatctatatgaacaaca

SEQ ID NO: 43801 - DNA, 25 bp, Homo sapien
cataaaaactagacgaaactttctt

SEQ ID NO: 43802 - DNA, 25 bp, Homo sapien
cataaaaactagacgagactttctt

SEQ ID NO: 43803 - DNA, 25 bp, Homo sapien
cataaaacaatctgatttccttacc

SEQ ID NO: 43804 - DNA, 25 bp, Homo sapien
cataaaacaatctgctttccttacc

SEQ ID NO: 43805 - DNA, 25 bp, Homo sapien
cataaaacactccaaatacccagaa

SEQ ID NO: 43806 - DNA, 25 bp, Homo sapien
cataaaacactccgaatacccagaa

SEQ ID NO: 43807 - DNA, 25 bp, Homo sapien
cataaaacctagagaacgtctttgc

SEQ ID NO: 43808 - DNA, 25 bp, Homo sapien
cataaaacctagagaatgtctttgc

SEQ ID NO: 43809 - DNA, 25 bp, Homo sapien
cataaaagaataatttaaaacacct

SEQ ID NO: 43810 - DNA, 25 bp, Homo sapien
cataaaagaatattttaaaacacct

SEQ ID NO: 43811 - DNA, 25 bp, Homo sapien
cataaaagcacacgagaccattaaa

SEQ ID NO: 43812 - DNA, 25 bp, Homo sapien
cataaaagtacacgagaccattaaa

SEQ ID NO: 43813 - DNA, 25 bp, Homo sapien
cataaaataggataagtgtctcgat

SEQ ID NO: 43814 - DNA, 25 bp, Homo sapien
cataaaataggttaagtgtctcgat

SEQ ID NO: 43815 - DNA, 25 bp, Homo sapien
cataaaatctccatagggaaataga

SEQ ID NO: 43816 - DNA, 25 bp, Homo sapien
cataaaatctccgtagggaaataga

SEQ ID NO: 43817 - DNA, 25 bp, Homo sapien
cataaaatggaacattacataccct

SEQ ID NO: 43818 - DNA, 25 bp, Homo sapien
cataaaatggaatattacataccct

SEQ ID NO: 43819 - DNA, 25 bp, Homo sapien
cataaacaaaggaagctaggatgtt

SEQ ID NO: 43820 - DNA, 25 bp, Homo sapien
cataaacaacctcacagaataccaa

SEQ ID NO: 43821 - DNA, 25 bp, Homo sapien
cataaacaagggaagctaggatgtt

SEQ ID NO: 43822 - DNA, 25 bp, Homo sapien
cataaacaatctcacagaataccaa

SEQ ID NO: 43823 - DNA, 25 bp, Homo sapien
cataaaccaacaatcctgcttcttt

SEQ ID NO: 43824 - DNA, 25 bp, Homo sapien
cataaaccaacaattctgcttcttt

SEQ ID NO: 43825 - DNA, 25 bp, Homo sapien
cataaacctatgctcaattccaagc

SEQ ID NO: 43826 - DNA, 25 bp, Homo sapien
cataaacctatgctcagttccaagc

SEQ ID NO: 43827 - DNA, 25 bp, Homo sapien
cataaacctgtgtacacaaaaagtt

SEQ ID NO: 43828 - DNA, 25 bp, Homo sapien
cataaacctgtgtacagaaaaagtt

SEQ ID NO: 43829 - DNA, 25 bp, Homo sapien
cataaactattacacatttgccaag

SEQ ID NO: 43830 - DNA, 25 bp, Homo sapien
cataaactattatacatttgccaag

SEQ ID NO: 43831 - DNA, 25 bp, Homo sapien
cataaactccactatccttcagacc

SEQ ID NO: 43832 - DNA, 25 bp, Homo sapien
cataaactccactctccttcagacc

SEQ ID NO: 43833 - DNA, 25 bp, Homo sapien
cataaagaaaaagtagcacattgga

SEQ ID NO: 43834 - DNA, 25 bp, Homo sapien
cataaagaacaagtagcacattgga

SEQ ID NO: 43835 - DNA, 25 bp, Homo sapien
cataaagacggtaaagagtctattt

SEQ ID NO: 43836 - DNA, 25 bp, Homo sapien
cataaagatggtaaagagtctattt

SEQ ID NO: 43837 - DNA, 25 bp, Homo sapien
cataaagattttcagccttctggaa

SEQ ID NO: 43838 - DNA, 25 bp, Homo sapien
cataaagattttgagccttctggaa

SEQ ID NO: 43839 - DNA, 25 bp, Homo sapien
cataaagccaaatattactcctaca

SEQ ID NO: 43840 - DNA, 25 bp, Homo sapien
cataaagccaaatattgctcctaca

SEQ ID NO: 43841 - DNA, 25 bp, Homo sapien
cataaaggacaagttaggcatagag

SEQ ID NO: 43842 - DNA, 25 bp, Homo sapien
cataaaggataagttaggcatagag

SEQ ID NO: 43843 - DNA, 25 bp, Homo sapien
cataaaggccttcgatgcgttgagg

SEQ ID NO: 43844 - DNA, 25 bp, Homo sapien
cataaaggccttcgctgcgttgagg

SEQ ID NO: 43845 - DNA, 25 bp, Homo sapien
cataaagtagtttgcactgtgcctg

SEQ ID NO: 43846 - DNA, 25 bp, Homo sapien
cataaagtagtttgcattgtgcctg

SEQ ID NO: 43847 - DNA, 25 bp, Homo sapien
cataaagtgatccgggtgatggagg

SEQ ID NO: 43848 - DNA, 25 bp, Homo sapien
cataaagtgatctgggtgatggagg

SEQ ID NO: 43849 - DNA, 25 bp, Homo sapien
cataaagttactaagaagaggcaaa

SEQ ID NO: 43850 - DNA, 25 bp, Homo sapien
cataaagttactcagaagaggcaaa

SEQ ID NO: 43851 - DNA, 25 bp, Homo sapien
cataaataccttatatcattctcca

SEQ ID NO: 43852 - DNA, 25 bp, Homo sapien
cataaataccttgtatcattctcca

SEQ ID NO: 43853 - DNA, 25 bp, Homo sapien
cataaatcgaaccctgtgttctgtt

SEQ ID NO: 43854 - DNA, 25 bp, Homo sapien
cataaatcgaaccttgtgttctgtt

SEQ ID NO: 43855 - DNA, 25 bp, Homo sapien
cataaatgagaagaaaagagaaaga

SEQ ID NO: 43856 - DNA, 25 bp, Homo sapien
cataaatgagaagaaaggagaaaga

SEQ ID NO: 43857 - DNA, 25 bp, Homo sapien
cataaatgatataatgctgaattac

SEQ ID NO: 43858 - DNA, 25 bp, Homo sapien
cataaatgatataatgttgaattac

SEQ ID NO: 43859 - DNA, 25 bp, Homo sapien
cataaatgcagccagagagaatagc

SEQ ID NO: 43860 - DNA, 25 bp, Homo sapien
cataaatgcagcccgagagaatagc

SEQ ID NO: 43861 - DNA, 25 bp, Homo sapien
cataaatgcctcctaaggatttagc

SEQ ID NO: 43862 - DNA, 25 bp, Homo sapien
cataaatgcctcctaatgatttagc

SEQ ID NO: 43863 - DNA, 25 bp, Homo sapien
cataaattctgacaggccttgtgtt

SEQ ID NO: 43864 - DNA, 25 bp, Homo sapien
cataaattctgacaggtcttgtgtt

SEQ ID NO: 43865 - DNA, 25 bp, Homo sapien
cataaattgctattcctcttcaaaa

SEQ ID NO: 43866 - DNA, 25 bp, Homo sapien
cataaattgttattcctcttcaaaa

SEQ ID NO: 43867 - DNA, 25 bp, Homo sapien
cataacaagacattgcatttgatcc

SEQ ID NO: 43868 - DNA, 25 bp, Homo sapien
cataacaagccattgcatttgatcc

SEQ ID NO: 43869 - DNA, 25 bp, Homo sapien
cataacaccttgacaccaggatgtg

SEQ ID NO: 43870 - DNA, 25 bp, Homo sapien
cataacaccttgtcaccaggatgtg

SEQ ID NO: 43871 - DNA, 25 bp, Homo sapien
cataacatcttaatggttgggctgg

SEQ ID NO: 43872 - DNA, 25 bp, Homo sapien
cataacattttaatggttgggctgg

SEQ ID NO: 43873 - DNA, 25 bp, Homo sapien
cataaccacccaaacttggaagcaa

SEQ ID NO: 43874 - DNA, 25 bp, Homo sapien
cataaccagtttataaaaggaggat

SEQ ID NO: 43875 - DNA, 25 bp, Homo sapien
cataaccagtttctaaaaggaggat

SEQ ID NO: 43876 - DNA, 25 bp, Homo sapien
cataaccatccaaacttggaagcaa

SEQ ID NO: 43877 - DNA, 25 bp, Homo sapien
cataacccgcttgaatctgcactac

SEQ ID NO: 43878 - DNA, 25 bp, Homo sapien
cataacccgcttgtatctgcactac

SEQ ID NO: 43879 - DNA, 25 bp, Homo sapien
cataactaaattcagagaagagctg

SEQ ID NO: 43880 - DNA, 25 bp, Homo sapien
cataactaaatttagagaagagctg

SEQ ID NO: 43881 - DNA, 25 bp, Homo sapien
cataactgacagaaatgcagaggca

SEQ ID NO: 43882 - DNA, 25 bp, Homo sapien
cataactgacctttattgcaaattg

SEQ ID NO: 43883 - DNA, 25 bp, Homo sapien
cataactggcactatttctgagaaa

SEQ ID NO: 43884 - DNA, 25 bp, Homo sapien
cataactggcactgtttctgagaaa

SEQ ID NO: 43885 - DNA, 25 bp, Homo sapien
cataactggcagaaatgcagaggca

SEQ ID NO: 43886 - DNA, 25 bp, Homo sapien
cataactggcctttattgcaaattg

SEQ ID NO: 43887 - DNA, 25 bp, Homo sapien
cataactggtcaacatatccatcac

SEQ ID NO: 43888 - DNA, 25 bp, Homo sapien
cataactggtcaacgtatccatcac

SEQ ID NO: 43889 - DNA, 25 bp, Homo sapien
cataacttagtcatatttctcttgc

SEQ ID NO: 43890 - DNA, 25 bp, Homo sapien
cataacttagtcgtatttctcttgc

SEQ ID NO: 43891 - DNA, 25 bp, Homo sapien
cataagaaatgatcgactagagtac

SEQ ID NO: 43892 - DNA, 25 bp, Homo sapien
cataagaaatgattgactagagtac

SEQ ID NO: 43893 - DNA, 25 bp, Homo sapien
cataagaaatgcatactgattgcct

SEQ ID NO: 43894 - DNA, 25 bp, Homo sapien
cataagaaatgcttactgattgcct

SEQ ID NO: 43895 - DNA, 25 bp, Homo sapien
cataagacattgggagaaagatcca

SEQ ID NO: 43896 - DNA, 25 bp, Homo sapien
cataagacctagatagcccatggta

SEQ ID NO: 43897 - DNA, 25 bp, Homo sapien
cataagacctagctagcccatggta

SEQ ID NO: 43898 - DNA, 25 bp, Homo sapien
cataagaccttgggagaaagatcca

SEQ ID NO: 43899 - DNA, 25 bp, Homo sapien
cataagagccaataatgtagttcca

SEQ ID NO: 43900 - DNA, 25 bp, Homo sapien
cataagagcgaataatgtagttcca

SEQ ID NO: 43901 - DNA, 25 bp, Homo sapien
cataagagtctcagtctggatattg

SEQ ID NO: 43902 - DNA, 25 bp, Homo sapien
cataagagtttcagtctggatattg

SEQ ID NO: 43903 - DNA, 25 bp, Homo sapien
cataagatagctcatttacaaagac

SEQ ID NO: 43904 - DNA, 25 bp, Homo sapien
cataagatatgaacagcaaatgttt

SEQ ID NO: 43905 - DNA, 25 bp, Homo sapien
cataagatatgaatagcaaatgttt

SEQ ID NO: 43906 - DNA, 25 bp, Homo sapien
cataagatcaataccaatgtatctc

SEQ ID NO: 43907 - DNA, 25 bp, Homo sapien
cataagatcaatatcaatgtatctc

SEQ ID NO: 43908 - DNA, 25 bp, Homo sapien
cataagatggctcatttacaaagac

SEQ ID NO: 43909 - DNA, 25 bp, Homo sapien
cataagcaaatgtcaaataattgaa

SEQ ID NO: 43910 - DNA, 25 bp, Homo sapien
cataagcaagccaagacagttatct

SEQ ID NO: 43911 - DNA, 25 bp, Homo sapien
cataagcaagccaagagagttatct

SEQ ID NO: 43912 - DNA, 25 bp, Homo sapien
cataagcacagccagttgctctaaa

SEQ ID NO: 43913 - DNA, 25 bp, Homo sapien
cataagcacagtcagttgctctaaa

SEQ ID NO: 43914 - DNA, 25 bp, Homo sapien
cataagcacatgtcaaataattgaa

SEQ ID NO: 43915 - DNA, 25 bp, Homo sapien
cataagccactggctcatctccatc

SEQ ID NO: 43916 - DNA, 25 bp, Homo sapien
cataagcccaggtttgaactggtta

SEQ ID NO: 43917 - DNA, 25 bp, Homo sapien
cataagccgctggctcatctccatc

SEQ ID NO: 43918 - DNA, 25 bp, Homo sapien
cataagcctaggtttgaactggtta

SEQ ID NO: 43919 - DNA, 25 bp, Homo sapien
cataagcctgcaaaaataagattta

SEQ ID NO: 43920 - DNA, 25 bp, Homo sapien
cataagcctgcgaaaataagattta

SEQ ID NO: 43921 - DNA, 25 bp, Homo sapien
cataagcggcctttggagtattaat

SEQ ID NO: 43922 - DNA, 25 bp, Homo sapien
cataagcgggctttggagtattaat

SEQ ID NO: 43923 - DNA, 25 bp, Homo sapien
cataaggacagaaagtatttgttgt

SEQ ID NO: 43924 - DNA, 25 bp, Homo sapien
cataaggacagaaggtatttgttgt

SEQ ID NO: 43925 - DNA, 25 bp, Homo sapien
cataaggacctgtcactatcatttc

SEQ ID NO: 43926 - DNA, 25 bp, Homo sapien
cataaggacctttcactatcatttc

SEQ ID NO: 43927 - DNA, 25 bp, Homo sapien
cataaggatagctgtcagtggtcct

SEQ ID NO: 43928 - DNA, 25 bp, Homo sapien
cataaggatagttgtcagtggtcct

SEQ ID NO: 43929 - DNA, 25 bp, Homo sapien
cataaggttactaagaggattgagt

SEQ ID NO: 43930 - DNA, 25 bp, Homo sapien
cataaggttactatgaggattgagt

SEQ ID NO: 43931 - DNA, 25 bp, Homo sapien
cataagtacaagtcaatttttggcc

SEQ ID NO: 43932 - DNA, 25 bp, Homo sapien
cataagtataagtcaatttttggcc

SEQ ID NO: 43933 - DNA, 25 bp, Homo sapien
cataagtcatttaggagcaaatcta

SEQ ID NO: 43934 - DNA, 25 bp, Homo sapien
cataagtcgtttaggagcaaatcta

SEQ ID NO: 43935 - DNA, 25 bp, Homo sapien
cataagtgaattagaagttttagag

SEQ ID NO: 43936 - DNA, 25 bp, Homo sapien
cataagtgaattagcagttttagag

SEQ ID NO: 43937 - DNA, 25 bp, Homo sapien
cataagtgagagcccggagaagtat

SEQ ID NO: 43938 - DNA, 25 bp, Homo sapien
cataagtgagagcctggagaagtat

SEQ ID NO: 43939 - DNA, 25 bp, Homo sapien
cataagtgcaatattctcctttatc

SEQ ID NO: 43940 - DNA, 25 bp, Homo sapien
cataagtgcgatattctcctttatc

SEQ ID NO: 43941 - DNA, 25 bp, Homo sapien
cataagtgtccaggagctggctgag

SEQ ID NO: 43942 - DNA, 25 bp, Homo sapien
cataagtgtccaggcgctggctgag

SEQ ID NO: 43943 - DNA, 25 bp, Homo sapien
cataataacccacgaagacaaaatg

SEQ ID NO: 43944 - DNA, 25 bp, Homo sapien
cataataagccacgaagacaaaatg

SEQ ID NO: 43945 - DNA, 25 bp, Homo sapien
cataataagtcacagccatgagcac

SEQ ID NO: 43946 - DNA, 25 bp, Homo sapien
cataataagtcatagccatgagcac

SEQ ID NO: 43947 - DNA, 25 bp, Homo sapien
cataatacaaatctagcttccgaaa

SEQ ID NO: 43948 - DNA, 25 bp, Homo sapien
cataatacaaatctagtttccgaaa

SEQ ID NO: 43949 - DNA, 25 bp, Homo sapien
cataatactcttgatcatatcacag

SEQ ID NO: 43950 - DNA, 25 bp, Homo sapien
cataatactcttgatcgtatcacag

SEQ ID NO: 43951 - DNA, 25 bp, Homo sapien
cataatagacggagtgtgtggttgc

SEQ ID NO: 43952 - DNA, 25 bp, Homo sapien
cataatagatggagtgtgtggttgc

SEQ ID NO: 43953 - DNA, 25 bp, Homo sapien
cataataggcaatccttttgtgtgt

SEQ ID NO: 43954 - DNA, 25 bp, Homo sapien
cataataggcaattcttttgtgtgt

SEQ ID NO: 43955 - DNA, 25 bp, Homo sapien
cataataggctcattggtcaatatg

SEQ ID NO: 43956 - DNA, 25 bp, Homo sapien
cataatagtctcattggtcaatatg

SEQ ID NO: 43957 - DNA, 25 bp, Homo sapien
cataatatactcaacaagtggcaga

SEQ ID NO: 43958 - DNA, 25 bp, Homo sapien
cataatatattcaacaagtggcaga

SEQ ID NO: 43959 - DNA, 25 bp, Homo sapien
cataatatcattttttgcagtgttt

SEQ ID NO: 43960 - DNA, 25 bp, Homo sapien
cataatattattttttgcagtgttt

SEQ ID NO: 43961 - DNA, 25 bp, Homo sapien
cataatcaatttagatgcagacatg

SEQ ID NO: 43962 - DNA, 25 bp, Homo sapien
cataatcagtttagatgcagacatg

SEQ ID NO: 43963 - DNA, 25 bp, Homo sapien
cataatccaatcacaaaagaaagag

SEQ ID NO: 43964 - DNA, 25 bp, Homo sapien
cataatccagtcacaaaagaaagag

SEQ ID NO: 43965 - DNA, 25 bp, Homo sapien
cataatctcatttacaatctctgag

SEQ ID NO: 43966 - DNA, 25 bp, Homo sapien
cataatctcatttgcaatctctgag

SEQ ID NO: 43967 - DNA, 25 bp, Homo sapien
cataatgagacaagagagtaggatc

SEQ ID NO: 43968 - DNA, 25 bp, Homo sapien
cataatgagacaggagagtaggatc

SEQ ID NO: 43969 - DNA, 25 bp, Homo sapien
cataatgataactcccatttttgga

SEQ ID NO: 43970 - DNA, 25 bp, Homo sapien
cataatgataactcccttttttgga

SEQ ID NO: 43971 - DNA, 25 bp, Homo sapien
cataatgatgacagaattaagttgt

SEQ ID NO: 43972 - DNA, 25 bp, Homo sapien
cataatgatgatagaattaagttgt

SEQ ID NO: 43973 - DNA, 25 bp, Homo sapien
cataatgcgtgaggcccagacctta

SEQ ID NO: 43974 - DNA, 25 bp, Homo sapien
cataatgcttgaggcccagacctta

SEQ ID NO: 43975 - DNA, 25 bp, Homo sapien
cataatgtgatagacaagaaacagg

SEQ ID NO: 43976 - DNA, 25 bp, Homo sapien
cataatgtgatagccaagaaacagg

SEQ ID NO: 43977 - DNA, 25 bp, Homo sapien
cataatgtgcttcctgaactccctg

SEQ ID NO: 43978 - DNA, 25 bp, Homo sapien
cataatgtgcttcttgaactccctg

SEQ ID NO: 43979 - DNA, 25 bp, Homo sapien
cataattctaattctcacagctaaa

SEQ ID NO: 43980 - DNA, 25 bp, Homo sapien
cataattctaattttcacagctaaa

SEQ ID NO: 43981 - DNA, 25 bp, Homo sapien
cataattctagcaaagagtcctaac

SEQ ID NO: 43982 - DNA, 25 bp, Homo sapien
cataattctaggaaagagtcctaac

SEQ ID NO: 43983 - DNA, 25 bp, Homo sapien
cataatttaccaactcaacattgac

SEQ ID NO: 43984 - DNA, 25 bp, Homo sapien
cataatttatcaactcaacattgac

SEQ ID NO: 43985 - DNA, 25 bp, Homo sapien
catacaaaattacaaatagcaattc

SEQ ID NO: 43986 - DNA, 25 bp, Homo sapien
catacaaaattagaaatagcaattc

SEQ ID NO: 43987 - DNA, 25 bp, Homo sapien
catacaaactagaagatgataaatt

SEQ ID NO: 43988 - DNA, 25 bp, Homo sapien
catacaaactataagatgataaatt

SEQ ID NO: 43989 - DNA, 25 bp, Homo sapien
catacaacacatatgaatacacaac

SEQ ID NO: 43990 - DNA, 25 bp, Homo sapien
catacaacacatatgactacacaac

SEQ ID NO: 43991 - DNA, 25 bp, Homo sapien
catacaacataggacaagagtagag

SEQ ID NO: 43992 - DNA, 25 bp, Homo sapien
catacaacatagggcaagagtagag

SEQ ID NO: 43993 - DNA, 25 bp, Homo sapien
catacaataagctcaagaaacaaag

SEQ ID NO: 43994 - DNA, 25 bp, Homo sapien
catacaatagagaccatcaacaaag

SEQ ID NO: 43995 - DNA, 25 bp, Homo sapien
catacaatagagactatcaacaaag

SEQ ID NO: 43996 - DNA, 25 bp, Homo sapien
catacaatcagaagaggctggaaaa

SEQ ID NO: 43997 - DNA, 25 bp, Homo sapien
catacaatcagaggaggctggaaaa

SEQ ID NO: 43998 - DNA, 25 bp, Homo sapien
catacaatgagctcaagaaacaaag

SEQ ID NO: 43999 - DNA, 25 bp, Homo sapien
catacaatttcaacggcagcttcct

SEQ ID NO: 44000 - DNA, 25 bp, Homo sapien
catacaatttcaagggcagcttcct

SEQ ID NO: 44001 - DNA, 25 bp, Homo sapien
catacaccagaatattatttagcaa

SEQ ID NO: 44002 - DNA, 25 bp, Homo sapien
catacaccagaatgttatttagcaa

SEQ ID NO: 44003 - DNA, 25 bp, Homo sapien
catacacttgctgttgtctctgtgc

SEQ ID NO: 44004 - DNA, 25 bp, Homo sapien
catacacttgcttttgtctctgtgc

SEQ ID NO: 44005 - DNA, 25 bp, Homo sapien
catacactttcattactgagatctc

SEQ ID NO: 44006 - DNA, 25 bp, Homo sapien
catacactttctttactgagatctc

SEQ ID NO: 44007 - DNA, 25 bp, Homo sapien
catacagaaacacaaaatgagggtg

SEQ ID NO: 44008 - DNA, 25 bp, Homo sapien
catacagaaacacaaattgagggtg

SEQ ID NO: 44009 - DNA, 25 bp, Homo sapien
catacagacatagaagaaacaccct

SEQ ID NO: 44010 - DNA, 25 bp, Homo sapien
catacagacatggaagaaacaccct

SEQ ID NO: 44011 - DNA, 25 bp, Homo sapien
catacagactttttgtgtggtcaga

SEQ ID NO: 44012 - DNA, 25 bp, Homo sapien
catacagagaattggaatcagaaga

SEQ ID NO: 44013 - DNA, 25 bp, Homo sapien
catacagagaattggagtcagaaga

SEQ ID NO: 44014 - DNA, 25 bp, Homo sapien
catacagattttttgtgtggtcaga

SEQ ID NO: 44015 - DNA, 25 bp, Homo sapien
catacagcctacattttaactaact

SEQ ID NO: 44016 - DNA, 25 bp, Homo sapien
catacagcctaccttttaactaact

SEQ ID NO: 44017 - DNA, 25 bp, Homo sapien
catacaggcatacacacaggagacc

SEQ ID NO: 44018 - DNA, 25 bp, Homo sapien
catacaggcgtacacacaggagacc

SEQ ID NO: 44019 - DNA, 25 bp, Homo sapien
catacaggttagacaacagtgatgc

SEQ ID NO: 44020 - DNA, 25 bp, Homo sapien
catacaggttagagaacagtgatgc

SEQ ID NO: 44021 - DNA, 25 bp, Homo sapien
catacagtaattatttataggaatc

SEQ ID NO: 44022 - DNA, 25 bp, Homo sapien
catacagtaattatttgtaggaatc

SEQ ID NO: 44023 - DNA, 25 bp, Homo sapien
catacagtctacaaggaacagtaag

SEQ ID NO: 44024 - DNA, 25 bp, Homo sapien
catacagtctacgaggaacagtaag

SEQ ID NO: 44025 - DNA, 25 bp, Homo sapien
catacagtgctataagacagtggaa

SEQ ID NO: 44026 - DNA, 25 bp, Homo sapien
catacagtgctataaggcagtggaa

SEQ ID NO: 44027 - DNA, 25 bp, Homo sapien
catacataaatctttgccgagagac

SEQ ID NO: 44028 - DNA, 25 bp, Homo sapien
catacataagtctttgccgagagac

SEQ ID NO: 44029 - DNA, 25 bp, Homo sapien
catacataggtgcattagtagctac

SEQ ID NO: 44030 - DNA, 25 bp, Homo sapien
catacatatgtgcattagtagctac

SEQ ID NO: 44031 - DNA, 25 bp, Homo sapien
catacatccatcatgctagtctcta

SEQ ID NO: 44032 - DNA, 25 bp, Homo sapien
catacatccgtcatgctagtctcta

SEQ ID NO: 44033 - DNA, 25 bp, Homo sapien
catacatctgaaaccttgaaacaag

SEQ ID NO: 44034 - DNA, 25 bp, Homo sapien
catacatctgaacccttgaaacaag

SEQ ID NO: 44035 - DNA, 25 bp, Homo sapien
catacatcttcatagagataaaagt

SEQ ID NO: 44036 - DNA, 25 bp, Homo sapien
catacatcttcatggagataaaagt

SEQ ID NO: 44037 - DNA, 25 bp, Homo sapien
catacatgaattttgtttatcgtct

SEQ ID NO: 44038 - DNA, 25 bp, Homo sapien
catacatgagttttgtttatcgtct

SEQ ID NO: 44039 - DNA, 25 bp, Homo sapien
catacatgcacatccacaatccatg

SEQ ID NO: 44040 - DNA, 25 bp, Homo sapien
catacatgcacgtccacaatccatg

SEQ ID NO: 44041 - DNA, 25 bp, Homo sapien
catacattatgaaacacaggcttct

SEQ ID NO: 44042 - DNA, 25 bp, Homo sapien
catacattatgaaccacaggcttct

SEQ ID NO: 44043 - DNA, 25 bp, Homo sapien
catacattccactccaaatattaat

SEQ ID NO: 44044 - DNA, 25 bp, Homo sapien
catacattccactgcaaatattaat

SEQ ID NO: 44045 - DNA, 25 bp, Homo sapien
catacattttgtgaaatagtcacct

SEQ ID NO: 44046 - DNA, 25 bp, Homo sapien
catacattttgtgcaatagtcacct

SEQ ID NO: 44047 - DNA, 25 bp, Homo sapien
cataccacactctcttcactattta

SEQ ID NO: 44048 - DNA, 25 bp, Homo sapien
cataccacagtctcttcactattta

SEQ ID NO: 44049 - DNA, 25 bp, Homo sapien
cataccatcagagaaatctgcccct

SEQ ID NO: 44050 - DNA, 25 bp, Homo sapien
cataccatcagaggaatctgcccct

SEQ ID NO: 44051 - DNA, 25 bp, Homo sapien
catacccagccgaggctttctccct

SEQ ID NO: 44052 - DNA, 25 bp, Homo sapien
catacccaggcgaggctttctccct

SEQ ID NO: 44053 - DNA, 25 bp, Homo sapien
cataccctataaagcaaccatgcag

SEQ ID NO: 44054 - DNA, 25 bp, Homo sapien
cataccctataaagtaaccatgcag

SEQ ID NO: 44055 - DNA, 25 bp, Homo sapien
cataccctgtgctctgaacattgct

SEQ ID NO: 44056 - DNA, 25 bp, Homo sapien
cataccctgtgttctgaacattgct

SEQ ID NO: 44057 - DNA, 25 bp, Homo sapien
catacctaacctctcagcattgact

SEQ ID NO: 44058 - DNA, 25 bp, Homo sapien
catacctaacctttcagcattgact

SEQ ID NO: 44059 - DNA, 25 bp, Homo sapien
catacctagagagctcagtaaccat

SEQ ID NO: 44060 - DNA, 25 bp, Homo sapien
catacctagattttttggtttacaa

SEQ ID NO: 44061 - DNA, 25 bp, Homo sapien
catacctagatttttttgtttacaa

SEQ ID NO: 44062 - DNA, 25 bp, Homo sapien
catacctagcgagctcagtaaccat

SEQ ID NO: 44063 - DNA, 25 bp, Homo sapien
catacctattgcacacagtagcttt

SEQ ID NO: 44064 - DNA, 25 bp, Homo sapien
catacctattgcacgcagtagcttt

SEQ ID NO: 44065 - DNA, 25 bp, Homo sapien
catacctcaaaataataaatgtcat

SEQ ID NO: 44066 - DNA, 25 bp, Homo sapien
catacctcaatttatttcacttggt

SEQ ID NO: 44067 - DNA, 25 bp, Homo sapien
catacctcattttatttcacttggt

SEQ ID NO: 44068 - DNA, 25 bp, Homo sapien
catacctcgaaataataaatgtcat

SEQ ID NO: 44069 - DNA, 25 bp, Homo sapien
catacctgttgaacgaaacattttc

SEQ ID NO: 44070 - DNA, 25 bp, Homo sapien
catacctgttgaatgaaacattttc

SEQ ID NO: 44071 - DNA, 25 bp, Homo sapien
catacgcatctcgcctcaagttgtg

SEQ ID NO: 44072 - DNA, 25 bp, Homo sapien
catacgcatcttgcctcaagttgtg

SEQ ID NO: 44073 - DNA, 25 bp, Homo sapien
catacgttgcggcaaggatggaggt

SEQ ID NO: 44074 - DNA, 25 bp, Homo sapien
catacgttgtggcaaggatggaggt

SEQ ID NO: 44075 - DNA, 25 bp, Homo sapien
catactaatgctatgcttctatttt

SEQ ID NO: 44076 - DNA, 25 bp, Homo sapien
catactaatgctgtgcttctatttt

SEQ ID NO: 44077 - DNA, 25 bp, Homo sapien
catactactatatttccctggaatc

SEQ ID NO: 44078 - DNA, 25 bp, Homo sapien
catactactgtatttccctggaatc

SEQ ID NO: 44079 - DNA, 25 bp, Homo sapien
catactcaaatataagtagacataa

SEQ ID NO: 44080 - DNA, 25 bp, Homo sapien
catactcaaatgtaagtagacataa

SEQ ID NO: 44081 - DNA, 25 bp, Homo sapien
catactcttttcgttcagccttcaa

SEQ ID NO: 44082 - DNA, 25 bp, Homo sapien
catactctttttgttcagccttcaa

SEQ ID NO: 44083 - DNA, 25 bp, Homo sapien
catactgcccacaatgcagctgcag

SEQ ID NO: 44084 - DNA, 25 bp, Homo sapien
catactgcccaccatgcagctgcag

SEQ ID NO: 44085 - DNA, 25 bp, Homo sapien
catactggaatgcataagattaatg

SEQ ID NO: 44086 - DNA, 25 bp, Homo sapien
catactggaatggataagattaatg

SEQ ID NO: 44087 - DNA, 25 bp, Homo sapien
catactgttcggatctgccaaagtc

SEQ ID NO: 44088 - DNA, 25 bp, Homo sapien
catactgtttggatctgccaaagtc

SEQ ID NO: 44089 - DNA, 25 bp, Homo sapien
catacttaactggaaaatgaaacac

SEQ ID NO: 44090 - DNA, 25 bp, Homo sapien
catacttaactggaaagtgaaacac

SEQ ID NO: 44091 - DNA, 25 bp, Homo sapien
catacttaatttgcgtttctttaat

SEQ ID NO: 44092 - DNA, 25 bp, Homo sapien
catacttaatttgtgtttctttaat

SEQ ID NO: 44093 - DNA, 25 bp, Homo sapien
catacttatatggccaatagcgttt

SEQ ID NO: 44094 - DNA, 25 bp, Homo sapien
catacttatgcatagtctctttgtg

SEQ ID NO: 44095 - DNA, 25 bp, Homo sapien
catacttatgcatattctctttgtg

SEQ ID NO: 44096 - DNA, 25 bp, Homo sapien
catacttatttggccaatagcgttt

SEQ ID NO: 44097 - DNA, 25 bp, Homo sapien
catacttcaaacaattcctttaaac

SEQ ID NO: 44098 - DNA, 25 bp, Homo sapien
catacttcaaaccattcctttaaac

SEQ ID NO: 44099 - DNA, 25 bp, Homo sapien
catacttcctcctattctcttactc

SEQ ID NO: 44100 - DNA, 25 bp, Homo sapien
catacttcctcttattctcttactc

SEQ ID NO: 44101 - DNA, 25 bp, Homo sapien
catacttgtgcctcgattccagaag

SEQ ID NO: 44102 - DNA, 25 bp, Homo sapien
catacttgtgccttgattccagaag

SEQ ID NO: 44103 - DNA, 25 bp, Homo sapien
catactttagcccaaaaagaaagcc

SEQ ID NO: 44104 - DNA, 25 bp, Homo sapien
catactttagcccataaagaaagcc

SEQ ID NO: 44105 - DNA, 25 bp, Homo sapien
catactttcatagaatagaacagga

SEQ ID NO: 44106 - DNA, 25 bp, Homo sapien
catactttcatagactagaacagga

SEQ ID NO: 44107 - DNA, 25 bp, Homo sapien
catacttttatacatgaaatgggtc

SEQ ID NO: 44108 - DNA, 25 bp, Homo sapien
catacttttatacgtgaaatgggtc

SEQ ID NO: 44109 - DNA, 25 bp, Homo sapien
catagaaaaaatcgacatatttgac

SEQ ID NO: 44110 - DNA, 25 bp, Homo sapien
catagaaaaaatcggcatatttgac

SEQ ID NO: 44111 - DNA, 25 bp, Homo sapien
catagaaaaagataatcaaagtgta

SEQ ID NO: 44112 - DNA, 25 bp, Homo sapien
catagaaaaagtgagtcagtgagac

SEQ ID NO: 44113 - DNA, 25 bp, Homo sapien
catagaaaaagtgagttagtgagac

SEQ ID NO: 44114 - DNA, 25 bp, Homo sapien
catagaaaaggataatcaaagtgta

SEQ ID NO: 44115 - DNA, 25 bp, Homo sapien
catagaaacagaatagatttttgtg

SEQ ID NO: 44116 - DNA, 25 bp, Homo sapien
catagaaagaaaacggcaagctggg

SEQ ID NO: 44117 - DNA, 25 bp, Homo sapien
catagaaagaaaatggcaagctggg

SEQ ID NO: 44118 - DNA, 25 bp, Homo sapien
catagaaagcctcagcaaagaaata

SEQ ID NO: 44119 - DNA, 25 bp, Homo sapien
catagaaagcctcatcaaagaaata

SEQ ID NO: 44120 - DNA, 25 bp, Homo sapien
catagaaatagaatagatttttgtg

SEQ ID NO: 44121 - DNA, 25 bp, Homo sapien
catagaacctataatcaacttttaa

SEQ ID NO: 44122 - DNA, 25 bp, Homo sapien
catagaacctatagtcaacttttaa

SEQ ID NO: 44123 - DNA, 25 bp, Homo sapien
catagaagaatgacgagagaaacgc

SEQ ID NO: 44124 - DNA, 25 bp, Homo sapien
catagaagaatgatgagagaaacgc

SEQ ID NO: 44125 - DNA, 25 bp, Homo sapien
catagaagcatagaacgtttaggaa

SEQ ID NO: 44126 - DNA, 25 bp, Homo sapien
catagaagcgtagaacgtttaggaa

SEQ ID NO: 44127 - DNA, 25 bp, Homo sapien
catagaatagttttctcagaacttg

SEQ ID NO: 44128 - DNA, 25 bp, Homo sapien
catagaatatttttctcagaacttg

SEQ ID NO: 44129 - DNA, 25 bp, Homo sapien
catagaattcacataggattcatga

SEQ ID NO: 44130 - DNA, 25 bp, Homo sapien
catagaattcacgtaggattcatga

SEQ ID NO: 44131 - DNA, 25 bp, Homo sapien
catagacaaagcattaggagacata

SEQ ID NO: 44132 - DNA, 25 bp, Homo sapien
catagacaaggcattaggagacata

SEQ ID NO: 44133 - DNA, 25 bp, Homo sapien
catagacacaattgcagtgttgggt

SEQ ID NO: 44134 - DNA, 25 bp, Homo sapien
catagacacgattgcagtgttgggt

SEQ ID NO: 44135 - DNA, 25 bp, Homo sapien
catagacactgacgttcagttttgc

SEQ ID NO: 44136 - DNA, 25 bp, Homo sapien
catagacactgatgttcagttttgc

SEQ ID NO: 44137 - DNA, 25 bp, Homo sapien
catagaccctagaatcatgctggac

SEQ ID NO: 44138 - DNA, 25 bp, Homo sapien
catagaccctagaatcgtgctggac

SEQ ID NO: 44139 - DNA, 25 bp, Homo sapien
catagactttcatgtaacggaaatg

SEQ ID NO: 44140 - DNA, 25 bp, Homo sapien
catagactttcatttaacggaaatg

SEQ ID NO: 44141 - DNA, 25 bp, Homo sapien
catagagatcctcgtcattgaagga

SEQ ID NO: 44142 - DNA, 25 bp, Homo sapien
catagagatccttgtcattgaagga

SEQ ID NO: 44143 - DNA, 25 bp, Homo sapien
catagagatgacacaattattttag

SEQ ID NO: 44144 - DNA, 25 bp, Homo sapien
catagagatgacagaattattttag

SEQ ID NO: 44145 - DNA, 25 bp, Homo sapien
catagagcatagctaattggcctaa

SEQ ID NO: 44146 - DNA, 25 bp, Homo sapien
catagagcatagcttattggcctaa

SEQ ID NO: 44147 - DNA, 25 bp, Homo sapien
catagaggatgaagacagggtacag

SEQ ID NO: 44148 - DNA, 25 bp, Homo sapien
catagaggatgacgacagggtacag

SEQ ID NO: 44149 - DNA, 25 bp, Homo sapien
catagaggatgttaaaagatcctta

SEQ ID NO: 44150 - DNA, 25 bp, Homo sapien
catagaggatgttaaatgatcctta

SEQ ID NO: 44151 - DNA, 25 bp, Homo sapien
catagagggatataagaggaaattt

SEQ ID NO: 44152 - DNA, 25 bp, Homo sapien
catagagggatataagcggaaattt

SEQ ID NO: 44153 - DNA, 25 bp, Homo sapien
catagaggtggacaatcataaaatt

SEQ ID NO: 44154 - DNA, 25 bp, Homo sapien
catagaggtggagaatcataaaatt

SEQ ID NO: 44155 - DNA, 25 bp, Homo sapien
catagagttcttacagagtacatgt

SEQ ID NO: 44156 - DNA, 25 bp, Homo sapien
catagagttcttacagggtacatgt

SEQ ID NO: 44157 - DNA, 25 bp, Homo sapien
catagatacatgtcaaaacttacca

SEQ ID NO: 44158 - DNA, 25 bp, Homo sapien
catagatagacaatttgccttaaga

SEQ ID NO: 44159 - DNA, 25 bp, Homo sapien
catagatagtcaatttgccttaaga

SEQ ID NO: 44160 - DNA, 25 bp, Homo sapien
catagatatatgtcaaaacttacca

SEQ ID NO: 44161 - DNA, 25 bp, Homo sapien
catagatggatgcctgaatagaccc

SEQ ID NO: 44162 - DNA, 25 bp, Homo sapien
catagatgtatgcctgaatagaccc

SEQ ID NO: 44163 - DNA, 25 bp, Homo sapien
catagatgttacagtcagggaaatt

SEQ ID NO: 44164 - DNA, 25 bp, Homo sapien
catagatgttacattcagggaaatt

SEQ ID NO: 44165 - DNA, 25 bp, Homo sapien
catagattgttgtttcggggaaggg

SEQ ID NO: 44166 - DNA, 25 bp, Homo sapien
catagatttttcataatgtacttaa

SEQ ID NO: 44167 - DNA, 25 bp, Homo sapien
catagatttttcgtaatgtacttaa

SEQ ID NO: 44168 - DNA, 25 bp, Homo sapien
catagatttttgtttcggggaaggg

SEQ ID NO: 44169 - DNA, 25 bp, Homo sapien
catagcaaactctatgaactactgt

SEQ ID NO: 44170 - DNA, 25 bp, Homo sapien
catagcaaactttatgaactactgt

SEQ ID NO: 44171 - DNA, 25 bp, Homo sapien
catagcaagggactcctactgcttg

SEQ ID NO: 44172 - DNA, 25 bp, Homo sapien
catagcaagggattcctactgcttg

SEQ ID NO: 44173 - DNA, 25 bp, Homo sapien
catagcagactctgtcagtgccttg

SEQ ID NO: 44174 - DNA, 25 bp, Homo sapien
catagcagactctgtcggtgccttg

SEQ ID NO: 44175 - DNA, 25 bp, Homo sapien
catagcatcgtgattttgttaaaac

SEQ ID NO: 44176 - DNA, 25 bp, Homo sapien
catagcatggtgattttgttaaaac

SEQ ID NO: 44177 - DNA, 25 bp, Homo sapien
catagccagctacaacttgggcagc

SEQ ID NO: 44178 - DNA, 25 bp, Homo sapien
catagccagctacgacttgggcagc

SEQ ID NO: 44179 - DNA, 25 bp, Homo sapien
catagctagaaattcaagactagag

SEQ ID NO: 44180 - DNA, 25 bp, Homo sapien
catagctagaaattcacgactagag

SEQ ID NO: 44181 - DNA, 25 bp, Homo sapien
catagctagccagctgatgaaaaag

SEQ ID NO: 44182 - DNA, 25 bp, Homo sapien
catagctagccagctggtgaaaaag

SEQ ID NO: 44183 - DNA, 25 bp, Homo sapien
catagctcaagaactccaacatggc

SEQ ID NO: 44184 - DNA, 25 bp, Homo sapien
catagctcgagaactccaacatggc

SEQ ID NO: 44185 - DNA, 25 bp, Homo sapien
catagctgcacacattccacattct

SEQ ID NO: 44186 - DNA, 25 bp, Homo sapien
catagctgcgcacattccacattct

SEQ ID NO: 44187 - DNA, 25 bp, Homo sapien
catagctgctctcaaacatacgcta

SEQ ID NO: 44188 - DNA, 25 bp, Homo sapien
catagctgctctgaaacatacgcta

SEQ ID NO: 44189 - DNA, 25 bp, Homo sapien
catagctggcactgagaatgaagag

SEQ ID NO: 44190 - DNA, 25 bp, Homo sapien
catagctggcattgagaatgaagag

SEQ ID NO: 44191 - DNA, 25 bp, Homo sapien
catagctgttactgccacttaaaga

SEQ ID NO: 44192 - DNA, 25 bp, Homo sapien
catagctgttattgccacttaaaga

SEQ ID NO: 44193 - DNA, 25 bp, Homo sapien
catagctgtttcactgtcagacaag

SEQ ID NO: 44194 - DNA, 25 bp, Homo sapien
catagctgtttcgctgtcagacaag

SEQ ID NO: 44195 - DNA, 25 bp, Homo sapien
catagctttcacgacaataaaatgg

SEQ ID NO: 44196 - DNA, 25 bp, Homo sapien
catagctttcatgacaataaaatgg

SEQ ID NO: 44197 - DNA, 25 bp, Homo sapien
cataggagagttttcaacagagtag

SEQ ID NO: 44198 - DNA, 25 bp, Homo sapien
cataggagagttttcatcagagtag

SEQ ID NO: 44199 - DNA, 25 bp, Homo sapien
cataggagccgggaccatttctggc

SEQ ID NO: 44200 - DNA, 25 bp, Homo sapien
cataggagctgggaccatttctggc

SEQ ID NO: 44201 - DNA, 25 bp, Homo sapien
cataggatttactgccccaacagaa

SEQ ID NO: 44202 - DNA, 25 bp, Homo sapien
cataggatttactgccgcaacagaa

SEQ ID NO: 44203 - DNA, 25 bp, Homo sapien
cataggcagtccatcattgaccaaa

SEQ ID NO: 44204 - DNA, 25 bp, Homo sapien
cataggcagtccgtcattgaccaaa

SEQ ID NO: 44205 - DNA, 25 bp, Homo sapien
cataggccacttaacagctttgtgc

SEQ ID NO: 44206 - DNA, 25 bp, Homo sapien
cataggccagttaacagctttgtgc

SEQ ID NO: 44207 - DNA, 25 bp, Homo sapien
cataggctgttagaagaagccatat

SEQ ID NO: 44208 - DNA, 25 bp, Homo sapien
cataggctgttataagaagccatat

SEQ ID NO: 44209 - DNA, 25 bp, Homo sapien
catagggattcctctaacagatctg

SEQ ID NO: 44210 - DNA, 25 bp, Homo sapien
catagggattcctgtaacagatctg

SEQ ID NO: 44211 - DNA, 25 bp, Homo sapien
catagggcaaacgattatgagattg

SEQ ID NO: 44212 - DNA, 25 bp, Homo sapien
catagggcaaacgattttgagattg

SEQ ID NO: 44213 - DNA, 25 bp, Homo sapien
catagggctcactaactgattgcaa

SEQ ID NO: 44214 - DNA, 25 bp, Homo sapien
catagggctcactgactgattgcaa

SEQ ID NO: 44215 - DNA, 25 bp, Homo sapien
cataggtatcgtatctctgaatgcc

SEQ ID NO: 44216 - DNA, 25 bp, Homo sapien
cataggtatcgtatctgtgaatgcc

SEQ ID NO: 44217 - DNA, 25 bp, Homo sapien
cataggtctcatgccacattttgct

SEQ ID NO: 44218 - DNA, 25 bp, Homo sapien
cataggtcttatgccacattttgct

SEQ ID NO: 44219 - DNA, 25 bp, Homo sapien
cataggtgactgagtgtgcaagaat

SEQ ID NO: 44220 - DNA, 25 bp, Homo sapien
cataggtgactgtgtgtgcaagaat

SEQ ID NO: 44221 - DNA, 25 bp, Homo sapien
cataggttcttccatttctgttatg

SEQ ID NO: 44222 - DNA, 25 bp, Homo sapien
cataggttcttccgtttctgttatg

SEQ ID NO: 44223 - DNA, 25 bp, Homo sapien
catagtaatacataggaaatcctgg

SEQ ID NO: 44224 - DNA, 25 bp, Homo sapien
catagtaatacatgggaaatcctgg

SEQ ID NO: 44225 - DNA, 25 bp, Homo sapien
catagtagacactaagaaaatggag

SEQ ID NO: 44226 - DNA, 25 bp, Homo sapien
catagtagacagtaagaaaatggag

SEQ ID NO: 44227 - DNA, 25 bp, Homo sapien
catagtagcacatgactttgaaagg

SEQ ID NO: 44228 - DNA, 25 bp, Homo sapien
catagtagcacgtgactttgaaagg

SEQ ID NO: 44229 - DNA, 25 bp, Homo sapien
catagtatatatttctgttacagca

SEQ ID NO: 44230 - DNA, 25 bp, Homo sapien
catagtatcgtcattaataaaacta

SEQ ID NO: 44231 - DNA, 25 bp, Homo sapien
catagtatgtatttctgttacagca

SEQ ID NO: 44232 - DNA, 25 bp, Homo sapien
catagtattgtcattaataaaacta

SEQ ID NO: 44233 - DNA, 25 bp, Homo sapien
catagtcaaacagctcatcagtgtc

SEQ ID NO: 44234 - DNA, 25 bp, Homo sapien
catagtcaaacagttcatcagtgtc

SEQ ID NO: 44235 - DNA, 25 bp, Homo sapien
catagtcaacctgatgaccatcttg

SEQ ID NO: 44236 - DNA, 25 bp, Homo sapien
catagtcaacgtaagaaaaaaatct

SEQ ID NO: 44237 - DNA, 25 bp, Homo sapien
catagtcaatgtaagaaaaaaatct

SEQ ID NO: 44238 - DNA, 25 bp, Homo sapien
catagtcagcctgatgaccatcttg

SEQ ID NO: 44239 - DNA, 25 bp, Homo sapien
catagtctgtttcctgcttctataa

SEQ ID NO: 44240 - DNA, 25 bp, Homo sapien
catagtctgttttctgcttctataa

SEQ ID NO: 44241 - DNA, 25 bp, Homo sapien
catagtcttctaaagtagtaggagc

SEQ ID NO: 44242 - DNA, 25 bp, Homo sapien
catagtcttctgaagtagtaggagc

SEQ ID NO: 44243 - DNA, 25 bp, Homo sapien
catagtgagcagcagagcaggaatt

SEQ ID NO: 44244 - DNA, 25 bp, Homo sapien
catagtgagcagcatagcaggaatt

SEQ ID NO: 44245 - DNA, 25 bp, Homo sapien
catagtgaggaacggtagttgatta

SEQ ID NO: 44246 - DNA, 25 bp, Homo sapien
catagtgaggaatggtagttgatta

SEQ ID NO: 44247 - DNA, 25 bp, Homo sapien
catagtgggaaaactagtcaggatt

SEQ ID NO: 44248 - DNA, 25 bp, Homo sapien
catagtggggaaactagtcaggatt

SEQ ID NO: 44249 - DNA, 25 bp, Homo sapien
catagttctacatgtgcatgttgga

SEQ ID NO: 44250 - DNA, 25 bp, Homo sapien
catagttctacatgtgtatgttgga

SEQ ID NO: 44251 - DNA, 25 bp, Homo sapien
catagttttctactggaccccacca

SEQ ID NO: 44252 - DNA, 25 bp, Homo sapien
catagttttctattggaccccacca

SEQ ID NO: 44253 - DNA, 25 bp, Homo sapien
catataaaacagaaactgttggaga

SEQ ID NO: 44254 - DNA, 25 bp, Homo sapien
catataaaacaggaactgttggaga

SEQ ID NO: 44255 - DNA, 25 bp, Homo sapien
catataaagcctttctactccgctg

SEQ ID NO: 44256 - DNA, 25 bp, Homo sapien
catataaaggctttctactccgctg

SEQ ID NO: 44257 - DNA, 25 bp, Homo sapien
catataaatggacgcatgcagttga

SEQ ID NO: 44258 - DNA, 25 bp, Homo sapien
catataaatggatgcatgcagttga

SEQ ID NO: 44259 - DNA, 25 bp, Homo sapien
catataaggagatggtagtcatttt

SEQ ID NO: 44260 - DNA, 25 bp, Homo sapien
catataaggagttggtagtcatttt

SEQ ID NO: 44261 - DNA, 25 bp, Homo sapien
catataatgaattgcagttcccaaa

SEQ ID NO: 44262 - DNA, 25 bp, Homo sapien
catataatggattgcagttcccaaa

SEQ ID NO: 44263 - DNA, 25 bp, Homo sapien
catatacaagttcaggaaagtattg

SEQ ID NO: 44264 - DNA, 25 bp, Homo sapien
catatacacatccgggcagcttcaa

SEQ ID NO: 44265 - DNA, 25 bp, Homo sapien
catatacacatctgggcagcttcaa

SEQ ID NO: 44266 - DNA, 25 bp, Homo sapien
catatacaggttcaggaaagtattg

SEQ ID NO: 44267 - DNA, 25 bp, Homo sapien
catatacagtcctcatcaacacaca

SEQ ID NO: 44268 - DNA, 25 bp, Homo sapien
catatacagtcctcgtcaacacaca

SEQ ID NO: 44269 - DNA, 25 bp, Homo sapien
catataccaatgtcattctttataa

SEQ ID NO: 44270 - DNA, 25 bp, Homo sapien
catataccagtgtcattctttataa

SEQ ID NO: 44271 - DNA, 25 bp, Homo sapien
catatacctccaattgtaaacacct

SEQ ID NO: 44272 - DNA, 25 bp, Homo sapien
catatacctccagttgtaaacacct

SEQ ID NO: 44273 - DNA, 25 bp, Homo sapien
catatagaagaggaaaagaatgtaa

SEQ ID NO: 44274 - DNA, 25 bp, Homo sapien
catatagaagaggtaaagaatgtaa

SEQ ID NO: 44275 - DNA, 25 bp, Homo sapien
catatagtaagcaatgaaaagtagt

SEQ ID NO: 44276 - DNA, 25 bp, Homo sapien
catatagtaagcactgaaaagtagt

SEQ ID NO: 44277 - DNA, 25 bp, Homo sapien
catatagtgtgtaacctttgcagac

SEQ ID NO: 44278 - DNA, 25 bp, Homo sapien
catatagtttgtaacctttgcagac

SEQ ID NO: 44279 - DNA, 25 bp, Homo sapien
catatatagcacacaatcatgtatg

SEQ ID NO: 44280 - DNA, 25 bp, Homo sapien
catatatatcacacaatcatgtatg

SEQ ID NO: 44281 - DNA, 25 bp, Homo sapien
catatatgatctcacttgttcctca

SEQ ID NO: 44282 - DNA, 25 bp, Homo sapien
catatatgatctcgcttgttcctca

SEQ ID NO: 44283 - DNA, 25 bp, Homo sapien
catatatgattgcttaggtaaggta

SEQ ID NO: 44284 - DNA, 25 bp, Homo sapien
catatatgattgcttatgtaaggta

SEQ ID NO: 44285 - DNA, 25 bp, Homo sapien
catatatgcactgcctaacaacacc

SEQ ID NO: 44286 - DNA, 25 bp, Homo sapien
catatatgcactgcgtaacaacacc

SEQ ID NO: 44287 - DNA, 25 bp, Homo sapien
catatatggtctgaccattgtctgt

SEQ ID NO: 44288 - DNA, 25 bp, Homo sapien
catatatggtctgaccgttgtctgt

SEQ ID NO: 44289 - DNA, 25 bp, Homo sapien
catatattctttggtctgctacaat

SEQ ID NO: 44290 - DNA, 25 bp, Homo sapien
catatatttgaaaaaagacttcata

SEQ ID NO: 44291 - DNA, 25 bp, Homo sapien
catatatttgataaaagacttcata

SEQ ID NO: 44292 - DNA, 25 bp, Homo sapien
catatattttctgacttaattttta

SEQ ID NO: 44293 - DNA, 25 bp, Homo sapien
catatattttctgatttaattttta

SEQ ID NO: 44294 - DNA, 25 bp, Homo sapien
catatattttcttcaggccagctac

SEQ ID NO: 44295 - DNA, 25 bp, Homo sapien
catatattttcttcgggccagctac

SEQ ID NO: 44296 - DNA, 25 bp, Homo sapien
catatatttttcaaactacctccat

SEQ ID NO: 44297 - DNA, 25 bp, Homo sapien
catatatttttgaaactacctccat

SEQ ID NO: 44298 - DNA, 25 bp, Homo sapien
catatattttttggtctgctacaat

SEQ ID NO: 44299 - DNA, 25 bp, Homo sapien
catatcaagaaaggagaagcccaag

SEQ ID NO: 44300 - DNA, 25 bp, Homo sapien
catatcaagaagggagaagcccaag

SEQ ID NO: 44301 - DNA, 25 bp, Homo sapien
catatcacatgcatcctcacatgca

SEQ ID NO: 44302 - DNA, 25 bp, Homo sapien
catatcacatgcattctcacatgca

SEQ ID NO: 44303 - DNA, 25 bp, Homo sapien
catatcagaacatacagatctacct

SEQ ID NO: 44304 - DNA, 25 bp, Homo sapien
catatcagcacatacagatctacct

SEQ ID NO: 44305 - DNA, 25 bp, Homo sapien
catatccaatcgtgttctatcttgg

SEQ ID NO: 44306 - DNA, 25 bp, Homo sapien
catatccacattgatagtgacatgg

SEQ ID NO: 44307 - DNA, 25 bp, Homo sapien
catatccacattgatattgacatgg

SEQ ID NO: 44308 - DNA, 25 bp, Homo sapien
catatccagtcgtgttctatcttgg

SEQ ID NO: 44309 - DNA, 25 bp, Homo sapien
catatccatgaatataatgctacaa

SEQ ID NO: 44310 - DNA, 25 bp, Homo sapien
catatccatgaatttaatgctacaa

SEQ ID NO: 44311 - DNA, 25 bp, Homo sapien
catatcggccagatttaatccaaat

SEQ ID NO: 44312 - DNA, 25 bp, Homo sapien
catatcggccagatttgatccaaat

SEQ ID NO: 44313 - DNA, 25 bp, Homo sapien
catatcgtcatggcagaacatagat

SEQ ID NO: 44314 - DNA, 25 bp, Homo sapien
catatcgtcgtggcagaacatagat

SEQ ID NO: 44315 - DNA, 25 bp, Homo sapien
catatctaataaacattgatacatt

SEQ ID NO: 44316 - DNA, 25 bp, Homo sapien
catatctaataagcattgatacatt

SEQ ID NO: 44317 - DNA, 25 bp, Homo sapien
catatctagtttatccattattctg

SEQ ID NO: 44318 - DNA, 25 bp, Homo sapien
catatctagtttatcccttattctg

SEQ ID NO: 44319 - DNA, 25 bp, Homo sapien
catatctattacattacccagcata

SEQ ID NO: 44320 - DNA, 25 bp, Homo sapien
catatctattacgttacccagcata

SEQ ID NO: 44321 - DNA, 25 bp, Homo sapien
catatctctctgcggctaaagtaga

SEQ ID NO: 44322 - DNA, 25 bp, Homo sapien
catatctctctgtggctaaagtaga

SEQ ID NO: 44323 - DNA, 25 bp, Homo sapien
catatctgattggctacaaagtgtg

SEQ ID NO: 44324 - DNA, 25 bp, Homo sapien
catatctggttggctacaaagtgtg

SEQ ID NO: 44325 - DNA, 25 bp, Homo sapien
catatctttcgggtaaatgattctt

SEQ ID NO: 44326 - DNA, 25 bp, Homo sapien
catatctttcgggtaagtgattctt

SEQ ID NO: 44327 - DNA, 25 bp, Homo sapien
catatgaactacggtataacacgtc

SEQ ID NO: 44328 - DNA, 25 bp, Homo sapien
catatgaactatggtataacacgtc

SEQ ID NO: 44329 - DNA, 25 bp, Homo sapien
catatgaatgcctaatatgcacatg

SEQ ID NO: 44330 - DNA, 25 bp, Homo sapien
catatgaatgcctagtatgcacatg

SEQ ID NO: 44331 - DNA, 25 bp, Homo sapien
catatgagagcccaataactgtgaa

SEQ ID NO: 44332 - DNA, 25 bp, Homo sapien
catatgagagcccgataactgtgaa

SEQ ID NO: 44333 - DNA, 25 bp, Homo sapien
catatgaggctgtgtggttaaggca

SEQ ID NO: 44334 - DNA, 25 bp, Homo sapien
catatgaggctttgtggttaaggca

SEQ ID NO: 44335 - DNA, 25 bp, Homo sapien
catatgaggtttaggtcctctttca

SEQ ID NO: 44336 - DNA, 25 bp, Homo sapien
catatgaggtttgggtcctctttca

SEQ ID NO: 44337 - DNA, 25 bp, Homo sapien
catatgagttcattaaaaaatatat

SEQ ID NO: 44338 - DNA, 25 bp, Homo sapien
catatgagttcattcaaaaatatat

SEQ ID NO: 44339 - DNA, 25 bp, Homo sapien
catatgatacgccaagcattgtgct

SEQ ID NO: 44340 - DNA, 25 bp, Homo sapien
catatgatatgccaagcattgtgct

SEQ ID NO: 44341 - DNA, 25 bp, Homo sapien
catatgcaaaaacatgaacttcagt

SEQ ID NO: 44342 - DNA, 25 bp, Homo sapien
catatgcaaaaatatgaacttcagt

SEQ ID NO: 44343 - DNA, 25 bp, Homo sapien
catatgcaaatggaaatggtaataa

SEQ ID NO: 44344 - DNA, 25 bp, Homo sapien
catatgcaaatggcaatggtaataa

SEQ ID NO: 44345 - DNA, 25 bp, Homo sapien
catatgcaccaatacttttaacgga

SEQ ID NO: 44346 - DNA, 25 bp, Homo sapien
catatgcaccagtacttttaacgga

SEQ ID NO: 44347 - DNA, 25 bp, Homo sapien
catatgccacaagaaaggaacagag

SEQ ID NO: 44348 - DNA, 25 bp, Homo sapien
catatgccacaagagaggaacagag

SEQ ID NO: 44349 - DNA, 25 bp, Homo sapien
catatgctcacatgacatctgtgta

SEQ ID NO: 44350 - DNA, 25 bp, Homo sapien
catatgctgtcaatggtcaacactc

SEQ ID NO: 44351 - DNA, 25 bp, Homo sapien
catatgctgtcaattgtcaacactc

SEQ ID NO: 44352 - DNA, 25 bp, Homo sapien
catatgcttacatgacatctgtgta

SEQ ID NO: 44353 - DNA, 25 bp, Homo sapien
catatgctttgcagtaacatgggat

SEQ ID NO: 44354 - DNA, 25 bp, Homo sapien
catatgctttgtagtaacatgggat

SEQ ID NO: 44355 - DNA, 25 bp, Homo sapien
catatggcttgtagctagggcactg

SEQ ID NO: 44356 - DNA, 25 bp, Homo sapien
catatggcttgtagctggggcactg

SEQ ID NO: 44357 - DNA, 25 bp, Homo sapien
catatggtagattacactgatagat

SEQ ID NO: 44358 - DNA, 25 bp, Homo sapien
catatggtagattacattgatagat

SEQ ID NO: 44359 - DNA, 25 bp, Homo sapien
catatggttgtttcctttctatttg

SEQ ID NO: 44360 - DNA, 25 bp, Homo sapien
catatggttgttttctttctatttg

SEQ ID NO: 44361 - DNA, 25 bp, Homo sapien
catatgtactcattgcaacaaatgc

SEQ ID NO: 44362 - DNA, 25 bp, Homo sapien
catatgtactcgttgcaacaaatgc

SEQ ID NO: 44363 - DNA, 25 bp, Homo sapien
catatgtcctcacaaagatatgtgt

SEQ ID NO: 44364 - DNA, 25 bp, Homo sapien
catatgtcctcacgaagatatgtgt

SEQ ID NO: 44365 - DNA, 25 bp, Homo sapien
catatgtgaaatccgcaaatagaga

SEQ ID NO: 44366 - DNA, 25 bp, Homo sapien
catatgtgaaatctgcaaatagaga

SEQ ID NO: 44367 - DNA, 25 bp, Homo sapien
catatgtgacccgtttagtgtcaac

SEQ ID NO: 44368 - DNA, 25 bp, Homo sapien
catatgtgacctgtttagtgtcaac

SEQ ID NO: 44369 - DNA, 25 bp, Homo sapien
catatgtgagtatctacttcctttt

SEQ ID NO: 44370 - DNA, 25 bp, Homo sapien
catatgtgagtatttacttcctttt

SEQ ID NO: 44371 - DNA, 25 bp, Homo sapien
catatgtgtgatatgtttgttatgt

SEQ ID NO: 44372 - DNA, 25 bp, Homo sapien
catatgtgtgatatttttgttatgt

SEQ ID NO: 44373 - DNA, 25 bp, Homo sapien
catatgtttagtgtcggtaagatct

SEQ ID NO: 44374 - DNA, 25 bp, Homo sapien
catatgtttagtgttggtaagatct

SEQ ID NO: 44375 - DNA, 25 bp, Homo sapien
catatgtttatcaaaatactcccat

SEQ ID NO: 44376 - DNA, 25 bp, Homo sapien
catatgtttatccaaatactcccat

SEQ ID NO: 44377 - DNA, 25 bp, Homo sapien
catattaaaagataagccagtacat

SEQ ID NO: 44378 - DNA, 25 bp, Homo sapien
catattaaaagataggccagtacat

SEQ ID NO: 44379 - DNA, 25 bp, Homo sapien
catattaaatcactcttagtacgca

SEQ ID NO: 44380 - DNA, 25 bp, Homo sapien
catattaaatcactgttagtacgca

SEQ ID NO: 44381 - DNA, 25 bp, Homo sapien
catattagtgatgattcaatgcatt

SEQ ID NO: 44382 - DNA, 25 bp, Homo sapien
catattagtgatggttcaatgcatt

SEQ ID NO: 44383 - DNA, 25 bp, Homo sapien
catattataacttcgcctcaaaatt

SEQ ID NO: 44384 - DNA, 25 bp, Homo sapien
catattataacttctcctcaaaatt

SEQ ID NO: 44385 - DNA, 25 bp, Homo sapien
catattatacaccttgttctgtatc

SEQ ID NO: 44386 - DNA, 25 bp, Homo sapien
catattatacacgttgttctgtatc

SEQ ID NO: 44387 - DNA, 25 bp, Homo sapien
catattatacgtaggagcaatcaca

SEQ ID NO: 44388 - DNA, 25 bp, Homo sapien
catattatatgtaggagcaatcaca

SEQ ID NO: 44389 - DNA, 25 bp, Homo sapien
catattatcaaaaacagcttgtcac

SEQ ID NO: 44390 - DNA, 25 bp, Homo sapien
catattatccaaaacagcttgtcac

SEQ ID NO: 44391 - DNA, 25 bp, Homo sapien
catattcaaatactctgcttggttc

SEQ ID NO: 44392 - DNA, 25 bp, Homo sapien
catattcaaatgctctgcttggttc

SEQ ID NO: 44393 - DNA, 25 bp, Homo sapien
catattcagctagtcttgctatacg

SEQ ID NO: 44394 - DNA, 25 bp, Homo sapien
catattcagctattcttgctatacg

SEQ ID NO: 44395 - DNA, 25 bp, Homo sapien
catattccattctgcggataggcca

SEQ ID NO: 44396 - DNA, 25 bp, Homo sapien
catattccattctgtggataggcca

SEQ ID NO: 44397 - DNA, 25 bp, Homo sapien
catattccgtaacgcaagtagagta

SEQ ID NO: 44398 - DNA, 25 bp, Homo sapien
catattccgtaacgcaggtagagta

SEQ ID NO: 44399 - DNA, 25 bp, Homo sapien
catattcctagatatggtagctatg

SEQ ID NO: 44400 - DNA, 25 bp, Homo sapien
catattcctagctatggtagctatg

SEQ ID NO: 44401 - DNA, 25 bp, Homo sapien
catattctgctataaattaaacagt

SEQ ID NO: 44402 - DNA, 25 bp, Homo sapien
catattctgctgtaaattaaacagt

SEQ ID NO: 44403 - DNA, 25 bp, Homo sapien
catattgattccctgcaaaaccaaa

SEQ ID NO: 44404 - DNA, 25 bp, Homo sapien
catattgattccctgccaaaccaaa

SEQ ID NO: 44405 - DNA, 25 bp, Homo sapien
catattggattaactaacatattaa

SEQ ID NO: 44406 - DNA, 25 bp, Homo sapien
catattggcttaactaacatattaa

SEQ ID NO: 44407 - DNA, 25 bp, Homo sapien
catattgtcataatcacttcatttt

SEQ ID NO: 44408 - DNA, 25 bp, Homo sapien
catattgtcatgatcacttcatttt

SEQ ID NO: 44409 - DNA, 25 bp, Homo sapien
catatttaatgtaggcaatttgatg

SEQ ID NO: 44410 - DNA, 25 bp, Homo sapien
catatttaatgtatgcaatttgatg

SEQ ID NO: 44411 - DNA, 25 bp, Homo sapien
catatttacagatacatcgaaaagg

SEQ ID NO: 44412 - DNA, 25 bp, Homo sapien
catatttacggatacatcgaaaagg

SEQ ID NO: 44413 - DNA, 25 bp, Homo sapien
catatttcaggtggagcaaatgctt

SEQ ID NO: 44414 - DNA, 25 bp, Homo sapien
catatttcaggttgagcaaatgctt

SEQ ID NO: 44415 - DNA, 25 bp, Homo sapien
catatttccgaagttttgccaactc

SEQ ID NO: 44416 - DNA, 25 bp, Homo sapien
catatttctgaagttttgccaactc

SEQ ID NO: 44417 - DNA, 25 bp, Homo sapien
catatttctgccacaactaagagga

SEQ ID NO: 44418 - DNA, 25 bp, Homo sapien
catatttctgccacgactaagagga

SEQ ID NO: 44419 - DNA, 25 bp, Homo sapien
catatttgaagaagaagcccttgca

SEQ ID NO: 44420 - DNA, 25 bp, Homo sapien
catatttgaggaagaagcccttgca

SEQ ID NO: 44421 - DNA, 25 bp, Homo sapien
catatttgcctggatttggccttat

SEQ ID NO: 44422 - DNA, 25 bp, Homo sapien
catatttgcctgggtttggccttat

SEQ ID NO: 44423 - DNA, 25 bp, Homo sapien
catatttgtttttagtttctcaggc

SEQ ID NO: 44424 - DNA, 25 bp, Homo sapien
catatttgttttttgtttctcaggc

SEQ ID NO: 44425 - DNA, 25 bp, Homo sapien
catattttaggagactccaaggtcc

SEQ ID NO: 44426 - DNA, 25 bp, Homo sapien
catattttgggagactccaaggtcc

SEQ ID NO: 44427 - DNA, 25 bp, Homo sapien
catatttttagagcacttctgcaac

SEQ ID NO: 44428 - DNA, 25 bp, Homo sapien
catatttttagagcccttctgcaac

SEQ ID NO: 44429 - DNA, 25 bp, Homo sapien
catatttttctgctaaaaggaaagg

SEQ ID NO: 44430 - DNA, 25 bp, Homo sapien
catatttttctgctaacaggaaagg

SEQ ID NO: 44431 - DNA, 25 bp, Homo sapien
catatttttgccagtatgtagtggt

SEQ ID NO: 44432 - DNA, 25 bp, Homo sapien
catattttttccagtatgtagtggt

SEQ ID NO: 44433 - DNA, 25 bp, Homo sapien
catattttttgtatgcttcctttca

SEQ ID NO: 44434 - DNA, 25 bp, Homo sapien
catattttttgtgtgcttcctttca

SEQ ID NO: 44435 - DNA, 25 bp, Homo sapien
catcaaaacataaaggtcagtttgt

SEQ ID NO: 44436 - DNA, 25 bp, Homo sapien
catcaaaactggatatgctttctac

SEQ ID NO: 44437 - DNA, 25 bp, Homo sapien
catcaaaactggatattctttctac

SEQ ID NO: 44438 - DNA, 25 bp, Homo sapien
catcaaaagataaaggtcagtttgt

SEQ ID NO: 44439 - DNA, 25 bp, Homo sapien
catcaaaatctcggccagctttcac

SEQ ID NO: 44440 - DNA, 25 bp, Homo sapien
catcaaaatcttggccagctttcac

SEQ ID NO: 44441 - DNA, 25 bp, Homo sapien
catcaaacacaatgctccgctctat

SEQ ID NO: 44442 - DNA, 25 bp, Homo sapien
catcaaacacagtgctccgctctat

SEQ ID NO: 44443 - DNA, 25 bp, Homo sapien
catcaaacactaggagaatcacaaa

SEQ ID NO: 44444 - DNA, 25 bp, Homo sapien
catcaaacgctaggagaatcacaaa

SEQ ID NO: 44445 - DNA, 25 bp, Homo sapien
catcaaatgaaaccaaaaggaatta

SEQ ID NO: 44446 - DNA, 25 bp, Homo sapien
catcaaatgaaaccgaaaggaatta

SEQ ID NO: 44447 - DNA, 25 bp, Homo sapien
catcaaattctatgaaactcaaaag

SEQ ID NO: 44448 - DNA, 25 bp, Homo sapien
catcaaattctatggaactcaaaag

SEQ ID NO: 44449 - DNA, 25 bp, Homo sapien
catcaacaaatcctatcaattttac

SEQ ID NO: 44450 - DNA, 25 bp, Homo sapien
catcaacaaatgctatcaattttac

SEQ ID NO: 44451 - DNA, 25 bp, Homo sapien
catcaacactggagtagggttgtca

SEQ ID NO: 44452 - DNA, 25 bp, Homo sapien
catcaacactgtagtagggttgtca

SEQ ID NO: 44453 - DNA, 25 bp, Homo sapien
catcaacttcattgcacttttccct

SEQ ID NO: 44454 - DNA, 25 bp, Homo sapien
catcaacttcatttcacttttccct

SEQ ID NO: 44455 - DNA, 25 bp, Homo sapien
catcaagaagaatgtttactggagt

SEQ ID NO: 44456 - DNA, 25 bp, Homo sapien
catcaagaagactgtttactggagt

SEQ ID NO: 44457 - DNA, 25 bp, Homo sapien
catcaagacctaaggtaatttatct

SEQ ID NO: 44458 - DNA, 25 bp, Homo sapien
catcaagagctaaggtaatttatct

SEQ ID NO: 44459 - DNA, 25 bp, Homo sapien
catcaagcatcaacctttaggtact

SEQ ID NO: 44460 - DNA, 25 bp, Homo sapien
catcaagcatcagcctttaggtact

SEQ ID NO: 44461 - DNA, 25 bp, Homo sapien
catcaagccactaaaattactcttt

SEQ ID NO: 44462 - DNA, 25 bp, Homo sapien
catcaagctactaaaattactcttt

SEQ ID NO: 44463 - DNA, 25 bp, Homo sapien
catcaagtagcctatttcctctaaa

SEQ ID NO: 44464 - DNA, 25 bp, Homo sapien
catcaagtagcctgtttcctctaaa

SEQ ID NO: 44465 - DNA, 25 bp, Homo sapien
catcaagtcctattattgaattatc

SEQ ID NO: 44466 - DNA, 25 bp, Homo sapien
catcaagtcctattcttgaattatc

SEQ ID NO: 44467 - DNA, 25 bp, Homo sapien
catcaataaatggctaagtcaaaaa

SEQ ID NO: 44468 - DNA, 25 bp, Homo sapien
catcaataaatggctacgtcaaaaa

SEQ ID NO: 44469 - DNA, 25 bp, Homo sapien
catcaatacaacacccagcttcatt

SEQ ID NO: 44470 - DNA, 25 bp, Homo sapien
catcaatacaacatccagcttcatt

SEQ ID NO: 44471 - DNA, 25 bp, Homo sapien
catcaatattcatcagaaatacttg

SEQ ID NO: 44472 - DNA, 25 bp, Homo sapien
catcaatattcatcaggaatacttg

SEQ ID NO: 44473 - DNA, 25 bp, Homo sapien
catcaatcacacctgtcctctaact

SEQ ID NO: 44474 - DNA, 25 bp, Homo sapien
catcaatcatacctgtcctctaact

SEQ ID NO: 44475 - DNA, 25 bp, Homo sapien
catcaatgacaacactcactcaatg

SEQ ID NO: 44476 - DNA, 25 bp, Homo sapien
catcaatgacaacattcactcaatg

SEQ ID NO: 44477 - DNA, 25 bp, Homo sapien
catcaatgggatcaatcaagaacct

SEQ ID NO: 44478 - DNA, 25 bp, Homo sapien
catcaatgggatcagtcaagaacct

SEQ ID NO: 44479 - DNA, 25 bp, Homo sapien
catcaattgaaattcgcttccggtg

SEQ ID NO: 44480 - DNA, 25 bp, Homo sapien
catcaattgaaattcggttccggtg

SEQ ID NO: 44481 - DNA, 25 bp, Homo sapien
catcaatttctgtggtttgtaagcc

SEQ ID NO: 44482 - DNA, 25 bp, Homo sapien
catcaatttctgttgtttgtaagcc

SEQ ID NO: 44483 - DNA, 25 bp, Homo sapien
catcacaaaactctttattctccaa

SEQ ID NO: 44484 - DNA, 25 bp, Homo sapien
catcacaaacatctaagtttctaag

SEQ ID NO: 44485 - DNA, 25 bp, Homo sapien
catcacaaacatttaagtttctaag

SEQ ID NO: 44486 - DNA, 25 bp, Homo sapien
catcacaaattctgttttagaaaaa

SEQ ID NO: 44487 - DNA, 25 bp, Homo sapien
catcacaagactctttattctccaa

SEQ ID NO: 44488 - DNA, 25 bp, Homo sapien
catcacaatttctgttttagaaaaa

SEQ ID NO: 44489 - DNA, 25 bp, Homo sapien
catcacaccgaagaagcctggagta

SEQ ID NO: 44490 - DNA, 25 bp, Homo sapien
catcacaccgaagaaggctggagta

SEQ ID NO: 44491 - DNA, 25 bp, Homo sapien
catcacagagaattttaaaacagca

SEQ ID NO: 44492 - DNA, 25 bp, Homo sapien
catcacagataattttaaaacagca

SEQ ID NO: 44493 - DNA, 25 bp, Homo sapien
catcacaggtaaattcttacaatgt

SEQ ID NO: 44494 - DNA, 25 bp, Homo sapien
catcacaggtaagttcttacaatgt

SEQ ID NO: 44495 - DNA, 25 bp, Homo sapien
catcacagtagcttctctaaccatt

SEQ ID NO: 44496 - DNA, 25 bp, Homo sapien
catcacagtagcttctgtaaccatt

SEQ ID NO: 44497 - DNA, 25 bp, Homo sapien
catcacatactctctgcgatggcta

SEQ ID NO: 44498 - DNA, 25 bp, Homo sapien
catcacatactgtctgcgatggcta

SEQ ID NO: 44499 - DNA, 25 bp, Homo sapien
catcacatatgtgacccgtttagtg

SEQ ID NO: 44500 - DNA, 25 bp, Homo sapien
catcacatatgtgacctgtttagtg

SEQ ID NO: 44501 - DNA, 25 bp, Homo sapien
catcacattccaacatatattagtc

SEQ ID NO: 44502 - DNA, 25 bp, Homo sapien
catcacattccaacatgtattagtc

SEQ ID NO: 44503 - DNA, 25 bp, Homo sapien
catcaccaacagaaaccataccacg

SEQ ID NO: 44504 - DNA, 25 bp, Homo sapien
catcaccaagagaaaccataccacg

SEQ ID NO: 44505 - DNA, 25 bp, Homo sapien
catcaccaagtttctcctaaaaaca

SEQ ID NO: 44506 - DNA, 25 bp, Homo sapien
catcaccaagtttctcttaaaaaca

SEQ ID NO: 44507 - DNA, 25 bp, Homo sapien
catcaccacaatcgattttatattt

SEQ ID NO: 44508 - DNA, 25 bp, Homo sapien
catcaccacaattgattttatattt

SEQ ID NO: 44509 - DNA, 25 bp, Homo sapien
catcacgagtagagtttgtttcaag

SEQ ID NO: 44510 - DNA, 25 bp, Homo sapien
catcacgagtagattttgtttcaag

SEQ ID NO: 44511 - DNA, 25 bp, Homo sapien
catcacgatacttatcgcgtttcca

SEQ ID NO: 44512 - DNA, 25 bp, Homo sapien
catcacgatacttatctcgtttcca

SEQ ID NO: 44513 - DNA, 25 bp, Homo sapien
catcactaagtctaatagttcctac

SEQ ID NO: 44514 - DNA, 25 bp, Homo sapien
catcactaagtctaatggttcctac

SEQ ID NO: 44515 - DNA, 25 bp, Homo sapien
catcactatccttggcaagagttca

SEQ ID NO: 44516 - DNA, 25 bp, Homo sapien
catcactatccttggcgagagttca

SEQ ID NO: 44517 - DNA, 25 bp, Homo sapien
catcactcagatttaatacatttta

SEQ ID NO: 44518 - DNA, 25 bp, Homo sapien
catcactcagatttgatacatttta

SEQ ID NO: 44519 - DNA, 25 bp, Homo sapien
catcactccctcctggttttcttcc

SEQ ID NO: 44520 - DNA, 25 bp, Homo sapien
catcactcctatatctgcctccgcc

SEQ ID NO: 44521 - DNA, 25 bp, Homo sapien
catcactccttcctggttttcttcc

SEQ ID NO: 44522 - DNA, 25 bp, Homo sapien
catcactcgtatatctgcctccgcc

SEQ ID NO: 44523 - DNA, 25 bp, Homo sapien
catcactctgacgttggtgcgcttt

SEQ ID NO: 44524 - DNA, 25 bp, Homo sapien
catcactctgatgttggtgcgcttt

SEQ ID NO: 44525 - DNA, 25 bp, Homo sapien
catcactgcgaattatttagagccc

SEQ ID NO: 44526 - DNA, 25 bp, Homo sapien
catcactgtgaattatttagagccc

SEQ ID NO: 44527 - DNA, 25 bp, Homo sapien
catcagaaaaagactagaccaggtg

SEQ ID NO: 44528 - DNA, 25 bp, Homo sapien
catcagaaaaatactagaccaggtg

SEQ ID NO: 44529 - DNA, 25 bp, Homo sapien
catcagaataatcataaatggagat

SEQ ID NO: 44530 - DNA, 25 bp, Homo sapien
catcagaatctcacgtgggagggat

SEQ ID NO: 44531 - DNA, 25 bp, Homo sapien
catcagaatctcaggtgggagggat

SEQ ID NO: 44532 - DNA, 25 bp, Homo sapien
catcagaattatcataaatggagat

SEQ ID NO: 44533 - DNA, 25 bp, Homo sapien
catcagactcctatacctgcataat

SEQ ID NO: 44534 - DNA, 25 bp, Homo sapien
catcagacttctatacctgcataat

SEQ ID NO: 44535 - DNA, 25 bp, Homo sapien
catcagatactccgccttttgtaaa

SEQ ID NO: 44536 - DNA, 25 bp, Homo sapien
catcagatactctgccttttgtaaa

SEQ ID NO: 44537 - DNA, 25 bp, Homo sapien
catcagatactgggaaggcacaatg

SEQ ID NO: 44538 - DNA, 25 bp, Homo sapien
catcagatactgtgaaggcacaatg

SEQ ID NO: 44539 - DNA, 25 bp, Homo sapien
catcagcaactgaaatgatatgacc

SEQ ID NO: 44540 - DNA, 25 bp, Homo sapien
catcagcaactgaagtgatatgacc

SEQ ID NO: 44541 - DNA, 25 bp, Homo sapien
catcagcactagccaggcagtattt

SEQ ID NO: 44542 - DNA, 25 bp, Homo sapien
catcagcactaggcaggcagtattt

SEQ ID NO: 44543 - DNA, 25 bp, Homo sapien
catcagcatctaggataagacgaaa

SEQ ID NO: 44544 - DNA, 25 bp, Homo sapien
catcagcatctaggatgagacgaaa

SEQ ID NO: 44545 - DNA, 25 bp, Homo sapien
catcagccaaaaagaaagaatctga

SEQ ID NO: 44546 - DNA, 25 bp, Homo sapien
catcagccataaagaaagaatctga

SEQ ID NO: 44547 - DNA, 25 bp, Homo sapien
catcagccgtagtttcgtcatttca

SEQ ID NO: 44548 - DNA, 25 bp, Homo sapien
catcagccgtagtttcttcatttca

SEQ ID NO: 44549 - DNA, 25 bp, Homo sapien
catcaggaagccattaagagattat

SEQ ID NO: 44550 - DNA, 25 bp, Homo sapien
catcaggaagccattaggagattat

SEQ ID NO: 44551 - DNA, 25 bp, Homo sapien
catcaggccagctgcaaatcgctct

SEQ ID NO: 44552 - DNA, 25 bp, Homo sapien
catcaggctagctgcaaatcgctct

SEQ ID NO: 44553 - DNA, 25 bp, Homo sapien
catcaggctggctggactctcgctg

SEQ ID NO: 44554 - DNA, 25 bp, Homo sapien
catcaggctggttggactctcgctg

SEQ ID NO: 44555 - DNA, 25 bp, Homo sapien
catcaggtgggtcatttgagcccag

SEQ ID NO: 44556 - DNA, 25 bp, Homo sapien
catcaggtgggttatttgagcccag

SEQ ID NO: 44557 - DNA, 25 bp, Homo sapien
catcagtaaacatactcaagtctct

SEQ ID NO: 44558 - DNA, 25 bp, Homo sapien
catcagtaaacatagtcaagtctct

SEQ ID NO: 44559 - DNA, 25 bp, Homo sapien
catcagtaaagcggattcacctgtt

SEQ ID NO: 44560 - DNA, 25 bp, Homo sapien
catcagtaaagtggattcacctgtt

SEQ ID NO: 44561 - DNA, 25 bp, Homo sapien
catcagtaacctcacggccacttag

SEQ ID NO: 44562 - DNA, 25 bp, Homo sapien
catcagtaacctcagggccacttag

SEQ ID NO: 44563 - DNA, 25 bp, Homo sapien
catcagtaattacaacatggaaaac

SEQ ID NO: 44564 - DNA, 25 bp, Homo sapien
catcagtaattccaacatggaaaac

SEQ ID NO: 44565 - DNA, 25 bp, Homo sapien
catcagtagaaagagcgctggattt

SEQ ID NO: 44566 - DNA, 25 bp, Homo sapien
catcagtagattgctgaaaaatatt

SEQ ID NO: 44567 - DNA, 25 bp, Homo sapien
catcagtagattgttgaaaaatatt

SEQ ID NO: 44568 - DNA, 25 bp, Homo sapien
catcagtataaagagcgctggattt

SEQ ID NO: 44569 - DNA, 25 bp, Homo sapien
catcagtccatttctcaggtgagga

SEQ ID NO: 44570 - DNA, 25 bp, Homo sapien
catcagtccatttctcgggtgagga

SEQ ID NO: 44571 - DNA, 25 bp, Homo sapien
catcagtgacgctcttctcttccct

SEQ ID NO: 44572 - DNA, 25 bp, Homo sapien
catcagtgataacattgaaagttga

SEQ ID NO: 44573 - DNA, 25 bp, Homo sapien
catcagtgataacgttgaaagttga

SEQ ID NO: 44574 - DNA, 25 bp, Homo sapien
catcagtgatgctcttctcttccct

SEQ ID NO: 44575 - DNA, 25 bp, Homo sapien
catcagtgtagcctaatctactctt

SEQ ID NO: 44576 - DNA, 25 bp, Homo sapien
catcagtgtcgcctaatctactctt

SEQ ID NO: 44577 - DNA, 25 bp, Homo sapien
catcagtgtgcaccttatcccactc

SEQ ID NO: 44578 - DNA, 25 bp, Homo sapien
catcagtgtgcactttatcccactc

SEQ ID NO: 44579 - DNA, 25 bp, Homo sapien
catcagttgatctcttttcatgttt

SEQ ID NO: 44580 - DNA, 25 bp, Homo sapien
catcagttgatttcttttcatgttt

SEQ ID NO: 44581 - DNA, 25 bp, Homo sapien
catcagttggagacattaacagcaa

SEQ ID NO: 44582 - DNA, 25 bp, Homo sapien
catcagttggaggcattaacagcaa

SEQ ID NO: 44583 - DNA, 25 bp, Homo sapien
catcagttttcagcgatcaggaaga

SEQ ID NO: 44584 - DNA, 25 bp, Homo sapien
catcagttttcagggatcaggaaga

SEQ ID NO: 44585 - DNA, 25 bp, Homo sapien
catcataacttattaacagtgattt

SEQ ID NO: 44586 - DNA, 25 bp, Homo sapien
catcataagttattaacagtgattt

SEQ ID NO: 44587 - DNA, 25 bp, Homo sapien
catcataccgtggtttgacttgttg

SEQ ID NO: 44588 - DNA, 25 bp, Homo sapien
catcatactgtggtttgacttgttg

SEQ ID NO: 44589 - DNA, 25 bp, Homo sapien
catcatagccagctacaacttgggc

SEQ ID NO: 44590 - DNA, 25 bp, Homo sapien
catcatagccagctacgacttgggc

SEQ ID NO: 44591 - DNA, 25 bp, Homo sapien
catcatagctgttactgccacttaa

SEQ ID NO: 44592 - DNA, 25 bp, Homo sapien
catcatagctgttattgccacttaa

SEQ ID NO: 44593 - DNA, 25 bp, Homo sapien
catcatatagaagaggaaaagaatg

SEQ ID NO: 44594 - DNA, 25 bp, Homo sapien
catcatatagaagaggtaaagaatg

SEQ ID NO: 44595 - DNA, 25 bp, Homo sapien
catcatcaactgtgtaatagtttgg

SEQ ID NO: 44596 - DNA, 25 bp, Homo sapien
catcatcacatttgtcaccattgaa

SEQ ID NO: 44597 - DNA, 25 bp, Homo sapien
catcatcacctgtgtaatagtttgg

SEQ ID NO: 44598 - DNA, 25 bp, Homo sapien
catcatcacgtttgtcaccattgaa

SEQ ID NO: 44599 - DNA, 25 bp, Homo sapien
catcatcataatatttcctgacatg

SEQ ID NO: 44600 - DNA, 25 bp, Homo sapien
catcatcataatattttctgacatg

SEQ ID NO: 44601 - DNA, 25 bp, Homo sapien
catcatcatcccgcaaacaattaaa

SEQ ID NO: 44602 - DNA, 25 bp, Homo sapien
catcatcatcctgcaaacaattaaa

SEQ ID NO: 44603 - DNA, 25 bp, Homo sapien
catcatccaccagaagaatgtgagt

SEQ ID NO: 44604 - DNA, 25 bp, Homo sapien
catcatccaccaggagaatgtgagt

SEQ ID NO: 44605 - DNA, 25 bp, Homo sapien
catcatcccgcaaacaattaaatat

SEQ ID NO: 44606 - DNA, 25 bp, Homo sapien
catcatcctgcaaacaattaaatat

SEQ ID NO: 44607 - DNA, 25 bp, Homo sapien
catcatctgatctcatcattcttcc

SEQ ID NO: 44608 - DNA, 25 bp, Homo sapien
catcatctggtctcatcattcttcc

SEQ ID NO: 44609 - DNA, 25 bp, Homo sapien
catcatgcaccaggtagcgtgccac

SEQ ID NO: 44610 - DNA, 25 bp, Homo sapien
catcatgccaagtggaataagccag

SEQ ID NO: 44611 - DNA, 25 bp, Homo sapien
catcatgccaagtggagtaagccag

SEQ ID NO: 44612 - DNA, 25 bp, Homo sapien
catcatgcgccaggtagcgtgccac

SEQ ID NO: 44613 - DNA, 25 bp, Homo sapien
catcatgggacacacttctgaaagc

SEQ ID NO: 44614 - DNA, 25 bp, Homo sapien
catcatggggcacacttctgaaagc

SEQ ID NO: 44615 - DNA, 25 bp, Homo sapien
catcatggtatgacctctgtttacc

SEQ ID NO: 44616 - DNA, 25 bp, Homo sapien
catcatggtatgagctctgtttacc

SEQ ID NO: 44617 - DNA, 25 bp, Homo sapien
catcatggtgatcctacaagattat

SEQ ID NO: 44618 - DNA, 25 bp, Homo sapien
catcatggtgatcctataagattat

SEQ ID NO: 44619 - DNA, 25 bp, Homo sapien
catcatgtactatggcagcaaatcc

SEQ ID NO: 44620 - DNA, 25 bp, Homo sapien
catcatgtactatggcggcaaatcc

SEQ ID NO: 44621 - DNA, 25 bp, Homo sapien
catcatgttatatactgatcacact

SEQ ID NO: 44622 - DNA, 25 bp, Homo sapien
catcatgttatgtactgatcacact

SEQ ID NO: 44623 - DNA, 25 bp, Homo sapien
catcattaaatagagacataagatc

SEQ ID NO: 44624 - DNA, 25 bp, Homo sapien
catcattaagtagagacataagatc

SEQ ID NO: 44625 - DNA, 25 bp, Homo sapien
catcattaattctgcactaactttt

SEQ ID NO: 44626 - DNA, 25 bp, Homo sapien
catcattaattttgcactaactttt

SEQ ID NO: 44627 - DNA, 25 bp, Homo sapien
catcattatggaaattctagcactc

SEQ ID NO: 44628 - DNA, 25 bp, Homo sapien
catcattatggaaattgtagcactc

SEQ ID NO: 44629 - DNA, 25 bp, Homo sapien
catcattcatctttattctcaatct

SEQ ID NO: 44630 - DNA, 25 bp, Homo sapien
catcattcatctttgttctcaatct

SEQ ID NO: 44631 - DNA, 25 bp, Homo sapien
catcattgacccacattgtggtttg

SEQ ID NO: 44632 - DNA, 25 bp, Homo sapien
catcattggcccacattgtggtttg

SEQ ID NO: 44633 - DNA, 25 bp, Homo sapien
catcattggtgcaaatgcaggtatt

SEQ ID NO: 44634 - DNA, 25 bp, Homo sapien
catcattggtgcagatgcaggtatt

SEQ ID NO: 44635 - DNA, 25 bp, Homo sapien
catcatttcaccgtcttctcatgga

SEQ ID NO: 44636 - DNA, 25 bp, Homo sapien
catcatttcactgtcttctcatgga

SEQ ID NO: 44637 - DNA, 25 bp, Homo sapien
catcatttcagtccagctaaattag

SEQ ID NO: 44638 - DNA, 25 bp, Homo sapien
catcatttcagtccagttaaattag

SEQ ID NO: 44639 - DNA, 25 bp, Homo sapien
catcattttcttcctagtaactaga

SEQ ID NO: 44640 - DNA, 25 bp, Homo sapien
catcatttttttcctagtaactaga

SEQ ID NO: 44641 - DNA, 25 bp, Homo sapien
catccaaattgctttggctctgccc

SEQ ID NO: 44642 - DNA, 25 bp, Homo sapien
catccaaattgttttggctctgccc

SEQ ID NO: 44643 - DNA, 25 bp, Homo sapien
catccaaccataattgtctaaactt

SEQ ID NO: 44644 - DNA, 25 bp, Homo sapien
catccaaccctgtaagccagcaggt

SEQ ID NO: 44645 - DNA, 25 bp, Homo sapien
catccaaccctttaagccagcaggt

SEQ ID NO: 44646 - DNA, 25 bp, Homo sapien
catccaaccgtaattgtctaaactt

SEQ ID NO: 44647 - DNA, 25 bp, Homo sapien
catccaagctcccacagttatccat

SEQ ID NO: 44648 - DNA, 25 bp, Homo sapien
catccaaggtcccacagttatccat

SEQ ID NO: 44649 - DNA, 25 bp, Homo sapien
catccaagtccttgagtggaaggag

SEQ ID NO: 44650 - DNA, 25 bp, Homo sapien
catccaagtgcttgagtggaaggag

SEQ ID NO: 44651 - DNA, 25 bp, Homo sapien
catccacatttacccagggcttagc

SEQ ID NO: 44652 - DNA, 25 bp, Homo sapien
catccacatttgcccagggcttagc

SEQ ID NO: 44653 - DNA, 25 bp, Homo sapien
catccaccaagtagtggcatcaatc

SEQ ID NO: 44654 - DNA, 25 bp, Homo sapien
catccaccacggaaatcgtattgca

SEQ ID NO: 44655 - DNA, 25 bp, Homo sapien
catccaccaggtagtggcatcaatc

SEQ ID NO: 44656 - DNA, 25 bp, Homo sapien
catccaccatggaaatcgtattgca

SEQ ID NO: 44657 - DNA, 25 bp, Homo sapien
catccacctctttgatatagaccca

SEQ ID NO: 44658 - DNA, 25 bp, Homo sapien
catccacctctttgttatagaccca

SEQ ID NO: 44659 - DNA, 25 bp, Homo sapien
catccagactgcttccattctgagg

SEQ ID NO: 44660 - DNA, 25 bp, Homo sapien
catccagactgcttccgttctgagg

SEQ ID NO: 44661 - DNA, 25 bp, Homo sapien
catccaggaataaaaagatttagag

SEQ ID NO: 44662 - DNA, 25 bp, Homo sapien
catccaggaataaacagatttagag

SEQ ID NO: 44663 - DNA, 25 bp, Homo sapien
catccaggcactatcgtagatccag

SEQ ID NO: 44664 - DNA, 25 bp, Homo sapien
catccaggcactattgtagatccag

SEQ ID NO: 44665 - DNA, 25 bp, Homo sapien
catccagttgcctaaaccacttatc

SEQ ID NO: 44666 - DNA, 25 bp, Homo sapien
catccagttgcctaaatcacttatc

SEQ ID NO: 44667 - DNA, 25 bp, Homo sapien
catccagttgctctcctccctcttt

SEQ ID NO: 44668 - DNA, 25 bp, Homo sapien
catccagttgctctgctccctcttt

SEQ ID NO: 44669 - DNA, 25 bp, Homo sapien
catccataaggcatgaggccggaga

SEQ ID NO: 44670 - DNA, 25 bp, Homo sapien
catccataatgcatgaggccggaga

SEQ ID NO: 44671 - DNA, 25 bp, Homo sapien
catccatacataggtgcattagtag

SEQ ID NO: 44672 - DNA, 25 bp, Homo sapien
catccatacatatgtgcattagtag

SEQ ID NO: 44673 - DNA, 25 bp, Homo sapien
catccatgacatcaatagtttagca

SEQ ID NO: 44674 - DNA, 25 bp, Homo sapien
catccatgacattaatagtttagca

SEQ ID NO: 44675 - DNA, 25 bp, Homo sapien
catcccaataacggtgtgcccttca

SEQ ID NO: 44676 - DNA, 25 bp, Homo sapien
catcccaataatggtgtgcccttca

SEQ ID NO: 44677 - DNA, 25 bp, Homo sapien
catcccaattctaccacgtcaatat

SEQ ID NO: 44678 - DNA, 25 bp, Homo sapien
catcccaattctaccatgtcaatat

SEQ ID NO: 44679 - DNA, 25 bp, Homo sapien
catcccagagcccgaatttctgagg

SEQ ID NO: 44680 - DNA, 25 bp, Homo sapien
catcccagagcctgaatttctgagg

SEQ ID NO: 44681 - DNA, 25 bp, Homo sapien
catcccagtagaatatgtagcaatt

SEQ ID NO: 44682 - DNA, 25 bp, Homo sapien
catcccagtggaatatgtagcaatt

SEQ ID NO: 44683 - DNA, 25 bp, Homo sapien
catcccatcaaaacataaaggtcag

SEQ ID NO: 44684 - DNA, 25 bp, Homo sapien
catcccatcaaaagataaaggtcag

SEQ ID NO: 44685 - DNA, 25 bp, Homo sapien
catcccatcttaccatctctaacct

SEQ ID NO: 44686 - DNA, 25 bp, Homo sapien
catcccatcttactatctctaacct

SEQ ID NO: 44687 - DNA, 25 bp, Homo sapien
catcccattctcttctgacctataa

SEQ ID NO: 44688 - DNA, 25 bp, Homo sapien
catcccattgtcttctgacctataa

SEQ ID NO: 44689 - DNA, 25 bp, Homo sapien
catccccaagacatctcagtatgta

SEQ ID NO: 44690 - DNA, 25 bp, Homo sapien
catccccaagacatctgagtatgta

SEQ ID NO: 44691 - DNA, 25 bp, Homo sapien
catccccaggcttgttatgcccact

SEQ ID NO: 44692 - DNA, 25 bp, Homo sapien
catccccaggcttgttgtgcccact

SEQ ID NO: 44693 - DNA, 25 bp, Homo sapien
catccctagacatcctgacaagtct

SEQ ID NO: 44694 - DNA, 25 bp, Homo sapien
catccctagacgtcctgacaagtct

SEQ ID NO: 44695 - DNA, 25 bp, Homo sapien
catccctgacaaaaacttagccaat

SEQ ID NO: 44696 - DNA, 25 bp, Homo sapien
catccctgacaaaaccttagccaat

SEQ ID NO: 44697 - DNA, 25 bp, Homo sapien
catccctgattgattataactctcc

SEQ ID NO: 44698 - DNA, 25 bp, Homo sapien
catccctgattgtttataactctcc

SEQ ID NO: 44699 - DNA, 25 bp, Homo sapien
catcccttgctttcagttgtcctat

SEQ ID NO: 44700 - DNA, 25 bp, Homo sapien
catccctttaacaccattaccatgg

SEQ ID NO: 44701 - DNA, 25 bp, Homo sapien
catccctttaacatcattaccatgg

SEQ ID NO: 44702 - DNA, 25 bp, Homo sapien
catccctttctttcagttgtcctat

SEQ ID NO: 44703 - DNA, 25 bp, Homo sapien
catccgagtcttgaaggaagagtga

SEQ ID NO: 44704 - DNA, 25 bp, Homo sapien
catccgagtcttgagggaagagtga

SEQ ID NO: 44705 - DNA, 25 bp, Homo sapien
catccgctctgtcaacttctctctt

SEQ ID NO: 44706 - DNA, 25 bp, Homo sapien
catccgctctgtcagcttctctctt

SEQ ID NO: 44707 - DNA, 25 bp, Homo sapien
catccgggtcctccatccacagggg

SEQ ID NO: 44708 - DNA, 25 bp, Homo sapien
catccgggtcctctatccacagggg

SEQ ID NO: 44709 - DNA, 25 bp, Homo sapien
catccgtaacttagcaaaataaaaa

SEQ ID NO: 44710 - DNA, 25 bp, Homo sapien
catccgtaacttggcaaaataaaaa

SEQ ID NO: 44711 - DNA, 25 bp, Homo sapien
catcctaagcaaaattccctaagtt

SEQ ID NO: 44712 - DNA, 25 bp, Homo sapien
catcctaagcaacattccctaagtt

SEQ ID NO: 44713 - DNA, 25 bp, Homo sapien
catcctacaagcattgtgacgcatg

SEQ ID NO: 44714 - DNA, 25 bp, Homo sapien
catcctacagtagacaaacataccc

SEQ ID NO: 44715 - DNA, 25 bp, Homo sapien
catcctacagtagataaacataccc

SEQ ID NO: 44716 - DNA, 25 bp, Homo sapien
catcctactagcattgtgacgcatg

SEQ ID NO: 44717 - DNA, 25 bp, Homo sapien
catcctcagggcctactgttcagcc

SEQ ID NO: 44718 - DNA, 25 bp, Homo sapien
catcctcagggcttactgttcagcc

SEQ ID NO: 44719 - DNA, 25 bp, Homo sapien
catcctcctttgaccttctatttgg

SEQ ID NO: 44720 - DNA, 25 bp, Homo sapien
catcctcctttgacgttctatttgg

SEQ ID NO: 44721 - DNA, 25 bp, Homo sapien
catcctctgcacgttcattagtgac

SEQ ID NO: 44722 - DNA, 25 bp, Homo sapien
catcctctgcactttcattagtgac

SEQ ID NO: 44723 - DNA, 25 bp, Homo sapien
catcctctttaatactgaattatgc

SEQ ID NO: 44724 - DNA, 25 bp, Homo sapien
catcctctttaatgctgaattatgc

SEQ ID NO: 44725 - DNA, 25 bp, Homo sapien
catcctgaataaggctataaggatt

SEQ ID NO: 44726 - DNA, 25 bp, Homo sapien
catcctgacaacatgttcaacaaag

SEQ ID NO: 44727 - DNA, 25 bp, Homo sapien
catcctgacaacgtgttcaacaaag

SEQ ID NO: 44728 - DNA, 25 bp, Homo sapien
catcctgagtaacccaccgtgtacc

SEQ ID NO: 44729 - DNA, 25 bp, Homo sapien
catcctgagtaacctaccgtgtacc

SEQ ID NO: 44730 - DNA, 25 bp, Homo sapien
catcctgagtaaggctataaggatt

SEQ ID NO: 44731 - DNA, 25 bp, Homo sapien
catcctgtacagggacaagaaatgg

SEQ ID NO: 44732 - DNA, 25 bp, Homo sapien
catcctgtacagggacgagaaatgg

SEQ ID NO: 44733 - DNA, 25 bp, Homo sapien
catccttaactcaacattattacaa

SEQ ID NO: 44734 - DNA, 25 bp, Homo sapien
catccttacctcactttacagcaac

SEQ ID NO: 44735 - DNA, 25 bp, Homo sapien
catccttagctcaacattattacaa

SEQ ID NO: 44736 - DNA, 25 bp, Homo sapien
catccttatctcactttacagcaac

SEQ ID NO: 44737 - DNA, 25 bp, Homo sapien
catccttatgtctcttcctcttttc

SEQ ID NO: 44738 - DNA, 25 bp, Homo sapien
catccttatgtctcttgctcttttc

SEQ ID NO: 44739 - DNA, 25 bp, Homo sapien
catccttcccttacaagctgaatgt

SEQ ID NO: 44740 - DNA, 25 bp, Homo sapien
catccttcccttaccagctgaatgt

SEQ ID NO: 44741 - DNA, 25 bp, Homo sapien
catccttgaaatcctgtgctcaggg

SEQ ID NO: 44742 - DNA, 25 bp, Homo sapien
catccttgaaatcgtgtgctcaggg

SEQ ID NO: 44743 - DNA, 25 bp, Homo sapien
catccttggctgccttctcttgcct

SEQ ID NO: 44744 - DNA, 25 bp, Homo sapien
catccttgtctgccttctcttgcct

SEQ ID NO: 44745 - DNA, 25 bp, Homo sapien
catcctttcacattttgacacacaa

SEQ ID NO: 44746 - DNA, 25 bp, Homo sapien
catcctttcaccttttgacacacaa

SEQ ID NO: 44747 - DNA, 25 bp, Homo sapien
catcctttcctggaatctgtctgaa

SEQ ID NO: 44748 - DNA, 25 bp, Homo sapien
catcctttcctgggatctgtctgaa

SEQ ID NO: 44749 - DNA, 25 bp, Homo sapien
catcgatgaaaaaaatcataaactc

SEQ ID NO: 44750 - DNA, 25 bp, Homo sapien
catcgatgaaaaaaatgataaactc

SEQ ID NO: 44751 - DNA, 25 bp, Homo sapien
catcgatttttgtatgctgaaccag

SEQ ID NO: 44752 - DNA, 25 bp, Homo sapien
catcgatttttgtgtgctgaaccag

SEQ ID NO: 44753 - DNA, 25 bp, Homo sapien
catcgcctgtcaccatgttctttgg

SEQ ID NO: 44754 - DNA, 25 bp, Homo sapien
catcgcctgtcaccgtgttctttgg

SEQ ID NO: 44755 - DNA, 25 bp, Homo sapien
catcggccttttccactggcaactt

SEQ ID NO: 44756 - DNA, 25 bp, Homo sapien
catcggcctttttcactggcaactt

SEQ ID NO: 44757 - DNA, 25 bp, Homo sapien
catcgtatcttcctctgtcttacta

SEQ ID NO: 44758 - DNA, 25 bp, Homo sapien
catcgtatcttcgtctgtcttacta

SEQ ID NO: 44759 - DNA, 25 bp, Homo sapien
catcgtgaatctccctagtgatcag

SEQ ID NO: 44760 - DNA, 25 bp, Homo sapien
catcgtgactctccctagtgatcag

SEQ ID NO: 44761 - DNA, 25 bp, Homo sapien
catctaaaattgcatttattgtgtg

SEQ ID NO: 44762 - DNA, 25 bp, Homo sapien
catctaaaattgtatttattgtgtg

SEQ ID NO: 44763 - DNA, 25 bp, Homo sapien
catctaaagcaataaaaacataccc

SEQ ID NO: 44764 - DNA, 25 bp, Homo sapien
catctaaagcaatagaaacataccc

SEQ ID NO: 44765 - DNA, 25 bp, Homo sapien
catctaacacatgcttgaaagaatc

SEQ ID NO: 44766 - DNA, 25 bp, Homo sapien
catctaacccatgcttgaaagaatc

SEQ ID NO: 44767 - DNA, 25 bp, Homo sapien
catctaacccttacttgaatctgtt

SEQ ID NO: 44768 - DNA, 25 bp, Homo sapien
catctaacccttatttgaatctgtt

SEQ ID NO: 44769 - DNA, 25 bp, Homo sapien
catctaatccaattccttcagtgac

SEQ ID NO: 44770 - DNA, 25 bp, Homo sapien
catctaatctaattccttcagtgac

SEQ ID NO: 44771 - DNA, 25 bp, Homo sapien
catctacaaaaataggtaggtagtt

SEQ ID NO: 44772 - DNA, 25 bp, Homo sapien
catctacaaaactaggtaggtagtt

SEQ ID NO: 44773 - DNA, 25 bp, Homo sapien
catctacaaatcacgtacacataac

SEQ ID NO: 44774 - DNA, 25 bp, Homo sapien
catctacaaatcatgtacacataac

SEQ ID NO: 44775 - DNA, 25 bp, Homo sapien
catctacggatctgtggaggtgagc

SEQ ID NO: 44776 - DNA, 25 bp, Homo sapien
catctacgtatctgtggaggtgagc

SEQ ID NO: 44777 - DNA, 25 bp, Homo sapien
catctactatgaattgacaatttgt

SEQ ID NO: 44778 - DNA, 25 bp, Homo sapien
catctactatgaattggcaatttgt

SEQ ID NO: 44779 - DNA, 25 bp, Homo sapien
catctagctcactatgttctccatg

SEQ ID NO: 44780 - DNA, 25 bp, Homo sapien
catctagctcactgtgttctccatg

SEQ ID NO: 44781 - DNA, 25 bp, Homo sapien
catctagtatcaaaacatgttcaac

SEQ ID NO: 44782 - DNA, 25 bp, Homo sapien
catctagtatcaaagcatgttcaac

SEQ ID NO: 44783 - DNA, 25 bp, Homo sapien
catctagtgccactttccactccag

SEQ ID NO: 44784 - DNA, 25 bp, Homo sapien
catctagtgccattttccactccag

SEQ ID NO: 44785 - DNA, 25 bp, Homo sapien
catctagtgctatgaagtatttcct

SEQ ID NO: 44786 - DNA, 25 bp, Homo sapien
catctagtgctatggagtatttcct

SEQ ID NO: 44787 - DNA, 25 bp, Homo sapien
catctagtttgaagtacggcatcat

SEQ ID NO: 44788 - DNA, 25 bp, Homo sapien
catctagtttgaggtacggcatcat

SEQ ID NO: 44789 - DNA, 25 bp, Homo sapien
catctataaaacaggttctttgaac

SEQ ID NO: 44790 - DNA, 25 bp, Homo sapien
catctataaaagaggttctttgaac

SEQ ID NO: 44791 - DNA, 25 bp, Homo sapien
catctatacacacaaagagtatgac

SEQ ID NO: 44792 - DNA, 25 bp, Homo sapien
catctatacgaacaacaaaaatata

SEQ ID NO: 44793 - DNA, 25 bp, Homo sapien
catctatatacacaaagagtatgac

SEQ ID NO: 44794 - DNA, 25 bp, Homo sapien
catctatatgaacaacaaaaatata

SEQ ID NO: 44795 - DNA, 25 bp, Homo sapien
catctatccgcagagctttttacaa

SEQ ID NO: 44796 - DNA, 25 bp, Homo sapien
catctatcggcagagctttttacaa

SEQ ID NO: 44797 - DNA, 25 bp, Homo sapien
catctatctattcgcgaacaaaagg

SEQ ID NO: 44798 - DNA, 25 bp, Homo sapien
catctatctattcgggaacaaaagg

SEQ ID NO: 44799 - DNA, 25 bp, Homo sapien
catctatgtaatgcggctaatgcca

SEQ ID NO: 44800 - DNA, 25 bp, Homo sapien
catctatgtaatggggctaatgcca

SEQ ID NO: 44801 - DNA, 25 bp, Homo sapien
catctattcatgaatttcctttcag

SEQ ID NO: 44802 - DNA, 25 bp, Homo sapien
catctattcattactataaagttcc

SEQ ID NO: 44803 - DNA, 25 bp, Homo sapien
catctattcattattataaagttcc

SEQ ID NO: 44804 - DNA, 25 bp, Homo sapien
catctattgcacagattattgttta

SEQ ID NO: 44805 - DNA, 25 bp, Homo sapien
catctattgcacggattattgttta

SEQ ID NO: 44806 - DNA, 25 bp, Homo sapien
catctattgccaagcacaagtaaaa

SEQ ID NO: 44807 - DNA, 25 bp, Homo sapien
catctattgccaagcataagtaaaa

SEQ ID NO: 44808 - DNA, 25 bp, Homo sapien
catctatttatgaatttcctttcag

SEQ ID NO: 44809 - DNA, 25 bp, Homo sapien
catctatttcagatgtggaatcgcg

SEQ ID NO: 44810 - DNA, 25 bp, Homo sapien
catctatttcagatttggaatcgcg

SEQ ID NO: 44811 - DNA, 25 bp, Homo sapien
catctcaaaaccaaagttcgctttc

SEQ ID NO: 44812 - DNA, 25 bp, Homo sapien
catctcaaaaccgaagttcgctttc

SEQ ID NO: 44813 - DNA, 25 bp, Homo sapien
catctcactgaagaagatttgttta

SEQ ID NO: 44814 - DNA, 25 bp, Homo sapien
catctcactgaagaggatttgttta

SEQ ID NO: 44815 - DNA, 25 bp, Homo sapien
catctcagaatatgtctggtcacta

SEQ ID NO: 44816 - DNA, 25 bp, Homo sapien
catctcagagccagaaaagggtttt

SEQ ID NO: 44817 - DNA, 25 bp, Homo sapien
catctcagagccggaaaagggtttt

SEQ ID NO: 44818 - DNA, 25 bp, Homo sapien
catctcagagtatgtctggtcacta

SEQ ID NO: 44819 - DNA, 25 bp, Homo sapien
catctcagctttcgatatgcctccc

SEQ ID NO: 44820 - DNA, 25 bp, Homo sapien
catctcagcttttgatatgcctccc

SEQ ID NO: 44821 - DNA, 25 bp, Homo sapien
catctcagtctcacacagaaatatt

SEQ ID NO: 44822 - DNA, 25 bp, Homo sapien
catctcagtctcacacggaaatatt

SEQ ID NO: 44823 - DNA, 25 bp, Homo sapien
catctcattacatctgaatttatgc

SEQ ID NO: 44824 - DNA, 25 bp, Homo sapien
catctcattgcatctgaatttatgc

SEQ ID NO: 44825 - DNA, 25 bp, Homo sapien
catctccaagttctgaaatgctcaa

SEQ ID NO: 44826 - DNA, 25 bp, Homo sapien
catctccaatagtaatcatgtctct

SEQ ID NO: 44827 - DNA, 25 bp, Homo sapien
catctccagtagtaatcatgtctct

SEQ ID NO: 44828 - DNA, 25 bp, Homo sapien
catctccatgttctgaaatgctcaa

SEQ ID NO: 44829 - DNA, 25 bp, Homo sapien
catctccgcataagtcatattttgt

SEQ ID NO: 44830 - DNA, 25 bp, Homo sapien
catctccgcatgagtcatattttgt

SEQ ID NO: 44831 - DNA, 25 bp, Homo sapien
catctccttcaacgagcttgttgtc

SEQ ID NO: 44832 - DNA, 25 bp, Homo sapien
catctccttcaatgagcttgttgtc

SEQ ID NO: 44833 - DNA, 25 bp, Homo sapien
catctctaatttgggaaatgatcaa

SEQ ID NO: 44834 - DNA, 25 bp, Homo sapien
catctctaattttggaaatgatcaa

SEQ ID NO: 44835 - DNA, 25 bp, Homo sapien
catctctactctctctcaaaggaat

SEQ ID NO: 44836 - DNA, 25 bp, Homo sapien
catctctatcgcatggcagccttac

SEQ ID NO: 44837 - DNA, 25 bp, Homo sapien
catctctattctctctcaaaggaat

SEQ ID NO: 44838 - DNA, 25 bp, Homo sapien
catctctattgcatggcagccttac

SEQ ID NO: 44839 - DNA, 25 bp, Homo sapien
catctctccctttcactgcttctga

SEQ ID NO: 44840 - DNA, 25 bp, Homo sapien
catctctccctttcgctgcttctga

SEQ ID NO: 44841 - DNA, 25 bp, Homo sapien
catctctctcattcacattgtgtct

SEQ ID NO: 44842 - DNA, 25 bp, Homo sapien
catctctctcattcacgttgtgtct

SEQ ID NO: 44843 - DNA, 25 bp, Homo sapien
catctctctgttcattcccagcacc

SEQ ID NO: 44844 - DNA, 25 bp, Homo sapien
catctctctgtttattcccagcacc

SEQ ID NO: 44845 - DNA, 25 bp, Homo sapien
catctctgactctcactgatattta

SEQ ID NO: 44846 - DNA, 25 bp, Homo sapien
catctctgactctcgctgatattta

SEQ ID NO: 44847 - DNA, 25 bp, Homo sapien
catctctgcaaatacctagtactgt

SEQ ID NO: 44848 - DNA, 25 bp, Homo sapien
catctctgcaaatagctagtactgt

SEQ ID NO: 44849 - DNA, 25 bp, Homo sapien
catctctggtatatggtaggtagtg

SEQ ID NO: 44850 - DNA, 25 bp, Homo sapien
catctctggtatattgtaggtagtg

SEQ ID NO: 44851 - DNA, 25 bp, Homo sapien
catctctgtaagcctgttttgctca

SEQ ID NO: 44852 - DNA, 25 bp, Homo sapien
catctctgtaagtctgttttgctca

SEQ ID NO: 44853 - DNA, 25 bp, Homo sapien
catctctgttgctcaactgcactct

SEQ ID NO: 44854 - DNA, 25 bp, Homo sapien
catctctgttgctcgactgcactct

SEQ ID NO: 44855 - DNA, 25 bp, Homo sapien
catctcttcattgtgcttgtgattt

SEQ ID NO: 44856 - DNA, 25 bp, Homo sapien
catctcttcttgttctcatggttta

SEQ ID NO: 44857 - DNA, 25 bp, Homo sapien
catctcttggcctcaacctgtcctg

SEQ ID NO: 44858 - DNA, 25 bp, Homo sapien
catctcttggcttcaacctgtcctg

SEQ ID NO: 44859 - DNA, 25 bp, Homo sapien
catctctttattgtgcttgtgattt

SEQ ID NO: 44860 - DNA, 25 bp, Homo sapien
catctctttttgttctcatggttta

SEQ ID NO: 44861 - DNA, 25 bp, Homo sapien
catctgaaaccttgaaacaagtcag

SEQ ID NO: 44862 - DNA, 25 bp, Homo sapien
catctgaacccttgaaacaagtcag

SEQ ID NO: 44863 - DNA, 25 bp, Homo sapien
catctgacaattggcctaacaggaa

SEQ ID NO: 44864 - DNA, 25 bp, Homo sapien
catctgacagttggcctaacaggaa

SEQ ID NO: 44865 - DNA, 25 bp, Homo sapien
catctgacatggcatttgcacattt

SEQ ID NO: 44866 - DNA, 25 bp, Homo sapien
catctgacatggcgtttgcacattt

SEQ ID NO: 44867 - DNA, 25 bp, Homo sapien
catctgaccgcttgttcactttatg

SEQ ID NO: 44868 - DNA, 25 bp, Homo sapien
catctgaccgcttgtttactttatg

SEQ ID NO: 44869 - DNA, 25 bp, Homo sapien
catctgactgagaaatgatccttgg

SEQ ID NO: 44870 - DNA, 25 bp, Homo sapien
catctgactgagaaattatccttgg

SEQ ID NO: 44871 - DNA, 25 bp, Homo sapien
catctgagaacctagaggaagatgc

SEQ ID NO: 44872 - DNA, 25 bp, Homo sapien
catctgagaacctggaggaagatgc

SEQ ID NO: 44873 - DNA, 25 bp, Homo sapien
catctgagcacaagtgatgggcgtg

SEQ ID NO: 44874 - DNA, 25 bp, Homo sapien
catctgagcccatttccattagtat

SEQ ID NO: 44875 - DNA, 25 bp, Homo sapien
catctgagcccatttcgattagtat

SEQ ID NO: 44876 - DNA, 25 bp, Homo sapien
catctgagtacaagtgatgggcgtg

SEQ ID NO: 44877 - DNA, 25 bp, Homo sapien
catctgagtacatttccgggtcggc

SEQ ID NO: 44878 - DNA, 25 bp, Homo sapien
catctgagtacatttctgggtcggc

SEQ ID NO: 44879 - DNA, 25 bp, Homo sapien
catctgcacatctagtccaccctca

SEQ ID NO: 44880 - DNA, 25 bp, Homo sapien
catctgcaccattttacactctctt

SEQ ID NO: 44881 - DNA, 25 bp, Homo sapien
catctgcagatctagtccaccctca

SEQ ID NO: 44882 - DNA, 25 bp, Homo sapien
catctgcatcattttacactctctt

SEQ ID NO: 44883 - DNA, 25 bp, Homo sapien
catctgcatttcactttaatgaatc

SEQ ID NO: 44884 - DNA, 25 bp, Homo sapien
catctgcatttcagtttaatgaatc

SEQ ID NO: 44885 - DNA, 25 bp, Homo sapien
catctgccaaaacatccttagaatt

SEQ ID NO: 44886 - DNA, 25 bp, Homo sapien
catctgccaaagcatccttagaatt

SEQ ID NO: 44887 - DNA, 25 bp, Homo sapien
catctgctctgacgccctagggaca

SEQ ID NO: 44888 - DNA, 25 bp, Homo sapien
catctgctctgatgccctagggaca

SEQ ID NO: 44889 - DNA, 25 bp, Homo sapien
catctgctgaacacacattttaata

SEQ ID NO: 44890 - DNA, 25 bp, Homo sapien
catctgctgaacatacattttaata

SEQ ID NO: 44891 - DNA, 25 bp, Homo sapien
catctgggaaagattttctcattga

SEQ ID NO: 44892 - DNA, 25 bp, Homo sapien
catctgggaagtcaaatgcctcttt

SEQ ID NO: 44893 - DNA, 25 bp, Homo sapien
catctgggaagtcgaatgcctcttt

SEQ ID NO: 44894 - DNA, 25 bp, Homo sapien
catctgggagagattttctcattga

SEQ ID NO: 44895 - DNA, 25 bp, Homo sapien
catctggtaaccgtgtgtttaataa

SEQ ID NO: 44896 - DNA, 25 bp, Homo sapien
catctggtaactgtgtgtttaataa

SEQ ID NO: 44897 - DNA, 25 bp, Homo sapien
catctggtaagggtcatcccatggt

SEQ ID NO: 44898 - DNA, 25 bp, Homo sapien
catctggtgagggtcatcccatggt

SEQ ID NO: 44899 - DNA, 25 bp, Homo sapien
catctgtcccacgcaaattcctttc

SEQ ID NO: 44900 - DNA, 25 bp, Homo sapien
catctgtcccatgcaaattcctttc

SEQ ID NO: 44901 - DNA, 25 bp, Homo sapien
catctgtcttatatggcatgcttct

SEQ ID NO: 44902 - DNA, 25 bp, Homo sapien
catctgtcttatgtggcatgcttct

SEQ ID NO: 44903 - DNA, 25 bp, Homo sapien
catctgtgcaaggatcgtctttatt

SEQ ID NO: 44904 - DNA, 25 bp, Homo sapien
catctgtgcaaggatcttctttatt

SEQ ID NO: 44905 - DNA, 25 bp, Homo sapien
catctgtgctgatcgttgtagtgtg

SEQ ID NO: 44906 - DNA, 25 bp, Homo sapien
catctgtgctgattgttgtagtgtg

SEQ ID NO: 44907 - DNA, 25 bp, Homo sapien
catctgtggacctgttattttccat

SEQ ID NO: 44908 - DNA, 25 bp, Homo sapien
catctgtggaccttttattttccat

SEQ ID NO: 44909 - DNA, 25 bp, Homo sapien
catctgttaatgtaaatgtattttg

SEQ ID NO: 44910 - DNA, 25 bp, Homo sapien
catctgttaatgtgaatgtattttg

SEQ ID NO: 44911 - DNA, 25 bp, Homo sapien
catctgttcatatatctgcttccca

SEQ ID NO: 44912 - DNA, 25 bp, Homo sapien
catctgttcatatgtctgcttccca

SEQ ID NO: 44913 - DNA, 25 bp, Homo sapien
catctgttctcctttgtttgcagtt

SEQ ID NO: 44914 - DNA, 25 bp, Homo sapien
catctgttctcgtttgtttgcagtt

SEQ ID NO: 44915 - DNA, 25 bp, Homo sapien
catcttaactcactacagcttcaag

SEQ ID NO: 44916 - DNA, 25 bp, Homo sapien
catcttaactcattacagcttcaag

SEQ ID NO: 44917 - DNA, 25 bp, Homo sapien
catcttaccatctctaacctatgtg

SEQ ID NO: 44918 - DNA, 25 bp, Homo sapien
catcttactatctctaacctatgtg

SEQ ID NO: 44919 - DNA, 25 bp, Homo sapien
catcttattccatggacatcaggct

SEQ ID NO: 44920 - DNA, 25 bp, Homo sapien
catcttattccgtggacatcaggct

SEQ ID NO: 44921 - DNA, 25 bp, Homo sapien
catcttcatagagataaaagttgtg

SEQ ID NO: 44922 - DNA, 25 bp, Homo sapien
catcttcatggagataaaagttgtg

SEQ ID NO: 44923 - DNA, 25 bp, Homo sapien
catcttcattttagccacatgagac

SEQ ID NO: 44924 - DNA, 25 bp, Homo sapien
catcttcattttcgccacatgagac

SEQ ID NO: 44925 - DNA, 25 bp, Homo sapien
catcttctcctgcctaaacaacagc

SEQ ID NO: 44926 - DNA, 25 bp, Homo sapien
catcttctcctgtctaaacaacagc

SEQ ID NO: 44927 - DNA, 25 bp, Homo sapien
catcttctgaacttcgacttcgcac

SEQ ID NO: 44928 - DNA, 25 bp, Homo sapien
catcttctgaactttgacttcgcac

SEQ ID NO: 44929 - DNA, 25 bp, Homo sapien
catcttgagcgtattgccttatctg

SEQ ID NO: 44930 - DNA, 25 bp, Homo sapien
catcttgagcgtgttgccttatctg

SEQ ID NO: 44931 - DNA, 25 bp, Homo sapien
catcttgcaaaaaatgaaactcttt

SEQ ID NO: 44932 - DNA, 25 bp, Homo sapien
catcttgcaaataatgaaactcttt

SEQ ID NO: 44933 - DNA, 25 bp, Homo sapien
catcttgtcacctttttatttagat

SEQ ID NO: 44934 - DNA, 25 bp, Homo sapien
catcttgtcacttttttatttagat

SEQ ID NO: 44935 - DNA, 25 bp, Homo sapien
catcttgtggagaccattttaacca

SEQ ID NO: 44936 - DNA, 25 bp, Homo sapien
catcttgtggagatcattttaacca

SEQ ID NO: 44937 - DNA, 25 bp, Homo sapien
catcttgtgttcatgatattctgtc

SEQ ID NO: 44938 - DNA, 25 bp, Homo sapien
catcttgtgtttatgatattctgtc

SEQ ID NO: 44939 - DNA, 25 bp, Homo sapien
catctttaatatacggttagtgtgt

SEQ ID NO: 44940 - DNA, 25 bp, Homo sapien
catctttaatatactgttagtgtgt

SEQ ID NO: 44941 - DNA, 25 bp, Homo sapien
catctttcaagacacagcgcaggac

SEQ ID NO: 44942 - DNA, 25 bp, Homo sapien
catctttcaaggcacagcgcaggac

SEQ ID NO: 44943 - DNA, 25 bp, Homo sapien
catctttgccattggtttgtacaag

SEQ ID NO: 44944 - DNA, 25 bp, Homo sapien
catctttgccattgttttgtacaag

SEQ ID NO: 44945 - DNA, 25 bp, Homo sapien
catctttgccgtgatttgagtcaca

SEQ ID NO: 44946 - DNA, 25 bp, Homo sapien
catctttgctgtgatttgagtcaca

SEQ ID NO: 44947 - DNA, 25 bp, Homo sapien
catctttgggaggaggcttcttatt

SEQ ID NO: 44948 - DNA, 25 bp, Homo sapien
catctttgggaggagggttcttatt

SEQ ID NO: 44949 - DNA, 25 bp, Homo sapien
catctttgttgatctaccaatctcc

SEQ ID NO: 44950 - DNA, 25 bp, Homo sapien
catctttgttggtctaccaatctcc

SEQ ID NO: 44951 - DNA, 25 bp, Homo sapien
catcttttaagaatgcttgtaatta

SEQ ID NO: 44952 - DNA, 25 bp, Homo sapien
catcttttaaggatgcttgtaatta

SEQ ID NO: 44953 - DNA, 25 bp, Homo sapien
catcttttatccaacaaagtataaa

SEQ ID NO: 44954 - DNA, 25 bp, Homo sapien
catcttttatccatcaaagtataaa

SEQ ID NO: 44955 - DNA, 25 bp, Homo sapien
catcttttcgaggccattcatgtta

SEQ ID NO: 44956 - DNA, 25 bp, Homo sapien
catcttttcgcccctgctaatggag

SEQ ID NO: 44957 - DNA, 25 bp, Homo sapien
catctttttctacaaatatgatcat

SEQ ID NO: 44958 - DNA, 25 bp, Homo sapien
catctttttctataaatatgatcat

SEQ ID NO: 44959 - DNA, 25 bp, Homo sapien
catctttttgaggccattcatgtta

SEQ ID NO: 44960 - DNA, 25 bp, Homo sapien
catctttttgcccctgctaatggag

SEQ ID NO: 44961 - DNA, 25 bp, Homo sapien
catgaaaaattctgagaagccctct

SEQ ID NO: 44962 - DNA, 25 bp, Homo sapien
catgaaaaattggcacctagttctt

SEQ ID NO: 44963 - DNA, 25 bp, Homo sapien
catgaaaaccaacgctttgtctctg

SEQ ID NO: 44964 - DNA, 25 bp, Homo sapien
catgaaaaccaatgctttgtctctg

SEQ ID NO: 44965 - DNA, 25 bp, Homo sapien
catgaaaagttctgagaagccctct

SEQ ID NO: 44966 - DNA, 25 bp, Homo sapien
catgaaaagttggcacctagttctt

SEQ ID NO: 44967 - DNA, 25 bp, Homo sapien
catgaaaatttaaaaggactagaat

SEQ ID NO: 44968 - DNA, 25 bp, Homo sapien
catgaaaattttaaaggactagaat

SEQ ID NO: 44969 - DNA, 25 bp, Homo sapien
catgaaagaaaaggcctggaaaggt

SEQ ID NO: 44970 - DNA, 25 bp, Homo sapien
catgaaagagatagcggatatggca

SEQ ID NO: 44971 - DNA, 25 bp, Homo sapien
catgaaagagatagtggatatggca

SEQ ID NO: 44972 - DNA, 25 bp, Homo sapien
catgaaagcaaaggcctggaaaggt

SEQ ID NO: 44973 - DNA, 25 bp, Homo sapien
catgaaagcgttagtatgaaataac

SEQ ID NO: 44974 - DNA, 25 bp, Homo sapien
catgaaagtgttagtatgaaataac

SEQ ID NO: 44975 - DNA, 25 bp, Homo sapien
catgaaagttgtaaatttgaagaag

SEQ ID NO: 44976 - DNA, 25 bp, Homo sapien
catgaaagttgtacatttgaagaag

SEQ ID NO: 44977 - DNA, 25 bp, Homo sapien
catgaaatccaaacctcgtcaggaa

SEQ ID NO: 44978 - DNA, 25 bp, Homo sapien
catgaaatgcttagaaacctgagaa

SEQ ID NO: 44979 - DNA, 25 bp, Homo sapien
catgaaatgcttagaatcctgagaa

SEQ ID NO: 44980 - DNA, 25 bp, Homo sapien
catgaaattcaaacctcgtcaggaa

SEQ ID NO: 44981 - DNA, 25 bp, Homo sapien
catgaaattcagtcaaggcagctgg

SEQ ID NO: 44982 - DNA, 25 bp, Homo sapien
catgaaattgagtcaaggcagctgg

SEQ ID NO: 44983 - DNA, 25 bp, Homo sapien
catgaacaattttaagaattacatc

SEQ ID NO: 44984 - DNA, 25 bp, Homo sapien
catgaacacgatatttttgtaacct

SEQ ID NO: 44985 - DNA, 25 bp, Homo sapien
catgaacactatatttttgtaacct

SEQ ID NO: 44986 - DNA, 25 bp, Homo sapien
catgaacacttttaagaattacatc

SEQ ID NO: 44987 - DNA, 25 bp, Homo sapien
catgaacctgtaaaattgcaaatgg

SEQ ID NO: 44988 - DNA, 25 bp, Homo sapien
catgaacctgtaacattgcaaatgg

SEQ ID NO: 44989 - DNA, 25 bp, Homo sapien
catgaactaaaaagcattacagttt

SEQ ID NO: 44990 - DNA, 25 bp, Homo sapien
catgaactcagcattggaagttttt

SEQ ID NO: 44991 - DNA, 25 bp, Homo sapien
catgaactcagcgttggaagttttt

SEQ ID NO: 44992 - DNA, 25 bp, Homo sapien
catgaactgaaaagcattacagttt

SEQ ID NO: 44993 - DNA, 25 bp, Homo sapien
catgaacttttccaggcttttgatc

SEQ ID NO: 44994 - DNA, 25 bp, Homo sapien
catgaacttttcccggcttttgatc

SEQ ID NO: 44995 - DNA, 25 bp, Homo sapien
catgaagacatcattgcagcatgat

SEQ ID NO: 44996 - DNA, 25 bp, Homo sapien
catgaagacgtcattgcagcatgat

SEQ ID NO: 44997 - DNA, 25 bp, Homo sapien
catgaagaggtgccataattattaa

SEQ ID NO: 44998 - DNA, 25 bp, Homo sapien
catgaagaggtgccgtaattattaa

SEQ ID NO: 44999 - DNA, 25 bp, Homo sapien
catgaagagtccttcctcagcttgg

SEQ ID NO: 45000 - DNA, 25 bp, Homo sapien
catgaagagtctttcctcagcttgg

SEQ ID NO: 45001 - DNA, 25 bp, Homo sapien
catgaagcagccggaaagatctatg

SEQ ID NO: 45002 - DNA, 25 bp, Homo sapien
catgaagcagctggaaagatctatg

SEQ ID NO: 45003 - DNA, 25 bp, Homo sapien
catgaagcctgacaatttaaaaagg

SEQ ID NO: 45004 - DNA, 25 bp, Homo sapien
catgaagcctgacgatttaaaaagg

SEQ ID NO: 45005 - DNA, 25 bp, Homo sapien
catgaagggaagccaacttccgatg

SEQ ID NO: 45006 - DNA, 25 bp, Homo sapien
catgaagggaagccaatttccgatg

SEQ ID NO: 45007 - DNA, 25 bp, Homo sapien
catgaagtccaaagtggtggccatt

SEQ ID NO: 45008 - DNA, 25 bp, Homo sapien
catgaagtccaaagtgttggccatt

SEQ ID NO: 45009 - DNA, 25 bp, Homo sapien
catgaagttttaaataaggaacaca

SEQ ID NO: 45010 - DNA, 25 bp, Homo sapien
catgaagttttaaatacggaacaca

SEQ ID NO: 45011 - DNA, 25 bp, Homo sapien
catgaataaaaccgttctcaggatg

SEQ ID NO: 45012 - DNA, 25 bp, Homo sapien
catgaataaaactgttctcaggatg

SEQ ID NO: 45013 - DNA, 25 bp, Homo sapien
catgaatcatctttcgctcaaataa

SEQ ID NO: 45014 - DNA, 25 bp, Homo sapien
catgaatcatcttttgctcaaataa

SEQ ID NO: 45015 - DNA, 25 bp, Homo sapien
catgaatctatttactccagaagca

SEQ ID NO: 45016 - DNA, 25 bp, Homo sapien
catgaatctatttacttcagaagca

SEQ ID NO: 45017 - DNA, 25 bp, Homo sapien
catgaatgaattttcccgagggcag

SEQ ID NO: 45018 - DNA, 25 bp, Homo sapien
catgaatgaattttcctgagggcag

SEQ ID NO: 45019 - DNA, 25 bp, Homo sapien
catgaatggtcagaatcaatatcat

SEQ ID NO: 45020 - DNA, 25 bp, Homo sapien
catgaatggtcagaatgaatatcat

SEQ ID NO: 45021 - DNA, 25 bp, Homo sapien
catgacaaaagacaagaagagagca

SEQ ID NO: 45022 - DNA, 25 bp, Homo sapien
catgacaaaagaccagaagagagca

SEQ ID NO: 45023 - DNA, 25 bp, Homo sapien
catgacaattaccacactataaact

SEQ ID NO: 45024 - DNA, 25 bp, Homo sapien
catgacaattactacactataaact

SEQ ID NO: 45025 - DNA, 25 bp, Homo sapien
catgacacacctattgatatgtggc

SEQ ID NO: 45026 - DNA, 25 bp, Homo sapien
catgacacagctattgatatgtggc

SEQ ID NO: 45027 - DNA, 25 bp, Homo sapien
catgacaccagttttcagatggggt

SEQ ID NO: 45028 - DNA, 25 bp, Homo sapien
catgacactagttttcagatggggt

SEQ ID NO: 45029 - DNA, 25 bp, Homo sapien
catgacactctcaggacgctgcaag

SEQ ID NO: 45030 - DNA, 25 bp, Homo sapien
catgacactctcaggatgctgcaag

SEQ ID NO: 45031 - DNA, 25 bp, Homo sapien
catgacatattcaaagtgctaaaag

SEQ ID NO: 45032 - DNA, 25 bp, Homo sapien
catgacatattcgaagtgctaaaag

SEQ ID NO: 45033 - DNA, 25 bp, Homo sapien
catgacatgtggtcaccagctgttg

SEQ ID NO: 45034 - DNA, 25 bp, Homo sapien
catgacatgtggtcacgagctgttg

SEQ ID NO: 45035 - DNA, 25 bp, Homo sapien
catgaccaactgagatttatctctt

SEQ ID NO: 45036 - DNA, 25 bp, Homo sapien
catgaccaactgggatttatctctt

SEQ ID NO: 45037 - DNA, 25 bp, Homo sapien
catgaccaagctgacaatgaaatga

SEQ ID NO: 45038 - DNA, 25 bp, Homo sapien
catgaccaagctgacactgaaatga

SEQ ID NO: 45039 - DNA, 25 bp, Homo sapien
catgaccatgaagtgggttcacata

SEQ ID NO: 45040 - DNA, 25 bp, Homo sapien
catgaccatgaggtgggttcacata

SEQ ID NO: 45041 - DNA, 25 bp, Homo sapien
catgacctaatcatctattaaaggc

SEQ ID NO: 45042 - DNA, 25 bp, Homo sapien
catgacctaatcatctcttaaaggc

SEQ ID NO: 45043 - DNA, 25 bp, Homo sapien
catgacctgaacaaagatcagtaga

SEQ ID NO: 45044 - DNA, 25 bp, Homo sapien
catgacctgaaccaagatcagtaga

SEQ ID NO: 45045 - DNA, 25 bp, Homo sapien
catgacgagttacagaaggtagaac

SEQ ID NO: 45046 - DNA, 25 bp, Homo sapien
catgacgagttacggaaggtagaac

SEQ ID NO: 45047 - DNA, 25 bp, Homo sapien
catgacgcttgtaagtggagctatt

SEQ ID NO: 45048 - DNA, 25 bp, Homo sapien
catgacgcttgtgagtggagctatt

SEQ ID NO: 45049 - DNA, 25 bp, Homo sapien
catgactgcaatgactgctcctggg

SEQ ID NO: 45050 - DNA, 25 bp, Homo sapien
catgactggaatgactgctcctggg

SEQ ID NO: 45051 - DNA, 25 bp, Homo sapien
catgactttaaccggtcgatctcaa

SEQ ID NO: 45052 - DNA, 25 bp, Homo sapien
catgactttaactggtcgatctcaa

SEQ ID NO: 45053 - DNA, 25 bp, Homo sapien
catgactttctcatggcggaaggca

SEQ ID NO: 45054 - DNA, 25 bp, Homo sapien
catgactttctcatggtggaaggca

SEQ ID NO: 45055 - DNA, 25 bp, Homo sapien
catgacttttcaggatatattctta

SEQ ID NO: 45056 - DNA, 25 bp, Homo sapien
catgacttttcagtatatattctta

SEQ ID NO: 45057 - DNA, 25 bp, Homo sapien
catgagaaaccctgatagaaggaag

SEQ ID NO: 45058 - DNA, 25 bp, Homo sapien
catgagaaaccttgatagaaggaag

SEQ ID NO: 45059 - DNA, 25 bp, Homo sapien
catgagaaatggcctctccgtgagc

SEQ ID NO: 45060 - DNA, 25 bp, Homo sapien
catgagaaatggtctctccgtgagc

SEQ ID NO: 45061 - DNA, 25 bp, Homo sapien
catgagagattccgacagtttcttg

SEQ ID NO: 45062 - DNA, 25 bp, Homo sapien
catgagagattctgacagtttcttg

SEQ ID NO: 45063 - DNA, 25 bp, Homo sapien
catgagatcacttaggaaatgagtg

SEQ ID NO: 45064 - DNA, 25 bp, Homo sapien
catgagatcgcttaggaaatgagtg

SEQ ID NO: 45065 - DNA, 25 bp, Homo sapien
catgaggcattgctttcgcttcatt

SEQ ID NO: 45066 - DNA, 25 bp, Homo sapien
catgaggcattgcttttgcttcatt

SEQ ID NO: 45067 - DNA, 25 bp, Homo sapien
catgaggttaagagcaatatttttt

SEQ ID NO: 45068 - DNA, 25 bp, Homo sapien
catgaggttgagagcaatatttttt

SEQ ID NO: 45069 - DNA, 25 bp, Homo sapien
catgagtaaggcgacttgactttga

SEQ ID NO: 45070 - DNA, 25 bp, Homo sapien
catgagtaaggtgacttgactttga

SEQ ID NO: 45071 - DNA, 25 bp, Homo sapien
catgagtgtcaaaaaccgatgatga

SEQ ID NO: 45072 - DNA, 25 bp, Homo sapien
catgagtgtcaaaacccgatgatga

SEQ ID NO: 45073 - DNA, 25 bp, Homo sapien
catgagttttgcatgttgcgttcca

SEQ ID NO: 45074 - DNA, 25 bp, Homo sapien
catgagttttgcgtgttgcgttcca

SEQ ID NO: 45075 - DNA, 25 bp, Homo sapien
catgataaaagcttgcttatttaag

SEQ ID NO: 45076 - DNA, 25 bp, Homo sapien
catgataaaaggttgcttatttaag

SEQ ID NO: 45077 - DNA, 25 bp, Homo sapien
catgataagctgggttcttaaaaat

SEQ ID NO: 45078 - DNA, 25 bp, Homo sapien
catgataatctgggttcttaaaaat

SEQ ID NO: 45079 - DNA, 25 bp, Homo sapien
catgatacaacatatgaacttgtaa

SEQ ID NO: 45080 - DNA, 25 bp, Homo sapien
catgatacaacttatgaacttgtaa

SEQ ID NO: 45081 - DNA, 25 bp, Homo sapien
catgataccatctcctctctataac

SEQ ID NO: 45082 - DNA, 25 bp, Homo sapien
catgatactatctcctctctataac

SEQ ID NO: 45083 - DNA, 25 bp, Homo sapien
catgatatacactgaaattagggat

SEQ ID NO: 45084 - DNA, 25 bp, Homo sapien
catgatatacattgaaattagggat

SEQ ID NO: 45085 - DNA, 25 bp, Homo sapien
catgatcaaatacaaacagatggaa

SEQ ID NO: 45086 - DNA, 25 bp, Homo sapien
catgatcaaatacacacagatggaa

SEQ ID NO: 45087 - DNA, 25 bp, Homo sapien
catgatcaagtctgcttagaaagga

SEQ ID NO: 45088 - DNA, 25 bp, Homo sapien
catgatcaagtctgtttagaaagga

SEQ ID NO: 45089 - DNA, 25 bp, Homo sapien
catgatcaatcctggtctttatacc

SEQ ID NO: 45090 - DNA, 25 bp, Homo sapien
catgatcagtcctggtctttatacc

SEQ ID NO: 45091 - DNA, 25 bp, Homo sapien
catgatcgggtaaagagattgattc

SEQ ID NO: 45092 - DNA, 25 bp, Homo sapien
catgatcgtgtaaagagattgattc

SEQ ID NO: 45093 - DNA, 25 bp, Homo sapien
catgatcttcccagagattttttaa

SEQ ID NO: 45094 - DNA, 25 bp, Homo sapien
catgatcttcccggagattttttaa

SEQ ID NO: 45095 - DNA, 25 bp, Homo sapien
catgatgacgacttagctctcagag

SEQ ID NO: 45096 - DNA, 25 bp, Homo sapien
catgatgaggacttagctctcagag

SEQ ID NO: 45097 - DNA, 25 bp, Homo sapien
catgatgaggagtacaagagttact

SEQ ID NO: 45098 - DNA, 25 bp, Homo sapien
catgatgaggagtagaagagttact

SEQ ID NO: 45099 - DNA, 25 bp, Homo sapien
catgatgcagatcccctgaattttc

SEQ ID NO: 45100 - DNA, 25 bp, Homo sapien
catgatgctgatcccctgaattttc

SEQ ID NO: 45101 - DNA, 25 bp, Homo sapien
catgatgttcccagctcatttggct

SEQ ID NO: 45102 - DNA, 25 bp, Homo sapien
catgatgttcccaggtcatttggct

SEQ ID NO: 45103 - DNA, 25 bp, Homo sapien
catgatgttcttattccaatccatc

SEQ ID NO: 45104 - DNA, 25 bp, Homo sapien
catgatgttcttgttccaatccatc

SEQ ID NO: 45105 - DNA, 25 bp, Homo sapien
catgattaaattcagctctggtgta

SEQ ID NO: 45106 - DNA, 25 bp, Homo sapien
catgattaaatttagctctggtgta

SEQ ID NO: 45107 - DNA, 25 bp, Homo sapien
catgattacttgtccattaaggcaa

SEQ ID NO: 45108 - DNA, 25 bp, Homo sapien
catgattatttgtccattaaggcaa

SEQ ID NO: 45109 - DNA, 25 bp, Homo sapien
catgattcagcataatctgtttttc

SEQ ID NO: 45110 - DNA, 25 bp, Homo sapien
catgattcagcgtaatctgtttttc

SEQ ID NO: 45111 - DNA, 25 bp, Homo sapien
catgattcctgagaaatattgcacc

SEQ ID NO: 45112 - DNA, 25 bp, Homo sapien
catgattcttgagaaatattgcacc

SEQ ID NO: 45113 - DNA, 25 bp, Homo sapien
catgattttctctgcaatttaacat

SEQ ID NO: 45114 - DNA, 25 bp, Homo sapien
catgattttctcttcaatttaacat

SEQ ID NO: 45115 - DNA, 25 bp, Homo sapien
catgcaaaagaggaactgcaaaatt

SEQ ID NO: 45116 - DNA, 25 bp, Homo sapien
catgcaaaggaggaactgcaaaatt

SEQ ID NO: 45117 - DNA, 25 bp, Homo sapien
catgcaactctgcgatgttggaaag

SEQ ID NO: 45118 - DNA, 25 bp, Homo sapien
catgcaactctgcgctgttggaaag

SEQ ID NO: 45119 - DNA, 25 bp, Homo sapien
catgcaatagatccagggtgtatgc

SEQ ID NO: 45120 - DNA, 25 bp, Homo sapien
catgcaatgaagacattggactgag

SEQ ID NO: 45121 - DNA, 25 bp, Homo sapien
catgcaatgaagatattggactgag

SEQ ID NO: 45122 - DNA, 25 bp, Homo sapien
catgcaatggatccagggtgtatgc

SEQ ID NO: 45123 - DNA, 25 bp, Homo sapien
catgcaattttgtggccatgtttcc

SEQ ID NO: 45124 - DNA, 25 bp, Homo sapien
catgcaattttgtggctatgtttcc

SEQ ID NO: 45125 - DNA, 25 bp, Homo sapien
catgcacaataccgacttataaaaa

SEQ ID NO: 45126 - DNA, 25 bp, Homo sapien
catgcacaatactgacttataaaaa

SEQ ID NO: 45127 - DNA, 25 bp, Homo sapien
catgcacacttgaataattagtgtt

SEQ ID NO: 45128 - DNA, 25 bp, Homo sapien
catgcacacttggataattagtgtt

SEQ ID NO: 45129 - DNA, 25 bp, Homo sapien
catgcactgtaataccagtccaatg

SEQ ID NO: 45130 - DNA, 25 bp, Homo sapien
catgcactttaataccagtccaatg

SEQ ID NO: 45131 - DNA, 25 bp, Homo sapien
catgcagatgacaggctgaaaggtt

SEQ ID NO: 45132 - DNA, 25 bp, Homo sapien
catgcagatgacgggctgaaaggtt

SEQ ID NO: 45133 - DNA, 25 bp, Homo sapien
catgcagattaatgaacgtatttga

SEQ ID NO: 45134 - DNA, 25 bp, Homo sapien
catgcagattaatggacgtatttga

SEQ ID NO: 45135 - DNA, 25 bp, Homo sapien
catgcaggccatgacaggctcattt

SEQ ID NO: 45136 - DNA, 25 bp, Homo sapien
catgcaggccatgataggctcattt

SEQ ID NO: 45137 - DNA, 25 bp, Homo sapien
catgcagtaatttcacccttgggaa

SEQ ID NO: 45138 - DNA, 25 bp, Homo sapien
catgcagtactttcacccttgggaa

SEQ ID NO: 45139 - DNA, 25 bp, Homo sapien
catgcagtccagcagaccatctagg

SEQ ID NO: 45140 - DNA, 25 bp, Homo sapien
catgcagtccagcggaccatctagg

SEQ ID NO: 45141 - DNA, 25 bp, Homo sapien
catgcagtctaaagataaaatgata

SEQ ID NO: 45142 - DNA, 25 bp, Homo sapien
catgcagtctaaggataaaatgata

SEQ ID NO: 45143 - DNA, 25 bp, Homo sapien
catgcagtgcggtgttcagagcctg

SEQ ID NO: 45144 - DNA, 25 bp, Homo sapien
catgcagtgtggtgttcagagcctg

SEQ ID NO: 45145 - DNA, 25 bp, Homo sapien
catgcatatacccatcacctccatt

SEQ ID NO: 45146 - DNA, 25 bp, Homo sapien
catgcatatacctatcacctccatt

SEQ ID NO: 45147 - DNA, 25 bp, Homo sapien
catgcatgccctgaatctaaaatag

SEQ ID NO: 45148 - DNA, 25 bp, Homo sapien
catgcatgccctgcatctaaaatag

SEQ ID NO: 45149 - DNA, 25 bp, Homo sapien
catgcatgtctttccccgtcgactg

SEQ ID NO: 45150 - DNA, 25 bp, Homo sapien
catgcatgtctttccctgtcgactg

SEQ ID NO: 45151 - DNA, 25 bp, Homo sapien
catgcattcatttacacttactgac

SEQ ID NO: 45152 - DNA, 25 bp, Homo sapien
catgcattcatttacagttactgac

SEQ ID NO: 45153 - DNA, 25 bp, Homo sapien
catgcattttcaaaatcactacagc

SEQ ID NO: 45154 - DNA, 25 bp, Homo sapien
catgcattttcaaattcactacagc

SEQ ID NO: 45155 - DNA, 25 bp, Homo sapien
catgccaagtggaataagccagaca

SEQ ID NO: 45156 - DNA, 25 bp, Homo sapien
catgccaagtggagtaagccagaca

SEQ ID NO: 45157 - DNA, 25 bp, Homo sapien
catgccaagttgaagaagcagacaa

SEQ ID NO: 45158 - DNA, 25 bp, Homo sapien
catgccaagttgcagaagcagacaa

SEQ ID NO: 45159 - DNA, 25 bp, Homo sapien
catgccaatacgacatacttttcat

SEQ ID NO: 45160 - DNA, 25 bp, Homo sapien
catgccaatactacatacttttcat

SEQ ID NO: 45161 - DNA, 25 bp, Homo sapien
catgccaatcaagaagaaaggagga

SEQ ID NO: 45162 - DNA, 25 bp, Homo sapien
catgccaatcaagaggaaaggagga

SEQ ID NO: 45163 - DNA, 25 bp, Homo sapien
catgccaccatatctggctaatctg

SEQ ID NO: 45164 - DNA, 25 bp, Homo sapien
catgccaccatttctggctaatctg

SEQ ID NO: 45165 - DNA, 25 bp, Homo sapien
catgccactaaaactggccaattaa

SEQ ID NO: 45166 - DNA, 25 bp, Homo sapien
catgccactaaatctggccaattaa

SEQ ID NO: 45167 - DNA, 25 bp, Homo sapien
catgccagacaaagagaagattcat

SEQ ID NO: 45168 - DNA, 25 bp, Homo sapien
catgccagacatagagaagattcat

SEQ ID NO: 45169 - DNA, 25 bp, Homo sapien
catgccagatgggtcatctcataca

SEQ ID NO: 45170 - DNA, 25 bp, Homo sapien
catgccagatgtgtcatctcataca

SEQ ID NO: 45171 - DNA, 25 bp, Homo sapien
catgccagcctaaggtttgtagttt

SEQ ID NO: 45172 - DNA, 25 bp, Homo sapien
catgccaggctaaggtttgtagttt

SEQ ID NO: 45173 - DNA, 25 bp, Homo sapien
catgcccaaatcacagtatgcgata

SEQ ID NO: 45174 - DNA, 25 bp, Homo sapien
catgcccaaatcacggtatgcgata

SEQ ID NO: 45175 - DNA, 25 bp, Homo sapien
catgcccactttcatttctctagtg

SEQ ID NO: 45176 - DNA, 25 bp, Homo sapien
catgcccacttttatttctctagtg

SEQ ID NO: 45177 - DNA, 25 bp, Homo sapien
catgcccagagattggatttaggtg

SEQ ID NO: 45178 - DNA, 25 bp, Homo sapien
catgcccagagatttgatttaggtg

SEQ ID NO: 45179 - DNA, 25 bp, Homo sapien
catgccctcaagcgatgccttttcc

SEQ ID NO: 45180 - DNA, 25 bp, Homo sapien
catgccctcaagtgatgccttttcc

SEQ ID NO: 45181 - DNA, 25 bp, Homo sapien
catgccctgaatctaaaatagaagt

SEQ ID NO: 45182 - DNA, 25 bp, Homo sapien
catgccctgcatctaaaatagaagt

SEQ ID NO: 45183 - DNA, 25 bp, Homo sapien
catgccggaatacatcaattcatct

SEQ ID NO: 45184 - DNA, 25 bp, Homo sapien
catgccggaatacatctattcatct

SEQ ID NO: 45185 - DNA, 25 bp, Homo sapien
catgcctcaagccaataaaagcccg

SEQ ID NO: 45186 - DNA, 25 bp, Homo sapien
catgcctcaagccaatgaaagcccg

SEQ ID NO: 45187 - DNA, 25 bp, Homo sapien
catgcctcactttactcctctgtaa

SEQ ID NO: 45188 - DNA, 25 bp, Homo sapien
catgcctcactttattcctctgtaa

SEQ ID NO: 45189 - DNA, 25 bp, Homo sapien
catgcctccgctgagctgtcaacaa

SEQ ID NO: 45190 - DNA, 25 bp, Homo sapien
catgcctctgctgagctgtcaacaa

SEQ ID NO: 45191 - DNA, 25 bp, Homo sapien
catgcctgaataattttttgtagag

SEQ ID NO: 45192 - DNA, 25 bp, Homo sapien
catgcctgactactgcagaaccatc

SEQ ID NO: 45193 - DNA, 25 bp, Homo sapien
catgcctgagtaattttttgtagag

SEQ ID NO: 45194 - DNA, 25 bp, Homo sapien
catgcctgccaacgcaacatccatt

SEQ ID NO: 45195 - DNA, 25 bp, Homo sapien
catgcctgccaatgcaacatccatt

SEQ ID NO: 45196 - DNA, 25 bp, Homo sapien
catgcctggcaacgttctgggtgct

SEQ ID NO: 45197 - DNA, 25 bp, Homo sapien
catgcctggcaatgttctgggtgct

SEQ ID NO: 45198 - DNA, 25 bp, Homo sapien
catgcctgtaaagtttctcattcaa

SEQ ID NO: 45199 - DNA, 25 bp, Homo sapien
catgcctgtctactgcagaaccatc

SEQ ID NO: 45200 - DNA, 25 bp, Homo sapien
catgcctgttaagtttctcattcaa

SEQ ID NO: 45201 - DNA, 25 bp, Homo sapien
catgccttaaccatgggtaacagtc

SEQ ID NO: 45202 - DNA, 25 bp, Homo sapien
catgccttaaccgtgggtaacagtc

SEQ ID NO: 45203 - DNA, 25 bp, Homo sapien
catgccttagaacatgcccatgaac

SEQ ID NO: 45204 - DNA, 25 bp, Homo sapien
catgccttagaatatgcccatgaac

SEQ ID NO: 45205 - DNA, 25 bp, Homo sapien
catgccttgatgacactcgttttgt

SEQ ID NO: 45206 - DNA, 25 bp, Homo sapien
catgccttgatgatactcgttttgt

SEQ ID NO: 45207 - DNA, 25 bp, Homo sapien
catgccttggtgtagaaaacttttt

SEQ ID NO: 45208 - DNA, 25 bp, Homo sapien
catgccttggtgtagataacttttt

SEQ ID NO: 45209 - DNA, 25 bp, Homo sapien
catgcgaagtttccttaagacagac

SEQ ID NO: 45210 - DNA, 25 bp, Homo sapien
catgcgaagttttcttaagacagac

SEQ ID NO: 45211 - DNA, 25 bp, Homo sapien
catgcgcagtttaaaaatttccagg

SEQ ID NO: 45212 - DNA, 25 bp, Homo sapien
catgcgcagttttaaaatttccagg

SEQ ID NO: 45213 - DNA, 25 bp, Homo sapien
catgctaattgtatgggatcactta

SEQ ID NO: 45214 - DNA, 25 bp, Homo sapien
catgctaattgtgtgggatcactta

SEQ ID NO: 45215 - DNA, 25 bp, Homo sapien
catgctactactaatcaattagttt

SEQ ID NO: 45216 - DNA, 25 bp, Homo sapien
catgctactgctaatcaattagttt

SEQ ID NO: 45217 - DNA, 25 bp, Homo sapien
catgctagaaatcagtgacaaataa

SEQ ID NO: 45218 - DNA, 25 bp, Homo sapien
catgctaggaatcagtgacaaataa

SEQ ID NO: 45219 - DNA, 25 bp, Homo sapien
catgctatggaacccagttttttct

SEQ ID NO: 45220 - DNA, 25 bp, Homo sapien
catgctatggaacccatttttttct

SEQ ID NO: 45221 - DNA, 25 bp, Homo sapien
catgctcaaacattcatccagaatg

SEQ ID NO: 45222 - DNA, 25 bp, Homo sapien
catgctcaagcattcatccagaatg

SEQ ID NO: 45223 - DNA, 25 bp, Homo sapien
catgctcaaggacagcaaaaatgag

SEQ ID NO: 45224 - DNA, 25 bp, Homo sapien
catgctcaaggacagcgaaaatgag

SEQ ID NO: 45225 - DNA, 25 bp, Homo sapien
catgctccatgaaataattgctttt

SEQ ID NO: 45226 - DNA, 25 bp, Homo sapien
catgctccatgacataattgctttt

SEQ ID NO: 45227 - DNA, 25 bp, Homo sapien
catgctccttcctgattccttaaat

SEQ ID NO: 45228 - DNA, 25 bp, Homo sapien
catgctccttcttgattccttaaat

SEQ ID NO: 45229 - DNA, 25 bp, Homo sapien
catgctctaatcactgaattaaata

SEQ ID NO: 45230 - DNA, 25 bp, Homo sapien
catgctctaatcattgaattaaata

SEQ ID NO: 45231 - DNA, 25 bp, Homo sapien
catgctgacgaacgtttgagttgtt

SEQ ID NO: 45232 - DNA, 25 bp, Homo sapien
catgctgactagttgcttgtgattt

SEQ ID NO: 45233 - DNA, 25 bp, Homo sapien
catgctgatgaacgtttgagttgtt

SEQ ID NO: 45234 - DNA, 25 bp, Homo sapien
catgctgattagttgcttgtgattt

SEQ ID NO: 45235 - DNA, 25 bp, Homo sapien
catgctgcaattttctttattcctt

SEQ ID NO: 45236 - DNA, 25 bp, Homo sapien
catgctgcagtcgcattttcaagga

SEQ ID NO: 45237 - DNA, 25 bp, Homo sapien
catgctgcagtctcattttcaagga

SEQ ID NO: 45238 - DNA, 25 bp, Homo sapien
catgctgcgattttctttattcctt

SEQ ID NO: 45239 - DNA, 25 bp, Homo sapien
catgctggctgcagttaacacagga

SEQ ID NO: 45240 - DNA, 25 bp, Homo sapien
catgctggctgcagtttacacagga

SEQ ID NO: 45241 - DNA, 25 bp, Homo sapien
catgctggcttgactactgtaactt

SEQ ID NO: 45242 - DNA, 25 bp, Homo sapien
catgctggcttgactattgtaactt

SEQ ID NO: 45243 - DNA, 25 bp, Homo sapien
catgctgggggaatagcattacctg

SEQ ID NO: 45244 - DNA, 25 bp, Homo sapien
catgctgggggaatcgcattacctg

SEQ ID NO: 45245 - DNA, 25 bp, Homo sapien
catgctgtctatctcaatgatatac

SEQ ID NO: 45246 - DNA, 25 bp, Homo sapien
catgctgtctatctcagtgatatac

SEQ ID NO: 45247 - DNA, 25 bp, Homo sapien
catgctgttaaaatggctgagtata

SEQ ID NO: 45248 - DNA, 25 bp, Homo sapien
catgctgttaaagtggctgagtata

SEQ ID NO: 45249 - DNA, 25 bp, Homo sapien
catgcttattttctaacgtcataat

SEQ ID NO: 45250 - DNA, 25 bp, Homo sapien
catgcttattttgtaacgtcataat

SEQ ID NO: 45251 - DNA, 25 bp, Homo sapien
catgcttcaacacccttctccttct

SEQ ID NO: 45252 - DNA, 25 bp, Homo sapien
catgcttcgacacccttctccttct

SEQ ID NO: 45253 - DNA, 25 bp, Homo sapien
catgctttcagttactttggataaa

SEQ ID NO: 45254 - DNA, 25 bp, Homo sapien
catgctttcagttattttggataaa

SEQ ID NO: 45255 - DNA, 25 bp, Homo sapien
catgcttttcccactcagctcattg

SEQ ID NO: 45256 - DNA, 25 bp, Homo sapien
catgcttttcccgctcagctcattg

SEQ ID NO: 45257 - DNA, 25 bp, Homo sapien
catggaaaaagggcctgacaaatga

SEQ ID NO: 45258 - DNA, 25 bp, Homo sapien
catggaaaaagggcttgacaaatga

SEQ ID NO: 45259 - DNA, 25 bp, Homo sapien
catggaaagactagacttgctgagt

SEQ ID NO: 45260 - DNA, 25 bp, Homo sapien
catggaaagactaggcttgctgagt

SEQ ID NO: 45261 - DNA, 25 bp, Homo sapien
catggaaagcagtaatggaaataaa

SEQ ID NO: 45262 - DNA, 25 bp, Homo sapien
catggaaagcagtaattgaaataaa

SEQ ID NO: 45263 - DNA, 25 bp, Homo sapien
catggaaataacggccagcataggt

SEQ ID NO: 45264 - DNA, 25 bp, Homo sapien
catggaaataatggccagcataggt

SEQ ID NO: 45265 - DNA, 25 bp, Homo sapien
catggaacaatgttcaagattaaat

SEQ ID NO: 45266 - DNA, 25 bp, Homo sapien
catggaacaatgtttaagattaaat

SEQ ID NO: 45267 - DNA, 25 bp, Homo sapien
catggaacatcagatgaaacaatgt

SEQ ID NO: 45268 - DNA, 25 bp, Homo sapien
catggaacatcggatgaaacaatgt

SEQ ID NO: 45269 - DNA, 25 bp, Homo sapien
catggaactttggtcaaaccaaaaa

SEQ ID NO: 45270 - DNA, 25 bp, Homo sapien
catggaacttttgtcaaaccaaaaa

SEQ ID NO: 45271 - DNA, 25 bp, Homo sapien
catggaagccactgggttcatcctc

SEQ ID NO: 45272 - DNA, 25 bp, Homo sapien
catggaagccattgggttcatcctc

SEQ ID NO: 45273 - DNA, 25 bp, Homo sapien
catggaatgcttcaggatggccaag

SEQ ID NO: 45274 - DNA, 25 bp, Homo sapien
catggaatgctttaggatggccaag

SEQ ID NO: 45275 - DNA, 25 bp, Homo sapien
catggaattgggctggatgtggctc

SEQ ID NO: 45276 - DNA, 25 bp, Homo sapien
catggaattgggttggatgtggctc

SEQ ID NO: 45277 - DNA, 25 bp, Homo sapien
catggactacttcatgtcttaagtt

SEQ ID NO: 45278 - DNA, 25 bp, Homo sapien
catggactatttcatgtcttaagtt

SEQ ID NO: 45279 - DNA, 25 bp, Homo sapien
catggagcaaagcagagaactcctg

SEQ ID NO: 45280 - DNA, 25 bp, Homo sapien
catggagcatagcagagaactcctg

SEQ ID NO: 45281 - DNA, 25 bp, Homo sapien
catggaggaaatatctactgggtaa

SEQ ID NO: 45282 - DNA, 25 bp, Homo sapien
catggaggaaatgtctactgggtaa

SEQ ID NO: 45283 - DNA, 25 bp, Homo sapien
catggaggtcaatactcaaaactta

SEQ ID NO: 45284 - DNA, 25 bp, Homo sapien
catggaggtcaatactgaaaactta

SEQ ID NO: 45285 - DNA, 25 bp, Homo sapien
catggaggtgattgcttggcttcct

SEQ ID NO: 45286 - DNA, 25 bp, Homo sapien
catggaggtgatttcttggcttcct

SEQ ID NO: 45287 - DNA, 25 bp, Homo sapien
catggagtatacaagagtcaaaagt

SEQ ID NO: 45288 - DNA, 25 bp, Homo sapien
catggagtatacgagagtcaaaagt

SEQ ID NO: 45289 - DNA, 25 bp, Homo sapien
catggagtgcacgtcatagccactt

SEQ ID NO: 45290 - DNA, 25 bp, Homo sapien
catggagtgcatgtcatagccactt

SEQ ID NO: 45291 - DNA, 25 bp, Homo sapien
catggagttaattaagcacaaaatg

SEQ ID NO: 45292 - DNA, 25 bp, Homo sapien
catggagttaattgagcacaaaatg

SEQ ID NO: 45293 - DNA, 25 bp, Homo sapien
catggataccaacggacaagggcat

SEQ ID NO: 45294 - DNA, 25 bp, Homo sapien
catggatatcaacggacaagggcat

SEQ ID NO: 45295 - DNA, 25 bp, Homo sapien
catggatcaatgagacaaaaagaaa

SEQ ID NO: 45296 - DNA, 25 bp, Homo sapien
catggatcaatgaggcaaaaagaaa

SEQ ID NO: 45297 - DNA, 25 bp, Homo sapien
catggatgtacaagcatctgagtac

SEQ ID NO: 45298 - DNA, 25 bp, Homo sapien
catggatgtacaagtatctgagtac

SEQ ID NO: 45299 - DNA, 25 bp, Homo sapien
catggattttaaatgtaaatgacct

SEQ ID NO: 45300 - DNA, 25 bp, Homo sapien
catggattttaagtgtaaatgacct

SEQ ID NO: 45301 - DNA, 25 bp, Homo sapien
catggcaagaggcatcatccataaa

SEQ ID NO: 45302 - DNA, 25 bp, Homo sapien
catggcaagaggtatcatccataaa

SEQ ID NO: 45303 - DNA, 25 bp, Homo sapien
catggcaagccaatcttacacaaat

SEQ ID NO: 45304 - DNA, 25 bp, Homo sapien
catggcaagccagtcttacacaaat

SEQ ID NO: 45305 - DNA, 25 bp, Homo sapien
catggcacccaggcttcttctgttt

SEQ ID NO: 45306 - DNA, 25 bp, Homo sapien
catggcacccaggtttcttctgttt

SEQ ID NO: 45307 - DNA, 25 bp, Homo sapien
catggcccaccttgcactgcccttg

SEQ ID NO: 45308 - DNA, 25 bp, Homo sapien
catggcccagcttgcactgcccttg

SEQ ID NO: 45309 - DNA, 25 bp, Homo sapien
catggctcacccacaagtcagtgaa

SEQ ID NO: 45310 - DNA, 25 bp, Homo sapien
catggctcacccagaagtcagtgaa

SEQ ID NO: 45311 - DNA, 25 bp, Homo sapien
catggcttaaatatctctagctaat

SEQ ID NO: 45312 - DNA, 25 bp, Homo sapien
catggcttaaatgtctctagctaat

SEQ ID NO: 45313 - DNA, 25 bp, Homo sapien
catggcttccttagcacgagagcag

SEQ ID NO: 45314 - DNA, 25 bp, Homo sapien
catggcttccttagcatgagagcag

SEQ ID NO: 45315 - DNA, 25 bp, Homo sapien
catgggattcctataagcattgtat

SEQ ID NO: 45316 - DNA, 25 bp, Homo sapien
catgggattcctgtaagcattgtat

SEQ ID NO: 45317 - DNA, 25 bp, Homo sapien
catgggcaactccggcgtctcaggt

SEQ ID NO: 45318 - DNA, 25 bp, Homo sapien
catgggcaactctggcgtctcaggt

SEQ ID NO: 45319 - DNA, 25 bp, Homo sapien
catgggcagaaacttaatgactaaa

SEQ ID NO: 45320 - DNA, 25 bp, Homo sapien
catgggcagaaccttaatgactaaa

SEQ ID NO: 45321 - DNA, 25 bp, Homo sapien
catgggcagtctcattttctagaac

SEQ ID NO: 45322 - DNA, 25 bp, Homo sapien
catgggcagtctctttttctagaac

SEQ ID NO: 45323 - DNA, 25 bp, Homo sapien
catgggccaaggtctaatttttcac

SEQ ID NO: 45324 - DNA, 25 bp, Homo sapien
catgggccaaggtctagtttttcac

SEQ ID NO: 45325 - DNA, 25 bp, Homo sapien
catgggccctaacaaacgagtgctg

SEQ ID NO: 45326 - DNA, 25 bp, Homo sapien
catgggccctaacaaatgagtgctg

SEQ ID NO: 45327 - DNA, 25 bp, Homo sapien
catgggctatctctccgtttactta

SEQ ID NO: 45328 - DNA, 25 bp, Homo sapien
catgggctatctcttcgtttactta

SEQ ID NO: 45329 - DNA, 25 bp, Homo sapien
catggggcctacgcctcagctctta

SEQ ID NO: 45330 - DNA, 25 bp, Homo sapien
catggggcctatgcctcagctctta

SEQ ID NO: 45331 - DNA, 25 bp, Homo sapien
catggggttgaaatgcatgctcccc

SEQ ID NO: 45332 - DNA, 25 bp, Homo sapien
catggggttgaattgcatgctcccc

SEQ ID NO: 45333 - DNA, 25 bp, Homo sapien
catgggtcccacatgcaaattcaaa

SEQ ID NO: 45334 - DNA, 25 bp, Homo sapien
catgggtcccacgtgcaaattcaaa

SEQ ID NO: 45335 - DNA, 25 bp, Homo sapien
catgggtttcagttaacggcaactt

SEQ ID NO: 45336 - DNA, 25 bp, Homo sapien
catgggtttcagttaatggcaactt

SEQ ID NO: 45337 - DNA, 25 bp, Homo sapien
catgggttttcaactgacagccttc

SEQ ID NO: 45338 - DNA, 25 bp, Homo sapien
catgggttttcagctgacagccttc

SEQ ID NO: 45339 - DNA, 25 bp, Homo sapien
catggtaagacatgcctacttctcc

SEQ ID NO: 45340 - DNA, 25 bp, Homo sapien
catggtaagacgtgcctacttctcc

SEQ ID NO: 45341 - DNA, 25 bp, Homo sapien
catggtaccattgcaatcaaactct

SEQ ID NO: 45342 - DNA, 25 bp, Homo sapien
catggtactattgcaatcaaactct

SEQ ID NO: 45343 - DNA, 25 bp, Homo sapien
catggtactgatgataaaaaaaaaa

SEQ ID NO: 45344 - DNA, 25 bp, Homo sapien
catggtactgatgttaaaaaaaaaa

SEQ ID NO: 45345 - DNA, 25 bp, Homo sapien
catggtagattggagtaagttcttt

SEQ ID NO: 45346 - DNA, 25 bp, Homo sapien
catggtaggttggagtaagttcttt

SEQ ID NO: 45347 - DNA, 25 bp, Homo sapien
catggtatcaactgttcagatagct

SEQ ID NO: 45348 - DNA, 25 bp, Homo sapien
catggtatcaagtgttcagatagct

SEQ ID NO: 45349 - DNA, 25 bp, Homo sapien
catggtcaagttccagtgagggccc

SEQ ID NO: 45350 - DNA, 25 bp, Homo sapien
catggtcaagttccggtgagggccc

SEQ ID NO: 45351 - DNA, 25 bp, Homo sapien
catggtcagatctacgtaaacggaa

SEQ ID NO: 45352 - DNA, 25 bp, Homo sapien
catggtcagatctatgtaaacggaa

SEQ ID NO: 45353 - DNA, 25 bp, Homo sapien
catggtctcaaggcctctatacatt

SEQ ID NO: 45354 - DNA, 25 bp, Homo sapien
catggtctcgaggcctctatacatt

SEQ ID NO: 45355 - DNA, 25 bp, Homo sapien
catggtcttggttcattttcaccca

SEQ ID NO: 45356 - DNA, 25 bp, Homo sapien
catggtctttgttcattttcaccca

SEQ ID NO: 45357 - DNA, 25 bp, Homo sapien
catggtgacgagtgaatggctcaat

SEQ ID NO: 45358 - DNA, 25 bp, Homo sapien
catggtgacgagtgcatggctcaat

SEQ ID NO: 45359 - DNA, 25 bp, Homo sapien
catggtgggatgagaaggagttggt

SEQ ID NO: 45360 - DNA, 25 bp, Homo sapien
catggtgggatgagtaggagttggt

SEQ ID NO: 45361 - DNA, 25 bp, Homo sapien
catggttaactaactacatgctaag

SEQ ID NO: 45362 - DNA, 25 bp, Homo sapien
catggttaactaattacatgctaag

SEQ ID NO: 45363 - DNA, 25 bp, Homo sapien
catggttaatcacgaagcagtggcc

SEQ ID NO: 45364 - DNA, 25 bp, Homo sapien
catggttaatcatgaagcagtggcc

SEQ ID NO: 45365 - DNA, 25 bp, Homo sapien
catggttaccaagctaaagtttttg

SEQ ID NO: 45366 - DNA, 25 bp, Homo sapien
catggttaccaagctacagtttttg

SEQ ID NO: 45367 - DNA, 25 bp, Homo sapien
catggttacgtgaatatggactatc

SEQ ID NO: 45368 - DNA, 25 bp, Homo sapien
catggttatgtgaatatggactatc

SEQ ID NO: 45369 - DNA, 25 bp, Homo sapien
catggttccagaaactccacagaag

SEQ ID NO: 45370 - DNA, 25 bp, Homo sapien
catggttccaggaactccacagaag

SEQ ID NO: 45371 - DNA, 25 bp, Homo sapien
catggttcgtggccaaattagatca

SEQ ID NO: 45372 - DNA, 25 bp, Homo sapien
catggttcgtggcctaattagatca

SEQ ID NO: 45373 - DNA, 25 bp, Homo sapien
catggttgctctcacctgtggtcct

SEQ ID NO: 45374 - DNA, 25 bp, Homo sapien
catggttgctctcatctgtggtcct

SEQ ID NO: 45375 - DNA, 25 bp, Homo sapien
catgtaaatgggcctatggtatttt

SEQ ID NO: 45376 - DNA, 25 bp, Homo sapien
catgtaaatgggtctatggtatttt

SEQ ID NO: 45377 - DNA, 25 bp, Homo sapien
catgtaatgtcatcacatttttctt

SEQ ID NO: 45378 - DNA, 25 bp, Homo sapien
catgtaatgtcgtcacatttttctt

SEQ ID NO: 45379 - DNA, 25 bp, Homo sapien
catgtacacattttttttgggttgg

SEQ ID NO: 45380 - DNA, 25 bp, Homo sapien
catgtacactttttttttgggttgg

SEQ ID NO: 45381 - DNA, 25 bp, Homo sapien
catgtacctaacagcatatgtatca

SEQ ID NO: 45382 - DNA, 25 bp, Homo sapien
catgtacctaaccgcatatgtatca

SEQ ID NO: 45383 - DNA, 25 bp, Homo sapien
catgtacctaattacatcattgcaa

SEQ ID NO: 45384 - DNA, 25 bp, Homo sapien
catgtacctaattatatcattgcaa

SEQ ID NO: 45385 - DNA, 25 bp, Homo sapien
catgtacctgtagttcctgttactt

SEQ ID NO: 45386 - DNA, 25 bp, Homo sapien
catgtacctgtagttcttgttactt

SEQ ID NO: 45387 - DNA, 25 bp, Homo sapien
catgtacggttgcactgctgactaa

SEQ ID NO: 45388 - DNA, 25 bp, Homo sapien
catgtacggttgcattgctgactaa

SEQ ID NO: 45389 - DNA, 25 bp, Homo sapien
catgtactcactgagattttgggca

SEQ ID NO: 45390 - DNA, 25 bp, Homo sapien
catgtactcactgtgattttgggca

SEQ ID NO: 45391 - DNA, 25 bp, Homo sapien
catgtagcctctatcctgaccttag

SEQ ID NO: 45392 - DNA, 25 bp, Homo sapien
catgtagcctctatgctgaccttag

SEQ ID NO: 45393 - DNA, 25 bp, Homo sapien
catgtatacttactgacctgctgcc

SEQ ID NO: 45394 - DNA, 25 bp, Homo sapien
catgtatacttattgacctgctgcc

SEQ ID NO: 45395 - DNA, 25 bp, Homo sapien
catgtatccatcttaattctgccat

SEQ ID NO: 45396 - DNA, 25 bp, Homo sapien
catgtatccctcttaattctgccat

SEQ ID NO: 45397 - DNA, 25 bp, Homo sapien
catgtattgtcaatagcagtgagat

SEQ ID NO: 45398 - DNA, 25 bp, Homo sapien
catgtattgtcagtagcagtgagat

SEQ ID NO: 45399 - DNA, 25 bp, Homo sapien
catgtatttatggatttgtttctaa

SEQ ID NO: 45400 - DNA, 25 bp, Homo sapien
catgtatttgtggatttgtttctaa

SEQ ID NO: 45401 - DNA, 25 bp, Homo sapien
catgtcacaaaaccacagacacatt

SEQ ID NO: 45402 - DNA, 25 bp, Homo sapien
catgtcacaaaaccacggacacatt

SEQ ID NO: 45403 - DNA, 25 bp, Homo sapien
catgtcacctaacagcatgtggccc

SEQ ID NO: 45404 - DNA, 25 bp, Homo sapien
catgtcacctaatagcatgtggccc

SEQ ID NO: 45405 - DNA, 25 bp, Homo sapien
catgtcacctagtcagaagttcata

SEQ ID NO: 45406 - DNA, 25 bp, Homo sapien
catgtcacctattcagaagttcata

SEQ ID NO: 45407 - DNA, 25 bp, Homo sapien
catgtcacttgattagatgccctct

SEQ ID NO: 45408 - DNA, 25 bp, Homo sapien
catgtcacttgattcgatgccctct

SEQ ID NO: 45409 - DNA, 25 bp, Homo sapien
catgtcagtctccctgatgattcta

SEQ ID NO: 45410 - DNA, 25 bp, Homo sapien
catgtcagtctctctgatgattcta

SEQ ID NO: 45411 - DNA, 25 bp, Homo sapien
catgtcatggatgcgtgtacagggt

SEQ ID NO: 45412 - DNA, 25 bp, Homo sapien
catgtcatggatgcttgtacagggt

SEQ ID NO: 45413 - DNA, 25 bp, Homo sapien
catgtcccctcacgggtgcaagctg

SEQ ID NO: 45414 - DNA, 25 bp, Homo sapien
catgtcccctcatgggtgcaagctg

SEQ ID NO: 45415 - DNA, 25 bp, Homo sapien
catgtcctgtgaggcactgccaagt

SEQ ID NO: 45416 - DNA, 25 bp, Homo sapien
catgtcctgtgaggcattgccaagt

SEQ ID NO: 45417 - DNA, 25 bp, Homo sapien
catgtccttcccggtgtctcaggct

SEQ ID NO: 45418 - DNA, 25 bp, Homo sapien
catgtccttcctggtgtctcaggct

SEQ ID NO: 45419 - DNA, 25 bp, Homo sapien
catgtctaataaagggtcaaggtgg

SEQ ID NO: 45420 - DNA, 25 bp, Homo sapien
catgtctaataaatggtcaaggtgg

SEQ ID NO: 45421 - DNA, 25 bp, Homo sapien
catgtctcaaaatcaggtcatgctg

SEQ ID NO: 45422 - DNA, 25 bp, Homo sapien
catgtctcacaatcaggtcatgctg

SEQ ID NO: 45423 - DNA, 25 bp, Homo sapien
catgtctgagactcagaacctcaac

SEQ ID NO: 45424 - DNA, 25 bp, Homo sapien
catgtctgagattcagaacctcaac

SEQ ID NO: 45425 - DNA, 25 bp, Homo sapien
catgtctgctaatacattcttcagc

SEQ ID NO: 45426 - DNA, 25 bp, Homo sapien
catgtctgctaatatattcttcagc

SEQ ID NO: 45427 - DNA, 25 bp, Homo sapien
catgtcttcaatgctctggcagaca

SEQ ID NO: 45428 - DNA, 25 bp, Homo sapien
catgtctttaatgctctggcagaca

SEQ ID NO: 45429 - DNA, 25 bp, Homo sapien
catgtctttccccgtcgactgactc

SEQ ID NO: 45430 - DNA, 25 bp, Homo sapien
catgtctttccctgtcgactgactc

SEQ ID NO: 45431 - DNA, 25 bp, Homo sapien
catgtgaaacactactgaatgaaaa

SEQ ID NO: 45432 - DNA, 25 bp, Homo sapien
catgtgaaatccatagaaccagaat

SEQ ID NO: 45433 - DNA, 25 bp, Homo sapien
catgtgaaatcgatagaaccagaat

SEQ ID NO: 45434 - DNA, 25 bp, Homo sapien
catgtgaaatcttttggagattctg

SEQ ID NO: 45435 - DNA, 25 bp, Homo sapien
catgtgaacctgggtagtccctgaa

SEQ ID NO: 45436 - DNA, 25 bp, Homo sapien
catgtgaagcactactgaatgaaaa

SEQ ID NO: 45437 - DNA, 25 bp, Homo sapien
catgtgaatctgggtagtccctgaa

SEQ ID NO: 45438 - DNA, 25 bp, Homo sapien
catgtgaatgagaacttccaaatta

SEQ ID NO: 45439 - DNA, 25 bp, Homo sapien
catgtgaatgagaatttccaaatta

SEQ ID NO: 45440 - DNA, 25 bp, Homo sapien
catgtgaattcttttggagattctg

SEQ ID NO: 45441 - DNA, 25 bp, Homo sapien
catgtgacaaaagaaaagaattgat

SEQ ID NO: 45442 - DNA, 25 bp, Homo sapien
catgtgacaaaggaaaagaattgat

SEQ ID NO: 45443 - DNA, 25 bp, Homo sapien
catgtgacatttgtgggtcagcaga

SEQ ID NO: 45444 - DNA, 25 bp, Homo sapien
catgtgacttttgtgggtcagcaga

SEQ ID NO: 45445 - DNA, 25 bp, Homo sapien
catgtgaggacataacaggaaaagg

SEQ ID NO: 45446 - DNA, 25 bp, Homo sapien
catgtgaggacataccaggaaaagg

SEQ ID NO: 45447 - DNA, 25 bp, Homo sapien
catgtgagggacctaggctgtgctc

SEQ ID NO: 45448 - DNA, 25 bp, Homo sapien
catgtgagggacctagtctgtgctc

SEQ ID NO: 45449 - DNA, 25 bp, Homo sapien
catgtgagggtacaaaattatgatg

SEQ ID NO: 45450 - DNA, 25 bp, Homo sapien
catgtgagggtataaaattatgatg

SEQ ID NO: 45451 - DNA, 25 bp, Homo sapien
catgtgataccacacgggactcatt

SEQ ID NO: 45452 - DNA, 25 bp, Homo sapien
catgtgataccgcacgggactcatt

SEQ ID NO: 45453 - DNA, 25 bp, Homo sapien
catgtgcaactatatctgcagagga

SEQ ID NO: 45454 - DNA, 25 bp, Homo sapien
catgtgcaactgtatctgcagagga

SEQ ID NO: 45455 - DNA, 25 bp, Homo sapien
catgtgctcatgggacactaagctc

SEQ ID NO: 45456 - DNA, 25 bp, Homo sapien
catgtgctcgtgggacactaagctc

SEQ ID NO: 45457 - DNA, 25 bp, Homo sapien
catgtggaacagggaaagatatttt

SEQ ID NO: 45458 - DNA, 25 bp, Homo sapien
catgtggaacagtgaaagatatttt

SEQ ID NO: 45459 - DNA, 25 bp, Homo sapien
catgtggatggccgaggtgcccaca

SEQ ID NO: 45460 - DNA, 25 bp, Homo sapien
catgtggatggctgaggtgcccaca

SEQ ID NO: 45461 - DNA, 25 bp, Homo sapien
catgtggcactgttatgctatgcag

SEQ ID NO: 45462 - DNA, 25 bp, Homo sapien
catgtggcacttttatgctatgcag

SEQ ID NO: 45463 - DNA, 25 bp, Homo sapien
catgtggcatgtatcgtggcaatct

SEQ ID NO: 45464 - DNA, 25 bp, Homo sapien
catgtggcatgtctcgtggcaatct

SEQ ID NO: 45465 - DNA, 25 bp, Homo sapien
catgtggcctgtactttctaaacat

SEQ ID NO: 45466 - DNA, 25 bp, Homo sapien
catgtggcgtgtactttctaaacat

SEQ ID NO: 45467 - DNA, 25 bp, Homo sapien
catgtgggaatcagcaagaacaaca

SEQ ID NO: 45468 - DNA, 25 bp, Homo sapien
catgtgggaatcggcaagaacaaca

SEQ ID NO: 45469 - DNA, 25 bp, Homo sapien
catgtgggagacaggagaagaagct

SEQ ID NO: 45470 - DNA, 25 bp, Homo sapien
catgtgggagataggagaagaagct

SEQ ID NO: 45471 - DNA, 25 bp, Homo sapien
catgtgggcaagcccgcctagatac

SEQ ID NO: 45472 - DNA, 25 bp, Homo sapien
catgtgggcaaggccgcctagatac

SEQ ID NO: 45473 - DNA, 25 bp, Homo sapien
catgtggtctccatacatcatcttc

SEQ ID NO: 45474 - DNA, 25 bp, Homo sapien
catgtggtctccatacctcatcttc

SEQ ID NO: 45475 - DNA, 25 bp, Homo sapien
catgtggtttgtttagaaagcagtg

SEQ ID NO: 45476 - DNA, 25 bp, Homo sapien
catgtggtttgtttaggaagcagtg

SEQ ID NO: 45477 - DNA, 25 bp, Homo sapien
catgtgtcaaaatcacacttaaact

SEQ ID NO: 45478 - DNA, 25 bp, Homo sapien
catgtgtcaaaatcgcacttaaact

SEQ ID NO: 45479 - DNA, 25 bp, Homo sapien
catgtgtcccgatgttccatagccc

SEQ ID NO: 45480 - DNA, 25 bp, Homo sapien
catgtgtcctgaagaaatgacgacc

SEQ ID NO: 45481 - DNA, 25 bp, Homo sapien
catgtgtcctgatgttccatagccc

SEQ ID NO: 45482 - DNA, 25 bp, Homo sapien
catgtgtcctgcagaaatgacgacc

SEQ ID NO: 45483 - DNA, 25 bp, Homo sapien
catgtgtctaatcttagctatctga

SEQ ID NO: 45484 - DNA, 25 bp, Homo sapien
catgtgtctgatcttagctatctga

SEQ ID NO: 45485 - DNA, 25 bp, Homo sapien
catgtgtgtcttctctggaaatgtg

SEQ ID NO: 45486 - DNA, 25 bp, Homo sapien
catgtgtgtcttctttggaaatgtg

SEQ ID NO: 45487 - DNA, 25 bp, Homo sapien
catgtgttaaaagaagcaatattgt

SEQ ID NO: 45488 - DNA, 25 bp, Homo sapien
catgtgttagaagaagcaatattgt

SEQ ID NO: 45489 - DNA, 25 bp, Homo sapien
catgttaaacattctgtagttaaca

SEQ ID NO: 45490 - DNA, 25 bp, Homo sapien
catgttaaacattgtgtagttaaca

SEQ ID NO: 45491 - DNA, 25 bp, Homo sapien
catgttaaacccttcaagtcgttcc

SEQ ID NO: 45492 - DNA, 25 bp, Homo sapien
catgttaaacccttcacgtcgttcc

SEQ ID NO: 45493 - DNA, 25 bp, Homo sapien
catgttaagtggcaatgttccatgc

SEQ ID NO: 45494 - DNA, 25 bp, Homo sapien
catgttaagtggtaatgttccatgc

SEQ ID NO: 45495 - DNA, 25 bp, Homo sapien
catgttaattacacttctataaaac

SEQ ID NO: 45496 - DNA, 25 bp, Homo sapien
catgttaattacgcttctataaaac

SEQ ID NO: 45497 - DNA, 25 bp, Homo sapien
catgttagtttccattttcttctgt

SEQ ID NO: 45498 - DNA, 25 bp, Homo sapien
catgttagtttccgttttcttctgt

SEQ ID NO: 45499 - DNA, 25 bp, Homo sapien
catgttataattccctgtctttcca

SEQ ID NO: 45500 - DNA, 25 bp, Homo sapien
catgttataatttaattggcagcat

SEQ ID NO: 45501 - DNA, 25 bp, Homo sapien
catgttataatttcattggcagcat

SEQ ID NO: 45502 - DNA, 25 bp, Homo sapien
catgttatacacccttttcatggct

SEQ ID NO: 45503 - DNA, 25 bp, Homo sapien
catgttatacttccctgtctttcca

SEQ ID NO: 45504 - DNA, 25 bp, Homo sapien
catgttatatacccttttcatggct

SEQ ID NO: 45505 - DNA, 25 bp, Homo sapien
catgttatatactgatcacactaga

SEQ ID NO: 45506 - DNA, 25 bp, Homo sapien
catgttatgtactgatcacactaga

SEQ ID NO: 45507 - DNA, 25 bp, Homo sapien
catgttcagttgatagctgcagtca

SEQ ID NO: 45508 - DNA, 25 bp, Homo sapien
catgttcatttgatagctgcagtca

SEQ ID NO: 45509 - DNA, 25 bp, Homo sapien
catgttccattgctttttcttagag

SEQ ID NO: 45510 - DNA, 25 bp, Homo sapien
catgttccattgttttttcttagag

SEQ ID NO: 45511 - DNA, 25 bp, Homo sapien
catgttcttataatggagtggaaag

SEQ ID NO: 45512 - DNA, 25 bp, Homo sapien
catgttcttttaatggagtggaaag

SEQ ID NO: 45513 - DNA, 25 bp, Homo sapien
catgttgagattagaaaggtgagca

SEQ ID NO: 45514 - DNA, 25 bp, Homo sapien
catgttgagattggaaaggtgagca

SEQ ID NO: 45515 - DNA, 25 bp, Homo sapien
catgttgatccataaaaaatctaat

SEQ ID NO: 45516 - DNA, 25 bp, Homo sapien
catgttgatccgtaaaaaatctaat

SEQ ID NO: 45517 - DNA, 25 bp, Homo sapien
catgttgatttacctttaacaaact

SEQ ID NO: 45518 - DNA, 25 bp, Homo sapien
catgttgatttatctttaacaaact

SEQ ID NO: 45519 - DNA, 25 bp, Homo sapien
catgttgtgattgtacgagtcaata

SEQ ID NO: 45520 - DNA, 25 bp, Homo sapien
catgttgtgattgtgcgagtcaata

SEQ ID NO: 45521 - DNA, 25 bp, Homo sapien
catgttgttgaatctatcagtagtc

SEQ ID NO: 45522 - DNA, 25 bp, Homo sapien
catgttgttgaatgtatcagtagtc

SEQ ID NO: 45523 - DNA, 25 bp, Homo sapien
catgtttaaaaacaaagccttgaag

SEQ ID NO: 45524 - DNA, 25 bp, Homo sapien
catgtttaaaatcaaagccttgaag

SEQ ID NO: 45525 - DNA, 25 bp, Homo sapien
catgtttaaattgtcgtaatctgag

SEQ ID NO: 45526 - DNA, 25 bp, Homo sapien
catgtttaaattgttgtaatctgag

SEQ ID NO: 45527 - DNA, 25 bp, Homo sapien
catgtttagaaattttggattatat

SEQ ID NO: 45528 - DNA, 25 bp, Homo sapien
catgtttagaagttttggattatat

SEQ ID NO: 45529 - DNA, 25 bp, Homo sapien
catgtttcaaatgtatgaatcccta

SEQ ID NO: 45530 - DNA, 25 bp, Homo sapien
catgtttcaaatttatgaatcccta

SEQ ID NO: 45531 - DNA, 25 bp, Homo sapien
catgtttcagagtcatcgtatgcta

SEQ ID NO: 45532 - DNA, 25 bp, Homo sapien
catgtttcattttagtaaccttgaa

SEQ ID NO: 45533 - DNA, 25 bp, Homo sapien
catgtttcattttggtaaccttgaa

SEQ ID NO: 45534 - DNA, 25 bp, Homo sapien
catgtttcggagtcatcgtatgcta

SEQ ID NO: 45535 - DNA, 25 bp, Homo sapien
catgtttctataagatggagagtgg

SEQ ID NO: 45536 - DNA, 25 bp, Homo sapien
catgtttctctaagatggagagtgg

SEQ ID NO: 45537 - DNA, 25 bp, Homo sapien
catgtttctgcgaagaactcaagaa

SEQ ID NO: 45538 - DNA, 25 bp, Homo sapien
catgtttctgctaagaactcaagaa

SEQ ID NO: 45539 - DNA, 25 bp, Homo sapien
catgtttgctttggctgtcttctgt

SEQ ID NO: 45540 - DNA, 25 bp, Homo sapien
catgtttgcttttcatttgtcagtg

SEQ ID NO: 45541 - DNA, 25 bp, Homo sapien
catgtttgcttttgctgtcttctgt

SEQ ID NO: 45542 - DNA, 25 bp, Homo sapien
catgtttgctttttatttgtcagtg

SEQ ID NO: 45543 - DNA, 25 bp, Homo sapien
catgttttagctagagccaaacaca

SEQ ID NO: 45544 - DNA, 25 bp, Homo sapien
catgttttagctagaggcaaacaca

SEQ ID NO: 45545 - DNA, 25 bp, Homo sapien
catgttttatttaatgcttggtatt

SEQ ID NO: 45546 - DNA, 25 bp, Homo sapien
catgttttatttaatgtttggtatt

SEQ ID NO: 45547 - DNA, 25 bp, Homo sapien
catgttttcacatcggtcactttaa

SEQ ID NO: 45548 - DNA, 25 bp, Homo sapien
catgttttcacattggtcactttaa

SEQ ID NO: 45549 - DNA, 25 bp, Homo sapien
catgttttgacctgattttcttccc

SEQ ID NO: 45550 - DNA, 25 bp, Homo sapien
catgttttggtatacacactaaaga

SEQ ID NO: 45551 - DNA, 25 bp, Homo sapien
catgttttggtattcacactaaaga

SEQ ID NO: 45552 - DNA, 25 bp, Homo sapien
catgtttttacctgattttcttccc

SEQ ID NO: 45553 - DNA, 25 bp, Homo sapien
catgttttttagtcagggtgaatgg

SEQ ID NO: 45554 - DNA, 25 bp, Homo sapien
catgttttttagtgagggtgaatgg

SEQ ID NO: 45555 - DNA, 25 bp, Homo sapien
cattaaaaacgatgccagaagtgtg

SEQ ID NO: 45556 - DNA, 25 bp, Homo sapien
cattaaaaatgatgccagaagtgtg

SEQ ID NO: 45557 - DNA, 25 bp, Homo sapien
cattaaaacgtgattaagtcctgag

SEQ ID NO: 45558 - DNA, 25 bp, Homo sapien
cattaaaacgtggttaagtcctgag

SEQ ID NO: 45559 - DNA, 25 bp, Homo sapien
cattaaaagtaccggcaaaaaccat

SEQ ID NO: 45560 - DNA, 25 bp, Homo sapien
cattaaaagtactggcaaaaaccat

SEQ ID NO: 45561 - DNA, 25 bp, Homo sapien
cattaaacacttatttctggcaatt

SEQ ID NO: 45562 - DNA, 25 bp, Homo sapien
cattaaacatttatttctggcaatt

SEQ ID NO: 45563 - DNA, 25 bp, Homo sapien
cattaaaccaagaaggaagtccaga

SEQ ID NO: 45564 - DNA, 25 bp, Homo sapien
cattaaaccgagaaggaagtccaga

SEQ ID NO: 45565 - DNA, 25 bp, Homo sapien
cattaaacgttacctaaaactcaaa

SEQ ID NO: 45566 - DNA, 25 bp, Homo sapien
cattaaacgttatctaaaactcaaa

SEQ ID NO: 45567 - DNA, 25 bp, Homo sapien
cattaaactaacctttaaaagcaca

SEQ ID NO: 45568 - DNA, 25 bp, Homo sapien
cattaaactaatctttaaaagcaca

SEQ ID NO: 45569 - DNA, 25 bp, Homo sapien
cattaaactttggtcagttatgtcc

SEQ ID NO: 45570 - DNA, 25 bp, Homo sapien
cattaaacttttgtcagttatgtcc

SEQ ID NO: 45571 - DNA, 25 bp, Homo sapien
cattaaagctgtttgtaggcatcgt

SEQ ID NO: 45572 - DNA, 25 bp, Homo sapien
cattaaagctgtttgtcggcatcgt

SEQ ID NO: 45573 - DNA, 25 bp, Homo sapien
cattaaaggttgagttttccttagt

SEQ ID NO: 45574 - DNA, 25 bp, Homo sapien
cattaaaggttgatttttccttagt

SEQ ID NO: 45575 - DNA, 25 bp, Homo sapien
cattaaagttcagaaagtttgcagc

SEQ ID NO: 45576 - DNA, 25 bp, Homo sapien
cattaaagttcataaagtttgcagc

SEQ ID NO: 45577 - DNA, 25 bp, Homo sapien
cattaaatctaagctaatgctatct

SEQ ID NO: 45578 - DNA, 25 bp, Homo sapien
cattaaatctaagctagtgctatct

SEQ ID NO: 45579 - DNA, 25 bp, Homo sapien
cattaaatttcctctgtagcttgta

SEQ ID NO: 45580 - DNA, 25 bp, Homo sapien
cattaaatttcctttgtagcttgta

SEQ ID NO: 45581 - DNA, 25 bp, Homo sapien
cattaactcaggtctgactcacatt

SEQ ID NO: 45582 - DNA, 25 bp, Homo sapien
cattaactcgggtctgactcacatt

SEQ ID NO: 45583 - DNA, 25 bp, Homo sapien
cattaactgcccagtgatgtcacac

SEQ ID NO: 45584 - DNA, 25 bp, Homo sapien
cattaactgcccattgatgtcacac

SEQ ID NO: 45585 - DNA, 25 bp, Homo sapien
cattaagcactgaagagaaagaaag

SEQ ID NO: 45586 - DNA, 25 bp, Homo sapien
cattaagcgctgaagagaaagaaag

SEQ ID NO: 45587 - DNA, 25 bp, Homo sapien
cattaaggactaagacaatgttgtg

SEQ ID NO: 45588 - DNA, 25 bp, Homo sapien
cattaaggactgagacaatgttgtg

SEQ ID NO: 45589 - DNA, 25 bp, Homo sapien
cattaagtaattcaatggaaacata

SEQ ID NO: 45590 - DNA, 25 bp, Homo sapien
cattaagtaattcagtggaaacata

SEQ ID NO: 45591 - DNA, 25 bp, Homo sapien
cattaataaatttcctatcatttac

SEQ ID NO: 45592 - DNA, 25 bp, Homo sapien
cattaataaatttcttatcatttac

SEQ ID NO: 45593 - DNA, 25 bp, Homo sapien
cattaatatcctagtacctctccat

SEQ ID NO: 45594 - DNA, 25 bp, Homo sapien
cattaatatccttgtacctctccat

SEQ ID NO: 45595 - DNA, 25 bp, Homo sapien
cattaatatcgttatccatgactgc

SEQ ID NO: 45596 - DNA, 25 bp, Homo sapien
cattaatatcgttatctatgactgc

SEQ ID NO: 45597 - DNA, 25 bp, Homo sapien
cattaatggtccatggcctggtggt

SEQ ID NO: 45598 - DNA, 25 bp, Homo sapien
cattaatggtccgtggcctggtggt

SEQ ID NO: 45599 - DNA, 25 bp, Homo sapien
cattaattctgcactaacttttata

SEQ ID NO: 45600 - DNA, 25 bp, Homo sapien
cattaattgcgtctcttttctattt

SEQ ID NO: 45601 - DNA, 25 bp, Homo sapien
cattaattgtgtctcttttctattt

SEQ ID NO: 45602 - DNA, 25 bp, Homo sapien
cattaattttgcactaacttttata

SEQ ID NO: 45603 - DNA, 25 bp, Homo sapien
cattacaaacagtagatatgacaca

SEQ ID NO: 45604 - DNA, 25 bp, Homo sapien
cattacaaacagtggatatgacaca

SEQ ID NO: 45605 - DNA, 25 bp, Homo sapien
cattacacattgcggtgccataggg

SEQ ID NO: 45606 - DNA, 25 bp, Homo sapien
cattacacgttgcggtgccataggg

SEQ ID NO: 45607 - DNA, 25 bp, Homo sapien
cattacataagccactggctcatct

SEQ ID NO: 45608 - DNA, 25 bp, Homo sapien
cattacataagccgctggctcatct

SEQ ID NO: 45609 - DNA, 25 bp, Homo sapien
cattacctcatttggctataaagtt

SEQ ID NO: 45610 - DNA, 25 bp, Homo sapien
cattacctcatttgtctataaagtt

SEQ ID NO: 45611 - DNA, 25 bp, Homo sapien
cattacggtatagtgtaccgtggac

SEQ ID NO: 45612 - DNA, 25 bp, Homo sapien
cattacggtatagtttaccgtggac

SEQ ID NO: 45613 - DNA, 25 bp, Homo sapien
cattacgtggcgatcccaattcaga

SEQ ID NO: 45614 - DNA, 25 bp, Homo sapien
cattacgtggcggtcccaattcaga

SEQ ID NO: 45615 - DNA, 25 bp, Homo sapien
cattactaaaaacaggttacaaata

SEQ ID NO: 45616 - DNA, 25 bp, Homo sapien
cattactaaaaacgggttacaaata

SEQ ID NO: 45617 - DNA, 25 bp, Homo sapien
cattactaaaccattactgtagatt

SEQ ID NO: 45618 - DNA, 25 bp, Homo sapien
cattactaaaccattattgtagatt

SEQ ID NO: 45619 - DNA, 25 bp, Homo sapien
cattactcatgaagacagatgggaa

SEQ ID NO: 45620 - DNA, 25 bp, Homo sapien
cattactcatgaagccagatgggaa

SEQ ID NO: 45621 - DNA, 25 bp, Homo sapien
cattactgaagctgttcttagcctc

SEQ ID NO: 45622 - DNA, 25 bp, Homo sapien
cattactgaagctgtttttagcctc

SEQ ID NO: 45623 - DNA, 25 bp, Homo sapien
cattactgattcccatcaatttctc

SEQ ID NO: 45624 - DNA, 25 bp, Homo sapien
cattactgattcccgtcaatttctc

SEQ ID NO: 45625 - DNA, 25 bp, Homo sapien
cattactgtcaagtttcttattcca

SEQ ID NO: 45626 - DNA, 25 bp, Homo sapien
cattactgtcaagttttttattcca

SEQ ID NO: 45627 - DNA, 25 bp, Homo sapien
cattacttgttgcgattaccacgat

SEQ ID NO: 45628 - DNA, 25 bp, Homo sapien
cattactttttgcgattaccacgat

SEQ ID NO: 45629 - DNA, 25 bp, Homo sapien
cattagaacacatctgatctgaatt

SEQ ID NO: 45630 - DNA, 25 bp, Homo sapien
cattagaacctccagatgtcttctg

SEQ ID NO: 45631 - DNA, 25 bp, Homo sapien
cattagaacctgcagatgtcttctg

SEQ ID NO: 45632 - DNA, 25 bp, Homo sapien
cattagaactcatctgatctgaatt

SEQ ID NO: 45633 - DNA, 25 bp, Homo sapien
cattagacaaataacgcattcctgc

SEQ ID NO: 45634 - DNA, 25 bp, Homo sapien
cattagacgaataacgcattcctgc

SEQ ID NO: 45635 - DNA, 25 bp, Homo sapien
cattagacttgctattttttttccc

SEQ ID NO: 45636 - DNA, 25 bp, Homo sapien
cattagacttgctcttttttttccc

SEQ ID NO: 45637 - DNA, 25 bp, Homo sapien
cattagatcataccctgtttgtcct

SEQ ID NO: 45638 - DNA, 25 bp, Homo sapien
cattagatcataccgtgtttgtcct

SEQ ID NO: 45639 - DNA, 25 bp, Homo sapien
cattagattctcagaggtgcgtcaa

SEQ ID NO: 45640 - DNA, 25 bp, Homo sapien
cattagattctcataggtgcgtcaa

SEQ ID NO: 45641 - DNA, 25 bp, Homo sapien
cattagcacgtcactaactaacttc

SEQ ID NO: 45642 - DNA, 25 bp, Homo sapien
cattagcatgtcactaactaacttc

SEQ ID NO: 45643 - DNA, 25 bp, Homo sapien
cattagccttccactgagatactga

SEQ ID NO: 45644 - DNA, 25 bp, Homo sapien
cattagccttccattgagatactga

SEQ ID NO: 45645 - DNA, 25 bp, Homo sapien
cattaggaagagcctactgaggtct

SEQ ID NO: 45646 - DNA, 25 bp, Homo sapien
cattaggaagagtctactgaggtct

SEQ ID NO: 45647 - DNA, 25 bp, Homo sapien
cattagggctgtctgtaatgtctct

SEQ ID NO: 45648 - DNA, 25 bp, Homo sapien
cattagggctgtttgtaatgtctct

SEQ ID NO: 45649 - DNA, 25 bp, Homo sapien
cattagttagttaagcttacattct

SEQ ID NO: 45650 - DNA, 25 bp, Homo sapien
cattagttatttaagcttacattct

SEQ ID NO: 45651 - DNA, 25 bp, Homo sapien
cattataaaccatcttttgaaaagg

SEQ ID NO: 45652 - DNA, 25 bp, Homo sapien
cattataaaccattttttgaaaagg

SEQ ID NO: 45653 - DNA, 25 bp, Homo sapien
cattataagaaagaccatatgcaag

SEQ ID NO: 45654 - DNA, 25 bp, Homo sapien
cattataagaaagaccgtatgcaag

SEQ ID NO: 45655 - DNA, 25 bp, Homo sapien
cattataattccatatgttgtatct

SEQ ID NO: 45656 - DNA, 25 bp, Homo sapien
cattataattccgtatgttgtatct

SEQ ID NO: 45657 - DNA, 25 bp, Homo sapien
cattatagtgaacgagtctcacgag

SEQ ID NO: 45658 - DNA, 25 bp, Homo sapien
cattatagtgaatgagtctcacgag

SEQ ID NO: 45659 - DNA, 25 bp, Homo sapien
cattatataggcacaccactcatcc

SEQ ID NO: 45660 - DNA, 25 bp, Homo sapien
cattatataggcataccactcatcc

SEQ ID NO: 45661 - DNA, 25 bp, Homo sapien
cattatatctcacaatgttcacagg

SEQ ID NO: 45662 - DNA, 25 bp, Homo sapien
cattatatctcacagtgttcacagg

SEQ ID NO: 45663 - DNA, 25 bp, Homo sapien
cattatatctggctacattttatcc

SEQ ID NO: 45664 - DNA, 25 bp, Homo sapien
cattatatctgtctacattttatcc

SEQ ID NO: 45665 - DNA, 25 bp, Homo sapien
cattatatgttacagtcaaatcctc

SEQ ID NO: 45666 - DNA, 25 bp, Homo sapien
cattatatgttactgtcaaatcctc

SEQ ID NO: 45667 - DNA, 25 bp, Homo sapien
cattatatttcccattatctgatga

SEQ ID NO: 45668 - DNA, 25 bp, Homo sapien
cattatatttctcattatctgatga

SEQ ID NO: 45669 - DNA, 25 bp, Homo sapien
cattatcaactcttgcttcactgct

SEQ ID NO: 45670 - DNA, 25 bp, Homo sapien
cattatcacctgcgctccgcctcct

SEQ ID NO: 45671 - DNA, 25 bp, Homo sapien
cattatcacctgtgctccgcctcct

SEQ ID NO: 45672 - DNA, 25 bp, Homo sapien
cattatcataatttttgagttacag

SEQ ID NO: 45673 - DNA, 25 bp, Homo sapien
cattatcataattttttagttacag

SEQ ID NO: 45674 - DNA, 25 bp, Homo sapien
cattatcatctcttgcttcactgct

SEQ ID NO: 45675 - DNA, 25 bp, Homo sapien
cattatcatgccagctaaaattggc

SEQ ID NO: 45676 - DNA, 25 bp, Homo sapien
cattatcatgctagctaaaattggc

SEQ ID NO: 45677 - DNA, 25 bp, Homo sapien
cattatccacgtttatcctcccagc

SEQ ID NO: 45678 - DNA, 25 bp, Homo sapien
cattatccatgtttatcctcccagc

SEQ ID NO: 45679 - DNA, 25 bp, Homo sapien
cattatcgaggcccaggctcatatg

SEQ ID NO: 45680 - DNA, 25 bp, Homo sapien
cattatcgaggcccgggctcatatg

SEQ ID NO: 45681 - DNA, 25 bp, Homo sapien
cattatctttcaatctcctccatat

SEQ ID NO: 45682 - DNA, 25 bp, Homo sapien
cattatctttcgatctcctccatat

SEQ ID NO: 45683 - DNA, 25 bp, Homo sapien
cattatgaaacacaggcttctaatg

SEQ ID NO: 45684 - DNA, 25 bp, Homo sapien
cattatgaacaaggcactggctggg

SEQ ID NO: 45685 - DNA, 25 bp, Homo sapien
cattatgaaccacaggcttctaatg

SEQ ID NO: 45686 - DNA, 25 bp, Homo sapien
cattatgagcaaggcactggctggg

SEQ ID NO: 45687 - DNA, 25 bp, Homo sapien
cattatgaggtccaaaaattggtat

SEQ ID NO: 45688 - DNA, 25 bp, Homo sapien
cattatgaggttcaaaaattggtat

SEQ ID NO: 45689 - DNA, 25 bp, Homo sapien
cattatgcacccgtttatacttggt

SEQ ID NO: 45690 - DNA, 25 bp, Homo sapien
cattatgcacccgtttttacttggt

SEQ ID NO: 45691 - DNA, 25 bp, Homo sapien
cattatgcatgtgttacaaagaatg

SEQ ID NO: 45692 - DNA, 25 bp, Homo sapien
cattatgcatgttttacaaagaatg

SEQ ID NO: 45693 - DNA, 25 bp, Homo sapien
cattatgccaaatgaaacaaatcaa

SEQ ID NO: 45694 - DNA, 25 bp, Homo sapien
cattatgccaagtgaaacaaatcaa

SEQ ID NO: 45695 - DNA, 25 bp, Homo sapien
cattatgcctcgaattttttcatgc

SEQ ID NO: 45696 - DNA, 25 bp, Homo sapien
cattatgcttcgaattttttcatgc

SEQ ID NO: 45697 - DNA, 25 bp, Homo sapien
cattatgtccacgttgagtaccccc

SEQ ID NO: 45698 - DNA, 25 bp, Homo sapien
cattatgtccatgttgagtaccccc

SEQ ID NO: 45699 - DNA, 25 bp, Homo sapien
cattattaatattcaatatccagat

SEQ ID NO: 45700 - DNA, 25 bp, Homo sapien
cattattaatattgaatatccagat

SEQ ID NO: 45701 - DNA, 25 bp, Homo sapien
cattattcacaatacccaatatatg

SEQ ID NO: 45702 - DNA, 25 bp, Homo sapien
cattattcacagtacccaatatatg

SEQ ID NO: 45703 - DNA, 25 bp, Homo sapien
cattatttgaccgtacatgtgtggg

SEQ ID NO: 45704 - DNA, 25 bp, Homo sapien
cattatttgactgtacatgtgtggg

SEQ ID NO: 45705 - DNA, 25 bp, Homo sapien
cattatttgcctcgactgtctctaa

SEQ ID NO: 45706 - DNA, 25 bp, Homo sapien
cattatttgccttgactgtctctaa

SEQ ID NO: 45707 - DNA, 25 bp, Homo sapien
cattattttatcatttctgtcattt

SEQ ID NO: 45708 - DNA, 25 bp, Homo sapien
cattattttatcgtttctgtcattt

SEQ ID NO: 45709 - DNA, 25 bp, Homo sapien
cattattttcatctacaaatggaac

SEQ ID NO: 45710 - DNA, 25 bp, Homo sapien
cattattttcatctacgaatggaac

SEQ ID NO: 45711 - DNA, 25 bp, Homo sapien
cattcaaaaccaagatgctggctag

SEQ ID NO: 45712 - DNA, 25 bp, Homo sapien
cattcaaagccaagatgctggctag

SEQ ID NO: 45713 - DNA, 25 bp, Homo sapien
cattcaacacacaaggttaagcctt

SEQ ID NO: 45714 - DNA, 25 bp, Homo sapien
cattcaactcacaaggttaagcctt

SEQ ID NO: 45715 - DNA, 25 bp, Homo sapien
cattcaataatgcctgtttttgacc

SEQ ID NO: 45716 - DNA, 25 bp, Homo sapien
cattcaatattgcctgtttttgacc

SEQ ID NO: 45717 - DNA, 25 bp, Homo sapien
cattcaattgaatatggtcaattgg

SEQ ID NO: 45718 - DNA, 25 bp, Homo sapien
cattcaattgaatatgttcaattgg

SEQ ID NO: 45719 - DNA, 25 bp, Homo sapien
cattcaatttccgtacttccaccag

SEQ ID NO: 45720 - DNA, 25 bp, Homo sapien
cattcaatttctgtacttccaccag

SEQ ID NO: 45721 - DNA, 25 bp, Homo sapien
cattcacacattgacggacattcag

SEQ ID NO: 45722 - DNA, 25 bp, Homo sapien
cattcacacattgatggacattcag

SEQ ID NO: 45723 - DNA, 25 bp, Homo sapien
cattcacatggaaccttcaactata

SEQ ID NO: 45724 - DNA, 25 bp, Homo sapien
cattcacatggaatcttcaactata

SEQ ID NO: 45725 - DNA, 25 bp, Homo sapien
cattcaccaagccaactgtgacaaa

SEQ ID NO: 45726 - DNA, 25 bp, Homo sapien
cattcaccgagccaactgtgacaaa

SEQ ID NO: 45727 - DNA, 25 bp, Homo sapien
cattcacctgtcgataacatttgca

SEQ ID NO: 45728 - DNA, 25 bp, Homo sapien
cattcacctgtcgatagcatttgca

SEQ ID NO: 45729 - DNA, 25 bp, Homo sapien
cattcacctttcttcgtgtacctgc

SEQ ID NO: 45730 - DNA, 25 bp, Homo sapien
cattcacctttctttgtgtacctgc

SEQ ID NO: 45731 - DNA, 25 bp, Homo sapien
cattcacgtctgtgctcctggttag

SEQ ID NO: 45732 - DNA, 25 bp, Homo sapien
cattcacgtctgtgttcctggttag

SEQ ID NO: 45733 - DNA, 25 bp, Homo sapien
cattcactgactctacactatatgt

SEQ ID NO: 45734 - DNA, 25 bp, Homo sapien
cattcactggctctacactatatgt

SEQ ID NO: 45735 - DNA, 25 bp, Homo sapien
cattcacttaacaacgtcttttgca

SEQ ID NO: 45736 - DNA, 25 bp, Homo sapien
cattcacttaacaatgtcttttgca

SEQ ID NO: 45737 - DNA, 25 bp, Homo sapien
cattcacttcctgccatcattatcc

SEQ ID NO: 45738 - DNA, 25 bp, Homo sapien
cattcactttctgccatcattatcc

SEQ ID NO: 45739 - DNA, 25 bp, Homo sapien
cattcagaagaggcactgagggtaa

SEQ ID NO: 45740 - DNA, 25 bp, Homo sapien
cattcagaagagtcactgagggtaa

SEQ ID NO: 45741 - DNA, 25 bp, Homo sapien
cattcagaagctcgtagaattgttc

SEQ ID NO: 45742 - DNA, 25 bp, Homo sapien
cattcagaagcttgtagaattgttc

SEQ ID NO: 45743 - DNA, 25 bp, Homo sapien
cattcagacaaactacatgactggc

SEQ ID NO: 45744 - DNA, 25 bp, Homo sapien
cattcagacaaactacctgactggc

SEQ ID NO: 45745 - DNA, 25 bp, Homo sapien
cattcagccacaccgggaatgatgc

SEQ ID NO: 45746 - DNA, 25 bp, Homo sapien
cattcagccacgccgggaatgatgc

SEQ ID NO: 45747 - DNA, 25 bp, Homo sapien
cattcagccagaaagatcatgatga

SEQ ID NO: 45748 - DNA, 25 bp, Homo sapien
cattcagccaggaagatcatgatga

SEQ ID NO: 45749 - DNA, 25 bp, Homo sapien
cattcagcccacacatggggcacag

SEQ ID NO: 45750 - DNA, 25 bp, Homo sapien
cattcagcccacgcatggggcacag

SEQ ID NO: 45751 - DNA, 25 bp, Homo sapien
cattcagggacttatataccagttt

SEQ ID NO: 45752 - DNA, 25 bp, Homo sapien
cattcaggggcttatataccagttt

SEQ ID NO: 45753 - DNA, 25 bp, Homo sapien
cattcagtattttgacaagaattta

SEQ ID NO: 45754 - DNA, 25 bp, Homo sapien
cattcagtattttggcaagaattta

SEQ ID NO: 45755 - DNA, 25 bp, Homo sapien
cattcatcatacaaaagaatcatac

SEQ ID NO: 45756 - DNA, 25 bp, Homo sapien
cattcatcatataaaagaatcatac

SEQ ID NO: 45757 - DNA, 25 bp, Homo sapien
cattcatctaaacactccaaaaata

SEQ ID NO: 45758 - DNA, 25 bp, Homo sapien
cattcatctaaacatttttaaattt

SEQ ID NO: 45759 - DNA, 25 bp, Homo sapien
cattcatctcagaatatgtctggtc

SEQ ID NO: 45760 - DNA, 25 bp, Homo sapien
cattcatctcagagtatgtctggtc

SEQ ID NO: 45761 - DNA, 25 bp, Homo sapien
cattcatctcttcttatgggaatta

SEQ ID NO: 45762 - DNA, 25 bp, Homo sapien
cattcatctgaacactccaaaaata

SEQ ID NO: 45763 - DNA, 25 bp, Homo sapien
cattcatctgaacatttttaaattt

SEQ ID NO: 45764 - DNA, 25 bp, Homo sapien
cattcatctgttcttatgggaatta

SEQ ID NO: 45765 - DNA, 25 bp, Homo sapien
cattcatctttattctcaatctaat

SEQ ID NO: 45766 - DNA, 25 bp, Homo sapien
cattcatctttgttctcaatctaat

SEQ ID NO: 45767 - DNA, 25 bp, Homo sapien
cattcatgacactgaaaccagagta

SEQ ID NO: 45768 - DNA, 25 bp, Homo sapien
cattcatgatttcaacaatacttat

SEQ ID NO: 45769 - DNA, 25 bp, Homo sapien
cattcatgatttccacaatacttat

SEQ ID NO: 45770 - DNA, 25 bp, Homo sapien
cattcatgccactgaaaccagagta

SEQ ID NO: 45771 - DNA, 25 bp, Homo sapien
cattcatggtgtcatatagaagggg

SEQ ID NO: 45772 - DNA, 25 bp, Homo sapien
cattcatggtgtcgtatagaagggg

SEQ ID NO: 45773 - DNA, 25 bp, Homo sapien
cattcatgtattgtcaatagcagtg

SEQ ID NO: 45774 - DNA, 25 bp, Homo sapien
cattcatgtattgtcagtagcagtg

SEQ ID NO: 45775 - DNA, 25 bp, Homo sapien
cattcattcatctaaacactccaaa

SEQ ID NO: 45776 - DNA, 25 bp, Homo sapien
cattcattcatctgaacactccaaa

SEQ ID NO: 45777 - DNA, 25 bp, Homo sapien
cattcatttacacttactgacaaca

SEQ ID NO: 45778 - DNA, 25 bp, Homo sapien
cattcatttacagttactgacaaca

SEQ ID NO: 45779 - DNA, 25 bp, Homo sapien
cattccaaaaatcagcttactggta

SEQ ID NO: 45780 - DNA, 25 bp, Homo sapien
cattccaaaaatcggcttactggta

SEQ ID NO: 45781 - DNA, 25 bp, Homo sapien
cattccaaggcataaacttgttaaa

SEQ ID NO: 45782 - DNA, 25 bp, Homo sapien
cattccaaggcatgaacttgttaaa

SEQ ID NO: 45783 - DNA, 25 bp, Homo sapien
cattccacatctcctttctgcacat

SEQ ID NO: 45784 - DNA, 25 bp, Homo sapien
cattccacatctcttttctgcacat

SEQ ID NO: 45785 - DNA, 25 bp, Homo sapien
cattccaccatagttcagactatat

SEQ ID NO: 45786 - DNA, 25 bp, Homo sapien
cattccaccgtagttcagactatat

SEQ ID NO: 45787 - DNA, 25 bp, Homo sapien
cattccactccaaatattaatgtgt

SEQ ID NO: 45788 - DNA, 25 bp, Homo sapien
cattccactgcaaatattaatgtgt

SEQ ID NO: 45789 - DNA, 25 bp, Homo sapien
cattccacttccgacggactacagc

SEQ ID NO: 45790 - DNA, 25 bp, Homo sapien
cattccacttccgatggactacagc

SEQ ID NO: 45791 - DNA, 25 bp, Homo sapien
cattccataaaataggataagtgtc

SEQ ID NO: 45792 - DNA, 25 bp, Homo sapien
cattccataaaataggttaagtgtc

SEQ ID NO: 45793 - DNA, 25 bp, Homo sapien
cattccataacatcttaatggttgg

SEQ ID NO: 45794 - DNA, 25 bp, Homo sapien
cattccataacattttaatggttgg

SEQ ID NO: 45795 - DNA, 25 bp, Homo sapien
cattccattaaattcctcagagggt

SEQ ID NO: 45796 - DNA, 25 bp, Homo sapien
cattccatttaattcctcagagggt

SEQ ID NO: 45797 - DNA, 25 bp, Homo sapien
cattccattttacaatcagacagtt

SEQ ID NO: 45798 - DNA, 25 bp, Homo sapien
cattccattttataatcagacagtt

SEQ ID NO: 45799 - DNA, 25 bp, Homo sapien
cattcccaacaagtctggctacgag

SEQ ID NO: 45800 - DNA, 25 bp, Homo sapien
cattcccaacaagtttggctacgag

SEQ ID NO: 45801 - DNA, 25 bp, Homo sapien
cattccgtttacaaagggaaagaag

SEQ ID NO: 45802 - DNA, 25 bp, Homo sapien
cattccgtttaccaagggaaagaag

SEQ ID NO: 45803 - DNA, 25 bp, Homo sapien
cattcctcacttctactcactagat

SEQ ID NO: 45804 - DNA, 25 bp, Homo sapien
cattcctccagatccctgatacaaa

SEQ ID NO: 45805 - DNA, 25 bp, Homo sapien
cattcctccagatctctgatacaaa

SEQ ID NO: 45806 - DNA, 25 bp, Homo sapien
cattcctcgcttctactcactagat

SEQ ID NO: 45807 - DNA, 25 bp, Homo sapien
cattcctgcacaaccatctggcaaa

SEQ ID NO: 45808 - DNA, 25 bp, Homo sapien
cattcctgcacatccatctggcaaa

SEQ ID NO: 45809 - DNA, 25 bp, Homo sapien
cattcctggaaaactcagtgtacat

SEQ ID NO: 45810 - DNA, 25 bp, Homo sapien
cattcctggaaaattcagtgtacat

SEQ ID NO: 45811 - DNA, 25 bp, Homo sapien
cattcctttcattcaccagttttga

SEQ ID NO: 45812 - DNA, 25 bp, Homo sapien
cattcctttcattcgccagttttga

SEQ ID NO: 45813 - DNA, 25 bp, Homo sapien
cattcgacacaggtgtggattttcc

SEQ ID NO: 45814 - DNA, 25 bp, Homo sapien
cattcgacataggtgtggattttcc

SEQ ID NO: 45815 - DNA, 25 bp, Homo sapien
cattctaaaaggcagtttatttttc

SEQ ID NO: 45816 - DNA, 25 bp, Homo sapien
cattctaaacatcataaggaaatta

SEQ ID NO: 45817 - DNA, 25 bp, Homo sapien
cattctaaacatcgtaaggaaatta

SEQ ID NO: 45818 - DNA, 25 bp, Homo sapien
cattctaaagaataaagtcatgtaa

SEQ ID NO: 45819 - DNA, 25 bp, Homo sapien
cattctaaagagtaaagtcatgtaa

SEQ ID NO: 45820 - DNA, 25 bp, Homo sapien
cattctaaagggcagtttatttttc

SEQ ID NO: 45821 - DNA, 25 bp, Homo sapien
cattctagacagagaagttgaaaat

SEQ ID NO: 45822 - DNA, 25 bp, Homo sapien
cattctagacagcgaagttgaaaat

SEQ ID NO: 45823 - DNA, 25 bp, Homo sapien
cattctcagcgtttaatgcctaact

SEQ ID NO: 45824 - DNA, 25 bp, Homo sapien
cattctcagtgtttaatgcctaact

SEQ ID NO: 45825 - DNA, 25 bp, Homo sapien
cattctccagtttacatctccatat

SEQ ID NO: 45826 - DNA, 25 bp, Homo sapien
cattctccatcagctcactttccat

SEQ ID NO: 45827 - DNA, 25 bp, Homo sapien
cattctccatcatctcactttccat

SEQ ID NO: 45828 - DNA, 25 bp, Homo sapien
cattctccattttacatctccatat

SEQ ID NO: 45829 - DNA, 25 bp, Homo sapien
cattctctcacatgcttttacagtc

SEQ ID NO: 45830 - DNA, 25 bp, Homo sapien
cattctctcacatgtttttacagtc

SEQ ID NO: 45831 - DNA, 25 bp, Homo sapien
cattctctcagaaaacactgttgag

SEQ ID NO: 45832 - DNA, 25 bp, Homo sapien
cattctctcagagaacactgttgag

SEQ ID NO: 45833 - DNA, 25 bp, Homo sapien
cattctctctgcagattcacctatt

SEQ ID NO: 45834 - DNA, 25 bp, Homo sapien
cattctctctgcggattcacctatt

SEQ ID NO: 45835 - DNA, 25 bp, Homo sapien
cattctctgaaagaaaactaacagc

SEQ ID NO: 45836 - DNA, 25 bp, Homo sapien
cattctctgaaagaaagctaacagc

SEQ ID NO: 45837 - DNA, 25 bp, Homo sapien
cattctgagaccctttgtcacccta

SEQ ID NO: 45838 - DNA, 25 bp, Homo sapien
cattctgagaccctttttcacccta

SEQ ID NO: 45839 - DNA, 25 bp, Homo sapien
cattctgagagcaacttttgacaga

SEQ ID NO: 45840 - DNA, 25 bp, Homo sapien
cattctgagagcagcttttgacaga

SEQ ID NO: 45841 - DNA, 25 bp, Homo sapien
cattctgatcttcaccctgaatgag

SEQ ID NO: 45842 - DNA, 25 bp, Homo sapien
cattctgatcttctccctgaatgag

SEQ ID NO: 45843 - DNA, 25 bp, Homo sapien
cattctggcagcgccccctgctatg

SEQ ID NO: 45844 - DNA, 25 bp, Homo sapien
cattctggcagtgccccctgctatg

SEQ ID NO: 45845 - DNA, 25 bp, Homo sapien
cattctgtgaaacctttcaaagagg

SEQ ID NO: 45846 - DNA, 25 bp, Homo sapien
cattctgtgaaatctttcaaagagg

SEQ ID NO: 45847 - DNA, 25 bp, Homo sapien
cattcttaccaacagccctcagtga

SEQ ID NO: 45848 - DNA, 25 bp, Homo sapien
cattcttaccaacagctctcagtga

SEQ ID NO: 45849 - DNA, 25 bp, Homo sapien
cattcttaccctcagtgcacagaag

SEQ ID NO: 45850 - DNA, 25 bp, Homo sapien
cattcttactctcagtgcacagaag

SEQ ID NO: 45851 - DNA, 25 bp, Homo sapien
cattctttacaggaacagtatttct

SEQ ID NO: 45852 - DNA, 25 bp, Homo sapien
cattctttactaagcggtctcaata

SEQ ID NO: 45853 - DNA, 25 bp, Homo sapien
cattctttagctgataagttgatta

SEQ ID NO: 45854 - DNA, 25 bp, Homo sapien
cattctttagctggtaagttgatta

SEQ ID NO: 45855 - DNA, 25 bp, Homo sapien
cattctttagtaagcggtctcaata

SEQ ID NO: 45856 - DNA, 25 bp, Homo sapien
cattctttccttactgcaggacttc

SEQ ID NO: 45857 - DNA, 25 bp, Homo sapien
cattctttccttattgcaggacttc

SEQ ID NO: 45858 - DNA, 25 bp, Homo sapien
cattctttgcaggaacagtatttct

SEQ ID NO: 45859 - DNA, 25 bp, Homo sapien
cattcttttaccaatttccccttat

SEQ ID NO: 45860 - DNA, 25 bp, Homo sapien
cattcttttaccattttccccttat

SEQ ID NO: 45861 - DNA, 25 bp, Homo sapien
cattcttttgatggcactgattgga

SEQ ID NO: 45862 - DNA, 25 bp, Homo sapien
cattcttttgattgcactgattgga

SEQ ID NO: 45863 - DNA, 25 bp, Homo sapien
cattctttttctttcagatatcagc

SEQ ID NO: 45864 - DNA, 25 bp, Homo sapien
cattctttttcttttagatatcagc

SEQ ID NO: 45865 - DNA, 25 bp, Homo sapien
cattcttttttgagcacgtcattac

SEQ ID NO: 45866 - DNA, 25 bp, Homo sapien
cattcttttttgagcatgtcattac

SEQ ID NO: 45867 - DNA, 25 bp, Homo sapien
cattgaaatctataacccattttga

SEQ ID NO: 45868 - DNA, 25 bp, Homo sapien
cattgaaatctgtaacccattttga

SEQ ID NO: 45869 - DNA, 25 bp, Homo sapien
cattgaaggagtatgattaccacct

SEQ ID NO: 45870 - DNA, 25 bp, Homo sapien
cattgaaggagtgtgattaccacct

SEQ ID NO: 45871 - DNA, 25 bp, Homo sapien
cattgaagttattactgtttcttgt

SEQ ID NO: 45872 - DNA, 25 bp, Homo sapien
cattgaagttattcctgtttcttgt

SEQ ID NO: 45873 - DNA, 25 bp, Homo sapien
cattgaatcttgcgctacatagatt

SEQ ID NO: 45874 - DNA, 25 bp, Homo sapien
cattgaatcttgtgctacatagatt

SEQ ID NO: 45875 - DNA, 25 bp, Homo sapien
cattgaattaaggccgactctcatg

SEQ ID NO: 45876 - DNA, 25 bp, Homo sapien
cattgaattaaggccgcctctcatg

SEQ ID NO: 45877 - DNA, 25 bp, Homo sapien
cattgactatgggaagacttctgca

SEQ ID NO: 45878 - DNA, 25 bp, Homo sapien
cattgactatgggaagccttctgca

SEQ ID NO: 45879 - DNA, 25 bp, Homo sapien
cattgagacagtagttagacttggt

SEQ ID NO: 45880 - DNA, 25 bp, Homo sapien
cattgagacggtagttagacttggt

SEQ ID NO: 45881 - DNA, 25 bp, Homo sapien
cattgagcattttagaatttgggtt

SEQ ID NO: 45882 - DNA, 25 bp, Homo sapien
cattgagcattttagagtttgggtt

SEQ ID NO: 45883 - DNA, 25 bp, Homo sapien
cattgagtaattcttacgtggcagt

SEQ ID NO: 45884 - DNA, 25 bp, Homo sapien
cattgagtaattcttatgtggcagt

SEQ ID NO: 45885 - DNA, 25 bp, Homo sapien
cattgagtgaattcattacccaatc

SEQ ID NO: 45886 - DNA, 25 bp, Homo sapien
cattgagtgaattgattacccaatc

SEQ ID NO: 45887 - DNA, 25 bp, Homo sapien
cattgatagtgacatggctttattt

SEQ ID NO: 45888 - DNA, 25 bp, Homo sapien
cattgatattgacatggctttattt

SEQ ID NO: 45889 - DNA, 25 bp, Homo sapien
cattgatcatctaatccaattcctt

SEQ ID NO: 45890 - DNA, 25 bp, Homo sapien
cattgatcatctaatctaattcctt

SEQ ID NO: 45891 - DNA, 25 bp, Homo sapien
cattgatgatcaactgatttttgac

SEQ ID NO: 45892 - DNA, 25 bp, Homo sapien
cattgatgatcaattgatttttgac

SEQ ID NO: 45893 - DNA, 25 bp, Homo sapien
cattgatggatgaacagaaaatgtg

SEQ ID NO: 45894 - DNA, 25 bp, Homo sapien
cattgatggatgaatagaaaatgtg

SEQ ID NO: 45895 - DNA, 25 bp, Homo sapien
cattgatgtttaaagtaattgttga

SEQ ID NO: 45896 - DNA, 25 bp, Homo sapien
cattgatgtttaaagtgattgttga

SEQ ID NO: 45897 - DNA, 25 bp, Homo sapien
cattgattaccgataaaagtttgtt

SEQ ID NO: 45898 - DNA, 25 bp, Homo sapien
cattgattaccggtaaaagtttgtt

SEQ ID NO: 45899 - DNA, 25 bp, Homo sapien
cattgattgaaaggctattccattc

SEQ ID NO: 45900 - DNA, 25 bp, Homo sapien
cattgattgaagggctattccattc

SEQ ID NO: 45901 - DNA, 25 bp, Homo sapien
cattgatttctcgcactgagtctaa

SEQ ID NO: 45902 - DNA, 25 bp, Homo sapien
cattgatttctggcactgagtctaa

SEQ ID NO: 45903 - DNA, 25 bp, Homo sapien
cattgatttgtgcatctgtaaaatg

SEQ ID NO: 45904 - DNA, 25 bp, Homo sapien
cattgatttgtgtatctgtaaaatg

SEQ ID NO: 45905 - DNA, 25 bp, Homo sapien
cattgcaaaatttactactgagaca

SEQ ID NO: 45906 - DNA, 25 bp, Homo sapien
cattgcaaaggaagatccacatcta

SEQ ID NO: 45907 - DNA, 25 bp, Homo sapien
cattgcaaaggaggatccacatcta

SEQ ID NO: 45908 - DNA, 25 bp, Homo sapien
cattgcaaagtttactactgagaca

SEQ ID NO: 45909 - DNA, 25 bp, Homo sapien
cattgcaaataccaacaccagcgat

SEQ ID NO: 45910 - DNA, 25 bp, Homo sapien
cattgcaaatatcaacaccagcgat

SEQ ID NO: 45911 - DNA, 25 bp, Homo sapien
cattgcaagagccatggaggactct

SEQ ID NO: 45912 - DNA, 25 bp, Homo sapien
cattgcaagagccgtggaggactct

SEQ ID NO: 45913 - DNA, 25 bp, Homo sapien
cattgcacatgcattaaaaaaaaga

SEQ ID NO: 45914 - DNA, 25 bp, Homo sapien
cattgcacatgcgttaaaaaaaaga

SEQ ID NO: 45915 - DNA, 25 bp, Homo sapien
cattgcacatggcggtgatcaagcc

SEQ ID NO: 45916 - DNA, 25 bp, Homo sapien
cattgcacatggtggtgatcaagcc

SEQ ID NO: 45917 - DNA, 25 bp, Homo sapien
cattgcaggaaaggaagaaaccatt

SEQ ID NO: 45918 - DNA, 25 bp, Homo sapien
cattgcagggaaggaagaaaccatt

SEQ ID NO: 45919 - DNA, 25 bp, Homo sapien
cattgcagtaacttaacacaacaaa

SEQ ID NO: 45920 - DNA, 25 bp, Homo sapien
cattgcagtcttttccttggcagtc

SEQ ID NO: 45921 - DNA, 25 bp, Homo sapien
cattgcagtgacttaacacaacaaa

SEQ ID NO: 45922 - DNA, 25 bp, Homo sapien
cattgcagtggatgagaaataaatg

SEQ ID NO: 45923 - DNA, 25 bp, Homo sapien
cattgcagtgggtgagaaataaatg

SEQ ID NO: 45924 - DNA, 25 bp, Homo sapien
cattgcagtgttttccttggcagtc

SEQ ID NO: 45925 - DNA, 25 bp, Homo sapien
cattgcagttccactttgccccaca

SEQ ID NO: 45926 - DNA, 25 bp, Homo sapien
cattgcagttccccgtaaatagggt

SEQ ID NO: 45927 - DNA, 25 bp, Homo sapien
cattgcagttccctgtaaatagggt

SEQ ID NO: 45928 - DNA, 25 bp, Homo sapien
cattgcagttccgctttgccccaca

SEQ ID NO: 45929 - DNA, 25 bp, Homo sapien
cattgcataataaggggtatcagat

SEQ ID NO: 45930 - DNA, 25 bp, Homo sapien
cattgcatagtaaggggtatcagat

SEQ ID NO: 45931 - DNA, 25 bp, Homo sapien
cattgccctgaaaagaaggacccag

SEQ ID NO: 45932 - DNA, 25 bp, Homo sapien
cattgccctgaagagaaggacccag

SEQ ID NO: 45933 - DNA, 25 bp, Homo sapien
cattgcctggccatgtatcttttgg

SEQ ID NO: 45934 - DNA, 25 bp, Homo sapien
cattgcctggccttgtatcttttgg

SEQ ID NO: 45935 - DNA, 25 bp, Homo sapien
cattgccttggcgtgagactgatgg

SEQ ID NO: 45936 - DNA, 25 bp, Homo sapien
cattgccttggtgtgagactgatgg

SEQ ID NO: 45937 - DNA, 25 bp, Homo sapien
cattgctatccctatacaccaaggt

SEQ ID NO: 45938 - DNA, 25 bp, Homo sapien
cattgctatccctatataccaaggt

SEQ ID NO: 45939 - DNA, 25 bp, Homo sapien
cattgctccttacatgtcagaagca

SEQ ID NO: 45940 - DNA, 25 bp, Homo sapien
cattgctccttacgtgtcagaagca

SEQ ID NO: 45941 - DNA, 25 bp, Homo sapien
cattgctctctatcaatacctggag

SEQ ID NO: 45942 - DNA, 25 bp, Homo sapien
cattgctctctgtcaatacctggag

SEQ ID NO: 45943 - DNA, 25 bp, Homo sapien
cattgctgtcactgacttccatttg

SEQ ID NO: 45944 - DNA, 25 bp, Homo sapien
cattgctgtcatgaaaagtagtata

SEQ ID NO: 45945 - DNA, 25 bp, Homo sapien
cattgctgtcattaaaagtagtata

SEQ ID NO: 45946 - DNA, 25 bp, Homo sapien
cattgctgtcattgacttccatttg

SEQ ID NO: 45947 - DNA, 25 bp, Homo sapien
cattgcttatgcatcactcatctaa

SEQ ID NO: 45948 - DNA, 25 bp, Homo sapien
cattgcttatgcatcattcatctaa

SEQ ID NO: 45949 - DNA, 25 bp, Homo sapien
cattggaaagccagatgggagtgac

SEQ ID NO: 45950 - DNA, 25 bp, Homo sapien
cattggaaagccaggtgggagtgac

SEQ ID NO: 45951 - DNA, 25 bp, Homo sapien
cattggacaaaagacgataatgttt

SEQ ID NO: 45952 - DNA, 25 bp, Homo sapien
cattggacaaaagatgataatgttt

SEQ ID NO: 45953 - DNA, 25 bp, Homo sapien
cattggacactaccaatttcatgta

SEQ ID NO: 45954 - DNA, 25 bp, Homo sapien
cattggacactactaatttcatgta

SEQ ID NO: 45955 - DNA, 25 bp, Homo sapien
cattggactacttctatcatggaaa

SEQ ID NO: 45956 - DNA, 25 bp, Homo sapien
cattggactgcttctatcatggaaa

SEQ ID NO: 45957 - DNA, 25 bp, Homo sapien
cattggacttcaattatgcaactag

SEQ ID NO: 45958 - DNA, 25 bp, Homo sapien
cattggacttcagttatgcaactag

SEQ ID NO: 45959 - DNA, 25 bp, Homo sapien
cattggattacatacttcgaagtga

SEQ ID NO: 45960 - DNA, 25 bp, Homo sapien
cattggattacatatttcgaagtga

SEQ ID NO: 45961 - DNA, 25 bp, Homo sapien
cattggcacaatatgcagggctcag

SEQ ID NO: 45962 - DNA, 25 bp, Homo sapien
cattggcagaatatgcagggctcag

SEQ ID NO: 45963 - DNA, 25 bp, Homo sapien
cattggctaggaaaatgaatattta

SEQ ID NO: 45964 - DNA, 25 bp, Homo sapien
cattggctaggaaagtgaatattta

SEQ ID NO: 45965 - DNA, 25 bp, Homo sapien
cattggctggaaagagacaaggagt

SEQ ID NO: 45966 - DNA, 25 bp, Homo sapien
cattggctggagagagacaaggagt

SEQ ID NO: 45967 - DNA, 25 bp, Homo sapien
cattgggattgactgcatttgtgtg

SEQ ID NO: 45968 - DNA, 25 bp, Homo sapien
cattgggattgattgcatttgtgtg

SEQ ID NO: 45969 - DNA, 25 bp, Homo sapien
cattggggaagtaccctcggatcac

SEQ ID NO: 45970 - DNA, 25 bp, Homo sapien
cattggggaagtcccctcggatcac

SEQ ID NO: 45971 - DNA, 25 bp, Homo sapien
cattggggcatgtcttcaatgctct

SEQ ID NO: 45972 - DNA, 25 bp, Homo sapien
cattggggcatgtctttaatgctct

SEQ ID NO: 45973 - DNA, 25 bp, Homo sapien
cattgggtctgcatattgaactttt

SEQ ID NO: 45974 - DNA, 25 bp, Homo sapien
cattgggtttgcatattgaactttt

SEQ ID NO: 45975 - DNA, 25 bp, Homo sapien
cattgtaaagaagtagaatttaagt

SEQ ID NO: 45976 - DNA, 25 bp, Homo sapien
cattgtaaagaggtagaatttaagt

SEQ ID NO: 45977 - DNA, 25 bp, Homo sapien
cattgtaataaatgcggacagacta

SEQ ID NO: 45978 - DNA, 25 bp, Homo sapien
cattgtaataaatgtggacagacta

SEQ ID NO: 45979 - DNA, 25 bp, Homo sapien
cattgtacaactgcactccaacttg

SEQ ID NO: 45980 - DNA, 25 bp, Homo sapien
cattgtacgactgcactccaacttg

SEQ ID NO: 45981 - DNA, 25 bp, Homo sapien
cattgtagagatatttggttaattc

SEQ ID NO: 45982 - DNA, 25 bp, Homo sapien
cattgtagagatctttggttaattc

SEQ ID NO: 45983 - DNA, 25 bp, Homo sapien
cattgtagcagttttgcaagcccca

SEQ ID NO: 45984 - DNA, 25 bp, Homo sapien
cattgtagcatcagagatatgtctg

SEQ ID NO: 45985 - DNA, 25 bp, Homo sapien
cattgtagcgtcagagatatgtctg

SEQ ID NO: 45986 - DNA, 25 bp, Homo sapien
cattgtaggaagcggaagtatttta

SEQ ID NO: 45987 - DNA, 25 bp, Homo sapien
cattgtaggaagtggaagtatttta

SEQ ID NO: 45988 - DNA, 25 bp, Homo sapien
cattgtagtagttttgcaagcccca

SEQ ID NO: 45989 - DNA, 25 bp, Homo sapien
cattgtagtgcccattggaggttgg

SEQ ID NO: 45990 - DNA, 25 bp, Homo sapien
cattgtagtgccctttggaggttgg

SEQ ID NO: 45991 - DNA, 25 bp, Homo sapien
cattgtatctgccactgattgctgt

SEQ ID NO: 45992 - DNA, 25 bp, Homo sapien
cattgtatctgccgctgattgctgt

SEQ ID NO: 45993 - DNA, 25 bp, Homo sapien
cattgtcaaaggtagtatgagctct

SEQ ID NO: 45994 - DNA, 25 bp, Homo sapien
cattgtcaaaggtggtatgagctct

SEQ ID NO: 45995 - DNA, 25 bp, Homo sapien
cattgtcactccaagggctgaggtg

SEQ ID NO: 45996 - DNA, 25 bp, Homo sapien
cattgtcactccgagggctgaggtg

SEQ ID NO: 45997 - DNA, 25 bp, Homo sapien
cattgtcagtggaacctttcacatt

SEQ ID NO: 45998 - DNA, 25 bp, Homo sapien
cattgtcagtggaagctttcacatt

SEQ ID NO: 45999 - DNA, 25 bp, Homo sapien
cattgtcatttgatctttgtaaata

SEQ ID NO: 46000 - DNA, 25 bp, Homo sapien
cattgtcatttgatgtttgtaaata

SEQ ID NO: 46001 - DNA, 25 bp, Homo sapien
cattgtcctatgatgatacttcaca

SEQ ID NO: 46002 - DNA, 25 bp, Homo sapien
cattgtcctctatggagttgtgtca

SEQ ID NO: 46003 - DNA, 25 bp, Homo sapien
cattgtcctctgtggagttgtgtca

SEQ ID NO: 46004 - DNA, 25 bp, Homo sapien
cattgtcctgtgatgatacttcaca

SEQ ID NO: 46005 - DNA, 25 bp, Homo sapien
cattgtcctttgattcatggaggta

SEQ ID NO: 46006 - DNA, 25 bp, Homo sapien
cattgtcctttgtttcatggaggta

SEQ ID NO: 46007 - DNA, 25 bp, Homo sapien
cattgtctctactgctcacacaacc

SEQ ID NO: 46008 - DNA, 25 bp, Homo sapien
cattgtctctagtgctcacacaacc

SEQ ID NO: 46009 - DNA, 25 bp, Homo sapien
cattgtgaaaaaatagatggaagga

SEQ ID NO: 46010 - DNA, 25 bp, Homo sapien
cattgtgaaaagatagatggaagga

SEQ ID NO: 46011 - DNA, 25 bp, Homo sapien
cattgtgaatcctccataaatggtt

SEQ ID NO: 46012 - DNA, 25 bp, Homo sapien
cattgtgacttgttatttttctttt

SEQ ID NO: 46013 - DNA, 25 bp, Homo sapien
cattgtgacttgttctttttctttt

SEQ ID NO: 46014 - DNA, 25 bp, Homo sapien
cattgtgagtcctccataaatggtt

SEQ ID NO: 46015 - DNA, 25 bp, Homo sapien
cattgtgctaggtgccctggaggaa

SEQ ID NO: 46016 - DNA, 25 bp, Homo sapien
cattgtgctaggtgtcctggaggaa

SEQ ID NO: 46017 - DNA, 25 bp, Homo sapien
cattgtgtatagttgctgatcatgg

SEQ ID NO: 46018 - DNA, 25 bp, Homo sapien
cattgtgtcatcttcattgaaaaag

SEQ ID NO: 46019 - DNA, 25 bp, Homo sapien
cattgtgtcgtcttcattgaaaaag

SEQ ID NO: 46020 - DNA, 25 bp, Homo sapien
cattgtgtgtagttgctgatcatgg

SEQ ID NO: 46021 - DNA, 25 bp, Homo sapien
cattgtgttttctcaacgattcaac

SEQ ID NO: 46022 - DNA, 25 bp, Homo sapien
cattgtgttttctcaatgattcaac

SEQ ID NO: 46023 - DNA, 25 bp, Homo sapien
cattgttcttcaacgtcctactctg

SEQ ID NO: 46024 - DNA, 25 bp, Homo sapien
cattgttcttcaatgtcctactctg

SEQ ID NO: 46025 - DNA, 25 bp, Homo sapien
cattgttgcctgcccaaaatagtac

SEQ ID NO: 46026 - DNA, 25 bp, Homo sapien
cattgttgcctgtccaaaatagtac

SEQ ID NO: 46027 - DNA, 25 bp, Homo sapien
cattgttggagagcaggaagcatcc

SEQ ID NO: 46028 - DNA, 25 bp, Homo sapien
cattgttggagatgaggtcaggaaa

SEQ ID NO: 46029 - DNA, 25 bp, Homo sapien
cattgttggcgatgaggtcaggaaa

SEQ ID NO: 46030 - DNA, 25 bp, Homo sapien
cattgttgtagagcaggaagcatcc

SEQ ID NO: 46031 - DNA, 25 bp, Homo sapien
cattgtttctaaaaattcattactt

SEQ ID NO: 46032 - DNA, 25 bp, Homo sapien
cattgtttctaagaattcattactt

SEQ ID NO: 46033 - DNA, 25 bp, Homo sapien
cattgttttacttgttgttattgtt

SEQ ID NO: 46034 - DNA, 25 bp, Homo sapien
cattgttttcttgggatagcaagga

SEQ ID NO: 46035 - DNA, 25 bp, Homo sapien
cattgttttctttggatagcaagga

SEQ ID NO: 46036 - DNA, 25 bp, Homo sapien
cattgttttgcttgttgttattgtt

SEQ ID NO: 46037 - DNA, 25 bp, Homo sapien
catttaaaacatgcaactcaatgat

SEQ ID NO: 46038 - DNA, 25 bp, Homo sapien
catttaaaacatgcaattcaatgat

SEQ ID NO: 46039 - DNA, 25 bp, Homo sapien
catttaaacattgtctctgctgggt

SEQ ID NO: 46040 - DNA, 25 bp, Homo sapien
catttaaacattgtctttgctgggt

SEQ ID NO: 46041 - DNA, 25 bp, Homo sapien
catttaaagagccatgattattgta

SEQ ID NO: 46042 - DNA, 25 bp, Homo sapien
catttaaagagccgtgattattgta

SEQ ID NO: 46043 - DNA, 25 bp, Homo sapien
catttaaccatgtcccagaacaaaa

SEQ ID NO: 46044 - DNA, 25 bp, Homo sapien
catttaacgatgtcccagaacaaaa

SEQ ID NO: 46045 - DNA, 25 bp, Homo sapien
catttaagcagatgtcaaggggatt

SEQ ID NO: 46046 - DNA, 25 bp, Homo sapien
catttaagctaactttgtcatggga

SEQ ID NO: 46047 - DNA, 25 bp, Homo sapien
catttaagctaattttgtcatggga

SEQ ID NO: 46048 - DNA, 25 bp, Homo sapien
catttaaggagatgtcaaggggatt

SEQ ID NO: 46049 - DNA, 25 bp, Homo sapien
catttaatcctcataataactccat

SEQ ID NO: 46050 - DNA, 25 bp, Homo sapien
catttaatgagcatcttagttatat

SEQ ID NO: 46051 - DNA, 25 bp, Homo sapien
catttaatgagcgtcttagttatat

SEQ ID NO: 46052 - DNA, 25 bp, Homo sapien
catttaattcccacatgaactctat

SEQ ID NO: 46053 - DNA, 25 bp, Homo sapien
catttaattcccacgtgaactctat

SEQ ID NO: 46054 - DNA, 25 bp, Homo sapien
catttaattctcataataactccat

SEQ ID NO: 46055 - DNA, 25 bp, Homo sapien
catttacatgtcgtctgggctgctt

SEQ ID NO: 46056 - DNA, 25 bp, Homo sapien
catttacatgttgtctgggctgctt

SEQ ID NO: 46057 - DNA, 25 bp, Homo sapien
catttacatgtttaacaagctacca

SEQ ID NO: 46058 - DNA, 25 bp, Homo sapien
catttacatttttaacaagctacca

SEQ ID NO: 46059 - DNA, 25 bp, Homo sapien
catttaccaaggccgtgaaagtatg

SEQ ID NO: 46060 - DNA, 25 bp, Homo sapien
catttaccaaggctgtgaaagtatg

SEQ ID NO: 46061 - DNA, 25 bp, Homo sapien
catttaccctgagttagtgtttctc

SEQ ID NO: 46062 - DNA, 25 bp, Homo sapien
catttaccgtgagttagtgtttctc

SEQ ID NO: 46063 - DNA, 25 bp, Homo sapien
catttacctacttcaaaacatggaa

SEQ ID NO: 46064 - DNA, 25 bp, Homo sapien
catttacctgcttcaaaacatggaa

SEQ ID NO: 46065 - DNA, 25 bp, Homo sapien
catttacgtagacgtttttgtgtga

SEQ ID NO: 46066 - DNA, 25 bp, Homo sapien
catttacgtagtcgtttttgtgtga

SEQ ID NO: 46067 - DNA, 25 bp, Homo sapien
catttactaaatcatcaagagtaaa

SEQ ID NO: 46068 - DNA, 25 bp, Homo sapien
catttactaaatcatcgagagtaaa

SEQ ID NO: 46069 - DNA, 25 bp, Homo sapien
catttacttgggttccgctcagcaa

SEQ ID NO: 46070 - DNA, 25 bp, Homo sapien
catttacttgggtttcgctcagcaa

SEQ ID NO: 46071 - DNA, 25 bp, Homo sapien
catttacttgtggccgatgagttgt

SEQ ID NO: 46072 - DNA, 25 bp, Homo sapien
catttacttgtggtcgatgagttgt

SEQ ID NO: 46073 - DNA, 25 bp, Homo sapien
catttacttttcgtcatgctggatt

SEQ ID NO: 46074 - DNA, 25 bp, Homo sapien
catttacttttggtcatgctggatt

SEQ ID NO: 46075 - DNA, 25 bp, Homo sapien
catttagaaaagagcaaaccgtaga

SEQ ID NO: 46076 - DNA, 25 bp, Homo sapien
catttagaacccaaccatttctacc

SEQ ID NO: 46077 - DNA, 25 bp, Homo sapien
catttagaacccagccatttctacc

SEQ ID NO: 46078 - DNA, 25 bp, Homo sapien
catttagagaagagcaaaccgtaga

SEQ ID NO: 46079 - DNA, 25 bp, Homo sapien
catttaggcgtctaaaggtgacact

SEQ ID NO: 46080 - DNA, 25 bp, Homo sapien
catttaggtgtctaaaggtgacact

SEQ ID NO: 46081 - DNA, 25 bp, Homo sapien
catttagtataacattgatgccgcc

SEQ ID NO: 46082 - DNA, 25 bp, Homo sapien
catttagtctacataatacatccct

SEQ ID NO: 46083 - DNA, 25 bp, Homo sapien
catttagtctacgtaatacatccct

SEQ ID NO: 46084 - DNA, 25 bp, Homo sapien
catttagtgtaacattgatgccgcc

SEQ ID NO: 46085 - DNA, 25 bp, Homo sapien
catttatacatcatcactctctgga

SEQ ID NO: 46086 - DNA, 25 bp, Homo sapien
catttatacatcgtcactctctgga

SEQ ID NO: 46087 - DNA, 25 bp, Homo sapien
catttatcaatcacctgcaatgccc

SEQ ID NO: 46088 - DNA, 25 bp, Homo sapien
catttatcaattacctgcaatgccc

SEQ ID NO: 46089 - DNA, 25 bp, Homo sapien
catttatcactcaagactattgtgt

SEQ ID NO: 46090 - DNA, 25 bp, Homo sapien
catttatcactcaggactattgtgt

SEQ ID NO: 46091 - DNA, 25 bp, Homo sapien
catttatcagtccatgagtaatact

SEQ ID NO: 46092 - DNA, 25 bp, Homo sapien
catttatcagtccgtgagtaatact

SEQ ID NO: 46093 - DNA, 25 bp, Homo sapien
catttatctgaaactagagttcgta

SEQ ID NO: 46094 - DNA, 25 bp, Homo sapien
catttatctgaaattagagttcgta

SEQ ID NO: 46095 - DNA, 25 bp, Homo sapien
catttatctttctacgcctctgttt

SEQ ID NO: 46096 - DNA, 25 bp, Homo sapien
catttatctttctatgcctctgttt

SEQ ID NO: 46097 - DNA, 25 bp, Homo sapien
catttatgttccgacccaaaggaca

SEQ ID NO: 46098 - DNA, 25 bp, Homo sapien
catttatgttctgacccaaaggaca

SEQ ID NO: 46099 - DNA, 25 bp, Homo sapien
catttattcctcagctatgacattc

SEQ ID NO: 46100 - DNA, 25 bp, Homo sapien
catttattcctcagctgtgacattc

SEQ ID NO: 46101 - DNA, 25 bp, Homo sapien
catttatttctcaaagttctggaga

SEQ ID NO: 46102 - DNA, 25 bp, Homo sapien
catttatttctcagcctgatgatag

SEQ ID NO: 46103 - DNA, 25 bp, Homo sapien
catttatttctgaaagttctggaga

SEQ ID NO: 46104 - DNA, 25 bp, Homo sapien
catttatttcttgcattgttatgtt

SEQ ID NO: 46105 - DNA, 25 bp, Homo sapien
catttatttgaaccttttttgacca

SEQ ID NO: 46106 - DNA, 25 bp, Homo sapien
catttatttgaactttttttgacca

SEQ ID NO: 46107 - DNA, 25 bp, Homo sapien
catttatttgtcagcctgatgatag

SEQ ID NO: 46108 - DNA, 25 bp, Homo sapien
catttatttgttgcattgttatgtt

SEQ ID NO: 46109 - DNA, 25 bp, Homo sapien
catttcaagcagcaaaatggaagga

SEQ ID NO: 46110 - DNA, 25 bp, Homo sapien
catttcaagtagcaaaatggaagga

SEQ ID NO: 46111 - DNA, 25 bp, Homo sapien
catttcacagcctcttctcaaggac

SEQ ID NO: 46112 - DNA, 25 bp, Homo sapien
catttcacatcctcttctcaaggac

SEQ ID NO: 46113 - DNA, 25 bp, Homo sapien
catttcaccataagcgtgcatgcag

SEQ ID NO: 46114 - DNA, 25 bp, Homo sapien
catttcaccataggcgtgcatgcag

SEQ ID NO: 46115 - DNA, 25 bp, Homo sapien
catttcaccgtcttctcatggatgg

SEQ ID NO: 46116 - DNA, 25 bp, Homo sapien
catttcactgtcttctcatggatgg

SEQ ID NO: 46117 - DNA, 25 bp, Homo sapien
catttcaggcaaagaaagtaggtta

SEQ ID NO: 46118 - DNA, 25 bp, Homo sapien
catttcaggcagagaaagtaggtta

SEQ ID NO: 46119 - DNA, 25 bp, Homo sapien
catttcaggtataaaggcaggcgag

SEQ ID NO: 46120 - DNA, 25 bp, Homo sapien
catttcaggtataaagtcaggcgag

SEQ ID NO: 46121 - DNA, 25 bp, Homo sapien
catttcagtaaaaggaaagagtaag

SEQ ID NO: 46122 - DNA, 25 bp, Homo sapien
catttcagtaaaatgaaagagtaag

SEQ ID NO: 46123 - DNA, 25 bp, Homo sapien
catttcagtccagctaaattagaaa

SEQ ID NO: 46124 - DNA, 25 bp, Homo sapien
catttcagtccagttaaattagaaa

SEQ ID NO: 46125 - DNA, 25 bp, Homo sapien
catttcatataacactaattttcct

SEQ ID NO: 46126 - DNA, 25 bp, Homo sapien
catttcatctaacactaattttcct

SEQ ID NO: 46127 - DNA, 25 bp, Homo sapien
catttcatggagatttgtgagtaac

SEQ ID NO: 46128 - DNA, 25 bp, Homo sapien
catttcatggagatttttgagtaac

SEQ ID NO: 46129 - DNA, 25 bp, Homo sapien
catttccaaaatagctgcctaaaat

SEQ ID NO: 46130 - DNA, 25 bp, Homo sapien
catttccaaaataggtgcctaaaat

SEQ ID NO: 46131 - DNA, 25 bp, Homo sapien
catttccaaatagctgaactgtaaa

SEQ ID NO: 46132 - DNA, 25 bp, Homo sapien
catttccaaatagttgaactgtaaa

SEQ ID NO: 46133 - DNA, 25 bp, Homo sapien
catttccaagccactgctacctagt

SEQ ID NO: 46134 - DNA, 25 bp, Homo sapien
catttccaagtctgggttaatcatt

SEQ ID NO: 46135 - DNA, 25 bp, Homo sapien
catttccaagtttgggttaatcatt

SEQ ID NO: 46136 - DNA, 25 bp, Homo sapien
catttccacagaattgtcattattt

SEQ ID NO: 46137 - DNA, 25 bp, Homo sapien
catttccacggaattgtcattattt

SEQ ID NO: 46138 - DNA, 25 bp, Homo sapien
catttccagctgactcacagtgggc

SEQ ID NO: 46139 - DNA, 25 bp, Homo sapien
catttccaggccactgctacctagt

SEQ ID NO: 46140 - DNA, 25 bp, Homo sapien
catttccagttgactcacagtgggc

SEQ ID NO: 46141 - DNA, 25 bp, Homo sapien
catttccatttgctctgccattcaa

SEQ ID NO: 46142 - DNA, 25 bp, Homo sapien
catttccatttgttctgccattcaa

SEQ ID NO: 46143 - DNA, 25 bp, Homo sapien
catttcccacatgagcactgcaaac

SEQ ID NO: 46144 - DNA, 25 bp, Homo sapien
catttcccatatgagcactgcaaac

SEQ ID NO: 46145 - DNA, 25 bp, Homo sapien
catttcccgttaggaaccacgattc

SEQ ID NO: 46146 - DNA, 25 bp, Homo sapien
catttccctttaggaaccacgattc

SEQ ID NO: 46147 - DNA, 25 bp, Homo sapien
catttccgacaaagttcttccttcc

SEQ ID NO: 46148 - DNA, 25 bp, Homo sapien
catttccggcaaagttcttccttcc

SEQ ID NO: 46149 - DNA, 25 bp, Homo sapien
catttcctcatagtttcaccaccca

SEQ ID NO: 46150 - DNA, 25 bp, Homo sapien
catttcctggtgatcacattcccaa

SEQ ID NO: 46151 - DNA, 25 bp, Homo sapien
catttcctggtgatcatattcccaa

SEQ ID NO: 46152 - DNA, 25 bp, Homo sapien
catttcctgttgtggaagcaggagg

SEQ ID NO: 46153 - DNA, 25 bp, Homo sapien
catttccttaaggtcccatcatctt

SEQ ID NO: 46154 - DNA, 25 bp, Homo sapien
catttccttaaggtccgatcatctt

SEQ ID NO: 46155 - DNA, 25 bp, Homo sapien
catttccttatagtttcaccaccca

SEQ ID NO: 46156 - DNA, 25 bp, Homo sapien
catttcctttcacctgcgcagtcac

SEQ ID NO: 46157 - DNA, 25 bp, Homo sapien
catttcctttcacctgggcagtcac

SEQ ID NO: 46158 - DNA, 25 bp, Homo sapien
catttccttttgaagtagatgttta

SEQ ID NO: 46159 - DNA, 25 bp, Homo sapien
catttccttttgaggtagatgttta

SEQ ID NO: 46160 - DNA, 25 bp, Homo sapien
catttccttttgtggaagcaggagg

SEQ ID NO: 46161 - DNA, 25 bp, Homo sapien
catttctaccatcatagcccaagcc

SEQ ID NO: 46162 - DNA, 25 bp, Homo sapien
catttctaccatcgtagcccaagcc

SEQ ID NO: 46163 - DNA, 25 bp, Homo sapien
catttctccataccaagaaaattca

SEQ ID NO: 46164 - DNA, 25 bp, Homo sapien
catttctccgtaccaagaaaattca

SEQ ID NO: 46165 - DNA, 25 bp, Homo sapien
catttctctatccatgtaccttaag

SEQ ID NO: 46166 - DNA, 25 bp, Homo sapien
catttctctatccgtgtaccttaag

SEQ ID NO: 46167 - DNA, 25 bp, Homo sapien
catttctctctgacagtcccattga

SEQ ID NO: 46168 - DNA, 25 bp, Homo sapien
catttctctctgatgtcaaagattt

SEQ ID NO: 46169 - DNA, 25 bp, Homo sapien
catttctctctggtgtcaaagattt

SEQ ID NO: 46170 - DNA, 25 bp, Homo sapien
catttctctcttacagtcccattga

SEQ ID NO: 46171 - DNA, 25 bp, Homo sapien
catttctgcagttattaaaagttat

SEQ ID NO: 46172 - DNA, 25 bp, Homo sapien
catttctgcagttcttaaaagttat

SEQ ID NO: 46173 - DNA, 25 bp, Homo sapien
catttctgcataacttgtgtgtgtg

SEQ ID NO: 46174 - DNA, 25 bp, Homo sapien
catttctgcataatttgtgtgtgtg

SEQ ID NO: 46175 - DNA, 25 bp, Homo sapien
catttctgccattacattagtcaac

SEQ ID NO: 46176 - DNA, 25 bp, Homo sapien
catttctgtcattacattagtcaac

SEQ ID NO: 46177 - DNA, 25 bp, Homo sapien
catttctgtggggtgaatggtaatg

SEQ ID NO: 46178 - DNA, 25 bp, Homo sapien
catttctgtgggttgaatggtaatg

SEQ ID NO: 46179 - DNA, 25 bp, Homo sapien
catttctgtgttgggtcactttcct

SEQ ID NO: 46180 - DNA, 25 bp, Homo sapien
catttctgttttgggtcactttcct

SEQ ID NO: 46181 - DNA, 25 bp, Homo sapien
catttcttcaccatggggtaacatc

SEQ ID NO: 46182 - DNA, 25 bp, Homo sapien
catttcttcactatggggtaacatc

SEQ ID NO: 46183 - DNA, 25 bp, Homo sapien
catttcttcttcaagtaatcaaaag

SEQ ID NO: 46184 - DNA, 25 bp, Homo sapien
catttcttggtaatgaagaccactg

SEQ ID NO: 46185 - DNA, 25 bp, Homo sapien
catttcttggtaatgaggaccactg

SEQ ID NO: 46186 - DNA, 25 bp, Homo sapien
catttcttgtgacacctaacttttc

SEQ ID NO: 46187 - DNA, 25 bp, Homo sapien
catttcttgtggcacctaacttttc

SEQ ID NO: 46188 - DNA, 25 bp, Homo sapien
catttctttccaagtctgcataagc

SEQ ID NO: 46189 - DNA, 25 bp, Homo sapien
catttctttccaattctgcataagc

SEQ ID NO: 46190 - DNA, 25 bp, Homo sapien
catttctttctcatcttagatgctt

SEQ ID NO: 46191 - DNA, 25 bp, Homo sapien
catttctttctcgtcttagatgctt

SEQ ID NO: 46192 - DNA, 25 bp, Homo sapien
catttctttttcaagtaatcaaaag

SEQ ID NO: 46193 - DNA, 25 bp, Homo sapien
catttgaaaaaaacaatcattctcc

SEQ ID NO: 46194 - DNA, 25 bp, Homo sapien
catttgaacgatatacttcaacttt

SEQ ID NO: 46195 - DNA, 25 bp, Homo sapien
catttgaactatatacttcaacttt

SEQ ID NO: 46196 - DNA, 25 bp, Homo sapien
catttgaagaaaacaatcattctcc

SEQ ID NO: 46197 - DNA, 25 bp, Homo sapien
catttgaccagcatccagatcaaga

SEQ ID NO: 46198 - DNA, 25 bp, Homo sapien
catttgaccagcttccagatcaaga

SEQ ID NO: 46199 - DNA, 25 bp, Homo sapien
catttgatactgagttgggtgctaa

SEQ ID NO: 46200 - DNA, 25 bp, Homo sapien
catttgatattgagttgggtgctaa

SEQ ID NO: 46201 - DNA, 25 bp, Homo sapien
catttgatctttgtaaatatctcaa

SEQ ID NO: 46202 - DNA, 25 bp, Homo sapien
catttgatgatctagtcactctgta

SEQ ID NO: 46203 - DNA, 25 bp, Homo sapien
catttgatggtctagtcactctgta

SEQ ID NO: 46204 - DNA, 25 bp, Homo sapien
catttgatgtttgtaaatatctcaa

SEQ ID NO: 46205 - DNA, 25 bp, Homo sapien
catttgcaaatccttggttcacaat

SEQ ID NO: 46206 - DNA, 25 bp, Homo sapien
catttgcaaatcgttggttcacaat

SEQ ID NO: 46207 - DNA, 25 bp, Homo sapien
catttgcccgtacagcattgtggag

SEQ ID NO: 46208 - DNA, 25 bp, Homo sapien
catttgcctgtacagcattgtggag

SEQ ID NO: 46209 - DNA, 25 bp, Homo sapien
catttgctattctcattgcacatcc

SEQ ID NO: 46210 - DNA, 25 bp, Homo sapien
catttgctcagcatcttgcctgtgc

SEQ ID NO: 46211 - DNA, 25 bp, Homo sapien
catttgctcggcatcttgcctgtgc

SEQ ID NO: 46212 - DNA, 25 bp, Homo sapien
catttgctgttctcattgcacatcc

SEQ ID NO: 46213 - DNA, 25 bp, Homo sapien
catttggaaattatgttttactcat

SEQ ID NO: 46214 - DNA, 25 bp, Homo sapien
catttggaaattgtgttttactcat

SEQ ID NO: 46215 - DNA, 25 bp, Homo sapien
catttggaatacaataaaatgcttg

SEQ ID NO: 46216 - DNA, 25 bp, Homo sapien
catttggaatacaatagaatgcttg

SEQ ID NO: 46217 - DNA, 25 bp, Homo sapien
catttggacccacaggtaataggtg

SEQ ID NO: 46218 - DNA, 25 bp, Homo sapien
catttggacccgcaggtaataggtg

SEQ ID NO: 46219 - DNA, 25 bp, Homo sapien
catttggctccaagagagatgaagc

SEQ ID NO: 46220 - DNA, 25 bp, Homo sapien
catttggctccaatagagatgaagc

SEQ ID NO: 46221 - DNA, 25 bp, Homo sapien
catttggctgtcagtgaagcggaag

SEQ ID NO: 46222 - DNA, 25 bp, Homo sapien
catttggctgttagtgaagcggaag

SEQ ID NO: 46223 - DNA, 25 bp, Homo sapien
catttgggatgactaaaaagttttg

SEQ ID NO: 46224 - DNA, 25 bp, Homo sapien
catttgggatgattaaaaagttttg

SEQ ID NO: 46225 - DNA, 25 bp, Homo sapien
catttggtagcatttaaggcacaga

SEQ ID NO: 46226 - DNA, 25 bp, Homo sapien
catttggtggcatttaaggcacaga

SEQ ID NO: 46227 - DNA, 25 bp, Homo sapien
catttggttcacttcgctactactg

SEQ ID NO: 46228 - DNA, 25 bp, Homo sapien
catttggttcactttgctactactg

SEQ ID NO: 46229 - DNA, 25 bp, Homo sapien
catttgtacaacagcaatgacccaa

SEQ ID NO: 46230 - DNA, 25 bp, Homo sapien
catttgtacaacagcactgacccaa

SEQ ID NO: 46231 - DNA, 25 bp, Homo sapien
catttgtacatcttaaaaattgaca

SEQ ID NO: 46232 - DNA, 25 bp, Homo sapien
catttgtacatcttgaaaattgaca

SEQ ID NO: 46233 - DNA, 25 bp, Homo sapien
catttgtatttcagttgcatcagtt

SEQ ID NO: 46234 - DNA, 25 bp, Homo sapien
catttgtatttgcagtcttctgctt

SEQ ID NO: 46235 - DNA, 25 bp, Homo sapien
catttgtattttagttgcatcagtt

SEQ ID NO: 46236 - DNA, 25 bp, Homo sapien
catttgtattttcagtcttctgctt

SEQ ID NO: 46237 - DNA, 25 bp, Homo sapien
catttgtattttctacctaattggc

SEQ ID NO: 46238 - DNA, 25 bp, Homo sapien
catttgtattttctccctaattggc

SEQ ID NO: 46239 - DNA, 25 bp, Homo sapien
catttgtcctccaaacttctcaaaa

SEQ ID NO: 46240 - DNA, 25 bp, Homo sapien
catttgtctcttgcacccagttcac

SEQ ID NO: 46241 - DNA, 25 bp, Homo sapien
catttgtctcttgcactcagttcac

SEQ ID NO: 46242 - DNA, 25 bp, Homo sapien
catttgtctgtgatccctgaagcaa

SEQ ID NO: 46243 - DNA, 25 bp, Homo sapien
catttgtcttccaaacttctcaaaa

SEQ ID NO: 46244 - DNA, 25 bp, Homo sapien
catttgtctttgatccctgaagcaa

SEQ ID NO: 46245 - DNA, 25 bp, Homo sapien
catttgtgagtaatcaaacagttga

SEQ ID NO: 46246 - DNA, 25 bp, Homo sapien
catttgtgagtaatcagacagttga

SEQ ID NO: 46247 - DNA, 25 bp, Homo sapien
catttgtgcataaatacacaggcat

SEQ ID NO: 46248 - DNA, 25 bp, Homo sapien
catttgtgcattcactgaagtagca

SEQ ID NO: 46249 - DNA, 25 bp, Homo sapien
catttgtgcgtaaatacacaggcat

SEQ ID NO: 46250 - DNA, 25 bp, Homo sapien
catttgtgcgttcactgaagtagca

SEQ ID NO: 46251 - DNA, 25 bp, Homo sapien
catttgtgtcttgctgccttcagtc

SEQ ID NO: 46252 - DNA, 25 bp, Homo sapien
catttgtgtcttgctggcttcagtc

SEQ ID NO: 46253 - DNA, 25 bp, Homo sapien
catttgtgtttacgcatttaccttc

SEQ ID NO: 46254 - DNA, 25 bp, Homo sapien
catttgtgtttatgcatttaccttc

SEQ ID NO: 46255 - DNA, 25 bp, Homo sapien
catttgttgagcattggcaataagt

SEQ ID NO: 46256 - DNA, 25 bp, Homo sapien
catttgttgagcgttggcaataagt

SEQ ID NO: 46257 - DNA, 25 bp, Homo sapien
catttgttgatttggcctattgttg

SEQ ID NO: 46258 - DNA, 25 bp, Homo sapien
catttgttggtttggcctattgttg

SEQ ID NO: 46259 - DNA, 25 bp, Homo sapien
catttgtttctgagaccaggaaata

SEQ ID NO: 46260 - DNA, 25 bp, Homo sapien
catttgtttcttagaccaggaaata

SEQ ID NO: 46261 - DNA, 25 bp, Homo sapien
catttgttttatcccaagccattgt

SEQ ID NO: 46262 - DNA, 25 bp, Homo sapien
catttgttttatcccaggccattgt

SEQ ID NO: 46263 - DNA, 25 bp, Homo sapien
cattttaacactcaccatagctcag

SEQ ID NO: 46264 - DNA, 25 bp, Homo sapien
cattttaacactcatcatagctcag

SEQ ID NO: 46265 - DNA, 25 bp, Homo sapien
cattttacactcactgactgtgttg

SEQ ID NO: 46266 - DNA, 25 bp, Homo sapien
cattttacacttactgactgtgttg

SEQ ID NO: 46267 - DNA, 25 bp, Homo sapien
cattttacgctgacaaacccaatct

SEQ ID NO: 46268 - DNA, 25 bp, Homo sapien
cattttacgctgaccaacccaatct

SEQ ID NO: 46269 - DNA, 25 bp, Homo sapien
cattttactgctacgtctctcaggt

SEQ ID NO: 46270 - DNA, 25 bp, Homo sapien
cattttactgctatgtctctcaggt

SEQ ID NO: 46271 - DNA, 25 bp, Homo sapien
cattttagaatacctcatgagattg

SEQ ID NO: 46272 - DNA, 25 bp, Homo sapien
cattttagaatacttcatgagattg

SEQ ID NO: 46273 - DNA, 25 bp, Homo sapien
cattttagatgtcttgcttaattag

SEQ ID NO: 46274 - DNA, 25 bp, Homo sapien
cattttagccttacagaactcctat

SEQ ID NO: 46275 - DNA, 25 bp, Homo sapien
cattttagccttacggaactcctat

SEQ ID NO: 46276 - DNA, 25 bp, Homo sapien
cattttagttgtcttgcttaattag

SEQ ID NO: 46277 - DNA, 25 bp, Homo sapien
cattttatactcctactaacagtgc

SEQ ID NO: 46278 - DNA, 25 bp, Homo sapien
cattttatactgctactaacagtgc

SEQ ID NO: 46279 - DNA, 25 bp, Homo sapien
cattttatatagtcaatatccgtgt

SEQ ID NO: 46280 - DNA, 25 bp, Homo sapien
cattttatatagtcgatatccgtgt

SEQ ID NO: 46281 - DNA, 25 bp, Homo sapien
cattttatcctatctgagtccccag

SEQ ID NO: 46282 - DNA, 25 bp, Homo sapien
cattttattatgtgatttttcctgc

SEQ ID NO: 46283 - DNA, 25 bp, Homo sapien
cattttattatgtggtttttcctgc

SEQ ID NO: 46284 - DNA, 25 bp, Homo sapien
cattttattctatctgagtccccag

SEQ ID NO: 46285 - DNA, 25 bp, Homo sapien
cattttcaaaaaacggtcagctgat

SEQ ID NO: 46286 - DNA, 25 bp, Homo sapien
cattttcaaaaaatggtcagctgat

SEQ ID NO: 46287 - DNA, 25 bp, Homo sapien
cattttcaactgtgggaatcaagac

SEQ ID NO: 46288 - DNA, 25 bp, Homo sapien
cattttcaatcctcagagatggaaa

SEQ ID NO: 46289 - DNA, 25 bp, Homo sapien
cattttcaattgtgggaatcaagac

SEQ ID NO: 46290 - DNA, 25 bp, Homo sapien
cattttcacataaagcatgcacttt

SEQ ID NO: 46291 - DNA, 25 bp, Homo sapien
cattttcacgggtgtaggttttctc

SEQ ID NO: 46292 - DNA, 25 bp, Homo sapien
cattttcacgggtttaggttttctc

SEQ ID NO: 46293 - DNA, 25 bp, Homo sapien
cattttcagcaagttcattagttgg

SEQ ID NO: 46294 - DNA, 25 bp, Homo sapien
cattttcagtaagttcattagttgg

SEQ ID NO: 46295 - DNA, 25 bp, Homo sapien
cattttcagtcctcagagatggaaa

SEQ ID NO: 46296 - DNA, 25 bp, Homo sapien
cattttcatataaagcatgcacttt

SEQ ID NO: 46297 - DNA, 25 bp, Homo sapien
cattttccaaggcaccactgttaaa

SEQ ID NO: 46298 - DNA, 25 bp, Homo sapien
cattttccaaggtaccactgttaaa

SEQ ID NO: 46299 - DNA, 25 bp, Homo sapien
cattttccactatgtactccaagtt

SEQ ID NO: 46300 - DNA, 25 bp, Homo sapien
cattttccattatgtactccaagtt

SEQ ID NO: 46301 - DNA, 25 bp, Homo sapien
cattttccttacgttgctaatacaa

SEQ ID NO: 46302 - DNA, 25 bp, Homo sapien
cattttccttatgttgctaatacaa

SEQ ID NO: 46303 - DNA, 25 bp, Homo sapien
cattttctaccacgctcccttaccc

SEQ ID NO: 46304 - DNA, 25 bp, Homo sapien
cattttctaccatgctcccttaccc

SEQ ID NO: 46305 - DNA, 25 bp, Homo sapien
cattttctaggttccacattcgtct

SEQ ID NO: 46306 - DNA, 25 bp, Homo sapien
cattttctaggttgcacattcgtct

SEQ ID NO: 46307 - DNA, 25 bp, Homo sapien
cattttctcaccatattgctcaaac

SEQ ID NO: 46308 - DNA, 25 bp, Homo sapien
cattttctcactatattgctcaaac

SEQ ID NO: 46309 - DNA, 25 bp, Homo sapien
cattttctcagatacaggacatata

SEQ ID NO: 46310 - DNA, 25 bp, Homo sapien
cattttctcagatataggacatata

SEQ ID NO: 46311 - DNA, 25 bp, Homo sapien
cattttctcagctcctctttgacag

SEQ ID NO: 46312 - DNA, 25 bp, Homo sapien
cattttctcagctcgtctttgacag

SEQ ID NO: 46313 - DNA, 25 bp, Homo sapien
cattttctccaatgaaaagctaagt

SEQ ID NO: 46314 - DNA, 25 bp, Homo sapien
cattttctctcagtgttcttaagta

SEQ ID NO: 46315 - DNA, 25 bp, Homo sapien
cattttctgggcaacttttgtgtgc

SEQ ID NO: 46316 - DNA, 25 bp, Homo sapien
cattttctgggcaatttttgtgtgc

SEQ ID NO: 46317 - DNA, 25 bp, Homo sapien
cattttctgtcagtgttcttaagta

SEQ ID NO: 46318 - DNA, 25 bp, Homo sapien
cattttcttcaatgaaaagctaagt

SEQ ID NO: 46319 - DNA, 25 bp, Homo sapien
cattttgaaaaacgacacagcacag

SEQ ID NO: 46320 - DNA, 25 bp, Homo sapien
cattttgaaaagcgacacagcacag

SEQ ID NO: 46321 - DNA, 25 bp, Homo sapien
cattttgaaagcagtccttcctttc

SEQ ID NO: 46322 - DNA, 25 bp, Homo sapien
cattttgaaagcagtctttcctttc

SEQ ID NO: 46323 - DNA, 25 bp, Homo sapien
cattttgaactggacaacgctaaag

SEQ ID NO: 46324 - DNA, 25 bp, Homo sapien
cattttgaactggacatcgctaaag

SEQ ID NO: 46325 - DNA, 25 bp, Homo sapien
cattttgacagagctaatcacaggg

SEQ ID NO: 46326 - DNA, 25 bp, Homo sapien
cattttgacagagttaatcacaggg

SEQ ID NO: 46327 - DNA, 25 bp, Homo sapien
cattttgaccatcttttacactact

SEQ ID NO: 46328 - DNA, 25 bp, Homo sapien
cattttgactatcttttacactact

SEQ ID NO: 46329 - DNA, 25 bp, Homo sapien
cattttgagattaccgtgcaatcag

SEQ ID NO: 46330 - DNA, 25 bp, Homo sapien
cattttgagattactgtgcaatcag

SEQ ID NO: 46331 - DNA, 25 bp, Homo sapien
cattttgagccaaataaccctttgc

SEQ ID NO: 46332 - DNA, 25 bp, Homo sapien
cattttgagccagataaccctttgc

SEQ ID NO: 46333 - DNA, 25 bp, Homo sapien
cattttgccactatcttcttaggat

SEQ ID NO: 46334 - DNA, 25 bp, Homo sapien
cattttgccactgtcttcttaggat

SEQ ID NO: 46335 - DNA, 25 bp, Homo sapien
cattttggcacaattttgcagagga

SEQ ID NO: 46336 - DNA, 25 bp, Homo sapien
cattttggcacagttttgcagagga

SEQ ID NO: 46337 - DNA, 25 bp, Homo sapien
cattttgtattcctgctctgtagtc

SEQ ID NO: 46338 - DNA, 25 bp, Homo sapien
cattttgtatttctgctctgtagtc

SEQ ID NO: 46339 - DNA, 25 bp, Homo sapien
cattttgtcaaacattcatgcgtgt

SEQ ID NO: 46340 - DNA, 25 bp, Homo sapien
cattttgtcttctaccacctgtatc

SEQ ID NO: 46341 - DNA, 25 bp, Homo sapien
cattttgtcttctaccgcctgtatc

SEQ ID NO: 46342 - DNA, 25 bp, Homo sapien
cattttgtgaaacattcatgcgtgt

SEQ ID NO: 46343 - DNA, 25 bp, Homo sapien
cattttgtgaaatagtcacctggat

SEQ ID NO: 46344 - DNA, 25 bp, Homo sapien
cattttgtgcaatagtcacctggat

SEQ ID NO: 46345 - DNA, 25 bp, Homo sapien
catttttaaacacggcacttttggc

SEQ ID NO: 46346 - DNA, 25 bp, Homo sapien
catttttaaacacggcgcttttggc

SEQ ID NO: 46347 - DNA, 25 bp, Homo sapien
catttttaattctctgagccacaat

SEQ ID NO: 46348 - DNA, 25 bp, Homo sapien
catttttagcattacccactagacc

SEQ ID NO: 46349 - DNA, 25 bp, Homo sapien
catttttagcattccccactagacc

SEQ ID NO: 46350 - DNA, 25 bp, Homo sapien
catttttagtggtaggtgaagtact

SEQ ID NO: 46351 - DNA, 25 bp, Homo sapien
catttttagtggtatgtgaagtact

SEQ ID NO: 46352 - DNA, 25 bp, Homo sapien
catttttatttctctgagccacaat

SEQ ID NO: 46353 - DNA, 25 bp, Homo sapien
catttttcaagttaggttgtaaaat

SEQ ID NO: 46354 - DNA, 25 bp, Homo sapien
catttttcatgacgaactttgagga

SEQ ID NO: 46355 - DNA, 25 bp, Homo sapien
catttttcatgatgaactttgagga

SEQ ID NO: 46356 - DNA, 25 bp, Homo sapien
catttttccagttaggttgtaaaat

SEQ ID NO: 46357 - DNA, 25 bp, Homo sapien
catttttctttgccaaataaggtaa

SEQ ID NO: 46358 - DNA, 25 bp, Homo sapien
catttttctttgccaagtaaggtaa

SEQ ID NO: 46359 - DNA, 25 bp, Homo sapien
cattttttataaaggccttgagcat

SEQ ID NO: 46360 - DNA, 25 bp, Homo sapien
cattttttataagggccttgagcat

SEQ ID NO: 46361 - DNA, 25 bp, Homo sapien
cattttttccgacctcaaaccttag

SEQ ID NO: 46362 - DNA, 25 bp, Homo sapien
cattttttctgacctcaaaccttag

SEQ ID NO: 46363 - DNA, 25 bp, Homo sapien
cattttttgctctatacccatcaaa

SEQ ID NO: 46364 - DNA, 25 bp, Homo sapien
cattttttgctctctacccatcaaa

SEQ ID NO: 46365 - DNA, 25 bp, Homo sapien
ccaaaaaaaagagcatgaattcaaa

SEQ ID NO: 46366 - DNA, 25 bp, Homo sapien
ccaaaaaaaagatcatgaattcaaa

SEQ ID NO: 46367 - DNA, 25 bp, Homo sapien
ccaaaaaaatatgtgattcctgccc

SEQ ID NO: 46368 - DNA, 25 bp, Homo sapien
ccaaaaaaatatgttattcctgccc

SEQ ID NO: 46369 - DNA, 25 bp, Homo sapien
ccaaaaaagaaagccgaataacaga

SEQ ID NO: 46370 - DNA, 25 bp, Homo sapien
ccaaaaaagaaagctgaataacaga

SEQ ID NO: 46371 - DNA, 25 bp, Homo sapien
ccaaaaaaggcccttagagactcaa

SEQ ID NO: 46372 - DNA, 25 bp, Homo sapien
ccaaaaaaggcctttagagactcaa

SEQ ID NO: 46373 - DNA, 25 bp, Homo sapien
ccaaaaacagactgagcccctagga

SEQ ID NO: 46374 - DNA, 25 bp, Homo sapien
ccaaaaacagattgagcccctagga

SEQ ID NO: 46375 - DNA, 25 bp, Homo sapien
ccaaaaacgaaacaacccagtgtcc

SEQ ID NO: 46376 - DNA, 25 bp, Homo sapien
ccaaaaacgaaacagcccagtgtcc

SEQ ID NO: 46377 - DNA, 25 bp, Homo sapien
ccaaaaactgggcgcagtaatgaga

SEQ ID NO: 46378 - DNA, 25 bp, Homo sapien
ccaaaaactgggtgcagtaatgaga

SEQ ID NO: 46379 - DNA, 25 bp, Homo sapien
ccaaaaagagagccagaaaccagta

SEQ ID NO: 46380 - DNA, 25 bp, Homo sapien
ccaaaaagagagcccgaaaccagta

SEQ ID NO: 46381 - DNA, 25 bp, Homo sapien
ccaaaaagttcaagcctatcatcat

SEQ ID NO: 46382 - DNA, 25 bp, Homo sapien
ccaaaaagttcaagtctatcatcat

SEQ ID NO: 46383 - DNA, 25 bp, Homo sapien
ccaaaaatacacaaaaagggataaa

SEQ ID NO: 46384 - DNA, 25 bp, Homo sapien
ccaaaaatacacaaaatgggataaa

SEQ ID NO: 46385 - DNA, 25 bp, Homo sapien
ccaaaaatcagcttactggtaactt

SEQ ID NO: 46386 - DNA, 25 bp, Homo sapien
ccaaaaatccaacttcctaaacacc

SEQ ID NO: 46387 - DNA, 25 bp, Homo sapien
ccaaaaatccaagttcctaaacacc

SEQ ID NO: 46388 - DNA, 25 bp, Homo sapien
ccaaaaatcgaatgtagctctgatt

SEQ ID NO: 46389 - DNA, 25 bp, Homo sapien
ccaaaaatcgagtgtagctctgatt

SEQ ID NO: 46390 - DNA, 25 bp, Homo sapien
ccaaaaatcggcttactggtaactt

SEQ ID NO: 46391 - DNA, 25 bp, Homo sapien
ccaaaaatttacatgctaaagaact

SEQ ID NO: 46392 - DNA, 25 bp, Homo sapien
ccaaaaatttagatgctaaagaact

SEQ ID NO: 46393 - DNA, 25 bp, Homo sapien
ccaaaacaaacaaatattgcatcct

SEQ ID NO: 46394 - DNA, 25 bp, Homo sapien
ccaaaacaaccaaatattgcatcct

SEQ ID NO: 46395 - DNA, 25 bp, Homo sapien
ccaaaacctcatgatggcctgcaga

SEQ ID NO: 46396 - DNA, 25 bp, Homo sapien
ccaaaacctcatgttggcctgcaga

SEQ ID NO: 46397 - DNA, 25 bp, Homo sapien
ccaaaaccttctgtagaaatatagt

SEQ ID NO: 46398 - DNA, 25 bp, Homo sapien
ccaaaaccttctgtaggaatatagt

SEQ ID NO: 46399 - DNA, 25 bp, Homo sapien
ccaaaacgtgaagctcaagggatag

SEQ ID NO: 46400 - DNA, 25 bp, Homo sapien
ccaaaacgtgaagttcaagggatag

SEQ ID NO: 46401 - DNA, 25 bp, Homo sapien
ccaaaactaggcatttggtttctgt

SEQ ID NO: 46402 - DNA, 25 bp, Homo sapien
ccaaaactatgcatttggtttctgt

SEQ ID NO: 46403 - DNA, 25 bp, Homo sapien
ccaaaactctctgattcagtaggct

SEQ ID NO: 46404 - DNA, 25 bp, Homo sapien
ccaaaactgtctgattcagtaggct

SEQ ID NO: 46405 - DNA, 25 bp, Homo sapien
ccaaaagaaaatgccttcagtacca

SEQ ID NO: 46406 - DNA, 25 bp, Homo sapien
ccaaaagaaaatggcttcagtacca

SEQ ID NO: 46407 - DNA, 25 bp, Homo sapien
ccaaaagagtgatggcgtctccatc

SEQ ID NO: 46408 - DNA, 25 bp, Homo sapien
ccaaaagattgatggcgtctccatc

SEQ ID NO: 46409 - DNA, 25 bp, Homo sapien
ccaaaagcagcagacgtgagcttat

SEQ ID NO: 46410 - DNA, 25 bp, Homo sapien
ccaaaagcagcagatgtgagcttat

SEQ ID NO: 46411 - DNA, 25 bp, Homo sapien
ccaaaagcctacatgtgctgttatg

SEQ ID NO: 46412 - DNA, 25 bp, Homo sapien
ccaaaagcctacgtgtgctgttatg

SEQ ID NO: 46413 - DNA, 25 bp, Homo sapien
ccaaaagcgttgtctgtaaatcact

SEQ ID NO: 46414 - DNA, 25 bp, Homo sapien
ccaaaagctttgtctgtaaatcact

SEQ ID NO: 46415 - DNA, 25 bp, Homo sapien
ccaaaagggtggagaatgtggatat

SEQ ID NO: 46416 - DNA, 25 bp, Homo sapien
ccaaaagggtggataatgtggatat

SEQ ID NO: 46417 - DNA, 25 bp, Homo sapien
ccaaaataaaacctttgtggtctaa

SEQ ID NO: 46418 - DNA, 25 bp, Homo sapien
ccaaaataaaatctttgtggtctaa

SEQ ID NO: 46419 - DNA, 25 bp, Homo sapien
ccaaaataataaaccaacatttgta

SEQ ID NO: 46420 - DNA, 25 bp, Homo sapien
ccaaaataataaaccagcatttgta

SEQ ID NO: 46421 - DNA, 25 bp, Homo sapien
ccaaaataccgagtgaggtctctct

SEQ ID NO: 46422 - DNA, 25 bp, Homo sapien
ccaaaatactgagtgaggtctctct

SEQ ID NO: 46423 - DNA, 25 bp, Homo sapien
ccaaaatagctgcctaaaatgaaga

SEQ ID NO: 46424 - DNA, 25 bp, Homo sapien
ccaaaataggtgcctaaaatgaaga

SEQ ID NO: 46425 - DNA, 25 bp, Homo sapien
ccaaaatatggaccaaaactcaggt

SEQ ID NO: 46426 - DNA, 25 bp, Homo sapien
ccaaaatatgggccaaaactcaggt

SEQ ID NO: 46427 - DNA, 25 bp, Homo sapien
ccaaaatattttacgtcctttgcat

SEQ ID NO: 46428 - DNA, 25 bp, Homo sapien
ccaaaatattttatgtcctttgcat

SEQ ID NO: 46429 - DNA, 25 bp, Homo sapien
ccaaaatcatgtccatttaatagca

SEQ ID NO: 46430 - DNA, 25 bp, Homo sapien
ccaaaatcatgtccgtttaatagca

SEQ ID NO: 46431 - DNA, 25 bp, Homo sapien
ccaaaatcttcacttatttatcata

SEQ ID NO: 46432 - DNA, 25 bp, Homo sapien
ccaaaatcttcagttatttatcata

SEQ ID NO: 46433 - DNA, 25 bp, Homo sapien
ccaaaatgatcagataatatttctg

SEQ ID NO: 46434 - DNA, 25 bp, Homo sapien
ccaaaatgatccgataatatttctg

SEQ ID NO: 46435 - DNA, 25 bp, Homo sapien
ccaaaatggatgctgaacagatttt

SEQ ID NO: 46436 - DNA, 25 bp, Homo sapien
ccaaaatggatgctgagcagatttt

SEQ ID NO: 46437 - DNA, 25 bp, Homo sapien
ccaaaatggctgttcgtaggaatgg

SEQ ID NO: 46438 - DNA, 25 bp, Homo sapien
ccaaaatggctgtttgtaggaatgg

SEQ ID NO: 46439 - DNA, 25 bp, Homo sapien
ccaaaattcatctcaaattaaggtg

SEQ ID NO: 46440 - DNA, 25 bp, Homo sapien
ccaaaattcgtctcaaattaaggtg

SEQ ID NO: 46441 - DNA, 25 bp, Homo sapien
ccaaaattgaaagctattgaacttt

SEQ ID NO: 46442 - DNA, 25 bp, Homo sapien
ccaaaattggaagctattgaacttt

SEQ ID NO: 46443 - DNA, 25 bp, Homo sapien
ccaaacaaaagacgacacaacccaa

SEQ ID NO: 46444 - DNA, 25 bp, Homo sapien
ccaaacaaaagatgacacaacccaa

SEQ ID NO: 46445 - DNA, 25 bp, Homo sapien
ccaaacacactttaaaaacacagaa

SEQ ID NO: 46446 - DNA, 25 bp, Homo sapien
ccaaacacactttagaaacacagaa

SEQ ID NO: 46447 - DNA, 25 bp, Homo sapien
ccaaacacatcatatcaaaatgcat

SEQ ID NO: 46448 - DNA, 25 bp, Homo sapien
ccaaacacatcatgtcaaaatgcat

SEQ ID NO: 46449 - DNA, 25 bp, Homo sapien
ccaaacaccttccactggggtcttc

SEQ ID NO: 46450 - DNA, 25 bp, Homo sapien
ccaaacaccttccgctggggtcttc

SEQ ID NO: 46451 - DNA, 25 bp, Homo sapien
ccaaacagaatttgaagtcttttat

SEQ ID NO: 46452 - DNA, 25 bp, Homo sapien
ccaaacagatgaaagctatccctaa

SEQ ID NO: 46453 - DNA, 25 bp, Homo sapien
ccaaacagatgaaggctatccctaa

SEQ ID NO: 46454 - DNA, 25 bp, Homo sapien
ccaaacagtaaaaatacgacctaaa

SEQ ID NO: 46455 - DNA, 25 bp, Homo sapien
ccaaacagtaaaaatatgacctaaa

SEQ ID NO: 46456 - DNA, 25 bp, Homo sapien
ccaaacagtatttgaagtcttttat

SEQ ID NO: 46457 - DNA, 25 bp, Homo sapien
ccaaacatacttctaggcattttat

SEQ ID NO: 46458 - DNA, 25 bp, Homo sapien
ccaaacatacttgtaggcattttat

SEQ ID NO: 46459 - DNA, 25 bp, Homo sapien
ccaaaccaaagcaaggattaaaacc

SEQ ID NO: 46460 - DNA, 25 bp, Homo sapien
ccaaaccaaatgtgttaaggcacta

SEQ ID NO: 46461 - DNA, 25 bp, Homo sapien
ccaaaccaaatgtgttgaggcacta

SEQ ID NO: 46462 - DNA, 25 bp, Homo sapien
ccaaaccaaggcaaggattaaaacc

SEQ ID NO: 46463 - DNA, 25 bp, Homo sapien
ccaaaccaccagagtgccacagcga

SEQ ID NO: 46464 - DNA, 25 bp, Homo sapien
ccaaaccagcagagtgccacagcga

SEQ ID NO: 46465 - DNA, 25 bp, Homo sapien
ccaaaccatagacttcgtagtatgt

SEQ ID NO: 46466 - DNA, 25 bp, Homo sapien
ccaaaccatagccttcgtagtatgt

SEQ ID NO: 46467 - DNA, 25 bp, Homo sapien
ccaaaccctaccatggtcatctcta

SEQ ID NO: 46468 - DNA, 25 bp, Homo sapien
ccaaaccctaccgtggtcatctcta

SEQ ID NO: 46469 - DNA, 25 bp, Homo sapien
ccaaaccgtcacagttaaccattac

SEQ ID NO: 46470 - DNA, 25 bp, Homo sapien
ccaaaccgtcactgttaaccattac

SEQ ID NO: 46471 - DNA, 25 bp, Homo sapien
ccaaacctgatcgcaggctcgtgtt

SEQ ID NO: 46472 - DNA, 25 bp, Homo sapien
ccaaacctgatctcaggctcgtgtt

SEQ ID NO: 46473 - DNA, 25 bp, Homo sapien
ccaaacttcaccatgatagcacaaa

SEQ ID NO: 46474 - DNA, 25 bp, Homo sapien
ccaaacttcactatgatagcacaaa

SEQ ID NO: 46475 - DNA, 25 bp, Homo sapien
ccaaagaaagaaaaaatcttaaaag

SEQ ID NO: 46476 - DNA, 25 bp, Homo sapien
ccaaagaaagagaaaatcttaaaag

SEQ ID NO: 46477 - DNA, 25 bp, Homo sapien
ccaaagaacatatatataaaggacc

SEQ ID NO: 46478 - DNA, 25 bp, Homo sapien
ccaaagaacatatgtataaaggacc

SEQ ID NO: 46479 - DNA, 25 bp, Homo sapien
ccaaagagaaccagatttctgcttt

SEQ ID NO: 46480 - DNA, 25 bp, Homo sapien
ccaaagagaaccaggtttctgcttt

SEQ ID NO: 46481 - DNA, 25 bp, Homo sapien
ccaaagagcttagtcggatttgagg

SEQ ID NO: 46482 - DNA, 25 bp, Homo sapien
ccaaagagcttagttggatttgagg

SEQ ID NO: 46483 - DNA, 25 bp, Homo sapien
ccaaagcaccctataccaaagctct

SEQ ID NO: 46484 - DNA, 25 bp, Homo sapien
ccaaagcaccctattccaaagctct

SEQ ID NO: 46485 - DNA, 25 bp, Homo sapien
ccaaagcataacaggtcggatgaca

SEQ ID NO: 46486 - DNA, 25 bp, Homo sapien
ccaaagcataacaggttggatgaca

SEQ ID NO: 46487 - DNA, 25 bp, Homo sapien
ccaaagccatcatgcctagcagagg

SEQ ID NO: 46488 - DNA, 25 bp, Homo sapien
ccaaagccatcgtgcctagcagagg

SEQ ID NO: 46489 - DNA, 25 bp, Homo sapien
ccaaagctctatgatgaccctgttg

SEQ ID NO: 46490 - DNA, 25 bp, Homo sapien
ccaaagctgtatgatgaccctgttg

SEQ ID NO: 46491 - DNA, 25 bp, Homo sapien
ccaaaggacgtgttaggctaattgt

SEQ ID NO: 46492 - DNA, 25 bp, Homo sapien
ccaaaggaggtgttaggctaattgt

SEQ ID NO: 46493 - DNA, 25 bp, Homo sapien
ccaaaggatggagaaaacagatctg

SEQ ID NO: 46494 - DNA, 25 bp, Homo sapien
ccaaaggatggataaaacagatctg

SEQ ID NO: 46495 - DNA, 25 bp, Homo sapien
ccaaaggcaaactttagaaattgag

SEQ ID NO: 46496 - DNA, 25 bp, Homo sapien
ccaaaggcaccactaatggctattc

SEQ ID NO: 46497 - DNA, 25 bp, Homo sapien
ccaaaggcactaatagcctcaacag

SEQ ID NO: 46498 - DNA, 25 bp, Homo sapien
ccaaaggcactagtagcctcaacag

SEQ ID NO: 46499 - DNA, 25 bp, Homo sapien
ccaaaggcagactttagaaattgag

SEQ ID NO: 46500 - DNA, 25 bp, Homo sapien
ccaaaggccatagttataaaagatt

SEQ ID NO: 46501 - DNA, 25 bp, Homo sapien
ccaaaggccgtagttataaaagatt

SEQ ID NO: 46502 - DNA, 25 bp, Homo sapien
ccaaaggcgacataaggcactaggc

SEQ ID NO: 46503 - DNA, 25 bp, Homo sapien
ccaaaggcgccactaatggctattc

SEQ ID NO: 46504 - DNA, 25 bp, Homo sapien
ccaaaggcggcataaggcactaggc

SEQ ID NO: 46505 - DNA, 25 bp, Homo sapien
ccaaagggctaacagtcaaaccatg

SEQ ID NO: 46506 - DNA, 25 bp, Homo sapien
ccaaagggctaagagtcaaaccatg

SEQ ID NO: 46507 - DNA, 25 bp, Homo sapien
ccaaagtatgaagatagaaagcagc

SEQ ID NO: 46508 - DNA, 25 bp, Homo sapien
ccaaagtatgaaggtagaaagcagc

SEQ ID NO: 46509 - DNA, 25 bp, Homo sapien
ccaaagtctgtgacctctgtgcttt

SEQ ID NO: 46510 - DNA, 25 bp, Homo sapien
ccaaagtctgtgatctctgtgcttt

SEQ ID NO: 46511 - DNA, 25 bp, Homo sapien
ccaaagtggctaataattgagaatc

SEQ ID NO: 46512 - DNA, 25 bp, Homo sapien
ccaaagtggctagtaattgagaatc

SEQ ID NO: 46513 - DNA, 25 bp, Homo sapien
ccaaagtggtggccattacctacaa

SEQ ID NO: 46514 - DNA, 25 bp, Homo sapien
ccaaagtgtaaggaccaatgacaca

SEQ ID NO: 46515 - DNA, 25 bp, Homo sapien
ccaaagtgtaaggaccgatgacaca

SEQ ID NO: 46516 - DNA, 25 bp, Homo sapien
ccaaagtgtctcacatctaaatctt

SEQ ID NO: 46517 - DNA, 25 bp, Homo sapien
ccaaagtgtcttacatctaaatctt

SEQ ID NO: 46518 - DNA, 25 bp, Homo sapien
ccaaagtgttggccattacctacaa

SEQ ID NO: 46519 - DNA, 25 bp, Homo sapien
ccaaagtgtttcaggaaaaatcaat

SEQ ID NO: 46520 - DNA, 25 bp, Homo sapien
ccaaagtgtttcgggaaaaatcaat

SEQ ID NO: 46521 - DNA, 25 bp, Homo sapien
ccaaataaaatggaaaaacctggac

SEQ ID NO: 46522 - DNA, 25 bp, Homo sapien
ccaaataaaatggagaaacctggac

SEQ ID NO: 46523 - DNA, 25 bp, Homo sapien
ccaaataaattcctgcataacaagt

SEQ ID NO: 46524 - DNA, 25 bp, Homo sapien
ccaaataaattcctgcgtaacaagt

SEQ ID NO: 46525 - DNA, 25 bp, Homo sapien
ccaaataatccctgaataacatatt

SEQ ID NO: 46526 - DNA, 25 bp, Homo sapien
ccaaataatccttgaataacatatt

SEQ ID NO: 46527 - DNA, 25 bp, Homo sapien
ccaaataattaagaacaccagcaac

SEQ ID NO: 46528 - DNA, 25 bp, Homo sapien
ccaaataattaaggacaccagcaac

SEQ ID NO: 46529 - DNA, 25 bp, Homo sapien
ccaaatacatctccagacactgtca

SEQ ID NO: 46530 - DNA, 25 bp, Homo sapien
ccaaatacgtctccagacactgtca

SEQ ID NO: 46531 - DNA, 25 bp, Homo sapien
ccaaatacttccagatccttatgga

SEQ ID NO: 46532 - DNA, 25 bp, Homo sapien
ccaaatacttccaggtccttatgga

SEQ ID NO: 46533 - DNA, 25 bp, Homo sapien
ccaaatagctgaactgtaaaccacc

SEQ ID NO: 46534 - DNA, 25 bp, Homo sapien
ccaaatagttgaactgtaaaccacc

SEQ ID NO: 46535 - DNA, 25 bp, Homo sapien
ccaaatatcagtggcttcatatacc

SEQ ID NO: 46536 - DNA, 25 bp, Homo sapien
ccaaatatcagtgtcttcatatacc

SEQ ID NO: 46537 - DNA, 25 bp, Homo sapien
ccaaatatcgtctagtgtaggtttt

SEQ ID NO: 46538 - DNA, 25 bp, Homo sapien
ccaaatatcttctagtgtaggtttt

SEQ ID NO: 46539 - DNA, 25 bp, Homo sapien
ccaaatcaatttgcttctctgtgta

SEQ ID NO: 46540 - DNA, 25 bp, Homo sapien
ccaaatcaattttcttctctgtgta

SEQ ID NO: 46541 - DNA, 25 bp, Homo sapien
ccaaatcacagtatgcgatagtgca

SEQ ID NO: 46542 - DNA, 25 bp, Homo sapien
ccaaatcaccctttgcaaactaata

SEQ ID NO: 46543 - DNA, 25 bp, Homo sapien
ccaaatcacccttttcaaactaata

SEQ ID NO: 46544 - DNA, 25 bp, Homo sapien
ccaaatcacggtatgcgatagtgca

SEQ ID NO: 46545 - DNA, 25 bp, Homo sapien
ccaaatcatgagttccttgagtgtg

SEQ ID NO: 46546 - DNA, 25 bp, Homo sapien
ccaaatcatgagtttcttgagtgtg

SEQ ID NO: 46547 - DNA, 25 bp, Homo sapien
ccaaatccaggtcctggctcctgga

SEQ ID NO: 46548 - DNA, 25 bp, Homo sapien
ccaaatccaggttctggctcctgga

SEQ ID NO: 46549 - DNA, 25 bp, Homo sapien
ccaaatctaacacgataggcttgta

SEQ ID NO: 46550 - DNA, 25 bp, Homo sapien
ccaaatctaacatgataggcttgta

SEQ ID NO: 46551 - DNA, 25 bp, Homo sapien
ccaaatctaatccaatgcaagacac

SEQ ID NO: 46552 - DNA, 25 bp, Homo sapien
ccaaatctaatccagtgcaagacac

SEQ ID NO: 46553 - DNA, 25 bp, Homo sapien
ccaaatctagtcttcactgtccttc

SEQ ID NO: 46554 - DNA, 25 bp, Homo sapien
ccaaatctagtcttcattgtccttc

SEQ ID NO: 46555 - DNA, 25 bp, Homo sapien
ccaaatctgctataaagcaaagcct

SEQ ID NO: 46556 - DNA, 25 bp, Homo sapien
ccaaatctgctgtaaagcaaagcct

SEQ ID NO: 46557 - DNA, 25 bp, Homo sapien
ccaaatctttctgcctaacctgtat

SEQ ID NO: 46558 - DNA, 25 bp, Homo sapien
ccaaatctttctgtctaacctgtat

SEQ ID NO: 46559 - DNA, 25 bp, Homo sapien
ccaaatgccagatgatgaatccatg

SEQ ID NO: 46560 - DNA, 25 bp, Homo sapien
ccaaatgccaggtgatgaatccatg

SEQ ID NO: 46561 - DNA, 25 bp, Homo sapien
ccaaatggaccaaggaaaacaaacg

SEQ ID NO: 46562 - DNA, 25 bp, Homo sapien
ccaaatggaccagggaaaacaaacg

SEQ ID NO: 46563 - DNA, 25 bp, Homo sapien
ccaaatggctcacggttggagtctg

SEQ ID NO: 46564 - DNA, 25 bp, Homo sapien
ccaaatggctcatggttggagtctg

SEQ ID NO: 46565 - DNA, 25 bp, Homo sapien
ccaaatggttgaacttctttttcct

SEQ ID NO: 46566 - DNA, 25 bp, Homo sapien
ccaaatggttgaatttctttttcct

SEQ ID NO: 46567 - DNA, 25 bp, Homo sapien
ccaaatgtgttaaggcactaggcat

SEQ ID NO: 46568 - DNA, 25 bp, Homo sapien
ccaaatgtgttgaggcactaggcat

SEQ ID NO: 46569 - DNA, 25 bp, Homo sapien
ccaaattcaacacaagttttagaga

SEQ ID NO: 46570 - DNA, 25 bp, Homo sapien
ccaaattcaacagaagttttagaga

SEQ ID NO: 46571 - DNA, 25 bp, Homo sapien
ccaaattgaatgatatattttcaca

SEQ ID NO: 46572 - DNA, 25 bp, Homo sapien
ccaaattgaatgatgtattttcaca

SEQ ID NO: 46573 - DNA, 25 bp, Homo sapien
ccaaattgctgacccataaaatcat

SEQ ID NO: 46574 - DNA, 25 bp, Homo sapien
ccaaattgctttggctctgcccctc

SEQ ID NO: 46575 - DNA, 25 bp, Homo sapien
ccaaattgtacaactatccatgcaa

SEQ ID NO: 46576 - DNA, 25 bp, Homo sapien
ccaaattgtacaagtatccatgcaa

SEQ ID NO: 46577 - DNA, 25 bp, Homo sapien
ccaaattgttaaattgcagctttca

SEQ ID NO: 46578 - DNA, 25 bp, Homo sapien
ccaaattgttaagttgcagctttca

SEQ ID NO: 46579 - DNA, 25 bp, Homo sapien
ccaaattgttgacccataaaatcat

SEQ ID NO: 46580 - DNA, 25 bp, Homo sapien
ccaaattgttttggctctgcccctc

SEQ ID NO: 46581 - DNA, 25 bp, Homo sapien
ccaaatttatgacccaaacttagta

SEQ ID NO: 46582 - DNA, 25 bp, Homo sapien
ccaaatttatgatccaaacttagta

SEQ ID NO: 46583 - DNA, 25 bp, Homo sapien
ccaacaaaacacagtggctcagtag

SEQ ID NO: 46584 - DNA, 25 bp, Homo sapien
ccaacaaaacacggtggctcagtag

SEQ ID NO: 46585 - DNA, 25 bp, Homo sapien
ccaacaaacccattcataggtatac

SEQ ID NO: 46586 - DNA, 25 bp, Homo sapien
ccaacaaacccgttcataggtatac

SEQ ID NO: 46587 - DNA, 25 bp, Homo sapien
ccaacaagataagagagaaaaagtg

SEQ ID NO: 46588 - DNA, 25 bp, Homo sapien
ccaacaagcatactttccagagatc

SEQ ID NO: 46589 - DNA, 25 bp, Homo sapien
ccaacaagcatattttccagagatc

SEQ ID NO: 46590 - DNA, 25 bp, Homo sapien
ccaacaagctttcacattgaatcag

SEQ ID NO: 46591 - DNA, 25 bp, Homo sapien
ccaacaagctttgacattgaatcag

SEQ ID NO: 46592 - DNA, 25 bp, Homo sapien
ccaacaaggtaagagagaaaaagtg

SEQ ID NO: 46593 - DNA, 25 bp, Homo sapien
ccaacaagtctggctacgagtcccc

SEQ ID NO: 46594 - DNA, 25 bp, Homo sapien
ccaacaagtttggctacgagtcccc

SEQ ID NO: 46595 - DNA, 25 bp, Homo sapien
ccaacaatcctgcttctttctgtgt

SEQ ID NO: 46596 - DNA, 25 bp, Homo sapien
ccaacaatcttcatttgggagtatc

SEQ ID NO: 46597 - DNA, 25 bp, Homo sapien
ccaacaatcttcgtttgggagtatc

SEQ ID NO: 46598 - DNA, 25 bp, Homo sapien
ccaacaattctgcttctttctgtgt

SEQ ID NO: 46599 - DNA, 25 bp, Homo sapien
ccaacacaatacaaagagctgtatt

SEQ ID NO: 46600 - DNA, 25 bp, Homo sapien
ccaacacaatacgaagagctgtatt

SEQ ID NO: 46601 - DNA, 25 bp, Homo sapien
ccaacacagataagtgcttcccaac

SEQ ID NO: 46602 - DNA, 25 bp, Homo sapien
ccaacacaggtaagtgcttcccaac

SEQ ID NO: 46603 - DNA, 25 bp, Homo sapien
ccaacacagtaggtttcactatcac

SEQ ID NO: 46604 - DNA, 25 bp, Homo sapien
ccaacacagtagttttcactatcac

SEQ ID NO: 46605 - DNA, 25 bp, Homo sapien
ccaacacgaacacaatgtatttgta

SEQ ID NO: 46606 - DNA, 25 bp, Homo sapien
ccaacacgagcacaatgtatttgta

SEQ ID NO: 46607 - DNA, 25 bp, Homo sapien
ccaacactgctttggttcacataag

SEQ ID NO: 46608 - DNA, 25 bp, Homo sapien
ccaacactgctttgtttcacataag

SEQ ID NO: 46609 - DNA, 25 bp, Homo sapien
ccaacactgtgcccatttcatatta

SEQ ID NO: 46610 - DNA, 25 bp, Homo sapien
ccaacactgtgcctatttcatatta

SEQ ID NO: 46611 - DNA, 25 bp, Homo sapien
ccaacagaacttcgtttacaaaaac

SEQ ID NO: 46612 - DNA, 25 bp, Homo sapien
ccaacagaatttcgtttacaaaaac

SEQ ID NO: 46613 - DNA, 25 bp, Homo sapien
ccaacagacaactgtacgctaacag

SEQ ID NO: 46614 - DNA, 25 bp, Homo sapien
ccaacagacaactgtatgctaacag

SEQ ID NO: 46615 - DNA, 25 bp, Homo sapien
ccaacagatgcgtccatcccagctt

SEQ ID NO: 46616 - DNA, 25 bp, Homo sapien
ccaacagatgcttccatcccagctt

SEQ ID NO: 46617 - DNA, 25 bp, Homo sapien
ccaacaggagcaagaagtttattct

SEQ ID NO: 46618 - DNA, 25 bp, Homo sapien
ccaacaggggcaagaagtttattct

SEQ ID NO: 46619 - DNA, 25 bp, Homo sapien
ccaacagtaagagcagtgttgttca

SEQ ID NO: 46620 - DNA, 25 bp, Homo sapien
ccaacagtgagagcagtgttgttca

SEQ ID NO: 46621 - DNA, 25 bp, Homo sapien
ccaacatgagtgcactgatgcctct

SEQ ID NO: 46622 - DNA, 25 bp, Homo sapien
ccaacatgcgtgcactgatgcctct

SEQ ID NO: 46623 - DNA, 25 bp, Homo sapien
ccaacattaaagggcctagttgaac

SEQ ID NO: 46624 - DNA, 25 bp, Homo sapien
ccaacattctgaacagtaccattta

SEQ ID NO: 46625 - DNA, 25 bp, Homo sapien
ccaacattctgaaccgtaccattta

SEQ ID NO: 46626 - DNA, 25 bp, Homo sapien
ccaacattgaagggcctagttgaac

SEQ ID NO: 46627 - DNA, 25 bp, Homo sapien
ccaacatttaaagtatctgtcagtt

SEQ ID NO: 46628 - DNA, 25 bp, Homo sapien
ccaacatttaaggtatctgtcagtt

SEQ ID NO: 46629 - DNA, 25 bp, Homo sapien
ccaacatttgtactcctctctaatt

SEQ ID NO: 46630 - DNA, 25 bp, Homo sapien
ccaacatttttactcctctctaatt

SEQ ID NO: 46631 - DNA, 25 bp, Homo sapien
ccaaccaaccacaaaattccacaga

SEQ ID NO: 46632 - DNA, 25 bp, Homo sapien
ccaaccaaccataaaattccacaga

SEQ ID NO: 46633 - DNA, 25 bp, Homo sapien
ccaaccacatttaggaagcgtcacc

SEQ ID NO: 46634 - DNA, 25 bp, Homo sapien
ccaaccacatttgggaagcgtcacc

SEQ ID NO: 46635 - DNA, 25 bp, Homo sapien
ccaaccaccaccatctgggtgacac

SEQ ID NO: 46636 - DNA, 25 bp, Homo sapien
ccaaccaccgccatctgggtgacac

SEQ ID NO: 46637 - DNA, 25 bp, Homo sapien
ccaaccaggccaaaataaacagcag

SEQ ID NO: 46638 - DNA, 25 bp, Homo sapien
ccaaccaggtcaaaataaacagcag

SEQ ID NO: 46639 - DNA, 25 bp, Homo sapien
ccaaccatttttccttctttgctct

SEQ ID NO: 46640 - DNA, 25 bp, Homo sapien
ccaaccattttttcttctttgctct

SEQ ID NO: 46641 - DNA, 25 bp, Homo sapien
ccaacccacgttctcctcagttctg

SEQ ID NO: 46642 - DNA, 25 bp, Homo sapien
ccaacccatgttctcctcagttctg

SEQ ID NO: 46643 - DNA, 25 bp, Homo sapien
ccaaccgattgaaattcaactcttt

SEQ ID NO: 46644 - DNA, 25 bp, Homo sapien
ccaaccgattgaagttcaactcttt

SEQ ID NO: 46645 - DNA, 25 bp, Homo sapien
ccaaccgggcataaagacttgacat

SEQ ID NO: 46646 - DNA, 25 bp, Homo sapien
ccaaccgggcataaaggcttgacat

SEQ ID NO: 46647 - DNA, 25 bp, Homo sapien
ccaacctctgcctgttacccatttg

SEQ ID NO: 46648 - DNA, 25 bp, Homo sapien
ccaacctctgcctgtttcccatttg

SEQ ID NO: 46649 - DNA, 25 bp, Homo sapien
ccaaccttcgttctggtcacaccca

SEQ ID NO: 46650 - DNA, 25 bp, Homo sapien
ccaaccttgaggccaaagcccatgg

SEQ ID NO: 46651 - DNA, 25 bp, Homo sapien
ccaaccttgaggccaaggcccatgg

SEQ ID NO: 46652 - DNA, 25 bp, Homo sapien
ccaacctttgttctggtcacaccca

SEQ ID NO: 46653 - DNA, 25 bp, Homo sapien
ccaacctttttcacaccaaggacca

SEQ ID NO: 46654 - DNA, 25 bp, Homo sapien
ccaacctttttcgcaccaaggacca

SEQ ID NO: 46655 - DNA, 25 bp, Homo sapien
ccaacgaacctactattttgacagg

SEQ ID NO: 46656 - DNA, 25 bp, Homo sapien
ccaacgaacctactgttttgacagg

SEQ ID NO: 46657 - DNA, 25 bp, Homo sapien
ccaacgctagacaaacatagctgag

SEQ ID NO: 46658 - DNA, 25 bp, Homo sapien
ccaacgctggacaaacatagctgag

SEQ ID NO: 46659 - DNA, 25 bp, Homo sapien
ccaacggcagacaaaaacaaagttt

SEQ ID NO: 46660 - DNA, 25 bp, Homo sapien
ccaacggcagacaaaagcaaagttt

SEQ ID NO: 46661 - DNA, 25 bp, Homo sapien
ccaactaaaccacttatccacttct

SEQ ID NO: 46662 - DNA, 25 bp, Homo sapien
ccaactaaaccgcttatccacttct

SEQ ID NO: 46663 - DNA, 25 bp, Homo sapien
ccaactaatatcatgaaactgattt

SEQ ID NO: 46664 - DNA, 25 bp, Homo sapien
ccaactaatatcgtgaaactgattt

SEQ ID NO: 46665 - DNA, 25 bp, Homo sapien
ccaactactgatttgcactacaaaa

SEQ ID NO: 46666 - DNA, 25 bp, Homo sapien
ccaactactgatttgcgctacaaaa

SEQ ID NO: 46667 - DNA, 25 bp, Homo sapien
ccaactcaaaacgagaagaagcttc

SEQ ID NO: 46668 - DNA, 25 bp, Homo sapien
ccaactcaaaactagaagaagcttc

SEQ ID NO: 46669 - DNA, 25 bp, Homo sapien
ccaactcaaatttgctaatccaaca

SEQ ID NO: 46670 - DNA, 25 bp, Homo sapien
ccaactcaacgatacaaaaacattc

SEQ ID NO: 46671 - DNA, 25 bp, Homo sapien
ccaactcagatttgctaatccaaca

SEQ ID NO: 46672 - DNA, 25 bp, Homo sapien
ccaactcatcgatacaaaaacattc

SEQ ID NO: 46673 - DNA, 25 bp, Homo sapien
ccaactccatcatatcttcagaaca

SEQ ID NO: 46674 - DNA, 25 bp, Homo sapien
ccaactccgtcatatcttcagaaca

SEQ ID NO: 46675 - DNA, 25 bp, Homo sapien
ccaactctatgatgttaaacgagtt

SEQ ID NO: 46676 - DNA, 25 bp, Homo sapien
ccaactctgaatcccatttcattta

SEQ ID NO: 46677 - DNA, 25 bp, Homo sapien
ccaactctgaatcctatttcattta

SEQ ID NO: 46678 - DNA, 25 bp, Homo sapien
ccaactctgtgatgttaaacgagtt

SEQ ID NO: 46679 - DNA, 25 bp, Homo sapien
ccaactctttgacaccaggttattt

SEQ ID NO: 46680 - DNA, 25 bp, Homo sapien
ccaactctttgacatcaggttattt

SEQ ID NO: 46681 - DNA, 25 bp, Homo sapien
ccaactgacctactgatttccatcc

SEQ ID NO: 46682 - DNA, 25 bp, Homo sapien
ccaactgacctcctgatttccatcc

SEQ ID NO: 46683 - DNA, 25 bp, Homo sapien
ccaactgcccggctacttctctggt

SEQ ID NO: 46684 - DNA, 25 bp, Homo sapien
ccaactgcctggctacttctctggt

SEQ ID NO: 46685 - DNA, 25 bp, Homo sapien
ccaactggcagcactgtaggtttgt

SEQ ID NO: 46686 - DNA, 25 bp, Homo sapien
ccaactgggagcactgtaggtttgt

SEQ ID NO: 46687 - DNA, 25 bp, Homo sapien
ccaactgtaagctattattatatgg

SEQ ID NO: 46688 - DNA, 25 bp, Homo sapien
ccaactgtaagctcttattatatgg

SEQ ID NO: 46689 - DNA, 25 bp, Homo sapien
ccaacttgctcaagaaggtggccac

SEQ ID NO: 46690 - DNA, 25 bp, Homo sapien
ccaacttgctcatgaaggtggccac

SEQ ID NO: 46691 - DNA, 25 bp, Homo sapien
ccaactttttctgataccacaccct

SEQ ID NO: 46692 - DNA, 25 bp, Homo sapien
ccaactttttctgatatcacaccct

SEQ ID NO: 46693 - DNA, 25 bp, Homo sapien
ccaagaaagcacccaaaaactaatg

SEQ ID NO: 46694 - DNA, 25 bp, Homo sapien
ccaagaaagcactcaaaaactaatg

SEQ ID NO: 46695 - DNA, 25 bp, Homo sapien
ccaagaacacgcttccttgtagctc

SEQ ID NO: 46696 - DNA, 25 bp, Homo sapien
ccaagaacatgcttccttgtagctc

SEQ ID NO: 46697 - DNA, 25 bp, Homo sapien
ccaagaacttacacgacaattttca

SEQ ID NO: 46698 - DNA, 25 bp, Homo sapien
ccaagaacttacatgacaattttca

SEQ ID NO: 46699 - DNA, 25 bp, Homo sapien
ccaagaagaaaataaaagttggcat

SEQ ID NO: 46700 - DNA, 25 bp, Homo sapien
ccaagaagaaaatacaagttggcat

SEQ ID NO: 46701 - DNA, 25 bp, Homo sapien
ccaagaagctttatcttctagctgc

SEQ ID NO: 46702 - DNA, 25 bp, Homo sapien
ccaagaaggcaaaacagatgagagc

SEQ ID NO: 46703 - DNA, 25 bp, Homo sapien
ccaagaaggcaaaagagatgagagc

SEQ ID NO: 46704 - DNA, 25 bp, Homo sapien
ccaagaagttttatcttctagctgc

SEQ ID NO: 46705 - DNA, 25 bp, Homo sapien
ccaagaatatcaggttttattgcat

SEQ ID NO: 46706 - DNA, 25 bp, Homo sapien
ccaagaatatcatgttttattgcat

SEQ ID NO: 46707 - DNA, 25 bp, Homo sapien
ccaagaattactggactgtgcattc

SEQ ID NO: 46708 - DNA, 25 bp, Homo sapien
ccaagaattactgggctgtgcattc

SEQ ID NO: 46709 - DNA, 25 bp, Homo sapien
ccaagacagaattggaatttagtct

SEQ ID NO: 46710 - DNA, 25 bp, Homo sapien
ccaagacagaattggagtttagtct

SEQ ID NO: 46711 - DNA, 25 bp, Homo sapien
ccaagacatctcagtatgtatatgc

SEQ ID NO: 46712 - DNA, 25 bp, Homo sapien
ccaagacatctgagtatgtatatgc

SEQ ID NO: 46713 - DNA, 25 bp, Homo sapien
ccaagagaaaactcatttcagtttc

SEQ ID NO: 46714 - DNA, 25 bp, Homo sapien
ccaagagaaataagcagtcacactg

SEQ ID NO: 46715 - DNA, 25 bp, Homo sapien
ccaagagaacttaacggttttccag

SEQ ID NO: 46716 - DNA, 25 bp, Homo sapien
ccaagagaacttaatggttttccag

SEQ ID NO: 46717 - DNA, 25 bp, Homo sapien
ccaagagaattaagcagtcacactg

SEQ ID NO: 46718 - DNA, 25 bp, Homo sapien
ccaagagacaactcatttcagtttc

SEQ ID NO: 46719 - DNA, 25 bp, Homo sapien
ccaagagaggagcagacggcttctt

SEQ ID NO: 46720 - DNA, 25 bp, Homo sapien
ccaagagaggagcagatggcttctt

SEQ ID NO: 46721 - DNA, 25 bp, Homo sapien
ccaagagcgcatagtacgacagaat

SEQ ID NO: 46722 - DNA, 25 bp, Homo sapien
ccaagagcgcatagtatgacagaat

SEQ ID NO: 46723 - DNA, 25 bp, Homo sapien
ccaagagtaggaaggctcatcatct

SEQ ID NO: 46724 - DNA, 25 bp, Homo sapien
ccaagagtaggatggctcatcatct

SEQ ID NO: 46725 - DNA, 25 bp, Homo sapien
ccaagagtcaactatagatctttta

SEQ ID NO: 46726 - DNA, 25 bp, Homo sapien
ccaagagtcgacatgtctattcaac

SEQ ID NO: 46727 - DNA, 25 bp, Homo sapien
ccaagagtcgactatagatctttta

SEQ ID NO: 46728 - DNA, 25 bp, Homo sapien
ccaagagtcgatatgtctattcaac

SEQ ID NO: 46729 - DNA, 25 bp, Homo sapien
ccaagagtgttctcaacatatttaa

SEQ ID NO: 46730 - DNA, 25 bp, Homo sapien
ccaagagtgttctctacatatttaa

SEQ ID NO: 46731 - DNA, 25 bp, Homo sapien
ccaagataaaaaatcccaggccctg

SEQ ID NO: 46732 - DNA, 25 bp, Homo sapien
ccaagataaaagatcccaggccctg

SEQ ID NO: 46733 - DNA, 25 bp, Homo sapien
ccaagataacaactctatcatttga

SEQ ID NO: 46734 - DNA, 25 bp, Homo sapien
ccaagataacacctctatcatttga

SEQ ID NO: 46735 - DNA, 25 bp, Homo sapien
ccaagataagaccagccctacttta

SEQ ID NO: 46736 - DNA, 25 bp, Homo sapien
ccaagataagacgagccctacttta

SEQ ID NO: 46737 - DNA, 25 bp, Homo sapien
ccaagataatttgcaagctagattc

SEQ ID NO: 46738 - DNA, 25 bp, Homo sapien
ccaagatagcctacaggacccaaaa

SEQ ID NO: 46739 - DNA, 25 bp, Homo sapien
ccaagatagcctacgggacccaaaa

SEQ ID NO: 46740 - DNA, 25 bp, Homo sapien
ccaagatagctctacttgaccttca

SEQ ID NO: 46741 - DNA, 25 bp, Homo sapien
ccaagatagctctgcttgaccttca

SEQ ID NO: 46742 - DNA, 25 bp, Homo sapien
ccaagatagtagacataaaacaact

SEQ ID NO: 46743 - DNA, 25 bp, Homo sapien
ccaagatagtagtcataaaacaact

SEQ ID NO: 46744 - DNA, 25 bp, Homo sapien
ccaagatataattgcacaaacatgt

SEQ ID NO: 46745 - DNA, 25 bp, Homo sapien
ccaagatataatttcacaaacatgt

SEQ ID NO: 46746 - DNA, 25 bp, Homo sapien
ccaagatattttgcaagctagattc

SEQ ID NO: 46747 - DNA, 25 bp, Homo sapien
ccaagattaaacctttctacgcatc

SEQ ID NO: 46748 - DNA, 25 bp, Homo sapien
ccaagattcaacctttctacgcatc

SEQ ID NO: 46749 - DNA, 25 bp, Homo sapien
ccaagattgaaatacgaagacatgg

SEQ ID NO: 46750 - DNA, 25 bp, Homo sapien
ccaagattgaaatatgaagacatgg

SEQ ID NO: 46751 - DNA, 25 bp, Homo sapien
ccaagcaaaataacattgagtagac

SEQ ID NO: 46752 - DNA, 25 bp, Homo sapien
ccaagcaaaatagcattgagtagac

SEQ ID NO: 46753 - DNA, 25 bp, Homo sapien
ccaagcaagctctcgtattccaggc

SEQ ID NO: 46754 - DNA, 25 bp, Homo sapien
ccaagcaagctcttgtattccaggc

SEQ ID NO: 46755 - DNA, 25 bp, Homo sapien
ccaagcaagtaaattattctttctg

SEQ ID NO: 46756 - DNA, 25 bp, Homo sapien
ccaagcaagtaacttattctttctg

SEQ ID NO: 46757 - DNA, 25 bp, Homo sapien
ccaagccttatcaaagaagaataaa

SEQ ID NO: 46758 - DNA, 25 bp, Homo sapien
ccaagccttatcaaggaagaataaa

SEQ ID NO: 46759 - DNA, 25 bp, Homo sapien
ccaagcgacatcaggtgttttagta

SEQ ID NO: 46760 - DNA, 25 bp, Homo sapien
ccaagcgacattaggtgttttagta

SEQ ID NO: 46761 - DNA, 25 bp, Homo sapien
ccaagcgcggtcggctgtgtcaggg

SEQ ID NO: 46762 - DNA, 25 bp, Homo sapien
ccaagcgcggttggctgtgtcaggg

SEQ ID NO: 46763 - DNA, 25 bp, Homo sapien
ccaagctcaatgaataaatgatata

SEQ ID NO: 46764 - DNA, 25 bp, Homo sapien
ccaagctccttttactatgtccaaa

SEQ ID NO: 46765 - DNA, 25 bp, Homo sapien
ccaagctccttttactctgtccaaa

SEQ ID NO: 46766 - DNA, 25 bp, Homo sapien
ccaagctcgatgaataaatgatata

SEQ ID NO: 46767 - DNA, 25 bp, Homo sapien
ccaagctgacaatgaaatgaaatct

SEQ ID NO: 46768 - DNA, 25 bp, Homo sapien
ccaagctgacactgaaatgaaatct

SEQ ID NO: 46769 - DNA, 25 bp, Homo sapien
ccaagctgaccatcaaggatctgcc

SEQ ID NO: 46770 - DNA, 25 bp, Homo sapien
ccaagctgaccatgaaggatctgcc

SEQ ID NO: 46771 - DNA, 25 bp, Homo sapien
ccaagctgatgtattggtattgtgc

SEQ ID NO: 46772 - DNA, 25 bp, Homo sapien
ccaagctgatgttttggtattgtgc

SEQ ID NO: 46773 - DNA, 25 bp, Homo sapien
ccaagctgcaagacataatcctctt

SEQ ID NO: 46774 - DNA, 25 bp, Homo sapien
ccaagctgcaagatataatcctctt

SEQ ID NO: 46775 - DNA, 25 bp, Homo sapien
ccaagcttgaaatgatgctgacaag

SEQ ID NO: 46776 - DNA, 25 bp, Homo sapien
ccaagcttgaaatggtgctgacaag

SEQ ID NO: 46777 - DNA, 25 bp, Homo sapien
ccaaggaacctctgcgaatgaagca

SEQ ID NO: 46778 - DNA, 25 bp, Homo sapien
ccaaggaacctctgtgaatgaagca

SEQ ID NO: 46779 - DNA, 25 bp, Homo sapien
ccaaggaagactcagtgttgtctaa

SEQ ID NO: 46780 - DNA, 25 bp, Homo sapien
ccaaggaagtctcagtgttgtctaa

SEQ ID NO: 46781 - DNA, 25 bp, Homo sapien
ccaaggactctggctgcctttgaaa

SEQ ID NO: 46782 - DNA, 25 bp, Homo sapien
ccaaggactctggctgtctttgaaa

SEQ ID NO: 46783 - DNA, 25 bp, Homo sapien
ccaaggactctgggtcagcagctgt

SEQ ID NO: 46784 - DNA, 25 bp, Homo sapien
ccaaggactctgtgtcagcagctgt

SEQ ID NO: 46785 - DNA, 25 bp, Homo sapien
ccaaggagacagtggatggctggga

SEQ ID NO: 46786 - DNA, 25 bp, Homo sapien
ccaaggagagagtggatggctggga

SEQ ID NO: 46787 - DNA, 25 bp, Homo sapien
ccaaggaggtccaacatccaaataa

SEQ ID NO: 46788 - DNA, 25 bp, Homo sapien
ccaaggaggtccgacatccaaataa

SEQ ID NO: 46789 - DNA, 25 bp, Homo sapien
ccaaggataatctgagattcacgca

SEQ ID NO: 46790 - DNA, 25 bp, Homo sapien
ccaaggataatctgaggttcacgca

SEQ ID NO: 46791 - DNA, 25 bp, Homo sapien
ccaaggcaacaacgattactcacca

SEQ ID NO: 46792 - DNA, 25 bp, Homo sapien
ccaaggcaacaatgattactcacca

SEQ ID NO: 46793 - DNA, 25 bp, Homo sapien
ccaaggcaagaactgatatgatttc

SEQ ID NO: 46794 - DNA, 25 bp, Homo sapien
ccaaggcaagatctgatatgatttc

SEQ ID NO: 46795 - DNA, 25 bp, Homo sapien
ccaaggcaatatgacacgaacaaag

SEQ ID NO: 46796 - DNA, 25 bp, Homo sapien
ccaaggcaatatgacatgaacaaag

SEQ ID NO: 46797 - DNA, 25 bp, Homo sapien
ccaaggcataaacttgttaaaatta

SEQ ID NO: 46798 - DNA, 25 bp, Homo sapien
ccaaggcatatcattgacctttgca

SEQ ID NO: 46799 - DNA, 25 bp, Homo sapien
ccaaggcatgaacttgttaaaatta

SEQ ID NO: 46800 - DNA, 25 bp, Homo sapien
ccaaggcatgtcattgacctttgca

SEQ ID NO: 46801 - DNA, 25 bp, Homo sapien
ccaagggaagactgtatgtgtatat

SEQ ID NO: 46802 - DNA, 25 bp, Homo sapien
ccaagggacataaactgaggaccag

SEQ ID NO: 46803 - DNA, 25 bp, Homo sapien
ccaagggacgactgtatgtgtatat

SEQ ID NO: 46804 - DNA, 25 bp, Homo sapien
ccaagggagataaactgaggaccag

SEQ ID NO: 46805 - DNA, 25 bp, Homo sapien
ccaaggtaaggcccaaagtattgat

SEQ ID NO: 46806 - DNA, 25 bp, Homo sapien
ccaaggtaaggcccgaagtattgat

SEQ ID NO: 46807 - DNA, 25 bp, Homo sapien
ccaaggtcaaagtatgtctcctcat

SEQ ID NO: 46808 - DNA, 25 bp, Homo sapien
ccaaggtcaaagtttgtctcctcat

SEQ ID NO: 46809 - DNA, 25 bp, Homo sapien
ccaaggtggagtacagcctgggtat

SEQ ID NO: 46810 - DNA, 25 bp, Homo sapien
ccaaggtggagtacggcctgggtat

SEQ ID NO: 46811 - DNA, 25 bp, Homo sapien
ccaagtaattgcagcaatgccacag

SEQ ID NO: 46812 - DNA, 25 bp, Homo sapien
ccaagtaattgcggcaatgccacag

SEQ ID NO: 46813 - DNA, 25 bp, Homo sapien
ccaagtagatctagctttgtatcta

SEQ ID NO: 46814 - DNA, 25 bp, Homo sapien
ccaagtaggtctagctttgtatcta

SEQ ID NO: 46815 - DNA, 25 bp, Homo sapien
ccaagtatagggccattgaaaaaca

SEQ ID NO: 46816 - DNA, 25 bp, Homo sapien
ccaagtatagggccgttgaaaaaca

SEQ ID NO: 46817 - DNA, 25 bp, Homo sapien
ccaagtatgggaacaatagacactg

SEQ ID NO: 46818 - DNA, 25 bp, Homo sapien
ccaagtatggggacaatagacactg

SEQ ID NO: 46819 - DNA, 25 bp, Homo sapien
ccaagtccaaatcagtttcttaggt

SEQ ID NO: 46820 - DNA, 25 bp, Homo sapien
ccaagtccaaggtccacatcaaagt

SEQ ID NO: 46821 - DNA, 25 bp, Homo sapien
ccaagtccaaggttcacatcaaagt

SEQ ID NO: 46822 - DNA, 25 bp, Homo sapien
ccaagtcccttctgccatacatgtg

SEQ ID NO: 46823 - DNA, 25 bp, Homo sapien
ccaagtcccttctgtcatacatgtg

SEQ ID NO: 46824 - DNA, 25 bp, Homo sapien
ccaagtccgaatcagtttcttaggt

SEQ ID NO: 46825 - DNA, 25 bp, Homo sapien
ccaagtcctatcttcttttcacttc

SEQ ID NO: 46826 - DNA, 25 bp, Homo sapien
ccaagtcctgtcttcttttcacttc

SEQ ID NO: 46827 - DNA, 25 bp, Homo sapien
ccaagtctaacttgtttcatgttca

SEQ ID NO: 46828 - DNA, 25 bp, Homo sapien
ccaagtctaccttgtttcatgttca

SEQ ID NO: 46829 - DNA, 25 bp, Homo sapien
ccaagtgagaatctttaatcacatc

SEQ ID NO: 46830 - DNA, 25 bp, Homo sapien
ccaagtgagaatttttaatcacatc

SEQ ID NO: 46831 - DNA, 25 bp, Homo sapien
ccaagtgattccaattctttcccat

SEQ ID NO: 46832 - DNA, 25 bp, Homo sapien
ccaagtgattctaattctttcccat

SEQ ID NO: 46833 - DNA, 25 bp, Homo sapien
ccaagtggaaccattatatcagttg

SEQ ID NO: 46834 - DNA, 25 bp, Homo sapien
ccaagtggaactattatatcagttg

SEQ ID NO: 46835 - DNA, 25 bp, Homo sapien
ccaagtggagtagacagcaggaacc

SEQ ID NO: 46836 - DNA, 25 bp, Homo sapien
ccaagtggagtagatagcaggaacc

SEQ ID NO: 46837 - DNA, 25 bp, Homo sapien
ccaagtgggtatagcaagctggcaa

SEQ ID NO: 46838 - DNA, 25 bp, Homo sapien
ccaagtggttatagcaagctggcaa

SEQ ID NO: 46839 - DNA, 25 bp, Homo sapien
ccaagttaaattctttctgttcctc

SEQ ID NO: 46840 - DNA, 25 bp, Homo sapien
ccaagttaaattctttttgttcctc

SEQ ID NO: 46841 - DNA, 25 bp, Homo sapien
ccaagttcataggtagtaacaaaga

SEQ ID NO: 46842 - DNA, 25 bp, Homo sapien
ccaagttcatagttagtaacaaaga

SEQ ID NO: 46843 - DNA, 25 bp, Homo sapien
ccaagttcatgttaatctattatag

SEQ ID NO: 46844 - DNA, 25 bp, Homo sapien
ccaagttcgtgttaatctattatag

SEQ ID NO: 46845 - DNA, 25 bp, Homo sapien
ccaagttgaagaagcagacaaaatg

SEQ ID NO: 46846 - DNA, 25 bp, Homo sapien
ccaagttgatataagacggtcaact

SEQ ID NO: 46847 - DNA, 25 bp, Homo sapien
ccaagttgatataagatggtcaact

SEQ ID NO: 46848 - DNA, 25 bp, Homo sapien
ccaagttgcagaagcagacaaaatg

SEQ ID NO: 46849 - DNA, 25 bp, Homo sapien
ccaagttgctgtaggtatccatagt

SEQ ID NO: 46850 - DNA, 25 bp, Homo sapien
ccaagttgttgtaggtatccatagt

SEQ ID NO: 46851 - DNA, 25 bp, Homo sapien
ccaagtttacctgttatataagagc

SEQ ID NO: 46852 - DNA, 25 bp, Homo sapien
ccaagtttatctgttatataagagc

SEQ ID NO: 46853 - DNA, 25 bp, Homo sapien
ccaagtttctcctaaaaacacagaa

SEQ ID NO: 46854 - DNA, 25 bp, Homo sapien
ccaagtttctcttaaaaacacagaa

SEQ ID NO: 46855 - DNA, 25 bp, Homo sapien
ccaagttttatgggttctccctgtg

SEQ ID NO: 46856 - DNA, 25 bp, Homo sapien
ccaagttttgtgggttctccctgtg

SEQ ID NO: 46857 - DNA, 25 bp, Homo sapien
ccaataacaagcatggagctagggc

SEQ ID NO: 46858 - DNA, 25 bp, Homo sapien
ccaataacaggcatggagctagggc

SEQ ID NO: 46859 - DNA, 25 bp, Homo sapien
ccaatacatacagactttttgtgtg

SEQ ID NO: 46860 - DNA, 25 bp, Homo sapien
ccaatacatacagattttttgtgtg

SEQ ID NO: 46861 - DNA, 25 bp, Homo sapien
ccaataccaacaggagcaagaagtt

SEQ ID NO: 46862 - DNA, 25 bp, Homo sapien
ccaataccaacaggggcaagaagtt

SEQ ID NO: 46863 - DNA, 25 bp, Homo sapien
ccaatacctgctatttgctgtttgt

SEQ ID NO: 46864 - DNA, 25 bp, Homo sapien
ccaatacctgctattttctgtttgt

SEQ ID NO: 46865 - DNA, 25 bp, Homo sapien
ccaatacgtgtcaggattcatctgg

SEQ ID NO: 46866 - DNA, 25 bp, Homo sapien
ccaatacgtgtgaggattcatctgg

SEQ ID NO: 46867 - DNA, 25 bp, Homo sapien
ccaatagagacttaaaaagagcaac

SEQ ID NO: 46868 - DNA, 25 bp, Homo sapien
ccaatagagacttaaatagagcaac

SEQ ID NO: 46869 - DNA, 25 bp, Homo sapien
ccaatagagttgacaggataattag

SEQ ID NO: 46870 - DNA, 25 bp, Homo sapien
ccaatagagttgataggataattag

SEQ ID NO: 46871 - DNA, 25 bp, Homo sapien
ccaatagccatgatgactactggag

SEQ ID NO: 46872 - DNA, 25 bp, Homo sapien
ccaatagccgtgatgactactggag

SEQ ID NO: 46873 - DNA, 25 bp, Homo sapien
ccaatagcgtgtgaatggaagtgat

SEQ ID NO: 46874 - DNA, 25 bp, Homo sapien
ccaatagcttgtgaatggaagtgat

SEQ ID NO: 46875 - DNA, 25 bp, Homo sapien
ccaataggaaagtggaattcctgag

SEQ ID NO: 46876 - DNA, 25 bp, Homo sapien
ccaataggagagtggaattcctgag

SEQ ID NO: 46877 - DNA, 25 bp, Homo sapien
ccaataggatttacatctacatatg

SEQ ID NO: 46878 - DNA, 25 bp, Homo sapien
ccaataggatttacgtctacatatg

SEQ ID NO: 46879 - DNA, 25 bp, Homo sapien
ccaatatccttaatttcaacacata

SEQ ID NO: 46880 - DNA, 25 bp, Homo sapien
ccaatatcgttaatttcaacacata

SEQ ID NO: 46881 - DNA, 25 bp, Homo sapien
ccaatatgttttccacaaggcttgc

SEQ ID NO: 46882 - DNA, 25 bp, Homo sapien
ccaatatgttttccacgaggcttgc

SEQ ID NO: 46883 - DNA, 25 bp, Homo sapien
ccaatcaaaaccttggagtaatttg

SEQ ID NO: 46884 - DNA, 25 bp, Homo sapien
ccaatcaacaccttggagtaatttg

SEQ ID NO: 46885 - DNA, 25 bp, Homo sapien
ccaatcaacgtgtacacttaatgca

SEQ ID NO: 46886 - DNA, 25 bp, Homo sapien
ccaatcaagagggacatgagaattt

SEQ ID NO: 46887 - DNA, 25 bp, Homo sapien
ccaatcaagaggtacatgagaattt

SEQ ID NO: 46888 - DNA, 25 bp, Homo sapien
ccaatcaatgtgtacacttaatgca

SEQ ID NO: 46889 - DNA, 25 bp, Homo sapien
ccaatcaattactgacttaacaatc

SEQ ID NO: 46890 - DNA, 25 bp, Homo sapien
ccaatcaattattgacttaacaatc

SEQ ID NO: 46891 - DNA, 25 bp, Homo sapien
ccaatcacaccatattgtttctgat

SEQ ID NO: 46892 - DNA, 25 bp, Homo sapien
ccaatcacaccgtattgtttctgat

SEQ ID NO: 46893 - DNA, 25 bp, Homo sapien
ccaatcacaggagtctatcacagtt

SEQ ID NO: 46894 - DNA, 25 bp, Homo sapien
ccaatcacaggagtttatcacagtt

SEQ ID NO: 46895 - DNA, 25 bp, Homo sapien
ccaatcagcccggaacttctgatga

SEQ ID NO: 46896 - DNA, 25 bp, Homo sapien
ccaatcagcccggagcttctgatga

SEQ ID NO: 46897 - DNA, 25 bp, Homo sapien
ccaatcataaagacggtaaagagtc

SEQ ID NO: 46898 - DNA, 25 bp, Homo sapien
ccaatcataaagatggtaaagagtc

SEQ ID NO: 46899 - DNA, 25 bp, Homo sapien
ccaatcatcagtagcacgcaccccc

SEQ ID NO: 46900 - DNA, 25 bp, Homo sapien
ccaatcatcggtagcacgcaccccc

SEQ ID NO: 46901 - DNA, 25 bp, Homo sapien
ccaatccagaaaacttgctaaaagt

SEQ ID NO: 46902 - DNA, 25 bp, Homo sapien
ccaatccagaaagcttgctaaaagt

SEQ ID NO: 46903 - DNA, 25 bp, Homo sapien
ccaatccatgtgcgcagaactcaga

SEQ ID NO: 46904 - DNA, 25 bp, Homo sapien
ccaatccatgtgtgcagaactcaga

SEQ ID NO: 46905 - DNA, 25 bp, Homo sapien
ccaatccctattttgccaagcttag

SEQ ID NO: 46906 - DNA, 25 bp, Homo sapien
ccaatccctattttgctaagcttag

SEQ ID NO: 46907 - DNA, 25 bp, Homo sapien
ccaatcctcagttaatagacatgaa

SEQ ID NO: 46908 - DNA, 25 bp, Homo sapien
ccaatcctccaggttctcataaccc

SEQ ID NO: 46909 - DNA, 25 bp, Homo sapien
ccaatcctctaggttctcataaccc

SEQ ID NO: 46910 - DNA, 25 bp, Homo sapien
ccaatccttagttaatagacatgaa

SEQ ID NO: 46911 - DNA, 25 bp, Homo sapien
ccaatcgccctaaagaatgattttt

SEQ ID NO: 46912 - DNA, 25 bp, Homo sapien
ccaatcgccttaaagaatgattttt

SEQ ID NO: 46913 - DNA, 25 bp, Homo sapien
ccaatctcaccattggctgactcca

SEQ ID NO: 46914 - DNA, 25 bp, Homo sapien
ccaatctcaccgttggctgactcca

SEQ ID NO: 46915 - DNA, 25 bp, Homo sapien
ccaatctcattatctttccattttg

SEQ ID NO: 46916 - DNA, 25 bp, Homo sapien
ccaatctcgttatctttccattttg

SEQ ID NO: 46917 - DNA, 25 bp, Homo sapien
ccaatctgagagcattgttaggaga

SEQ ID NO: 46918 - DNA, 25 bp, Homo sapien
ccaatctgagagcgttgttaggaga

SEQ ID NO: 46919 - DNA, 25 bp, Homo sapien
ccaatctgtgcaacaggatatgtcc

SEQ ID NO: 46920 - DNA, 25 bp, Homo sapien
ccaatctgtgcaataggatatgtcc

SEQ ID NO: 46921 - DNA, 25 bp, Homo sapien
ccaatcttattgttgtgaaattaac

SEQ ID NO: 46922 - DNA, 25 bp, Homo sapien
ccaatcttgttgttgtgaaattaac

SEQ ID NO: 46923 - DNA, 25 bp, Homo sapien
ccaatgacaaacgtccttataaatg

SEQ ID NO: 46924 - DNA, 25 bp, Homo sapien
ccaatgacaaatgtccttataaatg

SEQ ID NO: 46925 - DNA, 25 bp, Homo sapien
ccaatgacatcaacttttattaatt

SEQ ID NO: 46926 - DNA, 25 bp, Homo sapien
ccaatgacatctacttttattaatt

SEQ ID NO: 46927 - DNA, 25 bp, Homo sapien
ccaatgagaaaacgaaggcataaaa

SEQ ID NO: 46928 - DNA, 25 bp, Homo sapien
ccaatgagaaaatgaaggcataaaa

SEQ ID NO: 46929 - DNA, 25 bp, Homo sapien
ccaatgatcctatatttgtgtgagt

SEQ ID NO: 46930 - DNA, 25 bp, Homo sapien
ccaatgattctatatttgtgtgagt

SEQ ID NO: 46931 - DNA, 25 bp, Homo sapien
ccaatgcattcagatacacatgaag

SEQ ID NO: 46932 - DNA, 25 bp, Homo sapien
ccaatgcattcagatatacatgaag

SEQ ID NO: 46933 - DNA, 25 bp, Homo sapien
ccaatgccaaaaatatgctctcaaa

SEQ ID NO: 46934 - DNA, 25 bp, Homo sapien
ccaatgccaaaacggaaagtcaaga

SEQ ID NO: 46935 - DNA, 25 bp, Homo sapien
ccaatgccaaaatggaaagtcaaga

SEQ ID NO: 46936 - DNA, 25 bp, Homo sapien
ccaatgccaaacatatgctctcaaa

SEQ ID NO: 46937 - DNA, 25 bp, Homo sapien
ccaatgccacaacatgactggaatg

SEQ ID NO: 46938 - DNA, 25 bp, Homo sapien
ccaatgccacaacatggctggaatg

SEQ ID NO: 46939 - DNA, 25 bp, Homo sapien
ccaatgcccagtctctgatgataag

SEQ ID NO: 46940 - DNA, 25 bp, Homo sapien
ccaatgcccagtgtctgatgataag

SEQ ID NO: 46941 - DNA, 25 bp, Homo sapien
ccaatgcttgtcaattctgccttta

SEQ ID NO: 46942 - DNA, 25 bp, Homo sapien
ccaatgcttgtcagttctgccttta

SEQ ID NO: 46943 - DNA, 25 bp, Homo sapien
ccaatggccactaaaatcatcagct

SEQ ID NO: 46944 - DNA, 25 bp, Homo sapien
ccaatggccatacatttactaaata

SEQ ID NO: 46945 - DNA, 25 bp, Homo sapien
ccaatggccttacatttactaaata

SEQ ID NO: 46946 - DNA, 25 bp, Homo sapien
ccaatggctactaaaatcatcagct

SEQ ID NO: 46947 - DNA, 25 bp, Homo sapien
ccaatgtaacagcaagctctgcttt

SEQ ID NO: 46948 - DNA, 25 bp, Homo sapien
ccaatgtaacagcgagctctgcttt

SEQ ID NO: 46949 - DNA, 25 bp, Homo sapien
ccaatgtggagttgaattctgacac

SEQ ID NO: 46950 - DNA, 25 bp, Homo sapien
ccaatgtggggttgaattctgacac

SEQ ID NO: 46951 - DNA, 25 bp, Homo sapien
ccaatgttacaatctctaaagttat

SEQ ID NO: 46952 - DNA, 25 bp, Homo sapien
ccaatgttactttgctaattttctg

SEQ ID NO: 46953 - DNA, 25 bp, Homo sapien
ccaatgttagtttgctaattttctg

SEQ ID NO: 46954 - DNA, 25 bp, Homo sapien
ccaatgttcagcagcttgcatcccc

SEQ ID NO: 46955 - DNA, 25 bp, Homo sapien
ccaatgttgcaatctctaaagttat

SEQ ID NO: 46956 - DNA, 25 bp, Homo sapien
ccaatgtttagcagcttgcatcccc

SEQ ID NO: 46957 - DNA, 25 bp, Homo sapien
ccaattaaaacctcggtggtgaaga

SEQ ID NO: 46958 - DNA, 25 bp, Homo sapien
ccaattaaaaccttggtggtgaaga

SEQ ID NO: 46959 - DNA, 25 bp, Homo sapien
ccaattacgcctaattatttgttat

SEQ ID NO: 46960 - DNA, 25 bp, Homo sapien
ccaattactcctaattatttgttat

SEQ ID NO: 46961 - DNA, 25 bp, Homo sapien
ccaattagaaaaccagtagtaggca

SEQ ID NO: 46962 - DNA, 25 bp, Homo sapien
ccaattagaaaaccggtagtaggca

SEQ ID NO: 46963 - DNA, 25 bp, Homo sapien
ccaattataatccatttctcatacc

SEQ ID NO: 46964 - DNA, 25 bp, Homo sapien
ccaattataatgctgttaaaaagaa

SEQ ID NO: 46965 - DNA, 25 bp, Homo sapien
ccaattatactgctgttaaaaagaa

SEQ ID NO: 46966 - DNA, 25 bp, Homo sapien
ccaattatagtccatttctcatacc

SEQ ID NO: 46967 - DNA, 25 bp, Homo sapien
ccaattatgaaaacctgtgattaca

SEQ ID NO: 46968 - DNA, 25 bp, Homo sapien
ccaattatgaaagcctgtgattaca

SEQ ID NO: 46969 - DNA, 25 bp, Homo sapien
ccaattcctatcttgactttatgtt

SEQ ID NO: 46970 - DNA, 25 bp, Homo sapien
ccaattcctatcttgattttatgtt

SEQ ID NO: 46971 - DNA, 25 bp, Homo sapien
ccaattctaccacgtcaatattatc

SEQ ID NO: 46972 - DNA, 25 bp, Homo sapien
ccaattctaccatgtcaatattatc

SEQ ID NO: 46973 - DNA, 25 bp, Homo sapien
ccaattctctcccctgaaaccctct

SEQ ID NO: 46974 - DNA, 25 bp, Homo sapien
ccaattctgcacaaatatgagataa

SEQ ID NO: 46975 - DNA, 25 bp, Homo sapien
ccaattctgctgaacgggataataa

SEQ ID NO: 46976 - DNA, 25 bp, Homo sapien
ccaattctgttgaacgggataataa

SEQ ID NO: 46977 - DNA, 25 bp, Homo sapien
ccaattcttcacaaatatgagataa

SEQ ID NO: 46978 - DNA, 25 bp, Homo sapien
ccaattctttcccctgaaaccctct

SEQ ID NO: 46979 - DNA, 25 bp, Homo sapien
ccaattgcagcaattcggttcagtg

SEQ ID NO: 46980 - DNA, 25 bp, Homo sapien
ccaattgcatcagcaaataattatt

SEQ ID NO: 46981 - DNA, 25 bp, Homo sapien
ccaattgcatcagtaaataattatt

SEQ ID NO: 46982 - DNA, 25 bp, Homo sapien
ccaattgcattgctccatagctgtt

SEQ ID NO: 46983 - DNA, 25 bp, Homo sapien
ccaattgcattgttccatagctgtt

SEQ ID NO: 46984 - DNA, 25 bp, Homo sapien
ccaattgctgcaattcggttcagtg

SEQ ID NO: 46985 - DNA, 25 bp, Homo sapien
ccaattgtttccctatactctaaga

SEQ ID NO: 46986 - DNA, 25 bp, Homo sapien
ccaattgtttccctgtactctaaga

SEQ ID NO: 46987 - DNA, 25 bp, Homo sapien
ccaatttaaattccaaaaagcagca

SEQ ID NO: 46988 - DNA, 25 bp, Homo sapien
ccaatttaaattcccaaaagcagca

SEQ ID NO: 46989 - DNA, 25 bp, Homo sapien
ccaatttaactatggaagggaccac

SEQ ID NO: 46990 - DNA, 25 bp, Homo sapien
ccaatttaatactcagatttcatat

SEQ ID NO: 46991 - DNA, 25 bp, Homo sapien
ccaatttaatactcggatttcatat

SEQ ID NO: 46992 - DNA, 25 bp, Homo sapien
ccaatttagctatggaagggaccac

SEQ ID NO: 46993 - DNA, 25 bp, Homo sapien
ccaatttccaatgattaaaagatgt

SEQ ID NO: 46994 - DNA, 25 bp, Homo sapien
ccaatttccgatgattaaaagatgt

SEQ ID NO: 46995 - DNA, 25 bp, Homo sapien
ccaatttgattggccacggtaaggt

SEQ ID NO: 46996 - DNA, 25 bp, Homo sapien
ccaatttgattggctacggtaaggt

SEQ ID NO: 46997 - DNA, 25 bp, Homo sapien
ccaatttgcgtttttatttgctttg

SEQ ID NO: 46998 - DNA, 25 bp, Homo sapien
ccaatttgtgtttttatttgctttg

SEQ ID NO: 46999 - DNA, 25 bp, Homo sapien
ccaattttatgtaagagctgaaatt

SEQ ID NO: 47000 - DNA, 25 bp, Homo sapien
ccaattttatgttagagctgaaatt

SEQ ID NO: 47001 - DNA, 25 bp, Homo sapien
ccaatttttttatgtgtcagccagt

SEQ ID NO: 47002 - DNA, 25 bp, Homo sapien
ccaatttttttgtgtgtcagccagt

SEQ ID NO: 47003 - DNA, 25 bp, Homo sapien
ccacaaaacgaggagaaaccagagc

SEQ ID NO: 47004 - DNA, 25 bp, Homo sapien
ccacaaaagctaggagtaataataa

SEQ ID NO: 47005 - DNA, 25 bp, Homo sapien
ccacaaaagctgggagtaataataa

SEQ ID NO: 47006 - DNA, 25 bp, Homo sapien
ccacaaaatatgcagcttgggcatg

SEQ ID NO: 47007 - DNA, 25 bp, Homo sapien
ccacaaaatatgctgcttgggcatg

SEQ ID NO: 47008 - DNA, 25 bp, Homo sapien
ccacaaaatgaggagaaaccagagc

SEQ ID NO: 47009 - DNA, 25 bp, Homo sapien
ccacaaacaagcaaacaacaaatac

SEQ ID NO: 47010 - DNA, 25 bp, Homo sapien
ccacaaacaagcgaacaacaaatac

SEQ ID NO: 47011 - DNA, 25 bp, Homo sapien
ccacaaaccgaaagctatgggacac

SEQ ID NO: 47012 - DNA, 25 bp, Homo sapien
ccacaaactcggtggcataaaacaa

SEQ ID NO: 47013 - DNA, 25 bp, Homo sapien
ccacaaactcggtgtcataaaacaa

SEQ ID NO: 47014 - DNA, 25 bp, Homo sapien
ccacaaactgaaagctatgggacac

SEQ ID NO: 47015 - DNA, 25 bp, Homo sapien
ccacaaagatagaccgaggttctgg

SEQ ID NO: 47016 - DNA, 25 bp, Homo sapien
ccacaaagatagactgaggttctgg

SEQ ID NO: 47017 - DNA, 25 bp, Homo sapien
ccacaaagcacacatgggcatttgc

SEQ ID NO: 47018 - DNA, 25 bp, Homo sapien
ccacaaagcacacgtgggcatttgc

SEQ ID NO: 47019 - DNA, 25 bp, Homo sapien
ccacaaatagaaacacctacatagc

SEQ ID NO: 47020 - DNA, 25 bp, Homo sapien
ccacaaatagaaagacctacatagc

SEQ ID NO: 47021 - DNA, 25 bp, Homo sapien
ccacaaatccacacaaaaggtcaag

SEQ ID NO: 47022 - DNA, 25 bp, Homo sapien
ccacaaatccacataaaaggtcaag

SEQ ID NO: 47023 - DNA, 25 bp, Homo sapien
ccacaaattccacattaattcttag

SEQ ID NO: 47024 - DNA, 25 bp, Homo sapien
ccacaaattccacgttaattcttag

SEQ ID NO: 47025 - DNA, 25 bp, Homo sapien
ccacaacatatccgctcctccagga

SEQ ID NO: 47026 - DNA, 25 bp, Homo sapien
ccacaacatatctgctcctccagga

SEQ ID NO: 47027 - DNA, 25 bp, Homo sapien
ccacaactccccttctaatcaggtt

SEQ ID NO: 47028 - DNA, 25 bp, Homo sapien
ccacaactctgaatttctgaaatcc

SEQ ID NO: 47029 - DNA, 25 bp, Homo sapien
ccacaactctgattttctgaaatcc

SEQ ID NO: 47030 - DNA, 25 bp, Homo sapien
ccacaacttcccttctaatcaggtt

SEQ ID NO: 47031 - DNA, 25 bp, Homo sapien
ccacaagaaattctggccagcatca

SEQ ID NO: 47032 - DNA, 25 bp, Homo sapien
ccacaagaaattctgggcagcatca

SEQ ID NO: 47033 - DNA, 25 bp, Homo sapien
ccacaagaagctagaaaagccaagg

SEQ ID NO: 47034 - DNA, 25 bp, Homo sapien
ccacaagaagctagaagagccaagg

SEQ ID NO: 47035 - DNA, 25 bp, Homo sapien
ccacaagataattctgtgagccgtc

SEQ ID NO: 47036 - DNA, 25 bp, Homo sapien
ccacaagatgattctgtgagccgtc

SEQ ID NO: 47037 - DNA, 25 bp, Homo sapien
ccacaagcagcatgagggcaggttc

SEQ ID NO: 47038 - DNA, 25 bp, Homo sapien
ccacaagcggcatgagggcaggttc

SEQ ID NO: 47039 - DNA, 25 bp, Homo sapien
ccacaaggagacagagatgattgga

SEQ ID NO: 47040 - DNA, 25 bp, Homo sapien
ccacaaggagacggagatgattgga

SEQ ID NO: 47041 - DNA, 25 bp, Homo sapien
ccacaataatattacgcaccatttg

SEQ ID NO: 47042 - DNA, 25 bp, Homo sapien
ccacaataatattatgcaccatttg

SEQ ID NO: 47043 - DNA, 25 bp, Homo sapien
ccacaatctacaaagtgctgaaaca

SEQ ID NO: 47044 - DNA, 25 bp, Homo sapien
ccacaatctacagagtgctgaaaca

SEQ ID NO: 47045 - DNA, 25 bp, Homo sapien
ccacaatgaatgagattgaggttct

SEQ ID NO: 47046 - DNA, 25 bp, Homo sapien
ccacaatgaatgcgattgaggttct

SEQ ID NO: 47047 - DNA, 25 bp, Homo sapien
ccacaatgcaccaagtggtcttcct

SEQ ID NO: 47048 - DNA, 25 bp, Homo sapien
ccacaatgcaccgagtggtcttcct

SEQ ID NO: 47049 - DNA, 25 bp, Homo sapien
ccacaattattaatccattcaactg

SEQ ID NO: 47050 - DNA, 25 bp, Homo sapien
ccacaattattaatccgttcaactg

SEQ ID NO: 47051 - DNA, 25 bp, Homo sapien
ccacaattgttgctttaggaattcc

SEQ ID NO: 47052 - DNA, 25 bp, Homo sapien
ccacaattttcaatatggtaattaa

SEQ ID NO: 47053 - DNA, 25 bp, Homo sapien
ccacaattttcagtatggtaattaa

SEQ ID NO: 47054 - DNA, 25 bp, Homo sapien
ccacaatttttgctttaggaattcc

SEQ ID NO: 47055 - DNA, 25 bp, Homo sapien
ccacacacaaaatgcatttcattta

SEQ ID NO: 47056 - DNA, 25 bp, Homo sapien
ccacacacaaagtgcatttcattta

SEQ ID NO: 47057 - DNA, 25 bp, Homo sapien
ccacacaccacacgggagagagttt

SEQ ID NO: 47058 - DNA, 25 bp, Homo sapien
ccacacaccacatgggagagagttt

SEQ ID NO: 47059 - DNA, 25 bp, Homo sapien
ccacacacctttaaccatatctcat

SEQ ID NO: 47060 - DNA, 25 bp, Homo sapien
ccacacacctttaatcatatctcat

SEQ ID NO: 47061 - DNA, 25 bp, Homo sapien
ccacacagagaactgagacatttca

SEQ ID NO: 47062 - DNA, 25 bp, Homo sapien
ccacacagcgaactgagacatttca

SEQ ID NO: 47063 - DNA, 25 bp, Homo sapien
ccacaccactctcgtaaaagtattc

SEQ ID NO: 47064 - DNA, 25 bp, Homo sapien
ccacaccactcttgtaaaagtattc

SEQ ID NO: 47065 - DNA, 25 bp, Homo sapien
ccacaccccttgctgaatgaggcac

SEQ ID NO: 47066 - DNA, 25 bp, Homo sapien
ccacaccctttgctgaatgaggcac

SEQ ID NO: 47067 - DNA, 25 bp, Homo sapien
ccacactatatttattccccttgca

SEQ ID NO: 47068 - DNA, 25 bp, Homo sapien
ccacactatgtttattccccttgca

SEQ ID NO: 47069 - DNA, 25 bp, Homo sapien
ccacactccagccacttcttttatc

SEQ ID NO: 47070 - DNA, 25 bp, Homo sapien
ccacactccagccgcttcttttatc

SEQ ID NO: 47071 - DNA, 25 bp, Homo sapien
ccacagaaaatggacatttgttagt

SEQ ID NO: 47072 - DNA, 25 bp, Homo sapien
ccacagaaaattgacatttgttagt

SEQ ID NO: 47073 - DNA, 25 bp, Homo sapien
ccacagaagcgggtagatctgctgg

SEQ ID NO: 47074 - DNA, 25 bp, Homo sapien
ccacagaagcgtgtagatctgctgg

SEQ ID NO: 47075 - DNA, 25 bp, Homo sapien
ccacagaagtgaccagacccaggag

SEQ ID NO: 47076 - DNA, 25 bp, Homo sapien
ccacagaagtgaccggacccaggag

SEQ ID NO: 47077 - DNA, 25 bp, Homo sapien
ccacagaataagtccaattgctttt

SEQ ID NO: 47078 - DNA, 25 bp, Homo sapien
ccacagaataagtccagttgctttt

SEQ ID NO: 47079 - DNA, 25 bp, Homo sapien
ccacagagaatatcagttctggaaa

SEQ ID NO: 47080 - DNA, 25 bp, Homo sapien
ccacagagactatcagttctggaaa

SEQ ID NO: 47081 - DNA, 25 bp, Homo sapien
ccacagatctactcaaacaagaaag

SEQ ID NO: 47082 - DNA, 25 bp, Homo sapien
ccacagatctactcgaacaagaaag

SEQ ID NO: 47083 - DNA, 25 bp, Homo sapien
ccacagcacagggtcttgtattcaa

SEQ ID NO: 47084 - DNA, 25 bp, Homo sapien
ccacagcacagtgtcttgtattcaa

SEQ ID NO: 47085 - DNA, 25 bp, Homo sapien
ccacagcagagaatacatgtgtttt

SEQ ID NO: 47086 - DNA, 25 bp, Homo sapien
ccacagcagagaatgcatgtgtttt

SEQ ID NO: 47087 - DNA, 25 bp, Homo sapien
ccacagccatcctcagtagacttta

SEQ ID NO: 47088 - DNA, 25 bp, Homo sapien
ccacagccatcctcggtagacttta

SEQ ID NO: 47089 - DNA, 25 bp, Homo sapien
ccacaggaaggctgaactggatgct

SEQ ID NO: 47090 - DNA, 25 bp, Homo sapien
ccacaggaaggctgaattggatgct

SEQ ID NO: 47091 - DNA, 25 bp, Homo sapien
ccacaggagcagaactgtccaggcc

SEQ ID NO: 47092 - DNA, 25 bp, Homo sapien
ccacaggagcagaactttccaggcc

SEQ ID NO: 47093 - DNA, 25 bp, Homo sapien
ccacaggccaataacaagcatggag

SEQ ID NO: 47094 - DNA, 25 bp, Homo sapien
ccacaggccaataacaggcatggag

SEQ ID NO: 47095 - DNA, 25 bp, Homo sapien
ccacagggctaggatgattaagata

SEQ ID NO: 47096 - DNA, 25 bp, Homo sapien
ccacagggttaggatgattaagata

SEQ ID NO: 47097 - DNA, 25 bp, Homo sapien
ccacaggtaccaaaatgattcacta

SEQ ID NO: 47098 - DNA, 25 bp, Homo sapien
ccacaggtaccagaatgattcacta

SEQ ID NO: 47099 - DNA, 25 bp, Homo sapien
ccacaggtatctcacagcaggcatt

SEQ ID NO: 47100 - DNA, 25 bp, Homo sapien
ccacaggtatctcgcagcaggcatt

SEQ ID NO: 47101 - DNA, 25 bp, Homo sapien
ccacaggtcataagaaaaagttatg

SEQ ID NO: 47102 - DNA, 25 bp, Homo sapien
ccacaggtctcaggataacagatgc

SEQ ID NO: 47103 - DNA, 25 bp, Homo sapien
ccacaggtctcagggtaacagatgc

SEQ ID NO: 47104 - DNA, 25 bp, Homo sapien
ccacaggttataagaaaaagttatg

SEQ ID NO: 47105 - DNA, 25 bp, Homo sapien
ccacagtttacacgagcacagagtt

SEQ ID NO: 47106 - DNA, 25 bp, Homo sapien
ccacagtttacatgagcacagagtt

SEQ ID NO: 47107 - DNA, 25 bp, Homo sapien
ccacataaagtagataaatgttcct

SEQ ID NO: 47108 - DNA, 25 bp, Homo sapien
ccacataaagtaggtaaatgttcct

SEQ ID NO: 47109 - DNA, 25 bp, Homo sapien
ccacataaatacaacgaacaaatcc

SEQ ID NO: 47110 - DNA, 25 bp, Homo sapien
ccacataaatacaatgaacaaatcc

SEQ ID NO: 47111 - DNA, 25 bp, Homo sapien
ccacatactaggagcttgctctatg

SEQ ID NO: 47112 - DNA, 25 bp, Homo sapien
ccacatactgggagcttgctctatg

SEQ ID NO: 47113 - DNA, 25 bp, Homo sapien
ccacatacttttatcttttacttct

SEQ ID NO: 47114 - DNA, 25 bp, Homo sapien
ccacatacttttgtcttttacttct

SEQ ID NO: 47115 - DNA, 25 bp, Homo sapien
ccacatatcgtcatggcagaacata

SEQ ID NO: 47116 - DNA, 25 bp, Homo sapien
ccacatatcgtcgtggcagaacata

SEQ ID NO: 47117 - DNA, 25 bp, Homo sapien
ccacatatgtgagtatctacttcct

SEQ ID NO: 47118 - DNA, 25 bp, Homo sapien
ccacatatgtgagtatttacttcct

SEQ ID NO: 47119 - DNA, 25 bp, Homo sapien
ccacatattatcaaaaacagcttgt

SEQ ID NO: 47120 - DNA, 25 bp, Homo sapien
ccacatattatccaaaacagcttgt

SEQ ID NO: 47121 - DNA, 25 bp, Homo sapien
ccacatattcgatttgctaattctc

SEQ ID NO: 47122 - DNA, 25 bp, Homo sapien
ccacatatttgatttgctaattctc

SEQ ID NO: 47123 - DNA, 25 bp, Homo sapien
ccacatctcctagaattgacacctg

SEQ ID NO: 47124 - DNA, 25 bp, Homo sapien
ccacatctgctagaattgacacctg

SEQ ID NO: 47125 - DNA, 25 bp, Homo sapien
ccacatcttcttgcctgggctcagc

SEQ ID NO: 47126 - DNA, 25 bp, Homo sapien
ccacatcttcttgtctgggctcagc

SEQ ID NO: 47127 - DNA, 25 bp, Homo sapien
ccacatgaagattgagaaaggagat

SEQ ID NO: 47128 - DNA, 25 bp, Homo sapien
ccacatgaagattgaggaaggagat

SEQ ID NO: 47129 - DNA, 25 bp, Homo sapien
ccacatgagcagaagagttaaagct

SEQ ID NO: 47130 - DNA, 25 bp, Homo sapien
ccacatgagcagaggagttaaagct

SEQ ID NO: 47131 - DNA, 25 bp, Homo sapien
ccacatgagctctggcggaatacgt

SEQ ID NO: 47132 - DNA, 25 bp, Homo sapien
ccacatgaggtctggcggaatacgt

SEQ ID NO: 47133 - DNA, 25 bp, Homo sapien
ccacatgcagcagatcattcagctc

SEQ ID NO: 47134 - DNA, 25 bp, Homo sapien
ccacatgcagcagatctttcagctc

SEQ ID NO: 47135 - DNA, 25 bp, Homo sapien
ccacatgtcttcgctgtgcagataa

SEQ ID NO: 47136 - DNA, 25 bp, Homo sapien
ccacatgtcttcgttgtgcagataa

SEQ ID NO: 47137 - DNA, 25 bp, Homo sapien
ccacattacacctttgcattactct

SEQ ID NO: 47138 - DNA, 25 bp, Homo sapien
ccacattacgcctttgcattactct

SEQ ID NO: 47139 - DNA, 25 bp, Homo sapien
ccacattcacatacatgccataagt

SEQ ID NO: 47140 - DNA, 25 bp, Homo sapien
ccacattcacatacgtgccataagt

SEQ ID NO: 47141 - DNA, 25 bp, Homo sapien
ccacattccgttgatggttgaaaca

SEQ ID NO: 47142 - DNA, 25 bp, Homo sapien
ccacattctgcacaccagtccaagt

SEQ ID NO: 47143 - DNA, 25 bp, Homo sapien
ccacattctgttgatggttgaaaca

SEQ ID NO: 47144 - DNA, 25 bp, Homo sapien
ccacattcttcacaccagtccaagt

SEQ ID NO: 47145 - DNA, 25 bp, Homo sapien
ccacattgcagtaacttaacacaac

SEQ ID NO: 47146 - DNA, 25 bp, Homo sapien
ccacattgcagtgacttaacacaac

SEQ ID NO: 47147 - DNA, 25 bp, Homo sapien
ccacattggctccactgttggtcaa

SEQ ID NO: 47148 - DNA, 25 bp, Homo sapien
ccacattggctccgctgttggtcaa

SEQ ID NO: 47149 - DNA, 25 bp, Homo sapien
ccacattgtcttccttgtgctgtga

SEQ ID NO: 47150 - DNA, 25 bp, Homo sapien
ccacattgtcttctttgtgctgtga

SEQ ID NO: 47151 - DNA, 25 bp, Homo sapien
ccacatttacccagggcttagcctg

SEQ ID NO: 47152 - DNA, 25 bp, Homo sapien
ccacatttatgatctcacagttctg

SEQ ID NO: 47153 - DNA, 25 bp, Homo sapien
ccacatttatgatttcacagttctg

SEQ ID NO: 47154 - DNA, 25 bp, Homo sapien
ccacatttgcccagggcttagcctg

SEQ ID NO: 47155 - DNA, 25 bp, Homo sapien
ccacattttaactccgggccagtgg

SEQ ID NO: 47156 - DNA, 25 bp, Homo sapien
ccacattttcactccgggccagtgg

SEQ ID NO: 47157 - DNA, 25 bp, Homo sapien
ccacattttcatactctcagaagag

SEQ ID NO: 47158 - DNA, 25 bp, Homo sapien
ccacattttcatattctcagaagag

SEQ ID NO: 47159 - DNA, 25 bp, Homo sapien
ccacatttttagacgatattgcatt

SEQ ID NO: 47160 - DNA, 25 bp, Homo sapien
ccacatttttagatgatattgcatt

SEQ ID NO: 47161 - DNA, 25 bp, Homo sapien
ccaccaaaggcgacataaggcacta

SEQ ID NO: 47162 - DNA, 25 bp, Homo sapien
ccaccaaaggcggcataaggcacta

SEQ ID NO: 47163 - DNA, 25 bp, Homo sapien
ccaccaaccaggccaaaataaacag

SEQ ID NO: 47164 - DNA, 25 bp, Homo sapien
ccaccaaccaggtcaaaataaacag

SEQ ID NO: 47165 - DNA, 25 bp, Homo sapien
ccaccaactccctagattatgttga

SEQ ID NO: 47166 - DNA, 25 bp, Homo sapien
ccaccaactccctggattatgttga

SEQ ID NO: 47167 - DNA, 25 bp, Homo sapien
ccaccaagtattgcagccaggaaat

SEQ ID NO: 47168 - DNA, 25 bp, Homo sapien
ccaccaagtattgcagtcaggaaat

SEQ ID NO: 47169 - DNA, 25 bp, Homo sapien
ccaccaagttcatgttaatctatta

SEQ ID NO: 47170 - DNA, 25 bp, Homo sapien
ccaccaagttcgtgttaatctatta

SEQ ID NO: 47171 - DNA, 25 bp, Homo sapien
ccaccaagtttacctgttatataag

SEQ ID NO: 47172 - DNA, 25 bp, Homo sapien
ccaccaagtttatctgttatataag

SEQ ID NO: 47173 - DNA, 25 bp, Homo sapien
ccaccaatcatgttatacctgggca

SEQ ID NO: 47174 - DNA, 25 bp, Homo sapien
ccaccaatcgtgttatacctgggca

SEQ ID NO: 47175 - DNA, 25 bp, Homo sapien
ccaccacaaaatatgcagcttgggc

SEQ ID NO: 47176 - DNA, 25 bp, Homo sapien
ccaccacaaaatatgctgcttgggc

SEQ ID NO: 47177 - DNA, 25 bp, Homo sapien
ccaccacaaaccgaaagctatggga

SEQ ID NO: 47178 - DNA, 25 bp, Homo sapien
ccaccacaaactgaaagctatggga

SEQ ID NO: 47179 - DNA, 25 bp, Homo sapien
ccaccacagagaatatcagttctgg

SEQ ID NO: 47180 - DNA, 25 bp, Homo sapien
ccaccacagagactatcagttctgg

SEQ ID NO: 47181 - DNA, 25 bp, Homo sapien
ccaccagacagtatacctgagtcac

SEQ ID NO: 47182 - DNA, 25 bp, Homo sapien
ccaccagacagtgtacctgagtcac

SEQ ID NO: 47183 - DNA, 25 bp, Homo sapien
ccaccagacatgtgaggaaatctaa

SEQ ID NO: 47184 - DNA, 25 bp, Homo sapien
ccaccagacgtgtgaggaaatctaa

SEQ ID NO: 47185 - DNA, 25 bp, Homo sapien
ccaccagctgggaagaagatgaccc

SEQ ID NO: 47186 - DNA, 25 bp, Homo sapien
ccaccagctgggaggaagatgaccc

SEQ ID NO: 47187 - DNA, 25 bp, Homo sapien
ccaccagtagaaattcctccttatc

SEQ ID NO: 47188 - DNA, 25 bp, Homo sapien
ccaccagtagaatttcctccttatc

SEQ ID NO: 47189 - DNA, 25 bp, Homo sapien
ccaccagttttatccacgctttact

SEQ ID NO: 47190 - DNA, 25 bp, Homo sapien
ccaccagttttatccatgctttact

SEQ ID NO: 47191 - DNA, 25 bp, Homo sapien
ccaccatattcagctagtcttgcta

SEQ ID NO: 47192 - DNA, 25 bp, Homo sapien
ccaccatattcagctattcttgcta

SEQ ID NO: 47193 - DNA, 25 bp, Homo sapien
ccaccatcatgcaaacatgcaaaac

SEQ ID NO: 47194 - DNA, 25 bp, Homo sapien
ccaccatcgtgcaaacatgcaaaac

SEQ ID NO: 47195 - DNA, 25 bp, Homo sapien
ccaccatgtgggaatcagcaagaac

SEQ ID NO: 47196 - DNA, 25 bp, Homo sapien
ccaccatgtgggaatcggcaagaac

SEQ ID NO: 47197 - DNA, 25 bp, Homo sapien
ccaccatttaagtgcgataatttgt

SEQ ID NO: 47198 - DNA, 25 bp, Homo sapien
ccaccatttaagtgtgataatttgt

SEQ ID NO: 47199 - DNA, 25 bp, Homo sapien
ccacccaaccttcgttctggtcaca

SEQ ID NO: 47200 - DNA, 25 bp, Homo sapien
ccacccaacctttgttctggtcaca

SEQ ID NO: 47201 - DNA, 25 bp, Homo sapien
ccacccaatccatgtgcgcagaact

SEQ ID NO: 47202 - DNA, 25 bp, Homo sapien
ccacccaatccatgtgtgcagaact

SEQ ID NO: 47203 - DNA, 25 bp, Homo sapien
ccacccagaaaagcatcagatctgg

SEQ ID NO: 47204 - DNA, 25 bp, Homo sapien
ccacccagaaaagcattagatctgg

SEQ ID NO: 47205 - DNA, 25 bp, Homo sapien
ccacccagaatatagcacagagaga

SEQ ID NO: 47206 - DNA, 25 bp, Homo sapien
ccacccagaatgtagcacagagaga

SEQ ID NO: 47207 - DNA, 25 bp, Homo sapien
ccacccagagtgttgcctctcagct

SEQ ID NO: 47208 - DNA, 25 bp, Homo sapien
ccacccagagtgttgcttctcagct

SEQ ID NO: 47209 - DNA, 25 bp, Homo sapien
ccacccaggttctatcacttcctga

SEQ ID NO: 47210 - DNA, 25 bp, Homo sapien
ccacccaggttctatcgcttcctga

SEQ ID NO: 47211 - DNA, 25 bp, Homo sapien
ccacccagtaccgactgatgaagtg

SEQ ID NO: 47212 - DNA, 25 bp, Homo sapien
ccacccagtaccggctgatgaagtg

SEQ ID NO: 47213 - DNA, 25 bp, Homo sapien
ccacccattcacacttgtacttttt

SEQ ID NO: 47214 - DNA, 25 bp, Homo sapien
ccacccattcacgcttgtacttttt

SEQ ID NO: 47215 - DNA, 25 bp, Homo sapien
ccacccctagccagaaaaaaattgt

SEQ ID NO: 47216 - DNA, 25 bp, Homo sapien
ccacccctagctagaaaaaaattgt

SEQ ID NO: 47217 - DNA, 25 bp, Homo sapien
ccaccctcacttctgtggctactgt

SEQ ID NO: 47218 - DNA, 25 bp, Homo sapien
ccaccctcacttgtgtggctactgt

SEQ ID NO: 47219 - DNA, 25 bp, Homo sapien
ccaccgatattcatgagatatgcca

SEQ ID NO: 47220 - DNA, 25 bp, Homo sapien
ccaccgatattcgtgagatatgcca

SEQ ID NO: 47221 - DNA, 25 bp, Homo sapien
ccaccgtcctgatcccagatgtgag

SEQ ID NO: 47222 - DNA, 25 bp, Homo sapien
ccaccgtcttgatcccagatgtgag

SEQ ID NO: 47223 - DNA, 25 bp, Homo sapien
ccacctacttcctagagctgttgta

SEQ ID NO: 47224 - DNA, 25 bp, Homo sapien
ccacctacttcctagatctgttgta

SEQ ID NO: 47225 - DNA, 25 bp, Homo sapien
ccacctagaaaaacgggacactctg

SEQ ID NO: 47226 - DNA, 25 bp, Homo sapien
ccacctagaaaaatgggacactctg

SEQ ID NO: 47227 - DNA, 25 bp, Homo sapien
ccacctagtgtgtccagtagaaaca

SEQ ID NO: 47228 - DNA, 25 bp, Homo sapien
ccacctagtgtgtgcagtagaaaca

SEQ ID NO: 47229 - DNA, 25 bp, Homo sapien
ccacctcacttcctggcatggcagt

SEQ ID NO: 47230 - DNA, 25 bp, Homo sapien
ccacctcaggatccaattactccca

SEQ ID NO: 47231 - DNA, 25 bp, Homo sapien
ccacctcaggatcgaattactccca

SEQ ID NO: 47232 - DNA, 25 bp, Homo sapien
ccacctcatttcctggcatggcagt

SEQ ID NO: 47233 - DNA, 25 bp, Homo sapien
ccacctccaacttatatcaacccca

SEQ ID NO: 47234 - DNA, 25 bp, Homo sapien
ccacctccaacttgtatcaacccca

SEQ ID NO: 47235 - DNA, 25 bp, Homo sapien
ccacctccagccacacacagcaggt

SEQ ID NO: 47236 - DNA, 25 bp, Homo sapien
ccacctccagccacgcacagcaggt

SEQ ID NO: 47237 - DNA, 25 bp, Homo sapien
ccacctcttgatgagagaagctgta

SEQ ID NO: 47238 - DNA, 25 bp, Homo sapien
ccacctcttgatgggagaagctgta

SEQ ID NO: 47239 - DNA, 25 bp, Homo sapien
ccacctctttgatatagacccaggg

SEQ ID NO: 47240 - DNA, 25 bp, Homo sapien
ccacctctttgttatagacccaggg

SEQ ID NO: 47241 - DNA, 25 bp, Homo sapien
ccacctgctgcccagccaggtgtcc

SEQ ID NO: 47242 - DNA, 25 bp, Homo sapien
ccacctgctgcccagcgaggtgtcc

SEQ ID NO: 47243 - DNA, 25 bp, Homo sapien
ccacctgtcttctgtacgtaagcca

SEQ ID NO: 47244 - DNA, 25 bp, Homo sapien
ccacctgtcttctgtatgtaagcca

SEQ ID NO: 47245 - DNA, 25 bp, Homo sapien
ccaccttaaaacggacacatcctaa

SEQ ID NO: 47246 - DNA, 25 bp, Homo sapien
ccaccttaaaatggacacatcctaa

SEQ ID NO: 47247 - DNA, 25 bp, Homo sapien
ccaccttgcccagctgctgtttgag

SEQ ID NO: 47248 - DNA, 25 bp, Homo sapien
ccaccttgcccggctgctgtttgag

SEQ ID NO: 47249 - DNA, 25 bp, Homo sapien
ccacctttgaatagttgccatcttt

SEQ ID NO: 47250 - DNA, 25 bp, Homo sapien
ccacctttgaatatttgccatcttt

SEQ ID NO: 47251 - DNA, 25 bp, Homo sapien
ccaccttttgtggaaggaaggacta

SEQ ID NO: 47252 - DNA, 25 bp, Homo sapien
ccaccttttgtggcaggaaggacta

SEQ ID NO: 47253 - DNA, 25 bp, Homo sapien
ccacgaaacaatgacttctcttctc

SEQ ID NO: 47254 - DNA, 25 bp, Homo sapien
ccacgaaacgatgacttctcttctc

SEQ ID NO: 47255 - DNA, 25 bp, Homo sapien
ccacgaaatctacgcacttgtccaa

SEQ ID NO: 47256 - DNA, 25 bp, Homo sapien
ccacgaaatctatgcacttgtccaa

SEQ ID NO: 47257 - DNA, 25 bp, Homo sapien
ccacgaatagctcatgaatttgttc

SEQ ID NO: 47258 - DNA, 25 bp, Homo sapien
ccacgaatagctcgtgaatttgttc

SEQ ID NO: 47259 - DNA, 25 bp, Homo sapien
ccacgatttctactcagcttcaaac

SEQ ID NO: 47260 - DNA, 25 bp, Homo sapien
ccacgatttctacttagcttcaaac

SEQ ID NO: 47261 - DNA, 25 bp, Homo sapien
ccacgccaatgcatttaccactctg

SEQ ID NO: 47262 - DNA, 25 bp, Homo sapien
ccacgccaatgcgtttaccactctg

SEQ ID NO: 47263 - DNA, 25 bp, Homo sapien
ccacgcctggcaatcatgacctctt

SEQ ID NO: 47264 - DNA, 25 bp, Homo sapien
ccacgcctggcagtcatgacctctt

SEQ ID NO: 47265 - DNA, 25 bp, Homo sapien
ccacggctgctcgcacgctactaca

SEQ ID NO: 47266 - DNA, 25 bp, Homo sapien
ccacggctgctctcacgctactaca

SEQ ID NO: 47267 - DNA, 25 bp, Homo sapien
ccacggtttttcaagagaagatact

SEQ ID NO: 47268 - DNA, 25 bp, Homo sapien
ccacggtttttcaggagaagatact

SEQ ID NO: 47269 - DNA, 25 bp, Homo sapien
ccacgtgttcttcagtcagcttttg

SEQ ID NO: 47270 - DNA, 25 bp, Homo sapien
ccacgtgttctttagtcagcttttg

SEQ ID NO: 47271 - DNA, 25 bp, Homo sapien
ccacgttcagaaacggcagttgtat

SEQ ID NO: 47272 - DNA, 25 bp, Homo sapien
ccacgttcggaaacggcagttgtat

SEQ ID NO: 47273 - DNA, 25 bp, Homo sapien
ccactaaaactggccaattaaaatt

SEQ ID NO: 47274 - DNA, 25 bp, Homo sapien
ccactaaatctggccaattaaaatt

SEQ ID NO: 47275 - DNA, 25 bp, Homo sapien
ccactaacaatcttgctccgacatg

SEQ ID NO: 47276 - DNA, 25 bp, Homo sapien
ccactaacagtcttgctccgacatg

SEQ ID NO: 47277 - DNA, 25 bp, Homo sapien
ccactaaccaaagattatttaactt

SEQ ID NO: 47278 - DNA, 25 bp, Homo sapien
ccactaaccgaagattatttaactt

SEQ ID NO: 47279 - DNA, 25 bp, Homo sapien
ccactaactcctggctactactgtg

SEQ ID NO: 47280 - DNA, 25 bp, Homo sapien
ccactaactcctggctgctactgtg

SEQ ID NO: 47281 - DNA, 25 bp, Homo sapien
ccactaatcattagggaaatgcaag

SEQ ID NO: 47282 - DNA, 25 bp, Homo sapien
ccactaatcgttagggaaatgcaag

SEQ ID NO: 47283 - DNA, 25 bp, Homo sapien
ccactaattcgagttttcatttaaa

SEQ ID NO: 47284 - DNA, 25 bp, Homo sapien
ccactaatttgagttttcatttaaa

SEQ ID NO: 47285 - DNA, 25 bp, Homo sapien
ccactacaaggataagaaaacaaaa

SEQ ID NO: 47286 - DNA, 25 bp, Homo sapien
ccactacaaggataaggaaacaaaa

SEQ ID NO: 47287 - DNA, 25 bp, Homo sapien
ccactacataaaaggattcagaaag

SEQ ID NO: 47288 - DNA, 25 bp, Homo sapien
ccactacataaaatgattcagaaag

SEQ ID NO: 47289 - DNA, 25 bp, Homo sapien
ccactagcttcatgatcatttgtta

SEQ ID NO: 47290 - DNA, 25 bp, Homo sapien
ccactagcttcgtgatcatttgtta

SEQ ID NO: 47291 - DNA, 25 bp, Homo sapien
ccactaggggtcttaaacttgctag

SEQ ID NO: 47292 - DNA, 25 bp, Homo sapien
ccactaggggtcttaagcttgctag

SEQ ID NO: 47293 - DNA, 25 bp, Homo sapien
ccactatgaggccacggaaagggtg

SEQ ID NO: 47294 - DNA, 25 bp, Homo sapien
ccactatgaggccatggaaagggtg

SEQ ID NO: 47295 - DNA, 25 bp, Homo sapien
ccactatttatttttctgatagcac

SEQ ID NO: 47296 - DNA, 25 bp, Homo sapien
ccactatttctttttctgatagcac

SEQ ID NO: 47297 - DNA, 25 bp, Homo sapien
ccactcaggatgccggatgacgggc

SEQ ID NO: 47298 - DNA, 25 bp, Homo sapien
ccactcaggatgctggatgacgggc

SEQ ID NO: 47299 - DNA, 25 bp, Homo sapien
ccactcagtctgctgtcttgttata

SEQ ID NO: 47300 - DNA, 25 bp, Homo sapien
ccactcagtcttctgtcttgttata

SEQ ID NO: 47301 - DNA, 25 bp, Homo sapien
ccactcattatgtccacgttgagta

SEQ ID NO: 47302 - DNA, 25 bp, Homo sapien
ccactcattatgtccatgttgagta

SEQ ID NO: 47303 - DNA, 25 bp, Homo sapien
ccactccaaaacataacggctaaag

SEQ ID NO: 47304 - DNA, 25 bp, Homo sapien
ccactccaaaacataatggctaaag

SEQ ID NO: 47305 - DNA, 25 bp, Homo sapien
ccactccaaagcgtgtgggttgcta

SEQ ID NO: 47306 - DNA, 25 bp, Homo sapien
ccactccaaagtgtgtgggttgcta

SEQ ID NO: 47307 - DNA, 25 bp, Homo sapien
ccactcctatgtctatatctaagag

SEQ ID NO: 47308 - DNA, 25 bp, Homo sapien
ccactcctatgtctgtatctaagag

SEQ ID NO: 47309 - DNA, 25 bp, Homo sapien
ccactccttactagctgtgtgatct

SEQ ID NO: 47310 - DNA, 25 bp, Homo sapien
ccactccttactatctgtgtgatct

SEQ ID NO: 47311 - DNA, 25 bp, Homo sapien
ccactctaggactgcaaggtacccc

SEQ ID NO: 47312 - DNA, 25 bp, Homo sapien
ccactctatgactgcaaggtacccc

SEQ ID NO: 47313 - DNA, 25 bp, Homo sapien
ccactctccccaatacgcacagtaa

SEQ ID NO: 47314 - DNA, 25 bp, Homo sapien
ccactctccccagtacgcacagtaa

SEQ ID NO: 47315 - DNA, 25 bp, Homo sapien
ccactctcctgatctttcagtggtt

SEQ ID NO: 47316 - DNA, 25 bp, Homo sapien
ccactctcttgatctttcagtggtt

SEQ ID NO: 47317 - DNA, 25 bp, Homo sapien
ccactctgaatacccagtgagtttc

SEQ ID NO: 47318 - DNA, 25 bp, Homo sapien
ccactctgagtacccagtgagtttc

SEQ ID NO: 47319 - DNA, 25 bp, Homo sapien
ccactctgtcatgcttgaaaagttt

SEQ ID NO: 47320 - DNA, 25 bp, Homo sapien
ccactctgtcattcttgaaaagttt

SEQ ID NO: 47321 - DNA, 25 bp, Homo sapien
ccactctgttgctagatcacagaag

SEQ ID NO: 47322 - DNA, 25 bp, Homo sapien
ccactctgttgttagatcacagaag

SEQ ID NO: 47323 - DNA, 25 bp, Homo sapien
ccactgaatccgaataaagctgaat

SEQ ID NO: 47324 - DNA, 25 bp, Homo sapien
ccactgaatccgaatagagctgaat

SEQ ID NO: 47325 - DNA, 25 bp, Homo sapien
ccactgaatcttgtgtacctgtgac

SEQ ID NO: 47326 - DNA, 25 bp, Homo sapien
ccactgaattttgtgtacctgtgac

SEQ ID NO: 47327 - DNA, 25 bp, Homo sapien
ccactgataaaccctatggtctttg

SEQ ID NO: 47328 - DNA, 25 bp, Homo sapien
ccactgataaatcctatggtctttg

SEQ ID NO: 47329 - DNA, 25 bp, Homo sapien
ccactgatgtcaagattaaaaaatt

SEQ ID NO: 47330 - DNA, 25 bp, Homo sapien
ccactgatgtcatgattaaaaaatt

SEQ ID NO: 47331 - DNA, 25 bp, Homo sapien
ccactgcactccaacaaacagagcc

SEQ ID NO: 47332 - DNA, 25 bp, Homo sapien
ccactgcactccatcaaacagagcc

SEQ ID NO: 47333 - DNA, 25 bp, Homo sapien
ccactgcagtccatttatgcaaaat

SEQ ID NO: 47334 - DNA, 25 bp, Homo sapien
ccactgcagtccatttgtgcaaaat

SEQ ID NO: 47335 - DNA, 25 bp, Homo sapien
ccactgcattgtcaaacctgaattc

SEQ ID NO: 47336 - DNA, 25 bp, Homo sapien
ccactgcattgtcgaacctgaattc

SEQ ID NO: 47337 - DNA, 25 bp, Homo sapien
ccactgccgatctaaactatttctt

SEQ ID NO: 47338 - DNA, 25 bp, Homo sapien
ccactgccgatttaaactatttctt

SEQ ID NO: 47339 - DNA, 25 bp, Homo sapien
ccactgctcttaaagcccttatttc

SEQ ID NO: 47340 - DNA, 25 bp, Homo sapien
ccactgctcttaaagctcttatttc

SEQ ID NO: 47341 - DNA, 25 bp, Homo sapien
ccactgctttttatgccttgacctt

SEQ ID NO: 47342 - DNA, 25 bp, Homo sapien
ccactgctttttatgcgttgacctt

SEQ ID NO: 47343 - DNA, 25 bp, Homo sapien
ccactggacaatcgaacaatgtgat

SEQ ID NO: 47344 - DNA, 25 bp, Homo sapien
ccactggacaatctaacaatgtgat

SEQ ID NO: 47345 - DNA, 25 bp, Homo sapien
ccactggcttaagaaactcccggga

SEQ ID NO: 47346 - DNA, 25 bp, Homo sapien
ccactggcttaggaaactcccggga

SEQ ID NO: 47347 - DNA, 25 bp, Homo sapien
ccactgggaactaaatggtaaaata

SEQ ID NO: 47348 - DNA, 25 bp, Homo sapien
ccactgggaactaaattgtaaaata

SEQ ID NO: 47349 - DNA, 25 bp, Homo sapien
ccactgggccactcggccttccatg

SEQ ID NO: 47350 - DNA, 25 bp, Homo sapien
ccactgggccactcgggcttccatg

SEQ ID NO: 47351 - DNA, 25 bp, Homo sapien
ccactggggtttcaatcagttcctc

SEQ ID NO: 47352 - DNA, 25 bp, Homo sapien
ccactggggtttgaatcagttcctc

SEQ ID NO: 47353 - DNA, 25 bp, Homo sapien
ccactgtcacttgtactcacacctg

SEQ ID NO: 47354 - DNA, 25 bp, Homo sapien
ccactgtcatttgtactcacacctg

SEQ ID NO: 47355 - DNA, 25 bp, Homo sapien
ccactgtcgatggccaaaggcatgg

SEQ ID NO: 47356 - DNA, 25 bp, Homo sapien
ccactgtctatggccaaaggcatgg

SEQ ID NO: 47357 - DNA, 25 bp, Homo sapien
ccactgtgcatttcacaaattgggc

SEQ ID NO: 47358 - DNA, 25 bp, Homo sapien
ccactgtgcttttcacaaattgggc

SEQ ID NO: 47359 - DNA, 25 bp, Homo sapien
ccactgtttctgctctgctccagag

SEQ ID NO: 47360 - DNA, 25 bp, Homo sapien
ccactgtttctgttctgctccagag

SEQ ID NO: 47361 - DNA, 25 bp, Homo sapien
ccactgtttttatactggagttctg

SEQ ID NO: 47362 - DNA, 25 bp, Homo sapien
ccactgtttttgtactggagttctg

SEQ ID NO: 47363 - DNA, 25 bp, Homo sapien
ccacttaattttctgcgcttagaat

SEQ ID NO: 47364 - DNA, 25 bp, Homo sapien
ccacttaattttctgctcttagaat

SEQ ID NO: 47365 - DNA, 25 bp, Homo sapien
ccacttagctgaaaccaccatatag

SEQ ID NO: 47366 - DNA, 25 bp, Homo sapien
ccacttagctgaatccaccatatag

SEQ ID NO: 47367 - DNA, 25 bp, Homo sapien
ccacttcacaactacagagtaacct

SEQ ID NO: 47368 - DNA, 25 bp, Homo sapien
ccacttcacaactgcagagtaacct

SEQ ID NO: 47369 - DNA, 25 bp, Homo sapien
ccacttcacaccataaaatgataca

SEQ ID NO: 47370 - DNA, 25 bp, Homo sapien
ccacttcacaccataagatgataca

SEQ ID NO: 47371 - DNA, 25 bp, Homo sapien
ccacttcatgtctatctctattata

SEQ ID NO: 47372 - DNA, 25 bp, Homo sapien
ccacttcattccagcttgagtgaca

SEQ ID NO: 47373 - DNA, 25 bp, Homo sapien
ccacttcattccggcttgagtgaca

SEQ ID NO: 47374 - DNA, 25 bp, Homo sapien
ccacttcatttctatctctattata

SEQ ID NO: 47375 - DNA, 25 bp, Homo sapien
ccacttctcacttctgcctctgctt

SEQ ID NO: 47376 - DNA, 25 bp, Homo sapien
ccacttctcgcttctgcctctgctt

SEQ ID NO: 47377 - DNA, 25 bp, Homo sapien
ccacttgatctaccaacagggtgag

SEQ ID NO: 47378 - DNA, 25 bp, Homo sapien
ccacttgatctaccaatagggtgag

SEQ ID NO: 47379 - DNA, 25 bp, Homo sapien
ccacttgcaacaaaaactgtatttt

SEQ ID NO: 47380 - DNA, 25 bp, Homo sapien
ccacttgcgacaaaaactgtatttt

SEQ ID NO: 47381 - DNA, 25 bp, Homo sapien
ccacttgctcagaccagaaactctg

SEQ ID NO: 47382 - DNA, 25 bp, Homo sapien
ccacttgctcagatcagaaactctg

SEQ ID NO: 47383 - DNA, 25 bp, Homo sapien
ccacttggaaaacggtaaatgtaat

SEQ ID NO: 47384 - DNA, 25 bp, Homo sapien
ccacttggaaaatggtaaatgtaat

SEQ ID NO: 47385 - DNA, 25 bp, Homo sapien
ccacttggagaacgtttttttgtgt

SEQ ID NO: 47386 - DNA, 25 bp, Homo sapien
ccacttggagaatgtttttttgtgt

SEQ ID NO: 47387 - DNA, 25 bp, Homo sapien
ccacttggctccgctgtatttcctc

SEQ ID NO: 47388 - DNA, 25 bp, Homo sapien
ccacttggctctgctgtatttcctc

SEQ ID NO: 47389 - DNA, 25 bp, Homo sapien
ccacttggtacctgccacctcggca

SEQ ID NO: 47390 - DNA, 25 bp, Homo sapien
ccacttggtacctgcctcctcggca

SEQ ID NO: 47391 - DNA, 25 bp, Homo sapien
ccactttaatctacataacactgga

SEQ ID NO: 47392 - DNA, 25 bp, Homo sapien
ccactttaatctacgtaacactgga

SEQ ID NO: 47393 - DNA, 25 bp, Homo sapien
ccactttatcaccgctcctccttgt

SEQ ID NO: 47394 - DNA, 25 bp, Homo sapien
ccactttatcactgctcctccttgt

SEQ ID NO: 47395 - DNA, 25 bp, Homo sapien
ccactttcaaatacagagaggccct

SEQ ID NO: 47396 - DNA, 25 bp, Homo sapien
ccactttcaaatagagagaggccct

SEQ ID NO: 47397 - DNA, 25 bp, Homo sapien
ccactttcaagtattaacaatcgag

SEQ ID NO: 47398 - DNA, 25 bp, Homo sapien
ccactttcaagtattagcaatcgag

SEQ ID NO: 47399 - DNA, 25 bp, Homo sapien
ccactttctatgcgtatatggtcaa

SEQ ID NO: 47400 - DNA, 25 bp, Homo sapien
ccactttctatgtgtatatggtcaa

SEQ ID NO: 47401 - DNA, 25 bp, Homo sapien
ccactttctctcggtgctaatggat

SEQ ID NO: 47402 - DNA, 25 bp, Homo sapien
ccactttctctcttacctcttgttc

SEQ ID NO: 47403 - DNA, 25 bp, Homo sapien
ccactttctgtcggtgctaatggat

SEQ ID NO: 47404 - DNA, 25 bp, Homo sapien
ccactttctttcttacctcttgttc

SEQ ID NO: 47405 - DNA, 25 bp, Homo sapien
ccactttgattgatggctataatgg

SEQ ID NO: 47406 - DNA, 25 bp, Homo sapien
ccactttgattgatgggtataatgg

SEQ ID NO: 47407 - DNA, 25 bp, Homo sapien
ccactttgggctccttctggctcca

SEQ ID NO: 47408 - DNA, 25 bp, Homo sapien
ccactttgggcttcttctggctcca

SEQ ID NO: 47409 - DNA, 25 bp, Homo sapien
ccactttgtcacatgccagatacta

SEQ ID NO: 47410 - DNA, 25 bp, Homo sapien
ccactttgtcacttgccagatacta

SEQ ID NO: 47411 - DNA, 25 bp, Homo sapien
ccacttttactctgagcatgaagag

SEQ ID NO: 47412 - DNA, 25 bp, Homo sapien
ccacttttactttgagcatgaagag

SEQ ID NO: 47413 - DNA, 25 bp, Homo sapien
ccacttttgctgaaaacgtgaactt

SEQ ID NO: 47414 - DNA, 25 bp, Homo sapien
ccacttttgctgaaaatgtgaactt

SEQ ID NO: 47415 - DNA, 25 bp, Homo sapien
ccactttttgcccaccttaatgata

SEQ ID NO: 47416 - DNA, 25 bp, Homo sapien
ccactttttgccccccttaatgata

SEQ ID NO: 47417 - DNA, 25 bp, Homo sapien
ccagaaaaactgttgctattaataa

SEQ ID NO: 47418 - DNA, 25 bp, Homo sapien
ccagaaaacctgttgctattaataa

SEQ ID NO: 47419 - DNA, 25 bp, Homo sapien
ccagaaaagactgatgagtactgtg

SEQ ID NO: 47420 - DNA, 25 bp, Homo sapien
ccagaaaagactggtgagtactgtg

SEQ ID NO: 47421 - DNA, 25 bp, Homo sapien
ccagaaaagcatcagatctgggaaa

SEQ ID NO: 47422 - DNA, 25 bp, Homo sapien
ccagaaaagcattagatctgggaaa

SEQ ID NO: 47423 - DNA, 25 bp, Homo sapien
ccagaaaatagtgaaaaatgaaaat

SEQ ID NO: 47424 - DNA, 25 bp, Homo sapien
ccagaaaatagtgagaaatgaaaat

SEQ ID NO: 47425 - DNA, 25 bp, Homo sapien
ccagaaaatgaacgaatgtgccttg

SEQ ID NO: 47426 - DNA, 25 bp, Homo sapien
ccagaaaatgaatgaatgtgccttg

SEQ ID NO: 47427 - DNA, 25 bp, Homo sapien
ccagaaacacatggaaagctctaga

SEQ ID NO: 47428 - DNA, 25 bp, Homo sapien
ccagaaactcatggaaagctctaga

SEQ ID NO: 47429 - DNA, 25 bp, Homo sapien
ccagaaagacgcatggagagttgtt

SEQ ID NO: 47430 - DNA, 25 bp, Homo sapien
ccagaaagagacctgaaggtgggag

SEQ ID NO: 47431 - DNA, 25 bp, Homo sapien
ccagaaagagagctgaaggtgggag

SEQ ID NO: 47432 - DNA, 25 bp, Homo sapien
ccagaaagatgcatggagagttgtt

SEQ ID NO: 47433 - DNA, 25 bp, Homo sapien
ccagaaagtaacccgaggacttgaa

SEQ ID NO: 47434 - DNA, 25 bp, Homo sapien
ccagaaagtaacctgaggacttgaa

SEQ ID NO: 47435 - DNA, 25 bp, Homo sapien
ccagaaataaactcacatatacgga

SEQ ID NO: 47436 - DNA, 25 bp, Homo sapien
ccagaaataaactcacgtatacgga

SEQ ID NO: 47437 - DNA, 25 bp, Homo sapien
ccagaaatccaacaaagaatggaaa

SEQ ID NO: 47438 - DNA, 25 bp, Homo sapien
ccagaaatccaagaaagaatggaaa

SEQ ID NO: 47439 - DNA, 25 bp, Homo sapien
ccagaaatgatgttggtatcactac

SEQ ID NO: 47440 - DNA, 25 bp, Homo sapien
ccagaaatgatgtttgtatcactac

SEQ ID NO: 47441 - DNA, 25 bp, Homo sapien
ccagaaatgccaacggctacagaca

SEQ ID NO: 47442 - DNA, 25 bp, Homo sapien
ccagaaatgccaatggctacagaca

SEQ ID NO: 47443 - DNA, 25 bp, Homo sapien
ccagaacagtaagaaacaacataat

SEQ ID NO: 47444 - DNA, 25 bp, Homo sapien
ccagaacagtaagaaataacataat

SEQ ID NO: 47445 - DNA, 25 bp, Homo sapien
ccagaacctctgccctcttgcccag

SEQ ID NO: 47446 - DNA, 25 bp, Homo sapien
ccagaacctttgccctcttgcccag

SEQ ID NO: 47447 - DNA, 25 bp, Homo sapien
ccagaactatagatacaaattcagg

SEQ ID NO: 47448 - DNA, 25 bp, Homo sapien
ccagaactatagatacgaattcagg

SEQ ID NO: 47449 - DNA, 25 bp, Homo sapien
ccagaagaaattacttgaaagttag

SEQ ID NO: 47450 - DNA, 25 bp, Homo sapien
ccagaagaagttacttgaaagttag

SEQ ID NO: 47451 - DNA, 25 bp, Homo sapien
ccagaagaataaaatcagaggactg

SEQ ID NO: 47452 - DNA, 25 bp, Homo sapien
ccagaagaataagatcagaggactg

SEQ ID NO: 47453 - DNA, 25 bp, Homo sapien
ccagaagaattcggctttataggca

SEQ ID NO: 47454 - DNA, 25 bp, Homo sapien
ccagaagaatttggctttataggca

SEQ ID NO: 47455 - DNA, 25 bp, Homo sapien
ccagaagagcaaaccagcctaatct

SEQ ID NO: 47456 - DNA, 25 bp, Homo sapien
ccagaagagtaaaccagcctaatct

SEQ ID NO: 47457 - DNA, 25 bp, Homo sapien
ccagaagcattgccagtgctaagag

SEQ ID NO: 47458 - DNA, 25 bp, Homo sapien
ccagaagcattgtcagtgctaagag

SEQ ID NO: 47459 - DNA, 25 bp, Homo sapien
ccagaaggaacctcagcaaattttt

SEQ ID NO: 47460 - DNA, 25 bp, Homo sapien
ccagaaggaacctcggcaaattttt

SEQ ID NO: 47461 - DNA, 25 bp, Homo sapien
ccagaaggctctaagtggcaaggcc

SEQ ID NO: 47462 - DNA, 25 bp, Homo sapien
ccagaagggcttctccaggaatgct

SEQ ID NO: 47463 - DNA, 25 bp, Homo sapien
ccagaagggtttctccaggaatgct

SEQ ID NO: 47464 - DNA, 25 bp, Homo sapien
ccagaaggtagacatttactctccc

SEQ ID NO: 47465 - DNA, 25 bp, Homo sapien
ccagaaggtagacgtttactctccc

SEQ ID NO: 47466 - DNA, 25 bp, Homo sapien
ccagaaggttctaagtggcaaggcc

SEQ ID NO: 47467 - DNA, 25 bp, Homo sapien
ccagaagtgcgcatgcagattttat

SEQ ID NO: 47468 - DNA, 25 bp, Homo sapien
ccagaagtgtgcatgcagattttat

SEQ ID NO: 47469 - DNA, 25 bp, Homo sapien
ccagaagtttgcataagtctgtcca

SEQ ID NO: 47470 - DNA, 25 bp, Homo sapien
ccagaagtttgcatgagtctgtcca

SEQ ID NO: 47471 - DNA, 25 bp, Homo sapien
ccagaatacagaagtacatcggtga

SEQ ID NO: 47472 - DNA, 25 bp, Homo sapien
ccagaatacggaagtacatcggtga

SEQ ID NO: 47473 - DNA, 25 bp, Homo sapien
ccagaattcagacccaaaatttttg

SEQ ID NO: 47474 - DNA, 25 bp, Homo sapien
ccagaattcagacccagaatttttg

SEQ ID NO: 47475 - DNA, 25 bp, Homo sapien
ccagaattcgtacgggcttagttcc

SEQ ID NO: 47476 - DNA, 25 bp, Homo sapien
ccagaattcgtatgggcttagttcc

SEQ ID NO: 47477 - DNA, 25 bp, Homo sapien
ccagaattgaactaatggtggcttg

SEQ ID NO: 47478 - DNA, 25 bp, Homo sapien
ccagaattgaactgatggtggcttg

SEQ ID NO: 47479 - DNA, 25 bp, Homo sapien
ccagaattgccgtccacgctaagcc

SEQ ID NO: 47480 - DNA, 25 bp, Homo sapien
ccagaattgccgtctacgctaagcc

SEQ ID NO: 47481 - DNA, 25 bp, Homo sapien
ccagaatttctcccacatgattaag

SEQ ID NO: 47482 - DNA, 25 bp, Homo sapien
ccagaatttctcccacgtgattaag

SEQ ID NO: 47483 - DNA, 25 bp, Homo sapien
ccagaattttcactgacagaaagat

SEQ ID NO: 47484 - DNA, 25 bp, Homo sapien
ccagaattttcattgacagaaagat

SEQ ID NO: 47485 - DNA, 25 bp, Homo sapien
ccagacaaccaacgccaatttttcc

SEQ ID NO: 47486 - DNA, 25 bp, Homo sapien
ccagacaaccaatgccaatttttcc

SEQ ID NO: 47487 - DNA, 25 bp, Homo sapien
ccagacacaaaacgctacatatcgt

SEQ ID NO: 47488 - DNA, 25 bp, Homo sapien
ccagacacaaaaggctacatatcgt

SEQ ID NO: 47489 - DNA, 25 bp, Homo sapien
ccagacacacagtttcttgacagat

SEQ ID NO: 47490 - DNA, 25 bp, Homo sapien
ccagacacgatgtggcaagagttgc

SEQ ID NO: 47491 - DNA, 25 bp, Homo sapien
ccagacacgcagtttcttgacagat

SEQ ID NO: 47492 - DNA, 25 bp, Homo sapien
ccagacactatgtggcaagagttgc

SEQ ID NO: 47493 - DNA, 25 bp, Homo sapien
ccagacacttacattttacactgtg

SEQ ID NO: 47494 - DNA, 25 bp, Homo sapien
ccagacacttatattttacactgtg

SEQ ID NO: 47495 - DNA, 25 bp, Homo sapien
ccagacagactggaaaactcttaat

SEQ ID NO: 47496 - DNA, 25 bp, Homo sapien
ccagacagactgggaaactcttaat

SEQ ID NO: 47497 - DNA, 25 bp, Homo sapien
ccagacaggactgaatggcaaagtg

SEQ ID NO: 47498 - DNA, 25 bp, Homo sapien
ccagacaggacttaatggcaaagtg

SEQ ID NO: 47499 - DNA, 25 bp, Homo sapien
ccagacagtatacctgagtcactgc

SEQ ID NO: 47500 - DNA, 25 bp, Homo sapien
ccagacagtgtacctgagtcactgc

SEQ ID NO: 47501 - DNA, 25 bp, Homo sapien
ccagacatatattccgcaatggaaa

SEQ ID NO: 47502 - DNA, 25 bp, Homo sapien
ccagacatcacaaaccagacacaga

SEQ ID NO: 47503 - DNA, 25 bp, Homo sapien
ccagacatcgcaaaccagacacaga

SEQ ID NO: 47504 - DNA, 25 bp, Homo sapien
ccagacatctgagcagcagtcctga

SEQ ID NO: 47505 - DNA, 25 bp, Homo sapien
ccagacatctgggcagcagtcctga

SEQ ID NO: 47506 - DNA, 25 bp, Homo sapien
ccagacatgcaaggagattcaacat

SEQ ID NO: 47507 - DNA, 25 bp, Homo sapien
ccagacattaaaccaagaaggaagt

SEQ ID NO: 47508 - DNA, 25 bp, Homo sapien
ccagacattaaaccgagaaggaagt

SEQ ID NO: 47509 - DNA, 25 bp, Homo sapien
ccagacattcaaggagattcaacat

SEQ ID NO: 47510 - DNA, 25 bp, Homo sapien
ccagacatttattccgcaatggaaa

SEQ ID NO: 47511 - DNA, 25 bp, Homo sapien
ccagacccgataaggatgctcaatc

SEQ ID NO: 47512 - DNA, 25 bp, Homo sapien
ccagacccgctaaggatgctcaatc

SEQ ID NO: 47513 - DNA, 25 bp, Homo sapien
ccagacctcctgccgctggactttt

SEQ ID NO: 47514 - DNA, 25 bp, Homo sapien
ccagacctcctgctgctggactttt

SEQ ID NO: 47515 - DNA, 25 bp, Homo sapien
ccagactccacaatcatgtgaacca

SEQ ID NO: 47516 - DNA, 25 bp, Homo sapien
ccagactccacattcatgtgaacca

SEQ ID NO: 47517 - DNA, 25 bp, Homo sapien
ccagactgatgagattcttcatggt

SEQ ID NO: 47518 - DNA, 25 bp, Homo sapien
ccagactgatgagatttttcatggt

SEQ ID NO: 47519 - DNA, 25 bp, Homo sapien
ccagactgccatgtcaaagtttcac

SEQ ID NO: 47520 - DNA, 25 bp, Homo sapien
ccagactgctatgtcaaagtttcac

SEQ ID NO: 47521 - DNA, 25 bp, Homo sapien
ccagacttacatttagtagaatttt

SEQ ID NO: 47522 - DNA, 25 bp, Homo sapien
ccagacttatatttagtagaatttt

SEQ ID NO: 47523 - DNA, 25 bp, Homo sapien
ccagacttcggaatagttggacaga

SEQ ID NO: 47524 - DNA, 25 bp, Homo sapien
ccagactttggaatagttggacaga

SEQ ID NO: 47525 - DNA, 25 bp, Homo sapien
ccagactttgtgctggttacagttc

SEQ ID NO: 47526 - DNA, 25 bp, Homo sapien
ccagactttttgctggttacagttc

SEQ ID NO: 47527 - DNA, 25 bp, Homo sapien
ccagagaagatattgaagccatgga

SEQ ID NO: 47528 - DNA, 25 bp, Homo sapien
ccagagaagatgttgaagccatgga

SEQ ID NO: 47529 - DNA, 25 bp, Homo sapien
ccagagaatcctgctaagcaatacc

SEQ ID NO: 47530 - DNA, 25 bp, Homo sapien
ccagagaatcctgttaagcaatacc

SEQ ID NO: 47531 - DNA, 25 bp, Homo sapien
ccagagaatgctcaaatagattttc

SEQ ID NO: 47532 - DNA, 25 bp, Homo sapien
ccagagaatgctcgaatagattttc

SEQ ID NO: 47533 - DNA, 25 bp, Homo sapien
ccagagacaaaacaacagctggaaa

SEQ ID NO: 47534 - DNA, 25 bp, Homo sapien
ccagagacaaaacgacagctggaaa

SEQ ID NO: 47535 - DNA, 25 bp, Homo sapien
ccagagacagctatcctttgaaagg

SEQ ID NO: 47536 - DNA, 25 bp, Homo sapien
ccagagactgccgcttttcccttta

SEQ ID NO: 47537 - DNA, 25 bp, Homo sapien
ccagagactgctatcctttgaaagg

SEQ ID NO: 47538 - DNA, 25 bp, Homo sapien
ccagagactgctgcttttcccttta

SEQ ID NO: 47539 - DNA, 25 bp, Homo sapien
ccagagagaaataaactagtccatg

SEQ ID NO: 47540 - DNA, 25 bp, Homo sapien
ccagagagaaatacactagtccatg

SEQ ID NO: 47541 - DNA, 25 bp, Homo sapien
ccagagagtgaagatacattaccta

SEQ ID NO: 47542 - DNA, 25 bp, Homo sapien
ccagagagtgaagatagattaccta

SEQ ID NO: 47543 - DNA, 25 bp, Homo sapien
ccagagagttacaatggtgaaaaaa

SEQ ID NO: 47544 - DNA, 25 bp, Homo sapien
ccagagagttataatggtgaaaaaa

SEQ ID NO: 47545 - DNA, 25 bp, Homo sapien
ccagagatactatgtgcaaaatatc

SEQ ID NO: 47546 - DNA, 25 bp, Homo sapien
ccagagatactgtgtgcaaaatatc

SEQ ID NO: 47547 - DNA, 25 bp, Homo sapien
ccagagatgatcattgctaacattt

SEQ ID NO: 47548 - DNA, 25 bp, Homo sapien
ccagagatgattattgctaacattt

SEQ ID NO: 47549 - DNA, 25 bp, Homo sapien
ccagagattggatttaggtgatgtg

SEQ ID NO: 47550 - DNA, 25 bp, Homo sapien
ccagagatttgatttaggtgatgtg

SEQ ID NO: 47551 - DNA, 25 bp, Homo sapien
ccagagcaaagcaaagagagggaaa

SEQ ID NO: 47552 - DNA, 25 bp, Homo sapien
ccagagcaaaggaaagagagggaaa

SEQ ID NO: 47553 - DNA, 25 bp, Homo sapien
ccagagcaatagtcaatgcatagca

SEQ ID NO: 47554 - DNA, 25 bp, Homo sapien
ccagagcaatagtcgatgcatagca

SEQ ID NO: 47555 - DNA, 25 bp, Homo sapien
ccagagcaatgtaaaaatcacagca

SEQ ID NO: 47556 - DNA, 25 bp, Homo sapien
ccagagcaatgtagaaatcacagca

SEQ ID NO: 47557 - DNA, 25 bp, Homo sapien
ccagagcccgaatttctgaggctta

SEQ ID NO: 47558 - DNA, 25 bp, Homo sapien
ccagagccctgagacagcaaatgtc

SEQ ID NO: 47559 - DNA, 25 bp, Homo sapien
ccagagccctgagagagcaaatgtc

SEQ ID NO: 47560 - DNA, 25 bp, Homo sapien
ccagagcctgaatttctgaggctta

SEQ ID NO: 47561 - DNA, 25 bp, Homo sapien
ccagagccttccaaggagcgcggcc

SEQ ID NO: 47562 - DNA, 25 bp, Homo sapien
ccagagccttccgaggagcgcggcc

SEQ ID NO: 47563 - DNA, 25 bp, Homo sapien
ccagagctaagcattgttgggctat

SEQ ID NO: 47564 - DNA, 25 bp, Homo sapien
ccagagctaagcgttgttgggctat

SEQ ID NO: 47565 - DNA, 25 bp, Homo sapien
ccagagctcaccacatctacttaaa

SEQ ID NO: 47566 - DNA, 25 bp, Homo sapien
ccagagctcgccacatctacttaaa

SEQ ID NO: 47567 - DNA, 25 bp, Homo sapien
ccagaggatccagatttccctgtgg

SEQ ID NO: 47568 - DNA, 25 bp, Homo sapien
ccagaggatccagctttccctgtgg

SEQ ID NO: 47569 - DNA, 25 bp, Homo sapien
ccagaggatggctcccactacaaag

SEQ ID NO: 47570 - DNA, 25 bp, Homo sapien
ccagaggatggttcccactacaaag

SEQ ID NO: 47571 - DNA, 25 bp, Homo sapien
ccagaggcccagtgaagttatcgca

SEQ ID NO: 47572 - DNA, 25 bp, Homo sapien
ccagaggctcagtgaagttatcgca

SEQ ID NO: 47573 - DNA, 25 bp, Homo sapien
ccagaggtaaagaaatcgtaagtgt

SEQ ID NO: 47574 - DNA, 25 bp, Homo sapien
ccagaggtaaagaagtcgtaagtgt

SEQ ID NO: 47575 - DNA, 25 bp, Homo sapien
ccagaggtaattacacatgttgttt

SEQ ID NO: 47576 - DNA, 25 bp, Homo sapien
ccagaggtaattatacatgttgttt

SEQ ID NO: 47577 - DNA, 25 bp, Homo sapien
ccagagtatgctactttccgaggca

SEQ ID NO: 47578 - DNA, 25 bp, Homo sapien
ccagagtatgcttctttccgaggca

SEQ ID NO: 47579 - DNA, 25 bp, Homo sapien
ccagagtggaccacaaaaataaaaa

SEQ ID NO: 47580 - DNA, 25 bp, Homo sapien
ccagagtggaccagaaaaataaaaa

SEQ ID NO: 47581 - DNA, 25 bp, Homo sapien
ccagagtggatatgttgttagccag

SEQ ID NO: 47582 - DNA, 25 bp, Homo sapien
ccagagtggatattttgttagccag

SEQ ID NO: 47583 - DNA, 25 bp, Homo sapien
ccagagtgttgcctctcagctcctc

SEQ ID NO: 47584 - DNA, 25 bp, Homo sapien
ccagagtgttgcttctcagctcctc

SEQ ID NO: 47585 - DNA, 25 bp, Homo sapien
ccagagtttcaaattcagtgtttct

SEQ ID NO: 47586 - DNA, 25 bp, Homo sapien
ccagagtttcagattcagtgtttct

SEQ ID NO: 47587 - DNA, 25 bp, Homo sapien
ccagataaaagacatgaattatttt

SEQ ID NO: 47588 - DNA, 25 bp, Homo sapien
ccagataaaaggcatgaattatttt

SEQ ID NO: 47589 - DNA, 25 bp, Homo sapien
ccagataatttacgctaacaatatg

SEQ ID NO: 47590 - DNA, 25 bp, Homo sapien
ccagataatttatgctaacaatatg

SEQ ID NO: 47591 - DNA, 25 bp, Homo sapien
ccagatacatacaaagccagagaaa

SEQ ID NO: 47592 - DNA, 25 bp, Homo sapien
ccagatacgtacaaagccagagaaa

SEQ ID NO: 47593 - DNA, 25 bp, Homo sapien
ccagatattcctcacctatggtttt

SEQ ID NO: 47594 - DNA, 25 bp, Homo sapien
ccagatattccttacctatggtttt

SEQ ID NO: 47595 - DNA, 25 bp, Homo sapien
ccagatattgaggcttaagagtcat

SEQ ID NO: 47596 - DNA, 25 bp, Homo sapien
ccagatattgagtcttaagagtcat

SEQ ID NO: 47597 - DNA, 25 bp, Homo sapien
ccagatatttgacatggcttcctcc

SEQ ID NO: 47598 - DNA, 25 bp, Homo sapien
ccagatatttgacgtggcttcctcc

SEQ ID NO: 47599 - DNA, 25 bp, Homo sapien
ccagatcaaaacacagtgtgccttt

SEQ ID NO: 47600 - DNA, 25 bp, Homo sapien
ccagatcaaaacagagtgtgccttt

SEQ ID NO: 47601 - DNA, 25 bp, Homo sapien
ccagatcactcacactgtttgcatt

SEQ ID NO: 47602 - DNA, 25 bp, Homo sapien
ccagatcactcatactgtttgcatt

SEQ ID NO: 47603 - DNA, 25 bp, Homo sapien
ccagatcactgaaggcagatatctt

SEQ ID NO: 47604 - DNA, 25 bp, Homo sapien
ccagatcagcaaagcgctgtaacta

SEQ ID NO: 47605 - DNA, 25 bp, Homo sapien
ccagatcagcaaagtgctgtaacta

SEQ ID NO: 47606 - DNA, 25 bp, Homo sapien
ccagatcatgagcgtactagaggct

SEQ ID NO: 47607 - DNA, 25 bp, Homo sapien
ccagatcatgagcgtagtagaggct

SEQ ID NO: 47608 - DNA, 25 bp, Homo sapien
ccagatcattgaaggcagatatctt

SEQ ID NO: 47609 - DNA, 25 bp, Homo sapien
ccagatccaaaatgccatagaaaat

SEQ ID NO: 47610 - DNA, 25 bp, Homo sapien
ccagatccaaagtgccatagaaaat

SEQ ID NO: 47611 - DNA, 25 bp, Homo sapien
ccagatccttaatatcatcacatct

SEQ ID NO: 47612 - DNA, 25 bp, Homo sapien
ccagatccttaatgtcatcacatct

SEQ ID NO: 47613 - DNA, 25 bp, Homo sapien
ccagatccttcactggcaaccccac

SEQ ID NO: 47614 - DNA, 25 bp, Homo sapien
ccagatccttcgctggcaaccccac

SEQ ID NO: 47615 - DNA, 25 bp, Homo sapien
ccagatctccttgccctagcctagg

SEQ ID NO: 47616 - DNA, 25 bp, Homo sapien
ccagatctccttgcgctagcctagg

SEQ ID NO: 47617 - DNA, 25 bp, Homo sapien
ccagatcttcaccggactggcttcc

SEQ ID NO: 47618 - DNA, 25 bp, Homo sapien
ccagatcttcacctgactggcttcc

SEQ ID NO: 47619 - DNA, 25 bp, Homo sapien
ccagatcttcgcatgtttttcagat

SEQ ID NO: 47620 - DNA, 25 bp, Homo sapien
ccagatctttcatatatattgtgtc

SEQ ID NO: 47621 - DNA, 25 bp, Homo sapien
ccagatctttcctatatattgtgtc

SEQ ID NO: 47622 - DNA, 25 bp, Homo sapien
ccagatctttgcatgtttttcagat

SEQ ID NO: 47623 - DNA, 25 bp, Homo sapien
ccagatgacatcttagctgggaatg

SEQ ID NO: 47624 - DNA, 25 bp, Homo sapien
ccagatgatactcccaaaacttagg

SEQ ID NO: 47625 - DNA, 25 bp, Homo sapien
ccagatgatactcctaaaacttagg

SEQ ID NO: 47626 - DNA, 25 bp, Homo sapien
ccagatgatatcttagctgggaatg

SEQ ID NO: 47627 - DNA, 25 bp, Homo sapien
ccagatgcttgcaaaggacaggtgt

SEQ ID NO: 47628 - DNA, 25 bp, Homo sapien
ccagatgcttgtaaaggacaggtgt

SEQ ID NO: 47629 - DNA, 25 bp, Homo sapien
ccagatggaagatgttctttaaggg

SEQ ID NO: 47630 - DNA, 25 bp, Homo sapien
ccagatggaagttgttctttaaggg

SEQ ID NO: 47631 - DNA, 25 bp, Homo sapien
ccagatggttttacaatgaaactgt

SEQ ID NO: 47632 - DNA, 25 bp, Homo sapien
ccagatggttttacgatgaaactgt

SEQ ID NO: 47633 - DNA, 25 bp, Homo sapien
ccagattactagcccgggtgcccaa

SEQ ID NO: 47634 - DNA, 25 bp, Homo sapien
ccagattactagcctgggtgcccaa

SEQ ID NO: 47635 - DNA, 25 bp, Homo sapien
ccagattatatagggaaacagataa

SEQ ID NO: 47636 - DNA, 25 bp, Homo sapien
ccagattatatggggaaacagataa

SEQ ID NO: 47637 - DNA, 25 bp, Homo sapien
ccagatttcgtttctggtgctaatc

SEQ ID NO: 47638 - DNA, 25 bp, Homo sapien
ccagatttgtgactgtgaattattt

SEQ ID NO: 47639 - DNA, 25 bp, Homo sapien
ccagatttgtgattgtgaattattt

SEQ ID NO: 47640 - DNA, 25 bp, Homo sapien
ccagattttgtttctggtgctaatc

SEQ ID NO: 47641 - DNA, 25 bp, Homo sapien
ccagcaaaatgactttcaaaagagg

SEQ ID NO: 47642 - DNA, 25 bp, Homo sapien
ccagcaaaatgattttcaaaagagg

SEQ ID NO: 47643 - DNA, 25 bp, Homo sapien
ccagcaaacaacaatttcttccgtg

SEQ ID NO: 47644 - DNA, 25 bp, Homo sapien
ccagcaaacaaccatttcttccgtg

SEQ ID NO: 47645 - DNA, 25 bp, Homo sapien
ccagcaacaatcaaagaaagttctt

SEQ ID NO: 47646 - DNA, 25 bp, Homo sapien
ccagcaacaatcagagaaagttctt

SEQ ID NO: 47647 - DNA, 25 bp, Homo sapien
ccagcaaggaaacgagggccactat

SEQ ID NO: 47648 - DNA, 25 bp, Homo sapien
ccagcaaggaaatgagggccactat

SEQ ID NO: 47649 - DNA, 25 bp, Homo sapien
ccagcaagggagcaacatggcaccc

SEQ ID NO: 47650 - DNA, 25 bp, Homo sapien
ccagcaagggagcagcatggcaccc

SEQ ID NO: 47651 - DNA, 25 bp, Homo sapien
ccagcaatcagtcctccaaggactc

SEQ ID NO: 47652 - DNA, 25 bp, Homo sapien
ccagcaatcggtcctccaaggactc

SEQ ID NO: 47653 - DNA, 25 bp, Homo sapien
ccagcaattctgttcccagagaaat

SEQ ID NO: 47654 - DNA, 25 bp, Homo sapien
ccagcaattctgttcctagagaaat

SEQ ID NO: 47655 - DNA, 25 bp, Homo sapien
ccagcacagtgaattaacgtaaacc

SEQ ID NO: 47656 - DNA, 25 bp, Homo sapien
ccagcacagtgcattaacgtaaacc

SEQ ID NO: 47657 - DNA, 25 bp, Homo sapien
ccagcacatatgcaacaagaagcgg

SEQ ID NO: 47658 - DNA, 25 bp, Homo sapien
ccagcacatatgtaacaagaagcgg

SEQ ID NO: 47659 - DNA, 25 bp, Homo sapien
ccagcacattacaggctccatggac

SEQ ID NO: 47660 - DNA, 25 bp, Homo sapien
ccagcacattacgggctccatggac

SEQ ID NO: 47661 - DNA, 25 bp, Homo sapien
ccagcacccattattcttccttatg

SEQ ID NO: 47662 - DNA, 25 bp, Homo sapien
ccagcacccattgcctccttactca

SEQ ID NO: 47663 - DNA, 25 bp, Homo sapien
ccagcacccatttcctccttactca

SEQ ID NO: 47664 - DNA, 25 bp, Homo sapien
ccagcaccctttattcttccttatg

SEQ ID NO: 47665 - DNA, 25 bp, Homo sapien
ccagcactctgcagacttcactttc

SEQ ID NO: 47666 - DNA, 25 bp, Homo sapien
ccagcactctgcaggcttcactttc

SEQ ID NO: 47667 - DNA, 25 bp, Homo sapien
ccagcactgcaaacatacttcttcc

SEQ ID NO: 47668 - DNA, 25 bp, Homo sapien
ccagcactgcaaccatacttcttcc

SEQ ID NO: 47669 - DNA, 25 bp, Homo sapien
ccagcagaatgcactaggacctgca

SEQ ID NO: 47670 - DNA, 25 bp, Homo sapien
ccagcagaatgcagtaggacctgca

SEQ ID NO: 47671 - DNA, 25 bp, Homo sapien
ccagcagcaatggaagggataagga

SEQ ID NO: 47672 - DNA, 25 bp, Homo sapien
ccagcagcacagggaatgaggaagc

SEQ ID NO: 47673 - DNA, 25 bp, Homo sapien
ccagcagcacagtgaatgaggaagc

SEQ ID NO: 47674 - DNA, 25 bp, Homo sapien
ccagcagcactggaagggataagga

SEQ ID NO: 47675 - DNA, 25 bp, Homo sapien
ccagcagcactttcaacacagaaac

SEQ ID NO: 47676 - DNA, 25 bp, Homo sapien
ccagcagcacttttaacacagaaac

SEQ ID NO: 47677 - DNA, 25 bp, Homo sapien
ccagcaggactaggtaccaaagcca

SEQ ID NO: 47678 - DNA, 25 bp, Homo sapien
ccagcaggactgggtaccaaagcca

SEQ ID NO: 47679 - DNA, 25 bp, Homo sapien
ccagcaggtccatttggatctggtt

SEQ ID NO: 47680 - DNA, 25 bp, Homo sapien
ccagcaggtccctttggatctggtt

SEQ ID NO: 47681 - DNA, 25 bp, Homo sapien
ccagcagtaaaggtcagcagctgag

SEQ ID NO: 47682 - DNA, 25 bp, Homo sapien
ccagcagtaaaggtgagcagctgag

SEQ ID NO: 47683 - DNA, 25 bp, Homo sapien
ccagcatcagactcctatacctgca

SEQ ID NO: 47684 - DNA, 25 bp, Homo sapien
ccagcatcagacttctatacctgca

SEQ ID NO: 47685 - DNA, 25 bp, Homo sapien
ccagcatcatgagattatagtttgc

SEQ ID NO: 47686 - DNA, 25 bp, Homo sapien
ccagcatcgtgagattatagtttgc

SEQ ID NO: 47687 - DNA, 25 bp, Homo sapien
ccagccaaactgcctgaagtatctc

SEQ ID NO: 47688 - DNA, 25 bp, Homo sapien
ccagccaaagtgcctgaagtatctc

SEQ ID NO: 47689 - DNA, 25 bp, Homo sapien
ccagccaatagagatcaatctagct

SEQ ID NO: 47690 - DNA, 25 bp, Homo sapien
ccagccaatagggatcaatctagct

SEQ ID NO: 47691 - DNA, 25 bp, Homo sapien
ccagccaatcctcagttaatagaca

SEQ ID NO: 47692 - DNA, 25 bp, Homo sapien
ccagccaatccttagttaatagaca

SEQ ID NO: 47693 - DNA, 25 bp, Homo sapien
ccagccacacacagcaggtcctttt

SEQ ID NO: 47694 - DNA, 25 bp, Homo sapien
ccagccacagacagctcccgatgcg

SEQ ID NO: 47695 - DNA, 25 bp, Homo sapien
ccagccacagacggctcccgatgcg

SEQ ID NO: 47696 - DNA, 25 bp, Homo sapien
ccagccaccatgccaaacactttat

SEQ ID NO: 47697 - DNA, 25 bp, Homo sapien
ccagccaccgtgccaaacactttat

SEQ ID NO: 47698 - DNA, 25 bp, Homo sapien
ccagccacgcacagcaggtcctttt

SEQ ID NO: 47699 - DNA, 25 bp, Homo sapien
ccagccagacagagcctttggaaga

SEQ ID NO: 47700 - DNA, 25 bp, Homo sapien
ccagccagacagaggctttggaaga

SEQ ID NO: 47701 - DNA, 25 bp, Homo sapien
ccagccatacttgggtaacagaatt

SEQ ID NO: 47702 - DNA, 25 bp, Homo sapien
ccagccatatttgggtaacagaatt

SEQ ID NO: 47703 - DNA, 25 bp, Homo sapien
ccagccatgtcatcgaatcgtcttt

SEQ ID NO: 47704 - DNA, 25 bp, Homo sapien
ccagccattatcattatccattatc

SEQ ID NO: 47705 - DNA, 25 bp, Homo sapien
ccagccattgtcattatccattatc

SEQ ID NO: 47706 - DNA, 25 bp, Homo sapien
ccagccatttcatcgaatcgtcttt

SEQ ID NO: 47707 - DNA, 25 bp, Homo sapien
ccagcccatcatactgtaggaatgt

SEQ ID NO: 47708 - DNA, 25 bp, Homo sapien
ccagcccatcatattgtaggaatgt

SEQ ID NO: 47709 - DNA, 25 bp, Homo sapien
ccagcctggtcaacacgatgaaacc

SEQ ID NO: 47710 - DNA, 25 bp, Homo sapien
ccagcctggtcaatacgatgaaacc

SEQ ID NO: 47711 - DNA, 25 bp, Homo sapien
ccagccttattctagttaaatgtaa

SEQ ID NO: 47712 - DNA, 25 bp, Homo sapien
ccagccttattctggttaaatgtaa

SEQ ID NO: 47713 - DNA, 25 bp, Homo sapien
ccagccttgtagttcgaggagagga

SEQ ID NO: 47714 - DNA, 25 bp, Homo sapien
ccagccttgtagttggaggagagga

SEQ ID NO: 47715 - DNA, 25 bp, Homo sapien
ccagcctttatgtgcacggtagcag

SEQ ID NO: 47716 - DNA, 25 bp, Homo sapien
ccagcctttatgtgcatggtagcag

SEQ ID NO: 47717 - DNA, 25 bp, Homo sapien
ccagcctttgccacagagcgagatc

SEQ ID NO: 47718 - DNA, 25 bp, Homo sapien
ccagcctttgccatagagcgagatc

SEQ ID NO: 47719 - DNA, 25 bp, Homo sapien
ccagcctttggcacgtgaagataat

SEQ ID NO: 47720 - DNA, 25 bp, Homo sapien
ccagcctttggcatgtgaagataat

SEQ ID NO: 47721 - DNA, 25 bp, Homo sapien
ccagcgaggttctaaaccaagttca

SEQ ID NO: 47722 - DNA, 25 bp, Homo sapien
ccagcgagtttctaaaccaagttca

SEQ ID NO: 47723 - DNA, 25 bp, Homo sapien
ccagcgcattctattggcaaggctg

SEQ ID NO: 47724 - DNA, 25 bp, Homo sapien
ccagcgcattctattgtcaaggctg

SEQ ID NO: 47725 - DNA, 25 bp, Homo sapien
ccagcgctactcggtgaccaaaccc

SEQ ID NO: 47726 - DNA, 25 bp, Homo sapien
ccagcgctacttggtgaccaaaccc

SEQ ID NO: 47727 - DNA, 25 bp, Homo sapien
ccagctacaacaacttaaagagatt

SEQ ID NO: 47728 - DNA, 25 bp, Homo sapien
ccagctacaacaatttaaagagatt

SEQ ID NO: 47729 - DNA, 25 bp, Homo sapien
ccagctactctaaccattgatcctt

SEQ ID NO: 47730 - DNA, 25 bp, Homo sapien
ccagctactctaatcattgatcctt

SEQ ID NO: 47731 - DNA, 25 bp, Homo sapien
ccagctagtttcacctatacccacc

SEQ ID NO: 47732 - DNA, 25 bp, Homo sapien
ccagctagttttacctatacccacc

SEQ ID NO: 47733 - DNA, 25 bp, Homo sapien
ccagctcagagcacccaactaagtg

SEQ ID NO: 47734 - DNA, 25 bp, Homo sapien
ccagctcagagtacccaactaagtg

SEQ ID NO: 47735 - DNA, 25 bp, Homo sapien
ccagctccaatgttttcactctaca

SEQ ID NO: 47736 - DNA, 25 bp, Homo sapien
ccagctccagtgttttcactctaca

SEQ ID NO: 47737 - DNA, 25 bp, Homo sapien
ccagctccctgcaccagtacttggc

SEQ ID NO: 47738 - DNA, 25 bp, Homo sapien
ccagctccctgcgccagtacttggc

SEQ ID NO: 47739 - DNA, 25 bp, Homo sapien
ccagctgatgatattcaaggatgtt

SEQ ID NO: 47740 - DNA, 25 bp, Homo sapien
ccagctgatgatgttcaaggatgtt

SEQ ID NO: 47741 - DNA, 25 bp, Homo sapien
ccagctgctatcatcacacactaca

SEQ ID NO: 47742 - DNA, 25 bp, Homo sapien
ccagctgctgtcatcacacactaca

SEQ ID NO: 47743 - DNA, 25 bp, Homo sapien
ccagctgtattgcgtccatttaaca

SEQ ID NO: 47744 - DNA, 25 bp, Homo sapien
ccagctgtattgtgtccatttaaca

SEQ ID NO: 47745 - DNA, 25 bp, Homo sapien
ccagctgtttgacgctcaatggatc

SEQ ID NO: 47746 - DNA, 25 bp, Homo sapien
ccagctgtttgatgctcaatggatc

SEQ ID NO: 47747 - DNA, 25 bp, Homo sapien
ccagcttccgctaatacatgttgat

SEQ ID NO: 47748 - DNA, 25 bp, Homo sapien
ccagcttctaccgtctgtttttgtg

SEQ ID NO: 47749 - DNA, 25 bp, Homo sapien
ccagcttctactgtctgtttttgtg

SEQ ID NO: 47750 - DNA, 25 bp, Homo sapien
ccagcttctcaacgtgttacttgtc

SEQ ID NO: 47751 - DNA, 25 bp, Homo sapien
ccagcttctcaatgtgttacttgtc

SEQ ID NO: 47752 - DNA, 25 bp, Homo sapien
ccagcttctgctaatacatgttgat

SEQ ID NO: 47753 - DNA, 25 bp, Homo sapien
ccagcttgtcacctgggactggtga

SEQ ID NO: 47754 - DNA, 25 bp, Homo sapien
ccagcttgtcacgtgggactggtga

SEQ ID NO: 47755 - DNA, 25 bp, Homo sapien
ccagcttgtgagtacaaataaaatc

SEQ ID NO: 47756 - DNA, 25 bp, Homo sapien
ccagcttgtgagtataaataaaatc

SEQ ID NO: 47757 - DNA, 25 bp, Homo sapien
ccagctttacctttaacgaaacaga

SEQ ID NO: 47758 - DNA, 25 bp, Homo sapien
ccagctttacctttaatgaaacaga

SEQ ID NO: 47759 - DNA, 25 bp, Homo sapien
ccagctttatcaacgggtccaaagt

SEQ ID NO: 47760 - DNA, 25 bp, Homo sapien
ccagctttatcaatgggtccaaagt

SEQ ID NO: 47761 - DNA, 25 bp, Homo sapien
ccagctttcccaactcaatcacctc

SEQ ID NO: 47762 - DNA, 25 bp, Homo sapien
ccagctttcccgactcaatcacctc

SEQ ID NO: 47763 - DNA, 25 bp, Homo sapien
ccagctttctgtcgggaaatcctct

SEQ ID NO: 47764 - DNA, 25 bp, Homo sapien
ccagctttctgttgggaaatcctct

SEQ ID NO: 47765 - DNA, 25 bp, Homo sapien
ccagctttggcacttgctgttcctc

SEQ ID NO: 47766 - DNA, 25 bp, Homo sapien
ccagctttggcacttgttgttcctc

SEQ ID NO: 47767 - DNA, 25 bp, Homo sapien
ccaggaaagtccatggagaagccca

SEQ ID NO: 47768 - DNA, 25 bp, Homo sapien
ccaggaaagtccgtggagaagccca

SEQ ID NO: 47769 - DNA, 25 bp, Homo sapien
ccaggaacagatgcccaaaaacagt

SEQ ID NO: 47770 - DNA, 25 bp, Homo sapien
ccaggaacagatgtccaaaaacagt

SEQ ID NO: 47771 - DNA, 25 bp, Homo sapien
ccaggaactactaaaaagacatggg

SEQ ID NO: 47772 - DNA, 25 bp, Homo sapien
ccaggaactgctaaaaagacatggg

SEQ ID NO: 47773 - DNA, 25 bp, Homo sapien
ccaggaagcagactgtggacttagt

SEQ ID NO: 47774 - DNA, 25 bp, Homo sapien
ccaggaagcagattgtggacttagt

SEQ ID NO: 47775 - DNA, 25 bp, Homo sapien
ccaggaaggagatatgtgagagtgt

SEQ ID NO: 47776 - DNA, 25 bp, Homo sapien
ccaggaaggaggtatgtgagagtgt

SEQ ID NO: 47777 - DNA, 25 bp, Homo sapien
ccaggaagtgccaccaaacctctga

SEQ ID NO: 47778 - DNA, 25 bp, Homo sapien
ccaggaagtgccgccaaacctctga

SEQ ID NO: 47779 - DNA, 25 bp, Homo sapien
ccaggaccgggttgctcagccttgg

SEQ ID NO: 47780 - DNA, 25 bp, Homo sapien
ccaggaccgggtttctcagccttgg

SEQ ID NO: 47781 - DNA, 25 bp, Homo sapien
ccaggacctcaataacacctaattt

SEQ ID NO: 47782 - DNA, 25 bp, Homo sapien
ccaggacctcattaacacctaattt

SEQ ID NO: 47783 - DNA, 25 bp, Homo sapien
ccaggactaaaagaacagctcagcc

SEQ ID NO: 47784 - DNA, 25 bp, Homo sapien
ccaggactaaaagaaccgctcagcc

SEQ ID NO: 47785 - DNA, 25 bp, Homo sapien
ccaggactcttacgggtcacacaaa

SEQ ID NO: 47786 - DNA, 25 bp, Homo sapien
ccaggactcttatgggtcacacaaa

SEQ ID NO: 47787 - DNA, 25 bp, Homo sapien
ccaggagaaagaagacaaccagcca

SEQ ID NO: 47788 - DNA, 25 bp, Homo sapien
ccaggagaaagatgacaaccagcca

SEQ ID NO: 47789 - DNA, 25 bp, Homo sapien
ccaggagaatgtgtatttttaaagc

SEQ ID NO: 47790 - DNA, 25 bp, Homo sapien
ccaggagaatttgtcacaaacaaac

SEQ ID NO: 47791 - DNA, 25 bp, Homo sapien
ccaggagaatttgtcagaaacaaac

SEQ ID NO: 47792 - DNA, 25 bp, Homo sapien
ccaggagacgacatctgagcatctg

SEQ ID NO: 47793 - DNA, 25 bp, Homo sapien
ccaggagacgatatctgagcatctg

SEQ ID NO: 47794 - DNA, 25 bp, Homo sapien
ccaggagagggatttttttcttggt

SEQ ID NO: 47795 - DNA, 25 bp, Homo sapien
ccaggagagggctttttttcttggt

SEQ ID NO: 47796 - DNA, 25 bp, Homo sapien
ccaggagagtgtgtatttttaaagc

SEQ ID NO: 47797 - DNA, 25 bp, Homo sapien
ccaggagcagcaccttcaagaccca

SEQ ID NO: 47798 - DNA, 25 bp, Homo sapien
ccaggagcagcatcttcaagaccca

SEQ ID NO: 47799 - DNA, 25 bp, Homo sapien
ccaggagggtcatctcagccccagg

SEQ ID NO: 47800 - DNA, 25 bp, Homo sapien
ccaggagggtcatgtcagccccagg

SEQ ID NO: 47801 - DNA, 25 bp, Homo sapien
ccaggaggtggacataatttaccct

SEQ ID NO: 47802 - DNA, 25 bp, Homo sapien
ccaggaggtggacgtaatttaccct

SEQ ID NO: 47803 - DNA, 25 bp, Homo sapien
ccaggagtagaattatgcagattga

SEQ ID NO: 47804 - DNA, 25 bp, Homo sapien
ccaggagtagaattattcagattga

SEQ ID NO: 47805 - DNA, 25 bp, Homo sapien
ccaggatcccagcgccttcttccat

SEQ ID NO: 47806 - DNA, 25 bp, Homo sapien
ccaggatcccagtgccttcttccat

SEQ ID NO: 47807 - DNA, 25 bp, Homo sapien
ccaggattcatacgtctaggaatca

SEQ ID NO: 47808 - DNA, 25 bp, Homo sapien
ccaggattcataggtctaggaatca

SEQ ID NO: 47809 - DNA, 25 bp, Homo sapien
ccaggatttagtcattcagcacagt

SEQ ID NO: 47810 - DNA, 25 bp, Homo sapien
ccaggatttagtcgttcagcacagt

SEQ ID NO: 47811 - DNA, 25 bp, Homo sapien
ccaggattttgtacgtggatgagat

SEQ ID NO: 47812 - DNA, 25 bp, Homo sapien
ccaggattttgtatgtggatgagat

SEQ ID NO: 47813 - DNA, 25 bp, Homo sapien
ccaggcaaaaagaaggcataataat

SEQ ID NO: 47814 - DNA, 25 bp, Homo sapien
ccaggcaaaacttgcaatcccgatt

SEQ ID NO: 47815 - DNA, 25 bp, Homo sapien
ccaggcaaaactttcaatcccgatt

SEQ ID NO: 47816 - DNA, 25 bp, Homo sapien
ccaggcaaagacattgattccaagg

SEQ ID NO: 47817 - DNA, 25 bp, Homo sapien
ccaggcaaagacgttgattccaagg

SEQ ID NO: 47818 - DNA, 25 bp, Homo sapien
ccaggcaacaagaaggcataataat

SEQ ID NO: 47819 - DNA, 25 bp, Homo sapien
ccaggcaacagagccaccttgaagc

SEQ ID NO: 47820 - DNA, 25 bp, Homo sapien
ccaggcaacagagccatcttgaagc

SEQ ID NO: 47821 - DNA, 25 bp, Homo sapien
ccaggcacatagcacgaagcatcac

SEQ ID NO: 47822 - DNA, 25 bp, Homo sapien
ccaggcacatagcaggaagcatcac

SEQ ID NO: 47823 - DNA, 25 bp, Homo sapien
ccaggcagtcacacggaaagctctt

SEQ ID NO: 47824 - DNA, 25 bp, Homo sapien
ccaggcagtcacatggaaagctctt

SEQ ID NO: 47825 - DNA, 25 bp, Homo sapien
ccaggcatttgcagagaaagaacaa

SEQ ID NO: 47826 - DNA, 25 bp, Homo sapien
ccaggcatttgcggagaaagaacaa

SEQ ID NO: 47827 - DNA, 25 bp, Homo sapien
ccaggccacgtcttaaaaatgagat

SEQ ID NO: 47828 - DNA, 25 bp, Homo sapien
ccaggccaggtcttaaaaatgagat

SEQ ID NO: 47829 - DNA, 25 bp, Homo sapien
ccaggcctctttacttttggttatg

SEQ ID NO: 47830 - DNA, 25 bp, Homo sapien
ccaggcctctttagttttggttatg

SEQ ID NO: 47831 - DNA, 25 bp, Homo sapien
ccaggcctgtactgacactggccca

SEQ ID NO: 47832 - DNA, 25 bp, Homo sapien
ccaggcctgtactgacgctggccca

SEQ ID NO: 47833 - DNA, 25 bp, Homo sapien
ccaggccttcttccttagaaaacaa

SEQ ID NO: 47834 - DNA, 25 bp, Homo sapien
ccaggccttcttccttggaaaacaa

SEQ ID NO: 47835 - DNA, 25 bp, Homo sapien
ccaggctaacctggttcctaacacg

SEQ ID NO: 47836 - DNA, 25 bp, Homo sapien
ccaggctaacctggtttctaacacg

SEQ ID NO: 47837 - DNA, 25 bp, Homo sapien
ccaggctactcccagccaatgactg

SEQ ID NO: 47838 - DNA, 25 bp, Homo sapien
ccaggctactcccggccaatgactg

SEQ ID NO: 47839 - DNA, 25 bp, Homo sapien
ccaggctcaaaaaaacaccgagtct

SEQ ID NO: 47840 - DNA, 25 bp, Homo sapien
ccaggctcaaaaacacaccgagtct

SEQ ID NO: 47841 - DNA, 25 bp, Homo sapien
ccaggctgccatacactgaggttgg

SEQ ID NO: 47842 - DNA, 25 bp, Homo sapien
ccaggctgcctctcacttgttgtta

SEQ ID NO: 47843 - DNA, 25 bp, Homo sapien
ccaggctgcctctcgcttgttgtta

SEQ ID NO: 47844 - DNA, 25 bp, Homo sapien
ccaggctgtcatacactgaggttgg

SEQ ID NO: 47845 - DNA, 25 bp, Homo sapien
ccaggcttaaaaacaaattacacgc

SEQ ID NO: 47846 - DNA, 25 bp, Homo sapien
ccaggcttaaaaataaattacacgc

SEQ ID NO: 47847 - DNA, 25 bp, Homo sapien
ccaggcttgtgaaatcctagtggcc

SEQ ID NO: 47848 - DNA, 25 bp, Homo sapien
ccaggcttgtgatatcctagtggcc

SEQ ID NO: 47849 - DNA, 25 bp, Homo sapien
ccaggcttgttatgcccacttttct

SEQ ID NO: 47850 - DNA, 25 bp, Homo sapien
ccaggcttgttgtgcccacttttct

SEQ ID NO: 47851 - DNA, 25 bp, Homo sapien
ccagggaaatagtaattgcagtctt

SEQ ID NO: 47852 - DNA, 25 bp, Homo sapien
ccagggaaatgcacatcacaaagac

SEQ ID NO: 47853 - DNA, 25 bp, Homo sapien
ccagggaaatgcacattacaaagac

SEQ ID NO: 47854 - DNA, 25 bp, Homo sapien
ccagggaaccactgatgctgcagtc

SEQ ID NO: 47855 - DNA, 25 bp, Homo sapien
ccagggaaccattgatgctgcagtc

SEQ ID NO: 47856 - DNA, 25 bp, Homo sapien
ccagggaactagtaattgcagtctt

SEQ ID NO: 47857 - DNA, 25 bp, Homo sapien
ccagggagaatgtcgtggatctggc

SEQ ID NO: 47858 - DNA, 25 bp, Homo sapien
ccagggagaatgttgtggatctggc

SEQ ID NO: 47859 - DNA, 25 bp, Homo sapien
ccagggataccaacaggaacaagac

SEQ ID NO: 47860 - DNA, 25 bp, Homo sapien
ccagggataccaccaggaacaagac

SEQ ID NO: 47861 - DNA, 25 bp, Homo sapien
ccagggcaataacgctcctgtttgg

SEQ ID NO: 47862 - DNA, 25 bp, Homo sapien
ccagggcaataatgctcctgtttgg

SEQ ID NO: 47863 - DNA, 25 bp, Homo sapien
ccagggcacaaaacaaagtcctccc

SEQ ID NO: 47864 - DNA, 25 bp, Homo sapien
ccagggcacaaagcaaagtcctccc

SEQ ID NO: 47865 - DNA, 25 bp, Homo sapien
ccagggcctcccaacatgtggtctt

SEQ ID NO: 47866 - DNA, 25 bp, Homo sapien
ccagggcctcccgacatgtggtctt

SEQ ID NO: 47867 - DNA, 25 bp, Homo sapien
ccaggggaatttctgaaaccagatt

SEQ ID NO: 47868 - DNA, 25 bp, Homo sapien
ccaggggagtttctgaaaccagatt

SEQ ID NO: 47869 - DNA, 25 bp, Homo sapien
ccaggggcatcagataccagtaaaa

SEQ ID NO: 47870 - DNA, 25 bp, Homo sapien
ccaggggcatcaggtaccagtaaaa

SEQ ID NO: 47871 - DNA, 25 bp, Homo sapien
ccagggtctacacttttagaaacaa

SEQ ID NO: 47872 - DNA, 25 bp, Homo sapien
ccagggtctacgcttttagaaacaa

SEQ ID NO: 47873 - DNA, 25 bp, Homo sapien
ccagggtgacagactcctagctaag

SEQ ID NO: 47874 - DNA, 25 bp, Homo sapien
ccagggtggcagactcctagctaag

SEQ ID NO: 47875 - DNA, 25 bp, Homo sapien
ccagggtttagggacgctcagcagg

SEQ ID NO: 47876 - DNA, 25 bp, Homo sapien
ccagggtttagggatgctcagcagg

SEQ ID NO: 47877 - DNA, 25 bp, Homo sapien
ccaggtaaaagaagaccagtagaat

SEQ ID NO: 47878 - DNA, 25 bp, Homo sapien
ccaggtaaaagaggaccagtagaat

SEQ ID NO: 47879 - DNA, 25 bp, Homo sapien
ccaggtactatgctatatcttatat

SEQ ID NO: 47880 - DNA, 25 bp, Homo sapien
ccaggtactatgctgtatcttatat

SEQ ID NO: 47881 - DNA, 25 bp, Homo sapien
ccaggtcatataactcactgtgatt

SEQ ID NO: 47882 - DNA, 25 bp, Homo sapien
ccaggtcatgtaactcactgtgatt

SEQ ID NO: 47883 - DNA, 25 bp, Homo sapien
ccaggtcctggggatacagaaatgg

SEQ ID NO: 47884 - DNA, 25 bp, Homo sapien
ccaggtcctggggatagagaaatgg

SEQ ID NO: 47885 - DNA, 25 bp, Homo sapien
ccaggtctgatttaactcacctttc

SEQ ID NO: 47886 - DNA, 25 bp, Homo sapien
ccaggtctgatttgactcacctttc

SEQ ID NO: 47887 - DNA, 25 bp, Homo sapien
ccaggtgaacaccacagccaagaaa

SEQ ID NO: 47888 - DNA, 25 bp, Homo sapien
ccaggtgagcaccacagccaagaaa

SEQ ID NO: 47889 - DNA, 25 bp, Homo sapien
ccaggtgagtgacactgtccagcac

SEQ ID NO: 47890 - DNA, 25 bp, Homo sapien
ccaggtgagtgatactgtccagcac

SEQ ID NO: 47891 - DNA, 25 bp, Homo sapien
ccaggtgattttaaggcaggaggtc

SEQ ID NO: 47892 - DNA, 25 bp, Homo sapien
ccaggtgattttaatgcaggaggtc

SEQ ID NO: 47893 - DNA, 25 bp, Homo sapien
ccaggtgcttcaccaagtgagtaga

SEQ ID NO: 47894 - DNA, 25 bp, Homo sapien
ccaggtgcttcgccaagtgagtaga

SEQ ID NO: 47895 - DNA, 25 bp, Homo sapien
ccaggtggactgacgctgatttcca

SEQ ID NO: 47896 - DNA, 25 bp, Homo sapien
ccaggtggactgatgctgatttcca

SEQ ID NO: 47897 - DNA, 25 bp, Homo sapien
ccaggtggagctcaccgaatgttgg

SEQ ID NO: 47898 - DNA, 25 bp, Homo sapien
ccaggtggagctcagcgaatgttgg

SEQ ID NO: 47899 - DNA, 25 bp, Homo sapien
ccaggtgttgaccctctaccattct

SEQ ID NO: 47900 - DNA, 25 bp, Homo sapien
ccaggtgtttaccctctaccattct

SEQ ID NO: 47901 - DNA, 25 bp, Homo sapien
ccaggttacttcatggtctcaaata

SEQ ID NO: 47902 - DNA, 25 bp, Homo sapien
ccaggttacttcattgtctcaaata

SEQ ID NO: 47903 - DNA, 25 bp, Homo sapien
ccaggttaggccaagttgagagtcc

SEQ ID NO: 47904 - DNA, 25 bp, Homo sapien
ccaggttaggccgagttgagagtcc

SEQ ID NO: 47905 - DNA, 25 bp, Homo sapien
ccaggttctatcacttcctgaaata

SEQ ID NO: 47906 - DNA, 25 bp, Homo sapien
ccaggttctatcgcttcctgaaata

SEQ ID NO: 47907 - DNA, 25 bp, Homo sapien
ccaggttctttctatcttcctgaca

SEQ ID NO: 47908 - DNA, 25 bp, Homo sapien
ccaggttctttctgtcttcctgaca

SEQ ID NO: 47909 - DNA, 25 bp, Homo sapien
ccaggtttaaagtttctcaggcttg

SEQ ID NO: 47910 - DNA, 25 bp, Homo sapien
ccaggtttagagtttctcaggcttg

SEQ ID NO: 47911 - DNA, 25 bp, Homo sapien
ccaggtttgcagagactgcctttcc

SEQ ID NO: 47912 - DNA, 25 bp, Homo sapien
ccaggtttgcagaggctgcctttcc

SEQ ID NO: 47913 - DNA, 25 bp, Homo sapien
ccaggttttcctcttctacctctag

SEQ ID NO: 47914 - DNA, 25 bp, Homo sapien
ccaggttttccttttctacctctag

SEQ ID NO: 47915 - DNA, 25 bp, Homo sapien
ccagtaatgtccaagtaatcaacat

SEQ ID NO: 47916 - DNA, 25 bp, Homo sapien
ccagtaatgtccacgtaatcaacat

SEQ ID NO: 47917 - DNA, 25 bp, Homo sapien
ccagtacaggagtgaacagatgagt

SEQ ID NO: 47918 - DNA, 25 bp, Homo sapien
ccagtacagtagtgaacagatgagt

SEQ ID NO: 47919 - DNA, 25 bp, Homo sapien
ccagtacatgataacgcgatttcaa

SEQ ID NO: 47920 - DNA, 25 bp, Homo sapien
ccagtacatgatatcgcgatttcaa

SEQ ID NO: 47921 - DNA, 25 bp, Homo sapien
ccagtagaaattcctccttatcaag

SEQ ID NO: 47922 - DNA, 25 bp, Homo sapien
ccagtagaatttcctccttatcaag

SEQ ID NO: 47923 - DNA, 25 bp, Homo sapien
ccagtagaggctagggtcctccatt

SEQ ID NO: 47924 - DNA, 25 bp, Homo sapien
ccagtagaggctagtgtcctccatt

SEQ ID NO: 47925 - DNA, 25 bp, Homo sapien
ccagtagttgcttgacctatgtttt

SEQ ID NO: 47926 - DNA, 25 bp, Homo sapien
ccagtagttgcttgacttatgtttt

SEQ ID NO: 47927 - DNA, 25 bp, Homo sapien
ccagtatagaagaaaaaacgcaggc

SEQ ID NO: 47928 - DNA, 25 bp, Homo sapien
ccagtatagaaggaaaaacgcaggc

SEQ ID NO: 47929 - DNA, 25 bp, Homo sapien
ccagtatgtatgtattcagatgagt

SEQ ID NO: 47930 - DNA, 25 bp, Homo sapien
ccagtatgtatgtattgagatgagt

SEQ ID NO: 47931 - DNA, 25 bp, Homo sapien
ccagtatgttacgggcttcatcaga

SEQ ID NO: 47932 - DNA, 25 bp, Homo sapien
ccagtatgttatgggcttcatcaga

SEQ ID NO: 47933 - DNA, 25 bp, Homo sapien
ccagtattgcttggttggagcattt

SEQ ID NO: 47934 - DNA, 25 bp, Homo sapien
ccagtattgtttggttggagcattt

SEQ ID NO: 47935 - DNA, 25 bp, Homo sapien
ccagtatttctgcacgaaggattta

SEQ ID NO: 47936 - DNA, 25 bp, Homo sapien
ccagtatttctggacgaaggattta

SEQ ID NO: 47937 - DNA, 25 bp, Homo sapien
ccagtcacccaagggacataaactg

SEQ ID NO: 47938 - DNA, 25 bp, Homo sapien
ccagtcacccaagggagataaactg

SEQ ID NO: 47939 - DNA, 25 bp, Homo sapien
ccagtcactgccctaattttccaca

SEQ ID NO: 47940 - DNA, 25 bp, Homo sapien
ccagtcactgccttaattttccaca

SEQ ID NO: 47941 - DNA, 25 bp, Homo sapien
ccagtcagagttgaagcaccaagaa

SEQ ID NO: 47942 - DNA, 25 bp, Homo sapien
ccagtcagagttgaggcaccaagaa

SEQ ID NO: 47943 - DNA, 25 bp, Homo sapien
ccagtcagataagaaatacagtcta

SEQ ID NO: 47944 - DNA, 25 bp, Homo sapien
ccagtcagcatgacaagagtgaaac

SEQ ID NO: 47945 - DNA, 25 bp, Homo sapien
ccagtcagcgtgacaagagtgaaac

SEQ ID NO: 47946 - DNA, 25 bp, Homo sapien
ccagtcaggtaagaaatacagtcta

SEQ ID NO: 47947 - DNA, 25 bp, Homo sapien
ccagtcaggtgaaggcaaacacatc

SEQ ID NO: 47948 - DNA, 25 bp, Homo sapien
ccagtcagtcttcctccctggtgag

SEQ ID NO: 47949 - DNA, 25 bp, Homo sapien
ccagtcagtcttgctccctggtgag

SEQ ID NO: 47950 - DNA, 25 bp, Homo sapien
ccagtcagttgaaggcaaacacatc

SEQ ID NO: 47951 - DNA, 25 bp, Homo sapien
ccagtcatctgccgtcactcagaca

SEQ ID NO: 47952 - DNA, 25 bp, Homo sapien
ccagtcatctgctgtcactcagaca

SEQ ID NO: 47953 - DNA, 25 bp, Homo sapien
ccagtcatgcaagtgaataatgtgg

SEQ ID NO: 47954 - DNA, 25 bp, Homo sapien
ccagtcatgcaggtgaataatgtgg

SEQ ID NO: 47955 - DNA, 25 bp, Homo sapien
ccagtccatttggtcaactcctcat

SEQ ID NO: 47956 - DNA, 25 bp, Homo sapien
ccagtccatttggttaactcctcat

SEQ ID NO: 47957 - DNA, 25 bp, Homo sapien
ccagtctcactgcttcatctaccac

SEQ ID NO: 47958 - DNA, 25 bp, Homo sapien
ccagtctcaggccagtcactttctt

SEQ ID NO: 47959 - DNA, 25 bp, Homo sapien
ccagtctcaggccggtcactttctt

SEQ ID NO: 47960 - DNA, 25 bp, Homo sapien
ccagtctcatccatatcattgtcac

SEQ ID NO: 47961 - DNA, 25 bp, Homo sapien
ccagtctcatccatattattgtcac

SEQ ID NO: 47962 - DNA, 25 bp, Homo sapien
ccagtctcattgcttcatctaccac

SEQ ID NO: 47963 - DNA, 25 bp, Homo sapien
ccagtctgggtcggcccaaagcaaa

SEQ ID NO: 47964 - DNA, 25 bp, Homo sapien
ccagtctgggtctgcccaaagcaaa

SEQ ID NO: 47965 - DNA, 25 bp, Homo sapien
ccagtcttcacctccatcttcacat

SEQ ID NO: 47966 - DNA, 25 bp, Homo sapien
ccagtcttcgcctccatcttcacat

SEQ ID NO: 47967 - DNA, 25 bp, Homo sapien
ccagtgaatgaagcgtgagaatatg

SEQ ID NO: 47968 - DNA, 25 bp, Homo sapien
ccagtgaatgaagtgtgagaatatg

SEQ ID NO: 47969 - DNA, 25 bp, Homo sapien
ccagtgacaagaaggaacaagatgg

SEQ ID NO: 47970 - DNA, 25 bp, Homo sapien
ccagtgacaagagggaacaagatgg

SEQ ID NO: 47971 - DNA, 25 bp, Homo sapien
ccagtgagagaagacgcacctcagg

SEQ ID NO: 47972 - DNA, 25 bp, Homo sapien
ccagtgagagaagatgcacctcagg

SEQ ID NO: 47973 - DNA, 25 bp, Homo sapien
ccagtgagtagcttagtatcaggta

SEQ ID NO: 47974 - DNA, 25 bp, Homo sapien
ccagtgagtagcttggtatcaggta

SEQ ID NO: 47975 - DNA, 25 bp, Homo sapien
ccagtgatatacagtagtagaaaac

SEQ ID NO: 47976 - DNA, 25 bp, Homo sapien
ccagtgatatacgagggctgaaaat

SEQ ID NO: 47977 - DNA, 25 bp, Homo sapien
ccagtgatatagagtagtagaaaac

SEQ ID NO: 47978 - DNA, 25 bp, Homo sapien
ccagtgatatatgagggctgaaaat

SEQ ID NO: 47979 - DNA, 25 bp, Homo sapien
ccagtgcatcgctaaggcttctaaa

SEQ ID NO: 47980 - DNA, 25 bp, Homo sapien
ccagtgcattgctaaggcttctaaa

SEQ ID NO: 47981 - DNA, 25 bp, Homo sapien
ccagtgcctaaccgggtgccttcag

SEQ ID NO: 47982 - DNA, 25 bp, Homo sapien
ccagtgcctaactgggtgccttcag

SEQ ID NO: 47983 - DNA, 25 bp, Homo sapien
ccagtgcgttacatggccagagcag

SEQ ID NO: 47984 - DNA, 25 bp, Homo sapien
ccagtgcgttatatggccagagcag

SEQ ID NO: 47985 - DNA, 25 bp, Homo sapien
ccagtgctcgtctggtctaagctgg

SEQ ID NO: 47986 - DNA, 25 bp, Homo sapien
ccagtgcttgtctggtctaagctgg

SEQ ID NO: 47987 - DNA, 25 bp, Homo sapien
ccagtggaggcgacacagcccaaga

SEQ ID NO: 47988 - DNA, 25 bp, Homo sapien
ccagtggaggcggcacagcccaaga

SEQ ID NO: 47989 - DNA, 25 bp, Homo sapien
ccagtggcaggtcacttgcaaattt

SEQ ID NO: 47990 - DNA, 25 bp, Homo sapien
ccagtggcaggtcatttgcaaattt

SEQ ID NO: 47991 - DNA, 25 bp, Homo sapien
ccagtggctctcctacctccttttc

SEQ ID NO: 47992 - DNA, 25 bp, Homo sapien
ccagtggctctcttacctccttttc

SEQ ID NO: 47993 - DNA, 25 bp, Homo sapien
ccagtgtactaccaccaacaattcg

SEQ ID NO: 47994 - DNA, 25 bp, Homo sapien
ccagtgtactactaccaacaattcg

SEQ ID NO: 47995 - DNA, 25 bp, Homo sapien
ccagtgtatgatatttagggtgtaa

SEQ ID NO: 47996 - DNA, 25 bp, Homo sapien
ccagtgtatgatttttagggtgtaa

SEQ ID NO: 47997 - DNA, 25 bp, Homo sapien
ccagtgtctcatacttcttaccttt

SEQ ID NO: 47998 - DNA, 25 bp, Homo sapien
ccagtgtctcatatttcttaccttt

SEQ ID NO: 47999 - DNA, 25 bp, Homo sapien
ccagtgtgagtttacgaggtatttt

SEQ ID NO: 48000 - DNA, 25 bp, Homo sapien
ccagtgtgagtttatgaggtatttt

SEQ ID NO: 48001 - DNA, 25 bp, Homo sapien
ccagtgtgcaacaggactttggctt

SEQ ID NO: 48002 - DNA, 25 bp, Homo sapien
ccagtgtgcaataggactttggctt

SEQ ID NO: 48003 - DNA, 25 bp, Homo sapien
ccagtgttgcgtgtcttagcgttct

SEQ ID NO: 48004 - DNA, 25 bp, Homo sapien
ccagtgtttcgtgtcttagcgttct

SEQ ID NO: 48005 - DNA, 25 bp, Homo sapien
ccagttaagccagaggacgacccac

SEQ ID NO: 48006 - DNA, 25 bp, Homo sapien
ccagttaagccagtggacgacccac

SEQ ID NO: 48007 - DNA, 25 bp, Homo sapien
ccagttacagccaatatgaacacac

SEQ ID NO: 48008 - DNA, 25 bp, Homo sapien
ccagttacagccgatatgaacacac

SEQ ID NO: 48009 - DNA, 25 bp, Homo sapien
ccagttagcaccaatcttgtacata

SEQ ID NO: 48010 - DNA, 25 bp, Homo sapien
ccagttagcaccgatcttgtacata

SEQ ID NO: 48011 - DNA, 25 bp, Homo sapien
ccagttataaccatgccaagtggag

SEQ ID NO: 48012 - DNA, 25 bp, Homo sapien
ccagttataaccgtgccaagtggag

SEQ ID NO: 48013 - DNA, 25 bp, Homo sapien
ccagttcaacatccttcattcggga

SEQ ID NO: 48014 - DNA, 25 bp, Homo sapien
ccagttcagcatccttcattcggga

SEQ ID NO: 48015 - DNA, 25 bp, Homo sapien
ccagttccaagttagaggtccacat

SEQ ID NO: 48016 - DNA, 25 bp, Homo sapien
ccagttccaagttggaggtccacat

SEQ ID NO: 48017 - DNA, 25 bp, Homo sapien
ccagttccattctgcacttggtggc

SEQ ID NO: 48018 - DNA, 25 bp, Homo sapien
ccagttccattctgcatttggtggc

SEQ ID NO: 48019 - DNA, 25 bp, Homo sapien
ccagttctattacaacaatgtgtag

SEQ ID NO: 48020 - DNA, 25 bp, Homo sapien
ccagttctattataacaatgtgtag

SEQ ID NO: 48021 - DNA, 25 bp, Homo sapien
ccagttcttcctaagtctttcattt

SEQ ID NO: 48022 - DNA, 25 bp, Homo sapien
ccagttctttctaagtctttcattt

SEQ ID NO: 48023 - DNA, 25 bp, Homo sapien
ccagttgaaaaatgtagtgcgtctc

SEQ ID NO: 48024 - DNA, 25 bp, Homo sapien
ccagttgaataatgtagtgcgtctc

SEQ ID NO: 48025 - DNA, 25 bp, Homo sapien
ccagttgcctaaaccacttatctgg

SEQ ID NO: 48026 - DNA, 25 bp, Homo sapien
ccagttgcctaaatcacttatctgg

SEQ ID NO: 48027 - DNA, 25 bp, Homo sapien
ccagttgcctccataagttaagatt

SEQ ID NO: 48028 - DNA, 25 bp, Homo sapien
ccagttgcctccgtaagttaagatt

SEQ ID NO: 48029 - DNA, 25 bp, Homo sapien
ccagttgctctcctccctctttgta

SEQ ID NO: 48030 - DNA, 25 bp, Homo sapien
ccagttgctctgctccctctttgta

SEQ ID NO: 48031 - DNA, 25 bp, Homo sapien
ccagtttatccaagtccaagaagta

SEQ ID NO: 48032 - DNA, 25 bp, Homo sapien
ccagtttatccaggtccaagaagta

SEQ ID NO: 48033 - DNA, 25 bp, Homo sapien
ccagtttattcacatgtaatctcgt

SEQ ID NO: 48034 - DNA, 25 bp, Homo sapien
ccagtttattcacgtgtaatctcgt

SEQ ID NO: 48035 - DNA, 25 bp, Homo sapien
ccagtttgcccaccactttgccagc

SEQ ID NO: 48036 - DNA, 25 bp, Homo sapien
ccagtttgcccagcactttgccagc

SEQ ID NO: 48037 - DNA, 25 bp, Homo sapien
ccagtttgcccatgatgtggtggtg

SEQ ID NO: 48038 - DNA, 25 bp, Homo sapien
ccagtttgcccatggtgtggtggtg

SEQ ID NO: 48039 - DNA, 25 bp, Homo sapien
ccataaaaaatctaccagttagtgg

SEQ ID NO: 48040 - DNA, 25 bp, Homo sapien
ccataaaaaatttaccagttagtgg

SEQ ID NO: 48041 - DNA, 25 bp, Homo sapien
ccataaaacgaaagtgagatgtgaa

SEQ ID NO: 48042 - DNA, 25 bp, Homo sapien
ccataaaacgaaagtgtgatgtgaa

SEQ ID NO: 48043 - DNA, 25 bp, Homo sapien
ccataaaataggataagtgtctcga

SEQ ID NO: 48044 - DNA, 25 bp, Homo sapien
ccataaaataggttaagtgtctcga

SEQ ID NO: 48045 - DNA, 25 bp, Homo sapien
ccataaagattttcagccttctgga

SEQ ID NO: 48046 - DNA, 25 bp, Homo sapien
ccataaagattttgagccttctgga

SEQ ID NO: 48047 - DNA, 25 bp, Homo sapien
ccataaatcgaaccctgtgttctgt

SEQ ID NO: 48048 - DNA, 25 bp, Homo sapien
ccataaatcgaaccttgtgttctgt

SEQ ID NO: 48049 - DNA, 25 bp, Homo sapien
ccataacatcttaatggttgggctg

SEQ ID NO: 48050 - DNA, 25 bp, Homo sapien
ccataacattttaatggttgggctg

SEQ ID NO: 48051 - DNA, 25 bp, Homo sapien
ccataactggcactatttctgagaa

SEQ ID NO: 48052 - DNA, 25 bp, Homo sapien
ccataactggcactgtttctgagaa

SEQ ID NO: 48053 - DNA, 25 bp, Homo sapien
ccataagtcatttaggagcaaatct

SEQ ID NO: 48054 - DNA, 25 bp, Homo sapien
ccataagtcgtttaggagcaaatct

SEQ ID NO: 48055 - DNA, 25 bp, Homo sapien
ccataataagtcacagccatgagca

SEQ ID NO: 48056 - DNA, 25 bp, Homo sapien
ccataataagtcatagccatgagca

SEQ ID NO: 48057 - DNA, 25 bp, Homo sapien
ccataataggctcattggtcaatat

SEQ ID NO: 48058 - DNA, 25 bp, Homo sapien
ccataatagtctcattggtcaatat

SEQ ID NO: 48059 - DNA, 25 bp, Homo sapien
ccataatgagacaagagagtaggat

SEQ ID NO: 48060 - DNA, 25 bp, Homo sapien
ccataatgagacaggagagtaggat

SEQ ID NO: 48061 - DNA, 25 bp, Homo sapien
ccataatgcaaaataagcctaaata

SEQ ID NO: 48062 - DNA, 25 bp, Homo sapien
ccataatgcgaaataagcctaaata

SEQ ID NO: 48063 - DNA, 25 bp, Homo sapien
ccataattccttagtttggagtcat

SEQ ID NO: 48064 - DNA, 25 bp, Homo sapien
ccataattgcttagtttggagtcat

SEQ ID NO: 48065 - DNA, 25 bp, Homo sapien
ccatacacactatcttcctcatttt

SEQ ID NO: 48066 - DNA, 25 bp, Homo sapien
ccatacacactatctttctcatttt

SEQ ID NO: 48067 - DNA, 25 bp, Homo sapien
ccatacacatacagaaaagtgcatg

SEQ ID NO: 48068 - DNA, 25 bp, Homo sapien
ccatacacatacggaaaagtgcatg

SEQ ID NO: 48069 - DNA, 25 bp, Homo sapien
ccatacaccagaatattatttagca

SEQ ID NO: 48070 - DNA, 25 bp, Homo sapien
ccatacaccagaatgttatttagca

SEQ ID NO: 48071 - DNA, 25 bp, Homo sapien
ccatacatataaatccataaacaat

SEQ ID NO: 48072 - DNA, 25 bp, Homo sapien
ccatacatatacatccataaacaat

SEQ ID NO: 48073 - DNA, 25 bp, Homo sapien
ccatacctaacctctcagcattgac

SEQ ID NO: 48074 - DNA, 25 bp, Homo sapien
ccatacctaacctttcagcattgac

SEQ ID NO: 48075 - DNA, 25 bp, Homo sapien
ccatacgggctcttttccgttctat

SEQ ID NO: 48076 - DNA, 25 bp, Homo sapien
ccatacgggctctttttcgttctat

SEQ ID NO: 48077 - DNA, 25 bp, Homo sapien
ccatactgatgatacaaaacagtca

SEQ ID NO: 48078 - DNA, 25 bp, Homo sapien
ccatactggtgatacaaaacagtca

SEQ ID NO: 48079 - DNA, 25 bp, Homo sapien
ccatactgtaagcaaaattccacgc

SEQ ID NO: 48080 - DNA, 25 bp, Homo sapien
ccatactgtaagcagaattccacgc

SEQ ID NO: 48081 - DNA, 25 bp, Homo sapien
ccatacttaccatgcaatacttttc

SEQ ID NO: 48082 - DNA, 25 bp, Homo sapien
ccatacttaccatgcagtacttttc

SEQ ID NO: 48083 - DNA, 25 bp, Homo sapien
ccatacttcctcctattctcttact

SEQ ID NO: 48084 - DNA, 25 bp, Homo sapien
ccatacttcctcttattctcttact

SEQ ID NO: 48085 - DNA, 25 bp, Homo sapien
ccatagaaagaaaacggcaagctgg

SEQ ID NO: 48086 - DNA, 25 bp, Homo sapien
ccatagaaagaaaatggcaagctgg

SEQ ID NO: 48087 - DNA, 25 bp, Homo sapien
ccatagagatgacacaattatttta

SEQ ID NO: 48088 - DNA, 25 bp, Homo sapien
ccatagagatgacagaattatttta

SEQ ID NO: 48089 - DNA, 25 bp, Homo sapien
ccatagatagtaatgcctgtgatgg

SEQ ID NO: 48090 - DNA, 25 bp, Homo sapien
ccatagatagtgatgcctgtgatgg

SEQ ID NO: 48091 - DNA, 25 bp, Homo sapien
ccatagctgctctcaaacatacgct

SEQ ID NO: 48092 - DNA, 25 bp, Homo sapien
ccatagctgctctgaaacatacgct

SEQ ID NO: 48093 - DNA, 25 bp, Homo sapien
ccataggattttcatacatccctct

SEQ ID NO: 48094 - DNA, 25 bp, Homo sapien
ccataggatttttatacatccctct

SEQ ID NO: 48095 - DNA, 25 bp, Homo sapien
ccatagtaatacataggaaatcctg

SEQ ID NO: 48096 - DNA, 25 bp, Homo sapien
ccatagtaatacatgggaaatcctg

SEQ ID NO: 48097 - DNA, 25 bp, Homo sapien
ccatatacatacttttttctgttgc

SEQ ID NO: 48098 - DNA, 25 bp, Homo sapien
ccatatacatatttttttctgttgc

SEQ ID NO: 48099 - DNA, 25 bp, Homo sapien
ccatatccaatcgtgttctatcttg

SEQ ID NO: 48100 - DNA, 25 bp, Homo sapien
ccatatccagcgccattcccacagg

SEQ ID NO: 48101 - DNA, 25 bp, Homo sapien
ccatatccagcggcattcccacagg

SEQ ID NO: 48102 - DNA, 25 bp, Homo sapien
ccatatccagtcgtgttctatcttg

SEQ ID NO: 48103 - DNA, 25 bp, Homo sapien
ccatatcttattcaattcctggcca

SEQ ID NO: 48104 - DNA, 25 bp, Homo sapien
ccatatcttatttaattcctggcca

SEQ ID NO: 48105 - DNA, 25 bp, Homo sapien
ccatatgcaaaaacatgaacttcag

SEQ ID NO: 48106 - DNA, 25 bp, Homo sapien
ccatatgcaaaaatatgaacttcag

SEQ ID NO: 48107 - DNA, 25 bp, Homo sapien
ccatatgcaccaatacttttaacgg

SEQ ID NO: 48108 - DNA, 25 bp, Homo sapien
ccatatgcaccagtacttttaacgg

SEQ ID NO: 48109 - DNA, 25 bp, Homo sapien
ccatatgcctgaacatttgattgga

SEQ ID NO: 48110 - DNA, 25 bp, Homo sapien
ccatatgcctggacatttgattgga

SEQ ID NO: 48111 - DNA, 25 bp, Homo sapien
ccatattaacagattcacaagctct

SEQ ID NO: 48112 - DNA, 25 bp, Homo sapien
ccatattaacaggttcacaagctct

SEQ ID NO: 48113 - DNA, 25 bp, Homo sapien
ccatattcaaattcagccatttata

SEQ ID NO: 48114 - DNA, 25 bp, Homo sapien
ccatattcactttccggtcttgtta

SEQ ID NO: 48115 - DNA, 25 bp, Homo sapien
ccatattcactttctggtcttgtta

SEQ ID NO: 48116 - DNA, 25 bp, Homo sapien
ccatattcagctagtcttgctatac

SEQ ID NO: 48117 - DNA, 25 bp, Homo sapien
ccatattcagctattcttgctatac

SEQ ID NO: 48118 - DNA, 25 bp, Homo sapien
ccatattcatacctatagcccactt

SEQ ID NO: 48119 - DNA, 25 bp, Homo sapien
ccatattcatacttatagcccactt

SEQ ID NO: 48120 - DNA, 25 bp, Homo sapien
ccatattccaattcagccatttata

SEQ ID NO: 48121 - DNA, 25 bp, Homo sapien
ccatattgcgatggtagtagaaacc

SEQ ID NO: 48122 - DNA, 25 bp, Homo sapien
ccatattgcttcactctcatttttt

SEQ ID NO: 48123 - DNA, 25 bp, Homo sapien
ccatattgtgatggtagtagaaacc

SEQ ID NO: 48124 - DNA, 25 bp, Homo sapien
ccatattgtttcactctcatttttt

SEQ ID NO: 48125 - DNA, 25 bp, Homo sapien
ccatatttaatgtaggcaatttgat

SEQ ID NO: 48126 - DNA, 25 bp, Homo sapien
ccatatttaatgtatgcaatttgat

SEQ ID NO: 48127 - DNA, 25 bp, Homo sapien
ccatatttccatgtattatactatg

SEQ ID NO: 48128 - DNA, 25 bp, Homo sapien
ccatattttaggagactccaaggtc

SEQ ID NO: 48129 - DNA, 25 bp, Homo sapien
ccatattttcatgtattatactatg

SEQ ID NO: 48130 - DNA, 25 bp, Homo sapien
ccatattttgggagactccaaggtc

SEQ ID NO: 48131 - DNA, 25 bp, Homo sapien
ccatcaaaacataaaggtcagtttg

SEQ ID NO: 48132 - DNA, 25 bp, Homo sapien
ccatcaaaagataaaggtcagtttg

SEQ ID NO: 48133 - DNA, 25 bp, Homo sapien
ccatcaaaatctcggccagctttca

SEQ ID NO: 48134 - DNA, 25 bp, Homo sapien
ccatcaaaatcttggccagctttca

SEQ ID NO: 48135 - DNA, 25 bp, Homo sapien
ccatcaaacataataaatccacagc

SEQ ID NO: 48136 - DNA, 25 bp, Homo sapien
ccatcaaacgtaataaatccacagc

SEQ ID NO: 48137 - DNA, 25 bp, Homo sapien
ccatcaacaaatcctatcaatttta

SEQ ID NO: 48138 - DNA, 25 bp, Homo sapien
ccatcaacaaatgctatcaatttta

SEQ ID NO: 48139 - DNA, 25 bp, Homo sapien
ccatcaacactggagtagggttgtc

SEQ ID NO: 48140 - DNA, 25 bp, Homo sapien
ccatcaacactgtagtagggttgtc

SEQ ID NO: 48141 - DNA, 25 bp, Homo sapien
ccatcaacagagtataatgtttaaa

SEQ ID NO: 48142 - DNA, 25 bp, Homo sapien
ccatcaacagagtatagtgtttaaa

SEQ ID NO: 48143 - DNA, 25 bp, Homo sapien
ccatcaagaagaatgtttactggag

SEQ ID NO: 48144 - DNA, 25 bp, Homo sapien
ccatcaagaagactgtttactggag

SEQ ID NO: 48145 - DNA, 25 bp, Homo sapien
ccatcaagcatcaacctttaggtac

SEQ ID NO: 48146 - DNA, 25 bp, Homo sapien
ccatcaagcatcagcctttaggtac

SEQ ID NO: 48147 - DNA, 25 bp, Homo sapien
ccatcacaggtaaattcttacaatg

SEQ ID NO: 48148 - DNA, 25 bp, Homo sapien
ccatcacaggtaagttcttacaatg

SEQ ID NO: 48149 - DNA, 25 bp, Homo sapien
ccatcagacggagagttggtctttt

SEQ ID NO: 48150 - DNA, 25 bp, Homo sapien
ccatcagagaaatctgccccttcct

SEQ ID NO: 48151 - DNA, 25 bp, Homo sapien
ccatcagagaactcagccagcctag

SEQ ID NO: 48152 - DNA, 25 bp, Homo sapien
ccatcagagaattcagccagcctag

SEQ ID NO: 48153 - DNA, 25 bp, Homo sapien
ccatcagaggaatctgccccttcct

SEQ ID NO: 48154 - DNA, 25 bp, Homo sapien
ccatcagatggagagttggtctttt

SEQ ID NO: 48155 - DNA, 25 bp, Homo sapien
ccatcagcagagcaggcagagccgt

SEQ ID NO: 48156 - DNA, 25 bp, Homo sapien
ccatcagcagagcaggtagagccgt

SEQ ID NO: 48157 - DNA, 25 bp, Homo sapien
ccatcagctttggcaccaaggccag

SEQ ID NO: 48158 - DNA, 25 bp, Homo sapien
ccatcagctttggcactaaggccag

SEQ ID NO: 48159 - DNA, 25 bp, Homo sapien
ccatcaggcacaggaaagctgagat

SEQ ID NO: 48160 - DNA, 25 bp, Homo sapien
ccatcaggcgcaggaaagctgagat

SEQ ID NO: 48161 - DNA, 25 bp, Homo sapien
ccatcagtgataacattgaaagttg

SEQ ID NO: 48162 - DNA, 25 bp, Homo sapien
ccatcagtgataacgttgaaagttg

SEQ ID NO: 48163 - DNA, 25 bp, Homo sapien
ccatcatactgtaggaatgtctccc

SEQ ID NO: 48164 - DNA, 25 bp, Homo sapien
ccatcatattgtaggaatgtctccc

SEQ ID NO: 48165 - DNA, 25 bp, Homo sapien
ccatcatccaccagaagaatgtgag

SEQ ID NO: 48166 - DNA, 25 bp, Homo sapien
ccatcatccaccaggagaatgtgag

SEQ ID NO: 48167 - DNA, 25 bp, Homo sapien
ccatcatggtatgacctctgtttac

SEQ ID NO: 48168 - DNA, 25 bp, Homo sapien
ccatcatggtatgagctctgtttac

SEQ ID NO: 48169 - DNA, 25 bp, Homo sapien
ccatccacatggcaaaggtatggtg

SEQ ID NO: 48170 - DNA, 25 bp, Homo sapien
ccatccacatggcagaggtatggtg

SEQ ID NO: 48171 - DNA, 25 bp, Homo sapien
ccatccctagacatcctgacaagtc

SEQ ID NO: 48172 - DNA, 25 bp, Homo sapien
ccatccctagacgtcctgacaagtc

SEQ ID NO: 48173 - DNA, 25 bp, Homo sapien
ccatcctcagtagactttaaacaac

SEQ ID NO: 48174 - DNA, 25 bp, Homo sapien
ccatcctcggtagactttaaacaac

SEQ ID NO: 48175 - DNA, 25 bp, Homo sapien
ccatcctctttaatactgaattatg

SEQ ID NO: 48176 - DNA, 25 bp, Homo sapien
ccatcctctttaatgctgaattatg

SEQ ID NO: 48177 - DNA, 25 bp, Homo sapien
ccatccttgaaatcctgtgctcagg

SEQ ID NO: 48178 - DNA, 25 bp, Homo sapien
ccatccttgaaatcgtgtgctcagg

SEQ ID NO: 48179 - DNA, 25 bp, Homo sapien
ccatcgattccaacttttcccctcc

SEQ ID NO: 48180 - DNA, 25 bp, Homo sapien
ccatcgattgcaacttttcccctcc

SEQ ID NO: 48181 - DNA, 25 bp, Homo sapien
ccatcgccatgcagtgcggtgttca

SEQ ID NO: 48182 - DNA, 25 bp, Homo sapien
ccatcgccatgcagtgtggtgttca

SEQ ID NO: 48183 - DNA, 25 bp, Homo sapien
ccatcgtatcttcctctgtcttact

SEQ ID NO: 48184 - DNA, 25 bp, Homo sapien
ccatcgtatcttcgtctgtcttact

SEQ ID NO: 48185 - DNA, 25 bp, Homo sapien
ccatctagtttgaagtacggcatca

SEQ ID NO: 48186 - DNA, 25 bp, Homo sapien
ccatctagtttgaggtacggcatca

SEQ ID NO: 48187 - DNA, 25 bp, Homo sapien
ccatctatacactgcccaaactcag

SEQ ID NO: 48188 - DNA, 25 bp, Homo sapien
ccatctatacactgtccaaactcag

SEQ ID NO: 48189 - DNA, 25 bp, Homo sapien
ccatctatccgcagagctttttaca

SEQ ID NO: 48190 - DNA, 25 bp, Homo sapien
ccatctatcggcagagctttttaca

SEQ ID NO: 48191 - DNA, 25 bp, Homo sapien
ccatctattacttcaattcaactct

SEQ ID NO: 48192 - DNA, 25 bp, Homo sapien
ccatctattacttcgattcaactct

SEQ ID NO: 48193 - DNA, 25 bp, Homo sapien
ccatctattgcacagattattgttt

SEQ ID NO: 48194 - DNA, 25 bp, Homo sapien
ccatctattgcacggattattgttt

SEQ ID NO: 48195 - DNA, 25 bp, Homo sapien
ccatctcaatatcttcacttaatca

SEQ ID NO: 48196 - DNA, 25 bp, Homo sapien
ccatctcaatatcttcccttaatca

SEQ ID NO: 48197 - DNA, 25 bp, Homo sapien
ccatctcaattacaccaactccatc

SEQ ID NO: 48198 - DNA, 25 bp, Homo sapien
ccatctcaattacaccgactccatc

SEQ ID NO: 48199 - DNA, 25 bp, Homo sapien
ccatctctaagtagaaaaatcaccc

SEQ ID NO: 48200 - DNA, 25 bp, Homo sapien
ccatctctaagttccaaataagtga

SEQ ID NO: 48201 - DNA, 25 bp, Homo sapien
ccatctctaagttctaaataagtga

SEQ ID NO: 48202 - DNA, 25 bp, Homo sapien
ccatctctatctcatgcggatttat

SEQ ID NO: 48203 - DNA, 25 bp, Homo sapien
ccatctctatctcatgtggatttat

SEQ ID NO: 48204 - DNA, 25 bp, Homo sapien
ccatctctgagtagaaaaatcaccc

SEQ ID NO: 48205 - DNA, 25 bp, Homo sapien
ccatctctgctttactgtgaaaatg

SEQ ID NO: 48206 - DNA, 25 bp, Homo sapien
ccatctctgctttattgtgaaaatg

SEQ ID NO: 48207 - DNA, 25 bp, Homo sapien
ccatctcttggcctcaacctgtcct

SEQ ID NO: 48208 - DNA, 25 bp, Homo sapien
ccatctcttggcttcaacctgtcct

SEQ ID NO: 48209 - DNA, 25 bp, Homo sapien
ccatctgacatggcatttgcacatt

SEQ ID NO: 48210 - DNA, 25 bp, Homo sapien
ccatctgacatggcgtttgcacatt

SEQ ID NO: 48211 - DNA, 25 bp, Homo sapien
ccatctgcacatctagtccaccctc

SEQ ID NO: 48212 - DNA, 25 bp, Homo sapien
ccatctgcagatctagtccaccctc

SEQ ID NO: 48213 - DNA, 25 bp, Homo sapien
ccatctgctgaacacacattttaat

SEQ ID NO: 48214 - DNA, 25 bp, Homo sapien
ccatctgctgaacatacattttaat

SEQ ID NO: 48215 - DNA, 25 bp, Homo sapien
ccatctgtcccacgcaaattccttt

SEQ ID NO: 48216 - DNA, 25 bp, Homo sapien
ccatctgtcccatgcaaattccttt

SEQ ID NO: 48217 - DNA, 25 bp, Homo sapien
ccatctgttgttaggaagaataaat

SEQ ID NO: 48218 - DNA, 25 bp, Homo sapien
ccatctgttgttaggatgaataaat

SEQ ID NO: 48219 - DNA, 25 bp, Homo sapien
ccatcttaccatctctaacctatgt

SEQ ID NO: 48220 - DNA, 25 bp, Homo sapien
ccatcttactatctctaacctatgt

SEQ ID NO: 48221 - DNA, 25 bp, Homo sapien
ccatcttagtccctttatgcttcta

SEQ ID NO: 48222 - DNA, 25 bp, Homo sapien
ccatcttagtccctttgtgcttcta

SEQ ID NO: 48223 - DNA, 25 bp, Homo sapien
ccatcttgagcgtattgccttatct

SEQ ID NO: 48224 - DNA, 25 bp, Homo sapien
ccatcttgagcgtgttgccttatct

SEQ ID NO: 48225 - DNA, 25 bp, Homo sapien
ccatcttgtaccgcaaacaaaaaaa

SEQ ID NO: 48226 - DNA, 25 bp, Homo sapien
ccatcttgtactgcaaacaaaaaaa

SEQ ID NO: 48227 - DNA, 25 bp, Homo sapien
ccatcttgtatattttcaaaacact

SEQ ID NO: 48228 - DNA, 25 bp, Homo sapien
ccatcttgtatcttttcaaaacact

SEQ ID NO: 48229 - DNA, 25 bp, Homo sapien
ccatctttatgccaatgtgtgccca

SEQ ID NO: 48230 - DNA, 25 bp, Homo sapien
ccatctttatgccagtgtgtgccca

SEQ ID NO: 48231 - DNA, 25 bp, Homo sapien
ccatctttcaaacgcttcagggcaa

SEQ ID NO: 48232 - DNA, 25 bp, Homo sapien
ccatctttcaaatgcttcagggcaa

SEQ ID NO: 48233 - DNA, 25 bp, Homo sapien
ccatcttttaagaatgcttgtaatt

SEQ ID NO: 48234 - DNA, 25 bp, Homo sapien
ccatcttttaaggatgcttgtaatt

SEQ ID NO: 48235 - DNA, 25 bp, Homo sapien
ccatcttttgacaccaagaagtatg

SEQ ID NO: 48236 - DNA, 25 bp, Homo sapien
ccatcttttgacaccaggaagtatg

SEQ ID NO: 48237 - DNA, 25 bp, Homo sapien
ccatgaaaaattctgagaagccctc

SEQ ID NO: 48238 - DNA, 25 bp, Homo sapien
ccatgaaaaattggcacctagttct

SEQ ID NO: 48239 - DNA, 25 bp, Homo sapien
ccatgaaaaccaacgctttgtctct

SEQ ID NO: 48240 - DNA, 25 bp, Homo sapien
ccatgaaaaccaatgctttgtctct

SEQ ID NO: 48241 - DNA, 25 bp, Homo sapien
ccatgaaaagttctgagaagccctc

SEQ ID NO: 48242 - DNA, 25 bp, Homo sapien
ccatgaaaagttggcacctagttct

SEQ ID NO: 48243 - DNA, 25 bp, Homo sapien
ccatgaaaatttaaaaggactagaa

SEQ ID NO: 48244 - DNA, 25 bp, Homo sapien
ccatgaaaattttaaaggactagaa

SEQ ID NO: 48245 - DNA, 25 bp, Homo sapien
ccatgaacctgtaaaattgcaaatg

SEQ ID NO: 48246 - DNA, 25 bp, Homo sapien
ccatgaacctgtaacattgcaaatg

SEQ ID NO: 48247 - DNA, 25 bp, Homo sapien
ccatgaagagtccttcctcagcttg

SEQ ID NO: 48248 - DNA, 25 bp, Homo sapien
ccatgaagagtctttcctcagcttg

SEQ ID NO: 48249 - DNA, 25 bp, Homo sapien
ccatgaataaaaccgttctcaggat

SEQ ID NO: 48250 - DNA, 25 bp, Homo sapien
ccatgaataaaactgttctcaggat

SEQ ID NO: 48251 - DNA, 25 bp, Homo sapien
ccatgaataaatctaaccagtgaga

SEQ ID NO: 48252 - DNA, 25 bp, Homo sapien
ccatgaataaatctaatcagtgaga

SEQ ID NO: 48253 - DNA, 25 bp, Homo sapien
ccatgaataacctcttgcctgtatg

SEQ ID NO: 48254 - DNA, 25 bp, Homo sapien
ccatgaatagagcttgcagggctgg

SEQ ID NO: 48255 - DNA, 25 bp, Homo sapien
ccatgaatagcctcttgcctgtatg

SEQ ID NO: 48256 - DNA, 25 bp, Homo sapien
ccatgaatataatgctacaatatat

SEQ ID NO: 48257 - DNA, 25 bp, Homo sapien
ccatgaatggagcttgcagggctgg

SEQ ID NO: 48258 - DNA, 25 bp, Homo sapien
ccatgaatttaatgctacaatatat

SEQ ID NO: 48259 - DNA, 25 bp, Homo sapien
ccatgacgagttacagaaggtagaa

SEQ ID NO: 48260 - DNA, 25 bp, Homo sapien
ccatgacgagttacggaaggtagaa

SEQ ID NO: 48261 - DNA, 25 bp, Homo sapien
ccatgacgcttgtaagtggagctat

SEQ ID NO: 48262 - DNA, 25 bp, Homo sapien
ccatgacgcttgtgagtggagctat

SEQ ID NO: 48263 - DNA, 25 bp, Homo sapien
ccatgagaaagcctgtcaatcctgc

SEQ ID NO: 48264 - DNA, 25 bp, Homo sapien
ccatgagaaagcttgtcaatcctgc

SEQ ID NO: 48265 - DNA, 25 bp, Homo sapien
ccatgaggagatgcactacattcaa

SEQ ID NO: 48266 - DNA, 25 bp, Homo sapien
ccatgaggagatgcgctacattcaa

SEQ ID NO: 48267 - DNA, 25 bp, Homo sapien
ccatgagtaaggcgacttgactttg

SEQ ID NO: 48268 - DNA, 25 bp, Homo sapien
ccatgagtaaggtgacttgactttg

SEQ ID NO: 48269 - DNA, 25 bp, Homo sapien
ccatgatatacactgaaattaggga

SEQ ID NO: 48270 - DNA, 25 bp, Homo sapien
ccatgatatacattgaaattaggga

SEQ ID NO: 48271 - DNA, 25 bp, Homo sapien
ccatgatcttcccagagatttttta

SEQ ID NO: 48272 - DNA, 25 bp, Homo sapien
ccatgatcttcccggagatttttta

SEQ ID NO: 48273 - DNA, 25 bp, Homo sapien
ccatgattacttgtccattaaggca

SEQ ID NO: 48274 - DNA, 25 bp, Homo sapien
ccatgattatttgtccattaaggca

SEQ ID NO: 48275 - DNA, 25 bp, Homo sapien
ccatgatttttctctttggggaaac

SEQ ID NO: 48276 - DNA, 25 bp, Homo sapien
ccatgatttttttctttggggaaac

SEQ ID NO: 48277 - DNA, 25 bp, Homo sapien
ccatgcaaaagaggaactgcaaaat

SEQ ID NO: 48278 - DNA, 25 bp, Homo sapien
ccatgcaaactcagatctaagagga

SEQ ID NO: 48279 - DNA, 25 bp, Homo sapien
ccatgcaaaggaggaactgcaaaat

SEQ ID NO: 48280 - DNA, 25 bp, Homo sapien
ccatgcaacctcagatctaagagga

SEQ ID NO: 48281 - DNA, 25 bp, Homo sapien
ccatgcaatgaagacattggactga

SEQ ID NO: 48282 - DNA, 25 bp, Homo sapien
ccatgcaatgaagatattggactga

SEQ ID NO: 48283 - DNA, 25 bp, Homo sapien
ccatgcaatgaccctgccttacatc

SEQ ID NO: 48284 - DNA, 25 bp, Homo sapien
ccatgcaatgactctgccttacatc

SEQ ID NO: 48285 - DNA, 25 bp, Homo sapien
ccatgcagatgacaggctgaaaggt

SEQ ID NO: 48286 - DNA, 25 bp, Homo sapien
ccatgcagatgacgggctgaaaggt

SEQ ID NO: 48287 - DNA, 25 bp, Homo sapien
ccatgcagtgaatacaaactcattc

SEQ ID NO: 48288 - DNA, 25 bp, Homo sapien
ccatgcagtgaatataaactcattc

SEQ ID NO: 48289 - DNA, 25 bp, Homo sapien
ccatgcatgcacctgattagtggaa

SEQ ID NO: 48290 - DNA, 25 bp, Homo sapien
ccatgcatgcatctgattagtggaa

SEQ ID NO: 48291 - DNA, 25 bp, Homo sapien
ccatgccagcctaaggtttgtagtt

SEQ ID NO: 48292 - DNA, 25 bp, Homo sapien
ccatgccaggctaaggtttgtagtt

SEQ ID NO: 48293 - DNA, 25 bp, Homo sapien
ccatgcccacttcaatctgttctca

SEQ ID NO: 48294 - DNA, 25 bp, Homo sapien
ccatgccctcttcaatctgttctca

SEQ ID NO: 48295 - DNA, 25 bp, Homo sapien
ccatgcccttttcaagactcaacac

SEQ ID NO: 48296 - DNA, 25 bp, Homo sapien
ccatgcccttttcaaggctcaacac

SEQ ID NO: 48297 - DNA, 25 bp, Homo sapien
ccatgcgcagtttaaaaatttccag

SEQ ID NO: 48298 - DNA, 25 bp, Homo sapien
ccatgcgcagttttaaaatttccag

SEQ ID NO: 48299 - DNA, 25 bp, Homo sapien
ccatgctaatatacatcgcttggag

SEQ ID NO: 48300 - DNA, 25 bp, Homo sapien
ccatgctaatatacatggcttggag

SEQ ID NO: 48301 - DNA, 25 bp, Homo sapien
ccatgctccatgaaataattgcttt

SEQ ID NO: 48302 - DNA, 25 bp, Homo sapien
ccatgctccatgacataattgcttt

SEQ ID NO: 48303 - DNA, 25 bp, Homo sapien
ccatgctgaacgtggggcatctaga

SEQ ID NO: 48304 - DNA, 25 bp, Homo sapien
ccatgctggacgtggggcatctaga

SEQ ID NO: 48305 - DNA, 25 bp, Homo sapien
ccatgctggagtggtgctcacaggg

SEQ ID NO: 48306 - DNA, 25 bp, Homo sapien
ccatgctggcgtggtgctcacaggg

SEQ ID NO: 48307 - DNA, 25 bp, Homo sapien
ccatgctgtcactgtgcgggttatc

SEQ ID NO: 48308 - DNA, 25 bp, Homo sapien
ccatgctgtcactgtgtgggttatc

SEQ ID NO: 48309 - DNA, 25 bp, Homo sapien
ccatgcttttcccactcagctcatt

SEQ ID NO: 48310 - DNA, 25 bp, Homo sapien
ccatgcttttcccgctcagctcatt

SEQ ID NO: 48311 - DNA, 25 bp, Homo sapien
ccatggaaactacagaaaattggac

SEQ ID NO: 48312 - DNA, 25 bp, Homo sapien
ccatggaaactacagagaattggac

SEQ ID NO: 48313 - DNA, 25 bp, Homo sapien
ccatggaaataacggccagcatagg

SEQ ID NO: 48314 - DNA, 25 bp, Homo sapien
ccatggaaataatggccagcatagg

SEQ ID NO: 48315 - DNA, 25 bp, Homo sapien
ccatggaattgggctggatgtggct

SEQ ID NO: 48316 - DNA, 25 bp, Homo sapien
ccatggaattgggttggatgtggct

SEQ ID NO: 48317 - DNA, 25 bp, Homo sapien
ccatggagataaatttgcaatcacc

SEQ ID NO: 48318 - DNA, 25 bp, Homo sapien
ccatggagatacatttgcaatcacc

SEQ ID NO: 48319 - DNA, 25 bp, Homo sapien
ccatggagtatacaagagtcaaaag

SEQ ID NO: 48320 - DNA, 25 bp, Homo sapien
ccatggagtatacgagagtcaaaag

SEQ ID NO: 48321 - DNA, 25 bp, Homo sapien
ccatggcattgtgtatagttgctga

SEQ ID NO: 48322 - DNA, 25 bp, Homo sapien
ccatggcattgtgtgtagttgctga

SEQ ID NO: 48323 - DNA, 25 bp, Homo sapien
ccatggctttctgataacagtgata

SEQ ID NO: 48324 - DNA, 25 bp, Homo sapien
ccatggctttctgatagcagtgata

SEQ ID NO: 48325 - DNA, 25 bp, Homo sapien
ccatgggaatctctttgcctttgta

SEQ ID NO: 48326 - DNA, 25 bp, Homo sapien
ccatgggattctctttgcctttgta

SEQ ID NO: 48327 - DNA, 25 bp, Homo sapien
ccatggtaagacatgcctacttctc

SEQ ID NO: 48328 - DNA, 25 bp, Homo sapien
ccatggtaagacgtgcctacttctc

SEQ ID NO: 48329 - DNA, 25 bp, Homo sapien
ccatggttttacgcaaatgtctgta

SEQ ID NO: 48330 - DNA, 25 bp, Homo sapien
ccatggttttatgcaaatgtctgta

SEQ ID NO: 48331 - DNA, 25 bp, Homo sapien
ccatgtaaccttctcggtcttgtaa

SEQ ID NO: 48332 - DNA, 25 bp, Homo sapien
ccatgtaaccttcttggtcttgtaa

SEQ ID NO: 48333 - DNA, 25 bp, Homo sapien
ccatgtaaggacacagagagaaggc

SEQ ID NO: 48334 - DNA, 25 bp, Homo sapien
ccatgtaaggacacagcgagaaggc

SEQ ID NO: 48335 - DNA, 25 bp, Homo sapien
ccatgtaccgtaggatgcttagcag

SEQ ID NO: 48336 - DNA, 25 bp, Homo sapien
ccatgtaccttaggatgcttagcag

SEQ ID NO: 48337 - DNA, 25 bp, Homo sapien
ccatgtagactttgaaccaggaaaa

SEQ ID NO: 48338 - DNA, 25 bp, Homo sapien
ccatgtaggctttgaaccaggaaaa

SEQ ID NO: 48339 - DNA, 25 bp, Homo sapien
ccatgtcacctttcaccaagtataa

SEQ ID NO: 48340 - DNA, 25 bp, Homo sapien
ccatgtcacgtttcaccaagtataa

SEQ ID NO: 48341 - DNA, 25 bp, Homo sapien
ccatgtctgagactcagaacctcaa

SEQ ID NO: 48342 - DNA, 25 bp, Homo sapien
ccatgtctgagattcagaacctcaa

SEQ ID NO: 48343 - DNA, 25 bp, Homo sapien
ccatgtgacatttgtgggtcagcag

SEQ ID NO: 48344 - DNA, 25 bp, Homo sapien
ccatgtgacttttgtgggtcagcag

SEQ ID NO: 48345 - DNA, 25 bp, Homo sapien
ccatgtgcaactatatctgcagagg

SEQ ID NO: 48346 - DNA, 25 bp, Homo sapien
ccatgtgcaactgtatctgcagagg

SEQ ID NO: 48347 - DNA, 25 bp, Homo sapien
ccatgtgccagccaccatgccaaac

SEQ ID NO: 48348 - DNA, 25 bp, Homo sapien
ccatgtgccagccaccgtgccaaac

SEQ ID NO: 48349 - DNA, 25 bp, Homo sapien
ccatgtggcatgtatcgtggcaatc

SEQ ID NO: 48350 - DNA, 25 bp, Homo sapien
ccatgtggcatgtctcgtggcaatc

SEQ ID NO: 48351 - DNA, 25 bp, Homo sapien
ccatgtgggaatcagcaagaacaac

SEQ ID NO: 48352 - DNA, 25 bp, Homo sapien
ccatgtgggaatcggcaagaacaac

SEQ ID NO: 48353 - DNA, 25 bp, Homo sapien
ccatgtgggcaagcccgcctagata

SEQ ID NO: 48354 - DNA, 25 bp, Homo sapien
ccatgtgggcaaggccgcctagata

SEQ ID NO: 48355 - DNA, 25 bp, Homo sapien
ccatgttaaccctactaccacattc

SEQ ID NO: 48356 - DNA, 25 bp, Homo sapien
ccatgttaaccttactaccacattc

SEQ ID NO: 48357 - DNA, 25 bp, Homo sapien
ccatgttgaatattcccagtgcaca

SEQ ID NO: 48358 - DNA, 25 bp, Homo sapien
ccatgttgaggcttccacaacagag

SEQ ID NO: 48359 - DNA, 25 bp, Homo sapien
ccatgttgaggtttccacaacagag

SEQ ID NO: 48360 - DNA, 25 bp, Homo sapien
ccatgttggatattcccagtgcaca

SEQ ID NO: 48361 - DNA, 25 bp, Homo sapien
ccatgttgttgaatctatcagtagt

SEQ ID NO: 48362 - DNA, 25 bp, Homo sapien
ccatgttgttgaatgtatcagtagt

SEQ ID NO: 48363 - DNA, 25 bp, Homo sapien
ccatgtttaaaaacaaagccttgaa

SEQ ID NO: 48364 - DNA, 25 bp, Homo sapien
ccatgtttaaaatcaaagccttgaa

SEQ ID NO: 48365 - DNA, 25 bp, Homo sapien
ccattaaaagtaccggcaaaaacca

SEQ ID NO: 48366 - DNA, 25 bp, Homo sapien
ccattaaaagtactggcaaaaacca

SEQ ID NO: 48367 - DNA, 25 bp, Homo sapien
ccattaaactaacctttaaaagcac

SEQ ID NO: 48368 - DNA, 25 bp, Homo sapien
ccattaaactaatctttaaaagcac

SEQ ID NO: 48369 - DNA, 25 bp, Homo sapien
ccattaaattgcacaaaatatcaaa

SEQ ID NO: 48370 - DNA, 25 bp, Homo sapien
ccattaaattgcacgaaatatcaaa

SEQ ID NO: 48371 - DNA, 25 bp, Homo sapien
ccattaacgataattcatctggtag

SEQ ID NO: 48372 - DNA, 25 bp, Homo sapien
ccattaacgataattcgtctggtag

SEQ ID NO: 48373 - DNA, 25 bp, Homo sapien
ccattaactgtggatgttgtcatca

SEQ ID NO: 48374 - DNA, 25 bp, Homo sapien
ccattaactgttgatgttgtcatca

SEQ ID NO: 48375 - DNA, 25 bp, Homo sapien
ccattacaaagttaggaaaaaccac

SEQ ID NO: 48376 - DNA, 25 bp, Homo sapien
ccattacaaggttaggaaaaaccac

SEQ ID NO: 48377 - DNA, 25 bp, Homo sapien
ccattaccattaccattaccctagc

SEQ ID NO: 48378 - DNA, 25 bp, Homo sapien
ccattacccataatatcattttttg

SEQ ID NO: 48379 - DNA, 25 bp, Homo sapien
ccattacccataatattattttttg

SEQ ID NO: 48380 - DNA, 25 bp, Homo sapien
ccattaccgttaccattaccctagc

SEQ ID NO: 48381 - DNA, 25 bp, Homo sapien
ccattacttgttgcgattaccacga

SEQ ID NO: 48382 - DNA, 25 bp, Homo sapien
ccattactttttgcgattaccacga

SEQ ID NO: 48383 - DNA, 25 bp, Homo sapien
ccattagaacctccagatgtcttct

SEQ ID NO: 48384 - DNA, 25 bp, Homo sapien
ccattagaacctgcagatgtcttct

SEQ ID NO: 48385 - DNA, 25 bp, Homo sapien
ccattagagtgacggaagtgagcat

SEQ ID NO: 48386 - DNA, 25 bp, Homo sapien
ccattagagtgatggaagtgagcat

SEQ ID NO: 48387 - DNA, 25 bp, Homo sapien
ccattagcttacaaccgctatgagg

SEQ ID NO: 48388 - DNA, 25 bp, Homo sapien
ccattagcttacaacctctatgagg

SEQ ID NO: 48389 - DNA, 25 bp, Homo sapien
ccattaggcttcatcctggttacca

SEQ ID NO: 48390 - DNA, 25 bp, Homo sapien
ccattaggctttatcctggttacca

SEQ ID NO: 48391 - DNA, 25 bp, Homo sapien
ccattatatttcccattatctgatg

SEQ ID NO: 48392 - DNA, 25 bp, Homo sapien
ccattatatttctcattatctgatg

SEQ ID NO: 48393 - DNA, 25 bp, Homo sapien
ccattatgaacaaggcactggctgg

SEQ ID NO: 48394 - DNA, 25 bp, Homo sapien
ccattatgagcaaggcactggctgg

SEQ ID NO: 48395 - DNA, 25 bp, Homo sapien
ccattatgattatgccaggttacac

SEQ ID NO: 48396 - DNA, 25 bp, Homo sapien
ccattatgattgtgccaggttacac

SEQ ID NO: 48397 - DNA, 25 bp, Homo sapien
ccattatttccatttaccaagtttt

SEQ ID NO: 48398 - DNA, 25 bp, Homo sapien
ccattatttccatttatcaagtttt

SEQ ID NO: 48399 - DNA, 25 bp, Homo sapien
ccattcaaatgcaccttccagaatg

SEQ ID NO: 48400 - DNA, 25 bp, Homo sapien
ccattcaaatgcactttccagaatg

SEQ ID NO: 48401 - DNA, 25 bp, Homo sapien
ccattcaacacacaaggttaagcct

SEQ ID NO: 48402 - DNA, 25 bp, Homo sapien
ccattcaactcacaaggttaagcct

SEQ ID NO: 48403 - DNA, 25 bp, Homo sapien
ccattcaagaataaaaatgattaga

SEQ ID NO: 48404 - DNA, 25 bp, Homo sapien
ccattcaaggataaaaatgattaga

SEQ ID NO: 48405 - DNA, 25 bp, Homo sapien
ccattcaatttccgtacttccacca

SEQ ID NO: 48406 - DNA, 25 bp, Homo sapien
ccattcaatttctgtacttccacca

SEQ ID NO: 48407 - DNA, 25 bp, Homo sapien
ccattcacacttgtactttttttat

SEQ ID NO: 48408 - DNA, 25 bp, Homo sapien
ccattcacagatcctaccacaacag

SEQ ID NO: 48409 - DNA, 25 bp, Homo sapien
ccattcacagattctaccacaacag

SEQ ID NO: 48410 - DNA, 25 bp, Homo sapien
ccattcaccgaatataaagcagtcc

SEQ ID NO: 48411 - DNA, 25 bp, Homo sapien
ccattcacgcttgtactttttttat

SEQ ID NO: 48412 - DNA, 25 bp, Homo sapien
ccattcactgaatataaagcagtcc

SEQ ID NO: 48413 - DNA, 25 bp, Homo sapien
ccattcatctcagaatatgtctggt

SEQ ID NO: 48414 - DNA, 25 bp, Homo sapien
ccattcatctcagagtatgtctggt

SEQ ID NO: 48415 - DNA, 25 bp, Homo sapien
ccattcatgatttcaacaatactta

SEQ ID NO: 48416 - DNA, 25 bp, Homo sapien
ccattcatgatttccacaatactta

SEQ ID NO: 48417 - DNA, 25 bp, Homo sapien
ccattcatggtgtcatatagaaggg

SEQ ID NO: 48418 - DNA, 25 bp, Homo sapien
ccattcatggtgtcgtatagaaggg

SEQ ID NO: 48419 - DNA, 25 bp, Homo sapien
ccattcatttacatgtcgtctgggc

SEQ ID NO: 48420 - DNA, 25 bp, Homo sapien
ccattcatttacatgttgtctgggc

SEQ ID NO: 48421 - DNA, 25 bp, Homo sapien
ccattccacgtgattgctaaaccct

SEQ ID NO: 48422 - DNA, 25 bp, Homo sapien
ccattccacgtggttgctaaaccct

SEQ ID NO: 48423 - DNA, 25 bp, Homo sapien
ccattccagagcaaagcaaagagag

SEQ ID NO: 48424 - DNA, 25 bp, Homo sapien
ccattccagagcaaaggaaagagag

SEQ ID NO: 48425 - DNA, 25 bp, Homo sapien
ccattcccagaggagagaaaccatt

SEQ ID NO: 48426 - DNA, 25 bp, Homo sapien
ccattcccggaggagagaaaccatt

SEQ ID NO: 48427 - DNA, 25 bp, Homo sapien
ccattccgcgtcagttggtgaatta

SEQ ID NO: 48428 - DNA, 25 bp, Homo sapien
ccattccgtgtcagttggtgaatta

SEQ ID NO: 48429 - DNA, 25 bp, Homo sapien
ccattcctcatgttcagttgatagc

SEQ ID NO: 48430 - DNA, 25 bp, Homo sapien
ccattcctcatgttcatttgatagc

SEQ ID NO: 48431 - DNA, 25 bp, Homo sapien
ccattcctgcacaaccatctggcaa

SEQ ID NO: 48432 - DNA, 25 bp, Homo sapien
ccattcctgcacatccatctggcaa

SEQ ID NO: 48433 - DNA, 25 bp, Homo sapien
ccattcgtcagacagtgtcaatagg

SEQ ID NO: 48434 - DNA, 25 bp, Homo sapien
ccattcgtcggacagtgtcaatagg

SEQ ID NO: 48435 - DNA, 25 bp, Homo sapien
ccattctacgggacatcaagcaagc

SEQ ID NO: 48436 - DNA, 25 bp, Homo sapien
ccattctatgggacatcaagcaagc

SEQ ID NO: 48437 - DNA, 25 bp, Homo sapien
ccattctcaggctgttatgaagaaa

SEQ ID NO: 48438 - DNA, 25 bp, Homo sapien
ccattctcatgctgttatgaagaaa

SEQ ID NO: 48439 - DNA, 25 bp, Homo sapien
ccattctccacatggtagtggctca

SEQ ID NO: 48440 - DNA, 25 bp, Homo sapien
ccattctccacgtggtagtggctca

SEQ ID NO: 48441 - DNA, 25 bp, Homo sapien
ccattctgcggataggccacatttt

SEQ ID NO: 48442 - DNA, 25 bp, Homo sapien
ccattctgggctgattattctcaaa

SEQ ID NO: 48443 - DNA, 25 bp, Homo sapien
ccattctgggctgattgttctcaaa

SEQ ID NO: 48444 - DNA, 25 bp, Homo sapien
ccattctgtacctgcacgtgacttt

SEQ ID NO: 48445 - DNA, 25 bp, Homo sapien
ccattctgtacctgcatgtgacttt

SEQ ID NO: 48446 - DNA, 25 bp, Homo sapien
ccattctgtggataggccacatttt

SEQ ID NO: 48447 - DNA, 25 bp, Homo sapien
ccattctgttcctcagccttctgga

SEQ ID NO: 48448 - DNA, 25 bp, Homo sapien
ccattctgttcctcaggcttctgga

SEQ ID NO: 48449 - DNA, 25 bp, Homo sapien
ccattcttcctctagtgcgcagcac

SEQ ID NO: 48450 - DNA, 25 bp, Homo sapien
ccattcttcctgtagtgcgcagcac

SEQ ID NO: 48451 - DNA, 25 bp, Homo sapien
ccattcttgagctaagtaagaagta

SEQ ID NO: 48452 - DNA, 25 bp, Homo sapien
ccattcttgaggtaagtaagaagta

SEQ ID NO: 48453 - DNA, 25 bp, Homo sapien
ccattcttgcagctgttcaggcaga

SEQ ID NO: 48454 - DNA, 25 bp, Homo sapien
ccattcttgcagttgttcaggcaga

SEQ ID NO: 48455 - DNA, 25 bp, Homo sapien
ccattctttacaggaacagtatttc

SEQ ID NO: 48456 - DNA, 25 bp, Homo sapien
ccattctttgcaggaacagtatttc

SEQ ID NO: 48457 - DNA, 25 bp, Homo sapien
ccattcttttgatggcactgattgg

SEQ ID NO: 48458 - DNA, 25 bp, Homo sapien
ccattcttttgattgcactgattgg

SEQ ID NO: 48459 - DNA, 25 bp, Homo sapien
ccattgaacagcaactctccatctc

SEQ ID NO: 48460 - DNA, 25 bp, Homo sapien
ccattgaacagtaactctccatctc

SEQ ID NO: 48461 - DNA, 25 bp, Homo sapien
ccattgaatcttgcgctacatagat

SEQ ID NO: 48462 - DNA, 25 bp, Homo sapien
ccattgaatcttgtgctacatagat

SEQ ID NO: 48463 - DNA, 25 bp, Homo sapien
ccattgacagcagtgattgaaagct

SEQ ID NO: 48464 - DNA, 25 bp, Homo sapien
ccattgacagcggtgattgaaagct

SEQ ID NO: 48465 - DNA, 25 bp, Homo sapien
ccattgaccatattggacatgaaca

SEQ ID NO: 48466 - DNA, 25 bp, Homo sapien
ccattgaccgatggcccagaacaat

SEQ ID NO: 48467 - DNA, 25 bp, Homo sapien
ccattgaccgtattggacatgaaca

SEQ ID NO: 48468 - DNA, 25 bp, Homo sapien
ccattgactgatggcccagaacaat

SEQ ID NO: 48469 - DNA, 25 bp, Homo sapien
ccattgagatacgtattacatgttg

SEQ ID NO: 48470 - DNA, 25 bp, Homo sapien
ccattgagatatgtattacatgttg

SEQ ID NO: 48471 - DNA, 25 bp, Homo sapien
ccattgatagatcgaagcctatagt

SEQ ID NO: 48472 - DNA, 25 bp, Homo sapien
ccattgatagattgaagcctatagt

SEQ ID NO: 48473 - DNA, 25 bp, Homo sapien
ccattgcaaataccaacaccagcga

SEQ ID NO: 48474 - DNA, 25 bp, Homo sapien
ccattgcaaatatcaacaccagcga

SEQ ID NO: 48475 - DNA, 25 bp, Homo sapien
ccattgcagttccactttgccccac

SEQ ID NO: 48476 - DNA, 25 bp, Homo sapien
ccattgcagttccccgtaaataggg

SEQ ID NO: 48477 - DNA, 25 bp, Homo sapien
ccattgcagttccctgtaaataggg

SEQ ID NO: 48478 - DNA, 25 bp, Homo sapien
ccattgcagttccgctttgccccac

SEQ ID NO: 48479 - DNA, 25 bp, Homo sapien
ccattgccctgaaaagaaggaccca

SEQ ID NO: 48480 - DNA, 25 bp, Homo sapien
ccattgccctgaagagaaggaccca

SEQ ID NO: 48481 - DNA, 25 bp, Homo sapien
ccattgccttggcgtgagactgatg

SEQ ID NO: 48482 - DNA, 25 bp, Homo sapien
ccattgccttggtgtgagactgatg

SEQ ID NO: 48483 - DNA, 25 bp, Homo sapien
ccattggaaaaacagaaattaaaac

SEQ ID NO: 48484 - DNA, 25 bp, Homo sapien
ccattggaaaaatagaaattaaaac

SEQ ID NO: 48485 - DNA, 25 bp, Homo sapien
ccattggaaagacatcagaaatacc

SEQ ID NO: 48486 - DNA, 25 bp, Homo sapien
ccattggaaagacatcggaaatacc

SEQ ID NO: 48487 - DNA, 25 bp, Homo sapien
ccattggacactaccaatttcatgt

SEQ ID NO: 48488 - DNA, 25 bp, Homo sapien
ccattggacactactaatttcatgt

SEQ ID NO: 48489 - DNA, 25 bp, Homo sapien
ccattgtaaagaagtagaatttaag

SEQ ID NO: 48490 - DNA, 25 bp, Homo sapien
ccattgtaaagaggtagaatttaag

SEQ ID NO: 48491 - DNA, 25 bp, Homo sapien
ccattgtatgaacgctattgtgccc

SEQ ID NO: 48492 - DNA, 25 bp, Homo sapien
ccattgtatgaatgctattgtgccc

SEQ ID NO: 48493 - DNA, 25 bp, Homo sapien
ccattgtatgggcagcctataaaag

SEQ ID NO: 48494 - DNA, 25 bp, Homo sapien
ccattgtatgggcagcgtataaaag

SEQ ID NO: 48495 - DNA, 25 bp, Homo sapien
ccattgtattgattaactagtatgg

SEQ ID NO: 48496 - DNA, 25 bp, Homo sapien
ccattgtattgattgactagtatgg

SEQ ID NO: 48497 - DNA, 25 bp, Homo sapien
ccattgtcaatagcaaatgtttcaa

SEQ ID NO: 48498 - DNA, 25 bp, Homo sapien
ccattgtcaatagcaagtgtttcaa

SEQ ID NO: 48499 - DNA, 25 bp, Homo sapien
ccattgtctctactgctcacacaac

SEQ ID NO: 48500 - DNA, 25 bp, Homo sapien
ccattgtctctagtgctcacacaac

SEQ ID NO: 48501 - DNA, 25 bp, Homo sapien
ccattgtttagcgacttctccaaac

SEQ ID NO: 48502 - DNA, 25 bp, Homo sapien
ccattgtttagtgacttctccaaac

SEQ ID NO: 48503 - DNA, 25 bp, Homo sapien
ccatttaacatcccttgctttcagt

SEQ ID NO: 48504 - DNA, 25 bp, Homo sapien
ccatttaacatccctttctttcagt

SEQ ID NO: 48505 - DNA, 25 bp, Homo sapien
ccatttaaccatgtcccagaacaaa

SEQ ID NO: 48506 - DNA, 25 bp, Homo sapien
ccatttaacgatgtcccagaacaaa

SEQ ID NO: 48507 - DNA, 25 bp, Homo sapien
ccatttaagtactgggatagactga

SEQ ID NO: 48508 - DNA, 25 bp, Homo sapien
ccatttaagtactggggtagactga

SEQ ID NO: 48509 - DNA, 25 bp, Homo sapien
ccatttaagtgcgataatttgtcag

SEQ ID NO: 48510 - DNA, 25 bp, Homo sapien
ccatttaagtgtgataatttgtcag

SEQ ID NO: 48511 - DNA, 25 bp, Homo sapien
ccatttaatatacaactcccataac

SEQ ID NO: 48512 - DNA, 25 bp, Homo sapien
ccatttaatgtacaactcccataac

SEQ ID NO: 48513 - DNA, 25 bp, Homo sapien
ccatttacatcattttcttcctagt

SEQ ID NO: 48514 - DNA, 25 bp, Homo sapien
ccatttacatcatttttttcctagt

SEQ ID NO: 48515 - DNA, 25 bp, Homo sapien
ccatttaccaaggccgtgaaagtat

SEQ ID NO: 48516 - DNA, 25 bp, Homo sapien
ccatttaccaaggctgtgaaagtat

SEQ ID NO: 48517 - DNA, 25 bp, Homo sapien
ccatttagtctacataatacatccc

SEQ ID NO: 48518 - DNA, 25 bp, Homo sapien
ccatttagtctacgtaatacatccc

SEQ ID NO: 48519 - DNA, 25 bp, Homo sapien
ccatttatatgaaattcaataagag

SEQ ID NO: 48520 - DNA, 25 bp, Homo sapien
ccatttatgtgaaattcaataagag

SEQ ID NO: 48521 - DNA, 25 bp, Homo sapien
ccatttatgttccgacccaaaggac

SEQ ID NO: 48522 - DNA, 25 bp, Homo sapien
ccatttatgttctgacccaaaggac

SEQ ID NO: 48523 - DNA, 25 bp, Homo sapien
ccatttccaagtctgggttaatcat

SEQ ID NO: 48524 - DNA, 25 bp, Homo sapien
ccatttccaagtttgggttaatcat

SEQ ID NO: 48525 - DNA, 25 bp, Homo sapien
ccatttccatttgctctgccattca

SEQ ID NO: 48526 - DNA, 25 bp, Homo sapien
ccatttccatttgttctgccattca

SEQ ID NO: 48527 - DNA, 25 bp, Homo sapien
ccatttctaccatcatagcccaagc

SEQ ID NO: 48528 - DNA, 25 bp, Homo sapien
ccatttctaccatcgtagcccaagc

SEQ ID NO: 48529 - DNA, 25 bp, Homo sapien
ccatttctgctgtatatccattggc

SEQ ID NO: 48530 - DNA, 25 bp, Homo sapien
ccatttctgtatatgttcatgttca

SEQ ID NO: 48531 - DNA, 25 bp, Homo sapien
ccatttcttaggtgttcaggcaagg

SEQ ID NO: 48532 - DNA, 25 bp, Homo sapien
ccatttcttaggtgttgaggcaagg

SEQ ID NO: 48533 - DNA, 25 bp, Homo sapien
ccatttcttcaccatggggtaacat

SEQ ID NO: 48534 - DNA, 25 bp, Homo sapien
ccatttcttcactatggggtaacat

SEQ ID NO: 48535 - DNA, 25 bp, Homo sapien
ccatttcttctgtatatccattggc

SEQ ID NO: 48536 - DNA, 25 bp, Homo sapien
ccatttctttatatgttcatgttca

SEQ ID NO: 48537 - DNA, 25 bp, Homo sapien
ccatttgaaaaaaacaatcattctc

SEQ ID NO: 48538 - DNA, 25 bp, Homo sapien
ccatttgaagaaaacaatcattctc

SEQ ID NO: 48539 - DNA, 25 bp, Homo sapien
ccatttgcctacttgacccacattt

SEQ ID NO: 48540 - DNA, 25 bp, Homo sapien
ccatttgcctacttgatccacattt

SEQ ID NO: 48541 - DNA, 25 bp, Homo sapien
ccatttggaaattatgttttactca

SEQ ID NO: 48542 - DNA, 25 bp, Homo sapien
ccatttggaaattgtgttttactca

SEQ ID NO: 48543 - DNA, 25 bp, Homo sapien
ccatttggtcaactcctcatttatt

SEQ ID NO: 48544 - DNA, 25 bp, Homo sapien
ccatttggttaactcctcatttatt

SEQ ID NO: 48545 - DNA, 25 bp, Homo sapien
ccatttgtattattgtctcagacct

SEQ ID NO: 48546 - DNA, 25 bp, Homo sapien
ccatttgtattcttgtctcagacct

SEQ ID NO: 48547 - DNA, 25 bp, Homo sapien
ccatttgttgagcattggcaataag

SEQ ID NO: 48548 - DNA, 25 bp, Homo sapien
ccatttgttgagcgttggcaataag

SEQ ID NO: 48549 - DNA, 25 bp, Homo sapien
ccatttgtttcaatccagcaatccc

SEQ ID NO: 48550 - DNA, 25 bp, Homo sapien
ccatttgtttcaatccggcaatccc

SEQ ID NO: 48551 - DNA, 25 bp, Homo sapien
ccattttaaaaccataagagggctc

SEQ ID NO: 48552 - DNA, 25 bp, Homo sapien
ccattttacaaccataagagggctc

SEQ ID NO: 48553 - DNA, 25 bp, Homo sapien
ccattttactgctacgtctctcagg

SEQ ID NO: 48554 - DNA, 25 bp, Homo sapien
ccattttactgctatgtctctcagg

SEQ ID NO: 48555 - DNA, 25 bp, Homo sapien
ccattttcaaaacacaaaagtataa

SEQ ID NO: 48556 - DNA, 25 bp, Homo sapien
ccattttcaaaacataaaagtataa

SEQ ID NO: 48557 - DNA, 25 bp, Homo sapien
ccattttcaaaggagcagcaccatc

SEQ ID NO: 48558 - DNA, 25 bp, Homo sapien
ccattttcaaaggagcggcaccatc

SEQ ID NO: 48559 - DNA, 25 bp, Homo sapien
ccattttcacataaagcatgcactt

SEQ ID NO: 48560 - DNA, 25 bp, Homo sapien
ccattttcagacatttagagctatg

SEQ ID NO: 48561 - DNA, 25 bp, Homo sapien
ccattttcagacgtttagagctatg

SEQ ID NO: 48562 - DNA, 25 bp, Homo sapien
ccattttcatataaagcatgcactt

SEQ ID NO: 48563 - DNA, 25 bp, Homo sapien
ccatttttaatgttcgagtgtttct

SEQ ID NO: 48564 - DNA, 25 bp, Homo sapien
ccatttttaatgtttgagtgtttct

SEQ ID NO: 48565 - DNA, 25 bp, Homo sapien
ccatttttcaagttaggttgtaaaa

SEQ ID NO: 48566 - DNA, 25 bp, Homo sapien
ccatttttccagttaggttgtaaaa

SEQ ID NO: 48567 - DNA, 25 bp, Homo sapien
ccatttttgagtgtgacttcatttc

SEQ ID NO: 48568 - DNA, 25 bp, Homo sapien
ccattttttagtgtgacttcatttc

SEQ ID NO: 48569 - DNA, 25 bp, Homo sapien
cccaaaaatgcatacaacatgaaca

SEQ ID NO: 48570 - DNA, 25 bp, Homo sapien
cccaaaaattcatacaacatgaaca

SEQ ID NO: 48571 - DNA, 25 bp, Homo sapien
cccaaaactctctgattcagtaggc

SEQ ID NO: 48572 - DNA, 25 bp, Homo sapien
cccaaaactgtctgattcagtaggc

SEQ ID NO: 48573 - DNA, 25 bp, Homo sapien
cccaaaagagtgatggcgtctccat

SEQ ID NO: 48574 - DNA, 25 bp, Homo sapien
cccaaaagattgatggcgtctccat

SEQ ID NO: 48575 - DNA, 25 bp, Homo sapien
cccaaaagcctgcttgatactctac

SEQ ID NO: 48576 - DNA, 25 bp, Homo sapien
cccaaaagcctgcttggtactctac

SEQ ID NO: 48577 - DNA, 25 bp, Homo sapien
cccaaaatattttacgtcctttgca

SEQ ID NO: 48578 - DNA, 25 bp, Homo sapien
cccaaaatattttatgtcctttgca

SEQ ID NO: 48579 - DNA, 25 bp, Homo sapien
cccaaaatgatcagataatatttct

SEQ ID NO: 48580 - DNA, 25 bp, Homo sapien
cccaaaatgatccgataatatttct

SEQ ID NO: 48581 - DNA, 25 bp, Homo sapien
cccaaaatgcagtcagtaggagata

SEQ ID NO: 48582 - DNA, 25 bp, Homo sapien
cccaaaatggagtcagtaggagata

SEQ ID NO: 48583 - DNA, 25 bp, Homo sapien
cccaaaccaccagagtgccacagcg

SEQ ID NO: 48584 - DNA, 25 bp, Homo sapien
cccaaaccagcagagtgccacagcg

SEQ ID NO: 48585 - DNA, 25 bp, Homo sapien
cccaaaccctaccatggtcatctct

SEQ ID NO: 48586 - DNA, 25 bp, Homo sapien
cccaaaccctaccgtggtcatctct

SEQ ID NO: 48587 - DNA, 25 bp, Homo sapien
cccaaactcaagaatgagaatgaac

SEQ ID NO: 48588 - DNA, 25 bp, Homo sapien
cccaaactgaagaatgagaatgaac

SEQ ID NO: 48589 - DNA, 25 bp, Homo sapien
cccaaagtgccctcaacttgaggca

SEQ ID NO: 48590 - DNA, 25 bp, Homo sapien
cccaaagtgccctcaatttgaggca

SEQ ID NO: 48591 - DNA, 25 bp, Homo sapien
cccaaatacgcagtttcctgtagat

SEQ ID NO: 48592 - DNA, 25 bp, Homo sapien
cccaaataggcgttctccctccttc

SEQ ID NO: 48593 - DNA, 25 bp, Homo sapien
cccaaataggctttctccctccttc

SEQ ID NO: 48594 - DNA, 25 bp, Homo sapien
cccaaatatcagtggcttcatatac

SEQ ID NO: 48595 - DNA, 25 bp, Homo sapien
cccaaatatcagtgtcttcatatac

SEQ ID NO: 48596 - DNA, 25 bp, Homo sapien
cccaaatatgcagtttcctgtagat

SEQ ID NO: 48597 - DNA, 25 bp, Homo sapien
cccaaatcaatttgcttctctgtgt

SEQ ID NO: 48598 - DNA, 25 bp, Homo sapien
cccaaatcaattttcttctctgtgt

SEQ ID NO: 48599 - DNA, 25 bp, Homo sapien
cccaaatccaggtcctggctcctgg

SEQ ID NO: 48600 - DNA, 25 bp, Homo sapien
cccaaatccaggttctggctcctgg

SEQ ID NO: 48601 - DNA, 25 bp, Homo sapien
cccaaatctaacacgataggcttgt

SEQ ID NO: 48602 - DNA, 25 bp, Homo sapien
cccaaatctaacatgataggcttgt

SEQ ID NO: 48603 - DNA, 25 bp, Homo sapien
cccaaatctgctataaagcaaagcc

SEQ ID NO: 48604 - DNA, 25 bp, Homo sapien
cccaaatctgctgtaaagcaaagcc

SEQ ID NO: 48605 - DNA, 25 bp, Homo sapien
cccaaatctttctgcctaacctgta

SEQ ID NO: 48606 - DNA, 25 bp, Homo sapien
cccaaatctttctgtctaacctgta

SEQ ID NO: 48607 - DNA, 25 bp, Homo sapien
cccaaatgccagatgatgaatccat

SEQ ID NO: 48608 - DNA, 25 bp, Homo sapien
cccaaatgccaggtgatgaatccat

SEQ ID NO: 48609 - DNA, 25 bp, Homo sapien
cccaaatggttgaacttctttttcc

SEQ ID NO: 48610 - DNA, 25 bp, Homo sapien
cccaaatggttgaatttctttttcc

SEQ ID NO: 48611 - DNA, 25 bp, Homo sapien
cccaaattgctgacccataaaatca

SEQ ID NO: 48612 - DNA, 25 bp, Homo sapien
cccaaattgttgacccataaaatca

SEQ ID NO: 48613 - DNA, 25 bp, Homo sapien
cccaacaagataagagagaaaaagt

SEQ ID NO: 48614 - DNA, 25 bp, Homo sapien
cccaacaaggtaagagagaaaaagt

SEQ ID NO: 48615 - DNA, 25 bp, Homo sapien
cccaacacacacaaaacatgaattt

SEQ ID NO: 48616 - DNA, 25 bp, Homo sapien
cccaacacacacgaaacatgaattt

SEQ ID NO: 48617 - DNA, 25 bp, Homo sapien
cccaacactgtgcccatttcatatt

SEQ ID NO: 48618 - DNA, 25 bp, Homo sapien
cccaacactgtgcctatttcatatt

SEQ ID NO: 48619 - DNA, 25 bp, Homo sapien
cccaacagatgcgtccatcccagct

SEQ ID NO: 48620 - DNA, 25 bp, Homo sapien
cccaacagatgcttccatcccagct

SEQ ID NO: 48621 - DNA, 25 bp, Homo sapien
cccaacagtaagagcagtgttgttc

SEQ ID NO: 48622 - DNA, 25 bp, Homo sapien
cccaacagtgagagcagtgttgttc

SEQ ID NO: 48623 - DNA, 25 bp, Homo sapien
cccaaccttcgttctggtcacaccc

SEQ ID NO: 48624 - DNA, 25 bp, Homo sapien
cccaacctttgttctggtcacaccc

SEQ ID NO: 48625 - DNA, 25 bp, Homo sapien
cccaactgcacctatgccctgctag

SEQ ID NO: 48626 - DNA, 25 bp, Homo sapien
cccaactgcacttatgccctgctag

SEQ ID NO: 48627 - DNA, 25 bp, Homo sapien
cccaagaactgcaaaaaacagtcaa

SEQ ID NO: 48628 - DNA, 25 bp, Homo sapien
cccaagaactgcaagaaacagtcaa

SEQ ID NO: 48629 - DNA, 25 bp, Homo sapien
cccaagaagccaagaaatgttactc

SEQ ID NO: 48630 - DNA, 25 bp, Homo sapien
cccaagaagccgagaaatgttactc

SEQ ID NO: 48631 - DNA, 25 bp, Homo sapien
cccaagacatctcagtatgtatatg

SEQ ID NO: 48632 - DNA, 25 bp, Homo sapien
cccaagacatctgagtatgtatatg

SEQ ID NO: 48633 - DNA, 25 bp, Homo sapien
cccaagataagaccagccctacttt

SEQ ID NO: 48634 - DNA, 25 bp, Homo sapien
cccaagataagacgagccctacttt

SEQ ID NO: 48635 - DNA, 25 bp, Homo sapien
cccaagatacttcattcgaccattt

SEQ ID NO: 48636 - DNA, 25 bp, Homo sapien
cccaagatacttcatttgaccattt

SEQ ID NO: 48637 - DNA, 25 bp, Homo sapien
cccaagctaacatgtcagcctacta

SEQ ID NO: 48638 - DNA, 25 bp, Homo sapien
cccaagctaacgtgtcagcctacta

SEQ ID NO: 48639 - DNA, 25 bp, Homo sapien
cccaaggaccaatcagtgtgcactt

SEQ ID NO: 48640 - DNA, 25 bp, Homo sapien
cccaaggaccagtcagtgtgcactt

SEQ ID NO: 48641 - DNA, 25 bp, Homo sapien
cccaaggcaagaactgatatgattt

SEQ ID NO: 48642 - DNA, 25 bp, Homo sapien
cccaaggcaagatctgatatgattt

SEQ ID NO: 48643 - DNA, 25 bp, Homo sapien
cccaagggacataaactgaggacca

SEQ ID NO: 48644 - DNA, 25 bp, Homo sapien
cccaagggagataaactgaggacca

SEQ ID NO: 48645 - DNA, 25 bp, Homo sapien
cccaagtatgggaacaatagacact

SEQ ID NO: 48646 - DNA, 25 bp, Homo sapien
cccaagtatggggacaatagacact

SEQ ID NO: 48647 - DNA, 25 bp, Homo sapien
cccaagtcaagcacttccccttggt

SEQ ID NO: 48648 - DNA, 25 bp, Homo sapien
cccaagtcaagcactttcccttggt

SEQ ID NO: 48649 - DNA, 25 bp, Homo sapien
cccaagtccaaatcagtttcttagg

SEQ ID NO: 48650 - DNA, 25 bp, Homo sapien
cccaagtccgaatcagtttcttagg

SEQ ID NO: 48651 - DNA, 25 bp, Homo sapien
cccaagtcctctgactcgtccttct

SEQ ID NO: 48652 - DNA, 25 bp, Homo sapien
cccaagtcttctgactcgtccttct

SEQ ID NO: 48653 - DNA, 25 bp, Homo sapien
cccaagtgaccaatttgcacagtaa

SEQ ID NO: 48654 - DNA, 25 bp, Homo sapien
cccaagtgaccgatttgcacagtaa

SEQ ID NO: 48655 - DNA, 25 bp, Homo sapien
cccaagtgagaatctttaatcacat

SEQ ID NO: 48656 - DNA, 25 bp, Homo sapien
cccaagtgagaatttttaatcacat

SEQ ID NO: 48657 - DNA, 25 bp, Homo sapien
cccaagtgctcactagtccagagac

SEQ ID NO: 48658 - DNA, 25 bp, Homo sapien
cccaagtgctcgctagtccagagac

SEQ ID NO: 48659 - DNA, 25 bp, Homo sapien
cccaagttaaggcaaatttcaaaaa

SEQ ID NO: 48660 - DNA, 25 bp, Homo sapien
cccaagttaagtcaaatttcaaaaa

SEQ ID NO: 48661 - DNA, 25 bp, Homo sapien
cccaagttcataggtagtaacaaag

SEQ ID NO: 48662 - DNA, 25 bp, Homo sapien
cccaagttcatagttagtaacaaag

SEQ ID NO: 48663 - DNA, 25 bp, Homo sapien
cccaagttgctgtaggtatccatag

SEQ ID NO: 48664 - DNA, 25 bp, Homo sapien
cccaagttgttgtaggtatccatag

SEQ ID NO: 48665 - DNA, 25 bp, Homo sapien
cccaataacggtgtgcccttcatga

SEQ ID NO: 48666 - DNA, 25 bp, Homo sapien
cccaataatattctgcctattgctc

SEQ ID NO: 48667 - DNA, 25 bp, Homo sapien
cccaataatattctgcgtattgctc

SEQ ID NO: 48668 - DNA, 25 bp, Homo sapien
cccaataatggtgtgcccttcatga

SEQ ID NO: 48669 - DNA, 25 bp, Homo sapien
cccaatagagttgacaggataatta

SEQ ID NO: 48670 - DNA, 25 bp, Homo sapien
cccaatagagttgataggataatta

SEQ ID NO: 48671 - DNA, 25 bp, Homo sapien
cccaatatccttaatttcaacacat

SEQ ID NO: 48672 - DNA, 25 bp, Homo sapien
cccaatatcgttaatttcaacacat

SEQ ID NO: 48673 - DNA, 25 bp, Homo sapien
cccaatcaatgagtggtgggtctca

SEQ ID NO: 48674 - DNA, 25 bp, Homo sapien
cccaatcagtgagtggtgggtctca

SEQ ID NO: 48675 - DNA, 25 bp, Homo sapien
cccaatctcattatctttccatttt

SEQ ID NO: 48676 - DNA, 25 bp, Homo sapien
cccaatctcgttatctttccatttt

SEQ ID NO: 48677 - DNA, 25 bp, Homo sapien
cccaatggaaggcggacagcggcca

SEQ ID NO: 48678 - DNA, 25 bp, Homo sapien
cccaatggaaggtggacagcggcca

SEQ ID NO: 48679 - DNA, 25 bp, Homo sapien
cccaattctaccacgtcaatattat

SEQ ID NO: 48680 - DNA, 25 bp, Homo sapien
cccaattctaccatgtcaatattat

SEQ ID NO: 48681 - DNA, 25 bp, Homo sapien
cccaattctatacccacttctttac

SEQ ID NO: 48682 - DNA, 25 bp, Homo sapien
cccaattctatacccagttctttac

SEQ ID NO: 48683 - DNA, 25 bp, Homo sapien
cccacaaaggaggcctttccttggt

SEQ ID NO: 48684 - DNA, 25 bp, Homo sapien
cccacaaaggaggcttttccttggt

SEQ ID NO: 48685 - DNA, 25 bp, Homo sapien
cccacaaggagacagagatgattgg

SEQ ID NO: 48686 - DNA, 25 bp, Homo sapien
cccacaaggagacggagatgattgg

SEQ ID NO: 48687 - DNA, 25 bp, Homo sapien
cccacaatcgattccttctccaatt

SEQ ID NO: 48688 - DNA, 25 bp, Homo sapien
cccacaattgattccttctccaatt

SEQ ID NO: 48689 - DNA, 25 bp, Homo sapien
cccacaattttcaatatggtaatta

SEQ ID NO: 48690 - DNA, 25 bp, Homo sapien
cccacaattttcagtatggtaatta

SEQ ID NO: 48691 - DNA, 25 bp, Homo sapien
cccacactgaacagttcattcttac

SEQ ID NO: 48692 - DNA, 25 bp, Homo sapien
cccacactgaagagttcattcttac

SEQ ID NO: 48693 - DNA, 25 bp, Homo sapien
cccacagaaaatggacatttgttag

SEQ ID NO: 48694 - DNA, 25 bp, Homo sapien
cccacagaaaattgacatttgttag

SEQ ID NO: 48695 - DNA, 25 bp, Homo sapien
cccacagaagcgggtagatctgctg

SEQ ID NO: 48696 - DNA, 25 bp, Homo sapien
cccacagaagcgtgtagatctgctg

SEQ ID NO: 48697 - DNA, 25 bp, Homo sapien
cccacagagcacaaaaacaatcatc

SEQ ID NO: 48698 - DNA, 25 bp, Homo sapien
cccacagagcacaaaagcaatcatc

SEQ ID NO: 48699 - DNA, 25 bp, Homo sapien
cccacagcacagggtcttgtattca

SEQ ID NO: 48700 - DNA, 25 bp, Homo sapien
cccacagcacagtgtcttgtattca

SEQ ID NO: 48701 - DNA, 25 bp, Homo sapien
cccacaggactaaacttgccatggg

SEQ ID NO: 48702 - DNA, 25 bp, Homo sapien
cccacaggatccatcatccacagga

SEQ ID NO: 48703 - DNA, 25 bp, Homo sapien
cccacaggcctaaacttgccatggg

SEQ ID NO: 48704 - DNA, 25 bp, Homo sapien
cccacagggctaggatgattaagat

SEQ ID NO: 48705 - DNA, 25 bp, Homo sapien
cccacagggtccatcatccacagga

SEQ ID NO: 48706 - DNA, 25 bp, Homo sapien
cccacagggttaggatgattaagat

SEQ ID NO: 48707 - DNA, 25 bp, Homo sapien
cccacatgtcttcgctgtgcagata

SEQ ID NO: 48708 - DNA, 25 bp, Homo sapien
cccacatgtcttcgttgtgcagata

SEQ ID NO: 48709 - DNA, 25 bp, Homo sapien
cccacattgcagtaacttaacacaa

SEQ ID NO: 48710 - DNA, 25 bp, Homo sapien
cccacattgcagtgacttaacacaa

SEQ ID NO: 48711 - DNA, 25 bp, Homo sapien
cccacattgtacgacaatcaatcct

SEQ ID NO: 48712 - DNA, 25 bp, Homo sapien
cccacattgtatgacaatcaatcct

SEQ ID NO: 48713 - DNA, 25 bp, Homo sapien
cccacattttcatactctcagaaga

SEQ ID NO: 48714 - DNA, 25 bp, Homo sapien
cccacattttcatattctcagaaga

SEQ ID NO: 48715 - DNA, 25 bp, Homo sapien
cccaccaaaggcgacataaggcact

SEQ ID NO: 48716 - DNA, 25 bp, Homo sapien
cccaccaaaggcggcataaggcact

SEQ ID NO: 48717 - DNA, 25 bp, Homo sapien
cccaccagcgtgtttttctctgagg

SEQ ID NO: 48718 - DNA, 25 bp, Homo sapien
cccaccagtgtgtttttctctgagg

SEQ ID NO: 48719 - DNA, 25 bp, Homo sapien
cccaccatatgcaccaatactttta

SEQ ID NO: 48720 - DNA, 25 bp, Homo sapien
cccaccatatgcaccagtactttta

SEQ ID NO: 48721 - DNA, 25 bp, Homo sapien
cccacccaaccttcgttctggtcac

SEQ ID NO: 48722 - DNA, 25 bp, Homo sapien
cccacccaacctttgttctggtcac

SEQ ID NO: 48723 - DNA, 25 bp, Homo sapien
cccaccctatcctagtatgacttca

SEQ ID NO: 48724 - DNA, 25 bp, Homo sapien
cccaccctatcttagtatgacttca

SEQ ID NO: 48725 - DNA, 25 bp, Homo sapien
cccaccgggaggaatgaacaactgg

SEQ ID NO: 48726 - DNA, 25 bp, Homo sapien
cccaccgggaggaatgtacaactgg

SEQ ID NO: 48727 - DNA, 25 bp, Homo sapien
cccacctcaccatgttagagaaaag

SEQ ID NO: 48728 - DNA, 25 bp, Homo sapien
cccacctcaccgtgttagagaaaag

SEQ ID NO: 48729 - DNA, 25 bp, Homo sapien
cccacctgtgatgatggccctgagt

SEQ ID NO: 48730 - DNA, 25 bp, Homo sapien
cccacctgtgatgatgtccctgagt

SEQ ID NO: 48731 - DNA, 25 bp, Homo sapien
cccaccttaaaacggacacatccta

SEQ ID NO: 48732 - DNA, 25 bp, Homo sapien
cccaccttaaaatggacacatccta

SEQ ID NO: 48733 - DNA, 25 bp, Homo sapien
cccaccttgcccagctgctgtttga

SEQ ID NO: 48734 - DNA, 25 bp, Homo sapien
cccaccttgcccggctgctgtttga

SEQ ID NO: 48735 - DNA, 25 bp, Homo sapien
cccacgatcagcttcaagaaccttc

SEQ ID NO: 48736 - DNA, 25 bp, Homo sapien
cccacgatcagtttcaagaaccttc

SEQ ID NO: 48737 - DNA, 25 bp, Homo sapien
cccacggtttttcaagagaagatac

SEQ ID NO: 48738 - DNA, 25 bp, Homo sapien
cccacggtttttcaggagaagatac

SEQ ID NO: 48739 - DNA, 25 bp, Homo sapien
cccacgtgttcttcagtcagctttt

SEQ ID NO: 48740 - DNA, 25 bp, Homo sapien
cccacgtgttctttagtcagctttt

SEQ ID NO: 48741 - DNA, 25 bp, Homo sapien
cccactcttctgtcccatttctacg

SEQ ID NO: 48742 - DNA, 25 bp, Homo sapien
cccactcttctgtcccgtttctacg

SEQ ID NO: 48743 - DNA, 25 bp, Homo sapien
cccactgcataatccaatcacaaaa

SEQ ID NO: 48744 - DNA, 25 bp, Homo sapien
cccactgcataatccagtcacaaaa

SEQ ID NO: 48745 - DNA, 25 bp, Homo sapien
cccactgcattgtcaaacctgaatt

SEQ ID NO: 48746 - DNA, 25 bp, Homo sapien
cccactgcattgtcgaacctgaatt

SEQ ID NO: 48747 - DNA, 25 bp, Homo sapien
cccagaaaagcatcagatctgggaa

SEQ ID NO: 48748 - DNA, 25 bp, Homo sapien
cccagaaaagcattagatctgggaa

SEQ ID NO: 48749 - DNA, 25 bp, Homo sapien
cccagaaacaggtggcatctttggt

SEQ ID NO: 48750 - DNA, 25 bp, Homo sapien
cccagaaacagttggcatctttggt

SEQ ID NO: 48751 - DNA, 25 bp, Homo sapien
cccagaaatccaacaaagaatggaa

SEQ ID NO: 48752 - DNA, 25 bp, Homo sapien
cccagaaatccaagaaagaatggaa

SEQ ID NO: 48753 - DNA, 25 bp, Homo sapien
cccagaagaataaaatcagaggact

SEQ ID NO: 48754 - DNA, 25 bp, Homo sapien
cccagaagaataagatcagaggact

SEQ ID NO: 48755 - DNA, 25 bp, Homo sapien
cccagaaggctctaagtggcaaggc

SEQ ID NO: 48756 - DNA, 25 bp, Homo sapien
cccagaaggttctaagtggcaaggc

SEQ ID NO: 48757 - DNA, 25 bp, Homo sapien
cccagaatgtatcattgttgcattt

SEQ ID NO: 48758 - DNA, 25 bp, Homo sapien
cccagaatgtatcatttttgcattt

SEQ ID NO: 48759 - DNA, 25 bp, Homo sapien
cccagaattgaactaatggtggctt

SEQ ID NO: 48760 - DNA, 25 bp, Homo sapien
cccagaattgaactgatggtggctt

SEQ ID NO: 48761 - DNA, 25 bp, Homo sapien
cccagacaaaaacaaacataagcat

SEQ ID NO: 48762 - DNA, 25 bp, Homo sapien
cccagacacaaacaaacataagcat

SEQ ID NO: 48763 - DNA, 25 bp, Homo sapien
cccagacacgatgtggcaagagttg

SEQ ID NO: 48764 - DNA, 25 bp, Homo sapien
cccagacactatgtggcaagagttg

SEQ ID NO: 48765 - DNA, 25 bp, Homo sapien
cccagacatctgagcagcagtcctg

SEQ ID NO: 48766 - DNA, 25 bp, Homo sapien
cccagacatctgggcagcagtcctg

SEQ ID NO: 48767 - DNA, 25 bp, Homo sapien
cccagacatgcaaggagattcaaca

SEQ ID NO: 48768 - DNA, 25 bp, Homo sapien
cccagacattcaaggagattcaaca

SEQ ID NO: 48769 - DNA, 25 bp, Homo sapien
cccagacctcctgccgctggacttt

SEQ ID NO: 48770 - DNA, 25 bp, Homo sapien
cccagacctcctgctgctggacttt

SEQ ID NO: 48771 - DNA, 25 bp, Homo sapien
cccagagaatgctcaaatagatttt

SEQ ID NO: 48772 - DNA, 25 bp, Homo sapien
cccagagaatgctcgaatagatttt

SEQ ID NO: 48773 - DNA, 25 bp, Homo sapien
cccagagagaaataaactagtccat

SEQ ID NO: 48774 - DNA, 25 bp, Homo sapien
cccagagagaaatacactagtccat

SEQ ID NO: 48775 - DNA, 25 bp, Homo sapien
cccagagagggagtcccgggtgcga

SEQ ID NO: 48776 - DNA, 25 bp, Homo sapien
cccagagagggagtccggggtgcga

SEQ ID NO: 48777 - DNA, 25 bp, Homo sapien
cccagagagttacaatggtgaaaaa

SEQ ID NO: 48778 - DNA, 25 bp, Homo sapien
cccagagagttataatggtgaaaaa

SEQ ID NO: 48779 - DNA, 25 bp, Homo sapien
cccagagatgatcattgctaacatt

SEQ ID NO: 48780 - DNA, 25 bp, Homo sapien
cccagagatgattattgctaacatt

SEQ ID NO: 48781 - DNA, 25 bp, Homo sapien
cccagagatgatttgaacagccatg

SEQ ID NO: 48782 - DNA, 25 bp, Homo sapien
cccagagatgatttgagcagccatg

SEQ ID NO: 48783 - DNA, 25 bp, Homo sapien
cccagagccccttacgtggcacagc

SEQ ID NO: 48784 - DNA, 25 bp, Homo sapien
cccagagccccttatgtggcacagc

SEQ ID NO: 48785 - DNA, 25 bp, Homo sapien
cccagagcccgaatttctgaggctt

SEQ ID NO: 48786 - DNA, 25 bp, Homo sapien
cccagagcctgaatttctgaggctt

SEQ ID NO: 48787 - DNA, 25 bp, Homo sapien
cccagagccttccaaggagcgcggc

SEQ ID NO: 48788 - DNA, 25 bp, Homo sapien
cccagagccttccgaggagcgcggc

SEQ ID NO: 48789 - DNA, 25 bp, Homo sapien
cccagagctgtggtgaagttcaaat

SEQ ID NO: 48790 - DNA, 25 bp, Homo sapien
cccagagctgtggtgaggttcaaat

SEQ ID NO: 48791 - DNA, 25 bp, Homo sapien
cccagaggtatgcaggcttcaggca

SEQ ID NO: 48792 - DNA, 25 bp, Homo sapien
cccagaggtatgcaggtttcaggca

SEQ ID NO: 48793 - DNA, 25 bp, Homo sapien
cccagagtgttgcctctcagctcct

SEQ ID NO: 48794 - DNA, 25 bp, Homo sapien
cccagagtgttgcttctcagctcct

SEQ ID NO: 48795 - DNA, 25 bp, Homo sapien
cccagagtttaccttggctttgtgt

SEQ ID NO: 48796 - DNA, 25 bp, Homo sapien
cccagagtttatcttggctttgtgt

SEQ ID NO: 48797 - DNA, 25 bp, Homo sapien
cccagagtttcaaattcagtgtttc

SEQ ID NO: 48798 - DNA, 25 bp, Homo sapien
cccagagtttcagattcagtgtttc

SEQ ID NO: 48799 - DNA, 25 bp, Homo sapien
cccagataaaattgccatggttatc

SEQ ID NO: 48800 - DNA, 25 bp, Homo sapien
cccagataaaattgccttggttatc

SEQ ID NO: 48801 - DNA, 25 bp, Homo sapien
cccagatacgtacccaagagaaatg

SEQ ID NO: 48802 - DNA, 25 bp, Homo sapien
cccagatatgtacccaagagaaatg

SEQ ID NO: 48803 - DNA, 25 bp, Homo sapien
cccagatccttcactggcaacccca

SEQ ID NO: 48804 - DNA, 25 bp, Homo sapien
cccagatccttcgctggcaacccca

SEQ ID NO: 48805 - DNA, 25 bp, Homo sapien
cccagatcttcaccggactggcttc

SEQ ID NO: 48806 - DNA, 25 bp, Homo sapien
cccagatcttcacctgactggcttc

SEQ ID NO: 48807 - DNA, 25 bp, Homo sapien
cccagatctttcatatatattgtgt

SEQ ID NO: 48808 - DNA, 25 bp, Homo sapien
cccagatctttcctatatattgtgt

SEQ ID NO: 48809 - DNA, 25 bp, Homo sapien
cccagatgcggagtcacagagtatt

SEQ ID NO: 48810 - DNA, 25 bp, Homo sapien
cccagatgctgaaagaacatttact

SEQ ID NO: 48811 - DNA, 25 bp, Homo sapien
cccagatgctggaagaacatttact

SEQ ID NO: 48812 - DNA, 25 bp, Homo sapien
cccagatgtggagtcacagagtatt

SEQ ID NO: 48813 - DNA, 25 bp, Homo sapien
cccagattatatagggaaacagata

SEQ ID NO: 48814 - DNA, 25 bp, Homo sapien
cccagattatatggggaaacagata

SEQ ID NO: 48815 - DNA, 25 bp, Homo sapien
cccagattcaaacggacctctgcaa

SEQ ID NO: 48816 - DNA, 25 bp, Homo sapien
cccagattcaaacggagctctgcaa

SEQ ID NO: 48817 - DNA, 25 bp, Homo sapien
cccagatttcgtgccaagaatggga

SEQ ID NO: 48818 - DNA, 25 bp, Homo sapien
cccagatttcgtttctggtgctaat

SEQ ID NO: 48819 - DNA, 25 bp, Homo sapien
cccagattttgtgccaagaatggga

SEQ ID NO: 48820 - DNA, 25 bp, Homo sapien
cccagattttgtttctggtgctaat

SEQ ID NO: 48821 - DNA, 25 bp, Homo sapien
cccagcaaaatgactttcaaaagag

SEQ ID NO: 48822 - DNA, 25 bp, Homo sapien
cccagcaaaatgattttcaaaagag

SEQ ID NO: 48823 - DNA, 25 bp, Homo sapien
cccagcaagcagtcttcctgcaatg

SEQ ID NO: 48824 - DNA, 25 bp, Homo sapien
cccagcaagcagtctttctgcaatg

SEQ ID NO: 48825 - DNA, 25 bp, Homo sapien
cccagcacattacaggctccatgga

SEQ ID NO: 48826 - DNA, 25 bp, Homo sapien
cccagcacattacgggctccatgga

SEQ ID NO: 48827 - DNA, 25 bp, Homo sapien
cccagcagcacagggaatgaggaag

SEQ ID NO: 48828 - DNA, 25 bp, Homo sapien
cccagcagcacagtgaatgaggaag

SEQ ID NO: 48829 - DNA, 25 bp, Homo sapien
cccagcagtccaagaacttgcccac

SEQ ID NO: 48830 - DNA, 25 bp, Homo sapien
cccagcagtccgagaacttgcccac

SEQ ID NO: 48831 - DNA, 25 bp, Homo sapien
cccagcatattcctagatatggtag

SEQ ID NO: 48832 - DNA, 25 bp, Homo sapien
cccagcatattcctagctatggtag

SEQ ID NO: 48833 - DNA, 25 bp, Homo sapien
cccagccaaccaggagaagcctcag

SEQ ID NO: 48834 - DNA, 25 bp, Homo sapien
cccagccaaccaggagcagcctcag

SEQ ID NO: 48835 - DNA, 25 bp, Homo sapien
cccagccaatagagatcaatctagc

SEQ ID NO: 48836 - DNA, 25 bp, Homo sapien
cccagccaatagggatcaatctagc

SEQ ID NO: 48837 - DNA, 25 bp, Homo sapien
cccagccatggtggttacggtgaaa

SEQ ID NO: 48838 - DNA, 25 bp, Homo sapien
cccagccatggtggttgcggtgaaa

SEQ ID NO: 48839 - DNA, 25 bp, Homo sapien
cccagcctcctgatctatgagaaat

SEQ ID NO: 48840 - DNA, 25 bp, Homo sapien
cccagcctcctgatttatgagaaat

SEQ ID NO: 48841 - DNA, 25 bp, Homo sapien
cccagctaagactagcagagactct

SEQ ID NO: 48842 - DNA, 25 bp, Homo sapien
cccagctaagattagcagagactct

SEQ ID NO: 48843 - DNA, 25 bp, Homo sapien
cccagctacaccattattatgtttt

SEQ ID NO: 48844 - DNA, 25 bp, Homo sapien
cccagctacactattattatgtttt

SEQ ID NO: 48845 - DNA, 25 bp, Homo sapien
cccagctactctaaccattgatcct

SEQ ID NO: 48846 - DNA, 25 bp, Homo sapien
cccagctactctaatcattgatcct

SEQ ID NO: 48847 - DNA, 25 bp, Homo sapien
cccagctccctgcaccagtacttgg

SEQ ID NO: 48848 - DNA, 25 bp, Homo sapien
cccagctccctgcgccagtacttgg

SEQ ID NO: 48849 - DNA, 25 bp, Homo sapien
cccagctgattttacagatttttcc

SEQ ID NO: 48850 - DNA, 25 bp, Homo sapien
cccagctgcttttacagatttttcc

SEQ ID NO: 48851 - DNA, 25 bp, Homo sapien
cccagctgtattgcgtccatttaac

SEQ ID NO: 48852 - DNA, 25 bp, Homo sapien
cccagctgtattgtgtccatttaac

SEQ ID NO: 48853 - DNA, 25 bp, Homo sapien
cccagcttccgctaatacatgttga

SEQ ID NO: 48854 - DNA, 25 bp, Homo sapien
cccagcttctaccgtctgtttttgt

SEQ ID NO: 48855 - DNA, 25 bp, Homo sapien
cccagcttctactgtctgtttttgt

SEQ ID NO: 48856 - DNA, 25 bp, Homo sapien
cccagcttctgctaatacatgttga

SEQ ID NO: 48857 - DNA, 25 bp, Homo sapien
cccagctttatcaacgggtccaaag

SEQ ID NO: 48858 - DNA, 25 bp, Homo sapien
cccagctttatcaatgggtccaaag

SEQ ID NO: 48859 - DNA, 25 bp, Homo sapien
cccaggaaagtccatggagaagccc

SEQ ID NO: 48860 - DNA, 25 bp, Homo sapien
cccaggaaagtccgtggagaagccc

SEQ ID NO: 48861 - DNA, 25 bp, Homo sapien
cccaggaaggagatatgtgagagtg

SEQ ID NO: 48862 - DNA, 25 bp, Homo sapien
cccaggaaggaggtatgtgagagtg

SEQ ID NO: 48863 - DNA, 25 bp, Homo sapien
cccaggaagttgaaagtaatgattg

SEQ ID NO: 48864 - DNA, 25 bp, Homo sapien
cccaggaatttgaaagtaatgattg

SEQ ID NO: 48865 - DNA, 25 bp, Homo sapien
cccaggaccacagagcgagcaagca

SEQ ID NO: 48866 - DNA, 25 bp, Homo sapien
cccaggaccacagagctagcaagca

SEQ ID NO: 48867 - DNA, 25 bp, Homo sapien
cccaggactcttacgggtcacacaa

SEQ ID NO: 48868 - DNA, 25 bp, Homo sapien
cccaggactcttatgggtcacacaa

SEQ ID NO: 48869 - DNA, 25 bp, Homo sapien
cccaggagaatgtgtatttttaaag

SEQ ID NO: 48870 - DNA, 25 bp, Homo sapien
cccaggagacgacatctgagcatct

SEQ ID NO: 48871 - DNA, 25 bp, Homo sapien
cccaggagacgatatctgagcatct

SEQ ID NO: 48872 - DNA, 25 bp, Homo sapien
cccaggagagggatttttttcttgg

SEQ ID NO: 48873 - DNA, 25 bp, Homo sapien
cccaggagagggctttttttcttgg

SEQ ID NO: 48874 - DNA, 25 bp, Homo sapien
cccaggagagtgtgtatttttaaag

SEQ ID NO: 48875 - DNA, 25 bp, Homo sapien
cccaggagccactgcaaatgatgat

SEQ ID NO: 48876 - DNA, 25 bp, Homo sapien
cccaggagccattgcaaatgatgat

SEQ ID NO: 48877 - DNA, 25 bp, Homo sapien
cccaggattagtctccatggctgat

SEQ ID NO: 48878 - DNA, 25 bp, Homo sapien
cccaggattagtctccgtggctgat

SEQ ID NO: 48879 - DNA, 25 bp, Homo sapien
cccaggcaaaaagaaggcataataa

SEQ ID NO: 48880 - DNA, 25 bp, Homo sapien
cccaggcaaaacttgcaatcccgat

SEQ ID NO: 48881 - DNA, 25 bp, Homo sapien
cccaggcaaaactttcaatcccgat

SEQ ID NO: 48882 - DNA, 25 bp, Homo sapien
cccaggcaacaagaaggcataataa

SEQ ID NO: 48883 - DNA, 25 bp, Homo sapien
cccaggcgctgaatgggctttggag

SEQ ID NO: 48884 - DNA, 25 bp, Homo sapien
cccaggcgctgagtgggctttggag

SEQ ID NO: 48885 - DNA, 25 bp, Homo sapien
cccaggctactcccagccaatgact

SEQ ID NO: 48886 - DNA, 25 bp, Homo sapien
cccaggctactcccggccaatgact

SEQ ID NO: 48887 - DNA, 25 bp, Homo sapien
cccaggcttgtgaaatcctagtggc

SEQ ID NO: 48888 - DNA, 25 bp, Homo sapien
cccaggcttgtgatatcctagtggc

SEQ ID NO: 48889 - DNA, 25 bp, Homo sapien
cccaggcttgttatgcccacttttc

SEQ ID NO: 48890 - DNA, 25 bp, Homo sapien
cccaggcttgttgtgcccacttttc

SEQ ID NO: 48891 - DNA, 25 bp, Homo sapien
cccagggaaccactgatgctgcagt

SEQ ID NO: 48892 - DNA, 25 bp, Homo sapien
cccagggaaccattgatgctgcagt

SEQ ID NO: 48893 - DNA, 25 bp, Homo sapien
cccagggcacaaaacaaagtcctcc

SEQ ID NO: 48894 - DNA, 25 bp, Homo sapien
cccagggcacaaagcaaagtcctcc

SEQ ID NO: 48895 - DNA, 25 bp, Homo sapien
cccagggcctcccaacatgtggtct

SEQ ID NO: 48896 - DNA, 25 bp, Homo sapien
cccagggcctcccgacatgtggtct

SEQ ID NO: 48897 - DNA, 25 bp, Homo sapien
cccagggtctacacttttagaaaca

SEQ ID NO: 48898 - DNA, 25 bp, Homo sapien
cccagggtctacgcttttagaaaca

SEQ ID NO: 48899 - DNA, 25 bp, Homo sapien
cccaggtaaaagaagaccagtagaa

SEQ ID NO: 48900 - DNA, 25 bp, Homo sapien
cccaggtaaaagaggaccagtagaa

SEQ ID NO: 48901 - DNA, 25 bp, Homo sapien
cccaggtcatttgggttttcccaca

SEQ ID NO: 48902 - DNA, 25 bp, Homo sapien
cccaggtcgtttgggttttcccaca

SEQ ID NO: 48903 - DNA, 25 bp, Homo sapien
cccaggtctgatttaactcaccttt

SEQ ID NO: 48904 - DNA, 25 bp, Homo sapien
cccaggtctgatttgactcaccttt

SEQ ID NO: 48905 - DNA, 25 bp, Homo sapien
cccaggtcttgcatctgccaccggc

SEQ ID NO: 48906 - DNA, 25 bp, Homo sapien
cccaggtcttgtatctgccaccggc

SEQ ID NO: 48907 - DNA, 25 bp, Homo sapien
cccaggtgaacgaaccctagctctg

SEQ ID NO: 48908 - DNA, 25 bp, Homo sapien
cccaggtgaactaaccctagctctg

SEQ ID NO: 48909 - DNA, 25 bp, Homo sapien
cccaggttctatcacttcctgaaat

SEQ ID NO: 48910 - DNA, 25 bp, Homo sapien
cccaggttctatcgcttcctgaaat

SEQ ID NO: 48911 - DNA, 25 bp, Homo sapien
cccaggttctttctatcttcctgac

SEQ ID NO: 48912 - DNA, 25 bp, Homo sapien
cccaggttctttctgtcttcctgac

SEQ ID NO: 48913 - DNA, 25 bp, Homo sapien
cccagtagagacgaaaaagtagtaa

SEQ ID NO: 48914 - DNA, 25 bp, Homo sapien
cccagtagagatgaaaaagtagtaa

SEQ ID NO: 48915 - DNA, 25 bp, Homo sapien
cccagtatttcaacataggttctat

SEQ ID NO: 48916 - DNA, 25 bp, Homo sapien
cccagtatttcaacgtaggttctat

SEQ ID NO: 48917 - DNA, 25 bp, Homo sapien
cccagtcagtcttcctccctggtga

SEQ ID NO: 48918 - DNA, 25 bp, Homo sapien
cccagtcagtcttgctccctggtga

SEQ ID NO: 48919 - DNA, 25 bp, Homo sapien
cccagtcatctgccgtcactcagac

SEQ ID NO: 48920 - DNA, 25 bp, Homo sapien
cccagtcatctgctgtcactcagac

SEQ ID NO: 48921 - DNA, 25 bp, Homo sapien
cccagtccatgctgcaaccacaaag

SEQ ID NO: 48922 - DNA, 25 bp, Homo sapien
cccagtccttgctgcaaccacaaag

SEQ ID NO: 48923 - DNA, 25 bp, Homo sapien
cccagtgatcacactatttcacctc

SEQ ID NO: 48924 - DNA, 25 bp, Homo sapien
cccagtgatcatactatttcacctc

SEQ ID NO: 48925 - DNA, 25 bp, Homo sapien
cccagtgctcgtctggtctaagctg

SEQ ID NO: 48926 - DNA, 25 bp, Homo sapien
cccagtgcttgtctggtctaagctg

SEQ ID NO: 48927 - DNA, 25 bp, Homo sapien
cccagtggctgcacgttgtagttct

SEQ ID NO: 48928 - DNA, 25 bp, Homo sapien
cccagtggctgtacgttgtagttct

SEQ ID NO: 48929 - DNA, 25 bp, Homo sapien
cccagtgggtcacgatgtttatcca

SEQ ID NO: 48930 - DNA, 25 bp, Homo sapien
cccagtgggtcaggatgtttatcca

SEQ ID NO: 48931 - DNA, 25 bp, Homo sapien
cccagtttataagcagccctttttt

SEQ ID NO: 48932 - DNA, 25 bp, Homo sapien
cccagtttctaagcagccctttttt

SEQ ID NO: 48933 - DNA, 25 bp, Homo sapien
cccataaaggccttcgatgcgttga

SEQ ID NO: 48934 - DNA, 25 bp, Homo sapien
cccataaaggccttcgctgcgttga

SEQ ID NO: 48935 - DNA, 25 bp, Homo sapien
cccataagtgagagcccggagaagt

SEQ ID NO: 48936 - DNA, 25 bp, Homo sapien
cccataagtgagagcctggagaagt

SEQ ID NO: 48937 - DNA, 25 bp, Homo sapien
cccataagtgcaatattctccttta

SEQ ID NO: 48938 - DNA, 25 bp, Homo sapien
cccataagtgcgatattctccttta

SEQ ID NO: 48939 - DNA, 25 bp, Homo sapien
cccatacataaatctttgccgagag

SEQ ID NO: 48940 - DNA, 25 bp, Homo sapien
cccatacataagtctttgccgagag

SEQ ID NO: 48941 - DNA, 25 bp, Homo sapien
cccatagaatatacaacatgatagt

SEQ ID NO: 48942 - DNA, 25 bp, Homo sapien
cccatagactatacaacatgatagt

SEQ ID NO: 48943 - DNA, 25 bp, Homo sapien
cccataggagccgggaccatttctg

SEQ ID NO: 48944 - DNA, 25 bp, Homo sapien
cccataggagctgggaccatttctg

SEQ ID NO: 48945 - DNA, 25 bp, Homo sapien
cccataggattttcatacatccctc

SEQ ID NO: 48946 - DNA, 25 bp, Homo sapien
cccataggatttttatacatccctc

SEQ ID NO: 48947 - DNA, 25 bp, Homo sapien
cccataggccacttaacagctttgt

SEQ ID NO: 48948 - DNA, 25 bp, Homo sapien
cccataggccagttaacagctttgt

SEQ ID NO: 48949 - DNA, 25 bp, Homo sapien
cccatagtatggagtcacaattacc

SEQ ID NO: 48950 - DNA, 25 bp, Homo sapien
cccatagtatggagtcgcaattacc

SEQ ID NO: 48951 - DNA, 25 bp, Homo sapien
cccatatacatacttttttctgttg

SEQ ID NO: 48952 - DNA, 25 bp, Homo sapien
cccatatacatatttttttctgttg

SEQ ID NO: 48953 - DNA, 25 bp, Homo sapien
cccatatatgcactgcctaacaaca

SEQ ID NO: 48954 - DNA, 25 bp, Homo sapien
cccatatatgcactgcgtaacaaca

SEQ ID NO: 48955 - DNA, 25 bp, Homo sapien
cccatatccagcgccattcccacag

SEQ ID NO: 48956 - DNA, 25 bp, Homo sapien
cccatatccagcggcattcccacag

SEQ ID NO: 48957 - DNA, 25 bp, Homo sapien
cccatattgcgatggtagtagaaac

SEQ ID NO: 48958 - DNA, 25 bp, Homo sapien
cccatattgtgatggtagtagaaac

SEQ ID NO: 48959 - DNA, 25 bp, Homo sapien
cccatatttctgccacaactaagag

SEQ ID NO: 48960 - DNA, 25 bp, Homo sapien
cccatatttctgccacgactaagag

SEQ ID NO: 48961 - DNA, 25 bp, Homo sapien
cccatcagacggagagttggtcttt

SEQ ID NO: 48962 - DNA, 25 bp, Homo sapien
cccatcagatggagagttggtcttt

SEQ ID NO: 48963 - DNA, 25 bp, Homo sapien
cccatcagcagtgagttccaaaggt

SEQ ID NO: 48964 - DNA, 25 bp, Homo sapien
cccatcagccttacaaccttatctc

SEQ ID NO: 48965 - DNA, 25 bp, Homo sapien
cccatcagccttacaagcttatctc

SEQ ID NO: 48966 - DNA, 25 bp, Homo sapien
cccatcagctgtgagttccaaaggt

SEQ ID NO: 48967 - DNA, 25 bp, Homo sapien
cccatcaggtgggtcatttgagccc

SEQ ID NO: 48968 - DNA, 25 bp, Homo sapien
cccatcaggtgggttatttgagccc

SEQ ID NO: 48969 - DNA, 25 bp, Homo sapien
cccatcagtgacaaagtacaaactg

SEQ ID NO: 48970 - DNA, 25 bp, Homo sapien
cccatcagtgaccaagtacaaactg

SEQ ID NO: 48971 - DNA, 25 bp, Homo sapien
cccatcagtgacgctcttctcttcc

SEQ ID NO: 48972 - DNA, 25 bp, Homo sapien
cccatcagtgatgctcttctcttcc

SEQ ID NO: 48973 - DNA, 25 bp, Homo sapien
cccatcatactgtaggaatgtctcc

SEQ ID NO: 48974 - DNA, 25 bp, Homo sapien
cccatcatattgtaggaatgtctcc

SEQ ID NO: 48975 - DNA, 25 bp, Homo sapien
cccatccgctctgtcaacttctctc

SEQ ID NO: 48976 - DNA, 25 bp, Homo sapien
cccatccgctctgtcagcttctctc

SEQ ID NO: 48977 - DNA, 25 bp, Homo sapien
cccatcctcgacctcacaaatcttc

SEQ ID NO: 48978 - DNA, 25 bp, Homo sapien
cccatccttgacctcacaaatcttc

SEQ ID NO: 48979 - DNA, 25 bp, Homo sapien
cccatctctaagtagaaaaatcacc

SEQ ID NO: 48980 - DNA, 25 bp, Homo sapien
cccatctctgagtagaaaaatcacc

SEQ ID NO: 48981 - DNA, 25 bp, Homo sapien
cccatctgcgcactttgagcttctc

SEQ ID NO: 48982 - DNA, 25 bp, Homo sapien
cccatctgggcactttgagcttctc

SEQ ID NO: 48983 - DNA, 25 bp, Homo sapien
cccatcttgagcgtattgccttatc

SEQ ID NO: 48984 - DNA, 25 bp, Homo sapien
cccatcttgagcgtgttgccttatc

SEQ ID NO: 48985 - DNA, 25 bp, Homo sapien
cccatgacacacctattgatatgtg

SEQ ID NO: 48986 - DNA, 25 bp, Homo sapien
cccatgacacagctattgatatgtg

SEQ ID NO: 48987 - DNA, 25 bp, Homo sapien
cccatgacccaaatttaccatcctc

SEQ ID NO: 48988 - DNA, 25 bp, Homo sapien
cccatgacccagatttaccatcctc

SEQ ID NO: 48989 - DNA, 25 bp, Homo sapien
cccatgacttaatcatccagggtac

SEQ ID NO: 48990 - DNA, 25 bp, Homo sapien
cccatgacttattcatccagggtac

SEQ ID NO: 48991 - DNA, 25 bp, Homo sapien
cccatgatttttctctttggggaaa

SEQ ID NO: 48992 - DNA, 25 bp, Homo sapien
cccatgatttttttctttggggaaa

SEQ ID NO: 48993 - DNA, 25 bp, Homo sapien
cccatgcaaactcagatctaagagg

SEQ ID NO: 48994 - DNA, 25 bp, Homo sapien
cccatgcaacctcagatctaagagg

SEQ ID NO: 48995 - DNA, 25 bp, Homo sapien
cccatgcaatgaccctgccttacat

SEQ ID NO: 48996 - DNA, 25 bp, Homo sapien
cccatgcaatgactctgccttacat

SEQ ID NO: 48997 - DNA, 25 bp, Homo sapien
cccatgcatgcacctgattagtgga

SEQ ID NO: 48998 - DNA, 25 bp, Homo sapien
cccatgcatgcatctgattagtgga

SEQ ID NO: 48999 - DNA, 25 bp, Homo sapien
cccatgcctcactttactcctctgt

SEQ ID NO: 49000 - DNA, 25 bp, Homo sapien
cccatgcctcactttattcctctgt

SEQ ID NO: 49001 - DNA, 25 bp, Homo sapien
cccatggaattgggctggatgtggc

SEQ ID NO: 49002 - DNA, 25 bp, Homo sapien
cccatggaattgggttggatgtggc

SEQ ID NO: 49003 - DNA, 25 bp, Homo sapien
cccatgtacggttgcactgctgact

SEQ ID NO: 49004 - DNA, 25 bp, Homo sapien
cccatgtacggttgcattgctgact

SEQ ID NO: 49005 - DNA, 25 bp, Homo sapien
cccatgtagcctctatcctgacctt

SEQ ID NO: 49006 - DNA, 25 bp, Homo sapien
cccatgtagcctctatgctgacctt

SEQ ID NO: 49007 - DNA, 25 bp, Homo sapien
cccatgtcacttgattagatgccct

SEQ ID NO: 49008 - DNA, 25 bp, Homo sapien
cccatgtcacttgattcgatgccct

SEQ ID NO: 49009 - DNA, 25 bp, Homo sapien
cccatgtgaatgctttatagttagt

SEQ ID NO: 49010 - DNA, 25 bp, Homo sapien
cccatgtgaatgctttctagttagt

SEQ ID NO: 49011 - DNA, 25 bp, Homo sapien
cccattaactgtggatgttgtcatc

SEQ ID NO: 49012 - DNA, 25 bp, Homo sapien
cccattaactgttgatgttgtcatc

SEQ ID NO: 49013 - DNA, 25 bp, Homo sapien
cccattactgattcccatcaatttc

SEQ ID NO: 49014 - DNA, 25 bp, Homo sapien
cccattactgattcccgtcaatttc

SEQ ID NO: 49015 - DNA, 25 bp, Homo sapien
cccattagatcctgacctgcctcgc

SEQ ID NO: 49016 - DNA, 25 bp, Homo sapien
cccattagatcttgacctgcctcgc

SEQ ID NO: 49017 - DNA, 25 bp, Homo sapien
cccattatccacgtttatcctccca

SEQ ID NO: 49018 - DNA, 25 bp, Homo sapien
cccattatccatgtttatcctccca

SEQ ID NO: 49019 - DNA, 25 bp, Homo sapien
cccattcacacttgtacttttttta

SEQ ID NO: 49020 - DNA, 25 bp, Homo sapien
cccattcacgcttgtacttttttta

SEQ ID NO: 49021 - DNA, 25 bp, Homo sapien
cccattccagaacattcatctttga

SEQ ID NO: 49022 - DNA, 25 bp, Homo sapien
cccattcccgaacattcatctttga

SEQ ID NO: 49023 - DNA, 25 bp, Homo sapien
cccattctccacatggtagtggctc

SEQ ID NO: 49024 - DNA, 25 bp, Homo sapien
cccattctccacgtggtagtggctc

SEQ ID NO: 49025 - DNA, 25 bp, Homo sapien
cccattcttcctctagtgcgcagca

SEQ ID NO: 49026 - DNA, 25 bp, Homo sapien
cccattcttcctgtagtgcgcagca

SEQ ID NO: 49027 - DNA, 25 bp, Homo sapien
cccattgaacagcaactctccatct

SEQ ID NO: 49028 - DNA, 25 bp, Homo sapien
cccattgaacagtaactctccatct

SEQ ID NO: 49029 - DNA, 25 bp, Homo sapien
cccattgatggatgaacagaaaatg

SEQ ID NO: 49030 - DNA, 25 bp, Homo sapien
cccattgatggatgaatagaaaatg

SEQ ID NO: 49031 - DNA, 25 bp, Homo sapien
cccattggcaagggaagaatgaagg

SEQ ID NO: 49032 - DNA, 25 bp, Homo sapien
cccattggtaagggaagaatgaagg

SEQ ID NO: 49033 - DNA, 25 bp, Homo sapien
cccattgtctctactgctcacacaa

SEQ ID NO: 49034 - DNA, 25 bp, Homo sapien
cccattgtctctagtgctcacacaa

SEQ ID NO: 49035 - DNA, 25 bp, Homo sapien
cccattgttctcagcaaaaagcagc

SEQ ID NO: 49036 - DNA, 25 bp, Homo sapien
cccattgttctcagcacaaagcagc

SEQ ID NO: 49037 - DNA, 25 bp, Homo sapien
cccatttccacagaattgtcattat

SEQ ID NO: 49038 - DNA, 25 bp, Homo sapien
cccatttccacggaattgtcattat

SEQ ID NO: 49039 - DNA, 25 bp, Homo sapien
cccatttccatttgctctgccattc

SEQ ID NO: 49040 - DNA, 25 bp, Homo sapien
cccatttccatttgttctgccattc

SEQ ID NO: 49041 - DNA, 25 bp, Homo sapien
cccattttgaagagagaacattggt

SEQ ID NO: 49042 - DNA, 25 bp, Homo sapien
cccatttttaagagagaacattggt

SEQ ID NO: 49043 - DNA, 25 bp, Homo sapien
ccccaaaattaacgcttagcttcag

SEQ ID NO: 49044 - DNA, 25 bp, Homo sapien
ccccaaaattaatgcttagcttcag

SEQ ID NO: 49045 - DNA, 25 bp, Homo sapien
ccccaaatcaatttgcttctctgtg

SEQ ID NO: 49046 - DNA, 25 bp, Homo sapien
ccccaaatcaattttcttctctgtg

SEQ ID NO: 49047 - DNA, 25 bp, Homo sapien
ccccaagctaacatgtcagcctact

SEQ ID NO: 49048 - DNA, 25 bp, Homo sapien
ccccaagctaacgtgtcagcctact

SEQ ID NO: 49049 - DNA, 25 bp, Homo sapien
ccccaaggcaagaactgatatgatt

SEQ ID NO: 49050 - DNA, 25 bp, Homo sapien
ccccaaggcaagatctgatatgatt

SEQ ID NO: 49051 - DNA, 25 bp, Homo sapien
ccccaagtgaccaatttgcacagta

SEQ ID NO: 49052 - DNA, 25 bp, Homo sapien
ccccaagtgaccgatttgcacagta

SEQ ID NO: 49053 - DNA, 25 bp, Homo sapien
ccccacaatgcaccaagtggtcttc

SEQ ID NO: 49054 - DNA, 25 bp, Homo sapien
ccccacaatgcaccgagtggtcttc

SEQ ID NO: 49055 - DNA, 25 bp, Homo sapien
ccccacactgaacagttcattctta

SEQ ID NO: 49056 - DNA, 25 bp, Homo sapien
ccccacactgaagagttcattctta

SEQ ID NO: 49057 - DNA, 25 bp, Homo sapien
ccccacattgcagtaacttaacaca

SEQ ID NO: 49058 - DNA, 25 bp, Homo sapien
ccccacattgcagtgacttaacaca

SEQ ID NO: 49059 - DNA, 25 bp, Homo sapien
ccccacattgtacgacaatcaatcc

SEQ ID NO: 49060 - DNA, 25 bp, Homo sapien
ccccacattgtatgacaatcaatcc

SEQ ID NO: 49061 - DNA, 25 bp, Homo sapien
ccccaccagcgtgtttttctctgag

SEQ ID NO: 49062 - DNA, 25 bp, Homo sapien
ccccaccagtgtgtttttctctgag

SEQ ID NO: 49063 - DNA, 25 bp, Homo sapien
ccccaccttaaaacggacacatcct

SEQ ID NO: 49064 - DNA, 25 bp, Homo sapien
ccccaccttaaaatggacacatcct

SEQ ID NO: 49065 - DNA, 25 bp, Homo sapien
ccccacgatttctactcagcttcaa

SEQ ID NO: 49066 - DNA, 25 bp, Homo sapien
ccccacgatttctacttagcttcaa

SEQ ID NO: 49067 - DNA, 25 bp, Homo sapien
ccccactgacatgtttcctcacttt

SEQ ID NO: 49068 - DNA, 25 bp, Homo sapien
ccccactgacatttttcctcacttt

SEQ ID NO: 49069 - DNA, 25 bp, Homo sapien
ccccactgcactgctgctttcctat

SEQ ID NO: 49070 - DNA, 25 bp, Homo sapien
ccccactgcactgctgttttcctat

SEQ ID NO: 49071 - DNA, 25 bp, Homo sapien
ccccagaattcgtacgggcttagtt

SEQ ID NO: 49072 - DNA, 25 bp, Homo sapien
ccccagaattcgtatgggcttagtt

SEQ ID NO: 49073 - DNA, 25 bp, Homo sapien
ccccagagatgatcattgctaacat

SEQ ID NO: 49074 - DNA, 25 bp, Homo sapien
ccccagagatgattattgctaacat

SEQ ID NO: 49075 - DNA, 25 bp, Homo sapien
ccccagagtttcaaattcagtgttt

SEQ ID NO: 49076 - DNA, 25 bp, Homo sapien
ccccagagtttcagattcagtgttt

SEQ ID NO: 49077 - DNA, 25 bp, Homo sapien
ccccagccaatagagatcaatctag

SEQ ID NO: 49078 - DNA, 25 bp, Homo sapien
ccccagccaatagggatcaatctag

SEQ ID NO: 49079 - DNA, 25 bp, Homo sapien
ccccagctacaccattattatgttt

SEQ ID NO: 49080 - DNA, 25 bp, Homo sapien
ccccagctacactattattatgttt

SEQ ID NO: 49081 - DNA, 25 bp, Homo sapien
ccccagctgattttacagatttttc

SEQ ID NO: 49082 - DNA, 25 bp, Homo sapien
ccccagctgcttttacagatttttc

SEQ ID NO: 49083 - DNA, 25 bp, Homo sapien
ccccaggactcttacgggtcacaca

SEQ ID NO: 49084 - DNA, 25 bp, Homo sapien
ccccaggactcttatgggtcacaca

SEQ ID NO: 49085 - DNA, 25 bp, Homo sapien
ccccaggcgccattacaccatattt

SEQ ID NO: 49086 - DNA, 25 bp, Homo sapien
ccccaggcgccattacgccatattt

SEQ ID NO: 49087 - DNA, 25 bp, Homo sapien
ccccaggtcatcagctgcactagac

SEQ ID NO: 49088 - DNA, 25 bp, Homo sapien
ccccaggtcatttgggttttcccac

SEQ ID NO: 49089 - DNA, 25 bp, Homo sapien
ccccaggtcgtttgggttttcccac

SEQ ID NO: 49090 - DNA, 25 bp, Homo sapien
ccccaggtgatcagctgcactagac

SEQ ID NO: 49091 - DNA, 25 bp, Homo sapien
ccccaggtggagctcaccgaatgtt

SEQ ID NO: 49092 - DNA, 25 bp, Homo sapien
ccccaggtggagctcagcgaatgtt

SEQ ID NO: 49093 - DNA, 25 bp, Homo sapien
ccccagtagagacgaaaaagtagta

SEQ ID NO: 49094 - DNA, 25 bp, Homo sapien
ccccagtagagatgaaaaagtagta

SEQ ID NO: 49095 - DNA, 25 bp, Homo sapien
ccccagtccatgctgcaaccacaaa

SEQ ID NO: 49096 - DNA, 25 bp, Homo sapien
ccccagtccttgctgcaaccacaaa

SEQ ID NO: 49097 - DNA, 25 bp, Homo sapien
ccccagtggacactgaattccagcc

SEQ ID NO: 49098 - DNA, 25 bp, Homo sapien
ccccagtggacgctgaattccagcc

SEQ ID NO: 49099 - DNA, 25 bp, Homo sapien
ccccataagtgcaatattctccttt

SEQ ID NO: 49100 - DNA, 25 bp, Homo sapien
ccccataagtgcgatattctccttt

SEQ ID NO: 49101 - DNA, 25 bp, Homo sapien
ccccatacattttctagttggctat

SEQ ID NO: 49102 - DNA, 25 bp, Homo sapien
ccccatacgttttctagttggctat

SEQ ID NO: 49103 - DNA, 25 bp, Homo sapien
ccccatcctcgacctcacaaatctt

SEQ ID NO: 49104 - DNA, 25 bp, Homo sapien
ccccatccttgacctcacaaatctt

SEQ ID NO: 49105 - DNA, 25 bp, Homo sapien
ccccatctatacactgcccaaactc

SEQ ID NO: 49106 - DNA, 25 bp, Homo sapien
ccccatctatacactgtccaaactc

SEQ ID NO: 49107 - DNA, 25 bp, Homo sapien
ccccatctcttggcctcaacctgtc

SEQ ID NO: 49108 - DNA, 25 bp, Homo sapien
ccccatctcttggcttcaacctgtc

SEQ ID NO: 49109 - DNA, 25 bp, Homo sapien
ccccatgaaaaattggcacctagtt

SEQ ID NO: 49110 - DNA, 25 bp, Homo sapien
ccccatgaaaagttggcacctagtt

SEQ ID NO: 49111 - DNA, 25 bp, Homo sapien
ccccatgcaatgaccctgccttaca

SEQ ID NO: 49112 - DNA, 25 bp, Homo sapien
ccccatgcaatgactctgccttaca

SEQ ID NO: 49113 - DNA, 25 bp, Homo sapien
ccccattacttgttgcgattaccac

SEQ ID NO: 49114 - DNA, 25 bp, Homo sapien
ccccattactttttgcgattaccac

SEQ ID NO: 49115 - DNA, 25 bp, Homo sapien
ccccatttccacagaattgtcatta

SEQ ID NO: 49116 - DNA, 25 bp, Homo sapien
ccccatttccacggaattgtcatta

SEQ ID NO: 49117 - DNA, 25 bp, Homo sapien
cccccaacacacacaaaacatgaat

SEQ ID NO: 49118 - DNA, 25 bp, Homo sapien
cccccaacacacacgaaacatgaat

SEQ ID NO: 49119 - DNA, 25 bp, Homo sapien
cccccaacagtaagagcagtgttgt

SEQ ID NO: 49120 - DNA, 25 bp, Homo sapien
cccccaacagtgagagcagtgttgt

SEQ ID NO: 49121 - DNA, 25 bp, Homo sapien
cccccaagctaacatgtcagcctac

SEQ ID NO: 49122 - DNA, 25 bp, Homo sapien
cccccaagctaacgtgtcagcctac

SEQ ID NO: 49123 - DNA, 25 bp, Homo sapien
cccccgtgtgcctgcaattggaggg

SEQ ID NO: 49124 - DNA, 25 bp, Homo sapien
cccccgtgtgcctgtaattggaggg

SEQ ID NO: 49125 - DNA, 25 bp, Homo sapien
ccccctaagtatgcagagaaaggaa

SEQ ID NO: 49126 - DNA, 25 bp, Homo sapien
ccccctaagtatgcagcgaaaggaa

SEQ ID NO: 49127 - DNA, 25 bp, Homo sapien
ccccctactagcgttactgtgtcca

SEQ ID NO: 49128 - DNA, 25 bp, Homo sapien
ccccctactagtgttactgtgtcca

SEQ ID NO: 49129 - DNA, 25 bp, Homo sapien
ccccctactcagccaatgtggtaag

SEQ ID NO: 49130 - DNA, 25 bp, Homo sapien
ccccctactcagccgatgtggtaag

SEQ ID NO: 49131 - DNA, 25 bp, Homo sapien
ccccctccacacgctgagaaagggc

SEQ ID NO: 49132 - DNA, 25 bp, Homo sapien
ccccctccacaggctgagaaagggc

SEQ ID NO: 49133 - DNA, 25 bp, Homo sapien
ccccctggctgacgtggtgcccatc

SEQ ID NO: 49134 - DNA, 25 bp, Homo sapien
ccccctggctgacgtgttgcccatc

SEQ ID NO: 49135 - DNA, 25 bp, Homo sapien
ccccctgtagagaaaagactagcaa

SEQ ID NO: 49136 - DNA, 25 bp, Homo sapien
ccccctgtatagaaaagactagcaa

SEQ ID NO: 49137 - DNA, 25 bp, Homo sapien
ccccctgtggacctcatttttcttg

SEQ ID NO: 49138 - DNA, 25 bp, Homo sapien
ccccctgtggacttcatttttcttg

SEQ ID NO: 49139 - DNA, 25 bp, Homo sapien
cccccttatggcaccccattgctgc

SEQ ID NO: 49140 - DNA, 25 bp, Homo sapien
cccccttatggcaccctattgctgc

SEQ ID NO: 49141 - DNA, 25 bp, Homo sapien
cccccttggtaaagctacctgagaa

SEQ ID NO: 49142 - DNA, 25 bp, Homo sapien
cccccttggtagagctacctgagaa

SEQ ID NO: 49143 - DNA, 25 bp, Homo sapien
cccccttttcgtgggacgagagcag

SEQ ID NO: 49144 - DNA, 25 bp, Homo sapien
cccccttttcgtgggatgagagcag

SEQ ID NO: 49145 - DNA, 25 bp, Homo sapien
ccccgaggcatcagttactatcacc

SEQ ID NO: 49146 - DNA, 25 bp, Homo sapien
ccccgaggcatcggttactatcacc

SEQ ID NO: 49147 - DNA, 25 bp, Homo sapien
ccccgagtcctgccattactactca

SEQ ID NO: 49148 - DNA, 25 bp, Homo sapien
ccccgagtcttgccattactactca

SEQ ID NO: 49149 - DNA, 25 bp, Homo sapien
ccccgccttgtcacacgccttataa

SEQ ID NO: 49150 - DNA, 25 bp, Homo sapien
ccccgccttgttacacgccttataa

SEQ ID NO: 49151 - DNA, 25 bp, Homo sapien
ccccgctccagtccttttcattggc

SEQ ID NO: 49152 - DNA, 25 bp, Homo sapien
ccccgctccagttcttttcattggc

SEQ ID NO: 49153 - DNA, 25 bp, Homo sapien
ccccgtggcgtgctatgttgtcttt

SEQ ID NO: 49154 - DNA, 25 bp, Homo sapien
ccccgtggtgtgctatgttgtcttt

SEQ ID NO: 49155 - DNA, 25 bp, Homo sapien
cccctaaaaggaccagcatgttcac

SEQ ID NO: 49156 - DNA, 25 bp, Homo sapien
cccctaaaaggatcagcatgttcac

SEQ ID NO: 49157 - DNA, 25 bp, Homo sapien
cccctagagcaaggaaaagttataa

SEQ ID NO: 49158 - DNA, 25 bp, Homo sapien
cccctagagcaagtaaaagttataa

SEQ ID NO: 49159 - DNA, 25 bp, Homo sapien
cccctagcacaaaaaagaaagccac

SEQ ID NO: 49160 - DNA, 25 bp, Homo sapien
cccctagcacaagaaagaaagccac

SEQ ID NO: 49161 - DNA, 25 bp, Homo sapien
cccctagccagaaaaaaattgtcca

SEQ ID NO: 49162 - DNA, 25 bp, Homo sapien
cccctagctagaaaaaaattgtcca

SEQ ID NO: 49163 - DNA, 25 bp, Homo sapien
cccctagtcaaagagcctgtggacc

SEQ ID NO: 49164 - DNA, 25 bp, Homo sapien
cccctagtcaaatagcctgtggacc

SEQ ID NO: 49165 - DNA, 25 bp, Homo sapien
cccctatccctgggcggtcacgttg

SEQ ID NO: 49166 - DNA, 25 bp, Homo sapien
cccctatccctgggtggtcacgttg

SEQ ID NO: 49167 - DNA, 25 bp, Homo sapien
cccctatgggcacccaaaccaagca

SEQ ID NO: 49168 - DNA, 25 bp, Homo sapien
cccctatgggcacccacaccaagca

SEQ ID NO: 49169 - DNA, 25 bp, Homo sapien
cccctattacttacgcatcacacat

SEQ ID NO: 49170 - DNA, 25 bp, Homo sapien
cccctattacttatgcatcacacat

SEQ ID NO: 49171 - DNA, 25 bp, Homo sapien
cccctcaagacacgcaatctctgca

SEQ ID NO: 49172 - DNA, 25 bp, Homo sapien
cccctcaagacatgcaatctctgca

SEQ ID NO: 49173 - DNA, 25 bp, Homo sapien
cccctcacttctcatgttttcttag

SEQ ID NO: 49174 - DNA, 25 bp, Homo sapien
cccctcacttctcgtgttttcttag

SEQ ID NO: 49175 - DNA, 25 bp, Homo sapien
cccctcatgcttcaacacccttctc

SEQ ID NO: 49176 - DNA, 25 bp, Homo sapien
cccctcatgcttcgacacccttctc

SEQ ID NO: 49177 - DNA, 25 bp, Homo sapien
cccctccaccgcaaatgtgtatgtt

SEQ ID NO: 49178 - DNA, 25 bp, Homo sapien
cccctccactgcaaatgtgtatgtt

SEQ ID NO: 49179 - DNA, 25 bp, Homo sapien
cccctcttcctaacaaagcatccaa

SEQ ID NO: 49180 - DNA, 25 bp, Homo sapien
cccctcttcctatcaaagcatccaa

SEQ ID NO: 49181 - DNA, 25 bp, Homo sapien
cccctcttttcctacttcctctaag

SEQ ID NO: 49182 - DNA, 25 bp, Homo sapien
cccctcttttcctatttcctctaag

SEQ ID NO: 49183 - DNA, 25 bp, Homo sapien
cccctgattaacgagaacactctac

SEQ ID NO: 49184 - DNA, 25 bp, Homo sapien
cccctgattaaggagaacactctac

SEQ ID NO: 49185 - DNA, 25 bp, Homo sapien
cccctgattcctataagatttttgt

SEQ ID NO: 49186 - DNA, 25 bp, Homo sapien
cccctgattcctctaagatttttgt

SEQ ID NO: 49187 - DNA, 25 bp, Homo sapien
cccctggagcttgcactttagtgga

SEQ ID NO: 49188 - DNA, 25 bp, Homo sapien
cccctggagcttgtactttagtgga

SEQ ID NO: 49189 - DNA, 25 bp, Homo sapien
cccctggcacacggtttgagatggt

SEQ ID NO: 49190 - DNA, 25 bp, Homo sapien
cccctggcacagggtttgagatggt

SEQ ID NO: 49191 - DNA, 25 bp, Homo sapien
cccctggtcccagaattaaggctgg

SEQ ID NO: 49192 - DNA, 25 bp, Homo sapien
cccctggtcccggaattaaggctgg

SEQ ID NO: 49193 - DNA, 25 bp, Homo sapien
cccctgtaaccagtcgtcaactcta

SEQ ID NO: 49194 - DNA, 25 bp, Homo sapien
cccctgtaaccagttgtcaactcta

SEQ ID NO: 49195 - DNA, 25 bp, Homo sapien
cccctgtagagaaaagactagcaag

SEQ ID NO: 49196 - DNA, 25 bp, Homo sapien
cccctgtatagaaaagactagcaag

SEQ ID NO: 49197 - DNA, 25 bp, Homo sapien
cccctgtggacctcatttttcttgt

SEQ ID NO: 49198 - DNA, 25 bp, Homo sapien
cccctgtggacttcatttttcttgt

SEQ ID NO: 49199 - DNA, 25 bp, Homo sapien
cccctgtttccaactttctatctcc

SEQ ID NO: 49200 - DNA, 25 bp, Homo sapien
cccctgtttccatctttctatctcc

SEQ ID NO: 49201 - DNA, 25 bp, Homo sapien
ccccttagatttcgttgcactatca

SEQ ID NO: 49202 - DNA, 25 bp, Homo sapien
ccccttaggtttcgttgcactatca

SEQ ID NO: 49203 - DNA, 25 bp, Homo sapien
ccccttcaagtagcactggtgcagt

SEQ ID NO: 49204 - DNA, 25 bp, Homo sapien
ccccttcaagtcgcactggtgcagt

SEQ ID NO: 49205 - DNA, 25 bp, Homo sapien
ccccttgccagcgaaaacttggggc

SEQ ID NO: 49206 - DNA, 25 bp, Homo sapien
ccccttgccagtgaaaacttggggc

SEQ ID NO: 49207 - DNA, 25 bp, Homo sapien
ccccttttctgcatgacagatgaaa

SEQ ID NO: 49208 - DNA, 25 bp, Homo sapien
ccccttttctgcgtgacagatgaaa

SEQ ID NO: 49209 - DNA, 25 bp, Homo sapien
cccgaatttcacatcccaggaaact

SEQ ID NO: 49210 - DNA, 25 bp, Homo sapien
cccgaatttcatatcccaggaaact

SEQ ID NO: 49211 - DNA, 25 bp, Homo sapien
cccgaggcatcagttactatcacca

SEQ ID NO: 49212 - DNA, 25 bp, Homo sapien
cccgaggcatcggttactatcacca

SEQ ID NO: 49213 - DNA, 25 bp, Homo sapien
cccgatatcaaagaatccaaaatat

SEQ ID NO: 49214 - DNA, 25 bp, Homo sapien
cccgatatcaaataatccaaaatat

SEQ ID NO: 49215 - DNA, 25 bp, Homo sapien
cccgatgactaacttcaacagctaa

SEQ ID NO: 49216 - DNA, 25 bp, Homo sapien
cccgatgactaatttcaacagctaa

SEQ ID NO: 49217 - DNA, 25 bp, Homo sapien
cccgattatctctgtttcatgtgac

SEQ ID NO: 49218 - DNA, 25 bp, Homo sapien
cccgattatgtctgtttcatgtgac

SEQ ID NO: 49219 - DNA, 25 bp, Homo sapien
cccgcaaaaccatgagacaattcaa

SEQ ID NO: 49220 - DNA, 25 bp, Homo sapien
cccgcaaaaccatgagccaattcaa

SEQ ID NO: 49221 - DNA, 25 bp, Homo sapien
cccgcaacattcacatctgcatcct

SEQ ID NO: 49222 - DNA, 25 bp, Homo sapien
cccgcaacatttacatctgcatcct

SEQ ID NO: 49223 - DNA, 25 bp, Homo sapien
cccgcagcttttcctgcagtaaaga

SEQ ID NO: 49224 - DNA, 25 bp, Homo sapien
cccgcagcttttcttgcagtaaaga

SEQ ID NO: 49225 - DNA, 25 bp, Homo sapien
cccgcagggggaatttccgcagtgt

SEQ ID NO: 49226 - DNA, 25 bp, Homo sapien
cccgcagggggagtttccgcagtgt

SEQ ID NO: 49227 - DNA, 25 bp, Homo sapien
cccgctaacataatcttataataat

SEQ ID NO: 49228 - DNA, 25 bp, Homo sapien
cccgctaacatactcttataataat

SEQ ID NO: 49229 - DNA, 25 bp, Homo sapien
cccgctaccttctattttggtctaa

SEQ ID NO: 49230 - DNA, 25 bp, Homo sapien
cccgctaccttctgttttggtctaa

SEQ ID NO: 49231 - DNA, 25 bp, Homo sapien
cccgctccagtccttttcattggct

SEQ ID NO: 49232 - DNA, 25 bp, Homo sapien
cccgctccagttcttttcattggct

SEQ ID NO: 49233 - DNA, 25 bp, Homo sapien
cccggcaccaaatgccaggaacaac

SEQ ID NO: 49234 - DNA, 25 bp, Homo sapien
cccggcaccgaatgccaggaacaac

SEQ ID NO: 49235 - DNA, 25 bp, Homo sapien
cccggctgcatacatagcagtctgt

SEQ ID NO: 49236 - DNA, 25 bp, Homo sapien
cccggctgcatacgtagcagtctgt

SEQ ID NO: 49237 - DNA, 25 bp, Homo sapien
cccgggacccgcatctgtgcaactc

SEQ ID NO: 49238 - DNA, 25 bp, Homo sapien
cccgggacccgcatgtgtgcaactc

SEQ ID NO: 49239 - DNA, 25 bp, Homo sapien
cccgtaagatttagttataatgaaa

SEQ ID NO: 49240 - DNA, 25 bp, Homo sapien
cccgtaagatttagttctaatgaaa

SEQ ID NO: 49241 - DNA, 25 bp, Homo sapien
cccgtattgttatcgaaaagacaag

SEQ ID NO: 49242 - DNA, 25 bp, Homo sapien
cccgtattgttatggaaaagacaag

SEQ ID NO: 49243 - DNA, 25 bp, Homo sapien
cccgtctatggacacaaaactggtg

SEQ ID NO: 49244 - DNA, 25 bp, Homo sapien
cccgtctatggactcaaaactggtg

SEQ ID NO: 49245 - DNA, 25 bp, Homo sapien
cccgtgaaaaagtagaatttataca

SEQ ID NO: 49246 - DNA, 25 bp, Homo sapien
cccgtgaaaaattagaatttataca

SEQ ID NO: 49247 - DNA, 25 bp, Homo sapien
cccgtgcatttatccttccagaagg

SEQ ID NO: 49248 - DNA, 25 bp, Homo sapien
cccgtgcatttattcttccagaagg

SEQ ID NO: 49249 - DNA, 25 bp, Homo sapien
cccgtggtgctcaccttccagcacc

SEQ ID NO: 49250 - DNA, 25 bp, Homo sapien
cccgtggtgctcactttccagcacc

SEQ ID NO: 49251 - DNA, 25 bp, Homo sapien
cccgtgtccctagccttgctctgcc

SEQ ID NO: 49252 - DNA, 25 bp, Homo sapien
cccgtgtccctatccttgctctgcc

SEQ ID NO: 49253 - DNA, 25 bp, Homo sapien
cccgtgtgcctgcaattggagggat

SEQ ID NO: 49254 - DNA, 25 bp, Homo sapien
cccgtgtgcctgtaattggagggat

SEQ ID NO: 49255 - DNA, 25 bp, Homo sapien
cccgttgacataagctggaaatgtc

SEQ ID NO: 49256 - DNA, 25 bp, Homo sapien
cccgttgatataagctggaaatgtc

SEQ ID NO: 49257 - DNA, 25 bp, Homo sapien
cccgtttcaccaggataattgagca

SEQ ID NO: 49258 - DNA, 25 bp, Homo sapien
cccgtttcaccagtataattgagca

SEQ ID NO: 49259 - DNA, 25 bp, Homo sapien
cccgtttctctagcgctttatttgt

SEQ ID NO: 49260 - DNA, 25 bp, Homo sapien
cccgtttctctagctctttatttgt

SEQ ID NO: 49261 - DNA, 25 bp, Homo sapien
ccctaaaaggaccagcatgttcacc

SEQ ID NO: 49262 - DNA, 25 bp, Homo sapien
ccctaaaaggatcagcatgttcacc

SEQ ID NO: 49263 - DNA, 25 bp, Homo sapien
ccctaaaattatactaatatccctg

SEQ ID NO: 49264 - DNA, 25 bp, Homo sapien
ccctaaaattatcctaatatccctg

SEQ ID NO: 49265 - DNA, 25 bp, Homo sapien
ccctaaatacagcaaagtggttccc

SEQ ID NO: 49266 - DNA, 25 bp, Homo sapien
ccctaaatacagcagagtggttccc

SEQ ID NO: 49267 - DNA, 25 bp, Homo sapien
ccctaacaaaaattgcctggcatat

SEQ ID NO: 49268 - DNA, 25 bp, Homo sapien
ccctaacacaaattgcctggcatat

SEQ ID NO: 49269 - DNA, 25 bp, Homo sapien
ccctaacacatgtattagattgacc

SEQ ID NO: 49270 - DNA, 25 bp, Homo sapien
ccctaacacatgttttagattgacc

SEQ ID NO: 49271 - DNA, 25 bp, Homo sapien
ccctaactgactacaattaggggtt

SEQ ID NO: 49272 - DNA, 25 bp, Homo sapien
ccctaactgactaccattaggggtt

SEQ ID NO: 49273 - DNA, 25 bp, Homo sapien
ccctaagatccacggccgctttagt

SEQ ID NO: 49274 - DNA, 25 bp, Homo sapien
ccctaagatccatggccgctttagt

SEQ ID NO: 49275 - DNA, 25 bp, Homo sapien
ccctaagcttccctcagaacattgc

SEQ ID NO: 49276 - DNA, 25 bp, Homo sapien
ccctaagcttccctcataacattgc

SEQ ID NO: 49277 - DNA, 25 bp, Homo sapien
ccctaagtatgcagagaaaggaaat

SEQ ID NO: 49278 - DNA, 25 bp, Homo sapien
ccctaagtatgcagcgaaaggaaat

SEQ ID NO: 49279 - DNA, 25 bp, Homo sapien
ccctaagtggtaaaatcttgatttc

SEQ ID NO: 49280 - DNA, 25 bp, Homo sapien
ccctaagtggtaagatcttgatttc

SEQ ID NO: 49281 - DNA, 25 bp, Homo sapien
ccctaatcagtgcattctaatagga

SEQ ID NO: 49282 - DNA, 25 bp, Homo sapien
ccctaatcagtgccttctaatagga

SEQ ID NO: 49283 - DNA, 25 bp, Homo sapien
ccctaatgcacccatgcttctaaag

SEQ ID NO: 49284 - DNA, 25 bp, Homo sapien
ccctaatgcacgcatgcttctaaag

SEQ ID NO: 49285 - DNA, 25 bp, Homo sapien
ccctaattttaagcgatctacagtc

SEQ ID NO: 49286 - DNA, 25 bp, Homo sapien
ccctaattttaagtgatctacagtc

SEQ ID NO: 49287 - DNA, 25 bp, Homo sapien
ccctaattttgcaccggagaaaatg

SEQ ID NO: 49288 - DNA, 25 bp, Homo sapien
ccctaattttgcacgggagaaaatg

SEQ ID NO: 49289 - DNA, 25 bp, Homo sapien
ccctacgatgggactctctcaactg

SEQ ID NO: 49290 - DNA, 25 bp, Homo sapien
ccctacgatgggattctctcaactg

SEQ ID NO: 49291 - DNA, 25 bp, Homo sapien
ccctacgcagcgatgttggctccct

SEQ ID NO: 49292 - DNA, 25 bp, Homo sapien
ccctacgcagctatgttggctccct

SEQ ID NO: 49293 - DNA, 25 bp, Homo sapien
ccctactagcgttactgtgtccaca

SEQ ID NO: 49294 - DNA, 25 bp, Homo sapien
ccctactagtgttactgtgtccaca

SEQ ID NO: 49295 - DNA, 25 bp, Homo sapien
ccctactcagccaatgtggtaagca

SEQ ID NO: 49296 - DNA, 25 bp, Homo sapien
ccctactcagccgatgtggtaagca

SEQ ID NO: 49297 - DNA, 25 bp, Homo sapien
ccctacttgcagcggccatagcaga

SEQ ID NO: 49298 - DNA, 25 bp, Homo sapien
ccctacttgcagtggccatagcaga

SEQ ID NO: 49299 - DNA, 25 bp, Homo sapien
ccctagacatcctgacaagtctgag

SEQ ID NO: 49300 - DNA, 25 bp, Homo sapien
ccctagacgtcctgacaagtctgag

SEQ ID NO: 49301 - DNA, 25 bp, Homo sapien
ccctagagcaaggaaaagttataaa

SEQ ID NO: 49302 - DNA, 25 bp, Homo sapien
ccctagagcaagtaaaagttataaa

SEQ ID NO: 49303 - DNA, 25 bp, Homo sapien
ccctagagtagcctcatccacaggg

SEQ ID NO: 49304 - DNA, 25 bp, Homo sapien
ccctagagtagccttatccacaggg

SEQ ID NO: 49305 - DNA, 25 bp, Homo sapien
ccctagcaaaaggagcctcgccctc

SEQ ID NO: 49306 - DNA, 25 bp, Homo sapien
ccctagcagaaggagcctcgccctc

SEQ ID NO: 49307 - DNA, 25 bp, Homo sapien
ccctagctctgtctctatcatctct

SEQ ID NO: 49308 - DNA, 25 bp, Homo sapien
ccctagctctgtctttatcatctct

SEQ ID NO: 49309 - DNA, 25 bp, Homo sapien
ccctaggaagtgtaaaagccagttg

SEQ ID NO: 49310 - DNA, 25 bp, Homo sapien
ccctaggatgtgtaaaagccagttg

SEQ ID NO: 49311 - DNA, 25 bp, Homo sapien
ccctaggcatgaagccattgcatag

SEQ ID NO: 49312 - DNA, 25 bp, Homo sapien
ccctaggcgtgaagccattgcatag

SEQ ID NO: 49313 - DNA, 25 bp, Homo sapien
ccctagggtatagttcttgctctta

SEQ ID NO: 49314 - DNA, 25 bp, Homo sapien
ccctagggtatggttcttgctctta

SEQ ID NO: 49315 - DNA, 25 bp, Homo sapien
ccctagtcaaagagcctgtggacct

SEQ ID NO: 49316 - DNA, 25 bp, Homo sapien
ccctagtcaaatagcctgtggacct

SEQ ID NO: 49317 - DNA, 25 bp, Homo sapien
ccctatcactcctctactcaaaagc

SEQ ID NO: 49318 - DNA, 25 bp, Homo sapien
ccctatcagcagagtcattatacaa

SEQ ID NO: 49319 - DNA, 25 bp, Homo sapien
ccctatcagcagtgtcattatacaa

SEQ ID NO: 49320 - DNA, 25 bp, Homo sapien
ccctatcagtcctctactcaaaagc

SEQ ID NO: 49321 - DNA, 25 bp, Homo sapien
ccctatccctgggcggtcacgttgg

SEQ ID NO: 49322 - DNA, 25 bp, Homo sapien
ccctatccctgggtggtcacgttgg

SEQ ID NO: 49323 - DNA, 25 bp, Homo sapien
ccctatctgaaacattctaatgaat

SEQ ID NO: 49324 - DNA, 25 bp, Homo sapien
ccctatctgaatcattctaatgaat

SEQ ID NO: 49325 - DNA, 25 bp, Homo sapien
ccctatgcttttcatcttcctcaca

SEQ ID NO: 49326 - DNA, 25 bp, Homo sapien
ccctatgctttttatcttcctcaca

SEQ ID NO: 49327 - DNA, 25 bp, Homo sapien
ccctatggcctatggacttactggc

SEQ ID NO: 49328 - DNA, 25 bp, Homo sapien
ccctatggcctgtggacttactggc

SEQ ID NO: 49329 - DNA, 25 bp, Homo sapien
ccctattacttacgcatcacacatc

SEQ ID NO: 49330 - DNA, 25 bp, Homo sapien
ccctattacttatgcatcacacatc

SEQ ID NO: 49331 - DNA, 25 bp, Homo sapien
ccctattcaaccttaagaagctaca

SEQ ID NO: 49332 - DNA, 25 bp, Homo sapien
ccctattcagccttaagaagctaca

SEQ ID NO: 49333 - DNA, 25 bp, Homo sapien
ccctattttgccaagcttagattca

SEQ ID NO: 49334 - DNA, 25 bp, Homo sapien
ccctattttgctaagcttagattca

SEQ ID NO: 49335 - DNA, 25 bp, Homo sapien
ccctatttttgctcgctggttatat

SEQ ID NO: 49336 - DNA, 25 bp, Homo sapien
ccctatttttgcttgctggttatat

SEQ ID NO: 49337 - DNA, 25 bp, Homo sapien
ccctcaaaaaaaatactaggaaact

SEQ ID NO: 49338 - DNA, 25 bp, Homo sapien
ccctcaaaaaaaatgctaggaaact

SEQ ID NO: 49339 - DNA, 25 bp, Homo sapien
ccctcaaacattcttcattatgatc

SEQ ID NO: 49340 - DNA, 25 bp, Homo sapien
ccctcaaacattcttcgttatgatc

SEQ ID NO: 49341 - DNA, 25 bp, Homo sapien
ccctcaacaatgacattaattcatt

SEQ ID NO: 49342 - DNA, 25 bp, Homo sapien
ccctcaacagtgacattaattcatt

SEQ ID NO: 49343 - DNA, 25 bp, Homo sapien
ccctcaagacacgcaatctctgcaa

SEQ ID NO: 49344 - DNA, 25 bp, Homo sapien
ccctcaagacatgcaatctctgcaa

SEQ ID NO: 49345 - DNA, 25 bp, Homo sapien
ccctcaagcgatgccttttccttct

SEQ ID NO: 49346 - DNA, 25 bp, Homo sapien
ccctcaagtgatgccttttccttct

SEQ ID NO: 49347 - DNA, 25 bp, Homo sapien
ccctcacttctcatgttttcttagc

SEQ ID NO: 49348 - DNA, 25 bp, Homo sapien
ccctcacttctcgtgttttcttagc

SEQ ID NO: 49349 - DNA, 25 bp, Homo sapien
ccctcacttctgtggctactgttct

SEQ ID NO: 49350 - DNA, 25 bp, Homo sapien
ccctcacttgtgtggctactgttct

SEQ ID NO: 49351 - DNA, 25 bp, Homo sapien
ccctcagagtttcggaatcagtagg

SEQ ID NO: 49352 - DNA, 25 bp, Homo sapien
ccctcagagttttggaatcagtagg

SEQ ID NO: 49353 - DNA, 25 bp, Homo sapien
ccctcagcacaaagtgtgtaatggc

SEQ ID NO: 49354 - DNA, 25 bp, Homo sapien
ccctcagcgcaaagtgtgtaatggc

SEQ ID NO: 49355 - DNA, 25 bp, Homo sapien
ccctcagctccaaccagaatactgc

SEQ ID NO: 49356 - DNA, 25 bp, Homo sapien
ccctcagctccacccagaatactgc

SEQ ID NO: 49357 - DNA, 25 bp, Homo sapien
ccctcaggcatgtgacttttctatg

SEQ ID NO: 49358 - DNA, 25 bp, Homo sapien
ccctcagggatgtgacttttctatg

SEQ ID NO: 49359 - DNA, 25 bp, Homo sapien
ccctcagtaagactgtaccattcat

SEQ ID NO: 49360 - DNA, 25 bp, Homo sapien
ccctcagtaagactttaccattcat

SEQ ID NO: 49361 - DNA, 25 bp, Homo sapien
ccctcatgcttcaacacccttctcc

SEQ ID NO: 49362 - DNA, 25 bp, Homo sapien
ccctcatgcttcgacacccttctcc

SEQ ID NO: 49363 - DNA, 25 bp, Homo sapien
ccctcattcctaaccatcctcagct

SEQ ID NO: 49364 - DNA, 25 bp, Homo sapien
ccctcattcttaaccatcctcagct

SEQ ID NO: 49365 - DNA, 25 bp, Homo sapien
ccctcattttggcacaattttgcag

SEQ ID NO: 49366 - DNA, 25 bp, Homo sapien
ccctcattttggcacagttttgcag

SEQ ID NO: 49367 - DNA, 25 bp, Homo sapien
ccctccaaacgtaaccctctatcta

SEQ ID NO: 49368 - DNA, 25 bp, Homo sapien
ccctccaaatgtaaccctctatcta

SEQ ID NO: 49369 - DNA, 25 bp, Homo sapien
ccctccaactgcccggctacttctc

SEQ ID NO: 49370 - DNA, 25 bp, Homo sapien
ccctccaactgcctggctacttctc

SEQ ID NO: 49371 - DNA, 25 bp, Homo sapien
ccctccacacgctgagaaagggcca

SEQ ID NO: 49372 - DNA, 25 bp, Homo sapien
ccctccacaggctgagaaagggcca

SEQ ID NO: 49373 - DNA, 25 bp, Homo sapien
ccctccaccgcaaatgtgtatgttg

SEQ ID NO: 49374 - DNA, 25 bp, Homo sapien
ccctccactgcaaatgtgtatgttg

SEQ ID NO: 49375 - DNA, 25 bp, Homo sapien
ccctccagtcttcacctccatcttc

SEQ ID NO: 49376 - DNA, 25 bp, Homo sapien
ccctccagtcttcgcctccatcttc

SEQ ID NO: 49377 - DNA, 25 bp, Homo sapien
ccctcctaatttacttcacatttgc

SEQ ID NO: 49378 - DNA, 25 bp, Homo sapien
ccctcctaatttatttcacatttgc

SEQ ID NO: 49379 - DNA, 25 bp, Homo sapien
ccctcctacctagagcttcgccctc

SEQ ID NO: 49380 - DNA, 25 bp, Homo sapien
ccctcctacctagtgcttcgccctc

SEQ ID NO: 49381 - DNA, 25 bp, Homo sapien
ccctcctctttagtttagtgtgttg

SEQ ID NO: 49382 - DNA, 25 bp, Homo sapien
ccctcctcttttgtttagtgtgttg

SEQ ID NO: 49383 - DNA, 25 bp, Homo sapien
ccctcctgccttggttcttctcaaa

SEQ ID NO: 49384 - DNA, 25 bp, Homo sapien
ccctcctgccttggttgttctcaaa

SEQ ID NO: 49385 - DNA, 25 bp, Homo sapien
ccctcctttgatgtagaaattatgg

SEQ ID NO: 49386 - DNA, 25 bp, Homo sapien
ccctcctttgatgtagcaattatgg

SEQ ID NO: 49387 - DNA, 25 bp, Homo sapien
ccctcctttggctactttcaagatt

SEQ ID NO: 49388 - DNA, 25 bp, Homo sapien
ccctcctttggctattttcaagatt

SEQ ID NO: 49389 - DNA, 25 bp, Homo sapien
ccctcgttcagattcgctccttgtt

SEQ ID NO: 49390 - DNA, 25 bp, Homo sapien
ccctcgttcagatttgctccttgtt

SEQ ID NO: 49391 - DNA, 25 bp, Homo sapien
ccctctaaaagctgctagtactaca

SEQ ID NO: 49392 - DNA, 25 bp, Homo sapien
ccctctaaaagctgctggtactaca

SEQ ID NO: 49393 - DNA, 25 bp, Homo sapien
ccctctagtgtattttgtatagcat

SEQ ID NO: 49394 - DNA, 25 bp, Homo sapien
ccctctagtgtgttttgtatagcat

SEQ ID NO: 49395 - DNA, 25 bp, Homo sapien
ccctctcagccacgaattaacttgc

SEQ ID NO: 49396 - DNA, 25 bp, Homo sapien
ccctctcagccatgaattaacttgc

SEQ ID NO: 49397 - DNA, 25 bp, Homo sapien
ccctctccacatgaacacctgttat

SEQ ID NO: 49398 - DNA, 25 bp, Homo sapien
ccctctccacatggacacctgttat

SEQ ID NO: 49399 - DNA, 25 bp, Homo sapien
ccctctcctctgaagtggtctgttt

SEQ ID NO: 49400 - DNA, 25 bp, Homo sapien
ccctctcctctgaagttgtctgttt

SEQ ID NO: 49401 - DNA, 25 bp, Homo sapien
ccctctctaatgcatcaaatccatg

SEQ ID NO: 49402 - DNA, 25 bp, Homo sapien
ccctctctaatgtatcaaatccatg

SEQ ID NO: 49403 - DNA, 25 bp, Homo sapien
ccctctgcgctgacacgaacatcat

SEQ ID NO: 49404 - DNA, 25 bp, Homo sapien
ccctctgcgttgacacgaacatcat

SEQ ID NO: 49405 - DNA, 25 bp, Homo sapien
ccctctggagatctggtctttatca

SEQ ID NO: 49406 - DNA, 25 bp, Homo sapien
ccctctggagatcttgtctttatca

SEQ ID NO: 49407 - DNA, 25 bp, Homo sapien
ccctctggcctatagaacagcatgc

SEQ ID NO: 49408 - DNA, 25 bp, Homo sapien
ccctctggcctgtagaacagcatgc

SEQ ID NO: 49409 - DNA, 25 bp, Homo sapien
ccctcttaaattgcgaagttgtcaa

SEQ ID NO: 49410 - DNA, 25 bp, Homo sapien
ccctcttaaattgtgaagttgtcaa

SEQ ID NO: 49411 - DNA, 25 bp, Homo sapien
ccctcttcatgcatctttaattcaa

SEQ ID NO: 49412 - DNA, 25 bp, Homo sapien
ccctcttcatggatctttaattcaa

SEQ ID NO: 49413 - DNA, 25 bp, Homo sapien
ccctctttgactcattaatgctgca

SEQ ID NO: 49414 - DNA, 25 bp, Homo sapien
ccctctttgacttattaatgctgca

SEQ ID NO: 49415 - DNA, 25 bp, Homo sapien
ccctcttttcctacttcctctaagt

SEQ ID NO: 49416 - DNA, 25 bp, Homo sapien
ccctcttttcctatttcctctaagt

SEQ ID NO: 49417 - DNA, 25 bp, Homo sapien
ccctgaaacgaatcagaggaaaaag

SEQ ID NO: 49418 - DNA, 25 bp, Homo sapien
ccctgaaatgaatcagaggaaaaag

SEQ ID NO: 49419 - DNA, 25 bp, Homo sapien
ccctgaactcagttgaaccattcag

SEQ ID NO: 49420 - DNA, 25 bp, Homo sapien
ccctgaactcagttgagccattcag

SEQ ID NO: 49421 - DNA, 25 bp, Homo sapien
ccctgaagaaacataagtagcaggc

SEQ ID NO: 49422 - DNA, 25 bp, Homo sapien
ccctgaagaaacgtaagtagcaggc

SEQ ID NO: 49423 - DNA, 25 bp, Homo sapien
ccctgaattgaccatcacataatgt

SEQ ID NO: 49424 - DNA, 25 bp, Homo sapien
ccctgaattgaccgtcacataatgt

SEQ ID NO: 49425 - DNA, 25 bp, Homo sapien
ccctgacgtacatacttgtgttctc

SEQ ID NO: 49426 - DNA, 25 bp, Homo sapien
ccctgacgtgcatacttgtgttctc

SEQ ID NO: 49427 - DNA, 25 bp, Homo sapien
ccctgaggatttaaacggtacagac

SEQ ID NO: 49428 - DNA, 25 bp, Homo sapien
ccctgaggatttaaactgtacagac

SEQ ID NO: 49429 - DNA, 25 bp, Homo sapien
ccctgaggccacataaagttagatc

SEQ ID NO: 49430 - DNA, 25 bp, Homo sapien
ccctgaggccacgtaaagttagatc

SEQ ID NO: 49431 - DNA, 25 bp, Homo sapien
ccctgaggtctgaagtcaccctcct

SEQ ID NO: 49432 - DNA, 25 bp, Homo sapien
ccctgaggtctggagtcaccctcct

SEQ ID NO: 49433 - DNA, 25 bp, Homo sapien
ccctgagtgagaaatgtcaaattga

SEQ ID NO: 49434 - DNA, 25 bp, Homo sapien
ccctgagtgagaactgtcaaattga

SEQ ID NO: 49435 - DNA, 25 bp, Homo sapien
ccctgatactaatgggagacaatct

SEQ ID NO: 49436 - DNA, 25 bp, Homo sapien
ccctgatagactgcaatataagaca

SEQ ID NO: 49437 - DNA, 25 bp, Homo sapien
ccctgataggctgcaatataagaca

SEQ ID NO: 49438 - DNA, 25 bp, Homo sapien
ccctgatagtaatgggagacaatct

SEQ ID NO: 49439 - DNA, 25 bp, Homo sapien
ccctgatgaatgattttgaagggtt

SEQ ID NO: 49440 - DNA, 25 bp, Homo sapien
ccctgatgcatgattttgaagggtt

SEQ ID NO: 49441 - DNA, 25 bp, Homo sapien
ccctgattatttacaagtttctcct

SEQ ID NO: 49442 - DNA, 25 bp, Homo sapien
ccctgattcctataagatttttgtg

SEQ ID NO: 49443 - DNA, 25 bp, Homo sapien
ccctgattcctctaagatttttgtg

SEQ ID NO: 49444 - DNA, 25 bp, Homo sapien
ccctgattctttacaagtttctcct

SEQ ID NO: 49445 - DNA, 25 bp, Homo sapien
ccctgattgattataactctccaac

SEQ ID NO: 49446 - DNA, 25 bp, Homo sapien
ccctgattgtttataactctccaac

SEQ ID NO: 49447 - DNA, 25 bp, Homo sapien
ccctgcaaaatgtgtaatccagcat

SEQ ID NO: 49448 - DNA, 25 bp, Homo sapien
ccctgcaaaatgtgtagtccagcat

SEQ ID NO: 49449 - DNA, 25 bp, Homo sapien
ccctgcaactgagcaaactacgtcc

SEQ ID NO: 49450 - DNA, 25 bp, Homo sapien
ccctgcaagggatccattttcaggt

SEQ ID NO: 49451 - DNA, 25 bp, Homo sapien
ccctgcaaggggtccattttcaggt

SEQ ID NO: 49452 - DNA, 25 bp, Homo sapien
ccctgcaattgagcaaactacgtcc

SEQ ID NO: 49453 - DNA, 25 bp, Homo sapien
ccctgccagttcaacatccttcatt

SEQ ID NO: 49454 - DNA, 25 bp, Homo sapien
ccctgccagttcagcatccttcatt

SEQ ID NO: 49455 - DNA, 25 bp, Homo sapien
ccctgcctcattcccttcaagctct

SEQ ID NO: 49456 - DNA, 25 bp, Homo sapien
ccctgcctcattccgttcaagctct

SEQ ID NO: 49457 - DNA, 25 bp, Homo sapien
ccctgcctctcttatattcttactc

SEQ ID NO: 49458 - DNA, 25 bp, Homo sapien
ccctgcctcttccatgaattacatg

SEQ ID NO: 49459 - DNA, 25 bp, Homo sapien
ccctgcctcttccgtgaattacatg

SEQ ID NO: 49460 - DNA, 25 bp, Homo sapien
ccctgcctggtgcgaccttagctca

SEQ ID NO: 49461 - DNA, 25 bp, Homo sapien
ccctgcctggtgtgaccttagctca

SEQ ID NO: 49462 - DNA, 25 bp, Homo sapien
ccctgcctgtcttatattcttactc

SEQ ID NO: 49463 - DNA, 25 bp, Homo sapien
ccctgcgagacatagcctgtgcctg

SEQ ID NO: 49464 - DNA, 25 bp, Homo sapien
ccctgcgagacgtagcctgtgcctg

SEQ ID NO: 49465 - DNA, 25 bp, Homo sapien
ccctgctccggtgggatttgcagtt

SEQ ID NO: 49466 - DNA, 25 bp, Homo sapien
ccctgctctggtgggatttgcagtt

SEQ ID NO: 49467 - DNA, 25 bp, Homo sapien
ccctgcttagtcatcattagtgcat

SEQ ID NO: 49468 - DNA, 25 bp, Homo sapien
ccctgcttagtcctcattagtgcat

SEQ ID NO: 49469 - DNA, 25 bp, Homo sapien
ccctgcttctgagttagacacactt

SEQ ID NO: 49470 - DNA, 25 bp, Homo sapien
ccctgcttctgggttagacacactt

SEQ ID NO: 49471 - DNA, 25 bp, Homo sapien
ccctgcttgccagatagcatctagt

SEQ ID NO: 49472 - DNA, 25 bp, Homo sapien
ccctgcttgccatatagcatctagt

SEQ ID NO: 49473 - DNA, 25 bp, Homo sapien
ccctggaaaagcgttgggccagccg

SEQ ID NO: 49474 - DNA, 25 bp, Homo sapien
ccctggaaaagtgttgggccagccg

SEQ ID NO: 49475 - DNA, 25 bp, Homo sapien
ccctggaacaacccaacaggctgtg

SEQ ID NO: 49476 - DNA, 25 bp, Homo sapien
ccctggaacaaccctacaggctgtg

SEQ ID NO: 49477 - DNA, 25 bp, Homo sapien
ccctggagcttgcactttagtggaa

SEQ ID NO: 49478 - DNA, 25 bp, Homo sapien
ccctggagcttgtactttagtggaa

SEQ ID NO: 49479 - DNA, 25 bp, Homo sapien
ccctggagtacttcaacatttagag

SEQ ID NO: 49480 - DNA, 25 bp, Homo sapien
ccctggagtcactggtgtagggtct

SEQ ID NO: 49481 - DNA, 25 bp, Homo sapien
ccctggagtcattggtgtagggtct

SEQ ID NO: 49482 - DNA, 25 bp, Homo sapien
ccctggagtcgagtttcacaaagat

SEQ ID NO: 49483 - DNA, 25 bp, Homo sapien
ccctggagtgcttcaacatttagag

SEQ ID NO: 49484 - DNA, 25 bp, Homo sapien
ccctggagttgagtttcacaaagat

SEQ ID NO: 49485 - DNA, 25 bp, Homo sapien
ccctggataactctctataactcct

SEQ ID NO: 49486 - DNA, 25 bp, Homo sapien
ccctggataactctctgtaactcct

SEQ ID NO: 49487 - DNA, 25 bp, Homo sapien
ccctggattgctactaaaaatgcag

SEQ ID NO: 49488 - DNA, 25 bp, Homo sapien
ccctggattgctagtaaaaatgcag

SEQ ID NO: 49489 - DNA, 25 bp, Homo sapien
ccctggcctagtatttaaggtgttc

SEQ ID NO: 49490 - DNA, 25 bp, Homo sapien
ccctggcctggtatttaaggtgttc

SEQ ID NO: 49491 - DNA, 25 bp, Homo sapien
ccctggctgacgtggtgcccatcag

SEQ ID NO: 49492 - DNA, 25 bp, Homo sapien
ccctggctgacgtgttgcccatcag

SEQ ID NO: 49493 - DNA, 25 bp, Homo sapien
ccctgggataaatcgcacttggtca

SEQ ID NO: 49494 - DNA, 25 bp, Homo sapien
ccctgggataaattgcacttggtca

SEQ ID NO: 49495 - DNA, 25 bp, Homo sapien
ccctggtccctgcattctagccact

SEQ ID NO: 49496 - DNA, 25 bp, Homo sapien
ccctggtccctgcgttctagccact

SEQ ID NO: 49497 - DNA, 25 bp, Homo sapien
ccctggtgctgtatgatcctgggca

SEQ ID NO: 49498 - DNA, 25 bp, Homo sapien
ccctggtgctgtgtgatcctgggca

SEQ ID NO: 49499 - DNA, 25 bp, Homo sapien
ccctgtaaccagtcgtcaactctac

SEQ ID NO: 49500 - DNA, 25 bp, Homo sapien
ccctgtaaccagttgtcaactctac

SEQ ID NO: 49501 - DNA, 25 bp, Homo sapien
ccctgtaaggttgcaacagaagatt

SEQ ID NO: 49502 - DNA, 25 bp, Homo sapien
ccctgtaaggttgcaatagaagatt

SEQ ID NO: 49503 - DNA, 25 bp, Homo sapien
ccctgtaatagatgctaataaacat

SEQ ID NO: 49504 - DNA, 25 bp, Homo sapien
ccctgtaatagatgctcataaacat

SEQ ID NO: 49505 - DNA, 25 bp, Homo sapien
ccctgtaatcacagaaaaacgcact

SEQ ID NO: 49506 - DNA, 25 bp, Homo sapien
ccctgtaatcatagaaaaacgcact

SEQ ID NO: 49507 - DNA, 25 bp, Homo sapien
ccctgtattgttcttagaatgtatg

SEQ ID NO: 49508 - DNA, 25 bp, Homo sapien
ccctgtattgtttttagaatgtatg

SEQ ID NO: 49509 - DNA, 25 bp, Homo sapien
ccctgtgacttttggcaggtcacat

SEQ ID NO: 49510 - DNA, 25 bp, Homo sapien
ccctgtgacttttggccggtcacat

SEQ ID NO: 49511 - DNA, 25 bp, Homo sapien
ccctgtgagctggtctgggcatgtg

SEQ ID NO: 49512 - DNA, 25 bp, Homo sapien
ccctgtgatctggtctgggcatgtg

SEQ ID NO: 49513 - DNA, 25 bp, Homo sapien
ccctgtgcagtgccacatttcacag

SEQ ID NO: 49514 - DNA, 25 bp, Homo sapien
ccctgtgcagtgccacgtttcacag

SEQ ID NO: 49515 - DNA, 25 bp, Homo sapien
ccctgtgcatacttcaagcctcatc

SEQ ID NO: 49516 - DNA, 25 bp, Homo sapien
ccctgtgcgtacttcaagcctcatc

SEQ ID NO: 49517 - DNA, 25 bp, Homo sapien
ccctgtggcattaacagtgatgatc

SEQ ID NO: 49518 - DNA, 25 bp, Homo sapien
ccctgtggcgttaacagtgatgatc

SEQ ID NO: 49519 - DNA, 25 bp, Homo sapien
ccctgtgttagacagcccaggaaac

SEQ ID NO: 49520 - DNA, 25 bp, Homo sapien
ccctgtgtttgacagcccaggaaac

SEQ ID NO: 49521 - DNA, 25 bp, Homo sapien
ccctgttcacactagacgtgcctcc

SEQ ID NO: 49522 - DNA, 25 bp, Homo sapien
ccctgttcacactagatgtgcctcc

SEQ ID NO: 49523 - DNA, 25 bp, Homo sapien
ccctgttggccaagtccgagctgtg

SEQ ID NO: 49524 - DNA, 25 bp, Homo sapien
ccctgttggccaagtctgagctgtg

SEQ ID NO: 49525 - DNA, 25 bp, Homo sapien
ccctgtttcacatgacagcccttta

SEQ ID NO: 49526 - DNA, 25 bp, Homo sapien
ccctgtttcacatggcagcccttta

SEQ ID NO: 49527 - DNA, 25 bp, Homo sapien
ccctgtttccaactttctatctcct

SEQ ID NO: 49528 - DNA, 25 bp, Homo sapien
ccctgtttccatctttctatctcct

SEQ ID NO: 49529 - DNA, 25 bp, Homo sapien
cccttaaagaccctttctgctccaa

SEQ ID NO: 49530 - DNA, 25 bp, Homo sapien
cccttaaagactctttctgctccaa

SEQ ID NO: 49531 - DNA, 25 bp, Homo sapien
cccttaactcccagcataatctctg

SEQ ID NO: 49532 - DNA, 25 bp, Homo sapien
cccttaactcctagcataatctctg

SEQ ID NO: 49533 - DNA, 25 bp, Homo sapien
cccttaattttggtttgaaaagcca

SEQ ID NO: 49534 - DNA, 25 bp, Homo sapien
cccttaattttgttttgaaaagcca

SEQ ID NO: 49535 - DNA, 25 bp, Homo sapien
cccttacggttcaacaagcttcccc

SEQ ID NO: 49536 - DNA, 25 bp, Homo sapien
cccttacggttcagcaagcttcccc

SEQ ID NO: 49537 - DNA, 25 bp, Homo sapien
cccttacttgaccactctgattaga

SEQ ID NO: 49538 - DNA, 25 bp, Homo sapien
cccttactttaccactctgattaga

SEQ ID NO: 49539 - DNA, 25 bp, Homo sapien
cccttactttcactttgcatttttt

SEQ ID NO: 49540 - DNA, 25 bp, Homo sapien
cccttactttcattttgcatttttt

SEQ ID NO: 49541 - DNA, 25 bp, Homo sapien
cccttagcatatgactgtctctatt

SEQ ID NO: 49542 - DNA, 25 bp, Homo sapien
cccttagcatatgattgtctctatt

SEQ ID NO: 49543 - DNA, 25 bp, Homo sapien
cccttatcataaatgctagaagact

SEQ ID NO: 49544 - DNA, 25 bp, Homo sapien
cccttatcatacatgctagaagact

SEQ ID NO: 49545 - DNA, 25 bp, Homo sapien
cccttatcttgtcctgactaatggc

SEQ ID NO: 49546 - DNA, 25 bp, Homo sapien
cccttatcttgtcttgactaatggc

SEQ ID NO: 49547 - DNA, 25 bp, Homo sapien
cccttcacaccttacacaccttata

SEQ ID NO: 49548 - DNA, 25 bp, Homo sapien
cccttcacaccttatacaccttata

SEQ ID NO: 49549 - DNA, 25 bp, Homo sapien
cccttcagcctggcatgagttaagt

SEQ ID NO: 49550 - DNA, 25 bp, Homo sapien
cccttcagcctgggatgagttaagt

SEQ ID NO: 49551 - DNA, 25 bp, Homo sapien
cccttcatctttcaagacacagcgc

SEQ ID NO: 49552 - DNA, 25 bp, Homo sapien
cccttcatctttcaaggcacagcgc

SEQ ID NO: 49553 - DNA, 25 bp, Homo sapien
cccttccagctctacaactcactac

SEQ ID NO: 49554 - DNA, 25 bp, Homo sapien
cccttccagctttacaactcactac

SEQ ID NO: 49555 - DNA, 25 bp, Homo sapien
cccttcctccgtaatcattacaaac

SEQ ID NO: 49556 - DNA, 25 bp, Homo sapien
cccttcctctgtaatcattacaaac

SEQ ID NO: 49557 - DNA, 25 bp, Homo sapien
cccttccttagaatagaaggctgtt

SEQ ID NO: 49558 - DNA, 25 bp, Homo sapien
cccttccttagaatggaaggctgtt

SEQ ID NO: 49559 - DNA, 25 bp, Homo sapien
cccttcgaagagcaacatcagacct

SEQ ID NO: 49560 - DNA, 25 bp, Homo sapien
cccttcgaagaggaacatcagacct

SEQ ID NO: 49561 - DNA, 25 bp, Homo sapien
cccttcgtttggaattatcttctag

SEQ ID NO: 49562 - DNA, 25 bp, Homo sapien
cccttcgtttggaattctcttctag

SEQ ID NO: 49563 - DNA, 25 bp, Homo sapien
cccttctatgccatacttatcactg

SEQ ID NO: 49564 - DNA, 25 bp, Homo sapien
cccttctatgccgtacttatcactg

SEQ ID NO: 49565 - DNA, 25 bp, Homo sapien
cccttctcacctgaatctgacagtg

SEQ ID NO: 49566 - DNA, 25 bp, Homo sapien
cccttctcatctgaatctgacagtg

SEQ ID NO: 49567 - DNA, 25 bp, Homo sapien
cccttctctctcatgtatgaacaaa

SEQ ID NO: 49568 - DNA, 25 bp, Homo sapien
cccttctctctcatgtttgaacaaa

SEQ ID NO: 49569 - DNA, 25 bp, Homo sapien
cccttctgccatacatgtgaagtga

SEQ ID NO: 49570 - DNA, 25 bp, Homo sapien
cccttctgtcatacatgtgaagtga

SEQ ID NO: 49571 - DNA, 25 bp, Homo sapien
cccttcttccgttatcaaaactagc

SEQ ID NO: 49572 - DNA, 25 bp, Homo sapien
cccttcttccgttgtcaaaactagc

SEQ ID NO: 49573 - DNA, 25 bp, Homo sapien
cccttcttggagaaaacctgttaat

SEQ ID NO: 49574 - DNA, 25 bp, Homo sapien
cccttcttggagtaaacctgttaat

SEQ ID NO: 49575 - DNA, 25 bp, Homo sapien
cccttgaatcaatgaatgagaacaa

SEQ ID NO: 49576 - DNA, 25 bp, Homo sapien
cccttgaatgaatgaatgagaacaa

SEQ ID NO: 49577 - DNA, 25 bp, Homo sapien
cccttgaatggaatttctggaccag

SEQ ID NO: 49578 - DNA, 25 bp, Homo sapien
cccttgaatggcatttctggaccag

SEQ ID NO: 49579 - DNA, 25 bp, Homo sapien
cccttgcagtgcaacatggagctat

SEQ ID NO: 49580 - DNA, 25 bp, Homo sapien
cccttgcagtgcagcatggagctat

SEQ ID NO: 49581 - DNA, 25 bp, Homo sapien
cccttgcctctgactgaacctgtgc

SEQ ID NO: 49582 - DNA, 25 bp, Homo sapien
cccttgcctctgactgcacctgtgc

SEQ ID NO: 49583 - DNA, 25 bp, Homo sapien
cccttgctcaagataatctactttt

SEQ ID NO: 49584 - DNA, 25 bp, Homo sapien
cccttgctcaaggtaatctactttt

SEQ ID NO: 49585 - DNA, 25 bp, Homo sapien
cccttggaagacagtggtagaaatg

SEQ ID NO: 49586 - DNA, 25 bp, Homo sapien
cccttggaagagagtggtagaaatg

SEQ ID NO: 49587 - DNA, 25 bp, Homo sapien
cccttggcttatggccacatcattc

SEQ ID NO: 49588 - DNA, 25 bp, Homo sapien
cccttggcttatggtcacatcattc

SEQ ID NO: 49589 - DNA, 25 bp, Homo sapien
cccttgggccatgactgaacatcag

SEQ ID NO: 49590 - DNA, 25 bp, Homo sapien
cccttgggccatgattgaacatcag

SEQ ID NO: 49591 - DNA, 25 bp, Homo sapien
cccttgggtgcagagtagatatggt

SEQ ID NO: 49592 - DNA, 25 bp, Homo sapien
cccttgggtgcggagtagatatggt

SEQ ID NO: 49593 - DNA, 25 bp, Homo sapien
cccttggtaaagctacctgagaatc

SEQ ID NO: 49594 - DNA, 25 bp, Homo sapien
cccttggtagagctacctgagaatc

SEQ ID NO: 49595 - DNA, 25 bp, Homo sapien
cccttggtgacaacatcactattta

SEQ ID NO: 49596 - DNA, 25 bp, Homo sapien
cccttggtgacagcatcactattta

SEQ ID NO: 49597 - DNA, 25 bp, Homo sapien
cccttgtacctccactataccatgc

SEQ ID NO: 49598 - DNA, 25 bp, Homo sapien
cccttgtacctccgctataccatgc

SEQ ID NO: 49599 - DNA, 25 bp, Homo sapien
cccttgtatttaaccaatatttaga

SEQ ID NO: 49600 - DNA, 25 bp, Homo sapien
cccttgtatttaaccattatttaga

SEQ ID NO: 49601 - DNA, 25 bp, Homo sapien
cccttgtgaaaaaacattaagttac

SEQ ID NO: 49602 - DNA, 25 bp, Homo sapien
cccttgtgaaaaaatattaagttac

SEQ ID NO: 49603 - DNA, 25 bp, Homo sapien
cccttgttccaataaaacgttacta

SEQ ID NO: 49604 - DNA, 25 bp, Homo sapien
cccttgttccaatagaacgttacta

SEQ ID NO: 49605 - DNA, 25 bp, Homo sapien
ccctttaccaagcaagccaacctca

SEQ ID NO: 49606 - DNA, 25 bp, Homo sapien
ccctttaccgagcaagccaacctca

SEQ ID NO: 49607 - DNA, 25 bp, Homo sapien
ccctttacctgagccaactccccag

SEQ ID NO: 49608 - DNA, 25 bp, Homo sapien
ccctttacctgagccatctccccag

SEQ ID NO: 49609 - DNA, 25 bp, Homo sapien
ccctttattgtgcaagactgccctg

SEQ ID NO: 49610 - DNA, 25 bp, Homo sapien
ccctttattgtgtaagactgccctg

SEQ ID NO: 49611 - DNA, 25 bp, Homo sapien
ccctttccacatattacgtcattta

SEQ ID NO: 49612 - DNA, 25 bp, Homo sapien
ccctttccacatattatgtcattta

SEQ ID NO: 49613 - DNA, 25 bp, Homo sapien
ccctttccattcccagaggagagaa

SEQ ID NO: 49614 - DNA, 25 bp, Homo sapien
ccctttccattcccggaggagagaa

SEQ ID NO: 49615 - DNA, 25 bp, Homo sapien
ccctttcccattctactcaaagcat

SEQ ID NO: 49616 - DNA, 25 bp, Homo sapien
ccctttcccattttactcaaagcat

SEQ ID NO: 49617 - DNA, 25 bp, Homo sapien
ccctttgaatatcgtgtactttatt

SEQ ID NO: 49618 - DNA, 25 bp, Homo sapien
ccctttgaatatggtgtactttatt

SEQ ID NO: 49619 - DNA, 25 bp, Homo sapien
ccctttgccgatggttgggatggca

SEQ ID NO: 49620 - DNA, 25 bp, Homo sapien
ccctttgctgatggttgggatggca

SEQ ID NO: 49621 - DNA, 25 bp, Homo sapien
ccctttggacgcaaatgtacctgac

SEQ ID NO: 49622 - DNA, 25 bp, Homo sapien
ccctttggatgcaaatgtacctgac

SEQ ID NO: 49623 - DNA, 25 bp, Homo sapien
ccctttgtatctcactctgcctccc

SEQ ID NO: 49624 - DNA, 25 bp, Homo sapien
ccctttgtctctcactctgcctccc

SEQ ID NO: 49625 - DNA, 25 bp, Homo sapien
ccctttgtggagtcccagaagcatg

SEQ ID NO: 49626 - DNA, 25 bp, Homo sapien
ccctttgtggagtctcagaagcatg

SEQ ID NO: 49627 - DNA, 25 bp, Homo sapien
cccttttcctgcctccttatttgac

SEQ ID NO: 49628 - DNA, 25 bp, Homo sapien
cccttttcctgcctgcttatttgac

SEQ ID NO: 49629 - DNA, 25 bp, Homo sapien
cccttttcgtgggacgagagcagag

SEQ ID NO: 49630 - DNA, 25 bp, Homo sapien
cccttttcgtgggatgagagcagag

SEQ ID NO: 49631 - DNA, 25 bp, Homo sapien
cccttttctgcatgacagatgaaaa

SEQ ID NO: 49632 - DNA, 25 bp, Homo sapien
cccttttctgcgtgacagatgaaaa

SEQ ID NO: 49633 - DNA, 25 bp, Homo sapien
cccttttgtagcgcaaatcagtagt

SEQ ID NO: 49634 - DNA, 25 bp, Homo sapien
cccttttgtagtgcaaatcagtagt

SEQ ID NO: 49635 - DNA, 25 bp, Homo sapien
ccctttttcgtcagattaattcaca

SEQ ID NO: 49636 - DNA, 25 bp, Homo sapien
ccctttttctcattgactggtgtgg

SEQ ID NO: 49637 - DNA, 25 bp, Homo sapien
ccctttttctcgttgactggtgtgg

SEQ ID NO: 49638 - DNA, 25 bp, Homo sapien
ccctttttcttcagattaattcaca

SEQ ID NO: 49639 - DNA, 25 bp, Homo sapien
ccctttttgacctctcatttcctcc

SEQ ID NO: 49640 - DNA, 25 bp, Homo sapien
ccctttttgacctgtcatttcctcc

SEQ ID NO: 49641 - DNA, 25 bp, Homo sapien
ccctttttttttccttgtgtgtgtg

SEQ ID NO: 49642 - DNA, 25 bp, Homo sapien
cccttttttttttcttgtgtgtgtg

SEQ ID NO: 49643 - DNA, 25 bp, Homo sapien
ccgaaaatgagtgacaccgaaagct

SEQ ID NO: 49644 - DNA, 25 bp, Homo sapien
ccgaaaattagtgacaccgaaagct

SEQ ID NO: 49645 - DNA, 25 bp, Homo sapien
ccgaaagcaggtcaccggaagggct

SEQ ID NO: 49646 - DNA, 25 bp, Homo sapien
ccgaaagcaggtcgccggaagggct

SEQ ID NO: 49647 - DNA, 25 bp, Homo sapien
ccgaaccaatgctcatccagcacgt

SEQ ID NO: 49648 - DNA, 25 bp, Homo sapien
ccgaaccaatgttcatccagcacgt

SEQ ID NO: 49649 - DNA, 25 bp, Homo sapien
ccgaagaggacaatgccacagagaa

SEQ ID NO: 49650 - DNA, 25 bp, Homo sapien
ccgaagaggacagtgccacagagaa

SEQ ID NO: 49651 - DNA, 25 bp, Homo sapien
ccgaaggacaccacattgaacccct

SEQ ID NO: 49652 - DNA, 25 bp, Homo sapien
ccgaaggacaccacgttgaacccct

SEQ ID NO: 49653 - DNA, 25 bp, Homo sapien
ccgaattccgctgtctggtctcaaa

SEQ ID NO: 49654 - DNA, 25 bp, Homo sapien
ccgaattctgctgtctggtctcaaa

SEQ ID NO: 49655 - DNA, 25 bp, Homo sapien
ccgaatttacgaacagctgtggtat

SEQ ID NO: 49656 - DNA, 25 bp, Homo sapien
ccgaatttatgaacagctgtggtat

SEQ ID NO: 49657 - DNA, 25 bp, Homo sapien
ccgacagacaattttaaatagctgt

SEQ ID NO: 49658 - DNA, 25 bp, Homo sapien
ccgacagaccattttaaatagctgt

SEQ ID NO: 49659 - DNA, 25 bp, Homo sapien
ccgacatgggtagtggcctgctggc

SEQ ID NO: 49660 - DNA, 25 bp, Homo sapien
ccgacatgtgtagtggcctgctggc

SEQ ID NO: 49661 - DNA, 25 bp, Homo sapien
ccgacattccgtattagacatatgt

SEQ ID NO: 49662 - DNA, 25 bp, Homo sapien
ccgacattctgtattagacatatgt

SEQ ID NO: 49663 - DNA, 25 bp, Homo sapien
ccgacctgcaccgtgctctcttccc

SEQ ID NO: 49664 - DNA, 25 bp, Homo sapien
ccgacctgcactgtgctctcttccc

SEQ ID NO: 49665 - DNA, 25 bp, Homo sapien
ccgacctgtagctggcctgctttcc

SEQ ID NO: 49666 - DNA, 25 bp, Homo sapien
ccgacctgtggctggcctgctttcc

SEQ ID NO: 49667 - DNA, 25 bp, Homo sapien
ccgacgtgcatcaaccagccttaaa

SEQ ID NO: 49668 - DNA, 25 bp, Homo sapien
ccgacgtgcgtcaaccagccttaaa

SEQ ID NO: 49669 - DNA, 25 bp, Homo sapien
ccgactcaaaacattggattaaaat

SEQ ID NO: 49670 - DNA, 25 bp, Homo sapien
ccgactcagaacattggattaaaat

SEQ ID NO: 49671 - DNA, 25 bp, Homo sapien
ccgacttgactgtggtggataaact

SEQ ID NO: 49672 - DNA, 25 bp, Homo sapien
ccgacttgactgttgtggataaact

SEQ ID NO: 49673 - DNA, 25 bp, Homo sapien
ccgaggtggtcattatcctgatttc

SEQ ID NO: 49674 - DNA, 25 bp, Homo sapien
ccgaggtggtctttatcctgatttc

SEQ ID NO: 49675 - DNA, 25 bp, Homo sapien
ccgagtagcggagccaagatttgac

SEQ ID NO: 49676 - DNA, 25 bp, Homo sapien
ccgagtagtggagccaagatttgac

SEQ ID NO: 49677 - DNA, 25 bp, Homo sapien
ccgagtcctacaataacacatgaca

SEQ ID NO: 49678 - DNA, 25 bp, Homo sapien
ccgagtcctacaattacacatgaca

SEQ ID NO: 49679 - DNA, 25 bp, Homo sapien
ccgagtggtgccgcggctctccctg

SEQ ID NO: 49680 - DNA, 25 bp, Homo sapien
ccgagtggtgctgcggctctccctg

SEQ ID NO: 49681 - DNA, 25 bp, Homo sapien
ccgatagtgtaaaatcaactgtctc

SEQ ID NO: 49682 - DNA, 25 bp, Homo sapien
ccgatagtgtaaaatcgactgtctc

SEQ ID NO: 49683 - DNA, 25 bp, Homo sapien
ccgatatcagtcacatgcaactaag

SEQ ID NO: 49684 - DNA, 25 bp, Homo sapien
ccgatatcagtcacgtgcaactaag

SEQ ID NO: 49685 - DNA, 25 bp, Homo sapien
ccgatattcatgagatatgccatat

SEQ ID NO: 49686 - DNA, 25 bp, Homo sapien
ccgatattcgtgagatatgccatat

SEQ ID NO: 49687 - DNA, 25 bp, Homo sapien
ccgatcacttacctgtttgttctga

SEQ ID NO: 49688 - DNA, 25 bp, Homo sapien
ccgatcacttatctgtttgttctga

SEQ ID NO: 49689 - DNA, 25 bp, Homo sapien
ccgatgttcgtccatgctgaccctc

SEQ ID NO: 49690 - DNA, 25 bp, Homo sapien
ccgatgtttgtccatgctgaccctc

SEQ ID NO: 49691 - DNA, 25 bp, Homo sapien
ccgattagggcagcaataccaattg

SEQ ID NO: 49692 - DNA, 25 bp, Homo sapien
ccgattagggcagcgataccaattg

SEQ ID NO: 49693 - DNA, 25 bp, Homo sapien
ccgcaatgctgtaaataggagtcat

SEQ ID NO: 49694 - DNA, 25 bp, Homo sapien
ccgcaatgctgtaaatcggagtcat

SEQ ID NO: 49695 - DNA, 25 bp, Homo sapien
ccgcagcttttcctgcagtaaagac

SEQ ID NO: 49696 - DNA, 25 bp, Homo sapien
ccgcagcttttcttgcagtaaagac

SEQ ID NO: 49697 - DNA, 25 bp, Homo sapien
ccgcagggggaatttccgcagtgta

SEQ ID NO: 49698 - DNA, 25 bp, Homo sapien
ccgcagggggagtttccgcagtgta

SEQ ID NO: 49699 - DNA, 25 bp, Homo sapien
ccgcatcaaaagaaaggtgaggcct

SEQ ID NO: 49700 - DNA, 25 bp, Homo sapien
ccgcatcaaaaggaaggtgaggcct

SEQ ID NO: 49701 - DNA, 25 bp, Homo sapien
ccgccaatagaagacatccatagga

SEQ ID NO: 49702 - DNA, 25 bp, Homo sapien
ccgccaatagaaggcatccatagga

SEQ ID NO: 49703 - DNA, 25 bp, Homo sapien
ccgccaggaacagatgcccaaaaac

SEQ ID NO: 49704 - DNA, 25 bp, Homo sapien
ccgccaggaacagatgtccaaaaac

SEQ ID NO: 49705 - DNA, 25 bp, Homo sapien
ccgccatcctgagttcctgtgtgac

SEQ ID NO: 49706 - DNA, 25 bp, Homo sapien
ccgccatcttgagttcctgtgtgac

SEQ ID NO: 49707 - DNA, 25 bp, Homo sapien
ccgccctgaaacgaatcagaggaaa

SEQ ID NO: 49708 - DNA, 25 bp, Homo sapien
ccgccctgaaatgaatcagaggaaa

SEQ ID NO: 49709 - DNA, 25 bp, Homo sapien
ccgcctctagcactcttttgcctgc

SEQ ID NO: 49710 - DNA, 25 bp, Homo sapien
ccgcctctagcgctcttttgcctgc

SEQ ID NO: 49711 - DNA, 25 bp, Homo sapien
ccgccttgtcacacgccttataaaa

SEQ ID NO: 49712 - DNA, 25 bp, Homo sapien
ccgccttgttacacgccttataaaa

SEQ ID NO: 49713 - DNA, 25 bp, Homo sapien
ccgctaaagtctgtacccagctacc

SEQ ID NO: 49714 - DNA, 25 bp, Homo sapien
ccgctaaagtctgtactcagctacc

SEQ ID NO: 49715 - DNA, 25 bp, Homo sapien
ccgctaacataatcttataataatg

SEQ ID NO: 49716 - DNA, 25 bp, Homo sapien
ccgctaacatactcttataataatg

SEQ ID NO: 49717 - DNA, 25 bp, Homo sapien
ccgctaccttctattttggtctaat

SEQ ID NO: 49718 - DNA, 25 bp, Homo sapien
ccgctaccttctgttttggtctaat

SEQ ID NO: 49719 - DNA, 25 bp, Homo sapien
ccgctctgtcaacttctctctttcc

SEQ ID NO: 49720 - DNA, 25 bp, Homo sapien
ccgctctgtcagcttctctctttcc

SEQ ID NO: 49721 - DNA, 25 bp, Homo sapien
ccgctgaaccaactcattcaaagat

SEQ ID NO: 49722 - DNA, 25 bp, Homo sapien
ccgctgaatcaactcattcaaagat

SEQ ID NO: 49723 - DNA, 25 bp, Homo sapien
ccgcttgaaaatagccaaaaagtct

SEQ ID NO: 49724 - DNA, 25 bp, Homo sapien
ccgcttgaaaataggcaaaaagtct

SEQ ID NO: 49725 - DNA, 25 bp, Homo sapien
ccgcttggccaatttaaagagaatg

SEQ ID NO: 49726 - DNA, 25 bp, Homo sapien
ccgcttggctaatttaaagagaatg

SEQ ID NO: 49727 - DNA, 25 bp, Homo sapien
ccgctttgccgtgctgattgcttca

SEQ ID NO: 49728 - DNA, 25 bp, Homo sapien
ccgctttgctgtgctgattgcttca

SEQ ID NO: 49729 - DNA, 25 bp, Homo sapien
ccggaagcatacacgcccattggat

SEQ ID NO: 49730 - DNA, 25 bp, Homo sapien
ccggaagcatacatgcccattggat

SEQ ID NO: 49731 - DNA, 25 bp, Homo sapien
ccggaatacatcaattcatcttctt

SEQ ID NO: 49732 - DNA, 25 bp, Homo sapien
ccggaatacatctattcatcttctt

SEQ ID NO: 49733 - DNA, 25 bp, Homo sapien
ccggaccgtcctagctccagagctc

SEQ ID NO: 49734 - DNA, 25 bp, Homo sapien
ccggaccgtcctagttccagagctc

SEQ ID NO: 49735 - DNA, 25 bp, Homo sapien
ccggactggatcccggactaggaaa

SEQ ID NO: 49736 - DNA, 25 bp, Homo sapien
ccggactggatcctggactaggaaa

SEQ ID NO: 49737 - DNA, 25 bp, Homo sapien
ccggaggtagacaggccactaggaa

SEQ ID NO: 49738 - DNA, 25 bp, Homo sapien
ccggaggtagacgggccactaggaa

SEQ ID NO: 49739 - DNA, 25 bp, Homo sapien
ccggatatcagcaccaactaaactt

SEQ ID NO: 49740 - DNA, 25 bp, Homo sapien
ccggatatcagctccaactaaactt

SEQ ID NO: 49741 - DNA, 25 bp, Homo sapien
ccggattactgctgatactacctta

SEQ ID NO: 49742 - DNA, 25 bp, Homo sapien
ccggattactgttgatactacctta

SEQ ID NO: 49743 - DNA, 25 bp, Homo sapien
ccggcaaggatcttaaacagatttg

SEQ ID NO: 49744 - DNA, 25 bp, Homo sapien
ccggcaaggttcttaaacagatttg

SEQ ID NO: 49745 - DNA, 25 bp, Homo sapien
ccggcaatggcgtaacatcaccagg

SEQ ID NO: 49746 - DNA, 25 bp, Homo sapien
ccggcaatggcgtgacatcaccagg

SEQ ID NO: 49747 - DNA, 25 bp, Homo sapien
ccggcaccaaatgccaggaacaacc

SEQ ID NO: 49748 - DNA, 25 bp, Homo sapien
ccggcaccgaatgccaggaacaacc

SEQ ID NO: 49749 - DNA, 25 bp, Homo sapien
ccggcacttttgccatggtcctggt

SEQ ID NO: 49750 - DNA, 25 bp, Homo sapien
ccggcacttttgccattgtcctggt

SEQ ID NO: 49751 - DNA, 25 bp, Homo sapien
ccggcagaatagtgagcgaaaataa

SEQ ID NO: 49752 - DNA, 25 bp, Homo sapien
ccggcagaatagtgcgcgaaaataa

SEQ ID NO: 49753 - DNA, 25 bp, Homo sapien
ccggcataggactgtgacaattaat

SEQ ID NO: 49754 - DNA, 25 bp, Homo sapien
ccggcataggattgtgacaattaat

SEQ ID NO: 49755 - DNA, 25 bp, Homo sapien
ccggcatcatggagaaaaatactca

SEQ ID NO: 49756 - DNA, 25 bp, Homo sapien
ccggcatcctggagaaaaatactca

SEQ ID NO: 49757 - DNA, 25 bp, Homo sapien
ccggcccataatattaaataacatt

SEQ ID NO: 49758 - DNA, 25 bp, Homo sapien
ccggcccatcatattaaataacatt

SEQ ID NO: 49759 - DNA, 25 bp, Homo sapien
ccggcggaactttcatatgctgtac

SEQ ID NO: 49760 - DNA, 25 bp, Homo sapien
ccggcggaactttcatgtgctgtac

SEQ ID NO: 49761 - DNA, 25 bp, Homo sapien
ccggctgcatacatagcagtctgtt

SEQ ID NO: 49762 - DNA, 25 bp, Homo sapien
ccggctgcatacgtagcagtctgtt

SEQ ID NO: 49763 - DNA, 25 bp, Homo sapien
ccgggaaaggaagacaaatggatgt

SEQ ID NO: 49764 - DNA, 25 bp, Homo sapien
ccgggaaaggaagagaaatggatgt

SEQ ID NO: 49765 - DNA, 25 bp, Homo sapien
ccgggacccgcatctgtgcaactcc

SEQ ID NO: 49766 - DNA, 25 bp, Homo sapien
ccgggacccgcatgtgtgcaactcc

SEQ ID NO: 49767 - DNA, 25 bp, Homo sapien
ccgggaggaatgaacaactggagac

SEQ ID NO: 49768 - DNA, 25 bp, Homo sapien
ccgggaggaatgtacaactggagac

SEQ ID NO: 49769 - DNA, 25 bp, Homo sapien
ccgggcagtggcggactgtaacctg

SEQ ID NO: 49770 - DNA, 25 bp, Homo sapien
ccgggcagtggtggactgtaacctg

SEQ ID NO: 49771 - DNA, 25 bp, Homo sapien
ccgggcataaagacttgacattctg

SEQ ID NO: 49772 - DNA, 25 bp, Homo sapien
ccgggcataaaggcttgacattctg

SEQ ID NO: 49773 - DNA, 25 bp, Homo sapien
ccggtgaaacagcgttcggtggcca

SEQ ID NO: 49774 - DNA, 25 bp, Homo sapien
ccggtgaaacagcgtttggtggcca

SEQ ID NO: 49775 - DNA, 25 bp, Homo sapien
ccggtggccaaggcatgaaaatcac

SEQ ID NO: 49776 - DNA, 25 bp, Homo sapien
ccggtggccgaggcatgaaaatcac

SEQ ID NO: 49777 - DNA, 25 bp, Homo sapien
ccgtaaagaagtgccagggagctct

SEQ ID NO: 49778 - DNA, 25 bp, Homo sapien
ccgtaaagaggtgccagggagctct

SEQ ID NO: 49779 - DNA, 25 bp, Homo sapien
ccgtaagtaaccctaaagaaaatcc

SEQ ID NO: 49780 - DNA, 25 bp, Homo sapien
ccgtaagtaaccttaaagaaaatcc

SEQ ID NO: 49781 - DNA, 25 bp, Homo sapien
ccgtattcagatttccccagttgct

SEQ ID NO: 49782 - DNA, 25 bp, Homo sapien
ccgtattcagattttcccagttgct

SEQ ID NO: 49783 - DNA, 25 bp, Homo sapien
ccgtattgttatcgaaaagacaagt

SEQ ID NO: 49784 - DNA, 25 bp, Homo sapien
ccgtattgttatggaaaagacaagt

SEQ ID NO: 49785 - DNA, 25 bp, Homo sapien
ccgtcagaccaagaatttaaaaata

SEQ ID NO: 49786 - DNA, 25 bp, Homo sapien
ccgtcagaccaaggatttaaaaata

SEQ ID NO: 49787 - DNA, 25 bp, Homo sapien
ccgtctatggacacaaaactggtgt

SEQ ID NO: 49788 - DNA, 25 bp, Homo sapien
ccgtctatggactcaaaactggtgt

SEQ ID NO: 49789 - DNA, 25 bp, Homo sapien
ccgtctctccatgacttggtgctca

SEQ ID NO: 49790 - DNA, 25 bp, Homo sapien
ccgtctctccatggcttggtgctca

SEQ ID NO: 49791 - DNA, 25 bp, Homo sapien
ccgtctctgccatcatgacagaaag

SEQ ID NO: 49792 - DNA, 25 bp, Homo sapien
ccgtctctgccttcatgacagaaag

SEQ ID NO: 49793 - DNA, 25 bp, Homo sapien
ccgtcttgactcagcttcatttgtg

SEQ ID NO: 49794 - DNA, 25 bp, Homo sapien
ccgtcttgactgagcttcatttgtg

SEQ ID NO: 49795 - DNA, 25 bp, Homo sapien
ccgtgattacggactattgcccaca

SEQ ID NO: 49796 - DNA, 25 bp, Homo sapien
ccgtgattatggactattgcccaca

SEQ ID NO: 49797 - DNA, 25 bp, Homo sapien
ccgtgcagcaggatggtatacagaa

SEQ ID NO: 49798 - DNA, 25 bp, Homo sapien
ccgtgcagcagggtggtatacagaa

SEQ ID NO: 49799 - DNA, 25 bp, Homo sapien
ccgtgcatcagaacagctggatcca

SEQ ID NO: 49800 - DNA, 25 bp, Homo sapien
ccgtgcatcagaacaggtggatcca

SEQ ID NO: 49801 - DNA, 25 bp, Homo sapien
ccgtgcatccactcaccttatctgt

SEQ ID NO: 49802 - DNA, 25 bp, Homo sapien
ccgtgcatcgactcaccttatctgt

SEQ ID NO: 49803 - DNA, 25 bp, Homo sapien
ccgtgcatttatccttccagaaggt

SEQ ID NO: 49804 - DNA, 25 bp, Homo sapien
ccgtgcatttattcttccagaaggt

SEQ ID NO: 49805 - DNA, 25 bp, Homo sapien
ccgtgcctatttgtctataccagct

SEQ ID NO: 49806 - DNA, 25 bp, Homo sapien
ccgtgcctgtttgtctataccagct

SEQ ID NO: 49807 - DNA, 25 bp, Homo sapien
ccgtggcatagttcacgtgtaatta

SEQ ID NO: 49808 - DNA, 25 bp, Homo sapien
ccgtggcatagttcacttgtaatta

SEQ ID NO: 49809 - DNA, 25 bp, Homo sapien
ccgtggtgctcaccttccagcacca

SEQ ID NO: 49810 - DNA, 25 bp, Homo sapien
ccgtggtgctcactttccagcacca

SEQ ID NO: 49811 - DNA, 25 bp, Homo sapien
ccgtgtcacacaaattcatctttgc

SEQ ID NO: 49812 - DNA, 25 bp, Homo sapien
ccgtgtcacacaagttcatctttgc

SEQ ID NO: 49813 - DNA, 25 bp, Homo sapien
ccgtgtccctagccttgctctgccc

SEQ ID NO: 49814 - DNA, 25 bp, Homo sapien
ccgtgtccctatccttgctctgccc

SEQ ID NO: 49815 - DNA, 25 bp, Homo sapien
ccgtgtgcctgcaattggagggatg

SEQ ID NO: 49816 - DNA, 25 bp, Homo sapien
ccgtgtgcctgtaattggagggatg

SEQ ID NO: 49817 - DNA, 25 bp, Homo sapien
ccgtgttgaaagtggaaccgttagt

SEQ ID NO: 49818 - DNA, 25 bp, Homo sapien
ccgtgttgaaagtggatccgttagt

SEQ ID NO: 49819 - DNA, 25 bp, Homo sapien
ccgttcaggatgaaaagagccatga

SEQ ID NO: 49820 - DNA, 25 bp, Homo sapien
ccgttcagggtgaaaagagccatga

SEQ ID NO: 49821 - DNA, 25 bp, Homo sapien
ccgtttacaaagggaaagaaggatt

SEQ ID NO: 49822 - DNA, 25 bp, Homo sapien
ccgtttaccaagggaaagaaggatt

SEQ ID NO: 49823 - DNA, 25 bp, Homo sapien
ccgtttcaccaggataattgagcag

SEQ ID NO: 49824 - DNA, 25 bp, Homo sapien
ccgtttcaccagtataattgagcag

SEQ ID NO: 49825 - DNA, 25 bp, Homo sapien
cctaaaaatacttctcccatggaca

SEQ ID NO: 49826 - DNA, 25 bp, Homo sapien
cctaaaaatgcttctcccatggaca

SEQ ID NO: 49827 - DNA, 25 bp, Homo sapien
cctaaaagagaacaagacccaatac

SEQ ID NO: 49828 - DNA, 25 bp, Homo sapien
cctaaaagagaacaaggcccaatac

SEQ ID NO: 49829 - DNA, 25 bp, Homo sapien
cctaaaagagtcaagttgcttctgg

SEQ ID NO: 49830 - DNA, 25 bp, Homo sapien
cctaaaagagtcatgttgcttctgg

SEQ ID NO: 49831 - DNA, 25 bp, Homo sapien
cctaaaagtcattgctagagaggct

SEQ ID NO: 49832 - DNA, 25 bp, Homo sapien
cctaaaagtcattgctggagaggct

SEQ ID NO: 49833 - DNA, 25 bp, Homo sapien
cctaaaagtgcacgatttccatcag

SEQ ID NO: 49834 - DNA, 25 bp, Homo sapien
cctaaaagtgcatgatttccatcag

SEQ ID NO: 49835 - DNA, 25 bp, Homo sapien
cctaaaatagagttccccacaggtc

SEQ ID NO: 49836 - DNA, 25 bp, Homo sapien
cctaaaatattttcaaatgatgtgg

SEQ ID NO: 49837 - DNA, 25 bp, Homo sapien
cctaaaatattttcaagtgatgtgg

SEQ ID NO: 49838 - DNA, 25 bp, Homo sapien
cctaaaatggagttccccacaggtc

SEQ ID NO: 49839 - DNA, 25 bp, Homo sapien
cctaaaatgtccacatcctgatccc

SEQ ID NO: 49840 - DNA, 25 bp, Homo sapien
cctaaaatgtccacattctgatccc

SEQ ID NO: 49841 - DNA, 25 bp, Homo sapien
cctaaaattatactaatatccctga

SEQ ID NO: 49842 - DNA, 25 bp, Homo sapien
cctaaaattatcctaatatccctga

SEQ ID NO: 49843 - DNA, 25 bp, Homo sapien
cctaaaattctaaaggactaacttt

SEQ ID NO: 49844 - DNA, 25 bp, Homo sapien
cctaaaattctaagggactaacttt

SEQ ID NO: 49845 - DNA, 25 bp, Homo sapien
cctaaaattctcccaagttaaatcg

SEQ ID NO: 49846 - DNA, 25 bp, Homo sapien
cctaaaatttaataaggcaaatgtt

SEQ ID NO: 49847 - DNA, 25 bp, Homo sapien
cctaaaatttagtaaggcaaatgtt

SEQ ID NO: 49848 - DNA, 25 bp, Homo sapien
cctaaaattttcccaagttaaatcg

SEQ ID NO: 49849 - DNA, 25 bp, Homo sapien
cctaaacacatcaacactccaagtg

SEQ ID NO: 49850 - DNA, 25 bp, Homo sapien
cctaaacacatcgacactccaagtg

SEQ ID NO: 49851 - DNA, 25 bp, Homo sapien
cctaaacagtatgtgaatttctcct

SEQ ID NO: 49852 - DNA, 25 bp, Homo sapien
cctaaacagtatgtgagtttctcct

SEQ ID NO: 49853 - DNA, 25 bp, Homo sapien
cctaaacatctcttgaatctatcac

SEQ ID NO: 49854 - DNA, 25 bp, Homo sapien
cctaaacattcaaaaccaagatgct

SEQ ID NO: 49855 - DNA, 25 bp, Homo sapien
cctaaacattcaaagccaagatgct

SEQ ID NO: 49856 - DNA, 25 bp, Homo sapien
cctaaacatttcttgaatctatcac

SEQ ID NO: 49857 - DNA, 25 bp, Homo sapien
cctaaactgcaattcctccagaatc

SEQ ID NO: 49858 - DNA, 25 bp, Homo sapien
cctaaactgcacttcctccagaatc

SEQ ID NO: 49859 - DNA, 25 bp, Homo sapien
cctaaagaaatgaagatttgtgaat

SEQ ID NO: 49860 - DNA, 25 bp, Homo sapien
cctaaagaaatggagatttgtgaat

SEQ ID NO: 49861 - DNA, 25 bp, Homo sapien
cctaaagcccaaaccaaaaaatcaa

SEQ ID NO: 49862 - DNA, 25 bp, Homo sapien
cctaaagcccaacccaaaaaatcaa

SEQ ID NO: 49863 - DNA, 25 bp, Homo sapien
cctaaagttaatcaatgtctttact

SEQ ID NO: 49864 - DNA, 25 bp, Homo sapien
cctaaagttaatcagtgtctttact

SEQ ID NO: 49865 - DNA, 25 bp, Homo sapien
cctaaatacagcaaagtggttccca

SEQ ID NO: 49866 - DNA, 25 bp, Homo sapien
cctaaatacagcagagtggttccca

SEQ ID NO: 49867 - DNA, 25 bp, Homo sapien
cctaaatagacactaaaaaaaaatt

SEQ ID NO: 49868 - DNA, 25 bp, Homo sapien
cctaaatagacactgaaaaaaaatt

SEQ ID NO: 49869 - DNA, 25 bp, Homo sapien
cctaaatagttacgaaaaacagaag

SEQ ID NO: 49870 - DNA, 25 bp, Homo sapien
cctaaatagttatgaaaaacagaag

SEQ ID NO: 49871 - DNA, 25 bp, Homo sapien
cctaaatctccagcttgccagctta

SEQ ID NO: 49872 - DNA, 25 bp, Homo sapien
cctaaatctccagtttgccagctta

SEQ ID NO: 49873 - DNA, 25 bp, Homo sapien
cctaaatctccgcactgaataggac

SEQ ID NO: 49874 - DNA, 25 bp, Homo sapien
cctaaatctccgcattgaataggac

SEQ ID NO: 49875 - DNA, 25 bp, Homo sapien
cctaaatgacatcatgtgtccacaa

SEQ ID NO: 49876 - DNA, 25 bp, Homo sapien
cctaaatgtcatcatgtgtccacaa

SEQ ID NO: 49877 - DNA, 25 bp, Homo sapien
cctaaattacacaatcatcagataa

SEQ ID NO: 49878 - DNA, 25 bp, Homo sapien
cctaaattacacaatcgtcagataa

SEQ ID NO: 49879 - DNA, 25 bp, Homo sapien
cctaaattgctgcgattacagttgt

SEQ ID NO: 49880 - DNA, 25 bp, Homo sapien
cctaaattgctgtgattacagttgt

SEQ ID NO: 49881 - DNA, 25 bp, Homo sapien
cctaaatttctcagcccagaactga

SEQ ID NO: 49882 - DNA, 25 bp, Homo sapien
cctaaatttctcagtccagaactga

SEQ ID NO: 49883 - DNA, 25 bp, Homo sapien
cctaaattttgcctacctccagttt

SEQ ID NO: 49884 - DNA, 25 bp, Homo sapien
cctaaattttgtctacctccagttt

SEQ ID NO: 49885 - DNA, 25 bp, Homo sapien
cctaacaaacgagtgctggatttat

SEQ ID NO: 49886 - DNA, 25 bp, Homo sapien
cctaacaaatgagtgctggatttat

SEQ ID NO: 49887 - DNA, 25 bp, Homo sapien
cctaacacatgtattagattgacca

SEQ ID NO: 49888 - DNA, 25 bp, Homo sapien
cctaacacatgttttagattgacca

SEQ ID NO: 49889 - DNA, 25 bp, Homo sapien
cctaaccccaagctgcaaagctcac

SEQ ID NO: 49890 - DNA, 25 bp, Homo sapien
cctaaccctaagctgcaaagctcac

SEQ ID NO: 49891 - DNA, 25 bp, Homo sapien
cctaacctaaaatagagttccccac

SEQ ID NO: 49892 - DNA, 25 bp, Homo sapien
cctaacctaaaatggagttccccac

SEQ ID NO: 49893 - DNA, 25 bp, Homo sapien
cctaacctagtgacgaattagtaat

SEQ ID NO: 49894 - DNA, 25 bp, Homo sapien
cctaacctagtgatgaattagtaat

SEQ ID NO: 49895 - DNA, 25 bp, Homo sapien
cctaacctctcagcattgactctcc

SEQ ID NO: 49896 - DNA, 25 bp, Homo sapien
cctaacctttcagcattgactctcc

SEQ ID NO: 49897 - DNA, 25 bp, Homo sapien
cctaactaaacagctccatagtggg

SEQ ID NO: 49898 - DNA, 25 bp, Homo sapien
cctaactaaacggctccatagtggg

SEQ ID NO: 49899 - DNA, 25 bp, Homo sapien
cctaactaaatagcctttcatcttt

SEQ ID NO: 49900 - DNA, 25 bp, Homo sapien
cctaactaaatagcttttcatcttt

SEQ ID NO: 49901 - DNA, 25 bp, Homo sapien
cctaactttcttaaattgtatgaag

SEQ ID NO: 49902 - DNA, 25 bp, Homo sapien
cctaactttcttaagttgtatgaag

SEQ ID NO: 49903 - DNA, 25 bp, Homo sapien
cctaagaatttccgtccttgttgtc

SEQ ID NO: 49904 - DNA, 25 bp, Homo sapien
cctaagaatttctgtccttgttgtc

SEQ ID NO: 49905 - DNA, 25 bp, Homo sapien
cctaagacaccacactctgttggaa

SEQ ID NO: 49906 - DNA, 25 bp, Homo sapien
cctaagacgccacactctgttggaa

SEQ ID NO: 49907 - DNA, 25 bp, Homo sapien
cctaagagatgccggatgttcctat

SEQ ID NO: 49908 - DNA, 25 bp, Homo sapien
cctaagagatgctggatgttcctat

SEQ ID NO: 49909 - DNA, 25 bp, Homo sapien
cctaagataactcaataatctcccc

SEQ ID NO: 49910 - DNA, 25 bp, Homo sapien
cctaagatccacggccgctttagtg

SEQ ID NO: 49911 - DNA, 25 bp, Homo sapien
cctaagatccatggccgctttagtg

SEQ ID NO: 49912 - DNA, 25 bp, Homo sapien
cctaagatgactcaataatctcccc

SEQ ID NO: 49913 - DNA, 25 bp, Homo sapien
cctaagattcaacttcctctgttta

SEQ ID NO: 49914 - DNA, 25 bp, Homo sapien
cctaagattcatcttcctctgttta

SEQ ID NO: 49915 - DNA, 25 bp, Homo sapien
cctaagcaaaattccctaagttttc

SEQ ID NO: 49916 - DNA, 25 bp, Homo sapien
cctaagcaacattccctaagttttc

SEQ ID NO: 49917 - DNA, 25 bp, Homo sapien
cctaagcaagactatctactgctct

SEQ ID NO: 49918 - DNA, 25 bp, Homo sapien
cctaagcacgactatctactgctct

SEQ ID NO: 49919 - DNA, 25 bp, Homo sapien
cctaaggctgccataaaaaatcacc

SEQ ID NO: 49920 - DNA, 25 bp, Homo sapien
cctaaggctgccgtaaaaaatcacc

SEQ ID NO: 49921 - DNA, 25 bp, Homo sapien
cctaagtaatgtccattttacctat

SEQ ID NO: 49922 - DNA, 25 bp, Homo sapien
cctaagtaatgttcattttacctat

SEQ ID NO: 49923 - DNA, 25 bp, Homo sapien
cctaagtatgcagagaaaggaaatg

SEQ ID NO: 49924 - DNA, 25 bp, Homo sapien
cctaagtatgcagcgaaaggaaatg

SEQ ID NO: 49925 - DNA, 25 bp, Homo sapien
cctaagtcacttatctgagtcagcc

SEQ ID NO: 49926 - DNA, 25 bp, Homo sapien
cctaagtcacttctctgagtcagcc

SEQ ID NO: 49927 - DNA, 25 bp, Homo sapien
cctaagtggtaaaatcttgatttct

SEQ ID NO: 49928 - DNA, 25 bp, Homo sapien
cctaagtggtaagatcttgatttct

SEQ ID NO: 49929 - DNA, 25 bp, Homo sapien
cctaagttaacagacattcacaaag

SEQ ID NO: 49930 - DNA, 25 bp, Homo sapien
cctaagttaacaggcattcacaaag

SEQ ID NO: 49931 - DNA, 25 bp, Homo sapien
cctaataaacctgtcctactcaccc

SEQ ID NO: 49932 - DNA, 25 bp, Homo sapien
cctaataagcctgtcctactcaccc

SEQ ID NO: 49933 - DNA, 25 bp, Homo sapien
cctaataatgtatcaccctgaattg

SEQ ID NO: 49934 - DNA, 25 bp, Homo sapien
cctaataatgtatcactctgaattg

SEQ ID NO: 49935 - DNA, 25 bp, Homo sapien
cctaatacagccacctgctaaagga

SEQ ID NO: 49936 - DNA, 25 bp, Homo sapien
cctaatacagccatctgctaaagga

SEQ ID NO: 49937 - DNA, 25 bp, Homo sapien
cctaatagtaaagtcggagttcttt

SEQ ID NO: 49938 - DNA, 25 bp, Homo sapien
cctaatagtaaagttggagttcttt

SEQ ID NO: 49939 - DNA, 25 bp, Homo sapien
cctaatcagcaaagatcaatcaagg

SEQ ID NO: 49940 - DNA, 25 bp, Homo sapien
cctaatcagcagagatcaatcaagg

SEQ ID NO: 49941 - DNA, 25 bp, Homo sapien
cctaatcagtgcattctaataggag

SEQ ID NO: 49942 - DNA, 25 bp, Homo sapien
cctaatcagtgccttctaataggag

SEQ ID NO: 49943 - DNA, 25 bp, Homo sapien
cctaatcatctattaaaggccccac

SEQ ID NO: 49944 - DNA, 25 bp, Homo sapien
cctaatcatctcttaaaggccccac

SEQ ID NO: 49945 - DNA, 25 bp, Homo sapien
cctaatccactgaaaatacaaacca

SEQ ID NO: 49946 - DNA, 25 bp, Homo sapien
cctaatccactgagaatacaaacca

SEQ ID NO: 49947 - DNA, 25 bp, Homo sapien
cctaatcctcgttattggcacattg

SEQ ID NO: 49948 - DNA, 25 bp, Homo sapien
cctaatccttgttattggcacattg

SEQ ID NO: 49949 - DNA, 25 bp, Homo sapien
cctaatcgggacaattgtgaaagtc

SEQ ID NO: 49950 - DNA, 25 bp, Homo sapien
cctaatcgggacagttgtgaaagtc

SEQ ID NO: 49951 - DNA, 25 bp, Homo sapien
cctaatgaatgtccaaagtattcaa

SEQ ID NO: 49952 - DNA, 25 bp, Homo sapien
cctaatgaatgtccgaagtattcaa

SEQ ID NO: 49953 - DNA, 25 bp, Homo sapien
cctaatgtttattatataccagatg

SEQ ID NO: 49954 - DNA, 25 bp, Homo sapien
cctaatgtttattgtataccagatg

SEQ ID NO: 49955 - DNA, 25 bp, Homo sapien
cctaattacttcaccaaaatcaggt

SEQ ID NO: 49956 - DNA, 25 bp, Homo sapien
cctaattatttcaccaaaatcaggt

SEQ ID NO: 49957 - DNA, 25 bp, Homo sapien
cctaattcccacgggtaaacactta

SEQ ID NO: 49958 - DNA, 25 bp, Homo sapien
cctaattcccatgggtaaacactta

SEQ ID NO: 49959 - DNA, 25 bp, Homo sapien
cctaattctcgtcaggccagtcact

SEQ ID NO: 49960 - DNA, 25 bp, Homo sapien
cctaattctcgtcgggccagtcact

SEQ ID NO: 49961 - DNA, 25 bp, Homo sapien
cctaattggcataccttttattttg

SEQ ID NO: 49962 - DNA, 25 bp, Homo sapien
cctaattggcatactttttattttg

SEQ ID NO: 49963 - DNA, 25 bp, Homo sapien
cctaatttacttcacatttgcatat

SEQ ID NO: 49964 - DNA, 25 bp, Homo sapien
cctaatttatttcacatttgcatat

SEQ ID NO: 49965 - DNA, 25 bp, Homo sapien
cctaatttcaatctaagttagccat

SEQ ID NO: 49966 - DNA, 25 bp, Homo sapien
cctaatttcaatgtaagttagccat

SEQ ID NO: 49967 - DNA, 25 bp, Homo sapien
cctaattttaagcgatctacagtct

SEQ ID NO: 49968 - DNA, 25 bp, Homo sapien
cctaattttaagtgatctacagtct

SEQ ID NO: 49969 - DNA, 25 bp, Homo sapien
cctaattttgcaccggagaaaatgg

SEQ ID NO: 49970 - DNA, 25 bp, Homo sapien
cctaattttgcacgggagaaaatgg

SEQ ID NO: 49971 - DNA, 25 bp, Homo sapien
cctacaaaaactcacaaaatgccca

SEQ ID NO: 49972 - DNA, 25 bp, Homo sapien
cctacaaaaactcacacaatgccca

SEQ ID NO: 49973 - DNA, 25 bp, Homo sapien
cctacaaatgcctccgcataccaga

SEQ ID NO: 49974 - DNA, 25 bp, Homo sapien
cctacaaatgcctctgcataccaga

SEQ ID NO: 49975 - DNA, 25 bp, Homo sapien
cctacaacacctctgtctgtgtgct

SEQ ID NO: 49976 - DNA, 25 bp, Homo sapien
cctacaacacctctgtttgtgtgct

SEQ ID NO: 49977 - DNA, 25 bp, Homo sapien
cctacaataacacatgacagagcca

SEQ ID NO: 49978 - DNA, 25 bp, Homo sapien
cctacaatgtctacagatgccagaa

SEQ ID NO: 49979 - DNA, 25 bp, Homo sapien
cctacaatgtctacggatgccagaa

SEQ ID NO: 49980 - DNA, 25 bp, Homo sapien
cctacaattacacatgacagagcca

SEQ ID NO: 49981 - DNA, 25 bp, Homo sapien
cctacacacgccttttgagaaacac

SEQ ID NO: 49982 - DNA, 25 bp, Homo sapien
cctacacatgccttttgagaaacac

SEQ ID NO: 49983 - DNA, 25 bp, Homo sapien
cctacacccatcctcagagctccag

SEQ ID NO: 49984 - DNA, 25 bp, Homo sapien
cctacacccatcttcagagctccag

SEQ ID NO: 49985 - DNA, 25 bp, Homo sapien
cctacacccttcatcacatctgcaa

SEQ ID NO: 49986 - DNA, 25 bp, Homo sapien
cctacacccttcgtcacatctgcaa

SEQ ID NO: 49987 - DNA, 25 bp, Homo sapien
cctacactacagtttggttccaaaa

SEQ ID NO: 49988 - DNA, 25 bp, Homo sapien
cctacactatagtttggttccaaaa

SEQ ID NO: 49989 - DNA, 25 bp, Homo sapien
cctacagaaccacgagctaattaat

SEQ ID NO: 49990 - DNA, 25 bp, Homo sapien
cctacagaaccatgagctaattaat

SEQ ID NO: 49991 - DNA, 25 bp, Homo sapien
cctacagtagacaaacatacccaat

SEQ ID NO: 49992 - DNA, 25 bp, Homo sapien
cctacagtagataaacatacccaat

SEQ ID NO: 49993 - DNA, 25 bp, Homo sapien
cctacatcacacccgaacaggcaaa

SEQ ID NO: 49994 - DNA, 25 bp, Homo sapien
cctacatcacagccgaacaggcaaa

SEQ ID NO: 49995 - DNA, 25 bp, Homo sapien
cctacatgagagattccgacagttt

SEQ ID NO: 49996 - DNA, 25 bp, Homo sapien
cctacatgagagattctgacagttt

SEQ ID NO: 49997 - DNA, 25 bp, Homo sapien
cctacatgataccatctcctctcta

SEQ ID NO: 49998 - DNA, 25 bp, Homo sapien
cctacatgatactatctcctctcta

SEQ ID NO: 49999 - DNA, 25 bp, Homo sapien
cctacatgttccattgctttttctt

SEQ ID NO: 50000 - DNA, 25 bp, Homo sapien
cctacatgttccattgttttttctt

SEQ ID NO: 50001 - DNA, 25 bp, Homo sapien
cctacattagaattagtctacacca

SEQ ID NO: 50002 - DNA, 25 bp, Homo sapien
cctacattagaattggtctacacca

SEQ ID NO: 50003 - DNA, 25 bp, Homo sapien
cctaccacacataacgccaagggga

SEQ ID NO: 50004 - DNA, 25 bp, Homo sapien
cctaccacgcataacgccaagggga

SEQ ID NO: 50005 - DNA, 25 bp, Homo sapien
cctacctagagcttcgccctcatca

SEQ ID NO: 50006 - DNA, 25 bp, Homo sapien
cctacctagtgcttcgccctcatca

SEQ ID NO: 50007 - DNA, 25 bp, Homo sapien
cctacctcagggcctgacttggcat

SEQ ID NO: 50008 - DNA, 25 bp, Homo sapien
cctacctcagggcctgtcttggcat

SEQ ID NO: 50009 - DNA, 25 bp, Homo sapien
cctacctgaacctacgaacaccaca

SEQ ID NO: 50010 - DNA, 25 bp, Homo sapien
cctacctgaccctacgaacaccaca

SEQ ID NO: 50011 - DNA, 25 bp, Homo sapien
cctacctgcaggaagaatgacctcc

SEQ ID NO: 50012 - DNA, 25 bp, Homo sapien
cctacctgcaggaagagtgacctcc

SEQ ID NO: 50013 - DNA, 25 bp, Homo sapien
cctaccttggctcttgacactagag

SEQ ID NO: 50014 - DNA, 25 bp, Homo sapien
cctaccttggctcttggcactagag

SEQ ID NO: 50015 - DNA, 25 bp, Homo sapien
cctacctttcaaaataggagccaaa

SEQ ID NO: 50016 - DNA, 25 bp, Homo sapien
cctacctttcaagaaaatgcacagg

SEQ ID NO: 50017 - DNA, 25 bp, Homo sapien
cctacctttcaagaaactgcacagg

SEQ ID NO: 50018 - DNA, 25 bp, Homo sapien
cctacctttcaatataggagccaaa

SEQ ID NO: 50019 - DNA, 25 bp, Homo sapien
cctacgagctattcttcgtacatat

SEQ ID NO: 50020 - DNA, 25 bp, Homo sapien
cctacgagctattctttgtacatat

SEQ ID NO: 50021 - DNA, 25 bp, Homo sapien
cctacgatgggactctctcaactgt

SEQ ID NO: 50022 - DNA, 25 bp, Homo sapien
cctacgatgggattctctcaactgt

SEQ ID NO: 50023 - DNA, 25 bp, Homo sapien
cctacgctaagtcaacttgtgcaat

SEQ ID NO: 50024 - DNA, 25 bp, Homo sapien
cctacgctaagtcatcttgtgcaat

SEQ ID NO: 50025 - DNA, 25 bp, Homo sapien
cctactactcccatcttgctcactc

SEQ ID NO: 50026 - DNA, 25 bp, Homo sapien
cctactactcccgtcttgctcactc

SEQ ID NO: 50027 - DNA, 25 bp, Homo sapien
cctactagcgttactgtgtccacat

SEQ ID NO: 50028 - DNA, 25 bp, Homo sapien
cctactagtgttactgtgtccacat

SEQ ID NO: 50029 - DNA, 25 bp, Homo sapien
cctactatttttcccacataagcct

SEQ ID NO: 50030 - DNA, 25 bp, Homo sapien
cctactatttttcgcacataagcct

SEQ ID NO: 50031 - DNA, 25 bp, Homo sapien
cctactcagccaatgtggtaagcat

SEQ ID NO: 50032 - DNA, 25 bp, Homo sapien
cctactcagccgatgtggtaagcat

SEQ ID NO: 50033 - DNA, 25 bp, Homo sapien
cctactctctagcatttataggaga

SEQ ID NO: 50034 - DNA, 25 bp, Homo sapien
cctactctctagcgtttataggaga

SEQ ID NO: 50035 - DNA, 25 bp, Homo sapien
cctactgaggcacaaactctaaggt

SEQ ID NO: 50036 - DNA, 25 bp, Homo sapien
cctactgaggcgcaaactctaaggt

SEQ ID NO: 50037 - DNA, 25 bp, Homo sapien
cctactgagtcataatctgcagact

SEQ ID NO: 50038 - DNA, 25 bp, Homo sapien
cctactgagtcgtaatctgcagact

SEQ ID NO: 50039 - DNA, 25 bp, Homo sapien
cctactgcacttccaaatcttgaac

SEQ ID NO: 50040 - DNA, 25 bp, Homo sapien
cctactgcacttctaaatcttgaac

SEQ ID NO: 50041 - DNA, 25 bp, Homo sapien
cctactggaaaaactgtgtccagat

SEQ ID NO: 50042 - DNA, 25 bp, Homo sapien
cctactggaaaaattgtgtccagat

SEQ ID NO: 50043 - DNA, 25 bp, Homo sapien
cctacttaacgttacgccctctcaa

SEQ ID NO: 50044 - DNA, 25 bp, Homo sapien
cctacttaacgttatgccctctcaa

SEQ ID NO: 50045 - DNA, 25 bp, Homo sapien
cctacttaatttctgtatgatttaa

SEQ ID NO: 50046 - DNA, 25 bp, Homo sapien
cctacttaggcacccaagagaaaat

SEQ ID NO: 50047 - DNA, 25 bp, Homo sapien
cctacttaggcacccaggagaaaat

SEQ ID NO: 50048 - DNA, 25 bp, Homo sapien
cctacttattttctgtatgatttaa

SEQ ID NO: 50049 - DNA, 25 bp, Homo sapien
cctacttctccaacaccgtgctctc

SEQ ID NO: 50050 - DNA, 25 bp, Homo sapien
cctacttctccaacactgtgctctc

SEQ ID NO: 50051 - DNA, 25 bp, Homo sapien
cctacttctgtcccatcccaaatca

SEQ ID NO: 50052 - DNA, 25 bp, Homo sapien
cctacttctgtcccgtcccaaatca

SEQ ID NO: 50053 - DNA, 25 bp, Homo sapien
cctacttgcagcggccatagcagaa

SEQ ID NO: 50054 - DNA, 25 bp, Homo sapien
cctacttgcagtggccatagcagaa

SEQ ID NO: 50055 - DNA, 25 bp, Homo sapien
cctacttttaattggcaacaagaaa

SEQ ID NO: 50056 - DNA, 25 bp, Homo sapien
cctacttttaatttgcaacaagaaa

SEQ ID NO: 50057 - DNA, 25 bp, Homo sapien
cctagaagccatgctgaacgtgggg

SEQ ID NO: 50058 - DNA, 25 bp, Homo sapien
cctagaagccatgctggacgtgggg

SEQ ID NO: 50059 - DNA, 25 bp, Homo sapien
cctagaagctcctccaaatgaagct

SEQ ID NO: 50060 - DNA, 25 bp, Homo sapien
cctagaagctcttccaaatgaagct

SEQ ID NO: 50061 - DNA, 25 bp, Homo sapien
cctagaatagtgcatacgttatggt

SEQ ID NO: 50062 - DNA, 25 bp, Homo sapien
cctagaatagttcatacgttatggt

SEQ ID NO: 50063 - DNA, 25 bp, Homo sapien
cctagaatccacagtttacaacgcc

SEQ ID NO: 50064 - DNA, 25 bp, Homo sapien
cctagaatccatagtttacaacgcc

SEQ ID NO: 50065 - DNA, 25 bp, Homo sapien
cctagaccactctgaccttgcccag

SEQ ID NO: 50066 - DNA, 25 bp, Homo sapien
cctagaccactttgaccttgcccag

SEQ ID NO: 50067 - DNA, 25 bp, Homo sapien
cctagactttttcagcaaaacccta

SEQ ID NO: 50068 - DNA, 25 bp, Homo sapien
cctagactttttcagcgaaacccta

SEQ ID NO: 50069 - DNA, 25 bp, Homo sapien
cctagagaacaccaaagattctgcc

SEQ ID NO: 50070 - DNA, 25 bp, Homo sapien
cctagagaacactaaagattctgcc

SEQ ID NO: 50071 - DNA, 25 bp, Homo sapien
cctagagaacgtctttgcataaata

SEQ ID NO: 50072 - DNA, 25 bp, Homo sapien
cctagagaatgtctttgcataaata

SEQ ID NO: 50073 - DNA, 25 bp, Homo sapien
cctagagacggccggagccaggccc

SEQ ID NO: 50074 - DNA, 25 bp, Homo sapien
cctagagagattaaattgcttgtcc

SEQ ID NO: 50075 - DNA, 25 bp, Homo sapien
cctagagagattaagttgcttgtcc

SEQ ID NO: 50076 - DNA, 25 bp, Homo sapien
cctagagatggccggagccaggccc

SEQ ID NO: 50077 - DNA, 25 bp, Homo sapien
cctagagcaagcagaagagacttaa

SEQ ID NO: 50078 - DNA, 25 bp, Homo sapien
cctagagcaagcggaagagacttaa

SEQ ID NO: 50079 - DNA, 25 bp, Homo sapien
cctagagccataatgcaaaataagc

SEQ ID NO: 50080 - DNA, 25 bp, Homo sapien
cctagagccataatgcgaaataagc

SEQ ID NO: 50081 - DNA, 25 bp, Homo sapien
cctagagcccgatgctatccaagat

SEQ ID NO: 50082 - DNA, 25 bp, Homo sapien
cctagagcccgtgagccgggaaaaa

SEQ ID NO: 50083 - DNA, 25 bp, Homo sapien
cctagagcctgtgagccgggaaaaa

SEQ ID NO: 50084 - DNA, 25 bp, Homo sapien
cctagagctcgatgctatccaagat

SEQ ID NO: 50085 - DNA, 25 bp, Homo sapien
cctagaggacaatcctaatctagtc

SEQ ID NO: 50086 - DNA, 25 bp, Homo sapien
cctagaggacaatcttaatctagtc

SEQ ID NO: 50087 - DNA, 25 bp, Homo sapien
cctagaggtaacatcagatcccaca

SEQ ID NO: 50088 - DNA, 25 bp, Homo sapien
cctagaggtaatatcagatcccaca

SEQ ID NO: 50089 - DNA, 25 bp, Homo sapien
cctagagtagcctcatccacagggt

SEQ ID NO: 50090 - DNA, 25 bp, Homo sapien
cctagagtagccttatccacagggt

SEQ ID NO: 50091 - DNA, 25 bp, Homo sapien
cctagatgcaaaagtgtccagaatt

SEQ ID NO: 50092 - DNA, 25 bp, Homo sapien
cctagatgcgaaagtgtccagaatt

SEQ ID NO: 50093 - DNA, 25 bp, Homo sapien
cctagattaagacctgcctggaatg

SEQ ID NO: 50094 - DNA, 25 bp, Homo sapien
cctagattaaggcctgcctggaatg

SEQ ID NO: 50095 - DNA, 25 bp, Homo sapien
cctagattgacccgttagctctccc

SEQ ID NO: 50096 - DNA, 25 bp, Homo sapien
cctagattgacctgttagctctccc

SEQ ID NO: 50097 - DNA, 25 bp, Homo sapien
cctagattttttggtttacaaagtt

SEQ ID NO: 50098 - DNA, 25 bp, Homo sapien
cctagatttttttgtttacaaagtt

SEQ ID NO: 50099 - DNA, 25 bp, Homo sapien
cctagcagaattcacgccctgctaa

SEQ ID NO: 50100 - DNA, 25 bp, Homo sapien
cctagcagaattcatgccctgctaa

SEQ ID NO: 50101 - DNA, 25 bp, Homo sapien
cctagcataataaagatacgtaggt

SEQ ID NO: 50102 - DNA, 25 bp, Homo sapien
cctagcataatacagatacgtaggt

SEQ ID NO: 50103 - DNA, 25 bp, Homo sapien
cctagccttgatccagaagattttt

SEQ ID NO: 50104 - DNA, 25 bp, Homo sapien
cctagccttgatccagcagattttt

SEQ ID NO: 50105 - DNA, 25 bp, Homo sapien
cctagctctgtctctatcatctcta

SEQ ID NO: 50106 - DNA, 25 bp, Homo sapien
cctagctctgtctttatcatctcta

SEQ ID NO: 50107 - DNA, 25 bp, Homo sapien
cctagctgcccatgtctgagccttg

SEQ ID NO: 50108 - DNA, 25 bp, Homo sapien
cctagctgcccttgtctgagccttg

SEQ ID NO: 50109 - DNA, 25 bp, Homo sapien
cctaggaacttgttaaattgttgtg

SEQ ID NO: 50110 - DNA, 25 bp, Homo sapien
cctaggaacttgttaatttgttgtg

SEQ ID NO: 50111 - DNA, 25 bp, Homo sapien
cctaggcaagcacagaatgcccatg

SEQ ID NO: 50112 - DNA, 25 bp, Homo sapien
cctaggcaagcacggaatgcccatg

SEQ ID NO: 50113 - DNA, 25 bp, Homo sapien
cctaggctaatctaagtcagccatc

SEQ ID NO: 50114 - DNA, 25 bp, Homo sapien
cctaggctaatctatgtcagccatc

SEQ ID NO: 50115 - DNA, 25 bp, Homo sapien
cctaggctggagaagacacagggag

SEQ ID NO: 50116 - DNA, 25 bp, Homo sapien
cctaggctggagaagatacagggag

SEQ ID NO: 50117 - DNA, 25 bp, Homo sapien
cctaggcttttcctgaacaatagtg

SEQ ID NO: 50118 - DNA, 25 bp, Homo sapien
cctaggcttttcttgaacaatagtg

SEQ ID NO: 50119 - DNA, 25 bp, Homo sapien
cctagggaactatgtaaattgattg

SEQ ID NO: 50120 - DNA, 25 bp, Homo sapien
cctagggaactatttaaattgattg

SEQ ID NO: 50121 - DNA, 25 bp, Homo sapien
cctaggtgcgctttctcgactgtct

SEQ ID NO: 50122 - DNA, 25 bp, Homo sapien
cctaggtgctctttctcgactgtct

SEQ ID NO: 50123 - DNA, 25 bp, Homo sapien
cctaggtgttcaaattcattcatca

SEQ ID NO: 50124 - DNA, 25 bp, Homo sapien
cctaggtgttcacattcattcatca

SEQ ID NO: 50125 - DNA, 25 bp, Homo sapien
cctaggttgtaattcgtatcactgc

SEQ ID NO: 50126 - DNA, 25 bp, Homo sapien
cctaggttgtaatttgtatcactgc

SEQ ID NO: 50127 - DNA, 25 bp, Homo sapien
cctagtagaaggcgcttaccatatt

SEQ ID NO: 50128 - DNA, 25 bp, Homo sapien
cctagtagaaggtgcttaccatatt

SEQ ID NO: 50129 - DNA, 25 bp, Homo sapien
cctagtcaaagtagttgggatggtg

SEQ ID NO: 50130 - DNA, 25 bp, Homo sapien
cctagtcaaagtggttgggatggtg

SEQ ID NO: 50131 - DNA, 25 bp, Homo sapien
cctagtcccgattcttgcttctact

SEQ ID NO: 50132 - DNA, 25 bp, Homo sapien
cctagtcctgattcttgcttctact

SEQ ID NO: 50133 - DNA, 25 bp, Homo sapien
cctagtcctgcaaagttctgttcca

SEQ ID NO: 50134 - DNA, 25 bp, Homo sapien
cctagtcctgcgaagttctgttcca

SEQ ID NO: 50135 - DNA, 25 bp, Homo sapien
cctagtctcaacacatgaggaataa

SEQ ID NO: 50136 - DNA, 25 bp, Homo sapien
cctagtcttaacacatgaggaataa

SEQ ID NO: 50137 - DNA, 25 bp, Homo sapien
cctagtgacgaattagtaatattgt

SEQ ID NO: 50138 - DNA, 25 bp, Homo sapien
cctagtgatgaattagtaatattgt

SEQ ID NO: 50139 - DNA, 25 bp, Homo sapien
cctagtggccaatgaacattggatg

SEQ ID NO: 50140 - DNA, 25 bp, Homo sapien
cctagtggccagttacatttctcat

SEQ ID NO: 50141 - DNA, 25 bp, Homo sapien
cctagtggccagttgcatttctcat

SEQ ID NO: 50142 - DNA, 25 bp, Homo sapien
cctagtggctaatgaacattggatg

SEQ ID NO: 50143 - DNA, 25 bp, Homo sapien
cctagtggtgttctctctctactgc

SEQ ID NO: 50144 - DNA, 25 bp, Homo sapien
cctagtggtgttctgtctctactgc

SEQ ID NO: 50145 - DNA, 25 bp, Homo sapien
cctagtgtgtcagcatgtgacctta

SEQ ID NO: 50146 - DNA, 25 bp, Homo sapien
cctagtgtgtcagcgtgtgacctta

SEQ ID NO: 50147 - DNA, 25 bp, Homo sapien
cctagtttgcacagttcgaggctca

SEQ ID NO: 50148 - DNA, 25 bp, Homo sapien
cctagtttgcacagtttgaggctca

SEQ ID NO: 50149 - DNA, 25 bp, Homo sapien
cctataaaactcctagatcataaca

SEQ ID NO: 50150 - DNA, 25 bp, Homo sapien
cctataaaactcttagatcataaca

SEQ ID NO: 50151 - DNA, 25 bp, Homo sapien
cctataaatcaggcattcgaggcaa

SEQ ID NO: 50152 - DNA, 25 bp, Homo sapien
cctataaatcaggtattcgaggcaa

SEQ ID NO: 50153 - DNA, 25 bp, Homo sapien
cctataattggatagataagacagg

SEQ ID NO: 50154 - DNA, 25 bp, Homo sapien
cctataattggatggataagacagg

SEQ ID NO: 50155 - DNA, 25 bp, Homo sapien
cctatacattctttcaattctgtcc

SEQ ID NO: 50156 - DNA, 25 bp, Homo sapien
cctatacattctttcagttctgtcc

SEQ ID NO: 50157 - DNA, 25 bp, Homo sapien
cctatagaaagtctcttatgccatg

SEQ ID NO: 50158 - DNA, 25 bp, Homo sapien
cctatagaaagtcttttatgccatg

SEQ ID NO: 50159 - DNA, 25 bp, Homo sapien
cctatagaacataaacccatgcatt

SEQ ID NO: 50160 - DNA, 25 bp, Homo sapien
cctatagaatataaacccatgcatt

SEQ ID NO: 50161 - DNA, 25 bp, Homo sapien
cctatagagcatttcaggaatggat

SEQ ID NO: 50162 - DNA, 25 bp, Homo sapien
cctatagagcatttgaggaatggat

SEQ ID NO: 50163 - DNA, 25 bp, Homo sapien
cctataggaactagaaaatcaagga

SEQ ID NO: 50164 - DNA, 25 bp, Homo sapien
cctataggagctagaaaatcaagga

SEQ ID NO: 50165 - DNA, 25 bp, Homo sapien
cctatatttcgaaggtgacacatta

SEQ ID NO: 50166 - DNA, 25 bp, Homo sapien
cctatattttgaaggtgacacatta

SEQ ID NO: 50167 - DNA, 25 bp, Homo sapien
cctatcaaaaaattgtgtcttacag

SEQ ID NO: 50168 - DNA, 25 bp, Homo sapien
cctatcaaagaattgtgtcttacag

SEQ ID NO: 50169 - DNA, 25 bp, Homo sapien
cctatcaaattgtgttacaacattt

SEQ ID NO: 50170 - DNA, 25 bp, Homo sapien
cctatcaatttgtgttacaacattt

SEQ ID NO: 50171 - DNA, 25 bp, Homo sapien
cctatcagcagagtcattatacaat

SEQ ID NO: 50172 - DNA, 25 bp, Homo sapien
cctatcagcagtgtcattatacaat

SEQ ID NO: 50173 - DNA, 25 bp, Homo sapien
cctatccaactggcagcactgtagg

SEQ ID NO: 50174 - DNA, 25 bp, Homo sapien
cctatccaactgggagcactgtagg

SEQ ID NO: 50175 - DNA, 25 bp, Homo sapien
cctatccagtctcactgcttcatct

SEQ ID NO: 50176 - DNA, 25 bp, Homo sapien
cctatccagtctcattgcttcatct

SEQ ID NO: 50177 - DNA, 25 bp, Homo sapien
cctatccctgggcggtcacgttggc

SEQ ID NO: 50178 - DNA, 25 bp, Homo sapien
cctatccctgggtggtcacgttggc

SEQ ID NO: 50179 - DNA, 25 bp, Homo sapien
cctatccttctgtggacagtgaaac

SEQ ID NO: 50180 - DNA, 25 bp, Homo sapien
cctatccttgaaaaatgatagcatg

SEQ ID NO: 50181 - DNA, 25 bp, Homo sapien
cctatccttgaacaatgatagcatg

SEQ ID NO: 50182 - DNA, 25 bp, Homo sapien
cctatccttttaattgcttatagtg

SEQ ID NO: 50183 - DNA, 25 bp, Homo sapien
cctatccttttatttgcttatagtg

SEQ ID NO: 50184 - DNA, 25 bp, Homo sapien
cctatccttttgtggacagtgaaac

SEQ ID NO: 50185 - DNA, 25 bp, Homo sapien
cctatctcagcccttatcatgcctt

SEQ ID NO: 50186 - DNA, 25 bp, Homo sapien
cctatctcagctcttatcatgcctt

SEQ ID NO: 50187 - DNA, 25 bp, Homo sapien
cctatctgcacttcatttaaatgct

SEQ ID NO: 50188 - DNA, 25 bp, Homo sapien
cctatctgcactttatttaaatgct

SEQ ID NO: 50189 - DNA, 25 bp, Homo sapien
cctatctgccttctataactccata

SEQ ID NO: 50190 - DNA, 25 bp, Homo sapien
cctatctgccttctgtaactccata

SEQ ID NO: 50191 - DNA, 25 bp, Homo sapien
cctatgagtacactttacaggccaa

SEQ ID NO: 50192 - DNA, 25 bp, Homo sapien
cctatgagtacgctttacaggccaa

SEQ ID NO: 50193 - DNA, 25 bp, Homo sapien
cctatgcacacccatctgtcatttg

SEQ ID NO: 50194 - DNA, 25 bp, Homo sapien
cctatgcacgcccatctgtcatttg

SEQ ID NO: 50195 - DNA, 25 bp, Homo sapien
cctatgcttttcatcttcctcacat

SEQ ID NO: 50196 - DNA, 25 bp, Homo sapien
cctatgctttttatcttcctcacat

SEQ ID NO: 50197 - DNA, 25 bp, Homo sapien
cctatggctccaaaggtcttaataa

SEQ ID NO: 50198 - DNA, 25 bp, Homo sapien
cctatggcttcaaaggtcttaataa

SEQ ID NO: 50199 - DNA, 25 bp, Homo sapien
cctatggttacacgtccttccctgg

SEQ ID NO: 50200 - DNA, 25 bp, Homo sapien
cctatggttacatgtccttccctgg

SEQ ID NO: 50201 - DNA, 25 bp, Homo sapien
cctatgtaacattgctaaaagtcct

SEQ ID NO: 50202 - DNA, 25 bp, Homo sapien
cctatgtaacattgctcaaagtcct

SEQ ID NO: 50203 - DNA, 25 bp, Homo sapien
cctatgtacggtgttcatcaattcc

SEQ ID NO: 50204 - DNA, 25 bp, Homo sapien
cctatgtacggtgttcgtcaattcc

SEQ ID NO: 50205 - DNA, 25 bp, Homo sapien
cctatgtcatatggcccaacgttac

SEQ ID NO: 50206 - DNA, 25 bp, Homo sapien
cctatgtcgtatggcccaacgttac

SEQ ID NO: 50207 - DNA, 25 bp, Homo sapien
cctatgtctatatctaagagaaaga

SEQ ID NO: 50208 - DNA, 25 bp, Homo sapien
cctatgtctgtatctaagagaaaga

SEQ ID NO: 50209 - DNA, 25 bp, Homo sapien
cctattaatccatcggcctcctgtc

SEQ ID NO: 50210 - DNA, 25 bp, Homo sapien
cctattaatccatctgcctcctgtc

SEQ ID NO: 50211 - DNA, 25 bp, Homo sapien
cctattcaaccttaagaagctacag

SEQ ID NO: 50212 - DNA, 25 bp, Homo sapien
cctattcaatggatgtcaacttttt

SEQ ID NO: 50213 - DNA, 25 bp, Homo sapien
cctattcaatggatgttaacttttt

SEQ ID NO: 50214 - DNA, 25 bp, Homo sapien
cctattcagaattaggatgacaccg

SEQ ID NO: 50215 - DNA, 25 bp, Homo sapien
cctattcagccttaagaagctacag

SEQ ID NO: 50216 - DNA, 25 bp, Homo sapien
cctattcaggattaggatgacaccg

SEQ ID NO: 50217 - DNA, 25 bp, Homo sapien
cctattcatatgtggcctgcttaat

SEQ ID NO: 50218 - DNA, 25 bp, Homo sapien
cctattcatcacggcatctttcatt

SEQ ID NO: 50219 - DNA, 25 bp, Homo sapien
cctattcatcacggtatctttcatt

SEQ ID NO: 50220 - DNA, 25 bp, Homo sapien
cctattcatgtgtggcctgcttaat

SEQ ID NO: 50221 - DNA, 25 bp, Homo sapien
cctattccagggtgacagactccta

SEQ ID NO: 50222 - DNA, 25 bp, Homo sapien
cctattccagggtggcagactccta

SEQ ID NO: 50223 - DNA, 25 bp, Homo sapien
cctattccgctcctgtctcaacaga

SEQ ID NO: 50224 - DNA, 25 bp, Homo sapien
cctattccgctcctgtgtcaacaga

SEQ ID NO: 50225 - DNA, 25 bp, Homo sapien
cctattcctatgcttctacctatgg

SEQ ID NO: 50226 - DNA, 25 bp, Homo sapien
cctattcctattcttctacctatgg

SEQ ID NO: 50227 - DNA, 25 bp, Homo sapien
cctattgcagtaaccacgatggcag

SEQ ID NO: 50228 - DNA, 25 bp, Homo sapien
cctattgcagtaaccatgatggcag

SEQ ID NO: 50229 - DNA, 25 bp, Homo sapien
cctattgctcagatgtccccctggt

SEQ ID NO: 50230 - DNA, 25 bp, Homo sapien
cctattgctcagatgttcccctggt

SEQ ID NO: 50231 - DNA, 25 bp, Homo sapien
cctatttcacacatacagaagacat

SEQ ID NO: 50232 - DNA, 25 bp, Homo sapien
cctatttcgcacatacagaagacat

SEQ ID NO: 50233 - DNA, 25 bp, Homo sapien
cctattttacaggtggctgaataac

SEQ ID NO: 50234 - DNA, 25 bp, Homo sapien
cctattttagaggtggctgaataac

SEQ ID NO: 50235 - DNA, 25 bp, Homo sapien
cctatttttgctcgctggttatatc

SEQ ID NO: 50236 - DNA, 25 bp, Homo sapien
cctatttttgcttgctggttatatc

SEQ ID NO: 50237 - DNA, 25 bp, Homo sapien
cctcaaaacattctatcttgtaatc

SEQ ID NO: 50238 - DNA, 25 bp, Homo sapien
cctcaaaacattctgtcttgtaatc

SEQ ID NO: 50239 - DNA, 25 bp, Homo sapien
cctcaaaacctgcaaatatgttatc

SEQ ID NO: 50240 - DNA, 25 bp, Homo sapien
cctcaaaacctgcgaatatgttatc

SEQ ID NO: 50241 - DNA, 25 bp, Homo sapien
cctcaaaagttccaagagagtgtaa

SEQ ID NO: 50242 - DNA, 25 bp, Homo sapien
cctcaaaagttccaagggagtgtaa

SEQ ID NO: 50243 - DNA, 25 bp, Homo sapien
cctcaaactctgaatatgcaatatt

SEQ ID NO: 50244 - DNA, 25 bp, Homo sapien
cctcaaactctgtatatgcaatatt

SEQ ID NO: 50245 - DNA, 25 bp, Homo sapien
cctcaaacttgtgtttcatgaatcc

SEQ ID NO: 50246 - DNA, 25 bp, Homo sapien
cctcaaacttgtgttttatgaatcc

SEQ ID NO: 50247 - DNA, 25 bp, Homo sapien
cctcaaagaaggttcagttggatat

SEQ ID NO: 50248 - DNA, 25 bp, Homo sapien
cctcaaagaagtttcagttggatat

SEQ ID NO: 50249 - DNA, 25 bp, Homo sapien
cctcaaatcctggctttgctacttt

SEQ ID NO: 50250 - DNA, 25 bp, Homo sapien
cctcaaatcctgggtttgctacttt

SEQ ID NO: 50251 - DNA, 25 bp, Homo sapien
cctcaaatctatgtgtatagtcgac

SEQ ID NO: 50252 - DNA, 25 bp, Homo sapien
cctcaaatctatttgtatagtcgac

SEQ ID NO: 50253 - DNA, 25 bp, Homo sapien
cctcaaatgatacttatgactttaa

SEQ ID NO: 50254 - DNA, 25 bp, Homo sapien
cctcaaatgatagttatgactttaa

SEQ ID NO: 50255 - DNA, 25 bp, Homo sapien
cctcaaattagttaactccaaattt

SEQ ID NO: 50256 - DNA, 25 bp, Homo sapien
cctcaaattagttatctccaaattt

SEQ ID NO: 50257 - DNA, 25 bp, Homo sapien
cctcaaattctcagccaaagaccct

SEQ ID NO: 50258 - DNA, 25 bp, Homo sapien
cctcaaattctcggccaaagaccct

SEQ ID NO: 50259 - DNA, 25 bp, Homo sapien
cctcaacaagccaaattcagtgaat

SEQ ID NO: 50260 - DNA, 25 bp, Homo sapien
cctcaacaggccaaattcagtgaat

SEQ ID NO: 50261 - DNA, 25 bp, Homo sapien
cctcaacctacattgagaagtacgc

SEQ ID NO: 50262 - DNA, 25 bp, Homo sapien
cctcaacctacatttagaagtacgc

SEQ ID NO: 50263 - DNA, 25 bp, Homo sapien
cctcaagccaataaaagcccgaaag

SEQ ID NO: 50264 - DNA, 25 bp, Homo sapien
cctcaagccaatgaaagcccgaaag

SEQ ID NO: 50265 - DNA, 25 bp, Homo sapien
cctcaaggaagatgtaagtaattta

SEQ ID NO: 50266 - DNA, 25 bp, Homo sapien
cctcaaggaggatgtaagtaattta

SEQ ID NO: 50267 - DNA, 25 bp, Homo sapien
cctcaaggctgagacccgctgtgtt

SEQ ID NO: 50268 - DNA, 25 bp, Homo sapien
cctcaaggctgagacctgctgtgtt

SEQ ID NO: 50269 - DNA, 25 bp, Homo sapien
cctcaagtacccaaaacagaccctg

SEQ ID NO: 50270 - DNA, 25 bp, Homo sapien
cctcaagtacctaaaacagaccctg

SEQ ID NO: 50271 - DNA, 25 bp, Homo sapien
cctcaagtcggcattccttcttgta

SEQ ID NO: 50272 - DNA, 25 bp, Homo sapien
cctcaagtgatgcaccggtctcggc

SEQ ID NO: 50273 - DNA, 25 bp, Homo sapien
cctcaagtgatgtaccggtctcggc

SEQ ID NO: 50274 - DNA, 25 bp, Homo sapien
cctcaagttggcattccttcttgta

SEQ ID NO: 50275 - DNA, 25 bp, Homo sapien
cctcaatccaggtctctgcaggctg

SEQ ID NO: 50276 - DNA, 25 bp, Homo sapien
cctcaatccgggtctctgcaggctg

SEQ ID NO: 50277 - DNA, 25 bp, Homo sapien
cctcaatctccctgttatagaaagt

SEQ ID NO: 50278 - DNA, 25 bp, Homo sapien
cctcaatcttcctgttatagaaagt

SEQ ID NO: 50279 - DNA, 25 bp, Homo sapien
cctcaatgtaggacttcatatttca

SEQ ID NO: 50280 - DNA, 25 bp, Homo sapien
cctcaatgtgggacttcatatttca

SEQ ID NO: 50281 - DNA, 25 bp, Homo sapien
cctcaattaaagtaatagcatctca

SEQ ID NO: 50282 - DNA, 25 bp, Homo sapien
cctcaattacagtaatagcatctca

SEQ ID NO: 50283 - DNA, 25 bp, Homo sapien
cctcaatttgcaatcaatcaccaag

SEQ ID NO: 50284 - DNA, 25 bp, Homo sapien
cctcaatttgcaatcagtcaccaag

SEQ ID NO: 50285 - DNA, 25 bp, Homo sapien
cctcaatttttttcgttttaatcca

SEQ ID NO: 50286 - DNA, 25 bp, Homo sapien
cctcaatttttttctttttaatcca

SEQ ID NO: 50287 - DNA, 25 bp, Homo sapien
cctcacaaaatggcacatcccgccc

SEQ ID NO: 50288 - DNA, 25 bp, Homo sapien
cctcacaaaatggctcatcccgccc

SEQ ID NO: 50289 - DNA, 25 bp, Homo sapien
cctcacaggcacatagaaaattagg

SEQ ID NO: 50290 - DNA, 25 bp, Homo sapien
cctcacagtcacatagaaaattagg

SEQ ID NO: 50291 - DNA, 25 bp, Homo sapien
cctcacatcctaaaaacggtactgg

SEQ ID NO: 50292 - DNA, 25 bp, Homo sapien
cctcacatcctgaaaacggtactgg

SEQ ID NO: 50293 - DNA, 25 bp, Homo sapien
cctcacattgtcctccttggttaca

SEQ ID NO: 50294 - DNA, 25 bp, Homo sapien
cctcacattgttctccttggttaca

SEQ ID NO: 50295 - DNA, 25 bp, Homo sapien
cctcacctaaccccaagctgcaaag

SEQ ID NO: 50296 - DNA, 25 bp, Homo sapien
cctcacctaaccctaagctgcaaag

SEQ ID NO: 50297 - DNA, 25 bp, Homo sapien
cctcaccttagaggccataaaaaaa

SEQ ID NO: 50298 - DNA, 25 bp, Homo sapien
cctcaccttaggggccataaaaaaa

SEQ ID NO: 50299 - DNA, 25 bp, Homo sapien
cctcactatcactggcctgactacc

SEQ ID NO: 50300 - DNA, 25 bp, Homo sapien
cctcactatcactggcttgactacc

SEQ ID NO: 50301 - DNA, 25 bp, Homo sapien
cctcactcaacttatttgtacctca

SEQ ID NO: 50302 - DNA, 25 bp, Homo sapien
cctcactcatcttatttgtacctca

SEQ ID NO: 50303 - DNA, 25 bp, Homo sapien
cctcactgcactgtgtgttacatgg

SEQ ID NO: 50304 - DNA, 25 bp, Homo sapien
cctcactgcactttgtgttacatgg

SEQ ID NO: 50305 - DNA, 25 bp, Homo sapien
cctcactgcgaataaggaagatcaa

SEQ ID NO: 50306 - DNA, 25 bp, Homo sapien
cctcactgtgaataaggaagatcaa

SEQ ID NO: 50307 - DNA, 25 bp, Homo sapien
cctcactgttaaaaagaaatgatgt

SEQ ID NO: 50308 - DNA, 25 bp, Homo sapien
cctcactgttaaaatgaaatgatgt

SEQ ID NO: 50309 - DNA, 25 bp, Homo sapien
cctcacttctcatgttttcttagca

SEQ ID NO: 50310 - DNA, 25 bp, Homo sapien
cctcacttctcgtgttttcttagca

SEQ ID NO: 50311 - DNA, 25 bp, Homo sapien
cctcacttctgtggctactgttctc

SEQ ID NO: 50312 - DNA, 25 bp, Homo sapien
cctcacttgtgtggctactgttctc

SEQ ID NO: 50313 - DNA, 25 bp, Homo sapien
cctcactttcccagagcatctatga

SEQ ID NO: 50314 - DNA, 25 bp, Homo sapien
cctcacttttccagagcatctatga

SEQ ID NO: 50315 - DNA, 25 bp, Homo sapien
cctcagaaaaaaatgttccctctga

SEQ ID NO: 50316 - DNA, 25 bp, Homo sapien
cctcagaaaaaattgttccctctga

SEQ ID NO: 50317 - DNA, 25 bp, Homo sapien
cctcagaataggaatagcataattt

SEQ ID NO: 50318 - DNA, 25 bp, Homo sapien
cctcagaattggaatagcataattt

SEQ ID NO: 50319 - DNA, 25 bp, Homo sapien
cctcagagtttcggaatcagtaggt

SEQ ID NO: 50320 - DNA, 25 bp, Homo sapien
cctcagagttttggaatcagtaggt

SEQ ID NO: 50321 - DNA, 25 bp, Homo sapien
cctcagatatccgtcctctttagga

SEQ ID NO: 50322 - DNA, 25 bp, Homo sapien
cctcagatatctgtcctctttagga

SEQ ID NO: 50323 - DNA, 25 bp, Homo sapien
cctcagatgtttgtctgctctttgt

SEQ ID NO: 50324 - DNA, 25 bp, Homo sapien
cctcagatgtttgtttgctctttgt

SEQ ID NO: 50325 - DNA, 25 bp, Homo sapien
cctcagcaggttcagtacttagaaa

SEQ ID NO: 50326 - DNA, 25 bp, Homo sapien
cctcagcatgttcagtacttagaaa

SEQ ID NO: 50327 - DNA, 25 bp, Homo sapien
cctcagccgtggacatcatctgcat

SEQ ID NO: 50328 - DNA, 25 bp, Homo sapien
cctcagccttggacatcatctgcat

SEQ ID NO: 50329 - DNA, 25 bp, Homo sapien
cctcagctatgacattctaaatgct

SEQ ID NO: 50330 - DNA, 25 bp, Homo sapien
cctcagctccaaccagaatactgcg

SEQ ID NO: 50331 - DNA, 25 bp, Homo sapien
cctcagctccacccagaatactgcg

SEQ ID NO: 50332 - DNA, 25 bp, Homo sapien
cctcagctgtgacattctaaatgct

SEQ ID NO: 50333 - DNA, 25 bp, Homo sapien
cctcaggaaaataggaagaagaaat

SEQ ID NO: 50334 - DNA, 25 bp, Homo sapien
cctcaggaaaatgggaagaagaaat

SEQ ID NO: 50335 - DNA, 25 bp, Homo sapien
cctcaggatgggtacaatgaagcag

SEQ ID NO: 50336 - DNA, 25 bp, Homo sapien
cctcaggatgggtgcaatgaagcag

SEQ ID NO: 50337 - DNA, 25 bp, Homo sapien
cctcaggcaactgacaatcatggca

SEQ ID NO: 50338 - DNA, 25 bp, Homo sapien
cctcaggcaactgacagtcatggca

SEQ ID NO: 50339 - DNA, 25 bp, Homo sapien
cctcaggcaagactgatgagggaaa

SEQ ID NO: 50340 - DNA, 25 bp, Homo sapien
cctcaggcaagtctgatgagggaaa

SEQ ID NO: 50341 - DNA, 25 bp, Homo sapien
cctcagggactatacaaaagatcct

SEQ ID NO: 50342 - DNA, 25 bp, Homo sapien
cctcagggcctactgttcagcctgc

SEQ ID NO: 50343 - DNA, 25 bp, Homo sapien
cctcagggcctgacttggcatccaa

SEQ ID NO: 50344 - DNA, 25 bp, Homo sapien
cctcagggcctgtcttggcatccaa

SEQ ID NO: 50345 - DNA, 25 bp, Homo sapien
cctcagggcttactgttcagcctgc

SEQ ID NO: 50346 - DNA, 25 bp, Homo sapien
cctcagggtctatacaaaagatcct

SEQ ID NO: 50347 - DNA, 25 bp, Homo sapien
cctcaggtttgctctaaatacaccc

SEQ ID NO: 50348 - DNA, 25 bp, Homo sapien
cctcaggtttgctgtaaatacaccc

SEQ ID NO: 50349 - DNA, 25 bp, Homo sapien
cctcagtaagactgtaccattcatc

SEQ ID NO: 50350 - DNA, 25 bp, Homo sapien
cctcagtaagactttaccattcatc

SEQ ID NO: 50351 - DNA, 25 bp, Homo sapien
cctcagtacagtctaggagagaact

SEQ ID NO: 50352 - DNA, 25 bp, Homo sapien
cctcagtacagtgtaggagagaact

SEQ ID NO: 50353 - DNA, 25 bp, Homo sapien
cctcagtgccgagtaaagtgtgata

SEQ ID NO: 50354 - DNA, 25 bp, Homo sapien
cctcagtgccgagtgaagtgtgata

SEQ ID NO: 50355 - DNA, 25 bp, Homo sapien
cctcagttccttcttggaaatcttt

SEQ ID NO: 50356 - DNA, 25 bp, Homo sapien
cctcagttcctttttggaaatcttt

SEQ ID NO: 50357 - DNA, 25 bp, Homo sapien
cctcatagtttgctcaaagattgta

SEQ ID NO: 50358 - DNA, 25 bp, Homo sapien
cctcatagtttgctcagagattgta

SEQ ID NO: 50359 - DNA, 25 bp, Homo sapien
cctcatcaatgagcacacgtccagt

SEQ ID NO: 50360 - DNA, 25 bp, Homo sapien
cctcatcaccaacagaaaccatacc

SEQ ID NO: 50361 - DNA, 25 bp, Homo sapien
cctcatcaccaagagaaaccatacc

SEQ ID NO: 50362 - DNA, 25 bp, Homo sapien
cctcatcacgcatttcttagagtgg

SEQ ID NO: 50363 - DNA, 25 bp, Homo sapien
cctcatcagtaaagcggattcacct

SEQ ID NO: 50364 - DNA, 25 bp, Homo sapien
cctcatcagtaaagtggattcacct

SEQ ID NO: 50365 - DNA, 25 bp, Homo sapien
cctcatcagtgagcacacgtccagt

SEQ ID NO: 50366 - DNA, 25 bp, Homo sapien
cctcatcatgcatttcttagagtgg

SEQ ID NO: 50367 - DNA, 25 bp, Homo sapien
cctcatccttacctcactttacagc

SEQ ID NO: 50368 - DNA, 25 bp, Homo sapien
cctcatccttatctcactttacagc

SEQ ID NO: 50369 - DNA, 25 bp, Homo sapien
cctcatctatgtaatgcggctaatg

SEQ ID NO: 50370 - DNA, 25 bp, Homo sapien
cctcatctatgtaatggggctaatg

SEQ ID NO: 50371 - DNA, 25 bp, Homo sapien
cctcatctcatagctccactagaca

SEQ ID NO: 50372 - DNA, 25 bp, Homo sapien
cctcatctcttagctccactagaca

SEQ ID NO: 50373 - DNA, 25 bp, Homo sapien
cctcatgattttctctgcaatttaa

SEQ ID NO: 50374 - DNA, 25 bp, Homo sapien
cctcatgattttctcttcaatttaa

SEQ ID NO: 50375 - DNA, 25 bp, Homo sapien
cctcatgcactctgttgttagtgaa

SEQ ID NO: 50376 - DNA, 25 bp, Homo sapien
cctcatgcattctgttgttagtgaa

SEQ ID NO: 50377 - DNA, 25 bp, Homo sapien
cctcatgccactgaagcaataggca

SEQ ID NO: 50378 - DNA, 25 bp, Homo sapien
cctcatgctactgaagcaataggca

SEQ ID NO: 50379 - DNA, 25 bp, Homo sapien
cctcatgcttcaacacccttctcct

SEQ ID NO: 50380 - DNA, 25 bp, Homo sapien
cctcatgcttcgacacccttctcct

SEQ ID NO: 50381 - DNA, 25 bp, Homo sapien
cctcatggcacccaggcttcttctg

SEQ ID NO: 50382 - DNA, 25 bp, Homo sapien
cctcatggcacccaggtttcttctg

SEQ ID NO: 50383 - DNA, 25 bp, Homo sapien
cctcatggtctgcttgtcctccaga

SEQ ID NO: 50384 - DNA, 25 bp, Homo sapien
cctcatggtttgcttgtcctccaga

SEQ ID NO: 50385 - DNA, 25 bp, Homo sapien
cctcatgtctcaaaatcaggtcatg

SEQ ID NO: 50386 - DNA, 25 bp, Homo sapien
cctcatgtctcacaatcaggtcatg

SEQ ID NO: 50387 - DNA, 25 bp, Homo sapien
cctcatgttcagttgatagctgcag

SEQ ID NO: 50388 - DNA, 25 bp, Homo sapien
cctcatgttcatttgatagctgcag

SEQ ID NO: 50389 - DNA, 25 bp, Homo sapien
cctcattagacttgctatttttttt

SEQ ID NO: 50390 - DNA, 25 bp, Homo sapien
cctcattagacttgctctttttttt

SEQ ID NO: 50391 - DNA, 25 bp, Homo sapien
cctcattataaaccatcttttgaaa

SEQ ID NO: 50392 - DNA, 25 bp, Homo sapien
cctcattataaaccattttttgaaa

SEQ ID NO: 50393 - DNA, 25 bp, Homo sapien
cctcattcctaaccatcctcagctt

SEQ ID NO: 50394 - DNA, 25 bp, Homo sapien
cctcattcttaaccatcctcagctt

SEQ ID NO: 50395 - DNA, 25 bp, Homo sapien
cctcattgaagttattactgtttct

SEQ ID NO: 50396 - DNA, 25 bp, Homo sapien
cctcattgaagttattcctgtttct

SEQ ID NO: 50397 - DNA, 25 bp, Homo sapien
cctcattgacattattaatttttga

SEQ ID NO: 50398 - DNA, 25 bp, Homo sapien
cctcattggcattattaatttttga

SEQ ID NO: 50399 - DNA, 25 bp, Homo sapien
cctcatttggctataaagttgtaca

SEQ ID NO: 50400 - DNA, 25 bp, Homo sapien
cctcatttgtctataaagttgtaca

SEQ ID NO: 50401 - DNA, 25 bp, Homo sapien
cctccaaaataccgagtgaggtctc

SEQ ID NO: 50402 - DNA, 25 bp, Homo sapien
cctccaaaatactgagtgaggtctc

SEQ ID NO: 50403 - DNA, 25 bp, Homo sapien
cctccaaacgtaaccctctatctac

SEQ ID NO: 50404 - DNA, 25 bp, Homo sapien
cctccaaagcctatgcctgaataag

SEQ ID NO: 50405 - DNA, 25 bp, Homo sapien
cctccaaagcctattcctgaataag

SEQ ID NO: 50406 - DNA, 25 bp, Homo sapien
cctccaaatgtaaccctctatctac

SEQ ID NO: 50407 - DNA, 25 bp, Homo sapien
cctccaacattaaagggcctagttg

SEQ ID NO: 50408 - DNA, 25 bp, Homo sapien
cctccaacattgaagggcctagttg

SEQ ID NO: 50409 - DNA, 25 bp, Homo sapien
cctccaactgcccggctacttctct

SEQ ID NO: 50410 - DNA, 25 bp, Homo sapien
cctccaactgcctggctacttctct

SEQ ID NO: 50411 - DNA, 25 bp, Homo sapien
cctccaatcaattactgacttaaca

SEQ ID NO: 50412 - DNA, 25 bp, Homo sapien
cctccaatcaattattgacttaaca

SEQ ID NO: 50413 - DNA, 25 bp, Homo sapien
cctccacacgctgagaaagggccac

SEQ ID NO: 50414 - DNA, 25 bp, Homo sapien
cctccacaggctgagaaagggccac

SEQ ID NO: 50415 - DNA, 25 bp, Homo sapien
cctccacggttagaggcattcctgg

SEQ ID NO: 50416 - DNA, 25 bp, Homo sapien
cctccacggttagatgcattcctgg

SEQ ID NO: 50417 - DNA, 25 bp, Homo sapien
cctccagccacacacagcaggtcct

SEQ ID NO: 50418 - DNA, 25 bp, Homo sapien
cctccagccacgcacagcaggtcct

SEQ ID NO: 50419 - DNA, 25 bp, Homo sapien
cctccaggaccgggttgctcagcct

SEQ ID NO: 50420 - DNA, 25 bp, Homo sapien
cctccaggaccgggtttctcagcct

SEQ ID NO: 50421 - DNA, 25 bp, Homo sapien
cctccagtcttcacctccatcttca

SEQ ID NO: 50422 - DNA, 25 bp, Homo sapien
cctccagtcttcgcctccatcttca

SEQ ID NO: 50423 - DNA, 25 bp, Homo sapien
cctccataatcataagataatattt

SEQ ID NO: 50424 - DNA, 25 bp, Homo sapien
cctccataatcgtaagataatattt

SEQ ID NO: 50425 - DNA, 25 bp, Homo sapien
cctccatctcgattgccatctcctg

SEQ ID NO: 50426 - DNA, 25 bp, Homo sapien
cctccatcttgattgccatctcctg

SEQ ID NO: 50427 - DNA, 25 bp, Homo sapien
cctccattcaacacacaaggttaag

SEQ ID NO: 50428 - DNA, 25 bp, Homo sapien
cctccattcaactcacaaggttaag

SEQ ID NO: 50429 - DNA, 25 bp, Homo sapien
cctccattcatttaccgccttacct

SEQ ID NO: 50430 - DNA, 25 bp, Homo sapien
cctccattcatttgccgccttacct

SEQ ID NO: 50431 - DNA, 25 bp, Homo sapien
cctcccacccagaatagtaccatca

SEQ ID NO: 50432 - DNA, 25 bp, Homo sapien
cctcccaccgagaatagtaccatca

SEQ ID NO: 50433 - DNA, 25 bp, Homo sapien
cctcccagaaatccaacaaagaatg

SEQ ID NO: 50434 - DNA, 25 bp, Homo sapien
cctcccagaaatccaagaaagaatg

SEQ ID NO: 50435 - DNA, 25 bp, Homo sapien
cctcccaggagaatgtgtattttta

SEQ ID NO: 50436 - DNA, 25 bp, Homo sapien
cctcccaggagagtgtgtattttta

SEQ ID NO: 50437 - DNA, 25 bp, Homo sapien
cctccccagagatgatcattgctaa

SEQ ID NO: 50438 - DNA, 25 bp, Homo sapien
cctccccagagatgattattgctaa

SEQ ID NO: 50439 - DNA, 25 bp, Homo sapien
cctcccctggcacacggtttgagat

SEQ ID NO: 50440 - DNA, 25 bp, Homo sapien
cctcccctggcacagggtttgagat

SEQ ID NO: 50441 - DNA, 25 bp, Homo sapien
cctccctccagtcggtaaaatgtct

SEQ ID NO: 50442 - DNA, 25 bp, Homo sapien
cctccctccagtctgtaaaatgtct

SEQ ID NO: 50443 - DNA, 25 bp, Homo sapien
cctccctgggctaccatttttctgt

SEQ ID NO: 50444 - DNA, 25 bp, Homo sapien
cctccctgggctatcatttttctgt

SEQ ID NO: 50445 - DNA, 25 bp, Homo sapien
cctcccttaactcccagcataatct

SEQ ID NO: 50446 - DNA, 25 bp, Homo sapien
cctcccttaactcctagcataatct

SEQ ID NO: 50447 - DNA, 25 bp, Homo sapien
cctccctttttctcattgactggtg

SEQ ID NO: 50448 - DNA, 25 bp, Homo sapien
cctccctttttctcgttgactggtg

SEQ ID NO: 50449 - DNA, 25 bp, Homo sapien
cctccgacctgtagctggcctgctt

SEQ ID NO: 50450 - DNA, 25 bp, Homo sapien
cctccgacctgtggctggcctgctt

SEQ ID NO: 50451 - DNA, 25 bp, Homo sapien
cctcctaaacatctcttgaatctat

SEQ ID NO: 50452 - DNA, 25 bp, Homo sapien
cctcctaaacatttcttgaatctat

SEQ ID NO: 50453 - DNA, 25 bp, Homo sapien
cctcctaatttacttcacatttgca

SEQ ID NO: 50454 - DNA, 25 bp, Homo sapien
cctcctaatttatttcacatttgca

SEQ ID NO: 50455 - DNA, 25 bp, Homo sapien
cctcctacctagagcttcgccctca

SEQ ID NO: 50456 - DNA, 25 bp, Homo sapien
cctcctacctagtgcttcgccctca

SEQ ID NO: 50457 - DNA, 25 bp, Homo sapien
cctcctattcctatgcttctaccta

SEQ ID NO: 50458 - DNA, 25 bp, Homo sapien
cctcctattcctattcttctaccta

SEQ ID NO: 50459 - DNA, 25 bp, Homo sapien
cctcctcaatccaggtctctgcagg

SEQ ID NO: 50460 - DNA, 25 bp, Homo sapien
cctcctcaatccgggtctctgcagg

SEQ ID NO: 50461 - DNA, 25 bp, Homo sapien
cctcctcaatgtaggacttcatatt

SEQ ID NO: 50462 - DNA, 25 bp, Homo sapien
cctcctcaatgtgggacttcatatt

SEQ ID NO: 50463 - DNA, 25 bp, Homo sapien
cctcctccacactaatttctctaag

SEQ ID NO: 50464 - DNA, 25 bp, Homo sapien
cctcctccacactcatttctctaag

SEQ ID NO: 50465 - DNA, 25 bp, Homo sapien
cctcctccctccagtcggtaaaatg

SEQ ID NO: 50466 - DNA, 25 bp, Homo sapien
cctcctccctccagtctgtaaaatg

SEQ ID NO: 50467 - DNA, 25 bp, Homo sapien
cctcctctaagtggaaaccacaagc

SEQ ID NO: 50468 - DNA, 25 bp, Homo sapien
cctcctctaagtggaatccacaagc

SEQ ID NO: 50469 - DNA, 25 bp, Homo sapien
cctcctctgacactattttatcaag

SEQ ID NO: 50470 - DNA, 25 bp, Homo sapien
cctcctctgacactgttttatcaag

SEQ ID NO: 50471 - DNA, 25 bp, Homo sapien
cctcctcttaatcaaactgacagaa

SEQ ID NO: 50472 - DNA, 25 bp, Homo sapien
cctcctcttaatcaaattgacagaa

SEQ ID NO: 50473 - DNA, 25 bp, Homo sapien
cctcctgagcaacatgactgagtat

SEQ ID NO: 50474 - DNA, 25 bp, Homo sapien
cctcctgagcaacgtgactgagtat

SEQ ID NO: 50475 - DNA, 25 bp, Homo sapien
cctcctgatctatgagaaataaatt

SEQ ID NO: 50476 - DNA, 25 bp, Homo sapien
cctcctgatttatgagaaataaatt

SEQ ID NO: 50477 - DNA, 25 bp, Homo sapien
cctcctgccgctggactttttcctc

SEQ ID NO: 50478 - DNA, 25 bp, Homo sapien
cctcctgctgaacaatctccatgca

SEQ ID NO: 50479 - DNA, 25 bp, Homo sapien
cctcctgctgaacagtctccatgca

SEQ ID NO: 50480 - DNA, 25 bp, Homo sapien
cctcctgctgctggactttttcctc

SEQ ID NO: 50481 - DNA, 25 bp, Homo sapien
cctcctgtaaatacaccttaagtaa

SEQ ID NO: 50482 - DNA, 25 bp, Homo sapien
cctcctgtaaatacgccttaagtaa

SEQ ID NO: 50483 - DNA, 25 bp, Homo sapien
cctccttacaacttcatttctccct

SEQ ID NO: 50484 - DNA, 25 bp, Homo sapien
cctccttacaactttatttctccct

SEQ ID NO: 50485 - DNA, 25 bp, Homo sapien
cctccttctttcattcgtttttggg

SEQ ID NO: 50486 - DNA, 25 bp, Homo sapien
cctccttctttcgttcgtttttggg

SEQ ID NO: 50487 - DNA, 25 bp, Homo sapien
cctcctttctctcatagtcagggtt

SEQ ID NO: 50488 - DNA, 25 bp, Homo sapien
cctcctttctctcgtagtcagggtt

SEQ ID NO: 50489 - DNA, 25 bp, Homo sapien
cctcctttgaccttctatttgggcc

SEQ ID NO: 50490 - DNA, 25 bp, Homo sapien
cctcctttgacgttctatttgggcc

SEQ ID NO: 50491 - DNA, 25 bp, Homo sapien
cctcctttggctactttcaagattt

SEQ ID NO: 50492 - DNA, 25 bp, Homo sapien
cctcctttggctattttcaagattt

SEQ ID NO: 50493 - DNA, 25 bp, Homo sapien
cctcgaacattgctatggtctcttc

SEQ ID NO: 50494 - DNA, 25 bp, Homo sapien
cctcgaacattgttatggtctcttc

SEQ ID NO: 50495 - DNA, 25 bp, Homo sapien
cctcgagaaccacagcactagagaa

SEQ ID NO: 50496 - DNA, 25 bp, Homo sapien
cctcgagaaccacggcactagagaa

SEQ ID NO: 50497 - DNA, 25 bp, Homo sapien
cctcgagaagagtaattccaagaca

SEQ ID NO: 50498 - DNA, 25 bp, Homo sapien
cctcgagaagagtgattccaagaca

SEQ ID NO: 50499 - DNA, 25 bp, Homo sapien
cctcgatttacctgtggtttccctt

SEQ ID NO: 50500 - DNA, 25 bp, Homo sapien
cctcgatttacttgtggtttccctt

SEQ ID NO: 50501 - DNA, 25 bp, Homo sapien
cctcggagctaccgtagttctgtgt

SEQ ID NO: 50502 - DNA, 25 bp, Homo sapien
cctcggagctactgtagttctgtgt

SEQ ID NO: 50503 - DNA, 25 bp, Homo sapien
cctcggtcatgaaacagcccaaggc

SEQ ID NO: 50504 - DNA, 25 bp, Homo sapien
cctcggtcatgaaagagcccaaggc

SEQ ID NO: 50505 - DNA, 25 bp, Homo sapien
cctcggtggccgacctattcctggc

SEQ ID NO: 50506 - DNA, 25 bp, Homo sapien
cctcggtggccgacgtattcctggc

SEQ ID NO: 50507 - DNA, 25 bp, Homo sapien
cctcgtccttcaagacttcttcatt

SEQ ID NO: 50508 - DNA, 25 bp, Homo sapien
cctcgtccttcgagacttcttcatt

SEQ ID NO: 50509 - DNA, 25 bp, Homo sapien
cctcgtgtcaaaaacagcacaccag

SEQ ID NO: 50510 - DNA, 25 bp, Homo sapien
cctcgtgtcaaaaatagcacaccag

SEQ ID NO: 50511 - DNA, 25 bp, Homo sapien
cctcgttcagattcgctccttgttc

SEQ ID NO: 50512 - DNA, 25 bp, Homo sapien
cctcgttcagatttgctccttgttc

SEQ ID NO: 50513 - DNA, 25 bp, Homo sapien
cctctaacatacgtgcatcctcccg

SEQ ID NO: 50514 - DNA, 25 bp, Homo sapien
cctctaacgtacgtgcatcctcccg

SEQ ID NO: 50515 - DNA, 25 bp, Homo sapien
cctctaacttgctttgtctctattt

SEQ ID NO: 50516 - DNA, 25 bp, Homo sapien
cctctaacttgttttgtctctattt

SEQ ID NO: 50517 - DNA, 25 bp, Homo sapien
cctctaagagaactttcagctctaa

SEQ ID NO: 50518 - DNA, 25 bp, Homo sapien
cctctaaggacaccaggctctgtta

SEQ ID NO: 50519 - DNA, 25 bp, Homo sapien
cctctaaggacgccaggctctgtta

SEQ ID NO: 50520 - DNA, 25 bp, Homo sapien
cctctaagggaactttcagctctaa

SEQ ID NO: 50521 - DNA, 25 bp, Homo sapien
cctctaagtaacagcctgaaagaac

SEQ ID NO: 50522 - DNA, 25 bp, Homo sapien
cctctaagtaacaggctgaaagaac

SEQ ID NO: 50523 - DNA, 25 bp, Homo sapien
cctctaagtggaaaccacaagcctc

SEQ ID NO: 50524 - DNA, 25 bp, Homo sapien
cctctaagtggaatccacaagcctc

SEQ ID NO: 50525 - DNA, 25 bp, Homo sapien
cctctaatggctcatggggaaaaac

SEQ ID NO: 50526 - DNA, 25 bp, Homo sapien
cctctaatggctcgtggggaaaaac

SEQ ID NO: 50527 - DNA, 25 bp, Homo sapien
cctctaccatgcttacagaatataa

SEQ ID NO: 50528 - DNA, 25 bp, Homo sapien
cctctaccatgtttacagaatataa

SEQ ID NO: 50529 - DNA, 25 bp, Homo sapien
cctctacccacaatcgattccttct

SEQ ID NO: 50530 - DNA, 25 bp, Homo sapien
cctctacccacaattgattccttct

SEQ ID NO: 50531 - DNA, 25 bp, Homo sapien
cctctactctttcacgcatttgtta

SEQ ID NO: 50532 - DNA, 25 bp, Homo sapien
cctctactctttcatgcatttgtta

SEQ ID NO: 50533 - DNA, 25 bp, Homo sapien
cctctagcaattgccaacaaatttc

SEQ ID NO: 50534 - DNA, 25 bp, Homo sapien
cctctagcactcttttgcctgccca

SEQ ID NO: 50535 - DNA, 25 bp, Homo sapien
cctctagcagttgccaacaaatttc

SEQ ID NO: 50536 - DNA, 25 bp, Homo sapien
cctctagcctcaaattttcctttga

SEQ ID NO: 50537 - DNA, 25 bp, Homo sapien
cctctagcctcaacttttcctttga

SEQ ID NO: 50538 - DNA, 25 bp, Homo sapien
cctctagcgctcttttgcctgccca

SEQ ID NO: 50539 - DNA, 25 bp, Homo sapien
cctctagggtgacacagtcaatata

SEQ ID NO: 50540 - DNA, 25 bp, Homo sapien
cctctaggttgacacagtcaatata

SEQ ID NO: 50541 - DNA, 25 bp, Homo sapien
cctctatattcgaacggtctgggtt

SEQ ID NO: 50542 - DNA, 25 bp, Homo sapien
cctctatattcgaatggtctgggtt

SEQ ID NO: 50543 - DNA, 25 bp, Homo sapien
cctctattcttgtataccgagacta

SEQ ID NO: 50544 - DNA, 25 bp, Homo sapien
cctctattcttgtgtaccgagacta

SEQ ID NO: 50545 - DNA, 25 bp, Homo sapien
cctctattttgtggcacataatgca

SEQ ID NO: 50546 - DNA, 25 bp, Homo sapien
cctctattttgtgtcacataatgca

SEQ ID NO: 50547 - DNA, 25 bp, Homo sapien
cctctcacaatgaacgaggacatcc

SEQ ID NO: 50548 - DNA, 25 bp, Homo sapien
cctctcacaatgaatgaggacatcc

SEQ ID NO: 50549 - DNA, 25 bp, Homo sapien
cctctcacacgttgctggtgcaaat

SEQ ID NO: 50550 - DNA, 25 bp, Homo sapien
cctctcacatgttgctggtgcaaat

SEQ ID NO: 50551 - DNA, 25 bp, Homo sapien
cctctcacctgacttctacagggct

SEQ ID NO: 50552 - DNA, 25 bp, Homo sapien
cctctcacctgatttctacagggct

SEQ ID NO: 50553 - DNA, 25 bp, Homo sapien
cctctcatacgcaaaatatattcac

SEQ ID NO: 50554 - DNA, 25 bp, Homo sapien
cctctcatacgcgaaatatattcac

SEQ ID NO: 50555 - DNA, 25 bp, Homo sapien
cctctccaaaaactaaagtaggaat

SEQ ID NO: 50556 - DNA, 25 bp, Homo sapien
cctctccaaaaactaatgtaggaat

SEQ ID NO: 50557 - DNA, 25 bp, Homo sapien
cctctccacatgaacacctgttatg

SEQ ID NO: 50558 - DNA, 25 bp, Homo sapien
cctctccacatggacacctgttatg

SEQ ID NO: 50559 - DNA, 25 bp, Homo sapien
cctctccgtcatcagcctattttca

SEQ ID NO: 50560 - DNA, 25 bp, Homo sapien
cctctccgtcattagcctattttca

SEQ ID NO: 50561 - DNA, 25 bp, Homo sapien
cctctcgatgacctatgaacaggaa

SEQ ID NO: 50562 - DNA, 25 bp, Homo sapien
cctctcgatgagctatgaacaggaa

SEQ ID NO: 50563 - DNA, 25 bp, Homo sapien
cctctcgcaaatccctgagtactct

SEQ ID NO: 50564 - DNA, 25 bp, Homo sapien
cctctcgcaaatccgtgagtactct

SEQ ID NO: 50565 - DNA, 25 bp, Homo sapien
cctctctaatgcatcaaatccatga

SEQ ID NO: 50566 - DNA, 25 bp, Homo sapien
cctctctaatgtatcaaatccatga

SEQ ID NO: 50567 - DNA, 25 bp, Homo sapien
cctctctcaacttcatactaaaata

SEQ ID NO: 50568 - DNA, 25 bp, Homo sapien
cctctctcaccttcatactaaaata

SEQ ID NO: 50569 - DNA, 25 bp, Homo sapien
cctctctccttcactcattgtatgt

SEQ ID NO: 50570 - DNA, 25 bp, Homo sapien
cctctctccttcactctttgtatgt

SEQ ID NO: 50571 - DNA, 25 bp, Homo sapien
cctctctgaaaacgtccatggataa

SEQ ID NO: 50572 - DNA, 25 bp, Homo sapien
cctctctgaaaatgtccatggataa

SEQ ID NO: 50573 - DNA, 25 bp, Homo sapien
cctctcttaatgaagaaaatgagaa

SEQ ID NO: 50574 - DNA, 25 bp, Homo sapien
cctctcttaatggagaaaatgagaa

SEQ ID NO: 50575 - DNA, 25 bp, Homo sapien
cctctcttccctcgcaatggtgtct

SEQ ID NO: 50576 - DNA, 25 bp, Homo sapien
cctctcttccctcggaatggtgtct

SEQ ID NO: 50577 - DNA, 25 bp, Homo sapien
cctctgaacctatgaattttggaca

SEQ ID NO: 50578 - DNA, 25 bp, Homo sapien
cctctgaacctgtgaattttggaca

SEQ ID NO: 50579 - DNA, 25 bp, Homo sapien
cctctgaagccaagagggctaacag

SEQ ID NO: 50580 - DNA, 25 bp, Homo sapien
cctctgaagccaagtgggctaacag

SEQ ID NO: 50581 - DNA, 25 bp, Homo sapien
cctctgaattatattggtctacatg

SEQ ID NO: 50582 - DNA, 25 bp, Homo sapien
cctctgaattatgttggtctacatg

SEQ ID NO: 50583 - DNA, 25 bp, Homo sapien
cctctgacaaacgtctctcagcatt

SEQ ID NO: 50584 - DNA, 25 bp, Homo sapien
cctctgacaaatgtctctcagcatt

SEQ ID NO: 50585 - DNA, 25 bp, Homo sapien
cctctgacactattttatcaaggag

SEQ ID NO: 50586 - DNA, 25 bp, Homo sapien
cctctgacactgttttatcaaggag

SEQ ID NO: 50587 - DNA, 25 bp, Homo sapien
cctctgagaccccagggcattgcat

SEQ ID NO: 50588 - DNA, 25 bp, Homo sapien
cctctgagacttaggcgagccaggc

SEQ ID NO: 50589 - DNA, 25 bp, Homo sapien
cctctgagactttggcgagccaggc

SEQ ID NO: 50590 - DNA, 25 bp, Homo sapien
cctctgaggacatatgccaatgaag

SEQ ID NO: 50591 - DNA, 25 bp, Homo sapien
cctctgaggacctatgccaatgaag

SEQ ID NO: 50592 - DNA, 25 bp, Homo sapien
cctctgagtccccagggcattgcat

SEQ ID NO: 50593 - DNA, 25 bp, Homo sapien
cctctgagttctatctaccttcttt

SEQ ID NO: 50594 - DNA, 25 bp, Homo sapien
cctctgagttctgtctaccttcttt

SEQ ID NO: 50595 - DNA, 25 bp, Homo sapien
cctctgcagacatgtggagaccaag

SEQ ID NO: 50596 - DNA, 25 bp, Homo sapien
cctctgcagacgtgtggagaccaag

SEQ ID NO: 50597 - DNA, 25 bp, Homo sapien
cctctgcctgttacccatttgcaaa

SEQ ID NO: 50598 - DNA, 25 bp, Homo sapien
cctctgcctgtttcccatttgcaaa

SEQ ID NO: 50599 - DNA, 25 bp, Homo sapien
cctctgcgctgacacgaacatcata

SEQ ID NO: 50600 - DNA, 25 bp, Homo sapien
cctctgcgttgacacgaacatcata

SEQ ID NO: 50601 - DNA, 25 bp, Homo sapien
cctctggattcagtaattggtagta

SEQ ID NO: 50602 - DNA, 25 bp, Homo sapien
cctctggattcggtaattggtagta

SEQ ID NO: 50603 - DNA, 25 bp, Homo sapien
cctctggcgtgacttcatcttgact

SEQ ID NO: 50604 - DNA, 25 bp, Homo sapien
cctctggcgtgagttcatcttgact

SEQ ID NO: 50605 - DNA, 25 bp, Homo sapien
cctctgggaaataacagatactcat

SEQ ID NO: 50606 - DNA, 25 bp, Homo sapien
cctctgggaaataatagatactcat

SEQ ID NO: 50607 - DNA, 25 bp, Homo sapien
cctctggtcacacgttcctcaactg

SEQ ID NO: 50608 - DNA, 25 bp, Homo sapien
cctctggtcacatgttcctcaactg

SEQ ID NO: 50609 - DNA, 25 bp, Homo sapien
cctctgtaacagcacatagcacatc

SEQ ID NO: 50610 - DNA, 25 bp, Homo sapien
cctctgtaacaggacatagcacatc

SEQ ID NO: 50611 - DNA, 25 bp, Homo sapien
cctctgtaataacttgcctggtatg

SEQ ID NO: 50612 - DNA, 25 bp, Homo sapien
cctctgtaataagttgcctggtatg

SEQ ID NO: 50613 - DNA, 25 bp, Homo sapien
cctctgtggctcatctatagtgctg

SEQ ID NO: 50614 - DNA, 25 bp, Homo sapien
cctctgtggctcatctgtagtgctg

SEQ ID NO: 50615 - DNA, 25 bp, Homo sapien
cctctgttaagatgagccaggtttc

SEQ ID NO: 50616 - DNA, 25 bp, Homo sapien
cctctgttaagatgaggcaggtttc

SEQ ID NO: 50617 - DNA, 25 bp, Homo sapien
cctcttaaattgcgaagttgtcaag

SEQ ID NO: 50618 - DNA, 25 bp, Homo sapien
cctcttaaattgtgaagttgtcaag

SEQ ID NO: 50619 - DNA, 25 bp, Homo sapien
cctcttaatcaaactgacagaaact

SEQ ID NO: 50620 - DNA, 25 bp, Homo sapien
cctcttaatcaaattgacagaaact

SEQ ID NO: 50621 - DNA, 25 bp, Homo sapien
cctcttattacaacctggaaattac

SEQ ID NO: 50622 - DNA, 25 bp, Homo sapien
cctcttattaccacctggaaattac

SEQ ID NO: 50623 - DNA, 25 bp, Homo sapien
cctcttccatgaattacatgtagtg

SEQ ID NO: 50624 - DNA, 25 bp, Homo sapien
cctcttccgtgaattacatgtagtg

SEQ ID NO: 50625 - DNA, 25 bp, Homo sapien
cctcttctattcacgcacttcagga

SEQ ID NO: 50626 - DNA, 25 bp, Homo sapien
cctcttctattcatgcacttcagga

SEQ ID NO: 50627 - DNA, 25 bp, Homo sapien
cctcttctcaaaagtacctggcata

SEQ ID NO: 50628 - DNA, 25 bp, Homo sapien
cctcttctccaaagtacctggcata

SEQ ID NO: 50629 - DNA, 25 bp, Homo sapien
cctcttctctgagcttagaattgca

SEQ ID NO: 50630 - DNA, 25 bp, Homo sapien
cctcttctctgtgcttagaattgca

SEQ ID NO: 50631 - DNA, 25 bp, Homo sapien
cctcttctgctagaaagtcagcatc

SEQ ID NO: 50632 - DNA, 25 bp, Homo sapien
cctcttctgctagaaattcagcatc

SEQ ID NO: 50633 - DNA, 25 bp, Homo sapien
cctcttgccaaggttgatggatata

SEQ ID NO: 50634 - DNA, 25 bp, Homo sapien
cctcttgccaagtttgatggatata

SEQ ID NO: 50635 - DNA, 25 bp, Homo sapien
cctcttgcctaaatgtgttctttta

SEQ ID NO: 50636 - DNA, 25 bp, Homo sapien
cctcttgcctctctctgactctcca

SEQ ID NO: 50637 - DNA, 25 bp, Homo sapien
cctcttgcctctgtctgactctcca

SEQ ID NO: 50638 - DNA, 25 bp, Homo sapien
cctcttgccttcatctttcattgta

SEQ ID NO: 50639 - DNA, 25 bp, Homo sapien
cctcttgccttcctctttcattgta

SEQ ID NO: 50640 - DNA, 25 bp, Homo sapien
cctcttgcttaaatgtgttctttta

SEQ ID NO: 50641 - DNA, 25 bp, Homo sapien
cctctttaagttaagtggtattacc

SEQ ID NO: 50642 - DNA, 25 bp, Homo sapien
cctctttaagttaggtggtattacc

SEQ ID NO: 50643 - DNA, 25 bp, Homo sapien
cctctttacttttggttatgctgtg

SEQ ID NO: 50644 - DNA, 25 bp, Homo sapien
cctctttagttttggttatgctgtg

SEQ ID NO: 50645 - DNA, 25 bp, Homo sapien
cctctttgactcattaatgctgcat

SEQ ID NO: 50646 - DNA, 25 bp, Homo sapien
cctctttgacttattaatgctgcat

SEQ ID NO: 50647 - DNA, 25 bp, Homo sapien
cctctttgatatagacccaggggag

SEQ ID NO: 50648 - DNA, 25 bp, Homo sapien
cctctttgcaccactatcacatcac

SEQ ID NO: 50649 - DNA, 25 bp, Homo sapien
cctctttgcaccgctatcacatcac

SEQ ID NO: 50650 - DNA, 25 bp, Homo sapien
cctctttgtcagagaaccaccagct

SEQ ID NO: 50651 - DNA, 25 bp, Homo sapien
cctctttgtcagagaagcaccagct

SEQ ID NO: 50652 - DNA, 25 bp, Homo sapien
cctctttgtgggattaggttctcct

SEQ ID NO: 50653 - DNA, 25 bp, Homo sapien
cctctttgtgggattatgttctcct

SEQ ID NO: 50654 - DNA, 25 bp, Homo sapien
cctctttgttatagacccaggggag

SEQ ID NO: 50655 - DNA, 25 bp, Homo sapien
cctcttttcctacttcctctaagta

SEQ ID NO: 50656 - DNA, 25 bp, Homo sapien
cctcttttcctatttcctctaagta

SEQ ID NO: 50657 - DNA, 25 bp, Homo sapien
cctcttttgagttgctggaacataa

SEQ ID NO: 50658 - DNA, 25 bp, Homo sapien
cctcttttgagttgttggaacataa

SEQ ID NO: 50659 - DNA, 25 bp, Homo sapien
cctctttttcccatacttcatccca

SEQ ID NO: 50660 - DNA, 25 bp, Homo sapien
cctctttttcccgtacttcatccca

SEQ ID NO: 50661 - DNA, 25 bp, Homo sapien
cctgaaaatgttcctatctactttt

SEQ ID NO: 50662 - DNA, 25 bp, Homo sapien
cctgaaaatgtttctatctactttt

SEQ ID NO: 50663 - DNA, 25 bp, Homo sapien
cctgaaagagctaagagttacctca

SEQ ID NO: 50664 - DNA, 25 bp, Homo sapien
cctgaaagagctaatagttacctca

SEQ ID NO: 50665 - DNA, 25 bp, Homo sapien
cctgaaaggatctcccacaatcatc

SEQ ID NO: 50666 - DNA, 25 bp, Homo sapien
cctgaaaggatttcccacaatcatc

SEQ ID NO: 50667 - DNA, 25 bp, Homo sapien
cctgaaatggtccaagcaagagttt

SEQ ID NO: 50668 - DNA, 25 bp, Homo sapien
cctgaaatggtccaggcaagagttt

SEQ ID NO: 50669 - DNA, 25 bp, Homo sapien
cctgaaattcgtatgttgaaaccct

SEQ ID NO: 50670 - DNA, 25 bp, Homo sapien
cctgaaatttgtatgttgaaaccct

SEQ ID NO: 50671 - DNA, 25 bp, Homo sapien
cctgaacaatctcgtgtatctacag

SEQ ID NO: 50672 - DNA, 25 bp, Homo sapien
cctgaacaatctcttgtatctacag

SEQ ID NO: 50673 - DNA, 25 bp, Homo sapien
cctgaacagagagacagtcgtctgt

SEQ ID NO: 50674 - DNA, 25 bp, Homo sapien
cctgaacagagatacagtcgtctgt

SEQ ID NO: 50675 - DNA, 25 bp, Homo sapien
cctgaactatacatggtaggatact

SEQ ID NO: 50676 - DNA, 25 bp, Homo sapien
cctgaactatacgtggtaggatact

SEQ ID NO: 50677 - DNA, 25 bp, Homo sapien
cctgaagaaacataagtagcaggcc

SEQ ID NO: 50678 - DNA, 25 bp, Homo sapien
cctgaagaaacgtaagtagcaggcc

SEQ ID NO: 50679 - DNA, 25 bp, Homo sapien
cctgaagaactgtttcaccttccca

SEQ ID NO: 50680 - DNA, 25 bp, Homo sapien
cctgaagaactttttcaccttccca

SEQ ID NO: 50681 - DNA, 25 bp, Homo sapien
cctgaagtcttcttgcagttactaa

SEQ ID NO: 50682 - DNA, 25 bp, Homo sapien
cctgaagtctttttgcagttactaa

SEQ ID NO: 50683 - DNA, 25 bp, Homo sapien
cctgaagtgaaagattaatgtccca

SEQ ID NO: 50684 - DNA, 25 bp, Homo sapien
cctgaagtgaaatattaatgtccca

SEQ ID NO: 50685 - DNA, 25 bp, Homo sapien
cctgaataaaggatccaaaaaccag

SEQ ID NO: 50686 - DNA, 25 bp, Homo sapien
cctgaataaagggtccaaaaaccag

SEQ ID NO: 50687 - DNA, 25 bp, Homo sapien
cctgaatacactcacttatgcatct

SEQ ID NO: 50688 - DNA, 25 bp, Homo sapien
cctgaatacatacaccctaataagt

SEQ ID NO: 50689 - DNA, 25 bp, Homo sapien
cctgaatacatataccctaataagt

SEQ ID NO: 50690 - DNA, 25 bp, Homo sapien
cctgaataccgaaaaggctctctcc

SEQ ID NO: 50691 - DNA, 25 bp, Homo sapien
cctgaatactctcacttatgcatct

SEQ ID NO: 50692 - DNA, 25 bp, Homo sapien
cctgaatactgaaaaggctctctcc

SEQ ID NO: 50693 - DNA, 25 bp, Homo sapien
cctgaatgtatcagcacatctaatc

SEQ ID NO: 50694 - DNA, 25 bp, Homo sapien
cctgaatgtttcagcacatctaatc

SEQ ID NO: 50695 - DNA, 25 bp, Homo sapien
cctgaattacttttaatactgcaag

SEQ ID NO: 50696 - DNA, 25 bp, Homo sapien
cctgaattatttttaatactgcaag

SEQ ID NO: 50697 - DNA, 25 bp, Homo sapien
cctgaattcttcttcaggcaaatca

SEQ ID NO: 50698 - DNA, 25 bp, Homo sapien
cctgaattctttttcaggcaaatca

SEQ ID NO: 50699 - DNA, 25 bp, Homo sapien
cctgaattgaccatcacataatgta

SEQ ID NO: 50700 - DNA, 25 bp, Homo sapien
cctgaattgaccgtcacataatgta

SEQ ID NO: 50701 - DNA, 25 bp, Homo sapien
cctgaattgcttctcggtctgtaaa

SEQ ID NO: 50702 - DNA, 25 bp, Homo sapien
cctgaattgcttcttggtctgtaaa

SEQ ID NO: 50703 - DNA, 25 bp, Homo sapien
cctgacaaaattgcgtgatatgaca

SEQ ID NO: 50704 - DNA, 25 bp, Homo sapien
cctgacaaaattgtgtgatatgaca

SEQ ID NO: 50705 - DNA, 25 bp, Homo sapien
cctgacaacatgttcaacaaagttc

SEQ ID NO: 50706 - DNA, 25 bp, Homo sapien
cctgacaacgtgttcaacaaagttc

SEQ ID NO: 50707 - DNA, 25 bp, Homo sapien
cctgacaactctgtgtggctggctg

SEQ ID NO: 50708 - DNA, 25 bp, Homo sapien
cctgacaactctgtgttgctggctg

SEQ ID NO: 50709 - DNA, 25 bp, Homo sapien
cctgacacatactctcatcttctga

SEQ ID NO: 50710 - DNA, 25 bp, Homo sapien
cctgacacatactctcgtcttctga

SEQ ID NO: 50711 - DNA, 25 bp, Homo sapien
cctgacggtggcaaggtcaactcag

SEQ ID NO: 50712 - DNA, 25 bp, Homo sapien
cctgacggtggctaggtcaactcag

SEQ ID NO: 50713 - DNA, 25 bp, Homo sapien
cctgactacgaacaaaaggagaaca

SEQ ID NO: 50714 - DNA, 25 bp, Homo sapien
cctgactacgaacgaaaggagaaca

SEQ ID NO: 50715 - DNA, 25 bp, Homo sapien
cctgactcacagatcacatatcggc

SEQ ID NO: 50716 - DNA, 25 bp, Homo sapien
cctgactcacagatcatatatcggc

SEQ ID NO: 50717 - DNA, 25 bp, Homo sapien
cctgactccaaatataagtctaacc

SEQ ID NO: 50718 - DNA, 25 bp, Homo sapien
cctgactccaattataagtctaacc

SEQ ID NO: 50719 - DNA, 25 bp, Homo sapien
cctgactcgatgcgctgactgcacc

SEQ ID NO: 50720 - DNA, 25 bp, Homo sapien
cctgactcgatgtgctgactgcacc

SEQ ID NO: 50721 - DNA, 25 bp, Homo sapien
cctgactgccgggaccgggacctgc

SEQ ID NO: 50722 - DNA, 25 bp, Homo sapien
cctgactgctgggaccgggacctgc

SEQ ID NO: 50723 - DNA, 25 bp, Homo sapien
cctgactggcccagtacagccgatg

SEQ ID NO: 50724 - DNA, 25 bp, Homo sapien
cctgactggcccagtatagccgatg

SEQ ID NO: 50725 - DNA, 25 bp, Homo sapien
cctgactgtgctaaaactagagcct

SEQ ID NO: 50726 - DNA, 25 bp, Homo sapien
cctgactgtgctaacactagagcct

SEQ ID NO: 50727 - DNA, 25 bp, Homo sapien
cctgacttcaggtacaaagcatcaa

SEQ ID NO: 50728 - DNA, 25 bp, Homo sapien
cctgacttcaggtgcaaagcatcaa

SEQ ID NO: 50729 - DNA, 25 bp, Homo sapien
cctgagaaaaaattccacaaatgtc

SEQ ID NO: 50730 - DNA, 25 bp, Homo sapien
cctgagaataaattccacaaatgtc

SEQ ID NO: 50731 - DNA, 25 bp, Homo sapien
cctgagaatttgcaggtctaacaag

SEQ ID NO: 50732 - DNA, 25 bp, Homo sapien
cctgagaatttgtaggtctaacaag

SEQ ID NO: 50733 - DNA, 25 bp, Homo sapien
cctgagacaactcctggtgataatt

SEQ ID NO: 50734 - DNA, 25 bp, Homo sapien
cctgagaccactcctggtgataatt

SEQ ID NO: 50735 - DNA, 25 bp, Homo sapien
cctgagagtgtgctccagtaaattt

SEQ ID NO: 50736 - DNA, 25 bp, Homo sapien
cctgagagtgtgctccggtaaattt

SEQ ID NO: 50737 - DNA, 25 bp, Homo sapien
cctgagatgagacaaaaatgtttac

SEQ ID NO: 50738 - DNA, 25 bp, Homo sapien
cctgagatgagaccaaaatgtttac

SEQ ID NO: 50739 - DNA, 25 bp, Homo sapien
cctgagcaatactggtgctaagtat

SEQ ID NO: 50740 - DNA, 25 bp, Homo sapien
cctgagcaatagtggtgctaagtat

SEQ ID NO: 50741 - DNA, 25 bp, Homo sapien
cctgagccaactccccagcctctct

SEQ ID NO: 50742 - DNA, 25 bp, Homo sapien
cctgagccatctccccagcctctct

SEQ ID NO: 50743 - DNA, 25 bp, Homo sapien
cctgaggacccacaggatccatcat

SEQ ID NO: 50744 - DNA, 25 bp, Homo sapien
cctgaggacccacagggtccatcat

SEQ ID NO: 50745 - DNA, 25 bp, Homo sapien
cctgaggcacctgtttggaatctgg

SEQ ID NO: 50746 - DNA, 25 bp, Homo sapien
cctgaggccacataaagttagatct

SEQ ID NO: 50747 - DNA, 25 bp, Homo sapien
cctgaggccacattcttacagcaac

SEQ ID NO: 50748 - DNA, 25 bp, Homo sapien
cctgaggccacgtaaagttagatct

SEQ ID NO: 50749 - DNA, 25 bp, Homo sapien
cctgaggccgcattcttacagcaac

SEQ ID NO: 50750 - DNA, 25 bp, Homo sapien
cctgaggcgcctgtttggaatctgg

SEQ ID NO: 50751 - DNA, 25 bp, Homo sapien
cctgaggctcacatgacctctgcac

SEQ ID NO: 50752 - DNA, 25 bp, Homo sapien
cctgaggctcacgtgacctctgcac

SEQ ID NO: 50753 - DNA, 25 bp, Homo sapien
cctgaggctctcttagaatactgca

SEQ ID NO: 50754 - DNA, 25 bp, Homo sapien
cctgaggctgtcttagaatactgca

SEQ ID NO: 50755 - DNA, 25 bp, Homo sapien
cctgaggtctgaagtcaccctcctg

SEQ ID NO: 50756 - DNA, 25 bp, Homo sapien
cctgaggtctggagtcaccctcctg

SEQ ID NO: 50757 - DNA, 25 bp, Homo sapien
cctgagtaggagactggaaggaagg

SEQ ID NO: 50758 - DNA, 25 bp, Homo sapien
cctgagtaggagattggaaggaagg

SEQ ID NO: 50759 - DNA, 25 bp, Homo sapien
cctgagtcacagagtacaaacagaa

SEQ ID NO: 50760 - DNA, 25 bp, Homo sapien
cctgagtcatagagtacaaacagaa

SEQ ID NO: 50761 - DNA, 25 bp, Homo sapien
cctgagtcctttcgaaaccactgtc

SEQ ID NO: 50762 - DNA, 25 bp, Homo sapien
cctgagtccttttgaaaccactgtc

SEQ ID NO: 50763 - DNA, 25 bp, Homo sapien
cctgagtgagaaatgtcaaattgaa

SEQ ID NO: 50764 - DNA, 25 bp, Homo sapien
cctgagtgagaactgtcaaattgaa

SEQ ID NO: 50765 - DNA, 25 bp, Homo sapien
cctgagttcaaatcatgactttgcc

SEQ ID NO: 50766 - DNA, 25 bp, Homo sapien
cctgagttcaaatcgtgactttgcc

SEQ ID NO: 50767 - DNA, 25 bp, Homo sapien
cctgagttgaaatcccagttctgct

SEQ ID NO: 50768 - DNA, 25 bp, Homo sapien
cctgagttggaatcccagttctgct

SEQ ID NO: 50769 - DNA, 25 bp, Homo sapien
cctgagtttttggcccaaggatgga

SEQ ID NO: 50770 - DNA, 25 bp, Homo sapien
cctgagtttttggcccgaggatgga

SEQ ID NO: 50771 - DNA, 25 bp, Homo sapien
cctgatagactgcaatataagacac

SEQ ID NO: 50772 - DNA, 25 bp, Homo sapien
cctgataggctgcaatataagacac

SEQ ID NO: 50773 - DNA, 25 bp, Homo sapien
cctgatatacataattaaaggattc

SEQ ID NO: 50774 - DNA, 25 bp, Homo sapien
cctgatatacataattcaaggattc

SEQ ID NO: 50775 - DNA, 25 bp, Homo sapien
cctgatgacctaatctttttattgc

SEQ ID NO: 50776 - DNA, 25 bp, Homo sapien
cctgatgacctacttaatgttcaat

SEQ ID NO: 50777 - DNA, 25 bp, Homo sapien
cctgatgacgtaatctttttattgc

SEQ ID NO: 50778 - DNA, 25 bp, Homo sapien
cctgatgacttacttaatgttcaat

SEQ ID NO: 50779 - DNA, 25 bp, Homo sapien
cctgatgataaatcaagttgagcac

SEQ ID NO: 50780 - DNA, 25 bp, Homo sapien
cctgatgataaatgaagttgagcac

SEQ ID NO: 50781 - DNA, 25 bp, Homo sapien
cctgatgcgtacctgcgctaagaga

SEQ ID NO: 50782 - DNA, 25 bp, Homo sapien
cctgatgcgtacctgctctaagaga

SEQ ID NO: 50783 - DNA, 25 bp, Homo sapien
cctgatgtcaaatctaaaaatccca

SEQ ID NO: 50784 - DNA, 25 bp, Homo sapien
cctgatgtcaagtctaaaaatccca

SEQ ID NO: 50785 - DNA, 25 bp, Homo sapien
cctgatgtcagcatgtctcagagcc

SEQ ID NO: 50786 - DNA, 25 bp, Homo sapien
cctgatgtccgcatgtctcagagcc

SEQ ID NO: 50787 - DNA, 25 bp, Homo sapien
cctgatgttctctactcgccttcat

SEQ ID NO: 50788 - DNA, 25 bp, Homo sapien
cctgatgttctctacttgccttcat

SEQ ID NO: 50789 - DNA, 25 bp, Homo sapien
cctgattaacgagaacactctacac

SEQ ID NO: 50790 - DNA, 25 bp, Homo sapien
cctgattaaggagaacactctacac

SEQ ID NO: 50791 - DNA, 25 bp, Homo sapien
cctgattactgaattgaagggagtt

SEQ ID NO: 50792 - DNA, 25 bp, Homo sapien
cctgattagccacaataacacattc

SEQ ID NO: 50793 - DNA, 25 bp, Homo sapien
cctgattagccagaataacacattc

SEQ ID NO: 50794 - DNA, 25 bp, Homo sapien
cctgattattgaattgaagggagtt

SEQ ID NO: 50795 - DNA, 25 bp, Homo sapien
cctgattcacttagctttggcttta

SEQ ID NO: 50796 - DNA, 25 bp, Homo sapien
cctgattcccagactacaatatggt

SEQ ID NO: 50797 - DNA, 25 bp, Homo sapien
cctgattcccagagtacaatatggt

SEQ ID NO: 50798 - DNA, 25 bp, Homo sapien
cctgattcctaccaccttccagtct

SEQ ID NO: 50799 - DNA, 25 bp, Homo sapien
cctgattcctacgaccttccagtct

SEQ ID NO: 50800 - DNA, 25 bp, Homo sapien
cctgattcctgtgcataatttttta

SEQ ID NO: 50801 - DNA, 25 bp, Homo sapien
cctgattcctgtgcgtaatttttta

SEQ ID NO: 50802 - DNA, 25 bp, Homo sapien
cctgattcgcttagctttggcttta

SEQ ID NO: 50803 - DNA, 25 bp, Homo sapien
cctgattgattataactctccaact

SEQ ID NO: 50804 - DNA, 25 bp, Homo sapien
cctgattgtttataactctccaact

SEQ ID NO: 50805 - DNA, 25 bp, Homo sapien
cctgcaaaagtaaaaaacaccaggt

SEQ ID NO: 50806 - DNA, 25 bp, Homo sapien
cctgcaaaagtcaaaaacaccaggt

SEQ ID NO: 50807 - DNA, 25 bp, Homo sapien
cctgcaaagcttcacctctagggaa

SEQ ID NO: 50808 - DNA, 25 bp, Homo sapien
cctgcaaagcttcgcctctagggaa

SEQ ID NO: 50809 - DNA, 25 bp, Homo sapien
cctgcacagatacgaaggcttacta

SEQ ID NO: 50810 - DNA, 25 bp, Homo sapien
cctgcacagatatgaaggcttacta

SEQ ID NO: 50811 - DNA, 25 bp, Homo sapien
cctgcacccatgggatggaaactct

SEQ ID NO: 50812 - DNA, 25 bp, Homo sapien
cctgcacctatgggatggaaactct

SEQ ID NO: 50813 - DNA, 25 bp, Homo sapien
cctgcacctctccggcaccaccacc

SEQ ID NO: 50814 - DNA, 25 bp, Homo sapien
cctgcacctctcctgcaccaccacc

SEQ ID NO: 50815 - DNA, 25 bp, Homo sapien
cctgcactagaccaactgtaagagt

SEQ ID NO: 50816 - DNA, 25 bp, Homo sapien
cctgcactagactaactgtaagagt

SEQ ID NO: 50817 - DNA, 25 bp, Homo sapien
cctgcagaaagttctcagtagattg

SEQ ID NO: 50818 - DNA, 25 bp, Homo sapien
cctgcagaaagttctcggtagattg

SEQ ID NO: 50819 - DNA, 25 bp, Homo sapien
cctgcagacaagactgcttctggag

SEQ ID NO: 50820 - DNA, 25 bp, Homo sapien
cctgcagataagactgcttctggag

SEQ ID NO: 50821 - DNA, 25 bp, Homo sapien
cctgcagcaaaaatcacttgggcat

SEQ ID NO: 50822 - DNA, 25 bp, Homo sapien
cctgcagcaaaaatcatttgggcat

SEQ ID NO: 50823 - DNA, 25 bp, Homo sapien
cctgcaggaagaatgacctcccatt

SEQ ID NO: 50824 - DNA, 25 bp, Homo sapien
cctgcaggaagagtgacctcccatt

SEQ ID NO: 50825 - DNA, 25 bp, Homo sapien
cctgcaggagaagtgggcttcaggc

SEQ ID NO: 50826 - DNA, 25 bp, Homo sapien
cctgcaggagaattgggcttcaggc

SEQ ID NO: 50827 - DNA, 25 bp, Homo sapien
cctgcaggtaagccaagtgggcaag

SEQ ID NO: 50828 - DNA, 25 bp, Homo sapien
cctgcaggtaaggcaagtgggcaag

SEQ ID NO: 50829 - DNA, 25 bp, Homo sapien
cctgcagtggacgagtctatcatgt

SEQ ID NO: 50830 - DNA, 25 bp, Homo sapien
cctgcagtggaggagtctatcatgt

SEQ ID NO: 50831 - DNA, 25 bp, Homo sapien
cctgcagtttttcttacaccatctc

SEQ ID NO: 50832 - DNA, 25 bp, Homo sapien
cctgcagtttttcttataccatctc

SEQ ID NO: 50833 - DNA, 25 bp, Homo sapien
cctgcatcatgggattaagaaaaaa

SEQ ID NO: 50834 - DNA, 25 bp, Homo sapien
cctgcatcatggggttaagaaaaaa

SEQ ID NO: 50835 - DNA, 25 bp, Homo sapien
cctgcatctgtactatatctttatc

SEQ ID NO: 50836 - DNA, 25 bp, Homo sapien
cctgcatctgtactgtatctttatc

SEQ ID NO: 50837 - DNA, 25 bp, Homo sapien
cctgcatgcttcatcacatagccac

SEQ ID NO: 50838 - DNA, 25 bp, Homo sapien
cctgcatgcttcgtcacatagccac

SEQ ID NO: 50839 - DNA, 25 bp, Homo sapien
cctgcatggcggagcttggttttcc

SEQ ID NO: 50840 - DNA, 25 bp, Homo sapien
cctgcatggcggaggttggttttcc

SEQ ID NO: 50841 - DNA, 25 bp, Homo sapien
cctgcatttctttgtgaggatgaca

SEQ ID NO: 50842 - DNA, 25 bp, Homo sapien
cctgcatttttttgtgaggatgaca

SEQ ID NO: 50843 - DNA, 25 bp, Homo sapien
cctgccaacgcaacatccattctgc

SEQ ID NO: 50844 - DNA, 25 bp, Homo sapien
cctgccaactctatgatgttaaacg

SEQ ID NO: 50845 - DNA, 25 bp, Homo sapien
cctgccaactctgtgatgttaaacg

SEQ ID NO: 50846 - DNA, 25 bp, Homo sapien
cctgccaactgcgaaccgccagctc

SEQ ID NO: 50847 - DNA, 25 bp, Homo sapien
cctgccaactgcgagccgccagctc

SEQ ID NO: 50848 - DNA, 25 bp, Homo sapien
cctgccaatgcaacatccattctgc

SEQ ID NO: 50849 - DNA, 25 bp, Homo sapien
cctgccacagaccgaatcagtggaa

SEQ ID NO: 50850 - DNA, 25 bp, Homo sapien
cctgccacagagcgaatcagtggaa

SEQ ID NO: 50851 - DNA, 25 bp, Homo sapien
cctgccacatgccataccactgcgg

SEQ ID NO: 50852 - DNA, 25 bp, Homo sapien
cctgccacgtgccataccactgcgg

SEQ ID NO: 50853 - DNA, 25 bp, Homo sapien
cctgccactttctatgcgtatatgg

SEQ ID NO: 50854 - DNA, 25 bp, Homo sapien
cctgccactttctatgtgtatatgg

SEQ ID NO: 50855 - DNA, 25 bp, Homo sapien
cctgccagttcaacatccttcattc

SEQ ID NO: 50856 - DNA, 25 bp, Homo sapien
cctgccagttcagcatccttcattc

SEQ ID NO: 50857 - DNA, 25 bp, Homo sapien
cctgccatgagtacattttcaggct

SEQ ID NO: 50858 - DNA, 25 bp, Homo sapien
cctgccatgagtacgttttcaggct

SEQ ID NO: 50859 - DNA, 25 bp, Homo sapien
cctgcccagtattgcttggttggag

SEQ ID NO: 50860 - DNA, 25 bp, Homo sapien
cctgcccagtattgtttggttggag

SEQ ID NO: 50861 - DNA, 25 bp, Homo sapien
cctgccccacactgaacagttcatt

SEQ ID NO: 50862 - DNA, 25 bp, Homo sapien
cctgccccacactgaagagttcatt

SEQ ID NO: 50863 - DNA, 25 bp, Homo sapien
cctgcctcctcaatccaggtctctg

SEQ ID NO: 50864 - DNA, 25 bp, Homo sapien
cctgcctcctcaatccgggtctctg

SEQ ID NO: 50865 - DNA, 25 bp, Homo sapien
cctgcctctatttcttgtttatttt

SEQ ID NO: 50866 - DNA, 25 bp, Homo sapien
cctgcctctattttttgtttatttt

SEQ ID NO: 50867 - DNA, 25 bp, Homo sapien
cctgcctctgtgctgtggtttataa

SEQ ID NO: 50868 - DNA, 25 bp, Homo sapien
cctgcctctgtgttgtggtttataa

SEQ ID NO: 50869 - DNA, 25 bp, Homo sapien
cctgcctcttccatgaattacatgt

SEQ ID NO: 50870 - DNA, 25 bp, Homo sapien
cctgcctcttccgtgaattacatgt

SEQ ID NO: 50871 - DNA, 25 bp, Homo sapien
cctgcctgccacatgccataccact

SEQ ID NO: 50872 - DNA, 25 bp, Homo sapien
cctgcctgccacgtgccataccact

SEQ ID NO: 50873 - DNA, 25 bp, Homo sapien
cctgcctggaccttcgctatccttc

SEQ ID NO: 50874 - DNA, 25 bp, Homo sapien
cctgcctggaccttcgttatccttc

SEQ ID NO: 50875 - DNA, 25 bp, Homo sapien
cctgcctggattgtgcctctgactc

SEQ ID NO: 50876 - DNA, 25 bp, Homo sapien
cctgcctggattgtgcttctgactc

SEQ ID NO: 50877 - DNA, 25 bp, Homo sapien
cctgcctggtgcgaccttagctcat

SEQ ID NO: 50878 - DNA, 25 bp, Homo sapien
cctgcctggtgtgaccttagctcat

SEQ ID NO: 50879 - DNA, 25 bp, Homo sapien
cctgccttgctagctgcatttcttg

SEQ ID NO: 50880 - DNA, 25 bp, Homo sapien
cctgccttggttcttctcaaaccag

SEQ ID NO: 50881 - DNA, 25 bp, Homo sapien
cctgccttggttgttctcaaaccag

SEQ ID NO: 50882 - DNA, 25 bp, Homo sapien
cctgccttgttagctgcatttcttg

SEQ ID NO: 50883 - DNA, 25 bp, Homo sapien
cctgcctttgcccaccacatgataa

SEQ ID NO: 50884 - DNA, 25 bp, Homo sapien
cctgcctttgcccgccacatgataa

SEQ ID NO: 50885 - DNA, 25 bp, Homo sapien
cctgcgagaataacaagtggacaag

SEQ ID NO: 50886 - DNA, 25 bp, Homo sapien
cctgcgagaataagaagtggacaag

SEQ ID NO: 50887 - DNA, 25 bp, Homo sapien
cctgcgagctccctacaaactcccc

SEQ ID NO: 50888 - DNA, 25 bp, Homo sapien
cctgcgagctccctacgaactcccc

SEQ ID NO: 50889 - DNA, 25 bp, Homo sapien
cctgcgagctggagacccgagaaag

SEQ ID NO: 50890 - DNA, 25 bp, Homo sapien
cctgcgagctggagacgcgagaaag

SEQ ID NO: 50891 - DNA, 25 bp, Homo sapien
cctgcgccatttaattgagtgaata

SEQ ID NO: 50892 - DNA, 25 bp, Homo sapien
cctgcgccttttaattgagtgaata

SEQ ID NO: 50893 - DNA, 25 bp, Homo sapien
cctgcgttagaactagagacaaaca

SEQ ID NO: 50894 - DNA, 25 bp, Homo sapien
cctgcgttagaactggagacaaaca

SEQ ID NO: 50895 - DNA, 25 bp, Homo sapien
cctgcgtttagggaaaccacattta

SEQ ID NO: 50896 - DNA, 25 bp, Homo sapien
cctgcgtttagggaaatcacattta

SEQ ID NO: 50897 - DNA, 25 bp, Homo sapien
cctgctacatttcacttcttaattc

SEQ ID NO: 50898 - DNA, 25 bp, Homo sapien
cctgctacttttcacttcttaattc

SEQ ID NO: 50899 - DNA, 25 bp, Homo sapien
cctgctataacttcgtagtcctgga

SEQ ID NO: 50900 - DNA, 25 bp, Homo sapien
cctgctataactttgtagtcctgga

SEQ ID NO: 50901 - DNA, 25 bp, Homo sapien
cctgctatattcaagagacccaact

SEQ ID NO: 50902 - DNA, 25 bp, Homo sapien
cctgctatcttcaagagacccaact

SEQ ID NO: 50903 - DNA, 25 bp, Homo sapien
cctgctccaccagctcatgttgcct

SEQ ID NO: 50904 - DNA, 25 bp, Homo sapien
cctgctccaccagttcatgttgcct

SEQ ID NO: 50905 - DNA, 25 bp, Homo sapien
cctgctccaggaagtatatcagaat

SEQ ID NO: 50906 - DNA, 25 bp, Homo sapien
cctgctccaggaggtatatcagaat

SEQ ID NO: 50907 - DNA, 25 bp, Homo sapien
cctgctcccaacgtacctgttgtgt

SEQ ID NO: 50908 - DNA, 25 bp, Homo sapien
cctgctcccaatgtacctgttgtgt

SEQ ID NO: 50909 - DNA, 25 bp, Homo sapien
cctgctccgatgttcgtccatgctg

SEQ ID NO: 50910 - DNA, 25 bp, Homo sapien
cctgctccgatgtttgtccatgctg

SEQ ID NO: 50911 - DNA, 25 bp, Homo sapien
cctgctcttctcttggggcctcccg

SEQ ID NO: 50912 - DNA, 25 bp, Homo sapien
cctgctcttctctttgggcctcccg

SEQ ID NO: 50913 - DNA, 25 bp, Homo sapien
cctgctgaagctattcccaaaaaat

SEQ ID NO: 50914 - DNA, 25 bp, Homo sapien
cctgctgaagctgttcccaaaaaat

SEQ ID NO: 50915 - DNA, 25 bp, Homo sapien
cctgctgaccatgctcctcgcaaca

SEQ ID NO: 50916 - DNA, 25 bp, Homo sapien
cctgctgaccatgttcctcgcaaca

SEQ ID NO: 50917 - DNA, 25 bp, Homo sapien
cctgctgcactttctcagtatggca

SEQ ID NO: 50918 - DNA, 25 bp, Homo sapien
cctgctgcagtttctcagtatggca

SEQ ID NO: 50919 - DNA, 25 bp, Homo sapien
cctgctgcccagccaggtgtccttg

SEQ ID NO: 50920 - DNA, 25 bp, Homo sapien
cctgctgcccagcgaggtgtccttg

SEQ ID NO: 50921 - DNA, 25 bp, Homo sapien
cctgctggataattgtaacatagag

SEQ ID NO: 50922 - DNA, 25 bp, Homo sapien
cctgctggctaattgtaacatagag

SEQ ID NO: 50923 - DNA, 25 bp, Homo sapien
cctgctgtcaaatgctttagggctg

SEQ ID NO: 50924 - DNA, 25 bp, Homo sapien
cctgctgtcaaatgttttagggctg

SEQ ID NO: 50925 - DNA, 25 bp, Homo sapien
cctgcttacctcacatggtaaatgt

SEQ ID NO: 50926 - DNA, 25 bp, Homo sapien
cctgcttacgtcacatggtaaatgt

SEQ ID NO: 50927 - DNA, 25 bp, Homo sapien
cctgcttagtcatcattagtgcatt

SEQ ID NO: 50928 - DNA, 25 bp, Homo sapien
cctgcttagtcctcattagtgcatt

SEQ ID NO: 50929 - DNA, 25 bp, Homo sapien
cctgcttcacactagttattggact

SEQ ID NO: 50930 - DNA, 25 bp, Homo sapien
cctgcttcacactatttattggact

SEQ ID NO: 50931 - DNA, 25 bp, Homo sapien
cctgcttcatgccactagctcgccc

SEQ ID NO: 50932 - DNA, 25 bp, Homo sapien
cctgcttcctaaatatgctctgtaa

SEQ ID NO: 50933 - DNA, 25 bp, Homo sapien
cctgcttcctaaatgtgctctgtaa

SEQ ID NO: 50934 - DNA, 25 bp, Homo sapien
cctgcttcgtgccactagctcgccc

SEQ ID NO: 50935 - DNA, 25 bp, Homo sapien
cctgcttctgttttcccacctgcca

SEQ ID NO: 50936 - DNA, 25 bp, Homo sapien
cctgcttctgtttttccacctgcca

SEQ ID NO: 50937 - DNA, 25 bp, Homo sapien
cctgcttgccagatagcatctagtc

SEQ ID NO: 50938 - DNA, 25 bp, Homo sapien
cctgcttgccatatagcatctagtc

SEQ ID NO: 50939 - DNA, 25 bp, Homo sapien
cctgcttggagatgatgatgacctt

SEQ ID NO: 50940 - DNA, 25 bp, Homo sapien
cctgcttggagatggtgatgacctt

SEQ ID NO: 50941 - DNA, 25 bp, Homo sapien
cctgcttgggttttgactgggatta

SEQ ID NO: 50942 - DNA, 25 bp, Homo sapien
cctgcttgggttttgattgggatta

SEQ ID NO: 50943 - DNA, 25 bp, Homo sapien
cctgcttggtgtcctccttccctgt

SEQ ID NO: 50944 - DNA, 25 bp, Homo sapien
cctgcttggtgtcctctttccctgt

SEQ ID NO: 50945 - DNA, 25 bp, Homo sapien
cctgctttaaaaaaagaaagacggc

SEQ ID NO: 50946 - DNA, 25 bp, Homo sapien
cctgctttaaaaaaggaaagacggc

SEQ ID NO: 50947 - DNA, 25 bp, Homo sapien
cctgctttacctgattctcaaatga

SEQ ID NO: 50948 - DNA, 25 bp, Homo sapien
cctgctttacctgcttctcaaatga

SEQ ID NO: 50949 - DNA, 25 bp, Homo sapien
cctgctttctgtcattatagataaa

SEQ ID NO: 50950 - DNA, 25 bp, Homo sapien
cctgctttgcgtcttgtgctctggt

SEQ ID NO: 50951 - DNA, 25 bp, Homo sapien
cctgctttgtgtcattatagataaa

SEQ ID NO: 50952 - DNA, 25 bp, Homo sapien
cctgctttgtgtcttgtgctctggt

SEQ ID NO: 50953 - DNA, 25 bp, Homo sapien
cctggaaaactcagtgtacattaaa

SEQ ID NO: 50954 - DNA, 25 bp, Homo sapien
cctggaaaattcagtgtacattaaa

SEQ ID NO: 50955 - DNA, 25 bp, Homo sapien
cctggaaagaacccactgcttattt

SEQ ID NO: 50956 - DNA, 25 bp, Homo sapien
cctggaaagaacctactgcttattt

SEQ ID NO: 50957 - DNA, 25 bp, Homo sapien
cctggaaatacagaattctatccaa

SEQ ID NO: 50958 - DNA, 25 bp, Homo sapien
cctggaaatactgaattctatccaa

SEQ ID NO: 50959 - DNA, 25 bp, Homo sapien
cctggaaatagattcttggagacac

SEQ ID NO: 50960 - DNA, 25 bp, Homo sapien
cctggaaataggttcttggagacac

SEQ ID NO: 50961 - DNA, 25 bp, Homo sapien
cctggaaatgtgacggtccgggaat

SEQ ID NO: 50962 - DNA, 25 bp, Homo sapien
cctggaaatttgacggtccgggaat

SEQ ID NO: 50963 - DNA, 25 bp, Homo sapien
cctggaacaacccaacaggctgtgc

SEQ ID NO: 50964 - DNA, 25 bp, Homo sapien
cctggaacaaccctacaggctgtgc

SEQ ID NO: 50965 - DNA, 25 bp, Homo sapien
cctggaactcaaagaaatggtagct

SEQ ID NO: 50966 - DNA, 25 bp, Homo sapien
cctggaactgaaagaaatggtagct

SEQ ID NO: 50967 - DNA, 25 bp, Homo sapien
cctggaactgataatttgaacaaga

SEQ ID NO: 50968 - DNA, 25 bp, Homo sapien
cctggaactgatattttgaacaaga

SEQ ID NO: 50969 - DNA, 25 bp, Homo sapien
cctggaagcgctcatgcagccagac

SEQ ID NO: 50970 - DNA, 25 bp, Homo sapien
cctggaagcgctcgtgcagccagac

SEQ ID NO: 50971 - DNA, 25 bp, Homo sapien
cctggaagtacagacctaccaagtg

SEQ ID NO: 50972 - DNA, 25 bp, Homo sapien
cctggaagtacagatctaccaagtg

SEQ ID NO: 50973 - DNA, 25 bp, Homo sapien
cctggaattgacactgttgcttctg

SEQ ID NO: 50974 - DNA, 25 bp, Homo sapien
cctggaattgacagtgttgcttctg

SEQ ID NO: 50975 - DNA, 25 bp, Homo sapien
cctggacaaagacatggagttagga

SEQ ID NO: 50976 - DNA, 25 bp, Homo sapien
cctggacaaagacttggagttagga

SEQ ID NO: 50977 - DNA, 25 bp, Homo sapien
cctggacaattcttccaatgcaagt

SEQ ID NO: 50978 - DNA, 25 bp, Homo sapien
cctggacagtacagaactctttaat

SEQ ID NO: 50979 - DNA, 25 bp, Homo sapien
cctggacagtacagaattctttaat

SEQ ID NO: 50980 - DNA, 25 bp, Homo sapien
cctggacagttcttccaatgcaagt

SEQ ID NO: 50981 - DNA, 25 bp, Homo sapien
cctggacattgcattgtttaaaagc

SEQ ID NO: 50982 - DNA, 25 bp, Homo sapien
cctggacattgtattgtttaaaagc

SEQ ID NO: 50983 - DNA, 25 bp, Homo sapien
cctggaccttcgctatccttctcta

SEQ ID NO: 50984 - DNA, 25 bp, Homo sapien
cctggaccttcgttatccttctcta

SEQ ID NO: 50985 - DNA, 25 bp, Homo sapien
cctggactatacaatccagtttaaa

SEQ ID NO: 50986 - DNA, 25 bp, Homo sapien
cctggactatacgatccagtttaaa

SEQ ID NO: 50987 - DNA, 25 bp, Homo sapien
cctggactatgatagccacagcagc

SEQ ID NO: 50988 - DNA, 25 bp, Homo sapien
cctggactatgatggccacagcagc

SEQ ID NO: 50989 - DNA, 25 bp, Homo sapien
cctggactgctgttcccccagatag

SEQ ID NO: 50990 - DNA, 25 bp, Homo sapien
cctggactgctgtttccccagatag

SEQ ID NO: 50991 - DNA, 25 bp, Homo sapien
cctggacttcccactcttgttagct

SEQ ID NO: 50992 - DNA, 25 bp, Homo sapien
cctggacttcccgctcttgttagct

SEQ ID NO: 50993 - DNA, 25 bp, Homo sapien
cctggagaacataaacctaagtgaa

SEQ ID NO: 50994 - DNA, 25 bp, Homo sapien
cctggagaacataatcctaagtgaa

SEQ ID NO: 50995 - DNA, 25 bp, Homo sapien
cctggagaactttatagtccagttg

SEQ ID NO: 50996 - DNA, 25 bp, Homo sapien
cctggagaattttatagtccagttg

SEQ ID NO: 50997 - DNA, 25 bp, Homo sapien
cctggagagacgtccgcaaacaggt

SEQ ID NO: 50998 - DNA, 25 bp, Homo sapien
cctggagagacgtctgcaaacaggt

SEQ ID NO: 50999 - DNA, 25 bp, Homo sapien
cctggagatcagcgtggatgagaac

SEQ ID NO: 51000 - DNA, 25 bp, Homo sapien
cctggagatcagtgtggatgagaac

SEQ ID NO: 51001 - DNA, 25 bp, Homo sapien
cctggagcttgcactttagtggaag

SEQ ID NO: 51002 - DNA, 25 bp, Homo sapien
cctggagcttgtactttagtggaag

SEQ ID NO: 51003 - DNA, 25 bp, Homo sapien
cctggaggcatccgaaatcggttca

SEQ ID NO: 51004 - DNA, 25 bp, Homo sapien
cctggaggcatcggaaatcggttca

SEQ ID NO: 51005 - DNA, 25 bp, Homo sapien
cctggagtacttcaacatttagaga

SEQ ID NO: 51006 - DNA, 25 bp, Homo sapien
cctggagtcgagtttcacaaagata

SEQ ID NO: 51007 - DNA, 25 bp, Homo sapien
cctggagtgcttcaacatttagaga

SEQ ID NO: 51008 - DNA, 25 bp, Homo sapien
cctggagttgagtttcacaaagata

SEQ ID NO: 51009 - DNA, 25 bp, Homo sapien
cctggatcatactactatatttccc

SEQ ID NO: 51010 - DNA, 25 bp, Homo sapien
cctggatcatactactgtatttccc

SEQ ID NO: 51011 - DNA, 25 bp, Homo sapien
cctggatctgacccagagaccagag

SEQ ID NO: 51012 - DNA, 25 bp, Homo sapien
cctggatctgacccagcgaccagag

SEQ ID NO: 51013 - DNA, 25 bp, Homo sapien
cctggatctggagtgactcctcaca

SEQ ID NO: 51014 - DNA, 25 bp, Homo sapien
cctggatctggagtgattcctcaca

SEQ ID NO: 51015 - DNA, 25 bp, Homo sapien
cctggatggtaccgatgcttgttga

SEQ ID NO: 51016 - DNA, 25 bp, Homo sapien
cctggatggtactgatgcttgttga

SEQ ID NO: 51017 - DNA, 25 bp, Homo sapien
cctggatgtctaaccattccttgtt

SEQ ID NO: 51018 - DNA, 25 bp, Homo sapien
cctggatgtctaactattccttgtt

SEQ ID NO: 51019 - DNA, 25 bp, Homo sapien
cctggattaagtcacactttccatt

SEQ ID NO: 51020 - DNA, 25 bp, Homo sapien
cctggattaagtcacattttccatt

SEQ ID NO: 51021 - DNA, 25 bp, Homo sapien
cctggattatcaggattatcacaat

SEQ ID NO: 51022 - DNA, 25 bp, Homo sapien
cctggattatcaggtttatcacaat

SEQ ID NO: 51023 - DNA, 25 bp, Homo sapien
cctggattctctcatacttagcacc

SEQ ID NO: 51024 - DNA, 25 bp, Homo sapien
cctggattctctgatacttagcacc

SEQ ID NO: 51025 - DNA, 25 bp, Homo sapien
cctggattgctactaaaaatgcaga

SEQ ID NO: 51026 - DNA, 25 bp, Homo sapien
cctggattgctagtaaaaatgcaga

SEQ ID NO: 51027 - DNA, 25 bp, Homo sapien
cctggattgtgcctctgactccctg

SEQ ID NO: 51028 - DNA, 25 bp, Homo sapien
cctggattgtgcttctgactccctg

SEQ ID NO: 51029 - DNA, 25 bp, Homo sapien
cctggcaattaataggaaccaagca

SEQ ID NO: 51030 - DNA, 25 bp, Homo sapien
cctggcaattactaggaaccaagca

SEQ ID NO: 51031 - DNA, 25 bp, Homo sapien
cctggcactctctatgaacattctc

SEQ ID NO: 51032 - DNA, 25 bp, Homo sapien
cctggcactctctgtgaacattctc

SEQ ID NO: 51033 - DNA, 25 bp, Homo sapien
cctggccaagagtcgacatgtctat

SEQ ID NO: 51034 - DNA, 25 bp, Homo sapien
cctggccaagagtcgatatgtctat

SEQ ID NO: 51035 - DNA, 25 bp, Homo sapien
cctggcctagtatttaaggtgttct

SEQ ID NO: 51036 - DNA, 25 bp, Homo sapien
cctggcctcagcaactccattcact

SEQ ID NO: 51037 - DNA, 25 bp, Homo sapien
cctggcctcagcagctccattcact

SEQ ID NO: 51038 - DNA, 25 bp, Homo sapien
cctggcctcgatactaaattctgct

SEQ ID NO: 51039 - DNA, 25 bp, Homo sapien
cctggcctcttcatgaattgatcga

SEQ ID NO: 51040 - DNA, 25 bp, Homo sapien
cctggcctcttcttgaattgatcga

SEQ ID NO: 51041 - DNA, 25 bp, Homo sapien
cctggcctgcacccatgggatggaa

SEQ ID NO: 51042 - DNA, 25 bp, Homo sapien
cctggcctgcacctatgggatggaa

SEQ ID NO: 51043 - DNA, 25 bp, Homo sapien
cctggcctggtatttaaggtgttct

SEQ ID NO: 51044 - DNA, 25 bp, Homo sapien
cctggccttgatactaaattctgct

SEQ ID NO: 51045 - DNA, 25 bp, Homo sapien
cctggctatgctacagaagacaaga

SEQ ID NO: 51046 - DNA, 25 bp, Homo sapien
cctggctatgctatagaagacaaga

SEQ ID NO: 51047 - DNA, 25 bp, Homo sapien
cctggctcagagcttgccaggtagt

SEQ ID NO: 51048 - DNA, 25 bp, Homo sapien
cctggctcagagcttgtcaggtagt

SEQ ID NO: 51049 - DNA, 25 bp, Homo sapien
cctggctgacgtggtgcccatcagg

SEQ ID NO: 51050 - DNA, 25 bp, Homo sapien
cctggctgacgtgttgcccatcagg

SEQ ID NO: 51051 - DNA, 25 bp, Homo sapien
cctggctgagattacgatatccatt

SEQ ID NO: 51052 - DNA, 25 bp, Homo sapien
cctggctgagattatgatatccatt

SEQ ID NO: 51053 - DNA, 25 bp, Homo sapien
cctggcttctaattcacccacactg

SEQ ID NO: 51054 - DNA, 25 bp, Homo sapien
cctggcttctagttcacccacactg

SEQ ID NO: 51055 - DNA, 25 bp, Homo sapien
cctgggaaaaagtcttggaagcaca

SEQ ID NO: 51056 - DNA, 25 bp, Homo sapien
cctgggaagaagtcttggaagcaca

SEQ ID NO: 51057 - DNA, 25 bp, Homo sapien
cctgggaataagctcgatgtgaagg

SEQ ID NO: 51058 - DNA, 25 bp, Homo sapien
cctgggaataagctggatgtgaagg

SEQ ID NO: 51059 - DNA, 25 bp, Homo sapien
cctgggacaatgagggacaggtctg

SEQ ID NO: 51060 - DNA, 25 bp, Homo sapien
cctgggacaatgcgggacaggtctg

SEQ ID NO: 51061 - DNA, 25 bp, Homo sapien
cctgggacatctgctcactttggga

SEQ ID NO: 51062 - DNA, 25 bp, Homo sapien
cctgggacatctgctcgctttggga

SEQ ID NO: 51063 - DNA, 25 bp, Homo sapien
cctgggagctccaactcttcccttt

SEQ ID NO: 51064 - DNA, 25 bp, Homo sapien
cctgggagctccaattcttcccttt

SEQ ID NO: 51065 - DNA, 25 bp, Homo sapien
cctgggataaatcgcacttggtcat

SEQ ID NO: 51066 - DNA, 25 bp, Homo sapien
cctgggataaattgcacttggtcat

SEQ ID NO: 51067 - DNA, 25 bp, Homo sapien
cctgggatactcaactacttcacat

SEQ ID NO: 51068 - DNA, 25 bp, Homo sapien
cctgggatactcaactgcttcacat

SEQ ID NO: 51069 - DNA, 25 bp, Homo sapien
cctgggatactcgagtttggtgggg

SEQ ID NO: 51070 - DNA, 25 bp, Homo sapien
cctgggatacttgagtttggtgggg

SEQ ID NO: 51071 - DNA, 25 bp, Homo sapien
cctgggattagtctccaggcatgat

SEQ ID NO: 51072 - DNA, 25 bp, Homo sapien
cctgggattcgtctccaggcatgat

SEQ ID NO: 51073 - DNA, 25 bp, Homo sapien
cctgggcaattcaacctattggtgt

SEQ ID NO: 51074 - DNA, 25 bp, Homo sapien
cctgggcaattcagcctattggtgt

SEQ ID NO: 51075 - DNA, 25 bp, Homo sapien
cctgggcagatgcaaagagctgagc

SEQ ID NO: 51076 - DNA, 25 bp, Homo sapien
cctgggcaggtgcaaagagctgagc

SEQ ID NO: 51077 - DNA, 25 bp, Homo sapien
cctgggcatcactgcgaattattta

SEQ ID NO: 51078 - DNA, 25 bp, Homo sapien
cctgggcatcactgtgaattattta

SEQ ID NO: 51079 - DNA, 25 bp, Homo sapien
cctgggcattttctcgttggtaggc

SEQ ID NO: 51080 - DNA, 25 bp, Homo sapien
cctgggcattttttcgttggtaggc

SEQ ID NO: 51081 - DNA, 25 bp, Homo sapien
cctgggccccggcaccaaatgccag

SEQ ID NO: 51082 - DNA, 25 bp, Homo sapien
cctgggccccggcaccgaatgccag

SEQ ID NO: 51083 - DNA, 25 bp, Homo sapien
cctgggccttatctcaccaagtttc

SEQ ID NO: 51084 - DNA, 25 bp, Homo sapien
cctgggccttatgtcaccaagtttc

SEQ ID NO: 51085 - DNA, 25 bp, Homo sapien
cctgggctctctattctcctttgct

SEQ ID NO: 51086 - DNA, 25 bp, Homo sapien
cctgggctctcttttctcctttgct

SEQ ID NO: 51087 - DNA, 25 bp, Homo sapien
cctgggcttccaagcattctgattt

SEQ ID NO: 51088 - DNA, 25 bp, Homo sapien
cctgggcttccaagtattctgattt

SEQ ID NO: 51089 - DNA, 25 bp, Homo sapien
cctgggtcatgggcagagatggtgc

SEQ ID NO: 51090 - DNA, 25 bp, Homo sapien
cctgggtcatggtcagagatggtgc

SEQ ID NO: 51091 - DNA, 25 bp, Homo sapien
cctgggtctaaattctcctgaaatc

SEQ ID NO: 51092 - DNA, 25 bp, Homo sapien
cctgggtctaaattcttctgaaatc

SEQ ID NO: 51093 - DNA, 25 bp, Homo sapien
cctgggtgaaagccatgtgctcttc

SEQ ID NO: 51094 - DNA, 25 bp, Homo sapien
cctgggtgaaagccgtgtgctcttc

SEQ ID NO: 51095 - DNA, 25 bp, Homo sapien
cctgggtgaacccgaacttcaaagt

SEQ ID NO: 51096 - DNA, 25 bp, Homo sapien
cctgggtgaacccggacttcaaagt

SEQ ID NO: 51097 - DNA, 25 bp, Homo sapien
cctgggtgagtagatgccctgccct

SEQ ID NO: 51098 - DNA, 25 bp, Homo sapien
cctgggtgagtcgatgccctgccct

SEQ ID NO: 51099 - DNA, 25 bp, Homo sapien
cctgggttcaagccacgactctgct

SEQ ID NO: 51100 - DNA, 25 bp, Homo sapien
cctgggttcaagtcacgactctgct

SEQ ID NO: 51101 - DNA, 25 bp, Homo sapien
cctggtacttgcatccaagaggtcc

SEQ ID NO: 51102 - DNA, 25 bp, Homo sapien
cctggtacttgcatcctagaggtcc

SEQ ID NO: 51103 - DNA, 25 bp, Homo sapien
cctggtagtatttgcttttgtaata

SEQ ID NO: 51104 - DNA, 25 bp, Homo sapien
cctggtagtatttgtttttgtaata

SEQ ID NO: 51105 - DNA, 25 bp, Homo sapien
cctggtatacctattttgaaagatc

SEQ ID NO: 51106 - DNA, 25 bp, Homo sapien
cctggtatccctattttgaaagatc

SEQ ID NO: 51107 - DNA, 25 bp, Homo sapien
cctggtatgtttaaggaagagaaag

SEQ ID NO: 51108 - DNA, 25 bp, Homo sapien
cctggtatgtttagggaagagaaag

SEQ ID NO: 51109 - DNA, 25 bp, Homo sapien
cctggtcaacacgatgaaaccctgt

SEQ ID NO: 51110 - DNA, 25 bp, Homo sapien
cctggtcaatacgatgaaaccctgt

SEQ ID NO: 51111 - DNA, 25 bp, Homo sapien
cctggtcccagaattaaggctgggc

SEQ ID NO: 51112 - DNA, 25 bp, Homo sapien
cctggtcccggaattaaggctgggc

SEQ ID NO: 51113 - DNA, 25 bp, Homo sapien
cctggtccctgcattctagccactc

SEQ ID NO: 51114 - DNA, 25 bp, Homo sapien
cctggtccctgcgttctagccactc

SEQ ID NO: 51115 - DNA, 25 bp, Homo sapien
cctggtctttcaaagccatctctga

SEQ ID NO: 51116 - DNA, 25 bp, Homo sapien
cctggtctttcgaagccatctctga

SEQ ID NO: 51117 - DNA, 25 bp, Homo sapien
cctggtctttttcggctgaatggct

SEQ ID NO: 51118 - DNA, 25 bp, Homo sapien
cctggtcttttttggctgaatggct

SEQ ID NO: 51119 - DNA, 25 bp, Homo sapien
cctggtgacaatctgagtaggttac

SEQ ID NO: 51120 - DNA, 25 bp, Homo sapien
cctggtgacaatttgagtaggttac

SEQ ID NO: 51121 - DNA, 25 bp, Homo sapien
cctggtgacagtgcaatcaaaaatt

SEQ ID NO: 51122 - DNA, 25 bp, Homo sapien
cctggtgacagtgcgatcaaaaatt

SEQ ID NO: 51123 - DNA, 25 bp, Homo sapien
cctggtgacatgtttaaaccccaga

SEQ ID NO: 51124 - DNA, 25 bp, Homo sapien
cctggtgacatttttaaaccccaga

SEQ ID NO: 51125 - DNA, 25 bp, Homo sapien
cctggtgatcacattcccaactgtt

SEQ ID NO: 51126 - DNA, 25 bp, Homo sapien
cctggtgatcatattcccaactgtt

SEQ ID NO: 51127 - DNA, 25 bp, Homo sapien
cctggtgccgcacttgctgggtttt

SEQ ID NO: 51128 - DNA, 25 bp, Homo sapien
cctggtgcctcacttgctgggtttt

SEQ ID NO: 51129 - DNA, 25 bp, Homo sapien
cctggtgctgtatgatcctgggcaa

SEQ ID NO: 51130 - DNA, 25 bp, Homo sapien
cctggtgctgtgtgatcctgggcaa

SEQ ID NO: 51131 - DNA, 25 bp, Homo sapien
cctggtggaacacgatccaactcca

SEQ ID NO: 51132 - DNA, 25 bp, Homo sapien
cctggtggaacatgatccaactcca

SEQ ID NO: 51133 - DNA, 25 bp, Homo sapien
cctggtgtgtgccctacgcaaatga

SEQ ID NO: 51134 - DNA, 25 bp, Homo sapien
cctggtgtgtgccctatgcaaatga

SEQ ID NO: 51135 - DNA, 25 bp, Homo sapien
cctggttcgggctaacaaattggtt

SEQ ID NO: 51136 - DNA, 25 bp, Homo sapien
cctggttcgggctgacaaattggtt

SEQ ID NO: 51137 - DNA, 25 bp, Homo sapien
cctggtttagtccacgaactccgaa

SEQ ID NO: 51138 - DNA, 25 bp, Homo sapien
cctggtttagtccatgaactccgaa

SEQ ID NO: 51139 - DNA, 25 bp, Homo sapien
cctgtaaaaatatgtccgtaagtta

SEQ ID NO: 51140 - DNA, 25 bp, Homo sapien
cctgtaaaaatatgtctgtaagtta

SEQ ID NO: 51141 - DNA, 25 bp, Homo sapien
cctgtaaacatttctgccattacat

SEQ ID NO: 51142 - DNA, 25 bp, Homo sapien
cctgtaaacatttctgtcattacat

SEQ ID NO: 51143 - DNA, 25 bp, Homo sapien
cctgtaaatacaccttaagtaaact

SEQ ID NO: 51144 - DNA, 25 bp, Homo sapien
cctgtaaatacgccttaagtaaact

SEQ ID NO: 51145 - DNA, 25 bp, Homo sapien
cctgtaaattcacggctatggtaaa

SEQ ID NO: 51146 - DNA, 25 bp, Homo sapien
cctgtaaattcatggctatggtaaa

SEQ ID NO: 51147 - DNA, 25 bp, Homo sapien
cctgtaacagccagaacacagtcca

SEQ ID NO: 51148 - DNA, 25 bp, Homo sapien
cctgtaacagccggaacacagtcca

SEQ ID NO: 51149 - DNA, 25 bp, Homo sapien
cctgtaaccagtcgtcaactctaca

SEQ ID NO: 51150 - DNA, 25 bp, Homo sapien
cctgtaaccagttgtcaactctaca

SEQ ID NO: 51151 - DNA, 25 bp, Homo sapien
cctgtaaccggtccttgtctcctct

SEQ ID NO: 51152 - DNA, 25 bp, Homo sapien
cctgtaactggtccttgtctcctct

SEQ ID NO: 51153 - DNA, 25 bp, Homo sapien
cctgtaatcccaactgaggacagga

SEQ ID NO: 51154 - DNA, 25 bp, Homo sapien
cctgtaatcccagctgaggacagga

SEQ ID NO: 51155 - DNA, 25 bp, Homo sapien
cctgtaattatcagtgcctatatcc

SEQ ID NO: 51156 - DNA, 25 bp, Homo sapien
cctgtaattatcggtgcctatatcc

SEQ ID NO: 51157 - DNA, 25 bp, Homo sapien
cctgtacacaccagcttgagcagtt

SEQ ID NO: 51158 - DNA, 25 bp, Homo sapien
cctgtacagactggaccaaaacagc

SEQ ID NO: 51159 - DNA, 25 bp, Homo sapien
cctgtacataccagcttgagcagtt

SEQ ID NO: 51160 - DNA, 25 bp, Homo sapien
cctgtacatactggaccaaaacagc

SEQ ID NO: 51161 - DNA, 25 bp, Homo sapien
cctgtaccttttaaatcaaaactca

SEQ ID NO: 51162 - DNA, 25 bp, Homo sapien
cctgtaccttttacatcaaaactca

SEQ ID NO: 51163 - DNA, 25 bp, Homo sapien
cctgtagaggagacatttcccatac

SEQ ID NO: 51164 - DNA, 25 bp, Homo sapien
cctgtagaggaggcatttcccatac

SEQ ID NO: 51165 - DNA, 25 bp, Homo sapien
cctgtagcaggagaaaggcacttgg

SEQ ID NO: 51166 - DNA, 25 bp, Homo sapien
cctgtagcaggataaaggcacttgg

SEQ ID NO: 51167 - DNA, 25 bp, Homo sapien
cctgtaggaatcttctcgctgaggt

SEQ ID NO: 51168 - DNA, 25 bp, Homo sapien
cctgtaggaatcttcttgctgaggt

SEQ ID NO: 51169 - DNA, 25 bp, Homo sapien
cctgtagggtggccaacttgtccca

SEQ ID NO: 51170 - DNA, 25 bp, Homo sapien
cctgtagggtggccaatttgtccca

SEQ ID NO: 51171 - DNA, 25 bp, Homo sapien
cctgtatctcttcacagtcatgatg

SEQ ID NO: 51172 - DNA, 25 bp, Homo sapien
cctgtatctcttcgcagtcatgatg

SEQ ID NO: 51173 - DNA, 25 bp, Homo sapien
cctgtatctttagtagaagtgctgc

SEQ ID NO: 51174 - DNA, 25 bp, Homo sapien
cctgtatctttagtaggagtgctgc

SEQ ID NO: 51175 - DNA, 25 bp, Homo sapien
cctgtatctttcttgctttgtagac

SEQ ID NO: 51176 - DNA, 25 bp, Homo sapien
cctgtatcttttgcagtgtttaaat

SEQ ID NO: 51177 - DNA, 25 bp, Homo sapien
cctgtatcttttgtagtgtttaaat

SEQ ID NO: 51178 - DNA, 25 bp, Homo sapien
cctgtatcttttttgctttgtagac

SEQ ID NO: 51179 - DNA, 25 bp, Homo sapien
cctgtatggtattgatacttgcaga

SEQ ID NO: 51180 - DNA, 25 bp, Homo sapien
cctgtatggtattgatgcttgcaga

SEQ ID NO: 51181 - DNA, 25 bp, Homo sapien
cctgtatgtccagaagatataaaac

SEQ ID NO: 51182 - DNA, 25 bp, Homo sapien
cctgtatgtccagaggatataaaac

SEQ ID NO: 51183 - DNA, 25 bp, Homo sapien
cctgtattgttcttagaatgtatgt

SEQ ID NO: 51184 - DNA, 25 bp, Homo sapien
cctgtattgtttttagaatgtatgt

SEQ ID NO: 51185 - DNA, 25 bp, Homo sapien
cctgtatttacaaagctccctgttt

SEQ ID NO: 51186 - DNA, 25 bp, Homo sapien
cctgtatttacatagctccctgttt

SEQ ID NO: 51187 - DNA, 25 bp, Homo sapien
cctgtatttcttggtttcagtatta

SEQ ID NO: 51188 - DNA, 25 bp, Homo sapien
cctgtatttgttggtttcagtatta

SEQ ID NO: 51189 - DNA, 25 bp, Homo sapien
cctgtcaataggagcgactcacgcg

SEQ ID NO: 51190 - DNA, 25 bp, Homo sapien
cctgtcaataggagcgtctcacgcg

SEQ ID NO: 51191 - DNA, 25 bp, Homo sapien
cctgtcagcaccgcacactgcatca

SEQ ID NO: 51192 - DNA, 25 bp, Homo sapien
cctgtcagcacggcacactgcatca

SEQ ID NO: 51193 - DNA, 25 bp, Homo sapien
cctgtcagcttggcagaaaatgtaa

SEQ ID NO: 51194 - DNA, 25 bp, Homo sapien
cctgtcagcttggcaggaaatgtaa

SEQ ID NO: 51195 - DNA, 25 bp, Homo sapien
cctgtcatcctagagaaaaaacata

SEQ ID NO: 51196 - DNA, 25 bp, Homo sapien
cctgtcatcttagagaaaaaacata

SEQ ID NO: 51197 - DNA, 25 bp, Homo sapien
cctgtcatgccaccttgctccctgg

SEQ ID NO: 51198 - DNA, 25 bp, Homo sapien
cctgtcatgccgccttgctccctgg

SEQ ID NO: 51199 - DNA, 25 bp, Homo sapien
cctgtcattgtggtcaaaaaccacg

SEQ ID NO: 51200 - DNA, 25 bp, Homo sapien
cctgtcattgtggtcagaaaccacg

SEQ ID NO: 51201 - DNA, 25 bp, Homo sapien
cctgtccctaacaaaaattgcctgg

SEQ ID NO: 51202 - DNA, 25 bp, Homo sapien
cctgtccctaacacaaattgcctgg

SEQ ID NO: 51203 - DNA, 25 bp, Homo sapien
cctgtcctggttcatctttgagtaa

SEQ ID NO: 51204 - DNA, 25 bp, Homo sapien
cctgtcctggtttatctttgagtaa

SEQ ID NO: 51205 - DNA, 25 bp, Homo sapien
cctgtcgtcttcatcatcgtcatca

SEQ ID NO: 51206 - DNA, 25 bp, Homo sapien
cctgtcgtcttcgtcatcgtcatca

SEQ ID NO: 51207 - DNA, 25 bp, Homo sapien
cctgtctaggccgcccaaattgctg

SEQ ID NO: 51208 - DNA, 25 bp, Homo sapien
cctgtctaggctgcccaaattgctg

SEQ ID NO: 51209 - DNA, 25 bp, Homo sapien
cctgtctctcacacatataattttt

SEQ ID NO: 51210 - DNA, 25 bp, Homo sapien
cctgtctctcacacgtataattttt

SEQ ID NO: 51211 - DNA, 25 bp, Homo sapien
cctgtctcttcacgcctgcagcaag

SEQ ID NO: 51212 - DNA, 25 bp, Homo sapien
cctgtctcttcatgcctgcagcaag

SEQ ID NO: 51213 - DNA, 25 bp, Homo sapien
cctgtctcttgttcatgttgcaatt

SEQ ID NO: 51214 - DNA, 25 bp, Homo sapien
cctgtctcttgttcattttgcaatt

SEQ ID NO: 51215 - DNA, 25 bp, Homo sapien
cctgtctggcagcatatggtgtggc

SEQ ID NO: 51216 - DNA, 25 bp, Homo sapien
cctgtctggcagtatatggtgtggc

SEQ ID NO: 51217 - DNA, 25 bp, Homo sapien
cctgtgaacaagataaggaagatgc

SEQ ID NO: 51218 - DNA, 25 bp, Homo sapien
cctgtgaacattttatcttaaatgg

SEQ ID NO: 51219 - DNA, 25 bp, Homo sapien
cctgtgaacattttgtcttaaatgg

SEQ ID NO: 51220 - DNA, 25 bp, Homo sapien
cctgtgaacgagataaggaagatgc

SEQ ID NO: 51221 - DNA, 25 bp, Homo sapien
cctgtgacattttacggactgctaa

SEQ ID NO: 51222 - DNA, 25 bp, Homo sapien
cctgtgacattttatggactgctaa

SEQ ID NO: 51223 - DNA, 25 bp, Homo sapien
cctgtgacttataaataatgcttta

SEQ ID NO: 51224 - DNA, 25 bp, Homo sapien
cctgtgacttatagataatgcttta

SEQ ID NO: 51225 - DNA, 25 bp, Homo sapien
cctgtgagcttctggtagcaacagt

SEQ ID NO: 51226 - DNA, 25 bp, Homo sapien
cctgtgagcttctggttgcaacagt

SEQ ID NO: 51227 - DNA, 25 bp, Homo sapien
cctgtgaggacaacaatttgttttt

SEQ ID NO: 51228 - DNA, 25 bp, Homo sapien
cctgtgaggacaataatttgttttt

SEQ ID NO: 51229 - DNA, 25 bp, Homo sapien
cctgtgaggcactgccaagtcgcat

SEQ ID NO: 51230 - DNA, 25 bp, Homo sapien
cctgtgaggcattgccaagtcgcat

SEQ ID NO: 51231 - DNA, 25 bp, Homo sapien
cctgtgatgatggccctgagttgtg

SEQ ID NO: 51232 - DNA, 25 bp, Homo sapien
cctgtgatgatgtccctgagttgtg

SEQ ID NO: 51233 - DNA, 25 bp, Homo sapien
cctgtgcacataatgggtcctgagt

SEQ ID NO: 51234 - DNA, 25 bp, Homo sapien
cctgtgcacatagtgggtcctgagt

SEQ ID NO: 51235 - DNA, 25 bp, Homo sapien
cctgtggacctcatttttcttgttt

SEQ ID NO: 51236 - DNA, 25 bp, Homo sapien
cctgtggacttcatttttcttgttt

SEQ ID NO: 51237 - DNA, 25 bp, Homo sapien
cctgtggatatgcaccttgtgtggc

SEQ ID NO: 51238 - DNA, 25 bp, Homo sapien
cctgtggatatgtaccttgtgtggc

SEQ ID NO: 51239 - DNA, 25 bp, Homo sapien
cctgtggcacttcagcgactattca

SEQ ID NO: 51240 - DNA, 25 bp, Homo sapien
cctgtggcactttagcgactattca

SEQ ID NO: 51241 - DNA, 25 bp, Homo sapien
cctgtgtaactctacatcagatatt

SEQ ID NO: 51242 - DNA, 25 bp, Homo sapien
cctgtgtacctctacatcagatatt

SEQ ID NO: 51243 - DNA, 25 bp, Homo sapien
cctgtgtaggctaagcctctgtttg

SEQ ID NO: 51244 - DNA, 25 bp, Homo sapien
cctgtgtaggctaagcttctgtttg

SEQ ID NO: 51245 - DNA, 25 bp, Homo sapien
cctgtgtccatgtaagttatttagc

SEQ ID NO: 51246 - DNA, 25 bp, Homo sapien
cctgtgtccctgtaagttatttagc

SEQ ID NO: 51247 - DNA, 25 bp, Homo sapien
cctgtgtgaccttggagaaatagct

SEQ ID NO: 51248 - DNA, 25 bp, Homo sapien
cctgtgtgctccctgactggcaatc

SEQ ID NO: 51249 - DNA, 25 bp, Homo sapien
cctgtgtgctctctgactggcaatc

SEQ ID NO: 51250 - DNA, 25 bp, Homo sapien
cctgtgtgtccttggagaaatagct

SEQ ID NO: 51251 - DNA, 25 bp, Homo sapien
cctgtgttagacagcccaggaaact

SEQ ID NO: 51252 - DNA, 25 bp, Homo sapien
cctgtgttgcctattgatttcaagt

SEQ ID NO: 51253 - DNA, 25 bp, Homo sapien
cctgtgttgcctgttgatttcaagt

SEQ ID NO: 51254 - DNA, 25 bp, Homo sapien
cctgtgtttgacagcccaggaaact

SEQ ID NO: 51255 - DNA, 25 bp, Homo sapien
cctgttaacagagtcctaactgagc

SEQ ID NO: 51256 - DNA, 25 bp, Homo sapien
cctgttaacagagttctaactgagc

SEQ ID NO: 51257 - DNA, 25 bp, Homo sapien
cctgttacccaagacggttattcca

SEQ ID NO: 51258 - DNA, 25 bp, Homo sapien
cctgttacccaagatggttattcca

SEQ ID NO: 51259 - DNA, 25 bp, Homo sapien
cctgttatagccagtttgtgttgga

SEQ ID NO: 51260 - DNA, 25 bp, Homo sapien
cctgttatagccggtttgtgttgga

SEQ ID NO: 51261 - DNA, 25 bp, Homo sapien
cctgttatatagagcaatcatgaat

SEQ ID NO: 51262 - DNA, 25 bp, Homo sapien
cctgttatatagcgcaatcatgaat

SEQ ID NO: 51263 - DNA, 25 bp, Homo sapien
cctgttctcaacttttaactccacc

SEQ ID NO: 51264 - DNA, 25 bp, Homo sapien
cctgttctcaacttttcactccacc

SEQ ID NO: 51265 - DNA, 25 bp, Homo sapien
cctgttcttgtacgaaccaaatgaa

SEQ ID NO: 51266 - DNA, 25 bp, Homo sapien
cctgttcttgtatgaaccaaatgaa

SEQ ID NO: 51267 - DNA, 25 bp, Homo sapien
cctgttgaacgaaacattttcatga

SEQ ID NO: 51268 - DNA, 25 bp, Homo sapien
cctgttgaatgaaacattttcatga

SEQ ID NO: 51269 - DNA, 25 bp, Homo sapien
cctgttgatcaatgacactaatcta

SEQ ID NO: 51270 - DNA, 25 bp, Homo sapien
cctgttgatcagtgacactaatcta

SEQ ID NO: 51271 - DNA, 25 bp, Homo sapien
cctgttgatgagactgatggcaaat

SEQ ID NO: 51272 - DNA, 25 bp, Homo sapien
cctgttgatgagagtgatggcaaat

SEQ ID NO: 51273 - DNA, 25 bp, Homo sapien
cctgttgatggctgtggaagaggta

SEQ ID NO: 51274 - DNA, 25 bp, Homo sapien
cctgttgattcactaaacaaatgcc

SEQ ID NO: 51275 - DNA, 25 bp, Homo sapien
cctgttgattcactgaacaaatgcc

SEQ ID NO: 51276 - DNA, 25 bp, Homo sapien
cctgttgattgctgtggaagaggta

SEQ ID NO: 51277 - DNA, 25 bp, Homo sapien
cctgttggacggaactttgctttat

SEQ ID NO: 51278 - DNA, 25 bp, Homo sapien
cctgttggatggaactttgctttat

SEQ ID NO: 51279 - DNA, 25 bp, Homo sapien
cctgttgtatcccttgctgtgttcc

SEQ ID NO: 51280 - DNA, 25 bp, Homo sapien
cctgttgtatcctttgctgtgttcc

SEQ ID NO: 51281 - DNA, 25 bp, Homo sapien
cctgtttaagaaaagtttgcctatg

SEQ ID NO: 51282 - DNA, 25 bp, Homo sapien
cctgtttaagaaatgtttgcctatg

SEQ ID NO: 51283 - DNA, 25 bp, Homo sapien
cctgtttcacatgacagccctttat

SEQ ID NO: 51284 - DNA, 25 bp, Homo sapien
cctgtttcacatggcagccctttat

SEQ ID NO: 51285 - DNA, 25 bp, Homo sapien
cctgttttagcattattatgtatta

SEQ ID NO: 51286 - DNA, 25 bp, Homo sapien
cctgttttagcattcttatgtatta

SEQ ID NO: 51287 - DNA, 25 bp, Homo sapien
cctgttttcatgactgcaatgactg

SEQ ID NO: 51288 - DNA, 25 bp, Homo sapien
cctgttttcatgactggaatgactg

SEQ ID NO: 51289 - DNA, 25 bp, Homo sapien
ccttaaaacacagatgctgagcccc

SEQ ID NO: 51290 - DNA, 25 bp, Homo sapien
ccttaaaacacagatggtgagcccc

SEQ ID NO: 51291 - DNA, 25 bp, Homo sapien
ccttaaacgcctagatacaataagt

SEQ ID NO: 51292 - DNA, 25 bp, Homo sapien
ccttaaacgcctaggtacaataagt

SEQ ID NO: 51293 - DNA, 25 bp, Homo sapien
ccttaacatatgcaaataataagca

SEQ ID NO: 51294 - DNA, 25 bp, Homo sapien
ccttaacatgtgcaaataataagca

SEQ ID NO: 51295 - DNA, 25 bp, Homo sapien
ccttaaccatgggtaacagtcatgg

SEQ ID NO: 51296 - DNA, 25 bp, Homo sapien
ccttaaccgtgggtaacagtcatgg

SEQ ID NO: 51297 - DNA, 25 bp, Homo sapien
ccttaactgctgggaatttgagaag

SEQ ID NO: 51298 - DNA, 25 bp, Homo sapien
ccttaactgctgggcatttgagaag

SEQ ID NO: 51299 - DNA, 25 bp, Homo sapien
ccttaaggacaatattagacatctg

SEQ ID NO: 51300 - DNA, 25 bp, Homo sapien
ccttaaggacaatattggacatctg

SEQ ID NO: 51301 - DNA, 25 bp, Homo sapien
ccttaaggcctaggtctaccttcat

SEQ ID NO: 51302 - DNA, 25 bp, Homo sapien
ccttaaggcctatgtctaccttcat

SEQ ID NO: 51303 - DNA, 25 bp, Homo sapien
ccttaagggaacattgtttgtaggc

SEQ ID NO: 51304 - DNA, 25 bp, Homo sapien
ccttaagggaatattgtttgtaggc

SEQ ID NO: 51305 - DNA, 25 bp, Homo sapien
ccttaagtacaattggattttccag

SEQ ID NO: 51306 - DNA, 25 bp, Homo sapien
ccttaagttcaattggattttccag

SEQ ID NO: 51307 - DNA, 25 bp, Homo sapien
ccttaatagttttttacatgcctgt

SEQ ID NO: 51308 - DNA, 25 bp, Homo sapien
ccttaatatcatcctcattattatc

SEQ ID NO: 51309 - DNA, 25 bp, Homo sapien
ccttaatatcatcctcgttattatc

SEQ ID NO: 51310 - DNA, 25 bp, Homo sapien
ccttaatatttttttacatgcctgt

SEQ ID NO: 51311 - DNA, 25 bp, Homo sapien
ccttaatgcttcctatctctcacac

SEQ ID NO: 51312 - DNA, 25 bp, Homo sapien
ccttaatgcttcctatgtctcacac

SEQ ID NO: 51313 - DNA, 25 bp, Homo sapien
ccttaatttcctcactgccataatt

SEQ ID NO: 51314 - DNA, 25 bp, Homo sapien
ccttaattttctcactgccataatt

SEQ ID NO: 51315 - DNA, 25 bp, Homo sapien
ccttaattttggtttgaaaagccag

SEQ ID NO: 51316 - DNA, 25 bp, Homo sapien
ccttaattttgttttgaaaagccag

SEQ ID NO: 51317 - DNA, 25 bp, Homo sapien
ccttacaaccttatctcgttggatt

SEQ ID NO: 51318 - DNA, 25 bp, Homo sapien
ccttacaactaccaagcgaggcaga

SEQ ID NO: 51319 - DNA, 25 bp, Homo sapien
ccttacaactaccaagtgaggcaga

SEQ ID NO: 51320 - DNA, 25 bp, Homo sapien
ccttacaacttcatttctccctgca

SEQ ID NO: 51321 - DNA, 25 bp, Homo sapien
ccttacaactttatttctccctgca

SEQ ID NO: 51322 - DNA, 25 bp, Homo sapien
ccttacaagcttatctcgttggatt

SEQ ID NO: 51323 - DNA, 25 bp, Homo sapien
ccttacacccttgaacctggtttct

SEQ ID NO: 51324 - DNA, 25 bp, Homo sapien
ccttacacccttgagcctggtttct

SEQ ID NO: 51325 - DNA, 25 bp, Homo sapien
ccttacagtgtgtgacagggagaga

SEQ ID NO: 51326 - DNA, 25 bp, Homo sapien
ccttacagtgtgttacagggagaga

SEQ ID NO: 51327 - DNA, 25 bp, Homo sapien
ccttacccagtccgccaattcaaat

SEQ ID NO: 51328 - DNA, 25 bp, Homo sapien
ccttacccagtctgccaattcaaat

SEQ ID NO: 51329 - DNA, 25 bp, Homo sapien
ccttacctattgcccattaggcacc

SEQ ID NO: 51330 - DNA, 25 bp, Homo sapien
ccttacctgttgcccattaggcacc

SEQ ID NO: 51331 - DNA, 25 bp, Homo sapien
ccttacggttcaacaagcttcccct

SEQ ID NO: 51332 - DNA, 25 bp, Homo sapien
ccttacggttcagcaagcttcccct

SEQ ID NO: 51333 - DNA, 25 bp, Homo sapien
ccttactaattcaaagctgtagttt

SEQ ID NO: 51334 - DNA, 25 bp, Homo sapien
ccttactaattcaaagttgtagttt

SEQ ID NO: 51335 - DNA, 25 bp, Homo sapien
ccttactagctgtgtgatcttgact

SEQ ID NO: 51336 - DNA, 25 bp, Homo sapien
ccttactatctgtgtgatcttgact

SEQ ID NO: 51337 - DNA, 25 bp, Homo sapien
ccttactccttctctttttggaata

SEQ ID NO: 51338 - DNA, 25 bp, Homo sapien
ccttactctttctctttttggaata

SEQ ID NO: 51339 - DNA, 25 bp, Homo sapien
ccttacttacggcacagaattaaat

SEQ ID NO: 51340 - DNA, 25 bp, Homo sapien
ccttacttatgctaccttacttctc

SEQ ID NO: 51341 - DNA, 25 bp, Homo sapien
ccttacttatgctatcttacttctc

SEQ ID NO: 51342 - DNA, 25 bp, Homo sapien
ccttacttatggcacagaattaaat

SEQ ID NO: 51343 - DNA, 25 bp, Homo sapien
ccttacttgaccactctgattagag

SEQ ID NO: 51344 - DNA, 25 bp, Homo sapien
ccttacttgcataggcactttatat

SEQ ID NO: 51345 - DNA, 25 bp, Homo sapien
ccttactttaccactctgattagag

SEQ ID NO: 51346 - DNA, 25 bp, Homo sapien
ccttactttcactttgcattttttg

SEQ ID NO: 51347 - DNA, 25 bp, Homo sapien
ccttactttcataggcactttatat

SEQ ID NO: 51348 - DNA, 25 bp, Homo sapien
ccttactttcattttgcattttttg

SEQ ID NO: 51349 - DNA, 25 bp, Homo sapien
ccttactttctccaaaatatacagt

SEQ ID NO: 51350 - DNA, 25 bp, Homo sapien
ccttactttctccagaatatacagt

SEQ ID NO: 51351 - DNA, 25 bp, Homo sapien
ccttagaacagactagaaaatgtat

SEQ ID NO: 51352 - DNA, 25 bp, Homo sapien
ccttagaacatgcccatgaacaatc

SEQ ID NO: 51353 - DNA, 25 bp, Homo sapien
ccttagaacggactagaaaatgtat

SEQ ID NO: 51354 - DNA, 25 bp, Homo sapien
ccttagaatagaaggctgttctaca

SEQ ID NO: 51355 - DNA, 25 bp, Homo sapien
ccttagaatatgcccatgaacaatc

SEQ ID NO: 51356 - DNA, 25 bp, Homo sapien
ccttagaatggaaggctgttctaca

SEQ ID NO: 51357 - DNA, 25 bp, Homo sapien
ccttagcaactctacaatcctgccc

SEQ ID NO: 51358 - DNA, 25 bp, Homo sapien
ccttagcaactctacagtcctgccc

SEQ ID NO: 51359 - DNA, 25 bp, Homo sapien
ccttagcaatctgctactgatatag

SEQ ID NO: 51360 - DNA, 25 bp, Homo sapien
ccttagcaatctgttactgatatag

SEQ ID NO: 51361 - DNA, 25 bp, Homo sapien
ccttagcgcagaacagtgtagcctt

SEQ ID NO: 51362 - DNA, 25 bp, Homo sapien
ccttagcgcagcacagtgtagcctt

SEQ ID NO: 51363 - DNA, 25 bp, Homo sapien
ccttaggaaactgcatagattaatg

SEQ ID NO: 51364 - DNA, 25 bp, Homo sapien
ccttaggaaactggatagattaatg

SEQ ID NO: 51365 - DNA, 25 bp, Homo sapien
ccttaggtgtagattaaaactgtgc

SEQ ID NO: 51366 - DNA, 25 bp, Homo sapien
ccttaggtgtaggttaaaactgtgc

SEQ ID NO: 51367 - DNA, 25 bp, Homo sapien
ccttagtctcttctgcccttataat

SEQ ID NO: 51368 - DNA, 25 bp, Homo sapien
ccttagtcttttctgcccttataat

SEQ ID NO: 51369 - DNA, 25 bp, Homo sapien
ccttagttggctcagcatgccttaa

SEQ ID NO: 51370 - DNA, 25 bp, Homo sapien
ccttagttggctcagcgtgccttaa

SEQ ID NO: 51371 - DNA, 25 bp, Homo sapien
ccttagttgttacatcttcaaagtg

SEQ ID NO: 51372 - DNA, 25 bp, Homo sapien
ccttagtttttacatcttcaaagtg

SEQ ID NO: 51373 - DNA, 25 bp, Homo sapien
ccttataagtgcagtcttccagggg

SEQ ID NO: 51374 - DNA, 25 bp, Homo sapien
ccttataagtgcggtcttccagggg

SEQ ID NO: 51375 - DNA, 25 bp, Homo sapien
ccttatcaaaacctaatcacctccc

SEQ ID NO: 51376 - DNA, 25 bp, Homo sapien
ccttatcaaaacctcatcacctccc

SEQ ID NO: 51377 - DNA, 25 bp, Homo sapien
ccttatcactgccttgaattcctca

SEQ ID NO: 51378 - DNA, 25 bp, Homo sapien
ccttatcattgccttgaattcctca

SEQ ID NO: 51379 - DNA, 25 bp, Homo sapien
ccttatccaaaggacgtgttaggct

SEQ ID NO: 51380 - DNA, 25 bp, Homo sapien
ccttatccaaaggaggtgttaggct

SEQ ID NO: 51381 - DNA, 25 bp, Homo sapien
ccttatctaccctttaatatcttcc

SEQ ID NO: 51382 - DNA, 25 bp, Homo sapien
ccttatctaccttttaatatcttcc

SEQ ID NO: 51383 - DNA, 25 bp, Homo sapien
ccttatcttgtcctgactaatggct

SEQ ID NO: 51384 - DNA, 25 bp, Homo sapien
ccttatcttgtcttgactaatggct

SEQ ID NO: 51385 - DNA, 25 bp, Homo sapien
ccttatgcatttcacagcctcttct

SEQ ID NO: 51386 - DNA, 25 bp, Homo sapien
ccttatgcatttcacatcctcttct

SEQ ID NO: 51387 - DNA, 25 bp, Homo sapien
ccttatgctatgcgagccactatga

SEQ ID NO: 51388 - DNA, 25 bp, Homo sapien
ccttatgctatgggagccactatga

SEQ ID NO: 51389 - DNA, 25 bp, Homo sapien
ccttatggcaccccattgctgcttt

SEQ ID NO: 51390 - DNA, 25 bp, Homo sapien
ccttatggcaccctattgctgcttt

SEQ ID NO: 51391 - DNA, 25 bp, Homo sapien
ccttattaaaatgtgacacaagtga

SEQ ID NO: 51392 - DNA, 25 bp, Homo sapien
ccttattaaaatgtgatacaagtga

SEQ ID NO: 51393 - DNA, 25 bp, Homo sapien
ccttattctagttaaatgtaaaagt

SEQ ID NO: 51394 - DNA, 25 bp, Homo sapien
ccttattctggttaaatgtaaaagt

SEQ ID NO: 51395 - DNA, 25 bp, Homo sapien
ccttattgatacattttgactttag

SEQ ID NO: 51396 - DNA, 25 bp, Homo sapien
ccttattgatagattttgactttag

SEQ ID NO: 51397 - DNA, 25 bp, Homo sapien
ccttatttgttgtatcatttctatt

SEQ ID NO: 51398 - DNA, 25 bp, Homo sapien
ccttatttgttgtatcgtttctatt

SEQ ID NO: 51399 - DNA, 25 bp, Homo sapien
ccttcaagtaaggtcactccagaaa

SEQ ID NO: 51400 - DNA, 25 bp, Homo sapien
ccttcaagtaaggtgactccagaaa

SEQ ID NO: 51401 - DNA, 25 bp, Homo sapien
ccttcaagtagcactggtgcagtct

SEQ ID NO: 51402 - DNA, 25 bp, Homo sapien
ccttcaagtagtcgataattggacc

SEQ ID NO: 51403 - DNA, 25 bp, Homo sapien
ccttcaagtagtcggtaattggacc

SEQ ID NO: 51404 - DNA, 25 bp, Homo sapien
ccttcaagtcgcactggtgcagtct

SEQ ID NO: 51405 - DNA, 25 bp, Homo sapien
ccttcaagtcttggagcatgcttat

SEQ ID NO: 51406 - DNA, 25 bp, Homo sapien
ccttcaagtctttgagcatgcttat

SEQ ID NO: 51407 - DNA, 25 bp, Homo sapien
ccttcaatctgcaaaaaatgcagta

SEQ ID NO: 51408 - DNA, 25 bp, Homo sapien
ccttcaatggattccaggctgcact

SEQ ID NO: 51409 - DNA, 25 bp, Homo sapien
ccttcaatgtattccaggctgcact

SEQ ID NO: 51410 - DNA, 25 bp, Homo sapien
ccttcaatttgcaaaaaatgcagta

SEQ ID NO: 51411 - DNA, 25 bp, Homo sapien
ccttcacacaaatctaaattttatt

SEQ ID NO: 51412 - DNA, 25 bp, Homo sapien
ccttcacacaagtctaaattttatt

SEQ ID NO: 51413 - DNA, 25 bp, Homo sapien
ccttcacaccttacacaccttatac

SEQ ID NO: 51414 - DNA, 25 bp, Homo sapien
ccttcacaccttatacaccttatac

SEQ ID NO: 51415 - DNA, 25 bp, Homo sapien
ccttcacacttatacagcaatgagg

SEQ ID NO: 51416 - DNA, 25 bp, Homo sapien
ccttcacatttatacagcaatgagg

SEQ ID NO: 51417 - DNA, 25 bp, Homo sapien
ccttcactcaacagtagtttttgtt

SEQ ID NO: 51418 - DNA, 25 bp, Homo sapien
ccttcactcaacattagtttttgtt

SEQ ID NO: 51419 - DNA, 25 bp, Homo sapien
ccttcactcattgtatgttaccttt

SEQ ID NO: 51420 - DNA, 25 bp, Homo sapien
ccttcactctttgtatgttaccttt

SEQ ID NO: 51421 - DNA, 25 bp, Homo sapien
ccttcactgtgcatatgtgagagga

SEQ ID NO: 51422 - DNA, 25 bp, Homo sapien
ccttcactgtgcgtatgtgagagga

SEQ ID NO: 51423 - DNA, 25 bp, Homo sapien
ccttcagaaaaattgcagcagctgg

SEQ ID NO: 51424 - DNA, 25 bp, Homo sapien
ccttcagacaaattgcagcagctgg

SEQ ID NO: 51425 - DNA, 25 bp, Homo sapien
ccttcagacttattttctcaatggg

SEQ ID NO: 51426 - DNA, 25 bp, Homo sapien
ccttcagagcaatattgtcttggct

SEQ ID NO: 51427 - DNA, 25 bp, Homo sapien
ccttcagagcaatattttcttggct

SEQ ID NO: 51428 - DNA, 25 bp, Homo sapien
ccttcagatgctccaatttgggaag

SEQ ID NO: 51429 - DNA, 25 bp, Homo sapien
ccttcagatgctccgatttgggaag

SEQ ID NO: 51430 - DNA, 25 bp, Homo sapien
ccttcagatttattttctcaatggg

SEQ ID NO: 51431 - DNA, 25 bp, Homo sapien
ccttcagcctggcatgagttaagtt

SEQ ID NO: 51432 - DNA, 25 bp, Homo sapien
ccttcagcctgggatgagttaagtt

SEQ ID NO: 51433 - DNA, 25 bp, Homo sapien
ccttcagctcccagttcctgagttt

SEQ ID NO: 51434 - DNA, 25 bp, Homo sapien
ccttcagcttccagttcctgagttt

SEQ ID NO: 51435 - DNA, 25 bp, Homo sapien
ccttcagtcagaaactggttccccg

SEQ ID NO: 51436 - DNA, 25 bp, Homo sapien
ccttcagtcagaagctggttccccg

SEQ ID NO: 51437 - DNA, 25 bp, Homo sapien
ccttcagttcctgcttttgaacaaa

SEQ ID NO: 51438 - DNA, 25 bp, Homo sapien
ccttcagttcctgtttttgaacaaa

SEQ ID NO: 51439 - DNA, 25 bp, Homo sapien
ccttcatacaaaaacgaaactgcta

SEQ ID NO: 51440 - DNA, 25 bp, Homo sapien
ccttcatacaaaaccgaaactgcta

SEQ ID NO: 51441 - DNA, 25 bp, Homo sapien
ccttcatactttttggtttcctggc

SEQ ID NO: 51442 - DNA, 25 bp, Homo sapien
ccttcatacttttttgtttcctggc

SEQ ID NO: 51443 - DNA, 25 bp, Homo sapien
ccttcatcagcatatatgcaaagag

SEQ ID NO: 51444 - DNA, 25 bp, Homo sapien
ccttcatcggcatatatgcaaagag

SEQ ID NO: 51445 - DNA, 25 bp, Homo sapien
ccttcatctctgcagagtcagttaa

SEQ ID NO: 51446 - DNA, 25 bp, Homo sapien
ccttcatctctgccgagtcagttaa

SEQ ID NO: 51447 - DNA, 25 bp, Homo sapien
ccttcatgagaagctattacagaat

SEQ ID NO: 51448 - DNA, 25 bp, Homo sapien
ccttcatgataagctattacagaat

SEQ ID NO: 51449 - DNA, 25 bp, Homo sapien
ccttcatgcctgactactgcagaac

SEQ ID NO: 51450 - DNA, 25 bp, Homo sapien
ccttcatgcctgtctactgcagaac

SEQ ID NO: 51451 - DNA, 25 bp, Homo sapien
ccttcatggataccaacggacaagg

SEQ ID NO: 51452 - DNA, 25 bp, Homo sapien
ccttcatggatatcaacggacaagg

SEQ ID NO: 51453 - DNA, 25 bp, Homo sapien
ccttcattattcagtggtttggcat

SEQ ID NO: 51454 - DNA, 25 bp, Homo sapien
ccttcattcttcagtggtttggcat

SEQ ID NO: 51455 - DNA, 25 bp, Homo sapien
ccttccaatttcaacatttaggact

SEQ ID NO: 51456 - DNA, 25 bp, Homo sapien
ccttccaatttcaagatttaggact

SEQ ID NO: 51457 - DNA, 25 bp, Homo sapien
ccttccacactacatgactggtaga

SEQ ID NO: 51458 - DNA, 25 bp, Homo sapien
ccttccacactatatgactggtaga

SEQ ID NO: 51459 - DNA, 25 bp, Homo sapien
ccttccacttcatgtctatctctat

SEQ ID NO: 51460 - DNA, 25 bp, Homo sapien
ccttccacttcatttctatctctat

SEQ ID NO: 51461 - DNA, 25 bp, Homo sapien
ccttccagctgatgaaattccagaa

SEQ ID NO: 51462 - DNA, 25 bp, Homo sapien
ccttccaggtgatgaaattccagaa

SEQ ID NO: 51463 - DNA, 25 bp, Homo sapien
ccttcccttacaagctgaatgtccc

SEQ ID NO: 51464 - DNA, 25 bp, Homo sapien
ccttcccttaccagctgaatgtccc

SEQ ID NO: 51465 - DNA, 25 bp, Homo sapien
ccttcctccgtaatcattacaaaca

SEQ ID NO: 51466 - DNA, 25 bp, Homo sapien
ccttcctctgtaatcattacaaaca

SEQ ID NO: 51467 - DNA, 25 bp, Homo sapien
ccttcctcttccacagtccaacaag

SEQ ID NO: 51468 - DNA, 25 bp, Homo sapien
ccttcctcttccacggtccaacaag

SEQ ID NO: 51469 - DNA, 25 bp, Homo sapien
ccttcctgagcgagtactgggtagc

SEQ ID NO: 51470 - DNA, 25 bp, Homo sapien
ccttcctgagcgattactgggtagc

SEQ ID NO: 51471 - DNA, 25 bp, Homo sapien
ccttcctgtacacaccagcttgagc

SEQ ID NO: 51472 - DNA, 25 bp, Homo sapien
ccttcctgtacagactggaccaaaa

SEQ ID NO: 51473 - DNA, 25 bp, Homo sapien
ccttcctgtacataccagcttgagc

SEQ ID NO: 51474 - DNA, 25 bp, Homo sapien
ccttcctgtacatactggaccaaaa

SEQ ID NO: 51475 - DNA, 25 bp, Homo sapien
ccttccttagaatagaaggctgttc

SEQ ID NO: 51476 - DNA, 25 bp, Homo sapien
ccttccttagaatggaaggctgttc

SEQ ID NO: 51477 - DNA, 25 bp, Homo sapien
ccttccttcataatagactcagtaa

SEQ ID NO: 51478 - DNA, 25 bp, Homo sapien
ccttccttcgtaatagactcagtaa

SEQ ID NO: 51479 - DNA, 25 bp, Homo sapien
ccttcggagaaccaccaatgcacag

SEQ ID NO: 51480 - DNA, 25 bp, Homo sapien
ccttcggagaaccaccgatgcacag

SEQ ID NO: 51481 - DNA, 25 bp, Homo sapien
ccttcgtgacgcaacagcaggaagt

SEQ ID NO: 51482 - DNA, 25 bp, Homo sapien
ccttcgtgatgcaacagcaggaagt

SEQ ID NO: 51483 - DNA, 25 bp, Homo sapien
ccttctaagcaccctggtgattaca

SEQ ID NO: 51484 - DNA, 25 bp, Homo sapien
ccttctaaggaccctggtgattaca

SEQ ID NO: 51485 - DNA, 25 bp, Homo sapien
ccttctaatttgcgccaaaatctct

SEQ ID NO: 51486 - DNA, 25 bp, Homo sapien
ccttctaatttgggccaaaatctct

SEQ ID NO: 51487 - DNA, 25 bp, Homo sapien
ccttctaccttaaactctctctccc

SEQ ID NO: 51488 - DNA, 25 bp, Homo sapien
ccttctaccttcaactctctctccc

SEQ ID NO: 51489 - DNA, 25 bp, Homo sapien
ccttctatacctcgcaaccttgcat

SEQ ID NO: 51490 - DNA, 25 bp, Homo sapien
ccttctataccttgcaaccttgcat

SEQ ID NO: 51491 - DNA, 25 bp, Homo sapien
ccttctatgccatacttatcactgt

SEQ ID NO: 51492 - DNA, 25 bp, Homo sapien
ccttctatgccgtacttatcactgt

SEQ ID NO: 51493 - DNA, 25 bp, Homo sapien
ccttctcaccacagagaactgggct

SEQ ID NO: 51494 - DNA, 25 bp, Homo sapien
ccttctcacctgaatctgacagtga

SEQ ID NO: 51495 - DNA, 25 bp, Homo sapien
ccttctcactacagagaactgggct

SEQ ID NO: 51496 - DNA, 25 bp, Homo sapien
ccttctcatctgaatctgacagtga

SEQ ID NO: 51497 - DNA, 25 bp, Homo sapien
ccttctcccaaggactgagctctgt

SEQ ID NO: 51498 - DNA, 25 bp, Homo sapien
ccttctcccgaggactgagctctgt

SEQ ID NO: 51499 - DNA, 25 bp, Homo sapien
ccttctccgagccgcaccttcctaa

SEQ ID NO: 51500 - DNA, 25 bp, Homo sapien
ccttctccgagctgcaccttcctaa

SEQ ID NO: 51501 - DNA, 25 bp, Homo sapien
ccttctctgattctgctcctgattt

SEQ ID NO: 51502 - DNA, 25 bp, Homo sapien
ccttctctgtaaagcagaactcaca

SEQ ID NO: 51503 - DNA, 25 bp, Homo sapien
ccttctctgtaaagtagaactcaca

SEQ ID NO: 51504 - DNA, 25 bp, Homo sapien
ccttctctgtttctgctcctgattt

SEQ ID NO: 51505 - DNA, 25 bp, Homo sapien
ccttctcttgtgttcgccatctacc

SEQ ID NO: 51506 - DNA, 25 bp, Homo sapien
ccttctcttgtgttcggcatctacc

SEQ ID NO: 51507 - DNA, 25 bp, Homo sapien
ccttctgaatggactacataacttg

SEQ ID NO: 51508 - DNA, 25 bp, Homo sapien
ccttctgaatggactatataacttg

SEQ ID NO: 51509 - DNA, 25 bp, Homo sapien
ccttctgatcaactaccacattcat

SEQ ID NO: 51510 - DNA, 25 bp, Homo sapien
ccttctgatcaactacgacattcat

SEQ ID NO: 51511 - DNA, 25 bp, Homo sapien
ccttctgccactttctctcggtgct

SEQ ID NO: 51512 - DNA, 25 bp, Homo sapien
ccttctgccactttctgtcggtgct

SEQ ID NO: 51513 - DNA, 25 bp, Homo sapien
ccttctgctggtgattagagctcat

SEQ ID NO: 51514 - DNA, 25 bp, Homo sapien
ccttctgctggtggttagagctcat

SEQ ID NO: 51515 - DNA, 25 bp, Homo sapien
ccttctggaaaaacgtcaccctgcc

SEQ ID NO: 51516 - DNA, 25 bp, Homo sapien
ccttctggaaaaatgtcaccctgcc

SEQ ID NO: 51517 - DNA, 25 bp, Homo sapien
ccttctgttcaaccagaagttctga

SEQ ID NO: 51518 - DNA, 25 bp, Homo sapien
ccttctgttcaagcagaagttctga

SEQ ID NO: 51519 - DNA, 25 bp, Homo sapien
ccttcttaacaagaaattggtgcca

SEQ ID NO: 51520 - DNA, 25 bp, Homo sapien
ccttcttaacaataaattggtgcca

SEQ ID NO: 51521 - DNA, 25 bp, Homo sapien
ccttcttatttaacttatttggtag

SEQ ID NO: 51522 - DNA, 25 bp, Homo sapien
ccttcttatttatcttatttggtag

SEQ ID NO: 51523 - DNA, 25 bp, Homo sapien
ccttcttcagcagccgcctctgctg

SEQ ID NO: 51524 - DNA, 25 bp, Homo sapien
ccttcttcagcagctgcctctgctg

SEQ ID NO: 51525 - DNA, 25 bp, Homo sapien
ccttcttcatctatgcacactccta

SEQ ID NO: 51526 - DNA, 25 bp, Homo sapien
ccttcttccgttatcaaaactagca

SEQ ID NO: 51527 - DNA, 25 bp, Homo sapien
ccttcttccgttgtcaaaactagca

SEQ ID NO: 51528 - DNA, 25 bp, Homo sapien
ccttcttcctacactacagtttggt

SEQ ID NO: 51529 - DNA, 25 bp, Homo sapien
ccttcttcctacactatagtttggt

SEQ ID NO: 51530 - DNA, 25 bp, Homo sapien
ccttcttcctttgttggcagcattc

SEQ ID NO: 51531 - DNA, 25 bp, Homo sapien
ccttcttcgtttgttggcagcattc

SEQ ID NO: 51532 - DNA, 25 bp, Homo sapien
ccttcttcttctatgcacactccta

SEQ ID NO: 51533 - DNA, 25 bp, Homo sapien
ccttcttgcaataactcttgatgga

SEQ ID NO: 51534 - DNA, 25 bp, Homo sapien
ccttcttgcaataactgttgatgga

SEQ ID NO: 51535 - DNA, 25 bp, Homo sapien
ccttcttgcagttacttcctaacgc

SEQ ID NO: 51536 - DNA, 25 bp, Homo sapien
ccttcttgcagttatttcctaacgc

SEQ ID NO: 51537 - DNA, 25 bp, Homo sapien
ccttcttggagaaaacctgttaata

SEQ ID NO: 51538 - DNA, 25 bp, Homo sapien
ccttcttggagaatcaattttagcc

SEQ ID NO: 51539 - DNA, 25 bp, Homo sapien
ccttcttggagaattaattttagcc

SEQ ID NO: 51540 - DNA, 25 bp, Homo sapien
ccttcttggagtaaacctgttaata

SEQ ID NO: 51541 - DNA, 25 bp, Homo sapien
ccttctttaggtattacggtggaag

SEQ ID NO: 51542 - DNA, 25 bp, Homo sapien
ccttctttaggtattatggtggaag

SEQ ID NO: 51543 - DNA, 25 bp, Homo sapien
ccttctttcattcgtttttgggtgg

SEQ ID NO: 51544 - DNA, 25 bp, Homo sapien
ccttctttccacgtctctcagtttc

SEQ ID NO: 51545 - DNA, 25 bp, Homo sapien
ccttctttccacgtctttcagtttc

SEQ ID NO: 51546 - DNA, 25 bp, Homo sapien
ccttctttcgttcgtttttgggtgg

SEQ ID NO: 51547 - DNA, 25 bp, Homo sapien
ccttctttctgcgccatcctattgt

SEQ ID NO: 51548 - DNA, 25 bp, Homo sapien
ccttctttctgtgccatcctattgt

SEQ ID NO: 51549 - DNA, 25 bp, Homo sapien
ccttcttttcacatagttaaccaat

SEQ ID NO: 51550 - DNA, 25 bp, Homo sapien
ccttcttttcacatggttaaccaat

SEQ ID NO: 51551 - DNA, 25 bp, Homo sapien
ccttgaaacatttatcttctgctca

SEQ ID NO: 51552 - DNA, 25 bp, Homo sapien
ccttgaaacctttatcttctgctca

SEQ ID NO: 51553 - DNA, 25 bp, Homo sapien
ccttgaaagctaccaccaaatcact

SEQ ID NO: 51554 - DNA, 25 bp, Homo sapien
ccttgaaagctactaccaaatcact

SEQ ID NO: 51555 - DNA, 25 bp, Homo sapien
ccttgaacatgcgcacagaaagggc

SEQ ID NO: 51556 - DNA, 25 bp, Homo sapien
ccttgaacatgtgcacagaaagggc

SEQ ID NO: 51557 - DNA, 25 bp, Homo sapien
ccttgaactctgtgtctgaaagtca

SEQ ID NO: 51558 - DNA, 25 bp, Homo sapien
ccttgaactctttgtctgaaagtca

SEQ ID NO: 51559 - DNA, 25 bp, Homo sapien
ccttgaactgttgaccacacatttt

SEQ ID NO: 51560 - DNA, 25 bp, Homo sapien
ccttgaactgttgacctcacatttt

SEQ ID NO: 51561 - DNA, 25 bp, Homo sapien
ccttgaataaacataagcagcagtc

SEQ ID NO: 51562 - DNA, 25 bp, Homo sapien
ccttgaataaacatcagcagcagtc

SEQ ID NO: 51563 - DNA, 25 bp, Homo sapien
ccttgaatataaacagaactcaaga

SEQ ID NO: 51564 - DNA, 25 bp, Homo sapien
ccttgaatataaagagaactcaaga

SEQ ID NO: 51565 - DNA, 25 bp, Homo sapien
ccttgacatttttatagctaaatct

SEQ ID NO: 51566 - DNA, 25 bp, Homo sapien
ccttgacatttttgtagctaaatct

SEQ ID NO: 51567 - DNA, 25 bp, Homo sapien
ccttgaccaaacacggaaatagcaa

SEQ ID NO: 51568 - DNA, 25 bp, Homo sapien
ccttgaccaaacatggaaatagcaa

SEQ ID NO: 51569 - DNA, 25 bp, Homo sapien
ccttgaccccattattgatgtcttg

SEQ ID NO: 51570 - DNA, 25 bp, Homo sapien
ccttgaccccattgttgatgtcttg

SEQ ID NO: 51571 - DNA, 25 bp, Homo sapien
ccttgacgcctcattgagtttgaac

SEQ ID NO: 51572 - DNA, 25 bp, Homo sapien
ccttgacgcctcgttgagtttgaac

SEQ ID NO: 51573 - DNA, 25 bp, Homo sapien
ccttgacgtcactggctacaggcta

SEQ ID NO: 51574 - DNA, 25 bp, Homo sapien
ccttgacgtcattggctacaggcta

SEQ ID NO: 51575 - DNA, 25 bp, Homo sapien
ccttgactctggatttaaagctttt

SEQ ID NO: 51576 - DNA, 25 bp, Homo sapien
ccttgactttggatttaaagctttt

SEQ ID NO: 51577 - DNA, 25 bp, Homo sapien
ccttgagagtggaagattattttgg

SEQ ID NO: 51578 - DNA, 25 bp, Homo sapien
ccttgagagtgggagattattttgg

SEQ ID NO: 51579 - DNA, 25 bp, Homo sapien
ccttgaggccaaagcccatggaacc

SEQ ID NO: 51580 - DNA, 25 bp, Homo sapien
ccttgaggccaaggcccatggaacc

SEQ ID NO: 51581 - DNA, 25 bp, Homo sapien
ccttgagtttgggcaggacttgttt

SEQ ID NO: 51582 - DNA, 25 bp, Homo sapien
ccttgagtttgggcagtacttgttt

SEQ ID NO: 51583 - DNA, 25 bp, Homo sapien
ccttgataaatactgacaaatagca

SEQ ID NO: 51584 - DNA, 25 bp, Homo sapien
ccttgataaatattgacaaatagca

SEQ ID NO: 51585 - DNA, 25 bp, Homo sapien
ccttgatattttgagtcaaaaagta

SEQ ID NO: 51586 - DNA, 25 bp, Homo sapien
ccttgatattttgagtgaaaaagta

SEQ ID NO: 51587 - DNA, 25 bp, Homo sapien
ccttgatcaacgtaatagtaaaaat

SEQ ID NO: 51588 - DNA, 25 bp, Homo sapien
ccttgatcaacgtaatggtaaaaat

SEQ ID NO: 51589 - DNA, 25 bp, Homo sapien
ccttgatccagaagatttttctcat

SEQ ID NO: 51590 - DNA, 25 bp, Homo sapien
ccttgatccagcagatttttctcat

SEQ ID NO: 51591 - DNA, 25 bp, Homo sapien
ccttgatgacactcgttttgtatag

SEQ ID NO: 51592 - DNA, 25 bp, Homo sapien
ccttgatgagagccatattttagga

SEQ ID NO: 51593 - DNA, 25 bp, Homo sapien
ccttgatgagagccttattttagga

SEQ ID NO: 51594 - DNA, 25 bp, Homo sapien
ccttgatgaggcagaaagagctaca

SEQ ID NO: 51595 - DNA, 25 bp, Homo sapien
ccttgatgaggtagaaagagctaca

SEQ ID NO: 51596 - DNA, 25 bp, Homo sapien
ccttgatgatactcgttttgtatag

SEQ ID NO: 51597 - DNA, 25 bp, Homo sapien
ccttgatttaccaggaaattacagg

SEQ ID NO: 51598 - DNA, 25 bp, Homo sapien
ccttgatttactaggaaattacagg

SEQ ID NO: 51599 - DNA, 25 bp, Homo sapien
ccttgatttgggcagagatttctgc

SEQ ID NO: 51600 - DNA, 25 bp, Homo sapien
ccttgatttggggagagatttctgc

SEQ ID NO: 51601 - DNA, 25 bp, Homo sapien
ccttgcaaacagagtacgactccct

SEQ ID NO: 51602 - DNA, 25 bp, Homo sapien
ccttgcaaacagagtatgactccct

SEQ ID NO: 51603 - DNA, 25 bp, Homo sapien
ccttgcaaattacaaaactcttggc

SEQ ID NO: 51604 - DNA, 25 bp, Homo sapien
ccttgcaaattagaaaactcttggc

SEQ ID NO: 51605 - DNA, 25 bp, Homo sapien
ccttgcaagaaacattaacagaagt

SEQ ID NO: 51606 - DNA, 25 bp, Homo sapien
ccttgcaagaaacgttaacagaagt

SEQ ID NO: 51607 - DNA, 25 bp, Homo sapien
ccttgcagacctcctggaatggtct

SEQ ID NO: 51608 - DNA, 25 bp, Homo sapien
ccttgcagagctcctggaatggtct

SEQ ID NO: 51609 - DNA, 25 bp, Homo sapien
ccttgcagtgaaatataacagtatg

SEQ ID NO: 51610 - DNA, 25 bp, Homo sapien
ccttgcagtgaattataacagtatg

SEQ ID NO: 51611 - DNA, 25 bp, Homo sapien
ccttgcagtgcaacatggagctata

SEQ ID NO: 51612 - DNA, 25 bp, Homo sapien
ccttgcagtgcagcatggagctata

SEQ ID NO: 51613 - DNA, 25 bp, Homo sapien
ccttgcattcaggcacagtgctctc

SEQ ID NO: 51614 - DNA, 25 bp, Homo sapien
ccttgcattcagtcacagtgctctc

SEQ ID NO: 51615 - DNA, 25 bp, Homo sapien
ccttgccaatattgaaataaaattg

SEQ ID NO: 51616 - DNA, 25 bp, Homo sapien
ccttgccagtattgaaataaaattg

SEQ ID NO: 51617 - DNA, 25 bp, Homo sapien
ccttgcccagctgctgtttgagaga

SEQ ID NO: 51618 - DNA, 25 bp, Homo sapien
ccttgcccggctgctgtttgagaga

SEQ ID NO: 51619 - DNA, 25 bp, Homo sapien
ccttgcctgactaaaacgtgaaaaa

SEQ ID NO: 51620 - DNA, 25 bp, Homo sapien
ccttgcctgacttaaacgtgaaaaa

SEQ ID NO: 51621 - DNA, 25 bp, Homo sapien
ccttgcctggctaaactttattctc

SEQ ID NO: 51622 - DNA, 25 bp, Homo sapien
ccttgcctggctatactttattctc

SEQ ID NO: 51623 - DNA, 25 bp, Homo sapien
ccttgcctgtcgtgttcacctgtcc

SEQ ID NO: 51624 - DNA, 25 bp, Homo sapien
ccttgcctgtcttgttcacctgtcc

SEQ ID NO: 51625 - DNA, 25 bp, Homo sapien
ccttgctcaagataatctacttttc

SEQ ID NO: 51626 - DNA, 25 bp, Homo sapien
ccttgctcaaggtaatctacttttc

SEQ ID NO: 51627 - DNA, 25 bp, Homo sapien
ccttgctcatctcagatctgccagg

SEQ ID NO: 51628 - DNA, 25 bp, Homo sapien
ccttgctcgtctcagatctgccagg

SEQ ID NO: 51629 - DNA, 25 bp, Homo sapien
ccttgctgaatactgttttttttgc

SEQ ID NO: 51630 - DNA, 25 bp, Homo sapien
ccttgctgaatacttttttttttgc

SEQ ID NO: 51631 - DNA, 25 bp, Homo sapien
ccttgctggcttttccatttgtcat

SEQ ID NO: 51632 - DNA, 25 bp, Homo sapien
ccttgctggcttttccgtttgtcat

SEQ ID NO: 51633 - DNA, 25 bp, Homo sapien
ccttgctttaagacagtcctctgat

SEQ ID NO: 51634 - DNA, 25 bp, Homo sapien
ccttgctttaagatagtcctctgat

SEQ ID NO: 51635 - DNA, 25 bp, Homo sapien
ccttggaaccagtctgaataggagg

SEQ ID NO: 51636 - DNA, 25 bp, Homo sapien
ccttggaaccagtctggataggagg

SEQ ID NO: 51637 - DNA, 25 bp, Homo sapien
ccttggaagaaaatggacactctga

SEQ ID NO: 51638 - DNA, 25 bp, Homo sapien
ccttggaagaaattggacactctga

SEQ ID NO: 51639 - DNA, 25 bp, Homo sapien
ccttggacaatgatttctaagcacc

SEQ ID NO: 51640 - DNA, 25 bp, Homo sapien
ccttggacaatgatttgtaagcacc

SEQ ID NO: 51641 - DNA, 25 bp, Homo sapien
ccttggacagatcatataatctctt

SEQ ID NO: 51642 - DNA, 25 bp, Homo sapien
ccttggacagatcgtataatctctt

SEQ ID NO: 51643 - DNA, 25 bp, Homo sapien
ccttggattgactaagtgtttatga

SEQ ID NO: 51644 - DNA, 25 bp, Homo sapien
ccttggattgactgagtgtttatga

SEQ ID NO: 51645 - DNA, 25 bp, Homo sapien
ccttggcccccagctgattttacag

SEQ ID NO: 51646 - DNA, 25 bp, Homo sapien
ccttggcccccagctgcttttacag

SEQ ID NO: 51647 - DNA, 25 bp, Homo sapien
ccttggctatctctgtctactcctc

SEQ ID NO: 51648 - DNA, 25 bp, Homo sapien
ccttggctcttgacactagagttcc

SEQ ID NO: 51649 - DNA, 25 bp, Homo sapien
ccttggctcttggcactagagttcc

SEQ ID NO: 51650 - DNA, 25 bp, Homo sapien
ccttggctgtctctgtctactcctc

SEQ ID NO: 51651 - DNA, 25 bp, Homo sapien
ccttggcttcgtatccccacaatat

SEQ ID NO: 51652 - DNA, 25 bp, Homo sapien
ccttggcttctgatatagcataata

SEQ ID NO: 51653 - DNA, 25 bp, Homo sapien
ccttggcttctgatatggcataata

SEQ ID NO: 51654 - DNA, 25 bp, Homo sapien
ccttggctttgtatccccacaatat

SEQ ID NO: 51655 - DNA, 25 bp, Homo sapien
ccttgggccacgcactatccaagtg

SEQ ID NO: 51656 - DNA, 25 bp, Homo sapien
ccttgggccacgcgctatccaagtg

SEQ ID NO: 51657 - DNA, 25 bp, Homo sapien
ccttgggccatgactgaacatcagc

SEQ ID NO: 51658 - DNA, 25 bp, Homo sapien
ccttgggccatgattgaacatcagc

SEQ ID NO: 51659 - DNA, 25 bp, Homo sapien
ccttgggtcattggtcccattccac

SEQ ID NO: 51660 - DNA, 25 bp, Homo sapien
ccttgggtcgttggtcccattccac

SEQ ID NO: 51661 - DNA, 25 bp, Homo sapien
ccttggtaaagctacctgagaatcc

SEQ ID NO: 51662 - DNA, 25 bp, Homo sapien
ccttggtagagctacctgagaatcc

SEQ ID NO: 51663 - DNA, 25 bp, Homo sapien
ccttggtatcattagtttctgtgat

SEQ ID NO: 51664 - DNA, 25 bp, Homo sapien
ccttggtatcattattttctgtgat

SEQ ID NO: 51665 - DNA, 25 bp, Homo sapien
ccttggtgacaacatcactatttat

SEQ ID NO: 51666 - DNA, 25 bp, Homo sapien
ccttggtgacagcatcactatttat

SEQ ID NO: 51667 - DNA, 25 bp, Homo sapien
ccttggtggtgccggactccagttc

SEQ ID NO: 51668 - DNA, 25 bp, Homo sapien
ccttggtggtgctggactccagttc

SEQ ID NO: 51669 - DNA, 25 bp, Homo sapien
ccttggtgtagaaaactttttactt

SEQ ID NO: 51670 - DNA, 25 bp, Homo sapien
ccttggtgtagataactttttactt

SEQ ID NO: 51671 - DNA, 25 bp, Homo sapien
ccttgtaagaaaaccaggtgggaaa

SEQ ID NO: 51672 - DNA, 25 bp, Homo sapien
ccttgtaagaaagccaggtgggaaa

SEQ ID NO: 51673 - DNA, 25 bp, Homo sapien
ccttgtacacggtatagctcaatac

SEQ ID NO: 51674 - DNA, 25 bp, Homo sapien
ccttgtacatggtatagctcaatac

SEQ ID NO: 51675 - DNA, 25 bp, Homo sapien
ccttgtacctccactataccatgcc

SEQ ID NO: 51676 - DNA, 25 bp, Homo sapien
ccttgtacctccgctataccatgcc

SEQ ID NO: 51677 - DNA, 25 bp, Homo sapien
ccttgtagattgtgagacaggttca

SEQ ID NO: 51678 - DNA, 25 bp, Homo sapien
ccttgtagattgtgaggcaggttca

SEQ ID NO: 51679 - DNA, 25 bp, Homo sapien
ccttgtataatctatccataagtgt

SEQ ID NO: 51680 - DNA, 25 bp, Homo sapien
ccttgtataatctctccataagtgt

SEQ ID NO: 51681 - DNA, 25 bp, Homo sapien
ccttgtatatgccattttataacct

SEQ ID NO: 51682 - DNA, 25 bp, Homo sapien
ccttgtatatgccgttttataacct

SEQ ID NO: 51683 - DNA, 25 bp, Homo sapien
ccttgtatcgttctatggaaatttt

SEQ ID NO: 51684 - DNA, 25 bp, Homo sapien
ccttgtatgacccttagagaaagga

SEQ ID NO: 51685 - DNA, 25 bp, Homo sapien
ccttgtatgactcttagagaaagga

SEQ ID NO: 51686 - DNA, 25 bp, Homo sapien
ccttgtattgttctatggaaatttt

SEQ ID NO: 51687 - DNA, 25 bp, Homo sapien
ccttgtctgtaccagaaaattcctc

SEQ ID NO: 51688 - DNA, 25 bp, Homo sapien
ccttgtctgtacctgaaaattcctc

SEQ ID NO: 51689 - DNA, 25 bp, Homo sapien
ccttgtgaaaaaacattaagttacc

SEQ ID NO: 51690 - DNA, 25 bp, Homo sapien
ccttgtgaaaaaatattaagttacc

SEQ ID NO: 51691 - DNA, 25 bp, Homo sapien
ccttgtgaaatcacctttaactgtg

SEQ ID NO: 51692 - DNA, 25 bp, Homo sapien
ccttgtgaaatcagctttaactgtg

SEQ ID NO: 51693 - DNA, 25 bp, Homo sapien
ccttgtgattccacgagtcaacact

SEQ ID NO: 51694 - DNA, 25 bp, Homo sapien
ccttgtgattccgcgagtcaacact

SEQ ID NO: 51695 - DNA, 25 bp, Homo sapien
ccttgtggcataacttgcggtccag

SEQ ID NO: 51696 - DNA, 25 bp, Homo sapien
ccttgtggcataatttgcggtccag

SEQ ID NO: 51697 - DNA, 25 bp, Homo sapien
ccttgttaggcaaaaaccttggaag

SEQ ID NO: 51698 - DNA, 25 bp, Homo sapien
ccttgttaggctgcttctttgcctt

SEQ ID NO: 51699 - DNA, 25 bp, Homo sapien
ccttgttaggcttcttctttgcctt

SEQ ID NO: 51700 - DNA, 25 bp, Homo sapien
ccttgttagtcaaaaaccttggaag

SEQ ID NO: 51701 - DNA, 25 bp, Homo sapien
ccttgttattttcttccgacctcat

SEQ ID NO: 51702 - DNA, 25 bp, Homo sapien
ccttgttattttcttctgacctcat

SEQ ID NO: 51703 - DNA, 25 bp, Homo sapien
ccttgttctcacgtcttctaagaga

SEQ ID NO: 51704 - DNA, 25 bp, Homo sapien
ccttgttctcatgtcttctaagaga

SEQ ID NO: 51705 - DNA, 25 bp, Homo sapien
ccttgttgtgagaccagacaaagat

SEQ ID NO: 51706 - DNA, 25 bp, Homo sapien
ccttgttgtgagatcagacaaagat

SEQ ID NO: 51707 - DNA, 25 bp, Homo sapien
ccttgttttatgaatggaaactagt

SEQ ID NO: 51708 - DNA, 25 bp, Homo sapien
ccttgttttattaatggaaactagt

SEQ ID NO: 51709 - DNA, 25 bp, Homo sapien
cctttaaactcagaatttataactc

SEQ ID NO: 51710 - DNA, 25 bp, Homo sapien
cctttaaactcggaatttataactc

SEQ ID NO: 51711 - DNA, 25 bp, Homo sapien
cctttaaatcacgaaaagcccactt

SEQ ID NO: 51712 - DNA, 25 bp, Homo sapien
cctttaaatcatgaaaagcccactt

SEQ ID NO: 51713 - DNA, 25 bp, Homo sapien
cctttaacaccattaccatggaaac

SEQ ID NO: 51714 - DNA, 25 bp, Homo sapien
cctttaacatcattaccatggaaac

SEQ ID NO: 51715 - DNA, 25 bp, Homo sapien
cctttaatgcaatgggtttccttct

SEQ ID NO: 51716 - DNA, 25 bp, Homo sapien
cctttaatgcagtgggtttccttct

SEQ ID NO: 51717 - DNA, 25 bp, Homo sapien
cctttacacacactgatgcattaca

SEQ ID NO: 51718 - DNA, 25 bp, Homo sapien
cctttacatacactgatgcattaca

SEQ ID NO: 51719 - DNA, 25 bp, Homo sapien
cctttaccaagcaagccaacctcag

SEQ ID NO: 51720 - DNA, 25 bp, Homo sapien
cctttaccgagcaagccaacctcag

SEQ ID NO: 51721 - DNA, 25 bp, Homo sapien
cctttagaacatgatgaaagccata

SEQ ID NO: 51722 - DNA, 25 bp, Homo sapien
cctttagaatatgatgaaagccata

SEQ ID NO: 51723 - DNA, 25 bp, Homo sapien
cctttagatccaacaatatttgcta

SEQ ID NO: 51724 - DNA, 25 bp, Homo sapien
cctttagatccatcaatatttgcta

SEQ ID NO: 51725 - DNA, 25 bp, Homo sapien
cctttagctaaagcctattctatga

SEQ ID NO: 51726 - DNA, 25 bp, Homo sapien
cctttagctaaatcctattctatga

SEQ ID NO: 51727 - DNA, 25 bp, Homo sapien
cctttagctattgcgaatatttctg

SEQ ID NO: 51728 - DNA, 25 bp, Homo sapien
cctttagctattgtgaatatttctg

SEQ ID NO: 51729 - DNA, 25 bp, Homo sapien
cctttagcttcaatgtattcattac

SEQ ID NO: 51730 - DNA, 25 bp, Homo sapien
cctttagcttcactgtattcattac

SEQ ID NO: 51731 - DNA, 25 bp, Homo sapien
cctttagggcaagcaccatctctgt

SEQ ID NO: 51732 - DNA, 25 bp, Homo sapien
cctttagggcaggcaccatctctgt

SEQ ID NO: 51733 - DNA, 25 bp, Homo sapien
cctttaggttcaggaagtagatgag

SEQ ID NO: 51734 - DNA, 25 bp, Homo sapien
cctttaggttcgggaagtagatgag

SEQ ID NO: 51735 - DNA, 25 bp, Homo sapien
cctttatagtttcgcctactcttct

SEQ ID NO: 51736 - DNA, 25 bp, Homo sapien
cctttatagtttcgtctactcttct

SEQ ID NO: 51737 - DNA, 25 bp, Homo sapien
cctttatccagcttcctcttcctgc

SEQ ID NO: 51738 - DNA, 25 bp, Homo sapien
cctttatcctgcttcctcttcctgc

SEQ ID NO: 51739 - DNA, 25 bp, Homo sapien
cctttatgtgcacggtagcagtgtg

SEQ ID NO: 51740 - DNA, 25 bp, Homo sapien
cctttatgtgcatggtagcagtgtg

SEQ ID NO: 51741 - DNA, 25 bp, Homo sapien
cctttattcagatgatcctacatat

SEQ ID NO: 51742 - DNA, 25 bp, Homo sapien
cctttattcagattatcctacatat

SEQ ID NO: 51743 - DNA, 25 bp, Homo sapien
cctttattgtgcaagactgccctgt

SEQ ID NO: 51744 - DNA, 25 bp, Homo sapien
cctttattgtgtaagactgccctgt

SEQ ID NO: 51745 - DNA, 25 bp, Homo sapien
cctttatttcggcagatgttacccc

SEQ ID NO: 51746 - DNA, 25 bp, Homo sapien
cctttattttggcagatgttacccc

SEQ ID NO: 51747 - DNA, 25 bp, Homo sapien
cctttcaagaaaatgcacagggtca

SEQ ID NO: 51748 - DNA, 25 bp, Homo sapien
cctttcaagaaactgcacagggtca

SEQ ID NO: 51749 - DNA, 25 bp, Homo sapien
cctttcacattttgacacacaaaaa

SEQ ID NO: 51750 - DNA, 25 bp, Homo sapien
cctttcacctgcgcagtcacaccct

SEQ ID NO: 51751 - DNA, 25 bp, Homo sapien
cctttcacctgggcagtcacaccct

SEQ ID NO: 51752 - DNA, 25 bp, Homo sapien
cctttcaccttgactatatggcatt

SEQ ID NO: 51753 - DNA, 25 bp, Homo sapien
cctttcaccttgtctatatggcatt

SEQ ID NO: 51754 - DNA, 25 bp, Homo sapien
cctttcaccttttgacacacaaaaa

SEQ ID NO: 51755 - DNA, 25 bp, Homo sapien
cctttcagagagagagtattcaaaa

SEQ ID NO: 51756 - DNA, 25 bp, Homo sapien
cctttcagagagagggtattcaaaa

SEQ ID NO: 51757 - DNA, 25 bp, Homo sapien
cctttcagctgttagtatgatatgc

SEQ ID NO: 51758 - DNA, 25 bp, Homo sapien
cctttcagctgttagtgtgatatgc

SEQ ID NO: 51759 - DNA, 25 bp, Homo sapien
cctttcatcttacccgcacatggct

SEQ ID NO: 51760 - DNA, 25 bp, Homo sapien
cctttcatcttacctgcacatggct

SEQ ID NO: 51761 - DNA, 25 bp, Homo sapien
cctttcattgttattctccagtgca

SEQ ID NO: 51762 - DNA, 25 bp, Homo sapien
cctttcattgttcttctccagtgca

SEQ ID NO: 51763 - DNA, 25 bp, Homo sapien
cctttccaagcgcggtcggctgtgt

SEQ ID NO: 51764 - DNA, 25 bp, Homo sapien
cctttccaagcgcggttggctgtgt

SEQ ID NO: 51765 - DNA, 25 bp, Homo sapien
cctttccacaaattaccatgcataa

SEQ ID NO: 51766 - DNA, 25 bp, Homo sapien
cctttccaccttcactgacttgctt

SEQ ID NO: 51767 - DNA, 25 bp, Homo sapien
cctttccactttcactgacttgctt

SEQ ID NO: 51768 - DNA, 25 bp, Homo sapien
cctttccagcggtagagttcaagag

SEQ ID NO: 51769 - DNA, 25 bp, Homo sapien
cctttccagtggtagagttcaagag

SEQ ID NO: 51770 - DNA, 25 bp, Homo sapien
cctttccataaattaccatgcataa

SEQ ID NO: 51771 - DNA, 25 bp, Homo sapien
cctttccatagtcgtcatgagctaa

SEQ ID NO: 51772 - DNA, 25 bp, Homo sapien
cctttccatagttgtcatgagctaa

SEQ ID NO: 51773 - DNA, 25 bp, Homo sapien
cctttccattcccagaggagagaaa

SEQ ID NO: 51774 - DNA, 25 bp, Homo sapien
cctttccattcccggaggagagaaa

SEQ ID NO: 51775 - DNA, 25 bp, Homo sapien
cctttcccattctactcaaagcatg

SEQ ID NO: 51776 - DNA, 25 bp, Homo sapien
cctttcccattttactcaaagcatg

SEQ ID NO: 51777 - DNA, 25 bp, Homo sapien
cctttcctacctggcaacatagaca

SEQ ID NO: 51778 - DNA, 25 bp, Homo sapien
cctttcctctcgttctaatggcaaa

SEQ ID NO: 51779 - DNA, 25 bp, Homo sapien
cctttcctctctttctaatggcaaa

SEQ ID NO: 51780 - DNA, 25 bp, Homo sapien
cctttcctgcctggcaacatagaca

SEQ ID NO: 51781 - DNA, 25 bp, Homo sapien
cctttcctttaatgcaatgggtttc

SEQ ID NO: 51782 - DNA, 25 bp, Homo sapien
cctttcctttaatgcagtgggtttc

SEQ ID NO: 51783 - DNA, 25 bp, Homo sapien
cctttccttttgaaattcctaggta

SEQ ID NO: 51784 - DNA, 25 bp, Homo sapien
cctttccttttgaagttcctaggta

SEQ ID NO: 51785 - DNA, 25 bp, Homo sapien
cctttctacacagagtgaaggagaa

SEQ ID NO: 51786 - DNA, 25 bp, Homo sapien
cctttctacacagggtgaaggagaa

SEQ ID NO: 51787 - DNA, 25 bp, Homo sapien
cctttctcaaaatctcctttaccac

SEQ ID NO: 51788 - DNA, 25 bp, Homo sapien
cctttctcaaaatttcctttaccac

SEQ ID NO: 51789 - DNA, 25 bp, Homo sapien
cctttctctacttgctgcttcttct

SEQ ID NO: 51790 - DNA, 25 bp, Homo sapien
cctttctctacttgcttcttcttct

SEQ ID NO: 51791 - DNA, 25 bp, Homo sapien
cctttctctcggatcaattacagag

SEQ ID NO: 51792 - DNA, 25 bp, Homo sapien
cctttctcttggatacagattgcta

SEQ ID NO: 51793 - DNA, 25 bp, Homo sapien
cctttctcttggataccgattgcta

SEQ ID NO: 51794 - DNA, 25 bp, Homo sapien
cctttctcttggatcaattacagag

SEQ ID NO: 51795 - DNA, 25 bp, Homo sapien
cctttctgaacgcttgcatgattgc

SEQ ID NO: 51796 - DNA, 25 bp, Homo sapien
cctttctgaacgcttgtatgattgc

SEQ ID NO: 51797 - DNA, 25 bp, Homo sapien
cctttctgagtttggtatgatcatt

SEQ ID NO: 51798 - DNA, 25 bp, Homo sapien
cctttctgagtttggtgtgatcatt

SEQ ID NO: 51799 - DNA, 25 bp, Homo sapien
cctttctgatctgatcttgtgctgc

SEQ ID NO: 51800 - DNA, 25 bp, Homo sapien
cctttctgatcttatcttgtgctgc

SEQ ID NO: 51801 - DNA, 25 bp, Homo sapien
cctttctgcacatgtctgagttgtg

SEQ ID NO: 51802 - DNA, 25 bp, Homo sapien
cctttctgcacgtgtctgagttgtg

SEQ ID NO: 51803 - DNA, 25 bp, Homo sapien
cctttcttacaatagaaccatcctt

SEQ ID NO: 51804 - DNA, 25 bp, Homo sapien
cctttcttacagtagaaccatcctt

SEQ ID NO: 51805 - DNA, 25 bp, Homo sapien
cctttcttattataccacatgcaaa

SEQ ID NO: 51806 - DNA, 25 bp, Homo sapien
cctttcttcaatataagttctcagc

SEQ ID NO: 51807 - DNA, 25 bp, Homo sapien
cctttcttcaatgtaagttctcagc

SEQ ID NO: 51808 - DNA, 25 bp, Homo sapien
cctttcttcgtgtacctgctgagct

SEQ ID NO: 51809 - DNA, 25 bp, Homo sapien
cctttcttgttataccacatgcaaa

SEQ ID NO: 51810 - DNA, 25 bp, Homo sapien
cctttctttgtgtacctgctgagct

SEQ ID NO: 51811 - DNA, 25 bp, Homo sapien
cctttgaaagacaaagtgctaccat

SEQ ID NO: 51812 - DNA, 25 bp, Homo sapien
cctttgaaagacaacgtgctaccat

SEQ ID NO: 51813 - DNA, 25 bp, Homo sapien
cctttgaagttacggctcttcttgc

SEQ ID NO: 51814 - DNA, 25 bp, Homo sapien
cctttgaagttatggctcttcttgc

SEQ ID NO: 51815 - DNA, 25 bp, Homo sapien
cctttgaatatcgtgtactttattt

SEQ ID NO: 51816 - DNA, 25 bp, Homo sapien
cctttgaatatggtgtactttattt

SEQ ID NO: 51817 - DNA, 25 bp, Homo sapien
cctttgaccttctatttgggccgat

SEQ ID NO: 51818 - DNA, 25 bp, Homo sapien
cctttgacgttctatttgggccgat

SEQ ID NO: 51819 - DNA, 25 bp, Homo sapien
cctttgagaaaaatggtaacagcag

SEQ ID NO: 51820 - DNA, 25 bp, Homo sapien
cctttgagctccaaaaattctttct

SEQ ID NO: 51821 - DNA, 25 bp, Homo sapien
cctttgagctccgaaaattctttct

SEQ ID NO: 51822 - DNA, 25 bp, Homo sapien
cctttgaggaaaatggtaacagcag

SEQ ID NO: 51823 - DNA, 25 bp, Homo sapien
cctttgagttgcatcgaacctgaaa

SEQ ID NO: 51824 - DNA, 25 bp, Homo sapien
cctttgagttgcattgaacctgaaa

SEQ ID NO: 51825 - DNA, 25 bp, Homo sapien
cctttgatgtagaaattatggagtt

SEQ ID NO: 51826 - DNA, 25 bp, Homo sapien
cctttgatgtagcaattatggagtt

SEQ ID NO: 51827 - DNA, 25 bp, Homo sapien
cctttgattgtataatgaatcaaca

SEQ ID NO: 51828 - DNA, 25 bp, Homo sapien
cctttgattgtatagtgaatcaaca

SEQ ID NO: 51829 - DNA, 25 bp, Homo sapien
cctttgccacagagcgagatcctgt

SEQ ID NO: 51830 - DNA, 25 bp, Homo sapien
cctttgccatagagcgagatcctgt

SEQ ID NO: 51831 - DNA, 25 bp, Homo sapien
cctttgctaagcacctcggtagatt

SEQ ID NO: 51832 - DNA, 25 bp, Homo sapien
cctttgctaagtacctcggtagatt

SEQ ID NO: 51833 - DNA, 25 bp, Homo sapien
cctttgctcatcttaaaatctggtt

SEQ ID NO: 51834 - DNA, 25 bp, Homo sapien
cctttgctcattttaaaatctggtt

SEQ ID NO: 51835 - DNA, 25 bp, Homo sapien
cctttggacgcaaatgtacctgaca

SEQ ID NO: 51836 - DNA, 25 bp, Homo sapien
cctttggatgcaaatgtacctgaca

SEQ ID NO: 51837 - DNA, 25 bp, Homo sapien
cctttggcacctccaacagttttgc

SEQ ID NO: 51838 - DNA, 25 bp, Homo sapien
cctttggcacctccaatagttttgc

SEQ ID NO: 51839 - DNA, 25 bp, Homo sapien
cctttggcatttgcttcaaacagcc

SEQ ID NO: 51840 - DNA, 25 bp, Homo sapien
cctttggcatttgtttcaaacagcc

SEQ ID NO: 51841 - DNA, 25 bp, Homo sapien
cctttggcccagatttcgtttctgg

SEQ ID NO: 51842 - DNA, 25 bp, Homo sapien
cctttggcccagattttgtttctgg

SEQ ID NO: 51843 - DNA, 25 bp, Homo sapien
cctttgggaaaccttccatcccttg

SEQ ID NO: 51844 - DNA, 25 bp, Homo sapien
cctttgggaaacgttccatcccttg

SEQ ID NO: 51845 - DNA, 25 bp, Homo sapien
cctttgggaactaattaatgaggtt

SEQ ID NO: 51846 - DNA, 25 bp, Homo sapien
cctttgggagctaattaatgaggtt

SEQ ID NO: 51847 - DNA, 25 bp, Homo sapien
cctttggttaagctcctgtgttcca

SEQ ID NO: 51848 - DNA, 25 bp, Homo sapien
cctttggttaagttcctgtgttcca

SEQ ID NO: 51849 - DNA, 25 bp, Homo sapien
cctttgtcagtcatcacctttgtca

SEQ ID NO: 51850 - DNA, 25 bp, Homo sapien
cctttgtcagtcgtcacctttgtca

SEQ ID NO: 51851 - DNA, 25 bp, Homo sapien
cctttgtggagtcccagaagcatga

SEQ ID NO: 51852 - DNA, 25 bp, Homo sapien
cctttgtggagtctcagaagcatga

SEQ ID NO: 51853 - DNA, 25 bp, Homo sapien
ccttttaatctgcactgaagtattt

SEQ ID NO: 51854 - DNA, 25 bp, Homo sapien
ccttttaatctgcattgaagtattt

SEQ ID NO: 51855 - DNA, 25 bp, Homo sapien
ccttttaatggatagattacacaga

SEQ ID NO: 51856 - DNA, 25 bp, Homo sapien
ccttttaatggatggattacacaga

SEQ ID NO: 51857 - DNA, 25 bp, Homo sapien
ccttttacaaacttacagaaactga

SEQ ID NO: 51858 - DNA, 25 bp, Homo sapien
ccttttacaaatttacagaaactga

SEQ ID NO: 51859 - DNA, 25 bp, Homo sapien
ccttttactatgtccaaagtctttt

SEQ ID NO: 51860 - DNA, 25 bp, Homo sapien
ccttttactctgtccaaagtctttt

SEQ ID NO: 51861 - DNA, 25 bp, Homo sapien
ccttttcacatgtgtagttttatat

SEQ ID NO: 51862 - DNA, 25 bp, Homo sapien
ccttttcaggcaagcacattacatg

SEQ ID NO: 51863 - DNA, 25 bp, Homo sapien
ccttttcaggcaagcatattacatg

SEQ ID NO: 51864 - DNA, 25 bp, Homo sapien
ccttttcataagactcgcccaccaa

SEQ ID NO: 51865 - DNA, 25 bp, Homo sapien
ccttttcataagattcgcccaccaa

SEQ ID NO: 51866 - DNA, 25 bp, Homo sapien
ccttttcatatgtgtagttttatat

SEQ ID NO: 51867 - DNA, 25 bp, Homo sapien
ccttttcgtgggacgagagcagagg

SEQ ID NO: 51868 - DNA, 25 bp, Homo sapien
ccttttcgtgggatgagagcagagg

SEQ ID NO: 51869 - DNA, 25 bp, Homo sapien
ccttttctaccatacgtcacaaacc

SEQ ID NO: 51870 - DNA, 25 bp, Homo sapien
ccttttctaccatgcgtcacaaacc

SEQ ID NO: 51871 - DNA, 25 bp, Homo sapien
ccttttctgaaggactatgaagctt

SEQ ID NO: 51872 - DNA, 25 bp, Homo sapien
ccttttctgaaggactgtgaagctt

SEQ ID NO: 51873 - DNA, 25 bp, Homo sapien
ccttttctgaatttatagtaacgac

SEQ ID NO: 51874 - DNA, 25 bp, Homo sapien
ccttttctgaatttttagtaacgac

SEQ ID NO: 51875 - DNA, 25 bp, Homo sapien
ccttttctgagaattagatagacca

SEQ ID NO: 51876 - DNA, 25 bp, Homo sapien
ccttttctgagaattatatagacca

SEQ ID NO: 51877 - DNA, 25 bp, Homo sapien
ccttttgaaattcctaggtaagcag

SEQ ID NO: 51878 - DNA, 25 bp, Homo sapien
ccttttgaagttcctaggtaagcag

SEQ ID NO: 51879 - DNA, 25 bp, Homo sapien
ccttttgcagcaaagcctttcccac

SEQ ID NO: 51880 - DNA, 25 bp, Homo sapien
ccttttgcagcagagcctttcccac

SEQ ID NO: 51881 - DNA, 25 bp, Homo sapien
ccttttgccaggaactgaatgccca

SEQ ID NO: 51882 - DNA, 25 bp, Homo sapien
ccttttgccaggaattgaatgccca

SEQ ID NO: 51883 - DNA, 25 bp, Homo sapien
ccttttggttctctatgtctgcact

SEQ ID NO: 51884 - DNA, 25 bp, Homo sapien
ccttttggttctctgtgtctgcact

SEQ ID NO: 51885 - DNA, 25 bp, Homo sapien
cctttttatccagttgttctcaagg

SEQ ID NO: 51886 - DNA, 25 bp, Homo sapien
cctttttatccggttgttctcaagg

SEQ ID NO: 51887 - DNA, 25 bp, Homo sapien
cctttttatgagaagagataatagg

SEQ ID NO: 51888 - DNA, 25 bp, Homo sapien
cctttttatgaggagagataatagg

SEQ ID NO: 51889 - DNA, 25 bp, Homo sapien
cctttttattttccattcccattct

SEQ ID NO: 51890 - DNA, 25 bp, Homo sapien
cctttttattttccgttcccattct

SEQ ID NO: 51891 - DNA, 25 bp, Homo sapien
cctttttcacaccaaggaccagttt

SEQ ID NO: 51892 - DNA, 25 bp, Homo sapien
cctttttccaaggagacagtggatg

SEQ ID NO: 51893 - DNA, 25 bp, Homo sapien
cctttttccaaggagagagtggatg

SEQ ID NO: 51894 - DNA, 25 bp, Homo sapien
cctttttcctatccttgctgctggc

SEQ ID NO: 51895 - DNA, 25 bp, Homo sapien
cctttttcgcaccaaggaccagttt

SEQ ID NO: 51896 - DNA, 25 bp, Homo sapien
cctttttcgtcagattaattcacaa

SEQ ID NO: 51897 - DNA, 25 bp, Homo sapien
cctttttcttatccttgctgctggc

SEQ ID NO: 51898 - DNA, 25 bp, Homo sapien
cctttttcttcagattaattcacaa

SEQ ID NO: 51899 - DNA, 25 bp, Homo sapien
cctttttgacctctcatttcctccc

SEQ ID NO: 51900 - DNA, 25 bp, Homo sapien
cctttttgacctgtcatttcctccc

SEQ ID NO: 51901 - DNA, 25 bp, Homo sapien
cctttttgcgttctgaagtatgaaa

SEQ ID NO: 51902 - DNA, 25 bp, Homo sapien
cctttttgggttctgaagtatgaaa

SEQ ID NO: 51903 - DNA, 25 bp, Homo sapien
cctttttgttccattggtctgtata

SEQ ID NO: 51904 - DNA, 25 bp, Homo sapien
cctttttgttccgttggtctgtata

SEQ ID NO: 51905 - DNA, 25 bp, Homo sapien
ccttttttaacacttaataagcagc

SEQ ID NO: 51906 - DNA, 25 bp, Homo sapien
ccttttttaacatttaataagcagc

SEQ ID NO: 51907 - DNA, 25 bp, Homo sapien
cctttttttcccttaaacattggaa

SEQ ID NO: 51908 - DNA, 25 bp, Homo sapien
ccttttttttccttaaacattggaa

SEQ ID NO: 51909 - DNA, 25 bp, Homo sapien
cctttttttttccttgtgtgtgtgt

SEQ ID NO: 51910 - DNA, 25 bp, Homo sapien
ccttttttttttcttgtgtgtgtgt

SEQ ID NO: 51911 - DNA, 25 bp, Homo sapien
cgaaaaaacaagtccaaggtgaaat

SEQ ID NO: 51912 - DNA, 25 bp, Homo sapien
cgaaaaaacaagtccagggtgaaat

SEQ ID NO: 51913 - DNA, 25 bp, Homo sapien
cgaaaacttctaaggatggaattca

SEQ ID NO: 51914 - DNA, 25 bp, Homo sapien
cgaaaacttgtaaggatggaattca

SEQ ID NO: 51915 - DNA, 25 bp, Homo sapien
cgaaaattcttagccagtattattt

SEQ ID NO: 51916 - DNA, 25 bp, Homo sapien
cgaaaattcttagccattattattt

SEQ ID NO: 51917 - DNA, 25 bp, Homo sapien
cgaaaccctggagtatcgcaatcat

SEQ ID NO: 51918 - DNA, 25 bp, Homo sapien
cgaaaccctggagtattgcaatcat

SEQ ID NO: 51919 - DNA, 25 bp, Homo sapien
cgaaactcccacatgtccttctttt

SEQ ID NO: 51920 - DNA, 25 bp, Homo sapien
cgaaactcccacgtgtccttctttt

SEQ ID NO: 51921 - DNA, 25 bp, Homo sapien
cgaaagataccaaagacaaagttaa

SEQ ID NO: 51922 - DNA, 25 bp, Homo sapien
cgaaagataccaaagataaagttaa

SEQ ID NO: 51923 - DNA, 25 bp, Homo sapien
cgaaagcaggtcaccggaagggctg

SEQ ID NO: 51924 - DNA, 25 bp, Homo sapien
cgaaagcaggtcgccggaagggctg

SEQ ID NO: 51925 - DNA, 25 bp, Homo sapien
cgaaaggaaaaatgtaaatgatcat

SEQ ID NO: 51926 - DNA, 25 bp, Homo sapien
cgaaaggataaatgtaaatgatcat

SEQ ID NO: 51927 - DNA, 25 bp, Homo sapien
cgaaatccaaacgcagggagagtgg

SEQ ID NO: 51928 - DNA, 25 bp, Homo sapien
cgaaatccaaatgcagggagagtgg

SEQ ID NO: 51929 - DNA, 25 bp, Homo sapien
cgaaatctacgcacttgtccaaagt

SEQ ID NO: 51930 - DNA, 25 bp, Homo sapien
cgaaatctatgcacttgtccaaagt

SEQ ID NO: 51931 - DNA, 25 bp, Homo sapien
cgaaatgctatgagcataaatcacc

SEQ ID NO: 51932 - DNA, 25 bp, Homo sapien
cgaaatgctgtgagcataaatcacc

SEQ ID NO: 51933 - DNA, 25 bp, Homo sapien
cgaaatggcgactcatgccctctcc

SEQ ID NO: 51934 - DNA, 25 bp, Homo sapien
cgaaatggtgactcatgccctctcc

SEQ ID NO: 51935 - DNA, 25 bp, Homo sapien
cgaacaaaacaaattaggaaaactg

SEQ ID NO: 51936 - DNA, 25 bp, Homo sapien
cgaacaaaccaaattaggaaaactg

SEQ ID NO: 51937 - DNA, 25 bp, Homo sapien
cgaacagtacggcaatgtggaaatt

SEQ ID NO: 51938 - DNA, 25 bp, Homo sapien
cgaacagtatggcaatgtggaaatt

SEQ ID NO: 51939 - DNA, 25 bp, Homo sapien
cgaacatgcaccctttagctgctct

SEQ ID NO: 51940 - DNA, 25 bp, Homo sapien
cgaacatgcactctttagctgctct

SEQ ID NO: 51941 - DNA, 25 bp, Homo sapien
cgaacattgctatggtctcttccag

SEQ ID NO: 51942 - DNA, 25 bp, Homo sapien
cgaacattgttatggtctcttccag

SEQ ID NO: 51943 - DNA, 25 bp, Homo sapien
cgaacgcaaacataataagttgtca

SEQ ID NO: 51944 - DNA, 25 bp, Homo sapien
cgaacgcaagcataataagttgtca

SEQ ID NO: 51945 - DNA, 25 bp, Homo sapien
cgaacgtttcgtctttggtggctaa

SEQ ID NO: 51946 - DNA, 25 bp, Homo sapien
cgaacgttttgtctttggtggctaa

SEQ ID NO: 51947 - DNA, 25 bp, Homo sapien
cgaactgttacctttccagaaaaga

SEQ ID NO: 51948 - DNA, 25 bp, Homo sapien
cgaactgtttcctttccagaaaaga

SEQ ID NO: 51949 - DNA, 25 bp, Homo sapien
cgaacttacctcatatttgtgttaa

SEQ ID NO: 51950 - DNA, 25 bp, Homo sapien
cgaacttacctcttatttgtgttaa

SEQ ID NO: 51951 - DNA, 25 bp, Homo sapien
cgaagaagatggcaaagatttgtca

SEQ ID NO: 51952 - DNA, 25 bp, Homo sapien
cgaagaagcacagatgtccagaaag

SEQ ID NO: 51953 - DNA, 25 bp, Homo sapien
cgaagaagcctggagtaaaatgaat

SEQ ID NO: 51954 - DNA, 25 bp, Homo sapien
cgaagaagcgcagatgtccagaaag

SEQ ID NO: 51955 - DNA, 25 bp, Homo sapien
cgaagaaggctggagtaaaatgaat

SEQ ID NO: 51956 - DNA, 25 bp, Homo sapien
cgaagaaggtggcaaagatttgtca

SEQ ID NO: 51957 - DNA, 25 bp, Homo sapien
cgaagagagccctgaaaaatctcat

SEQ ID NO: 51958 - DNA, 25 bp, Homo sapien
cgaagagagccttgaaaaatctcat

SEQ ID NO: 51959 - DNA, 25 bp, Homo sapien
cgaagaggacaatgccacagagaag

SEQ ID NO: 51960 - DNA, 25 bp, Homo sapien
cgaagaggacagtgccacagagaag

SEQ ID NO: 51961 - DNA, 25 bp, Homo sapien
cgaagaggcaaattgcagaatctaa

SEQ ID NO: 51962 - DNA, 25 bp, Homo sapien
cgaagaggcaagttgcagaatctaa

SEQ ID NO: 51963 - DNA, 25 bp, Homo sapien
cgaagcaaaaaccttctctcatttg

SEQ ID NO: 51964 - DNA, 25 bp, Homo sapien
cgaagcaaaaacgttctctcatttg

SEQ ID NO: 51965 - DNA, 25 bp, Homo sapien
cgaagcatttttgcagtttatcaat

SEQ ID NO: 51966 - DNA, 25 bp, Homo sapien
cgaagcatttttgccgtttatcaat

SEQ ID NO: 51967 - DNA, 25 bp, Homo sapien
cgaagctgaacagcagcaggggtgc

SEQ ID NO: 51968 - DNA, 25 bp, Homo sapien
cgaagctgaacggcagcaggggtgc

SEQ ID NO: 51969 - DNA, 25 bp, Homo sapien
cgaaggacaccacattgaacccctg

SEQ ID NO: 51970 - DNA, 25 bp, Homo sapien
cgaaggacaccacgttgaacccctg

SEQ ID NO: 51971 - DNA, 25 bp, Homo sapien
cgaaggcagacctgccagaagcaca

SEQ ID NO: 51972 - DNA, 25 bp, Homo sapien
cgaaggcagacttgccagaagcaca

SEQ ID NO: 51973 - DNA, 25 bp, Homo sapien
cgaaggttttggcttctgagttcag

SEQ ID NO: 51974 - DNA, 25 bp, Homo sapien
cgaaggttttgggttctgagttcag

SEQ ID NO: 51975 - DNA, 25 bp, Homo sapien
cgaagtctgattatcctgagcaggt

SEQ ID NO: 51976 - DNA, 25 bp, Homo sapien
cgaagtctgattgtcctgagcaggt

SEQ ID NO: 51977 - DNA, 25 bp, Homo sapien
cgaagttgcatgtattgtgttaatt

SEQ ID NO: 51978 - DNA, 25 bp, Homo sapien
cgaagttgcgtgtattgtgttaatt

SEQ ID NO: 51979 - DNA, 25 bp, Homo sapien
cgaagtttccttaagacagacaggt

SEQ ID NO: 51980 - DNA, 25 bp, Homo sapien
cgaagttttcttaagacagacaggt

SEQ ID NO: 51981 - DNA, 25 bp, Homo sapien
cgaataaactaagagacgatacaat

SEQ ID NO: 51982 - DNA, 25 bp, Homo sapien
cgaataaactaagagaggatacaat

SEQ ID NO: 51983 - DNA, 25 bp, Homo sapien
cgaatacttgggttactcccagtgt

SEQ ID NO: 51984 - DNA, 25 bp, Homo sapien
cgaatacttggtttactcccagtgt

SEQ ID NO: 51985 - DNA, 25 bp, Homo sapien
cgaatgagaagcaaaaccacgtctt

SEQ ID NO: 51986 - DNA, 25 bp, Homo sapien
cgaatgagaagcaaaatcacgtctt

SEQ ID NO: 51987 - DNA, 25 bp, Homo sapien
cgaatgttgacaacgatgctgaaca

SEQ ID NO: 51988 - DNA, 25 bp, Homo sapien
cgaatgttgacaaggatgctgaaca

SEQ ID NO: 51989 - DNA, 25 bp, Homo sapien
cgaatgtttggcatggtgctagtta

SEQ ID NO: 51990 - DNA, 25 bp, Homo sapien
cgaatgtttggcgtggtgctagtta

SEQ ID NO: 51991 - DNA, 25 bp, Homo sapien
cgaattctgcttccattgccacatc

SEQ ID NO: 51992 - DNA, 25 bp, Homo sapien
cgaattctgcttccgttgccacatc

SEQ ID NO: 51993 - DNA, 25 bp, Homo sapien
cgaatttacgaacagctgtggtatg

SEQ ID NO: 51994 - DNA, 25 bp, Homo sapien
cgaatttatgaacagctgtggtatg

SEQ ID NO: 51995 - DNA, 25 bp, Homo sapien
cgaatttgtttccttaagctcttaa

SEQ ID NO: 51996 - DNA, 25 bp, Homo sapien
cgaatttgtttccttaggctcttaa

SEQ ID NO: 51997 - DNA, 25 bp, Homo sapien
cgacaaagactactccaataagtgg

SEQ ID NO: 51998 - DNA, 25 bp, Homo sapien
cgacaaaggctactccaataagtgg

SEQ ID NO: 51999 - DNA, 25 bp, Homo sapien
cgacaattgtgtctatcctggagtt

SEQ ID NO: 52000 - DNA, 25 bp, Homo sapien
cgacaattgtgtctattctggagtt

SEQ ID NO: 52001 - DNA, 25 bp, Homo sapien
cgacaatttatagtcactaagcatc

SEQ ID NO: 52002 - DNA, 25 bp, Homo sapien
cgacaatttatagtcagtaagcatc

SEQ ID NO: 52003 - DNA, 25 bp, Homo sapien
cgacagttttacacaacattctgaa

SEQ ID NO: 52004 - DNA, 25 bp, Homo sapien
cgacagttttacagaacattctgaa

SEQ ID NO: 52005 - DNA, 25 bp, Homo sapien
cgacattccgtattagacatatgtt

SEQ ID NO: 52006 - DNA, 25 bp, Homo sapien
cgacattctgtattagacatatgtt

SEQ ID NO: 52007 - DNA, 25 bp, Homo sapien
cgaccactgaatactactgagtttc

SEQ ID NO: 52008 - DNA, 25 bp, Homo sapien
cgaccactgaatattactgagtttc

SEQ ID NO: 52009 - DNA, 25 bp, Homo sapien
cgaccatttaatatacaactcccat

SEQ ID NO: 52010 - DNA, 25 bp, Homo sapien
cgaccatttaatgtacaactcccat

SEQ ID NO: 52011 - DNA, 25 bp, Homo sapien
cgaccattttaacacatgatataaa

SEQ ID NO: 52012 - DNA, 25 bp, Homo sapien
cgaccattttaacgcatgatataaa

SEQ ID NO: 52013 - DNA, 25 bp, Homo sapien
cgacctcagccgtggacatcatctg

SEQ ID NO: 52014 - DNA, 25 bp, Homo sapien
cgacctcagccttggacatcatctg

SEQ ID NO: 52015 - DNA, 25 bp, Homo sapien
cgacctctacgtcagcagttccata

SEQ ID NO: 52016 - DNA, 25 bp, Homo sapien
cgacctctacgttagcagttccata

SEQ ID NO: 52017 - DNA, 25 bp, Homo sapien
cgacctgggcaattcaacctattgg

SEQ ID NO: 52018 - DNA, 25 bp, Homo sapien
cgacctgggcaattcagcctattgg

SEQ ID NO: 52019 - DNA, 25 bp, Homo sapien
cgactcagccacattgcatactctg

SEQ ID NO: 52020 - DNA, 25 bp, Homo sapien
cgactcagccacgttgcatactctg

SEQ ID NO: 52021 - DNA, 25 bp, Homo sapien
cgacttgactgtggtggataaactt

SEQ ID NO: 52022 - DNA, 25 bp, Homo sapien
cgacttgactgttgtggataaactt

SEQ ID NO: 52023 - DNA, 25 bp, Homo sapien
cgagaaactgacaatatctatgggt

SEQ ID NO: 52024 - DNA, 25 bp, Homo sapien
cgagaaactgacagtatctatgggt

SEQ ID NO: 52025 - DNA, 25 bp, Homo sapien
cgagaataacaagtggacaagtaaa

SEQ ID NO: 52026 - DNA, 25 bp, Homo sapien
cgagaataagaagtggacaagtaaa

SEQ ID NO: 52027 - DNA, 25 bp, Homo sapien
cgagacaattcagagtgaaatgttg

SEQ ID NO: 52028 - DNA, 25 bp, Homo sapien
cgagacaattcagagttaaatgttg

SEQ ID NO: 52029 - DNA, 25 bp, Homo sapien
cgagagagaatcgccttgtctgccg

SEQ ID NO: 52030 - DNA, 25 bp, Homo sapien
cgagagagattcgccttgtctgccg

SEQ ID NO: 52031 - DNA, 25 bp, Homo sapien
cgagatgatatcttgattttcaagt

SEQ ID NO: 52032 - DNA, 25 bp, Homo sapien
cgagatgatattttgattttcaagt

SEQ ID NO: 52033 - DNA, 25 bp, Homo sapien
cgagatgggtctatcaatggaggcc

SEQ ID NO: 52034 - DNA, 25 bp, Homo sapien
cgagatggttctatcaatggaggcc

SEQ ID NO: 52035 - DNA, 25 bp, Homo sapien
cgagattggagagattcatctacaa

SEQ ID NO: 52036 - DNA, 25 bp, Homo sapien
cgagattggagagattgatctacaa

SEQ ID NO: 52037 - DNA, 25 bp, Homo sapien
cgagattgggcgcattcctactcct

SEQ ID NO: 52038 - DNA, 25 bp, Homo sapien
cgagattgggctcattcctactcct

SEQ ID NO: 52039 - DNA, 25 bp, Homo sapien
cgagattgttaacacgtgtgaggag

SEQ ID NO: 52040 - DNA, 25 bp, Homo sapien
cgagattgttaacatgtgtgaggag

SEQ ID NO: 52041 - DNA, 25 bp, Homo sapien
cgagcaaacgccagcaaggtggaaa

SEQ ID NO: 52042 - DNA, 25 bp, Homo sapien
cgagcaaacgctagcaaggtggaaa

SEQ ID NO: 52043 - DNA, 25 bp, Homo sapien
cgagcaatgctattaccggttgagt

SEQ ID NO: 52044 - DNA, 25 bp, Homo sapien
cgagcaatgctattactggttgagt

SEQ ID NO: 52045 - DNA, 25 bp, Homo sapien
cgagcagatacttataggaaagaga

SEQ ID NO: 52046 - DNA, 25 bp, Homo sapien
cgagcagatacttctaggaaagaga

SEQ ID NO: 52047 - DNA, 25 bp, Homo sapien
cgagcagccagactttgtgctggtt

SEQ ID NO: 52048 - DNA, 25 bp, Homo sapien
cgagcagccagactttttgctggtt

SEQ ID NO: 52049 - DNA, 25 bp, Homo sapien
cgagccacacctggatcacagtagc

SEQ ID NO: 52050 - DNA, 25 bp, Homo sapien
cgagccacgcctggatcacagtagc

SEQ ID NO: 52051 - DNA, 25 bp, Homo sapien
cgagcctacaacatcttgttctacc

SEQ ID NO: 52052 - DNA, 25 bp, Homo sapien
cgagcctacaatatcttgttctacc

SEQ ID NO: 52053 - DNA, 25 bp, Homo sapien
cgagctatcatactgcattgtttta

SEQ ID NO: 52054 - DNA, 25 bp, Homo sapien
cgagctatcatgctgcattgtttta

SEQ ID NO: 52055 - DNA, 25 bp, Homo sapien
cgagctattcttcgtacatatggta

SEQ ID NO: 52056 - DNA, 25 bp, Homo sapien
cgagctattctttgtacatatggta

SEQ ID NO: 52057 - DNA, 25 bp, Homo sapien
cgagctccctacaaactccccggtg

SEQ ID NO: 52058 - DNA, 25 bp, Homo sapien
cgagctccctacgaactccccggtg

SEQ ID NO: 52059 - DNA, 25 bp, Homo sapien
cgagctggagacccgagaaagccag

SEQ ID NO: 52060 - DNA, 25 bp, Homo sapien
cgagctggagacgcgagaaagccag

SEQ ID NO: 52061 - DNA, 25 bp, Homo sapien
cgagctggtgtagagttgaccttca

SEQ ID NO: 52062 - DNA, 25 bp, Homo sapien
cgagctggtgtggagttgaccttca

SEQ ID NO: 52063 - DNA, 25 bp, Homo sapien
cgaggcaacaggaactctcaggaac

SEQ ID NO: 52064 - DNA, 25 bp, Homo sapien
cgaggcaacaggaactgtcaggaac

SEQ ID NO: 52065 - DNA, 25 bp, Homo sapien
cgaggcatcagttactatcaccaac

SEQ ID NO: 52066 - DNA, 25 bp, Homo sapien
cgaggcatcggttactatcaccaac

SEQ ID NO: 52067 - DNA, 25 bp, Homo sapien
cgaggctgtcagaccatgagaggaa

SEQ ID NO: 52068 - DNA, 25 bp, Homo sapien
cgaggctgtcaggccatgagaggaa

SEQ ID NO: 52069 - DNA, 25 bp, Homo sapien
cgagggaccttctatcgcccatgtg

SEQ ID NO: 52070 - DNA, 25 bp, Homo sapien
cgagggaccttctgtcgcccatgtg

SEQ ID NO: 52071 - DNA, 25 bp, Homo sapien
cgaggtatgaaactatcacacgcag

SEQ ID NO: 52072 - DNA, 25 bp, Homo sapien
cgaggtatgaaactgtcacacgcag

SEQ ID NO: 52073 - DNA, 25 bp, Homo sapien
cgaggtgcaatgataagttaacatc

SEQ ID NO: 52074 - DNA, 25 bp, Homo sapien
cgaggtgcaattataagttaacatc

SEQ ID NO: 52075 - DNA, 25 bp, Homo sapien
cgaggttctccacagctgcctgcga

SEQ ID NO: 52076 - DNA, 25 bp, Homo sapien
cgaggttctccacggctgcctgcga

SEQ ID NO: 52077 - DNA, 25 bp, Homo sapien
cgagtaatccttttaagggaaatga

SEQ ID NO: 52078 - DNA, 25 bp, Homo sapien
cgagtaatctttttaagggaaatga

SEQ ID NO: 52079 - DNA, 25 bp, Homo sapien
cgagtacacacggtaaagtttgaga

SEQ ID NO: 52080 - DNA, 25 bp, Homo sapien
cgagtacacacggtcaagtttgaga

SEQ ID NO: 52081 - DNA, 25 bp, Homo sapien
cgagtatggaaaacgcatgtcaaag

SEQ ID NO: 52082 - DNA, 25 bp, Homo sapien
cgagtatggaaaatgcatgtcaaag

SEQ ID NO: 52083 - DNA, 25 bp, Homo sapien
cgagttaccctgtcttcttccatgt

SEQ ID NO: 52084 - DNA, 25 bp, Homo sapien
cgagttaccctttcttcttccatgt

SEQ ID NO: 52085 - DNA, 25 bp, Homo sapien
cgagttataaccgctgcaccttaca

SEQ ID NO: 52086 - DNA, 25 bp, Homo sapien
cgagttataacctctgcaccttaca

SEQ ID NO: 52087 - DNA, 25 bp, Homo sapien
cgagttctcgtcatgagcccataat

SEQ ID NO: 52088 - DNA, 25 bp, Homo sapien
cgagttcttgtcatgagcccataat

SEQ ID NO: 52089 - DNA, 25 bp, Homo sapien
cgagttgagtcaaaggccatagtga

SEQ ID NO: 52090 - DNA, 25 bp, Homo sapien
cgagttgagtccaaggccatagtga

SEQ ID NO: 52091 - DNA, 25 bp, Homo sapien
cgagttgtctggtcactttagtgag

SEQ ID NO: 52092 - DNA, 25 bp, Homo sapien
cgagttgtctgttcactttagtgag

SEQ ID NO: 52093 - DNA, 25 bp, Homo sapien
cgagttttcacatatgcatataccc

SEQ ID NO: 52094 - DNA, 25 bp, Homo sapien
cgagttttcacatgtgcatataccc

SEQ ID NO: 52095 - DNA, 25 bp, Homo sapien
cgataccacgctcttccacgtagga

SEQ ID NO: 52096 - DNA, 25 bp, Homo sapien
cgataccactctcttccacgtagga

SEQ ID NO: 52097 - DNA, 25 bp, Homo sapien
cgatactgggcagcgaaacaacaca

SEQ ID NO: 52098 - DNA, 25 bp, Homo sapien
cgatactgggcagtgaaacaacaca

SEQ ID NO: 52099 - DNA, 25 bp, Homo sapien
cgatacttatcgcgtttccatcata

SEQ ID NO: 52100 - DNA, 25 bp, Homo sapien
cgatacttatctcgtttccatcata

SEQ ID NO: 52101 - DNA, 25 bp, Homo sapien
cgatatcagtcacatgcaactaagt

SEQ ID NO: 52102 - DNA, 25 bp, Homo sapien
cgatatcagtcacgtgcaactaagt

SEQ ID NO: 52103 - DNA, 25 bp, Homo sapien
cgatatggatcacatgggtataatg

SEQ ID NO: 52104 - DNA, 25 bp, Homo sapien
cgatatggatcacgtgggtataatg

SEQ ID NO: 52105 - DNA, 25 bp, Homo sapien
cgatcaaaccttaaccgtctggttt

SEQ ID NO: 52106 - DNA, 25 bp, Homo sapien
cgatcaaactttaaccgtctggttt

SEQ ID NO: 52107 - DNA, 25 bp, Homo sapien
cgatcagaaaagtctcagtgtttta

SEQ ID NO: 52108 - DNA, 25 bp, Homo sapien
cgatcagaaaagtctcggtgtttta

SEQ ID NO: 52109 - DNA, 25 bp, Homo sapien
cgatcatgtataaaaacattacact

SEQ ID NO: 52110 - DNA, 25 bp, Homo sapien
cgatcatgtatgaaaacattacact

SEQ ID NO: 52111 - DNA, 25 bp, Homo sapien
cgatctcttcgcttcctgtaaatag

SEQ ID NO: 52112 - DNA, 25 bp, Homo sapien
cgatctcttcgctttctgtaaatag

SEQ ID NO: 52113 - DNA, 25 bp, Homo sapien
cgatctgcaacatttcatttaatat

SEQ ID NO: 52114 - DNA, 25 bp, Homo sapien
cgatctgcaacttttcatttaatat

SEQ ID NO: 52115 - DNA, 25 bp, Homo sapien
cgatcttccctgtgtcataagtaag

SEQ ID NO: 52116 - DNA, 25 bp, Homo sapien
cgatcttccctgtttcataagtaag

SEQ ID NO: 52117 - DNA, 25 bp, Homo sapien
cgatgaaaaaaatcataaactcatt

SEQ ID NO: 52118 - DNA, 25 bp, Homo sapien
cgatgaaaaaaatgataaactcatt

SEQ ID NO: 52119 - DNA, 25 bp, Homo sapien
cgatgacgagctcactaagaagggt

SEQ ID NO: 52120 - DNA, 25 bp, Homo sapien
cgatgacgagctcattaagaagggt

SEQ ID NO: 52121 - DNA, 25 bp, Homo sapien
cgatgagcgaggctccatgcagaca

SEQ ID NO: 52122 - DNA, 25 bp, Homo sapien
cgatgagcgaggctccgtgcagaca

SEQ ID NO: 52123 - DNA, 25 bp, Homo sapien
cgatgattaacaccaggtcagggga

SEQ ID NO: 52124 - DNA, 25 bp, Homo sapien
cgatgattaccaccaggtcagggga

SEQ ID NO: 52125 - DNA, 25 bp, Homo sapien
cgatgccactaatcattagggaaat

SEQ ID NO: 52126 - DNA, 25 bp, Homo sapien
cgatgccactaatcgttagggaaat

SEQ ID NO: 52127 - DNA, 25 bp, Homo sapien
cgatgggacatatgaagacaattat

SEQ ID NO: 52128 - DNA, 25 bp, Homo sapien
cgatgggactctctcaactgtccct

SEQ ID NO: 52129 - DNA, 25 bp, Homo sapien
cgatgggatatatgaagacaattat

SEQ ID NO: 52130 - DNA, 25 bp, Homo sapien
cgatgggattctctcaactgtccct

SEQ ID NO: 52131 - DNA, 25 bp, Homo sapien
cgattaaactcttaattctttcctc

SEQ ID NO: 52132 - DNA, 25 bp, Homo sapien
cgattaaactcttacttctttcctc

SEQ ID NO: 52133 - DNA, 25 bp, Homo sapien
cgattaccttatcactgccttgaat

SEQ ID NO: 52134 - DNA, 25 bp, Homo sapien
cgattaccttatcattgccttgaat

SEQ ID NO: 52135 - DNA, 25 bp, Homo sapien
cgattagggcagcaataccaattgg

SEQ ID NO: 52136 - DNA, 25 bp, Homo sapien
cgattagggcagcgataccaattgg

SEQ ID NO: 52137 - DNA, 25 bp, Homo sapien
cgattcctctacgtaaatcttcacc

SEQ ID NO: 52138 - DNA, 25 bp, Homo sapien
cgattcctctatgtaaatcttcacc

SEQ ID NO: 52139 - DNA, 25 bp, Homo sapien
cgattctcactatactgttttataa

SEQ ID NO: 52140 - DNA, 25 bp, Homo sapien
cgattctcactatattgttttataa

SEQ ID NO: 52141 - DNA, 25 bp, Homo sapien
cgattggaaaatgaaagcaagatgt

SEQ ID NO: 52142 - DNA, 25 bp, Homo sapien
cgattggaaaatggaagcaagatgt

SEQ ID NO: 52143 - DNA, 25 bp, Homo sapien
cgattgtacttctaataagctccca

SEQ ID NO: 52144 - DNA, 25 bp, Homo sapien
cgattgtatttctaataagctccca

SEQ ID NO: 52145 - DNA, 25 bp, Homo sapien
cgattgttcgagacttacatgctca

SEQ ID NO: 52146 - DNA, 25 bp, Homo sapien
cgattgttcgagatttacatgctca

SEQ ID NO: 52147 - DNA, 25 bp, Homo sapien
cgatttgatcagactttgaatgtgt

SEQ ID NO: 52148 - DNA, 25 bp, Homo sapien
cgatttgatgagactttgaatgtgt

SEQ ID NO: 52149 - DNA, 25 bp, Homo sapien
cgatttgtctacataagatcctgct

SEQ ID NO: 52150 - DNA, 25 bp, Homo sapien
cgatttgtctatataagatcctgct

SEQ ID NO: 52151 - DNA, 25 bp, Homo sapien
cgatttttctaccaatcaacgaagt

SEQ ID NO: 52152 - DNA, 25 bp, Homo sapien
cgatttttctaccgatcaacgaagt

SEQ ID NO: 52153 - DNA, 25 bp, Homo sapien
cgcaaaaactggtaacacaagcaga

SEQ ID NO: 52154 - DNA, 25 bp, Homo sapien
cgcaaaaattggtaacacaagcaga

SEQ ID NO: 52155 - DNA, 25 bp, Homo sapien
cgcaaaaccatgagacaattcaaac

SEQ ID NO: 52156 - DNA, 25 bp, Homo sapien
cgcaaaaccatgagccaattcaaac

SEQ ID NO: 52157 - DNA, 25 bp, Homo sapien
cgcaaaaggtactcgctgccaaaag

SEQ ID NO: 52158 - DNA, 25 bp, Homo sapien
cgcaaaagttactcgctgccaaaag

SEQ ID NO: 52159 - DNA, 25 bp, Homo sapien
cgcaaagccacagacactgtaacct

SEQ ID NO: 52160 - DNA, 25 bp, Homo sapien
cgcaaagccacaggcactgtaacct

SEQ ID NO: 52161 - DNA, 25 bp, Homo sapien
cgcaaatccctgagtactctctcag

SEQ ID NO: 52162 - DNA, 25 bp, Homo sapien
cgcaaatccgtgagtactctctcag

SEQ ID NO: 52163 - DNA, 25 bp, Homo sapien
cgcaataaaatatgcgcttgtgtgc

SEQ ID NO: 52164 - DNA, 25 bp, Homo sapien
cgcaataaaatatgtgcttgtgtgc

SEQ ID NO: 52165 - DNA, 25 bp, Homo sapien
cgcaatcaggtggcgaacatcccgt

SEQ ID NO: 52166 - DNA, 25 bp, Homo sapien
cgcaatcaggtggtgaacatcccgt

SEQ ID NO: 52167 - DNA, 25 bp, Homo sapien
cgcaatttgatcatgaaatttttgc

SEQ ID NO: 52168 - DNA, 25 bp, Homo sapien
cgcaatttggtcatgaaatttttgc

SEQ ID NO: 52169 - DNA, 25 bp, Homo sapien
cgcacattttaataagttgcatatt

SEQ ID NO: 52170 - DNA, 25 bp, Homo sapien
cgcacattttaatgagttgcatatt

SEQ ID NO: 52171 - DNA, 25 bp, Homo sapien
cgcacctcagtattatgtgtatgaa

SEQ ID NO: 52172 - DNA, 25 bp, Homo sapien
cgcacctcagtgttatgtgtatgaa

SEQ ID NO: 52173 - DNA, 25 bp, Homo sapien
cgcagcaagaaaggcctggggcaag

SEQ ID NO: 52174 - DNA, 25 bp, Homo sapien
cgcagcaagaaaggtctggggcaag

SEQ ID NO: 52175 - DNA, 25 bp, Homo sapien
cgcagcttttcctgcagtaaagact

SEQ ID NO: 52176 - DNA, 25 bp, Homo sapien
cgcagcttttcttgcagtaaagact

SEQ ID NO: 52177 - DNA, 25 bp, Homo sapien
cgcagggatgcagcatccaatacca

SEQ ID NO: 52178 - DNA, 25 bp, Homo sapien
cgcagggatgcggcatccaatacca

SEQ ID NO: 52179 - DNA, 25 bp, Homo sapien
cgcagggtttatcgtatcgtgaaca

SEQ ID NO: 52180 - DNA, 25 bp, Homo sapien
cgcagggtttattgtatcgtgaaca

SEQ ID NO: 52181 - DNA, 25 bp, Homo sapien
cgcagtcactgcacacatgttctcc

SEQ ID NO: 52182 - DNA, 25 bp, Homo sapien
cgcagtcactgcacacgtgttctcc

SEQ ID NO: 52183 - DNA, 25 bp, Homo sapien
cgcagttttagaaccctcaagaaat

SEQ ID NO: 52184 - DNA, 25 bp, Homo sapien
cgcagttttagaagcctcaagaaat

SEQ ID NO: 52185 - DNA, 25 bp, Homo sapien
cgcatagtacgacagaatcagtatg

SEQ ID NO: 52186 - DNA, 25 bp, Homo sapien
cgcatagtatgacagaatcagtatg

SEQ ID NO: 52187 - DNA, 25 bp, Homo sapien
cgcatcaaaagaaaggtgaggcctt

SEQ ID NO: 52188 - DNA, 25 bp, Homo sapien
cgcatcaaaaggaaggtgaggcctt

SEQ ID NO: 52189 - DNA, 25 bp, Homo sapien
cgcatgacatattcaaagtgctaaa

SEQ ID NO: 52190 - DNA, 25 bp, Homo sapien
cgcatgacatattcgaagtgctaaa

SEQ ID NO: 52191 - DNA, 25 bp, Homo sapien
cgcatgcctggcaacgttctgggtg

SEQ ID NO: 52192 - DNA, 25 bp, Homo sapien
cgcatgcctggcaatgttctgggtg

SEQ ID NO: 52193 - DNA, 25 bp, Homo sapien
cgcattctattggcaaggctgcgag

SEQ ID NO: 52194 - DNA, 25 bp, Homo sapien
cgcattctattgtcaaggctgcgag

SEQ ID NO: 52195 - DNA, 25 bp, Homo sapien
cgcatttgaccagcatccagatcaa

SEQ ID NO: 52196 - DNA, 25 bp, Homo sapien
cgcatttgaccagcttccagatcaa

SEQ ID NO: 52197 - DNA, 25 bp, Homo sapien
cgccaaaaactacgtactcttggtg

SEQ ID NO: 52198 - DNA, 25 bp, Homo sapien
cgccaaaaactatgtactcttggtg

SEQ ID NO: 52199 - DNA, 25 bp, Homo sapien
cgccaaagtgtttcaggaaaaatca

SEQ ID NO: 52200 - DNA, 25 bp, Homo sapien
cgccaaagtgtttcgggaaaaatca

SEQ ID NO: 52201 - DNA, 25 bp, Homo sapien
cgccaatagaagacatccataggag

SEQ ID NO: 52202 - DNA, 25 bp, Homo sapien
cgccaatagaaggcatccataggag

SEQ ID NO: 52203 - DNA, 25 bp, Homo sapien
cgccaatgcatttaccactctggaa

SEQ ID NO: 52204 - DNA, 25 bp, Homo sapien
cgccaatgcgtttaccactctggaa

SEQ ID NO: 52205 - DNA, 25 bp, Homo sapien
cgccagccaggtttgagcacctctg

SEQ ID NO: 52206 - DNA, 25 bp, Homo sapien
cgccagccatgtttgagcacctctg

SEQ ID NO: 52207 - DNA, 25 bp, Homo sapien
cgccagtgttctaaagtttttgatt

SEQ ID NO: 52208 - DNA, 25 bp, Homo sapien
cgccagtgttctgaagtttttgatt

SEQ ID NO: 52209 - DNA, 25 bp, Homo sapien
cgccatgcagtgcggtgttcagagc

SEQ ID NO: 52210 - DNA, 25 bp, Homo sapien
cgccatgcagtgtggtgttcagagc

SEQ ID NO: 52211 - DNA, 25 bp, Homo sapien
cgccatgtaccgtaggatgcttagc

SEQ ID NO: 52212 - DNA, 25 bp, Homo sapien
cgccatgtaccttaggatgcttagc

SEQ ID NO: 52213 - DNA, 25 bp, Homo sapien
cgccatgttatataaatatgcacat

SEQ ID NO: 52214 - DNA, 25 bp, Homo sapien
cgccatgttatgtaaatatgcacat

SEQ ID NO: 52215 - DNA, 25 bp, Homo sapien
cgccattacaccatatttgaattat

SEQ ID NO: 52216 - DNA, 25 bp, Homo sapien
cgccattacgccatatttgaattat

SEQ ID NO: 52217 - DNA, 25 bp, Homo sapien
cgcccagaattgaactaatggtggc

SEQ ID NO: 52218 - DNA, 25 bp, Homo sapien
cgcccagaattgaactgatggtggc

SEQ ID NO: 52219 - DNA, 25 bp, Homo sapien
cgcccataggagccgggaccatttc

SEQ ID NO: 52220 - DNA, 25 bp, Homo sapien
cgcccataggagctgggaccatttc

SEQ ID NO: 52221 - DNA, 25 bp, Homo sapien
cgccctcttcatgcatctttaattc

SEQ ID NO: 52222 - DNA, 25 bp, Homo sapien
cgccctcttcatggatctttaattc

SEQ ID NO: 52223 - DNA, 25 bp, Homo sapien
cgccctgcgagacatagcctgtgcc

SEQ ID NO: 52224 - DNA, 25 bp, Homo sapien
cgccctgcgagacgtagcctgtgcc

SEQ ID NO: 52225 - DNA, 25 bp, Homo sapien
cgccctttaccaagcaagccaacct

SEQ ID NO: 52226 - DNA, 25 bp, Homo sapien
cgccctttaccgagcaagccaacct

SEQ ID NO: 52227 - DNA, 25 bp, Homo sapien
cgccgatgccggtcttccaaagaga

SEQ ID NO: 52228 - DNA, 25 bp, Homo sapien
cgccgatgctggtcttccaaagaga

SEQ ID NO: 52229 - DNA, 25 bp, Homo sapien
cgcctacaaataaatgaataaccac

SEQ ID NO: 52230 - DNA, 25 bp, Homo sapien
cgcctacaaatagatgaataaccac

SEQ ID NO: 52231 - DNA, 25 bp, Homo sapien
cgcctccgacctgtagctggcctgc

SEQ ID NO: 52232 - DNA, 25 bp, Homo sapien
cgcctccgacctgtggctggcctgc

SEQ ID NO: 52233 - DNA, 25 bp, Homo sapien
cgcctgagtccacagtgagtaatta

SEQ ID NO: 52234 - DNA, 25 bp, Homo sapien
cgcctgagtccagagtgagtaatta

SEQ ID NO: 52235 - DNA, 25 bp, Homo sapien
cgcctggcaatcatgacctcttctt

SEQ ID NO: 52236 - DNA, 25 bp, Homo sapien
cgcctggcagtcatgacctcttctt

SEQ ID NO: 52237 - DNA, 25 bp, Homo sapien
cgcctgtcaccatgttctttggctg

SEQ ID NO: 52238 - DNA, 25 bp, Homo sapien
cgcctgtcaccgtgttctttggctg

SEQ ID NO: 52239 - DNA, 25 bp, Homo sapien
cgccttggtcaccgcacaggaacag

SEQ ID NO: 52240 - DNA, 25 bp, Homo sapien
cgccttggtcactgcacaggaacag

SEQ ID NO: 52241 - DNA, 25 bp, Homo sapien
cgccttgtcacacgccttataaaag

SEQ ID NO: 52242 - DNA, 25 bp, Homo sapien
cgccttgttacacgccttataaaag

SEQ ID NO: 52243 - DNA, 25 bp, Homo sapien
cgcgcatgcaatagatccagggtgt

SEQ ID NO: 52244 - DNA, 25 bp, Homo sapien
cgcgcatgcaatggatccagggtgt

SEQ ID NO: 52245 - DNA, 25 bp, Homo sapien
cgctaaataaagcgatcctggtgtg

SEQ ID NO: 52246 - DNA, 25 bp, Homo sapien
cgctaaataaagctatcctggtgtg

SEQ ID NO: 52247 - DNA, 25 bp, Homo sapien
cgctaactggcttcccgtgccgact

SEQ ID NO: 52248 - DNA, 25 bp, Homo sapien
cgctaactggctttccgtgccgact

SEQ ID NO: 52249 - DNA, 25 bp, Homo sapien
cgctacatagattgttgtttcgggg

SEQ ID NO: 52250 - DNA, 25 bp, Homo sapien
cgctacatagatttttgtttcgggg

SEQ ID NO: 52251 - DNA, 25 bp, Homo sapien
cgctaccttctattttggtctaatt

SEQ ID NO: 52252 - DNA, 25 bp, Homo sapien
cgctaccttctgttttggtctaatt

SEQ ID NO: 52253 - DNA, 25 bp, Homo sapien
cgctatgaattttccgtctttaatt

SEQ ID NO: 52254 - DNA, 25 bp, Homo sapien
cgctatgaattttctgtctttaatt

SEQ ID NO: 52255 - DNA, 25 bp, Homo sapien
cgctcaatactaaatagttctcacc

SEQ ID NO: 52256 - DNA, 25 bp, Homo sapien
cgctcaatactaagtagttctcacc

SEQ ID NO: 52257 - DNA, 25 bp, Homo sapien
cgctcacacatcggtattcaaattc

SEQ ID NO: 52258 - DNA, 25 bp, Homo sapien
cgctcacacatctgtattcaaattc

SEQ ID NO: 52259 - DNA, 25 bp, Homo sapien
cgctccagtccttttcattggctct

SEQ ID NO: 52260 - DNA, 25 bp, Homo sapien
cgctccagttcttttcattggctct

SEQ ID NO: 52261 - DNA, 25 bp, Homo sapien
cgctcctagtggccaatgaacattg

SEQ ID NO: 52262 - DNA, 25 bp, Homo sapien
cgctcctagtggctaatgaacattg

SEQ ID NO: 52263 - DNA, 25 bp, Homo sapien
cgctcctgtctcaacagaatcatgg

SEQ ID NO: 52264 - DNA, 25 bp, Homo sapien
cgctcctgtgtcaacagaatcatgg

SEQ ID NO: 52265 - DNA, 25 bp, Homo sapien
cgctgattattcatcctacgttgta

SEQ ID NO: 52266 - DNA, 25 bp, Homo sapien
cgctgattattcttcctacgttgta

SEQ ID NO: 52267 - DNA, 25 bp, Homo sapien
cgctgccaggatccagtaacctccc

SEQ ID NO: 52268 - DNA, 25 bp, Homo sapien
cgctgccaggatccggtaacctccc

SEQ ID NO: 52269 - DNA, 25 bp, Homo sapien
cgctggcaaatacttggatgggcac

SEQ ID NO: 52270 - DNA, 25 bp, Homo sapien
cgctggcatatacttggatgggcac

SEQ ID NO: 52271 - DNA, 25 bp, Homo sapien
cgctgtaaggtgaaggcctgatcac

SEQ ID NO: 52272 - DNA, 25 bp, Homo sapien
cgctgtaagttgaaggcctgatcac

SEQ ID NO: 52273 - DNA, 25 bp, Homo sapien
cgctgttaaaaatcacccaattgtg

SEQ ID NO: 52274 - DNA, 25 bp, Homo sapien
cgctgttaaaaattacccaattgtg

SEQ ID NO: 52275 - DNA, 25 bp, Homo sapien
cgctgttagccgaatgccctcaaga

SEQ ID NO: 52276 - DNA, 25 bp, Homo sapien
cgctgttagccgaatgtcctcaaga

SEQ ID NO: 52277 - DNA, 25 bp, Homo sapien
cgcttacgtgttcatcccagtgtcc

SEQ ID NO: 52278 - DNA, 25 bp, Homo sapien
cgcttacgtgttgatcccagtgtcc

SEQ ID NO: 52279 - DNA, 25 bp, Homo sapien
cgcttccgtgccctcctgtttttga

SEQ ID NO: 52280 - DNA, 25 bp, Homo sapien
cgcttccgtgccttcctgtttttga

SEQ ID NO: 52281 - DNA, 25 bp, Homo sapien
cgcttcgatttgatcagactttgaa

SEQ ID NO: 52282 - DNA, 25 bp, Homo sapien
cgcttcgatttgatgagactttgaa

SEQ ID NO: 52283 - DNA, 25 bp, Homo sapien
cgcttctatcatattctgagtctca

SEQ ID NO: 52284 - DNA, 25 bp, Homo sapien
cgcttctatcatgttctgagtctca

SEQ ID NO: 52285 - DNA, 25 bp, Homo sapien
cgcttctgactttccaaaatgcttc

SEQ ID NO: 52286 - DNA, 25 bp, Homo sapien
cgcttctgactttgcaaaatgcttc

SEQ ID NO: 52287 - DNA, 25 bp, Homo sapien
cgcttgaaaatagccaaaaagtcta

SEQ ID NO: 52288 - DNA, 25 bp, Homo sapien
cgcttgaaaataggcaaaaagtcta

SEQ ID NO: 52289 - DNA, 25 bp, Homo sapien
cgcttggccacattacttatgtaga

SEQ ID NO: 52290 - DNA, 25 bp, Homo sapien
cgcttggccacattgcttatgtaga

SEQ ID NO: 52291 - DNA, 25 bp, Homo sapien
cgcttgttcactttatgtgtcaact

SEQ ID NO: 52292 - DNA, 25 bp, Homo sapien
cgcttgtttactttatgtgtcaact

SEQ ID NO: 52293 - DNA, 25 bp, Homo sapien
cgctttctaatgtctgagtgaaaag

SEQ ID NO: 52294 - DNA, 25 bp, Homo sapien
cgctttctactgtctgagtgaaaag

SEQ ID NO: 52295 - DNA, 25 bp, Homo sapien
cgcttttcaaactttttgtgtttga

SEQ ID NO: 52296 - DNA, 25 bp, Homo sapien
cgcttttcatactttttgtgtttga

SEQ ID NO: 52297 - DNA, 25 bp, Homo sapien
cgctttttccaagtgtgctgtattt

SEQ ID NO: 52298 - DNA, 25 bp, Homo sapien
cgctttttgcaagtgtgctgtattt

SEQ ID NO: 52299 - DNA, 25 bp, Homo sapien
cggaaaatccacctaaccaagaagg

SEQ ID NO: 52300 - DNA, 25 bp, Homo sapien
cggaaaatccacctaagcaagaagg

SEQ ID NO: 52301 - DNA, 25 bp, Homo sapien
cggaactttcatatgctgtactggc

SEQ ID NO: 52302 - DNA, 25 bp, Homo sapien
cggaactttcatgtgctgtactggc

SEQ ID NO: 52303 - DNA, 25 bp, Homo sapien
cggaagaagatatggacacaaaagc

SEQ ID NO: 52304 - DNA, 25 bp, Homo sapien
cggaagaagatgtggacacaaaagc

SEQ ID NO: 52305 - DNA, 25 bp, Homo sapien
cggaagaggaaaaaattaactgttt

SEQ ID NO: 52306 - DNA, 25 bp, Homo sapien
cggaagaggaaaaatttaactgttt

SEQ ID NO: 52307 - DNA, 25 bp, Homo sapien
cggaagcatacacgcccattggatt

SEQ ID NO: 52308 - DNA, 25 bp, Homo sapien
cggaagcatacatgcccattggatt

SEQ ID NO: 52309 - DNA, 25 bp, Homo sapien
cggaatggcggaagtaaatcgacag

SEQ ID NO: 52310 - DNA, 25 bp, Homo sapien
cggaatggtggaagtaaatcgacag

SEQ ID NO: 52311 - DNA, 25 bp, Homo sapien
cggacaaactttacagaagactagt

SEQ ID NO: 52312 - DNA, 25 bp, Homo sapien
cggacaaactttagagaagactagt

SEQ ID NO: 52313 - DNA, 25 bp, Homo sapien
cggacaccagagcaggatgagctga

SEQ ID NO: 52314 - DNA, 25 bp, Homo sapien
cggacaccagagtaggatgagctga

SEQ ID NO: 52315 - DNA, 25 bp, Homo sapien
cggaccgtcctagctccagagctcc

SEQ ID NO: 52316 - DNA, 25 bp, Homo sapien
cggaccgtcctagttccagagctcc

SEQ ID NO: 52317 - DNA, 25 bp, Homo sapien
cggactactcaataatttatccagc

SEQ ID NO: 52318 - DNA, 25 bp, Homo sapien
cggactactcagtaatttatccagc

SEQ ID NO: 52319 - DNA, 25 bp, Homo sapien
cggactatataaaaatcaaagcaaa

SEQ ID NO: 52320 - DNA, 25 bp, Homo sapien
cggactatataaatatcaaagcaaa

SEQ ID NO: 52321 - DNA, 25 bp, Homo sapien
cggactcttaagatgcagtggcgaa

SEQ ID NO: 52322 - DNA, 25 bp, Homo sapien
cggactcttaagctgcagtggcgaa

SEQ ID NO: 52323 - DNA, 25 bp, Homo sapien
cggactgaattatctcaaccaagga

SEQ ID NO: 52324 - DNA, 25 bp, Homo sapien
cggactgaattatctcgaccaagga

SEQ ID NO: 52325 - DNA, 25 bp, Homo sapien
cggactggatcccggactaggaaaa

SEQ ID NO: 52326 - DNA, 25 bp, Homo sapien
cggactggatcctggactaggaaaa

SEQ ID NO: 52327 - DNA, 25 bp, Homo sapien
cggagaaccaccaatgcacaggatg

SEQ ID NO: 52328 - DNA, 25 bp, Homo sapien
cggagaaccaccgatgcacaggatg

SEQ ID NO: 52329 - DNA, 25 bp, Homo sapien
cggagagacgaaaattctaagaaag

SEQ ID NO: 52330 - DNA, 25 bp, Homo sapien
cggagagacgaacattctaagaaag

SEQ ID NO: 52331 - DNA, 25 bp, Homo sapien
cggagccacattttaactccgggcc

SEQ ID NO: 52332 - DNA, 25 bp, Homo sapien
cggagccacattttcactccgggcc

SEQ ID NO: 52333 - DNA, 25 bp, Homo sapien
cggagctaccgtagttctgtgtttg

SEQ ID NO: 52334 - DNA, 25 bp, Homo sapien
cggagctactgtagttctgtgtttg

SEQ ID NO: 52335 - DNA, 25 bp, Homo sapien
cggaggacaccaccctgaaaggacg

SEQ ID NO: 52336 - DNA, 25 bp, Homo sapien
cggaggacaccatcctgaaaggacg

SEQ ID NO: 52337 - DNA, 25 bp, Homo sapien
cggagggagagaaccgctaaaataa

SEQ ID NO: 52338 - DNA, 25 bp, Homo sapien
cggagggagagaatcgctaaaataa

SEQ ID NO: 52339 - DNA, 25 bp, Homo sapien
cggaggtagacaggccactaggaac

SEQ ID NO: 52340 - DNA, 25 bp, Homo sapien
cggaggtagacgggccactaggaac

SEQ ID NO: 52341 - DNA, 25 bp, Homo sapien
cggagtttgagacaaaagctagact

SEQ ID NO: 52342 - DNA, 25 bp, Homo sapien
cggagtttgggacaaaagctagact

SEQ ID NO: 52343 - DNA, 25 bp, Homo sapien
cggatatactaacatgcgtcaaaga

SEQ ID NO: 52344 - DNA, 25 bp, Homo sapien
cggatatactaacatgtgtcaaaga

SEQ ID NO: 52345 - DNA, 25 bp, Homo sapien
cggatatcagcaccaactaaacttt

SEQ ID NO: 52346 - DNA, 25 bp, Homo sapien
cggatatcagctccaactaaacttt

SEQ ID NO: 52347 - DNA, 25 bp, Homo sapien
cggatgagaaataaatcggagctgc

SEQ ID NO: 52348 - DNA, 25 bp, Homo sapien
cggatgagaaatcaatcggagctgc

SEQ ID NO: 52349 - DNA, 25 bp, Homo sapien
cggatggtctagcaccttttttgaa

SEQ ID NO: 52350 - DNA, 25 bp, Homo sapien
cggatggtctagcatcttttttgaa

SEQ ID NO: 52351 - DNA, 25 bp, Homo sapien
cggatgtctactgaatctaaaggaa

SEQ ID NO: 52352 - DNA, 25 bp, Homo sapien
cggatgtctactgagtctaaaggaa

SEQ ID NO: 52353 - DNA, 25 bp, Homo sapien
cggattccatttctgctgtatatcc

SEQ ID NO: 52354 - DNA, 25 bp, Homo sapien
cggattccatttcttctgtatatcc

SEQ ID NO: 52355 - DNA, 25 bp, Homo sapien
cggattgaggtctcaatatctgggg

SEQ ID NO: 52356 - DNA, 25 bp, Homo sapien
cggattgaggtttcaatatctgggg

SEQ ID NO: 52357 - DNA, 25 bp, Homo sapien
cggattgctaaagaacattcttggc

SEQ ID NO: 52358 - DNA, 25 bp, Homo sapien
cggattgctaaagaacgttcttggc

SEQ ID NO: 52359 - DNA, 25 bp, Homo sapien
cggattgtgttttggtgattgtatg

SEQ ID NO: 52360 - DNA, 25 bp, Homo sapien
cggattgtgttttgttgattgtatg

SEQ ID NO: 52361 - DNA, 25 bp, Homo sapien
cggcaaacacaggctgaagagagag

SEQ ID NO: 52362 - DNA, 25 bp, Homo sapien
cggcaaacacaggctggagagagag

SEQ ID NO: 52363 - DNA, 25 bp, Homo sapien
cggcaaggatcttaaacagatttgt

SEQ ID NO: 52364 - DNA, 25 bp, Homo sapien
cggcaaggttcttaaacagatttgt

SEQ ID NO: 52365 - DNA, 25 bp, Homo sapien
cggcaatggcgtaacatcaccaggc

SEQ ID NO: 52366 - DNA, 25 bp, Homo sapien
cggcaatggcgtgacatcaccaggc

SEQ ID NO: 52367 - DNA, 25 bp, Homo sapien
cggcagacaaaaacaaagttttcat

SEQ ID NO: 52368 - DNA, 25 bp, Homo sapien
cggcagacaaaagcaaagttttcat

SEQ ID NO: 52369 - DNA, 25 bp, Homo sapien
cggcatcctattttcctggacagac

SEQ ID NO: 52370 - DNA, 25 bp, Homo sapien
cggcatcctgttttcctggacagac

SEQ ID NO: 52371 - DNA, 25 bp, Homo sapien
cggcatgagtccaactgaaaaaatt

SEQ ID NO: 52372 - DNA, 25 bp, Homo sapien
cggcatgagtccagctgaaaaaatt

SEQ ID NO: 52373 - DNA, 25 bp, Homo sapien
cggcattaagcactgaagagaaaga

SEQ ID NO: 52374 - DNA, 25 bp, Homo sapien
cggcattaagcgctgaagagaaaga

SEQ ID NO: 52375 - DNA, 25 bp, Homo sapien
cggcattgtgaaaaaatagatggaa

SEQ ID NO: 52376 - DNA, 25 bp, Homo sapien
cggcattgtgaaaagatagatggaa

SEQ ID NO: 52377 - DNA, 25 bp, Homo sapien
cggccaagataaaaaatcccaggcc

SEQ ID NO: 52378 - DNA, 25 bp, Homo sapien
cggccaagataaaagatcccaggcc

SEQ ID NO: 52379 - DNA, 25 bp, Homo sapien
cggccaagatgaattttgaggaact

SEQ ID NO: 52380 - DNA, 25 bp, Homo sapien
cggccaagatgcattttgaggaact

SEQ ID NO: 52381 - DNA, 25 bp, Homo sapien
cggccaatagccatgatgactactg

SEQ ID NO: 52382 - DNA, 25 bp, Homo sapien
cggccaatagccgtgatgactactg

SEQ ID NO: 52383 - DNA, 25 bp, Homo sapien
cggccagatttaatccaaataaact

SEQ ID NO: 52384 - DNA, 25 bp, Homo sapien
cggccagatttgatccaaataaact

SEQ ID NO: 52385 - DNA, 25 bp, Homo sapien
cggccatgacctgaacaaagatcag

SEQ ID NO: 52386 - DNA, 25 bp, Homo sapien
cggccatgacctgaaccaagatcag

SEQ ID NO: 52387 - DNA, 25 bp, Homo sapien
cggcccaatcaatgagtggtgggtc

SEQ ID NO: 52388 - DNA, 25 bp, Homo sapien
cggcccaatcagtgagtggtgggtc

SEQ ID NO: 52389 - DNA, 25 bp, Homo sapien
cggcccataatattaaataacattg

SEQ ID NO: 52390 - DNA, 25 bp, Homo sapien
cggcccatcatattaaataacattg

SEQ ID NO: 52391 - DNA, 25 bp, Homo sapien
cggccgaaagcaggtcaccggaagg

SEQ ID NO: 52392 - DNA, 25 bp, Homo sapien
cggccgaaagcaggtcgccggaagg

SEQ ID NO: 52393 - DNA, 25 bp, Homo sapien
cggcctctctcaacttcatactaaa

SEQ ID NO: 52394 - DNA, 25 bp, Homo sapien
cggcctctctcaccttcatactaaa

SEQ ID NO: 52395 - DNA, 25 bp, Homo sapien
cggcgtatcggagacgagtttaacg

SEQ ID NO: 52396 - DNA, 25 bp, Homo sapien
cggcgtattggagacgagtttaacg

SEQ ID NO: 52397 - DNA, 25 bp, Homo sapien
cggctaaagtccacgagggccacgt

SEQ ID NO: 52398 - DNA, 25 bp, Homo sapien
cggctaaagtctacgagggccacgt

SEQ ID NO: 52399 - DNA, 25 bp, Homo sapien
cggctacgtaacggaaacccagagg

SEQ ID NO: 52400 - DNA, 25 bp, Homo sapien
cggctacgtgacggaaacccagagg

SEQ ID NO: 52401 - DNA, 25 bp, Homo sapien
cggctagtatccagaatctacaatg

SEQ ID NO: 52402 - DNA, 25 bp, Homo sapien
cggctagtgtccagaatctacaatg

SEQ ID NO: 52403 - DNA, 25 bp, Homo sapien
cggctcgctggcatgttgctggcag

SEQ ID NO: 52404 - DNA, 25 bp, Homo sapien
cggctcgctggcgtgttgctggcag

SEQ ID NO: 52405 - DNA, 25 bp, Homo sapien
cggctgagataaaacaaggccaatc

SEQ ID NO: 52406 - DNA, 25 bp, Homo sapien
cggctgaggtaaaacaaggccaatc

SEQ ID NO: 52407 - DNA, 25 bp, Homo sapien
cggctgcatacatagcagtctgttc

SEQ ID NO: 52408 - DNA, 25 bp, Homo sapien
cggctgcatacgtagcagtctgttc

SEQ ID NO: 52409 - DNA, 25 bp, Homo sapien
cggctgctcgcacgctactacagca

SEQ ID NO: 52410 - DNA, 25 bp, Homo sapien
cggctgctctcacgctactacagca

SEQ ID NO: 52411 - DNA, 25 bp, Homo sapien
cggctgtaatacagggataataaag

SEQ ID NO: 52412 - DNA, 25 bp, Homo sapien
cggctgtaatacggggataataaag

SEQ ID NO: 52413 - DNA, 25 bp, Homo sapien
cggctgtggaagtgtgagatggaga

SEQ ID NO: 52414 - DNA, 25 bp, Homo sapien
cggctgtgggagtgtgagatggaga

SEQ ID NO: 52415 - DNA, 25 bp, Homo sapien
cggcttatctaatacgttgggtggt

SEQ ID NO: 52416 - DNA, 25 bp, Homo sapien
cggcttatctaatgcgttgggtggt

SEQ ID NO: 52417 - DNA, 25 bp, Homo sapien
cggcttcatagacatcctggcagct

SEQ ID NO: 52418 - DNA, 25 bp, Homo sapien
cggcttcatagacatcttggcagct

SEQ ID NO: 52419 - DNA, 25 bp, Homo sapien
cgggaaaggaagacaaatggatgta

SEQ ID NO: 52420 - DNA, 25 bp, Homo sapien
cgggaaaggaagagaaatggatgta

SEQ ID NO: 52421 - DNA, 25 bp, Homo sapien
cgggaagaaatcaacaaaggatgca

SEQ ID NO: 52422 - DNA, 25 bp, Homo sapien
cgggaagaaatcagcaaaggatgca

SEQ ID NO: 52423 - DNA, 25 bp, Homo sapien
cgggaaggtcaaagttctagcttcc

SEQ ID NO: 52424 - DNA, 25 bp, Homo sapien
cgggaaggtcagagttctagcttcc

SEQ ID NO: 52425 - DNA, 25 bp, Homo sapien
cgggaatgatgtgaccataagccaa

SEQ ID NO: 52426 - DNA, 25 bp, Homo sapien
cgggaatgatgtggccataagccaa

SEQ ID NO: 52427 - DNA, 25 bp, Homo sapien
cgggacccgcatctgtgcaactcca

SEQ ID NO: 52428 - DNA, 25 bp, Homo sapien
cgggacccgcatgtgtgcaactcca

SEQ ID NO: 52429 - DNA, 25 bp, Homo sapien
cgggactccgccatcaagcgtggca

SEQ ID NO: 52430 - DNA, 25 bp, Homo sapien
cgggactctgccatcaagcgtggca

SEQ ID NO: 52431 - DNA, 25 bp, Homo sapien
cgggagcttctcccacaaagacttt

SEQ ID NO: 52432 - DNA, 25 bp, Homo sapien
cgggagcttctcccgcaaagacttt

SEQ ID NO: 52433 - DNA, 25 bp, Homo sapien
cgggaggaatgaacaactggagacg

SEQ ID NO: 52434 - DNA, 25 bp, Homo sapien
cgggaggaatgtacaactggagacg

SEQ ID NO: 52435 - DNA, 25 bp, Homo sapien
cgggataaaagataggaagagacac

SEQ ID NO: 52436 - DNA, 25 bp, Homo sapien
cgggataaaagatatgaagagacac

SEQ ID NO: 52437 - DNA, 25 bp, Homo sapien
cgggcaatggaatgagacccccatg

SEQ ID NO: 52438 - DNA, 25 bp, Homo sapien
cgggcaatggagtgagacccccatg

SEQ ID NO: 52439 - DNA, 25 bp, Homo sapien
cgggcagggaaaaactgtgtgctca

SEQ ID NO: 52440 - DNA, 25 bp, Homo sapien
cgggcagggaaaaattgtgtgctca

SEQ ID NO: 52441 - DNA, 25 bp, Homo sapien
cgggcataacagattaaatatattt

SEQ ID NO: 52442 - DNA, 25 bp, Homo sapien
cgggcataccagattaaatatattt

SEQ ID NO: 52443 - DNA, 25 bp, Homo sapien
cgggcattacacttattatccacat

SEQ ID NO: 52444 - DNA, 25 bp, Homo sapien
cgggcattatacttattatccacat

SEQ ID NO: 52445 - DNA, 25 bp, Homo sapien
cgggcgggcagaaatacttgtctct

SEQ ID NO: 52446 - DNA, 25 bp, Homo sapien
cgggcgggcaggaatacttgtctct

SEQ ID NO: 52447 - DNA, 25 bp, Homo sapien
cgggctcttttccgttctatataaa

SEQ ID NO: 52448 - DNA, 25 bp, Homo sapien
cgggctctttttcgttctatataaa

SEQ ID NO: 52449 - DNA, 25 bp, Homo sapien
cggggactccagccttataaaatat

SEQ ID NO: 52450 - DNA, 25 bp, Homo sapien
cggggactccaggcttataaaatat

SEQ ID NO: 52451 - DNA, 25 bp, Homo sapien
cgggggaatcgttctggaggctctg

SEQ ID NO: 52452 - DNA, 25 bp, Homo sapien
cgggggaattgttctggaggctctg

SEQ ID NO: 52453 - DNA, 25 bp, Homo sapien
cgggtgaaggacaattattttttag

SEQ ID NO: 52454 - DNA, 25 bp, Homo sapien
cgggtgaaggacgattattttttag

SEQ ID NO: 52455 - DNA, 25 bp, Homo sapien
cgggtttgctgaaaattcaggaggg

SEQ ID NO: 52456 - DNA, 25 bp, Homo sapien
cgggtttgctgaacattcaggaggg

SEQ ID NO: 52457 - DNA, 25 bp, Homo sapien
cggtacaagctgtaggcggatctac

SEQ ID NO: 52458 - DNA, 25 bp, Homo sapien
cggtacaagctgtaggtggatctac

SEQ ID NO: 52459 - DNA, 25 bp, Homo sapien
cggtacaatgcagcatattaaaatt

SEQ ID NO: 52460 - DNA, 25 bp, Homo sapien
cggtacaatgcagcgtattaaaatt

SEQ ID NO: 52461 - DNA, 25 bp, Homo sapien
cggtagagtaataaactatgatgct

SEQ ID NO: 52462 - DNA, 25 bp, Homo sapien
cggtagagtaatgaactatgatgct

SEQ ID NO: 52463 - DNA, 25 bp, Homo sapien
cggtaggtcattaagcagccaatga

SEQ ID NO: 52464 - DNA, 25 bp, Homo sapien
cggtaggtcgttaagcagccaatga

SEQ ID NO: 52465 - DNA, 25 bp, Homo sapien
cggtatagtgtaccgtggactcagc

SEQ ID NO: 52466 - DNA, 25 bp, Homo sapien
cggtatagtttaccgtggactcagc

SEQ ID NO: 52467 - DNA, 25 bp, Homo sapien
cggtcacagcttgtccacatgatct

SEQ ID NO: 52468 - DNA, 25 bp, Homo sapien
cggtcacagcttgtccgcatgatct

SEQ ID NO: 52469 - DNA, 25 bp, Homo sapien
cggtcatgaaacagcccaaggcagg

SEQ ID NO: 52470 - DNA, 25 bp, Homo sapien
cggtcatgaaagagcccaaggcagg

SEQ ID NO: 52471 - DNA, 25 bp, Homo sapien
cggtccactctttacttggaatccc

SEQ ID NO: 52472 - DNA, 25 bp, Homo sapien
cggtccactgtttacttggaatccc

SEQ ID NO: 52473 - DNA, 25 bp, Homo sapien
cggtcctgaacagagagacagtcgt

SEQ ID NO: 52474 - DNA, 25 bp, Homo sapien
cggtcctgaacagagatacagtcgt

SEQ ID NO: 52475 - DNA, 25 bp, Homo sapien
cggtctccatctctttggtcttgtc

SEQ ID NO: 52476 - DNA, 25 bp, Homo sapien
cggtctccatctgtttggtcttgtc

SEQ ID NO: 52477 - DNA, 25 bp, Homo sapien
cggtctgttaaaaaatgcctccttt

SEQ ID NO: 52478 - DNA, 25 bp, Homo sapien
cggtctgttaaaaagtgcctccttt

SEQ ID NO: 52479 - DNA, 25 bp, Homo sapien
cggtgaattccacagtggccatgct

SEQ ID NO: 52480 - DNA, 25 bp, Homo sapien
cggtgaattccacggtggccatgct

SEQ ID NO: 52481 - DNA, 25 bp, Homo sapien
cggtgatttgttcaatatttcacat

SEQ ID NO: 52482 - DNA, 25 bp, Homo sapien
cggtgattttttcaatatttcacat

SEQ ID NO: 52483 - DNA, 25 bp, Homo sapien
cggtgcaaatataacaatagatttc

SEQ ID NO: 52484 - DNA, 25 bp, Homo sapien
cggtgcaaatatgacaatagatttc

SEQ ID NO: 52485 - DNA, 25 bp, Homo sapien
cggtgccggcccataatattaaata

SEQ ID NO: 52486 - DNA, 25 bp, Homo sapien
cggtgccggcccatcatattaaata

SEQ ID NO: 52487 - DNA, 25 bp, Homo sapien
cggtgcttcatacagctctagttaa

SEQ ID NO: 52488 - DNA, 25 bp, Homo sapien
cggtgcttcatatagctctagttaa

SEQ ID NO: 52489 - DNA, 25 bp, Homo sapien
cggtggccgacctattcctggctac

SEQ ID NO: 52490 - DNA, 25 bp, Homo sapien
cggtggccgacgtattcctggctac

SEQ ID NO: 52491 - DNA, 25 bp, Homo sapien
cggtggcttcatataaacaagtgag

SEQ ID NO: 52492 - DNA, 25 bp, Homo sapien
cggtggcttcatatcaacaagtgag

SEQ ID NO: 52493 - DNA, 25 bp, Homo sapien
cggtgttggtcacgcccaagacaaa

SEQ ID NO: 52494 - DNA, 25 bp, Homo sapien
cggtgttggtcatgcccaagacaaa

SEQ ID NO: 52495 - DNA, 25 bp, Homo sapien
cggttaaggaaagaagctggttaat

SEQ ID NO: 52496 - DNA, 25 bp, Homo sapien
cggttaaggaaataagctggttaat

SEQ ID NO: 52497 - DNA, 25 bp, Homo sapien
cggttaggaaggttgtcaaaatgag

SEQ ID NO: 52498 - DNA, 25 bp, Homo sapien
cggttaggaagtttgtcaaaatgag

SEQ ID NO: 52499 - DNA, 25 bp, Homo sapien
cggttgataaatgaacaaacacaat

SEQ ID NO: 52500 - DNA, 25 bp, Homo sapien
cggttgataaatgagcaaacacaat

SEQ ID NO: 52501 - DNA, 25 bp, Homo sapien
cggtttcactgccttcattgctatc

SEQ ID NO: 52502 - DNA, 25 bp, Homo sapien
cggtttcactgccttcgttgctatc

SEQ ID NO: 52503 - DNA, 25 bp, Homo sapien
cggtttgcacgaacagcatggattt

SEQ ID NO: 52504 - DNA, 25 bp, Homo sapien
cggtttgcacgaacaggatggattt

SEQ ID NO: 52505 - DNA, 25 bp, Homo sapien
cgtaaagaagtgccagggagctctg

SEQ ID NO: 52506 - DNA, 25 bp, Homo sapien
cgtaaagaggtgccagggagctctg

SEQ ID NO: 52507 - DNA, 25 bp, Homo sapien
cgtaaagcaagacaggaaaatacag

SEQ ID NO: 52508 - DNA, 25 bp, Homo sapien
cgtaaagcaagacagggaaatacag

SEQ ID NO: 52509 - DNA, 25 bp, Homo sapien
cgtaacaaaatatgttcaagatctg

SEQ ID NO: 52510 - DNA, 25 bp, Homo sapien
cgtaacaaagtatgttcaagatctg

SEQ ID NO: 52511 - DNA, 25 bp, Homo sapien
cgtaacagcaaaccacttcaaaatc

SEQ ID NO: 52512 - DNA, 25 bp, Homo sapien
cgtaacagtaaaccacttcaaaatc

SEQ ID NO: 52513 - DNA, 25 bp, Homo sapien
cgtaacccactccacttccaaagcc

SEQ ID NO: 52514 - DNA, 25 bp, Homo sapien
cgtaacccgctccacttccaaagcc

SEQ ID NO: 52515 - DNA, 25 bp, Homo sapien
cgtaacgtctttcgatgccacattg

SEQ ID NO: 52516 - DNA, 25 bp, Homo sapien
cgtaacgtcttttgatgccacattg

SEQ ID NO: 52517 - DNA, 25 bp, Homo sapien
cgtaacttagcaaaataaaaagctg

SEQ ID NO: 52518 - DNA, 25 bp, Homo sapien
cgtaacttggcaaaataaaaagctg

SEQ ID NO: 52519 - DNA, 25 bp, Homo sapien
cgtaagatgcacatattgtagcttg

SEQ ID NO: 52520 - DNA, 25 bp, Homo sapien
cgtaagatgcacatgttgtagcttg

SEQ ID NO: 52521 - DNA, 25 bp, Homo sapien
cgtaagatttagttataatgaaagg

SEQ ID NO: 52522 - DNA, 25 bp, Homo sapien
cgtaagatttagttctaatgaaagg

SEQ ID NO: 52523 - DNA, 25 bp, Homo sapien
cgtaaggacagaagcccaagatcaa

SEQ ID NO: 52524 - DNA, 25 bp, Homo sapien
cgtaaggacagaagcctaagatcaa

SEQ ID NO: 52525 - DNA, 25 bp, Homo sapien
cgtaagtaaccctaaagaaaatcca

SEQ ID NO: 52526 - DNA, 25 bp, Homo sapien
cgtaagtaaccttaaagaaaatcca

SEQ ID NO: 52527 - DNA, 25 bp, Homo sapien
cgtaagtgctcaaattcagattgga

SEQ ID NO: 52528 - DNA, 25 bp, Homo sapien
cgtaagtgttcaaattcagattgga

SEQ ID NO: 52529 - DNA, 25 bp, Homo sapien
cgtaccaattataatgctgttaaaa

SEQ ID NO: 52530 - DNA, 25 bp, Homo sapien
cgtaccaattatactgctgttaaaa

SEQ ID NO: 52531 - DNA, 25 bp, Homo sapien
cgtacctgcgctaagagaagtttta

SEQ ID NO: 52532 - DNA, 25 bp, Homo sapien
cgtacctgctctaagagaagtttta

SEQ ID NO: 52533 - DNA, 25 bp, Homo sapien
cgtaccttgtgattccacgagtcaa

SEQ ID NO: 52534 - DNA, 25 bp, Homo sapien
cgtaccttgtgattccgcgagtcaa

SEQ ID NO: 52535 - DNA, 25 bp, Homo sapien
cgtacttgccattttctcttaagtt

SEQ ID NO: 52536 - DNA, 25 bp, Homo sapien
cgtacttggcattttctcttaagtt

SEQ ID NO: 52537 - DNA, 25 bp, Homo sapien
cgtagcatacaagacagcatctctg

SEQ ID NO: 52538 - DNA, 25 bp, Homo sapien
cgtagcatacaagatagcatctctg

SEQ ID NO: 52539 - DNA, 25 bp, Homo sapien
cgtaggcctggtaacgttcaccaca

SEQ ID NO: 52540 - DNA, 25 bp, Homo sapien
cgtaggcctggtaatgttcaccaca

SEQ ID NO: 52541 - DNA, 25 bp, Homo sapien
cgtaggtatcaacatattttatctt

SEQ ID NO: 52542 - DNA, 25 bp, Homo sapien
cgtaggtatcaacgtattttatctt

SEQ ID NO: 52543 - DNA, 25 bp, Homo sapien
cgtagtcaacactttagtaatgtag

SEQ ID NO: 52544 - DNA, 25 bp, Homo sapien
cgtagtcaacattttagtaatgtag

SEQ ID NO: 52545 - DNA, 25 bp, Homo sapien
cgtagtctatgctggacacttcctt

SEQ ID NO: 52546 - DNA, 25 bp, Homo sapien
cgtagtctatgttggacacttcctt

SEQ ID NO: 52547 - DNA, 25 bp, Homo sapien
cgtataaggtccaaaatcacacttt

SEQ ID NO: 52548 - DNA, 25 bp, Homo sapien
cgtataaggtcccaaatcacacttt

SEQ ID NO: 52549 - DNA, 25 bp, Homo sapien
cgtataattctgatatgacttagtg

SEQ ID NO: 52550 - DNA, 25 bp, Homo sapien
cgtataattctgatttgacttagtg

SEQ ID NO: 52551 - DNA, 25 bp, Homo sapien
cgtatcttcctctgtcttactagat

SEQ ID NO: 52552 - DNA, 25 bp, Homo sapien
cgtatcttcgtctgtcttactagat

SEQ ID NO: 52553 - DNA, 25 bp, Homo sapien
cgtatgaaacaagattcacaaacag

SEQ ID NO: 52554 - DNA, 25 bp, Homo sapien
cgtatgaaagaagattcacaaacag

SEQ ID NO: 52555 - DNA, 25 bp, Homo sapien
cgtatgaacgatacagtttactttt

SEQ ID NO: 52556 - DNA, 25 bp, Homo sapien
cgtatgaatgatacagtttactttt

SEQ ID NO: 52557 - DNA, 25 bp, Homo sapien
cgtatgactttcggttcttttttat

SEQ ID NO: 52558 - DNA, 25 bp, Homo sapien
cgtatgacttttggttcttttttat

SEQ ID NO: 52559 - DNA, 25 bp, Homo sapien
cgtatgccttaacttttcagaaatg

SEQ ID NO: 52560 - DNA, 25 bp, Homo sapien
cgtatgccttagcttttcagaaatg

SEQ ID NO: 52561 - DNA, 25 bp, Homo sapien
cgtattcagatttccccagttgctc

SEQ ID NO: 52562 - DNA, 25 bp, Homo sapien
cgtattcagattttcccagttgctc

SEQ ID NO: 52563 - DNA, 25 bp, Homo sapien
cgtattctcctgcaacaactggctg

SEQ ID NO: 52564 - DNA, 25 bp, Homo sapien
cgtattctcttgcaacaactggctg

SEQ ID NO: 52565 - DNA, 25 bp, Homo sapien
cgtattgttatcgaaaagacaagtg

SEQ ID NO: 52566 - DNA, 25 bp, Homo sapien
cgtattgttatggaaaagacaagtg

SEQ ID NO: 52567 - DNA, 25 bp, Homo sapien
cgtatttaaacagcaatccaaagga

SEQ ID NO: 52568 - DNA, 25 bp, Homo sapien
cgtatttaaccagcaatccaaagga

SEQ ID NO: 52569 - DNA, 25 bp, Homo sapien
cgtatttgcattgcatcttctttga

SEQ ID NO: 52570 - DNA, 25 bp, Homo sapien
cgtatttgcattgcgtcttctttga

SEQ ID NO: 52571 - DNA, 25 bp, Homo sapien
cgtatttgttgaatgttgttgaaga

SEQ ID NO: 52572 - DNA, 25 bp, Homo sapien
cgtatttgttgcatgttgttgaaga

SEQ ID NO: 52573 - DNA, 25 bp, Homo sapien
cgtcaaagctgaaagcctgtttgaa

SEQ ID NO: 52574 - DNA, 25 bp, Homo sapien
cgtcaaagctgaatgcctgtttgaa

SEQ ID NO: 52575 - DNA, 25 bp, Homo sapien
cgtcaaggaagctgcaaaaaggctg

SEQ ID NO: 52576 - DNA, 25 bp, Homo sapien
cgtcaaggaagctgcagaaaggctg

SEQ ID NO: 52577 - DNA, 25 bp, Homo sapien
cgtcaatttggctgttgttctccag

SEQ ID NO: 52578 - DNA, 25 bp, Homo sapien
cgtcaatttggctgtttttctccag

SEQ ID NO: 52579 - DNA, 25 bp, Homo sapien
cgtcacatgcacatatggattttgc

SEQ ID NO: 52580 - DNA, 25 bp, Homo sapien
cgtcacatgtacatatggattttgc

SEQ ID NO: 52581 - DNA, 25 bp, Homo sapien
cgtcagaccaagaatttaaaaatag

SEQ ID NO: 52582 - DNA, 25 bp, Homo sapien
cgtcagaccaaggatttaaaaatag

SEQ ID NO: 52583 - DNA, 25 bp, Homo sapien
cgtcattgtcctatgatgatacttc

SEQ ID NO: 52584 - DNA, 25 bp, Homo sapien
cgtcattgtcctgtgatgatacttc

SEQ ID NO: 52585 - DNA, 25 bp, Homo sapien
cgtcatttcaaatacttcctcttac

SEQ ID NO: 52586 - DNA, 25 bp, Homo sapien
cgtcatttcgaatacttcctcttac

SEQ ID NO: 52587 - DNA, 25 bp, Homo sapien
cgtccacctcttctcttgttatccc

SEQ ID NO: 52588 - DNA, 25 bp, Homo sapien
cgtccaccttttctcttgttatccc

SEQ ID NO: 52589 - DNA, 25 bp, Homo sapien
cgtcccatgacacacctattgatat

SEQ ID NO: 52590 - DNA, 25 bp, Homo sapien
cgtcccatgacacagctattgatat

SEQ ID NO: 52591 - DNA, 25 bp, Homo sapien
cgtccttcaagacttcttcattttt

SEQ ID NO: 52592 - DNA, 25 bp, Homo sapien
cgtccttcgagacttcttcattttt

SEQ ID NO: 52593 - DNA, 25 bp, Homo sapien
cgtcgctgagtcacaggggcaggcg

SEQ ID NO: 52594 - DNA, 25 bp, Homo sapien
cgtcgctgagtcacgggggcaggcg

SEQ ID NO: 52595 - DNA, 25 bp, Homo sapien
cgtcgtaaccccgtctggacgtatt

SEQ ID NO: 52596 - DNA, 25 bp, Homo sapien
cgtcgtaaccctgtctggacgtatt

SEQ ID NO: 52597 - DNA, 25 bp, Homo sapien
cgtcgtatgttctatgaagagccac

SEQ ID NO: 52598 - DNA, 25 bp, Homo sapien
cgtcgtatgttctgtgaagagccac

SEQ ID NO: 52599 - DNA, 25 bp, Homo sapien
cgtctattcgtaatttctgacactc

SEQ ID NO: 52600 - DNA, 25 bp, Homo sapien
cgtctattcgtagtttctgacactc

SEQ ID NO: 52601 - DNA, 25 bp, Homo sapien
cgtctcaaagcagttcctcagaatg

SEQ ID NO: 52602 - DNA, 25 bp, Homo sapien
cgtctcaaagcggttcctcagaatg

SEQ ID NO: 52603 - DNA, 25 bp, Homo sapien
cgtctcatgccattctcctaactca

SEQ ID NO: 52604 - DNA, 25 bp, Homo sapien
cgtctcatgccgttctcctaactca

SEQ ID NO: 52605 - DNA, 25 bp, Homo sapien
cgtctctccatgacttggtgctcat

SEQ ID NO: 52606 - DNA, 25 bp, Homo sapien
cgtctctccatggcttggtgctcat

SEQ ID NO: 52607 - DNA, 25 bp, Homo sapien
cgtctgcaatttgactgtaagctct

SEQ ID NO: 52608 - DNA, 25 bp, Homo sapien
cgtctgcaatttgattgtaagctct

SEQ ID NO: 52609 - DNA, 25 bp, Homo sapien
cgtctgccacacacttgcactctgc

SEQ ID NO: 52610 - DNA, 25 bp, Homo sapien
cgtctgcctcacacttgcactctgc

SEQ ID NO: 52611 - DNA, 25 bp, Homo sapien
cgtctgtgctcctggttaggtctcc

SEQ ID NO: 52612 - DNA, 25 bp, Homo sapien
cgtctgtgttcctggttaggtctcc

SEQ ID NO: 52613 - DNA, 25 bp, Homo sapien
cgtcttagtcaacacttaatattat

SEQ ID NO: 52614 - DNA, 25 bp, Homo sapien
cgtcttagtgaacacttaatattat

SEQ ID NO: 52615 - DNA, 25 bp, Homo sapien
cgtcttctctttcaatgtcagaagc

SEQ ID NO: 52616 - DNA, 25 bp, Homo sapien
cgtcttctctttctatgtcagaagc

SEQ ID NO: 52617 - DNA, 25 bp, Homo sapien
cgtgaaagagaagacctaagatgaa

SEQ ID NO: 52618 - DNA, 25 bp, Homo sapien
cgtgaaagagaagagctaagatgaa

SEQ ID NO: 52619 - DNA, 25 bp, Homo sapien
cgtgaaccctggcattttcatgatt

SEQ ID NO: 52620 - DNA, 25 bp, Homo sapien
cgtgaaccctggcgttttcatgatt

SEQ ID NO: 52621 - DNA, 25 bp, Homo sapien
cgtgacctcatcaaatgaactaaat

SEQ ID NO: 52622 - DNA, 25 bp, Homo sapien
cgtgacctcgtcaaatgaactaaat

SEQ ID NO: 52623 - DNA, 25 bp, Homo sapien
cgtgactctaccatgaccctagaat

SEQ ID NO: 52624 - DNA, 25 bp, Homo sapien
cgtgactctaccgtgaccctagaat

SEQ ID NO: 52625 - DNA, 25 bp, Homo sapien
cgtgagaccagacccgataaggatg

SEQ ID NO: 52626 - DNA, 25 bp, Homo sapien
cgtgagaccagacccgctaaggatg

SEQ ID NO: 52627 - DNA, 25 bp, Homo sapien
cgtgaggtaggcctctttgtgtaat

SEQ ID NO: 52628 - DNA, 25 bp, Homo sapien
cgtgaggtaggcctttttgtgtaat

SEQ ID NO: 52629 - DNA, 25 bp, Homo sapien
cgtgatcaaacataaaatgcactat

SEQ ID NO: 52630 - DNA, 25 bp, Homo sapien
cgtgatcaaacatcaaatgcactat

SEQ ID NO: 52631 - DNA, 25 bp, Homo sapien
cgtgatgacccatatgcaaatgttc

SEQ ID NO: 52632 - DNA, 25 bp, Homo sapien
cgtgatgacccctatgcaaatgttc

SEQ ID NO: 52633 - DNA, 25 bp, Homo sapien
cgtgatgcaaaagagcataagagct

SEQ ID NO: 52634 - DNA, 25 bp, Homo sapien
cgtgatgcaaaatagcataagagct

SEQ ID NO: 52635 - DNA, 25 bp, Homo sapien
cgtgattacggactattgcccacaa

SEQ ID NO: 52636 - DNA, 25 bp, Homo sapien
cgtgattatggactattgcccacaa

SEQ ID NO: 52637 - DNA, 25 bp, Homo sapien
cgtgattattggtagtaagccagac

SEQ ID NO: 52638 - DNA, 25 bp, Homo sapien
cgtgattattggttgtaagccagac

SEQ ID NO: 52639 - DNA, 25 bp, Homo sapien
cgtgattcccagcaataaaaaggcc

SEQ ID NO: 52640 - DNA, 25 bp, Homo sapien
cgtgattccgagcaataaaaaggcc

SEQ ID NO: 52641 - DNA, 25 bp, Homo sapien
cgtgatttggcaacagaaatatgca

SEQ ID NO: 52642 - DNA, 25 bp, Homo sapien
cgtgatttggcaatagaaatatgca

SEQ ID NO: 52643 - DNA, 25 bp, Homo sapien
cgtgcacaccgggctctgcaaatta

SEQ ID NO: 52644 - DNA, 25 bp, Homo sapien
cgtgcacactgggctctgcaaatta

SEQ ID NO: 52645 - DNA, 25 bp, Homo sapien
cgtgcactttgccgaacatggatca

SEQ ID NO: 52646 - DNA, 25 bp, Homo sapien
cgtgcactttgctgaacatggatca

SEQ ID NO: 52647 - DNA, 25 bp, Homo sapien
cgtgcagcaggatggtatacagaat

SEQ ID NO: 52648 - DNA, 25 bp, Homo sapien
cgtgcagcagggtggtatacagaat

SEQ ID NO: 52649 - DNA, 25 bp, Homo sapien
cgtgcatcagtagtaagaactgtga

SEQ ID NO: 52650 - DNA, 25 bp, Homo sapien
cgtgcatcattagtaagaactgtga

SEQ ID NO: 52651 - DNA, 25 bp, Homo sapien
cgtgcatccactcaccttatctgtc

SEQ ID NO: 52652 - DNA, 25 bp, Homo sapien
cgtgcatcgactcaccttatctgtc

SEQ ID NO: 52653 - DNA, 25 bp, Homo sapien
cgtgctcggatcttaccacatactt

SEQ ID NO: 52654 - DNA, 25 bp, Homo sapien
cgtgctcggattttaccacatactt

SEQ ID NO: 52655 - DNA, 25 bp, Homo sapien
cgtgctctcgaattgaatgccatga

SEQ ID NO: 52656 - DNA, 25 bp, Homo sapien
cgtgctctgagataaacagccagag

SEQ ID NO: 52657 - DNA, 25 bp, Homo sapien
cgtgctctgagataaatagccagag

SEQ ID NO: 52658 - DNA, 25 bp, Homo sapien
cgtgctctggaattgaatgccatga

SEQ ID NO: 52659 - DNA, 25 bp, Homo sapien
cgtggaaacaagaaattcaactaaa

SEQ ID NO: 52660 - DNA, 25 bp, Homo sapien
cgtggaaataagaaattcaactaaa

SEQ ID NO: 52661 - DNA, 25 bp, Homo sapien
cgtggacccttcatgttaatcccat

SEQ ID NO: 52662 - DNA, 25 bp, Homo sapien
cgtggacctttcatgttaatcccat

SEQ ID NO: 52663 - DNA, 25 bp, Homo sapien
cgtggagaaaagatgttcctgaaac

SEQ ID NO: 52664 - DNA, 25 bp, Homo sapien
cgtggagaagagatgttcctgaaac

SEQ ID NO: 52665 - DNA, 25 bp, Homo sapien
cgtggcaacacggcaggactgtggt

SEQ ID NO: 52666 - DNA, 25 bp, Homo sapien
cgtggcaacactgcaggactgtggt

SEQ ID NO: 52667 - DNA, 25 bp, Homo sapien
cgtggcaggaaatagcctatcaccc

SEQ ID NO: 52668 - DNA, 25 bp, Homo sapien
cgtggcaggaaatagcgtatcaccc

SEQ ID NO: 52669 - DNA, 25 bp, Homo sapien
cgtggctgggtcactgggttgttat

SEQ ID NO: 52670 - DNA, 25 bp, Homo sapien
cgtggctgggtcactgtgttgttat

SEQ ID NO: 52671 - DNA, 25 bp, Homo sapien
cgtggcttaactgagtatcctaagg

SEQ ID NO: 52672 - DNA, 25 bp, Homo sapien
cgtggcttaactgattatcctaagg

SEQ ID NO: 52673 - DNA, 25 bp, Homo sapien
cgtggctttggtacatgctccttcg

SEQ ID NO: 52674 - DNA, 25 bp, Homo sapien
cgtggcttttgtacatgctccttcg

SEQ ID NO: 52675 - DNA, 25 bp, Homo sapien
cgtgggatttaactgaagttgacac

SEQ ID NO: 52676 - DNA, 25 bp, Homo sapien
cgtgggatttaattgaagttgacac

SEQ ID NO: 52677 - DNA, 25 bp, Homo sapien
cgtgggcctatgatcaagcctggcc

SEQ ID NO: 52678 - DNA, 25 bp, Homo sapien
cgtgggcctatggtcaagcctggcc

SEQ ID NO: 52679 - DNA, 25 bp, Homo sapien
cgtgggtattacggttcacaatgag

SEQ ID NO: 52680 - DNA, 25 bp, Homo sapien
cgtgggtattatggttcacaatgag

SEQ ID NO: 52681 - DNA, 25 bp, Homo sapien
cgtggtgctcaccttccagcaccag

SEQ ID NO: 52682 - DNA, 25 bp, Homo sapien
cgtggtgctcactttccagcaccag

SEQ ID NO: 52683 - DNA, 25 bp, Homo sapien
cgtggtgtatctgttcttactttca

SEQ ID NO: 52684 - DNA, 25 bp, Homo sapien
cgtggtgtcgtcctcagcacccagg

SEQ ID NO: 52685 - DNA, 25 bp, Homo sapien
cgtggtgtcgtcttcagcacccagg

SEQ ID NO: 52686 - DNA, 25 bp, Homo sapien
cgtggtgtgtctgttcttactttca

SEQ ID NO: 52687 - DNA, 25 bp, Homo sapien
cgtggttttaaacacgttatgtgtg

SEQ ID NO: 52688 - DNA, 25 bp, Homo sapien
cgtggttttaaacatgttatgtgtg

SEQ ID NO: 52689 - DNA, 25 bp, Homo sapien
cgtgtaatgtctcatggcttttaac

SEQ ID NO: 52690 - DNA, 25 bp, Homo sapien
cgtgtaatgtcttatggcttttaac

SEQ ID NO: 52691 - DNA, 25 bp, Homo sapien
cgtgtattaatggcactaatttttg

SEQ ID NO: 52692 - DNA, 25 bp, Homo sapien
cgtgtattaatggtactaatttttg

SEQ ID NO: 52693 - DNA, 25 bp, Homo sapien
cgtgtcaaaaacagcacaccagtgg

SEQ ID NO: 52694 - DNA, 25 bp, Homo sapien
cgtgtcaaaaatagcacaccagtgg

SEQ ID NO: 52695 - DNA, 25 bp, Homo sapien
cgtgtcacacaaattcatctttgcc

SEQ ID NO: 52696 - DNA, 25 bp, Homo sapien
cgtgtcacacaagttcatctttgcc

SEQ ID NO: 52697 - DNA, 25 bp, Homo sapien
cgtgtccttgggaaacttgctgtgt

SEQ ID NO: 52698 - DNA, 25 bp, Homo sapien
cgtgtccttgggcaacttgctgtgt

SEQ ID NO: 52699 - DNA, 25 bp, Homo sapien
cgtgtgaccgctgaaattaacatct

SEQ ID NO: 52700 - DNA, 25 bp, Homo sapien
cgtgtgactgctgaaattaacatct

SEQ ID NO: 52701 - DNA, 25 bp, Homo sapien
cgtgtgcatgtatcatctgtttaca

SEQ ID NO: 52702 - DNA, 25 bp, Homo sapien
cgtgtgcatgtatgatctgtttaca

SEQ ID NO: 52703 - DNA, 25 bp, Homo sapien
cgtgtggtgaccctgaccctaagaa

SEQ ID NO: 52704 - DNA, 25 bp, Homo sapien
cgtgtggtgactctgaccctaagaa

SEQ ID NO: 52705 - DNA, 25 bp, Homo sapien
cgttaacacgtaatttagtacatat

SEQ ID NO: 52706 - DNA, 25 bp, Homo sapien
cgttaacatgtaatttagtacatat

SEQ ID NO: 52707 - DNA, 25 bp, Homo sapien
cgttaagaccatcatcatctctcaa

SEQ ID NO: 52708 - DNA, 25 bp, Homo sapien
cgttaagaccatcgtcatctctcaa

SEQ ID NO: 52709 - DNA, 25 bp, Homo sapien
cgttaatgcttgatgtatccgaacc

SEQ ID NO: 52710 - DNA, 25 bp, Homo sapien
cgttaatgcttggtgtatccgaacc

SEQ ID NO: 52711 - DNA, 25 bp, Homo sapien
cgttaggctctaatgaaacctcagc

SEQ ID NO: 52712 - DNA, 25 bp, Homo sapien
cgttaggctctgatgaaacctcagc

SEQ ID NO: 52713 - DNA, 25 bp, Homo sapien
cgttagtaataggccttaaacagat

SEQ ID NO: 52714 - DNA, 25 bp, Homo sapien
cgttagtattaggccttaaacagat

SEQ ID NO: 52715 - DNA, 25 bp, Homo sapien
cgttatagcacagactagtttttca

SEQ ID NO: 52716 - DNA, 25 bp, Homo sapien
cgttatagcacagactggtttttca

SEQ ID NO: 52717 - DNA, 25 bp, Homo sapien
cgttatcaagaaagaggaattttgc

SEQ ID NO: 52718 - DNA, 25 bp, Homo sapien
cgttatcaagaatgaggaattttgc

SEQ ID NO: 52719 - DNA, 25 bp, Homo sapien
cgttattccccaccagcgtgttttt

SEQ ID NO: 52720 - DNA, 25 bp, Homo sapien
cgttattccccaccagtgtgttttt

SEQ ID NO: 52721 - DNA, 25 bp, Homo sapien
cgttcaaaatagcctgtctctggaa

SEQ ID NO: 52722 - DNA, 25 bp, Homo sapien
cgttcaaaataggctgtctctggaa

SEQ ID NO: 52723 - DNA, 25 bp, Homo sapien
cgttcagccaacacatctctaaaaa

SEQ ID NO: 52724 - DNA, 25 bp, Homo sapien
cgttcagccaacgcatctctaaaaa

SEQ ID NO: 52725 - DNA, 25 bp, Homo sapien
cgttcctcatgcactctgttgttag

SEQ ID NO: 52726 - DNA, 25 bp, Homo sapien
cgttcctcatgcattctgttgttag

SEQ ID NO: 52727 - DNA, 25 bp, Homo sapien
cgttcttcttttatcttgccacagc

SEQ ID NO: 52728 - DNA, 25 bp, Homo sapien
cgttcttcttttctcttgccacagc

SEQ ID NO: 52729 - DNA, 25 bp, Homo sapien
cgttctttttttcggttatctgtga

SEQ ID NO: 52730 - DNA, 25 bp, Homo sapien
cgttcttttttttggttatctgtga

SEQ ID NO: 52731 - DNA, 25 bp, Homo sapien
cgttgaaacacaatagcattacaag

SEQ ID NO: 52732 - DNA, 25 bp, Homo sapien
cgttgaaacacagtagcattacaag

SEQ ID NO: 52733 - DNA, 25 bp, Homo sapien
cgttgaacacagactcagctcaaca

SEQ ID NO: 52734 - DNA, 25 bp, Homo sapien
cgttgaacacagattcagctcaaca

SEQ ID NO: 52735 - DNA, 25 bp, Homo sapien
cgttgactgaaatgtcattatgtgg

SEQ ID NO: 52736 - DNA, 25 bp, Homo sapien
cgttgactgaaatgtcgttatgtgg

SEQ ID NO: 52737 - DNA, 25 bp, Homo sapien
cgttggaatgaaaccatactctgtt

SEQ ID NO: 52738 - DNA, 25 bp, Homo sapien
cgttggaatgaaactatactctgtt

SEQ ID NO: 52739 - DNA, 25 bp, Homo sapien
cgttggagaagctacaaagaaatgc

SEQ ID NO: 52740 - DNA, 25 bp, Homo sapien
cgttggagaggctacaaagaaatgc

SEQ ID NO: 52741 - DNA, 25 bp, Homo sapien
cgttgtggacagcaaagccagtgtg

SEQ ID NO: 52742 - DNA, 25 bp, Homo sapien
cgttgtgggcagcaaagccagtgtg

SEQ ID NO: 52743 - DNA, 25 bp, Homo sapien
cgttgtttctacgagtagagctcag

SEQ ID NO: 52744 - DNA, 25 bp, Homo sapien
cgttgtttctatgagtagagctcag

SEQ ID NO: 52745 - DNA, 25 bp, Homo sapien
cgtttaatgtagaggtgactttatg

SEQ ID NO: 52746 - DNA, 25 bp, Homo sapien
cgtttaatttagaggtgactttatg

SEQ ID NO: 52747 - DNA, 25 bp, Homo sapien
cgtttagaagtggtccatgtataac

SEQ ID NO: 52748 - DNA, 25 bp, Homo sapien
cgtttagaagttgtccatgtataac

SEQ ID NO: 52749 - DNA, 25 bp, Homo sapien
cgtttagggaaaccacatttaccca

SEQ ID NO: 52750 - DNA, 25 bp, Homo sapien
cgtttagggaaatcacatttaccca

SEQ ID NO: 52751 - DNA, 25 bp, Homo sapien
cgtttatttaacttaccgctaatct

SEQ ID NO: 52752 - DNA, 25 bp, Homo sapien
cgtttatttaacttactgctaatct

SEQ ID NO: 52753 - DNA, 25 bp, Homo sapien
cgtttcaccaggataattgagcagc

SEQ ID NO: 52754 - DNA, 25 bp, Homo sapien
cgtttcaccagtataattgagcagc

SEQ ID NO: 52755 - DNA, 25 bp, Homo sapien
cgtttcatagtgcgagttcagatat

SEQ ID NO: 52756 - DNA, 25 bp, Homo sapien
cgtttcatagtgggagttcagatat

SEQ ID NO: 52757 - DNA, 25 bp, Homo sapien
cgtttcattgcctccgatttataat

SEQ ID NO: 52758 - DNA, 25 bp, Homo sapien
cgtttcatttcctccgatttataat

SEQ ID NO: 52759 - DNA, 25 bp, Homo sapien
cgtttctctagcgctttatttgtgt

SEQ ID NO: 52760 - DNA, 25 bp, Homo sapien
cgtttctctagctctttatttgtgt

SEQ ID NO: 52761 - DNA, 25 bp, Homo sapien
cgtttgcatggaacagtctcaaact

SEQ ID NO: 52762 - DNA, 25 bp, Homo sapien
cgtttgcatgggacagtctcaaact

SEQ ID NO: 52763 - DNA, 25 bp, Homo sapien
cgtttgctcagtcttatttcatgcc

SEQ ID NO: 52764 - DNA, 25 bp, Homo sapien
cgtttgctcggtcttatttcatgcc

SEQ ID NO: 52765 - DNA, 25 bp, Homo sapien
cgtttgcttaacatacaccctggaa

SEQ ID NO: 52766 - DNA, 25 bp, Homo sapien
cgtttgcttaacgtacaccctggaa

SEQ ID NO: 52767 - DNA, 25 bp, Homo sapien
cgtttggaattatcttctagtataa

SEQ ID NO: 52768 - DNA, 25 bp, Homo sapien
cgtttggaattctcttctagtataa

SEQ ID NO: 52769 - DNA, 25 bp, Homo sapien
cgtttgtgcccacagtaactccctg

SEQ ID NO: 52770 - DNA, 25 bp, Homo sapien
cgtttgtgcccaccgtaactccctg

SEQ ID NO: 52771 - DNA, 25 bp, Homo sapien
cgtttgttaggttgcactgtcctcc

SEQ ID NO: 52772 - DNA, 25 bp, Homo sapien
cgtttgttaggttgcagtgtcctcc

SEQ ID NO: 52773 - DNA, 25 bp, Homo sapien
cgttttacgaacgtccagacttctc

SEQ ID NO: 52774 - DNA, 25 bp, Homo sapien
cgttttacgaatgtccagacttctc

SEQ ID NO: 52775 - DNA, 25 bp, Homo sapien
cgttttatgcaccgaacttactgca

SEQ ID NO: 52776 - DNA, 25 bp, Homo sapien
cgttttatgcacggaacttactgca

SEQ ID NO: 52777 - DNA, 25 bp, Homo sapien
cgttttatttgtacactgggccttt

SEQ ID NO: 52778 - DNA, 25 bp, Homo sapien
cgttttatttgtagactgggccttt

SEQ ID NO: 52779 - DNA, 25 bp, Homo sapien
cgttttcatcccacaaattcgaatc

SEQ ID NO: 52780 - DNA, 25 bp, Homo sapien
cgttttcatcctacaaattcgaatc

SEQ ID NO: 52781 - DNA, 25 bp, Homo sapien
cgttttctaaacaacccttccatgt

SEQ ID NO: 52782 - DNA, 25 bp, Homo sapien
cgttttctaaacaacctttccatgt

SEQ ID NO: 52783 - DNA, 25 bp, Homo sapien
cgttttctatatttgcaccaacacc

SEQ ID NO: 52784 - DNA, 25 bp, Homo sapien
cgttttctgtatttgcaccaacacc

SEQ ID NO: 52785 - DNA, 25 bp, Homo sapien
cgttttgtccttgaagacctcctgg

SEQ ID NO: 52786 - DNA, 25 bp, Homo sapien
cgttttgtccttgcagacctcctgg

SEQ ID NO: 52787 - DNA, 25 bp, Homo sapien
cgtttttagactccacagcttcgct

SEQ ID NO: 52788 - DNA, 25 bp, Homo sapien
cgtttttagactccgcagcttcgct

SEQ ID NO: 52789 - DNA, 25 bp, Homo sapien
cgttttttgctagacagaactatct

SEQ ID NO: 52790 - DNA, 25 bp, Homo sapien
cgttttttgctggacagaactatct

SEQ ID NO: 52791 - DNA, 25 bp, Homo sapien
ctaaaaaaagttcaagtaacctaca

SEQ ID NO: 52792 - DNA, 25 bp, Homo sapien
ctaaaaaacgttcaagtaacctaca

SEQ ID NO: 52793 - DNA, 25 bp, Homo sapien
ctaaaaaactgctgtgccttttgta

SEQ ID NO: 52794 - DNA, 25 bp, Homo sapien
ctaaaaaactgctttgccttttgta

SEQ ID NO: 52795 - DNA, 25 bp, Homo sapien
ctaaaaaattacacgatttgtgcag

SEQ ID NO: 52796 - DNA, 25 bp, Homo sapien
ctaaaaaattacatgatttgtgcag

SEQ ID NO: 52797 - DNA, 25 bp, Homo sapien
ctaaaaacaaaaaccacgtgaccct

SEQ ID NO: 52798 - DNA, 25 bp, Homo sapien
ctaaaaacaaaaactacgtgaccct

SEQ ID NO: 52799 - DNA, 25 bp, Homo sapien
ctaaaaacaggttacaaataggtaa

SEQ ID NO: 52800 - DNA, 25 bp, Homo sapien
ctaaaaaccacagagaacaatgtaa

SEQ ID NO: 52801 - DNA, 25 bp, Homo sapien
ctaaaaaccacagagagcaatgtaa

SEQ ID NO: 52802 - DNA, 25 bp, Homo sapien
ctaaaaacgggttacaaataggtaa

SEQ ID NO: 52803 - DNA, 25 bp, Homo sapien
ctaaaaagcgaagaataaggcacca

SEQ ID NO: 52804 - DNA, 25 bp, Homo sapien
ctaaaaagcgaggaataaggcacca

SEQ ID NO: 52805 - DNA, 25 bp, Homo sapien
ctaaaaagtggatcataactggatg

SEQ ID NO: 52806 - DNA, 25 bp, Homo sapien
ctaaaaagtggatcgtaactggatg

SEQ ID NO: 52807 - DNA, 25 bp, Homo sapien
ctaaaaatacctgcgcaaatcgcta

SEQ ID NO: 52808 - DNA, 25 bp, Homo sapien
ctaaaaatacctgctcaaatcgcta

SEQ ID NO: 52809 - DNA, 25 bp, Homo sapien
ctaaaaatacttctcccatggacat

SEQ ID NO: 52810 - DNA, 25 bp, Homo sapien
ctaaaaatataatgtggcccacagc

SEQ ID NO: 52811 - DNA, 25 bp, Homo sapien
ctaaaaatataatgtgtcccacagc

SEQ ID NO: 52812 - DNA, 25 bp, Homo sapien
ctaaaaatccgaaacaattagccag

SEQ ID NO: 52813 - DNA, 25 bp, Homo sapien
ctaaaaatcctttaaatcagttacc

SEQ ID NO: 52814 - DNA, 25 bp, Homo sapien
ctaaaaatctgaaacaattagccag

SEQ ID NO: 52815 - DNA, 25 bp, Homo sapien
ctaaaaatcttttaaatcagttacc

SEQ ID NO: 52816 - DNA, 25 bp, Homo sapien
ctaaaaatgcttctcccatggacat

SEQ ID NO: 52817 - DNA, 25 bp, Homo sapien
ctaaaaatttgaaaactcctcattt

SEQ ID NO: 52818 - DNA, 25 bp, Homo sapien
ctaaaaatttgaaagctcctcattt

SEQ ID NO: 52819 - DNA, 25 bp, Homo sapien
ctaaaacaatgactcactcatgaag

SEQ ID NO: 52820 - DNA, 25 bp, Homo sapien
ctaaaacaatgacttactcatgaag

SEQ ID NO: 52821 - DNA, 25 bp, Homo sapien
ctaaaacaattgcatttaaatgact

SEQ ID NO: 52822 - DNA, 25 bp, Homo sapien
ctaaaacactcagaagatatttcct

SEQ ID NO: 52823 - DNA, 25 bp, Homo sapien
ctaaaacactcagaaggtatttcct

SEQ ID NO: 52824 - DNA, 25 bp, Homo sapien
ctaaaacacttgcatttaaatgact

SEQ ID NO: 52825 - DNA, 25 bp, Homo sapien
ctaaaaccttcaatgaagaaaatgt

SEQ ID NO: 52826 - DNA, 25 bp, Homo sapien
ctaaaaccttcattgaagaaaatgt

SEQ ID NO: 52827 - DNA, 25 bp, Homo sapien
ctaaaactctaatctctttcccttg

SEQ ID NO: 52828 - DNA, 25 bp, Homo sapien
ctaaaactttaatctctttcccttg

SEQ ID NO: 52829 - DNA, 25 bp, Homo sapien
ctaaaagagtcaagttgcttctgga

SEQ ID NO: 52830 - DNA, 25 bp, Homo sapien
ctaaaagagtcatgttgcttctgga

SEQ ID NO: 52831 - DNA, 25 bp, Homo sapien
ctaaaagcaataaactcatttgcaa

SEQ ID NO: 52832 - DNA, 25 bp, Homo sapien
ctaaaagcaataagctcatttgcaa

SEQ ID NO: 52833 - DNA, 25 bp, Homo sapien
ctaaaagcactaatactgtaaaact

SEQ ID NO: 52834 - DNA, 25 bp, Homo sapien
ctaaaagcactactactgtaaaact

SEQ ID NO: 52835 - DNA, 25 bp, Homo sapien
ctaaaagctctggtctcaaagcccc

SEQ ID NO: 52836 - DNA, 25 bp, Homo sapien
ctaaaagctctgttctcaaagcccc

SEQ ID NO: 52837 - DNA, 25 bp, Homo sapien
ctaaaagctgctagtactacagaga

SEQ ID NO: 52838 - DNA, 25 bp, Homo sapien
ctaaaagctgctggtactacagaga

SEQ ID NO: 52839 - DNA, 25 bp, Homo sapien
ctaaaaggaccagcatgttcacctg

SEQ ID NO: 52840 - DNA, 25 bp, Homo sapien
ctaaaaggatcagcatgttcacctg

SEQ ID NO: 52841 - DNA, 25 bp, Homo sapien
ctaaaagtcataccttgattttcaa

SEQ ID NO: 52842 - DNA, 25 bp, Homo sapien
ctaaaagtcatactttgattttcaa

SEQ ID NO: 52843 - DNA, 25 bp, Homo sapien
ctaaaagtcggtcacacaagatata

SEQ ID NO: 52844 - DNA, 25 bp, Homo sapien
ctaaaagtgcacgatttccatcaga

SEQ ID NO: 52845 - DNA, 25 bp, Homo sapien
ctaaaagtgcatgatttccatcaga

SEQ ID NO: 52846 - DNA, 25 bp, Homo sapien
ctaaaagtgggtcacacaagatata

SEQ ID NO: 52847 - DNA, 25 bp, Homo sapien
ctaaaagttgtctcattctctcctt

SEQ ID NO: 52848 - DNA, 25 bp, Homo sapien
ctaaaagttgtctcgttctctcctt

SEQ ID NO: 52849 - DNA, 25 bp, Homo sapien
ctaaaataccaactccatcatatct

SEQ ID NO: 52850 - DNA, 25 bp, Homo sapien
ctaaaataccaactccgtcatatct

SEQ ID NO: 52851 - DNA, 25 bp, Homo sapien
ctaaaatagaagcgtaagggagaca

SEQ ID NO: 52852 - DNA, 25 bp, Homo sapien
ctaaaatagaagtgtaagggagaca

SEQ ID NO: 52853 - DNA, 25 bp, Homo sapien
ctaaaataggatttgaatgtaagca

SEQ ID NO: 52854 - DNA, 25 bp, Homo sapien
ctaaaataggatttgagtgtaagca

SEQ ID NO: 52855 - DNA, 25 bp, Homo sapien
ctaaaatagttctctaagttgctct

SEQ ID NO: 52856 - DNA, 25 bp, Homo sapien
ctaaaatagttttctaagttgctct

SEQ ID NO: 52857 - DNA, 25 bp, Homo sapien
ctaaaatccttgaaagatcccacta

SEQ ID NO: 52858 - DNA, 25 bp, Homo sapien
ctaaaatccttggaagatcccacta

SEQ ID NO: 52859 - DNA, 25 bp, Homo sapien
ctaaaatgatggcaaataaggcaat

SEQ ID NO: 52860 - DNA, 25 bp, Homo sapien
ctaaaatgatgtcaaataaggcaat

SEQ ID NO: 52861 - DNA, 25 bp, Homo sapien
ctaaaatgcaaataccccaaagcac

SEQ ID NO: 52862 - DNA, 25 bp, Homo sapien
ctaaaatgcaaatatcccaaagcac

SEQ ID NO: 52863 - DNA, 25 bp, Homo sapien
ctaaaattacgaaatatctcttttg

SEQ ID NO: 52864 - DNA, 25 bp, Homo sapien
ctaaaattatgaaatatctcttttg

SEQ ID NO: 52865 - DNA, 25 bp, Homo sapien
ctaaaattatggaaaaccagacacg

SEQ ID NO: 52866 - DNA, 25 bp, Homo sapien
ctaaaattatggagaaccagacacg

SEQ ID NO: 52867 - DNA, 25 bp, Homo sapien
ctaaaattcaagaatattcaaaatt

SEQ ID NO: 52868 - DNA, 25 bp, Homo sapien
ctaaaattcgagaatattcaaaatt

SEQ ID NO: 52869 - DNA, 25 bp, Homo sapien
ctaaaattctaaaggactaactttt

SEQ ID NO: 52870 - DNA, 25 bp, Homo sapien
ctaaaattctaagggactaactttt

SEQ ID NO: 52871 - DNA, 25 bp, Homo sapien
ctaaaattctcccaagttaaatcgc

SEQ ID NO: 52872 - DNA, 25 bp, Homo sapien
ctaaaattgaccacatacttaacca

SEQ ID NO: 52873 - DNA, 25 bp, Homo sapien
ctaaaattgaccacatgcttaacca

SEQ ID NO: 52874 - DNA, 25 bp, Homo sapien
ctaaaattgagaccgagaggaagta

SEQ ID NO: 52875 - DNA, 25 bp, Homo sapien
ctaaaattgagactgagaggaagta

SEQ ID NO: 52876 - DNA, 25 bp, Homo sapien
ctaaaattgcatttattgtgtgcaa

SEQ ID NO: 52877 - DNA, 25 bp, Homo sapien
ctaaaattgtatttattgtgtgcaa

SEQ ID NO: 52878 - DNA, 25 bp, Homo sapien
ctaaaatttagcccacattgccaag

SEQ ID NO: 52879 - DNA, 25 bp, Homo sapien
ctaaaatttagctcacattgccaag

SEQ ID NO: 52880 - DNA, 25 bp, Homo sapien
ctaaaattttcccaagttaaatcgc

SEQ ID NO: 52881 - DNA, 25 bp, Homo sapien
ctaaacaaagaagataagcgctgac

SEQ ID NO: 52882 - DNA, 25 bp, Homo sapien
ctaaacaacaacttctgagttaaca

SEQ ID NO: 52883 - DNA, 25 bp, Homo sapien
ctaaacaacaatttctgagttaaca

SEQ ID NO: 52884 - DNA, 25 bp, Homo sapien
ctaaacaaggaagataagcgctgac

SEQ ID NO: 52885 - DNA, 25 bp, Homo sapien
ctaaacacactctaccatcttagat

SEQ ID NO: 52886 - DNA, 25 bp, Homo sapien
ctaaacacagagccaaaggctgcat

SEQ ID NO: 52887 - DNA, 25 bp, Homo sapien
ctaaacacagagccaagggctgcat

SEQ ID NO: 52888 - DNA, 25 bp, Homo sapien
ctaaacacatcaacactccaagtgg

SEQ ID NO: 52889 - DNA, 25 bp, Homo sapien
ctaaacacatcgacactccaagtgg

SEQ ID NO: 52890 - DNA, 25 bp, Homo sapien
ctaaacacattctaccatcttagat

SEQ ID NO: 52891 - DNA, 25 bp, Homo sapien
ctaaacagatcccgaataaagggta

SEQ ID NO: 52892 - DNA, 25 bp, Homo sapien
ctaaacagatcctgaataaagggta

SEQ ID NO: 52893 - DNA, 25 bp, Homo sapien
ctaaacaggatgtgtaagtgggagg

SEQ ID NO: 52894 - DNA, 25 bp, Homo sapien
ctaaacagggtgtgtaagtgggagg

SEQ ID NO: 52895 - DNA, 25 bp, Homo sapien
ctaaacagtcccatgagtaagaaca

SEQ ID NO: 52896 - DNA, 25 bp, Homo sapien
ctaaacagtcccgtgagtaagaaca

SEQ ID NO: 52897 - DNA, 25 bp, Homo sapien
ctaaacataaaacgatacacaaacc

SEQ ID NO: 52898 - DNA, 25 bp, Homo sapien
ctaaacataaaatgatacacaaacc

SEQ ID NO: 52899 - DNA, 25 bp, Homo sapien
ctaaacatcataaggaaattaaata

SEQ ID NO: 52900 - DNA, 25 bp, Homo sapien
ctaaacatcgtaaggaaattaaata

SEQ ID NO: 52901 - DNA, 25 bp, Homo sapien
ctaaacatctcttgaatctatcact

SEQ ID NO: 52902 - DNA, 25 bp, Homo sapien
ctaaacatctgcgacggtttggata

SEQ ID NO: 52903 - DNA, 25 bp, Homo sapien
ctaaacatctgctacggtttggata

SEQ ID NO: 52904 - DNA, 25 bp, Homo sapien
ctaaacattcaaaaccaagatgctg

SEQ ID NO: 52905 - DNA, 25 bp, Homo sapien
ctaaacattcaaagccaagatgctg

SEQ ID NO: 52906 - DNA, 25 bp, Homo sapien
ctaaacatttcttgaatctatcact

SEQ ID NO: 52907 - DNA, 25 bp, Homo sapien
ctaaaccaatcttattgttgtgaaa

SEQ ID NO: 52908 - DNA, 25 bp, Homo sapien
ctaaaccaatcttgttgttgtgaaa

SEQ ID NO: 52909 - DNA, 25 bp, Homo sapien
ctaaaccattactgtagattaataa

SEQ ID NO: 52910 - DNA, 25 bp, Homo sapien
ctaaaccattattgtagattaataa

SEQ ID NO: 52911 - DNA, 25 bp, Homo sapien
ctaaaccgatacagggaagctctct

SEQ ID NO: 52912 - DNA, 25 bp, Homo sapien
ctaaaccgatatagggaagctctct

SEQ ID NO: 52913 - DNA, 25 bp, Homo sapien
ctaaactaccactggcaagagaggc

SEQ ID NO: 52914 - DNA, 25 bp, Homo sapien
ctaaactacgcaggccctcttggct

SEQ ID NO: 52915 - DNA, 25 bp, Homo sapien
ctaaactatcactggcaagagaggc

SEQ ID NO: 52916 - DNA, 25 bp, Homo sapien
ctaaactatgcaggccctcttggct

SEQ ID NO: 52917 - DNA, 25 bp, Homo sapien
ctaaactcacattccttctagtcat

SEQ ID NO: 52918 - DNA, 25 bp, Homo sapien
ctaaactcatattccttctagtcat

SEQ ID NO: 52919 - DNA, 25 bp, Homo sapien
ctaaactcattacgtttaacatgca

SEQ ID NO: 52920 - DNA, 25 bp, Homo sapien
ctaaactcattatgtttaacatgca

SEQ ID NO: 52921 - DNA, 25 bp, Homo sapien
ctaaactgaggatcattcacctgaa

SEQ ID NO: 52922 - DNA, 25 bp, Homo sapien
ctaaactgaggattattcacctgaa

SEQ ID NO: 52923 - DNA, 25 bp, Homo sapien
ctaaactggcaaaatgtcttatgag

SEQ ID NO: 52924 - DNA, 25 bp, Homo sapien
ctaaactggcacaatgtcttatgag

SEQ ID NO: 52925 - DNA, 25 bp, Homo sapien
ctaaacttctccagatagcaggata

SEQ ID NO: 52926 - DNA, 25 bp, Homo sapien
ctaaacttctccagatcgcaggata

SEQ ID NO: 52927 - DNA, 25 bp, Homo sapien
ctaaagaaatgaagatttgtgaatt

SEQ ID NO: 52928 - DNA, 25 bp, Homo sapien
ctaaagaaatggagatttgtgaatt

SEQ ID NO: 52929 - DNA, 25 bp, Homo sapien
ctaaagaacattcttggcaagagga

SEQ ID NO: 52930 - DNA, 25 bp, Homo sapien
ctaaagaacgttcttggcaagagga

SEQ ID NO: 52931 - DNA, 25 bp, Homo sapien
ctaaagaactcctacatagcaaaag

SEQ ID NO: 52932 - DNA, 25 bp, Homo sapien
ctaaagaagagtcaggtaaatataa

SEQ ID NO: 52933 - DNA, 25 bp, Homo sapien
ctaaagaagagtcgggtaaatataa

SEQ ID NO: 52934 - DNA, 25 bp, Homo sapien
ctaaagaagtcctacatagcaaaag

SEQ ID NO: 52935 - DNA, 25 bp, Homo sapien
ctaaagatagctggcaggctaaaat

SEQ ID NO: 52936 - DNA, 25 bp, Homo sapien
ctaaagatagctggcatgctaaaat

SEQ ID NO: 52937 - DNA, 25 bp, Homo sapien
ctaaagatttcccaattttactgga

SEQ ID NO: 52938 - DNA, 25 bp, Homo sapien
ctaaagatttctcaattttactgga

SEQ ID NO: 52939 - DNA, 25 bp, Homo sapien
ctaaagcagataaagattgaatcac

SEQ ID NO: 52940 - DNA, 25 bp, Homo sapien
ctaaagcagatacagattgaatcac

SEQ ID NO: 52941 - DNA, 25 bp, Homo sapien
ctaaagcatgcatacactcacaaaa

SEQ ID NO: 52942 - DNA, 25 bp, Homo sapien
ctaaagcatgcgtacactcacaaaa

SEQ ID NO: 52943 - DNA, 25 bp, Homo sapien
ctaaagctatggtcacacctggcac

SEQ ID NO: 52944 - DNA, 25 bp, Homo sapien
ctaaagctatggtcacgcctggcac

SEQ ID NO: 52945 - DNA, 25 bp, Homo sapien
ctaaagctctagtaatcaagacagt

SEQ ID NO: 52946 - DNA, 25 bp, Homo sapien
ctaaagctctagtaattaagacagt

SEQ ID NO: 52947 - DNA, 25 bp, Homo sapien
ctaaagctggaaaatgcaactggca

SEQ ID NO: 52948 - DNA, 25 bp, Homo sapien
ctaaagctggaaaatgtaactggca

SEQ ID NO: 52949 - DNA, 25 bp, Homo sapien
ctaaaggaatgacctacatagcatt

SEQ ID NO: 52950 - DNA, 25 bp, Homo sapien
ctaaaggaatgacctatatagcatt

SEQ ID NO: 52951 - DNA, 25 bp, Homo sapien
ctaaaggaatttactctcttccagg

SEQ ID NO: 52952 - DNA, 25 bp, Homo sapien
ctaaaggagacacaggtgatccagc

SEQ ID NO: 52953 - DNA, 25 bp, Homo sapien
ctaaaggagacacgggtgatccagc

SEQ ID NO: 52954 - DNA, 25 bp, Homo sapien
ctaaaggagtttactctcttccagg

SEQ ID NO: 52955 - DNA, 25 bp, Homo sapien
ctaaaggcactgtctgacaaaactt

SEQ ID NO: 52956 - DNA, 25 bp, Homo sapien
ctaaaggcactgtttgacaaaactt

SEQ ID NO: 52957 - DNA, 25 bp, Homo sapien
ctaaagggagagataggcttcaatg

SEQ ID NO: 52958 - DNA, 25 bp, Homo sapien
ctaaagggagagatgggcttcaatg

SEQ ID NO: 52959 - DNA, 25 bp, Homo sapien
ctaaagggttctagtccaattcact

SEQ ID NO: 52960 - DNA, 25 bp, Homo sapien
ctaaagggttctggtccaattcact

SEQ ID NO: 52961 - DNA, 25 bp, Homo sapien
ctaaaggtgacctctgcaaccactt

SEQ ID NO: 52962 - DNA, 25 bp, Homo sapien
ctaaaggtggcctctgcaaccactt

SEQ ID NO: 52963 - DNA, 25 bp, Homo sapien
ctaaagtatctccacgaggttggtc

SEQ ID NO: 52964 - DNA, 25 bp, Homo sapien
ctaaagtatctccatgaggttggtc

SEQ ID NO: 52965 - DNA, 25 bp, Homo sapien
ctaaagtcactgggaacagccctta

SEQ ID NO: 52966 - DNA, 25 bp, Homo sapien
ctaaagtcattgggaacagccctta

SEQ ID NO: 52967 - DNA, 25 bp, Homo sapien
ctaaagtctgtacccagctacctca

SEQ ID NO: 52968 - DNA, 25 bp, Homo sapien
ctaaagtctgtactcagctacctca

SEQ ID NO: 52969 - DNA, 25 bp, Homo sapien
ctaaagttcaatttaagattccatt

SEQ ID NO: 52970 - DNA, 25 bp, Homo sapien
ctaaagttctatttaagattccatt

SEQ ID NO: 52971 - DNA, 25 bp, Homo sapien
ctaaagttttgtcggttcaaactag

SEQ ID NO: 52972 - DNA, 25 bp, Homo sapien
ctaaagttttgtctgttcaaactag

SEQ ID NO: 52973 - DNA, 25 bp, Homo sapien
ctaaataaacgcctatgtactgtgg

SEQ ID NO: 52974 - DNA, 25 bp, Homo sapien
ctaaataaacgcttggagtgcggag

SEQ ID NO: 52975 - DNA, 25 bp, Homo sapien
ctaaataaatgcctatgtactgtgg

SEQ ID NO: 52976 - DNA, 25 bp, Homo sapien
ctaaataaatgcttggagtgcggag

SEQ ID NO: 52977 - DNA, 25 bp, Homo sapien
ctaaatacagcaaagtggttcccag

SEQ ID NO: 52978 - DNA, 25 bp, Homo sapien
ctaaatacagcagagtggttcccag

SEQ ID NO: 52979 - DNA, 25 bp, Homo sapien
ctaaatacttgaagacctgttatgt

SEQ ID NO: 52980 - DNA, 25 bp, Homo sapien
ctaaatacttgaggacctgttatgt

SEQ ID NO: 52981 - DNA, 25 bp, Homo sapien
ctaaatagacactaaaaaaaaattt

SEQ ID NO: 52982 - DNA, 25 bp, Homo sapien
ctaaatagacactgaaaaaaaattt

SEQ ID NO: 52983 - DNA, 25 bp, Homo sapien
ctaaataggtctgtatgtaaccacc

SEQ ID NO: 52984 - DNA, 25 bp, Homo sapien
ctaaataggtctgtgtgtaaccacc

SEQ ID NO: 52985 - DNA, 25 bp, Homo sapien
ctaaatagttacgaaaaacagaagt

SEQ ID NO: 52986 - DNA, 25 bp, Homo sapien
ctaaatagttatgaaaaacagaagt

SEQ ID NO: 52987 - DNA, 25 bp, Homo sapien
ctaaatatcacttttactgcatcca

SEQ ID NO: 52988 - DNA, 25 bp, Homo sapien
ctaaatatcgcttttactgcatcca

SEQ ID NO: 52989 - DNA, 25 bp, Homo sapien
ctaaatctactattgaggtttacta

SEQ ID NO: 52990 - DNA, 25 bp, Homo sapien
ctaaatctactgttgaggtttacta

SEQ ID NO: 52991 - DNA, 25 bp, Homo sapien
ctaaatctccagcttgccagcttac

SEQ ID NO: 52992 - DNA, 25 bp, Homo sapien
ctaaatctccagtttgccagcttac

SEQ ID NO: 52993 - DNA, 25 bp, Homo sapien
ctaaatctcttgcacaggtatctca

SEQ ID NO: 52994 - DNA, 25 bp, Homo sapien
ctaaatctgttgcacaggtatctca

SEQ ID NO: 52995 - DNA, 25 bp, Homo sapien
ctaaatgaagaaaatgatttgcctc

SEQ ID NO: 52996 - DNA, 25 bp, Homo sapien
ctaaatgacagaacataaatgaaag

SEQ ID NO: 52997 - DNA, 25 bp, Homo sapien
ctaaatgagagaacataaatgaaag

SEQ ID NO: 52998 - DNA, 25 bp, Homo sapien
ctaaatgaggaaaatgatttgcctc

SEQ ID NO: 52999 - DNA, 25 bp, Homo sapien
ctaaatgcccacagaagacagcagg

SEQ ID NO: 53000 - DNA, 25 bp, Homo sapien
ctaaatgcccacggaagacagcagg

SEQ ID NO: 53001 - DNA, 25 bp, Homo sapien
ctaaatgtcggtgaagatgttgagt

SEQ ID NO: 53002 - DNA, 25 bp, Homo sapien
ctaaatgttggtgaagatgttgagt

SEQ ID NO: 53003 - DNA, 25 bp, Homo sapien
ctaaattaaagacaacacggtacca

SEQ ID NO: 53004 - DNA, 25 bp, Homo sapien
ctaaattaaagataacacggtacca

SEQ ID NO: 53005 - DNA, 25 bp, Homo sapien
ctaaattattccactccatgacctc

SEQ ID NO: 53006 - DNA, 25 bp, Homo sapien
ctaaattattccgctccatgacctc

SEQ ID NO: 53007 - DNA, 25 bp, Homo sapien
ctaaattattctgcatcttgcattc

SEQ ID NO: 53008 - DNA, 25 bp, Homo sapien
ctaaattattctgtatcttgcattc

SEQ ID NO: 53009 - DNA, 25 bp, Homo sapien
ctaaattctactgactttttcctac

SEQ ID NO: 53010 - DNA, 25 bp, Homo sapien
ctaaattctactgattttttcctac

SEQ ID NO: 53011 - DNA, 25 bp, Homo sapien
ctaaattctcctgaaatcctttatc

SEQ ID NO: 53012 - DNA, 25 bp, Homo sapien
ctaaattcttctgaaatcctttatc

SEQ ID NO: 53013 - DNA, 25 bp, Homo sapien
ctaaattgctgcgattacagttgtg

SEQ ID NO: 53014 - DNA, 25 bp, Homo sapien
ctaaattgctgtgattacagttgtg

SEQ ID NO: 53015 - DNA, 25 bp, Homo sapien
ctaaattgggaatgcagacaactag

SEQ ID NO: 53016 - DNA, 25 bp, Homo sapien
ctaaattgggaatgtagacaactag

SEQ ID NO: 53017 - DNA, 25 bp, Homo sapien
ctaaatttcaggccttgtggcactc

SEQ ID NO: 53018 - DNA, 25 bp, Homo sapien
ctaaatttcgggccttgtggcactc

SEQ ID NO: 53019 - DNA, 25 bp, Homo sapien
ctaaatttctcagcccagaactgac

SEQ ID NO: 53020 - DNA, 25 bp, Homo sapien
ctaaatttctcagtccagaactgac

SEQ ID NO: 53021 - DNA, 25 bp, Homo sapien
ctaaatttgattgttcctggactca

SEQ ID NO: 53022 - DNA, 25 bp, Homo sapien
ctaaatttgccatcaggtagttcat

SEQ ID NO: 53023 - DNA, 25 bp, Homo sapien
ctaaatttgccattaggtagttcat

SEQ ID NO: 53024 - DNA, 25 bp, Homo sapien
ctaaatttgctacttacgatgtgaa

SEQ ID NO: 53025 - DNA, 25 bp, Homo sapien
ctaaatttgctacttatgatgtgaa

SEQ ID NO: 53026 - DNA, 25 bp, Homo sapien
ctaaatttgtttgttcctggactca

SEQ ID NO: 53027 - DNA, 25 bp, Homo sapien
ctaacaaaacaaacatatcttctac

SEQ ID NO: 53028 - DNA, 25 bp, Homo sapien
ctaacaaaagaaacatatcttctac

SEQ ID NO: 53029 - DNA, 25 bp, Homo sapien
ctaacaaacgagtgctggatttatc

SEQ ID NO: 53030 - DNA, 25 bp, Homo sapien
ctaacaaatgagtgctggatttatc

SEQ ID NO: 53031 - DNA, 25 bp, Homo sapien
ctaacaagttgtcaaaaattaacag

SEQ ID NO: 53032 - DNA, 25 bp, Homo sapien
ctaacaagttgtcagaaattaacag

SEQ ID NO: 53033 - DNA, 25 bp, Homo sapien
ctaacaattctcattggttatctga

SEQ ID NO: 53034 - DNA, 25 bp, Homo sapien
ctaacaattcttattggttatctga

SEQ ID NO: 53035 - DNA, 25 bp, Homo sapien
ctaacacacggcagctgcttacaaa

SEQ ID NO: 53036 - DNA, 25 bp, Homo sapien
ctaacacatggcagctgcttacaaa

SEQ ID NO: 53037 - DNA, 25 bp, Homo sapien
ctaacacatgttttatgagcatatg

SEQ ID NO: 53038 - DNA, 25 bp, Homo sapien
ctaacacatgttttgtgagcatatg

SEQ ID NO: 53039 - DNA, 25 bp, Homo sapien
ctaacactaccacctcagtaaagct

SEQ ID NO: 53040 - DNA, 25 bp, Homo sapien
ctaacactaccgcctcagtaaagct

SEQ ID NO: 53041 - DNA, 25 bp, Homo sapien
ctaacactgtggcaaaataggtggt

SEQ ID NO: 53042 - DNA, 25 bp, Homo sapien
ctaacactgtggcgaaataggtggt

SEQ ID NO: 53043 - DNA, 25 bp, Homo sapien
ctaacagaaaaattggcaaaggatg

SEQ ID NO: 53044 - DNA, 25 bp, Homo sapien
ctaacagaatatgtttaccactgct

SEQ ID NO: 53045 - DNA, 25 bp, Homo sapien
ctaacagagaaattggcaaaggatg

SEQ ID NO: 53046 - DNA, 25 bp, Homo sapien
ctaacagagtatgtttaccactgct

SEQ ID NO: 53047 - DNA, 25 bp, Homo sapien
ctaacagggtggccgagaggaagaa

SEQ ID NO: 53048 - DNA, 25 bp, Homo sapien
ctaacagggtggcggagaggaagaa

SEQ ID NO: 53049 - DNA, 25 bp, Homo sapien
ctaacagtgttggcaaaggcacggg

SEQ ID NO: 53050 - DNA, 25 bp, Homo sapien
ctaacagtgttggcaacggcacggg

SEQ ID NO: 53051 - DNA, 25 bp, Homo sapien
ctaacataatcttataataatgttt

SEQ ID NO: 53052 - DNA, 25 bp, Homo sapien
ctaacatactcttataataatgttt

SEQ ID NO: 53053 - DNA, 25 bp, Homo sapien
ctaacatcacatccatatctatgtt

SEQ ID NO: 53054 - DNA, 25 bp, Homo sapien
ctaacatcccatccatatctatgtt

SEQ ID NO: 53055 - DNA, 25 bp, Homo sapien
ctaacatgccgtccatagcagaatt

SEQ ID NO: 53056 - DNA, 25 bp, Homo sapien
ctaacatgcgtcaaagaatacaatc

SEQ ID NO: 53057 - DNA, 25 bp, Homo sapien
ctaacatgctgtccatagcagaatt

SEQ ID NO: 53058 - DNA, 25 bp, Homo sapien
ctaacatgtgtcaaagaatacaatc

SEQ ID NO: 53059 - DNA, 25 bp, Homo sapien
ctaacatttgaaagtgatttgaaaa

SEQ ID NO: 53060 - DNA, 25 bp, Homo sapien
ctaacatttgatagtgatttgaaaa

SEQ ID NO: 53061 - DNA, 25 bp, Homo sapien
ctaaccacaagatttttttctggtc

SEQ ID NO: 53062 - DNA, 25 bp, Homo sapien
ctaaccacaaggtttttttctggtc

SEQ ID NO: 53063 - DNA, 25 bp, Homo sapien
ctaaccacatctcctagaattgaca

SEQ ID NO: 53064 - DNA, 25 bp, Homo sapien
ctaaccacatctgctagaattgaca

SEQ ID NO: 53065 - DNA, 25 bp, Homo sapien
ctaaccatggctgcttttaaggcat

SEQ ID NO: 53066 - DNA, 25 bp, Homo sapien
ctaaccatggctgtttttaaggcat

SEQ ID NO: 53067 - DNA, 25 bp, Homo sapien
ctaacccacacagagaactgagaca

SEQ ID NO: 53068 - DNA, 25 bp, Homo sapien
ctaacccacacagcgaactgagaca

SEQ ID NO: 53069 - DNA, 25 bp, Homo sapien
ctaacccagtcattttgtagcccag

SEQ ID NO: 53070 - DNA, 25 bp, Homo sapien
ctaacccagtcgttttgtagcccag

SEQ ID NO: 53071 - DNA, 25 bp, Homo sapien
ctaacctaaaatagagttccccaca

SEQ ID NO: 53072 - DNA, 25 bp, Homo sapien
ctaacctaaaatggagttccccaca

SEQ ID NO: 53073 - DNA, 25 bp, Homo sapien
ctaacctagtgacgaattagtaata

SEQ ID NO: 53074 - DNA, 25 bp, Homo sapien
ctaacctagtgatgaattagtaata

SEQ ID NO: 53075 - DNA, 25 bp, Homo sapien
ctaacctcagtacagtctaggagag

SEQ ID NO: 53076 - DNA, 25 bp, Homo sapien
ctaacctcagtacagtgtaggagag

SEQ ID NO: 53077 - DNA, 25 bp, Homo sapien
ctaacctctaaggcatttcagaagc

SEQ ID NO: 53078 - DNA, 25 bp, Homo sapien
ctaacctctgaggcatttcagaagc

SEQ ID NO: 53079 - DNA, 25 bp, Homo sapien
ctaacctttctgattccctttctca

SEQ ID NO: 53080 - DNA, 25 bp, Homo sapien
ctaacctttcttattccctttctca

SEQ ID NO: 53081 - DNA, 25 bp, Homo sapien
ctaacgcagccataactggtatgga

SEQ ID NO: 53082 - DNA, 25 bp, Homo sapien
ctaacgcagccgtaactggtatgga

SEQ ID NO: 53083 - DNA, 25 bp, Homo sapien
ctaactaaatagcctttcatctttc

SEQ ID NO: 53084 - DNA, 25 bp, Homo sapien
ctaactaaatagcttttcatctttc

SEQ ID NO: 53085 - DNA, 25 bp, Homo sapien
ctaactcagaccaatgggtggccta

SEQ ID NO: 53086 - DNA, 25 bp, Homo sapien
ctaactcataccaatgggtggccta

SEQ ID NO: 53087 - DNA, 25 bp, Homo sapien
ctaactcctggctactactgtgtat

SEQ ID NO: 53088 - DNA, 25 bp, Homo sapien
ctaactcctggctgctactgtgtat

SEQ ID NO: 53089 - DNA, 25 bp, Homo sapien
ctaactctaagtacacactggaaaa

SEQ ID NO: 53090 - DNA, 25 bp, Homo sapien
ctaactctaagtacaccctggaaaa

SEQ ID NO: 53091 - DNA, 25 bp, Homo sapien
ctaactgaacacttgcagcatatac

SEQ ID NO: 53092 - DNA, 25 bp, Homo sapien
ctaactgactacaattaggggtttc

SEQ ID NO: 53093 - DNA, 25 bp, Homo sapien
ctaactgactaccattaggggtttc

SEQ ID NO: 53094 - DNA, 25 bp, Homo sapien
ctaactgagcacttgcagcatatac

SEQ ID NO: 53095 - DNA, 25 bp, Homo sapien
ctaactggcttcccgtgccgactcc

SEQ ID NO: 53096 - DNA, 25 bp, Homo sapien
ctaactggcttcgtattgcactttt

SEQ ID NO: 53097 - DNA, 25 bp, Homo sapien
ctaactggctttccgtgccgactcc

SEQ ID NO: 53098 - DNA, 25 bp, Homo sapien
ctaactggctttgtattgcactttt

SEQ ID NO: 53099 - DNA, 25 bp, Homo sapien
ctaactggtgataaagcatcatgaa

SEQ ID NO: 53100 - DNA, 25 bp, Homo sapien
ctaactggtgatgaagcatcatgaa

SEQ ID NO: 53101 - DNA, 25 bp, Homo sapien
ctaactgtgatggcaaaattctcct

SEQ ID NO: 53102 - DNA, 25 bp, Homo sapien
ctaactgtgatggccaaattctcct

SEQ ID NO: 53103 - DNA, 25 bp, Homo sapien
ctaacttactattcacacatgctac

SEQ ID NO: 53104 - DNA, 25 bp, Homo sapien
ctaacttattattcacacatgctac

SEQ ID NO: 53105 - DNA, 25 bp, Homo sapien
ctaacttctatgcttattggtttat

SEQ ID NO: 53106 - DNA, 25 bp, Homo sapien
ctaacttctatgtttattggtttat

SEQ ID NO: 53107 - DNA, 25 bp, Homo sapien
ctaacttgccaagaatcatgcatgc

SEQ ID NO: 53108 - DNA, 25 bp, Homo sapien
ctaacttgccaataatcatgcatgc

SEQ ID NO: 53109 - DNA, 25 bp, Homo sapien
ctaacttgctttgtctctatttttt

SEQ ID NO: 53110 - DNA, 25 bp, Homo sapien
ctaacttggctatccaggaaaactt

SEQ ID NO: 53111 - DNA, 25 bp, Homo sapien
ctaacttggctttccaggaaaactt

SEQ ID NO: 53112 - DNA, 25 bp, Homo sapien
ctaacttgttttgtctctatttttt

SEQ ID NO: 53113 - DNA, 25 bp, Homo sapien
ctaactttacaactgaagggaggga

SEQ ID NO: 53114 - DNA, 25 bp, Homo sapien
ctaactttacaattgaagggaggga

SEQ ID NO: 53115 - DNA, 25 bp, Homo sapien
ctaactttattgtatacaaactcat

SEQ ID NO: 53116 - DNA, 25 bp, Homo sapien
ctaactttattgtgtacaaactcat

SEQ ID NO: 53117 - DNA, 25 bp, Homo sapien
ctaagaaaaatccgtagactgtgag

SEQ ID NO: 53118 - DNA, 25 bp, Homo sapien
ctaagaaaaatctgtagactgtgag

SEQ ID NO: 53119 - DNA, 25 bp, Homo sapien
ctaagaaagcctgctcttgaatcat

SEQ ID NO: 53120 - DNA, 25 bp, Homo sapien
ctaagaaagcctgttcttgaatcat

SEQ ID NO: 53121 - DNA, 25 bp, Homo sapien
ctaagaagaaacatgtttgaggcca

SEQ ID NO: 53122 - DNA, 25 bp, Homo sapien
ctaagaagaaatatgtttgaggcca

SEQ ID NO: 53123 - DNA, 25 bp, Homo sapien
ctaagaagccataataactgaaggc

SEQ ID NO: 53124 - DNA, 25 bp, Homo sapien
ctaagaagccatagtaactgaaggc

SEQ ID NO: 53125 - DNA, 25 bp, Homo sapien
ctaagaaggacctaagagctcccta

SEQ ID NO: 53126 - DNA, 25 bp, Homo sapien
ctaagaaggacctatgagctcccta

SEQ ID NO: 53127 - DNA, 25 bp, Homo sapien
ctaagaatcaaacgaatggttattt

SEQ ID NO: 53128 - DNA, 25 bp, Homo sapien
ctaagaatcaaatgaatggttattt

SEQ ID NO: 53129 - DNA, 25 bp, Homo sapien
ctaagaatttccgtccttgttgtct

SEQ ID NO: 53130 - DNA, 25 bp, Homo sapien
ctaagaatttctgtccttgttgtct

SEQ ID NO: 53131 - DNA, 25 bp, Homo sapien
ctaagagacgatacaattttaaaaa

SEQ ID NO: 53132 - DNA, 25 bp, Homo sapien
ctaagagaggatacaattttaaaaa

SEQ ID NO: 53133 - DNA, 25 bp, Homo sapien
ctaagagttgctatccatatgatct

SEQ ID NO: 53134 - DNA, 25 bp, Homo sapien
ctaagagttgctatccgtatgatct

SEQ ID NO: 53135 - DNA, 25 bp, Homo sapien
ctaagatacagggttcaaaggagtg

SEQ ID NO: 53136 - DNA, 25 bp, Homo sapien
ctaagatacttctcttttattgtgc

SEQ ID NO: 53137 - DNA, 25 bp, Homo sapien
ctaagatacttttcttttattgtgc

SEQ ID NO: 53138 - DNA, 25 bp, Homo sapien
ctaagatagggcacgaccgaacttg

SEQ ID NO: 53139 - DNA, 25 bp, Homo sapien
ctaagatagggcatgaccgaacttg

SEQ ID NO: 53140 - DNA, 25 bp, Homo sapien
ctaagatatagggttcaaaggagtg

SEQ ID NO: 53141 - DNA, 25 bp, Homo sapien
ctaagatattcaactctcaacatta

SEQ ID NO: 53142 - DNA, 25 bp, Homo sapien
ctaagatattcagctctcaacatta

SEQ ID NO: 53143 - DNA, 25 bp, Homo sapien
ctaagatccatatgccaaatctgga

SEQ ID NO: 53144 - DNA, 25 bp, Homo sapien
ctaagatccctatgccaaatctgga

SEQ ID NO: 53145 - DNA, 25 bp, Homo sapien
ctaagcaaaattccctaagttttcc

SEQ ID NO: 53146 - DNA, 25 bp, Homo sapien
ctaagcaacattccctaagttttcc

SEQ ID NO: 53147 - DNA, 25 bp, Homo sapien
ctaagcaagatgatttcgggaatga

SEQ ID NO: 53148 - DNA, 25 bp, Homo sapien
ctaagcaagatgattttgggaatga

SEQ ID NO: 53149 - DNA, 25 bp, Homo sapien
ctaagcaatccattaaacttctcct

SEQ ID NO: 53150 - DNA, 25 bp, Homo sapien
ctaagcaatccattaatcttctcct

SEQ ID NO: 53151 - DNA, 25 bp, Homo sapien
ctaagcacgtattctcctgcaacaa

SEQ ID NO: 53152 - DNA, 25 bp, Homo sapien
ctaagcacgtattctcttgcaacaa

SEQ ID NO: 53153 - DNA, 25 bp, Homo sapien
ctaagcagaaccagaaagtaaaaca

SEQ ID NO: 53154 - DNA, 25 bp, Homo sapien
ctaagcagaaccggaaagtaaaaca

SEQ ID NO: 53155 - DNA, 25 bp, Homo sapien
ctaagcataaagctgttatcagacc

SEQ ID NO: 53156 - DNA, 25 bp, Homo sapien
ctaagcatgaaaatgatttagtagc

SEQ ID NO: 53157 - DNA, 25 bp, Homo sapien
ctaagcatgaaactgatttagtagc

SEQ ID NO: 53158 - DNA, 25 bp, Homo sapien
ctaagcatgttttgacctgattttc

SEQ ID NO: 53159 - DNA, 25 bp, Homo sapien
ctaagcatgtttttacctgattttc

SEQ ID NO: 53160 - DNA, 25 bp, Homo sapien
ctaagcattaagctgttatcagacc

SEQ ID NO: 53161 - DNA, 25 bp, Homo sapien
ctaagcatttggcttgtttgaagac

SEQ ID NO: 53162 - DNA, 25 bp, Homo sapien
ctaagcatttggtttgtttgaagac

SEQ ID NO: 53163 - DNA, 25 bp, Homo sapien
ctaagctaatgctatctcgctccat

SEQ ID NO: 53164 - DNA, 25 bp, Homo sapien
ctaagctagtgctatctcgctccat

SEQ ID NO: 53165 - DNA, 25 bp, Homo sapien
ctaagctggctaagctggtgagtga

SEQ ID NO: 53166 - DNA, 25 bp, Homo sapien
ctaagctggctaatctggtgagtga

SEQ ID NO: 53167 - DNA, 25 bp, Homo sapien
ctaagctgttaattgatgtgaacat

SEQ ID NO: 53168 - DNA, 25 bp, Homo sapien
ctaagctgttatttgatgtgaacat

SEQ ID NO: 53169 - DNA, 25 bp, Homo sapien
ctaagcttccctcagaacattgcac

SEQ ID NO: 53170 - DNA, 25 bp, Homo sapien
ctaagcttccctcataacattgcac

SEQ ID NO: 53171 - DNA, 25 bp, Homo sapien
ctaaggaaaacacgaattccgaaat

SEQ ID NO: 53172 - DNA, 25 bp, Homo sapien
ctaaggaaaacatgaattccgaaat

SEQ ID NO: 53173 - DNA, 25 bp, Homo sapien
ctaaggacaccaggctctgttatcc

SEQ ID NO: 53174 - DNA, 25 bp, Homo sapien
ctaaggacgccaggctctgttatcc

SEQ ID NO: 53175 - DNA, 25 bp, Homo sapien
ctaaggaggattaggtcaaaaccaa

SEQ ID NO: 53176 - DNA, 25 bp, Homo sapien
ctaaggaggattaggttaaaaccaa

SEQ ID NO: 53177 - DNA, 25 bp, Homo sapien
ctaaggctcggcatcctttaacctg

SEQ ID NO: 53178 - DNA, 25 bp, Homo sapien
ctaaggctcggcgtcctttaacctg

SEQ ID NO: 53179 - DNA, 25 bp, Homo sapien
ctaaggctcttgctggaaaccataa

SEQ ID NO: 53180 - DNA, 25 bp, Homo sapien
ctaaggctcttgttggaaaccataa

SEQ ID NO: 53181 - DNA, 25 bp, Homo sapien
ctaaggctgccataaaaaatcacca

SEQ ID NO: 53182 - DNA, 25 bp, Homo sapien
ctaaggctgccgtaaaaaatcacca

SEQ ID NO: 53183 - DNA, 25 bp, Homo sapien
ctaaggcttgtagacaggataactc

SEQ ID NO: 53184 - DNA, 25 bp, Homo sapien
ctaaggcttgtagataggataactc

SEQ ID NO: 53185 - DNA, 25 bp, Homo sapien
ctaagggcacactggtttctggaaa

SEQ ID NO: 53186 - DNA, 25 bp, Homo sapien
ctaagggcacattggtttctggaaa

SEQ ID NO: 53187 - DNA, 25 bp, Homo sapien
ctaaggggaataacggcctggcttt

SEQ ID NO: 53188 - DNA, 25 bp, Homo sapien
ctaaggggaataagggcctggcttt

SEQ ID NO: 53189 - DNA, 25 bp, Homo sapien
ctaaggtacagtaacaacatgcctc

SEQ ID NO: 53190 - DNA, 25 bp, Homo sapien
ctaaggtacggtaacaacatgcctc

SEQ ID NO: 53191 - DNA, 25 bp, Homo sapien
ctaagtaagaatgaatatagtccat

SEQ ID NO: 53192 - DNA, 25 bp, Homo sapien
ctaagtaagaatgcatatagtccat

SEQ ID NO: 53193 - DNA, 25 bp, Homo sapien
ctaagtactattcccacgacaaaac

SEQ ID NO: 53194 - DNA, 25 bp, Homo sapien
ctaagtactattcccaggacaaaac

SEQ ID NO: 53195 - DNA, 25 bp, Homo sapien
ctaagtatgcagagaaaggaaatgt

SEQ ID NO: 53196 - DNA, 25 bp, Homo sapien
ctaagtatgcagcgaaaggaaatgt

SEQ ID NO: 53197 - DNA, 25 bp, Homo sapien
ctaagtcactacggcacacaggaaa

SEQ ID NO: 53198 - DNA, 25 bp, Homo sapien
ctaagtcactatggcacacaggaaa

SEQ ID NO: 53199 - DNA, 25 bp, Homo sapien
ctaagtcacttatctgagtcagccc

SEQ ID NO: 53200 - DNA, 25 bp, Homo sapien
ctaagtcacttctctgagtcagccc

SEQ ID NO: 53201 - DNA, 25 bp, Homo sapien
ctaagtcagaccaaggctggcccat

SEQ ID NO: 53202 - DNA, 25 bp, Homo sapien
ctaagtcagaccgaggctggcccat

SEQ ID NO: 53203 - DNA, 25 bp, Homo sapien
ctaagtcagagtttcagctgtaaga

SEQ ID NO: 53204 - DNA, 25 bp, Homo sapien
ctaagtcagtgtttcagctgtaaga

SEQ ID NO: 53205 - DNA, 25 bp, Homo sapien
ctaagtctaatagttcctactgcca

SEQ ID NO: 53206 - DNA, 25 bp, Homo sapien
ctaagtctaatggttcctactgcca

SEQ ID NO: 53207 - DNA, 25 bp, Homo sapien
ctaagtctaggtgttcaaaccaact

SEQ ID NO: 53208 - DNA, 25 bp, Homo sapien
ctaagtctaggtgttcgaaccaact

SEQ ID NO: 53209 - DNA, 25 bp, Homo sapien
ctaagtctctccctatgtgtcagcc

SEQ ID NO: 53210 - DNA, 25 bp, Homo sapien
ctaagtctctccctgtgtgtcagcc

SEQ ID NO: 53211 - DNA, 25 bp, Homo sapien
ctaagtgaaccctcaaacacaaaac

SEQ ID NO: 53212 - DNA, 25 bp, Homo sapien
ctaagtgaaccctcaagcacaaaac

SEQ ID NO: 53213 - DNA, 25 bp, Homo sapien
ctaagtgagctcttaggatgtctga

SEQ ID NO: 53214 - DNA, 25 bp, Homo sapien
ctaagtgagcttttaggatgtctga

SEQ ID NO: 53215 - DNA, 25 bp, Homo sapien
ctaagtgctgcaaaaacactggaca

SEQ ID NO: 53216 - DNA, 25 bp, Homo sapien
ctaagtgctgcgaaaacactggaca

SEQ ID NO: 53217 - DNA, 25 bp, Homo sapien
ctaagtggatagaaaagacatgcat

SEQ ID NO: 53218 - DNA, 25 bp, Homo sapien
ctaagtggtaaaatcttgatttctt

SEQ ID NO: 53219 - DNA, 25 bp, Homo sapien
ctaagtggtaagatcttgatttctt

SEQ ID NO: 53220 - DNA, 25 bp, Homo sapien
ctaagtggttagaaaagacatgcat

SEQ ID NO: 53221 - DNA, 25 bp, Homo sapien
ctaagtgtaacaagtagtgtgctga

SEQ ID NO: 53222 - DNA, 25 bp, Homo sapien
ctaagtgtaacaggtagtgtgctga

SEQ ID NO: 53223 - DNA, 25 bp, Homo sapien
ctaagtgtccaacatgcattctctc

SEQ ID NO: 53224 - DNA, 25 bp, Homo sapien
ctaagtgtccaacgtgcattctctc

SEQ ID NO: 53225 - DNA, 25 bp, Homo sapien
ctaagttaacagacattcacaaagc

SEQ ID NO: 53226 - DNA, 25 bp, Homo sapien
ctaagttaacaggcattcacaaagc

SEQ ID NO: 53227 - DNA, 25 bp, Homo sapien
ctaagttgaaaatatgatcaatcca

SEQ ID NO: 53228 - DNA, 25 bp, Homo sapien
ctaagttgaaaatatggtcaatcca

SEQ ID NO: 53229 - DNA, 25 bp, Homo sapien
ctaagttttgaacagaatctaagtg

SEQ ID NO: 53230 - DNA, 25 bp, Homo sapien
ctaagttttgaatagaatctaagtg

SEQ ID NO: 53231 - DNA, 25 bp, Homo sapien
ctaataaagaagataatagagaagc

SEQ ID NO: 53232 - DNA, 25 bp, Homo sapien
ctaataaagaaggtaatagagaagc

SEQ ID NO: 53233 - DNA, 25 bp, Homo sapien
ctaataatacacagagtggaaaaaa

SEQ ID NO: 53234 - DNA, 25 bp, Homo sapien
ctaataatatacagagtggaaaaaa

SEQ ID NO: 53235 - DNA, 25 bp, Homo sapien
ctaatacacggatcttgacgaagtg

SEQ ID NO: 53236 - DNA, 25 bp, Homo sapien
ctaatacagccacctgctaaaggag

SEQ ID NO: 53237 - DNA, 25 bp, Homo sapien
ctaatacagccatctgctaaaggag

SEQ ID NO: 53238 - DNA, 25 bp, Homo sapien
ctaatacatggatcttgacgaagtg

SEQ ID NO: 53239 - DNA, 25 bp, Homo sapien
ctaataccaaccatactcaaactac

SEQ ID NO: 53240 - DNA, 25 bp, Homo sapien
ctaataccaaccgtactcaaactac

SEQ ID NO: 53241 - DNA, 25 bp, Homo sapien
ctaataccgctgaaccaactcattc

SEQ ID NO: 53242 - DNA, 25 bp, Homo sapien
ctaataccgctgaatcaactcattc

SEQ ID NO: 53243 - DNA, 25 bp, Homo sapien
ctaatactcaaatgctcgtaagaat

SEQ ID NO: 53244 - DNA, 25 bp, Homo sapien
ctaatactcaaatgcttgtaagaat

SEQ ID NO: 53245 - DNA, 25 bp, Homo sapien
ctaatactctacggactgaaacaca

SEQ ID NO: 53246 - DNA, 25 bp, Homo sapien
ctaatactctatggactgaaacaca

SEQ ID NO: 53247 - DNA, 25 bp, Homo sapien
ctaatagaaaaaaagccaaacagga

SEQ ID NO: 53248 - DNA, 25 bp, Homo sapien
ctaatagagaaaaagccaaacagga

SEQ ID NO: 53249 - DNA, 25 bp, Homo sapien
ctaatagccatggcatattgtagtc

SEQ ID NO: 53250 - DNA, 25 bp, Homo sapien
ctaatagccatggcgtattgtagtc

SEQ ID NO: 53251 - DNA, 25 bp, Homo sapien
ctaatagccgtataaaggagttggg

SEQ ID NO: 53252 - DNA, 25 bp, Homo sapien
ctaatagccgtatgaaggagttggg

SEQ ID NO: 53253 - DNA, 25 bp, Homo sapien
ctaatagtaaagtcggagttctttg

SEQ ID NO: 53254 - DNA, 25 bp, Homo sapien
ctaatagtaaagttggagttctttg

SEQ ID NO: 53255 - DNA, 25 bp, Homo sapien
ctaatagtgaaaatatgacttgatg

SEQ ID NO: 53256 - DNA, 25 bp, Homo sapien
ctaatagtggaaatatgacttgatg

SEQ ID NO: 53257 - DNA, 25 bp, Homo sapien
ctaatatacattcctaccatctgtg

SEQ ID NO: 53258 - DNA, 25 bp, Homo sapien
ctaatatacattcctagcatctgtg

SEQ ID NO: 53259 - DNA, 25 bp, Homo sapien
ctaatatattccaatgcaatcctag

SEQ ID NO: 53260 - DNA, 25 bp, Homo sapien
ctaatatattccagtgcaatcctag

SEQ ID NO: 53261 - DNA, 25 bp, Homo sapien
ctaatatcacaaagagatgttctta

SEQ ID NO: 53262 - DNA, 25 bp, Homo sapien
ctaatatcacagagagatgttctta

SEQ ID NO: 53263 - DNA, 25 bp, Homo sapien
ctaatatcagttataaggactagat

SEQ ID NO: 53264 - DNA, 25 bp, Homo sapien
ctaatatcagttttaaggactagat

SEQ ID NO: 53265 - DNA, 25 bp, Homo sapien
ctaatatcatgaaactgattttgca

SEQ ID NO: 53266 - DNA, 25 bp, Homo sapien
ctaatatcgtgaaactgattttgca

SEQ ID NO: 53267 - DNA, 25 bp, Homo sapien
ctaatatggtcaactcttataaaag

SEQ ID NO: 53268 - DNA, 25 bp, Homo sapien
ctaatatgttcaactcttataaaag

SEQ ID NO: 53269 - DNA, 25 bp, Homo sapien
ctaatcactattggaaagggcctcc

SEQ ID NO: 53270 - DNA, 25 bp, Homo sapien
ctaatcactattggcaagggcctcc

SEQ ID NO: 53271 - DNA, 25 bp, Homo sapien
ctaatcatatttacagatacatcga

SEQ ID NO: 53272 - DNA, 25 bp, Homo sapien
ctaatcatatttacggatacatcga

SEQ ID NO: 53273 - DNA, 25 bp, Homo sapien
ctaatcatcaattaaatgaatcgct

SEQ ID NO: 53274 - DNA, 25 bp, Homo sapien
ctaatcatcaattgaatgaatcgct

SEQ ID NO: 53275 - DNA, 25 bp, Homo sapien
ctaatccactgaaaatacaaaccaa

SEQ ID NO: 53276 - DNA, 25 bp, Homo sapien
ctaatccactgagaatacaaaccaa

SEQ ID NO: 53277 - DNA, 25 bp, Homo sapien
ctaatccagaaagagacctgaaggt

SEQ ID NO: 53278 - DNA, 25 bp, Homo sapien
ctaatccagaaagagagctgaaggt

SEQ ID NO: 53279 - DNA, 25 bp, Homo sapien
ctaatccattgaccgatggcccaga

SEQ ID NO: 53280 - DNA, 25 bp, Homo sapien
ctaatccattgactgatggcccaga

SEQ ID NO: 53281 - DNA, 25 bp, Homo sapien
ctaatcccattcataagggcagagt

SEQ ID NO: 53282 - DNA, 25 bp, Homo sapien
ctaatcccattctagctacatataa

SEQ ID NO: 53283 - DNA, 25 bp, Homo sapien
ctaatcccattcttaagggcagagt

SEQ ID NO: 53284 - DNA, 25 bp, Homo sapien
ctaatccctttctagctacatataa

SEQ ID NO: 53285 - DNA, 25 bp, Homo sapien
ctaatcctacatttattttgttata

SEQ ID NO: 53286 - DNA, 25 bp, Homo sapien
ctaatcctacatttgttttgttata

SEQ ID NO: 53287 - DNA, 25 bp, Homo sapien
ctaatcctcgttattggcacattga

SEQ ID NO: 53288 - DNA, 25 bp, Homo sapien
ctaatccttgttattggcacattga

SEQ ID NO: 53289 - DNA, 25 bp, Homo sapien
ctaatcgggacaattgtgaaagtct

SEQ ID NO: 53290 - DNA, 25 bp, Homo sapien
ctaatcgggacagttgtgaaagtct

SEQ ID NO: 53291 - DNA, 25 bp, Homo sapien
ctaatctaactggcttcgtattgca

SEQ ID NO: 53292 - DNA, 25 bp, Homo sapien
ctaatctaactggctttgtattgca

SEQ ID NO: 53293 - DNA, 25 bp, Homo sapien
ctaatctaagtcagccatctgagct

SEQ ID NO: 53294 - DNA, 25 bp, Homo sapien
ctaatctatgtcagccatctgagct

SEQ ID NO: 53295 - DNA, 25 bp, Homo sapien
ctaatcttacaaaaacagaacctct

SEQ ID NO: 53296 - DNA, 25 bp, Homo sapien
ctaatcttacaacaacagaacctct

SEQ ID NO: 53297 - DNA, 25 bp, Homo sapien
ctaatcttcattgtgaaaacctggt

SEQ ID NO: 53298 - DNA, 25 bp, Homo sapien
ctaatcttcgttgtgaaaacctggt

SEQ ID NO: 53299 - DNA, 25 bp, Homo sapien
ctaatcttctgtagtactgccttga

SEQ ID NO: 53300 - DNA, 25 bp, Homo sapien
ctaatcttctgtagtagtgccttga

SEQ ID NO: 53301 - DNA, 25 bp, Homo sapien
ctaatcttggtattgttcatcaatt

SEQ ID NO: 53302 - DNA, 25 bp, Homo sapien
ctaatcttggtatttttcatcaatt

SEQ ID NO: 53303 - DNA, 25 bp, Homo sapien
ctaatctttttgatcctccaattcc

SEQ ID NO: 53304 - DNA, 25 bp, Homo sapien
ctaatcttttttatcctccaattcc

SEQ ID NO: 53305 - DNA, 25 bp, Homo sapien
ctaatgaaagatatgttgacttact

SEQ ID NO: 53306 - DNA, 25 bp, Homo sapien
ctaatgaaatacataactgcctggt

SEQ ID NO: 53307 - DNA, 25 bp, Homo sapien
ctaatgaaatacgtaactgcctggt

SEQ ID NO: 53308 - DNA, 25 bp, Homo sapien
ctaatgaaggatatgttgacttact

SEQ ID NO: 53309 - DNA, 25 bp, Homo sapien
ctaatgaatgtacgggttagcaggg

SEQ ID NO: 53310 - DNA, 25 bp, Homo sapien
ctaatgaatgtatgggttagcaggg

SEQ ID NO: 53311 - DNA, 25 bp, Homo sapien
ctaatgaatgtccaaagtattcaat

SEQ ID NO: 53312 - DNA, 25 bp, Homo sapien
ctaatgaatgtccgaagtattcaat

SEQ ID NO: 53313 - DNA, 25 bp, Homo sapien
ctaatgaattccctttcttcttgtt

SEQ ID NO: 53314 - DNA, 25 bp, Homo sapien
ctaatgaattctctttcttcttgtt

SEQ ID NO: 53315 - DNA, 25 bp, Homo sapien
ctaatgagactacaaacaatccagc

SEQ ID NO: 53316 - DNA, 25 bp, Homo sapien
ctaatgagactacacacaatccagc

SEQ ID NO: 53317 - DNA, 25 bp, Homo sapien
ctaatgagtctaagctgaatctagt

SEQ ID NO: 53318 - DNA, 25 bp, Homo sapien
ctaatgagtctaaggtgaatctagt

SEQ ID NO: 53319 - DNA, 25 bp, Homo sapien
ctaatgattggatataggttgaggg

SEQ ID NO: 53320 - DNA, 25 bp, Homo sapien
ctaatgattggatgtaggttgaggg

SEQ ID NO: 53321 - DNA, 25 bp, Homo sapien
ctaatgcacccatgcttctaaagga

SEQ ID NO: 53322 - DNA, 25 bp, Homo sapien
ctaatgcacgcatgcttctaaagga

SEQ ID NO: 53323 - DNA, 25 bp, Homo sapien
ctaatgctatgcttctattttggtc

SEQ ID NO: 53324 - DNA, 25 bp, Homo sapien
ctaatgctgtgcttctattttggtc

SEQ ID NO: 53325 - DNA, 25 bp, Homo sapien
ctaatgggcaaatctgcagataact

SEQ ID NO: 53326 - DNA, 25 bp, Homo sapien
ctaatgggcaaatctgtagataact

SEQ ID NO: 53327 - DNA, 25 bp, Homo sapien
ctaatgtagctccatctttaatgat

SEQ ID NO: 53328 - DNA, 25 bp, Homo sapien
ctaatgtagctccttctttaatgat

SEQ ID NO: 53329 - DNA, 25 bp, Homo sapien
ctaatgtagctgctgactttaaatt

SEQ ID NO: 53330 - DNA, 25 bp, Homo sapien
ctaatgtagctgctgattttaaatt

SEQ ID NO: 53331 - DNA, 25 bp, Homo sapien
ctaatgtgacatttgtttggtaata

SEQ ID NO: 53332 - DNA, 25 bp, Homo sapien
ctaatgtggcatttgtttggtaata

SEQ ID NO: 53333 - DNA, 25 bp, Homo sapien
ctaatgtttattatataccagatgt

SEQ ID NO: 53334 - DNA, 25 bp, Homo sapien
ctaatgtttattgtataccagatgt

SEQ ID NO: 53335 - DNA, 25 bp, Homo sapien
ctaattaaaggcttgaccctgggaa

SEQ ID NO: 53336 - DNA, 25 bp, Homo sapien
ctaattaaaggcttgatcctgggaa

SEQ ID NO: 53337 - DNA, 25 bp, Homo sapien
ctaattatacgaagtcctttgaaat

SEQ ID NO: 53338 - DNA, 25 bp, Homo sapien
ctaattatatgaagtcctttgaaat

SEQ ID NO: 53339 - DNA, 25 bp, Homo sapien
ctaattatcacataaatcttttggt

SEQ ID NO: 53340 - DNA, 25 bp, Homo sapien
ctaattatctcataaatcttttggt

SEQ ID NO: 53341 - DNA, 25 bp, Homo sapien
ctaattcaaagctgtagtttttgtg

SEQ ID NO: 53342 - DNA, 25 bp, Homo sapien
ctaattcaaagttgtagtttttgtg

SEQ ID NO: 53343 - DNA, 25 bp, Homo sapien
ctaattcaactaatccctaaccttt

SEQ ID NO: 53344 - DNA, 25 bp, Homo sapien
ctaattcaactagtccctaaccttt

SEQ ID NO: 53345 - DNA, 25 bp, Homo sapien
ctaattcaatcagatatccttagaa

SEQ ID NO: 53346 - DNA, 25 bp, Homo sapien
ctaattcaatcaggtatccttagaa

SEQ ID NO: 53347 - DNA, 25 bp, Homo sapien
ctaattctatgaagtcagtcacttt

SEQ ID NO: 53348 - DNA, 25 bp, Homo sapien
ctaattctatgaggtcagtcacttt

SEQ ID NO: 53349 - DNA, 25 bp, Homo sapien
ctaattctcgtcaggccagtcactt

SEQ ID NO: 53350 - DNA, 25 bp, Homo sapien
ctaattctcgtcgggccagtcactt

SEQ ID NO: 53351 - DNA, 25 bp, Homo sapien
ctaattcttgtcaggccagtcactt

SEQ ID NO: 53352 - DNA, 25 bp, Homo sapien
ctaattgagaggccctctgaatact

SEQ ID NO: 53353 - DNA, 25 bp, Homo sapien
ctaattgagaggctctctgaatact

SEQ ID NO: 53354 - DNA, 25 bp, Homo sapien
ctaattgctataacgaatctaaagt

SEQ ID NO: 53355 - DNA, 25 bp, Homo sapien
ctaattgctataatgaatctaaagt

SEQ ID NO: 53356 - DNA, 25 bp, Homo sapien
ctaattggaaacaggaaggagcacc

SEQ ID NO: 53357 - DNA, 25 bp, Homo sapien
ctaattggaaagaggaaggagcacc

SEQ ID NO: 53358 - DNA, 25 bp, Homo sapien
ctaattggagcctcttaaattgaag

SEQ ID NO: 53359 - DNA, 25 bp, Homo sapien
ctaattggagcttcttaaattgaag

SEQ ID NO: 53360 - DNA, 25 bp, Homo sapien
ctaattggcataccttttattttgt

SEQ ID NO: 53361 - DNA, 25 bp, Homo sapien
ctaattggcatactttttattttgt

SEQ ID NO: 53362 - DNA, 25 bp, Homo sapien
ctaattgggccagactcttcctatg

SEQ ID NO: 53363 - DNA, 25 bp, Homo sapien
ctaattgggccagacttttcctatg

SEQ ID NO: 53364 - DNA, 25 bp, Homo sapien
ctaatttatattgcacttacaacac

SEQ ID NO: 53365 - DNA, 25 bp, Homo sapien
ctaatttatgttgcacttacaacac

SEQ ID NO: 53366 - DNA, 25 bp, Homo sapien
ctaatttcaatctaagttagccatt

SEQ ID NO: 53367 - DNA, 25 bp, Homo sapien
ctaatttcaatgtaagttagccatt

SEQ ID NO: 53368 - DNA, 25 bp, Homo sapien
ctaatttcattgaaagtctcctcca

SEQ ID NO: 53369 - DNA, 25 bp, Homo sapien
ctaatttcattggaagtctcctcca

SEQ ID NO: 53370 - DNA, 25 bp, Homo sapien
ctaatttcgccgattcattaaaata

SEQ ID NO: 53371 - DNA, 25 bp, Homo sapien
ctaatttcgccgattcgttaaaata

SEQ ID NO: 53372 - DNA, 25 bp, Homo sapien
ctaatttctatccatctttgcttca

SEQ ID NO: 53373 - DNA, 25 bp, Homo sapien
ctaatttctatccgtctttgcttca

SEQ ID NO: 53374 - DNA, 25 bp, Homo sapien
ctaatttgcgccaaaatctctgacc

SEQ ID NO: 53375 - DNA, 25 bp, Homo sapien
ctaatttgggccaaaatctctgacc

SEQ ID NO: 53376 - DNA, 25 bp, Homo sapien
ctaattttaagcgatctacagtctg

SEQ ID NO: 53377 - DNA, 25 bp, Homo sapien
ctaattttaagtgatctacagtctg

SEQ ID NO: 53378 - DNA, 25 bp, Homo sapien
ctaattttatccacatcattctcct

SEQ ID NO: 53379 - DNA, 25 bp, Homo sapien
ctaattttatccgcatcattctcct

SEQ ID NO: 53380 - DNA, 25 bp, Homo sapien
ctaattttcacaatagtttgttcac

SEQ ID NO: 53381 - DNA, 25 bp, Homo sapien
ctaattttgcaccggagaaaatggg

SEQ ID NO: 53382 - DNA, 25 bp, Homo sapien
ctaattttgcacgggagaaaatggg

SEQ ID NO: 53383 - DNA, 25 bp, Homo sapien
ctaattttgtccagacctagaaacc

SEQ ID NO: 53384 - DNA, 25 bp, Homo sapien
ctaatttttacaatagtttgttcac

SEQ ID NO: 53385 - DNA, 25 bp, Homo sapien
ctaattttttccagacctagaaacc

SEQ ID NO: 53386 - DNA, 25 bp, Homo sapien
ctacaaaaaagaaaatagccaggca

SEQ ID NO: 53387 - DNA, 25 bp, Homo sapien
ctacaaaaaagaaaatcgccaggca

SEQ ID NO: 53388 - DNA, 25 bp, Homo sapien
ctacaaaatccagtgcaaagctgtt

SEQ ID NO: 53389 - DNA, 25 bp, Homo sapien
ctacaaaatccggtgcaaagctgtt

SEQ ID NO: 53390 - DNA, 25 bp, Homo sapien
ctacaaaattgacgaattccttcac

SEQ ID NO: 53391 - DNA, 25 bp, Homo sapien
ctacaaaattgatgaattccttcac

SEQ ID NO: 53392 - DNA, 25 bp, Homo sapien
ctacaaactaatgactaatgatatt

SEQ ID NO: 53393 - DNA, 25 bp, Homo sapien
ctacaaactgatgactaatgatatt

SEQ ID NO: 53394 - DNA, 25 bp, Homo sapien
ctacaaataaatgaataaccacata

SEQ ID NO: 53395 - DNA, 25 bp, Homo sapien
ctacaaatagatgaataaccacata

SEQ ID NO: 53396 - DNA, 25 bp, Homo sapien
ctacaaatcatgctagaaatcagtg

SEQ ID NO: 53397 - DNA, 25 bp, Homo sapien
ctacaaatcatgctaggaatcagtg

SEQ ID NO: 53398 - DNA, 25 bp, Homo sapien
ctacaaatgcctccgcataccagac

SEQ ID NO: 53399 - DNA, 25 bp, Homo sapien
ctacaaatgcctctgcataccagac

SEQ ID NO: 53400 - DNA, 25 bp, Homo sapien
ctacaaattgcccagggaaggtatt

SEQ ID NO: 53401 - DNA, 25 bp, Homo sapien
ctacaaattgctcagggaaggtatt

SEQ ID NO: 53402 - DNA, 25 bp, Homo sapien
ctacaacaacttaaagagattgaca

SEQ ID NO: 53403 - DNA, 25 bp, Homo sapien
ctacaacaatttaaagagattgaca

SEQ ID NO: 53404 - DNA, 25 bp, Homo sapien
ctacaaccatgcaaaactggcactg

SEQ ID NO: 53405 - DNA, 25 bp, Homo sapien
ctacaaccatgcaaaattggcactg

SEQ ID NO: 53406 - DNA, 25 bp, Homo sapien
ctacaacgtggatcaatcttggaaa

SEQ ID NO: 53407 - DNA, 25 bp, Homo sapien
ctacaacgtggatgaatcttggaaa

SEQ ID NO: 53408 - DNA, 25 bp, Homo sapien
ctacaactagacctggttggatcag

SEQ ID NO: 53409 - DNA, 25 bp, Homo sapien
ctacaactagagctggttggatcag

SEQ ID NO: 53410 - DNA, 25 bp, Homo sapien
ctacaacttaccatatcttccttcc

SEQ ID NO: 53411 - DNA, 25 bp, Homo sapien
ctacaacttacgatatcttccttcc

SEQ ID NO: 53412 - DNA, 25 bp, Homo sapien
ctacaagaaattatgaagctatttc

SEQ ID NO: 53413 - DNA, 25 bp, Homo sapien
ctacaagaaattttgaagctatttc

SEQ ID NO: 53414 - DNA, 25 bp, Homo sapien
ctacaagaacttcattttatgcatc

SEQ ID NO: 53415 - DNA, 25 bp, Homo sapien
ctacaagagcttcattttatgcatc

SEQ ID NO: 53416 - DNA, 25 bp, Homo sapien
ctacaagagtacttaacacatgcat

SEQ ID NO: 53417 - DNA, 25 bp, Homo sapien
ctacaagagtacttgacacatgcat

SEQ ID NO: 53418 - DNA, 25 bp, Homo sapien
ctacaagctaggaagcaagccctcc

SEQ ID NO: 53419 - DNA, 25 bp, Homo sapien
ctacaagctaggaagcgagccctcc

SEQ ID NO: 53420 - DNA, 25 bp, Homo sapien
ctacaaggacaattctttgccttta

SEQ ID NO: 53421 - DNA, 25 bp, Homo sapien
ctacaaggacagttctttgccttta

SEQ ID NO: 53422 - DNA, 25 bp, Homo sapien
ctacaagtgttaaaatatacctaca

SEQ ID NO: 53423 - DNA, 25 bp, Homo sapien
ctacaagtgttaaaatgtacctaca

SEQ ID NO: 53424 - DNA, 25 bp, Homo sapien
ctacaatcaacagaataatgtagtt

SEQ ID NO: 53425 - DNA, 25 bp, Homo sapien
ctacaatcaacggaataatgtagtt

SEQ ID NO: 53426 - DNA, 25 bp, Homo sapien
ctacaatgaaatatctatgcaaatc

SEQ ID NO: 53427 - DNA, 25 bp, Homo sapien
ctacaatgaaatgtctatgcaaatc

SEQ ID NO: 53428 - DNA, 25 bp, Homo sapien
ctacaatgtctacagatgccagaac

SEQ ID NO: 53429 - DNA, 25 bp, Homo sapien
ctacaatgtctacggatgccagaac

SEQ ID NO: 53430 - DNA, 25 bp, Homo sapien
ctacacaccgtcaaattaaggctca

SEQ ID NO: 53431 - DNA, 25 bp, Homo sapien
ctacacactgtcaaattaaggctca

SEQ ID NO: 53432 - DNA, 25 bp, Homo sapien
ctacacagaggatcatgtcatctac

SEQ ID NO: 53433 - DNA, 25 bp, Homo sapien
ctacacagaggatcgtgtcatctac

SEQ ID NO: 53434 - DNA, 25 bp, Homo sapien
ctacacagagtgaaggagaaagact

SEQ ID NO: 53435 - DNA, 25 bp, Homo sapien
ctacacagccattaaacatgaacct

SEQ ID NO: 53436 - DNA, 25 bp, Homo sapien
ctacacagccattagacatgaacct

SEQ ID NO: 53437 - DNA, 25 bp, Homo sapien
ctacacaggcccttccatacgagtc

SEQ ID NO: 53438 - DNA, 25 bp, Homo sapien
ctacacaggcccttccgtacgagtc

SEQ ID NO: 53439 - DNA, 25 bp, Homo sapien
ctacacagggtgaaggagaaagact

SEQ ID NO: 53440 - DNA, 25 bp, Homo sapien
ctacacatacacacaagagacatgc

SEQ ID NO: 53441 - DNA, 25 bp, Homo sapien
ctacacatacacccaagagacatgc

SEQ ID NO: 53442 - DNA, 25 bp, Homo sapien
ctacacatgaccgctatactatttt

SEQ ID NO: 53443 - DNA, 25 bp, Homo sapien
ctacacatgcccgctatactatttt

SEQ ID NO: 53444 - DNA, 25 bp, Homo sapien
ctacacccttcatcacatctgcaaa

SEQ ID NO: 53445 - DNA, 25 bp, Homo sapien
ctacacccttcgtcacatctgcaaa

SEQ ID NO: 53446 - DNA, 25 bp, Homo sapien
ctacaccgttgtcagaattaaattt

SEQ ID NO: 53447 - DNA, 25 bp, Homo sapien
ctacaccgttgtcggaattaaattt

SEQ ID NO: 53448 - DNA, 25 bp, Homo sapien
ctacacctacaacttatagaaactc

SEQ ID NO: 53449 - DNA, 25 bp, Homo sapien
ctacacctacatcttatagaaactc

SEQ ID NO: 53450 - DNA, 25 bp, Homo sapien
ctacactatatataccagactctgt

SEQ ID NO: 53451 - DNA, 25 bp, Homo sapien
ctacactatatgtaccagactctgt

SEQ ID NO: 53452 - DNA, 25 bp, Homo sapien
ctacactattgaaggtgctgtcatt

SEQ ID NO: 53453 - DNA, 25 bp, Homo sapien
ctacactattgaaggttctgtcatt

SEQ ID NO: 53454 - DNA, 25 bp, Homo sapien
ctacactcacttccagctctaggca

SEQ ID NO: 53455 - DNA, 25 bp, Homo sapien
ctacactcacttgcagctctaggca

SEQ ID NO: 53456 - DNA, 25 bp, Homo sapien
ctacacttagaaaaattgtgagcaa

SEQ ID NO: 53457 - DNA, 25 bp, Homo sapien
ctacacttagataaattgtgagcaa

SEQ ID NO: 53458 - DNA, 25 bp, Homo sapien
ctacagaaataattgtctctctcaa

SEQ ID NO: 53459 - DNA, 25 bp, Homo sapien
ctacagaaccacgagctaattaatg

SEQ ID NO: 53460 - DNA, 25 bp, Homo sapien
ctacagaaccatgagctaattaatg

SEQ ID NO: 53461 - DNA, 25 bp, Homo sapien
ctacagaagatgttggaagcttaga

SEQ ID NO: 53462 - DNA, 25 bp, Homo sapien
ctacagaagattttggaagcttaga

SEQ ID NO: 53463 - DNA, 25 bp, Homo sapien
ctacagaagtaattgtctctctcaa

SEQ ID NO: 53464 - DNA, 25 bp, Homo sapien
ctacagataaacagggaggaaatga

SEQ ID NO: 53465 - DNA, 25 bp, Homo sapien
ctacagataaagagggaggaaatga

SEQ ID NO: 53466 - DNA, 25 bp, Homo sapien
ctacagatggcaattttcacaaaga

SEQ ID NO: 53467 - DNA, 25 bp, Homo sapien
ctacagatggcagttttcacaaaga

SEQ ID NO: 53468 - DNA, 25 bp, Homo sapien
ctacagcagccaaacccagacagag

SEQ ID NO: 53469 - DNA, 25 bp, Homo sapien
ctacagcagccaaaccgagacagag

SEQ ID NO: 53470 - DNA, 25 bp, Homo sapien
ctacagccccttagatttcgttgca

SEQ ID NO: 53471 - DNA, 25 bp, Homo sapien
ctacagccccttaggtttcgttgca

SEQ ID NO: 53472 - DNA, 25 bp, Homo sapien
ctacaggcaacatatcacataattg

SEQ ID NO: 53473 - DNA, 25 bp, Homo sapien
ctacaggcaacatatcccataattg

SEQ ID NO: 53474 - DNA, 25 bp, Homo sapien
ctacaggcaacatgttacatatagt

SEQ ID NO: 53475 - DNA, 25 bp, Homo sapien
ctacaggcaacgtgttacatatagt

SEQ ID NO: 53476 - DNA, 25 bp, Homo sapien
ctacaggccggcgagctgggggatg

SEQ ID NO: 53477 - DNA, 25 bp, Homo sapien
ctacaggcctttaagcctctggttc

SEQ ID NO: 53478 - DNA, 25 bp, Homo sapien
ctacaggcgtttaagcctctggttc

SEQ ID NO: 53479 - DNA, 25 bp, Homo sapien
ctacaggctggcgagctgggggatg

SEQ ID NO: 53480 - DNA, 25 bp, Homo sapien
ctacaggttcacataggtcagctcc

SEQ ID NO: 53481 - DNA, 25 bp, Homo sapien
ctacaggttcacgtaggtcagctcc

SEQ ID NO: 53482 - DNA, 25 bp, Homo sapien
ctacagtgaacattgatcacaagat

SEQ ID NO: 53483 - DNA, 25 bp, Homo sapien
ctacagtgaacgttgatcacaagat

SEQ ID NO: 53484 - DNA, 25 bp, Homo sapien
ctacagtgcaagctaaaaacatact

SEQ ID NO: 53485 - DNA, 25 bp, Homo sapien
ctacagtgcgagctaaaaacatact

SEQ ID NO: 53486 - DNA, 25 bp, Homo sapien
ctacagttaacaacatacttactga

SEQ ID NO: 53487 - DNA, 25 bp, Homo sapien
ctacagttaacatcatacttactga

SEQ ID NO: 53488 - DNA, 25 bp, Homo sapien
ctacataatctgcctactatcagca

SEQ ID NO: 53489 - DNA, 25 bp, Homo sapien
ctacataatctgcttactatcagca

SEQ ID NO: 53490 - DNA, 25 bp, Homo sapien
ctacatacatgagctgtagattcta

SEQ ID NO: 53491 - DNA, 25 bp, Homo sapien
ctacatacgtgagctgtagattcta

SEQ ID NO: 53492 - DNA, 25 bp, Homo sapien
ctacatagattgttgtttcggggaa

SEQ ID NO: 53493 - DNA, 25 bp, Homo sapien
ctacatagatttttgtttcggggaa

SEQ ID NO: 53494 - DNA, 25 bp, Homo sapien
ctacatagcgtttgaaaacaaagca

SEQ ID NO: 53495 - DNA, 25 bp, Homo sapien
ctacatagtgtttgaaaacaaagca

SEQ ID NO: 53496 - DNA, 25 bp, Homo sapien
ctacatataaagcgctctggaaggt

SEQ ID NO: 53497 - DNA, 25 bp, Homo sapien
ctacatataaagtgctctggaaggt

SEQ ID NO: 53498 - DNA, 25 bp, Homo sapien
ctacatataagtcaatctgaaaagg

SEQ ID NO: 53499 - DNA, 25 bp, Homo sapien
ctacatataggtcaatctgaaaagg

SEQ ID NO: 53500 - DNA, 25 bp, Homo sapien
ctacatatcatctaattctgtttgt

SEQ ID NO: 53501 - DNA, 25 bp, Homo sapien
ctacatatcgtctaattctgtttgt

SEQ ID NO: 53502 - DNA, 25 bp, Homo sapien
ctacatatgaactacggtataacac

SEQ ID NO: 53503 - DNA, 25 bp, Homo sapien
ctacatatgaactatggtataacac

SEQ ID NO: 53504 - DNA, 25 bp, Homo sapien
ctacatatgaggctgtgtggttaag

SEQ ID NO: 53505 - DNA, 25 bp, Homo sapien
ctacatatgaggctttgtggttaag

SEQ ID NO: 53506 - DNA, 25 bp, Homo sapien
ctacatatgtgaaatccgcaaatag

SEQ ID NO: 53507 - DNA, 25 bp, Homo sapien
ctacatatgtgaaatctgcaaatag

SEQ ID NO: 53508 - DNA, 25 bp, Homo sapien
ctacatcatttaggcgtctaaaggt

SEQ ID NO: 53509 - DNA, 25 bp, Homo sapien
ctacatcatttaggtgtctaaaggt

SEQ ID NO: 53510 - DNA, 25 bp, Homo sapien
ctacatcgagtgaagtcagtgttga

SEQ ID NO: 53511 - DNA, 25 bp, Homo sapien
ctacatcgagtgaggtcagtgttga

SEQ ID NO: 53512 - DNA, 25 bp, Homo sapien
ctacatctaacccttacttgaatct

SEQ ID NO: 53513 - DNA, 25 bp, Homo sapien
ctacatctaacccttatttgaatct

SEQ ID NO: 53514 - DNA, 25 bp, Homo sapien
ctacatgcatgtccgtcagagagga

SEQ ID NO: 53515 - DNA, 25 bp, Homo sapien
ctacatgcatgtctgtcagagagga

SEQ ID NO: 53516 - DNA, 25 bp, Homo sapien
ctacatgccttgatgacactcgttt

SEQ ID NO: 53517 - DNA, 25 bp, Homo sapien
ctacatgccttgatgatactcgttt

SEQ ID NO: 53518 - DNA, 25 bp, Homo sapien
ctacatggaagatggaattaaggtt

SEQ ID NO: 53519 - DNA, 25 bp, Homo sapien
ctacatggagttaattaagcacaaa

SEQ ID NO: 53520 - DNA, 25 bp, Homo sapien
ctacatggagttaattgagcacaaa

SEQ ID NO: 53521 - DNA, 25 bp, Homo sapien
ctacatggcagatggaattaaggtt

SEQ ID NO: 53522 - DNA, 25 bp, Homo sapien
ctacatgtgcatgttggatgtgtgt

SEQ ID NO: 53523 - DNA, 25 bp, Homo sapien
ctacatgtgtatgttggatgtgtgt

SEQ ID NO: 53524 - DNA, 25 bp, Homo sapien
ctacatgttgatccataaaaaatct

SEQ ID NO: 53525 - DNA, 25 bp, Homo sapien
ctacatgttgatccgtaaaaaatct

SEQ ID NO: 53526 - DNA, 25 bp, Homo sapien
ctacattagaattagtctacaccag

SEQ ID NO: 53527 - DNA, 25 bp, Homo sapien
ctacattagaattggtctacaccag

SEQ ID NO: 53528 - DNA, 25 bp, Homo sapien
ctacattagttagttaagcttacat

SEQ ID NO: 53529 - DNA, 25 bp, Homo sapien
ctacattagttatttaagcttacat

SEQ ID NO: 53530 - DNA, 25 bp, Homo sapien
ctacattcatccagataaaaactac

SEQ ID NO: 53531 - DNA, 25 bp, Homo sapien
ctacattcatccagctaaaaactac

SEQ ID NO: 53532 - DNA, 25 bp, Homo sapien
ctacattcattcatctaaacactcc

SEQ ID NO: 53533 - DNA, 25 bp, Homo sapien
ctacattcattcatctgaacactcc

SEQ ID NO: 53534 - DNA, 25 bp, Homo sapien
ctacattgcagtggatgagaaataa

SEQ ID NO: 53535 - DNA, 25 bp, Homo sapien
ctacattgcagtgggtgagaaataa

SEQ ID NO: 53536 - DNA, 25 bp, Homo sapien
ctacatttagaacccaaccatttct

SEQ ID NO: 53537 - DNA, 25 bp, Homo sapien
ctacatttagaacccagccatttct

SEQ ID NO: 53538 - DNA, 25 bp, Homo sapien
ctacatttattttgttatattcagt

SEQ ID NO: 53539 - DNA, 25 bp, Homo sapien
ctacatttccaacaagatataatcc

SEQ ID NO: 53540 - DNA, 25 bp, Homo sapien
ctacatttcgaacaagatataatcc

SEQ ID NO: 53541 - DNA, 25 bp, Homo sapien
ctacatttgttttgttatattcagt

SEQ ID NO: 53542 - DNA, 25 bp, Homo sapien
ctaccaaacagaatttgaagtcttt

SEQ ID NO: 53543 - DNA, 25 bp, Homo sapien
ctaccaaacagtatttgaagtcttt

SEQ ID NO: 53544 - DNA, 25 bp, Homo sapien
ctaccaatgggccgaatggggcagg

SEQ ID NO: 53545 - DNA, 25 bp, Homo sapien
ctaccaatgggctgaatggggcagg

SEQ ID NO: 53546 - DNA, 25 bp, Homo sapien
ctaccacaacgattaagtaatgaca

SEQ ID NO: 53547 - DNA, 25 bp, Homo sapien
ctaccacaaggattaagtaatgaca

SEQ ID NO: 53548 - DNA, 25 bp, Homo sapien
ctaccagacagactggaaaactctt

SEQ ID NO: 53549 - DNA, 25 bp, Homo sapien
ctaccagacagactgggaaactctt

SEQ ID NO: 53550 - DNA, 25 bp, Homo sapien
ctaccagcacccattattcttcctt

SEQ ID NO: 53551 - DNA, 25 bp, Homo sapien
ctaccagcaccctttattcttcctt

SEQ ID NO: 53552 - DNA, 25 bp, Homo sapien
ctaccagcatcaacagtagaaagat

SEQ ID NO: 53553 - DNA, 25 bp, Homo sapien
ctaccagcatcaatagtagaaagat

SEQ ID NO: 53554 - DNA, 25 bp, Homo sapien
ctaccaggtcatataactcactgtg

SEQ ID NO: 53555 - DNA, 25 bp, Homo sapien
ctaccaggtcatgtaactcactgtg

SEQ ID NO: 53556 - DNA, 25 bp, Homo sapien
ctaccagtgcatcgctaaggcttct

SEQ ID NO: 53557 - DNA, 25 bp, Homo sapien
ctaccagtgcattgctaaggcttct

SEQ ID NO: 53558 - DNA, 25 bp, Homo sapien
ctaccatactgatgatacaaaacag

SEQ ID NO: 53559 - DNA, 25 bp, Homo sapien
ctaccatactggtgatacaaaacag

SEQ ID NO: 53560 - DNA, 25 bp, Homo sapien
ctaccatgatcttcccagagatttt

SEQ ID NO: 53561 - DNA, 25 bp, Homo sapien
ctaccatgatcttcccggagatttt

SEQ ID NO: 53562 - DNA, 25 bp, Homo sapien
ctaccatgcttacagaatataaaat

SEQ ID NO: 53563 - DNA, 25 bp, Homo sapien
ctaccatgtttacagaatataaaat

SEQ ID NO: 53564 - DNA, 25 bp, Homo sapien
ctacccacaatcgattccttctcca

SEQ ID NO: 53565 - DNA, 25 bp, Homo sapien
ctacccacaattgattccttctcca

SEQ ID NO: 53566 - DNA, 25 bp, Homo sapien
ctacccatcagcagtgagttccaaa

SEQ ID NO: 53567 - DNA, 25 bp, Homo sapien
ctacccatcagctgtgagttccaaa

SEQ ID NO: 53568 - DNA, 25 bp, Homo sapien
ctacccgtgcatttatccttccaga

SEQ ID NO: 53569 - DNA, 25 bp, Homo sapien
ctacccgtgcatttattcttccaga

SEQ ID NO: 53570 - DNA, 25 bp, Homo sapien
ctaccctctgtcaataacttactaa

SEQ ID NO: 53571 - DNA, 25 bp, Homo sapien
ctaccctctgtcagtaacttactaa

SEQ ID NO: 53572 - DNA, 25 bp, Homo sapien
ctaccctggagaactttatagtcca

SEQ ID NO: 53573 - DNA, 25 bp, Homo sapien
ctaccctggagaattttatagtcca

SEQ ID NO: 53574 - DNA, 25 bp, Homo sapien
ctaccgacgtgcatcaaccagcctt

SEQ ID NO: 53575 - DNA, 25 bp, Homo sapien
ctaccgacgtgcgtcaaccagcctt

SEQ ID NO: 53576 - DNA, 25 bp, Homo sapien
ctacctaagggtaatcttctacaac

SEQ ID NO: 53577 - DNA, 25 bp, Homo sapien
ctacctaagtgtaatcttctacaac

SEQ ID NO: 53578 - DNA, 25 bp, Homo sapien
ctacctagagcttcgccctcatcac

SEQ ID NO: 53579 - DNA, 25 bp, Homo sapien
ctacctagaggtaacatcagatccc

SEQ ID NO: 53580 - DNA, 25 bp, Homo sapien
ctacctagaggtaatatcagatccc

SEQ ID NO: 53581 - DNA, 25 bp, Homo sapien
ctacctagtgcttcgccctcatcac

SEQ ID NO: 53582 - DNA, 25 bp, Homo sapien
ctacctatcagattatcagtaaaac

SEQ ID NO: 53583 - DNA, 25 bp, Homo sapien
ctacctatcagattgtcagtaaaac

SEQ ID NO: 53584 - DNA, 25 bp, Homo sapien
ctacctattattgataaactctctc

SEQ ID NO: 53585 - DNA, 25 bp, Homo sapien
ctacctatttttgataaactctctc

SEQ ID NO: 53586 - DNA, 25 bp, Homo sapien
ctacctccattcatttaccgcctta

SEQ ID NO: 53587 - DNA, 25 bp, Homo sapien
ctacctccattcatttgccgcctta

SEQ ID NO: 53588 - DNA, 25 bp, Homo sapien
ctacctctagcctcaaattttcctt

SEQ ID NO: 53589 - DNA, 25 bp, Homo sapien
ctacctctagcctcaacttttcctt

SEQ ID NO: 53590 - DNA, 25 bp, Homo sapien
ctacctctgggccgtcacccagcaa

SEQ ID NO: 53591 - DNA, 25 bp, Homo sapien
ctacctctgggctgtcacccagcaa

SEQ ID NO: 53592 - DNA, 25 bp, Homo sapien
ctacctcttctctgagcttagaatt

SEQ ID NO: 53593 - DNA, 25 bp, Homo sapien
ctacctcttctctgtgcttagaatt

SEQ ID NO: 53594 - DNA, 25 bp, Homo sapien
ctacctcttttcctccagccaacaa

SEQ ID NO: 53595 - DNA, 25 bp, Homo sapien
ctacctcttttcctccggccaacaa

SEQ ID NO: 53596 - DNA, 25 bp, Homo sapien
ctacctgaacctacgaacaccacaa

SEQ ID NO: 53597 - DNA, 25 bp, Homo sapien
ctacctgaccctacgaacaccacaa

SEQ ID NO: 53598 - DNA, 25 bp, Homo sapien
ctaccttgaatataaacagaactca

SEQ ID NO: 53599 - DNA, 25 bp, Homo sapien
ctaccttgaatataaagagaactca

SEQ ID NO: 53600 - DNA, 25 bp, Homo sapien
ctacctttcaaaataggagccaaag

SEQ ID NO: 53601 - DNA, 25 bp, Homo sapien
ctacctttcaatataggagccaaag

SEQ ID NO: 53602 - DNA, 25 bp, Homo sapien
ctacctttccaagtgtatggctctt

SEQ ID NO: 53603 - DNA, 25 bp, Homo sapien
ctacctttctcttacaaggacactg

SEQ ID NO: 53604 - DNA, 25 bp, Homo sapien
ctacctttctcttataaggacactg

SEQ ID NO: 53605 - DNA, 25 bp, Homo sapien
ctaccttttcaagtgtatggctctt

SEQ ID NO: 53606 - DNA, 25 bp, Homo sapien
ctaccttttcacatgtgtagtttta

SEQ ID NO: 53607 - DNA, 25 bp, Homo sapien
ctaccttttcatatgtgtagtttta

SEQ ID NO: 53608 - DNA, 25 bp, Homo sapien
ctacctttttttcccttaaacattg

SEQ ID NO: 53609 - DNA, 25 bp, Homo sapien
ctaccttttttttccttaaacattg

SEQ ID NO: 53610 - DNA, 25 bp, Homo sapien
ctacgaacaaaaggagaacagatgc

SEQ ID NO: 53611 - DNA, 25 bp, Homo sapien
ctacgaacgaaaggagaacagatgc

SEQ ID NO: 53612 - DNA, 25 bp, Homo sapien
ctacgaacgtttcgtctttggtggc

SEQ ID NO: 53613 - DNA, 25 bp, Homo sapien
ctacgaacgttttgtctttggtggc

SEQ ID NO: 53614 - DNA, 25 bp, Homo sapien
ctacgaggaggccatgagaagaggc

SEQ ID NO: 53615 - DNA, 25 bp, Homo sapien
ctacgaggaggccgtgagaagaggc

SEQ ID NO: 53616 - DNA, 25 bp, Homo sapien
ctacgaggcatgatccccaaattga

SEQ ID NO: 53617 - DNA, 25 bp, Homo sapien
ctacgaggcatgattcccaaattga

SEQ ID NO: 53618 - DNA, 25 bp, Homo sapien
ctacgcactgtttcgtgtaaggctt

SEQ ID NO: 53619 - DNA, 25 bp, Homo sapien
ctacgcactgttttgtgtaaggctt

SEQ ID NO: 53620 - DNA, 25 bp, Homo sapien
ctacgcagcgatgttggctccctta

SEQ ID NO: 53621 - DNA, 25 bp, Homo sapien
ctacgcagctatgttggctccctta

SEQ ID NO: 53622 - DNA, 25 bp, Homo sapien
ctacgccatgtaccgtaggatgctt

SEQ ID NO: 53623 - DNA, 25 bp, Homo sapien
ctacgccatgtaccttaggatgctt

SEQ ID NO: 53624 - DNA, 25 bp, Homo sapien
ctacgctctctgccatcccaaatat

SEQ ID NO: 53625 - DNA, 25 bp, Homo sapien
ctacgctctgtgccatcccaaatat

SEQ ID NO: 53626 - DNA, 25 bp, Homo sapien
ctacggcattttcttttttttgcca

SEQ ID NO: 53627 - DNA, 25 bp, Homo sapien
ctacggcatttttttttttttgcca

SEQ ID NO: 53628 - DNA, 25 bp, Homo sapien
ctacggtacatttctatatccatat

SEQ ID NO: 53629 - DNA, 25 bp, Homo sapien
ctacggtaggtcattaagcagccaa

SEQ ID NO: 53630 - DNA, 25 bp, Homo sapien
ctacggtaggtcgttaagcagccaa

SEQ ID NO: 53631 - DNA, 25 bp, Homo sapien
ctacggtatatttctatatccatat

SEQ ID NO: 53632 - DNA, 25 bp, Homo sapien
ctacgtggacagcaaatctagaata

SEQ ID NO: 53633 - DNA, 25 bp, Homo sapien
ctacgtggagacaaaagtgctataa

SEQ ID NO: 53634 - DNA, 25 bp, Homo sapien
ctacgtgggcagcaaatctagaata

SEQ ID NO: 53635 - DNA, 25 bp, Homo sapien
ctacgtggtgacaaaagtgctataa

SEQ ID NO: 53636 - DNA, 25 bp, Homo sapien
ctactaaaaatccgaaacaattagc

SEQ ID NO: 53637 - DNA, 25 bp, Homo sapien
ctactaaaaatctgaaacaattagc

SEQ ID NO: 53638 - DNA, 25 bp, Homo sapien
ctactaaaatcagccttttttcatt

SEQ ID NO: 53639 - DNA, 25 bp, Homo sapien
ctactaaaatcaggcttttttcatt

SEQ ID NO: 53640 - DNA, 25 bp, Homo sapien
ctactaaaattacgaaatatctctt

SEQ ID NO: 53641 - DNA, 25 bp, Homo sapien
ctactaaaattatgaaatatctctt

SEQ ID NO: 53642 - DNA, 25 bp, Homo sapien
ctactaaagttcagatagatcttac

SEQ ID NO: 53643 - DNA, 25 bp, Homo sapien
ctactaaagttcagattgatcttac

SEQ ID NO: 53644 - DNA, 25 bp, Homo sapien
ctactaacgcagtaacagtacaaag

SEQ ID NO: 53645 - DNA, 25 bp, Homo sapien
ctactaacgcagtgacagtacaaag

SEQ ID NO: 53646 - DNA, 25 bp, Homo sapien
ctactactcccatcttgctcactct

SEQ ID NO: 53647 - DNA, 25 bp, Homo sapien
ctactactcccgtcttgctcactct

SEQ ID NO: 53648 - DNA, 25 bp, Homo sapien
ctactactctaacgtttcgtattat

SEQ ID NO: 53649 - DNA, 25 bp, Homo sapien
ctactactctaatgtttcgtattat

SEQ ID NO: 53650 - DNA, 25 bp, Homo sapien
ctactactctgaatttgagaatttt

SEQ ID NO: 53651 - DNA, 25 bp, Homo sapien
ctactactttgaatttgagaatttt

SEQ ID NO: 53652 - DNA, 25 bp, Homo sapien
ctactagacagtgcttaagcataat

SEQ ID NO: 53653 - DNA, 25 bp, Homo sapien
ctactagacggtgcttaagcataat

SEQ ID NO: 53654 - DNA, 25 bp, Homo sapien
ctactagagacattgctggcatgca

SEQ ID NO: 53655 - DNA, 25 bp, Homo sapien
ctactagagacgttgctggcatgca

SEQ ID NO: 53656 - DNA, 25 bp, Homo sapien
ctactagagcagaaaagaatggtca

SEQ ID NO: 53657 - DNA, 25 bp, Homo sapien
ctactagagcagagaagaatggtca

SEQ ID NO: 53658 - DNA, 25 bp, Homo sapien
ctactagctataagagtgttctggt

SEQ ID NO: 53659 - DNA, 25 bp, Homo sapien
ctactagctgtaagagtgttctggt

SEQ ID NO: 53660 - DNA, 25 bp, Homo sapien
ctactatatgccaaatactgtgaag

SEQ ID NO: 53661 - DNA, 25 bp, Homo sapien
ctactatatgccaattactgtgaag

SEQ ID NO: 53662 - DNA, 25 bp, Homo sapien
ctactatttattacataccaactca

SEQ ID NO: 53663 - DNA, 25 bp, Homo sapien
ctactatttattacctaccaactca

SEQ ID NO: 53664 - DNA, 25 bp, Homo sapien
ctactatttttcccacataagcctc

SEQ ID NO: 53665 - DNA, 25 bp, Homo sapien
ctactatttttcgcacataagcctc

SEQ ID NO: 53666 - DNA, 25 bp, Homo sapien
ctactcaaccttctaatcatttcaa

SEQ ID NO: 53667 - DNA, 25 bp, Homo sapien
ctactcaatcttctaatcatttcaa

SEQ ID NO: 53668 - DNA, 25 bp, Homo sapien
ctactcactctgtttcatcctagtt

SEQ ID NO: 53669 - DNA, 25 bp, Homo sapien
ctactcactctgtttcttcctagtt

SEQ ID NO: 53670 - DNA, 25 bp, Homo sapien
ctactcagaatcttaccctattatg

SEQ ID NO: 53671 - DNA, 25 bp, Homo sapien
ctactcagacatacgtgaaaaggct

SEQ ID NO: 53672 - DNA, 25 bp, Homo sapien
ctactcagacataggtgaaaaggct

SEQ ID NO: 53673 - DNA, 25 bp, Homo sapien
ctactcagactcttaccctattatg

SEQ ID NO: 53674 - DNA, 25 bp, Homo sapien
ctactcagagggttgcattgcatgt

SEQ ID NO: 53675 - DNA, 25 bp, Homo sapien
ctactcagagggttgcgttgcatgt

SEQ ID NO: 53676 - DNA, 25 bp, Homo sapien
ctactcccaaaaaacagattgcaca

SEQ ID NO: 53677 - DNA, 25 bp, Homo sapien
ctactcccaaaagacagattgcaca

SEQ ID NO: 53678 - DNA, 25 bp, Homo sapien
ctactcccatcttgctcactctgct

SEQ ID NO: 53679 - DNA, 25 bp, Homo sapien
ctactcccgtcttgctcactctgct

SEQ ID NO: 53680 - DNA, 25 bp, Homo sapien
ctactccggtggccaaggcatgaaa

SEQ ID NO: 53681 - DNA, 25 bp, Homo sapien
ctactccggtggccgaggcatgaaa

SEQ ID NO: 53682 - DNA, 25 bp, Homo sapien
ctactcgtggtccctgaaatattct

SEQ ID NO: 53683 - DNA, 25 bp, Homo sapien
ctactcgttgtccctgaaatattct

SEQ ID NO: 53684 - DNA, 25 bp, Homo sapien
ctactctaaccattgatcctttact

SEQ ID NO: 53685 - DNA, 25 bp, Homo sapien
ctactctaacgtttcgtattatttt

SEQ ID NO: 53686 - DNA, 25 bp, Homo sapien
ctactctaatcattgatcctttact

SEQ ID NO: 53687 - DNA, 25 bp, Homo sapien
ctactctaatgtttcgtattatttt

SEQ ID NO: 53688 - DNA, 25 bp, Homo sapien
ctactctctagcatttataggagac

SEQ ID NO: 53689 - DNA, 25 bp, Homo sapien
ctactctctagcgtttataggagac

SEQ ID NO: 53690 - DNA, 25 bp, Homo sapien
ctactctgcaccatggtatatttac

SEQ ID NO: 53691 - DNA, 25 bp, Homo sapien
ctactctgcaccgtggtatatttac

SEQ ID NO: 53692 - DNA, 25 bp, Homo sapien
ctactctgtgactctgaagatggat

SEQ ID NO: 53693 - DNA, 25 bp, Homo sapien
ctactctgtgactttgaagatggat

SEQ ID NO: 53694 - DNA, 25 bp, Homo sapien
ctactgactttcatacaatggcttt

SEQ ID NO: 53695 - DNA, 25 bp, Homo sapien
ctactgacttttatacaatggcttt

SEQ ID NO: 53696 - DNA, 25 bp, Homo sapien
ctactgatattctcttccatagcac

SEQ ID NO: 53697 - DNA, 25 bp, Homo sapien
ctactgatattgtcttccatagcac

SEQ ID NO: 53698 - DNA, 25 bp, Homo sapien
ctactgatttgcactacaaaaggga

SEQ ID NO: 53699 - DNA, 25 bp, Homo sapien
ctactgatttgcgctacaaaaggga

SEQ ID NO: 53700 - DNA, 25 bp, Homo sapien
ctactgcaagaaagagaaaataggt

SEQ ID NO: 53701 - DNA, 25 bp, Homo sapien
ctactgcacgaaagagaaaataggt

SEQ ID NO: 53702 - DNA, 25 bp, Homo sapien
ctactgcacttccaaatcttgaaca

SEQ ID NO: 53703 - DNA, 25 bp, Homo sapien
ctactgcacttctaaatcttgaaca

SEQ ID NO: 53704 - DNA, 25 bp, Homo sapien
ctactgcctagattacttatgtttt

SEQ ID NO: 53705 - DNA, 25 bp, Homo sapien
ctactgcctagattgcttatgtttt

SEQ ID NO: 53706 - DNA, 25 bp, Homo sapien
ctactggaaaaactgtgtccagatg

SEQ ID NO: 53707 - DNA, 25 bp, Homo sapien
ctactggaaaaattgtgtccagatg

SEQ ID NO: 53708 - DNA, 25 bp, Homo sapien
ctactggaataatatttttgggcag

SEQ ID NO: 53709 - DNA, 25 bp, Homo sapien
ctactggagtaatatttttgggcag

SEQ ID NO: 53710 - DNA, 25 bp, Homo sapien
ctactggcatccaataggtagaggc

SEQ ID NO: 53711 - DNA, 25 bp, Homo sapien
ctactggcatccgataggtagaggc

SEQ ID NO: 53712 - DNA, 25 bp, Homo sapien
ctactggccgtaagtcgggcttgat

SEQ ID NO: 53713 - DNA, 25 bp, Homo sapien
ctactggctgtaagtcgggcttgat

SEQ ID NO: 53714 - DNA, 25 bp, Homo sapien
ctactggcttcacataattttcata

SEQ ID NO: 53715 - DNA, 25 bp, Homo sapien
ctactggcttcgcataattttcata

SEQ ID NO: 53716 - DNA, 25 bp, Homo sapien
ctactggggaatcccttacatttca

SEQ ID NO: 53717 - DNA, 25 bp, Homo sapien
ctactggggaatcctttacatttca

SEQ ID NO: 53718 - DNA, 25 bp, Homo sapien
ctactgtacagcaagttgagaacca

SEQ ID NO: 53719 - DNA, 25 bp, Homo sapien
ctactgtagagcaagttgagaacca

SEQ ID NO: 53720 - DNA, 25 bp, Homo sapien
ctactgtattggacaaaactagagg

SEQ ID NO: 53721 - DNA, 25 bp, Homo sapien
ctactgtattggataaaactagagg

SEQ ID NO: 53722 - DNA, 25 bp, Homo sapien
ctactgtatttaaaattggcttatt

SEQ ID NO: 53723 - DNA, 25 bp, Homo sapien
ctactgtattttaaattggcttatt

SEQ ID NO: 53724 - DNA, 25 bp, Homo sapien
ctactgtccttgttgttcaaaaagc

SEQ ID NO: 53725 - DNA, 25 bp, Homo sapien
ctactgtcgttgttgttcaaaaagc

SEQ ID NO: 53726 - DNA, 25 bp, Homo sapien
ctactgtgaagattttgccttttaa

SEQ ID NO: 53727 - DNA, 25 bp, Homo sapien
ctactgtgaagctccaacagtccca

SEQ ID NO: 53728 - DNA, 25 bp, Homo sapien
ctactgtgaagctgcaacagtccca

SEQ ID NO: 53729 - DNA, 25 bp, Homo sapien
ctactgtgacctatagcatgtcctt

SEQ ID NO: 53730 - DNA, 25 bp, Homo sapien
ctactgtgacctatggcatgtcctt

SEQ ID NO: 53731 - DNA, 25 bp, Homo sapien
ctactgtgacgattttgccttttaa

SEQ ID NO: 53732 - DNA, 25 bp, Homo sapien
ctactgtgccaatgtattaaccagt

SEQ ID NO: 53733 - DNA, 25 bp, Homo sapien
ctactgtgccattgtattaaccagt

SEQ ID NO: 53734 - DNA, 25 bp, Homo sapien
ctactgttaatgaatatactgcttg

SEQ ID NO: 53735 - DNA, 25 bp, Homo sapien
ctactgttaatggatatactgcttg

SEQ ID NO: 53736 - DNA, 25 bp, Homo sapien
ctacttaacgttacgccctctcaaa

SEQ ID NO: 53737 - DNA, 25 bp, Homo sapien
ctacttaacgttatgccctctcaaa

SEQ ID NO: 53738 - DNA, 25 bp, Homo sapien
ctacttacagcaagcgacaagtcaa

SEQ ID NO: 53739 - DNA, 25 bp, Homo sapien
ctacttacagcaagtgacaagtcaa

SEQ ID NO: 53740 - DNA, 25 bp, Homo sapien
ctacttagcattttgcctacctcgt

SEQ ID NO: 53741 - DNA, 25 bp, Homo sapien
ctacttagtattttgcctacctcgt

SEQ ID NO: 53742 - DNA, 25 bp, Homo sapien
ctacttagttcagagtcgctctttg

SEQ ID NO: 53743 - DNA, 25 bp, Homo sapien
ctacttagttcagagttgctctttg

SEQ ID NO: 53744 - DNA, 25 bp, Homo sapien
ctacttatgctcgcatttcagtctc

SEQ ID NO: 53745 - DNA, 25 bp, Homo sapien
ctacttatgctctcatttcagtctc

SEQ ID NO: 53746 - DNA, 25 bp, Homo sapien
ctacttcaattgcctcctacctgtt

SEQ ID NO: 53747 - DNA, 25 bp, Homo sapien
ctacttcagttgcctcctacctgtt

SEQ ID NO: 53748 - DNA, 25 bp, Homo sapien
ctacttcctagagctgttgtaaggc

SEQ ID NO: 53749 - DNA, 25 bp, Homo sapien
ctacttcctagatctgttgtaaggc

SEQ ID NO: 53750 - DNA, 25 bp, Homo sapien
ctacttctgtcccatcccaaatcac

SEQ ID NO: 53751 - DNA, 25 bp, Homo sapien
ctacttctgtcccgtcccaaatcac

SEQ ID NO: 53752 - DNA, 25 bp, Homo sapien
ctacttgactttcaacattatacac

SEQ ID NO: 53753 - DNA, 25 bp, Homo sapien
ctacttgacttttaacattatacac

SEQ ID NO: 53754 - DNA, 25 bp, Homo sapien
ctacttgcattcatctaaacatttt

SEQ ID NO: 53755 - DNA, 25 bp, Homo sapien
ctacttgcattcatctgaacatttt

SEQ ID NO: 53756 - DNA, 25 bp, Homo sapien
ctacttgccgttatttacatttatg

SEQ ID NO: 53757 - DNA, 25 bp, Homo sapien
ctacttgccgttgtttacatttatg

SEQ ID NO: 53758 - DNA, 25 bp, Homo sapien
ctacttgcggtcacttatactgtgc

SEQ ID NO: 53759 - DNA, 25 bp, Homo sapien
ctacttgctgcttcttcttaatctt

SEQ ID NO: 53760 - DNA, 25 bp, Homo sapien
ctacttgctgtcacttatactgtgc

SEQ ID NO: 53761 - DNA, 25 bp, Homo sapien
ctacttgcttcctggacttgccatt

SEQ ID NO: 53762 - DNA, 25 bp, Homo sapien
ctacttgcttcgtggacttgccatt

SEQ ID NO: 53763 - DNA, 25 bp, Homo sapien
ctacttgcttcttcttcttaatctt

SEQ ID NO: 53764 - DNA, 25 bp, Homo sapien
ctacttggcaagaacgttacaaatg

SEQ ID NO: 53765 - DNA, 25 bp, Homo sapien
ctacttggcaagaatgttacaaatg

SEQ ID NO: 53766 - DNA, 25 bp, Homo sapien
ctacttggtgcaatatcttatacaa

SEQ ID NO: 53767 - DNA, 25 bp, Homo sapien
ctacttggtgcaatgtcttatacaa

SEQ ID NO: 53768 - DNA, 25 bp, Homo sapien
ctactttacctgctctttcacttat

SEQ ID NO: 53769 - DNA, 25 bp, Homo sapien
ctactttacctgttctttcacttat

SEQ ID NO: 53770 - DNA, 25 bp, Homo sapien
ctactttactctttccataatcact

SEQ ID NO: 53771 - DNA, 25 bp, Homo sapien
ctactttactcttttcataatcact

SEQ ID NO: 53772 - DNA, 25 bp, Homo sapien
ctactttcaggccacaatgctagga

SEQ ID NO: 53773 - DNA, 25 bp, Homo sapien
ctactttcaggccacagtgctagga

SEQ ID NO: 53774 - DNA, 25 bp, Homo sapien
ctactttctcaccttgtgtttctaa

SEQ ID NO: 53775 - DNA, 25 bp, Homo sapien
ctactttcttaccttgtgtttctaa

SEQ ID NO: 53776 - DNA, 25 bp, Homo sapien
ctactttcttagcactttttgagta

SEQ ID NO: 53777 - DNA, 25 bp, Homo sapien
ctactttcttagcagtttttgagta

SEQ ID NO: 53778 - DNA, 25 bp, Homo sapien
ctactttggtgacatttgttatgca

SEQ ID NO: 53779 - DNA, 25 bp, Homo sapien
ctactttggtgatatttgttatgca

SEQ ID NO: 53780 - DNA, 25 bp, Homo sapien
ctacttttaattggcaacaagaaaa

SEQ ID NO: 53781 - DNA, 25 bp, Homo sapien
ctacttttaatttgcaacaagaaaa

SEQ ID NO: 53782 - DNA, 25 bp, Homo sapien
ctactttttttcatttccttgtgtt

SEQ ID NO: 53783 - DNA, 25 bp, Homo sapien
ctactttttttcgtttccttgtgtt

SEQ ID NO: 53784 - DNA, 25 bp, Homo sapien
ctagaaaaacgggacactctggccc

SEQ ID NO: 53785 - DNA, 25 bp, Homo sapien
ctagaaaaatgggacactctggccc

SEQ ID NO: 53786 - DNA, 25 bp, Homo sapien
ctagaaaggatatatgaatgcaaca

SEQ ID NO: 53787 - DNA, 25 bp, Homo sapien
ctagaaagggtatatgaatgcaaca

SEQ ID NO: 53788 - DNA, 25 bp, Homo sapien
ctagaaatacctgcacgtcatttct

SEQ ID NO: 53789 - DNA, 25 bp, Homo sapien
ctagaaatacctgcccgtcatttct

SEQ ID NO: 53790 - DNA, 25 bp, Homo sapien
ctagaaatgagcccagctgaacact

SEQ ID NO: 53791 - DNA, 25 bp, Homo sapien
ctagaaatgagcccagttgaacact

SEQ ID NO: 53792 - DNA, 25 bp, Homo sapien
ctagaaatgtatagcctttgtcttt

SEQ ID NO: 53793 - DNA, 25 bp, Homo sapien
ctagaaattgaacttacgcaaagct

SEQ ID NO: 53794 - DNA, 25 bp, Homo sapien
ctagaaattgaacttatgcaaagct

SEQ ID NO: 53795 - DNA, 25 bp, Homo sapien
ctagaaatttatagcctttgtcttt

SEQ ID NO: 53796 - DNA, 25 bp, Homo sapien
ctagaacaatgagcaacaaaataaa

SEQ ID NO: 53797 - DNA, 25 bp, Homo sapien
ctagaacactgagcaacaaaataaa

SEQ ID NO: 53798 - DNA, 25 bp, Homo sapien
ctagaaccatcactagaaacaaaat

SEQ ID NO: 53799 - DNA, 25 bp, Homo sapien
ctagaaccgtcactagaaacaaaat

SEQ ID NO: 53800 - DNA, 25 bp, Homo sapien
ctagaacctcactgcgaataaggaa

SEQ ID NO: 53801 - DNA, 25 bp, Homo sapien
ctagaacctcactgtgaataaggaa

SEQ ID NO: 53802 - DNA, 25 bp, Homo sapien
ctagaactcaatacggcggcaggtt

SEQ ID NO: 53803 - DNA, 25 bp, Homo sapien
ctagaactcaatacggtggcaggtt

SEQ ID NO: 53804 - DNA, 25 bp, Homo sapien
ctagaactcacaggactcaaaaaag

SEQ ID NO: 53805 - DNA, 25 bp, Homo sapien
ctagaactcacagggctcaaaaaag

SEQ ID NO: 53806 - DNA, 25 bp, Homo sapien
ctagaactttcattcagtgatatgt

SEQ ID NO: 53807 - DNA, 25 bp, Homo sapien
ctagaactttcattgagtgatatgt

SEQ ID NO: 53808 - DNA, 25 bp, Homo sapien
ctagaagcacacatagctgtttcac

SEQ ID NO: 53809 - DNA, 25 bp, Homo sapien
ctagaagcacacatagttgtttcac

SEQ ID NO: 53810 - DNA, 25 bp, Homo sapien
ctagaagcattagaacacatctgat

SEQ ID NO: 53811 - DNA, 25 bp, Homo sapien
ctagaagcattagaactcatctgat

SEQ ID NO: 53812 - DNA, 25 bp, Homo sapien
ctagaagctacctttttcctaggag

SEQ ID NO: 53813 - DNA, 25 bp, Homo sapien
ctagaagctacttttttcctaggag

SEQ ID NO: 53814 - DNA, 25 bp, Homo sapien
ctagaagctgtggaaagaaaaagag

SEQ ID NO: 53815 - DNA, 25 bp, Homo sapien
ctagaagctgtgggaagaaaaagag

SEQ ID NO: 53816 - DNA, 25 bp, Homo sapien
ctagaaggacgatactgaacggtca

SEQ ID NO: 53817 - DNA, 25 bp, Homo sapien
ctagaaggatgatactgaacggtca

SEQ ID NO: 53818 - DNA, 25 bp, Homo sapien
ctagaatcatgctggaccacagtag

SEQ ID NO: 53819 - DNA, 25 bp, Homo sapien
ctagaatcgtgctggaccacagtag

SEQ ID NO: 53820 - DNA, 25 bp, Homo sapien
ctagaattaggtcacaaatggatat

SEQ ID NO: 53821 - DNA, 25 bp, Homo sapien
ctagaattaggttacaaatggatat

SEQ ID NO: 53822 - DNA, 25 bp, Homo sapien
ctagaattatgctcatattacaggt

SEQ ID NO: 53823 - DNA, 25 bp, Homo sapien
ctagaattatgctgatattacaggt

SEQ ID NO: 53824 - DNA, 25 bp, Homo sapien
ctagaattcgccatagcatggtcta

SEQ ID NO: 53825 - DNA, 25 bp, Homo sapien
ctagaattcgccgtagcatggtcta

SEQ ID NO: 53826 - DNA, 25 bp, Homo sapien
ctagaattctgactcgctgatttat

SEQ ID NO: 53827 - DNA, 25 bp, Homo sapien
ctagaattctgacttgctgatttat

SEQ ID NO: 53828 - DNA, 25 bp, Homo sapien
ctagaatttacaataatatgttgaa

SEQ ID NO: 53829 - DNA, 25 bp, Homo sapien
ctagaatttccaataatatgttgaa

SEQ ID NO: 53830 - DNA, 25 bp, Homo sapien
ctagacaaagacaccataaatagga

SEQ ID NO: 53831 - DNA, 25 bp, Homo sapien
ctagacaaagacactataaatagga

SEQ ID NO: 53832 - DNA, 25 bp, Homo sapien
ctagacaaccttcctacagctaacc

SEQ ID NO: 53833 - DNA, 25 bp, Homo sapien
ctagacaaccttcttacagctaacc

SEQ ID NO: 53834 - DNA, 25 bp, Homo sapien
ctagacagagaagttgaaaatcatg

SEQ ID NO: 53835 - DNA, 25 bp, Homo sapien
ctagacagcgaagttgaaaatcatg

SEQ ID NO: 53836 - DNA, 25 bp, Homo sapien
ctagacagctgctttttacaaataa

SEQ ID NO: 53837 - DNA, 25 bp, Homo sapien
ctagacagttgctttttacaaataa

SEQ ID NO: 53838 - DNA, 25 bp, Homo sapien
ctagacattaccggactcactaacg

SEQ ID NO: 53839 - DNA, 25 bp, Homo sapien
ctagacattactggactcactaacg

SEQ ID NO: 53840 - DNA, 25 bp, Homo sapien
ctagaccccaggtcatcagctgcac

SEQ ID NO: 53841 - DNA, 25 bp, Homo sapien
ctagaccccaggtgatcagctgcac

SEQ ID NO: 53842 - DNA, 25 bp, Homo sapien
ctagacctagagagcacctggctat

SEQ ID NO: 53843 - DNA, 25 bp, Homo sapien
ctagacctagagagtacctggctat

SEQ ID NO: 53844 - DNA, 25 bp, Homo sapien
ctagactcactgttttcctgaagtg

SEQ ID NO: 53845 - DNA, 25 bp, Homo sapien
ctagactcactgtttttctgaagtg

SEQ ID NO: 53846 - DNA, 25 bp, Homo sapien
ctagacttcagacttactaagcaaa

SEQ ID NO: 53847 - DNA, 25 bp, Homo sapien
ctagacttcagatttactaagcaaa

SEQ ID NO: 53848 - DNA, 25 bp, Homo sapien
ctagagaacgtctttgcataaataa

SEQ ID NO: 53849 - DNA, 25 bp, Homo sapien
ctagagaatgtctttgcataaataa

SEQ ID NO: 53850 - DNA, 25 bp, Homo sapien
ctagagacattgctggcatgcagtc

SEQ ID NO: 53851 - DNA, 25 bp, Homo sapien
ctagagacgttgctggcatgcagtc

SEQ ID NO: 53852 - DNA, 25 bp, Homo sapien
ctagagagaagtcaatgcttagctt

SEQ ID NO: 53853 - DNA, 25 bp, Homo sapien
ctagagagaagtcgatgcttagctt

SEQ ID NO: 53854 - DNA, 25 bp, Homo sapien
ctagagagattaaattgcttgtcca

SEQ ID NO: 53855 - DNA, 25 bp, Homo sapien
ctagagagattaagttgcttgtcca

SEQ ID NO: 53856 - DNA, 25 bp, Homo sapien
ctagagagcacctggctataggaat

SEQ ID NO: 53857 - DNA, 25 bp, Homo sapien
ctagagaggcacttgcaggatctca

SEQ ID NO: 53858 - DNA, 25 bp, Homo sapien
ctagagaggcactttcaggatctca

SEQ ID NO: 53859 - DNA, 25 bp, Homo sapien
ctagagagtacctggctataggaat

SEQ ID NO: 53860 - DNA, 25 bp, Homo sapien
ctagagatagggctatagtaaggag

SEQ ID NO: 53861 - DNA, 25 bp, Homo sapien
ctagagatagggctgtagtaaggag

SEQ ID NO: 53862 - DNA, 25 bp, Homo sapien
ctagagcaagcagaagagacttaaa

SEQ ID NO: 53863 - DNA, 25 bp, Homo sapien
ctagagcaagcggaagagacttaaa

SEQ ID NO: 53864 - DNA, 25 bp, Homo sapien
ctagagcaatttgagataaacacta

SEQ ID NO: 53865 - DNA, 25 bp, Homo sapien
ctagagcactttgagataaacacta

SEQ ID NO: 53866 - DNA, 25 bp, Homo sapien
ctagagcccgtgagccgggaaaaaa

SEQ ID NO: 53867 - DNA, 25 bp, Homo sapien
ctagagcctgtgagccgggaaaaaa

SEQ ID NO: 53868 - DNA, 25 bp, Homo sapien
ctagagctcgtgccattcaacctgc

SEQ ID NO: 53869 - DNA, 25 bp, Homo sapien
ctagagctcgtgccgttcaacctgc

SEQ ID NO: 53870 - DNA, 25 bp, Homo sapien
ctagaggacaatcctaatctagtca

SEQ ID NO: 53871 - DNA, 25 bp, Homo sapien
ctagaggacaatcttaatctagtca

SEQ ID NO: 53872 - DNA, 25 bp, Homo sapien
ctagagggagatataacctgtctgc

SEQ ID NO: 53873 - DNA, 25 bp, Homo sapien
ctagagggagatataagctgtctgc

SEQ ID NO: 53874 - DNA, 25 bp, Homo sapien
ctagagtaagtgtaaacaggtcaaa

SEQ ID NO: 53875 - DNA, 25 bp, Homo sapien
ctagagtaagtgtgaacaggtcaaa

SEQ ID NO: 53876 - DNA, 25 bp, Homo sapien
ctagagtagcctcatccacagggtg

SEQ ID NO: 53877 - DNA, 25 bp, Homo sapien
ctagagtagccttatccacagggtg

SEQ ID NO: 53878 - DNA, 25 bp, Homo sapien
ctagagttatgaatggaaacagaaa

SEQ ID NO: 53879 - DNA, 25 bp, Homo sapien
ctagagttatgactggaaacagaaa

SEQ ID NO: 53880 - DNA, 25 bp, Homo sapien
ctagagttccagaaatgtgggttca

SEQ ID NO: 53881 - DNA, 25 bp, Homo sapien
ctagagttccagagatgtgggttca

SEQ ID NO: 53882 - DNA, 25 bp, Homo sapien
ctagataaacccaatcaaatcagaa

SEQ ID NO: 53883 - DNA, 25 bp, Homo sapien
ctagataaacccaatccaatcagaa

SEQ ID NO: 53884 - DNA, 25 bp, Homo sapien
ctagataactctgcaattaagtgga

SEQ ID NO: 53885 - DNA, 25 bp, Homo sapien
ctagataactctgtaattaagtgga

SEQ ID NO: 53886 - DNA, 25 bp, Homo sapien
ctagataagtaataatagcccttga

SEQ ID NO: 53887 - DNA, 25 bp, Homo sapien
ctagataagtaataattgcccttga

SEQ ID NO: 53888 - DNA, 25 bp, Homo sapien
ctagatcttgtactttaaactctgg

SEQ ID NO: 53889 - DNA, 25 bp, Homo sapien
ctagatcttgtgctttaaactctgg

SEQ ID NO: 53890 - DNA, 25 bp, Homo sapien
ctagatgaatactcaccctgtatgt

SEQ ID NO: 53891 - DNA, 25 bp, Homo sapien
ctagatgaatattcaccctgtatgt

SEQ ID NO: 53892 - DNA, 25 bp, Homo sapien
ctagatgcaaaagtgtccagaatta

SEQ ID NO: 53893 - DNA, 25 bp, Homo sapien
ctagatgcgaaagtgtccagaatta

SEQ ID NO: 53894 - DNA, 25 bp, Homo sapien
ctagatggagtgtgttttataaagc

SEQ ID NO: 53895 - DNA, 25 bp, Homo sapien
ctagatggagtttgttttataaagc

SEQ ID NO: 53896 - DNA, 25 bp, Homo sapien
ctagatgggtccaaaagcatgcagt

SEQ ID NO: 53897 - DNA, 25 bp, Homo sapien
ctagatgggtccgaaagcatgcagt

SEQ ID NO: 53898 - DNA, 25 bp, Homo sapien
ctagatggtcttgaatatacttcaa

SEQ ID NO: 53899 - DNA, 25 bp, Homo sapien
ctagatggtcttgagtatacttcaa

SEQ ID NO: 53900 - DNA, 25 bp, Homo sapien
ctagatgttcagcgtatttgggaga

SEQ ID NO: 53901 - DNA, 25 bp, Homo sapien
ctagatgttcagtgtatttgggaga

SEQ ID NO: 53902 - DNA, 25 bp, Homo sapien
ctagattcgagtcctttcctgatac

SEQ ID NO: 53903 - DNA, 25 bp, Homo sapien
ctagattcgagttctttcctgatac

SEQ ID NO: 53904 - DNA, 25 bp, Homo sapien
ctagattgacccgttagctctccca

SEQ ID NO: 53905 - DNA, 25 bp, Homo sapien
ctagattgacctgttagctctccca

SEQ ID NO: 53906 - DNA, 25 bp, Homo sapien
ctagattggaacccctgcacatgca

SEQ ID NO: 53907 - DNA, 25 bp, Homo sapien
ctagattgggacccctgcacatgca

SEQ ID NO: 53908 - DNA, 25 bp, Homo sapien
ctagcaaatggccaggccaggattc

SEQ ID NO: 53909 - DNA, 25 bp, Homo sapien
ctagcaaatggccgggccaggattc

SEQ ID NO: 53910 - DNA, 25 bp, Homo sapien
ctagcaataagagataaacttctac

SEQ ID NO: 53911 - DNA, 25 bp, Homo sapien
ctagcaataggagataaacttctac

SEQ ID NO: 53912 - DNA, 25 bp, Homo sapien
ctagcaatgtgactccaagctagtt

SEQ ID NO: 53913 - DNA, 25 bp, Homo sapien
ctagcaatgtgactccgagctagtt

SEQ ID NO: 53914 - DNA, 25 bp, Homo sapien
ctagcacaaaaaagaaagccactta

SEQ ID NO: 53915 - DNA, 25 bp, Homo sapien
ctagcacaagaaagaaagccactta

SEQ ID NO: 53916 - DNA, 25 bp, Homo sapien
ctagcacagaagaaagaacttttct

SEQ ID NO: 53917 - DNA, 25 bp, Homo sapien
ctagcacagatgctatatctctagt

SEQ ID NO: 53918 - DNA, 25 bp, Homo sapien
ctagcacagatgttatatctctagt

SEQ ID NO: 53919 - DNA, 25 bp, Homo sapien
ctagcacagtagaaagaacttttct

SEQ ID NO: 53920 - DNA, 25 bp, Homo sapien
ctagcagaattcacgccctgctaac

SEQ ID NO: 53921 - DNA, 25 bp, Homo sapien
ctagcagaattcatgccctgctaac

SEQ ID NO: 53922 - DNA, 25 bp, Homo sapien
ctagcagaggactcaatgatgcaag

SEQ ID NO: 53923 - DNA, 25 bp, Homo sapien
ctagcagaggattcaatgatgcaag

SEQ ID NO: 53924 - DNA, 25 bp, Homo sapien
ctagcagatcaaaaacatcccgatt

SEQ ID NO: 53925 - DNA, 25 bp, Homo sapien
ctagcagatcaaaagcatcccgatt

SEQ ID NO: 53926 - DNA, 25 bp, Homo sapien
ctagcaggacttcaatgtacattgc

SEQ ID NO: 53927 - DNA, 25 bp, Homo sapien
ctagcaggagttcaatgtacattgc

SEQ ID NO: 53928 - DNA, 25 bp, Homo sapien
ctagcagttaggaacactggcattg

SEQ ID NO: 53929 - DNA, 25 bp, Homo sapien
ctagcagttaggagcactggcattg

SEQ ID NO: 53930 - DNA, 25 bp, Homo sapien
ctagcataactgacctttattgcaa

SEQ ID NO: 53931 - DNA, 25 bp, Homo sapien
ctagcataactggcctttattgcaa

SEQ ID NO: 53932 - DNA, 25 bp, Homo sapien
ctagcataataaagatacgtaggtg

SEQ ID NO: 53933 - DNA, 25 bp, Homo sapien
ctagcataatacagatacgtaggtg

SEQ ID NO: 53934 - DNA, 25 bp, Homo sapien
ctagcattacgcattttgatgctca

SEQ ID NO: 53935 - DNA, 25 bp, Homo sapien
ctagcattatgcattttgatgctca

SEQ ID NO: 53936 - DNA, 25 bp, Homo sapien
ctagcattgcgtctgacatgtaaca

SEQ ID NO: 53937 - DNA, 25 bp, Homo sapien
ctagcattgtgtctgacatgtaaca

SEQ ID NO: 53938 - DNA, 25 bp, Homo sapien
ctagccacatagaataagtttggaa

SEQ ID NO: 53939 - DNA, 25 bp, Homo sapien
ctagccacgtagaataagtttggaa

SEQ ID NO: 53940 - DNA, 25 bp, Homo sapien
ctagccactttgggctccttctggc

SEQ ID NO: 53941 - DNA, 25 bp, Homo sapien
ctagccactttgggcttcttctggc

SEQ ID NO: 53942 - DNA, 25 bp, Homo sapien
ctagccagcggacaaatggcagatg

SEQ ID NO: 53943 - DNA, 25 bp, Homo sapien
ctagccagcggccaaatggcagatg

SEQ ID NO: 53944 - DNA, 25 bp, Homo sapien
ctagccagctgatgaaaaagagacc

SEQ ID NO: 53945 - DNA, 25 bp, Homo sapien
ctagccagctggtgaaaaagagacc

SEQ ID NO: 53946 - DNA, 25 bp, Homo sapien
ctagccatcctgtattttatccagc

SEQ ID NO: 53947 - DNA, 25 bp, Homo sapien
ctagccatcttgtattttatccagc

SEQ ID NO: 53948 - DNA, 25 bp, Homo sapien
ctagccattaattttagaaagagct

SEQ ID NO: 53949 - DNA, 25 bp, Homo sapien
ctagccattgattttagaaagagct

SEQ ID NO: 53950 - DNA, 25 bp, Homo sapien
ctagcccaaattgctgacccataaa

SEQ ID NO: 53951 - DNA, 25 bp, Homo sapien
ctagcccaaattgttgacccataaa

SEQ ID NO: 53952 - DNA, 25 bp, Homo sapien
ctagccctgccaactgaagacaaac

SEQ ID NO: 53953 - DNA, 25 bp, Homo sapien
ctagccctggcaactgaagacaaac

SEQ ID NO: 53954 - DNA, 25 bp, Homo sapien
ctagcctctcgtctttcattaaacc

SEQ ID NO: 53955 - DNA, 25 bp, Homo sapien
ctagcctcttgtctttcattaaacc

SEQ ID NO: 53956 - DNA, 25 bp, Homo sapien
ctagcctgtaattatcagtgcctat

SEQ ID NO: 53957 - DNA, 25 bp, Homo sapien
ctagcctgtaattatcggtgcctat

SEQ ID NO: 53958 - DNA, 25 bp, Homo sapien
ctagctaaaaatcatgatcactaag

SEQ ID NO: 53959 - DNA, 25 bp, Homo sapien
ctagctaaaaatcctgatcactaag

SEQ ID NO: 53960 - DNA, 25 bp, Homo sapien
ctagctctgtaaatggccaaacaac

SEQ ID NO: 53961 - DNA, 25 bp, Homo sapien
ctagctctgtaaatggtcaaacaac

SEQ ID NO: 53962 - DNA, 25 bp, Homo sapien
ctagctctgtcataagagtcacagc

SEQ ID NO: 53963 - DNA, 25 bp, Homo sapien
ctagctctgtcgtaagagtcacagc

SEQ ID NO: 53964 - DNA, 25 bp, Homo sapien
ctagctctgtctctatcatctctat

SEQ ID NO: 53965 - DNA, 25 bp, Homo sapien
ctagctctgtctttatcatctctat

SEQ ID NO: 53966 - DNA, 25 bp, Homo sapien
ctagctcttcttcattagaactgtt

SEQ ID NO: 53967 - DNA, 25 bp, Homo sapien
ctagctcttcttcgttagaactgtt

SEQ ID NO: 53968 - DNA, 25 bp, Homo sapien
ctagctgacagatcttaaagtggct

SEQ ID NO: 53969 - DNA, 25 bp, Homo sapien
ctagctgacagatcttcaagtggct

SEQ ID NO: 53970 - DNA, 25 bp, Homo sapien
ctagctgactctgtgtctctaaccg

SEQ ID NO: 53971 - DNA, 25 bp, Homo sapien
ctagctgactctgtgtttctaaccg

SEQ ID NO: 53972 - DNA, 25 bp, Homo sapien
ctagctgcatatataatcctgtgaa

SEQ ID NO: 53973 - DNA, 25 bp, Homo sapien
ctagctgcatatgtaatcctgtgaa

SEQ ID NO: 53974 - DNA, 25 bp, Homo sapien
ctagcttcatggcatctggatgcat

SEQ ID NO: 53975 - DNA, 25 bp, Homo sapien
ctagcttcatggtatctggatgcat

SEQ ID NO: 53976 - DNA, 25 bp, Homo sapien
ctagcttgcaaaatatcttggtatc

SEQ ID NO: 53977 - DNA, 25 bp, Homo sapien
ctagcttgcaaattatcttggtatc

SEQ ID NO: 53978 - DNA, 25 bp, Homo sapien
ctaggaacattatttcccttgtgtc

SEQ ID NO: 53979 - DNA, 25 bp, Homo sapien
ctaggaacattgtttcccttgtgtc

SEQ ID NO: 53980 - DNA, 25 bp, Homo sapien
ctaggaactatagtagatactgact

SEQ ID NO: 53981 - DNA, 25 bp, Homo sapien
ctaggaactgtagtagatactgact

SEQ ID NO: 53982 - DNA, 25 bp, Homo sapien
ctaggaagcaagccctccccagaaa

SEQ ID NO: 53983 - DNA, 25 bp, Homo sapien
ctaggaagcacagcgtatcccaaac

SEQ ID NO: 53984 - DNA, 25 bp, Homo sapien
ctaggaagcacagtgtatcccaaac

SEQ ID NO: 53985 - DNA, 25 bp, Homo sapien
ctaggaagcgagccctccccagaaa

SEQ ID NO: 53986 - DNA, 25 bp, Homo sapien
ctaggaatttgtcatttaaagatcc

SEQ ID NO: 53987 - DNA, 25 bp, Homo sapien
ctaggaatttgtcgtttaaagatcc

SEQ ID NO: 53988 - DNA, 25 bp, Homo sapien
ctaggagactaagtggatagaaaag

SEQ ID NO: 53989 - DNA, 25 bp, Homo sapien
ctaggagactaagtggttagaaaag

SEQ ID NO: 53990 - DNA, 25 bp, Homo sapien
ctaggatgcaccattccatagaaca

SEQ ID NO: 53991 - DNA, 25 bp, Homo sapien
ctaggatgcaccattcgatagaaca

SEQ ID NO: 53992 - DNA, 25 bp, Homo sapien
ctaggattatgctgagtcagaccga

SEQ ID NO: 53993 - DNA, 25 bp, Homo sapien
ctaggattatgctgggtcagaccga

SEQ ID NO: 53994 - DNA, 25 bp, Homo sapien
ctaggcaaaaatttaaaaaaacatt

SEQ ID NO: 53995 - DNA, 25 bp, Homo sapien
ctaggcaaaaatttaagaaaacatt

SEQ ID NO: 53996 - DNA, 25 bp, Homo sapien
ctaggcaagcacagaatgcccatgt

SEQ ID NO: 53997 - DNA, 25 bp, Homo sapien
ctaggcaagcacggaatgcccatgt

SEQ ID NO: 53998 - DNA, 25 bp, Homo sapien
ctaggcatatactcatctgtacaaa

SEQ ID NO: 53999 - DNA, 25 bp, Homo sapien
ctaggcatatactcatgtgtacaaa

SEQ ID NO: 54000 - DNA, 25 bp, Homo sapien
ctaggcgcacttccttggactcagg

SEQ ID NO: 54001 - DNA, 25 bp, Homo sapien
ctaggcgcatttccttggactcagg

SEQ ID NO: 54002 - DNA, 25 bp, Homo sapien
ctaggctgcctggcttcagggtcta

SEQ ID NO: 54003 - DNA, 25 bp, Homo sapien
ctaggctgcttggcttcagggtcta

SEQ ID NO: 54004 - DNA, 25 bp, Homo sapien
ctaggcttttcctgaacaatagtga

SEQ ID NO: 54005 - DNA, 25 bp, Homo sapien
ctaggcttttcttgaacaatagtga

SEQ ID NO: 54006 - DNA, 25 bp, Homo sapien
ctagggaactatgtaaattgattgt

SEQ ID NO: 54007 - DNA, 25 bp, Homo sapien
ctagggaactatttaaattgattgt

SEQ ID NO: 54008 - DNA, 25 bp, Homo sapien
ctagggatgctcacagtaatggaaa

SEQ ID NO: 54009 - DNA, 25 bp, Homo sapien
ctagggatgttcacagtaatggaaa

SEQ ID NO: 54010 - DNA, 25 bp, Homo sapien
ctagggcattagacagattacccac

SEQ ID NO: 54011 - DNA, 25 bp, Homo sapien
ctagggcattagatagattacccac

SEQ ID NO: 54012 - DNA, 25 bp, Homo sapien
ctagggccagttagcccacttactc

SEQ ID NO: 54013 - DNA, 25 bp, Homo sapien
ctagggccagttagtccacttactc

SEQ ID NO: 54014 - DNA, 25 bp, Homo sapien
ctagggcttgaaatagatctttcta

SEQ ID NO: 54015 - DNA, 25 bp, Homo sapien
ctagggcttgagatagatctttcta

SEQ ID NO: 54016 - DNA, 25 bp, Homo sapien
ctaggggcagaagcaatgatcttcc

SEQ ID NO: 54017 - DNA, 25 bp, Homo sapien
ctaggggcagaaggaatgatcttcc

SEQ ID NO: 54018 - DNA, 25 bp, Homo sapien
ctaggggtcatgtcttgaagctaca

SEQ ID NO: 54019 - DNA, 25 bp, Homo sapien
ctaggggtcgtgtcttgaagctaca

SEQ ID NO: 54020 - DNA, 25 bp, Homo sapien
ctaggggtcttaaacttgctaggat

SEQ ID NO: 54021 - DNA, 25 bp, Homo sapien
ctaggggtcttaagcttgctaggat

SEQ ID NO: 54022 - DNA, 25 bp, Homo sapien
ctaggggtttggagtcatgcaacca

SEQ ID NO: 54023 - DNA, 25 bp, Homo sapien
ctaggggtttggagtcgtgcaacca

SEQ ID NO: 54024 - DNA, 25 bp, Homo sapien
ctagggtaatcacgacaacacaata

SEQ ID NO: 54025 - DNA, 25 bp, Homo sapien
ctagggtaatcatgacaacacaata

SEQ ID NO: 54026 - DNA, 25 bp, Homo sapien
ctagggtgctatatgcttaggatag

SEQ ID NO: 54027 - DNA, 25 bp, Homo sapien
ctagggtggtatatgcttaggatag

SEQ ID NO: 54028 - DNA, 25 bp, Homo sapien
ctaggtacctgtcctgagcatgcag

SEQ ID NO: 54029 - DNA, 25 bp, Homo sapien
ctaggtacgtgtcctgagcatgcag

SEQ ID NO: 54030 - DNA, 25 bp, Homo sapien
ctaggtcaccattgagtaggaatgt

SEQ ID NO: 54031 - DNA, 25 bp, Homo sapien
ctaggtcatcattgagtaggaatgt

SEQ ID NO: 54032 - DNA, 25 bp, Homo sapien
ctaggtctagctctctaaaaaaaaa

SEQ ID NO: 54033 - DNA, 25 bp, Homo sapien
ctaggtctagctctctcaaaaaaaa

SEQ ID NO: 54034 - DNA, 25 bp, Homo sapien
ctaggtgaaagacgggagttcaggc

SEQ ID NO: 54035 - DNA, 25 bp, Homo sapien
ctaggtgaaagatgggagttcaggc

SEQ ID NO: 54036 - DNA, 25 bp, Homo sapien
ctaggtgcgctttctcgactgtctt

SEQ ID NO: 54037 - DNA, 25 bp, Homo sapien
ctaggtgctctttctcgactgtctt

SEQ ID NO: 54038 - DNA, 25 bp, Homo sapien
ctaggtgtgtctcagtcgaatggcc

SEQ ID NO: 54039 - DNA, 25 bp, Homo sapien
ctaggtgtgtctcagttgaatggcc

SEQ ID NO: 54040 - DNA, 25 bp, Homo sapien
ctaggtgttcaaattcattcatcac

SEQ ID NO: 54041 - DNA, 25 bp, Homo sapien
ctaggtgttcacattcattcatcac

SEQ ID NO: 54042 - DNA, 25 bp, Homo sapien
ctaggttaatggctacaaaacattt

SEQ ID NO: 54043 - DNA, 25 bp, Homo sapien
ctaggttaatggctacgaaacattt

SEQ ID NO: 54044 - DNA, 25 bp, Homo sapien
ctaggttcctaagagcaaggaagtt

SEQ ID NO: 54045 - DNA, 25 bp, Homo sapien
ctaggttcctacgagcaaggaagtt

SEQ ID NO: 54046 - DNA, 25 bp, Homo sapien
ctaggttgagtcagagattgcttct

SEQ ID NO: 54047 - DNA, 25 bp, Homo sapien
ctaggttgagtcagggattgcttct

SEQ ID NO: 54048 - DNA, 25 bp, Homo sapien
ctaggttgtaattcgtatcactgca

SEQ ID NO: 54049 - DNA, 25 bp, Homo sapien
ctaggttgtaatttgtatcactgca

SEQ ID NO: 54050 - DNA, 25 bp, Homo sapien
ctagtaaatagtagacccaggactt

SEQ ID NO: 54051 - DNA, 25 bp, Homo sapien
ctagtaaatggtagacccaggactt

SEQ ID NO: 54052 - DNA, 25 bp, Homo sapien
ctagtaacaaacgcaagcttagaac

SEQ ID NO: 54053 - DNA, 25 bp, Homo sapien
ctagtaacaaatgcaagcttagaac

SEQ ID NO: 54054 - DNA, 25 bp, Homo sapien
ctagtaactctctaaagtctctgga

SEQ ID NO: 54055 - DNA, 25 bp, Homo sapien
ctagtaactctctgaagtctctgga

SEQ ID NO: 54056 - DNA, 25 bp, Homo sapien
ctagtaagccaattcctctcttgtt

SEQ ID NO: 54057 - DNA, 25 bp, Homo sapien
ctagtaagccagttcctctcttgtt

SEQ ID NO: 54058 - DNA, 25 bp, Homo sapien
ctagtaagcgtggattcactgggtt

SEQ ID NO: 54059 - DNA, 25 bp, Homo sapien
ctagtaagtgtggattcactgggtt

SEQ ID NO: 54060 - DNA, 25 bp, Homo sapien
ctagtaatcaagacagtgtgcataa

SEQ ID NO: 54061 - DNA, 25 bp, Homo sapien
ctagtaatcactcactctgctattt

SEQ ID NO: 54062 - DNA, 25 bp, Homo sapien
ctagtaatcactctctctgctattt

SEQ ID NO: 54063 - DNA, 25 bp, Homo sapien
ctagtaattaagacagtgtgcataa

SEQ ID NO: 54064 - DNA, 25 bp, Homo sapien
ctagtactaggtacctgtcctgagc

SEQ ID NO: 54065 - DNA, 25 bp, Homo sapien
ctagtactaggtacgtgtcctgagc

SEQ ID NO: 54066 - DNA, 25 bp, Homo sapien
ctagtagacatgaccgtgacagtta

SEQ ID NO: 54067 - DNA, 25 bp, Homo sapien
ctagtagacatgactgtgacagtta

SEQ ID NO: 54068 - DNA, 25 bp, Homo sapien
ctagtataaagttgtacaggccact

SEQ ID NO: 54069 - DNA, 25 bp, Homo sapien
ctagtataacgttgtacaggccact

SEQ ID NO: 54070 - DNA, 25 bp, Homo sapien
ctagtatcaaaacatgttcaactgg

SEQ ID NO: 54071 - DNA, 25 bp, Homo sapien
ctagtatcaaagcatgttcaactgg

SEQ ID NO: 54072 - DNA, 25 bp, Homo sapien
ctagtcaaagagcctgtggacctcc

SEQ ID NO: 54073 - DNA, 25 bp, Homo sapien
ctagtcaaagtagttgggatggtgc

SEQ ID NO: 54074 - DNA, 25 bp, Homo sapien
ctagtcaaagtggttgggatggtgc

SEQ ID NO: 54075 - DNA, 25 bp, Homo sapien
ctagtcaaatagcctgtggacctcc

SEQ ID NO: 54076 - DNA, 25 bp, Homo sapien
ctagtcagccttctatgaaatgtac

SEQ ID NO: 54077 - DNA, 25 bp, Homo sapien
ctagtcagccttttatgaaatgtac

SEQ ID NO: 54078 - DNA, 25 bp, Homo sapien
ctagtcagtaaactcaccaatgtct

SEQ ID NO: 54079 - DNA, 25 bp, Homo sapien
ctagtcagtaagctcaccaatgtct

SEQ ID NO: 54080 - DNA, 25 bp, Homo sapien
ctagtctatcaagctatttactgag

SEQ ID NO: 54081 - DNA, 25 bp, Homo sapien
ctagtctatcaggctatttactgag

SEQ ID NO: 54082 - DNA, 25 bp, Homo sapien
ctagtgaaaataataggtctaatat

SEQ ID NO: 54083 - DNA, 25 bp, Homo sapien
ctagtgaaaatgataggtctaatat

SEQ ID NO: 54084 - DNA, 25 bp, Homo sapien
ctagtgaattgaccaatttataact

SEQ ID NO: 54085 - DNA, 25 bp, Homo sapien
ctagtgaattggccaatttataact

SEQ ID NO: 54086 - DNA, 25 bp, Homo sapien
ctagtgcctacacacgccttttgag

SEQ ID NO: 54087 - DNA, 25 bp, Homo sapien
ctagtgcctacacatgccttttgag

SEQ ID NO: 54088 - DNA, 25 bp, Homo sapien
ctagtgctaaaagcaaagtgaaagg

SEQ ID NO: 54089 - DNA, 25 bp, Homo sapien
ctagtgctatgaagtatttcctagg

SEQ ID NO: 54090 - DNA, 25 bp, Homo sapien
ctagtgctatggagtatttcctagg

SEQ ID NO: 54091 - DNA, 25 bp, Homo sapien
ctagtgctattagattacaacacgt

SEQ ID NO: 54092 - DNA, 25 bp, Homo sapien
ctagtgctattagattccaacacgt

SEQ ID NO: 54093 - DNA, 25 bp, Homo sapien
ctagtgctcaaagcaaagtgaaagg

SEQ ID NO: 54094 - DNA, 25 bp, Homo sapien
ctagtggcacgaagcaggaacattt

SEQ ID NO: 54095 - DNA, 25 bp, Homo sapien
ctagtggcatgaagcaggaacattt

SEQ ID NO: 54096 - DNA, 25 bp, Homo sapien
ctagtggccagttacatttctcatc

SEQ ID NO: 54097 - DNA, 25 bp, Homo sapien
ctagtggccagttgcatttctcatc

SEQ ID NO: 54098 - DNA, 25 bp, Homo sapien
ctagtggcgttcagtggtttaacgt

SEQ ID NO: 54099 - DNA, 25 bp, Homo sapien
ctagtggctttcagtggtttaacgt

SEQ ID NO: 54100 - DNA, 25 bp, Homo sapien
ctagtggttatttaagtcacccgtg

SEQ ID NO: 54101 - DNA, 25 bp, Homo sapien
ctagtggttatttaggtcacccgtg

SEQ ID NO: 54102 - DNA, 25 bp, Homo sapien
ctagtgtacgacaaagactactcca

SEQ ID NO: 54103 - DNA, 25 bp, Homo sapien
ctagtgtacgacaaaggctactcca

SEQ ID NO: 54104 - DNA, 25 bp, Homo sapien
ctagtgtccttgaaggttggtactc

SEQ ID NO: 54105 - DNA, 25 bp, Homo sapien
ctagtgtccttgagggttggtactc

SEQ ID NO: 54106 - DNA, 25 bp, Homo sapien
ctagtgtctgctaacaaaatgtcgg

SEQ ID NO: 54107 - DNA, 25 bp, Homo sapien
ctagtgtctgctaccaaaatgtcgg

SEQ ID NO: 54108 - DNA, 25 bp, Homo sapien
ctagtgtgtccagtagaaacacctg

SEQ ID NO: 54109 - DNA, 25 bp, Homo sapien
ctagtgtgtgcagtagaaacacctg

SEQ ID NO: 54110 - DNA, 25 bp, Homo sapien
ctagttaaatataacgttgaatttc

SEQ ID NO: 54111 - DNA, 25 bp, Homo sapien
ctagttaaatataatgttgaatttc

SEQ ID NO: 54112 - DNA, 25 bp, Homo sapien
ctagttaactcgaggattttctatt

SEQ ID NO: 54113 - DNA, 25 bp, Homo sapien
ctagttaactcgatgattttctatt

SEQ ID NO: 54114 - DNA, 25 bp, Homo sapien
ctagttactcttggcccaccactct

SEQ ID NO: 54115 - DNA, 25 bp, Homo sapien
ctagttacttttggcccaccactct

SEQ ID NO: 54116 - DNA, 25 bp, Homo sapien
ctagttcatgaggcgttaagaagga

SEQ ID NO: 54117 - DNA, 25 bp, Homo sapien
ctagttcatgaggtgttaagaagga

SEQ ID NO: 54118 - DNA, 25 bp, Homo sapien
ctagttctctccagtacagggattg

SEQ ID NO: 54119 - DNA, 25 bp, Homo sapien
ctagttctttccagtacagggattg

SEQ ID NO: 54120 - DNA, 25 bp, Homo sapien
ctagttgcacacaaaggcccaggaa

SEQ ID NO: 54121 - DNA, 25 bp, Homo sapien
ctagttgcacacaaagtcccaggaa

SEQ ID NO: 54122 - DNA, 25 bp, Homo sapien
ctagttggtagtagactggaattcc

SEQ ID NO: 54123 - DNA, 25 bp, Homo sapien
ctagttggtagtagcctggaattcc

SEQ ID NO: 54124 - DNA, 25 bp, Homo sapien
ctagttggtagtcaaatctcaccat

SEQ ID NO: 54125 - DNA, 25 bp, Homo sapien
ctagttggtagtcacatctcaccat

SEQ ID NO: 54126 - DNA, 25 bp, Homo sapien
ctagttgtccggagcttcctaggtt

SEQ ID NO: 54127 - DNA, 25 bp, Homo sapien
ctagttgtctggagcttcctaggtt

SEQ ID NO: 54128 - DNA, 25 bp, Homo sapien
ctagtttaaatctgaattcctgcaa

SEQ ID NO: 54129 - DNA, 25 bp, Homo sapien
ctagtttaaatcttaattcctgcaa

SEQ ID NO: 54130 - DNA, 25 bp, Homo sapien
ctagtttaatgaagtatggttgcag

SEQ ID NO: 54131 - DNA, 25 bp, Homo sapien
ctagtttaatgacgtatggttgcag

SEQ ID NO: 54132 - DNA, 25 bp, Homo sapien
ctagtttatagaagaactttccatc

SEQ ID NO: 54133 - DNA, 25 bp, Homo sapien
ctagtttatagaaggactttccatc

SEQ ID NO: 54134 - DNA, 25 bp, Homo sapien
ctagtttatccattattctgaataa

SEQ ID NO: 54135 - DNA, 25 bp, Homo sapien
ctagtttatcccttattctgaataa

SEQ ID NO: 54136 - DNA, 25 bp, Homo sapien
ctagtttccattacagaggtctttc

SEQ ID NO: 54137 - DNA, 25 bp, Homo sapien
ctagtttccattatagaggtctttc

SEQ ID NO: 54138 - DNA, 25 bp, Homo sapien
ctagtttctcatactacttgtctaa

SEQ ID NO: 54139 - DNA, 25 bp, Homo sapien
ctagtttcttatactacttgtctaa

SEQ ID NO: 54140 - DNA, 25 bp, Homo sapien
ctagttttttatcatgtgatattct

SEQ ID NO: 54141 - DNA, 25 bp, Homo sapien
ctagttttttatcgtgtgatattct

SEQ ID NO: 54142 - DNA, 25 bp, Homo sapien
ctataaaacaaacaaaattcaaact

SEQ ID NO: 54143 - DNA, 25 bp, Homo sapien
ctataaaacaaacaaacttcaaact

SEQ ID NO: 54144 - DNA, 25 bp, Homo sapien
ctataaaacaggttctttgaacaag

SEQ ID NO: 54145 - DNA, 25 bp, Homo sapien
ctataaaaccctgtaaaatcttgac

SEQ ID NO: 54146 - DNA, 25 bp, Homo sapien
ctataaaactcctagatcataacat

SEQ ID NO: 54147 - DNA, 25 bp, Homo sapien
ctataaaactcttagatcataacat

SEQ ID NO: 54148 - DNA, 25 bp, Homo sapien
ctataaaagacatagatcacctaga

SEQ ID NO: 54149 - DNA, 25 bp, Homo sapien
ctataaaagacgtagatcacctaga

SEQ ID NO: 54150 - DNA, 25 bp, Homo sapien
ctataaaagaggttctttgaacaag

SEQ ID NO: 54151 - DNA, 25 bp, Homo sapien
ctataaaatcctgtaaaatcttgac

SEQ ID NO: 54152 - DNA, 25 bp, Homo sapien
ctataaagaagaacaaagtgtggca

SEQ ID NO: 54153 - DNA, 25 bp, Homo sapien
ctataaagaagaccaaagtgtggca

SEQ ID NO: 54154 - DNA, 25 bp, Homo sapien
ctataaagcaaccatgcagtaggaa

SEQ ID NO: 54155 - DNA, 25 bp, Homo sapien
ctataaagtaaccatgcagtaggaa

SEQ ID NO: 54156 - DNA, 25 bp, Homo sapien
ctataaagtcacacactcttggatt

SEQ ID NO: 54157 - DNA, 25 bp, Homo sapien
ctataaagtcagacactcttggatt

SEQ ID NO: 54158 - DNA, 25 bp, Homo sapien
ctataaatatacctttcagagtgag

SEQ ID NO: 54159 - DNA, 25 bp, Homo sapien
ctataaatatactgacttctctaat

SEQ ID NO: 54160 - DNA, 25 bp, Homo sapien
ctataaatatacttttcagagtgag

SEQ ID NO: 54161 - DNA, 25 bp, Homo sapien
ctataaatatattgacttctctaat

SEQ ID NO: 54162 - DNA, 25 bp, Homo sapien
ctataaatcaggcattcgaggcaat

SEQ ID NO: 54163 - DNA, 25 bp, Homo sapien
ctataaatcaggtattcgaggcaat

SEQ ID NO: 54164 - DNA, 25 bp, Homo sapien
ctataaattattgatgagtaaagag

SEQ ID NO: 54165 - DNA, 25 bp, Homo sapien
ctataaattattggtgagtaaagag

SEQ ID NO: 54166 - DNA, 25 bp, Homo sapien
ctataacaaaagggtcttccatctc

SEQ ID NO: 54167 - DNA, 25 bp, Homo sapien
ctataacaacagggtcttccatctc

SEQ ID NO: 54168 - DNA, 25 bp, Homo sapien
ctataactccaaagctcatttgatt

SEQ ID NO: 54169 - DNA, 25 bp, Homo sapien
ctataactccaatgctcatttgatt

SEQ ID NO: 54170 - DNA, 25 bp, Homo sapien
ctataactgagaaccacaaactgag

SEQ ID NO: 54171 - DNA, 25 bp, Homo sapien
ctataactgagaaccataaactgag

SEQ ID NO: 54172 - DNA, 25 bp, Homo sapien
ctataacttatctcccagcctttct

SEQ ID NO: 54173 - DNA, 25 bp, Homo sapien
ctataacttgtctcccagcctttct

SEQ ID NO: 54174 - DNA, 25 bp, Homo sapien
ctataagaagttgcttttatatggg

SEQ ID NO: 54175 - DNA, 25 bp, Homo sapien
ctataagagaataaattcatgttgt

SEQ ID NO: 54176 - DNA, 25 bp, Homo sapien
ctataagagcataaattcatgttgt

SEQ ID NO: 54177 - DNA, 25 bp, Homo sapien
ctataagaggttgcttttatatggg

SEQ ID NO: 54178 - DNA, 25 bp, Homo sapien
ctataataataatgcgtatgaagcg

SEQ ID NO: 54179 - DNA, 25 bp, Homo sapien
ctataataataatgtgtatgaagcg

SEQ ID NO: 54180 - DNA, 25 bp, Homo sapien
ctataatcatggcagatgaaataaa

SEQ ID NO: 54181 - DNA, 25 bp, Homo sapien
ctataatcatggcggatgaaataaa

SEQ ID NO: 54182 - DNA, 25 bp, Homo sapien
ctataatctgtgaaaagtgtgttca

SEQ ID NO: 54183 - DNA, 25 bp, Homo sapien
ctataatctgtgaagagtgtgttca

SEQ ID NO: 54184 - DNA, 25 bp, Homo sapien
ctataatgtggtaaagattagtatt

SEQ ID NO: 54185 - DNA, 25 bp, Homo sapien
ctataatgtggtcaagattagtatt

SEQ ID NO: 54186 - DNA, 25 bp, Homo sapien
ctataattcctctcatgccctgcct

SEQ ID NO: 54187 - DNA, 25 bp, Homo sapien
ctataattcctctcgtgccctgcct

SEQ ID NO: 54188 - DNA, 25 bp, Homo sapien
ctataattctagcgcagagacttcc

SEQ ID NO: 54189 - DNA, 25 bp, Homo sapien
ctataattctagctcagagacttcc

SEQ ID NO: 54190 - DNA, 25 bp, Homo sapien
ctataattggatagataagacagga

SEQ ID NO: 54191 - DNA, 25 bp, Homo sapien
ctataattggatggataagacagga

SEQ ID NO: 54192 - DNA, 25 bp, Homo sapien
ctataattggtgattcctatcatcc

SEQ ID NO: 54193 - DNA, 25 bp, Homo sapien
ctataattggtggttcctatcatcc

SEQ ID NO: 54194 - DNA, 25 bp, Homo sapien
ctataattgtactgaggaatcattg

SEQ ID NO: 54195 - DNA, 25 bp, Homo sapien
ctataattgtagtgaggaatcattg

SEQ ID NO: 54196 - DNA, 25 bp, Homo sapien
ctatacaaaatccatcttttcagtc

SEQ ID NO: 54197 - DNA, 25 bp, Homo sapien
ctatacaaaatgcatcttttcagtc

SEQ ID NO: 54198 - DNA, 25 bp, Homo sapien
ctatacagcaggataagcaataaag

SEQ ID NO: 54199 - DNA, 25 bp, Homo sapien
ctatacagcaggttaagcaataaag

SEQ ID NO: 54200 - DNA, 25 bp, Homo sapien
ctatacagtgtctacacatttgatg

SEQ ID NO: 54201 - DNA, 25 bp, Homo sapien
ctatacagtgtctacatatttgatg

SEQ ID NO: 54202 - DNA, 25 bp, Homo sapien
ctatacattcatcctcttgcccatc

SEQ ID NO: 54203 - DNA, 25 bp, Homo sapien
ctatacattcattctcttgcccatc

SEQ ID NO: 54204 - DNA, 25 bp, Homo sapien
ctatacatttagaaaagagcaaacc

SEQ ID NO: 54205 - DNA, 25 bp, Homo sapien
ctatacatttagagaagagcaaacc

SEQ ID NO: 54206 - DNA, 25 bp, Homo sapien
ctataccaattcccacaggttaagg

SEQ ID NO: 54207 - DNA, 25 bp, Homo sapien
ctataccagttcccacaggttaagg

SEQ ID NO: 54208 - DNA, 25 bp, Homo sapien
ctatacccttaaagaccctttctgc

SEQ ID NO: 54209 - DNA, 25 bp, Homo sapien
ctatacccttaaagactctttctgc

SEQ ID NO: 54210 - DNA, 25 bp, Homo sapien
ctatacctcgcaaccttgcatgtaa

SEQ ID NO: 54211 - DNA, 25 bp, Homo sapien
ctataccttgcaaccttgcatgtaa

SEQ ID NO: 54212 - DNA, 25 bp, Homo sapien
ctatacctttaatgcaactccatca

SEQ ID NO: 54213 - DNA, 25 bp, Homo sapien
ctatacctttaatgcacctccatca

SEQ ID NO: 54214 - DNA, 25 bp, Homo sapien
ctatactaaataaacgcttggagtg

SEQ ID NO: 54215 - DNA, 25 bp, Homo sapien
ctatactaaataaatgcttggagtg

SEQ ID NO: 54216 - DNA, 25 bp, Homo sapien
ctatactgttccattcctgttacac

SEQ ID NO: 54217 - DNA, 25 bp, Homo sapien
ctatactgttccattcttgttacac

SEQ ID NO: 54218 - DNA, 25 bp, Homo sapien
ctatacttgttccctggccagcctt

SEQ ID NO: 54219 - DNA, 25 bp, Homo sapien
ctatacttgtttcctggccagcctt

SEQ ID NO: 54220 - DNA, 25 bp, Homo sapien
ctatactttgaaatacagaaaatca

SEQ ID NO: 54221 - DNA, 25 bp, Homo sapien
ctatactttgaaatacggaaaatca

SEQ ID NO: 54222 - DNA, 25 bp, Homo sapien
ctatagaaagtctcttatgccatgg

SEQ ID NO: 54223 - DNA, 25 bp, Homo sapien
ctatagaaagtcttttatgccatgg

SEQ ID NO: 54224 - DNA, 25 bp, Homo sapien
ctatagaacataaacccatgcattt

SEQ ID NO: 54225 - DNA, 25 bp, Homo sapien
ctatagaatataaacccatgcattt

SEQ ID NO: 54226 - DNA, 25 bp, Homo sapien
ctatagagcatttcaggaatggata

SEQ ID NO: 54227 - DNA, 25 bp, Homo sapien
ctatagagcatttgaggaatggata

SEQ ID NO: 54228 - DNA, 25 bp, Homo sapien
ctatagatatcctcacagtactcat

SEQ ID NO: 54229 - DNA, 25 bp, Homo sapien
ctatagatatcctcacggtactcat

SEQ ID NO: 54230 - DNA, 25 bp, Homo sapien
ctataggaactagaaaatcaaggac

SEQ ID NO: 54231 - DNA, 25 bp, Homo sapien
ctataggagctagaaaatcaaggac

SEQ ID NO: 54232 - DNA, 25 bp, Homo sapien
ctataggtaaagggacatactaatt

SEQ ID NO: 54233 - DNA, 25 bp, Homo sapien
ctataggtaaatggacatactaatt

SEQ ID NO: 54234 - DNA, 25 bp, Homo sapien
ctataggtgactagatgttcgagct

SEQ ID NO: 54235 - DNA, 25 bp, Homo sapien
ctataggtgtgctagaatgtactca

SEQ ID NO: 54236 - DNA, 25 bp, Homo sapien
ctataggtgtgttagaatgtactca

SEQ ID NO: 54237 - DNA, 25 bp, Homo sapien
ctataggttactagatgttcgagct

SEQ ID NO: 54238 - DNA, 25 bp, Homo sapien
ctatagtaatcaattttatgtatat

SEQ ID NO: 54239 - DNA, 25 bp, Homo sapien
ctatagtaatcatttttatgtatat

SEQ ID NO: 54240 - DNA, 25 bp, Homo sapien
ctatagtcaaagaaattaaagcaga

SEQ ID NO: 54241 - DNA, 25 bp, Homo sapien
ctatagtcaaataaattaaagcaga

SEQ ID NO: 54242 - DNA, 25 bp, Homo sapien
ctatagtgaaaaaccgaatattcca

SEQ ID NO: 54243 - DNA, 25 bp, Homo sapien
ctatagtgaaaatccgaatattcca

SEQ ID NO: 54244 - DNA, 25 bp, Homo sapien
ctatagtgggaccaaagagagagaa

SEQ ID NO: 54245 - DNA, 25 bp, Homo sapien
ctatagtgggatcaaagagagagaa

SEQ ID NO: 54246 - DNA, 25 bp, Homo sapien
ctatagttactgaacattgaatatc

SEQ ID NO: 54247 - DNA, 25 bp, Homo sapien
ctatagttattgaacattgaatatc

SEQ ID NO: 54248 - DNA, 25 bp, Homo sapien
ctatataaaaatcaaagcaaaagtt

SEQ ID NO: 54249 - DNA, 25 bp, Homo sapien
ctatataaatatcaaagcaaaagtt

SEQ ID NO: 54250 - DNA, 25 bp, Homo sapien
ctatatagaaaaagaagttggatga

SEQ ID NO: 54251 - DNA, 25 bp, Homo sapien
ctatatagagaaagaagttggatga

SEQ ID NO: 54252 - DNA, 25 bp, Homo sapien
ctatatattgctttaagaagtgcgg

SEQ ID NO: 54253 - DNA, 25 bp, Homo sapien
ctatatattgctttgagaagtgcgg

SEQ ID NO: 54254 - DNA, 25 bp, Homo sapien
ctatatcctttactatcctcttagt

SEQ ID NO: 54255 - DNA, 25 bp, Homo sapien
ctatatcctttactattctcttagt

SEQ ID NO: 54256 - DNA, 25 bp, Homo sapien
ctatatctaaagtacaaaagcttca

SEQ ID NO: 54257 - DNA, 25 bp, Homo sapien
ctatatcttaagtacaaaagcttca

SEQ ID NO: 54258 - DNA, 25 bp, Homo sapien
ctatatgcaagaatggcaattatta

SEQ ID NO: 54259 - DNA, 25 bp, Homo sapien
ctatatgcaggaatggcaattatta

SEQ ID NO: 54260 - DNA, 25 bp, Homo sapien
ctatattgacaaacactcagaccag

SEQ ID NO: 54261 - DNA, 25 bp, Homo sapien
ctatattgacaaatactcagaccag

SEQ ID NO: 54262 - DNA, 25 bp, Homo sapien
ctatattttagtgcactggttccct

SEQ ID NO: 54263 - DNA, 25 bp, Homo sapien
ctatattttagtgcgctggttccct

SEQ ID NO: 54264 - DNA, 25 bp, Homo sapien
ctatcaaaacatacgaaaacctaaa

SEQ ID NO: 54265 - DNA, 25 bp, Homo sapien
ctatcaaaacatatgaaaacctaaa

SEQ ID NO: 54266 - DNA, 25 bp, Homo sapien
ctatcaacagcacacaaaccttggt

SEQ ID NO: 54267 - DNA, 25 bp, Homo sapien
ctatcaacatcacacaaaccttggt

SEQ ID NO: 54268 - DNA, 25 bp, Homo sapien
ctatcaccattgcaaacctgatatg

SEQ ID NO: 54269 - DNA, 25 bp, Homo sapien
ctatcaccgttgcaaacctgatatg

SEQ ID NO: 54270 - DNA, 25 bp, Homo sapien
ctatcacctttgatgagtggccatc

SEQ ID NO: 54271 - DNA, 25 bp, Homo sapien
ctatcacctttgttgagtggccatc

SEQ ID NO: 54272 - DNA, 25 bp, Homo sapien
ctatcactgcttctggttgaatcat

SEQ ID NO: 54273 - DNA, 25 bp, Homo sapien
ctatcactgcttttggttgaatcat

SEQ ID NO: 54274 - DNA, 25 bp, Homo sapien
ctatcactggcctgactaccactgg

SEQ ID NO: 54275 - DNA, 25 bp, Homo sapien
ctatcactggcttgactaccactgg

SEQ ID NO: 54276 - DNA, 25 bp, Homo sapien
ctatcagacattcaaaagagaattg

SEQ ID NO: 54277 - DNA, 25 bp, Homo sapien
ctatcagacgttcaaaagagaattg

SEQ ID NO: 54278 - DNA, 25 bp, Homo sapien
ctatcagggtcattagaaaattggc

SEQ ID NO: 54279 - DNA, 25 bp, Homo sapien
ctatcagggtcgttagaaaattggc

SEQ ID NO: 54280 - DNA, 25 bp, Homo sapien
ctatcatcattgacccacattgtgg

SEQ ID NO: 54281 - DNA, 25 bp, Homo sapien
ctatcatcattggcccacattgtgg

SEQ ID NO: 54282 - DNA, 25 bp, Homo sapien
ctatcatctccaccgttattatttt

SEQ ID NO: 54283 - DNA, 25 bp, Homo sapien
ctatcatctccactgttattatttt

SEQ ID NO: 54284 - DNA, 25 bp, Homo sapien
ctatcatcttctcctgcctaaacaa

SEQ ID NO: 54285 - DNA, 25 bp, Homo sapien
ctatcatcttctcctgtctaaacaa

SEQ ID NO: 54286 - DNA, 25 bp, Homo sapien
ctatcatgaaatccaaacctcgtca

SEQ ID NO: 54287 - DNA, 25 bp, Homo sapien
ctatcatgaaattcaaacctcgtca

SEQ ID NO: 54288 - DNA, 25 bp, Homo sapien
ctatcattgtacaactgcactccaa

SEQ ID NO: 54289 - DNA, 25 bp, Homo sapien
ctatcattgtacgactgcactccaa

SEQ ID NO: 54290 - DNA, 25 bp, Homo sapien
ctatcatttggtagcatttaaggca

SEQ ID NO: 54291 - DNA, 25 bp, Homo sapien
ctatcatttggtggcatttaaggca

SEQ ID NO: 54292 - DNA, 25 bp, Homo sapien
ctatcattttatcctatctgagtcc

SEQ ID NO: 54293 - DNA, 25 bp, Homo sapien
ctatcattttattctatctgagtcc

SEQ ID NO: 54294 - DNA, 25 bp, Homo sapien
ctatccaaagaaggcataagttgtt

SEQ ID NO: 54295 - DNA, 25 bp, Homo sapien
ctatccaaagatggcataagttgtt

SEQ ID NO: 54296 - DNA, 25 bp, Homo sapien
ctatccaactggcagcactgtaggt

SEQ ID NO: 54297 - DNA, 25 bp, Homo sapien
ctatccaactgggagcactgtaggt

SEQ ID NO: 54298 - DNA, 25 bp, Homo sapien
ctatccacaatgacctactttctgt

SEQ ID NO: 54299 - DNA, 25 bp, Homo sapien
ctatccacctgcaggtttacaaagg

SEQ ID NO: 54300 - DNA, 25 bp, Homo sapien
ctatccacctgcgggtttacaaagg

SEQ ID NO: 54301 - DNA, 25 bp, Homo sapien
ctatccactatgacctactttctgt

SEQ ID NO: 54302 - DNA, 25 bp, Homo sapien
ctatccacttccaatcttaccaatt

SEQ ID NO: 54303 - DNA, 25 bp, Homo sapien
ctatccacttctaatcttaccaatt

SEQ ID NO: 54304 - DNA, 25 bp, Homo sapien
ctatccagagtatgctactttccga

SEQ ID NO: 54305 - DNA, 25 bp, Homo sapien
ctatccagagtatgcttctttccga

SEQ ID NO: 54306 - DNA, 25 bp, Homo sapien
ctatccagctgttatttttgtatgt

SEQ ID NO: 54307 - DNA, 25 bp, Homo sapien
ctatccagctgttctttttgtatgt

SEQ ID NO: 54308 - DNA, 25 bp, Homo sapien
ctatccagtttagacagagtctgct

SEQ ID NO: 54309 - DNA, 25 bp, Homo sapien
ctatccagtttagatagagtctgct

SEQ ID NO: 54310 - DNA, 25 bp, Homo sapien
ctatccataattctgtttctttttt

SEQ ID NO: 54311 - DNA, 25 bp, Homo sapien
ctatccataattttgtttctttttt

SEQ ID NO: 54312 - DNA, 25 bp, Homo sapien
ctatccatagcaggcttcttggcca

SEQ ID NO: 54313 - DNA, 25 bp, Homo sapien
ctatccatcgcaggcttcttggcca

SEQ ID NO: 54314 - DNA, 25 bp, Homo sapien
ctatcccagtttataagcagccctt

SEQ ID NO: 54315 - DNA, 25 bp, Homo sapien
ctatcccagtttctaagcagccctt

SEQ ID NO: 54316 - DNA, 25 bp, Homo sapien
ctatccccaaaattaacgcttagct

SEQ ID NO: 54317 - DNA, 25 bp, Homo sapien
ctatccccaaaattaatgcttagct

SEQ ID NO: 54318 - DNA, 25 bp, Homo sapien
ctatccctatacaccaaggtttgct

SEQ ID NO: 54319 - DNA, 25 bp, Homo sapien
ctatccctatataccaaggtttgct

SEQ ID NO: 54320 - DNA, 25 bp, Homo sapien
ctatccctgggcggtcacgttggct

SEQ ID NO: 54321 - DNA, 25 bp, Homo sapien
ctatccctgggtggtcacgttggct

SEQ ID NO: 54322 - DNA, 25 bp, Homo sapien
ctatccgagtattacattgccacta

SEQ ID NO: 54323 - DNA, 25 bp, Homo sapien
ctatccgagtattatattgccacta

SEQ ID NO: 54324 - DNA, 25 bp, Homo sapien
ctatccttggcaagagttcactgca

SEQ ID NO: 54325 - DNA, 25 bp, Homo sapien
ctatccttggcgagagttcactgca

SEQ ID NO: 54326 - DNA, 25 bp, Homo sapien
ctatccttttaattgcttatagtgt

SEQ ID NO: 54327 - DNA, 25 bp, Homo sapien
ctatccttttatttgcttatagtgt

SEQ ID NO: 54328 - DNA, 25 bp, Homo sapien
ctatctaactcagaccaatgggtgg

SEQ ID NO: 54329 - DNA, 25 bp, Homo sapien
ctatctaactcataccaatgggtgg

SEQ ID NO: 54330 - DNA, 25 bp, Homo sapien
ctatctacggtaggtcattaagcag

SEQ ID NO: 54331 - DNA, 25 bp, Homo sapien
ctatctacggtaggtcgttaagcag

SEQ ID NO: 54332 - DNA, 25 bp, Homo sapien
ctatctatggcagttacggatgtat

SEQ ID NO: 54333 - DNA, 25 bp, Homo sapien
ctatctatggcagttatggatgtat

SEQ ID NO: 54334 - DNA, 25 bp, Homo sapien
ctatctattcgcgaacaaaaggaag

SEQ ID NO: 54335 - DNA, 25 bp, Homo sapien
ctatctattcgggaacaaaaggaag

SEQ ID NO: 54336 - DNA, 25 bp, Homo sapien
ctatctcaatgatatacccagttgc

SEQ ID NO: 54337 - DNA, 25 bp, Homo sapien
ctatctcagtgatatacccagttgc

SEQ ID NO: 54338 - DNA, 25 bp, Homo sapien
ctatctcggctgagataaaacaagg

SEQ ID NO: 54339 - DNA, 25 bp, Homo sapien
ctatctcggctgaggtaaaacaagg

SEQ ID NO: 54340 - DNA, 25 bp, Homo sapien
ctatctctaaactaccactggcaag

SEQ ID NO: 54341 - DNA, 25 bp, Homo sapien
ctatctctaaactatcactggcaag

SEQ ID NO: 54342 - DNA, 25 bp, Homo sapien
ctatctctccgtttacttaggtatt

SEQ ID NO: 54343 - DNA, 25 bp, Homo sapien
ctatctctctccgttgcatcatatg

SEQ ID NO: 54344 - DNA, 25 bp, Homo sapien
ctatctctctctgttgcatcatatg

SEQ ID NO: 54345 - DNA, 25 bp, Homo sapien
ctatctcttcgtttacttaggtatt

SEQ ID NO: 54346 - DNA, 25 bp, Homo sapien
ctatctgcacttcatttaaatgctt

SEQ ID NO: 54347 - DNA, 25 bp, Homo sapien
ctatctgcactttatttaaatgctt

SEQ ID NO: 54348 - DNA, 25 bp, Homo sapien
ctatctgccttctataactccatat

SEQ ID NO: 54349 - DNA, 25 bp, Homo sapien
ctatctgccttctgtaactccatat

SEQ ID NO: 54350 - DNA, 25 bp, Homo sapien
ctatctgggttgaagtttaatttct

SEQ ID NO: 54351 - DNA, 25 bp, Homo sapien
ctatctgggttgaggtttaatttct

SEQ ID NO: 54352 - DNA, 25 bp, Homo sapien
ctatctggtataaattttcttcaaa

SEQ ID NO: 54353 - DNA, 25 bp, Homo sapien
ctatctggtataatttttcttcaaa

SEQ ID NO: 54354 - DNA, 25 bp, Homo sapien
ctatctgtattacactttaaagcaa

SEQ ID NO: 54355 - DNA, 25 bp, Homo sapien
ctatctgtattatactttaaagcaa

SEQ ID NO: 54356 - DNA, 25 bp, Homo sapien
ctatctgtccctatgcaatgagaaa

SEQ ID NO: 54357 - DNA, 25 bp, Homo sapien
ctatctgtccctatgcgatgagaaa

SEQ ID NO: 54358 - DNA, 25 bp, Homo sapien
ctatcttccagcctttctattgaag

SEQ ID NO: 54359 - DNA, 25 bp, Homo sapien
ctatcttccagcctttttattgaag

SEQ ID NO: 54360 - DNA, 25 bp, Homo sapien
ctatcttgacttctactcttgagca

SEQ ID NO: 54361 - DNA, 25 bp, Homo sapien
ctatcttgacttttactcttgagca

SEQ ID NO: 54362 - DNA, 25 bp, Homo sapien
ctatcttgagaatggaatttgccac

SEQ ID NO: 54363 - DNA, 25 bp, Homo sapien
ctatcttgagagtggaatttgccac

SEQ ID NO: 54364 - DNA, 25 bp, Homo sapien
ctatcttgatcccctgaaaaaaaga

SEQ ID NO: 54365 - DNA, 25 bp, Homo sapien
ctatcttgatctcctgaaaaaaaga

SEQ ID NO: 54366 - DNA, 25 bp, Homo sapien
ctatgaaagtctaatagtgcaattc

SEQ ID NO: 54367 - DNA, 25 bp, Homo sapien
ctatgaaagtctaatattgcaattc

SEQ ID NO: 54368 - DNA, 25 bp, Homo sapien
ctatgaaatccataagcctccatat

SEQ ID NO: 54369 - DNA, 25 bp, Homo sapien
ctatgaaatccgtaagcctccatat

SEQ ID NO: 54370 - DNA, 25 bp, Homo sapien
ctatgaataactacatcttattttt

SEQ ID NO: 54371 - DNA, 25 bp, Homo sapien
ctatgaataactacattttattttt

SEQ ID NO: 54372 - DNA, 25 bp, Homo sapien
ctatgaattttccgtctttaattct

SEQ ID NO: 54373 - DNA, 25 bp, Homo sapien
ctatgaattttctgtctttaattct

SEQ ID NO: 54374 - DNA, 25 bp, Homo sapien
ctatgactaaaaaaatgcacatccc

SEQ ID NO: 54375 - DNA, 25 bp, Homo sapien
ctatgactaaaacaatgcacatccc

SEQ ID NO: 54376 - DNA, 25 bp, Homo sapien
ctatgagacggactaacacccatgg

SEQ ID NO: 54377 - DNA, 25 bp, Homo sapien
ctatgagatggactaacacccatgg

SEQ ID NO: 54378 - DNA, 25 bp, Homo sapien
ctatgaggttttcgatttactttgt

SEQ ID NO: 54379 - DNA, 25 bp, Homo sapien
ctatgaggtttttgatttactttgt

SEQ ID NO: 54380 - DNA, 25 bp, Homo sapien
ctatgatcatctggccaattctata

SEQ ID NO: 54381 - DNA, 25 bp, Homo sapien
ctatgatcatctggtcaattctata

SEQ ID NO: 54382 - DNA, 25 bp, Homo sapien
ctatgatcattatcctatcccattt

SEQ ID NO: 54383 - DNA, 25 bp, Homo sapien
ctatgatcattatcttatcccattt

SEQ ID NO: 54384 - DNA, 25 bp, Homo sapien
ctatgatgcctcagcggtgaccatt

SEQ ID NO: 54385 - DNA, 25 bp, Homo sapien
ctatgatgcttcagcggtgaccatt

SEQ ID NO: 54386 - DNA, 25 bp, Homo sapien
ctatgcacacccatctgtcatttgg

SEQ ID NO: 54387 - DNA, 25 bp, Homo sapien
ctatgcacgcccatctgtcatttgg

SEQ ID NO: 54388 - DNA, 25 bp, Homo sapien
ctatgcataccacaaaaggaaaaga

SEQ ID NO: 54389 - DNA, 25 bp, Homo sapien
ctatgcataccataaaaggaaaaga

SEQ ID NO: 54390 - DNA, 25 bp, Homo sapien
ctatgcctacccgattctgatagtt

SEQ ID NO: 54391 - DNA, 25 bp, Homo sapien
ctatgcctacctgattctgatagtt

SEQ ID NO: 54392 - DNA, 25 bp, Homo sapien
ctatgcctctccactcgcaaagtca

SEQ ID NO: 54393 - DNA, 25 bp, Homo sapien
ctatgcctctctactcgcaaagtca

SEQ ID NO: 54394 - DNA, 25 bp, Homo sapien
ctatgcctgtgatgtgactaacttt

SEQ ID NO: 54395 - DNA, 25 bp, Homo sapien
ctatgcctgtgatttgactaacttt

SEQ ID NO: 54396 - DNA, 25 bp, Homo sapien
ctatgctacactacacaacttgata

SEQ ID NO: 54397 - DNA, 25 bp, Homo sapien
ctatgctacactatacaacttgata

SEQ ID NO: 54398 - DNA, 25 bp, Homo sapien
ctatgctgaggaaaaagtgcacgca

SEQ ID NO: 54399 - DNA, 25 bp, Homo sapien
ctatgctgagggaaaagtgcacgca

SEQ ID NO: 54400 - DNA, 25 bp, Homo sapien
ctatgctttgtgaatgcctgttaac

SEQ ID NO: 54401 - DNA, 25 bp, Homo sapien
ctatgctttgtgaatgtctgttaac

SEQ ID NO: 54402 - DNA, 25 bp, Homo sapien
ctatggaaactaatatctttgaaca

SEQ ID NO: 54403 - DNA, 25 bp, Homo sapien
ctatggaaactagtatctttgaaca

SEQ ID NO: 54404 - DNA, 25 bp, Homo sapien
ctatggaacactgcaacatatttct

SEQ ID NO: 54405 - DNA, 25 bp, Homo sapien
ctatggaacactggaacatatttct

SEQ ID NO: 54406 - DNA, 25 bp, Homo sapien
ctatggaacccagttttttctttaa

SEQ ID NO: 54407 - DNA, 25 bp, Homo sapien
ctatggaacccatttttttctttaa

SEQ ID NO: 54408 - DNA, 25 bp, Homo sapien
ctatggaagagagccgttttctacc

SEQ ID NO: 54409 - DNA, 25 bp, Homo sapien
ctatggaagagagctgttttctacc

SEQ ID NO: 54410 - DNA, 25 bp, Homo sapien
ctatggaagaggtaattgccccacc

SEQ ID NO: 54411 - DNA, 25 bp, Homo sapien
ctatggaagaggtcattgccccacc

SEQ ID NO: 54412 - DNA, 25 bp, Homo sapien
ctatggacacaaaactggtgtgata

SEQ ID NO: 54413 - DNA, 25 bp, Homo sapien
ctatggactcaaaactggtgtgata

SEQ ID NO: 54414 - DNA, 25 bp, Homo sapien
ctatggagttgtgtcacctatcagc

SEQ ID NO: 54415 - DNA, 25 bp, Homo sapien
ctatggagttgtgtcatctatcagc

SEQ ID NO: 54416 - DNA, 25 bp, Homo sapien
ctatggcaaccttgacagctcagtc

SEQ ID NO: 54417 - DNA, 25 bp, Homo sapien
ctatggcaatcttgacagctcagtc

SEQ ID NO: 54418 - DNA, 25 bp, Homo sapien
ctatggcagttacggatgtatgaaa

SEQ ID NO: 54419 - DNA, 25 bp, Homo sapien
ctatggcagttatggatgtatgaaa

SEQ ID NO: 54420 - DNA, 25 bp, Homo sapien
ctatggcccaaccaatgctttcttg

SEQ ID NO: 54421 - DNA, 25 bp, Homo sapien
ctatggcccaaccgatgctttcttg

SEQ ID NO: 54422 - DNA, 25 bp, Homo sapien
ctatggctatttatcctgcttacaa

SEQ ID NO: 54423 - DNA, 25 bp, Homo sapien
ctatggctatttatgctgcttacaa

SEQ ID NO: 54424 - DNA, 25 bp, Homo sapien
ctatggctcacgactccacataaat

SEQ ID NO: 54425 - DNA, 25 bp, Homo sapien
ctatggctccaaaggtcttaataat

SEQ ID NO: 54426 - DNA, 25 bp, Homo sapien
ctatggctcgcgactccacataaat

SEQ ID NO: 54427 - DNA, 25 bp, Homo sapien
ctatggcttcaaaggtcttaataat

SEQ ID NO: 54428 - DNA, 25 bp, Homo sapien
ctatgggcacccaaaccaagcagtt

SEQ ID NO: 54429 - DNA, 25 bp, Homo sapien
ctatgggcacccacaccaagcagtt

SEQ ID NO: 54430 - DNA, 25 bp, Homo sapien
ctatgggggtggcttaatgacatag

SEQ ID NO: 54431 - DNA, 25 bp, Homo sapien
ctatgggggtggtttaatgacatag

SEQ ID NO: 54432 - DNA, 25 bp, Homo sapien
ctatggtctctgagtgatagtgatg

SEQ ID NO: 54433 - DNA, 25 bp, Homo sapien
ctatggtctcttagtgatagtgatg

SEQ ID NO: 54434 - DNA, 25 bp, Homo sapien
ctatggtgtaatactagatccctgc

SEQ ID NO: 54435 - DNA, 25 bp, Homo sapien
ctatggtgtgatactagatccctgc

SEQ ID NO: 54436 - DNA, 25 bp, Homo sapien
ctatggttacacgtccttccctgga

SEQ ID NO: 54437 - DNA, 25 bp, Homo sapien
ctatggttacatgtccttccctgga

SEQ ID NO: 54438 - DNA, 25 bp, Homo sapien
ctatgtaaggttactcaagggttta

SEQ ID NO: 54439 - DNA, 25 bp, Homo sapien
ctatgtaatgttactcaagggttta

SEQ ID NO: 54440 - DNA, 25 bp, Homo sapien
ctatgtcaaacttcatatcacttga

SEQ ID NO: 54441 - DNA, 25 bp, Homo sapien
ctatgtcaaacttcgtatcacttga

SEQ ID NO: 54442 - DNA, 25 bp, Homo sapien
ctatgtctatatctaagagaaagaa

SEQ ID NO: 54443 - DNA, 25 bp, Homo sapien
ctatgtctgtatctaagagaaagaa

SEQ ID NO: 54444 - DNA, 25 bp, Homo sapien
ctatgtgacttcagccaaatcactt

SEQ ID NO: 54445 - DNA, 25 bp, Homo sapien
ctatgtgacttcggccaaatcactt

SEQ ID NO: 54446 - DNA, 25 bp, Homo sapien
ctatgtgagggactaaaaaaacctg

SEQ ID NO: 54447 - DNA, 25 bp, Homo sapien
ctatgtgagggattaaaaaaacctg

SEQ ID NO: 54448 - DNA, 25 bp, Homo sapien
ctatgtgccaatcctctaagtcctc

SEQ ID NO: 54449 - DNA, 25 bp, Homo sapien
ctatgtgccaattctctaagtcctc

SEQ ID NO: 54450 - DNA, 25 bp, Homo sapien
ctatgtgttcaatacagatgcagcc

SEQ ID NO: 54451 - DNA, 25 bp, Homo sapien
ctatgtgttcagtacagatgcagcc

SEQ ID NO: 54452 - DNA, 25 bp, Homo sapien
ctatgttacatatattcatagactg

SEQ ID NO: 54453 - DNA, 25 bp, Homo sapien
ctatgttacatgtattcatagactg

SEQ ID NO: 54454 - DNA, 25 bp, Homo sapien
ctatgttcagagagcgtctaccctc

SEQ ID NO: 54455 - DNA, 25 bp, Homo sapien
ctatgttcagagagtgtctaccctc

SEQ ID NO: 54456 - DNA, 25 bp, Homo sapien
ctatgttgccatactcccataacgt

SEQ ID NO: 54457 - DNA, 25 bp, Homo sapien
ctatgttgtcatactcccataacgt

SEQ ID NO: 54458 - DNA, 25 bp, Homo sapien
ctatgttgtctaagctaatcataaa

SEQ ID NO: 54459 - DNA, 25 bp, Homo sapien
ctatgttgtctgagctaatcataaa

SEQ ID NO: 54460 - DNA, 25 bp, Homo sapien
ctatgttttatcatttatcagttgg

SEQ ID NO: 54461 - DNA, 25 bp, Homo sapien
ctatgttttatgatttatcagttgg

SEQ ID NO: 54462 - DNA, 25 bp, Homo sapien
ctattaaaacaattttggcaactat

SEQ ID NO: 54463 - DNA, 25 bp, Homo sapien
ctattaaaagaattttggcaactat

SEQ ID NO: 54464 - DNA, 25 bp, Homo sapien
ctattaaacaagtcacacccttctt

SEQ ID NO: 54465 - DNA, 25 bp, Homo sapien
ctattaaacaagtcgcacccttctt

SEQ ID NO: 54466 - DNA, 25 bp, Homo sapien
ctattaactctcaattactagacat

SEQ ID NO: 54467 - DNA, 25 bp, Homo sapien
ctattaacttacccaatccttacaa

SEQ ID NO: 54468 - DNA, 25 bp, Homo sapien
ctattaacttacctaatccttacaa

SEQ ID NO: 54469 - DNA, 25 bp, Homo sapien
ctattaactttcaattactagacat

SEQ ID NO: 54470 - DNA, 25 bp, Homo sapien
ctattacctgtaaccggtccttgtc

SEQ ID NO: 54471 - DNA, 25 bp, Homo sapien
ctattacctgtaactggtccttgtc

SEQ ID NO: 54472 - DNA, 25 bp, Homo sapien
ctattactccacacttcaaggtcaa

SEQ ID NO: 54473 - DNA, 25 bp, Homo sapien
ctattactccatacttcaaggtcaa

SEQ ID NO: 54474 - DNA, 25 bp, Homo sapien
ctattacttctgtaacaaattgcca

SEQ ID NO: 54475 - DNA, 25 bp, Homo sapien
ctattacttctgtaaccaattgcca

SEQ ID NO: 54476 - DNA, 25 bp, Homo sapien
ctattagatgagctaccagagatga

SEQ ID NO: 54477 - DNA, 25 bp, Homo sapien
ctattagatgagttaccagagatga

SEQ ID NO: 54478 - DNA, 25 bp, Homo sapien
ctattagctataccaaggttacttc

SEQ ID NO: 54479 - DNA, 25 bp, Homo sapien
ctattagctctaccaaggttacttc

SEQ ID NO: 54480 - DNA, 25 bp, Homo sapien
ctattaggcaataacactacttgct

SEQ ID NO: 54481 - DNA, 25 bp, Homo sapien
ctattaggcaataatactacttgct

SEQ ID NO: 54482 - DNA, 25 bp, Homo sapien
ctattataaacatatttaggagacc

SEQ ID NO: 54483 - DNA, 25 bp, Homo sapien
ctattataaacatgtttaggagacc

SEQ ID NO: 54484 - DNA, 25 bp, Homo sapien
ctattatggactaaacattgggtca

SEQ ID NO: 54485 - DNA, 25 bp, Homo sapien
ctattatggactagacattgggtca

SEQ ID NO: 54486 - DNA, 25 bp, Homo sapien
ctattattcctacgtgtttctttta

SEQ ID NO: 54487 - DNA, 25 bp, Homo sapien
ctattattcctatgtgtttctttta

SEQ ID NO: 54488 - DNA, 25 bp, Homo sapien
ctattatttgtcaagtattaaaggc

SEQ ID NO: 54489 - DNA, 25 bp, Homo sapien
ctattatttgttaagtattaaaggc

SEQ ID NO: 54490 - DNA, 25 bp, Homo sapien
ctattcaaatcccaatgtgatgctg

SEQ ID NO: 54491 - DNA, 25 bp, Homo sapien
ctattcaaatcccgatgtgatgctg

SEQ ID NO: 54492 - DNA, 25 bp, Homo sapien
ctattcaagccttttttattttggg

SEQ ID NO: 54493 - DNA, 25 bp, Homo sapien
ctattcaaggcttttttattttggg

SEQ ID NO: 54494 - DNA, 25 bp, Homo sapien
ctattcactgatgactgttataatt

SEQ ID NO: 54495 - DNA, 25 bp, Homo sapien
ctattcactgatggctgttataatt

SEQ ID NO: 54496 - DNA, 25 bp, Homo sapien
ctattcagaattaggatgacaccgt

SEQ ID NO: 54497 - DNA, 25 bp, Homo sapien
ctattcaggattaggatgacaccgt

SEQ ID NO: 54498 - DNA, 25 bp, Homo sapien
ctattcatatgtggcctgcttaatg

SEQ ID NO: 54499 - DNA, 25 bp, Homo sapien
ctattcatctgaaaacttgaacaaa

SEQ ID NO: 54500 - DNA, 25 bp, Homo sapien
ctattcatgtgtggcctgcttaatg

SEQ ID NO: 54501 - DNA, 25 bp, Homo sapien
ctattcatttgaaaacttgaacaaa

SEQ ID NO: 54502 - DNA, 25 bp, Homo sapien
ctattccagccattatcattatcca

SEQ ID NO: 54503 - DNA, 25 bp, Homo sapien
ctattccagccattgtcattatcca

SEQ ID NO: 54504 - DNA, 25 bp, Homo sapien
ctattcccacagaggctgtgagtgt

SEQ ID NO: 54505 - DNA, 25 bp, Homo sapien
ctattcccacgacaaaactggcaca

SEQ ID NO: 54506 - DNA, 25 bp, Homo sapien
ctattcccaggacaaaactggcaca

SEQ ID NO: 54507 - DNA, 25 bp, Homo sapien
ctattcccgcagaggctgtgagtgt

SEQ ID NO: 54508 - DNA, 25 bp, Homo sapien
ctattccttctcctcctctttattc

SEQ ID NO: 54509 - DNA, 25 bp, Homo sapien
ctattccttctcttcctctttattc

SEQ ID NO: 54510 - DNA, 25 bp, Homo sapien
ctattcgtaatttctgacactcagc

SEQ ID NO: 54511 - DNA, 25 bp, Homo sapien
ctattcgtagtttctgacactcagc

SEQ ID NO: 54512 - DNA, 25 bp, Homo sapien
ctattctcaggcagaaggcacgacg

SEQ ID NO: 54513 - DNA, 25 bp, Homo sapien
ctattctcaggcaggaggcacgacg

SEQ ID NO: 54514 - DNA, 25 bp, Homo sapien
ctattctctaatgaaaaggatcaag

SEQ ID NO: 54515 - DNA, 25 bp, Homo sapien
ctattctcttatgaaaaggatcaag

SEQ ID NO: 54516 - DNA, 25 bp, Homo sapien
ctattctggatgctaagaataaaat

SEQ ID NO: 54517 - DNA, 25 bp, Homo sapien
ctattctggttgctaagaataaaat

SEQ ID NO: 54518 - DNA, 25 bp, Homo sapien
ctattcttaacactttcgtcactaa

SEQ ID NO: 54519 - DNA, 25 bp, Homo sapien
ctattcttaacacttttgtcactaa

SEQ ID NO: 54520 - DNA, 25 bp, Homo sapien
ctattcttacgtggtagaacgcttt

SEQ ID NO: 54521 - DNA, 25 bp, Homo sapien
ctattcttatgtggtagaacgcttt

SEQ ID NO: 54522 - DNA, 25 bp, Homo sapien
ctattcttcgtacatatggtaaaat

SEQ ID NO: 54523 - DNA, 25 bp, Homo sapien
ctattctttgtacatatggtaaaat

SEQ ID NO: 54524 - DNA, 25 bp, Homo sapien
ctattcttttccaactgaattgtct

SEQ ID NO: 54525 - DNA, 25 bp, Homo sapien
ctattcttttccgactgaattgtct

SEQ ID NO: 54526 - DNA, 25 bp, Homo sapien
ctattgaaggtgctgtcattgttgt

SEQ ID NO: 54527 - DNA, 25 bp, Homo sapien
ctattgaaggttctgtcattgttgt

SEQ ID NO: 54528 - DNA, 25 bp, Homo sapien
ctattgacatatgacggacataatg

SEQ ID NO: 54529 - DNA, 25 bp, Homo sapien
ctattgacatatgatggacataatg

SEQ ID NO: 54530 - DNA, 25 bp, Homo sapien
ctattgagaagacaatatatacata

SEQ ID NO: 54531 - DNA, 25 bp, Homo sapien
ctattgagaagacgatatatacata

SEQ ID NO: 54532 - DNA, 25 bp, Homo sapien
ctattgataactatcctcaccctca

SEQ ID NO: 54533 - DNA, 25 bp, Homo sapien
ctattgatatctatcctcaccctca

SEQ ID NO: 54534 - DNA, 25 bp, Homo sapien
ctattgcacagattattgtttaaag

SEQ ID NO: 54535 - DNA, 25 bp, Homo sapien
ctattgcacggattattgtttaaag

SEQ ID NO: 54536 - DNA, 25 bp, Homo sapien
ctattgccaagcacaagtaaaataa

SEQ ID NO: 54537 - DNA, 25 bp, Homo sapien
ctattgccaagcataagtaaaataa

SEQ ID NO: 54538 - DNA, 25 bp, Homo sapien
ctattgctatatctctttcctcatt

SEQ ID NO: 54539 - DNA, 25 bp, Homo sapien
ctattgctatatgtctttcctcatt

SEQ ID NO: 54540 - DNA, 25 bp, Homo sapien
ctattgctatcacctggtaagagta

SEQ ID NO: 54541 - DNA, 25 bp, Homo sapien
ctattgctattcattctggaattga

SEQ ID NO: 54542 - DNA, 25 bp, Homo sapien
ctattgctgtcacctggtaagagta

SEQ ID NO: 54543 - DNA, 25 bp, Homo sapien
ctattgctgttcattctggaattga

SEQ ID NO: 54544 - DNA, 25 bp, Homo sapien
ctattggcgtaacatacatactatt

SEQ ID NO: 54545 - DNA, 25 bp, Homo sapien
ctattggcgtaacatatatactatt

SEQ ID NO: 54546 - DNA, 25 bp, Homo sapien
ctattgggccacatgtagcctatgt

SEQ ID NO: 54547 - DNA, 25 bp, Homo sapien
ctattgggtcacatgtagcctatgt

SEQ ID NO: 54548 - DNA, 25 bp, Homo sapien
ctattggtactattaactgccaacc

SEQ ID NO: 54549 - DNA, 25 bp, Homo sapien
ctattggtactgttaactgccaacc

SEQ ID NO: 54550 - DNA, 25 bp, Homo sapien
ctattgtgtatgattttaactgtgg

SEQ ID NO: 54551 - DNA, 25 bp, Homo sapien
ctattgtgtatgtttttaactgtgg

SEQ ID NO: 54552 - DNA, 25 bp, Homo sapien
ctattgttggactcattaaggttgc

SEQ ID NO: 54553 - DNA, 25 bp, Homo sapien
ctattgttgtactcattaaggttgc

SEQ ID NO: 54554 - DNA, 25 bp, Homo sapien
ctattgttgtgttagaaaggcatgt

SEQ ID NO: 54555 - DNA, 25 bp, Homo sapien
ctattgttgtgttataaaggcatgt

SEQ ID NO: 54556 - DNA, 25 bp, Homo sapien
ctatttaactcaacttccttccctg

SEQ ID NO: 54557 - DNA, 25 bp, Homo sapien
ctatttaactcagcttccttccctg

SEQ ID NO: 54558 - DNA, 25 bp, Homo sapien
ctatttaagaaggctactttgcacc

SEQ ID NO: 54559 - DNA, 25 bp, Homo sapien
ctatttaagcaggctactttgcacc

SEQ ID NO: 54560 - DNA, 25 bp, Homo sapien
ctatttacattaacaccaaacaatt

SEQ ID NO: 54561 - DNA, 25 bp, Homo sapien
ctatttacgttaacaccaaacaatt

SEQ ID NO: 54562 - DNA, 25 bp, Homo sapien
ctatttactaaccattcaatccctt

SEQ ID NO: 54563 - DNA, 25 bp, Homo sapien
ctatttactaactattcaatccctt

SEQ ID NO: 54564 - DNA, 25 bp, Homo sapien
ctatttagcccagactattcatata

SEQ ID NO: 54565 - DNA, 25 bp, Homo sapien
ctatttagcccagattattcatata

SEQ ID NO: 54566 - DNA, 25 bp, Homo sapien
ctatttatacacataagccactttc

SEQ ID NO: 54567 - DNA, 25 bp, Homo sapien
ctatttatatacataagccactttc

SEQ ID NO: 54568 - DNA, 25 bp, Homo sapien
ctatttatcctgcttacaagaagaa

SEQ ID NO: 54569 - DNA, 25 bp, Homo sapien
ctatttatgctgcttacaagaagaa

SEQ ID NO: 54570 - DNA, 25 bp, Homo sapien
ctatttattacataccaactcaaga

SEQ ID NO: 54571 - DNA, 25 bp, Homo sapien
ctatttattacctaccaactcaaga

SEQ ID NO: 54572 - DNA, 25 bp, Homo sapien
ctatttattgacgtaccagatggtg

SEQ ID NO: 54573 - DNA, 25 bp, Homo sapien
ctatttattgaggtaccagatggtg

SEQ ID NO: 54574 - DNA, 25 bp, Homo sapien
ctatttatttaaccttactaagcct

SEQ ID NO: 54575 - DNA, 25 bp, Homo sapien
ctatttatttaaccttcctaagcct

SEQ ID NO: 54576 - DNA, 25 bp, Homo sapien
ctatttcagatgtggaatcgcgaca

SEQ ID NO: 54577 - DNA, 25 bp, Homo sapien
ctatttcagatttggaatcgcgaca

SEQ ID NO: 54578 - DNA, 25 bp, Homo sapien
ctatttcagccttacagtgggagcc

SEQ ID NO: 54579 - DNA, 25 bp, Homo sapien
ctatttcagccttagagtgggagcc

SEQ ID NO: 54580 - DNA, 25 bp, Homo sapien
ctatttcagttttctccttctgcca

SEQ ID NO: 54581 - DNA, 25 bp, Homo sapien
ctatttcagttttgtccttctgcca

SEQ ID NO: 54582 - DNA, 25 bp, Homo sapien
ctatttcatttaattgaatcaccgg

SEQ ID NO: 54583 - DNA, 25 bp, Homo sapien
ctatttcatttatttgaatcaccgg

SEQ ID NO: 54584 - DNA, 25 bp, Homo sapien
ctatttccaggtccatgttttcaga

SEQ ID NO: 54585 - DNA, 25 bp, Homo sapien
ctatttccaggtccattttttcaga

SEQ ID NO: 54586 - DNA, 25 bp, Homo sapien
ctatttctatttagccaaccataaa

SEQ ID NO: 54587 - DNA, 25 bp, Homo sapien
ctatttctcttgcctttcggagagt

SEQ ID NO: 54588 - DNA, 25 bp, Homo sapien
ctatttctcttgtctttcggagagt

SEQ ID NO: 54589 - DNA, 25 bp, Homo sapien
ctatttctgccttttattttaatgt

SEQ ID NO: 54590 - DNA, 25 bp, Homo sapien
ctatttctggcttttattttaatgt

SEQ ID NO: 54591 - DNA, 25 bp, Homo sapien
ctatttctgtttagccaaccataaa

SEQ ID NO: 54592 - DNA, 25 bp, Homo sapien
ctatttcttcgtgtactagtagtgg

SEQ ID NO: 54593 - DNA, 25 bp, Homo sapien
ctatttctttgtgtactagtagtgg

SEQ ID NO: 54594 - DNA, 25 bp, Homo sapien
ctatttgagttcaaacaccaacaag

SEQ ID NO: 54595 - DNA, 25 bp, Homo sapien
ctatttgagttcaaacgccaacaag

SEQ ID NO: 54596 - DNA, 25 bp, Homo sapien
ctatttgctaggcatcgaccaccca

SEQ ID NO: 54597 - DNA, 25 bp, Homo sapien
ctatttgctgggcatcgaccaccca

SEQ ID NO: 54598 - DNA, 25 bp, Homo sapien
ctatttggagtcagtttctcccacc

SEQ ID NO: 54599 - DNA, 25 bp, Homo sapien
ctatttggagttagtttctcccacc

SEQ ID NO: 54600 - DNA, 25 bp, Homo sapien
ctatttggggtgttatcttttggtt

SEQ ID NO: 54601 - DNA, 25 bp, Homo sapien
ctatttgggttgttatcttttggtt

SEQ ID NO: 54602 - DNA, 25 bp, Homo sapien
ctatttgtttacattccacttgcat

SEQ ID NO: 54603 - DNA, 25 bp, Homo sapien
ctatttgtttagattccacttgcat

SEQ ID NO: 54604 - DNA, 25 bp, Homo sapien
ctatttgtttatccatgagttgttt

SEQ ID NO: 54605 - DNA, 25 bp, Homo sapien
ctatttgtttatccgtgagttgttt

SEQ ID NO: 54606 - DNA, 25 bp, Homo sapien
ctattttaacagtccaggtgaaaaa

SEQ ID NO: 54607 - DNA, 25 bp, Homo sapien
ctattttaatagtccaggtgaaaaa

SEQ ID NO: 54608 - DNA, 25 bp, Homo sapien
ctattttacaggtggctgaataaca

SEQ ID NO: 54609 - DNA, 25 bp, Homo sapien
ctattttaccccgtggcgtgctatg

SEQ ID NO: 54610 - DNA, 25 bp, Homo sapien
ctattttaccccgtggtgtgctatg

SEQ ID NO: 54611 - DNA, 25 bp, Homo sapien
ctattttacgcagcaggtttagatc

SEQ ID NO: 54612 - DNA, 25 bp, Homo sapien
ctattttagaggtggctgaataaca

SEQ ID NO: 54613 - DNA, 25 bp, Homo sapien
ctattttatgcagcaggtttagatc

SEQ ID NO: 54614 - DNA, 25 bp, Homo sapien
ctattttcataactagaagacgaaa

SEQ ID NO: 54615 - DNA, 25 bp, Homo sapien
ctattttcgtaactagaagacgaaa

SEQ ID NO: 54616 - DNA, 25 bp, Homo sapien
ctattttctcatgcctaagtgacag

SEQ ID NO: 54617 - DNA, 25 bp, Homo sapien
ctattttctcatggctaagtgacag

SEQ ID NO: 54618 - DNA, 25 bp, Homo sapien
ctattttcttgccaaactccattga

SEQ ID NO: 54619 - DNA, 25 bp, Homo sapien
ctattttcttgccgaactccattga

SEQ ID NO: 54620 - DNA, 25 bp, Homo sapien
ctattttgagccttttttgactttc

SEQ ID NO: 54621 - DNA, 25 bp, Homo sapien
ctattttgagcgttttttgactttc

SEQ ID NO: 54622 - DNA, 25 bp, Homo sapien
ctattttgatacagtttgttagaac

SEQ ID NO: 54623 - DNA, 25 bp, Homo sapien
ctattttgatatagtttgttagaac

SEQ ID NO: 54624 - DNA, 25 bp, Homo sapien
ctattttgcctgatgagatttactt

SEQ ID NO: 54625 - DNA, 25 bp, Homo sapien
ctattttgcttgatgagatttactt

SEQ ID NO: 54626 - DNA, 25 bp, Homo sapien
ctattttggttctaagccaacctat

SEQ ID NO: 54627 - DNA, 25 bp, Homo sapien
ctattttggttctaggccaacctat

SEQ ID NO: 54628 - DNA, 25 bp, Homo sapien
ctattttgtagcatcaattgtttca

SEQ ID NO: 54629 - DNA, 25 bp, Homo sapien
ctattttgtagcatcacttgtttca

SEQ ID NO: 54630 - DNA, 25 bp, Homo sapien
ctatttttatccatcttccttcatt

SEQ ID NO: 54631 - DNA, 25 bp, Homo sapien
ctatttttatccttcttccttcatt

SEQ ID NO: 54632 - DNA, 25 bp, Homo sapien
ctatttttccatataaacgaatcca

SEQ ID NO: 54633 - DNA, 25 bp, Homo sapien
ctatttttcccacataagcctccag

SEQ ID NO: 54634 - DNA, 25 bp, Homo sapien
ctatttttcgcacataagcctccag

SEQ ID NO: 54635 - DNA, 25 bp, Homo sapien
ctatttttctatataaacgaatcca

SEQ ID NO: 54636 - DNA, 25 bp, Homo sapien
ctatttttgctcgctggttatatcc

SEQ ID NO: 54637 - DNA, 25 bp, Homo sapien
ctatttttgcttgctggttatatcc

SEQ ID NO: 54638 - DNA, 25 bp, Homo sapien
ctatttttttctgcatagattcaga

SEQ ID NO: 54639 - DNA, 25 bp, Homo sapien
ctatttttttctgcatggattcaga

SEQ ID NO: 54640 - DNA, 25 bp, Homo sapien
ctcaaaaaaaatactaggaaactga

SEQ ID NO: 54641 - DNA, 25 bp, Homo sapien
ctcaaaaaaaatgctaggaaactga

SEQ ID NO: 54642 - DNA, 25 bp, Homo sapien
ctcaaaaaaacaccgagtcttcctg

SEQ ID NO: 54643 - DNA, 25 bp, Homo sapien
ctcaaaaacacaccgagtcttcctg

SEQ ID NO: 54644 - DNA, 25 bp, Homo sapien
ctcaaaacagtggtgaggttgatgt

SEQ ID NO: 54645 - DNA, 25 bp, Homo sapien
ctcaaaacattctatcttgtaatcc

SEQ ID NO: 54646 - DNA, 25 bp, Homo sapien
ctcaaaacattctgtcttgtaatcc

SEQ ID NO: 54647 - DNA, 25 bp, Homo sapien
ctcaaaaccaaagttcgctttctag

SEQ ID NO: 54648 - DNA, 25 bp, Homo sapien
ctcaaaaccacaacaaaagtgatgc

SEQ ID NO: 54649 - DNA, 25 bp, Homo sapien
ctcaaaaccacaacgaaagtgatgc

SEQ ID NO: 54650 - DNA, 25 bp, Homo sapien
ctcaaaaccgaagttcgctttctag

SEQ ID NO: 54651 - DNA, 25 bp, Homo sapien
ctcaaaacctgcaaatatgttatct

SEQ ID NO: 54652 - DNA, 25 bp, Homo sapien
ctcaaaacctgcgaatatgttatct

SEQ ID NO: 54653 - DNA, 25 bp, Homo sapien
ctcaaaacgagaagaagcttctgtg

SEQ ID NO: 54654 - DNA, 25 bp, Homo sapien
ctcaaaacggtggtgaggttgatgt

SEQ ID NO: 54655 - DNA, 25 bp, Homo sapien
ctcaaaactagaagaagcttctgtg

SEQ ID NO: 54656 - DNA, 25 bp, Homo sapien
ctcaaaagtcaagccagtgcctgtg

SEQ ID NO: 54657 - DNA, 25 bp, Homo sapien
ctcaaaagtcaatccagtgcctgtg

SEQ ID NO: 54658 - DNA, 25 bp, Homo sapien
ctcaaaataaaccaaggaaagaaag

SEQ ID NO: 54659 - DNA, 25 bp, Homo sapien
ctcaaaataaagcaaggaaagaaag

SEQ ID NO: 54660 - DNA, 25 bp, Homo sapien
ctcaaaatcatcttcagacagctaa

SEQ ID NO: 54661 - DNA, 25 bp, Homo sapien
ctcaaaatcattttcagacagctaa

SEQ ID NO: 54662 - DNA, 25 bp, Homo sapien
ctcaaaatctcctttaccacatgaa

SEQ ID NO: 54663 - DNA, 25 bp, Homo sapien
ctcaaaatttcctttaccacatgaa

SEQ ID NO: 54664 - DNA, 25 bp, Homo sapien
ctcaaacatattcataaagcagaac

SEQ ID NO: 54665 - DNA, 25 bp, Homo sapien
ctcaaacatgttcataaagcagaac

SEQ ID NO: 54666 - DNA, 25 bp, Homo sapien
ctcaaacattcttcattatgatcct

SEQ ID NO: 54667 - DNA, 25 bp, Homo sapien
ctcaaacattcttcgttatgatcct

SEQ ID NO: 54668 - DNA, 25 bp, Homo sapien
ctcaaaccaatttgggccagatttc

SEQ ID NO: 54669 - DNA, 25 bp, Homo sapien
ctcaaaccaatttgggtcagatttc

SEQ ID NO: 54670 - DNA, 25 bp, Homo sapien
ctcaaaccttttcttcagacgtaga

SEQ ID NO: 54671 - DNA, 25 bp, Homo sapien
ctcaaaccttttcttccgacgtaga

SEQ ID NO: 54672 - DNA, 25 bp, Homo sapien
ctcaaactgttcttaggaaattcac

SEQ ID NO: 54673 - DNA, 25 bp, Homo sapien
ctcaaacttttcttaggaaattcac

SEQ ID NO: 54674 - DNA, 25 bp, Homo sapien
ctcaaagcaacaacctgcctggttt

SEQ ID NO: 54675 - DNA, 25 bp, Homo sapien
ctcaaagcaacagcctgcctggttt

SEQ ID NO: 54676 - DNA, 25 bp, Homo sapien
ctcaaaggcctggggtatctcaaca

SEQ ID NO: 54677 - DNA, 25 bp, Homo sapien
ctcaaaggcttggggtatctcaaca

SEQ ID NO: 54678 - DNA, 25 bp, Homo sapien
ctcaaagggatattaaccaagaccc

SEQ ID NO: 54679 - DNA, 25 bp, Homo sapien
ctcaaagggatattaatcaagaccc

SEQ ID NO: 54680 - DNA, 25 bp, Homo sapien
ctcaaagggcttttgtgagcactac

SEQ ID NO: 54681 - DNA, 25 bp, Homo sapien
ctcaaagggtttttgtgagcactac

SEQ ID NO: 54682 - DNA, 25 bp, Homo sapien
ctcaaaggtgcaactgaagatcatc

SEQ ID NO: 54683 - DNA, 25 bp, Homo sapien
ctcaaaggtgcaattgaagatcatc

SEQ ID NO: 54684 - DNA, 25 bp, Homo sapien
ctcaaagtgaacacccttttttgcc

SEQ ID NO: 54685 - DNA, 25 bp, Homo sapien
ctcaaagtgaacagccttttttgcc

SEQ ID NO: 54686 - DNA, 25 bp, Homo sapien
ctcaaagtggagtgttctttctgag

SEQ ID NO: 54687 - DNA, 25 bp, Homo sapien
ctcaaagtggagttttctttctgag

SEQ ID NO: 54688 - DNA, 25 bp, Homo sapien
ctcaaatacgaatccctccttgtca

SEQ ID NO: 54689 - DNA, 25 bp, Homo sapien
ctcaaatacgaatctctccttgtca

SEQ ID NO: 54690 - DNA, 25 bp, Homo sapien
ctcaaatccattaaatttttccatc

SEQ ID NO: 54691 - DNA, 25 bp, Homo sapien
ctcaaatccatttccttgacccact

SEQ ID NO: 54692 - DNA, 25 bp, Homo sapien
ctcaaatccgttaaatttttccatc

SEQ ID NO: 54693 - DNA, 25 bp, Homo sapien
ctcaaatcctggctttgctactttc

SEQ ID NO: 54694 - DNA, 25 bp, Homo sapien
ctcaaatcctgggtttgctactttc

SEQ ID NO: 54695 - DNA, 25 bp, Homo sapien
ctcaaatccttttccttgacccact

SEQ ID NO: 54696 - DNA, 25 bp, Homo sapien
ctcaaatctatgtgtatagtcgaca

SEQ ID NO: 54697 - DNA, 25 bp, Homo sapien
ctcaaatctatttgtatagtcgaca

SEQ ID NO: 54698 - DNA, 25 bp, Homo sapien
ctcaaattagttaactccaaatttt

SEQ ID NO: 54699 - DNA, 25 bp, Homo sapien
ctcaaattagttatctccaaatttt

SEQ ID NO: 54700 - DNA, 25 bp, Homo sapien
ctcaaattctcagccaaagacccta

SEQ ID NO: 54701 - DNA, 25 bp, Homo sapien
ctcaaattctcggccaaagacccta

SEQ ID NO: 54702 - DNA, 25 bp, Homo sapien
ctcaaattgccatgtctttgaaaag

SEQ ID NO: 54703 - DNA, 25 bp, Homo sapien
ctcaaattgccgtgtctttgaaaag

SEQ ID NO: 54704 - DNA, 25 bp, Homo sapien
ctcaacaaaaccgatagctgagtgt

SEQ ID NO: 54705 - DNA, 25 bp, Homo sapien
ctcaacaaaactgatagctgagtgt

SEQ ID NO: 54706 - DNA, 25 bp, Homo sapien
ctcaacaaaatgctacaaaacttaa

SEQ ID NO: 54707 - DNA, 25 bp, Homo sapien
ctcaacaaaatgctacgaaacttaa

SEQ ID NO: 54708 - DNA, 25 bp, Homo sapien
ctcaacaaccaaagtttgaacaact

SEQ ID NO: 54709 - DNA, 25 bp, Homo sapien
ctcaacaaccaatgtttgaacaact

SEQ ID NO: 54710 - DNA, 25 bp, Homo sapien
ctcaacaagatacatatttactcaa

SEQ ID NO: 54711 - DNA, 25 bp, Homo sapien
ctcaacaagatacttatttactcaa

SEQ ID NO: 54712 - DNA, 25 bp, Homo sapien
ctcaacaagccacttatcttatgag

SEQ ID NO: 54713 - DNA, 25 bp, Homo sapien
ctcaacaatccacttatcttatgag

SEQ ID NO: 54714 - DNA, 25 bp, Homo sapien
ctcaacactttgaaaacccaaggca

SEQ ID NO: 54715 - DNA, 25 bp, Homo sapien
ctcaacactttggaaacccaaggca

SEQ ID NO: 54716 - DNA, 25 bp, Homo sapien
ctcaacagatcctcatgattttacc

SEQ ID NO: 54717 - DNA, 25 bp, Homo sapien
ctcaacagatcctcgtgattttacc

SEQ ID NO: 54718 - DNA, 25 bp, Homo sapien
ctcaacagcccttgtttattcctat

SEQ ID NO: 54719 - DNA, 25 bp, Homo sapien
ctcaacagtccttatccaaacttgc

SEQ ID NO: 54720 - DNA, 25 bp, Homo sapien
ctcaacagtccttgtttattcctat

SEQ ID NO: 54721 - DNA, 25 bp, Homo sapien
ctcaacagttcttatccaaacttgc

SEQ ID NO: 54722 - DNA, 25 bp, Homo sapien
ctcaacatacctctgtaggtttaat

SEQ ID NO: 54723 - DNA, 25 bp, Homo sapien
ctcaacatatctctgtaggtttaat

SEQ ID NO: 54724 - DNA, 25 bp, Homo sapien
ctcaacatcattcgctatgctgagc

SEQ ID NO: 54725 - DNA, 25 bp, Homo sapien
ctcaacatcattggctatgctgagc

SEQ ID NO: 54726 - DNA, 25 bp, Homo sapien
ctcaacatcctcatctgcaaactag

SEQ ID NO: 54727 - DNA, 25 bp, Homo sapien
ctcaacatcttcatctgcaaactag

SEQ ID NO: 54728 - DNA, 25 bp, Homo sapien
ctcaaccaacatcgaccctttgagc

SEQ ID NO: 54729 - DNA, 25 bp, Homo sapien
ctcaaccaacattgaccctttgagc

SEQ ID NO: 54730 - DNA, 25 bp, Homo sapien
ctcaaccaattctatgaaaacaagc

SEQ ID NO: 54731 - DNA, 25 bp, Homo sapien
ctcaaccaattctgtgaaaacaagc

SEQ ID NO: 54732 - DNA, 25 bp, Homo sapien
ctcaacctacattgagaagtacgcc

SEQ ID NO: 54733 - DNA, 25 bp, Homo sapien
ctcaacctacatttagaagtacgcc

SEQ ID NO: 54734 - DNA, 25 bp, Homo sapien
ctcaactaatactctgcttttggtt

SEQ ID NO: 54735 - DNA, 25 bp, Homo sapien
ctcaactaatactgtgcttttggtt

SEQ ID NO: 54736 - DNA, 25 bp, Homo sapien
ctcaactacttcaattgcctcctac

SEQ ID NO: 54737 - DNA, 25 bp, Homo sapien
ctcaactacttcagttgcctcctac

SEQ ID NO: 54738 - DNA, 25 bp, Homo sapien
ctcaagaaataagctgcaaatatat

SEQ ID NO: 54739 - DNA, 25 bp, Homo sapien
ctcaagaaatatgctgcaaatatat

SEQ ID NO: 54740 - DNA, 25 bp, Homo sapien
ctcaagaaatgctgttataataacc

SEQ ID NO: 54741 - DNA, 25 bp, Homo sapien
ctcaagaagattaaactgatcggcc

SEQ ID NO: 54742 - DNA, 25 bp, Homo sapien
ctcaagaagattaagctgatcggcc

SEQ ID NO: 54743 - DNA, 25 bp, Homo sapien
ctcaagaagtgctgttataataacc

SEQ ID NO: 54744 - DNA, 25 bp, Homo sapien
ctcaagacacgcaatctctgcaaac

SEQ ID NO: 54745 - DNA, 25 bp, Homo sapien
ctcaagacatgcaatctctgcaaac

SEQ ID NO: 54746 - DNA, 25 bp, Homo sapien
ctcaagagaaagtaagaaatctgtt

SEQ ID NO: 54747 - DNA, 25 bp, Homo sapien
ctcaagaggaagtaagaaatctgtt

SEQ ID NO: 54748 - DNA, 25 bp, Homo sapien
ctcaagcatgctgaacatggaaacc

SEQ ID NO: 54749 - DNA, 25 bp, Homo sapien
ctcaagcatgctgaacttggaaacc

SEQ ID NO: 54750 - DNA, 25 bp, Homo sapien
ctcaagccaataaaagcccgaaagg

SEQ ID NO: 54751 - DNA, 25 bp, Homo sapien
ctcaagccaatgaaagcccgaaagg

SEQ ID NO: 54752 - DNA, 25 bp, Homo sapien
ctcaagccacaatattcacattatt

SEQ ID NO: 54753 - DNA, 25 bp, Homo sapien
ctcaagccacagtattcacattatt

SEQ ID NO: 54754 - DNA, 25 bp, Homo sapien
ctcaagctcaaggacgggacaaagt

SEQ ID NO: 54755 - DNA, 25 bp, Homo sapien
ctcaagctcaaggatgggacaaagt

SEQ ID NO: 54756 - DNA, 25 bp, Homo sapien
ctcaaggaattgaaagaaataatgt

SEQ ID NO: 54757 - DNA, 25 bp, Homo sapien
ctcaaggaattgcaagaaataatgt

SEQ ID NO: 54758 - DNA, 25 bp, Homo sapien
ctcaaggacagcaaaaatgagggat

SEQ ID NO: 54759 - DNA, 25 bp, Homo sapien
ctcaaggacagcgaaaatgagggat

SEQ ID NO: 54760 - DNA, 25 bp, Homo sapien
ctcaaggataattaaagcatgagct

SEQ ID NO: 54761 - DNA, 25 bp, Homo sapien
ctcaaggataattgaagcatgagct

SEQ ID NO: 54762 - DNA, 25 bp, Homo sapien
ctcaaggatggccaggtgtgttcct

SEQ ID NO: 54763 - DNA, 25 bp, Homo sapien
ctcaaggatggtcaggtgtgttcct

SEQ ID NO: 54764 - DNA, 25 bp, Homo sapien
ctcaaggcacggtataaataaagta

SEQ ID NO: 54765 - DNA, 25 bp, Homo sapien
ctcaaggcatggtataaataaagta

SEQ ID NO: 54766 - DNA, 25 bp, Homo sapien
ctcaagggactgtagaccactgcat

SEQ ID NO: 54767 - DNA, 25 bp, Homo sapien
ctcaagggactgtagagcactgcat

SEQ ID NO: 54768 - DNA, 25 bp, Homo sapien
ctcaagtaccggagttcccaatggt

SEQ ID NO: 54769 - DNA, 25 bp, Homo sapien
ctcaagtactggagttcccaatggt

SEQ ID NO: 54770 - DNA, 25 bp, Homo sapien
ctcaagtatctggtaaagtgacaaa

SEQ ID NO: 54771 - DNA, 25 bp, Homo sapien
ctcaagtatctggtgaagtgacaaa

SEQ ID NO: 54772 - DNA, 25 bp, Homo sapien
ctcaagtgatgcaccggtctcggcc

SEQ ID NO: 54773 - DNA, 25 bp, Homo sapien
ctcaagtgatgtaccggtctcggcc

SEQ ID NO: 54774 - DNA, 25 bp, Homo sapien
ctcaagttcagtgacaaaacaacaa

SEQ ID NO: 54775 - DNA, 25 bp, Homo sapien
ctcaagttcagtgtcaaaacaacaa

SEQ ID NO: 54776 - DNA, 25 bp, Homo sapien
ctcaagttgatataggtttaagtta

SEQ ID NO: 54777 - DNA, 25 bp, Homo sapien
ctcaagttgatgtaggtttaagtta

SEQ ID NO: 54778 - DNA, 25 bp, Homo sapien
ctcaagttttgttatcaatattata

SEQ ID NO: 54779 - DNA, 25 bp, Homo sapien
ctcaagttttgttgtcaatattata

SEQ ID NO: 54780 - DNA, 25 bp, Homo sapien
ctcaataaaacctgttaataactaa

SEQ ID NO: 54781 - DNA, 25 bp, Homo sapien
ctcaataaatcctgttaataactaa

SEQ ID NO: 54782 - DNA, 25 bp, Homo sapien
ctcaataaatgcctactgagaaata

SEQ ID NO: 54783 - DNA, 25 bp, Homo sapien
ctcaataaatgtctactgagaaata

SEQ ID NO: 54784 - DNA, 25 bp, Homo sapien
ctcaataaattctacggcacatcag

SEQ ID NO: 54785 - DNA, 25 bp, Homo sapien
ctcaataaattctatggcacatcag

SEQ ID NO: 54786 - DNA, 25 bp, Homo sapien
ctcaataaggtaatggttcaaaaga

SEQ ID NO: 54787 - DNA, 25 bp, Homo sapien
ctcaataatgtaatggttcaaaaga

SEQ ID NO: 54788 - DNA, 25 bp, Homo sapien
ctcaataattcccaagatgtttcag

SEQ ID NO: 54789 - DNA, 25 bp, Homo sapien
ctcaataattcccaggatgtttcag

SEQ ID NO: 54790 - DNA, 25 bp, Homo sapien
ctcaatacatcagtgcaagctgaaa

SEQ ID NO: 54791 - DNA, 25 bp, Homo sapien
ctcaataccttatctaaatgccaat

SEQ ID NO: 54792 - DNA, 25 bp, Homo sapien
ctcaataccttttctaaatgccaat

SEQ ID NO: 54793 - DNA, 25 bp, Homo sapien
ctcaatacgtcagtgcaagctgaaa

SEQ ID NO: 54794 - DNA, 25 bp, Homo sapien
ctcaatactaaatagttctcaccca

SEQ ID NO: 54795 - DNA, 25 bp, Homo sapien
ctcaatactaagtagttctcaccca

SEQ ID NO: 54796 - DNA, 25 bp, Homo sapien
ctcaatagctatacgttggatgaca

SEQ ID NO: 54797 - DNA, 25 bp, Homo sapien
ctcaatagctatatgttggatgaca

SEQ ID NO: 54798 - DNA, 25 bp, Homo sapien
ctcaatatcttcacttaatcatctc

SEQ ID NO: 54799 - DNA, 25 bp, Homo sapien
ctcaatatcttcccttaatcatctc

SEQ ID NO: 54800 - DNA, 25 bp, Homo sapien
ctcaatcaagagaacagtcaaaatc

SEQ ID NO: 54801 - DNA, 25 bp, Homo sapien
ctcaatcaagataacagtcaaaatc

SEQ ID NO: 54802 - DNA, 25 bp, Homo sapien
ctcaatccaggtctctgcaggctgg

SEQ ID NO: 54803 - DNA, 25 bp, Homo sapien
ctcaatccatacagtgagtaaaatt

SEQ ID NO: 54804 - DNA, 25 bp, Homo sapien
ctcaatccgggtctctgcaggctgg

SEQ ID NO: 54805 - DNA, 25 bp, Homo sapien
ctcaatccgtacagtgagtaaaatt

SEQ ID NO: 54806 - DNA, 25 bp, Homo sapien
ctcaatctccctgttatagaaagtg

SEQ ID NO: 54807 - DNA, 25 bp, Homo sapien
ctcaatcttcaaatgagtctgatga

SEQ ID NO: 54808 - DNA, 25 bp, Homo sapien
ctcaatcttcctgttatagaaagtg

SEQ ID NO: 54809 - DNA, 25 bp, Homo sapien
ctcaatctttaaatgagtctgatga

SEQ ID NO: 54810 - DNA, 25 bp, Homo sapien
ctcaatgacacctgcagacactgag

SEQ ID NO: 54811 - DNA, 25 bp, Homo sapien
ctcaatgatacctgcagacactgag

SEQ ID NO: 54812 - DNA, 25 bp, Homo sapien
ctcaatgcggaaattcatggtttta

SEQ ID NO: 54813 - DNA, 25 bp, Homo sapien
ctcaatgctccaacgtggtcttctc

SEQ ID NO: 54814 - DNA, 25 bp, Homo sapien
ctcaatgctccaacttggtcttctc

SEQ ID NO: 54815 - DNA, 25 bp, Homo sapien
ctcaatgctgaaattcatggtttta

SEQ ID NO: 54816 - DNA, 25 bp, Homo sapien
ctcaatgtaggacttcatatttcag

SEQ ID NO: 54817 - DNA, 25 bp, Homo sapien
ctcaatgtctccatgtttctttttg

SEQ ID NO: 54818 - DNA, 25 bp, Homo sapien
ctcaatgtctccatttttctttttg

SEQ ID NO: 54819 - DNA, 25 bp, Homo sapien
ctcaatgtgggacttcatatttcag

SEQ ID NO: 54820 - DNA, 25 bp, Homo sapien
ctcaattaaagtaatagcatctcac

SEQ ID NO: 54821 - DNA, 25 bp, Homo sapien
ctcaattacaccaactccatctgtt

SEQ ID NO: 54822 - DNA, 25 bp, Homo sapien
ctcaattacaccgactccatctgtt

SEQ ID NO: 54823 - DNA, 25 bp, Homo sapien
ctcaattacagtaatagcatctcac

SEQ ID NO: 54824 - DNA, 25 bp, Homo sapien
ctcaattagtatcatccgaatgtcc

SEQ ID NO: 54825 - DNA, 25 bp, Homo sapien
ctcaattagtatcatctgaatgtcc

SEQ ID NO: 54826 - DNA, 25 bp, Homo sapien
ctcaattctttcttaaactacaaaa

SEQ ID NO: 54827 - DNA, 25 bp, Homo sapien
ctcaattctttcttgaactacaaaa

SEQ ID NO: 54828 - DNA, 25 bp, Homo sapien
ctcaattgacgtctcaggatagctc

SEQ ID NO: 54829 - DNA, 25 bp, Homo sapien
ctcaattgatgtctcaggatagctc

SEQ ID NO: 54830 - DNA, 25 bp, Homo sapien
ctcaattttaatcacaaggaacaat

SEQ ID NO: 54831 - DNA, 25 bp, Homo sapien
ctcaattttaatcacacggaacaat

SEQ ID NO: 54832 - DNA, 25 bp, Homo sapien
ctcaatttttttcgttttaatccat

SEQ ID NO: 54833 - DNA, 25 bp, Homo sapien
ctcaatttttttctttttaatccat

SEQ ID NO: 54834 - DNA, 25 bp, Homo sapien
ctcacaaaatggcacatcccgcccc

SEQ ID NO: 54835 - DNA, 25 bp, Homo sapien
ctcacaaaatggctcatcccgcccc

SEQ ID NO: 54836 - DNA, 25 bp, Homo sapien
ctcacaaaggacgtgtctctcacag

SEQ ID NO: 54837 - DNA, 25 bp, Homo sapien
ctcacaaaggatgtgtctctcacag

SEQ ID NO: 54838 - DNA, 25 bp, Homo sapien
ctcacaattcagcatacccagttta

SEQ ID NO: 54839 - DNA, 25 bp, Homo sapien
ctcacaattcagtatacccagttta

SEQ ID NO: 54840 - DNA, 25 bp, Homo sapien
ctcacacaaaactactgcttcatca

SEQ ID NO: 54841 - DNA, 25 bp, Homo sapien
ctcacacaaaattactgcttcatca

SEQ ID NO: 54842 - DNA, 25 bp, Homo sapien
ctcacaccaccaatgaggcagttcc

SEQ ID NO: 54843 - DNA, 25 bp, Homo sapien
ctcacaccatcgagagcactaacga

SEQ ID NO: 54844 - DNA, 25 bp, Homo sapien
ctcacaccatcgagagtactaacga

SEQ ID NO: 54845 - DNA, 25 bp, Homo sapien
ctcacaccgccaatgaggcagttcc

SEQ ID NO: 54846 - DNA, 25 bp, Homo sapien
ctcacagatcacatatcggcagaga

SEQ ID NO: 54847 - DNA, 25 bp, Homo sapien
ctcacagatcatatatcggcagaga

SEQ ID NO: 54848 - DNA, 25 bp, Homo sapien
ctcacaggactcaaaaaagctgtta

SEQ ID NO: 54849 - DNA, 25 bp, Homo sapien
ctcacaggcatcacagataggaaga

SEQ ID NO: 54850 - DNA, 25 bp, Homo sapien
ctcacaggcatctcagataggaaga

SEQ ID NO: 54851 - DNA, 25 bp, Homo sapien
ctcacagggctcaaaaaagctgtta

SEQ ID NO: 54852 - DNA, 25 bp, Homo sapien
ctcacagtatagacgctggagccag

SEQ ID NO: 54853 - DNA, 25 bp, Homo sapien
ctcacagtatagatgctggagccag

SEQ ID NO: 54854 - DNA, 25 bp, Homo sapien
ctcacagtttcaaagtgtttcaaac

SEQ ID NO: 54855 - DNA, 25 bp, Homo sapien
ctcacagtttcgaagtgtttcaaac

SEQ ID NO: 54856 - DNA, 25 bp, Homo sapien
ctcacatcagtagaaagagcgctgg

SEQ ID NO: 54857 - DNA, 25 bp, Homo sapien
ctcacatcagtataaagagcgctgg

SEQ ID NO: 54858 - DNA, 25 bp, Homo sapien
ctcacatgacacagattctaaaccc

SEQ ID NO: 54859 - DNA, 25 bp, Homo sapien
ctcacatgacacagtttctaaaccc

SEQ ID NO: 54860 - DNA, 25 bp, Homo sapien
ctcacatgcttttacagtcttctgt

SEQ ID NO: 54861 - DNA, 25 bp, Homo sapien
ctcacatggtctttccttggtgtgt

SEQ ID NO: 54862 - DNA, 25 bp, Homo sapien
ctcacatggtcttttcttggtgtgt

SEQ ID NO: 54863 - DNA, 25 bp, Homo sapien
ctcacatgtttttacagtcttctgt

SEQ ID NO: 54864 - DNA, 25 bp, Homo sapien
ctcacattttttccgacctcaaacc

SEQ ID NO: 54865 - DNA, 25 bp, Homo sapien
ctcacattttttctgacctcaaacc

SEQ ID NO: 54866 - DNA, 25 bp, Homo sapien
ctcaccaaaagcgttgtctgtaaat

SEQ ID NO: 54867 - DNA, 25 bp, Homo sapien
ctcaccaaaagctttgtctgtaaat

SEQ ID NO: 54868 - DNA, 25 bp, Homo sapien
ctcaccaaaggcaccactaatggct

SEQ ID NO: 54869 - DNA, 25 bp, Homo sapien
ctcaccaaaggcgccactaatggct

SEQ ID NO: 54870 - DNA, 25 bp, Homo sapien
ctcaccaaggcaacaacgattactc

SEQ ID NO: 54871 - DNA, 25 bp, Homo sapien
ctcaccaaggcaacaatgattactc

SEQ ID NO: 54872 - DNA, 25 bp, Homo sapien
ctcaccacaacaatttttcccttcg

SEQ ID NO: 54873 - DNA, 25 bp, Homo sapien
ctcaccacagcaatttttcccttcg

SEQ ID NO: 54874 - DNA, 25 bp, Homo sapien
ctcaccactcgaaaaacaaactcaa

SEQ ID NO: 54875 - DNA, 25 bp, Homo sapien
ctcaccactgtcacttgtactcaca

SEQ ID NO: 54876 - DNA, 25 bp, Homo sapien
ctcaccactgtcatttgtactcaca

SEQ ID NO: 54877 - DNA, 25 bp, Homo sapien
ctcaccacttgaaaaacaaactcaa

SEQ ID NO: 54878 - DNA, 25 bp, Homo sapien
ctcacccacaagcagcatgagggca

SEQ ID NO: 54879 - DNA, 25 bp, Homo sapien
ctcacccacaagcggcatgagggca

SEQ ID NO: 54880 - DNA, 25 bp, Homo sapien
ctcacccacaagtcagtgaagactg

SEQ ID NO: 54881 - DNA, 25 bp, Homo sapien
ctcacccagaagtcagtgaagactg

SEQ ID NO: 54882 - DNA, 25 bp, Homo sapien
ctcacccatggaaagttatggaatc

SEQ ID NO: 54883 - DNA, 25 bp, Homo sapien
ctcacccatgggaagttatggaatc

SEQ ID NO: 54884 - DNA, 25 bp, Homo sapien
ctcaccgcaagcttcacctcccggg

SEQ ID NO: 54885 - DNA, 25 bp, Homo sapien
ctcaccgcaggcttcacctcccggg

SEQ ID NO: 54886 - DNA, 25 bp, Homo sapien
ctcacctaaccccaagctgcaaagc

SEQ ID NO: 54887 - DNA, 25 bp, Homo sapien
ctcacctaaccctaagctgcaaagc

SEQ ID NO: 54888 - DNA, 25 bp, Homo sapien
ctcacctgacttctacagggctctt

SEQ ID NO: 54889 - DNA, 25 bp, Homo sapien
ctcacctgatttctacagggctctt

SEQ ID NO: 54890 - DNA, 25 bp, Homo sapien
ctcacctggatcatcgcaataactg

SEQ ID NO: 54891 - DNA, 25 bp, Homo sapien
ctcacctggatcattgcaataactg

SEQ ID NO: 54892 - DNA, 25 bp, Homo sapien
ctcaccttacttgcataggcacttt

SEQ ID NO: 54893 - DNA, 25 bp, Homo sapien
ctcaccttactttcataggcacttt

SEQ ID NO: 54894 - DNA, 25 bp, Homo sapien
ctcacgacacattgtatgtatccag

SEQ ID NO: 54895 - DNA, 25 bp, Homo sapien
ctcacgacgcattgtatgtatccag

SEQ ID NO: 54896 - DNA, 25 bp, Homo sapien
ctcactaaaattcaagaatattcaa

SEQ ID NO: 54897 - DNA, 25 bp, Homo sapien
ctcactaaaattcgagaatattcaa

SEQ ID NO: 54898 - DNA, 25 bp, Homo sapien
ctcactaactgatatgtcaataata

SEQ ID NO: 54899 - DNA, 25 bp, Homo sapien
ctcactaatatctataagggcagca

SEQ ID NO: 54900 - DNA, 25 bp, Homo sapien
ctcactaatctctataagggcagca

SEQ ID NO: 54901 - DNA, 25 bp, Homo sapien
ctcactaattgatatgtcaataata

SEQ ID NO: 54902 - DNA, 25 bp, Homo sapien
ctcactacaaactaaacaaggtacc

SEQ ID NO: 54903 - DNA, 25 bp, Homo sapien
ctcactacactgtcatcacatgtga

SEQ ID NO: 54904 - DNA, 25 bp, Homo sapien
ctcactacactgtcgtcacatgtga

SEQ ID NO: 54905 - DNA, 25 bp, Homo sapien
ctcactacagactaaacaaggtacc

SEQ ID NO: 54906 - DNA, 25 bp, Homo sapien
ctcactactctcaaaaatcagaaag

SEQ ID NO: 54907 - DNA, 25 bp, Homo sapien
ctcactactctcagaaatcagaaag

SEQ ID NO: 54908 - DNA, 25 bp, Homo sapien
ctcactatcatttacatagcttaaa

SEQ ID NO: 54909 - DNA, 25 bp, Homo sapien
ctcactatcatttgcatagcttaaa

SEQ ID NO: 54910 - DNA, 25 bp, Homo sapien
ctcactatcccagtttataagcagc

SEQ ID NO: 54911 - DNA, 25 bp, Homo sapien
ctcactatcccagtttctaagcagc

SEQ ID NO: 54912 - DNA, 25 bp, Homo sapien
ctcactatgtgccaatcctctaagt

SEQ ID NO: 54913 - DNA, 25 bp, Homo sapien
ctcactatgtgccaattctctaagt

SEQ ID NO: 54914 - DNA, 25 bp, Homo sapien
ctcactattcccacagaggctgtga

SEQ ID NO: 54915 - DNA, 25 bp, Homo sapien
ctcactattcccgcagaggctgtga

SEQ ID NO: 54916 - DNA, 25 bp, Homo sapien
ctcactcaactgcctaaaaacgaat

SEQ ID NO: 54917 - DNA, 25 bp, Homo sapien
ctcactcaacttatttgtacctcaa

SEQ ID NO: 54918 - DNA, 25 bp, Homo sapien
ctcactcaattgcctaaaaacgaat

SEQ ID NO: 54919 - DNA, 25 bp, Homo sapien
ctcactcatctctgtaacagttcaa

SEQ ID NO: 54920 - DNA, 25 bp, Homo sapien
ctcactcatcttatttgtacctcaa

SEQ ID NO: 54921 - DNA, 25 bp, Homo sapien
ctcactcatctttgtaacagttcaa

SEQ ID NO: 54922 - DNA, 25 bp, Homo sapien
ctcactcctaccactacaagagaca

SEQ ID NO: 54923 - DNA, 25 bp, Homo sapien
ctcactcctaccgctacaagagaca

SEQ ID NO: 54924 - DNA, 25 bp, Homo sapien
ctcactcgcatatcttacgtagggc

SEQ ID NO: 54925 - DNA, 25 bp, Homo sapien
ctcactcgcgtatcttacgtagggc

SEQ ID NO: 54926 - DNA, 25 bp, Homo sapien
ctcactctattgcacggaatatata

SEQ ID NO: 54927 - DNA, 25 bp, Homo sapien
ctcactctattgcatggaatatata

SEQ ID NO: 54928 - DNA, 25 bp, Homo sapien
ctcactcttagactcaggaaattat

SEQ ID NO: 54929 - DNA, 25 bp, Homo sapien
ctcactcttagattcaggaaattat

SEQ ID NO: 54930 - DNA, 25 bp, Homo sapien
ctcactgcactgtgtgttacatgga

SEQ ID NO: 54931 - DNA, 25 bp, Homo sapien
ctcactgcactttgtgttacatgga

SEQ ID NO: 54932 - DNA, 25 bp, Homo sapien
ctcactgccactaatttagagcttt

SEQ ID NO: 54933 - DNA, 25 bp, Homo sapien
ctcactgctactaatttagagcttt

SEQ ID NO: 54934 - DNA, 25 bp, Homo sapien
ctcactgtaaggatcttcattcaaa

SEQ ID NO: 54935 - DNA, 25 bp, Homo sapien
ctcactgtaaggttcttcattcaaa

SEQ ID NO: 54936 - DNA, 25 bp, Homo sapien
ctcactgtgaggataagcaagaaaa

SEQ ID NO: 54937 - DNA, 25 bp, Homo sapien
ctcactgtgaggatgagcaagaaaa

SEQ ID NO: 54938 - DNA, 25 bp, Homo sapien
ctcactgttaaaaagaaatgatgtc

SEQ ID NO: 54939 - DNA, 25 bp, Homo sapien
ctcactgttaaaatgaaatgatgtc

SEQ ID NO: 54940 - DNA, 25 bp, Homo sapien
ctcactgtttcctcacgtggcagaa

SEQ ID NO: 54941 - DNA, 25 bp, Homo sapien
ctcactgtttcctcacttggcagaa

SEQ ID NO: 54942 - DNA, 25 bp, Homo sapien
ctcacttactatcatgcgaacagca

SEQ ID NO: 54943 - DNA, 25 bp, Homo sapien
ctcacttactatcgtgcgaacagca

SEQ ID NO: 54944 - DNA, 25 bp, Homo sapien
ctcacttatattataaactattgca

SEQ ID NO: 54945 - DNA, 25 bp, Homo sapien
ctcacttatgttataaactattgca

SEQ ID NO: 54946 - DNA, 25 bp, Homo sapien
ctcacttctgattttgcatttcatt

SEQ ID NO: 54947 - DNA, 25 bp, Homo sapien
ctcacttctgattttgtatttcatt

SEQ ID NO: 54948 - DNA, 25 bp, Homo sapien
ctcacttctgccttaaccgaagagc

SEQ ID NO: 54949 - DNA, 25 bp, Homo sapien
ctcacttctgccttaatcgaagagc

SEQ ID NO: 54950 - DNA, 25 bp, Homo sapien
ctcactttcccagagcatctatgag

SEQ ID NO: 54951 - DNA, 25 bp, Homo sapien
ctcactttcgctgttcttcctgcct

SEQ ID NO: 54952 - DNA, 25 bp, Homo sapien
ctcactttgtgccactctgatgcta

SEQ ID NO: 54953 - DNA, 25 bp, Homo sapien
ctcactttgtgtcactctgatgcta

SEQ ID NO: 54954 - DNA, 25 bp, Homo sapien
ctcacttttccagagcatctatgag

SEQ ID NO: 54955 - DNA, 25 bp, Homo sapien
ctcacttttgctgttcttcctgcct

SEQ ID NO: 54956 - DNA, 25 bp, Homo sapien
ctcagaaaaaaatgttccctctgag

SEQ ID NO: 54957 - DNA, 25 bp, Homo sapien
ctcagaaaaaattgttccctctgag

SEQ ID NO: 54958 - DNA, 25 bp, Homo sapien
ctcagaaaaagaccacctaagatca

SEQ ID NO: 54959 - DNA, 25 bp, Homo sapien
ctcagaaaaagaccgcctaagatca

SEQ ID NO: 54960 - DNA, 25 bp, Homo sapien
ctcagaaacagccaggatacagtga

SEQ ID NO: 54961 - DNA, 25 bp, Homo sapien
ctcagaaacagccgggatacagtga

SEQ ID NO: 54962 - DNA, 25 bp, Homo sapien
ctcagaaaccatggagccatattgt

SEQ ID NO: 54963 - DNA, 25 bp, Homo sapien
ctcagaaatcatggagccatattgt

SEQ ID NO: 54964 - DNA, 25 bp, Homo sapien
ctcagaacactagcagcgagaaaga

SEQ ID NO: 54965 - DNA, 25 bp, Homo sapien
ctcagaacactagcggcgagaaaga

SEQ ID NO: 54966 - DNA, 25 bp, Homo sapien
ctcagaactagtttattcaattatt

SEQ ID NO: 54967 - DNA, 25 bp, Homo sapien
ctcagaactggtttattcaattatt

SEQ ID NO: 54968 - DNA, 25 bp, Homo sapien
ctcagaagctaatcataaagtggac

SEQ ID NO: 54969 - DNA, 25 bp, Homo sapien
ctcagaagctaatcgtaaagtggac

SEQ ID NO: 54970 - DNA, 25 bp, Homo sapien
ctcagaagggccactccaaactctt

SEQ ID NO: 54971 - DNA, 25 bp, Homo sapien
ctcagaagggccactctaaactctt

SEQ ID NO: 54972 - DNA, 25 bp, Homo sapien
ctcagaataggaatagcataatttc

SEQ ID NO: 54973 - DNA, 25 bp, Homo sapien
ctcagaatatactgatgaatgcaaa

SEQ ID NO: 54974 - DNA, 25 bp, Homo sapien
ctcagaatatattgatgaatgcaaa

SEQ ID NO: 54975 - DNA, 25 bp, Homo sapien
ctcagaatcgcttggagagctcctt

SEQ ID NO: 54976 - DNA, 25 bp, Homo sapien
ctcagaatctcttggagagctcctt

SEQ ID NO: 54977 - DNA, 25 bp, Homo sapien
ctcagaatggttaagtaacttgcca

SEQ ID NO: 54978 - DNA, 25 bp, Homo sapien
ctcagaatggttaggtaacttgcca

SEQ ID NO: 54979 - DNA, 25 bp, Homo sapien
ctcagaattggaatagcataatttc

SEQ ID NO: 54980 - DNA, 25 bp, Homo sapien
ctcagaattttgcaagtgcttcagg

SEQ ID NO: 54981 - DNA, 25 bp, Homo sapien
ctcagaattttggaagtgcttcagg

SEQ ID NO: 54982 - DNA, 25 bp, Homo sapien
ctcagacaagttacctaacatctct

SEQ ID NO: 54983 - DNA, 25 bp, Homo sapien
ctcagacaagttacttaacatctct

SEQ ID NO: 54984 - DNA, 25 bp, Homo sapien
ctcagaccaataactattctcagtc

SEQ ID NO: 54985 - DNA, 25 bp, Homo sapien
ctcagaccaatgactattctcagtc

SEQ ID NO: 54986 - DNA, 25 bp, Homo sapien
ctcagactacatattacagaagaaa

SEQ ID NO: 54987 - DNA, 25 bp, Homo sapien
ctcagactagatattacagaagaaa

SEQ ID NO: 54988 - DNA, 25 bp, Homo sapien
ctcagagaagcacgtgtgactatat

SEQ ID NO: 54989 - DNA, 25 bp, Homo sapien
ctcagagaaggaggattgcattgtg

SEQ ID NO: 54990 - DNA, 25 bp, Homo sapien
ctcagagaaggagggttgcattgtg

SEQ ID NO: 54991 - DNA, 25 bp, Homo sapien
ctcagagaccaaagagcaagagttt

SEQ ID NO: 54992 - DNA, 25 bp, Homo sapien
ctcagagacgttaagcaatttgttc

SEQ ID NO: 54993 - DNA, 25 bp, Homo sapien
ctcagagaggcacgtgtgactatat

SEQ ID NO: 54994 - DNA, 25 bp, Homo sapien
ctcagagatcaaagagcaagagttt

SEQ ID NO: 54995 - DNA, 25 bp, Homo sapien
ctcagagatgttaagcaatttgttc

SEQ ID NO: 54996 - DNA, 25 bp, Homo sapien
ctcagagccagaaaagggttttttg

SEQ ID NO: 54997 - DNA, 25 bp, Homo sapien
ctcagagccggaaaagggttttttg

SEQ ID NO: 54998 - DNA, 25 bp, Homo sapien
ctcagagctggaacggtgtactaag

SEQ ID NO: 54999 - DNA, 25 bp, Homo sapien
ctcagagctggaatggtgtactaag

SEQ ID NO: 55000 - DNA, 25 bp, Homo sapien
ctcagagcttgccaggtagtgagtg

SEQ ID NO: 55001 - DNA, 25 bp, Homo sapien
ctcagagcttgtcaggtagtgagtg

SEQ ID NO: 55002 - DNA, 25 bp, Homo sapien
ctcagagggaaatatacagctgcaa

SEQ ID NO: 55003 - DNA, 25 bp, Homo sapien
ctcagagggaaatatatagctgcaa

SEQ ID NO: 55004 - DNA, 25 bp, Homo sapien
ctcagagggttgcattgcatgtcag

SEQ ID NO: 55005 - DNA, 25 bp, Homo sapien
ctcagagggttgcgttgcatgtcag

SEQ ID NO: 55006 - DNA, 25 bp, Homo sapien
ctcagagtctcaccaaaggtttttg

SEQ ID NO: 55007 - DNA, 25 bp, Homo sapien
ctcagagtctcatcaaaggtttttg

SEQ ID NO: 55008 - DNA, 25 bp, Homo sapien
ctcagatacaggacatataaacaca

SEQ ID NO: 55009 - DNA, 25 bp, Homo sapien
ctcagatataggacatataaacaca

SEQ ID NO: 55010 - DNA, 25 bp, Homo sapien
ctcagatatattagagaaaaaaatg

SEQ ID NO: 55011 - DNA, 25 bp, Homo sapien
ctcagatatattagggaaaaaaatg

SEQ ID NO: 55012 - DNA, 25 bp, Homo sapien
ctcagatgcctattgtattaccgag

SEQ ID NO: 55013 - DNA, 25 bp, Homo sapien
ctcagatgcctattttattaccgag

SEQ ID NO: 55014 - DNA, 25 bp, Homo sapien
ctcagatgtccccctggtagtaaag

SEQ ID NO: 55015 - DNA, 25 bp, Homo sapien
ctcagatgttcccctggtagtaaag

SEQ ID NO: 55016 - DNA, 25 bp, Homo sapien
ctcagatgtttgcacctttctttaa

SEQ ID NO: 55017 - DNA, 25 bp, Homo sapien
ctcagatgtttgtacctttctttaa

SEQ ID NO: 55018 - DNA, 25 bp, Homo sapien
ctcagatgtttgtctgctctttgtt

SEQ ID NO: 55019 - DNA, 25 bp, Homo sapien
ctcagatgtttgtttgctctttgtt

SEQ ID NO: 55020 - DNA, 25 bp, Homo sapien
ctcagcaaccacagggaggatccag

SEQ ID NO: 55021 - DNA, 25 bp, Homo sapien
ctcagcaactacagggaggatccag

SEQ ID NO: 55022 - DNA, 25 bp, Homo sapien
ctcagcacacggcatcacacccagt

SEQ ID NO: 55023 - DNA, 25 bp, Homo sapien
ctcagcacacggcatcgcacccagt

SEQ ID NO: 55024 - DNA, 25 bp, Homo sapien
ctcagcacatgagttgcctactgac

SEQ ID NO: 55025 - DNA, 25 bp, Homo sapien
ctcagcacatgagttgtctactgac

SEQ ID NO: 55026 - DNA, 25 bp, Homo sapien
ctcagcagtctgtatgacctctaat

SEQ ID NO: 55027 - DNA, 25 bp, Homo sapien
ctcagcagtctgtatggcctctaat

SEQ ID NO: 55028 - DNA, 25 bp, Homo sapien
ctcagcatcttcgtcgtctcctatc

SEQ ID NO: 55029 - DNA, 25 bp, Homo sapien
ctcagcatcttcttcgtctcctatc

SEQ ID NO: 55030 - DNA, 25 bp, Homo sapien
ctcagcatgaagcagccggaaagat

SEQ ID NO: 55031 - DNA, 25 bp, Homo sapien
ctcagcatgaagcagctggaaagat

SEQ ID NO: 55032 - DNA, 25 bp, Homo sapien
ctcagccacattgcatactctgatt

SEQ ID NO: 55033 - DNA, 25 bp, Homo sapien
ctcagccacgaattaacttgctctt

SEQ ID NO: 55034 - DNA, 25 bp, Homo sapien
ctcagccacgttgcatactctgatt

SEQ ID NO: 55035 - DNA, 25 bp, Homo sapien
ctcagccacttggctccgctgtatt

SEQ ID NO: 55036 - DNA, 25 bp, Homo sapien
ctcagccacttggctctgctgtatt

SEQ ID NO: 55037 - DNA, 25 bp, Homo sapien
ctcagccaggctacaacaaggagtc

SEQ ID NO: 55038 - DNA, 25 bp, Homo sapien
ctcagccaggctgcaacaaggagtc

SEQ ID NO: 55039 - DNA, 25 bp, Homo sapien
ctcagccatgaattaacttgctctt

SEQ ID NO: 55040 - DNA, 25 bp, Homo sapien
ctcagccctgagagtccttgcctga

SEQ ID NO: 55041 - DNA, 25 bp, Homo sapien
ctcagccctgagggtccttgcctga

SEQ ID NO: 55042 - DNA, 25 bp, Homo sapien
ctcagcctccatcaatattagagaa

SEQ ID NO: 55043 - DNA, 25 bp, Homo sapien
ctcagcctccatcaatgttagagaa

SEQ ID NO: 55044 - DNA, 25 bp, Homo sapien
ctcagctaagagacgaagaccatcc

SEQ ID NO: 55045 - DNA, 25 bp, Homo sapien
ctcagctaagagactaagaccatcc

SEQ ID NO: 55046 - DNA, 25 bp, Homo sapien
ctcagctaccaacactgtgttcttt

SEQ ID NO: 55047 - DNA, 25 bp, Homo sapien
ctcagctaccaagactgtgttcttt

SEQ ID NO: 55048 - DNA, 25 bp, Homo sapien
ctcagctagatttcaactagagagc

SEQ ID NO: 55049 - DNA, 25 bp, Homo sapien
ctcagctaggtttcaactagagagc

SEQ ID NO: 55050 - DNA, 25 bp, Homo sapien
ctcagctagtaacaaacgcaagctt

SEQ ID NO: 55051 - DNA, 25 bp, Homo sapien
ctcagctagtaacaaatgcaagctt

SEQ ID NO: 55052 - DNA, 25 bp, Homo sapien
ctcagctcaagtcttcactgacccc

SEQ ID NO: 55053 - DNA, 25 bp, Homo sapien
ctcagctcaagttttcactgacccc

SEQ ID NO: 55054 - DNA, 25 bp, Homo sapien
ctcagctcctctttgacaggagttg

SEQ ID NO: 55055 - DNA, 25 bp, Homo sapien
ctcagctcgtctttgacaggagttg

SEQ ID NO: 55056 - DNA, 25 bp, Homo sapien
ctcagctgcaataaaaaagttacaa

SEQ ID NO: 55057 - DNA, 25 bp, Homo sapien
ctcagctgcgataaaaaagttacaa

SEQ ID NO: 55058 - DNA, 25 bp, Homo sapien
ctcagctgtaaaaacaccttctctg

SEQ ID NO: 55059 - DNA, 25 bp, Homo sapien
ctcagctgtaaaagcaccttctctg

SEQ ID NO: 55060 - DNA, 25 bp, Homo sapien
ctcagcttaccatattttcagagtt

SEQ ID NO: 55061 - DNA, 25 bp, Homo sapien
ctcagcttaccatgttttcagagtt

SEQ ID NO: 55062 - DNA, 25 bp, Homo sapien
ctcagcttcgtcggtgccaatgctt

SEQ ID NO: 55063 - DNA, 25 bp, Homo sapien
ctcagctttcgatatgcctccctaa

SEQ ID NO: 55064 - DNA, 25 bp, Homo sapien
ctcagctttgtcggtgccaatgctt

SEQ ID NO: 55065 - DNA, 25 bp, Homo sapien
ctcagcttttgatatgcctccctaa

SEQ ID NO: 55066 - DNA, 25 bp, Homo sapien
ctcaggaaaataggaagaagaaatg

SEQ ID NO: 55067 - DNA, 25 bp, Homo sapien
ctcaggaaaatgggaagaagaaatg

SEQ ID NO: 55068 - DNA, 25 bp, Homo sapien
ctcaggaagtttacaagcatggtgg

SEQ ID NO: 55069 - DNA, 25 bp, Homo sapien
ctcaggaattttacaagcatggtgg

SEQ ID NO: 55070 - DNA, 25 bp, Homo sapien
ctcaggagcaagccagggaagaaag

SEQ ID NO: 55071 - DNA, 25 bp, Homo sapien
ctcaggagcaagtcagggaagaaag

SEQ ID NO: 55072 - DNA, 25 bp, Homo sapien
ctcaggatcacacaacattctaggt

SEQ ID NO: 55073 - DNA, 25 bp, Homo sapien
ctcaggatcacacagcattctaggt

SEQ ID NO: 55074 - DNA, 25 bp, Homo sapien
ctcaggatccaattactcccattgc

SEQ ID NO: 55075 - DNA, 25 bp, Homo sapien
ctcaggatcgaattactcccattgc

SEQ ID NO: 55076 - DNA, 25 bp, Homo sapien
ctcaggatgggtacaatgaagcaga

SEQ ID NO: 55077 - DNA, 25 bp, Homo sapien
ctcaggatgggtgcaatgaagcaga

SEQ ID NO: 55078 - DNA, 25 bp, Homo sapien
ctcaggcagaaggcacgacgattgt

SEQ ID NO: 55079 - DNA, 25 bp, Homo sapien
ctcaggcaggaggcacgacgattgt

SEQ ID NO: 55080 - DNA, 25 bp, Homo sapien
ctcaggccactccaacaaaatacct

SEQ ID NO: 55081 - DNA, 25 bp, Homo sapien
ctcaggccactgcaacaaaatacct

SEQ ID NO: 55082 - DNA, 25 bp, Homo sapien
ctcaggccagtcactttctttttta

SEQ ID NO: 55083 - DNA, 25 bp, Homo sapien
ctcaggccggtcactttctttttta

SEQ ID NO: 55084 - DNA, 25 bp, Homo sapien
ctcagggacctacaagactacaatc

SEQ ID NO: 55085 - DNA, 25 bp, Homo sapien
ctcagggatcctttcgatgcactga

SEQ ID NO: 55086 - DNA, 25 bp, Homo sapien
ctcagggatccttttgatgcactga

SEQ ID NO: 55087 - DNA, 25 bp, Homo sapien
ctcagggatctacaagactacaatc

SEQ ID NO: 55088 - DNA, 25 bp, Homo sapien
ctcagggcaaacgtcaactccactg

SEQ ID NO: 55089 - DNA, 25 bp, Homo sapien
ctcagggcaaatgtcaactccactg

SEQ ID NO: 55090 - DNA, 25 bp, Homo sapien
ctcagggcacgacgagaagcccata

SEQ ID NO: 55091 - DNA, 25 bp, Homo sapien
ctcagggcacgatgagaagcccata

SEQ ID NO: 55092 - DNA, 25 bp, Homo sapien
ctcagggcctactgttcagcctgcc

SEQ ID NO: 55093 - DNA, 25 bp, Homo sapien
ctcagggcctgacttggcatccaac

SEQ ID NO: 55094 - DNA, 25 bp, Homo sapien
ctcagggcctgtcttggcatccaac

SEQ ID NO: 55095 - DNA, 25 bp, Homo sapien
ctcagggcctttcacattatttttc

SEQ ID NO: 55096 - DNA, 25 bp, Homo sapien
ctcagggcctttcatattatttttc

SEQ ID NO: 55097 - DNA, 25 bp, Homo sapien
ctcagggcttactgttcagcctgcc

SEQ ID NO: 55098 - DNA, 25 bp, Homo sapien
ctcaggttgccaagcgccacccttc

SEQ ID NO: 55099 - DNA, 25 bp, Homo sapien
ctcaggttgccaagtgccacccttc

SEQ ID NO: 55100 - DNA, 25 bp, Homo sapien
ctcaggttggggattagctctctca

SEQ ID NO: 55101 - DNA, 25 bp, Homo sapien
ctcaggttggggattatctctctca

SEQ ID NO: 55102 - DNA, 25 bp, Homo sapien
ctcaggtttgctctaaatacaccca

SEQ ID NO: 55103 - DNA, 25 bp, Homo sapien
ctcaggtttgctgtaaatacaccca

SEQ ID NO: 55104 - DNA, 25 bp, Homo sapien
ctcagtaactgcgtgtgactaatgg

SEQ ID NO: 55105 - DNA, 25 bp, Homo sapien
ctcagtaactgtgtgtgactaatgg

SEQ ID NO: 55106 - DNA, 25 bp, Homo sapien
ctcagtaagactgtaccattcatca

SEQ ID NO: 55107 - DNA, 25 bp, Homo sapien
ctcagtaagactttaccattcatca

SEQ ID NO: 55108 - DNA, 25 bp, Homo sapien
ctcagtaatgccaacgttctgttag

SEQ ID NO: 55109 - DNA, 25 bp, Homo sapien
ctcagtaatgccaaggttctgttag

SEQ ID NO: 55110 - DNA, 25 bp, Homo sapien
ctcagtacagacagtcttcatgcaa

SEQ ID NO: 55111 - DNA, 25 bp, Homo sapien
ctcagtacagacattcttcatgcaa

SEQ ID NO: 55112 - DNA, 25 bp, Homo sapien
ctcagtacagtctaggagagaacta

SEQ ID NO: 55113 - DNA, 25 bp, Homo sapien
ctcagtacagtgtaggagagaacta

SEQ ID NO: 55114 - DNA, 25 bp, Homo sapien
ctcagtagtgtcaaagagtttgctt

SEQ ID NO: 55115 - DNA, 25 bp, Homo sapien
ctcagtagtgtcaaggagtttgctt

SEQ ID NO: 55116 - DNA, 25 bp, Homo sapien
ctcagtattcctctttaatttatct

SEQ ID NO: 55117 - DNA, 25 bp, Homo sapien
ctcagtattcctctttgatttatct

SEQ ID NO: 55118 - DNA, 25 bp, Homo sapien
ctcagtcatcaagaacaactagaaa

SEQ ID NO: 55119 - DNA, 25 bp, Homo sapien
ctcagtcatcaggaacaactagaaa

SEQ ID NO: 55120 - DNA, 25 bp, Homo sapien
ctcagtcatgactatcagtaattta

SEQ ID NO: 55121 - DNA, 25 bp, Homo sapien
ctcagtcatgactatcggtaattta

SEQ ID NO: 55122 - DNA, 25 bp, Homo sapien
ctcagtcgtgtttctctaatgagat

SEQ ID NO: 55123 - DNA, 25 bp, Homo sapien
ctcagtcgtgtttgtctaatgagat

SEQ ID NO: 55124 - DNA, 25 bp, Homo sapien
ctcagtctccatagttatatgagcc

SEQ ID NO: 55125 - DNA, 25 bp, Homo sapien
ctcagtctgcatagttatatgagcc

SEQ ID NO: 55126 - DNA, 25 bp, Homo sapien
ctcagtctggacgtaggagttggca

SEQ ID NO: 55127 - DNA, 25 bp, Homo sapien
ctcagtctggatgtaggagttggca

SEQ ID NO: 55128 - DNA, 25 bp, Homo sapien
ctcagtgatacaacccttttataag

SEQ ID NO: 55129 - DNA, 25 bp, Homo sapien
ctcagtgatacgacccttttataag

SEQ ID NO: 55130 - DNA, 25 bp, Homo sapien
ctcagtgccgagtaaagtgtgatac

SEQ ID NO: 55131 - DNA, 25 bp, Homo sapien
ctcagtgccgagtgaagtgtgatac

SEQ ID NO: 55132 - DNA, 25 bp, Homo sapien
ctcagtggtccacgtgctacaactg

SEQ ID NO: 55133 - DNA, 25 bp, Homo sapien
ctcagtggtccatgtgctacaactg

SEQ ID NO: 55134 - DNA, 25 bp, Homo sapien
ctcagtggtgctcccagaggctcgg

SEQ ID NO: 55135 - DNA, 25 bp, Homo sapien
ctcagtggtgcttccagaggctcgg

SEQ ID NO: 55136 - DNA, 25 bp, Homo sapien
ctcagtgtaaacatcaaagatctta

SEQ ID NO: 55137 - DNA, 25 bp, Homo sapien
ctcagtgtaaacgtcaaagatctta

SEQ ID NO: 55138 - DNA, 25 bp, Homo sapien
ctcagttcaggtcttctagctttag

SEQ ID NO: 55139 - DNA, 25 bp, Homo sapien
ctcagttccttcttggaaatctttc

SEQ ID NO: 55140 - DNA, 25 bp, Homo sapien
ctcagttcctttttggaaatctttc

SEQ ID NO: 55141 - DNA, 25 bp, Homo sapien
ctcagttcgggtcttctagctttag

SEQ ID NO: 55142 - DNA, 25 bp, Homo sapien
ctcagttgaagacctcacttattat

SEQ ID NO: 55143 - DNA, 25 bp, Homo sapien
ctcagttgaagatctcacttattat

SEQ ID NO: 55144 - DNA, 25 bp, Homo sapien
ctcagtttacagttggctaaatatg

SEQ ID NO: 55145 - DNA, 25 bp, Homo sapien
ctcagtttacagttggttaaatatg

SEQ ID NO: 55146 - DNA, 25 bp, Homo sapien
ctcagtttctacatagcgtttgaaa

SEQ ID NO: 55147 - DNA, 25 bp, Homo sapien
ctcagtttctacatagtgtttgaaa

SEQ ID NO: 55148 - DNA, 25 bp, Homo sapien
ctcagtttgggagagaatatgattt

SEQ ID NO: 55149 - DNA, 25 bp, Homo sapien
ctcagttttggagagaatatgattt

SEQ ID NO: 55150 - DNA, 25 bp, Homo sapien
ctcagtttttacgtcacttaaatgt

SEQ ID NO: 55151 - DNA, 25 bp, Homo sapien
ctcagtttttatgtcacttaaatgt

SEQ ID NO: 55152 - DNA, 25 bp, Homo sapien
ctcataaaaattacaaataaaacat

SEQ ID NO: 55153 - DNA, 25 bp, Homo sapien
ctcataaaagttacaaataaaacat

SEQ ID NO: 55154 - DNA, 25 bp, Homo sapien
ctcataaacaaaggaagctaggatg

SEQ ID NO: 55155 - DNA, 25 bp, Homo sapien
ctcataaacaagggaagctaggatg

SEQ ID NO: 55156 - DNA, 25 bp, Homo sapien
ctcataagcctgcaaaaataagatt

SEQ ID NO: 55157 - DNA, 25 bp, Homo sapien
ctcataagcctgcgaaaataagatt

SEQ ID NO: 55158 - DNA, 25 bp, Homo sapien
ctcataagcggcctttggagtatta

SEQ ID NO: 55159 - DNA, 25 bp, Homo sapien
ctcataagcgggctttggagtatta

SEQ ID NO: 55160 - DNA, 25 bp, Homo sapien
ctcataattctagcaaagagtccta

SEQ ID NO: 55161 - DNA, 25 bp, Homo sapien
ctcataattctaggaaagagtccta

SEQ ID NO: 55162 - DNA, 25 bp, Homo sapien
ctcatacacagctactggggatgta

SEQ ID NO: 55163 - DNA, 25 bp, Homo sapien
ctcatacaccgctactggggatgta

SEQ ID NO: 55164 - DNA, 25 bp, Homo sapien
ctcatacacgcaattgtgtgaagaa

SEQ ID NO: 55165 - DNA, 25 bp, Homo sapien
ctcatacatgcaattgtgtgaagaa

SEQ ID NO: 55166 - DNA, 25 bp, Homo sapien
ctcatacccagccgaggctttctcc

SEQ ID NO: 55167 - DNA, 25 bp, Homo sapien
ctcatacccaggcgaggctttctcc

SEQ ID NO: 55168 - DNA, 25 bp, Homo sapien
ctcatactttagcccaaaaagaaag

SEQ ID NO: 55169 - DNA, 25 bp, Homo sapien
ctcatactttagcccataaagaaag

SEQ ID NO: 55170 - DNA, 25 bp, Homo sapien
ctcatagaaacagaagacatgactt

SEQ ID NO: 55171 - DNA, 25 bp, Homo sapien
ctcatagaagcagaagacatgactt

SEQ ID NO: 55172 - DNA, 25 bp, Homo sapien
ctcatagaggatgaagacagggtac

SEQ ID NO: 55173 - DNA, 25 bp, Homo sapien
ctcatagaggatgacgacagggtac

SEQ ID NO: 55174 - DNA, 25 bp, Homo sapien
ctcatagagtttgcagactagtgag

SEQ ID NO: 55175 - DNA, 25 bp, Homo sapien
ctcatagagtttggagactagtgag

SEQ ID NO: 55176 - DNA, 25 bp, Homo sapien
ctcatagttttctactggaccccac

SEQ ID NO: 55177 - DNA, 25 bp, Homo sapien
ctcatagttttctattggaccccac

SEQ ID NO: 55178 - DNA, 25 bp, Homo sapien
ctcatatacagtcctcatcaacaca

SEQ ID NO: 55179 - DNA, 25 bp, Homo sapien
ctcatatacagtcctcgtcaacaca

SEQ ID NO: 55180 - DNA, 25 bp, Homo sapien
ctcatcaaaattcctgccttacact

SEQ ID NO: 55181 - DNA, 25 bp, Homo sapien
ctcatcaaaatttctgccttacact

SEQ ID NO: 55182 - DNA, 25 bp, Homo sapien
ctcatcaacactccttattaactgc

SEQ ID NO: 55183 - DNA, 25 bp, Homo sapien
ctcatcaacacttcttattaactgc

SEQ ID NO: 55184 - DNA, 25 bp, Homo sapien
ctcatcaccaacagaaaccatacca

SEQ ID NO: 55185 - DNA, 25 bp, Homo sapien
ctcatcaccaagagaaaccatacca

SEQ ID NO: 55186 - DNA, 25 bp, Homo sapien
ctcatcactagaaacaaaaagggtc

SEQ ID NO: 55187 - DNA, 25 bp, Homo sapien
ctcatcactcagatttaatacattt

SEQ ID NO: 55188 - DNA, 25 bp, Homo sapien
ctcatcactcagatttgatacattt

SEQ ID NO: 55189 - DNA, 25 bp, Homo sapien
ctcatcactggaaacaaaaagggtc

SEQ ID NO: 55190 - DNA, 25 bp, Homo sapien
ctcatcagcaactgaaatgatatga

SEQ ID NO: 55191 - DNA, 25 bp, Homo sapien
ctcatcagcaactgaagtgatatga

SEQ ID NO: 55192 - DNA, 25 bp, Homo sapien
ctcatcaggctggctggactctcgc

SEQ ID NO: 55193 - DNA, 25 bp, Homo sapien
ctcatcaggctggttggactctcgc

SEQ ID NO: 55194 - DNA, 25 bp, Homo sapien
ctcatccacatttacccagggctta

SEQ ID NO: 55195 - DNA, 25 bp, Homo sapien
ctcatccacatttgcccagggctta

SEQ ID NO: 55196 - DNA, 25 bp, Homo sapien
ctcatccatgacatcaatagtttag

SEQ ID NO: 55197 - DNA, 25 bp, Homo sapien
ctcatccatgacattaatagtttag

SEQ ID NO: 55198 - DNA, 25 bp, Homo sapien
ctcatcctacagtagacaaacatac

SEQ ID NO: 55199 - DNA, 25 bp, Homo sapien
ctcatcctacagtagataaacatac

SEQ ID NO: 55200 - DNA, 25 bp, Homo sapien
ctcatcctgttgatcaatgacacta

SEQ ID NO: 55201 - DNA, 25 bp, Homo sapien
ctcatcctgttgatcagtgacacta

SEQ ID NO: 55202 - DNA, 25 bp, Homo sapien
ctcatcgagttctcgtcatgagccc

SEQ ID NO: 55203 - DNA, 25 bp, Homo sapien
ctcatcgagttcttgtcatgagccc

SEQ ID NO: 55204 - DNA, 25 bp, Homo sapien
ctcatctacaaaaataggtaggtag

SEQ ID NO: 55205 - DNA, 25 bp, Homo sapien
ctcatctacaaaactaggtaggtag

SEQ ID NO: 55206 - DNA, 25 bp, Homo sapien
ctcatctcatagctccactagacag

SEQ ID NO: 55207 - DNA, 25 bp, Homo sapien
ctcatctccttcaacgagcttgttg

SEQ ID NO: 55208 - DNA, 25 bp, Homo sapien
ctcatctccttcaatgagcttgttg

SEQ ID NO: 55209 - DNA, 25 bp, Homo sapien
ctcatctcttagctccactagacag

SEQ ID NO: 55210 - DNA, 25 bp, Homo sapien
ctcatctgctctgacgccctaggga

SEQ ID NO: 55211 - DNA, 25 bp, Homo sapien
ctcatctgctctgatgccctaggga

SEQ ID NO: 55212 - DNA, 25 bp, Homo sapien
ctcatctgttctcctttgtttgcag

SEQ ID NO: 55213 - DNA, 25 bp, Homo sapien
ctcatctgttctcgtttgtttgcag

SEQ ID NO: 55214 - DNA, 25 bp, Homo sapien
ctcatctttgctctaggcactgttc

SEQ ID NO: 55215 - DNA, 25 bp, Homo sapien
ctcatctttgctttaggcactgttc

SEQ ID NO: 55216 - DNA, 25 bp, Homo sapien
ctcatgaaagactccaacaaggcag

SEQ ID NO: 55217 - DNA, 25 bp, Homo sapien
ctcatgaaagattccaacaaggcag

SEQ ID NO: 55218 - DNA, 25 bp, Homo sapien
ctcatgaactggcattctttctttt

SEQ ID NO: 55219 - DNA, 25 bp, Homo sapien
ctcatgaagacagatgggaagtgga

SEQ ID NO: 55220 - DNA, 25 bp, Homo sapien
ctcatgaagccagatgggaagtgga

SEQ ID NO: 55221 - DNA, 25 bp, Homo sapien
ctcatgaatatcacatccaaaacct

SEQ ID NO: 55222 - DNA, 25 bp, Homo sapien
ctcatgaatatcagatccaaaacct

SEQ ID NO: 55223 - DNA, 25 bp, Homo sapien
ctcatgaattggcattctttctttt

SEQ ID NO: 55224 - DNA, 25 bp, Homo sapien
ctcatgacattagcaaagtgtaagt

SEQ ID NO: 55225 - DNA, 25 bp, Homo sapien
ctcatgacattagtaaagtgtaagt

SEQ ID NO: 55226 - DNA, 25 bp, Homo sapien
ctcatgaccctgagttaagccaagc

SEQ ID NO: 55227 - DNA, 25 bp, Homo sapien
ctcatgaccttgagttaagccaagc

SEQ ID NO: 55228 - DNA, 25 bp, Homo sapien
ctcatgagttttgcatgttgcgttc

SEQ ID NO: 55229 - DNA, 25 bp, Homo sapien
ctcatgagttttgcgtgttgcgttc

SEQ ID NO: 55230 - DNA, 25 bp, Homo sapien
ctcatgatacaatggcatgccccac

SEQ ID NO: 55231 - DNA, 25 bp, Homo sapien
ctcatgatagaatggcatgccccac

SEQ ID NO: 55232 - DNA, 25 bp, Homo sapien
ctcatgcacaataccgacttataaa

SEQ ID NO: 55233 - DNA, 25 bp, Homo sapien
ctcatgcacaatactgacttataaa

SEQ ID NO: 55234 - DNA, 25 bp, Homo sapien
ctcatgccattctcctaactcatat

SEQ ID NO: 55235 - DNA, 25 bp, Homo sapien
ctcatgccgttctcctaactcatat

SEQ ID NO: 55236 - DNA, 25 bp, Homo sapien
ctcatgctagaaatccaatacttgg

SEQ ID NO: 55237 - DNA, 25 bp, Homo sapien
ctcatgctagaactccaatacttgg

SEQ ID NO: 55238 - DNA, 25 bp, Homo sapien
ctcatgctcttgaagttcgtgatga

SEQ ID NO: 55239 - DNA, 25 bp, Homo sapien
ctcatgctcttgacgttcgtgatga

SEQ ID NO: 55240 - DNA, 25 bp, Homo sapien
ctcatgggattcctataagcattgt

SEQ ID NO: 55241 - DNA, 25 bp, Homo sapien
ctcatgggattcctgtaagcattgt

SEQ ID NO: 55242 - DNA, 25 bp, Homo sapien
ctcatggtaagcagacacctacctg

SEQ ID NO: 55243 - DNA, 25 bp, Homo sapien
ctcatggtaagcggacacctacctg

SEQ ID NO: 55244 - DNA, 25 bp, Homo sapien
ctcatggtcctgtgcaaattaataa

SEQ ID NO: 55245 - DNA, 25 bp, Homo sapien
ctcatggtctgcttgtcctccagat

SEQ ID NO: 55246 - DNA, 25 bp, Homo sapien
ctcatggtcttgtgcaaattaataa

SEQ ID NO: 55247 - DNA, 25 bp, Homo sapien
ctcatggttaatcacgaagcagtgg

SEQ ID NO: 55248 - DNA, 25 bp, Homo sapien
ctcatggttaatcatgaagcagtgg

SEQ ID NO: 55249 - DNA, 25 bp, Homo sapien
ctcatggttagtatggattggtgta

SEQ ID NO: 55250 - DNA, 25 bp, Homo sapien
ctcatggttagtatgggttggtgta

SEQ ID NO: 55251 - DNA, 25 bp, Homo sapien
ctcatggttgtactggagagcaatt

SEQ ID NO: 55252 - DNA, 25 bp, Homo sapien
ctcatggttgttctggagagcaatt

SEQ ID NO: 55253 - DNA, 25 bp, Homo sapien
ctcatggtttgcttgtcctccagat

SEQ ID NO: 55254 - DNA, 25 bp, Homo sapien
ctcatgtcagcactatggctcagaa

SEQ ID NO: 55255 - DNA, 25 bp, Homo sapien
ctcatgtcagcagtatggctcagaa

SEQ ID NO: 55256 - DNA, 25 bp, Homo sapien
ctcatgtggatggccgaggtgccca

SEQ ID NO: 55257 - DNA, 25 bp, Homo sapien
ctcatgtggatggctgaggtgccca

SEQ ID NO: 55258 - DNA, 25 bp, Homo sapien
ctcattaaacacttatttctggcaa

SEQ ID NO: 55259 - DNA, 25 bp, Homo sapien
ctcattaaacatttatttctggcaa

SEQ ID NO: 55260 - DNA, 25 bp, Homo sapien
ctcattactcatgaagacagatggg

SEQ ID NO: 55261 - DNA, 25 bp, Homo sapien
ctcattactcatgaagccagatggg

SEQ ID NO: 55262 - DNA, 25 bp, Homo sapien
ctcattatagtgaacgagtctcacg

SEQ ID NO: 55263 - DNA, 25 bp, Homo sapien
ctcattatagtgaatgagtctcacg

SEQ ID NO: 55264 - DNA, 25 bp, Homo sapien
ctcattatgtccacgttgagtaccc

SEQ ID NO: 55265 - DNA, 25 bp, Homo sapien
ctcattatgtccatgttgagtaccc

SEQ ID NO: 55266 - DNA, 25 bp, Homo sapien
ctcattcacattgtgtctcattcat

SEQ ID NO: 55267 - DNA, 25 bp, Homo sapien
ctcattcacgttgtgtctcattcat

SEQ ID NO: 55268 - DNA, 25 bp, Homo sapien
ctcattcattacctgccattcaata

SEQ ID NO: 55269 - DNA, 25 bp, Homo sapien
ctcattcattacgtgccattcaata

SEQ ID NO: 55270 - DNA, 25 bp, Homo sapien
ctcattcccttcaagctctctcctt

SEQ ID NO: 55271 - DNA, 25 bp, Homo sapien
ctcattccgttcaagctctctcctt

SEQ ID NO: 55272 - DNA, 25 bp, Homo sapien
ctcattcctcgggatttaataagtt

SEQ ID NO: 55273 - DNA, 25 bp, Homo sapien
ctcattccttgggatttaataagtt

SEQ ID NO: 55274 - DNA, 25 bp, Homo sapien
ctcattctcacaaatgtgcacatac

SEQ ID NO: 55275 - DNA, 25 bp, Homo sapien
ctcattctggcagcgccccctgcta

SEQ ID NO: 55276 - DNA, 25 bp, Homo sapien
ctcattctggcagtgccccctgcta

SEQ ID NO: 55277 - DNA, 25 bp, Homo sapien
ctcattcttacaaatgtgcacatac

SEQ ID NO: 55278 - DNA, 25 bp, Homo sapien
ctcattctttgaatcattttatttt

SEQ ID NO: 55279 - DNA, 25 bp, Homo sapien
ctcattctttgattcattttatttt

SEQ ID NO: 55280 - DNA, 25 bp, Homo sapien
ctcattgatagctatggtaaaataa

SEQ ID NO: 55281 - DNA, 25 bp, Homo sapien
ctcattgatagctatgttaaaataa

SEQ ID NO: 55282 - DNA, 25 bp, Homo sapien
ctcattgctcaacttctctgtgcct

SEQ ID NO: 55283 - DNA, 25 bp, Homo sapien
ctcattgctcagcttctctgtgcct

SEQ ID NO: 55284 - DNA, 25 bp, Homo sapien
ctcattggactctagtctcataatg

SEQ ID NO: 55285 - DNA, 25 bp, Homo sapien
ctcattggacttcaattatgcaact

SEQ ID NO: 55286 - DNA, 25 bp, Homo sapien
ctcattggacttcagttatgcaact

SEQ ID NO: 55287 - DNA, 25 bp, Homo sapien
ctcattggagtctagtctcataatg

SEQ ID NO: 55288 - DNA, 25 bp, Homo sapien
ctcattgtattgtgtcaggagcagc

SEQ ID NO: 55289 - DNA, 25 bp, Homo sapien
ctcattgtattgtgtcgggagcagc

SEQ ID NO: 55290 - DNA, 25 bp, Homo sapien
ctcattgtccagaccttcatgtttt

SEQ ID NO: 55291 - DNA, 25 bp, Homo sapien
ctcattgtccaggccttcatgtttt

SEQ ID NO: 55292 - DNA, 25 bp, Homo sapien
ctcatttacagtccttttgcatctc

SEQ ID NO: 55293 - DNA, 25 bp, Homo sapien
ctcatttacggtccttttgcatctc

SEQ ID NO: 55294 - DNA, 25 bp, Homo sapien
ctcatttctcttcatccaggaaggc

SEQ ID NO: 55295 - DNA, 25 bp, Homo sapien
ctcatttctctttatccaggaaggc

SEQ ID NO: 55296 - DNA, 25 bp, Homo sapien
ctcatttgccttacgggtgtctgag

SEQ ID NO: 55297 - DNA, 25 bp, Homo sapien
ctcatttgctttacgggtgtctgag

SEQ ID NO: 55298 - DNA, 25 bp, Homo sapien
ctcatttggctataaagttgtacag

SEQ ID NO: 55299 - DNA, 25 bp, Homo sapien
ctcatttgtctataaagttgtacag

SEQ ID NO: 55300 - DNA, 25 bp, Homo sapien
ctcatttgtctgtgatccctgaagc

SEQ ID NO: 55301 - DNA, 25 bp, Homo sapien
ctcatttgtctttgatccctgaagc

SEQ ID NO: 55302 - DNA, 25 bp, Homo sapien
ctcattttagccttacagaactcct

SEQ ID NO: 55303 - DNA, 25 bp, Homo sapien
ctcattttagccttacggaactcct

SEQ ID NO: 55304 - DNA, 25 bp, Homo sapien
ctcattttatactcctactaacagt

SEQ ID NO: 55305 - DNA, 25 bp, Homo sapien
ctcattttatactgctactaacagt

SEQ ID NO: 55306 - DNA, 25 bp, Homo sapien
ctcattttgagattaccgtgcaatc

SEQ ID NO: 55307 - DNA, 25 bp, Homo sapien
ctcattttgagattactgtgcaatc

SEQ ID NO: 55308 - DNA, 25 bp, Homo sapien
ctcattttggcacaattttgcagag

SEQ ID NO: 55309 - DNA, 25 bp, Homo sapien
ctcattttggcacagttttgcagag

SEQ ID NO: 55310 - DNA, 25 bp, Homo sapien
ctcatttttaatattttttccaatt

SEQ ID NO: 55311 - DNA, 25 bp, Homo sapien
ctcatttttaatgttttttccaatt

SEQ ID NO: 55312 - DNA, 25 bp, Homo sapien
ctccaaaaactaaagtaggaattga

SEQ ID NO: 55313 - DNA, 25 bp, Homo sapien
ctccaaaaactaatgtaggaattga

SEQ ID NO: 55314 - DNA, 25 bp, Homo sapien
ctccaaaaactttcccaatgtattt

SEQ ID NO: 55315 - DNA, 25 bp, Homo sapien
ctccaaaaactttgccaatgtattt

SEQ ID NO: 55316 - DNA, 25 bp, Homo sapien
ctccaaaaatccataggcccagtct

SEQ ID NO: 55317 - DNA, 25 bp, Homo sapien
ctccaaaaatccatagtcccagtct

SEQ ID NO: 55318 - DNA, 25 bp, Homo sapien
ctccaaaacataacggctaaagcca

SEQ ID NO: 55319 - DNA, 25 bp, Homo sapien
ctccaaaacataatggctaaagcca

SEQ ID NO: 55320 - DNA, 25 bp, Homo sapien
ctccaaaataccgagtgaggtctct

SEQ ID NO: 55321 - DNA, 25 bp, Homo sapien
ctccaaaatactgagtgaggtctct

SEQ ID NO: 55322 - DNA, 25 bp, Homo sapien
ctccaaaattacaccctatgctgtg

SEQ ID NO: 55323 - DNA, 25 bp, Homo sapien
ctccaaaattacgccctatgctgtg

SEQ ID NO: 55324 - DNA, 25 bp, Homo sapien
ctccaaacaatgatacatttagagt

SEQ ID NO: 55325 - DNA, 25 bp, Homo sapien
ctccaaacactgatacatttagagt

SEQ ID NO: 55326 - DNA, 25 bp, Homo sapien
ctccaaaccatagacttcgtagtat

SEQ ID NO: 55327 - DNA, 25 bp, Homo sapien
ctccaaaccatagccttcgtagtat

SEQ ID NO: 55328 - DNA, 25 bp, Homo sapien
ctccaaagcccgcttatgagattat

SEQ ID NO: 55329 - DNA, 25 bp, Homo sapien
ctccaaagcctatgcctgaataagt

SEQ ID NO: 55330 - DNA, 25 bp, Homo sapien
ctccaaagcctattcctgaataagt

SEQ ID NO: 55331 - DNA, 25 bp, Homo sapien
ctccaaagcgtgtgggttgctagaa

SEQ ID NO: 55332 - DNA, 25 bp, Homo sapien
ctccaaagctattaggactatgcac

SEQ ID NO: 55333 - DNA, 25 bp, Homo sapien
ctccaaagctattgggactatgcac

SEQ ID NO: 55334 - DNA, 25 bp, Homo sapien
ctccaaaggccgcttatgagattat

SEQ ID NO: 55335 - DNA, 25 bp, Homo sapien
ctccaaagggctaacagtcaaacca

SEQ ID NO: 55336 - DNA, 25 bp, Homo sapien
ctccaaagggctaagagtcaaacca

SEQ ID NO: 55337 - DNA, 25 bp, Homo sapien
ctccaaagtgtgtgggttgctagaa

SEQ ID NO: 55338 - DNA, 25 bp, Homo sapien
ctccaaataaaactgtatttatgga

SEQ ID NO: 55339 - DNA, 25 bp, Homo sapien
ctccaaatataactgtatttatgga

SEQ ID NO: 55340 - DNA, 25 bp, Homo sapien
ctccaacacaatacaaagagctgta

SEQ ID NO: 55341 - DNA, 25 bp, Homo sapien
ctccaacacaatacgaagagctgta

SEQ ID NO: 55342 - DNA, 25 bp, Homo sapien
ctccaacacactctaatgaatcttg

SEQ ID NO: 55343 - DNA, 25 bp, Homo sapien
ctccaacacactgtaatgaatcttg

SEQ ID NO: 55344 - DNA, 25 bp, Homo sapien
ctccaacaccgtgctctctagcttc

SEQ ID NO: 55345 - DNA, 25 bp, Homo sapien
ctccaacactgtgctctctagcttc

SEQ ID NO: 55346 - DNA, 25 bp, Homo sapien
ctccaaccatttttccttctttgct

SEQ ID NO: 55347 - DNA, 25 bp, Homo sapien
ctccaaccattttttcttctttgct

SEQ ID NO: 55348 - DNA, 25 bp, Homo sapien
ctccaacctttttcacaccaaggac

SEQ ID NO: 55349 - DNA, 25 bp, Homo sapien
ctccaacctttttcgcaccaaggac

SEQ ID NO: 55350 - DNA, 25 bp, Homo sapien
ctccaactcaaaacgagaagaagct

SEQ ID NO: 55351 - DNA, 25 bp, Homo sapien
ctccaactcaaaactagaagaagct

SEQ ID NO: 55352 - DNA, 25 bp, Homo sapien
ctccaactcaccttgtccacagaga

SEQ ID NO: 55353 - DNA, 25 bp, Homo sapien
ctccaactcagtagccaaacacact

SEQ ID NO: 55354 - DNA, 25 bp, Homo sapien
ctccaactcgccttgtccacagaga

SEQ ID NO: 55355 - DNA, 25 bp, Homo sapien
ctccaactcggtagccaaacacact

SEQ ID NO: 55356 - DNA, 25 bp, Homo sapien
ctccaactgcccggctacttctctg

SEQ ID NO: 55357 - DNA, 25 bp, Homo sapien
ctccaactgcctggctacttctctg

SEQ ID NO: 55358 - DNA, 25 bp, Homo sapien
ctccaactgtccacttcttcaatct

SEQ ID NO: 55359 - DNA, 25 bp, Homo sapien
ctccaactgtccgcttcttcaatct

SEQ ID NO: 55360 - DNA, 25 bp, Homo sapien
ctccaacttatatcaaccccatttg

SEQ ID NO: 55361 - DNA, 25 bp, Homo sapien
ctccaacttgctcaagaaggtggcc

SEQ ID NO: 55362 - DNA, 25 bp, Homo sapien
ctccaacttgctcatgaaggtggcc

SEQ ID NO: 55363 - DNA, 25 bp, Homo sapien
ctccaacttgtatcaaccccatttg

SEQ ID NO: 55364 - DNA, 25 bp, Homo sapien
ctccaagcaaaataacattgagtag

SEQ ID NO: 55365 - DNA, 25 bp, Homo sapien
ctccaagcaaaatagcattgagtag

SEQ ID NO: 55366 - DNA, 25 bp, Homo sapien
ctccaaggcatatcattgacctttg

SEQ ID NO: 55367 - DNA, 25 bp, Homo sapien
ctccaaggcatgtcattgacctttg

SEQ ID NO: 55368 - DNA, 25 bp, Homo sapien
ctccaatcaattactgacttaacaa

SEQ ID NO: 55369 - DNA, 25 bp, Homo sapien
ctccaatcaattattgacttaacaa

SEQ ID NO: 55370 - DNA, 25 bp, Homo sapien
ctccaatctcaccattggctgactc

SEQ ID NO: 55371 - DNA, 25 bp, Homo sapien
ctccaatctcaccgttggctgactc

SEQ ID NO: 55372 - DNA, 25 bp, Homo sapien
ctccaatgacaaacgtccttataaa

SEQ ID NO: 55373 - DNA, 25 bp, Homo sapien
ctccaatgacaaatgtccttataaa

SEQ ID NO: 55374 - DNA, 25 bp, Homo sapien
ctccaatgcccagtctctgatgata

SEQ ID NO: 55375 - DNA, 25 bp, Homo sapien
ctccaatgcccagtgtctgatgata

SEQ ID NO: 55376 - DNA, 25 bp, Homo sapien
ctccaattactttatgggtagtctg

SEQ ID NO: 55377 - DNA, 25 bp, Homo sapien
ctccaattattttatgggtagtctg

SEQ ID NO: 55378 - DNA, 25 bp, Homo sapien
ctccaattgcattgctccatagctg

SEQ ID NO: 55379 - DNA, 25 bp, Homo sapien
ctccaattgcattgttccatagctg

SEQ ID NO: 55380 - DNA, 25 bp, Homo sapien
ctccacaacaatttctttttttgtt

SEQ ID NO: 55381 - DNA, 25 bp, Homo sapien
ctccacaaccatttctttttttgtt

SEQ ID NO: 55382 - DNA, 25 bp, Homo sapien
ctccacaatgaacgtgtccttctgc

SEQ ID NO: 55383 - DNA, 25 bp, Homo sapien
ctccacaatgaatgtgtccttctgc

SEQ ID NO: 55384 - DNA, 25 bp, Homo sapien
ctccacaccacagctgtagcctaat

SEQ ID NO: 55385 - DNA, 25 bp, Homo sapien
ctccacacctcagctgtagcctaat

SEQ ID NO: 55386 - DNA, 25 bp, Homo sapien
ctccacactaatttctctaagtctt

SEQ ID NO: 55387 - DNA, 25 bp, Homo sapien
ctccacactcatttctctaagtctt

SEQ ID NO: 55388 - DNA, 25 bp, Homo sapien
ctccacagatctactcaaacaagaa

SEQ ID NO: 55389 - DNA, 25 bp, Homo sapien
ctccacagatctactcgaacaagaa

SEQ ID NO: 55390 - DNA, 25 bp, Homo sapien
ctccacagcgttcatcatcactaaa

SEQ ID NO: 55391 - DNA, 25 bp, Homo sapien
ctccacagtgttcatcatcactaaa

SEQ ID NO: 55392 - DNA, 25 bp, Homo sapien
ctccacatgaacacctgttatgctc

SEQ ID NO: 55393 - DNA, 25 bp, Homo sapien
ctccacatggacacctgttatgctc

SEQ ID NO: 55394 - DNA, 25 bp, Homo sapien
ctccaccaatcatgttatacctggg

SEQ ID NO: 55395 - DNA, 25 bp, Homo sapien
ctccaccaatcgtgttatacctggg

SEQ ID NO: 55396 - DNA, 25 bp, Homo sapien
ctccacctatcaaggggacaatgat

SEQ ID NO: 55397 - DNA, 25 bp, Homo sapien
ctccacctatcacggggacaatgat

SEQ ID NO: 55398 - DNA, 25 bp, Homo sapien
ctccacgaaatctacgcacttgtcc

SEQ ID NO: 55399 - DNA, 25 bp, Homo sapien
ctccacgaaatctatgcacttgtcc

SEQ ID NO: 55400 - DNA, 25 bp, Homo sapien
ctccacggttagaggcattcctggg

SEQ ID NO: 55401 - DNA, 25 bp, Homo sapien
ctccacggttagatgcattcctggg

SEQ ID NO: 55402 - DNA, 25 bp, Homo sapien
ctccactaacaatcttgctccgaca

SEQ ID NO: 55403 - DNA, 25 bp, Homo sapien
ctccactaacagtcttgctccgaca

SEQ ID NO: 55404 - DNA, 25 bp, Homo sapien
ctccactctgaatacccagtgagtt

SEQ ID NO: 55405 - DNA, 25 bp, Homo sapien
ctccactctgagtacccagtgagtt

SEQ ID NO: 55406 - DNA, 25 bp, Homo sapien
ctccacttatctggaatacagctcc

SEQ ID NO: 55407 - DNA, 25 bp, Homo sapien
ctccacttgtctggaatacagctcc

SEQ ID NO: 55408 - DNA, 25 bp, Homo sapien
ctccactttggcttttaacaacatg

SEQ ID NO: 55409 - DNA, 25 bp, Homo sapien
ctccactttggctttttacaacatg

SEQ ID NO: 55410 - DNA, 25 bp, Homo sapien
ctccagaaaatgcggttttgttttc

SEQ ID NO: 55411 - DNA, 25 bp, Homo sapien
ctccagaaaatgtggttttgttttc

SEQ ID NO: 55412 - DNA, 25 bp, Homo sapien
ctccagaaatgatgttggtatcact

SEQ ID NO: 55413 - DNA, 25 bp, Homo sapien
ctccagaaatgatgtttgtatcact

SEQ ID NO: 55414 - DNA, 25 bp, Homo sapien
ctccagaattgccgtccacgctaag

SEQ ID NO: 55415 - DNA, 25 bp, Homo sapien
ctccagaattgccgtctacgctaag

SEQ ID NO: 55416 - DNA, 25 bp, Homo sapien
ctccagagactgccgcttttccctt

SEQ ID NO: 55417 - DNA, 25 bp, Homo sapien
ctccagagactgctgcttttccctt

SEQ ID NO: 55418 - DNA, 25 bp, Homo sapien
ctccagagccctgagacagcaaatg

SEQ ID NO: 55419 - DNA, 25 bp, Homo sapien
ctccagagccctgagagagcaaatg

SEQ ID NO: 55420 - DNA, 25 bp, Homo sapien
ctccagagcgtagcatcaaagcaaa

SEQ ID NO: 55421 - DNA, 25 bp, Homo sapien
ctccagaggacactgctctgtacca

SEQ ID NO: 55422 - DNA, 25 bp, Homo sapien
ctccagaggccactgctctgtacca

SEQ ID NO: 55423 - DNA, 25 bp, Homo sapien
ctccagagtgtagcatcaaagcaaa

SEQ ID NO: 55424 - DNA, 25 bp, Homo sapien
ctccagatagcaggatagctgaaca

SEQ ID NO: 55425 - DNA, 25 bp, Homo sapien
ctccagatattgaggcttaagagtc

SEQ ID NO: 55426 - DNA, 25 bp, Homo sapien
ctccagatattgagtcttaagagtc

SEQ ID NO: 55427 - DNA, 25 bp, Homo sapien
ctccagatccctgatacaaaagatc

SEQ ID NO: 55428 - DNA, 25 bp, Homo sapien
ctccagatcctgttaagccactaaa

SEQ ID NO: 55429 - DNA, 25 bp, Homo sapien
ctccagatcgcaggatagctgaaca

SEQ ID NO: 55430 - DNA, 25 bp, Homo sapien
ctccagatctctgatacaaaagatc

SEQ ID NO: 55431 - DNA, 25 bp, Homo sapien
ctccagatggaagatgttctttaag

SEQ ID NO: 55432 - DNA, 25 bp, Homo sapien
ctccagatggaagttgttctttaag

SEQ ID NO: 55433 - DNA, 25 bp, Homo sapien
ctccagattctgttaagccactaaa

SEQ ID NO: 55434 - DNA, 25 bp, Homo sapien
ctccagattttcaacctgtgcagtg

SEQ ID NO: 55435 - DNA, 25 bp, Homo sapien
ctccagattttcgacctgtgcagtg

SEQ ID NO: 55436 - DNA, 25 bp, Homo sapien
ctccagcacccattgcctccttact

SEQ ID NO: 55437 - DNA, 25 bp, Homo sapien
ctccagcacccatttcctccttact

SEQ ID NO: 55438 - DNA, 25 bp, Homo sapien
ctccagcacctaaactggtatatat

SEQ ID NO: 55439 - DNA, 25 bp, Homo sapien
ctccagcactctgcagacttcactt

SEQ ID NO: 55440 - DNA, 25 bp, Homo sapien
ctccagcactctgcaggcttcactt

SEQ ID NO: 55441 - DNA, 25 bp, Homo sapien
ctccagcacttaaactggtatatat

SEQ ID NO: 55442 - DNA, 25 bp, Homo sapien
ctccagccaaaaagaggagagagga

SEQ ID NO: 55443 - DNA, 25 bp, Homo sapien
ctccagccaaactgcctgaagtatc

SEQ ID NO: 55444 - DNA, 25 bp, Homo sapien
ctccagccaaagtgcctgaagtatc

SEQ ID NO: 55445 - DNA, 25 bp, Homo sapien
ctccagccacaaagaggagagagga

SEQ ID NO: 55446 - DNA, 25 bp, Homo sapien
ctccagccacttcttttatcaggca

SEQ ID NO: 55447 - DNA, 25 bp, Homo sapien
ctccagccatacttgggtaacagaa

SEQ ID NO: 55448 - DNA, 25 bp, Homo sapien
ctccagccatatttgggtaacagaa

SEQ ID NO: 55449 - DNA, 25 bp, Homo sapien
ctccagccgcttcttttatcaggca

SEQ ID NO: 55450 - DNA, 25 bp, Homo sapien
ctccaggaaaatattgccttcttat

SEQ ID NO: 55451 - DNA, 25 bp, Homo sapien
ctccaggaaaatgttgccttcttat

SEQ ID NO: 55452 - DNA, 25 bp, Homo sapien
ctccaggaagtatatcagaatgcaa

SEQ ID NO: 55453 - DNA, 25 bp, Homo sapien
ctccaggaggtatatcagaatgcaa

SEQ ID NO: 55454 - DNA, 25 bp, Homo sapien
ctccaggggccaatgtcagaacatg

SEQ ID NO: 55455 - DNA, 25 bp, Homo sapien
ctccaggggccagtgtcagaacatg

SEQ ID NO: 55456 - DNA, 25 bp, Homo sapien
ctccagtaacctaccactgaagcca

SEQ ID NO: 55457 - DNA, 25 bp, Homo sapien
ctccagtaacctaccattgaagcca

SEQ ID NO: 55458 - DNA, 25 bp, Homo sapien
ctccagtcagcatgacaagagtgaa

SEQ ID NO: 55459 - DNA, 25 bp, Homo sapien
ctccagtcagcgtgacaagagtgaa

SEQ ID NO: 55460 - DNA, 25 bp, Homo sapien
ctccagtccccaaagattgatctca

SEQ ID NO: 55461 - DNA, 25 bp, Homo sapien
ctccagtccgcaaagattgatctca

SEQ ID NO: 55462 - DNA, 25 bp, Homo sapien
ctccagtcttcacctccatcttcac

SEQ ID NO: 55463 - DNA, 25 bp, Homo sapien
ctccagtcttcgcctccatcttcac

SEQ ID NO: 55464 - DNA, 25 bp, Homo sapien
ctccagtgtatgatatttagggtgt

SEQ ID NO: 55465 - DNA, 25 bp, Homo sapien
ctccagtgtatgatttttagggtgt

SEQ ID NO: 55466 - DNA, 25 bp, Homo sapien
ctccagtgtatgtaatgctggtgac

SEQ ID NO: 55467 - DNA, 25 bp, Homo sapien
ctccagtgtgtgtaatgctggtgac

SEQ ID NO: 55468 - DNA, 25 bp, Homo sapien
ctccatacatcatcttcactggggg

SEQ ID NO: 55469 - DNA, 25 bp, Homo sapien
ctccatacctcatcttcactggggg

SEQ ID NO: 55470 - DNA, 25 bp, Homo sapien
ctccataggtctcatgccacatttt

SEQ ID NO: 55471 - DNA, 25 bp, Homo sapien
ctccataggtcttatgccacatttt

SEQ ID NO: 55472 - DNA, 25 bp, Homo sapien
ctccatattttaggagactccaagg

SEQ ID NO: 55473 - DNA, 25 bp, Homo sapien
ctccatattttgggagactccaagg

SEQ ID NO: 55474 - DNA, 25 bp, Homo sapien
ctccatatttttgccagtatgtagt

SEQ ID NO: 55475 - DNA, 25 bp, Homo sapien
ctccatattttttccagtatgtagt

SEQ ID NO: 55476 - DNA, 25 bp, Homo sapien
ctccatcaatggtcactgtgggtat

SEQ ID NO: 55477 - DNA, 25 bp, Homo sapien
ctccatcagctcactttccattttt

SEQ ID NO: 55478 - DNA, 25 bp, Homo sapien
ctccatcagtggtcactgtgggtat

SEQ ID NO: 55479 - DNA, 25 bp, Homo sapien
ctccatcatctcactttccattttt

SEQ ID NO: 55480 - DNA, 25 bp, Homo sapien
ctccatccacaggttcctgtcctca

SEQ ID NO: 55481 - DNA, 25 bp, Homo sapien
ctccatccataggttcctgtcctca

SEQ ID NO: 55482 - DNA, 25 bp, Homo sapien
ctccatccgccatatttaaagctca

SEQ ID NO: 55483 - DNA, 25 bp, Homo sapien
ctccatcctccatatttaaagctca

SEQ ID NO: 55484 - DNA, 25 bp, Homo sapien
ctccatctcgattgccatctcctgc

SEQ ID NO: 55485 - DNA, 25 bp, Homo sapien
ctccatctctttggtcttgtccaca

SEQ ID NO: 55486 - DNA, 25 bp, Homo sapien
ctccatctgtttggtcttgtccaca

SEQ ID NO: 55487 - DNA, 25 bp, Homo sapien
ctccatcttgattgccatctcctgc

SEQ ID NO: 55488 - DNA, 25 bp, Homo sapien
ctccatcttttaagaatgcttgtaa

SEQ ID NO: 55489 - DNA, 25 bp, Homo sapien
ctccatcttttaaggatgcttgtaa

SEQ ID NO: 55490 - DNA, 25 bp, Homo sapien
ctccatgaaactcggaggaaatctg

SEQ ID NO: 55491 - DNA, 25 bp, Homo sapien
ctccatgaaataattgcttttgaat

SEQ ID NO: 55492 - DNA, 25 bp, Homo sapien
ctccatgaacctcggaggaaatctg

SEQ ID NO: 55493 - DNA, 25 bp, Homo sapien
ctccatgacataattgcttttgaat

SEQ ID NO: 55494 - DNA, 25 bp, Homo sapien
ctccatgagatcacttaggaaatga

SEQ ID NO: 55495 - DNA, 25 bp, Homo sapien
ctccatgagatcgcttaggaaatga

SEQ ID NO: 55496 - DNA, 25 bp, Homo sapien
ctccatgggcttacagtcgtgtgtg

SEQ ID NO: 55497 - DNA, 25 bp, Homo sapien
ctccatgggcttccagtcgtgtgtg

SEQ ID NO: 55498 - DNA, 25 bp, Homo sapien
ctccatggtctcaaggcctctatac

SEQ ID NO: 55499 - DNA, 25 bp, Homo sapien
ctccatggtctcgaggcctctatac

SEQ ID NO: 55500 - DNA, 25 bp, Homo sapien
ctccatgtaatctgaaaaatcaaat

SEQ ID NO: 55501 - DNA, 25 bp, Homo sapien
ctccatgtattctgaaaaatcaaat

SEQ ID NO: 55502 - DNA, 25 bp, Homo sapien
ctccatgtcacctttcaccaagtat

SEQ ID NO: 55503 - DNA, 25 bp, Homo sapien
ctccatgtcacgtttcaccaagtat

SEQ ID NO: 55504 - DNA, 25 bp, Homo sapien
ctccatgtttcagagtcatcgtatg

SEQ ID NO: 55505 - DNA, 25 bp, Homo sapien
ctccatgtttcggagtcatcgtatg

SEQ ID NO: 55506 - DNA, 25 bp, Homo sapien
ctccattcaacacacaaggttaagc

SEQ ID NO: 55507 - DNA, 25 bp, Homo sapien
ctccattcaactcacaaggttaagc

SEQ ID NO: 55508 - DNA, 25 bp, Homo sapien
ctccattcattcttaagtgcaaaag

SEQ ID NO: 55509 - DNA, 25 bp, Homo sapien
ctccattcatttaccgccttacctg

SEQ ID NO: 55510 - DNA, 25 bp, Homo sapien
ctccattcatttgccgccttacctg

SEQ ID NO: 55511 - DNA, 25 bp, Homo sapien
ctccattcgttcttaagtgcaaaag

SEQ ID NO: 55512 - DNA, 25 bp, Homo sapien
ctccattgagacagtagttagactt

SEQ ID NO: 55513 - DNA, 25 bp, Homo sapien
ctccattgagacggtagttagactt

SEQ ID NO: 55514 - DNA, 25 bp, Homo sapien
ctccattgtatgaacgctattgtgc

SEQ ID NO: 55515 - DNA, 25 bp, Homo sapien
ctccattgtatgaatgctattgtgc

SEQ ID NO: 55516 - DNA, 25 bp, Homo sapien
ctccattgtctttactgggctgtgt

SEQ ID NO: 55517 - DNA, 25 bp, Homo sapien
ctccattgtttttactgggctgtgt

SEQ ID NO: 55518 - DNA, 25 bp, Homo sapien
ctccatttcattctagttgctgggt

SEQ ID NO: 55519 - DNA, 25 bp, Homo sapien
ctccatttccaagccactgctacct

SEQ ID NO: 55520 - DNA, 25 bp, Homo sapien
ctccatttccaggccactgctacct

SEQ ID NO: 55521 - DNA, 25 bp, Homo sapien
ctccatttgtgcacgactgttctag

SEQ ID NO: 55522 - DNA, 25 bp, Homo sapien
ctccatttgtgtacgactgttctag

SEQ ID NO: 55523 - DNA, 25 bp, Homo sapien
ctccattttattctagttgctgggt

SEQ ID NO: 55524 - DNA, 25 bp, Homo sapien
ctcccaaaaaacagattgcacagca

SEQ ID NO: 55525 - DNA, 25 bp, Homo sapien
ctcccaaaagacagattgcacagca

SEQ ID NO: 55526 - DNA, 25 bp, Homo sapien
ctcccaacccaggaaaaaggaaaga

SEQ ID NO: 55527 - DNA, 25 bp, Homo sapien
ctcccaacctaggaaaaaggaaaga

SEQ ID NO: 55528 - DNA, 25 bp, Homo sapien
ctcccaagtctaacttgtttcatgt

SEQ ID NO: 55529 - DNA, 25 bp, Homo sapien
ctcccaagtctaccttgtttcatgt

SEQ ID NO: 55530 - DNA, 25 bp, Homo sapien
ctcccaatctgcctgggaagggctc

SEQ ID NO: 55531 - DNA, 25 bp, Homo sapien
ctcccaatctgtctgggaagggctc

SEQ ID NO: 55532 - DNA, 25 bp, Homo sapien
ctcccacagaagcgggtagatctgc

SEQ ID NO: 55533 - DNA, 25 bp, Homo sapien
ctcccacagaagcgtgtagatctgc

SEQ ID NO: 55534 - DNA, 25 bp, Homo sapien
ctcccacccagaatagtaccatcag

SEQ ID NO: 55535 - DNA, 25 bp, Homo sapien
ctcccaccgagaatagtaccatcag

SEQ ID NO: 55536 - DNA, 25 bp, Homo sapien
ctcccagaatgttctgtataaagca

SEQ ID NO: 55537 - DNA, 25 bp, Homo sapien
ctcccagactgccatgtcaaagttt

SEQ ID NO: 55538 - DNA, 25 bp, Homo sapien
ctcccagactgctatgtcaaagttt

SEQ ID NO: 55539 - DNA, 25 bp, Homo sapien
ctcccagactgttctgtataaagca

SEQ ID NO: 55540 - DNA, 25 bp, Homo sapien
ctcccagctccaatgttttcactct

SEQ ID NO: 55541 - DNA, 25 bp, Homo sapien
ctcccagctccagtgttttcactct

SEQ ID NO: 55542 - DNA, 25 bp, Homo sapien
ctcccagcttccgctaatacatgtt

SEQ ID NO: 55543 - DNA, 25 bp, Homo sapien
ctcccagcttctgctaatacatgtt

SEQ ID NO: 55544 - DNA, 25 bp, Homo sapien
ctcccaggagaatgtgtatttttaa

SEQ ID NO: 55545 - DNA, 25 bp, Homo sapien
ctcccaggagagtgtgtatttttaa

SEQ ID NO: 55546 - DNA, 25 bp, Homo sapien
ctcccaggtgttgaccctctaccat

SEQ ID NO: 55547 - DNA, 25 bp, Homo sapien
ctcccaggtgtttaccctctaccat

SEQ ID NO: 55548 - DNA, 25 bp, Homo sapien
ctcccagtaaaatttaagggcagaa

SEQ ID NO: 55549 - DNA, 25 bp, Homo sapien
ctcccagtacaatttaagggcagaa

SEQ ID NO: 55550 - DNA, 25 bp, Homo sapien
ctcccagtctcagaaaccatggagc

SEQ ID NO: 55551 - DNA, 25 bp, Homo sapien
ctcccagtctcagaaatcatggagc

SEQ ID NO: 55552 - DNA, 25 bp, Homo sapien
ctcccatacagaaaaaaaaatcaag

SEQ ID NO: 55553 - DNA, 25 bp, Homo sapien
ctcccatatagaaaaaaaaatcaag

SEQ ID NO: 55554 - DNA, 25 bp, Homo sapien
ctcccatcgattccaacttttcccc

SEQ ID NO: 55555 - DNA, 25 bp, Homo sapien
ctcccatcgattgcaacttttcccc

SEQ ID NO: 55556 - DNA, 25 bp, Homo sapien
ctcccatcttgagcgtattgcctta

SEQ ID NO: 55557 - DNA, 25 bp, Homo sapien
ctcccatcttgagcgtgttgcctta

SEQ ID NO: 55558 - DNA, 25 bp, Homo sapien
ctccccactgacatgtttcctcact

SEQ ID NO: 55559 - DNA, 25 bp, Homo sapien
ctccccactgacatttttcctcact

SEQ ID NO: 55560 - DNA, 25 bp, Homo sapien
ctccccaggcaaaaagaaggcataa

SEQ ID NO: 55561 - DNA, 25 bp, Homo sapien
ctccccaggcaacaagaaggcataa

SEQ ID NO: 55562 - DNA, 25 bp, Homo sapien
ctcccccaacagtaagagcagtgtt

SEQ ID NO: 55563 - DNA, 25 bp, Homo sapien
ctcccccaacagtgagagcagtgtt

SEQ ID NO: 55564 - DNA, 25 bp, Homo sapien
ctcccccgtgtgcctgcaattggag

SEQ ID NO: 55565 - DNA, 25 bp, Homo sapien
ctcccccgtgtgcctgtaattggag

SEQ ID NO: 55566 - DNA, 25 bp, Homo sapien
ctcccctaaacacatcaacactcca

SEQ ID NO: 55567 - DNA, 25 bp, Homo sapien
ctcccctaaacacatcgacactcca

SEQ ID NO: 55568 - DNA, 25 bp, Homo sapien
ctcccctggcacacggtttgagatg

SEQ ID NO: 55569 - DNA, 25 bp, Homo sapien
ctcccctggcacagggtttgagatg

SEQ ID NO: 55570 - DNA, 25 bp, Homo sapien
ctcccgatgactaacttcaacagct

SEQ ID NO: 55571 - DNA, 25 bp, Homo sapien
ctcccgatgactaatttcaacagct

SEQ ID NO: 55572 - DNA, 25 bp, Homo sapien
ctcccgcaacattcacatctgcatc

SEQ ID NO: 55573 - DNA, 25 bp, Homo sapien
ctcccgcaacatttacatctgcatc

SEQ ID NO: 55574 - DNA, 25 bp, Homo sapien
ctcccggcaaggatcttaaacagat

SEQ ID NO: 55575 - DNA, 25 bp, Homo sapien
ctcccggcaaggttcttaaacagat

SEQ ID NO: 55576 - DNA, 25 bp, Homo sapien
ctcccgggcctacgcagcgctgggt

SEQ ID NO: 55577 - DNA, 25 bp, Homo sapien
ctcccgggtctacgcagcgctgggt

SEQ ID NO: 55578 - DNA, 25 bp, Homo sapien
ctcccgtgtcacacaaattcatctt

SEQ ID NO: 55579 - DNA, 25 bp, Homo sapien
ctcccgtgtcacacaagttcatctt

SEQ ID NO: 55580 - DNA, 25 bp, Homo sapien
ctccctaaaattctcccaagttaaa

SEQ ID NO: 55581 - DNA, 25 bp, Homo sapien
ctccctaaaattttcccaagttaaa

SEQ ID NO: 55582 - DNA, 25 bp, Homo sapien
ctccctacaaactccccggtgcttg

SEQ ID NO: 55583 - DNA, 25 bp, Homo sapien
ctccctacctgaacctacgaacacc

SEQ ID NO: 55584 - DNA, 25 bp, Homo sapien
ctccctacctgaccctacgaacacc

SEQ ID NO: 55585 - DNA, 25 bp, Homo sapien
ctccctacgaactccccggtgcttg

SEQ ID NO: 55586 - DNA, 25 bp, Homo sapien
ctccctacttttaattggcaacaag

SEQ ID NO: 55587 - DNA, 25 bp, Homo sapien
ctccctacttttaatttgcaacaag

SEQ ID NO: 55588 - DNA, 25 bp, Homo sapien
ctccctcaacaatgacattaattca

SEQ ID NO: 55589 - DNA, 25 bp, Homo sapien
ctccctcaacagtgacattaattca

SEQ ID NO: 55590 - DNA, 25 bp, Homo sapien
ctccctcactttcccagagcatcta

SEQ ID NO: 55591 - DNA, 25 bp, Homo sapien
ctccctcacttttccagagcatcta

SEQ ID NO: 55592 - DNA, 25 bp, Homo sapien
ctccctccagtcggtaaaatgtctt

SEQ ID NO: 55593 - DNA, 25 bp, Homo sapien
ctccctccagtctgtaaaatgtctt

SEQ ID NO: 55594 - DNA, 25 bp, Homo sapien
ctccctctgcgctgacacgaacatc

SEQ ID NO: 55595 - DNA, 25 bp, Homo sapien
ctccctctgcgttgacacgaacatc

SEQ ID NO: 55596 - DNA, 25 bp, Homo sapien
ctccctgcaccagtacttggctgta

SEQ ID NO: 55597 - DNA, 25 bp, Homo sapien
ctccctgcctcattcccttcaagct

SEQ ID NO: 55598 - DNA, 25 bp, Homo sapien
ctccctgcctcattccgttcaagct

SEQ ID NO: 55599 - DNA, 25 bp, Homo sapien
ctccctgcgccagtacttggctgta

SEQ ID NO: 55600 - DNA, 25 bp, Homo sapien
ctccctgctttgcgtcttgtgctct

SEQ ID NO: 55601 - DNA, 25 bp, Homo sapien
ctccctgctttgtgtcttgtgctct

SEQ ID NO: 55602 - DNA, 25 bp, Homo sapien
ctccctggaacaacccaacaggctg

SEQ ID NO: 55603 - DNA, 25 bp, Homo sapien
ctccctggaacaaccctacaggctg

SEQ ID NO: 55604 - DNA, 25 bp, Homo sapien
ctccctggaactgataatttgaaca

SEQ ID NO: 55605 - DNA, 25 bp, Homo sapien
ctccctggaactgatattttgaaca

SEQ ID NO: 55606 - DNA, 25 bp, Homo sapien
ctccctgggctaccatttttctgtt

SEQ ID NO: 55607 - DNA, 25 bp, Homo sapien
ctccctgggctatcatttttctgtt

SEQ ID NO: 55608 - DNA, 25 bp, Homo sapien
ctcccttcctccgtaatcattacaa

SEQ ID NO: 55609 - DNA, 25 bp, Homo sapien
ctcccttcctctgtaatcattacaa

SEQ ID NO: 55610 - DNA, 25 bp, Homo sapien
ctcccttctcccaaggactgagctc

SEQ ID NO: 55611 - DNA, 25 bp, Homo sapien
ctcccttctcccgaggactgagctc

SEQ ID NO: 55612 - DNA, 25 bp, Homo sapien
ctcccttgaatcaatgaatgagaac

SEQ ID NO: 55613 - DNA, 25 bp, Homo sapien
ctcccttgaatgaatgaatgagaac

SEQ ID NO: 55614 - DNA, 25 bp, Homo sapien
ctcccttgctcaagataatctactt

SEQ ID NO: 55615 - DNA, 25 bp, Homo sapien
ctcccttgctcaaggtaatctactt

SEQ ID NO: 55616 - DNA, 25 bp, Homo sapien
ctccctttcactgcttctgaattac

SEQ ID NO: 55617 - DNA, 25 bp, Homo sapien
ctccctttcgctgcttctgaattac

SEQ ID NO: 55618 - DNA, 25 bp, Homo sapien
ctccgagccgcaccttcctaagtag

SEQ ID NO: 55619 - DNA, 25 bp, Homo sapien
ctccgagctgcaccttcctaagtag

SEQ ID NO: 55620 - DNA, 25 bp, Homo sapien
ctccgattgtacttctaataagctc

SEQ ID NO: 55621 - DNA, 25 bp, Homo sapien
ctccgattgtatttctaataagctc

SEQ ID NO: 55622 - DNA, 25 bp, Homo sapien
ctccgcataagtcatattttgtacc

SEQ ID NO: 55623 - DNA, 25 bp, Homo sapien
ctccgcatgagtcatattttgtacc

SEQ ID NO: 55624 - DNA, 25 bp, Homo sapien
ctccgccccatcaggtacagagtgt

SEQ ID NO: 55625 - DNA, 25 bp, Homo sapien
ctccgccctatcaggtacagagtgt

SEQ ID NO: 55626 - DNA, 25 bp, Homo sapien
ctccgctatccaattcagcccctct

SEQ ID NO: 55627 - DNA, 25 bp, Homo sapien
ctccgctatccatttcagcccctct

SEQ ID NO: 55628 - DNA, 25 bp, Homo sapien
ctccggcatcctattttcctggaca

SEQ ID NO: 55629 - DNA, 25 bp, Homo sapien
ctccggcatcctgttttcctggaca

SEQ ID NO: 55630 - DNA, 25 bp, Homo sapien
ctccggtggccaaggcatgaaaatc

SEQ ID NO: 55631 - DNA, 25 bp, Homo sapien
ctccggtggccgaggcatgaaaatc

SEQ ID NO: 55632 - DNA, 25 bp, Homo sapien
ctccgtcatcagcctattttcagcc

SEQ ID NO: 55633 - DNA, 25 bp, Homo sapien
ctccgtcattagcctattttcagcc

SEQ ID NO: 55634 - DNA, 25 bp, Homo sapien
ctcctaaacatctcttgaatctatc

SEQ ID NO: 55635 - DNA, 25 bp, Homo sapien
ctcctaaacatttcttgaatctatc

SEQ ID NO: 55636 - DNA, 25 bp, Homo sapien
ctcctaaatagttacgaaaaacaga

SEQ ID NO: 55637 - DNA, 25 bp, Homo sapien
ctcctaaatagttatgaaaaacaga

SEQ ID NO: 55638 - DNA, 25 bp, Homo sapien
ctcctaaatctccgcactgaatagg

SEQ ID NO: 55639 - DNA, 25 bp, Homo sapien
ctcctaaatctccgcattgaatagg

SEQ ID NO: 55640 - DNA, 25 bp, Homo sapien
ctcctaaattgctgcgattacagtt

SEQ ID NO: 55641 - DNA, 25 bp, Homo sapien
ctcctaaattgctgtgattacagtt

SEQ ID NO: 55642 - DNA, 25 bp, Homo sapien
ctcctaatcatctgcccaggaatct

SEQ ID NO: 55643 - DNA, 25 bp, Homo sapien
ctcctaatcgtctgcccaggaatct

SEQ ID NO: 55644 - DNA, 25 bp, Homo sapien
ctcctaatttacttcacatttgcat

SEQ ID NO: 55645 - DNA, 25 bp, Homo sapien
ctcctaatttatttcacatttgcat

SEQ ID NO: 55646 - DNA, 25 bp, Homo sapien
ctcctaatttcaatctaagttagcc

SEQ ID NO: 55647 - DNA, 25 bp, Homo sapien
ctcctaatttcaatgtaagttagcc

SEQ ID NO: 55648 - DNA, 25 bp, Homo sapien
ctcctacacccatcctcagagctcc

SEQ ID NO: 55649 - DNA, 25 bp, Homo sapien
ctcctacacccatcttcagagctcc

SEQ ID NO: 55650 - DNA, 25 bp, Homo sapien
ctcctaccactacaagagacacctg

SEQ ID NO: 55651 - DNA, 25 bp, Homo sapien
ctcctaccgctacaagagacacctg

SEQ ID NO: 55652 - DNA, 25 bp, Homo sapien
ctcctacctagagcttcgccctcat

SEQ ID NO: 55653 - DNA, 25 bp, Homo sapien
ctcctacctagtgcttcgccctcat

SEQ ID NO: 55654 - DNA, 25 bp, Homo sapien
ctcctactactcccatcttgctcac

SEQ ID NO: 55655 - DNA, 25 bp, Homo sapien
ctcctactactcccgtcttgctcac

SEQ ID NO: 55656 - DNA, 25 bp, Homo sapien
ctcctagattaagacctgcctggaa

SEQ ID NO: 55657 - DNA, 25 bp, Homo sapien
ctcctagattaaggcctgcctggaa

SEQ ID NO: 55658 - DNA, 25 bp, Homo sapien
ctcctagtgtgtcagcatgtgacct

SEQ ID NO: 55659 - DNA, 25 bp, Homo sapien
ctcctagtgtgtcagcgtgtgacct

SEQ ID NO: 55660 - DNA, 25 bp, Homo sapien
ctcctatagaacataaacccatgca

SEQ ID NO: 55661 - DNA, 25 bp, Homo sapien
ctcctatagaatataaacccatgca

SEQ ID NO: 55662 - DNA, 25 bp, Homo sapien
ctcctatccctcattcctaaccatc

SEQ ID NO: 55663 - DNA, 25 bp, Homo sapien
ctcctatccctcattcttaaccatc

SEQ ID NO: 55664 - DNA, 25 bp, Homo sapien
ctcctatgcacacccatctgtcatt

SEQ ID NO: 55665 - DNA, 25 bp, Homo sapien
ctcctatgcacgcccatctgtcatt

SEQ ID NO: 55666 - DNA, 25 bp, Homo sapien
ctcctattcatcacggcatctttca

SEQ ID NO: 55667 - DNA, 25 bp, Homo sapien
ctcctattcatcacggtatctttca

SEQ ID NO: 55668 - DNA, 25 bp, Homo sapien
ctcctatttgctaggcatcgaccac

SEQ ID NO: 55669 - DNA, 25 bp, Homo sapien
ctcctatttgctgggcatcgaccac

SEQ ID NO: 55670 - DNA, 25 bp, Homo sapien
ctcctcaaatctatgtgtatagtcg

SEQ ID NO: 55671 - DNA, 25 bp, Homo sapien
ctcctcaaatctatttgtatagtcg

SEQ ID NO: 55672 - DNA, 25 bp, Homo sapien
ctcctcaaattagttaactccaaat

SEQ ID NO: 55673 - DNA, 25 bp, Homo sapien
ctcctcaaattagttatctccaaat

SEQ ID NO: 55674 - DNA, 25 bp, Homo sapien
ctcctcaatccaggtctctgcaggc

SEQ ID NO: 55675 - DNA, 25 bp, Homo sapien
ctcctcaatccgggtctctgcaggc

SEQ ID NO: 55676 - DNA, 25 bp, Homo sapien
ctcctcaatgtaggacttcatattt

SEQ ID NO: 55677 - DNA, 25 bp, Homo sapien
ctcctcaatgtgggacttcatattt

SEQ ID NO: 55678 - DNA, 25 bp, Homo sapien
ctcctcaccgcaagcttcacctccc

SEQ ID NO: 55679 - DNA, 25 bp, Homo sapien
ctcctcaccgcaggcttcacctccc

SEQ ID NO: 55680 - DNA, 25 bp, Homo sapien
ctcctcactatggaaacattggaga

SEQ ID NO: 55681 - DNA, 25 bp, Homo sapien
ctcctcactgcactgtgtgttacat

SEQ ID NO: 55682 - DNA, 25 bp, Homo sapien
ctcctcactgcactttgtgttacat

SEQ ID NO: 55683 - DNA, 25 bp, Homo sapien
ctcctcactgtggaaacattggaga

SEQ ID NO: 55684 - DNA, 25 bp, Homo sapien
ctcctcattggcacaatatgcaggg

SEQ ID NO: 55685 - DNA, 25 bp, Homo sapien
ctcctcattggcagaatatgcaggg

SEQ ID NO: 55686 - DNA, 25 bp, Homo sapien
ctcctccacactaatttctctaagt

SEQ ID NO: 55687 - DNA, 25 bp, Homo sapien
ctcctccacactcatttctctaagt

SEQ ID NO: 55688 - DNA, 25 bp, Homo sapien
ctcctccacgttactttgattataa

SEQ ID NO: 55689 - DNA, 25 bp, Homo sapien
ctcctccatcttgccatcataccaa

SEQ ID NO: 55690 - DNA, 25 bp, Homo sapien
ctcctccatgttactttgattataa

SEQ ID NO: 55691 - DNA, 25 bp, Homo sapien
ctcctccattttgccatcataccaa

SEQ ID NO: 55692 - DNA, 25 bp, Homo sapien
ctcctcctgctgaacaatctccatg

SEQ ID NO: 55693 - DNA, 25 bp, Homo sapien
ctcctcctgctgaacagtctccatg

SEQ ID NO: 55694 - DNA, 25 bp, Homo sapien
ctcctctactctttcacgcatttgt

SEQ ID NO: 55695 - DNA, 25 bp, Homo sapien
ctcctctactctttcatgcatttgt

SEQ ID NO: 55696 - DNA, 25 bp, Homo sapien
ctcctctgaagtggtctgtttgttc

SEQ ID NO: 55697 - DNA, 25 bp, Homo sapien
ctcctctgaagttgtctgtttgttc

SEQ ID NO: 55698 - DNA, 25 bp, Homo sapien
ctcctctgacactattttatcaagg

SEQ ID NO: 55699 - DNA, 25 bp, Homo sapien
ctcctctgacactgttttatcaagg

SEQ ID NO: 55700 - DNA, 25 bp, Homo sapien
ctcctcttattacgtgaattgtcta

SEQ ID NO: 55701 - DNA, 25 bp, Homo sapien
ctcctcttattatgtgaattgtcta

SEQ ID NO: 55702 - DNA, 25 bp, Homo sapien
ctcctcttcctgcattcaggtgtag

SEQ ID NO: 55703 - DNA, 25 bp, Homo sapien
ctcctcttcctgcgttcaggtgtag

SEQ ID NO: 55704 - DNA, 25 bp, Homo sapien
ctcctcttctatatctaaagtacaa

SEQ ID NO: 55705 - DNA, 25 bp, Homo sapien
ctcctcttctatatcttaagtacaa

SEQ ID NO: 55706 - DNA, 25 bp, Homo sapien
ctcctctttagtttagtgtgttgtc

SEQ ID NO: 55707 - DNA, 25 bp, Homo sapien
ctcctcttttgtttagtgtgttgtc

SEQ ID NO: 55708 - DNA, 25 bp, Homo sapien
ctcctgaagtcaaacaagaccatga

SEQ ID NO: 55709 - DNA, 25 bp, Homo sapien
ctcctgaagtcaagcaagaccatga

SEQ ID NO: 55710 - DNA, 25 bp, Homo sapien
ctcctgaagtcttcttgcagttact

SEQ ID NO: 55711 - DNA, 25 bp, Homo sapien
ctcctgaagtctttttgcagttact

SEQ ID NO: 55712 - DNA, 25 bp, Homo sapien
ctcctgaattcttcttcaggcaaat

SEQ ID NO: 55713 - DNA, 25 bp, Homo sapien
ctcctgaattctttttcaggcaaat

SEQ ID NO: 55714 - DNA, 25 bp, Homo sapien
ctcctgactacagaagatcactccc

SEQ ID NO: 55715 - DNA, 25 bp, Homo sapien
ctcctgactacataagatcactccc

SEQ ID NO: 55716 - DNA, 25 bp, Homo sapien
ctcctgactgccgggaccgggacct

SEQ ID NO: 55717 - DNA, 25 bp, Homo sapien
ctcctgactgctgggaccgggacct

SEQ ID NO: 55718 - DNA, 25 bp, Homo sapien
ctcctgagcaacatgactgagtatt

SEQ ID NO: 55719 - DNA, 25 bp, Homo sapien
ctcctgagcaacgtgactgagtatt

SEQ ID NO: 55720 - DNA, 25 bp, Homo sapien
ctcctgagtcctttcgaaaccactg

SEQ ID NO: 55721 - DNA, 25 bp, Homo sapien
ctcctgagtccttttgaaaccactg

SEQ ID NO: 55722 - DNA, 25 bp, Homo sapien
ctcctgattcctgtgcataattttt

SEQ ID NO: 55723 - DNA, 25 bp, Homo sapien
ctcctgattcctgtgcgtaattttt

SEQ ID NO: 55724 - DNA, 25 bp, Homo sapien
ctcctgcatgcttcatcacatagcc

SEQ ID NO: 55725 - DNA, 25 bp, Homo sapien
ctcctgcatgcttcgtcacatagcc

SEQ ID NO: 55726 - DNA, 25 bp, Homo sapien
ctcctgccatgtgttcactctattt

SEQ ID NO: 55727 - DNA, 25 bp, Homo sapien
ctcctgccgtgtgttcactctattt

SEQ ID NO: 55728 - DNA, 25 bp, Homo sapien
ctcctgccttggttcttctcaaacc

SEQ ID NO: 55729 - DNA, 25 bp, Homo sapien
ctcctgccttggttgttctcaaacc

SEQ ID NO: 55730 - DNA, 25 bp, Homo sapien
ctcctgcgttagaactagagacaaa

SEQ ID NO: 55731 - DNA, 25 bp, Homo sapien
ctcctgcgttagaactggagacaaa

SEQ ID NO: 55732 - DNA, 25 bp, Homo sapien
ctcctgctcatcactgaaaagtaga

SEQ ID NO: 55733 - DNA, 25 bp, Homo sapien
ctcctgctcatcgctgaaaagtaga

SEQ ID NO: 55734 - DNA, 25 bp, Homo sapien
ctcctgctgaacaatctccatgcac

SEQ ID NO: 55735 - DNA, 25 bp, Homo sapien
ctcctgctgaacagtctccatgcac

SEQ ID NO: 55736 - DNA, 25 bp, Homo sapien
ctcctgcttctgttttcccacctgc

SEQ ID NO: 55737 - DNA, 25 bp, Homo sapien
ctcctgcttctgtttttccacctgc

SEQ ID NO: 55738 - DNA, 25 bp, Homo sapien
ctcctggcaattaataggaaccaag

SEQ ID NO: 55739 - DNA, 25 bp, Homo sapien
ctcctggcaattactaggaaccaag

SEQ ID NO: 55740 - DNA, 25 bp, Homo sapien
ctcctggctactactgtgtatcttc

SEQ ID NO: 55741 - DNA, 25 bp, Homo sapien
ctcctggctcctggtcattacggga

SEQ ID NO: 55742 - DNA, 25 bp, Homo sapien
ctcctggctccttgtcattacggga

SEQ ID NO: 55743 - DNA, 25 bp, Homo sapien
ctcctggctctcagttcagagattc

SEQ ID NO: 55744 - DNA, 25 bp, Homo sapien
ctcctggctctcggttcagagattc

SEQ ID NO: 55745 - DNA, 25 bp, Homo sapien
ctcctggctgctactgtgtatcttc

SEQ ID NO: 55746 - DNA, 25 bp, Homo sapien
ctcctggtgacagtgcaatcaaaaa

SEQ ID NO: 55747 - DNA, 25 bp, Homo sapien
ctcctggtgacagtgcgatcaaaaa

SEQ ID NO: 55748 - DNA, 25 bp, Homo sapien
ctcctgtgcatagtcaacctgatga

SEQ ID NO: 55749 - DNA, 25 bp, Homo sapien
ctcctgtgcatagtcagcctgatga

SEQ ID NO: 55750 - DNA, 25 bp, Homo sapien
ctcctgtgctgtcacctgcaattct

SEQ ID NO: 55751 - DNA, 25 bp, Homo sapien
ctcctgtgtatccttcaccactttc

SEQ ID NO: 55752 - DNA, 25 bp, Homo sapien
ctcctgtgtgtccttcaccactttc

SEQ ID NO: 55753 - DNA, 25 bp, Homo sapien
ctcctgtgttgtcacctgcaattct

SEQ ID NO: 55754 - DNA, 25 bp, Homo sapien
ctcctgtttctgattgtagctgggc

SEQ ID NO: 55755 - DNA, 25 bp, Homo sapien
ctcctgtttttgattgtagctgggc

SEQ ID NO: 55756 - DNA, 25 bp, Homo sapien
ctccttaaggcctaggtctaccttc

SEQ ID NO: 55757 - DNA, 25 bp, Homo sapien
ctccttaaggcctatgtctaccttc

SEQ ID NO: 55758 - DNA, 25 bp, Homo sapien
ctccttacaacttcatttctccctg

SEQ ID NO: 55759 - DNA, 25 bp, Homo sapien
ctccttacaactttatttctccctg

SEQ ID NO: 55760 - DNA, 25 bp, Homo sapien
ctccttaccggcaagtgtttgcagc

SEQ ID NO: 55761 - DNA, 25 bp, Homo sapien
ctccttactggcaagtgtttgcagc

SEQ ID NO: 55762 - DNA, 25 bp, Homo sapien
ctccttagttaccagtaagactgct

SEQ ID NO: 55763 - DNA, 25 bp, Homo sapien
ctccttagttaccggtaagactgct

SEQ ID NO: 55764 - DNA, 25 bp, Homo sapien
ctccttcaagtagtcgataattgga

SEQ ID NO: 55765 - DNA, 25 bp, Homo sapien
ctccttcaagtagtcggtaattgga

SEQ ID NO: 55766 - DNA, 25 bp, Homo sapien
ctccttcactcattgtatgttacct

SEQ ID NO: 55767 - DNA, 25 bp, Homo sapien
ctccttcactctttgtatgttacct

SEQ ID NO: 55768 - DNA, 25 bp, Homo sapien
ctccttccagtgaaaagtgtagaca

SEQ ID NO: 55769 - DNA, 25 bp, Homo sapien
ctccttccagtgagaagtgtagaca

SEQ ID NO: 55770 - DNA, 25 bp, Homo sapien
ctccttcctgtacacaccagcttga

SEQ ID NO: 55771 - DNA, 25 bp, Homo sapien
ctccttcctgtacataccagcttga

SEQ ID NO: 55772 - DNA, 25 bp, Homo sapien
ctccttcttgcagttacttcctaac

SEQ ID NO: 55773 - DNA, 25 bp, Homo sapien
ctccttcttgcagttatttcctaac

SEQ ID NO: 55774 - DNA, 25 bp, Homo sapien
ctccttctttctgcgccatcctatt

SEQ ID NO: 55775 - DNA, 25 bp, Homo sapien
ctccttctttctgtgccatcctatt

SEQ ID NO: 55776 - DNA, 25 bp, Homo sapien
ctcctttacaatgtggccatcttca

SEQ ID NO: 55777 - DNA, 25 bp, Homo sapien
ctcctttaccatgtggccatcttca

SEQ ID NO: 55778 - DNA, 25 bp, Homo sapien
ctcctttatgaatcttactttaatt

SEQ ID NO: 55779 - DNA, 25 bp, Homo sapien
ctcctttatgaatctttctttaatt

SEQ ID NO: 55780 - DNA, 25 bp, Homo sapien
ctcctttctctcatagtcagggttc

SEQ ID NO: 55781 - DNA, 25 bp, Homo sapien
ctcctttctctcggatcaattacag

SEQ ID NO: 55782 - DNA, 25 bp, Homo sapien
ctcctttctctcgtagtcagggttc

SEQ ID NO: 55783 - DNA, 25 bp, Homo sapien
ctcctttctcttggatcaattacag

SEQ ID NO: 55784 - DNA, 25 bp, Homo sapien
ctcctttgatgtagaaattatggag

SEQ ID NO: 55785 - DNA, 25 bp, Homo sapien
ctcctttgatgtagcaattatggag

SEQ ID NO: 55786 - DNA, 25 bp, Homo sapien
ctcctttggctactttcaagatttt

SEQ ID NO: 55787 - DNA, 25 bp, Homo sapien
ctcctttggctattttcaagatttt

SEQ ID NO: 55788 - DNA, 25 bp, Homo sapien
ctccttttactcggtgactcttcct

SEQ ID NO: 55789 - DNA, 25 bp, Homo sapien
ctccttttacttggtgactcttcct

SEQ ID NO: 55790 - DNA, 25 bp, Homo sapien
ctcctttttgttccattggtctgta

SEQ ID NO: 55791 - DNA, 25 bp, Homo sapien
ctcctttttgttccgttggtctgta

SEQ ID NO: 55792 - DNA, 25 bp, Homo sapien
ctcgaaactcccacatgtccttctt

SEQ ID NO: 55793 - DNA, 25 bp, Homo sapien
ctcgaaactcccacgtgtccttctt

SEQ ID NO: 55794 - DNA, 25 bp, Homo sapien
ctcgaaggttcctgcaattctaaca

SEQ ID NO: 55795 - DNA, 25 bp, Homo sapien
ctcgaaggttcctgcagttctaaca

SEQ ID NO: 55796 - DNA, 25 bp, Homo sapien
ctcgacgtcctggccttaggtgatc

SEQ ID NO: 55797 - DNA, 25 bp, Homo sapien
ctcgacgtcttggccttaggtgatc

SEQ ID NO: 55798 - DNA, 25 bp, Homo sapien
ctcgagaaccacagcactagagaag

SEQ ID NO: 55799 - DNA, 25 bp, Homo sapien
ctcgagaaccacggcactagagaag

SEQ ID NO: 55800 - DNA, 25 bp, Homo sapien
ctcgagaagagtaattccaagacac

SEQ ID NO: 55801 - DNA, 25 bp, Homo sapien
ctcgagaagagtgattccaagacac

SEQ ID NO: 55802 - DNA, 25 bp, Homo sapien
ctcgagcatttctgacacacagtag

SEQ ID NO: 55803 - DNA, 25 bp, Homo sapien
ctcgagcatttctgacccacagtag

SEQ ID NO: 55804 - DNA, 25 bp, Homo sapien
ctcgagcccagaagatcaggcccta

SEQ ID NO: 55805 - DNA, 25 bp, Homo sapien
ctcgagcctagaagatcaggcccta

SEQ ID NO: 55806 - DNA, 25 bp, Homo sapien
ctcgagtgcataacattttttactt

SEQ ID NO: 55807 - DNA, 25 bp, Homo sapien
ctcgagtgcatagcattttttactt

SEQ ID NO: 55808 - DNA, 25 bp, Homo sapien
ctcgatgacctatgaacaggaacag

SEQ ID NO: 55809 - DNA, 25 bp, Homo sapien
ctcgatgagctatgaacaggaacag

SEQ ID NO: 55810 - DNA, 25 bp, Homo sapien
ctcgatgccactaatcattagggaa

SEQ ID NO: 55811 - DNA, 25 bp, Homo sapien
ctcgatgccactaatcgttagggaa

SEQ ID NO: 55812 - DNA, 25 bp, Homo sapien
ctcgattcctctacgtaaatcttca

SEQ ID NO: 55813 - DNA, 25 bp, Homo sapien
ctcgattcctctatgtaaatcttca

SEQ ID NO: 55814 - DNA, 25 bp, Homo sapien
ctcgcaaatccctgagtactctctc

SEQ ID NO: 55815 - DNA, 25 bp, Homo sapien
ctcgcaaatccgtgagtactctctc

SEQ ID NO: 55816 - DNA, 25 bp, Homo sapien
ctcgcaaggatgttcaaatgccact

SEQ ID NO: 55817 - DNA, 25 bp, Homo sapien
ctcgcaaggattttcaaatgccact

SEQ ID NO: 55818 - DNA, 25 bp, Homo sapien
ctcgctggcatgttgctggcagggt

SEQ ID NO: 55819 - DNA, 25 bp, Homo sapien
ctcgctggcgtgttgctggcagggt

SEQ ID NO: 55820 - DNA, 25 bp, Homo sapien
ctcgctgtaaggtgaaggcctgatc

SEQ ID NO: 55821 - DNA, 25 bp, Homo sapien
ctcgctgtaagttgaaggcctgatc

SEQ ID NO: 55822 - DNA, 25 bp, Homo sapien
ctcggagacaatttgtaggtgcagg

SEQ ID NO: 55823 - DNA, 25 bp, Homo sapien
ctcggagactatttgtaggtgcagg

SEQ ID NO: 55824 - DNA, 25 bp, Homo sapien
ctcggatccttaaaaataggaattc

SEQ ID NO: 55825 - DNA, 25 bp, Homo sapien
ctcggatccttagaaataggaattc

SEQ ID NO: 55826 - DNA, 25 bp, Homo sapien
ctcggattgaggtctcaatatctgg

SEQ ID NO: 55827 - DNA, 25 bp, Homo sapien
ctcggattgaggtttcaatatctgg

SEQ ID NO: 55828 - DNA, 25 bp, Homo sapien
ctcggcagatgtttactttgatttt

SEQ ID NO: 55829 - DNA, 25 bp, Homo sapien
ctcggcaggtgtttactttgatttt

SEQ ID NO: 55830 - DNA, 25 bp, Homo sapien
ctcggccaatagccatgatgactac

SEQ ID NO: 55831 - DNA, 25 bp, Homo sapien
ctcggccaatagccgtgatgactac

SEQ ID NO: 55832 - DNA, 25 bp, Homo sapien
ctcgggggaatcgttctggaggctc

SEQ ID NO: 55833 - DNA, 25 bp, Homo sapien
ctcgggggaattgttctggaggctc

SEQ ID NO: 55834 - DNA, 25 bp, Homo sapien
ctcgggtgaaggacaattatttttt

SEQ ID NO: 55835 - DNA, 25 bp, Homo sapien
ctcgggtgaaggacgattatttttt

SEQ ID NO: 55836 - DNA, 25 bp, Homo sapien
ctcggtctacatctgatcctaaggg

SEQ ID NO: 55837 - DNA, 25 bp, Homo sapien
ctcggtctacatgtgatcctaaggg

SEQ ID NO: 55838 - DNA, 25 bp, Homo sapien
ctcggtctccttaattcaggatcta

SEQ ID NO: 55839 - DNA, 25 bp, Homo sapien
ctcggtcttcttaattcaggatcta

SEQ ID NO: 55840 - DNA, 25 bp, Homo sapien
ctcggtgatttgttcaatatttcac

SEQ ID NO: 55841 - DNA, 25 bp, Homo sapien
ctcggtgattttttcaatatttcac

SEQ ID NO: 55842 - DNA, 25 bp, Homo sapien
ctcggtgcaaatataacaatagatt

SEQ ID NO: 55843 - DNA, 25 bp, Homo sapien
ctcggtgcaaatatgacaatagatt

SEQ ID NO: 55844 - DNA, 25 bp, Homo sapien
ctcggtggccgacctattcctggct

SEQ ID NO: 55845 - DNA, 25 bp, Homo sapien
ctcggtggccgacgtattcctggct

SEQ ID NO: 55846 - DNA, 25 bp, Homo sapien
ctcggtgtgaaagtagagtaataat

SEQ ID NO: 55847 - DNA, 25 bp, Homo sapien
ctcggtgtgaaattagagtaataat

SEQ ID NO: 55848 - DNA, 25 bp, Homo sapien
ctcgtataattctgatatgacttag

SEQ ID NO: 55849 - DNA, 25 bp, Homo sapien
ctcgtataattctgatttgacttag

SEQ ID NO: 55850 - DNA, 25 bp, Homo sapien
ctcgtgccaatccatcatgtcaggc

SEQ ID NO: 55851 - DNA, 25 bp, Homo sapien
ctcgtgccaatctatcatgtcaggc

SEQ ID NO: 55852 - DNA, 25 bp, Homo sapien
ctcgtgccattcaacctgccaaagc

SEQ ID NO: 55853 - DNA, 25 bp, Homo sapien
ctcgtgccgttcaacctgccaaagc

SEQ ID NO: 55854 - DNA, 25 bp, Homo sapien
ctcgtgggatttaactgaagttgac

SEQ ID NO: 55855 - DNA, 25 bp, Homo sapien
ctcgtgggatttaattgaagttgac

SEQ ID NO: 55856 - DNA, 25 bp, Homo sapien
ctcgtgtcaaaaacagcacaccagt

SEQ ID NO: 55857 - DNA, 25 bp, Homo sapien
ctcgtgtcaaaaatagcacaccagt

SEQ ID NO: 55858 - DNA, 25 bp, Homo sapien
ctcgtgtggtgaccctgaccctaag

SEQ ID NO: 55859 - DNA, 25 bp, Homo sapien
ctcgtgtggtgactctgaccctaag

SEQ ID NO: 55860 - DNA, 25 bp, Homo sapien
ctcgttcaaaatagcctgtctctgg

SEQ ID NO: 55861 - DNA, 25 bp, Homo sapien
ctcgttcaaaataggctgtctctgg

SEQ ID NO: 55862 - DNA, 25 bp, Homo sapien
ctcgttcagattcgctccttgttct

SEQ ID NO: 55863 - DNA, 25 bp, Homo sapien
ctcgttcagatttgctccttgttct

SEQ ID NO: 55864 - DNA, 25 bp, Homo sapien
ctctaaaaactcacaaagaacaaga

SEQ ID NO: 55865 - DNA, 25 bp, Homo sapien
ctctaaaaactcccaaagaacaaga

SEQ ID NO: 55866 - DNA, 25 bp, Homo sapien
ctctaaaaatccatcaacttataat

SEQ ID NO: 55867 - DNA, 25 bp, Homo sapien
ctctaaaaatccatcagcttataat

SEQ ID NO: 55868 - DNA, 25 bp, Homo sapien
ctctaaaagttgtctcattctctcc

SEQ ID NO: 55869 - DNA, 25 bp, Homo sapien
ctctaaaagttgtctcgttctctcc

SEQ ID NO: 55870 - DNA, 25 bp, Homo sapien
ctctaaaatgcaaataccccaaagc

SEQ ID NO: 55871 - DNA, 25 bp, Homo sapien
ctctaaaatgcaaatatcccaaagc

SEQ ID NO: 55872 - DNA, 25 bp, Homo sapien
ctctaaacacagattatatcctatt

SEQ ID NO: 55873 - DNA, 25 bp, Homo sapien
ctctaaacacaggttatatcctatt

SEQ ID NO: 55874 - DNA, 25 bp, Homo sapien
ctctaaacctcaatctccctgttat

SEQ ID NO: 55875 - DNA, 25 bp, Homo sapien
ctctaaacctcaatcttcctgttat

SEQ ID NO: 55876 - DNA, 25 bp, Homo sapien
ctctaaataacttcaccagaaccca

SEQ ID NO: 55877 - DNA, 25 bp, Homo sapien
ctctaaatagcttcaccagaaccca

SEQ ID NO: 55878 - DNA, 25 bp, Homo sapien
ctctaaataggtctgtatgtaacca

SEQ ID NO: 55879 - DNA, 25 bp, Homo sapien
ctctaaataggtctgtgtgtaacca

SEQ ID NO: 55880 - DNA, 25 bp, Homo sapien
ctctaacccagtcattttgtagccc

SEQ ID NO: 55881 - DNA, 25 bp, Homo sapien
ctctaacccagtcgttttgtagccc

SEQ ID NO: 55882 - DNA, 25 bp, Homo sapien
ctctaactccacatagaaagtatca

SEQ ID NO: 55883 - DNA, 25 bp, Homo sapien
ctctaactccacgtagaaagtatca

SEQ ID NO: 55884 - DNA, 25 bp, Homo sapien
ctctaactggtgataaagcatcatg

SEQ ID NO: 55885 - DNA, 25 bp, Homo sapien
ctctaactggtgatgaagcatcatg

SEQ ID NO: 55886 - DNA, 25 bp, Homo sapien
ctctaaggactgctttagctacttc

SEQ ID NO: 55887 - DNA, 25 bp, Homo sapien
ctctaaggactgctttcgctacttc

SEQ ID NO: 55888 - DNA, 25 bp, Homo sapien
ctctaaggtccgaagagaagttgtt

SEQ ID NO: 55889 - DNA, 25 bp, Homo sapien
ctctaaggtccggagagaagttgtt

SEQ ID NO: 55890 - DNA, 25 bp, Homo sapien
ctctaagtaacagcctgaaagaaca

SEQ ID NO: 55891 - DNA, 25 bp, Homo sapien
ctctaagtaacaggctgaaagaaca

SEQ ID NO: 55892 - DNA, 25 bp, Homo sapien
ctctaagtacacactggaaaattac

SEQ ID NO: 55893 - DNA, 25 bp, Homo sapien
ctctaagtacaccctggaaaattac

SEQ ID NO: 55894 - DNA, 25 bp, Homo sapien
ctctaagtggaaaccacaagcctcc

SEQ ID NO: 55895 - DNA, 25 bp, Homo sapien
ctctaagtggaatccacaagcctcc

SEQ ID NO: 55896 - DNA, 25 bp, Homo sapien
ctctaatacatagctgtaacacaaa

SEQ ID NO: 55897 - DNA, 25 bp, Homo sapien
ctctaatacgtagctgtaacacaaa

SEQ ID NO: 55898 - DNA, 25 bp, Homo sapien
ctctaatatgctatcgtgaacatct

SEQ ID NO: 55899 - DNA, 25 bp, Homo sapien
ctctaatatgctgtcgtgaacatct

SEQ ID NO: 55900 - DNA, 25 bp, Homo sapien
ctctaatcccattcataagggcaga

SEQ ID NO: 55901 - DNA, 25 bp, Homo sapien
ctctaatcccattcttaagggcaga

SEQ ID NO: 55902 - DNA, 25 bp, Homo sapien
ctctaatcttcattgtgaaaacctg

SEQ ID NO: 55903 - DNA, 25 bp, Homo sapien
ctctaatcttcgttgtgaaaacctg

SEQ ID NO: 55904 - DNA, 25 bp, Homo sapien
ctctaatgcatcaaatccatgatca

SEQ ID NO: 55905 - DNA, 25 bp, Homo sapien
ctctaatgctcatatagtgcggaca

SEQ ID NO: 55906 - DNA, 25 bp, Homo sapien
ctctaatggctcatggggaaaaaca

SEQ ID NO: 55907 - DNA, 25 bp, Homo sapien
ctctaatggctcgtggggaaaaaca

SEQ ID NO: 55908 - DNA, 25 bp, Homo sapien
ctctaatgtatcaaatccatgatca

SEQ ID NO: 55909 - DNA, 25 bp, Homo sapien
ctctaatgttcatatagtgcggaca

SEQ ID NO: 55910 - DNA, 25 bp, Homo sapien
ctctaatttgggaaatgatcaatgg

SEQ ID NO: 55911 - DNA, 25 bp, Homo sapien
ctctaattttggaaatgatcaatgg

SEQ ID NO: 55912 - DNA, 25 bp, Homo sapien
ctctacacatgctctataaatggaa

SEQ ID NO: 55913 - DNA, 25 bp, Homo sapien
ctctacacgtgctctataaatggaa

SEQ ID NO: 55914 - DNA, 25 bp, Homo sapien
ctctacactatatataccagactct

SEQ ID NO: 55915 - DNA, 25 bp, Homo sapien
ctctacactatatgtaccagactct

SEQ ID NO: 55916 - DNA, 25 bp, Homo sapien
ctctacagaagatgttggaagctta

SEQ ID NO: 55917 - DNA, 25 bp, Homo sapien
ctctacagaagattttggaagctta

SEQ ID NO: 55918 - DNA, 25 bp, Homo sapien
ctctaccaaacaccaacttacatag

SEQ ID NO: 55919 - DNA, 25 bp, Homo sapien
ctctaccaagcaccaacttacatag

SEQ ID NO: 55920 - DNA, 25 bp, Homo sapien
ctctacctttctcttacaaggacac

SEQ ID NO: 55921 - DNA, 25 bp, Homo sapien
ctctacctttctcttataaggacac

SEQ ID NO: 55922 - DNA, 25 bp, Homo sapien
ctctactaaaaatccgaaacaatta

SEQ ID NO: 55923 - DNA, 25 bp, Homo sapien
ctctactaaaaatctgaaacaatta

SEQ ID NO: 55924 - DNA, 25 bp, Homo sapien
ctctactctttcacgcatttgttag

SEQ ID NO: 55925 - DNA, 25 bp, Homo sapien
ctctactctttcatgcatttgttag

SEQ ID NO: 55926 - DNA, 25 bp, Homo sapien
ctctactggattgctttacatatag

SEQ ID NO: 55927 - DNA, 25 bp, Homo sapien
ctctactggtttgctttacatatag

SEQ ID NO: 55928 - DNA, 25 bp, Homo sapien
ctctagaacctcactgcgaataagg

SEQ ID NO: 55929 - DNA, 25 bp, Homo sapien
ctctagaacctcactgtgaataagg

SEQ ID NO: 55930 - DNA, 25 bp, Homo sapien
ctctagagtaagatgtgatggtaac

SEQ ID NO: 55931 - DNA, 25 bp, Homo sapien
ctctagagtcagatgtgatggtaac

SEQ ID NO: 55932 - DNA, 25 bp, Homo sapien
ctctagcaattgccaacaaatttca

SEQ ID NO: 55933 - DNA, 25 bp, Homo sapien
ctctagcagttgccaacaaatttca

SEQ ID NO: 55934 - DNA, 25 bp, Homo sapien
ctctagccacctctcatacctactg

SEQ ID NO: 55935 - DNA, 25 bp, Homo sapien
ctctagcctcaaattttcctttgaa

SEQ ID NO: 55936 - DNA, 25 bp, Homo sapien
ctctagcctcaacttttcctttgaa

SEQ ID NO: 55937 - DNA, 25 bp, Homo sapien
ctctagcctcctctcatacctactg

SEQ ID NO: 55938 - DNA, 25 bp, Homo sapien
ctctaggtggaccatcatgcatacc

SEQ ID NO: 55939 - DNA, 25 bp, Homo sapien
ctctaggtggactatcatgcatacc

SEQ ID NO: 55940 - DNA, 25 bp, Homo sapien
ctctagtaagccaattcctctcttg

SEQ ID NO: 55941 - DNA, 25 bp, Homo sapien
ctctagtaagccagttcctctcttg

SEQ ID NO: 55942 - DNA, 25 bp, Homo sapien
ctctagtactaggtacctgtcctga

SEQ ID NO: 55943 - DNA, 25 bp, Homo sapien
ctctagtactaggtacgtgtcctga

SEQ ID NO: 55944 - DNA, 25 bp, Homo sapien
ctctagtgtattttgtatagcattg

SEQ ID NO: 55945 - DNA, 25 bp, Homo sapien
ctctagtgtccttcttaagaagtct

SEQ ID NO: 55946 - DNA, 25 bp, Homo sapien
ctctagtgtgttttgtatagcattg

SEQ ID NO: 55947 - DNA, 25 bp, Homo sapien
ctctagtgttcttcttaagaagtct

SEQ ID NO: 55948 - DNA, 25 bp, Homo sapien
ctctagttttatggtaccagagaat

SEQ ID NO: 55949 - DNA, 25 bp, Homo sapien
ctctagttttatggtatcagagaat

SEQ ID NO: 55950 - DNA, 25 bp, Homo sapien
ctctatacaagcaactatgcccagt

SEQ ID NO: 55951 - DNA, 25 bp, Homo sapien
ctctatacatgcaactatgcccagt

SEQ ID NO: 55952 - DNA, 25 bp, Homo sapien
ctctatagaaagtaaaatgtagagg

SEQ ID NO: 55953 - DNA, 25 bp, Homo sapien
ctctatagagagtaaaatgtagagg

SEQ ID NO: 55954 - DNA, 25 bp, Homo sapien
ctctatagcttaaaaaataatctcc

SEQ ID NO: 55955 - DNA, 25 bp, Homo sapien
ctctatagcttacaaaataatctcc

SEQ ID NO: 55956 - DNA, 25 bp, Homo sapien
ctctatatcgaatgcacagacttgg

SEQ ID NO: 55957 - DNA, 25 bp, Homo sapien
ctctatattcgaacggtctgggtta

SEQ ID NO: 55958 - DNA, 25 bp, Homo sapien
ctctatattcgaatggtctgggtta

SEQ ID NO: 55959 - DNA, 25 bp, Homo sapien
ctctatattgaatgcacagacttgg

SEQ ID NO: 55960 - DNA, 25 bp, Homo sapien
ctctatcaccgtaggccctgatata

SEQ ID NO: 55961 - DNA, 25 bp, Homo sapien
ctctatcactgtaggccctgatata

SEQ ID NO: 55962 - DNA, 25 bp, Homo sapien
ctctatcatttggtagcatttaagg

SEQ ID NO: 55963 - DNA, 25 bp, Homo sapien
ctctatcatttggtggcatttaagg

SEQ ID NO: 55964 - DNA, 25 bp, Homo sapien
ctctatcattttatcctatctgagt

SEQ ID NO: 55965 - DNA, 25 bp, Homo sapien
ctctatcattttattctatctgagt

SEQ ID NO: 55966 - DNA, 25 bp, Homo sapien
ctctatccatgtaccttaagcatag

SEQ ID NO: 55967 - DNA, 25 bp, Homo sapien
ctctatccctctcatttttcaggca

SEQ ID NO: 55968 - DNA, 25 bp, Homo sapien
ctctatccctcttatttttcaggca

SEQ ID NO: 55969 - DNA, 25 bp, Homo sapien
ctctatccgtgtaccttaagcatag

SEQ ID NO: 55970 - DNA, 25 bp, Homo sapien
ctctatctcatgcggatttatgtcc

SEQ ID NO: 55971 - DNA, 25 bp, Homo sapien
ctctatctcatgtggatttatgtcc

SEQ ID NO: 55972 - DNA, 25 bp, Homo sapien
ctctatcttgacttctactcttgag

SEQ ID NO: 55973 - DNA, 25 bp, Homo sapien
ctctatcttgacttttactcttgag

SEQ ID NO: 55974 - DNA, 25 bp, Homo sapien
ctctatgagcacatttcattgcaag

SEQ ID NO: 55975 - DNA, 25 bp, Homo sapien
ctctatgagcacattttattgcaag

SEQ ID NO: 55976 - DNA, 25 bp, Homo sapien
ctctatgtgctcaaatgaatctgac

SEQ ID NO: 55977 - DNA, 25 bp, Homo sapien
ctctatgtgttcaatacagatgcag

SEQ ID NO: 55978 - DNA, 25 bp, Homo sapien
ctctatgtgttcagtacagatgcag

SEQ ID NO: 55979 - DNA, 25 bp, Homo sapien
ctctatgttcagagagcgtctaccc

SEQ ID NO: 55980 - DNA, 25 bp, Homo sapien
ctctatgttcagagagtgtctaccc

SEQ ID NO: 55981 - DNA, 25 bp, Homo sapien
ctctatgttctcaaatgaatctgac

SEQ ID NO: 55982 - DNA, 25 bp, Homo sapien
ctctattccttcaagaaaaaattct

SEQ ID NO: 55983 - DNA, 25 bp, Homo sapien
ctctattccttccagaaaaaattct

SEQ ID NO: 55984 - DNA, 25 bp, Homo sapien
ctctattcttgtataccgagactat

SEQ ID NO: 55985 - DNA, 25 bp, Homo sapien
ctctattcttgtgtaccgagactat

SEQ ID NO: 55986 - DNA, 25 bp, Homo sapien
ctctatttcttgtttattttctact

SEQ ID NO: 55987 - DNA, 25 bp, Homo sapien
ctctatttggggtgttatcttttgg

SEQ ID NO: 55988 - DNA, 25 bp, Homo sapien
ctctatttgggttgttatcttttgg

SEQ ID NO: 55989 - DNA, 25 bp, Homo sapien
ctctattttgtggcacataatgcat

SEQ ID NO: 55990 - DNA, 25 bp, Homo sapien
ctctattttgtgtcacataatgcat

SEQ ID NO: 55991 - DNA, 25 bp, Homo sapien
ctctattttttgtttattttctact

SEQ ID NO: 55992 - DNA, 25 bp, Homo sapien
ctctcaactgtacgtcagaagtccc

SEQ ID NO: 55993 - DNA, 25 bp, Homo sapien
ctctcaactgtatgtcagaagtccc

SEQ ID NO: 55994 - DNA, 25 bp, Homo sapien
ctctcaactttgcagactcaaataa

SEQ ID NO: 55995 - DNA, 25 bp, Homo sapien
ctctcaactttgcagattcaaataa

SEQ ID NO: 55996 - DNA, 25 bp, Homo sapien
ctctcaagtcaacgtttgattggtg

SEQ ID NO: 55997 - DNA, 25 bp, Homo sapien
ctctcaagtcaatgtttgattggtg

SEQ ID NO: 55998 - DNA, 25 bp, Homo sapien
ctctcaataattcccaagatgtttc

SEQ ID NO: 55999 - DNA, 25 bp, Homo sapien
ctctcaataattcccaggatgtttc

SEQ ID NO: 56000 - DNA, 25 bp, Homo sapien
ctctcaatttataaggtcgtttaat

SEQ ID NO: 56001 - DNA, 25 bp, Homo sapien
ctctcaatttatgaggtcgtttaat

SEQ ID NO: 56002 - DNA, 25 bp, Homo sapien
ctctcacaatccaagcatctgaaaa

SEQ ID NO: 56003 - DNA, 25 bp, Homo sapien
ctctcacaatccaagcgtctgaaaa

SEQ ID NO: 56004 - DNA, 25 bp, Homo sapien
ctctcacaatgaacgaggacatcca

SEQ ID NO: 56005 - DNA, 25 bp, Homo sapien
ctctcacaatgaatgaggacatcca

SEQ ID NO: 56006 - DNA, 25 bp, Homo sapien
ctctcacacatataattttttaaaa

SEQ ID NO: 56007 - DNA, 25 bp, Homo sapien
ctctcacacgtataattttttaaaa

SEQ ID NO: 56008 - DNA, 25 bp, Homo sapien
ctctcacacgttgctggtgcaaatg

SEQ ID NO: 56009 - DNA, 25 bp, Homo sapien
ctctcacagttacaggagctagagg

SEQ ID NO: 56010 - DNA, 25 bp, Homo sapien
ctctcacagttataggagctagagg

SEQ ID NO: 56011 - DNA, 25 bp, Homo sapien
ctctcacatgttgctggtgcaaatg

SEQ ID NO: 56012 - DNA, 25 bp, Homo sapien
ctctcacctgacttctacagggctc

SEQ ID NO: 56013 - DNA, 25 bp, Homo sapien
ctctcacctgatttctacagggctc

SEQ ID NO: 56014 - DNA, 25 bp, Homo sapien
ctctcaccttacttgcataggcact

SEQ ID NO: 56015 - DNA, 25 bp, Homo sapien
ctctcaccttactttcataggcact

SEQ ID NO: 56016 - DNA, 25 bp, Homo sapien
ctctcactcttaatacaatcgccaa

SEQ ID NO: 56017 - DNA, 25 bp, Homo sapien
ctctcactcttcatacaatcgccaa

SEQ ID NO: 56018 - DNA, 25 bp, Homo sapien
ctctcactgtgaggataagcaagaa

SEQ ID NO: 56019 - DNA, 25 bp, Homo sapien
ctctcactgtgaggatgagcaagaa

SEQ ID NO: 56020 - DNA, 25 bp, Homo sapien
ctctcagaaaacactgttgagatgg

SEQ ID NO: 56021 - DNA, 25 bp, Homo sapien
ctctcagagaacactgttgagatgg

SEQ ID NO: 56022 - DNA, 25 bp, Homo sapien
ctctcagcaattccacttaagaata

SEQ ID NO: 56023 - DNA, 25 bp, Homo sapien
ctctcagcacttccacttaagaata

SEQ ID NO: 56024 - DNA, 25 bp, Homo sapien
ctctcagctgccacttaatgacttt

SEQ ID NO: 56025 - DNA, 25 bp, Homo sapien
ctctcagctgccgcttaatgacttt

SEQ ID NO: 56026 - DNA, 25 bp, Homo sapien
ctctcaggacgctgcaagttgtggg

SEQ ID NO: 56027 - DNA, 25 bp, Homo sapien
ctctcaggatgctgcaagttgtggg

SEQ ID NO: 56028 - DNA, 25 bp, Homo sapien
ctctcagtgtagggaacaaggtagg

SEQ ID NO: 56029 - DNA, 25 bp, Homo sapien
ctctcagttgaagacctcacttatt

SEQ ID NO: 56030 - DNA, 25 bp, Homo sapien
ctctcagttgaagatctcacttatt

SEQ ID NO: 56031 - DNA, 25 bp, Homo sapien
ctctcagttggacatgaatgttgct

SEQ ID NO: 56032 - DNA, 25 bp, Homo sapien
ctctcagttggatatgaatgttgct

SEQ ID NO: 56033 - DNA, 25 bp, Homo sapien
ctctcagtttagggaacaaggtagg

SEQ ID NO: 56034 - DNA, 25 bp, Homo sapien
ctctcatacgcaaaatatattcact

SEQ ID NO: 56035 - DNA, 25 bp, Homo sapien
ctctcatacgcgaaatatattcact

SEQ ID NO: 56036 - DNA, 25 bp, Homo sapien
ctctcatatatggctttcattgtgt

SEQ ID NO: 56037 - DNA, 25 bp, Homo sapien
ctctcatatatgggtttcattgtgt

SEQ ID NO: 56038 - DNA, 25 bp, Homo sapien
ctctcatcccagtagaatatgtagc

SEQ ID NO: 56039 - DNA, 25 bp, Homo sapien
ctctcatcccagtggaatatgtagc

SEQ ID NO: 56040 - DNA, 25 bp, Homo sapien
ctctcatctattcatgaatttcctt

SEQ ID NO: 56041 - DNA, 25 bp, Homo sapien
ctctcatctatttatgaatttcctt

SEQ ID NO: 56042 - DNA, 25 bp, Homo sapien
ctctcatgtatgaacaaatcaaatg

SEQ ID NO: 56043 - DNA, 25 bp, Homo sapien
ctctcatgtttgaacaaatcaaatg

SEQ ID NO: 56044 - DNA, 25 bp, Homo sapien
ctctcattaaacacttatttctggc

SEQ ID NO: 56045 - DNA, 25 bp, Homo sapien
ctctcattaaacatttatttctggc

SEQ ID NO: 56046 - DNA, 25 bp, Homo sapien
ctctcattgcgtgaattcaagtcac

SEQ ID NO: 56047 - DNA, 25 bp, Homo sapien
ctctcattgtgtgaattcaagtcac

SEQ ID NO: 56048 - DNA, 25 bp, Homo sapien
ctctccaaacggacccaggttgtga

SEQ ID NO: 56049 - DNA, 25 bp, Homo sapien
ctctccaaatggacccaggttgtga

SEQ ID NO: 56050 - DNA, 25 bp, Homo sapien
ctctccaacaactacctgctctaat

SEQ ID NO: 56051 - DNA, 25 bp, Homo sapien
ctctccaacaattacctgctctaat

SEQ ID NO: 56052 - DNA, 25 bp, Homo sapien
ctctccacatgaacacctgttatgc

SEQ ID NO: 56053 - DNA, 25 bp, Homo sapien
ctctccacatggacacctgttatgc

SEQ ID NO: 56054 - DNA, 25 bp, Homo sapien
ctctccactatgtttctaaaacttt

SEQ ID NO: 56055 - DNA, 25 bp, Homo sapien
ctctccactgtgtttctaaaacttt

SEQ ID NO: 56056 - DNA, 25 bp, Homo sapien
ctctccagaaaatgcggttttgttt

SEQ ID NO: 56057 - DNA, 25 bp, Homo sapien
ctctccagaaaatgtggttttgttt

SEQ ID NO: 56058 - DNA, 25 bp, Homo sapien
ctctccagcaccgactttctcacca

SEQ ID NO: 56059 - DNA, 25 bp, Homo sapien
ctctccagcactgactttctcacca

SEQ ID NO: 56060 - DNA, 25 bp, Homo sapien
ctctccagtgtatgtaatgctggtg

SEQ ID NO: 56061 - DNA, 25 bp, Homo sapien
ctctccagtgtgtgtaatgctggtg

SEQ ID NO: 56062 - DNA, 25 bp, Homo sapien
ctctccataggtctcatgccacatt

SEQ ID NO: 56063 - DNA, 25 bp, Homo sapien
ctctccataggtcttatgccacatt

SEQ ID NO: 56064 - DNA, 25 bp, Homo sapien
ctctccatgtaatctgaaaaatcaa

SEQ ID NO: 56065 - DNA, 25 bp, Homo sapien
ctctccatgtattctgaaaaatcaa

SEQ ID NO: 56066 - DNA, 25 bp, Homo sapien
ctctccatgtttcagagtcatcgta

SEQ ID NO: 56067 - DNA, 25 bp, Homo sapien
ctctccatgtttcggagtcatcgta

SEQ ID NO: 56068 - DNA, 25 bp, Homo sapien
ctctccattgtctttactgggctgt

SEQ ID NO: 56069 - DNA, 25 bp, Homo sapien
ctctccattgtttttactgggctgt

SEQ ID NO: 56070 - DNA, 25 bp, Homo sapien
ctctcccagcttccgctaatacatg

SEQ ID NO: 56071 - DNA, 25 bp, Homo sapien
ctctcccagcttctgctaatacatg

SEQ ID NO: 56072 - DNA, 25 bp, Homo sapien
ctctcccatcgattccaacttttcc

SEQ ID NO: 56073 - DNA, 25 bp, Homo sapien
ctctcccatcgattgcaacttttcc

SEQ ID NO: 56074 - DNA, 25 bp, Homo sapien
ctctccccaatacgcacagtaatat

SEQ ID NO: 56075 - DNA, 25 bp, Homo sapien
ctctccccagtacgcacagtaatat

SEQ ID NO: 56076 - DNA, 25 bp, Homo sapien
ctctccctacctgaacctacgaaca

SEQ ID NO: 56077 - DNA, 25 bp, Homo sapien
ctctccctacctgaccctacgaaca

SEQ ID NO: 56078 - DNA, 25 bp, Homo sapien
ctctcccttcctccgtaatcattac

SEQ ID NO: 56079 - DNA, 25 bp, Homo sapien
ctctcccttcctctgtaatcattac

SEQ ID NO: 56080 - DNA, 25 bp, Homo sapien
ctctccgtaattatctcttcaatta

SEQ ID NO: 56081 - DNA, 25 bp, Homo sapien
ctctccgtagttatctcttcaatta

SEQ ID NO: 56082 - DNA, 25 bp, Homo sapien
ctctccgtcatcagcctattttcag

SEQ ID NO: 56083 - DNA, 25 bp, Homo sapien
ctctccgtcattagcctattttcag

SEQ ID NO: 56084 - DNA, 25 bp, Homo sapien
ctctcctaatcatctgcccaggaat

SEQ ID NO: 56085 - DNA, 25 bp, Homo sapien
ctctcctaatcgtctgcccaggaat

SEQ ID NO: 56086 - DNA, 25 bp, Homo sapien
ctctcctaccacacataacgccaag

SEQ ID NO: 56087 - DNA, 25 bp, Homo sapien
ctctcctaccacgcataacgccaag

SEQ ID NO: 56088 - DNA, 25 bp, Homo sapien
ctctcctcaccgcaagcttcacctc

SEQ ID NO: 56089 - DNA, 25 bp, Homo sapien
ctctcctcaccgcaggcttcacctc

SEQ ID NO: 56090 - DNA, 25 bp, Homo sapien
ctctcctctgaagtggtctgtttgt

SEQ ID NO: 56091 - DNA, 25 bp, Homo sapien
ctctcctctgaagttgtctgtttgt

SEQ ID NO: 56092 - DNA, 25 bp, Homo sapien
ctctcctcttattacgtgaattgtc

SEQ ID NO: 56093 - DNA, 25 bp, Homo sapien
ctctcctcttattatgtgaattgtc

SEQ ID NO: 56094 - DNA, 25 bp, Homo sapien
ctctcctggctcctggtcattacgg

SEQ ID NO: 56095 - DNA, 25 bp, Homo sapien
ctctcctggctccttgtcattacgg

SEQ ID NO: 56096 - DNA, 25 bp, Homo sapien
ctctccttaaggcctaggtctacct

SEQ ID NO: 56097 - DNA, 25 bp, Homo sapien
ctctccttaaggcctatgtctacct

SEQ ID NO: 56098 - DNA, 25 bp, Homo sapien
ctctccttcactcattgtatgttac

SEQ ID NO: 56099 - DNA, 25 bp, Homo sapien
ctctccttcactctttgtatgttac

SEQ ID NO: 56100 - DNA, 25 bp, Homo sapien
ctctccttgccacggaatttgctgg

SEQ ID NO: 56101 - DNA, 25 bp, Homo sapien
ctctccttgccatggaatttgctgg

SEQ ID NO: 56102 - DNA, 25 bp, Homo sapien
ctctcggtgtgaaagtagagtaata

SEQ ID NO: 56103 - DNA, 25 bp, Homo sapien
ctctcggtgtgaaattagagtaata

SEQ ID NO: 56104 - DNA, 25 bp, Homo sapien
ctctctactcccaaaaaacagattg

SEQ ID NO: 56105 - DNA, 25 bp, Homo sapien
ctctctactcccaaaagacagattg

SEQ ID NO: 56106 - DNA, 25 bp, Homo sapien
ctctctagcatttataggagactgg

SEQ ID NO: 56107 - DNA, 25 bp, Homo sapien
ctctctagcgtttataggagactgg

SEQ ID NO: 56108 - DNA, 25 bp, Homo sapien
ctctctcaacttcatactaaaatat

SEQ ID NO: 56109 - DNA, 25 bp, Homo sapien
ctctctcaagtcaacgtttgattgg

SEQ ID NO: 56110 - DNA, 25 bp, Homo sapien
ctctctcaagtcaatgtttgattgg

SEQ ID NO: 56111 - DNA, 25 bp, Homo sapien
ctctctcaccttcatactaaaatat

SEQ ID NO: 56112 - DNA, 25 bp, Homo sapien
ctctctcacgttatatgtgtgcttg

SEQ ID NO: 56113 - DNA, 25 bp, Homo sapien
ctctctcatgttatatgtgtgcttg

SEQ ID NO: 56114 - DNA, 25 bp, Homo sapien
ctctctcattcacattgtgtctcat

SEQ ID NO: 56115 - DNA, 25 bp, Homo sapien
ctctctcattcacgttgtgtctcat

SEQ ID NO: 56116 - DNA, 25 bp, Homo sapien
ctctctcattctcacaaatgtgcac

SEQ ID NO: 56117 - DNA, 25 bp, Homo sapien
ctctctcattcttacaaatgtgcac

SEQ ID NO: 56118 - DNA, 25 bp, Homo sapien
ctctctccaaatcggagtgtcagat

SEQ ID NO: 56119 - DNA, 25 bp, Homo sapien
ctctctccaaattggagtgtcagat

SEQ ID NO: 56120 - DNA, 25 bp, Homo sapien
ctctctccattgtctttactgggct

SEQ ID NO: 56121 - DNA, 25 bp, Homo sapien
ctctctccattgtttttactgggct

SEQ ID NO: 56122 - DNA, 25 bp, Homo sapien
ctctctcctccacgttactttgatt

SEQ ID NO: 56123 - DNA, 25 bp, Homo sapien
ctctctcctccatgttactttgatt

SEQ ID NO: 56124 - DNA, 25 bp, Homo sapien
ctctctcggcagatgtttactttga

SEQ ID NO: 56125 - DNA, 25 bp, Homo sapien
ctctctcggcaggtgtttactttga

SEQ ID NO: 56126 - DNA, 25 bp, Homo sapien
ctctctgaaaacgtccatggataat

SEQ ID NO: 56127 - DNA, 25 bp, Homo sapien
ctctctgaaaatgtccatggataat

SEQ ID NO: 56128 - DNA, 25 bp, Homo sapien
ctctctgacattcaaccacatgctc

SEQ ID NO: 56129 - DNA, 25 bp, Homo sapien
ctctctgacgttcaaccacatgctc

SEQ ID NO: 56130 - DNA, 25 bp, Homo sapien
ctctctgcacatttcactttttaga

SEQ ID NO: 56131 - DNA, 25 bp, Homo sapien
ctctctgcacattttactttttaga

SEQ ID NO: 56132 - DNA, 25 bp, Homo sapien
ctctctgcagattcacctattctgg

SEQ ID NO: 56133 - DNA, 25 bp, Homo sapien
ctctctgcggattcacctattctgg

SEQ ID NO: 56134 - DNA, 25 bp, Homo sapien
ctctctgcgtccacctcttctcttg

SEQ ID NO: 56135 - DNA, 25 bp, Homo sapien
ctctctgcgtccaccttttctcttg

SEQ ID NO: 56136 - DNA, 25 bp, Homo sapien
ctctctggtggcataaaacagaaag

SEQ ID NO: 56137 - DNA, 25 bp, Homo sapien
ctctctggtggcgtaaaacagaaag

SEQ ID NO: 56138 - DNA, 25 bp, Homo sapien
ctctctgtgccaaaactttttgtaa

SEQ ID NO: 56139 - DNA, 25 bp, Homo sapien
ctctctgtgccagaactttttgtaa

SEQ ID NO: 56140 - DNA, 25 bp, Homo sapien
ctctctgttcattcccagcacctaa

SEQ ID NO: 56141 - DNA, 25 bp, Homo sapien
ctctctgttgatgtatacactgaaa

SEQ ID NO: 56142 - DNA, 25 bp, Homo sapien
ctctctgttgatttatacactgaaa

SEQ ID NO: 56143 - DNA, 25 bp, Homo sapien
ctctctgtttattcccagcacctaa

SEQ ID NO: 56144 - DNA, 25 bp, Homo sapien
ctctcttaaccatcatgagataact

SEQ ID NO: 56145 - DNA, 25 bp, Homo sapien
ctctcttaatgaagaaaatgagaaa

SEQ ID NO: 56146 - DNA, 25 bp, Homo sapien
ctctcttaatggagaaaatgagaaa

SEQ ID NO: 56147 - DNA, 25 bp, Homo sapien
ctctcttagccatcatgagataact

SEQ ID NO: 56148 - DNA, 25 bp, Homo sapien
ctctcttagttcttcgacctctctg

SEQ ID NO: 56149 - DNA, 25 bp, Homo sapien
ctctcttagttctttgacctctctg

SEQ ID NO: 56150 - DNA, 25 bp, Homo sapien
ctctcttatgatgaggaaagtttga

SEQ ID NO: 56151 - DNA, 25 bp, Homo sapien
ctctcttatgatggggaaagtttga

SEQ ID NO: 56152 - DNA, 25 bp, Homo sapien
ctctcttcatgcattctctttcccc

SEQ ID NO: 56153 - DNA, 25 bp, Homo sapien
ctctcttcatgcgttctctttcccc

SEQ ID NO: 56154 - DNA, 25 bp, Homo sapien
ctctcttccaatcctccaggttctc

SEQ ID NO: 56155 - DNA, 25 bp, Homo sapien
ctctcttccaatcctctaggttctc

SEQ ID NO: 56156 - DNA, 25 bp, Homo sapien
ctctcttccctcgcaatggtgtctt

SEQ ID NO: 56157 - DNA, 25 bp, Homo sapien
ctctcttccctcggaatggtgtctt

SEQ ID NO: 56158 - DNA, 25 bp, Homo sapien
ctctcttctaaccatcttattctca

SEQ ID NO: 56159 - DNA, 25 bp, Homo sapien
ctctcttctaactatcttattctca

SEQ ID NO: 56160 - DNA, 25 bp, Homo sapien
ctctcttctcacctacaagaattta

SEQ ID NO: 56161 - DNA, 25 bp, Homo sapien
ctctcttctcacctgcaagaattta

SEQ ID NO: 56162 - DNA, 25 bp, Homo sapien
ctctcttgggacaagaaatactaaa

SEQ ID NO: 56163 - DNA, 25 bp, Homo sapien
ctctcttgggaccagaaatactaaa

SEQ ID NO: 56164 - DNA, 25 bp, Homo sapien
ctctcttgtagacagtccagatcct

SEQ ID NO: 56165 - DNA, 25 bp, Homo sapien
ctctcttgtagactgtccagatcct

SEQ ID NO: 56166 - DNA, 25 bp, Homo sapien
ctctctttaaaaaatgaaaattaaa

SEQ ID NO: 56167 - DNA, 25 bp, Homo sapien
ctctctttgaaaaatgaaaattaaa

SEQ ID NO: 56168 - DNA, 25 bp, Homo sapien
ctctctttgacgttgaccttcctgc

SEQ ID NO: 56169 - DNA, 25 bp, Homo sapien
ctctctttgacgttgatcttcctgc

SEQ ID NO: 56170 - DNA, 25 bp, Homo sapien
ctctctttggacttcagaagcaatc

SEQ ID NO: 56171 - DNA, 25 bp, Homo sapien
ctctctttggactttagaagcaatc

SEQ ID NO: 56172 - DNA, 25 bp, Homo sapien
ctctgaaaaaataatacgagccaga

SEQ ID NO: 56173 - DNA, 25 bp, Homo sapien
ctctgaaaaaataatatgagccaga

SEQ ID NO: 56174 - DNA, 25 bp, Homo sapien
ctctgaaaacgtccatggataattt

SEQ ID NO: 56175 - DNA, 25 bp, Homo sapien
ctctgaaaatgtccatggataattt

SEQ ID NO: 56176 - DNA, 25 bp, Homo sapien
ctctgaaagaaaactaacagcccca

SEQ ID NO: 56177 - DNA, 25 bp, Homo sapien
ctctgaaagaaagctaacagcccca

SEQ ID NO: 56178 - DNA, 25 bp, Homo sapien
ctctgaaatctccacttatctctta

SEQ ID NO: 56179 - DNA, 25 bp, Homo sapien
ctctgaaatctccgcttatctctta

SEQ ID NO: 56180 - DNA, 25 bp, Homo sapien
ctctgaacagagagtgacatgatca

SEQ ID NO: 56181 - DNA, 25 bp, Homo sapien
ctctgaacataccgtacttgtccaa

SEQ ID NO: 56182 - DNA, 25 bp, Homo sapien
ctctgaacatactgtacttgtccaa

SEQ ID NO: 56183 - DNA, 25 bp, Homo sapien
ctctgaacggagagtgacatgatca

SEQ ID NO: 56184 - DNA, 25 bp, Homo sapien
ctctgaagacgtaattgtatcattg

SEQ ID NO: 56185 - DNA, 25 bp, Homo sapien
ctctgaagagagtgactgatcctga

SEQ ID NO: 56186 - DNA, 25 bp, Homo sapien
ctctgaagagagtggctgatcctga

SEQ ID NO: 56187 - DNA, 25 bp, Homo sapien
ctctgaagatgtaattgtatcattg

SEQ ID NO: 56188 - DNA, 25 bp, Homo sapien
ctctgaagatttttatggcaattcc

SEQ ID NO: 56189 - DNA, 25 bp, Homo sapien
ctctgaagatttttgtggcaattcc

SEQ ID NO: 56190 - DNA, 25 bp, Homo sapien
ctctgaagtccacatttttcttaaa

SEQ ID NO: 56191 - DNA, 25 bp, Homo sapien
ctctgaagtccatatttttcttaaa

SEQ ID NO: 56192 - DNA, 25 bp, Homo sapien
ctctgaagtggtctgtttgttcttc

SEQ ID NO: 56193 - DNA, 25 bp, Homo sapien
ctctgaagtgttaatcatttacaca

SEQ ID NO: 56194 - DNA, 25 bp, Homo sapien
ctctgaagtgttaatcgtttacaca

SEQ ID NO: 56195 - DNA, 25 bp, Homo sapien
ctctgaagttcctccaattcagaaa

SEQ ID NO: 56196 - DNA, 25 bp, Homo sapien
ctctgaagttcctccagttcagaaa

SEQ ID NO: 56197 - DNA, 25 bp, Homo sapien
ctctgaagttgtctgtttgttcttc

SEQ ID NO: 56198 - DNA, 25 bp, Homo sapien
ctctgaattaggagaacagtgtcta

SEQ ID NO: 56199 - DNA, 25 bp, Homo sapien
ctctgaattaggaggacagtgtcta

SEQ ID NO: 56200 - DNA, 25 bp, Homo sapien
ctctgacaatcggatctccatgaac

SEQ ID NO: 56201 - DNA, 25 bp, Homo sapien
ctctgacaatcgggtctccatgaac

SEQ ID NO: 56202 - DNA, 25 bp, Homo sapien
ctctgactcaattatgtggaaagtg

SEQ ID NO: 56203 - DNA, 25 bp, Homo sapien
ctctgactcgattatgtggaaagtg

SEQ ID NO: 56204 - DNA, 25 bp, Homo sapien
ctctgactttgaagacccattagta

SEQ ID NO: 56205 - DNA, 25 bp, Homo sapien
ctctgactttgaagactcattagta

SEQ ID NO: 56206 - DNA, 25 bp, Homo sapien
ctctgagaaccactggtttgtttgt

SEQ ID NO: 56207 - DNA, 25 bp, Homo sapien
ctctgagaaccgctggtttgtttgt

SEQ ID NO: 56208 - DNA, 25 bp, Homo sapien
ctctgagacacatatctctgtctct

SEQ ID NO: 56209 - DNA, 25 bp, Homo sapien
ctctgagacacatttctctgtctct

SEQ ID NO: 56210 - DNA, 25 bp, Homo sapien
ctctgagacttaggcgagccaggca

SEQ ID NO: 56211 - DNA, 25 bp, Homo sapien
ctctgagactttggcgagccaggca

SEQ ID NO: 56212 - DNA, 25 bp, Homo sapien
ctctgagataaacagccagagtctt

SEQ ID NO: 56213 - DNA, 25 bp, Homo sapien
ctctgagataaatagccagagtctt

SEQ ID NO: 56214 - DNA, 25 bp, Homo sapien
ctctgagcactaaaatatactctga

SEQ ID NO: 56215 - DNA, 25 bp, Homo sapien
ctctgagctctaaaatatactctga

SEQ ID NO: 56216 - DNA, 25 bp, Homo sapien
ctctgaggttcaatcatttgtcact

SEQ ID NO: 56217 - DNA, 25 bp, Homo sapien
ctctgaggttcagtcatttgtcact

SEQ ID NO: 56218 - DNA, 25 bp, Homo sapien
ctctgaggtttaagcactctgcttt

SEQ ID NO: 56219 - DNA, 25 bp, Homo sapien
ctctgaggtttgagcactctgcttt

SEQ ID NO: 56220 - DNA, 25 bp, Homo sapien
ctctgagtgttacctctctattaat

SEQ ID NO: 56221 - DNA, 25 bp, Homo sapien
ctctgagtgttatctctctattaat

SEQ ID NO: 56222 - DNA, 25 bp, Homo sapien
ctctgagttctatctaccttcttta

SEQ ID NO: 56223 - DNA, 25 bp, Homo sapien
ctctgagttctgtctaccttcttta

SEQ ID NO: 56224 - DNA, 25 bp, Homo sapien
ctctgataaacaatatgtttggcat

SEQ ID NO: 56225 - DNA, 25 bp, Homo sapien
ctctgataaacagtatgtttggcat

SEQ ID NO: 56226 - DNA, 25 bp, Homo sapien
ctctgatcacaagattttggaaaag

SEQ ID NO: 56227 - DNA, 25 bp, Homo sapien
ctctgatcacaaggttttggaaaag

SEQ ID NO: 56228 - DNA, 25 bp, Homo sapien
ctctgatccgaaattttaataagaa

SEQ ID NO: 56229 - DNA, 25 bp, Homo sapien
ctctgatctgaaattttaataagaa

SEQ ID NO: 56230 - DNA, 25 bp, Homo sapien
ctctgatgcatacggaattgtgact

SEQ ID NO: 56231 - DNA, 25 bp, Homo sapien
ctctgatgcatatggaattgtgact

SEQ ID NO: 56232 - DNA, 25 bp, Homo sapien
ctctgatgcattaccatatagaatc

SEQ ID NO: 56233 - DNA, 25 bp, Homo sapien
ctctgatgccttaccatatagaatc

SEQ ID NO: 56234 - DNA, 25 bp, Homo sapien
ctctgattgggaacgttgggtacta

SEQ ID NO: 56235 - DNA, 25 bp, Homo sapien
ctctgattgggaatgttgggtacta

SEQ ID NO: 56236 - DNA, 25 bp, Homo sapien
ctctgcaacataaccattcagaata

SEQ ID NO: 56237 - DNA, 25 bp, Homo sapien
ctctgcaacatatccattcagaata

SEQ ID NO: 56238 - DNA, 25 bp, Homo sapien
ctctgcaagaggcaggcacagacgt

SEQ ID NO: 56239 - DNA, 25 bp, Homo sapien
ctctgcaagaggcaggtacagacgt

SEQ ID NO: 56240 - DNA, 25 bp, Homo sapien
ctctgcaatatacgcggaatgtctt

SEQ ID NO: 56241 - DNA, 25 bp, Homo sapien
ctctgcaatatacgtggaatgtctt

SEQ ID NO: 56242 - DNA, 25 bp, Homo sapien
ctctgcacatttcactttttagaat

SEQ ID NO: 56243 - DNA, 25 bp, Homo sapien
ctctgcacattttactttttagaat

SEQ ID NO: 56244 - DNA, 25 bp, Homo sapien
ctctgcaccatggtatatttactta

SEQ ID NO: 56245 - DNA, 25 bp, Homo sapien
ctctgcaccgtggtatatttactta

SEQ ID NO: 56246 - DNA, 25 bp, Homo sapien
ctctgcacgttcattagtgacggtt

SEQ ID NO: 56247 - DNA, 25 bp, Homo sapien
ctctgcactgaatactatctgcgaa

SEQ ID NO: 56248 - DNA, 25 bp, Homo sapien
ctctgcactgaatcctatctgcgaa

SEQ ID NO: 56249 - DNA, 25 bp, Homo sapien
ctctgcactttcattagtgacggtt

SEQ ID NO: 56250 - DNA, 25 bp, Homo sapien
ctctgcagaaacggacccagcagag

SEQ ID NO: 56251 - DNA, 25 bp, Homo sapien
ctctgcagaaacggactcagcagag

SEQ ID NO: 56252 - DNA, 25 bp, Homo sapien
ctctgcagacttcactttccccaaa

SEQ ID NO: 56253 - DNA, 25 bp, Homo sapien
ctctgcaggcttcactttccccaaa

SEQ ID NO: 56254 - DNA, 25 bp, Homo sapien
ctctgcatcttttagactggtggtt

SEQ ID NO: 56255 - DNA, 25 bp, Homo sapien
ctctgcatcttttagattggtggtt

SEQ ID NO: 56256 - DNA, 25 bp, Homo sapien
ctctgcatggtcattatccttttac

SEQ ID NO: 56257 - DNA, 25 bp, Homo sapien
ctctgcatggtcgttatccttttac

SEQ ID NO: 56258 - DNA, 25 bp, Homo sapien
ctctgccaaagttctaagttttcat

SEQ ID NO: 56259 - DNA, 25 bp, Homo sapien
ctctgccaaagttgtaagttttcat

SEQ ID NO: 56260 - DNA, 25 bp, Homo sapien
ctctgccaatttgggatttttagct

SEQ ID NO: 56261 - DNA, 25 bp, Homo sapien
ctctgccacactatatttattcccc

SEQ ID NO: 56262 - DNA, 25 bp, Homo sapien
ctctgccacactatgtttattcccc

SEQ ID NO: 56263 - DNA, 25 bp, Homo sapien
ctctgccagataatgctctaagaaa

SEQ ID NO: 56264 - DNA, 25 bp, Homo sapien
ctctgccagatgatgctctaagaaa

SEQ ID NO: 56265 - DNA, 25 bp, Homo sapien
ctctgccattttgggatttttagct

SEQ ID NO: 56266 - DNA, 25 bp, Homo sapien
ctctgcctatacatgggtccagact

SEQ ID NO: 56267 - DNA, 25 bp, Homo sapien
ctctgcctatacctgggtccagact

SEQ ID NO: 56268 - DNA, 25 bp, Homo sapien
ctctgcctgttacccatttgcaaag

SEQ ID NO: 56269 - DNA, 25 bp, Homo sapien
ctctgcctgtttcccatttgcaaag

SEQ ID NO: 56270 - DNA, 25 bp, Homo sapien
ctctgcctttcaccttcttagtttc

SEQ ID NO: 56271 - DNA, 25 bp, Homo sapien
ctctgcctttcgccttcttagtttc

SEQ ID NO: 56272 - DNA, 25 bp, Homo sapien
ctctgccttttctagtctaaagaca

SEQ ID NO: 56273 - DNA, 25 bp, Homo sapien
ctctgccttttcttgtctaaagaca

SEQ ID NO: 56274 - DNA, 25 bp, Homo sapien
ctctgcgttgacacgaacatcatac

SEQ ID NO: 56275 - DNA, 25 bp, Homo sapien
ctctgcgttgacatgaacatcatac

SEQ ID NO: 56276 - DNA, 25 bp, Homo sapien
ctctgctctgtcaagcttccaaacc

SEQ ID NO: 56277 - DNA, 25 bp, Homo sapien
ctctgctctgtgaagcttccaaacc

SEQ ID NO: 56278 - DNA, 25 bp, Homo sapien
ctctgctcttttctttcgtgatact

SEQ ID NO: 56279 - DNA, 25 bp, Homo sapien
ctctgctcttttcttttgtgatact

SEQ ID NO: 56280 - DNA, 25 bp, Homo sapien
ctctgctgcatataacaagcctgtc

SEQ ID NO: 56281 - DNA, 25 bp, Homo sapien
ctctgctgcatgtaacaagcctgtc

SEQ ID NO: 56282 - DNA, 25 bp, Homo sapien
ctctgctgctctgatgaaggcatgt

SEQ ID NO: 56283 - DNA, 25 bp, Homo sapien
ctctgctgttctgatgaaggcatgt

SEQ ID NO: 56284 - DNA, 25 bp, Homo sapien
ctctgcttaggatggtcttgcttgc

SEQ ID NO: 56285 - DNA, 25 bp, Homo sapien
ctctgcttaggatggttttgcttgc

SEQ ID NO: 56286 - DNA, 25 bp, Homo sapien
ctctgcttcctccctagcagttgca

SEQ ID NO: 56287 - DNA, 25 bp, Homo sapien
ctctgcttcttccctagcagttgca

SEQ ID NO: 56288 - DNA, 25 bp, Homo sapien
ctctgctttgaaattatttatccct

SEQ ID NO: 56289 - DNA, 25 bp, Homo sapien
ctctgctttgaagttatttatccct

SEQ ID NO: 56290 - DNA, 25 bp, Homo sapien
ctctggaaacgattactagttagta

SEQ ID NO: 56291 - DNA, 25 bp, Homo sapien
ctctggaaacggttactagttagta

SEQ ID NO: 56292 - DNA, 25 bp, Homo sapien
ctctggaccggctcactggactcat

SEQ ID NO: 56293 - DNA, 25 bp, Homo sapien
ctctggaccggcttactggactcat

SEQ ID NO: 56294 - DNA, 25 bp, Homo sapien
ctctggagatctggtctttatcaga

SEQ ID NO: 56295 - DNA, 25 bp, Homo sapien
ctctggagatcttgtctttatcaga

SEQ ID NO: 56296 - DNA, 25 bp, Homo sapien
ctctggaggaaaaatcatctttcca

SEQ ID NO: 56297 - DNA, 25 bp, Homo sapien
ctctggaggaaaaatcgtctttcca

SEQ ID NO: 56298 - DNA, 25 bp, Homo sapien
ctctggagtcccagcgcggcaggaa

SEQ ID NO: 56299 - DNA, 25 bp, Homo sapien
ctctggagtcccagtgcggcaggaa

SEQ ID NO: 56300 - DNA, 25 bp, Homo sapien
ctctggatctttatccaccttctcc

SEQ ID NO: 56301 - DNA, 25 bp, Homo sapien
ctctggatctttattcaccttctcc

SEQ ID NO: 56302 - DNA, 25 bp, Homo sapien
ctctggatgactgatatgggttatt

SEQ ID NO: 56303 - DNA, 25 bp, Homo sapien
ctctggatgtctgatatgggttatt

SEQ ID NO: 56304 - DNA, 25 bp, Homo sapien
ctctggcaaaatgggatgagttctc

SEQ ID NO: 56305 - DNA, 25 bp, Homo sapien
ctctggcaagatgggatgagttctc

SEQ ID NO: 56306 - DNA, 25 bp, Homo sapien
ctctggcagctgtggtgtttcattg

SEQ ID NO: 56307 - DNA, 25 bp, Homo sapien
ctctggcatatgaaccatttacttc

SEQ ID NO: 56308 - DNA, 25 bp, Homo sapien
ctctggcatatgaaccgtttacttc

SEQ ID NO: 56309 - DNA, 25 bp, Homo sapien
ctctggcatctgtggtgtttcattg

SEQ ID NO: 56310 - DNA, 25 bp, Homo sapien
ctctggcctactaactgttaccact

SEQ ID NO: 56311 - DNA, 25 bp, Homo sapien
ctctggcctactatctgttaccact

SEQ ID NO: 56312 - DNA, 25 bp, Homo sapien
ctctggcctatagaacagcatgcat

SEQ ID NO: 56313 - DNA, 25 bp, Homo sapien
ctctggcctgtagaacagcatgcat

SEQ ID NO: 56314 - DNA, 25 bp, Homo sapien
ctctggctattctctcgggctgcat

SEQ ID NO: 56315 - DNA, 25 bp, Homo sapien
ctctggctattctctctggctgcat

SEQ ID NO: 56316 - DNA, 25 bp, Homo sapien
ctctggctctctcaattttgaatta

SEQ ID NO: 56317 - DNA, 25 bp, Homo sapien
ctctggctctcttaattttgaatta

SEQ ID NO: 56318 - DNA, 25 bp, Homo sapien
ctctggctgatttgttgcctctttt

SEQ ID NO: 56319 - DNA, 25 bp, Homo sapien
ctctggctgatttgtttcctctttt

SEQ ID NO: 56320 - DNA, 25 bp, Homo sapien
ctctggctgcctttgaaatatatta

SEQ ID NO: 56321 - DNA, 25 bp, Homo sapien
ctctggctgtctttgaaatatatta

SEQ ID NO: 56322 - DNA, 25 bp, Homo sapien
ctctggcttccatgtgcagaataga

SEQ ID NO: 56323 - DNA, 25 bp, Homo sapien
ctctggcttccatgtggagaataga

SEQ ID NO: 56324 - DNA, 25 bp, Homo sapien
ctctgggaccaggagttgtgcagcc

SEQ ID NO: 56325 - DNA, 25 bp, Homo sapien
ctctgggaccaggcgttgtgcagcc

SEQ ID NO: 56326 - DNA, 25 bp, Homo sapien
ctctgggccgtcacccagcaagtgc

SEQ ID NO: 56327 - DNA, 25 bp, Homo sapien
ctctgggctgtcacccagcaagtgc

SEQ ID NO: 56328 - DNA, 25 bp, Homo sapien
ctctgggtccctcagtatcagagtc

SEQ ID NO: 56329 - DNA, 25 bp, Homo sapien
ctctgggtccctgagtatcagagtc

SEQ ID NO: 56330 - DNA, 25 bp, Homo sapien
ctctggtcacacgttcctcaactga

SEQ ID NO: 56331 - DNA, 25 bp, Homo sapien
ctctggtcacatgttcctcaactga

SEQ ID NO: 56332 - DNA, 25 bp, Homo sapien
ctctggtccatgatattgatagtag

SEQ ID NO: 56333 - DNA, 25 bp, Homo sapien
ctctggtccctgatattgatagtag

SEQ ID NO: 56334 - DNA, 25 bp, Homo sapien
ctctggtgccctagcttgtcagcca

SEQ ID NO: 56335 - DNA, 25 bp, Homo sapien
ctctggtgccctagtttgtcagcca

SEQ ID NO: 56336 - DNA, 25 bp, Homo sapien
ctctggttaaatgaaaccttctagc

SEQ ID NO: 56337 - DNA, 25 bp, Homo sapien
ctctggttaaatgaaatcttctagc

SEQ ID NO: 56338 - DNA, 25 bp, Homo sapien
ctctggtttaattatatcgcacaat

SEQ ID NO: 56339 - DNA, 25 bp, Homo sapien
ctctggtttaattgtatcgcacaat

SEQ ID NO: 56340 - DNA, 25 bp, Homo sapien
ctctgtaaatggccaaacaaccata

SEQ ID NO: 56341 - DNA, 25 bp, Homo sapien
ctctgtaaatggtcaaacaaccata

SEQ ID NO: 56342 - DNA, 25 bp, Homo sapien
ctctgtaagagaggctttcatgtag

SEQ ID NO: 56343 - DNA, 25 bp, Homo sapien
ctctgtaagagatgctttcatgtag

SEQ ID NO: 56344 - DNA, 25 bp, Homo sapien
ctctgtaagcctgttttgctcatcc

SEQ ID NO: 56345 - DNA, 25 bp, Homo sapien
ctctgtaagtctgttttgctcatcc

SEQ ID NO: 56346 - DNA, 25 bp, Homo sapien
ctctgtaataacttgcctggtatgg

SEQ ID NO: 56347 - DNA, 25 bp, Homo sapien
ctctgtaataagttgcctggtatgg

SEQ ID NO: 56348 - DNA, 25 bp, Homo sapien
ctctgtacgataccataatggtgga

SEQ ID NO: 56349 - DNA, 25 bp, Homo sapien
ctctgtacgatatcataatggtgga

SEQ ID NO: 56350 - DNA, 25 bp, Homo sapien
ctctgtacttacatgaatttgatta

SEQ ID NO: 56351 - DNA, 25 bp, Homo sapien
ctctgtacttatatgaatttgatta

SEQ ID NO: 56352 - DNA, 25 bp, Homo sapien
ctctgtagatttagaattaaatgat

SEQ ID NO: 56353 - DNA, 25 bp, Homo sapien
ctctgtagattttgaattaaatgat

SEQ ID NO: 56354 - DNA, 25 bp, Homo sapien
ctctgtatactttacttgcctttat

SEQ ID NO: 56355 - DNA, 25 bp, Homo sapien
ctctgtatactttccttgcctttat

SEQ ID NO: 56356 - DNA, 25 bp, Homo sapien
ctctgtcaataacttactaattaga

SEQ ID NO: 56357 - DNA, 25 bp, Homo sapien
ctctgtcagtaacttactaattaga

SEQ ID NO: 56358 - DNA, 25 bp, Homo sapien
ctctgtcagtgttgtgaaaggaaat

SEQ ID NO: 56359 - DNA, 25 bp, Homo sapien
ctctgtcagtgttttgaaaggaaat

SEQ ID NO: 56360 - DNA, 25 bp, Homo sapien
ctctgtctaatgatgcttcaaaaat

SEQ ID NO: 56361 - DNA, 25 bp, Homo sapien
ctctgtctatgctcaacaaatggaa

SEQ ID NO: 56362 - DNA, 25 bp, Homo sapien
ctctgtctatgctcaataaatggaa

SEQ ID NO: 56363 - DNA, 25 bp, Homo sapien
ctctgtctctctaccttttcaccaa

SEQ ID NO: 56364 - DNA, 25 bp, Homo sapien
ctctgtctctctatcttttcaccaa

SEQ ID NO: 56365 - DNA, 25 bp, Homo sapien
ctctgtctgatgatgcttcaaaaat

SEQ ID NO: 56366 - DNA, 25 bp, Homo sapien
ctctgtctgcagatttaaatgttaa

SEQ ID NO: 56367 - DNA, 25 bp, Homo sapien
ctctgtcttcagatttaaatgttaa

SEQ ID NO: 56368 - DNA, 25 bp, Homo sapien
ctctgtgcctaagccactatgaaat

SEQ ID NO: 56369 - DNA, 25 bp, Homo sapien
ctctgtgcctaagcgactatgaaat

SEQ ID NO: 56370 - DNA, 25 bp, Homo sapien
ctctgtgctaaatacgagtggtgat

SEQ ID NO: 56371 - DNA, 25 bp, Homo sapien
ctctgtgctaaataggagtggtgat

SEQ ID NO: 56372 - DNA, 25 bp, Homo sapien
ctctgtggagatgatagcaattcat

SEQ ID NO: 56373 - DNA, 25 bp, Homo sapien
ctctgtggagattatagcaattcat

SEQ ID NO: 56374 - DNA, 25 bp, Homo sapien
ctctgtggcactcattaatagagtc

SEQ ID NO: 56375 - DNA, 25 bp, Homo sapien
ctctgtggcactcatttatagagtc

SEQ ID NO: 56376 - DNA, 25 bp, Homo sapien
ctctgtgggcataggacccgccaag

SEQ ID NO: 56377 - DNA, 25 bp, Homo sapien
ctctgtgggtataggacccgccaag

SEQ ID NO: 56378 - DNA, 25 bp, Homo sapien
ctctgtggtaacggaatgtctgtgt

SEQ ID NO: 56379 - DNA, 25 bp, Homo sapien
ctctgtggtaatggaatgtctgtgt

SEQ ID NO: 56380 - DNA, 25 bp, Homo sapien
ctctgtgtcctgaggaaccttcggt

SEQ ID NO: 56381 - DNA, 25 bp, Homo sapien
ctctgtgtctctaaccgtctgtaga

SEQ ID NO: 56382 - DNA, 25 bp, Homo sapien
ctctgtgtgctgaggaaccttcggt

SEQ ID NO: 56383 - DNA, 25 bp, Homo sapien
ctctgtgtggctggctgcccccact

SEQ ID NO: 56384 - DNA, 25 bp, Homo sapien
ctctgtgttgctggctgcccccact

SEQ ID NO: 56385 - DNA, 25 bp, Homo sapien
ctctgtgtttctaaccgtctgtaga

SEQ ID NO: 56386 - DNA, 25 bp, Homo sapien
ctctgttcaaccagaacagccatga

SEQ ID NO: 56387 - DNA, 25 bp, Homo sapien
ctctgttcacatctgctctctgaat

SEQ ID NO: 56388 - DNA, 25 bp, Homo sapien
ctctgttcacatttgctctctgaat

SEQ ID NO: 56389 - DNA, 25 bp, Homo sapien
ctctgttcagcatgaagtttttgga

SEQ ID NO: 56390 - DNA, 25 bp, Homo sapien
ctctgttcagcgtgaagtttttgga

SEQ ID NO: 56391 - DNA, 25 bp, Homo sapien
ctctgttccaccagaacagccatga

SEQ ID NO: 56392 - DNA, 25 bp, Homo sapien
ctctgttctgctcttaatttttaca

SEQ ID NO: 56393 - DNA, 25 bp, Homo sapien
ctctgttctgctcttattttttaca

SEQ ID NO: 56394 - DNA, 25 bp, Homo sapien
ctctgttgctcaactgcactctctg

SEQ ID NO: 56395 - DNA, 25 bp, Homo sapien
ctctgttgctcgactgcactctctg

SEQ ID NO: 56396 - DNA, 25 bp, Homo sapien
ctctgtttcatcctagtttttttcc

SEQ ID NO: 56397 - DNA, 25 bp, Homo sapien
ctctgtttctgaagaaaatggagct

SEQ ID NO: 56398 - DNA, 25 bp, Homo sapien
ctctgtttctggagaaaatggagct

SEQ ID NO: 56399 - DNA, 25 bp, Homo sapien
ctctgtttcttcctagtttttttcc

SEQ ID NO: 56400 - DNA, 25 bp, Homo sapien
ctctgtttggccgtccatggtggca

SEQ ID NO: 56401 - DNA, 25 bp, Homo sapien
ctctgtttggccgtccgtggtggca

SEQ ID NO: 56402 - DNA, 25 bp, Homo sapien
ctctgtttttatcaggaaagaagat

SEQ ID NO: 56403 - DNA, 25 bp, Homo sapien
ctctgtttttatcgggaaagaagat

SEQ ID NO: 56404 - DNA, 25 bp, Homo sapien
ctcttaaaagcgtccacctgtaaat

SEQ ID NO: 56405 - DNA, 25 bp, Homo sapien
ctcttaaaagcttccacctgtaaat

SEQ ID NO: 56406 - DNA, 25 bp, Homo sapien
ctcttaaattgcgaagttgtcaagt

SEQ ID NO: 56407 - DNA, 25 bp, Homo sapien
ctcttaaattgtgaagttgtcaagt

SEQ ID NO: 56408 - DNA, 25 bp, Homo sapien
ctcttaagatgcagtggcgaaagca

SEQ ID NO: 56409 - DNA, 25 bp, Homo sapien
ctcttaagcaaacgaagaacaataa

SEQ ID NO: 56410 - DNA, 25 bp, Homo sapien
ctcttaagcgcataggaatctctat

SEQ ID NO: 56411 - DNA, 25 bp, Homo sapien
ctcttaagcgcgtaggaatctctat

SEQ ID NO: 56412 - DNA, 25 bp, Homo sapien
ctcttaagctgcagtggcgaaagca

SEQ ID NO: 56413 - DNA, 25 bp, Homo sapien
ctcttaaggaaacgaagaacaataa

SEQ ID NO: 56414 - DNA, 25 bp, Homo sapien
ctcttaagtgaaatatctcttcatg

SEQ ID NO: 56415 - DNA, 25 bp, Homo sapien
ctcttaagtgaaatgtctcttcatg

SEQ ID NO: 56416 - DNA, 25 bp, Homo sapien
ctcttaatcaaactgacagaaacta

SEQ ID NO: 56417 - DNA, 25 bp, Homo sapien
ctcttaatcaaattgacagaaacta

SEQ ID NO: 56418 - DNA, 25 bp, Homo sapien
ctcttaatgcagcaatctcaggctt

SEQ ID NO: 56419 - DNA, 25 bp, Homo sapien
ctcttaatgcagcgatctcaggctt

SEQ ID NO: 56420 - DNA, 25 bp, Homo sapien
ctcttacactatactgtctcccgtg

SEQ ID NO: 56421 - DNA, 25 bp, Homo sapien
ctcttacactatgctgtctcccgtg

SEQ ID NO: 56422 - DNA, 25 bp, Homo sapien
ctcttacctttgacgtcagaggcca

SEQ ID NO: 56423 - DNA, 25 bp, Homo sapien
ctcttacctttgatgtcagaggcca

SEQ ID NO: 56424 - DNA, 25 bp, Homo sapien
ctcttagaaccataataatgcttcg

SEQ ID NO: 56425 - DNA, 25 bp, Homo sapien
ctcttagaaccgtaataatgcttcg

SEQ ID NO: 56426 - DNA, 25 bp, Homo sapien
ctcttagactcaggaaattattgtc

SEQ ID NO: 56427 - DNA, 25 bp, Homo sapien
ctcttagattcaggaaattattgtc

SEQ ID NO: 56428 - DNA, 25 bp, Homo sapien
ctcttagttccaagaaccgtagtaa

SEQ ID NO: 56429 - DNA, 25 bp, Homo sapien
ctcttagttcttcgacctctctgac

SEQ ID NO: 56430 - DNA, 25 bp, Homo sapien
ctcttagttctttgacctctctgac

SEQ ID NO: 56431 - DNA, 25 bp, Homo sapien
ctcttagtttcaagaaccgtagtaa

SEQ ID NO: 56432 - DNA, 25 bp, Homo sapien
ctcttagtttttgctgctgcttaga

SEQ ID NO: 56433 - DNA, 25 bp, Homo sapien
ctcttagtttttggtgctgcttaga

SEQ ID NO: 56434 - DNA, 25 bp, Homo sapien
ctcttataacacaactatgtaatat

SEQ ID NO: 56435 - DNA, 25 bp, Homo sapien
ctcttataacacaattatgtaatat

SEQ ID NO: 56436 - DNA, 25 bp, Homo sapien
ctcttataaggaaacttgtaattgc

SEQ ID NO: 56437 - DNA, 25 bp, Homo sapien
ctcttataaggaaccttgtaattgc

SEQ ID NO: 56438 - DNA, 25 bp, Homo sapien
ctcttatagttccaaaggccagaaa

SEQ ID NO: 56439 - DNA, 25 bp, Homo sapien
ctcttatagttccgaaggccagaaa

SEQ ID NO: 56440 - DNA, 25 bp, Homo sapien
ctcttatgaaaaggcatgtgattac

SEQ ID NO: 56441 - DNA, 25 bp, Homo sapien
ctcttatgaaaagtcatgtgattac

SEQ ID NO: 56442 - DNA, 25 bp, Homo sapien
ctcttatgggaatctagtcaggact

SEQ ID NO: 56443 - DNA, 25 bp, Homo sapien
ctcttatgggaatctattcaggact

SEQ ID NO: 56444 - DNA, 25 bp, Homo sapien
ctcttatgtcagcctatttaactgt

SEQ ID NO: 56445 - DNA, 25 bp, Homo sapien
ctcttatgtcatcctatttaactgt

SEQ ID NO: 56446 - DNA, 25 bp, Homo sapien
ctcttattgcaaaattctattgccc

SEQ ID NO: 56447 - DNA, 25 bp, Homo sapien
ctcttattgctttttcatgggaatg

SEQ ID NO: 56448 - DNA, 25 bp, Homo sapien
ctcttattgctttttcgtgggaatg

SEQ ID NO: 56449 - DNA, 25 bp, Homo sapien
ctcttatttcaaaattctattgccc

SEQ ID NO: 56450 - DNA, 25 bp, Homo sapien
ctcttcacaaacgtggggtagagcc

SEQ ID NO: 56451 - DNA, 25 bp, Homo sapien
ctcttcacaaatgtggggtagagcc

SEQ ID NO: 56452 - DNA, 25 bp, Homo sapien
ctcttcacaacatccaaacaggtga

SEQ ID NO: 56453 - DNA, 25 bp, Homo sapien
ctcttcacaacatccatacaggtga

SEQ ID NO: 56454 - DNA, 25 bp, Homo sapien
ctcttcacgtataggtttcatcagt

SEQ ID NO: 56455 - DNA, 25 bp, Homo sapien
ctcttcacgtatatgtttcatcagt

SEQ ID NO: 56456 - DNA, 25 bp, Homo sapien
ctcttcatgcatctttaattcaatt

SEQ ID NO: 56457 - DNA, 25 bp, Homo sapien
ctcttcatgcccataaggctgatcc

SEQ ID NO: 56458 - DNA, 25 bp, Homo sapien
ctcttcatgcctataaggctgatcc

SEQ ID NO: 56459 - DNA, 25 bp, Homo sapien
ctcttcatggatctttaattcaatt

SEQ ID NO: 56460 - DNA, 25 bp, Homo sapien
ctcttcattgtcaaaactacctcag

SEQ ID NO: 56461 - DNA, 25 bp, Homo sapien
ctcttcattttcaaaactacctcag

SEQ ID NO: 56462 - DNA, 25 bp, Homo sapien
ctcttccaaggttccgtgcaccaaa

SEQ ID NO: 56463 - DNA, 25 bp, Homo sapien
ctcttccaaggttctgtgcaccaaa

SEQ ID NO: 56464 - DNA, 25 bp, Homo sapien
ctcttccaatcctccaggttctcat

SEQ ID NO: 56465 - DNA, 25 bp, Homo sapien
ctcttccaatcctctaggttctcat

SEQ ID NO: 56466 - DNA, 25 bp, Homo sapien
ctcttccagagaatataagaaggat

SEQ ID NO: 56467 - DNA, 25 bp, Homo sapien
ctcttccagagactataagaaggat

SEQ ID NO: 56468 - DNA, 25 bp, Homo sapien
ctcttccctcgcaatggtgtcttta

SEQ ID NO: 56469 - DNA, 25 bp, Homo sapien
ctcttccctcggaatggtgtcttta

SEQ ID NO: 56470 - DNA, 25 bp, Homo sapien
ctcttcctaacaaagcatccaatct

SEQ ID NO: 56471 - DNA, 25 bp, Homo sapien
ctcttcctatcaaagcatccaatct

SEQ ID NO: 56472 - DNA, 25 bp, Homo sapien
ctcttcgaaaagattaagtgcatga

SEQ ID NO: 56473 - DNA, 25 bp, Homo sapien
ctcttcgaaaatattaagtgcatga

SEQ ID NO: 56474 - DNA, 25 bp, Homo sapien
ctcttctaaagcatgcatacactca

SEQ ID NO: 56475 - DNA, 25 bp, Homo sapien
ctcttctaaagcatgcgtacactca

SEQ ID NO: 56476 - DNA, 25 bp, Homo sapien
ctcttctacgactaatcctacactt

SEQ ID NO: 56477 - DNA, 25 bp, Homo sapien
ctcttctatatctaaagtacaaaag

SEQ ID NO: 56478 - DNA, 25 bp, Homo sapien
ctcttctatatcttaagtacaaaag

SEQ ID NO: 56479 - DNA, 25 bp, Homo sapien
ctcttctatgactaatcctacactt

SEQ ID NO: 56480 - DNA, 25 bp, Homo sapien
ctcttctattcacgcacttcaggaa

SEQ ID NO: 56481 - DNA, 25 bp, Homo sapien
ctcttctattcatgcacttcaggaa

SEQ ID NO: 56482 - DNA, 25 bp, Homo sapien
ctcttctcaaaagtacctggcatag

SEQ ID NO: 56483 - DNA, 25 bp, Homo sapien
ctcttctcacctacaagaatttata

SEQ ID NO: 56484 - DNA, 25 bp, Homo sapien
ctcttctcacctgcaagaatttata

SEQ ID NO: 56485 - DNA, 25 bp, Homo sapien
ctcttctcagtctggacgtaggagt

SEQ ID NO: 56486 - DNA, 25 bp, Homo sapien
ctcttctcagtctggatgtaggagt

SEQ ID NO: 56487 - DNA, 25 bp, Homo sapien
ctcttctccaaagtacctggcatag

SEQ ID NO: 56488 - DNA, 25 bp, Homo sapien
ctcttctgtcataatttggacctta

SEQ ID NO: 56489 - DNA, 25 bp, Homo sapien
ctcttctgtcatgatttggacctta

SEQ ID NO: 56490 - DNA, 25 bp, Homo sapien
ctcttctgtcccatttctacgggca

SEQ ID NO: 56491 - DNA, 25 bp, Homo sapien
ctcttctgtcccgtttctacgggca

SEQ ID NO: 56492 - DNA, 25 bp, Homo sapien
ctcttctgtttcactggacatacaa

SEQ ID NO: 56493 - DNA, 25 bp, Homo sapien
ctcttctgtttcagtggacatacaa

SEQ ID NO: 56494 - DNA, 25 bp, Homo sapien
ctcttcttacatttgcagtgtgccc

SEQ ID NO: 56495 - DNA, 25 bp, Homo sapien
ctcttcttacattttcagtgtgccc

SEQ ID NO: 56496 - DNA, 25 bp, Homo sapien
ctcttcttagaaacgtcagaattgc

SEQ ID NO: 56497 - DNA, 25 bp, Homo sapien
ctcttcttagaaatgtcagaattgc

SEQ ID NO: 56498 - DNA, 25 bp, Homo sapien
ctcttcttagatgagacccaatgca

SEQ ID NO: 56499 - DNA, 25 bp, Homo sapien
ctcttcttcaaggataacatccctt

SEQ ID NO: 56500 - DNA, 25 bp, Homo sapien
ctcttcttcaaggatagcatccctt

SEQ ID NO: 56501 - DNA, 25 bp, Homo sapien
ctcttcttcacaactgttggaccgt

SEQ ID NO: 56502 - DNA, 25 bp, Homo sapien
ctcttcttcacagctgttggaccgt

SEQ ID NO: 56503 - DNA, 25 bp, Homo sapien
ctcttcttcattagaactgttctag

SEQ ID NO: 56504 - DNA, 25 bp, Homo sapien
ctcttcttcctcatcaatgagcaca

SEQ ID NO: 56505 - DNA, 25 bp, Homo sapien
ctcttcttcctcatcagtgagcaca

SEQ ID NO: 56506 - DNA, 25 bp, Homo sapien
ctcttcttcgatgagacccaatgca

SEQ ID NO: 56507 - DNA, 25 bp, Homo sapien
ctcttcttcgttagaactgttctag

SEQ ID NO: 56508 - DNA, 25 bp, Homo sapien
ctcttcttgctaaagtctgtacagt

SEQ ID NO: 56509 - DNA, 25 bp, Homo sapien
ctcttcttgctaatgtctgtacagt

SEQ ID NO: 56510 - DNA, 25 bp, Homo sapien
ctcttcttgctattgtcagacaaca

SEQ ID NO: 56511 - DNA, 25 bp, Homo sapien
ctcttcttgctgttgtcagacaaca

SEQ ID NO: 56512 - DNA, 25 bp, Homo sapien
ctcttctttgtagatgggagaccct

SEQ ID NO: 56513 - DNA, 25 bp, Homo sapien
ctcttctttgtagttgggagaccct

SEQ ID NO: 56514 - DNA, 25 bp, Homo sapien
ctcttcttttacatgtcatcttaga

SEQ ID NO: 56515 - DNA, 25 bp, Homo sapien
ctcttcttttacgtgtcatcttaga

SEQ ID NO: 56516 - DNA, 25 bp, Homo sapien
ctcttgaaactttctatttagtcgt

SEQ ID NO: 56517 - DNA, 25 bp, Homo sapien
ctcttgaaactttgtatttagtcgt

SEQ ID NO: 56518 - DNA, 25 bp, Homo sapien
ctcttgagaagacacagcaggggat

SEQ ID NO: 56519 - DNA, 25 bp, Homo sapien
ctcttgagaagacgcagcaggggat

SEQ ID NO: 56520 - DNA, 25 bp, Homo sapien
ctcttgaggagtttgcagtcaaaaa

SEQ ID NO: 56521 - DNA, 25 bp, Homo sapien
ctcttgaggagtttgccgtcaaaaa

SEQ ID NO: 56522 - DNA, 25 bp, Homo sapien
ctcttgagtctatccttgtctctgt

SEQ ID NO: 56523 - DNA, 25 bp, Homo sapien
ctcttgagtctattcttgtctctgt

SEQ ID NO: 56524 - DNA, 25 bp, Homo sapien
ctcttgatcatatcacagattgcct

SEQ ID NO: 56525 - DNA, 25 bp, Homo sapien
ctcttgatcgtatcacagattgcct

SEQ ID NO: 56526 - DNA, 25 bp, Homo sapien
ctcttgatgagagaagctgtaaagt

SEQ ID NO: 56527 - DNA, 25 bp, Homo sapien
ctcttgatgggagaagctgtaaagt

SEQ ID NO: 56528 - DNA, 25 bp, Homo sapien
ctcttgcacccagttcacacagact

SEQ ID NO: 56529 - DNA, 25 bp, Homo sapien
ctcttgcactcagttcacacagact

SEQ ID NO: 56530 - DNA, 25 bp, Homo sapien
ctcttgcagaagacaatggatatcg

SEQ ID NO: 56531 - DNA, 25 bp, Homo sapien
ctcttgcagaaggcaatggatatcg

SEQ ID NO: 56532 - DNA, 25 bp, Homo sapien
ctcttgcattttctccaatgaaaag

SEQ ID NO: 56533 - DNA, 25 bp, Homo sapien
ctcttgcattttcttcaatgaaaag

SEQ ID NO: 56534 - DNA, 25 bp, Homo sapien
ctcttgccaaggttgatggatatat

SEQ ID NO: 56535 - DNA, 25 bp, Homo sapien
ctcttgccaagtttgatggatatat

SEQ ID NO: 56536 - DNA, 25 bp, Homo sapien
ctcttgcctcactcgacctccaaag

SEQ ID NO: 56537 - DNA, 25 bp, Homo sapien
ctcttgcctcattcgacctccaaag

SEQ ID NO: 56538 - DNA, 25 bp, Homo sapien
ctcttgcctctctctgactctccat

SEQ ID NO: 56539 - DNA, 25 bp, Homo sapien
ctcttgcctctgtctgactctccat

SEQ ID NO: 56540 - DNA, 25 bp, Homo sapien
ctcttgccttcatctttcattgtaa

SEQ ID NO: 56541 - DNA, 25 bp, Homo sapien
ctcttgccttcctctttcattgtaa

SEQ ID NO: 56542 - DNA, 25 bp, Homo sapien
ctcttgctccctactgccttgtgct

SEQ ID NO: 56543 - DNA, 25 bp, Homo sapien
ctcttgctccctcctgccttgtgct

SEQ ID NO: 56544 - DNA, 25 bp, Homo sapien
ctcttgctttcctgaaatcaatcag

SEQ ID NO: 56545 - DNA, 25 bp, Homo sapien
ctcttgctttcctgaagtcaatcag

SEQ ID NO: 56546 - DNA, 25 bp, Homo sapien
ctcttggaacttgttcttattagac

SEQ ID NO: 56547 - DNA, 25 bp, Homo sapien
ctcttggaactttttcttattagac

SEQ ID NO: 56548 - DNA, 25 bp, Homo sapien
ctcttggacagcagaacgttaatcg

SEQ ID NO: 56549 - DNA, 25 bp, Homo sapien
ctcttggacagcagaatgttaatcg

SEQ ID NO: 56550 - DNA, 25 bp, Homo sapien
ctcttggagtaaacgatttttgcag

SEQ ID NO: 56551 - DNA, 25 bp, Homo sapien
ctcttggagtaaatgatttttgcag

SEQ ID NO: 56552 - DNA, 25 bp, Homo sapien
ctcttggattcaccaagcactcatc

SEQ ID NO: 56553 - DNA, 25 bp, Homo sapien
ctcttggattcgccaagcactcatc

SEQ ID NO: 56554 - DNA, 25 bp, Homo sapien
ctcttggcacacaaaaatagtttac

SEQ ID NO: 56555 - DNA, 25 bp, Homo sapien
ctcttggcacacagaaatagtttac

SEQ ID NO: 56556 - DNA, 25 bp, Homo sapien
ctcttggccgtagaagagcatgctt

SEQ ID NO: 56557 - DNA, 25 bp, Homo sapien
ctcttggcctcaacctgtcctggcc

SEQ ID NO: 56558 - DNA, 25 bp, Homo sapien
ctcttggctgtagaagagcatgctt

SEQ ID NO: 56559 - DNA, 25 bp, Homo sapien
ctcttggcttcaacctgtcctggcc

SEQ ID NO: 56560 - DNA, 25 bp, Homo sapien
ctcttgggacactgacagccagact

SEQ ID NO: 56561 - DNA, 25 bp, Homo sapien
ctcttgggacactgacggccagact

SEQ ID NO: 56562 - DNA, 25 bp, Homo sapien
ctcttggggtatcaatgagagaaga

SEQ ID NO: 56563 - DNA, 25 bp, Homo sapien
ctcttggggtatcagtgagagaaga

SEQ ID NO: 56564 - DNA, 25 bp, Homo sapien
ctcttgggttcatgacagtggctag

SEQ ID NO: 56565 - DNA, 25 bp, Homo sapien
ctcttgggttcatgaccgtggctag

SEQ ID NO: 56566 - DNA, 25 bp, Homo sapien
ctcttggtgggacgaaagaagcttg

SEQ ID NO: 56567 - DNA, 25 bp, Homo sapien
ctcttggtgggacgaatgaagcttg

SEQ ID NO: 56568 - DNA, 25 bp, Homo sapien
ctcttgtagacagtccagatcctgt

SEQ ID NO: 56569 - DNA, 25 bp, Homo sapien
ctcttgtagactgtccagatcctgt

SEQ ID NO: 56570 - DNA, 25 bp, Homo sapien
ctcttgtattcattgaatggctatt

SEQ ID NO: 56571 - DNA, 25 bp, Homo sapien
ctcttgtattcattgagtggctatt

SEQ ID NO: 56572 - DNA, 25 bp, Homo sapien
ctcttgtcattcaggttaaagagaa

SEQ ID NO: 56573 - DNA, 25 bp, Homo sapien
ctcttgtcattcagtttaaagagaa

SEQ ID NO: 56574 - DNA, 25 bp, Homo sapien
ctcttgtcctcaagatttcaaaagc

SEQ ID NO: 56575 - DNA, 25 bp, Homo sapien
ctcttgtcctcaaggtttcaaaagc

SEQ ID NO: 56576 - DNA, 25 bp, Homo sapien
ctcttgtgcccttctgcgttttgct

SEQ ID NO: 56577 - DNA, 25 bp, Homo sapien
ctcttgtgcccttctgtgttttgct

SEQ ID NO: 56578 - DNA, 25 bp, Homo sapien
ctcttgtgttcgccatctaccgcag

SEQ ID NO: 56579 - DNA, 25 bp, Homo sapien
ctcttgtgttcggcatctaccgcag

SEQ ID NO: 56580 - DNA, 25 bp, Homo sapien
ctctttaagttaagtggtattacct

SEQ ID NO: 56581 - DNA, 25 bp, Homo sapien
ctctttaagttaggtggtattacct

SEQ ID NO: 56582 - DNA, 25 bp, Homo sapien
ctctttactatccattactttttaa

SEQ ID NO: 56583 - DNA, 25 bp, Homo sapien
ctctttactatcccttactttttaa

SEQ ID NO: 56584 - DNA, 25 bp, Homo sapien
ctctttactttcatctatgtcatgg

SEQ ID NO: 56585 - DNA, 25 bp, Homo sapien
ctctttactttcatttatgtcatgg

SEQ ID NO: 56586 - DNA, 25 bp, Homo sapien
ctctttagtacaaattttattggct

SEQ ID NO: 56587 - DNA, 25 bp, Homo sapien
ctctttagtacaacttttattggct

SEQ ID NO: 56588 - DNA, 25 bp, Homo sapien
ctctttatgctctcacatgctgcat

SEQ ID NO: 56589 - DNA, 25 bp, Homo sapien
ctctttatgctgtcacatgctgcat

SEQ ID NO: 56590 - DNA, 25 bp, Homo sapien
ctctttcacgcatttgttagctact

SEQ ID NO: 56591 - DNA, 25 bp, Homo sapien
ctctttcatgaccgaggctccatca

SEQ ID NO: 56592 - DNA, 25 bp, Homo sapien
ctctttcatgactgaggctccatca

SEQ ID NO: 56593 - DNA, 25 bp, Homo sapien
ctctttcatgcatttgttagctact

SEQ ID NO: 56594 - DNA, 25 bp, Homo sapien
ctctttcccttctaagcaccctggt

SEQ ID NO: 56595 - DNA, 25 bp, Homo sapien
ctctttcccttctaaggaccctggt

SEQ ID NO: 56596 - DNA, 25 bp, Homo sapien
ctctttcgtcaattggaggtattta

SEQ ID NO: 56597 - DNA, 25 bp, Homo sapien
ctctttcgtcagttggaggtattta

SEQ ID NO: 56598 - DNA, 25 bp, Homo sapien
ctctttctactgtggatgaaggaag

SEQ ID NO: 56599 - DNA, 25 bp, Homo sapien
ctctttctattgtggatgaaggaag

SEQ ID NO: 56600 - DNA, 25 bp, Homo sapien
ctctttctcgccgctagtgttctga

SEQ ID NO: 56601 - DNA, 25 bp, Homo sapien
ctctttctcgctgctagtgttctga

SEQ ID NO: 56602 - DNA, 25 bp, Homo sapien
ctctttctgaaacatgtatctggct

SEQ ID NO: 56603 - DNA, 25 bp, Homo sapien
ctctttctggaacatgtatctggct

SEQ ID NO: 56604 - DNA, 25 bp, Homo sapien
ctctttcttacgttaaacacctaat

SEQ ID NO: 56605 - DNA, 25 bp, Homo sapien
ctctttcttacgttaatcacctaat

SEQ ID NO: 56606 - DNA, 25 bp, Homo sapien
ctctttgagtgaagacataagatct

SEQ ID NO: 56607 - DNA, 25 bp, Homo sapien
ctctttgagtgaagacgtaagatct

SEQ ID NO: 56608 - DNA, 25 bp, Homo sapien
ctctttgcacattgtctcatatctc

SEQ ID NO: 56609 - DNA, 25 bp, Homo sapien
ctctttgcaccactatcacatcacc

SEQ ID NO: 56610 - DNA, 25 bp, Homo sapien
ctctttgcaccgctatcacatcacc

SEQ ID NO: 56611 - DNA, 25 bp, Homo sapien
ctctttgcagattgtctcatatctc

SEQ ID NO: 56612 - DNA, 25 bp, Homo sapien
ctctttgctctgttatttatttatc

SEQ ID NO: 56613 - DNA, 25 bp, Homo sapien
ctctttgctgtgttatttatttatc

SEQ ID NO: 56614 - DNA, 25 bp, Homo sapien
ctctttggaccaaacttcctccttc

SEQ ID NO: 56615 - DNA, 25 bp, Homo sapien
ctctttggaccaaccttcctccttc

SEQ ID NO: 56616 - DNA, 25 bp, Homo sapien
ctctttggacttcagaagcaatcct

SEQ ID NO: 56617 - DNA, 25 bp, Homo sapien
ctctttggactttagaagcaatcct

SEQ ID NO: 56618 - DNA, 25 bp, Homo sapien
ctctttggataacgacagtgactaa

SEQ ID NO: 56619 - DNA, 25 bp, Homo sapien
ctctttggataatgacagtgactaa

SEQ ID NO: 56620 - DNA, 25 bp, Homo sapien
ctctttggatatcaaggtctggtag

SEQ ID NO: 56621 - DNA, 25 bp, Homo sapien
ctctttgggtatcaaggtctggtag

SEQ ID NO: 56622 - DNA, 25 bp, Homo sapien
ctctttggtgccaggaaccaaacca

SEQ ID NO: 56623 - DNA, 25 bp, Homo sapien
ctctttggtgccaggatccaaacca

SEQ ID NO: 56624 - DNA, 25 bp, Homo sapien
ctctttggttacatgaactgacttt

SEQ ID NO: 56625 - DNA, 25 bp, Homo sapien
ctctttggttacattaactgacttt

SEQ ID NO: 56626 - DNA, 25 bp, Homo sapien
ctctttggtttcaagaacattgaat

SEQ ID NO: 56627 - DNA, 25 bp, Homo sapien
ctctttggtttcaagaccattgaat

SEQ ID NO: 56628 - DNA, 25 bp, Homo sapien
ctctttgtacaacaaattacagggt

SEQ ID NO: 56629 - DNA, 25 bp, Homo sapien
ctctttgtacaataaattacagggt

SEQ ID NO: 56630 - DNA, 25 bp, Homo sapien
ctctttgtttcctttttagacatac

SEQ ID NO: 56631 - DNA, 25 bp, Homo sapien
ctctttgtttcttttttagacatac

SEQ ID NO: 56632 - DNA, 25 bp, Homo sapien
ctcttttagcagccctattccagaa

SEQ ID NO: 56633 - DNA, 25 bp, Homo sapien
ctcttttagcagctctattccagaa

SEQ ID NO: 56634 - DNA, 25 bp, Homo sapien
ctcttttattaccagtgaatagtgt

SEQ ID NO: 56635 - DNA, 25 bp, Homo sapien
ctcttttattatcagtgaatagtgt

SEQ ID NO: 56636 - DNA, 25 bp, Homo sapien
ctcttttcaacaactagttctcatg

SEQ ID NO: 56637 - DNA, 25 bp, Homo sapien
ctcttttcagcaactagttctcatg

SEQ ID NO: 56638 - DNA, 25 bp, Homo sapien
ctcttttcattttgctaagtttgtt

SEQ ID NO: 56639 - DNA, 25 bp, Homo sapien
ctcttttcattttggtaagtttgtt

SEQ ID NO: 56640 - DNA, 25 bp, Homo sapien
ctcttttcctacttcctctaagtag

SEQ ID NO: 56641 - DNA, 25 bp, Homo sapien
ctcttttcctatttcctctaagtag

SEQ ID NO: 56642 - DNA, 25 bp, Homo sapien
ctcttttcctccagccaacaacccc

SEQ ID NO: 56643 - DNA, 25 bp, Homo sapien
ctcttttcctccggccaacaacccc

SEQ ID NO: 56644 - DNA, 25 bp, Homo sapien
ctcttttctttcgtgatacttatct

SEQ ID NO: 56645 - DNA, 25 bp, Homo sapien
ctcttttcttttgtgatacttatct

SEQ ID NO: 56646 - DNA, 25 bp, Homo sapien
ctcttttgaacatacaattcggtga

SEQ ID NO: 56647 - DNA, 25 bp, Homo sapien
ctcttttgaacgtacaattcggtga

SEQ ID NO: 56648 - DNA, 25 bp, Homo sapien
ctcttttgagctagtttttatatcc

SEQ ID NO: 56649 - DNA, 25 bp, Homo sapien
ctcttttgagcttgtttttatatcc

SEQ ID NO: 56650 - DNA, 25 bp, Homo sapien
ctcttttgtactcagctggtcataa

SEQ ID NO: 56651 - DNA, 25 bp, Homo sapien
ctcttttgtactctgctggtcataa

SEQ ID NO: 56652 - DNA, 25 bp, Homo sapien
ctcttttgtcagacagcatgttctt

SEQ ID NO: 56653 - DNA, 25 bp, Homo sapien
ctcttttgtcaggcagcatgttctt

SEQ ID NO: 56654 - DNA, 25 bp, Homo sapien
ctcttttgtctaggcacattgtccc

SEQ ID NO: 56655 - DNA, 25 bp, Homo sapien
ctcttttgtctagtcacattgtccc

SEQ ID NO: 56656 - DNA, 25 bp, Homo sapien
ctcttttgttttttcatgactgcgt

SEQ ID NO: 56657 - DNA, 25 bp, Homo sapien
ctcttttgtttttttatgactgcgt

SEQ ID NO: 56658 - DNA, 25 bp, Homo sapien
ctctttttactgaggtatactgtgg

SEQ ID NO: 56659 - DNA, 25 bp, Homo sapien
ctctttttagtgaggtatactgtgg

SEQ ID NO: 56660 - DNA, 25 bp, Homo sapien
ctctttttagtgtggtcatctagct

SEQ ID NO: 56661 - DNA, 25 bp, Homo sapien
ctctttttagtgtggttatctagct

SEQ ID NO: 56662 - DNA, 25 bp, Homo sapien
ctctttttcaattaaaacctgaatt

SEQ ID NO: 56663 - DNA, 25 bp, Homo sapien
ctctttttcccatacttcatcccag

SEQ ID NO: 56664 - DNA, 25 bp, Homo sapien
ctctttttcccgtacttcatcccag

SEQ ID NO: 56665 - DNA, 25 bp, Homo sapien
ctctttttcgattaaaacctgaatt

SEQ ID NO: 56666 - DNA, 25 bp, Homo sapien
ctcttttttttgaacaactaccttt

SEQ ID NO: 56667 - DNA, 25 bp, Homo sapien
ctcttttttttgagcaactaccttt

SEQ ID NO: 56668 - DNA, 25 bp, Homo sapien
ctgaaaaaaagtcctgaaattgcta

SEQ ID NO: 56669 - DNA, 25 bp, Homo sapien
ctgaaaaaataatacgagccagaag

SEQ ID NO: 56670 - DNA, 25 bp, Homo sapien
ctgaaaaaataatatgagccagaag

SEQ ID NO: 56671 - DNA, 25 bp, Homo sapien
ctgaaaaaatgtcctgaaattgcta

SEQ ID NO: 56672 - DNA, 25 bp, Homo sapien
ctgaaaaaccaactgtttgcttcac

SEQ ID NO: 56673 - DNA, 25 bp, Homo sapien
ctgaaaaaccaactttttgcttcac

SEQ ID NO: 56674 - DNA, 25 bp, Homo sapien
ctgaaaaatataaaaagtgttgtgg

SEQ ID NO: 56675 - DNA, 25 bp, Homo sapien
ctgaaaaatctaaaaagtgttgtgg

SEQ ID NO: 56676 - DNA, 25 bp, Homo sapien
ctgaaaacaaagtttcagcatcact

SEQ ID NO: 56677 - DNA, 25 bp, Homo sapien
ctgaaaacaaagtttcggcatcact

SEQ ID NO: 56678 - DNA, 25 bp, Homo sapien
ctgaaaacggaactgaaagtgaaaa

SEQ ID NO: 56679 - DNA, 25 bp, Homo sapien
ctgaaaactgaactgaaagtgaaaa

SEQ ID NO: 56680 - DNA, 25 bp, Homo sapien
ctgaaaactggcctggattgacaag

SEQ ID NO: 56681 - DNA, 25 bp, Homo sapien
ctgaaaactggcctgggttgacaag

SEQ ID NO: 56682 - DNA, 25 bp, Homo sapien
ctgaaaagaaactaagcacgtgcac

SEQ ID NO: 56683 - DNA, 25 bp, Homo sapien
ctgaaaagatactaagcacgtgcac

SEQ ID NO: 56684 - DNA, 25 bp, Homo sapien
ctgaaaagctgcaggaccttgaatt

SEQ ID NO: 56685 - DNA, 25 bp, Homo sapien
ctgaaaagctgcgggaccttgaatt

SEQ ID NO: 56686 - DNA, 25 bp, Homo sapien
ctgaaaaggccagagaaaaatgtga

SEQ ID NO: 56687 - DNA, 25 bp, Homo sapien
ctgaaaaggccagagacaaatgtga

SEQ ID NO: 56688 - DNA, 25 bp, Homo sapien
ctgaaaataatcatcatctccaaaa

SEQ ID NO: 56689 - DNA, 25 bp, Homo sapien
ctgaaaatagtcatcatctccaaaa

SEQ ID NO: 56690 - DNA, 25 bp, Homo sapien
ctgaaaatcttgacagaaaaacctc

SEQ ID NO: 56691 - DNA, 25 bp, Homo sapien
ctgaaaatcttgacaggaaaacctc

SEQ ID NO: 56692 - DNA, 25 bp, Homo sapien
ctgaaaatggagaaagaaaccatga

SEQ ID NO: 56693 - DNA, 25 bp, Homo sapien
ctgaaaatggagaaaggaaccatga

SEQ ID NO: 56694 - DNA, 25 bp, Homo sapien
ctgaaaatgttcctatctacttttt

SEQ ID NO: 56695 - DNA, 25 bp, Homo sapien
ctgaaaatgtttctatctacttttt

SEQ ID NO: 56696 - DNA, 25 bp, Homo sapien
ctgaaacatcgctaaaatgattttc

SEQ ID NO: 56697 - DNA, 25 bp, Homo sapien
ctgaaacatcgttaaaatgattttc

SEQ ID NO: 56698 - DNA, 25 bp, Homo sapien
ctgaaacggacaacgaactggaaga

SEQ ID NO: 56699 - DNA, 25 bp, Homo sapien
ctgaaacggacaaggaactggaaga

SEQ ID NO: 56700 - DNA, 25 bp, Homo sapien
ctgaaactaagttgttctctaacat

SEQ ID NO: 56701 - DNA, 25 bp, Homo sapien
ctgaaactaagttgttgtctaacat

SEQ ID NO: 56702 - DNA, 25 bp, Homo sapien
ctgaaagacctcatatttctgcagg

SEQ ID NO: 56703 - DNA, 25 bp, Homo sapien
ctgaaagaccttatatttctgcagg

SEQ ID NO: 56704 - DNA, 25 bp, Homo sapien
ctgaaagagacagtgctatctggcc

SEQ ID NO: 56705 - DNA, 25 bp, Homo sapien
ctgaaagagacggtgctatctggcc

SEQ ID NO: 56706 - DNA, 25 bp, Homo sapien
ctgaaagagctaagagttacctcaa

SEQ ID NO: 56707 - DNA, 25 bp, Homo sapien
ctgaaagagctaatagttacctcaa

SEQ ID NO: 56708 - DNA, 25 bp, Homo sapien
ctgaaagcatcccttacgttctttt

SEQ ID NO: 56709 - DNA, 25 bp, Homo sapien
ctgaaagcatcccttatgttctttt

SEQ ID NO: 56710 - DNA, 25 bp, Homo sapien
ctgaaaggaaggaaagctttagtca

SEQ ID NO: 56711 - DNA, 25 bp, Homo sapien
ctgaaaggtaggaaagctttagtca

SEQ ID NO: 56712 - DNA, 25 bp, Homo sapien
ctgaaagtaagagtggcctcagtaa

SEQ ID NO: 56713 - DNA, 25 bp, Homo sapien
ctgaaagtaggagtggcctcagtaa

SEQ ID NO: 56714 - DNA, 25 bp, Homo sapien
ctgaaagtcaccagttaccagagct

SEQ ID NO: 56715 - DNA, 25 bp, Homo sapien
ctgaaagtcaccagttgccagagct

SEQ ID NO: 56716 - DNA, 25 bp, Homo sapien
ctgaaagtgtaaacacgagtcccag

SEQ ID NO: 56717 - DNA, 25 bp, Homo sapien
ctgaaagtgtaaagacgagtcccag

SEQ ID NO: 56718 - DNA, 25 bp, Homo sapien
ctgaaagttatcgccaatagccagt

SEQ ID NO: 56719 - DNA, 25 bp, Homo sapien
ctgaaagttattgccaatagccagt

SEQ ID NO: 56720 - DNA, 25 bp, Homo sapien
ctgaaataaaaatctcaatgaatgg

SEQ ID NO: 56721 - DNA, 25 bp, Homo sapien
ctgaaataaaactctcaatgaatgg

SEQ ID NO: 56722 - DNA, 25 bp, Homo sapien
ctgaaataacgcaactacaaaccaa

SEQ ID NO: 56723 - DNA, 25 bp, Homo sapien
ctgaaataacgcatctacaaaccaa

SEQ ID NO: 56724 - DNA, 25 bp, Homo sapien
ctgaaataatgaggttctgctatgt

SEQ ID NO: 56725 - DNA, 25 bp, Homo sapien
ctgaaataatgaggttttgctatgt

SEQ ID NO: 56726 - DNA, 25 bp, Homo sapien
ctgaaatacaggtcttaaattcctg

SEQ ID NO: 56727 - DNA, 25 bp, Homo sapien
ctgaaatacaggtcttgaattcctg

SEQ ID NO: 56728 - DNA, 25 bp, Homo sapien
ctgaaatagcaatacgtatctgtac

SEQ ID NO: 56729 - DNA, 25 bp, Homo sapien
ctgaaatagcaatatgtatctgtac

SEQ ID NO: 56730 - DNA, 25 bp, Homo sapien
ctgaaatatctgcgcatgcaataga

SEQ ID NO: 56731 - DNA, 25 bp, Homo sapien
ctgaaatatctgtgcatgcaataga

SEQ ID NO: 56732 - DNA, 25 bp, Homo sapien
ctgaaatgcaaaactatggattaat

SEQ ID NO: 56733 - DNA, 25 bp, Homo sapien
ctgaaatgcaactttctggaacaaa

SEQ ID NO: 56734 - DNA, 25 bp, Homo sapien
ctgaaatgcgaaactatggattaat

SEQ ID NO: 56735 - DNA, 25 bp, Homo sapien
ctgaaatgcgactttctggaacaaa

SEQ ID NO: 56736 - DNA, 25 bp, Homo sapien
ctgaaatgctgcaagtcaataatat

SEQ ID NO: 56737 - DNA, 25 bp, Homo sapien
ctgaaatgctgcgagtcaataatat

SEQ ID NO: 56738 - DNA, 25 bp, Homo sapien
ctgaaatggtccaagcaagagtttc

SEQ ID NO: 56739 - DNA, 25 bp, Homo sapien
ctgaaatggtccaggcaagagtttc

SEQ ID NO: 56740 - DNA, 25 bp, Homo sapien
ctgaaatgttagcatacgcttttta

SEQ ID NO: 56741 - DNA, 25 bp, Homo sapien
ctgaaatgttagcatatgcttttta

SEQ ID NO: 56742 - DNA, 25 bp, Homo sapien
ctgaaattcaaacccaggtggttct

SEQ ID NO: 56743 - DNA, 25 bp, Homo sapien
ctgaaattcgaacccaggtggttct

SEQ ID NO: 56744 - DNA, 25 bp, Homo sapien
ctgaaattcgtatgttgaaacccta

SEQ ID NO: 56745 - DNA, 25 bp, Homo sapien
ctgaaatttgtatgttgaaacccta

SEQ ID NO: 56746 - DNA, 25 bp, Homo sapien
ctgaaatttgtcgtagtctggaact

SEQ ID NO: 56747 - DNA, 25 bp, Homo sapien
ctgaaatttgtcgtcgtctggaact

SEQ ID NO: 56748 - DNA, 25 bp, Homo sapien
ctgaacaaaggattgtttctccaaa

SEQ ID NO: 56749 - DNA, 25 bp, Homo sapien
ctgaacaaatgattgtttctccaaa

SEQ ID NO: 56750 - DNA, 25 bp, Homo sapien
ctgaacaagcacttaacaaaattca

SEQ ID NO: 56751 - DNA, 25 bp, Homo sapien
ctgaacaagcacttaataaaattca

SEQ ID NO: 56752 - DNA, 25 bp, Homo sapien
ctgaacaatctcgtgtatctacagc

SEQ ID NO: 56753 - DNA, 25 bp, Homo sapien
ctgaacaatctcttgtatctacagc

SEQ ID NO: 56754 - DNA, 25 bp, Homo sapien
ctgaacacctactatgagtcacgag

SEQ ID NO: 56755 - DNA, 25 bp, Homo sapien
ctgaacacctactgtgagtcacgag

SEQ ID NO: 56756 - DNA, 25 bp, Homo sapien
ctgaacatttatcacttctacattt

SEQ ID NO: 56757 - DNA, 25 bp, Homo sapien
ctgaacatttatcatttctacattt

SEQ ID NO: 56758 - DNA, 25 bp, Homo sapien
ctgaacgagccatgtaaattaagtt

SEQ ID NO: 56759 - DNA, 25 bp, Homo sapien
ctgaacgagtcatgtaaattaagtt

SEQ ID NO: 56760 - DNA, 25 bp, Homo sapien
ctgaacgcttgcatgattgcttctt

SEQ ID NO: 56761 - DNA, 25 bp, Homo sapien
ctgaacgcttgtatgattgcttctt

SEQ ID NO: 56762 - DNA, 25 bp, Homo sapien
ctgaacgtgtacaactgaaagcaca

SEQ ID NO: 56763 - DNA, 25 bp, Homo sapien
ctgaacgtgtataactgaaagcaca

SEQ ID NO: 56764 - DNA, 25 bp, Homo sapien
ctgaactaaaaaatttattggaggc

SEQ ID NO: 56765 - DNA, 25 bp, Homo sapien
ctgaactaaaaagtttattggaggc

SEQ ID NO: 56766 - DNA, 25 bp, Homo sapien
ctgaactaaacaggatgtgtaagtg

SEQ ID NO: 56767 - DNA, 25 bp, Homo sapien
ctgaactaaacagggtgtgtaagtg

SEQ ID NO: 56768 - DNA, 25 bp, Homo sapien
ctgaactactgcagggtaatcagag

SEQ ID NO: 56769 - DNA, 25 bp, Homo sapien
ctgaactactgcggggtaatcagag

SEQ ID NO: 56770 - DNA, 25 bp, Homo sapien
ctgaactcaaagatgacatctggtg

SEQ ID NO: 56771 - DNA, 25 bp, Homo sapien
ctgaactcagagatgacatctggtg

SEQ ID NO: 56772 - DNA, 25 bp, Homo sapien
ctgaactcagttgaaccattcagat

SEQ ID NO: 56773 - DNA, 25 bp, Homo sapien
ctgaactcagttgagccattcagat

SEQ ID NO: 56774 - DNA, 25 bp, Homo sapien
ctgaactgatatacagtttgtaaga

SEQ ID NO: 56775 - DNA, 25 bp, Homo sapien
ctgaactgatatccagtttgtaaga

SEQ ID NO: 56776 - DNA, 25 bp, Homo sapien
ctgaactgcatgcattcccaggctt

SEQ ID NO: 56777 - DNA, 25 bp, Homo sapien
ctgaactgcatgcatttccaggctt

SEQ ID NO: 56778 - DNA, 25 bp, Homo sapien
ctgaactgtaaggtatgcaaaattt

SEQ ID NO: 56779 - DNA, 25 bp, Homo sapien
ctgaactgtgaggtatgcaaaattt

SEQ ID NO: 56780 - DNA, 25 bp, Homo sapien
ctgaacttagaaaagactcttcaaa

SEQ ID NO: 56781 - DNA, 25 bp, Homo sapien
ctgaacttagaaaatactcttcaaa

SEQ ID NO: 56782 - DNA, 25 bp, Homo sapien
ctgaacttcgacttcgcactttgtt

SEQ ID NO: 56783 - DNA, 25 bp, Homo sapien
ctgaacttctgaatgaaataactga

SEQ ID NO: 56784 - DNA, 25 bp, Homo sapien
ctgaactttgacttcgcactttgtt

SEQ ID NO: 56785 - DNA, 25 bp, Homo sapien
ctgaacttttgaatgaaataactga

SEQ ID NO: 56786 - DNA, 25 bp, Homo sapien
ctgaagaaaccttgggccatgattg

SEQ ID NO: 56787 - DNA, 25 bp, Homo sapien
ctgaagaacccttgggccatgattg

SEQ ID NO: 56788 - DNA, 25 bp, Homo sapien
ctgaagaatgcgttgggccagtgtt

SEQ ID NO: 56789 - DNA, 25 bp, Homo sapien
ctgaagaatgctttgggccagtgtt

SEQ ID NO: 56790 - DNA, 25 bp, Homo sapien
ctgaagagaacactggaaaagaggc

SEQ ID NO: 56791 - DNA, 25 bp, Homo sapien
ctgaagagaacattgacattaaaga

SEQ ID NO: 56792 - DNA, 25 bp, Homo sapien
ctgaagagaacattgatattaaaga

SEQ ID NO: 56793 - DNA, 25 bp, Homo sapien
ctgaagagaacattggaaaagaggc

SEQ ID NO: 56794 - DNA, 25 bp, Homo sapien
ctgaagagaagagcatcaagagacg

SEQ ID NO: 56795 - DNA, 25 bp, Homo sapien
ctgaagagaagatcatcaagagacg

SEQ ID NO: 56796 - DNA, 25 bp, Homo sapien
ctgaagagaatgtcctactcagctt

SEQ ID NO: 56797 - DNA, 25 bp, Homo sapien
ctgaagagaatgttggaaaatcatc

SEQ ID NO: 56798 - DNA, 25 bp, Homo sapien
ctgaagagaatttcctactcagctt

SEQ ID NO: 56799 - DNA, 25 bp, Homo sapien
ctgaagagaggctcacatcaagtgg

SEQ ID NO: 56800 - DNA, 25 bp, Homo sapien
ctgaagagaggctcacgtcaagtgg

SEQ ID NO: 56801 - DNA, 25 bp, Homo sapien
ctgaagagagtgactgatcctgaca

SEQ ID NO: 56802 - DNA, 25 bp, Homo sapien
ctgaagagagtggctgatcctgaca

SEQ ID NO: 56803 - DNA, 25 bp, Homo sapien
ctgaagagattgttggaaaatcatc

SEQ ID NO: 56804 - DNA, 25 bp, Homo sapien
ctgaagattaagagacacaaaagtt

SEQ ID NO: 56805 - DNA, 25 bp, Homo sapien
ctgaagattaagagccacaaaagtt

SEQ ID NO: 56806 - DNA, 25 bp, Homo sapien
ctgaagatttttatggcaattccaa

SEQ ID NO: 56807 - DNA, 25 bp, Homo sapien
ctgaagatttttgtggcaattccaa

SEQ ID NO: 56808 - DNA, 25 bp, Homo sapien
ctgaagcaacgacagcaaagaccaa

SEQ ID NO: 56809 - DNA, 25 bp, Homo sapien
ctgaagcaatacaaaaaggatagtt

SEQ ID NO: 56810 - DNA, 25 bp, Homo sapien
ctgaagcaatacgaaaaggatagtt

SEQ ID NO: 56811 - DNA, 25 bp, Homo sapien
ctgaagcaatgacagcaaagaccaa

SEQ ID NO: 56812 - DNA, 25 bp, Homo sapien
ctgaagccaagagggctaacaggaa

SEQ ID NO: 56813 - DNA, 25 bp, Homo sapien
ctgaagccaagtgggctaacaggaa

SEQ ID NO: 56814 - DNA, 25 bp, Homo sapien
ctgaagccagggccggcgggtacag

SEQ ID NO: 56815 - DNA, 25 bp, Homo sapien
ctgaagccggggccggcgggtacag

SEQ ID NO: 56816 - DNA, 25 bp, Homo sapien
ctgaagctattcccaaaaaatcaaa

SEQ ID NO: 56817 - DNA, 25 bp, Homo sapien
ctgaagctggtgcactctgaaaaca

SEQ ID NO: 56818 - DNA, 25 bp, Homo sapien
ctgaagctggtgcattctgaaaaca

SEQ ID NO: 56819 - DNA, 25 bp, Homo sapien
ctgaagctgttcccaaaaaatcaaa

SEQ ID NO: 56820 - DNA, 25 bp, Homo sapien
ctgaaggaacaccacaccggtgatc

SEQ ID NO: 56821 - DNA, 25 bp, Homo sapien
ctgaaggaacaccacagcggtgatc

SEQ ID NO: 56822 - DNA, 25 bp, Homo sapien
ctgaaggaacggaatttgatcagga

SEQ ID NO: 56823 - DNA, 25 bp, Homo sapien
ctgaaggaatggaatttgatcagga

SEQ ID NO: 56824 - DNA, 25 bp, Homo sapien
ctgaaggatggagcatccaaatggc

SEQ ID NO: 56825 - DNA, 25 bp, Homo sapien
ctgaaggatggagtatccaaatggc

SEQ ID NO: 56826 - DNA, 25 bp, Homo sapien
ctgaaggctgcatcgtcagcttccc

SEQ ID NO: 56827 - DNA, 25 bp, Homo sapien
ctgaaggctgcattgtcagcttccc

SEQ ID NO: 56828 - DNA, 25 bp, Homo sapien
ctgaaggcttgaaacttccagggga

SEQ ID NO: 56829 - DNA, 25 bp, Homo sapien
ctgaaggcttgcaacttccagggga

SEQ ID NO: 56830 - DNA, 25 bp, Homo sapien
ctgaagtaacgccggagataaactt

SEQ ID NO: 56831 - DNA, 25 bp, Homo sapien
ctgaagtaacgcctgagataaactt

SEQ ID NO: 56832 - DNA, 25 bp, Homo sapien
ctgaagtcagagtctacataaatag

SEQ ID NO: 56833 - DNA, 25 bp, Homo sapien
ctgaagtcccatcaacacttcatga

SEQ ID NO: 56834 - DNA, 25 bp, Homo sapien
ctgaagtcccatcaccacttcatga

SEQ ID NO: 56835 - DNA, 25 bp, Homo sapien
ctgaagtcggagtctacataaatag

SEQ ID NO: 56836 - DNA, 25 bp, Homo sapien
ctgaagtgaaagattaatgtcccag

SEQ ID NO: 56837 - DNA, 25 bp, Homo sapien
ctgaagtgaaatattaatgtcccag

SEQ ID NO: 56838 - DNA, 25 bp, Homo sapien
ctgaagttcctccaattcagaaagg

SEQ ID NO: 56839 - DNA, 25 bp, Homo sapien
ctgaagttcctccagttcagaaagg

SEQ ID NO: 56840 - DNA, 25 bp, Homo sapien
ctgaagttttccgtaatgtgaattt

SEQ ID NO: 56841 - DNA, 25 bp, Homo sapien
ctgaagttttccttaatgtgaattt

SEQ ID NO: 56842 - DNA, 25 bp, Homo sapien
ctgaatacatacaccctaataagtg

SEQ ID NO: 56843 - DNA, 25 bp, Homo sapien
ctgaatacatataccctaataagtg

SEQ ID NO: 56844 - DNA, 25 bp, Homo sapien
ctgaataccgaaaaggctctctccc

SEQ ID NO: 56845 - DNA, 25 bp, Homo sapien
ctgaatactgaaaaggctctctccc

SEQ ID NO: 56846 - DNA, 25 bp, Homo sapien
ctgaatactgttttttttgcggcac

SEQ ID NO: 56847 - DNA, 25 bp, Homo sapien
ctgaatacttttttttttgcggcac

SEQ ID NO: 56848 - DNA, 25 bp, Homo sapien
ctgaatagagagtgatctgaacaac

SEQ ID NO: 56849 - DNA, 25 bp, Homo sapien
ctgaatagagagtggtctgaacaac

SEQ ID NO: 56850 - DNA, 25 bp, Homo sapien
ctgaatcatagggtagttcttaatg

SEQ ID NO: 56851 - DNA, 25 bp, Homo sapien
ctgaatcatggggtagttcttaatg

SEQ ID NO: 56852 - DNA, 25 bp, Homo sapien
ctgaatccaagatcataaacccaag

SEQ ID NO: 56853 - DNA, 25 bp, Homo sapien
ctgaatccaagattataaacccaag

SEQ ID NO: 56854 - DNA, 25 bp, Homo sapien
ctgaatccagataaaactgtttttt

SEQ ID NO: 56855 - DNA, 25 bp, Homo sapien
ctgaatccagataaaattgtttttt

SEQ ID NO: 56856 - DNA, 25 bp, Homo sapien
ctgaatccagattctgaaacttttt

SEQ ID NO: 56857 - DNA, 25 bp, Homo sapien
ctgaatccatattctgaaacttttt

SEQ ID NO: 56858 - DNA, 25 bp, Homo sapien
ctgaatcccatttcatttattgtag

SEQ ID NO: 56859 - DNA, 25 bp, Homo sapien
ctgaatccctttatccagcttcctc

SEQ ID NO: 56860 - DNA, 25 bp, Homo sapien
ctgaatccctttatcctgcttcctc

SEQ ID NO: 56861 - DNA, 25 bp, Homo sapien
ctgaatcctatttcatttattgtag

SEQ ID NO: 56862 - DNA, 25 bp, Homo sapien
ctgaatcttgaagtatgagtaagag

SEQ ID NO: 56863 - DNA, 25 bp, Homo sapien
ctgaatcttgaagtttgagtaagag

SEQ ID NO: 56864 - DNA, 25 bp, Homo sapien
ctgaatgaactacggtgatggccaa

SEQ ID NO: 56865 - DNA, 25 bp, Homo sapien
ctgaatgaactagggtgatggccaa

SEQ ID NO: 56866 - DNA, 25 bp, Homo sapien
ctgaatgatttctaagtaaacaaca

SEQ ID NO: 56867 - DNA, 25 bp, Homo sapien
ctgaatgatttctaggtaaacaaca

SEQ ID NO: 56868 - DNA, 25 bp, Homo sapien
ctgaatgcttttaacgacaccaaag

SEQ ID NO: 56869 - DNA, 25 bp, Homo sapien
ctgaatgcttttaatgacaccaaag

SEQ ID NO: 56870 - DNA, 25 bp, Homo sapien
ctgaatggaaaaaacaaactttgtt

SEQ ID NO: 56871 - DNA, 25 bp, Homo sapien
ctgaatggaaaaaataaactttgtt

SEQ ID NO: 56872 - DNA, 25 bp, Homo sapien
ctgaatggactacataacttgggtg

SEQ ID NO: 56873 - DNA, 25 bp, Homo sapien
ctgaatggactatataacttgggtg

SEQ ID NO: 56874 - DNA, 25 bp, Homo sapien
ctgaatgtatcagcacatctaatct

SEQ ID NO: 56875 - DNA, 25 bp, Homo sapien
ctgaatgtgtcagtctctctgaact

SEQ ID NO: 56876 - DNA, 25 bp, Homo sapien
ctgaatgtgtcagtttctctgaact

SEQ ID NO: 56877 - DNA, 25 bp, Homo sapien
ctgaatgtttcagcacatctaatct

SEQ ID NO: 56878 - DNA, 25 bp, Homo sapien
ctgaattaattaagccttgagacag

SEQ ID NO: 56879 - DNA, 25 bp, Homo sapien
ctgaattaattaggccttgagacag

SEQ ID NO: 56880 - DNA, 25 bp, Homo sapien
ctgaattactaacatcacatccata

SEQ ID NO: 56881 - DNA, 25 bp, Homo sapien
ctgaattactaacatcccatccata

SEQ ID NO: 56882 - DNA, 25 bp, Homo sapien
ctgaattaggagaacagtgtctaag

SEQ ID NO: 56883 - DNA, 25 bp, Homo sapien
ctgaattaggaggacagtgtctaag

SEQ ID NO: 56884 - DNA, 25 bp, Homo sapien
ctgaattataaggcacatctatgtt

SEQ ID NO: 56885 - DNA, 25 bp, Homo sapien
ctgaattataaggcacctctatgtt

SEQ ID NO: 56886 - DNA, 25 bp, Homo sapien
ctgaattatattggtctacatgtat

SEQ ID NO: 56887 - DNA, 25 bp, Homo sapien
ctgaattatctcaaccaaggagatt

SEQ ID NO: 56888 - DNA, 25 bp, Homo sapien
ctgaattatctcgaccaaggagatt

SEQ ID NO: 56889 - DNA, 25 bp, Homo sapien
ctgaattatctcttttcgcatctct

SEQ ID NO: 56890 - DNA, 25 bp, Homo sapien
ctgaattatctctttttgcatctct

SEQ ID NO: 56891 - DNA, 25 bp, Homo sapien
ctgaattatgttggtctacatgtat

SEQ ID NO: 56892 - DNA, 25 bp, Homo sapien
ctgaattatttcaaaaactgcattt

SEQ ID NO: 56893 - DNA, 25 bp, Homo sapien
ctgaattatttcaacaactgcattt

SEQ ID NO: 56894 - DNA, 25 bp, Homo sapien
ctgaattcaaaggtcagaaaccatc

SEQ ID NO: 56895 - DNA, 25 bp, Homo sapien
ctgaattcaggattaaagtagaaaa

SEQ ID NO: 56896 - DNA, 25 bp, Homo sapien
ctgaattcagggttaaagtagaaaa

SEQ ID NO: 56897 - DNA, 25 bp, Homo sapien
ctgaattcgaaggtcagaaaccatc

SEQ ID NO: 56898 - DNA, 25 bp, Homo sapien
ctgaattgaccatcacataatgtat

SEQ ID NO: 56899 - DNA, 25 bp, Homo sapien
ctgaattgaccgtcacataatgtat

SEQ ID NO: 56900 - DNA, 25 bp, Homo sapien
ctgaattgcttctcggtctgtaaat

SEQ ID NO: 56901 - DNA, 25 bp, Homo sapien
ctgaattgcttcttggtctgtaaat

SEQ ID NO: 56902 - DNA, 25 bp, Homo sapien
ctgaatttatagtaacgactcaaca

SEQ ID NO: 56903 - DNA, 25 bp, Homo sapien
ctgaatttctttacttaatctcaga

SEQ ID NO: 56904 - DNA, 25 bp, Homo sapien
ctgaatttcttttcttaatctcaga

SEQ ID NO: 56905 - DNA, 25 bp, Homo sapien
ctgaatttgagctctagttgccacg

SEQ ID NO: 56906 - DNA, 25 bp, Homo sapien
ctgaatttgatgacagacttaatat

SEQ ID NO: 56907 - DNA, 25 bp, Homo sapien
ctgaatttgatgaggtggtagagtt

SEQ ID NO: 56908 - DNA, 25 bp, Homo sapien
ctgaatttgatgaggttgtagagtt

SEQ ID NO: 56909 - DNA, 25 bp, Homo sapien
ctgaatttgcgctctagttgccacg

SEQ ID NO: 56910 - DNA, 25 bp, Homo sapien
ctgaatttggtgacagacttaatat

SEQ ID NO: 56911 - DNA, 25 bp, Homo sapien
ctgaatttggtgctctaagaaccaa

SEQ ID NO: 56912 - DNA, 25 bp, Homo sapien
ctgaatttggtgctgtaagaaccaa

SEQ ID NO: 56913 - DNA, 25 bp, Homo sapien
ctgaatttttagtaacgactcaaca

SEQ ID NO: 56914 - DNA, 25 bp, Homo sapien
ctgaatttttgtcaaatataggaaa

SEQ ID NO: 56915 - DNA, 25 bp, Homo sapien
ctgaatttttgttaaatataggaaa

SEQ ID NO: 56916 - DNA, 25 bp, Homo sapien
ctgacaaaaacttagccaatgtgaa

SEQ ID NO: 56917 - DNA, 25 bp, Homo sapien
ctgacaaaaccttagccaatgtgaa

SEQ ID NO: 56918 - DNA, 25 bp, Homo sapien
ctgacaaaattgcgtgatatgacaa

SEQ ID NO: 56919 - DNA, 25 bp, Homo sapien
ctgacaaaattgtgtgatatgacaa

SEQ ID NO: 56920 - DNA, 25 bp, Homo sapien
ctgacaaacggctagtatccagaat

SEQ ID NO: 56921 - DNA, 25 bp, Homo sapien
ctgacaaacggctagtgtccagaat

SEQ ID NO: 56922 - DNA, 25 bp, Homo sapien
ctgacaaatcatgaaaatatgagat

SEQ ID NO: 56923 - DNA, 25 bp, Homo sapien
ctgacaaatcatgagaatatgagat

SEQ ID NO: 56924 - DNA, 25 bp, Homo sapien
ctgacaacatgttcaacaaagttct

SEQ ID NO: 56925 - DNA, 25 bp, Homo sapien
ctgacaacgtgttcaacaaagttct

SEQ ID NO: 56926 - DNA, 25 bp, Homo sapien
ctgacaactgtaaatgtctttttac

SEQ ID NO: 56927 - DNA, 25 bp, Homo sapien
ctgacaactgtaattgtctttttac

SEQ ID NO: 56928 - DNA, 25 bp, Homo sapien
ctgacaagaaaaaagcatttcaaat

SEQ ID NO: 56929 - DNA, 25 bp, Homo sapien
ctgacaagaccacaaactccctgtc

SEQ ID NO: 56930 - DNA, 25 bp, Homo sapien
ctgacaagaccacagactccctgtc

SEQ ID NO: 56931 - DNA, 25 bp, Homo sapien
ctgacaagattgatggctttatttt

SEQ ID NO: 56932 - DNA, 25 bp, Homo sapien
ctgacaagattgatggttttatttt

SEQ ID NO: 56933 - DNA, 25 bp, Homo sapien
ctgacaaggaaaaagcatttcaaat

SEQ ID NO: 56934 - DNA, 25 bp, Homo sapien
ctgacaatagccgaaacttaccagt

SEQ ID NO: 56935 - DNA, 25 bp, Homo sapien
ctgacaatagcggaaacttaccagt

SEQ ID NO: 56936 - DNA, 25 bp, Homo sapien
ctgacaatcggatctccatgaacac

SEQ ID NO: 56937 - DNA, 25 bp, Homo sapien
ctgacaatcgggtctccatgaacac

SEQ ID NO: 56938 - DNA, 25 bp, Homo sapien
ctgacaatgaacagggtaagtataa

SEQ ID NO: 56939 - DNA, 25 bp, Homo sapien
ctgacaatgaacatggtaagtataa

SEQ ID NO: 56940 - DNA, 25 bp, Homo sapien
ctgacacattccctgtcaatttctt

SEQ ID NO: 56941 - DNA, 25 bp, Homo sapien
ctgacacattccctgttaatttctt

SEQ ID NO: 56942 - DNA, 25 bp, Homo sapien
ctgacactattttatcaaggagagg

SEQ ID NO: 56943 - DNA, 25 bp, Homo sapien
ctgacactgtttcgttccacacggt

SEQ ID NO: 56944 - DNA, 25 bp, Homo sapien
ctgacactgtttggttccacacggt

SEQ ID NO: 56945 - DNA, 25 bp, Homo sapien
ctgacactgttttatcaaggagagg

SEQ ID NO: 56946 - DNA, 25 bp, Homo sapien
ctgacacttactccatatggttgaa

SEQ ID NO: 56947 - DNA, 25 bp, Homo sapien
ctgacacttactgcatatggttgaa

SEQ ID NO: 56948 - DNA, 25 bp, Homo sapien
ctgacagaggctcctctctactcag

SEQ ID NO: 56949 - DNA, 25 bp, Homo sapien
ctgacagaggcttctctctactcag

SEQ ID NO: 56950 - DNA, 25 bp, Homo sapien
ctgacagatcttaaagtggctgagc

SEQ ID NO: 56951 - DNA, 25 bp, Homo sapien
ctgacagatcttcaagtggctgagc

SEQ ID NO: 56952 - DNA, 25 bp, Homo sapien
ctgacagatgtttgcaataatcata

SEQ ID NO: 56953 - DNA, 25 bp, Homo sapien
ctgacagatgtttgcagtaatcata

SEQ ID NO: 56954 - DNA, 25 bp, Homo sapien
ctgacaggtacttaaaaccaagtga

SEQ ID NO: 56955 - DNA, 25 bp, Homo sapien
ctgacaggtccttaaaaccaagtga

SEQ ID NO: 56956 - DNA, 25 bp, Homo sapien
ctgacagtattagacagaccatcaa

SEQ ID NO: 56957 - DNA, 25 bp, Homo sapien
ctgacagtattagatagaccatcaa

SEQ ID NO: 56958 - DNA, 25 bp, Homo sapien
ctgacagtgacctagtaacatccaa

SEQ ID NO: 56959 - DNA, 25 bp, Homo sapien
ctgacagtgacctggtaacatccaa

SEQ ID NO: 56960 - DNA, 25 bp, Homo sapien
ctgacataaaagctgcaggtattgt

SEQ ID NO: 56961 - DNA, 25 bp, Homo sapien
ctgacataagagctgcaggtattgt

SEQ ID NO: 56962 - DNA, 25 bp, Homo sapien
ctgacataatctcattgcaatattg

SEQ ID NO: 56963 - DNA, 25 bp, Homo sapien
ctgacataatctccttgcaatattg

SEQ ID NO: 56964 - DNA, 25 bp, Homo sapien
ctgacatcaagacctaaggtaattt

SEQ ID NO: 56965 - DNA, 25 bp, Homo sapien
ctgacatcaagagctaaggtaattt

SEQ ID NO: 56966 - DNA, 25 bp, Homo sapien
ctgacatcaagccactaaaattact

SEQ ID NO: 56967 - DNA, 25 bp, Homo sapien
ctgacatcaagctactaaaattact

SEQ ID NO: 56968 - DNA, 25 bp, Homo sapien
ctgacatcactccctcctggttttc

SEQ ID NO: 56969 - DNA, 25 bp, Homo sapien
ctgacatcactccttcctggttttc

SEQ ID NO: 56970 - DNA, 25 bp, Homo sapien
ctgacatcattaaaaaattagctat

SEQ ID NO: 56971 - DNA, 25 bp, Homo sapien
ctgacatcattgaaaaattagctat

SEQ ID NO: 56972 - DNA, 25 bp, Homo sapien
ctgacatccttgcgaagtatttgtc

SEQ ID NO: 56973 - DNA, 25 bp, Homo sapien
ctgacatccttgtgaagtatttgtc

SEQ ID NO: 56974 - DNA, 25 bp, Homo sapien
ctgacattcagcccacacatggggc

SEQ ID NO: 56975 - DNA, 25 bp, Homo sapien
ctgacattcagcccacgcatggggc

SEQ ID NO: 56976 - DNA, 25 bp, Homo sapien
ctgacattccaggaaaagcaaactg

SEQ ID NO: 56977 - DNA, 25 bp, Homo sapien
ctgacattccaggcaaagcaaactg

SEQ ID NO: 56978 - DNA, 25 bp, Homo sapien
ctgacatttaagctaactttgtcat

SEQ ID NO: 56979 - DNA, 25 bp, Homo sapien
ctgacatttaagctaattttgtcat

SEQ ID NO: 56980 - DNA, 25 bp, Homo sapien
ctgaccaagatgaacactttgagga

SEQ ID NO: 56981 - DNA, 25 bp, Homo sapien
ctgaccaaggtgaacactttgagga

SEQ ID NO: 56982 - DNA, 25 bp, Homo sapien
ctgaccacatattatcaaaaacagc

SEQ ID NO: 56983 - DNA, 25 bp, Homo sapien
ctgaccacatattatccaaaacagc

SEQ ID NO: 56984 - DNA, 25 bp, Homo sapien
ctgaccactatctcttgccacttca

SEQ ID NO: 56985 - DNA, 25 bp, Homo sapien
ctgaccactatttcttgccacttca

SEQ ID NO: 56986 - DNA, 25 bp, Homo sapien
ctgaccatgctcctcgcaacagggc

SEQ ID NO: 56987 - DNA, 25 bp, Homo sapien
ctgaccatgttcctcgcaacagggc

SEQ ID NO: 56988 - DNA, 25 bp, Homo sapien
ctgaccattcaatttccgtacttcc

SEQ ID NO: 56989 - DNA, 25 bp, Homo sapien
ctgaccattcaatttctgtacttcc

SEQ ID NO: 56990 - DNA, 25 bp, Homo sapien
ctgacccaaaaggtagactggacac

SEQ ID NO: 56991 - DNA, 25 bp, Homo sapien
ctgacccaacggaatctacttaaga

SEQ ID NO: 56992 - DNA, 25 bp, Homo sapien
ctgacccaagaggtagactggacac

SEQ ID NO: 56993 - DNA, 25 bp, Homo sapien
ctgacccaatggaatctacttaaga

SEQ ID NO: 56994 - DNA, 25 bp, Homo sapien
ctgacccagagaccagaggcacaaa

SEQ ID NO: 56995 - DNA, 25 bp, Homo sapien
ctgacccagcgaccagaggcacaaa

SEQ ID NO: 56996 - DNA, 25 bp, Homo sapien
ctgaccccaaaactctctgattcag

SEQ ID NO: 56997 - DNA, 25 bp, Homo sapien
ctgaccccaaaactgtctgattcag

SEQ ID NO: 56998 - DNA, 25 bp, Homo sapien
ctgacccctgtttccaactttctat

SEQ ID NO: 56999 - DNA, 25 bp, Homo sapien
ctgacccctgtttccatctttctat

SEQ ID NO: 57000 - DNA, 25 bp, Homo sapien
ctgacccgtgtccctagccttgctc

SEQ ID NO: 57001 - DNA, 25 bp, Homo sapien
ctgacccgtgtccctatccttgctc

SEQ ID NO: 57002 - DNA, 25 bp, Homo sapien
ctgaccctgcctctcttatattctt

SEQ ID NO: 57003 - DNA, 25 bp, Homo sapien
ctgaccctgcctgtcttatattctt

SEQ ID NO: 57004 - DNA, 25 bp, Homo sapien
ctgacctgcaggagaagtgggcttc

SEQ ID NO: 57005 - DNA, 25 bp, Homo sapien
ctgacctgcaggagaattgggcttc

SEQ ID NO: 57006 - DNA, 25 bp, Homo sapien
ctgacctgtctcttcacgcctgcag

SEQ ID NO: 57007 - DNA, 25 bp, Homo sapien
ctgacctgtctcttcatgcctgcag

SEQ ID NO: 57008 - DNA, 25 bp, Homo sapien
ctgaccttcccattcctgagttcct

SEQ ID NO: 57009 - DNA, 25 bp, Homo sapien
ctgacctttccattcctgagttcct

SEQ ID NO: 57010 - DNA, 25 bp, Homo sapien
ctgacgttagtaataggccttaaac

SEQ ID NO: 57011 - DNA, 25 bp, Homo sapien
ctgacgttagtattaggccttaaac

SEQ ID NO: 57012 - DNA, 25 bp, Homo sapien
ctgactacaattaggggtttctaaa

SEQ ID NO: 57013 - DNA, 25 bp, Homo sapien
ctgactacagaagatcactccctgc

SEQ ID NO: 57014 - DNA, 25 bp, Homo sapien
ctgactacataagatcactccctgc

SEQ ID NO: 57015 - DNA, 25 bp, Homo sapien
ctgactaccattaggggtttctaaa

SEQ ID NO: 57016 - DNA, 25 bp, Homo sapien
ctgactacgaacaaaaggagaacag

SEQ ID NO: 57017 - DNA, 25 bp, Homo sapien
ctgactacgaacgaaaggagaacag

SEQ ID NO: 57018 - DNA, 25 bp, Homo sapien
ctgactactaatgcagctaaatgtt

SEQ ID NO: 57019 - DNA, 25 bp, Homo sapien
ctgactactgatgcagctaaatgtt

SEQ ID NO: 57020 - DNA, 25 bp, Homo sapien
ctgactatatgagtactaatagcag

SEQ ID NO: 57021 - DNA, 25 bp, Homo sapien
ctgactatatgggtactaatagcag

SEQ ID NO: 57022 - DNA, 25 bp, Homo sapien
ctgactcaacgttcccaactggatt

SEQ ID NO: 57023 - DNA, 25 bp, Homo sapien
ctgactcaatgttcccaactggatt

SEQ ID NO: 57024 - DNA, 25 bp, Homo sapien
ctgactcgatgcgctgactgcacct

SEQ ID NO: 57025 - DNA, 25 bp, Homo sapien
ctgactcgatgtgctgactgcacct

SEQ ID NO: 57026 - DNA, 25 bp, Homo sapien
ctgactctcactgatatttattaac

SEQ ID NO: 57027 - DNA, 25 bp, Homo sapien
ctgactctcgctgatatttattaac

SEQ ID NO: 57028 - DNA, 25 bp, Homo sapien
ctgactctctaaatctgtttgggat

SEQ ID NO: 57029 - DNA, 25 bp, Homo sapien
ctgactctctaaatttgtttgggat

SEQ ID NO: 57030 - DNA, 25 bp, Homo sapien
ctgactctgaagccagggccggcgg

SEQ ID NO: 57031 - DNA, 25 bp, Homo sapien
ctgactctgaagccggggccggcgg

SEQ ID NO: 57032 - DNA, 25 bp, Homo sapien
ctgactctgctcctcctcactgttg

SEQ ID NO: 57033 - DNA, 25 bp, Homo sapien
ctgactctgctccttctcactgttg

SEQ ID NO: 57034 - DNA, 25 bp, Homo sapien
ctgactctgtgtctctaaccgtctg

SEQ ID NO: 57035 - DNA, 25 bp, Homo sapien
ctgactctgtgtttctaaccgtctg

SEQ ID NO: 57036 - DNA, 25 bp, Homo sapien
ctgactgagaaatgatccttggact

SEQ ID NO: 57037 - DNA, 25 bp, Homo sapien
ctgactgagaaattatccttggact

SEQ ID NO: 57038 - DNA, 25 bp, Homo sapien
ctgactgagataataaatctatgcc

SEQ ID NO: 57039 - DNA, 25 bp, Homo sapien
ctgactgagataatgaatctatgcc

SEQ ID NO: 57040 - DNA, 25 bp, Homo sapien
ctgactgagccatattacctgagcc

SEQ ID NO: 57041 - DNA, 25 bp, Homo sapien
ctgactgagccatattccctgagcc

SEQ ID NO: 57042 - DNA, 25 bp, Homo sapien
ctgactgcaaacatactaatggaga

SEQ ID NO: 57043 - DNA, 25 bp, Homo sapien
ctgactgcaaacctactaatggaga

SEQ ID NO: 57044 - DNA, 25 bp, Homo sapien
ctgactgctcacctttaccctacct

SEQ ID NO: 57045 - DNA, 25 bp, Homo sapien
ctgactgctcacttttaccctacct

SEQ ID NO: 57046 - DNA, 25 bp, Homo sapien
ctgactggtgcatgggaaggattaa

SEQ ID NO: 57047 - DNA, 25 bp, Homo sapien
ctgactggtgcctgggaaggattaa

SEQ ID NO: 57048 - DNA, 25 bp, Homo sapien
ctgacttaaatgacacccttgttat

SEQ ID NO: 57049 - DNA, 25 bp, Homo sapien
ctgacttaaatgtcacccttgttat

SEQ ID NO: 57050 - DNA, 25 bp, Homo sapien
ctgacttcaggtacaaagcatcaat

SEQ ID NO: 57051 - DNA, 25 bp, Homo sapien
ctgacttcaggtgcaaagcatcaat

SEQ ID NO: 57052 - DNA, 25 bp, Homo sapien
ctgacttgaatacttctgagcatct

SEQ ID NO: 57053 - DNA, 25 bp, Homo sapien
ctgacttgagtacttctgagcatct

SEQ ID NO: 57054 - DNA, 25 bp, Homo sapien
ctgacttggatggactacatcacca

SEQ ID NO: 57055 - DNA, 25 bp, Homo sapien
ctgacttggatggcctacatcacca

SEQ ID NO: 57056 - DNA, 25 bp, Homo sapien
ctgactttcatacaatggcttttta

SEQ ID NO: 57057 - DNA, 25 bp, Homo sapien
ctgactttccaaaatgcttctgtta

SEQ ID NO: 57058 - DNA, 25 bp, Homo sapien
ctgactttccacccgtttttccctt

SEQ ID NO: 57059 - DNA, 25 bp, Homo sapien
ctgactttccacccttttttccctt

SEQ ID NO: 57060 - DNA, 25 bp, Homo sapien
ctgactttgaagacccattagtaat

SEQ ID NO: 57061 - DNA, 25 bp, Homo sapien
ctgactttgaagactcattagtaat

SEQ ID NO: 57062 - DNA, 25 bp, Homo sapien
ctgactttgcaaaatgcttctgtta

SEQ ID NO: 57063 - DNA, 25 bp, Homo sapien
ctgactttgctcacagtgggctttt

SEQ ID NO: 57064 - DNA, 25 bp, Homo sapien
ctgactttggtcacagtgggctttt

SEQ ID NO: 57065 - DNA, 25 bp, Homo sapien
ctgacttttatacaatggcttttta

SEQ ID NO: 57066 - DNA, 25 bp, Homo sapien
ctgagaaaacaagtaagttacagtt

SEQ ID NO: 57067 - DNA, 25 bp, Homo sapien
ctgagaaaataagtaagttacagtt

SEQ ID NO: 57068 - DNA, 25 bp, Homo sapien
ctgagaaagttcacataactgcaaa

SEQ ID NO: 57069 - DNA, 25 bp, Homo sapien
ctgagaaagttcatataactgcaaa

SEQ ID NO: 57070 - DNA, 25 bp, Homo sapien
ctgagaaataccaaagtcctcaaag

SEQ ID NO: 57071 - DNA, 25 bp, Homo sapien
ctgagaaataccaaggtcctcaaag

SEQ ID NO: 57072 - DNA, 25 bp, Homo sapien
ctgagaaatagcaacaaagatttct

SEQ ID NO: 57073 - DNA, 25 bp, Homo sapien
ctgagaaatagcagcaaagatttct

SEQ ID NO: 57074 - DNA, 25 bp, Homo sapien
ctgagaaatgatcaggctaaatcgc

SEQ ID NO: 57075 - DNA, 25 bp, Homo sapien
ctgagaaatgatcaggttaaatcgc

SEQ ID NO: 57076 - DNA, 25 bp, Homo sapien
ctgagaaatgatccttggactataa

SEQ ID NO: 57077 - DNA, 25 bp, Homo sapien
ctgagaaattatccttggactataa

SEQ ID NO: 57078 - DNA, 25 bp, Homo sapien
ctgagaactccagaagagcctatca

SEQ ID NO: 57079 - DNA, 25 bp, Homo sapien
ctgagaacttcagaagagcctatca

SEQ ID NO: 57080 - DNA, 25 bp, Homo sapien
ctgagaagatgaatatatacaaatc

SEQ ID NO: 57081 - DNA, 25 bp, Homo sapien
ctgagaagatgaatgtatacaaatc

SEQ ID NO: 57082 - DNA, 25 bp, Homo sapien
ctgagaagcattcggctgattctcc

SEQ ID NO: 57083 - DNA, 25 bp, Homo sapien
ctgagaagcatttggctgattctcc

SEQ ID NO: 57084 - DNA, 25 bp, Homo sapien
ctgagaagggaggatcaatcgcttg

SEQ ID NO: 57085 - DNA, 25 bp, Homo sapien
ctgagaagggaggatcgatcgcttg

SEQ ID NO: 57086 - DNA, 25 bp, Homo sapien
ctgagaatttgcaggtctaacaagt

SEQ ID NO: 57087 - DNA, 25 bp, Homo sapien
ctgagaatttgtaggtctaacaagt

SEQ ID NO: 57088 - DNA, 25 bp, Homo sapien
ctgagacaaatttaagtattagttg

SEQ ID NO: 57089 - DNA, 25 bp, Homo sapien
ctgagacaaatttacgtattagttg

SEQ ID NO: 57090 - DNA, 25 bp, Homo sapien
ctgagacaactcatgaagactctgt

SEQ ID NO: 57091 - DNA, 25 bp, Homo sapien
ctgagacagctcatgaagactctgt

SEQ ID NO: 57092 - DNA, 25 bp, Homo sapien
ctgagaccattcactttcctttaat

SEQ ID NO: 57093 - DNA, 25 bp, Homo sapien
ctgagaccattcattttcctttaat

SEQ ID NO: 57094 - DNA, 25 bp, Homo sapien
ctgagacccgctgtgtttccaccaa

SEQ ID NO: 57095 - DNA, 25 bp, Homo sapien
ctgagaccctttgtcaccctatgat

SEQ ID NO: 57096 - DNA, 25 bp, Homo sapien
ctgagaccctttttcaccctatgat

SEQ ID NO: 57097 - DNA, 25 bp, Homo sapien
ctgagacctgctgtgtttccaccaa

SEQ ID NO: 57098 - DNA, 25 bp, Homo sapien
ctgagactccgcataccagacgggt

SEQ ID NO: 57099 - DNA, 25 bp, Homo sapien
ctgagactccgtataccagacgggt

SEQ ID NO: 57100 - DNA, 25 bp, Homo sapien
ctgagacttaggcgagccaggcaat

SEQ ID NO: 57101 - DNA, 25 bp, Homo sapien
ctgagactttggcgagccaggcaat

SEQ ID NO: 57102 - DNA, 25 bp, Homo sapien
ctgagagaaaataaagagttatatc

SEQ ID NO: 57103 - DNA, 25 bp, Homo sapien
ctgagagaaaataacgagttatatc

SEQ ID NO: 57104 - DNA, 25 bp, Homo sapien
ctgagagatcattaagcatcactct

SEQ ID NO: 57105 - DNA, 25 bp, Homo sapien
ctgagagattattaagcatcactct

SEQ ID NO: 57106 - DNA, 25 bp, Homo sapien
ctgagagatttttatgcgtggattc

SEQ ID NO: 57107 - DNA, 25 bp, Homo sapien
ctgagagatttttatgtgtggattc

SEQ ID NO: 57108 - DNA, 25 bp, Homo sapien
ctgagagcaacttttgacagaagca

SEQ ID NO: 57109 - DNA, 25 bp, Homo sapien
ctgagagcaccacaagaaagatcac

SEQ ID NO: 57110 - DNA, 25 bp, Homo sapien
ctgagagcaccacaaggaagatcac

SEQ ID NO: 57111 - DNA, 25 bp, Homo sapien
ctgagagcagcttttgacagaagca

SEQ ID NO: 57112 - DNA, 25 bp, Homo sapien
ctgagagcattgttaggagagtgaa

SEQ ID NO: 57113 - DNA, 25 bp, Homo sapien
ctgagagcgttgttaggagagtgaa

SEQ ID NO: 57114 - DNA, 25 bp, Homo sapien
ctgagaggtcttgaggatatctaga

SEQ ID NO: 57115 - DNA, 25 bp, Homo sapien
ctgagaggtcttgcggatatctaga

SEQ ID NO: 57116 - DNA, 25 bp, Homo sapien
ctgagaggtggtataacatctagtt

SEQ ID NO: 57117 - DNA, 25 bp, Homo sapien
ctgagaggtggtataatatctagtt

SEQ ID NO: 57118 - DNA, 25 bp, Homo sapien
ctgagataaggataaacatataaat

SEQ ID NO: 57119 - DNA, 25 bp, Homo sapien
ctgagatagggataaacatataaat

SEQ ID NO: 57120 - DNA, 25 bp, Homo sapien
ctgagatatacactgttttgccttt

SEQ ID NO: 57121 - DNA, 25 bp, Homo sapien
ctgagatattcactgttttgccttt

SEQ ID NO: 57122 - DNA, 25 bp, Homo sapien
ctgagatcacgcaattatcaataac

SEQ ID NO: 57123 - DNA, 25 bp, Homo sapien
ctgagatcatgcaattatcaataac

SEQ ID NO: 57124 - DNA, 25 bp, Homo sapien
ctgagatgagacaaaaatgtttact

SEQ ID NO: 57125 - DNA, 25 bp, Homo sapien
ctgagatgagaccaaaatgtttact

SEQ ID NO: 57126 - DNA, 25 bp, Homo sapien
ctgagatgattcgatttgcatttga

SEQ ID NO: 57127 - DNA, 25 bp, Homo sapien
ctgagatgatttgatttgcatttga

SEQ ID NO: 57128 - DNA, 25 bp, Homo sapien
ctgagatgcctttgagaaaaatggt

SEQ ID NO: 57129 - DNA, 25 bp, Homo sapien
ctgagatgcctttgaggaaaatggt

SEQ ID NO: 57130 - DNA, 25 bp, Homo sapien
ctgagattacgatatccattgacat

SEQ ID NO: 57131 - DNA, 25 bp, Homo sapien
ctgagattatgatatccattgacat

SEQ ID NO: 57132 - DNA, 25 bp, Homo sapien
ctgagcaacatgactgagtattcca

SEQ ID NO: 57133 - DNA, 25 bp, Homo sapien
ctgagcaacccaaagctggatgtgg

SEQ ID NO: 57134 - DNA, 25 bp, Homo sapien
ctgagcaacccgaagctggatgtgg

SEQ ID NO: 57135 - DNA, 25 bp, Homo sapien
ctgagcaacgtgactgagtattcca

SEQ ID NO: 57136 - DNA, 25 bp, Homo sapien
ctgagcatctcagaatagccctctt

SEQ ID NO: 57137 - DNA, 25 bp, Homo sapien
ctgagcatgtcagaatagccctctt

SEQ ID NO: 57138 - DNA, 25 bp, Homo sapien
ctgagccaatcagattgtctttcgc

SEQ ID NO: 57139 - DNA, 25 bp, Homo sapien
ctgagccaatcggattgtctttcgc

SEQ ID NO: 57140 - DNA, 25 bp, Homo sapien
ctgagccacaaacgcctacaactaa

SEQ ID NO: 57141 - DNA, 25 bp, Homo sapien
ctgagccacaaatgcctacaactaa

SEQ ID NO: 57142 - DNA, 25 bp, Homo sapien
ctgagccagaaaattccttcagtga

SEQ ID NO: 57143 - DNA, 25 bp, Homo sapien
ctgagccagaaatttccttcagtga

SEQ ID NO: 57144 - DNA, 25 bp, Homo sapien
ctgagccagctgtgatactatttat

SEQ ID NO: 57145 - DNA, 25 bp, Homo sapien
ctgagccagttgtgatactatttat

SEQ ID NO: 57146 - DNA, 25 bp, Homo sapien
ctgagccataacatcctttctcata

SEQ ID NO: 57147 - DNA, 25 bp, Homo sapien
ctgagccataatatcctttctcata

SEQ ID NO: 57148 - DNA, 25 bp, Homo sapien
ctgagccatattacctgagcccaat

SEQ ID NO: 57149 - DNA, 25 bp, Homo sapien
ctgagccatattccctgagcccaat

SEQ ID NO: 57150 - DNA, 25 bp, Homo sapien
ctgagcccatttccattagtatctt

SEQ ID NO: 57151 - DNA, 25 bp, Homo sapien
ctgagcccatttcgattagtatctt

SEQ ID NO: 57152 - DNA, 25 bp, Homo sapien
ctgagcctctatattttcatttcta

SEQ ID NO: 57153 - DNA, 25 bp, Homo sapien
ctgagcctctatgttttcatttcta

SEQ ID NO: 57154 - DNA, 25 bp, Homo sapien
ctgagccttcaatcttctaagatca

SEQ ID NO: 57155 - DNA, 25 bp, Homo sapien
ctgagccttcagtcttctaagatca

SEQ ID NO: 57156 - DNA, 25 bp, Homo sapien
ctgagcgagtactgggtagcctgat

SEQ ID NO: 57157 - DNA, 25 bp, Homo sapien
ctgagcgattactgggtagcctgat

SEQ ID NO: 57158 - DNA, 25 bp, Homo sapien
ctgagcgtaacccactccacttcca

SEQ ID NO: 57159 - DNA, 25 bp, Homo sapien
ctgagcgtaacccgctccacttcca

SEQ ID NO: 57160 - DNA, 25 bp, Homo sapien
ctgagcgtccactctgtgcctggct

SEQ ID NO: 57161 - DNA, 25 bp, Homo sapien
ctgagcgtctactctgtgcctggct

SEQ ID NO: 57162 - DNA, 25 bp, Homo sapien
ctgagctataaccacattcacgtgg

SEQ ID NO: 57163 - DNA, 25 bp, Homo sapien
ctgagctataacgacattcacgtgg

SEQ ID NO: 57164 - DNA, 25 bp, Homo sapien
ctgagctcaaacatcccaaggtcaa

SEQ ID NO: 57165 - DNA, 25 bp, Homo sapien
ctgagctcaaagatcccaaggtcaa

SEQ ID NO: 57166 - DNA, 25 bp, Homo sapien
ctgagctcaaattgccatgtctttg

SEQ ID NO: 57167 - DNA, 25 bp, Homo sapien
ctgagctcaaattgccgtgtctttg

SEQ ID NO: 57168 - DNA, 25 bp, Homo sapien
ctgagctcatatgatacgccaagca

SEQ ID NO: 57169 - DNA, 25 bp, Homo sapien
ctgagctcatatgatatgccaagca

SEQ ID NO: 57170 - DNA, 25 bp, Homo sapien
ctgagctcatgttgtcacaagcaga

SEQ ID NO: 57171 - DNA, 25 bp, Homo sapien
ctgagctccccatagatgaaatgct

SEQ ID NO: 57172 - DNA, 25 bp, Homo sapien
ctgagctccccatggatgaaatgct

SEQ ID NO: 57173 - DNA, 25 bp, Homo sapien
ctgagctctgccagataatgctcta

SEQ ID NO: 57174 - DNA, 25 bp, Homo sapien
ctgagctctgccagatgatgctcta

SEQ ID NO: 57175 - DNA, 25 bp, Homo sapien
ctgagctcttgttgtcacaagcaga

SEQ ID NO: 57176 - DNA, 25 bp, Homo sapien
ctgagctctttatttctatacactt

SEQ ID NO: 57177 - DNA, 25 bp, Homo sapien
ctgagctctttgtttctatacactt

SEQ ID NO: 57178 - DNA, 25 bp, Homo sapien
ctgagctgcgactcaggctgtgcct

SEQ ID NO: 57179 - DNA, 25 bp, Homo sapien
ctgagctgtcacacgtgctgctaga

SEQ ID NO: 57180 - DNA, 25 bp, Homo sapien
ctgagctgtcacatgtgctgctaga

SEQ ID NO: 57181 - DNA, 25 bp, Homo sapien
ctgagctgtcccgcgtgtggtgatt

SEQ ID NO: 57182 - DNA, 25 bp, Homo sapien
ctgagctgtcctgcgtgtggtgatt

SEQ ID NO: 57183 - DNA, 25 bp, Homo sapien
ctgagctgtgactcaggctgtgcct

SEQ ID NO: 57184 - DNA, 25 bp, Homo sapien
ctgagcttagaatgcagatcactcc

SEQ ID NO: 57185 - DNA, 25 bp, Homo sapien
ctgagcttagaatgtagatcactcc

SEQ ID NO: 57186 - DNA, 25 bp, Homo sapien
ctgagcttcctaacctatactggat

SEQ ID NO: 57187 - DNA, 25 bp, Homo sapien
ctgagcttcgtaacctatactggat

SEQ ID NO: 57188 - DNA, 25 bp, Homo sapien
ctgaggaaactggactaatgagctg

SEQ ID NO: 57189 - DNA, 25 bp, Homo sapien
ctgaggaaactggacttatgagctg

SEQ ID NO: 57190 - DNA, 25 bp, Homo sapien
ctgaggaaccttcataatgctttct

SEQ ID NO: 57191 - DNA, 25 bp, Homo sapien
ctgaggaaccttcctaatgctttct

SEQ ID NO: 57192 - DNA, 25 bp, Homo sapien
ctgaggaactgaatgccagggtaag

SEQ ID NO: 57193 - DNA, 25 bp, Homo sapien
ctgaggaactgctgaccaaggggtc

SEQ ID NO: 57194 - DNA, 25 bp, Homo sapien
ctgaggaattgaatgccagggtaag

SEQ ID NO: 57195 - DNA, 25 bp, Homo sapien
ctgaggaattgctgaccaaggggtc

SEQ ID NO: 57196 - DNA, 25 bp, Homo sapien
ctgaggacaagacatgttgacaaac

SEQ ID NO: 57197 - DNA, 25 bp, Homo sapien
ctgaggacaagatatgttgacaaac

SEQ ID NO: 57198 - DNA, 25 bp, Homo sapien
ctgaggacattacgctagtgaaata

SEQ ID NO: 57199 - DNA, 25 bp, Homo sapien
ctgaggacattatgctagtgaaata

SEQ ID NO: 57200 - DNA, 25 bp, Homo sapien
ctgaggagaacaagacaaagtcctg

SEQ ID NO: 57201 - DNA, 25 bp, Homo sapien
ctgaggagaacaaggcaaagtcctg

SEQ ID NO: 57202 - DNA, 25 bp, Homo sapien
ctgaggagaacacgctgtgctcaga

SEQ ID NO: 57203 - DNA, 25 bp, Homo sapien
ctgaggagaacatgctgtgctcaga

SEQ ID NO: 57204 - DNA, 25 bp, Homo sapien
ctgaggatcgaaaacagaactaaca

SEQ ID NO: 57205 - DNA, 25 bp, Homo sapien
ctgaggattgaaaacagaactaaca

SEQ ID NO: 57206 - DNA, 25 bp, Homo sapien
ctgaggatttaaacggtacagacag

SEQ ID NO: 57207 - DNA, 25 bp, Homo sapien
ctgaggatttaaactgtacagacag

SEQ ID NO: 57208 - DNA, 25 bp, Homo sapien
ctgaggcactgaaaacctaaatttc

SEQ ID NO: 57209 - DNA, 25 bp, Homo sapien
ctgaggcactgaatacctaaatttc

SEQ ID NO: 57210 - DNA, 25 bp, Homo sapien
ctgaggccacaaagttaactgtatg

SEQ ID NO: 57211 - DNA, 25 bp, Homo sapien
ctgaggccagaaagttaactgtatg

SEQ ID NO: 57212 - DNA, 25 bp, Homo sapien
ctgaggctagcaagcaaaacacctc

SEQ ID NO: 57213 - DNA, 25 bp, Homo sapien
ctgaggctagcacgcaaaacacctc

SEQ ID NO: 57214 - DNA, 25 bp, Homo sapien
ctgaggctctcttagaatactgcaa

SEQ ID NO: 57215 - DNA, 25 bp, Homo sapien
ctgaggctgtcttagaatactgcaa

SEQ ID NO: 57216 - DNA, 25 bp, Homo sapien
ctgagggaggaacagtcacttctgg

SEQ ID NO: 57217 - DNA, 25 bp, Homo sapien
ctgagggaggaacagtgacttctgg

SEQ ID NO: 57218 - DNA, 25 bp, Homo sapien
ctgagggatgcataataattttccg

SEQ ID NO: 57219 - DNA, 25 bp, Homo sapien
ctgagggatgcataatgattttccg

SEQ ID NO: 57220 - DNA, 25 bp, Homo sapien
ctgaggtcacgtgataccaacaagg

SEQ ID NO: 57221 - DNA, 25 bp, Homo sapien
ctgaggtcacgtgatatcaacaagg

SEQ ID NO: 57222 - DNA, 25 bp, Homo sapien
ctgaggtctcacaaaatgtcagatt

SEQ ID NO: 57223 - DNA, 25 bp, Homo sapien
ctgaggtctcacgaaatgtcagatt

SEQ ID NO: 57224 - DNA, 25 bp, Homo sapien
ctgaggtctgataaaaagtttgttg

SEQ ID NO: 57225 - DNA, 25 bp, Homo sapien
ctgaggtctgataaaacgtttgttg

SEQ ID NO: 57226 - DNA, 25 bp, Homo sapien
ctgaggttaaacagccagcaagggg

SEQ ID NO: 57227 - DNA, 25 bp, Homo sapien
ctgaggttaaacggccagcaagggg

SEQ ID NO: 57228 - DNA, 25 bp, Homo sapien
ctgaggttattttcaccctcctgtc

SEQ ID NO: 57229 - DNA, 25 bp, Homo sapien
ctgaggttattttcactctcctgtc

SEQ ID NO: 57230 - DNA, 25 bp, Homo sapien
ctgaggttctgcacctactgattca

SEQ ID NO: 57231 - DNA, 25 bp, Homo sapien
ctgaggttctgcatctactgattca

SEQ ID NO: 57232 - DNA, 25 bp, Homo sapien
ctgaggttgtgcgtttaagaagact

SEQ ID NO: 57233 - DNA, 25 bp, Homo sapien
ctgaggttgtgtgtttaagaagact

SEQ ID NO: 57234 - DNA, 25 bp, Homo sapien
ctgagtaaggagactgattggactt

SEQ ID NO: 57235 - DNA, 25 bp, Homo sapien
ctgagtaaggagattgattggactt

SEQ ID NO: 57236 - DNA, 25 bp, Homo sapien
ctgagtacatttccgggtcggctaa

SEQ ID NO: 57237 - DNA, 25 bp, Homo sapien
ctgagtacatttctgggtcggctaa

SEQ ID NO: 57238 - DNA, 25 bp, Homo sapien
ctgagtaggagactggaaggaagga

SEQ ID NO: 57239 - DNA, 25 bp, Homo sapien
ctgagtaggagattggaaggaagga

SEQ ID NO: 57240 - DNA, 25 bp, Homo sapien
ctgagtcacagagtacaaacagaaa

SEQ ID NO: 57241 - DNA, 25 bp, Homo sapien
ctgagtcacaggggcaggcgtgggc

SEQ ID NO: 57242 - DNA, 25 bp, Homo sapien
ctgagtcacgggggcaggcgtgggc

SEQ ID NO: 57243 - DNA, 25 bp, Homo sapien
ctgagtcactgattgatgtaaactt

SEQ ID NO: 57244 - DNA, 25 bp, Homo sapien
ctgagtcacttctcagcaacatctc

SEQ ID NO: 57245 - DNA, 25 bp, Homo sapien
ctgagtcacttttcagcaacatctc

SEQ ID NO: 57246 - DNA, 25 bp, Homo sapien
ctgagtcagtgattgatgtaaactt

SEQ ID NO: 57247 - DNA, 25 bp, Homo sapien
ctgagtcatagagtacaaacagaaa

SEQ ID NO: 57248 - DNA, 25 bp, Homo sapien
ctgagtcatttttaattctctgagc

SEQ ID NO: 57249 - DNA, 25 bp, Homo sapien
ctgagtcatttttatttctctgagc

SEQ ID NO: 57250 - DNA, 25 bp, Homo sapien
ctgagtccacagtgagtaattaata

SEQ ID NO: 57251 - DNA, 25 bp, Homo sapien
ctgagtccagagtgagtaattaata

SEQ ID NO: 57252 - DNA, 25 bp, Homo sapien
ctgagtctcgctccaaggctagagt

SEQ ID NO: 57253 - DNA, 25 bp, Homo sapien
ctgagtctctgctgctctgatgaag

SEQ ID NO: 57254 - DNA, 25 bp, Homo sapien
ctgagtctctgctgttctgatgaag

SEQ ID NO: 57255 - DNA, 25 bp, Homo sapien
ctgagtctgattctcacaaatggcc

SEQ ID NO: 57256 - DNA, 25 bp, Homo sapien
ctgagtctgattctcataaatggcc

SEQ ID NO: 57257 - DNA, 25 bp, Homo sapien
ctgagtcttgctccaaggctagagt

SEQ ID NO: 57258 - DNA, 25 bp, Homo sapien
ctgagtgaaggttgatatcattttc

SEQ ID NO: 57259 - DNA, 25 bp, Homo sapien
ctgagtgaaggttggtatcattttc

SEQ ID NO: 57260 - DNA, 25 bp, Homo sapien
ctgagtgacaatttatcatatccat

SEQ ID NO: 57261 - DNA, 25 bp, Homo sapien
ctgagtgacaatttattatatccat

SEQ ID NO: 57262 - DNA, 25 bp, Homo sapien
ctgagtgatacatagaatacaatga

SEQ ID NO: 57263 - DNA, 25 bp, Homo sapien
ctgagtgatacatagactacaatga

SEQ ID NO: 57264 - DNA, 25 bp, Homo sapien
ctgagtgcatagcaaacaacaacat

SEQ ID NO: 57265 - DNA, 25 bp, Homo sapien
ctgagtgcatagcagacaacaacat

SEQ ID NO: 57266 - DNA, 25 bp, Homo sapien
ctgagtgctttccatttgctaattc

SEQ ID NO: 57267 - DNA, 25 bp, Homo sapien
ctgagtgctttccgtttgctaattc

SEQ ID NO: 57268 - DNA, 25 bp, Homo sapien
ctgagttacaggtaaaaactgaaat

SEQ ID NO: 57269 - DNA, 25 bp, Homo sapien
ctgagttacaggtagaaactgaaat

SEQ ID NO: 57270 - DNA, 25 bp, Homo sapien
ctgagttcaaatcatgactttgcca

SEQ ID NO: 57271 - DNA, 25 bp, Homo sapien
ctgagttcaaatcgtgactttgcca

SEQ ID NO: 57272 - DNA, 25 bp, Homo sapien
ctgagttctacatgagcctctcatg

SEQ ID NO: 57273 - DNA, 25 bp, Homo sapien
ctgagttctatctaccttctttaca

SEQ ID NO: 57274 - DNA, 25 bp, Homo sapien
ctgagttctgtctaccttctttaca

SEQ ID NO: 57275 - DNA, 25 bp, Homo sapien
ctgagttcttcatgagcctctcatg

SEQ ID NO: 57276 - DNA, 25 bp, Homo sapien
ctgagttgaaatcccagttctgcta

SEQ ID NO: 57277 - DNA, 25 bp, Homo sapien
ctgagttggaatcccagttctgcta

SEQ ID NO: 57278 - DNA, 25 bp, Homo sapien
ctgagtttggtatgatcattaggtg

SEQ ID NO: 57279 - DNA, 25 bp, Homo sapien
ctgagtttggtgtgatcattaggtg

SEQ ID NO: 57280 - DNA, 25 bp, Homo sapien
ctgataaaaagtttgttggattaat

SEQ ID NO: 57281 - DNA, 25 bp, Homo sapien
ctgataaaacgaggagactgctggg

SEQ ID NO: 57282 - DNA, 25 bp, Homo sapien
ctgataaaacgtttgttggattaat

SEQ ID NO: 57283 - DNA, 25 bp, Homo sapien
ctgataaaaggaggagactgctggg

SEQ ID NO: 57284 - DNA, 25 bp, Homo sapien
ctgataaacagactcacctgtccat

SEQ ID NO: 57285 - DNA, 25 bp, Homo sapien
ctgataaaccctatggtctttgtca

SEQ ID NO: 57286 - DNA, 25 bp, Homo sapien
ctgataaatagactcacctgtccat

SEQ ID NO: 57287 - DNA, 25 bp, Homo sapien
ctgataaatcctatggtctttgtca

SEQ ID NO: 57288 - DNA, 25 bp, Homo sapien
ctgataacttctatatctaaaaatg

SEQ ID NO: 57289 - DNA, 25 bp, Homo sapien
ctgataacttctgtatctaaaaatg

SEQ ID NO: 57290 - DNA, 25 bp, Homo sapien
ctgataagaaagcccgggtgtttcc

SEQ ID NO: 57291 - DNA, 25 bp, Homo sapien
ctgataagaaagcctgggtgtttcc

SEQ ID NO: 57292 - DNA, 25 bp, Homo sapien
ctgataagctaacaagaatcaacat

SEQ ID NO: 57293 - DNA, 25 bp, Homo sapien
ctgataagctaataagaatcaacat

SEQ ID NO: 57294 - DNA, 25 bp, Homo sapien
ctgataagtagaggacagctgaacc

SEQ ID NO: 57295 - DNA, 25 bp, Homo sapien
ctgataagtagagggcagctgaacc

SEQ ID NO: 57296 - DNA, 25 bp, Homo sapien
ctgataatgccccagtttggcttcc

SEQ ID NO: 57297 - DNA, 25 bp, Homo sapien
ctgataatgccccggtttggcttcc

SEQ ID NO: 57298 - DNA, 25 bp, Homo sapien
ctgatacacttttttgcagatgtaa

SEQ ID NO: 57299 - DNA, 25 bp, Homo sapien
ctgatacatttttttgcagatgtaa

SEQ ID NO: 57300 - DNA, 25 bp, Homo sapien
ctgatacctgacaaaagagattcta

SEQ ID NO: 57301 - DNA, 25 bp, Homo sapien
ctgatacctgacgaaagagattcta

SEQ ID NO: 57302 - DNA, 25 bp, Homo sapien
ctgatactaatatagccattcctgc

SEQ ID NO: 57303 - DNA, 25 bp, Homo sapien
ctgatactagtatagccattcctgc

SEQ ID NO: 57304 - DNA, 25 bp, Homo sapien
ctgatagaatacatgttccatgaag

SEQ ID NO: 57305 - DNA, 25 bp, Homo sapien
ctgatagactacatgttccatgaag

SEQ ID NO: 57306 - DNA, 25 bp, Homo sapien
ctgatagatcctcacattcattccc

SEQ ID NO: 57307 - DNA, 25 bp, Homo sapien
ctgatagatcctcagattcattccc

SEQ ID NO: 57308 - DNA, 25 bp, Homo sapien
ctgatatattggaacaattaatatg

SEQ ID NO: 57309 - DNA, 25 bp, Homo sapien
ctgatatattgtaacaattaatatg

SEQ ID NO: 57310 - DNA, 25 bp, Homo sapien
ctgatatgtaccattgcaacttgga

SEQ ID NO: 57311 - DNA, 25 bp, Homo sapien
ctgatatgtaccattgtaacttgga

SEQ ID NO: 57312 - DNA, 25 bp, Homo sapien
ctgatattgatcaccttattaccta

SEQ ID NO: 57313 - DNA, 25 bp, Homo sapien
ctgatattgattaccttattaccta

SEQ ID NO: 57314 - DNA, 25 bp, Homo sapien
ctgatattgctaaacttctggtatt

SEQ ID NO: 57315 - DNA, 25 bp, Homo sapien
ctgatattgctaatcttctggtatt

SEQ ID NO: 57316 - DNA, 25 bp, Homo sapien
ctgatcaactaccacattcatgcca

SEQ ID NO: 57317 - DNA, 25 bp, Homo sapien
ctgatcaactacgacattcatgcca

SEQ ID NO: 57318 - DNA, 25 bp, Homo sapien
ctgatcacagtgatatatgagtaga

SEQ ID NO: 57319 - DNA, 25 bp, Homo sapien
ctgatcacagtggtatatgagtaga

SEQ ID NO: 57320 - DNA, 25 bp, Homo sapien
ctgatccaaaagccatttctagggc

SEQ ID NO: 57321 - DNA, 25 bp, Homo sapien
ctgatccagaagccatttctagggc

SEQ ID NO: 57322 - DNA, 25 bp, Homo sapien
ctgatccagctgggaaagtgttggg

SEQ ID NO: 57323 - DNA, 25 bp, Homo sapien
ctgatccagctgggaaggtgttggg

SEQ ID NO: 57324 - DNA, 25 bp, Homo sapien
ctgatcccactattgaaataaaaag

SEQ ID NO: 57325 - DNA, 25 bp, Homo sapien
ctgatcccgctattgaaataaaaag

SEQ ID NO: 57326 - DNA, 25 bp, Homo sapien
ctgatctcatttatctccacattct

SEQ ID NO: 57327 - DNA, 25 bp, Homo sapien
ctgatctcatttgtctccacattct

SEQ ID NO: 57328 - DNA, 25 bp, Homo sapien
ctgatctgatacagaaaacttttta

SEQ ID NO: 57329 - DNA, 25 bp, Homo sapien
ctgatctgatagagaaaacttttta

SEQ ID NO: 57330 - DNA, 25 bp, Homo sapien
ctgatcttcaccctgaatgagtaaa

SEQ ID NO: 57331 - DNA, 25 bp, Homo sapien
ctgatcttctccctgaatgagtaaa

SEQ ID NO: 57332 - DNA, 25 bp, Homo sapien
ctgatgaaacccagcgtgtttttaa

SEQ ID NO: 57333 - DNA, 25 bp, Homo sapien
ctgatgaagcccagcgtgtttttaa

SEQ ID NO: 57334 - DNA, 25 bp, Homo sapien
ctgatgaaggctcactctactttca

SEQ ID NO: 57335 - DNA, 25 bp, Homo sapien
ctgatgaaggctcactgtactttca

SEQ ID NO: 57336 - DNA, 25 bp, Homo sapien
ctgatgaatagactagctgcttcca

SEQ ID NO: 57337 - DNA, 25 bp, Homo sapien
ctgatgaatggactagctgcttcca

SEQ ID NO: 57338 - DNA, 25 bp, Homo sapien
ctgatgaatgtactttagaattccc

SEQ ID NO: 57339 - DNA, 25 bp, Homo sapien
ctgatgaatgtcctttagaattccc

SEQ ID NO: 57340 - DNA, 25 bp, Homo sapien
ctgatgacaacgacgatgatgatga

SEQ ID NO: 57341 - DNA, 25 bp, Homo sapien
ctgatgacaacgatgatgatgatga

SEQ ID NO: 57342 - DNA, 25 bp, Homo sapien
ctgatgacctacttaatgttcaatc

SEQ ID NO: 57343 - DNA, 25 bp, Homo sapien
ctgatgactaccacatctataattc

SEQ ID NO: 57344 - DNA, 25 bp, Homo sapien
ctgatgactacctcatctataattc

SEQ ID NO: 57345 - DNA, 25 bp, Homo sapien
ctgatgacttacttaatgttcaatc

SEQ ID NO: 57346 - DNA, 25 bp, Homo sapien
ctgatgagattcttcatggtgcatt

SEQ ID NO: 57347 - DNA, 25 bp, Homo sapien
ctgatgagatttttcatggtgcatt

SEQ ID NO: 57348 - DNA, 25 bp, Homo sapien
ctgatgaggacatcaagctgctttt

SEQ ID NO: 57349 - DNA, 25 bp, Homo sapien
ctgatgagggcatcaagctgctttt

SEQ ID NO: 57350 - DNA, 25 bp, Homo sapien
ctgatgataaatcaagttgagcact

SEQ ID NO: 57351 - DNA, 25 bp, Homo sapien
ctgatgataaatgaagttgagcact

SEQ ID NO: 57352 - DNA, 25 bp, Homo sapien
ctgatgatagaaagccatcacaggc

SEQ ID NO: 57353 - DNA, 25 bp, Homo sapien
ctgatgatagaaggccatcacaggc

SEQ ID NO: 57354 - DNA, 25 bp, Homo sapien
ctgatgcaggggaaatgcagtccaa

SEQ ID NO: 57355 - DNA, 25 bp, Homo sapien
ctgatgcaggggaagtgcagtccaa

SEQ ID NO: 57356 - DNA, 25 bp, Homo sapien
ctgatggcagaaaatttttttcacc

SEQ ID NO: 57357 - DNA, 25 bp, Homo sapien
ctgatggcagaatatttttttcacc

SEQ ID NO: 57358 - DNA, 25 bp, Homo sapien
ctgatggccttgaagcagcctccca

SEQ ID NO: 57359 - DNA, 25 bp, Homo sapien
ctgatggctgtccaagtggttacgg

SEQ ID NO: 57360 - DNA, 25 bp, Homo sapien
ctgatggctgtcgaagtggttacgg

SEQ ID NO: 57361 - DNA, 25 bp, Homo sapien
ctgatggctttgaagcagcctccca

SEQ ID NO: 57362 - DNA, 25 bp, Homo sapien
ctgatggggaatctggacttatttc

SEQ ID NO: 57363 - DNA, 25 bp, Homo sapien
ctgatggggaatttggacttatttc

SEQ ID NO: 57364 - DNA, 25 bp, Homo sapien
ctgatggtactccaaatcaccttat

SEQ ID NO: 57365 - DNA, 25 bp, Homo sapien
ctgatggtactcgaaatcaccttat

SEQ ID NO: 57366 - DNA, 25 bp, Homo sapien
ctgatgtcaaccaggagaatgagtt

SEQ ID NO: 57367 - DNA, 25 bp, Homo sapien
ctgatgtcaacccggagaatgagtt

SEQ ID NO: 57368 - DNA, 25 bp, Homo sapien
ctgatgtcaagattaaaaaattacc

SEQ ID NO: 57369 - DNA, 25 bp, Homo sapien
ctgatgtcatgattaaaaaattacc

SEQ ID NO: 57370 - DNA, 25 bp, Homo sapien
ctgattacctgtctgggatttcttg

SEQ ID NO: 57371 - DNA, 25 bp, Homo sapien
ctgattacctgtcttggatttcttg

SEQ ID NO: 57372 - DNA, 25 bp, Homo sapien
ctgattatacgttctgtactgtttt

SEQ ID NO: 57373 - DNA, 25 bp, Homo sapien
ctgattatatgttctgtactgtttt

SEQ ID NO: 57374 - DNA, 25 bp, Homo sapien
ctgattattcaaaacttaatgtagg

SEQ ID NO: 57375 - DNA, 25 bp, Homo sapien
ctgattattcaaaatttaatgtagg

SEQ ID NO: 57376 - DNA, 25 bp, Homo sapien
ctgattcagtacgaacactggaaat

SEQ ID NO: 57377 - DNA, 25 bp, Homo sapien
ctgattcagtatgaacactggaaat

SEQ ID NO: 57378 - DNA, 25 bp, Homo sapien
ctgattcccagactacaatatggta

SEQ ID NO: 57379 - DNA, 25 bp, Homo sapien
ctgattcccagagtacaatatggta

SEQ ID NO: 57380 - DNA, 25 bp, Homo sapien
ctgattcctaccaccttccagtctg

SEQ ID NO: 57381 - DNA, 25 bp, Homo sapien
ctgattcctacgaccttccagtctg

SEQ ID NO: 57382 - DNA, 25 bp, Homo sapien
ctgattcctataagatttttgtgtc

SEQ ID NO: 57383 - DNA, 25 bp, Homo sapien
ctgattcctctaagatttttgtgtc

SEQ ID NO: 57384 - DNA, 25 bp, Homo sapien
ctgattctatcatgagttactctac

SEQ ID NO: 57385 - DNA, 25 bp, Homo sapien
ctgattctatcctgagttactctac

SEQ ID NO: 57386 - DNA, 25 bp, Homo sapien
ctgattgagtaaacatggcaaagaa

SEQ ID NO: 57387 - DNA, 25 bp, Homo sapien
ctgattgagtaaatatggcaaagaa

SEQ ID NO: 57388 - DNA, 25 bp, Homo sapien
ctgattgcatgagcagatccacgtc

SEQ ID NO: 57389 - DNA, 25 bp, Homo sapien
ctgattgcatgaggagatccacgtc

SEQ ID NO: 57390 - DNA, 25 bp, Homo sapien
ctgattggaacctttgaataaatgg

SEQ ID NO: 57391 - DNA, 25 bp, Homo sapien
ctgattgggaacgttgggtactaaa

SEQ ID NO: 57392 - DNA, 25 bp, Homo sapien
ctgattgggaatgttgggtactaaa

SEQ ID NO: 57393 - DNA, 25 bp, Homo sapien
ctgattgggacctttgaataaatgg

SEQ ID NO: 57394 - DNA, 25 bp, Homo sapien
ctgattgggtagtcaacgcactttg

SEQ ID NO: 57395 - DNA, 25 bp, Homo sapien
ctgattgggtagtcaatgcactttg

SEQ ID NO: 57396 - DNA, 25 bp, Homo sapien
ctgattgtaaacattaatgccatcc

SEQ ID NO: 57397 - DNA, 25 bp, Homo sapien
ctgattgtaaacgttaatgccatcc

SEQ ID NO: 57398 - DNA, 25 bp, Homo sapien
ctgatttaaaactatttatgcagca

SEQ ID NO: 57399 - DNA, 25 bp, Homo sapien
ctgatttaaaagtatttatgcagca

SEQ ID NO: 57400 - DNA, 25 bp, Homo sapien
ctgatttaaaatcctgcttctgcaa

SEQ ID NO: 57401 - DNA, 25 bp, Homo sapien
ctgatttaaactcaatgtaacaaat

SEQ ID NO: 57402 - DNA, 25 bp, Homo sapien
ctgatttacaatcgagaccactaca

SEQ ID NO: 57403 - DNA, 25 bp, Homo sapien
ctgatttacaattgagaccactaca

SEQ ID NO: 57404 - DNA, 25 bp, Homo sapien
ctgatttagaatcctgcttctgcaa

SEQ ID NO: 57405 - DNA, 25 bp, Homo sapien
ctgatttagactcaatgtaacaaat

SEQ ID NO: 57406 - DNA, 25 bp, Homo sapien
ctgatttagttgcaagatgtaaaaa

SEQ ID NO: 57407 - DNA, 25 bp, Homo sapien
ctgatttagtttcaagatgtaaaaa

SEQ ID NO: 57408 - DNA, 25 bp, Homo sapien
ctgatttccattctagttctaccca

SEQ ID NO: 57409 - DNA, 25 bp, Homo sapien
ctgatttccattctggttctaccca

SEQ ID NO: 57410 - DNA, 25 bp, Homo sapien
ctgatttgcactacaaaagggaatg

SEQ ID NO: 57411 - DNA, 25 bp, Homo sapien
ctgatttgcgctacaaaagggaatg

SEQ ID NO: 57412 - DNA, 25 bp, Homo sapien
ctgattttaatccgtcaggtttcca

SEQ ID NO: 57413 - DNA, 25 bp, Homo sapien
ctgattttaatctgtcaggtttcca

SEQ ID NO: 57414 - DNA, 25 bp, Homo sapien
ctgattttacgaatagtttccatct

SEQ ID NO: 57415 - DNA, 25 bp, Homo sapien
ctgattttatgaatagtttccatct

SEQ ID NO: 57416 - DNA, 25 bp, Homo sapien
ctgatttttacagtattgcaaacct

SEQ ID NO: 57417 - DNA, 25 bp, Homo sapien
ctgatttttacattattgcaaacct

SEQ ID NO: 57418 - DNA, 25 bp, Homo sapien
ctgatttttgcaccaatgagggaca

SEQ ID NO: 57419 - DNA, 25 bp, Homo sapien
ctgatttttgcacgaatgagggaca

SEQ ID NO: 57420 - DNA, 25 bp, Homo sapien
ctgatttttgtgctgtaaagtgtct

SEQ ID NO: 57421 - DNA, 25 bp, Homo sapien
ctgatttttgttctgtaaagtgtct

SEQ ID NO: 57422 - DNA, 25 bp, Homo sapien
ctgcaaaaaacaaggattttccctt

SEQ ID NO: 57423 - DNA, 25 bp, Homo sapien
ctgcaaaaagcaaggattttccctt

SEQ ID NO: 57424 - DNA, 25 bp, Homo sapien
ctgcaaaaataacgtcaatgctttt

SEQ ID NO: 57425 - DNA, 25 bp, Homo sapien
ctgcaaaaataatgtcaatgctttt

SEQ ID NO: 57426 - DNA, 25 bp, Homo sapien
ctgcaaaatgtgtaatccagcatcc

SEQ ID NO: 57427 - DNA, 25 bp, Homo sapien
ctgcaaaatgtgtagtccagcatcc

SEQ ID NO: 57428 - DNA, 25 bp, Homo sapien
ctgcaaacatactaatggagagtac

SEQ ID NO: 57429 - DNA, 25 bp, Homo sapien
ctgcaaacctactaatggagagtac

SEQ ID NO: 57430 - DNA, 25 bp, Homo sapien
ctgcaaacctcattcttcctggatg

SEQ ID NO: 57431 - DNA, 25 bp, Homo sapien
ctgcaaacctcattgttcctggatg

SEQ ID NO: 57432 - DNA, 25 bp, Homo sapien
ctgcaaagaggaacattgccaaatt

SEQ ID NO: 57433 - DNA, 25 bp, Homo sapien
ctgcaaagaggagcattgccaaatt

SEQ ID NO: 57434 - DNA, 25 bp, Homo sapien
ctgcaaagcattcaagagctggtgg

SEQ ID NO: 57435 - DNA, 25 bp, Homo sapien
ctgcaaagcgttcaagagctggtgg

SEQ ID NO: 57436 - DNA, 25 bp, Homo sapien
ctgcaaagctcacaactccaaaaat

SEQ ID NO: 57437 - DNA, 25 bp, Homo sapien
ctgcaaagctcagaactccaaaaat

SEQ ID NO: 57438 - DNA, 25 bp, Homo sapien
ctgcaaagcttcacctctagggaat

SEQ ID NO: 57439 - DNA, 25 bp, Homo sapien
ctgcaaagcttcgcctctagggaat

SEQ ID NO: 57440 - DNA, 25 bp, Homo sapien
ctgcaaatacctagtactgttggac

SEQ ID NO: 57441 - DNA, 25 bp, Homo sapien
ctgcaaatagctagtactgttggac

SEQ ID NO: 57442 - DNA, 25 bp, Homo sapien
ctgcaaatcgcatcagactgagggc

SEQ ID NO: 57443 - DNA, 25 bp, Homo sapien
ctgcaaatggcatcagactgagggc

SEQ ID NO: 57444 - DNA, 25 bp, Homo sapien
ctgcaacaaaatgccaggtgtagag

SEQ ID NO: 57445 - DNA, 25 bp, Homo sapien
ctgcaacaagaaacattgtccatat

SEQ ID NO: 57446 - DNA, 25 bp, Homo sapien
ctgcaacaagaatcattgtccatat

SEQ ID NO: 57447 - DNA, 25 bp, Homo sapien
ctgcaacagaatgccaggtgtagag

SEQ ID NO: 57448 - DNA, 25 bp, Homo sapien
ctgcaacttggagcctcgtgagtgc

SEQ ID NO: 57449 - DNA, 25 bp, Homo sapien
ctgcaacttggagccttgtgagtgc

SEQ ID NO: 57450 - DNA, 25 bp, Homo sapien
ctgcaagacataatcctctttaccc

SEQ ID NO: 57451 - DNA, 25 bp, Homo sapien
ctgcaagactgcaagaaatacctaa

SEQ ID NO: 57452 - DNA, 25 bp, Homo sapien
ctgcaagactgcgagaaatacctaa

SEQ ID NO: 57453 - DNA, 25 bp, Homo sapien
ctgcaagagacaaggaatatcatga

SEQ ID NO: 57454 - DNA, 25 bp, Homo sapien
ctgcaagagaccaggaatatcatga

SEQ ID NO: 57455 - DNA, 25 bp, Homo sapien
ctgcaagagccaagcattactgggc

SEQ ID NO: 57456 - DNA, 25 bp, Homo sapien
ctgcaagagtgctcttgtttcacac

SEQ ID NO: 57457 - DNA, 25 bp, Homo sapien
ctgcaagagtggtcttgtttcacac

SEQ ID NO: 57458 - DNA, 25 bp, Homo sapien
ctgcaagatataatcctctttaccc

SEQ ID NO: 57459 - DNA, 25 bp, Homo sapien
ctgcaagatccaagcattactgggc

SEQ ID NO: 57460 - DNA, 25 bp, Homo sapien
ctgcaagccaatgaggtccacagcc

SEQ ID NO: 57461 - DNA, 25 bp, Homo sapien
ctgcaagccgatgaggtccacagcc

SEQ ID NO: 57462 - DNA, 25 bp, Homo sapien
ctgcaaggaatttgcccaacaaagg

SEQ ID NO: 57463 - DNA, 25 bp, Homo sapien
ctgcaaggaattttcccaacaaagg

SEQ ID NO: 57464 - DNA, 25 bp, Homo sapien
ctgcaagggatccattttcaggtag

SEQ ID NO: 57465 - DNA, 25 bp, Homo sapien
ctgcaagggcttcttcctcaaatat

SEQ ID NO: 57466 - DNA, 25 bp, Homo sapien
ctgcaagggcttcttcttcaaatat

SEQ ID NO: 57467 - DNA, 25 bp, Homo sapien
ctgcaaggggtccattttcaggtag

SEQ ID NO: 57468 - DNA, 25 bp, Homo sapien
ctgcaatagcataaaccagtacaca

SEQ ID NO: 57469 - DNA, 25 bp, Homo sapien
ctgcaatagcatgaaccagtacaca

SEQ ID NO: 57470 - DNA, 25 bp, Homo sapien
ctgcaatatacgcggaatgtcttaa

SEQ ID NO: 57471 - DNA, 25 bp, Homo sapien
ctgcaatatacgtggaatgtcttaa

SEQ ID NO: 57472 - DNA, 25 bp, Homo sapien
ctgcaattatttgaacctgtctttt

SEQ ID NO: 57473 - DNA, 25 bp, Homo sapien
ctgcaattatttgaacttgtctttt

SEQ ID NO: 57474 - DNA, 25 bp, Homo sapien
ctgcacaaagatactaataacaaac

SEQ ID NO: 57475 - DNA, 25 bp, Homo sapien
ctgcacaaagatgctaataacaaac

SEQ ID NO: 57476 - DNA, 25 bp, Homo sapien
ctgcacacatgttctccaagaagca

SEQ ID NO: 57477 - DNA, 25 bp, Homo sapien
ctgcacacgtgttctccaagaagca

SEQ ID NO: 57478 - DNA, 25 bp, Homo sapien
ctgcacactcgtgaaacagttccta

SEQ ID NO: 57479 - DNA, 25 bp, Homo sapien
ctgcacacttgtgaaacagttccta

SEQ ID NO: 57480 - DNA, 25 bp, Homo sapien
ctgcacacttgttaccctaacacta

SEQ ID NO: 57481 - DNA, 25 bp, Homo sapien
ctgcacacttgtttccctaacacta

SEQ ID NO: 57482 - DNA, 25 bp, Homo sapien
ctgcacagaagaagagagaagtcag

SEQ ID NO: 57483 - DNA, 25 bp, Homo sapien
ctgcacagaagaagagggaagtcag

SEQ ID NO: 57484 - DNA, 25 bp, Homo sapien
ctgcacagatcaaaagtgtcgaact

SEQ ID NO: 57485 - DNA, 25 bp, Homo sapien
ctgcacagatcgaaagtgtcgaact

SEQ ID NO: 57486 - DNA, 25 bp, Homo sapien
ctgcacagcttaagggtcagcgtcc

SEQ ID NO: 57487 - DNA, 25 bp, Homo sapien
ctgcacagcttaggggtcagcgtcc

SEQ ID NO: 57488 - DNA, 25 bp, Homo sapien
ctgcacagtcacactgctgtactta

SEQ ID NO: 57489 - DNA, 25 bp, Homo sapien
ctgcacagtcacattgctgtactta

SEQ ID NO: 57490 - DNA, 25 bp, Homo sapien
ctgcacattgtattcaccttgggag

SEQ ID NO: 57491 - DNA, 25 bp, Homo sapien
ctgcacattgtattgaccttgggag

SEQ ID NO: 57492 - DNA, 25 bp, Homo sapien
ctgcaccagataagctatgctaaca

SEQ ID NO: 57493 - DNA, 25 bp, Homo sapien
ctgcaccagataggctatgctaaca

SEQ ID NO: 57494 - DNA, 25 bp, Homo sapien
ctgcacctctccggcaccaccacca

SEQ ID NO: 57495 - DNA, 25 bp, Homo sapien
ctgcacctctcctgcaccaccacca

SEQ ID NO: 57496 - DNA, 25 bp, Homo sapien
ctgcaccttctaccttaaactctct

SEQ ID NO: 57497 - DNA, 25 bp, Homo sapien
ctgcaccttctaccttcaactctct

SEQ ID NO: 57498 - DNA, 25 bp, Homo sapien
ctgcactagacatttttttctgatc

SEQ ID NO: 57499 - DNA, 25 bp, Homo sapien
ctgcactagaccaactgtaagagtg

SEQ ID NO: 57500 - DNA, 25 bp, Homo sapien
ctgcactagactaactgtaagagtg

SEQ ID NO: 57501 - DNA, 25 bp, Homo sapien
ctgcactatacatttttttctgatc

SEQ ID NO: 57502 - DNA, 25 bp, Homo sapien
ctgcactgaatactatctgcgaaat

SEQ ID NO: 57503 - DNA, 25 bp, Homo sapien
ctgcactgaatcctatctgcgaaat

SEQ ID NO: 57504 - DNA, 25 bp, Homo sapien
ctgcactgctgctttcctatgattg

SEQ ID NO: 57505 - DNA, 25 bp, Homo sapien
ctgcactgctgttttcctatgattg

SEQ ID NO: 57506 - DNA, 25 bp, Homo sapien
ctgcacttcatttaaatgcttatat

SEQ ID NO: 57507 - DNA, 25 bp, Homo sapien
ctgcactttatttaaatgcttatat

SEQ ID NO: 57508 - DNA, 25 bp, Homo sapien
ctgcagaaacggacccagcagagca

SEQ ID NO: 57509 - DNA, 25 bp, Homo sapien
ctgcagaaacggactcagcagagca

SEQ ID NO: 57510 - DNA, 25 bp, Homo sapien
ctgcagagaccctgtgagcaacagg

SEQ ID NO: 57511 - DNA, 25 bp, Homo sapien
ctgcagagaccctgtgggcaacagg

SEQ ID NO: 57512 - DNA, 25 bp, Homo sapien
ctgcagaggcacaactgatggcaag

SEQ ID NO: 57513 - DNA, 25 bp, Homo sapien
ctgcagaggcacacctgatggcaag

SEQ ID NO: 57514 - DNA, 25 bp, Homo sapien
ctgcagagtccaagaactgttgatc

SEQ ID NO: 57515 - DNA, 25 bp, Homo sapien
ctgcagagtccaagtactgttgatc

SEQ ID NO: 57516 - DNA, 25 bp, Homo sapien
ctgcagccaaagagctagttctcct

SEQ ID NO: 57517 - DNA, 25 bp, Homo sapien
ctgcagccaaagagctggttctcct

SEQ ID NO: 57518 - DNA, 25 bp, Homo sapien
ctgcaggaagaatgacctcccattc

SEQ ID NO: 57519 - DNA, 25 bp, Homo sapien
ctgcaggaagagtgacctcccattc

SEQ ID NO: 57520 - DNA, 25 bp, Homo sapien
ctgcaggagaagtgggcttcaggca

SEQ ID NO: 57521 - DNA, 25 bp, Homo sapien
ctgcaggagaattgggcttcaggca

SEQ ID NO: 57522 - DNA, 25 bp, Homo sapien
ctgcaggattcagcaccaagagctc

SEQ ID NO: 57523 - DNA, 25 bp, Homo sapien
ctgcaggattcatcaccaagagctc

SEQ ID NO: 57524 - DNA, 25 bp, Homo sapien
ctgcaggtgccaataggcagccgat

SEQ ID NO: 57525 - DNA, 25 bp, Homo sapien
ctgcaggtgccaatgggcagccgat

SEQ ID NO: 57526 - DNA, 25 bp, Homo sapien
ctgcagtatcttcagttcttacagt

SEQ ID NO: 57527 - DNA, 25 bp, Homo sapien
ctgcagtatcttcatttcttacagt

SEQ ID NO: 57528 - DNA, 25 bp, Homo sapien
ctgcagtccatttatgcaaaataat

SEQ ID NO: 57529 - DNA, 25 bp, Homo sapien
ctgcagtccatttgtgcaaaataat

SEQ ID NO: 57530 - DNA, 25 bp, Homo sapien
ctgcagtcgcattttcaaggaagcc

SEQ ID NO: 57531 - DNA, 25 bp, Homo sapien
ctgcagtctataatatataaccctt

SEQ ID NO: 57532 - DNA, 25 bp, Homo sapien
ctgcagtctatgatatataaccctt

SEQ ID NO: 57533 - DNA, 25 bp, Homo sapien
ctgcagtctcattttcaaggaagcc

SEQ ID NO: 57534 - DNA, 25 bp, Homo sapien
ctgcagtgtcatgaccttagcttct

SEQ ID NO: 57535 - DNA, 25 bp, Homo sapien
ctgcagtgtcatgcccttagcttct

SEQ ID NO: 57536 - DNA, 25 bp, Homo sapien
ctgcagttattaaaagttatgttct

SEQ ID NO: 57537 - DNA, 25 bp, Homo sapien
ctgcagttcaggcagccctgtcatt

SEQ ID NO: 57538 - DNA, 25 bp, Homo sapien
ctgcagttcaggtagccctgtcatt

SEQ ID NO: 57539 - DNA, 25 bp, Homo sapien
ctgcagttcttaaaagttatgttct

SEQ ID NO: 57540 - DNA, 25 bp, Homo sapien
ctgcagtttataagacacctagttt

SEQ ID NO: 57541 - DNA, 25 bp, Homo sapien
ctgcagtttataaggcacctagttt

SEQ ID NO: 57542 - DNA, 25 bp, Homo sapien
ctgcagtttgtctcagccaagaact

SEQ ID NO: 57543 - DNA, 25 bp, Homo sapien
ctgcagtttgtttcagccaagaact

SEQ ID NO: 57544 - DNA, 25 bp, Homo sapien
ctgcagtttttgttactattgttta

SEQ ID NO: 57545 - DNA, 25 bp, Homo sapien
ctgcagtttttgttcctattgttta

SEQ ID NO: 57546 - DNA, 25 bp, Homo sapien
ctgcataaatgtgggatgcctccac

SEQ ID NO: 57547 - DNA, 25 bp, Homo sapien
ctgcataactgtgggatgcctccac

SEQ ID NO: 57548 - DNA, 25 bp, Homo sapien
ctgcataatccaatcacaaaagaaa

SEQ ID NO: 57549 - DNA, 25 bp, Homo sapien
ctgcataatccagtcacaaaagaaa

SEQ ID NO: 57550 - DNA, 25 bp, Homo sapien
ctgcataatctgccacataattaaa

SEQ ID NO: 57551 - DNA, 25 bp, Homo sapien
ctgcataatctgccacgtaattaaa

SEQ ID NO: 57552 - DNA, 25 bp, Homo sapien
ctgcatatataatcctgtgaaagcc

SEQ ID NO: 57553 - DNA, 25 bp, Homo sapien
ctgcatatgtaatcctgtgaaagcc

SEQ ID NO: 57554 - DNA, 25 bp, Homo sapien
ctgcatcagttgatctcttttcatg

SEQ ID NO: 57555 - DNA, 25 bp, Homo sapien
ctgcatcagttgatttcttttcatg

SEQ ID NO: 57556 - DNA, 25 bp, Homo sapien
ctgcatcataaacccaaattcctcc

SEQ ID NO: 57557 - DNA, 25 bp, Homo sapien
ctgcatcatgaacccaaattcctcc

SEQ ID NO: 57558 - DNA, 25 bp, Homo sapien
ctgcatcatgggacacacttctgaa

SEQ ID NO: 57559 - DNA, 25 bp, Homo sapien
ctgcatcatgggattaagaaaaaaa

SEQ ID NO: 57560 - DNA, 25 bp, Homo sapien
ctgcatcatggggcacacttctgaa

SEQ ID NO: 57561 - DNA, 25 bp, Homo sapien
ctgcatcatggggttaagaaaaaaa

SEQ ID NO: 57562 - DNA, 25 bp, Homo sapien
ctgcatctacttgttggcacaggtt

SEQ ID NO: 57563 - DNA, 25 bp, Homo sapien
ctgcatctatttgttggcacaggtt

SEQ ID NO: 57564 - DNA, 25 bp, Homo sapien
ctgcatcttttagactggtggttgt

SEQ ID NO: 57565 - DNA, 25 bp, Homo sapien
ctgcatcttttagattggtggttgt

SEQ ID NO: 57566 - DNA, 25 bp, Homo sapien
ctgcatgcattcccaggcttgtcat

SEQ ID NO: 57567 - DNA, 25 bp, Homo sapien
ctgcatgcatttccaggcttgtcat

SEQ ID NO: 57568 - DNA, 25 bp, Homo sapien
ctgcatgccggttacgtcctcactg

SEQ ID NO: 57569 - DNA, 25 bp, Homo sapien
ctgcatgccggttgcgtcctcactg

SEQ ID NO: 57570 - DNA, 25 bp, Homo sapien
ctgcatgcttcatcacatagccacc

SEQ ID NO: 57571 - DNA, 25 bp, Homo sapien
ctgcatgcttcgtcacatagccacc

SEQ ID NO: 57572 - DNA, 25 bp, Homo sapien
ctgcatggcggagcttggttttccc

SEQ ID NO: 57573 - DNA, 25 bp, Homo sapien
ctgcatggcggaggttggttttccc

SEQ ID NO: 57574 - DNA, 25 bp, Homo sapien
ctgcatggctcacccacaagtcagt

SEQ ID NO: 57575 - DNA, 25 bp, Homo sapien
ctgcatggctcacccagaagtcagt

SEQ ID NO: 57576 - DNA, 25 bp, Homo sapien
ctgcatgtgctcatgggacactaag

SEQ ID NO: 57577 - DNA, 25 bp, Homo sapien
ctgcatgtgctcgtgggacactaag

SEQ ID NO: 57578 - DNA, 25 bp, Homo sapien
ctgcatgtttctataagatggagag

SEQ ID NO: 57579 - DNA, 25 bp, Homo sapien
ctgcatgtttctctaagatggagag

SEQ ID NO: 57580 - DNA, 25 bp, Homo sapien
ctgcattaaaggttgagttttcctt

SEQ ID NO: 57581 - DNA, 25 bp, Homo sapien
ctgcattaaaggttgatttttcctt

SEQ ID NO: 57582 - DNA, 25 bp, Homo sapien
ctgcattatatcaatttttctacat

SEQ ID NO: 57583 - DNA, 25 bp, Homo sapien
ctgcattatatcagtttttctacat

SEQ ID NO: 57584 - DNA, 25 bp, Homo sapien
ctgcatttcaagcagcaaaatggaa

SEQ ID NO: 57585 - DNA, 25 bp, Homo sapien
ctgcatttcaagtagcaaaatggaa

SEQ ID NO: 57586 - DNA, 25 bp, Homo sapien
ctgcatttctttgtgaggatgacag

SEQ ID NO: 57587 - DNA, 25 bp, Homo sapien
ctgcatttggacccacaggtaatag

SEQ ID NO: 57588 - DNA, 25 bp, Homo sapien
ctgcatttggacccgcaggtaatag

SEQ ID NO: 57589 - DNA, 25 bp, Homo sapien
ctgcatttggctgtcagtgaagcgg

SEQ ID NO: 57590 - DNA, 25 bp, Homo sapien
ctgcatttggctgttagtgaagcgg

SEQ ID NO: 57591 - DNA, 25 bp, Homo sapien
ctgcattttggacgtgccagcttct

SEQ ID NO: 57592 - DNA, 25 bp, Homo sapien
ctgcattttggatgtgccagcttct

SEQ ID NO: 57593 - DNA, 25 bp, Homo sapien
ctgcattttgtcaaacattcatgcg

SEQ ID NO: 57594 - DNA, 25 bp, Homo sapien
ctgcattttgtgaaacattcatgcg

SEQ ID NO: 57595 - DNA, 25 bp, Homo sapien
ctgcatttttttgtgaggatgacag

SEQ ID NO: 57596 - DNA, 25 bp, Homo sapien
ctgccaaaaacaagccaagtgagta

SEQ ID NO: 57597 - DNA, 25 bp, Homo sapien
ctgccaaaaacaagccgagtgagta

SEQ ID NO: 57598 - DNA, 25 bp, Homo sapien
ctgccaaaacatccttagaattcat

SEQ ID NO: 57599 - DNA, 25 bp, Homo sapien
ctgccaaagcatccttagaattcat

SEQ ID NO: 57600 - DNA, 25 bp, Homo sapien
ctgccaaagttctaagttttcatga

SEQ ID NO: 57601 - DNA, 25 bp, Homo sapien
ctgccaaagttgtaagttttcatga

SEQ ID NO: 57602 - DNA, 25 bp, Homo sapien
ctgccaactctatgatgttaaacga

SEQ ID NO: 57603 - DNA, 25 bp, Homo sapien
ctgccaactctgtgatgttaaacga

SEQ ID NO: 57604 - DNA, 25 bp, Homo sapien
ctgccaaggctacatcattttgtgg

SEQ ID NO: 57605 - DNA, 25 bp, Homo sapien
ctgccaaggttacatcattttgtgg

SEQ ID NO: 57606 - DNA, 25 bp, Homo sapien
ctgccacactatatttattcccctt

SEQ ID NO: 57607 - DNA, 25 bp, Homo sapien
ctgccacactatgtttattcccctt

SEQ ID NO: 57608 - DNA, 25 bp, Homo sapien
ctgccacatactaggagcttgctct

SEQ ID NO: 57609 - DNA, 25 bp, Homo sapien
ctgccacatactgggagcttgctct

SEQ ID NO: 57610 - DNA, 25 bp, Homo sapien
ctgccaccaaaaaaaaagtggatgt

SEQ ID NO: 57611 - DNA, 25 bp, Homo sapien
ctgccaccaaaaaaaatgtggatgt

SEQ ID NO: 57612 - DNA, 25 bp, Homo sapien
ctgccaccaactccctagattatgt

SEQ ID NO: 57613 - DNA, 25 bp, Homo sapien
ctgccaccaactccctggattatgt

SEQ ID NO: 57614 - DNA, 25 bp, Homo sapien
ctgccacctcaggatccaattactc

SEQ ID NO: 57615 - DNA, 25 bp, Homo sapien
ctgccacctcaggatcgaattactc

SEQ ID NO: 57616 - DNA, 25 bp, Homo sapien
ctgccacctctctagttctctctct

SEQ ID NO: 57617 - DNA, 25 bp, Homo sapien
ctgccacctctcttgttctctctct

SEQ ID NO: 57618 - DNA, 25 bp, Homo sapien
ctgccacggtttacgttttcacacc

SEQ ID NO: 57619 - DNA, 25 bp, Homo sapien
ctgccacggtttatgttttcacacc

SEQ ID NO: 57620 - DNA, 25 bp, Homo sapien
ctgccactaattcgagttttcattt

SEQ ID NO: 57621 - DNA, 25 bp, Homo sapien
ctgccactaatttgagttttcattt

SEQ ID NO: 57622 - DNA, 25 bp, Homo sapien
ctgccactcaggatgccggatgacg

SEQ ID NO: 57623 - DNA, 25 bp, Homo sapien
ctgccactcaggatgctggatgacg

SEQ ID NO: 57624 - DNA, 25 bp, Homo sapien
ctgccactttctctcggtgctaatg

SEQ ID NO: 57625 - DNA, 25 bp, Homo sapien
ctgccactttctgtcggtgctaatg

SEQ ID NO: 57626 - DNA, 25 bp, Homo sapien
ctgccagaagggcttctccaggaat

SEQ ID NO: 57627 - DNA, 25 bp, Homo sapien
ctgccagaagggtttctccaggaat

SEQ ID NO: 57628 - DNA, 25 bp, Homo sapien
ctgccagaggtaattacacatgttg

SEQ ID NO: 57629 - DNA, 25 bp, Homo sapien
ctgccagaggtaattatacatgttg

SEQ ID NO: 57630 - DNA, 25 bp, Homo sapien
ctgccagcatcatgagattatagtt

SEQ ID NO: 57631 - DNA, 25 bp, Homo sapien
ctgccagcatcgtgagattatagtt

SEQ ID NO: 57632 - DNA, 25 bp, Homo sapien
ctgccaggatccagtaacctcccac

SEQ ID NO: 57633 - DNA, 25 bp, Homo sapien
ctgccaggatccggtaacctcccac

SEQ ID NO: 57634 - DNA, 25 bp, Homo sapien
ctgccagtcagccgagcccgtgaac

SEQ ID NO: 57635 - DNA, 25 bp, Homo sapien
ctgccagtcagctgagcccgtgaac

SEQ ID NO: 57636 - DNA, 25 bp, Homo sapien
ctgccagtgctaatcgtgtcattac

SEQ ID NO: 57637 - DNA, 25 bp, Homo sapien
ctgccagtgctaattgtgtcattac

SEQ ID NO: 57638 - DNA, 25 bp, Homo sapien
ctgccagttcaacatccttcattcg

SEQ ID NO: 57639 - DNA, 25 bp, Homo sapien
ctgccagttcagcatccttcattcg

SEQ ID NO: 57640 - DNA, 25 bp, Homo sapien
ctgccatagatagtaatgcctgtga

SEQ ID NO: 57641 - DNA, 25 bp, Homo sapien
ctgccatagatagtgatgcctgtga

SEQ ID NO: 57642 - DNA, 25 bp, Homo sapien
ctgccatatagccacctgtgtttca

SEQ ID NO: 57643 - DNA, 25 bp, Homo sapien
ctgccatatagtcacctgtgtttca

SEQ ID NO: 57644 - DNA, 25 bp, Homo sapien
ctgccatcaggagataataaaaagt

SEQ ID NO: 57645 - DNA, 25 bp, Homo sapien
ctgccatcaggagttaataaaaagt

SEQ ID NO: 57646 - DNA, 25 bp, Homo sapien
ctgccatcctgaggctaattttata

SEQ ID NO: 57647 - DNA, 25 bp, Homo sapien
ctgccatcttgaggctaattttata

SEQ ID NO: 57648 - DNA, 25 bp, Homo sapien
ctgccatgagtacattttcaggctc

SEQ ID NO: 57649 - DNA, 25 bp, Homo sapien
ctgccatgagtacgttttcaggctc

SEQ ID NO: 57650 - DNA, 25 bp, Homo sapien
ctgccattcagactgttgttttatt

SEQ ID NO: 57651 - DNA, 25 bp, Homo sapien
ctgccattcggactgttgttttatt

SEQ ID NO: 57652 - DNA, 25 bp, Homo sapien
ctgccattctctctgttgtgctttc

SEQ ID NO: 57653 - DNA, 25 bp, Homo sapien
ctgccattgcaaaatttactactga

SEQ ID NO: 57654 - DNA, 25 bp, Homo sapien
ctgccattgcaaagtttactactga

SEQ ID NO: 57655 - DNA, 25 bp, Homo sapien
ctgccattgtctctgttgtgctttc

SEQ ID NO: 57656 - DNA, 25 bp, Homo sapien
ctgccatttatacatcatcactctc

SEQ ID NO: 57657 - DNA, 25 bp, Homo sapien
ctgccatttatacatcgtcactctc

SEQ ID NO: 57658 - DNA, 25 bp, Homo sapien
ctgccatttgtcctccaaacttctc

SEQ ID NO: 57659 - DNA, 25 bp, Homo sapien
ctgccatttgtcttccaaacttctc

SEQ ID NO: 57660 - DNA, 25 bp, Homo sapien
ctgcccaagataagaccagccctac

SEQ ID NO: 57661 - DNA, 25 bp, Homo sapien
ctgcccaagataagacgagccctac

SEQ ID NO: 57662 - DNA, 25 bp, Homo sapien
ctgcccaagttgctgtaggtatcca

SEQ ID NO: 57663 - DNA, 25 bp, Homo sapien
ctgcccaagttgttgtaggtatcca

SEQ ID NO: 57664 - DNA, 25 bp, Homo sapien
ctgcccacaatgcagctgcagatgg

SEQ ID NO: 57665 - DNA, 25 bp, Homo sapien
ctgcccaccatgcagctgcagatgg

SEQ ID NO: 57666 - DNA, 25 bp, Homo sapien
ctgcccagccaggtgtccttgttca

SEQ ID NO: 57667 - DNA, 25 bp, Homo sapien
ctgcccagcgaggtgtccttgttca

SEQ ID NO: 57668 - DNA, 25 bp, Homo sapien
ctgcccaggtttaaagtttctcagg

SEQ ID NO: 57669 - DNA, 25 bp, Homo sapien
ctgcccaggtttagagtttctcagg

SEQ ID NO: 57670 - DNA, 25 bp, Homo sapien
ctgcccagttgctcagccagaagaa

SEQ ID NO: 57671 - DNA, 25 bp, Homo sapien
ctgcccagttgttcagccagaagaa

SEQ ID NO: 57672 - DNA, 25 bp, Homo sapien
ctgcccatcgcgtatatcaactcat

SEQ ID NO: 57673 - DNA, 25 bp, Homo sapien
ctgcccatcgcgtctatcaactcat

SEQ ID NO: 57674 - DNA, 25 bp, Homo sapien
ctgcccattccagaacattcatctt

SEQ ID NO: 57675 - DNA, 25 bp, Homo sapien
ctgcccattcccgaacattcatctt

SEQ ID NO: 57676 - DNA, 25 bp, Homo sapien
ctgcccattgtctctactgctcaca

SEQ ID NO: 57677 - DNA, 25 bp, Homo sapien
ctgcccattgtctctagtgctcaca

SEQ ID NO: 57678 - DNA, 25 bp, Homo sapien
ctgccccctgtagagaaaagactag

SEQ ID NO: 57679 - DNA, 25 bp, Homo sapien
ctgccccctgtatagaaaagactag

SEQ ID NO: 57680 - DNA, 25 bp, Homo sapien
ctgcccctcatcttcgcagaacagg

SEQ ID NO: 57681 - DNA, 25 bp, Homo sapien
ctgcccctcgtcttcgcagaacagg

SEQ ID NO: 57682 - DNA, 25 bp, Homo sapien
ctgccctcagcacaaagtgtgtaat

SEQ ID NO: 57683 - DNA, 25 bp, Homo sapien
ctgccctcagcgcaaagtgtgtaat

SEQ ID NO: 57684 - DNA, 25 bp, Homo sapien
ctgccctggcttagagtcccagctc

SEQ ID NO: 57685 - DNA, 25 bp, Homo sapien
ctgccctgggttagagtcccagctc

SEQ ID NO: 57686 - DNA, 25 bp, Homo sapien
ctgccgacatgggtagtggcctgct

SEQ ID NO: 57687 - DNA, 25 bp, Homo sapien
ctgccgacatgtgtagtggcctgct

SEQ ID NO: 57688 - DNA, 25 bp, Homo sapien
ctgccgatctaaactatttcttcta

SEQ ID NO: 57689 - DNA, 25 bp, Homo sapien
ctgccgatttaaactatttcttcta

SEQ ID NO: 57690 - DNA, 25 bp, Homo sapien
ctgccgctattgctattcattctgg

SEQ ID NO: 57691 - DNA, 25 bp, Homo sapien
ctgccgctattgctgttcattctgg

SEQ ID NO: 57692 - DNA, 25 bp, Homo sapien
ctgcctacagaattagagaactgca

SEQ ID NO: 57693 - DNA, 25 bp, Homo sapien
ctgcctacagagttagagaactgca

SEQ ID NO: 57694 - DNA, 25 bp, Homo sapien
ctgcctactttagacaactacaata

SEQ ID NO: 57695 - DNA, 25 bp, Homo sapien
ctgcctacttttgacaactacaata

SEQ ID NO: 57696 - DNA, 25 bp, Homo sapien
ctgcctatttcacacatacagaaga

SEQ ID NO: 57697 - DNA, 25 bp, Homo sapien
ctgcctatttcgcacatacagaaga

SEQ ID NO: 57698 - DNA, 25 bp, Homo sapien
ctgcctcaaggaagatgtaagtaat

SEQ ID NO: 57699 - DNA, 25 bp, Homo sapien
ctgcctcaaggaggatgtaagtaat

SEQ ID NO: 57700 - DNA, 25 bp, Homo sapien
ctgcctcagaatcgcttggagagct

SEQ ID NO: 57701 - DNA, 25 bp, Homo sapien
ctgcctcagaatctcttggagagct

SEQ ID NO: 57702 - DNA, 25 bp, Homo sapien
ctgcctcattcccttcaagctctct

SEQ ID NO: 57703 - DNA, 25 bp, Homo sapien
ctgcctcattccgttcaagctctct

SEQ ID NO: 57704 - DNA, 25 bp, Homo sapien
ctgcctctacgctctcttctttgag

SEQ ID NO: 57705 - DNA, 25 bp, Homo sapien
ctgcctctatgctctcttctttgag

SEQ ID NO: 57706 - DNA, 25 bp, Homo sapien
ctgcctctatttcttgtttattttc

SEQ ID NO: 57707 - DNA, 25 bp, Homo sapien
ctgcctctattttttgtttattttc

SEQ ID NO: 57708 - DNA, 25 bp, Homo sapien
ctgcctctgatgcattaccatatag

SEQ ID NO: 57709 - DNA, 25 bp, Homo sapien
ctgcctctgatgccttaccatatag

SEQ ID NO: 57710 - DNA, 25 bp, Homo sapien
ctgcctctgatttaaaatcctgctt

SEQ ID NO: 57711 - DNA, 25 bp, Homo sapien
ctgcctctgatttagaatcctgctt

SEQ ID NO: 57712 - DNA, 25 bp, Homo sapien
ctgcctctgtgctgtggtttataaa

SEQ ID NO: 57713 - DNA, 25 bp, Homo sapien
ctgcctctgtgttgtggtttataaa

SEQ ID NO: 57714 - DNA, 25 bp, Homo sapien
ctgcctcttccatgaattacatgta

SEQ ID NO: 57715 - DNA, 25 bp, Homo sapien
ctgcctcttccgtgaattacatgta

SEQ ID NO: 57716 - DNA, 25 bp, Homo sapien
ctgcctgacaaaggactcatctttc

SEQ ID NO: 57717 - DNA, 25 bp, Homo sapien
ctgcctgaccaaggactcatctttc

SEQ ID NO: 57718 - DNA, 25 bp, Homo sapien
ctgcctgccacagaccgaatcagtg

SEQ ID NO: 57719 - DNA, 25 bp, Homo sapien
ctgcctgccacagagcgaatcagtg

SEQ ID NO: 57720 - DNA, 25 bp, Homo sapien
ctgcctgccacatgccataccactg

SEQ ID NO: 57721 - DNA, 25 bp, Homo sapien
ctgcctgccacgtgccataccactg

SEQ ID NO: 57722 - DNA, 25 bp, Homo sapien
ctgcctgccattctccagggaacta

SEQ ID NO: 57723 - DNA, 25 bp, Homo sapien
ctgcctgccctggcttagagtccca

SEQ ID NO: 57724 - DNA, 25 bp, Homo sapien
ctgcctgccctgggttagagtccca

SEQ ID NO: 57725 - DNA, 25 bp, Homo sapien
ctgcctgctattctccagggaacta

SEQ ID NO: 57726 - DNA, 25 bp, Homo sapien
ctgcctgctgcactttctcagtatg

SEQ ID NO: 57727 - DNA, 25 bp, Homo sapien
ctgcctgctgcagtttctcagtatg

SEQ ID NO: 57728 - DNA, 25 bp, Homo sapien
ctgcctgttacccatttgcaaagtt

SEQ ID NO: 57729 - DNA, 25 bp, Homo sapien
ctgcctgtttcccatttgcaaagtt

SEQ ID NO: 57730 - DNA, 25 bp, Homo sapien
ctgccttactccttctctttttgga

SEQ ID NO: 57731 - DNA, 25 bp, Homo sapien
ctgccttactctttctctttttgga

SEQ ID NO: 57732 - DNA, 25 bp, Homo sapien
ctgccttagtctcttctgcccttat

SEQ ID NO: 57733 - DNA, 25 bp, Homo sapien
ctgccttagtcttttctgcccttat

SEQ ID NO: 57734 - DNA, 25 bp, Homo sapien
ctgccttcattgctatccgactcag

SEQ ID NO: 57735 - DNA, 25 bp, Homo sapien
ctgccttcgttgctatccgactcag

SEQ ID NO: 57736 - DNA, 25 bp, Homo sapien
ctgccttctataactccatatactc

SEQ ID NO: 57737 - DNA, 25 bp, Homo sapien
ctgccttctggaaaaacgtcaccct

SEQ ID NO: 57738 - DNA, 25 bp, Homo sapien
ctgccttctggaaaaatgtcaccct

SEQ ID NO: 57739 - DNA, 25 bp, Homo sapien
ctgccttctgtaactccatatactc

SEQ ID NO: 57740 - DNA, 25 bp, Homo sapien
ctgccttcttcctttgttggcagca

SEQ ID NO: 57741 - DNA, 25 bp, Homo sapien
ctgccttcttcgtttgttggcagca

SEQ ID NO: 57742 - DNA, 25 bp, Homo sapien
ctgccttgcaagaaacattaacaga

SEQ ID NO: 57743 - DNA, 25 bp, Homo sapien
ctgccttgcaagaaacgttaacaga

SEQ ID NO: 57744 - DNA, 25 bp, Homo sapien
ctgccttgctagctgcatttcttgg

SEQ ID NO: 57745 - DNA, 25 bp, Homo sapien
ctgccttggttcttctcaaaccaga

SEQ ID NO: 57746 - DNA, 25 bp, Homo sapien
ctgccttggttgttctcaaaccaga

SEQ ID NO: 57747 - DNA, 25 bp, Homo sapien
ctgccttgttagctgcatttcttgg

SEQ ID NO: 57748 - DNA, 25 bp, Homo sapien
ctgcctttcaccttcttagtttctc

SEQ ID NO: 57749 - DNA, 25 bp, Homo sapien
ctgcctttcgccttcttagtttctc

SEQ ID NO: 57750 - DNA, 25 bp, Homo sapien
ctgcctttgcccaccacatgataaa

SEQ ID NO: 57751 - DNA, 25 bp, Homo sapien
ctgcctttgcccgccacatgataaa

SEQ ID NO: 57752 - DNA, 25 bp, Homo sapien
ctgccttttctagtctaaagacagg

SEQ ID NO: 57753 - DNA, 25 bp, Homo sapien
ctgccttttcttgtctaaagacagg

SEQ ID NO: 57754 - DNA, 25 bp, Homo sapien
ctgcgagaataacaagtggacaagt

SEQ ID NO: 57755 - DNA, 25 bp, Homo sapien
ctgcgagaataagaagtggacaagt

SEQ ID NO: 57756 - DNA, 25 bp, Homo sapien
ctgcgatggcggcaaacagcagtgg

SEQ ID NO: 57757 - DNA, 25 bp, Homo sapien
ctgcgatggtggcaaacagcagtgg

SEQ ID NO: 57758 - DNA, 25 bp, Homo sapien
ctgcgccatctgctcctgacattaa

SEQ ID NO: 57759 - DNA, 25 bp, Homo sapien
ctgcgccatctgttcctgacattaa

SEQ ID NO: 57760 - DNA, 25 bp, Homo sapien
ctgcgggacagttaagaaaatggaa

SEQ ID NO: 57761 - DNA, 25 bp, Homo sapien
ctgcgggacagttgagaaaatggaa

SEQ ID NO: 57762 - DNA, 25 bp, Homo sapien
ctgcggttaggaaggttgtcaaaat

SEQ ID NO: 57763 - DNA, 25 bp, Homo sapien
ctgcggttaggaagtttgtcaaaat

SEQ ID NO: 57764 - DNA, 25 bp, Homo sapien
ctgcgtaaaattagttttattttga

SEQ ID NO: 57765 - DNA, 25 bp, Homo sapien
ctgcgtaaaattatttttattttga

SEQ ID NO: 57766 - DNA, 25 bp, Homo sapien
ctgcgtccacctcttctcttgttat

SEQ ID NO: 57767 - DNA, 25 bp, Homo sapien
ctgcgtccaccttttctcttgttat

SEQ ID NO: 57768 - DNA, 25 bp, Homo sapien
ctgcgtcttctctttcaatgtcaga

SEQ ID NO: 57769 - DNA, 25 bp, Homo sapien
ctgcgtcttctctttctatgtcaga

SEQ ID NO: 57770 - DNA, 25 bp, Homo sapien
ctgcgtgcacaccgggctctgcaaa

SEQ ID NO: 57771 - DNA, 25 bp, Homo sapien
ctgcgtgcacactgggctctgcaaa

SEQ ID NO: 57772 - DNA, 25 bp, Homo sapien
ctgcgtgctcggatcttaccacata

SEQ ID NO: 57773 - DNA, 25 bp, Homo sapien
ctgcgtgctcggattttaccacata

SEQ ID NO: 57774 - DNA, 25 bp, Homo sapien
ctgcgttagaactagagacaaacat

SEQ ID NO: 57775 - DNA, 25 bp, Homo sapien
ctgcgttagaactggagacaaacat

SEQ ID NO: 57776 - DNA, 25 bp, Homo sapien
ctgcgttcaagggatgcactgaccc

SEQ ID NO: 57777 - DNA, 25 bp, Homo sapien
ctgcgttcatgggcaactgtactct

SEQ ID NO: 57778 - DNA, 25 bp, Homo sapien
ctgcgttcgagggatgcactgaccc

SEQ ID NO: 57779 - DNA, 25 bp, Homo sapien
ctgcgttcgtgggcaactgtactct

SEQ ID NO: 57780 - DNA, 25 bp, Homo sapien
ctgcgttgacacgaacatcatactg

SEQ ID NO: 57781 - DNA, 25 bp, Homo sapien
ctgcgttgacatgaacatcatactg

SEQ ID NO: 57782 - DNA, 25 bp, Homo sapien
ctgctaacagtacccatggtaataa

SEQ ID NO: 57783 - DNA, 25 bp, Homo sapien
ctgctaacattacccatggtaataa

SEQ ID NO: 57784 - DNA, 25 bp, Homo sapien
ctgctaacgcaatctagctaatacc

SEQ ID NO: 57785 - DNA, 25 bp, Homo sapien
ctgctaacggaatctagctaatacc

SEQ ID NO: 57786 - DNA, 25 bp, Homo sapien
ctgctaactctagctaaccatctca

SEQ ID NO: 57787 - DNA, 25 bp, Homo sapien
ctgctaactctggctaaccatctca

SEQ ID NO: 57788 - DNA, 25 bp, Homo sapien
ctgctaatacattcttcagcccaaa

SEQ ID NO: 57789 - DNA, 25 bp, Homo sapien
ctgctaatatattcttcagcccaaa

SEQ ID NO: 57790 - DNA, 25 bp, Homo sapien
ctgctaatcatcaattaaatgaatc

SEQ ID NO: 57791 - DNA, 25 bp, Homo sapien
ctgctaatcatcaattgaatgaatc

SEQ ID NO: 57792 - DNA, 25 bp, Homo sapien
ctgctaatgtgacatttgtttggta

SEQ ID NO: 57793 - DNA, 25 bp, Homo sapien
ctgctaatgtggcatttgtttggta

SEQ ID NO: 57794 - DNA, 25 bp, Homo sapien
ctgctacaagccaagaacacctgag

SEQ ID NO: 57795 - DNA, 25 bp, Homo sapien
ctgctacaagccaggaacacctgag

SEQ ID NO: 57796 - DNA, 25 bp, Homo sapien
ctgctacactacagcgccacacagg

SEQ ID NO: 57797 - DNA, 25 bp, Homo sapien
ctgctacatgctaaaatgtgaatga

SEQ ID NO: 57798 - DNA, 25 bp, Homo sapien
ctgctacatgctataatgtgaatga

SEQ ID NO: 57799 - DNA, 25 bp, Homo sapien
ctgctacattacagcgccacacagg

SEQ ID NO: 57800 - DNA, 25 bp, Homo sapien
ctgctaccatgaagtccaagaagaa

SEQ ID NO: 57801 - DNA, 25 bp, Homo sapien
ctgctaccttgaagtccaagaagaa

SEQ ID NO: 57802 - DNA, 25 bp, Homo sapien
ctgctagcagggatcagtgagggat

SEQ ID NO: 57803 - DNA, 25 bp, Homo sapien
ctgctagcagggctcagtgagggat

SEQ ID NO: 57804 - DNA, 25 bp, Homo sapien
ctgctagccagcagcaatggaaggg

SEQ ID NO: 57805 - DNA, 25 bp, Homo sapien
ctgctagccagcagcactggaaggg

SEQ ID NO: 57806 - DNA, 25 bp, Homo sapien
ctgctagggatacagtggattaatg

SEQ ID NO: 57807 - DNA, 25 bp, Homo sapien
ctgctagggatatagtggattaatg

SEQ ID NO: 57808 - DNA, 25 bp, Homo sapien
ctgctataacttcgtagtcctggat

SEQ ID NO: 57809 - DNA, 25 bp, Homo sapien
ctgctataactttgtagtcctggat

SEQ ID NO: 57810 - DNA, 25 bp, Homo sapien
ctgctataagaagatggaagattgt

SEQ ID NO: 57811 - DNA, 25 bp, Homo sapien
ctgctataataagatggaagattgt

SEQ ID NO: 57812 - DNA, 25 bp, Homo sapien
ctgctataggtaaagggacatacta

SEQ ID NO: 57813 - DNA, 25 bp, Homo sapien
ctgctataggtaaatggacatacta

SEQ ID NO: 57814 - DNA, 25 bp, Homo sapien
ctgctatccacttccaatcttacca

SEQ ID NO: 57815 - DNA, 25 bp, Homo sapien
ctgctatccacttctaatcttacca

SEQ ID NO: 57816 - DNA, 25 bp, Homo sapien
ctgctatctgttacgtgatgccatc

SEQ ID NO: 57817 - DNA, 25 bp, Homo sapien
ctgctatctgttatgtgatgccatc

SEQ ID NO: 57818 - DNA, 25 bp, Homo sapien
ctgctatgtccactagaagaagtat

SEQ ID NO: 57819 - DNA, 25 bp, Homo sapien
ctgctatgtccactggaagaagtat

SEQ ID NO: 57820 - DNA, 25 bp, Homo sapien
ctgctatttggagtcagtttctccc

SEQ ID NO: 57821 - DNA, 25 bp, Homo sapien
ctgctatttggagttagtttctccc

SEQ ID NO: 57822 - DNA, 25 bp, Homo sapien
ctgctcaatccatacagtgagtaaa

SEQ ID NO: 57823 - DNA, 25 bp, Homo sapien
ctgctcaatccgtacagtgagtaaa

SEQ ID NO: 57824 - DNA, 25 bp, Homo sapien
ctgctcaatgacacctgcagacact

SEQ ID NO: 57825 - DNA, 25 bp, Homo sapien
ctgctcaatgatacctgcagacact

SEQ ID NO: 57826 - DNA, 25 bp, Homo sapien
ctgctcaattgacgtctcaggatag

SEQ ID NO: 57827 - DNA, 25 bp, Homo sapien
ctgctcaattgatgtctcaggatag

SEQ ID NO: 57828 - DNA, 25 bp, Homo sapien
ctgctcaccactcgaaaaacaaact

SEQ ID NO: 57829 - DNA, 25 bp, Homo sapien
ctgctcaccacttgaaaaacaaact

SEQ ID NO: 57830 - DNA, 25 bp, Homo sapien
ctgctcacctttaccctacctgcct

SEQ ID NO: 57831 - DNA, 25 bp, Homo sapien
ctgctcacttttaccctacctgcct

SEQ ID NO: 57832 - DNA, 25 bp, Homo sapien
ctgctcagatgtcatacattttctg

SEQ ID NO: 57833 - DNA, 25 bp, Homo sapien
ctgctcagggacctacaagactaca

SEQ ID NO: 57834 - DNA, 25 bp, Homo sapien
ctgctcagggatctacaagactaca

SEQ ID NO: 57835 - DNA, 25 bp, Homo sapien
ctgctcagttgtcatacattttctg

SEQ ID NO: 57836 - DNA, 25 bp, Homo sapien
ctgctcatcactgaaaagtagactc

SEQ ID NO: 57837 - DNA, 25 bp, Homo sapien
ctgctcatcgctgaaaagtagactc

SEQ ID NO: 57838 - DNA, 25 bp, Homo sapien
ctgctccacacaatttctcagtgat

SEQ ID NO: 57839 - DNA, 25 bp, Homo sapien
ctgctccaccagctcatgttgcctc

SEQ ID NO: 57840 - DNA, 25 bp, Homo sapien
ctgctccaccagttcatgttgcctc

SEQ ID NO: 57841 - DNA, 25 bp, Homo sapien
ctgctccacgcaatttctcagtgat

SEQ ID NO: 57842 - DNA, 25 bp, Homo sapien
ctgctccatccacaggttcctgtcc

SEQ ID NO: 57843 - DNA, 25 bp, Homo sapien
ctgctccatccataggttcctgtcc

SEQ ID NO: 57844 - DNA, 25 bp, Homo sapien
ctgctccatgaaactcggaggaaat

SEQ ID NO: 57845 - DNA, 25 bp, Homo sapien
ctgctccatgaacctcggaggaaat

SEQ ID NO: 57846 - DNA, 25 bp, Homo sapien
ctgctccgatgttcgtccatgctga

SEQ ID NO: 57847 - DNA, 25 bp, Homo sapien
ctgctccgatgtttgtccatgctga

SEQ ID NO: 57848 - DNA, 25 bp, Homo sapien
ctgctcctcaggcgggtggtgctga

SEQ ID NO: 57849 - DNA, 25 bp, Homo sapien
ctgctcctcctcactgttgctttgc

SEQ ID NO: 57850 - DNA, 25 bp, Homo sapien
ctgctcctcgaagtagggaccttaa

SEQ ID NO: 57851 - DNA, 25 bp, Homo sapien
ctgctcctcgggcgggtggtgctga

SEQ ID NO: 57852 - DNA, 25 bp, Homo sapien
ctgctcctcttcctgcattcaggtg

SEQ ID NO: 57853 - DNA, 25 bp, Homo sapien
ctgctcctcttcctgcgttcaggtg

SEQ ID NO: 57854 - DNA, 25 bp, Homo sapien
ctgctcctgtgctgtcacctgcaat

SEQ ID NO: 57855 - DNA, 25 bp, Homo sapien
ctgctcctgtgttgtcacctgcaat

SEQ ID NO: 57856 - DNA, 25 bp, Homo sapien
ctgctccttcctcgggctgcctacc

SEQ ID NO: 57857 - DNA, 25 bp, Homo sapien
ctgctccttctcactgttgctttgc

SEQ ID NO: 57858 - DNA, 25 bp, Homo sapien
ctgctccttgaagtagggaccttaa

SEQ ID NO: 57859 - DNA, 25 bp, Homo sapien
ctgctcctttctcgggctgcctacc

SEQ ID NO: 57860 - DNA, 25 bp, Homo sapien
ctgctctcctaatcatctgcccagg

SEQ ID NO: 57861 - DNA, 25 bp, Homo sapien
ctgctctcctaatcgtctgcccagg

SEQ ID NO: 57862 - DNA, 25 bp, Homo sapien
ctgctctggcctactaactgttacc

SEQ ID NO: 57863 - DNA, 25 bp, Homo sapien
ctgctctggcctactatctgttacc

SEQ ID NO: 57864 - DNA, 25 bp, Homo sapien
ctgctctgtcaagcttccaaaccgt

SEQ ID NO: 57865 - DNA, 25 bp, Homo sapien
ctgctctgtgaagcttccaaaccgt

SEQ ID NO: 57866 - DNA, 25 bp, Homo sapien
ctgctcttaaagcccttatttctca

SEQ ID NO: 57867 - DNA, 25 bp, Homo sapien
ctgctcttaaagctcttatttctca

SEQ ID NO: 57868 - DNA, 25 bp, Homo sapien
ctgctcttcatgcccataaggctga

SEQ ID NO: 57869 - DNA, 25 bp, Homo sapien
ctgctcttcatgcctataaggctga

SEQ ID NO: 57870 - DNA, 25 bp, Homo sapien
ctgctgaagctattcccaaaaaatc

SEQ ID NO: 57871 - DNA, 25 bp, Homo sapien
ctgctgaagctgttcccaaaaaatc

SEQ ID NO: 57872 - DNA, 25 bp, Homo sapien
ctgctgaccatgctcctcgcaacag

SEQ ID NO: 57873 - DNA, 25 bp, Homo sapien
ctgctgaccatgttcctcgcaacag

SEQ ID NO: 57874 - DNA, 25 bp, Homo sapien
ctgctgagctaaccaacggtggaaa

SEQ ID NO: 57875 - DNA, 25 bp, Homo sapien
ctgctgagctagccaacggtggaaa

SEQ ID NO: 57876 - DNA, 25 bp, Homo sapien
ctgctgagctcatgttgtcacaagc

SEQ ID NO: 57877 - DNA, 25 bp, Homo sapien
ctgctgagctcttgttgtcacaagc

SEQ ID NO: 57878 - DNA, 25 bp, Homo sapien
ctgctgagctctttatttctataca

SEQ ID NO: 57879 - DNA, 25 bp, Homo sapien
ctgctgagctctttgtttctataca

SEQ ID NO: 57880 - DNA, 25 bp, Homo sapien
ctgctgatataaagtcaaactcata

SEQ ID NO: 57881 - DNA, 25 bp, Homo sapien
ctgctgatgtaaagtcaaactcata

SEQ ID NO: 57882 - DNA, 25 bp, Homo sapien
ctgctgcaatattaagttccttgtg

SEQ ID NO: 57883 - DNA, 25 bp, Homo sapien
ctgctgcactttctcagtatggcaa

SEQ ID NO: 57884 - DNA, 25 bp, Homo sapien
ctgctgcagtattaagttccttgtg

SEQ ID NO: 57885 - DNA, 25 bp, Homo sapien
ctgctgcagtttctcagtatggcaa

SEQ ID NO: 57886 - DNA, 25 bp, Homo sapien
ctgctgcataagaaacgaaactgca

SEQ ID NO: 57887 - DNA, 25 bp, Homo sapien
ctgctgcattagaaacgaaactgca

SEQ ID NO: 57888 - DNA, 25 bp, Homo sapien
ctgctgcccagccaggtgtccttgt

SEQ ID NO: 57889 - DNA, 25 bp, Homo sapien
ctgctgcccagcgaggtgtccttgt

SEQ ID NO: 57890 - DNA, 25 bp, Homo sapien
ctgctgcctggttctaacaccaacg

SEQ ID NO: 57891 - DNA, 25 bp, Homo sapien
ctgctgcctggttctatcaccaacg

SEQ ID NO: 57892 - DNA, 25 bp, Homo sapien
ctgctgggaatttgagaagtctcag

SEQ ID NO: 57893 - DNA, 25 bp, Homo sapien
ctgctgggcatttgagaagtctcag

SEQ ID NO: 57894 - DNA, 25 bp, Homo sapien
ctgctgggcgttctcctggatggga

SEQ ID NO: 57895 - DNA, 25 bp, Homo sapien
ctgctgggctctttctgtttgtcat

SEQ ID NO: 57896 - DNA, 25 bp, Homo sapien
ctgctgggctctttttgtttgtcat

SEQ ID NO: 57897 - DNA, 25 bp, Homo sapien
ctgctgggtgttctcctggatggga

SEQ ID NO: 57898 - DNA, 25 bp, Homo sapien
ctgctggtgattagagctcattcga

SEQ ID NO: 57899 - DNA, 25 bp, Homo sapien
ctgctggtggttagagctcattcga

SEQ ID NO: 57900 - DNA, 25 bp, Homo sapien
ctgctggtgtttttgggttagtttt

SEQ ID NO: 57901 - DNA, 25 bp, Homo sapien
ctgctggtgttttttggttagtttt

SEQ ID NO: 57902 - DNA, 25 bp, Homo sapien
ctgctgtaaaaagcgagttaagaag

SEQ ID NO: 57903 - DNA, 25 bp, Homo sapien
ctgctgtaaaaagtgagttaagaag

SEQ ID NO: 57904 - DNA, 25 bp, Homo sapien
ctgctgtaatatcctactcctcttc

SEQ ID NO: 57905 - DNA, 25 bp, Homo sapien
ctgctgtaatatgctactcctcttc

SEQ ID NO: 57906 - DNA, 25 bp, Homo sapien
ctgctgtcaaatgctttagggctgt

SEQ ID NO: 57907 - DNA, 25 bp, Homo sapien
ctgctgtcaaatgttttagggctgt

SEQ ID NO: 57908 - DNA, 25 bp, Homo sapien
ctgctgtcattctcgtacgcctctc

SEQ ID NO: 57909 - DNA, 25 bp, Homo sapien
ctgctgtcattctcgtgcgcctctc

SEQ ID NO: 57910 - DNA, 25 bp, Homo sapien
ctgctgtctaaaatccttttcatgt

SEQ ID NO: 57911 - DNA, 25 bp, Homo sapien
ctgctgtctaagatccttttcatgt

SEQ ID NO: 57912 - DNA, 25 bp, Homo sapien
ctgctgtgcttatactatgactgaa

SEQ ID NO: 57913 - DNA, 25 bp, Homo sapien
ctgctgtgcttatactgtgactgaa

SEQ ID NO: 57914 - DNA, 25 bp, Homo sapien
ctgctgtgtagaactgataatatgg

SEQ ID NO: 57915 - DNA, 25 bp, Homo sapien
ctgctgtgtagaattgataatatgg

SEQ ID NO: 57916 - DNA, 25 bp, Homo sapien
ctgctgttcccccagatagcattgt

SEQ ID NO: 57917 - DNA, 25 bp, Homo sapien
ctgctgtttccccagatagcattgt

SEQ ID NO: 57918 - DNA, 25 bp, Homo sapien
ctgcttaaataaccaagatgtgttg

SEQ ID NO: 57919 - DNA, 25 bp, Homo sapien
ctgcttaactttctgaaatcagatt

SEQ ID NO: 57920 - DNA, 25 bp, Homo sapien
ctgcttaactttctgatatcagatt

SEQ ID NO: 57921 - DNA, 25 bp, Homo sapien
ctgcttaagctgcatccgagagatt

SEQ ID NO: 57922 - DNA, 25 bp, Homo sapien
ctgcttaagctgcatctgagagatt

SEQ ID NO: 57923 - DNA, 25 bp, Homo sapien
ctgcttaaggccataagtccgaaac

SEQ ID NO: 57924 - DNA, 25 bp, Homo sapien
ctgcttaaggccgtaagtccgaaac

SEQ ID NO: 57925 - DNA, 25 bp, Homo sapien
ctgcttaagtaaccaagatgtgttg

SEQ ID NO: 57926 - DNA, 25 bp, Homo sapien
ctgcttaccgcacgattattttgag

SEQ ID NO: 57927 - DNA, 25 bp, Homo sapien
ctgcttaccgcatgattattttgag

SEQ ID NO: 57928 - DNA, 25 bp, Homo sapien
ctgcttaccgcggtcgtttttagat

SEQ ID NO: 57929 - DNA, 25 bp, Homo sapien
ctgcttaccgcggtggtttttagat

SEQ ID NO: 57930 - DNA, 25 bp, Homo sapien
ctgcttacctcacatggtaaatgtg

SEQ ID NO: 57931 - DNA, 25 bp, Homo sapien
ctgcttacgtcacatggtaaatgtg

SEQ ID NO: 57932 - DNA, 25 bp, Homo sapien
ctgcttagaagataaccgctatgac

SEQ ID NO: 57933 - DNA, 25 bp, Homo sapien
ctgcttagaagataactgctatgac

SEQ ID NO: 57934 - DNA, 25 bp, Homo sapien
ctgcttagcataataattggcattt

SEQ ID NO: 57935 - DNA, 25 bp, Homo sapien
ctgcttagcatagtaattggcattt

SEQ ID NO: 57936 - DNA, 25 bp, Homo sapien
ctgcttaggatggtcttgcttgcca

SEQ ID NO: 57937 - DNA, 25 bp, Homo sapien
ctgcttaggatggttttgcttgcca

SEQ ID NO: 57938 - DNA, 25 bp, Homo sapien
ctgcttagtatcgttgtctcctatg

SEQ ID NO: 57939 - DNA, 25 bp, Homo sapien
ctgcttagtatctttgtctcctatg

SEQ ID NO: 57940 - DNA, 25 bp, Homo sapien
ctgcttagtgaaggtgatttccttt

SEQ ID NO: 57941 - DNA, 25 bp, Homo sapien
ctgcttagtgatggtgatttccttt

SEQ ID NO: 57942 - DNA, 25 bp, Homo sapien
ctgcttatatcccaatggccagaaa

SEQ ID NO: 57943 - DNA, 25 bp, Homo sapien
ctgcttatatcccattggccagaaa

SEQ ID NO: 57944 - DNA, 25 bp, Homo sapien
ctgcttcaacttgttctctgcaggt

SEQ ID NO: 57945 - DNA, 25 bp, Homo sapien
ctgcttcaattataacccaacctac

SEQ ID NO: 57946 - DNA, 25 bp, Homo sapien
ctgcttcaattataactcaacctac

SEQ ID NO: 57947 - DNA, 25 bp, Homo sapien
ctgcttcatagtctcaaatgttcat

SEQ ID NO: 57948 - DNA, 25 bp, Homo sapien
ctgcttcatagtctcacatgttcat

SEQ ID NO: 57949 - DNA, 25 bp, Homo sapien
ctgcttcatcttgttctctgcaggt

SEQ ID NO: 57950 - DNA, 25 bp, Homo sapien
ctgcttccaagtggcatatggacta

SEQ ID NO: 57951 - DNA, 25 bp, Homo sapien
ctgcttccaagttgcatatggacta

SEQ ID NO: 57952 - DNA, 25 bp, Homo sapien
ctgcttccattctgaggcttggcca

SEQ ID NO: 57953 - DNA, 25 bp, Homo sapien
ctgcttccattgccacatcttcgtg

SEQ ID NO: 57954 - DNA, 25 bp, Homo sapien
ctgcttcccacttctcacttctgcc

SEQ ID NO: 57955 - DNA, 25 bp, Homo sapien
ctgcttcccacttctcgcttctgcc

SEQ ID NO: 57956 - DNA, 25 bp, Homo sapien
ctgcttccgttctgaggcttggcca

SEQ ID NO: 57957 - DNA, 25 bp, Homo sapien
ctgcttccgttgccacatcttcgtg

SEQ ID NO: 57958 - DNA, 25 bp, Homo sapien
ctgcttcctgttagagccttgatca

SEQ ID NO: 57959 - DNA, 25 bp, Homo sapien
ctgcttcctgttagaggcttgatca

SEQ ID NO: 57960 - DNA, 25 bp, Homo sapien
ctgcttctgagttagacacacttgg

SEQ ID NO: 57961 - DNA, 25 bp, Homo sapien
ctgcttctgggttagacacacttgg

SEQ ID NO: 57962 - DNA, 25 bp, Homo sapien
ctgcttctgttttcccacctgccat

SEQ ID NO: 57963 - DNA, 25 bp, Homo sapien
ctgcttctgtttttccacctgccat

SEQ ID NO: 57964 - DNA, 25 bp, Homo sapien
ctgcttgacaaacatgcttttataa

SEQ ID NO: 57965 - DNA, 25 bp, Homo sapien
ctgcttgaccaacatgcttttataa

SEQ ID NO: 57966 - DNA, 25 bp, Homo sapien
ctgcttgcctgagattggtaccagc

SEQ ID NO: 57967 - DNA, 25 bp, Homo sapien
ctgcttgcctgggattggtaccagc

SEQ ID NO: 57968 - DNA, 25 bp, Homo sapien
ctgcttggaaacactataggaacag

SEQ ID NO: 57969 - DNA, 25 bp, Homo sapien
ctgcttggaaacagtataggaacag

SEQ ID NO: 57970 - DNA, 25 bp, Homo sapien
ctgcttggcagggcttagcggtgaa

SEQ ID NO: 57971 - DNA, 25 bp, Homo sapien
ctgcttggcagtgcttagcggtgaa

SEQ ID NO: 57972 - DNA, 25 bp, Homo sapien
ctgctttaaaaaaagaaagacggcg

SEQ ID NO: 57973 - DNA, 25 bp, Homo sapien
ctgctttaaaaaaggaaagacggcg

SEQ ID NO: 57974 - DNA, 25 bp, Homo sapien
ctgctttacagtaaagagtgtccat

SEQ ID NO: 57975 - DNA, 25 bp, Homo sapien
ctgctttacagtagagagtgtccat

SEQ ID NO: 57976 - DNA, 25 bp, Homo sapien
ctgctttacctgattctcaaatgac

SEQ ID NO: 57977 - DNA, 25 bp, Homo sapien
ctgctttacctgcttctcaaatgac

SEQ ID NO: 57978 - DNA, 25 bp, Homo sapien
ctgctttagaattcatttggctccc

SEQ ID NO: 57979 - DNA, 25 bp, Homo sapien
ctgctttagaattcgtttggctccc

SEQ ID NO: 57980 - DNA, 25 bp, Homo sapien
ctgctttatcaatgaagtttatgta

SEQ ID NO: 57981 - DNA, 25 bp, Homo sapien
ctgctttatcaatgaattttatgta

SEQ ID NO: 57982 - DNA, 25 bp, Homo sapien
ctgctttcagagctgcatttacctc

SEQ ID NO: 57983 - DNA, 25 bp, Homo sapien
ctgctttcagagcttcatttacctc

SEQ ID NO: 57984 - DNA, 25 bp, Homo sapien
ctgctttctttctacgccctgaaga

SEQ ID NO: 57985 - DNA, 25 bp, Homo sapien
ctgctttctttctatgccctgaaga

SEQ ID NO: 57986 - DNA, 25 bp, Homo sapien
ctgctttgcgtcttgtgctctggta

SEQ ID NO: 57987 - DNA, 25 bp, Homo sapien
ctgctttggaaataaggtgtacact

SEQ ID NO: 57988 - DNA, 25 bp, Homo sapien
ctgctttggaaatagggtgtacact

SEQ ID NO: 57989 - DNA, 25 bp, Homo sapien
ctgctttgtggggtcaattccagta

SEQ ID NO: 57990 - DNA, 25 bp, Homo sapien
ctgctttgtggggtcatttccagta

SEQ ID NO: 57991 - DNA, 25 bp, Homo sapien
ctgctttgtgtcttgtgctctggta

SEQ ID NO: 57992 - DNA, 25 bp, Homo sapien
ctgcttttatttttaagaagatcaa

SEQ ID NO: 57993 - DNA, 25 bp, Homo sapien
ctgcttttatttttgagaagatcaa

SEQ ID NO: 57994 - DNA, 25 bp, Homo sapien
ctgctttttatgccttgacctttgt

SEQ ID NO: 57995 - DNA, 25 bp, Homo sapien
ctgctttttatgcgttgacctttgt

SEQ ID NO: 57996 - DNA, 25 bp, Homo sapien
ctggaaaaaacatcacaactctaaa

SEQ ID NO: 57997 - DNA, 25 bp, Homo sapien
ctggaaaaaacatcacgactctaaa

SEQ ID NO: 57998 - DNA, 25 bp, Homo sapien
ctggaaaaactgtgtccagatgttg

SEQ ID NO: 57999 - DNA, 25 bp, Homo sapien
ctggaaaaattgtgtccagatgttg

SEQ ID NO: 58000 - DNA, 25 bp, Homo sapien
ctggaaaagcgttgggccagccgtt

SEQ ID NO: 58001 - DNA, 25 bp, Homo sapien
ctggaaaagtgttgggccagccgtt

SEQ ID NO: 58002 - DNA, 25 bp, Homo sapien
ctggaaaataccaacggcaactcca

SEQ ID NO: 58003 - DNA, 25 bp, Homo sapien
ctggaaaatactaacggcaactcca

SEQ ID NO: 58004 - DNA, 25 bp, Homo sapien
ctggaaaatggcttgacagttttta

SEQ ID NO: 58005 - DNA, 25 bp, Homo sapien
ctggaaaatggtttgacagttttta

SEQ ID NO: 58006 - DNA, 25 bp, Homo sapien
ctggaaaccactataatagctctaa

SEQ ID NO: 58007 - DNA, 25 bp, Homo sapien
ctggaaaccactctaatagctctaa

SEQ ID NO: 58008 - DNA, 25 bp, Homo sapien
ctggaaaccctttacagaagagcct

SEQ ID NO: 58009 - DNA, 25 bp, Homo sapien
ctggaaaccctttagagaagagcct

SEQ ID NO: 58010 - DNA, 25 bp, Homo sapien
ctggaaagaacccactgcttatttt

SEQ ID NO: 58011 - DNA, 25 bp, Homo sapien
ctggaaagaacctactgcttatttt

SEQ ID NO: 58012 - DNA, 25 bp, Homo sapien
ctggaaagcatccgacttcttaaag

SEQ ID NO: 58013 - DNA, 25 bp, Homo sapien
ctggaaagcatccggcttcttaaag

SEQ ID NO: 58014 - DNA, 25 bp, Homo sapien
ctggaaagtttgtgtcaatttatta

SEQ ID NO: 58015 - DNA, 25 bp, Homo sapien
ctggaaagtttttgtcaatttatta

SEQ ID NO: 58016 - DNA, 25 bp, Homo sapien
ctggaaatcactgcagttttctcca

SEQ ID NO: 58017 - DNA, 25 bp, Homo sapien
ctggaaatcactgccgttttctcca

SEQ ID NO: 58018 - DNA, 25 bp, Homo sapien
ctggaaatctatcctatggtctact

SEQ ID NO: 58019 - DNA, 25 bp, Homo sapien
ctggaaatctatgctatggtctact

SEQ ID NO: 58020 - DNA, 25 bp, Homo sapien
ctggaaatgagtaggtactgctaaa

SEQ ID NO: 58021 - DNA, 25 bp, Homo sapien
ctggaaatgagtgggtactgctaaa

SEQ ID NO: 58022 - DNA, 25 bp, Homo sapien
ctggaaatgcccttctgcatatagc

SEQ ID NO: 58023 - DNA, 25 bp, Homo sapien
ctggaaatgcccttttgcatatagc

SEQ ID NO: 58024 - DNA, 25 bp, Homo sapien
ctggaaatgtgacggtccgggaata

SEQ ID NO: 58025 - DNA, 25 bp, Homo sapien
ctggaaatttgacggtccgggaata

SEQ ID NO: 58026 - DNA, 25 bp, Homo sapien
ctggaacaacccaacaggctgtgcg

SEQ ID NO: 58027 - DNA, 25 bp, Homo sapien
ctggaacaaccctacaggctgtgcg

SEQ ID NO: 58028 - DNA, 25 bp, Homo sapien
ctggaacagacagtatctatcaaca

SEQ ID NO: 58029 - DNA, 25 bp, Homo sapien
ctggaacagacagtatttatcaaca

SEQ ID NO: 58030 - DNA, 25 bp, Homo sapien
ctggaaccacacaaaaagcttagca

SEQ ID NO: 58031 - DNA, 25 bp, Homo sapien
ctggaaccacacgaaaagcttagca

SEQ ID NO: 58032 - DNA, 25 bp, Homo sapien
ctggaacgcttttggccgacatgat

SEQ ID NO: 58033 - DNA, 25 bp, Homo sapien
ctggaacgtttttggccgacatgat

SEQ ID NO: 58034 - DNA, 25 bp, Homo sapien
ctggaactcaaagaaatggtagcta

SEQ ID NO: 58035 - DNA, 25 bp, Homo sapien
ctggaactgaaagaaatggtagcta

SEQ ID NO: 58036 - DNA, 25 bp, Homo sapien
ctggaactgataatttgaacaagac

SEQ ID NO: 58037 - DNA, 25 bp, Homo sapien
ctggaactgatattttgaacaagac

SEQ ID NO: 58038 - DNA, 25 bp, Homo sapien
ctggaagcacttgggaacagctggg

SEQ ID NO: 58039 - DNA, 25 bp, Homo sapien
ctggaagcacttgtgaacagctggg

SEQ ID NO: 58040 - DNA, 25 bp, Homo sapien
ctggaagcagtcaggaacataagct

SEQ ID NO: 58041 - DNA, 25 bp, Homo sapien
ctggaagcagtgaggaacataagct

SEQ ID NO: 58042 - DNA, 25 bp, Homo sapien
ctggaagcgctcatgcagccagacc

SEQ ID NO: 58043 - DNA, 25 bp, Homo sapien
ctggaagcgctcgtgcagccagacc

SEQ ID NO: 58044 - DNA, 25 bp, Homo sapien
ctggaagctggccatttgggtgtga

SEQ ID NO: 58045 - DNA, 25 bp, Homo sapien
ctggaagctggctatttgggtgtga

SEQ ID NO: 58046 - DNA, 25 bp, Homo sapien
ctggaagggacccgcagcttcaatt

SEQ ID NO: 58047 - DNA, 25 bp, Homo sapien
ctggaagggacctgcagcttcaatt

SEQ ID NO: 58048 - DNA, 25 bp, Homo sapien
ctggaagttttataagaaatcagat

SEQ ID NO: 58049 - DNA, 25 bp, Homo sapien
ctggaagttttccctacctaacact

SEQ ID NO: 58050 - DNA, 25 bp, Homo sapien
ctggaagttttctctacctaacact

SEQ ID NO: 58051 - DNA, 25 bp, Homo sapien
ctggaagttttgtaagaaatcagat

SEQ ID NO: 58052 - DNA, 25 bp, Homo sapien
ctggaataatgcaagaggtagtatg

SEQ ID NO: 58053 - DNA, 25 bp, Homo sapien
ctggaataatgcaggaggtagtatg

SEQ ID NO: 58054 - DNA, 25 bp, Homo sapien
ctggaatcagggacgtttcctggag

SEQ ID NO: 58055 - DNA, 25 bp, Homo sapien
ctggaatcagggacttttcctggag

SEQ ID NO: 58056 - DNA, 25 bp, Homo sapien
ctggaatccagtatctgcctttggt

SEQ ID NO: 58057 - DNA, 25 bp, Homo sapien
ctggaatccagtgtctgcctttggt

SEQ ID NO: 58058 - DNA, 25 bp, Homo sapien
ctggaatgcataagattaatgaagc

SEQ ID NO: 58059 - DNA, 25 bp, Homo sapien
ctggaatggaacaaaattaagaagg

SEQ ID NO: 58060 - DNA, 25 bp, Homo sapien
ctggaatggaacagaattaagaagg

SEQ ID NO: 58061 - DNA, 25 bp, Homo sapien
ctggaatggataagattaatgaagc

SEQ ID NO: 58062 - DNA, 25 bp, Homo sapien
ctggaatggcatatgcaagcaactg

SEQ ID NO: 58063 - DNA, 25 bp, Homo sapien
ctggaatggtatatgcaagcaactg

SEQ ID NO: 58064 - DNA, 25 bp, Homo sapien
ctggaattataacagacatgtgctc

SEQ ID NO: 58065 - DNA, 25 bp, Homo sapien
ctggaattataatagacatgtgctc

SEQ ID NO: 58066 - DNA, 25 bp, Homo sapien
ctggaattcacacgcttactgaact

SEQ ID NO: 58067 - DNA, 25 bp, Homo sapien
ctggaattcacatgcttactgaact

SEQ ID NO: 58068 - DNA, 25 bp, Homo sapien
ctggaattgacactgttgcttctgt

SEQ ID NO: 58069 - DNA, 25 bp, Homo sapien
ctggaattgacagtgttgcttctgt

SEQ ID NO: 58070 - DNA, 25 bp, Homo sapien
ctggacaaagacatggagttaggaa

SEQ ID NO: 58071 - DNA, 25 bp, Homo sapien
ctggacaaagacttggagttaggaa

SEQ ID NO: 58072 - DNA, 25 bp, Homo sapien
ctggacaacgaaacactgcagctgg

SEQ ID NO: 58073 - DNA, 25 bp, Homo sapien
ctggacaactacccttttcaggaaa

SEQ ID NO: 58074 - DNA, 25 bp, Homo sapien
ctggacaactatccttttcaggaaa

SEQ ID NO: 58075 - DNA, 25 bp, Homo sapien
ctggacaatgaaacactgcagctgg

SEQ ID NO: 58076 - DNA, 25 bp, Homo sapien
ctggacaatttacataagggtatgt

SEQ ID NO: 58077 - DNA, 25 bp, Homo sapien
ctggacaatttagataagggtatgt

SEQ ID NO: 58078 - DNA, 25 bp, Homo sapien
ctggacataaacaacctcacagaat

SEQ ID NO: 58079 - DNA, 25 bp, Homo sapien
ctggacataaacaatctcacagaat

SEQ ID NO: 58080 - DNA, 25 bp, Homo sapien
ctggacatcatcagtgccagcggaa

SEQ ID NO: 58081 - DNA, 25 bp, Homo sapien
ctggacatctactgggaatccagaa

SEQ ID NO: 58082 - DNA, 25 bp, Homo sapien
ctggacatctattgggaatccagaa

SEQ ID NO: 58083 - DNA, 25 bp, Homo sapien
ctggacattatcagtgccagcggaa

SEQ ID NO: 58084 - DNA, 25 bp, Homo sapien
ctggaccggctcactggactcattc

SEQ ID NO: 58085 - DNA, 25 bp, Homo sapien
ctggaccggcttactggactcattc

SEQ ID NO: 58086 - DNA, 25 bp, Homo sapien
ctggaccttccttcataatagactc

SEQ ID NO: 58087 - DNA, 25 bp, Homo sapien
ctggaccttccttcgtaatagactc

SEQ ID NO: 58088 - DNA, 25 bp, Homo sapien
ctggaccttcgctatccttctctaa

SEQ ID NO: 58089 - DNA, 25 bp, Homo sapien
ctggaccttcgttatccttctctaa

SEQ ID NO: 58090 - DNA, 25 bp, Homo sapien
ctggactaggttcctaagagcaagg

SEQ ID NO: 58091 - DNA, 25 bp, Homo sapien
ctggactaggttcctacgagcaagg

SEQ ID NO: 58092 - DNA, 25 bp, Homo sapien
ctggactatacaatccagtttaaat

SEQ ID NO: 58093 - DNA, 25 bp, Homo sapien
ctggactatacgatccagtttaaat

SEQ ID NO: 58094 - DNA, 25 bp, Homo sapien
ctggactatgatagccacagcagct

SEQ ID NO: 58095 - DNA, 25 bp, Homo sapien
ctggactatgatggccacagcagct

SEQ ID NO: 58096 - DNA, 25 bp, Homo sapien
ctggactctaaaaaaacggaatttg

SEQ ID NO: 58097 - DNA, 25 bp, Homo sapien
ctggactctgaaaaaacggaatttg

SEQ ID NO: 58098 - DNA, 25 bp, Homo sapien
ctggactgaaactgaaaggaaaccc

SEQ ID NO: 58099 - DNA, 25 bp, Homo sapien
ctggactgaaattgaaaggaaaccc

SEQ ID NO: 58100 - DNA, 25 bp, Homo sapien
ctggactgggtactccctattgttt

SEQ ID NO: 58101 - DNA, 25 bp, Homo sapien
ctggactgggtattccctattgttt

SEQ ID NO: 58102 - DNA, 25 bp, Homo sapien
ctggactgttccttttggttagcaa

SEQ ID NO: 58103 - DNA, 25 bp, Homo sapien
ctggactgttctttttggttagcaa

SEQ ID NO: 58104 - DNA, 25 bp, Homo sapien
ctggagaacataaacctaagtgaaa

SEQ ID NO: 58105 - DNA, 25 bp, Homo sapien
ctggagaacataatcctaagtgaaa

SEQ ID NO: 58106 - DNA, 25 bp, Homo sapien
ctggagaactttatagtccagttga

SEQ ID NO: 58107 - DNA, 25 bp, Homo sapien
ctggagaattttatagtccagttga

SEQ ID NO: 58108 - DNA, 25 bp, Homo sapien
ctggagacatggtgaaataggccaa

SEQ ID NO: 58109 - DNA, 25 bp, Homo sapien
ctggagacgtggtgaaataggccaa

SEQ ID NO: 58110 - DNA, 25 bp, Homo sapien
ctggagagacgtccgcaaacaggtt

SEQ ID NO: 58111 - DNA, 25 bp, Homo sapien
ctggagagacgtctgcaaacaggtt

SEQ ID NO: 58112 - DNA, 25 bp, Homo sapien
ctggagagatgtccgcaaacaggtt

SEQ ID NO: 58113 - DNA, 25 bp, Homo sapien
ctggagaggaatgaacaagagttta

SEQ ID NO: 58114 - DNA, 25 bp, Homo sapien
ctggagaggaatgaaccagagttta

SEQ ID NO: 58115 - DNA, 25 bp, Homo sapien
ctggagagttcatcaccaatagacc

SEQ ID NO: 58116 - DNA, 25 bp, Homo sapien
ctggagagttcgtcaccaatagacc

SEQ ID NO: 58117 - DNA, 25 bp, Homo sapien
ctggagatgacaactttaattatta

SEQ ID NO: 58118 - DNA, 25 bp, Homo sapien
ctggagatggcaactttaattatta

SEQ ID NO: 58119 - DNA, 25 bp, Homo sapien
ctggagattacagcgcattctttct

SEQ ID NO: 58120 - DNA, 25 bp, Homo sapien
ctggagattacagtgcattctttct

SEQ ID NO: 58121 - DNA, 25 bp, Homo sapien
ctggagcccaatagcttcattgggg

SEQ ID NO: 58122 - DNA, 25 bp, Homo sapien
ctggagcctaatagcttcattgggg

SEQ ID NO: 58123 - DNA, 25 bp, Homo sapien
ctggagctaaaaaatgaagcctagt

SEQ ID NO: 58124 - DNA, 25 bp, Homo sapien
ctggagctaaaacatgaagcctagt

SEQ ID NO: 58125 - DNA, 25 bp, Homo sapien
ctggagctacacaccgtcaaattaa

SEQ ID NO: 58126 - DNA, 25 bp, Homo sapien
ctggagctacacactgtcaaattaa

SEQ ID NO: 58127 - DNA, 25 bp, Homo sapien
ctggaggaaaaatcatctttccaaa

SEQ ID NO: 58128 - DNA, 25 bp, Homo sapien
ctggaggaaaaatcgtctttccaaa

SEQ ID NO: 58129 - DNA, 25 bp, Homo sapien
ctggaggctgaaaatacaagatcag

SEQ ID NO: 58130 - DNA, 25 bp, Homo sapien
ctggaggctgaaagtacaagatcag

SEQ ID NO: 58131 - DNA, 25 bp, Homo sapien
ctggagggtcgtgaatagcagtgcc

SEQ ID NO: 58132 - DNA, 25 bp, Homo sapien
ctggagggttgtgaatagcagtgcc

SEQ ID NO: 58133 - DNA, 25 bp, Homo sapien
ctggagtacctgaatcatacaatta

SEQ ID NO: 58134 - DNA, 25 bp, Homo sapien
ctggagtacctgcatcatacaatta

SEQ ID NO: 58135 - DNA, 25 bp, Homo sapien
ctggagtacgaaaaaaaactcctgc

SEQ ID NO: 58136 - DNA, 25 bp, Homo sapien
ctggagtacgaaaacaaactcctgc

SEQ ID NO: 58137 - DNA, 25 bp, Homo sapien
ctggagtagacacactaacacataa

SEQ ID NO: 58138 - DNA, 25 bp, Homo sapien
ctggagtagacaccctaacacataa

SEQ ID NO: 58139 - DNA, 25 bp, Homo sapien
ctggagtatagatccacgtctctgt

SEQ ID NO: 58140 - DNA, 25 bp, Homo sapien
ctggagtatagatccatgtctctgt

SEQ ID NO: 58141 - DNA, 25 bp, Homo sapien
ctggagtatcgcaatcatgacttct

SEQ ID NO: 58142 - DNA, 25 bp, Homo sapien
ctggagtattgcaatcatgacttct

SEQ ID NO: 58143 - DNA, 25 bp, Homo sapien
ctggagtatttctatagagaggatc

SEQ ID NO: 58144 - DNA, 25 bp, Homo sapien
ctggagtatttctttagagaggatc

SEQ ID NO: 58145 - DNA, 25 bp, Homo sapien
ctggagtcacaattctgctaacagt

SEQ ID NO: 58146 - DNA, 25 bp, Homo sapien
ctggagtcacaattttgctaacagt

SEQ ID NO: 58147 - DNA, 25 bp, Homo sapien
ctggagtcaggattcttctttagca

SEQ ID NO: 58148 - DNA, 25 bp, Homo sapien
ctggagtcagggttcttctttagca

SEQ ID NO: 58149 - DNA, 25 bp, Homo sapien
ctggagtcccagcgcggcaggaaaa

SEQ ID NO: 58150 - DNA, 25 bp, Homo sapien
ctggagtcccagtgcggcaggaaaa

SEQ ID NO: 58151 - DNA, 25 bp, Homo sapien
ctggagtgtaataagcaagagagag

SEQ ID NO: 58152 - DNA, 25 bp, Homo sapien
ctggagtgtaatgagcaagagagag

SEQ ID NO: 58153 - DNA, 25 bp, Homo sapien
ctggataactctctataactccttc

SEQ ID NO: 58154 - DNA, 25 bp, Homo sapien
ctggataactctctgtaactccttc

SEQ ID NO: 58155 - DNA, 25 bp, Homo sapien
ctggataaggtaactgccataacaa

SEQ ID NO: 58156 - DNA, 25 bp, Homo sapien
ctggataaggtcactgccataacaa

SEQ ID NO: 58157 - DNA, 25 bp, Homo sapien
ctggatacattttgaaaatagaacc

SEQ ID NO: 58158 - DNA, 25 bp, Homo sapien
ctggatacgttttgaaaatagaacc

SEQ ID NO: 58159 - DNA, 25 bp, Homo sapien
ctggatatgaaattttgggttaaca

SEQ ID NO: 58160 - DNA, 25 bp, Homo sapien
ctggatatgctttctacattgtatc

SEQ ID NO: 58161 - DNA, 25 bp, Homo sapien
ctggatatggaattttgggttaaca

SEQ ID NO: 58162 - DNA, 25 bp, Homo sapien
ctggatattctttctacattgtatc

SEQ ID NO: 58163 - DNA, 25 bp, Homo sapien
ctggatcaacacgtgagattagcta

SEQ ID NO: 58164 - DNA, 25 bp, Homo sapien
ctggatcaacatgtgagattagcta

SEQ ID NO: 58165 - DNA, 25 bp, Homo sapien
ctggatcatcgcaataactgtctaa

SEQ ID NO: 58166 - DNA, 25 bp, Homo sapien
ctggatcattgcaataactgtctaa

SEQ ID NO: 58167 - DNA, 25 bp, Homo sapien
ctggatcccggactaggaaaaggac

SEQ ID NO: 58168 - DNA, 25 bp, Homo sapien
ctggatcctggactaggaaaaggac

SEQ ID NO: 58169 - DNA, 25 bp, Homo sapien
ctggatctaatcttatttatgcaaa

SEQ ID NO: 58170 - DNA, 25 bp, Homo sapien
ctggatctcatcttatttatgcaaa

SEQ ID NO: 58171 - DNA, 25 bp, Homo sapien
ctggatctgctttactagcacattt

SEQ ID NO: 58172 - DNA, 25 bp, Homo sapien
ctggatctgttttactagcacattt

SEQ ID NO: 58173 - DNA, 25 bp, Homo sapien
ctggatctttatccaccttctcctc

SEQ ID NO: 58174 - DNA, 25 bp, Homo sapien
ctggatctttattcaccttctcctc

SEQ ID NO: 58175 - DNA, 25 bp, Homo sapien
ctggatgtctaaccattccttgttg

SEQ ID NO: 58176 - DNA, 25 bp, Homo sapien
ctggatgtctaactattccttgttg

SEQ ID NO: 58177 - DNA, 25 bp, Homo sapien
ctggatgttttcaaatagtcgcatt

SEQ ID NO: 58178 - DNA, 25 bp, Homo sapien
ctggatgttttcaagtagtcgcatt

SEQ ID NO: 58179 - DNA, 25 bp, Homo sapien
ctggattaaaacaaattgtgattaa

SEQ ID NO: 58180 - DNA, 25 bp, Homo sapien
ctggattaatcccatgtgtttgagc

SEQ ID NO: 58181 - DNA, 25 bp, Homo sapien
ctggattaatcccttgtgtttgagc

SEQ ID NO: 58182 - DNA, 25 bp, Homo sapien
ctggattacaacaaattgtgattaa

SEQ ID NO: 58183 - DNA, 25 bp, Homo sapien
ctggattagagtaggccttaagtcc

SEQ ID NO: 58184 - DNA, 25 bp, Homo sapien
ctggattagcgtaggccttaagtcc

SEQ ID NO: 58185 - DNA, 25 bp, Homo sapien
ctggattatcaggattatcacaatt

SEQ ID NO: 58186 - DNA, 25 bp, Homo sapien
ctggattatcaggtttatcacaatt

SEQ ID NO: 58187 - DNA, 25 bp, Homo sapien
ctggattatgttatcttcttttaca

SEQ ID NO: 58188 - DNA, 25 bp, Homo sapien
ctggattatgttattttcttttaca

SEQ ID NO: 58189 - DNA, 25 bp, Homo sapien
ctggattccgcagtgccaaaccaaa

SEQ ID NO: 58190 - DNA, 25 bp, Homo sapien
ctggattccgcggtgccaaaccaaa

SEQ ID NO: 58191 - DNA, 25 bp, Homo sapien
ctggattctctcatacttagcacca

SEQ ID NO: 58192 - DNA, 25 bp, Homo sapien
ctggattctctgatacttagcacca

SEQ ID NO: 58193 - DNA, 25 bp, Homo sapien
ctggattgctactaaaaatgcagaa

SEQ ID NO: 58194 - DNA, 25 bp, Homo sapien
ctggattgctagtaaaaatgcagaa

SEQ ID NO: 58195 - DNA, 25 bp, Homo sapien
ctggattggaagtactctgcatctt

SEQ ID NO: 58196 - DNA, 25 bp, Homo sapien
ctggattggaagtgctctgcatctt

SEQ ID NO: 58197 - DNA, 25 bp, Homo sapien
ctggatttagtaactgcaggtaagc

SEQ ID NO: 58198 - DNA, 25 bp, Homo sapien
ctggatttagtaattgcaggtaagc

SEQ ID NO: 58199 - DNA, 25 bp, Homo sapien
ctggatttcaaagactgtataaaaa

SEQ ID NO: 58200 - DNA, 25 bp, Homo sapien
ctggatttcaaagattgtataaaaa

SEQ ID NO: 58201 - DNA, 25 bp, Homo sapien
ctggcaaaattaaacgtatattaaa

SEQ ID NO: 58202 - DNA, 25 bp, Homo sapien
ctggcaaaattaaaggtatattaaa

SEQ ID NO: 58203 - DNA, 25 bp, Homo sapien
ctggcaacactgagcttttgtctct

SEQ ID NO: 58204 - DNA, 25 bp, Homo sapien
ctggcaacattgagcttttgtctct

SEQ ID NO: 58205 - DNA, 25 bp, Homo sapien
ctggcaagactgaaatttgaactca

SEQ ID NO: 58206 - DNA, 25 bp, Homo sapien
ctggcaagactggaatttgaactca

SEQ ID NO: 58207 - DNA, 25 bp, Homo sapien
ctggcacaaaacagatctagaataa

SEQ ID NO: 58208 - DNA, 25 bp, Homo sapien
ctggcacaaaactgatctagaataa

SEQ ID NO: 58209 - DNA, 25 bp, Homo sapien
ctggcacaacatacattgcaaatac

SEQ ID NO: 58210 - DNA, 25 bp, Homo sapien
ctggcacaccatacattgcaaatac

SEQ ID NO: 58211 - DNA, 25 bp, Homo sapien
ctggcacacggtttgagatggtctt

SEQ ID NO: 58212 - DNA, 25 bp, Homo sapien
ctggcacactgcagtaccctgtaaa

SEQ ID NO: 58213 - DNA, 25 bp, Homo sapien
ctggcacactgcggtaccctgtaaa

SEQ ID NO: 58214 - DNA, 25 bp, Homo sapien
ctggcacagggtttgagatggtctt

SEQ ID NO: 58215 - DNA, 25 bp, Homo sapien
ctggcaccaaagttccaccagccca

SEQ ID NO: 58216 - DNA, 25 bp, Homo sapien
ctggcaccacagattcctataaaca

SEQ ID NO: 58217 - DNA, 25 bp, Homo sapien
ctggcaccacagattcttataaaca

SEQ ID NO: 58218 - DNA, 25 bp, Homo sapien
ctggcaccagagttccaccagccca

SEQ ID NO: 58219 - DNA, 25 bp, Homo sapien
ctggcactatccatagcaggcttct

SEQ ID NO: 58220 - DNA, 25 bp, Homo sapien
ctggcactatccatcgcaggcttct

SEQ ID NO: 58221 - DNA, 25 bp, Homo sapien
ctggcactctctatgaacattctct

SEQ ID NO: 58222 - DNA, 25 bp, Homo sapien
ctggcactctctgtgaacattctct

SEQ ID NO: 58223 - DNA, 25 bp, Homo sapien
ctggcagatgtatcctaaagaaaaa

SEQ ID NO: 58224 - DNA, 25 bp, Homo sapien
ctggcagatttatcctaaagaaaaa

SEQ ID NO: 58225 - DNA, 25 bp, Homo sapien
ctggcagcatgccgtgagagtcact

SEQ ID NO: 58226 - DNA, 25 bp, Homo sapien
ctggcagcatgctgtgagagtcact

SEQ ID NO: 58227 - DNA, 25 bp, Homo sapien
ctggcagggactttgtttggctttg

SEQ ID NO: 58228 - DNA, 25 bp, Homo sapien
ctggcagggactttttttggctttg

SEQ ID NO: 58229 - DNA, 25 bp, Homo sapien
ctggcaggtggaagacattgagacg

SEQ ID NO: 58230 - DNA, 25 bp, Homo sapien
ctggcaggtggaaggcattgagacg

SEQ ID NO: 58231 - DNA, 25 bp, Homo sapien
ctggcataataaactatttgggcgg

SEQ ID NO: 58232 - DNA, 25 bp, Homo sapien
ctggcataataagctatttgggcgg

SEQ ID NO: 58233 - DNA, 25 bp, Homo sapien
ctggcatccaataggtagaggccag

SEQ ID NO: 58234 - DNA, 25 bp, Homo sapien
ctggcatccgataggtagaggccag

SEQ ID NO: 58235 - DNA, 25 bp, Homo sapien
ctggcatctccaatagtaatcatgt

SEQ ID NO: 58236 - DNA, 25 bp, Homo sapien
ctggcatctccagtagtaatcatgt

SEQ ID NO: 58237 - DNA, 25 bp, Homo sapien
ctggcattagtgaaattgcttcctg

SEQ ID NO: 58238 - DNA, 25 bp, Homo sapien
ctggcattagtgacattgcttcctg

SEQ ID NO: 58239 - DNA, 25 bp, Homo sapien
ctggccaaatgtgcagtggggacta

SEQ ID NO: 58240 - DNA, 25 bp, Homo sapien
ctggccaaatgtgccgtggggacta

SEQ ID NO: 58241 - DNA, 25 bp, Homo sapien
ctggccaactcaacgatacaaaaac

SEQ ID NO: 58242 - DNA, 25 bp, Homo sapien
ctggccaactcatcgatacaaaaac

SEQ ID NO: 58243 - DNA, 25 bp, Homo sapien
ctggccaccgaactgggaaggcctg

SEQ ID NO: 58244 - DNA, 25 bp, Homo sapien
ctggccactgaactgggaaggcctg

SEQ ID NO: 58245 - DNA, 25 bp, Homo sapien
ctggccagtcagataagaaatacag

SEQ ID NO: 58246 - DNA, 25 bp, Homo sapien
ctggccagtcaggtaagaaatacag

SEQ ID NO: 58247 - DNA, 25 bp, Homo sapien
ctggccagttacagccaatatgaac

SEQ ID NO: 58248 - DNA, 25 bp, Homo sapien
ctggccagttacagccgatatgaac

SEQ ID NO: 58249 - DNA, 25 bp, Homo sapien
ctggccatttatgttccgacccaaa

SEQ ID NO: 58250 - DNA, 25 bp, Homo sapien
ctggccatttatgttctgacccaaa

SEQ ID NO: 58251 - DNA, 25 bp, Homo sapien
ctggcccagtacagccgatggaagt

SEQ ID NO: 58252 - DNA, 25 bp, Homo sapien
ctggcccagtatagccgatggaagt

SEQ ID NO: 58253 - DNA, 25 bp, Homo sapien
ctggcctcacttaggattgcagtga

SEQ ID NO: 58254 - DNA, 25 bp, Homo sapien
ctggcctcagcaactccattcactt

SEQ ID NO: 58255 - DNA, 25 bp, Homo sapien
ctggcctcagcagctccattcactt

SEQ ID NO: 58256 - DNA, 25 bp, Homo sapien
ctggcctcagttaggattgcagtga

SEQ ID NO: 58257 - DNA, 25 bp, Homo sapien
ctggcctcttcatgaattgatcgat

SEQ ID NO: 58258 - DNA, 25 bp, Homo sapien
ctggcctcttcttgaattgatcgat

SEQ ID NO: 58259 - DNA, 25 bp, Homo sapien
ctggcctgcacccatgggatggaaa

SEQ ID NO: 58260 - DNA, 25 bp, Homo sapien
ctggcctgcacctatgggatggaaa

SEQ ID NO: 58261 - DNA, 25 bp, Homo sapien
ctggcctggattgacaagcgcaatg

SEQ ID NO: 58262 - DNA, 25 bp, Homo sapien
ctggcctgggttgacaagcgcaatg

SEQ ID NO: 58263 - DNA, 25 bp, Homo sapien
ctggccttagctggccgaatcttca

SEQ ID NO: 58264 - DNA, 25 bp, Homo sapien
ctggccttggctggccgaatcttca

SEQ ID NO: 58265 - DNA, 25 bp, Homo sapien
ctggcgtgacttcatcttgactaat

SEQ ID NO: 58266 - DNA, 25 bp, Homo sapien
ctggcgtgagttcatcttgactaat

SEQ ID NO: 58267 - DNA, 25 bp, Homo sapien
ctggctaaggaaaacacgaattccg

SEQ ID NO: 58268 - DNA, 25 bp, Homo sapien
ctggctaaggaaaacatgaattccg

SEQ ID NO: 58269 - DNA, 25 bp, Homo sapien
ctggctacctctgggccgtcaccca

SEQ ID NO: 58270 - DNA, 25 bp, Homo sapien
ctggctacctctgggctgtcaccca

SEQ ID NO: 58271 - DNA, 25 bp, Homo sapien
ctggctactcttccaacgcaccatg

SEQ ID NO: 58272 - DNA, 25 bp, Homo sapien
ctggctactctttcaacgcaccatg

SEQ ID NO: 58273 - DNA, 25 bp, Homo sapien
ctggctagaatttacaataatatgt

SEQ ID NO: 58274 - DNA, 25 bp, Homo sapien
ctggctagaatttccaataatatgt

SEQ ID NO: 58275 - DNA, 25 bp, Homo sapien
ctggctatgctacagaagacaagaa

SEQ ID NO: 58276 - DNA, 25 bp, Homo sapien
ctggctatgctatagaagacaagaa

SEQ ID NO: 58277 - DNA, 25 bp, Homo sapien
ctggctattctctcgggctgcattt

SEQ ID NO: 58278 - DNA, 25 bp, Homo sapien
ctggctattctctctggctgcattt

SEQ ID NO: 58279 - DNA, 25 bp, Homo sapien
ctggctcaaaaaccactgcaccatc

SEQ ID NO: 58280 - DNA, 25 bp, Homo sapien
ctggctcaaaagccactgcaccatc

SEQ ID NO: 58281 - DNA, 25 bp, Homo sapien
ctggctcagttacgcactttaaatc

SEQ ID NO: 58282 - DNA, 25 bp, Homo sapien
ctggctcagttactcactttaaatc

SEQ ID NO: 58283 - DNA, 25 bp, Homo sapien
ctggctccaattattcccattcctc

SEQ ID NO: 58284 - DNA, 25 bp, Homo sapien
ctggctcccactatgtaaaggctga

SEQ ID NO: 58285 - DNA, 25 bp, Homo sapien
ctggctcccgctatgtaaaggctga

SEQ ID NO: 58286 - DNA, 25 bp, Homo sapien
ctggctccgattattcccattcctc

SEQ ID NO: 58287 - DNA, 25 bp, Homo sapien
ctggctcctaccagcctgctcagct

SEQ ID NO: 58288 - DNA, 25 bp, Homo sapien
ctggctcctactagcctgctcagct

SEQ ID NO: 58289 - DNA, 25 bp, Homo sapien
ctggctcctggtcattacgggaaat

SEQ ID NO: 58290 - DNA, 25 bp, Homo sapien
ctggctccttgtcattacgggaaat

SEQ ID NO: 58291 - DNA, 25 bp, Homo sapien
ctggctctccgtaattatctcttca

SEQ ID NO: 58292 - DNA, 25 bp, Homo sapien
ctggctctccgtagttatctcttca

SEQ ID NO: 58293 - DNA, 25 bp, Homo sapien
ctggctctgagaatatcttcatgcc

SEQ ID NO: 58294 - DNA, 25 bp, Homo sapien
ctggctctgagattatcttcatgcc

SEQ ID NO: 58295 - DNA, 25 bp, Homo sapien
ctggctctgccgtttctactatatt

SEQ ID NO: 58296 - DNA, 25 bp, Homo sapien
ctggctctgtcgtttctactatatt

SEQ ID NO: 58297 - DNA, 25 bp, Homo sapien
ctggctgacgtggtgcccatcagga

SEQ ID NO: 58298 - DNA, 25 bp, Homo sapien
ctggctgacgtgttgcccatcagga

SEQ ID NO: 58299 - DNA, 25 bp, Homo sapien
ctggctgagattacgatatccattg

SEQ ID NO: 58300 - DNA, 25 bp, Homo sapien
ctggctgagattatgatatccattg

SEQ ID NO: 58301 - DNA, 25 bp, Homo sapien
ctggctgatttgttgcctcttttct

SEQ ID NO: 58302 - DNA, 25 bp, Homo sapien
ctggctgatttgtttcctcttttct

SEQ ID NO: 58303 - DNA, 25 bp, Homo sapien
ctggctgcagttaacacaggaaaac

SEQ ID NO: 58304 - DNA, 25 bp, Homo sapien
ctggctgcagtttacacaggaaaac

SEQ ID NO: 58305 - DNA, 25 bp, Homo sapien
ctggctgcatctacttgttggcaca

SEQ ID NO: 58306 - DNA, 25 bp, Homo sapien
ctggctgcatctatttgttggcaca

SEQ ID NO: 58307 - DNA, 25 bp, Homo sapien
ctggctgcgccatctgctcctgaca

SEQ ID NO: 58308 - DNA, 25 bp, Homo sapien
ctggctgcgccatctgttcctgaca

SEQ ID NO: 58309 - DNA, 25 bp, Homo sapien
ctggctgctgggcgttctcctggat

SEQ ID NO: 58310 - DNA, 25 bp, Homo sapien
ctggctgctgggtgttctcctggat

SEQ ID NO: 58311 - DNA, 25 bp, Homo sapien
ctggctggaccatgctaagcagaca

SEQ ID NO: 58312 - DNA, 25 bp, Homo sapien
ctggctggaccgtgctaagcagaca

SEQ ID NO: 58313 - DNA, 25 bp, Homo sapien
ctggctgtaactcactgaaactaac

SEQ ID NO: 58314 - DNA, 25 bp, Homo sapien
ctggctgtcacctggaacttccaaa

SEQ ID NO: 58315 - DNA, 25 bp, Homo sapien
ctggctgtcacctggagcttccaaa

SEQ ID NO: 58316 - DNA, 25 bp, Homo sapien
ctggctgtctaaagatatgttgaat

SEQ ID NO: 58317 - DNA, 25 bp, Homo sapien
ctggctgtctacagatatgttgaat

SEQ ID NO: 58318 - DNA, 25 bp, Homo sapien
ctggctgtgactcactgaaactaac

SEQ ID NO: 58319 - DNA, 25 bp, Homo sapien
ctggctgtgtcctcacagagtgaaa

SEQ ID NO: 58320 - DNA, 25 bp, Homo sapien
ctggctgtgtccttacagagtgaaa

SEQ ID NO: 58321 - DNA, 25 bp, Homo sapien
ctggcttcacataattttcatatag

SEQ ID NO: 58322 - DNA, 25 bp, Homo sapien
ctggcttcagaaaggacccaatgtc

SEQ ID NO: 58323 - DNA, 25 bp, Homo sapien
ctggcttcagaaaggatccaatgtc

SEQ ID NO: 58324 - DNA, 25 bp, Homo sapien
ctggcttccatgtgcagaatagatt

SEQ ID NO: 58325 - DNA, 25 bp, Homo sapien
ctggcttccatgtggagaatagatt

SEQ ID NO: 58326 - DNA, 25 bp, Homo sapien
ctggcttcgcataattttcatatag

SEQ ID NO: 58327 - DNA, 25 bp, Homo sapien
ctggcttctacctatagtatattat

SEQ ID NO: 58328 - DNA, 25 bp, Homo sapien
ctggcttctacctgtagtatattat

SEQ ID NO: 58329 - DNA, 25 bp, Homo sapien
ctggcttctttttcgtagtataata

SEQ ID NO: 58330 - DNA, 25 bp, Homo sapien
ctggcttctttttcttagtataata

SEQ ID NO: 58331 - DNA, 25 bp, Homo sapien
ctggcttgaaggttgatgaaaatcc

SEQ ID NO: 58332 - DNA, 25 bp, Homo sapien
ctggcttgaagtttgatgaaaatcc

SEQ ID NO: 58333 - DNA, 25 bp, Homo sapien
ctggcttgactactgtaactttgta

SEQ ID NO: 58334 - DNA, 25 bp, Homo sapien
ctggcttgactattgtaactttgta

SEQ ID NO: 58335 - DNA, 25 bp, Homo sapien
ctggctttaaatatctgccttacca

SEQ ID NO: 58336 - DNA, 25 bp, Homo sapien
ctggctttcgcaacatcccataatt

SEQ ID NO: 58337 - DNA, 25 bp, Homo sapien
ctggctttcttctggtcgaattggg

SEQ ID NO: 58338 - DNA, 25 bp, Homo sapien
ctggctttcttctggttgaattggg

SEQ ID NO: 58339 - DNA, 25 bp, Homo sapien
ctggctttgaatatctgccttacca

SEQ ID NO: 58340 - DNA, 25 bp, Homo sapien
ctggctttgatgatgccaattgcta

SEQ ID NO: 58341 - DNA, 25 bp, Homo sapien
ctggctttgatgatgctaattgcta

SEQ ID NO: 58342 - DNA, 25 bp, Homo sapien
ctggcttttgcaacatcccataatt

SEQ ID NO: 58343 - DNA, 25 bp, Homo sapien
ctgggaaataacagatactcatcat

SEQ ID NO: 58344 - DNA, 25 bp, Homo sapien
ctgggaaataatagatactcatcat

SEQ ID NO: 58345 - DNA, 25 bp, Homo sapien
ctgggaaccaaacactcctggcacc

SEQ ID NO: 58346 - DNA, 25 bp, Homo sapien
ctgggaaccaaagactcctggcacc

SEQ ID NO: 58347 - DNA, 25 bp, Homo sapien
ctgggaaccacattaaggtatatac

SEQ ID NO: 58348 - DNA, 25 bp, Homo sapien
ctgggaaccacgttaaggtatatac

SEQ ID NO: 58349 - DNA, 25 bp, Homo sapien
ctgggaactaaatggtaaaataaga

SEQ ID NO: 58350 - DNA, 25 bp, Homo sapien
ctgggaactaaattgtaaaataaga

SEQ ID NO: 58351 - DNA, 25 bp, Homo sapien
ctgggaagaatgacgccttctatat

SEQ ID NO: 58352 - DNA, 25 bp, Homo sapien
ctgggaagaatgatgccttctatat

SEQ ID NO: 58353 - DNA, 25 bp, Homo sapien
ctgggaagtgggcattatggtcttt

SEQ ID NO: 58354 - DNA, 25 bp, Homo sapien
ctgggaagtgggcgttatggtcttt

SEQ ID NO: 58355 - DNA, 25 bp, Homo sapien
ctgggaataagctcgatgtgaaggc

SEQ ID NO: 58356 - DNA, 25 bp, Homo sapien
ctgggaataagctggatgtgaaggc

SEQ ID NO: 58357 - DNA, 25 bp, Homo sapien
ctgggacaatgagggacaggtctgt

SEQ ID NO: 58358 - DNA, 25 bp, Homo sapien
ctgggacaatgcgggacaggtctgt

SEQ ID NO: 58359 - DNA, 25 bp, Homo sapien
ctgggacatgctcgtccactagccc

SEQ ID NO: 58360 - DNA, 25 bp, Homo sapien
ctgggacatgctcgtcgactagccc

SEQ ID NO: 58361 - DNA, 25 bp, Homo sapien
ctgggacgcagtatgaccaggaccc

SEQ ID NO: 58362 - DNA, 25 bp, Homo sapien
ctgggacgcggtatgaccaggaccc

SEQ ID NO: 58363 - DNA, 25 bp, Homo sapien
ctgggagactgttccctattgagta

SEQ ID NO: 58364 - DNA, 25 bp, Homo sapien
ctgggagagtgttccctattgagta

SEQ ID NO: 58365 - DNA, 25 bp, Homo sapien
ctgggagctctttggaaacagatta

SEQ ID NO: 58366 - DNA, 25 bp, Homo sapien
ctgggagctttttggaaacagatta

SEQ ID NO: 58367 - DNA, 25 bp, Homo sapien
ctgggataaatcgcacttggtcatg

SEQ ID NO: 58368 - DNA, 25 bp, Homo sapien
ctgggataaattgcacttggtcatg

SEQ ID NO: 58369 - DNA, 25 bp, Homo sapien
ctgggattagtctccaggcatgatt

SEQ ID NO: 58370 - DNA, 25 bp, Homo sapien
ctgggattcgtctccaggcatgatt

SEQ ID NO: 58371 - DNA, 25 bp, Homo sapien
ctgggattgtttattatagcagcat

SEQ ID NO: 58372 - DNA, 25 bp, Homo sapien
ctgggattgtttgttatagcagcat

SEQ ID NO: 58373 - DNA, 25 bp, Homo sapien
ctgggcaaataaacggtttggttta

SEQ ID NO: 58374 - DNA, 25 bp, Homo sapien
ctgggcaaataaatggtttggttta

SEQ ID NO: 58375 - DNA, 25 bp, Homo sapien
ctgggcaacacagtggaacctcatc

SEQ ID NO: 58376 - DNA, 25 bp, Homo sapien
ctgggcaacacagtgggacctcatc

SEQ ID NO: 58377 - DNA, 25 bp, Homo sapien
ctgggcaattcaacctattggtgtg

SEQ ID NO: 58378 - DNA, 25 bp, Homo sapien
ctgggcaattcagcctattggtgtg

SEQ ID NO: 58379 - DNA, 25 bp, Homo sapien
ctgggcagggctggcagtcccagga

SEQ ID NO: 58380 - DNA, 25 bp, Homo sapien
ctgggcagggctggtagtcccagga

SEQ ID NO: 58381 - DNA, 25 bp, Homo sapien
ctgggcatcactgcgaattatttag

SEQ ID NO: 58382 - DNA, 25 bp, Homo sapien
ctgggcatcactgtgaattatttag

SEQ ID NO: 58383 - DNA, 25 bp, Homo sapien
ctgggcatccgtttctccatttgtc

SEQ ID NO: 58384 - DNA, 25 bp, Homo sapien
ctgggcatctgtttctccatttgtc

SEQ ID NO: 58385 - DNA, 25 bp, Homo sapien
ctgggcatcttgagttttagcttca

SEQ ID NO: 58386 - DNA, 25 bp, Homo sapien
ctgggcattttctcgttggtaggct

SEQ ID NO: 58387 - DNA, 25 bp, Homo sapien
ctgggcattttgagttttagcttca

SEQ ID NO: 58388 - DNA, 25 bp, Homo sapien
ctgggcattttttcgttggtaggct

SEQ ID NO: 58389 - DNA, 25 bp, Homo sapien
ctgggccaaagttcatcaggtagta

SEQ ID NO: 58390 - DNA, 25 bp, Homo sapien
ctgggccaaggttcatcaggtagta

SEQ ID NO: 58391 - DNA, 25 bp, Homo sapien
ctgggccagtctctccacccagaat

SEQ ID NO: 58392 - DNA, 25 bp, Homo sapien
ctgggccagtctgtccacccagaat

SEQ ID NO: 58393 - DNA, 25 bp, Homo sapien
ctgggccgccctgaaacgaatcaga

SEQ ID NO: 58394 - DNA, 25 bp, Homo sapien
ctgggccgccctgaaatgaatcaga

SEQ ID NO: 58395 - DNA, 25 bp, Homo sapien
ctgggccttatctcaccaagtttca

SEQ ID NO: 58396 - DNA, 25 bp, Homo sapien
ctgggccttatgtcaccaagtttca

SEQ ID NO: 58397 - DNA, 25 bp, Homo sapien
ctgggcgagactcatggattctttg

SEQ ID NO: 58398 - DNA, 25 bp, Homo sapien
ctgggcgagtctcatggattctttg

SEQ ID NO: 58399 - DNA, 25 bp, Homo sapien
ctgggcgccagccaagacttgcagc

SEQ ID NO: 58400 - DNA, 25 bp, Homo sapien
ctgggcgccggccaagacttgcagc

SEQ ID NO: 58401 - DNA, 25 bp, Homo sapien
ctgggctctctattctcctttgctt

SEQ ID NO: 58402 - DNA, 25 bp, Homo sapien
ctgggctctcttttctcctttgctt

SEQ ID NO: 58403 - DNA, 25 bp, Homo sapien
ctgggctctttctgtttgtcatcac

SEQ ID NO: 58404 - DNA, 25 bp, Homo sapien
ctgggctctttttgtttgtcatcac

SEQ ID NO: 58405 - DNA, 25 bp, Homo sapien
ctgggctgatctgaatacaattgtt

SEQ ID NO: 58406 - DNA, 25 bp, Homo sapien
ctgggctggtctgaatacaattgtt

SEQ ID NO: 58407 - DNA, 25 bp, Homo sapien
ctgggcttccaagcattctgatttt

SEQ ID NO: 58408 - DNA, 25 bp, Homo sapien
ctgggcttccaagtattctgatttt

SEQ ID NO: 58409 - DNA, 25 bp, Homo sapien
ctgggcttgtgattcctggtataaa

SEQ ID NO: 58410 - DNA, 25 bp, Homo sapien
ctgggcttttgattcctggtataaa

SEQ ID NO: 58411 - DNA, 25 bp, Homo sapien
ctggggaatcccttacatttcagtg

SEQ ID NO: 58412 - DNA, 25 bp, Homo sapien
ctggggaatcctttacatttcagtg

SEQ ID NO: 58413 - DNA, 25 bp, Homo sapien
ctggggacacaagattatagatgta

SEQ ID NO: 58414 - DNA, 25 bp, Homo sapien
ctggggacacaatattatagatgta

SEQ ID NO: 58415 - DNA, 25 bp, Homo sapien
ctggggagatgcaattcagcccata

SEQ ID NO: 58416 - DNA, 25 bp, Homo sapien
ctggggagatgcatttcagcccata

SEQ ID NO: 58417 - DNA, 25 bp, Homo sapien
ctggggagccaacgggcagtatgac

SEQ ID NO: 58418 - DNA, 25 bp, Homo sapien
ctggggagccaatgggcagtatgac

SEQ ID NO: 58419 - DNA, 25 bp, Homo sapien
ctggggataaagaataagccaagtc

SEQ ID NO: 58420 - DNA, 25 bp, Homo sapien
ctggggataatccagctaagcagat

SEQ ID NO: 58421 - DNA, 25 bp, Homo sapien
ctggggataattcagctaagcagat

SEQ ID NO: 58422 - DNA, 25 bp, Homo sapien
ctggggatacagaaatggagaagcc

SEQ ID NO: 58423 - DNA, 25 bp, Homo sapien
ctggggatacagaataagccaagtc

SEQ ID NO: 58424 - DNA, 25 bp, Homo sapien
ctggggatagagaaatggagaagcc

SEQ ID NO: 58425 - DNA, 25 bp, Homo sapien
ctggggattgaatgggccatactag

SEQ ID NO: 58426 - DNA, 25 bp, Homo sapien
ctggggattgaatgtgccatactag

SEQ ID NO: 58427 - DNA, 25 bp, Homo sapien
ctggggcacgaagactccaagttag

SEQ ID NO: 58428 - DNA, 25 bp, Homo sapien
ctggggcagtccaggtgtggagctc

SEQ ID NO: 58429 - DNA, 25 bp, Homo sapien
ctggggcagtccatgtgtggagctc

SEQ ID NO: 58430 - DNA, 25 bp, Homo sapien
ctggggcatgaagactccaagttag

SEQ ID NO: 58431 - DNA, 25 bp, Homo sapien
ctgggggataggatccaagttctga

SEQ ID NO: 58432 - DNA, 25 bp, Homo sapien
ctgggggataggatcccagttctga

SEQ ID NO: 58433 - DNA, 25 bp, Homo sapien
ctgggggctatttcttcgtgtacta

SEQ ID NO: 58434 - DNA, 25 bp, Homo sapien
ctgggggctatttctttgtgtacta

SEQ ID NO: 58435 - DNA, 25 bp, Homo sapien
ctggggtgctcagaggacgcctgtg

SEQ ID NO: 58436 - DNA, 25 bp, Homo sapien
ctggggtggatgcgaacatgaaaag

SEQ ID NO: 58437 - DNA, 25 bp, Homo sapien
ctggggtggatgtgaacatgaaaag

SEQ ID NO: 58438 - DNA, 25 bp, Homo sapien
ctggggtgttcagaggacgcctgtg

SEQ ID NO: 58439 - DNA, 25 bp, Homo sapien
ctggggttctttcgttctgaaacag

SEQ ID NO: 58440 - DNA, 25 bp, Homo sapien
ctggggttctttggttctgaaacag

SEQ ID NO: 58441 - DNA, 25 bp, Homo sapien
ctgggtatcatcaggtctctccttt

SEQ ID NO: 58442 - DNA, 25 bp, Homo sapien
ctgggtatcatcagttctctccttt

SEQ ID NO: 58443 - DNA, 25 bp, Homo sapien
ctgggtattttgttcttttagcata

SEQ ID NO: 58444 - DNA, 25 bp, Homo sapien
ctgggtatttttttcttttagcata

SEQ ID NO: 58445 - DNA, 25 bp, Homo sapien
ctgggtcactgggttgttattgcct

SEQ ID NO: 58446 - DNA, 25 bp, Homo sapien
ctgggtcactgtgttgttattgcct

SEQ ID NO: 58447 - DNA, 25 bp, Homo sapien
ctgggtcaggctgcatgaatcactt

SEQ ID NO: 58448 - DNA, 25 bp, Homo sapien
ctgggtcaggctgcgtgaatcactt

SEQ ID NO: 58449 - DNA, 25 bp, Homo sapien
ctgggtccagcattaaacagctctg

SEQ ID NO: 58450 - DNA, 25 bp, Homo sapien
ctgggtccagcattaaccagctctg

SEQ ID NO: 58451 - DNA, 25 bp, Homo sapien
ctgggtgaaagccatgtgctcttcc

SEQ ID NO: 58452 - DNA, 25 bp, Homo sapien
ctgggtgaaagccgtgtgctcttcc

SEQ ID NO: 58453 - DNA, 25 bp, Homo sapien
ctgggtgaacccgaacttcaaagtg

SEQ ID NO: 58454 - DNA, 25 bp, Homo sapien
ctgggtgaacccggacttcaaagtg

SEQ ID NO: 58455 - DNA, 25 bp, Homo sapien
ctgggtgacaatatgaagattttta

SEQ ID NO: 58456 - DNA, 25 bp, Homo sapien
ctgggtgacaatatgaggattttta

SEQ ID NO: 58457 - DNA, 25 bp, Homo sapien
ctgggtgactatgtaatctgaactt

SEQ ID NO: 58458 - DNA, 25 bp, Homo sapien
ctgggtgagattctcaggctcatca

SEQ ID NO: 58459 - DNA, 25 bp, Homo sapien
ctgggtgagattctcatgctcatca

SEQ ID NO: 58460 - DNA, 25 bp, Homo sapien
ctgggtgattatgtaatctgaactt

SEQ ID NO: 58461 - DNA, 25 bp, Homo sapien
ctgggtgcattacacttctacaaag

SEQ ID NO: 58462 - DNA, 25 bp, Homo sapien
ctgggtgcctcaacagcccttgttt

SEQ ID NO: 58463 - DNA, 25 bp, Homo sapien
ctgggtgcctcaacagtccttgttt

SEQ ID NO: 58464 - DNA, 25 bp, Homo sapien
ctgggtgctttacacttctacaaag

SEQ ID NO: 58465 - DNA, 25 bp, Homo sapien
ctgggtggaatgattgagtaaaagt

SEQ ID NO: 58466 - DNA, 25 bp, Homo sapien
ctgggtggaatgattgcgtaaaagt

SEQ ID NO: 58467 - DNA, 25 bp, Homo sapien
ctgggtgtttgtggagatggatgga

SEQ ID NO: 58468 - DNA, 25 bp, Homo sapien
ctgggtgtttgtggcgatggatgga

SEQ ID NO: 58469 - DNA, 25 bp, Homo sapien
ctgggttaccaacaagagcaaaaga

SEQ ID NO: 58470 - DNA, 25 bp, Homo sapien
ctgggttaccaacaggagcaaaaga

SEQ ID NO: 58471 - DNA, 25 bp, Homo sapien
ctgggttagtgtatttcgcagtgtc

SEQ ID NO: 58472 - DNA, 25 bp, Homo sapien
ctgggttagtgtattttgcagtgtc

SEQ ID NO: 58473 - DNA, 25 bp, Homo sapien
ctgggttcaagccacgactctgcta

SEQ ID NO: 58474 - DNA, 25 bp, Homo sapien
ctgggttcaagtcacgactctgcta

SEQ ID NO: 58475 - DNA, 25 bp, Homo sapien
ctgggttccatttacaaagacaaag

SEQ ID NO: 58476 - DNA, 25 bp, Homo sapien
ctgggttccatttagaaagacaaag

SEQ ID NO: 58477 - DNA, 25 bp, Homo sapien
ctgggttgaagtttaatttctgcct

SEQ ID NO: 58478 - DNA, 25 bp, Homo sapien
ctgggttgaggtttaatttctgcct

SEQ ID NO: 58479 - DNA, 25 bp, Homo sapien
ctgggtttcaagactaggaccaaga

SEQ ID NO: 58480 - DNA, 25 bp, Homo sapien
ctgggtttcaagattaggaccaaga

SEQ ID NO: 58481 - DNA, 25 bp, Homo sapien
ctgggttttctcgtccatttcttca

SEQ ID NO: 58482 - DNA, 25 bp, Homo sapien
ctgggttttcttgtccatttcttca

SEQ ID NO: 58483 - DNA, 25 bp, Homo sapien
ctggtaaacctacaaaaacttgcaa

SEQ ID NO: 58484 - DNA, 25 bp, Homo sapien
ctggtaaacctataaaaacttgcaa

SEQ ID NO: 58485 - DNA, 25 bp, Homo sapien
ctggtaacaagttacgacaaagcag

SEQ ID NO: 58486 - DNA, 25 bp, Homo sapien
ctggtaacaagttatgacaaagcag

SEQ ID NO: 58487 - DNA, 25 bp, Homo sapien
ctggtaacagcttccttctggaccg

SEQ ID NO: 58488 - DNA, 25 bp, Homo sapien
ctggtaacagcttctttctggaccg

SEQ ID NO: 58489 - DNA, 25 bp, Homo sapien
ctggtaaccgtaagtaaatgtttcc

SEQ ID NO: 58490 - DNA, 25 bp, Homo sapien
ctggtaactgtaagtaaatgtttcc

SEQ ID NO: 58491 - DNA, 25 bp, Homo sapien
ctggtaagattcagaaaaaaatgaa

SEQ ID NO: 58492 - DNA, 25 bp, Homo sapien
ctggtaagattcaggaaaaaatgaa

SEQ ID NO: 58493 - DNA, 25 bp, Homo sapien
ctggtactctgctctttgtactcta

SEQ ID NO: 58494 - DNA, 25 bp, Homo sapien
ctggtactctgctttttgtactcta

SEQ ID NO: 58495 - DNA, 25 bp, Homo sapien
ctggtagagacagtgcaaccctgct

SEQ ID NO: 58496 - DNA, 25 bp, Homo sapien
ctggtagagacagtgcgaccctgct

SEQ ID NO: 58497 - DNA, 25 bp, Homo sapien
ctggtagaggaaataacatgcctaa

SEQ ID NO: 58498 - DNA, 25 bp, Homo sapien
ctggtagaggaaataatatgcctaa

SEQ ID NO: 58499 - DNA, 25 bp, Homo sapien
ctggtagtatttgcttttgtaataa

SEQ ID NO: 58500 - DNA, 25 bp, Homo sapien
ctggtagtatttgtttttgtaataa

SEQ ID NO: 58501 - DNA, 25 bp, Homo sapien
ctggtatatggtaggtagtgtgccg

SEQ ID NO: 58502 - DNA, 25 bp, Homo sapien
ctggtatattctatcatttagagag

SEQ ID NO: 58503 - DNA, 25 bp, Homo sapien
ctggtatattctgtcatttagagag

SEQ ID NO: 58504 - DNA, 25 bp, Homo sapien
ctggtatattgtaggtagtgtgccg

SEQ ID NO: 58505 - DNA, 25 bp, Homo sapien
ctggtatgtttaaggaagagaaaga

SEQ ID NO: 58506 - DNA, 25 bp, Homo sapien
ctggtatgtttagggaagagaaaga

SEQ ID NO: 58507 - DNA, 25 bp, Homo sapien
ctggtcaaactccttccttttggtg

SEQ ID NO: 58508 - DNA, 25 bp, Homo sapien
ctggtcaaactctttccttttggtg

SEQ ID NO: 58509 - DNA, 25 bp, Homo sapien
ctggtcaaagtcctattctaaggtc

SEQ ID NO: 58510 - DNA, 25 bp, Homo sapien
ctggtcaaatccaactggaacccag

SEQ ID NO: 58511 - DNA, 25 bp, Homo sapien
ctggtcaaatccaattggaacccag

SEQ ID NO: 58512 - DNA, 25 bp, Homo sapien
ctggtcaacatatccatcactccat

SEQ ID NO: 58513 - DNA, 25 bp, Homo sapien
ctggtcaacgtatccatcactccat

SEQ ID NO: 58514 - DNA, 25 bp, Homo sapien
ctggtcaagaactagaggacttcta

SEQ ID NO: 58515 - DNA, 25 bp, Homo sapien
ctggtcaaggactagaggacttcta

SEQ ID NO: 58516 - DNA, 25 bp, Homo sapien
ctggtcaaggtcctattctaaggtc

SEQ ID NO: 58517 - DNA, 25 bp, Homo sapien
ctggtcacacgttcctcaactgatc

SEQ ID NO: 58518 - DNA, 25 bp, Homo sapien
ctggtcacatgttcctcaactgatc

SEQ ID NO: 58519 - DNA, 25 bp, Homo sapien
ctggtccacgtagatttctatgaat

SEQ ID NO: 58520 - DNA, 25 bp, Homo sapien
ctggtccacgtggatttctatgaat

SEQ ID NO: 58521 - DNA, 25 bp, Homo sapien
ctggtcccagaattaaggctgggct

SEQ ID NO: 58522 - DNA, 25 bp, Homo sapien
ctggtcccggaattaaggctgggct

SEQ ID NO: 58523 - DNA, 25 bp, Homo sapien
ctggtccctgcattctagccactcc

SEQ ID NO: 58524 - DNA, 25 bp, Homo sapien
ctggtccctgcgttctagccactcc

SEQ ID NO: 58525 - DNA, 25 bp, Homo sapien
ctggtcctttgacctaggattatct

SEQ ID NO: 58526 - DNA, 25 bp, Homo sapien
ctggtcctttgatctaggattatct

SEQ ID NO: 58527 - DNA, 25 bp, Homo sapien
ctggtctaaactgcaagtgacttat

SEQ ID NO: 58528 - DNA, 25 bp, Homo sapien
ctggtctaaacttcaagtgacttat

SEQ ID NO: 58529 - DNA, 25 bp, Homo sapien
ctggtctagcaaaaaatcggatatg

SEQ ID NO: 58530 - DNA, 25 bp, Homo sapien
ctggtctagcacaaaatcggatatg

SEQ ID NO: 58531 - DNA, 25 bp, Homo sapien
ctggtctcaaagccataattgatat

SEQ ID NO: 58532 - DNA, 25 bp, Homo sapien
ctggtctcaaagccgtaattgatat

SEQ ID NO: 58533 - DNA, 25 bp, Homo sapien
ctggtctccttgcgtaattgagagt

SEQ ID NO: 58534 - DNA, 25 bp, Homo sapien
ctggtctccttgtgtaattgagagt

SEQ ID NO: 58535 - DNA, 25 bp, Homo sapien
ctggtctttttcggctgaatggctt

SEQ ID NO: 58536 - DNA, 25 bp, Homo sapien
ctggtcttttttggctgaatggctt

SEQ ID NO: 58537 - DNA, 25 bp, Homo sapien
ctggtgacagtgcaatcaaaaatta

SEQ ID NO: 58538 - DNA, 25 bp, Homo sapien
ctggtgacagtgcgatcaaaaatta

SEQ ID NO: 58539 - DNA, 25 bp, Homo sapien
ctggtgataaagcatcatgaaattc

SEQ ID NO: 58540 - DNA, 25 bp, Homo sapien
ctggtgataggaagaccgcactttg

SEQ ID NO: 58541 - DNA, 25 bp, Homo sapien
ctggtgataggaagactgcactttg

SEQ ID NO: 58542 - DNA, 25 bp, Homo sapien
ctggtgatgaagcatcatgaaattc

SEQ ID NO: 58543 - DNA, 25 bp, Homo sapien
ctggtgattacaattcaacacgaga

SEQ ID NO: 58544 - DNA, 25 bp, Homo sapien
ctggtgattacaattcgacacgaga

SEQ ID NO: 58545 - DNA, 25 bp, Homo sapien
ctggtgccctagcttgtcagccaaa

SEQ ID NO: 58546 - DNA, 25 bp, Homo sapien
ctggtgccctagtttgtcagccaaa

SEQ ID NO: 58547 - DNA, 25 bp, Homo sapien
ctggtgccctctttacaggatctaa

SEQ ID NO: 58548 - DNA, 25 bp, Homo sapien
ctggtgccgcacttgctgggtttta

SEQ ID NO: 58549 - DNA, 25 bp, Homo sapien
ctggtgccgttcccatcgacagcag

SEQ ID NO: 58550 - DNA, 25 bp, Homo sapien
ctggtgccgttcctatcgacagcag

SEQ ID NO: 58551 - DNA, 25 bp, Homo sapien
ctggtgcctcacttgctgggtttta

SEQ ID NO: 58552 - DNA, 25 bp, Homo sapien
ctggtgccttctttacaggatctaa

SEQ ID NO: 58553 - DNA, 25 bp, Homo sapien
ctggtgcttttctccgcaggcctca

SEQ ID NO: 58554 - DNA, 25 bp, Homo sapien
ctggtgcttttctctgcaggcctca

SEQ ID NO: 58555 - DNA, 25 bp, Homo sapien
ctggtggaacacgatccaactccaa

SEQ ID NO: 58556 - DNA, 25 bp, Homo sapien
ctggtggaacatgatccaactccaa

SEQ ID NO: 58557 - DNA, 25 bp, Homo sapien
ctggtggacccactgtaatcacaag

SEQ ID NO: 58558 - DNA, 25 bp, Homo sapien
ctggtggacccattgtaatcacaag

SEQ ID NO: 58559 - DNA, 25 bp, Homo sapien
ctggtggcaaattgattacattgga

SEQ ID NO: 58560 - DNA, 25 bp, Homo sapien
ctggtggcacttacttcagtgtctg

SEQ ID NO: 58561 - DNA, 25 bp, Homo sapien
ctggtggcacttactttagtgtctg

SEQ ID NO: 58562 - DNA, 25 bp, Homo sapien
ctggtggcagattgattacattgga

SEQ ID NO: 58563 - DNA, 25 bp, Homo sapien
ctggtggcataaaacagaaagaagc

SEQ ID NO: 58564 - DNA, 25 bp, Homo sapien
ctggtggcgtaaaacagaaagaagc

SEQ ID NO: 58565 - DNA, 25 bp, Homo sapien
ctggtgggattgaacagaaagaagc

SEQ ID NO: 58566 - DNA, 25 bp, Homo sapien
ctggtgggattggacagaaagaagc

SEQ ID NO: 58567 - DNA, 25 bp, Homo sapien
ctggtggtactaccaaggctttgac

SEQ ID NO: 58568 - DNA, 25 bp, Homo sapien
ctggtggtactatcaaggctttgac

SEQ ID NO: 58569 - DNA, 25 bp, Homo sapien
ctggtggttctgaacactggagttg

SEQ ID NO: 58570 - DNA, 25 bp, Homo sapien
ctggtggttctgaatactggagttg

SEQ ID NO: 58571 - DNA, 25 bp, Homo sapien
ctggtgtgctcacttggccagaagc

SEQ ID NO: 58572 - DNA, 25 bp, Homo sapien
ctggtgtgctcatttggccagaagc

SEQ ID NO: 58573 - DNA, 25 bp, Homo sapien
ctggtgtttttgggttagttttgca

SEQ ID NO: 58574 - DNA, 25 bp, Homo sapien
ctggtgttttttggttagttttgca

SEQ ID NO: 58575 - DNA, 25 bp, Homo sapien
ctggttaaaatgggtagactcttca

SEQ ID NO: 58576 - DNA, 25 bp, Homo sapien
ctggttaaaatgtgtagactcttca

SEQ ID NO: 58577 - DNA, 25 bp, Homo sapien
ctggttagtcttcttgttctaagtt

SEQ ID NO: 58578 - DNA, 25 bp, Homo sapien
ctggttagtgttcttgttctaagtt

SEQ ID NO: 58579 - DNA, 25 bp, Homo sapien
ctggttatataatcatagacaagtt

SEQ ID NO: 58580 - DNA, 25 bp, Homo sapien
ctggttatctctatttaaatggagc

SEQ ID NO: 58581 - DNA, 25 bp, Homo sapien
ctggttatggcttttgacaacatca

SEQ ID NO: 58582 - DNA, 25 bp, Homo sapien
ctggttatggcttttggcaacatca

SEQ ID NO: 58583 - DNA, 25 bp, Homo sapien
ctggttatgtaatcatagacaagtt

SEQ ID NO: 58584 - DNA, 25 bp, Homo sapien
ctggttatgttgtttactgatatcc

SEQ ID NO: 58585 - DNA, 25 bp, Homo sapien
ctggttatgttgtttattgatatcc

SEQ ID NO: 58586 - DNA, 25 bp, Homo sapien
ctggttatttctatttaaatggagc

SEQ ID NO: 58587 - DNA, 25 bp, Homo sapien
ctggttatttttaatagagctcaac

SEQ ID NO: 58588 - DNA, 25 bp, Homo sapien
ctggttatttttagtagagctcaac

SEQ ID NO: 58589 - DNA, 25 bp, Homo sapien
ctggttcagaacatcacaaggtgta

SEQ ID NO: 58590 - DNA, 25 bp, Homo sapien
ctggttcagaatatcacaaggtgta

SEQ ID NO: 58591 - DNA, 25 bp, Homo sapien
ctggttcagttgatataatacaatt

SEQ ID NO: 58592 - DNA, 25 bp, Homo sapien
ctggttcagttggtataatacaatt

SEQ ID NO: 58593 - DNA, 25 bp, Homo sapien
ctggttcccgaagccgatgggctct

SEQ ID NO: 58594 - DNA, 25 bp, Homo sapien
ctggttcccgaagctgatgggctct

SEQ ID NO: 58595 - DNA, 25 bp, Homo sapien
ctggttcctagtctgctagttgata

SEQ ID NO: 58596 - DNA, 25 bp, Homo sapien
ctggttcctagtgtgctagttgata

SEQ ID NO: 58597 - DNA, 25 bp, Homo sapien
ctggttcgggctaacaaattggttt

SEQ ID NO: 58598 - DNA, 25 bp, Homo sapien
ctggttcgggctgacaaattggttt

SEQ ID NO: 58599 - DNA, 25 bp, Homo sapien
ctggttctaacaccaacgttttaaa

SEQ ID NO: 58600 - DNA, 25 bp, Homo sapien
ctggttctatcaccaacgttttaaa

SEQ ID NO: 58601 - DNA, 25 bp, Homo sapien
ctggttctgatgctatactattgtt

SEQ ID NO: 58602 - DNA, 25 bp, Homo sapien
ctggttctgatggtatactattgtt

SEQ ID NO: 58603 - DNA, 25 bp, Homo sapien
ctggttctgtttaaccatacctaaa

SEQ ID NO: 58604 - DNA, 25 bp, Homo sapien
ctggttctgtttaaccgtacctaaa

SEQ ID NO: 58605 - DNA, 25 bp, Homo sapien
ctggttcttgttggctacaccctct

SEQ ID NO: 58606 - DNA, 25 bp, Homo sapien
ctggttcttgttggctccaccctct

SEQ ID NO: 58607 - DNA, 25 bp, Homo sapien
ctggttgaaagaatgcttgtctcca

SEQ ID NO: 58608 - DNA, 25 bp, Homo sapien
ctggttgaaagagtgcttgtctcca

SEQ ID NO: 58609 - DNA, 25 bp, Homo sapien
ctggttggttgctcctaatttgagt

SEQ ID NO: 58610 - DNA, 25 bp, Homo sapien
ctggttggttgctcctgatttgagt

SEQ ID NO: 58611 - DNA, 25 bp, Homo sapien
ctggttgttctcaaatggaataaat

SEQ ID NO: 58612 - DNA, 25 bp, Homo sapien
ctggttgttctcgaatggaataaat

SEQ ID NO: 58613 - DNA, 25 bp, Homo sapien
ctggtttaattatatcgcacaatgc

SEQ ID NO: 58614 - DNA, 25 bp, Homo sapien
ctggtttaattgtatcgcacaatgc

SEQ ID NO: 58615 - DNA, 25 bp, Homo sapien
ctggtttagtccacgaactccgaac

SEQ ID NO: 58616 - DNA, 25 bp, Homo sapien
ctggtttagtccatgaactccgaac

SEQ ID NO: 58617 - DNA, 25 bp, Homo sapien
ctggtttcacctcttcatcattcag

SEQ ID NO: 58618 - DNA, 25 bp, Homo sapien
ctggtttcacctcttcttcattcag

SEQ ID NO: 58619 - DNA, 25 bp, Homo sapien
ctggtttcagctcaggccatttttc

SEQ ID NO: 58620 - DNA, 25 bp, Homo sapien
ctggtttcagctcaggtcatttttc

SEQ ID NO: 58621 - DNA, 25 bp, Homo sapien
ctggtttctttgatttaacagacaa

SEQ ID NO: 58622 - DNA, 25 bp, Homo sapien
ctggtttctttgatttgacagacaa

SEQ ID NO: 58623 - DNA, 25 bp, Homo sapien
ctggttttgacaatcatagtatctt

SEQ ID NO: 58624 - DNA, 25 bp, Homo sapien
ctggttttgcattgtaaattaaagt

SEQ ID NO: 58625 - DNA, 25 bp, Homo sapien
ctggttttgcattttaaattaaagt

SEQ ID NO: 58626 - DNA, 25 bp, Homo sapien
ctggttttgcgggagcaggatttat

SEQ ID NO: 58627 - DNA, 25 bp, Homo sapien
ctggttttggcaatcatagtatctt

SEQ ID NO: 58628 - DNA, 25 bp, Homo sapien
ctggttttgtgggagcaggatttat

SEQ ID NO: 58629 - DNA, 25 bp, Homo sapien
ctggtttttatacaagtcttctaga

SEQ ID NO: 58630 - DNA, 25 bp, Homo sapien
ctggtttttattcaagtcttctaga

SEQ ID NO: 58631 - DNA, 25 bp, Homo sapien
ctgtaaaaacaccttctctgctatc

SEQ ID NO: 58632 - DNA, 25 bp, Homo sapien
ctgtaaaactgcactgataggatcc

SEQ ID NO: 58633 - DNA, 25 bp, Homo sapien
ctgtaaaagcaccttctctgctatc

SEQ ID NO: 58634 - DNA, 25 bp, Homo sapien
ctgtaaaagcacttatcatgagatc

SEQ ID NO: 58635 - DNA, 25 bp, Homo sapien
ctgtaaaagcacttatgatgagatc

SEQ ID NO: 58636 - DNA, 25 bp, Homo sapien
ctgtaaaattgcactgataggatcc

SEQ ID NO: 58637 - DNA, 25 bp, Homo sapien
ctgtaacaaaactgaagggttagga

SEQ ID NO: 58638 - DNA, 25 bp, Homo sapien
ctgtaacaaaattgaagggttagga

SEQ ID NO: 58639 - DNA, 25 bp, Homo sapien
ctgtaacaaagtttcgctaattaag

SEQ ID NO: 58640 - DNA, 25 bp, Homo sapien
ctgtaacaaagttttgctaattaag

SEQ ID NO: 58641 - DNA, 25 bp, Homo sapien
ctgtaacagcacatagcacatccgc

SEQ ID NO: 58642 - DNA, 25 bp, Homo sapien
ctgtaacagccagaacacagtccat

SEQ ID NO: 58643 - DNA, 25 bp, Homo sapien
ctgtaacagccggaacacagtccat

SEQ ID NO: 58644 - DNA, 25 bp, Homo sapien
ctgtaacaggacatagcacatccgc

SEQ ID NO: 58645 - DNA, 25 bp, Homo sapien
ctgtaagctattattatatggtcat

SEQ ID NO: 58646 - DNA, 25 bp, Homo sapien
ctgtaagctcttattatatggtcat

SEQ ID NO: 58647 - DNA, 25 bp, Homo sapien
ctgtaaggatcttcattcaaacaga

SEQ ID NO: 58648 - DNA, 25 bp, Homo sapien
ctgtaaggcagagcagtgagtgaat

SEQ ID NO: 58649 - DNA, 25 bp, Homo sapien
ctgtaaggcagagctgtgagtgaat

SEQ ID NO: 58650 - DNA, 25 bp, Homo sapien
ctgtaaggttcttcattcaaacaga

SEQ ID NO: 58651 - DNA, 25 bp, Homo sapien
ctgtaaggttgcaacagaagattga

SEQ ID NO: 58652 - DNA, 25 bp, Homo sapien
ctgtaaggttgcaatagaagattga

SEQ ID NO: 58653 - DNA, 25 bp, Homo sapien
ctgtaagttgtctcattatgatttc

SEQ ID NO: 58654 - DNA, 25 bp, Homo sapien
ctgtaagttgtctcgttatgatttc

SEQ ID NO: 58655 - DNA, 25 bp, Homo sapien
ctgtaataacgtcactaaagctgta

SEQ ID NO: 58656 - DNA, 25 bp, Homo sapien
ctgtaataaggtcactaaagctgta

SEQ ID NO: 58657 - DNA, 25 bp, Homo sapien
ctgtaatacagggataataaagtat

SEQ ID NO: 58658 - DNA, 25 bp, Homo sapien
ctgtaatacggggataataaagtat

SEQ ID NO: 58659 - DNA, 25 bp, Homo sapien
ctgtaatagatgctaataaacattt

SEQ ID NO: 58660 - DNA, 25 bp, Homo sapien
ctgtaatagatgctcataaacattt

SEQ ID NO: 58661 - DNA, 25 bp, Homo sapien
ctgtaatatcctactcctcttctca

SEQ ID NO: 58662 - DNA, 25 bp, Homo sapien
ctgtaatatgctactcctcttctca

SEQ ID NO: 58663 - DNA, 25 bp, Homo sapien
ctgtaatcacagaaaaacgcactta

SEQ ID NO: 58664 - DNA, 25 bp, Homo sapien
ctgtaatcatagaaaaacgcactta

SEQ ID NO: 58665 - DNA, 25 bp, Homo sapien
ctgtaatcccaactgaggacaggag

SEQ ID NO: 58666 - DNA, 25 bp, Homo sapien
ctgtaatcccagctgaggacaggag

SEQ ID NO: 58667 - DNA, 25 bp, Homo sapien
ctgtaatcccttgtatcacattgag

SEQ ID NO: 58668 - DNA, 25 bp, Homo sapien
ctgtaatcctttgtatcacattgag

SEQ ID NO: 58669 - DNA, 25 bp, Homo sapien
ctgtaatgaatcagttgaattcaga

SEQ ID NO: 58670 - DNA, 25 bp, Homo sapien
ctgtaatgaatcggttgaattcaga

SEQ ID NO: 58671 - DNA, 25 bp, Homo sapien
ctgtaatgactttcagagtgcacat

SEQ ID NO: 58672 - DNA, 25 bp, Homo sapien
ctgtaatgattttcagagtgcacat

SEQ ID NO: 58673 - DNA, 25 bp, Homo sapien
ctgtaatgcatttatcacaaacctc

SEQ ID NO: 58674 - DNA, 25 bp, Homo sapien
ctgtaatgcgtttatcacaaacctc

SEQ ID NO: 58675 - DNA, 25 bp, Homo sapien
ctgtaattatcagtgcctatatcct

SEQ ID NO: 58676 - DNA, 25 bp, Homo sapien
ctgtaattatcggtgcctatatcct

SEQ ID NO: 58677 - DNA, 25 bp, Homo sapien
ctgtacaagtcacctatgaaactgt

SEQ ID NO: 58678 - DNA, 25 bp, Homo sapien
ctgtacaagtcatctatgaaactgt

SEQ ID NO: 58679 - DNA, 25 bp, Homo sapien
ctgtacagaaaacagtaagaaatca

SEQ ID NO: 58680 - DNA, 25 bp, Homo sapien
ctgtacagaaaatagtaagaaatca

SEQ ID NO: 58681 - DNA, 25 bp, Homo sapien
ctgtacagaactatagggtgccttt

SEQ ID NO: 58682 - DNA, 25 bp, Homo sapien
ctgtacagaactatagtgtgccttt

SEQ ID NO: 58683 - DNA, 25 bp, Homo sapien
ctgtacagcatcatactgtgctgaa

SEQ ID NO: 58684 - DNA, 25 bp, Homo sapien
ctgtacagcattatttatcaacaag

SEQ ID NO: 58685 - DNA, 25 bp, Homo sapien
ctgtacagcgttatttatcaacaag

SEQ ID NO: 58686 - DNA, 25 bp, Homo sapien
ctgtacagggacaagaaatggaacc

SEQ ID NO: 58687 - DNA, 25 bp, Homo sapien
ctgtacagggacgagaaatggaacc

SEQ ID NO: 58688 - DNA, 25 bp, Homo sapien
ctgtacagtatcatactgtgctgaa

SEQ ID NO: 58689 - DNA, 25 bp, Homo sapien
ctgtacccagtcattagggaaaagc

SEQ ID NO: 58690 - DNA, 25 bp, Homo sapien
ctgtacccagtcgttagggaaaagc

SEQ ID NO: 58691 - DNA, 25 bp, Homo sapien
ctgtacctgagcagtgctgaaaaca

SEQ ID NO: 58692 - DNA, 25 bp, Homo sapien
ctgtacctgcacgtgactttgaggc

SEQ ID NO: 58693 - DNA, 25 bp, Homo sapien
ctgtacctgcatgtgactttgaggc

SEQ ID NO: 58694 - DNA, 25 bp, Homo sapien
ctgtacctgggcagtgctgaaaaca

SEQ ID NO: 58695 - DNA, 25 bp, Homo sapien
ctgtaccttttaaatcaaaactcag

SEQ ID NO: 58696 - DNA, 25 bp, Homo sapien
ctgtaccttttacatcaaaactcag

SEQ ID NO: 58697 - DNA, 25 bp, Homo sapien
ctgtactggatctaatcttatttat

SEQ ID NO: 58698 - DNA, 25 bp, Homo sapien
ctgtactggatctcatcttatttat

SEQ ID NO: 58699 - DNA, 25 bp, Homo sapien
ctgtacttcctgaacgtagccctgc

SEQ ID NO: 58700 - DNA, 25 bp, Homo sapien
ctgtacttcctgaatgtagccctgc

SEQ ID NO: 58701 - DNA, 25 bp, Homo sapien
ctgtacttcttaaaatattactatg

SEQ ID NO: 58702 - DNA, 25 bp, Homo sapien
ctgtacttcttaaagtattactatg

SEQ ID NO: 58703 - DNA, 25 bp, Homo sapien
ctgtacttgcagttgctagggcaaa

SEQ ID NO: 58704 - DNA, 25 bp, Homo sapien
ctgtacttggagttgctagggcaaa

SEQ ID NO: 58705 - DNA, 25 bp, Homo sapien
ctgtactttaaaactgccacaggca

SEQ ID NO: 58706 - DNA, 25 bp, Homo sapien
ctgtactttaaaattgccacaggca

SEQ ID NO: 58707 - DNA, 25 bp, Homo sapien
ctgtagaaatgtaccaggtaatcat

SEQ ID NO: 58708 - DNA, 25 bp, Homo sapien
ctgtagaaatgtacgaggtaatcat

SEQ ID NO: 58709 - DNA, 25 bp, Homo sapien
ctgtagaagctgtgtgctaaaccta

SEQ ID NO: 58710 - DNA, 25 bp, Homo sapien
ctgtagaagctgtgtgttaaaccta

SEQ ID NO: 58711 - DNA, 25 bp, Homo sapien
ctgtagacctgcgttcatgggcaac

SEQ ID NO: 58712 - DNA, 25 bp, Homo sapien
ctgtagacctgcgttcgtgggcaac

SEQ ID NO: 58713 - DNA, 25 bp, Homo sapien
ctgtagactctgcgtgtgtgtatag

SEQ ID NO: 58714 - DNA, 25 bp, Homo sapien
ctgtagactgtgcgtgtgtgtatag

SEQ ID NO: 58715 - DNA, 25 bp, Homo sapien
ctgtagacttttccagataggataa

SEQ ID NO: 58716 - DNA, 25 bp, Homo sapien
ctgtagactttttcagataggataa

SEQ ID NO: 58717 - DNA, 25 bp, Homo sapien
ctgtagagaagaaataaaagctgag

SEQ ID NO: 58718 - DNA, 25 bp, Homo sapien
ctgtagagacgaaataaaagctgag

SEQ ID NO: 58719 - DNA, 25 bp, Homo sapien
ctgtagagattcatcggctcctccc

SEQ ID NO: 58720 - DNA, 25 bp, Homo sapien
ctgtagaggagacatttcccatacc

SEQ ID NO: 58721 - DNA, 25 bp, Homo sapien
ctgtagaggaggcatttcccatacc

SEQ ID NO: 58722 - DNA, 25 bp, Homo sapien
ctgtagagtttcatcggctcctccc

SEQ ID NO: 58723 - DNA, 25 bp, Homo sapien
ctgtagatcattcttcagaggtcag

SEQ ID NO: 58724 - DNA, 25 bp, Homo sapien
ctgtagatcatttttcagaggtcag

SEQ ID NO: 58725 - DNA, 25 bp, Homo sapien
ctgtagatccatcaaccttgcaatc

SEQ ID NO: 58726 - DNA, 25 bp, Homo sapien
ctgtagattcatcaaccttgcaatc

SEQ ID NO: 58727 - DNA, 25 bp, Homo sapien
ctgtagcactagacttgtgaatttg

SEQ ID NO: 58728 - DNA, 25 bp, Homo sapien
ctgtagcactagtcttgtgaatttg

SEQ ID NO: 58729 - DNA, 25 bp, Homo sapien
ctgtagccaaagacccgcgagctcc

SEQ ID NO: 58730 - DNA, 25 bp, Homo sapien
ctgtagccaaaggcccgcgagctcc

SEQ ID NO: 58731 - DNA, 25 bp, Homo sapien
ctgtagctctgaacagagagtgaca

SEQ ID NO: 58732 - DNA, 25 bp, Homo sapien
ctgtagctctgaacggagagtgaca

SEQ ID NO: 58733 - DNA, 25 bp, Homo sapien
ctgtaggcaatttagatgatgaaat

SEQ ID NO: 58734 - DNA, 25 bp, Homo sapien
ctgtaggcaatttggatgatgaaat

SEQ ID NO: 58735 - DNA, 25 bp, Homo sapien
ctgtaggcatgatcttgtggtctga

SEQ ID NO: 58736 - DNA, 25 bp, Homo sapien
ctgtaggcatgatgttgtggtctga

SEQ ID NO: 58737 - DNA, 25 bp, Homo sapien
ctgtaggctccatgaaagggcatcc

SEQ ID NO: 58738 - DNA, 25 bp, Homo sapien
ctgtaggctccttgaaagggcatcc

SEQ ID NO: 58739 - DNA, 25 bp, Homo sapien
ctgtaggttgcattcggttaattat

SEQ ID NO: 58740 - DNA, 25 bp, Homo sapien
ctgtaggttgcatttggttaattat

SEQ ID NO: 58741 - DNA, 25 bp, Homo sapien
ctgtagtactgccttgatttaaatt

SEQ ID NO: 58742 - DNA, 25 bp, Homo sapien
ctgtagtagtgccttgatttaaatt

SEQ ID NO: 58743 - DNA, 25 bp, Homo sapien
ctgtataactcaaatctttgatctt

SEQ ID NO: 58744 - DNA, 25 bp, Homo sapien
ctgtataactcaagtctttgatctt

SEQ ID NO: 58745 - DNA, 25 bp, Homo sapien
ctgtatagtttcaattctcacatga

SEQ ID NO: 58746 - DNA, 25 bp, Homo sapien
ctgtatagtttctattctcacatga

SEQ ID NO: 58747 - DNA, 25 bp, Homo sapien
ctgtatcacactgtctcgactaatg

SEQ ID NO: 58748 - DNA, 25 bp, Homo sapien
ctgtatcacactgtcttgactaatg

SEQ ID NO: 58749 - DNA, 25 bp, Homo sapien
ctgtatcagctcatcatctgcagtt

SEQ ID NO: 58750 - DNA, 25 bp, Homo sapien
ctgtatcagctcgtcatctgcagtt

SEQ ID NO: 58751 - DNA, 25 bp, Homo sapien
ctgtatctcttcacagtcatgatgt

SEQ ID NO: 58752 - DNA, 25 bp, Homo sapien
ctgtatctcttcgcagtcatgatgt

SEQ ID NO: 58753 - DNA, 25 bp, Homo sapien
ctgtatctgaactaattggtgatat

SEQ ID NO: 58754 - DNA, 25 bp, Homo sapien
ctgtatctgaattaattggtgatat

SEQ ID NO: 58755 - DNA, 25 bp, Homo sapien
ctgtatcttcagtagaaaacatata

SEQ ID NO: 58756 - DNA, 25 bp, Homo sapien
ctgtatcttgagtagaaaacatata

SEQ ID NO: 58757 - DNA, 25 bp, Homo sapien
ctgtatcttttgcagtgtttaaatt

SEQ ID NO: 58758 - DNA, 25 bp, Homo sapien
ctgtatcttttgtagtgtttaaatt

SEQ ID NO: 58759 - DNA, 25 bp, Homo sapien
ctgtatgaggtcgcagccttctctg

SEQ ID NO: 58760 - DNA, 25 bp, Homo sapien
ctgtatgaggtcgcaggcttctctg

SEQ ID NO: 58761 - DNA, 25 bp, Homo sapien
ctgtatgatgtgctaaatgttgcca

SEQ ID NO: 58762 - DNA, 25 bp, Homo sapien
ctgtatgatgtgctaagtgttgcca

SEQ ID NO: 58763 - DNA, 25 bp, Homo sapien
ctgtatggatggcatcatttggtta

SEQ ID NO: 58764 - DNA, 25 bp, Homo sapien
ctgtatggatggcatcgtttggtta

SEQ ID NO: 58765 - DNA, 25 bp, Homo sapien
ctgtatgtattctgcaaatatttca

SEQ ID NO: 58766 - DNA, 25 bp, Homo sapien
ctgtatgtattctgtaaatatttca

SEQ ID NO: 58767 - DNA, 25 bp, Homo sapien
ctgtatgtccagaagatataaaact

SEQ ID NO: 58768 - DNA, 25 bp, Homo sapien
ctgtatgtccagaggatataaaact

SEQ ID NO: 58769 - DNA, 25 bp, Homo sapien
ctgtatgtgtaatggtaatgtgctg

SEQ ID NO: 58770 - DNA, 25 bp, Homo sapien
ctgtatgtgtaatggtcatgtgctg

SEQ ID NO: 58771 - DNA, 25 bp, Homo sapien
ctgtattacactttaaagcaaacaa

SEQ ID NO: 58772 - DNA, 25 bp, Homo sapien
ctgtattatactttaaagcaaacaa

SEQ ID NO: 58773 - DNA, 25 bp, Homo sapien
ctgtattattagggatttaggtcag

SEQ ID NO: 58774 - DNA, 25 bp, Homo sapien
ctgtattattagggttttaggtcag

SEQ ID NO: 58775 - DNA, 25 bp, Homo sapien
ctgtattcacacacttcttttggat

SEQ ID NO: 58776 - DNA, 25 bp, Homo sapien
ctgtattcacatacttcttttggat

SEQ ID NO: 58777 - DNA, 25 bp, Homo sapien
ctgtattgacatgaataaattccca

SEQ ID NO: 58778 - DNA, 25 bp, Homo sapien
ctgtattgtcatgaataaattccca

SEQ ID NO: 58779 - DNA, 25 bp, Homo sapien
ctgtatttacaaagctccctgtttt

SEQ ID NO: 58780 - DNA, 25 bp, Homo sapien
ctgtatttacatagctccctgtttt

SEQ ID NO: 58781 - DNA, 25 bp, Homo sapien
ctgtatttcttggtttcagtattaa

SEQ ID NO: 58782 - DNA, 25 bp, Homo sapien
ctgtatttgttggtttcagtattaa

SEQ ID NO: 58783 - DNA, 25 bp, Homo sapien
ctgtattttaacgtaaaacatgcag

SEQ ID NO: 58784 - DNA, 25 bp, Homo sapien
ctgtattttaatgtaaaacatgcag

SEQ ID NO: 58785 - DNA, 25 bp, Homo sapien
ctgtattttcaccgcaattttctaa

SEQ ID NO: 58786 - DNA, 25 bp, Homo sapien
ctgtattttcactgcaattttctaa

SEQ ID NO: 58787 - DNA, 25 bp, Homo sapien
ctgtattttctgtagcatgtattta

SEQ ID NO: 58788 - DNA, 25 bp, Homo sapien
ctgtattttctgtagcgtgtattta

SEQ ID NO: 58789 - DNA, 25 bp, Homo sapien
ctgtcaaaaccctaacttacggctt

SEQ ID NO: 58790 - DNA, 25 bp, Homo sapien
ctgtcaaaagcctaacttacggctt

SEQ ID NO: 58791 - DNA, 25 bp, Homo sapien
ctgtcaaaggaaagagtgcaatcag

SEQ ID NO: 58792 - DNA, 25 bp, Homo sapien
ctgtcaaaggaaagggtgcaatcag

SEQ ID NO: 58793 - DNA, 25 bp, Homo sapien
ctgtcaagtttcttattccatgttt

SEQ ID NO: 58794 - DNA, 25 bp, Homo sapien
ctgtcaagttttttattccatgttt

SEQ ID NO: 58795 - DNA, 25 bp, Homo sapien
ctgtcacacgtgctgctagagtggc

SEQ ID NO: 58796 - DNA, 25 bp, Homo sapien
ctgtcacatgtgctgctagagtggc

SEQ ID NO: 58797 - DNA, 25 bp, Homo sapien
ctgtcaccatgttctttggctgctt

SEQ ID NO: 58798 - DNA, 25 bp, Homo sapien
ctgtcaccattttaaaaccataaga

SEQ ID NO: 58799 - DNA, 25 bp, Homo sapien
ctgtcaccattttacaaccataaga

SEQ ID NO: 58800 - DNA, 25 bp, Homo sapien
ctgtcaccggtttacagatgaggcc

SEQ ID NO: 58801 - DNA, 25 bp, Homo sapien
ctgtcaccgtgttctttggctgctt

SEQ ID NO: 58802 - DNA, 25 bp, Homo sapien
ctgtcaccgttttacagatgaggcc

SEQ ID NO: 58803 - DNA, 25 bp, Homo sapien
ctgtcacctgaatgagactatgagc

SEQ ID NO: 58804 - DNA, 25 bp, Homo sapien
ctgtcacctgagtgagactatgagc

SEQ ID NO: 58805 - DNA, 25 bp, Homo sapien
ctgtcacctggaacttccaaactca

SEQ ID NO: 58806 - DNA, 25 bp, Homo sapien
ctgtcacctggagcttccaaactca

SEQ ID NO: 58807 - DNA, 25 bp, Homo sapien
ctgtcactactggccagaacaagca

SEQ ID NO: 58808 - DNA, 25 bp, Homo sapien
ctgtcactattggccagaacaagca

SEQ ID NO: 58809 - DNA, 25 bp, Homo sapien
ctgtcagaattccatgtgggcctgt

SEQ ID NO: 58810 - DNA, 25 bp, Homo sapien
ctgtcagaattccctgtgggcctgt

SEQ ID NO: 58811 - DNA, 25 bp, Homo sapien
ctgtcagcttataaacaacattgaa

SEQ ID NO: 58812 - DNA, 25 bp, Homo sapien
ctgtcagcttataaactacattgaa

SEQ ID NO: 58813 - DNA, 25 bp, Homo sapien
ctgtcaggaagttgagttttgaata

SEQ ID NO: 58814 - DNA, 25 bp, Homo sapien
ctgtcaggaagttgcgttttgaata

SEQ ID NO: 58815 - DNA, 25 bp, Homo sapien
ctgtcagggccaggcgaggagcttg

SEQ ID NO: 58816 - DNA, 25 bp, Homo sapien
ctgtcagggccaggcgtggagcttg

SEQ ID NO: 58817 - DNA, 25 bp, Homo sapien
ctgtcagtgttgtgaaaggaaatac

SEQ ID NO: 58818 - DNA, 25 bp, Homo sapien
ctgtcagtgttttgaaaggaaatac

SEQ ID NO: 58819 - DNA, 25 bp, Homo sapien
ctgtcatagaacgcagctgaagaaa

SEQ ID NO: 58820 - DNA, 25 bp, Homo sapien
ctgtcatagaatgcagctgaagaaa

SEQ ID NO: 58821 - DNA, 25 bp, Homo sapien
ctgtcatagtctgtttcctgcttct

SEQ ID NO: 58822 - DNA, 25 bp, Homo sapien
ctgtcatagtctgttttctgcttct

SEQ ID NO: 58823 - DNA, 25 bp, Homo sapien
ctgtcatcctagagaaaaaacatag

SEQ ID NO: 58824 - DNA, 25 bp, Homo sapien
ctgtcatcttagagaaaaaacatag

SEQ ID NO: 58825 - DNA, 25 bp, Homo sapien
ctgtcatgcaccgagttgatggtct

SEQ ID NO: 58826 - DNA, 25 bp, Homo sapien
ctgtcatgcacctagttgatggtct

SEQ ID NO: 58827 - DNA, 25 bp, Homo sapien
ctgtcatgtggcgttactgactgga

SEQ ID NO: 58828 - DNA, 25 bp, Homo sapien
ctgtcatgtggtgttactgactgga

SEQ ID NO: 58829 - DNA, 25 bp, Homo sapien
ctgtcattaaaaacgatgccagaag

SEQ ID NO: 58830 - DNA, 25 bp, Homo sapien
ctgtcattaaaaatgatgccagaag

SEQ ID NO: 58831 - DNA, 25 bp, Homo sapien
ctgtcattcctacaagccagtataa

SEQ ID NO: 58832 - DNA, 25 bp, Homo sapien
ctgtcattcctacaggccagtataa

SEQ ID NO: 58833 - DNA, 25 bp, Homo sapien
ctgtcattctcgtacgcctctctag

SEQ ID NO: 58834 - DNA, 25 bp, Homo sapien
ctgtcattctcgtgcgcctctctag

SEQ ID NO: 58835 - DNA, 25 bp, Homo sapien
ctgtcattgaaccgccagtgacaac

SEQ ID NO: 58836 - DNA, 25 bp, Homo sapien
ctgtcattgcccaacgtcacactag

SEQ ID NO: 58837 - DNA, 25 bp, Homo sapien
ctgtcattgcccaatgtcacactag

SEQ ID NO: 58838 - DNA, 25 bp, Homo sapien
ctgtcattggaccgccagtgacaac

SEQ ID NO: 58839 - DNA, 25 bp, Homo sapien
ctgtccaacacgctatgaaggacca

SEQ ID NO: 58840 - DNA, 25 bp, Homo sapien
ctgtccaacgcgctatgaaggacca

SEQ ID NO: 58841 - DNA, 25 bp, Homo sapien
ctgtccaagattaaacctttctacg

SEQ ID NO: 58842 - DNA, 25 bp, Homo sapien
ctgtccaagattcaacctttctacg

SEQ ID NO: 58843 - DNA, 25 bp, Homo sapien
ctgtccacatcaaagacgccatctt

SEQ ID NO: 58844 - DNA, 25 bp, Homo sapien
ctgtccacatcaaggacgccatctt

SEQ ID NO: 58845 - DNA, 25 bp, Homo sapien
ctgtccactccatagaagaacaagg

SEQ ID NO: 58846 - DNA, 25 bp, Homo sapien
ctgtccactccgtagaagaacaagg

SEQ ID NO: 58847 - DNA, 25 bp, Homo sapien
ctgtccactttgtgcgccagaattg

SEQ ID NO: 58848 - DNA, 25 bp, Homo sapien
ctgtccactttgtgtgccagaattg

SEQ ID NO: 58849 - DNA, 25 bp, Homo sapien
ctgtccctaacaaaaattgcctggc

SEQ ID NO: 58850 - DNA, 25 bp, Homo sapien
ctgtccctaacacaaattgcctggc

SEQ ID NO: 58851 - DNA, 25 bp, Homo sapien
ctgtccctaggcatgaagccattgc

SEQ ID NO: 58852 - DNA, 25 bp, Homo sapien
ctgtccctaggcgtgaagccattgc

SEQ ID NO: 58853 - DNA, 25 bp, Homo sapien
ctgtccctatgcaatgagaaagcag

SEQ ID NO: 58854 - DNA, 25 bp, Homo sapien
ctgtccctatgcgatgagaaagcag

SEQ ID NO: 58855 - DNA, 25 bp, Homo sapien
ctgtccctgtattgttcttagaatg

SEQ ID NO: 58856 - DNA, 25 bp, Homo sapien
ctgtccctgtattgtttttagaatg

SEQ ID NO: 58857 - DNA, 25 bp, Homo sapien
ctgtcccttggtgacaacatcacta

SEQ ID NO: 58858 - DNA, 25 bp, Homo sapien
ctgtcccttggtgacagcatcacta

SEQ ID NO: 58859 - DNA, 25 bp, Homo sapien
ctgtcctctccactatgtttctaaa

SEQ ID NO: 58860 - DNA, 25 bp, Homo sapien
ctgtcctctccactgtgtttctaaa

SEQ ID NO: 58861 - DNA, 25 bp, Homo sapien
ctgtcctggttcatctttgagtaat

SEQ ID NO: 58862 - DNA, 25 bp, Homo sapien
ctgtcctggtttatctttgagtaat

SEQ ID NO: 58863 - DNA, 25 bp, Homo sapien
ctgtcgtcttcatcatcgtcatcat

SEQ ID NO: 58864 - DNA, 25 bp, Homo sapien
ctgtcgtcttcgtcatcgtcatcat

SEQ ID NO: 58865 - DNA, 25 bp, Homo sapien
ctgtctaaaacataagtgctatttt

SEQ ID NO: 58866 - DNA, 25 bp, Homo sapien
ctgtctaaaacgtaagtgctatttt

SEQ ID NO: 58867 - DNA, 25 bp, Homo sapien
ctgtctaaaatccttttcatgtcat

SEQ ID NO: 58868 - DNA, 25 bp, Homo sapien
ctgtctaacacacggcagctgctta

SEQ ID NO: 58869 - DNA, 25 bp, Homo sapien
ctgtctaacacatggcagctgctta

SEQ ID NO: 58870 - DNA, 25 bp, Homo sapien
ctgtctaagatccttttcatgtcat

SEQ ID NO: 58871 - DNA, 25 bp, Homo sapien
ctgtctactgcaagaaagagaaaat

SEQ ID NO: 58872 - DNA, 25 bp, Homo sapien
ctgtctactgcacgaaagagaaaat

SEQ ID NO: 58873 - DNA, 25 bp, Homo sapien
ctgtctatcggtctcacttccaaag

SEQ ID NO: 58874 - DNA, 25 bp, Homo sapien
ctgtctatctcaatgatatacccag

SEQ ID NO: 58875 - DNA, 25 bp, Homo sapien
ctgtctatctcagtgatatacccag

SEQ ID NO: 58876 - DNA, 25 bp, Homo sapien
ctgtctatgctcaacaaatggaaga

SEQ ID NO: 58877 - DNA, 25 bp, Homo sapien
ctgtctatgctcaataaatggaaga

SEQ ID NO: 58878 - DNA, 25 bp, Homo sapien
ctgtctatgggtctcacttccaaag

SEQ ID NO: 58879 - DNA, 25 bp, Homo sapien
ctgtctattggaagaagatgccttg

SEQ ID NO: 58880 - DNA, 25 bp, Homo sapien
ctgtctattggcagaagatgccttg

SEQ ID NO: 58881 - DNA, 25 bp, Homo sapien
ctgtctatttaactcaacttccttc

SEQ ID NO: 58882 - DNA, 25 bp, Homo sapien
ctgtctatttaactcagcttccttc

SEQ ID NO: 58883 - DNA, 25 bp, Homo sapien
ctgtctctactatgtacatggagcg

SEQ ID NO: 58884 - DNA, 25 bp, Homo sapien
ctgtctctactctgtacatggagcg

SEQ ID NO: 58885 - DNA, 25 bp, Homo sapien
ctgtctctctaccttttcaccaaaa

SEQ ID NO: 58886 - DNA, 25 bp, Homo sapien
ctgtctctctatcttttcaccaaaa

SEQ ID NO: 58887 - DNA, 25 bp, Homo sapien
ctgtctcttcacgcctgcagcaagc

SEQ ID NO: 58888 - DNA, 25 bp, Homo sapien
ctgtctcttcatgcctgcagcaagc

SEQ ID NO: 58889 - DNA, 25 bp, Homo sapien
ctgtctgatgttccttgcagccctc

SEQ ID NO: 58890 - DNA, 25 bp, Homo sapien
ctgtctgatgtttcttgcagccctc

SEQ ID NO: 58891 - DNA, 25 bp, Homo sapien
ctgtctgcccctccataaattgcct

SEQ ID NO: 58892 - DNA, 25 bp, Homo sapien
ctgtctgcccctctataaattgcct

SEQ ID NO: 58893 - DNA, 25 bp, Homo sapien
ctgtctggcagcatatggtgtggct

SEQ ID NO: 58894 - DNA, 25 bp, Homo sapien
ctgtctggcagtatatggtgtggct

SEQ ID NO: 58895 - DNA, 25 bp, Homo sapien
ctgtctggttcctagtctgctagtt

SEQ ID NO: 58896 - DNA, 25 bp, Homo sapien
ctgtctggttcctagtgtgctagtt

SEQ ID NO: 58897 - DNA, 25 bp, Homo sapien
ctgtctgtacaacccttttgaatgg

SEQ ID NO: 58898 - DNA, 25 bp, Homo sapien
ctgtctgtagcagaatattttaatt

SEQ ID NO: 58899 - DNA, 25 bp, Homo sapien
ctgtctgtagcagagtattttaatt

SEQ ID NO: 58900 - DNA, 25 bp, Homo sapien
ctgtctgtataacccttttgaatgg

SEQ ID NO: 58901 - DNA, 25 bp, Homo sapien
ctgtcttacgtttataccggaagac

SEQ ID NO: 58902 - DNA, 25 bp, Homo sapien
ctgtcttatatggcatgcttctgtg

SEQ ID NO: 58903 - DNA, 25 bp, Homo sapien
ctgtcttatgtggcatgcttctgtg

SEQ ID NO: 58904 - DNA, 25 bp, Homo sapien
ctgtcttatgtttataccggaagac

SEQ ID NO: 58905 - DNA, 25 bp, Homo sapien
ctgtcttcctatacattttcagaaa

SEQ ID NO: 58906 - DNA, 25 bp, Homo sapien
ctgtcttcctattcattttcagaaa

SEQ ID NO: 58907 - DNA, 25 bp, Homo sapien
ctgtcttctgtacgtaagccactat

SEQ ID NO: 58908 - DNA, 25 bp, Homo sapien
ctgtcttctgtatgtaagccactat

SEQ ID NO: 58909 - DNA, 25 bp, Homo sapien
ctgtctttaactcaagtatagtaat

SEQ ID NO: 58910 - DNA, 25 bp, Homo sapien
ctgtctttaactcaggtatagtaat

SEQ ID NO: 58911 - DNA, 25 bp, Homo sapien
ctgtctttgaccacagcctggcaca

SEQ ID NO: 58912 - DNA, 25 bp, Homo sapien
ctgtctttgaccacaggctggcaca

SEQ ID NO: 58913 - DNA, 25 bp, Homo sapien
ctgtgaaacctttcaaagaggaatg

SEQ ID NO: 58914 - DNA, 25 bp, Homo sapien
ctgtgaaaggtagcatcatcaaaac

SEQ ID NO: 58915 - DNA, 25 bp, Homo sapien
ctgtgaaaggtagcgtcatcaaaac

SEQ ID NO: 58916 - DNA, 25 bp, Homo sapien
ctgtgaaatctttcaaagaggaatg

SEQ ID NO: 58917 - DNA, 25 bp, Homo sapien
ctgtgaacattttatcttaaatggt

SEQ ID NO: 58918 - DNA, 25 bp, Homo sapien
ctgtgaacattttgtcttaaatggt

SEQ ID NO: 58919 - DNA, 25 bp, Homo sapien
ctgtgaagacatactgaagttaagc

SEQ ID NO: 58920 - DNA, 25 bp, Homo sapien
ctgtgaagtcatactgaagttaagc

SEQ ID NO: 58921 - DNA, 25 bp, Homo sapien
ctgtgacaatctaacgccactggta

SEQ ID NO: 58922 - DNA, 25 bp, Homo sapien
ctgtgacaatctaatgccactggta

SEQ ID NO: 58923 - DNA, 25 bp, Homo sapien
ctgtgacattttacggactgctaag

SEQ ID NO: 58924 - DNA, 25 bp, Homo sapien
ctgtgacattttatggactgctaag

SEQ ID NO: 58925 - DNA, 25 bp, Homo sapien
ctgtgacctatagcatgtccttgag

SEQ ID NO: 58926 - DNA, 25 bp, Homo sapien
ctgtgacctatggcatgtccttgag

SEQ ID NO: 58927 - DNA, 25 bp, Homo sapien
ctgtgactaagatgatacccaagtt

SEQ ID NO: 58928 - DNA, 25 bp, Homo sapien
ctgtgactaagatggtacccaagtt

SEQ ID NO: 58929 - DNA, 25 bp, Homo sapien
ctgtgactacagaacatttttcgtg

SEQ ID NO: 58930 - DNA, 25 bp, Homo sapien
ctgtgactatagaacatttttcgtg

SEQ ID NO: 58931 - DNA, 25 bp, Homo sapien
ctgtgactattacctgcctgacaaa

SEQ ID NO: 58932 - DNA, 25 bp, Homo sapien
ctgtgactctgaagatggataaagg

SEQ ID NO: 58933 - DNA, 25 bp, Homo sapien
ctgtgactgttacctgcctgacaaa

SEQ ID NO: 58934 - DNA, 25 bp, Homo sapien
ctgtgacttataaataatgctttat

SEQ ID NO: 58935 - DNA, 25 bp, Homo sapien
ctgtgacttatagataatgctttat

SEQ ID NO: 58936 - DNA, 25 bp, Homo sapien
ctgtgactttgaagatggataaagg

SEQ ID NO: 58937 - DNA, 25 bp, Homo sapien
ctgtgacttttggcaggtcacatgt

SEQ ID NO: 58938 - DNA, 25 bp, Homo sapien
ctgtgacttttggccggtcacatgt

SEQ ID NO: 58939 - DNA, 25 bp, Homo sapien
ctgtgaggacaacaatttgtttttt

SEQ ID NO: 58940 - DNA, 25 bp, Homo sapien
ctgtgaggacaataatttgtttttt

SEQ ID NO: 58941 - DNA, 25 bp, Homo sapien
ctgtgaggctccgccccatcaggta

SEQ ID NO: 58942 - DNA, 25 bp, Homo sapien
ctgtgaggctccgccctatcaggta

SEQ ID NO: 58943 - DNA, 25 bp, Homo sapien
ctgtgaggtccaaattattatttcc

SEQ ID NO: 58944 - DNA, 25 bp, Homo sapien
ctgtgaggtccagattattatttcc

SEQ ID NO: 58945 - DNA, 25 bp, Homo sapien
ctgtgagtagttacagcagtgaaac

SEQ ID NO: 58946 - DNA, 25 bp, Homo sapien
ctgtgagtagttatagcagtgaaac

SEQ ID NO: 58947 - DNA, 25 bp, Homo sapien
ctgtgagtcaagttatcggttgaca

SEQ ID NO: 58948 - DNA, 25 bp, Homo sapien
ctgtgagtcaagttattggttgaca

SEQ ID NO: 58949 - DNA, 25 bp, Homo sapien
ctgtgagttagaagaaactttatca

SEQ ID NO: 58950 - DNA, 25 bp, Homo sapien
ctgtgagttagaagaacctttatca

SEQ ID NO: 58951 - DNA, 25 bp, Homo sapien
ctgtgatctactagacagtgcttaa

SEQ ID NO: 58952 - DNA, 25 bp, Homo sapien
ctgtgatctactagacggtgcttaa

SEQ ID NO: 58953 - DNA, 25 bp, Homo sapien
ctgtgatgacaccacttgatcaaac

SEQ ID NO: 58954 - DNA, 25 bp, Homo sapien
ctgtgatgacaccgcttgatcaaac

SEQ ID NO: 58955 - DNA, 25 bp, Homo sapien
ctgtgatgatggccctgagttgtga

SEQ ID NO: 58956 - DNA, 25 bp, Homo sapien
ctgtgatgatgtccctgagttgtga

SEQ ID NO: 58957 - DNA, 25 bp, Homo sapien
ctgtgatgatttccatgtctacaat

SEQ ID NO: 58958 - DNA, 25 bp, Homo sapien
ctgtgatgatttccgtgtctacaat

SEQ ID NO: 58959 - DNA, 25 bp, Homo sapien
ctgtgatgctcttcaaattcagaac

SEQ ID NO: 58960 - DNA, 25 bp, Homo sapien
ctgtgatgctcttccaattcagaac

SEQ ID NO: 58961 - DNA, 25 bp, Homo sapien
ctgtgatgctgaggatcgaaaacag

SEQ ID NO: 58962 - DNA, 25 bp, Homo sapien
ctgtgatgctgaggattgaaaacag

SEQ ID NO: 58963 - DNA, 25 bp, Homo sapien
ctgtgattgacacttccttacaact

SEQ ID NO: 58964 - DNA, 25 bp, Homo sapien
ctgtgattgacgcttccttacaact

SEQ ID NO: 58965 - DNA, 25 bp, Homo sapien
ctgtgcaaaacttctaggagtacca

SEQ ID NO: 58966 - DNA, 25 bp, Homo sapien
ctgtgcaaagcttctaggagtacca

SEQ ID NO: 58967 - DNA, 25 bp, Homo sapien
ctgtgcaacaggatatgtccttcag

SEQ ID NO: 58968 - DNA, 25 bp, Homo sapien
ctgtgcaaggatcgtctttatttac

SEQ ID NO: 58969 - DNA, 25 bp, Homo sapien
ctgtgcaaggatcttctttatttac

SEQ ID NO: 58970 - DNA, 25 bp, Homo sapien
ctgtgcaataggatatgtccttcag

SEQ ID NO: 58971 - DNA, 25 bp, Homo sapien
ctgtgcacattactccagaactgtt

SEQ ID NO: 58972 - DNA, 25 bp, Homo sapien
ctgtgcacattattccagaactgtt

SEQ ID NO: 58973 - DNA, 25 bp, Homo sapien
ctgtgcagcagttatccctttatgt

SEQ ID NO: 58974 - DNA, 25 bp, Homo sapien
ctgtgcagcggttatccctttatgt

SEQ ID NO: 58975 - DNA, 25 bp, Homo sapien
ctgtgcagtcctctctcattgtcct

SEQ ID NO: 58976 - DNA, 25 bp, Homo sapien
ctgtgcagtcctctgtcattgtcct

SEQ ID NO: 58977 - DNA, 25 bp, Homo sapien
ctgtgcagtgccacatttcacaggt

SEQ ID NO: 58978 - DNA, 25 bp, Homo sapien
ctgtgcagtgccacgtttcacaggt

SEQ ID NO: 58979 - DNA, 25 bp, Homo sapien
ctgtgcagtgtttctgaggcccctt

SEQ ID NO: 58980 - DNA, 25 bp, Homo sapien
ctgtgcagtgtttctggggcccctt

SEQ ID NO: 58981 - DNA, 25 bp, Homo sapien
ctgtgcatagtcaacctgatgacca

SEQ ID NO: 58982 - DNA, 25 bp, Homo sapien
ctgtgcatagtcagcctgatgacca

SEQ ID NO: 58983 - DNA, 25 bp, Homo sapien
ctgtgccaaaactttttgtaaaaca

SEQ ID NO: 58984 - DNA, 25 bp, Homo sapien
ctgtgccaatgtattaaccagtatc

SEQ ID NO: 58985 - DNA, 25 bp, Homo sapien
ctgtgccagaactttttgtaaaaca

SEQ ID NO: 58986 - DNA, 25 bp, Homo sapien
ctgtgccattgtattaaccagtatc

SEQ ID NO: 58987 - DNA, 25 bp, Homo sapien
ctgtgcccagagtttaccttggctt

SEQ ID NO: 58988 - DNA, 25 bp, Homo sapien
ctgtgcccagagtttatcttggctt

SEQ ID NO: 58989 - DNA, 25 bp, Homo sapien
ctgtgcccatcaaactaccaattac

SEQ ID NO: 58990 - DNA, 25 bp, Homo sapien
ctgtgcccatcgaactaccaattac

SEQ ID NO: 58991 - DNA, 25 bp, Homo sapien
ctgtgcccttctcacctgaatctga

SEQ ID NO: 58992 - DNA, 25 bp, Homo sapien
ctgtgcccttctcatctgaatctga

SEQ ID NO: 58993 - DNA, 25 bp, Homo sapien
ctgtgccgtgcctatttgtctatac

SEQ ID NO: 58994 - DNA, 25 bp, Homo sapien
ctgtgccgtgcctgtttgtctatac

SEQ ID NO: 58995 - DNA, 25 bp, Homo sapien
ctgtgcctaagccactatgaaatag

SEQ ID NO: 58996 - DNA, 25 bp, Homo sapien
ctgtgcctaagcgactatgaaatag

SEQ ID NO: 58997 - DNA, 25 bp, Homo sapien
ctgtgcctcaagtacccaaaacaga

SEQ ID NO: 58998 - DNA, 25 bp, Homo sapien
ctgtgcctcaagtacctaaaacaga

SEQ ID NO: 58999 - DNA, 25 bp, Homo sapien
ctgtgcctttcagattgcaaaaccc

SEQ ID NO: 59000 - DNA, 25 bp, Homo sapien
ctgtgcctttctgattgcaaaaccc

SEQ ID NO: 59001 - DNA, 25 bp, Homo sapien
ctgtgctaaaactagagcctatttc

SEQ ID NO: 59002 - DNA, 25 bp, Homo sapien
ctgtgctaaatacgagtggtgattc

SEQ ID NO: 59003 - DNA, 25 bp, Homo sapien
ctgtgctaaataggagtggtgattc

SEQ ID NO: 59004 - DNA, 25 bp, Homo sapien
ctgtgctaacactagagcctatttc

SEQ ID NO: 59005 - DNA, 25 bp, Homo sapien
ctgtgctaagtcatttctttgccat

SEQ ID NO: 59006 - DNA, 25 bp, Homo sapien
ctgtgctaagtcctttctttgccat

SEQ ID NO: 59007 - DNA, 25 bp, Homo sapien
ctgtgctacctcttgcctaaatgtg

SEQ ID NO: 59008 - DNA, 25 bp, Homo sapien
ctgtgctacctcttgcttaaatgtg

SEQ ID NO: 59009 - DNA, 25 bp, Homo sapien
ctgtgctatatgcaagaatggcaat

SEQ ID NO: 59010 - DNA, 25 bp, Homo sapien
ctgtgctatatgcaggaatggcaat

SEQ ID NO: 59011 - DNA, 25 bp, Homo sapien
ctgtgctcaatatttactgttgatg

SEQ ID NO: 59012 - DNA, 25 bp, Homo sapien
ctgtgctcagtatttactgttgatg

SEQ ID NO: 59013 - DNA, 25 bp, Homo sapien
ctgtgcttataacgattgccagttt

SEQ ID NO: 59014 - DNA, 25 bp, Homo sapien
ctgtgcttataatgattgccagttt

SEQ ID NO: 59015 - DNA, 25 bp, Homo sapien
ctgtgcttatactatgactgaatgt

SEQ ID NO: 59016 - DNA, 25 bp, Homo sapien
ctgtgcttatactgtgactgaatgt

SEQ ID NO: 59017 - DNA, 25 bp, Homo sapien
ctgtgcttctcataactactgggtt

SEQ ID NO: 59018 - DNA, 25 bp, Homo sapien
ctgtgcttctcctaactactgggtt

SEQ ID NO: 59019 - DNA, 25 bp, Homo sapien
ctgtgctttcataagagcaaaatgc

SEQ ID NO: 59020 - DNA, 25 bp, Homo sapien
ctgtgcttttataagagcaaaatgc

SEQ ID NO: 59021 - DNA, 25 bp, Homo sapien
ctgtggacagactcaagccagctgc

SEQ ID NO: 59022 - DNA, 25 bp, Homo sapien
ctgtggacagattcaagccagctgc

SEQ ID NO: 59023 - DNA, 25 bp, Homo sapien
ctgtggacattccttgcactgcttc

SEQ ID NO: 59024 - DNA, 25 bp, Homo sapien
ctgtggacctcatttttcttgtttg

SEQ ID NO: 59025 - DNA, 25 bp, Homo sapien
ctgtggacttcatttttcttgtttg

SEQ ID NO: 59026 - DNA, 25 bp, Homo sapien
ctgtggactttccttgcactgcttc

SEQ ID NO: 59027 - DNA, 25 bp, Homo sapien
ctgtggagcaaccaagcatcctaat

SEQ ID NO: 59028 - DNA, 25 bp, Homo sapien
ctgtggagcaagcaagcatcctaat

SEQ ID NO: 59029 - DNA, 25 bp, Homo sapien
ctgtggatatgcaccttgtgtggca

SEQ ID NO: 59030 - DNA, 25 bp, Homo sapien
ctgtggatatgtaccttgtgtggca

SEQ ID NO: 59031 - DNA, 25 bp, Homo sapien
ctgtggatctgtacatttccttagg

SEQ ID NO: 59032 - DNA, 25 bp, Homo sapien
ctgtggatctgtacgtttccttagg

SEQ ID NO: 59033 - DNA, 25 bp, Homo sapien
ctgtggcaacttcagaaatcagatt

SEQ ID NO: 59034 - DNA, 25 bp, Homo sapien
ctgtggcactcattaatagagtctg

SEQ ID NO: 59035 - DNA, 25 bp, Homo sapien
ctgtggcactcatttatagagtctg

SEQ ID NO: 59036 - DNA, 25 bp, Homo sapien
ctgtggcacttcagcgactattcaa

SEQ ID NO: 59037 - DNA, 25 bp, Homo sapien
ctgtggcactttagcgactattcaa

SEQ ID NO: 59038 - DNA, 25 bp, Homo sapien
ctgtggcagcttcagaaatcagatt

SEQ ID NO: 59039 - DNA, 25 bp, Homo sapien
ctgtggctcatctatagtgctgctt

SEQ ID NO: 59040 - DNA, 25 bp, Homo sapien
ctgtggctcatctgtagtgctgctt

SEQ ID NO: 59041 - DNA, 25 bp, Homo sapien
ctgtgggaaacatgccatgccctct

SEQ ID NO: 59042 - DNA, 25 bp, Homo sapien
ctgtgggaaacgtgccatgccctct

SEQ ID NO: 59043 - DNA, 25 bp, Homo sapien
ctgtgggagagcatcctagccaggg

SEQ ID NO: 59044 - DNA, 25 bp, Homo sapien
ctgtgggagagcgtcctagccaggg

SEQ ID NO: 59045 - DNA, 25 bp, Homo sapien
ctgtggggtgtcctttttctagatg

SEQ ID NO: 59046 - DNA, 25 bp, Homo sapien
ctgtggggtgtcttttttctagatg

SEQ ID NO: 59047 - DNA, 25 bp, Homo sapien
ctgtggtaacggaatgtctgtgttt

SEQ ID NO: 59048 - DNA, 25 bp, Homo sapien
ctgtggtaatggaatgtctgtgttt

SEQ ID NO: 59049 - DNA, 25 bp, Homo sapien
ctgtggtgaagttcaaatgagctaa

SEQ ID NO: 59050 - DNA, 25 bp, Homo sapien
ctgtggtgaggttcaaatgagctaa

SEQ ID NO: 59051 - DNA, 25 bp, Homo sapien
ctgtggtggaactgaaccatctttg

SEQ ID NO: 59052 - DNA, 25 bp, Homo sapien
ctgtggtggaattgaaccatctttg

SEQ ID NO: 59053 - DNA, 25 bp, Homo sapien
ctgtggtggattccactgttccttc

SEQ ID NO: 59054 - DNA, 25 bp, Homo sapien
ctgtggtggatttcactgttccttc

SEQ ID NO: 59055 - DNA, 25 bp, Homo sapien
ctgtggttcttcacccagacataat

SEQ ID NO: 59056 - DNA, 25 bp, Homo sapien
ctgtggttcttcgcccagacataat

SEQ ID NO: 59057 - DNA, 25 bp, Homo sapien
ctgtgtacacaaaaagttgaaaata

SEQ ID NO: 59058 - DNA, 25 bp, Homo sapien
ctgtgtacagaaaaagttgaaaata

SEQ ID NO: 59059 - DNA, 25 bp, Homo sapien
ctgtgtacattgaacttctgagctg

SEQ ID NO: 59060 - DNA, 25 bp, Homo sapien
ctgtgtacgttgaacttctgagctg

SEQ ID NO: 59061 - DNA, 25 bp, Homo sapien
ctgtgtactcatacacttgacaaca

SEQ ID NO: 59062 - DNA, 25 bp, Homo sapien
ctgtgtactcatagacttgacaaca

SEQ ID NO: 59063 - DNA, 25 bp, Homo sapien
ctgtgtatccaccagtagtcacttc

SEQ ID NO: 59064 - DNA, 25 bp, Homo sapien
ctgtgtatccaccggtagtcacttc

SEQ ID NO: 59065 - DNA, 25 bp, Homo sapien
ctgtgtatttaaacgtttccattat

SEQ ID NO: 59066 - DNA, 25 bp, Homo sapien
ctgtgtatttaaatgtttccattat

SEQ ID NO: 59067 - DNA, 25 bp, Homo sapien
ctgtgtcatgtctgtgtccagatgt

SEQ ID NO: 59068 - DNA, 25 bp, Homo sapien
ctgtgtcatgtctttgtccagatgt

SEQ ID NO: 59069 - DNA, 25 bp, Homo sapien
ctgtgtccatgtaagttatttagcc

SEQ ID NO: 59070 - DNA, 25 bp, Homo sapien
ctgtgtccctgtaagttatttagcc

SEQ ID NO: 59071 - DNA, 25 bp, Homo sapien
ctgtgtcctcacagagtgaaagggg

SEQ ID NO: 59072 - DNA, 25 bp, Homo sapien
ctgtgtccttacagagtgaaagggg

SEQ ID NO: 59073 - DNA, 25 bp, Homo sapien
ctgtgtccttttgacatacttttat

SEQ ID NO: 59074 - DNA, 25 bp, Homo sapien
ctgtgtcctttttacatacttttat

SEQ ID NO: 59075 - DNA, 25 bp, Homo sapien
ctgtgtctacacataaaggatatag

SEQ ID NO: 59076 - DNA, 25 bp, Homo sapien
ctgtgtctccacataaaggatatag

SEQ ID NO: 59077 - DNA, 25 bp, Homo sapien
ctgtgtctctgaggagctaccattt

SEQ ID NO: 59078 - DNA, 25 bp, Homo sapien
ctgtgtctctgaggagttaccattt

SEQ ID NO: 59079 - DNA, 25 bp, Homo sapien
ctgtgtctctttcagctttaacact

SEQ ID NO: 59080 - DNA, 25 bp, Homo sapien
ctgtgtctttttcagctttaacact

SEQ ID NO: 59081 - DNA, 25 bp, Homo sapien
ctgtgtgatctgctttggccaacaa

SEQ ID NO: 59082 - DNA, 25 bp, Homo sapien
ctgtgtgatttgctttggccaacaa

SEQ ID NO: 59083 - DNA, 25 bp, Homo sapien
ctgtgtggcaatatgattagttaca

SEQ ID NO: 59084 - DNA, 25 bp, Homo sapien
ctgtgtggcgatatgattagttaca

SEQ ID NO: 59085 - DNA, 25 bp, Homo sapien
ctgtgtgttaggcaaggcaacctca

SEQ ID NO: 59086 - DNA, 25 bp, Homo sapien
ctgtgtgttaggcgaggcaacctca

SEQ ID NO: 59087 - DNA, 25 bp, Homo sapien
ctgtgttcaatctttggttactctg

SEQ ID NO: 59088 - DNA, 25 bp, Homo sapien
ctgtgttcagaaacctctcacatgc

SEQ ID NO: 59089 - DNA, 25 bp, Homo sapien
ctgtgttcagaaccctctcacatgc

SEQ ID NO: 59090 - DNA, 25 bp, Homo sapien
ctgtgttcagtctttggttactctg

SEQ ID NO: 59091 - DNA, 25 bp, Homo sapien
ctgtgttccaacagaacttcgttta

SEQ ID NO: 59092 - DNA, 25 bp, Homo sapien
ctgtgttccaacagaatttcgttta

SEQ ID NO: 59093 - DNA, 25 bp, Homo sapien
ctgtgttgcctattgatttcaagtc

SEQ ID NO: 59094 - DNA, 25 bp, Homo sapien
ctgtgttgcctgttgatttcaagtc

SEQ ID NO: 59095 - DNA, 25 bp, Homo sapien
ctgtgttgtgcactagatagatatg

SEQ ID NO: 59096 - DNA, 25 bp, Homo sapien
ctgtgttgtgcattagatagatatg

SEQ ID NO: 59097 - DNA, 25 bp, Homo sapien
ctgtgtttgtaagtttcattgtagg

SEQ ID NO: 59098 - DNA, 25 bp, Homo sapien
ctgtgttttaggcgataacatttca

SEQ ID NO: 59099 - DNA, 25 bp, Homo sapien
ctgtgttttaggtgataacatttca

SEQ ID NO: 59100 - DNA, 25 bp, Homo sapien
ctgtgttttgcccagagttaggaca

SEQ ID NO: 59101 - DNA, 25 bp, Homo sapien
ctgtgttttgcgcagagttaggaca

SEQ ID NO: 59102 - DNA, 25 bp, Homo sapien
ctgtgtttttaagtttcattgtagg

SEQ ID NO: 59103 - DNA, 25 bp, Homo sapien
ctgttaaaaaaattcacattcatat

SEQ ID NO: 59104 - DNA, 25 bp, Homo sapien
ctgttaaaaaatttcacattcatat

SEQ ID NO: 59105 - DNA, 25 bp, Homo sapien
ctgttaaaaagaaatgatgtcaaag

SEQ ID NO: 59106 - DNA, 25 bp, Homo sapien
ctgttaaaatgaaatgatgtcaaag

SEQ ID NO: 59107 - DNA, 25 bp, Homo sapien
ctgttaaacatcctatgaagcacag

SEQ ID NO: 59108 - DNA, 25 bp, Homo sapien
ctgttaaacatgctatgaagcacag

SEQ ID NO: 59109 - DNA, 25 bp, Homo sapien
ctgttaaagttctacacctcattat

SEQ ID NO: 59110 - DNA, 25 bp, Homo sapien
ctgttaaagttctatacctcattat

SEQ ID NO: 59111 - DNA, 25 bp, Homo sapien
ctgttaacagagtcctaactgagct

SEQ ID NO: 59112 - DNA, 25 bp, Homo sapien
ctgttaacagagttctaactgagct

SEQ ID NO: 59113 - DNA, 25 bp, Homo sapien
ctgttaaccaatctctgactattca

SEQ ID NO: 59114 - DNA, 25 bp, Homo sapien
ctgttaaccaatttctgactattca

SEQ ID NO: 59115 - DNA, 25 bp, Homo sapien
ctgttaagatgagccaggtttcttt

SEQ ID NO: 59116 - DNA, 25 bp, Homo sapien
ctgttaagatgaggcaggtttcttt

SEQ ID NO: 59117 - DNA, 25 bp, Homo sapien
ctgttaataaaagtctcatcctccc

SEQ ID NO: 59118 - DNA, 25 bp, Homo sapien
ctgttaataaaggtctcatcctccc

SEQ ID NO: 59119 - DNA, 25 bp, Homo sapien
ctgttaatgaatatactgcttgtcc

SEQ ID NO: 59120 - DNA, 25 bp, Homo sapien
ctgttaatggatatactgcttgtcc

SEQ ID NO: 59121 - DNA, 25 bp, Homo sapien
ctgttacaattattaattcacaaaa

SEQ ID NO: 59122 - DNA, 25 bp, Homo sapien
ctgttacaattgttaattcacaaaa

SEQ ID NO: 59123 - DNA, 25 bp, Homo sapien
ctgttaccagaagaaagttatgtag

SEQ ID NO: 59124 - DNA, 25 bp, Homo sapien
ctgttaccagaaggaagttatgtag

SEQ ID NO: 59125 - DNA, 25 bp, Homo sapien
ctgttaccagcactagcggatgtga

SEQ ID NO: 59126 - DNA, 25 bp, Homo sapien
ctgttaccagcattagcggatgtga

SEQ ID NO: 59127 - DNA, 25 bp, Homo sapien
ctgttaccatcagatcatcttaatc

SEQ ID NO: 59128 - DNA, 25 bp, Homo sapien
ctgttaccatcagatcgtcttaatc

SEQ ID NO: 59129 - DNA, 25 bp, Homo sapien
ctgttaccatgaaaagagggcctgg

SEQ ID NO: 59130 - DNA, 25 bp, Homo sapien
ctgttaccatgagaagagggcctgg

SEQ ID NO: 59131 - DNA, 25 bp, Homo sapien
ctgttacccaagacggttattccag

SEQ ID NO: 59132 - DNA, 25 bp, Homo sapien
ctgttacccaagatggttattccag

SEQ ID NO: 59133 - DNA, 25 bp, Homo sapien
ctgttaccttcttcatctatgcaca

SEQ ID NO: 59134 - DNA, 25 bp, Homo sapien
ctgttaccttcttcttctatgcaca

SEQ ID NO: 59135 - DNA, 25 bp, Homo sapien
ctgttacgtacctatgcttctttta

SEQ ID NO: 59136 - DNA, 25 bp, Homo sapien
ctgttacgtacctgtgcttctttta

SEQ ID NO: 59137 - DNA, 25 bp, Homo sapien
ctgttactgcataagaaacctttcc

SEQ ID NO: 59138 - DNA, 25 bp, Homo sapien
ctgttactgtccccgtaaaggtaat

SEQ ID NO: 59139 - DNA, 25 bp, Homo sapien
ctgttactgtccctgtaaaggtaat

SEQ ID NO: 59140 - DNA, 25 bp, Homo sapien
ctgttacttcataagaaacctttcc

SEQ ID NO: 59141 - DNA, 25 bp, Homo sapien
ctgttagagccttgatcaactgcta

SEQ ID NO: 59142 - DNA, 25 bp, Homo sapien
ctgttagaggcttgatcaactgcta

SEQ ID NO: 59143 - DNA, 25 bp, Homo sapien
ctgttagccgaatgccctcaagagc

SEQ ID NO: 59144 - DNA, 25 bp, Homo sapien
ctgttagccgaatgtcctcaagagc

SEQ ID NO: 59145 - DNA, 25 bp, Homo sapien
ctgttagtcgttctggcacttaaaa

SEQ ID NO: 59146 - DNA, 25 bp, Homo sapien
ctgttagtctttctggcacttaaaa

SEQ ID NO: 59147 - DNA, 25 bp, Homo sapien
ctgttatggacttcattctaagaag

SEQ ID NO: 59148 - DNA, 25 bp, Homo sapien
ctgttatggccttcattctaagaag

SEQ ID NO: 59149 - DNA, 25 bp, Homo sapien
ctgttattaatgtactccgtggcgt

SEQ ID NO: 59150 - DNA, 25 bp, Homo sapien
ctgttattagtgtactccgtggcgt

SEQ ID NO: 59151 - DNA, 25 bp, Homo sapien
ctgttattttaaatggaagaacttg

SEQ ID NO: 59152 - DNA, 25 bp, Homo sapien
ctgttattttaagtggaagaacttg

SEQ ID NO: 59153 - DNA, 25 bp, Homo sapien
ctgttcaaccagaagttctgactcc

SEQ ID NO: 59154 - DNA, 25 bp, Homo sapien
ctgttcaagcagaagttctgactcc

SEQ ID NO: 59155 - DNA, 25 bp, Homo sapien
ctgttcaatgtccatattcctaccc

SEQ ID NO: 59156 - DNA, 25 bp, Homo sapien
ctgttcaatgttcatattcctaccc

SEQ ID NO: 59157 - DNA, 25 bp, Homo sapien
ctgttcacacacttgagaccaaccc

SEQ ID NO: 59158 - DNA, 25 bp, Homo sapien
ctgttcacacatttgagaccaaccc

SEQ ID NO: 59159 - DNA, 25 bp, Homo sapien
ctgttcacactagacgtgcctccac

SEQ ID NO: 59160 - DNA, 25 bp, Homo sapien
ctgttcacactagatgtgcctccac

SEQ ID NO: 59161 - DNA, 25 bp, Homo sapien
ctgttcagatagctcttggtctcca

SEQ ID NO: 59162 - DNA, 25 bp, Homo sapien
ctgttcagatagctgttggtctcca

SEQ ID NO: 59163 - DNA, 25 bp, Homo sapien
ctgttcatatgcctattatttcact

SEQ ID NO: 59164 - DNA, 25 bp, Homo sapien
ctgttcatatgtctattatttcact

SEQ ID NO: 59165 - DNA, 25 bp, Homo sapien
ctgttcatcagcatattctgtaaag

SEQ ID NO: 59166 - DNA, 25 bp, Homo sapien
ctgttcatcagcgtattctgtaaag

SEQ ID NO: 59167 - DNA, 25 bp, Homo sapien
ctgttcatcttgtcacctttttatt

SEQ ID NO: 59168 - DNA, 25 bp, Homo sapien
ctgttcatcttgtcacttttttatt

SEQ ID NO: 59169 - DNA, 25 bp, Homo sapien
ctgttcattacatgttactatgaga

SEQ ID NO: 59170 - DNA, 25 bp, Homo sapien
ctgttcatttcatgttactatgaga

SEQ ID NO: 59171 - DNA, 25 bp, Homo sapien
ctgttccacaaaagctaggagtaat

SEQ ID NO: 59172 - DNA, 25 bp, Homo sapien
ctgttccacaaaagctgggagtaat

SEQ ID NO: 59173 - DNA, 25 bp, Homo sapien
ctgttcctcagccttctggacccgt

SEQ ID NO: 59174 - DNA, 25 bp, Homo sapien
ctgttcctcaggcttctggacccgt

SEQ ID NO: 59175 - DNA, 25 bp, Homo sapien
ctgttcctctaccatttttatggcc

SEQ ID NO: 59176 - DNA, 25 bp, Homo sapien
ctgttcctctacgatttttatggcc

SEQ ID NO: 59177 - DNA, 25 bp, Homo sapien
ctgttcctttgcttggctacgtcca

SEQ ID NO: 59178 - DNA, 25 bp, Homo sapien
ctgttcctttgtttggctacgtcca

SEQ ID NO: 59179 - DNA, 25 bp, Homo sapien
ctgttctaggatacaacaagaagga

SEQ ID NO: 59180 - DNA, 25 bp, Homo sapien
ctgttctaggataccacaagaagga

SEQ ID NO: 59181 - DNA, 25 bp, Homo sapien
ctgttctcagttttcttttgcagag

SEQ ID NO: 59182 - DNA, 25 bp, Homo sapien
ctgttctccgttttcttttgcagag

SEQ ID NO: 59183 - DNA, 25 bp, Homo sapien
ctgttctgagcaacccaaagctgga

SEQ ID NO: 59184 - DNA, 25 bp, Homo sapien
ctgttctgagcaacccgaagctgga

SEQ ID NO: 59185 - DNA, 25 bp, Homo sapien
ctgttctgctcttaatttttacata

SEQ ID NO: 59186 - DNA, 25 bp, Homo sapien
ctgttctgctcttattttttacata

SEQ ID NO: 59187 - DNA, 25 bp, Homo sapien
ctgttctgtccctacagtgatttat

SEQ ID NO: 59188 - DNA, 25 bp, Homo sapien
ctgttctgttcctacagtgatttat

SEQ ID NO: 59189 - DNA, 25 bp, Homo sapien
ctgttcttccctacacctgcttttg

SEQ ID NO: 59190 - DNA, 25 bp, Homo sapien
ctgttcttctctacacctgcttttg

SEQ ID NO: 59191 - DNA, 25 bp, Homo sapien
ctgttcttctctctggatcctgatt

SEQ ID NO: 59192 - DNA, 25 bp, Homo sapien
ctgttcttgtctctggatcctgatt

SEQ ID NO: 59193 - DNA, 25 bp, Homo sapien
ctgttgaataaaacaccaagtggag

SEQ ID NO: 59194 - DNA, 25 bp, Homo sapien
ctgttgaataaaacgccaagtggag

SEQ ID NO: 59195 - DNA, 25 bp, Homo sapien
ctgttgatatccagttctcaaatga

SEQ ID NO: 59196 - DNA, 25 bp, Homo sapien
ctgttgatatccagttttcaaatga

SEQ ID NO: 59197 - DNA, 25 bp, Homo sapien
ctgttgatcacgtggtctgccaggg

SEQ ID NO: 59198 - DNA, 25 bp, Homo sapien
ctgttgatcacgtggtttgccaggg

SEQ ID NO: 59199 - DNA, 25 bp, Homo sapien
ctgttgatgagactgatggcaaatg

SEQ ID NO: 59200 - DNA, 25 bp, Homo sapien
ctgttgatgagagtgatggcaaatg

SEQ ID NO: 59201 - DNA, 25 bp, Homo sapien
ctgttgatggctgtggaagaggtag

SEQ ID NO: 59202 - DNA, 25 bp, Homo sapien
ctgttgatgtatacactgaaaacaa

SEQ ID NO: 59203 - DNA, 25 bp, Homo sapien
ctgttgattcactaaacaaatgcct

SEQ ID NO: 59204 - DNA, 25 bp, Homo sapien
ctgttgattcactgaacaaatgcct

SEQ ID NO: 59205 - DNA, 25 bp, Homo sapien
ctgttgattgctgtggaagaggtag

SEQ ID NO: 59206 - DNA, 25 bp, Homo sapien
ctgttgatttatacactgaaaacaa

SEQ ID NO: 59207 - DNA, 25 bp, Homo sapien
ctgttgccgctctcttgctaggaga

SEQ ID NO: 59208 - DNA, 25 bp, Homo sapien
ctgttgcctctctcttgctaggaga

SEQ ID NO: 59209 - DNA, 25 bp, Homo sapien
ctgttgctatgacagaggtattaaa

SEQ ID NO: 59210 - DNA, 25 bp, Homo sapien
ctgttgctatgagagaggtattaaa

SEQ ID NO: 59211 - DNA, 25 bp, Homo sapien
ctgttgcttacaacagtaaaagtcc

SEQ ID NO: 59212 - DNA, 25 bp, Homo sapien
ctgttgcttacaatagtaaaagtcc

SEQ ID NO: 59213 - DNA, 25 bp, Homo sapien
ctgttggaccagcacagggcttctt

SEQ ID NO: 59214 - DNA, 25 bp, Homo sapien
ctgttggaccagcgcagggcttctt

SEQ ID NO: 59215 - DNA, 25 bp, Homo sapien
ctgttggacggaactttgctttata

SEQ ID NO: 59216 - DNA, 25 bp, Homo sapien
ctgttggatggaactttgctttata

SEQ ID NO: 59217 - DNA, 25 bp, Homo sapien
ctgttggccaagtccgagctgtgtc

SEQ ID NO: 59218 - DNA, 25 bp, Homo sapien
ctgttggccaagtctgagctgtgtc

SEQ ID NO: 59219 - DNA, 25 bp, Homo sapien
ctgttggccgtagcgttaagtgtca

SEQ ID NO: 59220 - DNA, 25 bp, Homo sapien
ctgttggccgtagctttaagtgtca

SEQ ID NO: 59221 - DNA, 25 bp, Homo sapien
ctgttgggactgcaataaaacatga

SEQ ID NO: 59222 - DNA, 25 bp, Homo sapien
ctgttgggactgccataaaacatga

SEQ ID NO: 59223 - DNA, 25 bp, Homo sapien
ctgttggtggctgtctaatgtttag

SEQ ID NO: 59224 - DNA, 25 bp, Homo sapien
ctgttggtggctgtctgatgtttag

SEQ ID NO: 59225 - DNA, 25 bp, Homo sapien
ctgttgtatcccttgctgtgttcct

SEQ ID NO: 59226 - DNA, 25 bp, Homo sapien
ctgttgtatcctttgctgtgttcct

SEQ ID NO: 59227 - DNA, 25 bp, Homo sapien
ctgttgtgtatgcaatcaaacaacc

SEQ ID NO: 59228 - DNA, 25 bp, Homo sapien
ctgttgtgtatgcaattaaacaacc

SEQ ID NO: 59229 - DNA, 25 bp, Homo sapien
ctgttgtgtctggtccgctacagtg

SEQ ID NO: 59230 - DNA, 25 bp, Homo sapien
ctgttgtgtctggtcctctacagtg

SEQ ID NO: 59231 - DNA, 25 bp, Homo sapien
ctgttgttaggaagaataaatacgt

SEQ ID NO: 59232 - DNA, 25 bp, Homo sapien
ctgttgttaggatgaataaatacgt

SEQ ID NO: 59233 - DNA, 25 bp, Homo sapien
ctgttgttgcctataactgtaagac

SEQ ID NO: 59234 - DNA, 25 bp, Homo sapien
ctgttgttgcctgtaactgtaagac

SEQ ID NO: 59235 - DNA, 25 bp, Homo sapien
ctgttgtttgtcctctcagtacaga

SEQ ID NO: 59236 - DNA, 25 bp, Homo sapien
ctgttgtttgtcttctcagtacaga

SEQ ID NO: 59237 - DNA, 25 bp, Homo sapien
ctgttgtttttgatattaaaagcac

SEQ ID NO: 59238 - DNA, 25 bp, Homo sapien
ctgttgtttttgatgttaaaagcac

SEQ ID NO: 59239 - DNA, 25 bp, Homo sapien
ctgtttaagaaaagtttgcctatgt

SEQ ID NO: 59240 - DNA, 25 bp, Homo sapien
ctgtttaagaaatgtttgcctatgt

SEQ ID NO: 59241 - DNA, 25 bp, Homo sapien
ctgtttaatagcaggttaagatgaa

SEQ ID NO: 59242 - DNA, 25 bp, Homo sapien
ctgtttaatagcgggttaagatgaa

SEQ ID NO: 59243 - DNA, 25 bp, Homo sapien
ctgtttaatgagagtgatgcagtag

SEQ ID NO: 59244 - DNA, 25 bp, Homo sapien
ctgtttaatgatagtgatgcagtag

SEQ ID NO: 59245 - DNA, 25 bp, Homo sapien
ctgtttacagcctgatatactgaat

SEQ ID NO: 59246 - DNA, 25 bp, Homo sapien
ctgtttacagcctggtatactgaat

SEQ ID NO: 59247 - DNA, 25 bp, Homo sapien
ctgtttataagacgcctacaataaa

SEQ ID NO: 59248 - DNA, 25 bp, Homo sapien
ctgtttataagatgcctacaataaa

SEQ ID NO: 59249 - DNA, 25 bp, Homo sapien
ctgtttatagagcacatccacagta

SEQ ID NO: 59250 - DNA, 25 bp, Homo sapien
ctgtttatagagtacatccacagta

SEQ ID NO: 59251 - DNA, 25 bp, Homo sapien
ctgtttattccagcccatgatgttg

SEQ ID NO: 59252 - DNA, 25 bp, Homo sapien
ctgtttattccagcccgtgatgttg

SEQ ID NO: 59253 - DNA, 25 bp, Homo sapien
ctgtttattcccaattgcactggac

SEQ ID NO: 59254 - DNA, 25 bp, Homo sapien
ctgtttattcctaattgcactggac

SEQ ID NO: 59255 - DNA, 25 bp, Homo sapien
ctgtttcacatgacagccctttata

SEQ ID NO: 59256 - DNA, 25 bp, Homo sapien
ctgtttcacatggcagccctttata

SEQ ID NO: 59257 - DNA, 25 bp, Homo sapien
ctgtttcactggacatacaatactg

SEQ ID NO: 59258 - DNA, 25 bp, Homo sapien
ctgtttcagaaaaccggcattctgg

SEQ ID NO: 59259 - DNA, 25 bp, Homo sapien
ctgtttcagaaaactggcattctgg

SEQ ID NO: 59260 - DNA, 25 bp, Homo sapien
ctgtttcagtggacatacaatactg

SEQ ID NO: 59261 - DNA, 25 bp, Homo sapien
ctgtttcatctgcagcaagcatctg

SEQ ID NO: 59262 - DNA, 25 bp, Homo sapien
ctgtttcatctgcagcgagcatctg

SEQ ID NO: 59263 - DNA, 25 bp, Homo sapien
ctgtttccaactttctatctccttc

SEQ ID NO: 59264 - DNA, 25 bp, Homo sapien
ctgtttccatctttctatctccttc

SEQ ID NO: 59265 - DNA, 25 bp, Homo sapien
ctgtttccatttttcttttttgttc

SEQ ID NO: 59266 - DNA, 25 bp, Homo sapien
ctgtttccgtttttcttttttgttc

SEQ ID NO: 59267 - DNA, 25 bp, Homo sapien
ctgtttcctcacgtggcagaaaggg

SEQ ID NO: 59268 - DNA, 25 bp, Homo sapien
ctgtttcctcacttggcagaaaggg

SEQ ID NO: 59269 - DNA, 25 bp, Homo sapien
ctgtttctactgctcctgttttttt

SEQ ID NO: 59270 - DNA, 25 bp, Homo sapien
ctgtttctactgcttctgttttttt

SEQ ID NO: 59271 - DNA, 25 bp, Homo sapien
ctgtttctcctagacatcatggtta

SEQ ID NO: 59272 - DNA, 25 bp, Homo sapien
ctgtttctcctaggcatcatggtta

SEQ ID NO: 59273 - DNA, 25 bp, Homo sapien
ctgtttctgaagaaaatggagctca

SEQ ID NO: 59274 - DNA, 25 bp, Homo sapien
ctgtttctggagaaaatggagctca

SEQ ID NO: 59275 - DNA, 25 bp, Homo sapien
ctgtttctttagtacgctccctgtc

SEQ ID NO: 59276 - DNA, 25 bp, Homo sapien
ctgtttctttagtacgttccctgtc

SEQ ID NO: 59277 - DNA, 25 bp, Homo sapien
ctgtttgacgctcaatggatccagt

SEQ ID NO: 59278 - DNA, 25 bp, Homo sapien
ctgtttgacttgctgatgattccat

SEQ ID NO: 59279 - DNA, 25 bp, Homo sapien
ctgtttgacttgttgatgattccat

SEQ ID NO: 59280 - DNA, 25 bp, Homo sapien
ctgtttgatgctcaatggatccagt

SEQ ID NO: 59281 - DNA, 25 bp, Homo sapien
ctgtttgatttggcgatgacaatgg

SEQ ID NO: 59282 - DNA, 25 bp, Homo sapien
ctgtttgatttggtgatgacaatgg

SEQ ID NO: 59283 - DNA, 25 bp, Homo sapien
ctgtttgcagcaacatggataaacc

SEQ ID NO: 59284 - DNA, 25 bp, Homo sapien
ctgtttgcagcaacgtggataaacc

SEQ ID NO: 59285 - DNA, 25 bp, Homo sapien
ctgtttgggcttcgaacgtaactga

SEQ ID NO: 59286 - DNA, 25 bp, Homo sapien
ctgtttgggcttcgaatgtaactga

SEQ ID NO: 59287 - DNA, 25 bp, Homo sapien
ctgttttaacctactgaggtcttgg

SEQ ID NO: 59288 - DNA, 25 bp, Homo sapien
ctgttttaagctactgaggtcttgg

SEQ ID NO: 59289 - DNA, 25 bp, Homo sapien
ctgttttagcattattatgtattat

SEQ ID NO: 59290 - DNA, 25 bp, Homo sapien
ctgttttagcattcttatgtattat

SEQ ID NO: 59291 - DNA, 25 bp, Homo sapien
ctgttttcacgctcttatgtcctct

SEQ ID NO: 59292 - DNA, 25 bp, Homo sapien
ctgttttcatgctcttatgtcctct

SEQ ID NO: 59293 - DNA, 25 bp, Homo sapien
ctgttttcctccgtgttctctaacc

SEQ ID NO: 59294 - DNA, 25 bp, Homo sapien
ctgttttcctccttgttctctaacc

SEQ ID NO: 59295 - DNA, 25 bp, Homo sapien
ctgttttctgaaaaagtttgtgtag

SEQ ID NO: 59296 - DNA, 25 bp, Homo sapien
ctgttttctgaaaaggtttgtgtag

SEQ ID NO: 59297 - DNA, 25 bp, Homo sapien
ctgttttctgccagtgagtaaatta

SEQ ID NO: 59298 - DNA, 25 bp, Homo sapien
ctgttttctgctagtgagtaaatta

SEQ ID NO: 59299 - DNA, 25 bp, Homo sapien
ctgttttcttgtcctgcgacagtgt

SEQ ID NO: 59300 - DNA, 25 bp, Homo sapien
ctgttttcttgtcctgtgacagtgt

SEQ ID NO: 59301 - DNA, 25 bp, Homo sapien
ctgtttttatactggagttctgttg

SEQ ID NO: 59302 - DNA, 25 bp, Homo sapien
ctgtttttatcaggaaagaagatct

SEQ ID NO: 59303 - DNA, 25 bp, Homo sapien
ctgtttttatcgggaaagaagatct

SEQ ID NO: 59304 - DNA, 25 bp, Homo sapien
ctgtttttcacttacagtacggtag

SEQ ID NO: 59305 - DNA, 25 bp, Homo sapien
ctgtttttcactttcagtacggtag

SEQ ID NO: 59306 - DNA, 25 bp, Homo sapien
ctgtttttccctctttatttgtaaa

SEQ ID NO: 59307 - DNA, 25 bp, Homo sapien
ctgtttttctctctttatttgtaaa

SEQ ID NO: 59308 - DNA, 25 bp, Homo sapien
ctgtttttgtactggagttctgttg

SEQ ID NO: 59309 - DNA, 25 bp, Homo sapien
ctgtttttgtttagtaatgatgcct

SEQ ID NO: 59310 - DNA, 25 bp, Homo sapien
ctgtttttgtttagtattgatgcct

SEQ ID NO: 59311 - DNA, 25 bp, Homo sapien
ctgttttttcttctcccgaatgcat

SEQ ID NO: 59312 - DNA, 25 bp, Homo sapien
ctgttttttcttctcctgaatgcat

SEQ ID NO: 59313 - DNA, 25 bp, Homo sapien
cttaaaaaattgtgaaatttgggca

SEQ ID NO: 59314 - DNA, 25 bp, Homo sapien
cttaaaaaattgtggaatttgggca

SEQ ID NO: 59315 - DNA, 25 bp, Homo sapien
cttaaaaaatttcctcattgggtgt

SEQ ID NO: 59316 - DNA, 25 bp, Homo sapien
cttaaaaaatttcttcattgggtgt

SEQ ID NO: 59317 - DNA, 25 bp, Homo sapien
cttaaaaacaaattacacgcctctg

SEQ ID NO: 59318 - DNA, 25 bp, Homo sapien
cttaaaaacctaaaatattagatga

SEQ ID NO: 59319 - DNA, 25 bp, Homo sapien
cttaaaaacctacaatattagatga

SEQ ID NO: 59320 - DNA, 25 bp, Homo sapien
cttaaaaataaattacacgcctctg

SEQ ID NO: 59321 - DNA, 25 bp, Homo sapien
cttaaaacccacgaattgggcagtt

SEQ ID NO: 59322 - DNA, 25 bp, Homo sapien
cttaaaacccacgatttgggcagtt

SEQ ID NO: 59323 - DNA, 25 bp, Homo sapien
cttaaaagccacgacatagaacaac

SEQ ID NO: 59324 - DNA, 25 bp, Homo sapien
cttaaaagccatgacatagaacaac

SEQ ID NO: 59325 - DNA, 25 bp, Homo sapien
cttaaaagttccacgtacactacta

SEQ ID NO: 59326 - DNA, 25 bp, Homo sapien
cttaaaagttccatgtacactacta

SEQ ID NO: 59327 - DNA, 25 bp, Homo sapien
cttaaaataaccagtccctattgct

SEQ ID NO: 59328 - DNA, 25 bp, Homo sapien
cttaaaatagccagtccctattgct

SEQ ID NO: 59329 - DNA, 25 bp, Homo sapien
cttaaaatcaacagatagaaattgt

SEQ ID NO: 59330 - DNA, 25 bp, Homo sapien
cttaaaatcaacggatagaaattgt

SEQ ID NO: 59331 - DNA, 25 bp, Homo sapien
cttaaaatctcattgaatcttacag

SEQ ID NO: 59332 - DNA, 25 bp, Homo sapien
cttaaaatgccaactgacttgtgtt

SEQ ID NO: 59333 - DNA, 25 bp, Homo sapien
cttaaaatgccagctgacttgtgtt

SEQ ID NO: 59334 - DNA, 25 bp, Homo sapien
cttaaaattgacccttgagcgatta

SEQ ID NO: 59335 - DNA, 25 bp, Homo sapien
cttaaaattgacgcttgagcgatta

SEQ ID NO: 59336 - DNA, 25 bp, Homo sapien
cttaaaatttcattgaatcttacag

SEQ ID NO: 59337 - DNA, 25 bp, Homo sapien
cttaaaattttatggatacgaattc

SEQ ID NO: 59338 - DNA, 25 bp, Homo sapien
cttaaaattttgtggatacgaattc

SEQ ID NO: 59339 - DNA, 25 bp, Homo sapien
cttaaacaataagactttacttagt

SEQ ID NO: 59340 - DNA, 25 bp, Homo sapien
cttaaacaataagcctttacttagt

SEQ ID NO: 59341 - DNA, 25 bp, Homo sapien
cttaaacacacccagtgctcaaatc

SEQ ID NO: 59342 - DNA, 25 bp, Homo sapien
cttaaacacacctagtgctcaaatc

SEQ ID NO: 59343 - DNA, 25 bp, Homo sapien
cttaaagaaaacatacaaggagtgt

SEQ ID NO: 59344 - DNA, 25 bp, Homo sapien
cttaaagaacacatacaaggagtgt

SEQ ID NO: 59345 - DNA, 25 bp, Homo sapien
cttaaagaatataaaatcatgtctg

SEQ ID NO: 59346 - DNA, 25 bp, Homo sapien
cttaaagaccctttctgctccaaga

SEQ ID NO: 59347 - DNA, 25 bp, Homo sapien
cttaaagactataaaatcatgtctg

SEQ ID NO: 59348 - DNA, 25 bp, Homo sapien
cttaaagactctttctgctccaaga

SEQ ID NO: 59349 - DNA, 25 bp, Homo sapien
cttaaagctcaagcgctcttcaatc

SEQ ID NO: 59350 - DNA, 25 bp, Homo sapien
cttaaagctcaagggctcttcaatc

SEQ ID NO: 59351 - DNA, 25 bp, Homo sapien
cttaaaggccctagtatttttggaa

SEQ ID NO: 59352 - DNA, 25 bp, Homo sapien
cttaaaggtcctagtatttttggaa

SEQ ID NO: 59353 - DNA, 25 bp, Homo sapien
cttaaaggtctcatccgtattttca

SEQ ID NO: 59354 - DNA, 25 bp, Homo sapien
cttaaaggtctcgtccgtattttca

SEQ ID NO: 59355 - DNA, 25 bp, Homo sapien
cttaaagtatacaacaaagctcatc

SEQ ID NO: 59356 - DNA, 25 bp, Homo sapien
cttaaagtatacaacacagctcatc

SEQ ID NO: 59357 - DNA, 25 bp, Homo sapien
cttaaataaatgcaagaacttcatt

SEQ ID NO: 59358 - DNA, 25 bp, Homo sapien
cttaaatacatgcaagaacttcatt

SEQ ID NO: 59359 - DNA, 25 bp, Homo sapien
cttaaatcataccaccttaagtttt

SEQ ID NO: 59360 - DNA, 25 bp, Homo sapien
cttaaatcataccatcttaagtttt

SEQ ID NO: 59361 - DNA, 25 bp, Homo sapien
cttaaatcctctcttaaccatcatg

SEQ ID NO: 59362 - DNA, 25 bp, Homo sapien
cttaaatcctctcttagccatcatg

SEQ ID NO: 59363 - DNA, 25 bp, Homo sapien
cttaaatgacacccttgttatttat

SEQ ID NO: 59364 - DNA, 25 bp, Homo sapien
cttaaatgtcacccttgttatttat

SEQ ID NO: 59365 - DNA, 25 bp, Homo sapien
cttaaattcagtcagagcggaaaaa

SEQ ID NO: 59366 - DNA, 25 bp, Homo sapien
cttaaattcagtcggagcggaaaaa

SEQ ID NO: 59367 - DNA, 25 bp, Homo sapien
cttaaattcctgccagctgtgagcc

SEQ ID NO: 59368 - DNA, 25 bp, Homo sapien
cttaaattcctgcgagctgtgagcc

SEQ ID NO: 59369 - DNA, 25 bp, Homo sapien
cttaaattgcgaagttgtcaagtca

SEQ ID NO: 59370 - DNA, 25 bp, Homo sapien
cttaaattgtgaagttgtcaagtca

SEQ ID NO: 59371 - DNA, 25 bp, Homo sapien
cttaacaagaaattggtgccagtca

SEQ ID NO: 59372 - DNA, 25 bp, Homo sapien
cttaacaataaattggtgccagtca

SEQ ID NO: 59373 - DNA, 25 bp, Homo sapien
cttaacacgctaacaacgtaaacgg

SEQ ID NO: 59374 - DNA, 25 bp, Homo sapien
cttaacacgctaacaatgtaaacgg

SEQ ID NO: 59375 - DNA, 25 bp, Homo sapien
cttaacactttcgtcactaagcaca

SEQ ID NO: 59376 - DNA, 25 bp, Homo sapien
cttaacacttttgtcactaagcaca

SEQ ID NO: 59377 - DNA, 25 bp, Homo sapien
cttaacagaacaacatggatttaaa

SEQ ID NO: 59378 - DNA, 25 bp, Homo sapien
cttaacagaattgtaatcatgcaga

SEQ ID NO: 59379 - DNA, 25 bp, Homo sapien
cttaacagaattttaatcatgcaga

SEQ ID NO: 59380 - DNA, 25 bp, Homo sapien
cttaacagagcaacatggatttaaa

SEQ ID NO: 59381 - DNA, 25 bp, Homo sapien
cttaacatgctgtatggtgcttagc

SEQ ID NO: 59382 - DNA, 25 bp, Homo sapien
cttaacatggtgtatggtgcttagc

SEQ ID NO: 59383 - DNA, 25 bp, Homo sapien
cttaaccacattgccaactggagca

SEQ ID NO: 59384 - DNA, 25 bp, Homo sapien
cttaaccatattgccaactggagca

SEQ ID NO: 59385 - DNA, 25 bp, Homo sapien
cttaaccggagttctcaccattcaa

SEQ ID NO: 59386 - DNA, 25 bp, Homo sapien
cttaaccggcgttctcaccattcaa

SEQ ID NO: 59387 - DNA, 25 bp, Homo sapien
cttaaccttgagatcaaaaacataa

SEQ ID NO: 59388 - DNA, 25 bp, Homo sapien
cttaaccttgagatcagaaacataa

SEQ ID NO: 59389 - DNA, 25 bp, Homo sapien
cttaactccaccccagactgctttt

SEQ ID NO: 59390 - DNA, 25 bp, Homo sapien
cttaactccacccgagactgctttt

SEQ ID NO: 59391 - DNA, 25 bp, Homo sapien
cttaactcccagcataatctctgca

SEQ ID NO: 59392 - DNA, 25 bp, Homo sapien
cttaactcctagcataatctctgca

SEQ ID NO: 59393 - DNA, 25 bp, Homo sapien
cttaactcctttcggatgtcacact

SEQ ID NO: 59394 - DNA, 25 bp, Homo sapien
cttaactccttttggatgtcacact

SEQ ID NO: 59395 - DNA, 25 bp, Homo sapien
cttaactctgagtgtgaacgaaaag

SEQ ID NO: 59396 - DNA, 25 bp, Homo sapien
cttaactctgagtttgaacgaaaag

SEQ ID NO: 59397 - DNA, 25 bp, Homo sapien
cttaactgagtatcctaaggtgtta

SEQ ID NO: 59398 - DNA, 25 bp, Homo sapien
cttaactgattatcctaaggtgtta

SEQ ID NO: 59399 - DNA, 25 bp, Homo sapien
cttaactggaaaatgaaacacttaa

SEQ ID NO: 59400 - DNA, 25 bp, Homo sapien
cttaactggaaagtgaaacacttaa

SEQ ID NO: 59401 - DNA, 25 bp, Homo sapien
cttaacttgaacacgactcattttg

SEQ ID NO: 59402 - DNA, 25 bp, Homo sapien
cttaacttgaacatgactcattttg

SEQ ID NO: 59403 - DNA, 25 bp, Homo sapien
cttaagaaacttgtccaagatatac

SEQ ID NO: 59404 - DNA, 25 bp, Homo sapien
cttaagaaatttgtccaagatatac

SEQ ID NO: 59405 - DNA, 25 bp, Homo sapien
cttaagcgcataggaatctctattt

SEQ ID NO: 59406 - DNA, 25 bp, Homo sapien
cttaagcgcgtaggaatctctattt

SEQ ID NO: 59407 - DNA, 25 bp, Homo sapien
cttaaggccataagtccgaaaccag

SEQ ID NO: 59408 - DNA, 25 bp, Homo sapien
cttaaggccgtaagtccgaaaccag

SEQ ID NO: 59409 - DNA, 25 bp, Homo sapien
cttaaggcctaggtctaccttcatg

SEQ ID NO: 59410 - DNA, 25 bp, Homo sapien
cttaaggcctatgtctaccttcatg

SEQ ID NO: 59411 - DNA, 25 bp, Homo sapien
cttaaggcttctgagtaccttagcc

SEQ ID NO: 59412 - DNA, 25 bp, Homo sapien
cttaaggcttctgagtgccttagcc

SEQ ID NO: 59413 - DNA, 25 bp, Homo sapien
cttaaggcttttagtatccatgaag

SEQ ID NO: 59414 - DNA, 25 bp, Homo sapien
cttaaggctttttgtatccatgaag

SEQ ID NO: 59415 - DNA, 25 bp, Homo sapien
cttaaggtgaaagtgacttgacttt

SEQ ID NO: 59416 - DNA, 25 bp, Homo sapien
cttaaggtgaaattgacttgacttt

SEQ ID NO: 59417 - DNA, 25 bp, Homo sapien
cttaaggttctcaatcggtgtacag

SEQ ID NO: 59418 - DNA, 25 bp, Homo sapien
cttaaggttttcaatcggtgtacag

SEQ ID NO: 59419 - DNA, 25 bp, Homo sapien
cttaagtacaccattgacgccatga

SEQ ID NO: 59420 - DNA, 25 bp, Homo sapien
cttaagtataccattgacgccatga

SEQ ID NO: 59421 - DNA, 25 bp, Homo sapien
cttaagtgaaatatctcttcatgac

SEQ ID NO: 59422 - DNA, 25 bp, Homo sapien
cttaagtgaaatgtctcttcatgac

SEQ ID NO: 59423 - DNA, 25 bp, Homo sapien
cttaagtgagtaaactctatctagc

SEQ ID NO: 59424 - DNA, 25 bp, Homo sapien
cttaagtgagtaaattctatctagc

SEQ ID NO: 59425 - DNA, 25 bp, Homo sapien
cttaagtgatgaggacctagatttg

SEQ ID NO: 59426 - DNA, 25 bp, Homo sapien
cttaagtgatgaggacttagatttg

SEQ ID NO: 59427 - DNA, 25 bp, Homo sapien
cttaagtgtaccagctagaagtaac

SEQ ID NO: 59428 - DNA, 25 bp, Homo sapien
cttaagtgtaccagctggaagtaac

SEQ ID NO: 59429 - DNA, 25 bp, Homo sapien
cttaataaaacaattgcactttgcc

SEQ ID NO: 59430 - DNA, 25 bp, Homo sapien
cttaataaaacgattgcactttgcc

SEQ ID NO: 59431 - DNA, 25 bp, Homo sapien
cttaataaagaattacacaaacaaa

SEQ ID NO: 59432 - DNA, 25 bp, Homo sapien
cttaataaagaattacgcaaacaaa

SEQ ID NO: 59433 - DNA, 25 bp, Homo sapien
cttaataatcaatactttggctgct

SEQ ID NO: 59434 - DNA, 25 bp, Homo sapien
cttaataatcaatcctttggctgct

SEQ ID NO: 59435 - DNA, 25 bp, Homo sapien
cttaatacctaatataatgtctgat

SEQ ID NO: 59436 - DNA, 25 bp, Homo sapien
cttaatacctaatgtaatgtctgat

SEQ ID NO: 59437 - DNA, 25 bp, Homo sapien
cttaatagaaacttacacccattga

SEQ ID NO: 59438 - DNA, 25 bp, Homo sapien
cttaatagaaacttacgcccattga

SEQ ID NO: 59439 - DNA, 25 bp, Homo sapien
cttaatagccaatgtgacagtatta

SEQ ID NO: 59440 - DNA, 25 bp, Homo sapien
cttaatagccagtgtgacagtatta

SEQ ID NO: 59441 - DNA, 25 bp, Homo sapien
cttaatcaattctgcttttaaaaga

SEQ ID NO: 59442 - DNA, 25 bp, Homo sapien
cttaatcagttctgcttttaaaaga

SEQ ID NO: 59443 - DNA, 25 bp, Homo sapien
cttaatcattacagttgtggggaat

SEQ ID NO: 59444 - DNA, 25 bp, Homo sapien
cttaatcattacggttgtggggaat

SEQ ID NO: 59445 - DNA, 25 bp, Homo sapien
cttaatctctgtatctcctgaaatt

SEQ ID NO: 59446 - DNA, 25 bp, Homo sapien
cttaatctgaatgacagttgcccta

SEQ ID NO: 59447 - DNA, 25 bp, Homo sapien
cttaatctgaatgagagttgcccta

SEQ ID NO: 59448 - DNA, 25 bp, Homo sapien
cttaatctgcagacgtggactgagg

SEQ ID NO: 59449 - DNA, 25 bp, Homo sapien
cttaatctgcagatgtggactgagg

SEQ ID NO: 59450 - DNA, 25 bp, Homo sapien
cttaatctttgtatctcctgaaatt

SEQ ID NO: 59451 - DNA, 25 bp, Homo sapien
cttaatgacaatgatacattctgag

SEQ ID NO: 59452 - DNA, 25 bp, Homo sapien
cttaatgacgatgatacattctgag

SEQ ID NO: 59453 - DNA, 25 bp, Homo sapien
cttaatgatccatatactgtcacgg

SEQ ID NO: 59454 - DNA, 25 bp, Homo sapien
cttaatgatccatgtactgtcacgg

SEQ ID NO: 59455 - DNA, 25 bp, Homo sapien
cttaatgcaataggagggcaacaaa

SEQ ID NO: 59456 - DNA, 25 bp, Homo sapien
cttaatgcagcaatctcaggcttta

SEQ ID NO: 59457 - DNA, 25 bp, Homo sapien
cttaatgcagcgatctcaggcttta

SEQ ID NO: 59458 - DNA, 25 bp, Homo sapien
cttaatgcgataggagggcaacaaa

SEQ ID NO: 59459 - DNA, 25 bp, Homo sapien
cttaatgtactccaatgaaagatgg

SEQ ID NO: 59460 - DNA, 25 bp, Homo sapien
cttaatgtgctccaatgaaagatgg

SEQ ID NO: 59461 - DNA, 25 bp, Homo sapien
cttaattaggaaaccatatttgtag

SEQ ID NO: 59462 - DNA, 25 bp, Homo sapien
cttaattaggagaccatatttgtag

SEQ ID NO: 59463 - DNA, 25 bp, Homo sapien
cttaattctggaattatttttgctc

SEQ ID NO: 59464 - DNA, 25 bp, Homo sapien
cttaattctggcattatttttgctc

SEQ ID NO: 59465 - DNA, 25 bp, Homo sapien
cttaattgaacaaactctcttgatt

SEQ ID NO: 59466 - DNA, 25 bp, Homo sapien
cttaattgaacaaattctcttgatt

SEQ ID NO: 59467 - DNA, 25 bp, Homo sapien
cttaattggatactctgtgggtggt

SEQ ID NO: 59468 - DNA, 25 bp, Homo sapien
cttaattggatactttgtgggtggt

SEQ ID NO: 59469 - DNA, 25 bp, Homo sapien
cttaatttcctcactgccataatta

SEQ ID NO: 59470 - DNA, 25 bp, Homo sapien
cttaatttgcgtttctttaattttt

SEQ ID NO: 59471 - DNA, 25 bp, Homo sapien
cttaatttgtgtttctttaattttt

SEQ ID NO: 59472 - DNA, 25 bp, Homo sapien
cttaattttctcactgccataatta

SEQ ID NO: 59473 - DNA, 25 bp, Homo sapien
cttacaaaattcacatggtagagct

SEQ ID NO: 59474 - DNA, 25 bp, Homo sapien
cttacaaaatttacatggtagagct

SEQ ID NO: 59475 - DNA, 25 bp, Homo sapien
cttacaaacaattttgattatgatg

SEQ ID NO: 59476 - DNA, 25 bp, Homo sapien
cttacaaactgcatctcaatttccc

SEQ ID NO: 59477 - DNA, 25 bp, Homo sapien
cttacaaactgtatctcaatttccc

SEQ ID NO: 59478 - DNA, 25 bp, Homo sapien
cttacaaataattttgattatgatg

SEQ ID NO: 59479 - DNA, 25 bp, Homo sapien
cttacaattattactaggtgcttct

SEQ ID NO: 59480 - DNA, 25 bp, Homo sapien
cttacaatttttactaggtgcttct

SEQ ID NO: 59481 - DNA, 25 bp, Homo sapien
cttacacaaaaaatttcgcagtgag

SEQ ID NO: 59482 - DNA, 25 bp, Homo sapien
cttacacaagagctctgtggattct

SEQ ID NO: 59483 - DNA, 25 bp, Homo sapien
cttacacaagagctctttggattct

SEQ ID NO: 59484 - DNA, 25 bp, Homo sapien
cttacacagaaaatttcgcagtgag

SEQ ID NO: 59485 - DNA, 25 bp, Homo sapien
cttacacattttactcattctttac

SEQ ID NO: 59486 - DNA, 25 bp, Homo sapien
cttacacattttactcgttctttac

SEQ ID NO: 59487 - DNA, 25 bp, Homo sapien
cttacacccttgaacctggtttctt

SEQ ID NO: 59488 - DNA, 25 bp, Homo sapien
cttacacccttgagcctggtttctt

SEQ ID NO: 59489 - DNA, 25 bp, Homo sapien
cttacactttttaaatgaagtttca

SEQ ID NO: 59490 - DNA, 25 bp, Homo sapien
cttacacttttttaatgaagtttca

SEQ ID NO: 59491 - DNA, 25 bp, Homo sapien
cttacagacaatcgttatcttgcta

SEQ ID NO: 59492 - DNA, 25 bp, Homo sapien
cttacagacaattgttatcttgcta

SEQ ID NO: 59493 - DNA, 25 bp, Homo sapien
cttacagcaagcgacaagtcaaaga

SEQ ID NO: 59494 - DNA, 25 bp, Homo sapien
cttacagcaagtgacaagtcaaaga

SEQ ID NO: 59495 - DNA, 25 bp, Homo sapien
cttacagcagcgctccactaccaca

SEQ ID NO: 59496 - DNA, 25 bp, Homo sapien
cttacagcagttacacagtagttac

SEQ ID NO: 59497 - DNA, 25 bp, Homo sapien
cttacagcccgttttaagaacttta

SEQ ID NO: 59498 - DNA, 25 bp, Homo sapien
cttacagcctgttttaagaacttta

SEQ ID NO: 59499 - DNA, 25 bp, Homo sapien
cttacagcggttacacagtagttac

SEQ ID NO: 59500 - DNA, 25 bp, Homo sapien
cttacagctgcgctccactaccaca

SEQ ID NO: 59501 - DNA, 25 bp, Homo sapien
cttacagtctagtcgggttagatag

SEQ ID NO: 59502 - DNA, 25 bp, Homo sapien
cttacagtctagttgggttagatag

SEQ ID NO: 59503 - DNA, 25 bp, Homo sapien
cttacagtgtgtgacagggagagaa

SEQ ID NO: 59504 - DNA, 25 bp, Homo sapien
cttacagtgtgttacagggagagaa

SEQ ID NO: 59505 - DNA, 25 bp, Homo sapien
cttacatcgcagaaaatgttaatga

SEQ ID NO: 59506 - DNA, 25 bp, Homo sapien
cttacatcgcagcaaatgttaatga

SEQ ID NO: 59507 - DNA, 25 bp, Homo sapien
cttacatgccttcttaaaacacagg

SEQ ID NO: 59508 - DNA, 25 bp, Homo sapien
cttacatgctttcttaaaacacagg

SEQ ID NO: 59509 - DNA, 25 bp, Homo sapien
cttaccaacagccctcagtgaaccc

SEQ ID NO: 59510 - DNA, 25 bp, Homo sapien
cttaccaacagctctcagtgaaccc

SEQ ID NO: 59511 - DNA, 25 bp, Homo sapien
cttaccatattttcagagttatctc

SEQ ID NO: 59512 - DNA, 25 bp, Homo sapien
cttaccatgaatagagcttgcaggg

SEQ ID NO: 59513 - DNA, 25 bp, Homo sapien
cttaccatgaatggagcttgcaggg

SEQ ID NO: 59514 - DNA, 25 bp, Homo sapien
cttaccatgcaatacttttccaata

SEQ ID NO: 59515 - DNA, 25 bp, Homo sapien
cttaccatgcagtacttttccaata

SEQ ID NO: 59516 - DNA, 25 bp, Homo sapien
cttaccatgttttcagagttatctc

SEQ ID NO: 59517 - DNA, 25 bp, Homo sapien
cttacccacggatatacacctagtg

SEQ ID NO: 59518 - DNA, 25 bp, Homo sapien
cttacccagtccgccaattcaaatg

SEQ ID NO: 59519 - DNA, 25 bp, Homo sapien
cttacccagtctgccaattcaaatg

SEQ ID NO: 59520 - DNA, 25 bp, Homo sapien
cttacccatggatatacacctagtg

SEQ ID NO: 59521 - DNA, 25 bp, Homo sapien
cttaccctttgaatatcgtgtactt

SEQ ID NO: 59522 - DNA, 25 bp, Homo sapien
cttaccctttgaatatggtgtactt

SEQ ID NO: 59523 - DNA, 25 bp, Homo sapien
cttaccgcacgattattttgaggaa

SEQ ID NO: 59524 - DNA, 25 bp, Homo sapien
cttaccgcatgattattttgaggaa

SEQ ID NO: 59525 - DNA, 25 bp, Homo sapien
cttaccgcggtcgtttttagatccg

SEQ ID NO: 59526 - DNA, 25 bp, Homo sapien
cttaccgcggtggtttttagatccg

SEQ ID NO: 59527 - DNA, 25 bp, Homo sapien
cttacctcatatttgtgttaatttc

SEQ ID NO: 59528 - DNA, 25 bp, Homo sapien
cttacctccatataatacattcagg

SEQ ID NO: 59529 - DNA, 25 bp, Homo sapien
cttacctccatgtaatacattcagg

SEQ ID NO: 59530 - DNA, 25 bp, Homo sapien
cttacctcttatttgtgttaatttc

SEQ ID NO: 59531 - DNA, 25 bp, Homo sapien
cttacctgactctttgaaggcatat

SEQ ID NO: 59532 - DNA, 25 bp, Homo sapien
cttacctgcttaggcacctgcgcac

SEQ ID NO: 59533 - DNA, 25 bp, Homo sapien
cttacctggctctttgaaggcatat

SEQ ID NO: 59534 - DNA, 25 bp, Homo sapien
cttacctggttaggcacctgcgcac

SEQ ID NO: 59535 - DNA, 25 bp, Homo sapien
cttacctttgacgtcagaggccaca

SEQ ID NO: 59536 - DNA, 25 bp, Homo sapien
cttacctttgatgtcagaggccaca

SEQ ID NO: 59537 - DNA, 25 bp, Homo sapien
cttacgcctgggataccttttattc

SEQ ID NO: 59538 - DNA, 25 bp, Homo sapien
cttacgccttggataccttttattc

SEQ ID NO: 59539 - DNA, 25 bp, Homo sapien
cttacgtagagattagtgctgatta

SEQ ID NO: 59540 - DNA, 25 bp, Homo sapien
cttacgtagggattagtgctgatta

SEQ ID NO: 59541 - DNA, 25 bp, Homo sapien
cttacgtttatccaaaagcatctca

SEQ ID NO: 59542 - DNA, 25 bp, Homo sapien
cttacgtttattcaaaagcatctca

SEQ ID NO: 59543 - DNA, 25 bp, Homo sapien
cttactaattatacgaagtcctttg

SEQ ID NO: 59544 - DNA, 25 bp, Homo sapien
cttactaattatatgaagtcctttg

SEQ ID NO: 59545 - DNA, 25 bp, Homo sapien
cttactacaatgtaaatgactggcc

SEQ ID NO: 59546 - DNA, 25 bp, Homo sapien
cttactacagtgtaaatgactggcc

SEQ ID NO: 59547 - DNA, 25 bp, Homo sapien
cttactcttcctcgagtcagtgcag

SEQ ID NO: 59548 - DNA, 25 bp, Homo sapien
cttactcttccttgagtcagtgcag

SEQ ID NO: 59549 - DNA, 25 bp, Homo sapien
cttactctttcattttactgaaatg

SEQ ID NO: 59550 - DNA, 25 bp, Homo sapien
cttactctttccttttactgaaatg

SEQ ID NO: 59551 - DNA, 25 bp, Homo sapien
cttactgcaaagcattcaagagctg

SEQ ID NO: 59552 - DNA, 25 bp, Homo sapien
cttactgcaaagcgttcaagagctg

SEQ ID NO: 59553 - DNA, 25 bp, Homo sapien
cttactggttatataatcatagaca

SEQ ID NO: 59554 - DNA, 25 bp, Homo sapien
cttactggttatgtaatcatagaca

SEQ ID NO: 59555 - DNA, 25 bp, Homo sapien
cttactggttttcaggacagtgtcc

SEQ ID NO: 59556 - DNA, 25 bp, Homo sapien
cttactggttttcgggacagtgtcc

SEQ ID NO: 59557 - DNA, 25 bp, Homo sapien
cttactgtgtctctttcagctttaa

SEQ ID NO: 59558 - DNA, 25 bp, Homo sapien
cttactgtgtctttttcagctttaa

SEQ ID NO: 59559 - DNA, 25 bp, Homo sapien
cttacttacggcacagaattaaatg

SEQ ID NO: 59560 - DNA, 25 bp, Homo sapien
cttacttatggcacagaattaaatg

SEQ ID NO: 59561 - DNA, 25 bp, Homo sapien
cttacttcactgagttgatataaaa

SEQ ID NO: 59562 - DNA, 25 bp, Homo sapien
cttacttcatcttcgtgtttcagct

SEQ ID NO: 59563 - DNA, 25 bp, Homo sapien
cttacttcatcttcgtttttcagct

SEQ ID NO: 59564 - DNA, 25 bp, Homo sapien
cttacttcattgagttgatataaaa

SEQ ID NO: 59565 - DNA, 25 bp, Homo sapien
cttactttctccaaaatatacagtc

SEQ ID NO: 59566 - DNA, 25 bp, Homo sapien
cttactttctccagaatatacagtc

SEQ ID NO: 59567 - DNA, 25 bp, Homo sapien
cttagaaaagactcttcaaaagata

SEQ ID NO: 59568 - DNA, 25 bp, Homo sapien
cttagaaaaggatttgtgatctgtg

SEQ ID NO: 59569 - DNA, 25 bp, Homo sapien
cttagaaaaggctttgtgatctgtg

SEQ ID NO: 59570 - DNA, 25 bp, Homo sapien
cttagaaaatactcttcaaaagata

SEQ ID NO: 59571 - DNA, 25 bp, Homo sapien
cttagaaacgtcagaattgcacatt

SEQ ID NO: 59572 - DNA, 25 bp, Homo sapien
cttagaaatgtcagaattgcacatt

SEQ ID NO: 59573 - DNA, 25 bp, Homo sapien
cttagaacagactagaaaatgtatt

SEQ ID NO: 59574 - DNA, 25 bp, Homo sapien
cttagaaccataataatgcttcgcc

SEQ ID NO: 59575 - DNA, 25 bp, Homo sapien
cttagaaccgtaataatgcttcgcc

SEQ ID NO: 59576 - DNA, 25 bp, Homo sapien
cttagaacggactagaaaatgtatt

SEQ ID NO: 59577 - DNA, 25 bp, Homo sapien
cttagaacttcaacttttgaatctg

SEQ ID NO: 59578 - DNA, 25 bp, Homo sapien
cttagaacttcaatttttgaatctg

SEQ ID NO: 59579 - DNA, 25 bp, Homo sapien
cttagaagcgtaaggtttatccata

SEQ ID NO: 59580 - DNA, 25 bp, Homo sapien
cttagaagcgttgttttttctacca

SEQ ID NO: 59581 - DNA, 25 bp, Homo sapien
cttagaagcttaaggtttatccata

SEQ ID NO: 59582 - DNA, 25 bp, Homo sapien
cttagaagggttaatgttttgtatt

SEQ ID NO: 59583 - DNA, 25 bp, Homo sapien
cttagaagggttattgttttgtatt

SEQ ID NO: 59584 - DNA, 25 bp, Homo sapien
cttagaagggttgttttttctacca

SEQ ID NO: 59585 - DNA, 25 bp, Homo sapien
cttagaatgatgtcacattgtccaa

SEQ ID NO: 59586 - DNA, 25 bp, Homo sapien
cttagaatgctgtcacattgtccaa

SEQ ID NO: 59587 - DNA, 25 bp, Homo sapien
cttagaattactacaatctataacg

SEQ ID NO: 59588 - DNA, 25 bp, Homo sapien
cttagaattactataatctataacg

SEQ ID NO: 59589 - DNA, 25 bp, Homo sapien
cttagaattttgaagacacacaggc

SEQ ID NO: 59590 - DNA, 25 bp, Homo sapien
cttagaattttgaagagacacaggc

SEQ ID NO: 59591 - DNA, 25 bp, Homo sapien
cttagacaataggagacttttttac

SEQ ID NO: 59592 - DNA, 25 bp, Homo sapien
cttagacaataggatacttttttac

SEQ ID NO: 59593 - DNA, 25 bp, Homo sapien
cttagaccagatttcacggcaatcc

SEQ ID NO: 59594 - DNA, 25 bp, Homo sapien
cttagaccagatttcatggcaatcc

SEQ ID NO: 59595 - DNA, 25 bp, Homo sapien
cttagactgagtaaaagtattgctg

SEQ ID NO: 59596 - DNA, 25 bp, Homo sapien
cttagactgagtgaaagtattgctg

SEQ ID NO: 59597 - DNA, 25 bp, Homo sapien
cttagagaactaaagtaacttgttt

SEQ ID NO: 59598 - DNA, 25 bp, Homo sapien
cttagagaagcgagtcttttttgaa

SEQ ID NO: 59599 - DNA, 25 bp, Homo sapien
cttagagaagctagtcttttttgaa

SEQ ID NO: 59600 - DNA, 25 bp, Homo sapien
cttagagagctaaagtaacttgttt

SEQ ID NO: 59601 - DNA, 25 bp, Homo sapien
cttagagatagtatcccaggtgact

SEQ ID NO: 59602 - DNA, 25 bp, Homo sapien
cttagagatggtatcccaggtgact

SEQ ID NO: 59603 - DNA, 25 bp, Homo sapien
cttagagtcattgttggagagcagg

SEQ ID NO: 59604 - DNA, 25 bp, Homo sapien
cttagagtcattgttgtagagcagg

SEQ ID NO: 59605 - DNA, 25 bp, Homo sapien
cttagcaaaatatgagataagtgtc

SEQ ID NO: 59606 - DNA, 25 bp, Homo sapien
cttagcaaaatattagataagtgtc

SEQ ID NO: 59607 - DNA, 25 bp, Homo sapien
cttagcaatccaaacagaaaaggga

SEQ ID NO: 59608 - DNA, 25 bp, Homo sapien
cttagcaatccaaagagaaaaggga

SEQ ID NO: 59609 - DNA, 25 bp, Homo sapien
cttagcaatctgcagtttcacccct

SEQ ID NO: 59610 - DNA, 25 bp, Homo sapien
cttagcaatctgctactgatatagt

SEQ ID NO: 59611 - DNA, 25 bp, Homo sapien
cttagcaatctgtagtttcacccct

SEQ ID NO: 59612 - DNA, 25 bp, Homo sapien
cttagcaatctgttactgatatagt

SEQ ID NO: 59613 - DNA, 25 bp, Homo sapien
cttagcaatgcacattaaagttcaa

SEQ ID NO: 59614 - DNA, 25 bp, Homo sapien
cttagcaatgcatattaaagttcaa

SEQ ID NO: 59615 - DNA, 25 bp, Homo sapien
cttagcacctgtttatgtaaataat

SEQ ID NO: 59616 - DNA, 25 bp, Homo sapien
cttagcacctgtttttgtaaataat

SEQ ID NO: 59617 - DNA, 25 bp, Homo sapien
cttagcactaggcttgctgctgctg

SEQ ID NO: 59618 - DNA, 25 bp, Homo sapien
cttagcactaggcttgttgctgctg

SEQ ID NO: 59619 - DNA, 25 bp, Homo sapien
cttagcagagacgaaataccaaaac

SEQ ID NO: 59620 - DNA, 25 bp, Homo sapien
cttagcagagatgaaataccaaaac

SEQ ID NO: 59621 - DNA, 25 bp, Homo sapien
cttagcataataattggcatttgtt

SEQ ID NO: 59622 - DNA, 25 bp, Homo sapien
cttagcatagtaattggcatttgtt

SEQ ID NO: 59623 - DNA, 25 bp, Homo sapien
cttagcatatgactgtctctattat

SEQ ID NO: 59624 - DNA, 25 bp, Homo sapien
cttagcatatgattgtctctattat

SEQ ID NO: 59625 - DNA, 25 bp, Homo sapien
cttagcatattaatcacagttgttt

SEQ ID NO: 59626 - DNA, 25 bp, Homo sapien
cttagcatattaatcatagttgttt

SEQ ID NO: 59627 - DNA, 25 bp, Homo sapien
cttagcatcacactctgcatgcagt

SEQ ID NO: 59628 - DNA, 25 bp, Homo sapien
cttagcatcacgctctgcatgcagt

SEQ ID NO: 59629 - DNA, 25 bp, Homo sapien
cttagccaaagtgtctcacatctaa

SEQ ID NO: 59630 - DNA, 25 bp, Homo sapien
cttagccaaagtgtcttacatctaa

SEQ ID NO: 59631 - DNA, 25 bp, Homo sapien
cttagccagtattatttcaaatatt

SEQ ID NO: 59632 - DNA, 25 bp, Homo sapien
cttagccattattatttcaaatatt

SEQ ID NO: 59633 - DNA, 25 bp, Homo sapien
cttagcctgatgacctacttaatgt

SEQ ID NO: 59634 - DNA, 25 bp, Homo sapien
cttagcctgatgacttacttaatgt

SEQ ID NO: 59635 - DNA, 25 bp, Homo sapien
cttagcctttttgcgttctgaagta

SEQ ID NO: 59636 - DNA, 25 bp, Homo sapien
cttagcctttttgggttctgaagta

SEQ ID NO: 59637 - DNA, 25 bp, Homo sapien
cttagctctggtccctctcgatgct

SEQ ID NO: 59638 - DNA, 25 bp, Homo sapien
cttagctctgtcctgcctaggcgac

SEQ ID NO: 59639 - DNA, 25 bp, Homo sapien
cttagctctgtcttgcctaggcgac

SEQ ID NO: 59640 - DNA, 25 bp, Homo sapien
cttagctcttgtccctctcgatgct

SEQ ID NO: 59641 - DNA, 25 bp, Homo sapien
cttagctgcttggaaagtcagtcac

SEQ ID NO: 59642 - DNA, 25 bp, Homo sapien
cttagctgcttgggaagtcagtcac

SEQ ID NO: 59643 - DNA, 25 bp, Homo sapien
cttagcttcataatgcaatgtttta

SEQ ID NO: 59644 - DNA, 25 bp, Homo sapien
cttagcttcgtaatgcaatgtttta

SEQ ID NO: 59645 - DNA, 25 bp, Homo sapien
cttaggaaaagccattcacatcaag

SEQ ID NO: 59646 - DNA, 25 bp, Homo sapien
cttaggaaaagccgttcacatcaag

SEQ ID NO: 59647 - DNA, 25 bp, Homo sapien
cttaggaaactgaatctatcctgtg

SEQ ID NO: 59648 - DNA, 25 bp, Homo sapien
cttaggaaactgcatagattaatgc

SEQ ID NO: 59649 - DNA, 25 bp, Homo sapien
cttaggaaactggatagattaatgc

SEQ ID NO: 59650 - DNA, 25 bp, Homo sapien
cttaggaaacttaatctatcctgtg

SEQ ID NO: 59651 - DNA, 25 bp, Homo sapien
cttaggaacatattttatgagaaac

SEQ ID NO: 59652 - DNA, 25 bp, Homo sapien
cttaggaacgtattttatgagaaac

SEQ ID NO: 59653 - DNA, 25 bp, Homo sapien
cttaggagaaaaggcaaatttattg

SEQ ID NO: 59654 - DNA, 25 bp, Homo sapien
cttaggagaaagggcaaatttattg

SEQ ID NO: 59655 - DNA, 25 bp, Homo sapien
cttaggatgcctgcagttgtcaagg

SEQ ID NO: 59656 - DNA, 25 bp, Homo sapien
cttaggatgcctgcggttgtcaagg

SEQ ID NO: 59657 - DNA, 25 bp, Homo sapien
cttaggatgtcatgacacttggtct

SEQ ID NO: 59658 - DNA, 25 bp, Homo sapien
cttaggatgtcatgacccttggtct

SEQ ID NO: 59659 - DNA, 25 bp, Homo sapien
cttaggcacccaagagaaaatcttg

SEQ ID NO: 59660 - DNA, 25 bp, Homo sapien
cttaggcacccaggagaaaatcttg

SEQ ID NO: 59661 - DNA, 25 bp, Homo sapien
cttaggcccatatcctaatttaggt

SEQ ID NO: 59662 - DNA, 25 bp, Homo sapien
cttaggcccgtatcctaatttaggt

SEQ ID NO: 59663 - DNA, 25 bp, Homo sapien
cttagggacttagaatgctttagct

SEQ ID NO: 59664 - DNA, 25 bp, Homo sapien
cttagggatttacgaggattatctc

SEQ ID NO: 59665 - DNA, 25 bp, Homo sapien
cttagggatttagaatgctttagct

SEQ ID NO: 59666 - DNA, 25 bp, Homo sapien
cttagggatttatgaggattatctc

SEQ ID NO: 59667 - DNA, 25 bp, Homo sapien
cttaggggcaaactgattgcatccg

SEQ ID NO: 59668 - DNA, 25 bp, Homo sapien
cttaggggcaaattgattgcatccg

SEQ ID NO: 59669 - DNA, 25 bp, Homo sapien
cttagggtagcacatggcacacagc

SEQ ID NO: 59670 - DNA, 25 bp, Homo sapien
cttagggtagcacgtggcacacagc

SEQ ID NO: 59671 - DNA, 25 bp, Homo sapien
cttaggtaggaaacctgccgggcac

SEQ ID NO: 59672 - DNA, 25 bp, Homo sapien
cttaggtaggaaatctgccgggcac

SEQ ID NO: 59673 - DNA, 25 bp, Homo sapien
cttaggtgacttttcggagaagatt

SEQ ID NO: 59674 - DNA, 25 bp, Homo sapien
cttaggtgactttttggagaagatt

SEQ ID NO: 59675 - DNA, 25 bp, Homo sapien
cttaggtgtagattaaaactgtgca

SEQ ID NO: 59676 - DNA, 25 bp, Homo sapien
cttaggtgtaggttaaaactgtgca

SEQ ID NO: 59677 - DNA, 25 bp, Homo sapien
cttaggtttagttgttcaacatcat

SEQ ID NO: 59678 - DNA, 25 bp, Homo sapien
cttaggtttagttgttgaacatcat

SEQ ID NO: 59679 - DNA, 25 bp, Homo sapien
cttagtaaataaaggtcaatttaag

SEQ ID NO: 59680 - DNA, 25 bp, Homo sapien
cttagtaagtaaaggtcaatttaag

SEQ ID NO: 59681 - DNA, 25 bp, Homo sapien
cttagtatcgttgtctcctatgggt

SEQ ID NO: 59682 - DNA, 25 bp, Homo sapien
cttagtatctttgtctcctatgggt

SEQ ID NO: 59683 - DNA, 25 bp, Homo sapien
cttagtccatgactttcccttgctt

SEQ ID NO: 59684 - DNA, 25 bp, Homo sapien
cttagtccatgattttcccttgctt

SEQ ID NO: 59685 - DNA, 25 bp, Homo sapien
cttagtcccagcatataacaattac

SEQ ID NO: 59686 - DNA, 25 bp, Homo sapien
cttagtcccagcgtataacaattac

SEQ ID NO: 59687 - DNA, 25 bp, Homo sapien
cttagtccctttatgcttctatata

SEQ ID NO: 59688 - DNA, 25 bp, Homo sapien
cttagtccctttgtgcttctatata

SEQ ID NO: 59689 - DNA, 25 bp, Homo sapien
cttagtcgatacatctcttcgtgtg

SEQ ID NO: 59690 - DNA, 25 bp, Homo sapien
cttagtcgatatatctcttcgtgtg

SEQ ID NO: 59691 - DNA, 25 bp, Homo sapien
cttagtcgcccacagtggtcacatg

SEQ ID NO: 59692 - DNA, 25 bp, Homo sapien
cttagtcgcccacggtggtcacatg

SEQ ID NO: 59693 - DNA, 25 bp, Homo sapien
cttagtgacgatttttcttgtgatt

SEQ ID NO: 59694 - DNA, 25 bp, Homo sapien
cttagtgatatatttccacctctgt

SEQ ID NO: 59695 - DNA, 25 bp, Homo sapien
cttagtgatatctttccacctctgt

SEQ ID NO: 59696 - DNA, 25 bp, Homo sapien
cttagtgatgatttttcttgtgatt

SEQ ID NO: 59697 - DNA, 25 bp, Homo sapien
cttagtggatgcttaccaaatgctg

SEQ ID NO: 59698 - DNA, 25 bp, Homo sapien
cttagtggatgcttactaaatgctg

SEQ ID NO: 59699 - DNA, 25 bp, Homo sapien
cttagtgtcctcatctttgagtctg

SEQ ID NO: 59700 - DNA, 25 bp, Homo sapien
cttagtgtcttcatctttgagtctg

SEQ ID NO: 59701 - DNA, 25 bp, Homo sapien
cttagtgtgattagctgtaattagc

SEQ ID NO: 59702 - DNA, 25 bp, Homo sapien
cttagtgtgattagttgtaattagc

SEQ ID NO: 59703 - DNA, 25 bp, Homo sapien
cttagttggacatttccactcagac

SEQ ID NO: 59704 - DNA, 25 bp, Homo sapien
cttagttggacctttccactcagac

SEQ ID NO: 59705 - DNA, 25 bp, Homo sapien
cttagtttagatgaaaagaatcact

SEQ ID NO: 59706 - DNA, 25 bp, Homo sapien
cttagtttagatgaaaggaatcact

SEQ ID NO: 59707 - DNA, 25 bp, Homo sapien
cttagttttttcattttctacagct

SEQ ID NO: 59708 - DNA, 25 bp, Homo sapien
cttagttttttcgttttctacagct

SEQ ID NO: 59709 - DNA, 25 bp, Homo sapien
cttataaaaatgccctggagaaatt

SEQ ID NO: 59710 - DNA, 25 bp, Homo sapien
cttataaaaatgctctggagaaatt

SEQ ID NO: 59711 - DNA, 25 bp, Homo sapien
cttataaaccactgactgcttcccg

SEQ ID NO: 59712 - DNA, 25 bp, Homo sapien
cttataaaccattgactgcttcccg

SEQ ID NO: 59713 - DNA, 25 bp, Homo sapien
cttataacacaactatgtaatataa

SEQ ID NO: 59714 - DNA, 25 bp, Homo sapien
cttataacacaattatgtaatataa

SEQ ID NO: 59715 - DNA, 25 bp, Homo sapien
cttataagagcacagtatttcgtag

SEQ ID NO: 59716 - DNA, 25 bp, Homo sapien
cttataagagcatagtatttcgtag

SEQ ID NO: 59717 - DNA, 25 bp, Homo sapien
cttataaggaaacttgtaattgctt

SEQ ID NO: 59718 - DNA, 25 bp, Homo sapien
cttataaggaaccttgtaattgctt

SEQ ID NO: 59719 - DNA, 25 bp, Homo sapien
cttatacctatcatatagcacagca

SEQ ID NO: 59720 - DNA, 25 bp, Homo sapien
cttatacctgtcatatagcacagca

SEQ ID NO: 59721 - DNA, 25 bp, Homo sapien
cttatacgctactgatagaatgtaa

SEQ ID NO: 59722 - DNA, 25 bp, Homo sapien
cttatacgctactgatggaatgtaa

SEQ ID NO: 59723 - DNA, 25 bp, Homo sapien
cttatactactgcacacctgtgaag

SEQ ID NO: 59724 - DNA, 25 bp, Homo sapien
cttatactactgtacacctgtgaag

SEQ ID NO: 59725 - DNA, 25 bp, Homo sapien
cttatagagcttaacgaaggaatag

SEQ ID NO: 59726 - DNA, 25 bp, Homo sapien
cttatagagcttaatgaaggaatag

SEQ ID NO: 59727 - DNA, 25 bp, Homo sapien
cttatagtatgcaaccttatatcca

SEQ ID NO: 59728 - DNA, 25 bp, Homo sapien
cttatagtatgcagccttatatcca

SEQ ID NO: 59729 - DNA, 25 bp, Homo sapien
cttatagttccaaaggccagaaatc

SEQ ID NO: 59730 - DNA, 25 bp, Homo sapien
cttatagttccgaaggccagaaatc

SEQ ID NO: 59731 - DNA, 25 bp, Homo sapien
cttatatatggacaactgatttgca

SEQ ID NO: 59732 - DNA, 25 bp, Homo sapien
cttatatatggacagctgatttgca

SEQ ID NO: 59733 - DNA, 25 bp, Homo sapien
cttatatcccaatggccagaaatgt

SEQ ID NO: 59734 - DNA, 25 bp, Homo sapien
cttatatcccattggccagaaatgt

SEQ ID NO: 59735 - DNA, 25 bp, Homo sapien
cttatattatcatccgagccataac

SEQ ID NO: 59736 - DNA, 25 bp, Homo sapien
cttatattatcatcggagccataac

SEQ ID NO: 59737 - DNA, 25 bp, Homo sapien
cttatcaaagaagaataaaaaaaca

SEQ ID NO: 59738 - DNA, 25 bp, Homo sapien
cttatcaacacattgattctctaac

SEQ ID NO: 59739 - DNA, 25 bp, Homo sapien
cttatcaacacatttattctctaac

SEQ ID NO: 59740 - DNA, 25 bp, Homo sapien
cttatcaagctccttctatgagtca

SEQ ID NO: 59741 - DNA, 25 bp, Homo sapien
cttatcaaggaagaataaaaaaaca

SEQ ID NO: 59742 - DNA, 25 bp, Homo sapien
cttatcaagttccttctatgagtca

SEQ ID NO: 59743 - DNA, 25 bp, Homo sapien
cttatcaccatgaacgtaatgaatc

SEQ ID NO: 59744 - DNA, 25 bp, Homo sapien
cttatcaccatgaatgtaatgaatc

SEQ ID NO: 59745 - DNA, 25 bp, Homo sapien
cttatcataaatgctagaagactgg

SEQ ID NO: 59746 - DNA, 25 bp, Homo sapien
cttatcatacatgctagaagactgg

SEQ ID NO: 59747 - DNA, 25 bp, Homo sapien
cttatcatatcttactctcccatct

SEQ ID NO: 59748 - DNA, 25 bp, Homo sapien
cttatcatgtcttactctcccatct

SEQ ID NO: 59749 - DNA, 25 bp, Homo sapien
cttatccaaaggacgtgttaggcta

SEQ ID NO: 59750 - DNA, 25 bp, Homo sapien
cttatccaaaggaggtgttaggcta

SEQ ID NO: 59751 - DNA, 25 bp, Homo sapien
cttatccactctgttgctagatcac

SEQ ID NO: 59752 - DNA, 25 bp, Homo sapien
cttatccactctgttgttagatcac

SEQ ID NO: 59753 - DNA, 25 bp, Homo sapien
cttatccagcaacggatgatgtgct

SEQ ID NO: 59754 - DNA, 25 bp, Homo sapien
cttatccagcaagggatgatgtgct

SEQ ID NO: 59755 - DNA, 25 bp, Homo sapien
cttatccttaggagtcagaaatagc

SEQ ID NO: 59756 - DNA, 25 bp, Homo sapien
cttatccttaggagtctgaaatagc

SEQ ID NO: 59757 - DNA, 25 bp, Homo sapien
cttatctaaaggaaagtactgtggg

SEQ ID NO: 59758 - DNA, 25 bp, Homo sapien
cttatctaaagggaagtactgtggg

SEQ ID NO: 59759 - DNA, 25 bp, Homo sapien
cttatctactgacactgttttcaca

SEQ ID NO: 59760 - DNA, 25 bp, Homo sapien
cttatctactgatactgttttcaca

SEQ ID NO: 59761 - DNA, 25 bp, Homo sapien
cttatctgatctatacgtaaccaat

SEQ ID NO: 59762 - DNA, 25 bp, Homo sapien
cttatctgatctgtacgtaaccaat

SEQ ID NO: 59763 - DNA, 25 bp, Homo sapien
cttatctggatcaacacgtgagatt

SEQ ID NO: 59764 - DNA, 25 bp, Homo sapien
cttatctggatcaacatgtgagatt

SEQ ID NO: 59765 - DNA, 25 bp, Homo sapien
cttatgaaaaggcatgtgattacat

SEQ ID NO: 59766 - DNA, 25 bp, Homo sapien
cttatgaaaagtcatgtgattacat

SEQ ID NO: 59767 - DNA, 25 bp, Homo sapien
cttatgaagtgatgcgataacagct

SEQ ID NO: 59768 - DNA, 25 bp, Homo sapien
cttatgaagtgatgtgataacagct

SEQ ID NO: 59769 - DNA, 25 bp, Homo sapien
cttatgactttgggttccttattaa

SEQ ID NO: 59770 - DNA, 25 bp, Homo sapien
cttatgactttgtgttccttattaa

SEQ ID NO: 59771 - DNA, 25 bp, Homo sapien
cttatgagaccactattactctgat

SEQ ID NO: 59772 - DNA, 25 bp, Homo sapien
cttatgaggataactaatacattgg

SEQ ID NO: 59773 - DNA, 25 bp, Homo sapien
cttatgaggatagctaatacattgg

SEQ ID NO: 59774 - DNA, 25 bp, Homo sapien
cttatgaggccactattactctgat

SEQ ID NO: 59775 - DNA, 25 bp, Homo sapien
cttatgatgaggaaagtttgaagcc

SEQ ID NO: 59776 - DNA, 25 bp, Homo sapien
cttatgatgatgcctagagattata

SEQ ID NO: 59777 - DNA, 25 bp, Homo sapien
cttatgatggggaaagtttgaagcc

SEQ ID NO: 59778 - DNA, 25 bp, Homo sapien
cttatgatggtgcctagagattata

SEQ ID NO: 59779 - DNA, 25 bp, Homo sapien
cttatgcaagtaagtcagattttgt

SEQ ID NO: 59780 - DNA, 25 bp, Homo sapien
cttatgcaagtgagtcagattttgt

SEQ ID NO: 59781 - DNA, 25 bp, Homo sapien
cttatgcatcactcatctaaaaggg

SEQ ID NO: 59782 - DNA, 25 bp, Homo sapien
cttatgcatcattcatctaaaaggg

SEQ ID NO: 59783 - DNA, 25 bp, Homo sapien
cttatgctatgcgagccactatgaa

SEQ ID NO: 59784 - DNA, 25 bp, Homo sapien
cttatgctatgggagccactatgaa

SEQ ID NO: 59785 - DNA, 25 bp, Homo sapien
cttatgctcgaattgatttgttctg

SEQ ID NO: 59786 - DNA, 25 bp, Homo sapien
cttatgctcgcatttcagtctcaca

SEQ ID NO: 59787 - DNA, 25 bp, Homo sapien
cttatgctctcatttcagtctcaca

SEQ ID NO: 59788 - DNA, 25 bp, Homo sapien
cttatgcttccataatgcaggaaga

SEQ ID NO: 59789 - DNA, 25 bp, Homo sapien
cttatgcttccataattcaggaaga

SEQ ID NO: 59790 - DNA, 25 bp, Homo sapien
cttatgcttgaattgatttgttctg

SEQ ID NO: 59791 - DNA, 25 bp, Homo sapien
cttatggcaccccattgctgctttc

SEQ ID NO: 59792 - DNA, 25 bp, Homo sapien
cttatggcaccctattgctgctttc

SEQ ID NO: 59793 - DNA, 25 bp, Homo sapien
cttatgggaatctagtcaggactct

SEQ ID NO: 59794 - DNA, 25 bp, Homo sapien
cttatgggaatctattcaggactct

SEQ ID NO: 59795 - DNA, 25 bp, Homo sapien
cttatgggaggaaatgacaggtgac

SEQ ID NO: 59796 - DNA, 25 bp, Homo sapien
cttatgggaggaaatggcaggtgac

SEQ ID NO: 59797 - DNA, 25 bp, Homo sapien
cttatggtgaaagcagatgaaacct

SEQ ID NO: 59798 - DNA, 25 bp, Homo sapien
cttatggtgaaaggagatgaaacct

SEQ ID NO: 59799 - DNA, 25 bp, Homo sapien
cttatgtcaaagcgcagggtcacag

SEQ ID NO: 59800 - DNA, 25 bp, Homo sapien
cttatgtcaaagctcagggtcacag

SEQ ID NO: 59801 - DNA, 25 bp, Homo sapien
cttatgtcacatttctctcactgtt

SEQ ID NO: 59802 - DNA, 25 bp, Homo sapien
cttatgtcagatttctctcactgtt

SEQ ID NO: 59803 - DNA, 25 bp, Homo sapien
cttatgtctcttcctcttttctgat

SEQ ID NO: 59804 - DNA, 25 bp, Homo sapien
cttatgtctcttgctcttttctgat

SEQ ID NO: 59805 - DNA, 25 bp, Homo sapien
cttatgtgtcttcgtctttaacatc

SEQ ID NO: 59806 - DNA, 25 bp, Homo sapien
cttatgtgtctttgtctttaacatc

SEQ ID NO: 59807 - DNA, 25 bp, Homo sapien
cttatgttctgttccactgcggcta

SEQ ID NO: 59808 - DNA, 25 bp, Homo sapien
cttatgttctgttctactgcggcta

SEQ ID NO: 59809 - DNA, 25 bp, Homo sapien
cttatgtttgataagcatatcagac

SEQ ID NO: 59810 - DNA, 25 bp, Homo sapien
cttatgtttgataagcgtatcagac

SEQ ID NO: 59811 - DNA, 25 bp, Homo sapien
cttattaaaacaacgttaggctcca

SEQ ID NO: 59812 - DNA, 25 bp, Homo sapien
cttattaaaacaactttaggctcca

SEQ ID NO: 59813 - DNA, 25 bp, Homo sapien
cttattacaacctggaaattaccac

SEQ ID NO: 59814 - DNA, 25 bp, Homo sapien
cttattaccacctggaaattaccac

SEQ ID NO: 59815 - DNA, 25 bp, Homo sapien
cttattagtacattttccctggaat

SEQ ID NO: 59816 - DNA, 25 bp, Homo sapien
cttattagtacgttttccctggaat

SEQ ID NO: 59817 - DNA, 25 bp, Homo sapien
cttattatcttacagtttcagagac

SEQ ID NO: 59818 - DNA, 25 bp, Homo sapien
cttattatcttatagtttcagagac

SEQ ID NO: 59819 - DNA, 25 bp, Homo sapien
cttattcaaatcagtgagttcaaaa

SEQ ID NO: 59820 - DNA, 25 bp, Homo sapien
cttattcaaatctgtgagttcaaaa

SEQ ID NO: 59821 - DNA, 25 bp, Homo sapien
cttattcagcggcagcccaggtggg

SEQ ID NO: 59822 - DNA, 25 bp, Homo sapien
cttattcagtggcagcccaggtggg

SEQ ID NO: 59823 - DNA, 25 bp, Homo sapien
cttattccatggacatcaggcttgt

SEQ ID NO: 59824 - DNA, 25 bp, Homo sapien
cttattccctatactcttcctctct

SEQ ID NO: 59825 - DNA, 25 bp, Homo sapien
cttattccctatagtcttcctctct

SEQ ID NO: 59826 - DNA, 25 bp, Homo sapien
cttattccgtggacatcaggcttgt

SEQ ID NO: 59827 - DNA, 25 bp, Homo sapien
cttattctagttaaatgtaaaagtt

SEQ ID NO: 59828 - DNA, 25 bp, Homo sapien
cttattctctctaatcctgttttgg

SEQ ID NO: 59829 - DNA, 25 bp, Homo sapien
cttattctcttaacaattttctccc

SEQ ID NO: 59830 - DNA, 25 bp, Homo sapien
cttattctcttaacgattttctccc

SEQ ID NO: 59831 - DNA, 25 bp, Homo sapien
cttattctggttaaatgtaaaagtt

SEQ ID NO: 59832 - DNA, 25 bp, Homo sapien
cttattctgtctaatcctgttttgg

SEQ ID NO: 59833 - DNA, 25 bp, Homo sapien
cttattgactactagctagaaatat

SEQ ID NO: 59834 - DNA, 25 bp, Homo sapien
cttattgactagtagctagaaatat

SEQ ID NO: 59835 - DNA, 25 bp, Homo sapien
cttattgtaaattctaaagagaagg

SEQ ID NO: 59836 - DNA, 25 bp, Homo sapien
cttattgtatccagtctgataggtg

SEQ ID NO: 59837 - DNA, 25 bp, Homo sapien
cttattgtatccattctgataggtg

SEQ ID NO: 59838 - DNA, 25 bp, Homo sapien
cttattgttaattctaaagagaagg

SEQ ID NO: 59839 - DNA, 25 bp, Homo sapien
cttatttacaagcgattagtttgct

SEQ ID NO: 59840 - DNA, 25 bp, Homo sapien
cttatttacaagtgattagtttgct

SEQ ID NO: 59841 - DNA, 25 bp, Homo sapien
cttatttagaaaactcaactatcac

SEQ ID NO: 59842 - DNA, 25 bp, Homo sapien
cttatttagaaaattcaactatcac

SEQ ID NO: 59843 - DNA, 25 bp, Homo sapien
cttatttataagccatataattttg

SEQ ID NO: 59844 - DNA, 25 bp, Homo sapien
cttatttataagtcatataattttg

SEQ ID NO: 59845 - DNA, 25 bp, Homo sapien
cttatttattctcgtggatggtcta

SEQ ID NO: 59846 - DNA, 25 bp, Homo sapien
cttatttattcttgtggatggtcta

SEQ ID NO: 59847 - DNA, 25 bp, Homo sapien
cttatttcacactgtatacaagatt

SEQ ID NO: 59848 - DNA, 25 bp, Homo sapien
cttatttcagaaaggtgaagatgaa

SEQ ID NO: 59849 - DNA, 25 bp, Homo sapien
cttatttcagaaagttgaagatgaa

SEQ ID NO: 59850 - DNA, 25 bp, Homo sapien
cttatttcatactgtatacaagatt

SEQ ID NO: 59851 - DNA, 25 bp, Homo sapien
cttatttccttcctacatatttgac

SEQ ID NO: 59852 - DNA, 25 bp, Homo sapien
cttatttccttcctacgtatttgac

SEQ ID NO: 59853 - DNA, 25 bp, Homo sapien
cttatttccttctcaccacagagaa

SEQ ID NO: 59854 - DNA, 25 bp, Homo sapien
cttatttccttctcactacagagaa

SEQ ID NO: 59855 - DNA, 25 bp, Homo sapien
cttatttgaatgttctctccctttt

SEQ ID NO: 59856 - DNA, 25 bp, Homo sapien
cttatttgagtgttctctccctttt

SEQ ID NO: 59857 - DNA, 25 bp, Homo sapien
cttatttggagcagtgattgatgaa

SEQ ID NO: 59858 - DNA, 25 bp, Homo sapien
cttatttggagtagtgattgatgaa

SEQ ID NO: 59859 - DNA, 25 bp, Homo sapien
cttattttctaacgtcataatcaga

SEQ ID NO: 59860 - DNA, 25 bp, Homo sapien
cttattttgaagacttctttttaat

SEQ ID NO: 59861 - DNA, 25 bp, Homo sapien
cttattttgaagacttgtttttaat

SEQ ID NO: 59862 - DNA, 25 bp, Homo sapien
cttattttgtaacgtcataatcaga

SEQ ID NO: 59863 - DNA, 25 bp, Homo sapien
cttcaaaacacttgcgtcaggacaa

SEQ ID NO: 59864 - DNA, 25 bp, Homo sapien
cttcaaaacacttgtgtcaggacaa

SEQ ID NO: 59865 - DNA, 25 bp, Homo sapien
cttcaaaacatctgcattaagttat

SEQ ID NO: 59866 - DNA, 25 bp, Homo sapien
cttcaaaacctatttcaaaacctac

SEQ ID NO: 59867 - DNA, 25 bp, Homo sapien
cttcaaaacgtctgcattaagttat

SEQ ID NO: 59868 - DNA, 25 bp, Homo sapien
cttcaaaacttatttcaaaacctac

SEQ ID NO: 59869 - DNA, 25 bp, Homo sapien
cttcaaaaggacaaaattataagca

SEQ ID NO: 59870 - DNA, 25 bp, Homo sapien
cttcaaaaggataaaattataagca

SEQ ID NO: 59871 - DNA, 25 bp, Homo sapien
cttcaaaaggctccatggaccctaa

SEQ ID NO: 59872 - DNA, 25 bp, Homo sapien
cttcaaaaggcttcatggaccctaa

SEQ ID NO: 59873 - DNA, 25 bp, Homo sapien
cttcaaacaattcctttaaactatg

SEQ ID NO: 59874 - DNA, 25 bp, Homo sapien
cttcaaaccaaaagcttaatcttca

SEQ ID NO: 59875 - DNA, 25 bp, Homo sapien
cttcaaaccattcctttaaactatg

SEQ ID NO: 59876 - DNA, 25 bp, Homo sapien
cttcaaaccgaaagcttaatcttca

SEQ ID NO: 59877 - DNA, 25 bp, Homo sapien
cttcaaagatggcatagctgataga

SEQ ID NO: 59878 - DNA, 25 bp, Homo sapien
cttcaaagatggcgtagctgataga

SEQ ID NO: 59879 - DNA, 25 bp, Homo sapien
cttcaaatacgttgtcatctcccct

SEQ ID NO: 59880 - DNA, 25 bp, Homo sapien
cttcaaatatgttgtcatctcccct

SEQ ID NO: 59881 - DNA, 25 bp, Homo sapien
cttcaacctcactcttcacatgaag

SEQ ID NO: 59882 - DNA, 25 bp, Homo sapien
cttcaacctcactctttacatgaag

SEQ ID NO: 59883 - DNA, 25 bp, Homo sapien
cttcaacgacttaaaatcatctgca

SEQ ID NO: 59884 - DNA, 25 bp, Homo sapien
cttcaacgacttacaatcatctgca

SEQ ID NO: 59885 - DNA, 25 bp, Homo sapien
cttcaactgtaaccttttaagagac

SEQ ID NO: 59886 - DNA, 25 bp, Homo sapien
cttcaactgtaatcttttaagagac

SEQ ID NO: 59887 - DNA, 25 bp, Homo sapien
cttcaagacacagtcatcatcaatg

SEQ ID NO: 59888 - DNA, 25 bp, Homo sapien
cttcaagacacggtcatcatcaatg

SEQ ID NO: 59889 - DNA, 25 bp, Homo sapien
cttcaagacaggacaaactcacttt

SEQ ID NO: 59890 - DNA, 25 bp, Homo sapien
cttcaagagaggacaaactcacttt

SEQ ID NO: 59891 - DNA, 25 bp, Homo sapien
cttcaagagttcacacaagtattaa

SEQ ID NO: 59892 - DNA, 25 bp, Homo sapien
cttcaagagttcacgcaagtattaa

SEQ ID NO: 59893 - DNA, 25 bp, Homo sapien
cttcaaggataacatccctttgctg

SEQ ID NO: 59894 - DNA, 25 bp, Homo sapien
cttcaaggatagcatccctttgctg

SEQ ID NO: 59895 - DNA, 25 bp, Homo sapien
cttcaagtaaggtcactccagaaag

SEQ ID NO: 59896 - DNA, 25 bp, Homo sapien
cttcaagtaaggtgactccagaaag

SEQ ID NO: 59897 - DNA, 25 bp, Homo sapien
cttcaagtagcactggtgcagtctt

SEQ ID NO: 59898 - DNA, 25 bp, Homo sapien
cttcaagtcgcactggtgcagtctt

SEQ ID NO: 59899 - DNA, 25 bp, Homo sapien
cttcaataaactatcctgatgggct

SEQ ID NO: 59900 - DNA, 25 bp, Homo sapien
cttcaataacctatcctgatgggct

SEQ ID NO: 59901 - DNA, 25 bp, Homo sapien
cttcaatggattccaggctgcactt

SEQ ID NO: 59902 - DNA, 25 bp, Homo sapien
cttcaatgtattccaggctgcactt

SEQ ID NO: 59903 - DNA, 25 bp, Homo sapien
cttcaattataacccaacctactaa

SEQ ID NO: 59904 - DNA, 25 bp, Homo sapien
cttcaattataactcaacctactaa

SEQ ID NO: 59905 - DNA, 25 bp, Homo sapien
cttcaattcgacggttagttattca

SEQ ID NO: 59906 - DNA, 25 bp, Homo sapien
cttcaattcgatggttagttattca

SEQ ID NO: 59907 - DNA, 25 bp, Homo sapien
cttcaatttccatatgaagatgctg

SEQ ID NO: 59908 - DNA, 25 bp, Homo sapien
cttcaatttccttatgaagatgctg

SEQ ID NO: 59909 - DNA, 25 bp, Homo sapien
cttcacaaacgtggggtagagccat

SEQ ID NO: 59910 - DNA, 25 bp, Homo sapien
cttcacaaatgtggggtagagccat

SEQ ID NO: 59911 - DNA, 25 bp, Homo sapien
cttcacaataacatcggtatgacac

SEQ ID NO: 59912 - DNA, 25 bp, Homo sapien
cttcacaataacattggtatgacac

SEQ ID NO: 59913 - DNA, 25 bp, Homo sapien
cttcacaccttacacaccttataca

SEQ ID NO: 59914 - DNA, 25 bp, Homo sapien
cttcacaccttatacaccttataca

SEQ ID NO: 59915 - DNA, 25 bp, Homo sapien
cttcacactcccacgtccattcagc

SEQ ID NO: 59916 - DNA, 25 bp, Homo sapien
cttcacactcccacttccattcagc

SEQ ID NO: 59917 - DNA, 25 bp, Homo sapien
cttcacagttatttttcaagtactt

SEQ ID NO: 59918 - DNA, 25 bp, Homo sapien
cttcacagttattttttaagtactt

SEQ ID NO: 59919 - DNA, 25 bp, Homo sapien
cttcacatttttcacatttgatttt

SEQ ID NO: 59920 - DNA, 25 bp, Homo sapien
cttcacatttttcagatttgatttt

SEQ ID NO: 59921 - DNA, 25 bp, Homo sapien
cttcaccacatcttgacaacattat

SEQ ID NO: 59922 - DNA, 25 bp, Homo sapien
cttcaccatatcttgacaacattat

SEQ ID NO: 59923 - DNA, 25 bp, Homo sapien
cttcaccccatgaaaaattggcacc

SEQ ID NO: 59924 - DNA, 25 bp, Homo sapien
cttcaccccatgaaaagttggcacc

SEQ ID NO: 59925 - DNA, 25 bp, Homo sapien
cttcaccctaaccttttattcaagc

SEQ ID NO: 59926 - DNA, 25 bp, Homo sapien
cttcaccctaacgttttattcaagc

SEQ ID NO: 59927 - DNA, 25 bp, Homo sapien
cttcaccgtggacccttcatgttaa

SEQ ID NO: 59928 - DNA, 25 bp, Homo sapien
cttcaccgtggacctttcatgttaa

SEQ ID NO: 59929 - DNA, 25 bp, Homo sapien
cttcacgtataggtttcatcagtca

SEQ ID NO: 59930 - DNA, 25 bp, Homo sapien
cttcacgtatatgtttcatcagtca

SEQ ID NO: 59931 - DNA, 25 bp, Homo sapien
cttcactaccactctcctgatcttt

SEQ ID NO: 59932 - DNA, 25 bp, Homo sapien
cttcactaccactctcttgatcttt

SEQ ID NO: 59933 - DNA, 25 bp, Homo sapien
cttcactcaacagtagtttttgttt

SEQ ID NO: 59934 - DNA, 25 bp, Homo sapien
cttcactcaacattagtttttgttt

SEQ ID NO: 59935 - DNA, 25 bp, Homo sapien
cttcactcagataatcatagtgccc

SEQ ID NO: 59936 - DNA, 25 bp, Homo sapien
cttcactcagatagtcatagtgccc

SEQ ID NO: 59937 - DNA, 25 bp, Homo sapien
cttcactgtaatgcatttatcacaa

SEQ ID NO: 59938 - DNA, 25 bp, Homo sapien
cttcactgtaatgcgtttatcacaa

SEQ ID NO: 59939 - DNA, 25 bp, Homo sapien
cttcactgtgcatatgtgagaggat

SEQ ID NO: 59940 - DNA, 25 bp, Homo sapien
cttcactgtgcgtatgtgagaggat

SEQ ID NO: 59941 - DNA, 25 bp, Homo sapien
cttcacttgttcagcaatttcctag

SEQ ID NO: 59942 - DNA, 25 bp, Homo sapien
cttcacttgttcagcactttcctag

SEQ ID NO: 59943 - DNA, 25 bp, Homo sapien
cttcactttccatagaactctagct

SEQ ID NO: 59944 - DNA, 25 bp, Homo sapien
cttcactttccgtagaactctagct

SEQ ID NO: 59945 - DNA, 25 bp, Homo sapien
cttcacttttgcagaataatttcgc

SEQ ID NO: 59946 - DNA, 25 bp, Homo sapien
cttcacttttgcggaataatttcgc

SEQ ID NO: 59947 - DNA, 25 bp, Homo sapien
cttcagaaacacagcgagtggccct

SEQ ID NO: 59948 - DNA, 25 bp, Homo sapien
cttcagaaacacagtgagtggccct

SEQ ID NO: 59949 - DNA, 25 bp, Homo sapien
cttcagaaaggacccaatgtctctt

SEQ ID NO: 59950 - DNA, 25 bp, Homo sapien
cttcagaaaggatccaatgtctctt

SEQ ID NO: 59951 - DNA, 25 bp, Homo sapien
cttcagaagtaagtttctatgttag

SEQ ID NO: 59952 - DNA, 25 bp, Homo sapien
cttcagaagtatgtttctatgttag

SEQ ID NO: 59953 - DNA, 25 bp, Homo sapien
cttcagatcctcctcactggctgtt

SEQ ID NO: 59954 - DNA, 25 bp, Homo sapien
cttcagatcctcgagtgctaacatt

SEQ ID NO: 59955 - DNA, 25 bp, Homo sapien
cttcagatcctcttcactggctgtt

SEQ ID NO: 59956 - DNA, 25 bp, Homo sapien
cttcagatccttgagtgctaacatt

SEQ ID NO: 59957 - DNA, 25 bp, Homo sapien
cttcagatgctccaatttgggaagc

SEQ ID NO: 59958 - DNA, 25 bp, Homo sapien
cttcagatgctccgatttgggaagc

SEQ ID NO: 59959 - DNA, 25 bp, Homo sapien
cttcagattaacttgaaaaccactc

SEQ ID NO: 59960 - DNA, 25 bp, Homo sapien
cttcagattaagttgaaaaccactc

SEQ ID NO: 59961 - DNA, 25 bp, Homo sapien
cttcagcctggcatgagttaagttc

SEQ ID NO: 59962 - DNA, 25 bp, Homo sapien
cttcagcctgggatgagttaagttc

SEQ ID NO: 59963 - DNA, 25 bp, Homo sapien
cttcagcggcgttcagttctctcag

SEQ ID NO: 59964 - DNA, 25 bp, Homo sapien
cttcagcggtgttcagttctctcag

SEQ ID NO: 59965 - DNA, 25 bp, Homo sapien
cttcagctcccagttcctgagtttg

SEQ ID NO: 59966 - DNA, 25 bp, Homo sapien
cttcagctgggacagttgtcactat

SEQ ID NO: 59967 - DNA, 25 bp, Homo sapien
cttcagctgggacggttgtcactat

SEQ ID NO: 59968 - DNA, 25 bp, Homo sapien
cttcagcttccagttcctgagtttg

SEQ ID NO: 59969 - DNA, 25 bp, Homo sapien
cttcagcttccccaatcactgataa

SEQ ID NO: 59970 - DNA, 25 bp, Homo sapien
cttcagcttccccagtcactgataa

SEQ ID NO: 59971 - DNA, 25 bp, Homo sapien
cttcaggacaagcaagacagcaaga

SEQ ID NO: 59972 - DNA, 25 bp, Homo sapien
cttcaggacgagcaagacagcaaga

SEQ ID NO: 59973 - DNA, 25 bp, Homo sapien
cttcaggattcacagttcagctaat

SEQ ID NO: 59974 - DNA, 25 bp, Homo sapien
cttcaggattcatagttcagctaat

SEQ ID NO: 59975 - DNA, 25 bp, Homo sapien
cttcaggcataataggtgcagttca

SEQ ID NO: 59976 - DNA, 25 bp, Homo sapien
cttcaggcattaatcgaaagtttga

SEQ ID NO: 59977 - DNA, 25 bp, Homo sapien
cttcaggcattaattgaaagtttga

SEQ ID NO: 59978 - DNA, 25 bp, Homo sapien
cttcaggcctaataggtgcagttca

SEQ ID NO: 59979 - DNA, 25 bp, Homo sapien
cttcaggcttcacaggccatgcagt

SEQ ID NO: 59980 - DNA, 25 bp, Homo sapien
cttcaggcttcgcaggccatgcagt

SEQ ID NO: 59981 - DNA, 25 bp, Homo sapien
cttcaggttagattgtcactgtgga

SEQ ID NO: 59982 - DNA, 25 bp, Homo sapien
cttcaggttaggttgtcactgtgga

SEQ ID NO: 59983 - DNA, 25 bp, Homo sapien
cttcagtaatgtccttcatagtgaa

SEQ ID NO: 59984 - DNA, 25 bp, Homo sapien
cttcagtaatgtcctttatagtgaa

SEQ ID NO: 59985 - DNA, 25 bp, Homo sapien
cttcagtcagaaactggttccccgc

SEQ ID NO: 59986 - DNA, 25 bp, Homo sapien
cttcagtcagaagctggttccccgc

SEQ ID NO: 59987 - DNA, 25 bp, Homo sapien
cttcagtgatacaagaatcttagag

SEQ ID NO: 59988 - DNA, 25 bp, Homo sapien
cttcagtgatacgagaatcttagag

SEQ ID NO: 59989 - DNA, 25 bp, Homo sapien
cttcagtgccgattttctgactcta

SEQ ID NO: 59990 - DNA, 25 bp, Homo sapien
cttcagtgctgattttctgactcta

SEQ ID NO: 59991 - DNA, 25 bp, Homo sapien
cttcagtgtccaacctctttgctca

SEQ ID NO: 59992 - DNA, 25 bp, Homo sapien
cttcagtgtccaatctctttgctca

SEQ ID NO: 59993 - DNA, 25 bp, Homo sapien
cttcagttcctgcttttgaacaaat

SEQ ID NO: 59994 - DNA, 25 bp, Homo sapien
cttcagttcctgtttttgaacaaat

SEQ ID NO: 59995 - DNA, 25 bp, Homo sapien
cttcagttgcgacctcagccttgga

SEQ ID NO: 59996 - DNA, 25 bp, Homo sapien
cttcagttgggacctcagccttgga

SEQ ID NO: 59997 - DNA, 25 bp, Homo sapien
cttcatacaaaaacgaaactgctat

SEQ ID NO: 59998 - DNA, 25 bp, Homo sapien
cttcatacaaaaccgaaactgctat

SEQ ID NO: 59999 - DNA, 25 bp, Homo sapien
cttcatacaaggcattgaacacaga

SEQ ID NO: 60000 - DNA, 25 bp, Homo sapien
cttcatacaaggccttgaacacaga

SEQ ID NO: 60001 - DNA, 25 bp, Homo sapien
cttcatacagagagtttggatgctt

SEQ ID NO: 60002 - DNA, 25 bp, Homo sapien
cttcatacggagagtttggatgctt

SEQ ID NO: 60003 - DNA, 25 bp, Homo sapien
cttcatactggatcataaaggccaa

SEQ ID NO: 60004 - DNA, 25 bp, Homo sapien
cttcatactggattataaaggccaa

SEQ ID NO: 60005 - DNA, 25 bp, Homo sapien
cttcatagccacgatgtacctcctt

SEQ ID NO: 60006 - DNA, 25 bp, Homo sapien
cttcatagccacgttgtacctcctt

SEQ ID NO: 60007 - DNA, 25 bp, Homo sapien
cttcatagtctcaaatgttcatgag

SEQ ID NO: 60008 - DNA, 25 bp, Homo sapien
cttcatagtctcacatgttcatgag

SEQ ID NO: 60009 - DNA, 25 bp, Homo sapien
cttcatataaacaagtgaggcactt

SEQ ID NO: 60010 - DNA, 25 bp, Homo sapien
cttcatataatagtcagatagttgt

SEQ ID NO: 60011 - DNA, 25 bp, Homo sapien
cttcatataatgaattgcagttccc

SEQ ID NO: 60012 - DNA, 25 bp, Homo sapien
cttcatataatggattgcagttccc

SEQ ID NO: 60013 - DNA, 25 bp, Homo sapien
cttcatatcaacaagtgaggcactt

SEQ ID NO: 60014 - DNA, 25 bp, Homo sapien
cttcatatgatagtcagatagttgt

SEQ ID NO: 60015 - DNA, 25 bp, Homo sapien
cttcatcaacttcattgcacttttc

SEQ ID NO: 60016 - DNA, 25 bp, Homo sapien
cttcatcaacttcatttcacttttc

SEQ ID NO: 60017 - DNA, 25 bp, Homo sapien
cttcatcacaaacaccctagttcaa

SEQ ID NO: 60018 - DNA, 25 bp, Homo sapien
cttcatcacaaacgccctagttcaa

SEQ ID NO: 60019 - DNA, 25 bp, Homo sapien
cttcatcacctacagctccgtggag

SEQ ID NO: 60020 - DNA, 25 bp, Homo sapien
cttcatcacctatagctccgtggag

SEQ ID NO: 60021 - DNA, 25 bp, Homo sapien
cttcatcacgagtagagtttgtttc

SEQ ID NO: 60022 - DNA, 25 bp, Homo sapien
cttcatcacgagtagattttgtttc

SEQ ID NO: 60023 - DNA, 25 bp, Homo sapien
cttcatcactctgacgttggtgcgc

SEQ ID NO: 60024 - DNA, 25 bp, Homo sapien
cttcatcactctgatgttggtgcgc

SEQ ID NO: 60025 - DNA, 25 bp, Homo sapien
cttcatcagagcagtcagtagaaca

SEQ ID NO: 60026 - DNA, 25 bp, Homo sapien
cttcatcagggcagtcagtagaaca

SEQ ID NO: 60027 - DNA, 25 bp, Homo sapien
cttcatcagtgtgcaccttatccca

SEQ ID NO: 60028 - DNA, 25 bp, Homo sapien
cttcatcagtgtgcactttatccca

SEQ ID NO: 60029 - DNA, 25 bp, Homo sapien
cttcatcatgcaccaggtagcgtgc

SEQ ID NO: 60030 - DNA, 25 bp, Homo sapien
cttcatcatgcgccaggtagcgtgc

SEQ ID NO: 60031 - DNA, 25 bp, Homo sapien
cttcatccataaggcatgaggccgg

SEQ ID NO: 60032 - DNA, 25 bp, Homo sapien
cttcatccataatgcatgaggccgg

SEQ ID NO: 60033 - DNA, 25 bp, Homo sapien
cttcatctcatattcacagagacac

SEQ ID NO: 60034 - DNA, 25 bp, Homo sapien
cttcatctccaagaataagtctcat

SEQ ID NO: 60035 - DNA, 25 bp, Homo sapien
cttcatctccaataataagtctcat

SEQ ID NO: 60036 - DNA, 25 bp, Homo sapien
cttcatctctgcagagtcagttaaa

SEQ ID NO: 60037 - DNA, 25 bp, Homo sapien
cttcatctctgccgagtcagttaaa

SEQ ID NO: 60038 - DNA, 25 bp, Homo sapien
cttcatcttatattcacagagacac

SEQ ID NO: 60039 - DNA, 25 bp, Homo sapien
cttcatcttcgtgtttcagcttact

SEQ ID NO: 60040 - DNA, 25 bp, Homo sapien
cttcatcttcgtttttcagcttact

SEQ ID NO: 60041 - DNA, 25 bp, Homo sapien
cttcatctttcaagacacagcgcag

SEQ ID NO: 60042 - DNA, 25 bp, Homo sapien
cttcatctttcaaggcacagcgcag

SEQ ID NO: 60043 - DNA, 25 bp, Homo sapien
cttcatcttttatccaacaaagtat

SEQ ID NO: 60044 - DNA, 25 bp, Homo sapien
cttcatcttttatccatcaaagtat

SEQ ID NO: 60045 - DNA, 25 bp, Homo sapien
cttcatgagaagctattacagaatt

SEQ ID NO: 60046 - DNA, 25 bp, Homo sapien
cttcatgataagctattacagaatt

SEQ ID NO: 60047 - DNA, 25 bp, Homo sapien
cttcatgcagtaatttcacccttgg

SEQ ID NO: 60048 - DNA, 25 bp, Homo sapien
cttcatgcagtactttcacccttgg

SEQ ID NO: 60049 - DNA, 25 bp, Homo sapien
cttcatgcccataaggctgatccat

SEQ ID NO: 60050 - DNA, 25 bp, Homo sapien
cttcatgcctataaggctgatccat

SEQ ID NO: 60051 - DNA, 25 bp, Homo sapien
cttcatggataccaacggacaaggg

SEQ ID NO: 60052 - DNA, 25 bp, Homo sapien
cttcatggatatcaacggacaaggg

SEQ ID NO: 60053 - DNA, 25 bp, Homo sapien
cttcatggcatctggatgcatgcat

SEQ ID NO: 60054 - DNA, 25 bp, Homo sapien
cttcatggtatctggatgcatgcat

SEQ ID NO: 60055 - DNA, 25 bp, Homo sapien
cttcatgtgatgaccgggaaattta

SEQ ID NO: 60056 - DNA, 25 bp, Homo sapien
cttcatgtgatgactgggaaattta

SEQ ID NO: 60057 - DNA, 25 bp, Homo sapien
cttcatgtggcactgttatgctatg

SEQ ID NO: 60058 - DNA, 25 bp, Homo sapien
cttcatgtggcacttttatgctatg

SEQ ID NO: 60059 - DNA, 25 bp, Homo sapien
cttcattgagcaggcacaggggatt

SEQ ID NO: 60060 - DNA, 25 bp, Homo sapien
cttcattgatcaggcacaggggatt

SEQ ID NO: 60061 - DNA, 25 bp, Homo sapien
cttcattgtgtcatcttcattgaaa

SEQ ID NO: 60062 - DNA, 25 bp, Homo sapien
cttcattgtgtcgtcttcattgaaa

SEQ ID NO: 60063 - DNA, 25 bp, Homo sapien
cttcatttaaataaatatctgcaat

SEQ ID NO: 60064 - DNA, 25 bp, Homo sapien
cttcatttaaatagatatctgcaat

SEQ ID NO: 60065 - DNA, 25 bp, Homo sapien
cttcattttacttatgtaaggaatt

SEQ ID NO: 60066 - DNA, 25 bp, Homo sapien
cttcattttacttctgtaaggaatt

SEQ ID NO: 60067 - DNA, 25 bp, Homo sapien
cttccaaagatgaaaacagaattcc

SEQ ID NO: 60068 - DNA, 25 bp, Homo sapien
cttccaaagatgaaaagagaattcc

SEQ ID NO: 60069 - DNA, 25 bp, Homo sapien
cttccaaatgcattagcctcctacc

SEQ ID NO: 60070 - DNA, 25 bp, Homo sapien
cttccaaatgcgttagcctcctacc

SEQ ID NO: 60071 - DNA, 25 bp, Homo sapien
cttccaacaagttacttctaggcat

SEQ ID NO: 60072 - DNA, 25 bp, Homo sapien
cttccaaccaccaccatctgggtga

SEQ ID NO: 60073 - DNA, 25 bp, Homo sapien
cttccaaccaccgccatctgggtga

SEQ ID NO: 60074 - DNA, 25 bp, Homo sapien
cttccaaccagttacttctaggcat

SEQ ID NO: 60075 - DNA, 25 bp, Homo sapien
cttccaactgacctactgatttcca

SEQ ID NO: 60076 - DNA, 25 bp, Homo sapien
cttccaactgacctcctgatttcca

SEQ ID NO: 60077 - DNA, 25 bp, Homo sapien
cttccaagcattctgattttccctg

SEQ ID NO: 60078 - DNA, 25 bp, Homo sapien
cttccaaggttccgtgcaccaaatc

SEQ ID NO: 60079 - DNA, 25 bp, Homo sapien
cttccaaggttctgtgcaccaaatc

SEQ ID NO: 60080 - DNA, 25 bp, Homo sapien
cttccaagtattctgattttccctg

SEQ ID NO: 60081 - DNA, 25 bp, Homo sapien
cttccaagtcctatcttcttttcac

SEQ ID NO: 60082 - DNA, 25 bp, Homo sapien
cttccaagtcctgtcttcttttcac

SEQ ID NO: 60083 - DNA, 25 bp, Homo sapien
cttccaagtggcatatggactagtt

SEQ ID NO: 60084 - DNA, 25 bp, Homo sapien
cttccaagttgcatatggactagtt

SEQ ID NO: 60085 - DNA, 25 bp, Homo sapien
cttccaatagacggctgtgttgtct

SEQ ID NO: 60086 - DNA, 25 bp, Homo sapien
cttccaatagagggctgtgttgtct

SEQ ID NO: 60087 - DNA, 25 bp, Homo sapien
cttccaatcctccaggttctcataa

SEQ ID NO: 60088 - DNA, 25 bp, Homo sapien
cttccaatcctctaggttctcataa

SEQ ID NO: 60089 - DNA, 25 bp, Homo sapien
cttccaattaaaacctcggtggtga

SEQ ID NO: 60090 - DNA, 25 bp, Homo sapien
cttccaattaaaaccttggtggtga

SEQ ID NO: 60091 - DNA, 25 bp, Homo sapien
cttccaatttcaacatttaggactc

SEQ ID NO: 60092 - DNA, 25 bp, Homo sapien
cttccaatttcaagatttaggactc

SEQ ID NO: 60093 - DNA, 25 bp, Homo sapien
cttccacactacatgactggtagac

SEQ ID NO: 60094 - DNA, 25 bp, Homo sapien
cttccacactatatgactggtagac

SEQ ID NO: 60095 - DNA, 25 bp, Homo sapien
cttccacattccgttgatggttgaa

SEQ ID NO: 60096 - DNA, 25 bp, Homo sapien
cttccacattctgttgatggttgaa

SEQ ID NO: 60097 - DNA, 25 bp, Homo sapien
cttccacatttttagaatcacttaa

SEQ ID NO: 60098 - DNA, 25 bp, Homo sapien
cttccacattttttgaatcacttaa

SEQ ID NO: 60099 - DNA, 25 bp, Homo sapien
cttccaccacacagtctgtagcttc

SEQ ID NO: 60100 - DNA, 25 bp, Homo sapien
cttccaccatacagtctgtagcttc

SEQ ID NO: 60101 - DNA, 25 bp, Homo sapien
cttccacctccaacttatatcaacc

SEQ ID NO: 60102 - DNA, 25 bp, Homo sapien
cttccacctccaacttgtatcaacc

SEQ ID NO: 60103 - DNA, 25 bp, Homo sapien
cttccactacaagacactagagctt

SEQ ID NO: 60104 - DNA, 25 bp, Homo sapien
cttccactgcaagacactagagctt

SEQ ID NO: 60105 - DNA, 25 bp, Homo sapien
cttccacttcatgtctatctctatt

SEQ ID NO: 60106 - DNA, 25 bp, Homo sapien
cttccacttcatttctatctctatt

SEQ ID NO: 60107 - DNA, 25 bp, Homo sapien
cttccagaaaacaatcataaagaag

SEQ ID NO: 60108 - DNA, 25 bp, Homo sapien
cttccagaaaacaatcgtaaagaag

SEQ ID NO: 60109 - DNA, 25 bp, Homo sapien
cttccagcatcagactcctatacct

SEQ ID NO: 60110 - DNA, 25 bp, Homo sapien
cttccagcatcagacttctatacct

SEQ ID NO: 60111 - DNA, 25 bp, Homo sapien
cttccagcctttctattgaagtttt

SEQ ID NO: 60112 - DNA, 25 bp, Homo sapien
cttccagcctttttattgaagtttt

SEQ ID NO: 60113 - DNA, 25 bp, Homo sapien
cttccagggcttgcattttttagtt

SEQ ID NO: 60114 - DNA, 25 bp, Homo sapien
cttccagggtttgcattttttagtt

SEQ ID NO: 60115 - DNA, 25 bp, Homo sapien
cttccagtaatgtccaagtaatcaa

SEQ ID NO: 60116 - DNA, 25 bp, Homo sapien
cttccagtaatgtccacgtaatcaa

SEQ ID NO: 60117 - DNA, 25 bp, Homo sapien
cttccatagacactgacgttcagtt

SEQ ID NO: 60118 - DNA, 25 bp, Homo sapien
cttccatagacactgatgttcagtt

SEQ ID NO: 60119 - DNA, 25 bp, Homo sapien
cttccatccatcaacccatttgctg

SEQ ID NO: 60120 - DNA, 25 bp, Homo sapien
cttccatccgtcaacccatttgctg

SEQ ID NO: 60121 - DNA, 25 bp, Homo sapien
cttccatctagtttgaagtacggca

SEQ ID NO: 60122 - DNA, 25 bp, Homo sapien
cttccatctagtttgaggtacggca

SEQ ID NO: 60123 - DNA, 25 bp, Homo sapien
cttccatgctccatgaaataattgc

SEQ ID NO: 60124 - DNA, 25 bp, Homo sapien
cttccatgctccatgacataattgc

SEQ ID NO: 60125 - DNA, 25 bp, Homo sapien
cttccattaattgcgtctcttttct

SEQ ID NO: 60126 - DNA, 25 bp, Homo sapien
cttccattaattgtgtctcttttct

SEQ ID NO: 60127 - DNA, 25 bp, Homo sapien
cttccattagatgacgtgtgatcag

SEQ ID NO: 60128 - DNA, 25 bp, Homo sapien
cttccattagatgatgtgtgatcag

SEQ ID NO: 60129 - DNA, 25 bp, Homo sapien
cttcccaaaaatgcatacaacatga

SEQ ID NO: 60130 - DNA, 25 bp, Homo sapien
cttcccaaaaattcatacaacatga

SEQ ID NO: 60131 - DNA, 25 bp, Homo sapien
cttcccaacaggatcagacctgggg

SEQ ID NO: 60132 - DNA, 25 bp, Homo sapien
cttcccaagtccaaatcagtttctt

SEQ ID NO: 60133 - DNA, 25 bp, Homo sapien
cttcccaagtccgaatcagtttctt

SEQ ID NO: 60134 - DNA, 25 bp, Homo sapien
cttcccaataggatcagacctgggg

SEQ ID NO: 60135 - DNA, 25 bp, Homo sapien
cttcccacgatcagcttcaagaacc

SEQ ID NO: 60136 - DNA, 25 bp, Homo sapien
cttcccacgatcagtttcaagaacc

SEQ ID NO: 60137 - DNA, 25 bp, Homo sapien
cttcccacttctcacttctgcctct

SEQ ID NO: 60138 - DNA, 25 bp, Homo sapien
cttcccacttctcgcttctgcctct

SEQ ID NO: 60139 - DNA, 25 bp, Homo sapien
cttcccagacacgatgtggcaagag

SEQ ID NO: 60140 - DNA, 25 bp, Homo sapien
cttcccagacactatgtggcaagag

SEQ ID NO: 60141 - DNA, 25 bp, Homo sapien
cttcccagttaggagaactatttaa

SEQ ID NO: 60142 - DNA, 25 bp, Homo sapien
cttcccagttatgagaactatttaa

SEQ ID NO: 60143 - DNA, 25 bp, Homo sapien
cttcccatgttataattccctgtct

SEQ ID NO: 60144 - DNA, 25 bp, Homo sapien
cttcccatgttatacttccctgtct

SEQ ID NO: 60145 - DNA, 25 bp, Homo sapien
cttcccattagatcctgacctgcct

SEQ ID NO: 60146 - DNA, 25 bp, Homo sapien
cttcccattagatcttgacctgcct

SEQ ID NO: 60147 - DNA, 25 bp, Homo sapien
cttccccaatcactgataactgctt

SEQ ID NO: 60148 - DNA, 25 bp, Homo sapien
cttccccacagggctaggatgatta

SEQ ID NO: 60149 - DNA, 25 bp, Homo sapien
cttccccacagggttaggatgatta

SEQ ID NO: 60150 - DNA, 25 bp, Homo sapien
cttccccagtcactgataactgctt

SEQ ID NO: 60151 - DNA, 25 bp, Homo sapien
cttccccctccacacgctgagaaag

SEQ ID NO: 60152 - DNA, 25 bp, Homo sapien
cttccccctccacaggctgagaaag

SEQ ID NO: 60153 - DNA, 25 bp, Homo sapien
cttcccctgattaacgagaacactc

SEQ ID NO: 60154 - DNA, 25 bp, Homo sapien
cttcccctgattaaggagaacactc

SEQ ID NO: 60155 - DNA, 25 bp, Homo sapien
cttcccctggagcttgcactttagt

SEQ ID NO: 60156 - DNA, 25 bp, Homo sapien
cttcccctggagcttgtactttagt

SEQ ID NO: 60157 - DNA, 25 bp, Homo sapien
cttccctggatttcaatttggtagg

SEQ ID NO: 60158 - DNA, 25 bp, Homo sapien
cttccctgggtttcaatttggtagg

SEQ ID NO: 60159 - DNA, 25 bp, Homo sapien
cttccctttccaccttcactgactt

SEQ ID NO: 60160 - DNA, 25 bp, Homo sapien
cttccctttccactttcactgactt

SEQ ID NO: 60161 - DNA, 25 bp, Homo sapien
cttccctttttcgtcagattaattc

SEQ ID NO: 60162 - DNA, 25 bp, Homo sapien
cttccctttttcttcagattaattc

SEQ ID NO: 60163 - DNA, 25 bp, Homo sapien
cttccgatcacttacctgtttgttc

SEQ ID NO: 60164 - DNA, 25 bp, Homo sapien
cttccgatcacttatctgtttgttc

SEQ ID NO: 60165 - DNA, 25 bp, Homo sapien
cttccgctcatttccagtgatccac

SEQ ID NO: 60166 - DNA, 25 bp, Homo sapien
cttccgctcattttcagtgatccac

SEQ ID NO: 60167 - DNA, 25 bp, Homo sapien
cttccgttatcaaaactagcaatag

SEQ ID NO: 60168 - DNA, 25 bp, Homo sapien
cttccgttgtcaaaactagcaatag

SEQ ID NO: 60169 - DNA, 25 bp, Homo sapien
cttcctaaatcctgaatctctatgc

SEQ ID NO: 60170 - DNA, 25 bp, Homo sapien
cttcctaaatcctgtatctctatgc

SEQ ID NO: 60171 - DNA, 25 bp, Homo sapien
cttcctacaaggtctggtgacttaa

SEQ ID NO: 60172 - DNA, 25 bp, Homo sapien
cttcctacactacagtttggttcca

SEQ ID NO: 60173 - DNA, 25 bp, Homo sapien
cttcctacactatagtttggttcca

SEQ ID NO: 60174 - DNA, 25 bp, Homo sapien
cttcctacagggtctggtgacttaa

SEQ ID NO: 60175 - DNA, 25 bp, Homo sapien
cttcctaccactatggtccagatcc

SEQ ID NO: 60176 - DNA, 25 bp, Homo sapien
cttcctaccgctatggtccagatcc

SEQ ID NO: 60177 - DNA, 25 bp, Homo sapien
cttcctactgtttgatttgtccttt

SEQ ID NO: 60178 - DNA, 25 bp, Homo sapien
cttcctactgttttatttgtccttt

SEQ ID NO: 60179 - DNA, 25 bp, Homo sapien
cttcctagagacggccggagccagg

SEQ ID NO: 60180 - DNA, 25 bp, Homo sapien
cttcctagagatggccggagccagg

SEQ ID NO: 60181 - DNA, 25 bp, Homo sapien
cttcctagcacagcatttcttcatt

SEQ ID NO: 60182 - DNA, 25 bp, Homo sapien
cttcctagcacagcgtttcttcatt

SEQ ID NO: 60183 - DNA, 25 bp, Homo sapien
cttcctagccaatctcctgttgaag

SEQ ID NO: 60184 - DNA, 25 bp, Homo sapien
cttcctagtcaatctcctgttgaag

SEQ ID NO: 60185 - DNA, 25 bp, Homo sapien
cttcctatacattttcagaaaggca

SEQ ID NO: 60186 - DNA, 25 bp, Homo sapien
cttcctattcattttcagaaaggca

SEQ ID NO: 60187 - DNA, 25 bp, Homo sapien
cttcctcatcaatgagcacacgtcc

SEQ ID NO: 60188 - DNA, 25 bp, Homo sapien
cttcctcatcagtgagcacacgtcc

SEQ ID NO: 60189 - DNA, 25 bp, Homo sapien
cttcctcatgatacaatggcatgcc

SEQ ID NO: 60190 - DNA, 25 bp, Homo sapien
cttcctcatgatagaatggcatgcc

SEQ ID NO: 60191 - DNA, 25 bp, Homo sapien
cttcctccacagtaactgaacacat

SEQ ID NO: 60192 - DNA, 25 bp, Homo sapien
cttcctccgcagtaactgaacacat

SEQ ID NO: 60193 - DNA, 25 bp, Homo sapien
cttcctctgcatcactcttaaccct

SEQ ID NO: 60194 - DNA, 25 bp, Homo sapien
cttcctctgcatcattcttaaccct

SEQ ID NO: 60195 - DNA, 25 bp, Homo sapien
cttcctctttgcacattgtctcata

SEQ ID NO: 60196 - DNA, 25 bp, Homo sapien
cttcctctttgcagattgtctcata

SEQ ID NO: 60197 - DNA, 25 bp, Homo sapien
cttcctgaacgtagccctgctgtgg

SEQ ID NO: 60198 - DNA, 25 bp, Homo sapien
cttcctgaatgtagccctgctgtgg

SEQ ID NO: 60199 - DNA, 25 bp, Homo sapien
cttcctgacttcaggtacaaagcat

SEQ ID NO: 60200 - DNA, 25 bp, Homo sapien
cttcctgacttcaggtgcaaagcat

SEQ ID NO: 60201 - DNA, 25 bp, Homo sapien
cttcctgagcgagtactgggtagcc

SEQ ID NO: 60202 - DNA, 25 bp, Homo sapien
cttcctgagcgattactgggtagcc

SEQ ID NO: 60203 - DNA, 25 bp, Homo sapien
cttcctgcattcaggtgtagtcctg

SEQ ID NO: 60204 - DNA, 25 bp, Homo sapien
cttcctgccatctttttggaatttt

SEQ ID NO: 60205 - DNA, 25 bp, Homo sapien
cttcctgccccctgtagagaaaaga

SEQ ID NO: 60206 - DNA, 25 bp, Homo sapien
cttcctgccccctgtatagaaaaga

SEQ ID NO: 60207 - DNA, 25 bp, Homo sapien
cttcctgccgtctttttggaatttt

SEQ ID NO: 60208 - DNA, 25 bp, Homo sapien
cttcctgcgttcaggtgtagtcctg

SEQ ID NO: 60209 - DNA, 25 bp, Homo sapien
cttcctggcagatgtatcctaaaga

SEQ ID NO: 60210 - DNA, 25 bp, Homo sapien
cttcctggcagatttatcctaaaga

SEQ ID NO: 60211 - DNA, 25 bp, Homo sapien
cttcctgggtgagtagatgccctgc

SEQ ID NO: 60212 - DNA, 25 bp, Homo sapien
cttcctgggtgagtcgatgccctgc

SEQ ID NO: 60213 - DNA, 25 bp, Homo sapien
cttcctgtcagtcaggcagaggacc

SEQ ID NO: 60214 - DNA, 25 bp, Homo sapien
cttcctgttagagccttgatcaact

SEQ ID NO: 60215 - DNA, 25 bp, Homo sapien
cttcctgttagaggcttgatcaact

SEQ ID NO: 60216 - DNA, 25 bp, Homo sapien
cttcctgttagtcaggcagaggacc

SEQ ID NO: 60217 - DNA, 25 bp, Homo sapien
cttcctgttcttccctacacctgct

SEQ ID NO: 60218 - DNA, 25 bp, Homo sapien
cttcctgttcttctctacacctgct

SEQ ID NO: 60219 - DNA, 25 bp, Homo sapien
cttccttagaatagaaggctgttct

SEQ ID NO: 60220 - DNA, 25 bp, Homo sapien
cttccttagaatggaaggctgttct

SEQ ID NO: 60221 - DNA, 25 bp, Homo sapien
cttccttagcacgagagcagactct

SEQ ID NO: 60222 - DNA, 25 bp, Homo sapien
cttccttagcatgagagcagactct

SEQ ID NO: 60223 - DNA, 25 bp, Homo sapien
cttccttaggaaactgcatagatta

SEQ ID NO: 60224 - DNA, 25 bp, Homo sapien
cttccttaggaaactggatagatta

SEQ ID NO: 60225 - DNA, 25 bp, Homo sapien
cttccttcaaagactgcagtgtact

SEQ ID NO: 60226 - DNA, 25 bp, Homo sapien
cttccttcagttcctgcttttgaac

SEQ ID NO: 60227 - DNA, 25 bp, Homo sapien
cttccttcagttcctgtttttgaac

SEQ ID NO: 60228 - DNA, 25 bp, Homo sapien
cttccttcataatagactcagtaat

SEQ ID NO: 60229 - DNA, 25 bp, Homo sapien
cttccttccaagactgcagtgtact

SEQ ID NO: 60230 - DNA, 25 bp, Homo sapien
cttccttcgtaatagactcagtaat

SEQ ID NO: 60231 - DNA, 25 bp, Homo sapien
cttccttcgtcctacagtcccaagg

SEQ ID NO: 60232 - DNA, 25 bp, Homo sapien
cttccttcgtcctgcagtcccaagg

SEQ ID NO: 60233 - DNA, 25 bp, Homo sapien
cttccttctgtgttactgattggga

SEQ ID NO: 60234 - DNA, 25 bp, Homo sapien
cttccttctgtgttcctgattggga

SEQ ID NO: 60235 - DNA, 25 bp, Homo sapien
cttcctttccttaacgtaccaaaag

SEQ ID NO: 60236 - DNA, 25 bp, Homo sapien
cttcctttctttaacgtaccaaaag

SEQ ID NO: 60237 - DNA, 25 bp, Homo sapien
cttcgagttgtctggtcactttagt

SEQ ID NO: 60238 - DNA, 25 bp, Homo sapien
cttcgagttgtctgttcactttagt

SEQ ID NO: 60239 - DNA, 25 bp, Homo sapien
cttcgatttgatcagactttgaatg

SEQ ID NO: 60240 - DNA, 25 bp, Homo sapien
cttcgatttgatgagactttgaatg

SEQ ID NO: 60241 - DNA, 25 bp, Homo sapien
cttcgcaaagccacagacactgtaa

SEQ ID NO: 60242 - DNA, 25 bp, Homo sapien
cttcgcaaagccacaggcactgtaa

SEQ ID NO: 60243 - DNA, 25 bp, Homo sapien
cttcgtcctacagtcccaaggagga

SEQ ID NO: 60244 - DNA, 25 bp, Homo sapien
cttcgtcctgcagtcccaaggagga

SEQ ID NO: 60245 - DNA, 25 bp, Homo sapien
cttcgtgacgcaacagcaggaagtt

SEQ ID NO: 60246 - DNA, 25 bp, Homo sapien
cttcgtgatgcaacagcaggaagtt

SEQ ID NO: 60247 - DNA, 25 bp, Homo sapien
cttcgtttggaattatcttctagta

SEQ ID NO: 60248 - DNA, 25 bp, Homo sapien
cttcgtttggaattctcttctagta

SEQ ID NO: 60249 - DNA, 25 bp, Homo sapien
cttctaaaattcactgtgatgtaga

SEQ ID NO: 60250 - DNA, 25 bp, Homo sapien
cttctaaaatttactgtgatgtaga

SEQ ID NO: 60251 - DNA, 25 bp, Homo sapien
cttctaaagcatgcatacactcaca

SEQ ID NO: 60252 - DNA, 25 bp, Homo sapien
cttctaaagcatgcgtacactcaca

SEQ ID NO: 60253 - DNA, 25 bp, Homo sapien
cttctaaatatcacttttactgcat

SEQ ID NO: 60254 - DNA, 25 bp, Homo sapien
cttctaaatatcgcttttactgcat

SEQ ID NO: 60255 - DNA, 25 bp, Homo sapien
cttctaacaaaacaaacatatcttc

SEQ ID NO: 60256 - DNA, 25 bp, Homo sapien
cttctaacaaaagaaacatatcttc

SEQ ID NO: 60257 - DNA, 25 bp, Homo sapien
cttctaacactgtggcaaaataggt

SEQ ID NO: 60258 - DNA, 25 bp, Homo sapien
cttctaacactgtggcgaaataggt

SEQ ID NO: 60259 - DNA, 25 bp, Homo sapien
cttctaacttactattcacacatgc

SEQ ID NO: 60260 - DNA, 25 bp, Homo sapien
cttctaacttattattcacacatgc

SEQ ID NO: 60261 - DNA, 25 bp, Homo sapien
cttctaagcaccctggtgattacag

SEQ ID NO: 60262 - DNA, 25 bp, Homo sapien
cttctaaggaccctggtgattacag

SEQ ID NO: 60263 - DNA, 25 bp, Homo sapien
cttctaagtgctgcaaaaacactgg

SEQ ID NO: 60264 - DNA, 25 bp, Homo sapien
cttctaagtgctgcgaaaacactgg

SEQ ID NO: 60265 - DNA, 25 bp, Homo sapien
cttctaattcaatcagatatcctta

SEQ ID NO: 60266 - DNA, 25 bp, Homo sapien
cttctaattcaatcaggtatcctta

SEQ ID NO: 60267 - DNA, 25 bp, Homo sapien
cttctaattggagcctcttaaattg

SEQ ID NO: 60268 - DNA, 25 bp, Homo sapien
cttctaattggagcttcttaaattg

SEQ ID NO: 60269 - DNA, 25 bp, Homo sapien
cttctaatttgcgccaaaatctctg

SEQ ID NO: 60270 - DNA, 25 bp, Homo sapien
cttctaatttgggccaaaatctctg

SEQ ID NO: 60271 - DNA, 25 bp, Homo sapien
cttctacaatattctatgtcatcta

SEQ ID NO: 60272 - DNA, 25 bp, Homo sapien
cttctacaatattttatgtcatcta

SEQ ID NO: 60273 - DNA, 25 bp, Homo sapien
cttctaccacctgtatcattttatt

SEQ ID NO: 60274 - DNA, 25 bp, Homo sapien
cttctaccgcctgtatcattttatt

SEQ ID NO: 60275 - DNA, 25 bp, Homo sapien
cttctacttgcggtcacttatactg

SEQ ID NO: 60276 - DNA, 25 bp, Homo sapien
cttctacttgctgtcacttatactg

SEQ ID NO: 60277 - DNA, 25 bp, Homo sapien
cttctaggtgtgcctgctgagtaga

SEQ ID NO: 60278 - DNA, 25 bp, Homo sapien
cttctaggtgttcctgctgagtaga

SEQ ID NO: 60279 - DNA, 25 bp, Homo sapien
cttctagtagcaaaaacagcagcag

SEQ ID NO: 60280 - DNA, 25 bp, Homo sapien
cttctagtagcaataacagcagcag

SEQ ID NO: 60281 - DNA, 25 bp, Homo sapien
cttctagtgtagaacctgtgaatat

SEQ ID NO: 60282 - DNA, 25 bp, Homo sapien
cttctagtgtagatcctgtgaatat

SEQ ID NO: 60283 - DNA, 25 bp, Homo sapien
cttctatacttgttccctggccagc

SEQ ID NO: 60284 - DNA, 25 bp, Homo sapien
cttctatacttgtttcctggccagc

SEQ ID NO: 60285 - DNA, 25 bp, Homo sapien
cttctatcatctccaccgttattat

SEQ ID NO: 60286 - DNA, 25 bp, Homo sapien
cttctatcatctccactgttattat

SEQ ID NO: 60287 - DNA, 25 bp, Homo sapien
cttctatgaaatccataagcctcca

SEQ ID NO: 60288 - DNA, 25 bp, Homo sapien
cttctatgaaatccgtaagcctcca

SEQ ID NO: 60289 - DNA, 25 bp, Homo sapien
cttctatgcttattggtttataatc

SEQ ID NO: 60290 - DNA, 25 bp, Homo sapien
cttctatgtttattggtttataatc

SEQ ID NO: 60291 - DNA, 25 bp, Homo sapien
cttctattcatttccttttacatct

SEQ ID NO: 60292 - DNA, 25 bp, Homo sapien
cttctattcatttctttttacatct

SEQ ID NO: 60293 - DNA, 25 bp, Homo sapien
cttctattctttcacttaagagatc

SEQ ID NO: 60294 - DNA, 25 bp, Homo sapien
cttctattctttcccttaagagatc

SEQ ID NO: 60295 - DNA, 25 bp, Homo sapien
cttctattttgagccttttttgact

SEQ ID NO: 60296 - DNA, 25 bp, Homo sapien
cttctattttgagcgttttttgact

SEQ ID NO: 60297 - DNA, 25 bp, Homo sapien
cttctcaactacttcaattgcctcc

SEQ ID NO: 60298 - DNA, 25 bp, Homo sapien
cttctcaactacttcagttgcctcc

SEQ ID NO: 60299 - DNA, 25 bp, Homo sapien
cttctcaataccttatctaaatgcc

SEQ ID NO: 60300 - DNA, 25 bp, Homo sapien
cttctcaataccttttctaaatgcc

SEQ ID NO: 60301 - DNA, 25 bp, Homo sapien
cttctcaatttcaagccacctgcca

SEQ ID NO: 60302 - DNA, 25 bp, Homo sapien
cttctcaatttccagccacctgcca

SEQ ID NO: 60303 - DNA, 25 bp, Homo sapien
cttctcaccacagagaactgggcta

SEQ ID NO: 60304 - DNA, 25 bp, Homo sapien
cttctcactacagagaactgggcta

SEQ ID NO: 60305 - DNA, 25 bp, Homo sapien
cttctcagtctggacgtaggagttg

SEQ ID NO: 60306 - DNA, 25 bp, Homo sapien
cttctcagtctggatgtaggagttg

SEQ ID NO: 60307 - DNA, 25 bp, Homo sapien
cttctcatcccaggaaataatcact

SEQ ID NO: 60308 - DNA, 25 bp, Homo sapien
cttctcatctcaggaaataatcact

SEQ ID NO: 60309 - DNA, 25 bp, Homo sapien
cttctcatctgtccaaattgtaatt

SEQ ID NO: 60310 - DNA, 25 bp, Homo sapien
cttctcatctgtccgaattgtaatt

SEQ ID NO: 60311 - DNA, 25 bp, Homo sapien
cttctcattaacatgcaatcatcac

SEQ ID NO: 60312 - DNA, 25 bp, Homo sapien
cttctcattaatatgcaatcatcac

SEQ ID NO: 60313 - DNA, 25 bp, Homo sapien
cttctcattctggcagcgccccctg

SEQ ID NO: 60314 - DNA, 25 bp, Homo sapien
cttctcattctggcagtgccccctg

SEQ ID NO: 60315 - DNA, 25 bp, Homo sapien
cttctccaacaccgtgctctctagc

SEQ ID NO: 60316 - DNA, 25 bp, Homo sapien
cttctccaacactgtgctctctagc

SEQ ID NO: 60317 - DNA, 25 bp, Homo sapien
cttctccagatggaagatgttcttt

SEQ ID NO: 60318 - DNA, 25 bp, Homo sapien
cttctccagatggaagttgttcttt

SEQ ID NO: 60319 - DNA, 25 bp, Homo sapien
cttctccagcacctaaactggtata

SEQ ID NO: 60320 - DNA, 25 bp, Homo sapien
cttctccagcacttaaactggtata

SEQ ID NO: 60321 - DNA, 25 bp, Homo sapien
cttctcccaaggactgagctctgtc

SEQ ID NO: 60322 - DNA, 25 bp, Homo sapien
cttctcccacaaatctgtctttagc

SEQ ID NO: 60323 - DNA, 25 bp, Homo sapien
cttctcccacaagtctgtctttagc

SEQ ID NO: 60324 - DNA, 25 bp, Homo sapien
cttctcccgaggactgagctctgtc

SEQ ID NO: 60325 - DNA, 25 bp, Homo sapien
cttctccttgtctcactgatcttag

SEQ ID NO: 60326 - DNA, 25 bp, Homo sapien
cttctccttgtctcgctgatcttag

SEQ ID NO: 60327 - DNA, 25 bp, Homo sapien
cttctcgcttttctcggacacacca

SEQ ID NO: 60328 - DNA, 25 bp, Homo sapien
cttctcgcttttcttggacacacca

SEQ ID NO: 60329 - DNA, 25 bp, Homo sapien
cttctctaacttattttgttaatag

SEQ ID NO: 60330 - DNA, 25 bp, Homo sapien
cttctctaacttcttttgttaatag

SEQ ID NO: 60331 - DNA, 25 bp, Homo sapien
cttctctatgtgctcaaatgaatct

SEQ ID NO: 60332 - DNA, 25 bp, Homo sapien
cttctctatgttctcaaatgaatct

SEQ ID NO: 60333 - DNA, 25 bp, Homo sapien
cttctctattatttgtcaagtatta

SEQ ID NO: 60334 - DNA, 25 bp, Homo sapien
cttctctattatttgttaagtatta

SEQ ID NO: 60335 - DNA, 25 bp, Homo sapien
cttctctattcagtttatgattcta

SEQ ID NO: 60336 - DNA, 25 bp, Homo sapien
cttctctattcggtttatgattcta

SEQ ID NO: 60337 - DNA, 25 bp, Homo sapien
cttctctccagcagaaatgatcatt

SEQ ID NO: 60338 - DNA, 25 bp, Homo sapien
cttctctcccttgaatcaatgaatg

SEQ ID NO: 60339 - DNA, 25 bp, Homo sapien
cttctctcccttgaatgaatgaatg

SEQ ID NO: 60340 - DNA, 25 bp, Homo sapien
cttctctccggcagaaatgatcatt

SEQ ID NO: 60341 - DNA, 25 bp, Homo sapien
cttctctctcatgtatgaacaaatc

SEQ ID NO: 60342 - DNA, 25 bp, Homo sapien
cttctctctcatgtttgaacaaatc

SEQ ID NO: 60343 - DNA, 25 bp, Homo sapien
cttctctcttgtagacagtccagat

SEQ ID NO: 60344 - DNA, 25 bp, Homo sapien
cttctctcttgtagactgtccagat

SEQ ID NO: 60345 - DNA, 25 bp, Homo sapien
cttctctgagcttagaattgcattt

SEQ ID NO: 60346 - DNA, 25 bp, Homo sapien
cttctctgattctgctcctgattta

SEQ ID NO: 60347 - DNA, 25 bp, Homo sapien
cttctctgggcgagactcatggatt

SEQ ID NO: 60348 - DNA, 25 bp, Homo sapien
cttctctgggcgagtctcatggatt

SEQ ID NO: 60349 - DNA, 25 bp, Homo sapien
cttctctgtaaagcagaactcacaa

SEQ ID NO: 60350 - DNA, 25 bp, Homo sapien
cttctctgtaaagtagaactcacaa

SEQ ID NO: 60351 - DNA, 25 bp, Homo sapien
cttctctgtacttacatgaatttga

SEQ ID NO: 60352 - DNA, 25 bp, Homo sapien
cttctctgtacttatatgaatttga

SEQ ID NO: 60353 - DNA, 25 bp, Homo sapien
cttctctgtgcttagaattgcattt

SEQ ID NO: 60354 - DNA, 25 bp, Homo sapien
cttctctgttcagcatgaagttttt

SEQ ID NO: 60355 - DNA, 25 bp, Homo sapien
cttctctgttcagcgtgaagttttt

SEQ ID NO: 60356 - DNA, 25 bp, Homo sapien
cttctctgtttctgctcctgattta

SEQ ID NO: 60357 - DNA, 25 bp, Homo sapien
cttctcttctcatcccaggaaataa

SEQ ID NO: 60358 - DNA, 25 bp, Homo sapien
cttctcttctcatctcaggaaataa

SEQ ID NO: 60359 - DNA, 25 bp, Homo sapien
cttctcttggggcctcccgccttct

SEQ ID NO: 60360 - DNA, 25 bp, Homo sapien
cttctctttggaccaaacttcctcc

SEQ ID NO: 60361 - DNA, 25 bp, Homo sapien
cttctctttggaccaaccttcctcc

SEQ ID NO: 60362 - DNA, 25 bp, Homo sapien
cttctctttgggcctcccgccttct

SEQ ID NO: 60363 - DNA, 25 bp, Homo sapien
cttctgaaaggaaggaaagctttag

SEQ ID NO: 60364 - DNA, 25 bp, Homo sapien
cttctgaaaggtaggaaagctttag

SEQ ID NO: 60365 - DNA, 25 bp, Homo sapien
cttctgaaatgcaaaactatggatt

SEQ ID NO: 60366 - DNA, 25 bp, Homo sapien
cttctgaaatgcaactttctggaac

SEQ ID NO: 60367 - DNA, 25 bp, Homo sapien
cttctgaaatgcgaaactatggatt

SEQ ID NO: 60368 - DNA, 25 bp, Homo sapien
cttctgaaatgcgactttctggaac

SEQ ID NO: 60369 - DNA, 25 bp, Homo sapien
cttctgaagatgaatcctatgtttt

SEQ ID NO: 60370 - DNA, 25 bp, Homo sapien
cttctgaagatgactcctatgtttt

SEQ ID NO: 60371 - DNA, 25 bp, Homo sapien
cttctgaccactatctcttgccact

SEQ ID NO: 60372 - DNA, 25 bp, Homo sapien
cttctgaccactatttcttgccact

SEQ ID NO: 60373 - DNA, 25 bp, Homo sapien
cttctgactttccaaaatgcttctg

SEQ ID NO: 60374 - DNA, 25 bp, Homo sapien
cttctgactttgcaaaatgcttctg

SEQ ID NO: 60375 - DNA, 25 bp, Homo sapien
cttctgagccataacatcctttctc

SEQ ID NO: 60376 - DNA, 25 bp, Homo sapien
cttctgagccataatatcctttctc

SEQ ID NO: 60377 - DNA, 25 bp, Homo sapien
cttctgattttgcatttcatttccc

SEQ ID NO: 60378 - DNA, 25 bp, Homo sapien
cttctgattttgtatttcatttccc

SEQ ID NO: 60379 - DNA, 25 bp, Homo sapien
cttctgcagaaccgttttctccttg

SEQ ID NO: 60380 - DNA, 25 bp, Homo sapien
cttctgcagaactgttttctccttg

SEQ ID NO: 60381 - DNA, 25 bp, Homo sapien
cttctgccgtcaattacgaagtttc

SEQ ID NO: 60382 - DNA, 25 bp, Homo sapien
cttctgccgtcagttacgaagtttc

SEQ ID NO: 60383 - DNA, 25 bp, Homo sapien
cttctgccttaaccgaagagctctt

SEQ ID NO: 60384 - DNA, 25 bp, Homo sapien
cttctgccttaatcgaagagctctt

SEQ ID NO: 60385 - DNA, 25 bp, Homo sapien
cttctgccttactccttctcttttt

SEQ ID NO: 60386 - DNA, 25 bp, Homo sapien
cttctgccttactctttctcttttt

SEQ ID NO: 60387 - DNA, 25 bp, Homo sapien
cttctgccttccacttcccaggctg

SEQ ID NO: 60388 - DNA, 25 bp, Homo sapien
cttctgccttctacttcccaggctg

SEQ ID NO: 60389 - DNA, 25 bp, Homo sapien
cttctgctagaaagtcagcatctta

SEQ ID NO: 60390 - DNA, 25 bp, Homo sapien
cttctgctagaaattcagcatctta

SEQ ID NO: 60391 - DNA, 25 bp, Homo sapien
cttctgctgaatcaattctattcta

SEQ ID NO: 60392 - DNA, 25 bp, Homo sapien
cttctgctggatcaattctattcta

SEQ ID NO: 60393 - DNA, 25 bp, Homo sapien
cttctgctggtgattagagctcatt

SEQ ID NO: 60394 - DNA, 25 bp, Homo sapien
cttctgctggtggttagagctcatt

SEQ ID NO: 60395 - DNA, 25 bp, Homo sapien
cttctgcttaagaacattcctcttg

SEQ ID NO: 60396 - DNA, 25 bp, Homo sapien
cttctgcttaagtacattcctcttg

SEQ ID NO: 60397 - DNA, 25 bp, Homo sapien
cttctgcttgacaaacatgctttta

SEQ ID NO: 60398 - DNA, 25 bp, Homo sapien
cttctgcttgaccaacatgctttta

SEQ ID NO: 60399 - DNA, 25 bp, Homo sapien
cttctggaaaaacgtcaccctgccg

SEQ ID NO: 60400 - DNA, 25 bp, Homo sapien
cttctggaaaaatgtcaccctgccg

SEQ ID NO: 60401 - DNA, 25 bp, Homo sapien
cttctggaatacttatgcaggacat

SEQ ID NO: 60402 - DNA, 25 bp, Homo sapien
cttctggaatacttgtgcaggacat

SEQ ID NO: 60403 - DNA, 25 bp, Homo sapien
cttctggctgtgtcctcacagagtg

SEQ ID NO: 60404 - DNA, 25 bp, Homo sapien
cttctggctgtgtccttacagagtg

SEQ ID NO: 60405 - DNA, 25 bp, Homo sapien
cttctgggaagctcgtcccatttta

SEQ ID NO: 60406 - DNA, 25 bp, Homo sapien
cttctgggaagcttgtcccatttta

SEQ ID NO: 60407 - DNA, 25 bp, Homo sapien
cttctgggcttgtgattcctggtat

SEQ ID NO: 60408 - DNA, 25 bp, Homo sapien
cttctgggcttttgattcctggtat

SEQ ID NO: 60409 - DNA, 25 bp, Homo sapien
cttctggtagcaacagtttcatcta

SEQ ID NO: 60410 - DNA, 25 bp, Homo sapien
cttctggtgctaggcgagatcaata

SEQ ID NO: 60411 - DNA, 25 bp, Homo sapien
cttctggtgctaggtgagatcaata

SEQ ID NO: 60412 - DNA, 25 bp, Homo sapien
cttctggttgcaacagtttcatcta

SEQ ID NO: 60413 - DNA, 25 bp, Homo sapien
cttctggtttttatacaagtcttct

SEQ ID NO: 60414 - DNA, 25 bp, Homo sapien
cttctggtttttattcaagtcttct

SEQ ID NO: 60415 - DNA, 25 bp, Homo sapien
cttctgtacagcattatttatcaac

SEQ ID NO: 60416 - DNA, 25 bp, Homo sapien
cttctgtacagcgttatttatcaac

SEQ ID NO: 60417 - DNA, 25 bp, Homo sapien
cttctgtacgtaagccactatgtaa

SEQ ID NO: 60418 - DNA, 25 bp, Homo sapien
cttctgtagaaatatagtgtcagta

SEQ ID NO: 60419 - DNA, 25 bp, Homo sapien
cttctgtaggaatatagtgtcagta

SEQ ID NO: 60420 - DNA, 25 bp, Homo sapien
cttctgtatgtaagccactatgtaa

SEQ ID NO: 60421 - DNA, 25 bp, Homo sapien
cttctgtattcccttgcagatcctg

SEQ ID NO: 60422 - DNA, 25 bp, Homo sapien
cttctgtattcctttgcagatcctg

SEQ ID NO: 60423 - DNA, 25 bp, Homo sapien
cttctgtcttccaaatcttgagtga

SEQ ID NO: 60424 - DNA, 25 bp, Homo sapien
cttctgtcttccacatcttgagtga

SEQ ID NO: 60425 - DNA, 25 bp, Homo sapien
cttctgtcttcttaaaaaatccagc

SEQ ID NO: 60426 - DNA, 25 bp, Homo sapien
cttctgtcttcttgaaaaatccagc

SEQ ID NO: 60427 - DNA, 25 bp, Homo sapien
cttctgtttcagaaagaataggttc

SEQ ID NO: 60428 - DNA, 25 bp, Homo sapien
cttctgtttcagagagaataggttc

SEQ ID NO: 60429 - DNA, 25 bp, Homo sapien
cttctgttttaaccattgaccttca

SEQ ID NO: 60430 - DNA, 25 bp, Homo sapien
cttctgttttaacgattgaccttca

SEQ ID NO: 60431 - DNA, 25 bp, Homo sapien
cttctgttttcacgctcttatgtcc

SEQ ID NO: 60432 - DNA, 25 bp, Homo sapien
cttctgttttcatgctcttatgtcc

SEQ ID NO: 60433 - DNA, 25 bp, Homo sapien
cttctgtttttccctctttatttgt

SEQ ID NO: 60434 - DNA, 25 bp, Homo sapien
cttctgtttttctctctttatttgt

SEQ ID NO: 60435 - DNA, 25 bp, Homo sapien
cttcttaaaatattactatgcaaag

SEQ ID NO: 60436 - DNA, 25 bp, Homo sapien
cttcttaaagtattactatgcaaag

SEQ ID NO: 60437 - DNA, 25 bp, Homo sapien
cttcttaaatctgtagactcatcag

SEQ ID NO: 60438 - DNA, 25 bp, Homo sapien
cttcttaacaagaaattggtgccag

SEQ ID NO: 60439 - DNA, 25 bp, Homo sapien
cttcttaacaataaattggtgccag

SEQ ID NO: 60440 - DNA, 25 bp, Homo sapien
cttcttaactctgtagactcatcag

SEQ ID NO: 60441 - DNA, 25 bp, Homo sapien
cttcttacatttgcagtgtgcccca

SEQ ID NO: 60442 - DNA, 25 bp, Homo sapien
cttcttacattttcagtgtgcccca

SEQ ID NO: 60443 - DNA, 25 bp, Homo sapien
cttcttaccatcctatgtacagctt

SEQ ID NO: 60444 - DNA, 25 bp, Homo sapien
cttcttaccgtcctatgtacagctt

SEQ ID NO: 60445 - DNA, 25 bp, Homo sapien
cttcttacttcactgagttgatata

SEQ ID NO: 60446 - DNA, 25 bp, Homo sapien
cttcttacttcattgagttgatata

SEQ ID NO: 60447 - DNA, 25 bp, Homo sapien
cttcttagaaacgtcagaattgcac

SEQ ID NO: 60448 - DNA, 25 bp, Homo sapien
cttcttagaaatgtcagaattgcac

SEQ ID NO: 60449 - DNA, 25 bp, Homo sapien
cttcttagatgtacttagggcatcc

SEQ ID NO: 60450 - DNA, 25 bp, Homo sapien
cttcttagatgtccttagggcatcc

SEQ ID NO: 60451 - DNA, 25 bp, Homo sapien
cttcttagcttcataatgcaatgtt

SEQ ID NO: 60452 - DNA, 25 bp, Homo sapien
cttcttagcttcgtaatgcaatgtt

SEQ ID NO: 60453 - DNA, 25 bp, Homo sapien
cttcttagtatcgtaactgtttctg

SEQ ID NO: 60454 - DNA, 25 bp, Homo sapien
cttcttagtgtcgtaactgtttctg

SEQ ID NO: 60455 - DNA, 25 bp, Homo sapien
cttcttagttggacatttccactca

SEQ ID NO: 60456 - DNA, 25 bp, Homo sapien
cttcttagttggacctttccactca

SEQ ID NO: 60457 - DNA, 25 bp, Homo sapien
cttcttataaaaatgccctggagaa

SEQ ID NO: 60458 - DNA, 25 bp, Homo sapien
cttcttataaaaatgctctggagaa

SEQ ID NO: 60459 - DNA, 25 bp, Homo sapien
cttcttatttaacttatttggtagc

SEQ ID NO: 60460 - DNA, 25 bp, Homo sapien
cttcttatttatcttatttggtagc

SEQ ID NO: 60461 - DNA, 25 bp, Homo sapien
cttcttcaaccttcgctttctggcc

SEQ ID NO: 60462 - DNA, 25 bp, Homo sapien
cttcttcaaccttggctttctggcc

SEQ ID NO: 60463 - DNA, 25 bp, Homo sapien
cttcttcaacttgggcccccctccg

SEQ ID NO: 60464 - DNA, 25 bp, Homo sapien
cttcttcacttacccgcaagcaccc

SEQ ID NO: 60465 - DNA, 25 bp, Homo sapien
cttcttcacttgcccgcaagcaccc

SEQ ID NO: 60466 - DNA, 25 bp, Homo sapien
cttcttcagcagccgcctctgctga

SEQ ID NO: 60467 - DNA, 25 bp, Homo sapien
cttcttcagcagctgcctctgctga

SEQ ID NO: 60468 - DNA, 25 bp, Homo sapien
cttcttcatataatagtcagatagt

SEQ ID NO: 60469 - DNA, 25 bp, Homo sapien
cttcttcatatgatagtcagatagt

SEQ ID NO: 60470 - DNA, 25 bp, Homo sapien
cttcttcatcttgggcccccctccg

SEQ ID NO: 60471 - DNA, 25 bp, Homo sapien
cttcttccaaatgcattagcctcct

SEQ ID NO: 60472 - DNA, 25 bp, Homo sapien
cttcttccaaatgcgttagcctcct

SEQ ID NO: 60473 - DNA, 25 bp, Homo sapien
cttcttccaatagacggctgtgttg

SEQ ID NO: 60474 - DNA, 25 bp, Homo sapien
cttcttccaatagagggctgtgttg

SEQ ID NO: 60475 - DNA, 25 bp, Homo sapien
cttcttctcatttctcgccacgagt

SEQ ID NO: 60476 - DNA, 25 bp, Homo sapien
cttcttctgatttctcgccacgagt

SEQ ID NO: 60477 - DNA, 25 bp, Homo sapien
cttcttcttaccatcctatgtacag

SEQ ID NO: 60478 - DNA, 25 bp, Homo sapien
cttcttcttaccgtcctatgtacag

SEQ ID NO: 60479 - DNA, 25 bp, Homo sapien
cttcttgaccagatgcttcgtcaag

SEQ ID NO: 60480 - DNA, 25 bp, Homo sapien
cttcttgaccagctgcttcgtcaag

SEQ ID NO: 60481 - DNA, 25 bp, Homo sapien
cttcttgagatcagctcatggtgta

SEQ ID NO: 60482 - DNA, 25 bp, Homo sapien
cttcttgagatcagctgatggtgta

SEQ ID NO: 60483 - DNA, 25 bp, Homo sapien
cttcttgcaccaaagtttgattgat

SEQ ID NO: 60484 - DNA, 25 bp, Homo sapien
cttcttgcaccaacgtttgattgat

SEQ ID NO: 60485 - DNA, 25 bp, Homo sapien
cttcttgcagttacttcctaacgct

SEQ ID NO: 60486 - DNA, 25 bp, Homo sapien
cttcttgcagttatttcctaacgct

SEQ ID NO: 60487 - DNA, 25 bp, Homo sapien
cttcttgcatgttatatggcttttg

SEQ ID NO: 60488 - DNA, 25 bp, Homo sapien
cttcttgcatgttttatggcttttg

SEQ ID NO: 60489 - DNA, 25 bp, Homo sapien
cttcttgcgccaaactggcatgctt

SEQ ID NO: 60490 - DNA, 25 bp, Homo sapien
cttcttgctaaagtctgtacagtca

SEQ ID NO: 60491 - DNA, 25 bp, Homo sapien
cttcttgctaatgtctgtacagtca

SEQ ID NO: 60492 - DNA, 25 bp, Homo sapien
cttcttgctccaaactggcatgctt

SEQ ID NO: 60493 - DNA, 25 bp, Homo sapien
cttcttggagaatcaattttagcct

SEQ ID NO: 60494 - DNA, 25 bp, Homo sapien
cttcttggagaattaattttagcct

SEQ ID NO: 60495 - DNA, 25 bp, Homo sapien
cttcttggtgtcatctttctttact

SEQ ID NO: 60496 - DNA, 25 bp, Homo sapien
cttcttggtgtcgtctttctttact

SEQ ID NO: 60497 - DNA, 25 bp, Homo sapien
cttcttgttaaacgctaatctccca

SEQ ID NO: 60498 - DNA, 25 bp, Homo sapien
cttcttgttaaatgctaatctccca

SEQ ID NO: 60499 - DNA, 25 bp, Homo sapien
cttcttgttcattcacatattctgc

SEQ ID NO: 60500 - DNA, 25 bp, Homo sapien
cttcttgttgattcacatattctgc

SEQ ID NO: 60501 - DNA, 25 bp, Homo sapien
cttcttgtttgctaacaatgatgaa

SEQ ID NO: 60502 - DNA, 25 bp, Homo sapien
cttcttgtttgctagcaatgatgaa

SEQ ID NO: 60503 - DNA, 25 bp, Homo sapien
cttctttattcactacaggttgttc

SEQ ID NO: 60504 - DNA, 25 bp, Homo sapien
cttctttattcactgcaggttgttc

SEQ ID NO: 60505 - DNA, 25 bp, Homo sapien
cttctttcattcgtttttgggtggc

SEQ ID NO: 60506 - DNA, 25 bp, Homo sapien
cttctttcctcaagggatcaaatca

SEQ ID NO: 60507 - DNA, 25 bp, Homo sapien
cttctttcctcaatggatcaaatca

SEQ ID NO: 60508 - DNA, 25 bp, Homo sapien
cttctttcgttcgtttttgggtggc

SEQ ID NO: 60509 - DNA, 25 bp, Homo sapien
cttctttctttcccaaaatcaccat

SEQ ID NO: 60510 - DNA, 25 bp, Homo sapien
cttctttcttttccaaaatcaccat

SEQ ID NO: 60511 - DNA, 25 bp, Homo sapien
cttctttgactgcaaatcttgccat

SEQ ID NO: 60512 - DNA, 25 bp, Homo sapien
cttctttgactgcgaatcttgccat

SEQ ID NO: 60513 - DNA, 25 bp, Homo sapien
cttctttgctccacagctactaagc

SEQ ID NO: 60514 - DNA, 25 bp, Homo sapien
cttctttgctccatagctactaagc

SEQ ID NO: 60515 - DNA, 25 bp, Homo sapien
cttctttgtagatgggagaccctaa

SEQ ID NO: 60516 - DNA, 25 bp, Homo sapien
cttctttgtagttgggagaccctaa

SEQ ID NO: 60517 - DNA, 25 bp, Homo sapien
cttctttgttcctttctaccattac

SEQ ID NO: 60518 - DNA, 25 bp, Homo sapien
cttctttgttcttttctaccattac

SEQ ID NO: 60519 - DNA, 25 bp, Homo sapien
cttcttttagttgctgagcttaatc

SEQ ID NO: 60520 - DNA, 25 bp, Homo sapien
cttcttttagtttctgagcttaatc

SEQ ID NO: 60521 - DNA, 25 bp, Homo sapien
cttcttttatcttgccacagctata

SEQ ID NO: 60522 - DNA, 25 bp, Homo sapien
cttcttttcacatagttaaccaatc

SEQ ID NO: 60523 - DNA, 25 bp, Homo sapien
cttcttttcacatggttaaccaatc

SEQ ID NO: 60524 - DNA, 25 bp, Homo sapien
cttcttttcgtaaagaggaaggtat

SEQ ID NO: 60525 - DNA, 25 bp, Homo sapien
cttcttttctacaacttacactaca

SEQ ID NO: 60526 - DNA, 25 bp, Homo sapien
cttcttttctacaccttacactaca

SEQ ID NO: 60527 - DNA, 25 bp, Homo sapien
cttcttttctcttgccacagctata

SEQ ID NO: 60528 - DNA, 25 bp, Homo sapien
cttctttttgcccaatttgtaagac

SEQ ID NO: 60529 - DNA, 25 bp, Homo sapien
cttctttttgcgcaatttgtaagac

SEQ ID NO: 60530 - DNA, 25 bp, Homo sapien
cttctttttgtaaagaggaaggtat

SEQ ID NO: 60531 - DNA, 25 bp, Homo sapien
cttgaaaacgggccttgtgtccacc

SEQ ID NO: 60532 - DNA, 25 bp, Homo sapien
cttgaaaagtggctatcggccagga

SEQ ID NO: 60533 - DNA, 25 bp, Homo sapien
cttgaaaagtggctattggccagga

SEQ ID NO: 60534 - DNA, 25 bp, Homo sapien
cttgaaaataacagcggttaaaggg

SEQ ID NO: 60535 - DNA, 25 bp, Homo sapien
cttgaaaataacagtggttaaaggg

SEQ ID NO: 60536 - DNA, 25 bp, Homo sapien
cttgaaaatagccaaaaagtctact

SEQ ID NO: 60537 - DNA, 25 bp, Homo sapien
cttgaaaataggcaaaaagtctact

SEQ ID NO: 60538 - DNA, 25 bp, Homo sapien
cttgaaaatgggccttgtgtccacc

SEQ ID NO: 60539 - DNA, 25 bp, Homo sapien
cttgaaacatttatcttctgctcac

SEQ ID NO: 60540 - DNA, 25 bp, Homo sapien
cttgaaacctttatcttctgctcac

SEQ ID NO: 60541 - DNA, 25 bp, Homo sapien
cttgaaactttctatttagtcgtta

SEQ ID NO: 60542 - DNA, 25 bp, Homo sapien
cttgaaactttgtatttagtcgtta

SEQ ID NO: 60543 - DNA, 25 bp, Homo sapien
cttgaaagctaccaccaaatcactc

SEQ ID NO: 60544 - DNA, 25 bp, Homo sapien
cttgaaagctactaccaaatcactc

SEQ ID NO: 60545 - DNA, 25 bp, Homo sapien
cttgaaataaatagcaagagcaaat

SEQ ID NO: 60546 - DNA, 25 bp, Homo sapien
cttgaaatcagcactattaggacaa

SEQ ID NO: 60547 - DNA, 25 bp, Homo sapien
cttgaaatgaatagcaagagcaaat

SEQ ID NO: 60548 - DNA, 25 bp, Homo sapien
cttgaaatgatgctgacaagggcca

SEQ ID NO: 60549 - DNA, 25 bp, Homo sapien
cttgaaatggtgctgacaagggcca

SEQ ID NO: 60550 - DNA, 25 bp, Homo sapien
cttgaaattagcactattaggacaa

SEQ ID NO: 60551 - DNA, 25 bp, Homo sapien
cttgaacacgactcattttgtgaat

SEQ ID NO: 60552 - DNA, 25 bp, Homo sapien
cttgaacatgactcattttgtgaat

SEQ ID NO: 60553 - DNA, 25 bp, Homo sapien
cttgaaccatggcaatgaaaaggag

SEQ ID NO: 60554 - DNA, 25 bp, Homo sapien
cttgaaccatggcagtgaaaaggag

SEQ ID NO: 60555 - DNA, 25 bp, Homo sapien
cttgaactgacaaataagcataaca

SEQ ID NO: 60556 - DNA, 25 bp, Homo sapien
cttgaactgacagataagcataaca

SEQ ID NO: 60557 - DNA, 25 bp, Homo sapien
cttgaagataggataatggatgaat

SEQ ID NO: 60558 - DNA, 25 bp, Homo sapien
cttgaagatgggataatggatgaat

SEQ ID NO: 60559 - DNA, 25 bp, Homo sapien
cttgaagcagggtcaacactgccag

SEQ ID NO: 60560 - DNA, 25 bp, Homo sapien
cttgaagcagggtccacactgccag

SEQ ID NO: 60561 - DNA, 25 bp, Homo sapien
cttgaatataaacagaactcaagaa

SEQ ID NO: 60562 - DNA, 25 bp, Homo sapien
cttgaatataaagagaactcaagaa

SEQ ID NO: 60563 - DNA, 25 bp, Homo sapien
cttgaatcaccaatgccaccactcc

SEQ ID NO: 60564 - DNA, 25 bp, Homo sapien
cttgaatcgccaatgccaccactcc

SEQ ID NO: 60565 - DNA, 25 bp, Homo sapien
cttgaatggaatttctggaccaggt

SEQ ID NO: 60566 - DNA, 25 bp, Homo sapien
cttgaatggcatttctggaccaggt

SEQ ID NO: 60567 - DNA, 25 bp, Homo sapien
cttgaattcttcaaaataagtacat

SEQ ID NO: 60568 - DNA, 25 bp, Homo sapien
cttgaattctttaaaataagtacat

SEQ ID NO: 60569 - DNA, 25 bp, Homo sapien
cttgaatttctcttcccgggtgcga

SEQ ID NO: 60570 - DNA, 25 bp, Homo sapien
cttgaatttctcttcctgggtgcga

SEQ ID NO: 60571 - DNA, 25 bp, Homo sapien
cttgacaaaggtagcggtcagctgt

SEQ ID NO: 60572 - DNA, 25 bp, Homo sapien
cttgacaaaggtagtggtcagctgt

SEQ ID NO: 60573 - DNA, 25 bp, Homo sapien
cttgacaacatgctttcccaggggt

SEQ ID NO: 60574 - DNA, 25 bp, Homo sapien
cttgacaacgtgctttcccaggggt

SEQ ID NO: 60575 - DNA, 25 bp, Homo sapien
cttgacacgcatgacgagtgagtgc

SEQ ID NO: 60576 - DNA, 25 bp, Homo sapien
cttgacacgcatgatgagtgagtgc

SEQ ID NO: 60577 - DNA, 25 bp, Homo sapien
cttgacagaaaaacctcacagtggt

SEQ ID NO: 60578 - DNA, 25 bp, Homo sapien
cttgacaggaaaacctcacagtggt

SEQ ID NO: 60579 - DNA, 25 bp, Homo sapien
cttgacatactggattggaattaag

SEQ ID NO: 60580 - DNA, 25 bp, Homo sapien
cttgacatattggattggaattaag

SEQ ID NO: 60581 - DNA, 25 bp, Homo sapien
cttgacatttttatagctaaatctc

SEQ ID NO: 60582 - DNA, 25 bp, Homo sapien
cttgacatttttgtagctaaatctc

SEQ ID NO: 60583 - DNA, 25 bp, Homo sapien
cttgaccaaacacggaaatagcaat

SEQ ID NO: 60584 - DNA, 25 bp, Homo sapien
cttgaccaaacatggaaatagcaat

SEQ ID NO: 60585 - DNA, 25 bp, Homo sapien
cttgaccagatgcttcgtcaagaag

SEQ ID NO: 60586 - DNA, 25 bp, Homo sapien
cttgaccagctgcttcgtcaagaag

SEQ ID NO: 60587 - DNA, 25 bp, Homo sapien
cttgaccccattattgatgtcttgg

SEQ ID NO: 60588 - DNA, 25 bp, Homo sapien
cttgaccccattgttgatgtcttgg

SEQ ID NO: 60589 - DNA, 25 bp, Homo sapien
cttgacctagaaccaaagctaggct

SEQ ID NO: 60590 - DNA, 25 bp, Homo sapien
cttgacctagaatcaaagctaggct

SEQ ID NO: 60591 - DNA, 25 bp, Homo sapien
cttgaccttggctatctctgtctac

SEQ ID NO: 60592 - DNA, 25 bp, Homo sapien
cttgaccttggctgtctctgtctac

SEQ ID NO: 60593 - DNA, 25 bp, Homo sapien
cttgacgcctcattgagtttgaact

SEQ ID NO: 60594 - DNA, 25 bp, Homo sapien
cttgacgcctcgttgagtttgaact

SEQ ID NO: 60595 - DNA, 25 bp, Homo sapien
cttgactcccaatctcattatcttt

SEQ ID NO: 60596 - DNA, 25 bp, Homo sapien
cttgactcccaatctcgttatcttt

SEQ ID NO: 60597 - DNA, 25 bp, Homo sapien
cttgactctatatcgaatgcacaga

SEQ ID NO: 60598 - DNA, 25 bp, Homo sapien
cttgactctatattgaatgcacaga

SEQ ID NO: 60599 - DNA, 25 bp, Homo sapien
cttgacttctactcttgagcagctc

SEQ ID NO: 60600 - DNA, 25 bp, Homo sapien
cttgactttaactgggctttttctc

SEQ ID NO: 60601 - DNA, 25 bp, Homo sapien
cttgactttaattgggctttttctc

SEQ ID NO: 60602 - DNA, 25 bp, Homo sapien
cttgactttcaacattatacacatg

SEQ ID NO: 60603 - DNA, 25 bp, Homo sapien
cttgacttttaacattatacacatg

SEQ ID NO: 60604 - DNA, 25 bp, Homo sapien
cttgacttttactcttgagcagctc

SEQ ID NO: 60605 - DNA, 25 bp, Homo sapien
cttgagaaaataaatcttcatgcca

SEQ ID NO: 60606 - DNA, 25 bp, Homo sapien
cttgagaaactgaaagggcatgagt

SEQ ID NO: 60607 - DNA, 25 bp, Homo sapien
cttgagaaactggaagggcatgagt

SEQ ID NO: 60608 - DNA, 25 bp, Homo sapien
cttgagaaattaaatcttcatgcca

SEQ ID NO: 60609 - DNA, 25 bp, Homo sapien
cttgagaagacacagcaggggatgc

SEQ ID NO: 60610 - DNA, 25 bp, Homo sapien
cttgagaagacgcagcaggggatgc

SEQ ID NO: 60611 - DNA, 25 bp, Homo sapien
cttgagacactcgagattcggggat

SEQ ID NO: 60612 - DNA, 25 bp, Homo sapien
cttgagacactcgggattcggggat

SEQ ID NO: 60613 - DNA, 25 bp, Homo sapien
cttgagagtacatggcatttcaaag

SEQ ID NO: 60614 - DNA, 25 bp, Homo sapien
cttgagagtacgtggcatttcaaag

SEQ ID NO: 60615 - DNA, 25 bp, Homo sapien
cttgagagtggaagattattttgga

SEQ ID NO: 60616 - DNA, 25 bp, Homo sapien
cttgagagtgggagattattttgga

SEQ ID NO: 60617 - DNA, 25 bp, Homo sapien
cttgagatcagctcatggtgtaata

SEQ ID NO: 60618 - DNA, 25 bp, Homo sapien
cttgagatcagctgatggtgtaata

SEQ ID NO: 60619 - DNA, 25 bp, Homo sapien
cttgagcacagtaaggagagtaagg

SEQ ID NO: 60620 - DNA, 25 bp, Homo sapien
cttgagcacggtaaggagagtaagg

SEQ ID NO: 60621 - DNA, 25 bp, Homo sapien
cttgagcatgccttatattccagcg

SEQ ID NO: 60622 - DNA, 25 bp, Homo sapien
cttgagcatgccttatgttccagcg

SEQ ID NO: 60623 - DNA, 25 bp, Homo sapien
cttgagctaaacaaagaagataagc

SEQ ID NO: 60624 - DNA, 25 bp, Homo sapien
cttgagctaaacaaggaagataagc

SEQ ID NO: 60625 - DNA, 25 bp, Homo sapien
cttgagctgcggcatctgtgctaac

SEQ ID NO: 60626 - DNA, 25 bp, Homo sapien
cttgagctgtggcatctgtgctaac

SEQ ID NO: 60627 - DNA, 25 bp, Homo sapien
cttgaggaacggtgcactgtggccc

SEQ ID NO: 60628 - DNA, 25 bp, Homo sapien
cttgaggaatggtgcactgtggccc

SEQ ID NO: 60629 - DNA, 25 bp, Homo sapien
cttgaggcaactcacctctgactca

SEQ ID NO: 60630 - DNA, 25 bp, Homo sapien
cttgaggcaactcatctctgactca

SEQ ID NO: 60631 - DNA, 25 bp, Homo sapien
cttgagggtggaaagagagaaccct

SEQ ID NO: 60632 - DNA, 25 bp, Homo sapien
cttgagggtggaaggagagaaccct

SEQ ID NO: 60633 - DNA, 25 bp, Homo sapien
cttgagtaatagtgacaagctaata

SEQ ID NO: 60634 - DNA, 25 bp, Homo sapien
cttgagtaatagtggcaagctaata

SEQ ID NO: 60635 - DNA, 25 bp, Homo sapien
cttgagtcaaataaccctgattctc

SEQ ID NO: 60636 - DNA, 25 bp, Homo sapien
cttgagtcaaatcaccctgattctc

SEQ ID NO: 60637 - DNA, 25 bp, Homo sapien
cttgagtgatccctgcagtattgtt

SEQ ID NO: 60638 - DNA, 25 bp, Homo sapien
cttgagtgatccctgcggtattgtt

SEQ ID NO: 60639 - DNA, 25 bp, Homo sapien
cttgagtgcctttaaagatttccgg

SEQ ID NO: 60640 - DNA, 25 bp, Homo sapien
cttgagtgcctttgaagatttccgg

SEQ ID NO: 60641 - DNA, 25 bp, Homo sapien
cttgagtggatataacctgtgagcc

SEQ ID NO: 60642 - DNA, 25 bp, Homo sapien
cttgagtggatgtaacctgtgagcc

SEQ ID NO: 60643 - DNA, 25 bp, Homo sapien
cttgagtttgtcattattgtggtga

SEQ ID NO: 60644 - DNA, 25 bp, Homo sapien
cttgagtttgtcgttattgtggtga

SEQ ID NO: 60645 - DNA, 25 bp, Homo sapien
cttgatacagggccagggcttagct

SEQ ID NO: 60646 - DNA, 25 bp, Homo sapien
cttgatacggggccagggcttagct

SEQ ID NO: 60647 - DNA, 25 bp, Homo sapien
cttgatactagcagtagaggattca

SEQ ID NO: 60648 - DNA, 25 bp, Homo sapien
cttgatactagcggtagaggattca

SEQ ID NO: 60649 - DNA, 25 bp, Homo sapien
cttgatagtaaaagactgaatgctg

SEQ ID NO: 60650 - DNA, 25 bp, Homo sapien
cttgatagtaaaatactgaatgctg

SEQ ID NO: 60651 - DNA, 25 bp, Homo sapien
cttgatcacatctgaaaaatctttc

SEQ ID NO: 60652 - DNA, 25 bp, Homo sapien
cttgatcatatctgaaaaatctttc

SEQ ID NO: 60653 - DNA, 25 bp, Homo sapien
cttgatctaccaacagggtgagatt

SEQ ID NO: 60654 - DNA, 25 bp, Homo sapien
cttgatctaccaatagggtgagatt

SEQ ID NO: 60655 - DNA, 25 bp, Homo sapien
cttgatcttaacctcaattctgctt

SEQ ID NO: 60656 - DNA, 25 bp, Homo sapien
cttgatcttaacctcagttctgctt

SEQ ID NO: 60657 - DNA, 25 bp, Homo sapien
cttgatgagagccatattttaggaa

SEQ ID NO: 60658 - DNA, 25 bp, Homo sapien
cttgatgagagccttattttaggaa

SEQ ID NO: 60659 - DNA, 25 bp, Homo sapien
cttgatgcctttccattgctttctc

SEQ ID NO: 60660 - DNA, 25 bp, Homo sapien
cttgatgcctttctattgctttctc

SEQ ID NO: 60661 - DNA, 25 bp, Homo sapien
cttgattagattcagataatttttg

SEQ ID NO: 60662 - DNA, 25 bp, Homo sapien
cttgattagattcatataatttttg

SEQ ID NO: 60663 - DNA, 25 bp, Homo sapien
cttgattcaactattctcctaaact

SEQ ID NO: 60664 - DNA, 25 bp, Homo sapien
cttgattcacctattctcctaaact

SEQ ID NO: 60665 - DNA, 25 bp, Homo sapien
cttgatttggaaacactgatggcct

SEQ ID NO: 60666 - DNA, 25 bp, Homo sapien
cttgatttggaaatactgatggcct

SEQ ID NO: 60667 - DNA, 25 bp, Homo sapien
cttgatttgggcagagatttctgca

SEQ ID NO: 60668 - DNA, 25 bp, Homo sapien
cttgatttggggagagatttctgca

SEQ ID NO: 60669 - DNA, 25 bp, Homo sapien
cttgattttttcagttaccggcatt

SEQ ID NO: 60670 - DNA, 25 bp, Homo sapien
cttgattttttcggttaccggcatt

SEQ ID NO: 60671 - DNA, 25 bp, Homo sapien
cttgcaaaaaatgaaactctttatc

SEQ ID NO: 60672 - DNA, 25 bp, Homo sapien
cttgcaaaatatcttggtatcttgt

SEQ ID NO: 60673 - DNA, 25 bp, Homo sapien
cttgcaaataatgaaactctttatc

SEQ ID NO: 60674 - DNA, 25 bp, Homo sapien
cttgcaaattacaaaactcttggca

SEQ ID NO: 60675 - DNA, 25 bp, Homo sapien
cttgcaaattagaaaactcttggca

SEQ ID NO: 60676 - DNA, 25 bp, Homo sapien
cttgcaaattatcttggtatcttgt

SEQ ID NO: 60677 - DNA, 25 bp, Homo sapien
cttgcaagaaacattaacagaagtt

SEQ ID NO: 60678 - DNA, 25 bp, Homo sapien
cttgcaagaaacgttaacagaagtt

SEQ ID NO: 60679 - DNA, 25 bp, Homo sapien
cttgcaataactcttgatggaaaga

SEQ ID NO: 60680 - DNA, 25 bp, Homo sapien
cttgcaataactgttgatggaaaga

SEQ ID NO: 60681 - DNA, 25 bp, Homo sapien
cttgcacatggggtttaataaggtt

SEQ ID NO: 60682 - DNA, 25 bp, Homo sapien
cttgcacatggggtttgataaggtt

SEQ ID NO: 60683 - DNA, 25 bp, Homo sapien
cttgcaccatcaaggattttaggac

SEQ ID NO: 60684 - DNA, 25 bp, Homo sapien
cttgcaccatcgaggattttaggac

SEQ ID NO: 60685 - DNA, 25 bp, Homo sapien
cttgcactaaaggaatttactctct

SEQ ID NO: 60686 - DNA, 25 bp, Homo sapien
cttgcactaaaggagtttactctct

SEQ ID NO: 60687 - DNA, 25 bp, Homo sapien
cttgcactgtgacattgagtaacaa

SEQ ID NO: 60688 - DNA, 25 bp, Homo sapien
cttgcactgtgatattgagtaacaa

SEQ ID NO: 60689 - DNA, 25 bp, Homo sapien
cttgcagagaagactgttcccttca

SEQ ID NO: 60690 - DNA, 25 bp, Homo sapien
cttgcagagaagcctgttcccttca

SEQ ID NO: 60691 - DNA, 25 bp, Homo sapien
cttgcagagcaccaacccagtcacg

SEQ ID NO: 60692 - DNA, 25 bp, Homo sapien
cttgcagagtaccaacccagtcacg

SEQ ID NO: 60693 - DNA, 25 bp, Homo sapien
cttgcagatatgattatagagaaaa

SEQ ID NO: 60694 - DNA, 25 bp, Homo sapien
cttgcagatatggttatagagaaaa

SEQ ID NO: 60695 - DNA, 25 bp, Homo sapien
cttgcagtattgcttaaccctgaag

SEQ ID NO: 60696 - DNA, 25 bp, Homo sapien
cttgcagtattgtttaaccctgaag

SEQ ID NO: 60697 - DNA, 25 bp, Homo sapien
cttgcagtgaaatataacagtatga

SEQ ID NO: 60698 - DNA, 25 bp, Homo sapien
cttgcagtgaattataacagtatga

SEQ ID NO: 60699 - DNA, 25 bp, Homo sapien
cttgcatagctctacaatggagatt

SEQ ID NO: 60700 - DNA, 25 bp, Homo sapien
cttgcatagctctataatggagatt

SEQ ID NO: 60701 - DNA, 25 bp, Homo sapien
cttgcatatgtttatcaaaatactc

SEQ ID NO: 60702 - DNA, 25 bp, Homo sapien
cttgcatatgtttatccaaatactc

SEQ ID NO: 60703 - DNA, 25 bp, Homo sapien
cttgcatgaacttttgtaactgcct

SEQ ID NO: 60704 - DNA, 25 bp, Homo sapien
cttgcatggacttttgtaactgcct

SEQ ID NO: 60705 - DNA, 25 bp, Homo sapien
cttgcattcaggcacagtgctctcc

SEQ ID NO: 60706 - DNA, 25 bp, Homo sapien
cttgcattcagtcacagtgctctcc

SEQ ID NO: 60707 - DNA, 25 bp, Homo sapien
cttgcattcatctaaacatttttaa

SEQ ID NO: 60708 - DNA, 25 bp, Homo sapien
cttgcattcatctgaacatttttaa

SEQ ID NO: 60709 - DNA, 25 bp, Homo sapien
cttgcattgctccctccaaaaggtg

SEQ ID NO: 60710 - DNA, 25 bp, Homo sapien
cttgcattgtagcagttttgcaagc

SEQ ID NO: 60711 - DNA, 25 bp, Homo sapien
cttgcattgtagtagttttgcaagc

SEQ ID NO: 60712 - DNA, 25 bp, Homo sapien
cttgcatttctccctccaaaaggtg

SEQ ID NO: 60713 - DNA, 25 bp, Homo sapien
cttgcattttctccaatgaaaagct

SEQ ID NO: 60714 - DNA, 25 bp, Homo sapien
cttgcattttcttcaatgaaaagct

SEQ ID NO: 60715 - DNA, 25 bp, Homo sapien
cttgccaagaatcatgcatgcagtg

SEQ ID NO: 60716 - DNA, 25 bp, Homo sapien
cttgccaaggttgatggatatatct

SEQ ID NO: 60717 - DNA, 25 bp, Homo sapien
cttgccaagtttgatggatatatct

SEQ ID NO: 60718 - DNA, 25 bp, Homo sapien
cttgccaataatcatgcatgcagtg

SEQ ID NO: 60719 - DNA, 25 bp, Homo sapien
cttgccacgttcagaaacggcagtt

SEQ ID NO: 60720 - DNA, 25 bp, Homo sapien
cttgccacgttcggaaacggcagtt

SEQ ID NO: 60721 - DNA, 25 bp, Homo sapien
cttgccagagctaagcattgttggg

SEQ ID NO: 60722 - DNA, 25 bp, Homo sapien
cttgccagagctaagcgttgttggg

SEQ ID NO: 60723 - DNA, 25 bp, Homo sapien
cttgccagcgaaaacttggggctga

SEQ ID NO: 60724 - DNA, 25 bp, Homo sapien
cttgccagtgaaaacttggggctga

SEQ ID NO: 60725 - DNA, 25 bp, Homo sapien
cttgccatagatagacaatttgcct

SEQ ID NO: 60726 - DNA, 25 bp, Homo sapien
cttgccatagatagtcaatttgcct

SEQ ID NO: 60727 - DNA, 25 bp, Homo sapien
cttgcccacaaatagtcacagcaac

SEQ ID NO: 60728 - DNA, 25 bp, Homo sapien
cttgcccaccaatagtcacagcaac

SEQ ID NO: 60729 - DNA, 25 bp, Homo sapien
cttgccctatatgtgtgacttcagg

SEQ ID NO: 60730 - DNA, 25 bp, Homo sapien
cttgccctgtatgtgtgacttcagg

SEQ ID NO: 60731 - DNA, 25 bp, Homo sapien
cttgccgttatttacatttatgtct

SEQ ID NO: 60732 - DNA, 25 bp, Homo sapien
cttgccgttgtttacatttatgtct

SEQ ID NO: 60733 - DNA, 25 bp, Homo sapien
cttgcctaacgcaaggcaatccgct

SEQ ID NO: 60734 - DNA, 25 bp, Homo sapien
cttgcctaatgcaaggcaatccgct

SEQ ID NO: 60735 - DNA, 25 bp, Homo sapien
cttgcctcactcgacctccaaagtg

SEQ ID NO: 60736 - DNA, 25 bp, Homo sapien
cttgcctcataagacttccaaggta

SEQ ID NO: 60737 - DNA, 25 bp, Homo sapien
cttgcctcattcgacctccaaagtg

SEQ ID NO: 60738 - DNA, 25 bp, Homo sapien
cttgcctcgtaagacttccaaggta

SEQ ID NO: 60739 - DNA, 25 bp, Homo sapien
cttgcctctctctgactctccatcc

SEQ ID NO: 60740 - DNA, 25 bp, Homo sapien
cttgcctctgactgaacctgtgcat

SEQ ID NO: 60741 - DNA, 25 bp, Homo sapien
cttgcctctgactgcacctgtgcat

SEQ ID NO: 60742 - DNA, 25 bp, Homo sapien
cttgcctctgtctgactctccatcc

SEQ ID NO: 60743 - DNA, 25 bp, Homo sapien
cttgcctgactaaaacgtgaaaaac

SEQ ID NO: 60744 - DNA, 25 bp, Homo sapien
cttgcctgacttaaacgtgaaaaac

SEQ ID NO: 60745 - DNA, 25 bp, Homo sapien
cttgcctgagattggtaccagctgg

SEQ ID NO: 60746 - DNA, 25 bp, Homo sapien
cttgcctggctaaactttattctct

SEQ ID NO: 60747 - DNA, 25 bp, Homo sapien
cttgcctggctatactttattctct

SEQ ID NO: 60748 - DNA, 25 bp, Homo sapien
cttgcctgggattggtaccagctgg

SEQ ID NO: 60749 - DNA, 25 bp, Homo sapien
cttgcctgttatatagagcaatcat

SEQ ID NO: 60750 - DNA, 25 bp, Homo sapien
cttgcctgttatatagcgcaatcat

SEQ ID NO: 60751 - DNA, 25 bp, Homo sapien
cttgccttcatctttcattgtaaca

SEQ ID NO: 60752 - DNA, 25 bp, Homo sapien
cttgccttcctctttcattgtaaca

SEQ ID NO: 60753 - DNA, 25 bp, Homo sapien
cttgccttttcagtttcataacagt

SEQ ID NO: 60754 - DNA, 25 bp, Homo sapien
cttgccttttcattttcataacagt

SEQ ID NO: 60755 - DNA, 25 bp, Homo sapien
cttgcggaacgcgttataaatgaat

SEQ ID NO: 60756 - DNA, 25 bp, Homo sapien
cttgcggaacgtgttataaatgaat

SEQ ID NO: 60757 - DNA, 25 bp, Homo sapien
cttgctaagcaaaaacaactgtccc

SEQ ID NO: 60758 - DNA, 25 bp, Homo sapien
cttgctaagcaaaagcaactgtccc

SEQ ID NO: 60759 - DNA, 25 bp, Homo sapien
cttgctaagtgtattttctgaggct

SEQ ID NO: 60760 - DNA, 25 bp, Homo sapien
cttgctaattgtattttctgaggct

SEQ ID NO: 60761 - DNA, 25 bp, Homo sapien
cttgctactactctaacgtttcgta

SEQ ID NO: 60762 - DNA, 25 bp, Homo sapien
cttgctactactctaatgtttcgta

SEQ ID NO: 60763 - DNA, 25 bp, Homo sapien
cttgctagtctcaccctgggctcaa

SEQ ID NO: 60764 - DNA, 25 bp, Homo sapien
cttgctagtgtcaccctgggctcaa

SEQ ID NO: 60765 - DNA, 25 bp, Homo sapien
cttgctcaacttagacatgcattct

SEQ ID NO: 60766 - DNA, 25 bp, Homo sapien
cttgctcacagattgtggagtccaa

SEQ ID NO: 60767 - DNA, 25 bp, Homo sapien
cttgctcacagattttggagtccaa

SEQ ID NO: 60768 - DNA, 25 bp, Homo sapien
cttgctcaccttagacatgcattct

SEQ ID NO: 60769 - DNA, 25 bp, Homo sapien
cttgctcactcaactgcctaaaaac

SEQ ID NO: 60770 - DNA, 25 bp, Homo sapien
cttgctcactcaattgcctaaaaac

SEQ ID NO: 60771 - DNA, 25 bp, Homo sapien
cttgctcacttatattataaactat

SEQ ID NO: 60772 - DNA, 25 bp, Homo sapien
cttgctcacttatgttataaactat

SEQ ID NO: 60773 - DNA, 25 bp, Homo sapien
cttgctcatggtaagcagacaccta

SEQ ID NO: 60774 - DNA, 25 bp, Homo sapien
cttgctcatggtaagcggacaccta

SEQ ID NO: 60775 - DNA, 25 bp, Homo sapien
cttgctccatatttttgccagtatg

SEQ ID NO: 60776 - DNA, 25 bp, Homo sapien
cttgctccatattttttccagtatg

SEQ ID NO: 60777 - DNA, 25 bp, Homo sapien
cttgctgaaaattgacacagaaaaa

SEQ ID NO: 60778 - DNA, 25 bp, Homo sapien
cttgctgaagattgacacagaaaaa

SEQ ID NO: 60779 - DNA, 25 bp, Homo sapien
cttgctgaatactgttttttttgcg

SEQ ID NO: 60780 - DNA, 25 bp, Homo sapien
cttgctgaatacttttttttttgcg

SEQ ID NO: 60781 - DNA, 25 bp, Homo sapien
cttgctgcagaaagttataaggact

SEQ ID NO: 60782 - DNA, 25 bp, Homo sapien
cttgctgcaggcatgaagagacagg

SEQ ID NO: 60783 - DNA, 25 bp, Homo sapien
cttgctgcaggcgtgaagagacagg

SEQ ID NO: 60784 - DNA, 25 bp, Homo sapien
cttgctgcggaaagttataaggact

SEQ ID NO: 60785 - DNA, 25 bp, Homo sapien
cttgctgtgggatgtcactttttaa

SEQ ID NO: 60786 - DNA, 25 bp, Homo sapien
cttgctgtgggttgtcactttttaa

SEQ ID NO: 60787 - DNA, 25 bp, Homo sapien
cttgctgtgttcttctcgagtagac

SEQ ID NO: 60788 - DNA, 25 bp, Homo sapien
cttgctgtgtttttctcgagtagac

SEQ ID NO: 60789 - DNA, 25 bp, Homo sapien
cttgctgtttgggtggttcaaccaa

SEQ ID NO: 60790 - DNA, 25 bp, Homo sapien
cttgctgtttgggttgttcaaccaa

SEQ ID NO: 60791 - DNA, 25 bp, Homo sapien
cttgcttagcccatgcacacagcat

SEQ ID NO: 60792 - DNA, 25 bp, Homo sapien
cttgcttagcccgtgcacacagcat

SEQ ID NO: 60793 - DNA, 25 bp, Homo sapien
cttgcttatgtgtcttcgtctttaa

SEQ ID NO: 60794 - DNA, 25 bp, Homo sapien
cttgcttatgtgtctttgtctttaa

SEQ ID NO: 60795 - DNA, 25 bp, Homo sapien
cttgcttcaccttccgagaaatgct

SEQ ID NO: 60796 - DNA, 25 bp, Homo sapien
cttgcttcaccttctgagaaatgct

SEQ ID NO: 60797 - DNA, 25 bp, Homo sapien
cttgcttcattgagcaggcacaggg

SEQ ID NO: 60798 - DNA, 25 bp, Homo sapien
cttgcttcattgatcaggcacaggg

SEQ ID NO: 60799 - DNA, 25 bp, Homo sapien
cttgcttcctacaaggtctggtgac

SEQ ID NO: 60800 - DNA, 25 bp, Homo sapien
cttgcttcctacagggtctggtgac

SEQ ID NO: 60801 - DNA, 25 bp, Homo sapien
cttgcttcctggacttgccatttac

SEQ ID NO: 60802 - DNA, 25 bp, Homo sapien
cttgcttcgtggacttgccatttac

SEQ ID NO: 60803 - DNA, 25 bp, Homo sapien
cttgcttcttaagtgtatttataga

SEQ ID NO: 60804 - DNA, 25 bp, Homo sapien
cttgcttcttaggtgtatttataga

SEQ ID NO: 60805 - DNA, 25 bp, Homo sapien
cttgcttgcagcttcccaggtgtat

SEQ ID NO: 60806 - DNA, 25 bp, Homo sapien
cttgcttgtagcttcccaggtgtat

SEQ ID NO: 60807 - DNA, 25 bp, Homo sapien
cttgctttaagacagtcctctgata

SEQ ID NO: 60808 - DNA, 25 bp, Homo sapien
cttgctttaagatagtcctctgata

SEQ ID NO: 60809 - DNA, 25 bp, Homo sapien
cttgctttcctgaaatcaatcagaa

SEQ ID NO: 60810 - DNA, 25 bp, Homo sapien
cttgctttcctgaagtcaatcagaa

SEQ ID NO: 60811 - DNA, 25 bp, Homo sapien
cttgctttctttcctgtattgatta

SEQ ID NO: 60812 - DNA, 25 bp, Homo sapien
cttgctttcttttctgtattgatta

SEQ ID NO: 60813 - DNA, 25 bp, Homo sapien
cttgctttgactaacagaatatcat

SEQ ID NO: 60814 - DNA, 25 bp, Homo sapien
cttgctttgactaatagaatatcat

SEQ ID NO: 60815 - DNA, 25 bp, Homo sapien
cttggaaaacggtaaatgtaatcta

SEQ ID NO: 60816 - DNA, 25 bp, Homo sapien
cttggaaaatccacttaacttcctg

SEQ ID NO: 60817 - DNA, 25 bp, Homo sapien
cttggaaaatccacttcacttcctg

SEQ ID NO: 60818 - DNA, 25 bp, Homo sapien
cttggaaaatggtaaatgtaatcta

SEQ ID NO: 60819 - DNA, 25 bp, Homo sapien
cttggaaagaactgattacctgaag

SEQ ID NO: 60820 - DNA, 25 bp, Homo sapien
cttggaaagaattgattacctgaag

SEQ ID NO: 60821 - DNA, 25 bp, Homo sapien
cttggaaaggaagtttaagttggag

SEQ ID NO: 60822 - DNA, 25 bp, Homo sapien
cttggaaatgaagtttaagttggag

SEQ ID NO: 60823 - DNA, 25 bp, Homo sapien
cttggaagacagtggtagaaatggg

SEQ ID NO: 60824 - DNA, 25 bp, Homo sapien
cttggaagagagtggtagaaatggg

SEQ ID NO: 60825 - DNA, 25 bp, Homo sapien
cttggaagagttttatacaggaaag

SEQ ID NO: 60826 - DNA, 25 bp, Homo sapien
cttggaagagttttatgcaggaaag

SEQ ID NO: 60827 - DNA, 25 bp, Homo sapien
cttggaaggccagacaagccagcat

SEQ ID NO: 60828 - DNA, 25 bp, Homo sapien
cttggaaggccagagaagccagcat

SEQ ID NO: 60829 - DNA, 25 bp, Homo sapien
cttggaagtaataacaaaccagaaa

SEQ ID NO: 60830 - DNA, 25 bp, Homo sapien
cttggaagtaataagaaaccagaaa

SEQ ID NO: 60831 - DNA, 25 bp, Homo sapien
cttggaatctgaacccaacaggatc

SEQ ID NO: 60832 - DNA, 25 bp, Homo sapien
cttggaatctgaactcaacaggatc

SEQ ID NO: 60833 - DNA, 25 bp, Homo sapien
cttggacagatcatataatctcttt

SEQ ID NO: 60834 - DNA, 25 bp, Homo sapien
cttggacagatcgtataatctcttt

SEQ ID NO: 60835 - DNA, 25 bp, Homo sapien
cttggacatcatctacatctggatt

SEQ ID NO: 60836 - DNA, 25 bp, Homo sapien
cttggacatcatctgcatctggatt

SEQ ID NO: 60837 - DNA, 25 bp, Homo sapien
cttggactctcaagtagtgtatact

SEQ ID NO: 60838 - DNA, 25 bp, Homo sapien
cttggactgtcaagtagtgtatact

SEQ ID NO: 60839 - DNA, 25 bp, Homo sapien
cttggaggctgcatctgctcttctg

SEQ ID NO: 60840 - DNA, 25 bp, Homo sapien
cttggaggctgtatctgctcttctg

SEQ ID NO: 60841 - DNA, 25 bp, Homo sapien
cttggagtaaacgatttttgcagga

SEQ ID NO: 60842 - DNA, 25 bp, Homo sapien
cttggagtaaatgatttttgcagga

SEQ ID NO: 60843 - DNA, 25 bp, Homo sapien
cttggagtctgttaataaggaattt

SEQ ID NO: 60844 - DNA, 25 bp, Homo sapien
cttggagtctgttaatgaggaattt

SEQ ID NO: 60845 - DNA, 25 bp, Homo sapien
cttggagtgctatgtcttgttccaa

SEQ ID NO: 60846 - DNA, 25 bp, Homo sapien
cttggagtgttatgtcttgttccaa

SEQ ID NO: 60847 - DNA, 25 bp, Homo sapien
cttggatacagattgctaagataaa

SEQ ID NO: 60848 - DNA, 25 bp, Homo sapien
cttggataccgattgctaagataaa

SEQ ID NO: 60849 - DNA, 25 bp, Homo sapien
cttggatataacacatttgtaatac

SEQ ID NO: 60850 - DNA, 25 bp, Homo sapien
cttggatataacgcatttgtaatac

SEQ ID NO: 60851 - DNA, 25 bp, Homo sapien
cttggatggactacatcaccaaggt

SEQ ID NO: 60852 - DNA, 25 bp, Homo sapien
cttggatggcctacatcaccaaggt

SEQ ID NO: 60853 - DNA, 25 bp, Homo sapien
cttggattcaggcttaggacaagca

SEQ ID NO: 60854 - DNA, 25 bp, Homo sapien
cttggattgaaagaaaaggctggga

SEQ ID NO: 60855 - DNA, 25 bp, Homo sapien
cttggattgaaagaaatggctggga

SEQ ID NO: 60856 - DNA, 25 bp, Homo sapien
cttggattgactaagtgtttatgat

SEQ ID NO: 60857 - DNA, 25 bp, Homo sapien
cttggattgactgagtgtttatgat

SEQ ID NO: 60858 - DNA, 25 bp, Homo sapien
cttggatttaggcttaggacaagca

SEQ ID NO: 60859 - DNA, 25 bp, Homo sapien
cttggatttcaacataaaaccttga

SEQ ID NO: 60860 - DNA, 25 bp, Homo sapien
cttggatttcaacatataaccttga

SEQ ID NO: 60861 - DNA, 25 bp, Homo sapien
cttggattttgcacaaattggcttg

SEQ ID NO: 60862 - DNA, 25 bp, Homo sapien
cttggattttgcgcaaattggcttg

SEQ ID NO: 60863 - DNA, 25 bp, Homo sapien
cttggcaaaactagtgatggaggca

SEQ ID NO: 60864 - DNA, 25 bp, Homo sapien
cttggcaaagctagtgatggaggca

SEQ ID NO: 60865 - DNA, 25 bp, Homo sapien
cttggcaagaacgttacaaatgaaa

SEQ ID NO: 60866 - DNA, 25 bp, Homo sapien
cttggcaagaatgttacaaatgaaa

SEQ ID NO: 60867 - DNA, 25 bp, Homo sapien
cttggcacacaaaaatagtttactg

SEQ ID NO: 60868 - DNA, 25 bp, Homo sapien
cttggcacacagaaatagtttactg

SEQ ID NO: 60869 - DNA, 25 bp, Homo sapien
cttggcagaaaatgtaatgcttcta

SEQ ID NO: 60870 - DNA, 25 bp, Homo sapien
cttggcagacctgtatgcattctat

SEQ ID NO: 60871 - DNA, 25 bp, Homo sapien
cttggcaggaaatgtaatgcttcta

SEQ ID NO: 60872 - DNA, 25 bp, Homo sapien
cttggcaggcctgtatgcattctat

SEQ ID NO: 60873 - DNA, 25 bp, Homo sapien
cttggcagggcttagcggtgaacaa

SEQ ID NO: 60874 - DNA, 25 bp, Homo sapien
cttggcagtgcttagcggtgaacaa

SEQ ID NO: 60875 - DNA, 25 bp, Homo sapien
cttggcattactaacgtctcctttc

SEQ ID NO: 60876 - DNA, 25 bp, Homo sapien
cttggcattactaatgtctcctttc

SEQ ID NO: 60877 - DNA, 25 bp, Homo sapien
cttggccacattacttatgtagaat

SEQ ID NO: 60878 - DNA, 25 bp, Homo sapien
cttggccacattgcttatgtagaat

SEQ ID NO: 60879 - DNA, 25 bp, Homo sapien
cttggctagatcacagctctgtggc

SEQ ID NO: 60880 - DNA, 25 bp, Homo sapien
cttggctaggtcacagctctgtggc

SEQ ID NO: 60881 - DNA, 25 bp, Homo sapien
cttggctccctgctcatatttaaga

SEQ ID NO: 60882 - DNA, 25 bp, Homo sapien
cttggctccctgttcatatttaaga

SEQ ID NO: 60883 - DNA, 25 bp, Homo sapien
cttggctctccagtgtatgtaatgc

SEQ ID NO: 60884 - DNA, 25 bp, Homo sapien
cttggctctccagtgtgtgtaatgc

SEQ ID NO: 60885 - DNA, 25 bp, Homo sapien
cttggctcttcttagatgagaccca

SEQ ID NO: 60886 - DNA, 25 bp, Homo sapien
cttggctcttcttcgatgagaccca

SEQ ID NO: 60887 - DNA, 25 bp, Homo sapien
cttggctgtaggctccatgaaaggg

SEQ ID NO: 60888 - DNA, 25 bp, Homo sapien
cttggctgtaggctccttgaaaggg

SEQ ID NO: 60889 - DNA, 25 bp, Homo sapien
cttggctgtgctatgaaacctggaa

SEQ ID NO: 60890 - DNA, 25 bp, Homo sapien
cttggctgtgctctgaaacctggaa

SEQ ID NO: 60891 - DNA, 25 bp, Homo sapien
cttggcttactctttcattttactg

SEQ ID NO: 60892 - DNA, 25 bp, Homo sapien
cttggcttactctttccttttactg

SEQ ID NO: 60893 - DNA, 25 bp, Homo sapien
cttggcttatggccacatcattccc

SEQ ID NO: 60894 - DNA, 25 bp, Homo sapien
cttggcttatggtcacatcattccc

SEQ ID NO: 60895 - DNA, 25 bp, Homo sapien
cttggcttcgtatccccacaatatc

SEQ ID NO: 60896 - DNA, 25 bp, Homo sapien
cttggctttgtatacttccacggtg

SEQ ID NO: 60897 - DNA, 25 bp, Homo sapien
cttggctttgtatccccacaatatc

SEQ ID NO: 60898 - DNA, 25 bp, Homo sapien
cttggctttgtgtacttccacggtg

SEQ ID NO: 60899 - DNA, 25 bp, Homo sapien
cttggctttttaagtgatagcttgc

SEQ ID NO: 60900 - DNA, 25 bp, Homo sapien
cttggctttttaggtgatagcttgc

SEQ ID NO: 60901 - DNA, 25 bp, Homo sapien
cttgggacaagaaatactaaacact

SEQ ID NO: 60902 - DNA, 25 bp, Homo sapien
cttgggacactgacagccagactta

SEQ ID NO: 60903 - DNA, 25 bp, Homo sapien
cttgggacactgacggccagactta

SEQ ID NO: 60904 - DNA, 25 bp, Homo sapien
cttgggaccagaaatactaaacact

SEQ ID NO: 60905 - DNA, 25 bp, Homo sapien
cttgggcatccaccgggagcttttc

SEQ ID NO: 60906 - DNA, 25 bp, Homo sapien
cttgggcatccactgggagcttttc

SEQ ID NO: 60907 - DNA, 25 bp, Homo sapien
cttgggccacgcactatccaagtga

SEQ ID NO: 60908 - DNA, 25 bp, Homo sapien
cttgggccacgcgctatccaagtga

SEQ ID NO: 60909 - DNA, 25 bp, Homo sapien
cttgggccatgactgaacatcagca

SEQ ID NO: 60910 - DNA, 25 bp, Homo sapien
cttgggccatgattgaacatcagca

SEQ ID NO: 60911 - DNA, 25 bp, Homo sapien
cttggggcaggacgttctccttctg

SEQ ID NO: 60912 - DNA, 25 bp, Homo sapien
cttggggcaggatgttctccttctg

SEQ ID NO: 60913 - DNA, 25 bp, Homo sapien
cttgggggctttctttagaatgact

SEQ ID NO: 60914 - DNA, 25 bp, Homo sapien
cttgggggctttgtttagaatgact

SEQ ID NO: 60915 - DNA, 25 bp, Homo sapien
cttggggtatcaatgagagaagagg

SEQ ID NO: 60916 - DNA, 25 bp, Homo sapien
cttggggtatcagtgagagaagagg

SEQ ID NO: 60917 - DNA, 25 bp, Homo sapien
cttggggtggttgcccagctcatta

SEQ ID NO: 60918 - DNA, 25 bp, Homo sapien
cttggggtggttggccagctcatta

SEQ ID NO: 60919 - DNA, 25 bp, Homo sapien
cttgggtatttactctaggaaatct

SEQ ID NO: 60920 - DNA, 25 bp, Homo sapien
cttgggtatttactcttggaaatct

SEQ ID NO: 60921 - DNA, 25 bp, Homo sapien
cttgggtcattggtcccattccact

SEQ ID NO: 60922 - DNA, 25 bp, Homo sapien
cttgggtcgttggtcccattccact

SEQ ID NO: 60923 - DNA, 25 bp, Homo sapien
cttgggtgcagagtagatatggttt

SEQ ID NO: 60924 - DNA, 25 bp, Homo sapien
cttgggtgcggagtagatatggttt

SEQ ID NO: 60925 - DNA, 25 bp, Homo sapien
cttgggtggtggcaacacagacttg

SEQ ID NO: 60926 - DNA, 25 bp, Homo sapien
cttgggtggtggctacacagacttg

SEQ ID NO: 60927 - DNA, 25 bp, Homo sapien
cttgggttcatgacagtggctagag

SEQ ID NO: 60928 - DNA, 25 bp, Homo sapien
cttgggttcatgaccgtggctagag

SEQ ID NO: 60929 - DNA, 25 bp, Homo sapien
cttgggttccgctcagcaacaaaga

SEQ ID NO: 60930 - DNA, 25 bp, Homo sapien
cttgggtttcgctcagcaacaaaga

SEQ ID NO: 60931 - DNA, 25 bp, Homo sapien
cttgggttttgactgggattatgac

SEQ ID NO: 60932 - DNA, 25 bp, Homo sapien
cttgggttttgattgggattatgac

SEQ ID NO: 60933 - DNA, 25 bp, Homo sapien
cttggtacctccactgaattaaaga

SEQ ID NO: 60934 - DNA, 25 bp, Homo sapien
cttggtacctccattgaattaaaga

SEQ ID NO: 60935 - DNA, 25 bp, Homo sapien
cttggtatcattagtttctgtgatc

SEQ ID NO: 60936 - DNA, 25 bp, Homo sapien
cttggtatcattattttctgtgatc

SEQ ID NO: 60937 - DNA, 25 bp, Homo sapien
cttggtatcctcatctgtaatgtgg

SEQ ID NO: 60938 - DNA, 25 bp, Homo sapien
cttggtatgctcatctgtaatgtgg

SEQ ID NO: 60939 - DNA, 25 bp, Homo sapien
cttggtcaccgcacaggaacaggga

SEQ ID NO: 60940 - DNA, 25 bp, Homo sapien
cttggtcactgcacaggaacaggga

SEQ ID NO: 60941 - DNA, 25 bp, Homo sapien
cttggtcattttgggttcatttgtt

SEQ ID NO: 60942 - DNA, 25 bp, Homo sapien
cttggtcattttgtgttcatttgtt

SEQ ID NO: 60943 - DNA, 25 bp, Homo sapien
cttggtccactgacttatcttggca

SEQ ID NO: 60944 - DNA, 25 bp, Homo sapien
cttggtccattgacttatcttggca

SEQ ID NO: 60945 - DNA, 25 bp, Homo sapien
cttggtgcaatatcttatacaaagc

SEQ ID NO: 60946 - DNA, 25 bp, Homo sapien
cttggtgcaatgtcttatacaaagc

SEQ ID NO: 60947 - DNA, 25 bp, Homo sapien
cttggtgggacgaaagaagcttgtg

SEQ ID NO: 60948 - DNA, 25 bp, Homo sapien
cttggtgggacgaatgaagcttgtg

SEQ ID NO: 60949 - DNA, 25 bp, Homo sapien
cttggtggtatgtttgcagtgacaa

SEQ ID NO: 60950 - DNA, 25 bp, Homo sapien
cttggtggtatgtttgtagtgacaa

SEQ ID NO: 60951 - DNA, 25 bp, Homo sapien
cttggtggtgccggactccagttct

SEQ ID NO: 60952 - DNA, 25 bp, Homo sapien
cttggtggtgctggactccagttct

SEQ ID NO: 60953 - DNA, 25 bp, Homo sapien
cttggtgtcatctttctttactaag

SEQ ID NO: 60954 - DNA, 25 bp, Homo sapien
cttggtgtcctccttccctgtcctg

SEQ ID NO: 60955 - DNA, 25 bp, Homo sapien
cttggtgtcctctttccctgtcctg

SEQ ID NO: 60956 - DNA, 25 bp, Homo sapien
cttggtgtcgtctttctttactaag

SEQ ID NO: 60957 - DNA, 25 bp, Homo sapien
cttggttttatacattgaaggagac

SEQ ID NO: 60958 - DNA, 25 bp, Homo sapien
cttggttttatgcattgaaggagac

SEQ ID NO: 60959 - DNA, 25 bp, Homo sapien
cttggttttcctttatcagcctttt

SEQ ID NO: 60960 - DNA, 25 bp, Homo sapien
cttggttttcctttattagcctttt

SEQ ID NO: 60961 - DNA, 25 bp, Homo sapien
cttggtttttgacatctgaaaagcc

SEQ ID NO: 60962 - DNA, 25 bp, Homo sapien
cttggtttttgacgtctgaaaagcc

SEQ ID NO: 60963 - DNA, 25 bp, Homo sapien
cttgtaaaactcccatttcgacatt

SEQ ID NO: 60964 - DNA, 25 bp, Homo sapien
cttgtaaaactcccgtttcgacatt

SEQ ID NO: 60965 - DNA, 25 bp, Homo sapien
cttgtaaatcgatcgctttctttct

SEQ ID NO: 60966 - DNA, 25 bp, Homo sapien
cttgtaaatcgattgctttctttct

SEQ ID NO: 60967 - DNA, 25 bp, Homo sapien
cttgtaattgcaagtgcaaaaacct

SEQ ID NO: 60968 - DNA, 25 bp, Homo sapien
cttgtaatttcaagtgcaaaaacct

SEQ ID NO: 60969 - DNA, 25 bp, Homo sapien
cttgtaatttcagcagaaaaatcta

SEQ ID NO: 60970 - DNA, 25 bp, Homo sapien
cttgtaatttcagtagaaaaatcta

SEQ ID NO: 60971 - DNA, 25 bp, Homo sapien
cttgtacacggtatagctcaatacg

SEQ ID NO: 60972 - DNA, 25 bp, Homo sapien
cttgtacatggtatagctcaatacg

SEQ ID NO: 60973 - DNA, 25 bp, Homo sapien
cttgtacctccactataccatgcct

SEQ ID NO: 60974 - DNA, 25 bp, Homo sapien
cttgtacctccgctataccatgcct

SEQ ID NO: 60975 - DNA, 25 bp, Homo sapien
cttgtacgctaggaattttctcatg

SEQ ID NO: 60976 - DNA, 25 bp, Homo sapien
cttgtacgctaggcattttctcatg

SEQ ID NO: 60977 - DNA, 25 bp, Homo sapien
cttgtactccactgcattcccagta

SEQ ID NO: 60978 - DNA, 25 bp, Homo sapien
cttgtactccacttcattcccagta

SEQ ID NO: 60979 - DNA, 25 bp, Homo sapien
cttgtactgtcaccaccagataaca

SEQ ID NO: 60980 - DNA, 25 bp, Homo sapien
cttgtactgtcaccactagataaca

SEQ ID NO: 60981 - DNA, 25 bp, Homo sapien
cttgtacttttcttttggtggccac

SEQ ID NO: 60982 - DNA, 25 bp, Homo sapien
cttgtactttttttttggtggccac

SEQ ID NO: 60983 - DNA, 25 bp, Homo sapien
cttgtagaagtagcttccagctcta

SEQ ID NO: 60984 - DNA, 25 bp, Homo sapien
cttgtagaattagcttccagctcta

SEQ ID NO: 60985 - DNA, 25 bp, Homo sapien
cttgtagacaggataactcatttaa

SEQ ID NO: 60986 - DNA, 25 bp, Homo sapien
cttgtagataggataactcatttaa

SEQ ID NO: 60987 - DNA, 25 bp, Homo sapien
cttgtagctagggcactgaagatat

SEQ ID NO: 60988 - DNA, 25 bp, Homo sapien
cttgtagctggggcactgaagatat

SEQ ID NO: 60989 - DNA, 25 bp, Homo sapien
cttgtaggatcccgcaaagaacaac

SEQ ID NO: 60990 - DNA, 25 bp, Homo sapien
cttgtaggatcctgcaaagaacaac

SEQ ID NO: 60991 - DNA, 25 bp, Homo sapien
cttgtagtcaactggagaagacaga

SEQ ID NO: 60992 - DNA, 25 bp, Homo sapien
cttgtagtcaattggagaagacaga

SEQ ID NO: 60993 - DNA, 25 bp, Homo sapien
cttgtataatctatccataagtgtg

SEQ ID NO: 60994 - DNA, 25 bp, Homo sapien
cttgtataatctctccataagtgtg

SEQ ID NO: 60995 - DNA, 25 bp, Homo sapien
cttgtatatgatggagtaggtagat

SEQ ID NO: 60996 - DNA, 25 bp, Homo sapien
cttgtatatgatggtgtaggtagat

SEQ ID NO: 60997 - DNA, 25 bp, Homo sapien
cttgtatatgccattttataacctt

SEQ ID NO: 60998 - DNA, 25 bp, Homo sapien
cttgtatatgccgttttataacctt

SEQ ID NO: 60999 - DNA, 25 bp, Homo sapien
cttgtatgattccaggctaagattg

SEQ ID NO: 61000 - DNA, 25 bp, Homo sapien
cttgtatgattccaggttaagattg

SEQ ID NO: 61001 - DNA, 25 bp, Homo sapien
cttgtatttaaccaatatttagagg

SEQ ID NO: 61002 - DNA, 25 bp, Homo sapien
cttgtatttaaccattatttagagg

SEQ ID NO: 61003 - DNA, 25 bp, Homo sapien
cttgtatttgctcggtgaagtgaaa

SEQ ID NO: 61004 - DNA, 25 bp, Homo sapien
cttgtatttgcttggtgaagtgaaa

SEQ ID NO: 61005 - DNA, 25 bp, Homo sapien
cttgtcaaatccaattatctgctta

SEQ ID NO: 61006 - DNA, 25 bp, Homo sapien
cttgtcaaatccagttatctgctta

SEQ ID NO: 61007 - DNA, 25 bp, Homo sapien
cttgtcactcaagtaatgcctatcc

SEQ ID NO: 61008 - DNA, 25 bp, Homo sapien
cttgtcacttaagtaatgcctatcc

SEQ ID NO: 61009 - DNA, 25 bp, Homo sapien
cttgtcagtttccttatcacccacc

SEQ ID NO: 61010 - DNA, 25 bp, Homo sapien
cttgtcagtttctttatcacccacc

SEQ ID NO: 61011 - DNA, 25 bp, Homo sapien
cttgtcatgtcacgaaaacatctag

SEQ ID NO: 61012 - DNA, 25 bp, Homo sapien
cttgtcatgtcgcgaaaacatctag

SEQ ID NO: 61013 - DNA, 25 bp, Homo sapien
cttgtcattcaggttaaagagaaac

SEQ ID NO: 61014 - DNA, 25 bp, Homo sapien
cttgtcattcagtttaaagagaaac

SEQ ID NO: 61015 - DNA, 25 bp, Homo sapien
cttgtcccaaaccaccagagtgcca

SEQ ID NO: 61016 - DNA, 25 bp, Homo sapien
cttgtcccaaaccagcagagtgcca

SEQ ID NO: 61017 - DNA, 25 bp, Homo sapien
cttgtcctcaagatttcaaaagcta

SEQ ID NO: 61018 - DNA, 25 bp, Homo sapien
cttgtcctcaaggtttcaaaagcta

SEQ ID NO: 61019 - DNA, 25 bp, Homo sapien
cttgtcctgcgacagtgttcagggt

SEQ ID NO: 61020 - DNA, 25 bp, Homo sapien
cttgtcctgtgacagtgttcagggt

SEQ ID NO: 61021 - DNA, 25 bp, Homo sapien
cttgtcctttatttcggcagatgtt

SEQ ID NO: 61022 - DNA, 25 bp, Homo sapien
cttgtcctttattttggcagatgtt

SEQ ID NO: 61023 - DNA, 25 bp, Homo sapien
cttgtctcactgatcttagataagc

SEQ ID NO: 61024 - DNA, 25 bp, Homo sapien
cttgtctcgctgatcttagataagc

SEQ ID NO: 61025 - DNA, 25 bp, Homo sapien
cttgtctgcattcgttaaaggaaaa

SEQ ID NO: 61026 - DNA, 25 bp, Homo sapien
cttgtctgcatttgttaaaggaaaa

SEQ ID NO: 61027 - DNA, 25 bp, Homo sapien
cttgtctgtaccagaaaattcctcc

SEQ ID NO: 61028 - DNA, 25 bp, Homo sapien
cttgtctgtacctgaaaattcctcc

SEQ ID NO: 61029 - DNA, 25 bp, Homo sapien
cttgtctgttctaccaaggactcgg

SEQ ID NO: 61030 - DNA, 25 bp, Homo sapien
cttgtctgttctaccagggactcgg

SEQ ID NO: 61031 - DNA, 25 bp, Homo sapien
cttgtcttagtgacgatttttcttg

SEQ ID NO: 61032 - DNA, 25 bp, Homo sapien
cttgtcttagtgatgatttttcttg

SEQ ID NO: 61033 - DNA, 25 bp, Homo sapien
cttgtcttcaatttagaaagctcta

SEQ ID NO: 61034 - DNA, 25 bp, Homo sapien
cttgtcttccatttagaaagctcta

SEQ ID NO: 61035 - DNA, 25 bp, Homo sapien
cttgtgaaaaaacattaagttacca

SEQ ID NO: 61036 - DNA, 25 bp, Homo sapien
cttgtgaaaaaatattaagttacca

SEQ ID NO: 61037 - DNA, 25 bp, Homo sapien
cttgtgaaataagactgagcttttg

SEQ ID NO: 61038 - DNA, 25 bp, Homo sapien
cttgtgaaataggactgagcttttg

SEQ ID NO: 61039 - DNA, 25 bp, Homo sapien
cttgtgaaatcacctttaactgtgt

SEQ ID NO: 61040 - DNA, 25 bp, Homo sapien
cttgtgaaatcagctttaactgtgt

SEQ ID NO: 61041 - DNA, 25 bp, Homo sapien
cttgtgaaatttgaccactaatgca

SEQ ID NO: 61042 - DNA, 25 bp, Homo sapien
cttgtgaaatttgatcactaatgca

SEQ ID NO: 61043 - DNA, 25 bp, Homo sapien
cttgtgatctctaccactattttgg

SEQ ID NO: 61044 - DNA, 25 bp, Homo sapien
cttgtgatctctactactattttgg

SEQ ID NO: 61045 - DNA, 25 bp, Homo sapien
cttgtgattccacgagtcaacactc

SEQ ID NO: 61046 - DNA, 25 bp, Homo sapien
cttgtgattccgcgagtcaacactc

SEQ ID NO: 61047 - DNA, 25 bp, Homo sapien
cttgtgcaagctcaataagaacagg

SEQ ID NO: 61048 - DNA, 25 bp, Homo sapien
cttgtgcaagctcaatgagaacagg

SEQ ID NO: 61049 - DNA, 25 bp, Homo sapien
cttgtgcctcgattccagaagtaga

SEQ ID NO: 61050 - DNA, 25 bp, Homo sapien
cttgtgccttcttagtatcgtaact

SEQ ID NO: 61051 - DNA, 25 bp, Homo sapien
cttgtgccttcttagtgtcgtaact

SEQ ID NO: 61052 - DNA, 25 bp, Homo sapien
cttgtgccttgattccagaagtaga

SEQ ID NO: 61053 - DNA, 25 bp, Homo sapien
cttgtggcataacttgcggtccagt

SEQ ID NO: 61054 - DNA, 25 bp, Homo sapien
cttgtggcataatttgcggtccagt

SEQ ID NO: 61055 - DNA, 25 bp, Homo sapien
cttgtgggcatttgagttttcaatg

SEQ ID NO: 61056 - DNA, 25 bp, Homo sapien
cttgtgggcatttgcgttttcaatg

SEQ ID NO: 61057 - DNA, 25 bp, Homo sapien
cttgtgtccatttactatgttgttg

SEQ ID NO: 61058 - DNA, 25 bp, Homo sapien
cttgtgtccatttagtatgttgttg

SEQ ID NO: 61059 - DNA, 25 bp, Homo sapien
cttgtgtgattaaagtgggctcacc

SEQ ID NO: 61060 - DNA, 25 bp, Homo sapien
cttgtgtgattgaagtgggctcacc

SEQ ID NO: 61061 - DNA, 25 bp, Homo sapien
cttgtgtgcttaaatgatgcgggct

SEQ ID NO: 61062 - DNA, 25 bp, Homo sapien
cttgtgtgcttaaatggtgcgggct

SEQ ID NO: 61063 - DNA, 25 bp, Homo sapien
cttgtgttcaaagcagcgctattca

SEQ ID NO: 61064 - DNA, 25 bp, Homo sapien
cttgtgttcaaagcagtgctattca

SEQ ID NO: 61065 - DNA, 25 bp, Homo sapien
cttgtgttcatgatattctgtcttc

SEQ ID NO: 61066 - DNA, 25 bp, Homo sapien
cttgtgtttatgatattctgtcttc

SEQ ID NO: 61067 - DNA, 25 bp, Homo sapien
cttgttaaacgctaatctcccacac

SEQ ID NO: 61068 - DNA, 25 bp, Homo sapien
cttgttaaatgctaatctcccacac

SEQ ID NO: 61069 - DNA, 25 bp, Homo sapien
cttgttaactctcctgtgttcatct

SEQ ID NO: 61070 - DNA, 25 bp, Homo sapien
cttgttaactctcttgtgttcatct

SEQ ID NO: 61071 - DNA, 25 bp, Homo sapien
cttgttacattttaagagtgacaag

SEQ ID NO: 61072 - DNA, 25 bp, Homo sapien
cttgttacattttacgagtgacaag

SEQ ID NO: 61073 - DNA, 25 bp, Homo sapien
cttgttaccccggaatatgctgtgt

SEQ ID NO: 61074 - DNA, 25 bp, Homo sapien
cttgttaccccgggatatgctgtgt

SEQ ID NO: 61075 - DNA, 25 bp, Homo sapien
cttgttagcataagccactgagttt

SEQ ID NO: 61076 - DNA, 25 bp, Homo sapien
cttgttagcataatggacttgtgac

SEQ ID NO: 61077 - DNA, 25 bp, Homo sapien
cttgttagcataatggccttgtgac

SEQ ID NO: 61078 - DNA, 25 bp, Homo sapien
cttgttagcgtaagccactgagttt

SEQ ID NO: 61079 - DNA, 25 bp, Homo sapien
cttgttaggcaaaaaccttggaagt

SEQ ID NO: 61080 - DNA, 25 bp, Homo sapien
cttgttaggctgcttctttgccttt

SEQ ID NO: 61081 - DNA, 25 bp, Homo sapien
cttgttaggcttcttctttgccttt

SEQ ID NO: 61082 - DNA, 25 bp, Homo sapien
cttgttagtcaaaaaccttggaagt

SEQ ID NO: 61083 - DNA, 25 bp, Homo sapien
cttgttatgacaggacacaaaggag

SEQ ID NO: 61084 - DNA, 25 bp, Homo sapien
cttgttatgacagggcacaaaggag

SEQ ID NO: 61085 - DNA, 25 bp, Homo sapien
cttgttcagcaatttcctagctgaa

SEQ ID NO: 61086 - DNA, 25 bp, Homo sapien
cttgttcagcactttcctagctgaa

SEQ ID NO: 61087 - DNA, 25 bp, Homo sapien
cttgttcatcgcctatcaagcacta

SEQ ID NO: 61088 - DNA, 25 bp, Homo sapien
cttgttcatgttgcaatttgagcgg

SEQ ID NO: 61089 - DNA, 25 bp, Homo sapien
cttgttcattgcctatcaagcacta

SEQ ID NO: 61090 - DNA, 25 bp, Homo sapien
cttgttcattttgcaatttgagcgg

SEQ ID NO: 61091 - DNA, 25 bp, Homo sapien
cttgttccaataaaacgttactaaa

SEQ ID NO: 61092 - DNA, 25 bp, Homo sapien
cttgttccaatagaacgttactaaa

SEQ ID NO: 61093 - DNA, 25 bp, Homo sapien
cttgttctcgccacatcagtgtttt

SEQ ID NO: 61094 - DNA, 25 bp, Homo sapien
cttgttctcgccgcatcagtgtttt

SEQ ID NO: 61095 - DNA, 25 bp, Homo sapien
cttgttctcttggcaagttcatagt

SEQ ID NO: 61096 - DNA, 25 bp, Homo sapien
cttgttctcttggccagttcatagt

SEQ ID NO: 61097 - DNA, 25 bp, Homo sapien
cttgttctctttccatctgggtcta

SEQ ID NO: 61098 - DNA, 25 bp, Homo sapien
cttgttctctttccgtctgggtcta

SEQ ID NO: 61099 - DNA, 25 bp, Homo sapien
cttgttcttactgatcatttataaa

SEQ ID NO: 61100 - DNA, 25 bp, Homo sapien
cttgttcttactgatcgtttataaa

SEQ ID NO: 61101 - DNA, 25 bp, Homo sapien
cttgttgatgacagtctccaggccc

SEQ ID NO: 61102 - DNA, 25 bp, Homo sapien
cttgttgatgacggtctccaggccc

SEQ ID NO: 61103 - DNA, 25 bp, Homo sapien
cttgttgcaataagataaccaattt

SEQ ID NO: 61104 - DNA, 25 bp, Homo sapien
cttgttgcaatcagataaccaattt

SEQ ID NO: 61105 - DNA, 25 bp, Homo sapien
cttgttgcactccatcacattaaaa

SEQ ID NO: 61106 - DNA, 25 bp, Homo sapien
cttgttgcactctatcacattaaaa

SEQ ID NO: 61107 - DNA, 25 bp, Homo sapien
cttgttgcctccacggactatgaag

SEQ ID NO: 61108 - DNA, 25 bp, Homo sapien
cttgttgcctccagggactatgaag

SEQ ID NO: 61109 - DNA, 25 bp, Homo sapien
cttgttgcttagacaatgcctagtc

SEQ ID NO: 61110 - DNA, 25 bp, Homo sapien
cttgttgcttagaccatgcctagtc

SEQ ID NO: 61111 - DNA, 25 bp, Homo sapien
cttgttggcatgttaatttcttctc

SEQ ID NO: 61112 - DNA, 25 bp, Homo sapien
cttgttggtatgttaatttcttctc

SEQ ID NO: 61113 - DNA, 25 bp, Homo sapien
cttgttggtccttccagatcttaaa

SEQ ID NO: 61114 - DNA, 25 bp, Homo sapien
cttgttggttcttccagatcttaaa

SEQ ID NO: 61115 - DNA, 25 bp, Homo sapien
cttgttgtacagtgcaacagtttca

SEQ ID NO: 61116 - DNA, 25 bp, Homo sapien
cttgttgtacagtgcagcagtttca

SEQ ID NO: 61117 - DNA, 25 bp, Homo sapien
cttgttgtgagaccagacaaagatt

SEQ ID NO: 61118 - DNA, 25 bp, Homo sapien
cttgttgtgagatcagacaaagatt

SEQ ID NO: 61119 - DNA, 25 bp, Homo sapien
cttgttgttgttccaaagttacaat

SEQ ID NO: 61120 - DNA, 25 bp, Homo sapien
cttgttgttgtttcaaagttacaat

SEQ ID NO: 61121 - DNA, 25 bp, Homo sapien
cttgtttatgttcctattgcctgtc

SEQ ID NO: 61122 - DNA, 25 bp, Homo sapien
cttgtttatgtttctattgcctgtc

SEQ ID NO: 61123 - DNA, 25 bp, Homo sapien
cttgtttcagttagcattttcagct

SEQ ID NO: 61124 - DNA, 25 bp, Homo sapien
cttgtttcagttagtattttcagct

SEQ ID NO: 61125 - DNA, 25 bp, Homo sapien
cttgtttcttaaatgggttgctttt

SEQ ID NO: 61126 - DNA, 25 bp, Homo sapien
cttgtttcttaattgggttgctttt

SEQ ID NO: 61127 - DNA, 25 bp, Homo sapien
cttgtttgctaacaatgatgaaaca

SEQ ID NO: 61128 - DNA, 25 bp, Homo sapien
cttgtttgctagcaatgatgaaaca

SEQ ID NO: 61129 - DNA, 25 bp, Homo sapien
cttgtttggtctgcctgtaacattt

SEQ ID NO: 61130 - DNA, 25 bp, Homo sapien
cttgtttgttctgcctgtaacattt

SEQ ID NO: 61131 - DNA, 25 bp, Homo sapien
cttgtttttacactaattcacaaat

SEQ ID NO: 61132 - DNA, 25 bp, Homo sapien
cttgtttttacgctaattcacaaat

SEQ ID NO: 61133 - DNA, 25 bp, Homo sapien
ctttaaaacagagaccttgtttatg

SEQ ID NO: 61134 - DNA, 25 bp, Homo sapien
ctttaaaacagaggccttgtttatg

SEQ ID NO: 61135 - DNA, 25 bp, Homo sapien
ctttaaaactcagatctaacaaagt

SEQ ID NO: 61136 - DNA, 25 bp, Homo sapien
ctttaaaactcatatctaacaaagt

SEQ ID NO: 61137 - DNA, 25 bp, Homo sapien
ctttaaaactttcattaaacatggt

SEQ ID NO: 61138 - DNA, 25 bp, Homo sapien
ctttaaaactttcgttaaacatggt

SEQ ID NO: 61139 - DNA, 25 bp, Homo sapien
ctttaaaccactgaaatgtacttgt

SEQ ID NO: 61140 - DNA, 25 bp, Homo sapien
ctttaaactactgaaatgtacttgt

SEQ ID NO: 61141 - DNA, 25 bp, Homo sapien
ctttaaagcacattatcacagatgt

SEQ ID NO: 61142 - DNA, 25 bp, Homo sapien
ctttaaagcacgttatcacagatgt

SEQ ID NO: 61143 - DNA, 25 bp, Homo sapien
ctttaaagcgatttcctgccactgg

SEQ ID NO: 61144 - DNA, 25 bp, Homo sapien
ctttaaagctcacgtctgtagaagc

SEQ ID NO: 61145 - DNA, 25 bp, Homo sapien
ctttaaagctcatgtctgtagaagc

SEQ ID NO: 61146 - DNA, 25 bp, Homo sapien
ctttaaagtgatttcctgccactgg

SEQ ID NO: 61147 - DNA, 25 bp, Homo sapien
ctttaaatttattaccacaaacctc

SEQ ID NO: 61148 - DNA, 25 bp, Homo sapien
ctttaaatttattaccgcaaacctc

SEQ ID NO: 61149 - DNA, 25 bp, Homo sapien
ctttaacaccattaccatggaaaca

SEQ ID NO: 61150 - DNA, 25 bp, Homo sapien
ctttaacatcattaccatggaaaca

SEQ ID NO: 61151 - DNA, 25 bp, Homo sapien
ctttaaccttccatttctatgataa

SEQ ID NO: 61152 - DNA, 25 bp, Homo sapien
ctttaaccttccgtttctatgataa

SEQ ID NO: 61153 - DNA, 25 bp, Homo sapien
ctttaagatcgcataatgcatctga

SEQ ID NO: 61154 - DNA, 25 bp, Homo sapien
ctttaagattgcataatgcatctga

SEQ ID NO: 61155 - DNA, 25 bp, Homo sapien
ctttaagcttattaaactccatgac

SEQ ID NO: 61156 - DNA, 25 bp, Homo sapien
ctttaagcttattaaattccatgac

SEQ ID NO: 61157 - DNA, 25 bp, Homo sapien
ctttaaggaatggccgatgcccagt

SEQ ID NO: 61158 - DNA, 25 bp, Homo sapien
ctttaaggaatggctgatgcccagt

SEQ ID NO: 61159 - DNA, 25 bp, Homo sapien
ctttaagtctaagtagaagcgacgt

SEQ ID NO: 61160 - DNA, 25 bp, Homo sapien
ctttaagtctatgtagaagcgacgt

SEQ ID NO: 61161 - DNA, 25 bp, Homo sapien
ctttaagttataatatccctaagct

SEQ ID NO: 61162 - DNA, 25 bp, Homo sapien
ctttaagttataatttccctaagct

SEQ ID NO: 61163 - DNA, 25 bp, Homo sapien
ctttaatatacggttagtgtgtgag

SEQ ID NO: 61164 - DNA, 25 bp, Homo sapien
ctttaatatactgttagtgtgtgag

SEQ ID NO: 61165 - DNA, 25 bp, Homo sapien
ctttaatccagccaatgtcatttcc

SEQ ID NO: 61166 - DNA, 25 bp, Homo sapien
ctttaatccagcccatgtcatttcc

SEQ ID NO: 61167 - DNA, 25 bp, Homo sapien
ctttaatctacataacactggaagt

SEQ ID NO: 61168 - DNA, 25 bp, Homo sapien
ctttaatctacgtaacactggaagt

SEQ ID NO: 61169 - DNA, 25 bp, Homo sapien
ctttaatctgtatttgcttgaatgg

SEQ ID NO: 61170 - DNA, 25 bp, Homo sapien
ctttaatctgtatttgtttgaatgg

SEQ ID NO: 61171 - DNA, 25 bp, Homo sapien
ctttaatcttatccatgaccttttt

SEQ ID NO: 61172 - DNA, 25 bp, Homo sapien
ctttaatcttatccgtgaccttttt

SEQ ID NO: 61173 - DNA, 25 bp, Homo sapien
ctttaatgaaaatcagtagaccatg

SEQ ID NO: 61174 - DNA, 25 bp, Homo sapien
ctttaatgaaaatcggtagaccatg

SEQ ID NO: 61175 - DNA, 25 bp, Homo sapien
ctttaatggaaaactctttcagttt

SEQ ID NO: 61176 - DNA, 25 bp, Homo sapien
ctttaatggaaatctctttcagttt

SEQ ID NO: 61177 - DNA, 25 bp, Homo sapien
ctttacaaaaagaaaaaattagtat

SEQ ID NO: 61178 - DNA, 25 bp, Homo sapien
ctttacaaaaaggaaaaattagtat

SEQ ID NO: 61179 - DNA, 25 bp, Homo sapien
ctttacaaagatgcgtcttttcctg

SEQ ID NO: 61180 - DNA, 25 bp, Homo sapien
ctttacaaagatgtgtcttttcctg

SEQ ID NO: 61181 - DNA, 25 bp, Homo sapien
ctttacaactgaagggagggatgag

SEQ ID NO: 61182 - DNA, 25 bp, Homo sapien
ctttacaattgaagggagggatgag

SEQ ID NO: 61183 - DNA, 25 bp, Homo sapien
ctttacacaataagacctaagaagt

SEQ ID NO: 61184 - DNA, 25 bp, Homo sapien
ctttacacagtaagacctaagaagt

SEQ ID NO: 61185 - DNA, 25 bp, Homo sapien
ctttacatcaatgaagcagatttgg

SEQ ID NO: 61186 - DNA, 25 bp, Homo sapien
ctttacatcgatgaagcagatttgg

SEQ ID NO: 61187 - DNA, 25 bp, Homo sapien
ctttaccaactcagtcaatgtcatc

SEQ ID NO: 61188 - DNA, 25 bp, Homo sapien
ctttaccaattcagtcaatgtcatc

SEQ ID NO: 61189 - DNA, 25 bp, Homo sapien
ctttaccagtgaagtgggtgtaaga

SEQ ID NO: 61190 - DNA, 25 bp, Homo sapien
ctttaccagtgaggtgggtgtaaga

SEQ ID NO: 61191 - DNA, 25 bp, Homo sapien
ctttacccataatttccaggtggat

SEQ ID NO: 61192 - DNA, 25 bp, Homo sapien
ctttacccgtaatttccaggtggat

SEQ ID NO: 61193 - DNA, 25 bp, Homo sapien
ctttacctgattctcaaatgacaga

SEQ ID NO: 61194 - DNA, 25 bp, Homo sapien
ctttacctgcttctcaaatgacaga

SEQ ID NO: 61195 - DNA, 25 bp, Homo sapien
ctttaccttcatcctgcaattaaaa

SEQ ID NO: 61196 - DNA, 25 bp, Homo sapien
ctttacctttaacgaaacagaaatt

SEQ ID NO: 61197 - DNA, 25 bp, Homo sapien
ctttacctttaatgaaacagaaatt

SEQ ID NO: 61198 - DNA, 25 bp, Homo sapien
ctttacctttatcctgcaattaaaa

SEQ ID NO: 61199 - DNA, 25 bp, Homo sapien
ctttacggtgctgccaaaaactatc

SEQ ID NO: 61200 - DNA, 25 bp, Homo sapien
ctttacggtgctgtcaaaaactatc

SEQ ID NO: 61201 - DNA, 25 bp, Homo sapien
ctttacgtcttagtcaacacttaat

SEQ ID NO: 61202 - DNA, 25 bp, Homo sapien
ctttacgtcttagtgaacacttaat

SEQ ID NO: 61203 - DNA, 25 bp, Homo sapien
ctttactaacaaccatattaatagg

SEQ ID NO: 61204 - DNA, 25 bp, Homo sapien
ctttactaacaagcatattaatagg

SEQ ID NO: 61205 - DNA, 25 bp, Homo sapien
ctttactatccattactttttaaaa

SEQ ID NO: 61206 - DNA, 25 bp, Homo sapien
ctttactatcccttactttttaaaa

SEQ ID NO: 61207 - DNA, 25 bp, Homo sapien
ctttactatcctcttagtcttcttt

SEQ ID NO: 61208 - DNA, 25 bp, Homo sapien
ctttactattctcttagtcttcttt

SEQ ID NO: 61209 - DNA, 25 bp, Homo sapien
ctttactctaatacatagctgtaac

SEQ ID NO: 61210 - DNA, 25 bp, Homo sapien
ctttactctaatacgtagctgtaac

SEQ ID NO: 61211 - DNA, 25 bp, Homo sapien
ctttactcttatgtcagcctattta

SEQ ID NO: 61212 - DNA, 25 bp, Homo sapien
ctttactcttatgtcatcctattta

SEQ ID NO: 61213 - DNA, 25 bp, Homo sapien
ctttactgcatcattaattttttcc

SEQ ID NO: 61214 - DNA, 25 bp, Homo sapien
ctttactgcatcgttaattttttcc

SEQ ID NO: 61215 - DNA, 25 bp, Homo sapien
ctttactggaacaaattagcacata

SEQ ID NO: 61216 - DNA, 25 bp, Homo sapien
ctttactggaataaattagcacata

SEQ ID NO: 61217 - DNA, 25 bp, Homo sapien
ctttacttgtttggtctgcctgtaa

SEQ ID NO: 61218 - DNA, 25 bp, Homo sapien
ctttacttgtttgttctgcctgtaa

SEQ ID NO: 61219 - DNA, 25 bp, Homo sapien
ctttactttcatctatgtcatggtc

SEQ ID NO: 61220 - DNA, 25 bp, Homo sapien
ctttactttcatttatgtcatggtc

SEQ ID NO: 61221 - DNA, 25 bp, Homo sapien
ctttagaacatgatgaaagccatag

SEQ ID NO: 61222 - DNA, 25 bp, Homo sapien
ctttagaagcctcattggagatttc

SEQ ID NO: 61223 - DNA, 25 bp, Homo sapien
ctttagaagccttattggagatttc

SEQ ID NO: 61224 - DNA, 25 bp, Homo sapien
ctttagaatatgatgaaagccatag

SEQ ID NO: 61225 - DNA, 25 bp, Homo sapien
ctttagaattcatttggctccctgg

SEQ ID NO: 61226 - DNA, 25 bp, Homo sapien
ctttagaattcgtttggctccctgg

SEQ ID NO: 61227 - DNA, 25 bp, Homo sapien
ctttagacagtaacagaaagtataa

SEQ ID NO: 61228 - DNA, 25 bp, Homo sapien
ctttagacagtaatagaaagtataa

SEQ ID NO: 61229 - DNA, 25 bp, Homo sapien
ctttagagaaaaagcgattggttag

SEQ ID NO: 61230 - DNA, 25 bp, Homo sapien
ctttagagaaaaggcgattggttag

SEQ ID NO: 61231 - DNA, 25 bp, Homo sapien
ctttagcaatgaacttttaagatag

SEQ ID NO: 61232 - DNA, 25 bp, Homo sapien
ctttagcagtgaacttttaagatag

SEQ ID NO: 61233 - DNA, 25 bp, Homo sapien
ctttagctaaagcctattctatgaa

SEQ ID NO: 61234 - DNA, 25 bp, Homo sapien
ctttagctaaatcctattctatgaa

SEQ ID NO: 61235 - DNA, 25 bp, Homo sapien
ctttagctattgcgaatatttctgc

SEQ ID NO: 61236 - DNA, 25 bp, Homo sapien
ctttagctattgtgaatatttctgc

SEQ ID NO: 61237 - DNA, 25 bp, Homo sapien
ctttagctcaacgtgggatgaatgc

SEQ ID NO: 61238 - DNA, 25 bp, Homo sapien
ctttagctcaacgttggatgaatgc

SEQ ID NO: 61239 - DNA, 25 bp, Homo sapien
ctttagctgataagttgattaaagt

SEQ ID NO: 61240 - DNA, 25 bp, Homo sapien
ctttagctgggctgatctgaataca

SEQ ID NO: 61241 - DNA, 25 bp, Homo sapien
ctttagctgggctggtctgaataca

SEQ ID NO: 61242 - DNA, 25 bp, Homo sapien
ctttagctggtaagttgattaaagt

SEQ ID NO: 61243 - DNA, 25 bp, Homo sapien
ctttagcttcaatgtattcattact

SEQ ID NO: 61244 - DNA, 25 bp, Homo sapien
ctttagcttcactgtattcattact

SEQ ID NO: 61245 - DNA, 25 bp, Homo sapien
ctttaggcattccctggttgatgga

SEQ ID NO: 61246 - DNA, 25 bp, Homo sapien
ctttaggccttccctggttgatgga

SEQ ID NO: 61247 - DNA, 25 bp, Homo sapien
ctttaggtattacggtggaagaatg

SEQ ID NO: 61248 - DNA, 25 bp, Homo sapien
ctttaggtattatggtggaagaatg

SEQ ID NO: 61249 - DNA, 25 bp, Homo sapien
ctttaggtctttcgtaccaaacatt

SEQ ID NO: 61250 - DNA, 25 bp, Homo sapien
ctttaggtctttggtaccaaacatt

SEQ ID NO: 61251 - DNA, 25 bp, Homo sapien
ctttagtacaaattttattggcttt

SEQ ID NO: 61252 - DNA, 25 bp, Homo sapien
ctttagtacaacttttattggcttt

SEQ ID NO: 61253 - DNA, 25 bp, Homo sapien
ctttagtgcttcaatctaaagagga

SEQ ID NO: 61254 - DNA, 25 bp, Homo sapien
ctttagtgctttaatctaaagagga

SEQ ID NO: 61255 - DNA, 25 bp, Homo sapien
ctttatagtttcgcctactcttctt

SEQ ID NO: 61256 - DNA, 25 bp, Homo sapien
ctttatagtttcgtctactcttctt

SEQ ID NO: 61257 - DNA, 25 bp, Homo sapien
ctttatcaacgggtccaaagttcct

SEQ ID NO: 61258 - DNA, 25 bp, Homo sapien
ctttatcaatgaagtttatgtaata

SEQ ID NO: 61259 - DNA, 25 bp, Homo sapien
ctttatcaatgaattttatgtaata

SEQ ID NO: 61260 - DNA, 25 bp, Homo sapien
ctttatcaatgggtccaaagttcct

SEQ ID NO: 61261 - DNA, 25 bp, Homo sapien
ctttatcaccgctcctccttgtact

SEQ ID NO: 61262 - DNA, 25 bp, Homo sapien
ctttatcactacacaatgcccttct

SEQ ID NO: 61263 - DNA, 25 bp, Homo sapien
ctttatcactgctcctccttgtact

SEQ ID NO: 61264 - DNA, 25 bp, Homo sapien
ctttatcattacacaatgcccttct

SEQ ID NO: 61265 - DNA, 25 bp, Homo sapien
ctttatcattttcttacatggctat

SEQ ID NO: 61266 - DNA, 25 bp, Homo sapien
ctttatcatttttttacatggctat

SEQ ID NO: 61267 - DNA, 25 bp, Homo sapien
ctttatccagcttcctcttcctgct

SEQ ID NO: 61268 - DNA, 25 bp, Homo sapien
ctttatccaggagatgtaaggttgg

SEQ ID NO: 61269 - DNA, 25 bp, Homo sapien
ctttatccatgagatgtaaggttgg

SEQ ID NO: 61270 - DNA, 25 bp, Homo sapien
ctttatcccaagtcctctgactcgt

SEQ ID NO: 61271 - DNA, 25 bp, Homo sapien
ctttatcccaagtcttctgactcgt

SEQ ID NO: 61272 - DNA, 25 bp, Homo sapien
ctttatcctgcttcctcttcctgct

SEQ ID NO: 61273 - DNA, 25 bp, Homo sapien
ctttatctcttgcgagtacgatttc

SEQ ID NO: 61274 - DNA, 25 bp, Homo sapien
ctttatctcttgggagtacgatttc

SEQ ID NO: 61275 - DNA, 25 bp, Homo sapien
ctttatctggacgtagcaatgagaa

SEQ ID NO: 61276 - DNA, 25 bp, Homo sapien
ctttatctggatgtagcaatgagaa

SEQ ID NO: 61277 - DNA, 25 bp, Homo sapien
ctttatcttgcatgaacttttgtaa

SEQ ID NO: 61278 - DNA, 25 bp, Homo sapien
ctttatcttgcatggacttttgtaa

SEQ ID NO: 61279 - DNA, 25 bp, Homo sapien
ctttatgaatagcagctgttttcct

SEQ ID NO: 61280 - DNA, 25 bp, Homo sapien
ctttatgaccttgagattgccagtg

SEQ ID NO: 61281 - DNA, 25 bp, Homo sapien
ctttatgaccttgcgattgccagtg

SEQ ID NO: 61282 - DNA, 25 bp, Homo sapien
ctttatgagtagcagctgttttcct

SEQ ID NO: 61283 - DNA, 25 bp, Homo sapien
ctttatgcatctgtcatctcttgct

SEQ ID NO: 61284 - DNA, 25 bp, Homo sapien
ctttatgcatctttcatctcttgct

SEQ ID NO: 61285 - DNA, 25 bp, Homo sapien
ctttatgctactcattcctacacct

SEQ ID NO: 61286 - DNA, 25 bp, Homo sapien
ctttatgctctcacatgctgcatct

SEQ ID NO: 61287 - DNA, 25 bp, Homo sapien
ctttatgctgtcacatgctgcatct

SEQ ID NO: 61288 - DNA, 25 bp, Homo sapien
ctttatgcttctcattcctacacct

SEQ ID NO: 61289 - DNA, 25 bp, Homo sapien
ctttatggaaaccatgacatacact

SEQ ID NO: 61290 - DNA, 25 bp, Homo sapien
ctttatggaaaccgtgacatacact

SEQ ID NO: 61291 - DNA, 25 bp, Homo sapien
ctttatgtaaaacggtaggatgcta

SEQ ID NO: 61292 - DNA, 25 bp, Homo sapien
ctttatgtaaaatggtaggatgcta

SEQ ID NO: 61293 - DNA, 25 bp, Homo sapien
ctttatgtccttttctctgaatgta

SEQ ID NO: 61294 - DNA, 25 bp, Homo sapien
ctttatgtctttttctctgaatgta

SEQ ID NO: 61295 - DNA, 25 bp, Homo sapien
ctttatgtgcacggtagcagtgtgt

SEQ ID NO: 61296 - DNA, 25 bp, Homo sapien
ctttatgtgcatggtagcagtgtgt

SEQ ID NO: 61297 - DNA, 25 bp, Homo sapien
ctttattaaagaaccacgcagaagt

SEQ ID NO: 61298 - DNA, 25 bp, Homo sapien
ctttattaaagaaccatgcagaagt

SEQ ID NO: 61299 - DNA, 25 bp, Homo sapien
ctttattagaatatagccaaacatg

SEQ ID NO: 61300 - DNA, 25 bp, Homo sapien
ctttattagaatatggccaaacatg

SEQ ID NO: 61301 - DNA, 25 bp, Homo sapien
ctttattagtgatcagcacttatga

SEQ ID NO: 61302 - DNA, 25 bp, Homo sapien
ctttattagtgatcggcacttatga

SEQ ID NO: 61303 - DNA, 25 bp, Homo sapien
ctttattatgaagctaaaacctggg

SEQ ID NO: 61304 - DNA, 25 bp, Homo sapien
ctttattatgaggctaaaacctggg

SEQ ID NO: 61305 - DNA, 25 bp, Homo sapien
ctttattcagatgatcctacatatg

SEQ ID NO: 61306 - DNA, 25 bp, Homo sapien
ctttattcagattatcctacatatg

SEQ ID NO: 61307 - DNA, 25 bp, Homo sapien
ctttattctccaaacaaatctatcg

SEQ ID NO: 61308 - DNA, 25 bp, Homo sapien
ctttattctccatacaaatctatcg

SEQ ID NO: 61309 - DNA, 25 bp, Homo sapien
ctttattgaaacggcaactcctcat

SEQ ID NO: 61310 - DNA, 25 bp, Homo sapien
ctttattgaaatggcaactcctcat

SEQ ID NO: 61311 - DNA, 25 bp, Homo sapien
ctttattgtatacaaactcataatg

SEQ ID NO: 61312 - DNA, 25 bp, Homo sapien
ctttattgtgtacaaactcataatg

SEQ ID NO: 61313 - DNA, 25 bp, Homo sapien
ctttatttcccaatcttatagacaa

SEQ ID NO: 61314 - DNA, 25 bp, Homo sapien
ctttatttcccaatgttatagacaa

SEQ ID NO: 61315 - DNA, 25 bp, Homo sapien
ctttatttctcagcacataattcat

SEQ ID NO: 61316 - DNA, 25 bp, Homo sapien
ctttatttgtcagcacataattcat

SEQ ID NO: 61317 - DNA, 25 bp, Homo sapien
ctttattttctttatcccgcatggg

SEQ ID NO: 61318 - DNA, 25 bp, Homo sapien
ctttatttttccgcattgttttcta

SEQ ID NO: 61319 - DNA, 25 bp, Homo sapien
ctttatttttccgtattgttttcta

SEQ ID NO: 61320 - DNA, 25 bp, Homo sapien
ctttattttttttatcccgcatggg

SEQ ID NO: 61321 - DNA, 25 bp, Homo sapien
ctttcaaaaaagaaaaactggcaaa

SEQ ID NO: 61322 - DNA, 25 bp, Homo sapien
ctttcaaaaaaggaaaactggcaaa

SEQ ID NO: 61323 - DNA, 25 bp, Homo sapien
ctttcaaaactccattgactagatt

SEQ ID NO: 61324 - DNA, 25 bp, Homo sapien
ctttcaaacagagaatcagaatcac

SEQ ID NO: 61325 - DNA, 25 bp, Homo sapien
ctttcaaacagggaatcagaatcac

SEQ ID NO: 61326 - DNA, 25 bp, Homo sapien
ctttcaaacgcttcagggcaatgca

SEQ ID NO: 61327 - DNA, 25 bp, Homo sapien
ctttcaaagtaaaacactgatatat

SEQ ID NO: 61328 - DNA, 25 bp, Homo sapien
ctttcaaagtaatacactgatatat

SEQ ID NO: 61329 - DNA, 25 bp, Homo sapien
ctttcaaatctccattgactagatt

SEQ ID NO: 61330 - DNA, 25 bp, Homo sapien
ctttcaaatgcttcagggcaatgca

SEQ ID NO: 61331 - DNA, 25 bp, Homo sapien
ctttcaacaaatcaaacggtttatt

SEQ ID NO: 61332 - DNA, 25 bp, Homo sapien
ctttcaacaaatcaaatggtttatt

SEQ ID NO: 61333 - DNA, 25 bp, Homo sapien
ctttcaacacatgcactgcacacat

SEQ ID NO: 61334 - DNA, 25 bp, Homo sapien
ctttcaacacatgcgctgcacacat

SEQ ID NO: 61335 - DNA, 25 bp, Homo sapien
ctttcaactatgatattgcctttgg

SEQ ID NO: 61336 - DNA, 25 bp, Homo sapien
ctttcaactctgatattgcctttgg

SEQ ID NO: 61337 - DNA, 25 bp, Homo sapien
ctttcaagaaaatgcacagggtcac

SEQ ID NO: 61338 - DNA, 25 bp, Homo sapien
ctttcaagaaactgcacagggtcac

SEQ ID NO: 61339 - DNA, 25 bp, Homo sapien
ctttcaagaggaacgcataaatagg

SEQ ID NO: 61340 - DNA, 25 bp, Homo sapien
ctttcaagaggaatgcataaatagg

SEQ ID NO: 61341 - DNA, 25 bp, Homo sapien
ctttcaagtattaacaatcgagtct

SEQ ID NO: 61342 - DNA, 25 bp, Homo sapien
ctttcaagtattagcaatcgagtct

SEQ ID NO: 61343 - DNA, 25 bp, Homo sapien
ctttcaccttgactatatggcatta

SEQ ID NO: 61344 - DNA, 25 bp, Homo sapien
ctttcaccttgtctatatggcatta

SEQ ID NO: 61345 - DNA, 25 bp, Homo sapien
ctttcactgtgaaatttgatgatac

SEQ ID NO: 61346 - DNA, 25 bp, Homo sapien
ctttcactgtggaatttgatgatac

SEQ ID NO: 61347 - DNA, 25 bp, Homo sapien
ctttcactttcttaacagtgttttt

SEQ ID NO: 61348 - DNA, 25 bp, Homo sapien
ctttcactttcttaacggtgttttt

SEQ ID NO: 61349 - DNA, 25 bp, Homo sapien
ctttcagaaacaatttgaaccttag

SEQ ID NO: 61350 - DNA, 25 bp, Homo sapien
ctttcagaaacagtttgaaccttag

SEQ ID NO: 61351 - DNA, 25 bp, Homo sapien
ctttcagagagagagtattcaaaat

SEQ ID NO: 61352 - DNA, 25 bp, Homo sapien
ctttcagagagagggtattcaaaat

SEQ ID NO: 61353 - DNA, 25 bp, Homo sapien
ctttcagagttacaatactcctacc

SEQ ID NO: 61354 - DNA, 25 bp, Homo sapien
ctttcagagttccaatactcctacc

SEQ ID NO: 61355 - DNA, 25 bp, Homo sapien
ctttcagatggctatgcaataggtt

SEQ ID NO: 61356 - DNA, 25 bp, Homo sapien
ctttcagatggctatgtaataggtt

SEQ ID NO: 61357 - DNA, 25 bp, Homo sapien
ctttcagcactcaatcagctctctc

SEQ ID NO: 61358 - DNA, 25 bp, Homo sapien
ctttcagcactgaatcagctctctc

SEQ ID NO: 61359 - DNA, 25 bp, Homo sapien
ctttcagctctttcattactgtctt

SEQ ID NO: 61360 - DNA, 25 bp, Homo sapien
ctttcagctctttcgttactgtctt

SEQ ID NO: 61361 - DNA, 25 bp, Homo sapien
ctttcatactttcacagaactgtaa

SEQ ID NO: 61362 - DNA, 25 bp, Homo sapien
ctttcatactttcatagaactgtaa

SEQ ID NO: 61363 - DNA, 25 bp, Homo sapien
ctttcatccggtaaccactcatgac

SEQ ID NO: 61364 - DNA, 25 bp, Homo sapien
ctttcatctggtaaccactcatgac

SEQ ID NO: 61365 - DNA, 25 bp, Homo sapien
ctttcatcttacccgcacatggcta

SEQ ID NO: 61366 - DNA, 25 bp, Homo sapien
ctttcatcttacctgcacatggcta

SEQ ID NO: 61367 - DNA, 25 bp, Homo sapien
ctttcattgtgggaattttaagcat

SEQ ID NO: 61368 - DNA, 25 bp, Homo sapien
ctttcattgtgggagttttaagcat

SEQ ID NO: 61369 - DNA, 25 bp, Homo sapien
ctttcattgttattctccagtgcat

SEQ ID NO: 61370 - DNA, 25 bp, Homo sapien
ctttcattgttcttctccagtgcat

SEQ ID NO: 61371 - DNA, 25 bp, Homo sapien
ctttccaaaggcaggtggttctaaa

SEQ ID NO: 61372 - DNA, 25 bp, Homo sapien
ctttccaaaggcagttggttctaaa

SEQ ID NO: 61373 - DNA, 25 bp, Homo sapien
ctttccaagagaaataagcagtcac

SEQ ID NO: 61374 - DNA, 25 bp, Homo sapien
ctttccaagagaattaagcagtcac

SEQ ID NO: 61375 - DNA, 25 bp, Homo sapien
ctttccaagtctgcataagctgcct

SEQ ID NO: 61376 - DNA, 25 bp, Homo sapien
ctttccaatagagtgagcagttgtc

SEQ ID NO: 61377 - DNA, 25 bp, Homo sapien
ctttccaatggagtgagcagttgtc

SEQ ID NO: 61378 - DNA, 25 bp, Homo sapien
ctttccaattctgcataagctgcct

SEQ ID NO: 61379 - DNA, 25 bp, Homo sapien
ctttccacatattacgtcatttaac

SEQ ID NO: 61380 - DNA, 25 bp, Homo sapien
ctttccacatattatgtcatttaac

SEQ ID NO: 61381 - DNA, 25 bp, Homo sapien
ctttccaccttcactgacttgcttt

SEQ ID NO: 61382 - DNA, 25 bp, Homo sapien
ctttccacgtctctcagtttctgtg

SEQ ID NO: 61383 - DNA, 25 bp, Homo sapien
ctttccacgtctttcagtttctgtg

SEQ ID NO: 61384 - DNA, 25 bp, Homo sapien
ctttccactttcactgacttgcttt

SEQ ID NO: 61385 - DNA, 25 bp, Homo sapien
ctttccagcggtagagttcaagagt

SEQ ID NO: 61386 - DNA, 25 bp, Homo sapien
ctttccagtggtagagttcaagagt

SEQ ID NO: 61387 - DNA, 25 bp, Homo sapien
ctttccagtgtactaccaccaacaa

SEQ ID NO: 61388 - DNA, 25 bp, Homo sapien
ctttccagtgtactactaccaacaa

SEQ ID NO: 61389 - DNA, 25 bp, Homo sapien
ctttccatcaaacataataaatcca

SEQ ID NO: 61390 - DNA, 25 bp, Homo sapien
ctttccatcaaacgtaataaatcca

SEQ ID NO: 61391 - DNA, 25 bp, Homo sapien
ctttccattcccagaggagagaaac

SEQ ID NO: 61392 - DNA, 25 bp, Homo sapien
ctttccattcccggaggagagaaac

SEQ ID NO: 61393 - DNA, 25 bp, Homo sapien
ctttccatttgagatacagctctgg

SEQ ID NO: 61394 - DNA, 25 bp, Homo sapien
ctttccatttgagttacagctctgg

SEQ ID NO: 61395 - DNA, 25 bp, Homo sapien
ctttcccccagtccatgctgcaacc

SEQ ID NO: 61396 - DNA, 25 bp, Homo sapien
ctttcccccagtccttgctgcaacc

SEQ ID NO: 61397 - DNA, 25 bp, Homo sapien
ctttcccgcagggggaatttccgca

SEQ ID NO: 61398 - DNA, 25 bp, Homo sapien
ctttcccgcagggggagtttccgca

SEQ ID NO: 61399 - DNA, 25 bp, Homo sapien
ctttccctgattatttacaagtttc

SEQ ID NO: 61400 - DNA, 25 bp, Homo sapien
ctttccctgattctttacaagtttc

SEQ ID NO: 61401 - DNA, 25 bp, Homo sapien
ctttccctgcacaatccaggtcctt

SEQ ID NO: 61402 - DNA, 25 bp, Homo sapien
ctttccctgcacgatccaggtcctt

SEQ ID NO: 61403 - DNA, 25 bp, Homo sapien
ctttccgtcactccgaaaacatgaa

SEQ ID NO: 61404 - DNA, 25 bp, Homo sapien
ctttccgtcactctgaaaacatgaa

SEQ ID NO: 61405 - DNA, 25 bp, Homo sapien
ctttccgtgaactctaggggaccaa

SEQ ID NO: 61406 - DNA, 25 bp, Homo sapien
ctttccgtgattacggactattgcc

SEQ ID NO: 61407 - DNA, 25 bp, Homo sapien
ctttccgtgattatggactattgcc

SEQ ID NO: 61408 - DNA, 25 bp, Homo sapien
ctttccgtggactctaggggaccaa

SEQ ID NO: 61409 - DNA, 25 bp, Homo sapien
ctttcctaagacatttcaacatgtg

SEQ ID NO: 61410 - DNA, 25 bp, Homo sapien
ctttcctaagatatttcaacatgtg

SEQ ID NO: 61411 - DNA, 25 bp, Homo sapien
ctttcctatcaaattgtgttacaac

SEQ ID NO: 61412 - DNA, 25 bp, Homo sapien
ctttcctatcaatttgtgttacaac

SEQ ID NO: 61413 - DNA, 25 bp, Homo sapien
ctttcctcaaatccattaaattttt

SEQ ID NO: 61414 - DNA, 25 bp, Homo sapien
ctttcctcaaatccgttaaattttt

SEQ ID NO: 61415 - DNA, 25 bp, Homo sapien
ctttcctcatgaactggcattcttt

SEQ ID NO: 61416 - DNA, 25 bp, Homo sapien
ctttcctcatgaattggcattcttt

SEQ ID NO: 61417 - DNA, 25 bp, Homo sapien
ctttcctcccacccagaatagtacc

SEQ ID NO: 61418 - DNA, 25 bp, Homo sapien
ctttcctcccaccgagaatagtacc

SEQ ID NO: 61419 - DNA, 25 bp, Homo sapien
ctttcctgacccaacggaatctact

SEQ ID NO: 61420 - DNA, 25 bp, Homo sapien
ctttcctgacccaatggaatctact

SEQ ID NO: 61421 - DNA, 25 bp, Homo sapien
ctttcctgaggccacattcttacag

SEQ ID NO: 61422 - DNA, 25 bp, Homo sapien
ctttcctgaggccgcattcttacag

SEQ ID NO: 61423 - DNA, 25 bp, Homo sapien
ctttcctgaggctctcttagaatac

SEQ ID NO: 61424 - DNA, 25 bp, Homo sapien
ctttcctgaggctgtcttagaatac

SEQ ID NO: 61425 - DNA, 25 bp, Homo sapien
ctttcctgctccaggaagtatatca

SEQ ID NO: 61426 - DNA, 25 bp, Homo sapien
ctttcctgctccaggaggtatatca

SEQ ID NO: 61427 - DNA, 25 bp, Homo sapien
ctttcctgcttacctcacatggtaa

SEQ ID NO: 61428 - DNA, 25 bp, Homo sapien
ctttcctgcttacgtcacatggtaa

SEQ ID NO: 61429 - DNA, 25 bp, Homo sapien
ctttcctggaatctgtctgaagtgt

SEQ ID NO: 61430 - DNA, 25 bp, Homo sapien
ctttcctgggatctgtctgaagtgt

SEQ ID NO: 61431 - DNA, 25 bp, Homo sapien
ctttccttactgcaggacttcagtt

SEQ ID NO: 61432 - DNA, 25 bp, Homo sapien
ctttccttattgcaggacttcagtt

SEQ ID NO: 61433 - DNA, 25 bp, Homo sapien
ctttccttccagctgatgaaattcc

SEQ ID NO: 61434 - DNA, 25 bp, Homo sapien
ctttccttccaggtgatgaaattcc

SEQ ID NO: 61435 - DNA, 25 bp, Homo sapien
ctttccttccgataggtttttccaa

SEQ ID NO: 61436 - DNA, 25 bp, Homo sapien
ctttccttcctggaatttgtccaat

SEQ ID NO: 61437 - DNA, 25 bp, Homo sapien
ctttccttctatacctcgcaacctt

SEQ ID NO: 61438 - DNA, 25 bp, Homo sapien
ctttccttctataccttgcaacctt

SEQ ID NO: 61439 - DNA, 25 bp, Homo sapien
ctttccttctgataggtttttccaa

SEQ ID NO: 61440 - DNA, 25 bp, Homo sapien
ctttccttcttggaatttgtccaat

SEQ ID NO: 61441 - DNA, 25 bp, Homo sapien
ctttccttgagtgactgacctctct

SEQ ID NO: 61442 - DNA, 25 bp, Homo sapien
ctttccttgagtgattgacctctct

SEQ ID NO: 61443 - DNA, 25 bp, Homo sapien
ctttccttttgaaattcctaggtaa

SEQ ID NO: 61444 - DNA, 25 bp, Homo sapien
ctttccttttgaagttcctaggtaa

SEQ ID NO: 61445 - DNA, 25 bp, Homo sapien
ctttcctttttctcgtcacttgtag

SEQ ID NO: 61446 - DNA, 25 bp, Homo sapien
ctttcctttttcttgtcacttgtag

SEQ ID NO: 61447 - DNA, 25 bp, Homo sapien
ctttcgcaaaaggtactcgctgcca

SEQ ID NO: 61448 - DNA, 25 bp, Homo sapien
ctttcgcaaaagttactcgctgcca

SEQ ID NO: 61449 - DNA, 25 bp, Homo sapien
ctttcgcctggaattagcagagact

SEQ ID NO: 61450 - DNA, 25 bp, Homo sapien
ctttcgcctgggattagcagagact

SEQ ID NO: 61451 - DNA, 25 bp, Homo sapien
ctttcgtccagccaggcttatgatc

SEQ ID NO: 61452 - DNA, 25 bp, Homo sapien
ctttcgtctagccaggcttatgatc

SEQ ID NO: 61453 - DNA, 25 bp, Homo sapien
ctttcgttgaaacacaatagcatta

SEQ ID NO: 61454 - DNA, 25 bp, Homo sapien
ctttcgttgaaacacagtagcatta

SEQ ID NO: 61455 - DNA, 25 bp, Homo sapien
ctttctaaatacttgaagacctgtt

SEQ ID NO: 61456 - DNA, 25 bp, Homo sapien
ctttctaaatacttgaggacctgtt

SEQ ID NO: 61457 - DNA, 25 bp, Homo sapien
ctttctacaagaacttcattttatg

SEQ ID NO: 61458 - DNA, 25 bp, Homo sapien
ctttctacaagagcttcattttatg

SEQ ID NO: 61459 - DNA, 25 bp, Homo sapien
ctttctacaataatctgaactgtaa

SEQ ID NO: 61460 - DNA, 25 bp, Homo sapien
ctttctacaataatttgaactgtaa

SEQ ID NO: 61461 - DNA, 25 bp, Homo sapien
ctttctacacagagtgaaggagaaa

SEQ ID NO: 61462 - DNA, 25 bp, Homo sapien
ctttctacacagggtgaaggagaaa

SEQ ID NO: 61463 - DNA, 25 bp, Homo sapien
ctttctacagttctgatttcattct

SEQ ID NO: 61464 - DNA, 25 bp, Homo sapien
ctttctacagttttgatttcattct

SEQ ID NO: 61465 - DNA, 25 bp, Homo sapien
ctttctactccgaagctgttttatt

SEQ ID NO: 61466 - DNA, 25 bp, Homo sapien
ctttctactcctaagctgttttatt

SEQ ID NO: 61467 - DNA, 25 bp, Homo sapien
ctttctaggtcaggtccaaacaata

SEQ ID NO: 61468 - DNA, 25 bp, Homo sapien
ctttctaggtcgggtccaaacaata

SEQ ID NO: 61469 - DNA, 25 bp, Homo sapien
ctttctagtaaaaattctaaacagt

SEQ ID NO: 61470 - DNA, 25 bp, Homo sapien
ctttctagtaaagattctaaacagt

SEQ ID NO: 61471 - DNA, 25 bp, Homo sapien
ctttctatgaggttttcgatttact

SEQ ID NO: 61472 - DNA, 25 bp, Homo sapien
ctttctatgaggtttttgatttact

SEQ ID NO: 61473 - DNA, 25 bp, Homo sapien
ctttctatgcgtatatggtcaacat

SEQ ID NO: 61474 - DNA, 25 bp, Homo sapien
ctttctatggcaaccttgacagctc

SEQ ID NO: 61475 - DNA, 25 bp, Homo sapien
ctttctatggcaatcttgacagctc

SEQ ID NO: 61476 - DNA, 25 bp, Homo sapien
ctttctatgtgtatatggtcaacat

SEQ ID NO: 61477 - DNA, 25 bp, Homo sapien
ctttctattgataactatcctcacc

SEQ ID NO: 61478 - DNA, 25 bp, Homo sapien
ctttctattgatatctatcctcacc

SEQ ID NO: 61479 - DNA, 25 bp, Homo sapien
ctttctatttctcttgcctttcgga

SEQ ID NO: 61480 - DNA, 25 bp, Homo sapien
ctttctatttctcttgtctttcgga

SEQ ID NO: 61481 - DNA, 25 bp, Homo sapien
ctttctcaaaatctcctttaccaca

SEQ ID NO: 61482 - DNA, 25 bp, Homo sapien
ctttctcaaaatttcctttaccaca

SEQ ID NO: 61483 - DNA, 25 bp, Homo sapien
ctttctcacagtaaatcaagtccag

SEQ ID NO: 61484 - DNA, 25 bp, Homo sapien
ctttctcacggtaaatcaagtccag

SEQ ID NO: 61485 - DNA, 25 bp, Homo sapien
ctttctcagaaataatgttttccaa

SEQ ID NO: 61486 - DNA, 25 bp, Homo sapien
ctttctcagaaatagtgttttccaa

SEQ ID NO: 61487 - DNA, 25 bp, Homo sapien
ctttctcatcacggcttctatgggg

SEQ ID NO: 61488 - DNA, 25 bp, Homo sapien
ctttctcatcatggcttctatgggg

SEQ ID NO: 61489 - DNA, 25 bp, Homo sapien
ctttctcattacagggttagctaaa

SEQ ID NO: 61490 - DNA, 25 bp, Homo sapien
ctttctcattagagggttagctaaa

SEQ ID NO: 61491 - DNA, 25 bp, Homo sapien
ctttctccaatatgaaaggtgtgag

SEQ ID NO: 61492 - DNA, 25 bp, Homo sapien
ctttctccaatctgaaaggtgtgag

SEQ ID NO: 61493 - DNA, 25 bp, Homo sapien
ctttctcccaaatgaacagtgttcc

SEQ ID NO: 61494 - DNA, 25 bp, Homo sapien
ctttctcccaactgaacagtgttcc

SEQ ID NO: 61495 - DNA, 25 bp, Homo sapien
ctttctcctcaaggagttcatggcc

SEQ ID NO: 61496 - DNA, 25 bp, Homo sapien
ctttctcctcatggagttcatggcc

SEQ ID NO: 61497 - DNA, 25 bp, Homo sapien
ctttctcctgctacatttcacttct

SEQ ID NO: 61498 - DNA, 25 bp, Homo sapien
ctttctcctgctacttttcacttct

SEQ ID NO: 61499 - DNA, 25 bp, Homo sapien
ctttctctcaggctgctctctgcct

SEQ ID NO: 61500 - DNA, 25 bp, Homo sapien
ctttctctcatagtcagggttcttg

SEQ ID NO: 61501 - DNA, 25 bp, Homo sapien
ctttctctccggctgctctctgcct

SEQ ID NO: 61502 - DNA, 25 bp, Homo sapien
ctttctctcggatcaattacagagg

SEQ ID NO: 61503 - DNA, 25 bp, Homo sapien
ctttctctcggctcattaccctgcc

SEQ ID NO: 61504 - DNA, 25 bp, Homo sapien
ctttctctcgtagtcagggttcttg

SEQ ID NO: 61505 - DNA, 25 bp, Homo sapien
ctttctctgatcctcttccttgttt

SEQ ID NO: 61506 - DNA, 25 bp, Homo sapien
ctttctctgatccttttccttgttt

SEQ ID NO: 61507 - DNA, 25 bp, Homo sapien
ctttctctgggctcaagaagtttca

SEQ ID NO: 61508 - DNA, 25 bp, Homo sapien
ctttctctgtgctcaagaagtttca

SEQ ID NO: 61509 - DNA, 25 bp, Homo sapien
ctttctctgttcacatctgctctct

SEQ ID NO: 61510 - DNA, 25 bp, Homo sapien
ctttctctgttcacatttgctctct

SEQ ID NO: 61511 - DNA, 25 bp, Homo sapien
ctttctcttggatcaattacagagg

SEQ ID NO: 61512 - DNA, 25 bp, Homo sapien
ctttctcttggctcattaccctgcc

SEQ ID NO: 61513 - DNA, 25 bp, Homo sapien
ctttctgaaatcagattgtgtctct

SEQ ID NO: 61514 - DNA, 25 bp, Homo sapien
ctttctgaaccaactaacgatggca

SEQ ID NO: 61515 - DNA, 25 bp, Homo sapien
ctttctgaaccagctaacgatggca

SEQ ID NO: 61516 - DNA, 25 bp, Homo sapien
ctttctgatatcagattgtgtctct

SEQ ID NO: 61517 - DNA, 25 bp, Homo sapien
ctttctgatctgatcttgtgctgct

SEQ ID NO: 61518 - DNA, 25 bp, Homo sapien
ctttctgatcttatcttgtgctgct

SEQ ID NO: 61519 - DNA, 25 bp, Homo sapien
ctttctgctaccatgaagtccaaga

SEQ ID NO: 61520 - DNA, 25 bp, Homo sapien
ctttctgctaccttgaagtccaaga

SEQ ID NO: 61521 - DNA, 25 bp, Homo sapien
ctttctggaagaaataaaagtgtca

SEQ ID NO: 61522 - DNA, 25 bp, Homo sapien
ctttctggcatctccaatagtaatc

SEQ ID NO: 61523 - DNA, 25 bp, Homo sapien
ctttctggcatctccagtagtaatc

SEQ ID NO: 61524 - DNA, 25 bp, Homo sapien
ctttctgggagaaataaaagtgtca

SEQ ID NO: 61525 - DNA, 25 bp, Homo sapien
ctttctgggtgcattacacttctac

SEQ ID NO: 61526 - DNA, 25 bp, Homo sapien
ctttctgggtgctttacacttctac

SEQ ID NO: 61527 - DNA, 25 bp, Homo sapien
ctttctgtcgggaaatcctcttaag

SEQ ID NO: 61528 - DNA, 25 bp, Homo sapien
ctttctgtctacgctcccatctttt

SEQ ID NO: 61529 - DNA, 25 bp, Homo sapien
ctttctgtctatgctcccatctttt

SEQ ID NO: 61530 - DNA, 25 bp, Homo sapien
ctttctgtcttacgtttataccgga

SEQ ID NO: 61531 - DNA, 25 bp, Homo sapien
ctttctgtcttatgtttataccgga

SEQ ID NO: 61532 - DNA, 25 bp, Homo sapien
ctttctgtgaagacatactgaagtt

SEQ ID NO: 61533 - DNA, 25 bp, Homo sapien
ctttctgtgaagtcatactgaagtt

SEQ ID NO: 61534 - DNA, 25 bp, Homo sapien
ctttctgtgactattacctgcctga

SEQ ID NO: 61535 - DNA, 25 bp, Homo sapien
ctttctgtgactgttacctgcctga

SEQ ID NO: 61536 - DNA, 25 bp, Homo sapien
ctttctgttgggaaatcctcttaag

SEQ ID NO: 61537 - DNA, 25 bp, Homo sapien
ctttcttaaattgtatgaaggctga

SEQ ID NO: 61538 - DNA, 25 bp, Homo sapien
ctttcttaaggcttttagtatccat

SEQ ID NO: 61539 - DNA, 25 bp, Homo sapien
ctttcttaaggctttttgtatccat

SEQ ID NO: 61540 - DNA, 25 bp, Homo sapien
ctttcttaagttgtatgaaggctga

SEQ ID NO: 61541 - DNA, 25 bp, Homo sapien
ctttcttaattgtccacttggagtg

SEQ ID NO: 61542 - DNA, 25 bp, Homo sapien
ctttcttaattgtctacttggagtg

SEQ ID NO: 61543 - DNA, 25 bp, Homo sapien
ctttcttacctgaaaatctgaattt

SEQ ID NO: 61544 - DNA, 25 bp, Homo sapien
ctttcttactacaatgtaaatgact

SEQ ID NO: 61545 - DNA, 25 bp, Homo sapien
ctttcttactacagtgtaaatgact

SEQ ID NO: 61546 - DNA, 25 bp, Homo sapien
ctttcttactgggactgtgaaaaag

SEQ ID NO: 61547 - DNA, 25 bp, Homo sapien
ctttcttactggggctgtgaaaaag

SEQ ID NO: 61548 - DNA, 25 bp, Homo sapien
ctttcttagcactttttgagtatat

SEQ ID NO: 61549 - DNA, 25 bp, Homo sapien
ctttcttagcagtttttgagtatat

SEQ ID NO: 61550 - DNA, 25 bp, Homo sapien
ctttcttatctgaaaatctgaattt

SEQ ID NO: 61551 - DNA, 25 bp, Homo sapien
ctttcttcaatataagttctcagca

SEQ ID NO: 61552 - DNA, 25 bp, Homo sapien
ctttcttcaatgtaagttctcagca

SEQ ID NO: 61553 - DNA, 25 bp, Homo sapien
ctttcttcattttgtgagttttctt

SEQ ID NO: 61554 - DNA, 25 bp, Homo sapien
ctttcttcattttttgagttttctt

SEQ ID NO: 61555 - DNA, 25 bp, Homo sapien
ctttcttctggtcgaattgggaata

SEQ ID NO: 61556 - DNA, 25 bp, Homo sapien
ctttcttctggttgaattgggaata

SEQ ID NO: 61557 - DNA, 25 bp, Homo sapien
ctttcttcttcttaccatcctatgt

SEQ ID NO: 61558 - DNA, 25 bp, Homo sapien
ctttcttcttcttaccgtcctatgt

SEQ ID NO: 61559 - DNA, 25 bp, Homo sapien
ctttcttgaagtagccatactatac

SEQ ID NO: 61560 - DNA, 25 bp, Homo sapien
ctttcttgaagtagtcatactatac

SEQ ID NO: 61561 - DNA, 25 bp, Homo sapien
ctttcttgaatttaatatacttggt

SEQ ID NO: 61562 - DNA, 25 bp, Homo sapien
ctttcttgattttaatatacttggt

SEQ ID NO: 61563 - DNA, 25 bp, Homo sapien
ctttcttggaggtagatgccacatg

SEQ ID NO: 61564 - DNA, 25 bp, Homo sapien
ctttcttggcggtagatgccacatg

SEQ ID NO: 61565 - DNA, 25 bp, Homo sapien
ctttcttgtaggatcccgcaaagaa

SEQ ID NO: 61566 - DNA, 25 bp, Homo sapien
ctttcttgtaggatcctgcaaagaa

SEQ ID NO: 61567 - DNA, 25 bp, Homo sapien
ctttctttcctgtattgattattta

SEQ ID NO: 61568 - DNA, 25 bp, Homo sapien
ctttctttctacgccctgaagatga

SEQ ID NO: 61569 - DNA, 25 bp, Homo sapien
ctttctttctatgccctgaagatga

SEQ ID NO: 61570 - DNA, 25 bp, Homo sapien
ctttctttgatggtagagaatattg

SEQ ID NO: 61571 - DNA, 25 bp, Homo sapien
ctttctttgccttacattccttatt

SEQ ID NO: 61572 - DNA, 25 bp, Homo sapien
ctttctttggcttacattccttatt

SEQ ID NO: 61573 - DNA, 25 bp, Homo sapien
ctttctttggtggtagagaatattg

SEQ ID NO: 61574 - DNA, 25 bp, Homo sapien
ctttcttttctgtattgattattta

SEQ ID NO: 61575 - DNA, 25 bp, Homo sapien
ctttcttttgttcagacttgccttc

SEQ ID NO: 61576 - DNA, 25 bp, Homo sapien
ctttcttttgttcagatttgccttc

SEQ ID NO: 61577 - DNA, 25 bp, Homo sapien
ctttgaaaatgccctcagctgtgcc

SEQ ID NO: 61578 - DNA, 25 bp, Homo sapien
ctttgaaaatgtcctcagctgtgcc

SEQ ID NO: 61579 - DNA, 25 bp, Homo sapien
ctttgaaacaacagagataccagaa

SEQ ID NO: 61580 - DNA, 25 bp, Homo sapien
ctttgaaacaatagagataccagaa

SEQ ID NO: 61581 - DNA, 25 bp, Homo sapien
ctttgaaagacaaagtgctaccatt

SEQ ID NO: 61582 - DNA, 25 bp, Homo sapien
ctttgaaagacaacgtgctaccatt

SEQ ID NO: 61583 - DNA, 25 bp, Homo sapien
ctttgaaatacagaaaatcagagaa

SEQ ID NO: 61584 - DNA, 25 bp, Homo sapien
ctttgaaatacggaaaatcagagaa

SEQ ID NO: 61585 - DNA, 25 bp, Homo sapien
ctttgaacaagataagttgagatta

SEQ ID NO: 61586 - DNA, 25 bp, Homo sapien
ctttgaacaagatgagttgagatta

SEQ ID NO: 61587 - DNA, 25 bp, Homo sapien
ctttgaatcgttatataatatcttt

SEQ ID NO: 61588 - DNA, 25 bp, Homo sapien
ctttgaatggttatataatatcttt

SEQ ID NO: 61589 - DNA, 25 bp, Homo sapien
ctttgacaaaagtgccacaatggac

SEQ ID NO: 61590 - DNA, 25 bp, Homo sapien
ctttgacaaagtttccaaaaagtct

SEQ ID NO: 61591 - DNA, 25 bp, Homo sapien
ctttgacaaagtttccgaaaagtct

SEQ ID NO: 61592 - DNA, 25 bp, Homo sapien
ctttgacagaagtgccacaatggac

SEQ ID NO: 61593 - DNA, 25 bp, Homo sapien
ctttgacagcaaaacctggcctttc

SEQ ID NO: 61594 - DNA, 25 bp, Homo sapien
ctttgacagcaaaatctggcctttc

SEQ ID NO: 61595 - DNA, 25 bp, Homo sapien
ctttgacattctaactacaatttca

SEQ ID NO: 61596 - DNA, 25 bp, Homo sapien
ctttgacattctacctacaatttca

SEQ ID NO: 61597 - DNA, 25 bp, Homo sapien
ctttgaccacagcctggcacaggag

SEQ ID NO: 61598 - DNA, 25 bp, Homo sapien
ctttgaccacaggctggcacaggag

SEQ ID NO: 61599 - DNA, 25 bp, Homo sapien
ctttgacctatcaattgaggccatg

SEQ ID NO: 61600 - DNA, 25 bp, Homo sapien
ctttgacctatcagttgaggccatg

SEQ ID NO: 61601 - DNA, 25 bp, Homo sapien
ctttgaccttttggaacacaaaccc

SEQ ID NO: 61602 - DNA, 25 bp, Homo sapien
ctttgaccttttggaatacaaaccc

SEQ ID NO: 61603 - DNA, 25 bp, Homo sapien
ctttgacgttgaccttcctgccata

SEQ ID NO: 61604 - DNA, 25 bp, Homo sapien
ctttgacgttgatcttcctgccata

SEQ ID NO: 61605 - DNA, 25 bp, Homo sapien
ctttgactcattaatgctgcatctg

SEQ ID NO: 61606 - DNA, 25 bp, Homo sapien
ctttgacttattaatgctgcatctg

SEQ ID NO: 61607 - DNA, 25 bp, Homo sapien
ctttgagaatagttaaaaaattaca

SEQ ID NO: 61608 - DNA, 25 bp, Homo sapien
ctttgagaatagtttaaaaattaca

SEQ ID NO: 61609 - DNA, 25 bp, Homo sapien
ctttgagaatatgtgacggatcatc

SEQ ID NO: 61610 - DNA, 25 bp, Homo sapien
ctttgagaatatgtgatggatcatc

SEQ ID NO: 61611 - DNA, 25 bp, Homo sapien
ctttgagaggtttcactttgtccaa

SEQ ID NO: 61612 - DNA, 25 bp, Homo sapien
ctttgagaggtttgactttgtccaa

SEQ ID NO: 61613 - DNA, 25 bp, Homo sapien
ctttgagctccaaaaattctttctc

SEQ ID NO: 61614 - DNA, 25 bp, Homo sapien
ctttgagctccgaaaattctttctc

SEQ ID NO: 61615 - DNA, 25 bp, Homo sapien
ctttgagggcacctgaatccacaag

SEQ ID NO: 61616 - DNA, 25 bp, Homo sapien
ctttgagggcacctgattccacaag

SEQ ID NO: 61617 - DNA, 25 bp, Homo sapien
ctttgagtgaagacataagatctat

SEQ ID NO: 61618 - DNA, 25 bp, Homo sapien
ctttgagtgaagacgtaagatctat

SEQ ID NO: 61619 - DNA, 25 bp, Homo sapien
ctttgagtggcataggaattatgat

SEQ ID NO: 61620 - DNA, 25 bp, Homo sapien
ctttgagtggcgtaggaattatgat

SEQ ID NO: 61621 - DNA, 25 bp, Homo sapien
ctttgagttgcatcgaacctgaaat

SEQ ID NO: 61622 - DNA, 25 bp, Homo sapien
ctttgagttgcattgaacctgaaat

SEQ ID NO: 61623 - DNA, 25 bp, Homo sapien
ctttgatatcatgctggcattaact

SEQ ID NO: 61624 - DNA, 25 bp, Homo sapien
ctttgatatcatgttggcattaact

SEQ ID NO: 61625 - DNA, 25 bp, Homo sapien
ctttgatcgatgcggttgttctttc

SEQ ID NO: 61626 - DNA, 25 bp, Homo sapien
ctttgatcgatgtggttgttctttc

SEQ ID NO: 61627 - DNA, 25 bp, Homo sapien
ctttgatgatgccaattgctatatt

SEQ ID NO: 61628 - DNA, 25 bp, Homo sapien
ctttgatgatgctaattgctatatt

SEQ ID NO: 61629 - DNA, 25 bp, Homo sapien
ctttgatgccataattccttagttt

SEQ ID NO: 61630 - DNA, 25 bp, Homo sapien
ctttgatgccataattgcttagttt

SEQ ID NO: 61631 - DNA, 25 bp, Homo sapien
ctttgatggccatgtccagtttgcc

SEQ ID NO: 61632 - DNA, 25 bp, Homo sapien
ctttgatggccatgtcgagtttgcc

SEQ ID NO: 61633 - DNA, 25 bp, Homo sapien
ctttgattgtataatgaatcaacat

SEQ ID NO: 61634 - DNA, 25 bp, Homo sapien
ctttgattgtatagtgaatcaacat

SEQ ID NO: 61635 - DNA, 25 bp, Homo sapien
ctttgatttaacagacaatgtatag

SEQ ID NO: 61636 - DNA, 25 bp, Homo sapien
ctttgatttcagatttctaaccttt

SEQ ID NO: 61637 - DNA, 25 bp, Homo sapien
ctttgatttcagctttctaaccttt

SEQ ID NO: 61638 - DNA, 25 bp, Homo sapien
ctttgatttcctaatatgggatgga

SEQ ID NO: 61639 - DNA, 25 bp, Homo sapien
ctttgatttgacagacaatgtatag

SEQ ID NO: 61640 - DNA, 25 bp, Homo sapien
ctttgatttgctaatatgggatgga

SEQ ID NO: 61641 - DNA, 25 bp, Homo sapien
ctttgatttgtaaacttgtggtaat

SEQ ID NO: 61642 - DNA, 25 bp, Homo sapien
ctttgatttgtatacttgtggtaat

SEQ ID NO: 61643 - DNA, 25 bp, Homo sapien
ctttgcaaaaaaaccacaaagcacc

SEQ ID NO: 61644 - DNA, 25 bp, Homo sapien
ctttgcaaaaaaactacaaagcacc

SEQ ID NO: 61645 - DNA, 25 bp, Homo sapien
ctttgcaaaacactcacaaataggt

SEQ ID NO: 61646 - DNA, 25 bp, Homo sapien
ctttgcaaaacacttacaaataggt

SEQ ID NO: 61647 - DNA, 25 bp, Homo sapien
ctttgcaacatcacgacaaacacta

SEQ ID NO: 61648 - DNA, 25 bp, Homo sapien
ctttgcaacatcatgacaaacacta

SEQ ID NO: 61649 - DNA, 25 bp, Homo sapien
ctttgcaacatttgaacaatgatga

SEQ ID NO: 61650 - DNA, 25 bp, Homo sapien
ctttgcaacatttggacaatgatga

SEQ ID NO: 61651 - DNA, 25 bp, Homo sapien
ctttgcaacctccaaccgctggatt

SEQ ID NO: 61652 - DNA, 25 bp, Homo sapien
ctttgcaacctccaactgctggatt

SEQ ID NO: 61653 - DNA, 25 bp, Homo sapien
ctttgcaccactatcacatcacctg

SEQ ID NO: 61654 - DNA, 25 bp, Homo sapien
ctttgcacccaaaactccaaactgc

SEQ ID NO: 61655 - DNA, 25 bp, Homo sapien
ctttgcacccacaactccaaactgc

SEQ ID NO: 61656 - DNA, 25 bp, Homo sapien
ctttgcaccgctatcacatcacctg

SEQ ID NO: 61657 - DNA, 25 bp, Homo sapien
ctttgcacctagaagaattagaaaa

SEQ ID NO: 61658 - DNA, 25 bp, Homo sapien
ctttgcacctagaggaattagaaaa

SEQ ID NO: 61659 - DNA, 25 bp, Homo sapien
ctttgcagactcaaataaatccaaa

SEQ ID NO: 61660 - DNA, 25 bp, Homo sapien
ctttgcagattcaaataaatccaaa

SEQ ID NO: 61661 - DNA, 25 bp, Homo sapien
ctttgcagcagtcttcataatgcca

SEQ ID NO: 61662 - DNA, 25 bp, Homo sapien
ctttgcagcggtcttcataatgcca

SEQ ID NO: 61663 - DNA, 25 bp, Homo sapien
ctttgcatatagttgcatcttgaag

SEQ ID NO: 61664 - DNA, 25 bp, Homo sapien
ctttgcatatagttgcgtcttgaag

SEQ ID NO: 61665 - DNA, 25 bp, Homo sapien
ctttgcatgctgtgtacgcttatga

SEQ ID NO: 61666 - DNA, 25 bp, Homo sapien
ctttgcatgttgtgtacgcttatga

SEQ ID NO: 61667 - DNA, 25 bp, Homo sapien
ctttgccaaataaggtaacaaattc

SEQ ID NO: 61668 - DNA, 25 bp, Homo sapien
ctttgccaagtaaggtaacaaattc

SEQ ID NO: 61669 - DNA, 25 bp, Homo sapien
ctttgccacagagcgagatcctgtc

SEQ ID NO: 61670 - DNA, 25 bp, Homo sapien
ctttgccatagagcgagatcctgtc

SEQ ID NO: 61671 - DNA, 25 bp, Homo sapien
ctttgccatgggaatctctttgcct

SEQ ID NO: 61672 - DNA, 25 bp, Homo sapien
ctttgccatgggattctctttgcct

SEQ ID NO: 61673 - DNA, 25 bp, Homo sapien
ctttgccattggtttgtacaagtga

SEQ ID NO: 61674 - DNA, 25 bp, Homo sapien
ctttgccattgttttgtacaagtga

SEQ ID NO: 61675 - DNA, 25 bp, Homo sapien
ctttgcccaccacatgataaatgta

SEQ ID NO: 61676 - DNA, 25 bp, Homo sapien
ctttgcccactgtcgatggccaaag

SEQ ID NO: 61677 - DNA, 25 bp, Homo sapien
ctttgcccactgtctatggccaaag

SEQ ID NO: 61678 - DNA, 25 bp, Homo sapien
ctttgcccgccacatgataaatgta

SEQ ID NO: 61679 - DNA, 25 bp, Homo sapien
ctttgccgacagacaattttaaata

SEQ ID NO: 61680 - DNA, 25 bp, Homo sapien
ctttgccgacagaccattttaaata

SEQ ID NO: 61681 - DNA, 25 bp, Homo sapien
ctttgctcgcattactattacccct

SEQ ID NO: 61682 - DNA, 25 bp, Homo sapien
ctttgctctcattactattacccct

SEQ ID NO: 61683 - DNA, 25 bp, Homo sapien
ctttgctctccagcaccgactttct

SEQ ID NO: 61684 - DNA, 25 bp, Homo sapien
ctttgctctccagcactgactttct

SEQ ID NO: 61685 - DNA, 25 bp, Homo sapien
ctttgctcttggagtttttaagata

SEQ ID NO: 61686 - DNA, 25 bp, Homo sapien
ctttgctcttggattttttaagata

SEQ ID NO: 61687 - DNA, 25 bp, Homo sapien
ctttgctgatggccttgaagcagcc

SEQ ID NO: 61688 - DNA, 25 bp, Homo sapien
ctttgctgatggctttgaagcagcc

SEQ ID NO: 61689 - DNA, 25 bp, Homo sapien
ctttgctgcttcaacttgttctctg

SEQ ID NO: 61690 - DNA, 25 bp, Homo sapien
ctttgctgcttcatcttgttctctg

SEQ ID NO: 61691 - DNA, 25 bp, Homo sapien
ctttgctgtttcatttatagagcag

SEQ ID NO: 61692 - DNA, 25 bp, Homo sapien
ctttgctgtttcctttatagagcag

SEQ ID NO: 61693 - DNA, 25 bp, Homo sapien
ctttgctgttttaacctactgaggt

SEQ ID NO: 61694 - DNA, 25 bp, Homo sapien
ctttgctgttttaagctactgaggt

SEQ ID NO: 61695 - DNA, 25 bp, Homo sapien
ctttgctttttctactagcatagag

SEQ ID NO: 61696 - DNA, 25 bp, Homo sapien
ctttgctttttgtactagcatagag

SEQ ID NO: 61697 - DNA, 25 bp, Homo sapien
ctttggaaagaactgagccagccca

SEQ ID NO: 61698 - DNA, 25 bp, Homo sapien
ctttggaaagaattgagccagccca

SEQ ID NO: 61699 - DNA, 25 bp, Homo sapien
ctttggaaagtgatgtcttgactgg

SEQ ID NO: 61700 - DNA, 25 bp, Homo sapien
ctttggaaagtggtgtcttgactgg

SEQ ID NO: 61701 - DNA, 25 bp, Homo sapien
ctttggaaattggcatgaggagtct

SEQ ID NO: 61702 - DNA, 25 bp, Homo sapien
ctttggaaattggtatgaggagtct

SEQ ID NO: 61703 - DNA, 25 bp, Homo sapien
ctttggaacactgtggaaagccaag

SEQ ID NO: 61704 - DNA, 25 bp, Homo sapien
ctttggaactctgtggaaagccaag

SEQ ID NO: 61705 - DNA, 25 bp, Homo sapien
ctttggaagacaatctgacactttc

SEQ ID NO: 61706 - DNA, 25 bp, Homo sapien
ctttggaagacaatttgacactttc

SEQ ID NO: 61707 - DNA, 25 bp, Homo sapien
ctttggaattcttgacctggttaag

SEQ ID NO: 61708 - DNA, 25 bp, Homo sapien
ctttggaattcttgacttggttaag

SEQ ID NO: 61709 - DNA, 25 bp, Homo sapien
ctttggactcagggtttatactagc

SEQ ID NO: 61710 - DNA, 25 bp, Homo sapien
ctttggactcaggttttatactagc

SEQ ID NO: 61711 - DNA, 25 bp, Homo sapien
ctttggagtgtggactgttcggtta

SEQ ID NO: 61712 - DNA, 25 bp, Homo sapien
ctttggagtgtgtactgttcggtta

SEQ ID NO: 61713 - DNA, 25 bp, Homo sapien
ctttggagttgcacatgctattcat

SEQ ID NO: 61714 - DNA, 25 bp, Homo sapien
ctttggagttgcacctgctattcat

SEQ ID NO: 61715 - DNA, 25 bp, Homo sapien
ctttggatatttggattccagtcct

SEQ ID NO: 61716 - DNA, 25 bp, Homo sapien
ctttggatatttgggttccagtcct

SEQ ID NO: 61717 - DNA, 25 bp, Homo sapien
ctttggatgcagatgacagagtgtg

SEQ ID NO: 61718 - DNA, 25 bp, Homo sapien
ctttggatgcagatgagagagtgtg

SEQ ID NO: 61719 - DNA, 25 bp, Homo sapien
ctttggcacttgctgttcctccagc

SEQ ID NO: 61720 - DNA, 25 bp, Homo sapien
ctttggcacttgttgttcctccagc

SEQ ID NO: 61721 - DNA, 25 bp, Homo sapien
ctttggcatatggcttccaatttga

SEQ ID NO: 61722 - DNA, 25 bp, Homo sapien
ctttggcatatggctttcaatttga

SEQ ID NO: 61723 - DNA, 25 bp, Homo sapien
ctttggcatttgcttcaaacagcct

SEQ ID NO: 61724 - DNA, 25 bp, Homo sapien
ctttggcatttgtttcaaacagcct

SEQ ID NO: 61725 - DNA, 25 bp, Homo sapien
ctttggcccaacaaaggttcagaaa

SEQ ID NO: 61726 - DNA, 25 bp, Homo sapien
ctttggcccaacaaagtttcagaaa

SEQ ID NO: 61727 - DNA, 25 bp, Homo sapien
ctttggctactttcaagatttttct

SEQ ID NO: 61728 - DNA, 25 bp, Homo sapien
ctttggctattttcaagatttttct

SEQ ID NO: 61729 - DNA, 25 bp, Homo sapien
ctttggctgtaaatatatagcaatt

SEQ ID NO: 61730 - DNA, 25 bp, Homo sapien
ctttggctgtaagtatatagcaatt

SEQ ID NO: 61731 - DNA, 25 bp, Homo sapien
ctttggcttttaacaacatggtaga

SEQ ID NO: 61732 - DNA, 25 bp, Homo sapien
ctttggctttttacaacatggtaga

SEQ ID NO: 61733 - DNA, 25 bp, Homo sapien
ctttggctttttttggtccaactct

SEQ ID NO: 61734 - DNA, 25 bp, Homo sapien
ctttggcttttttttgtccaactct

SEQ ID NO: 61735 - DNA, 25 bp, Homo sapien
ctttgggaaacaaacaacttgccat

SEQ ID NO: 61736 - DNA, 25 bp, Homo sapien
ctttgggaaacaaccaacttgccat

SEQ ID NO: 61737 - DNA, 25 bp, Homo sapien
ctttgggaaaccttccatcccttgc

SEQ ID NO: 61738 - DNA, 25 bp, Homo sapien
ctttgggaaacgttccatcccttgc

SEQ ID NO: 61739 - DNA, 25 bp, Homo sapien
ctttgggaactaattaatgaggttg

SEQ ID NO: 61740 - DNA, 25 bp, Homo sapien
ctttgggaagaaaacgtctgtattg

SEQ ID NO: 61741 - DNA, 25 bp, Homo sapien
ctttgggaagaaaatgtctgtattg

SEQ ID NO: 61742 - DNA, 25 bp, Homo sapien
ctttgggagactgcagttggaggat

SEQ ID NO: 61743 - DNA, 25 bp, Homo sapien
ctttgggagactgcggttggaggat

SEQ ID NO: 61744 - DNA, 25 bp, Homo sapien
ctttgggagctaattaatgaggttg

SEQ ID NO: 61745 - DNA, 25 bp, Homo sapien
ctttgggcaagtttactccgagcct

SEQ ID NO: 61746 - DNA, 25 bp, Homo sapien
ctttgggcaggtttactccgagcct

SEQ ID NO: 61747 - DNA, 25 bp, Homo sapien
ctttgggctccttctggctccaagt

SEQ ID NO: 61748 - DNA, 25 bp, Homo sapien
ctttgggcttcttctggctccaagt

SEQ ID NO: 61749 - DNA, 25 bp, Homo sapien
ctttgggtcctctatagcacttact

SEQ ID NO: 61750 - DNA, 25 bp, Homo sapien
ctttgggtcctctgtagcacttact

SEQ ID NO: 61751 - DNA, 25 bp, Homo sapien
ctttggtctagcgtcctatagagct

SEQ ID NO: 61752 - DNA, 25 bp, Homo sapien
ctttggtctagtgtcctatagagct

SEQ ID NO: 61753 - DNA, 25 bp, Homo sapien
ctttggtgcaatcaaaggaatgtga

SEQ ID NO: 61754 - DNA, 25 bp, Homo sapien
ctttggtgcaattaaaggaatgtga

SEQ ID NO: 61755 - DNA, 25 bp, Homo sapien
ctttggtgccaggaaccaaaccaag

SEQ ID NO: 61756 - DNA, 25 bp, Homo sapien
ctttggtgccaggatccaaaccaag

SEQ ID NO: 61757 - DNA, 25 bp, Homo sapien
ctttggtggaaacattgctaacact

SEQ ID NO: 61758 - DNA, 25 bp, Homo sapien
ctttggtggaaacgttgctaacact

SEQ ID NO: 61759 - DNA, 25 bp, Homo sapien
ctttggtggtgtttctttgagacag

SEQ ID NO: 61760 - DNA, 25 bp, Homo sapien
ctttggtggtgtttttttgagacag

SEQ ID NO: 61761 - DNA, 25 bp, Homo sapien
ctttggtgtcattgacatggcaaga

SEQ ID NO: 61762 - DNA, 25 bp, Homo sapien
ctttggtgtcattgacttggcaaga

SEQ ID NO: 61763 - DNA, 25 bp, Homo sapien
ctttggttacatgaactgacttttg

SEQ ID NO: 61764 - DNA, 25 bp, Homo sapien
ctttggttacattaactgacttttg

SEQ ID NO: 61765 - DNA, 25 bp, Homo sapien
ctttggttcaaaagcggggttctaa

SEQ ID NO: 61766 - DNA, 25 bp, Homo sapien
ctttggtttaaaagcggggttctaa

SEQ ID NO: 61767 - DNA, 25 bp, Homo sapien
ctttggttttcccatcagcagatgt

SEQ ID NO: 61768 - DNA, 25 bp, Homo sapien
ctttggttttctcatcagcagatgt

SEQ ID NO: 61769 - DNA, 25 bp, Homo sapien
ctttgtaacaatttaggcgctacct

SEQ ID NO: 61770 - DNA, 25 bp, Homo sapien
ctttgtaacgatttaggcgctacct

SEQ ID NO: 61771 - DNA, 25 bp, Homo sapien
ctttgtacatcaccttcagaaggca

SEQ ID NO: 61772 - DNA, 25 bp, Homo sapien
ctttgtacgtcaccttcagaaggca

SEQ ID NO: 61773 - DNA, 25 bp, Homo sapien
ctttgtagatgggagaccctaagaa

SEQ ID NO: 61774 - DNA, 25 bp, Homo sapien
ctttgtagtctcataacaccctgaa

SEQ ID NO: 61775 - DNA, 25 bp, Homo sapien
ctttgtagttgggagaccctaagaa

SEQ ID NO: 61776 - DNA, 25 bp, Homo sapien
ctttgtagtttcataacaccctgaa

SEQ ID NO: 61777 - DNA, 25 bp, Homo sapien
ctttgtcaacaaatttggacacttt

SEQ ID NO: 61778 - DNA, 25 bp, Homo sapien
ctttgtcaataaatttggacacttt

SEQ ID NO: 61779 - DNA, 25 bp, Homo sapien
ctttgtcacatgccagatactatgt

SEQ ID NO: 61780 - DNA, 25 bp, Homo sapien
ctttgtcacttgccagatactatgt

SEQ ID NO: 61781 - DNA, 25 bp, Homo sapien
ctttgtcaggcatttcacagctttg

SEQ ID NO: 61782 - DNA, 25 bp, Homo sapien
ctttgtcaggcatttcgcagctttg

SEQ ID NO: 61783 - DNA, 25 bp, Homo sapien
ctttgtcctatacctgtgaagatga

SEQ ID NO: 61784 - DNA, 25 bp, Homo sapien
ctttgtcctatacgtgtgaagatga

SEQ ID NO: 61785 - DNA, 25 bp, Homo sapien
ctttgtccttacagagtttgtggtc

SEQ ID NO: 61786 - DNA, 25 bp, Homo sapien
ctttgtccttacggagtttgtggtc

SEQ ID NO: 61787 - DNA, 25 bp, Homo sapien
ctttgtctcctatagtagattattt

SEQ ID NO: 61788 - DNA, 25 bp, Homo sapien
ctttgtcttctatagtagattattt

SEQ ID NO: 61789 - DNA, 25 bp, Homo sapien
ctttgtctttggacattttcacctt

SEQ ID NO: 61790 - DNA, 25 bp, Homo sapien
ctttgtctttggacgttttcacctt

SEQ ID NO: 61791 - DNA, 25 bp, Homo sapien
ctttgtgaatgcctgttaacttagg

SEQ ID NO: 61792 - DNA, 25 bp, Homo sapien
ctttgtgaatgtctgttaacttagg

SEQ ID NO: 61793 - DNA, 25 bp, Homo sapien
ctttgtgacatgcatatattgcata

SEQ ID NO: 61794 - DNA, 25 bp, Homo sapien
ctttgtgacatgtatatattgcata

SEQ ID NO: 61795 - DNA, 25 bp, Homo sapien
ctttgtgaccttgcctcgtcagtgt

SEQ ID NO: 61796 - DNA, 25 bp, Homo sapien
ctttgtgaccttgccttgtcagtgt

SEQ ID NO: 61797 - DNA, 25 bp, Homo sapien
ctttgtgcacttaacccatctgtag

SEQ ID NO: 61798 - DNA, 25 bp, Homo sapien
ctttgtgcacttgacccatctgtag

SEQ ID NO: 61799 - DNA, 25 bp, Homo sapien
ctttgtggagtcccagaagcatgat

SEQ ID NO: 61800 - DNA, 25 bp, Homo sapien
ctttgtggagtctcagaagcatgat

SEQ ID NO: 61801 - DNA, 25 bp, Homo sapien
ctttgtgggattaggttctcctgat

SEQ ID NO: 61802 - DNA, 25 bp, Homo sapien
ctttgtgggattatgttctcctgat

SEQ ID NO: 61803 - DNA, 25 bp, Homo sapien
ctttgtggggtcaattccagtatca

SEQ ID NO: 61804 - DNA, 25 bp, Homo sapien
ctttgtggggtcatttccagtatca

SEQ ID NO: 61805 - DNA, 25 bp, Homo sapien
ctttgtgtccatccacagatactct

SEQ ID NO: 61806 - DNA, 25 bp, Homo sapien
ctttgtgtctatccacagatactct

SEQ ID NO: 61807 - DNA, 25 bp, Homo sapien
ctttgtgtggagccgttttcctgta

SEQ ID NO: 61808 - DNA, 25 bp, Homo sapien
ctttgtgtggagctgttttcctgta

SEQ ID NO: 61809 - DNA, 25 bp, Homo sapien
ctttgtgttttcagttgttattttc

SEQ ID NO: 61810 - DNA, 25 bp, Homo sapien
ctttgtgtttttagttgttattttc

SEQ ID NO: 61811 - DNA, 25 bp, Homo sapien
ctttgttcctttctaccattactgg

SEQ ID NO: 61812 - DNA, 25 bp, Homo sapien
ctttgttctatcacccgtatctgct

SEQ ID NO: 61813 - DNA, 25 bp, Homo sapien
ctttgttctatcatccgtatctgct

SEQ ID NO: 61814 - DNA, 25 bp, Homo sapien
ctttgttcttttctaccattactgg

SEQ ID NO: 61815 - DNA, 25 bp, Homo sapien
ctttgttgatctaccaatctccatc

SEQ ID NO: 61816 - DNA, 25 bp, Homo sapien
ctttgttggattgactcaaactctt

SEQ ID NO: 61817 - DNA, 25 bp, Homo sapien
ctttgttggattgacttaaactctt

SEQ ID NO: 61818 - DNA, 25 bp, Homo sapien
ctttgttggtctaccaatctccatc

SEQ ID NO: 61819 - DNA, 25 bp, Homo sapien
ctttgttgtttcacttatagaacac

SEQ ID NO: 61820 - DNA, 25 bp, Homo sapien
ctttgttgtttcgcttatagaacac

SEQ ID NO: 61821 - DNA, 25 bp, Homo sapien
ctttgtttcatgtgctgtgcatttc

SEQ ID NO: 61822 - DNA, 25 bp, Homo sapien
ctttgtttcctttttagacatacca

SEQ ID NO: 61823 - DNA, 25 bp, Homo sapien
ctttgtttcgtgtgctgtgcatttc

SEQ ID NO: 61824 - DNA, 25 bp, Homo sapien
ctttgtttcttttttagacatacca

SEQ ID NO: 61825 - DNA, 25 bp, Homo sapien
ctttgtttgactagttctcattcaa

SEQ ID NO: 61826 - DNA, 25 bp, Homo sapien
ctttgtttgactggttctcattcaa

SEQ ID NO: 61827 - DNA, 25 bp, Homo sapien
ctttgttttccaatagaaatcattc

SEQ ID NO: 61828 - DNA, 25 bp, Homo sapien
ctttgttttccagtagaaatcattc

SEQ ID NO: 61829 - DNA, 25 bp, Homo sapien
cttttaaaaaatgaagagtctgtca

SEQ ID NO: 61830 - DNA, 25 bp, Homo sapien
cttttaaaaaatgacgagtctgtca

SEQ ID NO: 61831 - DNA, 25 bp, Homo sapien
cttttaaaacaagccatgtgttagt

SEQ ID NO: 61832 - DNA, 25 bp, Homo sapien
cttttaaaacaatccatgtgttagt

SEQ ID NO: 61833 - DNA, 25 bp, Homo sapien
cttttaaaatctgatctgcaaaaag

SEQ ID NO: 61834 - DNA, 25 bp, Homo sapien
cttttaaacaatcaatagaatatga

SEQ ID NO: 61835 - DNA, 25 bp, Homo sapien
cttttaaacaatcagtagaatatga

SEQ ID NO: 61836 - DNA, 25 bp, Homo sapien
cttttaaacatactacacattcaat

SEQ ID NO: 61837 - DNA, 25 bp, Homo sapien
cttttaaacatactgcacattcaat

SEQ ID NO: 61838 - DNA, 25 bp, Homo sapien
cttttaaagaatcagagttttttca

SEQ ID NO: 61839 - DNA, 25 bp, Homo sapien
cttttaaagaatcggagttttttca

SEQ ID NO: 61840 - DNA, 25 bp, Homo sapien
cttttaaagtctgatctgcaaaaag

SEQ ID NO: 61841 - DNA, 25 bp, Homo sapien
cttttaacaaacataattccctctc

SEQ ID NO: 61842 - DNA, 25 bp, Homo sapien
cttttaacaaacatcattccctctc

SEQ ID NO: 61843 - DNA, 25 bp, Homo sapien
cttttaagcaagcacccgttttcac

SEQ ID NO: 61844 - DNA, 25 bp, Homo sapien
cttttaagcaagcgcccgttttcac

SEQ ID NO: 61845 - DNA, 25 bp, Homo sapien
cttttaaggagtttctgtatttcac

SEQ ID NO: 61846 - DNA, 25 bp, Homo sapien
cttttaagtagtttctgtatttcac

SEQ ID NO: 61847 - DNA, 25 bp, Homo sapien
cttttaatctgcactgaagtatttc

SEQ ID NO: 61848 - DNA, 25 bp, Homo sapien
cttttaatctgcattgaagtatttc

SEQ ID NO: 61849 - DNA, 25 bp, Homo sapien
cttttaatggatagattacacagag

SEQ ID NO: 61850 - DNA, 25 bp, Homo sapien
cttttaatggatggattacacagag

SEQ ID NO: 61851 - DNA, 25 bp, Homo sapien
cttttaattggcaacaagaaaaagg

SEQ ID NO: 61852 - DNA, 25 bp, Homo sapien
cttttaatttgcaacaagaaaaagg

SEQ ID NO: 61853 - DNA, 25 bp, Homo sapien
cttttacaatgatggcagaattggt

SEQ ID NO: 61854 - DNA, 25 bp, Homo sapien
cttttacaatggtggcagaattggt

SEQ ID NO: 61855 - DNA, 25 bp, Homo sapien
cttttacagggtcagagtagataat

SEQ ID NO: 61856 - DNA, 25 bp, Homo sapien
cttttacagggtgagagtagataat

SEQ ID NO: 61857 - DNA, 25 bp, Homo sapien
cttttacagtctgcagagaaaaatg

SEQ ID NO: 61858 - DNA, 25 bp, Homo sapien
cttttacagtcttcagagaaaaatg

SEQ ID NO: 61859 - DNA, 25 bp, Homo sapien
cttttaccaatttccccttatcaat

SEQ ID NO: 61860 - DNA, 25 bp, Homo sapien
cttttaccattttccccttatcaat

SEQ ID NO: 61861 - DNA, 25 bp, Homo sapien
cttttactatgtccaaagtcttttg

SEQ ID NO: 61862 - DNA, 25 bp, Homo sapien
cttttactcggtgactcttcctctg

SEQ ID NO: 61863 - DNA, 25 bp, Homo sapien
cttttactctgtccaaagtcttttg

SEQ ID NO: 61864 - DNA, 25 bp, Homo sapien
cttttacttattattacagcttcaa

SEQ ID NO: 61865 - DNA, 25 bp, Homo sapien
cttttacttggtgactcttcctctg

SEQ ID NO: 61866 - DNA, 25 bp, Homo sapien
cttttactttagttcaccaaaccta

SEQ ID NO: 61867 - DNA, 25 bp, Homo sapien
cttttactttagttcatcaaaccta

SEQ ID NO: 61868 - DNA, 25 bp, Homo sapien
cttttactttttattacagcttcaa

SEQ ID NO: 61869 - DNA, 25 bp, Homo sapien
cttttagaagaatatcatcttgaag

SEQ ID NO: 61870 - DNA, 25 bp, Homo sapien
cttttagaagaatatcgtcttgaag

SEQ ID NO: 61871 - DNA, 25 bp, Homo sapien
cttttagaattcaaaccattatctg

SEQ ID NO: 61872 - DNA, 25 bp, Homo sapien
cttttagaattcagaccattatctg

SEQ ID NO: 61873 - DNA, 25 bp, Homo sapien
cttttagacccaacactcagggaag

SEQ ID NO: 61874 - DNA, 25 bp, Homo sapien
cttttagatccaacactcagggaag

SEQ ID NO: 61875 - DNA, 25 bp, Homo sapien
cttttagattgtatcacctctttac

SEQ ID NO: 61876 - DNA, 25 bp, Homo sapien
cttttagattgtatcatctctttac

SEQ ID NO: 61877 - DNA, 25 bp, Homo sapien
cttttagcagccctattccagaaac

SEQ ID NO: 61878 - DNA, 25 bp, Homo sapien
cttttagcagctctattccagaaac

SEQ ID NO: 61879 - DNA, 25 bp, Homo sapien
cttttagcatgaaagaaaagttatg

SEQ ID NO: 61880 - DNA, 25 bp, Homo sapien
cttttagccatgaaagagaatatac

SEQ ID NO: 61881 - DNA, 25 bp, Homo sapien
cttttagccatgtaagagaatatac

SEQ ID NO: 61882 - DNA, 25 bp, Homo sapien
cttttagcgtgaaagaaaagttatg

SEQ ID NO: 61883 - DNA, 25 bp, Homo sapien
cttttaggatcaattgacccttgag

SEQ ID NO: 61884 - DNA, 25 bp, Homo sapien
cttttaggatcagttgacccttgag

SEQ ID NO: 61885 - DNA, 25 bp, Homo sapien
cttttaggtatacggcacaggcttt

SEQ ID NO: 61886 - DNA, 25 bp, Homo sapien
cttttaggtatatggcacaggcttt

SEQ ID NO: 61887 - DNA, 25 bp, Homo sapien
cttttagtatgccttcaaatttttt

SEQ ID NO: 61888 - DNA, 25 bp, Homo sapien
cttttagtatgccttctaatttttt

SEQ ID NO: 61889 - DNA, 25 bp, Homo sapien
cttttagtcaaatgtatcaaactcc

SEQ ID NO: 61890 - DNA, 25 bp, Homo sapien
cttttagtcaagtgtatcaaactcc

SEQ ID NO: 61891 - DNA, 25 bp, Homo sapien
cttttagttgctgagcttaatcatt

SEQ ID NO: 61892 - DNA, 25 bp, Homo sapien
cttttagtttctgagcttaatcatt

SEQ ID NO: 61893 - DNA, 25 bp, Homo sapien
cttttataaatccattcactaccca

SEQ ID NO: 61894 - DNA, 25 bp, Homo sapien
cttttataaatccgttcactaccca

SEQ ID NO: 61895 - DNA, 25 bp, Homo sapien
cttttataactaacttactgacaat

SEQ ID NO: 61896 - DNA, 25 bp, Homo sapien
cttttataactaatttactgacaat

SEQ ID NO: 61897 - DNA, 25 bp, Homo sapien
cttttataatccttcctcaactagt

SEQ ID NO: 61898 - DNA, 25 bp, Homo sapien
cttttataatcctttctcaactagt

SEQ ID NO: 61899 - DNA, 25 bp, Homo sapien
cttttatcattacggcatcatcgtc

SEQ ID NO: 61900 - DNA, 25 bp, Homo sapien
cttttatcattatggcatcatcgtc

SEQ ID NO: 61901 - DNA, 25 bp, Homo sapien
cttttatcattcacctaaagaccca

SEQ ID NO: 61902 - DNA, 25 bp, Homo sapien
cttttatcattcatctaaagaccca

SEQ ID NO: 61903 - DNA, 25 bp, Homo sapien
cttttatcttattgctccagcactc

SEQ ID NO: 61904 - DNA, 25 bp, Homo sapien
cttttatcttattgttccagcactc

SEQ ID NO: 61905 - DNA, 25 bp, Homo sapien
cttttatggcagagtgcgtgatgga

SEQ ID NO: 61906 - DNA, 25 bp, Homo sapien
cttttatggcagagtgtgtgatgga

SEQ ID NO: 61907 - DNA, 25 bp, Homo sapien
cttttatggctgtacgctgaaatga

SEQ ID NO: 61908 - DNA, 25 bp, Homo sapien
cttttatggctgtatgctgaaatga

SEQ ID NO: 61909 - DNA, 25 bp, Homo sapien
cttttattaactacatgcgcttgga

SEQ ID NO: 61910 - DNA, 25 bp, Homo sapien
cttttattaactacgtgcgcttgga

SEQ ID NO: 61911 - DNA, 25 bp, Homo sapien
cttttattaccagtgaatagtgtaa

SEQ ID NO: 61912 - DNA, 25 bp, Homo sapien
cttttattaccattctgtagcagaa

SEQ ID NO: 61913 - DNA, 25 bp, Homo sapien
cttttattaccattttgtagcagaa

SEQ ID NO: 61914 - DNA, 25 bp, Homo sapien
cttttattatcagtgaatagtgtaa

SEQ ID NO: 61915 - DNA, 25 bp, Homo sapien
cttttattccaatgttacaatctct

SEQ ID NO: 61916 - DNA, 25 bp, Homo sapien
cttttattccaatgttgcaatctct

SEQ ID NO: 61917 - DNA, 25 bp, Homo sapien
cttttattcgggtacttgttgcttt

SEQ ID NO: 61918 - DNA, 25 bp, Homo sapien
cttttattcgggtgcttgttgcttt

SEQ ID NO: 61919 - DNA, 25 bp, Homo sapien
cttttattctagtcatgattgcagc

SEQ ID NO: 61920 - DNA, 25 bp, Homo sapien
cttttattctagtcgtgattgcagc

SEQ ID NO: 61921 - DNA, 25 bp, Homo sapien
cttttatttttaagaagatcaaagt

SEQ ID NO: 61922 - DNA, 25 bp, Homo sapien
cttttatttttgagaagatcaaagt

SEQ ID NO: 61923 - DNA, 25 bp, Homo sapien
cttttcaaaagcctacattatataa

SEQ ID NO: 61924 - DNA, 25 bp, Homo sapien
cttttcaaaagcttacattatataa

SEQ ID NO: 61925 - DNA, 25 bp, Homo sapien
cttttcaagactcaacacactttgc

SEQ ID NO: 61926 - DNA, 25 bp, Homo sapien
cttttcaaggctcaacacactttgc

SEQ ID NO: 61927 - DNA, 25 bp, Homo sapien
cttttcactactacacagtgcatct

SEQ ID NO: 61928 - DNA, 25 bp, Homo sapien
cttttcactactccacagtgcatct

SEQ ID NO: 61929 - DNA, 25 bp, Homo sapien
cttttcaggatatattcttacccaa

SEQ ID NO: 61930 - DNA, 25 bp, Homo sapien
cttttcaggcagcgaaaaagttcta

SEQ ID NO: 61931 - DNA, 25 bp, Homo sapien
cttttcaggcagtgaaaaagttcta

SEQ ID NO: 61932 - DNA, 25 bp, Homo sapien
cttttcagtatatattcttacccaa

SEQ ID NO: 61933 - DNA, 25 bp, Homo sapien
cttttcataagactcgcccaccaat

SEQ ID NO: 61934 - DNA, 25 bp, Homo sapien
cttttcataagattcgcccaccaat

SEQ ID NO: 61935 - DNA, 25 bp, Homo sapien
cttttcatatgctcacatgacatct

SEQ ID NO: 61936 - DNA, 25 bp, Homo sapien
cttttcatatgcttacatgacatct

SEQ ID NO: 61937 - DNA, 25 bp, Homo sapien
cttttcatattcaaatactctgctt

SEQ ID NO: 61938 - DNA, 25 bp, Homo sapien
cttttcatattcaaatgctctgctt

SEQ ID NO: 61939 - DNA, 25 bp, Homo sapien
cttttcatcagccaaaaagaaagaa

SEQ ID NO: 61940 - DNA, 25 bp, Homo sapien
cttttcatcagccataaagaaagaa

SEQ ID NO: 61941 - DNA, 25 bp, Homo sapien
cttttcatctgcctgctccttaaat

SEQ ID NO: 61942 - DNA, 25 bp, Homo sapien
cttttcatctgtctgctccttaaat

SEQ ID NO: 61943 - DNA, 25 bp, Homo sapien
cttttcattcaccaagccaactgtg

SEQ ID NO: 61944 - DNA, 25 bp, Homo sapien
cttttcattcaccgagccaactgtg

SEQ ID NO: 61945 - DNA, 25 bp, Homo sapien
cttttcattttgctaagtttgttta

SEQ ID NO: 61946 - DNA, 25 bp, Homo sapien
cttttcattttggtaagtttgttta

SEQ ID NO: 61947 - DNA, 25 bp, Homo sapien
cttttccattgaatccaggaatata

SEQ ID NO: 61948 - DNA, 25 bp, Homo sapien
cttttccattgattccaggaatata

SEQ ID NO: 61949 - DNA, 25 bp, Homo sapien
cttttcccactcagctcattgtatg

SEQ ID NO: 61950 - DNA, 25 bp, Homo sapien
cttttcccgctcagctcattgtatg

SEQ ID NO: 61951 - DNA, 25 bp, Homo sapien
cttttccctgcctgacatactttgg

SEQ ID NO: 61952 - DNA, 25 bp, Homo sapien
cttttcccttcctgacatactttgg

SEQ ID NO: 61953 - DNA, 25 bp, Homo sapien
cttttcctagagcccgtgagccggg

SEQ ID NO: 61954 - DNA, 25 bp, Homo sapien
cttttcctagagcctgtgagccggg

SEQ ID NO: 61955 - DNA, 25 bp, Homo sapien
cttttcctcaaacagttcctgctaa

SEQ ID NO: 61956 - DNA, 25 bp, Homo sapien
cttttcctcaaacatttcctgctaa

SEQ ID NO: 61957 - DNA, 25 bp, Homo sapien
cttttcctcttctcaaaagtacctg

SEQ ID NO: 61958 - DNA, 25 bp, Homo sapien
cttttcctcttctccaaagtacctg

SEQ ID NO: 61959 - DNA, 25 bp, Homo sapien
cttttcctgcctccttatttgactg

SEQ ID NO: 61960 - DNA, 25 bp, Homo sapien
cttttcctgcctgcttatttgactg

SEQ ID NO: 61961 - DNA, 25 bp, Homo sapien
cttttcctgtcatgccaccttgctc

SEQ ID NO: 61962 - DNA, 25 bp, Homo sapien
cttttcctgtcatgccgccttgctc

SEQ ID NO: 61963 - DNA, 25 bp, Homo sapien
cttttcctgtgagcttgcattgccc

SEQ ID NO: 61964 - DNA, 25 bp, Homo sapien
cttttcctgtgatcttgcattgccc

SEQ ID NO: 61965 - DNA, 25 bp, Homo sapien
cttttccttaatttcctcactgcca

SEQ ID NO: 61966 - DNA, 25 bp, Homo sapien
cttttccttaattttctcactgcca

SEQ ID NO: 61967 - DNA, 25 bp, Homo sapien
cttttcgcaatttgatcatgaaatt

SEQ ID NO: 61968 - DNA, 25 bp, Homo sapien
cttttcgcaatttggtcatgaaatt

SEQ ID NO: 61969 - DNA, 25 bp, Homo sapien
cttttcgtgggacgagagcagaggg

SEQ ID NO: 61970 - DNA, 25 bp, Homo sapien
cttttcgtgggatgagagcagaggg

SEQ ID NO: 61971 - DNA, 25 bp, Homo sapien
cttttctaaagaattaatgtacaga

SEQ ID NO: 61972 - DNA, 25 bp, Homo sapien
cttttctaaagagttaatgtacaga

SEQ ID NO: 61973 - DNA, 25 bp, Homo sapien
cttttctaccatacgtcacaaaccg

SEQ ID NO: 61974 - DNA, 25 bp, Homo sapien
cttttctaccatgcgtcacaaaccg

SEQ ID NO: 61975 - DNA, 25 bp, Homo sapien
cttttctattttacgcagcaggttt

SEQ ID NO: 61976 - DNA, 25 bp, Homo sapien
cttttctattttatgcagcaggttt

SEQ ID NO: 61977 - DNA, 25 bp, Homo sapien
cttttctcccgaatgatgggatctg

SEQ ID NO: 61978 - DNA, 25 bp, Homo sapien
cttttctcccgagtgatgggatctg

SEQ ID NO: 61979 - DNA, 25 bp, Homo sapien
cttttctctagtgtccttcttaaga

SEQ ID NO: 61980 - DNA, 25 bp, Homo sapien
cttttctctagtgttcttcttaaga

SEQ ID NO: 61981 - DNA, 25 bp, Homo sapien
cttttctctccaacaactacctgct

SEQ ID NO: 61982 - DNA, 25 bp, Homo sapien
cttttctctccaacaattacctgct

SEQ ID NO: 61983 - DNA, 25 bp, Homo sapien
cttttctctgcaccatccagcgctg

SEQ ID NO: 61984 - DNA, 25 bp, Homo sapien
cttttctctgcgccatccagcgctg

SEQ ID NO: 61985 - DNA, 25 bp, Homo sapien
cttttctgaagaatgcgttgggcca

SEQ ID NO: 61986 - DNA, 25 bp, Homo sapien
cttttctgaagaatgctttgggcca

SEQ ID NO: 61987 - DNA, 25 bp, Homo sapien
cttttctgaatgataaaaaagtgac

SEQ ID NO: 61988 - DNA, 25 bp, Homo sapien
cttttctgattgataaaaaagtgac

SEQ ID NO: 61989 - DNA, 25 bp, Homo sapien
cttttctgcatgacagatgaaaaat

SEQ ID NO: 61990 - DNA, 25 bp, Homo sapien
cttttctgcgtgacagatgaaaaat

SEQ ID NO: 61991 - DNA, 25 bp, Homo sapien
cttttcttattctctctaatcctgt

SEQ ID NO: 61992 - DNA, 25 bp, Homo sapien
cttttcttattctgtctaatcctgt

SEQ ID NO: 61993 - DNA, 25 bp, Homo sapien
cttttcttcagacgtagaatgccag

SEQ ID NO: 61994 - DNA, 25 bp, Homo sapien
cttttcttccgacgtagaatgccag

SEQ ID NO: 61995 - DNA, 25 bp, Homo sapien
cttttcttctgggaaatgctaccct

SEQ ID NO: 61996 - DNA, 25 bp, Homo sapien
cttttcttctgtgaaatgctaccct

SEQ ID NO: 61997 - DNA, 25 bp, Homo sapien
cttttctttcacaggtatgaaggtt

SEQ ID NO: 61998 - DNA, 25 bp, Homo sapien
cttttctttcacgggtatgaaggtt

SEQ ID NO: 61999 - DNA, 25 bp, Homo sapien
cttttgaaacgtaaacaaaagagga

SEQ ID NO: 62000 - DNA, 25 bp, Homo sapien
cttttgaaatgtaaacaaaagagga

SEQ ID NO: 62001 - DNA, 25 bp, Homo sapien
cttttgaaattcctaggtaagcagc

SEQ ID NO: 62002 - DNA, 25 bp, Homo sapien
cttttgaacatacaattcggtgact

SEQ ID NO: 62003 - DNA, 25 bp, Homo sapien
cttttgaacgtacaattcggtgact

SEQ ID NO: 62004 - DNA, 25 bp, Homo sapien
cttttgaaggcactgaaaaaatata

SEQ ID NO: 62005 - DNA, 25 bp, Homo sapien
cttttgaaggcactgagaaaatata

SEQ ID NO: 62006 - DNA, 25 bp, Homo sapien
cttttgaagttcctaggtaagcagc

SEQ ID NO: 62007 - DNA, 25 bp, Homo sapien
cttttgaatagtatcagacactttt

SEQ ID NO: 62008 - DNA, 25 bp, Homo sapien
cttttgaatagtattagacactttt

SEQ ID NO: 62009 - DNA, 25 bp, Homo sapien
cttttgacaccaagaagtatgggaa

SEQ ID NO: 62010 - DNA, 25 bp, Homo sapien
cttttgacaccaggaagtatgggaa

SEQ ID NO: 62011 - DNA, 25 bp, Homo sapien
cttttgaggatggctgttatccttc

SEQ ID NO: 62012 - DNA, 25 bp, Homo sapien
cttttgaggatgggtgttatccttc

SEQ ID NO: 62013 - DNA, 25 bp, Homo sapien
cttttgaggttaagaacgagtaata

SEQ ID NO: 62014 - DNA, 25 bp, Homo sapien
cttttgaggttaagaatgagtaata

SEQ ID NO: 62015 - DNA, 25 bp, Homo sapien
cttttgagttgctggaacataaatc

SEQ ID NO: 62016 - DNA, 25 bp, Homo sapien
cttttgagttgttggaacataaatc

SEQ ID NO: 62017 - DNA, 25 bp, Homo sapien
cttttgatggcactgattggaacag

SEQ ID NO: 62018 - DNA, 25 bp, Homo sapien
cttttgattgcactgattggaacag

SEQ ID NO: 62019 - DNA, 25 bp, Homo sapien
cttttgatttcctctttaactcatc

SEQ ID NO: 62020 - DNA, 25 bp, Homo sapien
cttttgatttcttctttaactcatc

SEQ ID NO: 62021 - DNA, 25 bp, Homo sapien
cttttgcagactctaaagaggccac

SEQ ID NO: 62022 - DNA, 25 bp, Homo sapien
cttttgcagactctgaagaggccac

SEQ ID NO: 62023 - DNA, 25 bp, Homo sapien
cttttgcagcaaagcctttcccacc

SEQ ID NO: 62024 - DNA, 25 bp, Homo sapien
cttttgcagcagagcctttcccacc

SEQ ID NO: 62025 - DNA, 25 bp, Homo sapien
cttttgcatttgggccgcaaagtaa

SEQ ID NO: 62026 - DNA, 25 bp, Homo sapien
cttttgcatttgggcctcaaagtaa

SEQ ID NO: 62027 - DNA, 25 bp, Homo sapien
cttttgccagaacataccacaatta

SEQ ID NO: 62028 - DNA, 25 bp, Homo sapien
cttttgccagagcataccacaatta

SEQ ID NO: 62029 - DNA, 25 bp, Homo sapien
cttttgccaggaactgaatgcccat

SEQ ID NO: 62030 - DNA, 25 bp, Homo sapien
cttttgccaggaattgaatgcccat

SEQ ID NO: 62031 - DNA, 25 bp, Homo sapien
cttttgctagagaatgaaatcaaag

SEQ ID NO: 62032 - DNA, 25 bp, Homo sapien
cttttgctatagaatgaaatcaaag

SEQ ID NO: 62033 - DNA, 25 bp, Homo sapien
cttttgctatccactgaattgttac

SEQ ID NO: 62034 - DNA, 25 bp, Homo sapien
cttttgctatccattgaattgttac

SEQ ID NO: 62035 - DNA, 25 bp, Homo sapien
cttttgctgaaaacgtgaacttgtt

SEQ ID NO: 62036 - DNA, 25 bp, Homo sapien
cttttgctgaaaatgtgaacttgtt

SEQ ID NO: 62037 - DNA, 25 bp, Homo sapien
cttttgctggttaatgagatgactg

SEQ ID NO: 62038 - DNA, 25 bp, Homo sapien
cttttgcttcgggcaatatcctaag

SEQ ID NO: 62039 - DNA, 25 bp, Homo sapien
cttttgcttgttaatgagatgactg

SEQ ID NO: 62040 - DNA, 25 bp, Homo sapien
cttttgctttgggcaatatcctaag

SEQ ID NO: 62041 - DNA, 25 bp, Homo sapien
cttttggaggtcttctctggaatta

SEQ ID NO: 62042 - DNA, 25 bp, Homo sapien
cttttggaggtcttctttggaatta

SEQ ID NO: 62043 - DNA, 25 bp, Homo sapien
cttttggcaggtcacatgtgctgtc

SEQ ID NO: 62044 - DNA, 25 bp, Homo sapien
cttttggccggtcacatgtgctgtc

SEQ ID NO: 62045 - DNA, 25 bp, Homo sapien
cttttgggagacctaacaggttttg

SEQ ID NO: 62046 - DNA, 25 bp, Homo sapien
cttttgggagacctgacaggttttg

SEQ ID NO: 62047 - DNA, 25 bp, Homo sapien
cttttggttctctatgtctgcactg

SEQ ID NO: 62048 - DNA, 25 bp, Homo sapien
cttttggttctctgtgtctgcactg

SEQ ID NO: 62049 - DNA, 25 bp, Homo sapien
cttttgtactcagctggtcataaaa

SEQ ID NO: 62050 - DNA, 25 bp, Homo sapien
cttttgtactctgctggtcataaaa

SEQ ID NO: 62051 - DNA, 25 bp, Homo sapien
cttttgtagcgcaaatcagtagttg

SEQ ID NO: 62052 - DNA, 25 bp, Homo sapien
cttttgtagtgcaaatcagtagttg

SEQ ID NO: 62053 - DNA, 25 bp, Homo sapien
cttttgtatcagcttcctccattat

SEQ ID NO: 62054 - DNA, 25 bp, Homo sapien
cttttgtatcagtttcctccattat

SEQ ID NO: 62055 - DNA, 25 bp, Homo sapien
cttttgtcaagagacacttacaaga

SEQ ID NO: 62056 - DNA, 25 bp, Homo sapien
cttttgtcaagagatacttacaaga

SEQ ID NO: 62057 - DNA, 25 bp, Homo sapien
cttttgtggaaggaaggactattca

SEQ ID NO: 62058 - DNA, 25 bp, Homo sapien
cttttgtggcaggaaggactattca

SEQ ID NO: 62059 - DNA, 25 bp, Homo sapien
cttttgttatttcgctgagaatgat

SEQ ID NO: 62060 - DNA, 25 bp, Homo sapien
cttttgttattttgctgagaatgat

SEQ ID NO: 62061 - DNA, 25 bp, Homo sapien
cttttgttcagacttgccttcccag

SEQ ID NO: 62062 - DNA, 25 bp, Homo sapien
cttttgttcagatttgccttcccag

SEQ ID NO: 62063 - DNA, 25 bp, Homo sapien
cttttgttgtcctccgattttatca

SEQ ID NO: 62064 - DNA, 25 bp, Homo sapien
cttttgttgtcctctgattttatca

SEQ ID NO: 62065 - DNA, 25 bp, Homo sapien
cttttgttttttcatgactgcgtac

SEQ ID NO: 62066 - DNA, 25 bp, Homo sapien
cttttgtttttttatgactgcgtac

SEQ ID NO: 62067 - DNA, 25 bp, Homo sapien
ctttttaagatccagattttttctt

SEQ ID NO: 62068 - DNA, 25 bp, Homo sapien
ctttttaagatccatattttttctt

SEQ ID NO: 62069 - DNA, 25 bp, Homo sapien
ctttttaatgtagaaaagccatatt

SEQ ID NO: 62070 - DNA, 25 bp, Homo sapien
ctttttaatgtagaaaggccatatt

SEQ ID NO: 62071 - DNA, 25 bp, Homo sapien
ctttttacaaactgtgcttatccca

SEQ ID NO: 62072 - DNA, 25 bp, Homo sapien
ctttttacgaactgtgcttatccca

SEQ ID NO: 62073 - DNA, 25 bp, Homo sapien
ctttttagtgtggtcatctagcttt

SEQ ID NO: 62074 - DNA, 25 bp, Homo sapien
ctttttagtgtggttatctagcttt

SEQ ID NO: 62075 - DNA, 25 bp, Homo sapien
ctttttataaatgttgaacacgatc

SEQ ID NO: 62076 - DNA, 25 bp, Homo sapien
ctttttataaattttgaacacgatc

SEQ ID NO: 62077 - DNA, 25 bp, Homo sapien
ctttttatcctcttgttcttccaca

SEQ ID NO: 62078 - DNA, 25 bp, Homo sapien
ctttttatcctctttttcttccaca

SEQ ID NO: 62079 - DNA, 25 bp, Homo sapien
ctttttatggtaaaagcaatgtagg

SEQ ID NO: 62080 - DNA, 25 bp, Homo sapien
ctttttatggtaaaggcaatgtagg

SEQ ID NO: 62081 - DNA, 25 bp, Homo sapien
ctttttatgtggctaacttcaataa

SEQ ID NO: 62082 - DNA, 25 bp, Homo sapien
ctttttatgtggttaacttcaataa

SEQ ID NO: 62083 - DNA, 25 bp, Homo sapien
ctttttattcaacgggttcacaagt

SEQ ID NO: 62084 - DNA, 25 bp, Homo sapien
ctttttattcaacgtgttcacaagt

SEQ ID NO: 62085 - DNA, 25 bp, Homo sapien
ctttttattttccattcccattctt

SEQ ID NO: 62086 - DNA, 25 bp, Homo sapien
ctttttattttccgttcccattctt

SEQ ID NO: 62087 - DNA, 25 bp, Homo sapien
ctttttcacagaacagttgcttagt

SEQ ID NO: 62088 - DNA, 25 bp, Homo sapien
ctttttcacagcacagttgcttagt

SEQ ID NO: 62089 - DNA, 25 bp, Homo sapien
ctttttcacatttccgacaaagttc

SEQ ID NO: 62090 - DNA, 25 bp, Homo sapien
ctttttcacatttccggcaaagttc

SEQ ID NO: 62091 - DNA, 25 bp, Homo sapien
ctttttcagcagtcattttcttcaa

SEQ ID NO: 62092 - DNA, 25 bp, Homo sapien
ctttttcagcagtctttttcttcaa

SEQ ID NO: 62093 - DNA, 25 bp, Homo sapien
ctttttcagctctgaagtttcatag

SEQ ID NO: 62094 - DNA, 25 bp, Homo sapien
ctttttcagttctgaagtttcatag

SEQ ID NO: 62095 - DNA, 25 bp, Homo sapien
ctttttccagtggactcaagtacat

SEQ ID NO: 62096 - DNA, 25 bp, Homo sapien
ctttttccatgaaatgcctgttcat

SEQ ID NO: 62097 - DNA, 25 bp, Homo sapien
ctttttcccgtggactcaagtacat

SEQ ID NO: 62098 - DNA, 25 bp, Homo sapien
ctttttcccgttcaatctatcttat

SEQ ID NO: 62099 - DNA, 25 bp, Homo sapien
ctttttcccgttgaatctatcttat

SEQ ID NO: 62100 - DNA, 25 bp, Homo sapien
ctttttccgtgaaatgcctgttcat

SEQ ID NO: 62101 - DNA, 25 bp, Homo sapien
ctttttcctccaaatgactccataa

SEQ ID NO: 62102 - DNA, 25 bp, Homo sapien
ctttttcctccacatgactccataa

SEQ ID NO: 62103 - DNA, 25 bp, Homo sapien
ctttttccttcatcagcatatatgc

SEQ ID NO: 62104 - DNA, 25 bp, Homo sapien
ctttttccttcatcggcatatatgc

SEQ ID NO: 62105 - DNA, 25 bp, Homo sapien
ctttttccttgcactgggcagcctg

SEQ ID NO: 62106 - DNA, 25 bp, Homo sapien
ctttttccttgcgctgggcagcctg

SEQ ID NO: 62107 - DNA, 25 bp, Homo sapien
ctttttctacaaatatgatcataga

SEQ ID NO: 62108 - DNA, 25 bp, Homo sapien
ctttttctactgaaagacactgaaa

SEQ ID NO: 62109 - DNA, 25 bp, Homo sapien
ctttttctactgaaaggcactgaaa

SEQ ID NO: 62110 - DNA, 25 bp, Homo sapien
ctttttctataaatatgatcataga

SEQ ID NO: 62111 - DNA, 25 bp, Homo sapien
ctttttctcaacgtatcaataactt

SEQ ID NO: 62112 - DNA, 25 bp, Homo sapien
ctttttctcaatgtatcaataactt

SEQ ID NO: 62113 - DNA, 25 bp, Homo sapien
ctttttctcattgactggtgtggat

SEQ ID NO: 62114 - DNA, 25 bp, Homo sapien
ctttttctcgtcacttgtagttgag

SEQ ID NO: 62115 - DNA, 25 bp, Homo sapien
ctttttctcgttgactggtgtggat

SEQ ID NO: 62116 - DNA, 25 bp, Homo sapien
ctttttctgataccacaccctggtc

SEQ ID NO: 62117 - DNA, 25 bp, Homo sapien
ctttttctgatatcacaccctggtc

SEQ ID NO: 62118 - DNA, 25 bp, Homo sapien
ctttttcttgtcacttgtagttgag

SEQ ID NO: 62119 - DNA, 25 bp, Homo sapien
ctttttcttttagctcccacacgtg

SEQ ID NO: 62120 - DNA, 25 bp, Homo sapien
ctttttcttttagttcccacacgtg

SEQ ID NO: 62121 - DNA, 25 bp, Homo sapien
ctttttcttttttcctatagcaatt

SEQ ID NO: 62122 - DNA, 25 bp, Homo sapien
ctttttcttttttcctgtagcaatt

SEQ ID NO: 62123 - DNA, 25 bp, Homo sapien
ctttttgaaatgctaaataaacact

SEQ ID NO: 62124 - DNA, 25 bp, Homo sapien
ctttttgaaatggtaaataaacact

SEQ ID NO: 62125 - DNA, 25 bp, Homo sapien
ctttttgacctctcatttcctccct

SEQ ID NO: 62126 - DNA, 25 bp, Homo sapien
ctttttgacctgtcatttcctccct

SEQ ID NO: 62127 - DNA, 25 bp, Homo sapien
ctttttgccatccactctattttcc

SEQ ID NO: 62128 - DNA, 25 bp, Homo sapien
ctttttgccattcactctattttcc

SEQ ID NO: 62129 - DNA, 25 bp, Homo sapien
ctttttggacatatccttactgttc

SEQ ID NO: 62130 - DNA, 25 bp, Homo sapien
ctttttggacatgtccttactgttc

SEQ ID NO: 62131 - DNA, 25 bp, Homo sapien
ctttttgtgacatgtaataaatgtt

SEQ ID NO: 62132 - DNA, 25 bp, Homo sapien
ctttttgtgacgtgtaataaatgtt

SEQ ID NO: 62133 - DNA, 25 bp, Homo sapien
cttttttaacacttaataagcagca

SEQ ID NO: 62134 - DNA, 25 bp, Homo sapien
cttttttaacatttaataagcagca

SEQ ID NO: 62135 - DNA, 25 bp, Homo sapien
cttttttgagcacgtcattactttc

SEQ ID NO: 62136 - DNA, 25 bp, Homo sapien
cttttttgagcatgtcattactttc

SEQ ID NO: 62137 - DNA, 25 bp, Homo sapien
cttttttggacagggtcgtgtgatg

SEQ ID NO: 62138 - DNA, 25 bp, Homo sapien
cttttttggacagggttgtgtgatg

SEQ ID NO: 62139 - DNA, 25 bp, Homo sapien
cttttttggttcaagttgatttttg

SEQ ID NO: 62140 - DNA, 25 bp, Homo sapien
cttttttgtttcaagttgatttttg

SEQ ID NO: 62141 - DNA, 25 bp, Homo sapien
ctttttttcaaaattcagtaacttg

SEQ ID NO: 62142 - DNA, 25 bp, Homo sapien
ctttttttcaaagttcagtaacttg

SEQ ID NO: 62143 - DNA, 25 bp, Homo sapien
ctttttttcatttccttgtgttttg

SEQ ID NO: 62144 - DNA, 25 bp, Homo sapien
ctttttttccacaagaacatgagat

SEQ ID NO: 62145 - DNA, 25 bp, Homo sapien
ctttttttcccttaaacattggaat

SEQ ID NO: 62146 - DNA, 25 bp, Homo sapien
ctttttttcggttatctgtgataga

SEQ ID NO: 62147 - DNA, 25 bp, Homo sapien
ctttttttcgtttccttgtgttttg

SEQ ID NO: 62148 - DNA, 25 bp, Homo sapien
ctttttttggtccaactctagttat

SEQ ID NO: 62149 - DNA, 25 bp, Homo sapien
ctttttttgtgcgagcctctgagat

SEQ ID NO: 62150 - DNA, 25 bp, Homo sapien
ctttttttgtgtgagcctctgagat

SEQ ID NO: 62151 - DNA, 25 bp, Homo sapien
cttttttttcacaagaacatgagat

SEQ ID NO: 62152 - DNA, 25 bp, Homo sapien
cttttttttccttaaacattggaat

SEQ ID NO: 62153 - DNA, 25 bp, Homo sapien
cttttttttgcagtgcatttattca

SEQ ID NO: 62154 - DNA, 25 bp, Homo sapien
cttttttttgcattgcatttattca

SEQ ID NO: 62155 - DNA, 25 bp, Homo sapien
cttttttttggttatctgtgataga

SEQ ID NO: 62156 - DNA, 25 bp, Homo sapien
cttttttttgtccaactctagttat

SEQ ID NO: 62157 - DNA, 25 bp, Homo sapien
gaaaaaaaaaaccttcatcatttaa

SEQ ID NO: 62158 - DNA, 25 bp, Homo sapien
gaaaaaaaaaagtcccaattcagat

SEQ ID NO: 62159 - DNA, 25 bp, Homo sapien
gaaaaaaaaaagttccaattcagat

SEQ ID NO: 62160 - DNA, 25 bp, Homo sapien
gaaaaaaaaaatcttcatcatttaa

SEQ ID NO: 62161 - DNA, 25 bp, Homo sapien
gaaaaaaaactgaagattcattacc

SEQ ID NO: 62162 - DNA, 25 bp, Homo sapien
gaaaaaaaagtatttaatagcaatt

SEQ ID NO: 62163 - DNA, 25 bp, Homo sapien
gaaaaaaaagtatttagtagcaatt

SEQ ID NO: 62164 - DNA, 25 bp, Homo sapien
gaaaaaaacatcacttgacattcgg

SEQ ID NO: 62165 - DNA, 25 bp, Homo sapien
gaaaaaaacatcccttgacattcgg

SEQ ID NO: 62166 - DNA, 25 bp, Homo sapien
gaaaaaaacctgaagattcattacc

SEQ ID NO: 62167 - DNA, 25 bp, Homo sapien
gaaaaaaacctgaggagagaataag

SEQ ID NO: 62168 - DNA, 25 bp, Homo sapien
gaaaaaaagcaacggtaatgagcca

SEQ ID NO: 62169 - DNA, 25 bp, Homo sapien
gaaaaaaagcaactgtaatgagcca

SEQ ID NO: 62170 - DNA, 25 bp, Homo sapien
gaaaaaaataatgttacggaagcac

SEQ ID NO: 62171 - DNA, 25 bp, Homo sapien
gaaaaaaataatgttatggaagcac

SEQ ID NO: 62172 - DNA, 25 bp, Homo sapien
gaaaaaaatcagtatgcctagcaat

SEQ ID NO: 62173 - DNA, 25 bp, Homo sapien
gaaaaaaatcagtatgtctagcaat

SEQ ID NO: 62174 - DNA, 25 bp, Homo sapien
gaaaaaaatccatgtaaaagtgaat

SEQ ID NO: 62175 - DNA, 25 bp, Homo sapien
gaaaaaaatccatgtacaagtgaat

SEQ ID NO: 62176 - DNA, 25 bp, Homo sapien
gaaaaaaatctgaggagagaataag

SEQ ID NO: 62177 - DNA, 25 bp, Homo sapien
gaaaaaaatgaccaagaatagccaa

SEQ ID NO: 62178 - DNA, 25 bp, Homo sapien
gaaaaaaatgaccgagaatagccaa

SEQ ID NO: 62179 - DNA, 25 bp, Homo sapien
gaaaaaaattatgaaagtgtctaga

SEQ ID NO: 62180 - DNA, 25 bp, Homo sapien
gaaaaaaattatggaagtgtctaga

SEQ ID NO: 62181 - DNA, 25 bp, Homo sapien
gaaaaaacatctatcagcataactg

SEQ ID NO: 62182 - DNA, 25 bp, Homo sapien
gaaaaaacatctttcagcataactg

SEQ ID NO: 62183 - DNA, 25 bp, Homo sapien
gaaaaaagaattcttcactgtcaaa

SEQ ID NO: 62184 - DNA, 25 bp, Homo sapien
gaaaaaagaattcttcgctgtcaaa

SEQ ID NO: 62185 - DNA, 25 bp, Homo sapien
gaaaaaagattctcaaaaatgaagt

SEQ ID NO: 62186 - DNA, 25 bp, Homo sapien
gaaaaaagattctcgaaaatgaagt

SEQ ID NO: 62187 - DNA, 25 bp, Homo sapien
gaaaaaaggacagtgagtagtatac

SEQ ID NO: 62188 - DNA, 25 bp, Homo sapien
gaaaaaagggcagtgagtagtatac

SEQ ID NO: 62189 - DNA, 25 bp, Homo sapien
gaaaaaagtgagtgagctataatag

SEQ ID NO: 62190 - DNA, 25 bp, Homo sapien
gaaaaaagtgtgccttcacaataat

SEQ ID NO: 62191 - DNA, 25 bp, Homo sapien
gaaaaaagtgtggcttcacaataat

SEQ ID NO: 62192 - DNA, 25 bp, Homo sapien
gaaaaaagttagtgagctataatag

SEQ ID NO: 62193 - DNA, 25 bp, Homo sapien
gaaaaaataatacgagccagaaggc

SEQ ID NO: 62194 - DNA, 25 bp, Homo sapien
gaaaaaataatatgagccagaaggc

SEQ ID NO: 62195 - DNA, 25 bp, Homo sapien
gaaaaaatactgaatttgaaaagga

SEQ ID NO: 62196 - DNA, 25 bp, Homo sapien
gaaaaaatattgaatttgaaaagga

SEQ ID NO: 62197 - DNA, 25 bp, Homo sapien
gaaaaacaaacaaaggacatcgaaa

SEQ ID NO: 62198 - DNA, 25 bp, Homo sapien
gaaaaacaaacaacggacatcgaaa

SEQ ID NO: 62199 - DNA, 25 bp, Homo sapien
gaaaaacaaacatcatgctcaaatg

SEQ ID NO: 62200 - DNA, 25 bp, Homo sapien
gaaaaacaaacgtcatgctcaaatg

SEQ ID NO: 62201 - DNA, 25 bp, Homo sapien
gaaaaacaaatggaaaaaaagacac

SEQ ID NO: 62202 - DNA, 25 bp, Homo sapien
gaaaaacaaatggaaacaaagacac

SEQ ID NO: 62203 - DNA, 25 bp, Homo sapien
gaaaaacagcaaaatgccacagtgg

SEQ ID NO: 62204 - DNA, 25 bp, Homo sapien
gaaaaacagcaagatgccacagtgg

SEQ ID NO: 62205 - DNA, 25 bp, Homo sapien
gaaaaacagtacagattattggtct

SEQ ID NO: 62206 - DNA, 25 bp, Homo sapien
gaaaaacagtacagtttattggtct

SEQ ID NO: 62207 - DNA, 25 bp, Homo sapien
gaaaaacatctggataatttagaac

SEQ ID NO: 62208 - DNA, 25 bp, Homo sapien
gaaaaacatctggatagtttagaac

SEQ ID NO: 62209 - DNA, 25 bp, Homo sapien
gaaaaacatgaaaacgagagacagg

SEQ ID NO: 62210 - DNA, 25 bp, Homo sapien
gaaaaacatgaaaaggagagacagg

SEQ ID NO: 62211 - DNA, 25 bp, Homo sapien
gaaaaaccaactgtttgcttcactg

SEQ ID NO: 62212 - DNA, 25 bp, Homo sapien
gaaaaaccaactttttgcttcactg

SEQ ID NO: 62213 - DNA, 25 bp, Homo sapien
gaaaaaccatgtagactttgaacca

SEQ ID NO: 62214 - DNA, 25 bp, Homo sapien
gaaaaaccatgtaggctttgaacca

SEQ ID NO: 62215 - DNA, 25 bp, Homo sapien
gaaaaaccctgcatctatgagcttt

SEQ ID NO: 62216 - DNA, 25 bp, Homo sapien
gaaaaaccctgcgtctatgagcttt

SEQ ID NO: 62217 - DNA, 25 bp, Homo sapien
gaaaaactcaggctaggatgagaat

SEQ ID NO: 62218 - DNA, 25 bp, Homo sapien
gaaaaactcaggttaggatgagaat

SEQ ID NO: 62219 - DNA, 25 bp, Homo sapien
gaaaaacttctggtactcattaggc

SEQ ID NO: 62220 - DNA, 25 bp, Homo sapien
gaaaaacttctgttactcattaggc

SEQ ID NO: 62221 - DNA, 25 bp, Homo sapien
gaaaaagcacttcatagcttggaga

SEQ ID NO: 62222 - DNA, 25 bp, Homo sapien
gaaaaagcagttcatagcttggaga

SEQ ID NO: 62223 - DNA, 25 bp, Homo sapien
gaaaaagccagcgatggtgcaacac

SEQ ID NO: 62224 - DNA, 25 bp, Homo sapien
gaaaaagccagggatggtgcaacac

SEQ ID NO: 62225 - DNA, 25 bp, Homo sapien
gaaaaagctgagggttaggagaagc

SEQ ID NO: 62226 - DNA, 25 bp, Homo sapien
gaaaaagctgagtgttaggagaagc

SEQ ID NO: 62227 - DNA, 25 bp, Homo sapien
gaaaaaggaagggacgagaccaaaa

SEQ ID NO: 62228 - DNA, 25 bp, Homo sapien
gaaaaaggaagggatgagaccaaaa

SEQ ID NO: 62229 - DNA, 25 bp, Homo sapien
gaaaaaggagaataatgtggagaaa

SEQ ID NO: 62230 - DNA, 25 bp, Homo sapien
gaaaaaggagaatattgtggagaaa

SEQ ID NO: 62231 - DNA, 25 bp, Homo sapien
gaaaaaggctgtattcagtgcagac

SEQ ID NO: 62232 - DNA, 25 bp, Homo sapien
gaaaaaggctgttttcagtgcagac

SEQ ID NO: 62233 - DNA, 25 bp, Homo sapien
gaaaaagtcatccggtcctttgtca

SEQ ID NO: 62234 - DNA, 25 bp, Homo sapien
gaaaaagtcatcgggtcctttgtca

SEQ ID NO: 62235 - DNA, 25 bp, Homo sapien
gaaaaagtgagtcagtgagacatat

SEQ ID NO: 62236 - DNA, 25 bp, Homo sapien
gaaaaagtgagttagtgagacatat

SEQ ID NO: 62237 - DNA, 25 bp, Homo sapien
gaaaaataaagagctgatttctgaa

SEQ ID NO: 62238 - DNA, 25 bp, Homo sapien
gaaaaataaagagctgctttctgaa

SEQ ID NO: 62239 - DNA, 25 bp, Homo sapien
gaaaaatagattcagcattaaaata

SEQ ID NO: 62240 - DNA, 25 bp, Homo sapien
gaaaaatagattccgcattaaaata

SEQ ID NO: 62241 - DNA, 25 bp, Homo sapien
gaaaaatatagaaggaaactgaagg

SEQ ID NO: 62242 - DNA, 25 bp, Homo sapien
gaaaaatatagagggaaactgaagg

SEQ ID NO: 62243 - DNA, 25 bp, Homo sapien
gaaaaatcattactatcttcacatg

SEQ ID NO: 62244 - DNA, 25 bp, Homo sapien
gaaaaatccgtagactgtgagaata

SEQ ID NO: 62245 - DNA, 25 bp, Homo sapien
gaaaaatccttactatcttcacatg

SEQ ID NO: 62246 - DNA, 25 bp, Homo sapien
gaaaaatcgagcagaaagcacagag

SEQ ID NO: 62247 - DNA, 25 bp, Homo sapien
gaaaaatcgagcggaaagcacagag

SEQ ID NO: 62248 - DNA, 25 bp, Homo sapien
gaaaaatctgtagactgtgagaata

SEQ ID NO: 62249 - DNA, 25 bp, Homo sapien
gaaaaatgactcaacaatggcctac

SEQ ID NO: 62250 - DNA, 25 bp, Homo sapien
gaaaaatgaggcttcaagaagtctg

SEQ ID NO: 62251 - DNA, 25 bp, Homo sapien
gaaaaatgaggcttcaggaagtctg

SEQ ID NO: 62252 - DNA, 25 bp, Homo sapien
gaaaaatgagtcaacaatggcctac

SEQ ID NO: 62253 - DNA, 25 bp, Homo sapien
gaaaaatggtcaacacatcataaat

SEQ ID NO: 62254 - DNA, 25 bp, Homo sapien
gaaaaatggtcaacacctcataaat

SEQ ID NO: 62255 - DNA, 25 bp, Homo sapien
gaaaaatgtgaaaatggtacttaca

SEQ ID NO: 62256 - DNA, 25 bp, Homo sapien
gaaaaatgtgaacatggtacttaca

SEQ ID NO: 62257 - DNA, 25 bp, Homo sapien
gaaaacaaagtgtggattgggagaa

SEQ ID NO: 62258 - DNA, 25 bp, Homo sapien
gaaaacaaagtttcagcatcactta

SEQ ID NO: 62259 - DNA, 25 bp, Homo sapien
gaaaacaaagtttcggcatcactta

SEQ ID NO: 62260 - DNA, 25 bp, Homo sapien
gaaaacaaggtgtggattgggagaa

SEQ ID NO: 62261 - DNA, 25 bp, Homo sapien
gaaaacaccatttatagtcatgcca

SEQ ID NO: 62262 - DNA, 25 bp, Homo sapien
gaaaacaccctttatagtcatgcca

SEQ ID NO: 62263 - DNA, 25 bp, Homo sapien
gaaaacacctgagtaatacagtgac

SEQ ID NO: 62264 - DNA, 25 bp, Homo sapien
gaaaacacctgagtcatacagtgac

SEQ ID NO: 62265 - DNA, 25 bp, Homo sapien
gaaaacagaaaagcccagtattact

SEQ ID NO: 62266 - DNA, 25 bp, Homo sapien
gaaaacagaaaatcccagtattact

SEQ ID NO: 62267 - DNA, 25 bp, Homo sapien
gaaaacagagattgtatcttatgta

SEQ ID NO: 62268 - DNA, 25 bp, Homo sapien
gaaaacagatatcagccttgggaaa

SEQ ID NO: 62269 - DNA, 25 bp, Homo sapien
gaaaacagcacttaagccttctata

SEQ ID NO: 62270 - DNA, 25 bp, Homo sapien
gaaaacagcacttaaggcttctata

SEQ ID NO: 62271 - DNA, 25 bp, Homo sapien
gaaaacagggattgtatcttatgta

SEQ ID NO: 62272 - DNA, 25 bp, Homo sapien
gaaaacaggtatcagccttgggaaa

SEQ ID NO: 62273 - DNA, 25 bp, Homo sapien
gaaaacagttgcataaagcagaatg

SEQ ID NO: 62274 - DNA, 25 bp, Homo sapien
gaaaacagttgcgtaaagcagaatg

SEQ ID NO: 62275 - DNA, 25 bp, Homo sapien
gaaaacatgatctgatcctagaaat

SEQ ID NO: 62276 - DNA, 25 bp, Homo sapien
gaaaacatgatttgatcctagaaat

SEQ ID NO: 62277 - DNA, 25 bp, Homo sapien
gaaaacattttcaactgtgggaatc

SEQ ID NO: 62278 - DNA, 25 bp, Homo sapien
gaaaacattttcaattgtgggaatc

SEQ ID NO: 62279 - DNA, 25 bp, Homo sapien
gaaaaccaaaactaagaaatacttt

SEQ ID NO: 62280 - DNA, 25 bp, Homo sapien
gaaaaccagaactaagaaatacttt

SEQ ID NO: 62281 - DNA, 25 bp, Homo sapien
gaaaacctgaagacttgaagattca

SEQ ID NO: 62282 - DNA, 25 bp, Homo sapien
gaaaacctgaagtcttgaagattca

SEQ ID NO: 62283 - DNA, 25 bp, Homo sapien
gaaaaccttcgtgacgcaacagcag

SEQ ID NO: 62284 - DNA, 25 bp, Homo sapien
gaaaaccttcgtgatgcaacagcag

SEQ ID NO: 62285 - DNA, 25 bp, Homo sapien
gaaaacgaggtccattgtggccact

SEQ ID NO: 62286 - DNA, 25 bp, Homo sapien
gaaaacgaggtctattgtggccact

SEQ ID NO: 62287 - DNA, 25 bp, Homo sapien
gaaaacgattgtcaaagaaagaggt

SEQ ID NO: 62288 - DNA, 25 bp, Homo sapien
gaaaacgattgttaaagaaagaggt

SEQ ID NO: 62289 - DNA, 25 bp, Homo sapien
gaaaacggacctctatgggccaaat

SEQ ID NO: 62290 - DNA, 25 bp, Homo sapien
gaaaacggatctctatgggccaaat

SEQ ID NO: 62291 - DNA, 25 bp, Homo sapien
gaaaactagccattaattttagaaa

SEQ ID NO: 62292 - DNA, 25 bp, Homo sapien
gaaaactagccattgattttagaaa

SEQ ID NO: 62293 - DNA, 25 bp, Homo sapien
gaaaactataacttatctcccagcc

SEQ ID NO: 62294 - DNA, 25 bp, Homo sapien
gaaaactataacttgtctcccagcc

SEQ ID NO: 62295 - DNA, 25 bp, Homo sapien
gaaaactcaaggcacggtataaata

SEQ ID NO: 62296 - DNA, 25 bp, Homo sapien
gaaaactcaaggcatggtataaata

SEQ ID NO: 62297 - DNA, 25 bp, Homo sapien
gaaaactcccaattgcataagaccg

SEQ ID NO: 62298 - DNA, 25 bp, Homo sapien
gaaaactcctaattgcataagaccg

SEQ ID NO: 62299 - DNA, 25 bp, Homo sapien
gaaaactgaaacatctgtactgtaa

SEQ ID NO: 62300 - DNA, 25 bp, Homo sapien
gaaaactgaaacgtctgtactgtaa

SEQ ID NO: 62301 - DNA, 25 bp, Homo sapien
gaaaactgaagagaatgtcctactc

SEQ ID NO: 62302 - DNA, 25 bp, Homo sapien
gaaaactgaagagaatttcctactc

SEQ ID NO: 62303 - DNA, 25 bp, Homo sapien
gaaaacttgtctaggtttcataaag

SEQ ID NO: 62304 - DNA, 25 bp, Homo sapien
gaaaacttttctaggtttcataaag

SEQ ID NO: 62305 - DNA, 25 bp, Homo sapien
gaaaagaaaatttcgatgaggttcc

SEQ ID NO: 62306 - DNA, 25 bp, Homo sapien
gaaaagaaaattttgatgaggttcc

SEQ ID NO: 62307 - DNA, 25 bp, Homo sapien
gaaaagaaatgcttgtgttacacat

SEQ ID NO: 62308 - DNA, 25 bp, Homo sapien
gaaaagaactaaaggacataacatc

SEQ ID NO: 62309 - DNA, 25 bp, Homo sapien
gaaaagaactgcttgtgttacacat

SEQ ID NO: 62310 - DNA, 25 bp, Homo sapien
gaaaagaattaaaggacataacatc

SEQ ID NO: 62311 - DNA, 25 bp, Homo sapien
gaaaagagaaaaagatgagtaagca

SEQ ID NO: 62312 - DNA, 25 bp, Homo sapien
gaaaagagaaaagtatgcaaaacat

SEQ ID NO: 62313 - DNA, 25 bp, Homo sapien
gaaaagagaaaagtgtgcaaaacat

SEQ ID NO: 62314 - DNA, 25 bp, Homo sapien
gaaaagagaaagagatgagtaagca

SEQ ID NO: 62315 - DNA, 25 bp, Homo sapien
gaaaagagccatcagtgagaaagtg

SEQ ID NO: 62316 - DNA, 25 bp, Homo sapien
gaaaagagccatccgtgagaaagtg

SEQ ID NO: 62317 - DNA, 25 bp, Homo sapien
gaaaagagttaataaattgcattcc

SEQ ID NO: 62318 - DNA, 25 bp, Homo sapien
gaaaagagttaatacattgcattcc

SEQ ID NO: 62319 - DNA, 25 bp, Homo sapien
gaaaagataccacgctgcaaagtct

SEQ ID NO: 62320 - DNA, 25 bp, Homo sapien
gaaaagataccatgctgcaaagtct

SEQ ID NO: 62321 - DNA, 25 bp, Homo sapien
gaaaagatcatgatcgggtaaagag

SEQ ID NO: 62322 - DNA, 25 bp, Homo sapien
gaaaagatcatgatcgtgtaaagag

SEQ ID NO: 62323 - DNA, 25 bp, Homo sapien
gaaaagattttccgacatgataatt

SEQ ID NO: 62324 - DNA, 25 bp, Homo sapien
gaaaagattttcggacatgataatt

SEQ ID NO: 62325 - DNA, 25 bp, Homo sapien
gaaaagcaactccattacataggct

SEQ ID NO: 62326 - DNA, 25 bp, Homo sapien
gaaaagcaagtccattacataggct

SEQ ID NO: 62327 - DNA, 25 bp, Homo sapien
gaaaagcactaggaaaagtccaagt

SEQ ID NO: 62328 - DNA, 25 bp, Homo sapien
gaaaagcactaggcaaagtccaagt

SEQ ID NO: 62329 - DNA, 25 bp, Homo sapien
gaaaagcatcagatctgggaaaagg

SEQ ID NO: 62330 - DNA, 25 bp, Homo sapien
gaaaagcattagatctgggaaaagg

SEQ ID NO: 62331 - DNA, 25 bp, Homo sapien
gaaaagccattcacatcaaggttgc

SEQ ID NO: 62332 - DNA, 25 bp, Homo sapien
gaaaagccgttcacatcaaggttgc

SEQ ID NO: 62333 - DNA, 25 bp, Homo sapien
gaaaagcctagtctcaacacatgag

SEQ ID NO: 62334 - DNA, 25 bp, Homo sapien
gaaaagcctagtcttaacacatgag

SEQ ID NO: 62335 - DNA, 25 bp, Homo sapien
gaaaagctgatgtggaaagaaccac

SEQ ID NO: 62336 - DNA, 25 bp, Homo sapien
gaaaagctgatgtggatagaaccac

SEQ ID NO: 62337 - DNA, 25 bp, Homo sapien
gaaaagcttcataatagtttctcca

SEQ ID NO: 62338 - DNA, 25 bp, Homo sapien
gaaaagcttcatagtagtttctcca

SEQ ID NO: 62339 - DNA, 25 bp, Homo sapien
gaaaaggacgctatgtgctgggcaa

SEQ ID NO: 62340 - DNA, 25 bp, Homo sapien
gaaaaggagtttcatgagatacaat

SEQ ID NO: 62341 - DNA, 25 bp, Homo sapien
gaaaaggagtttcttgagatacaat

SEQ ID NO: 62342 - DNA, 25 bp, Homo sapien
gaaaaggatgctatgtgctgggcaa

SEQ ID NO: 62343 - DNA, 25 bp, Homo sapien
gaaaaggcaattcatagaatggcat

SEQ ID NO: 62344 - DNA, 25 bp, Homo sapien
gaaaaggccagagaaaaatgtgacc

SEQ ID NO: 62345 - DNA, 25 bp, Homo sapien
gaaaaggccagagacaaatgtgacc

SEQ ID NO: 62346 - DNA, 25 bp, Homo sapien
gaaaaggcctgccagtagagcaaaa

SEQ ID NO: 62347 - DNA, 25 bp, Homo sapien
gaaaaggcctgtcagtagagcaaaa

SEQ ID NO: 62348 - DNA, 25 bp, Homo sapien
gaaaaggcgattcatagaatggcat

SEQ ID NO: 62349 - DNA, 25 bp, Homo sapien
gaaaaggctcacgcttcagtagaac

SEQ ID NO: 62350 - DNA, 25 bp, Homo sapien
gaaaaggctcatgcttcagtagaac

SEQ ID NO: 62351 - DNA, 25 bp, Homo sapien
gaaaaggttacagataccaggtacc

SEQ ID NO: 62352 - DNA, 25 bp, Homo sapien
gaaaaggttacagatatcaggtacc

SEQ ID NO: 62353 - DNA, 25 bp, Homo sapien
gaaaagtaagaggatgccaaaaatg

SEQ ID NO: 62354 - DNA, 25 bp, Homo sapien
gaaaagtaagagggtgccaaaaatg

SEQ ID NO: 62355 - DNA, 25 bp, Homo sapien
gaaaagtacaaaagaaaagagagat

SEQ ID NO: 62356 - DNA, 25 bp, Homo sapien
gaaaagtacaaaaggaaagagagat

SEQ ID NO: 62357 - DNA, 25 bp, Homo sapien
gaaaagtacataggttaatgacaag

SEQ ID NO: 62358 - DNA, 25 bp, Homo sapien
gaaaagtacatagtttaatgacaag

SEQ ID NO: 62359 - DNA, 25 bp, Homo sapien
gaaaagtgaataatgactgactaac

SEQ ID NO: 62360 - DNA, 25 bp, Homo sapien
gaaaagtgactaatgactgactaac

SEQ ID NO: 62361 - DNA, 25 bp, Homo sapien
gaaaagttaagcgattatttttata

SEQ ID NO: 62362 - DNA, 25 bp, Homo sapien
gaaaagttaagtgattatttttata

SEQ ID NO: 62363 - DNA, 25 bp, Homo sapien
gaaaagttgaacaaataacccaagt

SEQ ID NO: 62364 - DNA, 25 bp, Homo sapien
gaaaagttgaacaaattacccaagt

SEQ ID NO: 62365 - DNA, 25 bp, Homo sapien
gaaaagttgtgtaatcattgtgttt

SEQ ID NO: 62366 - DNA, 25 bp, Homo sapien
gaaaagttgtgtcatcattgtgttt

SEQ ID NO: 62367 - DNA, 25 bp, Homo sapien
gaaaagtttaagaacaaatgcataa

SEQ ID NO: 62368 - DNA, 25 bp, Homo sapien
gaaaagtttaagatcaaatgcataa

SEQ ID NO: 62369 - DNA, 25 bp, Homo sapien
gaaaataaagagttatatcagaaat

SEQ ID NO: 62370 - DNA, 25 bp, Homo sapien
gaaaataacacctcctctttgtaat

SEQ ID NO: 62371 - DNA, 25 bp, Homo sapien
gaaaataacacctcctttttgtaat

SEQ ID NO: 62372 - DNA, 25 bp, Homo sapien
gaaaataacgagttatatcagaaat

SEQ ID NO: 62373 - DNA, 25 bp, Homo sapien
gaaaataacttaggaccaaagctgg

SEQ ID NO: 62374 - DNA, 25 bp, Homo sapien
gaaaataacttagggccaaagctgg

SEQ ID NO: 62375 - DNA, 25 bp, Homo sapien
gaaaataagggacaaatattgcatg

SEQ ID NO: 62376 - DNA, 25 bp, Homo sapien
gaaaataagggagaaatattgcatg

SEQ ID NO: 62377 - DNA, 25 bp, Homo sapien
gaaaataaggggacatgatggatta

SEQ ID NO: 62378 - DNA, 25 bp, Homo sapien
gaaaataaggggagatgatggatta

SEQ ID NO: 62379 - DNA, 25 bp, Homo sapien
gaaaataattgcaaccatttatcta

SEQ ID NO: 62380 - DNA, 25 bp, Homo sapien
gaaaataattgcaaccgtttatcta

SEQ ID NO: 62381 - DNA, 25 bp, Homo sapien
gaaaatacactgtgtaagtccccat

SEQ ID NO: 62382 - DNA, 25 bp, Homo sapien
gaaaatacactgtttaagtccccat

SEQ ID NO: 62383 - DNA, 25 bp, Homo sapien
gaaaatactcagatagctttactag

SEQ ID NO: 62384 - DNA, 25 bp, Homo sapien
gaaaatactgagatagctttactag

SEQ ID NO: 62385 - DNA, 25 bp, Homo sapien
gaaaatactgcaattactgatatgg

SEQ ID NO: 62386 - DNA, 25 bp, Homo sapien
gaaaatactgcagttactgatatgg

SEQ ID NO: 62387 - DNA, 25 bp, Homo sapien
gaaaatatacgctatcacaggaaca

SEQ ID NO: 62388 - DNA, 25 bp, Homo sapien
gaaaatatatgctatcacaggaaca

SEQ ID NO: 62389 - DNA, 25 bp, Homo sapien
gaaaatatggcccataaccaggaaa

SEQ ID NO: 62390 - DNA, 25 bp, Homo sapien
gaaaatatggcctataaccaggaaa

SEQ ID NO: 62391 - DNA, 25 bp, Homo sapien
gaaaatatttcaagaccatggtttg

SEQ ID NO: 62392 - DNA, 25 bp, Homo sapien
gaaaatatttccagaccatggtttg

SEQ ID NO: 62393 - DNA, 25 bp, Homo sapien
gaaaatcaaaacgagtagaaatgaa

SEQ ID NO: 62394 - DNA, 25 bp, Homo sapien
gaaaatcaaaacgagtggaaatgaa

SEQ ID NO: 62395 - DNA, 25 bp, Homo sapien
gaaaatcacctgatgaagcatttat

SEQ ID NO: 62396 - DNA, 25 bp, Homo sapien
gaaaatcactaatatggtcaactct

SEQ ID NO: 62397 - DNA, 25 bp, Homo sapien
gaaaatcactaatatgttcaactct

SEQ ID NO: 62398 - DNA, 25 bp, Homo sapien
gaaaatcacttgatgaagcatttat

SEQ ID NO: 62399 - DNA, 25 bp, Homo sapien
gaaaatcatgggtttctctagtgtg

SEQ ID NO: 62400 - DNA, 25 bp, Homo sapien
gaaaatcatggttttctctagtgtg

SEQ ID NO: 62401 - DNA, 25 bp, Homo sapien
gaaaatccacctaaccaagaaggct

SEQ ID NO: 62402 - DNA, 25 bp, Homo sapien
gaaaatccacctaagcaagaaggct

SEQ ID NO: 62403 - DNA, 25 bp, Homo sapien
gaaaatccacttaacttcctgaaga

SEQ ID NO: 62404 - DNA, 25 bp, Homo sapien
gaaaatccacttcacttcctgaaga

SEQ ID NO: 62405 - DNA, 25 bp, Homo sapien
gaaaatctggataatctccccatca

SEQ ID NO: 62406 - DNA, 25 bp, Homo sapien
gaaaatctggatagtctccccatca

SEQ ID NO: 62407 - DNA, 25 bp, Homo sapien
gaaaatctgggataaataattggta

SEQ ID NO: 62408 - DNA, 25 bp, Homo sapien
gaaaatctgtacaatgtgttaccca

SEQ ID NO: 62409 - DNA, 25 bp, Homo sapien
gaaaatctgtacagtgtgttaccca

SEQ ID NO: 62410 - DNA, 25 bp, Homo sapien
gaaaatcttgacagaaaaacctcac

SEQ ID NO: 62411 - DNA, 25 bp, Homo sapien
gaaaatcttgacaggaaaacctcac

SEQ ID NO: 62412 - DNA, 25 bp, Homo sapien
gaaaatcttggataaataattggta

SEQ ID NO: 62413 - DNA, 25 bp, Homo sapien
gaaaatgaatcaagccctttattct

SEQ ID NO: 62414 - DNA, 25 bp, Homo sapien
gaaaatgaatcgagccctttattct

SEQ ID NO: 62415 - DNA, 25 bp, Homo sapien
gaaaatgacgtgctaagtctcattt

SEQ ID NO: 62416 - DNA, 25 bp, Homo sapien
gaaaatgataccctacatacaaaat

SEQ ID NO: 62417 - DNA, 25 bp, Homo sapien
gaaaatgatactctacatacaaaat

SEQ ID NO: 62418 - DNA, 25 bp, Homo sapien
gaaaatgatgtgctaagtctcattt

SEQ ID NO: 62419 - DNA, 25 bp, Homo sapien
gaaaatgcaattgacacactgaaga

SEQ ID NO: 62420 - DNA, 25 bp, Homo sapien
gaaaatgcacagaaacagggcagca

SEQ ID NO: 62421 - DNA, 25 bp, Homo sapien
gaaaatgcacagaaacggggcagca

SEQ ID NO: 62422 - DNA, 25 bp, Homo sapien
gaaaatgcaggaaacgctgaggctt

SEQ ID NO: 62423 - DNA, 25 bp, Homo sapien
gaaaatgcaggaaatgctgaggctt

SEQ ID NO: 62424 - DNA, 25 bp, Homo sapien
gaaaatgcctaggagtgaacaggtt

SEQ ID NO: 62425 - DNA, 25 bp, Homo sapien
gaaaatgcctatgagtgaacaggtt

SEQ ID NO: 62426 - DNA, 25 bp, Homo sapien
gaaaatgcgattgacacactgaaga

SEQ ID NO: 62427 - DNA, 25 bp, Homo sapien
gaaaatggagaaagaaaccatgaac

SEQ ID NO: 62428 - DNA, 25 bp, Homo sapien
gaaaatggagaaaggaaccatgaac

SEQ ID NO: 62429 - DNA, 25 bp, Homo sapien
gaaaatggcaataaaaagaagaaga

SEQ ID NO: 62430 - DNA, 25 bp, Homo sapien
gaaaatggcgataaaaagaagaaga

SEQ ID NO: 62431 - DNA, 25 bp, Homo sapien
gaaaatggcttgacagtttttaaaa

SEQ ID NO: 62432 - DNA, 25 bp, Homo sapien
gaaaatggtttgacagtttttaaaa

SEQ ID NO: 62433 - DNA, 25 bp, Homo sapien
gaaaatgtcatattgaatcaagctg

SEQ ID NO: 62434 - DNA, 25 bp, Homo sapien
gaaaatgtcatcccacatttctccg

SEQ ID NO: 62435 - DNA, 25 bp, Homo sapien
gaaaatgtcatctcacatttctccg

SEQ ID NO: 62436 - DNA, 25 bp, Homo sapien
gaaaatgtcctattgaatcaagctg

SEQ ID NO: 62437 - DNA, 25 bp, Homo sapien
gaaaatgtgatgtttgatatggacg

SEQ ID NO: 62438 - DNA, 25 bp, Homo sapien
gaaaatgtgatgtttggtatggacg

SEQ ID NO: 62439 - DNA, 25 bp, Homo sapien
gaaaatgtgcagtaaaaatatggta

SEQ ID NO: 62440 - DNA, 25 bp, Homo sapien
gaaaatgtgcattaaaaatatggta

SEQ ID NO: 62441 - DNA, 25 bp, Homo sapien
gaaaatgtgccctaactcaggcaga

SEQ ID NO: 62442 - DNA, 25 bp, Homo sapien
gaaaatgtgccctagctcaggcaga

SEQ ID NO: 62443 - DNA, 25 bp, Homo sapien
gaaaatgttacctctgatcccttat

SEQ ID NO: 62444 - DNA, 25 bp, Homo sapien
gaaaatgttacctttgatcccttat

SEQ ID NO: 62445 - DNA, 25 bp, Homo sapien
gaaaatgttcctatctactttttct

SEQ ID NO: 62446 - DNA, 25 bp, Homo sapien
gaaaatgtttctatctactttttct

SEQ ID NO: 62447 - DNA, 25 bp, Homo sapien
gaaaattatagatgtccataattcc

SEQ ID NO: 62448 - DNA, 25 bp, Homo sapien
gaaaattatgccggggaatgccttt

SEQ ID NO: 62449 - DNA, 25 bp, Homo sapien
gaaaattatgctggggaatgccttt

SEQ ID NO: 62450 - DNA, 25 bp, Homo sapien
gaaaattatggatgtccataattcc

SEQ ID NO: 62451 - DNA, 25 bp, Homo sapien
gaaaattcaccatatagttgaagga

SEQ ID NO: 62452 - DNA, 25 bp, Homo sapien
gaaaattcaccgtatagttgaagga

SEQ ID NO: 62453 - DNA, 25 bp, Homo sapien
gaaaattccctcaaacttggaaatc

SEQ ID NO: 62454 - DNA, 25 bp, Homo sapien
gaaaattccctcgaacttggaaatc

SEQ ID NO: 62455 - DNA, 25 bp, Homo sapien
gaaaattctttcatgggctaagctc

SEQ ID NO: 62456 - DNA, 25 bp, Homo sapien
gaaaattctttcgtgggctaagctc

SEQ ID NO: 62457 - DNA, 25 bp, Homo sapien
gaaaattgagtctgaattaatttct

SEQ ID NO: 62458 - DNA, 25 bp, Homo sapien
gaaaattgagttccagggcagtaag

SEQ ID NO: 62459 - DNA, 25 bp, Homo sapien
gaaaattgagtttcagggcagtaag

SEQ ID NO: 62460 - DNA, 25 bp, Homo sapien
gaaaattgagtttgaattaatttct

SEQ ID NO: 62461 - DNA, 25 bp, Homo sapien
gaaaattggcacttatgaaagtgga

SEQ ID NO: 62462 - DNA, 25 bp, Homo sapien
gaaaattggcacttgtgaaagtgga

SEQ ID NO: 62463 - DNA, 25 bp, Homo sapien
gaaaatttcactattttgtcatcat

SEQ ID NO: 62464 - DNA, 25 bp, Homo sapien
gaaaatttccctattttgtcatcat

SEQ ID NO: 62465 - DNA, 25 bp, Homo sapien
gaaaatttcgatgaggttcctataa

SEQ ID NO: 62466 - DNA, 25 bp, Homo sapien
gaaaatttcttgaactttatactta

SEQ ID NO: 62467 - DNA, 25 bp, Homo sapien
gaaaatttcttgagctttatactta

SEQ ID NO: 62468 - DNA, 25 bp, Homo sapien
gaaaattttgatgaggttcctataa

SEQ ID NO: 62469 - DNA, 25 bp, Homo sapien
gaaaattttgcccaaatgttatcag

SEQ ID NO: 62470 - DNA, 25 bp, Homo sapien
gaaaattttgcccagatgttatcag

SEQ ID NO: 62471 - DNA, 25 bp, Homo sapien
gaaacaaaacttcataacaccttgg

SEQ ID NO: 62472 - DNA, 25 bp, Homo sapien
gaaacaaaacttcctaacaccttgg

SEQ ID NO: 62473 - DNA, 25 bp, Homo sapien
gaaacaaacggagaccaaaataagc

SEQ ID NO: 62474 - DNA, 25 bp, Homo sapien
gaaacaaagcaaaagtatctatctc

SEQ ID NO: 62475 - DNA, 25 bp, Homo sapien
gaaacaaaggaaaagtatctatctc

SEQ ID NO: 62476 - DNA, 25 bp, Homo sapien
gaaacaaatggagaccaaaataagc

SEQ ID NO: 62477 - DNA, 25 bp, Homo sapien
gaaacaaccagaccgttagaagtgt

SEQ ID NO: 62478 - DNA, 25 bp, Homo sapien
gaaacaaccagactgttagaagtgt

SEQ ID NO: 62479 - DNA, 25 bp, Homo sapien
gaaacaagctgtgcatggcaggaca

SEQ ID NO: 62480 - DNA, 25 bp, Homo sapien
gaaacaaggaaggcatgagagacag

SEQ ID NO: 62481 - DNA, 25 bp, Homo sapien
gaaacaaggaaggcgtgagagacag

SEQ ID NO: 62482 - DNA, 25 bp, Homo sapien
gaaacaagttgtgcatggcaggaca

SEQ ID NO: 62483 - DNA, 25 bp, Homo sapien
gaaacaataaaggcttgctaacaag

SEQ ID NO: 62484 - DNA, 25 bp, Homo sapien
gaaacaataaagtcttgctaacaag

SEQ ID NO: 62485 - DNA, 25 bp, Homo sapien
gaaacaatcctaaactgctgaaatt

SEQ ID NO: 62486 - DNA, 25 bp, Homo sapien
gaaacaatcttaaactgctgaaatt

SEQ ID NO: 62487 - DNA, 25 bp, Homo sapien
gaaacaattaacaatatggcgttaa

SEQ ID NO: 62488 - DNA, 25 bp, Homo sapien
gaaacaattaaccatatggcgttaa

SEQ ID NO: 62489 - DNA, 25 bp, Homo sapien
gaaacaattgtcgatggtggaaata

SEQ ID NO: 62490 - DNA, 25 bp, Homo sapien
gaaacaattgtcggtggtggaaata

SEQ ID NO: 62491 - DNA, 25 bp, Homo sapien
gaaacaccacagatgccagagcctt

SEQ ID NO: 62492 - DNA, 25 bp, Homo sapien
gaaacaccacagctgccagagcctt

SEQ ID NO: 62493 - DNA, 25 bp, Homo sapien
gaaacactataggaggcgctggaaa

SEQ ID NO: 62494 - DNA, 25 bp, Homo sapien
gaaacactataggaggtgctggaaa

SEQ ID NO: 62495 - DNA, 25 bp, Homo sapien
gaaacagaaaacactagtcagccat

SEQ ID NO: 62496 - DNA, 25 bp, Homo sapien
gaaacagaaaacgctagtcagccat

SEQ ID NO: 62497 - DNA, 25 bp, Homo sapien
gaaacagacaactgttgcattcctg

SEQ ID NO: 62498 - DNA, 25 bp, Homo sapien
gaaacagacaagtgttgcattcctg

SEQ ID NO: 62499 - DNA, 25 bp, Homo sapien
gaaacagatatagtcaaatgtttgt

SEQ ID NO: 62500 - DNA, 25 bp, Homo sapien
gaaacagatatattcaaatgtttgt

SEQ ID NO: 62501 - DNA, 25 bp, Homo sapien
gaaacagcaagacttctttcctctc

SEQ ID NO: 62502 - DNA, 25 bp, Homo sapien
gaaacagcaagccttctttcctctc

SEQ ID NO: 62503 - DNA, 25 bp, Homo sapien
gaaacagccaggatacagtgaccag

SEQ ID NO: 62504 - DNA, 25 bp, Homo sapien
gaaacagccgggatacagtgaccag

SEQ ID NO: 62505 - DNA, 25 bp, Homo sapien
gaaacagcgttcggtggccactgac

SEQ ID NO: 62506 - DNA, 25 bp, Homo sapien
gaaacagcgtttggtggccactgac

SEQ ID NO: 62507 - DNA, 25 bp, Homo sapien
gaaacagggcttcctttatggacac

SEQ ID NO: 62508 - DNA, 25 bp, Homo sapien
gaaacagggctttctttatggacac

SEQ ID NO: 62509 - DNA, 25 bp, Homo sapien
gaaacataacaccttgacaccagga

SEQ ID NO: 62510 - DNA, 25 bp, Homo sapien
gaaacataacaccttgtcaccagga

SEQ ID NO: 62511 - DNA, 25 bp, Homo sapien
gaaacataagacaatgcctcttata

SEQ ID NO: 62512 - DNA, 25 bp, Homo sapien
gaaacataagataatgcctcttata

SEQ ID NO: 62513 - DNA, 25 bp, Homo sapien
gaaacatcacgcaggaaagtggggg

SEQ ID NO: 62514 - DNA, 25 bp, Homo sapien
gaaacatcacgcagtaaagtggggg

SEQ ID NO: 62515 - DNA, 25 bp, Homo sapien
gaaacatcagaataatcataaatgg

SEQ ID NO: 62516 - DNA, 25 bp, Homo sapien
gaaacatcagaattatcataaatgg

SEQ ID NO: 62517 - DNA, 25 bp, Homo sapien
gaaacatcgctaaaatgattttcaa

SEQ ID NO: 62518 - DNA, 25 bp, Homo sapien
gaaacatcggccttttccactggca

SEQ ID NO: 62519 - DNA, 25 bp, Homo sapien
gaaacatcggcctttttcactggca

SEQ ID NO: 62520 - DNA, 25 bp, Homo sapien
gaaacatcgttaaaatgattttcaa

SEQ ID NO: 62521 - DNA, 25 bp, Homo sapien
gaaacatgaaagttgcctaaaaacc

SEQ ID NO: 62522 - DNA, 25 bp, Homo sapien
gaaacatgaaagtttcctaaaaacc

SEQ ID NO: 62523 - DNA, 25 bp, Homo sapien
gaaacatgtaccgtacctcaccata

SEQ ID NO: 62524 - DNA, 25 bp, Homo sapien
gaaacatgtactgtacctcaccata

SEQ ID NO: 62525 - DNA, 25 bp, Homo sapien
gaaacatgtgtagaagtctccttgg

SEQ ID NO: 62526 - DNA, 25 bp, Homo sapien
gaaacatgtgtagacgtctccttgg

SEQ ID NO: 62527 - DNA, 25 bp, Homo sapien
gaaacattggattagacaaacattt

SEQ ID NO: 62528 - DNA, 25 bp, Homo sapien
gaaacattggattatacaaacattt

SEQ ID NO: 62529 - DNA, 25 bp, Homo sapien
gaaacattgtcactccaagggctga

SEQ ID NO: 62530 - DNA, 25 bp, Homo sapien
gaaacattgtcactccgagggctga

SEQ ID NO: 62531 - DNA, 25 bp, Homo sapien
gaaacatttcaggcaatctgacata

SEQ ID NO: 62532 - DNA, 25 bp, Homo sapien
gaaacatttcaggcgatctgacata

SEQ ID NO: 62533 - DNA, 25 bp, Homo sapien
gaaacatttgttgatttggcctatt

SEQ ID NO: 62534 - DNA, 25 bp, Homo sapien
gaaacatttgttggtttggcctatt

SEQ ID NO: 62535 - DNA, 25 bp, Homo sapien
gaaacattttcagcaagttcattag

SEQ ID NO: 62536 - DNA, 25 bp, Homo sapien
gaaacattttcagtaagttcattag

SEQ ID NO: 62537 - DNA, 25 bp, Homo sapien
gaaacattttgccactatcttctta

SEQ ID NO: 62538 - DNA, 25 bp, Homo sapien
gaaacattttgccactgtcttctta

SEQ ID NO: 62539 - DNA, 25 bp, Homo sapien
gaaaccaagaaagcacccaaaaact

SEQ ID NO: 62540 - DNA, 25 bp, Homo sapien
gaaaccaagaaagcactcaaaaact

SEQ ID NO: 62541 - DNA, 25 bp, Homo sapien
gaaaccaatcgtgtgatttcaagga

SEQ ID NO: 62542 - DNA, 25 bp, Homo sapien
gaaaccaattgtgtgatttcaagga

SEQ ID NO: 62543 - DNA, 25 bp, Homo sapien
gaaaccacagagtgacaggtgagtg

SEQ ID NO: 62544 - DNA, 25 bp, Homo sapien
gaaaccacggagtgacaggtgagtg

SEQ ID NO: 62545 - DNA, 25 bp, Homo sapien
gaaaccactataatagctctaagat

SEQ ID NO: 62546 - DNA, 25 bp, Homo sapien
gaaaccactctaatagctctaagat

SEQ ID NO: 62547 - DNA, 25 bp, Homo sapien
gaaaccagcctctgtgaagaggtta

SEQ ID NO: 62548 - DNA, 25 bp, Homo sapien
gaaaccaggctctgtgaagaggtta

SEQ ID NO: 62549 - DNA, 25 bp, Homo sapien
gaaaccataaataggaaaagcaaaa

SEQ ID NO: 62550 - DNA, 25 bp, Homo sapien
gaaaccatgaataggaaaagcaaaa

SEQ ID NO: 62551 - DNA, 25 bp, Homo sapien
gaaaccctttattgtgcaagactgc

SEQ ID NO: 62552 - DNA, 25 bp, Homo sapien
gaaaccctttattgtgtaagactgc

SEQ ID NO: 62553 - DNA, 25 bp, Homo sapien
gaaaccgtcatttcaaatacttcct

SEQ ID NO: 62554 - DNA, 25 bp, Homo sapien
gaaaccgtcatttcgaatacttcct

SEQ ID NO: 62555 - DNA, 25 bp, Homo sapien
gaaacctacttctagttcgtgttct

SEQ ID NO: 62556 - DNA, 25 bp, Homo sapien
gaaacctagttctagttcgtgttct

SEQ ID NO: 62557 - DNA, 25 bp, Homo sapien
gaaacctatgcacgtcatgctttac

SEQ ID NO: 62558 - DNA, 25 bp, Homo sapien
gaaacctatgcccgtcatgctttac

SEQ ID NO: 62559 - DNA, 25 bp, Homo sapien
gaaacctcactgcaggaagaaactc

SEQ ID NO: 62560 - DNA, 25 bp, Homo sapien
gaaacctcactgtaggaagaaactc

SEQ ID NO: 62561 - DNA, 25 bp, Homo sapien
gaaacctgataggactttagccttt

SEQ ID NO: 62562 - DNA, 25 bp, Homo sapien
gaaacctgataggattttagccttt

SEQ ID NO: 62563 - DNA, 25 bp, Homo sapien
gaaacgagtcctgcggctgattgct

SEQ ID NO: 62564 - DNA, 25 bp, Homo sapien
gaaacgagtcctgctgctgattgct

SEQ ID NO: 62565 - DNA, 25 bp, Homo sapien
gaaacggacaacgaactggaagaaa

SEQ ID NO: 62566 - DNA, 25 bp, Homo sapien
gaaacggacaaggaactggaagaaa

SEQ ID NO: 62567 - DNA, 25 bp, Homo sapien
gaaacggacccagcagagcaggacc

SEQ ID NO: 62568 - DNA, 25 bp, Homo sapien
gaaacggactcagcagagcaggacc

SEQ ID NO: 62569 - DNA, 25 bp, Homo sapien
gaaacgttttctatatttgcaccaa

SEQ ID NO: 62570 - DNA, 25 bp, Homo sapien
gaaacgttttctgtatttgcaccaa

SEQ ID NO: 62571 - DNA, 25 bp, Homo sapien
gaaactaagttgttctctaacattc

SEQ ID NO: 62572 - DNA, 25 bp, Homo sapien
gaaactaagttgttgtctaacattc

SEQ ID NO: 62573 - DNA, 25 bp, Homo sapien
gaaactactgtccttgttgttcaaa

SEQ ID NO: 62574 - DNA, 25 bp, Homo sapien
gaaactactgtcgttgttgttcaaa

SEQ ID NO: 62575 - DNA, 25 bp, Homo sapien
gaaactagttcactcgaaaatgcag

SEQ ID NO: 62576 - DNA, 25 bp, Homo sapien
gaaactagttcacttgaaaatgcag

SEQ ID NO: 62577 - DNA, 25 bp, Homo sapien
gaaactcaaagaaatacaagataac

SEQ ID NO: 62578 - DNA, 25 bp, Homo sapien
gaaactcaattcgtgctcagcatgc

SEQ ID NO: 62579 - DNA, 25 bp, Homo sapien
gaaactcaatttgtgctcagcatgc

SEQ ID NO: 62580 - DNA, 25 bp, Homo sapien
gaaactcacaccaccaatgaggcag

SEQ ID NO: 62581 - DNA, 25 bp, Homo sapien
gaaactcacaccgccaatgaggcag

SEQ ID NO: 62582 - DNA, 25 bp, Homo sapien
gaaactcagagaaatacaagataac

SEQ ID NO: 62583 - DNA, 25 bp, Homo sapien
gaaactcaggtttggcatgtcatgc

SEQ ID NO: 62584 - DNA, 25 bp, Homo sapien
gaaactcagttttggcatgtcatgc

SEQ ID NO: 62585 - DNA, 25 bp, Homo sapien
gaaactcatataaatgtaggaggaa

SEQ ID NO: 62586 - DNA, 25 bp, Homo sapien
gaaactcatatagatgtaggaggaa

SEQ ID NO: 62587 - DNA, 25 bp, Homo sapien
gaaactcccacatgtccttcttttc

SEQ ID NO: 62588 - DNA, 25 bp, Homo sapien
gaaactcccacgtgtccttcttttc

SEQ ID NO: 62589 - DNA, 25 bp, Homo sapien
gaaactctaaggtccgaagagaagt

SEQ ID NO: 62590 - DNA, 25 bp, Homo sapien
gaaactctaaggtccggagagaagt

SEQ ID NO: 62591 - DNA, 25 bp, Homo sapien
gaaactcttccagagaatataagaa

SEQ ID NO: 62592 - DNA, 25 bp, Homo sapien
gaaactcttccagagactataagaa

SEQ ID NO: 62593 - DNA, 25 bp, Homo sapien
gaaactgacgttagtaataggcctt

SEQ ID NO: 62594 - DNA, 25 bp, Homo sapien
gaaactgacgttagtattaggcctt

SEQ ID NO: 62595 - DNA, 25 bp, Homo sapien
gaaactgaggctagcaagcaaaaca

SEQ ID NO: 62596 - DNA, 25 bp, Homo sapien
gaaactgaggctagcacgcaaaaca

SEQ ID NO: 62597 - DNA, 25 bp, Homo sapien
gaaactgatacaatcatgtcaaagg

SEQ ID NO: 62598 - DNA, 25 bp, Homo sapien
gaaactgatacgatcatgtcaaagg

SEQ ID NO: 62599 - DNA, 25 bp, Homo sapien
gaaactgcaatgagcgttgattgat

SEQ ID NO: 62600 - DNA, 25 bp, Homo sapien
gaaactgcagtgagcgttgattgat

SEQ ID NO: 62601 - DNA, 25 bp, Homo sapien
gaaactgggtatctgcgttcgcttg

SEQ ID NO: 62602 - DNA, 25 bp, Homo sapien
gaaactggttatctgcgttcgcttg

SEQ ID NO: 62603 - DNA, 25 bp, Homo sapien
gaaactgtgttcagaaacctctcac

SEQ ID NO: 62604 - DNA, 25 bp, Homo sapien
gaaactgtgttcagaaccctctcac

SEQ ID NO: 62605 - DNA, 25 bp, Homo sapien
gaaactgttaccagcactagcggat

SEQ ID NO: 62606 - DNA, 25 bp, Homo sapien
gaaactgttaccagcattagcggat

SEQ ID NO: 62607 - DNA, 25 bp, Homo sapien
gaaacttcaataaactatcctgatg

SEQ ID NO: 62608 - DNA, 25 bp, Homo sapien
gaaacttcaataacctatcctgatg

SEQ ID NO: 62609 - DNA, 25 bp, Homo sapien
gaaacttcatctcatattcacagag

SEQ ID NO: 62610 - DNA, 25 bp, Homo sapien
gaaacttcatcttatattcacagag

SEQ ID NO: 62611 - DNA, 25 bp, Homo sapien
gaaacttgagtttgtcattattgtg

SEQ ID NO: 62612 - DNA, 25 bp, Homo sapien
gaaacttgagtttgtcgttattgtg

SEQ ID NO: 62613 - DNA, 25 bp, Homo sapien
gaaactttactatctgaatgtgtac

SEQ ID NO: 62614 - DNA, 25 bp, Homo sapien
gaaactttactatgtgaatgtgtac

SEQ ID NO: 62615 - DNA, 25 bp, Homo sapien
gaaactttctatttagtcgttagtt

SEQ ID NO: 62616 - DNA, 25 bp, Homo sapien
gaaactttgtatttagtcgttagtt

SEQ ID NO: 62617 - DNA, 25 bp, Homo sapien
gaaagaaaaacagcaaaatgccaca

SEQ ID NO: 62618 - DNA, 25 bp, Homo sapien
gaaagaaaaacagcaagatgccaca

SEQ ID NO: 62619 - DNA, 25 bp, Homo sapien
gaaagaaaacggcaagctgggaaac

SEQ ID NO: 62620 - DNA, 25 bp, Homo sapien
gaaagaaaactaacagccccagtca

SEQ ID NO: 62621 - DNA, 25 bp, Homo sapien
gaaagaaaatggcaagctgggaaac

SEQ ID NO: 62622 - DNA, 25 bp, Homo sapien
gaaagaaaccaagaccctggagata

SEQ ID NO: 62623 - DNA, 25 bp, Homo sapien
gaaagaaaccaagatcctggagata

SEQ ID NO: 62624 - DNA, 25 bp, Homo sapien
gaaagaaactcaggtttggcatgtc

SEQ ID NO: 62625 - DNA, 25 bp, Homo sapien
gaaagaaactcagttttggcatgtc

SEQ ID NO: 62626 - DNA, 25 bp, Homo sapien
gaaagaaagctaacagccccagtca

SEQ ID NO: 62627 - DNA, 25 bp, Homo sapien
gaaagaacccactgcttattttgcc

SEQ ID NO: 62628 - DNA, 25 bp, Homo sapien
gaaagaacctactgcttattttgcc

SEQ ID NO: 62629 - DNA, 25 bp, Homo sapien
gaaagaagaaattgaagatgttgac

SEQ ID NO: 62630 - DNA, 25 bp, Homo sapien
gaaagaagagattgaagatgttgac

SEQ ID NO: 62631 - DNA, 25 bp, Homo sapien
gaaagaaggagcacaagagggtcag

SEQ ID NO: 62632 - DNA, 25 bp, Homo sapien
gaaagaaggaggacaagagggtcag

SEQ ID NO: 62633 - DNA, 25 bp, Homo sapien
gaaagaatacccaaagaaaccatga

SEQ ID NO: 62634 - DNA, 25 bp, Homo sapien
gaaagaatacccagagaaaccatga

SEQ ID NO: 62635 - DNA, 25 bp, Homo sapien
gaaagaatgagcagaaataggagac

SEQ ID NO: 62636 - DNA, 25 bp, Homo sapien
gaaagaatgagcagaagtaggagac

SEQ ID NO: 62637 - DNA, 25 bp, Homo sapien
gaaagaatggtagatgggaacatcc

SEQ ID NO: 62638 - DNA, 25 bp, Homo sapien
gaaagaatggtaggtgggaacatcc

SEQ ID NO: 62639 - DNA, 25 bp, Homo sapien
gaaagacaaagtgctaccatttctt

SEQ ID NO: 62640 - DNA, 25 bp, Homo sapien
gaaagacaacgtgctaccatttctt

SEQ ID NO: 62641 - DNA, 25 bp, Homo sapien
gaaagacagaaacagacaggaactt

SEQ ID NO: 62642 - DNA, 25 bp, Homo sapien
gaaagacagaaatagacaggaactt

SEQ ID NO: 62643 - DNA, 25 bp, Homo sapien
gaaagacagcatcactaaaagacac

SEQ ID NO: 62644 - DNA, 25 bp, Homo sapien
gaaagacaggatcactaaaagacac

SEQ ID NO: 62645 - DNA, 25 bp, Homo sapien
gaaagacaggatgacaaagaaaagg

SEQ ID NO: 62646 - DNA, 25 bp, Homo sapien
gaaagacaggatgacagagaaaagg

SEQ ID NO: 62647 - DNA, 25 bp, Homo sapien
gaaagacaggcccggagggagaaga

SEQ ID NO: 62648 - DNA, 25 bp, Homo sapien
gaaagacaggcctggagggagaaga

SEQ ID NO: 62649 - DNA, 25 bp, Homo sapien
gaaagaccaaaaaatcttacgaact

SEQ ID NO: 62650 - DNA, 25 bp, Homo sapien
gaaagaccaaaaagtcttacgaact

SEQ ID NO: 62651 - DNA, 25 bp, Homo sapien
gaaagacctcatatttctgcagggc

SEQ ID NO: 62652 - DNA, 25 bp, Homo sapien
gaaagaccttatatttctgcagggc

SEQ ID NO: 62653 - DNA, 25 bp, Homo sapien
gaaagactctctttaaaaaatgaaa

SEQ ID NO: 62654 - DNA, 25 bp, Homo sapien
gaaagactctctttgaaaaatgaaa

SEQ ID NO: 62655 - DNA, 25 bp, Homo sapien
gaaagactgtcacagcagaaagtgt

SEQ ID NO: 62656 - DNA, 25 bp, Homo sapien
gaaagactgtcacggcagaaagtgt

SEQ ID NO: 62657 - DNA, 25 bp, Homo sapien
gaaagactttaatcttaacctctaa

SEQ ID NO: 62658 - DNA, 25 bp, Homo sapien
gaaagactttaattttaacctctaa

SEQ ID NO: 62659 - DNA, 25 bp, Homo sapien
gaaagagaagacctaagatgaacaa

SEQ ID NO: 62660 - DNA, 25 bp, Homo sapien
gaaagagaagagctaagatgaacaa

SEQ ID NO: 62661 - DNA, 25 bp, Homo sapien
gaaagagacctgaaggtgggagaga

SEQ ID NO: 62662 - DNA, 25 bp, Homo sapien
gaaagagagacacattgagctagag

SEQ ID NO: 62663 - DNA, 25 bp, Homo sapien
gaaagagagacatattgagctagag

SEQ ID NO: 62664 - DNA, 25 bp, Homo sapien
gaaagagagctgaaggtgggagaga

SEQ ID NO: 62665 - DNA, 25 bp, Homo sapien
gaaagagatagcggatatggcaaaa

SEQ ID NO: 62666 - DNA, 25 bp, Homo sapien
gaaagagatagtggatatggcaaaa

SEQ ID NO: 62667 - DNA, 25 bp, Homo sapien
gaaagagcatcaaatgtgctttgaa

SEQ ID NO: 62668 - DNA, 25 bp, Homo sapien
gaaagagcatcagatgtgctttgaa

SEQ ID NO: 62669 - DNA, 25 bp, Homo sapien
gaaagagcatgtcaggaaaatgaaa

SEQ ID NO: 62670 - DNA, 25 bp, Homo sapien
gaaagagcatgttaggaaaatgaaa

SEQ ID NO: 62671 - DNA, 25 bp, Homo sapien
gaaagagccagaacctctgccctct

SEQ ID NO: 62672 - DNA, 25 bp, Homo sapien
gaaagagccagaacctttgccctct

SEQ ID NO: 62673 - DNA, 25 bp, Homo sapien
gaaagagccagctccacaaccagac

SEQ ID NO: 62674 - DNA, 25 bp, Homo sapien
gaaagagccagcttcacaaccagac

SEQ ID NO: 62675 - DNA, 25 bp, Homo sapien
gaaagagggaaggacatgataggat

SEQ ID NO: 62676 - DNA, 25 bp, Homo sapien
gaaagagggaaggccatgataggat

SEQ ID NO: 62677 - DNA, 25 bp, Homo sapien
gaaagagggcacgcgagtcccactc

SEQ ID NO: 62678 - DNA, 25 bp, Homo sapien
gaaagagggcatgcgagtcccactc

SEQ ID NO: 62679 - DNA, 25 bp, Homo sapien
gaaagaggtatctaaaatctcccac

SEQ ID NO: 62680 - DNA, 25 bp, Homo sapien
gaaagaggtatgtaaaatctcccac

SEQ ID NO: 62681 - DNA, 25 bp, Homo sapien
gaaagagtagcaaggcaatttagtt

SEQ ID NO: 62682 - DNA, 25 bp, Homo sapien
gaaagagtagcgaggcaatttagtt

SEQ ID NO: 62683 - DNA, 25 bp, Homo sapien
gaaagataaaagtcgggtcgaaaaa

SEQ ID NO: 62684 - DNA, 25 bp, Homo sapien
gaaagataaaagttgggtcgaaaaa

SEQ ID NO: 62685 - DNA, 25 bp, Homo sapien
gaaagataatgtgctaaaggcagat

SEQ ID NO: 62686 - DNA, 25 bp, Homo sapien
gaaagataatgtggtaaaggcagat

SEQ ID NO: 62687 - DNA, 25 bp, Homo sapien
gaaagatcaccatgcatgcactgga

SEQ ID NO: 62688 - DNA, 25 bp, Homo sapien
gaaagatcatcatgcatgcactgga

SEQ ID NO: 62689 - DNA, 25 bp, Homo sapien
gaaagatgaagattcaggcattacc

SEQ ID NO: 62690 - DNA, 25 bp, Homo sapien
gaaagatgaaggttcaggcattacc

SEQ ID NO: 62691 - DNA, 25 bp, Homo sapien
gaaagatggaggccaaaagactaag

SEQ ID NO: 62692 - DNA, 25 bp, Homo sapien
gaaagatggaggtcaaaagactaag

SEQ ID NO: 62693 - DNA, 25 bp, Homo sapien
gaaagattagttggttatataggtt

SEQ ID NO: 62694 - DNA, 25 bp, Homo sapien
gaaagattagttggttgtataggtt

SEQ ID NO: 62695 - DNA, 25 bp, Homo sapien
gaaagatttgaactacatataattc

SEQ ID NO: 62696 - DNA, 25 bp, Homo sapien
gaaagatttgaagtacatataattc

SEQ ID NO: 62697 - DNA, 25 bp, Homo sapien
gaaagcaagacacgaagagatcaca

SEQ ID NO: 62698 - DNA, 25 bp, Homo sapien
gaaagcaagacatgaagagatcaca

SEQ ID NO: 62699 - DNA, 25 bp, Homo sapien
gaaagcaataaagtcaagacagtgg

SEQ ID NO: 62700 - DNA, 25 bp, Homo sapien
gaaagcaatgaagtcaagacagtgg

SEQ ID NO: 62701 - DNA, 25 bp, Homo sapien
gaaagcacaaaagacatggaaaaac

SEQ ID NO: 62702 - DNA, 25 bp, Homo sapien
gaaagcacaaaagagatggaaaaac

SEQ ID NO: 62703 - DNA, 25 bp, Homo sapien
gaaagcacagtgcatttgagtaact

SEQ ID NO: 62704 - DNA, 25 bp, Homo sapien
gaaagcacagtgcctttgagtaact

SEQ ID NO: 62705 - DNA, 25 bp, Homo sapien
gaaagcacccaaaaactaatgggaa

SEQ ID NO: 62706 - DNA, 25 bp, Homo sapien
gaaagcactcaaaaactaatgggaa

SEQ ID NO: 62707 - DNA, 25 bp, Homo sapien
gaaagcaggtcaccggaagggctgc

SEQ ID NO: 62708 - DNA, 25 bp, Homo sapien
gaaagcaggtcgccggaagggctgc

SEQ ID NO: 62709 - DNA, 25 bp, Homo sapien
gaaagcagtaatggaaataaagatc

SEQ ID NO: 62710 - DNA, 25 bp, Homo sapien
gaaagcagtaattgaaataaagatc

SEQ ID NO: 62711 - DNA, 25 bp, Homo sapien
gaaagcatcataataatgtgggtga

SEQ ID NO: 62712 - DNA, 25 bp, Homo sapien
gaaagcatcatagtaatgtgggtga

SEQ ID NO: 62713 - DNA, 25 bp, Homo sapien
gaaagcatcccttacgttcttttag

SEQ ID NO: 62714 - DNA, 25 bp, Homo sapien
gaaagcatcccttatgttcttttag

SEQ ID NO: 62715 - DNA, 25 bp, Homo sapien
gaaagcatccgacttcttaaaggta

SEQ ID NO: 62716 - DNA, 25 bp, Homo sapien
gaaagcatccggcttcttaaaggta

SEQ ID NO: 62717 - DNA, 25 bp, Homo sapien
gaaagcatttgcccgtacagcattg

SEQ ID NO: 62718 - DNA, 25 bp, Homo sapien
gaaagcatttgcctgtacagcattg

SEQ ID NO: 62719 - DNA, 25 bp, Homo sapien
gaaagcattttaatccctatcaaga

SEQ ID NO: 62720 - DNA, 25 bp, Homo sapien
gaaagcattttaattcctatcaaga

SEQ ID NO: 62721 - DNA, 25 bp, Homo sapien
gaaagccagatgggagtgactggaa

SEQ ID NO: 62722 - DNA, 25 bp, Homo sapien
gaaagccaggtgggagtgactggaa

SEQ ID NO: 62723 - DNA, 25 bp, Homo sapien
gaaagcccaaagctctatgatgacc

SEQ ID NO: 62724 - DNA, 25 bp, Homo sapien
gaaagcccaaagctgtatgatgacc

SEQ ID NO: 62725 - DNA, 25 bp, Homo sapien
gaaagcccacctaaaatgatgatca

SEQ ID NO: 62726 - DNA, 25 bp, Homo sapien
gaaagcccacctgaaatgatgatca

SEQ ID NO: 62727 - DNA, 25 bp, Homo sapien
gaaagcctgctcttgaatcatgtac

SEQ ID NO: 62728 - DNA, 25 bp, Homo sapien
gaaagcctgttcttgaatcatgtac

SEQ ID NO: 62729 - DNA, 25 bp, Homo sapien
gaaagccttaacaatagattagacc

SEQ ID NO: 62730 - DNA, 25 bp, Homo sapien
gaaagccttaaccatagattagacc

SEQ ID NO: 62731 - DNA, 25 bp, Homo sapien
gaaagctaaataaacgcctatgtac

SEQ ID NO: 62732 - DNA, 25 bp, Homo sapien
gaaagctaaataaatgcctatgtac

SEQ ID NO: 62733 - DNA, 25 bp, Homo sapien
gaaagctatttctgaacatgaggcc

SEQ ID NO: 62734 - DNA, 25 bp, Homo sapien
gaaagctatttttgaacatgaggcc

SEQ ID NO: 62735 - DNA, 25 bp, Homo sapien
gaaagctctatagaaagtaaaatgt

SEQ ID NO: 62736 - DNA, 25 bp, Homo sapien
gaaagctctatagagagtaaaatgt

SEQ ID NO: 62737 - DNA, 25 bp, Homo sapien
gaaagctcttgaattcgtttcctag

SEQ ID NO: 62738 - DNA, 25 bp, Homo sapien
gaaagctcttgcattcgtttcctag

SEQ ID NO: 62739 - DNA, 25 bp, Homo sapien
gaaagctgcaaaggcaaattgaaat

SEQ ID NO: 62740 - DNA, 25 bp, Homo sapien
gaaagctgcaatggcaaattgaaat

SEQ ID NO: 62741 - DNA, 25 bp, Homo sapien
gaaagcttaaacattagctactcta

SEQ ID NO: 62742 - DNA, 25 bp, Homo sapien
gaaagcttaaacgttagctactcta

SEQ ID NO: 62743 - DNA, 25 bp, Homo sapien
gaaagcttagaccttatgggagcta

SEQ ID NO: 62744 - DNA, 25 bp, Homo sapien
gaaagcttataccttatgggagcta

SEQ ID NO: 62745 - DNA, 25 bp, Homo sapien
gaaagcttctttcagtttggctgaa

SEQ ID NO: 62746 - DNA, 25 bp, Homo sapien
gaaagcttggcagacctgtatgcat

SEQ ID NO: 62747 - DNA, 25 bp, Homo sapien
gaaagcttggcaggcctgtatgcat

SEQ ID NO: 62748 - DNA, 25 bp, Homo sapien
gaaagcttgtttcagtttggctgaa

SEQ ID NO: 62749 - DNA, 25 bp, Homo sapien
gaaaggaaacaattatcagtactac

SEQ ID NO: 62750 - DNA, 25 bp, Homo sapien
gaaaggaaacagttatcagtactac

SEQ ID NO: 62751 - DNA, 25 bp, Homo sapien
gaaaggaaacatgtaccgtacctca

SEQ ID NO: 62752 - DNA, 25 bp, Homo sapien
gaaaggaaacatgtactgtacctca

SEQ ID NO: 62753 - DNA, 25 bp, Homo sapien
gaaaggaaactagcaggagatgatg

SEQ ID NO: 62754 - DNA, 25 bp, Homo sapien
gaaaggaaactggcaggagatgatg

SEQ ID NO: 62755 - DNA, 25 bp, Homo sapien
gaaaggaaggtcacagtgattgtca

SEQ ID NO: 62756 - DNA, 25 bp, Homo sapien
gaaaggaaggtcagagtgattgtca

SEQ ID NO: 62757 - DNA, 25 bp, Homo sapien
gaaaggaattcaagctgtacattgt

SEQ ID NO: 62758 - DNA, 25 bp, Homo sapien
gaaaggaattcgagctgtacattgt

SEQ ID NO: 62759 - DNA, 25 bp, Homo sapien
gaaaggacaaataatacaagagaaa

SEQ ID NO: 62760 - DNA, 25 bp, Homo sapien
gaaaggacaaataatataagagaaa

SEQ ID NO: 62761 - DNA, 25 bp, Homo sapien
gaaaggacagtcatttagataagaa

SEQ ID NO: 62762 - DNA, 25 bp, Homo sapien
gaaaggacagtcgtttagataagaa

SEQ ID NO: 62763 - DNA, 25 bp, Homo sapien
gaaaggaccaccagacatgtgagga

SEQ ID NO: 62764 - DNA, 25 bp, Homo sapien
gaaaggaccaccagacgtgtgagga

SEQ ID NO: 62765 - DNA, 25 bp, Homo sapien
gaaaggagtaaacggtcctttcaca

SEQ ID NO: 62766 - DNA, 25 bp, Homo sapien
gaaaggagtaagcggtcctttcaca

SEQ ID NO: 62767 - DNA, 25 bp, Homo sapien
gaaaggatctcccacaatcatctgg

SEQ ID NO: 62768 - DNA, 25 bp, Homo sapien
gaaaggattaatgctgccatcatga

SEQ ID NO: 62769 - DNA, 25 bp, Homo sapien
gaaaggattaatgttgccatcatga

SEQ ID NO: 62770 - DNA, 25 bp, Homo sapien
gaaaggatttcccacaatcatctgg

SEQ ID NO: 62771 - DNA, 25 bp, Homo sapien
gaaagggaaggtgctactgacatgt

SEQ ID NO: 62772 - DNA, 25 bp, Homo sapien
gaaagggaaggtggtactgacatgt

SEQ ID NO: 62773 - DNA, 25 bp, Homo sapien
gaaagggaccttaaaaagatcatct

SEQ ID NO: 62774 - DNA, 25 bp, Homo sapien
gaaagggagcttaaaaagatcatct

SEQ ID NO: 62775 - DNA, 25 bp, Homo sapien
gaaagggcataacaggaacattaat

SEQ ID NO: 62776 - DNA, 25 bp, Homo sapien
gaaagggcataacgggaacattaat

SEQ ID NO: 62777 - DNA, 25 bp, Homo sapien
gaaagggtcttacgagccattgaat

SEQ ID NO: 62778 - DNA, 25 bp, Homo sapien
gaaagggtcttatgagccattgaat

SEQ ID NO: 62779 - DNA, 25 bp, Homo sapien
gaaaggtccagcagacagttgtgca

SEQ ID NO: 62780 - DNA, 25 bp, Homo sapien
gaaaggtccagcggacagttgtgca

SEQ ID NO: 62781 - DNA, 25 bp, Homo sapien
gaaaggtggattgtctgtcactgaa

SEQ ID NO: 62782 - DNA, 25 bp, Homo sapien
gaaaggtggattttctgtcactgaa

SEQ ID NO: 62783 - DNA, 25 bp, Homo sapien
gaaaggttattagagatagttgggt

SEQ ID NO: 62784 - DNA, 25 bp, Homo sapien
gaaaggttattggagatagttgggt

SEQ ID NO: 62785 - DNA, 25 bp, Homo sapien
gaaaggttctcaatccagtccgtgg

SEQ ID NO: 62786 - DNA, 25 bp, Homo sapien
gaaaggttctcgatccagtccgtgg

SEQ ID NO: 62787 - DNA, 25 bp, Homo sapien
gaaaggttgggcacatggcatcagc

SEQ ID NO: 62788 - DNA, 25 bp, Homo sapien
gaaaggttgggcacgtggcatcagc

SEQ ID NO: 62789 - DNA, 25 bp, Homo sapien
gaaagtaaattcacctgttcttaga

SEQ ID NO: 62790 - DNA, 25 bp, Homo sapien
gaaagtaaattcacttgttcttaga

SEQ ID NO: 62791 - DNA, 25 bp, Homo sapien
gaaagtaacacaagtagtgctatta

SEQ ID NO: 62792 - DNA, 25 bp, Homo sapien
gaaagtaatacaagtagtgctatta

SEQ ID NO: 62793 - DNA, 25 bp, Homo sapien
gaaagtaatgactgcgctttggccc

SEQ ID NO: 62794 - DNA, 25 bp, Homo sapien
gaaagtaatgactgtgctttggccc

SEQ ID NO: 62795 - DNA, 25 bp, Homo sapien
gaaagtagttgggtaaagaaactgc

SEQ ID NO: 62796 - DNA, 25 bp, Homo sapien
gaaagtagttgggtaaggaaactgc

SEQ ID NO: 62797 - DNA, 25 bp, Homo sapien
gaaagtcaacatgaaaaaaaataat

SEQ ID NO: 62798 - DNA, 25 bp, Homo sapien
gaaagtcaacatgagaaaaaataat

SEQ ID NO: 62799 - DNA, 25 bp, Homo sapien
gaaagtcacaggaaggcatactaca

SEQ ID NO: 62800 - DNA, 25 bp, Homo sapien
gaaagtcacaggagggcatactaca

SEQ ID NO: 62801 - DNA, 25 bp, Homo sapien
gaaagtcaccagttaccagagctgc

SEQ ID NO: 62802 - DNA, 25 bp, Homo sapien
gaaagtcaccagttgccagagctgc

SEQ ID NO: 62803 - DNA, 25 bp, Homo sapien
gaaagtcaggcttcagctcagatct

SEQ ID NO: 62804 - DNA, 25 bp, Homo sapien
gaaagtcatgcttcagctcagatct

SEQ ID NO: 62805 - DNA, 25 bp, Homo sapien
gaaagtcattttcttcctgctgttt

SEQ ID NO: 62806 - DNA, 25 bp, Homo sapien
gaaagtcattttgttcctgctgttt

SEQ ID NO: 62807 - DNA, 25 bp, Homo sapien
gaaagtccacagtgcaaagtaaaag

SEQ ID NO: 62808 - DNA, 25 bp, Homo sapien
gaaagtccatggagaagcccacact

SEQ ID NO: 62809 - DNA, 25 bp, Homo sapien
gaaagtccgcagtgcaaagtaaaag

SEQ ID NO: 62810 - DNA, 25 bp, Homo sapien
gaaagtccgtggagaagcccacact

SEQ ID NO: 62811 - DNA, 25 bp, Homo sapien
gaaagtcctatctgctttaatcttt

SEQ ID NO: 62812 - DNA, 25 bp, Homo sapien
gaaagtcctatcttctttaatcttt

SEQ ID NO: 62813 - DNA, 25 bp, Homo sapien
gaaagtcctttgagaaaaacattgc

SEQ ID NO: 62814 - DNA, 25 bp, Homo sapien
gaaagtcctttgggaaaaacattgc

SEQ ID NO: 62815 - DNA, 25 bp, Homo sapien
gaaagtcgcttaattcaggaggcag

SEQ ID NO: 62816 - DNA, 25 bp, Homo sapien
gaaagtcgcttaattcgggaggcag

SEQ ID NO: 62817 - DNA, 25 bp, Homo sapien
gaaagtctaatagtgcaattctttc

SEQ ID NO: 62818 - DNA, 25 bp, Homo sapien
gaaagtctaatattgcaattctttc

SEQ ID NO: 62819 - DNA, 25 bp, Homo sapien
gaaagtctatgggatcaaagcattt

SEQ ID NO: 62820 - DNA, 25 bp, Homo sapien
gaaagtctcagaagaatttaccaat

SEQ ID NO: 62821 - DNA, 25 bp, Homo sapien
gaaagtctcagcagaatttaccaat

SEQ ID NO: 62822 - DNA, 25 bp, Homo sapien
gaaagtctcttatgccatggatctg

SEQ ID NO: 62823 - DNA, 25 bp, Homo sapien
gaaagtctgtgggatcaaagcattt

SEQ ID NO: 62824 - DNA, 25 bp, Homo sapien
gaaagtcttttatgccatggatctg

SEQ ID NO: 62825 - DNA, 25 bp, Homo sapien
gaaagtgaaaaacacaatggttgca

SEQ ID NO: 62826 - DNA, 25 bp, Homo sapien
gaaagtgaaaaacacagtggttgca

SEQ ID NO: 62827 - DNA, 25 bp, Homo sapien
gaaagtgaaagacagaaacagatat

SEQ ID NO: 62828 - DNA, 25 bp, Homo sapien
gaaagtgaaagacggaaacagatat

SEQ ID NO: 62829 - DNA, 25 bp, Homo sapien
gaaagtgacggtagaaaaattataa

SEQ ID NO: 62830 - DNA, 25 bp, Homo sapien
gaaagtgacggtaggaaaattataa

SEQ ID NO: 62831 - DNA, 25 bp, Homo sapien
gaaagtgagaagcatgagaaaagct

SEQ ID NO: 62832 - DNA, 25 bp, Homo sapien
gaaagtgagaagcatgggaaaagct

SEQ ID NO: 62833 - DNA, 25 bp, Homo sapien
gaaagtgagggcaagaacagaaacc

SEQ ID NO: 62834 - DNA, 25 bp, Homo sapien
gaaagtgagggcgagaacagaaacc

SEQ ID NO: 62835 - DNA, 25 bp, Homo sapien
gaaagtgcaaaggaaaaagtaagaa

SEQ ID NO: 62836 - DNA, 25 bp, Homo sapien
gaaagtgcgaaggaaaaagtaagaa

SEQ ID NO: 62837 - DNA, 25 bp, Homo sapien
gaaagtgggaagcacgtgagccaat

SEQ ID NO: 62838 - DNA, 25 bp, Homo sapien
gaaagtgggaagcatgtgagccaat

SEQ ID NO: 62839 - DNA, 25 bp, Homo sapien
gaaagttaggcaatgagtccactaa

SEQ ID NO: 62840 - DNA, 25 bp, Homo sapien
gaaagttaggcgatgagtccactaa

SEQ ID NO: 62841 - DNA, 25 bp, Homo sapien
gaaagttcacataactgcaaagcat

SEQ ID NO: 62842 - DNA, 25 bp, Homo sapien
gaaagttcatataactgcaaagcat

SEQ ID NO: 62843 - DNA, 25 bp, Homo sapien
gaaagttggagaataacgaaagaga

SEQ ID NO: 62844 - DNA, 25 bp, Homo sapien
gaaagttggagaataatgaaagaga

SEQ ID NO: 62845 - DNA, 25 bp, Homo sapien
gaaagttgtatacgttaatgattgt

SEQ ID NO: 62846 - DNA, 25 bp, Homo sapien
gaaagttgtatatgttaatgattgt

SEQ ID NO: 62847 - DNA, 25 bp, Homo sapien
gaaagttgtatgaaattatatgaaa

SEQ ID NO: 62848 - DNA, 25 bp, Homo sapien
gaaagttgtatgagattatatgaaa

SEQ ID NO: 62849 - DNA, 25 bp, Homo sapien
gaaagtttatggcaataataggtag

SEQ ID NO: 62850 - DNA, 25 bp, Homo sapien
gaaagtttatgggaataataggtag

SEQ ID NO: 62851 - DNA, 25 bp, Homo sapien
gaaagtttcaataaattaaccagac

SEQ ID NO: 62852 - DNA, 25 bp, Homo sapien
gaaagtttgaacccagtgacaatca

SEQ ID NO: 62853 - DNA, 25 bp, Homo sapien
gaaagtttgaagccagtgacaatca

SEQ ID NO: 62854 - DNA, 25 bp, Homo sapien
gaaagtttgaataaattaaccagac

SEQ ID NO: 62855 - DNA, 25 bp, Homo sapien
gaaagtttgtgtcaatttattaaag

SEQ ID NO: 62856 - DNA, 25 bp, Homo sapien
gaaagtttttgtcaatttattaaag

SEQ ID NO: 62857 - DNA, 25 bp, Homo sapien
gaaataaaaaacagatgaacaatgt

SEQ ID NO: 62858 - DNA, 25 bp, Homo sapien
gaaataaaaaacaggtgaacaatgt

SEQ ID NO: 62859 - DNA, 25 bp, Homo sapien
gaaataaaaatctcaatgaatgggc

SEQ ID NO: 62860 - DNA, 25 bp, Homo sapien
gaaataaaactctcaatgaatgggc

SEQ ID NO: 62861 - DNA, 25 bp, Homo sapien
gaaataaatacccagcataaggcat

SEQ ID NO: 62862 - DNA, 25 bp, Homo sapien
gaaataaataccgagcataaggcat

SEQ ID NO: 62863 - DNA, 25 bp, Homo sapien
gaaataagctaagaaacaatgggat

SEQ ID NO: 62864 - DNA, 25 bp, Homo sapien
gaaataagctaagcaacaatgggat

SEQ ID NO: 62865 - DNA, 25 bp, Homo sapien
gaaataagtccaaattccccatcag

SEQ ID NO: 62866 - DNA, 25 bp, Homo sapien
gaaataagtccagattccccatcag

SEQ ID NO: 62867 - DNA, 25 bp, Homo sapien
gaaataatcatctgtgtactaagtc

SEQ ID NO: 62868 - DNA, 25 bp, Homo sapien
gaaataatcgtctgtgtactaagtc

SEQ ID NO: 62869 - DNA, 25 bp, Homo sapien
gaaataatgaggttctgctatgtaa

SEQ ID NO: 62870 - DNA, 25 bp, Homo sapien
gaaataatgaggttttgctatgtaa

SEQ ID NO: 62871 - DNA, 25 bp, Homo sapien
gaaataatgcacactccataatctc

SEQ ID NO: 62872 - DNA, 25 bp, Homo sapien
gaaataatgcacattccataatctc

SEQ ID NO: 62873 - DNA, 25 bp, Homo sapien
gaaatacaaaaacaatgacccatgg

SEQ ID NO: 62874 - DNA, 25 bp, Homo sapien
gaaatacaaaaacattgacccatgg

SEQ ID NO: 62875 - DNA, 25 bp, Homo sapien
gaaatacaaaagagcctaaataggt

SEQ ID NO: 62876 - DNA, 25 bp, Homo sapien
gaaatacaaatgctggtttattatt

SEQ ID NO: 62877 - DNA, 25 bp, Homo sapien
gaaatacaaatgttggtttattatt

SEQ ID NO: 62878 - DNA, 25 bp, Homo sapien
gaaatacaatagagcctaaataggt

SEQ ID NO: 62879 - DNA, 25 bp, Homo sapien
gaaataccacctggtccctgctgcc

SEQ ID NO: 62880 - DNA, 25 bp, Homo sapien
gaaataccattgcttgcatgtcaaa

SEQ ID NO: 62881 - DNA, 25 bp, Homo sapien
gaaataccattgtttgcatgtcaaa

SEQ ID NO: 62882 - DNA, 25 bp, Homo sapien
gaaataccgcctggtccctgctgcc

SEQ ID NO: 62883 - DNA, 25 bp, Homo sapien
gaaatacctcaatccttatgcttca

SEQ ID NO: 62884 - DNA, 25 bp, Homo sapien
gaaatacctcaattcttatgcttca

SEQ ID NO: 62885 - DNA, 25 bp, Homo sapien
gaaatacctgcacgtcatttctact

SEQ ID NO: 62886 - DNA, 25 bp, Homo sapien
gaaatacctgcccgtcatttctact

SEQ ID NO: 62887 - DNA, 25 bp, Homo sapien
gaaatagaaaaaactgaattgccat

SEQ ID NO: 62888 - DNA, 25 bp, Homo sapien
gaaatagaaaaaattgaattgccat

SEQ ID NO: 62889 - DNA, 25 bp, Homo sapien
gaaatagaaggtacgtggattagaa

SEQ ID NO: 62890 - DNA, 25 bp, Homo sapien
gaaatagaaggtatgtggattagaa

SEQ ID NO: 62891 - DNA, 25 bp, Homo sapien
gaaatagacatcaaccatttgagca

SEQ ID NO: 62892 - DNA, 25 bp, Homo sapien
gaaatagacatcaagcatttgagca

SEQ ID NO: 62893 - DNA, 25 bp, Homo sapien
gaaatagataactagataaacaaag

SEQ ID NO: 62894 - DNA, 25 bp, Homo sapien
gaaatagataactggataaacaaag

SEQ ID NO: 62895 - DNA, 25 bp, Homo sapien
gaaatagcaatacgtatctgtacac

SEQ ID NO: 62896 - DNA, 25 bp, Homo sapien
gaaatagcaatatgtatctgtacac

SEQ ID NO: 62897 - DNA, 25 bp, Homo sapien
gaaatagcacggtgagtaagaaata

SEQ ID NO: 62898 - DNA, 25 bp, Homo sapien
gaaatagcacgtatggctcccaggc

SEQ ID NO: 62899 - DNA, 25 bp, Homo sapien
gaaatagcacgtgtggctcccaggc

SEQ ID NO: 62900 - DNA, 25 bp, Homo sapien
gaaatagcatggtgagtaagaaata

SEQ ID NO: 62901 - DNA, 25 bp, Homo sapien
gaaatagccaacccacactaaagca

SEQ ID NO: 62902 - DNA, 25 bp, Homo sapien
gaaatagccaactcacactaaagca

SEQ ID NO: 62903 - DNA, 25 bp, Homo sapien
gaaatagcctatcaccctggtacac

SEQ ID NO: 62904 - DNA, 25 bp, Homo sapien
gaaatagcgtatcaccctggtacac

SEQ ID NO: 62905 - DNA, 25 bp, Homo sapien
gaaatagctgcaaagttacaaatta

SEQ ID NO: 62906 - DNA, 25 bp, Homo sapien
gaaatagctgcatagttacaaatta

SEQ ID NO: 62907 - DNA, 25 bp, Homo sapien
gaaatagctgctcctccagaaaccg

SEQ ID NO: 62908 - DNA, 25 bp, Homo sapien
gaaatagcttcaatacagtccagag

SEQ ID NO: 62909 - DNA, 25 bp, Homo sapien
gaaatagcttcagtacagtccagag

SEQ ID NO: 62910 - DNA, 25 bp, Homo sapien
gaaatagcttctcctccagaaaccg

SEQ ID NO: 62911 - DNA, 25 bp, Homo sapien
gaaatataattgctaaatatggttt

SEQ ID NO: 62912 - DNA, 25 bp, Homo sapien
gaaatataattgttaaatatggttt

SEQ ID NO: 62913 - DNA, 25 bp, Homo sapien
gaaatatacagctgcaaatgccttt

SEQ ID NO: 62914 - DNA, 25 bp, Homo sapien
gaaatataggaaaacaactaaggtc

SEQ ID NO: 62915 - DNA, 25 bp, Homo sapien
gaaatataggaagacaactaaggtc

SEQ ID NO: 62916 - DNA, 25 bp, Homo sapien
gaaatatatagctgcaaatgccttt

SEQ ID NO: 62917 - DNA, 25 bp, Homo sapien
gaaatatcaccacctaagaaaggca

SEQ ID NO: 62918 - DNA, 25 bp, Homo sapien
gaaatatcaccacctacgaaaggca

SEQ ID NO: 62919 - DNA, 25 bp, Homo sapien
gaaatatcgccggccccagtcttaa

SEQ ID NO: 62920 - DNA, 25 bp, Homo sapien
gaaatatcgcctgccccagtcttaa

SEQ ID NO: 62921 - DNA, 25 bp, Homo sapien
gaaatatctcacagcatgattttat

SEQ ID NO: 62922 - DNA, 25 bp, Homo sapien
gaaatatctcacagtatgattttat

SEQ ID NO: 62923 - DNA, 25 bp, Homo sapien
gaaatatctcatgcgtagtatgtaa

SEQ ID NO: 62924 - DNA, 25 bp, Homo sapien
gaaatatctcatgtgtagtatgtaa

SEQ ID NO: 62925 - DNA, 25 bp, Homo sapien
gaaatatgattgcatcagacaatgg

SEQ ID NO: 62926 - DNA, 25 bp, Homo sapien
gaaatatggagtacacattctgctg

SEQ ID NO: 62927 - DNA, 25 bp, Homo sapien
gaaatatggagtatacattctgctg

SEQ ID NO: 62928 - DNA, 25 bp, Homo sapien
gaaatatgtttgcatcagacaatgg

SEQ ID NO: 62929 - DNA, 25 bp, Homo sapien
gaaatcaaacagaagtgtctatgct

SEQ ID NO: 62930 - DNA, 25 bp, Homo sapien
gaaatcaagcagaagtgtctatgct

SEQ ID NO: 62931 - DNA, 25 bp, Homo sapien
gaaatcaaggtgtaaagagggccct

SEQ ID NO: 62932 - DNA, 25 bp, Homo sapien
gaaatcaatgtgtaaagagggccct

SEQ ID NO: 62933 - DNA, 25 bp, Homo sapien
gaaatcacatctgatacagaagctg

SEQ ID NO: 62934 - DNA, 25 bp, Homo sapien
gaaatcacatctggtacagaagctg

SEQ ID NO: 62935 - DNA, 25 bp, Homo sapien
gaaatcagaaatgagcaggcttggt

SEQ ID NO: 62936 - DNA, 25 bp, Homo sapien
gaaatcagaaatgtgcaggcttggt

SEQ ID NO: 62937 - DNA, 25 bp, Homo sapien
gaaatcaggctacggttccagctac

SEQ ID NO: 62938 - DNA, 25 bp, Homo sapien
gaaatcaggctatggttccagctac

SEQ ID NO: 62939 - DNA, 25 bp, Homo sapien
gaaatcagtaacaaagcctatatgt

SEQ ID NO: 62940 - DNA, 25 bp, Homo sapien
gaaatcagtaaccaagcctatatgt

SEQ ID NO: 62941 - DNA, 25 bp, Homo sapien
gaaatcctgcgccatttaattgagt

SEQ ID NO: 62942 - DNA, 25 bp, Homo sapien
gaaatcctgcgccttttaattgagt

SEQ ID NO: 62943 - DNA, 25 bp, Homo sapien
gaaatcctgtttacttcactcaggc

SEQ ID NO: 62944 - DNA, 25 bp, Homo sapien
gaaatcctgttttcttcactcaggc

SEQ ID NO: 62945 - DNA, 25 bp, Homo sapien
gaaatcgggaatacaatgataagta

SEQ ID NO: 62946 - DNA, 25 bp, Homo sapien
gaaatcggggatacaatgataagta

SEQ ID NO: 62947 - DNA, 25 bp, Homo sapien
gaaatcgtcctcaatgaaaaacctt

SEQ ID NO: 62948 - DNA, 25 bp, Homo sapien
gaaatcgtcctcagtgaaaaacctt

SEQ ID NO: 62949 - DNA, 25 bp, Homo sapien
gaaatctacgcacttgtccaaagtg

SEQ ID NO: 62950 - DNA, 25 bp, Homo sapien
gaaatctacgctgccgcttacagca

SEQ ID NO: 62951 - DNA, 25 bp, Homo sapien
gaaatctactctgccgcttacagca

SEQ ID NO: 62952 - DNA, 25 bp, Homo sapien
gaaatctatcctatggtctactttg

SEQ ID NO: 62953 - DNA, 25 bp, Homo sapien
gaaatctatgcacttgtccaaagtg

SEQ ID NO: 62954 - DNA, 25 bp, Homo sapien
gaaatctatgctatggtctactttg

SEQ ID NO: 62955 - DNA, 25 bp, Homo sapien
gaaatctcaacctaggagcaggttg

SEQ ID NO: 62956 - DNA, 25 bp, Homo sapien
gaaatctcaacgtaggagcaggttg

SEQ ID NO: 62957 - DNA, 25 bp, Homo sapien
gaaatctccaaattttatctgtcct

SEQ ID NO: 62958 - DNA, 25 bp, Homo sapien
gaaatctccacttatctcttaactt

SEQ ID NO: 62959 - DNA, 25 bp, Homo sapien
gaaatctccgaattttatctgtcct

SEQ ID NO: 62960 - DNA, 25 bp, Homo sapien
gaaatctccgcttatctcttaactt

SEQ ID NO: 62961 - DNA, 25 bp, Homo sapien
gaaatctgtacctgcattatactgg

SEQ ID NO: 62962 - DNA, 25 bp, Homo sapien
gaaatctgtacttgcattatactgg

SEQ ID NO: 62963 - DNA, 25 bp, Homo sapien
gaaatcttacgcgtactcagtttga

SEQ ID NO: 62964 - DNA, 25 bp, Homo sapien
gaaatcttacgtgtactcagtttga

SEQ ID NO: 62965 - DNA, 25 bp, Homo sapien
gaaatcttatacccactagctgtca

SEQ ID NO: 62966 - DNA, 25 bp, Homo sapien
gaaatcttatactcactagctgtca

SEQ ID NO: 62967 - DNA, 25 bp, Homo sapien
gaaatcttcaaaatgacaaggccat

SEQ ID NO: 62968 - DNA, 25 bp, Homo sapien
gaaatcttcaaagtgacaaggccat

SEQ ID NO: 62969 - DNA, 25 bp, Homo sapien
gaaatcttgacatactggattggaa

SEQ ID NO: 62970 - DNA, 25 bp, Homo sapien
gaaatcttgacatattggattggaa

SEQ ID NO: 62971 - DNA, 25 bp, Homo sapien
gaaatgaacctgcaggaaaaacagt

SEQ ID NO: 62972 - DNA, 25 bp, Homo sapien
gaaatgaacgtgcaggaaaaacagt

SEQ ID NO: 62973 - DNA, 25 bp, Homo sapien
gaaatgaagaagctgcataatgatg

SEQ ID NO: 62974 - DNA, 25 bp, Homo sapien
gaaatgaagaagttgcataatgatg

SEQ ID NO: 62975 - DNA, 25 bp, Homo sapien
gaaatgaatagagagtgcgttgagt

SEQ ID NO: 62976 - DNA, 25 bp, Homo sapien
gaaatgaatagatagtgcgttgagt

SEQ ID NO: 62977 - DNA, 25 bp, Homo sapien
gaaatgacaaccaaggctttagaat

SEQ ID NO: 62978 - DNA, 25 bp, Homo sapien
gaaatgaccatagaaattagccttg

SEQ ID NO: 62979 - DNA, 25 bp, Homo sapien
gaaatgacccaaaagataagagggt

SEQ ID NO: 62980 - DNA, 25 bp, Homo sapien
gaaatgaccgaaaagataagagggt

SEQ ID NO: 62981 - DNA, 25 bp, Homo sapien
gaaatgaccgtagaaattagccttg

SEQ ID NO: 62982 - DNA, 25 bp, Homo sapien
gaaatgacgaccaaggctttagaat

SEQ ID NO: 62983 - DNA, 25 bp, Homo sapien
gaaatgactcaaacaaagttaaata

SEQ ID NO: 62984 - DNA, 25 bp, Homo sapien
gaaatgactcaaagaaagttaaata

SEQ ID NO: 62985 - DNA, 25 bp, Homo sapien
gaaatgaggtcaccaagtgatggat

SEQ ID NO: 62986 - DNA, 25 bp, Homo sapien
gaaatgaggtcgccaagtgatggat

SEQ ID NO: 62987 - DNA, 25 bp, Homo sapien
gaaatgagtaggtactgctaaaaca

SEQ ID NO: 62988 - DNA, 25 bp, Homo sapien
gaaatgagtgggtactgctaaaaca

SEQ ID NO: 62989 - DNA, 25 bp, Homo sapien
gaaatgatattcaccgccgactgcc

SEQ ID NO: 62990 - DNA, 25 bp, Homo sapien
gaaatgatattcgccgccgactgcc

SEQ ID NO: 62991 - DNA, 25 bp, Homo sapien
gaaatgatcaggctaaatcgccagg

SEQ ID NO: 62992 - DNA, 25 bp, Homo sapien
gaaatgatcaggttaaatcgccagg

SEQ ID NO: 62993 - DNA, 25 bp, Homo sapien
gaaatgatcgactagagtactgaga

SEQ ID NO: 62994 - DNA, 25 bp, Homo sapien
gaaatgatgttggtatcactactta

SEQ ID NO: 62995 - DNA, 25 bp, Homo sapien
gaaatgatgtttgtatcactactta

SEQ ID NO: 62996 - DNA, 25 bp, Homo sapien
gaaatgattgactagagtactgaga

SEQ ID NO: 62997 - DNA, 25 bp, Homo sapien
gaaatgcaacctattttctgggttc

SEQ ID NO: 62998 - DNA, 25 bp, Homo sapien
gaaatgcaacctcttttctgggttc

SEQ ID NO: 62999 - DNA, 25 bp, Homo sapien
gaaatgcaagatttatgagtcatga

SEQ ID NO: 63000 - DNA, 25 bp, Homo sapien
gaaatgcaagatttgtgagtcatga

SEQ ID NO: 63001 - DNA, 25 bp, Homo sapien
gaaatgcacatcacaaagacatacc

SEQ ID NO: 63002 - DNA, 25 bp, Homo sapien
gaaatgcacattacaaagacatacc

SEQ ID NO: 63003 - DNA, 25 bp, Homo sapien
gaaatgcagtaggtagtctctttct

SEQ ID NO: 63004 - DNA, 25 bp, Homo sapien
gaaatgcagtaggtggtctctttct

SEQ ID NO: 63005 - DNA, 25 bp, Homo sapien
gaaatgccaaatatgctggagtccc

SEQ ID NO: 63006 - DNA, 25 bp, Homo sapien
gaaatgccaaatctgctggagtccc

SEQ ID NO: 63007 - DNA, 25 bp, Homo sapien
gaaatgcccttctgcatatagccat

SEQ ID NO: 63008 - DNA, 25 bp, Homo sapien
gaaatgcccttttgcatatagccat

SEQ ID NO: 63009 - DNA, 25 bp, Homo sapien
gaaatgcctattagatagttgtgga

SEQ ID NO: 63010 - DNA, 25 bp, Homo sapien
gaaatgcctattatatagttgtgga

SEQ ID NO: 63011 - DNA, 25 bp, Homo sapien
gaaatgcctccatagagtcctttca

SEQ ID NO: 63012 - DNA, 25 bp, Homo sapien
gaaatgccttcatagagtcctttca

SEQ ID NO: 63013 - DNA, 25 bp, Homo sapien
gaaatgctatgagcataaatcaccc

SEQ ID NO: 63014 - DNA, 25 bp, Homo sapien
gaaatgctgtgagcataaatcaccc

SEQ ID NO: 63015 - DNA, 25 bp, Homo sapien
gaaatgcttcttactgatcatgtga

SEQ ID NO: 63016 - DNA, 25 bp, Homo sapien
gaaatgcttcttattgatcatgtga

SEQ ID NO: 63017 - DNA, 25 bp, Homo sapien
gaaatggagaagaaatgagactgag

SEQ ID NO: 63018 - DNA, 25 bp, Homo sapien
gaaatggagaaggaatgagactgag

SEQ ID NO: 63019 - DNA, 25 bp, Homo sapien
gaaatggagaagtgttaatcttatg

SEQ ID NO: 63020 - DNA, 25 bp, Homo sapien
gaaatggagctgtcctctgacctac

SEQ ID NO: 63021 - DNA, 25 bp, Homo sapien
gaaatggagctgtcttctgacctac

SEQ ID NO: 63022 - DNA, 25 bp, Homo sapien
gaaatggagtagtgttaatcttatg

SEQ ID NO: 63023 - DNA, 25 bp, Homo sapien
gaaatgggcttaaatctgcatttga

SEQ ID NO: 63024 - DNA, 25 bp, Homo sapien
gaaatggggacaaaaatgcactctg

SEQ ID NO: 63025 - DNA, 25 bp, Homo sapien
gaaatggggacagaaatgcactctg

SEQ ID NO: 63026 - DNA, 25 bp, Homo sapien
gaaatgggtctttcgcgaagcccaa

SEQ ID NO: 63027 - DNA, 25 bp, Homo sapien
gaaatgggtcttttgcgaagcccaa

SEQ ID NO: 63028 - DNA, 25 bp, Homo sapien
gaaatgggtttaaatctgcatttga

SEQ ID NO: 63029 - DNA, 25 bp, Homo sapien
gaaatggtgccagcaaaagagaagg

SEQ ID NO: 63030 - DNA, 25 bp, Homo sapien
gaaatggtgccagcgaaagagaagg

SEQ ID NO: 63031 - DNA, 25 bp, Homo sapien
gaaatgtatgtgtaataattcatgt

SEQ ID NO: 63032 - DNA, 25 bp, Homo sapien
gaaatgtatgtgtagtaattcatgt

SEQ ID NO: 63033 - DNA, 25 bp, Homo sapien
gaaatgtcagtaccagtttatgaca

SEQ ID NO: 63034 - DNA, 25 bp, Homo sapien
gaaatgtcagtacctgtttatgaca

SEQ ID NO: 63035 - DNA, 25 bp, Homo sapien
gaaatgtcattatgtggtatgtgac

SEQ ID NO: 63036 - DNA, 25 bp, Homo sapien
gaaatgtccaaggattgccatttat

SEQ ID NO: 63037 - DNA, 25 bp, Homo sapien
gaaatgtccaagggttgccatttat

SEQ ID NO: 63038 - DNA, 25 bp, Homo sapien
gaaatgtcgttatgtggtatgtgac

SEQ ID NO: 63039 - DNA, 25 bp, Homo sapien
gaaatgtctgtatcaaccaagacat

SEQ ID NO: 63040 - DNA, 25 bp, Homo sapien
gaaatgtctgtatccaccaagacat

SEQ ID NO: 63041 - DNA, 25 bp, Homo sapien
gaaatgtgaggaaaggatgcatttg

SEQ ID NO: 63042 - DNA, 25 bp, Homo sapien
gaaatgtgaggaagggatgcatttg

SEQ ID NO: 63043 - DNA, 25 bp, Homo sapien
gaaatgtgaggttgaagtccccaca

SEQ ID NO: 63044 - DNA, 25 bp, Homo sapien
gaaatgtgaggtttaagtccccaca

SEQ ID NO: 63045 - DNA, 25 bp, Homo sapien
gaaatgtgcttgcagagaggaaaga

SEQ ID NO: 63046 - DNA, 25 bp, Homo sapien
gaaatgtgcttgcatagaggaaaga

SEQ ID NO: 63047 - DNA, 25 bp, Homo sapien
gaaatgtgtttaacttgaattgctc

SEQ ID NO: 63048 - DNA, 25 bp, Homo sapien
gaaatgtgtttatcttgaattgctc

SEQ ID NO: 63049 - DNA, 25 bp, Homo sapien
gaaatgttacaaaatatagaccact

SEQ ID NO: 63050 - DNA, 25 bp, Homo sapien
gaaatgttagaaaatatagaccact

SEQ ID NO: 63051 - DNA, 25 bp, Homo sapien
gaaatgttctgtatttgcactatcc

SEQ ID NO: 63052 - DNA, 25 bp, Homo sapien
gaaatgttttgtatttgcactatcc

SEQ ID NO: 63053 - DNA, 25 bp, Homo sapien
gaaatgtttttgcatatggcttcca

SEQ ID NO: 63054 - DNA, 25 bp, Homo sapien
gaaatgtttttgcgtatggcttcca

SEQ ID NO: 63055 - DNA, 25 bp, Homo sapien
gaaattaaaacactgatgagacctt

SEQ ID NO: 63056 - DNA, 25 bp, Homo sapien
gaaattaaaacattgatgagacctt

SEQ ID NO: 63057 - DNA, 25 bp, Homo sapien
gaaattaaatgatatataggatttg

SEQ ID NO: 63058 - DNA, 25 bp, Homo sapien
gaaattaaatgatgtataggatttg

SEQ ID NO: 63059 - DNA, 25 bp, Homo sapien
gaaattaaccaaccctggatattag

SEQ ID NO: 63060 - DNA, 25 bp, Homo sapien
gaaattaaccaaccgtggatattag

SEQ ID NO: 63061 - DNA, 25 bp, Homo sapien
gaaattaactctccttgcttatctt

SEQ ID NO: 63062 - DNA, 25 bp, Homo sapien
gaaattaactcttcttgcttatctt

SEQ ID NO: 63063 - DNA, 25 bp, Homo sapien
gaaattaatactagtctaaatagat

SEQ ID NO: 63064 - DNA, 25 bp, Homo sapien
gaaattaatacttgtctaaatagat

SEQ ID NO: 63065 - DNA, 25 bp, Homo sapien
gaaattagaatccctgtcctagttc

SEQ ID NO: 63066 - DNA, 25 bp, Homo sapien
gaaattagagtccctgtcctagttc

SEQ ID NO: 63067 - DNA, 25 bp, Homo sapien
gaaattagctttcttacctgaaaat

SEQ ID NO: 63068 - DNA, 25 bp, Homo sapien
gaaattagctttcttatctgaaaat

SEQ ID NO: 63069 - DNA, 25 bp, Homo sapien
gaaattcaacaggtgaaattagcat

SEQ ID NO: 63070 - DNA, 25 bp, Homo sapien
gaaattcaagactagagacgaggtc

SEQ ID NO: 63071 - DNA, 25 bp, Homo sapien
gaaattcaagaggtgaaattagcat

SEQ ID NO: 63072 - DNA, 25 bp, Homo sapien
gaaattcacaaagggtacaatacat

SEQ ID NO: 63073 - DNA, 25 bp, Homo sapien
gaaattcacaaggggtacaatacat

SEQ ID NO: 63074 - DNA, 25 bp, Homo sapien
gaaattcacgactagagacgaggtc

SEQ ID NO: 63075 - DNA, 25 bp, Homo sapien
gaaattcataacacacaaatgtaag

SEQ ID NO: 63076 - DNA, 25 bp, Homo sapien
gaaattcataacacgcaaatgtaag

SEQ ID NO: 63077 - DNA, 25 bp, Homo sapien
gaaattccacccaccaaggagaagc

SEQ ID NO: 63078 - DNA, 25 bp, Homo sapien
gaaattccacccgccaaggagaagc

SEQ ID NO: 63079 - DNA, 25 bp, Homo sapien
gaaattcgttgactcgtactgtgct

SEQ ID NO: 63080 - DNA, 25 bp, Homo sapien
gaaattcgttgtctcgtactgtgct

SEQ ID NO: 63081 - DNA, 25 bp, Homo sapien
gaaattctcattaaagtcaagacta

SEQ ID NO: 63082 - DNA, 25 bp, Homo sapien
gaaattctcattacagtcaagacta

SEQ ID NO: 63083 - DNA, 25 bp, Homo sapien
gaaattcttcataaacctgacctgg

SEQ ID NO: 63084 - DNA, 25 bp, Homo sapien
gaaattcttcataaacgtgacctgg

SEQ ID NO: 63085 - DNA, 25 bp, Homo sapien
gaaattgatggcctcaaaagatagt

SEQ ID NO: 63086 - DNA, 25 bp, Homo sapien
gaaattgatggtctcaaaagatagt

SEQ ID NO: 63087 - DNA, 25 bp, Homo sapien
gaaattgcagccacattccaggaag

SEQ ID NO: 63088 - DNA, 25 bp, Homo sapien
gaaattgcagccatattccaggaag

SEQ ID NO: 63089 - DNA, 25 bp, Homo sapien
gaaattgctttgcagcagtcttcat

SEQ ID NO: 63090 - DNA, 25 bp, Homo sapien
gaaattgctttgcagcggtcttcat

SEQ ID NO: 63091 - DNA, 25 bp, Homo sapien
gaaattggcatgaggagtctataga

SEQ ID NO: 63092 - DNA, 25 bp, Homo sapien
gaaattgggatcatcaaaggagaga

SEQ ID NO: 63093 - DNA, 25 bp, Homo sapien
gaaattgggatcattaaaggagaga

SEQ ID NO: 63094 - DNA, 25 bp, Homo sapien
gaaattggtaaagatacattaatac

SEQ ID NO: 63095 - DNA, 25 bp, Homo sapien
gaaattggtatgaggagtctataga

SEQ ID NO: 63096 - DNA, 25 bp, Homo sapien
gaaattggtgaagatacattaatac

SEQ ID NO: 63097 - DNA, 25 bp, Homo sapien
gaaattgtccagacttggctaaaga

SEQ ID NO: 63098 - DNA, 25 bp, Homo sapien
gaaattgtccagatttggctaaaga

SEQ ID NO: 63099 - DNA, 25 bp, Homo sapien
gaaattgtgaatgcatagaaattaa

SEQ ID NO: 63100 - DNA, 25 bp, Homo sapien
gaaattgtgaatgcgtagaaattaa

SEQ ID NO: 63101 - DNA, 25 bp, Homo sapien
gaaatttaattttcacatcacagta

SEQ ID NO: 63102 - DNA, 25 bp, Homo sapien
gaaatttaattttcacgtcacagta

SEQ ID NO: 63103 - DNA, 25 bp, Homo sapien
gaaatttcagaaagagaaccacact

SEQ ID NO: 63104 - DNA, 25 bp, Homo sapien
gaaatttcagaaggagaaccacact

SEQ ID NO: 63105 - DNA, 25 bp, Homo sapien
gaaatttcccagaacaaaagacaga

SEQ ID NO: 63106 - DNA, 25 bp, Homo sapien
gaaatttcccataacaaaagacaga

SEQ ID NO: 63107 - DNA, 25 bp, Homo sapien
gaaatttcctgggcgatagaagcat

SEQ ID NO: 63108 - DNA, 25 bp, Homo sapien
gaaatttcctgggtgatagaagcat

SEQ ID NO: 63109 - DNA, 25 bp, Homo sapien
gaaatttgaccactaatgcaataat

SEQ ID NO: 63110 - DNA, 25 bp, Homo sapien
gaaatttgatcactaatgcaataat

SEQ ID NO: 63111 - DNA, 25 bp, Homo sapien
gaaatttgtcgtagtctggaactat

SEQ ID NO: 63112 - DNA, 25 bp, Homo sapien
gaaatttgtcgtcgtctggaactat

SEQ ID NO: 63113 - DNA, 25 bp, Homo sapien
gaaattttatctcctttgagcaaca

SEQ ID NO: 63114 - DNA, 25 bp, Homo sapien
gaaattttatctgctttgagcaaca

SEQ ID NO: 63115 - DNA, 25 bp, Homo sapien
gaaattttgacacagagctacatac

SEQ ID NO: 63116 - DNA, 25 bp, Homo sapien
gaaattttgacacggagctacatac

SEQ ID NO: 63117 - DNA, 25 bp, Homo sapien
gaaattttgcaggcatactggagga

SEQ ID NO: 63118 - DNA, 25 bp, Homo sapien
gaaattttgcagtcatactggagga

SEQ ID NO: 63119 - DNA, 25 bp, Homo sapien
gaaatttttaggcttattactttca

SEQ ID NO: 63120 - DNA, 25 bp, Homo sapien
gaaatttttaggtttattactttca

SEQ ID NO: 63121 - DNA, 25 bp, Homo sapien
gaacaaaaaaaaaaagggaatgagg

SEQ ID NO: 63122 - DNA, 25 bp, Homo sapien
gaacaaaaaaaaaaggggaatgagg

SEQ ID NO: 63123 - DNA, 25 bp, Homo sapien
gaacaaaaacagagaaaaggcaaat

SEQ ID NO: 63124 - DNA, 25 bp, Homo sapien
gaacaaaaacagtgccatgttactc

SEQ ID NO: 63125 - DNA, 25 bp, Homo sapien
gaacaaaaacagtgccgtgttactc

SEQ ID NO: 63126 - DNA, 25 bp, Homo sapien
gaacaaaaatagagaaaaggcaaat

SEQ ID NO: 63127 - DNA, 25 bp, Homo sapien
gaacaaaattaaccctgtgtgtatt

SEQ ID NO: 63128 - DNA, 25 bp, Homo sapien
gaacaaaattaactctgtgtgtatt

SEQ ID NO: 63129 - DNA, 25 bp, Homo sapien
gaacaaaggagcttcaatgaataaa

SEQ ID NO: 63130 - DNA, 25 bp, Homo sapien
gaacaaaggagcttcagtgaataaa

SEQ ID NO: 63131 - DNA, 25 bp, Homo sapien
gaacaaataacccaagtttacaaga

SEQ ID NO: 63132 - DNA, 25 bp, Homo sapien
gaacaaatgaaaaatatgtttccca

SEQ ID NO: 63133 - DNA, 25 bp, Homo sapien
gaacaaatgcagcgaaatgttaatt

SEQ ID NO: 63134 - DNA, 25 bp, Homo sapien
gaacaaatgcagtgaaatgttaatt

SEQ ID NO: 63135 - DNA, 25 bp, Homo sapien
gaacaaatggaaaatatgtttccca

SEQ ID NO: 63136 - DNA, 25 bp, Homo sapien
gaacaaattacccaagtttacaaga

SEQ ID NO: 63137 - DNA, 25 bp, Homo sapien
gaacaacttaatatccataagcaaa

SEQ ID NO: 63138 - DNA, 25 bp, Homo sapien
gaacaacttaatatccgtaagcaaa

SEQ ID NO: 63139 - DNA, 25 bp, Homo sapien
gaacaacttcctccacagtaactga

SEQ ID NO: 63140 - DNA, 25 bp, Homo sapien
gaacaacttcctccgcagtaactga

SEQ ID NO: 63141 - DNA, 25 bp, Homo sapien
gaacaagataagttgagattaaaca

SEQ ID NO: 63142 - DNA, 25 bp, Homo sapien
gaacaagatcaataaccagtgtgat

SEQ ID NO: 63143 - DNA, 25 bp, Homo sapien
gaacaagatcaatagccagtgtgat

SEQ ID NO: 63144 - DNA, 25 bp, Homo sapien
gaacaagatgagttgagattaaaca

SEQ ID NO: 63145 - DNA, 25 bp, Homo sapien
gaacaagatgtctgcacctgccctg

SEQ ID NO: 63146 - DNA, 25 bp, Homo sapien
gaacaagatgtctggacctgccctg

SEQ ID NO: 63147 - DNA, 25 bp, Homo sapien
gaacaagcacttaacaaaattcaac

SEQ ID NO: 63148 - DNA, 25 bp, Homo sapien
gaacaagcacttaataaaattcaac

SEQ ID NO: 63149 - DNA, 25 bp, Homo sapien
gaacaaggatcctcaacattgtact

SEQ ID NO: 63150 - DNA, 25 bp, Homo sapien
gaacaaggatcctcaatattgtact

SEQ ID NO: 63151 - DNA, 25 bp, Homo sapien
gaacaataacagcaacggcggctgc

SEQ ID NO: 63152 - DNA, 25 bp, Homo sapien
gaacaataacagcaactgcggctgc

SEQ ID NO: 63153 - DNA, 25 bp, Homo sapien
gaacaatctaaaatagtcatgttct

SEQ ID NO: 63154 - DNA, 25 bp, Homo sapien
gaacaatctaaactagtcatgttct

SEQ ID NO: 63155 - DNA, 25 bp, Homo sapien
gaacaatgggaacaagcgagacaga

SEQ ID NO: 63156 - DNA, 25 bp, Homo sapien
gaacaatgggaacaagtgagacaga

SEQ ID NO: 63157 - DNA, 25 bp, Homo sapien
gaacaatgtcaaataacaatgatga

SEQ ID NO: 63158 - DNA, 25 bp, Homo sapien
gaacaatgtcaagtaacaatgatga

SEQ ID NO: 63159 - DNA, 25 bp, Homo sapien
gaacacaaaatgcagatgtgggact

SEQ ID NO: 63160 - DNA, 25 bp, Homo sapien
gaacacaaaatgctgatgtgggact

SEQ ID NO: 63161 - DNA, 25 bp, Homo sapien
gaacacaactttgaatcgttatata

SEQ ID NO: 63162 - DNA, 25 bp, Homo sapien
gaacacaactttgaatggttatata

SEQ ID NO: 63163 - DNA, 25 bp, Homo sapien
gaacacaattgaatcttattctgcc

SEQ ID NO: 63164 - DNA, 25 bp, Homo sapien
gaacacaattggatcttattctgcc

SEQ ID NO: 63165 - DNA, 25 bp, Homo sapien
gaacacagactcagctcaacatgga

SEQ ID NO: 63166 - DNA, 25 bp, Homo sapien
gaacacagattcagctcaacatgga

SEQ ID NO: 63167 - DNA, 25 bp, Homo sapien
gaacacagtgacacgtttctgagtg

SEQ ID NO: 63168 - DNA, 25 bp, Homo sapien
gaacacagtgacacttttctgagtg

SEQ ID NO: 63169 - DNA, 25 bp, Homo sapien
gaacacagttggataccaatacagc

SEQ ID NO: 63170 - DNA, 25 bp, Homo sapien
gaacacagttggatgccaatacagc

SEQ ID NO: 63171 - DNA, 25 bp, Homo sapien
gaacacagtttgaacagttggtcac

SEQ ID NO: 63172 - DNA, 25 bp, Homo sapien
gaacacagtttgaagagttggtcac

SEQ ID NO: 63173 - DNA, 25 bp, Homo sapien
gaacacatcgacaacaggggagccc

SEQ ID NO: 63174 - DNA, 25 bp, Homo sapien
gaacacatcgacgacaggggagccc

SEQ ID NO: 63175 - DNA, 25 bp, Homo sapien
gaacacatgtgtctaatcttagcta

SEQ ID NO: 63176 - DNA, 25 bp, Homo sapien
gaacacatgtgtctgatcttagcta

SEQ ID NO: 63177 - DNA, 25 bp, Homo sapien
gaacacattttcaactggctgccaa

SEQ ID NO: 63178 - DNA, 25 bp, Homo sapien
gaacacatttttaactggctgccaa

SEQ ID NO: 63179 - DNA, 25 bp, Homo sapien
gaacaccaaagaaagaaaaaatctt

SEQ ID NO: 63180 - DNA, 25 bp, Homo sapien
gaacaccaaagaaagagaaaatctt

SEQ ID NO: 63181 - DNA, 25 bp, Homo sapien
gaacaccaagcaccatgtgttctca

SEQ ID NO: 63182 - DNA, 25 bp, Homo sapien
gaacaccaagcaccgtgtgttctca

SEQ ID NO: 63183 - DNA, 25 bp, Homo sapien
gaacaccctgagagcattttgagtg

SEQ ID NO: 63184 - DNA, 25 bp, Homo sapien
gaacaccctgagtgcattttgagtg

SEQ ID NO: 63185 - DNA, 25 bp, Homo sapien
gaacactcagctcaaagtccattgc

SEQ ID NO: 63186 - DNA, 25 bp, Homo sapien
gaacactcggctcaaagtccattgc

SEQ ID NO: 63187 - DNA, 25 bp, Homo sapien
gaacactgcaacatatttcttctat

SEQ ID NO: 63188 - DNA, 25 bp, Homo sapien
gaacactggaacatatttcttctat

SEQ ID NO: 63189 - DNA, 25 bp, Homo sapien
gaacactgtgaaacgctgccaagaa

SEQ ID NO: 63190 - DNA, 25 bp, Homo sapien
gaacactgtgaaatgctgccaagaa

SEQ ID NO: 63191 - DNA, 25 bp, Homo sapien
gaacactttggaacactgtggaaag

SEQ ID NO: 63192 - DNA, 25 bp, Homo sapien
gaacactttggaactctgtggaaag

SEQ ID NO: 63193 - DNA, 25 bp, Homo sapien
gaacagaagtgaaaatgatatgtag

SEQ ID NO: 63194 - DNA, 25 bp, Homo sapien
gaacagaagtgaaaattatatgtag

SEQ ID NO: 63195 - DNA, 25 bp, Homo sapien
gaacagacagtatctatcaacaggg

SEQ ID NO: 63196 - DNA, 25 bp, Homo sapien
gaacagacagtatttatcaacaggg

SEQ ID NO: 63197 - DNA, 25 bp, Homo sapien
gaacagagagacagtcgtctgtgag

SEQ ID NO: 63198 - DNA, 25 bp, Homo sapien
gaacagagatacagtcgtctgtgag

SEQ ID NO: 63199 - DNA, 25 bp, Homo sapien
gaacagagattagatcaccaatatt

SEQ ID NO: 63200 - DNA, 25 bp, Homo sapien
gaacagagattagttcaccaatatt

SEQ ID NO: 63201 - DNA, 25 bp, Homo sapien
gaacagatgcccaaaaacagtcttc

SEQ ID NO: 63202 - DNA, 25 bp, Homo sapien
gaacagatgtccaaaaacagtcttc

SEQ ID NO: 63203 - DNA, 25 bp, Homo sapien
gaacagcaacaatttgaaaaatctg

SEQ ID NO: 63204 - DNA, 25 bp, Homo sapien
gaacagcaacaatttgcaaaatctg

SEQ ID NO: 63205 - DNA, 25 bp, Homo sapien
gaacagcaatgcatgtggtggtgta

SEQ ID NO: 63206 - DNA, 25 bp, Homo sapien
gaacagcaatgcgtgtggtggtgta

SEQ ID NO: 63207 - DNA, 25 bp, Homo sapien
gaacagcagctgtggaactcagaga

SEQ ID NO: 63208 - DNA, 25 bp, Homo sapien
gaacagcagttgtggaactcagaga

SEQ ID NO: 63209 - DNA, 25 bp, Homo sapien
gaacaggagtacccaggaacatgac

SEQ ID NO: 63210 - DNA, 25 bp, Homo sapien
gaacaggattacccaggaacatgac

SEQ ID NO: 63211 - DNA, 25 bp, Homo sapien
gaacaggtgataggtcctttctctt

SEQ ID NO: 63212 - DNA, 25 bp, Homo sapien
gaacaggtgttaggtcctttctctt

SEQ ID NO: 63213 - DNA, 25 bp, Homo sapien
gaacagtaaatacaaataccctaag

SEQ ID NO: 63214 - DNA, 25 bp, Homo sapien
gaacagtaaataccaataccctaag

SEQ ID NO: 63215 - DNA, 25 bp, Homo sapien
gaacagtacggcaatgtggaaatta

SEQ ID NO: 63216 - DNA, 25 bp, Homo sapien
gaacagtatggcaatgtggaaatta

SEQ ID NO: 63217 - DNA, 25 bp, Homo sapien
gaacagtgacactcgtgcctggcat

SEQ ID NO: 63218 - DNA, 25 bp, Homo sapien
gaacagtgacacttgtgcctggcat

SEQ ID NO: 63219 - DNA, 25 bp, Homo sapien
gaacataaagatggaaacgatgctg

SEQ ID NO: 63220 - DNA, 25 bp, Homo sapien
gaacataaagatggtaacgatgctg

SEQ ID NO: 63221 - DNA, 25 bp, Homo sapien
gaacataaattgctattcctcttca

SEQ ID NO: 63222 - DNA, 25 bp, Homo sapien
gaacataaattgttattcctcttca

SEQ ID NO: 63223 - DNA, 25 bp, Homo sapien
gaacataagcagaaaaagtgaccag

SEQ ID NO: 63224 - DNA, 25 bp, Homo sapien
gaacataagcagagaaagtgaccag

SEQ ID NO: 63225 - DNA, 25 bp, Homo sapien
gaacatacacatttctcatgctatg

SEQ ID NO: 63226 - DNA, 25 bp, Homo sapien
gaacatacccatttctcatgctatg

SEQ ID NO: 63227 - DNA, 25 bp, Homo sapien
gaacatagtgggaaaactagtcagg

SEQ ID NO: 63228 - DNA, 25 bp, Homo sapien
gaacatagtggggaaactagtcagg

SEQ ID NO: 63229 - DNA, 25 bp, Homo sapien
gaacatatatataaaggaccttgag

SEQ ID NO: 63230 - DNA, 25 bp, Homo sapien
gaacatatgtataaaggaccttgag

SEQ ID NO: 63231 - DNA, 25 bp, Homo sapien
gaacatattcctcaacaacagcatg

SEQ ID NO: 63232 - DNA, 25 bp, Homo sapien
gaacatattcctcagcaacagcatg

SEQ ID NO: 63233 - DNA, 25 bp, Homo sapien
gaacatcaatgcagaatgactatgg

SEQ ID NO: 63234 - DNA, 25 bp, Homo sapien
gaacatcagtgcagaatgactatgg

SEQ ID NO: 63235 - DNA, 25 bp, Homo sapien
gaacatccacaagcgtcaagaccat

SEQ ID NO: 63236 - DNA, 25 bp, Homo sapien
gaacatccacaagtgtcaagaccat

SEQ ID NO: 63237 - DNA, 25 bp, Homo sapien
gaacatctcttcttgttctcatggt

SEQ ID NO: 63238 - DNA, 25 bp, Homo sapien
gaacatctctttttgttctcatggt

SEQ ID NO: 63239 - DNA, 25 bp, Homo sapien
gaacatgcactgaatttacaaatca

SEQ ID NO: 63240 - DNA, 25 bp, Homo sapien
gaacatgcgctgaatttacaaatca

SEQ ID NO: 63241 - DNA, 25 bp, Homo sapien
gaacatggagtgcacgtcatagcca

SEQ ID NO: 63242 - DNA, 25 bp, Homo sapien
gaacatggagtgcatgtcatagcca

SEQ ID NO: 63243 - DNA, 25 bp, Homo sapien
gaacatgtacagagtggaactttgc

SEQ ID NO: 63244 - DNA, 25 bp, Homo sapien
gaacatgtatagagtggaactttgc

SEQ ID NO: 63245 - DNA, 25 bp, Homo sapien
gaacatgtggtatttagcgtgtagt

SEQ ID NO: 63246 - DNA, 25 bp, Homo sapien
gaacatgtgttatttagcgtgtagt

SEQ ID NO: 63247 - DNA, 25 bp, Homo sapien
gaacattcaaattcaggaaacattc

SEQ ID NO: 63248 - DNA, 25 bp, Homo sapien
gaacattcaaatttaggaaacattc

SEQ ID NO: 63249 - DNA, 25 bp, Homo sapien
gaacattgacaaaacgcagaagggg

SEQ ID NO: 63250 - DNA, 25 bp, Homo sapien
gaacattgacaaaatgcagaagggg

SEQ ID NO: 63251 - DNA, 25 bp, Homo sapien
gaacattgacattaaagagaaaatt

SEQ ID NO: 63252 - DNA, 25 bp, Homo sapien
gaacattgatattaaagagaaaatt

SEQ ID NO: 63253 - DNA, 25 bp, Homo sapien
gaacattgctatggtctcttccagc

SEQ ID NO: 63254 - DNA, 25 bp, Homo sapien
gaacattgttatggtctcttccagc

SEQ ID NO: 63255 - DNA, 25 bp, Homo sapien
gaacatttatcacttctacattttt

SEQ ID NO: 63256 - DNA, 25 bp, Homo sapien
gaacatttatcatttctacattttt

SEQ ID NO: 63257 - DNA, 25 bp, Homo sapien
gaacatttattacacgtcacaaaaa

SEQ ID NO: 63258 - DNA, 25 bp, Homo sapien
gaacatttattacatgtcacaaaaa

SEQ ID NO: 63259 - DNA, 25 bp, Homo sapien
gaacatttattatctctgggctgtg

SEQ ID NO: 63260 - DNA, 25 bp, Homo sapien
gaacatttattctctctgggctgtg

SEQ ID NO: 63261 - DNA, 25 bp, Homo sapien
gaaccaaaacctcatgatggcctgc

SEQ ID NO: 63262 - DNA, 25 bp, Homo sapien
gaaccaaaacctcatgttggcctgc

SEQ ID NO: 63263 - DNA, 25 bp, Homo sapien
gaaccaaagagatgcaggttaattt

SEQ ID NO: 63264 - DNA, 25 bp, Homo sapien
gaaccaaagagattcaggttaattt

SEQ ID NO: 63265 - DNA, 25 bp, Homo sapien
gaaccaatacggtaatggcatgtga

SEQ ID NO: 63266 - DNA, 25 bp, Homo sapien
gaaccaatatggtaatggcatgtga

SEQ ID NO: 63267 - DNA, 25 bp, Homo sapien
gaaccaatgctcatccagcacgtat

SEQ ID NO: 63268 - DNA, 25 bp, Homo sapien
gaaccaatgttcatccagcacgtat

SEQ ID NO: 63269 - DNA, 25 bp, Homo sapien
gaaccaccaatgcacaggatggtga

SEQ ID NO: 63270 - DNA, 25 bp, Homo sapien
gaaccaccgatgcacaggatggtga

SEQ ID NO: 63271 - DNA, 25 bp, Homo sapien
gaaccaggccacgtcttaaaaatga

SEQ ID NO: 63272 - DNA, 25 bp, Homo sapien
gaaccaggccaggtcttaaaaatga

SEQ ID NO: 63273 - DNA, 25 bp, Homo sapien
gaaccagtctgaataggaggataca

SEQ ID NO: 63274 - DNA, 25 bp, Homo sapien
gaaccagtctggataggaggataca

SEQ ID NO: 63275 - DNA, 25 bp, Homo sapien
gaaccatgaagacatcattgcagca

SEQ ID NO: 63276 - DNA, 25 bp, Homo sapien
gaaccatgaagacgtcattgcagca

SEQ ID NO: 63277 - DNA, 25 bp, Homo sapien
gaaccatggcaatgaaaaggagaaa

SEQ ID NO: 63278 - DNA, 25 bp, Homo sapien
gaaccatggcagtgaaaaggagaaa

SEQ ID NO: 63279 - DNA, 25 bp, Homo sapien
gaaccatttttgagtgtgacttcat

SEQ ID NO: 63280 - DNA, 25 bp, Homo sapien
gaaccattttttagtgtgacttcat

SEQ ID NO: 63281 - DNA, 25 bp, Homo sapien
gaacccatgattacttgtccattaa

SEQ ID NO: 63282 - DNA, 25 bp, Homo sapien
gaacccatgattatttgtccattaa

SEQ ID NO: 63283 - DNA, 25 bp, Homo sapien
gaacccgttcaggatgaaaagagcc

SEQ ID NO: 63284 - DNA, 25 bp, Homo sapien
gaacccgttcagggtgaaaagagcc

SEQ ID NO: 63285 - DNA, 25 bp, Homo sapien
gaaccctaaagcttaatgaatttgt

SEQ ID NO: 63286 - DNA, 25 bp, Homo sapien
gaaccctacagcttaatgaatttgt

SEQ ID NO: 63287 - DNA, 25 bp, Homo sapien
gaaccctgctccggtgggatttgca

SEQ ID NO: 63288 - DNA, 25 bp, Homo sapien
gaaccctgctctggtgggatttgca

SEQ ID NO: 63289 - DNA, 25 bp, Homo sapien
gaacccttgcacagtgttagtgggc

SEQ ID NO: 63290 - DNA, 25 bp, Homo sapien
gaacccttgcatagtgttagtgggc

SEQ ID NO: 63291 - DNA, 25 bp, Homo sapien
gaaccgtgtaggagactcctgcagt

SEQ ID NO: 63292 - DNA, 25 bp, Homo sapien
gaaccgtgtgggagactcctgcagt

SEQ ID NO: 63293 - DNA, 25 bp, Homo sapien
gaacctaaccgtagaagatcagctc

SEQ ID NO: 63294 - DNA, 25 bp, Homo sapien
gaacctaatcgtagaagatcagctc

SEQ ID NO: 63295 - DNA, 25 bp, Homo sapien
gaacctagatgcaaaagtgtccaga

SEQ ID NO: 63296 - DNA, 25 bp, Homo sapien
gaacctagatgcgaaagtgtccaga

SEQ ID NO: 63297 - DNA, 25 bp, Homo sapien
gaacctaggctgcctggcttcaggg

SEQ ID NO: 63298 - DNA, 25 bp, Homo sapien
gaacctaggctgcttggcttcaggg

SEQ ID NO: 63299 - DNA, 25 bp, Homo sapien
gaacctatcttgactagagctttgc

SEQ ID NO: 63300 - DNA, 25 bp, Homo sapien
gaacctatcttgagtagagctttgc

SEQ ID NO: 63301 - DNA, 25 bp, Homo sapien
gaacctcaaaaatatatctgtgctg

SEQ ID NO: 63302 - DNA, 25 bp, Homo sapien
gaacctcagaaatatatctgtgctg

SEQ ID NO: 63303 - DNA, 25 bp, Homo sapien
gaacctctactctaggagaaaagcc

SEQ ID NO: 63304 - DNA, 25 bp, Homo sapien
gaacctctgcgaatgaagcacttcc

SEQ ID NO: 63305 - DNA, 25 bp, Homo sapien
gaacctctgctctaggagaaaagcc

SEQ ID NO: 63306 - DNA, 25 bp, Homo sapien
gaacctctggattcagtaattggta

SEQ ID NO: 63307 - DNA, 25 bp, Homo sapien
gaacctctggattcggtaattggta

SEQ ID NO: 63308 - DNA, 25 bp, Homo sapien
gaacctctgtgaatgaagcacttcc

SEQ ID NO: 63309 - DNA, 25 bp, Homo sapien
gaacctgattttacgaatagtttcc

SEQ ID NO: 63310 - DNA, 25 bp, Homo sapien
gaacctgattttatgaatagtttcc

SEQ ID NO: 63311 - DNA, 25 bp, Homo sapien
gaacctggacagtgataggactagc

SEQ ID NO: 63312 - DNA, 25 bp, Homo sapien
gaacctggagaatgaaggtggaaga

SEQ ID NO: 63313 - DNA, 25 bp, Homo sapien
gaacctggcgaatgaaggtggaaga

SEQ ID NO: 63314 - DNA, 25 bp, Homo sapien
gaacctgggcagtgataggactagc

SEQ ID NO: 63315 - DNA, 25 bp, Homo sapien
gaacctgtatcttcagtagaaaaca

SEQ ID NO: 63316 - DNA, 25 bp, Homo sapien
gaacctgtatcttgagtagaaaaca

SEQ ID NO: 63317 - DNA, 25 bp, Homo sapien
gaacctgtcaaattgagttctcctc

SEQ ID NO: 63318 - DNA, 25 bp, Homo sapien
gaacctgttaaattgagttctcctc

SEQ ID NO: 63319 - DNA, 25 bp, Homo sapien
gaaccttggctccctgctcatattt

SEQ ID NO: 63320 - DNA, 25 bp, Homo sapien
gaaccttggctccctgttcatattt

SEQ ID NO: 63321 - DNA, 25 bp, Homo sapien
gaaccttgttggtccttccagatct

SEQ ID NO: 63322 - DNA, 25 bp, Homo sapien
gaaccttgttggttcttccagatct

SEQ ID NO: 63323 - DNA, 25 bp, Homo sapien
gaacgaaaaagcacttcatagcttg

SEQ ID NO: 63324 - DNA, 25 bp, Homo sapien
gaacgaaaaagcagttcatagcttg

SEQ ID NO: 63325 - DNA, 25 bp, Homo sapien
gaacgaagaagatggcaaagatttg

SEQ ID NO: 63326 - DNA, 25 bp, Homo sapien
gaacgaagaaggtggcaaagatttg

SEQ ID NO: 63327 - DNA, 25 bp, Homo sapien
gaacgagccaccttttccatgaaga

SEQ ID NO: 63328 - DNA, 25 bp, Homo sapien
gaacgagccactttttccatgaaga

SEQ ID NO: 63329 - DNA, 25 bp, Homo sapien
gaacgagttttcacatatgcatata

SEQ ID NO: 63330 - DNA, 25 bp, Homo sapien
gaacgagttttcacatgtgcatata

SEQ ID NO: 63331 - DNA, 25 bp, Homo sapien
gaacgcaaacataataagttgtcag

SEQ ID NO: 63332 - DNA, 25 bp, Homo sapien
gaacgcaagcataataagttgtcag

SEQ ID NO: 63333 - DNA, 25 bp, Homo sapien
gaacgcatagaacagttgtgaggct

SEQ ID NO: 63334 - DNA, 25 bp, Homo sapien
gaacgcatataacagttgtgaggct

SEQ ID NO: 63335 - DNA, 25 bp, Homo sapien
gaacgcctttaggttcaggaagtag

SEQ ID NO: 63336 - DNA, 25 bp, Homo sapien
gaacgcctttaggttcgggaagtag

SEQ ID NO: 63337 - DNA, 25 bp, Homo sapien
gaacgctaaacatgggatcaaaaga

SEQ ID NO: 63338 - DNA, 25 bp, Homo sapien
gaacgctaagcatgggatcaaaaga

SEQ ID NO: 63339 - DNA, 25 bp, Homo sapien
gaacgtagtctatgctggacacttc

SEQ ID NO: 63340 - DNA, 25 bp, Homo sapien
gaacgtagtctatgttggacacttc

SEQ ID NO: 63341 - DNA, 25 bp, Homo sapien
gaacgtcgtatgttctatgaagagc

SEQ ID NO: 63342 - DNA, 25 bp, Homo sapien
gaacgtcgtatgttctgtgaagagc

SEQ ID NO: 63343 - DNA, 25 bp, Homo sapien
gaacgtggcttaacgaacctcatat

SEQ ID NO: 63344 - DNA, 25 bp, Homo sapien
gaacgtggcttaatgaacctcatat

SEQ ID NO: 63345 - DNA, 25 bp, Homo sapien
gaacgttgtttctacgagtagagct

SEQ ID NO: 63346 - DNA, 25 bp, Homo sapien
gaacgttgtttctatgagtagagct

SEQ ID NO: 63347 - DNA, 25 bp, Homo sapien
gaactaaaattatggaaaaccagac

SEQ ID NO: 63348 - DNA, 25 bp, Homo sapien
gaactaaaattatggagaaccagac

SEQ ID NO: 63349 - DNA, 25 bp, Homo sapien
gaactaaacaggatgtgtaagtggg

SEQ ID NO: 63350 - DNA, 25 bp, Homo sapien
gaactaaacagggtgtgtaagtggg

SEQ ID NO: 63351 - DNA, 25 bp, Homo sapien
gaactaaacgatacgtgttttgcag

SEQ ID NO: 63352 - DNA, 25 bp, Homo sapien
gaactaaacgatatgtgttttgcag

SEQ ID NO: 63353 - DNA, 25 bp, Homo sapien
gaactaaatggtaaaataagaacgg

SEQ ID NO: 63354 - DNA, 25 bp, Homo sapien
gaactaaattgtaaaataagaacgg

SEQ ID NO: 63355 - DNA, 25 bp, Homo sapien
gaactaactgcctcatgttctgtgg

SEQ ID NO: 63356 - DNA, 25 bp, Homo sapien
gaactaactgcctcgtgttctgtgg

SEQ ID NO: 63357 - DNA, 25 bp, Homo sapien
gaactacatcgagtgaagtcagtgt

SEQ ID NO: 63358 - DNA, 25 bp, Homo sapien
gaactacatcgagtgaggtcagtgt

SEQ ID NO: 63359 - DNA, 25 bp, Homo sapien
gaactacgtggagacaaaagtgcta

SEQ ID NO: 63360 - DNA, 25 bp, Homo sapien
gaactacgtggtgacaaaagtgcta

SEQ ID NO: 63361 - DNA, 25 bp, Homo sapien
gaactactggaataaggacacaggg

SEQ ID NO: 63362 - DNA, 25 bp, Homo sapien
gaactactggaatgaggacacaggg

SEQ ID NO: 63363 - DNA, 25 bp, Homo sapien
gaactatagggtgcctttcattaaa

SEQ ID NO: 63364 - DNA, 25 bp, Homo sapien
gaactatagtgggaccaaagagaga

SEQ ID NO: 63365 - DNA, 25 bp, Homo sapien
gaactatagtgggatcaaagagaga

SEQ ID NO: 63366 - DNA, 25 bp, Homo sapien
gaactatagtgtgcctttcattaaa

SEQ ID NO: 63367 - DNA, 25 bp, Homo sapien
gaactatcaaaacatacgaaaacct

SEQ ID NO: 63368 - DNA, 25 bp, Homo sapien
gaactatcaaaacatatgaaaacct

SEQ ID NO: 63369 - DNA, 25 bp, Homo sapien
gaactatgaaaacatttttaaaatt

SEQ ID NO: 63370 - DNA, 25 bp, Homo sapien
gaactatggaaacatttttaaaatt

SEQ ID NO: 63371 - DNA, 25 bp, Homo sapien
gaactatggatacctgggttctaat

SEQ ID NO: 63372 - DNA, 25 bp, Homo sapien
gaactatggatacctgtgttctaat

SEQ ID NO: 63373 - DNA, 25 bp, Homo sapien
gaactattaacttacccaatcctta

SEQ ID NO: 63374 - DNA, 25 bp, Homo sapien
gaactattaacttacctaatcctta

SEQ ID NO: 63375 - DNA, 25 bp, Homo sapien
gaactcaacaaaaccgatagctgag

SEQ ID NO: 63376 - DNA, 25 bp, Homo sapien
gaactcaacaaaactgatagctgag

SEQ ID NO: 63377 - DNA, 25 bp, Homo sapien
gaactcaatacggcggcaggttctg

SEQ ID NO: 63378 - DNA, 25 bp, Homo sapien
gaactcaatacggtggcaggttctg

SEQ ID NO: 63379 - DNA, 25 bp, Homo sapien
gaactcacagtttcaaagtgtttca

SEQ ID NO: 63380 - DNA, 25 bp, Homo sapien
gaactcacagtttcgaagtgtttca

SEQ ID NO: 63381 - DNA, 25 bp, Homo sapien
gaactcacatgcaagtattgacata

SEQ ID NO: 63382 - DNA, 25 bp, Homo sapien
gaactcacatgcaattattgacata

SEQ ID NO: 63383 - DNA, 25 bp, Homo sapien
gaactcacctgatctagcacctggg

SEQ ID NO: 63384 - DNA, 25 bp, Homo sapien
gaactcacctgatttagcacctggg

SEQ ID NO: 63385 - DNA, 25 bp, Homo sapien
gaactcacttactatcatgcgaaca

SEQ ID NO: 63386 - DNA, 25 bp, Homo sapien
gaactcacttactatcgtgcgaaca

SEQ ID NO: 63387 - DNA, 25 bp, Homo sapien
gaactcagacactagtgcaagaatg

SEQ ID NO: 63388 - DNA, 25 bp, Homo sapien
gaactcaggcactagtgcaagaatg

SEQ ID NO: 63389 - DNA, 25 bp, Homo sapien
gaactcagttgaaccattcagataa

SEQ ID NO: 63390 - DNA, 25 bp, Homo sapien
gaactcagttgagccattcagataa

SEQ ID NO: 63391 - DNA, 25 bp, Homo sapien
gaactccaactcagtagccaaacac

SEQ ID NO: 63392 - DNA, 25 bp, Homo sapien
gaactccaactcggtagccaaacac

SEQ ID NO: 63393 - DNA, 25 bp, Homo sapien
gaactccaagtagaagcaggcagta

SEQ ID NO: 63394 - DNA, 25 bp, Homo sapien
gaactccaggtagaagcaggcagta

SEQ ID NO: 63395 - DNA, 25 bp, Homo sapien
gaactccatattttaggagactcca

SEQ ID NO: 63396 - DNA, 25 bp, Homo sapien
gaactccatattttgggagactcca

SEQ ID NO: 63397 - DNA, 25 bp, Homo sapien
gaactccatcgatgtctcctgaata

SEQ ID NO: 63398 - DNA, 25 bp, Homo sapien
gaactccatggatgtctcctgaata

SEQ ID NO: 63399 - DNA, 25 bp, Homo sapien
gaactcctgaggcagaagtattacc

SEQ ID NO: 63400 - DNA, 25 bp, Homo sapien
gaactcctgcggcagaagtattacc

SEQ ID NO: 63401 - DNA, 25 bp, Homo sapien
gaactctccatgtaatctgaaaaat

SEQ ID NO: 63402 - DNA, 25 bp, Homo sapien
gaactctccatgtattctgaaaaat

SEQ ID NO: 63403 - DNA, 25 bp, Homo sapien
gaactctgatacaggatattttact

SEQ ID NO: 63404 - DNA, 25 bp, Homo sapien
gaactctgatataggatattttact

SEQ ID NO: 63405 - DNA, 25 bp, Homo sapien
gaactcttaatcattcctggaactc

SEQ ID NO: 63406 - DNA, 25 bp, Homo sapien
gaactcttattcattcctggaactc

SEQ ID NO: 63407 - DNA, 25 bp, Homo sapien
gaactctttactggaacaaattagc

SEQ ID NO: 63408 - DNA, 25 bp, Homo sapien
gaactctttactggaataaattagc

SEQ ID NO: 63409 - DNA, 25 bp, Homo sapien
gaactgaaaaaaagtcctgaaattg

SEQ ID NO: 63410 - DNA, 25 bp, Homo sapien
gaactgaaaaaatgtcctgaaattg

SEQ ID NO: 63411 - DNA, 25 bp, Homo sapien
gaactgaaagctcagtccaagtcta

SEQ ID NO: 63412 - DNA, 25 bp, Homo sapien
gaactgaacctgctcttgctgaggt

SEQ ID NO: 63413 - DNA, 25 bp, Homo sapien
gaactgaatctgctcttgctgaggt

SEQ ID NO: 63414 - DNA, 25 bp, Homo sapien
gaactgaatgctcagtccaagtcta

SEQ ID NO: 63415 - DNA, 25 bp, Homo sapien
gaactgacaaataagcataacaata

SEQ ID NO: 63416 - DNA, 25 bp, Homo sapien
gaactgacagataagcataacaata

SEQ ID NO: 63417 - DNA, 25 bp, Homo sapien
gaactgaccttcccattcctgagtt

SEQ ID NO: 63418 - DNA, 25 bp, Homo sapien
gaactgacctttccattcctgagtt

SEQ ID NO: 63419 - DNA, 25 bp, Homo sapien
gaactgataatagacttggcaaaaa

SEQ ID NO: 63420 - DNA, 25 bp, Homo sapien
gaactgataatagatttggcaaaaa

SEQ ID NO: 63421 - DNA, 25 bp, Homo sapien
gaactgatgatgtggtttctttagc

SEQ ID NO: 63422 - DNA, 25 bp, Homo sapien
gaactgatgctgtggtttctttagc

SEQ ID NO: 63423 - DNA, 25 bp, Homo sapien
gaactgcaaaaaacagtcaattgtg

SEQ ID NO: 63424 - DNA, 25 bp, Homo sapien
gaactgcaagaaacagtcaattgtg

SEQ ID NO: 63425 - DNA, 25 bp, Homo sapien
gaactgcaatattggatctcctggt

SEQ ID NO: 63426 - DNA, 25 bp, Homo sapien
gaactgcagtattggatctcctggt

SEQ ID NO: 63427 - DNA, 25 bp, Homo sapien
gaactgcatgcattcccaggcttgt

SEQ ID NO: 63428 - DNA, 25 bp, Homo sapien
gaactgcatgcatttccaggcttgt

SEQ ID NO: 63429 - DNA, 25 bp, Homo sapien
gaactgccagcatcatgagattata

SEQ ID NO: 63430 - DNA, 25 bp, Homo sapien
gaactgccagcatcgtgagattata

SEQ ID NO: 63431 - DNA, 25 bp, Homo sapien
gaactgccataaccagaaaagatta

SEQ ID NO: 63432 - DNA, 25 bp, Homo sapien
gaactgccgtaaccagaaaagatta

SEQ ID NO: 63433 - DNA, 25 bp, Homo sapien
gaactggaacgggcttttggctagt

SEQ ID NO: 63434 - DNA, 25 bp, Homo sapien
gaactggaactgcaatattggatct

SEQ ID NO: 63435 - DNA, 25 bp, Homo sapien
gaactggaactgcagtattggatct

SEQ ID NO: 63436 - DNA, 25 bp, Homo sapien
gaactggaatgggcttttggctagt

SEQ ID NO: 63437 - DNA, 25 bp, Homo sapien
gaactggaattcttagactgaaagg

SEQ ID NO: 63438 - DNA, 25 bp, Homo sapien
gaactggaatttttagactgaaagg

SEQ ID NO: 63439 - DNA, 25 bp, Homo sapien
gaactggactgaaactgaaaggaaa

SEQ ID NO: 63440 - DNA, 25 bp, Homo sapien
gaactggactgaaattgaaaggaaa

SEQ ID NO: 63441 - DNA, 25 bp, Homo sapien
gaactgggcatccgtttctccattt

SEQ ID NO: 63442 - DNA, 25 bp, Homo sapien
gaactgggcatctgtttctccattt

SEQ ID NO: 63443 - DNA, 25 bp, Homo sapien
gaactgtctgcaaatagacataaga

SEQ ID NO: 63444 - DNA, 25 bp, Homo sapien
gaactgtctgcacatagacataaga

SEQ ID NO: 63445 - DNA, 25 bp, Homo sapien
gaactgtctgtatgttaactacttt

SEQ ID NO: 63446 - DNA, 25 bp, Homo sapien
gaactgtctgtattttaactacttt

SEQ ID NO: 63447 - DNA, 25 bp, Homo sapien
gaactgtggaaaaattatttcattg

SEQ ID NO: 63448 - DNA, 25 bp, Homo sapien
gaactgtgggaaaattatttcattg

SEQ ID NO: 63449 - DNA, 25 bp, Homo sapien
gaactgtgttggggtctagcatgta

SEQ ID NO: 63450 - DNA, 25 bp, Homo sapien
gaactgtgttgggttctagcatgta

SEQ ID NO: 63451 - DNA, 25 bp, Homo sapien
gaactgttacctttccagaaaagac

SEQ ID NO: 63452 - DNA, 25 bp, Homo sapien
gaactgttactgtccccgtaaaggt

SEQ ID NO: 63453 - DNA, 25 bp, Homo sapien
gaactgttactgtccctgtaaaggt

SEQ ID NO: 63454 - DNA, 25 bp, Homo sapien
gaactgttatggacttcattctaag

SEQ ID NO: 63455 - DNA, 25 bp, Homo sapien
gaactgttatggccttcattctaag

SEQ ID NO: 63456 - DNA, 25 bp, Homo sapien
gaactgttcaacttccaagcaaatg

SEQ ID NO: 63457 - DNA, 25 bp, Homo sapien
gaactgttgaccacacattttcact

SEQ ID NO: 63458 - DNA, 25 bp, Homo sapien
gaactgttgacctcacattttcact

SEQ ID NO: 63459 - DNA, 25 bp, Homo sapien
gaactgtttaacttccaagcaaatg

SEQ ID NO: 63460 - DNA, 25 bp, Homo sapien
gaactgtttcctttccagaaaagac

SEQ ID NO: 63461 - DNA, 25 bp, Homo sapien
gaacttaagaaacttgtccaagata

SEQ ID NO: 63462 - DNA, 25 bp, Homo sapien
gaacttaagaaatttgtccaagata

SEQ ID NO: 63463 - DNA, 25 bp, Homo sapien
gaacttaaggttacgtacagcagtc

SEQ ID NO: 63464 - DNA, 25 bp, Homo sapien
gaacttaaggttaggtacagcagtc

SEQ ID NO: 63465 - DNA, 25 bp, Homo sapien
gaacttacaagcacgaagcacaaag

SEQ ID NO: 63466 - DNA, 25 bp, Homo sapien
gaacttacaagcatgaagcacaaag

SEQ ID NO: 63467 - DNA, 25 bp, Homo sapien
gaacttacacgacaattttcagaca

SEQ ID NO: 63468 - DNA, 25 bp, Homo sapien
gaacttacatgacaattttcagaca

SEQ ID NO: 63469 - DNA, 25 bp, Homo sapien
gaacttagaaaagactcttcaaaag

SEQ ID NO: 63470 - DNA, 25 bp, Homo sapien
gaacttagaaaatactcttcaaaag

SEQ ID NO: 63471 - DNA, 25 bp, Homo sapien
gaacttaggaaactgaatctatcct

SEQ ID NO: 63472 - DNA, 25 bp, Homo sapien
gaacttaggaaacttaatctatcct

SEQ ID NO: 63473 - DNA, 25 bp, Homo sapien
gaacttaggcaggctatcccaagaa

SEQ ID NO: 63474 - DNA, 25 bp, Homo sapien
gaacttaggcaggttatcccaagaa

SEQ ID NO: 63475 - DNA, 25 bp, Homo sapien
gaacttatttcacactgtatacaag

SEQ ID NO: 63476 - DNA, 25 bp, Homo sapien
gaacttatttcatactgtatacaag

SEQ ID NO: 63477 - DNA, 25 bp, Homo sapien
gaacttcatggtcttcagaataaaa

SEQ ID NO: 63478 - DNA, 25 bp, Homo sapien
gaacttcattgtcttcagaataaaa

SEQ ID NO: 63479 - DNA, 25 bp, Homo sapien
gaacttcttcatataatagtcagat

SEQ ID NO: 63480 - DNA, 25 bp, Homo sapien
gaacttcttcatatgatagtcagat

SEQ ID NO: 63481 - DNA, 25 bp, Homo sapien
gaacttcttttgcaccttaaaatac

SEQ ID NO: 63482 - DNA, 25 bp, Homo sapien
gaacttcttttgctccttaaaatac

SEQ ID NO: 63483 - DNA, 25 bp, Homo sapien
gaacttgcagagcaccaacccagtc

SEQ ID NO: 63484 - DNA, 25 bp, Homo sapien
gaacttgcagagtaccaacccagtc

SEQ ID NO: 63485 - DNA, 25 bp, Homo sapien
gaacttggagacttagattactctt

SEQ ID NO: 63486 - DNA, 25 bp, Homo sapien
gaacttggccttccaggtggagact

SEQ ID NO: 63487 - DNA, 25 bp, Homo sapien
gaacttggcctttcaggtggagact

SEQ ID NO: 63488 - DNA, 25 bp, Homo sapien
gaacttggggacttagattactctt

SEQ ID NO: 63489 - DNA, 25 bp, Homo sapien
gaacttgttaaattgttgtgattaa

SEQ ID NO: 63490 - DNA, 25 bp, Homo sapien
gaacttgttaatttgttgtgattaa

SEQ ID NO: 63491 - DNA, 25 bp, Homo sapien
gaactttcattcagtgatatgtatt

SEQ ID NO: 63492 - DNA, 25 bp, Homo sapien
gaactttcattgagtgatatgtatt

SEQ ID NO: 63493 - DNA, 25 bp, Homo sapien
gaactttccttcctggaatttgtcc

SEQ ID NO: 63494 - DNA, 25 bp, Homo sapien
gaactttccttcttggaatttgtcc

SEQ ID NO: 63495 - DNA, 25 bp, Homo sapien
gaactttggctgcatgttggtgtct

SEQ ID NO: 63496 - DNA, 25 bp, Homo sapien
gaactttggctgcctgttggtgtct

SEQ ID NO: 63497 - DNA, 25 bp, Homo sapien
gaacttttgcataaattcactgcta

SEQ ID NO: 63498 - DNA, 25 bp, Homo sapien
gaacttttgcgttccttcttggata

SEQ ID NO: 63499 - DNA, 25 bp, Homo sapien
gaacttttgtataaattcactgcta

SEQ ID NO: 63500 - DNA, 25 bp, Homo sapien
gaacttttgtgttccttcttggata

SEQ ID NO: 63501 - DNA, 25 bp, Homo sapien
gaagaaaacaaacaaaaaattctaa

SEQ ID NO: 63502 - DNA, 25 bp, Homo sapien
gaagaaaacaaacgaaaaattctaa

SEQ ID NO: 63503 - DNA, 25 bp, Homo sapien
gaagaaaacgtctgtattgaaagga

SEQ ID NO: 63504 - DNA, 25 bp, Homo sapien
gaagaaaatatacgctatcacagga

SEQ ID NO: 63505 - DNA, 25 bp, Homo sapien
gaagaaaatatatgctatcacagga

SEQ ID NO: 63506 - DNA, 25 bp, Homo sapien
gaagaaaatggagtccttgctggct

SEQ ID NO: 63507 - DNA, 25 bp, Homo sapien
gaagaaaatgtctgtattgaaagga

SEQ ID NO: 63508 - DNA, 25 bp, Homo sapien
gaagaaaattgagtccttgctggct

SEQ ID NO: 63509 - DNA, 25 bp, Homo sapien
gaagaaacataagtagcaggccatg

SEQ ID NO: 63510 - DNA, 25 bp, Homo sapien
gaagaaaccagcctctgtgaagagg

SEQ ID NO: 63511 - DNA, 25 bp, Homo sapien
gaagaaaccaggctctgtgaagagg

SEQ ID NO: 63512 - DNA, 25 bp, Homo sapien
gaagaaacgtaagtagcaggccatg

SEQ ID NO: 63513 - DNA, 25 bp, Homo sapien
gaagaaagactgtcacagcagaaag

SEQ ID NO: 63514 - DNA, 25 bp, Homo sapien
gaagaaagactgtcacggcagaaag

SEQ ID NO: 63515 - DNA, 25 bp, Homo sapien
gaagaaagagggcacgcgagtccca

SEQ ID NO: 63516 - DNA, 25 bp, Homo sapien
gaagaaagagggcatgcgagtccca

SEQ ID NO: 63517 - DNA, 25 bp, Homo sapien
gaagaaagatttggtttctaaaata

SEQ ID NO: 63518 - DNA, 25 bp, Homo sapien
gaagaaaggttctcaatccagtccg

SEQ ID NO: 63519 - DNA, 25 bp, Homo sapien
gaagaaaggttctcgatccagtccg

SEQ ID NO: 63520 - DNA, 25 bp, Homo sapien
gaagaaaggtttggtttctaaaata

SEQ ID NO: 63521 - DNA, 25 bp, Homo sapien
gaagaaatgggcttaaatctgcatt

SEQ ID NO: 63522 - DNA, 25 bp, Homo sapien
gaagaaatgggtttaaatctgcatt

SEQ ID NO: 63523 - DNA, 25 bp, Homo sapien
gaagaaatggtaaagtgggatgcca

SEQ ID NO: 63524 - DNA, 25 bp, Homo sapien
gaagaaatggtaacgtgggatgcca

SEQ ID NO: 63525 - DNA, 25 bp, Homo sapien
gaagaaatgtgggttcctggtattc

SEQ ID NO: 63526 - DNA, 25 bp, Homo sapien
gaagaaatttgggttcctggtattc

SEQ ID NO: 63527 - DNA, 25 bp, Homo sapien
gaagaacaagaaagtgaatttgtaa

SEQ ID NO: 63528 - DNA, 25 bp, Homo sapien
gaagaacaccatttaatctttaaaa

SEQ ID NO: 63529 - DNA, 25 bp, Homo sapien
gaagaacaccatttgatctttaaaa

SEQ ID NO: 63530 - DNA, 25 bp, Homo sapien
gaagaacagaatacggcactagatt

SEQ ID NO: 63531 - DNA, 25 bp, Homo sapien
gaagaacagaatatggcactagatt

SEQ ID NO: 63532 - DNA, 25 bp, Homo sapien
gaagaacaggaaagtgaatttgtaa

SEQ ID NO: 63533 - DNA, 25 bp, Homo sapien
gaagaacaggaataattcttcagac

SEQ ID NO: 63534 - DNA, 25 bp, Homo sapien
gaagaacaggaattattcttcagac

SEQ ID NO: 63535 - DNA, 25 bp, Homo sapien
gaagaaccaatacggtaatggcatg

SEQ ID NO: 63536 - DNA, 25 bp, Homo sapien
gaagaaccaatatggtaatggcatg

SEQ ID NO: 63537 - DNA, 25 bp, Homo sapien
gaagaacgaatgagcgagcttgaag

SEQ ID NO: 63538 - DNA, 25 bp, Homo sapien
gaagaacgcatgagcgagcttgaag

SEQ ID NO: 63539 - DNA, 25 bp, Homo sapien
gaagaactgtagaggcagcaaagct

SEQ ID NO: 63540 - DNA, 25 bp, Homo sapien
gaagaactgtagcggcagcaaagct

SEQ ID NO: 63541 - DNA, 25 bp, Homo sapien
gaagaagaaaatggagtccttgctg

SEQ ID NO: 63542 - DNA, 25 bp, Homo sapien
gaagaagaaaattgagtccttgctg

SEQ ID NO: 63543 - DNA, 25 bp, Homo sapien
gaagaagaacaagtcggaggactga

SEQ ID NO: 63544 - DNA, 25 bp, Homo sapien
gaagaagaagaacaagtcggaggac

SEQ ID NO: 63545 - DNA, 25 bp, Homo sapien
gaagaagaagaagaagtcggaggac

SEQ ID NO: 63546 - DNA, 25 bp, Homo sapien
gaagaagaagaagtcggaggactga

SEQ ID NO: 63547 - DNA, 25 bp, Homo sapien
gaagaagaagagaagatgcccaagc

SEQ ID NO: 63548 - DNA, 25 bp, Homo sapien
gaagaagacacagggaatatcccct

SEQ ID NO: 63549 - DNA, 25 bp, Homo sapien
gaagaagacacagggactatcccct

SEQ ID NO: 63550 - DNA, 25 bp, Homo sapien
gaagaagaggagaagatgcccaagc

SEQ ID NO: 63551 - DNA, 25 bp, Homo sapien
gaagaagagtgattaagacagatgg

SEQ ID NO: 63552 - DNA, 25 bp, Homo sapien
gaagaagagtgggaagccttgatta

SEQ ID NO: 63553 - DNA, 25 bp, Homo sapien
gaagaagagtgggaaggcttgatta

SEQ ID NO: 63554 - DNA, 25 bp, Homo sapien
gaagaagagtggttaagacagatgg

SEQ ID NO: 63555 - DNA, 25 bp, Homo sapien
gaagaagcacaataccatatgttag

SEQ ID NO: 63556 - DNA, 25 bp, Homo sapien
gaagaagcacaatatcatatgttag

SEQ ID NO: 63557 - DNA, 25 bp, Homo sapien
gaagaaggcatccttgaagtccaga

SEQ ID NO: 63558 - DNA, 25 bp, Homo sapien
gaagaaggcgtccttgaagtccaga

SEQ ID NO: 63559 - DNA, 25 bp, Homo sapien
gaagaaggtattccgctgtttactg

SEQ ID NO: 63560 - DNA, 25 bp, Homo sapien
gaagaaggtattctgctgtttactg

SEQ ID NO: 63561 - DNA, 25 bp, Homo sapien
gaagaagttagaacaactgtacaat

SEQ ID NO: 63562 - DNA, 25 bp, Homo sapien
gaagaagttagaataactgtacaat

SEQ ID NO: 63563 - DNA, 25 bp, Homo sapien
gaagaataaaatcagaggactgacg

SEQ ID NO: 63564 - DNA, 25 bp, Homo sapien
gaagaataagatcagaggactgacg

SEQ ID NO: 63565 - DNA, 25 bp, Homo sapien
gaagaatgaaagaacgactgcaact

SEQ ID NO: 63566 - DNA, 25 bp, Homo sapien
gaagaatgacgccttctatatttgt

SEQ ID NO: 63567 - DNA, 25 bp, Homo sapien
gaagaatgagagaacgactgcaact

SEQ ID NO: 63568 - DNA, 25 bp, Homo sapien
gaagaatgatgccttctatatttgt

SEQ ID NO: 63569 - DNA, 25 bp, Homo sapien
gaagaatgcgttgggccagtgttct

SEQ ID NO: 63570 - DNA, 25 bp, Homo sapien
gaagaatgctttgggccagtgttct

SEQ ID NO: 63571 - DNA, 25 bp, Homo sapien
gaagaattcagtgcagatattcgct

SEQ ID NO: 63572 - DNA, 25 bp, Homo sapien
gaagaattcagtgtagatattcgct

SEQ ID NO: 63573 - DNA, 25 bp, Homo sapien
gaagaattcggctttataggcagag

SEQ ID NO: 63574 - DNA, 25 bp, Homo sapien
gaagaatttggctttataggcagag

SEQ ID NO: 63575 - DNA, 25 bp, Homo sapien
gaagacacagggaatatccccttct

SEQ ID NO: 63576 - DNA, 25 bp, Homo sapien
gaagacacagggactatccccttct

SEQ ID NO: 63577 - DNA, 25 bp, Homo sapien
gaagacaggaatgctgctatatatc

SEQ ID NO: 63578 - DNA, 25 bp, Homo sapien
gaagacagggatgctgctatatatc

SEQ ID NO: 63579 - DNA, 25 bp, Homo sapien
gaagacatctgcaggttctaatggc

SEQ ID NO: 63580 - DNA, 25 bp, Homo sapien
gaagacatctggaggttctaatggc

SEQ ID NO: 63581 - DNA, 25 bp, Homo sapien
gaagaccatttacttacaagtgcaa

SEQ ID NO: 63582 - DNA, 25 bp, Homo sapien
gaagaccatttgcttacaagtgcaa

SEQ ID NO: 63583 - DNA, 25 bp, Homo sapien
gaagaccttgccatgttaagtgatg

SEQ ID NO: 63584 - DNA, 25 bp, Homo sapien
gaagaccttgccgtgttaagtgatg

SEQ ID NO: 63585 - DNA, 25 bp, Homo sapien
gaagacggaatcagcaggtattttt

SEQ ID NO: 63586 - DNA, 25 bp, Homo sapien
gaagacggactcagcaggtattttt

SEQ ID NO: 63587 - DNA, 25 bp, Homo sapien
gaagactacagtttacacacacaca

SEQ ID NO: 63588 - DNA, 25 bp, Homo sapien
gaagactacggtttacacacacaca

SEQ ID NO: 63589 - DNA, 25 bp, Homo sapien
gaagactatcttcttgccttgggca

SEQ ID NO: 63590 - DNA, 25 bp, Homo sapien
gaagactattttcttgccttgggca

SEQ ID NO: 63591 - DNA, 25 bp, Homo sapien
gaagacttctttttaatcctctctt

SEQ ID NO: 63592 - DNA, 25 bp, Homo sapien
gaagacttgtttttaatcctctctt

SEQ ID NO: 63593 - DNA, 25 bp, Homo sapien
gaagagaaaaattcaggaatcaaat

SEQ ID NO: 63594 - DNA, 25 bp, Homo sapien
gaagagaaaagtctgcctttgacaa

SEQ ID NO: 63595 - DNA, 25 bp, Homo sapien
gaagagaaaatccatagacacccag

SEQ ID NO: 63596 - DNA, 25 bp, Homo sapien
gaagagaaagcataggacaaggccc

SEQ ID NO: 63597 - DNA, 25 bp, Homo sapien
gaagagaaagcgtaggacaaggccc

SEQ ID NO: 63598 - DNA, 25 bp, Homo sapien
gaagagaaatgtctgcctttgacaa

SEQ ID NO: 63599 - DNA, 25 bp, Homo sapien
gaagagaacattgacattaaagaga

SEQ ID NO: 63600 - DNA, 25 bp, Homo sapien
gaagagaacattgatattaaagaga

SEQ ID NO: 63601 - DNA, 25 bp, Homo sapien
gaagagaagaaagtaccaggactta

SEQ ID NO: 63602 - DNA, 25 bp, Homo sapien
gaagagaagaaatgtgggttcctgg

SEQ ID NO: 63603 - DNA, 25 bp, Homo sapien
gaagagaagaaattaccaggactta

SEQ ID NO: 63604 - DNA, 25 bp, Homo sapien
gaagagaagaaatttgggttcctgg

SEQ ID NO: 63605 - DNA, 25 bp, Homo sapien
gaagagaagaattcaggaatcaaat

SEQ ID NO: 63606 - DNA, 25 bp, Homo sapien
gaagagaagatccatagacacccag

SEQ ID NO: 63607 - DNA, 25 bp, Homo sapien
gaagagaagattcctcaggtgaaaa

SEQ ID NO: 63608 - DNA, 25 bp, Homo sapien
gaagagaagattcctcgggtgaaaa

SEQ ID NO: 63609 - DNA, 25 bp, Homo sapien
gaagagagaactccggacactctac

SEQ ID NO: 63610 - DNA, 25 bp, Homo sapien
gaagagagaactctggacactctac

SEQ ID NO: 63611 - DNA, 25 bp, Homo sapien
gaagagagaggttcgtctgagaaaa

SEQ ID NO: 63612 - DNA, 25 bp, Homo sapien
gaagagagaggtttgtctgagaaaa

SEQ ID NO: 63613 - DNA, 25 bp, Homo sapien
gaagagagccgttttctacctactt

SEQ ID NO: 63614 - DNA, 25 bp, Homo sapien
gaagagagctgttttctacctactt

SEQ ID NO: 63615 - DNA, 25 bp, Homo sapien
gaagagatagataaaaggaggaatc

SEQ ID NO: 63616 - DNA, 25 bp, Homo sapien
gaagagatagataaaatgaggaatc

SEQ ID NO: 63617 - DNA, 25 bp, Homo sapien
gaagagattttgaaggagcaagact

SEQ ID NO: 63618 - DNA, 25 bp, Homo sapien
gaagagattttgagggagcaagact

SEQ ID NO: 63619 - DNA, 25 bp, Homo sapien
gaagagcataggttttattcatttc

SEQ ID NO: 63620 - DNA, 25 bp, Homo sapien
gaagagcataggttttgttcatttc

SEQ ID NO: 63621 - DNA, 25 bp, Homo sapien
gaagagctgtcaagttaattaatct

SEQ ID NO: 63622 - DNA, 25 bp, Homo sapien
gaagagctgtcaggttaattaatct

SEQ ID NO: 63623 - DNA, 25 bp, Homo sapien
gaagaggaaaaaattaactgtttca

SEQ ID NO: 63624 - DNA, 25 bp, Homo sapien
gaagaggaaaaatttaactgtttca

SEQ ID NO: 63625 - DNA, 25 bp, Homo sapien
gaagaggaaaatatgatctcagact

SEQ ID NO: 63626 - DNA, 25 bp, Homo sapien
gaagaggacaatatgatctcagact

SEQ ID NO: 63627 - DNA, 25 bp, Homo sapien
gaagaggagagacccagctgccgcc

SEQ ID NO: 63628 - DNA, 25 bp, Homo sapien
gaagaggagaggcccagctgccgcc

SEQ ID NO: 63629 - DNA, 25 bp, Homo sapien
gaagaggatgggacttttcagttga

SEQ ID NO: 63630 - DNA, 25 bp, Homo sapien
gaagaggatgggccttttcagttga

SEQ ID NO: 63631 - DNA, 25 bp, Homo sapien
gaagaggcaaattgcagaatctaat

SEQ ID NO: 63632 - DNA, 25 bp, Homo sapien
gaagaggcaaattgtagaatctaat

SEQ ID NO: 63633 - DNA, 25 bp, Homo sapien
gaagaggcctgtacattcgtttaat

SEQ ID NO: 63634 - DNA, 25 bp, Homo sapien
gaagaggcctgtacgttcgtttaat

SEQ ID NO: 63635 - DNA, 25 bp, Homo sapien
gaagagggtcggtttctcatatttg

SEQ ID NO: 63636 - DNA, 25 bp, Homo sapien
gaagagggttggtttctcatatttg

SEQ ID NO: 63637 - DNA, 25 bp, Homo sapien
gaagaggtaattgccccaccagata

SEQ ID NO: 63638 - DNA, 25 bp, Homo sapien
gaagaggtattctgaaatcctcaaa

SEQ ID NO: 63639 - DNA, 25 bp, Homo sapien
gaagaggtattctggaatcctcaaa

SEQ ID NO: 63640 - DNA, 25 bp, Homo sapien
gaagaggtcattgccccaccagata

SEQ ID NO: 63641 - DNA, 25 bp, Homo sapien
gaagaggtgccataattattaaaca

SEQ ID NO: 63642 - DNA, 25 bp, Homo sapien
gaagaggtgccgtaattattaaaca

SEQ ID NO: 63643 - DNA, 25 bp, Homo sapien
gaagagtaaaggggaatttgtcttg

SEQ ID NO: 63644 - DNA, 25 bp, Homo sapien
gaagagtaaagggtaatttgtcttg

SEQ ID NO: 63645 - DNA, 25 bp, Homo sapien
gaagagtaacgataactgttcttat

SEQ ID NO: 63646 - DNA, 25 bp, Homo sapien
gaagagtaactgtgataggttccga

SEQ ID NO: 63647 - DNA, 25 bp, Homo sapien
gaagagtaactgtggtaggttccga

SEQ ID NO: 63648 - DNA, 25 bp, Homo sapien
gaagagtaatgataactgttcttat

SEQ ID NO: 63649 - DNA, 25 bp, Homo sapien
gaagagtcaggtaaatataaatctg

SEQ ID NO: 63650 - DNA, 25 bp, Homo sapien
gaagagtccatcgaatgctaagcag

SEQ ID NO: 63651 - DNA, 25 bp, Homo sapien
gaagagtccatctaatgctaagcag

SEQ ID NO: 63652 - DNA, 25 bp, Homo sapien
gaagagtcgggtaaatataaatctg

SEQ ID NO: 63653 - DNA, 25 bp, Homo sapien
gaagagtctcacactttctttcagg

SEQ ID NO: 63654 - DNA, 25 bp, Homo sapien
gaagagtctcacattttctttcagg

SEQ ID NO: 63655 - DNA, 25 bp, Homo sapien
gaagagtgacagcaaaaatcatagc

SEQ ID NO: 63656 - DNA, 25 bp, Homo sapien
gaagagtgacatcaaaaatcatagc

SEQ ID NO: 63657 - DNA, 25 bp, Homo sapien
gaagagtgattaagacagatggaat

SEQ ID NO: 63658 - DNA, 25 bp, Homo sapien
gaagagtgctgggtggtatgaaact

SEQ ID NO: 63659 - DNA, 25 bp, Homo sapien
gaagagtgctgggttgtatgaaact

SEQ ID NO: 63660 - DNA, 25 bp, Homo sapien
gaagagtggttaagacagatggaat

SEQ ID NO: 63661 - DNA, 25 bp, Homo sapien
gaagagttaggaaataaagttactt

SEQ ID NO: 63662 - DNA, 25 bp, Homo sapien
gaagagtttaattttttcctgatta

SEQ ID NO: 63663 - DNA, 25 bp, Homo sapien
gaagagtttggaaataaagttactt

SEQ ID NO: 63664 - DNA, 25 bp, Homo sapien
gaagagttttatacaggaaaggatt

SEQ ID NO: 63665 - DNA, 25 bp, Homo sapien
gaagagttttatgcaggaaaggatt

SEQ ID NO: 63666 - DNA, 25 bp, Homo sapien
gaagagttttattttttcctgatta

SEQ ID NO: 63667 - DNA, 25 bp, Homo sapien
gaagataaccgctatgacacactga

SEQ ID NO: 63668 - DNA, 25 bp, Homo sapien
gaagataactgctatgacacactga

SEQ ID NO: 63669 - DNA, 25 bp, Homo sapien
gaagatacaaagtgaagagtaaatc

SEQ ID NO: 63670 - DNA, 25 bp, Homo sapien
gaagatacaaagtgaatagtaaatc

SEQ ID NO: 63671 - DNA, 25 bp, Homo sapien
gaagatacccactgaaatttgagac

SEQ ID NO: 63672 - DNA, 25 bp, Homo sapien
gaagatacccactggaatttgagac

SEQ ID NO: 63673 - DNA, 25 bp, Homo sapien
gaagataggctctttgaaaatatgc

SEQ ID NO: 63674 - DNA, 25 bp, Homo sapien
gaagataggctgtttgaaaatatgc

SEQ ID NO: 63675 - DNA, 25 bp, Homo sapien
gaagatataagacgaagttcaaatg

SEQ ID NO: 63676 - DNA, 25 bp, Homo sapien
gaagatataagccgaagttcaaatg

SEQ ID NO: 63677 - DNA, 25 bp, Homo sapien
gaagatatactcatctagccacagg

SEQ ID NO: 63678 - DNA, 25 bp, Homo sapien
gaagatatactcatctcgccacagg

SEQ ID NO: 63679 - DNA, 25 bp, Homo sapien
gaagatatgactcgtaactttccaa

SEQ ID NO: 63680 - DNA, 25 bp, Homo sapien
gaagatatgacttgtaactttccaa

SEQ ID NO: 63681 - DNA, 25 bp, Homo sapien
gaagatcaaatagttgcaggtgtgt

SEQ ID NO: 63682 - DNA, 25 bp, Homo sapien
gaagatcaaatggttgcaggtgtgt

SEQ ID NO: 63683 - DNA, 25 bp, Homo sapien
gaagatctaaatgaagaaaatgatt

SEQ ID NO: 63684 - DNA, 25 bp, Homo sapien
gaagatctaaatgaggaaaatgatt

SEQ ID NO: 63685 - DNA, 25 bp, Homo sapien
gaagatcttaaccacattgccaact

SEQ ID NO: 63686 - DNA, 25 bp, Homo sapien
gaagatcttaaccatattgccaact

SEQ ID NO: 63687 - DNA, 25 bp, Homo sapien
gaagatgaaagacgcttaataatgg

SEQ ID NO: 63688 - DNA, 25 bp, Homo sapien
gaagatgaaagatgcttaataatgg

SEQ ID NO: 63689 - DNA, 25 bp, Homo sapien
gaagatgaagacattcaacttgata

SEQ ID NO: 63690 - DNA, 25 bp, Homo sapien
gaagatgaagatattcaacttgata

SEQ ID NO: 63691 - DNA, 25 bp, Homo sapien
gaagatgaatcctatgttttcagtc

SEQ ID NO: 63692 - DNA, 25 bp, Homo sapien
gaagatgactcctatgttttcagtc

SEQ ID NO: 63693 - DNA, 25 bp, Homo sapien
gaagatgctgccctctttcttatca

SEQ ID NO: 63694 - DNA, 25 bp, Homo sapien
gaagatgctgccttctttcttatca

SEQ ID NO: 63695 - DNA, 25 bp, Homo sapien
gaagatgtgcttcgttattaatttc

SEQ ID NO: 63696 - DNA, 25 bp, Homo sapien
gaagatgtgcttctttattaatttc

SEQ ID NO: 63697 - DNA, 25 bp, Homo sapien
gaagattaagagacacaaaagtttg

SEQ ID NO: 63698 - DNA, 25 bp, Homo sapien
gaagattaagagccacaaaagtttg

SEQ ID NO: 63699 - DNA, 25 bp, Homo sapien
gaagattcataaaaaaaaaaaagga

SEQ ID NO: 63700 - DNA, 25 bp, Homo sapien
gaagattcataaaagaaaaaaagga

SEQ ID NO: 63701 - DNA, 25 bp, Homo sapien
gaagattcttgcactcaaccatgaa

SEQ ID NO: 63702 - DNA, 25 bp, Homo sapien
gaagattcttgccctcaaccatgaa

SEQ ID NO: 63703 - DNA, 25 bp, Homo sapien
gaagattttgtggtgcatagggcga

SEQ ID NO: 63704 - DNA, 25 bp, Homo sapien
gaagattttgtggtgcgtagggcga

SEQ ID NO: 63705 - DNA, 25 bp, Homo sapien
gaagcaaaaaccttctctcatttgt

SEQ ID NO: 63706 - DNA, 25 bp, Homo sapien
gaagcaaaaacgttctctcatttgt

SEQ ID NO: 63707 - DNA, 25 bp, Homo sapien
gaagcaaaaagagtactgttatcac

SEQ ID NO: 63708 - DNA, 25 bp, Homo sapien
gaagcaaaaagagtgctgttatcac

SEQ ID NO: 63709 - DNA, 25 bp, Homo sapien
gaagcaaaaccacgtcttacatggc

SEQ ID NO: 63710 - DNA, 25 bp, Homo sapien
gaagcaaaatcacgtcttacatggc

SEQ ID NO: 63711 - DNA, 25 bp, Homo sapien
gaagcaaacctgccatcttagaatt

SEQ ID NO: 63712 - DNA, 25 bp, Homo sapien
gaagcaaacgtgccatcttagaatt

SEQ ID NO: 63713 - DNA, 25 bp, Homo sapien
gaagcaaataccttcaaggttgagt

SEQ ID NO: 63714 - DNA, 25 bp, Homo sapien
gaagcaaatcccttcaaggttgagt

SEQ ID NO: 63715 - DNA, 25 bp, Homo sapien
gaagcaacagcaatcgtattcatag

SEQ ID NO: 63716 - DNA, 25 bp, Homo sapien
gaagcaacagcgatcgtattcatag

SEQ ID NO: 63717 - DNA, 25 bp, Homo sapien
gaagcaagactgggggcgcaaagag

SEQ ID NO: 63718 - DNA, 25 bp, Homo sapien
gaagcaagactgggggtgcaaagag

SEQ ID NO: 63719 - DNA, 25 bp, Homo sapien
gaagcaagaggctgagccacagagg

SEQ ID NO: 63720 - DNA, 25 bp, Homo sapien
gaagcaagaggctgagtcacagagg

SEQ ID NO: 63721 - DNA, 25 bp, Homo sapien
gaagcaagtccaagttaaatacatg

SEQ ID NO: 63722 - DNA, 25 bp, Homo sapien
gaagcaagtccaagttgaatacatg

SEQ ID NO: 63723 - DNA, 25 bp, Homo sapien
gaagcaagtctcacaattcaaggtg

SEQ ID NO: 63724 - DNA, 25 bp, Homo sapien
gaagcaagtctcgcaattcaaggtg

SEQ ID NO: 63725 - DNA, 25 bp, Homo sapien
gaagcaagtggacggtctccaactt

SEQ ID NO: 63726 - DNA, 25 bp, Homo sapien
gaagcaagtggatggtctccaactt

SEQ ID NO: 63727 - DNA, 25 bp, Homo sapien
gaagcacaacagatgagcagaaatt

SEQ ID NO: 63728 - DNA, 25 bp, Homo sapien
gaagcacaataccatatgttagctc

SEQ ID NO: 63729 - DNA, 25 bp, Homo sapien
gaagcacaatagatgagcagaaatt

SEQ ID NO: 63730 - DNA, 25 bp, Homo sapien
gaagcacaatatcatatgttagctc

SEQ ID NO: 63731 - DNA, 25 bp, Homo sapien
gaagcacacatagctgtttcactgc

SEQ ID NO: 63732 - DNA, 25 bp, Homo sapien
gaagcacacatagttgtttcactgc

SEQ ID NO: 63733 - DNA, 25 bp, Homo sapien
gaagcacagcgtatcccaaacagca

SEQ ID NO: 63734 - DNA, 25 bp, Homo sapien
gaagcacagtgtatcccaaacagca

SEQ ID NO: 63735 - DNA, 25 bp, Homo sapien
gaagcacctgttagtcgttctggca

SEQ ID NO: 63736 - DNA, 25 bp, Homo sapien
gaagcacctgttagtctttctggca

SEQ ID NO: 63737 - DNA, 25 bp, Homo sapien
gaagcagaaaactcaaaaacaaaca

SEQ ID NO: 63738 - DNA, 25 bp, Homo sapien
gaagcagaaaactcgaaaacaaaca

SEQ ID NO: 63739 - DNA, 25 bp, Homo sapien
gaagcagaaatcaattatgcctgtg

SEQ ID NO: 63740 - DNA, 25 bp, Homo sapien
gaagcagaaatcagttatgcctgtg

SEQ ID NO: 63741 - DNA, 25 bp, Homo sapien
gaagcagaatggtaaaccagctgca

SEQ ID NO: 63742 - DNA, 25 bp, Homo sapien
gaagcagaccataatatgataccta

SEQ ID NO: 63743 - DNA, 25 bp, Homo sapien
gaagcagaccatgatatgataccta

SEQ ID NO: 63744 - DNA, 25 bp, Homo sapien
gaagcagagcatggtatccccagag

SEQ ID NO: 63745 - DNA, 25 bp, Homo sapien
gaagcagaggatggtatccccagag

SEQ ID NO: 63746 - DNA, 25 bp, Homo sapien
gaagcagagtggtaaaccagctgca

SEQ ID NO: 63747 - DNA, 25 bp, Homo sapien
gaagcaggcaagaatatgtgggtgg

SEQ ID NO: 63748 - DNA, 25 bp, Homo sapien
gaagcaggcgagaatatgtgggtgg

SEQ ID NO: 63749 - DNA, 25 bp, Homo sapien
gaagcagggaacctaggactgattt

SEQ ID NO: 63750 - DNA, 25 bp, Homo sapien
gaagcagggaagctaggactgattt

SEQ ID NO: 63751 - DNA, 25 bp, Homo sapien
gaagcagggtcaacactgccaggtc

SEQ ID NO: 63752 - DNA, 25 bp, Homo sapien
gaagcagggtccacactgccaggtc

SEQ ID NO: 63753 - DNA, 25 bp, Homo sapien
gaagcagtcaaaagtccattgataa

SEQ ID NO: 63754 - DNA, 25 bp, Homo sapien
gaagcagtcaaatgtccattgataa

SEQ ID NO: 63755 - DNA, 25 bp, Homo sapien
gaagcagtcaggaacataagctact

SEQ ID NO: 63756 - DNA, 25 bp, Homo sapien
gaagcagtgaggaacataagctact

SEQ ID NO: 63757 - DNA, 25 bp, Homo sapien
gaagcataatagacggagtgtgtgg

SEQ ID NO: 63758 - DNA, 25 bp, Homo sapien
gaagcataatagatggagtgtgtgg

SEQ ID NO: 63759 - DNA, 25 bp, Homo sapien
gaagcatatttccgaagttttgcca

SEQ ID NO: 63760 - DNA, 25 bp, Homo sapien
gaagcatatttctgaagttttgcca

SEQ ID NO: 63761 - DNA, 25 bp, Homo sapien
gaagcatgtggcctgtactttctaa

SEQ ID NO: 63762 - DNA, 25 bp, Homo sapien
gaagcatgtggcgtgtactttctaa

SEQ ID NO: 63763 - DNA, 25 bp, Homo sapien
gaagcattagaacacatctgatctg

SEQ ID NO: 63764 - DNA, 25 bp, Homo sapien
gaagcattagaactcatctgatctg

SEQ ID NO: 63765 - DNA, 25 bp, Homo sapien
gaagcatttctacattaaacatgag

SEQ ID NO: 63766 - DNA, 25 bp, Homo sapien
gaagcatttctgcattaaacatgag

SEQ ID NO: 63767 - DNA, 25 bp, Homo sapien
gaagcatttggaaatgactggggac

SEQ ID NO: 63768 - DNA, 25 bp, Homo sapien
gaagcatttggaattgactggggac

SEQ ID NO: 63769 - DNA, 25 bp, Homo sapien
gaagcatttttgcagtttatcaatc

SEQ ID NO: 63770 - DNA, 25 bp, Homo sapien
gaagcatttttgccgtttatcaatc

SEQ ID NO: 63771 - DNA, 25 bp, Homo sapien
gaagccaaacatacttctaggcatt

SEQ ID NO: 63772 - DNA, 25 bp, Homo sapien
gaagccaaacatacttgtaggcatt

SEQ ID NO: 63773 - DNA, 25 bp, Homo sapien
gaagccaaatagaattttttattca

SEQ ID NO: 63774 - DNA, 25 bp, Homo sapien
gaagccaaatataattttttattca

SEQ ID NO: 63775 - DNA, 25 bp, Homo sapien
gaagccaagagaaaactcatttcag

SEQ ID NO: 63776 - DNA, 25 bp, Homo sapien
gaagccaagagacaactcatttcag

SEQ ID NO: 63777 - DNA, 25 bp, Homo sapien
gaagccaagagggctaacaggaaaa

SEQ ID NO: 63778 - DNA, 25 bp, Homo sapien
gaagccaagctgatgtattggtatt

SEQ ID NO: 63779 - DNA, 25 bp, Homo sapien
gaagccaagctgatgttttggtatt

SEQ ID NO: 63780 - DNA, 25 bp, Homo sapien
gaagccaagtgggctaacaggaaaa

SEQ ID NO: 63781 - DNA, 25 bp, Homo sapien
gaagccaatttccaatgattaaaag

SEQ ID NO: 63782 - DNA, 25 bp, Homo sapien
gaagccaatttccgatgattaaaag

SEQ ID NO: 63783 - DNA, 25 bp, Homo sapien
gaagccagacacaaaacgctacata

SEQ ID NO: 63784 - DNA, 25 bp, Homo sapien
gaagccagacacaaaaggctacata

SEQ ID NO: 63785 - DNA, 25 bp, Homo sapien
gaagccaggcaaagacattgattcc

SEQ ID NO: 63786 - DNA, 25 bp, Homo sapien
gaagccaggcaaagacgttgattcc

SEQ ID NO: 63787 - DNA, 25 bp, Homo sapien
gaagccatattcaaattcagccatt

SEQ ID NO: 63788 - DNA, 25 bp, Homo sapien
gaagccatattccaattcagccatt

SEQ ID NO: 63789 - DNA, 25 bp, Homo sapien
gaagccatgctgaacgtggggcatc

SEQ ID NO: 63790 - DNA, 25 bp, Homo sapien
gaagccatgctggacgtggggcatc

SEQ ID NO: 63791 - DNA, 25 bp, Homo sapien
gaagcccagcgccagggtaggaagg

SEQ ID NO: 63792 - DNA, 25 bp, Homo sapien
gaagcccagtgccagggtaggaagg

SEQ ID NO: 63793 - DNA, 25 bp, Homo sapien
gaagcctcaggaagtttacaagcat

SEQ ID NO: 63794 - DNA, 25 bp, Homo sapien
gaagcctcaggaattttacaagcat

SEQ ID NO: 63795 - DNA, 25 bp, Homo sapien
gaagccttgtaagaaaaccaggtgg

SEQ ID NO: 63796 - DNA, 25 bp, Homo sapien
gaagccttgtaagaaagccaggtgg

SEQ ID NO: 63797 - DNA, 25 bp, Homo sapien
gaagcgcacatttgatctaattgtg

SEQ ID NO: 63798 - DNA, 25 bp, Homo sapien
gaagcgcacgtttgatctaattgtg

SEQ ID NO: 63799 - DNA, 25 bp, Homo sapien
gaagcgctcatgcagccagaccctg

SEQ ID NO: 63800 - DNA, 25 bp, Homo sapien
gaagcgctcgtgcagccagaccctg

SEQ ID NO: 63801 - DNA, 25 bp, Homo sapien
gaagctaacagaatatgtttaccac

SEQ ID NO: 63802 - DNA, 25 bp, Homo sapien
gaagctaacagagtatgtttaccac

SEQ ID NO: 63803 - DNA, 25 bp, Homo sapien
gaagctacctttttcctaggagcta

SEQ ID NO: 63804 - DNA, 25 bp, Homo sapien
gaagctacggtacatttctatatcc

SEQ ID NO: 63805 - DNA, 25 bp, Homo sapien
gaagctacggtatatttctatatcc

SEQ ID NO: 63806 - DNA, 25 bp, Homo sapien
gaagctactgaaaaactgatttcta

SEQ ID NO: 63807 - DNA, 25 bp, Homo sapien
gaagctactgaaacactgatttcta

SEQ ID NO: 63808 - DNA, 25 bp, Homo sapien
gaagctacttttttcctaggagcta

SEQ ID NO: 63809 - DNA, 25 bp, Homo sapien
gaagctagaaaaataaaaccatcaa

SEQ ID NO: 63810 - DNA, 25 bp, Homo sapien
gaagctagaaaagtaaaaccatcaa

SEQ ID NO: 63811 - DNA, 25 bp, Homo sapien
gaagctagaacccaatgggacctag

SEQ ID NO: 63812 - DNA, 25 bp, Homo sapien
gaagctagaactcaatgggacctag

SEQ ID NO: 63813 - DNA, 25 bp, Homo sapien
gaagctaggtatgacaacagagaca

SEQ ID NO: 63814 - DNA, 25 bp, Homo sapien
gaagctaggtatgataacagagaca

SEQ ID NO: 63815 - DNA, 25 bp, Homo sapien
gaagctcaagtaccggagttcccaa

SEQ ID NO: 63816 - DNA, 25 bp, Homo sapien
gaagctcaagtactggagttcccaa

SEQ ID NO: 63817 - DNA, 25 bp, Homo sapien
gaagctcactttataaaacagggaa

SEQ ID NO: 63818 - DNA, 25 bp, Homo sapien
gaagctcagtttataaaacagggaa

SEQ ID NO: 63819 - DNA, 25 bp, Homo sapien
gaagctctcagtgtagggaacaagg

SEQ ID NO: 63820 - DNA, 25 bp, Homo sapien
gaagctctcagtttagggaacaagg

SEQ ID NO: 63821 - DNA, 25 bp, Homo sapien
gaagctgaccctgacgcaaagattc

SEQ ID NO: 63822 - DNA, 25 bp, Homo sapien
gaagctgaccctgatgcaaagattc

SEQ ID NO: 63823 - DNA, 25 bp, Homo sapien
gaagctgagaagcattcggctgatt

SEQ ID NO: 63824 - DNA, 25 bp, Homo sapien
gaagctgagaagcatttggctgatt

SEQ ID NO: 63825 - DNA, 25 bp, Homo sapien
gaagctgcaaaaaacaaggattttc

SEQ ID NO: 63826 - DNA, 25 bp, Homo sapien
gaagctgcaaaaagcaaggattttc

SEQ ID NO: 63827 - DNA, 25 bp, Homo sapien
gaagctgcaaaaaggctgtgttaac

SEQ ID NO: 63828 - DNA, 25 bp, Homo sapien
gaagctgcagaaaggctgtgttaac

SEQ ID NO: 63829 - DNA, 25 bp, Homo sapien
gaagctggccatttgggtgtgagta

SEQ ID NO: 63830 - DNA, 25 bp, Homo sapien
gaagctggctatttgggtgtgagta

SEQ ID NO: 63831 - DNA, 25 bp, Homo sapien
gaagctggggtggatgcgaacatga

SEQ ID NO: 63832 - DNA, 25 bp, Homo sapien
gaagctggggtggatgtgaacatga

SEQ ID NO: 63833 - DNA, 25 bp, Homo sapien
gaagctggtgcactctgaaaacaag

SEQ ID NO: 63834 - DNA, 25 bp, Homo sapien
gaagctggtgcattctgaaaacaag

SEQ ID NO: 63835 - DNA, 25 bp, Homo sapien
gaagctgttcttagcctcttaattt

SEQ ID NO: 63836 - DNA, 25 bp, Homo sapien
gaagctgtttttagcctcttaattt

SEQ ID NO: 63837 - DNA, 25 bp, Homo sapien
gaagcttatgactttgggttcctta

SEQ ID NO: 63838 - DNA, 25 bp, Homo sapien
gaagcttatgactttgtgttcctta

SEQ ID NO: 63839 - DNA, 25 bp, Homo sapien
gaagcttcatacccattagcggtca

SEQ ID NO: 63840 - DNA, 25 bp, Homo sapien
gaagcttcatacccgttagcggtca

SEQ ID NO: 63841 - DNA, 25 bp, Homo sapien
gaagcttcccaaaaatgcatacaac

SEQ ID NO: 63842 - DNA, 25 bp, Homo sapien
gaagcttcccaaaaattcatacaac

SEQ ID NO: 63843 - DNA, 25 bp, Homo sapien
gaagcttcccaaagttttaagtggg

SEQ ID NO: 63844 - DNA, 25 bp, Homo sapien
gaagcttctcaaagttttaagtggg

SEQ ID NO: 63845 - DNA, 25 bp, Homo sapien
gaagctttccagagcaggtaatgtc

SEQ ID NO: 63846 - DNA, 25 bp, Homo sapien
gaagctttccagagtaggtaatgtc

SEQ ID NO: 63847 - DNA, 25 bp, Homo sapien
gaaggaaaacctccaaacatcagca

SEQ ID NO: 63848 - DNA, 25 bp, Homo sapien
gaaggaaaacctccgaacatcagca

SEQ ID NO: 63849 - DNA, 25 bp, Homo sapien
gaaggaaaagtcagggaaatgtcat

SEQ ID NO: 63850 - DNA, 25 bp, Homo sapien
gaaggaaaattccgcactggtgctg

SEQ ID NO: 63851 - DNA, 25 bp, Homo sapien
gaaggaaaattctgcactggtgctg

SEQ ID NO: 63852 - DNA, 25 bp, Homo sapien
gaaggaaactcatataaatgtagga

SEQ ID NO: 63853 - DNA, 25 bp, Homo sapien
gaaggaaactcatatagatgtagga

SEQ ID NO: 63854 - DNA, 25 bp, Homo sapien
gaaggaaataccaccgcttcttatg

SEQ ID NO: 63855 - DNA, 25 bp, Homo sapien
gaaggaaataccactgcttcttatg

SEQ ID NO: 63856 - DNA, 25 bp, Homo sapien
gaaggaaatgtcagggaaatgtcat

SEQ ID NO: 63857 - DNA, 25 bp, Homo sapien
gaaggaacagctcaggtctcagtct

SEQ ID NO: 63858 - DNA, 25 bp, Homo sapien
gaaggaacggctcaggtctcagtct

SEQ ID NO: 63859 - DNA, 25 bp, Homo sapien
gaaggaagcaatgtgagttgaaaaa

SEQ ID NO: 63860 - DNA, 25 bp, Homo sapien
gaaggaagcaatttgagttgaaaaa

SEQ ID NO: 63861 - DNA, 25 bp, Homo sapien
gaaggaagtaaggatgatcagagcc

SEQ ID NO: 63862 - DNA, 25 bp, Homo sapien
gaaggaagtaagggtgatcagagcc

SEQ ID NO: 63863 - DNA, 25 bp, Homo sapien
gaaggaataaatgaccagcaataaa

SEQ ID NO: 63864 - DNA, 25 bp, Homo sapien
gaaggaataaatgaccggcaataaa

SEQ ID NO: 63865 - DNA, 25 bp, Homo sapien
gaaggaatgagggaacaatgaataa

SEQ ID NO: 63866 - DNA, 25 bp, Homo sapien
gaaggaatgcgggaacaatgaataa

SEQ ID NO: 63867 - DNA, 25 bp, Homo sapien
gaaggaatttgtatcttattgtaag

SEQ ID NO: 63868 - DNA, 25 bp, Homo sapien
gaaggaatttgtattttattgtaag

SEQ ID NO: 63869 - DNA, 25 bp, Homo sapien
gaaggacaacaagtagtgtgaaaca

SEQ ID NO: 63870 - DNA, 25 bp, Homo sapien
gaaggacaagaagtagtgtgaaaca

SEQ ID NO: 63871 - DNA, 25 bp, Homo sapien
gaaggacaattctactcagtgaaat

SEQ ID NO: 63872 - DNA, 25 bp, Homo sapien
gaaggacaccacattgaacccctgg

SEQ ID NO: 63873 - DNA, 25 bp, Homo sapien
gaaggacaccacgttgaacccctgg

SEQ ID NO: 63874 - DNA, 25 bp, Homo sapien
gaaggacagcatcacaggttataaa

SEQ ID NO: 63875 - DNA, 25 bp, Homo sapien
gaaggacagctagtgaagtaggaag

SEQ ID NO: 63876 - DNA, 25 bp, Homo sapien
gaaggacagctagttaagtaggaag

SEQ ID NO: 63877 - DNA, 25 bp, Homo sapien
gaaggacagtacttgtgctgaagaa

SEQ ID NO: 63878 - DNA, 25 bp, Homo sapien
gaaggacagtatcacaggttataaa

SEQ ID NO: 63879 - DNA, 25 bp, Homo sapien
gaaggacagtatttgtgctgaagaa

SEQ ID NO: 63880 - DNA, 25 bp, Homo sapien
gaaggacagttctactcagtgaaat

SEQ ID NO: 63881 - DNA, 25 bp, Homo sapien
gaaggaccctaacgaatacacctcc

SEQ ID NO: 63882 - DNA, 25 bp, Homo sapien
gaaggaccctaactaatacacctcc

SEQ ID NO: 63883 - DNA, 25 bp, Homo sapien
gaaggaccctttagactcttggaac

SEQ ID NO: 63884 - DNA, 25 bp, Homo sapien
gaaggaccttttagactcttggaac

SEQ ID NO: 63885 - DNA, 25 bp, Homo sapien
gaaggagaaaaacaagataaattaa

SEQ ID NO: 63886 - DNA, 25 bp, Homo sapien
gaaggagaaaagcaagataaattaa

SEQ ID NO: 63887 - DNA, 25 bp, Homo sapien
gaaggagaacttagtccgagtaaag

SEQ ID NO: 63888 - DNA, 25 bp, Homo sapien
gaaggagaacttagtctgagtaaag

SEQ ID NO: 63889 - DNA, 25 bp, Homo sapien
gaaggagaatgaaggagttaggttg

SEQ ID NO: 63890 - DNA, 25 bp, Homo sapien
gaaggagaatgagggagttaggttg

SEQ ID NO: 63891 - DNA, 25 bp, Homo sapien
gaaggagatagacaaggagatgaag

SEQ ID NO: 63892 - DNA, 25 bp, Homo sapien
gaaggagatagacgaggagatgaag

SEQ ID NO: 63893 - DNA, 25 bp, Homo sapien
gaaggagcctgggtacagaagtttc

SEQ ID NO: 63894 - DNA, 25 bp, Homo sapien
gaaggagcctgtgtacagaagtttc

SEQ ID NO: 63895 - DNA, 25 bp, Homo sapien
gaaggaggattgcattgtgaggact

SEQ ID NO: 63896 - DNA, 25 bp, Homo sapien
gaaggagggtggcacatgctcatca

SEQ ID NO: 63897 - DNA, 25 bp, Homo sapien
gaaggagggtggcgcatgctcatca

SEQ ID NO: 63898 - DNA, 25 bp, Homo sapien
gaaggagggttgcattgtgaggact

SEQ ID NO: 63899 - DNA, 25 bp, Homo sapien
gaaggagtatgattaccacctgcct

SEQ ID NO: 63900 - DNA, 25 bp, Homo sapien
gaaggagtgtgattaccacctgcct

SEQ ID NO: 63901 - DNA, 25 bp, Homo sapien
gaaggataccatataacttggcact

SEQ ID NO: 63902 - DNA, 25 bp, Homo sapien
gaaggataccatatgacttggcact

SEQ ID NO: 63903 - DNA, 25 bp, Homo sapien
gaaggataggaagagaaaactgcac

SEQ ID NO: 63904 - DNA, 25 bp, Homo sapien
gaaggataggaagggaaaactgcac

SEQ ID NO: 63905 - DNA, 25 bp, Homo sapien
gaaggatggagcatccaaatggcac

SEQ ID NO: 63906 - DNA, 25 bp, Homo sapien
gaaggatggagtatccaaatggcac

SEQ ID NO: 63907 - DNA, 25 bp, Homo sapien
gaaggattcagttaagtttgttcat

SEQ ID NO: 63908 - DNA, 25 bp, Homo sapien
gaaggattcagttacgtttgttcat

SEQ ID NO: 63909 - DNA, 25 bp, Homo sapien
gaaggatttactcacccacaaaagt

SEQ ID NO: 63910 - DNA, 25 bp, Homo sapien
gaaggatttactcagccacaaaagt

SEQ ID NO: 63911 - DNA, 25 bp, Homo sapien
gaaggcaagacctcaactgcttcat

SEQ ID NO: 63912 - DNA, 25 bp, Homo sapien
gaaggcaagaccttaactgcttcat

SEQ ID NO: 63913 - DNA, 25 bp, Homo sapien
gaaggcaagaggacatagtaggtac

SEQ ID NO: 63914 - DNA, 25 bp, Homo sapien
gaaggcaagaggacatggtaggtac

SEQ ID NO: 63915 - DNA, 25 bp, Homo sapien
gaaggcactccagtccccaaagatt

SEQ ID NO: 63916 - DNA, 25 bp, Homo sapien
gaaggcactccagtccgcaaagatt

SEQ ID NO: 63917 - DNA, 25 bp, Homo sapien
gaaggcactgaaaaaatatatattt

SEQ ID NO: 63918 - DNA, 25 bp, Homo sapien
gaaggcactgagaaaatatatattt

SEQ ID NO: 63919 - DNA, 25 bp, Homo sapien
gaaggcagactcatgattattccaa

SEQ ID NO: 63920 - DNA, 25 bp, Homo sapien
gaaggcagactcgtgattattccaa

SEQ ID NO: 63921 - DNA, 25 bp, Homo sapien
gaaggcaggtgcctctgctttgccg

SEQ ID NO: 63922 - DNA, 25 bp, Homo sapien
gaaggcaggtgcttctgctttgccg

SEQ ID NO: 63923 - DNA, 25 bp, Homo sapien
gaaggcatgaagacatttatgtggt

SEQ ID NO: 63924 - DNA, 25 bp, Homo sapien
gaaggcatgaaggcatttatgtggt

SEQ ID NO: 63925 - DNA, 25 bp, Homo sapien
gaaggccacctggcaggaatccctc

SEQ ID NO: 63926 - DNA, 25 bp, Homo sapien
gaaggccacctgtcaggaatccctc

SEQ ID NO: 63927 - DNA, 25 bp, Homo sapien
gaaggccagactgaagaggtcacag

SEQ ID NO: 63928 - DNA, 25 bp, Homo sapien
gaaggccagacttaagaggtcacag

SEQ ID NO: 63929 - DNA, 25 bp, Homo sapien
gaaggccagtgatatacagtagtag

SEQ ID NO: 63930 - DNA, 25 bp, Homo sapien
gaaggccagtgatatagagtagtag

SEQ ID NO: 63931 - DNA, 25 bp, Homo sapien
gaaggccatcttgtaccgcaaacaa

SEQ ID NO: 63932 - DNA, 25 bp, Homo sapien
gaaggccatcttgtactgcaaacaa

SEQ ID NO: 63933 - DNA, 25 bp, Homo sapien
gaaggccatgaataacctcttgcct

SEQ ID NO: 63934 - DNA, 25 bp, Homo sapien
gaaggccatgaatagcctcttgcct

SEQ ID NO: 63935 - DNA, 25 bp, Homo sapien
gaaggccatttgacataacaaaaac

SEQ ID NO: 63936 - DNA, 25 bp, Homo sapien
gaaggccatttggcataacaaaaac

SEQ ID NO: 63937 - DNA, 25 bp, Homo sapien
gaaggcgagcaaacgccagcaaggt

SEQ ID NO: 63938 - DNA, 25 bp, Homo sapien
gaaggcgagcaaacgctagcaaggt

SEQ ID NO: 63939 - DNA, 25 bp, Homo sapien
gaaggctactggaataatatttttg

SEQ ID NO: 63940 - DNA, 25 bp, Homo sapien
gaaggctactggagtaatatttttg

SEQ ID NO: 63941 - DNA, 25 bp, Homo sapien
gaaggctcactctactttcaagatg

SEQ ID NO: 63942 - DNA, 25 bp, Homo sapien
gaaggctcactgtactttcaagatg

SEQ ID NO: 63943 - DNA, 25 bp, Homo sapien
gaaggctctgcaactagatctgtgg

SEQ ID NO: 63944 - DNA, 25 bp, Homo sapien
gaaggctctgcagctagatctgtgg

SEQ ID NO: 63945 - DNA, 25 bp, Homo sapien
gaaggctgcatcgtcagcttcccta

SEQ ID NO: 63946 - DNA, 25 bp, Homo sapien
gaaggctgcattgtcagcttcccta

SEQ ID NO: 63947 - DNA, 25 bp, Homo sapien
gaaggcttaaaataaccagtcccta

SEQ ID NO: 63948 - DNA, 25 bp, Homo sapien
gaaggcttaaaatagccagtcccta

SEQ ID NO: 63949 - DNA, 25 bp, Homo sapien
gaagggaagccaacttccgatgatt

SEQ ID NO: 63950 - DNA, 25 bp, Homo sapien
gaagggaagccaatttccgatgatt

SEQ ID NO: 63951 - DNA, 25 bp, Homo sapien
gaagggaatgaaccagtgttttcca

SEQ ID NO: 63952 - DNA, 25 bp, Homo sapien
gaagggaatgaaccggtgttttcca

SEQ ID NO: 63953 - DNA, 25 bp, Homo sapien
gaagggaatggagatccaggtttct

SEQ ID NO: 63954 - DNA, 25 bp, Homo sapien
gaagggaatggaggtccaggtttct

SEQ ID NO: 63955 - DNA, 25 bp, Homo sapien
gaagggacccgcagcttcaattctg

SEQ ID NO: 63956 - DNA, 25 bp, Homo sapien
gaagggacctgcagcttcaattctg

SEQ ID NO: 63957 - DNA, 25 bp, Homo sapien
gaagggagatcaacatgaaatgaac

SEQ ID NO: 63958 - DNA, 25 bp, Homo sapien
gaagggagatcaatatgaaatgaac

SEQ ID NO: 63959 - DNA, 25 bp, Homo sapien
gaagggaggatcaatcgcttgagcc

SEQ ID NO: 63960 - DNA, 25 bp, Homo sapien
gaagggaggatcgatcgcttgagcc

SEQ ID NO: 63961 - DNA, 25 bp, Homo sapien
gaagggccactccaaactcttgaaa

SEQ ID NO: 63962 - DNA, 25 bp, Homo sapien
gaagggccactctaaactcttgaaa

SEQ ID NO: 63963 - DNA, 25 bp, Homo sapien
gaagggcgtgcctcttaatgcagtc

SEQ ID NO: 63964 - DNA, 25 bp, Homo sapien
gaagggcgtgcctcttgatgcagtc

SEQ ID NO: 63965 - DNA, 25 bp, Homo sapien
gaaggggtggcatgtccaaagactc

SEQ ID NO: 63966 - DNA, 25 bp, Homo sapien
gaaggggtggcatgtcgaaagactc

SEQ ID NO: 63967 - DNA, 25 bp, Homo sapien
gaaggggtttgagttgagccaggat

SEQ ID NO: 63968 - DNA, 25 bp, Homo sapien
gaaggggtttgatttgagccaggat

SEQ ID NO: 63969 - DNA, 25 bp, Homo sapien
gaagggtaagagacttaggactcag

SEQ ID NO: 63970 - DNA, 25 bp, Homo sapien
gaagggtaggagacttaggactcag

SEQ ID NO: 63971 - DNA, 25 bp, Homo sapien
gaagggtcatctacatggatactga

SEQ ID NO: 63972 - DNA, 25 bp, Homo sapien
gaagggtcatctacgtggatactga

SEQ ID NO: 63973 - DNA, 25 bp, Homo sapien
gaagggttaatgttttgtattattt

SEQ ID NO: 63974 - DNA, 25 bp, Homo sapien
gaagggttattgttttgtattattt

SEQ ID NO: 63975 - DNA, 25 bp, Homo sapien
gaaggtacaaaaatgacctgtgatt

SEQ ID NO: 63976 - DNA, 25 bp, Homo sapien
gaaggtaccaaaatgacctgtgatt

SEQ ID NO: 63977 - DNA, 25 bp, Homo sapien
gaaggtagggcactacagaacaagt

SEQ ID NO: 63978 - DNA, 25 bp, Homo sapien
gaaggtagggcgctacagaacaagt

SEQ ID NO: 63979 - DNA, 25 bp, Homo sapien
gaaggtattacaagtcatgccacag

SEQ ID NO: 63980 - DNA, 25 bp, Homo sapien
gaaggtattacaagtcgtgccacag

SEQ ID NO: 63981 - DNA, 25 bp, Homo sapien
gaaggtattatgatctttacactaa

SEQ ID NO: 63982 - DNA, 25 bp, Homo sapien
gaaggtattatgctctttacactaa

SEQ ID NO: 63983 - DNA, 25 bp, Homo sapien
gaaggtcagttaagagaagactaaa

SEQ ID NO: 63984 - DNA, 25 bp, Homo sapien
gaaggtcagttgagagaagactaaa

SEQ ID NO: 63985 - DNA, 25 bp, Homo sapien
gaaggtgaacttggcatcagaaaca

SEQ ID NO: 63986 - DNA, 25 bp, Homo sapien
gaaggtgaactttgcatcagaaaca

SEQ ID NO: 63987 - DNA, 25 bp, Homo sapien
gaaggtgaccactcctcgggaatag

SEQ ID NO: 63988 - DNA, 25 bp, Homo sapien
gaaggtgaccagtcctcgggaatag

SEQ ID NO: 63989 - DNA, 25 bp, Homo sapien
gaaggtggagacatatgtgtcaaga

SEQ ID NO: 63990 - DNA, 25 bp, Homo sapien
gaaggtggagacgtatgtgtcaaga

SEQ ID NO: 63991 - DNA, 25 bp, Homo sapien
gaaggtggtgctgagaaggatctta

SEQ ID NO: 63992 - DNA, 25 bp, Homo sapien
gaaggtggttctgagaaggatctta

SEQ ID NO: 63993 - DNA, 25 bp, Homo sapien
gaaggtgtggcccaaagtcccaatc

SEQ ID NO: 63994 - DNA, 25 bp, Homo sapien
gaaggtgtggcccagagtcccaatc

SEQ ID NO: 63995 - DNA, 25 bp, Homo sapien
gaaggttaaattataggtcaagaat

SEQ ID NO: 63996 - DNA, 25 bp, Homo sapien
gaaggttaaattgtaggtcaagaat

SEQ ID NO: 63997 - DNA, 25 bp, Homo sapien
gaaggttcctgcaattctaacattt

SEQ ID NO: 63998 - DNA, 25 bp, Homo sapien
gaaggttcctgcagttctaacattt

SEQ ID NO: 63999 - DNA, 25 bp, Homo sapien
gaaggttctctgcagaacaaggcag

SEQ ID NO: 64000 - DNA, 25 bp, Homo sapien
gaaggttctctgtagaacaaggcag

SEQ ID NO: 64001 - DNA, 25 bp, Homo sapien
gaaggttgagtaccgatactggggg

SEQ ID NO: 64002 - DNA, 25 bp, Homo sapien
gaaggttgagtacggatactggggg

SEQ ID NO: 64003 - DNA, 25 bp, Homo sapien
gaaggttgatatcattttctgagat

SEQ ID NO: 64004 - DNA, 25 bp, Homo sapien
gaaggttggtatcattttctgagat

SEQ ID NO: 64005 - DNA, 25 bp, Homo sapien
gaaggttgtctcatcactgctaatg

SEQ ID NO: 64006 - DNA, 25 bp, Homo sapien
gaaggttgtctcatgactgctaatg

SEQ ID NO: 64007 - DNA, 25 bp, Homo sapien
gaaggtttccagagatcacatgtgg

SEQ ID NO: 64008 - DNA, 25 bp, Homo sapien
gaaggtttccagcgatcacatgtgg

SEQ ID NO: 64009 - DNA, 25 bp, Homo sapien
gaaggttttggcttctgagttcagg

SEQ ID NO: 64010 - DNA, 25 bp, Homo sapien
gaaggttttgggttctgagttcagg

SEQ ID NO: 64011 - DNA, 25 bp, Homo sapien
gaagtaacagtcacaacagcatttt

SEQ ID NO: 64012 - DNA, 25 bp, Homo sapien
gaagtaacagttacaacagcatttt

SEQ ID NO: 64013 - DNA, 25 bp, Homo sapien
gaagtaagcttggacagctgagttc

SEQ ID NO: 64014 - DNA, 25 bp, Homo sapien
gaagtaagcttggccagctgagttc

SEQ ID NO: 64015 - DNA, 25 bp, Homo sapien
gaagtaaggatgatcagagccctag

SEQ ID NO: 64016 - DNA, 25 bp, Homo sapien
gaagtaagggtgatcagagccctag

SEQ ID NO: 64017 - DNA, 25 bp, Homo sapien
gaagtaatattgcccttgctccaaa

SEQ ID NO: 64018 - DNA, 25 bp, Homo sapien
gaagtaatattgcctttgctccaaa

SEQ ID NO: 64019 - DNA, 25 bp, Homo sapien
gaagtaccactttaacccaccagac

SEQ ID NO: 64020 - DNA, 25 bp, Homo sapien
gaagtaccattttaacccaccagac

SEQ ID NO: 64021 - DNA, 25 bp, Homo sapien
gaagtagaaatgcttggagataaaa

SEQ ID NO: 64022 - DNA, 25 bp, Homo sapien
gaagtagaaattcttggagataaaa

SEQ ID NO: 64023 - DNA, 25 bp, Homo sapien
gaagtagataataagactgttgcct

SEQ ID NO: 64024 - DNA, 25 bp, Homo sapien
gaagtagataatcagactgttgcct

SEQ ID NO: 64025 - DNA, 25 bp, Homo sapien
gaagtagcagcaaacctaatgctct

SEQ ID NO: 64026 - DNA, 25 bp, Homo sapien
gaagtagcagcagacctaatgctct

SEQ ID NO: 64027 - DNA, 25 bp, Homo sapien
gaagtagccagggacatttgtcttt

SEQ ID NO: 64028 - DNA, 25 bp, Homo sapien
gaagtagccagggatatttgtcttt

SEQ ID NO: 64029 - DNA, 25 bp, Homo sapien
gaagtaggtactattaattatccac

SEQ ID NO: 64030 - DNA, 25 bp, Homo sapien
gaagtaggtactattatttatccac

SEQ ID NO: 64031 - DNA, 25 bp, Homo sapien
gaagtagttgttctcagatgtgggg

SEQ ID NO: 64032 - DNA, 25 bp, Homo sapien
gaagtagttgttttcagatgtgggg

SEQ ID NO: 64033 - DNA, 25 bp, Homo sapien
gaagtatcaaggtatatatgaagag

SEQ ID NO: 64034 - DNA, 25 bp, Homo sapien
gaagtatcagggtatatatgaagag

SEQ ID NO: 64035 - DNA, 25 bp, Homo sapien
gaagtattaatagcagaagagacaa

SEQ ID NO: 64036 - DNA, 25 bp, Homo sapien
gaagtattaatggcagaagagacaa

SEQ ID NO: 64037 - DNA, 25 bp, Homo sapien
gaagtcaaacaagaccatgaaccca

SEQ ID NO: 64038 - DNA, 25 bp, Homo sapien
gaagtcaagcaagaccatgaaccca

SEQ ID NO: 64039 - DNA, 25 bp, Homo sapien
gaagtcaagctgtgcaaagtcaatt

SEQ ID NO: 64040 - DNA, 25 bp, Homo sapien
gaagtcaagctgtgcagagtcaatt

SEQ ID NO: 64041 - DNA, 25 bp, Homo sapien
gaagtcaggccagcagtctgaaaat

SEQ ID NO: 64042 - DNA, 25 bp, Homo sapien
gaagtcaggccggcagtctgaaaat

SEQ ID NO: 64043 - DNA, 25 bp, Homo sapien
gaagtcagttgcatcacaccctaag

SEQ ID NO: 64044 - DNA, 25 bp, Homo sapien
gaagtcagttgcgtcacaccctaag

SEQ ID NO: 64045 - DNA, 25 bp, Homo sapien
gaagtcatagaggacacttatggga

SEQ ID NO: 64046 - DNA, 25 bp, Homo sapien
gaagtcatagagtacacttatggga

SEQ ID NO: 64047 - DNA, 25 bp, Homo sapien
gaagtcataggaacacaaggcctct

SEQ ID NO: 64048 - DNA, 25 bp, Homo sapien
gaagtcatgaaagtaaccagtggaa

SEQ ID NO: 64049 - DNA, 25 bp, Homo sapien
gaagtcatggaagtaaccagtggaa

SEQ ID NO: 64050 - DNA, 25 bp, Homo sapien
gaagtcatgggaacacaaggcctct

SEQ ID NO: 64051 - DNA, 25 bp, Homo sapien
gaagtcattgattcaacaatagcta

SEQ ID NO: 64052 - DNA, 25 bp, Homo sapien
gaagtcattgattcaagaatagcta

SEQ ID NO: 64053 - DNA, 25 bp, Homo sapien
gaagtccacatttttcttaaatcca

SEQ ID NO: 64054 - DNA, 25 bp, Homo sapien
gaagtccatatttttcttaaatcca

SEQ ID NO: 64055 - DNA, 25 bp, Homo sapien
gaagtcccatcaacacttcatgaaa

SEQ ID NO: 64056 - DNA, 25 bp, Homo sapien
gaagtcccatcaccacttcatgaaa

SEQ ID NO: 64057 - DNA, 25 bp, Homo sapien
gaagtccgtacttgccattttctct

SEQ ID NO: 64058 - DNA, 25 bp, Homo sapien
gaagtccgtacttggcattttctct

SEQ ID NO: 64059 - DNA, 25 bp, Homo sapien
gaagtctcaaaattaatgttccagt

SEQ ID NO: 64060 - DNA, 25 bp, Homo sapien
gaagtctcaaaatttatgttccagt

SEQ ID NO: 64061 - DNA, 25 bp, Homo sapien
gaagtctctttcatcagttggaggt

SEQ ID NO: 64062 - DNA, 25 bp, Homo sapien
gaagtctctttcgtcaattggaggt

SEQ ID NO: 64063 - DNA, 25 bp, Homo sapien
gaagtctctttcgtcagttggaggt

SEQ ID NO: 64064 - DNA, 25 bp, Homo sapien
gaagtctgatttaaaactatttatg

SEQ ID NO: 64065 - DNA, 25 bp, Homo sapien
gaagtctgatttaaaagtatttatg

SEQ ID NO: 64066 - DNA, 25 bp, Homo sapien
gaagtcttagaagcgttgttttttc

SEQ ID NO: 64067 - DNA, 25 bp, Homo sapien
gaagtcttagaagggttgttttttc

SEQ ID NO: 64068 - DNA, 25 bp, Homo sapien
gaagtcttcttgcagttactaatta

SEQ ID NO: 64069 - DNA, 25 bp, Homo sapien
gaagtctttttgcagttactaatta

SEQ ID NO: 64070 - DNA, 25 bp, Homo sapien
gaagtgaaaatgatatgtagaatca

SEQ ID NO: 64071 - DNA, 25 bp, Homo sapien
gaagtgaaaattatatgtagaatca

SEQ ID NO: 64072 - DNA, 25 bp, Homo sapien
gaagtgaaactcagataaattaaat

SEQ ID NO: 64073 - DNA, 25 bp, Homo sapien
gaagtgaaactcggataaattaaat

SEQ ID NO: 64074 - DNA, 25 bp, Homo sapien
gaagtgaaccgatgttctgtttctg

SEQ ID NO: 64075 - DNA, 25 bp, Homo sapien
gaagtgaactgatgttctgtttctg

SEQ ID NO: 64076 - DNA, 25 bp, Homo sapien
gaagtgaagcgtaaaatctaatctc

SEQ ID NO: 64077 - DNA, 25 bp, Homo sapien
gaagtgaagtgtaaaatctaatctc

SEQ ID NO: 64078 - DNA, 25 bp, Homo sapien
gaagtgaatcttatgactcttaacc

SEQ ID NO: 64079 - DNA, 25 bp, Homo sapien
gaagtgaatcttatgagtcttaacc

SEQ ID NO: 64080 - DNA, 25 bp, Homo sapien
gaagtgaattaaacagagaagacta

SEQ ID NO: 64081 - DNA, 25 bp, Homo sapien
gaagtgaattaaacggagaagacta

SEQ ID NO: 64082 - DNA, 25 bp, Homo sapien
gaagtgaccagacccaggagtctct

SEQ ID NO: 64083 - DNA, 25 bp, Homo sapien
gaagtgaccggacccaggagtctct

SEQ ID NO: 64084 - DNA, 25 bp, Homo sapien
gaagtgactctcattgcgtgaattc

SEQ ID NO: 64085 - DNA, 25 bp, Homo sapien
gaagtgactctcattgtgtgaattc

SEQ ID NO: 64086 - DNA, 25 bp, Homo sapien
gaagtgactttcaaactagggtgag

SEQ ID NO: 64087 - DNA, 25 bp, Homo sapien
gaagtgactttcatactagggtgag

SEQ ID NO: 64088 - DNA, 25 bp, Homo sapien
gaagtgatatgacctcggtgtttat

SEQ ID NO: 64089 - DNA, 25 bp, Homo sapien
gaagtgatatgacttcggtgtttat

SEQ ID NO: 64090 - DNA, 25 bp, Homo sapien
gaagtgatgcgataacagctccttt

SEQ ID NO: 64091 - DNA, 25 bp, Homo sapien
gaagtgatgtgataacagctccttt

SEQ ID NO: 64092 - DNA, 25 bp, Homo sapien
gaagtgatgtttaagaataattttc

SEQ ID NO: 64093 - DNA, 25 bp, Homo sapien
gaagtgatgtttaagagtaattttc

SEQ ID NO: 64094 - DNA, 25 bp, Homo sapien
gaagtgattctccttcacttttgct

SEQ ID NO: 64095 - DNA, 25 bp, Homo sapien
gaagtgattctctttcacttttgct

SEQ ID NO: 64096 - DNA, 25 bp, Homo sapien
gaagtgattttaatcgtatgtccat

SEQ ID NO: 64097 - DNA, 25 bp, Homo sapien
gaagtgattttaatggtatgtccat

SEQ ID NO: 64098 - DNA, 25 bp, Homo sapien
gaagtgcaaggatcaaaggctcaca

SEQ ID NO: 64099 - DNA, 25 bp, Homo sapien
gaagtgcaagggtcaaaggctcaca

SEQ ID NO: 64100 - DNA, 25 bp, Homo sapien
gaagtgcatacgccgaagaggcatt

SEQ ID NO: 64101 - DNA, 25 bp, Homo sapien
gaagtgcatacgctgaagaggcatt

SEQ ID NO: 64102 - DNA, 25 bp, Homo sapien
gaagtgccaccaaacctctgataca

SEQ ID NO: 64103 - DNA, 25 bp, Homo sapien
gaagtgccgccaaacctctgataca

SEQ ID NO: 64104 - DNA, 25 bp, Homo sapien
gaagtgccttacacgttcacgcagt

SEQ ID NO: 64105 - DNA, 25 bp, Homo sapien
gaagtgccttacatgttcacgcagt

SEQ ID NO: 64106 - DNA, 25 bp, Homo sapien
gaagtgcgtttaatgtagaggtgac

SEQ ID NO: 64107 - DNA, 25 bp, Homo sapien
gaagtgcgtttaatttagaggtgac

SEQ ID NO: 64108 - DNA, 25 bp, Homo sapien
gaagtggaccttgatgtgactcctg

SEQ ID NO: 64109 - DNA, 25 bp, Homo sapien
gaagtggaccttggtgtgactcctg

SEQ ID NO: 64110 - DNA, 25 bp, Homo sapien
gaagtggctcttcccatggacagtc

SEQ ID NO: 64111 - DNA, 25 bp, Homo sapien
gaagtggctcttcgcatggacagtc

SEQ ID NO: 64112 - DNA, 25 bp, Homo sapien
gaagtggtcaaaagcagaatttaaa

SEQ ID NO: 64113 - DNA, 25 bp, Homo sapien
gaagtggtcaaaagtagaatttaaa

SEQ ID NO: 64114 - DNA, 25 bp, Homo sapien
gaagtgtctgaacacagcctacaca

SEQ ID NO: 64115 - DNA, 25 bp, Homo sapien
gaagtgtctgaacatagcctacaca

SEQ ID NO: 64116 - DNA, 25 bp, Homo sapien
gaagtgtctggtttctatcacttag

SEQ ID NO: 64117 - DNA, 25 bp, Homo sapien
gaagtgtctggtttctgtcacttag

SEQ ID NO: 64118 - DNA, 25 bp, Homo sapien
gaagtgtgaatgacaatagcacaga

SEQ ID NO: 64119 - DNA, 25 bp, Homo sapien
gaagtgtgaatgagaatagcacaga

SEQ ID NO: 64120 - DNA, 25 bp, Homo sapien
gaagtgtgacctaaaccggtgatgg

SEQ ID NO: 64121 - DNA, 25 bp, Homo sapien
gaagtgtgagctaaaccggtgatgg

SEQ ID NO: 64122 - DNA, 25 bp, Homo sapien
gaagtgtgtaaaataccaggctgct

SEQ ID NO: 64123 - DNA, 25 bp, Homo sapien
gaagtgtgtaaaatgccaggctgct

SEQ ID NO: 64124 - DNA, 25 bp, Homo sapien
gaagtgtgtcatacgctgccaagtt

SEQ ID NO: 64125 - DNA, 25 bp, Homo sapien
gaagtgtgtcataggctgccaagtt

SEQ ID NO: 64126 - DNA, 25 bp, Homo sapien
gaagtgttaatcatttacacaagca

SEQ ID NO: 64127 - DNA, 25 bp, Homo sapien
gaagtgttaatcgtttacacaagca

SEQ ID NO: 64128 - DNA, 25 bp, Homo sapien
gaagtgttcctcaatcttggtgcta

SEQ ID NO: 64129 - DNA, 25 bp, Homo sapien
gaagtgttcctcagtcttggtgcta

SEQ ID NO: 64130 - DNA, 25 bp, Homo sapien
gaagtgttttacacatcctgaggtt

SEQ ID NO: 64131 - DNA, 25 bp, Homo sapien
gaagtgttttacatatcctgaggtt

SEQ ID NO: 64132 - DNA, 25 bp, Homo sapien
gaagttaaagctgaagctatttgcc

SEQ ID NO: 64133 - DNA, 25 bp, Homo sapien
gaagttaaagctgaggctatttgcc

SEQ ID NO: 64134 - DNA, 25 bp, Homo sapien
gaagttaaattatctgtttatatca

SEQ ID NO: 64135 - DNA, 25 bp, Homo sapien
gaagttaaattatttgtttatatca

SEQ ID NO: 64136 - DNA, 25 bp, Homo sapien
gaagttattactgtttcttgtaaga

SEQ ID NO: 64137 - DNA, 25 bp, Homo sapien
gaagttattcctgtttcttgtaaga

SEQ ID NO: 64138 - DNA, 25 bp, Homo sapien
gaagttcagttgctttgcagataaa

SEQ ID NO: 64139 - DNA, 25 bp, Homo sapien
gaagttcatttgctttgcagataaa

SEQ ID NO: 64140 - DNA, 25 bp, Homo sapien
gaagttcctccaattcagaaaggga

SEQ ID NO: 64141 - DNA, 25 bp, Homo sapien
gaagttcctccagttcagaaaggga

SEQ ID NO: 64142 - DNA, 25 bp, Homo sapien
gaagttcttccaagccaccaccgaa

SEQ ID NO: 64143 - DNA, 25 bp, Homo sapien
gaagttcttccaggccaccaccgaa

SEQ ID NO: 64144 - DNA, 25 bp, Homo sapien
gaagttcttctatggccggcatgac

SEQ ID NO: 64145 - DNA, 25 bp, Homo sapien
gaagttcttctatggctggcatgac

SEQ ID NO: 64146 - DNA, 25 bp, Homo sapien
gaagttgcatgtattgtgttaattt

SEQ ID NO: 64147 - DNA, 25 bp, Homo sapien
gaagttgccatatccatttctgtga

SEQ ID NO: 64148 - DNA, 25 bp, Homo sapien
gaagttgccatatctatttctgtga

SEQ ID NO: 64149 - DNA, 25 bp, Homo sapien
gaagttgcgtgtattgtgttaattt

SEQ ID NO: 64150 - DNA, 25 bp, Homo sapien
gaagttgtgcacatgcccatctgtg

SEQ ID NO: 64151 - DNA, 25 bp, Homo sapien
gaagttgtgcacatgctcatctgtg

SEQ ID NO: 64152 - DNA, 25 bp, Homo sapien
gaagtttacatttcatattggacca

SEQ ID NO: 64153 - DNA, 25 bp, Homo sapien
gaagtttacttttcatattggacca

SEQ ID NO: 64154 - DNA, 25 bp, Homo sapien
gaagtttcaaaacagggccactcca

SEQ ID NO: 64155 - DNA, 25 bp, Homo sapien
gaagtttcaaaacggggccactcca

SEQ ID NO: 64156 - DNA, 25 bp, Homo sapien
gaagtttgatttttaaaatgctgat

SEQ ID NO: 64157 - DNA, 25 bp, Homo sapien
gaagtttgcataagtctgtccattc

SEQ ID NO: 64158 - DNA, 25 bp, Homo sapien
gaagtttgcatgagtctgtccattc

SEQ ID NO: 64159 - DNA, 25 bp, Homo sapien
gaagtttgttttttaaaatgctgat

SEQ ID NO: 64160 - DNA, 25 bp, Homo sapien
gaagttttaaataaggaacacaatg

SEQ ID NO: 64161 - DNA, 25 bp, Homo sapien
gaagttttaaatacggaacacaatg

SEQ ID NO: 64162 - DNA, 25 bp, Homo sapien
gaagttttccctacctaacactttc

SEQ ID NO: 64163 - DNA, 25 bp, Homo sapien
gaagttttctctacctaacactttc

SEQ ID NO: 64164 - DNA, 25 bp, Homo sapien
gaataaaaaagataatgcaggtact

SEQ ID NO: 64165 - DNA, 25 bp, Homo sapien
gaataaaaaagcgaaacagccttat

SEQ ID NO: 64166 - DNA, 25 bp, Homo sapien
gaataaaaaagctaaacagccttat

SEQ ID NO: 64167 - DNA, 25 bp, Homo sapien
gaataaaaaaggtaatgcaggtact

SEQ ID NO: 64168 - DNA, 25 bp, Homo sapien
gaataaaaatgttcacgaattaagt

SEQ ID NO: 64169 - DNA, 25 bp, Homo sapien
gaataaaaatgttcgcgaattaagt

SEQ ID NO: 64170 - DNA, 25 bp, Homo sapien
gaataaaacagaagatatggaggtg

SEQ ID NO: 64171 - DNA, 25 bp, Homo sapien
gaataaaacagaaggtatggaggtg

SEQ ID NO: 64172 - DNA, 25 bp, Homo sapien
gaataaaaccgttctcaggatgcag

SEQ ID NO: 64173 - DNA, 25 bp, Homo sapien
gaataaaactgattgcccttattca

SEQ ID NO: 64174 - DNA, 25 bp, Homo sapien
gaataaaactgatttcccttattca

SEQ ID NO: 64175 - DNA, 25 bp, Homo sapien
gaataaaactgttctcaggatgcag

SEQ ID NO: 64176 - DNA, 25 bp, Homo sapien
gaataaaagacccacaatccaatta

SEQ ID NO: 64177 - DNA, 25 bp, Homo sapien
gaataaaagacctacaatccaatta

SEQ ID NO: 64178 - DNA, 25 bp, Homo sapien
gaataaaatatttgaaaggaaagcc

SEQ ID NO: 64179 - DNA, 25 bp, Homo sapien
gaataaaatatttgaatggaaagcc

SEQ ID NO: 64180 - DNA, 25 bp, Homo sapien
gaataaaatctagcatcgctttatg

SEQ ID NO: 64181 - DNA, 25 bp, Homo sapien
gaataaaatctagcatggctttatg

SEQ ID NO: 64182 - DNA, 25 bp, Homo sapien
gaataaacaaatacgaaatcttaac

SEQ ID NO: 64183 - DNA, 25 bp, Homo sapien
gaataaacaaatactaaatcttaac

SEQ ID NO: 64184 - DNA, 25 bp, Homo sapien
gaataaacaaggattcctaaatctc

SEQ ID NO: 64185 - DNA, 25 bp, Homo sapien
gaataaacaaggattcttaaatctc

SEQ ID NO: 64186 - DNA, 25 bp, Homo sapien
gaataaactcagaaaagaatcaaag

SEQ ID NO: 64187 - DNA, 25 bp, Homo sapien
gaataaactcagaagagaatcaaag

SEQ ID NO: 64188 - DNA, 25 bp, Homo sapien
gaataaagacaaatgagaacagatc

SEQ ID NO: 64189 - DNA, 25 bp, Homo sapien
gaataaagacaaatgataacagatc

SEQ ID NO: 64190 - DNA, 25 bp, Homo sapien
gaataaagacgaaaggatgagtttg

SEQ ID NO: 64191 - DNA, 25 bp, Homo sapien
gaataaagatgaaaggatgagtttg

SEQ ID NO: 64192 - DNA, 25 bp, Homo sapien
gaataaaggatccaaaaaccagaca

SEQ ID NO: 64193 - DNA, 25 bp, Homo sapien
gaataaagggtccaaaaaccagaca

SEQ ID NO: 64194 - DNA, 25 bp, Homo sapien
gaataaagtcagcttgtgaggtaaa

SEQ ID NO: 64195 - DNA, 25 bp, Homo sapien
gaataaagtcagtttgtgaggtaaa

SEQ ID NO: 64196 - DNA, 25 bp, Homo sapien
gaataaatctaaccagtgagagtca

SEQ ID NO: 64197 - DNA, 25 bp, Homo sapien
gaataaatctaatcagtgagagtca

SEQ ID NO: 64198 - DNA, 25 bp, Homo sapien
gaataaatgaactcaagtaagtaat

SEQ ID NO: 64199 - DNA, 25 bp, Homo sapien
gaataaatgaccagcaataaagtcc

SEQ ID NO: 64200 - DNA, 25 bp, Homo sapien
gaataaatgaccggcaataaagtcc

SEQ ID NO: 64201 - DNA, 25 bp, Homo sapien
gaataaattaactcaagtaagtaat

SEQ ID NO: 64202 - DNA, 25 bp, Homo sapien
gaataacactactgctattcacttt

SEQ ID NO: 64203 - DNA, 25 bp, Homo sapien
gaataacactacttctattcacttt

SEQ ID NO: 64204 - DNA, 25 bp, Homo sapien
gaataacagttttcattcttcatgc

SEQ ID NO: 64205 - DNA, 25 bp, Homo sapien
gaataacatccaacagtgtgaaaat

SEQ ID NO: 64206 - DNA, 25 bp, Homo sapien
gaataacatccaactgtgtgaaaat

SEQ ID NO: 64207 - DNA, 25 bp, Homo sapien
gaataacatttttcattcttcatgc

SEQ ID NO: 64208 - DNA, 25 bp, Homo sapien
gaataactacatcttatttttattc

SEQ ID NO: 64209 - DNA, 25 bp, Homo sapien
gaataactacattttatttttattc

SEQ ID NO: 64210 - DNA, 25 bp, Homo sapien
gaataagaaaccacagatggaaaag

SEQ ID NO: 64211 - DNA, 25 bp, Homo sapien
gaataagaaacgacagatggaaaag

SEQ ID NO: 64212 - DNA, 25 bp, Homo sapien
gaataagaatggtacgtagaacacc

SEQ ID NO: 64213 - DNA, 25 bp, Homo sapien
gaataagacccaggaaaaatcgatg

SEQ ID NO: 64214 - DNA, 25 bp, Homo sapien
gaataagacccgggaaaaatcgatg

SEQ ID NO: 64215 - DNA, 25 bp, Homo sapien
gaataagagtggtacgtagaacacc

SEQ ID NO: 64216 - DNA, 25 bp, Homo sapien
gaataagctaaatacgctgagactc

SEQ ID NO: 64217 - DNA, 25 bp, Homo sapien
gaataagctaaatatgctgagactc

SEQ ID NO: 64218 - DNA, 25 bp, Homo sapien
gaataaggaatccagtaacttgaag

SEQ ID NO: 64219 - DNA, 25 bp, Homo sapien
gaataaggaatccggtaacttgaag

SEQ ID NO: 64220 - DNA, 25 bp, Homo sapien
gaataaggcagcacaagcttgggtg

SEQ ID NO: 64221 - DNA, 25 bp, Homo sapien
gaataaggcagcagaagcttgggtg

SEQ ID NO: 64222 - DNA, 25 bp, Homo sapien
gaataaggtgaaacagaaacagatc

SEQ ID NO: 64223 - DNA, 25 bp, Homo sapien
gaataaggtgaaatagaaacagatc

SEQ ID NO: 64224 - DNA, 25 bp, Homo sapien
gaataagtaagcccttgttaacatg

SEQ ID NO: 64225 - DNA, 25 bp, Homo sapien
gaataagtaagctcttgttaacatg

SEQ ID NO: 64226 - DNA, 25 bp, Homo sapien
gaataagtccaattgctttttcata

SEQ ID NO: 64227 - DNA, 25 bp, Homo sapien
gaataagtccagttgctttttcata

SEQ ID NO: 64228 - DNA, 25 bp, Homo sapien
gaataagttacatatacatggcgat

SEQ ID NO: 64229 - DNA, 25 bp, Homo sapien
gaataagttacgtatacatggcgat

SEQ ID NO: 64230 - DNA, 25 bp, Homo sapien
gaataagttcaggaaaatttagtcg

SEQ ID NO: 64231 - DNA, 25 bp, Homo sapien
gaataagttcaggaaagtttagtcg

SEQ ID NO: 64232 - DNA, 25 bp, Homo sapien
gaataagttgacaaggataaaccta

SEQ ID NO: 64233 - DNA, 25 bp, Homo sapien
gaataagttgacaaggctaaaccta

SEQ ID NO: 64234 - DNA, 25 bp, Homo sapien
gaataagttttgctggttttcctag

SEQ ID NO: 64235 - DNA, 25 bp, Homo sapien
gaataagttttgttggttttcctag

SEQ ID NO: 64236 - DNA, 25 bp, Homo sapien
gaataatatcgccggctgtttacat

SEQ ID NO: 64237 - DNA, 25 bp, Homo sapien
gaataatatcgctggctgtttacat

SEQ ID NO: 64238 - DNA, 25 bp, Homo sapien
gaataatgaaaatctcagtaagaaa

SEQ ID NO: 64239 - DNA, 25 bp, Homo sapien
gaataatgaaaatctcggtaagaaa

SEQ ID NO: 64240 - DNA, 25 bp, Homo sapien
gaataatgattcttaaataacatca

SEQ ID NO: 64241 - DNA, 25 bp, Homo sapien
gaataatgattcttaagtaacatca

SEQ ID NO: 64242 - DNA, 25 bp, Homo sapien
gaataatggctcgcgtccacggttc

SEQ ID NO: 64243 - DNA, 25 bp, Homo sapien
gaataatggctcgtgtccacggttc

SEQ ID NO: 64244 - DNA, 25 bp, Homo sapien
gaataattagcacaataggcagcaa

SEQ ID NO: 64245 - DNA, 25 bp, Homo sapien
gaataattagcagaataggcagcaa

SEQ ID NO: 64246 - DNA, 25 bp, Homo sapien
gaataattcagacgatcttaatagg

SEQ ID NO: 64247 - DNA, 25 bp, Homo sapien
gaataattcagatgatcttaatagg

SEQ ID NO: 64248 - DNA, 25 bp, Homo sapien
gaatacaaaaatagttcatcatatg

SEQ ID NO: 64249 - DNA, 25 bp, Homo sapien
gaatacaaaaatggttcatcatatg

SEQ ID NO: 64250 - DNA, 25 bp, Homo sapien
gaatacccaaagaaaccatgaaatc

SEQ ID NO: 64251 - DNA, 25 bp, Homo sapien
gaatacccagagaaaccatgaaatc

SEQ ID NO: 64252 - DNA, 25 bp, Homo sapien
gaatacctgggatatctgggatatc

SEQ ID NO: 64253 - DNA, 25 bp, Homo sapien
gaatacctgggttatctgggatatc

SEQ ID NO: 64254 - DNA, 25 bp, Homo sapien
gaatacctgtcatcctagagaaaaa

SEQ ID NO: 64255 - DNA, 25 bp, Homo sapien
gaatacctgtcatcttagagaaaaa

SEQ ID NO: 64256 - DNA, 25 bp, Homo sapien
gaataccttttgatagaagacacgt

SEQ ID NO: 64257 - DNA, 25 bp, Homo sapien
gaatacctttttatagaagacacgt

SEQ ID NO: 64258 - DNA, 25 bp, Homo sapien
gaatacttatgcaggacatgcaggt

SEQ ID NO: 64259 - DNA, 25 bp, Homo sapien
gaatacttgtgcaggacatgcaggt

SEQ ID NO: 64260 - DNA, 25 bp, Homo sapien
gaatactttatcactacacaatgcc

SEQ ID NO: 64261 - DNA, 25 bp, Homo sapien
gaatactttatcattacacaatgcc

SEQ ID NO: 64262 - DNA, 25 bp, Homo sapien
gaatagaaggaatcaatttctgggg

SEQ ID NO: 64263 - DNA, 25 bp, Homo sapien
gaatagaatagtggttatcagaggt

SEQ ID NO: 64264 - DNA, 25 bp, Homo sapien
gaatagaatgaatcaatttctgggg

SEQ ID NO: 64265 - DNA, 25 bp, Homo sapien
gaatagaatggtggttatcagaggt

SEQ ID NO: 64266 - DNA, 25 bp, Homo sapien
gaatagagagtgatctgaacaacta

SEQ ID NO: 64267 - DNA, 25 bp, Homo sapien
gaatagagagtggtctgaacaacta

SEQ ID NO: 64268 - DNA, 25 bp, Homo sapien
gaatagagtctcccatgcatgcagg

SEQ ID NO: 64269 - DNA, 25 bp, Homo sapien
gaatagagtctcccgtgcatgcagg

SEQ ID NO: 64270 - DNA, 25 bp, Homo sapien
gaatagatgtacagaaagctaatta

SEQ ID NO: 64271 - DNA, 25 bp, Homo sapien
gaatagatgtacagaatgctaatta

SEQ ID NO: 64272 - DNA, 25 bp, Homo sapien
gaatagcaaagatgtgcgaacaaac

SEQ ID NO: 64273 - DNA, 25 bp, Homo sapien
gaatagcaaaggtgtgcgaacaaac

SEQ ID NO: 64274 - DNA, 25 bp, Homo sapien
gaatagcagagaaaatgaagaaatt

SEQ ID NO: 64275 - DNA, 25 bp, Homo sapien
gaatagcagagataatgaagaaatt

SEQ ID NO: 64276 - DNA, 25 bp, Homo sapien
gaatagcagggaaccatagcctagc

SEQ ID NO: 64277 - DNA, 25 bp, Homo sapien
gaatagcaggggaccatagcctagc

SEQ ID NO: 64278 - DNA, 25 bp, Homo sapien
gaatagccacgttttcagaaaagaa

SEQ ID NO: 64279 - DNA, 25 bp, Homo sapien
gaatagccatgttttcagaaaagaa

SEQ ID NO: 64280 - DNA, 25 bp, Homo sapien
gaatagcccgaagtggcggaagatg

SEQ ID NO: 64281 - DNA, 25 bp, Homo sapien
gaatagccggaagtggcggaagatg

SEQ ID NO: 64282 - DNA, 25 bp, Homo sapien
gaatagctagatgctaattatttgg

SEQ ID NO: 64283 - DNA, 25 bp, Homo sapien
gaatagctagatgttaattatttgg

SEQ ID NO: 64284 - DNA, 25 bp, Homo sapien
gaatagctcatgaatttgttcactt

SEQ ID NO: 64285 - DNA, 25 bp, Homo sapien
gaatagctcgtgaatttgttcactt

SEQ ID NO: 64286 - DNA, 25 bp, Homo sapien
gaatagctgcaaggagtactgaaag

SEQ ID NO: 64287 - DNA, 25 bp, Homo sapien
gaatagctgcaatgagtactgaaag

SEQ ID NO: 64288 - DNA, 25 bp, Homo sapien
gaataggaagggctctctgtgatct

SEQ ID NO: 64289 - DNA, 25 bp, Homo sapien
gaataggaaggtctctctgtgatct

SEQ ID NO: 64290 - DNA, 25 bp, Homo sapien
gaataggccagaaagagggacatta

SEQ ID NO: 64291 - DNA, 25 bp, Homo sapien
gaataggcgagaaagagggacatta

SEQ ID NO: 64292 - DNA, 25 bp, Homo sapien
gaataggctatcagttgcccaatag

SEQ ID NO: 64293 - DNA, 25 bp, Homo sapien
gaataggctatccgttgcccaatag

SEQ ID NO: 64294 - DNA, 25 bp, Homo sapien
gaatagggacactctccagagaggg

SEQ ID NO: 64295 - DNA, 25 bp, Homo sapien
gaatagggatactctccagagaggg

SEQ ID NO: 64296 - DNA, 25 bp, Homo sapien
gaatagtcaaaaatcgtgtgttcta

SEQ ID NO: 64297 - DNA, 25 bp, Homo sapien
gaatagtcaaaaattgtgtgttcta

SEQ ID NO: 64298 - DNA, 25 bp, Homo sapien
gaatagtgagcgaaaataaatgtct

SEQ ID NO: 64299 - DNA, 25 bp, Homo sapien
gaatagtgcgcgaaaataaatgtct

SEQ ID NO: 64300 - DNA, 25 bp, Homo sapien
gaatagttaaaaaattacaaaatgt

SEQ ID NO: 64301 - DNA, 25 bp, Homo sapien
gaatagtttaaaaattacaaaatgt

SEQ ID NO: 64302 - DNA, 25 bp, Homo sapien
gaatataaacagaactcaagaaaat

SEQ ID NO: 64303 - DNA, 25 bp, Homo sapien
gaatataaagagaactcaagaaaat

SEQ ID NO: 64304 - DNA, 25 bp, Homo sapien
gaatatactcacaggctccagggtt

SEQ ID NO: 64305 - DNA, 25 bp, Homo sapien
gaatatactcacgggctccagggtt

SEQ ID NO: 64306 - DNA, 25 bp, Homo sapien
gaatatacttggcgcatgctattct

SEQ ID NO: 64307 - DNA, 25 bp, Homo sapien
gaatatacttggtgcatgctattct

SEQ ID NO: 64308 - DNA, 25 bp, Homo sapien
gaatatatgagcaaatgaatccaag

SEQ ID NO: 64309 - DNA, 25 bp, Homo sapien
gaatatatgagcaactgaatccaag

SEQ ID NO: 64310 - DNA, 25 bp, Homo sapien
gaatatatgatacaatgatggcaca

SEQ ID NO: 64311 - DNA, 25 bp, Homo sapien
gaatatatgatataatgatggcaca

SEQ ID NO: 64312 - DNA, 25 bp, Homo sapien
gaatatatgttgaggtgttaagttt

SEQ ID NO: 64313 - DNA, 25 bp, Homo sapien
gaatatatgttggggtgttaagttt

SEQ ID NO: 64314 - DNA, 25 bp, Homo sapien
gaatatcacatccaaaacctagtat

SEQ ID NO: 64315 - DNA, 25 bp, Homo sapien
gaatatcagatccaaaacctagtat

SEQ ID NO: 64316 - DNA, 25 bp, Homo sapien
gaatatcaggttttattgcattttt

SEQ ID NO: 64317 - DNA, 25 bp, Homo sapien
gaatatcatgttttattgcattttt

SEQ ID NO: 64318 - DNA, 25 bp, Homo sapien
gaatatccaaattgaagtcgagagg

SEQ ID NO: 64319 - DNA, 25 bp, Homo sapien
gaatatccgaattgaagtcgagagg

SEQ ID NO: 64320 - DNA, 25 bp, Homo sapien
gaatatcgctattattcaatgtggc

SEQ ID NO: 64321 - DNA, 25 bp, Homo sapien
gaatatcgctattgttcaatgtggc

SEQ ID NO: 64322 - DNA, 25 bp, Homo sapien
gaatatcggtgtatatcaaattttc

SEQ ID NO: 64323 - DNA, 25 bp, Homo sapien
gaatatcggtgtatttcaaattttc

SEQ ID NO: 64324 - DNA, 25 bp, Homo sapien
gaatatgaacttcctgatcctctta

SEQ ID NO: 64325 - DNA, 25 bp, Homo sapien
gaatatgaactttctgatcctctta

SEQ ID NO: 64326 - DNA, 25 bp, Homo sapien
gaatatgactggtatggtcctccag

SEQ ID NO: 64327 - DNA, 25 bp, Homo sapien
gaatatgagtggtatggtcctccag

SEQ ID NO: 64328 - DNA, 25 bp, Homo sapien
gaatatgatgccattagataacttt

SEQ ID NO: 64329 - DNA, 25 bp, Homo sapien
gaatatgatgccattatataacttt

SEQ ID NO: 64330 - DNA, 25 bp, Homo sapien
gaatatgcaacaccaaaagtgagcc

SEQ ID NO: 64331 - DNA, 25 bp, Homo sapien
gaatatgcaacaccaagagtgagcc

SEQ ID NO: 64332 - DNA, 25 bp, Homo sapien
gaatatggaacaacttactttgttg

SEQ ID NO: 64333 - DNA, 25 bp, Homo sapien
gaatatggagcaacttactttgttg

SEQ ID NO: 64334 - DNA, 25 bp, Homo sapien
gaatatgggtgctagacatttgact

SEQ ID NO: 64335 - DNA, 25 bp, Homo sapien
gaatatgggtgttagacatttgact

SEQ ID NO: 64336 - DNA, 25 bp, Homo sapien
gaatattgtgcatgacacctagaaa

SEQ ID NO: 64337 - DNA, 25 bp, Homo sapien
gaatattgtgcgtgacacctagaaa

SEQ ID NO: 64338 - DNA, 25 bp, Homo sapien
gaatattgtggaaacaaacagaatg

SEQ ID NO: 64339 - DNA, 25 bp, Homo sapien
gaatattgtggaagcaaacagaatg

SEQ ID NO: 64340 - DNA, 25 bp, Homo sapien
gaatatttaaagagttcttgtaggg

SEQ ID NO: 64341 - DNA, 25 bp, Homo sapien
gaatatttaaagggttcttgtaggg

SEQ ID NO: 64342 - DNA, 25 bp, Homo sapien
gaatatttacatattagtgctcttc

SEQ ID NO: 64343 - DNA, 25 bp, Homo sapien
gaatatttacatgttagtgctcttc

SEQ ID NO: 64344 - DNA, 25 bp, Homo sapien
gaatattttcaaataactccatggt

SEQ ID NO: 64345 - DNA, 25 bp, Homo sapien
gaatattttcaagtaactccatggt

SEQ ID NO: 64346 - DNA, 25 bp, Homo sapien
gaatatttttaagtcaaatggacaa

SEQ ID NO: 64347 - DNA, 25 bp, Homo sapien
gaatatttttaggtcaaatggacaa

SEQ ID NO: 64348 - DNA, 25 bp, Homo sapien
gaatcaaacaaatccaattgcaaat

SEQ ID NO: 64349 - DNA, 25 bp, Homo sapien
gaatcaaactaatccaattgcaaat

SEQ ID NO: 64350 - DNA, 25 bp, Homo sapien
gaatcaaggatgtcataatgtcatg

SEQ ID NO: 64351 - DNA, 25 bp, Homo sapien
gaatcaaggatgtcatgatgtcatg

SEQ ID NO: 64352 - DNA, 25 bp, Homo sapien
gaatcaatgactaacgaaaaaacta

SEQ ID NO: 64353 - DNA, 25 bp, Homo sapien
gaatcaatgactaatgaaaaaacta

SEQ ID NO: 64354 - DNA, 25 bp, Homo sapien
gaatcacagctccttgcatcccatc

SEQ ID NO: 64355 - DNA, 25 bp, Homo sapien
gaatcacagcttcttgcatcccatc

SEQ ID NO: 64356 - DNA, 25 bp, Homo sapien
gaatcaccagcttaggcggctatag

SEQ ID NO: 64357 - DNA, 25 bp, Homo sapien
gaatcaccagcttaggtggctatag

SEQ ID NO: 64358 - DNA, 25 bp, Homo sapien
gaatcacctattcaaaaggcgaatc

SEQ ID NO: 64359 - DNA, 25 bp, Homo sapien
gaatcacctattcgaaaggcgaatc

SEQ ID NO: 64360 - DNA, 25 bp, Homo sapien
gaatcagaagaaaaagataacagcc

SEQ ID NO: 64361 - DNA, 25 bp, Homo sapien
gaatcagaagaagaagataacagcc

SEQ ID NO: 64362 - DNA, 25 bp, Homo sapien
gaatcagcactggcatctcattttg

SEQ ID NO: 64363 - DNA, 25 bp, Homo sapien
gaatcagcactggcttctcattttg

SEQ ID NO: 64364 - DNA, 25 bp, Homo sapien
gaatcagccttctctgccacgaatt

SEQ ID NO: 64365 - DNA, 25 bp, Homo sapien
gaatcagccttttctgccacgaatt

SEQ ID NO: 64366 - DNA, 25 bp, Homo sapien
gaatcatctagggtctaatgggtag

SEQ ID NO: 64367 - DNA, 25 bp, Homo sapien
gaatcatctagtgtctaatgggtag

SEQ ID NO: 64368 - DNA, 25 bp, Homo sapien
gaatcatctttcgctcaaataaatt

SEQ ID NO: 64369 - DNA, 25 bp, Homo sapien
gaatcatcttttgctcaaataaatt

SEQ ID NO: 64370 - DNA, 25 bp, Homo sapien
gaatccaagatcataaacccaagtt

SEQ ID NO: 64371 - DNA, 25 bp, Homo sapien
gaatccaagattataaacccaagtt

SEQ ID NO: 64372 - DNA, 25 bp, Homo sapien
gaatccacacaaagcaaagcatttt

SEQ ID NO: 64373 - DNA, 25 bp, Homo sapien
gaatccacacaaggcaaagcatttt

SEQ ID NO: 64374 - DNA, 25 bp, Homo sapien
gaatccacttggtaaaatattggtc

SEQ ID NO: 64375 - DNA, 25 bp, Homo sapien
gaatccacttggtagaatattggtc

SEQ ID NO: 64376 - DNA, 25 bp, Homo sapien
gaatccagataaaactgtttttttc

SEQ ID NO: 64377 - DNA, 25 bp, Homo sapien
gaatccagataaaattgtttttttc

SEQ ID NO: 64378 - DNA, 25 bp, Homo sapien
gaatccagtatcggtggcccactgg

SEQ ID NO: 64379 - DNA, 25 bp, Homo sapien
gaatccagtatctgcctttggtggt

SEQ ID NO: 64380 - DNA, 25 bp, Homo sapien
gaatccagtattggtggcccactgg

SEQ ID NO: 64381 - DNA, 25 bp, Homo sapien
gaatccagtgtctgcctttggtggt

SEQ ID NO: 64382 - DNA, 25 bp, Homo sapien
gaatccatctctatcgcatggcagc

SEQ ID NO: 64383 - DNA, 25 bp, Homo sapien
gaatccatctctattgcatggcagc

SEQ ID NO: 64384 - DNA, 25 bp, Homo sapien
gaatcccatgatttttctctttggg

SEQ ID NO: 64385 - DNA, 25 bp, Homo sapien
gaatcccatgatttttttctttggg

SEQ ID NO: 64386 - DNA, 25 bp, Homo sapien
gaatccctggctccaattattccca

SEQ ID NO: 64387 - DNA, 25 bp, Homo sapien
gaatccctggctccgattattccca

SEQ ID NO: 64388 - DNA, 25 bp, Homo sapien
gaatcctcatgccactgaagcaata

SEQ ID NO: 64389 - DNA, 25 bp, Homo sapien
gaatcctcatgctactgaagcaata

SEQ ID NO: 64390 - DNA, 25 bp, Homo sapien
gaatcctgctaagcaatacccagat

SEQ ID NO: 64391 - DNA, 25 bp, Homo sapien
gaatcctgttaagcaatacccagat

SEQ ID NO: 64392 - DNA, 25 bp, Homo sapien
gaatcctttagaacatgatgaaagc

SEQ ID NO: 64393 - DNA, 25 bp, Homo sapien
gaatcctttagaatatgatgaaagc

SEQ ID NO: 64394 - DNA, 25 bp, Homo sapien
gaatctagcagccgaactgtgcttt

SEQ ID NO: 64395 - DNA, 25 bp, Homo sapien
gaatctagcagcctaactgtgcttt

SEQ ID NO: 64396 - DNA, 25 bp, Homo sapien
gaatctagcttgcaaaatatcttgg

SEQ ID NO: 64397 - DNA, 25 bp, Homo sapien
gaatctagcttgcaaattatcttgg

SEQ ID NO: 64398 - DNA, 25 bp, Homo sapien
gaatctatggttccgtgatgctgac

SEQ ID NO: 64399 - DNA, 25 bp, Homo sapien
gaatctatggttctgtgatgctgac

SEQ ID NO: 64400 - DNA, 25 bp, Homo sapien
gaatctattattatcttcatgttgt

SEQ ID NO: 64401 - DNA, 25 bp, Homo sapien
gaatctatttactccagaagcagtt

SEQ ID NO: 64402 - DNA, 25 bp, Homo sapien
gaatctatttacttcagaagcagtt

SEQ ID NO: 64403 - DNA, 25 bp, Homo sapien
gaatctatttttatcttcatgttgt

SEQ ID NO: 64404 - DNA, 25 bp, Homo sapien
gaatctcacgtgggagggatagcaa

SEQ ID NO: 64405 - DNA, 25 bp, Homo sapien
gaatctcacgttaataggacagtag

SEQ ID NO: 64406 - DNA, 25 bp, Homo sapien
gaatctcactaccctcatatctgga

SEQ ID NO: 64407 - DNA, 25 bp, Homo sapien
gaatctcaggtgggagggatagcaa

SEQ ID NO: 64408 - DNA, 25 bp, Homo sapien
gaatctcaggttaataggacagtag

SEQ ID NO: 64409 - DNA, 25 bp, Homo sapien
gaatctcattaccctcatatctgga

SEQ ID NO: 64410 - DNA, 25 bp, Homo sapien
gaatctcctcttccttttcttataa

SEQ ID NO: 64411 - DNA, 25 bp, Homo sapien
gaatctcctcttctttttcttataa

SEQ ID NO: 64412 - DNA, 25 bp, Homo sapien
gaatctcttcagtagctcatttaca

SEQ ID NO: 64413 - DNA, 25 bp, Homo sapien
gaatctcttcattagctcatttaca

SEQ ID NO: 64414 - DNA, 25 bp, Homo sapien
gaatctgaagcaacgacagcaaaga

SEQ ID NO: 64415 - DNA, 25 bp, Homo sapien
gaatctgaagcaatgacagcaaaga

SEQ ID NO: 64416 - DNA, 25 bp, Homo sapien
gaatctgaagctaggtatgcctgac

SEQ ID NO: 64417 - DNA, 25 bp, Homo sapien
gaatctgacgctaggtatgcctgac

SEQ ID NO: 64418 - DNA, 25 bp, Homo sapien
gaatctgactactaatgcagctaaa

SEQ ID NO: 64419 - DNA, 25 bp, Homo sapien
gaatctgactactgatgcagctaaa

SEQ ID NO: 64420 - DNA, 25 bp, Homo sapien
gaatctgagcatctcagaatagccc

SEQ ID NO: 64421 - DNA, 25 bp, Homo sapien
gaatctgagcatgtcagaatagccc

SEQ ID NO: 64422 - DNA, 25 bp, Homo sapien
gaatctgctcctcgaagtagggacc

SEQ ID NO: 64423 - DNA, 25 bp, Homo sapien
gaatctgctccttgaagtagggacc

SEQ ID NO: 64424 - DNA, 25 bp, Homo sapien
gaatctggctttaaatatctgcctt

SEQ ID NO: 64425 - DNA, 25 bp, Homo sapien
gaatctggctttgaatatctgcctt

SEQ ID NO: 64426 - DNA, 25 bp, Homo sapien
gaatctggggttctttcgttctgaa

SEQ ID NO: 64427 - DNA, 25 bp, Homo sapien
gaatctggggttctttggttctgaa

SEQ ID NO: 64428 - DNA, 25 bp, Homo sapien
gaatctgtgagttggttacgtctgg

SEQ ID NO: 64429 - DNA, 25 bp, Homo sapien
gaatctgtgggttggttacgtctgg

SEQ ID NO: 64430 - DNA, 25 bp, Homo sapien
gaatctgttcgatgcctctcctagc

SEQ ID NO: 64431 - DNA, 25 bp, Homo sapien
gaatctgtttgatgcctctcctagc

SEQ ID NO: 64432 - DNA, 25 bp, Homo sapien
gaatcttagtaaataaaggtcaatt

SEQ ID NO: 64433 - DNA, 25 bp, Homo sapien
gaatcttagtaagtaaaggtcaatt

SEQ ID NO: 64434 - DNA, 25 bp, Homo sapien
gaatcttatgactcttaacctctcc

SEQ ID NO: 64435 - DNA, 25 bp, Homo sapien
gaatcttatgagtcttaacctctcc

SEQ ID NO: 64436 - DNA, 25 bp, Homo sapien
gaatcttctcgctgaggttagttaa

SEQ ID NO: 64437 - DNA, 25 bp, Homo sapien
gaatcttcttgctgaggttagttaa

SEQ ID NO: 64438 - DNA, 25 bp, Homo sapien
gaatcttgaagtatgagtaagagtt

SEQ ID NO: 64439 - DNA, 25 bp, Homo sapien
gaatcttgaagtttgagtaagagtt

SEQ ID NO: 64440 - DNA, 25 bp, Homo sapien
gaatcttgagtccaataattaggta

SEQ ID NO: 64441 - DNA, 25 bp, Homo sapien
gaatcttgagtgcaataattaggta

SEQ ID NO: 64442 - DNA, 25 bp, Homo sapien
gaatcttgcgctacatagatttttg

SEQ ID NO: 64443 - DNA, 25 bp, Homo sapien
gaatcttgtgctacatagatttttg

SEQ ID NO: 64444 - DNA, 25 bp, Homo sapien
gaatctttccaacaaaaaggtgacc

SEQ ID NO: 64445 - DNA, 25 bp, Homo sapien
gaatctttctaacaaaaaggtgacc

SEQ ID NO: 64446 - DNA, 25 bp, Homo sapien
gaatgaaaacagagataagcatata

SEQ ID NO: 64447 - DNA, 25 bp, Homo sapien
gaatgaaaagtcaagtgctgaatgg

SEQ ID NO: 64448 - DNA, 25 bp, Homo sapien
gaatgaaaagtcaggtgctgaatgg

SEQ ID NO: 64449 - DNA, 25 bp, Homo sapien
gaatgaaagcagagataagcatata

SEQ ID NO: 64450 - DNA, 25 bp, Homo sapien
gaatgaacaagagtttaagagatgg

SEQ ID NO: 64451 - DNA, 25 bp, Homo sapien
gaatgaaccagagtttaagagatgg

SEQ ID NO: 64452 - DNA, 25 bp, Homo sapien
gaatgaactccatcgatgtctcctg

SEQ ID NO: 64453 - DNA, 25 bp, Homo sapien
gaatgaactccatggatgtctcctg

SEQ ID NO: 64454 - DNA, 25 bp, Homo sapien
gaatgaacttacgccaataacttgc

SEQ ID NO: 64455 - DNA, 25 bp, Homo sapien
gaatgaacttatgccaataacttgc

SEQ ID NO: 64456 - DNA, 25 bp, Homo sapien
gaatgaagcgtgagaatatgccata

SEQ ID NO: 64457 - DNA, 25 bp, Homo sapien
gaatgaagtgtgagaatatgccata

SEQ ID NO: 64458 - DNA, 25 bp, Homo sapien
gaatgaataaagacgaaaggatgag

SEQ ID NO: 64459 - DNA, 25 bp, Homo sapien
gaatgaataaagatgaaaggatgag

SEQ ID NO: 64460 - DNA, 25 bp, Homo sapien
gaatgaatactgaccatgtgctccg

SEQ ID NO: 64461 - DNA, 25 bp, Homo sapien
gaatgaatattgaccatgtgctccg

SEQ ID NO: 64462 - DNA, 25 bp, Homo sapien
gaatgaattttacaaccagacatat

SEQ ID NO: 64463 - DNA, 25 bp, Homo sapien
gaatgaattttagaaccagacatat

SEQ ID NO: 64464 - DNA, 25 bp, Homo sapien
gaatgaattttcccgagggcaggag

SEQ ID NO: 64465 - DNA, 25 bp, Homo sapien
gaatgaattttcctgagggcaggag

SEQ ID NO: 64466 - DNA, 25 bp, Homo sapien
gaatgacaacagggactgcagaaag

SEQ ID NO: 64467 - DNA, 25 bp, Homo sapien
gaatgacaacaggggctgcagaaag

SEQ ID NO: 64468 - DNA, 25 bp, Homo sapien
gaatgacaagatatactcatttgcc

SEQ ID NO: 64469 - DNA, 25 bp, Homo sapien
gaatgacaagatattctcatttgcc

SEQ ID NO: 64470 - DNA, 25 bp, Homo sapien
gaatgacaatcaccgtggtgggttt

SEQ ID NO: 64471 - DNA, 25 bp, Homo sapien
gaatgacaatcactgtggtgggttt

SEQ ID NO: 64472 - DNA, 25 bp, Homo sapien
gaatgacacgggactccgccatcaa

SEQ ID NO: 64473 - DNA, 25 bp, Homo sapien
gaatgacacgggactctgccatcaa

SEQ ID NO: 64474 - DNA, 25 bp, Homo sapien
gaatgacagaatcgggtatgtgaga

SEQ ID NO: 64475 - DNA, 25 bp, Homo sapien
gaatgacagaattgggtatgtgaga

SEQ ID NO: 64476 - DNA, 25 bp, Homo sapien
gaatgacagacataatcaacagtta

SEQ ID NO: 64477 - DNA, 25 bp, Homo sapien
gaatgacagacatcatcaacagtta

SEQ ID NO: 64478 - DNA, 25 bp, Homo sapien
gaatgacagtgttcgacgagaccaa

SEQ ID NO: 64479 - DNA, 25 bp, Homo sapien
gaatgacagtgttcgatgagaccaa

SEQ ID NO: 64480 - DNA, 25 bp, Homo sapien
gaatgaccaggtacgctgtcaatga

SEQ ID NO: 64481 - DNA, 25 bp, Homo sapien
gaatgaccaggtatgctgtcaatga

SEQ ID NO: 64482 - DNA, 25 bp, Homo sapien
gaatgacccatctcaacatgtttgt

SEQ ID NO: 64483 - DNA, 25 bp, Homo sapien
gaatgacccatctctacatgtttgt

SEQ ID NO: 64484 - DNA, 25 bp, Homo sapien
gaatgacttcctcgaagccagtgtt

SEQ ID NO: 64485 - DNA, 25 bp, Homo sapien
gaatgacttccttgaagccagtgtt

SEQ ID NO: 64486 - DNA, 25 bp, Homo sapien
gaatgagaacttccaaattaaccaa

SEQ ID NO: 64487 - DNA, 25 bp, Homo sapien
gaatgagaagaaccttacagtagcc

SEQ ID NO: 64488 - DNA, 25 bp, Homo sapien
gaatgagaagacccttacagtagcc

SEQ ID NO: 64489 - DNA, 25 bp, Homo sapien
gaatgagaagggtaagagacttagg

SEQ ID NO: 64490 - DNA, 25 bp, Homo sapien
gaatgagaagggtaggagacttagg

SEQ ID NO: 64491 - DNA, 25 bp, Homo sapien
gaatgagaattacatcatctgcttc

SEQ ID NO: 64492 - DNA, 25 bp, Homo sapien
gaatgagaattacttcatctgcttc

SEQ ID NO: 64493 - DNA, 25 bp, Homo sapien
gaatgagaatttccaaattaaccaa

SEQ ID NO: 64494 - DNA, 25 bp, Homo sapien
gaatgagcaaacataaaaaagaaat

SEQ ID NO: 64495 - DNA, 25 bp, Homo sapien
gaatgagcaaagataaaaaagaaat

SEQ ID NO: 64496 - DNA, 25 bp, Homo sapien
gaatgagcaaattgtggtatattca

SEQ ID NO: 64497 - DNA, 25 bp, Homo sapien
gaatgagcaaattttggtatattca

SEQ ID NO: 64498 - DNA, 25 bp, Homo sapien
gaatgagcagaaataggagacctgg

SEQ ID NO: 64499 - DNA, 25 bp, Homo sapien
gaatgagcagaagtaggagacctgg

SEQ ID NO: 64500 - DNA, 25 bp, Homo sapien
gaatgagccagggcctagaggaaaa

SEQ ID NO: 64501 - DNA, 25 bp, Homo sapien
gaatgagcgagggcctagaggaaaa

SEQ ID NO: 64502 - DNA, 25 bp, Homo sapien
gaatgaggagacgaacaaggcctat

SEQ ID NO: 64503 - DNA, 25 bp, Homo sapien
gaatgaggagatgaacaaggcctat

SEQ ID NO: 64504 - DNA, 25 bp, Homo sapien
gaatgaggttccaatgcatgctacc

SEQ ID NO: 64505 - DNA, 25 bp, Homo sapien
gaatgaggttccgatgcatgctacc

SEQ ID NO: 64506 - DNA, 25 bp, Homo sapien
gaatgagtgattaaaaccaggaaac

SEQ ID NO: 64507 - DNA, 25 bp, Homo sapien
gaatgagtggttaaaaccaggaaac

SEQ ID NO: 64508 - DNA, 25 bp, Homo sapien
gaatgagttcaaggaaggccaagag

SEQ ID NO: 64509 - DNA, 25 bp, Homo sapien
gaatgagttcaagtaaggccaagag

SEQ ID NO: 64510 - DNA, 25 bp, Homo sapien
gaatgatagaaaaggaaagagtaac

SEQ ID NO: 64511 - DNA, 25 bp, Homo sapien
gaatgatagaaaagtaaagagtaac

SEQ ID NO: 64512 - DNA, 25 bp, Homo sapien
gaatgatatgaacaattaacatttc

SEQ ID NO: 64513 - DNA, 25 bp, Homo sapien
gaatgatatgaacagttaacatttc

SEQ ID NO: 64514 - DNA, 25 bp, Homo sapien
gaatgatattgttccataacctgtt

SEQ ID NO: 64515 - DNA, 25 bp, Homo sapien
gaatgatattgttctataacctgtt

SEQ ID NO: 64516 - DNA, 25 bp, Homo sapien
gaatgatgtgtgcttcacattgtgg

SEQ ID NO: 64517 - DNA, 25 bp, Homo sapien
gaatgatgtgtggttcacattgtgg

SEQ ID NO: 64518 - DNA, 25 bp, Homo sapien
gaatgattccggaaagttaacttgt

SEQ ID NO: 64519 - DNA, 25 bp, Homo sapien
gaatgattccgggaagttaacttgt

SEQ ID NO: 64520 - DNA, 25 bp, Homo sapien
gaatgattgaatcggctaaatatct

SEQ ID NO: 64521 - DNA, 25 bp, Homo sapien
gaatgattgaattggctaaatatct

SEQ ID NO: 64522 - DNA, 25 bp, Homo sapien
gaatgattgagtaaaagtgattttt

SEQ ID NO: 64523 - DNA, 25 bp, Homo sapien
gaatgattgcgtaaaagtgattttt

SEQ ID NO: 64524 - DNA, 25 bp, Homo sapien
gaatgattgttccgagggttttgta

SEQ ID NO: 64525 - DNA, 25 bp, Homo sapien
gaatgattgttctgagggttttgta

SEQ ID NO: 64526 - DNA, 25 bp, Homo sapien
gaatgatttctaagtaaacaacaaa

SEQ ID NO: 64527 - DNA, 25 bp, Homo sapien
gaatgatttctaggtaaacaacaaa

SEQ ID NO: 64528 - DNA, 25 bp, Homo sapien
gaatgatttgtgccactaagaaaca

SEQ ID NO: 64529 - DNA, 25 bp, Homo sapien
gaatgatttgtgtcactaagaaaca

SEQ ID NO: 64530 - DNA, 25 bp, Homo sapien
gaatgcaaactgatatagccactct

SEQ ID NO: 64531 - DNA, 25 bp, Homo sapien
gaatgcaaactggtatagccactct

SEQ ID NO: 64532 - DNA, 25 bp, Homo sapien
gaatgcaaatgagccttttttcctt

SEQ ID NO: 64533 - DNA, 25 bp, Homo sapien
gaatgcaaatgagtcttttttcctt

SEQ ID NO: 64534 - DNA, 25 bp, Homo sapien
gaatgcagttttaagatgcagaatt

SEQ ID NO: 64535 - DNA, 25 bp, Homo sapien
gaatgcagttttaggatgcagaatt

SEQ ID NO: 64536 - DNA, 25 bp, Homo sapien
gaatgcatgataagctgggttctta

SEQ ID NO: 64537 - DNA, 25 bp, Homo sapien
gaatgcatgataatctgggttctta

SEQ ID NO: 64538 - DNA, 25 bp, Homo sapien
gaatgcctaatatgcacatgaaaag

SEQ ID NO: 64539 - DNA, 25 bp, Homo sapien
gaatgcctagtatgcacatgaaaag

SEQ ID NO: 64540 - DNA, 25 bp, Homo sapien
gaatgctcaaatagattttctatat

SEQ ID NO: 64541 - DNA, 25 bp, Homo sapien
gaatgctcacagaagatctgagaag

SEQ ID NO: 64542 - DNA, 25 bp, Homo sapien
gaatgctcacagaatatctgagaag

SEQ ID NO: 64543 - DNA, 25 bp, Homo sapien
gaatgctcgaatagattttctatat

SEQ ID NO: 64544 - DNA, 25 bp, Homo sapien
gaatgctgacatataacctatacct

SEQ ID NO: 64545 - DNA, 25 bp, Homo sapien
gaatgctgacatataatctatacct

SEQ ID NO: 64546 - DNA, 25 bp, Homo sapien
gaatgctgtggtaagagaggaagag

SEQ ID NO: 64547 - DNA, 25 bp, Homo sapien
gaatgctgtggtacgagaggaagag

SEQ ID NO: 64548 - DNA, 25 bp, Homo sapien
gaatgcttcaggatggccaagattg

SEQ ID NO: 64549 - DNA, 25 bp, Homo sapien
gaatgcttgctcatatggaaagtct

SEQ ID NO: 64550 - DNA, 25 bp, Homo sapien
gaatgcttgttcatatggaaagtct

SEQ ID NO: 64551 - DNA, 25 bp, Homo sapien
gaatgctttaggatggccaagattg

SEQ ID NO: 64552 - DNA, 25 bp, Homo sapien
gaatgctttatagttagttgagaat

SEQ ID NO: 64553 - DNA, 25 bp, Homo sapien
gaatgctttctagttagttgagaat

SEQ ID NO: 64554 - DNA, 25 bp, Homo sapien
gaatgcttttaacgacaccaaagtc

SEQ ID NO: 64555 - DNA, 25 bp, Homo sapien
gaatgcttttaatgacaccaaagtc

SEQ ID NO: 64556 - DNA, 25 bp, Homo sapien
gaatggaaaaaacaaactttgttag

SEQ ID NO: 64557 - DNA, 25 bp, Homo sapien
gaatggaaaaaataaactttgttag

SEQ ID NO: 64558 - DNA, 25 bp, Homo sapien
gaatggagatccaggtttctgagaa

SEQ ID NO: 64559 - DNA, 25 bp, Homo sapien
gaatggaggtccaggtttctgagaa

SEQ ID NO: 64560 - DNA, 25 bp, Homo sapien
gaatggagtccacggatgttgctaa

SEQ ID NO: 64561 - DNA, 25 bp, Homo sapien
gaatggagtccgcggatgttgctaa

SEQ ID NO: 64562 - DNA, 25 bp, Homo sapien
gaatggcgtcctcagagagtagaaa

SEQ ID NO: 64563 - DNA, 25 bp, Homo sapien
gaatggcgtcctcggagagtagaaa

SEQ ID NO: 64564 - DNA, 25 bp, Homo sapien
gaatggctttgatagtttgatagaa

SEQ ID NO: 64565 - DNA, 25 bp, Homo sapien
gaatggctttgatggtttgatagaa

SEQ ID NO: 64566 - DNA, 25 bp, Homo sapien
gaatgggctaatacagtaaatgcag

SEQ ID NO: 64567 - DNA, 25 bp, Homo sapien
gaatgggctaatatagtaaatgcag

SEQ ID NO: 64568 - DNA, 25 bp, Homo sapien
gaatggtagatgggaacatccaatg

SEQ ID NO: 64569 - DNA, 25 bp, Homo sapien
gaatggtaggtgggaacatccaatg

SEQ ID NO: 64570 - DNA, 25 bp, Homo sapien
gaatggtatcaataaagagatgaag

SEQ ID NO: 64571 - DNA, 25 bp, Homo sapien
gaatggtatcagtaaagagatgaag

SEQ ID NO: 64572 - DNA, 25 bp, Homo sapien
gaatggtcagaatcaatatcatgta

SEQ ID NO: 64573 - DNA, 25 bp, Homo sapien
gaatggtcagaatgaatatcatgta

SEQ ID NO: 64574 - DNA, 25 bp, Homo sapien
gaatggtcctgcacaagttggattt

SEQ ID NO: 64575 - DNA, 25 bp, Homo sapien
gaatggtcctgtacaagttggattt

SEQ ID NO: 64576 - DNA, 25 bp, Homo sapien
gaatggttaagtaacttgccaaagg

SEQ ID NO: 64577 - DNA, 25 bp, Homo sapien
gaatggttaggtaacttgccaaagg

SEQ ID NO: 64578 - DNA, 25 bp, Homo sapien
gaatggtttgtatctggttattaaa

SEQ ID NO: 64579 - DNA, 25 bp, Homo sapien
gaatggtttgtatctgtttattaaa

SEQ ID NO: 64580 - DNA, 25 bp, Homo sapien
gaatgtaaacactatatgcctgtgt

SEQ ID NO: 64581 - DNA, 25 bp, Homo sapien
gaatgtaaacagtatatgcctgtgt

SEQ ID NO: 64582 - DNA, 25 bp, Homo sapien
gaatgtaaattgcatctcgacaaaa

SEQ ID NO: 64583 - DNA, 25 bp, Homo sapien
gaatgtaaattgtatctcgacaaaa

SEQ ID NO: 64584 - DNA, 25 bp, Homo sapien
gaatgtaacaatgttggactctttc

SEQ ID NO: 64585 - DNA, 25 bp, Homo sapien
gaatgtaaccatgttggactctttc

SEQ ID NO: 64586 - DNA, 25 bp, Homo sapien
gaatgtaacttccttcaaagactgc

SEQ ID NO: 64587 - DNA, 25 bp, Homo sapien
gaatgtaacttccttccaagactgc

SEQ ID NO: 64588 - DNA, 25 bp, Homo sapien
gaatgtacgggcattgaagcactga

SEQ ID NO: 64589 - DNA, 25 bp, Homo sapien
gaatgtactggcattgaagcactga

SEQ ID NO: 64590 - DNA, 25 bp, Homo sapien
gaatgtaggcatttttatacttttg

SEQ ID NO: 64591 - DNA, 25 bp, Homo sapien
gaatgtaggcatttttgtacttttg

SEQ ID NO: 64592 - DNA, 25 bp, Homo sapien
gaatgtatcattgttgcatttgatt

SEQ ID NO: 64593 - DNA, 25 bp, Homo sapien
gaatgtatcatttttgcatttgatt

SEQ ID NO: 64594 - DNA, 25 bp, Homo sapien
gaatgtcaaagataaagtgcaacac

SEQ ID NO: 64595 - DNA, 25 bp, Homo sapien
gaatgtcaaaggtaaagtgcaacac

SEQ ID NO: 64596 - DNA, 25 bp, Homo sapien
gaatgtccaaagtattcaatgtgtt

SEQ ID NO: 64597 - DNA, 25 bp, Homo sapien
gaatgtccgaagtattcaatgtgtt

SEQ ID NO: 64598 - DNA, 25 bp, Homo sapien
gaatgtctcacggcgaatcaaatgt

SEQ ID NO: 64599 - DNA, 25 bp, Homo sapien
gaatgtctcacggctaatcaaatgt

SEQ ID NO: 64600 - DNA, 25 bp, Homo sapien
gaatgtgaaaagactacagtggctt

SEQ ID NO: 64601 - DNA, 25 bp, Homo sapien
gaatgtgaaaagactagagtggctt

SEQ ID NO: 64602 - DNA, 25 bp, Homo sapien
gaatgtgaggatcattaactgtcca

SEQ ID NO: 64603 - DNA, 25 bp, Homo sapien
gaatgtgaggatcattcactgtcca

SEQ ID NO: 64604 - DNA, 25 bp, Homo sapien
gaatgtgccttaatctctgtatctc

SEQ ID NO: 64605 - DNA, 25 bp, Homo sapien
gaatgtgccttaatctttgtatctc

SEQ ID NO: 64606 - DNA, 25 bp, Homo sapien
gaatgtgctaccttccaaggctgcc

SEQ ID NO: 64607 - DNA, 25 bp, Homo sapien
gaatgtgctacctttcaaggctgcc

SEQ ID NO: 64608 - DNA, 25 bp, Homo sapien
gaatgtggatcaaaataaggtccat

SEQ ID NO: 64609 - DNA, 25 bp, Homo sapien
gaatgtgggtcaaaataaggtccat

SEQ ID NO: 64610 - DNA, 25 bp, Homo sapien
gaatgtgtcagtctctctgaacttc

SEQ ID NO: 64611 - DNA, 25 bp, Homo sapien
gaatgtgtcagtttctctgaacttc

SEQ ID NO: 64612 - DNA, 25 bp, Homo sapien
gaatgttcttacagcgatgttacca

SEQ ID NO: 64613 - DNA, 25 bp, Homo sapien
gaatgttcttacagtgatgttacca

SEQ ID NO: 64614 - DNA, 25 bp, Homo sapien
gaatgttgacaacgatgctgaacaa

SEQ ID NO: 64615 - DNA, 25 bp, Homo sapien
gaatgttgacaaggatgctgaacaa

SEQ ID NO: 64616 - DNA, 25 bp, Homo sapien
gaatgttgcagaggcaccaatggtt

SEQ ID NO: 64617 - DNA, 25 bp, Homo sapien
gaatgttgcagaggcagcaatggtt

SEQ ID NO: 64618 - DNA, 25 bp, Homo sapien
gaatgtttgcccaactttaagaatt

SEQ ID NO: 64619 - DNA, 25 bp, Homo sapien
gaatgtttgcccgactttaagaatt

SEQ ID NO: 64620 - DNA, 25 bp, Homo sapien
gaattaaactgatggtaagaaaatg

SEQ ID NO: 64621 - DNA, 25 bp, Homo sapien
gaattaaagatatacattttcatag

SEQ ID NO: 64622 - DNA, 25 bp, Homo sapien
gaattaaagatgtacattttcatag

SEQ ID NO: 64623 - DNA, 25 bp, Homo sapien
gaattaaattgatggtaagaaaatg

SEQ ID NO: 64624 - DNA, 25 bp, Homo sapien
gaattaaattgttgtgagaccacca

SEQ ID NO: 64625 - DNA, 25 bp, Homo sapien
gaattaaattgttttgagaccacca

SEQ ID NO: 64626 - DNA, 25 bp, Homo sapien
gaattaacttgctgatgtactgttg

SEQ ID NO: 64627 - DNA, 25 bp, Homo sapien
gaattaacttgttgatgtactgttg

SEQ ID NO: 64628 - DNA, 25 bp, Homo sapien
gaattaaggccgactctcatgatct

SEQ ID NO: 64629 - DNA, 25 bp, Homo sapien
gaattaaggccgcctctcatgatct

SEQ ID NO: 64630 - DNA, 25 bp, Homo sapien
gaattaatacgaaagaggcaaaatt

SEQ ID NO: 64631 - DNA, 25 bp, Homo sapien
gaattaatactggaaagttcctaaa

SEQ ID NO: 64632 - DNA, 25 bp, Homo sapien
gaattaatactgggaagttcctaaa

SEQ ID NO: 64633 - DNA, 25 bp, Homo sapien
gaattaatagaaccatgactgaaaa

SEQ ID NO: 64634 - DNA, 25 bp, Homo sapien
gaattaatagatccatgactgaaaa

SEQ ID NO: 64635 - DNA, 25 bp, Homo sapien
gaattaatatgaaagaggcaaaatt

SEQ ID NO: 64636 - DNA, 25 bp, Homo sapien
gaattaatctatgaataagaaagac

SEQ ID NO: 64637 - DNA, 25 bp, Homo sapien
gaattaatctatgaatgagaaagac

SEQ ID NO: 64638 - DNA, 25 bp, Homo sapien
gaattacactttaatgccctcaaat

SEQ ID NO: 64639 - DNA, 25 bp, Homo sapien
gaattacacttttatgccctcaaat

SEQ ID NO: 64640 - DNA, 25 bp, Homo sapien
gaattaccatatgtcccagcaattc

SEQ ID NO: 64641 - DNA, 25 bp, Homo sapien
gaattaccgtatgtcccagcaattc

SEQ ID NO: 64642 - DNA, 25 bp, Homo sapien
gaattactaacatcacatccatatc

SEQ ID NO: 64643 - DNA, 25 bp, Homo sapien
gaattactaacatcccatccatatc

SEQ ID NO: 64644 - DNA, 25 bp, Homo sapien
gaattactacaatctataacgtctg

SEQ ID NO: 64645 - DNA, 25 bp, Homo sapien
gaattactataatctataacgtctg

SEQ ID NO: 64646 - DNA, 25 bp, Homo sapien
gaattagaaacagagtagtctttta

SEQ ID NO: 64647 - DNA, 25 bp, Homo sapien
gaattagaaagtataagtgaagaga

SEQ ID NO: 64648 - DNA, 25 bp, Homo sapien
gaattagaaagtgtaagtgaagaga

SEQ ID NO: 64649 - DNA, 25 bp, Homo sapien
gaattagaaccagagtagtctttta

SEQ ID NO: 64650 - DNA, 25 bp, Homo sapien
gaattagagtaagcgtacatctaaa

SEQ ID NO: 64651 - DNA, 25 bp, Homo sapien
gaattagagtaagtgtacatctaaa

SEQ ID NO: 64652 - DNA, 25 bp, Homo sapien
gaattagcacacaaaaacattaaga

SEQ ID NO: 64653 - DNA, 25 bp, Homo sapien
gaattagcacacaagaacattaaga

SEQ ID NO: 64654 - DNA, 25 bp, Homo sapien
gaattagcgaaacagaaaagtatct

SEQ ID NO: 64655 - DNA, 25 bp, Homo sapien
gaattagctaaacagaaaagtatct

SEQ ID NO: 64656 - DNA, 25 bp, Homo sapien
gaattagtccacacaggtagccaac

SEQ ID NO: 64657 - DNA, 25 bp, Homo sapien
gaattagtccagacaggtagccaac

SEQ ID NO: 64658 - DNA, 25 bp, Homo sapien
gaattataaaaacagtcatatgttc

SEQ ID NO: 64659 - DNA, 25 bp, Homo sapien
gaattataagaacagtcatatgttc

SEQ ID NO: 64660 - DNA, 25 bp, Homo sapien
gaattataaggcacatctatgttta

SEQ ID NO: 64661 - DNA, 25 bp, Homo sapien
gaattataaggcacctctatgttta

SEQ ID NO: 64662 - DNA, 25 bp, Homo sapien
gaattatctaatggcgaataaagag

SEQ ID NO: 64663 - DNA, 25 bp, Homo sapien
gaattatctaatggtgaataaagag

SEQ ID NO: 64664 - DNA, 25 bp, Homo sapien
gaattatgccactccataaatttgt

SEQ ID NO: 64665 - DNA, 25 bp, Homo sapien
gaattatgccactctataaatttgt

SEQ ID NO: 64666 - DNA, 25 bp, Homo sapien
gaattattgagagttgttcattgga

SEQ ID NO: 64667 - DNA, 25 bp, Homo sapien
gaattattgagggttgttcattgga

SEQ ID NO: 64668 - DNA, 25 bp, Homo sapien
gaattattgcaactatcttttaaca

SEQ ID NO: 64669 - DNA, 25 bp, Homo sapien
gaattattgcaattatcttttaaca

SEQ ID NO: 64670 - DNA, 25 bp, Homo sapien
gaattatttcaaaaactgcattttc

SEQ ID NO: 64671 - DNA, 25 bp, Homo sapien
gaattatttcaacaactgcattttc

SEQ ID NO: 64672 - DNA, 25 bp, Homo sapien
gaattcaaccacaatgaaggaatta

SEQ ID NO: 64673 - DNA, 25 bp, Homo sapien
gaattcaaccacagtgaaggaatta

SEQ ID NO: 64674 - DNA, 25 bp, Homo sapien
gaattcactaatcgagttgggctat

SEQ ID NO: 64675 - DNA, 25 bp, Homo sapien
gaattcactaattgagttgggctat

SEQ ID NO: 64676 - DNA, 25 bp, Homo sapien
gaattcactatgatcttctattctg

SEQ ID NO: 64677 - DNA, 25 bp, Homo sapien
gaattcactgtgatcttctattctg

SEQ ID NO: 64678 - DNA, 25 bp, Homo sapien
gaattcagaattaagcatagtagat

SEQ ID NO: 64679 - DNA, 25 bp, Homo sapien
gaattcagaattaagcgtagtagat

SEQ ID NO: 64680 - DNA, 25 bp, Homo sapien
gaattcagcagtgatgccattgggt

SEQ ID NO: 64681 - DNA, 25 bp, Homo sapien
gaattcagcagtgatgtcattgggt

SEQ ID NO: 64682 - DNA, 25 bp, Homo sapien
gaattcaggaactcagttgaagtat

SEQ ID NO: 64683 - DNA, 25 bp, Homo sapien
gaattcaggattaaagtagaaaaag

SEQ ID NO: 64684 - DNA, 25 bp, Homo sapien
gaattcagggttaaagtagaaaaag

SEQ ID NO: 64685 - DNA, 25 bp, Homo sapien
gaattcaggtactcagttgaagtat

SEQ ID NO: 64686 - DNA, 25 bp, Homo sapien
gaattcatgagggaaaaaaacagac

SEQ ID NO: 64687 - DNA, 25 bp, Homo sapien
gaattcatgagggaaagaaacagac

SEQ ID NO: 64688 - DNA, 25 bp, Homo sapien
gaattccaacatgctcagagtgcta

SEQ ID NO: 64689 - DNA, 25 bp, Homo sapien
gaattccacagtggccatgctgcac

SEQ ID NO: 64690 - DNA, 25 bp, Homo sapien
gaattccacggtggccatgctgcac

SEQ ID NO: 64691 - DNA, 25 bp, Homo sapien
gaattccagcatgctcagagtgcta

SEQ ID NO: 64692 - DNA, 25 bp, Homo sapien
gaattccatttctgtatatgttcat

SEQ ID NO: 64693 - DNA, 25 bp, Homo sapien
gaattccatttctttatatgttcat

SEQ ID NO: 64694 - DNA, 25 bp, Homo sapien
gaattccattttgaatcggtgctac

SEQ ID NO: 64695 - DNA, 25 bp, Homo sapien
gaattccattttgaattggtgctac

SEQ ID NO: 64696 - DNA, 25 bp, Homo sapien
gaattcccgaattccgctgtctggt

SEQ ID NO: 64697 - DNA, 25 bp, Homo sapien
gaattcccgaattctgctgtctggt

SEQ ID NO: 64698 - DNA, 25 bp, Homo sapien
gaattcctgagtttgaaccatcttc

SEQ ID NO: 64699 - DNA, 25 bp, Homo sapien
gaattcctgagtttgagccatcttc

SEQ ID NO: 64700 - DNA, 25 bp, Homo sapien
gaattcctggaactcaaagaaatgg

SEQ ID NO: 64701 - DNA, 25 bp, Homo sapien
gaattcctggaactgaaagaaatgg

SEQ ID NO: 64702 - DNA, 25 bp, Homo sapien
gaattccttgttaggcaaaaacctt

SEQ ID NO: 64703 - DNA, 25 bp, Homo sapien
gaattccttgttagtcaaaaacctt

SEQ ID NO: 64704 - DNA, 25 bp, Homo sapien
gaattcgccatagcatggtctatgt

SEQ ID NO: 64705 - DNA, 25 bp, Homo sapien
gaattcgccgtagcatggtctatgt

SEQ ID NO: 64706 - DNA, 25 bp, Homo sapien
gaattcgtacgggcttagttccagg

SEQ ID NO: 64707 - DNA, 25 bp, Homo sapien
gaattcgtatgggcttagttccagg

SEQ ID NO: 64708 - DNA, 25 bp, Homo sapien
gaattctaaaaaaagttcaagtaac

SEQ ID NO: 64709 - DNA, 25 bp, Homo sapien
gaattctaaaaaacgttcaagtaac

SEQ ID NO: 64710 - DNA, 25 bp, Homo sapien
gaattctactctatcgactatattg

SEQ ID NO: 64711 - DNA, 25 bp, Homo sapien
gaattctactctattgactatattg

SEQ ID NO: 64712 - DNA, 25 bp, Homo sapien
gaattctgactcgctgatttatcgt

SEQ ID NO: 64713 - DNA, 25 bp, Homo sapien
gaattctgacttgctgatttatcgt

SEQ ID NO: 64714 - DNA, 25 bp, Homo sapien
gaattctgcttccattgccacatct

SEQ ID NO: 64715 - DNA, 25 bp, Homo sapien
gaattctgcttccgttgccacatct

SEQ ID NO: 64716 - DNA, 25 bp, Homo sapien
gaattcttacagcccgttttaagaa

SEQ ID NO: 64717 - DNA, 25 bp, Homo sapien
gaattcttacagcctgttttaagaa

SEQ ID NO: 64718 - DNA, 25 bp, Homo sapien
gaattcttcactgtcaaattattta

SEQ ID NO: 64719 - DNA, 25 bp, Homo sapien
gaattcttccaatatgttaaaagcc

SEQ ID NO: 64720 - DNA, 25 bp, Homo sapien
gaattcttcgctgtcaaattattta

SEQ ID NO: 64721 - DNA, 25 bp, Homo sapien
gaattcttcttcaggcaaatcaggg

SEQ ID NO: 64722 - DNA, 25 bp, Homo sapien
gaattcttgacctggttaagggagg

SEQ ID NO: 64723 - DNA, 25 bp, Homo sapien
gaattcttgacttggttaagggagg

SEQ ID NO: 64724 - DNA, 25 bp, Homo sapien
gaattcttgcaatatgttaaaagcc

SEQ ID NO: 64725 - DNA, 25 bp, Homo sapien
gaattctttttcaggcaaatcaggg

SEQ ID NO: 64726 - DNA, 25 bp, Homo sapien
gaattgatggataaatttttctcag

SEQ ID NO: 64727 - DNA, 25 bp, Homo sapien
gaattgatggataactttttctcag

SEQ ID NO: 64728 - DNA, 25 bp, Homo sapien
gaattgcaaatgtcttaccacttgt

SEQ ID NO: 64729 - DNA, 25 bp, Homo sapien
gaattgcaaatgtcttcccacttgt

SEQ ID NO: 64730 - DNA, 25 bp, Homo sapien
gaattgcagtctaatactcaaaatt

SEQ ID NO: 64731 - DNA, 25 bp, Homo sapien
gaattgcagtctaatattcaaaatt

SEQ ID NO: 64732 - DNA, 25 bp, Homo sapien
gaattgcctaatatcataaaaacag

SEQ ID NO: 64733 - DNA, 25 bp, Homo sapien
gaattgcctgatatcataaaaacag

SEQ ID NO: 64734 - DNA, 25 bp, Homo sapien
gaattgcttatgctcgaattgattt

SEQ ID NO: 64735 - DNA, 25 bp, Homo sapien
gaattgcttatgcttgaattgattt

SEQ ID NO: 64736 - DNA, 25 bp, Homo sapien
gaattgcttctcggtctgtaaatcc

SEQ ID NO: 64737 - DNA, 25 bp, Homo sapien
gaattgcttcttggtctgtaaatcc

SEQ ID NO: 64738 - DNA, 25 bp, Homo sapien
gaattggaacacaatctaactgttg

SEQ ID NO: 64739 - DNA, 25 bp, Homo sapien
gaattggaacacgatctaactgttg

SEQ ID NO: 64740 - DNA, 25 bp, Homo sapien
gaattggaatttagtctcagtgtgt

SEQ ID NO: 64741 - DNA, 25 bp, Homo sapien
gaattggagtttagtctcagtgtgt

SEQ ID NO: 64742 - DNA, 25 bp, Homo sapien
gaattgggcatgagtttagagtgct

SEQ ID NO: 64743 - DNA, 25 bp, Homo sapien
gaattgggcgtgagtttagagtgct

SEQ ID NO: 64744 - DNA, 25 bp, Homo sapien
gaattgggctggatgtggctcagca

SEQ ID NO: 64745 - DNA, 25 bp, Homo sapien
gaattgggttggatgtggctcagca

SEQ ID NO: 64746 - DNA, 25 bp, Homo sapien
gaattgtaagtacaagtgtcagcca

SEQ ID NO: 64747 - DNA, 25 bp, Homo sapien
gaattgtaagtacgagtgtcagcca

SEQ ID NO: 64748 - DNA, 25 bp, Homo sapien
gaattgtctcaggccgcatataaaa

SEQ ID NO: 64749 - DNA, 25 bp, Homo sapien
gaattgtctcaggctgcatataaaa

SEQ ID NO: 64750 - DNA, 25 bp, Homo sapien
gaattgtgcatcgtatggttggcac

SEQ ID NO: 64751 - DNA, 25 bp, Homo sapien
gaattgtgcattgtatggttggcac

SEQ ID NO: 64752 - DNA, 25 bp, Homo sapien
gaattgttttcctatcttgggagaa

SEQ ID NO: 64753 - DNA, 25 bp, Homo sapien
gaattgttttcctctcttgggagaa

SEQ ID NO: 64754 - DNA, 25 bp, Homo sapien
gaatttaacaggagcttcaggtttg

SEQ ID NO: 64755 - DNA, 25 bp, Homo sapien
gaatttaacaggcgcttcaggtttg

SEQ ID NO: 64756 - DNA, 25 bp, Homo sapien
gaatttagtagtgacgccattaggt

SEQ ID NO: 64757 - DNA, 25 bp, Homo sapien
gaatttagtagtgatgccattaggt

SEQ ID NO: 64758 - DNA, 25 bp, Homo sapien
gaatttattgcaacactgtgagttt

SEQ ID NO: 64759 - DNA, 25 bp, Homo sapien
gaatttattgccacactgtgagttt

SEQ ID NO: 64760 - DNA, 25 bp, Homo sapien
gaatttcactgtgttcagagtctga

SEQ ID NO: 64761 - DNA, 25 bp, Homo sapien
gaatttcattgtgttcagagtctga

SEQ ID NO: 64762 - DNA, 25 bp, Homo sapien
gaatttctcccacatgattaagctg

SEQ ID NO: 64763 - DNA, 25 bp, Homo sapien
gaatttctcccacgtgattaagctg

SEQ ID NO: 64764 - DNA, 25 bp, Homo sapien
gaatttctcttcccgggtgcgattc

SEQ ID NO: 64765 - DNA, 25 bp, Homo sapien
gaatttctcttcctgggtgcgattc

SEQ ID NO: 64766 - DNA, 25 bp, Homo sapien
gaatttgaaagacgctaagaagcca

SEQ ID NO: 64767 - DNA, 25 bp, Homo sapien
gaatttgaaagatgctaagaagcca

SEQ ID NO: 64768 - DNA, 25 bp, Homo sapien
gaatttgacagaggacttggacagt

SEQ ID NO: 64769 - DNA, 25 bp, Homo sapien
gaatttgacagaggtcttggacagt

SEQ ID NO: 64770 - DNA, 25 bp, Homo sapien
gaatttgacattggttctcctgtgt

SEQ ID NO: 64771 - DNA, 25 bp, Homo sapien
gaatttgacattggttttcctgtgt

SEQ ID NO: 64772 - DNA, 25 bp, Homo sapien
gaatttgacttgttggcatgttaat

SEQ ID NO: 64773 - DNA, 25 bp, Homo sapien
gaatttgacttgttggtatgttaat

SEQ ID NO: 64774 - DNA, 25 bp, Homo sapien
gaatttgatgggtagagagcaaaaa

SEQ ID NO: 64775 - DNA, 25 bp, Homo sapien
gaatttgatgggtatagagcaaaaa

SEQ ID NO: 64776 - DNA, 25 bp, Homo sapien
gaatttggaatcaagatagtttggg

SEQ ID NO: 64777 - DNA, 25 bp, Homo sapien
gaatttggaatcgagatagtttggg

SEQ ID NO: 64778 - DNA, 25 bp, Homo sapien
gaatttggagaggtataaaatgagg

SEQ ID NO: 64779 - DNA, 25 bp, Homo sapien
gaatttggagagttataaaatgagg

SEQ ID NO: 64780 - DNA, 25 bp, Homo sapien
gaatttggtgctctaagaaccaaga

SEQ ID NO: 64781 - DNA, 25 bp, Homo sapien
gaatttggtgctgtaagaaccaaga

SEQ ID NO: 64782 - DNA, 25 bp, Homo sapien
gaatttgtcatttaaagatcctaat

SEQ ID NO: 64783 - DNA, 25 bp, Homo sapien
gaatttgtccactttcactgatgtc

SEQ ID NO: 64784 - DNA, 25 bp, Homo sapien
gaatttgtccatatttccatgtatt

SEQ ID NO: 64785 - DNA, 25 bp, Homo sapien
gaatttgtccatattttcatgtatt

SEQ ID NO: 64786 - DNA, 25 bp, Homo sapien
gaatttgtcgtttaaagatcctaat

SEQ ID NO: 64787 - DNA, 25 bp, Homo sapien
gaatttgtgagataagtctgcaaac

SEQ ID NO: 64788 - DNA, 25 bp, Homo sapien
gaatttgtgagatcagtctgcaaac

SEQ ID NO: 64789 - DNA, 25 bp, Homo sapien
gaatttgttcactttcactgatgtc

SEQ ID NO: 64790 - DNA, 25 bp, Homo sapien
gaattttcaaacattatcaaaatga

SEQ ID NO: 64791 - DNA, 25 bp, Homo sapien
gaattttcaaactttatcaaaatga

SEQ ID NO: 64792 - DNA, 25 bp, Homo sapien
gaattttcactgacagaaagataga

SEQ ID NO: 64793 - DNA, 25 bp, Homo sapien
gaattttcattgacagaaagataga

SEQ ID NO: 64794 - DNA, 25 bp, Homo sapien
gaattttccgtctttaattctataa

SEQ ID NO: 64795 - DNA, 25 bp, Homo sapien
gaattttctcgggtgatagaaatgt

SEQ ID NO: 64796 - DNA, 25 bp, Homo sapien
gaattttctgtctttaattctataa

SEQ ID NO: 64797 - DNA, 25 bp, Homo sapien
gaattttcttgggtgatagaaatgt

SEQ ID NO: 64798 - DNA, 25 bp, Homo sapien
gaattttgaagacacacaggcattc

SEQ ID NO: 64799 - DNA, 25 bp, Homo sapien
gaattttgaagagacacaggcattc

SEQ ID NO: 64800 - DNA, 25 bp, Homo sapien
gaattttgcaagtgcttcaggccgg

SEQ ID NO: 64801 - DNA, 25 bp, Homo sapien
gaattttgcataggcatctactaca

SEQ ID NO: 64802 - DNA, 25 bp, Homo sapien
gaattttgcattggcatctactaca

SEQ ID NO: 64803 - DNA, 25 bp, Homo sapien
gaattttgcctgggaaaaagtcttg

SEQ ID NO: 64804 - DNA, 25 bp, Homo sapien
gaattttgcctgggaagaagtcttg

SEQ ID NO: 64805 - DNA, 25 bp, Homo sapien
gaattttggaagtgcttcaggccgg

SEQ ID NO: 64806 - DNA, 25 bp, Homo sapien
gaattttgtaattttcattgctctc

SEQ ID NO: 64807 - DNA, 25 bp, Homo sapien
gaattttgtaattttcgttgctctc

SEQ ID NO: 64808 - DNA, 25 bp, Homo sapien
gaattttgtagacatgattaagagc

SEQ ID NO: 64809 - DNA, 25 bp, Homo sapien
gaattttgtagacatggttaagagc

SEQ ID NO: 64810 - DNA, 25 bp, Homo sapien
gaatttttctactgtggaatttttc

SEQ ID NO: 64811 - DNA, 25 bp, Homo sapien
gaatttttctcccgtaatgcataat

SEQ ID NO: 64812 - DNA, 25 bp, Homo sapien
gaatttttctcctgtaatgcataat

SEQ ID NO: 64813 - DNA, 25 bp, Homo sapien
gaatttttgacagattttaatgaag

SEQ ID NO: 64814 - DNA, 25 bp, Homo sapien
gaatttttgacggattttaatgaag

SEQ ID NO: 64815 - DNA, 25 bp, Homo sapien
gaatttttgtactgtggaatttttc

SEQ ID NO: 64816 - DNA, 25 bp, Homo sapien
gaatttttgttttagtaggcagcta

SEQ ID NO: 64817 - DNA, 25 bp, Homo sapien
gaatttttgttttcgtaggcagcta

SEQ ID NO: 64818 - DNA, 25 bp, Homo sapien
gacaaaaaagtagaactaataagtg

SEQ ID NO: 64819 - DNA, 25 bp, Homo sapien
gacaaaaaagtagacctaataagtg

SEQ ID NO: 64820 - DNA, 25 bp, Homo sapien
gacaaaaagaactgtaaaggtcaag

SEQ ID NO: 64821 - DNA, 25 bp, Homo sapien
gacaaaaagaattgtaaaggtcaag

SEQ ID NO: 64822 - DNA, 25 bp, Homo sapien
gacaaaaagcgttactagaaatcaa

SEQ ID NO: 64823 - DNA, 25 bp, Homo sapien
gacaaaaagtaaagcaagtgtgagc

SEQ ID NO: 64824 - DNA, 25 bp, Homo sapien
gacaaaaagtaaggcaagtgtgagc

SEQ ID NO: 64825 - DNA, 25 bp, Homo sapien
gacaaaaagtgttactagaaatcaa

SEQ ID NO: 64826 - DNA, 25 bp, Homo sapien
gacaaaacaacagctggaaagctca

SEQ ID NO: 64827 - DNA, 25 bp, Homo sapien
gacaaaacgacagctggaaagctca

SEQ ID NO: 64828 - DNA, 25 bp, Homo sapien
gacaaaatatgcctgcacttcctag

SEQ ID NO: 64829 - DNA, 25 bp, Homo sapien
gacaaaatatgcctgcgcttcctag

SEQ ID NO: 64830 - DNA, 25 bp, Homo sapien
gacaaacaagtaagaagtttcccaa

SEQ ID NO: 64831 - DNA, 25 bp, Homo sapien
gacaaacaagtcagaagtttcccaa

SEQ ID NO: 64832 - DNA, 25 bp, Homo sapien
gacaaacaccgaaaagaatagagta

SEQ ID NO: 64833 - DNA, 25 bp, Homo sapien
gacaaacactgaaaagaatagagta

SEQ ID NO: 64834 - DNA, 25 bp, Homo sapien
gacaaacggctagtatccagaatct

SEQ ID NO: 64835 - DNA, 25 bp, Homo sapien
gacaaacggctagtgtccagaatct

SEQ ID NO: 64836 - DNA, 25 bp, Homo sapien
gacaaactgatgcacaaaaccaatg

SEQ ID NO: 64837 - DNA, 25 bp, Homo sapien
gacaaactgatggacaaaaccaatg

SEQ ID NO: 64838 - DNA, 25 bp, Homo sapien
gacaaagaacaggagtacccaggaa

SEQ ID NO: 64839 - DNA, 25 bp, Homo sapien
gacaaagaacaggattacccaggaa

SEQ ID NO: 64840 - DNA, 25 bp, Homo sapien
gacaaagacaccataaataggatac

SEQ ID NO: 64841 - DNA, 25 bp, Homo sapien
gacaaagacactataaataggatac

SEQ ID NO: 64842 - DNA, 25 bp, Homo sapien
gacaaagagggcacgggctccgcag

SEQ ID NO: 64843 - DNA, 25 bp, Homo sapien
gacaaagagggcatgggctccgcag

SEQ ID NO: 64844 - DNA, 25 bp, Homo sapien
gacaaagagtagcatgcgattctaa

SEQ ID NO: 64845 - DNA, 25 bp, Homo sapien
gacaaagagtagcatgtgattctaa

SEQ ID NO: 64846 - DNA, 25 bp, Homo sapien
gacaaagcaagacaaatgacctgga

SEQ ID NO: 64847 - DNA, 25 bp, Homo sapien
gacaaagcaagacagatgacctgga

SEQ ID NO: 64848 - DNA, 25 bp, Homo sapien
gacaaagcactacactggctctcgt

SEQ ID NO: 64849 - DNA, 25 bp, Homo sapien
gacaaagcactatactggctctcgt

SEQ ID NO: 64850 - DNA, 25 bp, Homo sapien
gacaaagtcactcacggtctaaaga

SEQ ID NO: 64851 - DNA, 25 bp, Homo sapien
gacaaagtcactcatggtctaaaga

SEQ ID NO: 64852 - DNA, 25 bp, Homo sapien
gacaaagtttccaaaaagtctccag

SEQ ID NO: 64853 - DNA, 25 bp, Homo sapien
gacaaagtttccgaaaagtctccag

SEQ ID NO: 64854 - DNA, 25 bp, Homo sapien
gacaaataataaaccataaatatgt

SEQ ID NO: 64855 - DNA, 25 bp, Homo sapien
gacaaataataaatcataaatatgt

SEQ ID NO: 64856 - DNA, 25 bp, Homo sapien
gacaaataatacaagagaaaaagaa

SEQ ID NO: 64857 - DNA, 25 bp, Homo sapien
gacaaataatataagagaaaaagaa

SEQ ID NO: 64858 - DNA, 25 bp, Homo sapien
gacaaatacaggaacccagttgaca

SEQ ID NO: 64859 - DNA, 25 bp, Homo sapien
gacaaatataggaacccagttgaca

SEQ ID NO: 64860 - DNA, 25 bp, Homo sapien
gacaaatcaaaattagtatttctta

SEQ ID NO: 64861 - DNA, 25 bp, Homo sapien
gacaaatcagtgccacagttgcacc

SEQ ID NO: 64862 - DNA, 25 bp, Homo sapien
gacaaatcagtgctacagttgcacc

SEQ ID NO: 64863 - DNA, 25 bp, Homo sapien
gacaaatcatgaaaatatgagatta

SEQ ID NO: 64864 - DNA, 25 bp, Homo sapien
gacaaatcatgagaatatgagatta

SEQ ID NO: 64865 - DNA, 25 bp, Homo sapien
gacaaatccaaattagtatttctta

SEQ ID NO: 64866 - DNA, 25 bp, Homo sapien
gacaaatctaaccagaagaggagac

SEQ ID NO: 64867 - DNA, 25 bp, Homo sapien
gacaaatctaactagaagaggagac

SEQ ID NO: 64868 - DNA, 25 bp, Homo sapien
gacaaatctgccattgtaaagagat

SEQ ID NO: 64869 - DNA, 25 bp, Homo sapien
gacaaatctgccgttgtaaagagat

SEQ ID NO: 64870 - DNA, 25 bp, Homo sapien
gacaaatctggtgagttctcaagga

SEQ ID NO: 64871 - DNA, 25 bp, Homo sapien
gacaaatctggttagttctcaagga

SEQ ID NO: 64872 - DNA, 25 bp, Homo sapien
gacaaatgagaacagatctacctta

SEQ ID NO: 64873 - DNA, 25 bp, Homo sapien
gacaaatgataacagatctacctta

SEQ ID NO: 64874 - DNA, 25 bp, Homo sapien
gacaaatgtcctcatgcctacctac

SEQ ID NO: 64875 - DNA, 25 bp, Homo sapien
gacaaatgtcctcgtgcctacctac

SEQ ID NO: 64876 - DNA, 25 bp, Homo sapien
gacaacaaataatttgatacgtaag

SEQ ID NO: 64877 - DNA, 25 bp, Homo sapien
gacaacaaatagtttgatacgtaag

SEQ ID NO: 64878 - DNA, 25 bp, Homo sapien
gacaacaactggctacatggcctga

SEQ ID NO: 64879 - DNA, 25 bp, Homo sapien
gacaacaactgggtacatggcctga

SEQ ID NO: 64880 - DNA, 25 bp, Homo sapien
gacaacaattgggaaacactcttgc

SEQ ID NO: 64881 - DNA, 25 bp, Homo sapien
gacaacaattgggaaatactcttgc

SEQ ID NO: 64882 - DNA, 25 bp, Homo sapien
gacaacacaataccaatgaaggaaa

SEQ ID NO: 64883 - DNA, 25 bp, Homo sapien
gacaacacaataccgatgaaggaaa

SEQ ID NO: 64884 - DNA, 25 bp, Homo sapien
gacaacactatgccctttcactctt

SEQ ID NO: 64885 - DNA, 25 bp, Homo sapien
gacaacactatgccttttcactctt

SEQ ID NO: 64886 - DNA, 25 bp, Homo sapien
gacaacatagaaaaagataatcaaa

SEQ ID NO: 64887 - DNA, 25 bp, Homo sapien
gacaacatagaaaaggataatcaaa

SEQ ID NO: 64888 - DNA, 25 bp, Homo sapien
gacaaccaatccactgaataagaga

SEQ ID NO: 64889 - DNA, 25 bp, Homo sapien
gacaaccaatccgctgaataagaga

SEQ ID NO: 64890 - DNA, 25 bp, Homo sapien
gacaacccacaggactaaacttgcc

SEQ ID NO: 64891 - DNA, 25 bp, Homo sapien
gacaacccacaggcctaaacttgcc

SEQ ID NO: 64892 - DNA, 25 bp, Homo sapien
gacaacgacgatgatgatgatgatg

SEQ ID NO: 64893 - DNA, 25 bp, Homo sapien
gacaacgatgatgatgatgatgatg

SEQ ID NO: 64894 - DNA, 25 bp, Homo sapien
gacaacgtgcaacataggactctga

SEQ ID NO: 64895 - DNA, 25 bp, Homo sapien
gacaacgtgcaatataggactctga

SEQ ID NO: 64896 - DNA, 25 bp, Homo sapien
gacaactctttttcaattaaaacct

SEQ ID NO: 64897 - DNA, 25 bp, Homo sapien
gacaactctttttcgattaaaacct

SEQ ID NO: 64898 - DNA, 25 bp, Homo sapien
gacaactgcatcctaagtactaatt

SEQ ID NO: 64899 - DNA, 25 bp, Homo sapien
gacaactggatcctaagtactaatt

SEQ ID NO: 64900 - DNA, 25 bp, Homo sapien
gacaactgggaggttccgattttgt

SEQ ID NO: 64901 - DNA, 25 bp, Homo sapien
gacaactgggaggttctgattttgt

SEQ ID NO: 64902 - DNA, 25 bp, Homo sapien
gacaactgtaaatgtctttttacct

SEQ ID NO: 64903 - DNA, 25 bp, Homo sapien
gacaactgtaattgtctttttacct

SEQ ID NO: 64904 - DNA, 25 bp, Homo sapien
gacaactgttcattacatgttacta

SEQ ID NO: 64905 - DNA, 25 bp, Homo sapien
gacaactgttcatttcatgttacta

SEQ ID NO: 64906 - DNA, 25 bp, Homo sapien
gacaactgttcttctctctggatcc

SEQ ID NO: 64907 - DNA, 25 bp, Homo sapien
gacaactgttcttgtctctggatcc

SEQ ID NO: 64908 - DNA, 25 bp, Homo sapien
gacaacttggtatttcgttcattct

SEQ ID NO: 64909 - DNA, 25 bp, Homo sapien
gacaacttggtatttctttcattct

SEQ ID NO: 64910 - DNA, 25 bp, Homo sapien
gacaacttttccacggactgaggtt

SEQ ID NO: 64911 - DNA, 25 bp, Homo sapien
gacaacttttccatggactgaggtt

SEQ ID NO: 64912 - DNA, 25 bp, Homo sapien
gacaagaaatgcctccatagagtcc

SEQ ID NO: 64913 - DNA, 25 bp, Homo sapien
gacaagaaatgccttcatagagtcc

SEQ ID NO: 64914 - DNA, 25 bp, Homo sapien
gacaagaatacaatacagtacttag

SEQ ID NO: 64915 - DNA, 25 bp, Homo sapien
gacaagaatacgatacagtacttag

SEQ ID NO: 64916 - DNA, 25 bp, Homo sapien
gacaagaatcgtcaagattgagaca

SEQ ID NO: 64917 - DNA, 25 bp, Homo sapien
gacaagaattgtcaagattgagaca

SEQ ID NO: 64918 - DNA, 25 bp, Homo sapien
gacaagacaaaaagcgttactagaa

SEQ ID NO: 64919 - DNA, 25 bp, Homo sapien
gacaagacaaaaagtgttactagaa

SEQ ID NO: 64920 - DNA, 25 bp, Homo sapien
gacaagaccacaaactccctgtcac

SEQ ID NO: 64921 - DNA, 25 bp, Homo sapien
gacaagaccacagactccctgtcac

SEQ ID NO: 64922 - DNA, 25 bp, Homo sapien
gacaagagaagcctgtaaatccgtt

SEQ ID NO: 64923 - DNA, 25 bp, Homo sapien
gacaagagaaggctgtaaatccgtt

SEQ ID NO: 64924 - DNA, 25 bp, Homo sapien
gacaagatggttatatagcagggct

SEQ ID NO: 64925 - DNA, 25 bp, Homo sapien
gacaagatggttatattgcagggct

SEQ ID NO: 64926 - DNA, 25 bp, Homo sapien
gacaagcagattttaaaatttatgt

SEQ ID NO: 64927 - DNA, 25 bp, Homo sapien
gacaagcagatttttaaatttatgt

SEQ ID NO: 64928 - DNA, 25 bp, Homo sapien
gacaagcgttttgattaagtgctgg

SEQ ID NO: 64929 - DNA, 25 bp, Homo sapien
gacaagcgttttgatttagtgctgg

SEQ ID NO: 64930 - DNA, 25 bp, Homo sapien
gacaaggcacttcgtagcacaatga

SEQ ID NO: 64931 - DNA, 25 bp, Homo sapien
gacaaggcactttgtagcacaatga

SEQ ID NO: 64932 - DNA, 25 bp, Homo sapien
gacaaggccattgaaccagacagaa

SEQ ID NO: 64933 - DNA, 25 bp, Homo sapien
gacaaggccattgacccagacagaa

SEQ ID NO: 64934 - DNA, 25 bp, Homo sapien
gacaagggttaaacgtagtggtaag

SEQ ID NO: 64935 - DNA, 25 bp, Homo sapien
gacaagggttaaatgtagtggtaag

SEQ ID NO: 64936 - DNA, 25 bp, Homo sapien
gacaaggtcaaaagttgattataag

SEQ ID NO: 64937 - DNA, 25 bp, Homo sapien
gacaaggtcaaatgttgattataag

SEQ ID NO: 64938 - DNA, 25 bp, Homo sapien
gacaagtaaacacatgagtataagg

SEQ ID NO: 64939 - DNA, 25 bp, Homo sapien
gacaagtaaacagatgagtataagg

SEQ ID NO: 64940 - DNA, 25 bp, Homo sapien
gacaataatacgacttgattagttc

SEQ ID NO: 64941 - DNA, 25 bp, Homo sapien
gacaataatacggcttgattagttc

SEQ ID NO: 64942 - DNA, 25 bp, Homo sapien
gacaatactgacccagttgttaact

SEQ ID NO: 64943 - DNA, 25 bp, Homo sapien
gacaatactgacgcagttgttaact

SEQ ID NO: 64944 - DNA, 25 bp, Homo sapien
gacaatagccgaaacttaccagtta

SEQ ID NO: 64945 - DNA, 25 bp, Homo sapien
gacaatagcggaaacttaccagtta

SEQ ID NO: 64946 - DNA, 25 bp, Homo sapien
gacaatatccagggttacttctagc

SEQ ID NO: 64947 - DNA, 25 bp, Homo sapien
gacaatatccagggttccttctagc

SEQ ID NO: 64948 - DNA, 25 bp, Homo sapien
gacaatcctttccacaaattaccat

SEQ ID NO: 64949 - DNA, 25 bp, Homo sapien
gacaatcctttccataaattaccat

SEQ ID NO: 64950 - DNA, 25 bp, Homo sapien
gacaatcggatctccatgaacacat

SEQ ID NO: 64951 - DNA, 25 bp, Homo sapien
gacaatcgggtctccatgaacacat

SEQ ID NO: 64952 - DNA, 25 bp, Homo sapien
gacaatcttttaccagaactttgaa

SEQ ID NO: 64953 - DNA, 25 bp, Homo sapien
gacaatcttttaccagcactttgaa

SEQ ID NO: 64954 - DNA, 25 bp, Homo sapien
gacaatgaacagggtaagtataata

SEQ ID NO: 64955 - DNA, 25 bp, Homo sapien
gacaatgaacatggtaagtataata

SEQ ID NO: 64956 - DNA, 25 bp, Homo sapien
gacaatgatttctaagcacctgtat

SEQ ID NO: 64957 - DNA, 25 bp, Homo sapien
gacaatgatttgtaagcacctgtat

SEQ ID NO: 64958 - DNA, 25 bp, Homo sapien
gacaatgggaccacataattgaagt

SEQ ID NO: 64959 - DNA, 25 bp, Homo sapien
gacaatgggactacataattgaagt

SEQ ID NO: 64960 - DNA, 25 bp, Homo sapien
gacaattaccacactataaactaca

SEQ ID NO: 64961 - DNA, 25 bp, Homo sapien
gacaattactacactataaactaca

SEQ ID NO: 64962 - DNA, 25 bp, Homo sapien
gacaattagagaatgaatgcctagg

SEQ ID NO: 64963 - DNA, 25 bp, Homo sapien
gacaattagaggatgaatgcctagg

SEQ ID NO: 64964 - DNA, 25 bp, Homo sapien
gacaattcagagtgaaatgttgggc

SEQ ID NO: 64965 - DNA, 25 bp, Homo sapien
gacaattcagagttaaatgttgggc

SEQ ID NO: 64966 - DNA, 25 bp, Homo sapien
gacaattgaccaactgtgcgtggaa

SEQ ID NO: 64967 - DNA, 25 bp, Homo sapien
gacaattgaccgactgtgcgtggaa

SEQ ID NO: 64968 - DNA, 25 bp, Homo sapien
gacaatttacataagggtatgtctt

SEQ ID NO: 64969 - DNA, 25 bp, Homo sapien
gacaatttagataagggtatgtctt

SEQ ID NO: 64970 - DNA, 25 bp, Homo sapien
gacacaaagatgttatctggctttt

SEQ ID NO: 64971 - DNA, 25 bp, Homo sapien
gacacaaatatgttatctggctttt

SEQ ID NO: 64972 - DNA, 25 bp, Homo sapien
gacacaagcctggccgagcttgcca

SEQ ID NO: 64973 - DNA, 25 bp, Homo sapien
gacacaagcctggctgagcttgcca

SEQ ID NO: 64974 - DNA, 25 bp, Homo sapien
gacacaaggcatgcagaaaccctcg

SEQ ID NO: 64975 - DNA, 25 bp, Homo sapien
gacacaagggaataatatgtgctta

SEQ ID NO: 64976 - DNA, 25 bp, Homo sapien
gacacaagggagtaatatgtgctta

SEQ ID NO: 64977 - DNA, 25 bp, Homo sapien
gacacaaggtatgcagaaaccctcg

SEQ ID NO: 64978 - DNA, 25 bp, Homo sapien
gacacacaatgtacgctaaatgtac

SEQ ID NO: 64979 - DNA, 25 bp, Homo sapien
gacacacaatgtatgctaaatgtac

SEQ ID NO: 64980 - DNA, 25 bp, Homo sapien
gacacacacaaaaatgtcaatagag

SEQ ID NO: 64981 - DNA, 25 bp, Homo sapien
gacacacacaaaattgtcaatagag

SEQ ID NO: 64982 - DNA, 25 bp, Homo sapien
gacacacagctagaagacacttacc

SEQ ID NO: 64983 - DNA, 25 bp, Homo sapien
gacacacagctagatgacacttacc

SEQ ID NO: 64984 - DNA, 25 bp, Homo sapien
gacacagaaagtaggtctgagcagt

SEQ ID NO: 64985 - DNA, 25 bp, Homo sapien
gacacagaaagtaggtttgagcagt

SEQ ID NO: 64986 - DNA, 25 bp, Homo sapien
gacacagaaatacagacccagtaaa

SEQ ID NO: 64987 - DNA, 25 bp, Homo sapien
gacacagaagctccgcaagaaacat

SEQ ID NO: 64988 - DNA, 25 bp, Homo sapien
gacacagaagcttcgcaagaaacat

SEQ ID NO: 64989 - DNA, 25 bp, Homo sapien
gacacagaattacagacccagtaaa

SEQ ID NO: 64990 - DNA, 25 bp, Homo sapien
gacacagacggggcaaggccacttt

SEQ ID NO: 64991 - DNA, 25 bp, Homo sapien
gacacagacggggctaggccacttt

SEQ ID NO: 64992 - DNA, 25 bp, Homo sapien
gacacagagaggcgtgaaagtagat

SEQ ID NO: 64993 - DNA, 25 bp, Homo sapien
gacacagagaggtgtgaaagtagat

SEQ ID NO: 64994 - DNA, 25 bp, Homo sapien
gacacagagcggcgctgccaccaca

SEQ ID NO: 64995 - DNA, 25 bp, Homo sapien
gacacagagcggtgctgccaccaca

SEQ ID NO: 64996 - DNA, 25 bp, Homo sapien
gacacagtcagatccgttagcaaac

SEQ ID NO: 64997 - DNA, 25 bp, Homo sapien
gacacagtcaggtccgttagcaaac

SEQ ID NO: 64998 - DNA, 25 bp, Homo sapien
gacacatactctcatcttctgacaa

SEQ ID NO: 64999 - DNA, 25 bp, Homo sapien
gacacatactctcgtcttctgacaa

SEQ ID NO: 65000 - DNA, 25 bp, Homo sapien
gacacatcctgaataaggctataag

SEQ ID NO: 65001 - DNA, 25 bp, Homo sapien
gacacatcctgagtaaggctataag

SEQ ID NO: 65002 - DNA, 25 bp, Homo sapien
gacacattccctgtcaatttcttga

SEQ ID NO: 65003 - DNA, 25 bp, Homo sapien
gacacattccctgttaatttcttga

SEQ ID NO: 65004 - DNA, 25 bp, Homo sapien
gacaccacttttaaataacagcaat

SEQ ID NO: 65005 - DNA, 25 bp, Homo sapien
gacaccacttttaagtaacagcaat

SEQ ID NO: 65006 - DNA, 25 bp, Homo sapien
gacaccatgcttctgagaagacagg

SEQ ID NO: 65007 - DNA, 25 bp, Homo sapien
gacaccatgcttttgagaagacagg

SEQ ID NO: 65008 - DNA, 25 bp, Homo sapien
gacacccaaatacgctggcttgatc

SEQ ID NO: 65009 - DNA, 25 bp, Homo sapien
gacacccaaatatgctggcttgatc

SEQ ID NO: 65010 - DNA, 25 bp, Homo sapien
gacaccgaaaatgagtgacaccgaa

SEQ ID NO: 65011 - DNA, 25 bp, Homo sapien
gacaccgaaaattagtgacaccgaa

SEQ ID NO: 65012 - DNA, 25 bp, Homo sapien
gacacctatatcatccagacaattc

SEQ ID NO: 65013 - DNA, 25 bp, Homo sapien
gacacctatattatccagacaattc

SEQ ID NO: 65014 - DNA, 25 bp, Homo sapien
gacacctcaaaacagtggtgaggtt

SEQ ID NO: 65015 - DNA, 25 bp, Homo sapien
gacacctcaaaacggtggtgaggtt

SEQ ID NO: 65016 - DNA, 25 bp, Homo sapien
gacacgcatgacgagtgagtgctct

SEQ ID NO: 65017 - DNA, 25 bp, Homo sapien
gacacgcatgatgagtgagtgctct

SEQ ID NO: 65018 - DNA, 25 bp, Homo sapien
gacacgggactccgccatcaagcgt

SEQ ID NO: 65019 - DNA, 25 bp, Homo sapien
gacacgggactctgccatcaagcgt

SEQ ID NO: 65020 - DNA, 25 bp, Homo sapien
gacacgtgtgaccgctgaaattaac

SEQ ID NO: 65021 - DNA, 25 bp, Homo sapien
gacacgtgtgactgctgaaattaac

SEQ ID NO: 65022 - DNA, 25 bp, Homo sapien
gacactaactggtacagatcagctg

SEQ ID NO: 65023 - DNA, 25 bp, Homo sapien
gacactaagaaattcactattcaag

SEQ ID NO: 65024 - DNA, 25 bp, Homo sapien
gacactaagaaatttactattcaag

SEQ ID NO: 65025 - DNA, 25 bp, Homo sapien
gacactaagtggtacagatcagctg

SEQ ID NO: 65026 - DNA, 25 bp, Homo sapien
gacactaatacacggatcttgacga

SEQ ID NO: 65027 - DNA, 25 bp, Homo sapien
gacactaatacatggatcttgacga

SEQ ID NO: 65028 - DNA, 25 bp, Homo sapien
gacactaataggtgcgttgaaggga

SEQ ID NO: 65029 - DNA, 25 bp, Homo sapien
gacactaataggtgtgttgaaggga

SEQ ID NO: 65030 - DNA, 25 bp, Homo sapien
gacactacattagttagttaagctt

SEQ ID NO: 65031 - DNA, 25 bp, Homo sapien
gacactacattagttatttaagctt

SEQ ID NO: 65032 - DNA, 25 bp, Homo sapien
gacactaccaatgggccgaatgggg

SEQ ID NO: 65033 - DNA, 25 bp, Homo sapien
gacactaccaatgggctgaatgggg

SEQ ID NO: 65034 - DNA, 25 bp, Homo sapien
gacactcaccgtaaagatcagtaaa

SEQ ID NO: 65035 - DNA, 25 bp, Homo sapien
gacactcatcgtaaagatcagtaaa

SEQ ID NO: 65036 - DNA, 25 bp, Homo sapien
gacactctcaggacgctgcaagttg

SEQ ID NO: 65037 - DNA, 25 bp, Homo sapien
gacactctcaggatgctgcaagttg

SEQ ID NO: 65038 - DNA, 25 bp, Homo sapien
gacactgaaatcatatcttgctcat

SEQ ID NO: 65039 - DNA, 25 bp, Homo sapien
gacactgaaatgatatcttgctcat

SEQ ID NO: 65040 - DNA, 25 bp, Homo sapien
gacactgacgttcagttttgcttgt

SEQ ID NO: 65041 - DNA, 25 bp, Homo sapien
gacactgagactaagatgtgaagtg

SEQ ID NO: 65042 - DNA, 25 bp, Homo sapien
gacactgaggaactgctgaccaagg

SEQ ID NO: 65043 - DNA, 25 bp, Homo sapien
gacactgaggaattgctgaccaagg

SEQ ID NO: 65044 - DNA, 25 bp, Homo sapien
gacactgaggattgttccctgtgca

SEQ ID NO: 65045 - DNA, 25 bp, Homo sapien
gacactgagtattgttccctgtgca

SEQ ID NO: 65046 - DNA, 25 bp, Homo sapien
gacactgatactaagatgtgaagtg

SEQ ID NO: 65047 - DNA, 25 bp, Homo sapien
gacactgatcaccaaatcttgactg

SEQ ID NO: 65048 - DNA, 25 bp, Homo sapien
gacactgatgttcagttttgcttgt

SEQ ID NO: 65049 - DNA, 25 bp, Homo sapien
gacactgattaccaaatcttgactg

SEQ ID NO: 65050 - DNA, 25 bp, Homo sapien
gacactgcagactgtaatgtttccc

SEQ ID NO: 65051 - DNA, 25 bp, Homo sapien
gacactgcggactgtaatgtttccc

SEQ ID NO: 65052 - DNA, 25 bp, Homo sapien
gacactggtggtactaccaaggctt

SEQ ID NO: 65053 - DNA, 25 bp, Homo sapien
gacactggtggtactatcaaggctt

SEQ ID NO: 65054 - DNA, 25 bp, Homo sapien
gacactggttttgcgggagcaggat

SEQ ID NO: 65055 - DNA, 25 bp, Homo sapien
gacactggttttgtgggagcaggat

SEQ ID NO: 65056 - DNA, 25 bp, Homo sapien
gacacttacattttacactgtgaac

SEQ ID NO: 65057 - DNA, 25 bp, Homo sapien
gacacttacctggggatgtaaagac

SEQ ID NO: 65058 - DNA, 25 bp, Homo sapien
gacacttacctgggtatgtaaagac

SEQ ID NO: 65059 - DNA, 25 bp, Homo sapien
gacacttatattttacactgtgaac

SEQ ID NO: 65060 - DNA, 25 bp, Homo sapien
gacacttcatacagagagtttggat

SEQ ID NO: 65061 - DNA, 25 bp, Homo sapien
gacacttcatacggagagtttggat

SEQ ID NO: 65062 - DNA, 25 bp, Homo sapien
gacacttgaagcatcacactaggaa

SEQ ID NO: 65063 - DNA, 25 bp, Homo sapien
gacacttgaagcgtcacactaggaa

SEQ ID NO: 65064 - DNA, 25 bp, Homo sapien
gacagaaacaaagcaaaagtatcta

SEQ ID NO: 65065 - DNA, 25 bp, Homo sapien
gacagaaacaaaggaaaagtatcta

SEQ ID NO: 65066 - DNA, 25 bp, Homo sapien
gacagaaacagacaggaactttctc

SEQ ID NO: 65067 - DNA, 25 bp, Homo sapien
gacagaaaccataaataggaaaagc

SEQ ID NO: 65068 - DNA, 25 bp, Homo sapien
gacagaaaccatgaataggaaaagc

SEQ ID NO: 65069 - DNA, 25 bp, Homo sapien
gacagaaatagacaggaactttctc

SEQ ID NO: 65070 - DNA, 25 bp, Homo sapien
gacagaaatttggggaagttgataa

SEQ ID NO: 65071 - DNA, 25 bp, Homo sapien
gacagaaatttgggtaagttgataa

SEQ ID NO: 65072 - DNA, 25 bp, Homo sapien
gacagaacctggagaatgaaggtgg

SEQ ID NO: 65073 - DNA, 25 bp, Homo sapien
gacagaacctggcgaatgaaggtgg

SEQ ID NO: 65074 - DNA, 25 bp, Homo sapien
gacagaatcgggtatgtgagacttc

SEQ ID NO: 65075 - DNA, 25 bp, Homo sapien
gacagaatgagccagggcctagagg

SEQ ID NO: 65076 - DNA, 25 bp, Homo sapien
gacagaatgagcgagggcctagagg

SEQ ID NO: 65077 - DNA, 25 bp, Homo sapien
gacagaattggaatttagtctcagt

SEQ ID NO: 65078 - DNA, 25 bp, Homo sapien
gacagaattggagtttagtctcagt

SEQ ID NO: 65079 - DNA, 25 bp, Homo sapien
gacagaattgggtatgtgagacttc

SEQ ID NO: 65080 - DNA, 25 bp, Homo sapien
gacagaattgtatcctctctgcaaa

SEQ ID NO: 65081 - DNA, 25 bp, Homo sapien
gacagaattgtgtcctctctgcaaa

SEQ ID NO: 65082 - DNA, 25 bp, Homo sapien
gacagacaatcattcagaccacagc

SEQ ID NO: 65083 - DNA, 25 bp, Homo sapien
gacagacagagaaagagaaaatgtg

SEQ ID NO: 65084 - DNA, 25 bp, Homo sapien
gacagacagagaaagataaaatgtg

SEQ ID NO: 65085 - DNA, 25 bp, Homo sapien
gacagacagagagttaatccagggt

SEQ ID NO: 65086 - DNA, 25 bp, Homo sapien
gacagacagagatttaatccagggt

SEQ ID NO: 65087 - DNA, 25 bp, Homo sapien
gacagacagtcattcagaccacagc

SEQ ID NO: 65088 - DNA, 25 bp, Homo sapien
gacagacataatcaacagttagcca

SEQ ID NO: 65089 - DNA, 25 bp, Homo sapien
gacagacatcatcaacagttagcca

SEQ ID NO: 65090 - DNA, 25 bp, Homo sapien
gacagaccattccgcgtcagttggt

SEQ ID NO: 65091 - DNA, 25 bp, Homo sapien
gacagaccattccgtgtcagttggt

SEQ ID NO: 65092 - DNA, 25 bp, Homo sapien
gacagacggaacaaaagcccacagc

SEQ ID NO: 65093 - DNA, 25 bp, Homo sapien
gacagacggaacgaaagcccacagc

SEQ ID NO: 65094 - DNA, 25 bp, Homo sapien
gacagactccatcttggctctttca

SEQ ID NO: 65095 - DNA, 25 bp, Homo sapien
gacagactccatgttggctctttca

SEQ ID NO: 65096 - DNA, 25 bp, Homo sapien
gacagactttctggaagaaataaaa

SEQ ID NO: 65097 - DNA, 25 bp, Homo sapien
gacagactttctgggagaaataaaa

SEQ ID NO: 65098 - DNA, 25 bp, Homo sapien
gacagagaaagagaaaatgtgacag

SEQ ID NO: 65099 - DNA, 25 bp, Homo sapien
gacagagaaagataaaatgtgacag

SEQ ID NO: 65100 - DNA, 25 bp, Homo sapien
gacagagagttaatccagggtaagg

SEQ ID NO: 65101 - DNA, 25 bp, Homo sapien
gacagagatttaatccagggtaagg

SEQ ID NO: 65102 - DNA, 25 bp, Homo sapien
gacagagggcttctcaagtataaaa

SEQ ID NO: 65103 - DNA, 25 bp, Homo sapien
gacagagggcttgtcaagtataaaa

SEQ ID NO: 65104 - DNA, 25 bp, Homo sapien
gacagagggtctccaacaggatggg

SEQ ID NO: 65105 - DNA, 25 bp, Homo sapien
gacagagggtctccaataggatggg

SEQ ID NO: 65106 - DNA, 25 bp, Homo sapien
gacagataaagcatagcgaaggatg

SEQ ID NO: 65107 - DNA, 25 bp, Homo sapien
gacagataaagcatagtgaaggatg

SEQ ID NO: 65108 - DNA, 25 bp, Homo sapien
gacagataatatcatcgtccaggag

SEQ ID NO: 65109 - DNA, 25 bp, Homo sapien
gacagataatatcatcttccaggag

SEQ ID NO: 65110 - DNA, 25 bp, Homo sapien
gacagataatccactgctgtgtttt

SEQ ID NO: 65111 - DNA, 25 bp, Homo sapien
gacagataatccgctgctgtgtttt

SEQ ID NO: 65112 - DNA, 25 bp, Homo sapien
gacagatagatgacagaataagaaa

SEQ ID NO: 65113 - DNA, 25 bp, Homo sapien
gacagatagatgacaggataagaaa

SEQ ID NO: 65114 - DNA, 25 bp, Homo sapien
gacagatcatataatctcttttagc

SEQ ID NO: 65115 - DNA, 25 bp, Homo sapien
gacagatcattctctaaccctttac

SEQ ID NO: 65116 - DNA, 25 bp, Homo sapien
gacagatcgtataatctcttttagc

SEQ ID NO: 65117 - DNA, 25 bp, Homo sapien
gacagatcgttctctaaccctttac

SEQ ID NO: 65118 - DNA, 25 bp, Homo sapien
gacagatgatcagctaattccacaa

SEQ ID NO: 65119 - DNA, 25 bp, Homo sapien
gacagatgatcagctagttccacaa

SEQ ID NO: 65120 - DNA, 25 bp, Homo sapien
gacagatgctttagtttggaaatct

SEQ ID NO: 65121 - DNA, 25 bp, Homo sapien
gacagatgtttgcaataatcataat

SEQ ID NO: 65122 - DNA, 25 bp, Homo sapien
gacagatgtttgcagtaatcataat

SEQ ID NO: 65123 - DNA, 25 bp, Homo sapien
gacagatgttttagtttggaaatct

SEQ ID NO: 65124 - DNA, 25 bp, Homo sapien
gacagattacatttatcggtttgtg

SEQ ID NO: 65125 - DNA, 25 bp, Homo sapien
gacagattacatttattggtttgtg

SEQ ID NO: 65126 - DNA, 25 bp, Homo sapien
gacagcaacacaaatccattacttt

SEQ ID NO: 65127 - DNA, 25 bp, Homo sapien
gacagcaacacatatccattacttt

SEQ ID NO: 65128 - DNA, 25 bp, Homo sapien
gacagcaagagacgaagttgaggga

SEQ ID NO: 65129 - DNA, 25 bp, Homo sapien
gacagcaagagatgaagttgaggga

SEQ ID NO: 65130 - DNA, 25 bp, Homo sapien
gacagcaagctctaatcacacatat

SEQ ID NO: 65131 - DNA, 25 bp, Homo sapien
gacagcaatacatttccctctaagg

SEQ ID NO: 65132 - DNA, 25 bp, Homo sapien
gacagcaatctctaatcacacatat

SEQ ID NO: 65133 - DNA, 25 bp, Homo sapien
gacagcaatgcatttccctctaagg

SEQ ID NO: 65134 - DNA, 25 bp, Homo sapien
gacagcactgaaatacagatcactg

SEQ ID NO: 65135 - DNA, 25 bp, Homo sapien
gacagcactgaagtacagatcactg

SEQ ID NO: 65136 - DNA, 25 bp, Homo sapien
gacagcagtacatgggctagaagct

SEQ ID NO: 65137 - DNA, 25 bp, Homo sapien
gacagcagtacgtgggctagaagct

SEQ ID NO: 65138 - DNA, 25 bp, Homo sapien
gacagcataagatagctcatttaca

SEQ ID NO: 65139 - DNA, 25 bp, Homo sapien
gacagcataagatggctcatttaca

SEQ ID NO: 65140 - DNA, 25 bp, Homo sapien
gacagccaggaactactaaaaagac

SEQ ID NO: 65141 - DNA, 25 bp, Homo sapien
gacagccaggaactgctaaaaagac

SEQ ID NO: 65142 - DNA, 25 bp, Homo sapien
gacagcccagacaggtcatggaaac

SEQ ID NO: 65143 - DNA, 25 bp, Homo sapien
gacagcccagagaggtcatggaaac

SEQ ID NO: 65144 - DNA, 25 bp, Homo sapien
gacagcgataccacgctcttccacg

SEQ ID NO: 65145 - DNA, 25 bp, Homo sapien
gacagcgataccactctcttccacg

SEQ ID NO: 65146 - DNA, 25 bp, Homo sapien
gacagctagaggatcgaaggccaac

SEQ ID NO: 65147 - DNA, 25 bp, Homo sapien
gacagctagaggattgaaggccaac

SEQ ID NO: 65148 - DNA, 25 bp, Homo sapien
gacagctcatcaataacacattact

SEQ ID NO: 65149 - DNA, 25 bp, Homo sapien
gacagctcgtcaataacacattact

SEQ ID NO: 65150 - DNA, 25 bp, Homo sapien
gacagcttgcttactgactcataga

SEQ ID NO: 65151 - DNA, 25 bp, Homo sapien
gacagcttgcttgctgactcataga

SEQ ID NO: 65152 - DNA, 25 bp, Homo sapien
gacaggaagagaaagcataggacaa

SEQ ID NO: 65153 - DNA, 25 bp, Homo sapien
gacaggaagagaaagcgtaggacaa

SEQ ID NO: 65154 - DNA, 25 bp, Homo sapien
gacaggagactttccatacaagaga

SEQ ID NO: 65155 - DNA, 25 bp, Homo sapien
gacaggagagtttccatacaagaga

SEQ ID NO: 65156 - DNA, 25 bp, Homo sapien
gacaggagatgactgacttctcagc

SEQ ID NO: 65157 - DNA, 25 bp, Homo sapien
gacaggagatgattgacttctcagc

SEQ ID NO: 65158 - DNA, 25 bp, Homo sapien
gacaggaggatcaggtagaataata

SEQ ID NO: 65159 - DNA, 25 bp, Homo sapien
gacaggaggatcgggtagaataata

SEQ ID NO: 65160 - DNA, 25 bp, Homo sapien
gacaggatgacaaagaaaagggcgc

SEQ ID NO: 65161 - DNA, 25 bp, Homo sapien
gacaggatgacagagaaaagggcgc

SEQ ID NO: 65162 - DNA, 25 bp, Homo sapien
gacaggcaggagctcgaaaggagaa

SEQ ID NO: 65163 - DNA, 25 bp, Homo sapien
gacaggcaggagcttgaaaggagaa

SEQ ID NO: 65164 - DNA, 25 bp, Homo sapien
gacaggcccggagggagaagaggga

SEQ ID NO: 65165 - DNA, 25 bp, Homo sapien
gacaggcctggagggagaagaggga

SEQ ID NO: 65166 - DNA, 25 bp, Homo sapien
gacaggctgcatccctttttggagg

SEQ ID NO: 65167 - DNA, 25 bp, Homo sapien
gacaggctgcattcctttttggagg

SEQ ID NO: 65168 - DNA, 25 bp, Homo sapien
gacaggcttaaataaatgcaagaac

SEQ ID NO: 65169 - DNA, 25 bp, Homo sapien
gacaggcttaaatacatgcaagaac

SEQ ID NO: 65170 - DNA, 25 bp, Homo sapien
gacagggagcctcattcttcctaaa

SEQ ID NO: 65171 - DNA, 25 bp, Homo sapien
gacagggagcctcatttttcctaaa

SEQ ID NO: 65172 - DNA, 25 bp, Homo sapien
gacagggtcgtgtgatggtttccca

SEQ ID NO: 65173 - DNA, 25 bp, Homo sapien
gacagggttgtgtgatggtttccca

SEQ ID NO: 65174 - DNA, 25 bp, Homo sapien
gacaggtagtcacaattgctagggg

SEQ ID NO: 65175 - DNA, 25 bp, Homo sapien
gacaggtagtcacatttgctagggg

SEQ ID NO: 65176 - DNA, 25 bp, Homo sapien
gacaggtgaaaggtcagcaacctag

SEQ ID NO: 65177 - DNA, 25 bp, Homo sapien
gacaggtgaaatgtcagcaacctag

SEQ ID NO: 65178 - DNA, 25 bp, Homo sapien
gacaggtgcatatctgattgcctcc

SEQ ID NO: 65179 - DNA, 25 bp, Homo sapien
gacaggtgcgtatctgattgcctcc

SEQ ID NO: 65180 - DNA, 25 bp, Homo sapien
gacaggtgtaacaagcattgccata

SEQ ID NO: 65181 - DNA, 25 bp, Homo sapien
gacaggtgtaaccagcattgccata

SEQ ID NO: 65182 - DNA, 25 bp, Homo sapien
gacagtaaaagaagagtaacaaacc

SEQ ID NO: 65183 - DNA, 25 bp, Homo sapien
gacagtaaaagaagtgtaacaaacc

SEQ ID NO: 65184 - DNA, 25 bp, Homo sapien
gacagtaacagaaagtataaaataa

SEQ ID NO: 65185 - DNA, 25 bp, Homo sapien
gacagtaatagaaagtataaaataa

SEQ ID NO: 65186 - DNA, 25 bp, Homo sapien
gacagtacagaactctttaattata

SEQ ID NO: 65187 - DNA, 25 bp, Homo sapien
gacagtacagaattctttaattata

SEQ ID NO: 65188 - DNA, 25 bp, Homo sapien
gacagtattagacagaccatcaagg

SEQ ID NO: 65189 - DNA, 25 bp, Homo sapien
gacagtattagatagaccatcaagg

SEQ ID NO: 65190 - DNA, 25 bp, Homo sapien
gacagtcaaattgggagcaggcatg

SEQ ID NO: 65191 - DNA, 25 bp, Homo sapien
gacagtcaagttgggagcaggcatg

SEQ ID NO: 65192 - DNA, 25 bp, Homo sapien
gacagtcttgaatcaccaatgccac

SEQ ID NO: 65193 - DNA, 25 bp, Homo sapien
gacagtcttgaatcgccaatgccac

SEQ ID NO: 65194 - DNA, 25 bp, Homo sapien
gacagtcttttaggttgtttgactg

SEQ ID NO: 65195 - DNA, 25 bp, Homo sapien
gacagtcttttagtttgtttgactg

SEQ ID NO: 65196 - DNA, 25 bp, Homo sapien
gacagtgacctagtaacatccaaaa

SEQ ID NO: 65197 - DNA, 25 bp, Homo sapien
gacagtgacctggtaacatccaaaa

SEQ ID NO: 65198 - DNA, 25 bp, Homo sapien
gacagtgcaatcaaaaattataagt

SEQ ID NO: 65199 - DNA, 25 bp, Homo sapien
gacagtgcccatagacggccataat

SEQ ID NO: 65200 - DNA, 25 bp, Homo sapien
gacagtgcccatggacggccataat

SEQ ID NO: 65201 - DNA, 25 bp, Homo sapien
gacagtgcgatcaaaaattataagt

SEQ ID NO: 65202 - DNA, 25 bp, Homo sapien
gacagtgtactgaacgatgcaggct

SEQ ID NO: 65203 - DNA, 25 bp, Homo sapien
gacagtgtactgaatgatgcaggct

SEQ ID NO: 65204 - DNA, 25 bp, Homo sapien
gacagtgtctctaattgtcccggtt

SEQ ID NO: 65205 - DNA, 25 bp, Homo sapien
gacagtgtctctagttgtcccggtt

SEQ ID NO: 65206 - DNA, 25 bp, Homo sapien
gacagtgttcgacgagaccaaaatg

SEQ ID NO: 65207 - DNA, 25 bp, Homo sapien
gacagtgttcgatgagaccaaaatg

SEQ ID NO: 65208 - DNA, 25 bp, Homo sapien
gacagttagtcatcaagatccattt

SEQ ID NO: 65209 - DNA, 25 bp, Homo sapien
gacagttattcatcaagatccattt

SEQ ID NO: 65210 - DNA, 25 bp, Homo sapien
gacagttcccagctacattgtattt

SEQ ID NO: 65211 - DNA, 25 bp, Homo sapien
gacagttcctagctacattgtattt

SEQ ID NO: 65212 - DNA, 25 bp, Homo sapien
gacagttctaggcagactcagaact

SEQ ID NO: 65213 - DNA, 25 bp, Homo sapien
gacagttctaggcagagtcagaact

SEQ ID NO: 65214 - DNA, 25 bp, Homo sapien
gacagttctgtgatctgcaaaattt

SEQ ID NO: 65215 - DNA, 25 bp, Homo sapien
gacagttctgtgatttgcaaaattt

SEQ ID NO: 65216 - DNA, 25 bp, Homo sapien
gacagttttacacaacattctgaat

SEQ ID NO: 65217 - DNA, 25 bp, Homo sapien
gacagttttacagaacattctgaat

SEQ ID NO: 65218 - DNA, 25 bp, Homo sapien
gacataaaatggaacattacatacc

SEQ ID NO: 65219 - DNA, 25 bp, Homo sapien
gacataaaatggaatattacatacc

SEQ ID NO: 65220 - DNA, 25 bp, Homo sapien
gacataaacaacataagcacagggt

SEQ ID NO: 65221 - DNA, 25 bp, Homo sapien
gacataaacgacataagcacagggt

SEQ ID NO: 65222 - DNA, 25 bp, Homo sapien
gacataaagaagaaggcatggggtg

SEQ ID NO: 65223 - DNA, 25 bp, Homo sapien
gacataaagaagcaggcatggggtg

SEQ ID NO: 65224 - DNA, 25 bp, Homo sapien
gacataaggatagctgtcagtggtc

SEQ ID NO: 65225 - DNA, 25 bp, Homo sapien
gacataaggatagttgtcagtggtc

SEQ ID NO: 65226 - DNA, 25 bp, Homo sapien
gacataatatatcactcataacagg

SEQ ID NO: 65227 - DNA, 25 bp, Homo sapien
gacataatctcattgcaatattgtt

SEQ ID NO: 65228 - DNA, 25 bp, Homo sapien
gacataatctccttgcaatattgtt

SEQ ID NO: 65229 - DNA, 25 bp, Homo sapien
gacataatgtatcactcataacagg

SEQ ID NO: 65230 - DNA, 25 bp, Homo sapien
gacatacaaactagaagatgataaa

SEQ ID NO: 65231 - DNA, 25 bp, Homo sapien
gacatacaaactataagatgataaa

SEQ ID NO: 65232 - DNA, 25 bp, Homo sapien
gacatacaagaacatgcggttccac

SEQ ID NO: 65233 - DNA, 25 bp, Homo sapien
gacatacaagaacatgtggttccac

SEQ ID NO: 65234 - DNA, 25 bp, Homo sapien
gacatacatacaaaaggttaatgtc

SEQ ID NO: 65235 - DNA, 25 bp, Homo sapien
gacatacatacagaaggttaatgtc

SEQ ID NO: 65236 - DNA, 25 bp, Homo sapien
gacatagaaaaaatcgacatatttg

SEQ ID NO: 65237 - DNA, 25 bp, Homo sapien
gacatagaaaaaatcggcatatttg

SEQ ID NO: 65238 - DNA, 25 bp, Homo sapien
gacatagcaagggactcctactgct

SEQ ID NO: 65239 - DNA, 25 bp, Homo sapien
gacatagcaagggattcctactgct

SEQ ID NO: 65240 - DNA, 25 bp, Homo sapien
gacatagtgagcagcagagcaggaa

SEQ ID NO: 65241 - DNA, 25 bp, Homo sapien
gacatagtgagcagcatagcaggaa

SEQ ID NO: 65242 - DNA, 25 bp, Homo sapien
gacatataacctatacctgtgcgct

SEQ ID NO: 65243 - DNA, 25 bp, Homo sapien
gacatataatctatacctgtgcgct

SEQ ID NO: 65244 - DNA, 25 bp, Homo sapien
gacatatagcacaagtgatacatat

SEQ ID NO: 65245 - DNA, 25 bp, Homo sapien
gacatatagcacgagtgatacatat

SEQ ID NO: 65246 - DNA, 25 bp, Homo sapien
gacatattcggtgttcacattgaaa

SEQ ID NO: 65247 - DNA, 25 bp, Homo sapien
gacatatttggtgttcacattgaaa

SEQ ID NO: 65248 - DNA, 25 bp, Homo sapien
gacatcaaccatttgagcacgttgg

SEQ ID NO: 65249 - DNA, 25 bp, Homo sapien
gacatcaagcatttgagcacgttgg

SEQ ID NO: 65250 - DNA, 25 bp, Homo sapien
gacatcacttggcaaaactagtgat

SEQ ID NO: 65251 - DNA, 25 bp, Homo sapien
gacatcacttggcaaagctagtgat

SEQ ID NO: 65252 - DNA, 25 bp, Homo sapien
gacatcagatactccgccttttgta

SEQ ID NO: 65253 - DNA, 25 bp, Homo sapien
gacatcagatactctgccttttgta

SEQ ID NO: 65254 - DNA, 25 bp, Homo sapien
gacatcctaaaacagcttatggacg

SEQ ID NO: 65255 - DNA, 25 bp, Homo sapien
gacatcctaaaagagcttatggacg

SEQ ID NO: 65256 - DNA, 25 bp, Homo sapien
gacatcctcagggcctactgttcag

SEQ ID NO: 65257 - DNA, 25 bp, Homo sapien
gacatcctcagggcttactgttcag

SEQ ID NO: 65258 - DNA, 25 bp, Homo sapien
gacatctactgggaatccagaaggt

SEQ ID NO: 65259 - DNA, 25 bp, Homo sapien
gacatctagtgccactttccactcc

SEQ ID NO: 65260 - DNA, 25 bp, Homo sapien
gacatctagtgccattttccactcc

SEQ ID NO: 65261 - DNA, 25 bp, Homo sapien
gacatctattgggaatccagaaggt

SEQ ID NO: 65262 - DNA, 25 bp, Homo sapien
gacatctgagcagcagtcctgagag

SEQ ID NO: 65263 - DNA, 25 bp, Homo sapien
gacatctgcatgattttccttaaat

SEQ ID NO: 65264 - DNA, 25 bp, Homo sapien
gacatctgcatgtttttccttaaat

SEQ ID NO: 65265 - DNA, 25 bp, Homo sapien
gacatctgctcactttgggactctt

SEQ ID NO: 65266 - DNA, 25 bp, Homo sapien
gacatctgctcgctttgggactctt

SEQ ID NO: 65267 - DNA, 25 bp, Homo sapien
gacatctgggcagcagtcctgagag

SEQ ID NO: 65268 - DNA, 25 bp, Homo sapien
gacatgaaggaacagctcaggtctc

SEQ ID NO: 65269 - DNA, 25 bp, Homo sapien
gacatgaaggaacggctcaggtctc

SEQ ID NO: 65270 - DNA, 25 bp, Homo sapien
gacatgacagttttacaatgccaaa

SEQ ID NO: 65271 - DNA, 25 bp, Homo sapien
gacatgaccgtgacagttaaaaatg

SEQ ID NO: 65272 - DNA, 25 bp, Homo sapien
gacatgacggttttacaatgccaaa

SEQ ID NO: 65273 - DNA, 25 bp, Homo sapien
gacatgactgtgacagttaaaaatg

SEQ ID NO: 65274 - DNA, 25 bp, Homo sapien
gacatgcccattatgaacaaggcac

SEQ ID NO: 65275 - DNA, 25 bp, Homo sapien
gacatgcccattatgagcaaggcac

SEQ ID NO: 65276 - DNA, 25 bp, Homo sapien
gacatgcggaacactgaaaacattt

SEQ ID NO: 65277 - DNA, 25 bp, Homo sapien
gacatgcgtaacactgaaaacattt

SEQ ID NO: 65278 - DNA, 25 bp, Homo sapien
gacatgctactcacaaccaggatgt

SEQ ID NO: 65279 - DNA, 25 bp, Homo sapien
gacatgctactcacaatcaggatgt

SEQ ID NO: 65280 - DNA, 25 bp, Homo sapien
gacatgctcgtccactagccctcgc

SEQ ID NO: 65281 - DNA, 25 bp, Homo sapien
gacatgctcgtcgactagccctcgc

SEQ ID NO: 65282 - DNA, 25 bp, Homo sapien
gacatggcatttgcacatttggaca

SEQ ID NO: 65283 - DNA, 25 bp, Homo sapien
gacatggcgtttgcacatttggaca

SEQ ID NO: 65284 - DNA, 25 bp, Homo sapien
gacatggtcttccttccggaacata

SEQ ID NO: 65285 - DNA, 25 bp, Homo sapien
gacatggtcttctttccggaacata

SEQ ID NO: 65286 - DNA, 25 bp, Homo sapien
gacatgtacgagaataatcacagca

SEQ ID NO: 65287 - DNA, 25 bp, Homo sapien
gacatgtatgagaataatcacagca

SEQ ID NO: 65288 - DNA, 25 bp, Homo sapien
gacatgtccatcacacgatttatta

SEQ ID NO: 65289 - DNA, 25 bp, Homo sapien
gacatgtccatcccacgatttatta

SEQ ID NO: 65290 - DNA, 25 bp, Homo sapien
gacatgtggtcaccagctgttggat

SEQ ID NO: 65291 - DNA, 25 bp, Homo sapien
gacatgtggtcacgagctgttggat

SEQ ID NO: 65292 - DNA, 25 bp, Homo sapien
gacatgttgtggcgagactgaaatc

SEQ ID NO: 65293 - DNA, 25 bp, Homo sapien
gacatgttgtggtgagactgaaatc

SEQ ID NO: 65294 - DNA, 25 bp, Homo sapien
gacattaccggactcactaacgcag

SEQ ID NO: 65295 - DNA, 25 bp, Homo sapien
gacattactggactcactaacgcag

SEQ ID NO: 65296 - DNA, 25 bp, Homo sapien
gacattagcaaagtgtaagtattcc

SEQ ID NO: 65297 - DNA, 25 bp, Homo sapien
gacattagtaaagtgtaagtattcc

SEQ ID NO: 65298 - DNA, 25 bp, Homo sapien
gacattatagatcacaggcatgttt

SEQ ID NO: 65299 - DNA, 25 bp, Homo sapien
gacattatagatgacaggcatgttt

SEQ ID NO: 65300 - DNA, 25 bp, Homo sapien
gacattcagcccacacatggggcac

SEQ ID NO: 65301 - DNA, 25 bp, Homo sapien
gacattcagcccacgcatggggcac

SEQ ID NO: 65302 - DNA, 25 bp, Homo sapien
gacattcatatttcttaaactagcc

SEQ ID NO: 65303 - DNA, 25 bp, Homo sapien
gacattcatattttttaaactagcc

SEQ ID NO: 65304 - DNA, 25 bp, Homo sapien
gacattccaggaaaagcaaactgct

SEQ ID NO: 65305 - DNA, 25 bp, Homo sapien
gacattccaggcaaagcaaactgct

SEQ ID NO: 65306 - DNA, 25 bp, Homo sapien
gacattctaactacaatttcaaaat

SEQ ID NO: 65307 - DNA, 25 bp, Homo sapien
gacattctacctacaatttcaaaat

SEQ ID NO: 65308 - DNA, 25 bp, Homo sapien
gacattgtttctaaaaattcattac

SEQ ID NO: 65309 - DNA, 25 bp, Homo sapien
gacattgtttctaagaattcattac

SEQ ID NO: 65310 - DNA, 25 bp, Homo sapien
gacatttaagctaactttgtcatgg

SEQ ID NO: 65311 - DNA, 25 bp, Homo sapien
gacatttaagctaattttgtcatgg

SEQ ID NO: 65312 - DNA, 25 bp, Homo sapien
gacatttcaggcaaagaaagtaggt

SEQ ID NO: 65313 - DNA, 25 bp, Homo sapien
gacatttcaggcagagaaagtaggt

SEQ ID NO: 65314 - DNA, 25 bp, Homo sapien
gacatttgcttcaccttctgttttc

SEQ ID NO: 65315 - DNA, 25 bp, Homo sapien
gacatttgcttcgccttctgttttc

SEQ ID NO: 65316 - DNA, 25 bp, Homo sapien
gacattttacggactgctaagcatt

SEQ ID NO: 65317 - DNA, 25 bp, Homo sapien
gacattttatggactgctaagcatt

SEQ ID NO: 65318 - DNA, 25 bp, Homo sapien
gacattttccactatgtactccaag

SEQ ID NO: 65319 - DNA, 25 bp, Homo sapien
gacattttccattatgtactccaag

SEQ ID NO: 65320 - DNA, 25 bp, Homo sapien
gaccaaaaaatcttacgaactgcac

SEQ ID NO: 65321 - DNA, 25 bp, Homo sapien
gaccaaaaagtcttacgaactgcac

SEQ ID NO: 65322 - DNA, 25 bp, Homo sapien
gaccaaacacggaaatagcaatgat

SEQ ID NO: 65323 - DNA, 25 bp, Homo sapien
gaccaaacatggaaatagcaatgat

SEQ ID NO: 65324 - DNA, 25 bp, Homo sapien
gaccaaaggcaaactttagaaattg

SEQ ID NO: 65325 - DNA, 25 bp, Homo sapien
gaccaaaggcagactttagaaattg

SEQ ID NO: 65326 - DNA, 25 bp, Homo sapien
gaccaacaaacaacaagagctgcaa

SEQ ID NO: 65327 - DNA, 25 bp, Homo sapien
gaccaacaaacagcaagagctgcaa

SEQ ID NO: 65328 - DNA, 25 bp, Homo sapien
gaccaacaagctttcacattgaatc

SEQ ID NO: 65329 - DNA, 25 bp, Homo sapien
gaccaacaagctttgacattgaatc

SEQ ID NO: 65330 - DNA, 25 bp, Homo sapien
gaccaacacagataagtgcttccca

SEQ ID NO: 65331 - DNA, 25 bp, Homo sapien
gaccaacacaggtaagtgcttccca

SEQ ID NO: 65332 - DNA, 25 bp, Homo sapien
gaccaacattccttgttaagtgaaa

SEQ ID NO: 65333 - DNA, 25 bp, Homo sapien
gaccaacattctttgttaagtgaaa

SEQ ID NO: 65334 - DNA, 25 bp, Homo sapien
gaccaactactacgggagtttcaga

SEQ ID NO: 65335 - DNA, 25 bp, Homo sapien
gaccaactactatgggagtttcaga

SEQ ID NO: 65336 - DNA, 25 bp, Homo sapien
gaccaactgagatttatctcttaga

SEQ ID NO: 65337 - DNA, 25 bp, Homo sapien
gaccaactgggatttatctcttaga

SEQ ID NO: 65338 - DNA, 25 bp, Homo sapien
gaccaagagtacaaagttctccatg

SEQ ID NO: 65339 - DNA, 25 bp, Homo sapien
gaccaagagtaccaagttctccatg

SEQ ID NO: 65340 - DNA, 25 bp, Homo sapien
gaccaagctgacaatgaaatgaaat

SEQ ID NO: 65341 - DNA, 25 bp, Homo sapien
gaccaagctgacactgaaatgaaat

SEQ ID NO: 65342 - DNA, 25 bp, Homo sapien
gaccacaacacgccatcttttcata

SEQ ID NO: 65343 - DNA, 25 bp, Homo sapien
gaccacaacacgtcatcttttcata

SEQ ID NO: 65344 - DNA, 25 bp, Homo sapien
gaccacaacaggaacatagccaagt

SEQ ID NO: 65345 - DNA, 25 bp, Homo sapien
gaccacaacgggaacatagccaagt

SEQ ID NO: 65346 - DNA, 25 bp, Homo sapien
gaccacatattatcaaaaacagctt

SEQ ID NO: 65347 - DNA, 25 bp, Homo sapien
gaccacatattatccaaaacagctt

SEQ ID NO: 65348 - DNA, 25 bp, Homo sapien
gaccaccagacatgtgaggaaatct

SEQ ID NO: 65349 - DNA, 25 bp, Homo sapien
gaccaccagacgtgtgaggaaatct

SEQ ID NO: 65350 - DNA, 25 bp, Homo sapien
gaccaccagtagaaattcctcctta

SEQ ID NO: 65351 - DNA, 25 bp, Homo sapien
gaccaccagtagaatttcctcctta

SEQ ID NO: 65352 - DNA, 25 bp, Homo sapien
gaccacctacaaaatgtagataatt

SEQ ID NO: 65353 - DNA, 25 bp, Homo sapien
gaccacctacaagatgtagataatt

SEQ ID NO: 65354 - DNA, 25 bp, Homo sapien
gaccacggtataagccaccacagcg

SEQ ID NO: 65355 - DNA, 25 bp, Homo sapien
gaccacggtataggccaccacagcg

SEQ ID NO: 65356 - DNA, 25 bp, Homo sapien
gaccactatctcttgccacttcagt

SEQ ID NO: 65357 - DNA, 25 bp, Homo sapien
gaccactatttcttgccacttcagt

SEQ ID NO: 65358 - DNA, 25 bp, Homo sapien
gaccactgaatactactgagtttct

SEQ ID NO: 65359 - DNA, 25 bp, Homo sapien
gaccactgaatattactgagtttct

SEQ ID NO: 65360 - DNA, 25 bp, Homo sapien
gaccactgtgcatttcacaaattgg

SEQ ID NO: 65361 - DNA, 25 bp, Homo sapien
gaccactgtgcttttcacaaattgg

SEQ ID NO: 65362 - DNA, 25 bp, Homo sapien
gaccacttcaggagcaaaggccaaa

SEQ ID NO: 65363 - DNA, 25 bp, Homo sapien
gaccacttcgggagcaaaggccaaa

SEQ ID NO: 65364 - DNA, 25 bp, Homo sapien
gaccagaagagcaaaccagcctaat

SEQ ID NO: 65365 - DNA, 25 bp, Homo sapien
gaccagaagagtaaaccagcctaat

SEQ ID NO: 65366 - DNA, 25 bp, Homo sapien
gaccagacccgataaggatgctcaa

SEQ ID NO: 65367 - DNA, 25 bp, Homo sapien
gaccagacccgctaaggatgctcaa

SEQ ID NO: 65368 - DNA, 25 bp, Homo sapien
gaccagataatttacgctaacaata

SEQ ID NO: 65369 - DNA, 25 bp, Homo sapien
gaccagataatttatgctaacaata

SEQ ID NO: 65370 - DNA, 25 bp, Homo sapien
gaccagatgtgagcacagagattca

SEQ ID NO: 65371 - DNA, 25 bp, Homo sapien
gaccagatgtgggcacagagattca

SEQ ID NO: 65372 - DNA, 25 bp, Homo sapien
gaccagatttcacggcaatcccttg

SEQ ID NO: 65373 - DNA, 25 bp, Homo sapien
gaccagatttcatggcaatcccttg

SEQ ID NO: 65374 - DNA, 25 bp, Homo sapien
gaccagccttaaaagagatccttaa

SEQ ID NO: 65375 - DNA, 25 bp, Homo sapien
gaccagccttaacagagatccttaa

SEQ ID NO: 65376 - DNA, 25 bp, Homo sapien
gaccaggagaaagaagacaaccagc

SEQ ID NO: 65377 - DNA, 25 bp, Homo sapien
gaccaggagaaagatgacaaccagc

SEQ ID NO: 65378 - DNA, 25 bp, Homo sapien
gaccaggctttccacattttctacc

SEQ ID NO: 65379 - DNA, 25 bp, Homo sapien
gaccaggctttccgcattttctacc

SEQ ID NO: 65380 - DNA, 25 bp, Homo sapien
gaccaggtacgctgtcaatgagcag

SEQ ID NO: 65381 - DNA, 25 bp, Homo sapien
gaccaggtatgctgtcaatgagcag

SEQ ID NO: 65382 - DNA, 25 bp, Homo sapien
gaccaggttaggccaagttgagagt

SEQ ID NO: 65383 - DNA, 25 bp, Homo sapien
gaccaggttaggccgagttgagagt

SEQ ID NO: 65384 - DNA, 25 bp, Homo sapien
gaccagtacaggagtgaacagatga

SEQ ID NO: 65385 - DNA, 25 bp, Homo sapien
gaccagtacagtagtgaacagatga

SEQ ID NO: 65386 - DNA, 25 bp, Homo sapien
gaccatagaaagaaaacggcaagct

SEQ ID NO: 65387 - DNA, 25 bp, Homo sapien
gaccatagaaagaaaatggcaagct

SEQ ID NO: 65388 - DNA, 25 bp, Homo sapien
gaccatagagatgacacaattattt

SEQ ID NO: 65389 - DNA, 25 bp, Homo sapien
gaccatagagatgacagaattattt

SEQ ID NO: 65390 - DNA, 25 bp, Homo sapien
gaccatatgttgcctgtttctggaa

SEQ ID NO: 65391 - DNA, 25 bp, Homo sapien
gaccatattttgcctgtttctggaa

SEQ ID NO: 65392 - DNA, 25 bp, Homo sapien
gaccatcaatgctttcctaattata

SEQ ID NO: 65393 - DNA, 25 bp, Homo sapien
gaccatcagtgctttcctaattata

SEQ ID NO: 65394 - DNA, 25 bp, Homo sapien
gaccatcataccgtggtttgacttg

SEQ ID NO: 65395 - DNA, 25 bp, Homo sapien
gaccatcatactgtggtttgacttg

SEQ ID NO: 65396 - DNA, 25 bp, Homo sapien
gaccatccacatggcaaaggtatgg

SEQ ID NO: 65397 - DNA, 25 bp, Homo sapien
gaccatccacatggcagaggtatgg

SEQ ID NO: 65398 - DNA, 25 bp, Homo sapien
gaccatctattacttcaattcaact

SEQ ID NO: 65399 - DNA, 25 bp, Homo sapien
gaccatctattacttcgattcaact

SEQ ID NO: 65400 - DNA, 25 bp, Homo sapien
gaccatctgagcacaagtgatgggc

SEQ ID NO: 65401 - DNA, 25 bp, Homo sapien
gaccatctgagtacaagtgatgggc

SEQ ID NO: 65402 - DNA, 25 bp, Homo sapien
gaccatctttcaaacgcttcagggc

SEQ ID NO: 65403 - DNA, 25 bp, Homo sapien
gaccatctttcaaatgcttcagggc

SEQ ID NO: 65404 - DNA, 25 bp, Homo sapien
gaccatgaagtgggttcacataacc

SEQ ID NO: 65405 - DNA, 25 bp, Homo sapien
gaccatgaggtgggttcacataacc

SEQ ID NO: 65406 - DNA, 25 bp, Homo sapien
gaccatggaggtgattgcttggctt

SEQ ID NO: 65407 - DNA, 25 bp, Homo sapien
gaccatggaggtgatttcttggctt

SEQ ID NO: 65408 - DNA, 25 bp, Homo sapien
gaccatggctctttgatatctttga

SEQ ID NO: 65409 - DNA, 25 bp, Homo sapien
gaccatggttctttgatatctttga

SEQ ID NO: 65410 - DNA, 25 bp, Homo sapien
gaccattaggcttcatcctggttac

SEQ ID NO: 65411 - DNA, 25 bp, Homo sapien
gaccattaggctttatcctggttac

SEQ ID NO: 65412 - DNA, 25 bp, Homo sapien
gaccattcaaatgcaccttccagaa

SEQ ID NO: 65413 - DNA, 25 bp, Homo sapien
gaccattcaaatgcactttccagaa

SEQ ID NO: 65414 - DNA, 25 bp, Homo sapien
gaccattcaatttccgtacttccac

SEQ ID NO: 65415 - DNA, 25 bp, Homo sapien
gaccattcaatttctgtacttccac

SEQ ID NO: 65416 - DNA, 25 bp, Homo sapien
gaccattcgacacaggtgtggattt

SEQ ID NO: 65417 - DNA, 25 bp, Homo sapien
gaccattcgacataggtgtggattt

SEQ ID NO: 65418 - DNA, 25 bp, Homo sapien
gaccatttaatatacaactcccata

SEQ ID NO: 65419 - DNA, 25 bp, Homo sapien
gaccatttaatgtacaactcccata

SEQ ID NO: 65420 - DNA, 25 bp, Homo sapien
gaccatttacttacaagtgcaaaac

SEQ ID NO: 65421 - DNA, 25 bp, Homo sapien
gaccatttctggaaattcatagaat

SEQ ID NO: 65422 - DNA, 25 bp, Homo sapien
gaccatttctgtaaattcatagaat

SEQ ID NO: 65423 - DNA, 25 bp, Homo sapien
gaccatttgactctatttgtatgtg

SEQ ID NO: 65424 - DNA, 25 bp, Homo sapien
gaccatttgcttacaagtgcaaaac

SEQ ID NO: 65425 - DNA, 25 bp, Homo sapien
gaccattttaacacatgatataaat

SEQ ID NO: 65426 - DNA, 25 bp, Homo sapien
gaccattttaacgcatgatataaat

SEQ ID NO: 65427 - DNA, 25 bp, Homo sapien
gaccattttactctatttgtatgtg

SEQ ID NO: 65428 - DNA, 25 bp, Homo sapien
gaccattttcctgggccaggggcca

SEQ ID NO: 65429 - DNA, 25 bp, Homo sapien
gaccatttttaatgttcgagtgttt

SEQ ID NO: 65430 - DNA, 25 bp, Homo sapien
gaccatttttaatgtttgagtgttt

SEQ ID NO: 65431 - DNA, 25 bp, Homo sapien
gaccatttttctgggccaggggcca

SEQ ID NO: 65432 - DNA, 25 bp, Homo sapien
gacccaaaggccatagttataaaag

SEQ ID NO: 65433 - DNA, 25 bp, Homo sapien
gacccaaaggccgtagttataaaag

SEQ ID NO: 65434 - DNA, 25 bp, Homo sapien
gacccaagaactgcaaaaaacagtc

SEQ ID NO: 65435 - DNA, 25 bp, Homo sapien
gacccaagaactgcaagaaacagtc

SEQ ID NO: 65436 - DNA, 25 bp, Homo sapien
gacccagatctttcatatatattgt

SEQ ID NO: 65437 - DNA, 25 bp, Homo sapien
gacccagatctttcctatatattgt

SEQ ID NO: 65438 - DNA, 25 bp, Homo sapien
gacccagattatatagggaaacaga

SEQ ID NO: 65439 - DNA, 25 bp, Homo sapien
gacccagattatatggggaaacaga

SEQ ID NO: 65440 - DNA, 25 bp, Homo sapien
gacccagatttcgtgccaagaatgg

SEQ ID NO: 65441 - DNA, 25 bp, Homo sapien
gacccagattttgtgccaagaatgg

SEQ ID NO: 65442 - DNA, 25 bp, Homo sapien
gacccaggttctttctatcttcctg

SEQ ID NO: 65443 - DNA, 25 bp, Homo sapien
gacccaggttctttctgtcttcctg

SEQ ID NO: 65444 - DNA, 25 bp, Homo sapien
gacccatggaattgggctggatgtg

SEQ ID NO: 65445 - DNA, 25 bp, Homo sapien
gacccatggaattgggttggatgtg

SEQ ID NO: 65446 - DNA, 25 bp, Homo sapien
gacccattcccactcatcatgtgaa

SEQ ID NO: 65447 - DNA, 25 bp, Homo sapien
gacccattcccgctcatcatgtgaa

SEQ ID NO: 65448 - DNA, 25 bp, Homo sapien
gacccattcctgcacaaccatctgg

SEQ ID NO: 65449 - DNA, 25 bp, Homo sapien
gacccattcctgcacatccatctgg

SEQ ID NO: 65450 - DNA, 25 bp, Homo sapien
gacccattgttggagatgaggtcag

SEQ ID NO: 65451 - DNA, 25 bp, Homo sapien
gacccattgttggcgatgaggtcag

SEQ ID NO: 65452 - DNA, 25 bp, Homo sapien
gaccccaaaactctctgattcagta

SEQ ID NO: 65453 - DNA, 25 bp, Homo sapien
gaccccaaaactgtctgattcagta

SEQ ID NO: 65454 - DNA, 25 bp, Homo sapien
gaccccattattgatgtcttgggag

SEQ ID NO: 65455 - DNA, 25 bp, Homo sapien
gaccccattgttgatgtcttgggag

SEQ ID NO: 65456 - DNA, 25 bp, Homo sapien
gacccgcatctgtgcaactccatgg

SEQ ID NO: 65457 - DNA, 25 bp, Homo sapien
gacccgcatgtgtgcaactccatgg

SEQ ID NO: 65458 - DNA, 25 bp, Homo sapien
gacccgctaacataatcttataata

SEQ ID NO: 65459 - DNA, 25 bp, Homo sapien
gacccgctaacatactcttataata

SEQ ID NO: 65460 - DNA, 25 bp, Homo sapien
gacccgtcactggttgaatccatga

SEQ ID NO: 65461 - DNA, 25 bp, Homo sapien
gacccgtcattggttgaatccatga

SEQ ID NO: 65462 - DNA, 25 bp, Homo sapien
gacccgtgtccctagccttgctctg

SEQ ID NO: 65463 - DNA, 25 bp, Homo sapien
gacccgtgtccctatccttgctctg

SEQ ID NO: 65464 - DNA, 25 bp, Homo sapien
gaccctaacgaatacacctcccctc

SEQ ID NO: 65465 - DNA, 25 bp, Homo sapien
gaccctaactaatacacctcccctc

SEQ ID NO: 65466 - DNA, 25 bp, Homo sapien
gaccctagaatcatgctggaccaca

SEQ ID NO: 65467 - DNA, 25 bp, Homo sapien
gaccctagaatcgtgctggaccaca

SEQ ID NO: 65468 - DNA, 25 bp, Homo sapien
gaccctgaataccgaaaaggctctc

SEQ ID NO: 65469 - DNA, 25 bp, Homo sapien
gaccctgaatactgaaaaggctctc

SEQ ID NO: 65470 - DNA, 25 bp, Homo sapien
gaccctgcctctgacccttttagac

SEQ ID NO: 65471 - DNA, 25 bp, Homo sapien
gaccctgcttctgacccttttagac

SEQ ID NO: 65472 - DNA, 25 bp, Homo sapien
gaccctggtgctgtatgatcctggg

SEQ ID NO: 65473 - DNA, 25 bp, Homo sapien
gaccctggtgctgtgtgatcctggg

SEQ ID NO: 65474 - DNA, 25 bp, Homo sapien
gaccctgttgccgctctcttgctag

SEQ ID NO: 65475 - DNA, 25 bp, Homo sapien
gaccctgttgcctctctcttgctag

SEQ ID NO: 65476 - DNA, 25 bp, Homo sapien
gacccttgaatggaatttctggacc

SEQ ID NO: 65477 - DNA, 25 bp, Homo sapien
gacccttgaatggcatttctggacc

SEQ ID NO: 65478 - DNA, 25 bp, Homo sapien
gaccctttgtcaccctatgatctta

SEQ ID NO: 65479 - DNA, 25 bp, Homo sapien
gaccctttttcaccctatgatctta

SEQ ID NO: 65480 - DNA, 25 bp, Homo sapien
gaccgaaccaatgctcatccagcac

SEQ ID NO: 65481 - DNA, 25 bp, Homo sapien
gaccgaaccaatgttcatccagcac

SEQ ID NO: 65482 - DNA, 25 bp, Homo sapien
gaccgaactggaacgggcttttggc

SEQ ID NO: 65483 - DNA, 25 bp, Homo sapien
gaccgaactggaatgggcttttggc

SEQ ID NO: 65484 - DNA, 25 bp, Homo sapien
gaccgagtatggaaaacgcatgtca

SEQ ID NO: 65485 - DNA, 25 bp, Homo sapien
gaccgagtatggaaaatgcatgtca

SEQ ID NO: 65486 - DNA, 25 bp, Homo sapien
gaccgccgatgccggtcttccaaag

SEQ ID NO: 65487 - DNA, 25 bp, Homo sapien
gaccgccgatgctggtcttccaaag

SEQ ID NO: 65488 - DNA, 25 bp, Homo sapien
gaccgccttggcttgtagatgtatc

SEQ ID NO: 65489 - DNA, 25 bp, Homo sapien
gaccgcctttgcttgtagatgtatc

SEQ ID NO: 65490 - DNA, 25 bp, Homo sapien
gaccgcttgttcactttatgtgtca

SEQ ID NO: 65491 - DNA, 25 bp, Homo sapien
gaccgcttgtttactttatgtgtca

SEQ ID NO: 65492 - DNA, 25 bp, Homo sapien
gaccgggatggtttccagattcaca

SEQ ID NO: 65493 - DNA, 25 bp, Homo sapien
gaccgggatggtttccggattcaca

SEQ ID NO: 65494 - DNA, 25 bp, Homo sapien
gaccgggttgctcagccttggcact

SEQ ID NO: 65495 - DNA, 25 bp, Homo sapien
gaccgggtttctcagccttggcact

SEQ ID NO: 65496 - DNA, 25 bp, Homo sapien
gaccgtaaagaagtgccagggagct

SEQ ID NO: 65497 - DNA, 25 bp, Homo sapien
gaccgtaaagaggtgccagggagct

SEQ ID NO: 65498 - DNA, 25 bp, Homo sapien
gaccgtcctagctccagagctccca

SEQ ID NO: 65499 - DNA, 25 bp, Homo sapien
gaccgtcctagttccagagctccca

SEQ ID NO: 65500 - DNA, 25 bp, Homo sapien
gaccgtgcatccactcaccttatct

SEQ ID NO: 65501 - DNA, 25 bp, Homo sapien
gaccgtgcatcgactcaccttatct

SEQ ID NO: 65502 - DNA, 25 bp, Homo sapien
gacctaatcatctattaaaggcccc

SEQ ID NO: 65503 - DNA, 25 bp, Homo sapien
gacctaatcatctcttaaaggcccc

SEQ ID NO: 65504 - DNA, 25 bp, Homo sapien
gacctacagaaccacgagctaatta

SEQ ID NO: 65505 - DNA, 25 bp, Homo sapien
gacctacagaaccatgagctaatta

SEQ ID NO: 65506 - DNA, 25 bp, Homo sapien
gacctactaactgcgtagctttaga

SEQ ID NO: 65507 - DNA, 25 bp, Homo sapien
gacctactaactgtgtagctttaga

SEQ ID NO: 65508 - DNA, 25 bp, Homo sapien
gacctagagagcacctggctatagg

SEQ ID NO: 65509 - DNA, 25 bp, Homo sapien
gacctagagagtacctggctatagg

SEQ ID NO: 65510 - DNA, 25 bp, Homo sapien
gacctagattgacccgttagctctc

SEQ ID NO: 65511 - DNA, 25 bp, Homo sapien
gacctagattgacctgttagctctc

SEQ ID NO: 65512 - DNA, 25 bp, Homo sapien
gacctatccagtctcactgcttcat

SEQ ID NO: 65513 - DNA, 25 bp, Homo sapien
gacctatccagtctcattgcttcat

SEQ ID NO: 65514 - DNA, 25 bp, Homo sapien
gacctcaaattctcagccaaagacc

SEQ ID NO: 65515 - DNA, 25 bp, Homo sapien
gacctcaaattctcggccaaagacc

SEQ ID NO: 65516 - DNA, 25 bp, Homo sapien
gacctcaagtgatgcaccggtctcg

SEQ ID NO: 65517 - DNA, 25 bp, Homo sapien
gacctcaagtgatgtaccggtctcg

SEQ ID NO: 65518 - DNA, 25 bp, Homo sapien
gacctcacattgtcctccttggtta

SEQ ID NO: 65519 - DNA, 25 bp, Homo sapien
gacctcacattgttctccttggtta

SEQ ID NO: 65520 - DNA, 25 bp, Homo sapien
gacctcactacaaactaaacaaggt

SEQ ID NO: 65521 - DNA, 25 bp, Homo sapien
gacctcactacagactaaacaaggt

SEQ ID NO: 65522 - DNA, 25 bp, Homo sapien
gacctcatcaccaacagaaaccata

SEQ ID NO: 65523 - DNA, 25 bp, Homo sapien
gacctcatcaccaagagaaaccata

SEQ ID NO: 65524 - DNA, 25 bp, Homo sapien
gacctccataatcataagataatat

SEQ ID NO: 65525 - DNA, 25 bp, Homo sapien
gacctccataatcgtaagataatat

SEQ ID NO: 65526 - DNA, 25 bp, Homo sapien
gacctccatttgtattattgtctca

SEQ ID NO: 65527 - DNA, 25 bp, Homo sapien
gacctccatttgtattcttgtctca

SEQ ID NO: 65528 - DNA, 25 bp, Homo sapien
gacctcctgtgtatccttcaccact

SEQ ID NO: 65529 - DNA, 25 bp, Homo sapien
gacctcctgtgtgtccttcaccact

SEQ ID NO: 65530 - DNA, 25 bp, Homo sapien
gacctcggagctaccgtagttctgt

SEQ ID NO: 65531 - DNA, 25 bp, Homo sapien
gacctcggagctactgtagttctgt

SEQ ID NO: 65532 - DNA, 25 bp, Homo sapien
gacctcgtccttcaagacttcttca

SEQ ID NO: 65533 - DNA, 25 bp, Homo sapien
gacctcgtccttcgagacttcttca

SEQ ID NO: 65534 - DNA, 25 bp, Homo sapien
gacctctacgtcagcagttccatat

SEQ ID NO: 65535 - DNA, 25 bp, Homo sapien
gacctctacgttagcagttccatat

SEQ ID NO: 65536 - DNA, 25 bp, Homo sapien
gacctctcacacgttgctggtgcaa

SEQ ID NO: 65537 - DNA, 25 bp, Homo sapien
gacctctcacatgttgctggtgcaa

SEQ ID NO: 65538 - DNA, 25 bp, Homo sapien
gacctctcttccctcgcaatggtgt

SEQ ID NO: 65539 - DNA, 25 bp, Homo sapien
gacctctcttccctcggaatggtgt

SEQ ID NO: 65540 - DNA, 25 bp, Homo sapien
gacctctgaggaactgaatgccagg

SEQ ID NO: 65541 - DNA, 25 bp, Homo sapien
gacctctgaggaattgaatgccagg

SEQ ID NO: 65542 - DNA, 25 bp, Homo sapien
gacctctgcagacatgtggagacca

SEQ ID NO: 65543 - DNA, 25 bp, Homo sapien
gacctctgcagacgtgtggagacca

SEQ ID NO: 65544 - DNA, 25 bp, Homo sapien
gacctctgctcagggacctacaaga

SEQ ID NO: 65545 - DNA, 25 bp, Homo sapien
gacctctgctcagggatctacaaga

SEQ ID NO: 65546 - DNA, 25 bp, Homo sapien
gacctgaacaaagatcagtagacag

SEQ ID NO: 65547 - DNA, 25 bp, Homo sapien
gacctgaaccaagatcagtagacag

SEQ ID NO: 65548 - DNA, 25 bp, Homo sapien
gacctgagttgaaatcccagttctg

SEQ ID NO: 65549 - DNA, 25 bp, Homo sapien
gacctgagttggaatcccagttctg

SEQ ID NO: 65550 - DNA, 25 bp, Homo sapien
gacctgcacatatagaatcaattga

SEQ ID NO: 65551 - DNA, 25 bp, Homo sapien
gacctgcaccgtgctctcttcccct

SEQ ID NO: 65552 - DNA, 25 bp, Homo sapien
gacctgcacgtatagaatcaattga

SEQ ID NO: 65553 - DNA, 25 bp, Homo sapien
gacctgcactgtgctctcttcccct

SEQ ID NO: 65554 - DNA, 25 bp, Homo sapien
gacctgcgttcatgggcaactgtac

SEQ ID NO: 65555 - DNA, 25 bp, Homo sapien
gacctgcgttcgtgggcaactgtac

SEQ ID NO: 65556 - DNA, 25 bp, Homo sapien
gacctgctttaaaaaaagaaagacg

SEQ ID NO: 65557 - DNA, 25 bp, Homo sapien
gacctgctttaaaaaaggaaagacg

SEQ ID NO: 65558 - DNA, 25 bp, Homo sapien
gacctggcctcttcatgaattgatc

SEQ ID NO: 65559 - DNA, 25 bp, Homo sapien
gacctggcctcttcttgaattgatc

SEQ ID NO: 65560 - DNA, 25 bp, Homo sapien
gacctgggagctccaactcttccct

SEQ ID NO: 65561 - DNA, 25 bp, Homo sapien
gacctgggagctccaattcttccct

SEQ ID NO: 65562 - DNA, 25 bp, Homo sapien
gacctgggctctctattctcctttg

SEQ ID NO: 65563 - DNA, 25 bp, Homo sapien
gacctgggctctcttttctcctttg

SEQ ID NO: 65564 - DNA, 25 bp, Homo sapien
gacctgggtcgcaacgtgcccttca

SEQ ID NO: 65565 - DNA, 25 bp, Homo sapien
gacctgggttcaagccacgactctg

SEQ ID NO: 65566 - DNA, 25 bp, Homo sapien
gacctgggttcaagtcacgactctg

SEQ ID NO: 65567 - DNA, 25 bp, Homo sapien
gacctgggttgcaacgtgcccttca

SEQ ID NO: 65568 - DNA, 25 bp, Homo sapien
gacctggttagtcttcttgttctaa

SEQ ID NO: 65569 - DNA, 25 bp, Homo sapien
gacctggttagtgttcttgttctaa

SEQ ID NO: 65570 - DNA, 25 bp, Homo sapien
gacctgtctcttcacgcctgcagca

SEQ ID NO: 65571 - DNA, 25 bp, Homo sapien
gacctgtctcttcatgcctgcagca

SEQ ID NO: 65572 - DNA, 25 bp, Homo sapien
gacctgtgactacagaacatttttc

SEQ ID NO: 65573 - DNA, 25 bp, Homo sapien
gacctgtgactatagaacatttttc

SEQ ID NO: 65574 - DNA, 25 bp, Homo sapien
gacctgttttagcattattatgtat

SEQ ID NO: 65575 - DNA, 25 bp, Homo sapien
gacctgttttagcattcttatgtat

SEQ ID NO: 65576 - DNA, 25 bp, Homo sapien
gaccttataagtgcagtcttccagg

SEQ ID NO: 65577 - DNA, 25 bp, Homo sapien
gaccttataagtgcggtcttccagg

SEQ ID NO: 65578 - DNA, 25 bp, Homo sapien
gaccttccatgtcctctctgggcgt

SEQ ID NO: 65579 - DNA, 25 bp, Homo sapien
gaccttccatgtcgtctctgggcgt

SEQ ID NO: 65580 - DNA, 25 bp, Homo sapien
gaccttccttcataatagactcagt

SEQ ID NO: 65581 - DNA, 25 bp, Homo sapien
gaccttccttcgtaatagactcagt

SEQ ID NO: 65582 - DNA, 25 bp, Homo sapien
gaccttctaattcctttctttagca

SEQ ID NO: 65583 - DNA, 25 bp, Homo sapien
gaccttctatcgcccatgtgacgca

SEQ ID NO: 65584 - DNA, 25 bp, Homo sapien
gaccttctcattcctttctttagca

SEQ ID NO: 65585 - DNA, 25 bp, Homo sapien
gaccttctgtcgcccatgtgacgca

SEQ ID NO: 65586 - DNA, 25 bp, Homo sapien
gaccttgagaaaataaatcttcatg

SEQ ID NO: 65587 - DNA, 25 bp, Homo sapien
gaccttgagaaattaaatcttcatg

SEQ ID NO: 65588 - DNA, 25 bp, Homo sapien
gacctttcagagagagagtattcaa

SEQ ID NO: 65589 - DNA, 25 bp, Homo sapien
gacctttcagagagagggtattcaa

SEQ ID NO: 65590 - DNA, 25 bp, Homo sapien
gacctttccggccgctgtgtgccct

SEQ ID NO: 65591 - DNA, 25 bp, Homo sapien
gacctttctggccgctgtgtgccct

SEQ ID NO: 65592 - DNA, 25 bp, Homo sapien
gacctttgaagttacggctcttctt

SEQ ID NO: 65593 - DNA, 25 bp, Homo sapien
gacctttgaagttatggctcttctt

SEQ ID NO: 65594 - DNA, 25 bp, Homo sapien
gaccttttctgaatgataaaaaagt

SEQ ID NO: 65595 - DNA, 25 bp, Homo sapien
gaccttttctgattgataaaaaagt

SEQ ID NO: 65596 - DNA, 25 bp, Homo sapien
gaccttttggaacacaaacccattc

SEQ ID NO: 65597 - DNA, 25 bp, Homo sapien
gaccttttggaatacaaacccattc

SEQ ID NO: 65598 - DNA, 25 bp, Homo sapien
gacgaacagctctgcttggcttgcg

SEQ ID NO: 65599 - DNA, 25 bp, Homo sapien
gacgaacagttctgcttggcttgcg

SEQ ID NO: 65600 - DNA, 25 bp, Homo sapien
gacgaatacttgggttactcccagt

SEQ ID NO: 65601 - DNA, 25 bp, Homo sapien
gacgaatacttggtttactcccagt

SEQ ID NO: 65602 - DNA, 25 bp, Homo sapien
gacgagtacacacggtaaagtttga

SEQ ID NO: 65603 - DNA, 25 bp, Homo sapien
gacgagtacacacggtcaagtttga

SEQ ID NO: 65604 - DNA, 25 bp, Homo sapien
gacgagttaccctgtcttcttccat

SEQ ID NO: 65605 - DNA, 25 bp, Homo sapien
gacgagttaccctttcttcttccat

SEQ ID NO: 65606 - DNA, 25 bp, Homo sapien
gacgatcattcagattgaggtagca

SEQ ID NO: 65607 - DNA, 25 bp, Homo sapien
gacgatcattcaggttgaggtagca

SEQ ID NO: 65608 - DNA, 25 bp, Homo sapien
gacgattctgacttgcgtcctggaa

SEQ ID NO: 65609 - DNA, 25 bp, Homo sapien
gacgattctgatttgcgtcctggaa

SEQ ID NO: 65610 - DNA, 25 bp, Homo sapien
gacgattggataagtgaaaacaatg

SEQ ID NO: 65611 - DNA, 25 bp, Homo sapien
gacgattggataattgaaaacaatg

SEQ ID NO: 65612 - DNA, 25 bp, Homo sapien
gacgcagaaaagacttgataaaatt

SEQ ID NO: 65613 - DNA, 25 bp, Homo sapien
gacgcagaaaagtcttgataaaatt

SEQ ID NO: 65614 - DNA, 25 bp, Homo sapien
gacgcatcactcctatatctgcctc

SEQ ID NO: 65615 - DNA, 25 bp, Homo sapien
gacgcatcactcgtatatctgcctc

SEQ ID NO: 65616 - DNA, 25 bp, Homo sapien
gacgccaggcacagtgctaaacact

SEQ ID NO: 65617 - DNA, 25 bp, Homo sapien
gacgccaggcaccgtgctaaacact

SEQ ID NO: 65618 - DNA, 25 bp, Homo sapien
gacgcctacaaataaatgaataacc

SEQ ID NO: 65619 - DNA, 25 bp, Homo sapien
gacgcctacaaatagatgaataacc

SEQ ID NO: 65620 - DNA, 25 bp, Homo sapien
gacgcctcattgagtttgaactttc

SEQ ID NO: 65621 - DNA, 25 bp, Homo sapien
gacgcctcgttgagtttgaactttc

SEQ ID NO: 65622 - DNA, 25 bp, Homo sapien
gacgcttgtaagtggagctattttt

SEQ ID NO: 65623 - DNA, 25 bp, Homo sapien
gacgcttgtgagtggagctattttt

SEQ ID NO: 65624 - DNA, 25 bp, Homo sapien
gacggaacaaaagcccacagctttg

SEQ ID NO: 65625 - DNA, 25 bp, Homo sapien
gacggaacgaaagcccacagctttg

SEQ ID NO: 65626 - DNA, 25 bp, Homo sapien
gacggactcttaagatgcagtggcg

SEQ ID NO: 65627 - DNA, 25 bp, Homo sapien
gacggactcttaagctgcagtggcg

SEQ ID NO: 65628 - DNA, 25 bp, Homo sapien
gacggagccacattttaactccggg

SEQ ID NO: 65629 - DNA, 25 bp, Homo sapien
gacggagccacattttcactccggg

SEQ ID NO: 65630 - DNA, 25 bp, Homo sapien
gacggcacaaatttccttgtcttgg

SEQ ID NO: 65631 - DNA, 25 bp, Homo sapien
gacggcaccaatttccttgtcttgg

SEQ ID NO: 65632 - DNA, 25 bp, Homo sapien
gacggcccaatcaatgagtggtggg

SEQ ID NO: 65633 - DNA, 25 bp, Homo sapien
gacggcccaatcagtgagtggtggg

SEQ ID NO: 65634 - DNA, 25 bp, Homo sapien
gacggctacgtaacggaaacccaga

SEQ ID NO: 65635 - DNA, 25 bp, Homo sapien
gacggctacgtgacggaaacccaga

SEQ ID NO: 65636 - DNA, 25 bp, Homo sapien
gacggggcaaggccactttttgaac

SEQ ID NO: 65637 - DNA, 25 bp, Homo sapien
gacggggctaggccactttttgaac

SEQ ID NO: 65638 - DNA, 25 bp, Homo sapien
gacggtagaaaaattataatgtctt

SEQ ID NO: 65639 - DNA, 25 bp, Homo sapien
gacggtaggaaaattataatgtctt

SEQ ID NO: 65640 - DNA, 25 bp, Homo sapien
gacggtggcaaggtcaactcagaat

SEQ ID NO: 65641 - DNA, 25 bp, Homo sapien
gacggtggctaggtcaactcagaat

SEQ ID NO: 65642 - DNA, 25 bp, Homo sapien
gacgtcaacatggaaggtacagtcc

SEQ ID NO: 65643 - DNA, 25 bp, Homo sapien
gacgtcaatatggaaggtacagtcc

SEQ ID NO: 65644 - DNA, 25 bp, Homo sapien
gacgtctgaaactggtgttcctgaa

SEQ ID NO: 65645 - DNA, 25 bp, Homo sapien
gacgtctgatactggtgttcctgaa

SEQ ID NO: 65646 - DNA, 25 bp, Homo sapien
gacgtgatgacccatatgcaaatgt

SEQ ID NO: 65647 - DNA, 25 bp, Homo sapien
gacgtgatgacccctatgcaaatgt

SEQ ID NO: 65648 - DNA, 25 bp, Homo sapien
gacgtgcatcagtagtaagaactgt

SEQ ID NO: 65649 - DNA, 25 bp, Homo sapien
gacgtgcatcattagtaagaactgt

SEQ ID NO: 65650 - DNA, 25 bp, Homo sapien
gacgtgtcattgtgggttcatcagc

SEQ ID NO: 65651 - DNA, 25 bp, Homo sapien
gacgtgtccttgtgggttcatcagc

SEQ ID NO: 65652 - DNA, 25 bp, Homo sapien
gacgtgttgctcaaagttgaagaga

SEQ ID NO: 65653 - DNA, 25 bp, Homo sapien
gacgtgttgctcgaagttgaagaga

SEQ ID NO: 65654 - DNA, 25 bp, Homo sapien
gacgtgtttctcctggtaacaaata

SEQ ID NO: 65655 - DNA, 25 bp, Homo sapien
gacgtgtttttcctggtaacaaata

SEQ ID NO: 65656 - DNA, 25 bp, Homo sapien
gacgttatcaagaaagaggaatttt

SEQ ID NO: 65657 - DNA, 25 bp, Homo sapien
gacgttatcaagaatgaggaatttt

SEQ ID NO: 65658 - DNA, 25 bp, Homo sapien
gacgttgaccttcctgccatactct

SEQ ID NO: 65659 - DNA, 25 bp, Homo sapien
gacgttgatcttcctgccatactct

SEQ ID NO: 65660 - DNA, 25 bp, Homo sapien
gacgtttagaagtggtccatgtata

SEQ ID NO: 65661 - DNA, 25 bp, Homo sapien
gacgtttagaagttgtccatgtata

SEQ ID NO: 65662 - DNA, 25 bp, Homo sapien
gactaaaaaaatgcacatcccctaa

SEQ ID NO: 65663 - DNA, 25 bp, Homo sapien
gactaaaacaatgcacatcccctaa

SEQ ID NO: 65664 - DNA, 25 bp, Homo sapien
gactaaaagaacagctcagccaact

SEQ ID NO: 65665 - DNA, 25 bp, Homo sapien
gactaaaagaaccgctcagccaact

SEQ ID NO: 65666 - DNA, 25 bp, Homo sapien
gactaaaatcaggtggtggaagtga

SEQ ID NO: 65667 - DNA, 25 bp, Homo sapien
gactaaaatcagttggtggaagtga

SEQ ID NO: 65668 - DNA, 25 bp, Homo sapien
gactaatagcacaaacatcaaatca

SEQ ID NO: 65669 - DNA, 25 bp, Homo sapien
gactaatagcacgaacatcaaatca

SEQ ID NO: 65670 - DNA, 25 bp, Homo sapien
gactaatggataaaataaggcagat

SEQ ID NO: 65671 - DNA, 25 bp, Homo sapien
gactaatggatacaataaggcagat

SEQ ID NO: 65672 - DNA, 25 bp, Homo sapien
gactacaagaaattatgaagctatt

SEQ ID NO: 65673 - DNA, 25 bp, Homo sapien
gactacaagaaattttgaagctatt

SEQ ID NO: 65674 - DNA, 25 bp, Homo sapien
gactacatgttgatccataaaaaat

SEQ ID NO: 65675 - DNA, 25 bp, Homo sapien
gactacatgttgatccgtaaaaaat

SEQ ID NO: 65676 - DNA, 25 bp, Homo sapien
gactacattcatccagataaaaact

SEQ ID NO: 65677 - DNA, 25 bp, Homo sapien
gactacattcatccagctaaaaact

SEQ ID NO: 65678 - DNA, 25 bp, Homo sapien
gactaccatactgatgatacaaaac

SEQ ID NO: 65679 - DNA, 25 bp, Homo sapien
gactaccatactggtgatacaaaac

SEQ ID NO: 65680 - DNA, 25 bp, Homo sapien
gactactcaataatttatccagctg

SEQ ID NO: 65681 - DNA, 25 bp, Homo sapien
gactactcagtaatttatccagctg

SEQ ID NO: 65682 - DNA, 25 bp, Homo sapien
gactactgccacagtacagccaggt

SEQ ID NO: 65683 - DNA, 25 bp, Homo sapien
gactactgccacggtacagccaggt

SEQ ID NO: 65684 - DNA, 25 bp, Homo sapien
gactactgcctagattacttatgtt

SEQ ID NO: 65685 - DNA, 25 bp, Homo sapien
gactactgcctagattgcttatgtt

SEQ ID NO: 65686 - DNA, 25 bp, Homo sapien
gactactttacctgctctttcactt

SEQ ID NO: 65687 - DNA, 25 bp, Homo sapien
gactactttacctgttctttcactt

SEQ ID NO: 65688 - DNA, 25 bp, Homo sapien
gactactttgacgtttctcaaacaa

SEQ ID NO: 65689 - DNA, 25 bp, Homo sapien
gactactttgaggtttctcaaacaa

SEQ ID NO: 65690 - DNA, 25 bp, Homo sapien
gactagaatcaattaactccagtgc

SEQ ID NO: 65691 - DNA, 25 bp, Homo sapien
gactagaatgaattaactccagtgc

SEQ ID NO: 65692 - DNA, 25 bp, Homo sapien
gactagacaaagacaccataaatag

SEQ ID NO: 65693 - DNA, 25 bp, Homo sapien
gactagacaaagacactataaatag

SEQ ID NO: 65694 - DNA, 25 bp, Homo sapien
gactagatggagtgtgttttataaa

SEQ ID NO: 65695 - DNA, 25 bp, Homo sapien
gactagatggagtttgttttataaa

SEQ ID NO: 65696 - DNA, 25 bp, Homo sapien
gactagatgttcagcgtatttggga

SEQ ID NO: 65697 - DNA, 25 bp, Homo sapien
gactagatgttcagtgtatttggga

SEQ ID NO: 65698 - DNA, 25 bp, Homo sapien
gactagcagatcaaaaacatcccga

SEQ ID NO: 65699 - DNA, 25 bp, Homo sapien
gactagcagatcaaaagcatcccga

SEQ ID NO: 65700 - DNA, 25 bp, Homo sapien
gactagctgatacagttaagcctaa

SEQ ID NO: 65701 - DNA, 25 bp, Homo sapien
gactagctggtacagttaagcctaa

SEQ ID NO: 65702 - DNA, 25 bp, Homo sapien
gactaggtccgtgttaagtgtattc

SEQ ID NO: 65703 - DNA, 25 bp, Homo sapien
gactaggtctgtgttaagtgtattc

SEQ ID NO: 65704 - DNA, 25 bp, Homo sapien
gactaggttcctaagagcaaggaag

SEQ ID NO: 65705 - DNA, 25 bp, Homo sapien
gactaggttcctacgagcaaggaag

SEQ ID NO: 65706 - DNA, 25 bp, Homo sapien
gactagtcagccttctatgaaatgt

SEQ ID NO: 65707 - DNA, 25 bp, Homo sapien
gactagtcagccttttatgaaatgt

SEQ ID NO: 65708 - DNA, 25 bp, Homo sapien
gactataaagaagaacaaagtgtgg

SEQ ID NO: 65709 - DNA, 25 bp, Homo sapien
gactataaagaagaccaaagtgtgg

SEQ ID NO: 65710 - DNA, 25 bp, Homo sapien
gactataatctgtgaaaagtgtgtt

SEQ ID NO: 65711 - DNA, 25 bp, Homo sapien
gactataatctgtgaagagtgtgtt

SEQ ID NO: 65712 - DNA, 25 bp, Homo sapien
gactatataaaaatcaaagcaaaag

SEQ ID NO: 65713 - DNA, 25 bp, Homo sapien
gactatataaatatcaaagcaaaag

SEQ ID NO: 65714 - DNA, 25 bp, Homo sapien
gactatatgagtactaatagcagtt

SEQ ID NO: 65715 - DNA, 25 bp, Homo sapien
gactatatgggtactaatagcagtt

SEQ ID NO: 65716 - DNA, 25 bp, Homo sapien
gactatccttggtccactgacttat

SEQ ID NO: 65717 - DNA, 25 bp, Homo sapien
gactatccttggtccattgacttat

SEQ ID NO: 65718 - DNA, 25 bp, Homo sapien
gactatctctaaactaccactggca

SEQ ID NO: 65719 - DNA, 25 bp, Homo sapien
gactatctctaaactatcactggca

SEQ ID NO: 65720 - DNA, 25 bp, Homo sapien
gactatgaagccagcagcagggtgg

SEQ ID NO: 65721 - DNA, 25 bp, Homo sapien
gactatgaggccagcagcagggtgg

SEQ ID NO: 65722 - DNA, 25 bp, Homo sapien
gactatgatagccacagcagctaaa

SEQ ID NO: 65723 - DNA, 25 bp, Homo sapien
gactatgatggccacagcagctaaa

SEQ ID NO: 65724 - DNA, 25 bp, Homo sapien
gactatgatttacgaaattcacata

SEQ ID NO: 65725 - DNA, 25 bp, Homo sapien
gactatgatttatgaaattcacata

SEQ ID NO: 65726 - DNA, 25 bp, Homo sapien
gactatgggaagacttctgcattga

SEQ ID NO: 65727 - DNA, 25 bp, Homo sapien
gactatgggaagccttctgcattga

SEQ ID NO: 65728 - DNA, 25 bp, Homo sapien
gactattgactgggaacaagccgag

SEQ ID NO: 65729 - DNA, 25 bp, Homo sapien
gactattgactgggaataagccgag

SEQ ID NO: 65730 - DNA, 25 bp, Homo sapien
gactatttttccatataaacgaatc

SEQ ID NO: 65731 - DNA, 25 bp, Homo sapien
gactatttttctatataaacgaatc

SEQ ID NO: 65732 - DNA, 25 bp, Homo sapien
gactcaaaagcgcactgtcacaata

SEQ ID NO: 65733 - DNA, 25 bp, Homo sapien
gactcaaaatcatcttcagacagct

SEQ ID NO: 65734 - DNA, 25 bp, Homo sapien
gactcaaaatcattttcagacagct

SEQ ID NO: 65735 - DNA, 25 bp, Homo sapien
gactcaaacaaagttaaataaaagg

SEQ ID NO: 65736 - DNA, 25 bp, Homo sapien
gactcaaagaaagttaaataaaagg

SEQ ID NO: 65737 - DNA, 25 bp, Homo sapien
gactcaaaggcctggggtatctcaa

SEQ ID NO: 65738 - DNA, 25 bp, Homo sapien
gactcaaaggcgcactgtcacaata

SEQ ID NO: 65739 - DNA, 25 bp, Homo sapien
gactcaaaggcttggggtatctcaa

SEQ ID NO: 65740 - DNA, 25 bp, Homo sapien
gactcaaagttccggtggctctggt

SEQ ID NO: 65741 - DNA, 25 bp, Homo sapien
gactcaaagttctggtggctctggt

SEQ ID NO: 65742 - DNA, 25 bp, Homo sapien
gactcaaatgtcaatttcctctggc

SEQ ID NO: 65743 - DNA, 25 bp, Homo sapien
gactcaaatgtcagtttcctctggc

SEQ ID NO: 65744 - DNA, 25 bp, Homo sapien
gactcaagatacgtttgaccataga

SEQ ID NO: 65745 - DNA, 25 bp, Homo sapien
gactcaagatatgtttgaccataga

SEQ ID NO: 65746 - DNA, 25 bp, Homo sapien
gactcaagtatctggtaaagtgaca

SEQ ID NO: 65747 - DNA, 25 bp, Homo sapien
gactcaagtatctggtgaagtgaca

SEQ ID NO: 65748 - DNA, 25 bp, Homo sapien
gactcaataacatgaacaacatttt

SEQ ID NO: 65749 - DNA, 25 bp, Homo sapien
gactcaatcacatgaacaacatttt

SEQ ID NO: 65750 - DNA, 25 bp, Homo sapien
gactcaatgaagattcagagggctg

SEQ ID NO: 65751 - DNA, 25 bp, Homo sapien
gactcaatgaaggttcagagggctg

SEQ ID NO: 65752 - DNA, 25 bp, Homo sapien
gactcaattatataaaagccattat

SEQ ID NO: 65753 - DNA, 25 bp, Homo sapien
gactcaattatttaaaagccattat

SEQ ID NO: 65754 - DNA, 25 bp, Homo sapien
gactcaccatacaaggagaagttcc

SEQ ID NO: 65755 - DNA, 25 bp, Homo sapien
gactcaccatacgaggagaagttcc

SEQ ID NO: 65756 - DNA, 25 bp, Homo sapien
gactcactgttttcctgaagtggga

SEQ ID NO: 65757 - DNA, 25 bp, Homo sapien
gactcactgtttttctgaagtggga

SEQ ID NO: 65758 - DNA, 25 bp, Homo sapien
gactcagaaatgtctccgcaatctg

SEQ ID NO: 65759 - DNA, 25 bp, Homo sapien
gactcagaattgtctccgcaatctg

SEQ ID NO: 65760 - DNA, 25 bp, Homo sapien
gactcagggtttatactagcggcct

SEQ ID NO: 65761 - DNA, 25 bp, Homo sapien
gactcaggttttatactagcggcct

SEQ ID NO: 65762 - DNA, 25 bp, Homo sapien
gactcataagcccaggtttgaactg

SEQ ID NO: 65763 - DNA, 25 bp, Homo sapien
gactcataagcctaggtttgaactg

SEQ ID NO: 65764 - DNA, 25 bp, Homo sapien
gactcatacagtgagaaagtgattg

SEQ ID NO: 65765 - DNA, 25 bp, Homo sapien
gactcatagtagatcatttgtaaca

SEQ ID NO: 65766 - DNA, 25 bp, Homo sapien
gactcatatagtgagaaagtgattg

SEQ ID NO: 65767 - DNA, 25 bp, Homo sapien
gactcatattagatcatttgtaaca

SEQ ID NO: 65768 - DNA, 25 bp, Homo sapien
gactcatgcctgtaaagtttctcat

SEQ ID NO: 65769 - DNA, 25 bp, Homo sapien
gactcatgcctgttaagtttctcat

SEQ ID NO: 65770 - DNA, 25 bp, Homo sapien
gactcattatgcctcgaattttttc

SEQ ID NO: 65771 - DNA, 25 bp, Homo sapien
gactcattatgcttcgaattttttc

SEQ ID NO: 65772 - DNA, 25 bp, Homo sapien
gactccaaatataagtctaaccaat

SEQ ID NO: 65773 - DNA, 25 bp, Homo sapien
gactccaagcctaactctctgcttt

SEQ ID NO: 65774 - DNA, 25 bp, Homo sapien
gactccaagcctgactctctgcttt

SEQ ID NO: 65775 - DNA, 25 bp, Homo sapien
gactccaattataagtctaaccaat

SEQ ID NO: 65776 - DNA, 25 bp, Homo sapien
gactccacaatcatgtgaaccaatt

SEQ ID NO: 65777 - DNA, 25 bp, Homo sapien
gactccacattcatgtgaaccaatt

SEQ ID NO: 65778 - DNA, 25 bp, Homo sapien
gactccagccttataaaatatgatt

SEQ ID NO: 65779 - DNA, 25 bp, Homo sapien
gactccaggcttataaaatatgatt

SEQ ID NO: 65780 - DNA, 25 bp, Homo sapien
gactccatcttggctctttcactgg

SEQ ID NO: 65781 - DNA, 25 bp, Homo sapien
gactccatgttggctctttcactgg

SEQ ID NO: 65782 - DNA, 25 bp, Homo sapien
gactccgactgcagtgcggacaatg

SEQ ID NO: 65783 - DNA, 25 bp, Homo sapien
gactccgactgcggtgcggacaatg

SEQ ID NO: 65784 - DNA, 25 bp, Homo sapien
gactcctttcttattataccacatg

SEQ ID NO: 65785 - DNA, 25 bp, Homo sapien
gactcctttcttgttataccacatg

SEQ ID NO: 65786 - DNA, 25 bp, Homo sapien
gactcgagtgcataacattttttac

SEQ ID NO: 65787 - DNA, 25 bp, Homo sapien
gactcgagtgcatagcattttttac

SEQ ID NO: 65788 - DNA, 25 bp, Homo sapien
gactcgatgcgctgactgcacctgt

SEQ ID NO: 65789 - DNA, 25 bp, Homo sapien
gactcgatgtgctgactgcacctgt

SEQ ID NO: 65790 - DNA, 25 bp, Homo sapien
gactctaactccacatagaaagtat

SEQ ID NO: 65791 - DNA, 25 bp, Homo sapien
gactctaactccacgtagaaagtat

SEQ ID NO: 65792 - DNA, 25 bp, Homo sapien
gactctaccatgaccctagaataaa

SEQ ID NO: 65793 - DNA, 25 bp, Homo sapien
gactctaccgtgaccctagaataaa

SEQ ID NO: 65794 - DNA, 25 bp, Homo sapien
gactctataaaaccctgtaaaatct

SEQ ID NO: 65795 - DNA, 25 bp, Homo sapien
gactctataaaatcctgtaaaatct

SEQ ID NO: 65796 - DNA, 25 bp, Homo sapien
gactctatttggggtgttatctttt

SEQ ID NO: 65797 - DNA, 25 bp, Homo sapien
gactctatttgggttgttatctttt

SEQ ID NO: 65798 - DNA, 25 bp, Homo sapien
gactctcagaactagtttattcaat

SEQ ID NO: 65799 - DNA, 25 bp, Homo sapien
gactctcagaactggtttattcaat

SEQ ID NO: 65800 - DNA, 25 bp, Homo sapien
gactctcattgcgtgaattcaagtc

SEQ ID NO: 65801 - DNA, 25 bp, Homo sapien
gactctcattgtgtgaattcaagtc

SEQ ID NO: 65802 - DNA, 25 bp, Homo sapien
gactctctaaatctgtttgggattt

SEQ ID NO: 65803 - DNA, 25 bp, Homo sapien
gactctctaaatttgtttgggattt

SEQ ID NO: 65804 - DNA, 25 bp, Homo sapien
gactctctctacgtaattttaggct

SEQ ID NO: 65805 - DNA, 25 bp, Homo sapien
gactctcttctcttttatagatgta

SEQ ID NO: 65806 - DNA, 25 bp, Homo sapien
gactctcttctgttttatagatgta

SEQ ID NO: 65807 - DNA, 25 bp, Homo sapien
gactctctttacgtaattttaggct

SEQ ID NO: 65808 - DNA, 25 bp, Homo sapien
gactctgaagccagggccggcgggt

SEQ ID NO: 65809 - DNA, 25 bp, Homo sapien
gactctgaagccggggccggcgggt

SEQ ID NO: 65810 - DNA, 25 bp, Homo sapien
gactctgacaggtacttaaaaccaa

SEQ ID NO: 65811 - DNA, 25 bp, Homo sapien
gactctgacaggtccttaaaaccaa

SEQ ID NO: 65812 - DNA, 25 bp, Homo sapien
gactctgatgcatacggaattgtga

SEQ ID NO: 65813 - DNA, 25 bp, Homo sapien
gactctgatgcatatggaattgtga

SEQ ID NO: 65814 - DNA, 25 bp, Homo sapien
gactctgcctcattgaggatatttt

SEQ ID NO: 65815 - DNA, 25 bp, Homo sapien
gactctgcctcgttgaggatatttt

SEQ ID NO: 65816 - DNA, 25 bp, Homo sapien
gactctgctcctcctcactgttgct

SEQ ID NO: 65817 - DNA, 25 bp, Homo sapien
gactctgctccttctcactgttgct

SEQ ID NO: 65818 - DNA, 25 bp, Homo sapien
gactcttacactatactgtctcccg

SEQ ID NO: 65819 - DNA, 25 bp, Homo sapien
gactcttacactatgctgtctcccg

SEQ ID NO: 65820 - DNA, 25 bp, Homo sapien
gactcttacgggtcacacaaaacta

SEQ ID NO: 65821 - DNA, 25 bp, Homo sapien
gactcttatgggtcacacaaaacta

SEQ ID NO: 65822 - DNA, 25 bp, Homo sapien
gactcttccacattctatgggacat

SEQ ID NO: 65823 - DNA, 25 bp, Homo sapien
gactcttctacattctatgggacat

SEQ ID NO: 65824 - DNA, 25 bp, Homo sapien
gactcttgcagaagacaatggatat

SEQ ID NO: 65825 - DNA, 25 bp, Homo sapien
gactcttgcagaaggcaatggatat

SEQ ID NO: 65826 - DNA, 25 bp, Homo sapien
gactcttggattcaggcttaggaca

SEQ ID NO: 65827 - DNA, 25 bp, Homo sapien
gactcttggatttaggcttaggaca

SEQ ID NO: 65828 - DNA, 25 bp, Homo sapien
gactctttatgcatctgtcatctct

SEQ ID NO: 65829 - DNA, 25 bp, Homo sapien
gactctttatgcatctttcatctct

SEQ ID NO: 65830 - DNA, 25 bp, Homo sapien
gactgaaaagctgcaggaccttgaa

SEQ ID NO: 65831 - DNA, 25 bp, Homo sapien
gactgaaaagctgcgggaccttgaa

SEQ ID NO: 65832 - DNA, 25 bp, Homo sapien
gactgaaacatcgctaaaatgattt

SEQ ID NO: 65833 - DNA, 25 bp, Homo sapien
gactgaaacatcgttaaaatgattt

SEQ ID NO: 65834 - DNA, 25 bp, Homo sapien
gactgaaacgttatgtaactttaag

SEQ ID NO: 65835 - DNA, 25 bp, Homo sapien
gactgaaactgaaaggaaaccccag

SEQ ID NO: 65836 - DNA, 25 bp, Homo sapien
gactgaaatgaacctttctaaactt

SEQ ID NO: 65837 - DNA, 25 bp, Homo sapien
gactgaaatgaatctttctaaactt

SEQ ID NO: 65838 - DNA, 25 bp, Homo sapien
gactgaaatgtcattatgtggtatg

SEQ ID NO: 65839 - DNA, 25 bp, Homo sapien
gactgaaatgtcgttatgtggtatg

SEQ ID NO: 65840 - DNA, 25 bp, Homo sapien
gactgaaatgttatgtaactttaag

SEQ ID NO: 65841 - DNA, 25 bp, Homo sapien
gactgaaattgaaaggaaaccccag

SEQ ID NO: 65842 - DNA, 25 bp, Homo sapien
gactgaagcgcacatttgatctaat

SEQ ID NO: 65843 - DNA, 25 bp, Homo sapien
gactgaagcgcacgtttgatctaat

SEQ ID NO: 65844 - DNA, 25 bp, Homo sapien
gactgaagtcccatcaacacttcat

SEQ ID NO: 65845 - DNA, 25 bp, Homo sapien
gactgaagtcccatcaccacttcat

SEQ ID NO: 65846 - DNA, 25 bp, Homo sapien
gactgaatagagagtgatctgaaca

SEQ ID NO: 65847 - DNA, 25 bp, Homo sapien
gactgaatagagagtggtctgaaca

SEQ ID NO: 65848 - DNA, 25 bp, Homo sapien
gactgaatcatagggtagttcttaa

SEQ ID NO: 65849 - DNA, 25 bp, Homo sapien
gactgaatcatggggtagttcttaa

SEQ ID NO: 65850 - DNA, 25 bp, Homo sapien
gactgaatggaaaaaacaaactttg

SEQ ID NO: 65851 - DNA, 25 bp, Homo sapien
gactgaatggaaaaaataaactttg

SEQ ID NO: 65852 - DNA, 25 bp, Homo sapien
gactgacatcattaaaaaattagct

SEQ ID NO: 65853 - DNA, 25 bp, Homo sapien
gactgacatcattgaaaaattagct

SEQ ID NO: 65854 - DNA, 25 bp, Homo sapien
gactgacttcgtttgcagcagagca

SEQ ID NO: 65855 - DNA, 25 bp, Homo sapien
gactgactttgtttgcagcagagca

SEQ ID NO: 65856 - DNA, 25 bp, Homo sapien
gactgagaaataattgatacattaa

SEQ ID NO: 65857 - DNA, 25 bp, Homo sapien
gactgagaaatgatccttggactat

SEQ ID NO: 65858 - DNA, 25 bp, Homo sapien
gactgagaaattatccttggactat

SEQ ID NO: 65859 - DNA, 25 bp, Homo sapien
gactgagaactaattgatacattaa

SEQ ID NO: 65860 - DNA, 25 bp, Homo sapien
gactgagataataaatctatgccca

SEQ ID NO: 65861 - DNA, 25 bp, Homo sapien
gactgagataatgaatctatgccca

SEQ ID NO: 65862 - DNA, 25 bp, Homo sapien
gactgagatcaacgctttatttatc

SEQ ID NO: 65863 - DNA, 25 bp, Homo sapien
gactgagatcaatgctttatttatc

SEQ ID NO: 65864 - DNA, 25 bp, Homo sapien
gactgagatgtcaaaatcccatctc

SEQ ID NO: 65865 - DNA, 25 bp, Homo sapien
gactgagatgtcagaatcccatctc

SEQ ID NO: 65866 - DNA, 25 bp, Homo sapien
gactgagcatagggttcccagttcc

SEQ ID NO: 65867 - DNA, 25 bp, Homo sapien
gactgagcatgtggaaataaggagc

SEQ ID NO: 65868 - DNA, 25 bp, Homo sapien
gactgagccatattacctgagccca

SEQ ID NO: 65869 - DNA, 25 bp, Homo sapien
gactgagccatattccctgagccca

SEQ ID NO: 65870 - DNA, 25 bp, Homo sapien
gactgagcgtagggttcccagttcc

SEQ ID NO: 65871 - DNA, 25 bp, Homo sapien
gactgagcgtgtggaaataaggagc

SEQ ID NO: 65872 - DNA, 25 bp, Homo sapien
gactgaggccacaaagttaactgta

SEQ ID NO: 65873 - DNA, 25 bp, Homo sapien
gactgaggccagaaagttaactgta

SEQ ID NO: 65874 - DNA, 25 bp, Homo sapien
gactgagtaaaagtattgctgaata

SEQ ID NO: 65875 - DNA, 25 bp, Homo sapien
gactgagtgaaagtattgctgaata

SEQ ID NO: 65876 - DNA, 25 bp, Homo sapien
gactgataaatgagaaaacatgtca

SEQ ID NO: 65877 - DNA, 25 bp, Homo sapien
gactgataaatgggaaaacatgtca

SEQ ID NO: 65878 - DNA, 25 bp, Homo sapien
gactgataactacccactctcagtc

SEQ ID NO: 65879 - DNA, 25 bp, Homo sapien
gactgataattacccactctcagtc

SEQ ID NO: 65880 - DNA, 25 bp, Homo sapien
gactgatggtactccaaatcacctt

SEQ ID NO: 65881 - DNA, 25 bp, Homo sapien
gactgatggtactcgaaatcacctt

SEQ ID NO: 65882 - DNA, 25 bp, Homo sapien
gactgattcagtacgaacactggaa

SEQ ID NO: 65883 - DNA, 25 bp, Homo sapien
gactgattcagtatgaacactggaa

SEQ ID NO: 65884 - DNA, 25 bp, Homo sapien
gactgcaaactccaccactaactag

SEQ ID NO: 65885 - DNA, 25 bp, Homo sapien
gactgcaaactctaccactaactag

SEQ ID NO: 65886 - DNA, 25 bp, Homo sapien
gactgcaagactgcaagaaatacct

SEQ ID NO: 65887 - DNA, 25 bp, Homo sapien
gactgcaagactgcgagaaatacct

SEQ ID NO: 65888 - DNA, 25 bp, Homo sapien
gactgcacagatcaaaagtgtcgaa

SEQ ID NO: 65889 - DNA, 25 bp, Homo sapien
gactgcacagatcgaaagtgtcgaa

SEQ ID NO: 65890 - DNA, 25 bp, Homo sapien
gactgcaccagataagctatgctaa

SEQ ID NO: 65891 - DNA, 25 bp, Homo sapien
gactgcaccagataggctatgctaa

SEQ ID NO: 65892 - DNA, 25 bp, Homo sapien
gactgcagtttacacttttctctga

SEQ ID NO: 65893 - DNA, 25 bp, Homo sapien
gactgcagtttatacttttctctga

SEQ ID NO: 65894 - DNA, 25 bp, Homo sapien
gactgcagtttgtctcagccaagaa

SEQ ID NO: 65895 - DNA, 25 bp, Homo sapien
gactgcagtttgtttcagccaagaa

SEQ ID NO: 65896 - DNA, 25 bp, Homo sapien
gactgccagtgctaatcgtgtcatt

SEQ ID NO: 65897 - DNA, 25 bp, Homo sapien
gactgccagtgctaattgtgtcatt

SEQ ID NO: 65898 - DNA, 25 bp, Homo sapien
gactgctaactgatttgaacatgaa

SEQ ID NO: 65899 - DNA, 25 bp, Homo sapien
gactgctaactggtttgaacatgaa

SEQ ID NO: 65900 - DNA, 25 bp, Homo sapien
gactgctggtgcatatggtaagtgt

SEQ ID NO: 65901 - DNA, 25 bp, Homo sapien
gactgctggtgcgtatggtaagtgt

SEQ ID NO: 65902 - DNA, 25 bp, Homo sapien
gactgcttaaggccataagtccgaa

SEQ ID NO: 65903 - DNA, 25 bp, Homo sapien
gactgcttaaggccgtaagtccgaa

SEQ ID NO: 65904 - DNA, 25 bp, Homo sapien
gactgcttgcttcaactattaatag

SEQ ID NO: 65905 - DNA, 25 bp, Homo sapien
gactgcttgctttaactattaatag

SEQ ID NO: 65906 - DNA, 25 bp, Homo sapien
gactgcttgttgcaataagataacc

SEQ ID NO: 65907 - DNA, 25 bp, Homo sapien
gactgcttgttgcaatcagataacc

SEQ ID NO: 65908 - DNA, 25 bp, Homo sapien
gactgctttagctacttctcataag

SEQ ID NO: 65909 - DNA, 25 bp, Homo sapien
gactgctttcgctacttctcataag

SEQ ID NO: 65910 - DNA, 25 bp, Homo sapien
gactggaagtaccataaaaataaat

SEQ ID NO: 65911 - DNA, 25 bp, Homo sapien
gactggaagtacgataaaaataaat

SEQ ID NO: 65912 - DNA, 25 bp, Homo sapien
gactggaatcagggacgtttcctgg

SEQ ID NO: 65913 - DNA, 25 bp, Homo sapien
gactggaatcagggacttttcctgg

SEQ ID NO: 65914 - DNA, 25 bp, Homo sapien
gactggagacgaggtacagttttat

SEQ ID NO: 65915 - DNA, 25 bp, Homo sapien
gactggagatgaggtacagttttat

SEQ ID NO: 65916 - DNA, 25 bp, Homo sapien
gactggatgaaactgaaggtcacgg

SEQ ID NO: 65917 - DNA, 25 bp, Homo sapien
gactggatgaaattgaaggtcacgg

SEQ ID NO: 65918 - DNA, 25 bp, Homo sapien
gactggcaaaattaaacgtatatta

SEQ ID NO: 65919 - DNA, 25 bp, Homo sapien
gactggcaaaattaaaggtatatta

SEQ ID NO: 65920 - DNA, 25 bp, Homo sapien
gactggcaccaaagttccaccagcc

SEQ ID NO: 65921 - DNA, 25 bp, Homo sapien
gactggcaccagagttccaccagcc

SEQ ID NO: 65922 - DNA, 25 bp, Homo sapien
gactggcagggactttgtttggctt

SEQ ID NO: 65923 - DNA, 25 bp, Homo sapien
gactggcagggactttttttggctt

SEQ ID NO: 65924 - DNA, 25 bp, Homo sapien
gactggcccagtacagccgatggaa

SEQ ID NO: 65925 - DNA, 25 bp, Homo sapien
gactggcccagtatagccgatggaa

SEQ ID NO: 65926 - DNA, 25 bp, Homo sapien
gactggctaaatggattttttaaaa

SEQ ID NO: 65927 - DNA, 25 bp, Homo sapien
gactggctgaatggattttttaaaa

SEQ ID NO: 65928 - DNA, 25 bp, Homo sapien
gactgggaacaagccgagaatattg

SEQ ID NO: 65929 - DNA, 25 bp, Homo sapien
gactgggaataagccgagaatattg

SEQ ID NO: 65930 - DNA, 25 bp, Homo sapien
gactgggagctctttggaaacagat

SEQ ID NO: 65931 - DNA, 25 bp, Homo sapien
gactgggagctttttggaaacagat

SEQ ID NO: 65932 - DNA, 25 bp, Homo sapien
gactgggatacaaaaaacaatgaag

SEQ ID NO: 65933 - DNA, 25 bp, Homo sapien
gactgggatacagaaaacaatgaag

SEQ ID NO: 65934 - DNA, 25 bp, Homo sapien
gactgggatatcatgaggtttaatg

SEQ ID NO: 65935 - DNA, 25 bp, Homo sapien
gactgggatgtcatgaggtttaatg

SEQ ID NO: 65936 - DNA, 25 bp, Homo sapien
gactgggggcgcaaagagcttcgtt

SEQ ID NO: 65937 - DNA, 25 bp, Homo sapien
gactgggggtgcaaagagcttcgtt

SEQ ID NO: 65938 - DNA, 25 bp, Homo sapien
gactggtgcatgggaaggattaaag

SEQ ID NO: 65939 - DNA, 25 bp, Homo sapien
gactggtgcctgggaaggattaaag

SEQ ID NO: 65940 - DNA, 25 bp, Homo sapien
gactgtacccttacttgaccactct

SEQ ID NO: 65941 - DNA, 25 bp, Homo sapien
gactgtacccttactttaccactct

SEQ ID NO: 65942 - DNA, 25 bp, Homo sapien
gactgtagcactagacttgtgaatt

SEQ ID NO: 65943 - DNA, 25 bp, Homo sapien
gactgtagcactagtcttgtgaatt

SEQ ID NO: 65944 - DNA, 25 bp, Homo sapien
gactgtatctggattatgtgatata

SEQ ID NO: 65945 - DNA, 25 bp, Homo sapien
gactgtatctgtattatgtgatata

SEQ ID NO: 65946 - DNA, 25 bp, Homo sapien
gactgtcacagcagaaagtgtcatc

SEQ ID NO: 65947 - DNA, 25 bp, Homo sapien
gactgtcacggcagaaagtgtcatc

SEQ ID NO: 65948 - DNA, 25 bp, Homo sapien
gactgtccttcccgaaagcagccct

SEQ ID NO: 65949 - DNA, 25 bp, Homo sapien
gactgtccttcctgaaagcagccct

SEQ ID NO: 65950 - DNA, 25 bp, Homo sapien
gactgtcttcctatacattttcaga

SEQ ID NO: 65951 - DNA, 25 bp, Homo sapien
gactgtcttcctattcattttcaga

SEQ ID NO: 65952 - DNA, 25 bp, Homo sapien
gactgtgaatatcccatcagagaga

SEQ ID NO: 65953 - DNA, 25 bp, Homo sapien
gactgtgacgaactgggcaaattaa

SEQ ID NO: 65954 - DNA, 25 bp, Homo sapien
gactgtgagtatcccatcagagaga

SEQ ID NO: 65955 - DNA, 25 bp, Homo sapien
gactgtgatgaactgggcaaattaa

SEQ ID NO: 65956 - DNA, 25 bp, Homo sapien
gactgtgctaaaactagagcctatt

SEQ ID NO: 65957 - DNA, 25 bp, Homo sapien
gactgtgctaacactagagcctatt

SEQ ID NO: 65958 - DNA, 25 bp, Homo sapien
gactgtgtcaccatcaatgcagtcg

SEQ ID NO: 65959 - DNA, 25 bp, Homo sapien
gactgtgtcaccatcagtgcagtcg

SEQ ID NO: 65960 - DNA, 25 bp, Homo sapien
gactgtgttgaaagtaatgaaaagg

SEQ ID NO: 65961 - DNA, 25 bp, Homo sapien
gactgtgttgaacgtaatgaaaagg

SEQ ID NO: 65962 - DNA, 25 bp, Homo sapien
gactgtgttgtgcactagatagata

SEQ ID NO: 65963 - DNA, 25 bp, Homo sapien
gactgtgttgtgcattagatagata

SEQ ID NO: 65964 - DNA, 25 bp, Homo sapien
gactgtgttttaggcgataacattt

SEQ ID NO: 65965 - DNA, 25 bp, Homo sapien
gactgtgttttaggtgataacattt

SEQ ID NO: 65966 - DNA, 25 bp, Homo sapien
gactgttacggagaaaagatttagg

SEQ ID NO: 65967 - DNA, 25 bp, Homo sapien
gactgttatggagaaaagatttagg

SEQ ID NO: 65968 - DNA, 25 bp, Homo sapien
gactgttccataagttatgtattca

SEQ ID NO: 65969 - DNA, 25 bp, Homo sapien
gactgttccgtaagttatgtattca

SEQ ID NO: 65970 - DNA, 25 bp, Homo sapien
gactgttccttttggttagcaagat

SEQ ID NO: 65971 - DNA, 25 bp, Homo sapien
gactgttctttttggttagcaagat

SEQ ID NO: 65972 - DNA, 25 bp, Homo sapien
gacttaaaaagagcaacagtagcta

SEQ ID NO: 65973 - DNA, 25 bp, Homo sapien
gacttaaaattgacccttgagcgat

SEQ ID NO: 65974 - DNA, 25 bp, Homo sapien
gacttaaaattgacgcttgagcgat

SEQ ID NO: 65975 - DNA, 25 bp, Homo sapien
gacttaaatagagcaacagtagcta

SEQ ID NO: 65976 - DNA, 25 bp, Homo sapien
gacttaagtacacttgctttacagg

SEQ ID NO: 65977 - DNA, 25 bp, Homo sapien
gacttaagtacatttgctttacagg

SEQ ID NO: 65978 - DNA, 25 bp, Homo sapien
gacttaatcatccagcagtgtccta

SEQ ID NO: 65979 - DNA, 25 bp, Homo sapien
gacttaatcgtccagcagtgtccta

SEQ ID NO: 65980 - DNA, 25 bp, Homo sapien
gacttagaaaccagtttagagaact

SEQ ID NO: 65981 - DNA, 25 bp, Homo sapien
gacttagaaaccggtttagagaact

SEQ ID NO: 65982 - DNA, 25 bp, Homo sapien
gacttagccataaattatttaccaa

SEQ ID NO: 65983 - DNA, 25 bp, Homo sapien
gacttagccgtaaattatttaccaa

SEQ ID NO: 65984 - DNA, 25 bp, Homo sapien
gacttaggcattcgttcttatcagg

SEQ ID NO: 65985 - DNA, 25 bp, Homo sapien
gacttaggcatttgttcttatcagg

SEQ ID NO: 65986 - DNA, 25 bp, Homo sapien
gacttataaaacatatagcaaacat

SEQ ID NO: 65987 - DNA, 25 bp, Homo sapien
gacttataaaacgtatagcaaacat

SEQ ID NO: 65988 - DNA, 25 bp, Homo sapien
gacttataaaccactgactgcttcc

SEQ ID NO: 65989 - DNA, 25 bp, Homo sapien
gacttataaaccattgactgcttcc

SEQ ID NO: 65990 - DNA, 25 bp, Homo sapien
gacttatgattgccctcattacgta

SEQ ID NO: 65991 - DNA, 25 bp, Homo sapien
gacttatgattgctctcattacgta

SEQ ID NO: 65992 - DNA, 25 bp, Homo sapien
gacttattgcgaagaatgtacttca

SEQ ID NO: 65993 - DNA, 25 bp, Homo sapien
gacttattgtgaagaatgtacttca

SEQ ID NO: 65994 - DNA, 25 bp, Homo sapien
gacttatttggagcagtgattgatg

SEQ ID NO: 65995 - DNA, 25 bp, Homo sapien
gacttatttggagtagtgattgatg

SEQ ID NO: 65996 - DNA, 25 bp, Homo sapien
gacttcaaacgatactataaggcac

SEQ ID NO: 65997 - DNA, 25 bp, Homo sapien
gacttcaaacgatactgtaaggcac

SEQ ID NO: 65998 - DNA, 25 bp, Homo sapien
gacttcaccctaaccttttattcaa

SEQ ID NO: 65999 - DNA, 25 bp, Homo sapien
gacttcaccctaacgttttattcaa

SEQ ID NO: 66000 - DNA, 25 bp, Homo sapien
gacttcagacttactaagcaaaaac

SEQ ID NO: 66001 - DNA, 25 bp, Homo sapien
gacttcagatttactaagcaaaaac

SEQ ID NO: 66002 - DNA, 25 bp, Homo sapien
gacttcagtgccgattttctgactc

SEQ ID NO: 66003 - DNA, 25 bp, Homo sapien
gacttcagtgctgattttctgactc

SEQ ID NO: 66004 - DNA, 25 bp, Homo sapien
gacttccaaaacatcccctgtgagg

SEQ ID NO: 66005 - DNA, 25 bp, Homo sapien
gacttccaaaagatcccctgtgagg

SEQ ID NO: 66006 - DNA, 25 bp, Homo sapien
gacttcccactcttgttagctgact

SEQ ID NO: 66007 - DNA, 25 bp, Homo sapien
gacttcccagacacgatgtggcaag

SEQ ID NO: 66008 - DNA, 25 bp, Homo sapien
gacttcccagacactatgtggcaag

SEQ ID NO: 66009 - DNA, 25 bp, Homo sapien
gacttcccgctcttgttagctgact

SEQ ID NO: 66010 - DNA, 25 bp, Homo sapien
gacttcctaacaataaaccacattc

SEQ ID NO: 66011 - DNA, 25 bp, Homo sapien
gacttcctaacactaaaccacattc

SEQ ID NO: 66012 - DNA, 25 bp, Homo sapien
gacttcctgaatattgcaaggtctg

SEQ ID NO: 66013 - DNA, 25 bp, Homo sapien
gacttcctgaatcttgcaaggtctg

SEQ ID NO: 66014 - DNA, 25 bp, Homo sapien
gacttcgagttgtctggtcacttta

SEQ ID NO: 66015 - DNA, 25 bp, Homo sapien
gacttcgagttgtctgttcacttta

SEQ ID NO: 66016 - DNA, 25 bp, Homo sapien
gacttctcagtctccatagttatat

SEQ ID NO: 66017 - DNA, 25 bp, Homo sapien
gacttctcagtctgcatagttatat

SEQ ID NO: 66018 - DNA, 25 bp, Homo sapien
gacttctcttagggagcacacttgc

SEQ ID NO: 66019 - DNA, 25 bp, Homo sapien
gacttctcttatggagcacacttgc

SEQ ID NO: 66020 - DNA, 25 bp, Homo sapien
gacttcttagagaagcgagtctttt

SEQ ID NO: 66021 - DNA, 25 bp, Homo sapien
gacttcttagagaagctagtctttt

SEQ ID NO: 66022 - DNA, 25 bp, Homo sapien
gacttgaacatttcccaagtttggc

SEQ ID NO: 66023 - DNA, 25 bp, Homo sapien
gacttgaacgtttcccaagtttggc

SEQ ID NO: 66024 - DNA, 25 bp, Homo sapien
gacttgaactgacaaataagcataa

SEQ ID NO: 66025 - DNA, 25 bp, Homo sapien
gacttgaactgacagataagcataa

SEQ ID NO: 66026 - DNA, 25 bp, Homo sapien
gacttgagtggatataacctgtgag

SEQ ID NO: 66027 - DNA, 25 bp, Homo sapien
gacttgagtggatgtaacctgtgag

SEQ ID NO: 66028 - DNA, 25 bp, Homo sapien
gacttgccattggcagataaaaaat

SEQ ID NO: 66029 - DNA, 25 bp, Homo sapien
gacttgccattggtagataaaaaat

SEQ ID NO: 66030 - DNA, 25 bp, Homo sapien
gacttgcccacaaatagtcacagca

SEQ ID NO: 66031 - DNA, 25 bp, Homo sapien
gacttgcccaccaatagtcacagca

SEQ ID NO: 66032 - DNA, 25 bp, Homo sapien
gacttgctattttttttcccttgga

SEQ ID NO: 66033 - DNA, 25 bp, Homo sapien
gacttgctcttttttttcccttgga

SEQ ID NO: 66034 - DNA, 25 bp, Homo sapien
gacttggaaagaactgattacctga

SEQ ID NO: 66035 - DNA, 25 bp, Homo sapien
gacttggaaagaattgattacctga

SEQ ID NO: 66036 - DNA, 25 bp, Homo sapien
gacttggatactattaaaagcattt

SEQ ID NO: 66037 - DNA, 25 bp, Homo sapien
gacttggatactgttaaaagcattt

SEQ ID NO: 66038 - DNA, 25 bp, Homo sapien
gacttggtcattaaggttattggat

SEQ ID NO: 66039 - DNA, 25 bp, Homo sapien
gacttggtcgttaaggttattggat

SEQ ID NO: 66040 - DNA, 25 bp, Homo sapien
gacttgtactttaagtttgattgac

SEQ ID NO: 66041 - DNA, 25 bp, Homo sapien
gacttgtactttgagtttgattgac

SEQ ID NO: 66042 - DNA, 25 bp, Homo sapien
gacttgtcagtttccttatcaccca

SEQ ID NO: 66043 - DNA, 25 bp, Homo sapien
gacttgtcagtttctttatcaccca

SEQ ID NO: 66044 - DNA, 25 bp, Homo sapien
gacttgtgtgattaaagtgggctca

SEQ ID NO: 66045 - DNA, 25 bp, Homo sapien
gacttgtgtgattgaagtgggctca

SEQ ID NO: 66046 - DNA, 25 bp, Homo sapien
gacttgttcttttacttttttaaat

SEQ ID NO: 66047 - DNA, 25 bp, Homo sapien
gacttgttctttttcttttttaaat

SEQ ID NO: 66048 - DNA, 25 bp, Homo sapien
gacttgttgcactccatcacattaa

SEQ ID NO: 66049 - DNA, 25 bp, Homo sapien
gacttgttgcactctatcacattaa

SEQ ID NO: 66050 - DNA, 25 bp, Homo sapien
gacttgtttatgttcctattgcctg

SEQ ID NO: 66051 - DNA, 25 bp, Homo sapien
gacttgtttatgtttctattgcctg

SEQ ID NO: 66052 - DNA, 25 bp, Homo sapien
gactttaactgggctttttctcctc

SEQ ID NO: 66053 - DNA, 25 bp, Homo sapien
gactttaattgggctttttctcctc

SEQ ID NO: 66054 - DNA, 25 bp, Homo sapien
gactttacacaataagacctaagaa

SEQ ID NO: 66055 - DNA, 25 bp, Homo sapien
gactttacacagtaagacctaagaa

SEQ ID NO: 66056 - DNA, 25 bp, Homo sapien
gactttactcggatagagtgttgag

SEQ ID NO: 66057 - DNA, 25 bp, Homo sapien
gactttacttggatagagtgttgag

SEQ ID NO: 66058 - DNA, 25 bp, Homo sapien
gactttatacaggaaataattccat

SEQ ID NO: 66059 - DNA, 25 bp, Homo sapien
gactttatagaggaaataattccat

SEQ ID NO: 66060 - DNA, 25 bp, Homo sapien
gactttatagaggcaaaagagtgag

SEQ ID NO: 66061 - DNA, 25 bp, Homo sapien
gactttatggaggcaaaagagtgag

SEQ ID NO: 66062 - DNA, 25 bp, Homo sapien
gactttattagtgatcagcacttat

SEQ ID NO: 66063 - DNA, 25 bp, Homo sapien
gactttattagtgatcggcacttat

SEQ ID NO: 66064 - DNA, 25 bp, Homo sapien
gactttattggaaatgtagtccttg

SEQ ID NO: 66065 - DNA, 25 bp, Homo sapien
gactttattggagatgtagtccttg

SEQ ID NO: 66066 - DNA, 25 bp, Homo sapien
gactttattttctttatcccgcatg

SEQ ID NO: 66067 - DNA, 25 bp, Homo sapien
gactttattttttttatcccgcatg

SEQ ID NO: 66068 - DNA, 25 bp, Homo sapien
gactttcaaactagggtgaggctag

SEQ ID NO: 66069 - DNA, 25 bp, Homo sapien
gactttcatactagggtgaggctag

SEQ ID NO: 66070 - DNA, 25 bp, Homo sapien
gactttccacccgtttttcccttca

SEQ ID NO: 66071 - DNA, 25 bp, Homo sapien
gactttccacccttttttcccttca

SEQ ID NO: 66072 - DNA, 25 bp, Homo sapien
gactttccatctcaattgtacagac

SEQ ID NO: 66073 - DNA, 25 bp, Homo sapien
gactttccatctgaattgtacagac

SEQ ID NO: 66074 - DNA, 25 bp, Homo sapien
gactttctcatggcggaaggcacgg

SEQ ID NO: 66075 - DNA, 25 bp, Homo sapien
gactttctcatggtggaaggcacgg

SEQ ID NO: 66076 - DNA, 25 bp, Homo sapien
gactttctccagcggcagaaatctt

SEQ ID NO: 66077 - DNA, 25 bp, Homo sapien
gactttctccagtggcagaaatctt

SEQ ID NO: 66078 - DNA, 25 bp, Homo sapien
gactttcttggaggtagatgccaca

SEQ ID NO: 66079 - DNA, 25 bp, Homo sapien
gactttcttggcggtagatgccaca

SEQ ID NO: 66080 - DNA, 25 bp, Homo sapien
gactttgaagacccattagtaatat

SEQ ID NO: 66081 - DNA, 25 bp, Homo sapien
gactttgaagactcattagtaatat

SEQ ID NO: 66082 - DNA, 25 bp, Homo sapien
gactttgaatgtcccaggatgggag

SEQ ID NO: 66083 - DNA, 25 bp, Homo sapien
gactttgagtgtcccaggatgggag

SEQ ID NO: 66084 - DNA, 25 bp, Homo sapien
gactttgatttcctaatatgggatg

SEQ ID NO: 66085 - DNA, 25 bp, Homo sapien
gactttgatttgctaatatgggatg

SEQ ID NO: 66086 - DNA, 25 bp, Homo sapien
gactttgccgacagacaattttaaa

SEQ ID NO: 66087 - DNA, 25 bp, Homo sapien
gactttgccgacagaccattttaaa

SEQ ID NO: 66088 - DNA, 25 bp, Homo sapien
gactttgggcaagtttactccgagc

SEQ ID NO: 66089 - DNA, 25 bp, Homo sapien
gactttgggcaggtttactccgagc

SEQ ID NO: 66090 - DNA, 25 bp, Homo sapien
gactttggtcttcggcctcctgctt

SEQ ID NO: 66091 - DNA, 25 bp, Homo sapien
gactttggtctttggcctcctgctt

SEQ ID NO: 66092 - DNA, 25 bp, Homo sapien
gactttgtcacgattgtgttcactg

SEQ ID NO: 66093 - DNA, 25 bp, Homo sapien
gactttgtcacggttgtgttcactg

SEQ ID NO: 66094 - DNA, 25 bp, Homo sapien
gactttgttttccaatagaaatcat

SEQ ID NO: 66095 - DNA, 25 bp, Homo sapien
gactttgttttccagtagaaatcat

SEQ ID NO: 66096 - DNA, 25 bp, Homo sapien
gacttttgcaatgtgttgattcttt

SEQ ID NO: 66097 - DNA, 25 bp, Homo sapien
gacttttgccatgtgttgattcttt

SEQ ID NO: 66098 - DNA, 25 bp, Homo sapien
gactttttcagcaaaaccctaagac

SEQ ID NO: 66099 - DNA, 25 bp, Homo sapien
gactttttcagcgaaaccctaagac

SEQ ID NO: 66100 - DNA, 25 bp, Homo sapien
gagaaaaaagtgtgccttcacaata

SEQ ID NO: 66101 - DNA, 25 bp, Homo sapien
gagaaaaaagtgtggcttcacaata

SEQ ID NO: 66102 - DNA, 25 bp, Homo sapien
gagaaaaaccttcgatttatgtcca

SEQ ID NO: 66103 - DNA, 25 bp, Homo sapien
gagaaaaaccttggatttatgtcca

SEQ ID NO: 66104 - DNA, 25 bp, Homo sapien
gagaaaaaggctgtattcagtgcag

SEQ ID NO: 66105 - DNA, 25 bp, Homo sapien
gagaaaaaggctgttttcagtgcag

SEQ ID NO: 66106 - DNA, 25 bp, Homo sapien
gagaaaacactgtattggttaattt

SEQ ID NO: 66107 - DNA, 25 bp, Homo sapien
gagaaaacgctgtattggttaattt

SEQ ID NO: 66108 - DNA, 25 bp, Homo sapien
gagaaaaggctagaaaacctcttca

SEQ ID NO: 66109 - DNA, 25 bp, Homo sapien
gagaaaaggctggaaaacctcttca

SEQ ID NO: 66110 - DNA, 25 bp, Homo sapien
gagaaaagtatgcaaaacattaaac

SEQ ID NO: 66111 - DNA, 25 bp, Homo sapien
gagaaaagtgtgcaaaacattaaac

SEQ ID NO: 66112 - DNA, 25 bp, Homo sapien
gagaaaataaaacgttagggtgaat

SEQ ID NO: 66113 - DNA, 25 bp, Homo sapien
gagaaaataaaatgttagggtgaat

SEQ ID NO: 66114 - DNA, 25 bp, Homo sapien
gagaaaatactacaatggaaaaagt

SEQ ID NO: 66115 - DNA, 25 bp, Homo sapien
gagaaaatagtacaatggaaaaagt

SEQ ID NO: 66116 - DNA, 25 bp, Homo sapien
gagaaaatcttgatatgctaaatga

SEQ ID NO: 66117 - DNA, 25 bp, Homo sapien
gagaaaatcttggtatgctaaatga

SEQ ID NO: 66118 - DNA, 25 bp, Homo sapien
gagaaaatgctctaatctgaaagaa

SEQ ID NO: 66119 - DNA, 25 bp, Homo sapien
gagaaaatgctctaatttgaaagaa

SEQ ID NO: 66120 - DNA, 25 bp, Homo sapien
gagaaaattatgccggggaatgcct

SEQ ID NO: 66121 - DNA, 25 bp, Homo sapien
gagaaaattatgctggggaatgcct

SEQ ID NO: 66122 - DNA, 25 bp, Homo sapien
gagaaacaacgaagcaagcctacaa

SEQ ID NO: 66123 - DNA, 25 bp, Homo sapien
gagaaacaatcctaaactgctgaaa

SEQ ID NO: 66124 - DNA, 25 bp, Homo sapien
gagaaacaatcttaaactgctgaaa

SEQ ID NO: 66125 - DNA, 25 bp, Homo sapien
gagaaacaatgaagcaagcctacaa

SEQ ID NO: 66126 - DNA, 25 bp, Homo sapien
gagaaacatcacgcaggaaagtggg

SEQ ID NO: 66127 - DNA, 25 bp, Homo sapien
gagaaacatcacgcagtaaagtggg

SEQ ID NO: 66128 - DNA, 25 bp, Homo sapien
gagaaaccacaaattactggagcag

SEQ ID NO: 66129 - DNA, 25 bp, Homo sapien
gagaaaccacaacttactggagcag

SEQ ID NO: 66130 - DNA, 25 bp, Homo sapien
gagaaaccctgatagaaggaagaaa

SEQ ID NO: 66131 - DNA, 25 bp, Homo sapien
gagaaaccttgatagaaggaagaaa

SEQ ID NO: 66132 - DNA, 25 bp, Homo sapien
gagaaactataaaagcagtgtggca

SEQ ID NO: 66133 - DNA, 25 bp, Homo sapien
gagaaactctaaaagcagtgtggca

SEQ ID NO: 66134 - DNA, 25 bp, Homo sapien
gagaaactgaaagggcatgagtcgt

SEQ ID NO: 66135 - DNA, 25 bp, Homo sapien
gagaaactgacaatatctatgggta

SEQ ID NO: 66136 - DNA, 25 bp, Homo sapien
gagaaactgacagtatctatgggta

SEQ ID NO: 66137 - DNA, 25 bp, Homo sapien
gagaaactggaagggcatgagtcgt

SEQ ID NO: 66138 - DNA, 25 bp, Homo sapien
gagaaagacaggcccggagggagaa

SEQ ID NO: 66139 - DNA, 25 bp, Homo sapien
gagaaagacaggcctggagggagaa

SEQ ID NO: 66140 - DNA, 25 bp, Homo sapien
gagaaagagcatcaaatgtgctttg

SEQ ID NO: 66141 - DNA, 25 bp, Homo sapien
gagaaagagcatcagatgtgctttg

SEQ ID NO: 66142 - DNA, 25 bp, Homo sapien
gagaaagagtagcaaggcaatttag

SEQ ID NO: 66143 - DNA, 25 bp, Homo sapien
gagaaagagtagcgaggcaatttag

SEQ ID NO: 66144 - DNA, 25 bp, Homo sapien
gagaaagatttgaactacatataat

SEQ ID NO: 66145 - DNA, 25 bp, Homo sapien
gagaaagatttgaagtacatataat

SEQ ID NO: 66146 - DNA, 25 bp, Homo sapien
gagaaagcaagacacgaagagatca

SEQ ID NO: 66147 - DNA, 25 bp, Homo sapien
gagaaagcaagacatgaagagatca

SEQ ID NO: 66148 - DNA, 25 bp, Homo sapien
gagaaagcaatgtgacaacctcagc

SEQ ID NO: 66149 - DNA, 25 bp, Homo sapien
gagaaagcagtgtgacaacctcagc

SEQ ID NO: 66150 - DNA, 25 bp, Homo sapien
gagaaagcataggacaaggcccatt

SEQ ID NO: 66151 - DNA, 25 bp, Homo sapien
gagaaagcctgtcaatcctgctgtc

SEQ ID NO: 66152 - DNA, 25 bp, Homo sapien
gagaaagcgtaggacaaggcccatt

SEQ ID NO: 66153 - DNA, 25 bp, Homo sapien
gagaaagcttgtcaatcctgctgtc

SEQ ID NO: 66154 - DNA, 25 bp, Homo sapien
gagaaaggaaactagcaggagatga

SEQ ID NO: 66155 - DNA, 25 bp, Homo sapien
gagaaaggaaactggcaggagatga

SEQ ID NO: 66156 - DNA, 25 bp, Homo sapien
gagaaaggccatatacacacttaaa

SEQ ID NO: 66157 - DNA, 25 bp, Homo sapien
gagaaaggccatgctgcaccctctt

SEQ ID NO: 66158 - DNA, 25 bp, Homo sapien
gagaaaggccattctgcaccctctt

SEQ ID NO: 66159 - DNA, 25 bp, Homo sapien
gagaaaggtcatatacacacttaaa

SEQ ID NO: 66160 - DNA, 25 bp, Homo sapien
gagaaagtctgcatacatatagcct

SEQ ID NO: 66161 - DNA, 25 bp, Homo sapien
gagaaagtctgcgtacatatagcct

SEQ ID NO: 66162 - DNA, 25 bp, Homo sapien
gagaaataagaaccaggatgaaatg

SEQ ID NO: 66163 - DNA, 25 bp, Homo sapien
gagaaataccaaagtcctcaaagca

SEQ ID NO: 66164 - DNA, 25 bp, Homo sapien
gagaaataccaaggtcctcaaagca

SEQ ID NO: 66165 - DNA, 25 bp, Homo sapien
gagaaatagcttcaatacagtccag

SEQ ID NO: 66166 - DNA, 25 bp, Homo sapien
gagaaatagcttcagtacagtccag

SEQ ID NO: 66167 - DNA, 25 bp, Homo sapien
gagaaataggaaccaggatgaaatg

SEQ ID NO: 66168 - DNA, 25 bp, Homo sapien
gagaaatgatattcaccgccgactg

SEQ ID NO: 66169 - DNA, 25 bp, Homo sapien
gagaaatgatattcgccgccgactg

SEQ ID NO: 66170 - DNA, 25 bp, Homo sapien
gagaaatgcaaggagagtcggaaga

SEQ ID NO: 66171 - DNA, 25 bp, Homo sapien
gagaaatgccaggagagtcggaaga

SEQ ID NO: 66172 - DNA, 25 bp, Homo sapien
gagaaatgcttattgtaaattctaa

SEQ ID NO: 66173 - DNA, 25 bp, Homo sapien
gagaaatgcttattgttaattctaa

SEQ ID NO: 66174 - DNA, 25 bp, Homo sapien
gagaaatggcctctccgtgagctag

SEQ ID NO: 66175 - DNA, 25 bp, Homo sapien
gagaaatggtctctccgtgagctag

SEQ ID NO: 66176 - DNA, 25 bp, Homo sapien
gagaacaaaagacaggaataaaaaa

SEQ ID NO: 66177 - DNA, 25 bp, Homo sapien
gagaacaaacacaagtacaactaat

SEQ ID NO: 66178 - DNA, 25 bp, Homo sapien
gagaacaaacaccagtacaactaat

SEQ ID NO: 66179 - DNA, 25 bp, Homo sapien
gagaacaagacaaagtcctgctctc

SEQ ID NO: 66180 - DNA, 25 bp, Homo sapien
gagaacaagagacaggaataaaaaa

SEQ ID NO: 66181 - DNA, 25 bp, Homo sapien
gagaacaaggcaaagtcctgctctc

SEQ ID NO: 66182 - DNA, 25 bp, Homo sapien
gagaacaatccatctcatggagact

SEQ ID NO: 66183 - DNA, 25 bp, Homo sapien
gagaacaatccatttcatggagact

SEQ ID NO: 66184 - DNA, 25 bp, Homo sapien
gagaacacatgtgtctaatcttagc

SEQ ID NO: 66185 - DNA, 25 bp, Homo sapien
gagaacacatgtgtctgatcttagc

SEQ ID NO: 66186 - DNA, 25 bp, Homo sapien
gagaacagtatattatggaccccca

SEQ ID NO: 66187 - DNA, 25 bp, Homo sapien
gagaacagtgtattatggaccccca

SEQ ID NO: 66188 - DNA, 25 bp, Homo sapien
gagaacatgctgccactgagatgtt

SEQ ID NO: 66189 - DNA, 25 bp, Homo sapien
gagaacatgctgtcactgagatgtt

SEQ ID NO: 66190 - DNA, 25 bp, Homo sapien
gagaacatgtggtatttagcgtgta

SEQ ID NO: 66191 - DNA, 25 bp, Homo sapien
gagaacatgtgttatttagcgtgta

SEQ ID NO: 66192 - DNA, 25 bp, Homo sapien
gagaacattgacattaaagagaaaa

SEQ ID NO: 66193 - DNA, 25 bp, Homo sapien
gagaacattgatattaaagagaaaa

SEQ ID NO: 66194 - DNA, 25 bp, Homo sapien
gagaaccacagcactagagaaggcc

SEQ ID NO: 66195 - DNA, 25 bp, Homo sapien
gagaaccacggcactagagaaggcc

SEQ ID NO: 66196 - DNA, 25 bp, Homo sapien
gagaaccctgctccggtgggatttg

SEQ ID NO: 66197 - DNA, 25 bp, Homo sapien
gagaaccctgctctggtgggatttg

SEQ ID NO: 66198 - DNA, 25 bp, Homo sapien
gagaaccgtgtaggagactcctgca

SEQ ID NO: 66199 - DNA, 25 bp, Homo sapien
gagaaccgtgtgggagactcctgca

SEQ ID NO: 66200 - DNA, 25 bp, Homo sapien
gagaacctagaggaagatgctgttt

SEQ ID NO: 66201 - DNA, 25 bp, Homo sapien
gagaacctggaggaagatgctgttt

SEQ ID NO: 66202 - DNA, 25 bp, Homo sapien
gagaactccagcaaggtggattggt

SEQ ID NO: 66203 - DNA, 25 bp, Homo sapien
gagaactctagcaaggtggattggt

SEQ ID NO: 66204 - DNA, 25 bp, Homo sapien
gagaacttaagaaacttgtccaaga

SEQ ID NO: 66205 - DNA, 25 bp, Homo sapien
gagaacttaagaaatttgtccaaga

SEQ ID NO: 66206 - DNA, 25 bp, Homo sapien
gagaacttagtccgagtaaaggtca

SEQ ID NO: 66207 - DNA, 25 bp, Homo sapien
gagaacttagtctgagtaaaggtca

SEQ ID NO: 66208 - DNA, 25 bp, Homo sapien
gagaagaaaagagaaagaactgcta

SEQ ID NO: 66209 - DNA, 25 bp, Homo sapien
gagaagaaaggagaaagaactgcta

SEQ ID NO: 66210 - DNA, 25 bp, Homo sapien
gagaagaaagtaccaggacttaagg

SEQ ID NO: 66211 - DNA, 25 bp, Homo sapien
gagaagaaattaccaggacttaagg

SEQ ID NO: 66212 - DNA, 25 bp, Homo sapien
gagaagacaatatatacataaagac

SEQ ID NO: 66213 - DNA, 25 bp, Homo sapien
gagaagacagatctaattcccaaac

SEQ ID NO: 66214 - DNA, 25 bp, Homo sapien
gagaagacgatatatacataaagac

SEQ ID NO: 66215 - DNA, 25 bp, Homo sapien
gagaagacggatctaattcccaaac

SEQ ID NO: 66216 - DNA, 25 bp, Homo sapien
gagaagagacgcattggtaattgtg

SEQ ID NO: 66217 - DNA, 25 bp, Homo sapien
gagaagagacgcgttggtaattgtg

SEQ ID NO: 66218 - DNA, 25 bp, Homo sapien
gagaagagggtcggtttctcatatt

SEQ ID NO: 66219 - DNA, 25 bp, Homo sapien
gagaagagggttggtttctcatatt

SEQ ID NO: 66220 - DNA, 25 bp, Homo sapien
gagaagagtaattccaagacacgta

SEQ ID NO: 66221 - DNA, 25 bp, Homo sapien
gagaagagtgattccaagacacgta

SEQ ID NO: 66222 - DNA, 25 bp, Homo sapien
gagaagatattgaagccatggaggg

SEQ ID NO: 66223 - DNA, 25 bp, Homo sapien
gagaagatctcagcgcagctcctgc

SEQ ID NO: 66224 - DNA, 25 bp, Homo sapien
gagaagatctcagtgcagctcctgc

SEQ ID NO: 66225 - DNA, 25 bp, Homo sapien
gagaagatgaatatatacaaatcta

SEQ ID NO: 66226 - DNA, 25 bp, Homo sapien
gagaagatgaatgtatacaaatcta

SEQ ID NO: 66227 - DNA, 25 bp, Homo sapien
gagaagatgttgaagccatggaggg

SEQ ID NO: 66228 - DNA, 25 bp, Homo sapien
gagaagattcctcaggtgaaaaatt

SEQ ID NO: 66229 - DNA, 25 bp, Homo sapien
gagaagattcctcgggtgaaaaatt

SEQ ID NO: 66230 - DNA, 25 bp, Homo sapien
gagaagcaaaaccacgtcttacatg

SEQ ID NO: 66231 - DNA, 25 bp, Homo sapien
gagaagcaaaatcacgtcttacatg

SEQ ID NO: 66232 - DNA, 25 bp, Homo sapien
gagaagcaaacctgccatcttagaa

SEQ ID NO: 66233 - DNA, 25 bp, Homo sapien
gagaagcaaacgtgccatcttagaa

SEQ ID NO: 66234 - DNA, 25 bp, Homo sapien
gagaagcacaacagatgagcagaaa

SEQ ID NO: 66235 - DNA, 25 bp, Homo sapien
gagaagcacaatagatgagcagaaa

SEQ ID NO: 66236 - DNA, 25 bp, Homo sapien
gagaagctagaaaaataaaaccatc

SEQ ID NO: 66237 - DNA, 25 bp, Homo sapien
gagaagctagaaaagtaaaaccatc

SEQ ID NO: 66238 - DNA, 25 bp, Homo sapien
gagaagctaggtatgacaacagaga

SEQ ID NO: 66239 - DNA, 25 bp, Homo sapien
gagaagctaggtatgataacagaga

SEQ ID NO: 66240 - DNA, 25 bp, Homo sapien
gagaagctctcagtgtagggaacaa

SEQ ID NO: 66241 - DNA, 25 bp, Homo sapien
gagaagctctcagtttagggaacaa

SEQ ID NO: 66242 - DNA, 25 bp, Homo sapien
gagaagggaaccatcctgaattacc

SEQ ID NO: 66243 - DNA, 25 bp, Homo sapien
gagaagggaaccgtcctgaattacc

SEQ ID NO: 66244 - DNA, 25 bp, Homo sapien
gagaagggaggatcaatcgcttgag

SEQ ID NO: 66245 - DNA, 25 bp, Homo sapien
gagaagggaggatcgatcgcttgag

SEQ ID NO: 66246 - DNA, 25 bp, Homo sapien
gagaaggttctctgcagaacaaggc

SEQ ID NO: 66247 - DNA, 25 bp, Homo sapien
gagaaggttctctgtagaacaaggc

SEQ ID NO: 66248 - DNA, 25 bp, Homo sapien
gagaagtaagaaaatgacagagttg

SEQ ID NO: 66249 - DNA, 25 bp, Homo sapien
gagaagtaagaagatgacagagttg

SEQ ID NO: 66250 - DNA, 25 bp, Homo sapien
gagaagtcaatgcttagctttgaag

SEQ ID NO: 66251 - DNA, 25 bp, Homo sapien
gagaagtcaatgtgaaaaaggagga

SEQ ID NO: 66252 - DNA, 25 bp, Homo sapien
gagaagtcactgtgaaaaaggagga

SEQ ID NO: 66253 - DNA, 25 bp, Homo sapien
gagaagtcgatgcttagctttgaag

SEQ ID NO: 66254 - DNA, 25 bp, Homo sapien
gagaagtgaaccgatgttctgtttc

SEQ ID NO: 66255 - DNA, 25 bp, Homo sapien
gagaagtgaactgatgttctgtttc

SEQ ID NO: 66256 - DNA, 25 bp, Homo sapien
gagaagttctggctctgagatcaga

SEQ ID NO: 66257 - DNA, 25 bp, Homo sapien
gagaagtttatatatctgtctccaa

SEQ ID NO: 66258 - DNA, 25 bp, Homo sapien
gagaagtttgtatatctgtctccaa

SEQ ID NO: 66259 - DNA, 25 bp, Homo sapien
gagaagttttggctctgagatcaga

SEQ ID NO: 66260 - DNA, 25 bp, Homo sapien
gagaataaactcagaaaagaatcaa

SEQ ID NO: 66261 - DNA, 25 bp, Homo sapien
gagaataaactcagaagagaatcaa

SEQ ID NO: 66262 - DNA, 25 bp, Homo sapien
gagaataacaagtggacaagtaaaa

SEQ ID NO: 66263 - DNA, 25 bp, Homo sapien
gagaataacgaaagagaagtaactg

SEQ ID NO: 66264 - DNA, 25 bp, Homo sapien
gagaataagaagtggacaagtaaaa

SEQ ID NO: 66265 - DNA, 25 bp, Homo sapien
gagaataatgaaagagaagtaactg

SEQ ID NO: 66266 - DNA, 25 bp, Homo sapien
gagaataattatcacaaaaatgcct

SEQ ID NO: 66267 - DNA, 25 bp, Homo sapien
gagaataattatgacaaaaatgcct

SEQ ID NO: 66268 - DNA, 25 bp, Homo sapien
gagaatactctccatccatagccat

SEQ ID NO: 66269 - DNA, 25 bp, Homo sapien
gagaatactctctatccatagccat

SEQ ID NO: 66270 - DNA, 25 bp, Homo sapien
gagaatagaatagtggttatcagag

SEQ ID NO: 66271 - DNA, 25 bp, Homo sapien
gagaatagaatggtggttatcagag

SEQ ID NO: 66272 - DNA, 25 bp, Homo sapien
gagaatagatctaacactggactgc

SEQ ID NO: 66273 - DNA, 25 bp, Homo sapien
gagaatagatctaacattggactgc

SEQ ID NO: 66274 - DNA, 25 bp, Homo sapien
gagaatatactcacaggctccaggg

SEQ ID NO: 66275 - DNA, 25 bp, Homo sapien
gagaatatactcacgggctccaggg

SEQ ID NO: 66276 - DNA, 25 bp, Homo sapien
gagaatatgtgacggatcatcttct

SEQ ID NO: 66277 - DNA, 25 bp, Homo sapien
gagaatatgtgatggatcatcttct

SEQ ID NO: 66278 - DNA, 25 bp, Homo sapien
gagaatcaatgtattccttttgatt

SEQ ID NO: 66279 - DNA, 25 bp, Homo sapien
gagaatcagtgtattccttttgatt

SEQ ID NO: 66280 - DNA, 25 bp, Homo sapien
gagaatccagtatcggtggcccact

SEQ ID NO: 66281 - DNA, 25 bp, Homo sapien
gagaatccagtattggtggcccact

SEQ ID NO: 66282 - DNA, 25 bp, Homo sapien
gagaatctcatttcttgactaagca

SEQ ID NO: 66283 - DNA, 25 bp, Homo sapien
gagaatctcgtttcttgactaagca

SEQ ID NO: 66284 - DNA, 25 bp, Homo sapien
gagaatctgttcgatgcctctccta

SEQ ID NO: 66285 - DNA, 25 bp, Homo sapien
gagaatctgtttgatgcctctccta

SEQ ID NO: 66286 - DNA, 25 bp, Homo sapien
gagaatcttgaggcctaattacttt

SEQ ID NO: 66287 - DNA, 25 bp, Homo sapien
gagaatcttgaggcctgattacttt

SEQ ID NO: 66288 - DNA, 25 bp, Homo sapien
gagaatgaaagaggtacgtcaaaga

SEQ ID NO: 66289 - DNA, 25 bp, Homo sapien
gagaatgaaagaggtatgtcaaaga

SEQ ID NO: 66290 - DNA, 25 bp, Homo sapien
gagaatgaaggagttaggttggagg

SEQ ID NO: 66291 - DNA, 25 bp, Homo sapien
gagaatgagggagttaggttggagg

SEQ ID NO: 66292 - DNA, 25 bp, Homo sapien
gagaatgattgaatcggctaaatat

SEQ ID NO: 66293 - DNA, 25 bp, Homo sapien
gagaatgattgaattggctaaatat

SEQ ID NO: 66294 - DNA, 25 bp, Homo sapien
gagaatggatgtcgagtttatccca

SEQ ID NO: 66295 - DNA, 25 bp, Homo sapien
gagaatggatgttgagtttatccca

SEQ ID NO: 66296 - DNA, 25 bp, Homo sapien
gagaatggtgtcatggcttgtatca

SEQ ID NO: 66297 - DNA, 25 bp, Homo sapien
gagaatggtttcatggcttgtatca

SEQ ID NO: 66298 - DNA, 25 bp, Homo sapien
gagaatgtcgtggatctggcattcc

SEQ ID NO: 66299 - DNA, 25 bp, Homo sapien
gagaatgtggtcacaatcaatagga

SEQ ID NO: 66300 - DNA, 25 bp, Homo sapien
gagaatgtggtcgcaatcaatagga

SEQ ID NO: 66301 - DNA, 25 bp, Homo sapien
gagaatgttgtggatctggcattcc

SEQ ID NO: 66302 - DNA, 25 bp, Homo sapien
gagaattacatcatctgcttctctc

SEQ ID NO: 66303 - DNA, 25 bp, Homo sapien
gagaattacttcatctgcttctctc

SEQ ID NO: 66304 - DNA, 25 bp, Homo sapien
gagaattagatagaccacctctatc

SEQ ID NO: 66305 - DNA, 25 bp, Homo sapien
gagaattatatagaccacctctatc

SEQ ID NO: 66306 - DNA, 25 bp, Homo sapien
gagaattcactatgatcttctattc

SEQ ID NO: 66307 - DNA, 25 bp, Homo sapien
gagaattcactgtgatcttctattc

SEQ ID NO: 66308 - DNA, 25 bp, Homo sapien
gagaattctactctatcgactatat

SEQ ID NO: 66309 - DNA, 25 bp, Homo sapien
gagaattctactctattgactatat

SEQ ID NO: 66310 - DNA, 25 bp, Homo sapien
gagaatttgtcacaaacaaacagca

SEQ ID NO: 66311 - DNA, 25 bp, Homo sapien
gagaatttgtcagaaacaaacagca

SEQ ID NO: 66312 - DNA, 25 bp, Homo sapien
gagaatttgttggctcatataatgg

SEQ ID NO: 66313 - DNA, 25 bp, Homo sapien
gagaatttgttggttcatataatgg

SEQ ID NO: 66314 - DNA, 25 bp, Homo sapien
gagaattttctcgggtgatagaaat

SEQ ID NO: 66315 - DNA, 25 bp, Homo sapien
gagaattttcttgggtgatagaaat

SEQ ID NO: 66316 - DNA, 25 bp, Homo sapien
gagacaaaggagaaaggtccttgat

SEQ ID NO: 66317 - DNA, 25 bp, Homo sapien
gagacaaaggagataggtccttgat

SEQ ID NO: 66318 - DNA, 25 bp, Homo sapien
gagacaaatttaagtattagttggc

SEQ ID NO: 66319 - DNA, 25 bp, Homo sapien
gagacaaatttacgtattagttggc

SEQ ID NO: 66320 - DNA, 25 bp, Homo sapien
gagacaacaaggcctatagtaaaaa

SEQ ID NO: 66321 - DNA, 25 bp, Homo sapien
gagacaactaggcctatagtaaaaa

SEQ ID NO: 66322 - DNA, 25 bp, Homo sapien
gagacaagggttagagactattgag

SEQ ID NO: 66323 - DNA, 25 bp, Homo sapien
gagacaaggtttagagactattgag

SEQ ID NO: 66324 - DNA, 25 bp, Homo sapien
gagacaagtcgccaaaaattctagg

SEQ ID NO: 66325 - DNA, 25 bp, Homo sapien
gagacaagtcgcccaaaattctagg

SEQ ID NO: 66326 - DNA, 25 bp, Homo sapien
gagacactcttactaccatactcaa

SEQ ID NO: 66327 - DNA, 25 bp, Homo sapien
gagacactcttagtaccatactcaa

SEQ ID NO: 66328 - DNA, 25 bp, Homo sapien
gagacagacagagagttaatccagg

SEQ ID NO: 66329 - DNA, 25 bp, Homo sapien
gagacagacagagatttaatccagg

SEQ ID NO: 66330 - DNA, 25 bp, Homo sapien
gagacagacggaacaaaagcccaca

SEQ ID NO: 66331 - DNA, 25 bp, Homo sapien
gagacagacggaacgaaagcccaca

SEQ ID NO: 66332 - DNA, 25 bp, Homo sapien
gagacagacttgccctactctctgt

SEQ ID NO: 66333 - DNA, 25 bp, Homo sapien
gagacagagtgtgacacttcataag

SEQ ID NO: 66334 - DNA, 25 bp, Homo sapien
gagacagagtgtgacagttcataag

SEQ ID NO: 66335 - DNA, 25 bp, Homo sapien
gagacagatttgccctactctctgt

SEQ ID NO: 66336 - DNA, 25 bp, Homo sapien
gagacaggaaacaatacagtccaac

SEQ ID NO: 66337 - DNA, 25 bp, Homo sapien
gagacaggagacaatacagtccaac

SEQ ID NO: 66338 - DNA, 25 bp, Homo sapien
gagacaggtgcatatctgattgcct

SEQ ID NO: 66339 - DNA, 25 bp, Homo sapien
gagacaggtgcgtatctgattgcct

SEQ ID NO: 66340 - DNA, 25 bp, Homo sapien
gagacagtgccacgtaaagttcttt

SEQ ID NO: 66341 - DNA, 25 bp, Homo sapien
gagacagtgccatgtaaagttcttt

SEQ ID NO: 66342 - DNA, 25 bp, Homo sapien
gagacagttaacaaatccactatta

SEQ ID NO: 66343 - DNA, 25 bp, Homo sapien
gagacagttcccagctacattgtat

SEQ ID NO: 66344 - DNA, 25 bp, Homo sapien
gagacagttcctagctacattgtat

SEQ ID NO: 66345 - DNA, 25 bp, Homo sapien
gagacagttgacaaatccactatta

SEQ ID NO: 66346 - DNA, 25 bp, Homo sapien
gagacatcacaggaggaaaacgcag

SEQ ID NO: 66347 - DNA, 25 bp, Homo sapien
gagacatctcaggaggaaaacgcag

SEQ ID NO: 66348 - DNA, 25 bp, Homo sapien
gagacatgaatggactgtactccct

SEQ ID NO: 66349 - DNA, 25 bp, Homo sapien
gagacatgacagagatctggtgaat

SEQ ID NO: 66350 - DNA, 25 bp, Homo sapien
gagacatgagtggactgtactccct

SEQ ID NO: 66351 - DNA, 25 bp, Homo sapien
gagacatgatagagatctggtgaat

SEQ ID NO: 66352 - DNA, 25 bp, Homo sapien
gagacatttgcttcaccttctgttt

SEQ ID NO: 66353 - DNA, 25 bp, Homo sapien
gagacatttgcttcgccttctgttt

SEQ ID NO: 66354 - DNA, 25 bp, Homo sapien
gagaccacaggtcataagaaaaagt

SEQ ID NO: 66355 - DNA, 25 bp, Homo sapien
gagaccacaggttataagaaaaagt

SEQ ID NO: 66356 - DNA, 25 bp, Homo sapien
gagaccagtacaggagtgaacagat

SEQ ID NO: 66357 - DNA, 25 bp, Homo sapien
gagaccagtacagtagtgaacagat

SEQ ID NO: 66358 - DNA, 25 bp, Homo sapien
gagaccatctgagcacaagtgatgg

SEQ ID NO: 66359 - DNA, 25 bp, Homo sapien
gagaccatctgagtacaagtgatgg

SEQ ID NO: 66360 - DNA, 25 bp, Homo sapien
gagaccattcactttcctttaattc

SEQ ID NO: 66361 - DNA, 25 bp, Homo sapien
gagaccattcattttcctttaattc

SEQ ID NO: 66362 - DNA, 25 bp, Homo sapien
gagacccagggaaccactgatgctg

SEQ ID NO: 66363 - DNA, 25 bp, Homo sapien
gagacccagggaaccattgatgctg

SEQ ID NO: 66364 - DNA, 25 bp, Homo sapien
gagaccgcataatcaaggaactgat

SEQ ID NO: 66365 - DNA, 25 bp, Homo sapien
gagaccgcgtaatcaaggaactgat

SEQ ID NO: 66366 - DNA, 25 bp, Homo sapien
gagacctggttagtcttcttgttct

SEQ ID NO: 66367 - DNA, 25 bp, Homo sapien
gagacctggttagtgttcttgttct

SEQ ID NO: 66368 - DNA, 25 bp, Homo sapien
gagacgaaaattctaagaaagaacc

SEQ ID NO: 66369 - DNA, 25 bp, Homo sapien
gagacgaacattctaagaaagaacc

SEQ ID NO: 66370 - DNA, 25 bp, Homo sapien
gagacgaaggttttggcttctgagt

SEQ ID NO: 66371 - DNA, 25 bp, Homo sapien
gagacgaaggttttgggttctgagt

SEQ ID NO: 66372 - DNA, 25 bp, Homo sapien
gagacgttctttttttcggttatct

SEQ ID NO: 66373 - DNA, 25 bp, Homo sapien
gagacgttcttttttttggttatct

SEQ ID NO: 66374 - DNA, 25 bp, Homo sapien
gagactaagtggatagaaaagacat

SEQ ID NO: 66375 - DNA, 25 bp, Homo sapien
gagactaagtggttagaaaagacat

SEQ ID NO: 66376 - DNA, 25 bp, Homo sapien
gagactacaaacaatccagcctcta

SEQ ID NO: 66377 - DNA, 25 bp, Homo sapien
gagactacacacaatccagcctcta

SEQ ID NO: 66378 - DNA, 25 bp, Homo sapien
gagactacgtggacagcaaatctag

SEQ ID NO: 66379 - DNA, 25 bp, Homo sapien
gagactacgtgggcagcaaatctag

SEQ ID NO: 66380 - DNA, 25 bp, Homo sapien
gagactagctgatacagttaagcct

SEQ ID NO: 66381 - DNA, 25 bp, Homo sapien
gagactagctggtacagttaagcct

SEQ ID NO: 66382 - DNA, 25 bp, Homo sapien
gagactatgatttacgaaattcaca

SEQ ID NO: 66383 - DNA, 25 bp, Homo sapien
gagactatgatttatgaaattcaca

SEQ ID NO: 66384 - DNA, 25 bp, Homo sapien
gagactcaaaggcctggggtatctc

SEQ ID NO: 66385 - DNA, 25 bp, Homo sapien
gagactcaaaggcttggggtatctc

SEQ ID NO: 66386 - DNA, 25 bp, Homo sapien
gagactccaagaactgtcatctacg

SEQ ID NO: 66387 - DNA, 25 bp, Homo sapien
gagactccatgaactgtcatctacg

SEQ ID NO: 66388 - DNA, 25 bp, Homo sapien
gagactctgcctcattgaggatatt

SEQ ID NO: 66389 - DNA, 25 bp, Homo sapien
gagactctgcctcgttgaggatatt

SEQ ID NO: 66390 - DNA, 25 bp, Homo sapien
gagactctgtacgataccataatgg

SEQ ID NO: 66391 - DNA, 25 bp, Homo sapien
gagactctgtacgatatcataatgg

SEQ ID NO: 66392 - DNA, 25 bp, Homo sapien
gagactgaaaataatcatcatctcc

SEQ ID NO: 66393 - DNA, 25 bp, Homo sapien
gagactgaaaatagtcatcatctcc

SEQ ID NO: 66394 - DNA, 25 bp, Homo sapien
gagactgagatcaacgctttattta

SEQ ID NO: 66395 - DNA, 25 bp, Homo sapien
gagactgagatcaatgctttattta

SEQ ID NO: 66396 - DNA, 25 bp, Homo sapien
gagactgcagttggaggatgacttg

SEQ ID NO: 66397 - DNA, 25 bp, Homo sapien
gagactgccgcttttccctttacct

SEQ ID NO: 66398 - DNA, 25 bp, Homo sapien
gagactgcggttggaggatgacttg

SEQ ID NO: 66399 - DNA, 25 bp, Homo sapien
gagactgctgcttttccctttacct

SEQ ID NO: 66400 - DNA, 25 bp, Homo sapien
gagactggagacgaggtacagtttt

SEQ ID NO: 66401 - DNA, 25 bp, Homo sapien
gagactggagatgaggtacagtttt

SEQ ID NO: 66402 - DNA, 25 bp, Homo sapien
gagactggcaacactgagcttttgt

SEQ ID NO: 66403 - DNA, 25 bp, Homo sapien
gagactggcaacattgagcttttgt

SEQ ID NO: 66404 - DNA, 25 bp, Homo sapien
gagactggctcccactatgtaaagg

SEQ ID NO: 66405 - DNA, 25 bp, Homo sapien
gagactggctcccgctatgtaaagg

SEQ ID NO: 66406 - DNA, 25 bp, Homo sapien
gagactgggatacaaaaaacaatga

SEQ ID NO: 66407 - DNA, 25 bp, Homo sapien
gagactgggatacagaaaacaatga

SEQ ID NO: 66408 - DNA, 25 bp, Homo sapien
gagactgtcttcctatacattttca

SEQ ID NO: 66409 - DNA, 25 bp, Homo sapien
gagactgtcttcctattcattttca

SEQ ID NO: 66410 - DNA, 25 bp, Homo sapien
gagactgtgtacattgaacttctga

SEQ ID NO: 66411 - DNA, 25 bp, Homo sapien
gagactgtgtacgttgaacttctga

SEQ ID NO: 66412 - DNA, 25 bp, Homo sapien
gagactgtgttgaaagtaatgaaaa

SEQ ID NO: 66413 - DNA, 25 bp, Homo sapien
gagactgtgttgaacgtaatgaaaa

SEQ ID NO: 66414 - DNA, 25 bp, Homo sapien
gagacttagccataaattatttacc

SEQ ID NO: 66415 - DNA, 25 bp, Homo sapien
gagacttagccgtaaattatttacc

SEQ ID NO: 66416 - DNA, 25 bp, Homo sapien
gagacttaggcattcgttcttatca

SEQ ID NO: 66417 - DNA, 25 bp, Homo sapien
gagacttaggcatttgttcttatca

SEQ ID NO: 66418 - DNA, 25 bp, Homo sapien
gagacttgaactgacaaataagcat

SEQ ID NO: 66419 - DNA, 25 bp, Homo sapien
gagacttgaactgacagataagcat

SEQ ID NO: 66420 - DNA, 25 bp, Homo sapien
gagactttggagtgtggactgttcg

SEQ ID NO: 66421 - DNA, 25 bp, Homo sapien
gagactttggagtgtgtactgttcg

SEQ ID NO: 66422 - DNA, 25 bp, Homo sapien
gagagaaaaatcattactatcttca

SEQ ID NO: 66423 - DNA, 25 bp, Homo sapien
gagagaaaaatccttactatcttca

SEQ ID NO: 66424 - DNA, 25 bp, Homo sapien
gagagaaaaattatgtttcaaaaac

SEQ ID NO: 66425 - DNA, 25 bp, Homo sapien
gagagaaaaggctagaaaacctctt

SEQ ID NO: 66426 - DNA, 25 bp, Homo sapien
gagagaaaaggctggaaaacctctt

SEQ ID NO: 66427 - DNA, 25 bp, Homo sapien
gagagaaaagtgaataatgactgac

SEQ ID NO: 66428 - DNA, 25 bp, Homo sapien
gagagaaaagtgactaatgactgac

SEQ ID NO: 66429 - DNA, 25 bp, Homo sapien
gagagaaaataaagagttatatcag

SEQ ID NO: 66430 - DNA, 25 bp, Homo sapien
gagagaaaataacgagttatatcag

SEQ ID NO: 66431 - DNA, 25 bp, Homo sapien
gagagaaatattatgtttcaaaaac

SEQ ID NO: 66432 - DNA, 25 bp, Homo sapien
gagagaacatgctgccactgagatg

SEQ ID NO: 66433 - DNA, 25 bp, Homo sapien
gagagaacatgctgtcactgagatg

SEQ ID NO: 66434 - DNA, 25 bp, Homo sapien
gagagaaccgtgtaggagactcctg

SEQ ID NO: 66435 - DNA, 25 bp, Homo sapien
gagagaaccgtgtgggagactcctg

SEQ ID NO: 66436 - DNA, 25 bp, Homo sapien
gagagaacttccgactgaaagctag

SEQ ID NO: 66437 - DNA, 25 bp, Homo sapien
gagagaacttctgactgaaagctag

SEQ ID NO: 66438 - DNA, 25 bp, Homo sapien
gagagaagaacaagaaagtgaattt

SEQ ID NO: 66439 - DNA, 25 bp, Homo sapien
gagagaagaacaggaaagtgaattt

SEQ ID NO: 66440 - DNA, 25 bp, Homo sapien
gagagaagacacactctttggatag

SEQ ID NO: 66441 - DNA, 25 bp, Homo sapien
gagagaagacacgctctttggatag

SEQ ID NO: 66442 - DNA, 25 bp, Homo sapien
gagagaaggacaacaagtagtgtga

SEQ ID NO: 66443 - DNA, 25 bp, Homo sapien
gagagaaggacaagaagtagtgtga

SEQ ID NO: 66444 - DNA, 25 bp, Homo sapien
gagagaataacagttttcattcttc

SEQ ID NO: 66445 - DNA, 25 bp, Homo sapien
gagagaataacatttttcattcttc

SEQ ID NO: 66446 - DNA, 25 bp, Homo sapien
gagagacaactgcatcctaagtact

SEQ ID NO: 66447 - DNA, 25 bp, Homo sapien
gagagacaactggatcctaagtact

SEQ ID NO: 66448 - DNA, 25 bp, Homo sapien
gagagacacattgagctagagatgc

SEQ ID NO: 66449 - DNA, 25 bp, Homo sapien
gagagacatattgagctagagatgc

SEQ ID NO: 66450 - DNA, 25 bp, Homo sapien
gagagactatgatttacgaaattca

SEQ ID NO: 66451 - DNA, 25 bp, Homo sapien
gagagactatgatttatgaaattca

SEQ ID NO: 66452 - DNA, 25 bp, Homo sapien
gagagagaactccagcaaggtggat

SEQ ID NO: 66453 - DNA, 25 bp, Homo sapien
gagagagaactctagcaaggtggat

SEQ ID NO: 66454 - DNA, 25 bp, Homo sapien
gagagagaatcgccttgtctgccgg

SEQ ID NO: 66455 - DNA, 25 bp, Homo sapien
gagagagaccatacaacttttggca

SEQ ID NO: 66456 - DNA, 25 bp, Homo sapien
gagagagactatacaacttttggca

SEQ ID NO: 66457 - DNA, 25 bp, Homo sapien
gagagagatattcacatttaattac

SEQ ID NO: 66458 - DNA, 25 bp, Homo sapien
gagagagatattgacatttaattac

SEQ ID NO: 66459 - DNA, 25 bp, Homo sapien
gagagagatcaagataaaacgaaaa

SEQ ID NO: 66460 - DNA, 25 bp, Homo sapien
gagagagatcaaggtaaaacgaaaa

SEQ ID NO: 66461 - DNA, 25 bp, Homo sapien
gagagagattcgccttgtctgccgg

SEQ ID NO: 66462 - DNA, 25 bp, Homo sapien
gagagagcaaacgttcaatattcta

SEQ ID NO: 66463 - DNA, 25 bp, Homo sapien
gagagagcaaatgttcaatattcta

SEQ ID NO: 66464 - DNA, 25 bp, Homo sapien
gagagagccagaaggctagcatggt

SEQ ID NO: 66465 - DNA, 25 bp, Homo sapien
gagagagccagagggctagcatggt

SEQ ID NO: 66466 - DNA, 25 bp, Homo sapien
gagagagccttattctgtggcaggg

SEQ ID NO: 66467 - DNA, 25 bp, Homo sapien
gagagagccttattttgtggcaggg

SEQ ID NO: 66468 - DNA, 25 bp, Homo sapien
gagagaggagctcagggcttggcag

SEQ ID NO: 66469 - DNA, 25 bp, Homo sapien
gagagaggagctcatggcttggcag

SEQ ID NO: 66470 - DNA, 25 bp, Homo sapien
gagagagtaaagcaaaaagtagagg

SEQ ID NO: 66471 - DNA, 25 bp, Homo sapien
gagagagtaaagcaaagagtagagg

SEQ ID NO: 66472 - DNA, 25 bp, Homo sapien
gagagagtgactacgtcaggcagca

SEQ ID NO: 66473 - DNA, 25 bp, Homo sapien
gagagagtgactatgtcaggcagca

SEQ ID NO: 66474 - DNA, 25 bp, Homo sapien
gagagatatttaccaaagggattct

SEQ ID NO: 66475 - DNA, 25 bp, Homo sapien
gagagatatttaccgaagggattct

SEQ ID NO: 66476 - DNA, 25 bp, Homo sapien
gagagatctcggttgtgaaggttga

SEQ ID NO: 66477 - DNA, 25 bp, Homo sapien
gagagatctgggttgtgaaggttga

SEQ ID NO: 66478 - DNA, 25 bp, Homo sapien
gagagatgctggttttaagtctgaa

SEQ ID NO: 66479 - DNA, 25 bp, Homo sapien
gagagatgttggttttaagtctgaa

SEQ ID NO: 66480 - DNA, 25 bp, Homo sapien
gagagatttgaagcttcttttgttc

SEQ ID NO: 66481 - DNA, 25 bp, Homo sapien
gagagatttgaagcttgttttgttc

SEQ ID NO: 66482 - DNA, 25 bp, Homo sapien
gagagattttattggaaaggaaaga

SEQ ID NO: 66483 - DNA, 25 bp, Homo sapien
gagagattttattggagaggaaaga

SEQ ID NO: 66484 - DNA, 25 bp, Homo sapien
gagagattttgaacagaactgacct

SEQ ID NO: 66485 - DNA, 25 bp, Homo sapien
gagagattttgaacagcactgacct

SEQ ID NO: 66486 - DNA, 25 bp, Homo sapien
gagagatttttatgcgtggattctt

SEQ ID NO: 66487 - DNA, 25 bp, Homo sapien
gagagatttttatgtgtggattctt

SEQ ID NO: 66488 - DNA, 25 bp, Homo sapien
gagagcaaacgttcaatattctata

SEQ ID NO: 66489 - DNA, 25 bp, Homo sapien
gagagcaaatgttcaatattctata

SEQ ID NO: 66490 - DNA, 25 bp, Homo sapien
gagagcacccaaatgttatattgtt

SEQ ID NO: 66491 - DNA, 25 bp, Homo sapien
gagagcacccaagtgttatattgtt

SEQ ID NO: 66492 - DNA, 25 bp, Homo sapien
gagagcagaatacagactaaaatcc

SEQ ID NO: 66493 - DNA, 25 bp, Homo sapien
gagagcagaatacagattaaaatcc

SEQ ID NO: 66494 - DNA, 25 bp, Homo sapien
gagagcagattcattttcagaccag

SEQ ID NO: 66495 - DNA, 25 bp, Homo sapien
gagagcagattcgttttcagaccag

SEQ ID NO: 66496 - DNA, 25 bp, Homo sapien
gagagcagcattagccagacctttg

SEQ ID NO: 66497 - DNA, 25 bp, Homo sapien
gagagcagcgttagccagacctttg

SEQ ID NO: 66498 - DNA, 25 bp, Homo sapien
gagagccagtgcgttacatggccag

SEQ ID NO: 66499 - DNA, 25 bp, Homo sapien
gagagccagtgcgttatatggccag

SEQ ID NO: 66500 - DNA, 25 bp, Homo sapien
gagagcctgtataaaatggctgttc

SEQ ID NO: 66501 - DNA, 25 bp, Homo sapien
gagagcctgtatacaatggctgttc

SEQ ID NO: 66502 - DNA, 25 bp, Homo sapien
gagagccttattctgtggcagggcg

SEQ ID NO: 66503 - DNA, 25 bp, Homo sapien
gagagccttattttgtggcagggcg

SEQ ID NO: 66504 - DNA, 25 bp, Homo sapien
gagagctactagagacattgctggc

SEQ ID NO: 66505 - DNA, 25 bp, Homo sapien
gagagctactagagacgttgctggc

SEQ ID NO: 66506 - DNA, 25 bp, Homo sapien
gagagctcagagaagcacgtgtgac

SEQ ID NO: 66507 - DNA, 25 bp, Homo sapien
gagagctcagagaggcacgtgtgac

SEQ ID NO: 66508 - DNA, 25 bp, Homo sapien
gagagctgcttcagaactgtgtgtc

SEQ ID NO: 66509 - DNA, 25 bp, Homo sapien
gagagctgcttgagaactgtgtgtc

SEQ ID NO: 66510 - DNA, 25 bp, Homo sapien
gagagcttacggctccaaagccaag

SEQ ID NO: 66511 - DNA, 25 bp, Homo sapien
gagagcttacggcttcaaagccaag

SEQ ID NO: 66512 - DNA, 25 bp, Homo sapien
gagagcttatctactgaatgacctc

SEQ ID NO: 66513 - DNA, 25 bp, Homo sapien
gagagcttatctattgaatgacctc

SEQ ID NO: 66514 - DNA, 25 bp, Homo sapien
gagaggaaaacggacctctatgggc

SEQ ID NO: 66515 - DNA, 25 bp, Homo sapien
gagaggaaaacggatctctatgggc

SEQ ID NO: 66516 - DNA, 25 bp, Homo sapien
gagaggaaaatacgtttggagagtg

SEQ ID NO: 66517 - DNA, 25 bp, Homo sapien
gagaggaaaataggcagcatcattt

SEQ ID NO: 66518 - DNA, 25 bp, Homo sapien
gagaggaaaataggtttggagagtg

SEQ ID NO: 66519 - DNA, 25 bp, Homo sapien
gagaggaaaatgggcagcatcattt

SEQ ID NO: 66520 - DNA, 25 bp, Homo sapien
gagaggaaacctggcatgagctggg

SEQ ID NO: 66521 - DNA, 25 bp, Homo sapien
gagaggaaagctggcatgagctggg

SEQ ID NO: 66522 - DNA, 25 bp, Homo sapien
gagaggacaataagtacaggcactg

SEQ ID NO: 66523 - DNA, 25 bp, Homo sapien
gagaggacagtaagtacaggcactg

SEQ ID NO: 66524 - DNA, 25 bp, Homo sapien
gagaggagacggcgcaggatcactc

SEQ ID NO: 66525 - DNA, 25 bp, Homo sapien
gagaggagatggcgcaggatcactc

SEQ ID NO: 66526 - DNA, 25 bp, Homo sapien
gagaggagcagacggcttcttgttt

SEQ ID NO: 66527 - DNA, 25 bp, Homo sapien
gagaggagcagatggcttcttgttt

SEQ ID NO: 66528 - DNA, 25 bp, Homo sapien
gagaggagctcagggcttggcagca

SEQ ID NO: 66529 - DNA, 25 bp, Homo sapien
gagaggagctcatggcttggcagca

SEQ ID NO: 66530 - DNA, 25 bp, Homo sapien
gagaggaggcacattgtactcactg

SEQ ID NO: 66531 - DNA, 25 bp, Homo sapien
gagaggaggcatattgtactcactg

SEQ ID NO: 66532 - DNA, 25 bp, Homo sapien
gagaggatgaaggtagccttgttga

SEQ ID NO: 66533 - DNA, 25 bp, Homo sapien
gagaggatgaagttagccttgttga

SEQ ID NO: 66534 - DNA, 25 bp, Homo sapien
gagaggctcacatcaagtggaagtc

SEQ ID NO: 66535 - DNA, 25 bp, Homo sapien
gagaggctcacgtcaagtggaagtc

SEQ ID NO: 66536 - DNA, 25 bp, Homo sapien
gagagggagtcccgggtgcgagaac

SEQ ID NO: 66537 - DNA, 25 bp, Homo sapien
gagagggagtccggggtgcgagaac

SEQ ID NO: 66538 - DNA, 25 bp, Homo sapien
gagaggtaaaaacgagccactcttc

SEQ ID NO: 66539 - DNA, 25 bp, Homo sapien
gagaggtaaaaatgagccactcttc

SEQ ID NO: 66540 - DNA, 25 bp, Homo sapien
gagaggtcatccttgtttctggcac

SEQ ID NO: 66541 - DNA, 25 bp, Homo sapien
gagaggtcgtccttgtttctggcac

SEQ ID NO: 66542 - DNA, 25 bp, Homo sapien
gagaggtcttgaggatatctagaaa

SEQ ID NO: 66543 - DNA, 25 bp, Homo sapien
gagaggtcttgcggatatctagaaa

SEQ ID NO: 66544 - DNA, 25 bp, Homo sapien
gagaggtgacgaggaatactctgaa

SEQ ID NO: 66545 - DNA, 25 bp, Homo sapien
gagaggtgatgaggaatactctgaa

SEQ ID NO: 66546 - DNA, 25 bp, Homo sapien
gagaggtgccgtgtgtatataggct

SEQ ID NO: 66547 - DNA, 25 bp, Homo sapien
gagaggtgcgatcatagcccagcaa

SEQ ID NO: 66548 - DNA, 25 bp, Homo sapien
gagaggtgctgtgtgtatataggct

SEQ ID NO: 66549 - DNA, 25 bp, Homo sapien
gagaggtggtataacatctagttag

SEQ ID NO: 66550 - DNA, 25 bp, Homo sapien
gagaggtggtataatatctagttag

SEQ ID NO: 66551 - DNA, 25 bp, Homo sapien
gagaggtgtgatcatagcccagcaa

SEQ ID NO: 66552 - DNA, 25 bp, Homo sapien
gagaggttcgtctgagaaaactcaa

SEQ ID NO: 66553 - DNA, 25 bp, Homo sapien
gagaggtttcactttgtccaacact

SEQ ID NO: 66554 - DNA, 25 bp, Homo sapien
gagaggtttgactttgtccaacact

SEQ ID NO: 66555 - DNA, 25 bp, Homo sapien
gagaggtttgtctgagaaaactcaa

SEQ ID NO: 66556 - DNA, 25 bp, Homo sapien
gagagtaaagatactaaccagccag

SEQ ID NO: 66557 - DNA, 25 bp, Homo sapien
gagagtaaagatgctaaccagccag

SEQ ID NO: 66558 - DNA, 25 bp, Homo sapien
gagagtaaagcaaaaagtagaggaa

SEQ ID NO: 66559 - DNA, 25 bp, Homo sapien
gagagtaaagcaaagagtagaggaa

SEQ ID NO: 66560 - DNA, 25 bp, Homo sapien
gagagtaaataccgagcgtaaaaaa

SEQ ID NO: 66561 - DNA, 25 bp, Homo sapien
gagagtaaataccgagtgtaaaaaa

SEQ ID NO: 66562 - DNA, 25 bp, Homo sapien
gagagtaacaaatgatactttaaca

SEQ ID NO: 66563 - DNA, 25 bp, Homo sapien
gagagtaacaaattatactttaaca

SEQ ID NO: 66564 - DNA, 25 bp, Homo sapien
gagagtaactgttgagactaaggtt

SEQ ID NO: 66565 - DNA, 25 bp, Homo sapien
gagagtaactgttgggactaaggtt

SEQ ID NO: 66566 - DNA, 25 bp, Homo sapien
gagagtaagaaaaaagtaggaattt

SEQ ID NO: 66567 - DNA, 25 bp, Homo sapien
gagagtaagaagaaagtaggaattt

SEQ ID NO: 66568 - DNA, 25 bp, Homo sapien
gagagtaatataacattgtttgtga

SEQ ID NO: 66569 - DNA, 25 bp, Homo sapien
gagagtaatataatattgtttgtga

SEQ ID NO: 66570 - DNA, 25 bp, Homo sapien
gagagtagagtccagacataaattc

SEQ ID NO: 66571 - DNA, 25 bp, Homo sapien
gagagtagagtccagatataaattc

SEQ ID NO: 66572 - DNA, 25 bp, Homo sapien
gagagtcacaaacccacctgtgaat

SEQ ID NO: 66573 - DNA, 25 bp, Homo sapien
gagagtcaccaacccacctgtgaat

SEQ ID NO: 66574 - DNA, 25 bp, Homo sapien
gagagtgaagatacattacctacac

SEQ ID NO: 66575 - DNA, 25 bp, Homo sapien
gagagtgaagatagattacctacac

SEQ ID NO: 66576 - DNA, 25 bp, Homo sapien
gagagtggaaattaggccagaaaga

SEQ ID NO: 66577 - DNA, 25 bp, Homo sapien
gagagtggaaattatgccagaaaga

SEQ ID NO: 66578 - DNA, 25 bp, Homo sapien
gagagtggaagattattttggagta

SEQ ID NO: 66579 - DNA, 25 bp, Homo sapien
gagagtgggagattattttggagta

SEQ ID NO: 66580 - DNA, 25 bp, Homo sapien
gagagtggggcttctcacatgcagt

SEQ ID NO: 66581 - DNA, 25 bp, Homo sapien
gagagtggggcttttcacatgcagt

SEQ ID NO: 66582 - DNA, 25 bp, Homo sapien
gagagtggtatgtgaatcatttttg

SEQ ID NO: 66583 - DNA, 25 bp, Homo sapien
gagagtggtgtgtgaatcatttttg

SEQ ID NO: 66584 - DNA, 25 bp, Homo sapien
gagagtggtgttcagtctcacccat

SEQ ID NO: 66585 - DNA, 25 bp, Homo sapien
gagagtggtgttcagtttcacccat

SEQ ID NO: 66586 - DNA, 25 bp, Homo sapien
gagagttacaatggtgaaaaaaggg

SEQ ID NO: 66587 - DNA, 25 bp, Homo sapien
gagagttataatggtgaaaaaaggg

SEQ ID NO: 66588 - DNA, 25 bp, Homo sapien
gagagttattacagagctgtgaact

SEQ ID NO: 66589 - DNA, 25 bp, Homo sapien
gagagttattacggagctgtgaact

SEQ ID NO: 66590 - DNA, 25 bp, Homo sapien
gagagtttgttcaacggaataataa

SEQ ID NO: 66591 - DNA, 25 bp, Homo sapien
gagagtttgttcaatggaataataa

SEQ ID NO: 66592 - DNA, 25 bp, Homo sapien
gagagttttaaaactgacatgcaat

SEQ ID NO: 66593 - DNA, 25 bp, Homo sapien
gagagttttaaaattgacatgcaat

SEQ ID NO: 66594 - DNA, 25 bp, Homo sapien
gagataaacaatgtctcttacttga

SEQ ID NO: 66595 - DNA, 25 bp, Homo sapien
gagataaacagccagagtctttaag

SEQ ID NO: 66596 - DNA, 25 bp, Homo sapien
gagataaacgatgtctcttacttga

SEQ ID NO: 66597 - DNA, 25 bp, Homo sapien
gagataaatagccagagtctttaag

SEQ ID NO: 66598 - DNA, 25 bp, Homo sapien
gagataagagtgttccttctcaaat

SEQ ID NO: 66599 - DNA, 25 bp, Homo sapien
gagataagagtgtttcttctcaaat

SEQ ID NO: 66600 - DNA, 25 bp, Homo sapien
gagataagccacgagtgcagtgccg

SEQ ID NO: 66601 - DNA, 25 bp, Homo sapien
gagataagccatgagtgcagtgccg

SEQ ID NO: 66602 - DNA, 25 bp, Homo sapien
gagataataaatctatgcccaattt

SEQ ID NO: 66603 - DNA, 25 bp, Homo sapien
gagataatcctcataaatccctaag

SEQ ID NO: 66604 - DNA, 25 bp, Homo sapien
gagataatcctcgtaaatccctaag

SEQ ID NO: 66605 - DNA, 25 bp, Homo sapien
gagataatgaatctatgcccaattt

SEQ ID NO: 66606 - DNA, 25 bp, Homo sapien
gagatactatgtgcaaaatatcagc

SEQ ID NO: 66607 - DNA, 25 bp, Homo sapien
gagatactgtgtgcaaaatatcagc

SEQ ID NO: 66608 - DNA, 25 bp, Homo sapien
gagatagacaaggagatgaagtgcg

SEQ ID NO: 66609 - DNA, 25 bp, Homo sapien
gagatagacgaggagatgaagtgcg

SEQ ID NO: 66610 - DNA, 25 bp, Homo sapien
gagatagagcctttcaagaaatgac

SEQ ID NO: 66611 - DNA, 25 bp, Homo sapien
gagatagaggctttcaagaaatgac

SEQ ID NO: 66612 - DNA, 25 bp, Homo sapien
gagatagagttctcctttgatttga

SEQ ID NO: 66613 - DNA, 25 bp, Homo sapien
gagatagagttttcctttgatttga

SEQ ID NO: 66614 - DNA, 25 bp, Homo sapien
gagatagataaaaggaggaatccct

SEQ ID NO: 66615 - DNA, 25 bp, Homo sapien
gagatagataaaatgaggaatccct

SEQ ID NO: 66616 - DNA, 25 bp, Homo sapien
gagataggaacaattttcagtggat

SEQ ID NO: 66617 - DNA, 25 bp, Homo sapien
gagataggaccaattttcagtggat

SEQ ID NO: 66618 - DNA, 25 bp, Homo sapien
gagatagggctatagtaaggagtaa

SEQ ID NO: 66619 - DNA, 25 bp, Homo sapien
gagatagggctgtagtaaggagtaa

SEQ ID NO: 66620 - DNA, 25 bp, Homo sapien
gagataggtcagaactagatgtaga

SEQ ID NO: 66621 - DNA, 25 bp, Homo sapien
gagataggtcagaagtagatgtaga

SEQ ID NO: 66622 - DNA, 25 bp, Homo sapien
gagatataacctgtctgcaaagcaa

SEQ ID NO: 66623 - DNA, 25 bp, Homo sapien
gagatataagctgtctgcaaagcaa

SEQ ID NO: 66624 - DNA, 25 bp, Homo sapien
gagatatagtggccatagtaagaag

SEQ ID NO: 66625 - DNA, 25 bp, Homo sapien
gagatatagtggccatggtaagaag

SEQ ID NO: 66626 - DNA, 25 bp, Homo sapien
gagatatatataagatagcatcaat

SEQ ID NO: 66627 - DNA, 25 bp, Homo sapien
gagatatatatacgatagcatcaat

SEQ ID NO: 66628 - DNA, 25 bp, Homo sapien
gagatattcacatttaattactgaa

SEQ ID NO: 66629 - DNA, 25 bp, Homo sapien
gagatattctaaaacagactgaatg

SEQ ID NO: 66630 - DNA, 25 bp, Homo sapien
gagatattctaacacagactgaatg

SEQ ID NO: 66631 - DNA, 25 bp, Homo sapien
gagatattgacatttaattactgaa

SEQ ID NO: 66632 - DNA, 25 bp, Homo sapien
gagatattgatgtattagtagacct

SEQ ID NO: 66633 - DNA, 25 bp, Homo sapien
gagatattggtgtattagtagacct

SEQ ID NO: 66634 - DNA, 25 bp, Homo sapien
gagatatttaccaaagggattcttt

SEQ ID NO: 66635 - DNA, 25 bp, Homo sapien
gagatatttaccgaagggattcttt

SEQ ID NO: 66636 - DNA, 25 bp, Homo sapien
gagatcaaatgataatacaagctca

SEQ ID NO: 66637 - DNA, 25 bp, Homo sapien
gagatcaaatgataattcaagctca

SEQ ID NO: 66638 - DNA, 25 bp, Homo sapien
gagatcaaccttgaagtgacataca

SEQ ID NO: 66639 - DNA, 25 bp, Homo sapien
gagatcaacctttaagtgacataca

SEQ ID NO: 66640 - DNA, 25 bp, Homo sapien
gagatcacacaggccaactcctcca

SEQ ID NO: 66641 - DNA, 25 bp, Homo sapien
gagatcacacaggccatctcctcca

SEQ ID NO: 66642 - DNA, 25 bp, Homo sapien
gagatcagcgtggatgagaactgag

SEQ ID NO: 66643 - DNA, 25 bp, Homo sapien
gagatcagtgtggatgagaactgag

SEQ ID NO: 66644 - DNA, 25 bp, Homo sapien
gagatcctcgtcattgaaggaagcc

SEQ ID NO: 66645 - DNA, 25 bp, Homo sapien
gagatccttgtcattgaaggaagcc

SEQ ID NO: 66646 - DNA, 25 bp, Homo sapien
gagatctctttctactgtggatgaa

SEQ ID NO: 66647 - DNA, 25 bp, Homo sapien
gagatctctttctattgtggatgaa

SEQ ID NO: 66648 - DNA, 25 bp, Homo sapien
gagatctgtggaagagaactgagaa

SEQ ID NO: 66649 - DNA, 25 bp, Homo sapien
gagatctgtggaagggaactgagaa

SEQ ID NO: 66650 - DNA, 25 bp, Homo sapien
gagatgaaatggttccacctaagat

SEQ ID NO: 66651 - DNA, 25 bp, Homo sapien
gagatgaagtcatgaaagtaaccag

SEQ ID NO: 66652 - DNA, 25 bp, Homo sapien
gagatgaagtcatggaagtaaccag

SEQ ID NO: 66653 - DNA, 25 bp, Homo sapien
gagatgaagtggttccacctaagat

SEQ ID NO: 66654 - DNA, 25 bp, Homo sapien
gagatgaatagccacgttttcagaa

SEQ ID NO: 66655 - DNA, 25 bp, Homo sapien
gagatgaatagccatgttttcagaa

SEQ ID NO: 66656 - DNA, 25 bp, Homo sapien
gagatgacaaagatcaatcactttc

SEQ ID NO: 66657 - DNA, 25 bp, Homo sapien
gagatgacaaaggtcaatcactttc

SEQ ID NO: 66658 - DNA, 25 bp, Homo sapien
gagatgacgcttcacattctccctt

SEQ ID NO: 66659 - DNA, 25 bp, Homo sapien
gagatgactcttcacattctccctt

SEQ ID NO: 66660 - DNA, 25 bp, Homo sapien
gagatgagattagcaaacaaaagtg

SEQ ID NO: 66661 - DNA, 25 bp, Homo sapien
gagatgagattaggaaacaaaagtg

SEQ ID NO: 66662 - DNA, 25 bp, Homo sapien
gagatgaggtccataagtagatcag

SEQ ID NO: 66663 - DNA, 25 bp, Homo sapien
gagatgaggtccataattagatcag

SEQ ID NO: 66664 - DNA, 25 bp, Homo sapien
gagatgatttattgtatcactgcta

SEQ ID NO: 66665 - DNA, 25 bp, Homo sapien
gagatgatttattttatcactgcta

SEQ ID NO: 66666 - DNA, 25 bp, Homo sapien
gagatgatttgaacagccatgccaa

SEQ ID NO: 66667 - DNA, 25 bp, Homo sapien
gagatgatttgagcagccatgccaa

SEQ ID NO: 66668 - DNA, 25 bp, Homo sapien
gagatgcaattcagcccataacagt

SEQ ID NO: 66669 - DNA, 25 bp, Homo sapien
gagatgcactcatatttttgcataa

SEQ ID NO: 66670 - DNA, 25 bp, Homo sapien
gagatgcactcatgtttttgcataa

SEQ ID NO: 66671 - DNA, 25 bp, Homo sapien
gagatgcatacacctacttcctttt

SEQ ID NO: 66672 - DNA, 25 bp, Homo sapien
gagatgcatactcctacttcctttt

SEQ ID NO: 66673 - DNA, 25 bp, Homo sapien
gagatgcatttcagcccataacagt

SEQ ID NO: 66674 - DNA, 25 bp, Homo sapien
gagatgcctatccagcctttccctg

SEQ ID NO: 66675 - DNA, 25 bp, Homo sapien
gagatgcctatccggcctttccctg

SEQ ID NO: 66676 - DNA, 25 bp, Homo sapien
gagatgctttaaaggaatttatgga

SEQ ID NO: 66677 - DNA, 25 bp, Homo sapien
gagatgctttaaagtaatttatgga

SEQ ID NO: 66678 - DNA, 25 bp, Homo sapien
gagatggaaataatgccaaggctgt

SEQ ID NO: 66679 - DNA, 25 bp, Homo sapien
gagatggaaatcatgccaaggctgt

SEQ ID NO: 66680 - DNA, 25 bp, Homo sapien
gagatggaattccaaagccaattca

SEQ ID NO: 66681 - DNA, 25 bp, Homo sapien
gagatggaattccgaagccaattca

SEQ ID NO: 66682 - DNA, 25 bp, Homo sapien
gagatggatatacctaacagttgac

SEQ ID NO: 66683 - DNA, 25 bp, Homo sapien
gagatggatatgcctaacagttgac

SEQ ID NO: 66684 - DNA, 25 bp, Homo sapien
gagatgtcaaaatcccatctcttcc

SEQ ID NO: 66685 - DNA, 25 bp, Homo sapien
gagatgtcagaatcccatctcttcc

SEQ ID NO: 66686 - DNA, 25 bp, Homo sapien
gagattaaaatagtacctacctcat

SEQ ID NO: 66687 - DNA, 25 bp, Homo sapien
gagattaaaatcgtacctacctcat

SEQ ID NO: 66688 - DNA, 25 bp, Homo sapien
gagattaaattgcttgtccaagttc

SEQ ID NO: 66689 - DNA, 25 bp, Homo sapien
gagattaagaactggaataagaatt

SEQ ID NO: 66690 - DNA, 25 bp, Homo sapien
gagattaagaattggaataagaatt

SEQ ID NO: 66691 - DNA, 25 bp, Homo sapien
gagattaagttgcttgtccaagttc

SEQ ID NO: 66692 - DNA, 25 bp, Homo sapien
gagattaatggaattgtctctcttc

SEQ ID NO: 66693 - DNA, 25 bp, Homo sapien
gagattaattgaattgtctctcttc

SEQ ID NO: 66694 - DNA, 25 bp, Homo sapien
gagattactaggtttgcttttagtg

SEQ ID NO: 66695 - DNA, 25 bp, Homo sapien
gagattactgggtttgcttttagtg

SEQ ID NO: 66696 - DNA, 25 bp, Homo sapien
gagattagatcaccaatattagaat

SEQ ID NO: 66697 - DNA, 25 bp, Homo sapien
gagattagcaaacaaaagtgttaaa

SEQ ID NO: 66698 - DNA, 25 bp, Homo sapien
gagattagctgcacggctgaggaga

SEQ ID NO: 66699 - DNA, 25 bp, Homo sapien
gagattagctgcatggctgaggaga

SEQ ID NO: 66700 - DNA, 25 bp, Homo sapien
gagattaggaaacaaaagtgttaaa

SEQ ID NO: 66701 - DNA, 25 bp, Homo sapien
gagattagttcaccaatattagaat

SEQ ID NO: 66702 - DNA, 25 bp, Homo sapien
gagattcagttgcaggagattaacg

SEQ ID NO: 66703 - DNA, 25 bp, Homo sapien
gagattcagttgtaggagattaacg

SEQ ID NO: 66704 - DNA, 25 bp, Homo sapien
gagattcatggtcactgagttcctt

SEQ ID NO: 66705 - DNA, 25 bp, Homo sapien
gagattcatggtcattgagttcctt

SEQ ID NO: 66706 - DNA, 25 bp, Homo sapien
gagattcattgtaccttgtcacaac

SEQ ID NO: 66707 - DNA, 25 bp, Homo sapien
gagattcattgtgccttgtcacaac

SEQ ID NO: 66708 - DNA, 25 bp, Homo sapien
gagattcctttacttattccatatt

SEQ ID NO: 66709 - DNA, 25 bp, Homo sapien
gagattcctttatttattccatatt

SEQ ID NO: 66710 - DNA, 25 bp, Homo sapien
gagattctatcaattgccaagtgcc

SEQ ID NO: 66711 - DNA, 25 bp, Homo sapien
gagattctatcagttgccaagtgcc

SEQ ID NO: 66712 - DNA, 25 bp, Homo sapien
gagattctgattgcggttcttttga

SEQ ID NO: 66713 - DNA, 25 bp, Homo sapien
gagattctgattgtggttcttttga

SEQ ID NO: 66714 - DNA, 25 bp, Homo sapien
gagattctgccaaatcattagctct

SEQ ID NO: 66715 - DNA, 25 bp, Homo sapien
gagattctgccaaatcgttagctct

SEQ ID NO: 66716 - DNA, 25 bp, Homo sapien
gagattgagtacaacagcaactaaa

SEQ ID NO: 66717 - DNA, 25 bp, Homo sapien
gagattgagtacaccagcaactaaa

SEQ ID NO: 66718 - DNA, 25 bp, Homo sapien
gagattgttaacacgtgtgaggaga

SEQ ID NO: 66719 - DNA, 25 bp, Homo sapien
gagattgttaacatgtgtgaggaga

SEQ ID NO: 66720 - DNA, 25 bp, Homo sapien
gagattgttttgatccagaatctct

SEQ ID NO: 66721 - DNA, 25 bp, Homo sapien
gagattgttttgatgcagaatctct

SEQ ID NO: 66722 - DNA, 25 bp, Homo sapien
gagatttagaaactgtaggattaca

SEQ ID NO: 66723 - DNA, 25 bp, Homo sapien
gagatttagaaagtgtaggattaca

SEQ ID NO: 66724 - DNA, 25 bp, Homo sapien
gagatttataactcgtaatgaatgt

SEQ ID NO: 66725 - DNA, 25 bp, Homo sapien
gagatttataacttgtaatgaatgt

SEQ ID NO: 66726 - DNA, 25 bp, Homo sapien
gagatttatttgatttcgcagtctg

SEQ ID NO: 66727 - DNA, 25 bp, Homo sapien
gagatttatttgattttgcagtctg

SEQ ID NO: 66728 - DNA, 25 bp, Homo sapien
gagatttcagtaggtgcattggaat

SEQ ID NO: 66729 - DNA, 25 bp, Homo sapien
gagatttcattaggtgcattggaat

SEQ ID NO: 66730 - DNA, 25 bp, Homo sapien
gagatttccatgagaccttcagaga

SEQ ID NO: 66731 - DNA, 25 bp, Homo sapien
gagatttccatgaggccttcagaga

SEQ ID NO: 66732 - DNA, 25 bp, Homo sapien
gagatttccttctgcgcctcagact

SEQ ID NO: 66733 - DNA, 25 bp, Homo sapien
gagatttctttctgcgcctcagact

SEQ ID NO: 66734 - DNA, 25 bp, Homo sapien
gagatttgaagctacatctgaatta

SEQ ID NO: 66735 - DNA, 25 bp, Homo sapien
gagatttgaagctatatctgaatta

SEQ ID NO: 66736 - DNA, 25 bp, Homo sapien
gagatttgaagcttcttttgttcag

SEQ ID NO: 66737 - DNA, 25 bp, Homo sapien
gagatttgaagcttgttttgttcag

SEQ ID NO: 66738 - DNA, 25 bp, Homo sapien
gagattttatatcatacatagcaga

SEQ ID NO: 66739 - DNA, 25 bp, Homo sapien
gagattttattggaaaggaaagaaa

SEQ ID NO: 66740 - DNA, 25 bp, Homo sapien
gagattttattggagaggaaagaaa

SEQ ID NO: 66741 - DNA, 25 bp, Homo sapien
gagattttcggttttatccattgat

SEQ ID NO: 66742 - DNA, 25 bp, Homo sapien
gagattttgaacagaactgacctgt

SEQ ID NO: 66743 - DNA, 25 bp, Homo sapien
gagattttgaacagcactgacctgt

SEQ ID NO: 66744 - DNA, 25 bp, Homo sapien
gagattttgtatcatacatagcaga

SEQ ID NO: 66745 - DNA, 25 bp, Homo sapien
gagatttttatgcgtggattctttt

SEQ ID NO: 66746 - DNA, 25 bp, Homo sapien
gagatttttatgtgtggattctttt

SEQ ID NO: 66747 - DNA, 25 bp, Homo sapien
gagatttttggttttatccattgat

SEQ ID NO: 66748 - DNA, 25 bp, Homo sapien
gagcaaacaaatcagtaactaccac

SEQ ID NO: 66749 - DNA, 25 bp, Homo sapien
gagcaaacaaatctgtaactaccac

SEQ ID NO: 66750 - DNA, 25 bp, Homo sapien
gagcaaacagatgcaggatgatccg

SEQ ID NO: 66751 - DNA, 25 bp, Homo sapien
gagcaaacagattcaggatgatccg

SEQ ID NO: 66752 - DNA, 25 bp, Homo sapien
gagcaaataaaaccgatacaagcaa

SEQ ID NO: 66753 - DNA, 25 bp, Homo sapien
gagcaaataaaactgatacaagcaa

SEQ ID NO: 66754 - DNA, 25 bp, Homo sapien
gagcaacagacatttctgcaacagg

SEQ ID NO: 66755 - DNA, 25 bp, Homo sapien
gagcaacagacttttctgcaacagg

SEQ ID NO: 66756 - DNA, 25 bp, Homo sapien
gagcaacagttcatcgtgtttcaaa

SEQ ID NO: 66757 - DNA, 25 bp, Homo sapien
gagcaacagttcattgtgtttcaaa

SEQ ID NO: 66758 - DNA, 25 bp, Homo sapien
gagcaacataatgcgtgaggcccag

SEQ ID NO: 66759 - DNA, 25 bp, Homo sapien
gagcaacataatgcttgaggcccag

SEQ ID NO: 66760 - DNA, 25 bp, Homo sapien
gagcaactgcaggattcgggcagcc

SEQ ID NO: 66761 - DNA, 25 bp, Homo sapien
gagcaactgcaggatttgggcagcc

SEQ ID NO: 66762 - DNA, 25 bp, Homo sapien
gagcaagaacaattagtggcatgag

SEQ ID NO: 66763 - DNA, 25 bp, Homo sapien
gagcaagaacaattcgtggcatgag

SEQ ID NO: 66764 - DNA, 25 bp, Homo sapien
gagcaagaacacttgtcatcacccg

SEQ ID NO: 66765 - DNA, 25 bp, Homo sapien
gagcaagaacatttgtcatcacccg

SEQ ID NO: 66766 - DNA, 25 bp, Homo sapien
gagcaagcagaagagacttaaactc

SEQ ID NO: 66767 - DNA, 25 bp, Homo sapien
gagcaagcggaagagacttaaactc

SEQ ID NO: 66768 - DNA, 25 bp, Homo sapien
gagcaaggcatggctaaaatacaag

SEQ ID NO: 66769 - DNA, 25 bp, Homo sapien
gagcaaggcgtggctaaaatacaag

SEQ ID NO: 66770 - DNA, 25 bp, Homo sapien
gagcaagtatgatacaatgcctttg

SEQ ID NO: 66771 - DNA, 25 bp, Homo sapien
gagcaagtatgatccaatgcctttg

SEQ ID NO: 66772 - DNA, 25 bp, Homo sapien
gagcaatactggtgctaagtatatc

SEQ ID NO: 66773 - DNA, 25 bp, Homo sapien
gagcaatagtcaatgcatagcatac

SEQ ID NO: 66774 - DNA, 25 bp, Homo sapien
gagcaatagtcgatgcatagcatac

SEQ ID NO: 66775 - DNA, 25 bp, Homo sapien
gagcaatagtggtgctaagtatatc

SEQ ID NO: 66776 - DNA, 25 bp, Homo sapien
gagcaatcatgcatctttgcatcaa

SEQ ID NO: 66777 - DNA, 25 bp, Homo sapien
gagcaatcatgcgtctttgcatcaa

SEQ ID NO: 66778 - DNA, 25 bp, Homo sapien
gagcaatccactcggtgtccatccc

SEQ ID NO: 66779 - DNA, 25 bp, Homo sapien
gagcaatccactgggtgtccatccc

SEQ ID NO: 66780 - DNA, 25 bp, Homo sapien
gagcaatggccctcgttaattttat

SEQ ID NO: 66781 - DNA, 25 bp, Homo sapien
gagcaatggccctctttaattttat

SEQ ID NO: 66782 - DNA, 25 bp, Homo sapien
gagcaattatacatagtactgcatt

SEQ ID NO: 66783 - DNA, 25 bp, Homo sapien
gagcaattatagatagtactgcatt

SEQ ID NO: 66784 - DNA, 25 bp, Homo sapien
gagcaattgggcaaaataataatcc

SEQ ID NO: 66785 - DNA, 25 bp, Homo sapien
gagcaattgggccaaataataatcc

SEQ ID NO: 66786 - DNA, 25 bp, Homo sapien
gagcaattttccaatcttcttcaga

SEQ ID NO: 66787 - DNA, 25 bp, Homo sapien
gagcaattttccgatcttcttcaga

SEQ ID NO: 66788 - DNA, 25 bp, Homo sapien
gagcacaagggactatttcttcaat

SEQ ID NO: 66789 - DNA, 25 bp, Homo sapien
gagcacaagggactgtttcttcaat

SEQ ID NO: 66790 - DNA, 25 bp, Homo sapien
gagcacaatgtaacgcacattttaa

SEQ ID NO: 66791 - DNA, 25 bp, Homo sapien
gagcacaatgttacgcacattttaa

SEQ ID NO: 66792 - DNA, 25 bp, Homo sapien
gagcacagatagaggagcctgagga

SEQ ID NO: 66793 - DNA, 25 bp, Homo sapien
gagcacagcatgaaggaagcagggt

SEQ ID NO: 66794 - DNA, 25 bp, Homo sapien
gagcacaggatgaaggaagcagggt

SEQ ID NO: 66795 - DNA, 25 bp, Homo sapien
gagcacagttagaggagcctgagga

SEQ ID NO: 66796 - DNA, 25 bp, Homo sapien
gagcacatggcccaccttgcactgc

SEQ ID NO: 66797 - DNA, 25 bp, Homo sapien
gagcacatggcccagcttgcactgc

SEQ ID NO: 66798 - DNA, 25 bp, Homo sapien
gagcaccaagcacctctatgaatgg

SEQ ID NO: 66799 - DNA, 25 bp, Homo sapien
gagcaccaagcgcctctatgaatgg

SEQ ID NO: 66800 - DNA, 25 bp, Homo sapien
gagcaccacaagaaagatcactgaa

SEQ ID NO: 66801 - DNA, 25 bp, Homo sapien
gagcaccacaaggaagatcactgaa

SEQ ID NO: 66802 - DNA, 25 bp, Homo sapien
gagcactgtagatccatcaaccttg

SEQ ID NO: 66803 - DNA, 25 bp, Homo sapien
gagcactgtagattcatcaaccttg

SEQ ID NO: 66804 - DNA, 25 bp, Homo sapien
gagcagaaagaggttgggtcttagt

SEQ ID NO: 66805 - DNA, 25 bp, Homo sapien
gagcagaaagagtttgggtcttagt

SEQ ID NO: 66806 - DNA, 25 bp, Homo sapien
gagcagaaataggagacctggggtg

SEQ ID NO: 66807 - DNA, 25 bp, Homo sapien
gagcagaagtaggagacctggggtg

SEQ ID NO: 66808 - DNA, 25 bp, Homo sapien
gagcagaatacagactaaaatcctt

SEQ ID NO: 66809 - DNA, 25 bp, Homo sapien
gagcagaatacagattaaaatcctt

SEQ ID NO: 66810 - DNA, 25 bp, Homo sapien
gagcagagaccttgatttttgttaa

SEQ ID NO: 66811 - DNA, 25 bp, Homo sapien
gagcagagaccttggtttttgttaa

SEQ ID NO: 66812 - DNA, 25 bp, Homo sapien
gagcagagcgcaaggaatgatctag

SEQ ID NO: 66813 - DNA, 25 bp, Homo sapien
gagcagagtgcaaggaatgatctag

SEQ ID NO: 66814 - DNA, 25 bp, Homo sapien
gagcagatacttataggaaagagac

SEQ ID NO: 66815 - DNA, 25 bp, Homo sapien
gagcagatacttctaggaaagagac

SEQ ID NO: 66816 - DNA, 25 bp, Homo sapien
gagcagatcaaacaacaccactttg

SEQ ID NO: 66817 - DNA, 25 bp, Homo sapien
gagcagatcaagcaacaccactttg

SEQ ID NO: 66818 - DNA, 25 bp, Homo sapien
gagcagattgaagaagccacttatg

SEQ ID NO: 66819 - DNA, 25 bp, Homo sapien
gagcagattgaaggagccacttatg

SEQ ID NO: 66820 - DNA, 25 bp, Homo sapien
gagcagcaccttcaagacccagatg

SEQ ID NO: 66821 - DNA, 25 bp, Homo sapien
gagcagcaccttcgtagtgccaagg

SEQ ID NO: 66822 - DNA, 25 bp, Homo sapien
gagcagcagagcaggaatttgaatc

SEQ ID NO: 66823 - DNA, 25 bp, Homo sapien
gagcagcaggaaaatgaaacttgga

SEQ ID NO: 66824 - DNA, 25 bp, Homo sapien
gagcagcaggaaactgaaacttgga

SEQ ID NO: 66825 - DNA, 25 bp, Homo sapien
gagcagcatagcaggaatttgaatc

SEQ ID NO: 66826 - DNA, 25 bp, Homo sapien
gagcagcatcttcaagacccagatg

SEQ ID NO: 66827 - DNA, 25 bp, Homo sapien
gagcagcatcttcgtagtgccaagg

SEQ ID NO: 66828 - DNA, 25 bp, Homo sapien
gagcagcctgtagagaagaaataaa

SEQ ID NO: 66829 - DNA, 25 bp, Homo sapien
gagcagcctgtagagacgaaataaa

SEQ ID NO: 66830 - DNA, 25 bp, Homo sapien
gagcagctgattcactcagttgaaa

SEQ ID NO: 66831 - DNA, 25 bp, Homo sapien
gagcagctgattcacttagttgaaa

SEQ ID NO: 66832 - DNA, 25 bp, Homo sapien
gagcagcttgaagcatctgtgacat

SEQ ID NO: 66833 - DNA, 25 bp, Homo sapien
gagcagcttgaagcatttgtgacat

SEQ ID NO: 66834 - DNA, 25 bp, Homo sapien
gagcaggcaccagctgtgaccacca

SEQ ID NO: 66835 - DNA, 25 bp, Homo sapien
gagcaggcaccggctgtgaccacca

SEQ ID NO: 66836 - DNA, 25 bp, Homo sapien
gagcagtcaagagaaaaaatgttat

SEQ ID NO: 66837 - DNA, 25 bp, Homo sapien
gagcagtcaagggaaaaaatgttat

SEQ ID NO: 66838 - DNA, 25 bp, Homo sapien
gagcagtctaggattctgatgaatg

SEQ ID NO: 66839 - DNA, 25 bp, Homo sapien
gagcagtctagggttctgatgaatg

SEQ ID NO: 66840 - DNA, 25 bp, Homo sapien
gagcagtctgaactgtaaggtatgc

SEQ ID NO: 66841 - DNA, 25 bp, Homo sapien
gagcagtctgaactgtgaggtatgc

SEQ ID NO: 66842 - DNA, 25 bp, Homo sapien
gagcagtgaagacagtaacacagca

SEQ ID NO: 66843 - DNA, 25 bp, Homo sapien
gagcagtgaagacagttacacagca

SEQ ID NO: 66844 - DNA, 25 bp, Homo sapien
gagcagttctttccatttttgtata

SEQ ID NO: 66845 - DNA, 25 bp, Homo sapien
gagcagttctttccctttttgtata

SEQ ID NO: 66846 - DNA, 25 bp, Homo sapien
gagcagtttttaatctgtgaacgtg

SEQ ID NO: 66847 - DNA, 25 bp, Homo sapien
gagcagtttttaatttgtgaacgtg

SEQ ID NO: 66848 - DNA, 25 bp, Homo sapien
gagcataaaaaaatggtgttctcca

SEQ ID NO: 66849 - DNA, 25 bp, Homo sapien
gagcataaaaaattggtgttctcca

SEQ ID NO: 66850 - DNA, 25 bp, Homo sapien
gagcataagatcatttttcagtagt

SEQ ID NO: 66851 - DNA, 25 bp, Homo sapien
gagcataagatcgtttttcagtagt

SEQ ID NO: 66852 - DNA, 25 bp, Homo sapien
gagcataatctcatttacaatctct

SEQ ID NO: 66853 - DNA, 25 bp, Homo sapien
gagcataatctcatttgcaatctct

SEQ ID NO: 66854 - DNA, 25 bp, Homo sapien
gagcatacctcaaaataataaatgt

SEQ ID NO: 66855 - DNA, 25 bp, Homo sapien
gagcatacctcgaaataataaatgt

SEQ ID NO: 66856 - DNA, 25 bp, Homo sapien
gagcatagacaaagcattaggagac

SEQ ID NO: 66857 - DNA, 25 bp, Homo sapien
gagcatagacaaggcattaggagac

SEQ ID NO: 66858 - DNA, 25 bp, Homo sapien
gagcataggttttattcatttccac

SEQ ID NO: 66859 - DNA, 25 bp, Homo sapien
gagcataggttttgttcatttccac

SEQ ID NO: 66860 - DNA, 25 bp, Homo sapien
gagcatcaaggaatacattttcaga

SEQ ID NO: 66861 - DNA, 25 bp, Homo sapien
gagcatcagggaatacattttcaga

SEQ ID NO: 66862 - DNA, 25 bp, Homo sapien
gagcatcagggcaaagaagacaggc

SEQ ID NO: 66863 - DNA, 25 bp, Homo sapien
gagcatcagggcatagaagacaggc

SEQ ID NO: 66864 - DNA, 25 bp, Homo sapien
gagcatctaacacatgcttgaaaga

SEQ ID NO: 66865 - DNA, 25 bp, Homo sapien
gagcatctaacccatgcttgaaaga

SEQ ID NO: 66866 - DNA, 25 bp, Homo sapien
gagcatcttctgtacaattaactgg

SEQ ID NO: 66867 - DNA, 25 bp, Homo sapien
gagcatctttataacagtgtcttat

SEQ ID NO: 66868 - DNA, 25 bp, Homo sapien
gagcatctttataatagtgtcttat

SEQ ID NO: 66869 - DNA, 25 bp, Homo sapien
gagcatcttttgtacaattaactgg

SEQ ID NO: 66870 - DNA, 25 bp, Homo sapien
gagcatgatgacaaattaacaccta

SEQ ID NO: 66871 - DNA, 25 bp, Homo sapien
gagcatgatgacaagttaacaccta

SEQ ID NO: 66872 - DNA, 25 bp, Homo sapien
gagcatggaactttggtcaaaccaa

SEQ ID NO: 66873 - DNA, 25 bp, Homo sapien
gagcatggaacttttgtcaaaccaa

SEQ ID NO: 66874 - DNA, 25 bp, Homo sapien
gagcatggaatcaagaaaagggtag

SEQ ID NO: 66875 - DNA, 25 bp, Homo sapien
gagcatggactcaagaaaagggtag

SEQ ID NO: 66876 - DNA, 25 bp, Homo sapien
gagcatggtatcaactgttcagata

SEQ ID NO: 66877 - DNA, 25 bp, Homo sapien
gagcatggtatcaagtgttcagata

SEQ ID NO: 66878 - DNA, 25 bp, Homo sapien
gagcatggtcatggatcctaaggtg

SEQ ID NO: 66879 - DNA, 25 bp, Homo sapien
gagcatggttatggatcctaaggtg

SEQ ID NO: 66880 - DNA, 25 bp, Homo sapien
gagcatgtcaggaaaatgaaaaact

SEQ ID NO: 66881 - DNA, 25 bp, Homo sapien
gagcatgttaggaaaatgaaaaact

SEQ ID NO: 66882 - DNA, 25 bp, Homo sapien
gagcattacaataagtgctgaggta

SEQ ID NO: 66883 - DNA, 25 bp, Homo sapien
gagcattagatacaaagaggcctta

SEQ ID NO: 66884 - DNA, 25 bp, Homo sapien
gagcattagatagaaagaggcctta

SEQ ID NO: 66885 - DNA, 25 bp, Homo sapien
gagcattataataagtgctgaggta

SEQ ID NO: 66886 - DNA, 25 bp, Homo sapien
gagcattgagagctatatcttttca

SEQ ID NO: 66887 - DNA, 25 bp, Homo sapien
gagcattgagagctgtatcttttca

SEQ ID NO: 66888 - DNA, 25 bp, Homo sapien
gagcattggacacactgatcaatca

SEQ ID NO: 66889 - DNA, 25 bp, Homo sapien
gagcattggacactctgatcaatca

SEQ ID NO: 66890 - DNA, 25 bp, Homo sapien
gagcatttaaccccttggtgatgaa

SEQ ID NO: 66891 - DNA, 25 bp, Homo sapien
gagcatttaacccgttggtgatgaa

SEQ ID NO: 66892 - DNA, 25 bp, Homo sapien
gagcatttctgacacacagtaggtg

SEQ ID NO: 66893 - DNA, 25 bp, Homo sapien
gagcatttctgacccacagtaggtg

SEQ ID NO: 66894 - DNA, 25 bp, Homo sapien
gagcatttgatactgagttgggtgc

SEQ ID NO: 66895 - DNA, 25 bp, Homo sapien
gagcatttgatattgagttgggtgc

SEQ ID NO: 66896 - DNA, 25 bp, Homo sapien
gagcattttagaatttgggtttagt

SEQ ID NO: 66897 - DNA, 25 bp, Homo sapien
gagcattttagagtttgggtttagt

SEQ ID NO: 66898 - DNA, 25 bp, Homo sapien
gagcattttcttttgccaaaaataa

SEQ ID NO: 66899 - DNA, 25 bp, Homo sapien
gagcattttgttttgccaaaaataa

SEQ ID NO: 66900 - DNA, 25 bp, Homo sapien
gagccaatcagattgtctttcgcag

SEQ ID NO: 66901 - DNA, 25 bp, Homo sapien
gagccaatcataaagacggtaaaga

SEQ ID NO: 66902 - DNA, 25 bp, Homo sapien
gagccaatcataaagatggtaaaga

SEQ ID NO: 66903 - DNA, 25 bp, Homo sapien
gagccaatcggattgtctttcgcag

SEQ ID NO: 66904 - DNA, 25 bp, Homo sapien
gagccacattttaactccgggccag

SEQ ID NO: 66905 - DNA, 25 bp, Homo sapien
gagccacattttcactccgggccag

SEQ ID NO: 66906 - DNA, 25 bp, Homo sapien
gagccactagaacaatggtgctgga

SEQ ID NO: 66907 - DNA, 25 bp, Homo sapien
gagccactagaacgatggtgctgga

SEQ ID NO: 66908 - DNA, 25 bp, Homo sapien
gagccagaacctctgccctcttgcc

SEQ ID NO: 66909 - DNA, 25 bp, Homo sapien
gagccagaacctttgccctcttgcc

SEQ ID NO: 66910 - DNA, 25 bp, Homo sapien
gagccagaaggctagcatggttgga

SEQ ID NO: 66911 - DNA, 25 bp, Homo sapien
gagccagacatatattccgcaatgg

SEQ ID NO: 66912 - DNA, 25 bp, Homo sapien
gagccagacatttattccgcaatgg

SEQ ID NO: 66913 - DNA, 25 bp, Homo sapien
gagccagagggctagcatggttgga

SEQ ID NO: 66914 - DNA, 25 bp, Homo sapien
gagccagatgcttgcaaaggacagg

SEQ ID NO: 66915 - DNA, 25 bp, Homo sapien
gagccagatgcttgtaaaggacagg

SEQ ID NO: 66916 - DNA, 25 bp, Homo sapien
gagccagcaatcagtcctccaagga

SEQ ID NO: 66917 - DNA, 25 bp, Homo sapien
gagccagcaatcggtcctccaagga

SEQ ID NO: 66918 - DNA, 25 bp, Homo sapien
gagccagctttcccaactcaatcac

SEQ ID NO: 66919 - DNA, 25 bp, Homo sapien
gagccagctttcccgactcaatcac

SEQ ID NO: 66920 - DNA, 25 bp, Homo sapien
gagccaggattttgtacgtggatga

SEQ ID NO: 66921 - DNA, 25 bp, Homo sapien
gagccaggattttgtatgtggatga

SEQ ID NO: 66922 - DNA, 25 bp, Homo sapien
gagccagtgcgttacatggccagag

SEQ ID NO: 66923 - DNA, 25 bp, Homo sapien
gagccagtgcgttatatggccagag

SEQ ID NO: 66924 - DNA, 25 bp, Homo sapien
gagccataatgcaaaataagcctaa

SEQ ID NO: 66925 - DNA, 25 bp, Homo sapien
gagccataatgcgaaataagcctaa

SEQ ID NO: 66926 - DNA, 25 bp, Homo sapien
gagccatacgctttaacagggaaaa

SEQ ID NO: 66927 - DNA, 25 bp, Homo sapien
gagccatatgctttaacagggaaaa

SEQ ID NO: 66928 - DNA, 25 bp, Homo sapien
gagccatcaggcacaggaaagctga

SEQ ID NO: 66929 - DNA, 25 bp, Homo sapien
gagccatcaggcgcaggaaagctga

SEQ ID NO: 66930 - DNA, 25 bp, Homo sapien
gagccatcagtgagaaagtggctaa

SEQ ID NO: 66931 - DNA, 25 bp, Homo sapien
gagccatccgtgagaaagtggctaa

SEQ ID NO: 66932 - DNA, 25 bp, Homo sapien
gagccatcttttcgcccctgctaat

SEQ ID NO: 66933 - DNA, 25 bp, Homo sapien
gagccatctttttgcccctgctaat

SEQ ID NO: 66934 - DNA, 25 bp, Homo sapien
gagccatttatttcttgcattgtta

SEQ ID NO: 66935 - DNA, 25 bp, Homo sapien
gagccatttatttgttgcattgtta

SEQ ID NO: 66936 - DNA, 25 bp, Homo sapien
gagcccacaaggagacagagatgat

SEQ ID NO: 66937 - DNA, 25 bp, Homo sapien
gagcccacaaggagacggagatgat

SEQ ID NO: 66938 - DNA, 25 bp, Homo sapien
gagcccatttccattagtatctttg

SEQ ID NO: 66939 - DNA, 25 bp, Homo sapien
gagcccatttcgattagtatctttg

SEQ ID NO: 66940 - DNA, 25 bp, Homo sapien
gagcccgtcaaaagcattcttattt

SEQ ID NO: 66941 - DNA, 25 bp, Homo sapien
gagcccgtcaaaggcattcttattt

SEQ ID NO: 66942 - DNA, 25 bp, Homo sapien
gagccctaaatgacatcatgtgtcc

SEQ ID NO: 66943 - DNA, 25 bp, Homo sapien
gagccctaaatgtcatcatgtgtcc

SEQ ID NO: 66944 - DNA, 25 bp, Homo sapien
gagccctattcatatgtggcctgct

SEQ ID NO: 66945 - DNA, 25 bp, Homo sapien
gagccctattcatgtgtggcctgct

SEQ ID NO: 66946 - DNA, 25 bp, Homo sapien
gagccctgacgtacatacttgtgtt

SEQ ID NO: 66947 - DNA, 25 bp, Homo sapien
gagccctgacgtgcatacttgtgtt

SEQ ID NO: 66948 - DNA, 25 bp, Homo sapien
gagccctgagacagcaaatgtctgt

SEQ ID NO: 66949 - DNA, 25 bp, Homo sapien
gagccctgagagagcaaatgtctgt

SEQ ID NO: 66950 - DNA, 25 bp, Homo sapien
gagccctggaaaagcgttgggccag

SEQ ID NO: 66951 - DNA, 25 bp, Homo sapien
gagccctggaaaagtgttgggccag

SEQ ID NO: 66952 - DNA, 25 bp, Homo sapien
gagcccttgagctgcggcatctgtg

SEQ ID NO: 66953 - DNA, 25 bp, Homo sapien
gagcccttgagctgtggcatctgtg

SEQ ID NO: 66954 - DNA, 25 bp, Homo sapien
gagccgacactgcagactgtaatgt

SEQ ID NO: 66955 - DNA, 25 bp, Homo sapien
gagccgacactgcggactgtaatgt

SEQ ID NO: 66956 - DNA, 25 bp, Homo sapien
gagccgggcagtggcggactgtaac

SEQ ID NO: 66957 - DNA, 25 bp, Homo sapien
gagccgggcagtggtggactgtaac

SEQ ID NO: 66958 - DNA, 25 bp, Homo sapien
gagcctcggagacaatttgtaggtg

SEQ ID NO: 66959 - DNA, 25 bp, Homo sapien
gagcctcggagactatttgtaggtg

SEQ ID NO: 66960 - DNA, 25 bp, Homo sapien
gagcctgaaagaatattttatggtc

SEQ ID NO: 66961 - DNA, 25 bp, Homo sapien
gagcctgaaaggatctcccacaatc

SEQ ID NO: 66962 - DNA, 25 bp, Homo sapien
gagcctgaaaggatttcccacaatc

SEQ ID NO: 66963 - DNA, 25 bp, Homo sapien
gagcctgaatgaatattttatggtc

SEQ ID NO: 66964 - DNA, 25 bp, Homo sapien
gagcctgagcttcctaacctatact

SEQ ID NO: 66965 - DNA, 25 bp, Homo sapien
gagcctgagcttcgtaacctatact

SEQ ID NO: 66966 - DNA, 25 bp, Homo sapien
gagcctggaattcaaaagactgaaa

SEQ ID NO: 66967 - DNA, 25 bp, Homo sapien
gagcctggcattcaaaagactgaaa

SEQ ID NO: 66968 - DNA, 25 bp, Homo sapien
gagcctgtataaaatggctgttcag

SEQ ID NO: 66969 - DNA, 25 bp, Homo sapien
gagcctgtatacaatggctgttcag

SEQ ID NO: 66970 - DNA, 25 bp, Homo sapien
gagcctgtgaacaagataaggaaga

SEQ ID NO: 66971 - DNA, 25 bp, Homo sapien
gagcctgtgaacgagataaggaaga

SEQ ID NO: 66972 - DNA, 25 bp, Homo sapien
gagccttcaatcttctaagatcatc

SEQ ID NO: 66973 - DNA, 25 bp, Homo sapien
gagccttcagtcttctaagatcatc

SEQ ID NO: 66974 - DNA, 25 bp, Homo sapien
gagccttcagttgcgacctcagcct

SEQ ID NO: 66975 - DNA, 25 bp, Homo sapien
gagccttcagttgggacctcagcct

SEQ ID NO: 66976 - DNA, 25 bp, Homo sapien
gagccttccaaggagcgcggcccct

SEQ ID NO: 66977 - DNA, 25 bp, Homo sapien
gagccttcccgagcaggtgaacaga

SEQ ID NO: 66978 - DNA, 25 bp, Homo sapien
gagccttccgaggagcgcggcccct

SEQ ID NO: 66979 - DNA, 25 bp, Homo sapien
gagccttcctgagcaggtgaacaga

SEQ ID NO: 66980 - DNA, 25 bp, Homo sapien
gagcctttgggaactaattaatgag

SEQ ID NO: 66981 - DNA, 25 bp, Homo sapien
gagcctttgggagctaattaatgag

SEQ ID NO: 66982 - DNA, 25 bp, Homo sapien
gagcgaggctccatgcagacaggtg

SEQ ID NO: 66983 - DNA, 25 bp, Homo sapien
gagcgaggctccgtgcagacaggtg

SEQ ID NO: 66984 - DNA, 25 bp, Homo sapien
gagcgagtaatccttttaagggaaa

SEQ ID NO: 66985 - DNA, 25 bp, Homo sapien
gagcgagtaatctttttaagggaaa

SEQ ID NO: 66986 - DNA, 25 bp, Homo sapien
gagcgcatagtacgacagaatcagt

SEQ ID NO: 66987 - DNA, 25 bp, Homo sapien
gagcgcatagtatgacagaatcagt

SEQ ID NO: 66988 - DNA, 25 bp, Homo sapien
gagcgcatttcatataacactaatt

SEQ ID NO: 66989 - DNA, 25 bp, Homo sapien
gagcgcatttcatctaacactaatt

SEQ ID NO: 66990 - DNA, 25 bp, Homo sapien
gagcgggaataggccagaaagaggg

SEQ ID NO: 66991 - DNA, 25 bp, Homo sapien
gagcgggaataggcgagaaagaggg

SEQ ID NO: 66992 - DNA, 25 bp, Homo sapien
gagcgtctcactttccttttccttt

SEQ ID NO: 66993 - DNA, 25 bp, Homo sapien
gagcgtctcgctttccttttccttt

SEQ ID NO: 66994 - DNA, 25 bp, Homo sapien
gagctaaaaaatgaagcctagtgag

SEQ ID NO: 66995 - DNA, 25 bp, Homo sapien
gagctaaaacatgaagcctagtgag

SEQ ID NO: 66996 - DNA, 25 bp, Homo sapien
gagctaaaagtcggtcacacaagat

SEQ ID NO: 66997 - DNA, 25 bp, Homo sapien
gagctaaaagtgggtcacacaagat

SEQ ID NO: 66998 - DNA, 25 bp, Homo sapien
gagctaaacaaagaagataagcgct

SEQ ID NO: 66999 - DNA, 25 bp, Homo sapien
gagctaaacaaggaagataagcgct

SEQ ID NO: 67000 - DNA, 25 bp, Homo sapien
gagctaaagtcactgggaacagccc

SEQ ID NO: 67001 - DNA, 25 bp, Homo sapien
gagctaaagtcattgggaacagccc

SEQ ID NO: 67002 - DNA, 25 bp, Homo sapien
gagctaagcattgtgccgcaacagc

SEQ ID NO: 67003 - DNA, 25 bp, Homo sapien
gagctaagcattgtgctgcaacagc

SEQ ID NO: 67004 - DNA, 25 bp, Homo sapien
gagctaagcattgttgggctataaa

SEQ ID NO: 67005 - DNA, 25 bp, Homo sapien
gagctaagcgttgttgggctataaa

SEQ ID NO: 67006 - DNA, 25 bp, Homo sapien
gagctaatttctatccatctttgct

SEQ ID NO: 67007 - DNA, 25 bp, Homo sapien
gagctaatttctatccgtctttgct

SEQ ID NO: 67008 - DNA, 25 bp, Homo sapien
gagctacaaaaggttgcaaaacatg

SEQ ID NO: 67009 - DNA, 25 bp, Homo sapien
gagctacaacttaccatatcttcct

SEQ ID NO: 67010 - DNA, 25 bp, Homo sapien
gagctacaacttacgatatcttcct

SEQ ID NO: 67011 - DNA, 25 bp, Homo sapien
gagctacagaaggttgcaaaacatg

SEQ ID NO: 67012 - DNA, 25 bp, Homo sapien
gagctagtgaattgaccaatttata

SEQ ID NO: 67013 - DNA, 25 bp, Homo sapien
gagctagtgaattggccaatttata

SEQ ID NO: 67014 - DNA, 25 bp, Homo sapien
gagctagtgcagtagacagaccatt

SEQ ID NO: 67015 - DNA, 25 bp, Homo sapien
gagctagtggagtagacagaccatt

SEQ ID NO: 67016 - DNA, 25 bp, Homo sapien
gagctagtggcacgaagcaggaaca

SEQ ID NO: 67017 - DNA, 25 bp, Homo sapien
gagctagtggcatgaagcaggaaca

SEQ ID NO: 67018 - DNA, 25 bp, Homo sapien
gagctatacttctacaccacatggg

SEQ ID NO: 67019 - DNA, 25 bp, Homo sapien
gagctatacttctgcaccacatggg

SEQ ID NO: 67020 - DNA, 25 bp, Homo sapien
gagctatgtatcttctgctaatttg

SEQ ID NO: 67021 - DNA, 25 bp, Homo sapien
gagctatgtattttctgctaatttg

SEQ ID NO: 67022 - DNA, 25 bp, Homo sapien
gagctattgttggactcattaaggt

SEQ ID NO: 67023 - DNA, 25 bp, Homo sapien
gagctattgttgtactcattaaggt

SEQ ID NO: 67024 - DNA, 25 bp, Homo sapien
gagctcaaacatcccaaggtcaaat

SEQ ID NO: 67025 - DNA, 25 bp, Homo sapien
gagctcaaagatcccaaggtcaaat

SEQ ID NO: 67026 - DNA, 25 bp, Homo sapien
gagctcaaggataaagaggagaatt

SEQ ID NO: 67027 - DNA, 25 bp, Homo sapien
gagctcaaggatagagaggagaatt

SEQ ID NO: 67028 - DNA, 25 bp, Homo sapien
gagctcaagttcagtgacaaaacaa

SEQ ID NO: 67029 - DNA, 25 bp, Homo sapien
gagctcaagttcagtgtcaaaacaa

SEQ ID NO: 67030 - DNA, 25 bp, Homo sapien
gagctcaccaaacatactaaatgag

SEQ ID NO: 67031 - DNA, 25 bp, Homo sapien
gagctcaccaaacgtactaaatgag

SEQ ID NO: 67032 - DNA, 25 bp, Homo sapien
gagctcatatgatacgccaagcatt

SEQ ID NO: 67033 - DNA, 25 bp, Homo sapien
gagctcatatgatatgccaagcatt

SEQ ID NO: 67034 - DNA, 25 bp, Homo sapien
gagctcattcctcgggatttaataa

SEQ ID NO: 67035 - DNA, 25 bp, Homo sapien
gagctcattccttgggatttaataa

SEQ ID NO: 67036 - DNA, 25 bp, Homo sapien
gagctccaactcttccctttatttt

SEQ ID NO: 67037 - DNA, 25 bp, Homo sapien
gagctccaattcttccctttatttt

SEQ ID NO: 67038 - DNA, 25 bp, Homo sapien
gagctcctcacagcgtagtggaaga

SEQ ID NO: 67039 - DNA, 25 bp, Homo sapien
gagctcctcacagtgtagtggaaga

SEQ ID NO: 67040 - DNA, 25 bp, Homo sapien
gagctcgtgccattcaacctgccaa

SEQ ID NO: 67041 - DNA, 25 bp, Homo sapien
gagctcgtgccgttcaacctgccaa

SEQ ID NO: 67042 - DNA, 25 bp, Homo sapien
gagctctcaacatacctctgtaggt

SEQ ID NO: 67043 - DNA, 25 bp, Homo sapien
gagctctcaacatatctctgtaggt

SEQ ID NO: 67044 - DNA, 25 bp, Homo sapien
gagctctgccagataatgctctaag

SEQ ID NO: 67045 - DNA, 25 bp, Homo sapien
gagctctgccagatgatgctctaag

SEQ ID NO: 67046 - DNA, 25 bp, Homo sapien
gagctctggaaacgattactagtta

SEQ ID NO: 67047 - DNA, 25 bp, Homo sapien
gagctctggaaacggttactagtta

SEQ ID NO: 67048 - DNA, 25 bp, Homo sapien
gagctcttagttccaagaaccgtag

SEQ ID NO: 67049 - DNA, 25 bp, Homo sapien
gagctcttagtttcaagaaccgtag

SEQ ID NO: 67050 - DNA, 25 bp, Homo sapien
gagctcttgttacctaaccatcttc

SEQ ID NO: 67051 - DNA, 25 bp, Homo sapien
gagctcttgttatctaaccatcttc

SEQ ID NO: 67052 - DNA, 25 bp, Homo sapien
gagctctttatttctatacacttat

SEQ ID NO: 67053 - DNA, 25 bp, Homo sapien
gagctctttcgcatttattttattt

SEQ ID NO: 67054 - DNA, 25 bp, Homo sapien
gagctctttgtttctatacacttat

SEQ ID NO: 67055 - DNA, 25 bp, Homo sapien
gagctcttttgcatttattttattt

SEQ ID NO: 67056 - DNA, 25 bp, Homo sapien
gagctgaaaagtcacaatcttttta

SEQ ID NO: 67057 - DNA, 25 bp, Homo sapien
gagctgaaactgtaaaagtgcaatc

SEQ ID NO: 67058 - DNA, 25 bp, Homo sapien
gagctgaaattgtaaaagtgcaatc

SEQ ID NO: 67059 - DNA, 25 bp, Homo sapien
gagctgaagagtcacaatcttttta

SEQ ID NO: 67060 - DNA, 25 bp, Homo sapien
gagctgaagtaacgccggagataaa

SEQ ID NO: 67061 - DNA, 25 bp, Homo sapien
gagctgaagtaacgcctgagataaa

SEQ ID NO: 67062 - DNA, 25 bp, Homo sapien
gagctgaccgtataaacgatgaaaa

SEQ ID NO: 67063 - DNA, 25 bp, Homo sapien
gagctgactgtataaacgatgaaaa

SEQ ID NO: 67064 - DNA, 25 bp, Homo sapien
gagctgatcaaagaagtggaacaat

SEQ ID NO: 67065 - DNA, 25 bp, Homo sapien
gagctgatgaaagaagtggaacaat

SEQ ID NO: 67066 - DNA, 25 bp, Homo sapien
gagctgatgttatcaacaacgttct

SEQ ID NO: 67067 - DNA, 25 bp, Homo sapien
gagctgatgttattaacaacgttct

SEQ ID NO: 67068 - DNA, 25 bp, Homo sapien
gagctgcatagcaacacgatttctg

SEQ ID NO: 67069 - DNA, 25 bp, Homo sapien
gagctgcatagcaacatgatttctg

SEQ ID NO: 67070 - DNA, 25 bp, Homo sapien
gagctgccaaggctacatcattttg

SEQ ID NO: 67071 - DNA, 25 bp, Homo sapien
gagctgccaaggttacatcattttg

SEQ ID NO: 67072 - DNA, 25 bp, Homo sapien
gagctgccagtccctcaggaggaac

SEQ ID NO: 67073 - DNA, 25 bp, Homo sapien
gagctgccagtccctctggaggaac

SEQ ID NO: 67074 - DNA, 25 bp, Homo sapien
gagctgcccctcatcttcgcagaac

SEQ ID NO: 67075 - DNA, 25 bp, Homo sapien
gagctgcccctcgtcttcgcagaac

SEQ ID NO: 67076 - DNA, 25 bp, Homo sapien
gagctgcgttcaagggatgcactga

SEQ ID NO: 67077 - DNA, 25 bp, Homo sapien
gagctgcgttcgagggatgcactga

SEQ ID NO: 67078 - DNA, 25 bp, Homo sapien
gagctgctcagatgtcatacatttt

SEQ ID NO: 67079 - DNA, 25 bp, Homo sapien
gagctgctcagttgtcatacatttt

SEQ ID NO: 67080 - DNA, 25 bp, Homo sapien
gagctgctgagctaaccaacggtgg

SEQ ID NO: 67081 - DNA, 25 bp, Homo sapien
gagctgctgagctagccaacggtgg

SEQ ID NO: 67082 - DNA, 25 bp, Homo sapien
gagctgctgcataagaaacgaaact

SEQ ID NO: 67083 - DNA, 25 bp, Homo sapien
gagctgctgcattagaaacgaaact

SEQ ID NO: 67084 - DNA, 25 bp, Homo sapien
gagctggaaaataccaacggcaact

SEQ ID NO: 67085 - DNA, 25 bp, Homo sapien
gagctggaaaatactaacggcaact

SEQ ID NO: 67086 - DNA, 25 bp, Homo sapien
gagctggaacggtgtactaagttaa

SEQ ID NO: 67087 - DNA, 25 bp, Homo sapien
gagctggaatggcatatgcaagcaa

SEQ ID NO: 67088 - DNA, 25 bp, Homo sapien
gagctggaatggtatatgcaagcaa

SEQ ID NO: 67089 - DNA, 25 bp, Homo sapien
gagctggaatggtgtactaagttaa

SEQ ID NO: 67090 - DNA, 25 bp, Homo sapien
gagctggagacccgagaaagccagg

SEQ ID NO: 67091 - DNA, 25 bp, Homo sapien
gagctggagacgcgagaaagccagg

SEQ ID NO: 67092 - DNA, 25 bp, Homo sapien
gagctgtcccgcgtgtggtgatttg

SEQ ID NO: 67093 - DNA, 25 bp, Homo sapien
gagctgtcctctgacctaccaaaga

SEQ ID NO: 67094 - DNA, 25 bp, Homo sapien
gagctgtcctgcgtgtggtgatttg

SEQ ID NO: 67095 - DNA, 25 bp, Homo sapien
gagctgtctattggaagaagatgcc

SEQ ID NO: 67096 - DNA, 25 bp, Homo sapien
gagctgtctattggcagaagatgcc

SEQ ID NO: 67097 - DNA, 25 bp, Homo sapien
gagctgtcttctgacctaccaaaga

SEQ ID NO: 67098 - DNA, 25 bp, Homo sapien
gagctgtgcccagatccgagccaga

SEQ ID NO: 67099 - DNA, 25 bp, Homo sapien
gagctgtgcccaggtccgagccaga

SEQ ID NO: 67100 - DNA, 25 bp, Homo sapien
gagctgtggtgaagttcaaatgagc

SEQ ID NO: 67101 - DNA, 25 bp, Homo sapien
gagctgtggtgaggttcaaatgagc

SEQ ID NO: 67102 - DNA, 25 bp, Homo sapien
gagctgtgtgtttcctggaaatgcc

SEQ ID NO: 67103 - DNA, 25 bp, Homo sapien
gagctgtgtgttttctggaaatgcc

SEQ ID NO: 67104 - DNA, 25 bp, Homo sapien
gagctgtgtttgtaagtttcattgt

SEQ ID NO: 67105 - DNA, 25 bp, Homo sapien
gagctgtgtttttaagtttcattgt

SEQ ID NO: 67106 - DNA, 25 bp, Homo sapien
gagctgttcctatgaagccatgttg

SEQ ID NO: 67107 - DNA, 25 bp, Homo sapien
gagctgttcctattaagccatgttg

SEQ ID NO: 67108 - DNA, 25 bp, Homo sapien
gagcttaacatgctgtatggtgctt

SEQ ID NO: 67109 - DNA, 25 bp, Homo sapien
gagcttaacatggtgtatggtgctt

SEQ ID NO: 67110 - DNA, 25 bp, Homo sapien
gagcttacagtctagtcgggttaga

SEQ ID NO: 67111 - DNA, 25 bp, Homo sapien
gagcttacagtctagttgggttaga

SEQ ID NO: 67112 - DNA, 25 bp, Homo sapien
gagcttacggctccaaagccaaggg

SEQ ID NO: 67113 - DNA, 25 bp, Homo sapien
gagcttacggcttcaaagccaaggg

SEQ ID NO: 67114 - DNA, 25 bp, Homo sapien
gagcttagaatgcagatcactccaa

SEQ ID NO: 67115 - DNA, 25 bp, Homo sapien
gagcttagaatgtagatcactccaa

SEQ ID NO: 67116 - DNA, 25 bp, Homo sapien
gagcttagggacttagaatgcttta

SEQ ID NO: 67117 - DNA, 25 bp, Homo sapien
gagcttagggatttagaatgcttta

SEQ ID NO: 67118 - DNA, 25 bp, Homo sapien
gagcttagtcggatttgagggaaaa

SEQ ID NO: 67119 - DNA, 25 bp, Homo sapien
gagcttagttggatttgagggaaaa

SEQ ID NO: 67120 - DNA, 25 bp, Homo sapien
gagcttatctactgaatgacctcag

SEQ ID NO: 67121 - DNA, 25 bp, Homo sapien
gagcttatctattgaatgacctcag

SEQ ID NO: 67122 - DNA, 25 bp, Homo sapien
gagcttcaatgaataaaacttttct

SEQ ID NO: 67123 - DNA, 25 bp, Homo sapien
gagcttcagtgaataaaacttttct

SEQ ID NO: 67124 - DNA, 25 bp, Homo sapien
gagcttcatcagagcagtcagtaga

SEQ ID NO: 67125 - DNA, 25 bp, Homo sapien
gagcttcatcagggcagtcagtaga

SEQ ID NO: 67126 - DNA, 25 bp, Homo sapien
gagcttcatgatctaatacaaatgc

SEQ ID NO: 67127 - DNA, 25 bp, Homo sapien
gagcttcatgatctcatacaaatgc

SEQ ID NO: 67128 - DNA, 25 bp, Homo sapien
gagcttcctaagcaagactatctac

SEQ ID NO: 67129 - DNA, 25 bp, Homo sapien
gagcttcctaagcacgactatctac

SEQ ID NO: 67130 - DNA, 25 bp, Homo sapien
gagcttctggtagcaacagtttcat

SEQ ID NO: 67131 - DNA, 25 bp, Homo sapien
gagcttctggttgcaacagtttcat

SEQ ID NO: 67132 - DNA, 25 bp, Homo sapien
gagctttgagcaatacacatgctca

SEQ ID NO: 67133 - DNA, 25 bp, Homo sapien
gagctttgagcagtacacatgctca

SEQ ID NO: 67134 - DNA, 25 bp, Homo sapien
gagctttgtgatccgcttggctgac

SEQ ID NO: 67135 - DNA, 25 bp, Homo sapien
gagctttgtgatctgcttggctgac

SEQ ID NO: 67136 - DNA, 25 bp, Homo sapien
gagcttttggaccccttttctgaac

SEQ ID NO: 67137 - DNA, 25 bp, Homo sapien
gagcttttggacctcttttctgaac

SEQ ID NO: 67138 - DNA, 25 bp, Homo sapien
gaggaaaaatcatctttccaaatgg

SEQ ID NO: 67139 - DNA, 25 bp, Homo sapien
gaggaaaaatcgtctttccaaatgg

SEQ ID NO: 67140 - DNA, 25 bp, Homo sapien
gaggaaaacggacctctatgggcca

SEQ ID NO: 67141 - DNA, 25 bp, Homo sapien
gaggaaaacggatctctatgggcca

SEQ ID NO: 67142 - DNA, 25 bp, Homo sapien
gaggaaaataaaagcttataactca

SEQ ID NO: 67143 - DNA, 25 bp, Homo sapien
gaggaaaataaaagtttataactca

SEQ ID NO: 67144 - DNA, 25 bp, Homo sapien
gaggaaaataggcagcatcattttg

SEQ ID NO: 67145 - DNA, 25 bp, Homo sapien
gaggaaaatgggcagcatcattttg

SEQ ID NO: 67146 - DNA, 25 bp, Homo sapien
gaggaaacagtacatgcagaggcca

SEQ ID NO: 67147 - DNA, 25 bp, Homo sapien
gaggaaacagtacgtgcagaggcca

SEQ ID NO: 67148 - DNA, 25 bp, Homo sapien
gaggaaactggactaatgagctgtg

SEQ ID NO: 67149 - DNA, 25 bp, Homo sapien
gaggaaactggacttatgagctgtg

SEQ ID NO: 67150 - DNA, 25 bp, Homo sapien
gaggaaagagagtaatgacggaaat

SEQ ID NO: 67151 - DNA, 25 bp, Homo sapien
gaggaaagatagtaatgacggaaat

SEQ ID NO: 67152 - DNA, 25 bp, Homo sapien
gaggaaaggatgaatacatttttcg

SEQ ID NO: 67153 - DNA, 25 bp, Homo sapien
gaggaaaggatgattacatttttcg

SEQ ID NO: 67154 - DNA, 25 bp, Homo sapien
gaggaacacattttcaactggctgc

SEQ ID NO: 67155 - DNA, 25 bp, Homo sapien
gaggaacacatttttaactggctgc

SEQ ID NO: 67156 - DNA, 25 bp, Homo sapien
gaggaactacctaccccattcaaat

SEQ ID NO: 67157 - DNA, 25 bp, Homo sapien
gaggaactacctatcccattcaaat

SEQ ID NO: 67158 - DNA, 25 bp, Homo sapien
gaggaactagaagattgggaagtcc

SEQ ID NO: 67159 - DNA, 25 bp, Homo sapien
gaggaacttgaagattgggaagtcc

SEQ ID NO: 67160 - DNA, 25 bp, Homo sapien
gaggaagacggatgcatgactatga

SEQ ID NO: 67161 - DNA, 25 bp, Homo sapien
gaggaagactatcttcttgccttgg

SEQ ID NO: 67162 - DNA, 25 bp, Homo sapien
gaggaagactattttcttgccttgg

SEQ ID NO: 67163 - DNA, 25 bp, Homo sapien
gaggaagaggtggctttgcttacag

SEQ ID NO: 67164 - DNA, 25 bp, Homo sapien
gaggaagaggtggttttgcttacag

SEQ ID NO: 67165 - DNA, 25 bp, Homo sapien
gaggaagatggatgcatgactatga

SEQ ID NO: 67166 - DNA, 25 bp, Homo sapien
gaggaagcacagagcatgtccaggg

SEQ ID NO: 67167 - DNA, 25 bp, Homo sapien
gaggaagcacagagtatgtccaggg

SEQ ID NO: 67168 - DNA, 25 bp, Homo sapien
gaggaagcaggcaagaatatgtggg

SEQ ID NO: 67169 - DNA, 25 bp, Homo sapien
gaggaagcaggcgagaatatgtggg

SEQ ID NO: 67170 - DNA, 25 bp, Homo sapien
gaggaagctcactttataaaacagg

SEQ ID NO: 67171 - DNA, 25 bp, Homo sapien
gaggaagctcagtttataaaacagg

SEQ ID NO: 67172 - DNA, 25 bp, Homo sapien
gaggaaggagcctgggtacagaagt

SEQ ID NO: 67173 - DNA, 25 bp, Homo sapien
gaggaaggagcctgtgtacagaagt

SEQ ID NO: 67174 - DNA, 25 bp, Homo sapien
gaggaaggatcaactgtgaatggca

SEQ ID NO: 67175 - DNA, 25 bp, Homo sapien
gaggaaggatcgactgtgaatggca

SEQ ID NO: 67176 - DNA, 25 bp, Homo sapien
gaggaaggccgatgggaagggaaaa

SEQ ID NO: 67177 - DNA, 25 bp, Homo sapien
gaggaaggtcgatgggaagggaaaa

SEQ ID NO: 67178 - DNA, 25 bp, Homo sapien
gaggaataatggctcgcgtccacgg

SEQ ID NO: 67179 - DNA, 25 bp, Homo sapien
gaggaataatggctcgtgtccacgg

SEQ ID NO: 67180 - DNA, 25 bp, Homo sapien
gaggaatgaacaactggagacgcgc

SEQ ID NO: 67181 - DNA, 25 bp, Homo sapien
gaggaatgaacaagagtttaagaga

SEQ ID NO: 67182 - DNA, 25 bp, Homo sapien
gaggaatgaaccagagtttaagaga

SEQ ID NO: 67183 - DNA, 25 bp, Homo sapien
gaggaatgacatgcgtgacatattc

SEQ ID NO: 67184 - DNA, 25 bp, Homo sapien
gaggaatgacatgtgtgacatattc

SEQ ID NO: 67185 - DNA, 25 bp, Homo sapien
gaggaatgtaagaagaatctgctgg

SEQ ID NO: 67186 - DNA, 25 bp, Homo sapien
gaggaatgtaagaggaatctgctgg

SEQ ID NO: 67187 - DNA, 25 bp, Homo sapien
gaggaatgtacaactggagacgcgc

SEQ ID NO: 67188 - DNA, 25 bp, Homo sapien
gaggacaaaggtgtaaagtcagact

SEQ ID NO: 67189 - DNA, 25 bp, Homo sapien
gaggacaagggtgtaaagtcagact

SEQ ID NO: 67190 - DNA, 25 bp, Homo sapien
gaggacacagggtctgacactaggc

SEQ ID NO: 67191 - DNA, 25 bp, Homo sapien
gaggacacatggtctgacactaggc

SEQ ID NO: 67192 - DNA, 25 bp, Homo sapien
gaggacacctcaaaacagtggtgag

SEQ ID NO: 67193 - DNA, 25 bp, Homo sapien
gaggacacctcaaaacggtggtgag

SEQ ID NO: 67194 - DNA, 25 bp, Homo sapien
gaggacactgagactaagatgtgaa

SEQ ID NO: 67195 - DNA, 25 bp, Homo sapien
gaggacactgatactaagatgtgaa

SEQ ID NO: 67196 - DNA, 25 bp, Homo sapien
gaggacagaagtaagggaatgagag

SEQ ID NO: 67197 - DNA, 25 bp, Homo sapien
gaggacagcagtacatgggctagaa

SEQ ID NO: 67198 - DNA, 25 bp, Homo sapien
gaggacagcagtacgtgggctagaa

SEQ ID NO: 67199 - DNA, 25 bp, Homo sapien
gaggacaggaaagacagtcataaat

SEQ ID NO: 67200 - DNA, 25 bp, Homo sapien
gaggacaggaaaggcagtcataaat

SEQ ID NO: 67201 - DNA, 25 bp, Homo sapien
gaggacaggagtaagggaatgagag

SEQ ID NO: 67202 - DNA, 25 bp, Homo sapien
gaggacatcgctactattattacag

SEQ ID NO: 67203 - DNA, 25 bp, Homo sapien
gaggacattgctactattattacag

SEQ ID NO: 67204 - DNA, 25 bp, Homo sapien
gaggaccaacacagataagtgcttc

SEQ ID NO: 67205 - DNA, 25 bp, Homo sapien
gaggaccaacacaggtaagtgcttc

SEQ ID NO: 67206 - DNA, 25 bp, Homo sapien
gaggactcacgtagtaaggtgtgcc

SEQ ID NO: 67207 - DNA, 25 bp, Homo sapien
gaggactcatgtagtaaggtgtgcc

SEQ ID NO: 67208 - DNA, 25 bp, Homo sapien
gaggactgtgaatatcccatcagag

SEQ ID NO: 67209 - DNA, 25 bp, Homo sapien
gaggactgtgagtatcccatcagag

SEQ ID NO: 67210 - DNA, 25 bp, Homo sapien
gaggagaacaagacaaagtcctgct

SEQ ID NO: 67211 - DNA, 25 bp, Homo sapien
gaggagaacaaggcaaagtcctgct

SEQ ID NO: 67212 - DNA, 25 bp, Homo sapien
gaggagaagaacaagtgatgattag

SEQ ID NO: 67213 - DNA, 25 bp, Homo sapien
gaggagaagaacaggtgatgattag

SEQ ID NO: 67214 - DNA, 25 bp, Homo sapien
gaggagaagcaaacctgccatctta

SEQ ID NO: 67215 - DNA, 25 bp, Homo sapien
gaggagaagcaaacgtgccatctta

SEQ ID NO: 67216 - DNA, 25 bp, Homo sapien
gaggagacacaatttaataaaaaga

SEQ ID NO: 67217 - DNA, 25 bp, Homo sapien
gaggagacgcaatttaataaaaaga

SEQ ID NO: 67218 - DNA, 25 bp, Homo sapien
gaggagagacccagctgccgccgcc

SEQ ID NO: 67219 - DNA, 25 bp, Homo sapien
gaggagagagaccatacaacttttg

SEQ ID NO: 67220 - DNA, 25 bp, Homo sapien
gaggagagagactatacaacttttg

SEQ ID NO: 67221 - DNA, 25 bp, Homo sapien
gaggagaggaaacagaattaattag

SEQ ID NO: 67222 - DNA, 25 bp, Homo sapien
gaggagaggaaacggaattaattag

SEQ ID NO: 67223 - DNA, 25 bp, Homo sapien
gaggagaggcccagctgccgccgcc

SEQ ID NO: 67224 - DNA, 25 bp, Homo sapien
gaggagataggaacaattttcagtg

SEQ ID NO: 67225 - DNA, 25 bp, Homo sapien
gaggagataggaccaattttcagtg

SEQ ID NO: 67226 - DNA, 25 bp, Homo sapien
gaggagcattcatgacactgaaacc

SEQ ID NO: 67227 - DNA, 25 bp, Homo sapien
gaggagcattcatgccactgaaacc

SEQ ID NO: 67228 - DNA, 25 bp, Homo sapien
gaggagccttttcgcagagtcttta

SEQ ID NO: 67229 - DNA, 25 bp, Homo sapien
gaggagcctttttgcagagtcttta

SEQ ID NO: 67230 - DNA, 25 bp, Homo sapien
gaggaggaaaacaagaatgatctta

SEQ ID NO: 67231 - DNA, 25 bp, Homo sapien
gaggaggaaaacatgaatgatctta

SEQ ID NO: 67232 - DNA, 25 bp, Homo sapien
gaggaggagactttggtagtcaaca

SEQ ID NO: 67233 - DNA, 25 bp, Homo sapien
gaggaggaggctttggtagtcaaca

SEQ ID NO: 67234 - DNA, 25 bp, Homo sapien
gaggaggcacattgtactcactggt

SEQ ID NO: 67235 - DNA, 25 bp, Homo sapien
gaggaggcatattgtactcactggt

SEQ ID NO: 67236 - DNA, 25 bp, Homo sapien
gaggaggccatgagaagaggctgaa

SEQ ID NO: 67237 - DNA, 25 bp, Homo sapien
gaggaggccgtgagaagaggctgaa

SEQ ID NO: 67238 - DNA, 25 bp, Homo sapien
gaggaggtaaaaagatgacaaacag

SEQ ID NO: 67239 - DNA, 25 bp, Homo sapien
gaggaggtaaaaagctgacaaacag

SEQ ID NO: 67240 - DNA, 25 bp, Homo sapien
gaggagtacaagagttactcaaaaa

SEQ ID NO: 67241 - DNA, 25 bp, Homo sapien
gaggagtagaagagttactcaaaaa

SEQ ID NO: 67242 - DNA, 25 bp, Homo sapien
gaggagtagtgactgaagatttttg

SEQ ID NO: 67243 - DNA, 25 bp, Homo sapien
gaggagtagtgagtgaagatttttg

SEQ ID NO: 67244 - DNA, 25 bp, Homo sapien
gaggagtgtcctgaaaactcactct

SEQ ID NO: 67245 - DNA, 25 bp, Homo sapien
gaggagtgtcctgacaactcactct

SEQ ID NO: 67246 - DNA, 25 bp, Homo sapien
gaggagttgggacgaaggtatcaat

SEQ ID NO: 67247 - DNA, 25 bp, Homo sapien
gaggagttgggatgaaggtatcaat

SEQ ID NO: 67248 - DNA, 25 bp, Homo sapien
gaggagtttgcagtcaaaaagcaaa

SEQ ID NO: 67249 - DNA, 25 bp, Homo sapien
gaggagtttgccgtcaaaaagcaaa

SEQ ID NO: 67250 - DNA, 25 bp, Homo sapien
gaggataaacaggacagtgataaat

SEQ ID NO: 67251 - DNA, 25 bp, Homo sapien
gaggataaagacagcagttggttag

SEQ ID NO: 67252 - DNA, 25 bp, Homo sapien
gaggataaagacaggagttggttag

SEQ ID NO: 67253 - DNA, 25 bp, Homo sapien
gaggataaataggacagtgataaat

SEQ ID NO: 67254 - DNA, 25 bp, Homo sapien
gaggataaattattgttttcattag

SEQ ID NO: 67255 - DNA, 25 bp, Homo sapien
gaggataaattatttttttcattag

SEQ ID NO: 67256 - DNA, 25 bp, Homo sapien
gaggataattcaattacttattgtg

SEQ ID NO: 67257 - DNA, 25 bp, Homo sapien
gaggataattcaattatttattgtg

SEQ ID NO: 67258 - DNA, 25 bp, Homo sapien
gaggatacacttacaacgaactgta

SEQ ID NO: 67259 - DNA, 25 bp, Homo sapien
gaggatacactttcaacgaactgta

SEQ ID NO: 67260 - DNA, 25 bp, Homo sapien
gaggatagaccacggcttcagcctg

SEQ ID NO: 67261 - DNA, 25 bp, Homo sapien
gaggatagaccatggcttcagcctg

SEQ ID NO: 67262 - DNA, 25 bp, Homo sapien
gaggatcacattctagttttgcata

SEQ ID NO: 67263 - DNA, 25 bp, Homo sapien
gaggatcagattctagttttgcata

SEQ ID NO: 67264 - DNA, 25 bp, Homo sapien
gaggatccaacaggaaggcaacttt

SEQ ID NO: 67265 - DNA, 25 bp, Homo sapien
gaggatccaacgggaaggcaacttt

SEQ ID NO: 67266 - DNA, 25 bp, Homo sapien
gaggatgagagctgactgctgaact

SEQ ID NO: 67267 - DNA, 25 bp, Homo sapien
gaggatgagagttgactgctgaact

SEQ ID NO: 67268 - DNA, 25 bp, Homo sapien
gaggatgattgatgcacgccccttg

SEQ ID NO: 67269 - DNA, 25 bp, Homo sapien
gaggatgattgatgcatgccccttg

SEQ ID NO: 67270 - DNA, 25 bp, Homo sapien
gaggatggaaatagcaaacaaacaa

SEQ ID NO: 67271 - DNA, 25 bp, Homo sapien
gaggatggaaatatcaaacaaacaa

SEQ ID NO: 67272 - DNA, 25 bp, Homo sapien
gaggatggctcccactacaaagaat

SEQ ID NO: 67273 - DNA, 25 bp, Homo sapien
gaggatggctgttatccttctagat

SEQ ID NO: 67274 - DNA, 25 bp, Homo sapien
gaggatgggacttttcagttgaatt

SEQ ID NO: 67275 - DNA, 25 bp, Homo sapien
gaggatgggccttttcagttgaatt

SEQ ID NO: 67276 - DNA, 25 bp, Homo sapien
gaggatggggagatgacgagtttaa

SEQ ID NO: 67277 - DNA, 25 bp, Homo sapien
gaggatggggagatgatgagtttaa

SEQ ID NO: 67278 - DNA, 25 bp, Homo sapien
gaggatgggtgttatccttctagat

SEQ ID NO: 67279 - DNA, 25 bp, Homo sapien
gaggatggttcccactacaaagaat

SEQ ID NO: 67280 - DNA, 25 bp, Homo sapien
gaggatgttaaaagatccttaagtt

SEQ ID NO: 67281 - DNA, 25 bp, Homo sapien
gaggatgttaaatgatccttaagtt

SEQ ID NO: 67282 - DNA, 25 bp, Homo sapien
gaggattaggtcaaaaccaacagca

SEQ ID NO: 67283 - DNA, 25 bp, Homo sapien
gaggattaggttaaaaccaacagca

SEQ ID NO: 67284 - DNA, 25 bp, Homo sapien
gaggattcaaaaccaaaatgctatt

SEQ ID NO: 67285 - DNA, 25 bp, Homo sapien
gaggattcaaaactaaaatgctatt

SEQ ID NO: 67286 - DNA, 25 bp, Homo sapien
gaggattggaatagaatatgggcat

SEQ ID NO: 67287 - DNA, 25 bp, Homo sapien
gaggattggcatagaatatgggcat

SEQ ID NO: 67288 - DNA, 25 bp, Homo sapien
gaggatttaaacggtacagacaggg

SEQ ID NO: 67289 - DNA, 25 bp, Homo sapien
gaggatttaaactgtacagacaggg

SEQ ID NO: 67290 - DNA, 25 bp, Homo sapien
gaggatttctagtacagtagcaagc

SEQ ID NO: 67291 - DNA, 25 bp, Homo sapien
gaggatttctagtatagtagcaagc

SEQ ID NO: 67292 - DNA, 25 bp, Homo sapien
gaggattttattaaacgtattcaca

SEQ ID NO: 67293 - DNA, 25 bp, Homo sapien
gaggattttgttaaacgtattcaca

SEQ ID NO: 67294 - DNA, 25 bp, Homo sapien
gaggcaaaataacttgagatacttt

SEQ ID NO: 67295 - DNA, 25 bp, Homo sapien
gaggcaaaatagcttgagatacttt

SEQ ID NO: 67296 - DNA, 25 bp, Homo sapien
gaggcaaattgcagaatctaatcct

SEQ ID NO: 67297 - DNA, 25 bp, Homo sapien
gaggcaaattgtagaatctaatcct

SEQ ID NO: 67298 - DNA, 25 bp, Homo sapien
gaggcaactcacctctgactcagaa

SEQ ID NO: 67299 - DNA, 25 bp, Homo sapien
gaggcaactcatctctgactcagaa

SEQ ID NO: 67300 - DNA, 25 bp, Homo sapien
gaggcaagactctacttcagtctag

SEQ ID NO: 67301 - DNA, 25 bp, Homo sapien
gaggcaagactctatttcagtctag

SEQ ID NO: 67302 - DNA, 25 bp, Homo sapien
gaggcaagagacaacctgaaggaat

SEQ ID NO: 67303 - DNA, 25 bp, Homo sapien
gaggcaagagataacctgaaggaat

SEQ ID NO: 67304 - DNA, 25 bp, Homo sapien
gaggcaatctgcatagcatcagaac

SEQ ID NO: 67305 - DNA, 25 bp, Homo sapien
gaggcaatctgcatggcatcagaac

SEQ ID NO: 67306 - DNA, 25 bp, Homo sapien
gaggcaatggagtaaagaggagtga

SEQ ID NO: 67307 - DNA, 25 bp, Homo sapien
gaggcaatggagtgaagaggagtga

SEQ ID NO: 67308 - DNA, 25 bp, Homo sapien
gaggcacaactgatggcaagctatg

SEQ ID NO: 67309 - DNA, 25 bp, Homo sapien
gaggcacacctgatggcaagctatg

SEQ ID NO: 67310 - DNA, 25 bp, Homo sapien
gaggcacgcatatgcggtagttcta

SEQ ID NO: 67311 - DNA, 25 bp, Homo sapien
gaggcacgcatgtgcggtagttcta

SEQ ID NO: 67312 - DNA, 25 bp, Homo sapien
gaggcactgaaaacctaaatttcct

SEQ ID NO: 67313 - DNA, 25 bp, Homo sapien
gaggcactgaatacctaaatttcct

SEQ ID NO: 67314 - DNA, 25 bp, Homo sapien
gaggcacttgcaggatctcagccat

SEQ ID NO: 67315 - DNA, 25 bp, Homo sapien
gaggcactttcaggatctcagccat

SEQ ID NO: 67316 - DNA, 25 bp, Homo sapien
gaggcagaaaattcgcatttccaaa

SEQ ID NO: 67317 - DNA, 25 bp, Homo sapien
gaggcagaaaatttgcatttccaaa

SEQ ID NO: 67318 - DNA, 25 bp, Homo sapien
gaggcaggaagacttaccttgaatc

SEQ ID NO: 67319 - DNA, 25 bp, Homo sapien
gaggcagggaacccagaaggacaga

SEQ ID NO: 67320 - DNA, 25 bp, Homo sapien
gaggcagggaacccagcaggacaga

SEQ ID NO: 67321 - DNA, 25 bp, Homo sapien
gaggcagggagacttaccttgaatc

SEQ ID NO: 67322 - DNA, 25 bp, Homo sapien
gaggcaggtagagggactctcattc

SEQ ID NO: 67323 - DNA, 25 bp, Homo sapien
gaggcaggtagagggattctcattc

SEQ ID NO: 67324 - DNA, 25 bp, Homo sapien
gaggcagtgctcctttcgcgagggc

SEQ ID NO: 67325 - DNA, 25 bp, Homo sapien
gaggcagtgctccttttgcgagggc

SEQ ID NO: 67326 - DNA, 25 bp, Homo sapien
gaggcatcagttactatcaccaaca

SEQ ID NO: 67327 - DNA, 25 bp, Homo sapien
gaggcatccgaaatcggttcagatc

SEQ ID NO: 67328 - DNA, 25 bp, Homo sapien
gaggcatcctacaagcattgtgacg

SEQ ID NO: 67329 - DNA, 25 bp, Homo sapien
gaggcatcctactagcattgtgacg

SEQ ID NO: 67330 - DNA, 25 bp, Homo sapien
gaggcatcggaaatcggttcagatc

SEQ ID NO: 67331 - DNA, 25 bp, Homo sapien
gaggcatcggttactatcaccaaca

SEQ ID NO: 67332 - DNA, 25 bp, Homo sapien
gaggcatgctaattgtatgggatca

SEQ ID NO: 67333 - DNA, 25 bp, Homo sapien
gaggcatgctaattgtgtgggatca

SEQ ID NO: 67334 - DNA, 25 bp, Homo sapien
gaggccaaagcccatggaaccaatc

SEQ ID NO: 67335 - DNA, 25 bp, Homo sapien
gaggccaagagaatttcctggcggc

SEQ ID NO: 67336 - DNA, 25 bp, Homo sapien
gaggccaagaggatttcctggcggc

SEQ ID NO: 67337 - DNA, 25 bp, Homo sapien
gaggccaaggcccatggaaccaatc

SEQ ID NO: 67338 - DNA, 25 bp, Homo sapien
gaggccacataaagttagatcttct

SEQ ID NO: 67339 - DNA, 25 bp, Homo sapien
gaggccacgtaaagttagatcttct

SEQ ID NO: 67340 - DNA, 25 bp, Homo sapien
gaggccattgccatgttcagcttgg

SEQ ID NO: 67341 - DNA, 25 bp, Homo sapien
gaggccattgctatgttcagcttgg

SEQ ID NO: 67342 - DNA, 25 bp, Homo sapien
gaggccgagatgggtctatcaatgg

SEQ ID NO: 67343 - DNA, 25 bp, Homo sapien
gaggccgagatggttctatcaatgg

SEQ ID NO: 67344 - DNA, 25 bp, Homo sapien
gaggccgttttcttctggtaggttg

SEQ ID NO: 67345 - DNA, 25 bp, Homo sapien
gaggccgttttcttttggtaggttg

SEQ ID NO: 67346 - DNA, 25 bp, Homo sapien
gaggcctacgaaaaggttccaaacc

SEQ ID NO: 67347 - DNA, 25 bp, Homo sapien
gaggcctatgaaaaggttccaaacc

SEQ ID NO: 67348 - DNA, 25 bp, Homo sapien
gaggcctcccaagacagtctcctgg

SEQ ID NO: 67349 - DNA, 25 bp, Homo sapien
gaggcctcccaggacagtctcctgg

SEQ ID NO: 67350 - DNA, 25 bp, Homo sapien
gaggcctctagcaattgccaacaaa

SEQ ID NO: 67351 - DNA, 25 bp, Homo sapien
gaggcctctagcagttgccaacaaa

SEQ ID NO: 67352 - DNA, 25 bp, Homo sapien
gaggcctgtacattcgtttaattaa

SEQ ID NO: 67353 - DNA, 25 bp, Homo sapien
gaggcctgtacgttcgtttaattaa

SEQ ID NO: 67354 - DNA, 25 bp, Homo sapien
gaggcctttttgctctctgcatccc

SEQ ID NO: 67355 - DNA, 25 bp, Homo sapien
gaggcctttttgttctctgcatccc

SEQ ID NO: 67356 - DNA, 25 bp, Homo sapien
gaggctaaaataaacagtcttcatt

SEQ ID NO: 67357 - DNA, 25 bp, Homo sapien
gaggctaaaataaatagtcttcatt

SEQ ID NO: 67358 - DNA, 25 bp, Homo sapien
gaggctagggtaatcacgacaacac

SEQ ID NO: 67359 - DNA, 25 bp, Homo sapien
gaggctagggtaatcatgacaacac

SEQ ID NO: 67360 - DNA, 25 bp, Homo sapien
gaggctagggtcctccatttaagcc

SEQ ID NO: 67361 - DNA, 25 bp, Homo sapien
gaggctagtgtcctccatttaagcc

SEQ ID NO: 67362 - DNA, 25 bp, Homo sapien
gaggctatgtatcacacagtgcaaa

SEQ ID NO: 67363 - DNA, 25 bp, Homo sapien
gaggctatgtatcagacagtgcaaa

SEQ ID NO: 67364 - DNA, 25 bp, Homo sapien
gaggctcacatgacctctgcacttg

SEQ ID NO: 67365 - DNA, 25 bp, Homo sapien
gaggctcacgtgacctctgcacttg

SEQ ID NO: 67366 - DNA, 25 bp, Homo sapien
gaggctccatgcagacaggtgacat

SEQ ID NO: 67367 - DNA, 25 bp, Homo sapien
gaggctccgccccatcaggtacaga

SEQ ID NO: 67368 - DNA, 25 bp, Homo sapien
gaggctccgccctatcaggtacaga

SEQ ID NO: 67369 - DNA, 25 bp, Homo sapien
gaggctccgctacataggcatgctt

SEQ ID NO: 67370 - DNA, 25 bp, Homo sapien
gaggctccgctacgtaggcatgctt

SEQ ID NO: 67371 - DNA, 25 bp, Homo sapien
gaggctccgtgcagacaggtgacat

SEQ ID NO: 67372 - DNA, 25 bp, Homo sapien
gaggctgagccacagaggaatgtgt

SEQ ID NO: 67373 - DNA, 25 bp, Homo sapien
gaggctgagtcacagaggaatgtgt

SEQ ID NO: 67374 - DNA, 25 bp, Homo sapien
gaggctgcaaacttctgcaatgtag

SEQ ID NO: 67375 - DNA, 25 bp, Homo sapien
gaggctgcaaatttctgcaatgtag

SEQ ID NO: 67376 - DNA, 25 bp, Homo sapien
gaggctggagtgtaataagcaagag

SEQ ID NO: 67377 - DNA, 25 bp, Homo sapien
gaggctggagtgtaatgagcaagag

SEQ ID NO: 67378 - DNA, 25 bp, Homo sapien
gaggctggcaacagattgtgaacat

SEQ ID NO: 67379 - DNA, 25 bp, Homo sapien
gaggctggcaacaggttgtgaacat

SEQ ID NO: 67380 - DNA, 25 bp, Homo sapien
gaggctgttattttaaatggaagaa

SEQ ID NO: 67381 - DNA, 25 bp, Homo sapien
gaggctgttattttaagtggaagaa

SEQ ID NO: 67382 - DNA, 25 bp, Homo sapien
gaggcttagagaactaaagtaactt

SEQ ID NO: 67383 - DNA, 25 bp, Homo sapien
gaggcttagagagctaaagtaactt

SEQ ID NO: 67384 - DNA, 25 bp, Homo sapien
gaggcttatcaagctccttctatga

SEQ ID NO: 67385 - DNA, 25 bp, Homo sapien
gaggcttatcaagttccttctatga

SEQ ID NO: 67386 - DNA, 25 bp, Homo sapien
gaggcttatttctaaactccttatc

SEQ ID NO: 67387 - DNA, 25 bp, Homo sapien
gaggcttatttttaaactccttatc

SEQ ID NO: 67388 - DNA, 25 bp, Homo sapien
gaggcttcaaacgactggtttataa

SEQ ID NO: 67389 - DNA, 25 bp, Homo sapien
gaggcttcaaatgactggtttataa

SEQ ID NO: 67390 - DNA, 25 bp, Homo sapien
gaggcttcaagaagtctgtttcccc

SEQ ID NO: 67391 - DNA, 25 bp, Homo sapien
gaggcttcacagctaattgacagaa

SEQ ID NO: 67392 - DNA, 25 bp, Homo sapien
gaggcttcacagttaattgacagaa

SEQ ID NO: 67393 - DNA, 25 bp, Homo sapien
gaggcttcagcataagatcccacag

SEQ ID NO: 67394 - DNA, 25 bp, Homo sapien
gaggcttcagcgtaagatcccacag

SEQ ID NO: 67395 - DNA, 25 bp, Homo sapien
gaggcttcaggaagtctgtttcccc

SEQ ID NO: 67396 - DNA, 25 bp, Homo sapien
gagggaaaaaaacagaccaatccac

SEQ ID NO: 67397 - DNA, 25 bp, Homo sapien
gagggaaaacaccaagacaaaaatg

SEQ ID NO: 67398 - DNA, 25 bp, Homo sapien
gagggaaaacatcaagacaaaaatg

SEQ ID NO: 67399 - DNA, 25 bp, Homo sapien
gagggaaagaaacagaccaatccac

SEQ ID NO: 67400 - DNA, 25 bp, Homo sapien
gagggaaagaactttgagagtgact

SEQ ID NO: 67401 - DNA, 25 bp, Homo sapien
gagggaaataactttgagagtgact

SEQ ID NO: 67402 - DNA, 25 bp, Homo sapien
gagggaaatatacagctgcaaatgc

SEQ ID NO: 67403 - DNA, 25 bp, Homo sapien
gagggaaatatatagctgcaaatgc

SEQ ID NO: 67404 - DNA, 25 bp, Homo sapien
gagggaagaaccaatacggtaatgg

SEQ ID NO: 67405 - DNA, 25 bp, Homo sapien
gagggaagaaccaatatggtaatgg

SEQ ID NO: 67406 - DNA, 25 bp, Homo sapien
gagggaagatcatttgagctcagca

SEQ ID NO: 67407 - DNA, 25 bp, Homo sapien
gagggaagatcgtttgagctcagca

SEQ ID NO: 67408 - DNA, 25 bp, Homo sapien
gagggaaggacatgataggatccat

SEQ ID NO: 67409 - DNA, 25 bp, Homo sapien
gagggaaggccatgataggatccat

SEQ ID NO: 67410 - DNA, 25 bp, Homo sapien
gagggaatgctcagtgtgactgagg

SEQ ID NO: 67411 - DNA, 25 bp, Homo sapien
gagggaatgcttagtgtgactgagg

SEQ ID NO: 67412 - DNA, 25 bp, Homo sapien
gagggacctaggctgtgctccttat

SEQ ID NO: 67413 - DNA, 25 bp, Homo sapien
gagggacctagtctgtgctccttat

SEQ ID NO: 67414 - DNA, 25 bp, Homo sapien
gagggacctgttgcgccactgcagt

SEQ ID NO: 67415 - DNA, 25 bp, Homo sapien
gagggacctgttgtgccactgcagt

SEQ ID NO: 67416 - DNA, 25 bp, Homo sapien
gagggaccttctatcgcccatgtga

SEQ ID NO: 67417 - DNA, 25 bp, Homo sapien
gagggaccttctgtcgcccatgtga

SEQ ID NO: 67418 - DNA, 25 bp, Homo sapien
gagggactcgccacttcttctgtct

SEQ ID NO: 67419 - DNA, 25 bp, Homo sapien
gagggacttgccacttcttctgtct

SEQ ID NO: 67420 - DNA, 25 bp, Homo sapien
gagggagagaaccgctaaaataaag

SEQ ID NO: 67421 - DNA, 25 bp, Homo sapien
gagggagagaatcgctaaaataaag

SEQ ID NO: 67422 - DNA, 25 bp, Homo sapien
gagggagatggacaattcatcaggc

SEQ ID NO: 67423 - DNA, 25 bp, Homo sapien
gagggagatggacgattcatcaggc

SEQ ID NO: 67424 - DNA, 25 bp, Homo sapien
gagggagctgcaaccaatggtcaaa

SEQ ID NO: 67425 - DNA, 25 bp, Homo sapien
gagggagctgcgaccaatggtcaaa

SEQ ID NO: 67426 - DNA, 25 bp, Homo sapien
gagggaggaacagtcacttctggtc

SEQ ID NO: 67427 - DNA, 25 bp, Homo sapien
gagggaggaacagtgacttctggtc

SEQ ID NO: 67428 - DNA, 25 bp, Homo sapien
gagggatataagaggaaattttaaa

SEQ ID NO: 67429 - DNA, 25 bp, Homo sapien
gagggatataagcggaaattttaaa

SEQ ID NO: 67430 - DNA, 25 bp, Homo sapien
gagggatatacactgtagctaaagt

SEQ ID NO: 67431 - DNA, 25 bp, Homo sapien
gagggatatacattgtagctaaagt

SEQ ID NO: 67432 - DNA, 25 bp, Homo sapien
gagggatgatgttacccagagccca

SEQ ID NO: 67433 - DNA, 25 bp, Homo sapien
gagggatgatgttatccagagccca

SEQ ID NO: 67434 - DNA, 25 bp, Homo sapien
gagggatgcataataattttccgtg

SEQ ID NO: 67435 - DNA, 25 bp, Homo sapien
gagggatgcataatgattttccgtg

SEQ ID NO: 67436 - DNA, 25 bp, Homo sapien
gagggcacctgaatccacaagatga

SEQ ID NO: 67437 - DNA, 25 bp, Homo sapien
gagggcacctgattccacaagatga

SEQ ID NO: 67438 - DNA, 25 bp, Homo sapien
gagggcactaaccatcttgacttga

SEQ ID NO: 67439 - DNA, 25 bp, Homo sapien
gagggcactaaccgtcttgacttga

SEQ ID NO: 67440 - DNA, 25 bp, Homo sapien
gagggcatctgggaaagattttctc

SEQ ID NO: 67441 - DNA, 25 bp, Homo sapien
gagggcatctgggagagattttctc

SEQ ID NO: 67442 - DNA, 25 bp, Homo sapien
gagggcatttcaataaaggaaggtc

SEQ ID NO: 67443 - DNA, 25 bp, Homo sapien
gagggcatttcaatgaaggaaggtc

SEQ ID NO: 67444 - DNA, 25 bp, Homo sapien
gagggccacaagatcagataagtga

SEQ ID NO: 67445 - DNA, 25 bp, Homo sapien
gagggccacaaggtcagataagtga

SEQ ID NO: 67446 - DNA, 25 bp, Homo sapien
gagggccactaccttctgagaaaca

SEQ ID NO: 67447 - DNA, 25 bp, Homo sapien
gagggccactactttctgagaaaca

SEQ ID NO: 67448 - DNA, 25 bp, Homo sapien
gagggccagttgaaaaatgtagtgc

SEQ ID NO: 67449 - DNA, 25 bp, Homo sapien
gagggccagttgaataatgtagtgc

SEQ ID NO: 67450 - DNA, 25 bp, Homo sapien
gagggcttacctgcttaggcacctg

SEQ ID NO: 67451 - DNA, 25 bp, Homo sapien
gagggcttacctggttaggcacctg

SEQ ID NO: 67452 - DNA, 25 bp, Homo sapien
gagggcttctcaagtataaaacctt

SEQ ID NO: 67453 - DNA, 25 bp, Homo sapien
gagggcttgtcaagtataaaacctt

SEQ ID NO: 67454 - DNA, 25 bp, Homo sapien
gaggggaatgccataaacagaagta

SEQ ID NO: 67455 - DNA, 25 bp, Homo sapien
gaggggaatgccgtaaacagaagta

SEQ ID NO: 67456 - DNA, 25 bp, Homo sapien
gaggggacattctacgactctctaa

SEQ ID NO: 67457 - DNA, 25 bp, Homo sapien
gaggggacattctatgactctctaa

SEQ ID NO: 67458 - DNA, 25 bp, Homo sapien
gaggggcagtgtccagcaatggata

SEQ ID NO: 67459 - DNA, 25 bp, Homo sapien
gaggggcagtgtccaggaatggata

SEQ ID NO: 67460 - DNA, 25 bp, Homo sapien
gaggggctcttccaccttcgcttcc

SEQ ID NO: 67461 - DNA, 25 bp, Homo sapien
gaggggctgtgactttcgctgattc

SEQ ID NO: 67462 - DNA, 25 bp, Homo sapien
gaggggctgtgacttttgctgattc

SEQ ID NO: 67463 - DNA, 25 bp, Homo sapien
gaggggcttttccaccttcgcttcc

SEQ ID NO: 67464 - DNA, 25 bp, Homo sapien
gagggggaaaaggagactacatgag

SEQ ID NO: 67465 - DNA, 25 bp, Homo sapien
gagggggaaaaggagattacatgag

SEQ ID NO: 67466 - DNA, 25 bp, Homo sapien
gagggggaatctgttcttagcccac

SEQ ID NO: 67467 - DNA, 25 bp, Homo sapien
gagggggagtctgttcttagcccac

SEQ ID NO: 67468 - DNA, 25 bp, Homo sapien
gagggggatgtgcggctgagtggcc

SEQ ID NO: 67469 - DNA, 25 bp, Homo sapien
gagggggatgtgtggctgagtggcc

SEQ ID NO: 67470 - DNA, 25 bp, Homo sapien
gaggggttagcacggaagaattgag

SEQ ID NO: 67471 - DNA, 25 bp, Homo sapien
gaggggtttgcacggaagaattgag

SEQ ID NO: 67472 - DNA, 25 bp, Homo sapien
gagggtaacatctacggatctgtgg

SEQ ID NO: 67473 - DNA, 25 bp, Homo sapien
gagggtaacatctacgtatctgtgg

SEQ ID NO: 67474 - DNA, 25 bp, Homo sapien
gagggtagcacacatccagaaacat

SEQ ID NO: 67475 - DNA, 25 bp, Homo sapien
gagggtagcacatatccagaaacat

SEQ ID NO: 67476 - DNA, 25 bp, Homo sapien
gagggtatcttgcatttgtcttggt

SEQ ID NO: 67477 - DNA, 25 bp, Homo sapien
gagggtattttgcatttgtcttggt

SEQ ID NO: 67478 - DNA, 25 bp, Homo sapien
gagggtcatctcagccccaggatcc

SEQ ID NO: 67479 - DNA, 25 bp, Homo sapien
gagggtcatgtcagccccaggatcc

SEQ ID NO: 67480 - DNA, 25 bp, Homo sapien
gagggtctccaacaggatgggctta

SEQ ID NO: 67481 - DNA, 25 bp, Homo sapien
gagggtctccaataggatgggctta

SEQ ID NO: 67482 - DNA, 25 bp, Homo sapien
gagggtggaagaatgaaagaacgac

SEQ ID NO: 67483 - DNA, 25 bp, Homo sapien
gagggtggaagaatgagagaacgac

SEQ ID NO: 67484 - DNA, 25 bp, Homo sapien
gagggttgcattgcatgtcagtatg

SEQ ID NO: 67485 - DNA, 25 bp, Homo sapien
gagggttgcgttgcatgtcagtatg

SEQ ID NO: 67486 - DNA, 25 bp, Homo sapien
gagggtttcacagatgagaaaaatt

SEQ ID NO: 67487 - DNA, 25 bp, Homo sapien
gagggtttcacagatgggaaaaatt

SEQ ID NO: 67488 - DNA, 25 bp, Homo sapien
gaggtaaaaagatgacaaacagcct

SEQ ID NO: 67489 - DNA, 25 bp, Homo sapien
gaggtaaaaagctgacaaacagcct

SEQ ID NO: 67490 - DNA, 25 bp, Homo sapien
gaggtaaacgattcttctcattgag

SEQ ID NO: 67491 - DNA, 25 bp, Homo sapien
gaggtaaatgattcttctcattgag

SEQ ID NO: 67492 - DNA, 25 bp, Homo sapien
gaggtaacccggcatcatggagaaa

SEQ ID NO: 67493 - DNA, 25 bp, Homo sapien
gaggtaacccggcatcctggagaaa

SEQ ID NO: 67494 - DNA, 25 bp, Homo sapien
gaggtaactgtggccaagattcaag

SEQ ID NO: 67495 - DNA, 25 bp, Homo sapien
gaggtaactgtgtccaagattcaag

SEQ ID NO: 67496 - DNA, 25 bp, Homo sapien
gaggtaggcctctttgtgtaataat

SEQ ID NO: 67497 - DNA, 25 bp, Homo sapien
gaggtaggcctttttgtgtaataat

SEQ ID NO: 67498 - DNA, 25 bp, Homo sapien
gaggtagggccttgtacgcctgagc

SEQ ID NO: 67499 - DNA, 25 bp, Homo sapien
gaggtagggccttgtatgcctgagc

SEQ ID NO: 67500 - DNA, 25 bp, Homo sapien
gaggtatagagatgttaaccacttg

SEQ ID NO: 67501 - DNA, 25 bp, Homo sapien
gaggtatagagattttaaccacttg

SEQ ID NO: 67502 - DNA, 25 bp, Homo sapien
gaggtatcagactatataaaaatca

SEQ ID NO: 67503 - DNA, 25 bp, Homo sapien
gaggtatcggactatataaaaatca

SEQ ID NO: 67504 - DNA, 25 bp, Homo sapien
gaggtatgaaactatcacacgcagg

SEQ ID NO: 67505 - DNA, 25 bp, Homo sapien
gaggtatgaaactgtcacacgcagg

SEQ ID NO: 67506 - DNA, 25 bp, Homo sapien
gaggtatgcaggcttcaggcacagt

SEQ ID NO: 67507 - DNA, 25 bp, Homo sapien
gaggtatgcaggtttcaggcacagt

SEQ ID NO: 67508 - DNA, 25 bp, Homo sapien
gaggtatgcgttaaggtctttggcc

SEQ ID NO: 67509 - DNA, 25 bp, Homo sapien
gaggtatgtacacattttcccagtg

SEQ ID NO: 67510 - DNA, 25 bp, Homo sapien
gaggtatgtactcattttcccagtg

SEQ ID NO: 67511 - DNA, 25 bp, Homo sapien
gaggtatgtgttaaggtctttggcc

SEQ ID NO: 67512 - DNA, 25 bp, Homo sapien
gaggtattctgaaatcctcaaaact

SEQ ID NO: 67513 - DNA, 25 bp, Homo sapien
gaggtattctggaatcctcaaaact

SEQ ID NO: 67514 - DNA, 25 bp, Homo sapien
gaggtatttcttgagccgagacttt

SEQ ID NO: 67515 - DNA, 25 bp, Homo sapien
gaggtatttcttgagctgagacttt

SEQ ID NO: 67516 - DNA, 25 bp, Homo sapien
gaggtcaatactcaaaacttaaagt

SEQ ID NO: 67517 - DNA, 25 bp, Homo sapien
gaggtcaatactgaaaacttaaagt

SEQ ID NO: 67518 - DNA, 25 bp, Homo sapien
gaggtcacgtgataccaacaaggtg

SEQ ID NO: 67519 - DNA, 25 bp, Homo sapien
gaggtcacgtgatatcaacaaggtg

SEQ ID NO: 67520 - DNA, 25 bp, Homo sapien
gaggtcacttcataagcttcatcag

SEQ ID NO: 67521 - DNA, 25 bp, Homo sapien
gaggtcacttcatgagcttcatcag

SEQ ID NO: 67522 - DNA, 25 bp, Homo sapien
gaggtcagactttgtcctatttagg

SEQ ID NO: 67523 - DNA, 25 bp, Homo sapien
gaggtcagtctttgtcctatttagg

SEQ ID NO: 67524 - DNA, 25 bp, Homo sapien
gaggtccaaattattatttccatct

SEQ ID NO: 67525 - DNA, 25 bp, Homo sapien
gaggtccagattattatttccatct

SEQ ID NO: 67526 - DNA, 25 bp, Homo sapien
gaggtccatggatgctatgtgtctg

SEQ ID NO: 67527 - DNA, 25 bp, Homo sapien
gaggtccatggttgctatgtgtctg

SEQ ID NO: 67528 - DNA, 25 bp, Homo sapien
gaggtcccaagaagccaagaaatgt

SEQ ID NO: 67529 - DNA, 25 bp, Homo sapien
gaggtcccaagaagccgagaaatgt

SEQ ID NO: 67530 - DNA, 25 bp, Homo sapien
gaggtctattttcataactagaaga

SEQ ID NO: 67531 - DNA, 25 bp, Homo sapien
gaggtctattttcgtaactagaaga

SEQ ID NO: 67532 - DNA, 25 bp, Homo sapien
gaggtctgaagtcaccctcctgccc

SEQ ID NO: 67533 - DNA, 25 bp, Homo sapien
gaggtctgaatttgatgacagactt

SEQ ID NO: 67534 - DNA, 25 bp, Homo sapien
gaggtctgaatttggtgacagactt

SEQ ID NO: 67535 - DNA, 25 bp, Homo sapien
gaggtctgatcccactattgaaata

SEQ ID NO: 67536 - DNA, 25 bp, Homo sapien
gaggtctgatcccgctattgaaata

SEQ ID NO: 67537 - DNA, 25 bp, Homo sapien
gaggtctggagtcaccctcctgccc

SEQ ID NO: 67538 - DNA, 25 bp, Homo sapien
gaggtctggatttcacagctagtat

SEQ ID NO: 67539 - DNA, 25 bp, Homo sapien
gaggtctggatttcacggctagtat

SEQ ID NO: 67540 - DNA, 25 bp, Homo sapien
gaggtgaaaacttgtctaggtttca

SEQ ID NO: 67541 - DNA, 25 bp, Homo sapien
gaggtgaaaacttttctaggtttca

SEQ ID NO: 67542 - DNA, 25 bp, Homo sapien
gaggtgaagttcgaaggatcactcg

SEQ ID NO: 67543 - DNA, 25 bp, Homo sapien
gaggtgaagtttgaaggatcactcg

SEQ ID NO: 67544 - DNA, 25 bp, Homo sapien
gaggtgagactggttactcctccgt

SEQ ID NO: 67545 - DNA, 25 bp, Homo sapien
gaggtgagactggttattcctccgt

SEQ ID NO: 67546 - DNA, 25 bp, Homo sapien
gaggtgagtccttggccgccggaca

SEQ ID NO: 67547 - DNA, 25 bp, Homo sapien
gaggtgagtccttggctgccggaca

SEQ ID NO: 67548 - DNA, 25 bp, Homo sapien
gaggtgattgcttggcttcctcaga

SEQ ID NO: 67549 - DNA, 25 bp, Homo sapien
gaggtgatttcttggcttcctcaga

SEQ ID NO: 67550 - DNA, 25 bp, Homo sapien
gaggtgccataattattaaacatga

SEQ ID NO: 67551 - DNA, 25 bp, Homo sapien
gaggtgccgtaattattaaacatga

SEQ ID NO: 67552 - DNA, 25 bp, Homo sapien
gaggtgctcttaagcaaacgaagaa

SEQ ID NO: 67553 - DNA, 25 bp, Homo sapien
gaggtgctcttaaggaaacgaagaa

SEQ ID NO: 67554 - DNA, 25 bp, Homo sapien
gaggtggacataatttaccctcagc

SEQ ID NO: 67555 - DNA, 25 bp, Homo sapien
gaggtggacgtaatttaccctcagc

SEQ ID NO: 67556 - DNA, 25 bp, Homo sapien
gaggtggcaatacagaagtagccca

SEQ ID NO: 67557 - DNA, 25 bp, Homo sapien
gaggtggcaatatagaagtagccca

SEQ ID NO: 67558 - DNA, 25 bp, Homo sapien
gaggtggcagatgtgaagtggccct

SEQ ID NO: 67559 - DNA, 25 bp, Homo sapien
gaggtggcagatttgaagtggccct

SEQ ID NO: 67560 - DNA, 25 bp, Homo sapien
gaggtggggatcctggcttcagtac

SEQ ID NO: 67561 - DNA, 25 bp, Homo sapien
gaggtggggatcctgggttcagtac

SEQ ID NO: 67562 - DNA, 25 bp, Homo sapien
gaggtggtataacatctagttagag

SEQ ID NO: 67563 - DNA, 25 bp, Homo sapien
gaggtggtataatatctagttagag

SEQ ID NO: 67564 - DNA, 25 bp, Homo sapien
gaggtggtcaccaggaataagttgt

SEQ ID NO: 67565 - DNA, 25 bp, Homo sapien
gaggtggtcaccaggagtaagttgt

SEQ ID NO: 67566 - DNA, 25 bp, Homo sapien
gaggtggtcattatcctgatttcta

SEQ ID NO: 67567 - DNA, 25 bp, Homo sapien
gaggtggtctttatcctgatttcta

SEQ ID NO: 67568 - DNA, 25 bp, Homo sapien
gaggtgtggctgaccatccaaagga

SEQ ID NO: 67569 - DNA, 25 bp, Homo sapien
gaggtgtggctgagcatccaaagga

SEQ ID NO: 67570 - DNA, 25 bp, Homo sapien
gaggtgttactggttgcgtgttaac

SEQ ID NO: 67571 - DNA, 25 bp, Homo sapien
gaggtgttactggttgtgtgttaac

SEQ ID NO: 67572 - DNA, 25 bp, Homo sapien
gaggttaaactctgttaatatgttt

SEQ ID NO: 67573 - DNA, 25 bp, Homo sapien
gaggttaaactcttttaatatgttt

SEQ ID NO: 67574 - DNA, 25 bp, Homo sapien
gaggttaagaacgagtaataagacc

SEQ ID NO: 67575 - DNA, 25 bp, Homo sapien
gaggttaagaatgagtaataagacc

SEQ ID NO: 67576 - DNA, 25 bp, Homo sapien
gaggttatggcttcccttacataag

SEQ ID NO: 67577 - DNA, 25 bp, Homo sapien
gaggttatggctttccttacataag

SEQ ID NO: 67578 - DNA, 25 bp, Homo sapien
gaggttcaatcatttgtcacttttg

SEQ ID NO: 67579 - DNA, 25 bp, Homo sapien
gaggttcaatcctagggctcatgac

SEQ ID NO: 67580 - DNA, 25 bp, Homo sapien
gaggttcagtcatttgtcacttttg

SEQ ID NO: 67581 - DNA, 25 bp, Homo sapien
gaggttcagtcctagggctcatgac

SEQ ID NO: 67582 - DNA, 25 bp, Homo sapien
gaggttccaatgcatgctaccatgt

SEQ ID NO: 67583 - DNA, 25 bp, Homo sapien
gaggttccgatgcatgctaccatgt

SEQ ID NO: 67584 - DNA, 25 bp, Homo sapien
gaggttcctcgtgccatcttcagga

SEQ ID NO: 67585 - DNA, 25 bp, Homo sapien
gaggttcctcgtgtcatcttcagga

SEQ ID NO: 67586 - DNA, 25 bp, Homo sapien
gaggttctccacagctgcctgcgac

SEQ ID NO: 67587 - DNA, 25 bp, Homo sapien
gaggttctccacggctgcctgcgac

SEQ ID NO: 67588 - DNA, 25 bp, Homo sapien
gaggttctgcacctactgattcaaa

SEQ ID NO: 67589 - DNA, 25 bp, Homo sapien
gaggttctgcatctactgattcaaa

SEQ ID NO: 67590 - DNA, 25 bp, Homo sapien
gaggttgacgaaatattatgcaact

SEQ ID NO: 67591 - DNA, 25 bp, Homo sapien
gaggttgatgaaatattatgcaact

SEQ ID NO: 67592 - DNA, 25 bp, Homo sapien
gaggttgccatctagccttcctcac

SEQ ID NO: 67593 - DNA, 25 bp, Homo sapien
gaggttgccgtctagccttcctcac

SEQ ID NO: 67594 - DNA, 25 bp, Homo sapien
gaggttggttataagcaatgcatga

SEQ ID NO: 67595 - DNA, 25 bp, Homo sapien
gaggttggttataggcaatgcatga

SEQ ID NO: 67596 - DNA, 25 bp, Homo sapien
gaggttgtgcgtttaagaagactca

SEQ ID NO: 67597 - DNA, 25 bp, Homo sapien
gaggttgtgtgtttaagaagactca

SEQ ID NO: 67598 - DNA, 25 bp, Homo sapien
gaggtttaaaaatatactaggggaa

SEQ ID NO: 67599 - DNA, 25 bp, Homo sapien
gaggtttaatatatgactgctgact

SEQ ID NO: 67600 - DNA, 25 bp, Homo sapien
gaggtttaatatatgagtgctgact

SEQ ID NO: 67601 - DNA, 25 bp, Homo sapien
gaggtttaccttggaccctgacaca

SEQ ID NO: 67602 - DNA, 25 bp, Homo sapien
gaggtttaccttggactctgacaca

SEQ ID NO: 67603 - DNA, 25 bp, Homo sapien
gaggtttagaaatatactaggggaa

SEQ ID NO: 67604 - DNA, 25 bp, Homo sapien
gaggtttctacagagtaacaaaaca

SEQ ID NO: 67605 - DNA, 25 bp, Homo sapien
gaggtttctacagagtgacaaaaca

SEQ ID NO: 67606 - DNA, 25 bp, Homo sapien
gaggtttgccactaggatttcccct

SEQ ID NO: 67607 - DNA, 25 bp, Homo sapien
gaggtttgccctagagtaggtatca

SEQ ID NO: 67608 - DNA, 25 bp, Homo sapien
gaggtttgccctagcgtaggtatca

SEQ ID NO: 67609 - DNA, 25 bp, Homo sapien
gaggtttgcctatgtgattaaatga

SEQ ID NO: 67610 - DNA, 25 bp, Homo sapien
gaggtttgcttatgtgattaaatga

SEQ ID NO: 67611 - DNA, 25 bp, Homo sapien
gaggtttggctacacagatgatgga

SEQ ID NO: 67612 - DNA, 25 bp, Homo sapien
gaggtttggttacacagatgatgga

SEQ ID NO: 67613 - DNA, 25 bp, Homo sapien
gaggtttgtcactaggatttcccct

SEQ ID NO: 67614 - DNA, 25 bp, Homo sapien
gagtaaacaacccattcaagacaat

SEQ ID NO: 67615 - DNA, 25 bp, Homo sapien
gagtaaacaacccgttcaagacaat

SEQ ID NO: 67616 - DNA, 25 bp, Homo sapien
gagtaaagatgtaaaacagggaagc

SEQ ID NO: 67617 - DNA, 25 bp, Homo sapien
gagtaaagatgtcaaacagggaagc

SEQ ID NO: 67618 - DNA, 25 bp, Homo sapien
gagtaaagcaaaaagtagaggaaat

SEQ ID NO: 67619 - DNA, 25 bp, Homo sapien
gagtaaagcaaagagtagaggaaat

SEQ ID NO: 67620 - DNA, 25 bp, Homo sapien
gagtaaataagtatcttgttgagta

SEQ ID NO: 67621 - DNA, 25 bp, Homo sapien
gagtaaatatgtatcttgttgagta

SEQ ID NO: 67622 - DNA, 25 bp, Homo sapien
gagtaaccaaaaacaggtatgaaca

SEQ ID NO: 67623 - DNA, 25 bp, Homo sapien
gagtaaccaaaaccaggtatgaaca

SEQ ID NO: 67624 - DNA, 25 bp, Homo sapien
gagtaactgtgataggttccgaagt

SEQ ID NO: 67625 - DNA, 25 bp, Homo sapien
gagtaactgtggtaggttccgaagt

SEQ ID NO: 67626 - DNA, 25 bp, Homo sapien
gagtaactgttgagactaaggttta

SEQ ID NO: 67627 - DNA, 25 bp, Homo sapien
gagtaactgttgggactaaggttta

SEQ ID NO: 67628 - DNA, 25 bp, Homo sapien
gagtaacttctatgtgccaggtacc

SEQ ID NO: 67629 - DNA, 25 bp, Homo sapien
gagtaacttctgtgtgccaggtacc

SEQ ID NO: 67630 - DNA, 25 bp, Homo sapien
gagtaagaaaaaagtaggaatttta

SEQ ID NO: 67631 - DNA, 25 bp, Homo sapien
gagtaagaagaaagtaggaatttta

SEQ ID NO: 67632 - DNA, 25 bp, Homo sapien
gagtaaggagactgattggacttta

SEQ ID NO: 67633 - DNA, 25 bp, Homo sapien
gagtaaggagattgattggacttta

SEQ ID NO: 67634 - DNA, 25 bp, Homo sapien
gagtaaggcgacttgactttgaaag

SEQ ID NO: 67635 - DNA, 25 bp, Homo sapien
gagtaaggtcacaggaaaagatgtc

SEQ ID NO: 67636 - DNA, 25 bp, Homo sapien
gagtaaggtcaccggaaaagatgtc

SEQ ID NO: 67637 - DNA, 25 bp, Homo sapien
gagtaaggtgacttgactttgaaag

SEQ ID NO: 67638 - DNA, 25 bp, Homo sapien
gagtaagtctaataaagcgtggaca

SEQ ID NO: 67639 - DNA, 25 bp, Homo sapien
gagtaagtctagtaaagcgtggaca

SEQ ID NO: 67640 - DNA, 25 bp, Homo sapien
gagtaatataacattgtttgtgaca

SEQ ID NO: 67641 - DNA, 25 bp, Homo sapien
gagtaatataatattgtttgtgaca

SEQ ID NO: 67642 - DNA, 25 bp, Homo sapien
gagtaatgcaaaggcgtaatgtggc

SEQ ID NO: 67643 - DNA, 25 bp, Homo sapien
gagtaatgcaaaggtgtaatgtggc

SEQ ID NO: 67644 - DNA, 25 bp, Homo sapien
gagtaattcttacgtggcagtcact

SEQ ID NO: 67645 - DNA, 25 bp, Homo sapien
gagtaattcttatgtggcagtcact

SEQ ID NO: 67646 - DNA, 25 bp, Homo sapien
gagtaattttcactttgaagtcttt

SEQ ID NO: 67647 - DNA, 25 bp, Homo sapien
gagtaattttcacttttaagtcttt

SEQ ID NO: 67648 - DNA, 25 bp, Homo sapien
gagtacaaaaagccatgttaaaaaa

SEQ ID NO: 67649 - DNA, 25 bp, Homo sapien
gagtacaaaaaggcatgttaaaaaa

SEQ ID NO: 67650 - DNA, 25 bp, Homo sapien
gagtacaaaatagtctctgaaacta

SEQ ID NO: 67651 - DNA, 25 bp, Homo sapien
gagtacaaactagtctctgaaacta

SEQ ID NO: 67652 - DNA, 25 bp, Homo sapien
gagtacaaactatctacagcagttt

SEQ ID NO: 67653 - DNA, 25 bp, Homo sapien
gagtacaaattatctacagcagttt

SEQ ID NO: 67654 - DNA, 25 bp, Homo sapien
gagtacacacggtaaagtttgagaa

SEQ ID NO: 67655 - DNA, 25 bp, Homo sapien
gagtacacacggtcaagtttgagaa

SEQ ID NO: 67656 - DNA, 25 bp, Homo sapien
gagtacagagaagcagaagataaaa

SEQ ID NO: 67657 - DNA, 25 bp, Homo sapien
gagtacagagaagcggaagataaaa

SEQ ID NO: 67658 - DNA, 25 bp, Homo sapien
gagtacagtgcttacaggcagtttc

SEQ ID NO: 67659 - DNA, 25 bp, Homo sapien
gagtacagtgcttataggcagtttc

SEQ ID NO: 67660 - DNA, 25 bp, Homo sapien
gagtacatttccgggtcggctaatt

SEQ ID NO: 67661 - DNA, 25 bp, Homo sapien
gagtacatttctgggtcggctaatt

SEQ ID NO: 67662 - DNA, 25 bp, Homo sapien
gagtacctattgatatgtgtggtgt

SEQ ID NO: 67663 - DNA, 25 bp, Homo sapien
gagtacctgatgtaccagcagccag

SEQ ID NO: 67664 - DNA, 25 bp, Homo sapien
gagtacctgttgatatgtgtggtgt

SEQ ID NO: 67665 - DNA, 25 bp, Homo sapien
gagtacctgttgtaccagcagccag

SEQ ID NO: 67666 - DNA, 25 bp, Homo sapien
gagtacgaaaaaaaactcctgcagt

SEQ ID NO: 67667 - DNA, 25 bp, Homo sapien
gagtacgaaaacaaactcctgcagt

SEQ ID NO: 67668 - DNA, 25 bp, Homo sapien
gagtactacctcagccacagtacaa

SEQ ID NO: 67669 - DNA, 25 bp, Homo sapien
gagtactacttcagccacagtacaa

SEQ ID NO: 67670 - DNA, 25 bp, Homo sapien
gagtacttaacacatgcatgaactc

SEQ ID NO: 67671 - DNA, 25 bp, Homo sapien
gagtacttgacacatgcatgaactc

SEQ ID NO: 67672 - DNA, 25 bp, Homo sapien
gagtacttgacagtgtcctcaataa

SEQ ID NO: 67673 - DNA, 25 bp, Homo sapien
gagtacttgacggtgtcctcaataa

SEQ ID NO: 67674 - DNA, 25 bp, Homo sapien
gagtagaatgtattttatgtctttt

SEQ ID NO: 67675 - DNA, 25 bp, Homo sapien
gagtagaatgtgttttatgtctttt

SEQ ID NO: 67676 - DNA, 25 bp, Homo sapien
gagtagaattatgcagattgattta

SEQ ID NO: 67677 - DNA, 25 bp, Homo sapien
gagtagaattattcagattgattta

SEQ ID NO: 67678 - DNA, 25 bp, Homo sapien
gagtagacacagagaaaatctctgg

SEQ ID NO: 67679 - DNA, 25 bp, Homo sapien
gagtagacgcagagaaaatctctgg

SEQ ID NO: 67680 - DNA, 25 bp, Homo sapien
gagtagagcaagtagcagttttaca

SEQ ID NO: 67681 - DNA, 25 bp, Homo sapien
gagtagagcacgtagcagtatcctg

SEQ ID NO: 67682 - DNA, 25 bp, Homo sapien
gagtagagcacttagcagtatcctg

SEQ ID NO: 67683 - DNA, 25 bp, Homo sapien
gagtagaggtacaacatagcaaaac

SEQ ID NO: 67684 - DNA, 25 bp, Homo sapien
gagtagaggtataacatagcaaaac

SEQ ID NO: 67685 - DNA, 25 bp, Homo sapien
gagtagaggttagtggaattgtttt

SEQ ID NO: 67686 - DNA, 25 bp, Homo sapien
gagtagaggttcgtggaattgtttt

SEQ ID NO: 67687 - DNA, 25 bp, Homo sapien
gagtagagtaagtagcagttttaca

SEQ ID NO: 67688 - DNA, 25 bp, Homo sapien
gagtagatctataccaattcccaca

SEQ ID NO: 67689 - DNA, 25 bp, Homo sapien
gagtagatctataccagttcccaca

SEQ ID NO: 67690 - DNA, 25 bp, Homo sapien
gagtagcacactcaaatgaggaagg

SEQ ID NO: 67691 - DNA, 25 bp, Homo sapien
gagtagcacacttaaatgaggaagg

SEQ ID NO: 67692 - DNA, 25 bp, Homo sapien
gagtagcatatgattctaataatga

SEQ ID NO: 67693 - DNA, 25 bp, Homo sapien
gagtagcatccagagcagttttcac

SEQ ID NO: 67694 - DNA, 25 bp, Homo sapien
gagtagcatccggagcagttttcac

SEQ ID NO: 67695 - DNA, 25 bp, Homo sapien
gagtagcatgtgattctaataatga

SEQ ID NO: 67696 - DNA, 25 bp, Homo sapien
gagtagcctcatccacagggtgttg

SEQ ID NO: 67697 - DNA, 25 bp, Homo sapien
gagtagccttatccacagggtgttg

SEQ ID NO: 67698 - DNA, 25 bp, Homo sapien
gagtagcttagtatcaggtatccaa

SEQ ID NO: 67699 - DNA, 25 bp, Homo sapien
gagtagcttggtatcaggtatccaa

SEQ ID NO: 67700 - DNA, 25 bp, Homo sapien
gagtaggaaataagagagatagctg

SEQ ID NO: 67701 - DNA, 25 bp, Homo sapien
gagtaggaaatgagagagatagctg

SEQ ID NO: 67702 - DNA, 25 bp, Homo sapien
gagtaggaaggctcatcatctgtaa

SEQ ID NO: 67703 - DNA, 25 bp, Homo sapien
gagtaggatggctcatcatctgtaa

SEQ ID NO: 67704 - DNA, 25 bp, Homo sapien
gagtagtgactgaagatttttgcaa

SEQ ID NO: 67705 - DNA, 25 bp, Homo sapien
gagtagtgagtgaagatttttgcaa

SEQ ID NO: 67706 - DNA, 25 bp, Homo sapien
gagtagtggatgtgcttcttttggc

SEQ ID NO: 67707 - DNA, 25 bp, Homo sapien
gagtagtggatgtgtttcttttggc

SEQ ID NO: 67708 - DNA, 25 bp, Homo sapien
gagtagtgttttatagtggctacaa

SEQ ID NO: 67709 - DNA, 25 bp, Homo sapien
gagtagtgttttgtagtggctacaa

SEQ ID NO: 67710 - DNA, 25 bp, Homo sapien
gagtagttacagcagtgaaacagga

SEQ ID NO: 67711 - DNA, 25 bp, Homo sapien
gagtagttatagcagtgaaacagga

SEQ ID NO: 67712 - DNA, 25 bp, Homo sapien
gagtataaagttccttcttctccct

SEQ ID NO: 67713 - DNA, 25 bp, Homo sapien
gagtataaagtttcttcttctccct

SEQ ID NO: 67714 - DNA, 25 bp, Homo sapien
gagtatacaagagtcaaaagttggt

SEQ ID NO: 67715 - DNA, 25 bp, Homo sapien
gagtatacattgcacttgatgtcta

SEQ ID NO: 67716 - DNA, 25 bp, Homo sapien
gagtatacattggacttgatgtcta

SEQ ID NO: 67717 - DNA, 25 bp, Homo sapien
gagtatacgagagtcaaaagttggt

SEQ ID NO: 67718 - DNA, 25 bp, Homo sapien
gagtatagatccacgtctctgttct

SEQ ID NO: 67719 - DNA, 25 bp, Homo sapien
gagtatagatccatgtctctgttct

SEQ ID NO: 67720 - DNA, 25 bp, Homo sapien
gagtatatgaccagcacagttttca

SEQ ID NO: 67721 - DNA, 25 bp, Homo sapien
gagtatatgactagcacagttttca

SEQ ID NO: 67722 - DNA, 25 bp, Homo sapien
gagtatggaaaacgcatgtcaaaga

SEQ ID NO: 67723 - DNA, 25 bp, Homo sapien
gagtatggaaaatgcatgtcaaaga

SEQ ID NO: 67724 - DNA, 25 bp, Homo sapien
gagtatgtcgactgatccaattgat

SEQ ID NO: 67725 - DNA, 25 bp, Homo sapien
gagtatgttgactgatccaattgat

SEQ ID NO: 67726 - DNA, 25 bp, Homo sapien
gagtattcacctgtaagatagtgac

SEQ ID NO: 67727 - DNA, 25 bp, Homo sapien
gagtattcatctgtaagatagtgac

SEQ ID NO: 67728 - DNA, 25 bp, Homo sapien
gagtattccggagacatggcctctt

SEQ ID NO: 67729 - DNA, 25 bp, Homo sapien
gagtattcctaccggtttggatatt

SEQ ID NO: 67730 - DNA, 25 bp, Homo sapien
gagtattcctactggtttggatatt

SEQ ID NO: 67731 - DNA, 25 bp, Homo sapien
gagtattctggagacatggcctctt

SEQ ID NO: 67732 - DNA, 25 bp, Homo sapien
gagtcaaagatgggcagaaatgtca

SEQ ID NO: 67733 - DNA, 25 bp, Homo sapien
gagtcaaaggtgggcagaaatgtca

SEQ ID NO: 67734 - DNA, 25 bp, Homo sapien
gagtcaacccccagttccaccattc

SEQ ID NO: 67735 - DNA, 25 bp, Homo sapien
gagtcaacccctagttccaccattc

SEQ ID NO: 67736 - DNA, 25 bp, Homo sapien
gagtcaagttatcggttgacatcct

SEQ ID NO: 67737 - DNA, 25 bp, Homo sapien
gagtcaagttattggttgacatcct

SEQ ID NO: 67738 - DNA, 25 bp, Homo sapien
gagtcaatcaaaccttcttccttta

SEQ ID NO: 67739 - DNA, 25 bp, Homo sapien
gagtcaatcaaacctttttccttta

SEQ ID NO: 67740 - DNA, 25 bp, Homo sapien
gagtcaatgcggaaaacgctgccaa

SEQ ID NO: 67741 - DNA, 25 bp, Homo sapien
gagtcaatgcggaaaatgctgccaa

SEQ ID NO: 67742 - DNA, 25 bp, Homo sapien
gagtcacaattctgctaacagtact

SEQ ID NO: 67743 - DNA, 25 bp, Homo sapien
gagtcacaattttgctaacagtact

SEQ ID NO: 67744 - DNA, 25 bp, Homo sapien
gagtcaccagactcttccttgggtg

SEQ ID NO: 67745 - DNA, 25 bp, Homo sapien
gagtcaccagactctttcttgggtg

SEQ ID NO: 67746 - DNA, 25 bp, Homo sapien
gagtcactcattcagggttagaatc

SEQ ID NO: 67747 - DNA, 25 bp, Homo sapien
gagtcactcattccgggttagaatc

SEQ ID NO: 67748 - DNA, 25 bp, Homo sapien
gagtcactctgaccattgaagacag

SEQ ID NO: 67749 - DNA, 25 bp, Homo sapien
gagtcactgtgaccattgaagacag

SEQ ID NO: 67750 - DNA, 25 bp, Homo sapien
gagtcacttctcagcaacatctcag

SEQ ID NO: 67751 - DNA, 25 bp, Homo sapien
gagtcacttttcagcaacatctcag

SEQ ID NO: 67752 - DNA, 25 bp, Homo sapien
gagtcagagtcttgttctgttgccc

SEQ ID NO: 67753 - DNA, 25 bp, Homo sapien
gagtcagagtctttttctgttgccc

SEQ ID NO: 67754 - DNA, 25 bp, Homo sapien
gagtcaggattcttctttagcagtg

SEQ ID NO: 67755 - DNA, 25 bp, Homo sapien
gagtcaggcaactatactattatgc

SEQ ID NO: 67756 - DNA, 25 bp, Homo sapien
gagtcaggcaactatattattatgc

SEQ ID NO: 67757 - DNA, 25 bp, Homo sapien
gagtcagggttcttctttagcagtg

SEQ ID NO: 67758 - DNA, 25 bp, Homo sapien
gagtcagtgtatccattttatgtca

SEQ ID NO: 67759 - DNA, 25 bp, Homo sapien
gagtcagtgtatctattttatgtca

SEQ ID NO: 67760 - DNA, 25 bp, Homo sapien
gagtcatgggtcaacgtccttctcc

SEQ ID NO: 67761 - DNA, 25 bp, Homo sapien
gagtcatgggtcaatgtccttctcc

SEQ ID NO: 67762 - DNA, 25 bp, Homo sapien
gagtcattgttggagagcaggaagc

SEQ ID NO: 67763 - DNA, 25 bp, Homo sapien
gagtcattgttgtagagcaggaagc

SEQ ID NO: 67764 - DNA, 25 bp, Homo sapien
gagtcattttagatgtcttgcttaa

SEQ ID NO: 67765 - DNA, 25 bp, Homo sapien
gagtcattttagttgtcttgcttaa

SEQ ID NO: 67766 - DNA, 25 bp, Homo sapien
gagtcatttttaattctctgagcca

SEQ ID NO: 67767 - DNA, 25 bp, Homo sapien
gagtcatttttatttctctgagcca

SEQ ID NO: 67768 - DNA, 25 bp, Homo sapien
gagtccaagaactgttgatctcaag

SEQ ID NO: 67769 - DNA, 25 bp, Homo sapien
gagtccaagtactgttgatctcaag

SEQ ID NO: 67770 - DNA, 25 bp, Homo sapien
gagtccaccgtcctgatcccagatg

SEQ ID NO: 67771 - DNA, 25 bp, Homo sapien
gagtccaccgtcttgatcccagatg

SEQ ID NO: 67772 - DNA, 25 bp, Homo sapien
gagtccagacataaattcatgccta

SEQ ID NO: 67773 - DNA, 25 bp, Homo sapien
gagtccagatataaattcatgccta

SEQ ID NO: 67774 - DNA, 25 bp, Homo sapien
gagtccagtgacaagaaggaacaag

SEQ ID NO: 67775 - DNA, 25 bp, Homo sapien
gagtccagtgacaagagggaacaag

SEQ ID NO: 67776 - DNA, 25 bp, Homo sapien
gagtccatcaggctcattcttttgt

SEQ ID NO: 67777 - DNA, 25 bp, Homo sapien
gagtccatccggctcattcttttgt

SEQ ID NO: 67778 - DNA, 25 bp, Homo sapien
gagtccatcgaatgctaagcaggat

SEQ ID NO: 67779 - DNA, 25 bp, Homo sapien
gagtccatctaatgctaagcaggat

SEQ ID NO: 67780 - DNA, 25 bp, Homo sapien
gagtcctacaataacacatgacaga

SEQ ID NO: 67781 - DNA, 25 bp, Homo sapien
gagtcctacaattacacatgacaga

SEQ ID NO: 67782 - DNA, 25 bp, Homo sapien
gagtcctccgaatgaaaaggccaga

SEQ ID NO: 67783 - DNA, 25 bp, Homo sapien
gagtcctctgaatgaaaaggccaga

SEQ ID NO: 67784 - DNA, 25 bp, Homo sapien
gagtcctctttttcccatacttcat

SEQ ID NO: 67785 - DNA, 25 bp, Homo sapien
gagtcctctttttcccgtacttcat

SEQ ID NO: 67786 - DNA, 25 bp, Homo sapien
gagtcctgattactgaattgaaggg

SEQ ID NO: 67787 - DNA, 25 bp, Homo sapien
gagtcctgattattgaattgaaggg

SEQ ID NO: 67788 - DNA, 25 bp, Homo sapien
gagtcctgcggctgattgcttagac

SEQ ID NO: 67789 - DNA, 25 bp, Homo sapien
gagtcctgctgctgattgcttagac

SEQ ID NO: 67790 - DNA, 25 bp, Homo sapien
gagtcctgttgagcatagcagagat

SEQ ID NO: 67791 - DNA, 25 bp, Homo sapien
gagtcctgttgagcgtagcagagat

SEQ ID NO: 67792 - DNA, 25 bp, Homo sapien
gagtctaaaaacaaggcagtgtgaa

SEQ ID NO: 67793 - DNA, 25 bp, Homo sapien
gagtctaagaacaaggcagtgtgaa

SEQ ID NO: 67794 - DNA, 25 bp, Homo sapien
gagtctaagctgaatctagttattt

SEQ ID NO: 67795 - DNA, 25 bp, Homo sapien
gagtctaaggtgaatctagttattt

SEQ ID NO: 67796 - DNA, 25 bp, Homo sapien
gagtctaatactttcaggaagaaac

SEQ ID NO: 67797 - DNA, 25 bp, Homo sapien
gagtctaatactttgaggaagaaac

SEQ ID NO: 67798 - DNA, 25 bp, Homo sapien
gagtctatccttgtctctgtaatga

SEQ ID NO: 67799 - DNA, 25 bp, Homo sapien
gagtctattcttgtctctgtaatga

SEQ ID NO: 67800 - DNA, 25 bp, Homo sapien
gagtctctgctgctctgatgaaggc

SEQ ID NO: 67801 - DNA, 25 bp, Homo sapien
gagtctctgctgttctgatgaaggc

SEQ ID NO: 67802 - DNA, 25 bp, Homo sapien
gagtctctttttacaaactgtgctt

SEQ ID NO: 67803 - DNA, 25 bp, Homo sapien
gagtctctttttacgaactgtgctt

SEQ ID NO: 67804 - DNA, 25 bp, Homo sapien
gagtctgaactgtaaaagaaattgt

SEQ ID NO: 67805 - DNA, 25 bp, Homo sapien
gagtctgaactgtgaaagaaattgt

SEQ ID NO: 67806 - DNA, 25 bp, Homo sapien
gagtctgagctataaccacattcac

SEQ ID NO: 67807 - DNA, 25 bp, Homo sapien
gagtctgagctataacgacattcac

SEQ ID NO: 67808 - DNA, 25 bp, Homo sapien
gagtctgcaagagccaagcattact

SEQ ID NO: 67809 - DNA, 25 bp, Homo sapien
gagtctgcaagatccaagcattact

SEQ ID NO: 67810 - DNA, 25 bp, Homo sapien
gagtctgctcttaaagctttctgcc

SEQ ID NO: 67811 - DNA, 25 bp, Homo sapien
gagtctgctcttaaggctttctgcc

SEQ ID NO: 67812 - DNA, 25 bp, Homo sapien
gagtctggtaaacctacaaaaactt

SEQ ID NO: 67813 - DNA, 25 bp, Homo sapien
gagtctggtaaacctataaaaactt

SEQ ID NO: 67814 - DNA, 25 bp, Homo sapien
gagtctggttatctctatttaaatg

SEQ ID NO: 67815 - DNA, 25 bp, Homo sapien
gagtctggttatttctatttaaatg

SEQ ID NO: 67816 - DNA, 25 bp, Homo sapien
gagtctgtgctttcataggccactc

SEQ ID NO: 67817 - DNA, 25 bp, Homo sapien
gagtctgtgctttgataggccactc

SEQ ID NO: 67818 - DNA, 25 bp, Homo sapien
gagtctgttaataaggaatttttgg

SEQ ID NO: 67819 - DNA, 25 bp, Homo sapien
gagtctgttaatgaggaatttttgg

SEQ ID NO: 67820 - DNA, 25 bp, Homo sapien
gagtgaaaaggcaattcatagaatg

SEQ ID NO: 67821 - DNA, 25 bp, Homo sapien
gagtgaaaaggcgattcatagaatg

SEQ ID NO: 67822 - DNA, 25 bp, Homo sapien
gagtgaaaattgagcaaatctgcat

SEQ ID NO: 67823 - DNA, 25 bp, Homo sapien
gagtgaaagttgagcaaatctgcat

SEQ ID NO: 67824 - DNA, 25 bp, Homo sapien
gagtgaagaagaagagaagatgccc

SEQ ID NO: 67825 - DNA, 25 bp, Homo sapien
gagtgaagaagaggagaagatgccc

SEQ ID NO: 67826 - DNA, 25 bp, Homo sapien
gagtgaaggttgatatcattttctg

SEQ ID NO: 67827 - DNA, 25 bp, Homo sapien
gagtgaaggttggtatcattttctg

SEQ ID NO: 67828 - DNA, 25 bp, Homo sapien
gagtgaattattacaggaaaaaaat

SEQ ID NO: 67829 - DNA, 25 bp, Homo sapien
gagtgaattattacgggaaaaaaat

SEQ ID NO: 67830 - DNA, 25 bp, Homo sapien
gagtgaattcattacccaatcctgg

SEQ ID NO: 67831 - DNA, 25 bp, Homo sapien
gagtgaattgattacccaatcctgg

SEQ ID NO: 67832 - DNA, 25 bp, Homo sapien
gagtgaattgcagtatttaacaaga

SEQ ID NO: 67833 - DNA, 25 bp, Homo sapien
gagtgaattgcggtatttaacaaga

SEQ ID NO: 67834 - DNA, 25 bp, Homo sapien
gagtgacaatttatcatatccatca

SEQ ID NO: 67835 - DNA, 25 bp, Homo sapien
gagtgacaatttattatatccatca

SEQ ID NO: 67836 - DNA, 25 bp, Homo sapien
gagtgacagaaaaacgccaggaccc

SEQ ID NO: 67837 - DNA, 25 bp, Homo sapien
gagtgacagaaaaatgccaggaccc

SEQ ID NO: 67838 - DNA, 25 bp, Homo sapien
gagtgacagcaaaaatcatagctga

SEQ ID NO: 67839 - DNA, 25 bp, Homo sapien
gagtgacatcaaaaatcatagctga

SEQ ID NO: 67840 - DNA, 25 bp, Homo sapien
gagtgacgtgtttctcctggtaaca

SEQ ID NO: 67841 - DNA, 25 bp, Homo sapien
gagtgacgtgtttttcctggtaaca

SEQ ID NO: 67842 - DNA, 25 bp, Homo sapien
gagtgacttggacaaggtggtcagg

SEQ ID NO: 67843 - DNA, 25 bp, Homo sapien
gagtgacttggataaggtggtcagg

SEQ ID NO: 67844 - DNA, 25 bp, Homo sapien
gagtgagaaatgtcaaattgaacta

SEQ ID NO: 67845 - DNA, 25 bp, Homo sapien
gagtgagaactgtcaaattgaacta

SEQ ID NO: 67846 - DNA, 25 bp, Homo sapien
gagtgagctataataggccttaaaa

SEQ ID NO: 67847 - DNA, 25 bp, Homo sapien
gagtgagctatactaggccttaaaa

SEQ ID NO: 67848 - DNA, 25 bp, Homo sapien
gagtgaggacagaagtaagggaatg

SEQ ID NO: 67849 - DNA, 25 bp, Homo sapien
gagtgaggacaggagtaagggaatg

SEQ ID NO: 67850 - DNA, 25 bp, Homo sapien
gagtgaggatgcaaaaatagaaaat

SEQ ID NO: 67851 - DNA, 25 bp, Homo sapien
gagtgaggatggaaaaatagaaaat

SEQ ID NO: 67852 - DNA, 25 bp, Homo sapien
gagtgagggaaagaactttgagagt

SEQ ID NO: 67853 - DNA, 25 bp, Homo sapien
gagtgagggaaataactttgagagt

SEQ ID NO: 67854 - DNA, 25 bp, Homo sapien
gagtgagggaacaatgaaccctacg

SEQ ID NO: 67855 - DNA, 25 bp, Homo sapien
gagtgagggaaccatgaaccctacg

SEQ ID NO: 67856 - DNA, 25 bp, Homo sapien
gagtgagtgttgctccagctctctg

SEQ ID NO: 67857 - DNA, 25 bp, Homo sapien
gagtgagtgtttctccagctctctg

SEQ ID NO: 67858 - DNA, 25 bp, Homo sapien
gagtgatacatagaatacaatgaaa

SEQ ID NO: 67859 - DNA, 25 bp, Homo sapien
gagtgatacatagactacaatgaaa

SEQ ID NO: 67860 - DNA, 25 bp, Homo sapien
gagtgataccacaataaacgatatt

SEQ ID NO: 67861 - DNA, 25 bp, Homo sapien
gagtgataccacgataaacgatatt

SEQ ID NO: 67862 - DNA, 25 bp, Homo sapien
gagtgatatcttacgaggttttgct

SEQ ID NO: 67863 - DNA, 25 bp, Homo sapien
gagtgatatcttatgaggttttgct

SEQ ID NO: 67864 - DNA, 25 bp, Homo sapien
gagtgatgatactggcccccaagtg

SEQ ID NO: 67865 - DNA, 25 bp, Homo sapien
gagtgatgcaatcattgaccttgaa

SEQ ID NO: 67866 - DNA, 25 bp, Homo sapien
gagtgatgcaatcgttgaccttgaa

SEQ ID NO: 67867 - DNA, 25 bp, Homo sapien
gagtgatggagtcggctctttcctg

SEQ ID NO: 67868 - DNA, 25 bp, Homo sapien
gagtgatggagttggctctttcctg

SEQ ID NO: 67869 - DNA, 25 bp, Homo sapien
gagtgatgttactggcccccaagtg

SEQ ID NO: 67870 - DNA, 25 bp, Homo sapien
gagtgattattatttatttgctaat

SEQ ID NO: 67871 - DNA, 25 bp, Homo sapien
gagtgattattctttatttgctaat

SEQ ID NO: 67872 - DNA, 25 bp, Homo sapien
gagtgcatagaccacaatagatttt

SEQ ID NO: 67873 - DNA, 25 bp, Homo sapien
gagtgcatagactacaatagatttt

SEQ ID NO: 67874 - DNA, 25 bp, Homo sapien
gagtgcatagcaaacaacaacataa

SEQ ID NO: 67875 - DNA, 25 bp, Homo sapien
gagtgcatagcagacaacaacataa

SEQ ID NO: 67876 - DNA, 25 bp, Homo sapien
gagtgcattttgatcatgttaaatt

SEQ ID NO: 67877 - DNA, 25 bp, Homo sapien
gagtgcattttggtcatgttaaatt

SEQ ID NO: 67878 - DNA, 25 bp, Homo sapien
gagtgcctgaacaaaatggaattct

SEQ ID NO: 67879 - DNA, 25 bp, Homo sapien
gagtgcctgaataaaatggaattct

SEQ ID NO: 67880 - DNA, 25 bp, Homo sapien
gagtgctacatataagtcaatctga

SEQ ID NO: 67881 - DNA, 25 bp, Homo sapien
gagtgctacatataggtcaatctga

SEQ ID NO: 67882 - DNA, 25 bp, Homo sapien
gagtgctattgctatcacctggtaa

SEQ ID NO: 67883 - DNA, 25 bp, Homo sapien
gagtgctattgctgtcacctggtaa

SEQ ID NO: 67884 - DNA, 25 bp, Homo sapien
gagtgctgggtggtatgaaactgac

SEQ ID NO: 67885 - DNA, 25 bp, Homo sapien
gagtgctgggttgtatgaaactgac

SEQ ID NO: 67886 - DNA, 25 bp, Homo sapien
gagtgctttccatttgctaattcat

SEQ ID NO: 67887 - DNA, 25 bp, Homo sapien
gagtgctttccgtttgctaattcat

SEQ ID NO: 67888 - DNA, 25 bp, Homo sapien
gagtgctttctatgtacctgctgag

SEQ ID NO: 67889 - DNA, 25 bp, Homo sapien
gagtgctttctgtgtacctgctgag

SEQ ID NO: 67890 - DNA, 25 bp, Homo sapien
gagtggaaattaggccagaaagaaa

SEQ ID NO: 67891 - DNA, 25 bp, Homo sapien
gagtggaaattatgccagaaagaaa

SEQ ID NO: 67892 - DNA, 25 bp, Homo sapien
gagtggagaagtagttaccttttac

SEQ ID NO: 67893 - DNA, 25 bp, Homo sapien
gagtggagaagtcgttaccttttac

SEQ ID NO: 67894 - DNA, 25 bp, Homo sapien
gagtggcacatgacacagtgagaca

SEQ ID NO: 67895 - DNA, 25 bp, Homo sapien
gagtggcacattacacagtgagaca

SEQ ID NO: 67896 - DNA, 25 bp, Homo sapien
gagtggcagcctccatcgtactgta

SEQ ID NO: 67897 - DNA, 25 bp, Homo sapien
gagtggcaggctccatcgtactgta

SEQ ID NO: 67898 - DNA, 25 bp, Homo sapien
gagtggcatgtcgaaaactgagaaa

SEQ ID NO: 67899 - DNA, 25 bp, Homo sapien
gagtggcatgtcgaaagctgagaaa

SEQ ID NO: 67900 - DNA, 25 bp, Homo sapien
gagtggccagtgttattaactatgt

SEQ ID NO: 67901 - DNA, 25 bp, Homo sapien
gagtggccggtgttattaactatgt

SEQ ID NO: 67902 - DNA, 25 bp, Homo sapien
gagtggctgcaataagctattaaag

SEQ ID NO: 67903 - DNA, 25 bp, Homo sapien
gagtggctgcaatatgctattaaag

SEQ ID NO: 67904 - DNA, 25 bp, Homo sapien
gagtggcttgaattagatggtgata

SEQ ID NO: 67905 - DNA, 25 bp, Homo sapien
gagtggcttgaattggatggtgata

SEQ ID NO: 67906 - DNA, 25 bp, Homo sapien
gagtgggaagactcatgtgagttca

SEQ ID NO: 67907 - DNA, 25 bp, Homo sapien
gagtgggaagactcatttgagttca

SEQ ID NO: 67908 - DNA, 25 bp, Homo sapien
gagtggggcttctcacatgcagtcc

SEQ ID NO: 67909 - DNA, 25 bp, Homo sapien
gagtggggcttttcacatgcagtcc

SEQ ID NO: 67910 - DNA, 25 bp, Homo sapien
gagtggtcatgtatttatggatttg

SEQ ID NO: 67911 - DNA, 25 bp, Homo sapien
gagtggtcatgtatttgtggatttg

SEQ ID NO: 67912 - DNA, 25 bp, Homo sapien
gagtggtgctaaaagaatctactgt

SEQ ID NO: 67913 - DNA, 25 bp, Homo sapien
gagtggtgttaaaagaatctactgt

SEQ ID NO: 67914 - DNA, 25 bp, Homo sapien
gagtgtaataagcaagagagagcga

SEQ ID NO: 67915 - DNA, 25 bp, Homo sapien
gagtgtaatgagcaagagagagcga

SEQ ID NO: 67916 - DNA, 25 bp, Homo sapien
gagtgtcctgaaaactcactctcaa

SEQ ID NO: 67917 - DNA, 25 bp, Homo sapien
gagtgtcctgacaactcactctcaa

SEQ ID NO: 67918 - DNA, 25 bp, Homo sapien
gagtgtctccctcaggcatgtgact

SEQ ID NO: 67919 - DNA, 25 bp, Homo sapien
gagtgtctccctcagggatgtgact

SEQ ID NO: 67920 - DNA, 25 bp, Homo sapien
gagtgtgctagctagattgtatgtt

SEQ ID NO: 67921 - DNA, 25 bp, Homo sapien
gagtgtgcttgctagattgtatgtt

SEQ ID NO: 67922 - DNA, 25 bp, Homo sapien
gagtgttacctctctattaatatgt

SEQ ID NO: 67923 - DNA, 25 bp, Homo sapien
gagtgttagagtccagagatcatgg

SEQ ID NO: 67924 - DNA, 25 bp, Homo sapien
gagtgttagagtcgagagatcatgg

SEQ ID NO: 67925 - DNA, 25 bp, Homo sapien
gagtgttatctctctattaatatgt

SEQ ID NO: 67926 - DNA, 25 bp, Homo sapien
gagtgttcattcttaccctcagtgc

SEQ ID NO: 67927 - DNA, 25 bp, Homo sapien
gagtgttcattcttactctcagtgc

SEQ ID NO: 67928 - DNA, 25 bp, Homo sapien
gagtgttgaacctgcattccagact

SEQ ID NO: 67929 - DNA, 25 bp, Homo sapien
gagtgttgagcctgcattccagact

SEQ ID NO: 67930 - DNA, 25 bp, Homo sapien
gagtgtttgttcctcacctaacatt

SEQ ID NO: 67931 - DNA, 25 bp, Homo sapien
gagtgtttgttcgtcacctaacatt

SEQ ID NO: 67932 - DNA, 25 bp, Homo sapien
gagttaaattttgtatatggtaaac

SEQ ID NO: 67933 - DNA, 25 bp, Homo sapien
gagttaaattttgtatgtggtaaac

SEQ ID NO: 67934 - DNA, 25 bp, Homo sapien
gagttaatacggacatgttctgaaa

SEQ ID NO: 67935 - DNA, 25 bp, Homo sapien
gagttaatacggatatgttctgaaa

SEQ ID NO: 67936 - DNA, 25 bp, Homo sapien
gagttaatcttttgagctatggtct

SEQ ID NO: 67937 - DNA, 25 bp, Homo sapien
gagttaatgttgaaaaagatgaacc

SEQ ID NO: 67938 - DNA, 25 bp, Homo sapien
gagttaatgttggaaaagatgaacc

SEQ ID NO: 67939 - DNA, 25 bp, Homo sapien
gagttaattaagcacaaaatgtgtt

SEQ ID NO: 67940 - DNA, 25 bp, Homo sapien
gagttaattgagcacaaaatgtgtt

SEQ ID NO: 67941 - DNA, 25 bp, Homo sapien
gagttaatttgatggcttgagcagg

SEQ ID NO: 67942 - DNA, 25 bp, Homo sapien
gagttaatttgccgcagttataagt

SEQ ID NO: 67943 - DNA, 25 bp, Homo sapien
gagttaatttgctgcagttataagt

SEQ ID NO: 67944 - DNA, 25 bp, Homo sapien
gagttaatttggtggcttgagcagg

SEQ ID NO: 67945 - DNA, 25 bp, Homo sapien
gagttaattttttgagctatggtct

SEQ ID NO: 67946 - DNA, 25 bp, Homo sapien
gagttacaggtaaaaactgaaatgg

SEQ ID NO: 67947 - DNA, 25 bp, Homo sapien
gagttacaggtagaaactgaaatgg

SEQ ID NO: 67948 - DNA, 25 bp, Homo sapien
gagttactcaactgggagtcgcaga

SEQ ID NO: 67949 - DNA, 25 bp, Homo sapien
gagttactgaactgggagtcgcaga

SEQ ID NO: 67950 - DNA, 25 bp, Homo sapien
gagttagaaagagcaactgaatatg

SEQ ID NO: 67951 - DNA, 25 bp, Homo sapien
gagttagaaagagcaattgaatatg

SEQ ID NO: 67952 - DNA, 25 bp, Homo sapien
gagttagaagaaactttatcacagt

SEQ ID NO: 67953 - DNA, 25 bp, Homo sapien
gagttagaagaacctttatcacagt

SEQ ID NO: 67954 - DNA, 25 bp, Homo sapien
gagttagcagtcccagaatgttact

SEQ ID NO: 67955 - DNA, 25 bp, Homo sapien
gagttagcagtctcagaatgttact

SEQ ID NO: 67956 - DNA, 25 bp, Homo sapien
gagttagcttaccactctgatactt

SEQ ID NO: 67957 - DNA, 25 bp, Homo sapien
gagttagcttaccgctctgatactt

SEQ ID NO: 67958 - DNA, 25 bp, Homo sapien
gagttagctttgtaacaatttaggc

SEQ ID NO: 67959 - DNA, 25 bp, Homo sapien
gagttagctttgtaacgatttaggc

SEQ ID NO: 67960 - DNA, 25 bp, Homo sapien
gagttaggcgagaacagtggtgtag

SEQ ID NO: 67961 - DNA, 25 bp, Homo sapien
gagttaggtgagaacagtggtgtag

SEQ ID NO: 67962 - DNA, 25 bp, Homo sapien
gagttagttataccgatcttcattt

SEQ ID NO: 67963 - DNA, 25 bp, Homo sapien
gagttagttatactgatcttcattt

SEQ ID NO: 67964 - DNA, 25 bp, Homo sapien
gagttatctttacgcaacagcatca

SEQ ID NO: 67965 - DNA, 25 bp, Homo sapien
gagttatctttactcaacagcatca

SEQ ID NO: 67966 - DNA, 25 bp, Homo sapien
gagttatgatctctcaagtcactga

SEQ ID NO: 67967 - DNA, 25 bp, Homo sapien
gagttatgttctctcaagtcactga

SEQ ID NO: 67968 - DNA, 25 bp, Homo sapien
gagttcaaatcatgactttgccaat

SEQ ID NO: 67969 - DNA, 25 bp, Homo sapien
gagttcaaatcgtgactttgccaat

SEQ ID NO: 67970 - DNA, 25 bp, Homo sapien
gagttcaaggaaggccaagagagat

SEQ ID NO: 67971 - DNA, 25 bp, Homo sapien
gagttcaagtaaggccaagagagat

SEQ ID NO: 67972 - DNA, 25 bp, Homo sapien
gagttcacaggtaaatgaaaggaaa

SEQ ID NO: 67973 - DNA, 25 bp, Homo sapien
gagttcacaggtgaatgaaaggaaa

SEQ ID NO: 67974 - DNA, 25 bp, Homo sapien
gagttcagaatatgctccttatcca

SEQ ID NO: 67975 - DNA, 25 bp, Homo sapien
gagttcagaatatgttccttatcca

SEQ ID NO: 67976 - DNA, 25 bp, Homo sapien
gagttcagacgtctgaaactggtgt

SEQ ID NO: 67977 - DNA, 25 bp, Homo sapien
gagttcagacgtctgatactggtgt

SEQ ID NO: 67978 - DNA, 25 bp, Homo sapien
gagttcagcagatatttgactctgg

SEQ ID NO: 67979 - DNA, 25 bp, Homo sapien
gagttcagcaggtatttgactctgg

SEQ ID NO: 67980 - DNA, 25 bp, Homo sapien
gagttcaggcaaatcatctaagtcc

SEQ ID NO: 67981 - DNA, 25 bp, Homo sapien
gagttcaggcaagtcatctaagtcc

SEQ ID NO: 67982 - DNA, 25 bp, Homo sapien
gagttcagttttggtcatgttcaat

SEQ ID NO: 67983 - DNA, 25 bp, Homo sapien
gagttcagtttttgtcatgttcaat

SEQ ID NO: 67984 - DNA, 25 bp, Homo sapien
gagttcatgtcccgagccaataata

SEQ ID NO: 67985 - DNA, 25 bp, Homo sapien
gagttcatgtcctgagccaataata

SEQ ID NO: 67986 - DNA, 25 bp, Homo sapien
gagttcattgtaagtaaatttttgg

SEQ ID NO: 67987 - DNA, 25 bp, Homo sapien
gagttcattgtaggtaaatttttgg

SEQ ID NO: 67988 - DNA, 25 bp, Homo sapien
gagttcctcttggtcctccagacac

SEQ ID NO: 67989 - DNA, 25 bp, Homo sapien
gagttcctcttggttctccagacac

SEQ ID NO: 67990 - DNA, 25 bp, Homo sapien
gagttctaacctctggtacctcaga

SEQ ID NO: 67991 - DNA, 25 bp, Homo sapien
gagttctaacctgtggtacctcaga

SEQ ID NO: 67992 - DNA, 25 bp, Homo sapien
gagttctgaactcaaagatgacatc

SEQ ID NO: 67993 - DNA, 25 bp, Homo sapien
gagttctgaactcagagatgacatc

SEQ ID NO: 67994 - DNA, 25 bp, Homo sapien
gagttctgaattcaaaggtcagaaa

SEQ ID NO: 67995 - DNA, 25 bp, Homo sapien
gagttctgaattcgaaggtcagaaa

SEQ ID NO: 67996 - DNA, 25 bp, Homo sapien
gagttctgaattggaagagcatcac

SEQ ID NO: 67997 - DNA, 25 bp, Homo sapien
gagttctgaatttgaagagcatcac

SEQ ID NO: 67998 - DNA, 25 bp, Homo sapien
gagttctgccatatagccacctgtg

SEQ ID NO: 67999 - DNA, 25 bp, Homo sapien
gagttctgccatatagtcacctgtg

SEQ ID NO: 68000 - DNA, 25 bp, Homo sapien
gagttcttacagagtacatgtgtct

SEQ ID NO: 68001 - DNA, 25 bp, Homo sapien
gagttcttacagggtacatgtgtct

SEQ ID NO: 68002 - DNA, 25 bp, Homo sapien
gagttgaaaaacacattaagagctc

SEQ ID NO: 68003 - DNA, 25 bp, Homo sapien
gagttgaaaaacccattaagagctc

SEQ ID NO: 68004 - DNA, 25 bp, Homo sapien
gagttgaaattcagttagatcccaa

SEQ ID NO: 68005 - DNA, 25 bp, Homo sapien
gagttgaatttcagttagatcccaa

SEQ ID NO: 68006 - DNA, 25 bp, Homo sapien
gagttgacttttgaccttgttcctt

SEQ ID NO: 68007 - DNA, 25 bp, Homo sapien
gagttgacttttggccttgttcctt

SEQ ID NO: 68008 - DNA, 25 bp, Homo sapien
gagttgaggtgtccagccatcaaaa

SEQ ID NO: 68009 - DNA, 25 bp, Homo sapien
gagttgaggtgttcagccatcaaaa

SEQ ID NO: 68010 - DNA, 25 bp, Homo sapien
gagttgatgtcatggaagtagagag

SEQ ID NO: 68011 - DNA, 25 bp, Homo sapien
gagttgatgtcatggatgtagagag

SEQ ID NO: 68012 - DNA, 25 bp, Homo sapien
gagttgatttcaaccggactaagcc

SEQ ID NO: 68013 - DNA, 25 bp, Homo sapien
gagttgatttcaactggactaagcc

SEQ ID NO: 68014 - DNA, 25 bp, Homo sapien
gagttgcacatgctattcattataa

SEQ ID NO: 68015 - DNA, 25 bp, Homo sapien
gagttgcacctgctattcattataa

SEQ ID NO: 68016 - DNA, 25 bp, Homo sapien
gagttgcagcttctaggagctcagc

SEQ ID NO: 68017 - DNA, 25 bp, Homo sapien
gagttgcagcttctgggagctcagc

SEQ ID NO: 68018 - DNA, 25 bp, Homo sapien
gagttgcatcgaacctgaaatgtag

SEQ ID NO: 68019 - DNA, 25 bp, Homo sapien
gagttgcattgaacctgaaatgtag

SEQ ID NO: 68020 - DNA, 25 bp, Homo sapien
gagttgccattttattggtgccact

SEQ ID NO: 68021 - DNA, 25 bp, Homo sapien
gagttgccgttttattggtgccact

SEQ ID NO: 68022 - DNA, 25 bp, Homo sapien
gagttgctaacaccactggctcatc

SEQ ID NO: 68023 - DNA, 25 bp, Homo sapien
gagttgctaacaccgctggctcatc

SEQ ID NO: 68024 - DNA, 25 bp, Homo sapien
gagttgctatccatatgatcttgta

SEQ ID NO: 68025 - DNA, 25 bp, Homo sapien
gagttgctatccgtatgatcttgta

SEQ ID NO: 68026 - DNA, 25 bp, Homo sapien
gagttgctgggtatcgagaaccaaa

SEQ ID NO: 68027 - DNA, 25 bp, Homo sapien
gagttgctgggtattgagaaccaaa

SEQ ID NO: 68028 - DNA, 25 bp, Homo sapien
gagttggagcaaatgagactcagat

SEQ ID NO: 68029 - DNA, 25 bp, Homo sapien
gagttggagcaactgagactcagat

SEQ ID NO: 68030 - DNA, 25 bp, Homo sapien
gagttggcttacatgattgtgaggt

SEQ ID NO: 68031 - DNA, 25 bp, Homo sapien
gagttggcttacgtgattgtgaggt

SEQ ID NO: 68032 - DNA, 25 bp, Homo sapien
gagttgggaacacatgatgagctct

SEQ ID NO: 68033 - DNA, 25 bp, Homo sapien
gagttgggaacacgtgatgagctct

SEQ ID NO: 68034 - DNA, 25 bp, Homo sapien
gagttgggaagaagttctctcctat

SEQ ID NO: 68035 - DNA, 25 bp, Homo sapien
gagttgggacgaaggtatcaataaa

SEQ ID NO: 68036 - DNA, 25 bp, Homo sapien
gagttgggatgaaggtatcaataaa

SEQ ID NO: 68037 - DNA, 25 bp, Homo sapien
gagttgggtagaagttctctcctat

SEQ ID NO: 68038 - DNA, 25 bp, Homo sapien
gagttgtcacccaatggcagttgaa

SEQ ID NO: 68039 - DNA, 25 bp, Homo sapien
gagttgtcacccagtggcagttgaa

SEQ ID NO: 68040 - DNA, 25 bp, Homo sapien
gagttgtcatttttagggagaagtc

SEQ ID NO: 68041 - DNA, 25 bp, Homo sapien
gagttgtcgtttttagggagaagtc

SEQ ID NO: 68042 - DNA, 25 bp, Homo sapien
gagttgtgtcacctatcagcgggct

SEQ ID NO: 68043 - DNA, 25 bp, Homo sapien
gagttgtgtcatctatcagcgggct

SEQ ID NO: 68044 - DNA, 25 bp, Homo sapien
gagttgtttccatattttagctatt

SEQ ID NO: 68045 - DNA, 25 bp, Homo sapien
gagttgttttcatattttagctatt

SEQ ID NO: 68046 - DNA, 25 bp, Homo sapien
gagtttcaaattcagtgtttctgga

SEQ ID NO: 68047 - DNA, 25 bp, Homo sapien
gagtttcagattcagtgtttctgga

SEQ ID NO: 68048 - DNA, 25 bp, Homo sapien
gagtttcagggatccacgtagaagt

SEQ ID NO: 68049 - DNA, 25 bp, Homo sapien
gagtttcagggatccatgtagaagt

SEQ ID NO: 68050 - DNA, 25 bp, Homo sapien
gagtttctactgctctgatagcacc

SEQ ID NO: 68051 - DNA, 25 bp, Homo sapien
gagtttctcagagagtactcagatc

SEQ ID NO: 68052 - DNA, 25 bp, Homo sapien
gagtttctcagatagtactcagatc

SEQ ID NO: 68053 - DNA, 25 bp, Homo sapien
gagtttctcctgctctgatagcacc

SEQ ID NO: 68054 - DNA, 25 bp, Homo sapien
gagtttctgcaaagccattaaaaat

SEQ ID NO: 68055 - DNA, 25 bp, Homo sapien
gagtttctgcaatgccattaaaaat

SEQ ID NO: 68056 - DNA, 25 bp, Homo sapien
gagtttgagaccagattgagcaaca

SEQ ID NO: 68057 - DNA, 25 bp, Homo sapien
gagtttgagacctgattgagcaaca

SEQ ID NO: 68058 - DNA, 25 bp, Homo sapien
gagtttgcagtcaaaaagcaaagca

SEQ ID NO: 68059 - DNA, 25 bp, Homo sapien
gagtttgccgtcaaaaagcaaagca

SEQ ID NO: 68060 - DNA, 25 bp, Homo sapien
gagtttgctttcaggctgctttgat

SEQ ID NO: 68061 - DNA, 25 bp, Homo sapien
gagtttgctttcgggctgctttgat

SEQ ID NO: 68062 - DNA, 25 bp, Homo sapien
gagtttgggcaggacttgtttattg

SEQ ID NO: 68063 - DNA, 25 bp, Homo sapien
gagtttgggcagtacttgtttattg

SEQ ID NO: 68064 - DNA, 25 bp, Homo sapien
gagtttgtagaaacacctagatttg

SEQ ID NO: 68065 - DNA, 25 bp, Homo sapien
gagtttgtagaaatacctagatttg

SEQ ID NO: 68066 - DNA, 25 bp, Homo sapien
gagtttgtcattattgtggtgactg

SEQ ID NO: 68067 - DNA, 25 bp, Homo sapien
gagtttgtcgttattgtggtgactg

SEQ ID NO: 68068 - DNA, 25 bp, Homo sapien
gagtttgttcaacggaataataata

SEQ ID NO: 68069 - DNA, 25 bp, Homo sapien
gagtttgttcaatggaataataata

SEQ ID NO: 68070 - DNA, 25 bp, Homo sapien
gagttttaaaactgacatgcaatac

SEQ ID NO: 68071 - DNA, 25 bp, Homo sapien
gagttttaaaattgacatgcaatac

SEQ ID NO: 68072 - DNA, 25 bp, Homo sapien
gagttttatacaggaaaggatttgt

SEQ ID NO: 68073 - DNA, 25 bp, Homo sapien
gagttttatactcttgcggttttgt

SEQ ID NO: 68074 - DNA, 25 bp, Homo sapien
gagttttatactcttgtggttttgt

SEQ ID NO: 68075 - DNA, 25 bp, Homo sapien
gagttttatgcaggaaaggatttgt

SEQ ID NO: 68076 - DNA, 25 bp, Homo sapien
gagttttcaacagagtagtgaaatg

SEQ ID NO: 68077 - DNA, 25 bp, Homo sapien
gagttttcacagccttagaaatgag

SEQ ID NO: 68078 - DNA, 25 bp, Homo sapien
gagttttcacagctttagaaatgag

SEQ ID NO: 68079 - DNA, 25 bp, Homo sapien
gagttttcacatatgcatatacccc

SEQ ID NO: 68080 - DNA, 25 bp, Homo sapien
gagttttcacatgtgcatatacccc

SEQ ID NO: 68081 - DNA, 25 bp, Homo sapien
gagttttcatcagagtagtgaaatg

SEQ ID NO: 68082 - DNA, 25 bp, Homo sapien
gagttttcggcttcatagacatctt

SEQ ID NO: 68083 - DNA, 25 bp, Homo sapien
gagttttcggcttcattgacatctt

SEQ ID NO: 68084 - DNA, 25 bp, Homo sapien
gagtttttgcttcagttttgtgtta

SEQ ID NO: 68085 - DNA, 25 bp, Homo sapien
gagtttttgcttgagttttgtgtta

SEQ ID NO: 68086 - DNA, 25 bp, Homo sapien
gagtttttggcccaaggatggagga

SEQ ID NO: 68087 - DNA, 25 bp, Homo sapien
gagtttttggcccgaggatggagga

SEQ ID NO: 68088 - DNA, 25 bp, Homo sapien
gataaaaacagtcatagaatggata

SEQ ID NO: 68089 - DNA, 25 bp, Homo sapien
gataaaaacagtcgtagaatggata

SEQ ID NO: 68090 - DNA, 25 bp, Homo sapien
gataaaaactccaatacagcacatt

SEQ ID NO: 68091 - DNA, 25 bp, Homo sapien
gataaaaactccgatacagcacatt

SEQ ID NO: 68092 - DNA, 25 bp, Homo sapien
gataaaacatttggaaagtgacagt

SEQ ID NO: 68093 - DNA, 25 bp, Homo sapien
gataaaacattttgaaagtgacagt

SEQ ID NO: 68094 - DNA, 25 bp, Homo sapien
gataaaacccaacaaatcatcgatt

SEQ ID NO: 68095 - DNA, 25 bp, Homo sapien
gataaaacccagcaaatcatcgatt

SEQ ID NO: 68096 - DNA, 25 bp, Homo sapien
gataaaagacatgaattattttggt

SEQ ID NO: 68097 - DNA, 25 bp, Homo sapien
gataaaagacgcatttgtgataatt

SEQ ID NO: 68098 - DNA, 25 bp, Homo sapien
gataaaagataggaagagacactac

SEQ ID NO: 68099 - DNA, 25 bp, Homo sapien
gataaaagatatgaagagacactac

SEQ ID NO: 68100 - DNA, 25 bp, Homo sapien
gataaaagatgcatttgtgataatt

SEQ ID NO: 68101 - DNA, 25 bp, Homo sapien
gataaaagctacctataaagttcaa

SEQ ID NO: 68102 - DNA, 25 bp, Homo sapien
gataaaagctacctctaaagttcaa

SEQ ID NO: 68103 - DNA, 25 bp, Homo sapien
gataaaaggaactgacatttactga

SEQ ID NO: 68104 - DNA, 25 bp, Homo sapien
gataaaaggaactggcatttactga

SEQ ID NO: 68105 - DNA, 25 bp, Homo sapien
gataaaaggcatgaattattttggt

SEQ ID NO: 68106 - DNA, 25 bp, Homo sapien
gataaaagtcgggtcgaaaaagata

SEQ ID NO: 68107 - DNA, 25 bp, Homo sapien
gataaaagttgggtcgaaaaagata

SEQ ID NO: 68108 - DNA, 25 bp, Homo sapien
gataaaatagcacaaaacgctgaaa

SEQ ID NO: 68109 - DNA, 25 bp, Homo sapien
gataaaatagcagaaaacgctgaaa

SEQ ID NO: 68110 - DNA, 25 bp, Homo sapien
gataaaatgttagcctatcaatatt

SEQ ID NO: 68111 - DNA, 25 bp, Homo sapien
gataaaatgttagcgtatcaatatt

SEQ ID NO: 68112 - DNA, 25 bp, Homo sapien
gataaaattgccatggttatctctg

SEQ ID NO: 68113 - DNA, 25 bp, Homo sapien
gataaaattgccttggttatctctg

SEQ ID NO: 68114 - DNA, 25 bp, Homo sapien
gataaacaatatgtttggcattctg

SEQ ID NO: 68115 - DNA, 25 bp, Homo sapien
gataaacaccaaataaatgcaacaa

SEQ ID NO: 68116 - DNA, 25 bp, Homo sapien
gataaacagcaaataaatgcaacaa

SEQ ID NO: 68117 - DNA, 25 bp, Homo sapien
gataaacagctgaagaatctgggtg

SEQ ID NO: 68118 - DNA, 25 bp, Homo sapien
gataaacagtatgtttggcattctg

SEQ ID NO: 68119 - DNA, 25 bp, Homo sapien
gataaacagttgaagaatctgggtg

SEQ ID NO: 68120 - DNA, 25 bp, Homo sapien
gataaacccaatcaaatcagaaaga

SEQ ID NO: 68121 - DNA, 25 bp, Homo sapien
gataaacccaatccaatcagaaaga

SEQ ID NO: 68122 - DNA, 25 bp, Homo sapien
gataaagacagcagttggttagatc

SEQ ID NO: 68123 - DNA, 25 bp, Homo sapien
gataaagacaggagttggttagatc

SEQ ID NO: 68124 - DNA, 25 bp, Homo sapien
gataaagatgagtaaaacaaactgt

SEQ ID NO: 68125 - DNA, 25 bp, Homo sapien
gataaagatgagtaaatcaaactgt

SEQ ID NO: 68126 - DNA, 25 bp, Homo sapien
gataaagcatagcgaaggatgggga

SEQ ID NO: 68127 - DNA, 25 bp, Homo sapien
gataaagcatagtgaaggatgggga

SEQ ID NO: 68128 - DNA, 25 bp, Homo sapien
gataaagccaagacaatattaggat

SEQ ID NO: 68129 - DNA, 25 bp, Homo sapien
gataaagccaaggcaatattaggat

SEQ ID NO: 68130 - DNA, 25 bp, Homo sapien
gataaagctatgcactgtgtttgtc

SEQ ID NO: 68131 - DNA, 25 bp, Homo sapien
gataaagctatgtactgtgtttgtc

SEQ ID NO: 68132 - DNA, 25 bp, Homo sapien
gataaagggttaaagcagatagaga

SEQ ID NO: 68133 - DNA, 25 bp, Homo sapien
gataaagggttagagcagatagaga

SEQ ID NO: 68134 - DNA, 25 bp, Homo sapien
gataaagtgtctatcaagtgcatga

SEQ ID NO: 68135 - DNA, 25 bp, Homo sapien
gataaagtgtctctcaagtgcatga

SEQ ID NO: 68136 - DNA, 25 bp, Homo sapien
gataaataccaagaaacacaattgc

SEQ ID NO: 68137 - DNA, 25 bp, Homo sapien
gataaataccaaggaacacaattgc

SEQ ID NO: 68138 - DNA, 25 bp, Homo sapien
gataaatcagttcagatctaatatt

SEQ ID NO: 68139 - DNA, 25 bp, Homo sapien
gataaatcagtttagatctaatatt

SEQ ID NO: 68140 - DNA, 25 bp, Homo sapien
gataaatcccactaggttctgatga

SEQ ID NO: 68141 - DNA, 25 bp, Homo sapien
gataaatcccacttggttctgatga

SEQ ID NO: 68142 - DNA, 25 bp, Homo sapien
gataaatcgtgaattggaaggagtc

SEQ ID NO: 68143 - DNA, 25 bp, Homo sapien
gataaatcgtgagttggaaggagtc

SEQ ID NO: 68144 - DNA, 25 bp, Homo sapien
gataaatgaacaaacacaatgtggg

SEQ ID NO: 68145 - DNA, 25 bp, Homo sapien
gataaatgagcaaacacaatgtggg

SEQ ID NO: 68146 - DNA, 25 bp, Homo sapien
gataaatgcacacatgtcaaggtgt

SEQ ID NO: 68147 - DNA, 25 bp, Homo sapien
gataaatgcacagatgtcaaggtgt

SEQ ID NO: 68148 - DNA, 25 bp, Homo sapien
gataacacaaacgaagagaaacaca

SEQ ID NO: 68149 - DNA, 25 bp, Homo sapien
gataacacaaatgaagagaaacaca

SEQ ID NO: 68150 - DNA, 25 bp, Homo sapien
gataacacaggtcattaaaggtctg

SEQ ID NO: 68151 - DNA, 25 bp, Homo sapien
gataacacaggtcgttaaaggtctg

SEQ ID NO: 68152 - DNA, 25 bp, Homo sapien
gataacagcagagaagatatttttg

SEQ ID NO: 68153 - DNA, 25 bp, Homo sapien
gataacagcagaggagatatttttg

SEQ ID NO: 68154 - DNA, 25 bp, Homo sapien
gataacaggcagtagcagtcctgaa

SEQ ID NO: 68155 - DNA, 25 bp, Homo sapien
gataacaggcagtagcggtcctgaa

SEQ ID NO: 68156 - DNA, 25 bp, Homo sapien
gataacatgttatacacccttttca

SEQ ID NO: 68157 - DNA, 25 bp, Homo sapien
gataacatgttatatacccttttca

SEQ ID NO: 68158 - DNA, 25 bp, Homo sapien
gataaccaaataaaatttgaggatt

SEQ ID NO: 68159 - DNA, 25 bp, Homo sapien
gataaccaaatacaatttgaggatt

SEQ ID NO: 68160 - DNA, 25 bp, Homo sapien
gataaccaccatcatgcaaacatgc

SEQ ID NO: 68161 - DNA, 25 bp, Homo sapien
gataaccaccatcgtgcaaacatgc

SEQ ID NO: 68162 - DNA, 25 bp, Homo sapien
gataactaatacttgtacacacaaa

SEQ ID NO: 68163 - DNA, 25 bp, Homo sapien
gataactaatatttgtacacacaaa

SEQ ID NO: 68164 - DNA, 25 bp, Homo sapien
gataactcaaaccgccaaatttcaa

SEQ ID NO: 68165 - DNA, 25 bp, Homo sapien
gataactcaaactgccaaatttcaa

SEQ ID NO: 68166 - DNA, 25 bp, Homo sapien
gataactctctataactccttcaag

SEQ ID NO: 68167 - DNA, 25 bp, Homo sapien
gataactctctgtaactccttcaag

SEQ ID NO: 68168 - DNA, 25 bp, Homo sapien
gataagaaagcccgggtgtttcctt

SEQ ID NO: 68169 - DNA, 25 bp, Homo sapien
gataagaaagcctgggtgtttcctt

SEQ ID NO: 68170 - DNA, 25 bp, Homo sapien
gataagaatgccaattaaatgcaca

SEQ ID NO: 68171 - DNA, 25 bp, Homo sapien
gataagaatgccgattaaatgcaca

SEQ ID NO: 68172 - DNA, 25 bp, Homo sapien
gataagaattgaacaaccaaatatc

SEQ ID NO: 68173 - DNA, 25 bp, Homo sapien
gataagaattgaccaaccaaatatc

SEQ ID NO: 68174 - DNA, 25 bp, Homo sapien
gataagacagaggaaatataagaat

SEQ ID NO: 68175 - DNA, 25 bp, Homo sapien
gataagacagtcaaattgggagcag

SEQ ID NO: 68176 - DNA, 25 bp, Homo sapien
gataagacagtcaagttgggagcag

SEQ ID NO: 68177 - DNA, 25 bp, Homo sapien
gataagactgaggaaatataagaat

SEQ ID NO: 68178 - DNA, 25 bp, Homo sapien
gataagaggcttatttctaaactcc

SEQ ID NO: 68179 - DNA, 25 bp, Homo sapien
gataagaggcttatttttaaactcc

SEQ ID NO: 68180 - DNA, 25 bp, Homo sapien
gataagagtgttccttctcaaatca

SEQ ID NO: 68181 - DNA, 25 bp, Homo sapien
gataagagtgtttcttctcaaatca

SEQ ID NO: 68182 - DNA, 25 bp, Homo sapien
gataagcctgtgctttccttaaaca

SEQ ID NO: 68183 - DNA, 25 bp, Homo sapien
gataagcctgtgttttccttaaaca

SEQ ID NO: 68184 - DNA, 25 bp, Homo sapien
gataaggacatgtaaaggaagttgg

SEQ ID NO: 68185 - DNA, 25 bp, Homo sapien
gataaggacatgtgaaggaagttgg

SEQ ID NO: 68186 - DNA, 25 bp, Homo sapien
gataagggaatgcttgctcatatgg

SEQ ID NO: 68187 - DNA, 25 bp, Homo sapien
gataagggaatgcttgttcatatgg

SEQ ID NO: 68188 - DNA, 25 bp, Homo sapien
gataagtaataatagcccttgagat

SEQ ID NO: 68189 - DNA, 25 bp, Homo sapien
gataagtaataattgcccttgagat

SEQ ID NO: 68190 - DNA, 25 bp, Homo sapien
gataagtagaggacagctgaaccaa

SEQ ID NO: 68191 - DNA, 25 bp, Homo sapien
gataagtagagggcagctgaaccaa

SEQ ID NO: 68192 - DNA, 25 bp, Homo sapien
gataagtctcaaatccatttccttg

SEQ ID NO: 68193 - DNA, 25 bp, Homo sapien
gataagtctcaaatccttttccttg

SEQ ID NO: 68194 - DNA, 25 bp, Homo sapien
gataagttagctacccaatgacaag

SEQ ID NO: 68195 - DNA, 25 bp, Homo sapien
gataagttagctactcaatgacaag

SEQ ID NO: 68196 - DNA, 25 bp, Homo sapien
gataagttcagaatagtcacaattt

SEQ ID NO: 68197 - DNA, 25 bp, Homo sapien
gataagttccgaatagtcacaattt

SEQ ID NO: 68198 - DNA, 25 bp, Homo sapien
gataataaacagcggtcagtttttg

SEQ ID NO: 68199 - DNA, 25 bp, Homo sapien
gataataaacagtggtcagtttttg

SEQ ID NO: 68200 - DNA, 25 bp, Homo sapien
gataataacttcctagtctacattt

SEQ ID NO: 68201 - DNA, 25 bp, Homo sapien
gataataatcagctgatagcacagg

SEQ ID NO: 68202 - DNA, 25 bp, Homo sapien
gataataatcagcttatagcacagg

SEQ ID NO: 68203 - DNA, 25 bp, Homo sapien
gataataatttcctagtctacattt

SEQ ID NO: 68204 - DNA, 25 bp, Homo sapien
gataatagacttggcaaaaacacaa

SEQ ID NO: 68205 - DNA, 25 bp, Homo sapien
gataatagatttggcaaaaacacaa

SEQ ID NO: 68206 - DNA, 25 bp, Homo sapien
gataataggagccgaaattccatag

SEQ ID NO: 68207 - DNA, 25 bp, Homo sapien
gataataggagctgaaattccatag

SEQ ID NO: 68208 - DNA, 25 bp, Homo sapien
gataatatcatcgtccaggagggtt

SEQ ID NO: 68209 - DNA, 25 bp, Homo sapien
gataatatcatcttccaggagggtt

SEQ ID NO: 68210 - DNA, 25 bp, Homo sapien
gataatattctatccgaaagacctt

SEQ ID NO: 68211 - DNA, 25 bp, Homo sapien
gataatattctatctgaaagacctt

SEQ ID NO: 68212 - DNA, 25 bp, Homo sapien
gataatatttccaacgtgactctac

SEQ ID NO: 68213 - DNA, 25 bp, Homo sapien
gataatatttccaatgtgactctac

SEQ ID NO: 68214 - DNA, 25 bp, Homo sapien
gataatcagatggtttttgctttta

SEQ ID NO: 68215 - DNA, 25 bp, Homo sapien
gataatcagatgttttttgctttta

SEQ ID NO: 68216 - DNA, 25 bp, Homo sapien
gataatccactctcattctccgaga

SEQ ID NO: 68217 - DNA, 25 bp, Homo sapien
gataatccactcttattctccgaga

SEQ ID NO: 68218 - DNA, 25 bp, Homo sapien
gataatccaggatattctccttata

SEQ ID NO: 68219 - DNA, 25 bp, Homo sapien
gataatccaggttattctccttata

SEQ ID NO: 68220 - DNA, 25 bp, Homo sapien
gataatctgagattcacgcaaagac

SEQ ID NO: 68221 - DNA, 25 bp, Homo sapien
gataatctgaggttcacgcaaagac

SEQ ID NO: 68222 - DNA, 25 bp, Homo sapien
gataatgagaaccctaaagcttaat

SEQ ID NO: 68223 - DNA, 25 bp, Homo sapien
gataatgagaaccctacagcttaat

SEQ ID NO: 68224 - DNA, 25 bp, Homo sapien
gataatgagaacgttctctggcatg

SEQ ID NO: 68225 - DNA, 25 bp, Homo sapien
gataatgagaatgttctctggcatg

SEQ ID NO: 68226 - DNA, 25 bp, Homo sapien
gataatgccgctgtgctatgaatag

SEQ ID NO: 68227 - DNA, 25 bp, Homo sapien
gataatgctagaggatccagctggg

SEQ ID NO: 68228 - DNA, 25 bp, Homo sapien
gataatgctagaggctccagctggg

SEQ ID NO: 68229 - DNA, 25 bp, Homo sapien
gataatgctgctgtgctatgaatag

SEQ ID NO: 68230 - DNA, 25 bp, Homo sapien
gataatgtgaaatatggcctaattt

SEQ ID NO: 68231 - DNA, 25 bp, Homo sapien
gataatgtgaactatggcctaattt

SEQ ID NO: 68232 - DNA, 25 bp, Homo sapien
gataattcaatgaaagaaagaataa

SEQ ID NO: 68233 - DNA, 25 bp, Homo sapien
gataattcaatgagagaaagaataa

SEQ ID NO: 68234 - DNA, 25 bp, Homo sapien
gataattcaattacttattgtgcac

SEQ ID NO: 68235 - DNA, 25 bp, Homo sapien
gataattcaattatttattgtgcac

SEQ ID NO: 68236 - DNA, 25 bp, Homo sapien
gataattgggtgtagacagtaaata

SEQ ID NO: 68237 - DNA, 25 bp, Homo sapien
gataattgggtgtagatagtaaata

SEQ ID NO: 68238 - DNA, 25 bp, Homo sapien
gataatttacgctaacaatatgatt

SEQ ID NO: 68239 - DNA, 25 bp, Homo sapien
gataatttatgctaacaatatgatt

SEQ ID NO: 68240 - DNA, 25 bp, Homo sapien
gatacaaactggtccccgataaaaa

SEQ ID NO: 68241 - DNA, 25 bp, Homo sapien
gatacaaactggtccctgataaaaa

SEQ ID NO: 68242 - DNA, 25 bp, Homo sapien
gatacaaagtgaagagtaaatcagt

SEQ ID NO: 68243 - DNA, 25 bp, Homo sapien
gatacaaagtgaatagtaaatcagt

SEQ ID NO: 68244 - DNA, 25 bp, Homo sapien
gatacaaatacagaacaatctcaac

SEQ ID NO: 68245 - DNA, 25 bp, Homo sapien
gatacaaatacagatcaatctcaac

SEQ ID NO: 68246 - DNA, 25 bp, Homo sapien
gatacaagattaatatgcaaaaatc

SEQ ID NO: 68247 - DNA, 25 bp, Homo sapien
gatacaagattagtatgcaaaaatc

SEQ ID NO: 68248 - DNA, 25 bp, Homo sapien
gatacagaggttcaatcctagggct

SEQ ID NO: 68249 - DNA, 25 bp, Homo sapien
gatacagaggttcagtcctagggct

SEQ ID NO: 68250 - DNA, 25 bp, Homo sapien
gatacagcaacataactcctgagtg

SEQ ID NO: 68251 - DNA, 25 bp, Homo sapien
gatacagcaacatgactcctgagtg

SEQ ID NO: 68252 - DNA, 25 bp, Homo sapien
gatacagtaaacagggccattgata

SEQ ID NO: 68253 - DNA, 25 bp, Homo sapien
gatacagtaaatagggccattgata

SEQ ID NO: 68254 - DNA, 25 bp, Homo sapien
gatacattggaacccttgcgcaccg

SEQ ID NO: 68255 - DNA, 25 bp, Homo sapien
gatacattggaactcttgcgcaccg

SEQ ID NO: 68256 - DNA, 25 bp, Homo sapien
gataccaaaacccaaaagagacata

SEQ ID NO: 68257 - DNA, 25 bp, Homo sapien
gataccaaaacccgaaagagacata

SEQ ID NO: 68258 - DNA, 25 bp, Homo sapien
gataccaaagacaaagttaacagac

SEQ ID NO: 68259 - DNA, 25 bp, Homo sapien
gataccaaagataaagttaacagac

SEQ ID NO: 68260 - DNA, 25 bp, Homo sapien
gataccaagaagacaaaaaactctc

SEQ ID NO: 68261 - DNA, 25 bp, Homo sapien
gataccaagaaggcaaaaaactctc

SEQ ID NO: 68262 - DNA, 25 bp, Homo sapien
gataccaagataatttgcaagctag

SEQ ID NO: 68263 - DNA, 25 bp, Homo sapien
gataccaagatattttgcaagctag

SEQ ID NO: 68264 - DNA, 25 bp, Homo sapien
gataccaagggaagactgtatgtgt

SEQ ID NO: 68265 - DNA, 25 bp, Homo sapien
gataccaagggacgactgtatgtgt

SEQ ID NO: 68266 - DNA, 25 bp, Homo sapien
gataccacaataaacgatattttct

SEQ ID NO: 68267 - DNA, 25 bp, Homo sapien
gataccacgataaacgatattttct

SEQ ID NO: 68268 - DNA, 25 bp, Homo sapien
gataccacgctcttccacgtaggaa

SEQ ID NO: 68269 - DNA, 25 bp, Homo sapien
gataccactctcttccacgtaggaa

SEQ ID NO: 68270 - DNA, 25 bp, Homo sapien
gatacctgggacaatgagggacagg

SEQ ID NO: 68271 - DNA, 25 bp, Homo sapien
gatacctgggacaatgcgggacagg

SEQ ID NO: 68272 - DNA, 25 bp, Homo sapien
gatacctgggttctaatcttaacag

SEQ ID NO: 68273 - DNA, 25 bp, Homo sapien
gatacctgtgtccatgtaagttatt

SEQ ID NO: 68274 - DNA, 25 bp, Homo sapien
gatacctgtgtccctgtaagttatt

SEQ ID NO: 68275 - DNA, 25 bp, Homo sapien
gatacctgtgttctaatcttaacag

SEQ ID NO: 68276 - DNA, 25 bp, Homo sapien
gatactaacatgccgtccatagcag

SEQ ID NO: 68277 - DNA, 25 bp, Homo sapien
gatactaacatgctgtccatagcag

SEQ ID NO: 68278 - DNA, 25 bp, Homo sapien
gatactaaggctcggcatcctttaa

SEQ ID NO: 68279 - DNA, 25 bp, Homo sapien
gatactaaggctcggcgtcctttaa

SEQ ID NO: 68280 - DNA, 25 bp, Homo sapien
gatactagaaatgtatagcctttgt

SEQ ID NO: 68281 - DNA, 25 bp, Homo sapien
gatactagaaatttatagcctttgt

SEQ ID NO: 68282 - DNA, 25 bp, Homo sapien
gatactagcagtagaggattcagaa

SEQ ID NO: 68283 - DNA, 25 bp, Homo sapien
gatactagcggtagaggattcagaa

SEQ ID NO: 68284 - DNA, 25 bp, Homo sapien
gatactcaaactgttcttaggaaat

SEQ ID NO: 68285 - DNA, 25 bp, Homo sapien
gatactcaaacttttcttaggaaat

SEQ ID NO: 68286 - DNA, 25 bp, Homo sapien
gatactcacatattgaatagatcac

SEQ ID NO: 68287 - DNA, 25 bp, Homo sapien
gatactcatatattgaatagatcac

SEQ ID NO: 68288 - DNA, 25 bp, Homo sapien
gatactcggtctccttaattcagga

SEQ ID NO: 68289 - DNA, 25 bp, Homo sapien
gatactcggtcttcttaattcagga

SEQ ID NO: 68290 - DNA, 25 bp, Homo sapien
gatactctacacatgctctataaat

SEQ ID NO: 68291 - DNA, 25 bp, Homo sapien
gatactctacacgtgctctataaat

SEQ ID NO: 68292 - DNA, 25 bp, Homo sapien
gatactctcaccataggtaacttgc

SEQ ID NO: 68293 - DNA, 25 bp, Homo sapien
gatactctcactataggtaacttgc

SEQ ID NO: 68294 - DNA, 25 bp, Homo sapien
gatactgacatcaagacctaaggta

SEQ ID NO: 68295 - DNA, 25 bp, Homo sapien
gatactgacatcaagagctaaggta

SEQ ID NO: 68296 - DNA, 25 bp, Homo sapien
gatactgagacaactcatgaagact

SEQ ID NO: 68297 - DNA, 25 bp, Homo sapien
gatactgagacagctcatgaagact

SEQ ID NO: 68298 - DNA, 25 bp, Homo sapien
gatactgagataaggataaacatat

SEQ ID NO: 68299 - DNA, 25 bp, Homo sapien
gatactgagatagggataaacatat

SEQ ID NO: 68300 - DNA, 25 bp, Homo sapien
gatactgatacacttttttgcagat

SEQ ID NO: 68301 - DNA, 25 bp, Homo sapien
gatactgatacatttttttgcagat

SEQ ID NO: 68302 - DNA, 25 bp, Homo sapien
gatactgcctgccattctccaggga

SEQ ID NO: 68303 - DNA, 25 bp, Homo sapien
gatactgcctgctattctccaggga

SEQ ID NO: 68304 - DNA, 25 bp, Homo sapien
gatactgggcagcgaaacaacacat

SEQ ID NO: 68305 - DNA, 25 bp, Homo sapien
gatactgggcagtgaaacaacacat

SEQ ID NO: 68306 - DNA, 25 bp, Homo sapien
gatactgtgctaagtcatttctttg

SEQ ID NO: 68307 - DNA, 25 bp, Homo sapien
gatactgtgctaagtcctttctttg

SEQ ID NO: 68308 - DNA, 25 bp, Homo sapien
gatacttcattcgaccattttaatt

SEQ ID NO: 68309 - DNA, 25 bp, Homo sapien
gatacttcatttgaccattttaatt

SEQ ID NO: 68310 - DNA, 25 bp, Homo sapien
gatacttgacttttatattcaatgg

SEQ ID NO: 68311 - DNA, 25 bp, Homo sapien
gatacttgatttttatattcaatgg

SEQ ID NO: 68312 - DNA, 25 bp, Homo sapien
gatactttgacaaaagtgccacaat

SEQ ID NO: 68313 - DNA, 25 bp, Homo sapien
gatactttgacagaagtgccacaat

SEQ ID NO: 68314 - DNA, 25 bp, Homo sapien
gatacttttatgtaattctctgttt

SEQ ID NO: 68315 - DNA, 25 bp, Homo sapien
gatacttttatttaattctctgttt

SEQ ID NO: 68316 - DNA, 25 bp, Homo sapien
gatagaaaagtaacagttgtcccaa

SEQ ID NO: 68317 - DNA, 25 bp, Homo sapien
gatagaaaagttacagttgtcccaa

SEQ ID NO: 68318 - DNA, 25 bp, Homo sapien
gatagaacatcatccttccattggc

SEQ ID NO: 68319 - DNA, 25 bp, Homo sapien
gatagaacgtcatccttccattggc

SEQ ID NO: 68320 - DNA, 25 bp, Homo sapien
gatagacatgacagttttacaatgc

SEQ ID NO: 68321 - DNA, 25 bp, Homo sapien
gatagacatgacggttttacaatgc

SEQ ID NO: 68322 - DNA, 25 bp, Homo sapien
gatagactacgcattctcttattta

SEQ ID NO: 68323 - DNA, 25 bp, Homo sapien
gatagactatgcattctcttattta

SEQ ID NO: 68324 - DNA, 25 bp, Homo sapien
gatagagaagcaccctgaagcctgg

SEQ ID NO: 68325 - DNA, 25 bp, Homo sapien
gatagagaagcatcctgaagcctgg

SEQ ID NO: 68326 - DNA, 25 bp, Homo sapien
gatagagacattcagccaaggataa

SEQ ID NO: 68327 - DNA, 25 bp, Homo sapien
gatagagacgttcagccaaggataa

SEQ ID NO: 68328 - DNA, 25 bp, Homo sapien
gatagagattttcggttttatccat

SEQ ID NO: 68329 - DNA, 25 bp, Homo sapien
gatagagatttttggttttatccat

SEQ ID NO: 68330 - DNA, 25 bp, Homo sapien
gatagagcagaaccctttttcaaaa

SEQ ID NO: 68331 - DNA, 25 bp, Homo sapien
gatagagcagagcgcaaggaatgat

SEQ ID NO: 68332 - DNA, 25 bp, Homo sapien
gatagagcagagtgcaaggaatgat

SEQ ID NO: 68333 - DNA, 25 bp, Homo sapien
gatagagcggaaccctttttcaaaa

SEQ ID NO: 68334 - DNA, 25 bp, Homo sapien
gatagagttctcctttgatttgaac

SEQ ID NO: 68335 - DNA, 25 bp, Homo sapien
gatagagttgtcatttttagggaga

SEQ ID NO: 68336 - DNA, 25 bp, Homo sapien
gatagagttgtcgtttttagggaga

SEQ ID NO: 68337 - DNA, 25 bp, Homo sapien
gatagagttttcctttgatttgaac

SEQ ID NO: 68338 - DNA, 25 bp, Homo sapien
gatagataaaaactccaatacagca

SEQ ID NO: 68339 - DNA, 25 bp, Homo sapien
gatagataaaaactccgatacagca

SEQ ID NO: 68340 - DNA, 25 bp, Homo sapien
gatagataaaaggaggaatccctac

SEQ ID NO: 68341 - DNA, 25 bp, Homo sapien
gatagataaaatgaggaatccctac

SEQ ID NO: 68342 - DNA, 25 bp, Homo sapien
gatagatacaaccatggagtcctat

SEQ ID NO: 68343 - DNA, 25 bp, Homo sapien
gatagatacaatagctagatggaga

SEQ ID NO: 68344 - DNA, 25 bp, Homo sapien
gatagatacgatagctagatggaga

SEQ ID NO: 68345 - DNA, 25 bp, Homo sapien
gatagatagatacaaccatggagtc

SEQ ID NO: 68346 - DNA, 25 bp, Homo sapien
gatagatagatacaatagctagatg

SEQ ID NO: 68347 - DNA, 25 bp, Homo sapien
gatagatagatacgatagctagatg

SEQ ID NO: 68348 - DNA, 25 bp, Homo sapien
gatagatagatataaccatggagtc

SEQ ID NO: 68349 - DNA, 25 bp, Homo sapien
gatagatataaccatggagtcctat

SEQ ID NO: 68350 - DNA, 25 bp, Homo sapien
gatagatcagtactttacagccttc

SEQ ID NO: 68351 - DNA, 25 bp, Homo sapien
gatagatcagtacttttcagccttc

SEQ ID NO: 68352 - DNA, 25 bp, Homo sapien
gatagatcatagatgacagatatgt

SEQ ID NO: 68353 - DNA, 25 bp, Homo sapien
gatagatcatagttgacagatatgt

SEQ ID NO: 68354 - DNA, 25 bp, Homo sapien
gatagatcatataaagcctttctac

SEQ ID NO: 68355 - DNA, 25 bp, Homo sapien
gatagatcatataaaggctttctac

SEQ ID NO: 68356 - DNA, 25 bp, Homo sapien
gatagatcctcacattcattccctg

SEQ ID NO: 68357 - DNA, 25 bp, Homo sapien
gatagatcctcagattcattccctg

SEQ ID NO: 68358 - DNA, 25 bp, Homo sapien
gatagatgacagaataagaaacaag

SEQ ID NO: 68359 - DNA, 25 bp, Homo sapien
gatagatgacaggataagaaacaag

SEQ ID NO: 68360 - DNA, 25 bp, Homo sapien
gatagatgttgagcccaggtagctt

SEQ ID NO: 68361 - DNA, 25 bp, Homo sapien
gatagatgttgagcccgggtagctt

SEQ ID NO: 68362 - DNA, 25 bp, Homo sapien
gatagcaatagtaactatccaggat

SEQ ID NO: 68363 - DNA, 25 bp, Homo sapien
gatagcaatagtagctatccaggat

SEQ ID NO: 68364 - DNA, 25 bp, Homo sapien
gatagcatctcatctgcagccccag

SEQ ID NO: 68365 - DNA, 25 bp, Homo sapien
gatagcatgtcatctgcagccccag

SEQ ID NO: 68366 - DNA, 25 bp, Homo sapien
gatagccaaaattgaaagctattga

SEQ ID NO: 68367 - DNA, 25 bp, Homo sapien
gatagccaaaattggaagctattga

SEQ ID NO: 68368 - DNA, 25 bp, Homo sapien
gatagctctacttgaccttcatctc

SEQ ID NO: 68369 - DNA, 25 bp, Homo sapien
gatagctctgcttgaccttcatctc

SEQ ID NO: 68370 - DNA, 25 bp, Homo sapien
gatagctgacatttgattctcctct

SEQ ID NO: 68371 - DNA, 25 bp, Homo sapien
gatagctgacattttattctcctct

SEQ ID NO: 68372 - DNA, 25 bp, Homo sapien
gatagctggcaggctaaaattgcag

SEQ ID NO: 68373 - DNA, 25 bp, Homo sapien
gatagctggcatgctaaaattgcag

SEQ ID NO: 68374 - DNA, 25 bp, Homo sapien
gataggaagaccgcactttgcaatc

SEQ ID NO: 68375 - DNA, 25 bp, Homo sapien
gataggaagactgcactttgcaatc

SEQ ID NO: 68376 - DNA, 25 bp, Homo sapien
gataggaagagaaaactgcacatta

SEQ ID NO: 68377 - DNA, 25 bp, Homo sapien
gataggaagggaaaactgcacatta

SEQ ID NO: 68378 - DNA, 25 bp, Homo sapien
gataggagagaaacaacgaagatat

SEQ ID NO: 68379 - DNA, 25 bp, Homo sapien
gataggagagaagcaacgaagatat

SEQ ID NO: 68380 - DNA, 25 bp, Homo sapien
gataggattgctaagcttgatgaat

SEQ ID NO: 68381 - DNA, 25 bp, Homo sapien
gataggattgctgagcttgatgaat

SEQ ID NO: 68382 - DNA, 25 bp, Homo sapien
gataggcaatggtatgaaagttggc

SEQ ID NO: 68383 - DNA, 25 bp, Homo sapien
gataggcaatggtgtgaaagttggc

SEQ ID NO: 68384 - DNA, 25 bp, Homo sapien
gataggctctttgaaaatatgcaat

SEQ ID NO: 68385 - DNA, 25 bp, Homo sapien
gataggctgtttgaaaatatgcaat

SEQ ID NO: 68386 - DNA, 25 bp, Homo sapien
gatagggcacgaccgaacttggttt

SEQ ID NO: 68387 - DNA, 25 bp, Homo sapien
gatagggcaggactctgtacttcag

SEQ ID NO: 68388 - DNA, 25 bp, Homo sapien
gatagggcaggactgtgtacttcag

SEQ ID NO: 68389 - DNA, 25 bp, Homo sapien
gatagggcatgaccgaacttggttt

SEQ ID NO: 68390 - DNA, 25 bp, Homo sapien
gatagggctatagtaaggagtaaaa

SEQ ID NO: 68391 - DNA, 25 bp, Homo sapien
gatagggctgtagtaaggagtaaaa

SEQ ID NO: 68392 - DNA, 25 bp, Homo sapien
gatagggttgtagtccaattatgta

SEQ ID NO: 68393 - DNA, 25 bp, Homo sapien
gatagggttgttgtccaattatgta

SEQ ID NO: 68394 - DNA, 25 bp, Homo sapien
gataggtaaatagagtttgcatgtg

SEQ ID NO: 68395 - DNA, 25 bp, Homo sapien
gataggtaaatatagtttgcatgtg

SEQ ID NO: 68396 - DNA, 25 bp, Homo sapien
gataggtaacccacagtcacacacg

SEQ ID NO: 68397 - DNA, 25 bp, Homo sapien
gataggtaccccacagtcacacacg

SEQ ID NO: 68398 - DNA, 25 bp, Homo sapien
gataggtcagaactagatgtagaga

SEQ ID NO: 68399 - DNA, 25 bp, Homo sapien
gataggtcagaagtagatgtagaga

SEQ ID NO: 68400 - DNA, 25 bp, Homo sapien
gataggtgaggcagatgacagtgtc

SEQ ID NO: 68401 - DNA, 25 bp, Homo sapien
gataggtgaggcggatgacagtgtc

SEQ ID NO: 68402 - DNA, 25 bp, Homo sapien
gatagtaaagaatacgagtaaacat

SEQ ID NO: 68403 - DNA, 25 bp, Homo sapien
gatagtaaagaatatgagtaaacat

SEQ ID NO: 68404 - DNA, 25 bp, Homo sapien
gatagtgttagaaactgggaatctg

SEQ ID NO: 68405 - DNA, 25 bp, Homo sapien
gatagtgttagagactgggaatctg

SEQ ID NO: 68406 - DNA, 25 bp, Homo sapien
gatagtgttttcttcaggtgtaagt

SEQ ID NO: 68407 - DNA, 25 bp, Homo sapien
gatagtgttttctttaggtgtaagt

SEQ ID NO: 68408 - DNA, 25 bp, Homo sapien
gatagttgcagagaggtggagatag

SEQ ID NO: 68409 - DNA, 25 bp, Homo sapien
gatagttgtagagaggtggagatag

SEQ ID NO: 68410 - DNA, 25 bp, Homo sapien
gatagttttctcctctgtcctcact

SEQ ID NO: 68411 - DNA, 25 bp, Homo sapien
gatagttttctcctgtgtcctcact

SEQ ID NO: 68412 - DNA, 25 bp, Homo sapien
gatataacacatttgtaataccata

SEQ ID NO: 68413 - DNA, 25 bp, Homo sapien
gatataacgcatttgtaataccata

SEQ ID NO: 68414 - DNA, 25 bp, Homo sapien
gatataagacgaagttcaaatgatg

SEQ ID NO: 68415 - DNA, 25 bp, Homo sapien
gatataagacggtcaactaaaatct

SEQ ID NO: 68416 - DNA, 25 bp, Homo sapien
gatataagatggtcaactaaaatct

SEQ ID NO: 68417 - DNA, 25 bp, Homo sapien
gatataagccgaagttcaaatgatg

SEQ ID NO: 68418 - DNA, 25 bp, Homo sapien
gatataatgctgaattactggccac

SEQ ID NO: 68419 - DNA, 25 bp, Homo sapien
gatataatggataccggaagcttta

SEQ ID NO: 68420 - DNA, 25 bp, Homo sapien
gatataatggattccggaagcttta

SEQ ID NO: 68421 - DNA, 25 bp, Homo sapien
gatataatgttgaattactggccac

SEQ ID NO: 68422 - DNA, 25 bp, Homo sapien
gatataattgcacaaacatgtacaa

SEQ ID NO: 68423 - DNA, 25 bp, Homo sapien
gatataatttcacaaacatgtacaa

SEQ ID NO: 68424 - DNA, 25 bp, Homo sapien
gatatacactgaaattagggatcct

SEQ ID NO: 68425 - DNA, 25 bp, Homo sapien
gatatacactgtagctaaagtgttg

SEQ ID NO: 68426 - DNA, 25 bp, Homo sapien
gatatacattgaaattagggatcct

SEQ ID NO: 68427 - DNA, 25 bp, Homo sapien
gatatacattgtagctaaagtgttg

SEQ ID NO: 68428 - DNA, 25 bp, Homo sapien
gatatactcatctagccacaggtat

SEQ ID NO: 68429 - DNA, 25 bp, Homo sapien
gatatactcatctcgccacaggtat

SEQ ID NO: 68430 - DNA, 25 bp, Homo sapien
gatataggagtaagttctgagcatg

SEQ ID NO: 68431 - DNA, 25 bp, Homo sapien
gatataggagtaggttctgagcatg

SEQ ID NO: 68432 - DNA, 25 bp, Homo sapien
gatatagtggccatagtaagaagaa

SEQ ID NO: 68433 - DNA, 25 bp, Homo sapien
gatatagtggccatggtaagaagaa

SEQ ID NO: 68434 - DNA, 25 bp, Homo sapien
gatatatgtatacgattgagcagga

SEQ ID NO: 68435 - DNA, 25 bp, Homo sapien
gatatatgtatatgattgagcagga

SEQ ID NO: 68436 - DNA, 25 bp, Homo sapien
gatatattggaacaattaatatgtt

SEQ ID NO: 68437 - DNA, 25 bp, Homo sapien
gatatattgtaacaattaatatgtt

SEQ ID NO: 68438 - DNA, 25 bp, Homo sapien
gatatatttcaacactaaaatttag

SEQ ID NO: 68439 - DNA, 25 bp, Homo sapien
gatatatttcaacagtaaaatttag

SEQ ID NO: 68440 - DNA, 25 bp, Homo sapien
gatatcacacgatcaagtgctgtca

SEQ ID NO: 68441 - DNA, 25 bp, Homo sapien
gatatcacatgatcaagtgctgtca

SEQ ID NO: 68442 - DNA, 25 bp, Homo sapien
gatatcagcaactactgaatgtgag

SEQ ID NO: 68443 - DNA, 25 bp, Homo sapien
gatatcagcaactattgaatgtgag

SEQ ID NO: 68444 - DNA, 25 bp, Homo sapien
gatatcagtcacatgcaactaagta

SEQ ID NO: 68445 - DNA, 25 bp, Homo sapien
gatatcagtcacgtgcaactaagta

SEQ ID NO: 68446 - DNA, 25 bp, Homo sapien
gatatcatgctggcattaactaggc

SEQ ID NO: 68447 - DNA, 25 bp, Homo sapien
gatatcatgttggcattaactaggc

SEQ ID NO: 68448 - DNA, 25 bp, Homo sapien
gatatcatttagtataacattgatg

SEQ ID NO: 68449 - DNA, 25 bp, Homo sapien
gatatcatttagtgtaacattgatg

SEQ ID NO: 68450 - DNA, 25 bp, Homo sapien
gatatccagttctcaaatgaccatc

SEQ ID NO: 68451 - DNA, 25 bp, Homo sapien
gatatccagttttcaaatgaccatc

SEQ ID NO: 68452 - DNA, 25 bp, Homo sapien
gatatcctcacagtactcattctcc

SEQ ID NO: 68453 - DNA, 25 bp, Homo sapien
gatatcctcacggtactcattctcc

SEQ ID NO: 68454 - DNA, 25 bp, Homo sapien
gatatcttacgaggttttgctagtc

SEQ ID NO: 68455 - DNA, 25 bp, Homo sapien
gatatcttatgaggttttgctagtc

SEQ ID NO: 68456 - DNA, 25 bp, Homo sapien
gatatgaacagcaaatgtttgttta

SEQ ID NO: 68457 - DNA, 25 bp, Homo sapien
gatatgaacggagtattcaaggcgt

SEQ ID NO: 68458 - DNA, 25 bp, Homo sapien
gatatgaactgagtattcaaggcgt

SEQ ID NO: 68459 - DNA, 25 bp, Homo sapien
gatatgaatagcaaatgtttgttta

SEQ ID NO: 68460 - DNA, 25 bp, Homo sapien
gatatgacaaatatttaatgctgat

SEQ ID NO: 68461 - DNA, 25 bp, Homo sapien
gatatgacaaatgtttaatgctgat

SEQ ID NO: 68462 - DNA, 25 bp, Homo sapien
gatatgacacagaaatggtaagctt

SEQ ID NO: 68463 - DNA, 25 bp, Homo sapien
gatatgacacagcaatggtaagctt

SEQ ID NO: 68464 - DNA, 25 bp, Homo sapien
gatatgacctcggtgtttattgtcc

SEQ ID NO: 68465 - DNA, 25 bp, Homo sapien
gatatgactcgtaactttccaataa

SEQ ID NO: 68466 - DNA, 25 bp, Homo sapien
gatatgacttcggtgtttattgtcc

SEQ ID NO: 68467 - DNA, 25 bp, Homo sapien
gatatgacttgtaactttccaataa

SEQ ID NO: 68468 - DNA, 25 bp, Homo sapien
gatatgatggttatcttgattttgg

SEQ ID NO: 68469 - DNA, 25 bp, Homo sapien
gatatgatgtttatcttgattttgg

SEQ ID NO: 68470 - DNA, 25 bp, Homo sapien
gatatgatttcagttgggccagtta

SEQ ID NO: 68471 - DNA, 25 bp, Homo sapien
gatatgatttcatttgggccagtta

SEQ ID NO: 68472 - DNA, 25 bp, Homo sapien
gatatggatcacatgggtataatgg

SEQ ID NO: 68473 - DNA, 25 bp, Homo sapien
gatatggatcacgtgggtataatgg

SEQ ID NO: 68474 - DNA, 25 bp, Homo sapien
gatatggcacatggctggggacctg

SEQ ID NO: 68475 - DNA, 25 bp, Homo sapien
gatatggcacatggttggggacctg

SEQ ID NO: 68476 - DNA, 25 bp, Homo sapien
gatatggctctaagtcagagtaata

SEQ ID NO: 68477 - DNA, 25 bp, Homo sapien
gatatggctttaagtcagagtaata

SEQ ID NO: 68478 - DNA, 25 bp, Homo sapien
gatatggtttccagggctgtaatat

SEQ ID NO: 68479 - DNA, 25 bp, Homo sapien
gatatggtttccagggttgtaatat

SEQ ID NO: 68480 - DNA, 25 bp, Homo sapien
gatatgtaccattgcaacttggaag

SEQ ID NO: 68481 - DNA, 25 bp, Homo sapien
gatatgtaccattgtaacttggaag

SEQ ID NO: 68482 - DNA, 25 bp, Homo sapien
gatatgtagcctgtgggatcctcaa

SEQ ID NO: 68483 - DNA, 25 bp, Homo sapien
gatatgtagtctgtgggatcctcaa

SEQ ID NO: 68484 - DNA, 25 bp, Homo sapien
gatatgtgtactcgtttcctggatt

SEQ ID NO: 68485 - DNA, 25 bp, Homo sapien
gatatgtgtacttgtttcctggatt

SEQ ID NO: 68486 - DNA, 25 bp, Homo sapien
gatatgttgagtctctgctgctact

SEQ ID NO: 68487 - DNA, 25 bp, Homo sapien
gatatgttgagtttctgctgctact

SEQ ID NO: 68488 - DNA, 25 bp, Homo sapien
gatattaaatgcagactctgttgaa

SEQ ID NO: 68489 - DNA, 25 bp, Homo sapien
gatattaaatgtagactctgttgaa

SEQ ID NO: 68490 - DNA, 25 bp, Homo sapien
gatattaggctgccatatgatccag

SEQ ID NO: 68491 - DNA, 25 bp, Homo sapien
gatattaggcttccatatgatccag

SEQ ID NO: 68492 - DNA, 25 bp, Homo sapien
gatattagttgttactcatttgtga

SEQ ID NO: 68493 - DNA, 25 bp, Homo sapien
gatattagttgttattcatttgtga

SEQ ID NO: 68494 - DNA, 25 bp, Homo sapien
gatattatcaacacgacagaagaga

SEQ ID NO: 68495 - DNA, 25 bp, Homo sapien
gatattatcaacatgacagaagaga

SEQ ID NO: 68496 - DNA, 25 bp, Homo sapien
gatattcaactctcaacattagaat

SEQ ID NO: 68497 - DNA, 25 bp, Homo sapien
gatattcagctctcaacattagaat

SEQ ID NO: 68498 - DNA, 25 bp, Homo sapien
gatattcatgttcttgactggttta

SEQ ID NO: 68499 - DNA, 25 bp, Homo sapien
gatattcatgttcttgtctggttta

SEQ ID NO: 68500 - DNA, 25 bp, Homo sapien
gatattccctttgccgatggttggg

SEQ ID NO: 68501 - DNA, 25 bp, Homo sapien
gatattccctttgctgatggttggg

SEQ ID NO: 68502 - DNA, 25 bp, Homo sapien
gatattcctcacctatggtttttgt

SEQ ID NO: 68503 - DNA, 25 bp, Homo sapien
gatattccttacctatggtttttgt

SEQ ID NO: 68504 - DNA, 25 bp, Homo sapien
gatattctgtgacagtagcccaaat

SEQ ID NO: 68505 - DNA, 25 bp, Homo sapien
gatattctgtgatagtagcccaaat

SEQ ID NO: 68506 - DNA, 25 bp, Homo sapien
gatattgaggcttaagagtcatgaa

SEQ ID NO: 68507 - DNA, 25 bp, Homo sapien
gatattgaggtgactgataaagttt

SEQ ID NO: 68508 - DNA, 25 bp, Homo sapien
gatattgaggtgattgataaagttt

SEQ ID NO: 68509 - DNA, 25 bp, Homo sapien
gatattgagtcttaagagtcatgaa

SEQ ID NO: 68510 - DNA, 25 bp, Homo sapien
gatattgatcaccttattacctaga

SEQ ID NO: 68511 - DNA, 25 bp, Homo sapien
gatattgattaccttattacctaga

SEQ ID NO: 68512 - DNA, 25 bp, Homo sapien
gatattggcaaaccatgtgttgtta

SEQ ID NO: 68513 - DNA, 25 bp, Homo sapien
gatattggcaaactatgtgttgtta

SEQ ID NO: 68514 - DNA, 25 bp, Homo sapien
gatattgggtgcttattccctggct

SEQ ID NO: 68515 - DNA, 25 bp, Homo sapien
gatattgggtgtttattccctggct

SEQ ID NO: 68516 - DNA, 25 bp, Homo sapien
gatattgtttgaagcccaccacggc

SEQ ID NO: 68517 - DNA, 25 bp, Homo sapien
gatattgtttgaagtccaccacggc

SEQ ID NO: 68518 - DNA, 25 bp, Homo sapien
gatatttataaagcagaaaaaatct

SEQ ID NO: 68519 - DNA, 25 bp, Homo sapien
gatatttataaggcagaaaaaatct

SEQ ID NO: 68520 - DNA, 25 bp, Homo sapien
gatatttcagttaaggttctcttgg

SEQ ID NO: 68521 - DNA, 25 bp, Homo sapien
gatatttcagttgaggttctcttgg

SEQ ID NO: 68522 - DNA, 25 bp, Homo sapien
gatatttcagttgcaggctattagt

SEQ ID NO: 68523 - DNA, 25 bp, Homo sapien
gatatttcggttgcaggctattagt

SEQ ID NO: 68524 - DNA, 25 bp, Homo sapien
gatatttggaaaaccataaagggct

SEQ ID NO: 68525 - DNA, 25 bp, Homo sapien
gatatttggaaagccataaagggct

SEQ ID NO: 68526 - DNA, 25 bp, Homo sapien
gatattttgagtcaaaaagtaactt

SEQ ID NO: 68527 - DNA, 25 bp, Homo sapien
gatattttgagtgaaaaagtaactt

SEQ ID NO: 68528 - DNA, 25 bp, Homo sapien
gatattttgtcatcattgaggcctt

SEQ ID NO: 68529 - DNA, 25 bp, Homo sapien
gatattttgtcgtcattgaggcctt

SEQ ID NO: 68530 - DNA, 25 bp, Homo sapien
gatcaaaactgcatgatcttctgct

SEQ ID NO: 68531 - DNA, 25 bp, Homo sapien
gatcaaaactgcgtgatcttctgct

SEQ ID NO: 68532 - DNA, 25 bp, Homo sapien
gatcaaaccttaaccgtctggtttc

SEQ ID NO: 68533 - DNA, 25 bp, Homo sapien
gatcaaactttaaccgtctggtttc

SEQ ID NO: 68534 - DNA, 25 bp, Homo sapien
gatcaaagaacaactgaatggaatc

SEQ ID NO: 68535 - DNA, 25 bp, Homo sapien
gatcaaagaaccactgaatggaatc

SEQ ID NO: 68536 - DNA, 25 bp, Homo sapien
gatcaaagtaaataaaatggaacac

SEQ ID NO: 68537 - DNA, 25 bp, Homo sapien
gatcaaagtaaataaagtggaacac

SEQ ID NO: 68538 - DNA, 25 bp, Homo sapien
gatcaaatatctccggcatttcaaa

SEQ ID NO: 68539 - DNA, 25 bp, Homo sapien
gatcaaatatctctggcatttcaaa

SEQ ID NO: 68540 - DNA, 25 bp, Homo sapien
gatcaaatattccatgagtgttcca

SEQ ID NO: 68541 - DNA, 25 bp, Homo sapien
gatcaaatattccgtgagtgttcca

SEQ ID NO: 68542 - DNA, 25 bp, Homo sapien
gatcaaatgttcaaagcgcttgcaa

SEQ ID NO: 68543 - DNA, 25 bp, Homo sapien
gatcaaatgttcaacgcgcttgcaa

SEQ ID NO: 68544 - DNA, 25 bp, Homo sapien
gatcaaattttgcgaagataagaat

SEQ ID NO: 68545 - DNA, 25 bp, Homo sapien
gatcaaattttgtgaagataagaat

SEQ ID NO: 68546 - DNA, 25 bp, Homo sapien
gatcaacgatacggcagaagtatgc

SEQ ID NO: 68547 - DNA, 25 bp, Homo sapien
gatcaacgatatggcagaagtatgc

SEQ ID NO: 68548 - DNA, 25 bp, Homo sapien
gatcaacgtaatagtaaaaattctt

SEQ ID NO: 68549 - DNA, 25 bp, Homo sapien
gatcaacgtaatggtaaaaattctt

SEQ ID NO: 68550 - DNA, 25 bp, Homo sapien
gatcaagtctgcttagaaaggaaag

SEQ ID NO: 68551 - DNA, 25 bp, Homo sapien
gatcaagtctgtttagaaaggaaag

SEQ ID NO: 68552 - DNA, 25 bp, Homo sapien
gatcaataccaatgtatctcatata

SEQ ID NO: 68553 - DNA, 25 bp, Homo sapien
gatcaataggttaaatgtgattaca

SEQ ID NO: 68554 - DNA, 25 bp, Homo sapien
gatcaataggttcaatgtgattaca

SEQ ID NO: 68555 - DNA, 25 bp, Homo sapien
gatcaatatcaatgtatctcatata

SEQ ID NO: 68556 - DNA, 25 bp, Homo sapien
gatcaatatccctacatggaactct

SEQ ID NO: 68557 - DNA, 25 bp, Homo sapien
gatcaatatccctgcatggaactct

SEQ ID NO: 68558 - DNA, 25 bp, Homo sapien
gatcaatcataatcaaaaagcatca

SEQ ID NO: 68559 - DNA, 25 bp, Homo sapien
gatcaatcataatccaaaagcatca

SEQ ID NO: 68560 - DNA, 25 bp, Homo sapien
gatcacaaccagtgaaactatccga

SEQ ID NO: 68561 - DNA, 25 bp, Homo sapien
gatcacaactagtgaaactatccga

SEQ ID NO: 68562 - DNA, 25 bp, Homo sapien
gatcacaagattttggaaaagcccc

SEQ ID NO: 68563 - DNA, 25 bp, Homo sapien
gatcacaaggttttggaaaagcccc

SEQ ID NO: 68564 - DNA, 25 bp, Homo sapien
gatcacacaacattctaggttcatg

SEQ ID NO: 68565 - DNA, 25 bp, Homo sapien
gatcacacagcattctaggttcatg

SEQ ID NO: 68566 - DNA, 25 bp, Homo sapien
gatcacatcagagccacgctaggaa

SEQ ID NO: 68567 - DNA, 25 bp, Homo sapien
gatcacatcagagccatgctaggaa

SEQ ID NO: 68568 - DNA, 25 bp, Homo sapien
gatcaccaagagtcaactatagatc

SEQ ID NO: 68569 - DNA, 25 bp, Homo sapien
gatcaccaagagtcgactatagatc

SEQ ID NO: 68570 - DNA, 25 bp, Homo sapien
gatcaccttaaactgaaactcgatt

SEQ ID NO: 68571 - DNA, 25 bp, Homo sapien
gatcaccttaaattgaaactcgatt

SEQ ID NO: 68572 - DNA, 25 bp, Homo sapien
gatcacgctcatttgttcaaagcac

SEQ ID NO: 68573 - DNA, 25 bp, Homo sapien
gatcacgctcattttttcaaagcac

SEQ ID NO: 68574 - DNA, 25 bp, Homo sapien
gatcactatactcctaaagaaataa

SEQ ID NO: 68575 - DNA, 25 bp, Homo sapien
gatcactatactcgtaaagaaataa

SEQ ID NO: 68576 - DNA, 25 bp, Homo sapien
gatcactctgcaagatattgtagga

SEQ ID NO: 68577 - DNA, 25 bp, Homo sapien
gatcactctgcaaggtattgtagga

SEQ ID NO: 68578 - DNA, 25 bp, Homo sapien
gatcactgaagatttgagaaacata

SEQ ID NO: 68579 - DNA, 25 bp, Homo sapien
gatcactgaaggtttgagaaacata

SEQ ID NO: 68580 - DNA, 25 bp, Homo sapien
gatcacttacctgtttgttctgact

SEQ ID NO: 68581 - DNA, 25 bp, Homo sapien
gatcacttatctgtttgttctgact

SEQ ID NO: 68582 - DNA, 25 bp, Homo sapien
gatcagaatttaagccactcttttc

SEQ ID NO: 68583 - DNA, 25 bp, Homo sapien
gatcagaatttaagtcactcttttc

SEQ ID NO: 68584 - DNA, 25 bp, Homo sapien
gatcagagagagctgagtggataag

SEQ ID NO: 68585 - DNA, 25 bp, Homo sapien
gatcagagagaggtgagtggataag

SEQ ID NO: 68586 - DNA, 25 bp, Homo sapien
gatcagcaaagcgctgtaactatgg

SEQ ID NO: 68587 - DNA, 25 bp, Homo sapien
gatcagcaaagtgctgtaactatgg

SEQ ID NO: 68588 - DNA, 25 bp, Homo sapien
gatcagcactaacaccacataccag

SEQ ID NO: 68589 - DNA, 25 bp, Homo sapien
gatcagcactaacgccacataccag

SEQ ID NO: 68590 - DNA, 25 bp, Homo sapien
gatcagcattcctacttcaccaaaa

SEQ ID NO: 68591 - DNA, 25 bp, Homo sapien
gatcagcattcttacttcaccaaaa

SEQ ID NO: 68592 - DNA, 25 bp, Homo sapien
gatcagccagagaagtctgaggagg

SEQ ID NO: 68593 - DNA, 25 bp, Homo sapien
gatcagccagagaagtttgaggagg

SEQ ID NO: 68594 - DNA, 25 bp, Homo sapien
gatcagctcatggtgtaatatgtct

SEQ ID NO: 68595 - DNA, 25 bp, Homo sapien
gatcagctgatggtgtaatatgtct

SEQ ID NO: 68596 - DNA, 25 bp, Homo sapien
gatcaggaacctaatctaaccttgc

SEQ ID NO: 68597 - DNA, 25 bp, Homo sapien
gatcaggaccctaatctaaccttgc

SEQ ID NO: 68598 - DNA, 25 bp, Homo sapien
gatcaggacggaagcaaggctgtcc

SEQ ID NO: 68599 - DNA, 25 bp, Homo sapien
gatcaggatggaagcaaggctgtcc

SEQ ID NO: 68600 - DNA, 25 bp, Homo sapien
gatcaggatttcaaggccaacctgg

SEQ ID NO: 68601 - DNA, 25 bp, Homo sapien
gatcaggatttcaaggtcaacctgg

SEQ ID NO: 68602 - DNA, 25 bp, Homo sapien
gatcaggctcaggatgaaatcgagt

SEQ ID NO: 68603 - DNA, 25 bp, Homo sapien
gatcaggctcaggttgaaatcgagt

SEQ ID NO: 68604 - DNA, 25 bp, Homo sapien
gatcagtaacgtaggataaacctcc

SEQ ID NO: 68605 - DNA, 25 bp, Homo sapien
gatcagtaatagtaataataatagt

SEQ ID NO: 68606 - DNA, 25 bp, Homo sapien
gatcagtaatagtagtaataatagt

SEQ ID NO: 68607 - DNA, 25 bp, Homo sapien
gatcagtaatgtaggataaacctcc

SEQ ID NO: 68608 - DNA, 25 bp, Homo sapien
gatcagtactttacagccttcctac

SEQ ID NO: 68609 - DNA, 25 bp, Homo sapien
gatcagtacttttcagccttcctac

SEQ ID NO: 68610 - DNA, 25 bp, Homo sapien
gatcatacaggcatacacacaggag

SEQ ID NO: 68611 - DNA, 25 bp, Homo sapien
gatcatacaggcgtacacacaggag

SEQ ID NO: 68612 - DNA, 25 bp, Homo sapien
gatcatactactatatttccctgga

SEQ ID NO: 68613 - DNA, 25 bp, Homo sapien
gatcatactactgtatttccctgga

SEQ ID NO: 68614 - DNA, 25 bp, Homo sapien
gatcatagatgacagatatgtaaaa

SEQ ID NO: 68615 - DNA, 25 bp, Homo sapien
gatcatagcatcgtgattttgttaa

SEQ ID NO: 68616 - DNA, 25 bp, Homo sapien
gatcatagcatggtgattttgttaa

SEQ ID NO: 68617 - DNA, 25 bp, Homo sapien
gatcatagttgacagatatgtaaaa

SEQ ID NO: 68618 - DNA, 25 bp, Homo sapien
gatcatataaagcctttctactccg

SEQ ID NO: 68619 - DNA, 25 bp, Homo sapien
gatcatataaaggctttctactccg

SEQ ID NO: 68620 - DNA, 25 bp, Homo sapien
gatcatatagtgtgtaacctttgca

SEQ ID NO: 68621 - DNA, 25 bp, Homo sapien
gatcatatagtttgtaacctttgca

SEQ ID NO: 68622 - DNA, 25 bp, Homo sapien
gatcatctaatccaattccttcagt

SEQ ID NO: 68623 - DNA, 25 bp, Homo sapien
gatcatctaatctaattccttcagt

SEQ ID NO: 68624 - DNA, 25 bp, Homo sapien
gatcatctccaagttctgaaatgct

SEQ ID NO: 68625 - DNA, 25 bp, Homo sapien
gatcatctccatgttctgaaatgct

SEQ ID NO: 68626 - DNA, 25 bp, Homo sapien
gatcatgaaagttgtaaatttgaag

SEQ ID NO: 68627 - DNA, 25 bp, Homo sapien
gatcatgaaagttgtacatttgaag

SEQ ID NO: 68628 - DNA, 25 bp, Homo sapien
gatcatgagcgtactagaggctatg

SEQ ID NO: 68629 - DNA, 25 bp, Homo sapien
gatcatgagcgtagtagaggctatg

SEQ ID NO: 68630 - DNA, 25 bp, Homo sapien
gatcatgatcgggtaaagagattga

SEQ ID NO: 68631 - DNA, 25 bp, Homo sapien
gatcatgatcgtgtaaagagattga

SEQ ID NO: 68632 - DNA, 25 bp, Homo sapien
gatcatgattcctgagaaatattgc

SEQ ID NO: 68633 - DNA, 25 bp, Homo sapien
gatcatgattcttgagaaatattgc

SEQ ID NO: 68634 - DNA, 25 bp, Homo sapien
gatcatgcgtgtcatattgatcagc

SEQ ID NO: 68635 - DNA, 25 bp, Homo sapien
gatcatgcttgtcatattgatcagc

SEQ ID NO: 68636 - DNA, 25 bp, Homo sapien
gatcatggactacttcatgtcttaa

SEQ ID NO: 68637 - DNA, 25 bp, Homo sapien
gatcatggactatttcatgtcttaa

SEQ ID NO: 68638 - DNA, 25 bp, Homo sapien
gatcatgtaggtgcagacgtttagc

SEQ ID NO: 68639 - DNA, 25 bp, Homo sapien
gatcatgtaggtgtagacgtttagc

SEQ ID NO: 68640 - DNA, 25 bp, Homo sapien
gatcatgttttggtatacacactaa

SEQ ID NO: 68641 - DNA, 25 bp, Homo sapien
gatcatgttttggtattcacactaa

SEQ ID NO: 68642 - DNA, 25 bp, Homo sapien
gatcattaactcaggtctgactcac

SEQ ID NO: 68643 - DNA, 25 bp, Homo sapien
gatcattaactcgggtctgactcac

SEQ ID NO: 68644 - DNA, 25 bp, Homo sapien
gatcattacataagccactggctca

SEQ ID NO: 68645 - DNA, 25 bp, Homo sapien
gatcattacataagccgctggctca

SEQ ID NO: 68646 - DNA, 25 bp, Homo sapien
gatcattgcaggaaaggaagaaacc

SEQ ID NO: 68647 - DNA, 25 bp, Homo sapien
gatcattgcagggaaggaagaaacc

SEQ ID NO: 68648 - DNA, 25 bp, Homo sapien
gatcattggatttccatggtttttt

SEQ ID NO: 68649 - DNA, 25 bp, Homo sapien
gatcattggattttcatggtttttt

SEQ ID NO: 68650 - DNA, 25 bp, Homo sapien
gatcatttctgcataacttgtgtgt

SEQ ID NO: 68651 - DNA, 25 bp, Homo sapien
gatcatttctgcataatttgtgtgt

SEQ ID NO: 68652 - DNA, 25 bp, Homo sapien
gatcattttgcaactcctaacaaca

SEQ ID NO: 68653 - DNA, 25 bp, Homo sapien
gatcattttgcagctcctaacaaca

SEQ ID NO: 68654 - DNA, 25 bp, Homo sapien
gatccaaaatgccatagaaaataaa

SEQ ID NO: 68655 - DNA, 25 bp, Homo sapien
gatccaaagtgccatagaaaataaa

SEQ ID NO: 68656 - DNA, 25 bp, Homo sapien
gatccaaagttttcgtgcaaaatgt

SEQ ID NO: 68657 - DNA, 25 bp, Homo sapien
gatccaaagtttttgtgcaaaatgt

SEQ ID NO: 68658 - DNA, 25 bp, Homo sapien
gatccaacaggaaggcaactttttt

SEQ ID NO: 68659 - DNA, 25 bp, Homo sapien
gatccaacgggaaggcaactttttt

SEQ ID NO: 68660 - DNA, 25 bp, Homo sapien
gatccaagagtcagcgagatggtgc

SEQ ID NO: 68661 - DNA, 25 bp, Homo sapien
gatccaagagtcagtgagatggtgc

SEQ ID NO: 68662 - DNA, 25 bp, Homo sapien
gatccaagctgtagtccacagatct

SEQ ID NO: 68663 - DNA, 25 bp, Homo sapien
gatccaagctgtcgtccacagatct

SEQ ID NO: 68664 - DNA, 25 bp, Homo sapien
gatccaatcgccctaaagaatgatt

SEQ ID NO: 68665 - DNA, 25 bp, Homo sapien
gatccaatcgccttaaagaatgatt

SEQ ID NO: 68666 - DNA, 25 bp, Homo sapien
gatccaatggtcaccctttaggcag

SEQ ID NO: 68667 - DNA, 25 bp, Homo sapien
gatccaatggtgaccctttaggcag

SEQ ID NO: 68668 - DNA, 25 bp, Homo sapien
gatccacaagataattctgtgagcc

SEQ ID NO: 68669 - DNA, 25 bp, Homo sapien
gatccacaagatgattctgtgagcc

SEQ ID NO: 68670 - DNA, 25 bp, Homo sapien
gatccacttccacgatccaaatacc

SEQ ID NO: 68671 - DNA, 25 bp, Homo sapien
gatccacttccactatccaaatacc

SEQ ID NO: 68672 - DNA, 25 bp, Homo sapien
gatccagaagtgcgcatgcagattt

SEQ ID NO: 68673 - DNA, 25 bp, Homo sapien
gatccagaagtgtgcatgcagattt

SEQ ID NO: 68674 - DNA, 25 bp, Homo sapien
gatccagctgggaaagtgttgggaa

SEQ ID NO: 68675 - DNA, 25 bp, Homo sapien
gatccagctgggaaggtgttgggaa

SEQ ID NO: 68676 - DNA, 25 bp, Homo sapien
gatcccaaattcacacaggtagtga

SEQ ID NO: 68677 - DNA, 25 bp, Homo sapien
gatcccaagttcacacaggtagtga

SEQ ID NO: 68678 - DNA, 25 bp, Homo sapien
gatcccagcaaaatgactttcaaaa

SEQ ID NO: 68679 - DNA, 25 bp, Homo sapien
gatcccagcaaaatgattttcaaaa

SEQ ID NO: 68680 - DNA, 25 bp, Homo sapien
gatcccagcgccttcttccatctta

SEQ ID NO: 68681 - DNA, 25 bp, Homo sapien
gatcccagtgccttcttccatctta

SEQ ID NO: 68682 - DNA, 25 bp, Homo sapien
gatccccatcctcgacctcacaaat

SEQ ID NO: 68683 - DNA, 25 bp, Homo sapien
gatccccatccttgacctcacaaat

SEQ ID NO: 68684 - DNA, 25 bp, Homo sapien
gatcccgttggagaagctacaaaga

SEQ ID NO: 68685 - DNA, 25 bp, Homo sapien
gatcccgttggagaggctacaaaga

SEQ ID NO: 68686 - DNA, 25 bp, Homo sapien
gatccctcacttggagatgtggtag

SEQ ID NO: 68687 - DNA, 25 bp, Homo sapien
gatccctcgcttggagatgtggtag

SEQ ID NO: 68688 - DNA, 25 bp, Homo sapien
gatccctgcagtattgtttctacta

SEQ ID NO: 68689 - DNA, 25 bp, Homo sapien
gatccctgcggtattgtttctacta

SEQ ID NO: 68690 - DNA, 25 bp, Homo sapien
gatcctagcctaatgtgctattttt

SEQ ID NO: 68691 - DNA, 25 bp, Homo sapien
gatcctagcttaatgtgctattttt

SEQ ID NO: 68692 - DNA, 25 bp, Homo sapien
gatcctcaacagtccttatccaaac

SEQ ID NO: 68693 - DNA, 25 bp, Homo sapien
gatcctcaacagttcttatccaaac

SEQ ID NO: 68694 - DNA, 25 bp, Homo sapien
gatcctgaaggtcatggatgtttgt

SEQ ID NO: 68695 - DNA, 25 bp, Homo sapien
gatcctgatggtcatggatgtttgt

SEQ ID NO: 68696 - DNA, 25 bp, Homo sapien
gatcctgcggaagagctcccaattt

SEQ ID NO: 68697 - DNA, 25 bp, Homo sapien
gatcctgcggatgagctcccaattt

SEQ ID NO: 68698 - DNA, 25 bp, Homo sapien
gatcctggcttcagtacgttgaccc

SEQ ID NO: 68699 - DNA, 25 bp, Homo sapien
gatcctgggttcagtacgttgaccc

SEQ ID NO: 68700 - DNA, 25 bp, Homo sapien
gatccttaaaaataggaattcatcc

SEQ ID NO: 68701 - DNA, 25 bp, Homo sapien
gatccttagaaataggaattcatcc

SEQ ID NO: 68702 - DNA, 25 bp, Homo sapien
gatccttcactggcaaccccacatg

SEQ ID NO: 68703 - DNA, 25 bp, Homo sapien
gatccttcgctggcaaccccacatg

SEQ ID NO: 68704 - DNA, 25 bp, Homo sapien
gatcgaacagtacggcaatgtggaa

SEQ ID NO: 68705 - DNA, 25 bp, Homo sapien
gatcgaacagtatggcaatgtggaa

SEQ ID NO: 68706 - DNA, 25 bp, Homo sapien
gatcgagatgatatcttgattttca

SEQ ID NO: 68707 - DNA, 25 bp, Homo sapien
gatcgagatgatattttgattttca

SEQ ID NO: 68708 - DNA, 25 bp, Homo sapien
gatcgatgcggttgttctttcctct

SEQ ID NO: 68709 - DNA, 25 bp, Homo sapien
gatcgatgtggttgttctttcctct

SEQ ID NO: 68710 - DNA, 25 bp, Homo sapien
gatcggctgaccctgcctctgaccc

SEQ ID NO: 68711 - DNA, 25 bp, Homo sapien
gatcggctgaccctgcttctgaccc

SEQ ID NO: 68712 - DNA, 25 bp, Homo sapien
gatcgggcagccattgtgcacttgg

SEQ ID NO: 68713 - DNA, 25 bp, Homo sapien
gatcgggcagccgttgtgcacttgg

SEQ ID NO: 68714 - DNA, 25 bp, Homo sapien
gatcgtctcatgccattctcctaac

SEQ ID NO: 68715 - DNA, 25 bp, Homo sapien
gatcgtctcatgccgttctcctaac

SEQ ID NO: 68716 - DNA, 25 bp, Homo sapien
gatctaaaaattgcaccatgtcaaa

SEQ ID NO: 68717 - DNA, 25 bp, Homo sapien
gatctaaacattgcaccatgtcaaa

SEQ ID NO: 68718 - DNA, 25 bp, Homo sapien
gatctaacatttgaaagtgatttga

SEQ ID NO: 68719 - DNA, 25 bp, Homo sapien
gatctaacatttgatagtgatttga

SEQ ID NO: 68720 - DNA, 25 bp, Homo sapien
gatctaagtcactacggcacacagg

SEQ ID NO: 68721 - DNA, 25 bp, Homo sapien
gatctaagtcactatggcacacagg

SEQ ID NO: 68722 - DNA, 25 bp, Homo sapien
gatctactagacagtgcttaagcat

SEQ ID NO: 68723 - DNA, 25 bp, Homo sapien
gatctactagacggtgcttaagcat

SEQ ID NO: 68724 - DNA, 25 bp, Homo sapien
gatctacttagcattttgcctacct

SEQ ID NO: 68725 - DNA, 25 bp, Homo sapien
gatctacttagtattttgcctacct

SEQ ID NO: 68726 - DNA, 25 bp, Homo sapien
gatctagcaggacttcaatgtacat

SEQ ID NO: 68727 - DNA, 25 bp, Homo sapien
gatctagcaggagttcaatgtacat

SEQ ID NO: 68728 - DNA, 25 bp, Homo sapien
gatctaggaagcacagcgtatccca

SEQ ID NO: 68729 - DNA, 25 bp, Homo sapien
gatctaggaagcacagtgtatccca

SEQ ID NO: 68730 - DNA, 25 bp, Homo sapien
gatctagtcagtaaactcaccaatg

SEQ ID NO: 68731 - DNA, 25 bp, Homo sapien
gatctagtcagtaagctcaccaatg

SEQ ID NO: 68732 - DNA, 25 bp, Homo sapien
gatctataccaattcccacaggtta

SEQ ID NO: 68733 - DNA, 25 bp, Homo sapien
gatctataccagttcccacaggtta

SEQ ID NO: 68734 - DNA, 25 bp, Homo sapien
gatctatcaagcaaaactgaacaca

SEQ ID NO: 68735 - DNA, 25 bp, Homo sapien
gatctatcatgcaaaactgaacaca

SEQ ID NO: 68736 - DNA, 25 bp, Homo sapien
gatctatgttttatcatttatcagt

SEQ ID NO: 68737 - DNA, 25 bp, Homo sapien
gatctatgttttatgatttatcagt

SEQ ID NO: 68738 - DNA, 25 bp, Homo sapien
gatctcaacatacaaatattaaagg

SEQ ID NO: 68739 - DNA, 25 bp, Homo sapien
gatctcaacatacgaatattaaagg

SEQ ID NO: 68740 - DNA, 25 bp, Homo sapien
gatctcacacatacgtagttcacaa

SEQ ID NO: 68741 - DNA, 25 bp, Homo sapien
gatctcacacatatgtagttcacaa

SEQ ID NO: 68742 - DNA, 25 bp, Homo sapien
gatctcacgtcacatgcacatatgg

SEQ ID NO: 68743 - DNA, 25 bp, Homo sapien
gatctcacgtcacatgtacatatgg

SEQ ID NO: 68744 - DNA, 25 bp, Homo sapien
gatctcatccttggctgccttctct

SEQ ID NO: 68745 - DNA, 25 bp, Homo sapien
gatctcatccttgtctgccttctct

SEQ ID NO: 68746 - DNA, 25 bp, Homo sapien
gatctcatttaatcctcataataac

SEQ ID NO: 68747 - DNA, 25 bp, Homo sapien
gatctcatttaattctcataataac

SEQ ID NO: 68748 - DNA, 25 bp, Homo sapien
gatctccacgtcctactaagaaact

SEQ ID NO: 68749 - DNA, 25 bp, Homo sapien
gatctccatgtcctactaagaaact

SEQ ID NO: 68750 - DNA, 25 bp, Homo sapien
gatctccttgccctagcctaggaaa

SEQ ID NO: 68751 - DNA, 25 bp, Homo sapien
gatctccttgcgctagcctaggaaa

SEQ ID NO: 68752 - DNA, 25 bp, Homo sapien
gatctctagcaatctttccctctta

SEQ ID NO: 68753 - DNA, 25 bp, Homo sapien
gatctctagcagtctttccctctta

SEQ ID NO: 68754 - DNA, 25 bp, Homo sapien
gatctctgtcactaaggaatgtttt

SEQ ID NO: 68755 - DNA, 25 bp, Homo sapien
gatctctgtcattaaggaatgtttt

SEQ ID NO: 68756 - DNA, 25 bp, Homo sapien
gatctctgtggtaacggaatgtctg

SEQ ID NO: 68757 - DNA, 25 bp, Homo sapien
gatctctgtggtaatggaatgtctg

SEQ ID NO: 68758 - DNA, 25 bp, Homo sapien
gatctcttcacgtataggtttcatc

SEQ ID NO: 68759 - DNA, 25 bp, Homo sapien
gatctcttcacgtatatgtttcatc

SEQ ID NO: 68760 - DNA, 25 bp, Homo sapien
gatctcttcgcttcctgtaaataga

SEQ ID NO: 68761 - DNA, 25 bp, Homo sapien
gatctcttcgctttctgtaaataga

SEQ ID NO: 68762 - DNA, 25 bp, Homo sapien
gatctctttatgctctcacatgctg

SEQ ID NO: 68763 - DNA, 25 bp, Homo sapien
gatctctttatgctgtcacatgctg

SEQ ID NO: 68764 - DNA, 25 bp, Homo sapien
gatctctttctactgtggatgaagg

SEQ ID NO: 68765 - DNA, 25 bp, Homo sapien
gatctctttctattgtggatgaagg

SEQ ID NO: 68766 - DNA, 25 bp, Homo sapien
gatctctttttactgaggtatactg

SEQ ID NO: 68767 - DNA, 25 bp, Homo sapien
gatctctttttagtgaggtatactg

SEQ ID NO: 68768 - DNA, 25 bp, Homo sapien
gatctgaatttgagctctagttgcc

SEQ ID NO: 68769 - DNA, 25 bp, Homo sapien
gatctgaatttgcgctctagttgcc

SEQ ID NO: 68770 - DNA, 25 bp, Homo sapien
gatctgacccagagaccagaggcac

SEQ ID NO: 68771 - DNA, 25 bp, Homo sapien
gatctgacccagcgaccagaggcac

SEQ ID NO: 68772 - DNA, 25 bp, Homo sapien
gatctgactgttacggagaaaagat

SEQ ID NO: 68773 - DNA, 25 bp, Homo sapien
gatctgactgttatggagaaaagat

SEQ ID NO: 68774 - DNA, 25 bp, Homo sapien
gatctgacttacctaggtgatttta

SEQ ID NO: 68775 - DNA, 25 bp, Homo sapien
gatctgacttacttaggtgatttta

SEQ ID NO: 68776 - DNA, 25 bp, Homo sapien
gatctgagtcacttctcagcaacat

SEQ ID NO: 68777 - DNA, 25 bp, Homo sapien
gatctgagtcacttttcagcaacat

SEQ ID NO: 68778 - DNA, 25 bp, Homo sapien
gatctgatcatgaattctcttagaa

SEQ ID NO: 68779 - DNA, 25 bp, Homo sapien
gatctgatcgtgaattctcttagaa

SEQ ID NO: 68780 - DNA, 25 bp, Homo sapien
gatctgattatacgttctgtactgt

SEQ ID NO: 68781 - DNA, 25 bp, Homo sapien
gatctgattatatgttctgtactgt

SEQ ID NO: 68782 - DNA, 25 bp, Homo sapien
gatctgcaggagaactggtgccctt

SEQ ID NO: 68783 - DNA, 25 bp, Homo sapien
gatctgcaggagagctggtgccctt

SEQ ID NO: 68784 - DNA, 25 bp, Homo sapien
gatctggagtgactcctcacatcgc

SEQ ID NO: 68785 - DNA, 25 bp, Homo sapien
gatctggagtgattcctcacatcgc

SEQ ID NO: 68786 - DNA, 25 bp, Homo sapien
gatctgtgcaaaacttctaggagta

SEQ ID NO: 68787 - DNA, 25 bp, Homo sapien
gatctgtgcaaagcttctaggagta

SEQ ID NO: 68788 - DNA, 25 bp, Homo sapien
gatctgtggaagagaactgagaaaa

SEQ ID NO: 68789 - DNA, 25 bp, Homo sapien
gatctgtggaagggaactgagaaaa

SEQ ID NO: 68790 - DNA, 25 bp, Homo sapien
gatcttaaccacattgccaactgga

SEQ ID NO: 68791 - DNA, 25 bp, Homo sapien
gatcttaaccatattgccaactgga

SEQ ID NO: 68792 - DNA, 25 bp, Homo sapien
gatcttaacctcaattctgcttctt

SEQ ID NO: 68793 - DNA, 25 bp, Homo sapien
gatcttaacctcagttctgcttctt

SEQ ID NO: 68794 - DNA, 25 bp, Homo sapien
gatcttaattaggaaaccatatttg

SEQ ID NO: 68795 - DNA, 25 bp, Homo sapien
gatcttaattaggagaccatatttg

SEQ ID NO: 68796 - DNA, 25 bp, Homo sapien
gatcttagcactgagggtcctcttg

SEQ ID NO: 68797 - DNA, 25 bp, Homo sapien
gatcttagcactgggggtcctcttg

SEQ ID NO: 68798 - DNA, 25 bp, Homo sapien
gatcttattatcaggcatatatgca

SEQ ID NO: 68799 - DNA, 25 bp, Homo sapien
gatcttattatgaggcatatatgca

SEQ ID NO: 68800 - DNA, 25 bp, Homo sapien
gatcttccctgtgtcataagtaagc

SEQ ID NO: 68801 - DNA, 25 bp, Homo sapien
gatcttccctgtttcataagtaagc

SEQ ID NO: 68802 - DNA, 25 bp, Homo sapien
gatcttgtactttaaactctggcct

SEQ ID NO: 68803 - DNA, 25 bp, Homo sapien
gatcttgtatatttggacaatgggg

SEQ ID NO: 68804 - DNA, 25 bp, Homo sapien
gatcttgtgctttaaactctggcct

SEQ ID NO: 68805 - DNA, 25 bp, Homo sapien
gatcttgtgtatttggacaatgggg

SEQ ID NO: 68806 - DNA, 25 bp, Homo sapien
gatctttacaagacctgagccatag

SEQ ID NO: 68807 - DNA, 25 bp, Homo sapien
gatctttacaagagctgagccatag

SEQ ID NO: 68808 - DNA, 25 bp, Homo sapien
gatctttatccaccttctcctcact

SEQ ID NO: 68809 - DNA, 25 bp, Homo sapien
gatctttattcaccttctcctcact

SEQ ID NO: 68810 - DNA, 25 bp, Homo sapien
gatctttcaaggtatcgttgggagt

SEQ ID NO: 68811 - DNA, 25 bp, Homo sapien
gatctttcatatatattgtgtcatc

SEQ ID NO: 68812 - DNA, 25 bp, Homo sapien
gatctttcatggtatcgttgggagt

SEQ ID NO: 68813 - DNA, 25 bp, Homo sapien
gatctttcctatatattgtgtcatc

SEQ ID NO: 68814 - DNA, 25 bp, Homo sapien
gatcttttacttgtggttaggctta

SEQ ID NO: 68815 - DNA, 25 bp, Homo sapien
gatcttttatttgtggttaggctta

SEQ ID NO: 68816 - DNA, 25 bp, Homo sapien
gatgaaaaaaatcataaactcattg

SEQ ID NO: 68817 - DNA, 25 bp, Homo sapien
gatgaaaaaaatgataaactcattg

SEQ ID NO: 68818 - DNA, 25 bp, Homo sapien
gatgaaaacaaagtgtggattggga

SEQ ID NO: 68819 - DNA, 25 bp, Homo sapien
gatgaaaacaaggtgtggattggga

SEQ ID NO: 68820 - DNA, 25 bp, Homo sapien
gatgaaaacagaattcctagtactc

SEQ ID NO: 68821 - DNA, 25 bp, Homo sapien
gatgaaaacgatatgataaaaaggg

SEQ ID NO: 68822 - DNA, 25 bp, Homo sapien
gatgaaaactatatgataaaaaggg

SEQ ID NO: 68823 - DNA, 25 bp, Homo sapien
gatgaaaagaactaaaggacataac

SEQ ID NO: 68824 - DNA, 25 bp, Homo sapien
gatgaaaagaattaaaggacataac

SEQ ID NO: 68825 - DNA, 25 bp, Homo sapien
gatgaaaagagaattcctagtactc

SEQ ID NO: 68826 - DNA, 25 bp, Homo sapien
gatgaaacaagctgtgcatggcagg

SEQ ID NO: 68827 - DNA, 25 bp, Homo sapien
gatgaaacaagttgtgcatggcagg

SEQ ID NO: 68828 - DNA, 25 bp, Homo sapien
gatgaaaccaggaattgccatcact

SEQ ID NO: 68829 - DNA, 25 bp, Homo sapien
gatgaaacctacttctagttcgtgt

SEQ ID NO: 68830 - DNA, 25 bp, Homo sapien
gatgaaacctagttctagttcgtgt

SEQ ID NO: 68831 - DNA, 25 bp, Homo sapien
gatgaaactaggaattgccatcact

SEQ ID NO: 68832 - DNA, 25 bp, Homo sapien
gatgaaactgggtatctgcgttcgc

SEQ ID NO: 68833 - DNA, 25 bp, Homo sapien
gatgaaactggttatctgcgttcgc

SEQ ID NO: 68834 - DNA, 25 bp, Homo sapien
gatgaaagacgcttaataatggtct

SEQ ID NO: 68835 - DNA, 25 bp, Homo sapien
gatgaaagatgcttaataatggtct

SEQ ID NO: 68836 - DNA, 25 bp, Homo sapien
gatgaaaggccagagttggtccttg

SEQ ID NO: 68837 - DNA, 25 bp, Homo sapien
gatgaaagggcataacaggaacatt

SEQ ID NO: 68838 - DNA, 25 bp, Homo sapien
gatgaaagggcataacgggaacatt

SEQ ID NO: 68839 - DNA, 25 bp, Homo sapien
gatgaaaggtcagagttggtccttg

SEQ ID NO: 68840 - DNA, 25 bp, Homo sapien
gatgaaatccataaaggtcagagcc

SEQ ID NO: 68841 - DNA, 25 bp, Homo sapien
gatgaaatccatgaaggtcagagcc

SEQ ID NO: 68842 - DNA, 25 bp, Homo sapien
gatgaaatctccaaattttatctgt

SEQ ID NO: 68843 - DNA, 25 bp, Homo sapien
gatgaaatctccgaattttatctgt

SEQ ID NO: 68844 - DNA, 25 bp, Homo sapien
gatgaacatccacaagcgtcaagac

SEQ ID NO: 68845 - DNA, 25 bp, Homo sapien
gatgaacatccacaagtgtcaagac

SEQ ID NO: 68846 - DNA, 25 bp, Homo sapien
gatgaactcctgaggcagaagtatt

SEQ ID NO: 68847 - DNA, 25 bp, Homo sapien
gatgaactcctgcggcagaagtatt

SEQ ID NO: 68848 - DNA, 25 bp, Homo sapien
gatgaactttaagtctagctgacaa

SEQ ID NO: 68849 - DNA, 25 bp, Homo sapien
gatgaactttaattctagctgacaa

SEQ ID NO: 68850 - DNA, 25 bp, Homo sapien
gatgaagaaaatgtcaagattttaa

SEQ ID NO: 68851 - DNA, 25 bp, Homo sapien
gatgaagaaaatgtcaggattttaa

SEQ ID NO: 68852 - DNA, 25 bp, Homo sapien
gatgaagacattcaacttgataaac

SEQ ID NO: 68853 - DNA, 25 bp, Homo sapien
gatgaagactcttagtgcatgatat

SEQ ID NO: 68854 - DNA, 25 bp, Homo sapien
gatgaagactcttcgtgcatgatat

SEQ ID NO: 68855 - DNA, 25 bp, Homo sapien
gatgaagatattcaacttgataaac

SEQ ID NO: 68856 - DNA, 25 bp, Homo sapien
gatgaagcataatagacggagtgtg

SEQ ID NO: 68857 - DNA, 25 bp, Homo sapien
gatgaagcataatagatggagtgtg

SEQ ID NO: 68858 - DNA, 25 bp, Homo sapien
gatgaagcccagcaaattcctagct

SEQ ID NO: 68859 - DNA, 25 bp, Homo sapien
gatgaagcgcagcaaattcctagct

SEQ ID NO: 68860 - DNA, 25 bp, Homo sapien
gatgaaggatagaaaatggaatcct

SEQ ID NO: 68861 - DNA, 25 bp, Homo sapien
gatgaaggatagagaatggaatcct

SEQ ID NO: 68862 - DNA, 25 bp, Homo sapien
gatgaagtaagcttggacagctgag

SEQ ID NO: 68863 - DNA, 25 bp, Homo sapien
gatgaagtaagcttggccagctgag

SEQ ID NO: 68864 - DNA, 25 bp, Homo sapien
gatgaagtcatgaaagtaaccagtg

SEQ ID NO: 68865 - DNA, 25 bp, Homo sapien
gatgaagtcatggaagtaaccagtg

SEQ ID NO: 68866 - DNA, 25 bp, Homo sapien
gatgaataattcctaaaatacgcaa

SEQ ID NO: 68867 - DNA, 25 bp, Homo sapien
gatgaataattcttaaaatacgcaa

SEQ ID NO: 68868 - DNA, 25 bp, Homo sapien
gatgaatactcaccctgtatgtgta

SEQ ID NO: 68869 - DNA, 25 bp, Homo sapien
gatgaatagccacgttttcagaaaa

SEQ ID NO: 68870 - DNA, 25 bp, Homo sapien
gatgaatagccatgttttcagaaaa

SEQ ID NO: 68871 - DNA, 25 bp, Homo sapien
gatgaatattcaccctgtatgtgta

SEQ ID NO: 68872 - DNA, 25 bp, Homo sapien
gatgaatgttaaaaggtaagtgctt

SEQ ID NO: 68873 - DNA, 25 bp, Homo sapien
gatgaatgttaaagggtaagtgctt

SEQ ID NO: 68874 - DNA, 25 bp, Homo sapien
gatgacaaaattcgaagatttacaa

SEQ ID NO: 68875 - DNA, 25 bp, Homo sapien
gatgacaaaatttgaagatttacaa

SEQ ID NO: 68876 - DNA, 25 bp, Homo sapien
gatgacaccacttgatcaaaccatc

SEQ ID NO: 68877 - DNA, 25 bp, Homo sapien
gatgacaccgcttgatcaaaccatc

SEQ ID NO: 68878 - DNA, 25 bp, Homo sapien
gatgacagaggaggagactttggta

SEQ ID NO: 68879 - DNA, 25 bp, Homo sapien
gatgacagaggaggaggctttggta

SEQ ID NO: 68880 - DNA, 25 bp, Homo sapien
gatgacagcatactaagacattcag

SEQ ID NO: 68881 - DNA, 25 bp, Homo sapien
gatgacagcgtactaagacattcag

SEQ ID NO: 68882 - DNA, 25 bp, Homo sapien
gatgacataatatatcactcataac

SEQ ID NO: 68883 - DNA, 25 bp, Homo sapien
gatgacataatgtatcactcataac

SEQ ID NO: 68884 - DNA, 25 bp, Homo sapien
gatgacccatatgcaaatgttcagt

SEQ ID NO: 68885 - DNA, 25 bp, Homo sapien
gatgacccctatgcaaatgttcagt

SEQ ID NO: 68886 - DNA, 25 bp, Homo sapien
gatgacgagctcactaagaagggtc

SEQ ID NO: 68887 - DNA, 25 bp, Homo sapien
gatgacgagctcattaagaagggtc

SEQ ID NO: 68888 - DNA, 25 bp, Homo sapien
gatgacgtttgctcagtcttatttc

SEQ ID NO: 68889 - DNA, 25 bp, Homo sapien
gatgacgtttgctcggtcttatttc

SEQ ID NO: 68890 - DNA, 25 bp, Homo sapien
gatgactaacttcaacagctaaatg

SEQ ID NO: 68891 - DNA, 25 bp, Homo sapien
gatgactaatttcaacagctaaatg

SEQ ID NO: 68892 - DNA, 25 bp, Homo sapien
gatgactacagatgccataagcctg

SEQ ID NO: 68893 - DNA, 25 bp, Homo sapien
gatgactatagatgccataagcctg

SEQ ID NO: 68894 - DNA, 25 bp, Homo sapien
gatgactcccctttcttcttagtac

SEQ ID NO: 68895 - DNA, 25 bp, Homo sapien
gatgactctcctttcttcttagtac

SEQ ID NO: 68896 - DNA, 25 bp, Homo sapien
gatgactgtatctggattatgtgat

SEQ ID NO: 68897 - DNA, 25 bp, Homo sapien
gatgactgtatctgtattatgtgat

SEQ ID NO: 68898 - DNA, 25 bp, Homo sapien
gatgacttcagatacagaaatcttt

SEQ ID NO: 68899 - DNA, 25 bp, Homo sapien
gatgacttcaggtacagaaatcttt

SEQ ID NO: 68900 - DNA, 25 bp, Homo sapien
gatgacttgaacatttcccaagttt

SEQ ID NO: 68901 - DNA, 25 bp, Homo sapien
gatgacttgaacgtttcccaagttt

SEQ ID NO: 68902 - DNA, 25 bp, Homo sapien
gatgacttgagtggatataacctgt

SEQ ID NO: 68903 - DNA, 25 bp, Homo sapien
gatgacttgagtggatgtaacctgt

SEQ ID NO: 68904 - DNA, 25 bp, Homo sapien
gatgagaatacagagcaactggaac

SEQ ID NO: 68905 - DNA, 25 bp, Homo sapien
gatgagaatacggagcaactggaac

SEQ ID NO: 68906 - DNA, 25 bp, Homo sapien
gatgagacaaaaatgtttactgtgg

SEQ ID NO: 68907 - DNA, 25 bp, Homo sapien
gatgagaccaaaatgtttactgtgg

SEQ ID NO: 68908 - DNA, 25 bp, Homo sapien
gatgagactagaatcaattaactcc

SEQ ID NO: 68909 - DNA, 25 bp, Homo sapien
gatgagactagaatgaattaactcc

SEQ ID NO: 68910 - DNA, 25 bp, Homo sapien
gatgagagctacaggcatcctttca

SEQ ID NO: 68911 - DNA, 25 bp, Homo sapien
gatgagagctagaggcatcctttca

SEQ ID NO: 68912 - DNA, 25 bp, Homo sapien
gatgagagctgactgctgaactgag

SEQ ID NO: 68913 - DNA, 25 bp, Homo sapien
gatgagagttgactgctgaactgag

SEQ ID NO: 68914 - DNA, 25 bp, Homo sapien
gatgagatgaaacaagctgtgcatg

SEQ ID NO: 68915 - DNA, 25 bp, Homo sapien
gatgagatgaaacaagttgtgcatg

SEQ ID NO: 68916 - DNA, 25 bp, Homo sapien
gatgagattagctgcacggctgagg

SEQ ID NO: 68917 - DNA, 25 bp, Homo sapien
gatgagattagctgcatggctgagg

SEQ ID NO: 68918 - DNA, 25 bp, Homo sapien
gatgagattcttcatggtgcattca

SEQ ID NO: 68919 - DNA, 25 bp, Homo sapien
gatgagatttttcatggtgcattca

SEQ ID NO: 68920 - DNA, 25 bp, Homo sapien
gatgagccttcagttgcgacctcag

SEQ ID NO: 68921 - DNA, 25 bp, Homo sapien
gatgagccttcagttgggacctcag

SEQ ID NO: 68922 - DNA, 25 bp, Homo sapien
gatgagctgctcagatgtcatacat

SEQ ID NO: 68923 - DNA, 25 bp, Homo sapien
gatgagctgctcagttgtcatacat

SEQ ID NO: 68924 - DNA, 25 bp, Homo sapien
gatgaggaaaccaagttatggtcta

SEQ ID NO: 68925 - DNA, 25 bp, Homo sapien
gatgaggaaaccgagttatggtcta

SEQ ID NO: 68926 - DNA, 25 bp, Homo sapien
gatgaggaactagaagattgggaag

SEQ ID NO: 68927 - DNA, 25 bp, Homo sapien
gatgaggaacttgaagattgggaag

SEQ ID NO: 68928 - DNA, 25 bp, Homo sapien
gatgaggacactgagactaagatgt

SEQ ID NO: 68929 - DNA, 25 bp, Homo sapien
gatgaggacactgatactaagatgt

SEQ ID NO: 68930 - DNA, 25 bp, Homo sapien
gatgaggagatagggagagaactgt

SEQ ID NO: 68931 - DNA, 25 bp, Homo sapien
gatgaggagctagggagagaactgt

SEQ ID NO: 68932 - DNA, 25 bp, Homo sapien
gatgaggatacaaagcagagcatgg

SEQ ID NO: 68933 - DNA, 25 bp, Homo sapien
gatgaggatacgaagcagagcatgg

SEQ ID NO: 68934 - DNA, 25 bp, Homo sapien
gatgaggcaaggaatgccactcata

SEQ ID NO: 68935 - DNA, 25 bp, Homo sapien
gatgaggcaaggaatgtcactcata

SEQ ID NO: 68936 - DNA, 25 bp, Homo sapien
gatgaggcagaaaattcgcatttcc

SEQ ID NO: 68937 - DNA, 25 bp, Homo sapien
gatgaggcagaaaatttgcatttcc

SEQ ID NO: 68938 - DNA, 25 bp, Homo sapien
gatgaggccgtgaaatgccagaata

SEQ ID NO: 68939 - DNA, 25 bp, Homo sapien
gatgaggctgtgaaatgccagaata

SEQ ID NO: 68940 - DNA, 25 bp, Homo sapien
gatgagggaatgctcagtgtgactg

SEQ ID NO: 68941 - DNA, 25 bp, Homo sapien
gatgagggaatgcttagtgtgactg

SEQ ID NO: 68942 - DNA, 25 bp, Homo sapien
gatgaggggttagcacggaagaatt

SEQ ID NO: 68943 - DNA, 25 bp, Homo sapien
gatgaggggtttgcacggaagaatt

SEQ ID NO: 68944 - DNA, 25 bp, Homo sapien
gatgaggttaacactgatgatcagt

SEQ ID NO: 68945 - DNA, 25 bp, Homo sapien
gatgaggttaacattgatgatcagt

SEQ ID NO: 68946 - DNA, 25 bp, Homo sapien
gatgagtacaaactatctacagcag

SEQ ID NO: 68947 - DNA, 25 bp, Homo sapien
gatgagtacaaattatctacagcag

SEQ ID NO: 68948 - DNA, 25 bp, Homo sapien
gatgagtagttcagcttgtgacatg

SEQ ID NO: 68949 - DNA, 25 bp, Homo sapien
gatgagtagttcagtttgtgacatg

SEQ ID NO: 68950 - DNA, 25 bp, Homo sapien
gatgagtcaaagatgggcagaaatg

SEQ ID NO: 68951 - DNA, 25 bp, Homo sapien
gatgagtcaaaggtgggcagaaatg

SEQ ID NO: 68952 - DNA, 25 bp, Homo sapien
gatgagtgttagagtccagagatca

SEQ ID NO: 68953 - DNA, 25 bp, Homo sapien
gatgagtgttagagtcgagagatca

SEQ ID NO: 68954 - DNA, 25 bp, Homo sapien
gatgataatgaagcattcctggcca

SEQ ID NO: 68955 - DNA, 25 bp, Homo sapien
gatgataatgaagtattcctggcca

SEQ ID NO: 68956 - DNA, 25 bp, Homo sapien
gatgatactcccaaaacttaggtat

SEQ ID NO: 68957 - DNA, 25 bp, Homo sapien
gatgatactcctaaaacttaggtat

SEQ ID NO: 68958 - DNA, 25 bp, Homo sapien
gatgatagcatctcatctgcagccc

SEQ ID NO: 68959 - DNA, 25 bp, Homo sapien
gatgatagcatgtcatctgcagccc

SEQ ID NO: 68960 - DNA, 25 bp, Homo sapien
gatgatcaactgatttttgacaagg

SEQ ID NO: 68961 - DNA, 25 bp, Homo sapien
gatgatcaagttccaccaagtattc

SEQ ID NO: 68962 - DNA, 25 bp, Homo sapien
gatgatcaattgatttttgacaagg

SEQ ID NO: 68963 - DNA, 25 bp, Homo sapien
gatgatcaatttccaccaagtattc

SEQ ID NO: 68964 - DNA, 25 bp, Homo sapien
gatgatcagctaattccacaaataa

SEQ ID NO: 68965 - DNA, 25 bp, Homo sapien
gatgatcagctagttccacaaataa

SEQ ID NO: 68966 - DNA, 25 bp, Homo sapien
gatgatcctggaaagaaaaaaaatt

SEQ ID NO: 68967 - DNA, 25 bp, Homo sapien
gatgatcctggagagaaaaaaaatt

SEQ ID NO: 68968 - DNA, 25 bp, Homo sapien
gatgatcgaggacagctaactagat

SEQ ID NO: 68969 - DNA, 25 bp, Homo sapien
gatgatcgatgacagctaactagat

SEQ ID NO: 68970 - DNA, 25 bp, Homo sapien
gatgatctttcaaggtatcgttggg

SEQ ID NO: 68971 - DNA, 25 bp, Homo sapien
gatgatctttcatggtatcgttggg

SEQ ID NO: 68972 - DNA, 25 bp, Homo sapien
gatgatggatgaaaagatataggta

SEQ ID NO: 68973 - DNA, 25 bp, Homo sapien
gatgatggatggaaagatataggta

SEQ ID NO: 68974 - DNA, 25 bp, Homo sapien
gatgatgttccactaaggatgggtg

SEQ ID NO: 68975 - DNA, 25 bp, Homo sapien
gatgatgttccagtaaggatgggtg

SEQ ID NO: 68976 - DNA, 25 bp, Homo sapien
gatgattgatgcacgccccttgttc

SEQ ID NO: 68977 - DNA, 25 bp, Homo sapien
gatgattgatgcatgccccttgttc

SEQ ID NO: 68978 - DNA, 25 bp, Homo sapien
gatgatttacggccagcttttgtac

SEQ ID NO: 68979 - DNA, 25 bp, Homo sapien
gatgatttatggccagcttttgtac

SEQ ID NO: 68980 - DNA, 25 bp, Homo sapien
gatgatttattgtatcactgctatc

SEQ ID NO: 68981 - DNA, 25 bp, Homo sapien
gatgatttattttatcactgctatc

SEQ ID NO: 68982 - DNA, 25 bp, Homo sapien
gatgatttcgggaatgattttttgt

SEQ ID NO: 68983 - DNA, 25 bp, Homo sapien
gatgattttcatggctttttatcat

SEQ ID NO: 68984 - DNA, 25 bp, Homo sapien
gatgattttcatggttttttatcat

SEQ ID NO: 68985 - DNA, 25 bp, Homo sapien
gatgattttgggaatgattttttgt

SEQ ID NO: 68986 - DNA, 25 bp, Homo sapien
gatgcaaaagagcataagagctggg

SEQ ID NO: 68987 - DNA, 25 bp, Homo sapien
gatgcaaaatagcataagagctggg

SEQ ID NO: 68988 - DNA, 25 bp, Homo sapien
gatgcaagggtaaaaaataaacaag

SEQ ID NO: 68989 - DNA, 25 bp, Homo sapien
gatgcaagggtaagaaataaacaag

SEQ ID NO: 68990 - DNA, 25 bp, Homo sapien
gatgcaagttgtagttcttctgtag

SEQ ID NO: 68991 - DNA, 25 bp, Homo sapien
gatgcaagttgtagtttttctgtag

SEQ ID NO: 68992 - DNA, 25 bp, Homo sapien
gatgcaatatatacctgtaatcata

SEQ ID NO: 68993 - DNA, 25 bp, Homo sapien
gatgcaatatatatctgtaatcata

SEQ ID NO: 68994 - DNA, 25 bp, Homo sapien
gatgcaatcattgaccttgaaaata

SEQ ID NO: 68995 - DNA, 25 bp, Homo sapien
gatgcaatcgttgaccttgaaaata

SEQ ID NO: 68996 - DNA, 25 bp, Homo sapien
gatgcaccattccatagaacaatag

SEQ ID NO: 68997 - DNA, 25 bp, Homo sapien
gatgcaccattcgatagaacaatag

SEQ ID NO: 68998 - DNA, 25 bp, Homo sapien
gatgcactcatatttttgcataaag

SEQ ID NO: 68999 - DNA, 25 bp, Homo sapien
gatgcactcatgtttttgcataaag

SEQ ID NO: 69000 - DNA, 25 bp, Homo sapien
gatgcacttgaaataaggatctact

SEQ ID NO: 69001 - DNA, 25 bp, Homo sapien
gatgcacttgaagtaaggatctact

SEQ ID NO: 69002 - DNA, 25 bp, Homo sapien
gatgcagaaactacagccttgttct

SEQ ID NO: 69003 - DNA, 25 bp, Homo sapien
gatgcagaaactacggccttgttct

SEQ ID NO: 69004 - DNA, 25 bp, Homo sapien
gatgcagacaaggaagctcagagga

SEQ ID NO: 69005 - DNA, 25 bp, Homo sapien
gatgcagacaaggaagttcagagga

SEQ ID NO: 69006 - DNA, 25 bp, Homo sapien
gatgcagagtacaaagcacatcctt

SEQ ID NO: 69007 - DNA, 25 bp, Homo sapien
gatgcagagtacaaggcacatcctt

SEQ ID NO: 69008 - DNA, 25 bp, Homo sapien
gatgcagatgacagagtgtgtctaa

SEQ ID NO: 69009 - DNA, 25 bp, Homo sapien
gatgcagatgagagagtgtgtctaa

SEQ ID NO: 69010 - DNA, 25 bp, Homo sapien
gatgcagatgccgttaaaactaagt

SEQ ID NO: 69011 - DNA, 25 bp, Homo sapien
gatgcagatgctgttaaaactaagt

SEQ ID NO: 69012 - DNA, 25 bp, Homo sapien
gatgcagggctgaacccagtctaaa

SEQ ID NO: 69013 - DNA, 25 bp, Homo sapien
gatgcagggctggacccagtctaaa

SEQ ID NO: 69014 - DNA, 25 bp, Homo sapien
gatgcaggggaaatgcagtccaagt

SEQ ID NO: 69015 - DNA, 25 bp, Homo sapien
gatgcaggggaagtgcagtccaagt

SEQ ID NO: 69016 - DNA, 25 bp, Homo sapien
gatgcagttcagtggaatgttagag

SEQ ID NO: 69017 - DNA, 25 bp, Homo sapien
gatgcagttcagtgtaatgttagag

SEQ ID NO: 69018 - DNA, 25 bp, Homo sapien
gatgcagtttttagtgcgacctggc

SEQ ID NO: 69019 - DNA, 25 bp, Homo sapien
gatgcagtttttagtgtgacctggc

SEQ ID NO: 69020 - DNA, 25 bp, Homo sapien
gatgcatacacctacttccttttta

SEQ ID NO: 69021 - DNA, 25 bp, Homo sapien
gatgcatacggaattgtgactctct

SEQ ID NO: 69022 - DNA, 25 bp, Homo sapien
gatgcatactcctacttccttttta

SEQ ID NO: 69023 - DNA, 25 bp, Homo sapien
gatgcatatggaattgtgactctct

SEQ ID NO: 69024 - DNA, 25 bp, Homo sapien
gatgcatgaggttaagagcaatatt

SEQ ID NO: 69025 - DNA, 25 bp, Homo sapien
gatgcatgaggttgagagcaatatt

SEQ ID NO: 69026 - DNA, 25 bp, Homo sapien
gatgcatttctccataccaagaaaa

SEQ ID NO: 69027 - DNA, 25 bp, Homo sapien
gatgcatttctccgtaccaagaaaa

SEQ ID NO: 69028 - DNA, 25 bp, Homo sapien
gatgccaaattcaggaaattaacaa

SEQ ID NO: 69029 - DNA, 25 bp, Homo sapien
gatgccaaattcgggaaattaacaa

SEQ ID NO: 69030 - DNA, 25 bp, Homo sapien
gatgccaatcatcagtagcacgcac

SEQ ID NO: 69031 - DNA, 25 bp, Homo sapien
gatgccaatcatcggtagcacgcac

SEQ ID NO: 69032 - DNA, 25 bp, Homo sapien
gatgccaatcgatactctgacaagg

SEQ ID NO: 69033 - DNA, 25 bp, Homo sapien
gatgccaattgatactctgacaagg

SEQ ID NO: 69034 - DNA, 25 bp, Homo sapien
gatgccaccattgacttcagttgag

SEQ ID NO: 69035 - DNA, 25 bp, Homo sapien
gatgccaccgttgacttcagttgag

SEQ ID NO: 69036 - DNA, 25 bp, Homo sapien
gatgccagtggaggcgacacagccc

SEQ ID NO: 69037 - DNA, 25 bp, Homo sapien
gatgccagtggaggcggcacagccc

SEQ ID NO: 69038 - DNA, 25 bp, Homo sapien
gatgccataattccttagtttggag

SEQ ID NO: 69039 - DNA, 25 bp, Homo sapien
gatgccataattgcttagtttggag

SEQ ID NO: 69040 - DNA, 25 bp, Homo sapien
gatgccatgagaaagcctgtcaatc

SEQ ID NO: 69041 - DNA, 25 bp, Homo sapien
gatgccatgagaaagcttgtcaatc

SEQ ID NO: 69042 - DNA, 25 bp, Homo sapien
gatgccattttcagacatttagagc

SEQ ID NO: 69043 - DNA, 25 bp, Homo sapien
gatgccattttcagacgtttagagc

SEQ ID NO: 69044 - DNA, 25 bp, Homo sapien
gatgcccctgtctgacatcggtgtc

SEQ ID NO: 69045 - DNA, 25 bp, Homo sapien
gatgcccctgtctggcatcggtgtc

SEQ ID NO: 69046 - DNA, 25 bp, Homo sapien
gatgccctgatactaatgggagaca

SEQ ID NO: 69047 - DNA, 25 bp, Homo sapien
gatgccctgatagtaatgggagaca

SEQ ID NO: 69048 - DNA, 25 bp, Homo sapien
gatgccctttcaaggagcctacagc

SEQ ID NO: 69049 - DNA, 25 bp, Homo sapien
gatgccctttcatggagcctacagc

SEQ ID NO: 69050 - DNA, 25 bp, Homo sapien
gatgcctatccagcctttccctgtt

SEQ ID NO: 69051 - DNA, 25 bp, Homo sapien
gatgcctatccggcctttccctgtt

SEQ ID NO: 69052 - DNA, 25 bp, Homo sapien
gatgcctatgtacgtggtatagctg

SEQ ID NO: 69053 - DNA, 25 bp, Homo sapien
gatgcctatgtgcgtggtatagctg

SEQ ID NO: 69054 - DNA, 25 bp, Homo sapien
gatgcctttgagaaaaatggtaaca

SEQ ID NO: 69055 - DNA, 25 bp, Homo sapien
gatgcctttgaggaaaatggtaaca

SEQ ID NO: 69056 - DNA, 25 bp, Homo sapien
gatgcggctaccgtgggataagaaa

SEQ ID NO: 69057 - DNA, 25 bp, Homo sapien
gatgcggctactgtgggataagaaa

SEQ ID NO: 69058 - DNA, 25 bp, Homo sapien
gatgcgtacctgcgctaagagaagt

SEQ ID NO: 69059 - DNA, 25 bp, Homo sapien
gatgcgtacctgctctaagagaagt

SEQ ID NO: 69060 - DNA, 25 bp, Homo sapien
gatgctaagcagaaccagaaagtaa

SEQ ID NO: 69061 - DNA, 25 bp, Homo sapien
gatgctaagcagaaccggaaagtaa

SEQ ID NO: 69062 - DNA, 25 bp, Homo sapien
gatgctaagtcagagtttcagctgt

SEQ ID NO: 69063 - DNA, 25 bp, Homo sapien
gatgctaagtcagtgtttcagctgt

SEQ ID NO: 69064 - DNA, 25 bp, Homo sapien
gatgctagaacttcactcccagaga

SEQ ID NO: 69065 - DNA, 25 bp, Homo sapien
gatgctagagcttcactcccagaga

SEQ ID NO: 69066 - DNA, 25 bp, Homo sapien
gatgctataacaaaagggtcttcca

SEQ ID NO: 69067 - DNA, 25 bp, Homo sapien
gatgctataacaacagggtcttcca

SEQ ID NO: 69068 - DNA, 25 bp, Homo sapien
gatgctatacgctttatatattttt

SEQ ID NO: 69069 - DNA, 25 bp, Homo sapien
gatgctatatgctttatatattttt

SEQ ID NO: 69070 - DNA, 25 bp, Homo sapien
gatgctattgggccacatgtagcct

SEQ ID NO: 69071 - DNA, 25 bp, Homo sapien
gatgctattgggtcacatgtagcct

SEQ ID NO: 69072 - DNA, 25 bp, Homo sapien
gatgctcaacaagccacttatctta

SEQ ID NO: 69073 - DNA, 25 bp, Homo sapien
gatgctcaacaatccacttatctta

SEQ ID NO: 69074 - DNA, 25 bp, Homo sapien
gatgctcacacctataagcccagtg

SEQ ID NO: 69075 - DNA, 25 bp, Homo sapien
gatgctcacacttataagcccagtg

SEQ ID NO: 69076 - DNA, 25 bp, Homo sapien
gatgctcatcaaactgttatttata

SEQ ID NO: 69077 - DNA, 25 bp, Homo sapien
gatgctcatcagactgttatttata

SEQ ID NO: 69078 - DNA, 25 bp, Homo sapien
gatgctccaatttgggaagcttcca

SEQ ID NO: 69079 - DNA, 25 bp, Homo sapien
gatgctccgatttgggaagcttcca

SEQ ID NO: 69080 - DNA, 25 bp, Homo sapien
gatgctgaagtcagagtctacataa

SEQ ID NO: 69081 - DNA, 25 bp, Homo sapien
gatgctgaagtcggagtctacataa

SEQ ID NO: 69082 - DNA, 25 bp, Homo sapien
gatgctgaggatcgaaaacagaact

SEQ ID NO: 69083 - DNA, 25 bp, Homo sapien
gatgctgaggattgaaaacagaact

SEQ ID NO: 69084 - DNA, 25 bp, Homo sapien
gatgctgccctctttcttatcactc

SEQ ID NO: 69085 - DNA, 25 bp, Homo sapien
gatgctgccttctttcttatcactc

SEQ ID NO: 69086 - DNA, 25 bp, Homo sapien
gatgcttaaacccaatagaagcctg

SEQ ID NO: 69087 - DNA, 25 bp, Homo sapien
gatgcttaaacccattagaagcctg

SEQ ID NO: 69088 - DNA, 25 bp, Homo sapien
gatgcttactcttcctcgagtcagt

SEQ ID NO: 69089 - DNA, 25 bp, Homo sapien
gatgcttactcttccttgagtcagt

SEQ ID NO: 69090 - DNA, 25 bp, Homo sapien
gatgcttatttatgaccttttaatt

SEQ ID NO: 69091 - DNA, 25 bp, Homo sapien
gatgcttatttgtgaccttttaatt

SEQ ID NO: 69092 - DNA, 25 bp, Homo sapien
gatgcttccaagacaattggctcgg

SEQ ID NO: 69093 - DNA, 25 bp, Homo sapien
gatgcttccaaggcaattggctcgg

SEQ ID NO: 69094 - DNA, 25 bp, Homo sapien
gatgctttaaaggaatttatggaat

SEQ ID NO: 69095 - DNA, 25 bp, Homo sapien
gatgctttaaagtaatttatggaat

SEQ ID NO: 69096 - DNA, 25 bp, Homo sapien
gatgctttctgctctatctttaggt

SEQ ID NO: 69097 - DNA, 25 bp, Homo sapien
gatgctttctggtctatctttaggt

SEQ ID NO: 69098 - DNA, 25 bp, Homo sapien
gatgctttctgtacgtgcttccttc

SEQ ID NO: 69099 - DNA, 25 bp, Homo sapien
gatgctttgtgtacgtgcttccttc

SEQ ID NO: 69100 - DNA, 25 bp, Homo sapien
gatggaaataatgccaaggctgtca

SEQ ID NO: 69101 - DNA, 25 bp, Homo sapien
gatggaaatataggaaaacaactaa

SEQ ID NO: 69102 - DNA, 25 bp, Homo sapien
gatggaaatataggaagacaactaa

SEQ ID NO: 69103 - DNA, 25 bp, Homo sapien
gatggaaatcatgccaaggctgtca

SEQ ID NO: 69104 - DNA, 25 bp, Homo sapien
gatggaaatgtgccaagtcacacct

SEQ ID NO: 69105 - DNA, 25 bp, Homo sapien
gatggaaatgtgccgagtcacacct

SEQ ID NO: 69106 - DNA, 25 bp, Homo sapien
gatggaaatgttcgctgtctgcact

SEQ ID NO: 69107 - DNA, 25 bp, Homo sapien
gatggaaatgttcgttgtctgcact

SEQ ID NO: 69108 - DNA, 25 bp, Homo sapien
gatggaaattttgctgtgagaatgt

SEQ ID NO: 69109 - DNA, 25 bp, Homo sapien
gatggaaattttggtgtgagaatgt

SEQ ID NO: 69110 - DNA, 25 bp, Homo sapien
gatggaaggaaactttttgcaagtg

SEQ ID NO: 69111 - DNA, 25 bp, Homo sapien
gatggaaggaaattttttgcaagtg

SEQ ID NO: 69112 - DNA, 25 bp, Homo sapien
gatggaatgaatatggtttctgccg

SEQ ID NO: 69113 - DNA, 25 bp, Homo sapien
gatggaatggatatggtttctgccg

SEQ ID NO: 69114 - DNA, 25 bp, Homo sapien
gatggaatgtaaattgcatctcgac

SEQ ID NO: 69115 - DNA, 25 bp, Homo sapien
gatggaatgtaaattgtatctcgac

SEQ ID NO: 69116 - DNA, 25 bp, Homo sapien
gatggacacccaaatacgctggctt

SEQ ID NO: 69117 - DNA, 25 bp, Homo sapien
gatggacacccaaatatgctggctt

SEQ ID NO: 69118 - DNA, 25 bp, Homo sapien
gatggactgttagccgatttaacag

SEQ ID NO: 69119 - DNA, 25 bp, Homo sapien
gatggactgttagctgatttaacag

SEQ ID NO: 69120 - DNA, 25 bp, Homo sapien
gatggacttttcccgagaggcttag

SEQ ID NO: 69121 - DNA, 25 bp, Homo sapien
gatggacttttcctgagaggcttag

SEQ ID NO: 69122 - DNA, 25 bp, Homo sapien
gatggaggccaaaagactaagccag

SEQ ID NO: 69123 - DNA, 25 bp, Homo sapien
gatggaggtcaaaagactaagccag

SEQ ID NO: 69124 - DNA, 25 bp, Homo sapien
gatggagtcggctctttcctggtga

SEQ ID NO: 69125 - DNA, 25 bp, Homo sapien
gatggagtgtgttttataaagcgat

SEQ ID NO: 69126 - DNA, 25 bp, Homo sapien
gatggagttggctctttcctggtga

SEQ ID NO: 69127 - DNA, 25 bp, Homo sapien
gatggagtttgttttataaagcgat

SEQ ID NO: 69128 - DNA, 25 bp, Homo sapien
gatggatatacctaacagttgacag

SEQ ID NO: 69129 - DNA, 25 bp, Homo sapien
gatggatatgcctaacagttgacag

SEQ ID NO: 69130 - DNA, 25 bp, Homo sapien
gatggatcggagagtcaggggaaag

SEQ ID NO: 69131 - DNA, 25 bp, Homo sapien
gatggatctgagagtcaggggaaag

SEQ ID NO: 69132 - DNA, 25 bp, Homo sapien
gatggatgaaaagatataggtatgg

SEQ ID NO: 69133 - DNA, 25 bp, Homo sapien
gatggatggaaagatataggtatgg

SEQ ID NO: 69134 - DNA, 25 bp, Homo sapien
gatggatgtgtcatgtctccctagg

SEQ ID NO: 69135 - DNA, 25 bp, Homo sapien
gatggatgtgttatgtctccctagg

SEQ ID NO: 69136 - DNA, 25 bp, Homo sapien
gatggcaaattagctgggtttataa

SEQ ID NO: 69137 - DNA, 25 bp, Homo sapien
gatggcaaattagttgggtttataa

SEQ ID NO: 69138 - DNA, 25 bp, Homo sapien
gatggcaagtctcaatagtttgcta

SEQ ID NO: 69139 - DNA, 25 bp, Homo sapien
gatggcaagtctcaatggtttgcta

SEQ ID NO: 69140 - DNA, 25 bp, Homo sapien
gatggcacaaggttcgagaggccaa

SEQ ID NO: 69141 - DNA, 25 bp, Homo sapien
gatggcacaaggtttgagaggccaa

SEQ ID NO: 69142 - DNA, 25 bp, Homo sapien
gatggcacgttaaagaaagaaagat

SEQ ID NO: 69143 - DNA, 25 bp, Homo sapien
gatggcacgttaaagagagaaagat

SEQ ID NO: 69144 - DNA, 25 bp, Homo sapien
gatggcagaatggatctttaaaagg

SEQ ID NO: 69145 - DNA, 25 bp, Homo sapien
gatggcagaatgggtctttaaaagg

SEQ ID NO: 69146 - DNA, 25 bp, Homo sapien
gatggcatcatttggttaaactgac

SEQ ID NO: 69147 - DNA, 25 bp, Homo sapien
gatggcatcgtttggttaaactgac

SEQ ID NO: 69148 - DNA, 25 bp, Homo sapien
gatggcatggagcaaagcagagaac

SEQ ID NO: 69149 - DNA, 25 bp, Homo sapien
gatggcatggagcatagcagagaac

SEQ ID NO: 69150 - DNA, 25 bp, Homo sapien
gatggccaaacgcagcagacaggag

SEQ ID NO: 69151 - DNA, 25 bp, Homo sapien
gatggccaaactcagcagacaggag

SEQ ID NO: 69152 - DNA, 25 bp, Homo sapien
gatggccatgtccagtttgccttct

SEQ ID NO: 69153 - DNA, 25 bp, Homo sapien
gatggccatgtcgagtttgccttct

SEQ ID NO: 69154 - DNA, 25 bp, Homo sapien
gatggcctgtttccagatcttctct

SEQ ID NO: 69155 - DNA, 25 bp, Homo sapien
gatggcctgttttcagatcttctct

SEQ ID NO: 69156 - DNA, 25 bp, Homo sapien
gatgggaatttttatttgagacaga

SEQ ID NO: 69157 - DNA, 25 bp, Homo sapien
gatgggaatttttgtttgagacaga

SEQ ID NO: 69158 - DNA, 25 bp, Homo sapien
gatgggacatggctgcctagaataa

SEQ ID NO: 69159 - DNA, 25 bp, Homo sapien
gatgggacttggctgcctagaataa

SEQ ID NO: 69160 - DNA, 25 bp, Homo sapien
gatgggagcaagaacacttgtcatc

SEQ ID NO: 69161 - DNA, 25 bp, Homo sapien
gatgggagcaagaacatttgtcatc

SEQ ID NO: 69162 - DNA, 25 bp, Homo sapien
gatgggcacaaagacacggagaatt

SEQ ID NO: 69163 - DNA, 25 bp, Homo sapien
gatgggcacaaagacatggagaatt

SEQ ID NO: 69164 - DNA, 25 bp, Homo sapien
gatgggctgctcgaaccttgtatgt

SEQ ID NO: 69165 - DNA, 25 bp, Homo sapien
gatgggctgcttgaaccttgtatgt

SEQ ID NO: 69166 - DNA, 25 bp, Homo sapien
gatggggactcgagcccagaagatc

SEQ ID NO: 69167 - DNA, 25 bp, Homo sapien
gatggggactcgagcctagaagatc

SEQ ID NO: 69168 - DNA, 25 bp, Homo sapien
gatggggagatgacgagtttaattt

SEQ ID NO: 69169 - DNA, 25 bp, Homo sapien
gatggggagatgatgagtttaattt

SEQ ID NO: 69170 - DNA, 25 bp, Homo sapien
gatggggttgccagacacctagtcc

SEQ ID NO: 69171 - DNA, 25 bp, Homo sapien
gatggggttgcctgacacctagtcc

SEQ ID NO: 69172 - DNA, 25 bp, Homo sapien
gatggggtttgaactcatctctgaa

SEQ ID NO: 69173 - DNA, 25 bp, Homo sapien
gatggggtttgatctcatctctgaa

SEQ ID NO: 69174 - DNA, 25 bp, Homo sapien
gatgggtaaacctaacaagaatcat

SEQ ID NO: 69175 - DNA, 25 bp, Homo sapien
gatgggtaaacttaacaagaatcat

SEQ ID NO: 69176 - DNA, 25 bp, Homo sapien
gatgggtagagagcaaaaaatgact

SEQ ID NO: 69177 - DNA, 25 bp, Homo sapien
gatgggtatagagcaaaaaatgact

SEQ ID NO: 69178 - DNA, 25 bp, Homo sapien
gatgggtgtccaaaaagtgttaaca

SEQ ID NO: 69179 - DNA, 25 bp, Homo sapien
gatgggtgttcaaaaagtgttaaca

SEQ ID NO: 69180 - DNA, 25 bp, Homo sapien
gatgggttacgttaattgttttgcg

SEQ ID NO: 69181 - DNA, 25 bp, Homo sapien
gatgggttatgttaattgttttgcg

SEQ ID NO: 69182 - DNA, 25 bp, Homo sapien
gatggtaatgttaagacacaaatta

SEQ ID NO: 69183 - DNA, 25 bp, Homo sapien
gatggtaatgttgagacacaaatta

SEQ ID NO: 69184 - DNA, 25 bp, Homo sapien
gatggtaccgatgcttgttgatatt

SEQ ID NO: 69185 - DNA, 25 bp, Homo sapien
gatggtactgatgcttgttgatatt

SEQ ID NO: 69186 - DNA, 25 bp, Homo sapien
gatggtagatatgactcttttttgg

SEQ ID NO: 69187 - DNA, 25 bp, Homo sapien
gatggtagatatggctcttttttgg

SEQ ID NO: 69188 - DNA, 25 bp, Homo sapien
gatggtatctcactcttgaaaatgg

SEQ ID NO: 69189 - DNA, 25 bp, Homo sapien
gatggtatctcattcttgaaaatgg

SEQ ID NO: 69190 - DNA, 25 bp, Homo sapien
gatggtcaacaacttcatattgaca

SEQ ID NO: 69191 - DNA, 25 bp, Homo sapien
gatggtcagcaacttcatattgaca

SEQ ID NO: 69192 - DNA, 25 bp, Homo sapien
gatggtcctcgcaacttctgagtca

SEQ ID NO: 69193 - DNA, 25 bp, Homo sapien
gatggtcctcgccacttctgagtca

SEQ ID NO: 69194 - DNA, 25 bp, Homo sapien
gatggtctagcaccttttttgaatt

SEQ ID NO: 69195 - DNA, 25 bp, Homo sapien
gatggtctagcatcttttttgaatt

SEQ ID NO: 69196 - DNA, 25 bp, Homo sapien
gatggtcttgaatatacttcaaatt

SEQ ID NO: 69197 - DNA, 25 bp, Homo sapien
gatggtcttgagtatacttcaaatt

SEQ ID NO: 69198 - DNA, 25 bp, Homo sapien
gatggtgacaacaaaaatgaaatgg

SEQ ID NO: 69199 - DNA, 25 bp, Homo sapien
gatggtgacaacagaaatgaaatgg

SEQ ID NO: 69200 - DNA, 25 bp, Homo sapien
gatggtggtgccattagtcaggatg

SEQ ID NO: 69201 - DNA, 25 bp, Homo sapien
gatggtggtgccgttagtcaggatg

SEQ ID NO: 69202 - DNA, 25 bp, Homo sapien
gatggtgtaccacagggagcctgga

SEQ ID NO: 69203 - DNA, 25 bp, Homo sapien
gatggtgtaccacggggagcctgga

SEQ ID NO: 69204 - DNA, 25 bp, Homo sapien
gatggttaatgcaacacagactgct

SEQ ID NO: 69205 - DNA, 25 bp, Homo sapien
gatggttaatgcaatacagactgct

SEQ ID NO: 69206 - DNA, 25 bp, Homo sapien
gatggttatatagcagggctcactt

SEQ ID NO: 69207 - DNA, 25 bp, Homo sapien
gatggttatattgcagggctcactt

SEQ ID NO: 69208 - DNA, 25 bp, Homo sapien
gatggtttcgagttagagagaagag

SEQ ID NO: 69209 - DNA, 25 bp, Homo sapien
gatggtttcgagttcgagagaagag

SEQ ID NO: 69210 - DNA, 25 bp, Homo sapien
gatggttttacaatgaaactgttcc

SEQ ID NO: 69211 - DNA, 25 bp, Homo sapien
gatggttttacgatgaaactgttcc

SEQ ID NO: 69212 - DNA, 25 bp, Homo sapien
gatgtaaacgtacaaaattcagggg

SEQ ID NO: 69213 - DNA, 25 bp, Homo sapien
gatgtaaagatgtatgtgtatatac

SEQ ID NO: 69214 - DNA, 25 bp, Homo sapien
gatgtaaagcttcattttttttcct

SEQ ID NO: 69215 - DNA, 25 bp, Homo sapien
gatgtaaagcttcgttttttttcct

SEQ ID NO: 69216 - DNA, 25 bp, Homo sapien
gatgtaaaggtgtatgtgtatatac

SEQ ID NO: 69217 - DNA, 25 bp, Homo sapien
gatgtaaatgtacaaaattcagggg

SEQ ID NO: 69218 - DNA, 25 bp, Homo sapien
gatgtaaattacggacctcgagacc

SEQ ID NO: 69219 - DNA, 25 bp, Homo sapien
gatgtaaattatggacctcgagacc

SEQ ID NO: 69220 - DNA, 25 bp, Homo sapien
gatgtaacgctctcccttgattgct

SEQ ID NO: 69221 - DNA, 25 bp, Homo sapien
gatgtaactctctcccttgattgct

SEQ ID NO: 69222 - DNA, 25 bp, Homo sapien
gatgtaaggagacagacttgcccta

SEQ ID NO: 69223 - DNA, 25 bp, Homo sapien
gatgtaaggagacagatttgcccta

SEQ ID NO: 69224 - DNA, 25 bp, Homo sapien
gatgtaatcatcagatccacttttt

SEQ ID NO: 69225 - DNA, 25 bp, Homo sapien
gatgtaatcatctgatccacttttt

SEQ ID NO: 69226 - DNA, 25 bp, Homo sapien
gatgtaggaaaagcaactccattac

SEQ ID NO: 69227 - DNA, 25 bp, Homo sapien
gatgtaggaaaagcaagtccattac

SEQ ID NO: 69228 - DNA, 25 bp, Homo sapien
gatgtagtcttgaagtcagttggaa

SEQ ID NO: 69229 - DNA, 25 bp, Homo sapien
gatgtagtcttgaattcagttggaa

SEQ ID NO: 69230 - DNA, 25 bp, Homo sapien
gatgtatgaagaaattaatgttgtt

SEQ ID NO: 69231 - DNA, 25 bp, Homo sapien
gatgtatgaagaagttaatgttgtt

SEQ ID NO: 69232 - DNA, 25 bp, Homo sapien
gatgtattcttcacgcatcttaata

SEQ ID NO: 69233 - DNA, 25 bp, Homo sapien
gatgtattcttcatgcatcttaata

SEQ ID NO: 69234 - DNA, 25 bp, Homo sapien
gatgtatttatacggcaccctctca

SEQ ID NO: 69235 - DNA, 25 bp, Homo sapien
gatgtatttatatggcaccctctca

SEQ ID NO: 69236 - DNA, 25 bp, Homo sapien
gatgtcaaatctaaaaatcccatga

SEQ ID NO: 69237 - DNA, 25 bp, Homo sapien
gatgtcaagtctaaaaatcccatga

SEQ ID NO: 69238 - DNA, 25 bp, Homo sapien
gatgtcattatcatgccagctaaaa

SEQ ID NO: 69239 - DNA, 25 bp, Homo sapien
gatgtcattatcatgctagctaaaa

SEQ ID NO: 69240 - DNA, 25 bp, Homo sapien
gatgtccatagaaagacgatagaga

SEQ ID NO: 69241 - DNA, 25 bp, Homo sapien
gatgtccatagaaagatgatagaga

SEQ ID NO: 69242 - DNA, 25 bp, Homo sapien
gatgtccattactaaaacaaagcag

SEQ ID NO: 69243 - DNA, 25 bp, Homo sapien
gatgtccattactcaaacaaagcag

SEQ ID NO: 69244 - DNA, 25 bp, Homo sapien
gatgtccttttgatcacatttcctg

SEQ ID NO: 69245 - DNA, 25 bp, Homo sapien
gatgtccttttggtcacatttcctg

SEQ ID NO: 69246 - DNA, 25 bp, Homo sapien
gatgtctactgaatctaaaggaatg

SEQ ID NO: 69247 - DNA, 25 bp, Homo sapien
gatgtctactgagtctaaaggaatg

SEQ ID NO: 69248 - DNA, 25 bp, Homo sapien
gatgtctgagaactccagaagagcc

SEQ ID NO: 69249 - DNA, 25 bp, Homo sapien
gatgtctgagaacttcagaagagcc

SEQ ID NO: 69250 - DNA, 25 bp, Homo sapien
gatgtctgcacctgccctgagccag

SEQ ID NO: 69251 - DNA, 25 bp, Homo sapien
gatgtctggacctgccctgagccag

SEQ ID NO: 69252 - DNA, 25 bp, Homo sapien
gatgtcttcagattaacttgaaaac

SEQ ID NO: 69253 - DNA, 25 bp, Homo sapien
gatgtcttcagattaagttgaaaac

SEQ ID NO: 69254 - DNA, 25 bp, Homo sapien
gatgtcttcatttaattcactgcta

SEQ ID NO: 69255 - DNA, 25 bp, Homo sapien
gatgtcttcgtttaattcactgcta

SEQ ID NO: 69256 - DNA, 25 bp, Homo sapien
gatgtcttggccaaccacagcaaca

SEQ ID NO: 69257 - DNA, 25 bp, Homo sapien
gatgtcttggccagccacagcaaca

SEQ ID NO: 69258 - DNA, 25 bp, Homo sapien
gatgtgaagaagctggaacctttgt

SEQ ID NO: 69259 - DNA, 25 bp, Homo sapien
gatgtgaagaagttggaacctttgt

SEQ ID NO: 69260 - DNA, 25 bp, Homo sapien
gatgtgattgttacagcgggtggtg

SEQ ID NO: 69261 - DNA, 25 bp, Homo sapien
gatgtgattgttactgcgggtggtg

SEQ ID NO: 69262 - DNA, 25 bp, Homo sapien
gatgtgcatttgcttagatgtttga

SEQ ID NO: 69263 - DNA, 25 bp, Homo sapien
gatgtgcatttgtttagatgtttga

SEQ ID NO: 69264 - DNA, 25 bp, Homo sapien
gatgtgcctgtcaatgttttttcag

SEQ ID NO: 69265 - DNA, 25 bp, Homo sapien
gatgtgcctgtcattgttttttcag

SEQ ID NO: 69266 - DNA, 25 bp, Homo sapien
gatgtgctaatacatggtatcattc

SEQ ID NO: 69267 - DNA, 25 bp, Homo sapien
gatgtgctaatgcatggtatcattc

SEQ ID NO: 69268 - DNA, 25 bp, Homo sapien
gatgtgctgaacagccacagaaata

SEQ ID NO: 69269 - DNA, 25 bp, Homo sapien
gatgtgctgaacagccgcagaaata

SEQ ID NO: 69270 - DNA, 25 bp, Homo sapien
gatgtggcaacagtattcaagatta

SEQ ID NO: 69271 - DNA, 25 bp, Homo sapien
gatgtggcacaatgggaattaatac

SEQ ID NO: 69272 - DNA, 25 bp, Homo sapien
gatgtggcataatgggaattaatac

SEQ ID NO: 69273 - DNA, 25 bp, Homo sapien
gatgtggcgacagtattcaagatta

SEQ ID NO: 69274 - DNA, 25 bp, Homo sapien
gatgtggctatttactgaacaggaa

SEQ ID NO: 69275 - DNA, 25 bp, Homo sapien
gatgtggctatttattgaacaggaa

SEQ ID NO: 69276 - DNA, 25 bp, Homo sapien
gatgtggctcctaccaattgaggtc

SEQ ID NO: 69277 - DNA, 25 bp, Homo sapien
gatgtggctcctgccaattgaggtc

SEQ ID NO: 69278 - DNA, 25 bp, Homo sapien
gatgtgtaaaacacttcacatatca

SEQ ID NO: 69279 - DNA, 25 bp, Homo sapien
gatgtgtaagacacttcacatatca

SEQ ID NO: 69280 - DNA, 25 bp, Homo sapien
gatgtgtctgaaggctgcacatagg

SEQ ID NO: 69281 - DNA, 25 bp, Homo sapien
gatgtgtctgagggctgcacatagg

SEQ ID NO: 69282 - DNA, 25 bp, Homo sapien
gatgtgtgactcatttgcatatcgg

SEQ ID NO: 69283 - DNA, 25 bp, Homo sapien
gatgtgtgactcgtttgcatatcgg

SEQ ID NO: 69284 - DNA, 25 bp, Homo sapien
gatgtgtgcttcacattgtggccga

SEQ ID NO: 69285 - DNA, 25 bp, Homo sapien
gatgtgtgggttttctgggagttca

SEQ ID NO: 69286 - DNA, 25 bp, Homo sapien
gatgtgtgggttttttgggagttca

SEQ ID NO: 69287 - DNA, 25 bp, Homo sapien
gatgtgtggttcacattgtggccga

SEQ ID NO: 69288 - DNA, 25 bp, Homo sapien
gatgtgttgcttaaataccacttcc

SEQ ID NO: 69289 - DNA, 25 bp, Homo sapien
gatgtgttgcttaaattccacttcc

SEQ ID NO: 69290 - DNA, 25 bp, Homo sapien
gatgtgttttaacacggatattttg

SEQ ID NO: 69291 - DNA, 25 bp, Homo sapien
gatgtgttttaacatggatattttg

SEQ ID NO: 69292 - DNA, 25 bp, Homo sapien
gatgttaaaagatccttaagttaaa

SEQ ID NO: 69293 - DNA, 25 bp, Homo sapien
gatgttaaatgatccttaagttaaa

SEQ ID NO: 69294 - DNA, 25 bp, Homo sapien
gatgttaatgtggccgtctccaatc

SEQ ID NO: 69295 - DNA, 25 bp, Homo sapien
gatgttaatgtggctgtctccaatc

SEQ ID NO: 69296 - DNA, 25 bp, Homo sapien
gatgttacagtcagggaaattttac

SEQ ID NO: 69297 - DNA, 25 bp, Homo sapien
gatgttacattcagggaaattttac

SEQ ID NO: 69298 - DNA, 25 bp, Homo sapien
gatgttacttgaaagagtttcagaa

SEQ ID NO: 69299 - DNA, 25 bp, Homo sapien
gatgttacttggaagagtttcagaa

SEQ ID NO: 69300 - DNA, 25 bp, Homo sapien
gatgttagtgcatctcatggataca

SEQ ID NO: 69301 - DNA, 25 bp, Homo sapien
gatgttagtgcatttcatggataca

SEQ ID NO: 69302 - DNA, 25 bp, Homo sapien
gatgttatcaacaacgttctatatg

SEQ ID NO: 69303 - DNA, 25 bp, Homo sapien
gatgttatgaactgcctttctaaaa

SEQ ID NO: 69304 - DNA, 25 bp, Homo sapien
gatgttatgaattgcctttctaaaa

SEQ ID NO: 69305 - DNA, 25 bp, Homo sapien
gatgttatggaactcataattttta

SEQ ID NO: 69306 - DNA, 25 bp, Homo sapien
gatgttatggaagtcataattttta

SEQ ID NO: 69307 - DNA, 25 bp, Homo sapien
gatgttattaacaacgttctatatg

SEQ ID NO: 69308 - DNA, 25 bp, Homo sapien
gatgttcaaaacttttcacttagtt

SEQ ID NO: 69309 - DNA, 25 bp, Homo sapien
gatgttcaaaatttttcacttagtt

SEQ ID NO: 69310 - DNA, 25 bp, Homo sapien
gatgttcaacgttgcaatactgttt

SEQ ID NO: 69311 - DNA, 25 bp, Homo sapien
gatgttcaatgttgcaatactgttt

SEQ ID NO: 69312 - DNA, 25 bp, Homo sapien
gatgttcaccataacagtgttgggc

SEQ ID NO: 69313 - DNA, 25 bp, Homo sapien
gatgttcaccataacattgttgggc

SEQ ID NO: 69314 - DNA, 25 bp, Homo sapien
gatgttcactggaggatttgaaaag

SEQ ID NO: 69315 - DNA, 25 bp, Homo sapien
gatgttcattggaggatttgaaaag

SEQ ID NO: 69316 - DNA, 25 bp, Homo sapien
gatgttcccagctcatttggcttct

SEQ ID NO: 69317 - DNA, 25 bp, Homo sapien
gatgttcccaggtcatttggcttct

SEQ ID NO: 69318 - DNA, 25 bp, Homo sapien
gatgttctctactcgccttcataaa

SEQ ID NO: 69319 - DNA, 25 bp, Homo sapien
gatgttctctacttgccttcataaa

SEQ ID NO: 69320 - DNA, 25 bp, Homo sapien
gatgttcttattccaatccatcatg

SEQ ID NO: 69321 - DNA, 25 bp, Homo sapien
gatgttcttgttccaatccatcatg

SEQ ID NO: 69322 - DNA, 25 bp, Homo sapien
gatgttgagcccaggtagcttggga

SEQ ID NO: 69323 - DNA, 25 bp, Homo sapien
gatgttgagcccgggtagcttggga

SEQ ID NO: 69324 - DNA, 25 bp, Homo sapien
gatgttgatgctcatgataatataa

SEQ ID NO: 69325 - DNA, 25 bp, Homo sapien
gatgttgatgctgatgataatataa

SEQ ID NO: 69326 - DNA, 25 bp, Homo sapien
gatgttgtatgactaaagaagatga

SEQ ID NO: 69327 - DNA, 25 bp, Homo sapien
gatgttgtatgagtaaagaagatga

SEQ ID NO: 69328 - DNA, 25 bp, Homo sapien
gatgtttaaagtaattgttgatgta

SEQ ID NO: 69329 - DNA, 25 bp, Homo sapien
gatgtttaaagtgattgttgatgta

SEQ ID NO: 69330 - DNA, 25 bp, Homo sapien
gatgtttaagaataattttcaatta

SEQ ID NO: 69331 - DNA, 25 bp, Homo sapien
gatgtttaagagtaattttcaatta

SEQ ID NO: 69332 - DNA, 25 bp, Homo sapien
gatgtttcacaagactgctcttaca

SEQ ID NO: 69333 - DNA, 25 bp, Homo sapien
gatgtttcacacgactgctcttaca

SEQ ID NO: 69334 - DNA, 25 bp, Homo sapien
gatgtttctggtatagggaagagtt

SEQ ID NO: 69335 - DNA, 25 bp, Homo sapien
gatgtttctggtgtagggaagagtt

SEQ ID NO: 69336 - DNA, 25 bp, Homo sapien
gatgtttgtctgctctttgttgggt

SEQ ID NO: 69337 - DNA, 25 bp, Homo sapien
gatgtttgtttgctctttgttgggt

SEQ ID NO: 69338 - DNA, 25 bp, Homo sapien
gatgttttatatactgtcagcagca

SEQ ID NO: 69339 - DNA, 25 bp, Homo sapien
gatgttttcaaatagtcgcattttt

SEQ ID NO: 69340 - DNA, 25 bp, Homo sapien
gatgttttcaagtagtcgcattttt

SEQ ID NO: 69341 - DNA, 25 bp, Homo sapien
gatgttttcattttcagtttttact

SEQ ID NO: 69342 - DNA, 25 bp, Homo sapien
gatgttttcgttttcagtttttact

SEQ ID NO: 69343 - DNA, 25 bp, Homo sapien
gatgttttctatactgtcagcagca

SEQ ID NO: 69344 - DNA, 25 bp, Homo sapien
gattaaaaaaaaatatgtaccacat

SEQ ID NO: 69345 - DNA, 25 bp, Homo sapien
gattaaaaaaacatatgtaccacat

SEQ ID NO: 69346 - DNA, 25 bp, Homo sapien
gattaaaatagtacctacctcataa

SEQ ID NO: 69347 - DNA, 25 bp, Homo sapien
gattaaaatcgtacctacctcataa

SEQ ID NO: 69348 - DNA, 25 bp, Homo sapien
gattaaagacaattcatgcctctga

SEQ ID NO: 69349 - DNA, 25 bp, Homo sapien
gattaaaggcaattcatgcctctga

SEQ ID NO: 69350 - DNA, 25 bp, Homo sapien
gattaaagggacccgcagtcatgtt

SEQ ID NO: 69351 - DNA, 25 bp, Homo sapien
gattaaagggacctgcagtcatgtt

SEQ ID NO: 69352 - DNA, 25 bp, Homo sapien
gattaaataaagagccgctatgttc

SEQ ID NO: 69353 - DNA, 25 bp, Homo sapien
gattaaataaagagtcgctatgttc

SEQ ID NO: 69354 - DNA, 25 bp, Homo sapien
gattaaattcagctctggtgtagtt

SEQ ID NO: 69355 - DNA, 25 bp, Homo sapien
gattaaatttagctctggtgtagtt

SEQ ID NO: 69356 - DNA, 25 bp, Homo sapien
gattaacactgatgcaataccatta

SEQ ID NO: 69357 - DNA, 25 bp, Homo sapien
gattaacattgatgcaataccatta

SEQ ID NO: 69358 - DNA, 25 bp, Homo sapien
gattaagaaacacttctgccaccct

SEQ ID NO: 69359 - DNA, 25 bp, Homo sapien
gattaagaaacatttctgccaccct

SEQ ID NO: 69360 - DNA, 25 bp, Homo sapien
gattaagaaatataccaaaggccac

SEQ ID NO: 69361 - DNA, 25 bp, Homo sapien
gattaagaaatataccgaaggccac

SEQ ID NO: 69362 - DNA, 25 bp, Homo sapien
gattaagagacacaaaagtttgatg

SEQ ID NO: 69363 - DNA, 25 bp, Homo sapien
gattaagagacgtcaacatggaagg

SEQ ID NO: 69364 - DNA, 25 bp, Homo sapien
gattaagagacgtcaatatggaagg

SEQ ID NO: 69365 - DNA, 25 bp, Homo sapien
gattaagagccacaaaagtttgatg

SEQ ID NO: 69366 - DNA, 25 bp, Homo sapien
gattaagagtccgagtctatagtct

SEQ ID NO: 69367 - DNA, 25 bp, Homo sapien
gattaagagtccgagtgtatagtct

SEQ ID NO: 69368 - DNA, 25 bp, Homo sapien
gattaagagttgtacggcttggatt

SEQ ID NO: 69369 - DNA, 25 bp, Homo sapien
gattaagagttgtgcggcttggatt

SEQ ID NO: 69370 - DNA, 25 bp, Homo sapien
gattaagattttgcttctcatctca

SEQ ID NO: 69371 - DNA, 25 bp, Homo sapien
gattaagatttttcttctcatctca

SEQ ID NO: 69372 - DNA, 25 bp, Homo sapien
gattaagcataacgataaatgaagg

SEQ ID NO: 69373 - DNA, 25 bp, Homo sapien
gattaagcataatgataaatgaagg

SEQ ID NO: 69374 - DNA, 25 bp, Homo sapien
gattaaggatcataagattgggaga

SEQ ID NO: 69375 - DNA, 25 bp, Homo sapien
gattaaggatcatgagattgggaga

SEQ ID NO: 69376 - DNA, 25 bp, Homo sapien
gattaaggctctggcagctgtggtg

SEQ ID NO: 69377 - DNA, 25 bp, Homo sapien
gattaaggctctggcatctgtggtg

SEQ ID NO: 69378 - DNA, 25 bp, Homo sapien
gattaagtcacactttccattgtct

SEQ ID NO: 69379 - DNA, 25 bp, Homo sapien
gattaagtcacattttccattgtct

SEQ ID NO: 69380 - DNA, 25 bp, Homo sapien
gattaatccacttccatgctaccac

SEQ ID NO: 69381 - DNA, 25 bp, Homo sapien
gattaatccatcttctatctacaga

SEQ ID NO: 69382 - DNA, 25 bp, Homo sapien
gattaatccgtcttctatctacaga

SEQ ID NO: 69383 - DNA, 25 bp, Homo sapien
gattaatctacttccatgctaccac

SEQ ID NO: 69384 - DNA, 25 bp, Homo sapien
gattaatgcacaagcaaggaaagag

SEQ ID NO: 69385 - DNA, 25 bp, Homo sapien
gattaatgcacaagtaaggaaagag

SEQ ID NO: 69386 - DNA, 25 bp, Homo sapien
gattaattttttaacaagtgccgtg

SEQ ID NO: 69387 - DNA, 25 bp, Homo sapien
gattaattttttaataagtgccgtg

SEQ ID NO: 69388 - DNA, 25 bp, Homo sapien
gattacacatggtgtattgagttga

SEQ ID NO: 69389 - DNA, 25 bp, Homo sapien
gattacacgtggtgtattgagttga

SEQ ID NO: 69390 - DNA, 25 bp, Homo sapien
gattacattgtgcccacgcagatta

SEQ ID NO: 69391 - DNA, 25 bp, Homo sapien
gattacattgtgccttgtcaacata

SEQ ID NO: 69392 - DNA, 25 bp, Homo sapien
gattacattgtgccttttcaacata

SEQ ID NO: 69393 - DNA, 25 bp, Homo sapien
gattacattgtgtccacgcagatta

SEQ ID NO: 69394 - DNA, 25 bp, Homo sapien
gattacatttatcggtttgtgtatg

SEQ ID NO: 69395 - DNA, 25 bp, Homo sapien
gattacatttattggtttgtgtatg

SEQ ID NO: 69396 - DNA, 25 bp, Homo sapien
gattacatttccatacaagaagtcc

SEQ ID NO: 69397 - DNA, 25 bp, Homo sapien
gattacatttccgtacaagaagtcc

SEQ ID NO: 69398 - DNA, 25 bp, Homo sapien
gattacctgagttgcaaaaagaaat

SEQ ID NO: 69399 - DNA, 25 bp, Homo sapien
gattacctgggttgcaaaaagaaat

SEQ ID NO: 69400 - DNA, 25 bp, Homo sapien
gattacctgtctgggatttcttgac

SEQ ID NO: 69401 - DNA, 25 bp, Homo sapien
gattacctgtcttggatttcttgac

SEQ ID NO: 69402 - DNA, 25 bp, Homo sapien
gattaccttatcactgccttgaatt

SEQ ID NO: 69403 - DNA, 25 bp, Homo sapien
gattaccttatcattgccttgaatt

SEQ ID NO: 69404 - DNA, 25 bp, Homo sapien
gattacgacacaacaacttgagaaa

SEQ ID NO: 69405 - DNA, 25 bp, Homo sapien
gattacgacacagcaacttgagaaa

SEQ ID NO: 69406 - DNA, 25 bp, Homo sapien
gattactacctgtgtgaccttggag

SEQ ID NO: 69407 - DNA, 25 bp, Homo sapien
gattactacctgtgtgtccttggag

SEQ ID NO: 69408 - DNA, 25 bp, Homo sapien
gattactgctgatactaccttaagg

SEQ ID NO: 69409 - DNA, 25 bp, Homo sapien
gattactgttgatactaccttaagg

SEQ ID NO: 69410 - DNA, 25 bp, Homo sapien
gattagaagaggagattctgacaca

SEQ ID NO: 69411 - DNA, 25 bp, Homo sapien
gattagaagaggagtttctgacaca

SEQ ID NO: 69412 - DNA, 25 bp, Homo sapien
gattagatgagtatagtgtgaaggt

SEQ ID NO: 69413 - DNA, 25 bp, Homo sapien
gattagatgagtatcgtgtgaaggt

SEQ ID NO: 69414 - DNA, 25 bp, Homo sapien
gattagatttattacctggatgatt

SEQ ID NO: 69415 - DNA, 25 bp, Homo sapien
gattagatttattatctggatgatt

SEQ ID NO: 69416 - DNA, 25 bp, Homo sapien
gattagccaactatcaacatcgggt

SEQ ID NO: 69417 - DNA, 25 bp, Homo sapien
gattagccaactgtcaacatcgggt

SEQ ID NO: 69418 - DNA, 25 bp, Homo sapien
gattagccacaataacacattctca

SEQ ID NO: 69419 - DNA, 25 bp, Homo sapien
gattagccagaataacacattctca

SEQ ID NO: 69420 - DNA, 25 bp, Homo sapien
gattagctgtagccacacattccag

SEQ ID NO: 69421 - DNA, 25 bp, Homo sapien
gattagctgtagccgcacattccag

SEQ ID NO: 69422 - DNA, 25 bp, Homo sapien
gattagggcagcaataccaattgga

SEQ ID NO: 69423 - DNA, 25 bp, Homo sapien
gattagggcagcgataccaattgga

SEQ ID NO: 69424 - DNA, 25 bp, Homo sapien
gattaggtgccttttcattcaatct

SEQ ID NO: 69425 - DNA, 25 bp, Homo sapien
gattaggtgtcttttcattcaatct

SEQ ID NO: 69426 - DNA, 25 bp, Homo sapien
gattaggttgcaagacttttctgtg

SEQ ID NO: 69427 - DNA, 25 bp, Homo sapien
gattaggttgcaagccttttctgtg

SEQ ID NO: 69428 - DNA, 25 bp, Homo sapien
gattagtacaagtgcaaagccatgt

SEQ ID NO: 69429 - DNA, 25 bp, Homo sapien
gattagtacaagttcaaagccatgt

SEQ ID NO: 69430 - DNA, 25 bp, Homo sapien
gattagtctccatggctgattcact

SEQ ID NO: 69431 - DNA, 25 bp, Homo sapien
gattagtctccgtggctgattcact

SEQ ID NO: 69432 - DNA, 25 bp, Homo sapien
gattagttggttatataggttacta

SEQ ID NO: 69433 - DNA, 25 bp, Homo sapien
gattagttggttgtataggttacta

SEQ ID NO: 69434 - DNA, 25 bp, Homo sapien
gattataaagccagacctcatgaaa

SEQ ID NO: 69435 - DNA, 25 bp, Homo sapien
gattataaagccagccctcatgaaa

SEQ ID NO: 69436 - DNA, 25 bp, Homo sapien
gattataattcacggtagctttaaa

SEQ ID NO: 69437 - DNA, 25 bp, Homo sapien
gattataattcatggtagctttaaa

SEQ ID NO: 69438 - DNA, 25 bp, Homo sapien
gattatatgctaatggctctccact

SEQ ID NO: 69439 - DNA, 25 bp, Homo sapien
gattatatgctaattgctctccact

SEQ ID NO: 69440 - DNA, 25 bp, Homo sapien
gattatcataaccagttccaccaaa

SEQ ID NO: 69441 - DNA, 25 bp, Homo sapien
gattatcataatcagttccaccaaa

SEQ ID NO: 69442 - DNA, 25 bp, Homo sapien
gattatcctatgtcatatggcccaa

SEQ ID NO: 69443 - DNA, 25 bp, Homo sapien
gattatcctatgtcgtatggcccaa

SEQ ID NO: 69444 - DNA, 25 bp, Homo sapien
gattatctaaaacagatgaagatta

SEQ ID NO: 69445 - DNA, 25 bp, Homo sapien
gattatctaaaacggatgaagatta

SEQ ID NO: 69446 - DNA, 25 bp, Homo sapien
gattatctcatgattaaattattgc

SEQ ID NO: 69447 - DNA, 25 bp, Homo sapien
gattatctcctgcatagagagacga

SEQ ID NO: 69448 - DNA, 25 bp, Homo sapien
gattatctcctgcgtagagagacga

SEQ ID NO: 69449 - DNA, 25 bp, Homo sapien
gattatctcgtgattaaattattgc

SEQ ID NO: 69450 - DNA, 25 bp, Homo sapien
gattatgcaggtatagaagtctgat

SEQ ID NO: 69451 - DNA, 25 bp, Homo sapien
gattatgcaggtataggagtctgat

SEQ ID NO: 69452 - DNA, 25 bp, Homo sapien
gattatggcacaacatatggagtcc

SEQ ID NO: 69453 - DNA, 25 bp, Homo sapien
gattatggcacagcatatggagtcc

SEQ ID NO: 69454 - DNA, 25 bp, Homo sapien
gattatgtcatgaaatctttgtttg

SEQ ID NO: 69455 - DNA, 25 bp, Homo sapien
gattatgtcatgcaatctttgtttg

SEQ ID NO: 69456 - DNA, 25 bp, Homo sapien
gattatgtggtcagtgatccaggaa

SEQ ID NO: 69457 - DNA, 25 bp, Homo sapien
gattatgtggtcggtgatccaggaa

SEQ ID NO: 69458 - DNA, 25 bp, Homo sapien
gattattaaagctcagttttttgct

SEQ ID NO: 69459 - DNA, 25 bp, Homo sapien
gattattaaagcttagttttttgct

SEQ ID NO: 69460 - DNA, 25 bp, Homo sapien
gattattatgggaaaagctgttggc

SEQ ID NO: 69461 - DNA, 25 bp, Homo sapien
gattattatggggaaagctgttggc

SEQ ID NO: 69462 - DNA, 25 bp, Homo sapien
gattattcaaaacttaatgtaggct

SEQ ID NO: 69463 - DNA, 25 bp, Homo sapien
gattattcaaaatttaatgtaggct

SEQ ID NO: 69464 - DNA, 25 bp, Homo sapien
gattattcacagtgaaatgctgaca

SEQ ID NO: 69465 - DNA, 25 bp, Homo sapien
gattattcacagttaaatgctgaca

SEQ ID NO: 69466 - DNA, 25 bp, Homo sapien
gattattcattaacttcatcttttt

SEQ ID NO: 69467 - DNA, 25 bp, Homo sapien
gattattcattagcttcatcttttt

SEQ ID NO: 69468 - DNA, 25 bp, Homo sapien
gattattccagaagcactcataatg

SEQ ID NO: 69469 - DNA, 25 bp, Homo sapien
gattattccagaagtactcataatg

SEQ ID NO: 69470 - DNA, 25 bp, Homo sapien
gattattctcaccacaacaattttt

SEQ ID NO: 69471 - DNA, 25 bp, Homo sapien
gattattctcaccacagcaattttt

SEQ ID NO: 69472 - DNA, 25 bp, Homo sapien
gattatttaagcctcagttcctata

SEQ ID NO: 69473 - DNA, 25 bp, Homo sapien
gattatttaagccttagttcctata

SEQ ID NO: 69474 - DNA, 25 bp, Homo sapien
gattatttggatcaaccctcagaac

SEQ ID NO: 69475 - DNA, 25 bp, Homo sapien
gattatttggatcaactctcagaac

SEQ ID NO: 69476 - DNA, 25 bp, Homo sapien
gattcaaacggacctctgcaacttt

SEQ ID NO: 69477 - DNA, 25 bp, Homo sapien
gattcaaacggagctctgcaacttt

SEQ ID NO: 69478 - DNA, 25 bp, Homo sapien
gattcaaatccaagtctttcctact

SEQ ID NO: 69479 - DNA, 25 bp, Homo sapien
gattcaaatccacattccacttaat

SEQ ID NO: 69480 - DNA, 25 bp, Homo sapien
gattcaaatccactttccacttaat

SEQ ID NO: 69481 - DNA, 25 bp, Homo sapien
gattcaaatccaggtctttcctact

SEQ ID NO: 69482 - DNA, 25 bp, Homo sapien
gattcaaatgacacattcattgaga

SEQ ID NO: 69483 - DNA, 25 bp, Homo sapien
gattcaaatgacccattcattgaga

SEQ ID NO: 69484 - DNA, 25 bp, Homo sapien
gattcacacaactcatagtatgtct

SEQ ID NO: 69485 - DNA, 25 bp, Homo sapien
gattcacacaactcatcgtatgtct

SEQ ID NO: 69486 - DNA, 25 bp, Homo sapien
gattcacacttgggtctccttccaa

SEQ ID NO: 69487 - DNA, 25 bp, Homo sapien
gattcacacttggttctccttccaa

SEQ ID NO: 69488 - DNA, 25 bp, Homo sapien
gattcacagatttaatcccaggtag

SEQ ID NO: 69489 - DNA, 25 bp, Homo sapien
gattcacatatttaatcccaggtag

SEQ ID NO: 69490 - DNA, 25 bp, Homo sapien
gattcagaaatgtacagatagaggg

SEQ ID NO: 69491 - DNA, 25 bp, Homo sapien
gattcagagatgtacagatagaggg

SEQ ID NO: 69492 - DNA, 25 bp, Homo sapien
gattcagatagttgcagagaggtgg

SEQ ID NO: 69493 - DNA, 25 bp, Homo sapien
gattcagatagttgtagagaggtgg

SEQ ID NO: 69494 - DNA, 25 bp, Homo sapien
gattcagcataatctgtttttcaat

SEQ ID NO: 69495 - DNA, 25 bp, Homo sapien
gattcagcatagttcactacttgcc

SEQ ID NO: 69496 - DNA, 25 bp, Homo sapien
gattcagcgtaatctgtttttcaat

SEQ ID NO: 69497 - DNA, 25 bp, Homo sapien
gattcagcgtagttcactacttgcc

SEQ ID NO: 69498 - DNA, 25 bp, Homo sapien
gattcaggtgtgaaccagtgcagtg

SEQ ID NO: 69499 - DNA, 25 bp, Homo sapien
gattcaggtgtgacccagtgcagtg

SEQ ID NO: 69500 - DNA, 25 bp, Homo sapien
gattcataaaaaaaaaaaaggaaga

SEQ ID NO: 69501 - DNA, 25 bp, Homo sapien
gattcataaaagaaaaaaaggaaga

SEQ ID NO: 69502 - DNA, 25 bp, Homo sapien
gattcataaactattacacatttgc

SEQ ID NO: 69503 - DNA, 25 bp, Homo sapien
gattcataaactattatacatttgc

SEQ ID NO: 69504 - DNA, 25 bp, Homo sapien
gattcatacgtctaggaatcaaggg

SEQ ID NO: 69505 - DNA, 25 bp, Homo sapien
gattcataggtctaggaatcaaggg

SEQ ID NO: 69506 - DNA, 25 bp, Homo sapien
gattcatcagcaacctaagagacag

SEQ ID NO: 69507 - DNA, 25 bp, Homo sapien
gattcatcagcaagtcttgatattt

SEQ ID NO: 69508 - DNA, 25 bp, Homo sapien
gattcatcagcaattcttgatattt

SEQ ID NO: 69509 - DNA, 25 bp, Homo sapien
gattcatcagcagcctaagagacag

SEQ ID NO: 69510 - DNA, 25 bp, Homo sapien
gattcatccactccggttgatcaga

SEQ ID NO: 69511 - DNA, 25 bp, Homo sapien
gattcatccactctggttgatcaga

SEQ ID NO: 69512 - DNA, 25 bp, Homo sapien
gattcatggtcactgagttccttgg

SEQ ID NO: 69513 - DNA, 25 bp, Homo sapien
gattcatggtcattgagttccttgg

SEQ ID NO: 69514 - DNA, 25 bp, Homo sapien
gattccaaatgctctggaaagaaaa

SEQ ID NO: 69515 - DNA, 25 bp, Homo sapien
gattccaacacgaacacaatgtatt

SEQ ID NO: 69516 - DNA, 25 bp, Homo sapien
gattccaacacgagcacaatgtatt

SEQ ID NO: 69517 - DNA, 25 bp, Homo sapien
gattccaagtgctctggaaagaaaa

SEQ ID NO: 69518 - DNA, 25 bp, Homo sapien
gattccaggcacatcctaactcagg

SEQ ID NO: 69519 - DNA, 25 bp, Homo sapien
gattccaggcacattctaactcagg

SEQ ID NO: 69520 - DNA, 25 bp, Homo sapien
gattccaggctaagattggacaaaa

SEQ ID NO: 69521 - DNA, 25 bp, Homo sapien
gattccaggttaagattggacaaaa

SEQ ID NO: 69522 - DNA, 25 bp, Homo sapien
gattccatttctgctgtatatccat

SEQ ID NO: 69523 - DNA, 25 bp, Homo sapien
gattccatttcttctgtatatccat

SEQ ID NO: 69524 - DNA, 25 bp, Homo sapien
gattcccgttgacataagctggaaa

SEQ ID NO: 69525 - DNA, 25 bp, Homo sapien
gattcccgttgatataagctggaaa

SEQ ID NO: 69526 - DNA, 25 bp, Homo sapien
gattcctaacagggttattttcatt

SEQ ID NO: 69527 - DNA, 25 bp, Homo sapien
gattcctagcagggttattttcatt

SEQ ID NO: 69528 - DNA, 25 bp, Homo sapien
gattcctcaggtgaaaaatttctgg

SEQ ID NO: 69529 - DNA, 25 bp, Homo sapien
gattcctcgggtgaaaaatttctgg

SEQ ID NO: 69530 - DNA, 25 bp, Homo sapien
gattcctgagagaggagaaccaaat

SEQ ID NO: 69531 - DNA, 25 bp, Homo sapien
gattcctgagagcggagaaccaaat

SEQ ID NO: 69532 - DNA, 25 bp, Homo sapien
gattcctgtgcataattttttattg

SEQ ID NO: 69533 - DNA, 25 bp, Homo sapien
gattcctgtgcgtaattttttattg

SEQ ID NO: 69534 - DNA, 25 bp, Homo sapien
gattcctgttactgcataagaaacc

SEQ ID NO: 69535 - DNA, 25 bp, Homo sapien
gattcctgttacttcataagaaacc

SEQ ID NO: 69536 - DNA, 25 bp, Homo sapien
gattcctttccatagtcgtcatgag

SEQ ID NO: 69537 - DNA, 25 bp, Homo sapien
gattcctttccatagttgtcatgag

SEQ ID NO: 69538 - DNA, 25 bp, Homo sapien
gattcgagtcctttcctgatactta

SEQ ID NO: 69539 - DNA, 25 bp, Homo sapien
gattcgagttctttcctgatactta

SEQ ID NO: 69540 - DNA, 25 bp, Homo sapien
gattcgggcataacagattaaatat

SEQ ID NO: 69541 - DNA, 25 bp, Homo sapien
gattcgggcataccagattaaatat

SEQ ID NO: 69542 - DNA, 25 bp, Homo sapien
gattctaactctcggcttcactagc

SEQ ID NO: 69543 - DNA, 25 bp, Homo sapien
gattctaactcttggcttcactagc

SEQ ID NO: 69544 - DNA, 25 bp, Homo sapien
gattctactgtacagcaagttgaga

SEQ ID NO: 69545 - DNA, 25 bp, Homo sapien
gattctactgtagagcaagttgaga

SEQ ID NO: 69546 - DNA, 25 bp, Homo sapien
gattctagcctctcgtctttcatta

SEQ ID NO: 69547 - DNA, 25 bp, Homo sapien
gattctagcctcttgtctttcatta

SEQ ID NO: 69548 - DNA, 25 bp, Homo sapien
gattctatcatgagttactctactc

SEQ ID NO: 69549 - DNA, 25 bp, Homo sapien
gattctatcctgagttactctactc

SEQ ID NO: 69550 - DNA, 25 bp, Homo sapien
gattctcacaaatggcctagcatac

SEQ ID NO: 69551 - DNA, 25 bp, Homo sapien
gattctcactatactgttttataat

SEQ ID NO: 69552 - DNA, 25 bp, Homo sapien
gattctcactatattgttttataat

SEQ ID NO: 69553 - DNA, 25 bp, Homo sapien
gattctcagaggtgcgtcaacccta

SEQ ID NO: 69554 - DNA, 25 bp, Homo sapien
gattctcaggctcatcaggaagccc

SEQ ID NO: 69555 - DNA, 25 bp, Homo sapien
gattctcataaatggcctagcatac

SEQ ID NO: 69556 - DNA, 25 bp, Homo sapien
gattctcataggtgcgtcaacccta

SEQ ID NO: 69557 - DNA, 25 bp, Homo sapien
gattctcatgctcatcaggaagccc

SEQ ID NO: 69558 - DNA, 25 bp, Homo sapien
gattctcatggttacgtgaatatgg

SEQ ID NO: 69559 - DNA, 25 bp, Homo sapien
gattctcatggttatgtgaatatgg

SEQ ID NO: 69560 - DNA, 25 bp, Homo sapien
gattctccacagcgttcatcatcac

SEQ ID NO: 69561 - DNA, 25 bp, Homo sapien
gattctccacagtgttcatcatcac

SEQ ID NO: 69562 - DNA, 25 bp, Homo sapien
gattctccattcattcttaagtgca

SEQ ID NO: 69563 - DNA, 25 bp, Homo sapien
gattctccattcgttcttaagtgca

SEQ ID NO: 69564 - DNA, 25 bp, Homo sapien
gattctcccaagtctaacttgtttc

SEQ ID NO: 69565 - DNA, 25 bp, Homo sapien
gattctcccaagtctaccttgtttc

SEQ ID NO: 69566 - DNA, 25 bp, Homo sapien
gattctcctctgagaccccagggca

SEQ ID NO: 69567 - DNA, 25 bp, Homo sapien
gattctcctctgagtccccagggca

SEQ ID NO: 69568 - DNA, 25 bp, Homo sapien
gattctcgatgggacatatgaagac

SEQ ID NO: 69569 - DNA, 25 bp, Homo sapien
gattctcgatgggatatatgaagac

SEQ ID NO: 69570 - DNA, 25 bp, Homo sapien
gattctctaattacatgctaccaaa

SEQ ID NO: 69571 - DNA, 25 bp, Homo sapien
gattctctaatttcatgctaccaaa

SEQ ID NO: 69572 - DNA, 25 bp, Homo sapien
gattctctcatacttagcaccaatt

SEQ ID NO: 69573 - DNA, 25 bp, Homo sapien
gattctctgatacttagcaccaatt

SEQ ID NO: 69574 - DNA, 25 bp, Homo sapien
gattctgacttgcgtcctggaagac

SEQ ID NO: 69575 - DNA, 25 bp, Homo sapien
gattctgatgatagaaagccatcac

SEQ ID NO: 69576 - DNA, 25 bp, Homo sapien
gattctgatgatagaaggccatcac

SEQ ID NO: 69577 - DNA, 25 bp, Homo sapien
gattctgattgcggttcttttgaat

SEQ ID NO: 69578 - DNA, 25 bp, Homo sapien
gattctgattgtggttcttttgaat

SEQ ID NO: 69579 - DNA, 25 bp, Homo sapien
gattctgatttgcgtcctggaagac

SEQ ID NO: 69580 - DNA, 25 bp, Homo sapien
gattctgccaaatcattagctctct

SEQ ID NO: 69581 - DNA, 25 bp, Homo sapien
gattctgccaaatcgttagctctct

SEQ ID NO: 69582 - DNA, 25 bp, Homo sapien
gattctgctgatataaagtcaaact

SEQ ID NO: 69583 - DNA, 25 bp, Homo sapien
gattctgctgatgtaaagtcaaact

SEQ ID NO: 69584 - DNA, 25 bp, Homo sapien
gattctggaaaccactataatagct

SEQ ID NO: 69585 - DNA, 25 bp, Homo sapien
gattctggaaaccactctaatagct

SEQ ID NO: 69586 - DNA, 25 bp, Homo sapien
gattctggaatgaaattaagtaact

SEQ ID NO: 69587 - DNA, 25 bp, Homo sapien
gattctggatacattttgaaaatag

SEQ ID NO: 69588 - DNA, 25 bp, Homo sapien
gattctggatacgttttgaaaatag

SEQ ID NO: 69589 - DNA, 25 bp, Homo sapien
gattctgggatgaaattaagtaact

SEQ ID NO: 69590 - DNA, 25 bp, Homo sapien
gattctgggattgtttattatagca

SEQ ID NO: 69591 - DNA, 25 bp, Homo sapien
gattctgggattgtttgttatagca

SEQ ID NO: 69592 - DNA, 25 bp, Homo sapien
gattcttaaataacatcatgcagag

SEQ ID NO: 69593 - DNA, 25 bp, Homo sapien
gattcttaaccgttctaatgcgctg

SEQ ID NO: 69594 - DNA, 25 bp, Homo sapien
gattcttaacctttctaatgcgctg

SEQ ID NO: 69595 - DNA, 25 bp, Homo sapien
gattcttaagtaacatcatgcagag

SEQ ID NO: 69596 - DNA, 25 bp, Homo sapien
gattcttcagcggcgttcagttctc

SEQ ID NO: 69597 - DNA, 25 bp, Homo sapien
gattcttcagcggtgttcagttctc

SEQ ID NO: 69598 - DNA, 25 bp, Homo sapien
gattcttcttctacggttccactaa

SEQ ID NO: 69599 - DNA, 25 bp, Homo sapien
gattcttcttctatggttccactaa

SEQ ID NO: 69600 - DNA, 25 bp, Homo sapien
gattcttgcactcaaccatgaactc

SEQ ID NO: 69601 - DNA, 25 bp, Homo sapien
gattcttgccctcaaccatgaactc

SEQ ID NO: 69602 - DNA, 25 bp, Homo sapien
gattcttgttctcgccacatcagtg

SEQ ID NO: 69603 - DNA, 25 bp, Homo sapien
gattcttgttctcgccgcatcagtg

SEQ ID NO: 69604 - DNA, 25 bp, Homo sapien
gattctttctgctaccatgaagtcc

SEQ ID NO: 69605 - DNA, 25 bp, Homo sapien
gattctttctgctaccttgaagtcc

SEQ ID NO: 69606 - DNA, 25 bp, Homo sapien
gattgaaagaaaaggctgggaaaat

SEQ ID NO: 69607 - DNA, 25 bp, Homo sapien
gattgaaagaaatggctgggaaaat

SEQ ID NO: 69608 - DNA, 25 bp, Homo sapien
gattgaaatcttcaaaatgacaagg

SEQ ID NO: 69609 - DNA, 25 bp, Homo sapien
gattgaaatcttcaaagtgacaagg

SEQ ID NO: 69610 - DNA, 25 bp, Homo sapien
gattgaactaggctctgaggagata

SEQ ID NO: 69611 - DNA, 25 bp, Homo sapien
gattgaactaggctttgaggagata

SEQ ID NO: 69612 - DNA, 25 bp, Homo sapien
gattgaagaagccacttatggccaa

SEQ ID NO: 69613 - DNA, 25 bp, Homo sapien
gattgaaggaagcaaaatattgttc

SEQ ID NO: 69614 - DNA, 25 bp, Homo sapien
gattgaaggaaggaaaatattgttc

SEQ ID NO: 69615 - DNA, 25 bp, Homo sapien
gattgaaggagaatgagaacgagat

SEQ ID NO: 69616 - DNA, 25 bp, Homo sapien
gattgaaggagcatgagaacgagat

SEQ ID NO: 69617 - DNA, 25 bp, Homo sapien
gattgaaggagccacttatggccaa

SEQ ID NO: 69618 - DNA, 25 bp, Homo sapien
gattgaaggattccatgagaaaaaa

SEQ ID NO: 69619 - DNA, 25 bp, Homo sapien
gattgaaggattctatgagaaaaaa

SEQ ID NO: 69620 - DNA, 25 bp, Homo sapien
gattgaagtcccggaagaaaaaatg

SEQ ID NO: 69621 - DNA, 25 bp, Homo sapien
gattgaagtcctggaagaaaaaatg

SEQ ID NO: 69622 - DNA, 25 bp, Homo sapien
gattgaatcggctaaatatctctcc

SEQ ID NO: 69623 - DNA, 25 bp, Homo sapien
gattgaatctcacgttaataggaca

SEQ ID NO: 69624 - DNA, 25 bp, Homo sapien
gattgaatctcaggttaataggaca

SEQ ID NO: 69625 - DNA, 25 bp, Homo sapien
gattgaatgggccatactagctgag

SEQ ID NO: 69626 - DNA, 25 bp, Homo sapien
gattgaatgtgaatatgcaagtgag

SEQ ID NO: 69627 - DNA, 25 bp, Homo sapien
gattgaatgtgactatgcaagtgag

SEQ ID NO: 69628 - DNA, 25 bp, Homo sapien
gattgaatgtgccatactagctgag

SEQ ID NO: 69629 - DNA, 25 bp, Homo sapien
gattgaattggctaaatatctctcc

SEQ ID NO: 69630 - DNA, 25 bp, Homo sapien
gattgacaaataaacttaatcatgt

SEQ ID NO: 69631 - DNA, 25 bp, Homo sapien
gattgacaagtaaacttaatcatgt

SEQ ID NO: 69632 - DNA, 25 bp, Homo sapien
gattgacccgttagctctcccactt

SEQ ID NO: 69633 - DNA, 25 bp, Homo sapien
gattgacctgttagctctcccactt

SEQ ID NO: 69634 - DNA, 25 bp, Homo sapien
gattgactaagtgtttatgatcttc

SEQ ID NO: 69635 - DNA, 25 bp, Homo sapien
gattgactgagtgtttatgatcttc

SEQ ID NO: 69636 - DNA, 25 bp, Homo sapien
gattgagaacctctactctaggaga

SEQ ID NO: 69637 - DNA, 25 bp, Homo sapien
gattgagaacctctgctctaggaga

SEQ ID NO: 69638 - DNA, 25 bp, Homo sapien
gattgagacagatgctttagtttgg

SEQ ID NO: 69639 - DNA, 25 bp, Homo sapien
gattgagacagatgttttagtttgg

SEQ ID NO: 69640 - DNA, 25 bp, Homo sapien
gattgagagaaggctggatacactg

SEQ ID NO: 69641 - DNA, 25 bp, Homo sapien
gattgagagaatgctggatacactg

SEQ ID NO: 69642 - DNA, 25 bp, Homo sapien
gattgaggtaacgctcataactgtt

SEQ ID NO: 69643 - DNA, 25 bp, Homo sapien
gattgaggtaatgctcataactgtt

SEQ ID NO: 69644 - DNA, 25 bp, Homo sapien
gattgagtattcacctgtaagatag

SEQ ID NO: 69645 - DNA, 25 bp, Homo sapien
gattgagtattcatctgtaagatag

SEQ ID NO: 69646 - DNA, 25 bp, Homo sapien
gattgagttaatcttttgagctatg

SEQ ID NO: 69647 - DNA, 25 bp, Homo sapien
gattgagttaattttttgagctatg

SEQ ID NO: 69648 - DNA, 25 bp, Homo sapien
gattgatcgaggaatatgttattat

SEQ ID NO: 69649 - DNA, 25 bp, Homo sapien
gattgatcgaggattatgttattat

SEQ ID NO: 69650 - DNA, 25 bp, Homo sapien
gattgatgcattttgtgtatgataa

SEQ ID NO: 69651 - DNA, 25 bp, Homo sapien
gattgatgcattttttgtatgataa

SEQ ID NO: 69652 - DNA, 25 bp, Homo sapien
gattgatggctataatggcattttg

SEQ ID NO: 69653 - DNA, 25 bp, Homo sapien
gattgatggctttattttctaagat

SEQ ID NO: 69654 - DNA, 25 bp, Homo sapien
gattgatgggtataatggcattttg

SEQ ID NO: 69655 - DNA, 25 bp, Homo sapien
gattgatggttttattttctaagat

SEQ ID NO: 69656 - DNA, 25 bp, Homo sapien
gattgattctggaatgaaattaagt

SEQ ID NO: 69657 - DNA, 25 bp, Homo sapien
gattgattctgggatgaaattaagt

SEQ ID NO: 69658 - DNA, 25 bp, Homo sapien
gattgcaaaacaccagtcacagcca

SEQ ID NO: 69659 - DNA, 25 bp, Homo sapien
gattgcaaaacacctgtcacagcca

SEQ ID NO: 69660 - DNA, 25 bp, Homo sapien
gattgcacctctacactatagcctg

SEQ ID NO: 69661 - DNA, 25 bp, Homo sapien
gattgcacctctgcactatagcctg

SEQ ID NO: 69662 - DNA, 25 bp, Homo sapien
gattgcatttgaacgatatacttca

SEQ ID NO: 69663 - DNA, 25 bp, Homo sapien
gattgcatttgaactatatacttca

SEQ ID NO: 69664 - DNA, 25 bp, Homo sapien
gattgccaattctctcccctgaaac

SEQ ID NO: 69665 - DNA, 25 bp, Homo sapien
gattgccaattctttcccctgaaac

SEQ ID NO: 69666 - DNA, 25 bp, Homo sapien
gattgccactggtcaagcctggtca

SEQ ID NO: 69667 - DNA, 25 bp, Homo sapien
gattgccaggtgaacaccacagcca

SEQ ID NO: 69668 - DNA, 25 bp, Homo sapien
gattgccaggtgagcaccacagcca

SEQ ID NO: 69669 - DNA, 25 bp, Homo sapien
gattgccattggtcaagcctggtca

SEQ ID NO: 69670 - DNA, 25 bp, Homo sapien
gattgcctgtttagcccggaagttg

SEQ ID NO: 69671 - DNA, 25 bp, Homo sapien
gattgcctgtttagcctggaagttg

SEQ ID NO: 69672 - DNA, 25 bp, Homo sapien
gattgccttagaagacttttaaagt

SEQ ID NO: 69673 - DNA, 25 bp, Homo sapien
gattgccttaggagacttttaaagt

SEQ ID NO: 69674 - DNA, 25 bp, Homo sapien
gattgctacttcctgtcaatcgcag

SEQ ID NO: 69675 - DNA, 25 bp, Homo sapien
gattgctagttcctgtcaatcgcag

SEQ ID NO: 69676 - DNA, 25 bp, Homo sapien
gattgcttaggtaaggtatgtatgt

SEQ ID NO: 69677 - DNA, 25 bp, Homo sapien
gattgcttatgtaaggtatgtatgt

SEQ ID NO: 69678 - DNA, 25 bp, Homo sapien
gattggaaaatgaaagcaagatgtc

SEQ ID NO: 69679 - DNA, 25 bp, Homo sapien
gattggaaaatggaagcaagatgtc

SEQ ID NO: 69680 - DNA, 25 bp, Homo sapien
gattggagagattcatctacaagtc

SEQ ID NO: 69681 - DNA, 25 bp, Homo sapien
gattggagagattgatctacaagtc

SEQ ID NO: 69682 - DNA, 25 bp, Homo sapien
gattggagtcacaatgcatagctga

SEQ ID NO: 69683 - DNA, 25 bp, Homo sapien
gattggagtcaccatgcatagctga

SEQ ID NO: 69684 - DNA, 25 bp, Homo sapien
gattggcttgaacagagaggttgaa

SEQ ID NO: 69685 - DNA, 25 bp, Homo sapien
gattggcttgagcagagaggttgaa

SEQ ID NO: 69686 - DNA, 25 bp, Homo sapien
gattgggacgagcttttcaacctac

SEQ ID NO: 69687 - DNA, 25 bp, Homo sapien
gattgggatgagcttttcaacctac

SEQ ID NO: 69688 - DNA, 25 bp, Homo sapien
gattgggcccagaaggctctaagtg

SEQ ID NO: 69689 - DNA, 25 bp, Homo sapien
gattgggcccagaaggttctaagtg

SEQ ID NO: 69690 - DNA, 25 bp, Homo sapien
gattgggcgcattcctactcctgac

SEQ ID NO: 69691 - DNA, 25 bp, Homo sapien
gattgggctcattcctactcctgac

SEQ ID NO: 69692 - DNA, 25 bp, Homo sapien
gattgggtagtcaacgcactttgtt

SEQ ID NO: 69693 - DNA, 25 bp, Homo sapien
gattgggtagtcaatgcactttgtt

SEQ ID NO: 69694 - DNA, 25 bp, Homo sapien
gattggtggaaacgttcttagggct

SEQ ID NO: 69695 - DNA, 25 bp, Homo sapien
gattggtggaaatgttcttagggct

SEQ ID NO: 69696 - DNA, 25 bp, Homo sapien
gattgtagatgttcatcaggcattg

SEQ ID NO: 69697 - DNA, 25 bp, Homo sapien
gattgtagatgttcgtcaggcattg

SEQ ID NO: 69698 - DNA, 25 bp, Homo sapien
gattgtataatgaatcaacatttta

SEQ ID NO: 69699 - DNA, 25 bp, Homo sapien
gattgtatagtgaatcaacatttta

SEQ ID NO: 69700 - DNA, 25 bp, Homo sapien
gattgtatctaaacttcaaagtacc

SEQ ID NO: 69701 - DNA, 25 bp, Homo sapien
gattgtatctaaccttcaaagtacc

SEQ ID NO: 69702 - DNA, 25 bp, Homo sapien
gattgtcaagtggtcataatactaa

SEQ ID NO: 69703 - DNA, 25 bp, Homo sapien
gattgtcaagttgtcataatactaa

SEQ ID NO: 69704 - DNA, 25 bp, Homo sapien
gattgtccagaattcagaccacaaa

SEQ ID NO: 69705 - DNA, 25 bp, Homo sapien
gattgtccaggcgaacttgtgggaa

SEQ ID NO: 69706 - DNA, 25 bp, Homo sapien
gattgtccaggtgaacttgtgggaa

SEQ ID NO: 69707 - DNA, 25 bp, Homo sapien
gattgtccggaattcagaccacaaa

SEQ ID NO: 69708 - DNA, 25 bp, Homo sapien
gattgtcctatgaaagactagggtt

SEQ ID NO: 69709 - DNA, 25 bp, Homo sapien
gattgtcctgtgaaagactagggtt

SEQ ID NO: 69710 - DNA, 25 bp, Homo sapien
gattgtcctttattccatattaaaa

SEQ ID NO: 69711 - DNA, 25 bp, Homo sapien
gattgtcctttattccgtattaaaa

SEQ ID NO: 69712 - DNA, 25 bp, Homo sapien
gattgtctctctctgtatgtttgaa

SEQ ID NO: 69713 - DNA, 25 bp, Homo sapien
gattgtctctctctgtgtgtttgaa

SEQ ID NO: 69714 - DNA, 25 bp, Homo sapien
gattgtgaattccaacatgctcaga

SEQ ID NO: 69715 - DNA, 25 bp, Homo sapien
gattgtgaattccagcatgctcaga

SEQ ID NO: 69716 - DNA, 25 bp, Homo sapien
gattgtgaattttgagacctggtta

SEQ ID NO: 69717 - DNA, 25 bp, Homo sapien
gattgtgagacaggttcaggaacaa

SEQ ID NO: 69718 - DNA, 25 bp, Homo sapien
gattgtgaggcaggttcaggaacaa

SEQ ID NO: 69719 - DNA, 25 bp, Homo sapien
gattgtgatttttgagacctggtta

SEQ ID NO: 69720 - DNA, 25 bp, Homo sapien
gattgtgccaccagctgcacctgag

SEQ ID NO: 69721 - DNA, 25 bp, Homo sapien
gattgtgccgccagctgcacctgag

SEQ ID NO: 69722 - DNA, 25 bp, Homo sapien
gattgtgcctctgactccctgagca

SEQ ID NO: 69723 - DNA, 25 bp, Homo sapien
gattgtgcttctgactccctgagca

SEQ ID NO: 69724 - DNA, 25 bp, Homo sapien
gattgtggcatttgggcctgggttc

SEQ ID NO: 69725 - DNA, 25 bp, Homo sapien
gattgtggcgtttgggcctgggttc

SEQ ID NO: 69726 - DNA, 25 bp, Homo sapien
gattgtgggaccagagcattcagga

SEQ ID NO: 69727 - DNA, 25 bp, Homo sapien
gattgtgggaccggagcattcagga

SEQ ID NO: 69728 - DNA, 25 bp, Homo sapien
gattgtgttgttctggctgtcaata

SEQ ID NO: 69729 - DNA, 25 bp, Homo sapien
gattgtgttgttcttgctgtcaata

SEQ ID NO: 69730 - DNA, 25 bp, Homo sapien
gattgtgtttgcttttccttgtctg

SEQ ID NO: 69731 - DNA, 25 bp, Homo sapien
gattgtgtttgtttttccttgtctg

SEQ ID NO: 69732 - DNA, 25 bp, Homo sapien
gattgtgttttggtgattgtatgtg

SEQ ID NO: 69733 - DNA, 25 bp, Homo sapien
gattgtgttttgttgattgtatgtg

SEQ ID NO: 69734 - DNA, 25 bp, Homo sapien
gattgttaaataatttctgagcagt

SEQ ID NO: 69735 - DNA, 25 bp, Homo sapien
gattgttaaatgatttctgagcagt

SEQ ID NO: 69736 - DNA, 25 bp, Homo sapien
gattgttacagcgggtggtgtgtgc

SEQ ID NO: 69737 - DNA, 25 bp, Homo sapien
gattgttactgcgggtggtgtgtgc

SEQ ID NO: 69738 - DNA, 25 bp, Homo sapien
gattgttagtgcagatctgtggtac

SEQ ID NO: 69739 - DNA, 25 bp, Homo sapien
gattgttagtgcggatctgtggtac

SEQ ID NO: 69740 - DNA, 25 bp, Homo sapien
gattgttccgagggttttgtaaaat

SEQ ID NO: 69741 - DNA, 25 bp, Homo sapien
gattgttcgagacttacatgctcat

SEQ ID NO: 69742 - DNA, 25 bp, Homo sapien
gattgttcgagatttacatgctcat

SEQ ID NO: 69743 - DNA, 25 bp, Homo sapien
gattgttctgagggttttgtaaaat

SEQ ID NO: 69744 - DNA, 25 bp, Homo sapien
gattgtttacctgtctgttttgtaa

SEQ ID NO: 69745 - DNA, 25 bp, Homo sapien
gattgtttccctgtctgttttgtaa

SEQ ID NO: 69746 - DNA, 25 bp, Homo sapien
gattgttttatacgactttgagttt

SEQ ID NO: 69747 - DNA, 25 bp, Homo sapien
gattgttttatatgactttgagttt

SEQ ID NO: 69748 - DNA, 25 bp, Homo sapien
gattgttttgatccagaatctctaa

SEQ ID NO: 69749 - DNA, 25 bp, Homo sapien
gattgttttgatgcagaatctctaa

SEQ ID NO: 69750 - DNA, 25 bp, Homo sapien
gattgtttttgaactgggtggtggt

SEQ ID NO: 69751 - DNA, 25 bp, Homo sapien
gattgtttttgacctgggtggtggt

SEQ ID NO: 69752 - DNA, 25 bp, Homo sapien
gatttaaaactatttatgcagcact

SEQ ID NO: 69753 - DNA, 25 bp, Homo sapien
gatttaaaagtatttatgcagcact

SEQ ID NO: 69754 - DNA, 25 bp, Homo sapien
gatttaaacggtacagacagggatc

SEQ ID NO: 69755 - DNA, 25 bp, Homo sapien
gatttaaactgtacagacagggatc

SEQ ID NO: 69756 - DNA, 25 bp, Homo sapien
gatttaaggaccggcgttgctttct

SEQ ID NO: 69757 - DNA, 25 bp, Homo sapien
gatttaaggaccggtgttgctttct

SEQ ID NO: 69758 - DNA, 25 bp, Homo sapien
gatttaatatagattccaaatttct

SEQ ID NO: 69759 - DNA, 25 bp, Homo sapien
gatttaatatagattctaaatttct

SEQ ID NO: 69760 - DNA, 25 bp, Homo sapien
gatttaatatgctgttactgtaagc

SEQ ID NO: 69761 - DNA, 25 bp, Homo sapien
gatttaatatgttgttactgtaagc

SEQ ID NO: 69762 - DNA, 25 bp, Homo sapien
gatttaattagagcgaccaagaaag

SEQ ID NO: 69763 - DNA, 25 bp, Homo sapien
gatttaattagtgcgaccaagaaag

SEQ ID NO: 69764 - DNA, 25 bp, Homo sapien
gatttaattttccacttgtgcaaat

SEQ ID NO: 69765 - DNA, 25 bp, Homo sapien
gatttaattttctacttgtgcaaat

SEQ ID NO: 69766 - DNA, 25 bp, Homo sapien
gatttactgccccaacagaaagtat

SEQ ID NO: 69767 - DNA, 25 bp, Homo sapien
gatttactgccgcaacagaaagtat

SEQ ID NO: 69768 - DNA, 25 bp, Homo sapien
gatttagtagcaagaaggttactgg

SEQ ID NO: 69769 - DNA, 25 bp, Homo sapien
gatttagtagcaaggaggttactgg

SEQ ID NO: 69770 - DNA, 25 bp, Homo sapien
gatttagtcacccttgatgcaggct

SEQ ID NO: 69771 - DNA, 25 bp, Homo sapien
gatttagttacccttgatgcaggct

SEQ ID NO: 69772 - DNA, 25 bp, Homo sapien
gatttatacgcaaaaactggtaaca

SEQ ID NO: 69773 - DNA, 25 bp, Homo sapien
gatttatacgcaaaaattggtaaca

SEQ ID NO: 69774 - DNA, 25 bp, Homo sapien
gatttatgcctgtagaaaaaacaat

SEQ ID NO: 69775 - DNA, 25 bp, Homo sapien
gatttatgcttgtagaaaaaacaat

SEQ ID NO: 69776 - DNA, 25 bp, Homo sapien
gatttattaaacattacgatgcagt

SEQ ID NO: 69777 - DNA, 25 bp, Homo sapien
gatttattaaacattatgatgcagt

SEQ ID NO: 69778 - DNA, 25 bp, Homo sapien
gatttattaagatgtaaggattcag

SEQ ID NO: 69779 - DNA, 25 bp, Homo sapien
gatttattaagttgtaaggattcag

SEQ ID NO: 69780 - DNA, 25 bp, Homo sapien
gatttattacctggatgattttaca

SEQ ID NO: 69781 - DNA, 25 bp, Homo sapien
gatttattatctggatgattttaca

SEQ ID NO: 69782 - DNA, 25 bp, Homo sapien
gatttattccatcaacacagtattg

SEQ ID NO: 69783 - DNA, 25 bp, Homo sapien
gatttattccatcgacacagtattg

SEQ ID NO: 69784 - DNA, 25 bp, Homo sapien
gatttattgtatcactgctatctaa

SEQ ID NO: 69785 - DNA, 25 bp, Homo sapien
gatttatttcactgatgctttatcc

SEQ ID NO: 69786 - DNA, 25 bp, Homo sapien
gatttatttcattgatgctttatcc

SEQ ID NO: 69787 - DNA, 25 bp, Homo sapien
gatttattttatcactgctatctaa

SEQ ID NO: 69788 - DNA, 25 bp, Homo sapien
gatttcaaagactgtataaaaaaac

SEQ ID NO: 69789 - DNA, 25 bp, Homo sapien
gatttcaaagattgtataaaaaaac

SEQ ID NO: 69790 - DNA, 25 bp, Homo sapien
gatttcaacataaaaccttgaagca

SEQ ID NO: 69791 - DNA, 25 bp, Homo sapien
gatttcaacatataaccttgaagca

SEQ ID NO: 69792 - DNA, 25 bp, Homo sapien
gatttcaatctccatacaaatgaga

SEQ ID NO: 69793 - DNA, 25 bp, Homo sapien
gatttcaatctctatacaaatgaga

SEQ ID NO: 69794 - DNA, 25 bp, Homo sapien
gatttcacagctagtatttttctga

SEQ ID NO: 69795 - DNA, 25 bp, Homo sapien
gatttcacggctagtatttttctga

SEQ ID NO: 69796 - DNA, 25 bp, Homo sapien
gatttcacttgtcttcaatttagaa

SEQ ID NO: 69797 - DNA, 25 bp, Homo sapien
gatttcacttgtcttccatttagaa

SEQ ID NO: 69798 - DNA, 25 bp, Homo sapien
gatttcagatttctaacctttggaa

SEQ ID NO: 69799 - DNA, 25 bp, Homo sapien
gatttcagctttctaacctttggaa

SEQ ID NO: 69800 - DNA, 25 bp, Homo sapien
gatttccatgagaccttcagagatc

SEQ ID NO: 69801 - DNA, 25 bp, Homo sapien
gatttccatgaggccttcagagatc

SEQ ID NO: 69802 - DNA, 25 bp, Homo sapien
gatttccattctagttctacccatg

SEQ ID NO: 69803 - DNA, 25 bp, Homo sapien
gatttccattctggttctacccatg

SEQ ID NO: 69804 - DNA, 25 bp, Homo sapien
gatttccattgcatttagagaacat

SEQ ID NO: 69805 - DNA, 25 bp, Homo sapien
gatttccattgcgtttagagaacat

SEQ ID NO: 69806 - DNA, 25 bp, Homo sapien
gatttccttttgagttcttggcatt

SEQ ID NO: 69807 - DNA, 25 bp, Homo sapien
gatttccttttgtgttcttggcatt

SEQ ID NO: 69808 - DNA, 25 bp, Homo sapien
gatttctaaaactatgcaactccca

SEQ ID NO: 69809 - DNA, 25 bp, Homo sapien
gatttctaaaattatgcaactccca

SEQ ID NO: 69810 - DNA, 25 bp, Homo sapien
gatttctacagcacaacctagcata

SEQ ID NO: 69811 - DNA, 25 bp, Homo sapien
gatttctacagcataacctagcata

SEQ ID NO: 69812 - DNA, 25 bp, Homo sapien
gatttctagtacagtagcaagcata

SEQ ID NO: 69813 - DNA, 25 bp, Homo sapien
gatttctagtatagtagcaagcata

SEQ ID NO: 69814 - DNA, 25 bp, Homo sapien
gatttctcttgcgtctgcagtcatg

SEQ ID NO: 69815 - DNA, 25 bp, Homo sapien
gatttctcttgtgtctgcagtcatg

SEQ ID NO: 69816 - DNA, 25 bp, Homo sapien
gatttctggtgccctctttacagga

SEQ ID NO: 69817 - DNA, 25 bp, Homo sapien
gatttctggtgccttctttacagga

SEQ ID NO: 69818 - DNA, 25 bp, Homo sapien
gatttctgtacttgcagttgctagg

SEQ ID NO: 69819 - DNA, 25 bp, Homo sapien
gatttctgtacttggagttgctagg

SEQ ID NO: 69820 - DNA, 25 bp, Homo sapien
gatttctttcggtgacaaagtcaca

SEQ ID NO: 69821 - DNA, 25 bp, Homo sapien
gatttcttttaaacattggttctcc

SEQ ID NO: 69822 - DNA, 25 bp, Homo sapien
gatttcttttaagcattggttctcc

SEQ ID NO: 69823 - DNA, 25 bp, Homo sapien
gatttcttttgacagcttacagaag

SEQ ID NO: 69824 - DNA, 25 bp, Homo sapien
gatttcttttggtgacaaagtcaca

SEQ ID NO: 69825 - DNA, 25 bp, Homo sapien
gatttcttttgtcagcttacagaag

SEQ ID NO: 69826 - DNA, 25 bp, Homo sapien
gatttgaaagcttagaccttatggg

SEQ ID NO: 69827 - DNA, 25 bp, Homo sapien
gatttgaaagcttataccttatggg

SEQ ID NO: 69828 - DNA, 25 bp, Homo sapien
gatttgaacatgtgatatgaacaag

SEQ ID NO: 69829 - DNA, 25 bp, Homo sapien
gatttgaactacatataattccata

SEQ ID NO: 69830 - DNA, 25 bp, Homo sapien
gatttgaagctacatctgaattact

SEQ ID NO: 69831 - DNA, 25 bp, Homo sapien
gatttgaagctatatctgaattact

SEQ ID NO: 69832 - DNA, 25 bp, Homo sapien
gatttgaagcttcttttgttcagag

SEQ ID NO: 69833 - DNA, 25 bp, Homo sapien
gatttgaagcttgttttgttcagag

SEQ ID NO: 69834 - DNA, 25 bp, Homo sapien
gatttgaaggtggtgctgagaagga

SEQ ID NO: 69835 - DNA, 25 bp, Homo sapien
gatttgaaggtggttctgagaagga

SEQ ID NO: 69836 - DNA, 25 bp, Homo sapien
gatttgaagtacatataattccata

SEQ ID NO: 69837 - DNA, 25 bp, Homo sapien
gatttgaagtagatgagcaaggtgg

SEQ ID NO: 69838 - DNA, 25 bp, Homo sapien
gatttgaagtaggtgagcaaggtgg

SEQ ID NO: 69839 - DNA, 25 bp, Homo sapien
gatttgaatatgtgatatgaacaag

SEQ ID NO: 69840 - DNA, 25 bp, Homo sapien
gatttgagagacaatcttggaaaac

SEQ ID NO: 69841 - DNA, 25 bp, Homo sapien
gatttgagagagaatcttggaaaac

SEQ ID NO: 69842 - DNA, 25 bp, Homo sapien
gatttgagtctaaaaacaaggcagt

SEQ ID NO: 69843 - DNA, 25 bp, Homo sapien
gatttgagtctaagaacaaggcagt

SEQ ID NO: 69844 - DNA, 25 bp, Homo sapien
gatttgagttccgtgtatgttgtca

SEQ ID NO: 69845 - DNA, 25 bp, Homo sapien
gatttgagttccttgtatgttgtca

SEQ ID NO: 69846 - DNA, 25 bp, Homo sapien
gatttgcacgtccgtcttttttctt

SEQ ID NO: 69847 - DNA, 25 bp, Homo sapien
gatttgcacgtctgtcttttttctt

SEQ ID NO: 69848 - DNA, 25 bp, Homo sapien
gatttgccataatataaggaaaaat

SEQ ID NO: 69849 - DNA, 25 bp, Homo sapien
gatttgccataatctaaggaaaaat

SEQ ID NO: 69850 - DNA, 25 bp, Homo sapien
gatttgcctgactatagtaaccatt

SEQ ID NO: 69851 - DNA, 25 bp, Homo sapien
gatttgcctgactatattaaccatt

SEQ ID NO: 69852 - DNA, 25 bp, Homo sapien
gatttgctatatagatcaacctgtc

SEQ ID NO: 69853 - DNA, 25 bp, Homo sapien
gatttgctgtatagatcaacctgtc

SEQ ID NO: 69854 - DNA, 25 bp, Homo sapien
gatttggaatcctgttatgttgccc

SEQ ID NO: 69855 - DNA, 25 bp, Homo sapien
gatttggagtcctgttatgttgccc

SEQ ID NO: 69856 - DNA, 25 bp, Homo sapien
gatttggcatacacatacgagttga

SEQ ID NO: 69857 - DNA, 25 bp, Homo sapien
gatttggcatacgcatacgagttga

SEQ ID NO: 69858 - DNA, 25 bp, Homo sapien
gatttgggagatacttcagagggag

SEQ ID NO: 69859 - DNA, 25 bp, Homo sapien
gatttgggagatatttcagagggag

SEQ ID NO: 69860 - DNA, 25 bp, Homo sapien
gatttgggcagagatttctgcagca

SEQ ID NO: 69861 - DNA, 25 bp, Homo sapien
gatttggggactcaattaatggaac

SEQ ID NO: 69862 - DNA, 25 bp, Homo sapien
gatttggggactgaattaatggaac

SEQ ID NO: 69863 - DNA, 25 bp, Homo sapien
gatttggggagagatttctgcagca

SEQ ID NO: 69864 - DNA, 25 bp, Homo sapien
gatttggtagacagataactcagct

SEQ ID NO: 69865 - DNA, 25 bp, Homo sapien
gatttggtagatagataactcagct

SEQ ID NO: 69866 - DNA, 25 bp, Homo sapien
gatttgtaaacttgtggtaattttc

SEQ ID NO: 69867 - DNA, 25 bp, Homo sapien
gatttgtagaggtttaaaaatatac

SEQ ID NO: 69868 - DNA, 25 bp, Homo sapien
gatttgtagaggtttagaaatatac

SEQ ID NO: 69869 - DNA, 25 bp, Homo sapien
gatttgtatacttgtggtaattttc

SEQ ID NO: 69870 - DNA, 25 bp, Homo sapien
gatttgtcactatttgacctgtctg

SEQ ID NO: 69871 - DNA, 25 bp, Homo sapien
gatttgtcactttttgacctgtctg

SEQ ID NO: 69872 - DNA, 25 bp, Homo sapien
gatttgtgactgtgaattatttatt

SEQ ID NO: 69873 - DNA, 25 bp, Homo sapien
gatttgtgattgtgaattatttatt

SEQ ID NO: 69874 - DNA, 25 bp, Homo sapien
gatttgtgccactaagaaacaatct

SEQ ID NO: 69875 - DNA, 25 bp, Homo sapien
gatttgtgtcactaagaaacaatct

SEQ ID NO: 69876 - DNA, 25 bp, Homo sapien
gatttgttgcctcttttctccagat

SEQ ID NO: 69877 - DNA, 25 bp, Homo sapien
gatttgtttcctcttttctccagat

SEQ ID NO: 69878 - DNA, 25 bp, Homo sapien
gattttaaatatactacacctcagg

SEQ ID NO: 69879 - DNA, 25 bp, Homo sapien
gattttaaatatgctacacctcagg

SEQ ID NO: 69880 - DNA, 25 bp, Homo sapien
gattttaacagatcgaatgggagtt

SEQ ID NO: 69881 - DNA, 25 bp, Homo sapien
gattttaacagattgaatgggagtt

SEQ ID NO: 69882 - DNA, 25 bp, Homo sapien
gattttaatcgtatgtccatgaaac

SEQ ID NO: 69883 - DNA, 25 bp, Homo sapien
gattttaatggtatgtccatgaaac

SEQ ID NO: 69884 - DNA, 25 bp, Homo sapien
gattttaggctatgcatttaaatct

SEQ ID NO: 69885 - DNA, 25 bp, Homo sapien
gattttaggctattcatttaaatct

SEQ ID NO: 69886 - DNA, 25 bp, Homo sapien
gattttattggaaaggaaagaaaag

SEQ ID NO: 69887 - DNA, 25 bp, Homo sapien
gattttattggagaggaaagaaaag

SEQ ID NO: 69888 - DNA, 25 bp, Homo sapien
gattttattttaagctaacatacac

SEQ ID NO: 69889 - DNA, 25 bp, Homo sapien
gattttattttaaggtaacatacac

SEQ ID NO: 69890 - DNA, 25 bp, Homo sapien
gattttcaaaagttttcattttgca

SEQ ID NO: 69891 - DNA, 25 bp, Homo sapien
gattttcagaagttttcattttgca

SEQ ID NO: 69892 - DNA, 25 bp, Homo sapien
gattttcctaatttatattgcactt

SEQ ID NO: 69893 - DNA, 25 bp, Homo sapien
gattttcctaatttatgttgcactt

SEQ ID NO: 69894 - DNA, 25 bp, Homo sapien
gattttcctacttaatttctgtatg

SEQ ID NO: 69895 - DNA, 25 bp, Homo sapien
gattttcctacttattttctgtatg

SEQ ID NO: 69896 - DNA, 25 bp, Homo sapien
gattttctggccatgtgtctactgc

SEQ ID NO: 69897 - DNA, 25 bp, Homo sapien
gattttctggccgtgtgtctactgc

SEQ ID NO: 69898 - DNA, 25 bp, Homo sapien
gattttgaacagaactgacctgttt

SEQ ID NO: 69899 - DNA, 25 bp, Homo sapien
gattttgaacagcactgacctgttt

SEQ ID NO: 69900 - DNA, 25 bp, Homo sapien
gattttgaagcttgtaacagaaata

SEQ ID NO: 69901 - DNA, 25 bp, Homo sapien
gattttgaagcttgtaccagaaata

SEQ ID NO: 69902 - DNA, 25 bp, Homo sapien
gattttgacctgctgttgctgactt

SEQ ID NO: 69903 - DNA, 25 bp, Homo sapien
gattttgacctgttgttgctgactt

SEQ ID NO: 69904 - DNA, 25 bp, Homo sapien
gattttgcacaaattggcttggctc

SEQ ID NO: 69905 - DNA, 25 bp, Homo sapien
gattttgcgcaaattggcttggctc

SEQ ID NO: 69906 - DNA, 25 bp, Homo sapien
gattttgctattcagtatttataat

SEQ ID NO: 69907 - DNA, 25 bp, Homo sapien
gattttgctatttagtatttataat

SEQ ID NO: 69908 - DNA, 25 bp, Homo sapien
gattttgtaggtcaagtttggaccg

SEQ ID NO: 69909 - DNA, 25 bp, Homo sapien
gattttgtaggtcgagtttggaccg

SEQ ID NO: 69910 - DNA, 25 bp, Homo sapien
gattttgtggtgcatagggcgattg

SEQ ID NO: 69911 - DNA, 25 bp, Homo sapien
gattttgtggtgcgtagggcgattg

SEQ ID NO: 69912 - DNA, 25 bp, Homo sapien
gatttttaaaattgctcatgctggc

SEQ ID NO: 69913 - DNA, 25 bp, Homo sapien
gatttttaaaatttctcatgctggc

SEQ ID NO: 69914 - DNA, 25 bp, Homo sapien
gatttttaacagcaagaaattaaca

SEQ ID NO: 69915 - DNA, 25 bp, Homo sapien
gatttttaacagtaagaaattaaca

SEQ ID NO: 69916 - DNA, 25 bp, Homo sapien
gatttttagacgataaagtgctagg

SEQ ID NO: 69917 - DNA, 25 bp, Homo sapien
gatttttagacggtaaagtgctagg

SEQ ID NO: 69918 - DNA, 25 bp, Homo sapien
gatttttcactttgaatatctaggt

SEQ ID NO: 69919 - DNA, 25 bp, Homo sapien
gatttttcactttggatatctaggt

SEQ ID NO: 69920 - DNA, 25 bp, Homo sapien
gatttttcataatgtacttaagcat

SEQ ID NO: 69921 - DNA, 25 bp, Homo sapien
gatttttccatgagagagaaaaaaa

SEQ ID NO: 69922 - DNA, 25 bp, Homo sapien
gatttttccatgggagagaaaaaaa

SEQ ID NO: 69923 - DNA, 25 bp, Homo sapien
gatttttcgtaatgtacttaagcat

SEQ ID NO: 69924 - DNA, 25 bp, Homo sapien
gatttttctaccaatcaacgaagtg

SEQ ID NO: 69925 - DNA, 25 bp, Homo sapien
gatttttctaccgatcaacgaagtg

SEQ ID NO: 69926 - DNA, 25 bp, Homo sapien
gatttttgcaccaatgagggacacg

SEQ ID NO: 69927 - DNA, 25 bp, Homo sapien
gatttttgcacgaatgagggacacg

SEQ ID NO: 69928 - DNA, 25 bp, Homo sapien
gattttttatagtgcacatccccta

SEQ ID NO: 69929 - DNA, 25 bp, Homo sapien
gattttttatagtgcatatccccta

SEQ ID NO: 69930 - DNA, 25 bp, Homo sapien
gattttttcagttaccggcattctc

SEQ ID NO: 69931 - DNA, 25 bp, Homo sapien
gattttttcggttaccggcattctc

SEQ ID NO: 69932 - DNA, 25 bp, Homo sapien
gattttttgatgcatttgggtaagt

SEQ ID NO: 69933 - DNA, 25 bp, Homo sapien
gattttttgatgcgtttgggtaagt

SEQ ID NO: 69934 - DNA, 25 bp, Homo sapien
gattttttttctccaagcctcatcc

SEQ ID NO: 69935 - DNA, 25 bp, Homo sapien
gattttttttctctaagcctcatcc

SEQ ID NO: 69936 - DNA, 25 bp, Homo sapien
gcaaaaaaaagagtcatgttcttgg

SEQ ID NO: 69937 - DNA, 25 bp, Homo sapien
gcaaaaaaaggagtcatgttcttgg

SEQ ID NO: 69938 - DNA, 25 bp, Homo sapien
gcaaaaaagcctaaaacaaaagtgc

SEQ ID NO: 69939 - DNA, 25 bp, Homo sapien
gcaaaaaaggctaaaacaaaagtgc

SEQ ID NO: 69940 - DNA, 25 bp, Homo sapien
gcaaaaaagggcacaaagaaaagag

SEQ ID NO: 69941 - DNA, 25 bp, Homo sapien
gcaaaaaagggcaccaagaaaagag

SEQ ID NO: 69942 - DNA, 25 bp, Homo sapien
gcaaaaacatctctcctggagtccc

SEQ ID NO: 69943 - DNA, 25 bp, Homo sapien
gcaaaaacctctctcctggagtccc

SEQ ID NO: 69944 - DNA, 25 bp, Homo sapien
gcaaaaaccttctctcatttgtgca

SEQ ID NO: 69945 - DNA, 25 bp, Homo sapien
gcaaaaacgttctctcatttgtgca

SEQ ID NO: 69946 - DNA, 25 bp, Homo sapien
gcaaaaagagtactgttatcacccc

SEQ ID NO: 69947 - DNA, 25 bp, Homo sapien
gcaaaaagagtgctgttatcacccc

SEQ ID NO: 69948 - DNA, 25 bp, Homo sapien
gcaaaaagtcatagatctaaataaa

SEQ ID NO: 69949 - DNA, 25 bp, Homo sapien
gcaaaaagtcatagatttaaataaa

SEQ ID NO: 69950 - DNA, 25 bp, Homo sapien
gcaaaaatacatgagattatatgta

SEQ ID NO: 69951 - DNA, 25 bp, Homo sapien
gcaaaaatacccaacagtgacaaca

SEQ ID NO: 69952 - DNA, 25 bp, Homo sapien
gcaaaaatacccagcagtgacaaca

SEQ ID NO: 69953 - DNA, 25 bp, Homo sapien
gcaaaaatgctgagataggaggttg

SEQ ID NO: 69954 - DNA, 25 bp, Homo sapien
gcaaaaatgctgggataggaggttg

SEQ ID NO: 69955 - DNA, 25 bp, Homo sapien
gcaaaaatgtccaggtataggagag

SEQ ID NO: 69956 - DNA, 25 bp, Homo sapien
gcaaaaatgtccgggtataggagag

SEQ ID NO: 69957 - DNA, 25 bp, Homo sapien
gcaaaaattcatgagattatatgta

SEQ ID NO: 69958 - DNA, 25 bp, Homo sapien
gcaaaaatttaaaaaaacattctag

SEQ ID NO: 69959 - DNA, 25 bp, Homo sapien
gcaaaaatttaagaaaacattctag

SEQ ID NO: 69960 - DNA, 25 bp, Homo sapien
gcaaaacaaaataaaacctccaaga

SEQ ID NO: 69961 - DNA, 25 bp, Homo sapien
gcaaaacaaaataatacctccaaga

SEQ ID NO: 69962 - DNA, 25 bp, Homo sapien
gcaaaacaagggtgaaaactagcta

SEQ ID NO: 69963 - DNA, 25 bp, Homo sapien
gcaaaacaagggttaaaactagcta

SEQ ID NO: 69964 - DNA, 25 bp, Homo sapien
gcaaaaccagctcgtggacaaacat

SEQ ID NO: 69965 - DNA, 25 bp, Homo sapien
gcaaaaccagcttgtggacaaacat

SEQ ID NO: 69966 - DNA, 25 bp, Homo sapien
gcaaaactatgagcgtccaggcagc

SEQ ID NO: 69967 - DNA, 25 bp, Homo sapien
gcaaaactatgagggtccaggcagc

SEQ ID NO: 69968 - DNA, 25 bp, Homo sapien
gcaaaagaatgtcaaaaacggtatc

SEQ ID NO: 69969 - DNA, 25 bp, Homo sapien
gcaaaagaatgtcaaacacggtatc

SEQ ID NO: 69970 - DNA, 25 bp, Homo sapien
gcaaaagcaacaatatcaaagaatg

SEQ ID NO: 69971 - DNA, 25 bp, Homo sapien
gcaaaagcaacagtatcaaagaatg

SEQ ID NO: 69972 - DNA, 25 bp, Homo sapien
gcaaaagctcaactctactaaaaat

SEQ ID NO: 69973 - DNA, 25 bp, Homo sapien
gcaaaagctcacctctactaaaaat

SEQ ID NO: 69974 - DNA, 25 bp, Homo sapien
gcaaaaggcagactaactggagaac

SEQ ID NO: 69975 - DNA, 25 bp, Homo sapien
gcaaaaggcagattaactggagaac

SEQ ID NO: 69976 - DNA, 25 bp, Homo sapien
gcaaaaggcatgatcttgctgggac

SEQ ID NO: 69977 - DNA, 25 bp, Homo sapien
gcaaaaggcatggtcttgctgggac

SEQ ID NO: 69978 - DNA, 25 bp, Homo sapien
gcaaaaggtacaaaaaccaatggaa

SEQ ID NO: 69979 - DNA, 25 bp, Homo sapien
gcaaaaggtacgaaaaccaatggaa

SEQ ID NO: 69980 - DNA, 25 bp, Homo sapien
gcaaaagtaaaaaacaccaggtaac

SEQ ID NO: 69981 - DNA, 25 bp, Homo sapien
gcaaaagtcaaaaacaccaggtaac

SEQ ID NO: 69982 - DNA, 25 bp, Homo sapien
gcaaaagtggcgctttctgctctga

SEQ ID NO: 69983 - DNA, 25 bp, Homo sapien
gcaaaagtggcgttttctgctctga

SEQ ID NO: 69984 - DNA, 25 bp, Homo sapien
gcaaaataaatttggtctcattaaa

SEQ ID NO: 69985 - DNA, 25 bp, Homo sapien
gcaaaataacattgagtagacacat

SEQ ID NO: 69986 - DNA, 25 bp, Homo sapien
gcaaaataacttgagatacttttgg

SEQ ID NO: 69987 - DNA, 25 bp, Homo sapien
gcaaaataagtttggtctcattaaa

SEQ ID NO: 69988 - DNA, 25 bp, Homo sapien
gcaaaatacaccagaaagtcccagc

SEQ ID NO: 69989 - DNA, 25 bp, Homo sapien
gcaaaatacaccggaaagtcccagc

SEQ ID NO: 69990 - DNA, 25 bp, Homo sapien
gcaaaatagcattgagtagacacat

SEQ ID NO: 69991 - DNA, 25 bp, Homo sapien
gcaaaatagcttgagatacttttgg

SEQ ID NO: 69992 - DNA, 25 bp, Homo sapien
gcaaaatagttcaaactacttagac

SEQ ID NO: 69993 - DNA, 25 bp, Homo sapien
gcaaaatagttcaacctacttagac

SEQ ID NO: 69994 - DNA, 25 bp, Homo sapien
gcaaaatatgagataagtgtcagca

SEQ ID NO: 69995 - DNA, 25 bp, Homo sapien
gcaaaatattagataagtgtcagca

SEQ ID NO: 69996 - DNA, 25 bp, Homo sapien
gcaaaatgatctttatgtgactctt

SEQ ID NO: 69997 - DNA, 25 bp, Homo sapien
gcaaaatgatctttgtgtgactctt

SEQ ID NO: 69998 - DNA, 25 bp, Homo sapien
gcaaaatgtgtaatccagcatccta

SEQ ID NO: 69999 - DNA, 25 bp, Homo sapien
gcaaaatgtgtagtccagcatccta

SEQ ID NO: 70000 - DNA, 25 bp, Homo sapien
gcaaaatgttaccacgcctcgacag

SEQ ID NO: 70001 - DNA, 25 bp, Homo sapien
gcaaaatgttaccatgcctcgacag

SEQ ID NO: 70002 - DNA, 25 bp, Homo sapien
gcaaaatgttttggaatacgactct

SEQ ID NO: 70003 - DNA, 25 bp, Homo sapien
gcaaaatgttttgggatacgactct

SEQ ID NO: 70004 - DNA, 25 bp, Homo sapien
gcaaaattaaacgtatattaaatag

SEQ ID NO: 70005 - DNA, 25 bp, Homo sapien
gcaaaattaaaggtatattaaatag

SEQ ID NO: 70006 - DNA, 25 bp, Homo sapien
gcaaaattacatatgagcttcccat

SEQ ID NO: 70007 - DNA, 25 bp, Homo sapien
gcaaaattatatatgagcttcccat

SEQ ID NO: 70008 - DNA, 25 bp, Homo sapien
gcaaacaaaccagaaaatggtatac

SEQ ID NO: 70009 - DNA, 25 bp, Homo sapien
gcaaacaaaccaggaaatggtatac

SEQ ID NO: 70010 - DNA, 25 bp, Homo sapien
gcaaacaaatcagtaactaccactc

SEQ ID NO: 70011 - DNA, 25 bp, Homo sapien
gcaaacaaatctgtaactaccactc

SEQ ID NO: 70012 - DNA, 25 bp, Homo sapien
gcaaacacaaataggtttctttact

SEQ ID NO: 70013 - DNA, 25 bp, Homo sapien
gcaaacacaagcgcaataaagatgt

SEQ ID NO: 70014 - DNA, 25 bp, Homo sapien
gcaaacacaagtgcaataaagatgt

SEQ ID NO: 70015 - DNA, 25 bp, Homo sapien
gcaaacacacactgaaactaagtaa

SEQ ID NO: 70016 - DNA, 25 bp, Homo sapien
gcaaacacacactgaatctaagtaa

SEQ ID NO: 70017 - DNA, 25 bp, Homo sapien
gcaaacacactctcttgacccgagg

SEQ ID NO: 70018 - DNA, 25 bp, Homo sapien
gcaaacacactgtcttgacccgagg

SEQ ID NO: 70019 - DNA, 25 bp, Homo sapien
gcaaacacagataggtttctttact

SEQ ID NO: 70020 - DNA, 25 bp, Homo sapien
gcaaacacaggctgaagagagagat

SEQ ID NO: 70021 - DNA, 25 bp, Homo sapien
gcaaacacaggctggagagagagat

SEQ ID NO: 70022 - DNA, 25 bp, Homo sapien
gcaaacagagtacgactcccttatt

SEQ ID NO: 70023 - DNA, 25 bp, Homo sapien
gcaaacagagtatgactcccttatt

SEQ ID NO: 70024 - DNA, 25 bp, Homo sapien
gcaaacatgatctattcccctgacc

SEQ ID NO: 70025 - DNA, 25 bp, Homo sapien
gcaaacatgttctattcccctgacc

SEQ ID NO: 70026 - DNA, 25 bp, Homo sapien
gcaaaccaatctgaactagaacctc

SEQ ID NO: 70027 - DNA, 25 bp, Homo sapien
gcaaaccaatctgagctagaacctc

SEQ ID NO: 70028 - DNA, 25 bp, Homo sapien
gcaaacccaagtgatcatttagtgt

SEQ ID NO: 70029 - DNA, 25 bp, Homo sapien
gcaaacccacgtgatcatttagtgt

SEQ ID NO: 70030 - DNA, 25 bp, Homo sapien
gcaaaccctatgaagagtcttgaga

SEQ ID NO: 70031 - DNA, 25 bp, Homo sapien
gcaaaccctatgatgagtcttgaga

SEQ ID NO: 70032 - DNA, 25 bp, Homo sapien
gcaaacctcattcttcctggatgcg

SEQ ID NO: 70033 - DNA, 25 bp, Homo sapien
gcaaacctcattgttcctggatgcg

SEQ ID NO: 70034 - DNA, 25 bp, Homo sapien
gcaaactatggtctctgagtgatag

SEQ ID NO: 70035 - DNA, 25 bp, Homo sapien
gcaaactatggtctcttagtgatag

SEQ ID NO: 70036 - DNA, 25 bp, Homo sapien
gcaaactccaccactaactagctgt

SEQ ID NO: 70037 - DNA, 25 bp, Homo sapien
gcaaactctaccactaactagctgt

SEQ ID NO: 70038 - DNA, 25 bp, Homo sapien
gcaaactctgaaggggcccattctc

SEQ ID NO: 70039 - DNA, 25 bp, Homo sapien
gcaaactctgagggggcccattctc

SEQ ID NO: 70040 - DNA, 25 bp, Homo sapien
gcaaactgatatagccactctggaa

SEQ ID NO: 70041 - DNA, 25 bp, Homo sapien
gcaaactgattttgggcaaaatttg

SEQ ID NO: 70042 - DNA, 25 bp, Homo sapien
gcaaactggtatagccactctggaa

SEQ ID NO: 70043 - DNA, 25 bp, Homo sapien
gcaaactggttttgggcaaaatttg

SEQ ID NO: 70044 - DNA, 25 bp, Homo sapien
gcaaagaaaatactcagatagcttt

SEQ ID NO: 70045 - DNA, 25 bp, Homo sapien
gcaaagaaaatactcagttaattat

SEQ ID NO: 70046 - DNA, 25 bp, Homo sapien
gcaaagaaaatactgagatagcttt

SEQ ID NO: 70047 - DNA, 25 bp, Homo sapien
gcaaagaaaatattcagttaattat

SEQ ID NO: 70048 - DNA, 25 bp, Homo sapien
gcaaagaaaatgaaagcacctttct

SEQ ID NO: 70049 - DNA, 25 bp, Homo sapien
gcaaagaaaattaaagcacctttct

SEQ ID NO: 70050 - DNA, 25 bp, Homo sapien
gcaaagaacaacgaagtagttgaga

SEQ ID NO: 70051 - DNA, 25 bp, Homo sapien
gcaaagaacaatgaagtagttgaga

SEQ ID NO: 70052 - DNA, 25 bp, Homo sapien
gcaaagacattgattccaaggcagg

SEQ ID NO: 70053 - DNA, 25 bp, Homo sapien
gcaaagacgttgattccaaggcagg

SEQ ID NO: 70054 - DNA, 25 bp, Homo sapien
gcaaagagcaaccaggaagctgtga

SEQ ID NO: 70055 - DNA, 25 bp, Homo sapien
gcaaagagcaaccagggagctgtga

SEQ ID NO: 70056 - DNA, 25 bp, Homo sapien
gcaaagatcaggacggaagcaaggc

SEQ ID NO: 70057 - DNA, 25 bp, Homo sapien
gcaaagatcaggatggaagcaaggc

SEQ ID NO: 70058 - DNA, 25 bp, Homo sapien
gcaaagatctctagcaatctttccc

SEQ ID NO: 70059 - DNA, 25 bp, Homo sapien
gcaaagatctctagcagtctttccc

SEQ ID NO: 70060 - DNA, 25 bp, Homo sapien
gcaaagatggatcggagagtcaggg

SEQ ID NO: 70061 - DNA, 25 bp, Homo sapien
gcaaagatggatctgagagtcaggg

SEQ ID NO: 70062 - DNA, 25 bp, Homo sapien
gcaaagatgtggcaacagtattcaa

SEQ ID NO: 70063 - DNA, 25 bp, Homo sapien
gcaaagatgtggcgacagtattcaa

SEQ ID NO: 70064 - DNA, 25 bp, Homo sapien
gcaaagcacctatttgaatcttttg

SEQ ID NO: 70065 - DNA, 25 bp, Homo sapien
gcaaagcacctgtttgaatcttttg

SEQ ID NO: 70066 - DNA, 25 bp, Homo sapien
gcaaagcattccctgaccacacgcc

SEQ ID NO: 70067 - DNA, 25 bp, Homo sapien
gcaaagcattccttgaccacacgcc

SEQ ID NO: 70068 - DNA, 25 bp, Homo sapien
gcaaagccaaggtacaaactcacgt

SEQ ID NO: 70069 - DNA, 25 bp, Homo sapien
gcaaagccaaggtacagactcacgt

SEQ ID NO: 70070 - DNA, 25 bp, Homo sapien
gcaaagccacagacactgtaacctt

SEQ ID NO: 70071 - DNA, 25 bp, Homo sapien
gcaaagccacaggcactgtaacctt

SEQ ID NO: 70072 - DNA, 25 bp, Homo sapien
gcaaagcctcaagacatttgccttt

SEQ ID NO: 70073 - DNA, 25 bp, Homo sapien
gcaaagcctcaggacatttgccttt

SEQ ID NO: 70074 - DNA, 25 bp, Homo sapien
gcaaaggaaaaccaaatgaagatca

SEQ ID NO: 70075 - DNA, 25 bp, Homo sapien
gcaaaggaaaagcaaatgaagatca

SEQ ID NO: 70076 - DNA, 25 bp, Homo sapien
gcaaaggaagatccacatctatatg

SEQ ID NO: 70077 - DNA, 25 bp, Homo sapien
gcaaaggacgatatttgggagtgga

SEQ ID NO: 70078 - DNA, 25 bp, Homo sapien
gcaaaggacgatgtttgggagtgga

SEQ ID NO: 70079 - DNA, 25 bp, Homo sapien
gcaaaggaggatccacatctatatg

SEQ ID NO: 70080 - DNA, 25 bp, Homo sapien
gcaaaggcgtaaagaggtgagaaag

SEQ ID NO: 70081 - DNA, 25 bp, Homo sapien
gcaaaggcgtaaggaggtgagaaag

SEQ ID NO: 70082 - DNA, 25 bp, Homo sapien
gcaaaggtacagaaagcagagttat

SEQ ID NO: 70083 - DNA, 25 bp, Homo sapien
gcaaaggtacagaaggcagagttat

SEQ ID NO: 70084 - DNA, 25 bp, Homo sapien
gcaaaggttctcagtcacacctggc

SEQ ID NO: 70085 - DNA, 25 bp, Homo sapien
gcaaaggttctcagtcccacctggc

SEQ ID NO: 70086 - DNA, 25 bp, Homo sapien
gcaaagtacccaattcactacccat

SEQ ID NO: 70087 - DNA, 25 bp, Homo sapien
gcaaagtacccagttcactacccat

SEQ ID NO: 70088 - DNA, 25 bp, Homo sapien
gcaaagtatccagctaattttggac

SEQ ID NO: 70089 - DNA, 25 bp, Homo sapien
gcaaagtattcagctaattttggac

SEQ ID NO: 70090 - DNA, 25 bp, Homo sapien
gcaaataaacggtttggtttacaag

SEQ ID NO: 70091 - DNA, 25 bp, Homo sapien
gcaaataaatggtttggtttacaag

SEQ ID NO: 70092 - DNA, 25 bp, Homo sapien
gcaaataactacaatacacggacac

SEQ ID NO: 70093 - DNA, 25 bp, Homo sapien
gcaaataactaccatacacggacac

SEQ ID NO: 70094 - DNA, 25 bp, Homo sapien
gcaaataagcaacggaaccagaatt

SEQ ID NO: 70095 - DNA, 25 bp, Homo sapien
gcaaataagcaatggaaccagaatt

SEQ ID NO: 70096 - DNA, 25 bp, Homo sapien
gcaaataatggatgacaaatgctga

SEQ ID NO: 70097 - DNA, 25 bp, Homo sapien
gcaaataatggatggcaaatgctga

SEQ ID NO: 70098 - DNA, 25 bp, Homo sapien
gcaaatacatcagtttacatgagag

SEQ ID NO: 70099 - DNA, 25 bp, Homo sapien
gcaaatacatcattttacatgagag

SEQ ID NO: 70100 - DNA, 25 bp, Homo sapien
gcaaatacgacaacggctgaggaat

SEQ ID NO: 70101 - DNA, 25 bp, Homo sapien
gcaaatacgacaatggctgaggaat

SEQ ID NO: 70102 - DNA, 25 bp, Homo sapien
gcaaatactgcaagccaatgaggtc

SEQ ID NO: 70103 - DNA, 25 bp, Homo sapien
gcaaatactgcaagccgatgaggtc

SEQ ID NO: 70104 - DNA, 25 bp, Homo sapien
gcaaatataaacagctaatggggtt

SEQ ID NO: 70105 - DNA, 25 bp, Homo sapien
gcaaatataaacggctaatggggtt

SEQ ID NO: 70106 - DNA, 25 bp, Homo sapien
gcaaatataacaatagatttcagag

SEQ ID NO: 70107 - DNA, 25 bp, Homo sapien
gcaaatatgacaatagatttcagag

SEQ ID NO: 70108 - DNA, 25 bp, Homo sapien
gcaaatccctgagtactctctcaga

SEQ ID NO: 70109 - DNA, 25 bp, Homo sapien
gcaaatccgtgagtactctctcaga

SEQ ID NO: 70110 - DNA, 25 bp, Homo sapien
gcaaatgatcctgatcttatctttt

SEQ ID NO: 70111 - DNA, 25 bp, Homo sapien
gcaaatgatcctggtcttatctttt

SEQ ID NO: 70112 - DNA, 25 bp, Homo sapien
gcaaatgcacctctcgaatcctgga

SEQ ID NO: 70113 - DNA, 25 bp, Homo sapien
gcaaatgcatctctcgaatcctgga

SEQ ID NO: 70114 - DNA, 25 bp, Homo sapien
gcaaatgtaaagcaggcagaataag

SEQ ID NO: 70115 - DNA, 25 bp, Homo sapien
gcaaatgtaaaggaggcagaataag

SEQ ID NO: 70116 - DNA, 25 bp, Homo sapien
gcaaatgtgtttccactaactccat

SEQ ID NO: 70117 - DNA, 25 bp, Homo sapien
gcaaatgtgtttccgctaactccat

SEQ ID NO: 70118 - DNA, 25 bp, Homo sapien
gcaaattaacataccaacaagtcaa

SEQ ID NO: 70119 - DNA, 25 bp, Homo sapien
gcaaattaacatgccaacaagtcaa

SEQ ID NO: 70120 - DNA, 25 bp, Homo sapien
gcaaattacaaaactcttggcacaa

SEQ ID NO: 70121 - DNA, 25 bp, Homo sapien
gcaaattagaaaactcttggcacaa

SEQ ID NO: 70122 - DNA, 25 bp, Homo sapien
gcaaattagctgggtttataattac

SEQ ID NO: 70123 - DNA, 25 bp, Homo sapien
gcaaattagttgggtttataattac

SEQ ID NO: 70124 - DNA, 25 bp, Homo sapien
gcaaattcaatgaaggaaatccaaa

SEQ ID NO: 70125 - DNA, 25 bp, Homo sapien
gcaaattcactacaaaagattgaag

SEQ ID NO: 70126 - DNA, 25 bp, Homo sapien
gcaaattcactacaaaggattgaag

SEQ ID NO: 70127 - DNA, 25 bp, Homo sapien
gcaaattcagcttttcattgaagct

SEQ ID NO: 70128 - DNA, 25 bp, Homo sapien
gcaaattcagcttttcgttgaagct

SEQ ID NO: 70129 - DNA, 25 bp, Homo sapien
gcaaattcattgaaggaaatccaaa

SEQ ID NO: 70130 - DNA, 25 bp, Homo sapien
gcaaatttaatgtaagagggcaaaa

SEQ ID NO: 70131 - DNA, 25 bp, Homo sapien
gcaaatttgaagagctaggcaaatt

SEQ ID NO: 70132 - DNA, 25 bp, Homo sapien
gcaaatttgaagagttaggcaaatt

SEQ ID NO: 70133 - DNA, 25 bp, Homo sapien
gcaaatttgatgtaagagggcaaaa

SEQ ID NO: 70134 - DNA, 25 bp, Homo sapien
gcaacaaacattcacatagaatatg

SEQ ID NO: 70135 - DNA, 25 bp, Homo sapien
gcaacaaacgttcacatagaatatg

SEQ ID NO: 70136 - DNA, 25 bp, Homo sapien
gcaacacaaatccattactttgatt

SEQ ID NO: 70137 - DNA, 25 bp, Homo sapien
gcaacacacgattcttgcggctttg

SEQ ID NO: 70138 - DNA, 25 bp, Homo sapien
gcaacacaggattcttgcggctttg

SEQ ID NO: 70139 - DNA, 25 bp, Homo sapien
gcaacacagtggaacctcatctcta

SEQ ID NO: 70140 - DNA, 25 bp, Homo sapien
gcaacacagtgggacctcatctcta

SEQ ID NO: 70141 - DNA, 25 bp, Homo sapien
gcaacacatatccattactttgatt

SEQ ID NO: 70142 - DNA, 25 bp, Homo sapien
gcaacaccaggctttacctgtatca

SEQ ID NO: 70143 - DNA, 25 bp, Homo sapien
gcaacaccaggctttatctgtatca

SEQ ID NO: 70144 - DNA, 25 bp, Homo sapien
gcaacacgggaattgacaggagagt

SEQ ID NO: 70145 - DNA, 25 bp, Homo sapien
gcaacacgggaattgagaggagagt

SEQ ID NO: 70146 - DNA, 25 bp, Homo sapien
gcaacagagccaccttgaagcacag

SEQ ID NO: 70147 - DNA, 25 bp, Homo sapien
gcaacagagccatcttgaagcacag

SEQ ID NO: 70148 - DNA, 25 bp, Homo sapien
gcaacagcaatatcctctttcagaa

SEQ ID NO: 70149 - DNA, 25 bp, Homo sapien
gcaacagcaatatcctgtttcagaa

SEQ ID NO: 70150 - DNA, 25 bp, Homo sapien
gcaacagcaatcgtattcatagtca

SEQ ID NO: 70151 - DNA, 25 bp, Homo sapien
gcaacagcgatcgtattcatagtca

SEQ ID NO: 70152 - DNA, 25 bp, Homo sapien
gcaacaggaactctcaggaactctc

SEQ ID NO: 70153 - DNA, 25 bp, Homo sapien
gcaacaggaactcttaatcattcct

SEQ ID NO: 70154 - DNA, 25 bp, Homo sapien
gcaacaggaactcttattcattcct

SEQ ID NO: 70155 - DNA, 25 bp, Homo sapien
gcaacaggaactgtcaggaactctc

SEQ ID NO: 70156 - DNA, 25 bp, Homo sapien
gcaacaggattggatgagagattgg

SEQ ID NO: 70157 - DNA, 25 bp, Homo sapien
gcaacagggaccaccgggaagctca

SEQ ID NO: 70158 - DNA, 25 bp, Homo sapien
gcaacagggaccactgggaagctca

SEQ ID NO: 70159 - DNA, 25 bp, Homo sapien
gcaacagggttggatgagagattgg

SEQ ID NO: 70160 - DNA, 25 bp, Homo sapien
gcaacagttcatcgtgtttcaaata

SEQ ID NO: 70161 - DNA, 25 bp, Homo sapien
gcaacagttcattgtgtttcaaata

SEQ ID NO: 70162 - DNA, 25 bp, Homo sapien
gcaacataaccacagctgaattctt

SEQ ID NO: 70163 - DNA, 25 bp, Homo sapien
gcaacataaccattcagaatatggg

SEQ ID NO: 70164 - DNA, 25 bp, Homo sapien
gcaacataatcacagctgaattctt

SEQ ID NO: 70165 - DNA, 25 bp, Homo sapien
gcaacataatgcgtgaggcccagac

SEQ ID NO: 70166 - DNA, 25 bp, Homo sapien
gcaacataatgcttgaggcccagac

SEQ ID NO: 70167 - DNA, 25 bp, Homo sapien
gcaacataatttaccaactcaacat

SEQ ID NO: 70168 - DNA, 25 bp, Homo sapien
gcaacataatttatcaactcaacat

SEQ ID NO: 70169 - DNA, 25 bp, Homo sapien
gcaacataggtgactgagtgtgcaa

SEQ ID NO: 70170 - DNA, 25 bp, Homo sapien
gcaacataggtgactgtgtgtgcaa

SEQ ID NO: 70171 - DNA, 25 bp, Homo sapien
gcaacatatccattcagaatatggg

SEQ ID NO: 70172 - DNA, 25 bp, Homo sapien
gcaacatctcattacatctgaattt

SEQ ID NO: 70173 - DNA, 25 bp, Homo sapien
gcaacatctcattgcatctgaattt

SEQ ID NO: 70174 - DNA, 25 bp, Homo sapien
gcaacatcttcattttagccacatg

SEQ ID NO: 70175 - DNA, 25 bp, Homo sapien
gcaacatcttcattttcgccacatg

SEQ ID NO: 70176 - DNA, 25 bp, Homo sapien
gcaacatggttaagcatcagcattc

SEQ ID NO: 70177 - DNA, 25 bp, Homo sapien
gcaacatggttaaggatcagcattc

SEQ ID NO: 70178 - DNA, 25 bp, Homo sapien
gcaacattcacatctgcatcctcaa

SEQ ID NO: 70179 - DNA, 25 bp, Homo sapien
gcaacattgatcaccagagttaagg

SEQ ID NO: 70180 - DNA, 25 bp, Homo sapien
gcaacattgatcatcagagttaagg

SEQ ID NO: 70181 - DNA, 25 bp, Homo sapien
gcaacattgccttccagtgtgcatc

SEQ ID NO: 70182 - DNA, 25 bp, Homo sapien
gcaacattgtcttccagtgtgcatc

SEQ ID NO: 70183 - DNA, 25 bp, Homo sapien
gcaacatttacatctgcatcctcaa

SEQ ID NO: 70184 - DNA, 25 bp, Homo sapien
gcaacatttcccttcgggttccagc

SEQ ID NO: 70185 - DNA, 25 bp, Homo sapien
gcaacatttccctttgggttccagc

SEQ ID NO: 70186 - DNA, 25 bp, Homo sapien
gcaaccaaagaaggagcttttacac

SEQ ID NO: 70187 - DNA, 25 bp, Homo sapien
gcaaccaaagagggagcttttacac

SEQ ID NO: 70188 - DNA, 25 bp, Homo sapien
gcaaccaaattcaacacaagtttta

SEQ ID NO: 70189 - DNA, 25 bp, Homo sapien
gcaaccaaattcaacagaagtttta

SEQ ID NO: 70190 - DNA, 25 bp, Homo sapien
gcaaccaactcaaatttgctaatcc

SEQ ID NO: 70191 - DNA, 25 bp, Homo sapien
gcaaccaactcagatttgctaatcc

SEQ ID NO: 70192 - DNA, 25 bp, Homo sapien
gcaaccaccaagtttacctgttata

SEQ ID NO: 70193 - DNA, 25 bp, Homo sapien
gcaaccaccaagtttatctgttata

SEQ ID NO: 70194 - DNA, 25 bp, Homo sapien
gcaaccaggaagctgtgagctttat

SEQ ID NO: 70195 - DNA, 25 bp, Homo sapien
gcaaccagggagctgtgagctttat

SEQ ID NO: 70196 - DNA, 25 bp, Homo sapien
gcaaccatgatgttcgtgttgcaat

SEQ ID NO: 70197 - DNA, 25 bp, Homo sapien
gcaaccatgatgtttgtgttgcaat

SEQ ID NO: 70198 - DNA, 25 bp, Homo sapien
gcaaccatggaatacttgagtggga

SEQ ID NO: 70199 - DNA, 25 bp, Homo sapien
gcaaccatggagtacttgagtggga

SEQ ID NO: 70200 - DNA, 25 bp, Homo sapien
gcaaccctcaacggacggctgcaga

SEQ ID NO: 70201 - DNA, 25 bp, Homo sapien
gcaaccctcaatggacggctgcaga

SEQ ID NO: 70202 - DNA, 25 bp, Homo sapien
gcaacctatttatacacataagcca

SEQ ID NO: 70203 - DNA, 25 bp, Homo sapien
gcaacctatttatatacataagcca

SEQ ID NO: 70204 - DNA, 25 bp, Homo sapien
gcaacctccaaccgctggattcaaa

SEQ ID NO: 70205 - DNA, 25 bp, Homo sapien
gcaacctccaactgctggattcaaa

SEQ ID NO: 70206 - DNA, 25 bp, Homo sapien
gcaacctcgacgtcctggccttagg

SEQ ID NO: 70207 - DNA, 25 bp, Homo sapien
gcaacctcgacgtcttggccttagg

SEQ ID NO: 70208 - DNA, 25 bp, Homo sapien
gcaacctgtgtggcaatatgattag

SEQ ID NO: 70209 - DNA, 25 bp, Homo sapien
gcaacctgtgtggcgatatgattag

SEQ ID NO: 70210 - DNA, 25 bp, Homo sapien
gcaacgcttacgtgttcatcccagt

SEQ ID NO: 70211 - DNA, 25 bp, Homo sapien
gcaacgcttacgtgttgatcccagt

SEQ ID NO: 70212 - DNA, 25 bp, Homo sapien
gcaacgtggagactcagaagcaagc

SEQ ID NO: 70213 - DNA, 25 bp, Homo sapien
gcaacgtggagactgagaagcaagc

SEQ ID NO: 70214 - DNA, 25 bp, Homo sapien
gcaactaaataactgcacaggctta

SEQ ID NO: 70215 - DNA, 25 bp, Homo sapien
gcaactaaatagctgcacaggctta

SEQ ID NO: 70216 - DNA, 25 bp, Homo sapien
gcaactcaatgaaaccaaagtcttt

SEQ ID NO: 70217 - DNA, 25 bp, Homo sapien
gcaactcaatgaagccaaagtcttt

SEQ ID NO: 70218 - DNA, 25 bp, Homo sapien
gcaactcacctctgactcagaactt

SEQ ID NO: 70219 - DNA, 25 bp, Homo sapien
gcaactcatctctgactcagaactt

SEQ ID NO: 70220 - DNA, 25 bp, Homo sapien
gcaactctacaatcctgcccactct

SEQ ID NO: 70221 - DNA, 25 bp, Homo sapien
gcaactctacagtcctgcccactct

SEQ ID NO: 70222 - DNA, 25 bp, Homo sapien
gcaactctaccaaacaccaacttac

SEQ ID NO: 70223 - DNA, 25 bp, Homo sapien
gcaactctaccaagcaccaacttac

SEQ ID NO: 70224 - DNA, 25 bp, Homo sapien
gcaactctctaatggctaataatgt

SEQ ID NO: 70225 - DNA, 25 bp, Homo sapien
gcaactctgcgatgttggaaaggct

SEQ ID NO: 70226 - DNA, 25 bp, Homo sapien
gcaactctgcgctgttggaaaggct

SEQ ID NO: 70227 - DNA, 25 bp, Homo sapien
gcaactctttaatggctaataatgt

SEQ ID NO: 70228 - DNA, 25 bp, Homo sapien
gcaactgagttctacatgagcctct

SEQ ID NO: 70229 - DNA, 25 bp, Homo sapien
gcaactgagttcttcatgagcctct

SEQ ID NO: 70230 - DNA, 25 bp, Homo sapien
gcaactgcaacaatctgacttgaca

SEQ ID NO: 70231 - DNA, 25 bp, Homo sapien
gcaactgcaacaatttgacttgaca

SEQ ID NO: 70232 - DNA, 25 bp, Homo sapien
gcaactgcaggattcgggcagccag

SEQ ID NO: 70233 - DNA, 25 bp, Homo sapien
gcaactgcaggatttgggcagccag

SEQ ID NO: 70234 - DNA, 25 bp, Homo sapien
gcaactgccactaattcgagttttc

SEQ ID NO: 70235 - DNA, 25 bp, Homo sapien
gcaactgccactaatttgagttttc

SEQ ID NO: 70236 - DNA, 25 bp, Homo sapien
gcaactgggccaaagttcatcaggt

SEQ ID NO: 70237 - DNA, 25 bp, Homo sapien
gcaactgggccaaggttcatcaggt

SEQ ID NO: 70238 - DNA, 25 bp, Homo sapien
gcaactgttttcaacgaggtttgat

SEQ ID NO: 70239 - DNA, 25 bp, Homo sapien
gcaactgttttcaatgaggtttgat

SEQ ID NO: 70240 - DNA, 25 bp, Homo sapien
gcaacttacactgactctctcagtt

SEQ ID NO: 70241 - DNA, 25 bp, Homo sapien
gcaacttacactgagtctctcagtt

SEQ ID NO: 70242 - DNA, 25 bp, Homo sapien
gcaacttggagcctcgtgagtgctg

SEQ ID NO: 70243 - DNA, 25 bp, Homo sapien
gcaacttggagccttgtgagtgctg

SEQ ID NO: 70244 - DNA, 25 bp, Homo sapien
gcaacttgtttggctcttcctcaac

SEQ ID NO: 70245 - DNA, 25 bp, Homo sapien
gcaacttgtttggttcttcctcaac

SEQ ID NO: 70246 - DNA, 25 bp, Homo sapien
gcaactttgcttcccctagagtttt

SEQ ID NO: 70247 - DNA, 25 bp, Homo sapien
gcaactttggttcccctagagtttt

SEQ ID NO: 70248 - DNA, 25 bp, Homo sapien
gcaagaaacattaacagaagttctt

SEQ ID NO: 70249 - DNA, 25 bp, Homo sapien
gcaagaaacggcagtcatcaaacta

SEQ ID NO: 70250 - DNA, 25 bp, Homo sapien
gcaagaaacgttaacagaagttctt

SEQ ID NO: 70251 - DNA, 25 bp, Homo sapien
gcaagaaataatcatctgtgtacta

SEQ ID NO: 70252 - DNA, 25 bp, Homo sapien
gcaagaaataatcgtctgtgtacta

SEQ ID NO: 70253 - DNA, 25 bp, Homo sapien
gcaagaaatggcagtcatcaaacta

SEQ ID NO: 70254 - DNA, 25 bp, Homo sapien
gcaagaacaattagtggcatgagcc

SEQ ID NO: 70255 - DNA, 25 bp, Homo sapien
gcaagaacaattcgtggcatgagcc

SEQ ID NO: 70256 - DNA, 25 bp, Homo sapien
gcaagaactacagagacagagttgt

SEQ ID NO: 70257 - DNA, 25 bp, Homo sapien
gcaagaactccagagacagagttgt

SEQ ID NO: 70258 - DNA, 25 bp, Homo sapien
gcaagaagcccagcgccagggtagg

SEQ ID NO: 70259 - DNA, 25 bp, Homo sapien
gcaagaagcccagtgccagggtagg

SEQ ID NO: 70260 - DNA, 25 bp, Homo sapien
gcaagaaggcacaatttaatcagga

SEQ ID NO: 70261 - DNA, 25 bp, Homo sapien
gcaagaaggcataatttaatcagga

SEQ ID NO: 70262 - DNA, 25 bp, Homo sapien
gcaagaatagacccattgcttcaaa

SEQ ID NO: 70263 - DNA, 25 bp, Homo sapien
gcaagaatagacccgttgcttcaaa

SEQ ID NO: 70264 - DNA, 25 bp, Homo sapien
gcaagacaaatgacctggaaattaa

SEQ ID NO: 70265 - DNA, 25 bp, Homo sapien
gcaagacacgaagagatcacaactc

SEQ ID NO: 70266 - DNA, 25 bp, Homo sapien
gcaagacagatgacctggaaattaa

SEQ ID NO: 70267 - DNA, 25 bp, Homo sapien
gcaagacatgaagagatcacaactc

SEQ ID NO: 70268 - DNA, 25 bp, Homo sapien
gcaagactctacttcagtctagctc

SEQ ID NO: 70269 - DNA, 25 bp, Homo sapien
gcaagactctatttcagtctagctc

SEQ ID NO: 70270 - DNA, 25 bp, Homo sapien
gcaagactgataaatgagaaaacat

SEQ ID NO: 70271 - DNA, 25 bp, Homo sapien
gcaagactgataaatgggaaaacat

SEQ ID NO: 70272 - DNA, 25 bp, Homo sapien
gcaagagaacacatatacgatgatg

SEQ ID NO: 70273 - DNA, 25 bp, Homo sapien
gcaagagacaacctgaaggaatgac

SEQ ID NO: 70274 - DNA, 25 bp, Homo sapien
gcaagagacaaggaatatcatgaac

SEQ ID NO: 70275 - DNA, 25 bp, Homo sapien
gcaagagaccacatatacgatgatg

SEQ ID NO: 70276 - DNA, 25 bp, Homo sapien
gcaagagaccaggaatatcatgaac

SEQ ID NO: 70277 - DNA, 25 bp, Homo sapien
gcaagagagaccaaaactcactgaa

SEQ ID NO: 70278 - DNA, 25 bp, Homo sapien
gcaagagagaccaacactcactgaa

SEQ ID NO: 70279 - DNA, 25 bp, Homo sapien
gcaagagaggaaggccgatgggaag

SEQ ID NO: 70280 - DNA, 25 bp, Homo sapien
gcaagagaggaaggtcgatgggaag

SEQ ID NO: 70281 - DNA, 25 bp, Homo sapien
gcaagagataacctgaaggaatgac

SEQ ID NO: 70282 - DNA, 25 bp, Homo sapien
gcaagagccatggaggactctggtg

SEQ ID NO: 70283 - DNA, 25 bp, Homo sapien
gcaagagccgtggaggactctggtg

SEQ ID NO: 70284 - DNA, 25 bp, Homo sapien
gcaagaggacatagtaggtacacaa

SEQ ID NO: 70285 - DNA, 25 bp, Homo sapien
gcaagaggacatggtaggtacacaa

SEQ ID NO: 70286 - DNA, 25 bp, Homo sapien
gcaagaggcaggcacagacgttagt

SEQ ID NO: 70287 - DNA, 25 bp, Homo sapien
gcaagaggcaggtacagacgttagt

SEQ ID NO: 70288 - DNA, 25 bp, Homo sapien
gcaagaggcatcatccataaaaaat

SEQ ID NO: 70289 - DNA, 25 bp, Homo sapien
gcaagaggtatcatccataaaaaat

SEQ ID NO: 70290 - DNA, 25 bp, Homo sapien
gcaagataccttttagtctatttct

SEQ ID NO: 70291 - DNA, 25 bp, Homo sapien
gcaagatatcttttagtctatttct

SEQ ID NO: 70292 - DNA, 25 bp, Homo sapien
gcaagatgactacagatgccataag

SEQ ID NO: 70293 - DNA, 25 bp, Homo sapien
gcaagatgactatagatgccataag

SEQ ID NO: 70294 - DNA, 25 bp, Homo sapien
gcaagatgatttcgggaatgatttt

SEQ ID NO: 70295 - DNA, 25 bp, Homo sapien
gcaagatgattttgggaatgatttt

SEQ ID NO: 70296 - DNA, 25 bp, Homo sapien
gcaagatttatgagtcatgaaaatg

SEQ ID NO: 70297 - DNA, 25 bp, Homo sapien
gcaagatttgtgagtcatgaaaatg

SEQ ID NO: 70298 - DNA, 25 bp, Homo sapien
gcaagattttgatgaccaggtagta

SEQ ID NO: 70299 - DNA, 25 bp, Homo sapien
gcaagattttggtgaccaggtagta

SEQ ID NO: 70300 - DNA, 25 bp, Homo sapien
gcaagcacattatatccagagatga

SEQ ID NO: 70301 - DNA, 25 bp, Homo sapien
gcaagcacattgtatccagagatga

SEQ ID NO: 70302 - DNA, 25 bp, Homo sapien
gcaagcaccacatgagctctggcgg

SEQ ID NO: 70303 - DNA, 25 bp, Homo sapien
gcaagcaccacatgaggtctggcgg

SEQ ID NO: 70304 - DNA, 25 bp, Homo sapien
gcaagcagacatatattattagtgc

SEQ ID NO: 70305 - DNA, 25 bp, Homo sapien
gcaagcagagtatgcgataagagat

SEQ ID NO: 70306 - DNA, 25 bp, Homo sapien
gcaagcagagtatgtgataagagat

SEQ ID NO: 70307 - DNA, 25 bp, Homo sapien
gcaagcagtcatatattattagtgc

SEQ ID NO: 70308 - DNA, 25 bp, Homo sapien
gcaagcagtcttcctgcaatggtgc

SEQ ID NO: 70309 - DNA, 25 bp, Homo sapien
gcaagcagtctttctgcaatggtgc

SEQ ID NO: 70310 - DNA, 25 bp, Homo sapien
gcaagcatgatacaacatatgaact

SEQ ID NO: 70311 - DNA, 25 bp, Homo sapien
gcaagcatgatacaacttatgaact

SEQ ID NO: 70312 - DNA, 25 bp, Homo sapien
gcaagccaagacagttatctaagtt

SEQ ID NO: 70313 - DNA, 25 bp, Homo sapien
gcaagccaagagagttatctaagtt

SEQ ID NO: 70314 - DNA, 25 bp, Homo sapien
gcaagccaatcttacacaaatgctg

SEQ ID NO: 70315 - DNA, 25 bp, Homo sapien
gcaagccagtcttacacaaatgctg

SEQ ID NO: 70316 - DNA, 25 bp, Homo sapien
gcaagcccagctaagactagcagag

SEQ ID NO: 70317 - DNA, 25 bp, Homo sapien
gcaagcccagctaagattagcagag

SEQ ID NO: 70318 - DNA, 25 bp, Homo sapien
gcaagctcaataagaacagggactg

SEQ ID NO: 70319 - DNA, 25 bp, Homo sapien
gcaagctcaatgagaacagggactg

SEQ ID NO: 70320 - DNA, 25 bp, Homo sapien
gcaagctctcgtattccaggcatat

SEQ ID NO: 70321 - DNA, 25 bp, Homo sapien
gcaagctcttgtattccaggcatat

SEQ ID NO: 70322 - DNA, 25 bp, Homo sapien
gcaagctgtaaaccctctgagaaca

SEQ ID NO: 70323 - DNA, 25 bp, Homo sapien
gcaagctgtaagccctctgagaaca

SEQ ID NO: 70324 - DNA, 25 bp, Homo sapien
gcaagcttcacaactttctccgact

SEQ ID NO: 70325 - DNA, 25 bp, Homo sapien
gcaagcttcacatctttctccgact

SEQ ID NO: 70326 - DNA, 25 bp, Homo sapien
gcaaggaaacgagggccactatgct

SEQ ID NO: 70327 - DNA, 25 bp, Homo sapien
gcaaggaaatgagggccactatgct

SEQ ID NO: 70328 - DNA, 25 bp, Homo sapien
gcaaggaataaatgaactcaagtaa

SEQ ID NO: 70329 - DNA, 25 bp, Homo sapien
gcaaggaataaattaactcaagtaa

SEQ ID NO: 70330 - DNA, 25 bp, Homo sapien
gcaaggaccaaagaaggaacctaag

SEQ ID NO: 70331 - DNA, 25 bp, Homo sapien
gcaaggaccaaaggaggaacctaag

SEQ ID NO: 70332 - DNA, 25 bp, Homo sapien
gcaaggatgggactctgctctgagg

SEQ ID NO: 70333 - DNA, 25 bp, Homo sapien
gcaaggatgttcaaatgccactggg

SEQ ID NO: 70334 - DNA, 25 bp, Homo sapien
gcaaggattgcggcttcctccttcc

SEQ ID NO: 70335 - DNA, 25 bp, Homo sapien
gcaaggattgcggcttgctccttcc

SEQ ID NO: 70336 - DNA, 25 bp, Homo sapien
gcaaggattggactctgctctgagg

SEQ ID NO: 70337 - DNA, 25 bp, Homo sapien
gcaaggattttcaaatgccactggg

SEQ ID NO: 70338 - DNA, 25 bp, Homo sapien
gcaaggcatacagacagctgaagaa

SEQ ID NO: 70339 - DNA, 25 bp, Homo sapien
gcaaggcatacaggcagctgaagaa

SEQ ID NO: 70340 - DNA, 25 bp, Homo sapien
gcaaggctcaatgcggaaattcatg

SEQ ID NO: 70341 - DNA, 25 bp, Homo sapien
gcaaggctcaatgctgaaattcatg

SEQ ID NO: 70342 - DNA, 25 bp, Homo sapien
gcaagggaactgacgagtcttgggt

SEQ ID NO: 70343 - DNA, 25 bp, Homo sapien
gcaagggaactgatgagtcttgggt

SEQ ID NO: 70344 - DNA, 25 bp, Homo sapien
gcaagggactcctactgcttgagga

SEQ ID NO: 70345 - DNA, 25 bp, Homo sapien
gcaagggagcaacatggcaccccag

SEQ ID NO: 70346 - DNA, 25 bp, Homo sapien
gcaagggagcagcatggcaccccag

SEQ ID NO: 70347 - DNA, 25 bp, Homo sapien
gcaagggattcctactgcttgagga

SEQ ID NO: 70348 - DNA, 25 bp, Homo sapien
gcaagggtagtcgccttctgatgtt

SEQ ID NO: 70349 - DNA, 25 bp, Homo sapien
gcaagggtagtcgtcttctgatgtt

SEQ ID NO: 70350 - DNA, 25 bp, Homo sapien
gcaagtaaataagtaaaggtcttct

SEQ ID NO: 70351 - DNA, 25 bp, Homo sapien
gcaagtaaattattctttctgtgcc

SEQ ID NO: 70352 - DNA, 25 bp, Homo sapien
gcaagtaacttattctttctgtgcc

SEQ ID NO: 70353 - DNA, 25 bp, Homo sapien
gcaagtaagtaagtaaaggtcttct

SEQ ID NO: 70354 - DNA, 25 bp, Homo sapien
gcaagtagagagtcatcagtaacct

SEQ ID NO: 70355 - DNA, 25 bp, Homo sapien
gcaagtagagagtcattagtaacct

SEQ ID NO: 70356 - DNA, 25 bp, Homo sapien
gcaagtatatgacaaccgcgacagc

SEQ ID NO: 70357 - DNA, 25 bp, Homo sapien
gcaagtatatgacaactgcgacagc

SEQ ID NO: 70358 - DNA, 25 bp, Homo sapien
gcaagtatgatattaatagtgggct

SEQ ID NO: 70359 - DNA, 25 bp, Homo sapien
gcaagtatgatattgatagtgggct

SEQ ID NO: 70360 - DNA, 25 bp, Homo sapien
gcaagtcaatgaccatgagagaatg

SEQ ID NO: 70361 - DNA, 25 bp, Homo sapien
gcaagtcaatgactatgagagaatg

SEQ ID NO: 70362 - DNA, 25 bp, Homo sapien
gcaagtccaagttaaatacatgtta

SEQ ID NO: 70363 - DNA, 25 bp, Homo sapien
gcaagtccaagttgaatacatgtta

SEQ ID NO: 70364 - DNA, 25 bp, Homo sapien
gcaagtctatgagacggactaacac

SEQ ID NO: 70365 - DNA, 25 bp, Homo sapien
gcaagtctatgagatggactaacac

SEQ ID NO: 70366 - DNA, 25 bp, Homo sapien
gcaagtctcaatagtttgctagatg

SEQ ID NO: 70367 - DNA, 25 bp, Homo sapien
gcaagtctcaatggtttgctagatg

SEQ ID NO: 70368 - DNA, 25 bp, Homo sapien
gcaagtctcacaattcaaggtgacc

SEQ ID NO: 70369 - DNA, 25 bp, Homo sapien
gcaagtctcgcaattcaaggtgacc

SEQ ID NO: 70370 - DNA, 25 bp, Homo sapien
gcaagtctgatatttggttatgatg

SEQ ID NO: 70371 - DNA, 25 bp, Homo sapien
gcaagtctgatctttggttatgatg

SEQ ID NO: 70372 - DNA, 25 bp, Homo sapien
gcaagtcttaataaattcgaaaatt

SEQ ID NO: 70373 - DNA, 25 bp, Homo sapien
gcaagtcttaatgaattcgaaaatt

SEQ ID NO: 70374 - DNA, 25 bp, Homo sapien
gcaagtggacggtctccaacttcga

SEQ ID NO: 70375 - DNA, 25 bp, Homo sapien
gcaagtggatggtctccaacttcga

SEQ ID NO: 70376 - DNA, 25 bp, Homo sapien
gcaagtgtatgaaattctgaaggaa

SEQ ID NO: 70377 - DNA, 25 bp, Homo sapien
gcaagtgtatgaagttctgaaggaa

SEQ ID NO: 70378 - DNA, 25 bp, Homo sapien
gcaagttccagccttatttttatag

SEQ ID NO: 70379 - DNA, 25 bp, Homo sapien
gcaagttccagcgttatttttatag

SEQ ID NO: 70380 - DNA, 25 bp, Homo sapien
gcaagttgtagttcttctgtagatt

SEQ ID NO: 70381 - DNA, 25 bp, Homo sapien
gcaagttgtagtttttctgtagatt

SEQ ID NO: 70382 - DNA, 25 bp, Homo sapien
gcaagttgtttagttttcatatatt

SEQ ID NO: 70383 - DNA, 25 bp, Homo sapien
gcaagttgtttggttttcatatatt

SEQ ID NO: 70384 - DNA, 25 bp, Homo sapien
gcaagtttctggtattcaacaaaat

SEQ ID NO: 70385 - DNA, 25 bp, Homo sapien
gcaagtttctggtcttcaacaaaat

SEQ ID NO: 70386 - DNA, 25 bp, Homo sapien
gcaagtttttatcaggccttcctcc

SEQ ID NO: 70387 - DNA, 25 bp, Homo sapien
gcaagtttttattaggccttcctcc

SEQ ID NO: 70388 - DNA, 25 bp, Homo sapien
gcaataaaatatgcgcttgtgtgct

SEQ ID NO: 70389 - DNA, 25 bp, Homo sapien
gcaataaaatatgtgcttgtgtgct

SEQ ID NO: 70390 - DNA, 25 bp, Homo sapien
gcaataaacaggcaagacagggaga

SEQ ID NO: 70391 - DNA, 25 bp, Homo sapien
gcaataaacaggcaaggcagggaga

SEQ ID NO: 70392 - DNA, 25 bp, Homo sapien
gcaataaacattcttcaaactcaat

SEQ ID NO: 70393 - DNA, 25 bp, Homo sapien
gcaataaagattcttcaaactcaat

SEQ ID NO: 70394 - DNA, 25 bp, Homo sapien
gcaatacacagatgctctcctattt

SEQ ID NO: 70395 - DNA, 25 bp, Homo sapien
gcaatacacagatgttctcctattt

SEQ ID NO: 70396 - DNA, 25 bp, Homo sapien
gcaataccacttcaatgcatactgt

SEQ ID NO: 70397 - DNA, 25 bp, Homo sapien
gcaataccacttcgatgcatactgt

SEQ ID NO: 70398 - DNA, 25 bp, Homo sapien
gcaatactcatcatatcagtgattg

SEQ ID NO: 70399 - DNA, 25 bp, Homo sapien
gcaatactcatcgtatcagtgattg

SEQ ID NO: 70400 - DNA, 25 bp, Homo sapien
gcaatagactcaacctcttaatagt

SEQ ID NO: 70401 - DNA, 25 bp, Homo sapien
gcaatagaggctgatccctgtctgt

SEQ ID NO: 70402 - DNA, 25 bp, Homo sapien
gcaatagaggctgatctctgtctgt

SEQ ID NO: 70403 - DNA, 25 bp, Homo sapien
gcaatagatgaggacattttggact

SEQ ID NO: 70404 - DNA, 25 bp, Homo sapien
gcaatagatgatgacattttggact

SEQ ID NO: 70405 - DNA, 25 bp, Homo sapien
gcaatagattcaacctcttaatagt

SEQ ID NO: 70406 - DNA, 25 bp, Homo sapien
gcaatagcatctaaagacaatatat

SEQ ID NO: 70407 - DNA, 25 bp, Homo sapien
gcaatagcatctgaagacaatatat

SEQ ID NO: 70408 - DNA, 25 bp, Homo sapien
gcaataggggtgccagtgaacaagt

SEQ ID NO: 70409 - DNA, 25 bp, Homo sapien
gcaataggggtgccggtgaacaagt

SEQ ID NO: 70410 - DNA, 25 bp, Homo sapien
gcaatagtaactatccaggatgaaa

SEQ ID NO: 70411 - DNA, 25 bp, Homo sapien
gcaatagtagctatccaggatgaaa

SEQ ID NO: 70412 - DNA, 25 bp, Homo sapien
gcaatatgacacgaacaaaggaatg

SEQ ID NO: 70413 - DNA, 25 bp, Homo sapien
gcaatatgacatgaacaaaggaatg

SEQ ID NO: 70414 - DNA, 25 bp, Homo sapien
gcaatattgtcttggctatgacttc

SEQ ID NO: 70415 - DNA, 25 bp, Homo sapien
gcaatatttatgactgcctggtaga

SEQ ID NO: 70416 - DNA, 25 bp, Homo sapien
gcaatatttctgactgcctggtaga

SEQ ID NO: 70417 - DNA, 25 bp, Homo sapien
gcaatattttcttggctatgacttc

SEQ ID NO: 70418 - DNA, 25 bp, Homo sapien
gcaatcaagaagacgctaaaaggat

SEQ ID NO: 70419 - DNA, 25 bp, Homo sapien
gcaatcaagaagatgctaaaaggat

SEQ ID NO: 70420 - DNA, 25 bp, Homo sapien
gcaatcaggtggcgaacatcccgtc

SEQ ID NO: 70421 - DNA, 25 bp, Homo sapien
gcaatcaggtggtgaacatcccgtc

SEQ ID NO: 70422 - DNA, 25 bp, Homo sapien
gcaatcattatgaagcttcagccca

SEQ ID NO: 70423 - DNA, 25 bp, Homo sapien
gcaatcattgtgaagcttcagccca

SEQ ID NO: 70424 - DNA, 25 bp, Homo sapien
gcaatccacattaagataaggctgg

SEQ ID NO: 70425 - DNA, 25 bp, Homo sapien
gcaatccacattgagataaggctgg

SEQ ID NO: 70426 - DNA, 25 bp, Homo sapien
gcaatccattaaacttctcctggct

SEQ ID NO: 70427 - DNA, 25 bp, Homo sapien
gcaatccattaatcttctcctggct

SEQ ID NO: 70428 - DNA, 25 bp, Homo sapien
gcaatctactacatacatgagctgt

SEQ ID NO: 70429 - DNA, 25 bp, Homo sapien
gcaatctactacatacgtgagctgt

SEQ ID NO: 70430 - DNA, 25 bp, Homo sapien
gcaatctgcagtttcacccctcgcc

SEQ ID NO: 70431 - DNA, 25 bp, Homo sapien
gcaatctgcatagcatcagaacaga

SEQ ID NO: 70432 - DNA, 25 bp, Homo sapien
gcaatctgcatggcatcagaacaga

SEQ ID NO: 70433 - DNA, 25 bp, Homo sapien
gcaatctgtagtttcacccctcgcc

SEQ ID NO: 70434 - DNA, 25 bp, Homo sapien
gcaatgaagggatgaaagaatgaat

SEQ ID NO: 70435 - DNA, 25 bp, Homo sapien
gcaatgaagggatgaaggaatgaat

SEQ ID NO: 70436 - DNA, 25 bp, Homo sapien
gcaatgaaggtacaaaaatgacctg

SEQ ID NO: 70437 - DNA, 25 bp, Homo sapien
gcaatgaaggtaccaaaatgacctg

SEQ ID NO: 70438 - DNA, 25 bp, Homo sapien
gcaatgaatggactggccacaaaaa

SEQ ID NO: 70439 - DNA, 25 bp, Homo sapien
gcaatgaatgggctggccacaaaaa

SEQ ID NO: 70440 - DNA, 25 bp, Homo sapien
gcaatgacaatcttcctggcctcaa

SEQ ID NO: 70441 - DNA, 25 bp, Homo sapien
gcaatgacaatgttcctggcctcaa

SEQ ID NO: 70442 - DNA, 25 bp, Homo sapien
gcaatgaccctgccttacatctcat

SEQ ID NO: 70443 - DNA, 25 bp, Homo sapien
gcaatgacggtgtaattttcagagg

SEQ ID NO: 70444 - DNA, 25 bp, Homo sapien
gcaatgactcatgatgtaaaattgg

SEQ ID NO: 70445 - DNA, 25 bp, Homo sapien
gcaatgactcatgctgtaaaattgg

SEQ ID NO: 70446 - DNA, 25 bp, Homo sapien
gcaatgactctgccttacatctcat

SEQ ID NO: 70447 - DNA, 25 bp, Homo sapien
gcaatgactgtgtaattttcagagg

SEQ ID NO: 70448 - DNA, 25 bp, Homo sapien
gcaatgatgtatcagaccattcatg

SEQ ID NO: 70449 - DNA, 25 bp, Homo sapien
gcaatgatgtatctgaccattcatg

SEQ ID NO: 70450 - DNA, 25 bp, Homo sapien
gcaatgcacattaaagttcaaattc

SEQ ID NO: 70451 - DNA, 25 bp, Homo sapien
gcaatgcatattaaagttcaaattc

SEQ ID NO: 70452 - DNA, 25 bp, Homo sapien
gcaatgcatgctctttaaatagaaa

SEQ ID NO: 70453 - DNA, 25 bp, Homo sapien
gcaatgcatgctttttaaatagaaa

SEQ ID NO: 70454 - DNA, 25 bp, Homo sapien
gcaatgctattaccggttgagtatc

SEQ ID NO: 70455 - DNA, 25 bp, Homo sapien
gcaatgctattactggttgagtatc

SEQ ID NO: 70456 - DNA, 25 bp, Homo sapien
gcaatgctggagacatggtgaaata

SEQ ID NO: 70457 - DNA, 25 bp, Homo sapien
gcaatgctggagacgtggtgaaata

SEQ ID NO: 70458 - DNA, 25 bp, Homo sapien
gcaatgctgtaaataggagtcatta

SEQ ID NO: 70459 - DNA, 25 bp, Homo sapien
gcaatgctgtaaatcggagtcatta

SEQ ID NO: 70460 - DNA, 25 bp, Homo sapien
gcaatggccctcgttaattttatca

SEQ ID NO: 70461 - DNA, 25 bp, Homo sapien
gcaatggccctctttaattttatca

SEQ ID NO: 70462 - DNA, 25 bp, Homo sapien
gcaatggtatgaaagttggcttcac

SEQ ID NO: 70463 - DNA, 25 bp, Homo sapien
gcaatggtcaagggaaatgatcact

SEQ ID NO: 70464 - DNA, 25 bp, Homo sapien
gcaatggtcaagggaactgatcact

SEQ ID NO: 70465 - DNA, 25 bp, Homo sapien
gcaatggtgtgaaagttggcttcac

SEQ ID NO: 70466 - DNA, 25 bp, Homo sapien
gcaatgtaaaaatcacagcacattt

SEQ ID NO: 70467 - DNA, 25 bp, Homo sapien
gcaatgtagaaatcacagcacattt

SEQ ID NO: 70468 - DNA, 25 bp, Homo sapien
gcaatgtctcccaaatttataaaga

SEQ ID NO: 70469 - DNA, 25 bp, Homo sapien
gcaatgtctcccagatttataaaga

SEQ ID NO: 70470 - DNA, 25 bp, Homo sapien
gcaatgtgaaaaggtgggaagactt

SEQ ID NO: 70471 - DNA, 25 bp, Homo sapien
gcaatgtgaaaagttgggaagactt

SEQ ID NO: 70472 - DNA, 25 bp, Homo sapien
gcaatgtgaaggacagcatcacagg

SEQ ID NO: 70473 - DNA, 25 bp, Homo sapien
gcaatgtgaaggacagtatcacagg

SEQ ID NO: 70474 - DNA, 25 bp, Homo sapien
gcaatgtgttggtgatcatacaaag

SEQ ID NO: 70475 - DNA, 25 bp, Homo sapien
gcaatgtgttggtgattatacaaag

SEQ ID NO: 70476 - DNA, 25 bp, Homo sapien
gcaatgtgttgtcattacaggactg

SEQ ID NO: 70477 - DNA, 25 bp, Homo sapien
gcaatgtgttgtcgttacaggactg

SEQ ID NO: 70478 - DNA, 25 bp, Homo sapien
gcaatgttctaacagttcaaattaa

SEQ ID NO: 70479 - DNA, 25 bp, Homo sapien
gcaatgttctaatagttcaaattaa

SEQ ID NO: 70480 - DNA, 25 bp, Homo sapien
gcaattagccgaacacgtagcccag

SEQ ID NO: 70481 - DNA, 25 bp, Homo sapien
gcaattagctgaacacgtagcccag

SEQ ID NO: 70482 - DNA, 25 bp, Homo sapien
gcaattagtggagactttaatagaa

SEQ ID NO: 70483 - DNA, 25 bp, Homo sapien
gcaattagtggagattttaatagaa

SEQ ID NO: 70484 - DNA, 25 bp, Homo sapien
gcaattatacatagtactgcatttt

SEQ ID NO: 70485 - DNA, 25 bp, Homo sapien
gcaattatagatagtactgcatttt

SEQ ID NO: 70486 - DNA, 25 bp, Homo sapien
gcaattatttgaacctgtctttttt

SEQ ID NO: 70487 - DNA, 25 bp, Homo sapien
gcaattatttgaacttgtctttttt

SEQ ID NO: 70488 - DNA, 25 bp, Homo sapien
gcaattcaacctattggtgtggagg

SEQ ID NO: 70489 - DNA, 25 bp, Homo sapien
gcaattcagcctattggtgtggagg

SEQ ID NO: 70490 - DNA, 25 bp, Homo sapien
gcaattctgttcccagagaaatgaa

SEQ ID NO: 70491 - DNA, 25 bp, Homo sapien
gcaattctgttcctagagaaatgaa

SEQ ID NO: 70492 - DNA, 25 bp, Homo sapien
gcaattgttccatcagagaatttgt

SEQ ID NO: 70493 - DNA, 25 bp, Homo sapien
gcaattgttccgtcagagaatttgt

SEQ ID NO: 70494 - DNA, 25 bp, Homo sapien
gcaatttactatcgcatgatagagc

SEQ ID NO: 70495 - DNA, 25 bp, Homo sapien
gcaatttactattgcatgatagagc

SEQ ID NO: 70496 - DNA, 25 bp, Homo sapien
gcaatttcactgcttagaacttaat

SEQ ID NO: 70497 - DNA, 25 bp, Homo sapien
gcaatttcacttcttagaacttaat

SEQ ID NO: 70498 - DNA, 25 bp, Homo sapien
gcaatttctggcaggcatccagccc

SEQ ID NO: 70499 - DNA, 25 bp, Homo sapien
gcaatttcttgcaggcatccagccc

SEQ ID NO: 70500 - DNA, 25 bp, Homo sapien
gcaatttgacaagagggtaaggtca

SEQ ID NO: 70501 - DNA, 25 bp, Homo sapien
gcaatttgacaggagggtaaggtca

SEQ ID NO: 70502 - DNA, 25 bp, Homo sapien
gcaatttgactgtaagctctttcaa

SEQ ID NO: 70503 - DNA, 25 bp, Homo sapien
gcaatttgatcatgaaatttttgcc

SEQ ID NO: 70504 - DNA, 25 bp, Homo sapien
gcaatttgattgtaagctctttcaa

SEQ ID NO: 70505 - DNA, 25 bp, Homo sapien
gcaatttggtcatgaaatttttgcc

SEQ ID NO: 70506 - DNA, 25 bp, Homo sapien
gcaattttattcactcatatcgaat

SEQ ID NO: 70507 - DNA, 25 bp, Homo sapien
gcaattttattcactcgtatcgaat

SEQ ID NO: 70508 - DNA, 25 bp, Homo sapien
gcaattttttgtaggtcaattatac

SEQ ID NO: 70509 - DNA, 25 bp, Homo sapien
gcaattttttgtatgtcaattatac

SEQ ID NO: 70510 - DNA, 25 bp, Homo sapien
gcacaaaaacaatcatcagcctgta

SEQ ID NO: 70511 - DNA, 25 bp, Homo sapien
gcacaaaacagatctagaataagtg

SEQ ID NO: 70512 - DNA, 25 bp, Homo sapien
gcacaaaaccatttctctgtcaagg

SEQ ID NO: 70513 - DNA, 25 bp, Homo sapien
gcacaaaaccatttctttgtcaagg

SEQ ID NO: 70514 - DNA, 25 bp, Homo sapien
gcacaaaactgatctagaataagtg

SEQ ID NO: 70515 - DNA, 25 bp, Homo sapien
gcacaaaagatattaccccagtgaa

SEQ ID NO: 70516 - DNA, 25 bp, Homo sapien
gcacaaaagatatttccccagtgaa

SEQ ID NO: 70517 - DNA, 25 bp, Homo sapien
gcacaaaagcaatcatcagcctgta

SEQ ID NO: 70518 - DNA, 25 bp, Homo sapien
gcacaaacatcccgaggggtgtctg

SEQ ID NO: 70519 - DNA, 25 bp, Homo sapien
gcacaaacatcgcgaggggtgtctg

SEQ ID NO: 70520 - DNA, 25 bp, Homo sapien
gcacaaagaaaactattcttggctg

SEQ ID NO: 70521 - DNA, 25 bp, Homo sapien
gcacaaagaaaagtattcttggctg

SEQ ID NO: 70522 - DNA, 25 bp, Homo sapien
gcacaaagacacggagaattccagg

SEQ ID NO: 70523 - DNA, 25 bp, Homo sapien
gcacaaagacatggagaattccagg

SEQ ID NO: 70524 - DNA, 25 bp, Homo sapien
gcacaaataccacatattacacttc

SEQ ID NO: 70525 - DNA, 25 bp, Homo sapien
gcacaaatcccacatattacacttc

SEQ ID NO: 70526 - DNA, 25 bp, Homo sapien
gcacaacacaggattagcacataaa

SEQ ID NO: 70527 - DNA, 25 bp, Homo sapien
gcacaacacagtattagcacataaa

SEQ ID NO: 70528 - DNA, 25 bp, Homo sapien
gcacaactgaaatattttacaactt

SEQ ID NO: 70529 - DNA, 25 bp, Homo sapien
gcacaactgaagtattttacaactt

SEQ ID NO: 70530 - DNA, 25 bp, Homo sapien
gcacaacttgaggactgtaagtaac

SEQ ID NO: 70531 - DNA, 25 bp, Homo sapien
gcacaacttgaggactttaagtaac

SEQ ID NO: 70532 - DNA, 25 bp, Homo sapien
gcacaagaacttaagcggttcaaaa

SEQ ID NO: 70533 - DNA, 25 bp, Homo sapien
gcacaagaacttaggcggttcaaaa

SEQ ID NO: 70534 - DNA, 25 bp, Homo sapien
gcacaagcacaagtcactgttgtaa

SEQ ID NO: 70535 - DNA, 25 bp, Homo sapien
gcacaagcacaattcactgttgtaa

SEQ ID NO: 70536 - DNA, 25 bp, Homo sapien
gcacaagggactatttcttcaatta

SEQ ID NO: 70537 - DNA, 25 bp, Homo sapien
gcacaagggactgtttcttcaatta

SEQ ID NO: 70538 - DNA, 25 bp, Homo sapien
gcacaagtaggacccagagacagag

SEQ ID NO: 70539 - DNA, 25 bp, Homo sapien
gcacaagtaggacctagagacagag

SEQ ID NO: 70540 - DNA, 25 bp, Homo sapien
gcacaataaataattgaattatcct

SEQ ID NO: 70541 - DNA, 25 bp, Homo sapien
gcacaataagtaattgaattatcct

SEQ ID NO: 70542 - DNA, 25 bp, Homo sapien
gcacaataccatatgttagctctta

SEQ ID NO: 70543 - DNA, 25 bp, Homo sapien
gcacaataccgacttataaaaagca

SEQ ID NO: 70544 - DNA, 25 bp, Homo sapien
gcacaatactgacttataaaaagca

SEQ ID NO: 70545 - DNA, 25 bp, Homo sapien
gcacaatatcatatgttagctctta

SEQ ID NO: 70546 - DNA, 25 bp, Homo sapien
gcacaatgcctaacgcagagtaaac

SEQ ID NO: 70547 - DNA, 25 bp, Homo sapien
gcacaatgcctaatgcagagtaaac

SEQ ID NO: 70548 - DNA, 25 bp, Homo sapien
gcacaatgtaacgcacattttaata

SEQ ID NO: 70549 - DNA, 25 bp, Homo sapien
gcacaatgttacgcacattttaata

SEQ ID NO: 70550 - DNA, 25 bp, Homo sapien
gcacacaaaaacattaagaaagcta

SEQ ID NO: 70551 - DNA, 25 bp, Homo sapien
gcacacaactctaaaattttactat

SEQ ID NO: 70552 - DNA, 25 bp, Homo sapien
gcacacaagaacattaagaaagcta

SEQ ID NO: 70553 - DNA, 25 bp, Homo sapien
gcacacaagtctaaaattttactat

SEQ ID NO: 70554 - DNA, 25 bp, Homo sapien
gcacacatcatgaatgactcaaaag

SEQ ID NO: 70555 - DNA, 25 bp, Homo sapien
gcacacatcgtgaatgactcaaaag

SEQ ID NO: 70556 - DNA, 25 bp, Homo sapien
gcacaccaatgtgaggtcatgttgt

SEQ ID NO: 70557 - DNA, 25 bp, Homo sapien
gcacaccagtgtgaggtcatgttgt

SEQ ID NO: 70558 - DNA, 25 bp, Homo sapien
gcacaccatcctaaattttttttca

SEQ ID NO: 70559 - DNA, 25 bp, Homo sapien
gcacaccatcctagattttttttca

SEQ ID NO: 70560 - DNA, 25 bp, Homo sapien
gcacacggcatcacacccagtcctc

SEQ ID NO: 70561 - DNA, 25 bp, Homo sapien
gcacacggcatcgcacccagtcctc

SEQ ID NO: 70562 - DNA, 25 bp, Homo sapien
gcacacgggaaggtcaaagttctag

SEQ ID NO: 70563 - DNA, 25 bp, Homo sapien
gcacacgggaaggtcagagttctag

SEQ ID NO: 70564 - DNA, 25 bp, Homo sapien
gcacactaaacataagcaatagtaa

SEQ ID NO: 70565 - DNA, 25 bp, Homo sapien
gcacactaaacgtaagcaatagtaa

SEQ ID NO: 70566 - DNA, 25 bp, Homo sapien
gcacactagctacagcagagacctt

SEQ ID NO: 70567 - DNA, 25 bp, Homo sapien
gcacactaggtacagcagagacctt

SEQ ID NO: 70568 - DNA, 25 bp, Homo sapien
gcacactgcagtaccctgtaaatat

SEQ ID NO: 70569 - DNA, 25 bp, Homo sapien
gcacactgcggtaccctgtaaatat

SEQ ID NO: 70570 - DNA, 25 bp, Homo sapien
gcacactgtctcattgttccacatc

SEQ ID NO: 70571 - DNA, 25 bp, Homo sapien
gcacactgtttcattgttccacatc

SEQ ID NO: 70572 - DNA, 25 bp, Homo sapien
gcacacttaagtacaccattgacgc

SEQ ID NO: 70573 - DNA, 25 bp, Homo sapien
gcacacttaagtataccattgacgc

SEQ ID NO: 70574 - DNA, 25 bp, Homo sapien
gcacacttgaataattagtgtttcc

SEQ ID NO: 70575 - DNA, 25 bp, Homo sapien
gcacacttggataattagtgtttcc

SEQ ID NO: 70576 - DNA, 25 bp, Homo sapien
gcacagaaaaaactaccatttataa

SEQ ID NO: 70577 - DNA, 25 bp, Homo sapien
gcacagaaaaaattaccatttataa

SEQ ID NO: 70578 - DNA, 25 bp, Homo sapien
gcacagaagaagagagaagtcaggg

SEQ ID NO: 70579 - DNA, 25 bp, Homo sapien
gcacagaagaagagggaagtcaggg

SEQ ID NO: 70580 - DNA, 25 bp, Homo sapien
gcacagaatgacatggataaatctc

SEQ ID NO: 70581 - DNA, 25 bp, Homo sapien
gcacagaatgacatggttaaatctc

SEQ ID NO: 70582 - DNA, 25 bp, Homo sapien
gcacagactgtgacgactacaataa

SEQ ID NO: 70583 - DNA, 25 bp, Homo sapien
gcacagactgtgatgactacaataa

SEQ ID NO: 70584 - DNA, 25 bp, Homo sapien
gcacagagaaataagaaccaggatg

SEQ ID NO: 70585 - DNA, 25 bp, Homo sapien
gcacagagaaataggaaccaggatg

SEQ ID NO: 70586 - DNA, 25 bp, Homo sapien
gcacagagcatgtccagggagggct

SEQ ID NO: 70587 - DNA, 25 bp, Homo sapien
gcacagagtatgtccagggagggct

SEQ ID NO: 70588 - DNA, 25 bp, Homo sapien
gcacagatacgaaggcttactattt

SEQ ID NO: 70589 - DNA, 25 bp, Homo sapien
gcacagatatgaaggcttactattt

SEQ ID NO: 70590 - DNA, 25 bp, Homo sapien
gcacagatgctatatctctagtttt

SEQ ID NO: 70591 - DNA, 25 bp, Homo sapien
gcacagatgttatatctctagtttt

SEQ ID NO: 70592 - DNA, 25 bp, Homo sapien
gcacaggacaaactcaatcatgtcc

SEQ ID NO: 70593 - DNA, 25 bp, Homo sapien
gcacaggacaagctcaatcatgtcc

SEQ ID NO: 70594 - DNA, 25 bp, Homo sapien
gcacaggagtatgtagaattgaatt

SEQ ID NO: 70595 - DNA, 25 bp, Homo sapien
gcacaggagtatgtggaattgaatt

SEQ ID NO: 70596 - DNA, 25 bp, Homo sapien
gcacaggggaaagccactccaggtc

SEQ ID NO: 70597 - DNA, 25 bp, Homo sapien
gcacaggggaaggccactccaggtc

SEQ ID NO: 70598 - DNA, 25 bp, Homo sapien
gcacagtcacactgctgtacttaaa

SEQ ID NO: 70599 - DNA, 25 bp, Homo sapien
gcacagtcacattgctgtacttaaa

SEQ ID NO: 70600 - DNA, 25 bp, Homo sapien
gcacagtgcatttgagtaactgaaa

SEQ ID NO: 70601 - DNA, 25 bp, Homo sapien
gcacagtgcctttgagtaactgaaa

SEQ ID NO: 70602 - DNA, 25 bp, Homo sapien
gcacagttaattccagggctgcctg

SEQ ID NO: 70603 - DNA, 25 bp, Homo sapien
gcacagttaattctagggctgcctg

SEQ ID NO: 70604 - DNA, 25 bp, Homo sapien
gcacagttcgaggctcaaaaagaga

SEQ ID NO: 70605 - DNA, 25 bp, Homo sapien
gcacagttgtacatgattttgatca

SEQ ID NO: 70606 - DNA, 25 bp, Homo sapien
gcacagttgtacgtgattttgatca

SEQ ID NO: 70607 - DNA, 25 bp, Homo sapien
gcacagtttgaggctcaaaaagaga

SEQ ID NO: 70608 - DNA, 25 bp, Homo sapien
gcacataaaaaaaattcaacaccac

SEQ ID NO: 70609 - DNA, 25 bp, Homo sapien
gcacataaaaaacattcaacaccac

SEQ ID NO: 70610 - DNA, 25 bp, Homo sapien
gcacatcaacctagtaagaatctta

SEQ ID NO: 70611 - DNA, 25 bp, Homo sapien
gcacatcagcctagtaagaatctta

SEQ ID NO: 70612 - DNA, 25 bp, Homo sapien
gcacatcatcaactgtgtaatagtt

SEQ ID NO: 70613 - DNA, 25 bp, Homo sapien
gcacatcatcacctgtgtaatagtt

SEQ ID NO: 70614 - DNA, 25 bp, Homo sapien
gcacatctgaaatttacataagaaa

SEQ ID NO: 70615 - DNA, 25 bp, Homo sapien
gcacatctgaactttacataagaaa

SEQ ID NO: 70616 - DNA, 25 bp, Homo sapien
gcacatgagttgcctactgacatgt

SEQ ID NO: 70617 - DNA, 25 bp, Homo sapien
gcacatgagttgtctactgacatgt

SEQ ID NO: 70618 - DNA, 25 bp, Homo sapien
gcacatgcatgccctgaatctaaaa

SEQ ID NO: 70619 - DNA, 25 bp, Homo sapien
gcacatgcatgccctgcatctaaaa

SEQ ID NO: 70620 - DNA, 25 bp, Homo sapien
gcacatgcattaaaaaaaagaatga

SEQ ID NO: 70621 - DNA, 25 bp, Homo sapien
gcacatgccaccatatctggctaat

SEQ ID NO: 70622 - DNA, 25 bp, Homo sapien
gcacatgccaccatttctggctaat

SEQ ID NO: 70623 - DNA, 25 bp, Homo sapien
gcacatgcgttaaaaaaaagaatga

SEQ ID NO: 70624 - DNA, 25 bp, Homo sapien
gcacatggaaaattagggagaaagg

SEQ ID NO: 70625 - DNA, 25 bp, Homo sapien
gcacatggagaattagggagaaagg

SEQ ID NO: 70626 - DNA, 25 bp, Homo sapien
gcacatggcccaccttgcactgccc

SEQ ID NO: 70627 - DNA, 25 bp, Homo sapien
gcacatggcccagcttgcactgccc

SEQ ID NO: 70628 - DNA, 25 bp, Homo sapien
gcacatggcggtgatcaagccagac

SEQ ID NO: 70629 - DNA, 25 bp, Homo sapien
gcacatggctggggacctgaggcag

SEQ ID NO: 70630 - DNA, 25 bp, Homo sapien
gcacatggggtttaataaggtttca

SEQ ID NO: 70631 - DNA, 25 bp, Homo sapien
gcacatggggtttgataaggtttca

SEQ ID NO: 70632 - DNA, 25 bp, Homo sapien
gcacatggtggtgatcaagccagac

SEQ ID NO: 70633 - DNA, 25 bp, Homo sapien
gcacatggttggggacctgaggcag

SEQ ID NO: 70634 - DNA, 25 bp, Homo sapien
gcacatgtagaggcctactcctcac

SEQ ID NO: 70635 - DNA, 25 bp, Homo sapien
gcacatgtagaggccttctcctcac

SEQ ID NO: 70636 - DNA, 25 bp, Homo sapien
gcacatgtgtcctgaagaaatgacg

SEQ ID NO: 70637 - DNA, 25 bp, Homo sapien
gcacatgtgtcctgcagaaatgacg

SEQ ID NO: 70638 - DNA, 25 bp, Homo sapien
gcacattcagcctggcctatcttat

SEQ ID NO: 70639 - DNA, 25 bp, Homo sapien
gcacattcagccttgcctatcttat

SEQ ID NO: 70640 - DNA, 25 bp, Homo sapien
gcacattctcagcgtttaatgccta

SEQ ID NO: 70641 - DNA, 25 bp, Homo sapien
gcacattctcagtgtttaatgccta

SEQ ID NO: 70642 - DNA, 25 bp, Homo sapien
gcacattgtattcaccttgggagct

SEQ ID NO: 70643 - DNA, 25 bp, Homo sapien
gcacattgtattgaccttgggagct

SEQ ID NO: 70644 - DNA, 25 bp, Homo sapien
gcacattgtgaatcctccataaatg

SEQ ID NO: 70645 - DNA, 25 bp, Homo sapien
gcacattgtgagtcctccataaatg

SEQ ID NO: 70646 - DNA, 25 bp, Homo sapien
gcacatttcactttttagaatcgta

SEQ ID NO: 70647 - DNA, 25 bp, Homo sapien
gcacatttcattgcaagactgggca

SEQ ID NO: 70648 - DNA, 25 bp, Homo sapien
gcacatttgcccgcaccttccatgc

SEQ ID NO: 70649 - DNA, 25 bp, Homo sapien
gcacatttgcctgcaccttccatgc

SEQ ID NO: 70650 - DNA, 25 bp, Homo sapien
gcacattttaataagttgcatattt

SEQ ID NO: 70651 - DNA, 25 bp, Homo sapien
gcacattttaatgagttgcatattt

SEQ ID NO: 70652 - DNA, 25 bp, Homo sapien
gcacattttactttttagaatcgta

SEQ ID NO: 70653 - DNA, 25 bp, Homo sapien
gcacattttattgcaagactgggca

SEQ ID NO: 70654 - DNA, 25 bp, Homo sapien
gcaccaagcacctctatgaatggag

SEQ ID NO: 70655 - DNA, 25 bp, Homo sapien
gcaccaagcgcctctatgaatggag

SEQ ID NO: 70656 - DNA, 25 bp, Homo sapien
gcaccaaggtcaaagtatgtctcct

SEQ ID NO: 70657 - DNA, 25 bp, Homo sapien
gcaccaaggtcaaagtttgtctcct

SEQ ID NO: 70658 - DNA, 25 bp, Homo sapien
gcaccaatcagatcatgtatgtgtt

SEQ ID NO: 70659 - DNA, 25 bp, Homo sapien
gcaccaatcagattatgtatgtgtt

SEQ ID NO: 70660 - DNA, 25 bp, Homo sapien
gcaccacatacagaaaccaatccaa

SEQ ID NO: 70661 - DNA, 25 bp, Homo sapien
gcaccacatacagaaatcaatccaa

SEQ ID NO: 70662 - DNA, 25 bp, Homo sapien
gcaccacatgagctctggcggaata

SEQ ID NO: 70663 - DNA, 25 bp, Homo sapien
gcaccacatgaggtctggcggaata

SEQ ID NO: 70664 - DNA, 25 bp, Homo sapien
gcaccacccagtaccgactgatgaa

SEQ ID NO: 70665 - DNA, 25 bp, Homo sapien
gcaccacccagtaccggctgatgaa

SEQ ID NO: 70666 - DNA, 25 bp, Homo sapien
gcaccagcaggtccatttggatctg

SEQ ID NO: 70667 - DNA, 25 bp, Homo sapien
gcaccagcaggtccctttggatctg

SEQ ID NO: 70668 - DNA, 25 bp, Homo sapien
gcaccagggcttcaatgaaacggaa

SEQ ID NO: 70669 - DNA, 25 bp, Homo sapien
gcaccaggtcttcaatgaaacggaa

SEQ ID NO: 70670 - DNA, 25 bp, Homo sapien
gcaccatataaaacagaaactgttg

SEQ ID NO: 70671 - DNA, 25 bp, Homo sapien
gcaccatataaaacaggaactgttg

SEQ ID NO: 70672 - DNA, 25 bp, Homo sapien
gcaccatcaaggattttaggacagg

SEQ ID NO: 70673 - DNA, 25 bp, Homo sapien
gcaccatccgtgatgccatgtagat

SEQ ID NO: 70674 - DNA, 25 bp, Homo sapien
gcaccatcgaggattttaggacagg

SEQ ID NO: 70675 - DNA, 25 bp, Homo sapien
gcaccatctcggttagctgtgggac

SEQ ID NO: 70676 - DNA, 25 bp, Homo sapien
gcaccatctgtgatgccatgtagat

SEQ ID NO: 70677 - DNA, 25 bp, Homo sapien
gcaccatcttggttagctgtgggac

SEQ ID NO: 70678 - DNA, 25 bp, Homo sapien
gcaccattccatagaacaatagtaa

SEQ ID NO: 70679 - DNA, 25 bp, Homo sapien
gcaccattcgatagaacaatagtaa

SEQ ID NO: 70680 - DNA, 25 bp, Homo sapien
gcacccaaatacgcagtttcctgta

SEQ ID NO: 70681 - DNA, 25 bp, Homo sapien
gcacccaaatatgcagtttcctgta

SEQ ID NO: 70682 - DNA, 25 bp, Homo sapien
gcacccaggcttcttctgtttcaca

SEQ ID NO: 70683 - DNA, 25 bp, Homo sapien
gcacccaggtttcttctgtttcaca

SEQ ID NO: 70684 - DNA, 25 bp, Homo sapien
gcacccattgcctccttactcaagc

SEQ ID NO: 70685 - DNA, 25 bp, Homo sapien
gcacccatttcctccttactcaagc

SEQ ID NO: 70686 - DNA, 25 bp, Homo sapien
gcaccccgagtcctgccattactac

SEQ ID NO: 70687 - DNA, 25 bp, Homo sapien
gcaccccgagtcttgccattactac

SEQ ID NO: 70688 - DNA, 25 bp, Homo sapien
gcacccgaatttcacatcccaggaa

SEQ ID NO: 70689 - DNA, 25 bp, Homo sapien
gcacccgaatttcatatcccaggaa

SEQ ID NO: 70690 - DNA, 25 bp, Homo sapien
gcaccctataccaaagctctctccc

SEQ ID NO: 70691 - DNA, 25 bp, Homo sapien
gcaccctattccaaagctctctccc

SEQ ID NO: 70692 - DNA, 25 bp, Homo sapien
gcaccctggagtacttcaacattta

SEQ ID NO: 70693 - DNA, 25 bp, Homo sapien
gcaccctggagtgcttcaacattta

SEQ ID NO: 70694 - DNA, 25 bp, Homo sapien
gcaccgtaacttggggtattggttt

SEQ ID NO: 70695 - DNA, 25 bp, Homo sapien
gcaccgtatcttggggtattggttt

SEQ ID NO: 70696 - DNA, 25 bp, Homo sapien
gcacctaaaacatcaatttctctgt

SEQ ID NO: 70697 - DNA, 25 bp, Homo sapien
gcacctaatacatcaatttctctgt

SEQ ID NO: 70698 - DNA, 25 bp, Homo sapien
gcacctatatttcgaaggtgacaca

SEQ ID NO: 70699 - DNA, 25 bp, Homo sapien
gcacctatattttgaaggtgacaca

SEQ ID NO: 70700 - DNA, 25 bp, Homo sapien
gcacctctacactatagcctgggtg

SEQ ID NO: 70701 - DNA, 25 bp, Homo sapien
gcacctctgcactatagcctgggtg

SEQ ID NO: 70702 - DNA, 25 bp, Homo sapien
gcacctcttcaccttccacaaatta

SEQ ID NO: 70703 - DNA, 25 bp, Homo sapien
gcacctcttgaccttccacaaatta

SEQ ID NO: 70704 - DNA, 25 bp, Homo sapien
gcacctgaagaactgtttcaccttc

SEQ ID NO: 70705 - DNA, 25 bp, Homo sapien
gcacctgaagaactttttcaccttc

SEQ ID NO: 70706 - DNA, 25 bp, Homo sapien
gcacctgaatccacaagatgaggag

SEQ ID NO: 70707 - DNA, 25 bp, Homo sapien
gcacctgattccacaagatgaggag

SEQ ID NO: 70708 - DNA, 25 bp, Homo sapien
gcacctgcacctctccggcaccacc

SEQ ID NO: 70709 - DNA, 25 bp, Homo sapien
gcacctgcacctctcctgcaccacc

SEQ ID NO: 70710 - DNA, 25 bp, Homo sapien
gcaccttctaccttaaactctctct

SEQ ID NO: 70711 - DNA, 25 bp, Homo sapien
gcaccttctaccttcaactctctct

SEQ ID NO: 70712 - DNA, 25 bp, Homo sapien
gcacctttcaactatgatattgcct

SEQ ID NO: 70713 - DNA, 25 bp, Homo sapien
gcacctttcaactctgatattgcct

SEQ ID NO: 70714 - DNA, 25 bp, Homo sapien
gcacctttccgtgaactctagggga

SEQ ID NO: 70715 - DNA, 25 bp, Homo sapien
gcacctttccgtggactctagggga

SEQ ID NO: 70716 - DNA, 25 bp, Homo sapien
gcacgagagagaatcgccttgtctg

SEQ ID NO: 70717 - DNA, 25 bp, Homo sapien
gcacgagagagattcgccttgtctg

SEQ ID NO: 70718 - DNA, 25 bp, Homo sapien
gcacgatgaccaccttcttacagat

SEQ ID NO: 70719 - DNA, 25 bp, Homo sapien
gcacgatgatcaccttcttacagat

SEQ ID NO: 70720 - DNA, 25 bp, Homo sapien
gcacgcagagattaagaagtgactg

SEQ ID NO: 70721 - DNA, 25 bp, Homo sapien
gcacgcagagattaggaagtgactg

SEQ ID NO: 70722 - DNA, 25 bp, Homo sapien
gcacgcagttttagaaccctcaaga

SEQ ID NO: 70723 - DNA, 25 bp, Homo sapien
gcacgcagttttagaagcctcaaga

SEQ ID NO: 70724 - DNA, 25 bp, Homo sapien
gcacgcatatgcggtagttctagct

SEQ ID NO: 70725 - DNA, 25 bp, Homo sapien
gcacgcatgtgcggtagttctagct

SEQ ID NO: 70726 - DNA, 25 bp, Homo sapien
gcacgctggcaaatacttggatggg

SEQ ID NO: 70727 - DNA, 25 bp, Homo sapien
gcacgctggcatatacttggatggg

SEQ ID NO: 70728 - DNA, 25 bp, Homo sapien
gcacgggcaatggaatgagaccccc

SEQ ID NO: 70729 - DNA, 25 bp, Homo sapien
gcacgggcaatggagtgagaccccc

SEQ ID NO: 70730 - DNA, 25 bp, Homo sapien
gcacgggttgaccctacagaaaaga

SEQ ID NO: 70731 - DNA, 25 bp, Homo sapien
gcacgggttgaccttacagaaaaga

SEQ ID NO: 70732 - DNA, 25 bp, Homo sapien
gcacgtattctcctgcaacaactgg

SEQ ID NO: 70733 - DNA, 25 bp, Homo sapien
gcacgtattctcttgcaacaactgg

SEQ ID NO: 70734 - DNA, 25 bp, Homo sapien
gcacgtcgtaaccccgtctggacgt

SEQ ID NO: 70735 - DNA, 25 bp, Homo sapien
gcacgtcgtaaccctgtctggacgt

SEQ ID NO: 70736 - DNA, 25 bp, Homo sapien
gcacgttaaagaaagaaagatggct

SEQ ID NO: 70737 - DNA, 25 bp, Homo sapien
gcacgttaaagagagaaagatggct

SEQ ID NO: 70738 - DNA, 25 bp, Homo sapien
gcacgttacattataaccactcaga

SEQ ID NO: 70739 - DNA, 25 bp, Homo sapien
gcacgttacgttataaccactcaga

SEQ ID NO: 70740 - DNA, 25 bp, Homo sapien
gcactaaaggaatttactctcttcc

SEQ ID NO: 70741 - DNA, 25 bp, Homo sapien
gcactaaaggagtttactctcttcc

SEQ ID NO: 70742 - DNA, 25 bp, Homo sapien
gcactaacaccacataccagccctt

SEQ ID NO: 70743 - DNA, 25 bp, Homo sapien
gcactaacactaccacctcagtaaa

SEQ ID NO: 70744 - DNA, 25 bp, Homo sapien
gcactaacactaccgcctcagtaaa

SEQ ID NO: 70745 - DNA, 25 bp, Homo sapien
gcactaaccatcttgacttgagttc

SEQ ID NO: 70746 - DNA, 25 bp, Homo sapien
gcactaaccgtcttgacttgagttc

SEQ ID NO: 70747 - DNA, 25 bp, Homo sapien
gcactaacgccacataccagccctt

SEQ ID NO: 70748 - DNA, 25 bp, Homo sapien
gcactaagtgagctcttaggatgtc

SEQ ID NO: 70749 - DNA, 25 bp, Homo sapien
gcactaagtgagcttttaggatgtc

SEQ ID NO: 70750 - DNA, 25 bp, Homo sapien
gcactagaccaactgtaagagtgag

SEQ ID NO: 70751 - DNA, 25 bp, Homo sapien
gcactagactaactgtaagagtgag

SEQ ID NO: 70752 - DNA, 25 bp, Homo sapien
gcactaggaaaagtccaagtttgtg

SEQ ID NO: 70753 - DNA, 25 bp, Homo sapien
gcactaggatgcaagttgcaggaca

SEQ ID NO: 70754 - DNA, 25 bp, Homo sapien
gcactaggatgtaagttgcaggaca

SEQ ID NO: 70755 - DNA, 25 bp, Homo sapien
gcactaggcaaagtccaagtttgtg

SEQ ID NO: 70756 - DNA, 25 bp, Homo sapien
gcactaggcttgctgctgctgcgtg

SEQ ID NO: 70757 - DNA, 25 bp, Homo sapien
gcactaggcttgttgctgctgcgtg

SEQ ID NO: 70758 - DNA, 25 bp, Homo sapien
gcactatgtgttaattgcttagtac

SEQ ID NO: 70759 - DNA, 25 bp, Homo sapien
gcactatgtgtttattgcttagtac

SEQ ID NO: 70760 - DNA, 25 bp, Homo sapien
gcactatttcagttttctccttctg

SEQ ID NO: 70761 - DNA, 25 bp, Homo sapien
gcactatttcagttttgtccttctg

SEQ ID NO: 70762 - DNA, 25 bp, Homo sapien
gcactcacaaaggacgtgtctctca

SEQ ID NO: 70763 - DNA, 25 bp, Homo sapien
gcactcacaaaggatgtgtctctca

SEQ ID NO: 70764 - DNA, 25 bp, Homo sapien
gcactcactataatttctgatattg

SEQ ID NO: 70765 - DNA, 25 bp, Homo sapien
gcactcactgtaatttctgatattg

SEQ ID NO: 70766 - DNA, 25 bp, Homo sapien
gcactcagtctggtgggtattactg

SEQ ID NO: 70767 - DNA, 25 bp, Homo sapien
gcactcagtgtggtgggtattactg

SEQ ID NO: 70768 - DNA, 25 bp, Homo sapien
gcactcattaatagagtctgcactc

SEQ ID NO: 70769 - DNA, 25 bp, Homo sapien
gcactcatttatagagtctgcactc

SEQ ID NO: 70770 - DNA, 25 bp, Homo sapien
gcactccaacaaacagagccagact

SEQ ID NO: 70771 - DNA, 25 bp, Homo sapien
gcactccagtccccaaagattgatc

SEQ ID NO: 70772 - DNA, 25 bp, Homo sapien
gcactccagtccgcaaagattgatc

SEQ ID NO: 70773 - DNA, 25 bp, Homo sapien
gcactccatcaaacagagccagact

SEQ ID NO: 70774 - DNA, 25 bp, Homo sapien
gcactcctcattgacattattaatt

SEQ ID NO: 70775 - DNA, 25 bp, Homo sapien
gcactcctcattggcattattaatt

SEQ ID NO: 70776 - DNA, 25 bp, Homo sapien
gcactctaatcatgagaataattgt

SEQ ID NO: 70777 - DNA, 25 bp, Homo sapien
gcactctaatcatgggaataattgt

SEQ ID NO: 70778 - DNA, 25 bp, Homo sapien
gcactctcaaaatgagtgtaggcca

SEQ ID NO: 70779 - DNA, 25 bp, Homo sapien
gcactctcgaaatgagtgtaggcca

SEQ ID NO: 70780 - DNA, 25 bp, Homo sapien
gcactctctatgaacattctctcct

SEQ ID NO: 70781 - DNA, 25 bp, Homo sapien
gcactctctgtgaacattctctcct

SEQ ID NO: 70782 - DNA, 25 bp, Homo sapien
gcactctgaagacgtaattgtatca

SEQ ID NO: 70783 - DNA, 25 bp, Homo sapien
gcactctgaagatgtaattgtatca

SEQ ID NO: 70784 - DNA, 25 bp, Homo sapien
gcactgaaaacctaaatttcctgcc

SEQ ID NO: 70785 - DNA, 25 bp, Homo sapien
gcactgaaatacagatcactgaaat

SEQ ID NO: 70786 - DNA, 25 bp, Homo sapien
gcactgaagtacagatcactgaaat

SEQ ID NO: 70787 - DNA, 25 bp, Homo sapien
gcactgaatacctaaatttcctgcc

SEQ ID NO: 70788 - DNA, 25 bp, Homo sapien
gcactgaatactatctgcgaaatcc

SEQ ID NO: 70789 - DNA, 25 bp, Homo sapien
gcactgaatcctatctgcgaaatcc

SEQ ID NO: 70790 - DNA, 25 bp, Homo sapien
gcactgagttattcttgagaatcct

SEQ ID NO: 70791 - DNA, 25 bp, Homo sapien
gcactgagttatttttgagaatcct

SEQ ID NO: 70792 - DNA, 25 bp, Homo sapien
gcactgattcctaacagggttattt

SEQ ID NO: 70793 - DNA, 25 bp, Homo sapien
gcactgattcctagcagggttattt

SEQ ID NO: 70794 - DNA, 25 bp, Homo sapien
gcactgattgcatgagcagatccac

SEQ ID NO: 70795 - DNA, 25 bp, Homo sapien
gcactgattgcatgaggagatccac

SEQ ID NO: 70796 - DNA, 25 bp, Homo sapien
gcactgcaaacatacttcttccaga

SEQ ID NO: 70797 - DNA, 25 bp, Homo sapien
gcactgcaaccatacttcttccaga

SEQ ID NO: 70798 - DNA, 25 bp, Homo sapien
gcactgcactagacatttttttctg

SEQ ID NO: 70799 - DNA, 25 bp, Homo sapien
gcactgcactatacatttttttctg

SEQ ID NO: 70800 - DNA, 25 bp, Homo sapien
gcactgcctagctaacacaggaaat

SEQ ID NO: 70801 - DNA, 25 bp, Homo sapien
gcactgcctagctgacacaggaaat

SEQ ID NO: 70802 - DNA, 25 bp, Homo sapien
gcactgctgctttcctatgattggt

SEQ ID NO: 70803 - DNA, 25 bp, Homo sapien
gcactgctgttttcctatgattggt

SEQ ID NO: 70804 - DNA, 25 bp, Homo sapien
gcactggaatcagatgttcccaacc

SEQ ID NO: 70805 - DNA, 25 bp, Homo sapien
gcactggaatcaggtgttcccaacc

SEQ ID NO: 70806 - DNA, 25 bp, Homo sapien
gcactggcatctcattttggctctg

SEQ ID NO: 70807 - DNA, 25 bp, Homo sapien
gcactggcttctcattttggctctg

SEQ ID NO: 70808 - DNA, 25 bp, Homo sapien
gcactgtgacattgagtaacaattt

SEQ ID NO: 70809 - DNA, 25 bp, Homo sapien
gcactgtgatattgagtaacaattt

SEQ ID NO: 70810 - DNA, 25 bp, Homo sapien
gcactgtgcggaaggctggctgaaa

SEQ ID NO: 70811 - DNA, 25 bp, Homo sapien
gcactgtgctctcaatttcaataca

SEQ ID NO: 70812 - DNA, 25 bp, Homo sapien
gcactgtgctctcgatttcaataca

SEQ ID NO: 70813 - DNA, 25 bp, Homo sapien
gcactgtgtggaaggctggctgaaa

SEQ ID NO: 70814 - DNA, 25 bp, Homo sapien
gcacttaagccttctatatataatc

SEQ ID NO: 70815 - DNA, 25 bp, Homo sapien
gcacttaaggcttctatatataatc

SEQ ID NO: 70816 - DNA, 25 bp, Homo sapien
gcacttacaaactgcatctcaattt

SEQ ID NO: 70817 - DNA, 25 bp, Homo sapien
gcacttacaaactgtatctcaattt

SEQ ID NO: 70818 - DNA, 25 bp, Homo sapien
gcacttacactctctcacatattca

SEQ ID NO: 70819 - DNA, 25 bp, Homo sapien
gcacttacactctttcacatattca

SEQ ID NO: 70820 - DNA, 25 bp, Homo sapien
gcacttagcatcacactctgcatgc

SEQ ID NO: 70821 - DNA, 25 bp, Homo sapien
gcacttagcatcacgctctgcatgc

SEQ ID NO: 70822 - DNA, 25 bp, Homo sapien
gcacttagcgaatggagagaaaatc

SEQ ID NO: 70823 - DNA, 25 bp, Homo sapien
gcacttagctacacattaagggctc

SEQ ID NO: 70824 - DNA, 25 bp, Homo sapien
gcacttagggtagcacatggcacac

SEQ ID NO: 70825 - DNA, 25 bp, Homo sapien
gcacttagggtagcacgtggcacac

SEQ ID NO: 70826 - DNA, 25 bp, Homo sapien
gcacttagtgaatggagagaaaatc

SEQ ID NO: 70827 - DNA, 25 bp, Homo sapien
gcacttagttacacattaagggctc

SEQ ID NO: 70828 - DNA, 25 bp, Homo sapien
gcacttatcatgagatctatagtct

SEQ ID NO: 70829 - DNA, 25 bp, Homo sapien
gcacttatgatgagatctatagtct

SEQ ID NO: 70830 - DNA, 25 bp, Homo sapien
gcacttgaaataaggatctactgtg

SEQ ID NO: 70831 - DNA, 25 bp, Homo sapien
gcacttgaagtaaggatctactgtg

SEQ ID NO: 70832 - DNA, 25 bp, Homo sapien
gcacttgagacactcgagattcggg

SEQ ID NO: 70833 - DNA, 25 bp, Homo sapien
gcacttgagacactcgggattcggg

SEQ ID NO: 70834 - DNA, 25 bp, Homo sapien
gcacttgagtagtcactggtaaaga

SEQ ID NO: 70835 - DNA, 25 bp, Homo sapien
gcacttgagtagtgactggtaaaga

SEQ ID NO: 70836 - DNA, 25 bp, Homo sapien
gcacttgagtgaacgggtgaaaaac

SEQ ID NO: 70837 - DNA, 25 bp, Homo sapien
gcacttgagtgaatgggtgaaaaac

SEQ ID NO: 70838 - DNA, 25 bp, Homo sapien
gcacttgcatgagggacttggagcc

SEQ ID NO: 70839 - DNA, 25 bp, Homo sapien
gcacttgcttgagggacttggagcc

SEQ ID NO: 70840 - DNA, 25 bp, Homo sapien
gcacttgttatagaataataaacga

SEQ ID NO: 70841 - DNA, 25 bp, Homo sapien
gcacttgttatataataataaacga

SEQ ID NO: 70842 - DNA, 25 bp, Homo sapien
gcactttcacctgggttatctcatt

SEQ ID NO: 70843 - DNA, 25 bp, Homo sapien
gcactttcacctgtgttatctcatt

SEQ ID NO: 70844 - DNA, 25 bp, Homo sapien
gcactttccacagatttttgctcat

SEQ ID NO: 70845 - DNA, 25 bp, Homo sapien
gcactttccacagctttttgctcat

SEQ ID NO: 70846 - DNA, 25 bp, Homo sapien
gcactttccttaataaaaatgtaca

SEQ ID NO: 70847 - DNA, 25 bp, Homo sapien
gcactttcgttaataaaaatgtaca

SEQ ID NO: 70848 - DNA, 25 bp, Homo sapien
gcacttttagacccaacactcaggg

SEQ ID NO: 70849 - DNA, 25 bp, Homo sapien
gcacttttagatccaacactcaggg

SEQ ID NO: 70850 - DNA, 25 bp, Homo sapien
gcactttttctcaacgtatcaataa

SEQ ID NO: 70851 - DNA, 25 bp, Homo sapien
gcactttttctcaatgtatcaataa

SEQ ID NO: 70852 - DNA, 25 bp, Homo sapien
gcagaaaaaacaaagctggaaaaca

SEQ ID NO: 70853 - DNA, 25 bp, Homo sapien
gcagaaaaagcaaagctggaaaaca

SEQ ID NO: 70854 - DNA, 25 bp, Homo sapien
gcagaaaacagatatcagccttggg

SEQ ID NO: 70855 - DNA, 25 bp, Homo sapien
gcagaaaacaggtatcagccttggg

SEQ ID NO: 70856 - DNA, 25 bp, Homo sapien
gcagaaaagaatctgaagctaggta

SEQ ID NO: 70857 - DNA, 25 bp, Homo sapien
gcagaaaagaatctgacgctaggta

SEQ ID NO: 70858 - DNA, 25 bp, Homo sapien
gcagaaaagacttgataaaattcaa

SEQ ID NO: 70859 - DNA, 25 bp, Homo sapien
gcagaaaagtcttgataaaattcaa

SEQ ID NO: 70860 - DNA, 25 bp, Homo sapien
gcagaaaatcgtaagtagctgaatt

SEQ ID NO: 70861 - DNA, 25 bp, Homo sapien
gcagaaaattgtaagtagctgaatt

SEQ ID NO: 70862 - DNA, 25 bp, Homo sapien
gcagaaacatacatccatcatgcta

SEQ ID NO: 70863 - DNA, 25 bp, Homo sapien
gcagaaacatacatccgtcatgcta

SEQ ID NO: 70864 - DNA, 25 bp, Homo sapien
gcagaaacggacccagcagagcagg

SEQ ID NO: 70865 - DNA, 25 bp, Homo sapien
gcagaaacggactcagcagagcagg

SEQ ID NO: 70866 - DNA, 25 bp, Homo sapien
gcagaaagttctcagtagattggtc

SEQ ID NO: 70867 - DNA, 25 bp, Homo sapien
gcagaaagttctcggtagattggtc

SEQ ID NO: 70868 - DNA, 25 bp, Homo sapien
gcagaacatactccttataaatgct

SEQ ID NO: 70869 - DNA, 25 bp, Homo sapien
gcagaacatgctccttataaatgct

SEQ ID NO: 70870 - DNA, 25 bp, Homo sapien
gcagaactcagacactagtgcaaga

SEQ ID NO: 70871 - DNA, 25 bp, Homo sapien
gcagaactcaggcactagtgcaaga

SEQ ID NO: 70872 - DNA, 25 bp, Homo sapien
gcagaactgtccaggccttgtatag

SEQ ID NO: 70873 - DNA, 25 bp, Homo sapien
gcagaactttccaggccttgtatag

SEQ ID NO: 70874 - DNA, 25 bp, Homo sapien
gcagaagaacgaatgagcgagcttg

SEQ ID NO: 70875 - DNA, 25 bp, Homo sapien
gcagaagaacgcatgagcgagcttg

SEQ ID NO: 70876 - DNA, 25 bp, Homo sapien
gcagaagagacaagctgagaaaaga

SEQ ID NO: 70877 - DNA, 25 bp, Homo sapien
gcagaagagacaatctgagaaaaga

SEQ ID NO: 70878 - DNA, 25 bp, Homo sapien
gcagaatacagactaaaatccttat

SEQ ID NO: 70879 - DNA, 25 bp, Homo sapien
gcagaatacagattaaaatccttat

SEQ ID NO: 70880 - DNA, 25 bp, Homo sapien
gcagaatatttttaagtcaaatgga

SEQ ID NO: 70881 - DNA, 25 bp, Homo sapien
gcagaatatttttaggtcaaatgga

SEQ ID NO: 70882 - DNA, 25 bp, Homo sapien
gcagaatggatctttaaaaggcagg

SEQ ID NO: 70883 - DNA, 25 bp, Homo sapien
gcagaatgggtctttaaaaggcagg

SEQ ID NO: 70884 - DNA, 25 bp, Homo sapien
gcagaattccggagttgagggtgct

SEQ ID NO: 70885 - DNA, 25 bp, Homo sapien
gcagaattctggagttgagggtgct

SEQ ID NO: 70886 - DNA, 25 bp, Homo sapien
gcagaattgttttcctatcttggga

SEQ ID NO: 70887 - DNA, 25 bp, Homo sapien
gcagaattgttttcctctcttggga

SEQ ID NO: 70888 - DNA, 25 bp, Homo sapien
gcagacaaggaagctcagaggagga

SEQ ID NO: 70889 - DNA, 25 bp, Homo sapien
gcagacaaggaagttcagaggagga

SEQ ID NO: 70890 - DNA, 25 bp, Homo sapien
gcagacactaatgcctttggatgcc

SEQ ID NO: 70891 - DNA, 25 bp, Homo sapien
gcagacactaatgtctttggatgcc

SEQ ID NO: 70892 - DNA, 25 bp, Homo sapien
gcagaccataatatgatacctatat

SEQ ID NO: 70893 - DNA, 25 bp, Homo sapien
gcagaccatgatatgatacctatat

SEQ ID NO: 70894 - DNA, 25 bp, Homo sapien
gcagacgtgtgtaggagcataaatg

SEQ ID NO: 70895 - DNA, 25 bp, Homo sapien
gcagacgtgtgtgggagcataaatg

SEQ ID NO: 70896 - DNA, 25 bp, Homo sapien
gcagactcaattatataaaagccat

SEQ ID NO: 70897 - DNA, 25 bp, Homo sapien
gcagactcaattatttaaaagccat

SEQ ID NO: 70898 - DNA, 25 bp, Homo sapien
gcagactcctgagtaaatattatct

SEQ ID NO: 70899 - DNA, 25 bp, Homo sapien
gcagactcctgggtaaatattatct

SEQ ID NO: 70900 - DNA, 25 bp, Homo sapien
gcagactctaaagaggccacccatg

SEQ ID NO: 70901 - DNA, 25 bp, Homo sapien
gcagactctgaagaggccacccatg

SEQ ID NO: 70902 - DNA, 25 bp, Homo sapien
gcagactctgtcagtgccttgccct

SEQ ID NO: 70903 - DNA, 25 bp, Homo sapien
gcagactctgtcggtgccttgccct

SEQ ID NO: 70904 - DNA, 25 bp, Homo sapien
gcagacttcctgtcgatgggccaaa

SEQ ID NO: 70905 - DNA, 25 bp, Homo sapien
gcagacttcctgttgatgggccaaa

SEQ ID NO: 70906 - DNA, 25 bp, Homo sapien
gcagagaaagggaccttaaaaagat

SEQ ID NO: 70907 - DNA, 25 bp, Homo sapien
gcagagaaagggagcttaaaaagat

SEQ ID NO: 70908 - DNA, 25 bp, Homo sapien
gcagagaatatggaacaacttactt

SEQ ID NO: 70909 - DNA, 25 bp, Homo sapien
gcagagaatatggagcaacttactt

SEQ ID NO: 70910 - DNA, 25 bp, Homo sapien
gcagagaccctgtgagcaacaggcc

SEQ ID NO: 70911 - DNA, 25 bp, Homo sapien
gcagagaccctgtgggcaacaggcc

SEQ ID NO: 70912 - DNA, 25 bp, Homo sapien
gcagagaccttgatttttgttaaga

SEQ ID NO: 70913 - DNA, 25 bp, Homo sapien
gcagagaccttggtttttgttaaga

SEQ ID NO: 70914 - DNA, 25 bp, Homo sapien
gcagagagtggtatgtgaatcattt

SEQ ID NO: 70915 - DNA, 25 bp, Homo sapien
gcagagagtggtgtgtgaatcattt

SEQ ID NO: 70916 - DNA, 25 bp, Homo sapien
gcagagcattccctactctatccta

SEQ ID NO: 70917 - DNA, 25 bp, Homo sapien
gcagagcattccttactctatccta

SEQ ID NO: 70918 - DNA, 25 bp, Homo sapien
gcagagcatttcaaatttcagattt

SEQ ID NO: 70919 - DNA, 25 bp, Homo sapien
gcagagcatttcagatttcagattt

SEQ ID NO: 70920 - DNA, 25 bp, Homo sapien
gcagagccagtagaaaagaacacaa

SEQ ID NO: 70921 - DNA, 25 bp, Homo sapien
gcagagcccgtagaaaagaacacaa

SEQ ID NO: 70922 - DNA, 25 bp, Homo sapien
gcagagctcgtgttatctaacctgt

SEQ ID NO: 70923 - DNA, 25 bp, Homo sapien
gcagagctcgtgttgtctaacctgt

SEQ ID NO: 70924 - DNA, 25 bp, Homo sapien
gcagagctgtgtgtttcctggaaat

SEQ ID NO: 70925 - DNA, 25 bp, Homo sapien
gcagagctgtgtgttttctggaaat

SEQ ID NO: 70926 - DNA, 25 bp, Homo sapien
gcagaggcaccaatggttgcagagg

SEQ ID NO: 70927 - DNA, 25 bp, Homo sapien
gcagaggcagcaatggttgcagagg

SEQ ID NO: 70928 - DNA, 25 bp, Homo sapien
gcagaggcctcccaagacagtctcc

SEQ ID NO: 70929 - DNA, 25 bp, Homo sapien
gcagaggcctcccaggacagtctcc

SEQ ID NO: 70930 - DNA, 25 bp, Homo sapien
gcagagggaaaaatggctgctaaaa

SEQ ID NO: 70931 - DNA, 25 bp, Homo sapien
gcagagggagaaatggctgctaaaa

SEQ ID NO: 70932 - DNA, 25 bp, Homo sapien
gcagagggcatcagattgtgagaca

SEQ ID NO: 70933 - DNA, 25 bp, Homo sapien
gcagagggcgtcagattgtgagaca

SEQ ID NO: 70934 - DNA, 25 bp, Homo sapien
gcagaggtggtgttctataaatatt

SEQ ID NO: 70935 - DNA, 25 bp, Homo sapien
gcagaggtggtgttctgtaaatatt

SEQ ID NO: 70936 - DNA, 25 bp, Homo sapien
gcagaggtttggctacacagatgat

SEQ ID NO: 70937 - DNA, 25 bp, Homo sapien
gcagaggtttggttacacagatgat

SEQ ID NO: 70938 - DNA, 25 bp, Homo sapien
gcagagtacaaagcacatccttctt

SEQ ID NO: 70939 - DNA, 25 bp, Homo sapien
gcagagtacaaggcacatccttctt

SEQ ID NO: 70940 - DNA, 25 bp, Homo sapien
gcagagtccaagaactgttgatctc

SEQ ID NO: 70941 - DNA, 25 bp, Homo sapien
gcagagtccaagtactgttgatctc

SEQ ID NO: 70942 - DNA, 25 bp, Homo sapien
gcagagtttcacaacataaatgaca

SEQ ID NO: 70943 - DNA, 25 bp, Homo sapien
gcagagttttacaacataaatgaca

SEQ ID NO: 70944 - DNA, 25 bp, Homo sapien
gcagataagacacaattaaagagaa

SEQ ID NO: 70945 - DNA, 25 bp, Homo sapien
gcagataatacacaattaaagagaa

SEQ ID NO: 70946 - DNA, 25 bp, Homo sapien
gcagatactatgatatccaacatgt

SEQ ID NO: 70947 - DNA, 25 bp, Homo sapien
gcagatactctgatatccaacatgt

SEQ ID NO: 70948 - DNA, 25 bp, Homo sapien
gcagatagaatcacagcaaccttag

SEQ ID NO: 70949 - DNA, 25 bp, Homo sapien
gcagatagaatcatagcaaccttag

SEQ ID NO: 70950 - DNA, 25 bp, Homo sapien
gcagatcaaaaacatcccgattccc

SEQ ID NO: 70951 - DNA, 25 bp, Homo sapien
gcagatcaaaagcatcccgattccc

SEQ ID NO: 70952 - DNA, 25 bp, Homo sapien
gcagatcaaacaacaccactttggg

SEQ ID NO: 70953 - DNA, 25 bp, Homo sapien
gcagatcaagcaacaccactttggg

SEQ ID NO: 70954 - DNA, 25 bp, Homo sapien
gcagatcccttacaaatggcttggt

SEQ ID NO: 70955 - DNA, 25 bp, Homo sapien
gcagatcccttacgaatggcttggt

SEQ ID NO: 70956 - DNA, 25 bp, Homo sapien
gcagatcctgccagattgcacctta

SEQ ID NO: 70957 - DNA, 25 bp, Homo sapien
gcagatcctgccagtttgcacctta

SEQ ID NO: 70958 - DNA, 25 bp, Homo sapien
gcagatgaaagacaaaagtacctct

SEQ ID NO: 70959 - DNA, 25 bp, Homo sapien
gcagatgaaagacgaaagtacctct

SEQ ID NO: 70960 - DNA, 25 bp, Homo sapien
gcagatgatttacggccagcttttg

SEQ ID NO: 70961 - DNA, 25 bp, Homo sapien
gcagatgatttatggccagcttttg

SEQ ID NO: 70962 - DNA, 25 bp, Homo sapien
gcagatgcatgatggagtagctgga

SEQ ID NO: 70963 - DNA, 25 bp, Homo sapien
gcagatgccgttaaaactaagttgt

SEQ ID NO: 70964 - DNA, 25 bp, Homo sapien
gcagatgcgtgatggagtagctgga

SEQ ID NO: 70965 - DNA, 25 bp, Homo sapien
gcagatgctgttaaaactaagttgt

SEQ ID NO: 70966 - DNA, 25 bp, Homo sapien
gcagatgtaaattacggacctcgag

SEQ ID NO: 70967 - DNA, 25 bp, Homo sapien
gcagatgtaaattatggacctcgag

SEQ ID NO: 70968 - DNA, 25 bp, Homo sapien
gcagatgtttaaaaaagtgaccttc

SEQ ID NO: 70969 - DNA, 25 bp, Homo sapien
gcagatgtttaaacaagtgaccttc

SEQ ID NO: 70970 - DNA, 25 bp, Homo sapien
gcagattaatgaacgtatttgaact

SEQ ID NO: 70971 - DNA, 25 bp, Homo sapien
gcagattaatggacgtatttgaact

SEQ ID NO: 70972 - DNA, 25 bp, Homo sapien
gcagattatcactcaaagtctcata

SEQ ID NO: 70973 - DNA, 25 bp, Homo sapien
gcagattatcactcaaggtctcata

SEQ ID NO: 70974 - DNA, 25 bp, Homo sapien
gcagattgaagaagccacttatggc

SEQ ID NO: 70975 - DNA, 25 bp, Homo sapien
gcagattgaaggagccacttatggc

SEQ ID NO: 70976 - DNA, 25 bp, Homo sapien
gcagattgaagtcccggaagaaaaa

SEQ ID NO: 70977 - DNA, 25 bp, Homo sapien
gcagattgaagtcctggaagaaaaa

SEQ ID NO: 70978 - DNA, 25 bp, Homo sapien
gcagattttaaaatttatgtggaat

SEQ ID NO: 70979 - DNA, 25 bp, Homo sapien
gcagatttttaaatttatgtggaat

SEQ ID NO: 70980 - DNA, 25 bp, Homo sapien
gcagcaaaaatcacttgggcatcat

SEQ ID NO: 70981 - DNA, 25 bp, Homo sapien
gcagcaaaaatcatttgggcatcat

SEQ ID NO: 70982 - DNA, 25 bp, Homo sapien
gcagcaacatggataaacctagaaa

SEQ ID NO: 70983 - DNA, 25 bp, Homo sapien
gcagcaacgtggataaacctagaaa

SEQ ID NO: 70984 - DNA, 25 bp, Homo sapien
gcagcaagaaaggcctggggcaaga

SEQ ID NO: 70985 - DNA, 25 bp, Homo sapien
gcagcaagaaaggtctggggcaaga

SEQ ID NO: 70986 - DNA, 25 bp, Homo sapien
gcagcacagcgaagacacggatctt

SEQ ID NO: 70987 - DNA, 25 bp, Homo sapien
gcagcacagggaatgaggaagcagc

SEQ ID NO: 70988 - DNA, 25 bp, Homo sapien
gcagcacagtgaagacacggatctt

SEQ ID NO: 70989 - DNA, 25 bp, Homo sapien
gcagcacagtgaatgaggaagcagc

SEQ ID NO: 70990 - DNA, 25 bp, Homo sapien
gcagcactcactataatttctgata

SEQ ID NO: 70991 - DNA, 25 bp, Homo sapien
gcagcactcactgtaatttctgata

SEQ ID NO: 70992 - DNA, 25 bp, Homo sapien
gcagcactccgccagtgaccttctg

SEQ ID NO: 70993 - DNA, 25 bp, Homo sapien
gcagcactctgccagtgaccttctg

SEQ ID NO: 70994 - DNA, 25 bp, Homo sapien
gcagcactgtgcggaaggctggctg

SEQ ID NO: 70995 - DNA, 25 bp, Homo sapien
gcagcactgtgtggaaggctggctg

SEQ ID NO: 70996 - DNA, 25 bp, Homo sapien
gcagcagacgtgagcttatatgtgg

SEQ ID NO: 70997 - DNA, 25 bp, Homo sapien
gcagcagagccagtagaaaagaaca

SEQ ID NO: 70998 - DNA, 25 bp, Homo sapien
gcagcagagcccgtagaaaagaaca

SEQ ID NO: 70999 - DNA, 25 bp, Homo sapien
gcagcagatgtgagcttatatgtgg

SEQ ID NO: 71000 - DNA, 25 bp, Homo sapien
gcagcagcactgcaaacatagtagc

SEQ ID NO: 71001 - DNA, 25 bp, Homo sapien
gcagcagcattgcaaacatagtagc

SEQ ID NO: 71002 - DNA, 25 bp, Homo sapien
gcagcagcatttcccacatgagcac

SEQ ID NO: 71003 - DNA, 25 bp, Homo sapien
gcagcagcatttcccatatgagcac

SEQ ID NO: 71004 - DNA, 25 bp, Homo sapien
gcagcagctcttacaggctcttcaa

SEQ ID NO: 71005 - DNA, 25 bp, Homo sapien
gcagcagctcttacagtctcttcaa

SEQ ID NO: 71006 - DNA, 25 bp, Homo sapien
gcagcaggaaaatgaaacttggatg

SEQ ID NO: 71007 - DNA, 25 bp, Homo sapien
gcagcaggaaactgaaacttggatg

SEQ ID NO: 71008 - DNA, 25 bp, Homo sapien
gcagcaggatggtatacagaatata

SEQ ID NO: 71009 - DNA, 25 bp, Homo sapien
gcagcaggcaagaaagcgtttgcag

SEQ ID NO: 71010 - DNA, 25 bp, Homo sapien
gcagcaggcaagagagcgtttgcag

SEQ ID NO: 71011 - DNA, 25 bp, Homo sapien
gcagcaggccgacaatcataggcgg

SEQ ID NO: 71012 - DNA, 25 bp, Homo sapien
gcagcaggccgacagtcataggcgg

SEQ ID NO: 71013 - DNA, 25 bp, Homo sapien
gcagcagggtggtatacagaatata

SEQ ID NO: 71014 - DNA, 25 bp, Homo sapien
gcagcagtaaaatgatcaaacaatt

SEQ ID NO: 71015 - DNA, 25 bp, Homo sapien
gcagcagtaaaatgttcaaacaatt

SEQ ID NO: 71016 - DNA, 25 bp, Homo sapien
gcagcatagaagcatagaacgttta

SEQ ID NO: 71017 - DNA, 25 bp, Homo sapien
gcagcatagaagcgtagaacgttta

SEQ ID NO: 71018 - DNA, 25 bp, Homo sapien
gcagcatggccaccgtggaattcac

SEQ ID NO: 71019 - DNA, 25 bp, Homo sapien
gcagcatggccactgtggaattcac

SEQ ID NO: 71020 - DNA, 25 bp, Homo sapien
gcagcattcctcacttctactcact

SEQ ID NO: 71021 - DNA, 25 bp, Homo sapien
gcagcattcctcgcttctactcact

SEQ ID NO: 71022 - DNA, 25 bp, Homo sapien
gcagcatttacatgtttaacaagct

SEQ ID NO: 71023 - DNA, 25 bp, Homo sapien
gcagcatttacatttttaacaagct

SEQ ID NO: 71024 - DNA, 25 bp, Homo sapien
gcagcatttcccacatgagcactgc

SEQ ID NO: 71025 - DNA, 25 bp, Homo sapien
gcagcatttcccatatgagcactgc

SEQ ID NO: 71026 - DNA, 25 bp, Homo sapien
gcagccaacagtaattttttaaaaa

SEQ ID NO: 71027 - DNA, 25 bp, Homo sapien
gcagccaacggtaattttttaaaaa

SEQ ID NO: 71028 - DNA, 25 bp, Homo sapien
gcagccaagacacccatgagagtac

SEQ ID NO: 71029 - DNA, 25 bp, Homo sapien
gcagccaagacgcccatgagagtac

SEQ ID NO: 71030 - DNA, 25 bp, Homo sapien
gcagccactggacaggactaagcta

SEQ ID NO: 71031 - DNA, 25 bp, Homo sapien
gcagccactgggcaggactaagcta

SEQ ID NO: 71032 - DNA, 25 bp, Homo sapien
gcagccctactagtcaggaggcttg

SEQ ID NO: 71033 - DNA, 25 bp, Homo sapien
gcagccctagaattaactgtgctga

SEQ ID NO: 71034 - DNA, 25 bp, Homo sapien
gcagccctgctagtcaggaggcttg

SEQ ID NO: 71035 - DNA, 25 bp, Homo sapien
gcagccctggaattaactgtgctga

SEQ ID NO: 71036 - DNA, 25 bp, Homo sapien
gcagcctgtagagaagaaataaaag

SEQ ID NO: 71037 - DNA, 25 bp, Homo sapien
gcagcctgtagagacgaaataaaag

SEQ ID NO: 71038 - DNA, 25 bp, Homo sapien
gcagcgctgtgacatgggaagggcc

SEQ ID NO: 71039 - DNA, 25 bp, Homo sapien
gcagcgctgtgacgtgggaagggcc

SEQ ID NO: 71040 - DNA, 25 bp, Homo sapien
gcagctaaactcacattccttctag

SEQ ID NO: 71041 - DNA, 25 bp, Homo sapien
gcagctaaactcatattccttctag

SEQ ID NO: 71042 - DNA, 25 bp, Homo sapien
gcagctaacacatgacattgggcct

SEQ ID NO: 71043 - DNA, 25 bp, Homo sapien
gcagctaacacatggcattgggcct

SEQ ID NO: 71044 - DNA, 25 bp, Homo sapien
gcagctataaatatacctttcagag

SEQ ID NO: 71045 - DNA, 25 bp, Homo sapien
gcagctataaatatacttttcagag

SEQ ID NO: 71046 - DNA, 25 bp, Homo sapien
gcagctatgattatggatattgaga

SEQ ID NO: 71047 - DNA, 25 bp, Homo sapien
gcagctatgattgtggatattgaga

SEQ ID NO: 71048 - DNA, 25 bp, Homo sapien
gcagctgaaattcaaacccaggtgg

SEQ ID NO: 71049 - DNA, 25 bp, Homo sapien
gcagctgaaattcgaacccaggtgg

SEQ ID NO: 71050 - DNA, 25 bp, Homo sapien
gcagctgattcactcagttgaaaca

SEQ ID NO: 71051 - DNA, 25 bp, Homo sapien
gcagctgattcacttagttgaaaca

SEQ ID NO: 71052 - DNA, 25 bp, Homo sapien
gcagctgctacactacagcgccaca

SEQ ID NO: 71053 - DNA, 25 bp, Homo sapien
gcagctgctacattacagcgccaca

SEQ ID NO: 71054 - DNA, 25 bp, Homo sapien
gcagcttaattagccaggtgtcctg

SEQ ID NO: 71055 - DNA, 25 bp, Homo sapien
gcagcttaattagcgaggtgtcctg

SEQ ID NO: 71056 - DNA, 25 bp, Homo sapien
gcagcttctaggagctcagcaggaa

SEQ ID NO: 71057 - DNA, 25 bp, Homo sapien
gcagcttctccatcaacactgctac

SEQ ID NO: 71058 - DNA, 25 bp, Homo sapien
gcagcttctccatcgacactgctac

SEQ ID NO: 71059 - DNA, 25 bp, Homo sapien
gcagcttctctaacttattttgtta

SEQ ID NO: 71060 - DNA, 25 bp, Homo sapien
gcagcttctctaacttcttttgtta

SEQ ID NO: 71061 - DNA, 25 bp, Homo sapien
gcagcttctgggagctcagcaggaa

SEQ ID NO: 71062 - DNA, 25 bp, Homo sapien
gcagcttttatcattacggcatcat

SEQ ID NO: 71063 - DNA, 25 bp, Homo sapien
gcagcttttatcattatggcatcat

SEQ ID NO: 71064 - DNA, 25 bp, Homo sapien
gcagctttttcgcccacagcaagaa

SEQ ID NO: 71065 - DNA, 25 bp, Homo sapien
gcagctttttcgcctacagcaagaa

SEQ ID NO: 71066 - DNA, 25 bp, Homo sapien
gcaggaaaatatggcccataaccag

SEQ ID NO: 71067 - DNA, 25 bp, Homo sapien
gcaggaaaatatggcctataaccag

SEQ ID NO: 71068 - DNA, 25 bp, Homo sapien
gcaggaaaatgaaacttggatggga

SEQ ID NO: 71069 - DNA, 25 bp, Homo sapien
gcaggaaactgaaacttggatggga

SEQ ID NO: 71070 - DNA, 25 bp, Homo sapien
gcaggaaatagcctatcaccctggt

SEQ ID NO: 71071 - DNA, 25 bp, Homo sapien
gcaggaaatagcgtatcaccctggt

SEQ ID NO: 71072 - DNA, 25 bp, Homo sapien
gcaggaagaatgacctcccattcct

SEQ ID NO: 71073 - DNA, 25 bp, Homo sapien
gcaggaagagtgacctcccattcct

SEQ ID NO: 71074 - DNA, 25 bp, Homo sapien
gcaggaatctcactaccctcatatc

SEQ ID NO: 71075 - DNA, 25 bp, Homo sapien
gcaggaatctcattaccctcatatc

SEQ ID NO: 71076 - DNA, 25 bp, Homo sapien
gcaggacaatataagcaggcaactt

SEQ ID NO: 71077 - DNA, 25 bp, Homo sapien
gcaggacaatatatgcaggcaactt

SEQ ID NO: 71078 - DNA, 25 bp, Homo sapien
gcaggacctaaaatggtttttctgt

SEQ ID NO: 71079 - DNA, 25 bp, Homo sapien
gcaggacctaatatggtttttctgt

SEQ ID NO: 71080 - DNA, 25 bp, Homo sapien
gcaggactaggtaccaaagccatga

SEQ ID NO: 71081 - DNA, 25 bp, Homo sapien
gcaggactcctctttaagcagagag

SEQ ID NO: 71082 - DNA, 25 bp, Homo sapien
gcaggactctgtacttcaggggcct

SEQ ID NO: 71083 - DNA, 25 bp, Homo sapien
gcaggactcttctttaagcagagag

SEQ ID NO: 71084 - DNA, 25 bp, Homo sapien
gcaggactgggtaccaaagccatga

SEQ ID NO: 71085 - DNA, 25 bp, Homo sapien
gcaggactgtgtacttcaggggcct

SEQ ID NO: 71086 - DNA, 25 bp, Homo sapien
gcaggagaaaagcaagaagacagga

SEQ ID NO: 71087 - DNA, 25 bp, Homo sapien
gcaggagaacagcaagaagacagga

SEQ ID NO: 71088 - DNA, 25 bp, Homo sapien
gcaggagaactggtgcccttcaccc

SEQ ID NO: 71089 - DNA, 25 bp, Homo sapien
gcaggagagctggtgcccttcaccc

SEQ ID NO: 71090 - DNA, 25 bp, Homo sapien
gcaggagctcgaaaggagaaggaga

SEQ ID NO: 71091 - DNA, 25 bp, Homo sapien
gcaggagcttgaaaggagaaggaga

SEQ ID NO: 71092 - DNA, 25 bp, Homo sapien
gcaggattcgggcagccaggatctg

SEQ ID NO: 71093 - DNA, 25 bp, Homo sapien
gcaggatttgggcagccaggatctg

SEQ ID NO: 71094 - DNA, 25 bp, Homo sapien
gcaggcaaaaaaaagagtcatgttc

SEQ ID NO: 71095 - DNA, 25 bp, Homo sapien
gcaggcaaaaaaaggagtcatgttc

SEQ ID NO: 71096 - DNA, 25 bp, Homo sapien
gcaggcagccctagaattaactgtg

SEQ ID NO: 71097 - DNA, 25 bp, Homo sapien
gcaggcagccctggaattaactgtg

SEQ ID NO: 71098 - DNA, 25 bp, Homo sapien
gcaggcatgaaagaaaaggcctgga

SEQ ID NO: 71099 - DNA, 25 bp, Homo sapien
gcaggcatgaaagcaaaggcctgga

SEQ ID NO: 71100 - DNA, 25 bp, Homo sapien
gcaggcattaaggactaagacaatg

SEQ ID NO: 71101 - DNA, 25 bp, Homo sapien
gcaggcattaaggactgagacaatg

SEQ ID NO: 71102 - DNA, 25 bp, Homo sapien
gcaggccatgacaggctcatttcaa

SEQ ID NO: 71103 - DNA, 25 bp, Homo sapien
gcaggccatgataggctcatttcaa

SEQ ID NO: 71104 - DNA, 25 bp, Homo sapien
gcaggctggaaagtcagatgataaa

SEQ ID NO: 71105 - DNA, 25 bp, Homo sapien
gcaggctgggaagtcagatgataaa

SEQ ID NO: 71106 - DNA, 25 bp, Homo sapien
gcagggaaaaactgtgtgctcagga

SEQ ID NO: 71107 - DNA, 25 bp, Homo sapien
gcagggaaaaattgtgtgctcagga

SEQ ID NO: 71108 - DNA, 25 bp, Homo sapien
gcagggaacaaccttgtacatacat

SEQ ID NO: 71109 - DNA, 25 bp, Homo sapien
gcagggaaccaccttgtacatacat

SEQ ID NO: 71110 - DNA, 25 bp, Homo sapien
gcagggaacccagaaggacagatgg

SEQ ID NO: 71111 - DNA, 25 bp, Homo sapien
gcagggaacccagcaggacagatgg

SEQ ID NO: 71112 - DNA, 25 bp, Homo sapien
gcagggaacctaggactgatttgtg

SEQ ID NO: 71113 - DNA, 25 bp, Homo sapien
gcagggaagctaggactgatttgtg

SEQ ID NO: 71114 - DNA, 25 bp, Homo sapien
gcagggacatgcctctcagcttcat

SEQ ID NO: 71115 - DNA, 25 bp, Homo sapien
gcagggacatggctctcagcttcat

SEQ ID NO: 71116 - DNA, 25 bp, Homo sapien
gcagggaccaaaataacatacagtg

SEQ ID NO: 71117 - DNA, 25 bp, Homo sapien
gcagggacctttccggccgctgtgt

SEQ ID NO: 71118 - DNA, 25 bp, Homo sapien
gcagggacctttctggccgctgtgt

SEQ ID NO: 71119 - DNA, 25 bp, Homo sapien
gcagggacgaaaataacatacagtg

SEQ ID NO: 71120 - DNA, 25 bp, Homo sapien
gcagggactttgtttggctttgtgt

SEQ ID NO: 71121 - DNA, 25 bp, Homo sapien
gcagggactttttttggctttgtgt

SEQ ID NO: 71122 - DNA, 25 bp, Homo sapien
gcagggagaatattgtcacacactc

SEQ ID NO: 71123 - DNA, 25 bp, Homo sapien
gcagggagaatattttcacacactc

SEQ ID NO: 71124 - DNA, 25 bp, Homo sapien
gcagggatgaaaacaaaattaattt

SEQ ID NO: 71125 - DNA, 25 bp, Homo sapien
gcagggatgaaagcaaaattaattt

SEQ ID NO: 71126 - DNA, 25 bp, Homo sapien
gcagggattaggatgtgaacgcagc

SEQ ID NO: 71127 - DNA, 25 bp, Homo sapien
gcagggattgggatgtgaacgcagc

SEQ ID NO: 71128 - DNA, 25 bp, Homo sapien
gcagggcagttctatagtcttcacc

SEQ ID NO: 71129 - DNA, 25 bp, Homo sapien
gcagggcagttctgtagtcttcacc

SEQ ID NO: 71130 - DNA, 25 bp, Homo sapien
gcagggcatcaggccagctgcaaat

SEQ ID NO: 71131 - DNA, 25 bp, Homo sapien
gcagggcatcaggctagctgcaaat

SEQ ID NO: 71132 - DNA, 25 bp, Homo sapien
gcagggctgaacccagtctaaatac

SEQ ID NO: 71133 - DNA, 25 bp, Homo sapien
gcagggctggacccagtctaaatac

SEQ ID NO: 71134 - DNA, 25 bp, Homo sapien
gcaggggaaatgcagtccaagtgcc

SEQ ID NO: 71135 - DNA, 25 bp, Homo sapien
gcaggggaagtgcagtccaagtgcc

SEQ ID NO: 71136 - DNA, 25 bp, Homo sapien
gcaggggcctaaaacctagactctg

SEQ ID NO: 71137 - DNA, 25 bp, Homo sapien
gcaggggcctaaaagctagactctg

SEQ ID NO: 71138 - DNA, 25 bp, Homo sapien
gcagggggaatttccgcagtgtact

SEQ ID NO: 71139 - DNA, 25 bp, Homo sapien
gcagggggagtttccgcagtgtact

SEQ ID NO: 71140 - DNA, 25 bp, Homo sapien
gcaggggtgtgacaatgactgcaaa

SEQ ID NO: 71141 - DNA, 25 bp, Homo sapien
gcaggggtgtgagaatgactgcaaa

SEQ ID NO: 71142 - DNA, 25 bp, Homo sapien
gcagggtcaacactgccaggtctct

SEQ ID NO: 71143 - DNA, 25 bp, Homo sapien
gcagggtccacactgccaggtctct

SEQ ID NO: 71144 - DNA, 25 bp, Homo sapien
gcagggtctttctgcagacaaagtg

SEQ ID NO: 71145 - DNA, 25 bp, Homo sapien
gcagggtctttgtgcagacaaagtg

SEQ ID NO: 71146 - DNA, 25 bp, Homo sapien
gcaggtaagccaagtgggcaagata

SEQ ID NO: 71147 - DNA, 25 bp, Homo sapien
gcaggtaaggcaagtgggcaagata

SEQ ID NO: 71148 - DNA, 25 bp, Homo sapien
gcaggtacctgggcagatgcaaaga

SEQ ID NO: 71149 - DNA, 25 bp, Homo sapien
gcaggtacctgggcaggtgcaaaga

SEQ ID NO: 71150 - DNA, 25 bp, Homo sapien
gcaggtagagggactctcattctgg

SEQ ID NO: 71151 - DNA, 25 bp, Homo sapien
gcaggtagagggattctcattctgg

SEQ ID NO: 71152 - DNA, 25 bp, Homo sapien
gcaggtagtgagaacactaggaaaa

SEQ ID NO: 71153 - DNA, 25 bp, Homo sapien
gcaggtagtgagaatactaggaaaa

SEQ ID NO: 71154 - DNA, 25 bp, Homo sapien
gcaggtcacttgcaaattttcttaa

SEQ ID NO: 71155 - DNA, 25 bp, Homo sapien
gcaggtcatttgcaaattttcttaa

SEQ ID NO: 71156 - DNA, 25 bp, Homo sapien
gcaggtccatttggatctggttgtt

SEQ ID NO: 71157 - DNA, 25 bp, Homo sapien
gcaggtccctttggatctggttgtt

SEQ ID NO: 71158 - DNA, 25 bp, Homo sapien
gcaggtgagggccgatctgaaccat

SEQ ID NO: 71159 - DNA, 25 bp, Homo sapien
gcaggtgagggccgatgtgaaccat

SEQ ID NO: 71160 - DNA, 25 bp, Homo sapien
gcaggtgattggcatcctgaatttt

SEQ ID NO: 71161 - DNA, 25 bp, Homo sapien
gcaggtgattggtatcctgaatttt

SEQ ID NO: 71162 - DNA, 25 bp, Homo sapien
gcaggtgccaataggcagccgatat

SEQ ID NO: 71163 - DNA, 25 bp, Homo sapien
gcaggtgccaatgggcagccgatat

SEQ ID NO: 71164 - DNA, 25 bp, Homo sapien
gcaggtgcctctgctttgccgttaa

SEQ ID NO: 71165 - DNA, 25 bp, Homo sapien
gcaggtgctgaccaagaacaggtta

SEQ ID NO: 71166 - DNA, 25 bp, Homo sapien
gcaggtgctgaccaaggacaggtta

SEQ ID NO: 71167 - DNA, 25 bp, Homo sapien
gcaggtgcttctgctttgccgttaa

SEQ ID NO: 71168 - DNA, 25 bp, Homo sapien
gcaggtggaagacattgagacgcct

SEQ ID NO: 71169 - DNA, 25 bp, Homo sapien
gcaggtggaaggcattgagacgcct

SEQ ID NO: 71170 - DNA, 25 bp, Homo sapien
gcaggtggaccccgtgtcataaatg

SEQ ID NO: 71171 - DNA, 25 bp, Homo sapien
gcaggtggaccctgtgtcataaatg

SEQ ID NO: 71172 - DNA, 25 bp, Homo sapien
gcagtaaaatgatcaaacaattttg

SEQ ID NO: 71173 - DNA, 25 bp, Homo sapien
gcagtaaaatgttcaaacaattttg

SEQ ID NO: 71174 - DNA, 25 bp, Homo sapien
gcagtaaaggtcagcagctgagggg

SEQ ID NO: 71175 - DNA, 25 bp, Homo sapien
gcagtaaaggtgagcagctgagggg

SEQ ID NO: 71176 - DNA, 25 bp, Homo sapien
gcagtaaatgtgcaaaagagacagg

SEQ ID NO: 71177 - DNA, 25 bp, Homo sapien
gcagtaaatgtgcgaaagagacagg

SEQ ID NO: 71178 - DNA, 25 bp, Homo sapien
gcagtaagtcattcatttggacaat

SEQ ID NO: 71179 - DNA, 25 bp, Homo sapien
gcagtaagtcatttatttggacaat

SEQ ID NO: 71180 - DNA, 25 bp, Homo sapien
gcagtaatatcccttcaccatcatt

SEQ ID NO: 71181 - DNA, 25 bp, Homo sapien
gcagtaatatcccttcgccatcatt

SEQ ID NO: 71182 - DNA, 25 bp, Homo sapien
gcagtaatggaaataaagatcccag

SEQ ID NO: 71183 - DNA, 25 bp, Homo sapien
gcagtaattgaaataaagatcccag

SEQ ID NO: 71184 - DNA, 25 bp, Homo sapien
gcagtagcagtcctgaagaacagtg

SEQ ID NO: 71185 - DNA, 25 bp, Homo sapien
gcagtagcctgaattctggaataga

SEQ ID NO: 71186 - DNA, 25 bp, Homo sapien
gcagtagcctgatttctggaataga

SEQ ID NO: 71187 - DNA, 25 bp, Homo sapien
gcagtagcggtcctgaagaacagtg

SEQ ID NO: 71188 - DNA, 25 bp, Homo sapien
gcagtaggcctagcaaggagagaga

SEQ ID NO: 71189 - DNA, 25 bp, Homo sapien
gcagtaggcctggcaaggagagaga

SEQ ID NO: 71190 - DNA, 25 bp, Homo sapien
gcagtagtcatattaaaagtgtctg

SEQ ID NO: 71191 - DNA, 25 bp, Homo sapien
gcagtagtcgtattaaaagtgtctg

SEQ ID NO: 71192 - DNA, 25 bp, Homo sapien
gcagtatatccaaagtttaattcaa

SEQ ID NO: 71193 - DNA, 25 bp, Homo sapien
gcagtatatccgaagtttaattcaa

SEQ ID NO: 71194 - DNA, 25 bp, Homo sapien
gcagtatcttcagttcttacagtgg

SEQ ID NO: 71195 - DNA, 25 bp, Homo sapien
gcagtatcttcatttcttacagtgg

SEQ ID NO: 71196 - DNA, 25 bp, Homo sapien
gcagtatgcacaaagggcaataaag

SEQ ID NO: 71197 - DNA, 25 bp, Homo sapien
gcagtatgcacgaagggcaataaag

SEQ ID NO: 71198 - DNA, 25 bp, Homo sapien
gcagtattgcttaaccctgaaggag

SEQ ID NO: 71199 - DNA, 25 bp, Homo sapien
gcagtattgtttaaccctgaaggag

SEQ ID NO: 71200 - DNA, 25 bp, Homo sapien
gcagtcaaaagtccattgataataa

SEQ ID NO: 71201 - DNA, 25 bp, Homo sapien
gcagtcaaatgtccattgataataa

SEQ ID NO: 71202 - DNA, 25 bp, Homo sapien
gcagtcacacggaaagctcttggtt

SEQ ID NO: 71203 - DNA, 25 bp, Homo sapien
gcagtcacatggaaagctcttggtt

SEQ ID NO: 71204 - DNA, 25 bp, Homo sapien
gcagtcaggtgaaacttaaaagatg

SEQ ID NO: 71205 - DNA, 25 bp, Homo sapien
gcagtcaggtgacacttaaaagatg

SEQ ID NO: 71206 - DNA, 25 bp, Homo sapien
gcagtcagttgttgcgataagatct

SEQ ID NO: 71207 - DNA, 25 bp, Homo sapien
gcagtcagttgttgggataagatct

SEQ ID NO: 71208 - DNA, 25 bp, Homo sapien
gcagtccaatcacaccatattgttt

SEQ ID NO: 71209 - DNA, 25 bp, Homo sapien
gcagtccaatcacaccgtattgttt

SEQ ID NO: 71210 - DNA, 25 bp, Homo sapien
gcagtccacaaacacctttttgtag

SEQ ID NO: 71211 - DNA, 25 bp, Homo sapien
gcagtccacaatcacctttttgtag

SEQ ID NO: 71212 - DNA, 25 bp, Homo sapien
gcagtccaggtgtggagctcttgtc

SEQ ID NO: 71213 - DNA, 25 bp, Homo sapien
gcagtccatgtgtggagctcttgtc

SEQ ID NO: 71214 - DNA, 25 bp, Homo sapien
gcagtccatttatgcaaaataatca

SEQ ID NO: 71215 - DNA, 25 bp, Homo sapien
gcagtccatttgtgcaaaataatca

SEQ ID NO: 71216 - DNA, 25 bp, Homo sapien
gcagtcctagtcaagatggccacac

SEQ ID NO: 71217 - DNA, 25 bp, Homo sapien
gcagtcctagtcgagatggccacac

SEQ ID NO: 71218 - DNA, 25 bp, Homo sapien
gcagtctaaagataaaatgatattc

SEQ ID NO: 71219 - DNA, 25 bp, Homo sapien
gcagtctaaggataaaatgatattc

SEQ ID NO: 71220 - DNA, 25 bp, Homo sapien
gcagtctaatactcaaaatttccca

SEQ ID NO: 71221 - DNA, 25 bp, Homo sapien
gcagtctaatattcaaaatttccca

SEQ ID NO: 71222 - DNA, 25 bp, Homo sapien
gcagtctctaaataacttcaccaga

SEQ ID NO: 71223 - DNA, 25 bp, Homo sapien
gcagtctctaaatagcttcaccaga

SEQ ID NO: 71224 - DNA, 25 bp, Homo sapien
gcagtctctgtctaatgatgcttca

SEQ ID NO: 71225 - DNA, 25 bp, Homo sapien
gcagtctctgtctgatgatgcttca

SEQ ID NO: 71226 - DNA, 25 bp, Homo sapien
gcagtctgtatgacctctaattctt

SEQ ID NO: 71227 - DNA, 25 bp, Homo sapien
gcagtctgtatggcctctaattctt

SEQ ID NO: 71228 - DNA, 25 bp, Homo sapien
gcagtcttgcactctcaaaatgagt

SEQ ID NO: 71229 - DNA, 25 bp, Homo sapien
gcagtcttgcactctcgaaatgagt

SEQ ID NO: 71230 - DNA, 25 bp, Homo sapien
gcagtgaatatgtgacctggagtct

SEQ ID NO: 71231 - DNA, 25 bp, Homo sapien
gcagtgaatatgtgacttggagtct

SEQ ID NO: 71232 - DNA, 25 bp, Homo sapien
gcagtgacatattcggtgttcacat

SEQ ID NO: 71233 - DNA, 25 bp, Homo sapien
gcagtgacatatttggtgttcacat

SEQ ID NO: 71234 - DNA, 25 bp, Homo sapien
gcagtgacatgttgaagaaactgga

SEQ ID NO: 71235 - DNA, 25 bp, Homo sapien
gcagtgacctcaaagtgacagcctg

SEQ ID NO: 71236 - DNA, 25 bp, Homo sapien
gcagtgacttcaaagtgacagcctg

SEQ ID NO: 71237 - DNA, 25 bp, Homo sapien
gcagtgacttgttgaagaaactgga

SEQ ID NO: 71238 - DNA, 25 bp, Homo sapien
gcagtgatataacacaatttgttca

SEQ ID NO: 71239 - DNA, 25 bp, Homo sapien
gcagtgatataccacaatttgttca

SEQ ID NO: 71240 - DNA, 25 bp, Homo sapien
gcagtgattaaattgaagctctaaa

SEQ ID NO: 71241 - DNA, 25 bp, Homo sapien
gcagtgattgaattgaagctctaaa

SEQ ID NO: 71242 - DNA, 25 bp, Homo sapien
gcagtgcaacatggagctatatttg

SEQ ID NO: 71243 - DNA, 25 bp, Homo sapien
gcagtgcagcatggagctatatttg

SEQ ID NO: 71244 - DNA, 25 bp, Homo sapien
gcagtgccaagttgagacaatggct

SEQ ID NO: 71245 - DNA, 25 bp, Homo sapien
gcagtgccaagttgaggcaatggct

SEQ ID NO: 71246 - DNA, 25 bp, Homo sapien
gcagtgctaacaggaaagtttatag

SEQ ID NO: 71247 - DNA, 25 bp, Homo sapien
gcagtgctaacagtaaagtttatag

SEQ ID NO: 71248 - DNA, 25 bp, Homo sapien
gcagtgctttgatgaataataaacc

SEQ ID NO: 71249 - DNA, 25 bp, Homo sapien
gcagtgctttggtgaataataaacc

SEQ ID NO: 71250 - DNA, 25 bp, Homo sapien
gcagtggacgagtctatcatgtttt

SEQ ID NO: 71251 - DNA, 25 bp, Homo sapien
gcagtggaggagtctatcatgtttt

SEQ ID NO: 71252 - DNA, 25 bp, Homo sapien
gcagtggatactcccgatgttcaaa

SEQ ID NO: 71253 - DNA, 25 bp, Homo sapien
gcagtggatactctcgatgttcaaa

SEQ ID NO: 71254 - DNA, 25 bp, Homo sapien
gcagtggtcatctcttggttccata

SEQ ID NO: 71255 - DNA, 25 bp, Homo sapien
gcagtggtcatttcttggttccata

SEQ ID NO: 71256 - DNA, 25 bp, Homo sapien
gcagtggttgttaagttttcattta

SEQ ID NO: 71257 - DNA, 25 bp, Homo sapien
gcagtggttgttacgttttcattta

SEQ ID NO: 71258 - DNA, 25 bp, Homo sapien
gcagtgtaaacccatgtagactgga

SEQ ID NO: 71259 - DNA, 25 bp, Homo sapien
gcagtgtaaacccctgtagactgga

SEQ ID NO: 71260 - DNA, 25 bp, Homo sapien
gcagtgtcatgaccttagcttcttt

SEQ ID NO: 71261 - DNA, 25 bp, Homo sapien
gcagtgtcatgcccttagcttcttt

SEQ ID NO: 71262 - DNA, 25 bp, Homo sapien
gcagtgtgactgaacggtactgtga

SEQ ID NO: 71263 - DNA, 25 bp, Homo sapien
gcagtgtgactgaatggtactgtga

SEQ ID NO: 71264 - DNA, 25 bp, Homo sapien
gcagtgtgtacaaattgtgggaaga

SEQ ID NO: 71265 - DNA, 25 bp, Homo sapien
gcagtgtgtacatattgtgggaaga

SEQ ID NO: 71266 - DNA, 25 bp, Homo sapien
gcagtgtttcataaacttatttgaa

SEQ ID NO: 71267 - DNA, 25 bp, Homo sapien
gcagtgtttcatgaacttatttgaa

SEQ ID NO: 71268 - DNA, 25 bp, Homo sapien
gcagtgtttctgaggcccctttgac

SEQ ID NO: 71269 - DNA, 25 bp, Homo sapien
gcagtgtttctggggcccctttgac

SEQ ID NO: 71270 - DNA, 25 bp, Homo sapien
gcagttaccctttgtcaagttaaga

SEQ ID NO: 71271 - DNA, 25 bp, Homo sapien
gcagttactctttgtcaagttaaga

SEQ ID NO: 71272 - DNA, 25 bp, Homo sapien
gcagttatgtttctcggaagcagtt

SEQ ID NO: 71273 - DNA, 25 bp, Homo sapien
gcagttatgtttcttggaagcagtt

SEQ ID NO: 71274 - DNA, 25 bp, Homo sapien
gcagttcaaataaaaagtgatgtag

SEQ ID NO: 71275 - DNA, 25 bp, Homo sapien
gcagttcaaatacaaagtgatgtag

SEQ ID NO: 71276 - DNA, 25 bp, Homo sapien
gcagttcaacagtcaaaagacaggt

SEQ ID NO: 71277 - DNA, 25 bp, Homo sapien
gcagttcaacagtgaaaagacaggt

SEQ ID NO: 71278 - DNA, 25 bp, Homo sapien
gcagttcagcaccatagctaagata

SEQ ID NO: 71279 - DNA, 25 bp, Homo sapien
gcagttcagcatcatagctaagata

SEQ ID NO: 71280 - DNA, 25 bp, Homo sapien
gcagttcagctgacattcaaactat

SEQ ID NO: 71281 - DNA, 25 bp, Homo sapien
gcagttcagctgagattcaaactat

SEQ ID NO: 71282 - DNA, 25 bp, Homo sapien
gcagttccactttgccccacaatga

SEQ ID NO: 71283 - DNA, 25 bp, Homo sapien
gcagttccgctttgccccacaatga

SEQ ID NO: 71284 - DNA, 25 bp, Homo sapien
gcagttctatagtcttcaccacagt

SEQ ID NO: 71285 - DNA, 25 bp, Homo sapien
gcagttctgtagtcttcaccacagt

SEQ ID NO: 71286 - DNA, 25 bp, Homo sapien
gcagttcttcaccagccagacatcg

SEQ ID NO: 71287 - DNA, 25 bp, Homo sapien
gcagttcttcaccagctagacatcg

SEQ ID NO: 71288 - DNA, 25 bp, Homo sapien
gcagttctttccatttttgtatatg

SEQ ID NO: 71289 - DNA, 25 bp, Homo sapien
gcagttctttccctttttgtatatg

SEQ ID NO: 71290 - DNA, 25 bp, Homo sapien
gcagttgaaccttattaacttattt

SEQ ID NO: 71291 - DNA, 25 bp, Homo sapien
gcagttgaacctttttaacttattt

SEQ ID NO: 71292 - DNA, 25 bp, Homo sapien
gcagttgctgtgaactgccatctct

SEQ ID NO: 71293 - DNA, 25 bp, Homo sapien
gcagttgctgtgagctgccatctct

SEQ ID NO: 71294 - DNA, 25 bp, Homo sapien
gcagttggagaatacaaggtggatg

SEQ ID NO: 71295 - DNA, 25 bp, Homo sapien
gcagttggagaatgcaaggtggatg

SEQ ID NO: 71296 - DNA, 25 bp, Homo sapien
gcagttgtgatcatagctccctgta

SEQ ID NO: 71297 - DNA, 25 bp, Homo sapien
gcagttgtgattatagctccctgta

SEQ ID NO: 71298 - DNA, 25 bp, Homo sapien
gcagtttaatcaaaaatttacttaa

SEQ ID NO: 71299 - DNA, 25 bp, Homo sapien
gcagtttaatcagaaatttacttaa

SEQ ID NO: 71300 - DNA, 25 bp, Homo sapien
gcagtttataagacacctagtttat

SEQ ID NO: 71301 - DNA, 25 bp, Homo sapien
gcagtttataaggcacctagtttat

SEQ ID NO: 71302 - DNA, 25 bp, Homo sapien
gcagtttatatacaggcttatggtt

SEQ ID NO: 71303 - DNA, 25 bp, Homo sapien
gcagtttatatataggcttatggtt

SEQ ID NO: 71304 - DNA, 25 bp, Homo sapien
gcagtttatgtgcgaggtatttagg

SEQ ID NO: 71305 - DNA, 25 bp, Homo sapien
gcagtttatgtgtgaggtatttagg

SEQ ID NO: 71306 - DNA, 25 bp, Homo sapien
gcagtttgaccataatgtgccctgg

SEQ ID NO: 71307 - DNA, 25 bp, Homo sapien
gcagtttgaccgtaatgtgccctgg

SEQ ID NO: 71308 - DNA, 25 bp, Homo sapien
gcagtttggattaaagaatcgcaaa

SEQ ID NO: 71309 - DNA, 25 bp, Homo sapien
gcagtttggattagagaatcgcaaa

SEQ ID NO: 71310 - DNA, 25 bp, Homo sapien
gcagtttgtgggatagttagttgtg

SEQ ID NO: 71311 - DNA, 25 bp, Homo sapien
gcagtttgtggggtagttagttgtg

SEQ ID NO: 71312 - DNA, 25 bp, Homo sapien
gcagttttaagatgcagaattatac

SEQ ID NO: 71313 - DNA, 25 bp, Homo sapien
gcagttttagaaccctcaagaaata

SEQ ID NO: 71314 - DNA, 25 bp, Homo sapien
gcagttttagaagcctcaagaaata

SEQ ID NO: 71315 - DNA, 25 bp, Homo sapien
gcagttttaggatgcagaattatac

SEQ ID NO: 71316 - DNA, 25 bp, Homo sapien
gcagttttatagccgtattacttca

SEQ ID NO: 71317 - DNA, 25 bp, Homo sapien
gcagttttatagctgtattacttca

SEQ ID NO: 71318 - DNA, 25 bp, Homo sapien
gcagttttcacttcctattggagtc

SEQ ID NO: 71319 - DNA, 25 bp, Homo sapien
gcagttttcacttcctgttggagtc

SEQ ID NO: 71320 - DNA, 25 bp, Homo sapien
gcagttttcctggcagctgtccatt

SEQ ID NO: 71321 - DNA, 25 bp, Homo sapien
gcagttttcctggcagttgtccatt

SEQ ID NO: 71322 - DNA, 25 bp, Homo sapien
gcagtttttaatctgtgaacgtgta

SEQ ID NO: 71323 - DNA, 25 bp, Homo sapien
gcagtttttaatttgtgaacgtgta

SEQ ID NO: 71324 - DNA, 25 bp, Homo sapien
gcagtttttcacagcaccttgatga

SEQ ID NO: 71325 - DNA, 25 bp, Homo sapien
gcagtttttcacggcaccttgatga

SEQ ID NO: 71326 - DNA, 25 bp, Homo sapien
gcagtttttgttactattgtttatt

SEQ ID NO: 71327 - DNA, 25 bp, Homo sapien
gcagtttttgttcctattgtttatt

SEQ ID NO: 71328 - DNA, 25 bp, Homo sapien
gcataaaatccaaatctcgagtttt

SEQ ID NO: 71329 - DNA, 25 bp, Homo sapien
gcataaaatccgaatctcgagtttt

SEQ ID NO: 71330 - DNA, 25 bp, Homo sapien
gcataaagacttgacattctgcaca

SEQ ID NO: 71331 - DNA, 25 bp, Homo sapien
gcataaaggcttgacattctgcaca

SEQ ID NO: 71332 - DNA, 25 bp, Homo sapien
gcataaagtgatccgggtgatggag

SEQ ID NO: 71333 - DNA, 25 bp, Homo sapien
gcataaagtgatctgggtgatggag

SEQ ID NO: 71334 - DNA, 25 bp, Homo sapien
gcataactgacagaaatgcagaggc

SEQ ID NO: 71335 - DNA, 25 bp, Homo sapien
gcataactggcagaaatgcagaggc

SEQ ID NO: 71336 - DNA, 25 bp, Homo sapien
gcataagaacaccaacctccaagtt

SEQ ID NO: 71337 - DNA, 25 bp, Homo sapien
gcataagaacacgaacctccaagtt

SEQ ID NO: 71338 - DNA, 25 bp, Homo sapien
gcataagacattgggagaaagatcc

SEQ ID NO: 71339 - DNA, 25 bp, Homo sapien
gcataagaccttgggagaaagatcc

SEQ ID NO: 71340 - DNA, 25 bp, Homo sapien
gcataagatagctcatttacaaaga

SEQ ID NO: 71341 - DNA, 25 bp, Homo sapien
gcataagatggctcatttacaaaga

SEQ ID NO: 71342 - DNA, 25 bp, Homo sapien
gcataagcaaatgtcaaataattga

SEQ ID NO: 71343 - DNA, 25 bp, Homo sapien
gcataagcacatgtcaaataattga

SEQ ID NO: 71344 - DNA, 25 bp, Homo sapien
gcataataaactatttgggcgggat

SEQ ID NO: 71345 - DNA, 25 bp, Homo sapien
gcataataaagatacgtaggtggca

SEQ ID NO: 71346 - DNA, 25 bp, Homo sapien
gcataataacccacgaagacaaaat

SEQ ID NO: 71347 - DNA, 25 bp, Homo sapien
gcataataagccacgaagacaaaat

SEQ ID NO: 71348 - DNA, 25 bp, Homo sapien
gcataataagctatttgggcgggat

SEQ ID NO: 71349 - DNA, 25 bp, Homo sapien
gcataatacagatacgtaggtggca

SEQ ID NO: 71350 - DNA, 25 bp, Homo sapien
gcataatgtgatagacaagaaacag

SEQ ID NO: 71351 - DNA, 25 bp, Homo sapien
gcataatgtgatagccaagaaacag

SEQ ID NO: 71352 - DNA, 25 bp, Homo sapien
gcatacaacataggacaagagtaga

SEQ ID NO: 71353 - DNA, 25 bp, Homo sapien
gcatacaacatagggcaagagtaga

SEQ ID NO: 71354 - DNA, 25 bp, Homo sapien
gcatacaacgatagaaaactcttaa

SEQ ID NO: 71355 - DNA, 25 bp, Homo sapien
gcatacaaggatagaaaactcttaa

SEQ ID NO: 71356 - DNA, 25 bp, Homo sapien
gcatacaatcagaagaggctggaaa

SEQ ID NO: 71357 - DNA, 25 bp, Homo sapien
gcatacaatcagaggaggctggaaa

SEQ ID NO: 71358 - DNA, 25 bp, Homo sapien
gcatacagacagctgaagaacactg

SEQ ID NO: 71359 - DNA, 25 bp, Homo sapien
gcatacagccacgtagggcctcaat

SEQ ID NO: 71360 - DNA, 25 bp, Homo sapien
gcatacagccatgtagggcctcaat

SEQ ID NO: 71361 - DNA, 25 bp, Homo sapien
gcatacaggcagctgaagaacactg

SEQ ID NO: 71362 - DNA, 25 bp, Homo sapien
gcataccacaaaaggaaaagaagga

SEQ ID NO: 71363 - DNA, 25 bp, Homo sapien
gcataccataaaaggaaaagaagga

SEQ ID NO: 71364 - DNA, 25 bp, Homo sapien
gcatacccaacctgaaagaatctaa

SEQ ID NO: 71365 - DNA, 25 bp, Homo sapien
gcatacccatcctgaaagaatctaa

SEQ ID NO: 71366 - DNA, 25 bp, Homo sapien
gcatacgcatctcgcctcaagttgt

SEQ ID NO: 71367 - DNA, 25 bp, Homo sapien
gcatacgcatcttgcctcaagttgt

SEQ ID NO: 71368 - DNA, 25 bp, Homo sapien
gcatacgtctcaaagcagttcctca

SEQ ID NO: 71369 - DNA, 25 bp, Homo sapien
gcatacgtctcaaagcggttcctca

SEQ ID NO: 71370 - DNA, 25 bp, Homo sapien
gcatactactgatctttaaaaattg

SEQ ID NO: 71371 - DNA, 25 bp, Homo sapien
gcatactattgatctttaaaaattg

SEQ ID NO: 71372 - DNA, 25 bp, Homo sapien
gcatactcttttcgttcagccttca

SEQ ID NO: 71373 - DNA, 25 bp, Homo sapien
gcatactctttttgttcagccttca

SEQ ID NO: 71374 - DNA, 25 bp, Homo sapien
gcatactggaatgcataagattaat

SEQ ID NO: 71375 - DNA, 25 bp, Homo sapien
gcatactggaatggataagattaat

SEQ ID NO: 71376 - DNA, 25 bp, Homo sapien
gcatagaaacagaatagatttttgt

SEQ ID NO: 71377 - DNA, 25 bp, Homo sapien
gcatagaaatagaatagatttttgt

SEQ ID NO: 71378 - DNA, 25 bp, Homo sapien
gcatagaacctataatcaactttta

SEQ ID NO: 71379 - DNA, 25 bp, Homo sapien
gcatagaacctatagtcaactttta

SEQ ID NO: 71380 - DNA, 25 bp, Homo sapien
gcatagaccctgcctagcactggag

SEQ ID NO: 71381 - DNA, 25 bp, Homo sapien
gcatagactctgcctagcactggag

SEQ ID NO: 71382 - DNA, 25 bp, Homo sapien
gcatagagcacataagctttcacac

SEQ ID NO: 71383 - DNA, 25 bp, Homo sapien
gcatagagcacgtaagctttcacac

SEQ ID NO: 71384 - DNA, 25 bp, Homo sapien
gcatagagccacgtccagcatcact

SEQ ID NO: 71385 - DNA, 25 bp, Homo sapien
gcatagagccatgtccagcatcact

SEQ ID NO: 71386 - DNA, 25 bp, Homo sapien
gcatagatttttcataatgtactta

SEQ ID NO: 71387 - DNA, 25 bp, Homo sapien
gcatagatttttcgtaatgtactta

SEQ ID NO: 71388 - DNA, 25 bp, Homo sapien
gcatagcaacacgatttctgaaaat

SEQ ID NO: 71389 - DNA, 25 bp, Homo sapien
gcatagcaacatgatttctgaaaat

SEQ ID NO: 71390 - DNA, 25 bp, Homo sapien
gcatagctctacaatggagatttta

SEQ ID NO: 71391 - DNA, 25 bp, Homo sapien
gcatagctctataatggagatttta

SEQ ID NO: 71392 - DNA, 25 bp, Homo sapien
gcatagctcttttactcagattcag

SEQ ID NO: 71393 - DNA, 25 bp, Homo sapien
gcatagcttttttactcagattcag

SEQ ID NO: 71394 - DNA, 25 bp, Homo sapien
gcataggactgtgacaattaatgaa

SEQ ID NO: 71395 - DNA, 25 bp, Homo sapien
gcataggattgtgacaattaatgaa

SEQ ID NO: 71396 - DNA, 25 bp, Homo sapien
gcataggcagtccatcattgaccaa

SEQ ID NO: 71397 - DNA, 25 bp, Homo sapien
gcataggcagtccgtcattgaccaa

SEQ ID NO: 71398 - DNA, 25 bp, Homo sapien
gcatagggtaaatgctacttaactg

SEQ ID NO: 71399 - DNA, 25 bp, Homo sapien
gcatagggtaaatgcttcttaactg

SEQ ID NO: 71400 - DNA, 25 bp, Homo sapien
gcataggttttattcatttccacat

SEQ ID NO: 71401 - DNA, 25 bp, Homo sapien
gcataggttttgttcatttccacat

SEQ ID NO: 71402 - DNA, 25 bp, Homo sapien
gcatagtcaacctgatgaccatctt

SEQ ID NO: 71403 - DNA, 25 bp, Homo sapien
gcatagtcagcctgatgaccatctt

SEQ ID NO: 71404 - DNA, 25 bp, Homo sapien
gcatagtcttctaaagtagtaggag

SEQ ID NO: 71405 - DNA, 25 bp, Homo sapien
gcatagtcttctgaagtagtaggag

SEQ ID NO: 71406 - DNA, 25 bp, Homo sapien
gcatagtgtagcattttaagagtat

SEQ ID NO: 71407 - DNA, 25 bp, Homo sapien
gcatagtgtagctttttaagagtat

SEQ ID NO: 71408 - DNA, 25 bp, Homo sapien
gcatagtgtatcggtattgtgttaa

SEQ ID NO: 71409 - DNA, 25 bp, Homo sapien
gcatagtgtattggtattgtgttaa

SEQ ID NO: 71410 - DNA, 25 bp, Homo sapien
gcatataaggagatggtagtcattt

SEQ ID NO: 71411 - DNA, 25 bp, Homo sapien
gcatataaggagttggtagtcattt

SEQ ID NO: 71412 - DNA, 25 bp, Homo sapien
gcatatacaagttcaggaaagtatt

SEQ ID NO: 71413 - DNA, 25 bp, Homo sapien
gcatatacaggttcaggaaagtatt

SEQ ID NO: 71414 - DNA, 25 bp, Homo sapien
gcatatacatgcgggagaaactcag

SEQ ID NO: 71415 - DNA, 25 bp, Homo sapien
gcatatacatgtgggagaaactcag

SEQ ID NO: 71416 - DNA, 25 bp, Homo sapien
gcatatactcatctgtacaaacaag

SEQ ID NO: 71417 - DNA, 25 bp, Homo sapien
gcatatactcatgtgtacaaacaag

SEQ ID NO: 71418 - DNA, 25 bp, Homo sapien
gcatatagaatatctgaaccgaggc

SEQ ID NO: 71419 - DNA, 25 bp, Homo sapien
gcatatagaatgtctgaaccgaggc

SEQ ID NO: 71420 - DNA, 25 bp, Homo sapien
gcatatagtaagcaatgaaaagtag

SEQ ID NO: 71421 - DNA, 25 bp, Homo sapien
gcatatagtaagcactgaaaagtag

SEQ ID NO: 71422 - DNA, 25 bp, Homo sapien
gcatatagttgcatcttgaagaaag

SEQ ID NO: 71423 - DNA, 25 bp, Homo sapien
gcatatagttgcgtcttgaagaaag

SEQ ID NO: 71424 - DNA, 25 bp, Homo sapien
gcatatgaaccatttacttctaaaa

SEQ ID NO: 71425 - DNA, 25 bp, Homo sapien
gcatatgaaccgtttacttctaaaa

SEQ ID NO: 71426 - DNA, 25 bp, Homo sapien
gcatatgactgtctctattatatgc

SEQ ID NO: 71427 - DNA, 25 bp, Homo sapien
gcatatgattgtctctattatatgc

SEQ ID NO: 71428 - DNA, 25 bp, Homo sapien
gcatatgctttattatgtatgcata

SEQ ID NO: 71429 - DNA, 25 bp, Homo sapien
gcatatgctttgcagtaacatggga

SEQ ID NO: 71430 - DNA, 25 bp, Homo sapien
gcatatgctttgtagtaacatggga

SEQ ID NO: 71431 - DNA, 25 bp, Homo sapien
gcatatgctttgttatgtatgcata

SEQ ID NO: 71432 - DNA, 25 bp, Homo sapien
gcatatggcatctcctcagcttgga

SEQ ID NO: 71433 - DNA, 25 bp, Homo sapien
gcatatggcatttcctcagcttgga

SEQ ID NO: 71434 - DNA, 25 bp, Homo sapien
gcatatggcttccaatttgagctcc

SEQ ID NO: 71435 - DNA, 25 bp, Homo sapien
gcatatggctttcaatttgagctcc

SEQ ID NO: 71436 - DNA, 25 bp, Homo sapien
gcatatgtaaaacaggaaagcattt

SEQ ID NO: 71437 - DNA, 25 bp, Homo sapien
gcatatgtacaacaggaaagcattt

SEQ ID NO: 71438 - DNA, 25 bp, Homo sapien
gcatattaatcacagttgttttaaa

SEQ ID NO: 71439 - DNA, 25 bp, Homo sapien
gcatattaatcatagttgttttaaa

SEQ ID NO: 71440 - DNA, 25 bp, Homo sapien
gcatattcctagatatggtagctat

SEQ ID NO: 71441 - DNA, 25 bp, Homo sapien
gcatattcctagctatggtagctat

SEQ ID NO: 71442 - DNA, 25 bp, Homo sapien
gcatattctagcctgttaggtgaac

SEQ ID NO: 71443 - DNA, 25 bp, Homo sapien
gcatattctagtctgttaggtgaac

SEQ ID NO: 71444 - DNA, 25 bp, Homo sapien
gcatattgtcataatcacttcattt

SEQ ID NO: 71445 - DNA, 25 bp, Homo sapien
gcatattgtcatgatcacttcattt

SEQ ID NO: 71446 - DNA, 25 bp, Homo sapien
gcatatttccgaagttttgccaact

SEQ ID NO: 71447 - DNA, 25 bp, Homo sapien
gcatatttctgaagttttgccaact

SEQ ID NO: 71448 - DNA, 25 bp, Homo sapien
gcatcacaaacatctaagtttctaa

SEQ ID NO: 71449 - DNA, 25 bp, Homo sapien
gcatcacaaacatttaagtttctaa

SEQ ID NO: 71450 - DNA, 25 bp, Homo sapien
gcatcactcctatatctgcctccgc

SEQ ID NO: 71451 - DNA, 25 bp, Homo sapien
gcatcactcgtatatctgcctccgc

SEQ ID NO: 71452 - DNA, 25 bp, Homo sapien
gcatcactgttttattcgtccagaa

SEQ ID NO: 71453 - DNA, 25 bp, Homo sapien
gcatcactgttttatttgtccagaa

SEQ ID NO: 71454 - DNA, 25 bp, Homo sapien
gcatcagaacagctggatccaagta

SEQ ID NO: 71455 - DNA, 25 bp, Homo sapien
gcatcagaacaggtggatccaagta

SEQ ID NO: 71456 - DNA, 25 bp, Homo sapien
gcatcagaatctcacgtgggaggga

SEQ ID NO: 71457 - DNA, 25 bp, Homo sapien
gcatcagaatctcaggtgggaggga

SEQ ID NO: 71458 - DNA, 25 bp, Homo sapien
gcatcagagaatcaatgtattcctt

SEQ ID NO: 71459 - DNA, 25 bp, Homo sapien
gcatcagagaatcagtgtattcctt

SEQ ID NO: 71460 - DNA, 25 bp, Homo sapien
gcatcagcccatgcccacttcaatc

SEQ ID NO: 71461 - DNA, 25 bp, Homo sapien
gcatcagcccatgccctcttcaatc

SEQ ID NO: 71462 - DNA, 25 bp, Homo sapien
gcatcaggccagctgcaaatcgctc

SEQ ID NO: 71463 - DNA, 25 bp, Homo sapien
gcatcaggctagctgcaaatcgctc

SEQ ID NO: 71464 - DNA, 25 bp, Homo sapien
gcatcagggcaaagaagacaggcat

SEQ ID NO: 71465 - DNA, 25 bp, Homo sapien
gcatcagggcatagaagacaggcat

SEQ ID NO: 71466 - DNA, 25 bp, Homo sapien
gcatcagttgatctcttttcatgtt

SEQ ID NO: 71467 - DNA, 25 bp, Homo sapien
gcatcagttgatttcttttcatgtt

SEQ ID NO: 71468 - DNA, 25 bp, Homo sapien
gcatcagttttcagcgatcaggaag

SEQ ID NO: 71469 - DNA, 25 bp, Homo sapien
gcatcagttttcagggatcaggaag

SEQ ID NO: 71470 - DNA, 25 bp, Homo sapien
gcatcataacttattaacagtgatt

SEQ ID NO: 71471 - DNA, 25 bp, Homo sapien
gcatcataagttattaacagtgatt

SEQ ID NO: 71472 - DNA, 25 bp, Homo sapien
gcatcatacaataagtgacaaaact

SEQ ID NO: 71473 - DNA, 25 bp, Homo sapien
gcatcatataataagtgacaaaact

SEQ ID NO: 71474 - DNA, 25 bp, Homo sapien
gcatcatgttatatactgatcacac

SEQ ID NO: 71475 - DNA, 25 bp, Homo sapien
gcatcatgttatgtactgatcacac

SEQ ID NO: 71476 - DNA, 25 bp, Homo sapien
gcatcattggtgcaaatgcaggtat

SEQ ID NO: 71477 - DNA, 25 bp, Homo sapien
gcatcattggtgcagatgcaggtat

SEQ ID NO: 71478 - DNA, 25 bp, Homo sapien
gcatccaccgggagcttttctcccc

SEQ ID NO: 71479 - DNA, 25 bp, Homo sapien
gcatccactgggagcttttctcccc

SEQ ID NO: 71480 - DNA, 25 bp, Homo sapien
gcatccacttggagaacgttttttt

SEQ ID NO: 71481 - DNA, 25 bp, Homo sapien
gcatccacttggagaatgttttttt

SEQ ID NO: 71482 - DNA, 25 bp, Homo sapien
gcatccaggtgagtgacactgtcca

SEQ ID NO: 71483 - DNA, 25 bp, Homo sapien
gcatccaggtgagtgatactgtcca

SEQ ID NO: 71484 - DNA, 25 bp, Homo sapien
gcatccatacataggtgcattagta

SEQ ID NO: 71485 - DNA, 25 bp, Homo sapien
gcatccatacatatgtgcattagta

SEQ ID NO: 71486 - DNA, 25 bp, Homo sapien
gcatcccaaatatcgtctagtgtag

SEQ ID NO: 71487 - DNA, 25 bp, Homo sapien
gcatcccaaatatcttctagtgtag

SEQ ID NO: 71488 - DNA, 25 bp, Homo sapien
gcatcccaataacggtgtgcccttc

SEQ ID NO: 71489 - DNA, 25 bp, Homo sapien
gcatcccaataatggtgtgcccttc

SEQ ID NO: 71490 - DNA, 25 bp, Homo sapien
gcatcctgcaacgcacagtccccca

SEQ ID NO: 71491 - DNA, 25 bp, Homo sapien
gcatcctgcaatgcacagtccccca

SEQ ID NO: 71492 - DNA, 25 bp, Homo sapien
gcatccttaactcaacattattaca

SEQ ID NO: 71493 - DNA, 25 bp, Homo sapien
gcatccttagctcaacattattaca

SEQ ID NO: 71494 - DNA, 25 bp, Homo sapien
gcatctaacacatgcttgaaagaat

SEQ ID NO: 71495 - DNA, 25 bp, Homo sapien
gcatctaacccatgcttgaaagaat

SEQ ID NO: 71496 - DNA, 25 bp, Homo sapien
gcatctaggataagacgaaaacgaa

SEQ ID NO: 71497 - DNA, 25 bp, Homo sapien
gcatctaggatgagacgaaaacgaa

SEQ ID NO: 71498 - DNA, 25 bp, Homo sapien
gcatctatactatgtcaggtgccat

SEQ ID NO: 71499 - DNA, 25 bp, Homo sapien
gcatctatactgtgtcaggtgccat

SEQ ID NO: 71500 - DNA, 25 bp, Homo sapien
gcatctcaaataaaatatttcaaaa

SEQ ID NO: 71501 - DNA, 25 bp, Homo sapien
gcatctcaaataaagtatttcaaaa

SEQ ID NO: 71502 - DNA, 25 bp, Homo sapien
gcatctcagccctgagagtccttgc

SEQ ID NO: 71503 - DNA, 25 bp, Homo sapien
gcatctcagccctgagggtccttgc

SEQ ID NO: 71504 - DNA, 25 bp, Homo sapien
gcatctggtaagggtcatcccatgg

SEQ ID NO: 71505 - DNA, 25 bp, Homo sapien
gcatctggtgagggtcatcccatgg

SEQ ID NO: 71506 - DNA, 25 bp, Homo sapien
gcatctgttaatgtaaatgtatttt

SEQ ID NO: 71507 - DNA, 25 bp, Homo sapien
gcatctgttaatgtgaatgtatttt

SEQ ID NO: 71508 - DNA, 25 bp, Homo sapien
gcatcttacttcatgagaaatgcat

SEQ ID NO: 71509 - DNA, 25 bp, Homo sapien
gcatcttactttatgagaaatgcat

SEQ ID NO: 71510 - DNA, 25 bp, Homo sapien
gcatcttattccatggacatcaggc

SEQ ID NO: 71511 - DNA, 25 bp, Homo sapien
gcatcttattccgtggacatcaggc

SEQ ID NO: 71512 - DNA, 25 bp, Homo sapien
gcatcttcgtcgtctcctatcactc

SEQ ID NO: 71513 - DNA, 25 bp, Homo sapien
gcatcttcttcgtctcctatcactc

SEQ ID NO: 71514 - DNA, 25 bp, Homo sapien
gcatctttacaaaaagaaaaaatta

SEQ ID NO: 71515 - DNA, 25 bp, Homo sapien
gcatctttacaaaaaggaaaaatta

SEQ ID NO: 71516 - DNA, 25 bp, Homo sapien
gcatctttataacagtgtcttattt

SEQ ID NO: 71517 - DNA, 25 bp, Homo sapien
gcatctttataatagtgtcttattt

SEQ ID NO: 71518 - DNA, 25 bp, Homo sapien
gcatctttgttgatctaccaatctc

SEQ ID NO: 71519 - DNA, 25 bp, Homo sapien
gcatctttgttggtctaccaatctc

SEQ ID NO: 71520 - DNA, 25 bp, Homo sapien
gcatcttttagactggtggttgtca

SEQ ID NO: 71521 - DNA, 25 bp, Homo sapien
gcatcttttagattggtggttgtca

SEQ ID NO: 71522 - DNA, 25 bp, Homo sapien
gcatgaaaatgatttagtagcaagg

SEQ ID NO: 71523 - DNA, 25 bp, Homo sapien
gcatgaaactgatttagtagcaagg

SEQ ID NO: 71524 - DNA, 25 bp, Homo sapien
gcatgaagcagccggaaagatctat

SEQ ID NO: 71525 - DNA, 25 bp, Homo sapien
gcatgaagcagctggaaagatctat

SEQ ID NO: 71526 - DNA, 25 bp, Homo sapien
gcatgacaattaccacactataaac

SEQ ID NO: 71527 - DNA, 25 bp, Homo sapien
gcatgacaattactacactataaac

SEQ ID NO: 71528 - DNA, 25 bp, Homo sapien
gcatgacagatcattctctaaccct

SEQ ID NO: 71529 - DNA, 25 bp, Homo sapien
gcatgacagatcgttctctaaccct

SEQ ID NO: 71530 - DNA, 25 bp, Homo sapien
gcatgacatattcaaagtgctaaaa

SEQ ID NO: 71531 - DNA, 25 bp, Homo sapien
gcatgacatattcgaagtgctaaaa

SEQ ID NO: 71532 - DNA, 25 bp, Homo sapien
gcatgagaaatggcctctccgtgag

SEQ ID NO: 71533 - DNA, 25 bp, Homo sapien
gcatgagaaatggtctctccgtgag

SEQ ID NO: 71534 - DNA, 25 bp, Homo sapien
gcatgaggttaaagaaaaactgtgg

SEQ ID NO: 71535 - DNA, 25 bp, Homo sapien
gcatgaggttaaagcaaaactgtgg

SEQ ID NO: 71536 - DNA, 25 bp, Homo sapien
gcatgagtccaactgaaaaaattga

SEQ ID NO: 71537 - DNA, 25 bp, Homo sapien
gcatgagtccagctgaaaaaattga

SEQ ID NO: 71538 - DNA, 25 bp, Homo sapien
gcatgatacaacatatgaacttgta

SEQ ID NO: 71539 - DNA, 25 bp, Homo sapien
gcatgatacaacttatgaacttgta

SEQ ID NO: 71540 - DNA, 25 bp, Homo sapien
gcatgatctgacagaggaaactctg

SEQ ID NO: 71541 - DNA, 25 bp, Homo sapien
gcatgatctgatagaggaaactctg

SEQ ID NO: 71542 - DNA, 25 bp, Homo sapien
gcatgatgacaaattaacacctaaa

SEQ ID NO: 71543 - DNA, 25 bp, Homo sapien
gcatgatgacaagttaacacctaaa

SEQ ID NO: 71544 - DNA, 25 bp, Homo sapien
gcatgcaatagatccagggtgtatg

SEQ ID NO: 71545 - DNA, 25 bp, Homo sapien
gcatgcaatggatccagggtgtatg

SEQ ID NO: 71546 - DNA, 25 bp, Homo sapien
gcatgcactgtaataccagtccaat

SEQ ID NO: 71547 - DNA, 25 bp, Homo sapien
gcatgcactttaataccagtccaat

SEQ ID NO: 71548 - DNA, 25 bp, Homo sapien
gcatgcatacttatatggccaatag

SEQ ID NO: 71549 - DNA, 25 bp, Homo sapien
gcatgcatacttatttggccaatag

SEQ ID NO: 71550 - DNA, 25 bp, Homo sapien
gcatgcattcccaggcttgtcatgt

SEQ ID NO: 71551 - DNA, 25 bp, Homo sapien
gcatgcatttccaggcttgtcatgt

SEQ ID NO: 71552 - DNA, 25 bp, Homo sapien
gcatgccactaaaactggccaatta

SEQ ID NO: 71553 - DNA, 25 bp, Homo sapien
gcatgccactaaatctggccaatta

SEQ ID NO: 71554 - DNA, 25 bp, Homo sapien
gcatgccagacaaagagaagattca

SEQ ID NO: 71555 - DNA, 25 bp, Homo sapien
gcatgccagacatagagaagattca

SEQ ID NO: 71556 - DNA, 25 bp, Homo sapien
gcatgcccacttagtaatgaaaaca

SEQ ID NO: 71557 - DNA, 25 bp, Homo sapien
gcatgccctcttagtaatgaaaaca

SEQ ID NO: 71558 - DNA, 25 bp, Homo sapien
gcatgccggttacgtcctcactgtt

SEQ ID NO: 71559 - DNA, 25 bp, Homo sapien
gcatgccggttgcgtcctcactgtt

SEQ ID NO: 71560 - DNA, 25 bp, Homo sapien
gcatgcctggcaacgttctgggtgc

SEQ ID NO: 71561 - DNA, 25 bp, Homo sapien
gcatgcctggcaatgttctgggtgc

SEQ ID NO: 71562 - DNA, 25 bp, Homo sapien
gcatgccttatggcaatgtagaaga

SEQ ID NO: 71563 - DNA, 25 bp, Homo sapien
gcatgccttattgcaatgtagaaga

SEQ ID NO: 71564 - DNA, 25 bp, Homo sapien
gcatgctaattgtatgggatcactt

SEQ ID NO: 71565 - DNA, 25 bp, Homo sapien
gcatgctaattgtgtgggatcactt

SEQ ID NO: 71566 - DNA, 25 bp, Homo sapien
gcatgctctaatcactgaattaaat

SEQ ID NO: 71567 - DNA, 25 bp, Homo sapien
gcatgctctaatcattgaattaaat

SEQ ID NO: 71568 - DNA, 25 bp, Homo sapien
gcatgctggattccgcagtgccaaa

SEQ ID NO: 71569 - DNA, 25 bp, Homo sapien
gcatgctggattccgcggtgccaaa

SEQ ID NO: 71570 - DNA, 25 bp, Homo sapien
gcatgcttattttctaacgtcataa

SEQ ID NO: 71571 - DNA, 25 bp, Homo sapien
gcatgcttattttgtaacgtcataa

SEQ ID NO: 71572 - DNA, 25 bp, Homo sapien
gcatgcttcatcacatagccacctt

SEQ ID NO: 71573 - DNA, 25 bp, Homo sapien
gcatgcttcgtcacatagccacctt

SEQ ID NO: 71574 - DNA, 25 bp, Homo sapien
gcatggaactttggtcaaaccaaaa

SEQ ID NO: 71575 - DNA, 25 bp, Homo sapien
gcatggaacttttgtcaaaccaaaa

SEQ ID NO: 71576 - DNA, 25 bp, Homo sapien
gcatggaagccactgggttcatcct

SEQ ID NO: 71577 - DNA, 25 bp, Homo sapien
gcatggaagccattgggttcatcct

SEQ ID NO: 71578 - DNA, 25 bp, Homo sapien
gcatggaatgcttcaggatggccaa

SEQ ID NO: 71579 - DNA, 25 bp, Homo sapien
gcatggaatgctttaggatggccaa

SEQ ID NO: 71580 - DNA, 25 bp, Homo sapien
gcatggagattgtggcatttgggcc

SEQ ID NO: 71581 - DNA, 25 bp, Homo sapien
gcatggagattgtggcgtttgggcc

SEQ ID NO: 71582 - DNA, 25 bp, Homo sapien
gcatggcggagcttggttttcccac

SEQ ID NO: 71583 - DNA, 25 bp, Homo sapien
gcatggcggaggttggttttcccac

SEQ ID NO: 71584 - DNA, 25 bp, Homo sapien
gcatggctcacccacaagtcagtga

SEQ ID NO: 71585 - DNA, 25 bp, Homo sapien
gcatggctcacccagaagtcagtga

SEQ ID NO: 71586 - DNA, 25 bp, Homo sapien
gcatggctggattcacagacccctt

SEQ ID NO: 71587 - DNA, 25 bp, Homo sapien
gcatggcttgattcacagacccctt

SEQ ID NO: 71588 - DNA, 25 bp, Homo sapien
gcatgggcaaatttaatgtaagagg

SEQ ID NO: 71589 - DNA, 25 bp, Homo sapien
gcatgggcaaatttgatgtaagagg

SEQ ID NO: 71590 - DNA, 25 bp, Homo sapien
gcatgggcagaaacttaatgactaa

SEQ ID NO: 71591 - DNA, 25 bp, Homo sapien
gcatgggcagaaccttaatgactaa

SEQ ID NO: 71592 - DNA, 25 bp, Homo sapien
gcatggggtaccttcatcggactca

SEQ ID NO: 71593 - DNA, 25 bp, Homo sapien
gcatggggtacctttatcggactca

SEQ ID NO: 71594 - DNA, 25 bp, Homo sapien
gcatggtatcaactgttcagatagc

SEQ ID NO: 71595 - DNA, 25 bp, Homo sapien
gcatggtatcaagtgttcagatagc

SEQ ID NO: 71596 - DNA, 25 bp, Homo sapien
gcatggtcattatccttttaccaca

SEQ ID NO: 71597 - DNA, 25 bp, Homo sapien
gcatggtcgttatccttttaccaca

SEQ ID NO: 71598 - DNA, 25 bp, Homo sapien
gcatggtctcactaagaaccaggac

SEQ ID NO: 71599 - DNA, 25 bp, Homo sapien
gcatggtctcattaagaaccaggac

SEQ ID NO: 71600 - DNA, 25 bp, Homo sapien
gcatggttccagaaactccacagaa

SEQ ID NO: 71601 - DNA, 25 bp, Homo sapien
gcatggttccaggaactccacagaa

SEQ ID NO: 71602 - DNA, 25 bp, Homo sapien
gcatggttctatgaaggatttgata

SEQ ID NO: 71603 - DNA, 25 bp, Homo sapien
gcatggttgtgcttgaatgatagag

SEQ ID NO: 71604 - DNA, 25 bp, Homo sapien
gcatggttgtggttgaatgatagag

SEQ ID NO: 71605 - DNA, 25 bp, Homo sapien
gcatggttttatgaaggatttgata

SEQ ID NO: 71606 - DNA, 25 bp, Homo sapien
gcatgtacacaaacactcactgacc

SEQ ID NO: 71607 - DNA, 25 bp, Homo sapien
gcatgtacacaaacgctcactgacc

SEQ ID NO: 71608 - DNA, 25 bp, Homo sapien
gcatgtacacaatatgttttcttta

SEQ ID NO: 71609 - DNA, 25 bp, Homo sapien
gcatgtacacattatgttttcttta

SEQ ID NO: 71610 - DNA, 25 bp, Homo sapien
gcatgtactctccacgccataattt

SEQ ID NO: 71611 - DNA, 25 bp, Homo sapien
gcatgtactctccacggcataattt

SEQ ID NO: 71612 - DNA, 25 bp, Homo sapien
gcatgtatcatctgtttacatgtgg

SEQ ID NO: 71613 - DNA, 25 bp, Homo sapien
gcatgtatgatctgtttacatgtgg

SEQ ID NO: 71614 - DNA, 25 bp, Homo sapien
gcatgtccagaaataaaatccgagg

SEQ ID NO: 71615 - DNA, 25 bp, Homo sapien
gcatgtccagaaataacatccgagg

SEQ ID NO: 71616 - DNA, 25 bp, Homo sapien
gcatgtccatcctccatatttattc

SEQ ID NO: 71617 - DNA, 25 bp, Homo sapien
gcatgtcccctcacgggtgcaagct

SEQ ID NO: 71618 - DNA, 25 bp, Homo sapien
gcatgtcccctcatgggtgcaagct

SEQ ID NO: 71619 - DNA, 25 bp, Homo sapien
gcatgtccgtcctccatatttattc

SEQ ID NO: 71620 - DNA, 25 bp, Homo sapien
gcatgtcgaaaactgagaaaggcca

SEQ ID NO: 71621 - DNA, 25 bp, Homo sapien
gcatgtcgaaagctgagaaaggcca

SEQ ID NO: 71622 - DNA, 25 bp, Homo sapien
gcatgtctaataaagggtcaaggtg

SEQ ID NO: 71623 - DNA, 25 bp, Homo sapien
gcatgtctaataaatggtcaaggtg

SEQ ID NO: 71624 - DNA, 25 bp, Homo sapien
gcatgtcttcaatgctctggcagac

SEQ ID NO: 71625 - DNA, 25 bp, Homo sapien
gcatgtctttaatgctctggcagac

SEQ ID NO: 71626 - DNA, 25 bp, Homo sapien
gcatgtctttccccgtcgactgact

SEQ ID NO: 71627 - DNA, 25 bp, Homo sapien
gcatgtctttccctgtcgactgact

SEQ ID NO: 71628 - DNA, 25 bp, Homo sapien
gcatgtgataccacacgggactcat

SEQ ID NO: 71629 - DNA, 25 bp, Homo sapien
gcatgtgataccgcacgggactcat

SEQ ID NO: 71630 - DNA, 25 bp, Homo sapien
gcatgtgcatgagtctgtgtaccct

SEQ ID NO: 71631 - DNA, 25 bp, Homo sapien
gcatgtgcgtgagtctgtgtaccct

SEQ ID NO: 71632 - DNA, 25 bp, Homo sapien
gcatgtttaggttgcgctaaaattt

SEQ ID NO: 71633 - DNA, 25 bp, Homo sapien
gcatgtttaggttgtgctaaaattt

SEQ ID NO: 71634 - DNA, 25 bp, Homo sapien
gcatgtttcaaatgtatgaatccct

SEQ ID NO: 71635 - DNA, 25 bp, Homo sapien
gcatgtttcaaatttatgaatccct

SEQ ID NO: 71636 - DNA, 25 bp, Homo sapien
gcatgtttctgcgaagaactcaaga

SEQ ID NO: 71637 - DNA, 25 bp, Homo sapien
gcatgtttctgctaagaactcaaga

SEQ ID NO: 71638 - DNA, 25 bp, Homo sapien
gcattaaaggttgagttttccttag

SEQ ID NO: 71639 - DNA, 25 bp, Homo sapien
gcattaaaggttgatttttccttag

SEQ ID NO: 71640 - DNA, 25 bp, Homo sapien
gcattaaagttactggtgctttaag

SEQ ID NO: 71641 - DNA, 25 bp, Homo sapien
gcattaaagttattggtgctttaag

SEQ ID NO: 71642 - DNA, 25 bp, Homo sapien
gcattaagcactgaagagaaagaaa

SEQ ID NO: 71643 - DNA, 25 bp, Homo sapien
gcattaagcattttataaagtaatg

SEQ ID NO: 71644 - DNA, 25 bp, Homo sapien
gcattaagcgctgaagagaaagaaa

SEQ ID NO: 71645 - DNA, 25 bp, Homo sapien
gcattaagcgttttataaagtaatg

SEQ ID NO: 71646 - DNA, 25 bp, Homo sapien
gcattaaggactaagacaatgttgt

SEQ ID NO: 71647 - DNA, 25 bp, Homo sapien
gcattaaggactgagacaatgttgt

SEQ ID NO: 71648 - DNA, 25 bp, Homo sapien
gcattaatcgaaagtttgaaagtgt

SEQ ID NO: 71649 - DNA, 25 bp, Homo sapien
gcattaatgactttatagaggcaaa

SEQ ID NO: 71650 - DNA, 25 bp, Homo sapien
gcattaatgactttatggaggcaaa

SEQ ID NO: 71651 - DNA, 25 bp, Homo sapien
gcattaatgtaatcccacgtaagtt

SEQ ID NO: 71652 - DNA, 25 bp, Homo sapien
gcattaatgtaatcccgcgtaagtt

SEQ ID NO: 71653 - DNA, 25 bp, Homo sapien
gcattaattgaaagtttgaaagtgt

SEQ ID NO: 71654 - DNA, 25 bp, Homo sapien
gcattacacactgcacaccatcttc

SEQ ID NO: 71655 - DNA, 25 bp, Homo sapien
gcattacacactgcacgccatcttc

SEQ ID NO: 71656 - DNA, 25 bp, Homo sapien
gcattacacctatgggtcttaaaat

SEQ ID NO: 71657 - DNA, 25 bp, Homo sapien
gcattacatctatgggtcttaaaat

SEQ ID NO: 71658 - DNA, 25 bp, Homo sapien
gcattagattctcagaggtgcgtca

SEQ ID NO: 71659 - DNA, 25 bp, Homo sapien
gcattagattctcataggtgcgtca

SEQ ID NO: 71660 - DNA, 25 bp, Homo sapien
gcattatatcaatttttctacatgt

SEQ ID NO: 71661 - DNA, 25 bp, Homo sapien
gcattatatcagtttttctacatgt

SEQ ID NO: 71662 - DNA, 25 bp, Homo sapien
gcattattcacaatacccaatatat

SEQ ID NO: 71663 - DNA, 25 bp, Homo sapien
gcattattcacagtacccaatatat

SEQ ID NO: 71664 - DNA, 25 bp, Homo sapien
gcattcaatatagccatttatgaaa

SEQ ID NO: 71665 - DNA, 25 bp, Homo sapien
gcattcaatatcattgttcatcatt

SEQ ID NO: 71666 - DNA, 25 bp, Homo sapien
gcattcaatatcgccatttatgaaa

SEQ ID NO: 71667 - DNA, 25 bp, Homo sapien
gcattcaatatcgttgttcatcatt

SEQ ID NO: 71668 - DNA, 25 bp, Homo sapien
gcattcaccgacaggggagcttctg

SEQ ID NO: 71669 - DNA, 25 bp, Homo sapien
gcattcactgacaggggagcttctg

SEQ ID NO: 71670 - DNA, 25 bp, Homo sapien
gcattcagatacacatgaagatttc

SEQ ID NO: 71671 - DNA, 25 bp, Homo sapien
gcattcagatatacatgaagatttc

SEQ ID NO: 71672 - DNA, 25 bp, Homo sapien
gcattcaggcacagtgctctcctgc

SEQ ID NO: 71673 - DNA, 25 bp, Homo sapien
gcattcagtcacagtgctctcctgc

SEQ ID NO: 71674 - DNA, 25 bp, Homo sapien
gcattcatgacactgaaaccagagt

SEQ ID NO: 71675 - DNA, 25 bp, Homo sapien
gcattcatgccactgaaaccagagt

SEQ ID NO: 71676 - DNA, 25 bp, Homo sapien
gcattcatttacacttactgacaac

SEQ ID NO: 71677 - DNA, 25 bp, Homo sapien
gcattcatttacagttactgacaac

SEQ ID NO: 71678 - DNA, 25 bp, Homo sapien
gcattccattttacaatcagacagt

SEQ ID NO: 71679 - DNA, 25 bp, Homo sapien
gcattccattttataatcagacagt

SEQ ID NO: 71680 - DNA, 25 bp, Homo sapien
gcattccgtttacaaagggaaagaa

SEQ ID NO: 71681 - DNA, 25 bp, Homo sapien
gcattccgtttaccaagggaaagaa

SEQ ID NO: 71682 - DNA, 25 bp, Homo sapien
gcattcctcacttctactcactaga

SEQ ID NO: 71683 - DNA, 25 bp, Homo sapien
gcattcctcgcttctactcactaga

SEQ ID NO: 71684 - DNA, 25 bp, Homo sapien
gcattcctggaaaactcagtgtaca

SEQ ID NO: 71685 - DNA, 25 bp, Homo sapien
gcattcctggaaaattcagtgtaca

SEQ ID NO: 71686 - DNA, 25 bp, Homo sapien
gcattcgagtcaacacattcttctt

SEQ ID NO: 71687 - DNA, 25 bp, Homo sapien
gcattcgattcaacacattcttctt

SEQ ID NO: 71688 - DNA, 25 bp, Homo sapien
gcattcgcaacctaagcccactctc

SEQ ID NO: 71689 - DNA, 25 bp, Homo sapien
gcattcgcaacttaagcccactctc

SEQ ID NO: 71690 - DNA, 25 bp, Homo sapien
gcattctaaagaataaagtcatgta

SEQ ID NO: 71691 - DNA, 25 bp, Homo sapien
gcattctaaagagtaaagtcatgta

SEQ ID NO: 71692 - DNA, 25 bp, Homo sapien
gcattctattggcaaggctgcgagg

SEQ ID NO: 71693 - DNA, 25 bp, Homo sapien
gcattctattgtcaaggctgcgagg

SEQ ID NO: 71694 - DNA, 25 bp, Homo sapien
gcattctctctgcagattcacctat

SEQ ID NO: 71695 - DNA, 25 bp, Homo sapien
gcattctctctgcggattcacctat

SEQ ID NO: 71696 - DNA, 25 bp, Homo sapien
gcattctgagactccgcataccaga

SEQ ID NO: 71697 - DNA, 25 bp, Homo sapien
gcattctgagactccgtataccaga

SEQ ID NO: 71698 - DNA, 25 bp, Homo sapien
gcattctgagcaggtatacaagaaa

SEQ ID NO: 71699 - DNA, 25 bp, Homo sapien
gcattctgagcgggtatacaagaaa

SEQ ID NO: 71700 - DNA, 25 bp, Homo sapien
gcattcttgctgtgttcttctcgag

SEQ ID NO: 71701 - DNA, 25 bp, Homo sapien
gcattcttgctgtgtttttctcgag

SEQ ID NO: 71702 - DNA, 25 bp, Homo sapien
gcattgagagctatatcttttcata

SEQ ID NO: 71703 - DNA, 25 bp, Homo sapien
gcattgagagctgtatcttttcata

SEQ ID NO: 71704 - DNA, 25 bp, Homo sapien
gcattgattaccgataaaagtttgt

SEQ ID NO: 71705 - DNA, 25 bp, Homo sapien
gcattgattaccggtaaaagtttgt

SEQ ID NO: 71706 - DNA, 25 bp, Homo sapien
gcattgatttctcgcactgagtcta

SEQ ID NO: 71707 - DNA, 25 bp, Homo sapien
gcattgatttctggcactgagtcta

SEQ ID NO: 71708 - DNA, 25 bp, Homo sapien
gcattggacacactgatcaatcatg

SEQ ID NO: 71709 - DNA, 25 bp, Homo sapien
gcattggacactctgatcaatcatg

SEQ ID NO: 71710 - DNA, 25 bp, Homo sapien
gcattggggaagtaccctcggatca

SEQ ID NO: 71711 - DNA, 25 bp, Homo sapien
gcattggggaagtcccctcggatca

SEQ ID NO: 71712 - DNA, 25 bp, Homo sapien
gcattgtcctctatggagttgtgtc

SEQ ID NO: 71713 - DNA, 25 bp, Homo sapien
gcattgtcctctgtggagttgtgtc

SEQ ID NO: 71714 - DNA, 25 bp, Homo sapien
gcattgtctgacgtgattctaaatg

SEQ ID NO: 71715 - DNA, 25 bp, Homo sapien
gcattgtctgatgtgattctaaatg

SEQ ID NO: 71716 - DNA, 25 bp, Homo sapien
gcattgtgaaaaaatagatggaagg

SEQ ID NO: 71717 - DNA, 25 bp, Homo sapien
gcattgtgaaaagatagatggaagg

SEQ ID NO: 71718 - DNA, 25 bp, Homo sapien
gcattgtgccgcaacagctgttagc

SEQ ID NO: 71719 - DNA, 25 bp, Homo sapien
gcattgtgctgcaacagctgttagc

SEQ ID NO: 71720 - DNA, 25 bp, Homo sapien
gcattgtgtatagttgctgatcatg

SEQ ID NO: 71721 - DNA, 25 bp, Homo sapien
gcattgtgtgtagttgctgatcatg

SEQ ID NO: 71722 - DNA, 25 bp, Homo sapien
gcattgttctacctttcagtgctca

SEQ ID NO: 71723 - DNA, 25 bp, Homo sapien
gcattgttcttactcctagatattt

SEQ ID NO: 71724 - DNA, 25 bp, Homo sapien
gcattgttcttactgctagatattt

SEQ ID NO: 71725 - DNA, 25 bp, Homo sapien
gcattgttttacctttcagtgctca

SEQ ID NO: 71726 - DNA, 25 bp, Homo sapien
gcatttaaccccttggtgatgaatt

SEQ ID NO: 71727 - DNA, 25 bp, Homo sapien
gcatttaacccgttggtgatgaatt

SEQ ID NO: 71728 - DNA, 25 bp, Homo sapien
gcatttacaagctcagtgtccctag

SEQ ID NO: 71729 - DNA, 25 bp, Homo sapien
gcatttacagtttagtcagagtcaa

SEQ ID NO: 71730 - DNA, 25 bp, Homo sapien
gcatttacagtttagttagagtcaa

SEQ ID NO: 71731 - DNA, 25 bp, Homo sapien
gcatttacgagctcagtgtccctag

SEQ ID NO: 71732 - DNA, 25 bp, Homo sapien
gcatttagaaagatcaccatgcatg

SEQ ID NO: 71733 - DNA, 25 bp, Homo sapien
gcatttagaaagatcatcatgcatg

SEQ ID NO: 71734 - DNA, 25 bp, Homo sapien
gcatttatatcaggtctcttcacaa

SEQ ID NO: 71735 - DNA, 25 bp, Homo sapien
gcatttatatctggtctcttcacaa

SEQ ID NO: 71736 - DNA, 25 bp, Homo sapien
gcatttatccttccagaaggtttga

SEQ ID NO: 71737 - DNA, 25 bp, Homo sapien
gcatttattcttccagaaggtttga

SEQ ID NO: 71738 - DNA, 25 bp, Homo sapien
gcatttatttctcaaagttctggag

SEQ ID NO: 71739 - DNA, 25 bp, Homo sapien
gcatttatttctgaaagttctggag

SEQ ID NO: 71740 - DNA, 25 bp, Homo sapien
gcatttcactttaatgaatctctat

SEQ ID NO: 71741 - DNA, 25 bp, Homo sapien
gcatttcagtttaatgaatctctat

SEQ ID NO: 71742 - DNA, 25 bp, Homo sapien
gcatttctacattaaacatgaggac

SEQ ID NO: 71743 - DNA, 25 bp, Homo sapien
gcatttctgcattaaacatgaggac

SEQ ID NO: 71744 - DNA, 25 bp, Homo sapien
gcatttctgtggggtgaatggtaat

SEQ ID NO: 71745 - DNA, 25 bp, Homo sapien
gcatttctgtgggttgaatggtaat

SEQ ID NO: 71746 - DNA, 25 bp, Homo sapien
gcatttcttcttcaagtaatcaaaa

SEQ ID NO: 71747 - DNA, 25 bp, Homo sapien
gcatttctttttcaagtaatcaaaa

SEQ ID NO: 71748 - DNA, 25 bp, Homo sapien
gcatttgaatagaaggaatcaattt

SEQ ID NO: 71749 - DNA, 25 bp, Homo sapien
gcatttgaatagaatgaatcaattt

SEQ ID NO: 71750 - DNA, 25 bp, Homo sapien
gcatttgaatatgactggtatggtc

SEQ ID NO: 71751 - DNA, 25 bp, Homo sapien
gcatttgaatatgagtggtatggtc

SEQ ID NO: 71752 - DNA, 25 bp, Homo sapien
gcatttgaccagcatccagatcaag

SEQ ID NO: 71753 - DNA, 25 bp, Homo sapien
gcatttgaccagcttccagatcaag

SEQ ID NO: 71754 - DNA, 25 bp, Homo sapien
gcatttgcagagaaagaacaaaggc

SEQ ID NO: 71755 - DNA, 25 bp, Homo sapien
gcatttgcggagaaagaacaaaggc

SEQ ID NO: 71756 - DNA, 25 bp, Homo sapien
gcatttgctgggacgcagtatgacc

SEQ ID NO: 71757 - DNA, 25 bp, Homo sapien
gcatttgctgggacgcggtatgacc

SEQ ID NO: 71758 - DNA, 25 bp, Homo sapien
gcatttggacccacaggtaataggt

SEQ ID NO: 71759 - DNA, 25 bp, Homo sapien
gcatttggacccgcaggtaataggt

SEQ ID NO: 71760 - DNA, 25 bp, Homo sapien
gcatttggctccaagagagatgaag

SEQ ID NO: 71761 - DNA, 25 bp, Homo sapien
gcatttggctccaatagagatgaag

SEQ ID NO: 71762 - DNA, 25 bp, Homo sapien
gcatttggctgtcagtgaagcggaa

SEQ ID NO: 71763 - DNA, 25 bp, Homo sapien
gcatttggctgttagtgaagcggaa

SEQ ID NO: 71764 - DNA, 25 bp, Homo sapien
gcatttggcttgtttgaagacatta

SEQ ID NO: 71765 - DNA, 25 bp, Homo sapien
gcatttggctttcattacacagtag

SEQ ID NO: 71766 - DNA, 25 bp, Homo sapien
gcatttggctttcattgcacagtag

SEQ ID NO: 71767 - DNA, 25 bp, Homo sapien
gcatttggtttgtttgaagacatta

SEQ ID NO: 71768 - DNA, 25 bp, Homo sapien
gcattttcacgggtgtaggttttct

SEQ ID NO: 71769 - DNA, 25 bp, Homo sapien
gcattttcacgggtttaggttttct

SEQ ID NO: 71770 - DNA, 25 bp, Homo sapien
gcattttccaaggcaccactgttaa

SEQ ID NO: 71771 - DNA, 25 bp, Homo sapien
gcattttccaaggtaccactgttaa

SEQ ID NO: 71772 - DNA, 25 bp, Homo sapien
gcattttccttacgttgctaataca

SEQ ID NO: 71773 - DNA, 25 bp, Homo sapien
gcattttccttatgttgctaataca

SEQ ID NO: 71774 - DNA, 25 bp, Homo sapien
gcattttctccaatgaaaagctaag

SEQ ID NO: 71775 - DNA, 25 bp, Homo sapien
gcattttcttcaatgaaaagctaag

SEQ ID NO: 71776 - DNA, 25 bp, Homo sapien
gcattttgataaataaaggaaagca

SEQ ID NO: 71777 - DNA, 25 bp, Homo sapien
gcattttgcaatcatctggaatatc

SEQ ID NO: 71778 - DNA, 25 bp, Homo sapien
gcattttgcaattatctggaatatc

SEQ ID NO: 71779 - DNA, 25 bp, Homo sapien
gcattttggtaaataaaggaaagca

SEQ ID NO: 71780 - DNA, 25 bp, Homo sapien
gcattttgtcaaacattcatgcgtg

SEQ ID NO: 71781 - DNA, 25 bp, Homo sapien
gcattttgtgaaacattcatgcgtg

SEQ ID NO: 71782 - DNA, 25 bp, Homo sapien
gcattttttaaagtctgttacagtg

SEQ ID NO: 71783 - DNA, 25 bp, Homo sapien
gcatttttttaagtctgttacagtg

SEQ ID NO: 71784 - DNA, 25 bp, Homo sapien
gcatttttttcccttaccagtccgg

SEQ ID NO: 71785 - DNA, 25 bp, Homo sapien
gcatttttttcccttatcagtccgg

SEQ ID NO: 71786 - DNA, 25 bp, Homo sapien
gccaaaaacaagccaagtgagtaag

SEQ ID NO: 71787 - DNA, 25 bp, Homo sapien
gccaaaaacaagccgagtgagtaag

SEQ ID NO: 71788 - DNA, 25 bp, Homo sapien
gccaaaaacagactgagcccctagg

SEQ ID NO: 71789 - DNA, 25 bp, Homo sapien
gccaaaaacagattgagcccctagg

SEQ ID NO: 71790 - DNA, 25 bp, Homo sapien
gccaaaaactacgtactcttggtgg

SEQ ID NO: 71791 - DNA, 25 bp, Homo sapien
gccaaaaactatgtactcttggtgg

SEQ ID NO: 71792 - DNA, 25 bp, Homo sapien
gccaaaaatttacatgctaaagaac

SEQ ID NO: 71793 - DNA, 25 bp, Homo sapien
gccaaaaatttagatgctaaagaac

SEQ ID NO: 71794 - DNA, 25 bp, Homo sapien
gccaaaagcctacatgtgctgttat

SEQ ID NO: 71795 - DNA, 25 bp, Homo sapien
gccaaaagcctacgtgtgctgttat

SEQ ID NO: 71796 - DNA, 25 bp, Homo sapien
gccaaaagggtggagaatgtggata

SEQ ID NO: 71797 - DNA, 25 bp, Homo sapien
gccaaaagggtggataatgtggata

SEQ ID NO: 71798 - DNA, 25 bp, Homo sapien
gccaaaatatggaccaaaactcagg

SEQ ID NO: 71799 - DNA, 25 bp, Homo sapien
gccaaaatatgggccaaaactcagg

SEQ ID NO: 71800 - DNA, 25 bp, Homo sapien
gccaaacccagacagaggtgatgtg

SEQ ID NO: 71801 - DNA, 25 bp, Homo sapien
gccaaacccatgcaaaagaggaact

SEQ ID NO: 71802 - DNA, 25 bp, Homo sapien
gccaaacccatgcaaaggaggaact

SEQ ID NO: 71803 - DNA, 25 bp, Homo sapien
gccaaaccgagacagaggtgatgtg

SEQ ID NO: 71804 - DNA, 25 bp, Homo sapien
gccaaactacaatatctgccacaat

SEQ ID NO: 71805 - DNA, 25 bp, Homo sapien
gccaaactgcaatatctgccacaat

SEQ ID NO: 71806 - DNA, 25 bp, Homo sapien
gccaaagaacacctcatttattata

SEQ ID NO: 71807 - DNA, 25 bp, Homo sapien
gccaaagaacatctcatttattata

SEQ ID NO: 71808 - DNA, 25 bp, Homo sapien
gccaaagagctagttctcctcagtt

SEQ ID NO: 71809 - DNA, 25 bp, Homo sapien
gccaaagagctggttctcctcagtt

SEQ ID NO: 71810 - DNA, 25 bp, Homo sapien
gccaaagccatcatgcctagcagag

SEQ ID NO: 71811 - DNA, 25 bp, Homo sapien
gccaaagccatcgtgcctagcagag

SEQ ID NO: 71812 - DNA, 25 bp, Homo sapien
gccaaaggacagtgaggccataaaa

SEQ ID NO: 71813 - DNA, 25 bp, Homo sapien
gccaaaggacagtgtggccataaaa

SEQ ID NO: 71814 - DNA, 25 bp, Homo sapien
gccaaagtatgaagatagaaagcag

SEQ ID NO: 71815 - DNA, 25 bp, Homo sapien
gccaaagtatgaaggtagaaagcag

SEQ ID NO: 71816 - DNA, 25 bp, Homo sapien
gccaaagtgtctcacatctaaatct

SEQ ID NO: 71817 - DNA, 25 bp, Homo sapien
gccaaagtgtcttacatctaaatct

SEQ ID NO: 71818 - DNA, 25 bp, Homo sapien
gccaaagtgtttcaggaaaaatcaa

SEQ ID NO: 71819 - DNA, 25 bp, Homo sapien
gccaaagtgtttcgggaaaaatcaa

SEQ ID NO: 71820 - DNA, 25 bp, Homo sapien
gccaaagttctaagttttcatgaaa

SEQ ID NO: 71821 - DNA, 25 bp, Homo sapien
gccaaagttgtaagttttcatgaaa

SEQ ID NO: 71822 - DNA, 25 bp, Homo sapien
gccaaatcattagctctctcttccc

SEQ ID NO: 71823 - DNA, 25 bp, Homo sapien
gccaaatcgttagctctctcttccc

SEQ ID NO: 71824 - DNA, 25 bp, Homo sapien
gccaaatgtgcagtggggactaaaa

SEQ ID NO: 71825 - DNA, 25 bp, Homo sapien
gccaaatgtgccgtggggactaaaa

SEQ ID NO: 71826 - DNA, 25 bp, Homo sapien
gccaaattcaggaaattaacaaaaa

SEQ ID NO: 71827 - DNA, 25 bp, Homo sapien
gccaaattcgggaaattaacaaaaa

SEQ ID NO: 71828 - DNA, 25 bp, Homo sapien
gccaaatttgtctaatgggaatctc

SEQ ID NO: 71829 - DNA, 25 bp, Homo sapien
gccaaatttgtttaatgggaatctc

SEQ ID NO: 71830 - DNA, 25 bp, Homo sapien
gccaaattttgaacataaagctcat

SEQ ID NO: 71831 - DNA, 25 bp, Homo sapien
gccaaattttgcacataaagctcat

SEQ ID NO: 71832 - DNA, 25 bp, Homo sapien
gccaacagcaaattcaatgaaggaa

SEQ ID NO: 71833 - DNA, 25 bp, Homo sapien
gccaacagcaaattcattgaaggaa

SEQ ID NO: 71834 - DNA, 25 bp, Homo sapien
gccaacataaggacctgtcactatc

SEQ ID NO: 71835 - DNA, 25 bp, Homo sapien
gccaacataaggacctttcactatc

SEQ ID NO: 71836 - DNA, 25 bp, Homo sapien
gccaacatgagtgcactgatgcctc

SEQ ID NO: 71837 - DNA, 25 bp, Homo sapien
gccaacatgcgtgcactgatgcctc

SEQ ID NO: 71838 - DNA, 25 bp, Homo sapien
gccaaccaggagaagcctcagcata

SEQ ID NO: 71839 - DNA, 25 bp, Homo sapien
gccaaccaggagcagcctcagcata

SEQ ID NO: 71840 - DNA, 25 bp, Homo sapien
gccaaccctagggtatagttcttgc

SEQ ID NO: 71841 - DNA, 25 bp, Homo sapien
gccaaccctagggtatggttcttgc

SEQ ID NO: 71842 - DNA, 25 bp, Homo sapien
gccaacgaattatgtcagaagcaga

SEQ ID NO: 71843 - DNA, 25 bp, Homo sapien
gccaacgaattgtgtcagaagcaga

SEQ ID NO: 71844 - DNA, 25 bp, Homo sapien
gccaactcaacgatacaaaaacatt

SEQ ID NO: 71845 - DNA, 25 bp, Homo sapien
gccaactcatcgatacaaaaacatt

SEQ ID NO: 71846 - DNA, 25 bp, Homo sapien
gccaactccgcaagaattgaaacac

SEQ ID NO: 71847 - DNA, 25 bp, Homo sapien
gccaactcctcaagaattgaaacac

SEQ ID NO: 71848 - DNA, 25 bp, Homo sapien
gccaactctatgatgttaaacgagt

SEQ ID NO: 71849 - DNA, 25 bp, Homo sapien
gccaactctgtgatgttaaacgagt

SEQ ID NO: 71850 - DNA, 25 bp, Homo sapien
gccaactgcgaaccgccagctctgt

SEQ ID NO: 71851 - DNA, 25 bp, Homo sapien
gccaactgcgagccgccagctctgt

SEQ ID NO: 71852 - DNA, 25 bp, Homo sapien
gccaagaatatcaggttttattgca

SEQ ID NO: 71853 - DNA, 25 bp, Homo sapien
gccaagaatatcatgttttattgca

SEQ ID NO: 71854 - DNA, 25 bp, Homo sapien
gccaagacacccatgagagtacctt

SEQ ID NO: 71855 - DNA, 25 bp, Homo sapien
gccaagacgcccatgagagtacctt

SEQ ID NO: 71856 - DNA, 25 bp, Homo sapien
gccaagagaaaactcatttcagttt

SEQ ID NO: 71857 - DNA, 25 bp, Homo sapien
gccaagagaatttcctggcggcttg

SEQ ID NO: 71858 - DNA, 25 bp, Homo sapien
gccaagagacaactcatttcagttt

SEQ ID NO: 71859 - DNA, 25 bp, Homo sapien
gccaagaggatttcctggcggcttg

SEQ ID NO: 71860 - DNA, 25 bp, Homo sapien
gccaagagtaggaaggctcatcatc

SEQ ID NO: 71861 - DNA, 25 bp, Homo sapien
gccaagagtaggatggctcatcatc

SEQ ID NO: 71862 - DNA, 25 bp, Homo sapien
gccaagagtcgacatgtctattcaa

SEQ ID NO: 71863 - DNA, 25 bp, Homo sapien
gccaagagtcgatatgtctattcaa

SEQ ID NO: 71864 - DNA, 25 bp, Homo sapien
gccaagataaaaaatcccaggccct

SEQ ID NO: 71865 - DNA, 25 bp, Homo sapien
gccaagataaaagatcccaggccct

SEQ ID NO: 71866 - DNA, 25 bp, Homo sapien
gccaagataacaactctatcatttg

SEQ ID NO: 71867 - DNA, 25 bp, Homo sapien
gccaagataacacctctatcatttg

SEQ ID NO: 71868 - DNA, 25 bp, Homo sapien
gccaaggtacaaactcacgtgcatt

SEQ ID NO: 71869 - DNA, 25 bp, Homo sapien
gccaaggtacagactcacgtgcatt

SEQ ID NO: 71870 - DNA, 25 bp, Homo sapien
gccaaggtctaatttttcacacata

SEQ ID NO: 71871 - DNA, 25 bp, Homo sapien
gccaaggtctagtttttcacacata

SEQ ID NO: 71872 - DNA, 25 bp, Homo sapien
gccaagtccgagctgtgtcctggtg

SEQ ID NO: 71873 - DNA, 25 bp, Homo sapien
gccaagtctgagctgtgtcctggtg

SEQ ID NO: 71874 - DNA, 25 bp, Homo sapien
gccaagttgagacaatggcttaaca

SEQ ID NO: 71875 - DNA, 25 bp, Homo sapien
gccaagttgaggcaatggcttaaca

SEQ ID NO: 71876 - DNA, 25 bp, Homo sapien
gccaatacgacatacttttcatata

SEQ ID NO: 71877 - DNA, 25 bp, Homo sapien
gccaatacgtgtcaggattcatctg

SEQ ID NO: 71878 - DNA, 25 bp, Homo sapien
gccaatacgtgtgaggattcatctg

SEQ ID NO: 71879 - DNA, 25 bp, Homo sapien
gccaatactacatacttttcatata

SEQ ID NO: 71880 - DNA, 25 bp, Homo sapien
gccaatagagatcaatctagctata

SEQ ID NO: 71881 - DNA, 25 bp, Homo sapien
gccaatagggatcaatctagctata

SEQ ID NO: 71882 - DNA, 25 bp, Homo sapien
gccaatcaagaagaaaggaggaggg

SEQ ID NO: 71883 - DNA, 25 bp, Homo sapien
gccaatcaagaggaaaggaggaggg

SEQ ID NO: 71884 - DNA, 25 bp, Homo sapien
gccaatcctcagttaatagacatga

SEQ ID NO: 71885 - DNA, 25 bp, Homo sapien
gccaatccttagttaatagacatga

SEQ ID NO: 71886 - DNA, 25 bp, Homo sapien
gccaatctagggtgctatatgctta

SEQ ID NO: 71887 - DNA, 25 bp, Homo sapien
gccaatctagggtggtatatgctta

SEQ ID NO: 71888 - DNA, 25 bp, Homo sapien
gccaatgaaatcacataaaccttag

SEQ ID NO: 71889 - DNA, 25 bp, Homo sapien
gccaatgaaatcacatcaaccttag

SEQ ID NO: 71890 - DNA, 25 bp, Homo sapien
gccaatgcaaactgacaggcttgaa

SEQ ID NO: 71891 - DNA, 25 bp, Homo sapien
gccaatgcaaactgactggcttgaa

SEQ ID NO: 71892 - DNA, 25 bp, Homo sapien
gccaatgcatttaccactctggaac

SEQ ID NO: 71893 - DNA, 25 bp, Homo sapien
gccaatgcatttccttcgtgtccaa

SEQ ID NO: 71894 - DNA, 25 bp, Homo sapien
gccaatgcatttcctttgtgtccaa

SEQ ID NO: 71895 - DNA, 25 bp, Homo sapien
gccaatgccaaaaatatgctctcaa

SEQ ID NO: 71896 - DNA, 25 bp, Homo sapien
gccaatgccaaacatatgctctcaa

SEQ ID NO: 71897 - DNA, 25 bp, Homo sapien
gccaatgcgtttaccactctggaac

SEQ ID NO: 71898 - DNA, 25 bp, Homo sapien
gccaattatagaacaaaatttaaga

SEQ ID NO: 71899 - DNA, 25 bp, Homo sapien
gccaattatagaaccaaatttaaga

SEQ ID NO: 71900 - DNA, 25 bp, Homo sapien
gccaattatagctatacattgagac

SEQ ID NO: 71901 - DNA, 25 bp, Homo sapien
gccaattatagctatatattgagac

SEQ ID NO: 71902 - DNA, 25 bp, Homo sapien
gccaattcacacggcaaaacctaga

SEQ ID NO: 71903 - DNA, 25 bp, Homo sapien
gccaattcacatggcaaaacctaga

SEQ ID NO: 71904 - DNA, 25 bp, Homo sapien
gccaattctcaagtatttcaaatcc

SEQ ID NO: 71905 - DNA, 25 bp, Homo sapien
gccaattctcaattatttcaaatcc

SEQ ID NO: 71906 - DNA, 25 bp, Homo sapien
gccaattctctcccctgaaaccctc

SEQ ID NO: 71907 - DNA, 25 bp, Homo sapien
gccaattctttcccctgaaaccctc

SEQ ID NO: 71908 - DNA, 25 bp, Homo sapien
gccaattttatgtaagagctgaaat

SEQ ID NO: 71909 - DNA, 25 bp, Homo sapien
gccaattttatgttagagctgaaat

SEQ ID NO: 71910 - DNA, 25 bp, Homo sapien
gccacaagatcagataagtgagttt

SEQ ID NO: 71911 - DNA, 25 bp, Homo sapien
gccacaaggtcagataagtgagttt

SEQ ID NO: 71912 - DNA, 25 bp, Homo sapien
gccacaatctacatgacagggatgt

SEQ ID NO: 71913 - DNA, 25 bp, Homo sapien
gccacaatctacgtgacagggatgt

SEQ ID NO: 71914 - DNA, 25 bp, Homo sapien
gccacaatgaatgagattgaggttc

SEQ ID NO: 71915 - DNA, 25 bp, Homo sapien
gccacaatgaatgcgattgaggttc

SEQ ID NO: 71916 - DNA, 25 bp, Homo sapien
gccacaccactctcgtaaaagtatt

SEQ ID NO: 71917 - DNA, 25 bp, Homo sapien
gccacaccactcttgtaaaagtatt

SEQ ID NO: 71918 - DNA, 25 bp, Homo sapien
gccacactgaaaaccaaaactaaga

SEQ ID NO: 71919 - DNA, 25 bp, Homo sapien
gccacactgaaaaccagaactaaga

SEQ ID NO: 71920 - DNA, 25 bp, Homo sapien
gccacagacagctcccgatgcgctg

SEQ ID NO: 71921 - DNA, 25 bp, Homo sapien
gccacagacggctcccgatgcgctg

SEQ ID NO: 71922 - DNA, 25 bp, Homo sapien
gccacagtttacacgagcacagagt

SEQ ID NO: 71923 - DNA, 25 bp, Homo sapien
gccacagtttacatgagcacagagt

SEQ ID NO: 71924 - DNA, 25 bp, Homo sapien
gccacatcctgaaccctggttagtc

SEQ ID NO: 71925 - DNA, 25 bp, Homo sapien
gccacatcctgaactctggttagtc

SEQ ID NO: 71926 - DNA, 25 bp, Homo sapien
gccacatgccttcaatttgggctta

SEQ ID NO: 71927 - DNA, 25 bp, Homo sapien
gccacatgtcttcaatttgggctta

SEQ ID NO: 71928 - DNA, 25 bp, Homo sapien
gccacattgaacgggttcatctgaa

SEQ ID NO: 71929 - DNA, 25 bp, Homo sapien
gccacattgaatgggttcatctgaa

SEQ ID NO: 71930 - DNA, 25 bp, Homo sapien
gccaccaaaaaaaaagtggatgtgt

SEQ ID NO: 71931 - DNA, 25 bp, Homo sapien
gccaccaaaaaaaatgtggatgtgt

SEQ ID NO: 71932 - DNA, 25 bp, Homo sapien
gccaccaaccacatttaggaagcgt

SEQ ID NO: 71933 - DNA, 25 bp, Homo sapien
gccaccaaccacatttgggaagcgt

SEQ ID NO: 71934 - DNA, 25 bp, Homo sapien
gccaccaagttcatgttaatctatt

SEQ ID NO: 71935 - DNA, 25 bp, Homo sapien
gccaccaagttcgtgttaatctatt

SEQ ID NO: 71936 - DNA, 25 bp, Homo sapien
gccaccaccacagagaatatcagtt

SEQ ID NO: 71937 - DNA, 25 bp, Homo sapien
gccaccaccacagagactatcagtt

SEQ ID NO: 71938 - DNA, 25 bp, Homo sapien
gccaccatatctggctaatctgttt

SEQ ID NO: 71939 - DNA, 25 bp, Homo sapien
gccaccatttctggctaatctgttt

SEQ ID NO: 71940 - DNA, 25 bp, Homo sapien
gccacctcacttcctggcatggcag

SEQ ID NO: 71941 - DNA, 25 bp, Homo sapien
gccacctcatttcctggcatggcag

SEQ ID NO: 71942 - DNA, 25 bp, Homo sapien
gccacctgctttctgtcattataga

SEQ ID NO: 71943 - DNA, 25 bp, Homo sapien
gccacctgctttgtgtcattataga

SEQ ID NO: 71944 - DNA, 25 bp, Homo sapien
gccacctgtggcacttcagcgacta

SEQ ID NO: 71945 - DNA, 25 bp, Homo sapien
gccacctgtggcactttagcgacta

SEQ ID NO: 71946 - DNA, 25 bp, Homo sapien
gccacggctgctcgcacgctactac

SEQ ID NO: 71947 - DNA, 25 bp, Homo sapien
gccacggctgctctcacgctactac

SEQ ID NO: 71948 - DNA, 25 bp, Homo sapien
gccacggtttacgttttcacaccac

SEQ ID NO: 71949 - DNA, 25 bp, Homo sapien
gccacggtttatgttttcacaccac

SEQ ID NO: 71950 - DNA, 25 bp, Homo sapien
gccacgttcagaaacggcagttgta

SEQ ID NO: 71951 - DNA, 25 bp, Homo sapien
gccacgttcggaaacggcagttgta

SEQ ID NO: 71952 - DNA, 25 bp, Homo sapien
gccactaaaactggccaattaaaat

SEQ ID NO: 71953 - DNA, 25 bp, Homo sapien
gccactaaatctggccaattaaaat

SEQ ID NO: 71954 - DNA, 25 bp, Homo sapien
gccactacataaaaggattcagaaa

SEQ ID NO: 71955 - DNA, 25 bp, Homo sapien
gccactacataaaatgattcagaaa

SEQ ID NO: 71956 - DNA, 25 bp, Homo sapien
gccactaccttctgagaaacagttt

SEQ ID NO: 71957 - DNA, 25 bp, Homo sapien
gccactactttctgagaaacagttt

SEQ ID NO: 71958 - DNA, 25 bp, Homo sapien
gccactagaacaatggtgctggaga

SEQ ID NO: 71959 - DNA, 25 bp, Homo sapien
gccactagaacgatggtgctggaga

SEQ ID NO: 71960 - DNA, 25 bp, Homo sapien
gccactagcttcatgatcatttgtt

SEQ ID NO: 71961 - DNA, 25 bp, Homo sapien
gccactagcttcgtgatcatttgtt

SEQ ID NO: 71962 - DNA, 25 bp, Homo sapien
gccactcagtctgctgtcttgttat

SEQ ID NO: 71963 - DNA, 25 bp, Homo sapien
gccactcagtcttctgtcttgttat

SEQ ID NO: 71964 - DNA, 25 bp, Homo sapien
gccactcggccttccatgtctggct

SEQ ID NO: 71965 - DNA, 25 bp, Homo sapien
gccactcgggcttccatgtctggct

SEQ ID NO: 71966 - DNA, 25 bp, Homo sapien
gccactctccttgccacggaatttg

SEQ ID NO: 71967 - DNA, 25 bp, Homo sapien
gccactctccttgccatggaatttg

SEQ ID NO: 71968 - DNA, 25 bp, Homo sapien
gccactctttgtacaacaaattaca

SEQ ID NO: 71969 - DNA, 25 bp, Homo sapien
gccactctttgtacaataaattaca

SEQ ID NO: 71970 - DNA, 25 bp, Homo sapien
gccactgataaaccctatggtcttt

SEQ ID NO: 71971 - DNA, 25 bp, Homo sapien
gccactgataaatcctatggtcttt

SEQ ID NO: 71972 - DNA, 25 bp, Homo sapien
gccactggacaatcgaacaatgtga

SEQ ID NO: 71973 - DNA, 25 bp, Homo sapien
gccactggacaatctaacaatgtga

SEQ ID NO: 71974 - DNA, 25 bp, Homo sapien
gccactggacaggactaagctatcc

SEQ ID NO: 71975 - DNA, 25 bp, Homo sapien
gccactggccatccagaactaatgc

SEQ ID NO: 71976 - DNA, 25 bp, Homo sapien
gccactggccatccggaactaatgc

SEQ ID NO: 71977 - DNA, 25 bp, Homo sapien
gccactgggcaggactaagctatcc

SEQ ID NO: 71978 - DNA, 25 bp, Homo sapien
gccactggggtttcaatcagttcct

SEQ ID NO: 71979 - DNA, 25 bp, Homo sapien
gccactggggtttgaatcagttcct

SEQ ID NO: 71980 - DNA, 25 bp, Homo sapien
gccacttaccatgaatagagcttgc

SEQ ID NO: 71981 - DNA, 25 bp, Homo sapien
gccacttaccatgaatggagcttgc

SEQ ID NO: 71982 - DNA, 25 bp, Homo sapien
gccacttgcattatatgccaaatga

SEQ ID NO: 71983 - DNA, 25 bp, Homo sapien
gccacttgcattatttgccaaatga

SEQ ID NO: 71984 - DNA, 25 bp, Homo sapien
gccacttggctccgctgtatttcct

SEQ ID NO: 71985 - DNA, 25 bp, Homo sapien
gccacttggctctgctgtatttcct

SEQ ID NO: 71986 - DNA, 25 bp, Homo sapien
gccacttttactctgagcatgaaga

SEQ ID NO: 71987 - DNA, 25 bp, Homo sapien
gccacttttactttgagcatgaaga

SEQ ID NO: 71988 - DNA, 25 bp, Homo sapien
gccactttttgcccaccttaatgat

SEQ ID NO: 71989 - DNA, 25 bp, Homo sapien
gccactttttgccccccttaatgat

SEQ ID NO: 71990 - DNA, 25 bp, Homo sapien
gccagaaaataagggacaaatattg

SEQ ID NO: 71991 - DNA, 25 bp, Homo sapien
gccagaaaataagggagaaatattg

SEQ ID NO: 71992 - DNA, 25 bp, Homo sapien
gccagaaaatgaacgaatgtgcctt

SEQ ID NO: 71993 - DNA, 25 bp, Homo sapien
gccagaaaatgaatgaatgtgcctt

SEQ ID NO: 71994 - DNA, 25 bp, Homo sapien
gccagaaaattccttcagtgagaca

SEQ ID NO: 71995 - DNA, 25 bp, Homo sapien
gccagaaacacatggaaagctctag

SEQ ID NO: 71996 - DNA, 25 bp, Homo sapien
gccagaaactcatggaaagctctag

SEQ ID NO: 71997 - DNA, 25 bp, Homo sapien
gccagaaagtaacccgaggacttga

SEQ ID NO: 71998 - DNA, 25 bp, Homo sapien
gccagaaagtaacctgaggacttga

SEQ ID NO: 71999 - DNA, 25 bp, Homo sapien
gccagaaatttccttcagtgagaca

SEQ ID NO: 72000 - DNA, 25 bp, Homo sapien
gccagaatgactctgaactttctgt

SEQ ID NO: 72001 - DNA, 25 bp, Homo sapien
gccagaatgtctctgaactttctgt

SEQ ID NO: 72002 - DNA, 25 bp, Homo sapien
gccagacaaagagaagattcattta

SEQ ID NO: 72003 - DNA, 25 bp, Homo sapien
gccagacacaaaacgctacatatcg

SEQ ID NO: 72004 - DNA, 25 bp, Homo sapien
gccagacacaaaaggctacatatcg

SEQ ID NO: 72005 - DNA, 25 bp, Homo sapien
gccagacacttacattttacactgt

SEQ ID NO: 72006 - DNA, 25 bp, Homo sapien
gccagacacttatattttacactgt

SEQ ID NO: 72007 - DNA, 25 bp, Homo sapien
gccagacaggactgaatggcaaagt

SEQ ID NO: 72008 - DNA, 25 bp, Homo sapien
gccagacaggacttaatggcaaagt

SEQ ID NO: 72009 - DNA, 25 bp, Homo sapien
gccagacatagagaagattcattta

SEQ ID NO: 72010 - DNA, 25 bp, Homo sapien
gccagacatatattccgcaatggaa

SEQ ID NO: 72011 - DNA, 25 bp, Homo sapien
gccagacatttattccgcaatggaa

SEQ ID NO: 72012 - DNA, 25 bp, Homo sapien
gccagactccacaatcatgtgaacc

SEQ ID NO: 72013 - DNA, 25 bp, Homo sapien
gccagactccacattcatgtgaacc

SEQ ID NO: 72014 - DNA, 25 bp, Homo sapien
gccagagaaaaatgtgacctaagaa

SEQ ID NO: 72015 - DNA, 25 bp, Homo sapien
gccagagaactgaaaatggcttatc

SEQ ID NO: 72016 - DNA, 25 bp, Homo sapien
gccagagaagtctgaggaggataag

SEQ ID NO: 72017 - DNA, 25 bp, Homo sapien
gccagagaagtttgaggaggataag

SEQ ID NO: 72018 - DNA, 25 bp, Homo sapien
gccagagaatcctgctaagcaatac

SEQ ID NO: 72019 - DNA, 25 bp, Homo sapien
gccagagaatcctgttaagcaatac

SEQ ID NO: 72020 - DNA, 25 bp, Homo sapien
gccagagaattgaaaatggcttatc

SEQ ID NO: 72021 - DNA, 25 bp, Homo sapien
gccagagacaaatgtgacctaagaa

SEQ ID NO: 72022 - DNA, 25 bp, Homo sapien
gccagagacagctatcctttgaaag

SEQ ID NO: 72023 - DNA, 25 bp, Homo sapien
gccagagactgctatcctttgaaag

SEQ ID NO: 72024 - DNA, 25 bp, Homo sapien
gccagagatcgacatgcaggatatt

SEQ ID NO: 72025 - DNA, 25 bp, Homo sapien
gccagagatcggcatgcaggatatt

SEQ ID NO: 72026 - DNA, 25 bp, Homo sapien
gccagagatgacgcttcacattctc

SEQ ID NO: 72027 - DNA, 25 bp, Homo sapien
gccagagatgactcttcacattctc

SEQ ID NO: 72028 - DNA, 25 bp, Homo sapien
gccagaggatggctcccactacaaa

SEQ ID NO: 72029 - DNA, 25 bp, Homo sapien
gccagaggatggttcccactacaaa

SEQ ID NO: 72030 - DNA, 25 bp, Homo sapien
gccagaggcccagtgaagttatcgc

SEQ ID NO: 72031 - DNA, 25 bp, Homo sapien
gccagaggctcagtgaagttatcgc

SEQ ID NO: 72032 - DNA, 25 bp, Homo sapien
gccagaggtaattacacatgttgtt

SEQ ID NO: 72033 - DNA, 25 bp, Homo sapien
gccagaggtaattatacatgttgtt

SEQ ID NO: 72034 - DNA, 25 bp, Homo sapien
gccagagtggatatgttgttagcca

SEQ ID NO: 72035 - DNA, 25 bp, Homo sapien
gccagagtggatattttgttagcca

SEQ ID NO: 72036 - DNA, 25 bp, Homo sapien
gccagataaaagacatgaattattt

SEQ ID NO: 72037 - DNA, 25 bp, Homo sapien
gccagataaaaggcatgaattattt

SEQ ID NO: 72038 - DNA, 25 bp, Homo sapien
gccagatacatacaaagccagagaa

SEQ ID NO: 72039 - DNA, 25 bp, Homo sapien
gccagatacgtacaaagccagagaa

SEQ ID NO: 72040 - DNA, 25 bp, Homo sapien
gccagatcactcacactgtttgcat

SEQ ID NO: 72041 - DNA, 25 bp, Homo sapien
gccagatcactcatactgtttgcat

SEQ ID NO: 72042 - DNA, 25 bp, Homo sapien
gccagatcactgaaggcagatatct

SEQ ID NO: 72043 - DNA, 25 bp, Homo sapien
gccagatcagagagagctgagtgga

SEQ ID NO: 72044 - DNA, 25 bp, Homo sapien
gccagatcagagagaggtgagtgga

SEQ ID NO: 72045 - DNA, 25 bp, Homo sapien
gccagatcattgaaggcagatatct

SEQ ID NO: 72046 - DNA, 25 bp, Homo sapien
gccagatgatccgtcacaaccacac

SEQ ID NO: 72047 - DNA, 25 bp, Homo sapien
gccagatgatctgtcacaaccacac

SEQ ID NO: 72048 - DNA, 25 bp, Homo sapien
gccagatgcttgcaaaggacaggtg

SEQ ID NO: 72049 - DNA, 25 bp, Homo sapien
gccagatgcttgtaaaggacaggtg

SEQ ID NO: 72050 - DNA, 25 bp, Homo sapien
gccagatgggtcatctcatacagga

SEQ ID NO: 72051 - DNA, 25 bp, Homo sapien
gccagatgtgtcatctcatacagga

SEQ ID NO: 72052 - DNA, 25 bp, Homo sapien
gccagatgtttctgaacgacacaaa

SEQ ID NO: 72053 - DNA, 25 bp, Homo sapien
gccagatgtttttgaacgacacaaa

SEQ ID NO: 72054 - DNA, 25 bp, Homo sapien
gccagattctctaattacatgctac

SEQ ID NO: 72055 - DNA, 25 bp, Homo sapien
gccagattctctaatttcatgctac

SEQ ID NO: 72056 - DNA, 25 bp, Homo sapien
gccagcaaatgtaaagcaggcagaa

SEQ ID NO: 72057 - DNA, 25 bp, Homo sapien
gccagcaaatgtaaaggaggcagaa

SEQ ID NO: 72058 - DNA, 25 bp, Homo sapien
gccagcaagggaagtgttatacgct

SEQ ID NO: 72059 - DNA, 25 bp, Homo sapien
gccagcaagggcagtgttatacgct

SEQ ID NO: 72060 - DNA, 25 bp, Homo sapien
gccagcacatatgcaacaagaagcg

SEQ ID NO: 72061 - DNA, 25 bp, Homo sapien
gccagcacatatgtaacaagaagcg

SEQ ID NO: 72062 - DNA, 25 bp, Homo sapien
gccagcactgcaaacatacttcttc

SEQ ID NO: 72063 - DNA, 25 bp, Homo sapien
gccagcactgcaaccatacttcttc

SEQ ID NO: 72064 - DNA, 25 bp, Homo sapien
gccagcagaatgcactaggacctgc

SEQ ID NO: 72065 - DNA, 25 bp, Homo sapien
gccagcagaatgcagtaggacctgc

SEQ ID NO: 72066 - DNA, 25 bp, Homo sapien
gccagcagctaaccctagtcactgg

SEQ ID NO: 72067 - DNA, 25 bp, Homo sapien
gccagcagctatccctagtcactgg

SEQ ID NO: 72068 - DNA, 25 bp, Homo sapien
gccagccaggtttgagcacctctga

SEQ ID NO: 72069 - DNA, 25 bp, Homo sapien
gccagccatgtttgagcacctctga

SEQ ID NO: 72070 - DNA, 25 bp, Homo sapien
gccagcgctactcggtgaccaaacc

SEQ ID NO: 72071 - DNA, 25 bp, Homo sapien
gccagcgctacttggtgaccaaacc

SEQ ID NO: 72072 - DNA, 25 bp, Homo sapien
gccagcggacaaatggcagatgact

SEQ ID NO: 72073 - DNA, 25 bp, Homo sapien
gccagcggccaaatggcagatgact

SEQ ID NO: 72074 - DNA, 25 bp, Homo sapien
gccagctacaacttgggcagccttt

SEQ ID NO: 72075 - DNA, 25 bp, Homo sapien
gccagctacaggagagtttgggtca

SEQ ID NO: 72076 - DNA, 25 bp, Homo sapien
gccagctacaggagcgtttgggtca

SEQ ID NO: 72077 - DNA, 25 bp, Homo sapien
gccagctacgacttgggcagccttt

SEQ ID NO: 72078 - DNA, 25 bp, Homo sapien
gccagctcatagacagtatctgctt

SEQ ID NO: 72079 - DNA, 25 bp, Homo sapien
gccagctcctatgcacacccatctg

SEQ ID NO: 72080 - DNA, 25 bp, Homo sapien
gccagctcctatgcacgcccatctg

SEQ ID NO: 72081 - DNA, 25 bp, Homo sapien
gccagctcgtagacagtatctgctt

SEQ ID NO: 72082 - DNA, 25 bp, Homo sapien
gccagctgtttgacgctcaatggat

SEQ ID NO: 72083 - DNA, 25 bp, Homo sapien
gccagctgtttgatgctcaatggat

SEQ ID NO: 72084 - DNA, 25 bp, Homo sapien
gccagcttgtcacctgggactggtg

SEQ ID NO: 72085 - DNA, 25 bp, Homo sapien
gccagcttgtcacgtgggactggtg

SEQ ID NO: 72086 - DNA, 25 bp, Homo sapien
gccagctttcccaactcaatcacct

SEQ ID NO: 72087 - DNA, 25 bp, Homo sapien
gccagctttcccgactcaatcacct

SEQ ID NO: 72088 - DNA, 25 bp, Homo sapien
gccaggaagtacttacaggaagcct

SEQ ID NO: 72089 - DNA, 25 bp, Homo sapien
gccaggaagtagttacaggaagcct

SEQ ID NO: 72090 - DNA, 25 bp, Homo sapien
gccaggacatggagaaacaataatg

SEQ ID NO: 72091 - DNA, 25 bp, Homo sapien
gccaggacctggagaaacaataatg

SEQ ID NO: 72092 - DNA, 25 bp, Homo sapien
gccaggactcagaagcaggtctgcc

SEQ ID NO: 72093 - DNA, 25 bp, Homo sapien
gccaggactcagcagcaggtctgcc

SEQ ID NO: 72094 - DNA, 25 bp, Homo sapien
gccaggattcatacgtctaggaatc

SEQ ID NO: 72095 - DNA, 25 bp, Homo sapien
gccaggattcataggtctaggaatc

SEQ ID NO: 72096 - DNA, 25 bp, Homo sapien
gccaggattttgtacgtggatgaga

SEQ ID NO: 72097 - DNA, 25 bp, Homo sapien
gccaggattttgtatgtggatgaga

SEQ ID NO: 72098 - DNA, 25 bp, Homo sapien
gccaggcaaagacattgattccaag

SEQ ID NO: 72099 - DNA, 25 bp, Homo sapien
gccaggcaaagacgttgattccaag

SEQ ID NO: 72100 - DNA, 25 bp, Homo sapien
gccaggcatttgcagagaaagaaca

SEQ ID NO: 72101 - DNA, 25 bp, Homo sapien
gccaggcatttgcggagaaagaaca

SEQ ID NO: 72102 - DNA, 25 bp, Homo sapien
gccaggcgaggagcttgcagctcta

SEQ ID NO: 72103 - DNA, 25 bp, Homo sapien
gccaggcgtggagcttgcagctcta

SEQ ID NO: 72104 - DNA, 25 bp, Homo sapien
gccaggctacaacaaggagtcttac

SEQ ID NO: 72105 - DNA, 25 bp, Homo sapien
gccaggctgcaacaaggagtcttac

SEQ ID NO: 72106 - DNA, 25 bp, Homo sapien
gccaggcttaaaaacaaattacacg

SEQ ID NO: 72107 - DNA, 25 bp, Homo sapien
gccaggcttaaaaataaattacacg

SEQ ID NO: 72108 - DNA, 25 bp, Homo sapien
gccagggcttaccttggtacctgag

SEQ ID NO: 72109 - DNA, 25 bp, Homo sapien
gccagggcttagcttggtacctgag

SEQ ID NO: 72110 - DNA, 25 bp, Homo sapien
gccagggtcattgccatcccacaac

SEQ ID NO: 72111 - DNA, 25 bp, Homo sapien
gccagggtcgttgccatcccacaac

SEQ ID NO: 72112 - DNA, 25 bp, Homo sapien
gccaggtatcacagagtgcttaagt

SEQ ID NO: 72113 - DNA, 25 bp, Homo sapien
gccaggtatcatagagtgcttaagt

SEQ ID NO: 72114 - DNA, 25 bp, Homo sapien
gccaggtccttaacttcccggagga

SEQ ID NO: 72115 - DNA, 25 bp, Homo sapien
gccaggtcctttacttcccggagga

SEQ ID NO: 72116 - DNA, 25 bp, Homo sapien
gccaggtgcttcaccaagtgagtag

SEQ ID NO: 72117 - DNA, 25 bp, Homo sapien
gccaggtgcttcgccaagtgagtag

SEQ ID NO: 72118 - DNA, 25 bp, Homo sapien
gccaggttcatattcaaaataagtt

SEQ ID NO: 72119 - DNA, 25 bp, Homo sapien
gccaggttgatattcaaaataagtt

SEQ ID NO: 72120 - DNA, 25 bp, Homo sapien
gccaggttgcaatagtacctagtct

SEQ ID NO: 72121 - DNA, 25 bp, Homo sapien
gccaggttgcagtagtacctagtct

SEQ ID NO: 72122 - DNA, 25 bp, Homo sapien
gccagtacatgataacgcgatttca

SEQ ID NO: 72123 - DNA, 25 bp, Homo sapien
gccagtacatgatatcgcgatttca

SEQ ID NO: 72124 - DNA, 25 bp, Homo sapien
gccagtatgttacgggcttcatcag

SEQ ID NO: 72125 - DNA, 25 bp, Homo sapien
gccagtatgttatgggcttcatcag

SEQ ID NO: 72126 - DNA, 25 bp, Homo sapien
gccagtcagactatgaagccagcag

SEQ ID NO: 72127 - DNA, 25 bp, Homo sapien
gccagtcagactatgaggccagcag

SEQ ID NO: 72128 - DNA, 25 bp, Homo sapien
gccagtcagataagaaatacagtct

SEQ ID NO: 72129 - DNA, 25 bp, Homo sapien
gccagtcaggtaagaaatacagtct

SEQ ID NO: 72130 - DNA, 25 bp, Homo sapien
gccagtcatgcaagtgaataatgtg

SEQ ID NO: 72131 - DNA, 25 bp, Homo sapien
gccagtcatgcaggtgaataatgtg

SEQ ID NO: 72132 - DNA, 25 bp, Homo sapien
gccagtccctcaggaggaactcaag

SEQ ID NO: 72133 - DNA, 25 bp, Homo sapien
gccagtccctctggaggaactcaag

SEQ ID NO: 72134 - DNA, 25 bp, Homo sapien
gccagtctctccacccagaatgtag

SEQ ID NO: 72135 - DNA, 25 bp, Homo sapien
gccagtctgtccacccagaatgtag

SEQ ID NO: 72136 - DNA, 25 bp, Homo sapien
gccagtgaatgaagcgtgagaatat

SEQ ID NO: 72137 - DNA, 25 bp, Homo sapien
gccagtgaatgaagtgtgagaatat

SEQ ID NO: 72138 - DNA, 25 bp, Homo sapien
gccagtgagatgctatcgatgttgc

SEQ ID NO: 72139 - DNA, 25 bp, Homo sapien
gccagtgagatgctattgatgttgc

SEQ ID NO: 72140 - DNA, 25 bp, Homo sapien
gccagtgatatacagtagtagaaaa

SEQ ID NO: 72141 - DNA, 25 bp, Homo sapien
gccagtgatatagagtagtagaaaa

SEQ ID NO: 72142 - DNA, 25 bp, Homo sapien
gccagtgcgttacatggccagagca

SEQ ID NO: 72143 - DNA, 25 bp, Homo sapien
gccagtgcgttatatggccagagca

SEQ ID NO: 72144 - DNA, 25 bp, Homo sapien
gccagtgctaatcgtgtcattacag

SEQ ID NO: 72145 - DNA, 25 bp, Homo sapien
gccagtgctaattgtgtcattacag

SEQ ID NO: 72146 - DNA, 25 bp, Homo sapien
gccagtgttctaaagtttttgattc

SEQ ID NO: 72147 - DNA, 25 bp, Homo sapien
gccagtgttctgaagtttttgattc

SEQ ID NO: 72148 - DNA, 25 bp, Homo sapien
gccagttagcccacttactccacat

SEQ ID NO: 72149 - DNA, 25 bp, Homo sapien
gccagttagtccacttactccacat

SEQ ID NO: 72150 - DNA, 25 bp, Homo sapien
gccagttcaacatccttcattcggg

SEQ ID NO: 72151 - DNA, 25 bp, Homo sapien
gccagttcagcatccttcattcggg

SEQ ID NO: 72152 - DNA, 25 bp, Homo sapien
gccagtttagccagtggaataatat

SEQ ID NO: 72153 - DNA, 25 bp, Homo sapien
gccagtttagctagtggaataatat

SEQ ID NO: 72154 - DNA, 25 bp, Homo sapien
gccagtttattcacatgtaatctcg

SEQ ID NO: 72155 - DNA, 25 bp, Homo sapien
gccagtttattcacgtgtaatctcg

SEQ ID NO: 72156 - DNA, 25 bp, Homo sapien
gccagtttccgattccttttcctca

SEQ ID NO: 72157 - DNA, 25 bp, Homo sapien
gccagtttctgattccttttcctca

SEQ ID NO: 72158 - DNA, 25 bp, Homo sapien
gccagtttgcccaccactttgccag

SEQ ID NO: 72159 - DNA, 25 bp, Homo sapien
gccagtttgcccagcactttgccag

SEQ ID NO: 72160 - DNA, 25 bp, Homo sapien
gccataataagtcacagccatgagc

SEQ ID NO: 72161 - DNA, 25 bp, Homo sapien
gccataataagtcatagccatgagc

SEQ ID NO: 72162 - DNA, 25 bp, Homo sapien
gccataattccttagtttggagtca

SEQ ID NO: 72163 - DNA, 25 bp, Homo sapien
gccataattgcttagtttggagtca

SEQ ID NO: 72164 - DNA, 25 bp, Homo sapien
gccatactatcaataggagagtgaa

SEQ ID NO: 72165 - DNA, 25 bp, Homo sapien
gccatactgtcaataggagagtgaa

SEQ ID NO: 72166 - DNA, 25 bp, Homo sapien
gccatagatagacaatttgccttaa

SEQ ID NO: 72167 - DNA, 25 bp, Homo sapien
gccatagatagtaatgcctgtgatg

SEQ ID NO: 72168 - DNA, 25 bp, Homo sapien
gccatagatagtcaatttgccttaa

SEQ ID NO: 72169 - DNA, 25 bp, Homo sapien
gccatagatagtgatgcctgtgatg

SEQ ID NO: 72170 - DNA, 25 bp, Homo sapien
gccatatgagttcattaaaaaatat

SEQ ID NO: 72171 - DNA, 25 bp, Homo sapien
gccatatgagttcattcaaaaatat

SEQ ID NO: 72172 - DNA, 25 bp, Homo sapien
gccatattaacagattcacaagctc

SEQ ID NO: 72173 - DNA, 25 bp, Homo sapien
gccatattaacaggttcacaagctc

SEQ ID NO: 72174 - DNA, 25 bp, Homo sapien
gccatattcaaattcagccatttat

SEQ ID NO: 72175 - DNA, 25 bp, Homo sapien
gccatattccaattcagccatttat

SEQ ID NO: 72176 - DNA, 25 bp, Homo sapien
gccatcaagaagaatgtttactgga

SEQ ID NO: 72177 - DNA, 25 bp, Homo sapien
gccatcaagaagactgtttactgga

SEQ ID NO: 72178 - DNA, 25 bp, Homo sapien
gccatcacaggtaaattcttacaat

SEQ ID NO: 72179 - DNA, 25 bp, Homo sapien
gccatcacaggtaagttcttacaat

SEQ ID NO: 72180 - DNA, 25 bp, Homo sapien
gccatcccattctcttctgacctat

SEQ ID NO: 72181 - DNA, 25 bp, Homo sapien
gccatcccattgtcttctgacctat

SEQ ID NO: 72182 - DNA, 25 bp, Homo sapien
gccatcctcagtagactttaaacaa

SEQ ID NO: 72183 - DNA, 25 bp, Homo sapien
gccatcctcggtagactttaaacaa

SEQ ID NO: 72184 - DNA, 25 bp, Homo sapien
gccatcttgtaccgcaaacaaaaaa

SEQ ID NO: 72185 - DNA, 25 bp, Homo sapien
gccatcttgtactgcaaacaaaaaa

SEQ ID NO: 72186 - DNA, 25 bp, Homo sapien
gccatcttttgctttaatagtaagg

SEQ ID NO: 72187 - DNA, 25 bp, Homo sapien
gccatcttttgctttagtagtaagg

SEQ ID NO: 72188 - DNA, 25 bp, Homo sapien
gccatgaaaatttaaaaggactaga

SEQ ID NO: 72189 - DNA, 25 bp, Homo sapien
gccatgaaaattttaaaggactaga

SEQ ID NO: 72190 - DNA, 25 bp, Homo sapien
gccatgaagagtccttcctcagctt

SEQ ID NO: 72191 - DNA, 25 bp, Homo sapien
gccatgaagagtctttcctcagctt

SEQ ID NO: 72192 - DNA, 25 bp, Homo sapien
gccatgacctgaacaaagatcagta

SEQ ID NO: 72193 - DNA, 25 bp, Homo sapien
gccatgacctgaaccaagatcagta

SEQ ID NO: 72194 - DNA, 25 bp, Homo sapien
gccatgagtacattttcaggctcgt

SEQ ID NO: 72195 - DNA, 25 bp, Homo sapien
gccatgagtacgttttcaggctcgt

SEQ ID NO: 72196 - DNA, 25 bp, Homo sapien
gccatgcagatgacaggctgaaagg

SEQ ID NO: 72197 - DNA, 25 bp, Homo sapien
gccatgcagatgacgggctgaaagg

SEQ ID NO: 72198 - DNA, 25 bp, Homo sapien
gccatgctgaacgtggggcatctag

SEQ ID NO: 72199 - DNA, 25 bp, Homo sapien
gccatgctggacgtggggcatctag

SEQ ID NO: 72200 - DNA, 25 bp, Homo sapien
gccatggaaataacggccagcatag

SEQ ID NO: 72201 - DNA, 25 bp, Homo sapien
gccatggaaataatggccagcatag

SEQ ID NO: 72202 - DNA, 25 bp, Homo sapien
gccatggagataaatttgcaatcac

SEQ ID NO: 72203 - DNA, 25 bp, Homo sapien
gccatggagatacatttgcaatcac

SEQ ID NO: 72204 - DNA, 25 bp, Homo sapien
gccatggcatattgtagtcctatac

SEQ ID NO: 72205 - DNA, 25 bp, Homo sapien
gccatggcgtattgtagtcctatac

SEQ ID NO: 72206 - DNA, 25 bp, Homo sapien
gccatgggaatctctttgcctttgt

SEQ ID NO: 72207 - DNA, 25 bp, Homo sapien
gccatgggattctctttgcctttgt

SEQ ID NO: 72208 - DNA, 25 bp, Homo sapien
gccatgggtatgttcacgatatcac

SEQ ID NO: 72209 - DNA, 25 bp, Homo sapien
gccatgggtatgttcatgatatcac

SEQ ID NO: 72210 - DNA, 25 bp, Homo sapien
gccatgggttttcaactgacagcct

SEQ ID NO: 72211 - DNA, 25 bp, Homo sapien
gccatgggttttcagctgacagcct

SEQ ID NO: 72212 - DNA, 25 bp, Homo sapien
gccatggtggttacggtgaaagact

SEQ ID NO: 72213 - DNA, 25 bp, Homo sapien
gccatggtggttgcggtgaaagact

SEQ ID NO: 72214 - DNA, 25 bp, Homo sapien
gccatgtacaccactggatttgctg

SEQ ID NO: 72215 - DNA, 25 bp, Homo sapien
gccatgtataccactggatttgctg

SEQ ID NO: 72216 - DNA, 25 bp, Homo sapien
gccatgtgaggacataacaggaaaa

SEQ ID NO: 72217 - DNA, 25 bp, Homo sapien
gccatgtgaggacataccaggaaaa

SEQ ID NO: 72218 - DNA, 25 bp, Homo sapien
gccatgtgtcccgatgttccatagc

SEQ ID NO: 72219 - DNA, 25 bp, Homo sapien
gccatgtgtcctgatgttccatagc

SEQ ID NO: 72220 - DNA, 25 bp, Homo sapien
gccatgttgaggcttccacaacaga

SEQ ID NO: 72221 - DNA, 25 bp, Homo sapien
gccatgttgaggtttccacaacaga

SEQ ID NO: 72222 - DNA, 25 bp, Homo sapien
gccattacaccatatttgaattatg

SEQ ID NO: 72223 - DNA, 25 bp, Homo sapien
gccattacgccatatttgaattatg

SEQ ID NO: 72224 - DNA, 25 bp, Homo sapien
gccattagaacctccagatgtcttc

SEQ ID NO: 72225 - DNA, 25 bp, Homo sapien
gccattagaacctgcagatgtcttc

SEQ ID NO: 72226 - DNA, 25 bp, Homo sapien
gccattatggtattgtccagttttt

SEQ ID NO: 72227 - DNA, 25 bp, Homo sapien
gccattatgttattgtccagttttt

SEQ ID NO: 72228 - DNA, 25 bp, Homo sapien
gccattcaccgaatataaagcagtc

SEQ ID NO: 72229 - DNA, 25 bp, Homo sapien
gccattcactgaatataaagcagtc

SEQ ID NO: 72230 - DNA, 25 bp, Homo sapien
gccattccacgtgattgctaaaccc

SEQ ID NO: 72231 - DNA, 25 bp, Homo sapien
gccattccacgtggttgctaaaccc

SEQ ID NO: 72232 - DNA, 25 bp, Homo sapien
gccattcttgagctaagtaagaagt

SEQ ID NO: 72233 - DNA, 25 bp, Homo sapien
gccattcttgaggtaagtaagaagt

SEQ ID NO: 72234 - DNA, 25 bp, Homo sapien
gccattgaaccagacagaaagagtt

SEQ ID NO: 72235 - DNA, 25 bp, Homo sapien
gccattgacccagacagaaagagtt

SEQ ID NO: 72236 - DNA, 25 bp, Homo sapien
gccattgcaaaatttactactgaga

SEQ ID NO: 72237 - DNA, 25 bp, Homo sapien
gccattgcaaagtttactactgaga

SEQ ID NO: 72238 - DNA, 25 bp, Homo sapien
gccattgcagtcttttccttggcag

SEQ ID NO: 72239 - DNA, 25 bp, Homo sapien
gccattgcagtgttttccttggcag

SEQ ID NO: 72240 - DNA, 25 bp, Homo sapien
gccattgcataataaggggtatcag

SEQ ID NO: 72241 - DNA, 25 bp, Homo sapien
gccattgcatagtaaggggtatcag

SEQ ID NO: 72242 - DNA, 25 bp, Homo sapien
gccattgccatgttcagcttggatg

SEQ ID NO: 72243 - DNA, 25 bp, Homo sapien
gccattgccctgaaaagaaggaccc

SEQ ID NO: 72244 - DNA, 25 bp, Homo sapien
gccattgccctgaagagaaggaccc

SEQ ID NO: 72245 - DNA, 25 bp, Homo sapien
gccattgctatgttcagcttggatg

SEQ ID NO: 72246 - DNA, 25 bp, Homo sapien
gccattggaaaaacagaaattaaaa

SEQ ID NO: 72247 - DNA, 25 bp, Homo sapien
gccattggaaaaatagaaattaaaa

SEQ ID NO: 72248 - DNA, 25 bp, Homo sapien
gccattggcagataaaaaattagga

SEQ ID NO: 72249 - DNA, 25 bp, Homo sapien
gccattggtagataaaaaattagga

SEQ ID NO: 72250 - DNA, 25 bp, Homo sapien
gccattgtaaagaagtagaatttaa

SEQ ID NO: 72251 - DNA, 25 bp, Homo sapien
gccattgtaaagaggtagaatttaa

SEQ ID NO: 72252 - DNA, 25 bp, Homo sapien
gccattgttttacttgttgttattg

SEQ ID NO: 72253 - DNA, 25 bp, Homo sapien
gccattgttttgcttgttgttattg

SEQ ID NO: 72254 - DNA, 25 bp, Homo sapien
gccatttatacatcatcactctctg

SEQ ID NO: 72255 - DNA, 25 bp, Homo sapien
gccatttatacatcgtcactctctg

SEQ ID NO: 72256 - DNA, 25 bp, Homo sapien
gccatttatctttctacgcctctgt

SEQ ID NO: 72257 - DNA, 25 bp, Homo sapien
gccatttatctttctatgcctctgt

SEQ ID NO: 72258 - DNA, 25 bp, Homo sapien
gccatttccaagtctgggttaatca

SEQ ID NO: 72259 - DNA, 25 bp, Homo sapien
gccatttccaagtttgggttaatca

SEQ ID NO: 72260 - DNA, 25 bp, Homo sapien
gccatttgcttccccgtatatgtgc

SEQ ID NO: 72261 - DNA, 25 bp, Homo sapien
gccatttgttgagcattggcaataa

SEQ ID NO: 72262 - DNA, 25 bp, Homo sapien
gccatttgttgagcgttggcaataa

SEQ ID NO: 72263 - DNA, 25 bp, Homo sapien
gccatttgtttccccgtatatgtgc

SEQ ID NO: 72264 - DNA, 25 bp, Homo sapien
gccattttcagacatttagagctat

SEQ ID NO: 72265 - DNA, 25 bp, Homo sapien
gccattttcagacgtttagagctat

SEQ ID NO: 72266 - DNA, 25 bp, Homo sapien
gcccaaaaaaatatgtgattcctgc

SEQ ID NO: 72267 - DNA, 25 bp, Homo sapien
gcccaaaaaaatatgttattcctgc

SEQ ID NO: 72268 - DNA, 25 bp, Homo sapien
gcccaaaaggcgtcatcagctgtca

SEQ ID NO: 72269 - DNA, 25 bp, Homo sapien
gcccaaaatgcgtcatcagctgtca

SEQ ID NO: 72270 - DNA, 25 bp, Homo sapien
gcccaaactcaagaatgagaatgaa

SEQ ID NO: 72271 - DNA, 25 bp, Homo sapien
gcccaaactgaagaatgagaatgaa

SEQ ID NO: 72272 - DNA, 25 bp, Homo sapien
gcccaaatctaatccaatgcaagac

SEQ ID NO: 72273 - DNA, 25 bp, Homo sapien
gcccaaatctaatccagtgcaagac

SEQ ID NO: 72274 - DNA, 25 bp, Homo sapien
gcccaaatgccagatgatgaatcca

SEQ ID NO: 72275 - DNA, 25 bp, Homo sapien
gcccaaatgccaggtgatgaatcca

SEQ ID NO: 72276 - DNA, 25 bp, Homo sapien
gcccaaccaatgctttcttggtctc

SEQ ID NO: 72277 - DNA, 25 bp, Homo sapien
gcccaaccgatgctttcttggtctc

SEQ ID NO: 72278 - DNA, 25 bp, Homo sapien
gcccaactgcacctatgccctgcta

SEQ ID NO: 72279 - DNA, 25 bp, Homo sapien
gcccaactgcacttatgccctgcta

SEQ ID NO: 72280 - DNA, 25 bp, Homo sapien
gcccaagatagtagacataaaacaa

SEQ ID NO: 72281 - DNA, 25 bp, Homo sapien
gcccaagatagtagtcataaaacaa

SEQ ID NO: 72282 - DNA, 25 bp, Homo sapien
gcccaaggaccaatcagtgtgcact

SEQ ID NO: 72283 - DNA, 25 bp, Homo sapien
gcccaaggaccagtcagtgtgcact

SEQ ID NO: 72284 - DNA, 25 bp, Homo sapien
gcccaagtgctcactagtccagaga

SEQ ID NO: 72285 - DNA, 25 bp, Homo sapien
gcccaagtgctcgctagtccagaga

SEQ ID NO: 72286 - DNA, 25 bp, Homo sapien
gcccaatcaatgagtggtgggtctc

SEQ ID NO: 72287 - DNA, 25 bp, Homo sapien
gcccaatcagtgagtggtgggtctc

SEQ ID NO: 72288 - DNA, 25 bp, Homo sapien
gcccacaaggagacagagatgattg

SEQ ID NO: 72289 - DNA, 25 bp, Homo sapien
gcccacaaggagacggagatgattg

SEQ ID NO: 72290 - DNA, 25 bp, Homo sapien
gcccacagaaaatggacatttgtta

SEQ ID NO: 72291 - DNA, 25 bp, Homo sapien
gcccacagaaaattgacatttgtta

SEQ ID NO: 72292 - DNA, 25 bp, Homo sapien
gcccacagctataggtgactagatg

SEQ ID NO: 72293 - DNA, 25 bp, Homo sapien
gcccacagctataggttactagatg

SEQ ID NO: 72294 - DNA, 25 bp, Homo sapien
gcccacagctttcaaatttataagt

SEQ ID NO: 72295 - DNA, 25 bp, Homo sapien
gcccacaggacacgtcaccttttct

SEQ ID NO: 72296 - DNA, 25 bp, Homo sapien
gcccacaggacatgtcaccttttct

SEQ ID NO: 72297 - DNA, 25 bp, Homo sapien
gcccacaggtttcaaatttataagt

SEQ ID NO: 72298 - DNA, 25 bp, Homo sapien
gcccacctaaaatgatgatcacaga

SEQ ID NO: 72299 - DNA, 25 bp, Homo sapien
gcccacctgaaatgatgatcacaga

SEQ ID NO: 72300 - DNA, 25 bp, Homo sapien
gcccacgtgttcttcagtcagcttt

SEQ ID NO: 72301 - DNA, 25 bp, Homo sapien
gcccacgtgttctttagtcagcttt

SEQ ID NO: 72302 - DNA, 25 bp, Homo sapien
gcccagaaacatgtaataggccctc

SEQ ID NO: 72303 - DNA, 25 bp, Homo sapien
gcccagaaacatttaataggccctc

SEQ ID NO: 72304 - DNA, 25 bp, Homo sapien
gcccagaacagcagaatataacaga

SEQ ID NO: 72305 - DNA, 25 bp, Homo sapien
gcccagaatagcagaatataacaga

SEQ ID NO: 72306 - DNA, 25 bp, Homo sapien
gcccagagctcaccacatctactta

SEQ ID NO: 72307 - DNA, 25 bp, Homo sapien
gcccagagctcgccacatctactta

SEQ ID NO: 72308 - DNA, 25 bp, Homo sapien
gcccagaggatagcgacggctgtgg

SEQ ID NO: 72309 - DNA, 25 bp, Homo sapien
gcccagagtatagcgacggctgtgg

SEQ ID NO: 72310 - DNA, 25 bp, Homo sapien
gcccagagtttaccttggctttgtg

SEQ ID NO: 72311 - DNA, 25 bp, Homo sapien
gcccagagtttatcttggctttgtg

SEQ ID NO: 72312 - DNA, 25 bp, Homo sapien
gcccagatattcctcacctatggtt

SEQ ID NO: 72313 - DNA, 25 bp, Homo sapien
gcccagatattccttacctatggtt

SEQ ID NO: 72314 - DNA, 25 bp, Homo sapien
gcccagatgctgaaagaacatttac

SEQ ID NO: 72315 - DNA, 25 bp, Homo sapien
gcccagatgctggaagaacatttac

SEQ ID NO: 72316 - DNA, 25 bp, Homo sapien
gcccagctaagactagcagagactc

SEQ ID NO: 72317 - DNA, 25 bp, Homo sapien
gcccagctaagattagcagagactc

SEQ ID NO: 72318 - DNA, 25 bp, Homo sapien
gcccagcttctaccgtctgtttttg

SEQ ID NO: 72319 - DNA, 25 bp, Homo sapien
gcccagcttctactgtctgtttttg

SEQ ID NO: 72320 - DNA, 25 bp, Homo sapien
gcccaggagagggatttttttcttg

SEQ ID NO: 72321 - DNA, 25 bp, Homo sapien
gcccaggagagggctttttttcttg

SEQ ID NO: 72322 - DNA, 25 bp, Homo sapien
gcccaggcgctgaatgggctttgga

SEQ ID NO: 72323 - DNA, 25 bp, Homo sapien
gcccaggcgctgagtgggctttgga

SEQ ID NO: 72324 - DNA, 25 bp, Homo sapien
gcccaggtttaaagtttctcaggct

SEQ ID NO: 72325 - DNA, 25 bp, Homo sapien
gcccaggtttagagtttctcaggct

SEQ ID NO: 72326 - DNA, 25 bp, Homo sapien
gcccagtattgcttggttggagcat

SEQ ID NO: 72327 - DNA, 25 bp, Homo sapien
gcccagtattgtttggttggagcat

SEQ ID NO: 72328 - DNA, 25 bp, Homo sapien
gcccagtgagagaagacgcacctca

SEQ ID NO: 72329 - DNA, 25 bp, Homo sapien
gcccagtgagagaagatgcacctca

SEQ ID NO: 72330 - DNA, 25 bp, Homo sapien
gcccagtggctgatcacactcaatt

SEQ ID NO: 72331 - DNA, 25 bp, Homo sapien
gcccagtggctgatcatactcaatt

SEQ ID NO: 72332 - DNA, 25 bp, Homo sapien
gcccatacataaatctttgccgaga

SEQ ID NO: 72333 - DNA, 25 bp, Homo sapien
gcccatacataagtctttgccgaga

SEQ ID NO: 72334 - DNA, 25 bp, Homo sapien
gcccatagatggatgcctgaataga

SEQ ID NO: 72335 - DNA, 25 bp, Homo sapien
gcccatagatgtatgcctgaataga

SEQ ID NO: 72336 - DNA, 25 bp, Homo sapien
gcccataggagccgggaccatttct

SEQ ID NO: 72337 - DNA, 25 bp, Homo sapien
gcccataggagctgggaccatttct

SEQ ID NO: 72338 - DNA, 25 bp, Homo sapien
gcccataggccacttaacagctttg

SEQ ID NO: 72339 - DNA, 25 bp, Homo sapien
gcccataggccagttaacagctttg

SEQ ID NO: 72340 - DNA, 25 bp, Homo sapien
gcccatcaattcaagcatttatcat

SEQ ID NO: 72341 - DNA, 25 bp, Homo sapien
gcccatcagtgacaaagtacaaact

SEQ ID NO: 72342 - DNA, 25 bp, Homo sapien
gcccatcagtgaccaagtacaaact

SEQ ID NO: 72343 - DNA, 25 bp, Homo sapien
gcccatcagttcaagcatttatcat

SEQ ID NO: 72344 - DNA, 25 bp, Homo sapien
gcccatcgcgtatatcaactcatcc

SEQ ID NO: 72345 - DNA, 25 bp, Homo sapien
gcccatcgcgtctatcaactcatcc

SEQ ID NO: 72346 - DNA, 25 bp, Homo sapien
gcccattcatggtgtcatatagaag

SEQ ID NO: 72347 - DNA, 25 bp, Homo sapien
gcccattcatggtgtcgtatagaag

SEQ ID NO: 72348 - DNA, 25 bp, Homo sapien
gcccattcctggttcatgagagtca

SEQ ID NO: 72349 - DNA, 25 bp, Homo sapien
gcccattcttggttcatgagagtca

SEQ ID NO: 72350 - DNA, 25 bp, Homo sapien
gcccattggcaagggaagaatgaag

SEQ ID NO: 72351 - DNA, 25 bp, Homo sapien
gcccattggtaagggaagaatgaag

SEQ ID NO: 72352 - DNA, 25 bp, Homo sapien
gcccattgtacatccaactcgttgt

SEQ ID NO: 72353 - DNA, 25 bp, Homo sapien
gcccattgtacatccacctcgttgt

SEQ ID NO: 72354 - DNA, 25 bp, Homo sapien
gcccatttccattagtatctttgat

SEQ ID NO: 72355 - DNA, 25 bp, Homo sapien
gcccatttcgattagtatctttgat

SEQ ID NO: 72356 - DNA, 25 bp, Homo sapien
gccccactgaatcttgtgtacctgt

SEQ ID NO: 72357 - DNA, 25 bp, Homo sapien
gccccactgaattttgtgtacctgt

SEQ ID NO: 72358 - DNA, 25 bp, Homo sapien
gccccaggcagtcacacggaaagct

SEQ ID NO: 72359 - DNA, 25 bp, Homo sapien
gccccaggcagtcacatggaaagct

SEQ ID NO: 72360 - DNA, 25 bp, Homo sapien
gccccagtagagacgaaaaagtagt

SEQ ID NO: 72361 - DNA, 25 bp, Homo sapien
gccccagtagagatgaaaaagtagt

SEQ ID NO: 72362 - DNA, 25 bp, Homo sapien
gccccagtggacactgaattccagc

SEQ ID NO: 72363 - DNA, 25 bp, Homo sapien
gccccagtggacgctgaattccagc

SEQ ID NO: 72364 - DNA, 25 bp, Homo sapien
gccccatttccacagaattgtcatt

SEQ ID NO: 72365 - DNA, 25 bp, Homo sapien
gccccatttccacggaattgtcatt

SEQ ID NO: 72366 - DNA, 25 bp, Homo sapien
gcccccaagctaacatgtcagccta

SEQ ID NO: 72367 - DNA, 25 bp, Homo sapien
gcccccaagctaacgtgtcagccta

SEQ ID NO: 72368 - DNA, 25 bp, Homo sapien
gcccccagctgattttacagatttt

SEQ ID NO: 72369 - DNA, 25 bp, Homo sapien
gcccccagctgcttttacagatttt

SEQ ID NO: 72370 - DNA, 25 bp, Homo sapien
gcccccagtcagtcttcctccctgg

SEQ ID NO: 72371 - DNA, 25 bp, Homo sapien
gcccccagtcagtcttgctccctgg

SEQ ID NO: 72372 - DNA, 25 bp, Homo sapien
gccccctactagcgttactgtgtcc

SEQ ID NO: 72373 - DNA, 25 bp, Homo sapien
gccccctactagtgttactgtgtcc

SEQ ID NO: 72374 - DNA, 25 bp, Homo sapien
gccccgctccagtccttttcattgg

SEQ ID NO: 72375 - DNA, 25 bp, Homo sapien
gccccgctccagttcttttcattgg

SEQ ID NO: 72376 - DNA, 25 bp, Homo sapien
gcccctagagcaaggaaaagttata

SEQ ID NO: 72377 - DNA, 25 bp, Homo sapien
gcccctagagcaagtaaaagttata

SEQ ID NO: 72378 - DNA, 25 bp, Homo sapien
gcccctattcaaccttaagaagcta

SEQ ID NO: 72379 - DNA, 25 bp, Homo sapien
gcccctattcagccttaagaagcta

SEQ ID NO: 72380 - DNA, 25 bp, Homo sapien
gcccctcaagacacgcaatctctgc

SEQ ID NO: 72381 - DNA, 25 bp, Homo sapien
gcccctcaagacatgcaatctctgc

SEQ ID NO: 72382 - DNA, 25 bp, Homo sapien
gcccctgtctgacatcggtgtctgt

SEQ ID NO: 72383 - DNA, 25 bp, Homo sapien
gcccctgtctggcatcggtgtctgt

SEQ ID NO: 72384 - DNA, 25 bp, Homo sapien
gccccttacgtggcacagctggttc

SEQ ID NO: 72385 - DNA, 25 bp, Homo sapien
gccccttatgtggcacagctggttc

SEQ ID NO: 72386 - DNA, 25 bp, Homo sapien
gcccggctgcatacatagcagtctg

SEQ ID NO: 72387 - DNA, 25 bp, Homo sapien
gcccggctgcatacgtagcagtctg

SEQ ID NO: 72388 - DNA, 25 bp, Homo sapien
gcccgggaaaggaagacaaatggat

SEQ ID NO: 72389 - DNA, 25 bp, Homo sapien
gcccgggaaaggaagagaaatggat

SEQ ID NO: 72390 - DNA, 25 bp, Homo sapien
gcccgtattgttatcgaaaagacaa

SEQ ID NO: 72391 - DNA, 25 bp, Homo sapien
gcccgtattgttatggaaaagacaa

SEQ ID NO: 72392 - DNA, 25 bp, Homo sapien
gcccgtctatggacacaaaactggt

SEQ ID NO: 72393 - DNA, 25 bp, Homo sapien
gcccgtctatggactcaaaactggt

SEQ ID NO: 72394 - DNA, 25 bp, Homo sapien
gcccgtttcaccaggataattgagc

SEQ ID NO: 72395 - DNA, 25 bp, Homo sapien
gcccgtttcaccagtataattgagc

SEQ ID NO: 72396 - DNA, 25 bp, Homo sapien
gccctaaaattatactaatatccct

SEQ ID NO: 72397 - DNA, 25 bp, Homo sapien
gccctaaaattatcctaatatccct

SEQ ID NO: 72398 - DNA, 25 bp, Homo sapien
gccctaagatccacggccgctttag

SEQ ID NO: 72399 - DNA, 25 bp, Homo sapien
gccctaagatccatggccgctttag

SEQ ID NO: 72400 - DNA, 25 bp, Homo sapien
gccctaatcagtgcattctaatagg

SEQ ID NO: 72401 - DNA, 25 bp, Homo sapien
gccctaatcagtgccttctaatagg

SEQ ID NO: 72402 - DNA, 25 bp, Homo sapien
gccctaggctaatctaagtcagcca

SEQ ID NO: 72403 - DNA, 25 bp, Homo sapien
gccctaggctaatctatgtcagcca

SEQ ID NO: 72404 - DNA, 25 bp, Homo sapien
gccctatctgaaacattctaatgaa

SEQ ID NO: 72405 - DNA, 25 bp, Homo sapien
gccctatctgaatcattctaatgaa

SEQ ID NO: 72406 - DNA, 25 bp, Homo sapien
gccctatctgccttctataactcca

SEQ ID NO: 72407 - DNA, 25 bp, Homo sapien
gccctatctgccttctgtaactcca

SEQ ID NO: 72408 - DNA, 25 bp, Homo sapien
gccctcaacttgaggcagtcagcat

SEQ ID NO: 72409 - DNA, 25 bp, Homo sapien
gccctcaatttgaggcagtcagcat

SEQ ID NO: 72410 - DNA, 25 bp, Homo sapien
gccctcagcacaaagtgtgtaatgg

SEQ ID NO: 72411 - DNA, 25 bp, Homo sapien
gccctcagcgcaaagtgtgtaatgg

SEQ ID NO: 72412 - DNA, 25 bp, Homo sapien
gccctcatctcatagctccactaga

SEQ ID NO: 72413 - DNA, 25 bp, Homo sapien
gccctcatctcttagctccactaga

SEQ ID NO: 72414 - DNA, 25 bp, Homo sapien
gccctcctctttagtttagtgtgtt

SEQ ID NO: 72415 - DNA, 25 bp, Homo sapien
gccctcctcttttgtttagtgtgtt

SEQ ID NO: 72416 - DNA, 25 bp, Homo sapien
gccctcctgtaaatacaccttaagt

SEQ ID NO: 72417 - DNA, 25 bp, Homo sapien
gccctcctgtaaatacgccttaagt

SEQ ID NO: 72418 - DNA, 25 bp, Homo sapien
gccctctatacaagcaactatgccc

SEQ ID NO: 72419 - DNA, 25 bp, Homo sapien
gccctctatacatgcaactatgccc

SEQ ID NO: 72420 - DNA, 25 bp, Homo sapien
gccctctggcctatagaacagcatg

SEQ ID NO: 72421 - DNA, 25 bp, Homo sapien
gccctctggcctgtagaacagcatg

SEQ ID NO: 72422 - DNA, 25 bp, Homo sapien
gccctcttcatgcatctttaattca

SEQ ID NO: 72423 - DNA, 25 bp, Homo sapien
gccctcttcatggatctttaattca

SEQ ID NO: 72424 - DNA, 25 bp, Homo sapien
gccctcttgagtctatccttgtctc

SEQ ID NO: 72425 - DNA, 25 bp, Homo sapien
gccctcttgagtctattcttgtctc

SEQ ID NO: 72426 - DNA, 25 bp, Homo sapien
gccctgaaaagaaggacccagtcct

SEQ ID NO: 72427 - DNA, 25 bp, Homo sapien
gccctgaagagaaggacccagtcct

SEQ ID NO: 72428 - DNA, 25 bp, Homo sapien
gccctgaatgtatcagcacatctaa

SEQ ID NO: 72429 - DNA, 25 bp, Homo sapien
gccctgaatgtttcagcacatctaa

SEQ ID NO: 72430 - DNA, 25 bp, Homo sapien
gccctgagagtccttgcctgagcca

SEQ ID NO: 72431 - DNA, 25 bp, Homo sapien
gccctgagggtccttgcctgagcca

SEQ ID NO: 72432 - DNA, 25 bp, Homo sapien
gccctgatactaatgggagacaatc

SEQ ID NO: 72433 - DNA, 25 bp, Homo sapien
gccctgatagtaatgggagacaatc

SEQ ID NO: 72434 - DNA, 25 bp, Homo sapien
gccctgcagatctttttcctggttg

SEQ ID NO: 72435 - DNA, 25 bp, Homo sapien
gccctgcatatctttttcctggttg

SEQ ID NO: 72436 - DNA, 25 bp, Homo sapien
gccctgcctggtgcgaccttagctc

SEQ ID NO: 72437 - DNA, 25 bp, Homo sapien
gccctgcctggtgtgaccttagctc

SEQ ID NO: 72438 - DNA, 25 bp, Homo sapien
gccctgcgagacatagcctgtgcct

SEQ ID NO: 72439 - DNA, 25 bp, Homo sapien
gccctgcgagacgtagcctgtgcct

SEQ ID NO: 72440 - DNA, 25 bp, Homo sapien
gccctggaaaagcgttgggccagcc

SEQ ID NO: 72441 - DNA, 25 bp, Homo sapien
gccctggaaaagtgttgggccagcc

SEQ ID NO: 72442 - DNA, 25 bp, Homo sapien
gccctggagtcactggtgtagggtc

SEQ ID NO: 72443 - DNA, 25 bp, Homo sapien
gccctggagtcattggtgtagggtc

SEQ ID NO: 72444 - DNA, 25 bp, Homo sapien
gccctgtcatccttaaagatctctg

SEQ ID NO: 72445 - DNA, 25 bp, Homo sapien
gccctgtcgtccttaaagatctctg

SEQ ID NO: 72446 - DNA, 25 bp, Homo sapien
gccctgtgagctggtctgggcatgt

SEQ ID NO: 72447 - DNA, 25 bp, Homo sapien
gccctgtgatctggtctgggcatgt

SEQ ID NO: 72448 - DNA, 25 bp, Homo sapien
gccctgttggacggaactttgcttt

SEQ ID NO: 72449 - DNA, 25 bp, Homo sapien
gccctgttggatggaactttgcttt

SEQ ID NO: 72450 - DNA, 25 bp, Homo sapien
gcccttcgaagagcaacatcagacc

SEQ ID NO: 72451 - DNA, 25 bp, Homo sapien
gcccttcgaagaggaacatcagacc

SEQ ID NO: 72452 - DNA, 25 bp, Homo sapien
gcccttctgcgttttgctttgtgag

SEQ ID NO: 72453 - DNA, 25 bp, Homo sapien
gcccttctgtgttttgctttgtgag

SEQ ID NO: 72454 - DNA, 25 bp, Homo sapien
gcccttgagctgcggcatctgtgct

SEQ ID NO: 72455 - DNA, 25 bp, Homo sapien
gcccttgagctgtggcatctgtgct

SEQ ID NO: 72456 - DNA, 25 bp, Homo sapien
gccctttcaaggagcctacagccaa

SEQ ID NO: 72457 - DNA, 25 bp, Homo sapien
gccctttcatggagcctacagccaa

SEQ ID NO: 72458 - DNA, 25 bp, Homo sapien
gccctttccggtaaaaagcaagtgg

SEQ ID NO: 72459 - DNA, 25 bp, Homo sapien
gccctttctggtaaaaagcaagtgg

SEQ ID NO: 72460 - DNA, 25 bp, Homo sapien
gcccttttcaagactcaacacactt

SEQ ID NO: 72461 - DNA, 25 bp, Homo sapien
gcccttttcaaggctcaacacactt

SEQ ID NO: 72462 - DNA, 25 bp, Homo sapien
gccctttttttttccttgtgtgtgt

SEQ ID NO: 72463 - DNA, 25 bp, Homo sapien
gcccttttttttttcttgtgtgtgt

SEQ ID NO: 72464 - DNA, 25 bp, Homo sapien
gccgaaagcaggtcaccggaagggc

SEQ ID NO: 72465 - DNA, 25 bp, Homo sapien
gccgaaagcaggtcgccggaagggc

SEQ ID NO: 72466 - DNA, 25 bp, Homo sapien
gccgaagagagaggttcgtctgaga

SEQ ID NO: 72467 - DNA, 25 bp, Homo sapien
gccgaagagagaggtttgtctgaga

SEQ ID NO: 72468 - DNA, 25 bp, Homo sapien
gccgacactgcagactgtaatgttt

SEQ ID NO: 72469 - DNA, 25 bp, Homo sapien
gccgacactgcggactgtaatgttt

SEQ ID NO: 72470 - DNA, 25 bp, Homo sapien
gccgacttgactgtggtggataaac

SEQ ID NO: 72471 - DNA, 25 bp, Homo sapien
gccgacttgactgttgtggataaac

SEQ ID NO: 72472 - DNA, 25 bp, Homo sapien
gccgaggtggtcattatcctgattt

SEQ ID NO: 72473 - DNA, 25 bp, Homo sapien
gccgaggtggtctttatcctgattt

SEQ ID NO: 72474 - DNA, 25 bp, Homo sapien
gccgatgattaacaccaggtcaggg

SEQ ID NO: 72475 - DNA, 25 bp, Homo sapien
gccgatgattaccaccaggtcaggg

SEQ ID NO: 72476 - DNA, 25 bp, Homo sapien
gccgatgccggtcttccaaagagag

SEQ ID NO: 72477 - DNA, 25 bp, Homo sapien
gccgatgctggtcttccaaagagag

SEQ ID NO: 72478 - DNA, 25 bp, Homo sapien
gccgattcattaaaataatcgactt

SEQ ID NO: 72479 - DNA, 25 bp, Homo sapien
gccgattcgttaaaataatcgactt

SEQ ID NO: 72480 - DNA, 25 bp, Homo sapien
gccgccctgaaacgaatcagaggaa

SEQ ID NO: 72481 - DNA, 25 bp, Homo sapien
gccgccctgaaatgaatcagaggaa

SEQ ID NO: 72482 - DNA, 25 bp, Homo sapien
gccgctattgctattcattctggaa

SEQ ID NO: 72483 - DNA, 25 bp, Homo sapien
gccgctattgctgttcattctggaa

SEQ ID NO: 72484 - DNA, 25 bp, Homo sapien
gccgcttccgtgccctcctgttttt

SEQ ID NO: 72485 - DNA, 25 bp, Homo sapien
gccgcttccgtgccttcctgttttt

SEQ ID NO: 72486 - DNA, 25 bp, Homo sapien
gccggaatacatcaattcatcttct

SEQ ID NO: 72487 - DNA, 25 bp, Homo sapien
gccggaatacatctattcatcttct

SEQ ID NO: 72488 - DNA, 25 bp, Homo sapien
gccggattactgctgatactacctt

SEQ ID NO: 72489 - DNA, 25 bp, Homo sapien
gccggattactgttgatactacctt

SEQ ID NO: 72490 - DNA, 25 bp, Homo sapien
gccgggcagtggcggactgtaacct

SEQ ID NO: 72491 - DNA, 25 bp, Homo sapien
gccgggcagtggtggactgtaacct

SEQ ID NO: 72492 - DNA, 25 bp, Homo sapien
gccggtggcttcatataaacaagtg

SEQ ID NO: 72493 - DNA, 25 bp, Homo sapien
gccggtggcttcatatcaacaagtg

SEQ ID NO: 72494 - DNA, 25 bp, Homo sapien
gccggtttctgtaatccgggaagac

SEQ ID NO: 72495 - DNA, 25 bp, Homo sapien
gccggtttttgtaatccgggaagac

SEQ ID NO: 72496 - DNA, 25 bp, Homo sapien
gccgtagtttcgtcatttcatattg

SEQ ID NO: 72497 - DNA, 25 bp, Homo sapien
gccgtagtttcttcatttcatattg

SEQ ID NO: 72498 - DNA, 25 bp, Homo sapien
gccgtctctccatgacttggtgctc

SEQ ID NO: 72499 - DNA, 25 bp, Homo sapien
gccgtctctccatggcttggtgctc

SEQ ID NO: 72500 - DNA, 25 bp, Homo sapien
gccgtgcctatttgtctataccagc

SEQ ID NO: 72501 - DNA, 25 bp, Homo sapien
gccgtgcctgtttgtctataccagc

SEQ ID NO: 72502 - DNA, 25 bp, Homo sapien
gccgttttcatcaatgatcttagct

SEQ ID NO: 72503 - DNA, 25 bp, Homo sapien
gccgttttcatgaatgatcttagct

SEQ ID NO: 72504 - DNA, 25 bp, Homo sapien
gccgttttcttctggtaggttggtt

SEQ ID NO: 72505 - DNA, 25 bp, Homo sapien
gccgttttcttttggtaggttggtt

SEQ ID NO: 72506 - DNA, 25 bp, Homo sapien
gcctaaaacctagactctgctctgg

SEQ ID NO: 72507 - DNA, 25 bp, Homo sapien
gcctaaaagctagactctgctctgg

SEQ ID NO: 72508 - DNA, 25 bp, Homo sapien
gcctaaaagtgcacgatttccatca

SEQ ID NO: 72509 - DNA, 25 bp, Homo sapien
gcctaaaagtgcatgatttccatca

SEQ ID NO: 72510 - DNA, 25 bp, Homo sapien
gcctaagacaccacactctgttgga

SEQ ID NO: 72511 - DNA, 25 bp, Homo sapien
gcctaagacgccacactctgttgga

SEQ ID NO: 72512 - DNA, 25 bp, Homo sapien
gcctaagtcacttatctgagtcagc

SEQ ID NO: 72513 - DNA, 25 bp, Homo sapien
gcctaagtcacttctctgagtcagc

SEQ ID NO: 72514 - DNA, 25 bp, Homo sapien
gcctaatcagcaaagatcaatcaag

SEQ ID NO: 72515 - DNA, 25 bp, Homo sapien
gcctaatcagcagagatcaatcaag

SEQ ID NO: 72516 - DNA, 25 bp, Homo sapien
gcctaatcgatcgaaagagggcatc

SEQ ID NO: 72517 - DNA, 25 bp, Homo sapien
gcctaatcgatggaaagagggcatc

SEQ ID NO: 72518 - DNA, 25 bp, Homo sapien
gcctaattcccacgggtaaacactt

SEQ ID NO: 72519 - DNA, 25 bp, Homo sapien
gcctaattcccatgggtaaacactt

SEQ ID NO: 72520 - DNA, 25 bp, Homo sapien
gcctacaacatcttgttctaccagc

SEQ ID NO: 72521 - DNA, 25 bp, Homo sapien
gcctacaatatcttgttctaccagc

SEQ ID NO: 72522 - DNA, 25 bp, Homo sapien
gcctacacccttcatcacatctgca

SEQ ID NO: 72523 - DNA, 25 bp, Homo sapien
gcctacacccttcgtcacatctgca

SEQ ID NO: 72524 - DNA, 25 bp, Homo sapien
gcctacagaattagagaactgcagg

SEQ ID NO: 72525 - DNA, 25 bp, Homo sapien
gcctacagagttagagaactgcagg

SEQ ID NO: 72526 - DNA, 25 bp, Homo sapien
gcctacatactcgatatgttagatg

SEQ ID NO: 72527 - DNA, 25 bp, Homo sapien
gcctacatactctatatgttagatg

SEQ ID NO: 72528 - DNA, 25 bp, Homo sapien
gcctacatatttggcatgtctgctg

SEQ ID NO: 72529 - DNA, 25 bp, Homo sapien
gcctacatcacacccgaacaggcaa

SEQ ID NO: 72530 - DNA, 25 bp, Homo sapien
gcctacatcacagccgaacaggcaa

SEQ ID NO: 72531 - DNA, 25 bp, Homo sapien
gcctacatgataccatctcctctct

SEQ ID NO: 72532 - DNA, 25 bp, Homo sapien
gcctacatgatactatctcctctct

SEQ ID NO: 72533 - DNA, 25 bp, Homo sapien
gcctacatgtttggcatgtctgctg

SEQ ID NO: 72534 - DNA, 25 bp, Homo sapien
gcctactaactgttaccactgagag

SEQ ID NO: 72535 - DNA, 25 bp, Homo sapien
gcctactatctgttaccactgagag

SEQ ID NO: 72536 - DNA, 25 bp, Homo sapien
gcctactctctagcatttataggag

SEQ ID NO: 72537 - DNA, 25 bp, Homo sapien
gcctactctctagcgtttataggag

SEQ ID NO: 72538 - DNA, 25 bp, Homo sapien
gcctactgcacttccaaatcttgaa

SEQ ID NO: 72539 - DNA, 25 bp, Homo sapien
gcctactgcacttctaaatcttgaa

SEQ ID NO: 72540 - DNA, 25 bp, Homo sapien
gcctacttctctattcagtttatga

SEQ ID NO: 72541 - DNA, 25 bp, Homo sapien
gcctacttctctattcggtttatga

SEQ ID NO: 72542 - DNA, 25 bp, Homo sapien
gcctactttactctttccataatca

SEQ ID NO: 72543 - DNA, 25 bp, Homo sapien
gcctactttactcttttcataatca

SEQ ID NO: 72544 - DNA, 25 bp, Homo sapien
gcctactttagacaactacaatatc

SEQ ID NO: 72545 - DNA, 25 bp, Homo sapien
gcctacttttgacaactacaatatc

SEQ ID NO: 72546 - DNA, 25 bp, Homo sapien
gcctagaagctcctccaaatgaagc

SEQ ID NO: 72547 - DNA, 25 bp, Homo sapien
gcctagaagctcttccaaatgaagc

SEQ ID NO: 72548 - DNA, 25 bp, Homo sapien
gcctagactataaactttagttatt

SEQ ID NO: 72549 - DNA, 25 bp, Homo sapien
gcctagactgtaaactttagttatt

SEQ ID NO: 72550 - DNA, 25 bp, Homo sapien
gcctagacttcagacttactaagca

SEQ ID NO: 72551 - DNA, 25 bp, Homo sapien
gcctagacttcagatttactaagca

SEQ ID NO: 72552 - DNA, 25 bp, Homo sapien
gcctagagcaagcagaagagactta

SEQ ID NO: 72553 - DNA, 25 bp, Homo sapien
gcctagagcaagcggaagagactta

SEQ ID NO: 72554 - DNA, 25 bp, Homo sapien
gcctagagggaaaacaccaagacaa

SEQ ID NO: 72555 - DNA, 25 bp, Homo sapien
gcctagagggaaaacatcaagacaa

SEQ ID NO: 72556 - DNA, 25 bp, Homo sapien
gcctagattacttatgttttagggg

SEQ ID NO: 72557 - DNA, 25 bp, Homo sapien
gcctagattgcttatgttttagggg

SEQ ID NO: 72558 - DNA, 25 bp, Homo sapien
gcctagcaataagagataaacttct

SEQ ID NO: 72559 - DNA, 25 bp, Homo sapien
gcctagcaataggagataaacttct

SEQ ID NO: 72560 - DNA, 25 bp, Homo sapien
gcctagctaacacaggaaattacct

SEQ ID NO: 72561 - DNA, 25 bp, Homo sapien
gcctagctgacacaggaaattacct

SEQ ID NO: 72562 - DNA, 25 bp, Homo sapien
gcctaggcaagcacagaatgcccat

SEQ ID NO: 72563 - DNA, 25 bp, Homo sapien
gcctaggcaagcacggaatgcccat

SEQ ID NO: 72564 - DNA, 25 bp, Homo sapien
gcctagggatgctcacagtaatgga

SEQ ID NO: 72565 - DNA, 25 bp, Homo sapien
gcctagggatgttcacagtaatgga

SEQ ID NO: 72566 - DNA, 25 bp, Homo sapien
gcctagtcctgcaaagttctgttcc

SEQ ID NO: 72567 - DNA, 25 bp, Homo sapien
gcctagtcctgcgaagttctgttcc

SEQ ID NO: 72568 - DNA, 25 bp, Homo sapien
gcctataaatcaggcattcgaggca

SEQ ID NO: 72569 - DNA, 25 bp, Homo sapien
gcctataaatcaggtattcgaggca

SEQ ID NO: 72570 - DNA, 25 bp, Homo sapien
gcctataacctctgttgttttcctt

SEQ ID NO: 72571 - DNA, 25 bp, Homo sapien
gcctataagctctgttgttttcctt

SEQ ID NO: 72572 - DNA, 25 bp, Homo sapien
gcctatacatgggtccagactccat

SEQ ID NO: 72573 - DNA, 25 bp, Homo sapien
gcctatacctgggtccagactccat

SEQ ID NO: 72574 - DNA, 25 bp, Homo sapien
gcctatagtgaaaaaccgaatattc

SEQ ID NO: 72575 - DNA, 25 bp, Homo sapien
gcctatagtgaaaatccgaatattc

SEQ ID NO: 72576 - DNA, 25 bp, Homo sapien
gcctatcacgaggccctggtatttc

SEQ ID NO: 72577 - DNA, 25 bp, Homo sapien
gcctatcatgaggccctggtatttc

SEQ ID NO: 72578 - DNA, 25 bp, Homo sapien
gcctatccaccacattccatatttg

SEQ ID NO: 72579 - DNA, 25 bp, Homo sapien
gcctatccaccatattccatatttg

SEQ ID NO: 72580 - DNA, 25 bp, Homo sapien
gcctatccagcctttccctgttatc

SEQ ID NO: 72581 - DNA, 25 bp, Homo sapien
gcctatccggcctttccctgttatc

SEQ ID NO: 72582 - DNA, 25 bp, Homo sapien
gcctatctcagcccttatcatgcct

SEQ ID NO: 72583 - DNA, 25 bp, Homo sapien
gcctatctcagctcttatcatgcct

SEQ ID NO: 72584 - DNA, 25 bp, Homo sapien
gcctatctgtctaaaagcattagga

SEQ ID NO: 72585 - DNA, 25 bp, Homo sapien
gcctatctgtctgaaagcattagga

SEQ ID NO: 72586 - DNA, 25 bp, Homo sapien
gcctatcttttgagagcatggttta

SEQ ID NO: 72587 - DNA, 25 bp, Homo sapien
gcctatcttttgcgagcatggttta

SEQ ID NO: 72588 - DNA, 25 bp, Homo sapien
gcctatgagtacactttacaggcca

SEQ ID NO: 72589 - DNA, 25 bp, Homo sapien
gcctatgagtacgctttacaggcca

SEQ ID NO: 72590 - DNA, 25 bp, Homo sapien
gcctatgtgaagccatgaaggccat

SEQ ID NO: 72591 - DNA, 25 bp, Homo sapien
gcctatgtgaagtcatgaaggccat

SEQ ID NO: 72592 - DNA, 25 bp, Homo sapien
gcctattgaaagcaaagatagcaac

SEQ ID NO: 72593 - DNA, 25 bp, Homo sapien
gcctattggaagcaaagatagcaac

SEQ ID NO: 72594 - DNA, 25 bp, Homo sapien
gcctcaaactctgaatatgcaatat

SEQ ID NO: 72595 - DNA, 25 bp, Homo sapien
gcctcaaactctgtatatgcaatat

SEQ ID NO: 72596 - DNA, 25 bp, Homo sapien
gcctcaaatgatacttatgacttta

SEQ ID NO: 72597 - DNA, 25 bp, Homo sapien
gcctcaaatgatagttatgacttta

SEQ ID NO: 72598 - DNA, 25 bp, Homo sapien
gcctcaagcatgctgaacttggaaa

SEQ ID NO: 72599 - DNA, 25 bp, Homo sapien
gcctcaagcattctgaacttggaaa

SEQ ID NO: 72600 - DNA, 25 bp, Homo sapien
gcctcaagccaataaaagcccgaaa

SEQ ID NO: 72601 - DNA, 25 bp, Homo sapien
gcctcaagccaatgaaagcccgaaa

SEQ ID NO: 72602 - DNA, 25 bp, Homo sapien
gcctcaagtacccaaaacagaccct

SEQ ID NO: 72603 - DNA, 25 bp, Homo sapien
gcctcaagtacctaaaacagaccct

SEQ ID NO: 72604 - DNA, 25 bp, Homo sapien
gcctcacatcctaaaaacggtactg

SEQ ID NO: 72605 - DNA, 25 bp, Homo sapien
gcctcacatcctgaaaacggtactg

SEQ ID NO: 72606 - DNA, 25 bp, Homo sapien
gcctcactcgcatatcttacgtagg

SEQ ID NO: 72607 - DNA, 25 bp, Homo sapien
gcctcactcgcgtatcttacgtagg

SEQ ID NO: 72608 - DNA, 25 bp, Homo sapien
gcctcactttactcctctgtaaagt

SEQ ID NO: 72609 - DNA, 25 bp, Homo sapien
gcctcactttattcctctgtaaagt

SEQ ID NO: 72610 - DNA, 25 bp, Homo sapien
gcctcagaatcgcttggagagctcc

SEQ ID NO: 72611 - DNA, 25 bp, Homo sapien
gcctcagaatctcttggagagctcc

SEQ ID NO: 72612 - DNA, 25 bp, Homo sapien
gcctcagcaactccattcacttccc

SEQ ID NO: 72613 - DNA, 25 bp, Homo sapien
gcctcagcagctccattcacttccc

SEQ ID NO: 72614 - DNA, 25 bp, Homo sapien
gcctcagctgcaataaaaaagttac

SEQ ID NO: 72615 - DNA, 25 bp, Homo sapien
gcctcagctgcgataaaaaagttac

SEQ ID NO: 72616 - DNA, 25 bp, Homo sapien
gcctcatactgcccacaatgcagct

SEQ ID NO: 72617 - DNA, 25 bp, Homo sapien
gcctcatactgcccaccatgcagct

SEQ ID NO: 72618 - DNA, 25 bp, Homo sapien
gcctcatccttacctcactttacag

SEQ ID NO: 72619 - DNA, 25 bp, Homo sapien
gcctcatccttatctcactttacag

SEQ ID NO: 72620 - DNA, 25 bp, Homo sapien
gcctcatgtctcaaaatcaggtcat

SEQ ID NO: 72621 - DNA, 25 bp, Homo sapien
gcctcatgtctcacaatcaggtcat

SEQ ID NO: 72622 - DNA, 25 bp, Homo sapien
gcctccaacccacgttctcctcagt

SEQ ID NO: 72623 - DNA, 25 bp, Homo sapien
gcctccaacccatgttctcctcagt

SEQ ID NO: 72624 - DNA, 25 bp, Homo sapien
gcctccatcaatattagagaaatgc

SEQ ID NO: 72625 - DNA, 25 bp, Homo sapien
gcctccatcaatgttagagaaatgc

SEQ ID NO: 72626 - DNA, 25 bp, Homo sapien
gcctccatcttttaagaatgcttgt

SEQ ID NO: 72627 - DNA, 25 bp, Homo sapien
gcctccatcttttaaggatgcttgt

SEQ ID NO: 72628 - DNA, 25 bp, Homo sapien
gcctccatgtctgagactcagaacc

SEQ ID NO: 72629 - DNA, 25 bp, Homo sapien
gcctccatgtctgagattcagaacc

SEQ ID NO: 72630 - DNA, 25 bp, Homo sapien
gcctcccgatgactaacttcaacag

SEQ ID NO: 72631 - DNA, 25 bp, Homo sapien
gcctcccgatgactaatttcaacag

SEQ ID NO: 72632 - DNA, 25 bp, Homo sapien
gcctccgacctgtagctggcctgct

SEQ ID NO: 72633 - DNA, 25 bp, Homo sapien
gcctccgacctgtggctggcctgct

SEQ ID NO: 72634 - DNA, 25 bp, Homo sapien
gcctcctaaggatttagctgtgctc

SEQ ID NO: 72635 - DNA, 25 bp, Homo sapien
gcctcctaatgatttagctgtgctc

SEQ ID NO: 72636 - DNA, 25 bp, Homo sapien
gcctcctttctctcatagtcagggt

SEQ ID NO: 72637 - DNA, 25 bp, Homo sapien
gcctcctttctctcgtagtcagggt

SEQ ID NO: 72638 - DNA, 25 bp, Homo sapien
gcctcgatttacctgtggtttccct

SEQ ID NO: 72639 - DNA, 25 bp, Homo sapien
gcctcgatttacttgtggtttccct

SEQ ID NO: 72640 - DNA, 25 bp, Homo sapien
gcctcggccgctgagggtctgcttt

SEQ ID NO: 72641 - DNA, 25 bp, Homo sapien
gcctcggctgctgagggtctgcttt

SEQ ID NO: 72642 - DNA, 25 bp, Homo sapien
gcctcggtgcaaatataacaataga

SEQ ID NO: 72643 - DNA, 25 bp, Homo sapien
gcctcggtgcaaatatgacaataga

SEQ ID NO: 72644 - DNA, 25 bp, Homo sapien
gcctctaaaaactcacaaagaacaa

SEQ ID NO: 72645 - DNA, 25 bp, Homo sapien
gcctctaaaaactcccaaagaacaa

SEQ ID NO: 72646 - DNA, 25 bp, Homo sapien
gcctctaaggacaccaggctctgtt

SEQ ID NO: 72647 - DNA, 25 bp, Homo sapien
gcctctaaggacgccaggctctgtt

SEQ ID NO: 72648 - DNA, 25 bp, Homo sapien
gcctctacctttccaagtgtatggc

SEQ ID NO: 72649 - DNA, 25 bp, Homo sapien
gcctctaccttttcaagtgtatggc

SEQ ID NO: 72650 - DNA, 25 bp, Homo sapien
gcctctagggtgacacagtcaatat

SEQ ID NO: 72651 - DNA, 25 bp, Homo sapien
gcctctaggttgacacagtcaatat

SEQ ID NO: 72652 - DNA, 25 bp, Homo sapien
gcctctaggtttgatcattgataca

SEQ ID NO: 72653 - DNA, 25 bp, Homo sapien
gcctctagttttgatcattgataca

SEQ ID NO: 72654 - DNA, 25 bp, Homo sapien
gcctctcacctgacttctacagggc

SEQ ID NO: 72655 - DNA, 25 bp, Homo sapien
gcctctcacctgatttctacagggc

SEQ ID NO: 72656 - DNA, 25 bp, Homo sapien
gcctctcagcgatctctcgtcagtt

SEQ ID NO: 72657 - DNA, 25 bp, Homo sapien
gcctctcagtgatctctcgtcagtt

SEQ ID NO: 72658 - DNA, 25 bp, Homo sapien
gcctctcctaccacacataacgcca

SEQ ID NO: 72659 - DNA, 25 bp, Homo sapien
gcctctcctaccacgcataacgcca

SEQ ID NO: 72660 - DNA, 25 bp, Homo sapien
gcctctcgatgacctatgaacagga

SEQ ID NO: 72661 - DNA, 25 bp, Homo sapien
gcctctcgatgagctatgaacagga

SEQ ID NO: 72662 - DNA, 25 bp, Homo sapien
gcctctctgttcaaccagaacagcc

SEQ ID NO: 72663 - DNA, 25 bp, Homo sapien
gcctctctgttccaccagaacagcc

SEQ ID NO: 72664 - DNA, 25 bp, Homo sapien
gcctctctgttgatgtatacactga

SEQ ID NO: 72665 - DNA, 25 bp, Homo sapien
gcctctctgttgatttatacactga

SEQ ID NO: 72666 - DNA, 25 bp, Homo sapien
gcctctgaacctatgaattttggac

SEQ ID NO: 72667 - DNA, 25 bp, Homo sapien
gcctctgaacctgtgaattttggac

SEQ ID NO: 72668 - DNA, 25 bp, Homo sapien
gcctctgactgaacctgtgcatagg

SEQ ID NO: 72669 - DNA, 25 bp, Homo sapien
gcctctgactgcacctgtgcatagg

SEQ ID NO: 72670 - DNA, 25 bp, Homo sapien
gcctctgaggacatatgccaatgaa

SEQ ID NO: 72671 - DNA, 25 bp, Homo sapien
gcctctgaggacctatgccaatgaa

SEQ ID NO: 72672 - DNA, 25 bp, Homo sapien
gcctctgatgcattaccatatagaa

SEQ ID NO: 72673 - DNA, 25 bp, Homo sapien
gcctctgatgccttaccatatagaa

SEQ ID NO: 72674 - DNA, 25 bp, Homo sapien
gcctctgatttaaaatcctgcttct

SEQ ID NO: 72675 - DNA, 25 bp, Homo sapien
gcctctgatttagaatcctgcttct

SEQ ID NO: 72676 - DNA, 25 bp, Homo sapien
gcctctgccgtctcttgctgtaacc

SEQ ID NO: 72677 - DNA, 25 bp, Homo sapien
gcctctgctgtctcttgctgtaacc

SEQ ID NO: 72678 - DNA, 25 bp, Homo sapien
gcctctggtcacacgttcctcaact

SEQ ID NO: 72679 - DNA, 25 bp, Homo sapien
gcctctggtcacatgttcctcaact

SEQ ID NO: 72680 - DNA, 25 bp, Homo sapien
gcctctgtgctgtggtttataaact

SEQ ID NO: 72681 - DNA, 25 bp, Homo sapien
gcctctgtgttgtggtttataaact

SEQ ID NO: 72682 - DNA, 25 bp, Homo sapien
gcctcttccatgaattacatgtagt

SEQ ID NO: 72683 - DNA, 25 bp, Homo sapien
gcctcttccgtgaattacatgtagt

SEQ ID NO: 72684 - DNA, 25 bp, Homo sapien
gcctctttaagttaagtggtattac

SEQ ID NO: 72685 - DNA, 25 bp, Homo sapien
gcctctttaagttaggtggtattac

SEQ ID NO: 72686 - DNA, 25 bp, Homo sapien
gcctctttacttttggttatgctgt

SEQ ID NO: 72687 - DNA, 25 bp, Homo sapien
gcctctttagttttggttatgctgt

SEQ ID NO: 72688 - DNA, 25 bp, Homo sapien
gcctgaaacatcgttcatggtgact

SEQ ID NO: 72689 - DNA, 25 bp, Homo sapien
gcctgaaacatggttcatggtgact

SEQ ID NO: 72690 - DNA, 25 bp, Homo sapien
gcctgaaaggatctcccacaatcat

SEQ ID NO: 72691 - DNA, 25 bp, Homo sapien
gcctgaaaggatttcccacaatcat

SEQ ID NO: 72692 - DNA, 25 bp, Homo sapien
gcctgacggtggcaaggtcaactca

SEQ ID NO: 72693 - DNA, 25 bp, Homo sapien
gcctgacggtggctaggtcaactca

SEQ ID NO: 72694 - DNA, 25 bp, Homo sapien
gcctgactatagtaaccatttcaca

SEQ ID NO: 72695 - DNA, 25 bp, Homo sapien
gcctgactatattaaccatttcaca

SEQ ID NO: 72696 - DNA, 25 bp, Homo sapien
gcctgactcgatgcgctgactgcac

SEQ ID NO: 72697 - DNA, 25 bp, Homo sapien
gcctgactcgatgtgctgactgcac

SEQ ID NO: 72698 - DNA, 25 bp, Homo sapien
gcctgagctcttagttccaagaacc

SEQ ID NO: 72699 - DNA, 25 bp, Homo sapien
gcctgagctcttagtttcaagaacc

SEQ ID NO: 72700 - DNA, 25 bp, Homo sapien
gcctgagcttcctaacctatactgg

SEQ ID NO: 72701 - DNA, 25 bp, Homo sapien
gcctgagcttcgtaacctatactgg

SEQ ID NO: 72702 - DNA, 25 bp, Homo sapien
gcctgaggagacaaaaagaaaggaa

SEQ ID NO: 72703 - DNA, 25 bp, Homo sapien
gcctgaggagataaaaagaaaggaa

SEQ ID NO: 72704 - DNA, 25 bp, Homo sapien
gcctgaggctcacatgacctctgca

SEQ ID NO: 72705 - DNA, 25 bp, Homo sapien
gcctgaggctcacgtgacctctgca

SEQ ID NO: 72706 - DNA, 25 bp, Homo sapien
gcctgagtccacagtgagtaattaa

SEQ ID NO: 72707 - DNA, 25 bp, Homo sapien
gcctgagtccagagtgagtaattaa

SEQ ID NO: 72708 - DNA, 25 bp, Homo sapien
gcctgattcccagactacaatatgg

SEQ ID NO: 72709 - DNA, 25 bp, Homo sapien
gcctgattcccagagtacaatatgg

SEQ ID NO: 72710 - DNA, 25 bp, Homo sapien
gcctgcaaagcttcacctctaggga

SEQ ID NO: 72711 - DNA, 25 bp, Homo sapien
gcctgcaaagcttcgcctctaggga

SEQ ID NO: 72712 - DNA, 25 bp, Homo sapien
gcctgcacccatgggatggaaactc

SEQ ID NO: 72713 - DNA, 25 bp, Homo sapien
gcctgcacctatgggatggaaactc

SEQ ID NO: 72714 - DNA, 25 bp, Homo sapien
gcctgcaggtaagccaagtgggcaa

SEQ ID NO: 72715 - DNA, 25 bp, Homo sapien
gcctgcaggtaaggcaagtgggcaa

SEQ ID NO: 72716 - DNA, 25 bp, Homo sapien
gcctgcagtggacgagtctatcatg

SEQ ID NO: 72717 - DNA, 25 bp, Homo sapien
gcctgcagtggaggagtctatcatg

SEQ ID NO: 72718 - DNA, 25 bp, Homo sapien
gcctgcagtttttgttactattgtt

SEQ ID NO: 72719 - DNA, 25 bp, Homo sapien
gcctgcagtttttgttcctattgtt

SEQ ID NO: 72720 - DNA, 25 bp, Homo sapien
gcctgcatcatgggattaagaaaaa

SEQ ID NO: 72721 - DNA, 25 bp, Homo sapien
gcctgcatcatggggttaagaaaaa

SEQ ID NO: 72722 - DNA, 25 bp, Homo sapien
gcctgcatgtttctataagatggag

SEQ ID NO: 72723 - DNA, 25 bp, Homo sapien
gcctgcatgtttctctaagatggag

SEQ ID NO: 72724 - DNA, 25 bp, Homo sapien
gcctgccacagaccgaatcagtgga

SEQ ID NO: 72725 - DNA, 25 bp, Homo sapien
gcctgccacagagcgaatcagtgga

SEQ ID NO: 72726 - DNA, 25 bp, Homo sapien
gcctgccctggcttagagtcccagc

SEQ ID NO: 72727 - DNA, 25 bp, Homo sapien
gcctgccctgggttagagtcccagc

SEQ ID NO: 72728 - DNA, 25 bp, Homo sapien
gcctgcctctgtgctgtggtttata

SEQ ID NO: 72729 - DNA, 25 bp, Homo sapien
gcctgcctctgtgttgtggtttata

SEQ ID NO: 72730 - DNA, 25 bp, Homo sapien
gcctgcctgataagtcacaatgaaa

SEQ ID NO: 72731 - DNA, 25 bp, Homo sapien
gcctgcctggtaagtcacaatgaaa

SEQ ID NO: 72732 - DNA, 25 bp, Homo sapien
gcctgctcccaacgtacctgttgtg

SEQ ID NO: 72733 - DNA, 25 bp, Homo sapien
gcctgctcccaatgtacctgttgtg

SEQ ID NO: 72734 - DNA, 25 bp, Homo sapien
gcctgctgaccatgctcctcgcaac

SEQ ID NO: 72735 - DNA, 25 bp, Homo sapien
gcctgctgaccatgttcctcgcaac

SEQ ID NO: 72736 - DNA, 25 bp, Homo sapien
gcctgcttgatactctaccccactg

SEQ ID NO: 72737 - DNA, 25 bp, Homo sapien
gcctgcttggtactctaccccactg

SEQ ID NO: 72738 - DNA, 25 bp, Homo sapien
gcctggaattgacactgttgcttct

SEQ ID NO: 72739 - DNA, 25 bp, Homo sapien
gcctggaattgacagtgttgcttct

SEQ ID NO: 72740 - DNA, 25 bp, Homo sapien
gcctggacattgcattgtttaaaag

SEQ ID NO: 72741 - DNA, 25 bp, Homo sapien
gcctggacattgtattgtttaaaag

SEQ ID NO: 72742 - DNA, 25 bp, Homo sapien
gcctggaccttcgctatccttctct

SEQ ID NO: 72743 - DNA, 25 bp, Homo sapien
gcctggaccttcgttatccttctct

SEQ ID NO: 72744 - DNA, 25 bp, Homo sapien
gcctggagtcaacccccagttccac

SEQ ID NO: 72745 - DNA, 25 bp, Homo sapien
gcctggagtcaacccctagttccac

SEQ ID NO: 72746 - DNA, 25 bp, Homo sapien
gcctggattctctcatacttagcac

SEQ ID NO: 72747 - DNA, 25 bp, Homo sapien
gcctggattctctgatacttagcac

SEQ ID NO: 72748 - DNA, 25 bp, Homo sapien
gcctggcaacgttctgggtgctgga

SEQ ID NO: 72749 - DNA, 25 bp, Homo sapien
gcctggcaatcatgacctcttcttt

SEQ ID NO: 72750 - DNA, 25 bp, Homo sapien
gcctggcaatgttctgggtgctgga

SEQ ID NO: 72751 - DNA, 25 bp, Homo sapien
gcctggcacaaaacagatctagaat

SEQ ID NO: 72752 - DNA, 25 bp, Homo sapien
gcctggcacaaaactgatctagaat

SEQ ID NO: 72753 - DNA, 25 bp, Homo sapien
gcctggcagtcatgacctcttcttt

SEQ ID NO: 72754 - DNA, 25 bp, Homo sapien
gcctggctaaactttattctcttct

SEQ ID NO: 72755 - DNA, 25 bp, Homo sapien
gcctggctatactttattctcttct

SEQ ID NO: 72756 - DNA, 25 bp, Homo sapien
gcctgggcgccagccaagacttgca

SEQ ID NO: 72757 - DNA, 25 bp, Homo sapien
gcctgggcgccggccaagacttgca

SEQ ID NO: 72758 - DNA, 25 bp, Homo sapien
gcctggtatacctattttgaaagat

SEQ ID NO: 72759 - DNA, 25 bp, Homo sapien
gcctggtatccctattttgaaagat

SEQ ID NO: 72760 - DNA, 25 bp, Homo sapien
gcctggtatgtttaaggaagagaaa

SEQ ID NO: 72761 - DNA, 25 bp, Homo sapien
gcctggtatgtttagggaagagaaa

SEQ ID NO: 72762 - DNA, 25 bp, Homo sapien
gcctggtcaagaactagaggacttc

SEQ ID NO: 72763 - DNA, 25 bp, Homo sapien
gcctggtcaaggactagaggacttc

SEQ ID NO: 72764 - DNA, 25 bp, Homo sapien
gcctggtctttttcggctgaatggc

SEQ ID NO: 72765 - DNA, 25 bp, Homo sapien
gcctggtcttttttggctgaatggc

SEQ ID NO: 72766 - DNA, 25 bp, Homo sapien
gcctggtgaagctacagtggaagag

SEQ ID NO: 72767 - DNA, 25 bp, Homo sapien
gcctggtgacatgtttaaaccccag

SEQ ID NO: 72768 - DNA, 25 bp, Homo sapien
gcctggtgacatttttaaaccccag

SEQ ID NO: 72769 - DNA, 25 bp, Homo sapien
gcctggtgcgaccttagctcatttg

SEQ ID NO: 72770 - DNA, 25 bp, Homo sapien
gcctggtggagctacagtggaagag

SEQ ID NO: 72771 - DNA, 25 bp, Homo sapien
gcctggtgtgaccttagctcatttg

SEQ ID NO: 72772 - DNA, 25 bp, Homo sapien
gcctgtaaattcacggctatggtaa

SEQ ID NO: 72773 - DNA, 25 bp, Homo sapien
gcctgtaaattcatggctatggtaa

SEQ ID NO: 72774 - DNA, 25 bp, Homo sapien
gcctgtaatcccaactgaggacagg

SEQ ID NO: 72775 - DNA, 25 bp, Homo sapien
gcctgtaatcccagctgaggacagg

SEQ ID NO: 72776 - DNA, 25 bp, Homo sapien
gcctgtacattcgtttaattaacac

SEQ ID NO: 72777 - DNA, 25 bp, Homo sapien
gcctgtaccaagctggtccaatcag

SEQ ID NO: 72778 - DNA, 25 bp, Homo sapien
gcctgtaccaagttggtccaatcag

SEQ ID NO: 72779 - DNA, 25 bp, Homo sapien
gcctgtaccttttaaatcaaaactc

SEQ ID NO: 72780 - DNA, 25 bp, Homo sapien
gcctgtaccttttacatcaaaactc

SEQ ID NO: 72781 - DNA, 25 bp, Homo sapien
gcctgtacgttcgtttaattaacac

SEQ ID NO: 72782 - DNA, 25 bp, Homo sapien
gcctgtactgacactggcccaggtc

SEQ ID NO: 72783 - DNA, 25 bp, Homo sapien
gcctgtactgacgctggcccaggtc

SEQ ID NO: 72784 - DNA, 25 bp, Homo sapien
gcctgtataaaatggctgttcagta

SEQ ID NO: 72785 - DNA, 25 bp, Homo sapien
gcctgtatacaatggctgttcagta

SEQ ID NO: 72786 - DNA, 25 bp, Homo sapien
gcctgtcgtcttcatcatcgtcatc

SEQ ID NO: 72787 - DNA, 25 bp, Homo sapien
gcctgtcgtcttcgtcatcgtcatc

SEQ ID NO: 72788 - DNA, 25 bp, Homo sapien
gcctgtctaggccgcccaaattgct

SEQ ID NO: 72789 - DNA, 25 bp, Homo sapien
gcctgtctaggctgcccaaattgct

SEQ ID NO: 72790 - DNA, 25 bp, Homo sapien
gcctgtgaggacaacaatttgtttt

SEQ ID NO: 72791 - DNA, 25 bp, Homo sapien
gcctgtgaggacaataatttgtttt

SEQ ID NO: 72792 - DNA, 25 bp, Homo sapien
gcctgtgatgtgactaacttttata

SEQ ID NO: 72793 - DNA, 25 bp, Homo sapien
gcctgtgatttgactaacttttata

SEQ ID NO: 72794 - DNA, 25 bp, Homo sapien
gcctgtgcattataagcaggatacg

SEQ ID NO: 72795 - DNA, 25 bp, Homo sapien
gcctgtgcgttataagcaggatacg

SEQ ID NO: 72796 - DNA, 25 bp, Homo sapien
gcctgttatatagagcaatcatgaa

SEQ ID NO: 72797 - DNA, 25 bp, Homo sapien
gcctgttatatagcgcaatcatgaa

SEQ ID NO: 72798 - DNA, 25 bp, Homo sapien
gcctgttcttgtacgaaccaaatga

SEQ ID NO: 72799 - DNA, 25 bp, Homo sapien
gcctgttcttgtatgaaccaaatga

SEQ ID NO: 72800 - DNA, 25 bp, Homo sapien
gcctgtttagcccggaagttggttt

SEQ ID NO: 72801 - DNA, 25 bp, Homo sapien
gcctgtttagcctggaagttggttt

SEQ ID NO: 72802 - DNA, 25 bp, Homo sapien
gcctgtttccagatcttctctttga

SEQ ID NO: 72803 - DNA, 25 bp, Homo sapien
gcctgttttcagatcttctctttga

SEQ ID NO: 72804 - DNA, 25 bp, Homo sapien
gccttaacaatagattagaccaagc

SEQ ID NO: 72805 - DNA, 25 bp, Homo sapien
gccttaaccatagattagaccaagc

SEQ ID NO: 72806 - DNA, 25 bp, Homo sapien
gccttaaccatgggtaacagtcatg

SEQ ID NO: 72807 - DNA, 25 bp, Homo sapien
gccttaaccgtgggtaacagtcatg

SEQ ID NO: 72808 - DNA, 25 bp, Homo sapien
gccttaagggaacattgtttgtagg

SEQ ID NO: 72809 - DNA, 25 bp, Homo sapien
gccttaagggaatattgtttgtagg

SEQ ID NO: 72810 - DNA, 25 bp, Homo sapien
gccttacaaccttatctcgttggat

SEQ ID NO: 72811 - DNA, 25 bp, Homo sapien
gccttacaagcttatctcgttggat

SEQ ID NO: 72812 - DNA, 25 bp, Homo sapien
gccttagctctggtccctctcgatg

SEQ ID NO: 72813 - DNA, 25 bp, Homo sapien
gccttagctcttgtccctctcgatg

SEQ ID NO: 72814 - DNA, 25 bp, Homo sapien
gccttatactactgcacacctgtga

SEQ ID NO: 72815 - DNA, 25 bp, Homo sapien
gccttatactactgtacacctgtga

SEQ ID NO: 72816 - DNA, 25 bp, Homo sapien
gccttatgaacaagtaagaggaaat

SEQ ID NO: 72817 - DNA, 25 bp, Homo sapien
gccttatggacaagtaagaggaaat

SEQ ID NO: 72818 - DNA, 25 bp, Homo sapien
gccttattgatacattttgacttta

SEQ ID NO: 72819 - DNA, 25 bp, Homo sapien
gccttattgatagattttgacttta

SEQ ID NO: 72820 - DNA, 25 bp, Homo sapien
gccttattggagattctagatcatt

SEQ ID NO: 72821 - DNA, 25 bp, Homo sapien
gccttattgttgttgacacggggaa

SEQ ID NO: 72822 - DNA, 25 bp, Homo sapien
gccttattgttgttgatacggggaa

SEQ ID NO: 72823 - DNA, 25 bp, Homo sapien
gccttatttgagattctagatcatt

SEQ ID NO: 72824 - DNA, 25 bp, Homo sapien
gccttcactcaacagtagtttttgt

SEQ ID NO: 72825 - DNA, 25 bp, Homo sapien
gccttcactcaacattagtttttgt

SEQ ID NO: 72826 - DNA, 25 bp, Homo sapien
gccttcactcacactcttctgtcca

SEQ ID NO: 72827 - DNA, 25 bp, Homo sapien
gccttcactcacgctcttctgtcca

SEQ ID NO: 72828 - DNA, 25 bp, Homo sapien
gccttcagaaaaattgcagcagctg

SEQ ID NO: 72829 - DNA, 25 bp, Homo sapien
gccttcagacaaattgcagcagctg

SEQ ID NO: 72830 - DNA, 25 bp, Homo sapien
gccttcagttgcgacctcagccttg

SEQ ID NO: 72831 - DNA, 25 bp, Homo sapien
gccttcagttgggacctcagccttg

SEQ ID NO: 72832 - DNA, 25 bp, Homo sapien
gccttcatctctgcagagtcagtta

SEQ ID NO: 72833 - DNA, 25 bp, Homo sapien
gccttcatctctgccgagtcagtta

SEQ ID NO: 72834 - DNA, 25 bp, Homo sapien
gccttcattattcagtggtttggca

SEQ ID NO: 72835 - DNA, 25 bp, Homo sapien
gccttcattcttcagtggtttggca

SEQ ID NO: 72836 - DNA, 25 bp, Homo sapien
gccttccacactacatgactggtag

SEQ ID NO: 72837 - DNA, 25 bp, Homo sapien
gccttccacactatatgactggtag

SEQ ID NO: 72838 - DNA, 25 bp, Homo sapien
gccttccactgagatactgactttg

SEQ ID NO: 72839 - DNA, 25 bp, Homo sapien
gccttccattgagatactgactttg

SEQ ID NO: 72840 - DNA, 25 bp, Homo sapien
gccttcgctattgtttttaacatgt

SEQ ID NO: 72841 - DNA, 25 bp, Homo sapien
gccttcgctattttttttaacatgt

SEQ ID NO: 72842 - DNA, 25 bp, Homo sapien
gccttctcgcttttctcggacacac

SEQ ID NO: 72843 - DNA, 25 bp, Homo sapien
gccttctcgcttttcttggacacac

SEQ ID NO: 72844 - DNA, 25 bp, Homo sapien
gccttctgaggttgtgcgtttaaga

SEQ ID NO: 72845 - DNA, 25 bp, Homo sapien
gccttctgaggttgtgtgtttaaga

SEQ ID NO: 72846 - DNA, 25 bp, Homo sapien
gccttctgctggtgattagagctca

SEQ ID NO: 72847 - DNA, 25 bp, Homo sapien
gccttctgctggtggttagagctca

SEQ ID NO: 72848 - DNA, 25 bp, Homo sapien
gccttctggaaaaacgtcaccctgc

SEQ ID NO: 72849 - DNA, 25 bp, Homo sapien
gccttctggaaaaatgtcaccctgc

SEQ ID NO: 72850 - DNA, 25 bp, Homo sapien
gccttcttagtatcgtaactgtttc

SEQ ID NO: 72851 - DNA, 25 bp, Homo sapien
gccttcttagtgtcgtaactgtttc

SEQ ID NO: 72852 - DNA, 25 bp, Homo sapien
gccttcttattggtaaggagtggca

SEQ ID NO: 72853 - DNA, 25 bp, Homo sapien
gccttcttatttaacttatttggta

SEQ ID NO: 72854 - DNA, 25 bp, Homo sapien
gccttcttatttatcttatttggta

SEQ ID NO: 72855 - DNA, 25 bp, Homo sapien
gccttcttccttagaaaacaaaacc

SEQ ID NO: 72856 - DNA, 25 bp, Homo sapien
gccttcttccttggaaaacaaaacc

SEQ ID NO: 72857 - DNA, 25 bp, Homo sapien
gccttcttcggttgacaagttctaa

SEQ ID NO: 72858 - DNA, 25 bp, Homo sapien
gccttcttgttggtaaggagtggca

SEQ ID NO: 72859 - DNA, 25 bp, Homo sapien
gccttctttggttgacaagttctaa

SEQ ID NO: 72860 - DNA, 25 bp, Homo sapien
gccttgacgcctcattgagtttgaa

SEQ ID NO: 72861 - DNA, 25 bp, Homo sapien
gccttgacgcctcgttgagtttgaa

SEQ ID NO: 72862 - DNA, 25 bp, Homo sapien
gccttgaggaacggtgcactgtggc

SEQ ID NO: 72863 - DNA, 25 bp, Homo sapien
gccttgaggaatggtgcactgtggc

SEQ ID NO: 72864 - DNA, 25 bp, Homo sapien
gccttgataaatactgacaaatagc

SEQ ID NO: 72865 - DNA, 25 bp, Homo sapien
gccttgataaatattgacaaatagc

SEQ ID NO: 72866 - DNA, 25 bp, Homo sapien
gccttgatccagaagatttttctca

SEQ ID NO: 72867 - DNA, 25 bp, Homo sapien
gccttgatccagcagatttttctca

SEQ ID NO: 72868 - DNA, 25 bp, Homo sapien
gccttgatttaccaggaaattacag

SEQ ID NO: 72869 - DNA, 25 bp, Homo sapien
gccttgatttactaggaaattacag

SEQ ID NO: 72870 - DNA, 25 bp, Homo sapien
gccttgcagagaagactgttccctt

SEQ ID NO: 72871 - DNA, 25 bp, Homo sapien
gccttgcagagaagcctgttccctt

SEQ ID NO: 72872 - DNA, 25 bp, Homo sapien
gccttgccaatattgaaataaaatt

SEQ ID NO: 72873 - DNA, 25 bp, Homo sapien
gccttgccacgttcagaaacggcag

SEQ ID NO: 72874 - DNA, 25 bp, Homo sapien
gccttgccacgttcggaaacggcag

SEQ ID NO: 72875 - DNA, 25 bp, Homo sapien
gccttgccagtattgaaataaaatt

SEQ ID NO: 72876 - DNA, 25 bp, Homo sapien
gccttgctttaagacagtcctctga

SEQ ID NO: 72877 - DNA, 25 bp, Homo sapien
gccttgctttaagatagtcctctga

SEQ ID NO: 72878 - DNA, 25 bp, Homo sapien
gccttggaagtaataacaaaccaga

SEQ ID NO: 72879 - DNA, 25 bp, Homo sapien
gccttggaagtaataagaaaccaga

SEQ ID NO: 72880 - DNA, 25 bp, Homo sapien
gccttgggccacgcactatccaagt

SEQ ID NO: 72881 - DNA, 25 bp, Homo sapien
gccttgggccacgcgctatccaagt

SEQ ID NO: 72882 - DNA, 25 bp, Homo sapien
gccttggtcaccgcacaggaacagg

SEQ ID NO: 72883 - DNA, 25 bp, Homo sapien
gccttggtcactgcacaggaacagg

SEQ ID NO: 72884 - DNA, 25 bp, Homo sapien
gccttggtgtagaaaactttttact

SEQ ID NO: 72885 - DNA, 25 bp, Homo sapien
gccttggtgtagataactttttact

SEQ ID NO: 72886 - DNA, 25 bp, Homo sapien
gccttggttgaattggatcagactg

SEQ ID NO: 72887 - DNA, 25 bp, Homo sapien
gccttggttgacttggatcagactg

SEQ ID NO: 72888 - DNA, 25 bp, Homo sapien
gccttgtaagaaaaccaggtgggaa

SEQ ID NO: 72889 - DNA, 25 bp, Homo sapien
gccttgtaagaaagccaggtgggaa

SEQ ID NO: 72890 - DNA, 25 bp, Homo sapien
gccttgtagaacatgttgaagattt

SEQ ID NO: 72891 - DNA, 25 bp, Homo sapien
gccttgtagaatatgttgaagattt

SEQ ID NO: 72892 - DNA, 25 bp, Homo sapien
gccttgtagttcgaggagaggaaga

SEQ ID NO: 72893 - DNA, 25 bp, Homo sapien
gccttgtagttggaggagaggaaga

SEQ ID NO: 72894 - DNA, 25 bp, Homo sapien
gccttgtatatgccattttataacc

SEQ ID NO: 72895 - DNA, 25 bp, Homo sapien
gccttgtatatgccgttttataacc

SEQ ID NO: 72896 - DNA, 25 bp, Homo sapien
gccttgtctttaccttcatcctgca

SEQ ID NO: 72897 - DNA, 25 bp, Homo sapien
gccttgtctttacctttatcctgca

SEQ ID NO: 72898 - DNA, 25 bp, Homo sapien
gccttgtgaaatcacctttaactgt

SEQ ID NO: 72899 - DNA, 25 bp, Homo sapien
gccttgtgaaatcagctttaactgt

SEQ ID NO: 72900 - DNA, 25 bp, Homo sapien
gccttgtggcataacttgcggtcca

SEQ ID NO: 72901 - DNA, 25 bp, Homo sapien
gccttgtggcataatttgcggtcca

SEQ ID NO: 72902 - DNA, 25 bp, Homo sapien
gccttgttaccaatctgatgaggaa

SEQ ID NO: 72903 - DNA, 25 bp, Homo sapien
gccttgttaccaatcttatgaggaa

SEQ ID NO: 72904 - DNA, 25 bp, Homo sapien
gcctttacacacactgatgcattac

SEQ ID NO: 72905 - DNA, 25 bp, Homo sapien
gcctttacataacagtagtcatacc

SEQ ID NO: 72906 - DNA, 25 bp, Homo sapien
gcctttacataatagtagtcatacc

SEQ ID NO: 72907 - DNA, 25 bp, Homo sapien
gcctttacatacactgatgcattac

SEQ ID NO: 72908 - DNA, 25 bp, Homo sapien
gcctttaggttcaggaagtagatga

SEQ ID NO: 72909 - DNA, 25 bp, Homo sapien
gcctttaggttcgggaagtagatga

SEQ ID NO: 72910 - DNA, 25 bp, Homo sapien
gcctttattcagatgatcctacata

SEQ ID NO: 72911 - DNA, 25 bp, Homo sapien
gcctttattcagattatcctacata

SEQ ID NO: 72912 - DNA, 25 bp, Homo sapien
gcctttcaacacatgcactgcacac

SEQ ID NO: 72913 - DNA, 25 bp, Homo sapien
gcctttcaacacatgcgctgcacac

SEQ ID NO: 72914 - DNA, 25 bp, Homo sapien
gcctttcacattatttttctttttt

SEQ ID NO: 72915 - DNA, 25 bp, Homo sapien
gcctttcatattatttttctttttt

SEQ ID NO: 72916 - DNA, 25 bp, Homo sapien
gcctttctgtagccagtcatcccaa

SEQ ID NO: 72917 - DNA, 25 bp, Homo sapien
gcctttctgtatccagtcatcccaa

SEQ ID NO: 72918 - DNA, 25 bp, Homo sapien
gcctttgagaaaaatggtaacagca

SEQ ID NO: 72919 - DNA, 25 bp, Homo sapien
gcctttgagctccaaaaattctttc

SEQ ID NO: 72920 - DNA, 25 bp, Homo sapien
gcctttgagctccgaaaattctttc

SEQ ID NO: 72921 - DNA, 25 bp, Homo sapien
gcctttgaggaaaatggtaacagca

SEQ ID NO: 72922 - DNA, 25 bp, Homo sapien
gcctttgctaagcacctcggtagat

SEQ ID NO: 72923 - DNA, 25 bp, Homo sapien
gcctttgctaagtacctcggtagat

SEQ ID NO: 72924 - DNA, 25 bp, Homo sapien
gcctttggttaagctcctgtgttcc

SEQ ID NO: 72925 - DNA, 25 bp, Homo sapien
gcctttggttaagttcctgtgttcc

SEQ ID NO: 72926 - DNA, 25 bp, Homo sapien
gccttttaaaaagcaggtgcccctt

SEQ ID NO: 72927 - DNA, 25 bp, Homo sapien
gccttttaaaaatcaggtgcccctt

SEQ ID NO: 72928 - DNA, 25 bp, Homo sapien
gccttttaacaagtcaatttggtga

SEQ ID NO: 72929 - DNA, 25 bp, Homo sapien
gccttttaacaagtcagtttggtga

SEQ ID NO: 72930 - DNA, 25 bp, Homo sapien
gccttttcagctgcttctggctata

SEQ ID NO: 72931 - DNA, 25 bp, Homo sapien
gccttttcagcttcttctggctata

SEQ ID NO: 72932 - DNA, 25 bp, Homo sapien
gccttttcagtttcataacagtgtt

SEQ ID NO: 72933 - DNA, 25 bp, Homo sapien
gccttttcattttcataacagtgtt

SEQ ID NO: 72934 - DNA, 25 bp, Homo sapien
gccttttctagtctaaagacaggcc

SEQ ID NO: 72935 - DNA, 25 bp, Homo sapien
gccttttcttgtctaaagacaggcc

SEQ ID NO: 72936 - DNA, 25 bp, Homo sapien
gcctttttgctctctgcatcccaga

SEQ ID NO: 72937 - DNA, 25 bp, Homo sapien
gcctttttgttctctgcatcccaga

SEQ ID NO: 72938 - DNA, 25 bp, Homo sapien
gcgaacaaaacaaattaggaaaact

SEQ ID NO: 72939 - DNA, 25 bp, Homo sapien
gcgaacaaaccaaattaggaaaact

SEQ ID NO: 72940 - DNA, 25 bp, Homo sapien
gcgaagaggcaaattgcagaatcta

SEQ ID NO: 72941 - DNA, 25 bp, Homo sapien
gcgaagaggcaaattgtagaatcta

SEQ ID NO: 72942 - DNA, 25 bp, Homo sapien
gcgaagaggcaagttgcagaatcta

SEQ ID NO: 72943 - DNA, 25 bp, Homo sapien
gcgaaggaatttgtatcttattgta

SEQ ID NO: 72944 - DNA, 25 bp, Homo sapien
gcgaaggaatttgtattttattgta

SEQ ID NO: 72945 - DNA, 25 bp, Homo sapien
gcgaaggcagacctgccagaagcac

SEQ ID NO: 72946 - DNA, 25 bp, Homo sapien
gcgaaggcagacttgccagaagcac

SEQ ID NO: 72947 - DNA, 25 bp, Homo sapien
gcgaagtgaaaagaatgcattaagg

SEQ ID NO: 72948 - DNA, 25 bp, Homo sapien
gcgaagtgaaaataatgcattaagg

SEQ ID NO: 72949 - DNA, 25 bp, Homo sapien
gcgaagtttccttaagacagacagg

SEQ ID NO: 72950 - DNA, 25 bp, Homo sapien
gcgaagttttcttaagacagacagg

SEQ ID NO: 72951 - DNA, 25 bp, Homo sapien
gcgaccactgaatactactgagttt

SEQ ID NO: 72952 - DNA, 25 bp, Homo sapien
gcgaccactgaatattactgagttt

SEQ ID NO: 72953 - DNA, 25 bp, Homo sapien
gcgacctcagccgtggacatcatct

SEQ ID NO: 72954 - DNA, 25 bp, Homo sapien
gcgacctcagccttggacatcatct

SEQ ID NO: 72955 - DNA, 25 bp, Homo sapien
gcgagattgggcgcattcctactcc

SEQ ID NO: 72956 - DNA, 25 bp, Homo sapien
gcgagattgggctcattcctactcc

SEQ ID NO: 72957 - DNA, 25 bp, Homo sapien
gcgagcaaacgccagcaaggtggaa

SEQ ID NO: 72958 - DNA, 25 bp, Homo sapien
gcgagcaaacgctagcaaggtggaa

SEQ ID NO: 72959 - DNA, 25 bp, Homo sapien
gcgagctagtggcacgaagcaggaa

SEQ ID NO: 72960 - DNA, 25 bp, Homo sapien
gcgagctagtggcatgaagcaggaa

SEQ ID NO: 72961 - DNA, 25 bp, Homo sapien
gcgagctatcatactgcattgtttt

SEQ ID NO: 72962 - DNA, 25 bp, Homo sapien
gcgagctatcatgctgcattgtttt

SEQ ID NO: 72963 - DNA, 25 bp, Homo sapien
gcgagctggaaaataccaacggcaa

SEQ ID NO: 72964 - DNA, 25 bp, Homo sapien
gcgagctggaaaatactaacggcaa

SEQ ID NO: 72965 - DNA, 25 bp, Homo sapien
gcgagctggagacccgagaaagcca

SEQ ID NO: 72966 - DNA, 25 bp, Homo sapien
gcgagctggagacgcgagaaagcca

SEQ ID NO: 72967 - DNA, 25 bp, Homo sapien
gcgagctggtgtagagttgaccttc

SEQ ID NO: 72968 - DNA, 25 bp, Homo sapien
gcgagctggtgtggagttgaccttc

SEQ ID NO: 72969 - DNA, 25 bp, Homo sapien
gcgaggagataaaatgccctggttc

SEQ ID NO: 72970 - DNA, 25 bp, Homo sapien
gcgaggaggtaaaatgccctggttc

SEQ ID NO: 72971 - DNA, 25 bp, Homo sapien
gcgagtttttgcttcagttttgtgt

SEQ ID NO: 72972 - DNA, 25 bp, Homo sapien
gcgagtttttgcttgagttttgtgt

SEQ ID NO: 72973 - DNA, 25 bp, Homo sapien
gcgatcatgtataaaaacattacac

SEQ ID NO: 72974 - DNA, 25 bp, Homo sapien
gcgatcatgtatgaaaacattacac

SEQ ID NO: 72975 - DNA, 25 bp, Homo sapien
gcgatctgcaacatttcatttaata

SEQ ID NO: 72976 - DNA, 25 bp, Homo sapien
gcgatctgcaacttttcatttaata

SEQ ID NO: 72977 - DNA, 25 bp, Homo sapien
gcgatcttccctgtgtcataagtaa

SEQ ID NO: 72978 - DNA, 25 bp, Homo sapien
gcgatcttccctgtttcataagtaa

SEQ ID NO: 72979 - DNA, 25 bp, Homo sapien
gcgatgaaatttctgatttgtaaat

SEQ ID NO: 72980 - DNA, 25 bp, Homo sapien
gcgatgaaatttgtgatttgtaaat

SEQ ID NO: 72981 - DNA, 25 bp, Homo sapien
gcgatgaggagatagggagagaact

SEQ ID NO: 72982 - DNA, 25 bp, Homo sapien
gcgatgaggagctagggagagaact

SEQ ID NO: 72983 - DNA, 25 bp, Homo sapien
gcgattggaaaatgaaagcaagatg

SEQ ID NO: 72984 - DNA, 25 bp, Homo sapien
gcgattggaaaatggaagcaagatg

SEQ ID NO: 72985 - DNA, 25 bp, Homo sapien
gcgattgtcctatgaaagactaggg

SEQ ID NO: 72986 - DNA, 25 bp, Homo sapien
gcgattgtcctgtgaaagactaggg

SEQ ID NO: 72987 - DNA, 25 bp, Homo sapien
gcgcacctcagtattatgtgtatga

SEQ ID NO: 72988 - DNA, 25 bp, Homo sapien
gcgcacctcagtgttatgtgtatga

SEQ ID NO: 72989 - DNA, 25 bp, Homo sapien
gcgcatcaccatgcatagctaattt

SEQ ID NO: 72990 - DNA, 25 bp, Homo sapien
gcgcatcactatgcatagctaattt

SEQ ID NO: 72991 - DNA, 25 bp, Homo sapien
gcgcatgtctaataaagggtcaagg

SEQ ID NO: 72992 - DNA, 25 bp, Homo sapien
gcgcatgtctaataaatggtcaagg

SEQ ID NO: 72993 - DNA, 25 bp, Homo sapien
gcgccactacataaaaggattcaga

SEQ ID NO: 72994 - DNA, 25 bp, Homo sapien
gcgccactacataaaatgattcaga

SEQ ID NO: 72995 - DNA, 25 bp, Homo sapien
gcgcctaatcagcaaagatcaatca

SEQ ID NO: 72996 - DNA, 25 bp, Homo sapien
gcgcctaatcagcagagatcaatca

SEQ ID NO: 72997 - DNA, 25 bp, Homo sapien
gcgcctgagtccacagtgagtaatt

SEQ ID NO: 72998 - DNA, 25 bp, Homo sapien
gcgcctgagtccagagtgagtaatt

SEQ ID NO: 72999 - DNA, 25 bp, Homo sapien
gcgcgcatcaccatgcatagctaat

SEQ ID NO: 73000 - DNA, 25 bp, Homo sapien
gcgcgcatcactatgcatagctaat

SEQ ID NO: 73001 - DNA, 25 bp, Homo sapien
gcgcgcatgcaatagatccagggtg

SEQ ID NO: 73002 - DNA, 25 bp, Homo sapien
gcgcgcatgcaatggatccagggtg

SEQ ID NO: 73003 - DNA, 25 bp, Homo sapien
gcgctaactggcttcccgtgccgac

SEQ ID NO: 73004 - DNA, 25 bp, Homo sapien
gcgctaactggctttccgtgccgac

SEQ ID NO: 73005 - DNA, 25 bp, Homo sapien
gcgctagttgacggctagcccaagc

SEQ ID NO: 73006 - DNA, 25 bp, Homo sapien
gcgctagttgatggctagcccaagc

SEQ ID NO: 73007 - DNA, 25 bp, Homo sapien
gcgcttcccactaaccaaagattat

SEQ ID NO: 73008 - DNA, 25 bp, Homo sapien
gcgcttcccactaaccgaagattat

SEQ ID NO: 73009 - DNA, 25 bp, Homo sapien
gcgcttcccgctttgttctctctct

SEQ ID NO: 73010 - DNA, 25 bp, Homo sapien
gcgcttcctgctttgttctctctct

SEQ ID NO: 73011 - DNA, 25 bp, Homo sapien
gcgctttttccaagtgtgctgtatt

SEQ ID NO: 73012 - DNA, 25 bp, Homo sapien
gcgctttttgcaagtgtgctgtatt

SEQ ID NO: 73013 - DNA, 25 bp, Homo sapien
gcggaactttcatatgctgtactgg

SEQ ID NO: 73014 - DNA, 25 bp, Homo sapien
gcggaactttcatgtgctgtactgg

SEQ ID NO: 73015 - DNA, 25 bp, Homo sapien
gcggaagaagatatggacacaaaag

SEQ ID NO: 73016 - DNA, 25 bp, Homo sapien
gcggaagaagatgtggacacaaaag

SEQ ID NO: 73017 - DNA, 25 bp, Homo sapien
gcggagagacgaaaattctaagaaa

SEQ ID NO: 73018 - DNA, 25 bp, Homo sapien
gcggagagacgaacattctaagaaa

SEQ ID NO: 73019 - DNA, 25 bp, Homo sapien
gcggatccctgaatgccacacttcc

SEQ ID NO: 73020 - DNA, 25 bp, Homo sapien
gcggatccctgagtgccacacttcc

SEQ ID NO: 73021 - DNA, 25 bp, Homo sapien
gcggatgagaaataaatcggagctg

SEQ ID NO: 73022 - DNA, 25 bp, Homo sapien
gcggatgagaaatcaatcggagctg

SEQ ID NO: 73023 - DNA, 25 bp, Homo sapien
gcggcagatgcatgatggagtagct

SEQ ID NO: 73024 - DNA, 25 bp, Homo sapien
gcggcagatgcgtgatggagtagct

SEQ ID NO: 73025 - DNA, 25 bp, Homo sapien
gcggccaagatgaattttgaggaac

SEQ ID NO: 73026 - DNA, 25 bp, Homo sapien
gcggccaagatgcattttgaggaac

SEQ ID NO: 73027 - DNA, 25 bp, Homo sapien
gcggcgtatcggagacgagtttaac

SEQ ID NO: 73028 - DNA, 25 bp, Homo sapien
gcggcgtattggagacgagtttaac

SEQ ID NO: 73029 - DNA, 25 bp, Homo sapien
gcggctaccgtgggataagaaacag

SEQ ID NO: 73030 - DNA, 25 bp, Homo sapien
gcggctactgtgggataagaaacag

SEQ ID NO: 73031 - DNA, 25 bp, Homo sapien
gcggctcgctggcatgttgctggca

SEQ ID NO: 73032 - DNA, 25 bp, Homo sapien
gcggctcgctggcgtgttgctggca

SEQ ID NO: 73033 - DNA, 25 bp, Homo sapien
gcgggaagaaatcaacaaaggatgc

SEQ ID NO: 73034 - DNA, 25 bp, Homo sapien
gcgggaagaaatcagcaaaggatgc

SEQ ID NO: 73035 - DNA, 25 bp, Homo sapien
gcgggaataggccagaaagagggac

SEQ ID NO: 73036 - DNA, 25 bp, Homo sapien
gcgggaataggcgagaaagagggac

SEQ ID NO: 73037 - DNA, 25 bp, Homo sapien
gcgggacactgagttcttccccagt

SEQ ID NO: 73038 - DNA, 25 bp, Homo sapien
gcgggacagtgagttcttccccagt

SEQ ID NO: 73039 - DNA, 25 bp, Homo sapien
gcgggacagttaagaaaatggaaga

SEQ ID NO: 73040 - DNA, 25 bp, Homo sapien
gcgggacagttgagaaaatggaaga

SEQ ID NO: 73041 - DNA, 25 bp, Homo sapien
gcgggcagaaatacttgtctctccc

SEQ ID NO: 73042 - DNA, 25 bp, Homo sapien
gcgggcaggaatacttgtctctccc

SEQ ID NO: 73043 - DNA, 25 bp, Homo sapien
gcggggactccagccttataaaata

SEQ ID NO: 73044 - DNA, 25 bp, Homo sapien
gcggggactccaggcttataaaata

SEQ ID NO: 73045 - DNA, 25 bp, Homo sapien
gcgggtgatatctgagtgtggcctg

SEQ ID NO: 73046 - DNA, 25 bp, Homo sapien
gcgggtgatatttgagtgtggcctg

SEQ ID NO: 73047 - DNA, 25 bp, Homo sapien
gcggtaataacaagtctattctaca

SEQ ID NO: 73048 - DNA, 25 bp, Homo sapien
gcggtaatagcaagtctattctaca

SEQ ID NO: 73049 - DNA, 25 bp, Homo sapien
gcggttaggaaggttgtcaaaatga

SEQ ID NO: 73050 - DNA, 25 bp, Homo sapien
gcggttaggaagtttgtcaaaatga

SEQ ID NO: 73051 - DNA, 25 bp, Homo sapien
gcggtttacaaacattttctcacga

SEQ ID NO: 73052 - DNA, 25 bp, Homo sapien
gcggtttacaaatattttctcacga

SEQ ID NO: 73053 - DNA, 25 bp, Homo sapien
gcgtaaaattacctgcaatttgtga

SEQ ID NO: 73054 - DNA, 25 bp, Homo sapien
gcgtaaaattatctgcaatttgtga

SEQ ID NO: 73055 - DNA, 25 bp, Homo sapien
gcgtaacccactccacttccaaagc

SEQ ID NO: 73056 - DNA, 25 bp, Homo sapien
gcgtaacccgctccacttccaaagc

SEQ ID NO: 73057 - DNA, 25 bp, Homo sapien
gcgtagtcaacactttagtaatgta

SEQ ID NO: 73058 - DNA, 25 bp, Homo sapien
gcgtagtcaacattttagtaatgta

SEQ ID NO: 73059 - DNA, 25 bp, Homo sapien
gcgtatgccttaacttttcagaaat

SEQ ID NO: 73060 - DNA, 25 bp, Homo sapien
gcgtatgccttagcttttcagaaat

SEQ ID NO: 73061 - DNA, 25 bp, Homo sapien
gcgtcatatgaggtttaggtcctct

SEQ ID NO: 73062 - DNA, 25 bp, Homo sapien
gcgtcatatgaggtttgggtcctct

SEQ ID NO: 73063 - DNA, 25 bp, Homo sapien
gcgtcctcagagagtagaaagaaca

SEQ ID NO: 73064 - DNA, 25 bp, Homo sapien
gcgtcctcggagagtagaaagaaca

SEQ ID NO: 73065 - DNA, 25 bp, Homo sapien
gcgtctattcgtaatttctgacact

SEQ ID NO: 73066 - DNA, 25 bp, Homo sapien
gcgtctattcgtagtttctgacact

SEQ ID NO: 73067 - DNA, 25 bp, Homo sapien
gcgtcttctctttcaatgtcagaag

SEQ ID NO: 73068 - DNA, 25 bp, Homo sapien
gcgtcttctctttctatgtcagaag

SEQ ID NO: 73069 - DNA, 25 bp, Homo sapien
gcgtgaaccctggcattttcatgat

SEQ ID NO: 73070 - DNA, 25 bp, Homo sapien
gcgtgaaccctggcgttttcatgat

SEQ ID NO: 73071 - DNA, 25 bp, Homo sapien
gcgtgacccactgtgcctagtcaaa

SEQ ID NO: 73072 - DNA, 25 bp, Homo sapien
gcgtgacctactgtgcctagtcaaa

SEQ ID NO: 73073 - DNA, 25 bp, Homo sapien
gcgtgatcaaacataaaatgcacta

SEQ ID NO: 73074 - DNA, 25 bp, Homo sapien
gcgtgatcaaacatcaaatgcacta

SEQ ID NO: 73075 - DNA, 25 bp, Homo sapien
gcgtgattgttagtgcagatctgtg

SEQ ID NO: 73076 - DNA, 25 bp, Homo sapien
gcgtgattgttagtgcggatctgtg

SEQ ID NO: 73077 - DNA, 25 bp, Homo sapien
gcgtgatttggcaacagaaatatgc

SEQ ID NO: 73078 - DNA, 25 bp, Homo sapien
gcgtgatttggcaatagaaatatgc

SEQ ID NO: 73079 - DNA, 25 bp, Homo sapien
gcgtgctcggatcttaccacatact

SEQ ID NO: 73080 - DNA, 25 bp, Homo sapien
gcgtgctcggattttaccacatact

SEQ ID NO: 73081 - DNA, 25 bp, Homo sapien
gcgtgctctcgaattgaatgccatg

SEQ ID NO: 73082 - DNA, 25 bp, Homo sapien
gcgtgctctggaattgaatgccatg

SEQ ID NO: 73083 - DNA, 25 bp, Homo sapien
gcgtgtccttgggaaacttgctgtg

SEQ ID NO: 73084 - DNA, 25 bp, Homo sapien
gcgtgtccttgggcaacttgctgtg

SEQ ID NO: 73085 - DNA, 25 bp, Homo sapien
gcgttaacacgtaatttagtacata

SEQ ID NO: 73086 - DNA, 25 bp, Homo sapien
gcgttaacatgtaatttagtacata

SEQ ID NO: 73087 - DNA, 25 bp, Homo sapien
gcgttgacacgaacatcatactgaa

SEQ ID NO: 73088 - DNA, 25 bp, Homo sapien
gcgttgacatgaacatcatactgaa

SEQ ID NO: 73089 - DNA, 25 bp, Homo sapien
gcgtttacatcgaagggcttgattt

SEQ ID NO: 73090 - DNA, 25 bp, Homo sapien
gcgtttacgtcgaagggcttgattt

SEQ ID NO: 73091 - DNA, 25 bp, Homo sapien
gcgttttattcacatcagttgtttt

SEQ ID NO: 73092 - DNA, 25 bp, Homo sapien
gcgttttattcgcatcagttgtttt

SEQ ID NO: 73093 - DNA, 25 bp, Homo sapien
gcgttttcatcccacaaattcgaat

SEQ ID NO: 73094 - DNA, 25 bp, Homo sapien
gcgttttcatcctacaaattcgaat

SEQ ID NO: 73095 - DNA, 25 bp, Homo sapien
gcgttttgattaagtgctggatttg

SEQ ID NO: 73096 - DNA, 25 bp, Homo sapien
gcgttttgatttagtgctggatttg

SEQ ID NO: 73097 - DNA, 25 bp, Homo sapien
gctaaaaagcgaagaataaggcacc

SEQ ID NO: 73098 - DNA, 25 bp, Homo sapien
gctaaaaagcgaggaataaggcacc

SEQ ID NO: 73099 - DNA, 25 bp, Homo sapien
gctaaaacatactaacacatgactt

SEQ ID NO: 73100 - DNA, 25 bp, Homo sapien
gctaaaacttactaacacatgactt

SEQ ID NO: 73101 - DNA, 25 bp, Homo sapien
gctaaaagtcggtcacacaagatat

SEQ ID NO: 73102 - DNA, 25 bp, Homo sapien
gctaaaagtgggtcacacaagatat

SEQ ID NO: 73103 - DNA, 25 bp, Homo sapien
gctaaaataaacagtcttcattcac

SEQ ID NO: 73104 - DNA, 25 bp, Homo sapien
gctaaaataaatagtcttcattcac

SEQ ID NO: 73105 - DNA, 25 bp, Homo sapien
gctaaaatatgtctcattccaaaca

SEQ ID NO: 73106 - DNA, 25 bp, Homo sapien
gctaaaatgtgtctcattccaaaca

SEQ ID NO: 73107 - DNA, 25 bp, Homo sapien
gctaaacaaagaagataagcgctga

SEQ ID NO: 73108 - DNA, 25 bp, Homo sapien
gctaaacaaggaagataagcgctga

SEQ ID NO: 73109 - DNA, 25 bp, Homo sapien
gctaaacacactcaatgagaaaagg

SEQ ID NO: 73110 - DNA, 25 bp, Homo sapien
gctaaacacactcagtgagaaaagg

SEQ ID NO: 73111 - DNA, 25 bp, Homo sapien
gctaaaccgatacagggaagctctc

SEQ ID NO: 73112 - DNA, 25 bp, Homo sapien
gctaaaccgatatagggaagctctc

SEQ ID NO: 73113 - DNA, 25 bp, Homo sapien
gctaaactacgcaggccctcttggc

SEQ ID NO: 73114 - DNA, 25 bp, Homo sapien
gctaaactatgcaggccctcttggc

SEQ ID NO: 73115 - DNA, 25 bp, Homo sapien
gctaaagagtatacaagggtgtttt

SEQ ID NO: 73116 - DNA, 25 bp, Homo sapien
gctaaagattatacaagggtgtttt

SEQ ID NO: 73117 - DNA, 25 bp, Homo sapien
gctaaagatttcccaattttactgg

SEQ ID NO: 73118 - DNA, 25 bp, Homo sapien
gctaaagatttctcaattttactgg

SEQ ID NO: 73119 - DNA, 25 bp, Homo sapien
gctaaaggagacacaggtgatccag

SEQ ID NO: 73120 - DNA, 25 bp, Homo sapien
gctaaaggagacacgggtgatccag

SEQ ID NO: 73121 - DNA, 25 bp, Homo sapien
gctaaagtccacgagggccacgtat

SEQ ID NO: 73122 - DNA, 25 bp, Homo sapien
gctaaagtctacgagggccacgtat

SEQ ID NO: 73123 - DNA, 25 bp, Homo sapien
gctaaagtctgtacccagctacctc

SEQ ID NO: 73124 - DNA, 25 bp, Homo sapien
gctaaagtctgtactcagctacctc

SEQ ID NO: 73125 - DNA, 25 bp, Homo sapien
gctaaagttaaagcaatatgcaatc

SEQ ID NO: 73126 - DNA, 25 bp, Homo sapien
gctaaagttaaggcaatatgcaatc

SEQ ID NO: 73127 - DNA, 25 bp, Homo sapien
gctaaagtttacatcataaagtgtc

SEQ ID NO: 73128 - DNA, 25 bp, Homo sapien
gctaaagtttacgtcataaagtgtc

SEQ ID NO: 73129 - DNA, 25 bp, Homo sapien
gctaaataaagcgatcctggtgtgt

SEQ ID NO: 73130 - DNA, 25 bp, Homo sapien
gctaaataaagctatcctggtgtgt

SEQ ID NO: 73131 - DNA, 25 bp, Homo sapien
gctaaatagactcacacggcaaaag

SEQ ID NO: 73132 - DNA, 25 bp, Homo sapien
gctaaatagactcacatggcaaaag

SEQ ID NO: 73133 - DNA, 25 bp, Homo sapien
gctaaatagagacgttgcaggagac

SEQ ID NO: 73134 - DNA, 25 bp, Homo sapien
gctaaatagaggcgttgcaggagac

SEQ ID NO: 73135 - DNA, 25 bp, Homo sapien
gctaaatctactattgaggtttact

SEQ ID NO: 73136 - DNA, 25 bp, Homo sapien
gctaaatctactgttgaggtttact

SEQ ID NO: 73137 - DNA, 25 bp, Homo sapien
gctaaatctcttgcacaggtatctc

SEQ ID NO: 73138 - DNA, 25 bp, Homo sapien
gctaaatctgttgcacaggtatctc

SEQ ID NO: 73139 - DNA, 25 bp, Homo sapien
gctaaatgctagtggcgttcagtgg

SEQ ID NO: 73140 - DNA, 25 bp, Homo sapien
gctaaatgctagtggctttcagtgg

SEQ ID NO: 73141 - DNA, 25 bp, Homo sapien
gctaacaattctcattggttatctg

SEQ ID NO: 73142 - DNA, 25 bp, Homo sapien
gctaacaattcttattggttatctg

SEQ ID NO: 73143 - DNA, 25 bp, Homo sapien
gctaacaccactggctcatctctga

SEQ ID NO: 73144 - DNA, 25 bp, Homo sapien
gctaacaccgctggctcatctctga

SEQ ID NO: 73145 - DNA, 25 bp, Homo sapien
gctaacataatcttataataatgtt

SEQ ID NO: 73146 - DNA, 25 bp, Homo sapien
gctaacatactcttataataatgtt

SEQ ID NO: 73147 - DNA, 25 bp, Homo sapien
gctaacctacttgaaccagctggat

SEQ ID NO: 73148 - DNA, 25 bp, Homo sapien
gctaacctactttaaccagctggat

SEQ ID NO: 73149 - DNA, 25 bp, Homo sapien
gctaacctggttcctaacacgtcta

SEQ ID NO: 73150 - DNA, 25 bp, Homo sapien
gctaacctggtttctaacacgtcta

SEQ ID NO: 73151 - DNA, 25 bp, Homo sapien
gctaactctagctaaccatctcaca

SEQ ID NO: 73152 - DNA, 25 bp, Homo sapien
gctaactctggctaaccatctcaca

SEQ ID NO: 73153 - DNA, 25 bp, Homo sapien
gctaactgatttgaacatgaagttg

SEQ ID NO: 73154 - DNA, 25 bp, Homo sapien
gctaactgcagcacagcgaagacac

SEQ ID NO: 73155 - DNA, 25 bp, Homo sapien
gctaactgcagcacagtgaagacac

SEQ ID NO: 73156 - DNA, 25 bp, Homo sapien
gctaactggcttcccgtgccgactc

SEQ ID NO: 73157 - DNA, 25 bp, Homo sapien
gctaactggctttccgtgccgactc

SEQ ID NO: 73158 - DNA, 25 bp, Homo sapien
gctaactggtttgaacatgaagttg

SEQ ID NO: 73159 - DNA, 25 bp, Homo sapien
gctaacttctatgcttattggttta

SEQ ID NO: 73160 - DNA, 25 bp, Homo sapien
gctaacttctatgtttattggttta

SEQ ID NO: 73161 - DNA, 25 bp, Homo sapien
gctaactttattgtatacaaactca

SEQ ID NO: 73162 - DNA, 25 bp, Homo sapien
gctaactttattgtgtacaaactca

SEQ ID NO: 73163 - DNA, 25 bp, Homo sapien
gctaagatagggcacgaccgaactt

SEQ ID NO: 73164 - DNA, 25 bp, Homo sapien
gctaagatagggcatgaccgaactt

SEQ ID NO: 73165 - DNA, 25 bp, Homo sapien
gctaagatattgctaaagagaagta

SEQ ID NO: 73166 - DNA, 25 bp, Homo sapien
gctaagatattgctaaggagaagta

SEQ ID NO: 73167 - DNA, 25 bp, Homo sapien
gctaagcagaaccagaaagtaaaac

SEQ ID NO: 73168 - DNA, 25 bp, Homo sapien
gctaagcagaaccggaaagtaaaac

SEQ ID NO: 73169 - DNA, 25 bp, Homo sapien
gctaagcataaagctgttatcagac

SEQ ID NO: 73170 - DNA, 25 bp, Homo sapien
gctaagcattaagctgttatcagac

SEQ ID NO: 73171 - DNA, 25 bp, Homo sapien
gctaagcattgtgccgcaacagctg

SEQ ID NO: 73172 - DNA, 25 bp, Homo sapien
gctaagcattgtgctgcaacagctg

SEQ ID NO: 73173 - DNA, 25 bp, Homo sapien
gctaagcgtcaataaacagcatcct

SEQ ID NO: 73174 - DNA, 25 bp, Homo sapien
gctaagcgtcagtaaacagcatcct

SEQ ID NO: 73175 - DNA, 25 bp, Homo sapien
gctaagctggctaagctggtgagtg

SEQ ID NO: 73176 - DNA, 25 bp, Homo sapien
gctaagctggctaatctggtgagtg

SEQ ID NO: 73177 - DNA, 25 bp, Homo sapien
gctaagctgttaattgatgtgaaca

SEQ ID NO: 73178 - DNA, 25 bp, Homo sapien
gctaagctgttatttgatgtgaaca

SEQ ID NO: 73179 - DNA, 25 bp, Homo sapien
gctaaggaaaacacgaattccgaaa

SEQ ID NO: 73180 - DNA, 25 bp, Homo sapien
gctaaggaaaacatgaattccgaaa

SEQ ID NO: 73181 - DNA, 25 bp, Homo sapien
gctaaggaattaatgcaggcactga

SEQ ID NO: 73182 - DNA, 25 bp, Homo sapien
gctaaggaattactgcaggcactga

SEQ ID NO: 73183 - DNA, 25 bp, Homo sapien
gctaaggggaataacggcctggctt

SEQ ID NO: 73184 - DNA, 25 bp, Homo sapien
gctaaggggaataagggcctggctt

SEQ ID NO: 73185 - DNA, 25 bp, Homo sapien
gctaagtaagaatgaatatagtcca

SEQ ID NO: 73186 - DNA, 25 bp, Homo sapien
gctaagtaagaatgcatatagtcca

SEQ ID NO: 73187 - DNA, 25 bp, Homo sapien
gctaagtcaacttgtgcaattttcc

SEQ ID NO: 73188 - DNA, 25 bp, Homo sapien
gctaagtcagaccaaggctggccca

SEQ ID NO: 73189 - DNA, 25 bp, Homo sapien
gctaagtcagaccgaggctggccca

SEQ ID NO: 73190 - DNA, 25 bp, Homo sapien
gctaagtcatcttgtgcaattttcc

SEQ ID NO: 73191 - DNA, 25 bp, Homo sapien
gctaagtcatttctttgccatcaga

SEQ ID NO: 73192 - DNA, 25 bp, Homo sapien
gctaagtcctttctttgccatcaga

SEQ ID NO: 73193 - DNA, 25 bp, Homo sapien
gctaagtgtccaacatgcattctct

SEQ ID NO: 73194 - DNA, 25 bp, Homo sapien
gctaagtgtccaacgtgcattctct

SEQ ID NO: 73195 - DNA, 25 bp, Homo sapien
gctaagttgcacttgaattttgaaa

SEQ ID NO: 73196 - DNA, 25 bp, Homo sapien
gctaagttgcatttgaattttgaaa

SEQ ID NO: 73197 - DNA, 25 bp, Homo sapien
gctaatacctataataacatttctc

SEQ ID NO: 73198 - DNA, 25 bp, Homo sapien
gctaatacgatgaaaaccaaggatt

SEQ ID NO: 73199 - DNA, 25 bp, Homo sapien
gctaatacgatgaaaagcaaggatt

SEQ ID NO: 73200 - DNA, 25 bp, Homo sapien
gctaatacgtataataacatttctc

SEQ ID NO: 73201 - DNA, 25 bp, Homo sapien
gctaatactctacggactgaaacac

SEQ ID NO: 73202 - DNA, 25 bp, Homo sapien
gctaatactctatggactgaaacac

SEQ ID NO: 73203 - DNA, 25 bp, Homo sapien
gctaatagaaaaaaagccaaacagg

SEQ ID NO: 73204 - DNA, 25 bp, Homo sapien
gctaatagagaaaaagccaaacagg

SEQ ID NO: 73205 - DNA, 25 bp, Homo sapien
gctaatatacatcgcttggagtttg

SEQ ID NO: 73206 - DNA, 25 bp, Homo sapien
gctaatatacatggcttggagtttg

SEQ ID NO: 73207 - DNA, 25 bp, Homo sapien
gctaatcaactggattaattggatg

SEQ ID NO: 73208 - DNA, 25 bp, Homo sapien
gctaatcaactggattgattggatg

SEQ ID NO: 73209 - DNA, 25 bp, Homo sapien
gctaatcatcaattaaatgaatcgc

SEQ ID NO: 73210 - DNA, 25 bp, Homo sapien
gctaatcatcaattgaatgaatcgc

SEQ ID NO: 73211 - DNA, 25 bp, Homo sapien
gctaatctttttgatcctccaattc

SEQ ID NO: 73212 - DNA, 25 bp, Homo sapien
gctaatcttttttatcctccaattc

SEQ ID NO: 73213 - DNA, 25 bp, Homo sapien
gctaatgaaagatatgttgacttac

SEQ ID NO: 73214 - DNA, 25 bp, Homo sapien
gctaatgaaatacataactgcctgg

SEQ ID NO: 73215 - DNA, 25 bp, Homo sapien
gctaatgaaatacgtaactgcctgg

SEQ ID NO: 73216 - DNA, 25 bp, Homo sapien
gctaatgaaggatatgttgacttac

SEQ ID NO: 73217 - DNA, 25 bp, Homo sapien
gctaattagatcaggaacctaatct

SEQ ID NO: 73218 - DNA, 25 bp, Homo sapien
gctaattagatcaggaccctaatct

SEQ ID NO: 73219 - DNA, 25 bp, Homo sapien
gctaattctacaccaattcttccaa

SEQ ID NO: 73220 - DNA, 25 bp, Homo sapien
gctaattctacacctattcttccaa

SEQ ID NO: 73221 - DNA, 25 bp, Homo sapien
gctaattctatgaagtcagtcactt

SEQ ID NO: 73222 - DNA, 25 bp, Homo sapien
gctaattctatgaggtcagtcactt

SEQ ID NO: 73223 - DNA, 25 bp, Homo sapien
gctaattgctatatatggttatgta

SEQ ID NO: 73224 - DNA, 25 bp, Homo sapien
gctaattgctatgtatggttatgta

SEQ ID NO: 73225 - DNA, 25 bp, Homo sapien
gctaattggaaacaggaaggagcac

SEQ ID NO: 73226 - DNA, 25 bp, Homo sapien
gctaattggaaagaggaaggagcac

SEQ ID NO: 73227 - DNA, 25 bp, Homo sapien
gctaattgtatgggatcacttaccc

SEQ ID NO: 73228 - DNA, 25 bp, Homo sapien
gctaattgtgtgggatcacttaccc

SEQ ID NO: 73229 - DNA, 25 bp, Homo sapien
gctaatttctatccatctttgcttc

SEQ ID NO: 73230 - DNA, 25 bp, Homo sapien
gctaatttctatccgtctttgcttc

SEQ ID NO: 73231 - DNA, 25 bp, Homo sapien
gctacaaaatccagtgcaaagctgt

SEQ ID NO: 73232 - DNA, 25 bp, Homo sapien
gctacaaaatccggtgcaaagctgt

SEQ ID NO: 73233 - DNA, 25 bp, Homo sapien
gctacaaaattgacgaattccttca

SEQ ID NO: 73234 - DNA, 25 bp, Homo sapien
gctacaaaattgatgaattccttca

SEQ ID NO: 73235 - DNA, 25 bp, Homo sapien
gctacaacgtggatcaatcttggaa

SEQ ID NO: 73236 - DNA, 25 bp, Homo sapien
gctacaacgtggatgaatcttggaa

SEQ ID NO: 73237 - DNA, 25 bp, Homo sapien
gctacaacttaccatatcttccttc

SEQ ID NO: 73238 - DNA, 25 bp, Homo sapien
gctacaacttacgatatcttccttc

SEQ ID NO: 73239 - DNA, 25 bp, Homo sapien
gctacaagccaagaacacctgaggc

SEQ ID NO: 73240 - DNA, 25 bp, Homo sapien
gctacaagccaggaacacctgaggc

SEQ ID NO: 73241 - DNA, 25 bp, Homo sapien
gctacaaggaaagaagagctatcct

SEQ ID NO: 73242 - DNA, 25 bp, Homo sapien
gctacaaggaacgaagagctatcct

SEQ ID NO: 73243 - DNA, 25 bp, Homo sapien
gctacaccaactacataagcagctc

SEQ ID NO: 73244 - DNA, 25 bp, Homo sapien
gctacaccacctacataagcagctc

SEQ ID NO: 73245 - DNA, 25 bp, Homo sapien
gctacactacacaacttgatacatt

SEQ ID NO: 73246 - DNA, 25 bp, Homo sapien
gctacactatacaacttgatacatt

SEQ ID NO: 73247 - DNA, 25 bp, Homo sapien
gctacagaatagatgtattagcagg

SEQ ID NO: 73248 - DNA, 25 bp, Homo sapien
gctacagaatagatgtgttagcagg

SEQ ID NO: 73249 - DNA, 25 bp, Homo sapien
gctacagataaacagggaggaaatg

SEQ ID NO: 73250 - DNA, 25 bp, Homo sapien
gctacagataaagagggaggaaatg

SEQ ID NO: 73251 - DNA, 25 bp, Homo sapien
gctacagccactgcacacccaggct

SEQ ID NO: 73252 - DNA, 25 bp, Homo sapien
gctacagcgactgcacacccaggct

SEQ ID NO: 73253 - DNA, 25 bp, Homo sapien
gctacagctggaattcttgctatgc

SEQ ID NO: 73254 - DNA, 25 bp, Homo sapien
gctacagctgggattcttgctatgc

SEQ ID NO: 73255 - DNA, 25 bp, Homo sapien
gctacaggccggcgagctgggggat

SEQ ID NO: 73256 - DNA, 25 bp, Homo sapien
gctacaggctggcgagctgggggat

SEQ ID NO: 73257 - DNA, 25 bp, Homo sapien
gctacaggttcacataggtcagctc

SEQ ID NO: 73258 - DNA, 25 bp, Homo sapien
gctacaggttcacgtaggtcagctc

SEQ ID NO: 73259 - DNA, 25 bp, Homo sapien
gctacagtctcagttcaggtcttct

SEQ ID NO: 73260 - DNA, 25 bp, Homo sapien
gctacagtctcagttcgggtcttct

SEQ ID NO: 73261 - DNA, 25 bp, Homo sapien
gctacataagacctagatatgctct

SEQ ID NO: 73262 - DNA, 25 bp, Homo sapien
gctacatacgacctagatatgctct

SEQ ID NO: 73263 - DNA, 25 bp, Homo sapien
gctacatagattgttgtttcgggga

SEQ ID NO: 73264 - DNA, 25 bp, Homo sapien
gctacatagatttttgtttcgggga

SEQ ID NO: 73265 - DNA, 25 bp, Homo sapien
gctacatagtgaggaacggtagttg

SEQ ID NO: 73266 - DNA, 25 bp, Homo sapien
gctacatagtgaggaatggtagttg

SEQ ID NO: 73267 - DNA, 25 bp, Homo sapien
gctacatgctaaaatgtgaatgatc

SEQ ID NO: 73268 - DNA, 25 bp, Homo sapien
gctacatgctataatgtgaatgatc

SEQ ID NO: 73269 - DNA, 25 bp, Homo sapien
gctacatggaagatggaattaaggt

SEQ ID NO: 73270 - DNA, 25 bp, Homo sapien
gctacatggcagatggaattaaggt

SEQ ID NO: 73271 - DNA, 25 bp, Homo sapien
gctacatgggcaactccggcgtctc

SEQ ID NO: 73272 - DNA, 25 bp, Homo sapien
gctacatgggcaactctggcgtctc

SEQ ID NO: 73273 - DNA, 25 bp, Homo sapien
gctaccaacactgtgttctttgatc

SEQ ID NO: 73274 - DNA, 25 bp, Homo sapien
gctaccaagactgtgttctttgatc

SEQ ID NO: 73275 - DNA, 25 bp, Homo sapien
gctaccagtgcatcgctaaggcttc

SEQ ID NO: 73276 - DNA, 25 bp, Homo sapien
gctaccagtgcattgctaaggcttc

SEQ ID NO: 73277 - DNA, 25 bp, Homo sapien
gctaccatgcctgaataattttttg

SEQ ID NO: 73278 - DNA, 25 bp, Homo sapien
gctaccatgcctgagtaattttttg

SEQ ID NO: 73279 - DNA, 25 bp, Homo sapien
gctacccattatcaattaccttctt

SEQ ID NO: 73280 - DNA, 25 bp, Homo sapien
gctacccattattaattaccttctt

SEQ ID NO: 73281 - DNA, 25 bp, Homo sapien
gctaccgacgtgcatcaaccagcct

SEQ ID NO: 73282 - DNA, 25 bp, Homo sapien
gctaccgacgtgcgtcaaccagcct

SEQ ID NO: 73283 - DNA, 25 bp, Homo sapien
gctacctcttgcctaaatgtgttct

SEQ ID NO: 73284 - DNA, 25 bp, Homo sapien
gctacctcttgcttaaatgtgttct

SEQ ID NO: 73285 - DNA, 25 bp, Homo sapien
gctaccttccaaggctgccagagcc

SEQ ID NO: 73286 - DNA, 25 bp, Homo sapien
gctacctttcaaggctgccagagcc

SEQ ID NO: 73287 - DNA, 25 bp, Homo sapien
gctaccttttcacatgtgtagtttt

SEQ ID NO: 73288 - DNA, 25 bp, Homo sapien
gctaccttttcatatgtgtagtttt

SEQ ID NO: 73289 - DNA, 25 bp, Homo sapien
gctacggtacatttctatatccata

SEQ ID NO: 73290 - DNA, 25 bp, Homo sapien
gctacggtatatttctatatccata

SEQ ID NO: 73291 - DNA, 25 bp, Homo sapien
gctactacttaatactgagccaagt

SEQ ID NO: 73292 - DNA, 25 bp, Homo sapien
gctactacttactactgagccaagt

SEQ ID NO: 73293 - DNA, 25 bp, Homo sapien
gctactagagacattgctggcatgc

SEQ ID NO: 73294 - DNA, 25 bp, Homo sapien
gctactagagacgttgctggcatgc

SEQ ID NO: 73295 - DNA, 25 bp, Homo sapien
gctactatctggtttttgtctcagt

SEQ ID NO: 73296 - DNA, 25 bp, Homo sapien
gctactatctgttttttgtctcagt

SEQ ID NO: 73297 - DNA, 25 bp, Homo sapien
gctactcacaaccaggatgtcagga

SEQ ID NO: 73298 - DNA, 25 bp, Homo sapien
gctactcacaatcaggatgtcagga

SEQ ID NO: 73299 - DNA, 25 bp, Homo sapien
gctactcttccaacgcaccatgaca

SEQ ID NO: 73300 - DNA, 25 bp, Homo sapien
gctactctttcaacgcaccatgaca

SEQ ID NO: 73301 - DNA, 25 bp, Homo sapien
gctactgactttcatacaatggctt

SEQ ID NO: 73302 - DNA, 25 bp, Homo sapien
gctactgacttttatacaatggctt

SEQ ID NO: 73303 - DNA, 25 bp, Homo sapien
gctactgaggactgtttcttttatt

SEQ ID NO: 73304 - DNA, 25 bp, Homo sapien
gctactgatagaatgtaaattagtt

SEQ ID NO: 73305 - DNA, 25 bp, Homo sapien
gctactgatattctcttccatagca

SEQ ID NO: 73306 - DNA, 25 bp, Homo sapien
gctactgatattgtcttccatagca

SEQ ID NO: 73307 - DNA, 25 bp, Homo sapien
gctactgatgactgtttcttttatt

SEQ ID NO: 73308 - DNA, 25 bp, Homo sapien
gctactgatggaatgtaaattagtt

SEQ ID NO: 73309 - DNA, 25 bp, Homo sapien
gctactgctgtaatatcctactcct

SEQ ID NO: 73310 - DNA, 25 bp, Homo sapien
gctactgctgtaatatgctactcct

SEQ ID NO: 73311 - DNA, 25 bp, Homo sapien
gctactggaataatatttttgggca

SEQ ID NO: 73312 - DNA, 25 bp, Homo sapien
gctactggagtaatatttttgggca

SEQ ID NO: 73313 - DNA, 25 bp, Homo sapien
gctactggcatccaataggtagagg

SEQ ID NO: 73314 - DNA, 25 bp, Homo sapien
gctactggcatccgataggtagagg

SEQ ID NO: 73315 - DNA, 25 bp, Homo sapien
gctactggcttcacataattttcat

SEQ ID NO: 73316 - DNA, 25 bp, Homo sapien
gctactggcttcgcataattttcat

SEQ ID NO: 73317 - DNA, 25 bp, Homo sapien
gctactgtagagattcatcggctcc

SEQ ID NO: 73318 - DNA, 25 bp, Homo sapien
gctactgtagagtttcatcggctcc

SEQ ID NO: 73319 - DNA, 25 bp, Homo sapien
gctactgtatttaaaattggcttat

SEQ ID NO: 73320 - DNA, 25 bp, Homo sapien
gctactgtattttaaattggcttat

SEQ ID NO: 73321 - DNA, 25 bp, Homo sapien
gctacttactggttatataatcata

SEQ ID NO: 73322 - DNA, 25 bp, Homo sapien
gctacttactggttatgtaatcata

SEQ ID NO: 73323 - DNA, 25 bp, Homo sapien
gctacttagactgagtaaaagtatt

SEQ ID NO: 73324 - DNA, 25 bp, Homo sapien
gctacttagactgagtgaaagtatt

SEQ ID NO: 73325 - DNA, 25 bp, Homo sapien
gctactttctagtaaaaattctaaa

SEQ ID NO: 73326 - DNA, 25 bp, Homo sapien
gctactttctagtaaagattctaaa

SEQ ID NO: 73327 - DNA, 25 bp, Homo sapien
gctacttttagcgatggcaacttgg

SEQ ID NO: 73328 - DNA, 25 bp, Homo sapien
gctacttttagtgatggcaacttgg

SEQ ID NO: 73329 - DNA, 25 bp, Homo sapien
gctactttttttcatttccttgtgt

SEQ ID NO: 73330 - DNA, 25 bp, Homo sapien
gctactttttttcgtttccttgtgt

SEQ ID NO: 73331 - DNA, 25 bp, Homo sapien
gctagaaaaaccctgcatctatgag

SEQ ID NO: 73332 - DNA, 25 bp, Homo sapien
gctagaaaaaccctgcgtctatgag

SEQ ID NO: 73333 - DNA, 25 bp, Homo sapien
gctagaaaaataaaaccatcaagtt

SEQ ID NO: 73334 - DNA, 25 bp, Homo sapien
gctagaaaagtaaaaccatcaagtt

SEQ ID NO: 73335 - DNA, 25 bp, Homo sapien
gctagaaattcaagactagagacga

SEQ ID NO: 73336 - DNA, 25 bp, Homo sapien
gctagaaattcacgactagagacga

SEQ ID NO: 73337 - DNA, 25 bp, Homo sapien
gctagaacaatgagcaacaaaataa

SEQ ID NO: 73338 - DNA, 25 bp, Homo sapien
gctagaacactgagcaacaaaataa

SEQ ID NO: 73339 - DNA, 25 bp, Homo sapien
gctagaataaaaacctccatgactt

SEQ ID NO: 73340 - DNA, 25 bp, Homo sapien
gctagaatgaaaacctccatgactt

SEQ ID NO: 73341 - DNA, 25 bp, Homo sapien
gctagaattaggtcacaaatggata

SEQ ID NO: 73342 - DNA, 25 bp, Homo sapien
gctagaattaggttacaaatggata

SEQ ID NO: 73343 - DNA, 25 bp, Homo sapien
gctagacaaccttcctacagctaac

SEQ ID NO: 73344 - DNA, 25 bp, Homo sapien
gctagacaaccttcttacagctaac

SEQ ID NO: 73345 - DNA, 25 bp, Homo sapien
gctagacaataatacgacttgatta

SEQ ID NO: 73346 - DNA, 25 bp, Homo sapien
gctagacaataatacggcttgatta

SEQ ID NO: 73347 - DNA, 25 bp, Homo sapien
gctagactttattggaaatgtagtc

SEQ ID NO: 73348 - DNA, 25 bp, Homo sapien
gctagactttattggagatgtagtc

SEQ ID NO: 73349 - DNA, 25 bp, Homo sapien
gctagagagaagtcaatgcttagct

SEQ ID NO: 73350 - DNA, 25 bp, Homo sapien
gctagagagaagtcgatgcttagct

SEQ ID NO: 73351 - DNA, 25 bp, Homo sapien
gctagatgctaattatttggaatac

SEQ ID NO: 73352 - DNA, 25 bp, Homo sapien
gctagatgggtccaaaagcatgcag

SEQ ID NO: 73353 - DNA, 25 bp, Homo sapien
gctagatgggtccgaaagcatgcag

SEQ ID NO: 73354 - DNA, 25 bp, Homo sapien
gctagatgttaattatttggaatac

SEQ ID NO: 73355 - DNA, 25 bp, Homo sapien
gctagcaaatggccaggccaggatt

SEQ ID NO: 73356 - DNA, 25 bp, Homo sapien
gctagcaaatggccgggccaggatt

SEQ ID NO: 73357 - DNA, 25 bp, Homo sapien
gctagcagaggactcaatgatgcaa

SEQ ID NO: 73358 - DNA, 25 bp, Homo sapien
gctagcagaggattcaatgatgcaa

SEQ ID NO: 73359 - DNA, 25 bp, Homo sapien
gctagcatcccaataacggtgtgcc

SEQ ID NO: 73360 - DNA, 25 bp, Homo sapien
gctagcatcccaataatggtgtgcc

SEQ ID NO: 73361 - DNA, 25 bp, Homo sapien
gctagccagcagcaatggaagggat

SEQ ID NO: 73362 - DNA, 25 bp, Homo sapien
gctagccagcagcactggaagggat

SEQ ID NO: 73363 - DNA, 25 bp, Homo sapien
gctagccagctgatgaaaaagagac

SEQ ID NO: 73364 - DNA, 25 bp, Homo sapien
gctagccagctggtgaaaaagagac

SEQ ID NO: 73365 - DNA, 25 bp, Homo sapien
gctagcttcatggcatctggatgca

SEQ ID NO: 73366 - DNA, 25 bp, Homo sapien
gctagcttcatggtatctggatgca

SEQ ID NO: 73367 - DNA, 25 bp, Homo sapien
gctaggaacattatttcccttgtgt

SEQ ID NO: 73368 - DNA, 25 bp, Homo sapien
gctaggaacattgtttcccttgtgt

SEQ ID NO: 73369 - DNA, 25 bp, Homo sapien
gctaggacttaatcatccagcagtg

SEQ ID NO: 73370 - DNA, 25 bp, Homo sapien
gctaggacttaatcgtccagcagtg

SEQ ID NO: 73371 - DNA, 25 bp, Homo sapien
gctaggcacctgtatctctttgata

SEQ ID NO: 73372 - DNA, 25 bp, Homo sapien
gctaggcatctgtatctctttgata

SEQ ID NO: 73373 - DNA, 25 bp, Homo sapien
gctaggccctgaagaggcaaagaca

SEQ ID NO: 73374 - DNA, 25 bp, Homo sapien
gctaggccctggagaggcaaagaca

SEQ ID NO: 73375 - DNA, 25 bp, Homo sapien
gctaggggcagaagcaatgatcttc

SEQ ID NO: 73376 - DNA, 25 bp, Homo sapien
gctaggggcagaaggaatgatcttc

SEQ ID NO: 73377 - DNA, 25 bp, Homo sapien
gctaggtcaccattgagtaggaatg

SEQ ID NO: 73378 - DNA, 25 bp, Homo sapien
gctaggtcatcattgagtaggaatg

SEQ ID NO: 73379 - DNA, 25 bp, Homo sapien
gctaggtgccctggaggaatacaaa

SEQ ID NO: 73380 - DNA, 25 bp, Homo sapien
gctaggtgtcctggaggaatacaaa

SEQ ID NO: 73381 - DNA, 25 bp, Homo sapien
gctaggttcttgccctatatgtgtg

SEQ ID NO: 73382 - DNA, 25 bp, Homo sapien
gctaggttcttgccctgtatgtgtg

SEQ ID NO: 73383 - DNA, 25 bp, Homo sapien
gctagtaacaaacgcaagcttagaa

SEQ ID NO: 73384 - DNA, 25 bp, Homo sapien
gctagtaacaaatgcaagcttagaa

SEQ ID NO: 73385 - DNA, 25 bp, Homo sapien
gctagtagtgggaattatgatagag

SEQ ID NO: 73386 - DNA, 25 bp, Homo sapien
gctagtagtgggaattgtgatagag

SEQ ID NO: 73387 - DNA, 25 bp, Homo sapien
gctagtcctcacaggcacatagaaa

SEQ ID NO: 73388 - DNA, 25 bp, Homo sapien
gctagtcctcacagtcacatagaaa

SEQ ID NO: 73389 - DNA, 25 bp, Homo sapien
gctagtgaaaataataggtctaata

SEQ ID NO: 73390 - DNA, 25 bp, Homo sapien
gctagtgaaaatgataggtctaata

SEQ ID NO: 73391 - DNA, 25 bp, Homo sapien
gctagtgaattgaccaatttataac

SEQ ID NO: 73392 - DNA, 25 bp, Homo sapien
gctagtgaattggccaatttataac

SEQ ID NO: 73393 - DNA, 25 bp, Homo sapien
gctagtgctaaaagcaaagtgaaag

SEQ ID NO: 73394 - DNA, 25 bp, Homo sapien
gctagtgctactttctcaccttgtg

SEQ ID NO: 73395 - DNA, 25 bp, Homo sapien
gctagtgctactttcttaccttgtg

SEQ ID NO: 73396 - DNA, 25 bp, Homo sapien
gctagtgctcaaagcaaagtgaaag

SEQ ID NO: 73397 - DNA, 25 bp, Homo sapien
gctagttgacggctagcccaagctg

SEQ ID NO: 73398 - DNA, 25 bp, Homo sapien
gctagttgatggctagcccaagctg

SEQ ID NO: 73399 - DNA, 25 bp, Homo sapien
gctagtttcacctatacccacccaa

SEQ ID NO: 73400 - DNA, 25 bp, Homo sapien
gctagttttacctatacccacccaa

SEQ ID NO: 73401 - DNA, 25 bp, Homo sapien
gctataaaccaaagaagcatctaca

SEQ ID NO: 73402 - DNA, 25 bp, Homo sapien
gctataaaccaacgaagcatctaca

SEQ ID NO: 73403 - DNA, 25 bp, Homo sapien
gctataaatatacctttcagagtga

SEQ ID NO: 73404 - DNA, 25 bp, Homo sapien
gctataaatatactgacttctctaa

SEQ ID NO: 73405 - DNA, 25 bp, Homo sapien
gctataaatatacttttcagagtga

SEQ ID NO: 73406 - DNA, 25 bp, Homo sapien
gctataaatatattgacttctctaa

SEQ ID NO: 73407 - DNA, 25 bp, Homo sapien
gctataaccacattcacgtggagcc

SEQ ID NO: 73408 - DNA, 25 bp, Homo sapien
gctataacgacattcacgtggagcc

SEQ ID NO: 73409 - DNA, 25 bp, Homo sapien
gctataagacagtggaaagaatgct

SEQ ID NO: 73410 - DNA, 25 bp, Homo sapien
gctataaggcagtggaaagaatgct

SEQ ID NO: 73411 - DNA, 25 bp, Homo sapien
gctataatgtggtaaagattagtat

SEQ ID NO: 73412 - DNA, 25 bp, Homo sapien
gctataatgtggtcaagattagtat

SEQ ID NO: 73413 - DNA, 25 bp, Homo sapien
gctatacaaaatccatcttttcagt

SEQ ID NO: 73414 - DNA, 25 bp, Homo sapien
gctatacaaaatgcatcttttcagt

SEQ ID NO: 73415 - DNA, 25 bp, Homo sapien
gctatacttctacaccacatgggat

SEQ ID NO: 73416 - DNA, 25 bp, Homo sapien
gctatacttctgcaccacatgggat

SEQ ID NO: 73417 - DNA, 25 bp, Homo sapien
gctataggtaaagggacatactaat

SEQ ID NO: 73418 - DNA, 25 bp, Homo sapien
gctataggtaaatggacatactaat

SEQ ID NO: 73419 - DNA, 25 bp, Homo sapien
gctataggtgactagatgttcgagc

SEQ ID NO: 73420 - DNA, 25 bp, Homo sapien
gctataggttactagatgttcgagc

SEQ ID NO: 73421 - DNA, 25 bp, Homo sapien
gctatattcctacatttcatttctg

SEQ ID NO: 73422 - DNA, 25 bp, Homo sapien
gctatatttctacatttcatttctg

SEQ ID NO: 73423 - DNA, 25 bp, Homo sapien
gctatcatgaaatccaaacctcgtc

SEQ ID NO: 73424 - DNA, 25 bp, Homo sapien
gctatcatgaaattcaaacctcgtc

SEQ ID NO: 73425 - DNA, 25 bp, Homo sapien
gctatccaattcagcccctctctcc

SEQ ID NO: 73426 - DNA, 25 bp, Homo sapien
gctatccacttccaatcttaccaat

SEQ ID NO: 73427 - DNA, 25 bp, Homo sapien
gctatccacttctaatcttaccaat

SEQ ID NO: 73428 - DNA, 25 bp, Homo sapien
gctatccatttcagcccctctctcc

SEQ ID NO: 73429 - DNA, 25 bp, Homo sapien
gctatccctatacaccaaggtttgc

SEQ ID NO: 73430 - DNA, 25 bp, Homo sapien
gctatccctatataccaaggtttgc

SEQ ID NO: 73431 - DNA, 25 bp, Homo sapien
gctatctgttacgtgatgccatcct

SEQ ID NO: 73432 - DNA, 25 bp, Homo sapien
gctatctgttatgtgatgccatcct

SEQ ID NO: 73433 - DNA, 25 bp, Homo sapien
gctatgaagaaaccagcctctgtga

SEQ ID NO: 73434 - DNA, 25 bp, Homo sapien
gctatgaagaaaccaggctctgtga

SEQ ID NO: 73435 - DNA, 25 bp, Homo sapien
gctatgaattagaaacagagtagtc

SEQ ID NO: 73436 - DNA, 25 bp, Homo sapien
gctatgaattagaaccagagtagtc

SEQ ID NO: 73437 - DNA, 25 bp, Homo sapien
gctatgaattttccgtctttaattc

SEQ ID NO: 73438 - DNA, 25 bp, Homo sapien
gctatgaattttctgtctttaattc

SEQ ID NO: 73439 - DNA, 25 bp, Homo sapien
gctatgacataattcttggttgcct

SEQ ID NO: 73440 - DNA, 25 bp, Homo sapien
gctatgacgtaattcttggttgcct

SEQ ID NO: 73441 - DNA, 25 bp, Homo sapien
gctatgagagcaccaaattatctac

SEQ ID NO: 73442 - DNA, 25 bp, Homo sapien
gctatgagagcgccaaattatctac

SEQ ID NO: 73443 - DNA, 25 bp, Homo sapien
gctatgattatggatattgagatgg

SEQ ID NO: 73444 - DNA, 25 bp, Homo sapien
gctatgattgacaattaccatgtaa

SEQ ID NO: 73445 - DNA, 25 bp, Homo sapien
gctatgattgataattaccatgtaa

SEQ ID NO: 73446 - DNA, 25 bp, Homo sapien
gctatgattgtggatattgagatgg

SEQ ID NO: 73447 - DNA, 25 bp, Homo sapien
gctatgccattgttttacttgttgt

SEQ ID NO: 73448 - DNA, 25 bp, Homo sapien
gctatgccattgttttgcttgttgt

SEQ ID NO: 73449 - DNA, 25 bp, Homo sapien
gctatgctacagaagacaagaagct

SEQ ID NO: 73450 - DNA, 25 bp, Homo sapien
gctatgctatagaagacaagaagct

SEQ ID NO: 73451 - DNA, 25 bp, Homo sapien
gctatgctgaggaaaaagtgcacgc

SEQ ID NO: 73452 - DNA, 25 bp, Homo sapien
gctatgctgagggaaaagtgcacgc

SEQ ID NO: 73453 - DNA, 25 bp, Homo sapien
gctatggaacccagttttttcttta

SEQ ID NO: 73454 - DNA, 25 bp, Homo sapien
gctatggaacccatttttttcttta

SEQ ID NO: 73455 - DNA, 25 bp, Homo sapien
gctatggattactcttcatcaaata

SEQ ID NO: 73456 - DNA, 25 bp, Homo sapien
gctatggattattcttcatcaaata

SEQ ID NO: 73457 - DNA, 25 bp, Homo sapien
gctatgggggtggcttaatgacata

SEQ ID NO: 73458 - DNA, 25 bp, Homo sapien
gctatgggggtggtttaatgacata

SEQ ID NO: 73459 - DNA, 25 bp, Homo sapien
gctatgtaagttggtgcttggtaga

SEQ ID NO: 73460 - DNA, 25 bp, Homo sapien
gctatgtaagttggtgtttggtaga

SEQ ID NO: 73461 - DNA, 25 bp, Homo sapien
gctatgtatcttctgctaatttgaa

SEQ ID NO: 73462 - DNA, 25 bp, Homo sapien
gctatgtattttctgctaatttgaa

SEQ ID NO: 73463 - DNA, 25 bp, Homo sapien
gctatgtccactagaagaagtattc

SEQ ID NO: 73464 - DNA, 25 bp, Homo sapien
gctatgtccactggaagaagtattc

SEQ ID NO: 73465 - DNA, 25 bp, Homo sapien
gctatgtccagctgctatcatcaca

SEQ ID NO: 73466 - DNA, 25 bp, Homo sapien
gctatgtccagctgctgtcatcaca

SEQ ID NO: 73467 - DNA, 25 bp, Homo sapien
gctatgtgacttcagccaaatcact

SEQ ID NO: 73468 - DNA, 25 bp, Homo sapien
gctatgtgacttcggccaaatcact

SEQ ID NO: 73469 - DNA, 25 bp, Homo sapien
gctattaccggttgagtatccctta

SEQ ID NO: 73470 - DNA, 25 bp, Homo sapien
gctattactggttgagtatccctta

SEQ ID NO: 73471 - DNA, 25 bp, Homo sapien
gctattagattacaacacgtgggct

SEQ ID NO: 73472 - DNA, 25 bp, Homo sapien
gctattagattccaacacgtgggct

SEQ ID NO: 73473 - DNA, 25 bp, Homo sapien
gctattattttacggtatctgcagg

SEQ ID NO: 73474 - DNA, 25 bp, Homo sapien
gctattattttatggtatctgcagg

SEQ ID NO: 73475 - DNA, 25 bp, Homo sapien
gctattcatctgaaaacttgaacaa

SEQ ID NO: 73476 - DNA, 25 bp, Homo sapien
gctattcatttgaaaacttgaacaa

SEQ ID NO: 73477 - DNA, 25 bp, Homo sapien
gctattgaaacctccaattctaatt

SEQ ID NO: 73478 - DNA, 25 bp, Homo sapien
gctattgagaagacaatatatacat

SEQ ID NO: 73479 - DNA, 25 bp, Homo sapien
gctattgagaagacgatatatacat

SEQ ID NO: 73480 - DNA, 25 bp, Homo sapien
gctattgatacctccaattctaatt

SEQ ID NO: 73481 - DNA, 25 bp, Homo sapien
gctattgctatcacctggtaagagt

SEQ ID NO: 73482 - DNA, 25 bp, Homo sapien
gctattgctgtcacctggtaagagt

SEQ ID NO: 73483 - DNA, 25 bp, Homo sapien
gctattgggccacatgtagcctatg

SEQ ID NO: 73484 - DNA, 25 bp, Homo sapien
gctattgggtcacatgtagcctatg

SEQ ID NO: 73485 - DNA, 25 bp, Homo sapien
gctatttacataaaactttagtagt

SEQ ID NO: 73486 - DNA, 25 bp, Homo sapien
gctatttacgtaaaactttagtagt

SEQ ID NO: 73487 - DNA, 25 bp, Homo sapien
gctatttactgaacaggaatgaaag

SEQ ID NO: 73488 - DNA, 25 bp, Homo sapien
gctatttatcctgcttacaagaaga

SEQ ID NO: 73489 - DNA, 25 bp, Homo sapien
gctatttatgctgcttacaagaaga

SEQ ID NO: 73490 - DNA, 25 bp, Homo sapien
gctatttattgaacaggaatgaaag

SEQ ID NO: 73491 - DNA, 25 bp, Homo sapien
gctatttcagaatttctgtagagaa

SEQ ID NO: 73492 - DNA, 25 bp, Homo sapien
gctatttcggaatttctgtagagaa

SEQ ID NO: 73493 - DNA, 25 bp, Homo sapien
gctatttggagtcagtttctcccac

SEQ ID NO: 73494 - DNA, 25 bp, Homo sapien
gctatttggagttagtttctcccac

SEQ ID NO: 73495 - DNA, 25 bp, Homo sapien
gctatttgggcgcctcaatccatct

SEQ ID NO: 73496 - DNA, 25 bp, Homo sapien
gctatttgggctcctcaatccatct

SEQ ID NO: 73497 - DNA, 25 bp, Homo sapien
gctatttgtttacattccacttgca

SEQ ID NO: 73498 - DNA, 25 bp, Homo sapien
gctatttgtttagattccacttgca

SEQ ID NO: 73499 - DNA, 25 bp, Homo sapien
gctcaaaataaaccaaggaaagaaa

SEQ ID NO: 73500 - DNA, 25 bp, Homo sapien
gctcaaaataaagcaaggaaagaaa

SEQ ID NO: 73501 - DNA, 25 bp, Homo sapien
gctcaaagcaacaacctgcctggtt

SEQ ID NO: 73502 - DNA, 25 bp, Homo sapien
gctcaaagcaacagcctgcctggtt

SEQ ID NO: 73503 - DNA, 25 bp, Homo sapien
gctcaaagtgaacacccttttttgc

SEQ ID NO: 73504 - DNA, 25 bp, Homo sapien
gctcaaagtgaacagccttttttgc

SEQ ID NO: 73505 - DNA, 25 bp, Homo sapien
gctcaaagtgttgtgactatagtta

SEQ ID NO: 73506 - DNA, 25 bp, Homo sapien
gctcaaagtgttgtgattatagtta

SEQ ID NO: 73507 - DNA, 25 bp, Homo sapien
gctcaaattgccatgtctttgaaaa

SEQ ID NO: 73508 - DNA, 25 bp, Homo sapien
gctcaaattgccgtgtctttgaaaa

SEQ ID NO: 73509 - DNA, 25 bp, Homo sapien
gctcaacaagccacttatcttatga

SEQ ID NO: 73510 - DNA, 25 bp, Homo sapien
gctcaacaatccacttatcttatga

SEQ ID NO: 73511 - DNA, 25 bp, Homo sapien
gctcaacataagtacaagtcaattt

SEQ ID NO: 73512 - DNA, 25 bp, Homo sapien
gctcaacataagtataagtcaattt

SEQ ID NO: 73513 - DNA, 25 bp, Homo sapien
gctcaactcgagtgcctttactggc

SEQ ID NO: 73514 - DNA, 25 bp, Homo sapien
gctcaactgatgctttctgtacgtg

SEQ ID NO: 73515 - DNA, 25 bp, Homo sapien
gctcaactgatgctttgtgtacgtg

SEQ ID NO: 73516 - DNA, 25 bp, Homo sapien
gctcaacttgagtgcctttactggc

SEQ ID NO: 73517 - DNA, 25 bp, Homo sapien
gctcaagagaaagtaagaaatctgt

SEQ ID NO: 73518 - DNA, 25 bp, Homo sapien
gctcaagaggaagtaagaaatctgt

SEQ ID NO: 73519 - DNA, 25 bp, Homo sapien
gctcaaggaacaagatcatggcagt

SEQ ID NO: 73520 - DNA, 25 bp, Homo sapien
gctcaaggaaccagatcatggcagt

SEQ ID NO: 73521 - DNA, 25 bp, Homo sapien
gctcaaggacgggacaaagttcagg

SEQ ID NO: 73522 - DNA, 25 bp, Homo sapien
gctcaaggataaagaggagaattgc

SEQ ID NO: 73523 - DNA, 25 bp, Homo sapien
gctcaaggatagagaggagaattgc

SEQ ID NO: 73524 - DNA, 25 bp, Homo sapien
gctcaaggatgggacaaagttcagg

SEQ ID NO: 73525 - DNA, 25 bp, Homo sapien
gctcaagtcttcactgaccccaagt

SEQ ID NO: 73526 - DNA, 25 bp, Homo sapien
gctcaagttcagtgacaaaacaaca

SEQ ID NO: 73527 - DNA, 25 bp, Homo sapien
gctcaagttcagtgtcaaaacaaca

SEQ ID NO: 73528 - DNA, 25 bp, Homo sapien
gctcaagttttcactgaccccaagt

SEQ ID NO: 73529 - DNA, 25 bp, Homo sapien
gctcaataaatgcctactgagaaat

SEQ ID NO: 73530 - DNA, 25 bp, Homo sapien
gctcaataaatgtctactgagaaat

SEQ ID NO: 73531 - DNA, 25 bp, Homo sapien
gctcaataaggtaatggttcaaaag

SEQ ID NO: 73532 - DNA, 25 bp, Homo sapien
gctcaataatgtaatggttcaaaag

SEQ ID NO: 73533 - DNA, 25 bp, Homo sapien
gctcaatacatcagtgcaagctgaa

SEQ ID NO: 73534 - DNA, 25 bp, Homo sapien
gctcaatacgtcagtgcaagctgaa

SEQ ID NO: 73535 - DNA, 25 bp, Homo sapien
gctcaatactaaatagttctcaccc

SEQ ID NO: 73536 - DNA, 25 bp, Homo sapien
gctcaatactaagtagttctcaccc

SEQ ID NO: 73537 - DNA, 25 bp, Homo sapien
gctcaatagagctacgagtctctgt

SEQ ID NO: 73538 - DNA, 25 bp, Homo sapien
gctcaatagagctacgcgtctctgt

SEQ ID NO: 73539 - DNA, 25 bp, Homo sapien
gctcaatagctatacgttggatgac

SEQ ID NO: 73540 - DNA, 25 bp, Homo sapien
gctcaatagctatatgttggatgac

SEQ ID NO: 73541 - DNA, 25 bp, Homo sapien
gctcaatcaagagaacagtcaaaat

SEQ ID NO: 73542 - DNA, 25 bp, Homo sapien
gctcaatcaagataacagtcaaaat

SEQ ID NO: 73543 - DNA, 25 bp, Homo sapien
gctcaatccatacagtgagtaaaat

SEQ ID NO: 73544 - DNA, 25 bp, Homo sapien
gctcaatccgtacagtgagtaaaat

SEQ ID NO: 73545 - DNA, 25 bp, Homo sapien
gctcaatcctgcttctttttctgtg

SEQ ID NO: 73546 - DNA, 25 bp, Homo sapien
gctcaatcctgcttttttttctgtg

SEQ ID NO: 73547 - DNA, 25 bp, Homo sapien
gctcaattctgcttttccctcatat

SEQ ID NO: 73548 - DNA, 25 bp, Homo sapien
gctcaattgtgcttttccctcatat

SEQ ID NO: 73549 - DNA, 25 bp, Homo sapien
gctcacacatcggtattcaaattct

SEQ ID NO: 73550 - DNA, 25 bp, Homo sapien
gctcacacatctgtattcaaattct

SEQ ID NO: 73551 - DNA, 25 bp, Homo sapien
gctcacacctataagcccagtgact

SEQ ID NO: 73552 - DNA, 25 bp, Homo sapien
gctcacacttataagcccagtgact

SEQ ID NO: 73553 - DNA, 25 bp, Homo sapien
gctcacagaccgcagtgaaagaaaa

SEQ ID NO: 73554 - DNA, 25 bp, Homo sapien
gctcacagacctcagtgaaagaaaa

SEQ ID NO: 73555 - DNA, 25 bp, Homo sapien
gctcacagattgtggagtccaattg

SEQ ID NO: 73556 - DNA, 25 bp, Homo sapien
gctcacagattttggagtccaattg

SEQ ID NO: 73557 - DNA, 25 bp, Homo sapien
gctcacaggaaccacggcctcagca

SEQ ID NO: 73558 - DNA, 25 bp, Homo sapien
gctcacaggaaccatggcctcagca

SEQ ID NO: 73559 - DNA, 25 bp, Homo sapien
gctcacatacactattttaatttga

SEQ ID NO: 73560 - DNA, 25 bp, Homo sapien
gctcacatacattattttaatttga

SEQ ID NO: 73561 - DNA, 25 bp, Homo sapien
gctcaccaaacatactaaatgaggt

SEQ ID NO: 73562 - DNA, 25 bp, Homo sapien
gctcaccaaacgtactaaatgaggt

SEQ ID NO: 73563 - DNA, 25 bp, Homo sapien
gctcaccaaaggcaccactaatggc

SEQ ID NO: 73564 - DNA, 25 bp, Homo sapien
gctcaccaaaggcgccactaatggc

SEQ ID NO: 73565 - DNA, 25 bp, Homo sapien
gctcaccactgtcacttgtactcac

SEQ ID NO: 73566 - DNA, 25 bp, Homo sapien
gctcaccactgtcatttgtactcac

SEQ ID NO: 73567 - DNA, 25 bp, Homo sapien
gctcactcagtgatacaaccctttt

SEQ ID NO: 73568 - DNA, 25 bp, Homo sapien
gctcactcagtgatacgaccctttt

SEQ ID NO: 73569 - DNA, 25 bp, Homo sapien
gctcactggactgttccttttggtt

SEQ ID NO: 73570 - DNA, 25 bp, Homo sapien
gctcactggactgttctttttggtt

SEQ ID NO: 73571 - DNA, 25 bp, Homo sapien
gctcacttaacatggccataattct

SEQ ID NO: 73572 - DNA, 25 bp, Homo sapien
gctcacttaacatggctataattct

SEQ ID NO: 73573 - DNA, 25 bp, Homo sapien
gctcagaccaataactattctcagt

SEQ ID NO: 73574 - DNA, 25 bp, Homo sapien
gctcagaccaatgactattctcagt

SEQ ID NO: 73575 - DNA, 25 bp, Homo sapien
gctcagagaagcacgtgtgactata

SEQ ID NO: 73576 - DNA, 25 bp, Homo sapien
gctcagagacgttaagcaatttgtt

SEQ ID NO: 73577 - DNA, 25 bp, Homo sapien
gctcagagaggcacgtgtgactata

SEQ ID NO: 73578 - DNA, 25 bp, Homo sapien
gctcagagatgttaagcaatttgtt

SEQ ID NO: 73579 - DNA, 25 bp, Homo sapien
gctcagagcttgccaggtagtgagt

SEQ ID NO: 73580 - DNA, 25 bp, Homo sapien
gctcagagcttgtcaggtagtgagt

SEQ ID NO: 73581 - DNA, 25 bp, Homo sapien
gctcagatgtcactttctcagaaag

SEQ ID NO: 73582 - DNA, 25 bp, Homo sapien
gctcagatgtcgctttctcagaaag

SEQ ID NO: 73583 - DNA, 25 bp, Homo sapien
gctcagatgtttgcacctttcttta

SEQ ID NO: 73584 - DNA, 25 bp, Homo sapien
gctcagatgtttgtacctttcttta

SEQ ID NO: 73585 - DNA, 25 bp, Homo sapien
gctcagcagagacacgtttcctgaa

SEQ ID NO: 73586 - DNA, 25 bp, Homo sapien
gctcagcagagacatgtttcctgaa

SEQ ID NO: 73587 - DNA, 25 bp, Homo sapien
gctcagctgtaaaaacaccttctct

SEQ ID NO: 73588 - DNA, 25 bp, Homo sapien
gctcagctgtaaaagcaccttctct

SEQ ID NO: 73589 - DNA, 25 bp, Homo sapien
gctcagcttaccatattttcagagt

SEQ ID NO: 73590 - DNA, 25 bp, Homo sapien
gctcagcttaccatgttttcagagt

SEQ ID NO: 73591 - DNA, 25 bp, Homo sapien
gctcagcttctacgtaccacgctca

SEQ ID NO: 73592 - DNA, 25 bp, Homo sapien
gctcagcttctatgtaccacgctca

SEQ ID NO: 73593 - DNA, 25 bp, Homo sapien
gctcaggccactccaacaaaatacc

SEQ ID NO: 73594 - DNA, 25 bp, Homo sapien
gctcaggccactgcaacaaaatacc

SEQ ID NO: 73595 - DNA, 25 bp, Homo sapien
gctcagggacctacaagactacaat

SEQ ID NO: 73596 - DNA, 25 bp, Homo sapien
gctcagggatctacaagactacaat

SEQ ID NO: 73597 - DNA, 25 bp, Homo sapien
gctcagtaactgcgtgtgactaatg

SEQ ID NO: 73598 - DNA, 25 bp, Homo sapien
gctcagtaactgtgtgtgactaatg

SEQ ID NO: 73599 - DNA, 25 bp, Homo sapien
gctcagtgagtcccaggatgtctct

SEQ ID NO: 73600 - DNA, 25 bp, Homo sapien
gctcagtgccagctctgtgacagtg

SEQ ID NO: 73601 - DNA, 25 bp, Homo sapien
gctcagtgccagctttgtgacagtg

SEQ ID NO: 73602 - DNA, 25 bp, Homo sapien
gctcagtgcgtcccaggatgtctct

SEQ ID NO: 73603 - DNA, 25 bp, Homo sapien
gctcatagacatgtttaaaatttcc

SEQ ID NO: 73604 - DNA, 25 bp, Homo sapien
gctcataggcatgtttaaaatttcc

SEQ ID NO: 73605 - DNA, 25 bp, Homo sapien
gctcataggtaaaagactttgtact

SEQ ID NO: 73606 - DNA, 25 bp, Homo sapien
gctcataggtaaaatactttgtact

SEQ ID NO: 73607 - DNA, 25 bp, Homo sapien
gctcatagtcaaacagctcatcagt

SEQ ID NO: 73608 - DNA, 25 bp, Homo sapien
gctcatagtcaaacagttcatcagt

SEQ ID NO: 73609 - DNA, 25 bp, Homo sapien
gctcatatgatacgccaagcattgt

SEQ ID NO: 73610 - DNA, 25 bp, Homo sapien
gctcatatgatatgccaagcattgt

SEQ ID NO: 73611 - DNA, 25 bp, Homo sapien
gctcatcaaactgttatttataata

SEQ ID NO: 73612 - DNA, 25 bp, Homo sapien
gctcatcagactgttatttataata

SEQ ID NO: 73613 - DNA, 25 bp, Homo sapien
gctcatctgtggacctgttattttc

SEQ ID NO: 73614 - DNA, 25 bp, Homo sapien
gctcatctgtggaccttttattttc

SEQ ID NO: 73615 - DNA, 25 bp, Homo sapien
gctcatctgttctcctttgtttgca

SEQ ID NO: 73616 - DNA, 25 bp, Homo sapien
gctcatctgttctcgtttgtttgca

SEQ ID NO: 73617 - DNA, 25 bp, Homo sapien
gctcatgacattagcaaagtgtaag

SEQ ID NO: 73618 - DNA, 25 bp, Homo sapien
gctcatgacattagtaaagtgtaag

SEQ ID NO: 73619 - DNA, 25 bp, Homo sapien
gctcatggtaagcagacacctacct

SEQ ID NO: 73620 - DNA, 25 bp, Homo sapien
gctcatggtaagcggacacctacct

SEQ ID NO: 73621 - DNA, 25 bp, Homo sapien
gctcatggtaccattgcaatcaaac

SEQ ID NO: 73622 - DNA, 25 bp, Homo sapien
gctcatggtactattgcaatcaaac

SEQ ID NO: 73623 - DNA, 25 bp, Homo sapien
gctcatggttgtactggagagcaat

SEQ ID NO: 73624 - DNA, 25 bp, Homo sapien
gctcatggttgttctggagagcaat

SEQ ID NO: 73625 - DNA, 25 bp, Homo sapien
gctcatgtacacattttttttgggt

SEQ ID NO: 73626 - DNA, 25 bp, Homo sapien
gctcatgtacactttttttttgggt

SEQ ID NO: 73627 - DNA, 25 bp, Homo sapien
gctcattaactcacaaggtagccct

SEQ ID NO: 73628 - DNA, 25 bp, Homo sapien
gctcattaattcacaaggtagccct

SEQ ID NO: 73629 - DNA, 25 bp, Homo sapien
gctcattctttgaatcattttattt

SEQ ID NO: 73630 - DNA, 25 bp, Homo sapien
gctcattctttgattcattttattt

SEQ ID NO: 73631 - DNA, 25 bp, Homo sapien
gctcattgctcaacttctctgtgcc

SEQ ID NO: 73632 - DNA, 25 bp, Homo sapien
gctcattgctcagcttctctgtgcc

SEQ ID NO: 73633 - DNA, 25 bp, Homo sapien
gctcattgctccttacatgtcagaa

SEQ ID NO: 73634 - DNA, 25 bp, Homo sapien
gctcattgctccttacgtgtcagaa

SEQ ID NO: 73635 - DNA, 25 bp, Homo sapien
gctcatttccagtgatccactccca

SEQ ID NO: 73636 - DNA, 25 bp, Homo sapien
gctcatttgtctgacggtttttgaa

SEQ ID NO: 73637 - DNA, 25 bp, Homo sapien
gctcattttacatataaaggaaagg

SEQ ID NO: 73638 - DNA, 25 bp, Homo sapien
gctcattttacgtataaaggaaagg

SEQ ID NO: 73639 - DNA, 25 bp, Homo sapien
gctcattttcagtgatccactccca

SEQ ID NO: 73640 - DNA, 25 bp, Homo sapien
gctcatttttctgacggtttttgaa

SEQ ID NO: 73641 - DNA, 25 bp, Homo sapien
gctccaacacactctaatgaatctt

SEQ ID NO: 73642 - DNA, 25 bp, Homo sapien
gctccaacacactgtaatgaatctt

SEQ ID NO: 73643 - DNA, 25 bp, Homo sapien
gctccaacgtggtcttctcatgtca

SEQ ID NO: 73644 - DNA, 25 bp, Homo sapien
gctccaacttggtcttctcatgtca

SEQ ID NO: 73645 - DNA, 25 bp, Homo sapien
gctccacctatcaaggggacaatga

SEQ ID NO: 73646 - DNA, 25 bp, Homo sapien
gctccacctatcacggggacaatga

SEQ ID NO: 73647 - DNA, 25 bp, Homo sapien
gctccactccttactagctgtgtga

SEQ ID NO: 73648 - DNA, 25 bp, Homo sapien
gctccactccttactatctgtgtga

SEQ ID NO: 73649 - DNA, 25 bp, Homo sapien
gctccacttatctggaatacagctc

SEQ ID NO: 73650 - DNA, 25 bp, Homo sapien
gctccacttgtctggaatacagctc

SEQ ID NO: 73651 - DNA, 25 bp, Homo sapien
gctccagaaaagactgatgagtact

SEQ ID NO: 73652 - DNA, 25 bp, Homo sapien
gctccagaaaagactggtgagtact

SEQ ID NO: 73653 - DNA, 25 bp, Homo sapien
gctccagcgaggttctaaaccaagt

SEQ ID NO: 73654 - DNA, 25 bp, Homo sapien
gctccagcgagtttctaaaccaagt

SEQ ID NO: 73655 - DNA, 25 bp, Homo sapien
gctccagctacaacaacttaaagag

SEQ ID NO: 73656 - DNA, 25 bp, Homo sapien
gctccagctacaacaatttaaagag

SEQ ID NO: 73657 - DNA, 25 bp, Homo sapien
gctccaggaagtatatcagaatgca

SEQ ID NO: 73658 - DNA, 25 bp, Homo sapien
gctccaggaggtatatcagaatgca

SEQ ID NO: 73659 - DNA, 25 bp, Homo sapien
gctccaggctgccatacactgaggt

SEQ ID NO: 73660 - DNA, 25 bp, Homo sapien
gctccaggctgtcatacactgaggt

SEQ ID NO: 73661 - DNA, 25 bp, Homo sapien
gctccagtccttttcattggctcta

SEQ ID NO: 73662 - DNA, 25 bp, Homo sapien
gctccagttcttttcattggctcta

SEQ ID NO: 73663 - DNA, 25 bp, Homo sapien
gctccatccgccatatttaaagctc

SEQ ID NO: 73664 - DNA, 25 bp, Homo sapien
gctccatcctccatatttaaagctc

SEQ ID NO: 73665 - DNA, 25 bp, Homo sapien
gctccatttacctctcgtatattgt

SEQ ID NO: 73666 - DNA, 25 bp, Homo sapien
gctccatttacttctcgtatattgt

SEQ ID NO: 73667 - DNA, 25 bp, Homo sapien
gctccatttccaagccactgctacc

SEQ ID NO: 73668 - DNA, 25 bp, Homo sapien
gctccatttccaggccactgctacc

SEQ ID NO: 73669 - DNA, 25 bp, Homo sapien
gctcccaaaccaaatcctattcaag

SEQ ID NO: 73670 - DNA, 25 bp, Homo sapien
gctcccaaatcaaatcctattcaag

SEQ ID NO: 73671 - DNA, 25 bp, Homo sapien
gctcccaatctgcctgggaagggct

SEQ ID NO: 73672 - DNA, 25 bp, Homo sapien
gctcccaatctgtctgggaagggct

SEQ ID NO: 73673 - DNA, 25 bp, Homo sapien
gctcccagaattttcactgacagaa

SEQ ID NO: 73674 - DNA, 25 bp, Homo sapien
gctcccagaattttcattgacagaa

SEQ ID NO: 73675 - DNA, 25 bp, Homo sapien
gctcccatctgcgcactttgagctt

SEQ ID NO: 73676 - DNA, 25 bp, Homo sapien
gctcccatctgggcactttgagctt

SEQ ID NO: 73677 - DNA, 25 bp, Homo sapien
gctccccaggcaaaaagaaggcata

SEQ ID NO: 73678 - DNA, 25 bp, Homo sapien
gctccccaggcaacaagaaggcata

SEQ ID NO: 73679 - DNA, 25 bp, Homo sapien
gctccccatagatgaaatgctcctt

SEQ ID NO: 73680 - DNA, 25 bp, Homo sapien
gctccccatggatgaaatgctcctt

SEQ ID NO: 73681 - DNA, 25 bp, Homo sapien
gctcccgcagcttttcctgcagtaa

SEQ ID NO: 73682 - DNA, 25 bp, Homo sapien
gctcccgcagcttttcttgcagtaa

SEQ ID NO: 73683 - DNA, 25 bp, Homo sapien
gctccctacaaactccccggtgctt

SEQ ID NO: 73684 - DNA, 25 bp, Homo sapien
gctccctacgaactccccggtgctt

SEQ ID NO: 73685 - DNA, 25 bp, Homo sapien
gctccctgcaccagtacttggctgt

SEQ ID NO: 73686 - DNA, 25 bp, Homo sapien
gctccctgcgccagtacttggctgt

SEQ ID NO: 73687 - DNA, 25 bp, Homo sapien
gctccgacctgcaccgtgctctctt

SEQ ID NO: 73688 - DNA, 25 bp, Homo sapien
gctccgacctgcactgtgctctctt

SEQ ID NO: 73689 - DNA, 25 bp, Homo sapien
gctccgattgtacttctaataagct

SEQ ID NO: 73690 - DNA, 25 bp, Homo sapien
gctccgattgtatttctaataagct

SEQ ID NO: 73691 - DNA, 25 bp, Homo sapien
gctccgccatcctgagttcctgtgt

SEQ ID NO: 73692 - DNA, 25 bp, Homo sapien
gctccgccatcttgagttcctgtgt

SEQ ID NO: 73693 - DNA, 25 bp, Homo sapien
gctccgccccatcaggtacagagtg

SEQ ID NO: 73694 - DNA, 25 bp, Homo sapien
gctccgccctatcaggtacagagtg

SEQ ID NO: 73695 - DNA, 25 bp, Homo sapien
gctcctagtggccaatgaacattgg

SEQ ID NO: 73696 - DNA, 25 bp, Homo sapien
gctcctagtggctaatgaacattgg

SEQ ID NO: 73697 - DNA, 25 bp, Homo sapien
gctcctatgcacacccatctgtcat

SEQ ID NO: 73698 - DNA, 25 bp, Homo sapien
gctcctatgcacgcccatctgtcat

SEQ ID NO: 73699 - DNA, 25 bp, Homo sapien
gctcctcaagtcggcattccttctt

SEQ ID NO: 73700 - DNA, 25 bp, Homo sapien
gctcctcaagttggcattccttctt

SEQ ID NO: 73701 - DNA, 25 bp, Homo sapien
gctcctcacaagcttaaaatccctt

SEQ ID NO: 73702 - DNA, 25 bp, Homo sapien
gctcctcacagcgtagtggaagaga

SEQ ID NO: 73703 - DNA, 25 bp, Homo sapien
gctcctcacagtgtagtggaagaga

SEQ ID NO: 73704 - DNA, 25 bp, Homo sapien
gctcctcataagcttaaaatccctt

SEQ ID NO: 73705 - DNA, 25 bp, Homo sapien
gctcctcttcctgcattcaggtgta

SEQ ID NO: 73706 - DNA, 25 bp, Homo sapien
gctcctcttcctgcgttcaggtgta

SEQ ID NO: 73707 - DNA, 25 bp, Homo sapien
gctcctgccatgtgttcactctatt

SEQ ID NO: 73708 - DNA, 25 bp, Homo sapien
gctcctgccgtgtgttcactctatt

SEQ ID NO: 73709 - DNA, 25 bp, Homo sapien
gctcctggcaattaataggaaccaa

SEQ ID NO: 73710 - DNA, 25 bp, Homo sapien
gctcctggcaattactaggaaccaa

SEQ ID NO: 73711 - DNA, 25 bp, Homo sapien
gctcctgtctcaacagaatcatggg

SEQ ID NO: 73712 - DNA, 25 bp, Homo sapien
gctcctgtgctgtcacctgcaattc

SEQ ID NO: 73713 - DNA, 25 bp, Homo sapien
gctcctgtgtcaacagaatcatggg

SEQ ID NO: 73714 - DNA, 25 bp, Homo sapien
gctcctgtgttgtcacctgcaattc

SEQ ID NO: 73715 - DNA, 25 bp, Homo sapien
gctccttataacaaaatgaccaaaa

SEQ ID NO: 73716 - DNA, 25 bp, Homo sapien
gctccttataataaaatgaccaaaa

SEQ ID NO: 73717 - DNA, 25 bp, Homo sapien
gctccttccagtgaaaagtgtagac

SEQ ID NO: 73718 - DNA, 25 bp, Homo sapien
gctccttccagtgagaagtgtagac

SEQ ID NO: 73719 - DNA, 25 bp, Homo sapien
gctccttcctgattccttaaatgaa

SEQ ID NO: 73720 - DNA, 25 bp, Homo sapien
gctccttcttgattccttaaatgaa

SEQ ID NO: 73721 - DNA, 25 bp, Homo sapien
gctcctttcgcgagggcattagctg

SEQ ID NO: 73722 - DNA, 25 bp, Homo sapien
gctccttttactatgtccaaagtct

SEQ ID NO: 73723 - DNA, 25 bp, Homo sapien
gctccttttactctgtccaaagtct

SEQ ID NO: 73724 - DNA, 25 bp, Homo sapien
gctccttttgcgagggcattagctg

SEQ ID NO: 73725 - DNA, 25 bp, Homo sapien
gctcggtctacatctgatcctaagg

SEQ ID NO: 73726 - DNA, 25 bp, Homo sapien
gctcggtctacatgtgatcctaagg

SEQ ID NO: 73727 - DNA, 25 bp, Homo sapien
gctcgtaagtgctcaaattcagatt

SEQ ID NO: 73728 - DNA, 25 bp, Homo sapien
gctcgtaagtgttcaaattcagatt

SEQ ID NO: 73729 - DNA, 25 bp, Homo sapien
gctcgtctctggttttgagtgtgta

SEQ ID NO: 73730 - DNA, 25 bp, Homo sapien
gctcgtctctgtttttgagtgtgta

SEQ ID NO: 73731 - DNA, 25 bp, Homo sapien
gctcgtgaagattaaatgcattaat

SEQ ID NO: 73732 - DNA, 25 bp, Homo sapien
gctcgtgaggattaaatgcattaat

SEQ ID NO: 73733 - DNA, 25 bp, Homo sapien
gctcgtggagacgctggtggtttgt

SEQ ID NO: 73734 - DNA, 25 bp, Homo sapien
gctcgtggagatgctggtggtttgt

SEQ ID NO: 73735 - DNA, 25 bp, Homo sapien
gctcgtgtggtgaccctgaccctaa

SEQ ID NO: 73736 - DNA, 25 bp, Homo sapien
gctcgtgtggtgactctgaccctaa

SEQ ID NO: 73737 - DNA, 25 bp, Homo sapien
gctcgtgttatctaacctgttttct

SEQ ID NO: 73738 - DNA, 25 bp, Homo sapien
gctcgtgttgtctaacctgttttct

SEQ ID NO: 73739 - DNA, 25 bp, Homo sapien
gctctaaacacagattatatcctat

SEQ ID NO: 73740 - DNA, 25 bp, Homo sapien
gctctaaacacaggttatatcctat

SEQ ID NO: 73741 - DNA, 25 bp, Homo sapien
gctctaatctgaaagaaaaagtctg

SEQ ID NO: 73742 - DNA, 25 bp, Homo sapien
gctctaatttgaaagaaaaagtctg

SEQ ID NO: 73743 - DNA, 25 bp, Homo sapien
gctctacactatatataccagactc

SEQ ID NO: 73744 - DNA, 25 bp, Homo sapien
gctctacactatatgtaccagactc

SEQ ID NO: 73745 - DNA, 25 bp, Homo sapien
gctctaccttgtatcgttctatgga

SEQ ID NO: 73746 - DNA, 25 bp, Homo sapien
gctctaccttgtattgttctatgga

SEQ ID NO: 73747 - DNA, 25 bp, Homo sapien
gctctagcctcagtacccgccatgc

SEQ ID NO: 73748 - DNA, 25 bp, Homo sapien
gctctagcttcagtacccgccatgc

SEQ ID NO: 73749 - DNA, 25 bp, Homo sapien
gctctagtttaaatctgaattcctg

SEQ ID NO: 73750 - DNA, 25 bp, Homo sapien
gctctagtttaaatcttaattcctg

SEQ ID NO: 73751 - DNA, 25 bp, Homo sapien
gctctataattcttcaactaaggtg

SEQ ID NO: 73752 - DNA, 25 bp, Homo sapien
gctctataattcttcagctaaggtg

SEQ ID NO: 73753 - DNA, 25 bp, Homo sapien
gctctatagccccgacagctggtag

SEQ ID NO: 73754 - DNA, 25 bp, Homo sapien
gctctatatccccgacagctggtag

SEQ ID NO: 73755 - DNA, 25 bp, Homo sapien
gctctatccacaatgacctactttc

SEQ ID NO: 73756 - DNA, 25 bp, Homo sapien
gctctatccactatgacctactttc

SEQ ID NO: 73757 - DNA, 25 bp, Homo sapien
gctctcaacatacctctgtaggttt

SEQ ID NO: 73758 - DNA, 25 bp, Homo sapien
gctctcaacatatctctgtaggttt

SEQ ID NO: 73759 - DNA, 25 bp, Homo sapien
gctctcactcttaatacaatcgcca

SEQ ID NO: 73760 - DNA, 25 bp, Homo sapien
gctctcactcttcatacaatcgcca

SEQ ID NO: 73761 - DNA, 25 bp, Homo sapien
gctctcagctggggtgctcagagga

SEQ ID NO: 73762 - DNA, 25 bp, Homo sapien
gctctcagctggggtgttcagagga

SEQ ID NO: 73763 - DNA, 25 bp, Homo sapien
gctctcagtgtagggaacaaggtag

SEQ ID NO: 73764 - DNA, 25 bp, Homo sapien
gctctcagtttagggaacaaggtag

SEQ ID NO: 73765 - DNA, 25 bp, Homo sapien
gctctcataattctagcaaagagtc

SEQ ID NO: 73766 - DNA, 25 bp, Homo sapien
gctctcataattctaggaaagagtc

SEQ ID NO: 73767 - DNA, 25 bp, Homo sapien
gctctccagcaccgactttctcacc

SEQ ID NO: 73768 - DNA, 25 bp, Homo sapien
gctctccagcactgactttctcacc

SEQ ID NO: 73769 - DNA, 25 bp, Homo sapien
gctctccagtgtatgtaatgctggt

SEQ ID NO: 73770 - DNA, 25 bp, Homo sapien
gctctccagtgtgtgtaatgctggt

SEQ ID NO: 73771 - DNA, 25 bp, Homo sapien
gctctcctaatcatctgcccaggaa

SEQ ID NO: 73772 - DNA, 25 bp, Homo sapien
gctctcctaatcgtctgcccaggaa

SEQ ID NO: 73773 - DNA, 25 bp, Homo sapien
gctctccttttactcggtgactctt

SEQ ID NO: 73774 - DNA, 25 bp, Homo sapien
gctctccttttacttggtgactctt

SEQ ID NO: 73775 - DNA, 25 bp, Homo sapien
gctctcgggggaatcgttctggagg

SEQ ID NO: 73776 - DNA, 25 bp, Homo sapien
gctctcgggggaattgttctggagg

SEQ ID NO: 73777 - DNA, 25 bp, Homo sapien
gctctctggtccatgatattgatag

SEQ ID NO: 73778 - DNA, 25 bp, Homo sapien
gctctctggtccctgatattgatag

SEQ ID NO: 73779 - DNA, 25 bp, Homo sapien
gctctcttcatgcattctctttccc

SEQ ID NO: 73780 - DNA, 25 bp, Homo sapien
gctctcttcatgcgttctctttccc

SEQ ID NO: 73781 - DNA, 25 bp, Homo sapien
gctctcttctaaccatcttattctc

SEQ ID NO: 73782 - DNA, 25 bp, Homo sapien
gctctcttctaactatcttattctc

SEQ ID NO: 73783 - DNA, 25 bp, Homo sapien
gctctgagaatatcttcatgccacg

SEQ ID NO: 73784 - DNA, 25 bp, Homo sapien
gctctgagataaacagccagagtct

SEQ ID NO: 73785 - DNA, 25 bp, Homo sapien
gctctgagataaatagccagagtct

SEQ ID NO: 73786 - DNA, 25 bp, Homo sapien
gctctgagattatcttcatgccacg

SEQ ID NO: 73787 - DNA, 25 bp, Homo sapien
gctctgatatagctctcaccaaaga

SEQ ID NO: 73788 - DNA, 25 bp, Homo sapien
gctctgatgtagctctcaccaaaga

SEQ ID NO: 73789 - DNA, 25 bp, Homo sapien
gctctgattgggaacgttgggtact

SEQ ID NO: 73790 - DNA, 25 bp, Homo sapien
gctctgattgggaatgttgggtact

SEQ ID NO: 73791 - DNA, 25 bp, Homo sapien
gctctgcaacataaccattcagaat

SEQ ID NO: 73792 - DNA, 25 bp, Homo sapien
gctctgcaacatatccattcagaat

SEQ ID NO: 73793 - DNA, 25 bp, Homo sapien
gctctgcaactagatctgtgggctc

SEQ ID NO: 73794 - DNA, 25 bp, Homo sapien
gctctgcaaggaatttgcccaacaa

SEQ ID NO: 73795 - DNA, 25 bp, Homo sapien
gctctgcaaggaattttcccaacaa

SEQ ID NO: 73796 - DNA, 25 bp, Homo sapien
gctctgcagctagatctgtgggctc

SEQ ID NO: 73797 - DNA, 25 bp, Homo sapien
gctctgccaatttgggatttttagc

SEQ ID NO: 73798 - DNA, 25 bp, Homo sapien
gctctgccagataatgctctaagaa

SEQ ID NO: 73799 - DNA, 25 bp, Homo sapien
gctctgccagatgatgctctaagaa

SEQ ID NO: 73800 - DNA, 25 bp, Homo sapien
gctctgccattttgggatttttagc

SEQ ID NO: 73801 - DNA, 25 bp, Homo sapien
gctctgcccatcgcgtatatcaact

SEQ ID NO: 73802 - DNA, 25 bp, Homo sapien
gctctgcccatcgcgtctatcaact

SEQ ID NO: 73803 - DNA, 25 bp, Homo sapien
gctctgctaatgtgacatttgtttg

SEQ ID NO: 73804 - DNA, 25 bp, Homo sapien
gctctgctaatgtggcatttgtttg

SEQ ID NO: 73805 - DNA, 25 bp, Homo sapien
gctctgctgcatataacaagcctgt

SEQ ID NO: 73806 - DNA, 25 bp, Homo sapien
gctctgctgcatgtaacaagcctgt

SEQ ID NO: 73807 - DNA, 25 bp, Homo sapien
gctctgcttggcagggcttagcggt

SEQ ID NO: 73808 - DNA, 25 bp, Homo sapien
gctctgcttggcagtgcttagcggt

SEQ ID NO: 73809 - DNA, 25 bp, Homo sapien
gctctggaaacgattactagttagt

SEQ ID NO: 73810 - DNA, 25 bp, Homo sapien
gctctggaaacggttactagttagt

SEQ ID NO: 73811 - DNA, 25 bp, Homo sapien
gctctggcagctgtggtgtttcatt

SEQ ID NO: 73812 - DNA, 25 bp, Homo sapien
gctctggcatctgtggtgtttcatt

SEQ ID NO: 73813 - DNA, 25 bp, Homo sapien
gctctggcctactaactgttaccac

SEQ ID NO: 73814 - DNA, 25 bp, Homo sapien
gctctggcctactatctgttaccac

SEQ ID NO: 73815 - DNA, 25 bp, Homo sapien
gctctggctagaatttacaataata

SEQ ID NO: 73816 - DNA, 25 bp, Homo sapien
gctctggctagaatttccaataata

SEQ ID NO: 73817 - DNA, 25 bp, Homo sapien
gctctggctggaccatgctaagcag

SEQ ID NO: 73818 - DNA, 25 bp, Homo sapien
gctctggctggaccgtgctaagcag

SEQ ID NO: 73819 - DNA, 25 bp, Homo sapien
gctctggctttcgcaacatcccata

SEQ ID NO: 73820 - DNA, 25 bp, Homo sapien
gctctggcttttgcaacatcccata

SEQ ID NO: 73821 - DNA, 25 bp, Homo sapien
gctctgggtccctcagtatcagagt

SEQ ID NO: 73822 - DNA, 25 bp, Homo sapien
gctctgggtccctgagtatcagagt

SEQ ID NO: 73823 - DNA, 25 bp, Homo sapien
gctctggttatcaggacagagaaat

SEQ ID NO: 73824 - DNA, 25 bp, Homo sapien
gctctggttatcgggacagagaaat

SEQ ID NO: 73825 - DNA, 25 bp, Homo sapien
gctctggtttaattatatcgcacaa

SEQ ID NO: 73826 - DNA, 25 bp, Homo sapien
gctctggtttaattgtatcgcacaa

SEQ ID NO: 73827 - DNA, 25 bp, Homo sapien
gctctgtaaatggccaaacaaccat

SEQ ID NO: 73828 - DNA, 25 bp, Homo sapien
gctctgtaaatggtcaaacaaccat

SEQ ID NO: 73829 - DNA, 25 bp, Homo sapien
gctctgtcctgcctaggcgactcaa

SEQ ID NO: 73830 - DNA, 25 bp, Homo sapien
gctctgtcttgcctaggcgactcaa

SEQ ID NO: 73831 - DNA, 25 bp, Homo sapien
gctctgtttctgaagaaaatggagc

SEQ ID NO: 73832 - DNA, 25 bp, Homo sapien
gctctgtttctggagaaaatggagc

SEQ ID NO: 73833 - DNA, 25 bp, Homo sapien
gctcttaaaagcgtccacctgtaaa

SEQ ID NO: 73834 - DNA, 25 bp, Homo sapien
gctcttaaaagcttccacctgtaaa

SEQ ID NO: 73835 - DNA, 25 bp, Homo sapien
gctcttaaacctaaatctaagaaag

SEQ ID NO: 73836 - DNA, 25 bp, Homo sapien
gctcttaaagcccttatttctcagt

SEQ ID NO: 73837 - DNA, 25 bp, Homo sapien
gctcttaaagctcttatttctcagt

SEQ ID NO: 73838 - DNA, 25 bp, Homo sapien
gctcttaaagctttctgccttttct

SEQ ID NO: 73839 - DNA, 25 bp, Homo sapien
gctcttaagcaaacgaagaacaata

SEQ ID NO: 73840 - DNA, 25 bp, Homo sapien
gctcttaagcctaaatctaagaaag

SEQ ID NO: 73841 - DNA, 25 bp, Homo sapien
gctcttaaggaaacgaagaacaata

SEQ ID NO: 73842 - DNA, 25 bp, Homo sapien
gctcttaaggctttctgccttttct

SEQ ID NO: 73843 - DNA, 25 bp, Homo sapien
gctcttcaagacaggacaaactcac

SEQ ID NO: 73844 - DNA, 25 bp, Homo sapien
gctcttcaagagaggacaaactcac

SEQ ID NO: 73845 - DNA, 25 bp, Homo sapien
gctcttcatgcccataaggctgatc

SEQ ID NO: 73846 - DNA, 25 bp, Homo sapien
gctcttcatgcctataaggctgatc

SEQ ID NO: 73847 - DNA, 25 bp, Homo sapien
gctcttccacatttttagaatcact

SEQ ID NO: 73848 - DNA, 25 bp, Homo sapien
gctcttccacattttttgaatcact

SEQ ID NO: 73849 - DNA, 25 bp, Homo sapien
gctcttccactgatctctcaagaag

SEQ ID NO: 73850 - DNA, 25 bp, Homo sapien
gctcttcctctgatctctcaagaag

SEQ ID NO: 73851 - DNA, 25 bp, Homo sapien
gctcttcgaaaagattaagtgcatg

SEQ ID NO: 73852 - DNA, 25 bp, Homo sapien
gctcttcgaaaatattaagtgcatg

SEQ ID NO: 73853 - DNA, 25 bp, Homo sapien
gctcttctcttggggcctcccgcct

SEQ ID NO: 73854 - DNA, 25 bp, Homo sapien
gctcttctctttgggcctcccgcct

SEQ ID NO: 73855 - DNA, 25 bp, Homo sapien
gctcttcttagatgagacccaatgc

SEQ ID NO: 73856 - DNA, 25 bp, Homo sapien
gctcttcttcgatgagacccaatgc

SEQ ID NO: 73857 - DNA, 25 bp, Homo sapien
gctcttcttgctaaagtctgtacag

SEQ ID NO: 73858 - DNA, 25 bp, Homo sapien
gctcttcttgctaatgtctgtacag

SEQ ID NO: 73859 - DNA, 25 bp, Homo sapien
gctcttgaagttcgtgatgagtact

SEQ ID NO: 73860 - DNA, 25 bp, Homo sapien
gctcttgacgttcgtgatgagtact

SEQ ID NO: 73861 - DNA, 25 bp, Homo sapien
gctcttgcctcactcgacctccaaa

SEQ ID NO: 73862 - DNA, 25 bp, Homo sapien
gctcttgcctcattcgacctccaaa

SEQ ID NO: 73863 - DNA, 25 bp, Homo sapien
gctcttggaaaaaaggtctgtttta

SEQ ID NO: 73864 - DNA, 25 bp, Homo sapien
gctcttggacaaaaggtctgtttta

SEQ ID NO: 73865 - DNA, 25 bp, Homo sapien
gctcttggagtttttaagataattt

SEQ ID NO: 73866 - DNA, 25 bp, Homo sapien
gctcttggattcaccaagcactcat

SEQ ID NO: 73867 - DNA, 25 bp, Homo sapien
gctcttggattcgccaagcactcat

SEQ ID NO: 73868 - DNA, 25 bp, Homo sapien
gctcttggattttttaagataattt

SEQ ID NO: 73869 - DNA, 25 bp, Homo sapien
gctcttggcacacaaaaatagttta

SEQ ID NO: 73870 - DNA, 25 bp, Homo sapien
gctcttggcacacagaaatagttta

SEQ ID NO: 73871 - DNA, 25 bp, Homo sapien
gctcttggccgtagaagagcatgct

SEQ ID NO: 73872 - DNA, 25 bp, Homo sapien
gctcttggctgtagaagagcatgct

SEQ ID NO: 73873 - DNA, 25 bp, Homo sapien
gctctttgccatgggaatctctttg

SEQ ID NO: 73874 - DNA, 25 bp, Homo sapien
gctctttgccatgggattctctttg

SEQ ID NO: 73875 - DNA, 25 bp, Homo sapien
gctcttttctaagtgcatgtgatac

SEQ ID NO: 73876 - DNA, 25 bp, Homo sapien
gctcttttctttcgtgatacttatc

SEQ ID NO: 73877 - DNA, 25 bp, Homo sapien
gctcttttcttttgtgatacttatc

SEQ ID NO: 73878 - DNA, 25 bp, Homo sapien
gctcttttgtaagtgcatgtgatac

SEQ ID NO: 73879 - DNA, 25 bp, Homo sapien
gctcttttgtactcagctggtcata

SEQ ID NO: 73880 - DNA, 25 bp, Homo sapien
gctcttttgtactctgctggtcata

SEQ ID NO: 73881 - DNA, 25 bp, Homo sapien
gctcttttgtcagacagcatgttct

SEQ ID NO: 73882 - DNA, 25 bp, Homo sapien
gctcttttgtcaggcagcatgttct

SEQ ID NO: 73883 - DNA, 25 bp, Homo sapien
gctgaaaaacttcagaaactgtctt

SEQ ID NO: 73884 - DNA, 25 bp, Homo sapien
gctgaaaatcttcagaaactgtctt

SEQ ID NO: 73885 - DNA, 25 bp, Homo sapien
gctgaaactaccatctagcccttta

SEQ ID NO: 73886 - DNA, 25 bp, Homo sapien
gctgaaactactatctagcccttta

SEQ ID NO: 73887 - DNA, 25 bp, Homo sapien
gctgaaagagacagtgctatctggc

SEQ ID NO: 73888 - DNA, 25 bp, Homo sapien
gctgaaagagacggtgctatctggc

SEQ ID NO: 73889 - DNA, 25 bp, Homo sapien
gctgaaagcacagtgcagaaatggt

SEQ ID NO: 73890 - DNA, 25 bp, Homo sapien
gctgaaagcacagtgccgaaatggt

SEQ ID NO: 73891 - DNA, 25 bp, Homo sapien
gctgaaagttatcgccaatagccag

SEQ ID NO: 73892 - DNA, 25 bp, Homo sapien
gctgaaagttattgccaatagccag

SEQ ID NO: 73893 - DNA, 25 bp, Homo sapien
gctgaaattcgttgactcgtactgt

SEQ ID NO: 73894 - DNA, 25 bp, Homo sapien
gctgaaattcgttgtctcgtactgt

SEQ ID NO: 73895 - DNA, 25 bp, Homo sapien
gctgaaattgtccagacttggctaa

SEQ ID NO: 73896 - DNA, 25 bp, Homo sapien
gctgaaattgtccagatttggctaa

SEQ ID NO: 73897 - DNA, 25 bp, Homo sapien
gctgaacagtgacactcgtgcctgg

SEQ ID NO: 73898 - DNA, 25 bp, Homo sapien
gctgaacagtgacacttgtgcctgg

SEQ ID NO: 73899 - DNA, 25 bp, Homo sapien
gctgaactcacctgatctagcacct

SEQ ID NO: 73900 - DNA, 25 bp, Homo sapien
gctgaactcacctgatttagcacct

SEQ ID NO: 73901 - DNA, 25 bp, Homo sapien
gctgaactgatatacagtttgtaag

SEQ ID NO: 73902 - DNA, 25 bp, Homo sapien
gctgaactgatatccagtttgtaag

SEQ ID NO: 73903 - DNA, 25 bp, Homo sapien
gctgaagcaatacaaaaaggatagt

SEQ ID NO: 73904 - DNA, 25 bp, Homo sapien
gctgaagcaatacgaaaaggatagt

SEQ ID NO: 73905 - DNA, 25 bp, Homo sapien
gctgaagcagtccgcaaggttaact

SEQ ID NO: 73906 - DNA, 25 bp, Homo sapien
gctgaagcagtgcgcaaggttaact

SEQ ID NO: 73907 - DNA, 25 bp, Homo sapien
gctgaagctattcccaaaaaatcaa

SEQ ID NO: 73908 - DNA, 25 bp, Homo sapien
gctgaagctgttcccaaaaaatcaa

SEQ ID NO: 73909 - DNA, 25 bp, Homo sapien
gctgaaggcaagacctcaactgctt

SEQ ID NO: 73910 - DNA, 25 bp, Homo sapien
gctgaaggcaagaccttaactgctt

SEQ ID NO: 73911 - DNA, 25 bp, Homo sapien
gctgaaggtttaggaaagaaccatc

SEQ ID NO: 73912 - DNA, 25 bp, Homo sapien
gctgaaggtttagggaagaaccatc

SEQ ID NO: 73913 - DNA, 25 bp, Homo sapien
gctgaagtaacgccggagataaact

SEQ ID NO: 73914 - DNA, 25 bp, Homo sapien
gctgaagtaacgcctgagataaact

SEQ ID NO: 73915 - DNA, 25 bp, Homo sapien
gctgaagtagtaattcaacacaatc

SEQ ID NO: 73916 - DNA, 25 bp, Homo sapien
gctgaagtcagagtctacataaata

SEQ ID NO: 73917 - DNA, 25 bp, Homo sapien
gctgaagtcggagtctacataaata

SEQ ID NO: 73918 - DNA, 25 bp, Homo sapien
gctgaagttgtaattcaacacaatc

SEQ ID NO: 73919 - DNA, 25 bp, Homo sapien
gctgaatccaagatcataaacccaa

SEQ ID NO: 73920 - DNA, 25 bp, Homo sapien
gctgaatccaagattataaacccaa

SEQ ID NO: 73921 - DNA, 25 bp, Homo sapien
gctgaatgcagccctatcagtgatc

SEQ ID NO: 73922 - DNA, 25 bp, Homo sapien
gctgaatgtagccctatcagtgatc

SEQ ID NO: 73923 - DNA, 25 bp, Homo sapien
gctgaattaacttgctgatgtactg

SEQ ID NO: 73924 - DNA, 25 bp, Homo sapien
gctgaattaacttgttgatgtactg

SEQ ID NO: 73925 - DNA, 25 bp, Homo sapien
gctgacaactgtaaatgtcttttta

SEQ ID NO: 73926 - DNA, 25 bp, Homo sapien
gctgacaactgtaattgtcttttta

SEQ ID NO: 73927 - DNA, 25 bp, Homo sapien
gctgacaagaaaaaagcatttcaaa

SEQ ID NO: 73928 - DNA, 25 bp, Homo sapien
gctgacaaggaaaaagcatttcaaa

SEQ ID NO: 73929 - DNA, 25 bp, Homo sapien
gctgacacttactccatatggttga

SEQ ID NO: 73930 - DNA, 25 bp, Homo sapien
gctgacacttactgcatatggttga

SEQ ID NO: 73931 - DNA, 25 bp, Homo sapien
gctgacagaggctcctctctactca

SEQ ID NO: 73932 - DNA, 25 bp, Homo sapien
gctgacagaggcttctctctactca

SEQ ID NO: 73933 - DNA, 25 bp, Homo sapien
gctgacatataacctatacctgtgc

SEQ ID NO: 73934 - DNA, 25 bp, Homo sapien
gctgacatataatctatacctgtgc

SEQ ID NO: 73935 - DNA, 25 bp, Homo sapien
gctgacatggcaaggacatcttggt

SEQ ID NO: 73936 - DNA, 25 bp, Homo sapien
gctgacatggcaaggatatcttggt

SEQ ID NO: 73937 - DNA, 25 bp, Homo sapien
gctgaccagaagaattcggctttat

SEQ ID NO: 73938 - DNA, 25 bp, Homo sapien
gctgaccagaagaatttggctttat

SEQ ID NO: 73939 - DNA, 25 bp, Homo sapien
gctgaccctgacgcaaagattcatg

SEQ ID NO: 73940 - DNA, 25 bp, Homo sapien
gctgaccctgatgcaaagattcatg

SEQ ID NO: 73941 - DNA, 25 bp, Homo sapien
gctgaccctgcctctcttatattct

SEQ ID NO: 73942 - DNA, 25 bp, Homo sapien
gctgaccctgcctgtcttatattct

SEQ ID NO: 73943 - DNA, 25 bp, Homo sapien
gctgactctgtgtctctaaccgtct

SEQ ID NO: 73944 - DNA, 25 bp, Homo sapien
gctgactctgtgtttctaaccgtct

SEQ ID NO: 73945 - DNA, 25 bp, Homo sapien
gctgactggtgcatgggaaggatta

SEQ ID NO: 73946 - DNA, 25 bp, Homo sapien
gctgactggtgcctgggaaggatta

SEQ ID NO: 73947 - DNA, 25 bp, Homo sapien
gctgacttaaatgacacccttgtta

SEQ ID NO: 73948 - DNA, 25 bp, Homo sapien
gctgacttaaatgtcacccttgtta

SEQ ID NO: 73949 - DNA, 25 bp, Homo sapien
gctgacttggatggactacatcacc

SEQ ID NO: 73950 - DNA, 25 bp, Homo sapien
gctgacttggatggcctacatcacc

SEQ ID NO: 73951 - DNA, 25 bp, Homo sapien
gctgagaaatagcaacaaagatttc

SEQ ID NO: 73952 - DNA, 25 bp, Homo sapien
gctgagaaatagcagcaaagatttc

SEQ ID NO: 73953 - DNA, 25 bp, Homo sapien
gctgagaagcattcggctgattctc

SEQ ID NO: 73954 - DNA, 25 bp, Homo sapien
gctgagaagcatttggctgattctc

SEQ ID NO: 73955 - DNA, 25 bp, Homo sapien
gctgagagacagttcccagctacat

SEQ ID NO: 73956 - DNA, 25 bp, Homo sapien
gctgagagacagttcctagctacat

SEQ ID NO: 73957 - DNA, 25 bp, Homo sapien
gctgagaggtcatccttgtttctgg

SEQ ID NO: 73958 - DNA, 25 bp, Homo sapien
gctgagaggtcgtccttgtttctgg

SEQ ID NO: 73959 - DNA, 25 bp, Homo sapien
gctgagaggtcttgaggatatctag

SEQ ID NO: 73960 - DNA, 25 bp, Homo sapien
gctgagaggtcttgcggatatctag

SEQ ID NO: 73961 - DNA, 25 bp, Homo sapien
gctgagagtgaatgaataaacagat

SEQ ID NO: 73962 - DNA, 25 bp, Homo sapien
gctgagagttaatgaataaacagat

SEQ ID NO: 73963 - DNA, 25 bp, Homo sapien
gctgagatgattcgatttgcatttg

SEQ ID NO: 73964 - DNA, 25 bp, Homo sapien
gctgagatgatttgatttgcatttg

SEQ ID NO: 73965 - DNA, 25 bp, Homo sapien
gctgagattaaaaaaaaatatgtac

SEQ ID NO: 73966 - DNA, 25 bp, Homo sapien
gctgagattaaaaaaacatatgtac

SEQ ID NO: 73967 - DNA, 25 bp, Homo sapien
gctgagccaatcagattgtctttcg

SEQ ID NO: 73968 - DNA, 25 bp, Homo sapien
gctgagccaatcggattgtctttcg

SEQ ID NO: 73969 - DNA, 25 bp, Homo sapien
gctgagcccgcaagtttgcctcacc

SEQ ID NO: 73970 - DNA, 25 bp, Homo sapien
gctgagccggcaagtttgcctcacc

SEQ ID NO: 73971 - DNA, 25 bp, Homo sapien
gctgagctaaccaacggtggaaatt

SEQ ID NO: 73972 - DNA, 25 bp, Homo sapien
gctgagctagccaacggtggaaatt

SEQ ID NO: 73973 - DNA, 25 bp, Homo sapien
gctgagctctttatttctatacact

SEQ ID NO: 73974 - DNA, 25 bp, Homo sapien
gctgagctctttgtttctatacact

SEQ ID NO: 73975 - DNA, 25 bp, Homo sapien
gctgagctgtcccgcgtgtggtgat

SEQ ID NO: 73976 - DNA, 25 bp, Homo sapien
gctgagctgtcctgcgtgtggtgat

SEQ ID NO: 73977 - DNA, 25 bp, Homo sapien
gctgaggacattgagtgatctaaga

SEQ ID NO: 73978 - DNA, 25 bp, Homo sapien
gctgaggatattgagtgatctaaga

SEQ ID NO: 73979 - DNA, 25 bp, Homo sapien
gctgaggatgagagctgactgctga

SEQ ID NO: 73980 - DNA, 25 bp, Homo sapien
gctgaggatgagagttgactgctga

SEQ ID NO: 73981 - DNA, 25 bp, Homo sapien
gctgaggtctcacaaaatgtcagat

SEQ ID NO: 73982 - DNA, 25 bp, Homo sapien
gctgaggtctcacgaaatgtcagat

SEQ ID NO: 73983 - DNA, 25 bp, Homo sapien
gctgaggttcacaaagtttgaggag

SEQ ID NO: 73984 - DNA, 25 bp, Homo sapien
gctgaggttcagaaagtttgaggag

SEQ ID NO: 73985 - DNA, 25 bp, Homo sapien
gctgagtgatgatactggcccccaa

SEQ ID NO: 73986 - DNA, 25 bp, Homo sapien
gctgagtgatgttactggcccccaa

SEQ ID NO: 73987 - DNA, 25 bp, Homo sapien
gctgagttacacccaacgtgcaggt

SEQ ID NO: 73988 - DNA, 25 bp, Homo sapien
gctgagttacacccaatgtgcaggt

SEQ ID NO: 73989 - DNA, 25 bp, Homo sapien
gctgataacttctatatctaaaaat

SEQ ID NO: 73990 - DNA, 25 bp, Homo sapien
gctgataacttctgtatctaaaaat

SEQ ID NO: 73991 - DNA, 25 bp, Homo sapien
gctgataagctaacaagaatcaaca

SEQ ID NO: 73992 - DNA, 25 bp, Homo sapien
gctgataagctaataagaatcaaca

SEQ ID NO: 73993 - DNA, 25 bp, Homo sapien
gctgatacctgacaaaagagattct

SEQ ID NO: 73994 - DNA, 25 bp, Homo sapien
gctgatacctgacgaaagagattct

SEQ ID NO: 73995 - DNA, 25 bp, Homo sapien
gctgatattaaatgcagactctgtt

SEQ ID NO: 73996 - DNA, 25 bp, Homo sapien
gctgatattaaatgtagactctgtt

SEQ ID NO: 73997 - DNA, 25 bp, Homo sapien
gctgatccacagtatcttccatacc

SEQ ID NO: 73998 - DNA, 25 bp, Homo sapien
gctgatccgcagtatcttccatacc

SEQ ID NO: 73999 - DNA, 25 bp, Homo sapien
gctgatctgatacagaaaacttttt

SEQ ID NO: 74000 - DNA, 25 bp, Homo sapien
gctgatctgatagagaaaacttttt

SEQ ID NO: 74001 - DNA, 25 bp, Homo sapien
gctgatgactaccacatctataatt

SEQ ID NO: 74002 - DNA, 25 bp, Homo sapien
gctgatgactacctcatctataatt

SEQ ID NO: 74003 - DNA, 25 bp, Homo sapien
gctgatgatacagaagcggaagcct

SEQ ID NO: 74004 - DNA, 25 bp, Homo sapien
gctgatgatacagaagtggaagcct

SEQ ID NO: 74005 - DNA, 25 bp, Homo sapien
gctgatgatattcaaggatgttttt

SEQ ID NO: 74006 - DNA, 25 bp, Homo sapien
gctgatgatgttcaaggatgttttt

SEQ ID NO: 74007 - DNA, 25 bp, Homo sapien
gctgatggcagaaaatttttttcac

SEQ ID NO: 74008 - DNA, 25 bp, Homo sapien
gctgatggcagaatatttttttcac

SEQ ID NO: 74009 - DNA, 25 bp, Homo sapien
gctgatggctgtccaagtggttacg

SEQ ID NO: 74010 - DNA, 25 bp, Homo sapien
gctgatggctgtcgaagtggttacg

SEQ ID NO: 74011 - DNA, 25 bp, Homo sapien
gctgatgtggaaagaaccactggct

SEQ ID NO: 74012 - DNA, 25 bp, Homo sapien
gctgatgtggatagaaccactggct

SEQ ID NO: 74013 - DNA, 25 bp, Homo sapien
gctgatgttatcaacaacgttctat

SEQ ID NO: 74014 - DNA, 25 bp, Homo sapien
gctgatgttattaacaacgttctat

SEQ ID NO: 74015 - DNA, 25 bp, Homo sapien
gctgattattcatcctacgttgtat

SEQ ID NO: 74016 - DNA, 25 bp, Homo sapien
gctgattattcttcctacgttgtat

SEQ ID NO: 74017 - DNA, 25 bp, Homo sapien
gctgattcactcagttgaaacatct

SEQ ID NO: 74018 - DNA, 25 bp, Homo sapien
gctgattcacttagttgaaacatct

SEQ ID NO: 74019 - DNA, 25 bp, Homo sapien
gctgattggaacctttgaataaatg

SEQ ID NO: 74020 - DNA, 25 bp, Homo sapien
gctgattgggacctttgaataaatg

SEQ ID NO: 74021 - DNA, 25 bp, Homo sapien
gctgatttaaactcaatgtaacaaa

SEQ ID NO: 74022 - DNA, 25 bp, Homo sapien
gctgatttagactcaatgtaacaaa

SEQ ID NO: 74023 - DNA, 25 bp, Homo sapien
gctgcaaaaacatctctcctggagt

SEQ ID NO: 74024 - DNA, 25 bp, Homo sapien
gctgcaaaaacctctctcctggagt

SEQ ID NO: 74025 - DNA, 25 bp, Homo sapien
gctgcaaacttctgcaatgtagggg

SEQ ID NO: 74026 - DNA, 25 bp, Homo sapien
gctgcaaagctcacaactccaaaaa

SEQ ID NO: 74027 - DNA, 25 bp, Homo sapien
gctgcaaagctcagaactccaaaaa

SEQ ID NO: 74028 - DNA, 25 bp, Homo sapien
gctgcaaatttctgcaatgtagggg

SEQ ID NO: 74029 - DNA, 25 bp, Homo sapien
gctgcaacagagaccgtgtggcctg

SEQ ID NO: 74030 - DNA, 25 bp, Homo sapien
gctgcaacagagacggtgtggcctg

SEQ ID NO: 74031 - DNA, 25 bp, Homo sapien
gctgcaagagacaaggaatatcatg

SEQ ID NO: 74032 - DNA, 25 bp, Homo sapien
gctgcaagagaccaggaatatcatg

SEQ ID NO: 74033 - DNA, 25 bp, Homo sapien
gctgcaataaacacgactactgatt

SEQ ID NO: 74034 - DNA, 25 bp, Homo sapien
gctgcaataaacacgattactgatt

SEQ ID NO: 74035 - DNA, 25 bp, Homo sapien
gctgcaataagctattaaagatgtc

SEQ ID NO: 74036 - DNA, 25 bp, Homo sapien
gctgcaatatgctattaaagatgtc

SEQ ID NO: 74037 - DNA, 25 bp, Homo sapien
gctgcaatggataacagcttcccaa

SEQ ID NO: 74038 - DNA, 25 bp, Homo sapien
gctgcaatgtataacagcttcccaa

SEQ ID NO: 74039 - DNA, 25 bp, Homo sapien
gctgcactaaacaatggattttcaa

SEQ ID NO: 74040 - DNA, 25 bp, Homo sapien
gctgcactgaacaatggattttcaa

SEQ ID NO: 74041 - DNA, 25 bp, Homo sapien
gctgcagaggcacaactgatggcaa

SEQ ID NO: 74042 - DNA, 25 bp, Homo sapien
gctgcagaggcacacctgatggcaa

SEQ ID NO: 74043 - DNA, 25 bp, Homo sapien
gctgcaggcatgaagagacaggtca

SEQ ID NO: 74044 - DNA, 25 bp, Homo sapien
gctgcaggcgtgaagagacaggtca

SEQ ID NO: 74045 - DNA, 25 bp, Homo sapien
gctgcagggacctttccggccgctg

SEQ ID NO: 74046 - DNA, 25 bp, Homo sapien
gctgcagggacctttctggccgctg

SEQ ID NO: 74047 - DNA, 25 bp, Homo sapien
gctgcaggtagagactacattttcc

SEQ ID NO: 74048 - DNA, 25 bp, Homo sapien
gctgcaggtccagcagctatcttgg

SEQ ID NO: 74049 - DNA, 25 bp, Homo sapien
gctgcaggtccagcagttatcttgg

SEQ ID NO: 74050 - DNA, 25 bp, Homo sapien
gctgcaggtggagactacattttcc

SEQ ID NO: 74051 - DNA, 25 bp, Homo sapien
gctgcagtaaatgtgcaaaagagac

SEQ ID NO: 74052 - DNA, 25 bp, Homo sapien
gctgcagtaaatgtgcgaaagagac

SEQ ID NO: 74053 - DNA, 25 bp, Homo sapien
gctgcagtcgcattttcaaggaagc

SEQ ID NO: 74054 - DNA, 25 bp, Homo sapien
gctgcagtctcattttcaaggaagc

SEQ ID NO: 74055 - DNA, 25 bp, Homo sapien
gctgcagttcaggcagccctgtcat

SEQ ID NO: 74056 - DNA, 25 bp, Homo sapien
gctgcagttcaggtagccctgtcat

SEQ ID NO: 74057 - DNA, 25 bp, Homo sapien
gctgcatagctcttttactcagatt

SEQ ID NO: 74058 - DNA, 25 bp, Homo sapien
gctgcatagcttttttactcagatt

SEQ ID NO: 74059 - DNA, 25 bp, Homo sapien
gctgcatccgagagattctggtatg

SEQ ID NO: 74060 - DNA, 25 bp, Homo sapien
gctgcatctgagagattctggtatg

SEQ ID NO: 74061 - DNA, 25 bp, Homo sapien
gctgcatgccggttacgtcctcact

SEQ ID NO: 74062 - DNA, 25 bp, Homo sapien
gctgcatgccggttgcgtcctcact

SEQ ID NO: 74063 - DNA, 25 bp, Homo sapien
gctgcatttgtctataaatttagaa

SEQ ID NO: 74064 - DNA, 25 bp, Homo sapien
gctgcatttgtttataaatttagaa

SEQ ID NO: 74065 - DNA, 25 bp, Homo sapien
gctgcattttgtcaaacattcatgc

SEQ ID NO: 74066 - DNA, 25 bp, Homo sapien
gctgcattttgtgaaacattcatgc

SEQ ID NO: 74067 - DNA, 25 bp, Homo sapien
gctgccacatactaggagcttgctc

SEQ ID NO: 74068 - DNA, 25 bp, Homo sapien
gctgccacatactgggagcttgctc

SEQ ID NO: 74069 - DNA, 25 bp, Homo sapien
gctgccacctctctagttctctctc

SEQ ID NO: 74070 - DNA, 25 bp, Homo sapien
gctgccacctctcttgttctctctc

SEQ ID NO: 74071 - DNA, 25 bp, Homo sapien
gctgccaggatccagtaacctccca

SEQ ID NO: 74072 - DNA, 25 bp, Homo sapien
gctgccaggatccggtaacctccca

SEQ ID NO: 74073 - DNA, 25 bp, Homo sapien
gctgccagtcagccgagcccgtgaa

SEQ ID NO: 74074 - DNA, 25 bp, Homo sapien
gctgccagtcagctgagcccgtgaa

SEQ ID NO: 74075 - DNA, 25 bp, Homo sapien
gctgccagtccctcaggaggaactc

SEQ ID NO: 74076 - DNA, 25 bp, Homo sapien
gctgccagtccctctggaggaactc

SEQ ID NO: 74077 - DNA, 25 bp, Homo sapien
gctgccattctctctgttgtgcttt

SEQ ID NO: 74078 - DNA, 25 bp, Homo sapien
gctgccattgtctctgttgtgcttt

SEQ ID NO: 74079 - DNA, 25 bp, Homo sapien
gctgccatttgtcctccaaacttct

SEQ ID NO: 74080 - DNA, 25 bp, Homo sapien
gctgccatttgtcttccaaacttct

SEQ ID NO: 74081 - DNA, 25 bp, Homo sapien
gctgccctgcttgtgccttagtggg

SEQ ID NO: 74082 - DNA, 25 bp, Homo sapien
gctgccctggcatatttaacaacat

SEQ ID NO: 74083 - DNA, 25 bp, Homo sapien
gctgccctggcgtatttaacaacat

SEQ ID NO: 74084 - DNA, 25 bp, Homo sapien
gctgccctgtttgtgccttagtggg

SEQ ID NO: 74085 - DNA, 25 bp, Homo sapien
gctgccgacatgggtagtggcctgc

SEQ ID NO: 74086 - DNA, 25 bp, Homo sapien
gctgccgacatgtgtagtggcctgc

SEQ ID NO: 74087 - DNA, 25 bp, Homo sapien
gctgcctacagaattagagaactgc

SEQ ID NO: 74088 - DNA, 25 bp, Homo sapien
gctgcctacagagttagagaactgc

SEQ ID NO: 74089 - DNA, 25 bp, Homo sapien
gctgcctactttagacaactacaat

SEQ ID NO: 74090 - DNA, 25 bp, Homo sapien
gctgcctacttttgacaactacaat

SEQ ID NO: 74091 - DNA, 25 bp, Homo sapien
gctgcctattgaaagcaaagatagc

SEQ ID NO: 74092 - DNA, 25 bp, Homo sapien
gctgcctattggaagcaaagatagc

SEQ ID NO: 74093 - DNA, 25 bp, Homo sapien
gctgcctatttcacacatacagaag

SEQ ID NO: 74094 - DNA, 25 bp, Homo sapien
gctgcctatttcgcacatacagaag

SEQ ID NO: 74095 - DNA, 25 bp, Homo sapien
gctgcctcagaatcgcttggagagc

SEQ ID NO: 74096 - DNA, 25 bp, Homo sapien
gctgcctcagaatctcttggagagc

SEQ ID NO: 74097 - DNA, 25 bp, Homo sapien
gctgcctggttctaacaccaacgtt

SEQ ID NO: 74098 - DNA, 25 bp, Homo sapien
gctgcctggttctatcaccaacgtt

SEQ ID NO: 74099 - DNA, 25 bp, Homo sapien
gctgccttagtctcttctgccctta

SEQ ID NO: 74100 - DNA, 25 bp, Homo sapien
gctgccttagtcttttctgccctta

SEQ ID NO: 74101 - DNA, 25 bp, Homo sapien
gctgccttatgaacaagtaagagga

SEQ ID NO: 74102 - DNA, 25 bp, Homo sapien
gctgccttatggacaagtaagagga

SEQ ID NO: 74103 - DNA, 25 bp, Homo sapien
gctgcgccatctgctcctgacatta

SEQ ID NO: 74104 - DNA, 25 bp, Homo sapien
gctgcgccatctgttcctgacatta

SEQ ID NO: 74105 - DNA, 25 bp, Homo sapien
gctgcgttcaagggatgcactgacc

SEQ ID NO: 74106 - DNA, 25 bp, Homo sapien
gctgcgttcgagggatgcactgacc

SEQ ID NO: 74107 - DNA, 25 bp, Homo sapien
gctgctaaacatctgcgacggtttg

SEQ ID NO: 74108 - DNA, 25 bp, Homo sapien
gctgctaaacatctgctacggtttg

SEQ ID NO: 74109 - DNA, 25 bp, Homo sapien
gctgctagggatacagtggattaat

SEQ ID NO: 74110 - DNA, 25 bp, Homo sapien
gctgctagggatatagtggattaat

SEQ ID NO: 74111 - DNA, 25 bp, Homo sapien
gctgctatttcagaatttctgtaga

SEQ ID NO: 74112 - DNA, 25 bp, Homo sapien
gctgctatttcggaatttctgtaga

SEQ ID NO: 74113 - DNA, 25 bp, Homo sapien
gctgctcaatgacacctgcagacac

SEQ ID NO: 74114 - DNA, 25 bp, Homo sapien
gctgctcaatgatacctgcagacac

SEQ ID NO: 74115 - DNA, 25 bp, Homo sapien
gctgctcaccactcgaaaaacaaac

SEQ ID NO: 74116 - DNA, 25 bp, Homo sapien
gctgctcaccacttgaaaaacaaac

SEQ ID NO: 74117 - DNA, 25 bp, Homo sapien
gctgctccacaatgaacgtgtcctt

SEQ ID NO: 74118 - DNA, 25 bp, Homo sapien
gctgctccacaatgaatgtgtcctt

SEQ ID NO: 74119 - DNA, 25 bp, Homo sapien
gctgctcctgtgctgtcacctgcaa

SEQ ID NO: 74120 - DNA, 25 bp, Homo sapien
gctgctcctgtgttgtcacctgcaa

SEQ ID NO: 74121 - DNA, 25 bp, Homo sapien
gctgctctcaaacatacgctagaaa

SEQ ID NO: 74122 - DNA, 25 bp, Homo sapien
gctgctctgaaacatacgctagaaa

SEQ ID NO: 74123 - DNA, 25 bp, Homo sapien
gctgctgaaaaacttcagaaactgt

SEQ ID NO: 74124 - DNA, 25 bp, Homo sapien
gctgctgaaaatcttcagaaactgt

SEQ ID NO: 74125 - DNA, 25 bp, Homo sapien
gctgctgagctaaccaacggtggaa

SEQ ID NO: 74126 - DNA, 25 bp, Homo sapien
gctgctgagctagccaacggtggaa

SEQ ID NO: 74127 - DNA, 25 bp, Homo sapien
gctgctgcaatattaagttccttgt

SEQ ID NO: 74128 - DNA, 25 bp, Homo sapien
gctgctgcagtattaagttccttgt

SEQ ID NO: 74129 - DNA, 25 bp, Homo sapien
gctgctgccttatgaacaagtaaga

SEQ ID NO: 74130 - DNA, 25 bp, Homo sapien
gctgctgccttatggacaagtaaga

SEQ ID NO: 74131 - DNA, 25 bp, Homo sapien
gctgctgtaatatcacacactgggt

SEQ ID NO: 74132 - DNA, 25 bp, Homo sapien
gctgctgtaatgtcacacactgggt

SEQ ID NO: 74133 - DNA, 25 bp, Homo sapien
gctgctgttcctctaccatttttat

SEQ ID NO: 74134 - DNA, 25 bp, Homo sapien
gctgctgttcctctacgatttttat

SEQ ID NO: 74135 - DNA, 25 bp, Homo sapien
gctgcttagtgaaggtgatttcctt

SEQ ID NO: 74136 - DNA, 25 bp, Homo sapien
gctgcttagtgatggtgatttcctt

SEQ ID NO: 74137 - DNA, 25 bp, Homo sapien
gctgcttcaacttgttctctgcagg

SEQ ID NO: 74138 - DNA, 25 bp, Homo sapien
gctgcttcatcttgttctctgcagg

SEQ ID NO: 74139 - DNA, 25 bp, Homo sapien
gctgcttccaagtggcatatggact

SEQ ID NO: 74140 - DNA, 25 bp, Homo sapien
gctgcttccaagttgcatatggact

SEQ ID NO: 74141 - DNA, 25 bp, Homo sapien
gctgcttcttgaccagatgcttcgt

SEQ ID NO: 74142 - DNA, 25 bp, Homo sapien
gctgcttcttgaccagctgcttcgt

SEQ ID NO: 74143 - DNA, 25 bp, Homo sapien
gctgcttgaaggcaaggatgatgcc

SEQ ID NO: 74144 - DNA, 25 bp, Homo sapien
gctgcttgaaggcagggatgatgcc

SEQ ID NO: 74145 - DNA, 25 bp, Homo sapien
gctgcttggaaagtcagtcacattt

SEQ ID NO: 74146 - DNA, 25 bp, Homo sapien
gctgcttgggaagtcagtcacattt

SEQ ID NO: 74147 - DNA, 25 bp, Homo sapien
gctggaaaataccaacggcaactcc

SEQ ID NO: 74148 - DNA, 25 bp, Homo sapien
gctggaaaatactaacggcaactcc

SEQ ID NO: 74149 - DNA, 25 bp, Homo sapien
gctggaaaatgcaactggcatactg

SEQ ID NO: 74150 - DNA, 25 bp, Homo sapien
gctggaaaatgtaactggcatactg

SEQ ID NO: 74151 - DNA, 25 bp, Homo sapien
gctggaaagtttgtgtcaatttatt

SEQ ID NO: 74152 - DNA, 25 bp, Homo sapien
gctggaaagtttttgtcaatttatt

SEQ ID NO: 74153 - DNA, 25 bp, Homo sapien
gctggaaatgagtaggtactgctaa

SEQ ID NO: 74154 - DNA, 25 bp, Homo sapien
gctggaaatgagtgggtactgctaa

SEQ ID NO: 74155 - DNA, 25 bp, Homo sapien
gctggaacagcaatgcatgtggtgg

SEQ ID NO: 74156 - DNA, 25 bp, Homo sapien
gctggaacagcaatgcgtgtggtgg

SEQ ID NO: 74157 - DNA, 25 bp, Homo sapien
gctggaagcagtcaggaacataagc

SEQ ID NO: 74158 - DNA, 25 bp, Homo sapien
gctggaagcagtgaggaacataagc

SEQ ID NO: 74159 - DNA, 25 bp, Homo sapien
gctggaagctggccatttgggtgtg

SEQ ID NO: 74160 - DNA, 25 bp, Homo sapien
gctggaagctggctatttgggtgtg

SEQ ID NO: 74161 - DNA, 25 bp, Homo sapien
gctggaagttttataagaaatcaga

SEQ ID NO: 74162 - DNA, 25 bp, Homo sapien
gctggaagttttgtaagaaatcaga

SEQ ID NO: 74163 - DNA, 25 bp, Homo sapien
gctggaatacattggtccaaccatg

SEQ ID NO: 74164 - DNA, 25 bp, Homo sapien
gctggaatccattggtccaaccatg

SEQ ID NO: 74165 - DNA, 25 bp, Homo sapien
gctggacagacgatttccagggatc

SEQ ID NO: 74166 - DNA, 25 bp, Homo sapien
gctggacagactatttccagggatc

SEQ ID NO: 74167 - DNA, 25 bp, Homo sapien
gctggaccatgctaagcagacagtc

SEQ ID NO: 74168 - DNA, 25 bp, Homo sapien
gctggaccgtgctaagcagacagtc

SEQ ID NO: 74169 - DNA, 25 bp, Homo sapien
gctggagaagacacagggaggatga

SEQ ID NO: 74170 - DNA, 25 bp, Homo sapien
gctggagaagatacagggaggatga

SEQ ID NO: 74171 - DNA, 25 bp, Homo sapien
gctggagacatggtgaaataggcca

SEQ ID NO: 74172 - DNA, 25 bp, Homo sapien
gctggagacccgagaaagccagggt

SEQ ID NO: 74173 - DNA, 25 bp, Homo sapien
gctggagacgcgagaaagccagggt

SEQ ID NO: 74174 - DNA, 25 bp, Homo sapien
gctggagacgtggtgaaataggcca

SEQ ID NO: 74175 - DNA, 25 bp, Homo sapien
gctggagcctggaattcaaaagact

SEQ ID NO: 74176 - DNA, 25 bp, Homo sapien
gctggagcctggcattcaaaagact

SEQ ID NO: 74177 - DNA, 25 bp, Homo sapien
gctggagtgtaataagcaagagaga

SEQ ID NO: 74178 - DNA, 25 bp, Homo sapien
gctggagtgtaatgagcaagagaga

SEQ ID NO: 74179 - DNA, 25 bp, Homo sapien
gctggattccgcagtgccaaaccaa

SEQ ID NO: 74180 - DNA, 25 bp, Homo sapien
gctggattccgcggtgccaaaccaa

SEQ ID NO: 74181 - DNA, 25 bp, Homo sapien
gctggattctccacagcgttcatca

SEQ ID NO: 74182 - DNA, 25 bp, Homo sapien
gctggattctccacagtgttcatca

SEQ ID NO: 74183 - DNA, 25 bp, Homo sapien
gctggcaacagattgtgaacatgcc

SEQ ID NO: 74184 - DNA, 25 bp, Homo sapien
gctggcaacaggttgtgaacatgcc

SEQ ID NO: 74185 - DNA, 25 bp, Homo sapien
gctggcacattctcagcgtttaatg

SEQ ID NO: 74186 - DNA, 25 bp, Homo sapien
gctggcacattctcagtgtttaatg

SEQ ID NO: 74187 - DNA, 25 bp, Homo sapien
gctggccacttttactctgagcatg

SEQ ID NO: 74188 - DNA, 25 bp, Homo sapien
gctggccacttttactttgagcatg

SEQ ID NO: 74189 - DNA, 25 bp, Homo sapien
gctggccatgcatcaataacataat

SEQ ID NO: 74190 - DNA, 25 bp, Homo sapien
gctggccatgcgtcaataacataat

SEQ ID NO: 74191 - DNA, 25 bp, Homo sapien
gctggctcagttacgcactttaaat

SEQ ID NO: 74192 - DNA, 25 bp, Homo sapien
gctggctcagttactcactttaaat

SEQ ID NO: 74193 - DNA, 25 bp, Homo sapien
gctggctctccgtaattatctcttc

SEQ ID NO: 74194 - DNA, 25 bp, Homo sapien
gctggctctccgtagttatctcttc

SEQ ID NO: 74195 - DNA, 25 bp, Homo sapien
gctggctgcagttaacacaggaaaa

SEQ ID NO: 74196 - DNA, 25 bp, Homo sapien
gctggctgcagtttacacaggaaaa

SEQ ID NO: 74197 - DNA, 25 bp, Homo sapien
gctggctgctgggcgttctcctgga

SEQ ID NO: 74198 - DNA, 25 bp, Homo sapien
gctggctgctgggtgttctcctgga

SEQ ID NO: 74199 - DNA, 25 bp, Homo sapien
gctggctggtcacagtattaagatg

SEQ ID NO: 74200 - DNA, 25 bp, Homo sapien
gctggctggtcacagtgttaagatg

SEQ ID NO: 74201 - DNA, 25 bp, Homo sapien
gctggctgtctaaagatatgttgaa

SEQ ID NO: 74202 - DNA, 25 bp, Homo sapien
gctggctgtctacagatatgttgaa

SEQ ID NO: 74203 - DNA, 25 bp, Homo sapien
gctggcttgactactgtaactttgt

SEQ ID NO: 74204 - DNA, 25 bp, Homo sapien
gctggcttgactattgtaactttgt

SEQ ID NO: 74205 - DNA, 25 bp, Homo sapien
gctggcttttccatttgtcatccat

SEQ ID NO: 74206 - DNA, 25 bp, Homo sapien
gctggcttttccgtttgtcatccat

SEQ ID NO: 74207 - DNA, 25 bp, Homo sapien
gctgggaaagtgttgggaaaaagct

SEQ ID NO: 74208 - DNA, 25 bp, Homo sapien
gctgggaaccaaacactcctggcac

SEQ ID NO: 74209 - DNA, 25 bp, Homo sapien
gctgggaaccaaagactcctggcac

SEQ ID NO: 74210 - DNA, 25 bp, Homo sapien
gctgggaaggtgttgggaaaaagct

SEQ ID NO: 74211 - DNA, 25 bp, Homo sapien
gctgggacagttgtcactattcaca

SEQ ID NO: 74212 - DNA, 25 bp, Homo sapien
gctgggaccggtcatgtgtctgtgg

SEQ ID NO: 74213 - DNA, 25 bp, Homo sapien
gctgggacggttgtcactattcaca

SEQ ID NO: 74214 - DNA, 25 bp, Homo sapien
gctgggactggtcatgtgtctgtgg

SEQ ID NO: 74215 - DNA, 25 bp, Homo sapien
gctgggagtgccgcgaatcagtgta

SEQ ID NO: 74216 - DNA, 25 bp, Homo sapien
gctgggagtgctgcgaatcagtgta

SEQ ID NO: 74217 - DNA, 25 bp, Homo sapien
gctgggcaggactcctctttaagca

SEQ ID NO: 74218 - DNA, 25 bp, Homo sapien
gctgggcaggactcttctttaagca

SEQ ID NO: 74219 - DNA, 25 bp, Homo sapien
gctgggcataagacattgggagaaa

SEQ ID NO: 74220 - DNA, 25 bp, Homo sapien
gctgggcataagaccttgggagaaa

SEQ ID NO: 74221 - DNA, 25 bp, Homo sapien
gctgggctctttctgtttgtcatca

SEQ ID NO: 74222 - DNA, 25 bp, Homo sapien
gctgggctctttttgtttgtcatca

SEQ ID NO: 74223 - DNA, 25 bp, Homo sapien
gctgggctgatctgaatacaattgt

SEQ ID NO: 74224 - DNA, 25 bp, Homo sapien
gctgggctggtctgaatacaattgt

SEQ ID NO: 74225 - DNA, 25 bp, Homo sapien
gctggggaaaataagcacgtcctgt

SEQ ID NO: 74226 - DNA, 25 bp, Homo sapien
gctggggaaaataagcgcgtcctgt

SEQ ID NO: 74227 - DNA, 25 bp, Homo sapien
gctggggacacaagattatagatgt

SEQ ID NO: 74228 - DNA, 25 bp, Homo sapien
gctggggacacaatattatagatgt

SEQ ID NO: 74229 - DNA, 25 bp, Homo sapien
gctggggtgctcagaggacgcctgt

SEQ ID NO: 74230 - DNA, 25 bp, Homo sapien
gctggggtgttcagaggacgcctgt

SEQ ID NO: 74231 - DNA, 25 bp, Homo sapien
gctgggtatcgagaaccaaactttg

SEQ ID NO: 74232 - DNA, 25 bp, Homo sapien
gctgggtattacgaaagcttcaaaa

SEQ ID NO: 74233 - DNA, 25 bp, Homo sapien
gctgggtattatgaaagcttcaaaa

SEQ ID NO: 74234 - DNA, 25 bp, Homo sapien
gctgggtattgagaaccaaactttg

SEQ ID NO: 74235 - DNA, 25 bp, Homo sapien
gctgggtcactgggttgttattgcc

SEQ ID NO: 74236 - DNA, 25 bp, Homo sapien
gctgggtcactgtgttgttattgcc

SEQ ID NO: 74237 - DNA, 25 bp, Homo sapien
gctgggtttggtcacacgagttata

SEQ ID NO: 74238 - DNA, 25 bp, Homo sapien
gctgggtttggtcacatgagttata

SEQ ID NO: 74239 - DNA, 25 bp, Homo sapien
gctggtaggcctataacaagattca

SEQ ID NO: 74240 - DNA, 25 bp, Homo sapien
gctggtaggcctgtaacaagattca

SEQ ID NO: 74241 - DNA, 25 bp, Homo sapien
gctggtagtttaacatgcacgtatt

SEQ ID NO: 74242 - DNA, 25 bp, Homo sapien
gctggtagtttaacattcacgtatt

SEQ ID NO: 74243 - DNA, 25 bp, Homo sapien
gctggtatattctatcatttagaga

SEQ ID NO: 74244 - DNA, 25 bp, Homo sapien
gctggtatattctgtcatttagaga

SEQ ID NO: 74245 - DNA, 25 bp, Homo sapien
gctggtcacagtattaagatgtgca

SEQ ID NO: 74246 - DNA, 25 bp, Homo sapien
gctggtcacagtgttaagatgtgca

SEQ ID NO: 74247 - DNA, 25 bp, Homo sapien
gctggtcacccaggaaggatggata

SEQ ID NO: 74248 - DNA, 25 bp, Homo sapien
gctggtcacccgggaaggatggata

SEQ ID NO: 74249 - DNA, 25 bp, Homo sapien
gctggtccagccaatcagggataaa

SEQ ID NO: 74250 - DNA, 25 bp, Homo sapien
gctggtccagctaatcagggataaa

SEQ ID NO: 74251 - DNA, 25 bp, Homo sapien
gctggtcctttgacctaggattatc

SEQ ID NO: 74252 - DNA, 25 bp, Homo sapien
gctggtcctttgatctaggattatc

SEQ ID NO: 74253 - DNA, 25 bp, Homo sapien
gctggtgcactctgaaaacaagagt

SEQ ID NO: 74254 - DNA, 25 bp, Homo sapien
gctggtgcatatggtaagtgtggtt

SEQ ID NO: 74255 - DNA, 25 bp, Homo sapien
gctggtgcattctgaaaacaagagt

SEQ ID NO: 74256 - DNA, 25 bp, Homo sapien
gctggtgccgttcccatcgacagca

SEQ ID NO: 74257 - DNA, 25 bp, Homo sapien
gctggtgccgttcctatcgacagca

SEQ ID NO: 74258 - DNA, 25 bp, Homo sapien
gctggtgcgtatggtaagtgtggtt

SEQ ID NO: 74259 - DNA, 25 bp, Homo sapien
gctggtgctttaaagtgaggcttct

SEQ ID NO: 74260 - DNA, 25 bp, Homo sapien
gctggtgctttcaagtgaggcttct

SEQ ID NO: 74261 - DNA, 25 bp, Homo sapien
gctggtgtttttgggttagttttgc

SEQ ID NO: 74262 - DNA, 25 bp, Homo sapien
gctggtgttttttggttagttttgc

SEQ ID NO: 74263 - DNA, 25 bp, Homo sapien
gctggttatttttaatagagctcaa

SEQ ID NO: 74264 - DNA, 25 bp, Homo sapien
gctggttatttttagtagagctcaa

SEQ ID NO: 74265 - DNA, 25 bp, Homo sapien
gctggttctgatgctatactattgt

SEQ ID NO: 74266 - DNA, 25 bp, Homo sapien
gctggttctgatggtatactattgt

SEQ ID NO: 74267 - DNA, 25 bp, Homo sapien
gctggtttcttacttaaatactgct

SEQ ID NO: 74268 - DNA, 25 bp, Homo sapien
gctggttttgtactccaacatgctc

SEQ ID NO: 74269 - DNA, 25 bp, Homo sapien
gctggttttgtactcccacatgctc

SEQ ID NO: 74270 - DNA, 25 bp, Homo sapien
gctggttttttacttaaatactgct

SEQ ID NO: 74271 - DNA, 25 bp, Homo sapien
gctgtaaaacaaaagcatcaggtaa

SEQ ID NO: 74272 - DNA, 25 bp, Homo sapien
gctgtaaagcaaaagcatcaggtaa

SEQ ID NO: 74273 - DNA, 25 bp, Homo sapien
gctgtaaagcagaagtattaatttg

SEQ ID NO: 74274 - DNA, 25 bp, Homo sapien
gctgtaaagcagaattattaatttg

SEQ ID NO: 74275 - DNA, 25 bp, Homo sapien
gctgtaaataggagtcattaatctt

SEQ ID NO: 74276 - DNA, 25 bp, Homo sapien
gctgtaaatcggagtcattaatctt

SEQ ID NO: 74277 - DNA, 25 bp, Homo sapien
gctgtaatgaactatgaaaacattt

SEQ ID NO: 74278 - DNA, 25 bp, Homo sapien
gctgtaatgaactatggaaacattt

SEQ ID NO: 74279 - DNA, 25 bp, Homo sapien
gctgtacaagtcacctatgaaactg

SEQ ID NO: 74280 - DNA, 25 bp, Homo sapien
gctgtacaagtcatctatgaaactg

SEQ ID NO: 74281 - DNA, 25 bp, Homo sapien
gctgtacccagtcattagggaaaag

SEQ ID NO: 74282 - DNA, 25 bp, Homo sapien
gctgtacccagtcgttagggaaaag

SEQ ID NO: 74283 - DNA, 25 bp, Homo sapien
gctgtagacctctctgaatagtgtg

SEQ ID NO: 74284 - DNA, 25 bp, Homo sapien
gctgtagatctctctgaatagtgtg

SEQ ID NO: 74285 - DNA, 25 bp, Homo sapien
gctgtagccacacattccagaagga

SEQ ID NO: 74286 - DNA, 25 bp, Homo sapien
gctgtagccgcacattccagaagga

SEQ ID NO: 74287 - DNA, 25 bp, Homo sapien
gctgtaggctccatgaaagggcatc

SEQ ID NO: 74288 - DNA, 25 bp, Homo sapien
gctgtaggctccttgaaagggcatc

SEQ ID NO: 74289 - DNA, 25 bp, Homo sapien
gctgtaggtgcactgatacagaagc

SEQ ID NO: 74290 - DNA, 25 bp, Homo sapien
gctgtaggtgcattgatacagaagc

SEQ ID NO: 74291 - DNA, 25 bp, Homo sapien
gctgtagtggacatacctggttttt

SEQ ID NO: 74292 - DNA, 25 bp, Homo sapien
gctgtagtggatatacctggttttt

SEQ ID NO: 74293 - DNA, 25 bp, Homo sapien
gctgtagtggcattacccttctttt

SEQ ID NO: 74294 - DNA, 25 bp, Homo sapien
gctgtagtggcgttacccttctttt

SEQ ID NO: 74295 - DNA, 25 bp, Homo sapien
gctgtcaatggtcaacactcttagt

SEQ ID NO: 74296 - DNA, 25 bp, Homo sapien
gctgtcaattgtcaacactcttagt

SEQ ID NO: 74297 - DNA, 25 bp, Homo sapien
gctgtcacacgtgctgctagagtgg

SEQ ID NO: 74298 - DNA, 25 bp, Homo sapien
gctgtcacatgtgctgctagagtgg

SEQ ID NO: 74299 - DNA, 25 bp, Homo sapien
gctgtcacctggaacttccaaactc

SEQ ID NO: 74300 - DNA, 25 bp, Homo sapien
gctgtcacctggagcttccaaactc

SEQ ID NO: 74301 - DNA, 25 bp, Homo sapien
gctgtcactgtgcgggttatccatg

SEQ ID NO: 74302 - DNA, 25 bp, Homo sapien
gctgtcactgtgtgggttatccatg

SEQ ID NO: 74303 - DNA, 25 bp, Homo sapien
gctgtcagaccatgagaggaagcaa

SEQ ID NO: 74304 - DNA, 25 bp, Homo sapien
gctgtcaggccatgagaggaagcaa

SEQ ID NO: 74305 - DNA, 25 bp, Homo sapien
gctgtcatagaacgcagctgaagaa

SEQ ID NO: 74306 - DNA, 25 bp, Homo sapien
gctgtcatagaatgcagctgaagaa

SEQ ID NO: 74307 - DNA, 25 bp, Homo sapien
gctgtcatgtggcgttactgactgg

SEQ ID NO: 74308 - DNA, 25 bp, Homo sapien
gctgtcatgtggtgttactgactgg

SEQ ID NO: 74309 - DNA, 25 bp, Homo sapien
gctgtcattctcgtacgcctctcta

SEQ ID NO: 74310 - DNA, 25 bp, Homo sapien
gctgtcattctcgtgcgcctctcta

SEQ ID NO: 74311 - DNA, 25 bp, Homo sapien
gctgtccacatcaaagacgccatct

SEQ ID NO: 74312 - DNA, 25 bp, Homo sapien
gctgtccacatcaaggacgccatct

SEQ ID NO: 74313 - DNA, 25 bp, Homo sapien
gctgtcctgtgtatggtgggctcca

SEQ ID NO: 74314 - DNA, 25 bp, Homo sapien
gctgtcctgtgtgtggtgggctcca

SEQ ID NO: 74315 - DNA, 25 bp, Homo sapien
gctgtccttccacggatacctgaag

SEQ ID NO: 74316 - DNA, 25 bp, Homo sapien
gctgtccttccatggatacctgaag

SEQ ID NO: 74317 - DNA, 25 bp, Homo sapien
gctgtctaaaatccttttcatgtca

SEQ ID NO: 74318 - DNA, 25 bp, Homo sapien
gctgtctaagatccttttcatgtca

SEQ ID NO: 74319 - DNA, 25 bp, Homo sapien
gctgtctatatccgataggctacag

SEQ ID NO: 74320 - DNA, 25 bp, Homo sapien
gctgtctatatctgataggctacag

SEQ ID NO: 74321 - DNA, 25 bp, Homo sapien
gctgtctattggaagaagatgcctt

SEQ ID NO: 74322 - DNA, 25 bp, Homo sapien
gctgtctattggcagaagatgcctt

SEQ ID NO: 74323 - DNA, 25 bp, Homo sapien
gctgtctctactatgtacatggagc

SEQ ID NO: 74324 - DNA, 25 bp, Homo sapien
gctgtctctactctgtacatggagc

SEQ ID NO: 74325 - DNA, 25 bp, Homo sapien
gctgtctgatgttccttgcagccct

SEQ ID NO: 74326 - DNA, 25 bp, Homo sapien
gctgtctgatgtttcttgcagccct

SEQ ID NO: 74327 - DNA, 25 bp, Homo sapien
gctgtctttcgcctggaattagcag

SEQ ID NO: 74328 - DNA, 25 bp, Homo sapien
gctgtctttcgcctgggattagcag

SEQ ID NO: 74329 - DNA, 25 bp, Homo sapien
gctgtgaacagatggataaggtctc

SEQ ID NO: 74330 - DNA, 25 bp, Homo sapien
gctgtgaacaggtggataaggtctc

SEQ ID NO: 74331 - DNA, 25 bp, Homo sapien
gctgtgacatgggaagggccctgtc

SEQ ID NO: 74332 - DNA, 25 bp, Homo sapien
gctgtgacgtgggaagggccctgtc

SEQ ID NO: 74333 - DNA, 25 bp, Homo sapien
gctgtgactttcgctgattcaagtt

SEQ ID NO: 74334 - DNA, 25 bp, Homo sapien
gctgtgacttttgctgattcaagtt

SEQ ID NO: 74335 - DNA, 25 bp, Homo sapien
gctgtgagcgtctcactttcctttt

SEQ ID NO: 74336 - DNA, 25 bp, Homo sapien
gctgtgagcgtctcgctttcctttt

SEQ ID NO: 74337 - DNA, 25 bp, Homo sapien
gctgtgcacattactccagaactgt

SEQ ID NO: 74338 - DNA, 25 bp, Homo sapien
gctgtgcacattattccagaactgt

SEQ ID NO: 74339 - DNA, 25 bp, Homo sapien
gctgtgcccagatccgagccagaga

SEQ ID NO: 74340 - DNA, 25 bp, Homo sapien
gctgtgcccaggtccgagccagaga

SEQ ID NO: 74341 - DNA, 25 bp, Homo sapien
gctgtgcccatcaaactaccaatta

SEQ ID NO: 74342 - DNA, 25 bp, Homo sapien
gctgtgcccatcgaactaccaatta

SEQ ID NO: 74343 - DNA, 25 bp, Homo sapien
gctgtgcctttcagattgcaaaacc

SEQ ID NO: 74344 - DNA, 25 bp, Homo sapien
gctgtgcctttctgattgcaaaacc

SEQ ID NO: 74345 - DNA, 25 bp, Homo sapien
gctgtgctgcagcggtgtgtgtgtc

SEQ ID NO: 74346 - DNA, 25 bp, Homo sapien
gctgtgctgcagtggtgtgtgtgtc

SEQ ID NO: 74347 - DNA, 25 bp, Homo sapien
gctgtgcttcttgttgggcttaatg

SEQ ID NO: 74348 - DNA, 25 bp, Homo sapien
gctgtgcttctttttgggcttaatg

SEQ ID NO: 74349 - DNA, 25 bp, Homo sapien
gctgtggacattccttgcactgctt

SEQ ID NO: 74350 - DNA, 25 bp, Homo sapien
gctgtggactttccttgcactgctt

SEQ ID NO: 74351 - DNA, 25 bp, Homo sapien
gctgtggctgatgaatagactagct

SEQ ID NO: 74352 - DNA, 25 bp, Homo sapien
gctgtggctgatgaatggactagct

SEQ ID NO: 74353 - DNA, 25 bp, Homo sapien
gctgtgggaaacatgccatgccctc

SEQ ID NO: 74354 - DNA, 25 bp, Homo sapien
gctgtgggaaacgtgccatgccctc

SEQ ID NO: 74355 - DNA, 25 bp, Homo sapien
gctgtgggacaaatcacaagactgg

SEQ ID NO: 74356 - DNA, 25 bp, Homo sapien
gctgtgggacagatcacaagactgg

SEQ ID NO: 74357 - DNA, 25 bp, Homo sapien
gctgtgggatctaacaatgaacagt

SEQ ID NO: 74358 - DNA, 25 bp, Homo sapien
gctgtgggatgtcactttttaatat

SEQ ID NO: 74359 - DNA, 25 bp, Homo sapien
gctgtgggttctaacaatgaacagt

SEQ ID NO: 74360 - DNA, 25 bp, Homo sapien
gctgtgggttgtcactttttaatat

SEQ ID NO: 74361 - DNA, 25 bp, Homo sapien
gctgtggttccatatcaagatattt

SEQ ID NO: 74362 - DNA, 25 bp, Homo sapien
gctgtggttccatatcgagatattt

SEQ ID NO: 74363 - DNA, 25 bp, Homo sapien
gctgtgtaatcgattgtgaagaaga

SEQ ID NO: 74364 - DNA, 25 bp, Homo sapien
gctgtgtaatctattgtgaagaaga

SEQ ID NO: 74365 - DNA, 25 bp, Homo sapien
gctgtgtagcgcttcccgctttgtt

SEQ ID NO: 74366 - DNA, 25 bp, Homo sapien
gctgtgtagcgcttcctgctttgtt

SEQ ID NO: 74367 - DNA, 25 bp, Homo sapien
gctgtgttcttctcgagtagactga

SEQ ID NO: 74368 - DNA, 25 bp, Homo sapien
gctgtgtttttctcgagtagactga

SEQ ID NO: 74369 - DNA, 25 bp, Homo sapien
gctgttaaaaaaattcacattcata

SEQ ID NO: 74370 - DNA, 25 bp, Homo sapien
gctgttaaaaaatttcacattcata

SEQ ID NO: 74371 - DNA, 25 bp, Homo sapien
gctgttaaaaatcacccaattgtga

SEQ ID NO: 74372 - DNA, 25 bp, Homo sapien
gctgttaaaaattacccaattgtga

SEQ ID NO: 74373 - DNA, 25 bp, Homo sapien
gctgttaaaatggctgagtatatac

SEQ ID NO: 74374 - DNA, 25 bp, Homo sapien
gctgttaaacatcctatgaagcaca

SEQ ID NO: 74375 - DNA, 25 bp, Homo sapien
gctgttaaacatgctatgaagcaca

SEQ ID NO: 74376 - DNA, 25 bp, Homo sapien
gctgttaaagtggctgagtatatac

SEQ ID NO: 74377 - DNA, 25 bp, Homo sapien
gctgttaccagaagaaagttatgta

SEQ ID NO: 74378 - DNA, 25 bp, Homo sapien
gctgttaccagaaggaagttatgta

SEQ ID NO: 74379 - DNA, 25 bp, Homo sapien
gctgttcagtgatggctgagtgctg

SEQ ID NO: 74380 - DNA, 25 bp, Homo sapien
gctgttcagtgatgtctgagtgctg

SEQ ID NO: 74381 - DNA, 25 bp, Homo sapien
gctgttcctatgaagccatgttgga

SEQ ID NO: 74382 - DNA, 25 bp, Homo sapien
gctgttcctattaagccatgttgga

SEQ ID NO: 74383 - DNA, 25 bp, Homo sapien
gctgttcctctaccatttttatggc

SEQ ID NO: 74384 - DNA, 25 bp, Homo sapien
gctgttcctctacgatttttatggc

SEQ ID NO: 74385 - DNA, 25 bp, Homo sapien
gctgttcctttgcttggctacgtcc

SEQ ID NO: 74386 - DNA, 25 bp, Homo sapien
gctgttcctttgtttggctacgtcc

SEQ ID NO: 74387 - DNA, 25 bp, Homo sapien
gctgttgaatctgagtccccactgg

SEQ ID NO: 74388 - DNA, 25 bp, Homo sapien
gctgttgactctgagtccccactgg

SEQ ID NO: 74389 - DNA, 25 bp, Homo sapien
gctgttggaccagcacagggcttct

SEQ ID NO: 74390 - DNA, 25 bp, Homo sapien
gctgttggaccagcgcagggcttct

SEQ ID NO: 74391 - DNA, 25 bp, Homo sapien
gctgtttcactgtcagacaagtaaa

SEQ ID NO: 74392 - DNA, 25 bp, Homo sapien
gctgtttcatttatagagcagagaa

SEQ ID NO: 74393 - DNA, 25 bp, Homo sapien
gctgtttccccaggtcatttgggtt

SEQ ID NO: 74394 - DNA, 25 bp, Homo sapien
gctgtttccccaggtcgtttgggtt

SEQ ID NO: 74395 - DNA, 25 bp, Homo sapien
gctgtttcctttatagagcagagaa

SEQ ID NO: 74396 - DNA, 25 bp, Homo sapien
gctgtttcgctgtcagacaagtaaa

SEQ ID NO: 74397 - DNA, 25 bp, Homo sapien
gctgtttctcaatgattctcacaac

SEQ ID NO: 74398 - DNA, 25 bp, Homo sapien
gctgtttctcattgattctcacaac

SEQ ID NO: 74399 - DNA, 25 bp, Homo sapien
gctgtttctcctagacatcatggtt

SEQ ID NO: 74400 - DNA, 25 bp, Homo sapien
gctgtttctcctaggcatcatggtt

SEQ ID NO: 74401 - DNA, 25 bp, Homo sapien
gctgtttgacgctcaatggatccag

SEQ ID NO: 74402 - DNA, 25 bp, Homo sapien
gctgtttgatgctcaatggatccag

SEQ ID NO: 74403 - DNA, 25 bp, Homo sapien
gctgtttgatttatatgaaagtggt

SEQ ID NO: 74404 - DNA, 25 bp, Homo sapien
gctgtttgatttggcgatgacaatg

SEQ ID NO: 74405 - DNA, 25 bp, Homo sapien
gctgtttgatttggtgatgacaatg

SEQ ID NO: 74406 - DNA, 25 bp, Homo sapien
gctgtttgggatacactgtgcttcc

SEQ ID NO: 74407 - DNA, 25 bp, Homo sapien
gctgtttgggatacgctgtgcttcc

SEQ ID NO: 74408 - DNA, 25 bp, Homo sapien
gctgtttgggtggttcaaccaaggt

SEQ ID NO: 74409 - DNA, 25 bp, Homo sapien
gctgtttgggttgttcaaccaaggt

SEQ ID NO: 74410 - DNA, 25 bp, Homo sapien
gctgtttgtaggcatcgtacgaaaa

SEQ ID NO: 74411 - DNA, 25 bp, Homo sapien
gctgtttgtcggcatcgtacgaaaa

SEQ ID NO: 74412 - DNA, 25 bp, Homo sapien
gctgtttgttttatatgaaagtggt

SEQ ID NO: 74413 - DNA, 25 bp, Homo sapien
gctgttttcttattgacgctcaaaa

SEQ ID NO: 74414 - DNA, 25 bp, Homo sapien
gctgttttcttattgaggctcaaaa

SEQ ID NO: 74415 - DNA, 25 bp, Homo sapien
gcttaaacattagctactctacctc

SEQ ID NO: 74416 - DNA, 25 bp, Homo sapien
gcttaaacgttagctactctacctc

SEQ ID NO: 74417 - DNA, 25 bp, Homo sapien
gcttaaagaatataaaatcatgtct

SEQ ID NO: 74418 - DNA, 25 bp, Homo sapien
gcttaaagactataaaatcatgtct

SEQ ID NO: 74419 - DNA, 25 bp, Homo sapien
gcttaaaggagtcaaaacattgatc

SEQ ID NO: 74420 - DNA, 25 bp, Homo sapien
gcttaaaggagttaaaacattgatc

SEQ ID NO: 74421 - DNA, 25 bp, Homo sapien
gcttaaaggtctcatccgtattttc

SEQ ID NO: 74422 - DNA, 25 bp, Homo sapien
gcttaaaggtctcgtccgtattttc

SEQ ID NO: 74423 - DNA, 25 bp, Homo sapien
gcttaaataccacttccagaaagag

SEQ ID NO: 74424 - DNA, 25 bp, Homo sapien
gcttaaatgatgcgggctcatgagg

SEQ ID NO: 74425 - DNA, 25 bp, Homo sapien
gcttaaatggtgcgggctcatgagg

SEQ ID NO: 74426 - DNA, 25 bp, Homo sapien
gcttaaattccacttccagaaagag

SEQ ID NO: 74427 - DNA, 25 bp, Homo sapien
gcttaactgtacgccaggagaaaaa

SEQ ID NO: 74428 - DNA, 25 bp, Homo sapien
gcttaactgtatgccaggagaaaaa

SEQ ID NO: 74429 - DNA, 25 bp, Homo sapien
gcttaagaaagcgatctcaggaagc

SEQ ID NO: 74430 - DNA, 25 bp, Homo sapien
gcttaagaaagtgatctcaggaagc

SEQ ID NO: 74431 - DNA, 25 bp, Homo sapien
gcttaagcatatatatgactcccaa

SEQ ID NO: 74432 - DNA, 25 bp, Homo sapien
gcttaagcgtatatatgactcccaa

SEQ ID NO: 74433 - DNA, 25 bp, Homo sapien
gcttaagctgcatccgagagattct

SEQ ID NO: 74434 - DNA, 25 bp, Homo sapien
gcttaagctgcatctgagagattct

SEQ ID NO: 74435 - DNA, 25 bp, Homo sapien
gcttaaggcattcttaaatcacaaa

SEQ ID NO: 74436 - DNA, 25 bp, Homo sapien
gcttaaggcattcttacatcacaaa

SEQ ID NO: 74437 - DNA, 25 bp, Homo sapien
gcttaataaaacaattgcactttgc

SEQ ID NO: 74438 - DNA, 25 bp, Homo sapien
gcttaataaaacgattgcactttgc

SEQ ID NO: 74439 - DNA, 25 bp, Homo sapien
gcttaatagccaatgtgacagtatt

SEQ ID NO: 74440 - DNA, 25 bp, Homo sapien
gcttaatagccagtgtgacagtatt

SEQ ID NO: 74441 - DNA, 25 bp, Homo sapien
gcttaatcaattctgcttttaaaag

SEQ ID NO: 74442 - DNA, 25 bp, Homo sapien
gcttaatcagttctgcttttaaaag

SEQ ID NO: 74443 - DNA, 25 bp, Homo sapien
gcttaatccgtttgggctactacaa

SEQ ID NO: 74444 - DNA, 25 bp, Homo sapien
gcttaatctgtttgggctactacaa

SEQ ID NO: 74445 - DNA, 25 bp, Homo sapien
gcttaatgatccatatactgtcacg

SEQ ID NO: 74446 - DNA, 25 bp, Homo sapien
gcttaatgatccatgtactgtcacg

SEQ ID NO: 74447 - DNA, 25 bp, Homo sapien
gcttaattagccaggtgtcctgcag

SEQ ID NO: 74448 - DNA, 25 bp, Homo sapien
gcttaattagcgaggtgtcctgcag

SEQ ID NO: 74449 - DNA, 25 bp, Homo sapien
gcttacaacagtaaaagtcctgact

SEQ ID NO: 74450 - DNA, 25 bp, Homo sapien
gcttacaatagtaaaagtcctgact

SEQ ID NO: 74451 - DNA, 25 bp, Homo sapien
gcttacatttatcaatcacctgcaa

SEQ ID NO: 74452 - DNA, 25 bp, Homo sapien
gcttacatttatcaattacctgcaa

SEQ ID NO: 74453 - DNA, 25 bp, Homo sapien
gcttaccaatgacggtcttctatga

SEQ ID NO: 74454 - DNA, 25 bp, Homo sapien
gcttaccagtgacggtcttctatga

SEQ ID NO: 74455 - DNA, 25 bp, Homo sapien
gcttaccgcggtcgtttttagatcc

SEQ ID NO: 74456 - DNA, 25 bp, Homo sapien
gcttaccgcggtggtttttagatcc

SEQ ID NO: 74457 - DNA, 25 bp, Homo sapien
gcttacctgactctttgaaggcata

SEQ ID NO: 74458 - DNA, 25 bp, Homo sapien
gcttacctgcttaggcacctgcgca

SEQ ID NO: 74459 - DNA, 25 bp, Homo sapien
gcttacctggctctttgaaggcata

SEQ ID NO: 74460 - DNA, 25 bp, Homo sapien
gcttacctggttaggcacctgcgca

SEQ ID NO: 74461 - DNA, 25 bp, Homo sapien
gcttacgtgttcatcccagtgtcct

SEQ ID NO: 74462 - DNA, 25 bp, Homo sapien
gcttacgtgttgatcccagtgtcct

SEQ ID NO: 74463 - DNA, 25 bp, Homo sapien
gcttacgtttatccaaaagcatctc

SEQ ID NO: 74464 - DNA, 25 bp, Homo sapien
gcttacgtttattcaaaagcatctc

SEQ ID NO: 74465 - DNA, 25 bp, Homo sapien
gcttactcttcctcgagtcagtgca

SEQ ID NO: 74466 - DNA, 25 bp, Homo sapien
gcttactcttccttgagtcagtgca

SEQ ID NO: 74467 - DNA, 25 bp, Homo sapien
gcttactctttcattttactgaaat

SEQ ID NO: 74468 - DNA, 25 bp, Homo sapien
gcttactctttccttttactgaaat

SEQ ID NO: 74469 - DNA, 25 bp, Homo sapien
gcttagaaacctgagaactgcaggg

SEQ ID NO: 74470 - DNA, 25 bp, Homo sapien
gcttagaatcctgagaactgcaggg

SEQ ID NO: 74471 - DNA, 25 bp, Homo sapien
gcttagagcagatcaaacaacacca

SEQ ID NO: 74472 - DNA, 25 bp, Homo sapien
gcttagagcagatcaagcaacacca

SEQ ID NO: 74473 - DNA, 25 bp, Homo sapien
gcttagatttactacaaattatagt

SEQ ID NO: 74474 - DNA, 25 bp, Homo sapien
gcttagatttattacaaattatagt

SEQ ID NO: 74475 - DNA, 25 bp, Homo sapien
gcttagatttccgcttcaggatgaa

SEQ ID NO: 74476 - DNA, 25 bp, Homo sapien
gcttagatttctgcttcaggatgaa

SEQ ID NO: 74477 - DNA, 25 bp, Homo sapien
gcttagcactaggatgcaagttgca

SEQ ID NO: 74478 - DNA, 25 bp, Homo sapien
gcttagcactaggatgtaagttgca

SEQ ID NO: 74479 - DNA, 25 bp, Homo sapien
gcttagcccatgcacacagcatctt

SEQ ID NO: 74480 - DNA, 25 bp, Homo sapien
gcttagcccgtgcacacagcatctt

SEQ ID NO: 74481 - DNA, 25 bp, Homo sapien
gcttagctgcttggaaagtcagtca

SEQ ID NO: 74482 - DNA, 25 bp, Homo sapien
gcttagctgcttgggaagtcagtca

SEQ ID NO: 74483 - DNA, 25 bp, Homo sapien
gcttaggagaaaaggcaaatttatt

SEQ ID NO: 74484 - DNA, 25 bp, Homo sapien
gcttaggagaaagggcaaatttatt

SEQ ID NO: 74485 - DNA, 25 bp, Homo sapien
gcttaggatggtcttgcttgccaag

SEQ ID NO: 74486 - DNA, 25 bp, Homo sapien
gcttaggatggttttgcttgccaag

SEQ ID NO: 74487 - DNA, 25 bp, Homo sapien
gcttagggacttagaatgctttagc

SEQ ID NO: 74488 - DNA, 25 bp, Homo sapien
gcttagggatttacgaggattatct

SEQ ID NO: 74489 - DNA, 25 bp, Homo sapien
gcttagggatttagaatgctttagc

SEQ ID NO: 74490 - DNA, 25 bp, Homo sapien
gcttagggatttatgaggattatct

SEQ ID NO: 74491 - DNA, 25 bp, Homo sapien
gcttaggtaggaaacctgccgggca

SEQ ID NO: 74492 - DNA, 25 bp, Homo sapien
gcttaggtaggaaatctgccgggca

SEQ ID NO: 74493 - DNA, 25 bp, Homo sapien
gcttagtcatcattagtgcatttca

SEQ ID NO: 74494 - DNA, 25 bp, Homo sapien
gcttagtcccagcatataacaatta

SEQ ID NO: 74495 - DNA, 25 bp, Homo sapien
gcttagtcccagcgtataacaatta

SEQ ID NO: 74496 - DNA, 25 bp, Homo sapien
gcttagtcctcattagtgcatttca

SEQ ID NO: 74497 - DNA, 25 bp, Homo sapien
gcttagtctgcatcataaacccaaa

SEQ ID NO: 74498 - DNA, 25 bp, Homo sapien
gcttagtctgcatcatgaacccaaa

SEQ ID NO: 74499 - DNA, 25 bp, Homo sapien
gcttagtgaaggtgatttcctttac

SEQ ID NO: 74500 - DNA, 25 bp, Homo sapien
gcttagtgatatatttccacctctg

SEQ ID NO: 74501 - DNA, 25 bp, Homo sapien
gcttagtgatatctttccacctctg

SEQ ID NO: 74502 - DNA, 25 bp, Homo sapien
gcttagtgatggtgatttcctttac

SEQ ID NO: 74503 - DNA, 25 bp, Homo sapien
gcttagttttaactccacagaattg

SEQ ID NO: 74504 - DNA, 25 bp, Homo sapien
gcttagttttatctccacagaattg

SEQ ID NO: 74505 - DNA, 25 bp, Homo sapien
gcttatactatgactgaatgtagtt

SEQ ID NO: 74506 - DNA, 25 bp, Homo sapien
gcttatactgtgactgaatgtagtt

SEQ ID NO: 74507 - DNA, 25 bp, Homo sapien
gcttatatacaagtaggcatgtcga

SEQ ID NO: 74508 - DNA, 25 bp, Homo sapien
gcttatatacatgtaggcatgtcga

SEQ ID NO: 74509 - DNA, 25 bp, Homo sapien
gcttatatcccaatggccagaaatg

SEQ ID NO: 74510 - DNA, 25 bp, Homo sapien
gcttatatcccattggccagaaatg

SEQ ID NO: 74511 - DNA, 25 bp, Homo sapien
gcttatatttcagtagtcaggtatg

SEQ ID NO: 74512 - DNA, 25 bp, Homo sapien
gcttatatttcattagtcaggtatg

SEQ ID NO: 74513 - DNA, 25 bp, Homo sapien
gcttatgaaagaccccattcaatat

SEQ ID NO: 74514 - DNA, 25 bp, Homo sapien
gcttatgaaagaccccgttcaatat

SEQ ID NO: 74515 - DNA, 25 bp, Homo sapien
gcttatgactttgggttccttatta

SEQ ID NO: 74516 - DNA, 25 bp, Homo sapien
gcttatgactttgtgttccttatta

SEQ ID NO: 74517 - DNA, 25 bp, Homo sapien
gcttatgcatcactcatctaaaagg

SEQ ID NO: 74518 - DNA, 25 bp, Homo sapien
gcttatgcatcattcatctaaaagg

SEQ ID NO: 74519 - DNA, 25 bp, Homo sapien
gcttatgcatggagagagatggaga

SEQ ID NO: 74520 - DNA, 25 bp, Homo sapien
gcttatgctcgaattgatttgttct

SEQ ID NO: 74521 - DNA, 25 bp, Homo sapien
gcttatgcttgaattgatttgttct

SEQ ID NO: 74522 - DNA, 25 bp, Homo sapien
gcttatgcttggagagagatggaga

SEQ ID NO: 74523 - DNA, 25 bp, Homo sapien
gcttatggaaaatgatcgtttaaat

SEQ ID NO: 74524 - DNA, 25 bp, Homo sapien
gcttatggaaaatgattgtttaaat

SEQ ID NO: 74525 - DNA, 25 bp, Homo sapien
gcttatggccacatcattcccgtct

SEQ ID NO: 74526 - DNA, 25 bp, Homo sapien
gcttatggtcacatcattcccgtct

SEQ ID NO: 74527 - DNA, 25 bp, Homo sapien
gcttatgtgacctatgagacagcat

SEQ ID NO: 74528 - DNA, 25 bp, Homo sapien
gcttatgtgacttatgagacagcat

SEQ ID NO: 74529 - DNA, 25 bp, Homo sapien
gcttatgtgtcttcgtctttaacat

SEQ ID NO: 74530 - DNA, 25 bp, Homo sapien
gcttatgtgtctttgtctttaacat

SEQ ID NO: 74531 - DNA, 25 bp, Homo sapien
gcttattgtaaattctaaagagaag

SEQ ID NO: 74532 - DNA, 25 bp, Homo sapien
gcttattgttaattctaaagagaag

SEQ ID NO: 74533 - DNA, 25 bp, Homo sapien
gcttatttcctcatctgttttggta

SEQ ID NO: 74534 - DNA, 25 bp, Homo sapien
gcttatttcctcttctgttttggta

SEQ ID NO: 74535 - DNA, 25 bp, Homo sapien
gcttatttctaaactccttatctgc

SEQ ID NO: 74536 - DNA, 25 bp, Homo sapien
gcttattttattggccatctctctg

SEQ ID NO: 74537 - DNA, 25 bp, Homo sapien
gcttattttattggccgtctctctg

SEQ ID NO: 74538 - DNA, 25 bp, Homo sapien
gcttattttctaacgtcataatcag

SEQ ID NO: 74539 - DNA, 25 bp, Homo sapien
gcttattttgtaacgtcataatcag

SEQ ID NO: 74540 - DNA, 25 bp, Homo sapien
gcttatttttaaactccttatctgc

SEQ ID NO: 74541 - DNA, 25 bp, Homo sapien
gcttatttttccgctcataatgtta

SEQ ID NO: 74542 - DNA, 25 bp, Homo sapien
gcttatttttctgctcataatgtta

SEQ ID NO: 74543 - DNA, 25 bp, Homo sapien
gcttcaaataaaatataatctgtgt

SEQ ID NO: 74544 - DNA, 25 bp, Homo sapien
gcttcaaataaaatatgatctgtgt

SEQ ID NO: 74545 - DNA, 25 bp, Homo sapien
gcttcaaatgacaatagtttacctt

SEQ ID NO: 74546 - DNA, 25 bp, Homo sapien
gcttcaaatgacgatagtttacctt

SEQ ID NO: 74547 - DNA, 25 bp, Homo sapien
gcttcaattcgacggttagttattc

SEQ ID NO: 74548 - DNA, 25 bp, Homo sapien
gcttcaattcgatggttagttattc

SEQ ID NO: 74549 - DNA, 25 bp, Homo sapien
gcttcacaactttctccgactctga

SEQ ID NO: 74550 - DNA, 25 bp, Homo sapien
gcttcacactagttattggactatc

SEQ ID NO: 74551 - DNA, 25 bp, Homo sapien
gcttcacactatttattggactatc

SEQ ID NO: 74552 - DNA, 25 bp, Homo sapien
gcttcacagctaattgacagaatta

SEQ ID NO: 74553 - DNA, 25 bp, Homo sapien
gcttcacagttaattgacagaatta

SEQ ID NO: 74554 - DNA, 25 bp, Homo sapien
gcttcacatctttctccgactctga

SEQ ID NO: 74555 - DNA, 25 bp, Homo sapien
gcttcaccacatcttgacaacatta

SEQ ID NO: 74556 - DNA, 25 bp, Homo sapien
gcttcaccatatcttgacaacatta

SEQ ID NO: 74557 - DNA, 25 bp, Homo sapien
gcttcaccatcaattaatgttgtgg

SEQ ID NO: 74558 - DNA, 25 bp, Homo sapien
gcttcaccgtcaattaatgttgtgg

SEQ ID NO: 74559 - DNA, 25 bp, Homo sapien
gcttcaccttccgagaaatgctcgc

SEQ ID NO: 74560 - DNA, 25 bp, Homo sapien
gcttcaccttctgagaaatgctcgc

SEQ ID NO: 74561 - DNA, 25 bp, Homo sapien
gcttcactccaatttctacctccat

SEQ ID NO: 74562 - DNA, 25 bp, Homo sapien
gcttcactccagtttctacctccat

SEQ ID NO: 74563 - DNA, 25 bp, Homo sapien
gcttcactgataaacagactcacct

SEQ ID NO: 74564 - DNA, 25 bp, Homo sapien
gcttcactgataaatagactcacct

SEQ ID NO: 74565 - DNA, 25 bp, Homo sapien
gcttcactttcttaccatacacgac

SEQ ID NO: 74566 - DNA, 25 bp, Homo sapien
gcttcactttcttaccgtacacgac

SEQ ID NO: 74567 - DNA, 25 bp, Homo sapien
gcttcagaaaggacccaatgtctct

SEQ ID NO: 74568 - DNA, 25 bp, Homo sapien
gcttcagaaaggatccaatgtctct

SEQ ID NO: 74569 - DNA, 25 bp, Homo sapien
gcttcagcataagatcccacagctt

SEQ ID NO: 74570 - DNA, 25 bp, Homo sapien
gcttcagcgtaagatcccacagctt

SEQ ID NO: 74571 - DNA, 25 bp, Homo sapien
gcttcatacagctctagttaaaata

SEQ ID NO: 74572 - DNA, 25 bp, Homo sapien
gcttcatataaacaagtgaggcact

SEQ ID NO: 74573 - DNA, 25 bp, Homo sapien
gcttcatatagctctagttaaaata

SEQ ID NO: 74574 - DNA, 25 bp, Homo sapien
gcttcatatcaacaagtgaggcact

SEQ ID NO: 74575 - DNA, 25 bp, Homo sapien
gcttcatatgccggaaattaagagt

SEQ ID NO: 74576 - DNA, 25 bp, Homo sapien
gcttcatatgctggaaattaagagt

SEQ ID NO: 74577 - DNA, 25 bp, Homo sapien
gcttcatgatctaatacaaatgcac

SEQ ID NO: 74578 - DNA, 25 bp, Homo sapien
gcttcatgatctcatacaaatgcac

SEQ ID NO: 74579 - DNA, 25 bp, Homo sapien
gcttcattctctcagaaaacactgt

SEQ ID NO: 74580 - DNA, 25 bp, Homo sapien
gcttcattctctcagagaacactgt

SEQ ID NO: 74581 - DNA, 25 bp, Homo sapien
gcttcattttacttatgtaaggaat

SEQ ID NO: 74582 - DNA, 25 bp, Homo sapien
gcttcattttacttctgtaaggaat

SEQ ID NO: 74583 - DNA, 25 bp, Homo sapien
gcttccaagctaagaccatgtgcgc

SEQ ID NO: 74584 - DNA, 25 bp, Homo sapien
gcttccaagctaagtccatgtgcgc

SEQ ID NO: 74585 - DNA, 25 bp, Homo sapien
gcttccaatatctctagtacatgat

SEQ ID NO: 74586 - DNA, 25 bp, Homo sapien
gcttccaatatttctagtacatgat

SEQ ID NO: 74587 - DNA, 25 bp, Homo sapien
gcttccactcaacaaggctgacttg

SEQ ID NO: 74588 - DNA, 25 bp, Homo sapien
gcttccactcaccaaggctgacttg

SEQ ID NO: 74589 - DNA, 25 bp, Homo sapien
gcttccatgtgcagaatagattgaa

SEQ ID NO: 74590 - DNA, 25 bp, Homo sapien
gcttccatgtggagaatagattgaa

SEQ ID NO: 74591 - DNA, 25 bp, Homo sapien
gcttcccaaaaatgcatacaacatg

SEQ ID NO: 74592 - DNA, 25 bp, Homo sapien
gcttcccaaaaattcatacaacatg

SEQ ID NO: 74593 - DNA, 25 bp, Homo sapien
gcttcccactaaccaaagattattt

SEQ ID NO: 74594 - DNA, 25 bp, Homo sapien
gcttcccactaaccgaagattattt

SEQ ID NO: 74595 - DNA, 25 bp, Homo sapien
gcttccccaatcactgataactgct

SEQ ID NO: 74596 - DNA, 25 bp, Homo sapien
gcttccccagtcactgataactgct

SEQ ID NO: 74597 - DNA, 25 bp, Homo sapien
gcttccctttttcgtcagattaatt

SEQ ID NO: 74598 - DNA, 25 bp, Homo sapien
gcttccctttttcttcagattaatt

SEQ ID NO: 74599 - DNA, 25 bp, Homo sapien
gcttccggaggtagacaggccacta

SEQ ID NO: 74600 - DNA, 25 bp, Homo sapien
gcttccggaggtagacgggccacta

SEQ ID NO: 74601 - DNA, 25 bp, Homo sapien
gcttccgtgccctcctgtttttgat

SEQ ID NO: 74602 - DNA, 25 bp, Homo sapien
gcttccgtgccttcctgtttttgat

SEQ ID NO: 74603 - DNA, 25 bp, Homo sapien
gcttcctaaatatgctctgtaaaac

SEQ ID NO: 74604 - DNA, 25 bp, Homo sapien
gcttcctaaatgtgctctgtaaaac

SEQ ID NO: 74605 - DNA, 25 bp, Homo sapien
gcttcctaagcaagactatctactg

SEQ ID NO: 74606 - DNA, 25 bp, Homo sapien
gcttcctaagcacgactatctactg

SEQ ID NO: 74607 - DNA, 25 bp, Homo sapien
gcttcctagaaaggatatatgaatg

SEQ ID NO: 74608 - DNA, 25 bp, Homo sapien
gcttcctagaaagggtatatgaatg

SEQ ID NO: 74609 - DNA, 25 bp, Homo sapien
gcttcctatctctcacacagcctat

SEQ ID NO: 74610 - DNA, 25 bp, Homo sapien
gcttcctatgtctcacacagcctat

SEQ ID NO: 74611 - DNA, 25 bp, Homo sapien
gcttcctcatctcccatttcgcctt

SEQ ID NO: 74612 - DNA, 25 bp, Homo sapien
gcttcctccttcactgggcactcaa

SEQ ID NO: 74613 - DNA, 25 bp, Homo sapien
gcttcctcgtctcccatttcgcctt

SEQ ID NO: 74614 - DNA, 25 bp, Homo sapien
gcttcctctttcactgggcactcaa

SEQ ID NO: 74615 - DNA, 25 bp, Homo sapien
gcttccttagcacgagagcagactc

SEQ ID NO: 74616 - DNA, 25 bp, Homo sapien
gcttccttagcatgagagcagactc

SEQ ID NO: 74617 - DNA, 25 bp, Homo sapien
gcttcgaacgtaactgacatctttg

SEQ ID NO: 74618 - DNA, 25 bp, Homo sapien
gcttcgaatgtaactgacatctttg

SEQ ID NO: 74619 - DNA, 25 bp, Homo sapien
gcttcgatttgatcagactttgaat

SEQ ID NO: 74620 - DNA, 25 bp, Homo sapien
gcttcgatttgatgagactttgaat

SEQ ID NO: 74621 - DNA, 25 bp, Homo sapien
gcttctaccgtctgtttttgtgcat

SEQ ID NO: 74622 - DNA, 25 bp, Homo sapien
gcttctactgtctgtttttgtgcat

SEQ ID NO: 74623 - DNA, 25 bp, Homo sapien
gcttctacttgcggtcacttatact

SEQ ID NO: 74624 - DNA, 25 bp, Homo sapien
gcttctacttgctgtcacttatact

SEQ ID NO: 74625 - DNA, 25 bp, Homo sapien
gcttctaggtgtgcctgctgagtag

SEQ ID NO: 74626 - DNA, 25 bp, Homo sapien
gcttctaggtgttcctgctgagtag

SEQ ID NO: 74627 - DNA, 25 bp, Homo sapien
gcttctatcacaacctgcagagggt

SEQ ID NO: 74628 - DNA, 25 bp, Homo sapien
gcttctatcacgacctgcagagggt

SEQ ID NO: 74629 - DNA, 25 bp, Homo sapien
gcttctcaacgtgttacttgtctca

SEQ ID NO: 74630 - DNA, 25 bp, Homo sapien
gcttctcaatgtgttacttgtctca

SEQ ID NO: 74631 - DNA, 25 bp, Homo sapien
gcttctcagcttcgtcggtgccaat

SEQ ID NO: 74632 - DNA, 25 bp, Homo sapien
gcttctcagctttgtcggtgccaat

SEQ ID NO: 74633 - DNA, 25 bp, Homo sapien
gcttctcatgtcagcactatggctc

SEQ ID NO: 74634 - DNA, 25 bp, Homo sapien
gcttctcatgtcagcagtatggctc

SEQ ID NO: 74635 - DNA, 25 bp, Homo sapien
gcttctccagcacctaaactggtat

SEQ ID NO: 74636 - DNA, 25 bp, Homo sapien
gcttctccagcacttaaactggtat

SEQ ID NO: 74637 - DNA, 25 bp, Homo sapien
gcttctccaggctcaaaaaaacacc

SEQ ID NO: 74638 - DNA, 25 bp, Homo sapien
gcttctccatcaacactgctactgc

SEQ ID NO: 74639 - DNA, 25 bp, Homo sapien
gcttctccatcgacactgctactgc

SEQ ID NO: 74640 - DNA, 25 bp, Homo sapien
gcttctccattctacgggacatcaa

SEQ ID NO: 74641 - DNA, 25 bp, Homo sapien
gcttctccattctatgggacatcaa

SEQ ID NO: 74642 - DNA, 25 bp, Homo sapien
gcttctcccacaaagactttcagct

SEQ ID NO: 74643 - DNA, 25 bp, Homo sapien
gcttctcccgcaaagactttcagct

SEQ ID NO: 74644 - DNA, 25 bp, Homo sapien
gcttctccctgaaaaaaagcaagag

SEQ ID NO: 74645 - DNA, 25 bp, Homo sapien
gcttctccctgcaaaaaagcaagag

SEQ ID NO: 74646 - DNA, 25 bp, Homo sapien
gcttctccgggctcaaaaaaacacc

SEQ ID NO: 74647 - DNA, 25 bp, Homo sapien
gcttctctaacttattttgttaata

SEQ ID NO: 74648 - DNA, 25 bp, Homo sapien
gcttctctaacttcttttgttaata

SEQ ID NO: 74649 - DNA, 25 bp, Homo sapien
gcttctctatgtgctcaaatgaatc

SEQ ID NO: 74650 - DNA, 25 bp, Homo sapien
gcttctctatgttctcaaatgaatc

SEQ ID NO: 74651 - DNA, 25 bp, Homo sapien
gcttctgaaaggaaggaaagcttta

SEQ ID NO: 74652 - DNA, 25 bp, Homo sapien
gcttctgaaaggtaggaaagcttta

SEQ ID NO: 74653 - DNA, 25 bp, Homo sapien
gcttctgaaatgcaaaactatggat

SEQ ID NO: 74654 - DNA, 25 bp, Homo sapien
gcttctgaaatgcgaaactatggat

SEQ ID NO: 74655 - DNA, 25 bp, Homo sapien
gcttctgactttccaaaatgcttct

SEQ ID NO: 74656 - DNA, 25 bp, Homo sapien
gcttctgactttgcaaaatgcttct

SEQ ID NO: 74657 - DNA, 25 bp, Homo sapien
gcttctgccttccacttcccaggct

SEQ ID NO: 74658 - DNA, 25 bp, Homo sapien
gcttctgccttctacttcccaggct

SEQ ID NO: 74659 - DNA, 25 bp, Homo sapien
gcttctgcttaagaacattcctctt

SEQ ID NO: 74660 - DNA, 25 bp, Homo sapien
gcttctgcttaagtacattcctctt

SEQ ID NO: 74661 - DNA, 25 bp, Homo sapien
gcttctgcttgacaaacatgctttt

SEQ ID NO: 74662 - DNA, 25 bp, Homo sapien
gcttctgcttgaccaacatgctttt

SEQ ID NO: 74663 - DNA, 25 bp, Homo sapien
gcttctggtagcaacagtttcatct

SEQ ID NO: 74664 - DNA, 25 bp, Homo sapien
gcttctggttgcaacagtttcatct

SEQ ID NO: 74665 - DNA, 25 bp, Homo sapien
gcttctgtacagcattatttatcaa

SEQ ID NO: 74666 - DNA, 25 bp, Homo sapien
gcttctgtacagcgttatttatcaa

SEQ ID NO: 74667 - DNA, 25 bp, Homo sapien
gcttctgtttatagagcacatccac

SEQ ID NO: 74668 - DNA, 25 bp, Homo sapien
gcttctgtttatagagtacatccac

SEQ ID NO: 74669 - DNA, 25 bp, Homo sapien
gcttctgttttaaccattgaccttc

SEQ ID NO: 74670 - DNA, 25 bp, Homo sapien
gcttctgttttaacgattgaccttc

SEQ ID NO: 74671 - DNA, 25 bp, Homo sapien
gcttctgttttcccacctgccatta

SEQ ID NO: 74672 - DNA, 25 bp, Homo sapien
gcttctgtttttccacctgccatta

SEQ ID NO: 74673 - DNA, 25 bp, Homo sapien
gcttcttactgatcatgtgaccact

SEQ ID NO: 74674 - DNA, 25 bp, Homo sapien
gcttcttagatgtacttagggcatc

SEQ ID NO: 74675 - DNA, 25 bp, Homo sapien
gcttcttagatgtccttagggcatc

SEQ ID NO: 74676 - DNA, 25 bp, Homo sapien
gcttcttattgatcatgtgaccact

SEQ ID NO: 74677 - DNA, 25 bp, Homo sapien
gcttcttcctagccaatctcctgtt

SEQ ID NO: 74678 - DNA, 25 bp, Homo sapien
gcttcttcctagtcaatctcctgtt

SEQ ID NO: 74679 - DNA, 25 bp, Homo sapien
gcttcttcctcaaatatgttatgat

SEQ ID NO: 74680 - DNA, 25 bp, Homo sapien
gcttcttcttcaaatatgttatgat

SEQ ID NO: 74681 - DNA, 25 bp, Homo sapien
gcttctttactgggcttcgcagcat

SEQ ID NO: 74682 - DNA, 25 bp, Homo sapien
gcttctttactgtgcttcgcagcat

SEQ ID NO: 74683 - DNA, 25 bp, Homo sapien
gcttctttctttcccaaaatcacca

SEQ ID NO: 74684 - DNA, 25 bp, Homo sapien
gcttctttcttttccaaaatcacca

SEQ ID NO: 74685 - DNA, 25 bp, Homo sapien
gcttctttggtattatcagagcttt

SEQ ID NO: 74686 - DNA, 25 bp, Homo sapien
gcttctttggtgttatcagagcttt

SEQ ID NO: 74687 - DNA, 25 bp, Homo sapien
gcttcttttcgtaaagaggaaggta

SEQ ID NO: 74688 - DNA, 25 bp, Homo sapien
gcttctttttgtaaagaggaaggta

SEQ ID NO: 74689 - DNA, 25 bp, Homo sapien
gcttgaaaatagccaaaaagtctac

SEQ ID NO: 74690 - DNA, 25 bp, Homo sapien
gcttgaaaataggcaaaaagtctac

SEQ ID NO: 74691 - DNA, 25 bp, Homo sapien
gcttgaaaattccctcaaacttgga

SEQ ID NO: 74692 - DNA, 25 bp, Homo sapien
gcttgaaaattccctcgaacttgga

SEQ ID NO: 74693 - DNA, 25 bp, Homo sapien
gcttgaagcatctgtgacatctgtg

SEQ ID NO: 74694 - DNA, 25 bp, Homo sapien
gcttgaagcatttgtgacatctgtg

SEQ ID NO: 74695 - DNA, 25 bp, Homo sapien
gcttgaaggcaaggatgatgcctat

SEQ ID NO: 74696 - DNA, 25 bp, Homo sapien
gcttgaaggcagggatgatgcctat

SEQ ID NO: 74697 - DNA, 25 bp, Homo sapien
gcttgaaggttgatgaaaatcccct

SEQ ID NO: 74698 - DNA, 25 bp, Homo sapien
gcttgaagtgagtttcagtgatatc

SEQ ID NO: 74699 - DNA, 25 bp, Homo sapien
gcttgaagtgattttcagtgatatc

SEQ ID NO: 74700 - DNA, 25 bp, Homo sapien
gcttgaagtttgatgaaaatcccct

SEQ ID NO: 74701 - DNA, 25 bp, Homo sapien
gcttgaattcttcaaaataagtaca

SEQ ID NO: 74702 - DNA, 25 bp, Homo sapien
gcttgaattctttaaaataagtaca

SEQ ID NO: 74703 - DNA, 25 bp, Homo sapien
gcttgactactgtaactttgtagta

SEQ ID NO: 74704 - DNA, 25 bp, Homo sapien
gcttgactattgtaactttgtagta

SEQ ID NO: 74705 - DNA, 25 bp, Homo sapien
gcttgactttaactgggctttttct

SEQ ID NO: 74706 - DNA, 25 bp, Homo sapien
gcttgactttaattgggctttttct

SEQ ID NO: 74707 - DNA, 25 bp, Homo sapien
gcttgaggagccttttcgcagagtc

SEQ ID NO: 74708 - DNA, 25 bp, Homo sapien
gcttgaggagcctttttgcagagtc

SEQ ID NO: 74709 - DNA, 25 bp, Homo sapien
gcttgagtcaaataaccctgattct

SEQ ID NO: 74710 - DNA, 25 bp, Homo sapien
gcttgagtcaaatcaccctgattct

SEQ ID NO: 74711 - DNA, 25 bp, Homo sapien
gcttgataaggtcacccaaaaatgt

SEQ ID NO: 74712 - DNA, 25 bp, Homo sapien
gcttgataaggtcatccaaaaatgt

SEQ ID NO: 74713 - DNA, 25 bp, Homo sapien
gcttgatatgtgtactcgtttcctg

SEQ ID NO: 74714 - DNA, 25 bp, Homo sapien
gcttgatatgtgtacttgtttcctg

SEQ ID NO: 74715 - DNA, 25 bp, Homo sapien
gcttgatattcatgaacatttcact

SEQ ID NO: 74716 - DNA, 25 bp, Homo sapien
gcttgatattcgtgaacatttcact

SEQ ID NO: 74717 - DNA, 25 bp, Homo sapien
gcttgcatctttgttgatctaccaa

SEQ ID NO: 74718 - DNA, 25 bp, Homo sapien
gcttgcatctttgttggtctaccaa

SEQ ID NO: 74719 - DNA, 25 bp, Homo sapien
gcttgcctcataagacttccaaggt

SEQ ID NO: 74720 - DNA, 25 bp, Homo sapien
gcttgcctcgtaagacttccaaggt

SEQ ID NO: 74721 - DNA, 25 bp, Homo sapien
gcttgcctgagattggtaccagctg

SEQ ID NO: 74722 - DNA, 25 bp, Homo sapien
gcttgcctgggattggtaccagctg

SEQ ID NO: 74723 - DNA, 25 bp, Homo sapien
gcttgccttttcagtttcataacag

SEQ ID NO: 74724 - DNA, 25 bp, Homo sapien
gcttgccttttcattttcataacag

SEQ ID NO: 74725 - DNA, 25 bp, Homo sapien
gcttgcggaacgcgttataaatgaa

SEQ ID NO: 74726 - DNA, 25 bp, Homo sapien
gcttgcggaacgtgttataaatgaa

SEQ ID NO: 74727 - DNA, 25 bp, Homo sapien
gcttgctgcagaaagttataaggac

SEQ ID NO: 74728 - DNA, 25 bp, Homo sapien
gcttgctgcaggcatgaagagacag

SEQ ID NO: 74729 - DNA, 25 bp, Homo sapien
gcttgctgcaggcgtgaagagacag

SEQ ID NO: 74730 - DNA, 25 bp, Homo sapien
gcttgctgcggaaagttataaggac

SEQ ID NO: 74731 - DNA, 25 bp, Homo sapien
gcttgctgtgggatgtcacttttta

SEQ ID NO: 74732 - DNA, 25 bp, Homo sapien
gcttgctgtgggttgtcacttttta

SEQ ID NO: 74733 - DNA, 25 bp, Homo sapien
gcttgctgttacgtccaaggcatct

SEQ ID NO: 74734 - DNA, 25 bp, Homo sapien
gcttgctgttatgtccaaggcatct

SEQ ID NO: 74735 - DNA, 25 bp, Homo sapien
gcttgcttactgactcatagatagt

SEQ ID NO: 74736 - DNA, 25 bp, Homo sapien
gcttgcttgctgactcatagatagt

SEQ ID NO: 74737 - DNA, 25 bp, Homo sapien
gcttggaaacactataggaacaggt

SEQ ID NO: 74738 - DNA, 25 bp, Homo sapien
gcttggaaacagtataggaacaggt

SEQ ID NO: 74739 - DNA, 25 bp, Homo sapien
gcttggagatgatgatgaccttgag

SEQ ID NO: 74740 - DNA, 25 bp, Homo sapien
gcttggagatggtgatgaccttgag

SEQ ID NO: 74741 - DNA, 25 bp, Homo sapien
gcttggaggaggtcagactttgtcc

SEQ ID NO: 74742 - DNA, 25 bp, Homo sapien
gcttggaggaggtcagtctttgtcc

SEQ ID NO: 74743 - DNA, 25 bp, Homo sapien
gcttggattttgcacaaattggctt

SEQ ID NO: 74744 - DNA, 25 bp, Homo sapien
gcttggattttgcgcaaattggctt

SEQ ID NO: 74745 - DNA, 25 bp, Homo sapien
gcttggcagacctgtatgcattcta

SEQ ID NO: 74746 - DNA, 25 bp, Homo sapien
gcttggcaggcctgtatgcattcta

SEQ ID NO: 74747 - DNA, 25 bp, Homo sapien
gcttggcagggcttagcggtgaaca

SEQ ID NO: 74748 - DNA, 25 bp, Homo sapien
gcttggcagtgcttagcggtgaaca

SEQ ID NO: 74749 - DNA, 25 bp, Homo sapien
gcttggcattgatcaaacactttac

SEQ ID NO: 74750 - DNA, 25 bp, Homo sapien
gcttggcattgttcaaacactttac

SEQ ID NO: 74751 - DNA, 25 bp, Homo sapien
gcttggccacattacttatgtagaa

SEQ ID NO: 74752 - DNA, 25 bp, Homo sapien
gcttggccacattgcttatgtagaa

SEQ ID NO: 74753 - DNA, 25 bp, Homo sapien
gcttgggtgtcagccccacagagga

SEQ ID NO: 74754 - DNA, 25 bp, Homo sapien
gcttgggtgtcagccctacagagga

SEQ ID NO: 74755 - DNA, 25 bp, Homo sapien
gcttgggttttgactgggattatga

SEQ ID NO: 74756 - DNA, 25 bp, Homo sapien
gcttgggttttgattgggattatga

SEQ ID NO: 74757 - DNA, 25 bp, Homo sapien
gcttggtggtggaacccgttctcac

SEQ ID NO: 74758 - DNA, 25 bp, Homo sapien
gcttggtggtggaacctgttctcac

SEQ ID NO: 74759 - DNA, 25 bp, Homo sapien
gcttgtaaatcgatcgctttctttc

SEQ ID NO: 74760 - DNA, 25 bp, Homo sapien
gcttgtaaatcgattgctttctttc

SEQ ID NO: 74761 - DNA, 25 bp, Homo sapien
gcttgtactacaacaagattccact

SEQ ID NO: 74762 - DNA, 25 bp, Homo sapien
gcttgtactacgacaagattccact

SEQ ID NO: 74763 - DNA, 25 bp, Homo sapien
gcttgtcaattctgcctttaatttc

SEQ ID NO: 74764 - DNA, 25 bp, Homo sapien
gcttgtcacctgggactggtgacat

SEQ ID NO: 74765 - DNA, 25 bp, Homo sapien
gcttgtcacgtgggactggtgacat

SEQ ID NO: 74766 - DNA, 25 bp, Homo sapien
gcttgtcagttctgcctttaatttc

SEQ ID NO: 74767 - DNA, 25 bp, Homo sapien
gcttgtccacatgatctcctgctcc

SEQ ID NO: 74768 - DNA, 25 bp, Homo sapien
gcttgtccgcatgatctcctgctcc

SEQ ID NO: 74769 - DNA, 25 bp, Homo sapien
gcttgtctttagctttcaaagtaga

SEQ ID NO: 74770 - DNA, 25 bp, Homo sapien
gcttgtctttagctttgaaagtaga

SEQ ID NO: 74771 - DNA, 25 bp, Homo sapien
gcttgtgaaatcctagtggccactc

SEQ ID NO: 74772 - DNA, 25 bp, Homo sapien
gcttgtgatatcctagtggccactc

SEQ ID NO: 74773 - DNA, 25 bp, Homo sapien
gcttgtggctccaaaaaagactcct

SEQ ID NO: 74774 - DNA, 25 bp, Homo sapien
gcttgtggctccatccgccatattt

SEQ ID NO: 74775 - DNA, 25 bp, Homo sapien
gcttgtggctccatcctccatattt

SEQ ID NO: 74776 - DNA, 25 bp, Homo sapien
gcttgtggctcgaaaaaagactcct

SEQ ID NO: 74777 - DNA, 25 bp, Homo sapien
gcttgttaccccggaatatgctgtg

SEQ ID NO: 74778 - DNA, 25 bp, Homo sapien
gcttgttaccccgggatatgctgtg

SEQ ID NO: 74779 - DNA, 25 bp, Homo sapien
gcttgttgcaataagataaccaatt

SEQ ID NO: 74780 - DNA, 25 bp, Homo sapien
gcttgttgcaatcagataaccaatt

SEQ ID NO: 74781 - DNA, 25 bp, Homo sapien
gcttgtttcttaaatgggttgcttt

SEQ ID NO: 74782 - DNA, 25 bp, Homo sapien
gcttgtttcttaattgggttgcttt

SEQ ID NO: 74783 - DNA, 25 bp, Homo sapien
gcttgtttgtttgttccaatttcat

SEQ ID NO: 74784 - DNA, 25 bp, Homo sapien
gcttgtttgtttgttctaatttcat

SEQ ID NO: 74785 - DNA, 25 bp, Homo sapien
gctttaaaaagattcaaccaaagcc

SEQ ID NO: 74786 - DNA, 25 bp, Homo sapien
gctttaaaactcagatctaacaaag

SEQ ID NO: 74787 - DNA, 25 bp, Homo sapien
gctttaaaactcatatctaacaaag

SEQ ID NO: 74788 - DNA, 25 bp, Homo sapien
gctttaaacagattcaaccaaagcc

SEQ ID NO: 74789 - DNA, 25 bp, Homo sapien
gctttaagtctaagtagaagcgacg

SEQ ID NO: 74790 - DNA, 25 bp, Homo sapien
gctttaagtctatgtagaagcgacg

SEQ ID NO: 74791 - DNA, 25 bp, Homo sapien
gctttaagttcagctctcaaaatca

SEQ ID NO: 74792 - DNA, 25 bp, Homo sapien
gctttaagttcggctctcaaaatca

SEQ ID NO: 74793 - DNA, 25 bp, Homo sapien
gctttaatggaaaactctttcagtt

SEQ ID NO: 74794 - DNA, 25 bp, Homo sapien
gctttaatggaaatctctttcagtt

SEQ ID NO: 74795 - DNA, 25 bp, Homo sapien
gctttacagtaaagagtgtccatcc

SEQ ID NO: 74796 - DNA, 25 bp, Homo sapien
gctttacagtagagagtgtccatcc

SEQ ID NO: 74797 - DNA, 25 bp, Homo sapien
gctttacctttaacgaaacagaaat

SEQ ID NO: 74798 - DNA, 25 bp, Homo sapien
gctttacctttaatgaaacagaaat

SEQ ID NO: 74799 - DNA, 25 bp, Homo sapien
gctttagaattcatttggctccctg

SEQ ID NO: 74800 - DNA, 25 bp, Homo sapien
gctttagaattcgtttggctccctg

SEQ ID NO: 74801 - DNA, 25 bp, Homo sapien
gctttagcaatgaacttttaagata

SEQ ID NO: 74802 - DNA, 25 bp, Homo sapien
gctttagcagtgaacttttaagata

SEQ ID NO: 74803 - DNA, 25 bp, Homo sapien
gctttaggcattccctggttgatgg

SEQ ID NO: 74804 - DNA, 25 bp, Homo sapien
gctttaggccttccctggttgatgg

SEQ ID NO: 74805 - DNA, 25 bp, Homo sapien
gctttaggtctttcgtaccaaacat

SEQ ID NO: 74806 - DNA, 25 bp, Homo sapien
gctttaggtctttggtaccaaacat

SEQ ID NO: 74807 - DNA, 25 bp, Homo sapien
gctttagtgcttcaatctaaagagg

SEQ ID NO: 74808 - DNA, 25 bp, Homo sapien
gctttagtgctttaatctaaagagg

SEQ ID NO: 74809 - DNA, 25 bp, Homo sapien
gctttatcaatgaagtttatgtaat

SEQ ID NO: 74810 - DNA, 25 bp, Homo sapien
gctttatcaatgaattttatgtaat

SEQ ID NO: 74811 - DNA, 25 bp, Homo sapien
gctttatggttaagcatgtggtcaa

SEQ ID NO: 74812 - DNA, 25 bp, Homo sapien
gctttatggttaagtatgtggtcaa

SEQ ID NO: 74813 - DNA, 25 bp, Homo sapien
gctttattcaaacgactggttgggg

SEQ ID NO: 74814 - DNA, 25 bp, Homo sapien
gctttattcaaatgactggttgggg

SEQ ID NO: 74815 - DNA, 25 bp, Homo sapien
gctttcaaagtaaaacactgatata

SEQ ID NO: 74816 - DNA, 25 bp, Homo sapien
gctttcaaagtaatacactgatata

SEQ ID NO: 74817 - DNA, 25 bp, Homo sapien
gctttcaccctgtgttagacagccc

SEQ ID NO: 74818 - DNA, 25 bp, Homo sapien
gctttcaccctgtgtttgacagccc

SEQ ID NO: 74819 - DNA, 25 bp, Homo sapien
gctttcagagctgcatttacctccc

SEQ ID NO: 74820 - DNA, 25 bp, Homo sapien
gctttcagagcttcatttacctccc

SEQ ID NO: 74821 - DNA, 25 bp, Homo sapien
gctttcagcactcaatcagctctct

SEQ ID NO: 74822 - DNA, 25 bp, Homo sapien
gctttcagcactgaatcagctctct

SEQ ID NO: 74823 - DNA, 25 bp, Homo sapien
gctttccaagagaaataagcagtca

SEQ ID NO: 74824 - DNA, 25 bp, Homo sapien
gctttccaagagaattaagcagtca

SEQ ID NO: 74825 - DNA, 25 bp, Homo sapien
gctttccagagcaggtaatgtcaga

SEQ ID NO: 74826 - DNA, 25 bp, Homo sapien
gctttccagagtaggtaatgtcaga

SEQ ID NO: 74827 - DNA, 25 bp, Homo sapien
gctttccccattacttgttgcgatt

SEQ ID NO: 74828 - DNA, 25 bp, Homo sapien
gctttccccattactttttgcgatt

SEQ ID NO: 74829 - DNA, 25 bp, Homo sapien
gctttccctgattatttacaagttt

SEQ ID NO: 74830 - DNA, 25 bp, Homo sapien
gctttccctgattctttacaagttt

SEQ ID NO: 74831 - DNA, 25 bp, Homo sapien
gctttccctgcacaatccaggtcct

SEQ ID NO: 74832 - DNA, 25 bp, Homo sapien
gctttccctgcacgatccaggtcct

SEQ ID NO: 74833 - DNA, 25 bp, Homo sapien
gctttccgtgattacggactattgc

SEQ ID NO: 74834 - DNA, 25 bp, Homo sapien
gctttccgtgattatggactattgc

SEQ ID NO: 74835 - DNA, 25 bp, Homo sapien
gctttcctgaaatcaatcagaagcc

SEQ ID NO: 74836 - DNA, 25 bp, Homo sapien
gctttcctgaagtcaatcagaagcc

SEQ ID NO: 74837 - DNA, 25 bp, Homo sapien
gctttcctgaggccacattcttaca

SEQ ID NO: 74838 - DNA, 25 bp, Homo sapien
gctttcctgaggccgcattcttaca

SEQ ID NO: 74839 - DNA, 25 bp, Homo sapien
gctttcctgtaccagacacctctga

SEQ ID NO: 74840 - DNA, 25 bp, Homo sapien
gctttccttccagctgatgaaattc

SEQ ID NO: 74841 - DNA, 25 bp, Homo sapien
gctttccttccaggtgatgaaattc

SEQ ID NO: 74842 - DNA, 25 bp, Homo sapien
gctttcctttaccagacacctctga

SEQ ID NO: 74843 - DNA, 25 bp, Homo sapien
gctttcgaagaagcacagatgtcca

SEQ ID NO: 74844 - DNA, 25 bp, Homo sapien
gctttcgaagaagcgcagatgtcca

SEQ ID NO: 74845 - DNA, 25 bp, Homo sapien
gctttcgcaaaaggtactcgctgcc

SEQ ID NO: 74846 - DNA, 25 bp, Homo sapien
gctttcgcaaaagttactcgctgcc

SEQ ID NO: 74847 - DNA, 25 bp, Homo sapien
gctttctaatgtctgagtgaaaagt

SEQ ID NO: 74848 - DNA, 25 bp, Homo sapien
gctttctacaagaacttcattttat

SEQ ID NO: 74849 - DNA, 25 bp, Homo sapien
gctttctacaagagcttcattttat

SEQ ID NO: 74850 - DNA, 25 bp, Homo sapien
gctttctactgtctgagtgaaaagt

SEQ ID NO: 74851 - DNA, 25 bp, Homo sapien
gctttctcatcacggcttctatggg

SEQ ID NO: 74852 - DNA, 25 bp, Homo sapien
gctttctcatcatggcttctatggg

SEQ ID NO: 74853 - DNA, 25 bp, Homo sapien
gctttctccaatatgaaaggtgtga

SEQ ID NO: 74854 - DNA, 25 bp, Homo sapien
gctttctccaatctgaaaggtgtga

SEQ ID NO: 74855 - DNA, 25 bp, Homo sapien
gctttctgctctatctttaggtttt

SEQ ID NO: 74856 - DNA, 25 bp, Homo sapien
gctttctggtctatctttaggtttt

SEQ ID NO: 74857 - DNA, 25 bp, Homo sapien
gctttctgtcgggaaatcctcttaa

SEQ ID NO: 74858 - DNA, 25 bp, Homo sapien
gctttctgttgggaaatcctcttaa

SEQ ID NO: 74859 - DNA, 25 bp, Homo sapien
gctttcttcaaaacctatttcaaaa

SEQ ID NO: 74860 - DNA, 25 bp, Homo sapien
gctttcttcaaaacttatttcaaaa

SEQ ID NO: 74861 - DNA, 25 bp, Homo sapien
gctttcttctggtcgaattgggaat

SEQ ID NO: 74862 - DNA, 25 bp, Homo sapien
gctttcttctggttgaattgggaat

SEQ ID NO: 74863 - DNA, 25 bp, Homo sapien
gctttctttcctgtattgattattt

SEQ ID NO: 74864 - DNA, 25 bp, Homo sapien
gctttctttctacgccctgaagatg

SEQ ID NO: 74865 - DNA, 25 bp, Homo sapien
gctttctttctatgccctgaagatg

SEQ ID NO: 74866 - DNA, 25 bp, Homo sapien
gctttcttttctgtattgattattt

SEQ ID NO: 74867 - DNA, 25 bp, Homo sapien
gctttgaaattatttatccctcttt

SEQ ID NO: 74868 - DNA, 25 bp, Homo sapien
gctttgaagttatttatccctcttt

SEQ ID NO: 74869 - DNA, 25 bp, Homo sapien
gctttgactaacagaatatcataaa

SEQ ID NO: 74870 - DNA, 25 bp, Homo sapien
gctttgactaatagaatatcataaa

SEQ ID NO: 74871 - DNA, 25 bp, Homo sapien
gctttgatagtttgatagaaataac

SEQ ID NO: 74872 - DNA, 25 bp, Homo sapien
gctttgatgatgccaattgctatat

SEQ ID NO: 74873 - DNA, 25 bp, Homo sapien
gctttgatgatgctaattgctatat

SEQ ID NO: 74874 - DNA, 25 bp, Homo sapien
gctttgatggtttgatagaaataac

SEQ ID NO: 74875 - DNA, 25 bp, Homo sapien
gctttgcaacatcacgacaaacact

SEQ ID NO: 74876 - DNA, 25 bp, Homo sapien
gctttgcaacatcatgacaaacact

SEQ ID NO: 74877 - DNA, 25 bp, Homo sapien
gctttgcattcaatatagccattta

SEQ ID NO: 74878 - DNA, 25 bp, Homo sapien
gctttgcattcaatatcgccattta

SEQ ID NO: 74879 - DNA, 25 bp, Homo sapien
gctttgccaactaagacccagcaga

SEQ ID NO: 74880 - DNA, 25 bp, Homo sapien
gctttgccgactaagacccagcaga

SEQ ID NO: 74881 - DNA, 25 bp, Homo sapien
gctttgctctacattcttttcaatc

SEQ ID NO: 74882 - DNA, 25 bp, Homo sapien
gctttgctctacgttcttttcaatc

SEQ ID NO: 74883 - DNA, 25 bp, Homo sapien
gctttgctctctctgcctttaacat

SEQ ID NO: 74884 - DNA, 25 bp, Homo sapien
gctttgctgatggccttgaagcagc

SEQ ID NO: 74885 - DNA, 25 bp, Homo sapien
gctttgctgatggctttgaagcagc

SEQ ID NO: 74886 - DNA, 25 bp, Homo sapien
gctttgctgtctctgcctttaacat

SEQ ID NO: 74887 - DNA, 25 bp, Homo sapien
gctttgctttttctactagcataga

SEQ ID NO: 74888 - DNA, 25 bp, Homo sapien
gctttgctttttgtactagcataga

SEQ ID NO: 74889 - DNA, 25 bp, Homo sapien
gctttggaaataaggtgtacactgt

SEQ ID NO: 74890 - DNA, 25 bp, Homo sapien
gctttggaaatagggtgtacactgt

SEQ ID NO: 74891 - DNA, 25 bp, Homo sapien
gctttggagtacaaacgatcccatc

SEQ ID NO: 74892 - DNA, 25 bp, Homo sapien
gctttggagtagaaacgatcccatc

SEQ ID NO: 74893 - DNA, 25 bp, Homo sapien
gctttggagtggcgaggttaaagtg

SEQ ID NO: 74894 - DNA, 25 bp, Homo sapien
gctttggagtggtgaggttaaagtg

SEQ ID NO: 74895 - DNA, 25 bp, Homo sapien
gctttggcacttgctgttcctccag

SEQ ID NO: 74896 - DNA, 25 bp, Homo sapien
gctttggcacttgttgttcctccag

SEQ ID NO: 74897 - DNA, 25 bp, Homo sapien
gctttgggaaacaaacaacttgcca

SEQ ID NO: 74898 - DNA, 25 bp, Homo sapien
gctttgggaaacaaccaacttgcca

SEQ ID NO: 74899 - DNA, 25 bp, Homo sapien
gctttggtctagcgtcctatagagc

SEQ ID NO: 74900 - DNA, 25 bp, Homo sapien
gctttggtctagtgtcctatagagc

SEQ ID NO: 74901 - DNA, 25 bp, Homo sapien
gctttggtgcaatcaaaggaatgtg

SEQ ID NO: 74902 - DNA, 25 bp, Homo sapien
gctttggtgcaattaaaggaatgtg

SEQ ID NO: 74903 - DNA, 25 bp, Homo sapien
gctttggtgtcctgttgtaacttta

SEQ ID NO: 74904 - DNA, 25 bp, Homo sapien
gctttggtgtcctgttttaacttta

SEQ ID NO: 74905 - DNA, 25 bp, Homo sapien
gctttgtctcctatagtagattatt

SEQ ID NO: 74906 - DNA, 25 bp, Homo sapien
gctttgtcttctatagtagattatt

SEQ ID NO: 74907 - DNA, 25 bp, Homo sapien
gctttgtgaatgcctgttaacttag

SEQ ID NO: 74908 - DNA, 25 bp, Homo sapien
gctttgtgaatgtctgttaacttag

SEQ ID NO: 74909 - DNA, 25 bp, Homo sapien
gctttgtgacatgcatatattgcat

SEQ ID NO: 74910 - DNA, 25 bp, Homo sapien
gctttgtgacatgtatatattgcat

SEQ ID NO: 74911 - DNA, 25 bp, Homo sapien
gctttgtggggtcaattccagtatc

SEQ ID NO: 74912 - DNA, 25 bp, Homo sapien
gctttgtggggtcatttccagtatc

SEQ ID NO: 74913 - DNA, 25 bp, Homo sapien
gctttgtgtggagccgttttcctgt

SEQ ID NO: 74914 - DNA, 25 bp, Homo sapien
gctttgtgtggagctgttttcctgt

SEQ ID NO: 74915 - DNA, 25 bp, Homo sapien
gctttgtgttttcagttgttatttt

SEQ ID NO: 74916 - DNA, 25 bp, Homo sapien
gctttgtgtttttagttgttatttt

SEQ ID NO: 74917 - DNA, 25 bp, Homo sapien
gctttgttaacttagcctcttcctc

SEQ ID NO: 74918 - DNA, 25 bp, Homo sapien
gctttgttaacttagcttcttcctc

SEQ ID NO: 74919 - DNA, 25 bp, Homo sapien
gctttgttgtttcacttatagaaca

SEQ ID NO: 74920 - DNA, 25 bp, Homo sapien
gctttgttgtttcgcttatagaaca

SEQ ID NO: 74921 - DNA, 25 bp, Homo sapien
gcttttaggtatacggcacaggctt

SEQ ID NO: 74922 - DNA, 25 bp, Homo sapien
gcttttaggtatatggcacaggctt

SEQ ID NO: 74923 - DNA, 25 bp, Homo sapien
gcttttatcattacggcatcatcgt

SEQ ID NO: 74924 - DNA, 25 bp, Homo sapien
gcttttatcattatggcatcatcgt

SEQ ID NO: 74925 - DNA, 25 bp, Homo sapien
gcttttatttcgtctctacaggctg

SEQ ID NO: 74926 - DNA, 25 bp, Homo sapien
gcttttatttcttctctacaggctg

SEQ ID NO: 74927 - DNA, 25 bp, Homo sapien
gcttttatttttaagaagatcaaag

SEQ ID NO: 74928 - DNA, 25 bp, Homo sapien
gcttttatttttgagaagatcaaag

SEQ ID NO: 74929 - DNA, 25 bp, Homo sapien
gcttttcatcaatataatatacatg

SEQ ID NO: 74930 - DNA, 25 bp, Homo sapien
gcttttcatcaattaggtttttttg

SEQ ID NO: 74931 - DNA, 25 bp, Homo sapien
gcttttcatcaattagttttttttg

SEQ ID NO: 74932 - DNA, 25 bp, Homo sapien
gcttttcatcagtataatatacatg

SEQ ID NO: 74933 - DNA, 25 bp, Homo sapien
gcttttccatttgtcatccattgct

SEQ ID NO: 74934 - DNA, 25 bp, Homo sapien
gcttttccgtttgtcatccattgct

SEQ ID NO: 74935 - DNA, 25 bp, Homo sapien
gcttttctattttacgcagcaggtt

SEQ ID NO: 74936 - DNA, 25 bp, Homo sapien
gcttttctattttatgcagcaggtt

SEQ ID NO: 74937 - DNA, 25 bp, Homo sapien
gcttttctccgcaggcctcatttgc

SEQ ID NO: 74938 - DNA, 25 bp, Homo sapien
gcttttctcggacacaccacactct

SEQ ID NO: 74939 - DNA, 25 bp, Homo sapien
gcttttctctacctcttcccaccaa

SEQ ID NO: 74940 - DNA, 25 bp, Homo sapien
gcttttctctagctcttcccaccaa

SEQ ID NO: 74941 - DNA, 25 bp, Homo sapien
gcttttctctgcaggcctcatttgc

SEQ ID NO: 74942 - DNA, 25 bp, Homo sapien
gcttttctgttacatctatctgtac

SEQ ID NO: 74943 - DNA, 25 bp, Homo sapien
gcttttctgttgcatctatctgtac

SEQ ID NO: 74944 - DNA, 25 bp, Homo sapien
gcttttcttcaaaccaatatcacaa

SEQ ID NO: 74945 - DNA, 25 bp, Homo sapien
gcttttcttcaaaccagtatcacaa

SEQ ID NO: 74946 - DNA, 25 bp, Homo sapien
gcttttcttggacacaccacactct

SEQ ID NO: 74947 - DNA, 25 bp, Homo sapien
gcttttcttggactctcaagtagtg

SEQ ID NO: 74948 - DNA, 25 bp, Homo sapien
gcttttcttggactgtcaagtagtg

SEQ ID NO: 74949 - DNA, 25 bp, Homo sapien
gcttttctttcacaggtatgaaggt

SEQ ID NO: 74950 - DNA, 25 bp, Homo sapien
gcttttctttcacgggtatgaaggt

SEQ ID NO: 74951 - DNA, 25 bp, Homo sapien
gcttttgacacttattgccaaattt

SEQ ID NO: 74952 - DNA, 25 bp, Homo sapien
gcttttgatacttattgccaaattt

SEQ ID NO: 74953 - DNA, 25 bp, Homo sapien
gcttttgctatgaggcaataacact

SEQ ID NO: 74954 - DNA, 25 bp, Homo sapien
gcttttgctattaggcaataacact

SEQ ID NO: 74955 - DNA, 25 bp, Homo sapien
gcttttggaccccttttctgaacat

SEQ ID NO: 74956 - DNA, 25 bp, Homo sapien
gcttttggacctcttttctgaacat

SEQ ID NO: 74957 - DNA, 25 bp, Homo sapien
gcttttgggcacaaataccacatat

SEQ ID NO: 74958 - DNA, 25 bp, Homo sapien
gcttttgggcacaaatcccacatat

SEQ ID NO: 74959 - DNA, 25 bp, Homo sapien
gctttttaagtgatagcttgctaga

SEQ ID NO: 74960 - DNA, 25 bp, Homo sapien
gctttttaggtgatagcttgctaga

SEQ ID NO: 74961 - DNA, 25 bp, Homo sapien
gctttttatccagaggcgtggactt

SEQ ID NO: 74962 - DNA, 25 bp, Homo sapien
gctttttatccagaggtgtggactt

SEQ ID NO: 74963 - DNA, 25 bp, Homo sapien
gctttttatgccttgacctttgtac

SEQ ID NO: 74964 - DNA, 25 bp, Homo sapien
gctttttatgcgttgacctttgtac

SEQ ID NO: 74965 - DNA, 25 bp, Homo sapien
gctttttcatgggaatgtagagtat

SEQ ID NO: 74966 - DNA, 25 bp, Homo sapien
gctttttcgcccacagcaagaaatt

SEQ ID NO: 74967 - DNA, 25 bp, Homo sapien
gctttttcgcctacagcaagaaatt

SEQ ID NO: 74968 - DNA, 25 bp, Homo sapien
gctttttcgtgggaatgtagagtat

SEQ ID NO: 74969 - DNA, 25 bp, Homo sapien
gctttttgaaatgctaaataaacac

SEQ ID NO: 74970 - DNA, 25 bp, Homo sapien
gctttttgaaatggtaaataaacac

SEQ ID NO: 74971 - DNA, 25 bp, Homo sapien
gctttttggacatatccttactgtt

SEQ ID NO: 74972 - DNA, 25 bp, Homo sapien
gctttttggacatgtccttactgtt

SEQ ID NO: 74973 - DNA, 25 bp, Homo sapien
gcttttttattcactgaatatggtt

SEQ ID NO: 74974 - DNA, 25 bp, Homo sapien
gcttttttccaagttagtttctgaa

SEQ ID NO: 74975 - DNA, 25 bp, Homo sapien
gcttttttccacgttagtttctgaa

SEQ ID NO: 74976 - DNA, 25 bp, Homo sapien
gctttttttgtgcgagcctctgaga

SEQ ID NO: 74977 - DNA, 25 bp, Homo sapien
gctttttttgtgtgagcctctgaga

SEQ ID NO: 74978 - DNA, 25 bp, Homo sapien
gctttttttttcactgaatatggtt

SEQ ID NO: 74979 - DNA, 25 bp, Homo sapien
ggaaaaaaaatgatgacgggcacag

SEQ ID NO: 74980 - DNA, 25 bp, Homo sapien
ggaaaaaaaatgatgatgggcacag

SEQ ID NO: 74981 - DNA, 25 bp, Homo sapien
ggaaaaaaacacagaggcaggtccc

SEQ ID NO: 74982 - DNA, 25 bp, Homo sapien
ggaaaaaaacacagagtcaggtccc

SEQ ID NO: 74983 - DNA, 25 bp, Homo sapien
ggaaaaaaagaacacaataaactca

SEQ ID NO: 74984 - DNA, 25 bp, Homo sapien
ggaaaaaaatgaccaagaatagcca

SEQ ID NO: 74985 - DNA, 25 bp, Homo sapien
ggaaaaaaatgaccgagaatagcca

SEQ ID NO: 74986 - DNA, 25 bp, Homo sapien
ggaaaaaacaaactttgttagtgac

SEQ ID NO: 74987 - DNA, 25 bp, Homo sapien
ggaaaaaacatcacaactctaaatt

SEQ ID NO: 74988 - DNA, 25 bp, Homo sapien
ggaaaaaacatcacgactctaaatt

SEQ ID NO: 74989 - DNA, 25 bp, Homo sapien
ggaaaaaagaacgtgaagactcagg

SEQ ID NO: 74990 - DNA, 25 bp, Homo sapien
ggaaaaaagaatgtgaagactcagg

SEQ ID NO: 74991 - DNA, 25 bp, Homo sapien
ggaaaaaaggaacacaataaactca

SEQ ID NO: 74992 - DNA, 25 bp, Homo sapien
ggaaaaaataaactttgttagtgac

SEQ ID NO: 74993 - DNA, 25 bp, Homo sapien
ggaaaaaataagcttcagagtgaga

SEQ ID NO: 74994 - DNA, 25 bp, Homo sapien
ggaaaaaatgagcttcagagtgaga

SEQ ID NO: 74995 - DNA, 25 bp, Homo sapien
ggaaaaaatgtaagtgatagataag

SEQ ID NO: 74996 - DNA, 25 bp, Homo sapien
ggaaaaaatgtaagtgctagataag

SEQ ID NO: 74997 - DNA, 25 bp, Homo sapien
ggaaaaagccagcgatggtgcaaca

SEQ ID NO: 74998 - DNA, 25 bp, Homo sapien
ggaaaaagccagggatggtgcaaca

SEQ ID NO: 74999 - DNA, 25 bp, Homo sapien
ggaaaaagggcctgacaaatgatgc

SEQ ID NO: 75000 - DNA, 25 bp, Homo sapien
ggaaaaagggcttgacaaatgatgc

SEQ ID NO: 75001 - DNA, 25 bp, Homo sapien
ggaaaaataacagaaccaataactg

SEQ ID NO: 75002 - DNA, 25 bp, Homo sapien
ggaaaaataacggaaccaataactg

SEQ ID NO: 75003 - DNA, 25 bp, Homo sapien
ggaaaaatgtgaaaatggtacttac

SEQ ID NO: 75004 - DNA, 25 bp, Homo sapien
ggaaaaatgtgaacatggtacttac

SEQ ID NO: 75005 - DNA, 25 bp, Homo sapien
ggaaaaattgccatatattctctat

SEQ ID NO: 75006 - DNA, 25 bp, Homo sapien
ggaaaaattgctatatattctctat

SEQ ID NO: 75007 - DNA, 25 bp, Homo sapien
ggaaaacaagaatgatcttacaagt

SEQ ID NO: 75008 - DNA, 25 bp, Homo sapien
ggaaaacaccaagacaaaaatgaaa

SEQ ID NO: 75009 - DNA, 25 bp, Homo sapien
ggaaaacacgaattccgaaatttct

SEQ ID NO: 75010 - DNA, 25 bp, Homo sapien
ggaaaacagagattgtatcttatgt

SEQ ID NO: 75011 - DNA, 25 bp, Homo sapien
ggaaaacagggattgtatcttatgt

SEQ ID NO: 75012 - DNA, 25 bp, Homo sapien
ggaaaacagttgcataaagcagaat

SEQ ID NO: 75013 - DNA, 25 bp, Homo sapien
ggaaaacagttgcgtaaagcagaat

SEQ ID NO: 75014 - DNA, 25 bp, Homo sapien
ggaaaacatcaagacaaaaatgaaa

SEQ ID NO: 75015 - DNA, 25 bp, Homo sapien
ggaaaacatgaatgatcttacaagt

SEQ ID NO: 75016 - DNA, 25 bp, Homo sapien
ggaaaacatgaattccgaaatttct

SEQ ID NO: 75017 - DNA, 25 bp, Homo sapien
ggaaaacatgatctgatcctagaaa

SEQ ID NO: 75018 - DNA, 25 bp, Homo sapien
ggaaaacatgatttgatcctagaaa

SEQ ID NO: 75019 - DNA, 25 bp, Homo sapien
ggaaaactcaaaacatccacgggta

SEQ ID NO: 75020 - DNA, 25 bp, Homo sapien
ggaaaactcaaagcatccacgggta

SEQ ID NO: 75021 - DNA, 25 bp, Homo sapien
ggaaaagaatgtataaattgatgtg

SEQ ID NO: 75022 - DNA, 25 bp, Homo sapien
ggaaaagaatgtataagttgatgtg

SEQ ID NO: 75023 - DNA, 25 bp, Homo sapien
ggaaaagagaaaaagatgagtaagc

SEQ ID NO: 75024 - DNA, 25 bp, Homo sapien
ggaaaagagaaagagatgagtaagc

SEQ ID NO: 75025 - DNA, 25 bp, Homo sapien
ggaaaagagccatcagtgagaaagt

SEQ ID NO: 75026 - DNA, 25 bp, Homo sapien
ggaaaagagccatccgtgagaaagt

SEQ ID NO: 75027 - DNA, 25 bp, Homo sapien
ggaaaagcactaggaaaagtccaag

SEQ ID NO: 75028 - DNA, 25 bp, Homo sapien
ggaaaagcactaggcaaagtccaag

SEQ ID NO: 75029 - DNA, 25 bp, Homo sapien
ggaaaagcagactactgcaagaagg

SEQ ID NO: 75030 - DNA, 25 bp, Homo sapien
ggaaaagcagagtactgcaagaagg

SEQ ID NO: 75031 - DNA, 25 bp, Homo sapien
ggaaaagccattcacatcaaggttg

SEQ ID NO: 75032 - DNA, 25 bp, Homo sapien
ggaaaagcccaatttaactatggaa

SEQ ID NO: 75033 - DNA, 25 bp, Homo sapien
ggaaaagcccaatttagctatggaa

SEQ ID NO: 75034 - DNA, 25 bp, Homo sapien
ggaaaagccgttcacatcaaggttg

SEQ ID NO: 75035 - DNA, 25 bp, Homo sapien
ggaaaagcgaggagataaaatgccc

SEQ ID NO: 75036 - DNA, 25 bp, Homo sapien
ggaaaagcgaggaggtaaaatgccc

SEQ ID NO: 75037 - DNA, 25 bp, Homo sapien
ggaaaagcttcataatagtttctcc

SEQ ID NO: 75038 - DNA, 25 bp, Homo sapien
ggaaaagcttcatagtagtttctcc

SEQ ID NO: 75039 - DNA, 25 bp, Homo sapien
ggaaaaggagactacatgaggtttt

SEQ ID NO: 75040 - DNA, 25 bp, Homo sapien
ggaaaaggagattacatgaggtttt

SEQ ID NO: 75041 - DNA, 25 bp, Homo sapien
ggaaaaggcctgccagtagagcaaa

SEQ ID NO: 75042 - DNA, 25 bp, Homo sapien
ggaaaaggcctgtcagtagagcaaa

SEQ ID NO: 75043 - DNA, 25 bp, Homo sapien
ggaaaaggctcacgcttcagtagaa

SEQ ID NO: 75044 - DNA, 25 bp, Homo sapien
ggaaaaggctcatgcttcagtagaa

SEQ ID NO: 75045 - DNA, 25 bp, Homo sapien
ggaaaagtttaagaacaaatgcata

SEQ ID NO: 75046 - DNA, 25 bp, Homo sapien
ggaaaagtttaagatcaaatgcata

SEQ ID NO: 75047 - DNA, 25 bp, Homo sapien
ggaaaataaaagcttataactcata

SEQ ID NO: 75048 - DNA, 25 bp, Homo sapien
ggaaaataaaagtttataactcata

SEQ ID NO: 75049 - DNA, 25 bp, Homo sapien
ggaaaatacgtataaggtcccaaat

SEQ ID NO: 75050 - DNA, 25 bp, Homo sapien
ggaaaatatgccgtgactagtcaca

SEQ ID NO: 75051 - DNA, 25 bp, Homo sapien
ggaaaatatgctgtgactagtcaca

SEQ ID NO: 75052 - DNA, 25 bp, Homo sapien
ggaaaatatggcccataaccaggaa

SEQ ID NO: 75053 - DNA, 25 bp, Homo sapien
ggaaaatatggcctataaccaggaa

SEQ ID NO: 75054 - DNA, 25 bp, Homo sapien
ggaaaatatgtataaggtcccaaat

SEQ ID NO: 75055 - DNA, 25 bp, Homo sapien
ggaaaatatttcaagaccatggttt

SEQ ID NO: 75056 - DNA, 25 bp, Homo sapien
ggaaaatatttccagaccatggttt

SEQ ID NO: 75057 - DNA, 25 bp, Homo sapien
ggaaaatccacttaacttcctgaag

SEQ ID NO: 75058 - DNA, 25 bp, Homo sapien
ggaaaatccacttcacttcctgaag

SEQ ID NO: 75059 - DNA, 25 bp, Homo sapien
ggaaaatctggataatctccccatc

SEQ ID NO: 75060 - DNA, 25 bp, Homo sapien
ggaaaatctggatagtctccccatc

SEQ ID NO: 75061 - DNA, 25 bp, Homo sapien
ggaaaatctgtacaatgtgttaccc

SEQ ID NO: 75062 - DNA, 25 bp, Homo sapien
ggaaaatctgtacagtgtgttaccc

SEQ ID NO: 75063 - DNA, 25 bp, Homo sapien
ggaaaatgaaagcaagatgtcctta

SEQ ID NO: 75064 - DNA, 25 bp, Homo sapien
ggaaaatgataacagagtaccctgg

SEQ ID NO: 75065 - DNA, 25 bp, Homo sapien
ggaaaatgataagagagtaccctgg

SEQ ID NO: 75066 - DNA, 25 bp, Homo sapien
ggaaaatgataccctacatacaaaa

SEQ ID NO: 75067 - DNA, 25 bp, Homo sapien
ggaaaatgatactctacatacaaaa

SEQ ID NO: 75068 - DNA, 25 bp, Homo sapien
ggaaaatgcctaggagtgaacaggt

SEQ ID NO: 75069 - DNA, 25 bp, Homo sapien
ggaaaatgcctatgagtgaacaggt

SEQ ID NO: 75070 - DNA, 25 bp, Homo sapien
ggaaaatggaagcaagatgtcctta

SEQ ID NO: 75071 - DNA, 25 bp, Homo sapien
ggaaaatgtattcaaagtgatggag

SEQ ID NO: 75072 - DNA, 25 bp, Homo sapien
ggaaaatgtattcacagtgatggag

SEQ ID NO: 75073 - DNA, 25 bp, Homo sapien
ggaaaatgtcaaatccaaaggaatg

SEQ ID NO: 75074 - DNA, 25 bp, Homo sapien
ggaaaatgtcacatccaaaggaatg

SEQ ID NO: 75075 - DNA, 25 bp, Homo sapien
ggaaaattccgcactggtgctgctc

SEQ ID NO: 75076 - DNA, 25 bp, Homo sapien
ggaaaattctgcactggtgctgctc

SEQ ID NO: 75077 - DNA, 25 bp, Homo sapien
ggaaacaaacaacttgccatgtgat

SEQ ID NO: 75078 - DNA, 25 bp, Homo sapien
ggaaacaaccaacttgccatgtgat

SEQ ID NO: 75079 - DNA, 25 bp, Homo sapien
ggaaacaatttttacaaagaccaaa

SEQ ID NO: 75080 - DNA, 25 bp, Homo sapien
ggaaacaatttttacagagaccaaa

SEQ ID NO: 75081 - DNA, 25 bp, Homo sapien
ggaaacagacaactgttgcattcct

SEQ ID NO: 75082 - DNA, 25 bp, Homo sapien
ggaaacagacaagtgttgcattcct

SEQ ID NO: 75083 - DNA, 25 bp, Homo sapien
ggaaacagaggataaacaggacagt

SEQ ID NO: 75084 - DNA, 25 bp, Homo sapien
ggaaacagaggataaataggacagt

SEQ ID NO: 75085 - DNA, 25 bp, Homo sapien
ggaaacagtacatgcagaggccaca

SEQ ID NO: 75086 - DNA, 25 bp, Homo sapien
ggaaacagtacgtgcagaggccaca

SEQ ID NO: 75087 - DNA, 25 bp, Homo sapien
ggaaacagtcctcaatacccaatat

SEQ ID NO: 75088 - DNA, 25 bp, Homo sapien
ggaaacagtcctgaatacccaatat

SEQ ID NO: 75089 - DNA, 25 bp, Homo sapien
ggaaacataagacaatgcctcttat

SEQ ID NO: 75090 - DNA, 25 bp, Homo sapien
ggaaacataagataatgcctcttat

SEQ ID NO: 75091 - DNA, 25 bp, Homo sapien
ggaaacatgtaccgtacctcaccat

SEQ ID NO: 75092 - DNA, 25 bp, Homo sapien
ggaaacatgtactgtacctcaccat

SEQ ID NO: 75093 - DNA, 25 bp, Homo sapien
ggaaacatttgttgatttggcctat

SEQ ID NO: 75094 - DNA, 25 bp, Homo sapien
ggaaacatttgttggtttggcctat

SEQ ID NO: 75095 - DNA, 25 bp, Homo sapien
ggaaaccacccagaatatagcacag

SEQ ID NO: 75096 - DNA, 25 bp, Homo sapien
ggaaaccacccagaatgtagcacag

SEQ ID NO: 75097 - DNA, 25 bp, Homo sapien
ggaaaccctttacagaagagccttc

SEQ ID NO: 75098 - DNA, 25 bp, Homo sapien
ggaaaccctttagagaagagccttc

SEQ ID NO: 75099 - DNA, 25 bp, Homo sapien
ggaaacctatgcacgtcatgcttta

SEQ ID NO: 75100 - DNA, 25 bp, Homo sapien
ggaaacctatgcccgtcatgcttta

SEQ ID NO: 75101 - DNA, 25 bp, Homo sapien
ggaaactaatatctttgaacatctc

SEQ ID NO: 75102 - DNA, 25 bp, Homo sapien
ggaaactacagaaaattggactccc

SEQ ID NO: 75103 - DNA, 25 bp, Homo sapien
ggaaactacagagaattggactccc

SEQ ID NO: 75104 - DNA, 25 bp, Homo sapien
ggaaactagtatctttgaacatctc

SEQ ID NO: 75105 - DNA, 25 bp, Homo sapien
ggaaactcaaagaaatacaagataa

SEQ ID NO: 75106 - DNA, 25 bp, Homo sapien
ggaaactcaattcgtgctcagcatg

SEQ ID NO: 75107 - DNA, 25 bp, Homo sapien
ggaaactcaatttgtgctcagcatg

SEQ ID NO: 75108 - DNA, 25 bp, Homo sapien
ggaaactcagagaaatacaagataa

SEQ ID NO: 75109 - DNA, 25 bp, Homo sapien
ggaaactcatataaatgtaggagga

SEQ ID NO: 75110 - DNA, 25 bp, Homo sapien
ggaaactcatatagatgtaggagga

SEQ ID NO: 75111 - DNA, 25 bp, Homo sapien
ggaaactcttccctttggagcagca

SEQ ID NO: 75112 - DNA, 25 bp, Homo sapien
ggaaactcttcgctttggagcagca

SEQ ID NO: 75113 - DNA, 25 bp, Homo sapien
ggaaactggactaatgagctgtgtg

SEQ ID NO: 75114 - DNA, 25 bp, Homo sapien
ggaaactggacttatgagctgtgtg

SEQ ID NO: 75115 - DNA, 25 bp, Homo sapien
ggaaacttcaataaactatcctgat

SEQ ID NO: 75116 - DNA, 25 bp, Homo sapien
ggaaacttcaataacctatcctgat

SEQ ID NO: 75117 - DNA, 25 bp, Homo sapien
ggaaagaacaactctaccaactaat

SEQ ID NO: 75118 - DNA, 25 bp, Homo sapien
ggaaagaacaattctaccaactaat

SEQ ID NO: 75119 - DNA, 25 bp, Homo sapien
ggaaagaactgagccagcccagtga

SEQ ID NO: 75120 - DNA, 25 bp, Homo sapien
ggaaagaatggtagatgggaacatc

SEQ ID NO: 75121 - DNA, 25 bp, Homo sapien
ggaaagaatggtaggtgggaacatc

SEQ ID NO: 75122 - DNA, 25 bp, Homo sapien
ggaaagaattgagccagcccagtga

SEQ ID NO: 75123 - DNA, 25 bp, Homo sapien
ggaaagacatcagaaataccaagag

SEQ ID NO: 75124 - DNA, 25 bp, Homo sapien
ggaaagacatcggaaataccaagag

SEQ ID NO: 75125 - DNA, 25 bp, Homo sapien
ggaaagaccaaaaaatcttacgaac

SEQ ID NO: 75126 - DNA, 25 bp, Homo sapien
ggaaagaccaaaaagtcttacgaac

SEQ ID NO: 75127 - DNA, 25 bp, Homo sapien
ggaaagactagacttgctgagtctt

SEQ ID NO: 75128 - DNA, 25 bp, Homo sapien
ggaaagactaggcttgctgagtctt

SEQ ID NO: 75129 - DNA, 25 bp, Homo sapien
ggaaagactatttttccatataaac

SEQ ID NO: 75130 - DNA, 25 bp, Homo sapien
ggaaagactatttttctatataaac

SEQ ID NO: 75131 - DNA, 25 bp, Homo sapien
ggaaagactggcaccaaagttccac

SEQ ID NO: 75132 - DNA, 25 bp, Homo sapien
ggaaagactggcaccagagttccac

SEQ ID NO: 75133 - DNA, 25 bp, Homo sapien
ggaaagagccacatgttcagtgaga

SEQ ID NO: 75134 - DNA, 25 bp, Homo sapien
ggaaagagccagatgttcagtgaga

SEQ ID NO: 75135 - DNA, 25 bp, Homo sapien
ggaaagaggtatctaaaatctccca

SEQ ID NO: 75136 - DNA, 25 bp, Homo sapien
ggaaagaggtatgtaaaatctccca

SEQ ID NO: 75137 - DNA, 25 bp, Homo sapien
ggaaagataatgtgctaaaggcaga

SEQ ID NO: 75138 - DNA, 25 bp, Homo sapien
ggaaagataatgtggtaaaggcaga

SEQ ID NO: 75139 - DNA, 25 bp, Homo sapien
ggaaagcaaaaaaccacgttttcca

SEQ ID NO: 75140 - DNA, 25 bp, Homo sapien
ggaaagcaaaaaaccatgttttcca

SEQ ID NO: 75141 - DNA, 25 bp, Homo sapien
ggaaagcacatggaaaattagggag

SEQ ID NO: 75142 - DNA, 25 bp, Homo sapien
ggaaagcacatggagaattagggag

SEQ ID NO: 75143 - DNA, 25 bp, Homo sapien
ggaaagcatccgacttcttaaaggt

SEQ ID NO: 75144 - DNA, 25 bp, Homo sapien
ggaaagcatccggcttcttaaaggt

SEQ ID NO: 75145 - DNA, 25 bp, Homo sapien
ggaaagctgcaaaggcaaattgaaa

SEQ ID NO: 75146 - DNA, 25 bp, Homo sapien
ggaaagctgcaatggcaaattgaaa

SEQ ID NO: 75147 - DNA, 25 bp, Homo sapien
ggaaaggaaaggagacagggagact

SEQ ID NO: 75148 - DNA, 25 bp, Homo sapien
ggaaaggaaaggcgacagggagact

SEQ ID NO: 75149 - DNA, 25 bp, Homo sapien
ggaaaggagtggccagaccatagag

SEQ ID NO: 75150 - DNA, 25 bp, Homo sapien
ggaaaggagtggccaggccatagag

SEQ ID NO: 75151 - DNA, 25 bp, Homo sapien
ggaaaggatgaatacatttttcggg

SEQ ID NO: 75152 - DNA, 25 bp, Homo sapien
ggaaaggatgattacatttttcggg

SEQ ID NO: 75153 - DNA, 25 bp, Homo sapien
ggaaaggggagttgccattttattg

SEQ ID NO: 75154 - DNA, 25 bp, Homo sapien
ggaaaggggagttgccgttttattg

SEQ ID NO: 75155 - DNA, 25 bp, Homo sapien
ggaaaggtggtacaatataacaaga

SEQ ID NO: 75156 - DNA, 25 bp, Homo sapien
ggaaaggtggtacaatgtaacaaga

SEQ ID NO: 75157 - DNA, 25 bp, Homo sapien
ggaaagtaacacaagtagtgctatt

SEQ ID NO: 75158 - DNA, 25 bp, Homo sapien
ggaaagtaatacaagtagtgctatt

SEQ ID NO: 75159 - DNA, 25 bp, Homo sapien
ggaaagtatggagcatggaaaaatg

SEQ ID NO: 75160 - DNA, 25 bp, Homo sapien
ggaaagtatggagcctggaaaaatg

SEQ ID NO: 75161 - DNA, 25 bp, Homo sapien
ggaaagtccatcttttcgaggccat

SEQ ID NO: 75162 - DNA, 25 bp, Homo sapien
ggaaagtccatctttttgaggccat

SEQ ID NO: 75163 - DNA, 25 bp, Homo sapien
ggaaagtccatggagaagcccacac

SEQ ID NO: 75164 - DNA, 25 bp, Homo sapien
ggaaagtccgtggagaagcccacac

SEQ ID NO: 75165 - DNA, 25 bp, Homo sapien
ggaaagtctatgggatcaaagcatt

SEQ ID NO: 75166 - DNA, 25 bp, Homo sapien
ggaaagtctgtgggatcaaagcatt

SEQ ID NO: 75167 - DNA, 25 bp, Homo sapien
ggaaagttaggcaatgagtccacta

SEQ ID NO: 75168 - DNA, 25 bp, Homo sapien
ggaaagttaggcgatgagtccacta

SEQ ID NO: 75169 - DNA, 25 bp, Homo sapien
ggaaagttgccatgactccacacca

SEQ ID NO: 75170 - DNA, 25 bp, Homo sapien
ggaaagttgccgtgactccacacca

SEQ ID NO: 75171 - DNA, 25 bp, Homo sapien
ggaaagtttgaacccagtgacaatc

SEQ ID NO: 75172 - DNA, 25 bp, Homo sapien
ggaaagtttgaagccagtgacaatc

SEQ ID NO: 75173 - DNA, 25 bp, Homo sapien
ggaaataacagatactcatcattgt

SEQ ID NO: 75174 - DNA, 25 bp, Homo sapien
ggaaataacggccagcataggtgaa

SEQ ID NO: 75175 - DNA, 25 bp, Homo sapien
ggaaataatagatactcatcattgt

SEQ ID NO: 75176 - DNA, 25 bp, Homo sapien
ggaaataatggccagcataggtgaa

SEQ ID NO: 75177 - DNA, 25 bp, Homo sapien
ggaaatacaaatgctggtttattat

SEQ ID NO: 75178 - DNA, 25 bp, Homo sapien
ggaaatacaaatgttggtttattat

SEQ ID NO: 75179 - DNA, 25 bp, Homo sapien
ggaaatacagaattctatccaacca

SEQ ID NO: 75180 - DNA, 25 bp, Homo sapien
ggaaataccaccgcttcttatgcat

SEQ ID NO: 75181 - DNA, 25 bp, Homo sapien
ggaaataccactgcttcttatgcat

SEQ ID NO: 75182 - DNA, 25 bp, Homo sapien
ggaaatactgaattctatccaacca

SEQ ID NO: 75183 - DNA, 25 bp, Homo sapien
ggaaatactttccaacatcgatttt

SEQ ID NO: 75184 - DNA, 25 bp, Homo sapien
ggaaatactttccaacgtcgatttt

SEQ ID NO: 75185 - DNA, 25 bp, Homo sapien
ggaaatagaaggtacgtggattaga

SEQ ID NO: 75186 - DNA, 25 bp, Homo sapien
ggaaatagaaggtatgtggattaga

SEQ ID NO: 75187 - DNA, 25 bp, Homo sapien
ggaaatagattcttggagacacagc

SEQ ID NO: 75188 - DNA, 25 bp, Homo sapien
ggaaatagcacgtatggctcccagg

SEQ ID NO: 75189 - DNA, 25 bp, Homo sapien
ggaaatagcacgtgtggctcccagg

SEQ ID NO: 75190 - DNA, 25 bp, Homo sapien
ggaaatagcctatcaccctggtaca

SEQ ID NO: 75191 - DNA, 25 bp, Homo sapien
ggaaatagcgtatcaccctggtaca

SEQ ID NO: 75192 - DNA, 25 bp, Homo sapien
ggaaataggttcttggagacacagc

SEQ ID NO: 75193 - DNA, 25 bp, Homo sapien
ggaaatatacagctgcaaatgcctt

SEQ ID NO: 75194 - DNA, 25 bp, Homo sapien
ggaaatatatagctgcaaatgcctt

SEQ ID NO: 75195 - DNA, 25 bp, Homo sapien
ggaaatatcgccggccccagtctta

SEQ ID NO: 75196 - DNA, 25 bp, Homo sapien
ggaaatatcgcctgccccagtctta

SEQ ID NO: 75197 - DNA, 25 bp, Homo sapien
ggaaatatgattgcatcagacaatg

SEQ ID NO: 75198 - DNA, 25 bp, Homo sapien
ggaaatatgtttgcatcagacaatg

SEQ ID NO: 75199 - DNA, 25 bp, Homo sapien
ggaaatattaacaggtcttgcatac

SEQ ID NO: 75200 - DNA, 25 bp, Homo sapien
ggaaatattaataggtcttgcatac

SEQ ID NO: 75201 - DNA, 25 bp, Homo sapien
ggaaatcactgcagttttctccatc

SEQ ID NO: 75202 - DNA, 25 bp, Homo sapien
ggaaatcactgccgttttctccatc

SEQ ID NO: 75203 - DNA, 25 bp, Homo sapien
ggaaatccagacacagacatgtgca

SEQ ID NO: 75204 - DNA, 25 bp, Homo sapien
ggaaatccagatacagacatgtgca

SEQ ID NO: 75205 - DNA, 25 bp, Homo sapien
ggaaatctgtacctgcattatactg

SEQ ID NO: 75206 - DNA, 25 bp, Homo sapien
ggaaatctgtacttgcattatactg

SEQ ID NO: 75207 - DNA, 25 bp, Homo sapien
ggaaatgcacatcacaaagacatac

SEQ ID NO: 75208 - DNA, 25 bp, Homo sapien
ggaaatgcacattacaaagacatac

SEQ ID NO: 75209 - DNA, 25 bp, Homo sapien
ggaaatgcccttctgcatatagcca

SEQ ID NO: 75210 - DNA, 25 bp, Homo sapien
ggaaatgcccttttgcatatagcca

SEQ ID NO: 75211 - DNA, 25 bp, Homo sapien
ggaaatgcttcttactgatcatgtg

SEQ ID NO: 75212 - DNA, 25 bp, Homo sapien
ggaaatgcttcttattgatcatgtg

SEQ ID NO: 75213 - DNA, 25 bp, Homo sapien
ggaaatggaatagaatagaaggctg

SEQ ID NO: 75214 - DNA, 25 bp, Homo sapien
ggaaatggagaagaaatgagactga

SEQ ID NO: 75215 - DNA, 25 bp, Homo sapien
ggaaatggagaaggaatgagactga

SEQ ID NO: 75216 - DNA, 25 bp, Homo sapien
ggaaatgggatagaatagaaggctg

SEQ ID NO: 75217 - DNA, 25 bp, Homo sapien
ggaaatgtatacgcccgcttagctc

SEQ ID NO: 75218 - DNA, 25 bp, Homo sapien
ggaaatgtatatgcccgcttagctc

SEQ ID NO: 75219 - DNA, 25 bp, Homo sapien
ggaaatgtattcaattctcttatac

SEQ ID NO: 75220 - DNA, 25 bp, Homo sapien
ggaaatgtattcaattttcttatac

SEQ ID NO: 75221 - DNA, 25 bp, Homo sapien
ggaaatgtccataacatgaattaat

SEQ ID NO: 75222 - DNA, 25 bp, Homo sapien
ggaaatgtccataatatgaattaat

SEQ ID NO: 75223 - DNA, 25 bp, Homo sapien
ggaaatgtgaggaaaggatgcattt

SEQ ID NO: 75224 - DNA, 25 bp, Homo sapien
ggaaatgtgaggaagggatgcattt

SEQ ID NO: 75225 - DNA, 25 bp, Homo sapien
ggaaatgtgaggttgaagtccccac

SEQ ID NO: 75226 - DNA, 25 bp, Homo sapien
ggaaatgtgaggtttaagtccccac

SEQ ID NO: 75227 - DNA, 25 bp, Homo sapien
ggaaatgtgccaagtcacacctgaa

SEQ ID NO: 75228 - DNA, 25 bp, Homo sapien
ggaaatgtgccgagtcacacctgaa

SEQ ID NO: 75229 - DNA, 25 bp, Homo sapien
ggaaatgttcgctgtctgcactgtc

SEQ ID NO: 75230 - DNA, 25 bp, Homo sapien
ggaaatgttcgttgtctgcactgtc

SEQ ID NO: 75231 - DNA, 25 bp, Homo sapien
ggaaatgttctgtatttgcactatc

SEQ ID NO: 75232 - DNA, 25 bp, Homo sapien
ggaaatgttttgtatttgcactatc

SEQ ID NO: 75233 - DNA, 25 bp, Homo sapien
ggaaattaatactagtctaaataga

SEQ ID NO: 75234 - DNA, 25 bp, Homo sapien
ggaaattaatacttgtctaaataga

SEQ ID NO: 75235 - DNA, 25 bp, Homo sapien
ggaaattacgggtagaaattgagat

SEQ ID NO: 75236 - DNA, 25 bp, Homo sapien
ggaaattagtttgattttctattag

SEQ ID NO: 75237 - DNA, 25 bp, Homo sapien
ggaaattatgggtagaaattgagat

SEQ ID NO: 75238 - DNA, 25 bp, Homo sapien
ggaaattattctcaagcctatatcc

SEQ ID NO: 75239 - DNA, 25 bp, Homo sapien
ggaaattattctcaaggctatatcc

SEQ ID NO: 75240 - DNA, 25 bp, Homo sapien
ggaaattattttgattttctattag

SEQ ID NO: 75241 - DNA, 25 bp, Homo sapien
ggaaattcacaaagggtacaataca

SEQ ID NO: 75242 - DNA, 25 bp, Homo sapien
ggaaattcacaaggggtacaataca

SEQ ID NO: 75243 - DNA, 25 bp, Homo sapien
ggaaattccacccaccaaggagaag

SEQ ID NO: 75244 - DNA, 25 bp, Homo sapien
ggaaattccacccgccaaggagaag

SEQ ID NO: 75245 - DNA, 25 bp, Homo sapien
ggaaattgaggatgcctaatgggta

SEQ ID NO: 75246 - DNA, 25 bp, Homo sapien
ggaaattgaggatggctaatgggta

SEQ ID NO: 75247 - DNA, 25 bp, Homo sapien
ggaaattgatggcctcaaaagatag

SEQ ID NO: 75248 - DNA, 25 bp, Homo sapien
ggaaattgatggtctcaaaagatag

SEQ ID NO: 75249 - DNA, 25 bp, Homo sapien
ggaaattgcagccacattccaggaa

SEQ ID NO: 75250 - DNA, 25 bp, Homo sapien
ggaaattgcagccatattccaggaa

SEQ ID NO: 75251 - DNA, 25 bp, Homo sapien
ggaaattgctgcaggtagagactac

SEQ ID NO: 75252 - DNA, 25 bp, Homo sapien
ggaaattgctgcaggtggagactac

SEQ ID NO: 75253 - DNA, 25 bp, Homo sapien
ggaaattggcatgaggagtctatag

SEQ ID NO: 75254 - DNA, 25 bp, Homo sapien
ggaaattggtatgaggagtctatag

SEQ ID NO: 75255 - DNA, 25 bp, Homo sapien
ggaaatttgatggaagagaattgtc

SEQ ID NO: 75256 - DNA, 25 bp, Homo sapien
ggaaatttgatggaagtgaattgtc

SEQ ID NO: 75257 - DNA, 25 bp, Homo sapien
ggaaattttgacacagagctacata

SEQ ID NO: 75258 - DNA, 25 bp, Homo sapien
ggaaattttgacacggagctacata

SEQ ID NO: 75259 - DNA, 25 bp, Homo sapien
ggaacaagcagatgatgttgtgagg

SEQ ID NO: 75260 - DNA, 25 bp, Homo sapien
ggaacaagcagctgatgttgtgagg

SEQ ID NO: 75261 - DNA, 25 bp, Homo sapien
ggaacaatgttcaagattaaatact

SEQ ID NO: 75262 - DNA, 25 bp, Homo sapien
ggaacaatgtttaagattaaatact

SEQ ID NO: 75263 - DNA, 25 bp, Homo sapien
ggaacacaaaatgcagatgtgggac

SEQ ID NO: 75264 - DNA, 25 bp, Homo sapien
ggaacacaaaatgctgatgtgggac

SEQ ID NO: 75265 - DNA, 25 bp, Homo sapien
ggaacacattttcaactggctgcca

SEQ ID NO: 75266 - DNA, 25 bp, Homo sapien
ggaacacatttttaactggctgcca

SEQ ID NO: 75267 - DNA, 25 bp, Homo sapien
ggaacaccacaccggtgatcgcttt

SEQ ID NO: 75268 - DNA, 25 bp, Homo sapien
ggaacaccacagcggtgatcgcttt

SEQ ID NO: 75269 - DNA, 25 bp, Homo sapien
ggaacagacagtatctatcaacagg

SEQ ID NO: 75270 - DNA, 25 bp, Homo sapien
ggaacagacagtatttatcaacagg

SEQ ID NO: 75271 - DNA, 25 bp, Homo sapien
ggaacagcaatgcatgtggtggtgt

SEQ ID NO: 75272 - DNA, 25 bp, Homo sapien
ggaacagcaatgcgtgtggtggtgt

SEQ ID NO: 75273 - DNA, 25 bp, Homo sapien
ggaacagccatgtcttctgaaacac

SEQ ID NO: 75274 - DNA, 25 bp, Homo sapien
ggaacagccgtgtcttctgaaacac

SEQ ID NO: 75275 - DNA, 25 bp, Homo sapien
ggaacagggaaataatgagtcccat

SEQ ID NO: 75276 - DNA, 25 bp, Homo sapien
ggaacagggaattaatgagtcccat

SEQ ID NO: 75277 - DNA, 25 bp, Homo sapien
ggaacagggactttgaatgtcccag

SEQ ID NO: 75278 - DNA, 25 bp, Homo sapien
ggaacagggactttgagtgtcccag

SEQ ID NO: 75279 - DNA, 25 bp, Homo sapien
ggaacattatgcatgtgttacaaag

SEQ ID NO: 75280 - DNA, 25 bp, Homo sapien
ggaacattatgcatgttttacaaag

SEQ ID NO: 75281 - DNA, 25 bp, Homo sapien
ggaacattcaaattcaggaaacatt

SEQ ID NO: 75282 - DNA, 25 bp, Homo sapien
ggaacattcaaatttaggaaacatt

SEQ ID NO: 75283 - DNA, 25 bp, Homo sapien
ggaaccaaacactcctggcaccaag

SEQ ID NO: 75284 - DNA, 25 bp, Homo sapien
ggaaccaaagactcctggcaccaag

SEQ ID NO: 75285 - DNA, 25 bp, Homo sapien
ggaaccaccgatattcatgagatat

SEQ ID NO: 75286 - DNA, 25 bp, Homo sapien
ggaaccaccgatattcgtgagatat

SEQ ID NO: 75287 - DNA, 25 bp, Homo sapien
ggaaccagacagcagaagaaaaggt

SEQ ID NO: 75288 - DNA, 25 bp, Homo sapien
ggaaccagctgatgatattcaagga

SEQ ID NO: 75289 - DNA, 25 bp, Homo sapien
ggaaccagctgatgatgttcaagga

SEQ ID NO: 75290 - DNA, 25 bp, Homo sapien
ggaaccaggcagcagaagaaaaggt

SEQ ID NO: 75291 - DNA, 25 bp, Homo sapien
ggaaccagtctgaataggaggatac

SEQ ID NO: 75292 - DNA, 25 bp, Homo sapien
ggaaccagtctggataggaggatac

SEQ ID NO: 75293 - DNA, 25 bp, Homo sapien
ggaaccatttttgagtgtgacttca

SEQ ID NO: 75294 - DNA, 25 bp, Homo sapien
ggaaccattttttagtgtgacttca

SEQ ID NO: 75295 - DNA, 25 bp, Homo sapien
ggaacccttgcacagtgttagtggg

SEQ ID NO: 75296 - DNA, 25 bp, Homo sapien
ggaacccttgcatagtgttagtggg

SEQ ID NO: 75297 - DNA, 25 bp, Homo sapien
ggaaccgatctctcatccccaacta

SEQ ID NO: 75298 - DNA, 25 bp, Homo sapien
ggaaccgatctgtcatccccaacta

SEQ ID NO: 75299 - DNA, 25 bp, Homo sapien
ggaacctaagataactcaataatct

SEQ ID NO: 75300 - DNA, 25 bp, Homo sapien
ggaacctaagatgactcaataatct

SEQ ID NO: 75301 - DNA, 25 bp, Homo sapien
ggaacctgattttacgaatagtttc

SEQ ID NO: 75302 - DNA, 25 bp, Homo sapien
ggaacctgattttatgaatagtttc

SEQ ID NO: 75303 - DNA, 25 bp, Homo sapien
ggaacctggacagtgataggactag

SEQ ID NO: 75304 - DNA, 25 bp, Homo sapien
ggaacctgggcagtgataggactag

SEQ ID NO: 75305 - DNA, 25 bp, Homo sapien
ggaaccttcataatgctttctgtag

SEQ ID NO: 75306 - DNA, 25 bp, Homo sapien
ggaaccttcctaatgctttctgtag

SEQ ID NO: 75307 - DNA, 25 bp, Homo sapien
ggaacgtgcactttgccgaacatgg

SEQ ID NO: 75308 - DNA, 25 bp, Homo sapien
ggaacgtgcactttgctgaacatgg

SEQ ID NO: 75309 - DNA, 25 bp, Homo sapien
ggaactatgtaaattgattgtgaag

SEQ ID NO: 75310 - DNA, 25 bp, Homo sapien
ggaactatttaaattgattgtgaag

SEQ ID NO: 75311 - DNA, 25 bp, Homo sapien
ggaactccattgagacagtagttag

SEQ ID NO: 75312 - DNA, 25 bp, Homo sapien
ggaactccattgagacggtagttag

SEQ ID NO: 75313 - DNA, 25 bp, Homo sapien
ggaactgaatcctgagttctaacta

SEQ ID NO: 75314 - DNA, 25 bp, Homo sapien
ggaactgaatcttgagttctaacta

SEQ ID NO: 75315 - DNA, 25 bp, Homo sapien
ggaactgcaatattggatctcctgg

SEQ ID NO: 75316 - DNA, 25 bp, Homo sapien
ggaactgcagtattggatctcctgg

SEQ ID NO: 75317 - DNA, 25 bp, Homo sapien
ggaactggaattcttagactgaaag

SEQ ID NO: 75318 - DNA, 25 bp, Homo sapien
ggaactggaatttttagactgaaag

SEQ ID NO: 75319 - DNA, 25 bp, Homo sapien
ggaactggcaagactgaaatttgaa

SEQ ID NO: 75320 - DNA, 25 bp, Homo sapien
ggaactggcaagactggaatttgaa

SEQ ID NO: 75321 - DNA, 25 bp, Homo sapien
ggaactgggcatccgtttctccatt

SEQ ID NO: 75322 - DNA, 25 bp, Homo sapien
ggaactgggcatctgtttctccatt

SEQ ID NO: 75323 - DNA, 25 bp, Homo sapien
ggaactgtctgcaaatagacataag

SEQ ID NO: 75324 - DNA, 25 bp, Homo sapien
ggaactgtctgcacatagacataag

SEQ ID NO: 75325 - DNA, 25 bp, Homo sapien
ggaactgtgtcctgctatgcctgac

SEQ ID NO: 75326 - DNA, 25 bp, Homo sapien
ggaactgtgtcttgctatgcctgac

SEQ ID NO: 75327 - DNA, 25 bp, Homo sapien
ggaactgttaccatgaaaagagggc

SEQ ID NO: 75328 - DNA, 25 bp, Homo sapien
ggaactgttaccatgagaagagggc

SEQ ID NO: 75329 - DNA, 25 bp, Homo sapien
ggaactgttatggacttcattctaa

SEQ ID NO: 75330 - DNA, 25 bp, Homo sapien
ggaactgttatggccttcattctaa

SEQ ID NO: 75331 - DNA, 25 bp, Homo sapien
ggaacttaaggttacgtacagcagt

SEQ ID NO: 75332 - DNA, 25 bp, Homo sapien
ggaacttaaggttaggtacagcagt

SEQ ID NO: 75333 - DNA, 25 bp, Homo sapien
ggaacttaatcattacagttgtggg

SEQ ID NO: 75334 - DNA, 25 bp, Homo sapien
ggaacttaatcattacggttgtggg

SEQ ID NO: 75335 - DNA, 25 bp, Homo sapien
ggaacttacccacggatatacacct

SEQ ID NO: 75336 - DNA, 25 bp, Homo sapien
ggaacttacccatggatatacacct

SEQ ID NO: 75337 - DNA, 25 bp, Homo sapien
ggaacttatttcacactgtatacaa

SEQ ID NO: 75338 - DNA, 25 bp, Homo sapien
ggaacttatttcatactgtatacaa

SEQ ID NO: 75339 - DNA, 25 bp, Homo sapien
ggaacttgcagagcaccaacccagt

SEQ ID NO: 75340 - DNA, 25 bp, Homo sapien
ggaacttgcagagtaccaacccagt

SEQ ID NO: 75341 - DNA, 25 bp, Homo sapien
ggaacttggtgagcatcatcactaa

SEQ ID NO: 75342 - DNA, 25 bp, Homo sapien
ggaacttggtgagcgtcatcactaa

SEQ ID NO: 75343 - DNA, 25 bp, Homo sapien
ggaacttgttaaattgttgtgatta

SEQ ID NO: 75344 - DNA, 25 bp, Homo sapien
ggaacttgttaatttgttgtgatta

SEQ ID NO: 75345 - DNA, 25 bp, Homo sapien
ggaagaaaacgtctgtattgaaagg

SEQ ID NO: 75346 - DNA, 25 bp, Homo sapien
ggaagaaaatggacactctgatact

SEQ ID NO: 75347 - DNA, 25 bp, Homo sapien
ggaagaaaatgtctgtattgaaagg

SEQ ID NO: 75348 - DNA, 25 bp, Homo sapien
ggaagaaagatttggtttctaaaat

SEQ ID NO: 75349 - DNA, 25 bp, Homo sapien
ggaagaaaggtttggtttctaaaat

SEQ ID NO: 75350 - DNA, 25 bp, Homo sapien
ggaagaaataagtccaaattcccca

SEQ ID NO: 75351 - DNA, 25 bp, Homo sapien
ggaagaaataagtccagattcccca

SEQ ID NO: 75352 - DNA, 25 bp, Homo sapien
ggaagaaattggacactctgatact

SEQ ID NO: 75353 - DNA, 25 bp, Homo sapien
ggaagaaccatatcatcaatgtcat

SEQ ID NO: 75354 - DNA, 25 bp, Homo sapien
ggaagaaccatatcgtcaatgtcat

SEQ ID NO: 75355 - DNA, 25 bp, Homo sapien
ggaagaactgtagaggcagcaaagc

SEQ ID NO: 75356 - DNA, 25 bp, Homo sapien
ggaagaactgtagcggcagcaaagc

SEQ ID NO: 75357 - DNA, 25 bp, Homo sapien
ggaagaagaaactgcagagtccctg

SEQ ID NO: 75358 - DNA, 25 bp, Homo sapien
ggaagaagaaattgcagagtccctg

SEQ ID NO: 75359 - DNA, 25 bp, Homo sapien
ggaagaagagcagcctacacttagt

SEQ ID NO: 75360 - DNA, 25 bp, Homo sapien
ggaagaagagcggcctacacttagt

SEQ ID NO: 75361 - DNA, 25 bp, Homo sapien
ggaagaagagtgattaagacagatg

SEQ ID NO: 75362 - DNA, 25 bp, Homo sapien
ggaagaagagtggttaagacagatg

SEQ ID NO: 75363 - DNA, 25 bp, Homo sapien
ggaagaagttagaacaactgtacaa

SEQ ID NO: 75364 - DNA, 25 bp, Homo sapien
ggaagaagttagaataactgtacaa

SEQ ID NO: 75365 - DNA, 25 bp, Homo sapien
ggaagaatttagactcataggggtc

SEQ ID NO: 75366 - DNA, 25 bp, Homo sapien
ggaagaatttatactcataggggtc

SEQ ID NO: 75367 - DNA, 25 bp, Homo sapien
ggaagacaaaaccaacaacaaatta

SEQ ID NO: 75368 - DNA, 25 bp, Homo sapien
ggaagacaaaagcaacaacaaatta

SEQ ID NO: 75369 - DNA, 25 bp, Homo sapien
ggaagactcaaagttccggtggctc

SEQ ID NO: 75370 - DNA, 25 bp, Homo sapien
ggaagactcaaagttctggtggctc

SEQ ID NO: 75371 - DNA, 25 bp, Homo sapien
ggaagactcatgtgagttcagagta

SEQ ID NO: 75372 - DNA, 25 bp, Homo sapien
ggaagactcatttgagttcagagta

SEQ ID NO: 75373 - DNA, 25 bp, Homo sapien
ggaagactctacaaggacatggcat

SEQ ID NO: 75374 - DNA, 25 bp, Homo sapien
ggaagactctataaggacatggcat

SEQ ID NO: 75375 - DNA, 25 bp, Homo sapien
ggaagagaaaaattcaggaatcaaa

SEQ ID NO: 75376 - DNA, 25 bp, Homo sapien
ggaagagaaagcataggacaaggcc

SEQ ID NO: 75377 - DNA, 25 bp, Homo sapien
ggaagagaaagcgtaggacaaggcc

SEQ ID NO: 75378 - DNA, 25 bp, Homo sapien
ggaagagaagaaatgtgggttcctg

SEQ ID NO: 75379 - DNA, 25 bp, Homo sapien
ggaagagaagaaatttgggttcctg

SEQ ID NO: 75380 - DNA, 25 bp, Homo sapien
ggaagagaagaattcaggaatcaaa

SEQ ID NO: 75381 - DNA, 25 bp, Homo sapien
ggaagagcccacagctttcaaattt

SEQ ID NO: 75382 - DNA, 25 bp, Homo sapien
ggaagagcccacaggtttcaaattt

SEQ ID NO: 75383 - DNA, 25 bp, Homo sapien
ggaagagctgtcaagttaattaatc

SEQ ID NO: 75384 - DNA, 25 bp, Homo sapien
ggaagagctgtcaggttaattaatc

SEQ ID NO: 75385 - DNA, 25 bp, Homo sapien
ggaagaggaaaaaattaactgtttc

SEQ ID NO: 75386 - DNA, 25 bp, Homo sapien
ggaagaggaaaaatttaactgtttc

SEQ ID NO: 75387 - DNA, 25 bp, Homo sapien
ggaagaggaaacgatgctgaagact

SEQ ID NO: 75388 - DNA, 25 bp, Homo sapien
ggaagaggaaatgatgctgaagact

SEQ ID NO: 75389 - DNA, 25 bp, Homo sapien
ggaagaggagagacccagctgccgc

SEQ ID NO: 75390 - DNA, 25 bp, Homo sapien
ggaagaggagaggcccagctgccgc

SEQ ID NO: 75391 - DNA, 25 bp, Homo sapien
ggaagaggtggctttgcttacaggt

SEQ ID NO: 75392 - DNA, 25 bp, Homo sapien
ggaagaggtggttttgcttacaggt

SEQ ID NO: 75393 - DNA, 25 bp, Homo sapien
ggaagagtaaaggggaatttgtctt

SEQ ID NO: 75394 - DNA, 25 bp, Homo sapien
ggaagagtaaagggtaatttgtctt

SEQ ID NO: 75395 - DNA, 25 bp, Homo sapien
ggaagagtataaagttccttcttct

SEQ ID NO: 75396 - DNA, 25 bp, Homo sapien
ggaagagtataaagtttcttcttct

SEQ ID NO: 75397 - DNA, 25 bp, Homo sapien
ggaagagtgaagaagaagagaagat

SEQ ID NO: 75398 - DNA, 25 bp, Homo sapien
ggaagagtgaagaagaggagaagat

SEQ ID NO: 75399 - DNA, 25 bp, Homo sapien
ggaagagttttatacaggaaaggat

SEQ ID NO: 75400 - DNA, 25 bp, Homo sapien
ggaagagttttatgcaggaaaggat

SEQ ID NO: 75401 - DNA, 25 bp, Homo sapien
ggaagatcatacaggcatacacaca

SEQ ID NO: 75402 - DNA, 25 bp, Homo sapien
ggaagatcatacaggcgtacacaca

SEQ ID NO: 75403 - DNA, 25 bp, Homo sapien
ggaagatcatttgagctcagcagtt

SEQ ID NO: 75404 - DNA, 25 bp, Homo sapien
ggaagatcgtttgagctcagcagtt

SEQ ID NO: 75405 - DNA, 25 bp, Homo sapien
ggaagatgaagacattcaacttgat

SEQ ID NO: 75406 - DNA, 25 bp, Homo sapien
ggaagatgaagatattcaacttgat

SEQ ID NO: 75407 - DNA, 25 bp, Homo sapien
ggaagatgacaataagtaacaatga

SEQ ID NO: 75408 - DNA, 25 bp, Homo sapien
ggaagatgacagtaagtaacaatga

SEQ ID NO: 75409 - DNA, 25 bp, Homo sapien
ggaagatgttgtatgactaaagaag

SEQ ID NO: 75410 - DNA, 25 bp, Homo sapien
ggaagatgttgtatgagtaaagaag

SEQ ID NO: 75411 - DNA, 25 bp, Homo sapien
ggaagatttttccatgagagagaaa

SEQ ID NO: 75412 - DNA, 25 bp, Homo sapien
ggaagatttttccatgggagagaaa

SEQ ID NO: 75413 - DNA, 25 bp, Homo sapien
ggaagcaaagaaaatactcagttaa

SEQ ID NO: 75414 - DNA, 25 bp, Homo sapien
ggaagcaaagaaaatattcagttaa

SEQ ID NO: 75415 - DNA, 25 bp, Homo sapien
ggaagcaatgtgagttgaaaaaaga

SEQ ID NO: 75416 - DNA, 25 bp, Homo sapien
ggaagcaatttgagttgaaaaaaga

SEQ ID NO: 75417 - DNA, 25 bp, Homo sapien
ggaagcacagagcatgtccagggag

SEQ ID NO: 75418 - DNA, 25 bp, Homo sapien
ggaagcacagagtatgtccagggag

SEQ ID NO: 75419 - DNA, 25 bp, Homo sapien
ggaagcagactgtggacttagttgt

SEQ ID NO: 75420 - DNA, 25 bp, Homo sapien
ggaagcagattgtggacttagttgt

SEQ ID NO: 75421 - DNA, 25 bp, Homo sapien
ggaagcagggaacctaggactgatt

SEQ ID NO: 75422 - DNA, 25 bp, Homo sapien
ggaagcagggaagctaggactgatt

SEQ ID NO: 75423 - DNA, 25 bp, Homo sapien
ggaagcatacacgcccattggattt

SEQ ID NO: 75424 - DNA, 25 bp, Homo sapien
ggaagcatacatgcccattggattt

SEQ ID NO: 75425 - DNA, 25 bp, Homo sapien
ggaagcatttggaaatgactgggga

SEQ ID NO: 75426 - DNA, 25 bp, Homo sapien
ggaagcatttggaattgactgggga

SEQ ID NO: 75427 - DNA, 25 bp, Homo sapien
ggaagccaatttccaatgattaaaa

SEQ ID NO: 75428 - DNA, 25 bp, Homo sapien
ggaagccaatttccgatgattaaaa

SEQ ID NO: 75429 - DNA, 25 bp, Homo sapien
ggaagccactgggttcatcctcccc

SEQ ID NO: 75430 - DNA, 25 bp, Homo sapien
ggaagccagagatgacgcttcacat

SEQ ID NO: 75431 - DNA, 25 bp, Homo sapien
ggaagccagagatgactcttcacat

SEQ ID NO: 75432 - DNA, 25 bp, Homo sapien
ggaagccaggcataagcagctatgt

SEQ ID NO: 75433 - DNA, 25 bp, Homo sapien
ggaagccaggcgtaagcagctatgt

SEQ ID NO: 75434 - DNA, 25 bp, Homo sapien
ggaagccattaagagattattattg

SEQ ID NO: 75435 - DNA, 25 bp, Homo sapien
ggaagccattaggagattattattg

SEQ ID NO: 75436 - DNA, 25 bp, Homo sapien
ggaagccattcttgagctaagtaag

SEQ ID NO: 75437 - DNA, 25 bp, Homo sapien
ggaagccattcttgaggtaagtaag

SEQ ID NO: 75438 - DNA, 25 bp, Homo sapien
ggaagccattgctgcattttaaatg

SEQ ID NO: 75439 - DNA, 25 bp, Homo sapien
ggaagccattgggttcatcctcccc

SEQ ID NO: 75440 - DNA, 25 bp, Homo sapien
ggaagccattggtgcattttaaatg

SEQ ID NO: 75441 - DNA, 25 bp, Homo sapien
ggaagcccacaggacacgtcacctt

SEQ ID NO: 75442 - DNA, 25 bp, Homo sapien
ggaagcccacaggacatgtcacctt

SEQ ID NO: 75443 - DNA, 25 bp, Homo sapien
ggaagcctcaggaagtttacaagca

SEQ ID NO: 75444 - DNA, 25 bp, Homo sapien
ggaagcctcaggaattttacaagca

SEQ ID NO: 75445 - DNA, 25 bp, Homo sapien
ggaagcctctctgttcaaccagaac

SEQ ID NO: 75446 - DNA, 25 bp, Homo sapien
ggaagcctctctgttccaccagaac

SEQ ID NO: 75447 - DNA, 25 bp, Homo sapien
ggaagcgacttcgaaattattatat

SEQ ID NO: 75448 - DNA, 25 bp, Homo sapien
ggaagcgactttgaaattattatat

SEQ ID NO: 75449 - DNA, 25 bp, Homo sapien
ggaagctcactttataaaacaggga

SEQ ID NO: 75450 - DNA, 25 bp, Homo sapien
ggaagctcagtttataaaacaggga

SEQ ID NO: 75451 - DNA, 25 bp, Homo sapien
ggaagctgaacaaattgagaacatg

SEQ ID NO: 75452 - DNA, 25 bp, Homo sapien
ggaagctgaacgaattgagaacatg

SEQ ID NO: 75453 - DNA, 25 bp, Homo sapien
ggaagctggacaggagcgaagagtc

SEQ ID NO: 75454 - DNA, 25 bp, Homo sapien
ggaagctggactggagcgaagagtc

SEQ ID NO: 75455 - DNA, 25 bp, Homo sapien
ggaaggaaactttttgcaagtggca

SEQ ID NO: 75456 - DNA, 25 bp, Homo sapien
ggaaggaaagaaactggcatgttat

SEQ ID NO: 75457 - DNA, 25 bp, Homo sapien
ggaaggaaagagactggcatgttat

SEQ ID NO: 75458 - DNA, 25 bp, Homo sapien
ggaaggaaattttttgcaagtggca

SEQ ID NO: 75459 - DNA, 25 bp, Homo sapien
ggaaggaagccaatcacagggtctc

SEQ ID NO: 75460 - DNA, 25 bp, Homo sapien
ggaaggaagccgatcacagggtctc

SEQ ID NO: 75461 - DNA, 25 bp, Homo sapien
ggaaggaagtaaggatgatcagagc

SEQ ID NO: 75462 - DNA, 25 bp, Homo sapien
ggaaggaagtaagggtgatcagagc

SEQ ID NO: 75463 - DNA, 25 bp, Homo sapien
ggaaggagcctgggtacagaagttt

SEQ ID NO: 75464 - DNA, 25 bp, Homo sapien
ggaaggagcctgtgtacagaagttt

SEQ ID NO: 75465 - DNA, 25 bp, Homo sapien
ggaaggatcaactgtgaatggcaaa

SEQ ID NO: 75466 - DNA, 25 bp, Homo sapien
ggaaggatcgactgtgaatggcaaa

SEQ ID NO: 75467 - DNA, 25 bp, Homo sapien
ggaaggcagaaaaaacaaagctgga

SEQ ID NO: 75468 - DNA, 25 bp, Homo sapien
ggaaggcagaaaaagcaaagctgga

SEQ ID NO: 75469 - DNA, 25 bp, Homo sapien
ggaaggcagactcatgattattcca

SEQ ID NO: 75470 - DNA, 25 bp, Homo sapien
ggaaggcagactcgtgattattcca

SEQ ID NO: 75471 - DNA, 25 bp, Homo sapien
ggaaggcgttttattcacatcagtt

SEQ ID NO: 75472 - DNA, 25 bp, Homo sapien
ggaaggcgttttattcgcatcagtt

SEQ ID NO: 75473 - DNA, 25 bp, Homo sapien
ggaaggctgaactggatgctcacca

SEQ ID NO: 75474 - DNA, 25 bp, Homo sapien
ggaaggctgaattggatgctcacca

SEQ ID NO: 75475 - DNA, 25 bp, Homo sapien
ggaagggacgagaccaaaaagaaaa

SEQ ID NO: 75476 - DNA, 25 bp, Homo sapien
ggaagggatgagaccaaaaagaaaa

SEQ ID NO: 75477 - DNA, 25 bp, Homo sapien
ggaagggggtcagaaacatttggat

SEQ ID NO: 75478 - DNA, 25 bp, Homo sapien
ggaagggggtcagaaatatttggat

SEQ ID NO: 75479 - DNA, 25 bp, Homo sapien
ggaaggtcacagtgattgtcacatg

SEQ ID NO: 75480 - DNA, 25 bp, Homo sapien
ggaaggtcagagtgattgtcacatg

SEQ ID NO: 75481 - DNA, 25 bp, Homo sapien
ggaaggtcagttaagagaagactaa

SEQ ID NO: 75482 - DNA, 25 bp, Homo sapien
ggaaggtcagttgagagaagactaa

SEQ ID NO: 75483 - DNA, 25 bp, Homo sapien
ggaaggtcctgcgagctgcggctgt

SEQ ID NO: 75484 - DNA, 25 bp, Homo sapien
ggaaggtcctgtgagctgcggctgt

SEQ ID NO: 75485 - DNA, 25 bp, Homo sapien
ggaaggtgctactgacatgtgctac

SEQ ID NO: 75486 - DNA, 25 bp, Homo sapien
ggaaggtggtactgacatgtgctac

SEQ ID NO: 75487 - DNA, 25 bp, Homo sapien
ggaaggtgtgaactttgaaaatttg

SEQ ID NO: 75488 - DNA, 25 bp, Homo sapien
ggaaggtgtgatctttgaaaatttg

SEQ ID NO: 75489 - DNA, 25 bp, Homo sapien
ggaaggttgtgcgtttaatctttag

SEQ ID NO: 75490 - DNA, 25 bp, Homo sapien
ggaaggttgtgtgtttaatctttag

SEQ ID NO: 75491 - DNA, 25 bp, Homo sapien
ggaagtaaagtacacttagaagagg

SEQ ID NO: 75492 - DNA, 25 bp, Homo sapien
ggaagtaaagtgcacttagaagagg

SEQ ID NO: 75493 - DNA, 25 bp, Homo sapien
ggaagtaactacaaatataatgctt

SEQ ID NO: 75494 - DNA, 25 bp, Homo sapien
ggaagtaactacaagtataatgctt

SEQ ID NO: 75495 - DNA, 25 bp, Homo sapien
ggaagtaataacaaaccagaaacag

SEQ ID NO: 75496 - DNA, 25 bp, Homo sapien
ggaagtaataagaaaccagaaacag

SEQ ID NO: 75497 - DNA, 25 bp, Homo sapien
ggaagtacagacctaccaagtgctt

SEQ ID NO: 75498 - DNA, 25 bp, Homo sapien
ggaagtacagatctaccaagtgctt

SEQ ID NO: 75499 - DNA, 25 bp, Homo sapien
ggaagtagaaatgcttggagataaa

SEQ ID NO: 75500 - DNA, 25 bp, Homo sapien
ggaagtagaaattcttggagataaa

SEQ ID NO: 75501 - DNA, 25 bp, Homo sapien
ggaagtagataataagactgttgcc

SEQ ID NO: 75502 - DNA, 25 bp, Homo sapien
ggaagtagataatcagactgttgcc

SEQ ID NO: 75503 - DNA, 25 bp, Homo sapien
ggaagtagcagcaaacctaatgctc

SEQ ID NO: 75504 - DNA, 25 bp, Homo sapien
ggaagtagcagcagacctaatgctc

SEQ ID NO: 75505 - DNA, 25 bp, Homo sapien
ggaagtagttgttctcagatgtggg

SEQ ID NO: 75506 - DNA, 25 bp, Homo sapien
ggaagtagttgttttcagatgtggg

SEQ ID NO: 75507 - DNA, 25 bp, Homo sapien
ggaagtatcacgatttatcttcctt

SEQ ID NO: 75508 - DNA, 25 bp, Homo sapien
ggaagtatcacgatttctcttcctt

SEQ ID NO: 75509 - DNA, 25 bp, Homo sapien
ggaagtcaggccagcagtctgaaaa

SEQ ID NO: 75510 - DNA, 25 bp, Homo sapien
ggaagtcaggccggcagtctgaaaa

SEQ ID NO: 75511 - DNA, 25 bp, Homo sapien
ggaagtcatagaggacacttatggg

SEQ ID NO: 75512 - DNA, 25 bp, Homo sapien
ggaagtcatagagtacacttatggg

SEQ ID NO: 75513 - DNA, 25 bp, Homo sapien
ggaagtgaaactcagataaattaaa

SEQ ID NO: 75514 - DNA, 25 bp, Homo sapien
ggaagtgaaactcggataaattaaa

SEQ ID NO: 75515 - DNA, 25 bp, Homo sapien
ggaagtgacagaagggatgtatatg

SEQ ID NO: 75516 - DNA, 25 bp, Homo sapien
ggaagtgacagaagggttgtatatg

SEQ ID NO: 75517 - DNA, 25 bp, Homo sapien
ggaagtgattctccttcacttttgc

SEQ ID NO: 75518 - DNA, 25 bp, Homo sapien
ggaagtgattctctttcacttttgc

SEQ ID NO: 75519 - DNA, 25 bp, Homo sapien
ggaagtgccaccaaacctctgatac

SEQ ID NO: 75520 - DNA, 25 bp, Homo sapien
ggaagtgccgccaaacctctgatac

SEQ ID NO: 75521 - DNA, 25 bp, Homo sapien
ggaagtgccttacacgttcacgcag

SEQ ID NO: 75522 - DNA, 25 bp, Homo sapien
ggaagtgccttacatgttcacgcag

SEQ ID NO: 75523 - DNA, 25 bp, Homo sapien
ggaagtgtaattcgcctgcctagct

SEQ ID NO: 75524 - DNA, 25 bp, Homo sapien
ggaagtgtaatttgcctgcctagct

SEQ ID NO: 75525 - DNA, 25 bp, Homo sapien
ggaagtgtgtcatacgctgccaagt

SEQ ID NO: 75526 - DNA, 25 bp, Homo sapien
ggaagtgtgtcataggctgccaagt

SEQ ID NO: 75527 - DNA, 25 bp, Homo sapien
ggaagtgttggattcagacacgcat

SEQ ID NO: 75528 - DNA, 25 bp, Homo sapien
ggaagtgttggatttagacacgcat

SEQ ID NO: 75529 - DNA, 25 bp, Homo sapien
ggaagttagaaactatgacctagag

SEQ ID NO: 75530 - DNA, 25 bp, Homo sapien
ggaagttagaatctatgacctagag

SEQ ID NO: 75531 - DNA, 25 bp, Homo sapien
ggaagttcttccaagccaccaccga

SEQ ID NO: 75532 - DNA, 25 bp, Homo sapien
ggaagttcttccaggccaccaccga

SEQ ID NO: 75533 - DNA, 25 bp, Homo sapien
ggaagttgagttttgaatatgctca

SEQ ID NO: 75534 - DNA, 25 bp, Homo sapien
ggaagttgcgttttgaatatgctca

SEQ ID NO: 75535 - DNA, 25 bp, Homo sapien
ggaagttgctatcttattgccataa

SEQ ID NO: 75536 - DNA, 25 bp, Homo sapien
ggaagttggtatcttattgccataa

SEQ ID NO: 75537 - DNA, 25 bp, Homo sapien
ggaagttttataagaaatcagattg

SEQ ID NO: 75538 - DNA, 25 bp, Homo sapien
ggaagttttgtaagaaatcagattg

SEQ ID NO: 75539 - DNA, 25 bp, Homo sapien
ggaataaaaagatttagagtcagac

SEQ ID NO: 75540 - DNA, 25 bp, Homo sapien
ggaataaaaccaaaaaagatcattc

SEQ ID NO: 75541 - DNA, 25 bp, Homo sapien
ggaataaacagatttagagtcagac

SEQ ID NO: 75542 - DNA, 25 bp, Homo sapien
ggaataaagccaaaaaagatcattc

SEQ ID NO: 75543 - DNA, 25 bp, Homo sapien
ggaataacatcacagagaattttaa

SEQ ID NO: 75544 - DNA, 25 bp, Homo sapien
ggaataacatcacagataattttaa

SEQ ID NO: 75545 - DNA, 25 bp, Homo sapien
ggaataagaaaccacagatggaaaa

SEQ ID NO: 75546 - DNA, 25 bp, Homo sapien
ggaataagaaacgacagatggaaaa

SEQ ID NO: 75547 - DNA, 25 bp, Homo sapien
ggaataaggaatccagtaacttgaa

SEQ ID NO: 75548 - DNA, 25 bp, Homo sapien
ggaataaggaatccggtaacttgaa

SEQ ID NO: 75549 - DNA, 25 bp, Homo sapien
ggaataagttttgctggttttccta

SEQ ID NO: 75550 - DNA, 25 bp, Homo sapien
ggaataagttttgttggttttccta

SEQ ID NO: 75551 - DNA, 25 bp, Homo sapien
ggaataatgcaagaggtagtatggt

SEQ ID NO: 75552 - DNA, 25 bp, Homo sapien
ggaataatgcaggaggtagtatggt

SEQ ID NO: 75553 - DNA, 25 bp, Homo sapien
ggaataattagcacaataggcagca

SEQ ID NO: 75554 - DNA, 25 bp, Homo sapien
ggaataattagcagaataggcagca

SEQ ID NO: 75555 - DNA, 25 bp, Homo sapien
ggaataattcagacgatcttaatag

SEQ ID NO: 75556 - DNA, 25 bp, Homo sapien
ggaataattcagatgatcttaatag

SEQ ID NO: 75557 - DNA, 25 bp, Homo sapien
ggaatacaaaaatagttcatcatat

SEQ ID NO: 75558 - DNA, 25 bp, Homo sapien
ggaatacaaaaatggttcatcatat

SEQ ID NO: 75559 - DNA, 25 bp, Homo sapien
ggaatagaagtcacaacatatccag

SEQ ID NO: 75560 - DNA, 25 bp, Homo sapien
ggaatagaagtcgcaacatatccag

SEQ ID NO: 75561 - DNA, 25 bp, Homo sapien
ggaataggagcacggaggccaagtt

SEQ ID NO: 75562 - DNA, 25 bp, Homo sapien
ggaataggagcatggaggccaagtt

SEQ ID NO: 75563 - DNA, 25 bp, Homo sapien
ggaataggccagaaagagggacatt

SEQ ID NO: 75564 - DNA, 25 bp, Homo sapien
ggaataggcgagaaagagggacatt

SEQ ID NO: 75565 - DNA, 25 bp, Homo sapien
ggaatatgaaaaagccacttgggtc

SEQ ID NO: 75566 - DNA, 25 bp, Homo sapien
ggaatatgaaaaggccacttgggtc

SEQ ID NO: 75567 - DNA, 25 bp, Homo sapien
ggaatcaagcatacaacgatagaaa

SEQ ID NO: 75568 - DNA, 25 bp, Homo sapien
ggaatcaagcatacaaggatagaaa

SEQ ID NO: 75569 - DNA, 25 bp, Homo sapien
ggaatcacagctccttgcatcccat

SEQ ID NO: 75570 - DNA, 25 bp, Homo sapien
ggaatcacagcttcttgcatcccat

SEQ ID NO: 75571 - DNA, 25 bp, Homo sapien
ggaatcagccttctctgccacgaat

SEQ ID NO: 75572 - DNA, 25 bp, Homo sapien
ggaatcagccttttctgccacgaat

SEQ ID NO: 75573 - DNA, 25 bp, Homo sapien
ggaatcagggacgtttcctggagga

SEQ ID NO: 75574 - DNA, 25 bp, Homo sapien
ggaatcagggacttttcctggagga

SEQ ID NO: 75575 - DNA, 25 bp, Homo sapien
ggaatcatctagggtctaatgggta

SEQ ID NO: 75576 - DNA, 25 bp, Homo sapien
ggaatcatctagtgtctaatgggta

SEQ ID NO: 75577 - DNA, 25 bp, Homo sapien
ggaatcctccaaaaatgaacacaga

SEQ ID NO: 75578 - DNA, 25 bp, Homo sapien
ggaatcctccagaaatgaacacaga

SEQ ID NO: 75579 - DNA, 25 bp, Homo sapien
ggaatcctttaaatcacgaaaagcc

SEQ ID NO: 75580 - DNA, 25 bp, Homo sapien
ggaatcctttaaatcatgaaaagcc

SEQ ID NO: 75581 - DNA, 25 bp, Homo sapien
ggaatctatcttgagaatggaattt

SEQ ID NO: 75582 - DNA, 25 bp, Homo sapien
ggaatctatcttgagagtggaattt

SEQ ID NO: 75583 - DNA, 25 bp, Homo sapien
ggaatctcactaccctcatatctgg

SEQ ID NO: 75584 - DNA, 25 bp, Homo sapien
ggaatctcattaccctcatatctgg

SEQ ID NO: 75585 - DNA, 25 bp, Homo sapien
ggaatctgagcatctcagaatagcc

SEQ ID NO: 75586 - DNA, 25 bp, Homo sapien
ggaatctgagcatgtcagaatagcc

SEQ ID NO: 75587 - DNA, 25 bp, Homo sapien
ggaatgaacaagagtttaagagatg

SEQ ID NO: 75588 - DNA, 25 bp, Homo sapien
ggaatgaaccagagtttaagagatg

SEQ ID NO: 75589 - DNA, 25 bp, Homo sapien
ggaatgaattttacaaccagacata

SEQ ID NO: 75590 - DNA, 25 bp, Homo sapien
ggaatgaattttagaaccagacata

SEQ ID NO: 75591 - DNA, 25 bp, Homo sapien
ggaatgacagaatcgggtatgtgag

SEQ ID NO: 75592 - DNA, 25 bp, Homo sapien
ggaatgacagaattgggtatgtgag

SEQ ID NO: 75593 - DNA, 25 bp, Homo sapien
ggaatgacagacataatcaacagtt

SEQ ID NO: 75594 - DNA, 25 bp, Homo sapien
ggaatgacagacatcatcaacagtt

SEQ ID NO: 75595 - DNA, 25 bp, Homo sapien
ggaatgacctacatagcattaaaac

SEQ ID NO: 75596 - DNA, 25 bp, Homo sapien
ggaatgacctatatagcattaaaac

SEQ ID NO: 75597 - DNA, 25 bp, Homo sapien
ggaatgacttgagtagtcaaagggc

SEQ ID NO: 75598 - DNA, 25 bp, Homo sapien
ggaatgacttgcgtagtcaaagggc

SEQ ID NO: 75599 - DNA, 25 bp, Homo sapien
ggaatgagaaaggacttgtttgtct

SEQ ID NO: 75600 - DNA, 25 bp, Homo sapien
ggaatgagaagaaccttacagtagc

SEQ ID NO: 75601 - DNA, 25 bp, Homo sapien
ggaatgagaagacccttacagtagc

SEQ ID NO: 75602 - DNA, 25 bp, Homo sapien
ggaatgagaattacatcatctgctt

SEQ ID NO: 75603 - DNA, 25 bp, Homo sapien
ggaatgagaattacttcatctgctt

SEQ ID NO: 75604 - DNA, 25 bp, Homo sapien
ggaatgagagaggacttgtttgtct

SEQ ID NO: 75605 - DNA, 25 bp, Homo sapien
ggaatgagattaagaactggaataa

SEQ ID NO: 75606 - DNA, 25 bp, Homo sapien
ggaatgagattaagaattggaataa

SEQ ID NO: 75607 - DNA, 25 bp, Homo sapien
ggaatgagcaaattgtggtatattc

SEQ ID NO: 75608 - DNA, 25 bp, Homo sapien
ggaatgagcaaattttggtatattc

SEQ ID NO: 75609 - DNA, 25 bp, Homo sapien
ggaatgattgttccgagggttttgt

SEQ ID NO: 75610 - DNA, 25 bp, Homo sapien
ggaatgattgttctgagggttttgt

SEQ ID NO: 75611 - DNA, 25 bp, Homo sapien
ggaatgcatatacactatcaaattt

SEQ ID NO: 75612 - DNA, 25 bp, Homo sapien
ggaatgcatgataagctgggttctt

SEQ ID NO: 75613 - DNA, 25 bp, Homo sapien
ggaatgcatgataatctgggttctt

SEQ ID NO: 75614 - DNA, 25 bp, Homo sapien
ggaatgcatgtacactatcaaattt

SEQ ID NO: 75615 - DNA, 25 bp, Homo sapien
ggaatgccataaacagaagtatttt

SEQ ID NO: 75616 - DNA, 25 bp, Homo sapien
ggaatgccgtaaacagaagtatttt

SEQ ID NO: 75617 - DNA, 25 bp, Homo sapien
ggaatggagatccaggtttctgaga

SEQ ID NO: 75618 - DNA, 25 bp, Homo sapien
ggaatggaggtccaggtttctgaga

SEQ ID NO: 75619 - DNA, 25 bp, Homo sapien
ggaatgggaataatgtgatgaaaac

SEQ ID NO: 75620 - DNA, 25 bp, Homo sapien
ggaatgggaatattgtgatgaaaac

SEQ ID NO: 75621 - DNA, 25 bp, Homo sapien
ggaatggtatcaataaagagatgaa

SEQ ID NO: 75622 - DNA, 25 bp, Homo sapien
ggaatggtatcagtaaagagatgaa

SEQ ID NO: 75623 - DNA, 25 bp, Homo sapien
ggaatgtaaacactatatgcctgtg

SEQ ID NO: 75624 - DNA, 25 bp, Homo sapien
ggaatgtaaacagtatatgcctgtg

SEQ ID NO: 75625 - DNA, 25 bp, Homo sapien
ggaatgtaagaagaatctgctggga

SEQ ID NO: 75626 - DNA, 25 bp, Homo sapien
ggaatgtaagaggaatctgctggga

SEQ ID NO: 75627 - DNA, 25 bp, Homo sapien
ggaatgtcaaagataaagtgcaaca

SEQ ID NO: 75628 - DNA, 25 bp, Homo sapien
ggaatgtcaaaggtaaagtgcaaca

SEQ ID NO: 75629 - DNA, 25 bp, Homo sapien
ggaatgttaaacacctcttgatcac

SEQ ID NO: 75630 - DNA, 25 bp, Homo sapien
ggaatgttaaagacctcttgatcac

SEQ ID NO: 75631 - DNA, 25 bp, Homo sapien
ggaattaacaaacagcctaaactct

SEQ ID NO: 75632 - DNA, 25 bp, Homo sapien
ggaattaacaaacagcgtaaactct

SEQ ID NO: 75633 - DNA, 25 bp, Homo sapien
ggaattacattacgcaaatgaaaac

SEQ ID NO: 75634 - DNA, 25 bp, Homo sapien
ggaattacattaggcaaatgaaaac

SEQ ID NO: 75635 - DNA, 25 bp, Homo sapien
ggaattatgcaggtaaacgtgtgct

SEQ ID NO: 75636 - DNA, 25 bp, Homo sapien
ggaattatgcaggtaatcgtgtgct

SEQ ID NO: 75637 - DNA, 25 bp, Homo sapien
ggaattccatttctgtatatgttca

SEQ ID NO: 75638 - DNA, 25 bp, Homo sapien
ggaattccatttctttatatgttca

SEQ ID NO: 75639 - DNA, 25 bp, Homo sapien
ggaattcttgacctggttaagggag

SEQ ID NO: 75640 - DNA, 25 bp, Homo sapien
ggaattcttgacttggttaagggag

SEQ ID NO: 75641 - DNA, 25 bp, Homo sapien
ggaattgacaggagagttgcttcaa

SEQ ID NO: 75642 - DNA, 25 bp, Homo sapien
ggaattgagaggagagttgcttcaa

SEQ ID NO: 75643 - DNA, 25 bp, Homo sapien
ggaattggaaatggaatagaataga

SEQ ID NO: 75644 - DNA, 25 bp, Homo sapien
ggaattggaaatgggatagaataga

SEQ ID NO: 75645 - DNA, 25 bp, Homo sapien
ggaattgggctggatgtggctcagc

SEQ ID NO: 75646 - DNA, 25 bp, Homo sapien
ggaattggggcattggaaagtaatt

SEQ ID NO: 75647 - DNA, 25 bp, Homo sapien
ggaattggggcattgggaagtaatt

SEQ ID NO: 75648 - DNA, 25 bp, Homo sapien
ggaattgggtaaacagttcttagga

SEQ ID NO: 75649 - DNA, 25 bp, Homo sapien
ggaattgggtatacagttcttagga

SEQ ID NO: 75650 - DNA, 25 bp, Homo sapien
ggaattgggttggatgtggctcagc

SEQ ID NO: 75651 - DNA, 25 bp, Homo sapien
ggaattgtgtggaatggaatagagg

SEQ ID NO: 75652 - DNA, 25 bp, Homo sapien
ggaattgtgtgtaatggaatagagg

SEQ ID NO: 75653 - DNA, 25 bp, Homo sapien
ggaatttcactgtgttcagagtctg

SEQ ID NO: 75654 - DNA, 25 bp, Homo sapien
ggaatttcattgtgttcagagtctg

SEQ ID NO: 75655 - DNA, 25 bp, Homo sapien
ggaatttgcaacacttacacatttt

SEQ ID NO: 75656 - DNA, 25 bp, Homo sapien
ggaatttgcaatacttacacatttt

SEQ ID NO: 75657 - DNA, 25 bp, Homo sapien
ggaatttggaatcaagatagtttgg

SEQ ID NO: 75658 - DNA, 25 bp, Homo sapien
ggaatttggaatcgagatagtttgg

SEQ ID NO: 75659 - DNA, 25 bp, Homo sapien
ggaatttgtggattggtcttagttc

SEQ ID NO: 75660 - DNA, 25 bp, Homo sapien
ggaatttgtgggttggtcttagttc

SEQ ID NO: 75661 - DNA, 25 bp, Homo sapien
ggaattttaaaaactgcctggtaca

SEQ ID NO: 75662 - DNA, 25 bp, Homo sapien
ggaattttaaacactgcctggtaca

SEQ ID NO: 75663 - DNA, 25 bp, Homo sapien
ggaattttatcatttttctgatcct

SEQ ID NO: 75664 - DNA, 25 bp, Homo sapien
ggaattttatcgtttttctgatcct

SEQ ID NO: 75665 - DNA, 25 bp, Homo sapien
ggaattttcatactggcatggaaag

SEQ ID NO: 75666 - DNA, 25 bp, Homo sapien
ggaattttcatcctggcatggaaag

SEQ ID NO: 75667 - DNA, 25 bp, Homo sapien
ggaatttttatttgagacagatgac

SEQ ID NO: 75668 - DNA, 25 bp, Homo sapien
ggaatttttgtttgagacagatgac

SEQ ID NO: 75669 - DNA, 25 bp, Homo sapien
ggacaaaaagaactgtaaaggtcaa

SEQ ID NO: 75670 - DNA, 25 bp, Homo sapien
ggacaaaaagaattgtaaaggtcaa

SEQ ID NO: 75671 - DNA, 25 bp, Homo sapien
ggacaaacaagtaagaagtttccca

SEQ ID NO: 75672 - DNA, 25 bp, Homo sapien
ggacaaacaagtcagaagtttccca

SEQ ID NO: 75673 - DNA, 25 bp, Homo sapien
ggacaaactttacagaagactagta

SEQ ID NO: 75674 - DNA, 25 bp, Homo sapien
ggacaaactttagagaagactagta

SEQ ID NO: 75675 - DNA, 25 bp, Homo sapien
ggacaaagagggcacgggctccgca

SEQ ID NO: 75676 - DNA, 25 bp, Homo sapien
ggacaaagagggcatgggctccgca

SEQ ID NO: 75677 - DNA, 25 bp, Homo sapien
ggacaaagcactacactggctctcg

SEQ ID NO: 75678 - DNA, 25 bp, Homo sapien
ggacaaagcactatactggctctcg

SEQ ID NO: 75679 - DNA, 25 bp, Homo sapien
ggacaaagtgacctcaaaatcaacc

SEQ ID NO: 75680 - DNA, 25 bp, Homo sapien
ggacaaagtgacctcagaatcaacc

SEQ ID NO: 75681 - DNA, 25 bp, Homo sapien
ggacaaataatacaagagaaaaaga

SEQ ID NO: 75682 - DNA, 25 bp, Homo sapien
ggacaaataatataagagaaaaaga

SEQ ID NO: 75683 - DNA, 25 bp, Homo sapien
ggacaaatatactcctcagtccatg

SEQ ID NO: 75684 - DNA, 25 bp, Homo sapien
ggacaaatatactcctgagtccatg

SEQ ID NO: 75685 - DNA, 25 bp, Homo sapien
ggacaaccttgataagaccccacta

SEQ ID NO: 75686 - DNA, 25 bp, Homo sapien
ggacaaccttggtaagaccccacta

SEQ ID NO: 75687 - DNA, 25 bp, Homo sapien
ggacaagaatacaatacagtactta

SEQ ID NO: 75688 - DNA, 25 bp, Homo sapien
ggacaagaatacgatacagtactta

SEQ ID NO: 75689 - DNA, 25 bp, Homo sapien
ggacaagaatatgccttcccagaca

SEQ ID NO: 75690 - DNA, 25 bp, Homo sapien
ggacaagaatattccttcccagaca

SEQ ID NO: 75691 - DNA, 25 bp, Homo sapien
ggacaagacatgttgacaaacccag

SEQ ID NO: 75692 - DNA, 25 bp, Homo sapien
ggacaagatatgttgacaaacccag

SEQ ID NO: 75693 - DNA, 25 bp, Homo sapien
ggacaatcctaatctagtcattaac

SEQ ID NO: 75694 - DNA, 25 bp, Homo sapien
ggacaatcgaacaatgtgatttgtg

SEQ ID NO: 75695 - DNA, 25 bp, Homo sapien
ggacaatctaacaatgtgatttgtg

SEQ ID NO: 75696 - DNA, 25 bp, Homo sapien
ggacaatcttaatctagtcattaac

SEQ ID NO: 75697 - DNA, 25 bp, Homo sapien
ggacaatgagggacaggtctgtgca

SEQ ID NO: 75698 - DNA, 25 bp, Homo sapien
ggacaatgatttctaagcacctgta

SEQ ID NO: 75699 - DNA, 25 bp, Homo sapien
ggacaatgatttgtaagcacctgta

SEQ ID NO: 75700 - DNA, 25 bp, Homo sapien
ggacaatgcgggacaggtctgtgca

SEQ ID NO: 75701 - DNA, 25 bp, Homo sapien
ggacaatgggaccacataattgaag

SEQ ID NO: 75702 - DNA, 25 bp, Homo sapien
ggacaatgggactacataattgaag

SEQ ID NO: 75703 - DNA, 25 bp, Homo sapien
ggacaattagagaatgaatgcctag

SEQ ID NO: 75704 - DNA, 25 bp, Homo sapien
ggacaattagaggatgaatgcctag

SEQ ID NO: 75705 - DNA, 25 bp, Homo sapien
ggacacagagagaaggcatctgtct

SEQ ID NO: 75706 - DNA, 25 bp, Homo sapien
ggacacagagaggcgtgaaagtaga

SEQ ID NO: 75707 - DNA, 25 bp, Homo sapien
ggacacagagaggtgtgaaagtaga

SEQ ID NO: 75708 - DNA, 25 bp, Homo sapien
ggacacagagcggcgctgccaccac

SEQ ID NO: 75709 - DNA, 25 bp, Homo sapien
ggacacagagcggtgctgccaccac

SEQ ID NO: 75710 - DNA, 25 bp, Homo sapien
ggacacagcgagaaggcatctgtct

SEQ ID NO: 75711 - DNA, 25 bp, Homo sapien
ggacaccacattgaacccctggcca

SEQ ID NO: 75712 - DNA, 25 bp, Homo sapien
ggacaccacgttgaacccctggcca

SEQ ID NO: 75713 - DNA, 25 bp, Homo sapien
ggacaccagagcaggatgagctgaa

SEQ ID NO: 75714 - DNA, 25 bp, Homo sapien
ggacaccagagtaggatgagctgaa

SEQ ID NO: 75715 - DNA, 25 bp, Homo sapien
ggacaccatcgggaatgtgctgtac

SEQ ID NO: 75716 - DNA, 25 bp, Homo sapien
ggacaccattgggaatgtgctgtac

SEQ ID NO: 75717 - DNA, 25 bp, Homo sapien
ggacacccaaatacgctggcttgat

SEQ ID NO: 75718 - DNA, 25 bp, Homo sapien
ggacacccaaatatgctggcttgat

SEQ ID NO: 75719 - DNA, 25 bp, Homo sapien
ggacacctcaaaacagtggtgaggt

SEQ ID NO: 75720 - DNA, 25 bp, Homo sapien
ggacacctcaaaacggtggtgaggt

SEQ ID NO: 75721 - DNA, 25 bp, Homo sapien
ggacacgtactggctttggctttct

SEQ ID NO: 75722 - DNA, 25 bp, Homo sapien
ggacacgtactgtctttggctttct

SEQ ID NO: 75723 - DNA, 25 bp, Homo sapien
ggacacgtgtgaccgctgaaattaa

SEQ ID NO: 75724 - DNA, 25 bp, Homo sapien
ggacacgtgtgactgctgaaattaa

SEQ ID NO: 75725 - DNA, 25 bp, Homo sapien
ggacactaaccaactctacaactta

SEQ ID NO: 75726 - DNA, 25 bp, Homo sapien
ggacactaatacacggatcttgacg

SEQ ID NO: 75727 - DNA, 25 bp, Homo sapien
ggacactaatacatggatcttgacg

SEQ ID NO: 75728 - DNA, 25 bp, Homo sapien
ggacactaccaatttcatgtatttt

SEQ ID NO: 75729 - DNA, 25 bp, Homo sapien
ggacactacccaactctacaactta

SEQ ID NO: 75730 - DNA, 25 bp, Homo sapien
ggacactactaatttcatgtatttt

SEQ ID NO: 75731 - DNA, 25 bp, Homo sapien
ggacactattaccaggcaaatatat

SEQ ID NO: 75732 - DNA, 25 bp, Homo sapien
ggacactattactaggcaaatatat

SEQ ID NO: 75733 - DNA, 25 bp, Homo sapien
ggacactgagactaagatgtgaagt

SEQ ID NO: 75734 - DNA, 25 bp, Homo sapien
ggacactgaggaactgctgaccaag

SEQ ID NO: 75735 - DNA, 25 bp, Homo sapien
ggacactgaggaattgctgaccaag

SEQ ID NO: 75736 - DNA, 25 bp, Homo sapien
ggacactgatactaagatgtgaagt

SEQ ID NO: 75737 - DNA, 25 bp, Homo sapien
ggacacttgaagcatcacactagga

SEQ ID NO: 75738 - DNA, 25 bp, Homo sapien
ggacacttgaagcgtcacactagga

SEQ ID NO: 75739 - DNA, 25 bp, Homo sapien
ggacagaagcccaagatcaagctgc

SEQ ID NO: 75740 - DNA, 25 bp, Homo sapien
ggacagaagcctaagatcaagctgc

SEQ ID NO: 75741 - DNA, 25 bp, Homo sapien
ggacagacgatttccagggatcgcc

SEQ ID NO: 75742 - DNA, 25 bp, Homo sapien
ggacagactatttccagggatcgcc

SEQ ID NO: 75743 - DNA, 25 bp, Homo sapien
ggacagaggatttttccttgcactt

SEQ ID NO: 75744 - DNA, 25 bp, Homo sapien
ggacagaggatttttctttgcactt

SEQ ID NO: 75745 - DNA, 25 bp, Homo sapien
ggacagatcatataatctcttttag

SEQ ID NO: 75746 - DNA, 25 bp, Homo sapien
ggacagatcgtataatctcttttag

SEQ ID NO: 75747 - DNA, 25 bp, Homo sapien
ggacagcaacacaaatccattactt

SEQ ID NO: 75748 - DNA, 25 bp, Homo sapien
ggacagcaacacatatccattactt

SEQ ID NO: 75749 - DNA, 25 bp, Homo sapien
ggacagcaagagacgaagttgaggg

SEQ ID NO: 75750 - DNA, 25 bp, Homo sapien
ggacagcaagagatgaagttgaggg

SEQ ID NO: 75751 - DNA, 25 bp, Homo sapien
ggacagcagtacatgggctagaagc

SEQ ID NO: 75752 - DNA, 25 bp, Homo sapien
ggacagcagtacgtgggctagaagc

SEQ ID NO: 75753 - DNA, 25 bp, Homo sapien
ggacagcatatctgattggctacaa

SEQ ID NO: 75754 - DNA, 25 bp, Homo sapien
ggacagcatatctggttggctacaa

SEQ ID NO: 75755 - DNA, 25 bp, Homo sapien
ggacagctagtgaagtaggaagaga

SEQ ID NO: 75756 - DNA, 25 bp, Homo sapien
ggacagctagttaagtaggaagaga

SEQ ID NO: 75757 - DNA, 25 bp, Homo sapien
ggacagctcatcaataacacattac

SEQ ID NO: 75758 - DNA, 25 bp, Homo sapien
ggacagctcgtcaataacacattac

SEQ ID NO: 75759 - DNA, 25 bp, Homo sapien
ggacaggaaagacagtcataaattt

SEQ ID NO: 75760 - DNA, 25 bp, Homo sapien
ggacaggaaaggcagtcataaattt

SEQ ID NO: 75761 - DNA, 25 bp, Homo sapien
ggacaggcacctggcaatccaaatt

SEQ ID NO: 75762 - DNA, 25 bp, Homo sapien
ggacaggcacctggcagtccaaatt

SEQ ID NO: 75763 - DNA, 25 bp, Homo sapien
ggacaggtgaaaggtcagcaaccta

SEQ ID NO: 75764 - DNA, 25 bp, Homo sapien
ggacaggtgaaatgtcagcaaccta

SEQ ID NO: 75765 - DNA, 25 bp, Homo sapien
ggacagtacagaactctttaattat

SEQ ID NO: 75766 - DNA, 25 bp, Homo sapien
ggacagtacagaattctttaattat

SEQ ID NO: 75767 - DNA, 25 bp, Homo sapien
ggacagtacttgtgctgaagaaact

SEQ ID NO: 75768 - DNA, 25 bp, Homo sapien
ggacagtatttgtgctgaagaaact

SEQ ID NO: 75769 - DNA, 25 bp, Homo sapien
ggacagtcatttagataagaactta

SEQ ID NO: 75770 - DNA, 25 bp, Homo sapien
ggacagtcgtttagataagaactta

SEQ ID NO: 75771 - DNA, 25 bp, Homo sapien
ggacagtgtctctaattgtcccggt

SEQ ID NO: 75772 - DNA, 25 bp, Homo sapien
ggacagtgtctctagttgtcccggt

SEQ ID NO: 75773 - DNA, 25 bp, Homo sapien
ggacagttctaacggcttccatttg

SEQ ID NO: 75774 - DNA, 25 bp, Homo sapien
ggacagttctaatggcttccatttg

SEQ ID NO: 75775 - DNA, 25 bp, Homo sapien
ggacataaacaacctcacagaatac

SEQ ID NO: 75776 - DNA, 25 bp, Homo sapien
ggacataaacaatctcacagaatac

SEQ ID NO: 75777 - DNA, 25 bp, Homo sapien
ggacataaggatagctgtcagtggt

SEQ ID NO: 75778 - DNA, 25 bp, Homo sapien
ggacataaggatagttgtcagtggt

SEQ ID NO: 75779 - DNA, 25 bp, Homo sapien
ggacataccatcagagaaatctgcc

SEQ ID NO: 75780 - DNA, 25 bp, Homo sapien
ggacataccatcagaggaatctgcc

SEQ ID NO: 75781 - DNA, 25 bp, Homo sapien
ggacatattggattaactaacatat

SEQ ID NO: 75782 - DNA, 25 bp, Homo sapien
ggacatattggcttaactaacatat

SEQ ID NO: 75783 - DNA, 25 bp, Homo sapien
ggacatcagaaaaagactagaccag

SEQ ID NO: 75784 - DNA, 25 bp, Homo sapien
ggacatcagaaaaatactagaccag

SEQ ID NO: 75785 - DNA, 25 bp, Homo sapien
ggacatcatctacatctggattcct

SEQ ID NO: 75786 - DNA, 25 bp, Homo sapien
ggacatcatctgcatctggattcct

SEQ ID NO: 75787 - DNA, 25 bp, Homo sapien
ggacatcctaaaacagcttatggac

SEQ ID NO: 75788 - DNA, 25 bp, Homo sapien
ggacatcctaaaagagcttatggac

SEQ ID NO: 75789 - DNA, 25 bp, Homo sapien
ggacatctactgggaatccagaagg

SEQ ID NO: 75790 - DNA, 25 bp, Homo sapien
ggacatctagctcactatgttctcc

SEQ ID NO: 75791 - DNA, 25 bp, Homo sapien
ggacatctagctcactgtgttctcc

SEQ ID NO: 75792 - DNA, 25 bp, Homo sapien
ggacatctattgggaatccagaagg

SEQ ID NO: 75793 - DNA, 25 bp, Homo sapien
ggacatctgctcactttgggactct

SEQ ID NO: 75794 - DNA, 25 bp, Homo sapien
ggacatctgctcgctttgggactct

SEQ ID NO: 75795 - DNA, 25 bp, Homo sapien
ggacatgaaggaacagctcaggtct

SEQ ID NO: 75796 - DNA, 25 bp, Homo sapien
ggacatgaaggaacggctcaggtct

SEQ ID NO: 75797 - DNA, 25 bp, Homo sapien
ggacatgatgacgacttagctctca

SEQ ID NO: 75798 - DNA, 25 bp, Homo sapien
ggacatgatgaggacttagctctca

SEQ ID NO: 75799 - DNA, 25 bp, Homo sapien
ggacatgctcgtccactagccctcg

SEQ ID NO: 75800 - DNA, 25 bp, Homo sapien
ggacatgctcgtcgactagccctcg

SEQ ID NO: 75801 - DNA, 25 bp, Homo sapien
ggacatggttacctacatatcagtt

SEQ ID NO: 75802 - DNA, 25 bp, Homo sapien
ggacatggttacctacgtatcagtt

SEQ ID NO: 75803 - DNA, 25 bp, Homo sapien
ggacatgtaaaggaagttggaacac

SEQ ID NO: 75804 - DNA, 25 bp, Homo sapien
ggacatgtcaaaatcacaatttaat

SEQ ID NO: 75805 - DNA, 25 bp, Homo sapien
ggacatgtcgaaatcacaatttaat

SEQ ID NO: 75806 - DNA, 25 bp, Homo sapien
ggacatgtgaaggaagttggaacac

SEQ ID NO: 75807 - DNA, 25 bp, Homo sapien
ggacatgttttttagtcagggtgaa

SEQ ID NO: 75808 - DNA, 25 bp, Homo sapien
ggacatgttttttagtgagggtgaa

SEQ ID NO: 75809 - DNA, 25 bp, Homo sapien
ggacattacgctagtgaaataggcc

SEQ ID NO: 75810 - DNA, 25 bp, Homo sapien
ggacattatgctagtgaaataggcc

SEQ ID NO: 75811 - DNA, 25 bp, Homo sapien
ggaccaaagaaggaacctaaggagc

SEQ ID NO: 75812 - DNA, 25 bp, Homo sapien
ggaccaaaggaggaacctaaggagc

SEQ ID NO: 75813 - DNA, 25 bp, Homo sapien
ggaccaacacagataagtgcttccc

SEQ ID NO: 75814 - DNA, 25 bp, Homo sapien
ggaccaacacaggtaagtgcttccc

SEQ ID NO: 75815 - DNA, 25 bp, Homo sapien
ggaccaactactacgggagtttcag

SEQ ID NO: 75816 - DNA, 25 bp, Homo sapien
ggaccaactactatgggagtttcag

SEQ ID NO: 75817 - DNA, 25 bp, Homo sapien
ggaccaagagtacaaagttctccat

SEQ ID NO: 75818 - DNA, 25 bp, Homo sapien
ggaccaagagtaccaagttctccat

SEQ ID NO: 75819 - DNA, 25 bp, Homo sapien
ggaccaagtagatctagctttgtat

SEQ ID NO: 75820 - DNA, 25 bp, Homo sapien
ggaccaagtaggtctagctttgtat

SEQ ID NO: 75821 - DNA, 25 bp, Homo sapien
ggaccacagagcgagcaagcagcag

SEQ ID NO: 75822 - DNA, 25 bp, Homo sapien
ggaccacagagctagcaagcagcag

SEQ ID NO: 75823 - DNA, 25 bp, Homo sapien
ggaccacattagacaaataacgcat

SEQ ID NO: 75824 - DNA, 25 bp, Homo sapien
ggaccacattagacgaataacgcat

SEQ ID NO: 75825 - DNA, 25 bp, Homo sapien
ggaccaccagacatgtgaggaaatc

SEQ ID NO: 75826 - DNA, 25 bp, Homo sapien
ggaccaccagacgtgtgaggaaatc

SEQ ID NO: 75827 - DNA, 25 bp, Homo sapien
ggaccacggtataagccaccacagc

SEQ ID NO: 75828 - DNA, 25 bp, Homo sapien
ggaccacggtataggccaccacagc

SEQ ID NO: 75829 - DNA, 25 bp, Homo sapien
ggaccactccaaagcgtgtgggttg

SEQ ID NO: 75830 - DNA, 25 bp, Homo sapien
ggaccactccaaagtgtgtgggttg

SEQ ID NO: 75831 - DNA, 25 bp, Homo sapien
ggaccagaaagacgcatggagagtt

SEQ ID NO: 75832 - DNA, 25 bp, Homo sapien
ggaccagaaagatgcatggagagtt

SEQ ID NO: 75833 - DNA, 25 bp, Homo sapien
ggaccaggaaagttgtgacttagca

SEQ ID NO: 75834 - DNA, 25 bp, Homo sapien
ggaccaggagggtcatctcagcccc

SEQ ID NO: 75835 - DNA, 25 bp, Homo sapien
ggaccaggagggtcatgtcagcccc

SEQ ID NO: 75836 - DNA, 25 bp, Homo sapien
ggaccaggagttgtgcagcccatcc

SEQ ID NO: 75837 - DNA, 25 bp, Homo sapien
ggaccaggcgttgtgcagcccatcc

SEQ ID NO: 75838 - DNA, 25 bp, Homo sapien
ggaccagggaagttgtgacttagca

SEQ ID NO: 75839 - DNA, 25 bp, Homo sapien
ggaccagtgtgtgcccactttcctt

SEQ ID NO: 75840 - DNA, 25 bp, Homo sapien
ggaccagtgtgtgcccgctttcctt

SEQ ID NO: 75841 - DNA, 25 bp, Homo sapien
ggaccatattcatcttcatctttat

SEQ ID NO: 75842 - DNA, 25 bp, Homo sapien
ggaccatattcttcttcatctttat

SEQ ID NO: 75843 - DNA, 25 bp, Homo sapien
ggaccattctttacaggaacagtat

SEQ ID NO: 75844 - DNA, 25 bp, Homo sapien
ggaccattctttgcaggaacagtat

SEQ ID NO: 75845 - DNA, 25 bp, Homo sapien
ggacccacaggatccatcatccaca

SEQ ID NO: 75846 - DNA, 25 bp, Homo sapien
ggacccacagggtccatcatccaca

SEQ ID NO: 75847 - DNA, 25 bp, Homo sapien
ggacccagatttcgtgccaagaatg

SEQ ID NO: 75848 - DNA, 25 bp, Homo sapien
ggacccagattttgtgccaagaatg

SEQ ID NO: 75849 - DNA, 25 bp, Homo sapien
ggacccagcagtccaagaacttgcc

SEQ ID NO: 75850 - DNA, 25 bp, Homo sapien
ggacccagcagtccgagaacttgcc

SEQ ID NO: 75851 - DNA, 25 bp, Homo sapien
ggacccattcccactcatcatgtga

SEQ ID NO: 75852 - DNA, 25 bp, Homo sapien
ggacccattcccgctcatcatgtga

SEQ ID NO: 75853 - DNA, 25 bp, Homo sapien
ggacccattgttggagatgaggtca

SEQ ID NO: 75854 - DNA, 25 bp, Homo sapien
ggacccattgttggcgatgaggtca

SEQ ID NO: 75855 - DNA, 25 bp, Homo sapien
ggaccctgttgccgctctcttgcta

SEQ ID NO: 75856 - DNA, 25 bp, Homo sapien
ggaccctgttgcctctctcttgcta

SEQ ID NO: 75857 - DNA, 25 bp, Homo sapien
ggaccggctcactggactcattcag

SEQ ID NO: 75858 - DNA, 25 bp, Homo sapien
ggaccggcttactggactcattcag

SEQ ID NO: 75859 - DNA, 25 bp, Homo sapien
ggaccgtaaagaagtgccagggagc

SEQ ID NO: 75860 - DNA, 25 bp, Homo sapien
ggaccgtaaagaggtgccagggagc

SEQ ID NO: 75861 - DNA, 25 bp, Homo sapien
ggaccgtcctagctccagagctccc

SEQ ID NO: 75862 - DNA, 25 bp, Homo sapien
ggaccgtcctagttccagagctccc

SEQ ID NO: 75863 - DNA, 25 bp, Homo sapien
ggacctaaaatggtttttctgtgtc

SEQ ID NO: 75864 - DNA, 25 bp, Homo sapien
ggacctaatatggtttttctgtgtc

SEQ ID NO: 75865 - DNA, 25 bp, Homo sapien
ggacctactgagtcataatctgcag

SEQ ID NO: 75866 - DNA, 25 bp, Homo sapien
ggacctactgagtcgtaatctgcag

SEQ ID NO: 75867 - DNA, 25 bp, Homo sapien
ggacctctcacacgttgctggtgca

SEQ ID NO: 75868 - DNA, 25 bp, Homo sapien
ggacctctcacatgttgctggtgca

SEQ ID NO: 75869 - DNA, 25 bp, Homo sapien
ggacctgagttgaaatcccagttct

SEQ ID NO: 75870 - DNA, 25 bp, Homo sapien
ggacctgagttggaatcccagttct

SEQ ID NO: 75871 - DNA, 25 bp, Homo sapien
ggacctggactatgatagccacagc

SEQ ID NO: 75872 - DNA, 25 bp, Homo sapien
ggacctggactatgatggccacagc

SEQ ID NO: 75873 - DNA, 25 bp, Homo sapien
ggacctggcctcgatactaaattct

SEQ ID NO: 75874 - DNA, 25 bp, Homo sapien
ggacctggccttgatactaaattct

SEQ ID NO: 75875 - DNA, 25 bp, Homo sapien
ggaccttccttcataatagactcag

SEQ ID NO: 75876 - DNA, 25 bp, Homo sapien
ggaccttccttcgtaatagactcag

SEQ ID NO: 75877 - DNA, 25 bp, Homo sapien
ggaccttcgctatccttctctaact

SEQ ID NO: 75878 - DNA, 25 bp, Homo sapien
ggaccttcgttatccttctctaact

SEQ ID NO: 75879 - DNA, 25 bp, Homo sapien
ggaccttgatgtgactcctggttct

SEQ ID NO: 75880 - DNA, 25 bp, Homo sapien
ggaccttggtgtgactcctggttct

SEQ ID NO: 75881 - DNA, 25 bp, Homo sapien
ggacctttccggccgctgtgtgccc

SEQ ID NO: 75882 - DNA, 25 bp, Homo sapien
ggacctttctggccgctgtgtgccc

SEQ ID NO: 75883 - DNA, 25 bp, Homo sapien
ggaccttttctgaatgataaaaaag

SEQ ID NO: 75884 - DNA, 25 bp, Homo sapien
ggaccttttctgattgataaaaaag

SEQ ID NO: 75885 - DNA, 25 bp, Homo sapien
ggacgattctgacttgcgtcctgga

SEQ ID NO: 75886 - DNA, 25 bp, Homo sapien
ggacgattctgatttgcgtcctgga

SEQ ID NO: 75887 - DNA, 25 bp, Homo sapien
ggacgctgttaaaaatcacccaatt

SEQ ID NO: 75888 - DNA, 25 bp, Homo sapien
ggacgctgttaaaaattacccaatt

SEQ ID NO: 75889 - DNA, 25 bp, Homo sapien
ggacggaaaccgtctccgaaattcc

SEQ ID NO: 75890 - DNA, 25 bp, Homo sapien
ggacggaagccgtctccgaaattcc

SEQ ID NO: 75891 - DNA, 25 bp, Homo sapien
ggacgtgttgctcaaagttgaagag

SEQ ID NO: 75892 - DNA, 25 bp, Homo sapien
ggacgtgttgctcgaagttgaagag

SEQ ID NO: 75893 - DNA, 25 bp, Homo sapien
ggactaaaagaacagctcagccaac

SEQ ID NO: 75894 - DNA, 25 bp, Homo sapien
ggactaaaagaaccgctcagccaac

SEQ ID NO: 75895 - DNA, 25 bp, Homo sapien
ggactactgtgaagctccaacagtc

SEQ ID NO: 75896 - DNA, 25 bp, Homo sapien
ggactactgtgaagctgcaacagtc

SEQ ID NO: 75897 - DNA, 25 bp, Homo sapien
ggactagaaccatcactagaaacaa

SEQ ID NO: 75898 - DNA, 25 bp, Homo sapien
ggactagaaccgtcactagaaacaa

SEQ ID NO: 75899 - DNA, 25 bp, Homo sapien
ggactagggcattagacagattacc

SEQ ID NO: 75900 - DNA, 25 bp, Homo sapien
ggactagggcattagatagattacc

SEQ ID NO: 75901 - DNA, 25 bp, Homo sapien
ggactaggttcctaagagcaaggaa

SEQ ID NO: 75902 - DNA, 25 bp, Homo sapien
ggactaggttcctacgagcaaggaa

SEQ ID NO: 75903 - DNA, 25 bp, Homo sapien
ggactatacaatccagtttaaatta

SEQ ID NO: 75904 - DNA, 25 bp, Homo sapien
ggactatacgatccagtttaaatta

SEQ ID NO: 75905 - DNA, 25 bp, Homo sapien
ggactatactttggttcaaaagcgg

SEQ ID NO: 75906 - DNA, 25 bp, Homo sapien
ggactatactttggtttaaaagcgg

SEQ ID NO: 75907 - DNA, 25 bp, Homo sapien
ggactatataaaaatcaaagcaaaa

SEQ ID NO: 75908 - DNA, 25 bp, Homo sapien
ggactatataaatatcaaagcaaaa

SEQ ID NO: 75909 - DNA, 25 bp, Homo sapien
ggactcagaagcaggtctgcctgac

SEQ ID NO: 75910 - DNA, 25 bp, Homo sapien
ggactcagcaattagtgaaacatac

SEQ ID NO: 75911 - DNA, 25 bp, Homo sapien
ggactcagcagcaggtctgcctgac

SEQ ID NO: 75912 - DNA, 25 bp, Homo sapien
ggactcagggtttatactagcggcc

SEQ ID NO: 75913 - DNA, 25 bp, Homo sapien
ggactcaggttttatactagcggcc

SEQ ID NO: 75914 - DNA, 25 bp, Homo sapien
ggactcagtaattagtgaaacatac

SEQ ID NO: 75915 - DNA, 25 bp, Homo sapien
ggactccagccttataaaatatgat

SEQ ID NO: 75916 - DNA, 25 bp, Homo sapien
ggactccaggcttataaaatatgat

SEQ ID NO: 75917 - DNA, 25 bp, Homo sapien
ggactcggcaacttcttggatgtgt

SEQ ID NO: 75918 - DNA, 25 bp, Homo sapien
ggactcggtaacttcttggatgtgt

SEQ ID NO: 75919 - DNA, 25 bp, Homo sapien
ggactctataaaaccctgtaaaatc

SEQ ID NO: 75920 - DNA, 25 bp, Homo sapien
ggactctataaaatcctgtaaaatc

SEQ ID NO: 75921 - DNA, 25 bp, Homo sapien
ggactctggctgcctttgaaatata

SEQ ID NO: 75922 - DNA, 25 bp, Homo sapien
ggactctggctgtctttgaaatata

SEQ ID NO: 75923 - DNA, 25 bp, Homo sapien
ggactctgggtcagcagctgtgaag

SEQ ID NO: 75924 - DNA, 25 bp, Homo sapien
ggactctgtgtcagcagctgtgaag

SEQ ID NO: 75925 - DNA, 25 bp, Homo sapien
ggactcttacgggtcacacaaaact

SEQ ID NO: 75926 - DNA, 25 bp, Homo sapien
ggactcttatgggtcacacaaaact

SEQ ID NO: 75927 - DNA, 25 bp, Homo sapien
ggactgaaacgttatgtaactttaa

SEQ ID NO: 75928 - DNA, 25 bp, Homo sapien
ggactgaaatgttatgtaactttaa

SEQ ID NO: 75929 - DNA, 25 bp, Homo sapien
ggactgagacatgaatggactgtac

SEQ ID NO: 75930 - DNA, 25 bp, Homo sapien
ggactgagacatgagtggactgtac

SEQ ID NO: 75931 - DNA, 25 bp, Homo sapien
ggactgagctgcgactcaggctgtg

SEQ ID NO: 75932 - DNA, 25 bp, Homo sapien
ggactgagctgtgactcaggctgtg

SEQ ID NO: 75933 - DNA, 25 bp, Homo sapien
ggactgcagtttgtctcagccaaga

SEQ ID NO: 75934 - DNA, 25 bp, Homo sapien
ggactgcagtttgtttcagccaaga

SEQ ID NO: 75935 - DNA, 25 bp, Homo sapien
ggactgcgtaaaattagttttattt

SEQ ID NO: 75936 - DNA, 25 bp, Homo sapien
ggactgcgtaaaattatttttattt

SEQ ID NO: 75937 - DNA, 25 bp, Homo sapien
ggactgctgttcccccagatagcat

SEQ ID NO: 75938 - DNA, 25 bp, Homo sapien
ggactgctgtttccccagatagcat

SEQ ID NO: 75939 - DNA, 25 bp, Homo sapien
ggactggatcccggactaggaaaag

SEQ ID NO: 75940 - DNA, 25 bp, Homo sapien
ggactggatcctggactaggaaaag

SEQ ID NO: 75941 - DNA, 25 bp, Homo sapien
ggactggatgaaactgaaggtcacg

SEQ ID NO: 75942 - DNA, 25 bp, Homo sapien
ggactggatgaaattgaaggtcacg

SEQ ID NO: 75943 - DNA, 25 bp, Homo sapien
ggactggccaccgaactgggaaggc

SEQ ID NO: 75944 - DNA, 25 bp, Homo sapien
ggactggccactgaactgggaaggc

SEQ ID NO: 75945 - DNA, 25 bp, Homo sapien
ggactggccttagctggccgaatct

SEQ ID NO: 75946 - DNA, 25 bp, Homo sapien
ggactggccttggctggccgaatct

SEQ ID NO: 75947 - DNA, 25 bp, Homo sapien
ggactgtactttaaaactgccacag

SEQ ID NO: 75948 - DNA, 25 bp, Homo sapien
ggactgtactttaaaattgccacag

SEQ ID NO: 75949 - DNA, 25 bp, Homo sapien
ggactgtgaatatcccatcagagag

SEQ ID NO: 75950 - DNA, 25 bp, Homo sapien
ggactgtgagtatcccatcagagag

SEQ ID NO: 75951 - DNA, 25 bp, Homo sapien
ggactgtgatgacaccacttgatca

SEQ ID NO: 75952 - DNA, 25 bp, Homo sapien
ggactgtgatgacaccgcttgatca

SEQ ID NO: 75953 - DNA, 25 bp, Homo sapien
ggacttatgattgccctcattacgt

SEQ ID NO: 75954 - DNA, 25 bp, Homo sapien
ggacttatgattgctctcattacgt

SEQ ID NO: 75955 - DNA, 25 bp, Homo sapien
ggacttcaattatgcaactagtgag

SEQ ID NO: 75956 - DNA, 25 bp, Homo sapien
ggacttcagaagtaagtttctatgt

SEQ ID NO: 75957 - DNA, 25 bp, Homo sapien
ggacttcagaagtatgtttctatgt

SEQ ID NO: 75958 - DNA, 25 bp, Homo sapien
ggacttcagttatgcaactagtgag

SEQ ID NO: 75959 - DNA, 25 bp, Homo sapien
ggacttcccactcttgttagctgac

SEQ ID NO: 75960 - DNA, 25 bp, Homo sapien
ggacttcccgctcttgttagctgac

SEQ ID NO: 75961 - DNA, 25 bp, Homo sapien
ggacttgcacgagacctgtatcctc

SEQ ID NO: 75962 - DNA, 25 bp, Homo sapien
ggacttgcacgggacctgtatcctc

SEQ ID NO: 75963 - DNA, 25 bp, Homo sapien
ggacttgtgtgattaaagtgggctc

SEQ ID NO: 75964 - DNA, 25 bp, Homo sapien
ggacttgtgtgattgaagtgggctc

SEQ ID NO: 75965 - DNA, 25 bp, Homo sapien
ggactttacacaataagacctaaga

SEQ ID NO: 75966 - DNA, 25 bp, Homo sapien
ggactttacacagtaagacctaaga

SEQ ID NO: 75967 - DNA, 25 bp, Homo sapien
ggactttattttctttatcccgcat

SEQ ID NO: 75968 - DNA, 25 bp, Homo sapien
ggactttattttttttatcccgcat

SEQ ID NO: 75969 - DNA, 25 bp, Homo sapien
ggactttccgtcactccgaaaacat

SEQ ID NO: 75970 - DNA, 25 bp, Homo sapien
ggactttccgtcactctgaaaacat

SEQ ID NO: 75971 - DNA, 25 bp, Homo sapien
ggactttcttggaggtagatgccac

SEQ ID NO: 75972 - DNA, 25 bp, Homo sapien
ggactttcttggcggtagatgccac

SEQ ID NO: 75973 - DNA, 25 bp, Homo sapien
ggactttgaatgtcccaggatggga

SEQ ID NO: 75974 - DNA, 25 bp, Homo sapien
ggactttgagtgtcccaggatggga

SEQ ID NO: 75975 - DNA, 25 bp, Homo sapien
ggactttgctcgcattactattacc

SEQ ID NO: 75976 - DNA, 25 bp, Homo sapien
ggactttgctctcattactattacc

SEQ ID NO: 75977 - DNA, 25 bp, Homo sapien
ggactttggaaattggcatgaggag

SEQ ID NO: 75978 - DNA, 25 bp, Homo sapien
ggactttggaaattggtatgaggag

SEQ ID NO: 75979 - DNA, 25 bp, Homo sapien
ggactttggtcttcggcctcctgct

SEQ ID NO: 75980 - DNA, 25 bp, Homo sapien
ggactttggtctttggcctcctgct

SEQ ID NO: 75981 - DNA, 25 bp, Homo sapien
ggagaaaaaaaactgaagattcatt

SEQ ID NO: 75982 - DNA, 25 bp, Homo sapien
ggagaaaaaaacctgaagattcatt

SEQ ID NO: 75983 - DNA, 25 bp, Homo sapien
ggagaaaaacaagataaattaaaga

SEQ ID NO: 75984 - DNA, 25 bp, Homo sapien
ggagaaaagcaagataaattaaaga

SEQ ID NO: 75985 - DNA, 25 bp, Homo sapien
ggagaaagaaaccatgaaccaagga

SEQ ID NO: 75986 - DNA, 25 bp, Homo sapien
ggagaaagatctatcaagcaaaact

SEQ ID NO: 75987 - DNA, 25 bp, Homo sapien
ggagaaagatctatcatgcaaaact

SEQ ID NO: 75988 - DNA, 25 bp, Homo sapien
ggagaaaggaaccatgaaccaagga

SEQ ID NO: 75989 - DNA, 25 bp, Homo sapien
ggagaaaggccatatacacacttaa

SEQ ID NO: 75990 - DNA, 25 bp, Homo sapien
ggagaaaggccatgctgcaccctct

SEQ ID NO: 75991 - DNA, 25 bp, Homo sapien
ggagaaaggccattctgcaccctct

SEQ ID NO: 75992 - DNA, 25 bp, Homo sapien
ggagaaaggtcatatacacacttaa

SEQ ID NO: 75993 - DNA, 25 bp, Homo sapien
ggagaaataagctaagaaacaatgg

SEQ ID NO: 75994 - DNA, 25 bp, Homo sapien
ggagaaataagctaagcaacaatgg

SEQ ID NO: 75995 - DNA, 25 bp, Homo sapien
ggagaaatgactcaaacaaagttaa

SEQ ID NO: 75996 - DNA, 25 bp, Homo sapien
ggagaaatgactcaaagaaagttaa

SEQ ID NO: 75997 - DNA, 25 bp, Homo sapien
ggagaaattacctaatcagcctgca

SEQ ID NO: 75998 - DNA, 25 bp, Homo sapien
ggagaaattacttaatcagcctgca

SEQ ID NO: 75999 - DNA, 25 bp, Homo sapien
ggagaaattgaagatccctgattgt

SEQ ID NO: 76000 - DNA, 25 bp, Homo sapien
ggagaaatttaagatccctgattgt

SEQ ID NO: 76001 - DNA, 25 bp, Homo sapien
ggagaacaaaagacaggaataaaaa

SEQ ID NO: 76002 - DNA, 25 bp, Homo sapien
ggagaacaagagacaggaataaaaa

SEQ ID NO: 76003 - DNA, 25 bp, Homo sapien
ggagaacacgctgtgctcagaaatg

SEQ ID NO: 76004 - DNA, 25 bp, Homo sapien
ggagaacatgctgtgctcagaaatg

SEQ ID NO: 76005 - DNA, 25 bp, Homo sapien
ggagaactctttggccttggtcagt

SEQ ID NO: 76006 - DNA, 25 bp, Homo sapien
ggagaactgtttggccttggtcagt

SEQ ID NO: 76007 - DNA, 25 bp, Homo sapien
ggagaacttagtccgagtaaaggtc

SEQ ID NO: 76008 - DNA, 25 bp, Homo sapien
ggagaacttagtctgagtaaaggtc

SEQ ID NO: 76009 - DNA, 25 bp, Homo sapien
ggagaagaacaagtgatgattagag

SEQ ID NO: 76010 - DNA, 25 bp, Homo sapien
ggagaagaacaggtgatgattagag

SEQ ID NO: 76011 - DNA, 25 bp, Homo sapien
ggagaagacgcaatagctctgtttt

SEQ ID NO: 76012 - DNA, 25 bp, Homo sapien
ggagaagagattttgaaggagcaag

SEQ ID NO: 76013 - DNA, 25 bp, Homo sapien
ggagaagagattttgagggagcaag

SEQ ID NO: 76014 - DNA, 25 bp, Homo sapien
ggagaagatctcagcgcagctcctg

SEQ ID NO: 76015 - DNA, 25 bp, Homo sapien
ggagaagatctcagtgcagctcctg

SEQ ID NO: 76016 - DNA, 25 bp, Homo sapien
ggagaagatgcaatagctctgtttt

SEQ ID NO: 76017 - DNA, 25 bp, Homo sapien
ggagaagcaaacctgccatcttaga

SEQ ID NO: 76018 - DNA, 25 bp, Homo sapien
ggagaagcaaacgtgccatcttaga

SEQ ID NO: 76019 - DNA, 25 bp, Homo sapien
ggagaagcacaacagatgagcagaa

SEQ ID NO: 76020 - DNA, 25 bp, Homo sapien
ggagaagcacaatagatgagcagaa

SEQ ID NO: 76021 - DNA, 25 bp, Homo sapien
ggagaagtagttaccttttaccttg

SEQ ID NO: 76022 - DNA, 25 bp, Homo sapien
ggagaagtcgttaccttttaccttg

SEQ ID NO: 76023 - DNA, 25 bp, Homo sapien
ggagaatataaagccaatgtacttt

SEQ ID NO: 76024 - DNA, 25 bp, Homo sapien
ggagaatatgaagccaatgtacttt

SEQ ID NO: 76025 - DNA, 25 bp, Homo sapien
ggagaatccagtatcggtggcccac

SEQ ID NO: 76026 - DNA, 25 bp, Homo sapien
ggagaatccagtattggtggcccac

SEQ ID NO: 76027 - DNA, 25 bp, Homo sapien
ggagaatctgttcgatgcctctcct

SEQ ID NO: 76028 - DNA, 25 bp, Homo sapien
ggagaatctgtttgatgcctctcct

SEQ ID NO: 76029 - DNA, 25 bp, Homo sapien
ggagaatttgtcacaaacaaacagc

SEQ ID NO: 76030 - DNA, 25 bp, Homo sapien
ggagaatttgtcagaaacaaacagc

SEQ ID NO: 76031 - DNA, 25 bp, Homo sapien
ggagacaaaaatagagctgttggga

SEQ ID NO: 76032 - DNA, 25 bp, Homo sapien
ggagacaaaggagaaaggtccttga

SEQ ID NO: 76033 - DNA, 25 bp, Homo sapien
ggagacaaaggagataggtccttga

SEQ ID NO: 76034 - DNA, 25 bp, Homo sapien
ggagacaaataataaaccataaata

SEQ ID NO: 76035 - DNA, 25 bp, Homo sapien
ggagacaaataataaatcataaata

SEQ ID NO: 76036 - DNA, 25 bp, Homo sapien
ggagacaaatacaggaacccagttg

SEQ ID NO: 76037 - DNA, 25 bp, Homo sapien
ggagacaaatataggaacccagttg

SEQ ID NO: 76038 - DNA, 25 bp, Homo sapien
ggagacaacaatagagctgttggga

SEQ ID NO: 76039 - DNA, 25 bp, Homo sapien
ggagacaagtcgccaaaaattctag

SEQ ID NO: 76040 - DNA, 25 bp, Homo sapien
ggagacaagtcgcccaaaattctag

SEQ ID NO: 76041 - DNA, 25 bp, Homo sapien
ggagacacacacaaaaatgtcaata

SEQ ID NO: 76042 - DNA, 25 bp, Homo sapien
ggagacacacacaaaattgtcaata

SEQ ID NO: 76043 - DNA, 25 bp, Homo sapien
ggagacacaggtgatccagcacctc

SEQ ID NO: 76044 - DNA, 25 bp, Homo sapien
ggagacacgggtgatccagcacctc

SEQ ID NO: 76045 - DNA, 25 bp, Homo sapien
ggagacagacttgccctactctctg

SEQ ID NO: 76046 - DNA, 25 bp, Homo sapien
ggagacagatttgccctactctctg

SEQ ID NO: 76047 - DNA, 25 bp, Homo sapien
ggagacagtgccacgtaaagttctt

SEQ ID NO: 76048 - DNA, 25 bp, Homo sapien
ggagacagtgccatgtaaagttctt

SEQ ID NO: 76049 - DNA, 25 bp, Homo sapien
ggagaccagtacaggagtgaacaga

SEQ ID NO: 76050 - DNA, 25 bp, Homo sapien
ggagaccagtacagtagtgaacaga

SEQ ID NO: 76051 - DNA, 25 bp, Homo sapien
ggagacccataagagccaataatgt

SEQ ID NO: 76052 - DNA, 25 bp, Homo sapien
ggagacccataagagcgaataatgt

SEQ ID NO: 76053 - DNA, 25 bp, Homo sapien
ggagaccgcataatcaaggaactga

SEQ ID NO: 76054 - DNA, 25 bp, Homo sapien
ggagaccgcgtaatcaaggaactga

SEQ ID NO: 76055 - DNA, 25 bp, Homo sapien
ggagacctaacaggttttgaaattc

SEQ ID NO: 76056 - DNA, 25 bp, Homo sapien
ggagacctgacaggttttgaaattc

SEQ ID NO: 76057 - DNA, 25 bp, Homo sapien
ggagacgacatctgagcatctgaat

SEQ ID NO: 76058 - DNA, 25 bp, Homo sapien
ggagacgatatctgagcatctgaat

SEQ ID NO: 76059 - DNA, 25 bp, Homo sapien
ggagactaagtggatagaaaagaca

SEQ ID NO: 76060 - DNA, 25 bp, Homo sapien
ggagactaagtggttagaaaagaca

SEQ ID NO: 76061 - DNA, 25 bp, Homo sapien
ggagactaggtgctggatgtgctgg

SEQ ID NO: 76062 - DNA, 25 bp, Homo sapien
ggagactaggtgttggatgtgctgg

SEQ ID NO: 76063 - DNA, 25 bp, Homo sapien
ggagactcaaaggcctggggtatct

SEQ ID NO: 76064 - DNA, 25 bp, Homo sapien
ggagactcaaaggcttggggtatct

SEQ ID NO: 76065 - DNA, 25 bp, Homo sapien
ggagactctgcctcattgaggatat

SEQ ID NO: 76066 - DNA, 25 bp, Homo sapien
ggagactctgcctcgttgaggatat

SEQ ID NO: 76067 - DNA, 25 bp, Homo sapien
ggagactgcagttggaggatgactt

SEQ ID NO: 76068 - DNA, 25 bp, Homo sapien
ggagactgcggttggaggatgactt

SEQ ID NO: 76069 - DNA, 25 bp, Homo sapien
ggagactggagacgaggtacagttt

SEQ ID NO: 76070 - DNA, 25 bp, Homo sapien
ggagactggagatgaggtacagttt

SEQ ID NO: 76071 - DNA, 25 bp, Homo sapien
ggagactggcaacactgagcttttg

SEQ ID NO: 76072 - DNA, 25 bp, Homo sapien
ggagactggcaacattgagcttttg

SEQ ID NO: 76073 - DNA, 25 bp, Homo sapien
ggagactggctcccactatgtaaag

SEQ ID NO: 76074 - DNA, 25 bp, Homo sapien
ggagactggctcccgctatgtaaag

SEQ ID NO: 76075 - DNA, 25 bp, Homo sapien
ggagacttagccataaattatttac

SEQ ID NO: 76076 - DNA, 25 bp, Homo sapien
ggagacttagccgtaaattatttac

SEQ ID NO: 76077 - DNA, 25 bp, Homo sapien
ggagactttgatttcctaatatggg

SEQ ID NO: 76078 - DNA, 25 bp, Homo sapien
ggagactttgatttgctaatatggg

SEQ ID NO: 76079 - DNA, 25 bp, Homo sapien
ggagagaaacaacgaagatataaga

SEQ ID NO: 76080 - DNA, 25 bp, Homo sapien
ggagagaaccgctaaaataaaggcc

SEQ ID NO: 76081 - DNA, 25 bp, Homo sapien
ggagagaacttccgactgaaagcta

SEQ ID NO: 76082 - DNA, 25 bp, Homo sapien
ggagagaacttctgactgaaagcta

SEQ ID NO: 76083 - DNA, 25 bp, Homo sapien
ggagagaagacagatctaattccca

SEQ ID NO: 76084 - DNA, 25 bp, Homo sapien
ggagagaagacggatctaattccca

SEQ ID NO: 76085 - DNA, 25 bp, Homo sapien
ggagagaagcaacgaagatataaga

SEQ ID NO: 76086 - DNA, 25 bp, Homo sapien
ggagagaagtttatatatctgtctc

SEQ ID NO: 76087 - DNA, 25 bp, Homo sapien
ggagagaagtttgtatatctgtctc

SEQ ID NO: 76088 - DNA, 25 bp, Homo sapien
ggagagaatcgctaaaataaaggcc

SEQ ID NO: 76089 - DNA, 25 bp, Homo sapien
ggagagacgtccgcaaacaggtttt

SEQ ID NO: 76090 - DNA, 25 bp, Homo sapien
ggagagacgtctgcaaacaggtttt

SEQ ID NO: 76091 - DNA, 25 bp, Homo sapien
ggagagagaaaaattatgtttcaaa

SEQ ID NO: 76092 - DNA, 25 bp, Homo sapien
ggagagagaaaaggctagaaaacct

SEQ ID NO: 76093 - DNA, 25 bp, Homo sapien
ggagagagaaaaggctggaaaacct

SEQ ID NO: 76094 - DNA, 25 bp, Homo sapien
ggagagagaaatattatgtttcaaa

SEQ ID NO: 76095 - DNA, 25 bp, Homo sapien
ggagagagtgactacgtcaggcagc

SEQ ID NO: 76096 - DNA, 25 bp, Homo sapien
ggagagagtgactatgtcaggcagc

SEQ ID NO: 76097 - DNA, 25 bp, Homo sapien
ggagagataggcttcaatgcaacaa

SEQ ID NO: 76098 - DNA, 25 bp, Homo sapien
ggagagatgggcttcaatgcaacaa

SEQ ID NO: 76099 - DNA, 25 bp, Homo sapien
ggagaggaaacagaattaattagtt

SEQ ID NO: 76100 - DNA, 25 bp, Homo sapien
ggagaggaaacggaattaattagtt

SEQ ID NO: 76101 - DNA, 25 bp, Homo sapien
ggagaggaagttagaaactatgacc

SEQ ID NO: 76102 - DNA, 25 bp, Homo sapien
ggagaggaagttagaatctatgacc

SEQ ID NO: 76103 - DNA, 25 bp, Homo sapien
ggagaggacaaaggtgtaaagtcag

SEQ ID NO: 76104 - DNA, 25 bp, Homo sapien
ggagaggacaagggtgtaaagtcag

SEQ ID NO: 76105 - DNA, 25 bp, Homo sapien
ggagagggggaatctgttcttagcc

SEQ ID NO: 76106 - DNA, 25 bp, Homo sapien
ggagagggggagtctgttcttagcc

SEQ ID NO: 76107 - DNA, 25 bp, Homo sapien
ggagaggtaaagtgatctctcatgg

SEQ ID NO: 76108 - DNA, 25 bp, Homo sapien
ggagaggtctgatcccactattgaa

SEQ ID NO: 76109 - DNA, 25 bp, Homo sapien
ggagaggtctgatcccgctattgaa

SEQ ID NO: 76110 - DNA, 25 bp, Homo sapien
ggagaggtgaagtgatctctcatgg

SEQ ID NO: 76111 - DNA, 25 bp, Homo sapien
ggagaggtgcgatcatagcccagca

SEQ ID NO: 76112 - DNA, 25 bp, Homo sapien
ggagaggtgtgatcatagcccagca

SEQ ID NO: 76113 - DNA, 25 bp, Homo sapien
ggagagtaacaaatgatactttaac

SEQ ID NO: 76114 - DNA, 25 bp, Homo sapien
ggagagtaacaaattatactttaac

SEQ ID NO: 76115 - DNA, 25 bp, Homo sapien
ggagagtccgcagtgaccaattgga

SEQ ID NO: 76116 - DNA, 25 bp, Homo sapien
ggagagtctgcagtgaccaattgga

SEQ ID NO: 76117 - DNA, 25 bp, Homo sapien
ggagagttttcaacagagtagtgaa

SEQ ID NO: 76118 - DNA, 25 bp, Homo sapien
ggagagttttcatcagagtagtgaa

SEQ ID NO: 76119 - DNA, 25 bp, Homo sapien
ggagatagagttctcctttgatttg

SEQ ID NO: 76120 - DNA, 25 bp, Homo sapien
ggagatagagttttcctttgatttg

SEQ ID NO: 76121 - DNA, 25 bp, Homo sapien
ggagatcatcacaaaactctttatt

SEQ ID NO: 76122 - DNA, 25 bp, Homo sapien
ggagatcatcacaagactctttatt

SEQ ID NO: 76123 - DNA, 25 bp, Homo sapien
ggagatcctgatgacacgtgcacaa

SEQ ID NO: 76124 - DNA, 25 bp, Homo sapien
ggagatcctgatgacatgtgcacaa

SEQ ID NO: 76125 - DNA, 25 bp, Homo sapien
ggagatctcatccttggctgccttc

SEQ ID NO: 76126 - DNA, 25 bp, Homo sapien
ggagatctcatccttgtctgccttc

SEQ ID NO: 76127 - DNA, 25 bp, Homo sapien
ggagatctggacatcatcagtgcca

SEQ ID NO: 76128 - DNA, 25 bp, Homo sapien
ggagatctggacattatcagtgcca

SEQ ID NO: 76129 - DNA, 25 bp, Homo sapien
ggagatgacgagtttaattttggct

SEQ ID NO: 76130 - DNA, 25 bp, Homo sapien
ggagatgactgacttctcagcttca

SEQ ID NO: 76131 - DNA, 25 bp, Homo sapien
ggagatgatgagtttaattttggct

SEQ ID NO: 76132 - DNA, 25 bp, Homo sapien
ggagatgattgacttctcagcttca

SEQ ID NO: 76133 - DNA, 25 bp, Homo sapien
ggagatgtatgaagaaattaatgtt

SEQ ID NO: 76134 - DNA, 25 bp, Homo sapien
ggagatgtatgaagaagttaatgtt

SEQ ID NO: 76135 - DNA, 25 bp, Homo sapien
ggagattaaaatagtacctacctca

SEQ ID NO: 76136 - DNA, 25 bp, Homo sapien
ggagattaaaatcgtacctacctca

SEQ ID NO: 76137 - DNA, 25 bp, Homo sapien
ggagattaaacaagcacgtacaaag

SEQ ID NO: 76138 - DNA, 25 bp, Homo sapien
ggagattaaacaagcatgtacaaag

SEQ ID NO: 76139 - DNA, 25 bp, Homo sapien
ggagattaacactgatgcaatacca

SEQ ID NO: 76140 - DNA, 25 bp, Homo sapien
ggagattaacattgatgcaatacca

SEQ ID NO: 76141 - DNA, 25 bp, Homo sapien
ggagattacagcgcattctttctag

SEQ ID NO: 76142 - DNA, 25 bp, Homo sapien
ggagattacagtgcattctttctag

SEQ ID NO: 76143 - DNA, 25 bp, Homo sapien
ggagattgtggcatttgggcctggg

SEQ ID NO: 76144 - DNA, 25 bp, Homo sapien
ggagattgtggcgtttgggcctggg

SEQ ID NO: 76145 - DNA, 25 bp, Homo sapien
ggagatttaattagagcgaccaaga

SEQ ID NO: 76146 - DNA, 25 bp, Homo sapien
ggagatttaattagtgcgaccaaga

SEQ ID NO: 76147 - DNA, 25 bp, Homo sapien
ggagatttagaaactgtaggattac

SEQ ID NO: 76148 - DNA, 25 bp, Homo sapien
ggagatttagaaagtgtaggattac

SEQ ID NO: 76149 - DNA, 25 bp, Homo sapien
ggagatttataactcgtaatgaatg

SEQ ID NO: 76150 - DNA, 25 bp, Homo sapien
ggagatttataacttgtaatgaatg

SEQ ID NO: 76151 - DNA, 25 bp, Homo sapien
ggagatttctccacctttagctgcc

SEQ ID NO: 76152 - DNA, 25 bp, Homo sapien
ggagatttctctacctttagctgcc

SEQ ID NO: 76153 - DNA, 25 bp, Homo sapien
ggagcaaataaaaccgatacaagca

SEQ ID NO: 76154 - DNA, 25 bp, Homo sapien
ggagcaaataaaactgatacaagca

SEQ ID NO: 76155 - DNA, 25 bp, Homo sapien
ggagcaagaacacttgtcatcaccc

SEQ ID NO: 76156 - DNA, 25 bp, Homo sapien
ggagcaagaacatttgtcatcaccc

SEQ ID NO: 76157 - DNA, 25 bp, Homo sapien
ggagcaagccagggaagaaagcgca

SEQ ID NO: 76158 - DNA, 25 bp, Homo sapien
ggagcaagtcagggaagaaagcgca

SEQ ID NO: 76159 - DNA, 25 bp, Homo sapien
ggagcaattatacatagtactgcat

SEQ ID NO: 76160 - DNA, 25 bp, Homo sapien
ggagcaattatagatagtactgcat

SEQ ID NO: 76161 - DNA, 25 bp, Homo sapien
ggagcaattgggcaaaataataatc

SEQ ID NO: 76162 - DNA, 25 bp, Homo sapien
ggagcaattgggccaaataataatc

SEQ ID NO: 76163 - DNA, 25 bp, Homo sapien
ggagcaattttccaatcttcttcag

SEQ ID NO: 76164 - DNA, 25 bp, Homo sapien
ggagcaattttccgatcttcttcag

SEQ ID NO: 76165 - DNA, 25 bp, Homo sapien
ggagcaattttttgtaggtcaatta

SEQ ID NO: 76166 - DNA, 25 bp, Homo sapien
ggagcaattttttgtatgtcaatta

SEQ ID NO: 76167 - DNA, 25 bp, Homo sapien
ggagcaccaagcacctctatgaatg

SEQ ID NO: 76168 - DNA, 25 bp, Homo sapien
ggagcaccaagcgcctctatgaatg

SEQ ID NO: 76169 - DNA, 25 bp, Homo sapien
ggagcactgtagatccatcaacctt

SEQ ID NO: 76170 - DNA, 25 bp, Homo sapien
ggagcactgtagattcatcaacctt

SEQ ID NO: 76171 - DNA, 25 bp, Homo sapien
ggagcagaactgtccaggccttgta

SEQ ID NO: 76172 - DNA, 25 bp, Homo sapien
ggagcagaactttccaggccttgta

SEQ ID NO: 76173 - DNA, 25 bp, Homo sapien
ggagcagacggcttcttgttttgac

SEQ ID NO: 76174 - DNA, 25 bp, Homo sapien
ggagcagatggcttcttgttttgac

SEQ ID NO: 76175 - DNA, 25 bp, Homo sapien
ggagcagcaccttcaagacccagat

SEQ ID NO: 76176 - DNA, 25 bp, Homo sapien
ggagcagcaccttcgtagtgccaag

SEQ ID NO: 76177 - DNA, 25 bp, Homo sapien
ggagcagcatcttcaagacccagat

SEQ ID NO: 76178 - DNA, 25 bp, Homo sapien
ggagcagcatcttcgtagtgccaag

SEQ ID NO: 76179 - DNA, 25 bp, Homo sapien
ggagcagtaggcctagcaaggagag

SEQ ID NO: 76180 - DNA, 25 bp, Homo sapien
ggagcagtaggcctggcaaggagag

SEQ ID NO: 76181 - DNA, 25 bp, Homo sapien
ggagcagttcagcaccatagctaag

SEQ ID NO: 76182 - DNA, 25 bp, Homo sapien
ggagcagttcagcatcatagctaag

SEQ ID NO: 76183 - DNA, 25 bp, Homo sapien
ggagcagttgtcggtatggttatat

SEQ ID NO: 76184 - DNA, 25 bp, Homo sapien
ggagcagttgttggtatggttatat

SEQ ID NO: 76185 - DNA, 25 bp, Homo sapien
ggagcatctaacacatgcttgaaag

SEQ ID NO: 76186 - DNA, 25 bp, Homo sapien
ggagcatctaacccatgcttgaaag

SEQ ID NO: 76187 - DNA, 25 bp, Homo sapien
ggagcatgaagctgcacaggcatca

SEQ ID NO: 76188 - DNA, 25 bp, Homo sapien
ggagcatgaagttgcacaggcatca

SEQ ID NO: 76189 - DNA, 25 bp, Homo sapien
ggagcatgatctgacagaggaaact

SEQ ID NO: 76190 - DNA, 25 bp, Homo sapien
ggagcatgatctgatagaggaaact

SEQ ID NO: 76191 - DNA, 25 bp, Homo sapien
ggagcattcatgacactgaaaccag

SEQ ID NO: 76192 - DNA, 25 bp, Homo sapien
ggagcattcatgccactgaaaccag

SEQ ID NO: 76193 - DNA, 25 bp, Homo sapien
ggagccaacgggcagtatgacaggg

SEQ ID NO: 76194 - DNA, 25 bp, Homo sapien
ggagccaatgggcagtatgacaggg

SEQ ID NO: 76195 - DNA, 25 bp, Homo sapien
ggagccacattttaactccgggcca

SEQ ID NO: 76196 - DNA, 25 bp, Homo sapien
ggagccacattttcactccgggcca

SEQ ID NO: 76197 - DNA, 25 bp, Homo sapien
ggagccagcaatcagtcctccaagg

SEQ ID NO: 76198 - DNA, 25 bp, Homo sapien
ggagccagcaatcggtcctccaagg

SEQ ID NO: 76199 - DNA, 25 bp, Homo sapien
ggagcccataggaggaagttcccac

SEQ ID NO: 76200 - DNA, 25 bp, Homo sapien
ggagcccatagtaggaagttcccac

SEQ ID NO: 76201 - DNA, 25 bp, Homo sapien
ggagcctcattcttcctaaatctgc

SEQ ID NO: 76202 - DNA, 25 bp, Homo sapien
ggagcctcatttttcctaaatctgc

SEQ ID NO: 76203 - DNA, 25 bp, Homo sapien
ggagcctgctgggtgattcacattt

SEQ ID NO: 76204 - DNA, 25 bp, Homo sapien
ggagcctggaattcaaaagactgaa

SEQ ID NO: 76205 - DNA, 25 bp, Homo sapien
ggagcctggcattcaaaagactgaa

SEQ ID NO: 76206 - DNA, 25 bp, Homo sapien
ggagcctgggtacagaagtttctca

SEQ ID NO: 76207 - DNA, 25 bp, Homo sapien
ggagcctgtgtacagaagtttctca

SEQ ID NO: 76208 - DNA, 25 bp, Homo sapien
ggagcctgttgggtgattcacattt

SEQ ID NO: 76209 - DNA, 25 bp, Homo sapien
ggagcctttgggaactaattaatga

SEQ ID NO: 76210 - DNA, 25 bp, Homo sapien
ggagcctttgggagctaattaatga

SEQ ID NO: 76211 - DNA, 25 bp, Homo sapien
ggagcgcatttcatataacactaat

SEQ ID NO: 76212 - DNA, 25 bp, Homo sapien
ggagcgcatttcatctaacactaat

SEQ ID NO: 76213 - DNA, 25 bp, Homo sapien
ggagcggacaccagagcaggatgag

SEQ ID NO: 76214 - DNA, 25 bp, Homo sapien
ggagcggacaccagagtaggatgag

SEQ ID NO: 76215 - DNA, 25 bp, Homo sapien
ggagcgtgctctcgaattgaatgcc

SEQ ID NO: 76216 - DNA, 25 bp, Homo sapien
ggagcgtgctctggaattgaatgcc

SEQ ID NO: 76217 - DNA, 25 bp, Homo sapien
ggagctacacaccgtcaaattaagg

SEQ ID NO: 76218 - DNA, 25 bp, Homo sapien
ggagctacacactgtcaaattaagg

SEQ ID NO: 76219 - DNA, 25 bp, Homo sapien
ggagctaccgtagttctgtgtttga

SEQ ID NO: 76220 - DNA, 25 bp, Homo sapien
ggagctactgtagttctgtgtttga

SEQ ID NO: 76221 - DNA, 25 bp, Homo sapien
ggagctcaccaaaggcaccactaat

SEQ ID NO: 76222 - DNA, 25 bp, Homo sapien
ggagctcaccaaaggcgccactaat

SEQ ID NO: 76223 - DNA, 25 bp, Homo sapien
ggagctcaccgaatgttggattgct

SEQ ID NO: 76224 - DNA, 25 bp, Homo sapien
ggagctcagcgaatgttggattgct

SEQ ID NO: 76225 - DNA, 25 bp, Homo sapien
ggagctcagggcttggcagcatgta

SEQ ID NO: 76226 - DNA, 25 bp, Homo sapien
ggagctcatggcttggcagcatgta

SEQ ID NO: 76227 - DNA, 25 bp, Homo sapien
ggagctcattaactcacaaggtagc

SEQ ID NO: 76228 - DNA, 25 bp, Homo sapien
ggagctcattaattcacaaggtagc

SEQ ID NO: 76229 - DNA, 25 bp, Homo sapien
ggagctcatttgtctgacggttttt

SEQ ID NO: 76230 - DNA, 25 bp, Homo sapien
ggagctcatttttctgacggttttt

SEQ ID NO: 76231 - DNA, 25 bp, Homo sapien
ggagctcctcacagcgtagtggaag

SEQ ID NO: 76232 - DNA, 25 bp, Homo sapien
ggagctcctcacagtgtagtggaag

SEQ ID NO: 76233 - DNA, 25 bp, Homo sapien
ggagctgaaaagtcacaatcttttt

SEQ ID NO: 76234 - DNA, 25 bp, Homo sapien
ggagctgaagagtcacaatcttttt

SEQ ID NO: 76235 - DNA, 25 bp, Homo sapien
ggagctgcaaccaatggtcaaactt

SEQ ID NO: 76236 - DNA, 25 bp, Homo sapien
ggagctgcgaccaatggtcaaactt

SEQ ID NO: 76237 - DNA, 25 bp, Homo sapien
ggagctgcgttcaagggatgcactg

SEQ ID NO: 76238 - DNA, 25 bp, Homo sapien
ggagctgcgttcgagggatgcactg

SEQ ID NO: 76239 - DNA, 25 bp, Homo sapien
ggagctgctgcataagaaacgaaac

SEQ ID NO: 76240 - DNA, 25 bp, Homo sapien
ggagctgctgcattagaaacgaaac

SEQ ID NO: 76241 - DNA, 25 bp, Homo sapien
ggagctgtcctctgacctaccaaag

SEQ ID NO: 76242 - DNA, 25 bp, Homo sapien
ggagctgtcttctgacctaccaaag

SEQ ID NO: 76243 - DNA, 25 bp, Homo sapien
ggagctgtggacattccttgcactg

SEQ ID NO: 76244 - DNA, 25 bp, Homo sapien
ggagctgtggactttccttgcactg

SEQ ID NO: 76245 - DNA, 25 bp, Homo sapien
ggagctgttcctatgaagccatgtt

SEQ ID NO: 76246 - DNA, 25 bp, Homo sapien
ggagctgttcctattaagccatgtt

SEQ ID NO: 76247 - DNA, 25 bp, Homo sapien
ggagcttagggacttagaatgcttt

SEQ ID NO: 76248 - DNA, 25 bp, Homo sapien
ggagcttagggatttagaatgcttt

SEQ ID NO: 76249 - DNA, 25 bp, Homo sapien
ggagcttcctccttcactgggcact

SEQ ID NO: 76250 - DNA, 25 bp, Homo sapien
ggagcttcctctttcactgggcact

SEQ ID NO: 76251 - DNA, 25 bp, Homo sapien
ggagcttctcccacaaagactttca

SEQ ID NO: 76252 - DNA, 25 bp, Homo sapien
ggagcttctcccgcaaagactttca

SEQ ID NO: 76253 - DNA, 25 bp, Homo sapien
ggagcttgatacagggccagggctt

SEQ ID NO: 76254 - DNA, 25 bp, Homo sapien
ggagcttgatacggggccagggctt

SEQ ID NO: 76255 - DNA, 25 bp, Homo sapien
ggagcttgcactttagtggaagaga

SEQ ID NO: 76256 - DNA, 25 bp, Homo sapien
ggagcttgtactttagtggaagaga

SEQ ID NO: 76257 - DNA, 25 bp, Homo sapien
ggagctttgtgatccgcttggctga

SEQ ID NO: 76258 - DNA, 25 bp, Homo sapien
ggagctttgtgatctgcttggctga

SEQ ID NO: 76259 - DNA, 25 bp, Homo sapien
ggaggaaaaatcatctttccaaatg

SEQ ID NO: 76260 - DNA, 25 bp, Homo sapien
ggaggaaaaatcgtctttccaaatg

SEQ ID NO: 76261 - DNA, 25 bp, Homo sapien
ggaggaaaacaagaatgatcttaca

SEQ ID NO: 76262 - DNA, 25 bp, Homo sapien
ggaggaaaacatgaatgatcttaca

SEQ ID NO: 76263 - DNA, 25 bp, Homo sapien
ggaggaaatatctactgggtaaatg

SEQ ID NO: 76264 - DNA, 25 bp, Homo sapien
ggaggaaatgtctactgggtaaatg

SEQ ID NO: 76265 - DNA, 25 bp, Homo sapien
ggaggaacagtcacttctggtcctg

SEQ ID NO: 76266 - DNA, 25 bp, Homo sapien
ggaggaacagtgacttctggtcctg

SEQ ID NO: 76267 - DNA, 25 bp, Homo sapien
ggaggaagactgaggaaataaaagt

SEQ ID NO: 76268 - DNA, 25 bp, Homo sapien
ggaggaagctcactttataaaacag

SEQ ID NO: 76269 - DNA, 25 bp, Homo sapien
ggaggaagctcagtttataaaacag

SEQ ID NO: 76270 - DNA, 25 bp, Homo sapien
ggaggaagtctgaggaaataaaagt

SEQ ID NO: 76271 - DNA, 25 bp, Homo sapien
ggaggaatgaacaactggagacgcg

SEQ ID NO: 76272 - DNA, 25 bp, Homo sapien
ggaggaatgacatgcgtgacatatt

SEQ ID NO: 76273 - DNA, 25 bp, Homo sapien
ggaggaatgacatgtgtgacatatt

SEQ ID NO: 76274 - DNA, 25 bp, Homo sapien
ggaggaatgtacaactggagacgcg

SEQ ID NO: 76275 - DNA, 25 bp, Homo sapien
ggaggacaccaccctgaaaggacga

SEQ ID NO: 76276 - DNA, 25 bp, Homo sapien
ggaggacaccatcctgaaaggacga

SEQ ID NO: 76277 - DNA, 25 bp, Homo sapien
ggaggactccacggtgcaggcagag

SEQ ID NO: 76278 - DNA, 25 bp, Homo sapien
ggaggactccatggtgcaggcagag

SEQ ID NO: 76279 - DNA, 25 bp, Homo sapien
ggaggagaagaacaagtgatgatta

SEQ ID NO: 76280 - DNA, 25 bp, Homo sapien
ggaggagaagaacaggtgatgatta

SEQ ID NO: 76281 - DNA, 25 bp, Homo sapien
ggaggagctaaagtcactgggaaca

SEQ ID NO: 76282 - DNA, 25 bp, Homo sapien
ggaggagctaaagtcattgggaaca

SEQ ID NO: 76283 - DNA, 25 bp, Homo sapien
ggaggaggcttcttattcatgccct

SEQ ID NO: 76284 - DNA, 25 bp, Homo sapien
ggaggagggttcttattcatgccct

SEQ ID NO: 76285 - DNA, 25 bp, Homo sapien
ggaggaggtcagactttgtcctatt

SEQ ID NO: 76286 - DNA, 25 bp, Homo sapien
ggaggaggtcagtctttgtcctatt

SEQ ID NO: 76287 - DNA, 25 bp, Homo sapien
ggaggagtattcctaccggtttgga

SEQ ID NO: 76288 - DNA, 25 bp, Homo sapien
ggaggagtattcctactggtttgga

SEQ ID NO: 76289 - DNA, 25 bp, Homo sapien
ggaggagttgggacgaaggtatcaa

SEQ ID NO: 76290 - DNA, 25 bp, Homo sapien
ggaggagttgggatgaaggtatcaa

SEQ ID NO: 76291 - DNA, 25 bp, Homo sapien
ggaggatcaggtagaataatactca

SEQ ID NO: 76292 - DNA, 25 bp, Homo sapien
ggaggatccaacaggaaggcaactt

SEQ ID NO: 76293 - DNA, 25 bp, Homo sapien
ggaggatccaacgggaaggcaactt

SEQ ID NO: 76294 - DNA, 25 bp, Homo sapien
ggaggatcgggtagaataatactca

SEQ ID NO: 76295 - DNA, 25 bp, Homo sapien
ggaggatgactggtctgagattttc

SEQ ID NO: 76296 - DNA, 25 bp, Homo sapien
ggaggatgactggtgtgagattttc

SEQ ID NO: 76297 - DNA, 25 bp, Homo sapien
ggaggattaggtcaaaaccaacagc

SEQ ID NO: 76298 - DNA, 25 bp, Homo sapien
ggaggattaggttaaaaccaacagc

SEQ ID NO: 76299 - DNA, 25 bp, Homo sapien
ggaggcaacggcgagggagctttaa

SEQ ID NO: 76300 - DNA, 25 bp, Homo sapien
ggaggcaagaaatctgagctcaagg

SEQ ID NO: 76301 - DNA, 25 bp, Homo sapien
ggaggcaagaagtctgagctcaagg

SEQ ID NO: 76302 - DNA, 25 bp, Homo sapien
ggaggcaatggagtaaagaggagtg

SEQ ID NO: 76303 - DNA, 25 bp, Homo sapien
ggaggcaatggagtgaagaggagtg

SEQ ID NO: 76304 - DNA, 25 bp, Homo sapien
ggaggcaatggcgagggagctttaa

SEQ ID NO: 76305 - DNA, 25 bp, Homo sapien
ggaggcacgcatatgcggtagttct

SEQ ID NO: 76306 - DNA, 25 bp, Homo sapien
ggaggcacgcatgtgcggtagttct

SEQ ID NO: 76307 - DNA, 25 bp, Homo sapien
ggaggcatccgaaatcggttcagat

SEQ ID NO: 76308 - DNA, 25 bp, Homo sapien
ggaggcatcggaaatcggttcagat

SEQ ID NO: 76309 - DNA, 25 bp, Homo sapien
ggaggccccagtggacactgaattc

SEQ ID NO: 76310 - DNA, 25 bp, Homo sapien
ggaggccccagtggacgctgaattc

SEQ ID NO: 76311 - DNA, 25 bp, Homo sapien
ggaggcccctggtcctgaaagtgct

SEQ ID NO: 76312 - DNA, 25 bp, Homo sapien
ggaggcccctgttcctgaaagtgct

SEQ ID NO: 76313 - DNA, 25 bp, Homo sapien
ggaggctccgctacataggcatgct

SEQ ID NO: 76314 - DNA, 25 bp, Homo sapien
ggaggctccgctacgtaggcatgct

SEQ ID NO: 76315 - DNA, 25 bp, Homo sapien
ggaggctcctttacaatgtggccat

SEQ ID NO: 76316 - DNA, 25 bp, Homo sapien
ggaggctcctttaccatgtggccat

SEQ ID NO: 76317 - DNA, 25 bp, Homo sapien
ggaggctgaaaatacaagatcaggg

SEQ ID NO: 76318 - DNA, 25 bp, Homo sapien
ggaggctgaaagtacaagatcaggg

SEQ ID NO: 76319 - DNA, 25 bp, Homo sapien
ggaggctgcatctgctcttctgtcc

SEQ ID NO: 76320 - DNA, 25 bp, Homo sapien
ggaggctgcctactttagacaacta

SEQ ID NO: 76321 - DNA, 25 bp, Homo sapien
ggaggctgcctacttttgacaacta

SEQ ID NO: 76322 - DNA, 25 bp, Homo sapien
ggaggctgtatctgctcttctgtcc

SEQ ID NO: 76323 - DNA, 25 bp, Homo sapien
ggagggaagatcatttgagctcagc

SEQ ID NO: 76324 - DNA, 25 bp, Homo sapien
ggagggaagatcgtttgagctcagc

SEQ ID NO: 76325 - DNA, 25 bp, Homo sapien
ggagggagagaaccgctaaaataaa

SEQ ID NO: 76326 - DNA, 25 bp, Homo sapien
ggagggagagaatcgctaaaataaa

SEQ ID NO: 76327 - DNA, 25 bp, Homo sapien
ggagggcactaaccatcttgacttg

SEQ ID NO: 76328 - DNA, 25 bp, Homo sapien
ggagggcactaaccgtcttgacttg

SEQ ID NO: 76329 - DNA, 25 bp, Homo sapien
ggagggcagccctgtgcatttttgg

SEQ ID NO: 76330 - DNA, 25 bp, Homo sapien
ggagggcagccttgtgcatttttgg

SEQ ID NO: 76331 - DNA, 25 bp, Homo sapien
ggagggtatctaatagaagcatctt

SEQ ID NO: 76332 - DNA, 25 bp, Homo sapien
ggagggtatctgatagaagcatctt

SEQ ID NO: 76333 - DNA, 25 bp, Homo sapien
ggagggtatcttgcatttgtcttgg

SEQ ID NO: 76334 - DNA, 25 bp, Homo sapien
ggagggtattttgcatttgtcttgg

SEQ ID NO: 76335 - DNA, 25 bp, Homo sapien
ggagggtgtaaacagtacctgacaa

SEQ ID NO: 76336 - DNA, 25 bp, Homo sapien
ggagggtgtaaatagtacctgacaa

SEQ ID NO: 76337 - DNA, 25 bp, Homo sapien
ggaggtaaaaagatgacaaacagcc

SEQ ID NO: 76338 - DNA, 25 bp, Homo sapien
ggaggtaaaaagctgacaaacagcc

SEQ ID NO: 76339 - DNA, 25 bp, Homo sapien
ggaggtagagagaatgaaaattaaa

SEQ ID NO: 76340 - DNA, 25 bp, Homo sapien
ggaggtagagagaatggaaattaaa

SEQ ID NO: 76341 - DNA, 25 bp, Homo sapien
ggaggtatgtacacattttcccagt

SEQ ID NO: 76342 - DNA, 25 bp, Homo sapien
ggaggtatgtactcattttcccagt

SEQ ID NO: 76343 - DNA, 25 bp, Homo sapien
ggaggtcaatactcaaaacttaaag

SEQ ID NO: 76344 - DNA, 25 bp, Homo sapien
ggaggtcaatactgaaaacttaaag

SEQ ID NO: 76345 - DNA, 25 bp, Homo sapien
ggaggtcagacgccaagtagaaaac

SEQ ID NO: 76346 - DNA, 25 bp, Homo sapien
ggaggtcagacgtcaagtagaaaac

SEQ ID NO: 76347 - DNA, 25 bp, Homo sapien
ggaggtcagactttgtcctatttag

SEQ ID NO: 76348 - DNA, 25 bp, Homo sapien
ggaggtcagtctttgtcctatttag

SEQ ID NO: 76349 - DNA, 25 bp, Homo sapien
ggaggtccatggatgctatgtgtct

SEQ ID NO: 76350 - DNA, 25 bp, Homo sapien
ggaggtccatggttgctatgtgtct

SEQ ID NO: 76351 - DNA, 25 bp, Homo sapien
ggaggtcttctctggaattatatca

SEQ ID NO: 76352 - DNA, 25 bp, Homo sapien
ggaggtcttctttggaattatatca

SEQ ID NO: 76353 - DNA, 25 bp, Homo sapien
ggaggtgaaaacttgtctaggtttc

SEQ ID NO: 76354 - DNA, 25 bp, Homo sapien
ggaggtgaaaacttttctaggtttc

SEQ ID NO: 76355 - DNA, 25 bp, Homo sapien
ggaggttccgattttgttgtctggg

SEQ ID NO: 76356 - DNA, 25 bp, Homo sapien
ggaggttctgattttgttgtctggg

SEQ ID NO: 76357 - DNA, 25 bp, Homo sapien
ggaggttgaaactgcaatgagcgtt

SEQ ID NO: 76358 - DNA, 25 bp, Homo sapien
ggaggttgaaactgcagtgagcgtt

SEQ ID NO: 76359 - DNA, 25 bp, Homo sapien
ggaggttgacgaaatattatgcaac

SEQ ID NO: 76360 - DNA, 25 bp, Homo sapien
ggaggttgatgaaatattatgcaac

SEQ ID NO: 76361 - DNA, 25 bp, Homo sapien
ggaggtttgccactaggatttcccc

SEQ ID NO: 76362 - DNA, 25 bp, Homo sapien
ggaggtttgtcactaggatttcccc

SEQ ID NO: 76363 - DNA, 25 bp, Homo sapien
ggagtaaacgatttttgcaggatag

SEQ ID NO: 76364 - DNA, 25 bp, Homo sapien
ggagtaaatgatttttgcaggatag

SEQ ID NO: 76365 - DNA, 25 bp, Homo sapien
ggagtaattaatcactcccgccact

SEQ ID NO: 76366 - DNA, 25 bp, Homo sapien
ggagtaattaatcattcccgccact

SEQ ID NO: 76367 - DNA, 25 bp, Homo sapien
ggagtacagccttgctgacagcttg

SEQ ID NO: 76368 - DNA, 25 bp, Homo sapien
ggagtacagccttgttgacagcttg

SEQ ID NO: 76369 - DNA, 25 bp, Homo sapien
ggagtacgaaaaaaaactcctgcag

SEQ ID NO: 76370 - DNA, 25 bp, Homo sapien
ggagtacgaaaacaaactcctgcag

SEQ ID NO: 76371 - DNA, 25 bp, Homo sapien
ggagtagaattaacagaagacagag

SEQ ID NO: 76372 - DNA, 25 bp, Homo sapien
ggagtagaattatgcagattgattt

SEQ ID NO: 76373 - DNA, 25 bp, Homo sapien
ggagtagaattattcagattgattt

SEQ ID NO: 76374 - DNA, 25 bp, Homo sapien
ggagtagacacactaacacataaat

SEQ ID NO: 76375 - DNA, 25 bp, Homo sapien
ggagtagacaccctaacacataaat

SEQ ID NO: 76376 - DNA, 25 bp, Homo sapien
ggagtagagcacgtagcagtatcct

SEQ ID NO: 76377 - DNA, 25 bp, Homo sapien
ggagtagagcacttagcagtatcct

SEQ ID NO: 76378 - DNA, 25 bp, Homo sapien
ggagtagagttaacagaagacagag

SEQ ID NO: 76379 - DNA, 25 bp, Homo sapien
ggagtagctgtgggatctaacaatg

SEQ ID NO: 76380 - DNA, 25 bp, Homo sapien
ggagtagctgtgggttctaacaatg

SEQ ID NO: 76381 - DNA, 25 bp, Homo sapien
ggagtaggaaataagagagatagct

SEQ ID NO: 76382 - DNA, 25 bp, Homo sapien
ggagtaggaaatgagagagatagct

SEQ ID NO: 76383 - DNA, 25 bp, Homo sapien
ggagtatagatccacgtctctgttc

SEQ ID NO: 76384 - DNA, 25 bp, Homo sapien
ggagtatagatccatgtctctgttc

SEQ ID NO: 76385 - DNA, 25 bp, Homo sapien
ggagtatcagacgcatttatttcgc

SEQ ID NO: 76386 - DNA, 25 bp, Homo sapien
ggagtatcagatgcatttatttcgc

SEQ ID NO: 76387 - DNA, 25 bp, Homo sapien
ggagtattcctaccggtttggatat

SEQ ID NO: 76388 - DNA, 25 bp, Homo sapien
ggagtattcctactggtttggatat

SEQ ID NO: 76389 - DNA, 25 bp, Homo sapien
ggagtatttctatagagaggatcca

SEQ ID NO: 76390 - DNA, 25 bp, Homo sapien
ggagtatttctttagagaggatcca

SEQ ID NO: 76391 - DNA, 25 bp, Homo sapien
ggagtcaacccccagttccaccatt

SEQ ID NO: 76392 - DNA, 25 bp, Homo sapien
ggagtcaacccctagttccaccatt

SEQ ID NO: 76393 - DNA, 25 bp, Homo sapien
ggagtcaactgtgcacaacgtgctg

SEQ ID NO: 76394 - DNA, 25 bp, Homo sapien
ggagtcaactgtgcgcaacgtgctg

SEQ ID NO: 76395 - DNA, 25 bp, Homo sapien
ggagtcacaattctgctaacagtac

SEQ ID NO: 76396 - DNA, 25 bp, Homo sapien
ggagtcacaattttgctaacagtac

SEQ ID NO: 76397 - DNA, 25 bp, Homo sapien
ggagtcacaggacaaaacttgaaat

SEQ ID NO: 76398 - DNA, 25 bp, Homo sapien
ggagtcacaggacaaaccttgaaat

SEQ ID NO: 76399 - DNA, 25 bp, Homo sapien
ggagtcacttatgtcacatttctct

SEQ ID NO: 76400 - DNA, 25 bp, Homo sapien
ggagtcacttatgtcagatttctct

SEQ ID NO: 76401 - DNA, 25 bp, Homo sapien
ggagtcagcatacccaacctgaaag

SEQ ID NO: 76402 - DNA, 25 bp, Homo sapien
ggagtcagcatacccatcctgaaag

SEQ ID NO: 76403 - DNA, 25 bp, Homo sapien
ggagtcatagagaagaaagatttgg

SEQ ID NO: 76404 - DNA, 25 bp, Homo sapien
ggagtcatagataagaaagatttgg

SEQ ID NO: 76405 - DNA, 25 bp, Homo sapien
ggagtcatagatattcacattatct

SEQ ID NO: 76406 - DNA, 25 bp, Homo sapien
ggagtcatagatattcgcattatct

SEQ ID NO: 76407 - DNA, 25 bp, Homo sapien
ggagtccattatgcttccaaatgca

SEQ ID NO: 76408 - DNA, 25 bp, Homo sapien
ggagtccattatgctttcaaatgca

SEQ ID NO: 76409 - DNA, 25 bp, Homo sapien
ggagtcctgattactgaattgaagg

SEQ ID NO: 76410 - DNA, 25 bp, Homo sapien
ggagtcctgattattgaattgaagg

SEQ ID NO: 76411 - DNA, 25 bp, Homo sapien
ggagtctgccagatcaacaattctc

SEQ ID NO: 76412 - DNA, 25 bp, Homo sapien
ggagtctgtcagatcaacaattctc

SEQ ID NO: 76413 - DNA, 25 bp, Homo sapien
ggagtctgttaataaggaatttttg

SEQ ID NO: 76414 - DNA, 25 bp, Homo sapien
ggagtctgttaatgaggaatttttg

SEQ ID NO: 76415 - DNA, 25 bp, Homo sapien
ggagtgaacaaataagagaagcagg

SEQ ID NO: 76416 - DNA, 25 bp, Homo sapien
ggagtgaacaagtaagagaagcagg

SEQ ID NO: 76417 - DNA, 25 bp, Homo sapien
ggagtgaattgcagtatttaacaag

SEQ ID NO: 76418 - DNA, 25 bp, Homo sapien
ggagtgaattgcggtatttaacaag

SEQ ID NO: 76419 - DNA, 25 bp, Homo sapien
ggagtgacttggacaaggtggtcag

SEQ ID NO: 76420 - DNA, 25 bp, Homo sapien
ggagtgacttggataaggtggtcag

SEQ ID NO: 76421 - DNA, 25 bp, Homo sapien
ggagtgaggatgcaaaaatagaaaa

SEQ ID NO: 76422 - DNA, 25 bp, Homo sapien
ggagtgaggatggaaaaatagaaaa

SEQ ID NO: 76423 - DNA, 25 bp, Homo sapien
ggagtgagggaaagaactttgagag

SEQ ID NO: 76424 - DNA, 25 bp, Homo sapien
ggagtgagggaaataactttgagag

SEQ ID NO: 76425 - DNA, 25 bp, Homo sapien
ggagtgataccacaataaacgatat

SEQ ID NO: 76426 - DNA, 25 bp, Homo sapien
ggagtgataccacgataaacgatat

SEQ ID NO: 76427 - DNA, 25 bp, Homo sapien
ggagtgatgccaccattgacttcag

SEQ ID NO: 76428 - DNA, 25 bp, Homo sapien
ggagtgatgccaccgttgacttcag

SEQ ID NO: 76429 - DNA, 25 bp, Homo sapien
ggagtgcacgtcatagccacttgcc

SEQ ID NO: 76430 - DNA, 25 bp, Homo sapien
ggagtgcagttgtgatcatagctcc

SEQ ID NO: 76431 - DNA, 25 bp, Homo sapien
ggagtgcagttgtgattatagctcc

SEQ ID NO: 76432 - DNA, 25 bp, Homo sapien
ggagtgcatgtcatagccacttgcc

SEQ ID NO: 76433 - DNA, 25 bp, Homo sapien
ggagtgcattttgatcatgttaaat

SEQ ID NO: 76434 - DNA, 25 bp, Homo sapien
ggagtgcattttggtcatgttaaat

SEQ ID NO: 76435 - DNA, 25 bp, Homo sapien
ggagtgctattgctatcacctggta

SEQ ID NO: 76436 - DNA, 25 bp, Homo sapien
ggagtgctattgctgtcacctggta

SEQ ID NO: 76437 - DNA, 25 bp, Homo sapien
ggagtggacttacagcgcaatcgac

SEQ ID NO: 76438 - DNA, 25 bp, Homo sapien
ggagtggacttatagcgcaatcgac

SEQ ID NO: 76439 - DNA, 25 bp, Homo sapien
ggagtggcatcctgacagctttccc

SEQ ID NO: 76440 - DNA, 25 bp, Homo sapien
ggagtggcatcttgacagctttccc

SEQ ID NO: 76441 - DNA, 25 bp, Homo sapien
ggagtgtcctgaaaactcactctca

SEQ ID NO: 76442 - DNA, 25 bp, Homo sapien
ggagtgtcctgacaactcactctca

SEQ ID NO: 76443 - DNA, 25 bp, Homo sapien
ggagtgtggactgttcggttaatat

SEQ ID NO: 76444 - DNA, 25 bp, Homo sapien
ggagtgtgtactgttcggttaatat

SEQ ID NO: 76445 - DNA, 25 bp, Homo sapien
ggagtgtttgttcctcacctaacat

SEQ ID NO: 76446 - DNA, 25 bp, Homo sapien
ggagtgtttgttcgtcacctaacat

SEQ ID NO: 76447 - DNA, 25 bp, Homo sapien
ggagttaatgttgaaaaagatgaac

SEQ ID NO: 76448 - DNA, 25 bp, Homo sapien
ggagttaatgttggaaaagatgaac

SEQ ID NO: 76449 - DNA, 25 bp, Homo sapien
ggagttaatttgccgcagttataag

SEQ ID NO: 76450 - DNA, 25 bp, Homo sapien
ggagttaatttgctgcagttataag

SEQ ID NO: 76451 - DNA, 25 bp, Homo sapien
ggagttagttataccgatcttcatt

SEQ ID NO: 76452 - DNA, 25 bp, Homo sapien
ggagttagttatactgatcttcatt

SEQ ID NO: 76453 - DNA, 25 bp, Homo sapien
ggagttcagttttggtcatgttcaa

SEQ ID NO: 76454 - DNA, 25 bp, Homo sapien
ggagttcagtttttgtcatgttcaa

SEQ ID NO: 76455 - DNA, 25 bp, Homo sapien
ggagttctaacctctggtacctcag

SEQ ID NO: 76456 - DNA, 25 bp, Homo sapien
ggagttctaacctgtggtacctcag

SEQ ID NO: 76457 - DNA, 25 bp, Homo sapien
ggagttgaaaaacacattaagagct

SEQ ID NO: 76458 - DNA, 25 bp, Homo sapien
ggagttgaaaaacccattaagagct

SEQ ID NO: 76459 - DNA, 25 bp, Homo sapien
ggagttgaagaaagggagtttccca

SEQ ID NO: 76460 - DNA, 25 bp, Homo sapien
ggagttgaagatagggagtttccca

SEQ ID NO: 76461 - DNA, 25 bp, Homo sapien
ggagttgccattttattggtgccac

SEQ ID NO: 76462 - DNA, 25 bp, Homo sapien
ggagttgccgttttattggtgccac

SEQ ID NO: 76463 - DNA, 25 bp, Homo sapien
ggagttgggaacacatgatgagctc

SEQ ID NO: 76464 - DNA, 25 bp, Homo sapien
ggagttgggaacacgtgatgagctc

SEQ ID NO: 76465 - DNA, 25 bp, Homo sapien
ggagttgtgtcacctatcagcgggc

SEQ ID NO: 76466 - DNA, 25 bp, Homo sapien
ggagttgtgtcatctatcagcgggc

SEQ ID NO: 76467 - DNA, 25 bp, Homo sapien
ggagtttcaggaatgaagctgagtc

SEQ ID NO: 76468 - DNA, 25 bp, Homo sapien
ggagtttcaggaatgaggctgagtc

SEQ ID NO: 76469 - DNA, 25 bp, Homo sapien
ggagtttcatgagatacaatatagt

SEQ ID NO: 76470 - DNA, 25 bp, Homo sapien
ggagtttctcagagagtactcagat

SEQ ID NO: 76471 - DNA, 25 bp, Homo sapien
ggagtttctcagatagtactcagat

SEQ ID NO: 76472 - DNA, 25 bp, Homo sapien
ggagtttctcatttacagtcctttt

SEQ ID NO: 76473 - DNA, 25 bp, Homo sapien
ggagtttctcatttacggtcctttt

SEQ ID NO: 76474 - DNA, 25 bp, Homo sapien
ggagtttctgcaaagccattaaaaa

SEQ ID NO: 76475 - DNA, 25 bp, Homo sapien
ggagtttctgcaatgccattaaaaa

SEQ ID NO: 76476 - DNA, 25 bp, Homo sapien
ggagtttcttgagatacaatatagt

SEQ ID NO: 76477 - DNA, 25 bp, Homo sapien
ggagtttgtttaaataagttagcag

SEQ ID NO: 76478 - DNA, 25 bp, Homo sapien
ggagtttgtttcaataagttagcag

SEQ ID NO: 76479 - DNA, 25 bp, Homo sapien
ggataaaagataggaagagacacta

SEQ ID NO: 76480 - DNA, 25 bp, Homo sapien
ggataaaagatatgaagagacacta

SEQ ID NO: 76481 - DNA, 25 bp, Homo sapien
ggataaagacagcagttggttagat

SEQ ID NO: 76482 - DNA, 25 bp, Homo sapien
ggataaagacaggagttggttagat

SEQ ID NO: 76483 - DNA, 25 bp, Homo sapien
ggataaatcgtgaattggaaggagt

SEQ ID NO: 76484 - DNA, 25 bp, Homo sapien
ggataaatcgtgagttggaaggagt

SEQ ID NO: 76485 - DNA, 25 bp, Homo sapien
ggataaatgcacacatgtcaaggtg

SEQ ID NO: 76486 - DNA, 25 bp, Homo sapien
ggataaatgcacagatgtcaaggtg

SEQ ID NO: 76487 - DNA, 25 bp, Homo sapien
ggataaattattgttttcattagct

SEQ ID NO: 76488 - DNA, 25 bp, Homo sapien
ggataaattatttttttcattagct

SEQ ID NO: 76489 - DNA, 25 bp, Homo sapien
ggataaatttgcttcgcgtttggag

SEQ ID NO: 76490 - DNA, 25 bp, Homo sapien
ggataaatttgctttgcgtttggag

SEQ ID NO: 76491 - DNA, 25 bp, Homo sapien
ggataacacaggtcattaaaggtct

SEQ ID NO: 76492 - DNA, 25 bp, Homo sapien
ggataacacaggtcgttaaaggtct

SEQ ID NO: 76493 - DNA, 25 bp, Homo sapien
ggataactaatacttgtacacacaa

SEQ ID NO: 76494 - DNA, 25 bp, Homo sapien
ggataactaatatttgtacacacaa

SEQ ID NO: 76495 - DNA, 25 bp, Homo sapien
ggataactcaaaccgccaaatttca

SEQ ID NO: 76496 - DNA, 25 bp, Homo sapien
ggataactcaaactgccaaatttca

SEQ ID NO: 76497 - DNA, 25 bp, Homo sapien
ggataactctctataactccttcaa

SEQ ID NO: 76498 - DNA, 25 bp, Homo sapien
ggataactctctgtaactccttcaa

SEQ ID NO: 76499 - DNA, 25 bp, Homo sapien
ggataagaattgaacaaccaaatat

SEQ ID NO: 76500 - DNA, 25 bp, Homo sapien
ggataagaattgaccaaccaaatat

SEQ ID NO: 76501 - DNA, 25 bp, Homo sapien
ggataaggacatgtaaaggaagttg

SEQ ID NO: 76502 - DNA, 25 bp, Homo sapien
ggataaggacatgtgaaggaagttg

SEQ ID NO: 76503 - DNA, 25 bp, Homo sapien
ggataaggcccattggcaagggaag

SEQ ID NO: 76504 - DNA, 25 bp, Homo sapien
ggataaggcccattggtaagggaag

SEQ ID NO: 76505 - DNA, 25 bp, Homo sapien
ggataaggtaactgccataacaaaa

SEQ ID NO: 76506 - DNA, 25 bp, Homo sapien
ggataaggtcactgccataacaaaa

SEQ ID NO: 76507 - DNA, 25 bp, Homo sapien
ggataatctgagattcacgcaaaga

SEQ ID NO: 76508 - DNA, 25 bp, Homo sapien
ggataatctgaggttcacgcaaaga

SEQ ID NO: 76509 - DNA, 25 bp, Homo sapien
ggataatgagaacgttctctggcat

SEQ ID NO: 76510 - DNA, 25 bp, Homo sapien
ggataatgagaatgttctctggcat

SEQ ID NO: 76511 - DNA, 25 bp, Homo sapien
ggataatgtgaaatatggcctaatt

SEQ ID NO: 76512 - DNA, 25 bp, Homo sapien
ggataatgtgaactatggcctaatt

SEQ ID NO: 76513 - DNA, 25 bp, Homo sapien
ggataattaaagcatgagctcaggc

SEQ ID NO: 76514 - DNA, 25 bp, Homo sapien
ggataattgaagcatgagctcaggc

SEQ ID NO: 76515 - DNA, 25 bp, Homo sapien
ggatacagccagggtcattgccatc

SEQ ID NO: 76516 - DNA, 25 bp, Homo sapien
ggatacagccagggtcgttgccatc

SEQ ID NO: 76517 - DNA, 25 bp, Homo sapien
ggatacagtaaacagggccattgat

SEQ ID NO: 76518 - DNA, 25 bp, Homo sapien
ggatacagtaaatagggccattgat

SEQ ID NO: 76519 - DNA, 25 bp, Homo sapien
ggatacagtatcatggctagtgctg

SEQ ID NO: 76520 - DNA, 25 bp, Homo sapien
ggatacagtatcgtggctagtgctg

SEQ ID NO: 76521 - DNA, 25 bp, Homo sapien
ggatacataaacttacaaaaagatg

SEQ ID NO: 76522 - DNA, 25 bp, Homo sapien
ggatacataaacttacgaaaagatg

SEQ ID NO: 76523 - DNA, 25 bp, Homo sapien
ggataccaagggaagactgtatgtg

SEQ ID NO: 76524 - DNA, 25 bp, Homo sapien
ggataccaagggacgactgtatgtg

SEQ ID NO: 76525 - DNA, 25 bp, Homo sapien
ggataccatataacttggcactcat

SEQ ID NO: 76526 - DNA, 25 bp, Homo sapien
ggataccatatgacttggcactcat

SEQ ID NO: 76527 - DNA, 25 bp, Homo sapien
ggatactcaactacttcacatttca

SEQ ID NO: 76528 - DNA, 25 bp, Homo sapien
ggatactcaactgcttcacatttca

SEQ ID NO: 76529 - DNA, 25 bp, Homo sapien
ggatactcagtactttgaagaggct

SEQ ID NO: 76530 - DNA, 25 bp, Homo sapien
ggatactcagtcctttgaagaggct

SEQ ID NO: 76531 - DNA, 25 bp, Homo sapien
ggatactcccgatgttcaaaaagat

SEQ ID NO: 76532 - DNA, 25 bp, Homo sapien
ggatactctcgatgttcaaaaagat

SEQ ID NO: 76533 - DNA, 25 bp, Homo sapien
ggatactgagacaactcatgaagac

SEQ ID NO: 76534 - DNA, 25 bp, Homo sapien
ggatactgagacagctcatgaagac

SEQ ID NO: 76535 - DNA, 25 bp, Homo sapien
ggatactgatacacttttttgcaga

SEQ ID NO: 76536 - DNA, 25 bp, Homo sapien
ggatactgatacatttttttgcaga

SEQ ID NO: 76537 - DNA, 25 bp, Homo sapien
ggatacttgcagccagctctaaagc

SEQ ID NO: 76538 - DNA, 25 bp, Homo sapien
ggatactttcagccagctctaaagc

SEQ ID NO: 76539 - DNA, 25 bp, Homo sapien
ggatactttttccagttgattctct

SEQ ID NO: 76540 - DNA, 25 bp, Homo sapien
ggatacttttttcagttgattctct

SEQ ID NO: 76541 - DNA, 25 bp, Homo sapien
ggatagaaaagtaacagttgtccca

SEQ ID NO: 76542 - DNA, 25 bp, Homo sapien
ggatagaaaagttacagttgtccca

SEQ ID NO: 76543 - DNA, 25 bp, Homo sapien
ggatagacatgacagttttacaatg

SEQ ID NO: 76544 - DNA, 25 bp, Homo sapien
ggatagacatgacggttttacaatg

SEQ ID NO: 76545 - DNA, 25 bp, Homo sapien
ggatagagaagcaccctgaagcctg

SEQ ID NO: 76546 - DNA, 25 bp, Homo sapien
ggatagagaagcatcctgaagcctg

SEQ ID NO: 76547 - DNA, 25 bp, Homo sapien
ggataggataaaaatacacacatga

SEQ ID NO: 76548 - DNA, 25 bp, Homo sapien
ggataggataaaaatatacacatga

SEQ ID NO: 76549 - DNA, 25 bp, Homo sapien
ggataggatccaagttctgagtgtg

SEQ ID NO: 76550 - DNA, 25 bp, Homo sapien
ggataggatcccagttctgagtgtg

SEQ ID NO: 76551 - DNA, 25 bp, Homo sapien
ggataggattgctaagcttgatgaa

SEQ ID NO: 76552 - DNA, 25 bp, Homo sapien
ggataggattgctgagcttgatgaa

SEQ ID NO: 76553 - DNA, 25 bp, Homo sapien
ggataggtaaatagagtttgcatgt

SEQ ID NO: 76554 - DNA, 25 bp, Homo sapien
ggataggtaaatatagtttgcatgt

SEQ ID NO: 76555 - DNA, 25 bp, Homo sapien
ggatagtgggctacaggatttctgt

SEQ ID NO: 76556 - DNA, 25 bp, Homo sapien
ggatagtgggctacagtatttctgt

SEQ ID NO: 76557 - DNA, 25 bp, Homo sapien
ggatataacacatttgtaataccat

SEQ ID NO: 76558 - DNA, 25 bp, Homo sapien
ggatataacgcatttgtaataccat

SEQ ID NO: 76559 - DNA, 25 bp, Homo sapien
ggatatacactgtagctaaagtgtt

SEQ ID NO: 76560 - DNA, 25 bp, Homo sapien
ggatatacattgtagctaaagtgtt

SEQ ID NO: 76561 - DNA, 25 bp, Homo sapien
ggatataggagtaagttctgagcat

SEQ ID NO: 76562 - DNA, 25 bp, Homo sapien
ggatataggagtaggttctgagcat

SEQ ID NO: 76563 - DNA, 25 bp, Homo sapien
ggatatatatcattctcagctggac

SEQ ID NO: 76564 - DNA, 25 bp, Homo sapien
ggatatatatcgttctcagctggac

SEQ ID NO: 76565 - DNA, 25 bp, Homo sapien
ggatatgacacagaaatggtaagct

SEQ ID NO: 76566 - DNA, 25 bp, Homo sapien
ggatatgacacagcaatggtaagct

SEQ ID NO: 76567 - DNA, 25 bp, Homo sapien
ggatatgagctggaatccgactttt

SEQ ID NO: 76568 - DNA, 25 bp, Homo sapien
ggatatgagctggaattcgactttt

SEQ ID NO: 76569 - DNA, 25 bp, Homo sapien
ggatatgcgtttacatcgaagggct

SEQ ID NO: 76570 - DNA, 25 bp, Homo sapien
ggatatgcgtttacgtcgaagggct

SEQ ID NO: 76571 - DNA, 25 bp, Homo sapien
ggatattttgtcatcattgaggcct

SEQ ID NO: 76572 - DNA, 25 bp, Homo sapien
ggatattttgtcgtcattgaggcct

SEQ ID NO: 76573 - DNA, 25 bp, Homo sapien
ggatcaacacgtgagattagctacc

SEQ ID NO: 76574 - DNA, 25 bp, Homo sapien
ggatcaacatgtgagattagctacc

SEQ ID NO: 76575 - DNA, 25 bp, Homo sapien
ggatcaatgacataatattcccatt

SEQ ID NO: 76576 - DNA, 25 bp, Homo sapien
ggatcaatgacatagtattcccatt

SEQ ID NO: 76577 - DNA, 25 bp, Homo sapien
ggatcactatttccacatctcattg

SEQ ID NO: 76578 - DNA, 25 bp, Homo sapien
ggatcactatttccacgtctcattg

SEQ ID NO: 76579 - DNA, 25 bp, Homo sapien
ggatcataagattgagagattaccc

SEQ ID NO: 76580 - DNA, 25 bp, Homo sapien
ggatcataagattgggagattaccc

SEQ ID NO: 76581 - DNA, 25 bp, Homo sapien
ggatcatactactatatttccctgg

SEQ ID NO: 76582 - DNA, 25 bp, Homo sapien
ggatcatactactgtatttccctgg

SEQ ID NO: 76583 - DNA, 25 bp, Homo sapien
ggatcatatagtgtgtaacctttgc

SEQ ID NO: 76584 - DNA, 25 bp, Homo sapien
ggatcatatagtttgtaacctttgc

SEQ ID NO: 76585 - DNA, 25 bp, Homo sapien
ggatcatattatacaccttgttctg

SEQ ID NO: 76586 - DNA, 25 bp, Homo sapien
ggatcatattatacacgttgttctg

SEQ ID NO: 76587 - DNA, 25 bp, Homo sapien
ggatcatgcgtgtcatattgatcag

SEQ ID NO: 76588 - DNA, 25 bp, Homo sapien
ggatcatgcttgtcatattgatcag

SEQ ID NO: 76589 - DNA, 25 bp, Homo sapien
ggatcatgtaggtgcagacgtttag

SEQ ID NO: 76590 - DNA, 25 bp, Homo sapien
ggatcatgtaggtgtagacgtttag

SEQ ID NO: 76591 - DNA, 25 bp, Homo sapien
ggatcattggatttccatggttttt

SEQ ID NO: 76592 - DNA, 25 bp, Homo sapien
ggatcattggattttcatggttttt

SEQ ID NO: 76593 - DNA, 25 bp, Homo sapien
ggatccaacaggaaggcaacttttt

SEQ ID NO: 76594 - DNA, 25 bp, Homo sapien
ggatccaacgggaaggcaacttttt

SEQ ID NO: 76595 - DNA, 25 bp, Homo sapien
ggatccaatggtcaccctttaggca

SEQ ID NO: 76596 - DNA, 25 bp, Homo sapien
ggatccaatggtgaccctttaggca

SEQ ID NO: 76597 - DNA, 25 bp, Homo sapien
ggatccacttccacgatccaaatac

SEQ ID NO: 76598 - DNA, 25 bp, Homo sapien
ggatccacttccactatccaaatac

SEQ ID NO: 76599 - DNA, 25 bp, Homo sapien
ggatccagaagtgcgcatgcagatt

SEQ ID NO: 76600 - DNA, 25 bp, Homo sapien
ggatccagaagtgtgcatgcagatt

SEQ ID NO: 76601 - DNA, 25 bp, Homo sapien
ggatcctgacccaaaaggtagactg

SEQ ID NO: 76602 - DNA, 25 bp, Homo sapien
ggatcctgacccaagaggtagactg

SEQ ID NO: 76603 - DNA, 25 bp, Homo sapien
ggatcctggctcagttaatgagaac

SEQ ID NO: 76604 - DNA, 25 bp, Homo sapien
ggatcctggcttagttaatgagaac

SEQ ID NO: 76605 - DNA, 25 bp, Homo sapien
ggatcctggcttcagtacgttgacc

SEQ ID NO: 76606 - DNA, 25 bp, Homo sapien
ggatcctgggttcagtacgttgacc

SEQ ID NO: 76607 - DNA, 25 bp, Homo sapien
ggatcctttcgatgcactgaccagg

SEQ ID NO: 76608 - DNA, 25 bp, Homo sapien
ggatccttttgatgcactgaccagg

SEQ ID NO: 76609 - DNA, 25 bp, Homo sapien
ggatcgtacggtatgaaaccccctt

SEQ ID NO: 76610 - DNA, 25 bp, Homo sapien
ggatcgtatggtatgaaaccccctt

SEQ ID NO: 76611 - DNA, 25 bp, Homo sapien
ggatctacttagcattttgcctacc

SEQ ID NO: 76612 - DNA, 25 bp, Homo sapien
ggatctacttagtattttgcctacc

SEQ ID NO: 76613 - DNA, 25 bp, Homo sapien
ggatctctgtcactaaggaatgttt

SEQ ID NO: 76614 - DNA, 25 bp, Homo sapien
ggatctctgtcattaaggaatgttt

SEQ ID NO: 76615 - DNA, 25 bp, Homo sapien
ggatctctttttactgaggtatact

SEQ ID NO: 76616 - DNA, 25 bp, Homo sapien
ggatctctttttagtgaggtatact

SEQ ID NO: 76617 - DNA, 25 bp, Homo sapien
ggatctgacccagagaccagaggca

SEQ ID NO: 76618 - DNA, 25 bp, Homo sapien
ggatctgacccagcgaccagaggca

SEQ ID NO: 76619 - DNA, 25 bp, Homo sapien
ggatctgacttacctaggtgatttt

SEQ ID NO: 76620 - DNA, 25 bp, Homo sapien
ggatctgacttacttaggtgatttt

SEQ ID NO: 76621 - DNA, 25 bp, Homo sapien
ggatctgattatacgttctgtactg

SEQ ID NO: 76622 - DNA, 25 bp, Homo sapien
ggatctgattatatgttctgtactg

SEQ ID NO: 76623 - DNA, 25 bp, Homo sapien
ggatctgcttgaatatttgaggcac

SEQ ID NO: 76624 - DNA, 25 bp, Homo sapien
ggatctgcttggatatttgaggcac

SEQ ID NO: 76625 - DNA, 25 bp, Homo sapien
ggatctggagtgactcctcacatcg

SEQ ID NO: 76626 - DNA, 25 bp, Homo sapien
ggatctggagtgattcctcacatcg

SEQ ID NO: 76627 - DNA, 25 bp, Homo sapien
ggatcttgatttgtacaaactgcta

SEQ ID NO: 76628 - DNA, 25 bp, Homo sapien
ggatcttgatttgtgcaaactgcta

SEQ ID NO: 76629 - DNA, 25 bp, Homo sapien
ggatcttgcttagcccatgcacaca

SEQ ID NO: 76630 - DNA, 25 bp, Homo sapien
ggatcttgcttagcccgtgcacaca

SEQ ID NO: 76631 - DNA, 25 bp, Homo sapien
ggatcttggccatattctgagccac

SEQ ID NO: 76632 - DNA, 25 bp, Homo sapien
ggatcttggccgtattctgagccac

SEQ ID NO: 76633 - DNA, 25 bp, Homo sapien
ggatctttagccttgaaaactgagt

SEQ ID NO: 76634 - DNA, 25 bp, Homo sapien
ggatctttagctttgaaaactgagt

SEQ ID NO: 76635 - DNA, 25 bp, Homo sapien
ggatgaaaacaaagtgtggattggg

SEQ ID NO: 76636 - DNA, 25 bp, Homo sapien
ggatgaaaacaaggtgtggattggg

SEQ ID NO: 76637 - DNA, 25 bp, Homo sapien
ggatgaaaagaactaaaggacataa

SEQ ID NO: 76638 - DNA, 25 bp, Homo sapien
ggatgaaaagaattaaaggacataa

SEQ ID NO: 76639 - DNA, 25 bp, Homo sapien
ggatgaaactgaaggtcacggctaa

SEQ ID NO: 76640 - DNA, 25 bp, Homo sapien
ggatgaaattgaaggtcacggctaa

SEQ ID NO: 76641 - DNA, 25 bp, Homo sapien
ggatgaaatttttaggcttattact

SEQ ID NO: 76642 - DNA, 25 bp, Homo sapien
ggatgaaatttttaggtttattact

SEQ ID NO: 76643 - DNA, 25 bp, Homo sapien
ggatgaagagtggctagagtttctt

SEQ ID NO: 76644 - DNA, 25 bp, Homo sapien
ggatgaagagttgctagagtttctt

SEQ ID NO: 76645 - DNA, 25 bp, Homo sapien
ggatgaaggtagccttgttgagcta

SEQ ID NO: 76646 - DNA, 25 bp, Homo sapien
ggatgaagttagccttgttgagcta

SEQ ID NO: 76647 - DNA, 25 bp, Homo sapien
ggatgactggtctgagattttcttg

SEQ ID NO: 76648 - DNA, 25 bp, Homo sapien
ggatgactggtgtgagattttcttg

SEQ ID NO: 76649 - DNA, 25 bp, Homo sapien
ggatgagaaataaatcggagctgct

SEQ ID NO: 76650 - DNA, 25 bp, Homo sapien
ggatgagaaatcaatcggagctgct

SEQ ID NO: 76651 - DNA, 25 bp, Homo sapien
ggatgagaatgaaaacagagataag

SEQ ID NO: 76652 - DNA, 25 bp, Homo sapien
ggatgagaatgaaagcagagataag

SEQ ID NO: 76653 - DNA, 25 bp, Homo sapien
ggatgagagcagattcattttcaga

SEQ ID NO: 76654 - DNA, 25 bp, Homo sapien
ggatgagagcagattcgttttcaga

SEQ ID NO: 76655 - DNA, 25 bp, Homo sapien
ggatgagcagtctaggattctgatg

SEQ ID NO: 76656 - DNA, 25 bp, Homo sapien
ggatgagcagtctagggttctgatg

SEQ ID NO: 76657 - DNA, 25 bp, Homo sapien
ggatgaggaactagaagattgggaa

SEQ ID NO: 76658 - DNA, 25 bp, Homo sapien
ggatgaggaacttgaagattgggaa

SEQ ID NO: 76659 - DNA, 25 bp, Homo sapien
ggatgaggaagacggatgcatgact

SEQ ID NO: 76660 - DNA, 25 bp, Homo sapien
ggatgaggaagatggatgcatgact

SEQ ID NO: 76661 - DNA, 25 bp, Homo sapien
ggatgagtcaaagatgggcagaaat

SEQ ID NO: 76662 - DNA, 25 bp, Homo sapien
ggatgagtcaaaggtgggcagaaat

SEQ ID NO: 76663 - DNA, 25 bp, Homo sapien
ggatgagtcatcgcaaaccaccatg

SEQ ID NO: 76664 - DNA, 25 bp, Homo sapien
ggatgagtcatcgccaaccaccatg

SEQ ID NO: 76665 - DNA, 25 bp, Homo sapien
ggatgagtgagggaacaatgaaccc

SEQ ID NO: 76666 - DNA, 25 bp, Homo sapien
ggatgagtgagggaaccatgaaccc

SEQ ID NO: 76667 - DNA, 25 bp, Homo sapien
ggatgatctttcaaggtatcgttgg

SEQ ID NO: 76668 - DNA, 25 bp, Homo sapien
ggatgatctttcatggtatcgttgg

SEQ ID NO: 76669 - DNA, 25 bp, Homo sapien
ggatgatggatgaaaagatataggt

SEQ ID NO: 76670 - DNA, 25 bp, Homo sapien
ggatgatggatggaaagatataggt

SEQ ID NO: 76671 - DNA, 25 bp, Homo sapien
ggatgattgatgcacgccccttgtt

SEQ ID NO: 76672 - DNA, 25 bp, Homo sapien
ggatgattgatgcatgccccttgtt

SEQ ID NO: 76673 - DNA, 25 bp, Homo sapien
ggatgcacttgaaataaggatctac

SEQ ID NO: 76674 - DNA, 25 bp, Homo sapien
ggatgcacttgaagtaaggatctac

SEQ ID NO: 76675 - DNA, 25 bp, Homo sapien
ggatgcagataaaagttgctgtcct

SEQ ID NO: 76676 - DNA, 25 bp, Homo sapien
ggatgcagatgacagagtgtgtcta

SEQ ID NO: 76677 - DNA, 25 bp, Homo sapien
ggatgcagatgagagagtgtgtcta

SEQ ID NO: 76678 - DNA, 25 bp, Homo sapien
ggatgcaggtaaaagttgctgtcct

SEQ ID NO: 76679 - DNA, 25 bp, Homo sapien
ggatgcataataattttccgtgaag

SEQ ID NO: 76680 - DNA, 25 bp, Homo sapien
ggatgcataatgattttccgtgaag

SEQ ID NO: 76681 - DNA, 25 bp, Homo sapien
ggatgcatcaacctatcgtcagtca

SEQ ID NO: 76682 - DNA, 25 bp, Homo sapien
ggatgcatcaagctatcgtcagtca

SEQ ID NO: 76683 - DNA, 25 bp, Homo sapien
ggatgccatgtacaccactggattt

SEQ ID NO: 76684 - DNA, 25 bp, Homo sapien
ggatgccatgtataccactggattt

SEQ ID NO: 76685 - DNA, 25 bp, Homo sapien
ggatgccctgatactaatgggagac

SEQ ID NO: 76686 - DNA, 25 bp, Homo sapien
ggatgccctgatagtaatgggagac

SEQ ID NO: 76687 - DNA, 25 bp, Homo sapien
ggatgccctttcaaggagcctacag

SEQ ID NO: 76688 - DNA, 25 bp, Homo sapien
ggatgccctttcatggagcctacag

SEQ ID NO: 76689 - DNA, 25 bp, Homo sapien
ggatgcgatgaaatttctgatttgt

SEQ ID NO: 76690 - DNA, 25 bp, Homo sapien
ggatgcgatgaaatttgtgatttgt

SEQ ID NO: 76691 - DNA, 25 bp, Homo sapien
ggatgctaggtcagcgatcagcacc

SEQ ID NO: 76692 - DNA, 25 bp, Homo sapien
ggatgctaggtcagtgatcagcacc

SEQ ID NO: 76693 - DNA, 25 bp, Homo sapien
ggatgctattggctttccctcgcta

SEQ ID NO: 76694 - DNA, 25 bp, Homo sapien
ggatgctattgggccacatgtagcc

SEQ ID NO: 76695 - DNA, 25 bp, Homo sapien
ggatgctattgggtcacatgtagcc

SEQ ID NO: 76696 - DNA, 25 bp, Homo sapien
ggatgctattgtctttccctcgcta

SEQ ID NO: 76697 - DNA, 25 bp, Homo sapien
ggatgctgttaaacatcctatgaag

SEQ ID NO: 76698 - DNA, 25 bp, Homo sapien
ggatgctgttaaacatgctatgaag

SEQ ID NO: 76699 - DNA, 25 bp, Homo sapien
ggatgcttccaagacaattggctcg

SEQ ID NO: 76700 - DNA, 25 bp, Homo sapien
ggatgcttccaaggcaattggctcg

SEQ ID NO: 76701 - DNA, 25 bp, Homo sapien
ggatggaaatagcaaacaaacaaca

SEQ ID NO: 76702 - DNA, 25 bp, Homo sapien
ggatggaaatatcaaacaaacaaca

SEQ ID NO: 76703 - DNA, 25 bp, Homo sapien
ggatggaacctaagataactcaata

SEQ ID NO: 76704 - DNA, 25 bp, Homo sapien
ggatggaacctaagatgactcaata

SEQ ID NO: 76705 - DNA, 25 bp, Homo sapien
ggatggagcatccaaatggcaccca

SEQ ID NO: 76706 - DNA, 25 bp, Homo sapien
ggatggagtatccaaatggcaccca

SEQ ID NO: 76707 - DNA, 25 bp, Homo sapien
ggatggatctctgtcactaaggaat

SEQ ID NO: 76708 - DNA, 25 bp, Homo sapien
ggatggatctctgtcattaaggaat

SEQ ID NO: 76709 - DNA, 25 bp, Homo sapien
ggatggccaaacgcagcagacagga

SEQ ID NO: 76710 - DNA, 25 bp, Homo sapien
ggatggccaaactcagcagacagga

SEQ ID NO: 76711 - DNA, 25 bp, Homo sapien
ggatggctgcaacctcaaaaaaagc

SEQ ID NO: 76712 - DNA, 25 bp, Homo sapien
ggatggctgcatcctcaaaaaaagc

SEQ ID NO: 76713 - DNA, 25 bp, Homo sapien
ggatggcttaaagtatgcaaatcaa

SEQ ID NO: 76714 - DNA, 25 bp, Homo sapien
ggatggcttaacgtatgcaaatcaa

SEQ ID NO: 76715 - DNA, 25 bp, Homo sapien
ggatgggatactcagtactttgaag

SEQ ID NO: 76716 - DNA, 25 bp, Homo sapien
ggatgggatactcagtcctttgaag

SEQ ID NO: 76717 - DNA, 25 bp, Homo sapien
ggatggggtttgaactcatctctga

SEQ ID NO: 76718 - DNA, 25 bp, Homo sapien
ggatggggtttgatctcatctctga

SEQ ID NO: 76719 - DNA, 25 bp, Homo sapien
ggatgggtacaatgaagcagagtga

SEQ ID NO: 76720 - DNA, 25 bp, Homo sapien
ggatgggtattgtaatcggagcagg

SEQ ID NO: 76721 - DNA, 25 bp, Homo sapien
ggatgggtattgtaattggagcagg

SEQ ID NO: 76722 - DNA, 25 bp, Homo sapien
ggatgggtgcaatgaagcagagtga

SEQ ID NO: 76723 - DNA, 25 bp, Homo sapien
ggatggtaatgttaagacacaaatt

SEQ ID NO: 76724 - DNA, 25 bp, Homo sapien
ggatggtaatgttgagacacaaatt

SEQ ID NO: 76725 - DNA, 25 bp, Homo sapien
ggatggtaccgatgcttgttgatat

SEQ ID NO: 76726 - DNA, 25 bp, Homo sapien
ggatggtactgatgcttgttgatat

SEQ ID NO: 76727 - DNA, 25 bp, Homo sapien
ggatggtgaggaagcactaacactt

SEQ ID NO: 76728 - DNA, 25 bp, Homo sapien
ggatggtgaggaagcagtaacactt

SEQ ID NO: 76729 - DNA, 25 bp, Homo sapien
ggatggtggtgccattagtcaggat

SEQ ID NO: 76730 - DNA, 25 bp, Homo sapien
ggatggtggtgccgttagtcaggat

SEQ ID NO: 76731 - DNA, 25 bp, Homo sapien
ggatggtgtaccacagggagcctgg

SEQ ID NO: 76732 - DNA, 25 bp, Homo sapien
ggatggtgtaccacggggagcctgg

SEQ ID NO: 76733 - DNA, 25 bp, Homo sapien
ggatggtttccagattcacatgcac

SEQ ID NO: 76734 - DNA, 25 bp, Homo sapien
ggatggtttccggattcacatgcac

SEQ ID NO: 76735 - DNA, 25 bp, Homo sapien
ggatgtacaagcatctgagtacctg

SEQ ID NO: 76736 - DNA, 25 bp, Homo sapien
ggatgtacaagtatctgagtacctg

SEQ ID NO: 76737 - DNA, 25 bp, Homo sapien
ggatgtatttatacggcaccctctc

SEQ ID NO: 76738 - DNA, 25 bp, Homo sapien
ggatgtatttatatggcaccctctc

SEQ ID NO: 76739 - DNA, 25 bp, Homo sapien
ggatgtcataatgtcatgtggatgt

SEQ ID NO: 76740 - DNA, 25 bp, Homo sapien
ggatgtcatgacacttggtctgtaa

SEQ ID NO: 76741 - DNA, 25 bp, Homo sapien
ggatgtcatgacccttggtctgtaa

SEQ ID NO: 76742 - DNA, 25 bp, Homo sapien
ggatgtcatgatgtcatgtggatgt

SEQ ID NO: 76743 - DNA, 25 bp, Homo sapien
ggatgtccattactaaaacaaagca

SEQ ID NO: 76744 - DNA, 25 bp, Homo sapien
ggatgtccattactcaaacaaagca

SEQ ID NO: 76745 - DNA, 25 bp, Homo sapien
ggatgtctaaccattccttgttgat

SEQ ID NO: 76746 - DNA, 25 bp, Homo sapien
ggatgtctaactattccttgttgat

SEQ ID NO: 76747 - DNA, 25 bp, Homo sapien
ggatgtctactgaatctaaaggaat

SEQ ID NO: 76748 - DNA, 25 bp, Homo sapien
ggatgtctactgagtctaaaggaat

SEQ ID NO: 76749 - DNA, 25 bp, Homo sapien
ggatgtcttggccaaccacagcaac

SEQ ID NO: 76750 - DNA, 25 bp, Homo sapien
ggatgtcttggccagccacagcaac

SEQ ID NO: 76751 - DNA, 25 bp, Homo sapien
ggatgtgaagaagctggaacctttg

SEQ ID NO: 76752 - DNA, 25 bp, Homo sapien
ggatgtgaagaagttggaacctttg

SEQ ID NO: 76753 - DNA, 25 bp, Homo sapien
ggatgtgcatttgcttagatgtttg

SEQ ID NO: 76754 - DNA, 25 bp, Homo sapien
ggatgtgcatttgtttagatgtttg

SEQ ID NO: 76755 - DNA, 25 bp, Homo sapien
ggatgtgcctgtcaatgttttttca

SEQ ID NO: 76756 - DNA, 25 bp, Homo sapien
ggatgtgcctgtcattgttttttca

SEQ ID NO: 76757 - DNA, 25 bp, Homo sapien
ggatgtgtcatgtctccctaggaag

SEQ ID NO: 76758 - DNA, 25 bp, Homo sapien
ggatgtgttatgtctccctaggaag

SEQ ID NO: 76759 - DNA, 25 bp, Homo sapien
ggatgttaaatgtgctacagattct

SEQ ID NO: 76760 - DNA, 25 bp, Homo sapien
ggatgttaaatgtgctccagattct

SEQ ID NO: 76761 - DNA, 25 bp, Homo sapien
ggatgttacttgaaagagtttcaga

SEQ ID NO: 76762 - DNA, 25 bp, Homo sapien
ggatgttacttggaagagtttcaga

SEQ ID NO: 76763 - DNA, 25 bp, Homo sapien
ggatgttatggaactcataattttt

SEQ ID NO: 76764 - DNA, 25 bp, Homo sapien
ggatgttatggaagtcataattttt

SEQ ID NO: 76765 - DNA, 25 bp, Homo sapien
ggatgttttcaaatagtcgcatttt

SEQ ID NO: 76766 - DNA, 25 bp, Homo sapien
ggatgttttcaagtagtcgcatttt

SEQ ID NO: 76767 - DNA, 25 bp, Homo sapien
ggattaaaattgtcataattaatag

SEQ ID NO: 76768 - DNA, 25 bp, Homo sapien
ggattaaaattgtcatcattaatag

SEQ ID NO: 76769 - DNA, 25 bp, Homo sapien
ggattaagaataatacataccacat

SEQ ID NO: 76770 - DNA, 25 bp, Homo sapien
ggattaagaataatacgtaccacat

SEQ ID NO: 76771 - DNA, 25 bp, Homo sapien
ggattaagtcacactttccattgtc

SEQ ID NO: 76772 - DNA, 25 bp, Homo sapien
ggattaagtcacattttccattgtc

SEQ ID NO: 76773 - DNA, 25 bp, Homo sapien
ggattacctatacaggctgacattt

SEQ ID NO: 76774 - DNA, 25 bp, Homo sapien
ggattacctatgcaggctgacattt

SEQ ID NO: 76775 - DNA, 25 bp, Homo sapien
ggattactgctgatactaccttaag

SEQ ID NO: 76776 - DNA, 25 bp, Homo sapien
ggattactgttgatactaccttaag

SEQ ID NO: 76777 - DNA, 25 bp, Homo sapien
ggattaggtcaaaaccaacagcata

SEQ ID NO: 76778 - DNA, 25 bp, Homo sapien
ggattaggttaaaaccaacagcata

SEQ ID NO: 76779 - DNA, 25 bp, Homo sapien
ggattagtacaagtgcaaagccatg

SEQ ID NO: 76780 - DNA, 25 bp, Homo sapien
ggattagtacaagttcaaagccatg

SEQ ID NO: 76781 - DNA, 25 bp, Homo sapien
ggattagtctccatggctgattcac

SEQ ID NO: 76782 - DNA, 25 bp, Homo sapien
ggattagtctccgtggctgattcac

SEQ ID NO: 76783 - DNA, 25 bp, Homo sapien
ggattataatgtttacagccatctc

SEQ ID NO: 76784 - DNA, 25 bp, Homo sapien
ggattataatgtttacggccatctc

SEQ ID NO: 76785 - DNA, 25 bp, Homo sapien
ggattataattcacggtagctttaa

SEQ ID NO: 76786 - DNA, 25 bp, Homo sapien
ggattataattcatggtagctttaa

SEQ ID NO: 76787 - DNA, 25 bp, Homo sapien
ggattatgctgagtcagaccgatgc

SEQ ID NO: 76788 - DNA, 25 bp, Homo sapien
ggattatgctgggtcagaccgatgc

SEQ ID NO: 76789 - DNA, 25 bp, Homo sapien
ggattatgttatcttcttttacaaa

SEQ ID NO: 76790 - DNA, 25 bp, Homo sapien
ggattatgttattttcttttacaaa

SEQ ID NO: 76791 - DNA, 25 bp, Homo sapien
ggattattatgggaaaagctgttgg

SEQ ID NO: 76792 - DNA, 25 bp, Homo sapien
ggattattatggggaaagctgttgg

SEQ ID NO: 76793 - DNA, 25 bp, Homo sapien
ggattcaaatccaagtctttcctac

SEQ ID NO: 76794 - DNA, 25 bp, Homo sapien
ggattcaaatccaggtctttcctac

SEQ ID NO: 76795 - DNA, 25 bp, Homo sapien
ggattcaaatgacacattcattgag

SEQ ID NO: 76796 - DNA, 25 bp, Homo sapien
ggattcaaatgacccattcattgag

SEQ ID NO: 76797 - DNA, 25 bp, Homo sapien
ggattcaaatggcttagttgatccc

SEQ ID NO: 76798 - DNA, 25 bp, Homo sapien
ggattcaaatggcttatttgatccc

SEQ ID NO: 76799 - DNA, 25 bp, Homo sapien
ggattcagaggaggtatcaaaaagt

SEQ ID NO: 76800 - DNA, 25 bp, Homo sapien
ggattcagaggatgtatcaaaaagt

SEQ ID NO: 76801 - DNA, 25 bp, Homo sapien
ggattcatcatcattaggtgtcacc

SEQ ID NO: 76802 - DNA, 25 bp, Homo sapien
ggattcatcatcgttaggtgtcacc

SEQ ID NO: 76803 - DNA, 25 bp, Homo sapien
ggattccaataaaacaaatcacctt

SEQ ID NO: 76804 - DNA, 25 bp, Homo sapien
ggattccagtaaaacaaatcacctt

SEQ ID NO: 76805 - DNA, 25 bp, Homo sapien
ggattccatttctgctgtatatcca

SEQ ID NO: 76806 - DNA, 25 bp, Homo sapien
ggattccatttcttctgtatatcca

SEQ ID NO: 76807 - DNA, 25 bp, Homo sapien
ggattcctgttactgcataagaaac

SEQ ID NO: 76808 - DNA, 25 bp, Homo sapien
ggattcctgttacttcataagaaac

SEQ ID NO: 76809 - DNA, 25 bp, Homo sapien
ggattcgggcataacagattaaata

SEQ ID NO: 76810 - DNA, 25 bp, Homo sapien
ggattcgggcataccagattaaata

SEQ ID NO: 76811 - DNA, 25 bp, Homo sapien
ggattctaactctcggcttcactag

SEQ ID NO: 76812 - DNA, 25 bp, Homo sapien
ggattctaactcttggcttcactag

SEQ ID NO: 76813 - DNA, 25 bp, Homo sapien
ggattctactgtacagcaagttgag

SEQ ID NO: 76814 - DNA, 25 bp, Homo sapien
ggattctactgtagagcaagttgag

SEQ ID NO: 76815 - DNA, 25 bp, Homo sapien
ggattctatgttgtctaagctaatc

SEQ ID NO: 76816 - DNA, 25 bp, Homo sapien
ggattctatgttgtctgagctaatc

SEQ ID NO: 76817 - DNA, 25 bp, Homo sapien
ggattctctcatacttagcaccaat

SEQ ID NO: 76818 - DNA, 25 bp, Homo sapien
ggattctctgatacttagcaccaat

SEQ ID NO: 76819 - DNA, 25 bp, Homo sapien
ggattcttttcatctgcctgctcct

SEQ ID NO: 76820 - DNA, 25 bp, Homo sapien
ggattcttttcatctgtctgctcct

SEQ ID NO: 76821 - DNA, 25 bp, Homo sapien
ggattgaaagaaaaggctgggaaaa

SEQ ID NO: 76822 - DNA, 25 bp, Homo sapien
ggattgaaagaaatggctgggaaaa

SEQ ID NO: 76823 - DNA, 25 bp, Homo sapien
ggattgaatctcacgttaataggac

SEQ ID NO: 76824 - DNA, 25 bp, Homo sapien
ggattgaatctcaggttaataggac

SEQ ID NO: 76825 - DNA, 25 bp, Homo sapien
ggattgaccacctaatctcatcata

SEQ ID NO: 76826 - DNA, 25 bp, Homo sapien
ggattgaccacgtaatctcatcata

SEQ ID NO: 76827 - DNA, 25 bp, Homo sapien
ggattgactgtggtcagagcctgtg

SEQ ID NO: 76828 - DNA, 25 bp, Homo sapien
ggattgactgttgtcagagcctgtg

SEQ ID NO: 76829 - DNA, 25 bp, Homo sapien
ggattgatatgattattgggcctct

SEQ ID NO: 76830 - DNA, 25 bp, Homo sapien
ggattgatgtgattattgggcctct

SEQ ID NO: 76831 - DNA, 25 bp, Homo sapien
ggattgattctggaatgaaattaag

SEQ ID NO: 76832 - DNA, 25 bp, Homo sapien
ggattgattctgggatgaaattaag

SEQ ID NO: 76833 - DNA, 25 bp, Homo sapien
ggattgcggcttcctccttcctgat

SEQ ID NO: 76834 - DNA, 25 bp, Homo sapien
ggattgcggcttgctccttcctgat

SEQ ID NO: 76835 - DNA, 25 bp, Homo sapien
ggattgctactaaaaatgcagaata

SEQ ID NO: 76836 - DNA, 25 bp, Homo sapien
ggattgctacttcctgtcaatcgca

SEQ ID NO: 76837 - DNA, 25 bp, Homo sapien
ggattgctagtaaaaatgcagaata

SEQ ID NO: 76838 - DNA, 25 bp, Homo sapien
ggattgctagttcctgtcaatcgca

SEQ ID NO: 76839 - DNA, 25 bp, Homo sapien
ggattggaagtactctgcatcttga

SEQ ID NO: 76840 - DNA, 25 bp, Homo sapien
ggattggaagtgctctgcatcttga

SEQ ID NO: 76841 - DNA, 25 bp, Homo sapien
ggattggtggaaacgttcttagggc

SEQ ID NO: 76842 - DNA, 25 bp, Homo sapien
ggattggtggaaatgttcttagggc

SEQ ID NO: 76843 - DNA, 25 bp, Homo sapien
ggattgtagaaaccacagagtgaca

SEQ ID NO: 76844 - DNA, 25 bp, Homo sapien
ggattgtagaaaccacggagtgaca

SEQ ID NO: 76845 - DNA, 25 bp, Homo sapien
ggattgtatcttagacattgtggtg

SEQ ID NO: 76846 - DNA, 25 bp, Homo sapien
ggattgtatgttagacattgtggtg

SEQ ID NO: 76847 - DNA, 25 bp, Homo sapien
ggattgtgcctctgactccctgagc

SEQ ID NO: 76848 - DNA, 25 bp, Homo sapien
ggattgtgcttctgactccctgagc

SEQ ID NO: 76849 - DNA, 25 bp, Homo sapien
ggattgtgggaccagagcattcagg

SEQ ID NO: 76850 - DNA, 25 bp, Homo sapien
ggattgtgggaccggagcattcagg

SEQ ID NO: 76851 - DNA, 25 bp, Homo sapien
ggattgtgtttgcttttccttgtct

SEQ ID NO: 76852 - DNA, 25 bp, Homo sapien
ggattgtgtttgtttttccttgtct

SEQ ID NO: 76853 - DNA, 25 bp, Homo sapien
ggattgttaaataatttctgagcag

SEQ ID NO: 76854 - DNA, 25 bp, Homo sapien
ggattgttaaatgatttctgagcag

SEQ ID NO: 76855 - DNA, 25 bp, Homo sapien
ggattgtttacctgtctgttttgta

SEQ ID NO: 76856 - DNA, 25 bp, Homo sapien
ggattgtttattatagcagcatcac

SEQ ID NO: 76857 - DNA, 25 bp, Homo sapien
ggattgtttccctgtctgttttgta

SEQ ID NO: 76858 - DNA, 25 bp, Homo sapien
ggattgtttgttatagcagcatcac

SEQ ID NO: 76859 - DNA, 25 bp, Homo sapien
ggatttaactgaagttgacacagaa

SEQ ID NO: 76860 - DNA, 25 bp, Homo sapien
ggatttaattgaagttgacacagaa

SEQ ID NO: 76861 - DNA, 25 bp, Homo sapien
ggatttacatctacatatgcagaag

SEQ ID NO: 76862 - DNA, 25 bp, Homo sapien
ggatttacgtctacatatgcagaag

SEQ ID NO: 76863 - DNA, 25 bp, Homo sapien
ggatttactcacccacaaaagtgtg

SEQ ID NO: 76864 - DNA, 25 bp, Homo sapien
ggatttactcagccacaaaagtgtg

SEQ ID NO: 76865 - DNA, 25 bp, Homo sapien
ggatttactgccccaacagaaagta

SEQ ID NO: 76866 - DNA, 25 bp, Homo sapien
ggatttactgccgcaacagaaagta

SEQ ID NO: 76867 - DNA, 25 bp, Homo sapien
ggatttagaaagacagcatcactaa

SEQ ID NO: 76868 - DNA, 25 bp, Homo sapien
ggatttagaaagacaggatcactaa

SEQ ID NO: 76869 - DNA, 25 bp, Homo sapien
ggatttagtcacccttgatgcaggc

SEQ ID NO: 76870 - DNA, 25 bp, Homo sapien
ggatttagttacccttgatgcaggc

SEQ ID NO: 76871 - DNA, 25 bp, Homo sapien
ggatttatttcactgatgctttatc

SEQ ID NO: 76872 - DNA, 25 bp, Homo sapien
ggatttatttcattgatgctttatc

SEQ ID NO: 76873 - DNA, 25 bp, Homo sapien
ggatttcaaagactgtataaaaaaa

SEQ ID NO: 76874 - DNA, 25 bp, Homo sapien
ggatttcaaagattgtataaaaaaa

SEQ ID NO: 76875 - DNA, 25 bp, Homo sapien
ggatttcaacataaaaccttgaagc

SEQ ID NO: 76876 - DNA, 25 bp, Homo sapien
ggatttcaacatataaccttgaagc

SEQ ID NO: 76877 - DNA, 25 bp, Homo sapien
ggatttcaaggccaacctgggcaac

SEQ ID NO: 76878 - DNA, 25 bp, Homo sapien
ggatttcaaggtcaacctgggcaac

SEQ ID NO: 76879 - DNA, 25 bp, Homo sapien
ggatttcaatgtatgaattttgtgg

SEQ ID NO: 76880 - DNA, 25 bp, Homo sapien
ggatttcacagctagtatttttctg

SEQ ID NO: 76881 - DNA, 25 bp, Homo sapien
ggatttcacggctagtatttttctg

SEQ ID NO: 76882 - DNA, 25 bp, Homo sapien
ggatttcagtgtatgaattttgtgg

SEQ ID NO: 76883 - DNA, 25 bp, Homo sapien
ggatttcatgctagattccaacttg

SEQ ID NO: 76884 - DNA, 25 bp, Homo sapien
ggatttcatgctggattccaacttg

SEQ ID NO: 76885 - DNA, 25 bp, Homo sapien
ggatttctagtacagtagcaagcat

SEQ ID NO: 76886 - DNA, 25 bp, Homo sapien
ggatttctagtatagtagcaagcat

SEQ ID NO: 76887 - DNA, 25 bp, Homo sapien
ggatttgaacatgtgatatgaacaa

SEQ ID NO: 76888 - DNA, 25 bp, Homo sapien
ggatttgaatatgtgatatgaacaa

SEQ ID NO: 76889 - DNA, 25 bp, Homo sapien
ggatttgcagtattagaacacagac

SEQ ID NO: 76890 - DNA, 25 bp, Homo sapien
ggatttgcagtattaggacacagac

SEQ ID NO: 76891 - DNA, 25 bp, Homo sapien
ggatttggggactcaattaatggaa

SEQ ID NO: 76892 - DNA, 25 bp, Homo sapien
ggatttggggactgaattaatggaa

SEQ ID NO: 76893 - DNA, 25 bp, Homo sapien
ggatttggtagacagataactcagc

SEQ ID NO: 76894 - DNA, 25 bp, Homo sapien
ggatttggtagatagataactcagc

SEQ ID NO: 76895 - DNA, 25 bp, Homo sapien
ggattttaaagttggcgttgatgga

SEQ ID NO: 76896 - DNA, 25 bp, Homo sapien
ggattttaaagttggctttgatgga

SEQ ID NO: 76897 - DNA, 25 bp, Homo sapien
ggattttaaatatactacacctcag

SEQ ID NO: 76898 - DNA, 25 bp, Homo sapien
ggattttaaatatgctacacctcag

SEQ ID NO: 76899 - DNA, 25 bp, Homo sapien
ggattttaaatgtaaatgacctcta

SEQ ID NO: 76900 - DNA, 25 bp, Homo sapien
ggattttaagtgtaaatgacctcta

SEQ ID NO: 76901 - DNA, 25 bp, Homo sapien
ggattttgacctgctgttgctgact

SEQ ID NO: 76902 - DNA, 25 bp, Homo sapien
ggattttgacctgttgttgctgact

SEQ ID NO: 76903 - DNA, 25 bp, Homo sapien
ggattttgagtaagagatttttctg

SEQ ID NO: 76904 - DNA, 25 bp, Homo sapien
ggattttgagtaagggatttttctg

SEQ ID NO: 76905 - DNA, 25 bp, Homo sapien
ggattttgataaggattgtgtttaa

SEQ ID NO: 76906 - DNA, 25 bp, Homo sapien
ggattttgcacaaattggcttggct

SEQ ID NO: 76907 - DNA, 25 bp, Homo sapien
ggattttgcgcaaattggcttggct

SEQ ID NO: 76908 - DNA, 25 bp, Homo sapien
ggattttgcttccattaatgtttcc

SEQ ID NO: 76909 - DNA, 25 bp, Homo sapien
ggattttgtaggtcaagtttggacc

SEQ ID NO: 76910 - DNA, 25 bp, Homo sapien
ggattttgtaggtcgagtttggacc

SEQ ID NO: 76911 - DNA, 25 bp, Homo sapien
ggattttgttaaggattgtgtttaa

SEQ ID NO: 76912 - DNA, 25 bp, Homo sapien
ggattttgtttccattaatgtttcc

SEQ ID NO: 76913 - DNA, 25 bp, Homo sapien
ggatttttactctagtctctagttc

SEQ ID NO: 76914 - DNA, 25 bp, Homo sapien
ggatttttactttagtctctagttc

SEQ ID NO: 76915 - DNA, 25 bp, Homo sapien
ggatttttccataatcgccattctg

SEQ ID NO: 76916 - DNA, 25 bp, Homo sapien
ggatttttccttgcactttatctta

SEQ ID NO: 76917 - DNA, 25 bp, Homo sapien
ggatttttctttgcactttatctta

SEQ ID NO: 76918 - DNA, 25 bp, Homo sapien
ggattttttcataatcgccattctg

SEQ ID NO: 76919 - DNA, 25 bp, Homo sapien
ggcaaaaatttaaaaaaacattcta

SEQ ID NO: 76920 - DNA, 25 bp, Homo sapien
ggcaaaaatttaagaaaacattcta

SEQ ID NO: 76921 - DNA, 25 bp, Homo sapien
ggcaaaagactagagagtgacataa

SEQ ID NO: 76922 - DNA, 25 bp, Homo sapien
ggcaaaagattagagagtgacataa

SEQ ID NO: 76923 - DNA, 25 bp, Homo sapien
ggcaaaagcatagtatcgtcattaa

SEQ ID NO: 76924 - DNA, 25 bp, Homo sapien
ggcaaaagcatagtattgtcattaa

SEQ ID NO: 76925 - DNA, 25 bp, Homo sapien
ggcaaaagctcaactctactaaaaa

SEQ ID NO: 76926 - DNA, 25 bp, Homo sapien
ggcaaaagctcacctctactaaaaa

SEQ ID NO: 76927 - DNA, 25 bp, Homo sapien
ggcaaaataacttgagatacttttg

SEQ ID NO: 76928 - DNA, 25 bp, Homo sapien
ggcaaaatagcttgagatacttttg

SEQ ID NO: 76929 - DNA, 25 bp, Homo sapien
ggcaaaattaaacgtatattaaata

SEQ ID NO: 76930 - DNA, 25 bp, Homo sapien
ggcaaaattaaaggtatattaaata

SEQ ID NO: 76931 - DNA, 25 bp, Homo sapien
ggcaaaattttcaccgggaagtgtc

SEQ ID NO: 76932 - DNA, 25 bp, Homo sapien
ggcaaaattttcactgggaagtgtc

SEQ ID NO: 76933 - DNA, 25 bp, Homo sapien
ggcaaaccctatgaagagtcttgag

SEQ ID NO: 76934 - DNA, 25 bp, Homo sapien
ggcaaaccctatgatgagtcttgag

SEQ ID NO: 76935 - DNA, 25 bp, Homo sapien
ggcaaagaaaatgaaagcacctttc

SEQ ID NO: 76936 - DNA, 25 bp, Homo sapien
ggcaaagaaaattaaagcacctttc

SEQ ID NO: 76937 - DNA, 25 bp, Homo sapien
ggcaaagaacacacagctacaggga

SEQ ID NO: 76938 - DNA, 25 bp, Homo sapien
ggcaaagaacacgcagctacaggga

SEQ ID NO: 76939 - DNA, 25 bp, Homo sapien
ggcaaagaagatcacaataattcaa

SEQ ID NO: 76940 - DNA, 25 bp, Homo sapien
ggcaaagaggatcacaataattcaa

SEQ ID NO: 76941 - DNA, 25 bp, Homo sapien
ggcaaagatggatcggagagtcagg

SEQ ID NO: 76942 - DNA, 25 bp, Homo sapien
ggcaaagatggatctgagagtcagg

SEQ ID NO: 76943 - DNA, 25 bp, Homo sapien
ggcaaagcaagacaccctagtaaaa

SEQ ID NO: 76944 - DNA, 25 bp, Homo sapien
ggcaaagcaaggcaccctagtaaaa

SEQ ID NO: 76945 - DNA, 25 bp, Homo sapien
ggcaaagcacctatttgaatctttt

SEQ ID NO: 76946 - DNA, 25 bp, Homo sapien
ggcaaagcacctgtttgaatctttt

SEQ ID NO: 76947 - DNA, 25 bp, Homo sapien
ggcaaaggaaaaccaaatgaagatc

SEQ ID NO: 76948 - DNA, 25 bp, Homo sapien
ggcaaaggaaaagcaaatgaagatc

SEQ ID NO: 76949 - DNA, 25 bp, Homo sapien
ggcaaaggcgtaaagaggtgagaaa

SEQ ID NO: 76950 - DNA, 25 bp, Homo sapien
ggcaaaggcgtaaggaggtgagaaa

SEQ ID NO: 76951 - DNA, 25 bp, Homo sapien
ggcaaatgatcctgatcttatcttt

SEQ ID NO: 76952 - DNA, 25 bp, Homo sapien
ggcaaatgatcctggtcttatcttt

SEQ ID NO: 76953 - DNA, 25 bp, Homo sapien
ggcaaatgcatgtgaaacactactg

SEQ ID NO: 76954 - DNA, 25 bp, Homo sapien
ggcaaatgcatgtgaagcactactg

SEQ ID NO: 76955 - DNA, 25 bp, Homo sapien
ggcaaattgcagaatctaatccttc

SEQ ID NO: 76956 - DNA, 25 bp, Homo sapien
ggcaaattgtagaatctaatccttc

SEQ ID NO: 76957 - DNA, 25 bp, Homo sapien
ggcaaatttaatgtaagagggcaaa

SEQ ID NO: 76958 - DNA, 25 bp, Homo sapien
ggcaaatttgatgtaagagggcaaa

SEQ ID NO: 76959 - DNA, 25 bp, Homo sapien
ggcaaatttgtagacgtgaactgca

SEQ ID NO: 76960 - DNA, 25 bp, Homo sapien
ggcaaatttgtagatgtgaactgca

SEQ ID NO: 76961 - DNA, 25 bp, Homo sapien
ggcaacaacgattactcaccagcag

SEQ ID NO: 76962 - DNA, 25 bp, Homo sapien
ggcaacaatgattactcaccagcag

SEQ ID NO: 76963 - DNA, 25 bp, Homo sapien
ggcaacagagccaccttgaagcaca

SEQ ID NO: 76964 - DNA, 25 bp, Homo sapien
ggcaacagagccatcttgaagcaca

SEQ ID NO: 76965 - DNA, 25 bp, Homo sapien
ggcaacaggaactctcaggaactct

SEQ ID NO: 76966 - DNA, 25 bp, Homo sapien
ggcaacaggaactgtcaggaactct

SEQ ID NO: 76967 - DNA, 25 bp, Homo sapien
ggcaacatagctataactctgggag

SEQ ID NO: 76968 - DNA, 25 bp, Homo sapien
ggcaacatagctataattctgggag

SEQ ID NO: 76969 - DNA, 25 bp, Homo sapien
ggcaacattgatcaccagagttaag

SEQ ID NO: 76970 - DNA, 25 bp, Homo sapien
ggcaacattgatcatcagagttaag

SEQ ID NO: 76971 - DNA, 25 bp, Homo sapien
ggcaaccaaagaaggagcttttaca

SEQ ID NO: 76972 - DNA, 25 bp, Homo sapien
ggcaaccaaagagggagcttttaca

SEQ ID NO: 76973 - DNA, 25 bp, Homo sapien
ggcaactatcttgatcccctgaaaa

SEQ ID NO: 76974 - DNA, 25 bp, Homo sapien
ggcaactatcttgatctcctgaaaa

SEQ ID NO: 76975 - DNA, 25 bp, Homo sapien
ggcaagaaatctgagctcaaggtgg

SEQ ID NO: 76976 - DNA, 25 bp, Homo sapien
ggcaagaacgttacaaatgaaatca

SEQ ID NO: 76977 - DNA, 25 bp, Homo sapien
ggcaagaagcccagcgccagggtag

SEQ ID NO: 76978 - DNA, 25 bp, Homo sapien
ggcaagaagcccagtgccagggtag

SEQ ID NO: 76979 - DNA, 25 bp, Homo sapien
ggcaagaagtctgagctcaaggtgg

SEQ ID NO: 76980 - DNA, 25 bp, Homo sapien
ggcaagaatgttacaaatgaaatca

SEQ ID NO: 76981 - DNA, 25 bp, Homo sapien
ggcaagactctacttcagtctagct

SEQ ID NO: 76982 - DNA, 25 bp, Homo sapien
ggcaagactctatttcagtctagct

SEQ ID NO: 76983 - DNA, 25 bp, Homo sapien
ggcaagaggacatagtaggtacaca

SEQ ID NO: 76984 - DNA, 25 bp, Homo sapien
ggcaagaggacatggtaggtacaca

SEQ ID NO: 76985 - DNA, 25 bp, Homo sapien
ggcaagaggcatcatccataaaaaa

SEQ ID NO: 76986 - DNA, 25 bp, Homo sapien
ggcaagaggtatcatccataaaaaa

SEQ ID NO: 76987 - DNA, 25 bp, Homo sapien
ggcaagattttgatgaccaggtagt

SEQ ID NO: 76988 - DNA, 25 bp, Homo sapien
ggcaagattttggtgaccaggtagt

SEQ ID NO: 76989 - DNA, 25 bp, Homo sapien
ggcaagcacattacatgagtttcac

SEQ ID NO: 76990 - DNA, 25 bp, Homo sapien
ggcaagcagacatatattattagtg

SEQ ID NO: 76991 - DNA, 25 bp, Homo sapien
ggcaagcagtcatatattattagtg

SEQ ID NO: 76992 - DNA, 25 bp, Homo sapien
ggcaagcatattacatgagtttcac

SEQ ID NO: 76993 - DNA, 25 bp, Homo sapien
ggcaagccttgacgggagagccaat

SEQ ID NO: 76994 - DNA, 25 bp, Homo sapien
ggcaagccttgatgggagagccaat

SEQ ID NO: 76995 - DNA, 25 bp, Homo sapien
ggcaagcgattgtcctatgaaagac

SEQ ID NO: 76996 - DNA, 25 bp, Homo sapien
ggcaagcgattgtcctgtgaaagac

SEQ ID NO: 76997 - DNA, 25 bp, Homo sapien
ggcaagctcaaatttaaactctagc

SEQ ID NO: 76998 - DNA, 25 bp, Homo sapien
ggcaagctctaatttaaactctagc

SEQ ID NO: 76999 - DNA, 25 bp, Homo sapien
ggcaaggaaagacaatcccaacatg

SEQ ID NO: 77000 - DNA, 25 bp, Homo sapien
ggcaaggaaagagaatcccaacatg

SEQ ID NO: 77001 - DNA, 25 bp, Homo sapien
ggcaaggaataaatgaactcaagta

SEQ ID NO: 77002 - DNA, 25 bp, Homo sapien
ggcaaggaataaattaactcaagta

SEQ ID NO: 77003 - DNA, 25 bp, Homo sapien
ggcaaggaatgccactcatacatgg

SEQ ID NO: 77004 - DNA, 25 bp, Homo sapien
ggcaaggaatgtcactcatacatgg

SEQ ID NO: 77005 - DNA, 25 bp, Homo sapien
ggcaaggacatcttggtcatcaagt

SEQ ID NO: 77006 - DNA, 25 bp, Homo sapien
ggcaaggatatcttggtcatcaagt

SEQ ID NO: 77007 - DNA, 25 bp, Homo sapien
ggcaaggatgggactctgctctgag

SEQ ID NO: 77008 - DNA, 25 bp, Homo sapien
ggcaaggattggactctgctctgag

SEQ ID NO: 77009 - DNA, 25 bp, Homo sapien
ggcaagggtagtcgccttctgatgt

SEQ ID NO: 77010 - DNA, 25 bp, Homo sapien
ggcaagggtagtcgtcttctgatgt

SEQ ID NO: 77011 - DNA, 25 bp, Homo sapien
ggcaaggtttacggccctgaggatg

SEQ ID NO: 77012 - DNA, 25 bp, Homo sapien
ggcaaggtttatggccctgaggatg

SEQ ID NO: 77013 - DNA, 25 bp, Homo sapien
ggcaagtcaatgaccatgagagaat

SEQ ID NO: 77014 - DNA, 25 bp, Homo sapien
ggcaagtcaatgactatgagagaat

SEQ ID NO: 77015 - DNA, 25 bp, Homo sapien
ggcaagtctcaatagtttgctagat

SEQ ID NO: 77016 - DNA, 25 bp, Homo sapien
ggcaagtctcaatggtttgctagat

SEQ ID NO: 77017 - DNA, 25 bp, Homo sapien
ggcaagtctgatatttggttatgat

SEQ ID NO: 77018 - DNA, 25 bp, Homo sapien
ggcaagtctgatctttggttatgat

SEQ ID NO: 77019 - DNA, 25 bp, Homo sapien
ggcaagtcttaataaattcgaaaat

SEQ ID NO: 77020 - DNA, 25 bp, Homo sapien
ggcaagtcttaatgaattcgaaaat

SEQ ID NO: 77021 - DNA, 25 bp, Homo sapien
ggcaagtttctggtattcaacaaaa

SEQ ID NO: 77022 - DNA, 25 bp, Homo sapien
ggcaagtttctggtcttcaacaaaa

SEQ ID NO: 77023 - DNA, 25 bp, Homo sapien
ggcaataaaggtactgagcataagc

SEQ ID NO: 77024 - DNA, 25 bp, Homo sapien
ggcaataaaggttctgagcataagc

SEQ ID NO: 77025 - DNA, 25 bp, Homo sapien
ggcaataacactacttgctaatcat

SEQ ID NO: 77026 - DNA, 25 bp, Homo sapien
ggcaataacgctcctgtttggccta

SEQ ID NO: 77027 - DNA, 25 bp, Homo sapien
ggcaataatactacttgctaatcat

SEQ ID NO: 77028 - DNA, 25 bp, Homo sapien
ggcaataatgctcctgtttggccta

SEQ ID NO: 77029 - DNA, 25 bp, Homo sapien
ggcaatagactcaacctcttaatag

SEQ ID NO: 77030 - DNA, 25 bp, Homo sapien
ggcaatagattcaacctcttaatag

SEQ ID NO: 77031 - DNA, 25 bp, Homo sapien
ggcaatatgacacgaacaaaggaat

SEQ ID NO: 77032 - DNA, 25 bp, Homo sapien
ggcaatatgacatgaacaaaggaat

SEQ ID NO: 77033 - DNA, 25 bp, Homo sapien
ggcaatctgcatagcatcagaacag

SEQ ID NO: 77034 - DNA, 25 bp, Homo sapien
ggcaatctgcatggcatcagaacag

SEQ ID NO: 77035 - DNA, 25 bp, Homo sapien
ggcaatgacaatcttcctggcctca

SEQ ID NO: 77036 - DNA, 25 bp, Homo sapien
ggcaatgacaatgttcctggcctca

SEQ ID NO: 77037 - DNA, 25 bp, Homo sapien
ggcaatggcgtaacatcaccaggcc

SEQ ID NO: 77038 - DNA, 25 bp, Homo sapien
ggcaatggcgtgacatcaccaggcc

SEQ ID NO: 77039 - DNA, 25 bp, Homo sapien
ggcaattcctaataaagcaacatag

SEQ ID NO: 77040 - DNA, 25 bp, Homo sapien
ggcaattcctattaaagcaacatag

SEQ ID NO: 77041 - DNA, 25 bp, Homo sapien
ggcacaaacatcccgaggggtgtct

SEQ ID NO: 77042 - DNA, 25 bp, Homo sapien
ggcacaaacatcgcgaggggtgtct

SEQ ID NO: 77043 - DNA, 25 bp, Homo sapien
ggcacaaagacacggagaattccag

SEQ ID NO: 77044 - DNA, 25 bp, Homo sapien
ggcacaaagacatggagaattccag

SEQ ID NO: 77045 - DNA, 25 bp, Homo sapien
ggcacaaggttcgagaggccaaaga

SEQ ID NO: 77046 - DNA, 25 bp, Homo sapien
ggcacaaggtttgagaggccaaaga

SEQ ID NO: 77047 - DNA, 25 bp, Homo sapien
ggcacacaactctaaaattttacta

SEQ ID NO: 77048 - DNA, 25 bp, Homo sapien
ggcacacaagtctaaaattttacta

SEQ ID NO: 77049 - DNA, 25 bp, Homo sapien
ggcacactaaacataagcaatagta

SEQ ID NO: 77050 - DNA, 25 bp, Homo sapien
ggcacactaaacgtaagcaatagta

SEQ ID NO: 77051 - DNA, 25 bp, Homo sapien
ggcacagaggaacattgtccaactc

SEQ ID NO: 77052 - DNA, 25 bp, Homo sapien
ggcacagaggaacattttccaactc

SEQ ID NO: 77053 - DNA, 25 bp, Homo sapien
ggcacagaggcacgctgatcaggaa

SEQ ID NO: 77054 - DNA, 25 bp, Homo sapien
ggcacagaggcatgctgatcaggaa

SEQ ID NO: 77055 - DNA, 25 bp, Homo sapien
ggcacatagcacgaagcatcaccct

SEQ ID NO: 77056 - DNA, 25 bp, Homo sapien
ggcacatagcaggaagcatcaccct

SEQ ID NO: 77057 - DNA, 25 bp, Homo sapien
ggcacatctgaaatttacataagaa

SEQ ID NO: 77058 - DNA, 25 bp, Homo sapien
ggcacatctgaactttacataagaa

SEQ ID NO: 77059 - DNA, 25 bp, Homo sapien
ggcacatggatgaaagattgcagta

SEQ ID NO: 77060 - DNA, 25 bp, Homo sapien
ggcacatggatgaatgattgcagta

SEQ ID NO: 77061 - DNA, 25 bp, Homo sapien
ggcacattctcagcgtttaatgcct

SEQ ID NO: 77062 - DNA, 25 bp, Homo sapien
ggcacattctcagtgtttaatgcct

SEQ ID NO: 77063 - DNA, 25 bp, Homo sapien
ggcaccacttggaaaacggtaaatg

SEQ ID NO: 77064 - DNA, 25 bp, Homo sapien
ggcaccacttggaaaatggtaaatg

SEQ ID NO: 77065 - DNA, 25 bp, Homo sapien
ggcaccagagttggctttcaggctg

SEQ ID NO: 77066 - DNA, 25 bp, Homo sapien
ggcaccagagtttgctttcaggctg

SEQ ID NO: 77067 - DNA, 25 bp, Homo sapien
ggcaccagggataccaacaggaaca

SEQ ID NO: 77068 - DNA, 25 bp, Homo sapien
ggcaccagggataccaccaggaaca

SEQ ID NO: 77069 - DNA, 25 bp, Homo sapien
ggcaccagggcttcaatgaaacgga

SEQ ID NO: 77070 - DNA, 25 bp, Homo sapien
ggcaccaggtcttcaatgaaacgga

SEQ ID NO: 77071 - DNA, 25 bp, Homo sapien
ggcacccaaaccaagcagtttaaga

SEQ ID NO: 77072 - DNA, 25 bp, Homo sapien
ggcacccacaccaagcagtttaaga

SEQ ID NO: 77073 - DNA, 25 bp, Homo sapien
ggcacctgaatccacaagatgagga

SEQ ID NO: 77074 - DNA, 25 bp, Homo sapien
ggcacctgattccacaagatgagga

SEQ ID NO: 77075 - DNA, 25 bp, Homo sapien
ggcacctggcaatccaaattgtcct

SEQ ID NO: 77076 - DNA, 25 bp, Homo sapien
ggcacctggcagtccaaattgtcct

SEQ ID NO: 77077 - DNA, 25 bp, Homo sapien
ggcacgagagagaatcgccttgtct

SEQ ID NO: 77078 - DNA, 25 bp, Homo sapien
ggcacgagagagattcgccttgtct

SEQ ID NO: 77079 - DNA, 25 bp, Homo sapien
ggcacgctggcaaatacttggatgg

SEQ ID NO: 77080 - DNA, 25 bp, Homo sapien
ggcacgctggcatatacttggatgg

SEQ ID NO: 77081 - DNA, 25 bp, Homo sapien
ggcacgttaaagaaagaaagatggc

SEQ ID NO: 77082 - DNA, 25 bp, Homo sapien
ggcacgttaaagagagaaagatggc

SEQ ID NO: 77083 - DNA, 25 bp, Homo sapien
ggcactatcatctactacccattct

SEQ ID NO: 77084 - DNA, 25 bp, Homo sapien
ggcactatcatttactacccattct

SEQ ID NO: 77085 - DNA, 25 bp, Homo sapien
ggcactatccatagcaggcttcttg

SEQ ID NO: 77086 - DNA, 25 bp, Homo sapien
ggcactatccatcgcaggcttcttg

SEQ ID NO: 77087 - DNA, 25 bp, Homo sapien
ggcactatcgtagatccagattttg

SEQ ID NO: 77088 - DNA, 25 bp, Homo sapien
ggcactatgactaaaaaaatgcaca

SEQ ID NO: 77089 - DNA, 25 bp, Homo sapien
ggcactatgactaaaacaatgcaca

SEQ ID NO: 77090 - DNA, 25 bp, Homo sapien
ggcactatgtgttaattgcttagta

SEQ ID NO: 77091 - DNA, 25 bp, Homo sapien
ggcactatgtgtttattgcttagta

SEQ ID NO: 77092 - DNA, 25 bp, Homo sapien
ggcactattgtagatccagattttg

SEQ ID NO: 77093 - DNA, 25 bp, Homo sapien
ggcactcctcattgacattattaat

SEQ ID NO: 77094 - DNA, 25 bp, Homo sapien
ggcactcctcattggcattattaat

SEQ ID NO: 77095 - DNA, 25 bp, Homo sapien
ggcactctcagtgtctccgtaaatt

SEQ ID NO: 77096 - DNA, 25 bp, Homo sapien
ggcactctcagtgtttccgtaaatt

SEQ ID NO: 77097 - DNA, 25 bp, Homo sapien
ggcactctgaagacgtaattgtatc

SEQ ID NO: 77098 - DNA, 25 bp, Homo sapien
ggcactctgaagatgtaattgtatc

SEQ ID NO: 77099 - DNA, 25 bp, Homo sapien
ggcactgcactagacatttttttct

SEQ ID NO: 77100 - DNA, 25 bp, Homo sapien
ggcactgcactatacatttttttct

SEQ ID NO: 77101 - DNA, 25 bp, Homo sapien
ggcactggagagtccgcagtgacca

SEQ ID NO: 77102 - DNA, 25 bp, Homo sapien
ggcactggagagtctgcagtgacca

SEQ ID NO: 77103 - DNA, 25 bp, Homo sapien
ggcacttttgccatggtcctggtgt

SEQ ID NO: 77104 - DNA, 25 bp, Homo sapien
ggcacttttgccattgtcctggtgt

SEQ ID NO: 77105 - DNA, 25 bp, Homo sapien
ggcagaaaattcgcatttccaaaat

SEQ ID NO: 77106 - DNA, 25 bp, Homo sapien
ggcagaaaatttgcatttccaaaat

SEQ ID NO: 77107 - DNA, 25 bp, Homo sapien
ggcagaaactcaataaatacttgct

SEQ ID NO: 77108 - DNA, 25 bp, Homo sapien
ggcagaaactcaatgaatacttgct

SEQ ID NO: 77109 - DNA, 25 bp, Homo sapien
ggcagaactcagacactagtgcaag

SEQ ID NO: 77110 - DNA, 25 bp, Homo sapien
ggcagaactcaggcactagtgcaag

SEQ ID NO: 77111 - DNA, 25 bp, Homo sapien
ggcagaagaattccaaataatcatg

SEQ ID NO: 77112 - DNA, 25 bp, Homo sapien
ggcagaagaattccgaataatcatg

SEQ ID NO: 77113 - DNA, 25 bp, Homo sapien
ggcagaagagacaagctgagaaaag

SEQ ID NO: 77114 - DNA, 25 bp, Homo sapien
ggcagaagagacaatctgagaaaag

SEQ ID NO: 77115 - DNA, 25 bp, Homo sapien
ggcagaagtctctttcatcagttgg

SEQ ID NO: 77116 - DNA, 25 bp, Homo sapien
ggcagaagtctctttcgtcagttgg

SEQ ID NO: 77117 - DNA, 25 bp, Homo sapien
ggcagaatagtgagcgaaaataaat

SEQ ID NO: 77118 - DNA, 25 bp, Homo sapien
ggcagaatagtgcgcgaaaataaat

SEQ ID NO: 77119 - DNA, 25 bp, Homo sapien
ggcagacacattaggtggaaaatat

SEQ ID NO: 77120 - DNA, 25 bp, Homo sapien
ggcagacatattaggtggaaaatat

SEQ ID NO: 77121 - DNA, 25 bp, Homo sapien
ggcagactcatgattattccaaaga

SEQ ID NO: 77122 - DNA, 25 bp, Homo sapien
ggcagactcgtgattattccaaaga

SEQ ID NO: 77123 - DNA, 25 bp, Homo sapien
ggcagagacaacagaaaaaactagg

SEQ ID NO: 77124 - DNA, 25 bp, Homo sapien
ggcagagataaacaattaaattcag

SEQ ID NO: 77125 - DNA, 25 bp, Homo sapien
ggcagagataacagaaaaaactagg

SEQ ID NO: 77126 - DNA, 25 bp, Homo sapien
ggcagagataagcaattaaattcag

SEQ ID NO: 77127 - DNA, 25 bp, Homo sapien
ggcagagcatttcaaatttcagatt

SEQ ID NO: 77128 - DNA, 25 bp, Homo sapien
ggcagagcatttcagatttcagatt

SEQ ID NO: 77129 - DNA, 25 bp, Homo sapien
ggcagagctttgagcaatacacatg

SEQ ID NO: 77130 - DNA, 25 bp, Homo sapien
ggcagagctttgagcagtacacatg

SEQ ID NO: 77131 - DNA, 25 bp, Homo sapien
ggcagatacaagattaatatgcaaa

SEQ ID NO: 77132 - DNA, 25 bp, Homo sapien
ggcagatacaagattagtatgcaaa

SEQ ID NO: 77133 - DNA, 25 bp, Homo sapien
ggcagatcccttacaaatggcttgg

SEQ ID NO: 77134 - DNA, 25 bp, Homo sapien
ggcagatcccttacgaatggcttgg

SEQ ID NO: 77135 - DNA, 25 bp, Homo sapien
ggcagatgatttacggccagctttt

SEQ ID NO: 77136 - DNA, 25 bp, Homo sapien
ggcagatgatttatggccagctttt

SEQ ID NO: 77137 - DNA, 25 bp, Homo sapien
ggcagatggcaggaagtaatctttc

SEQ ID NO: 77138 - DNA, 25 bp, Homo sapien
ggcagatggcatgaagtaatctttc

SEQ ID NO: 77139 - DNA, 25 bp, Homo sapien
ggcagcactgtgcggaaggctggct

SEQ ID NO: 77140 - DNA, 25 bp, Homo sapien
ggcagcactgtgtggaaggctggct

SEQ ID NO: 77141 - DNA, 25 bp, Homo sapien
ggcagcagcacaaacagatgggtgg

SEQ ID NO: 77142 - DNA, 25 bp, Homo sapien
ggcagcagcacaaatagatgggtgg

SEQ ID NO: 77143 - DNA, 25 bp, Homo sapien
ggcagccctagaattaactgtgctg

SEQ ID NO: 77144 - DNA, 25 bp, Homo sapien
ggcagccctggaattaactgtgctg

SEQ ID NO: 77145 - DNA, 25 bp, Homo sapien
ggcagcgctgtgacatgggaagggc

SEQ ID NO: 77146 - DNA, 25 bp, Homo sapien
ggcagcgctgtgacgtgggaagggc

SEQ ID NO: 77147 - DNA, 25 bp, Homo sapien
ggcagctaaactcacattccttcta

SEQ ID NO: 77148 - DNA, 25 bp, Homo sapien
ggcagctaaactcatattccttcta

SEQ ID NO: 77149 - DNA, 25 bp, Homo sapien
ggcagctcatgtacacatttttttt

SEQ ID NO: 77150 - DNA, 25 bp, Homo sapien
ggcagctcatgtacacttttttttt

SEQ ID NO: 77151 - DNA, 25 bp, Homo sapien
ggcagctgctacactacagcgccac

SEQ ID NO: 77152 - DNA, 25 bp, Homo sapien
ggcagctgctacattacagcgccac

SEQ ID NO: 77153 - DNA, 25 bp, Homo sapien
ggcagctgtctatatccgataggct

SEQ ID NO: 77154 - DNA, 25 bp, Homo sapien
ggcagctgtctatatctgataggct

SEQ ID NO: 77155 - DNA, 25 bp, Homo sapien
ggcagctgtggcctgataaaggcaa

SEQ ID NO: 77156 - DNA, 25 bp, Homo sapien
ggcagctgtggtctgataaaggcaa

SEQ ID NO: 77157 - DNA, 25 bp, Homo sapien
ggcaggaaaatagataacattacaa

SEQ ID NO: 77158 - DNA, 25 bp, Homo sapien
ggcaggaaaatcgataacattacaa

SEQ ID NO: 77159 - DNA, 25 bp, Homo sapien
ggcaggacaatataagcaggcaact

SEQ ID NO: 77160 - DNA, 25 bp, Homo sapien
ggcaggacaatatatgcaggcaact

SEQ ID NO: 77161 - DNA, 25 bp, Homo sapien
ggcaggactctgtacttcaggggcc

SEQ ID NO: 77162 - DNA, 25 bp, Homo sapien
ggcaggactgtgtacttcaggggcc

SEQ ID NO: 77163 - DNA, 25 bp, Homo sapien
ggcaggatttacaggtaaaggataa

SEQ ID NO: 77164 - DNA, 25 bp, Homo sapien
ggcaggatttagaggtaaaggataa

SEQ ID NO: 77165 - DNA, 25 bp, Homo sapien
ggcaggccacacagaatggtctccc

SEQ ID NO: 77166 - DNA, 25 bp, Homo sapien
ggcaggccacagagaatggtctccc

SEQ ID NO: 77167 - DNA, 25 bp, Homo sapien
ggcaggccttgtagaacatgttgaa

SEQ ID NO: 77168 - DNA, 25 bp, Homo sapien
ggcaggccttgtagaatatgttgaa

SEQ ID NO: 77169 - DNA, 25 bp, Homo sapien
ggcagggaaaaactgtgtgctcagg

SEQ ID NO: 77170 - DNA, 25 bp, Homo sapien
ggcagggaaaaattgtgtgctcagg

SEQ ID NO: 77171 - DNA, 25 bp, Homo sapien
ggcagggaacccagaaggacagatg

SEQ ID NO: 77172 - DNA, 25 bp, Homo sapien
ggcagggaacccagcaggacagatg

SEQ ID NO: 77173 - DNA, 25 bp, Homo sapien
ggcagggaccaaaataacatacagt

SEQ ID NO: 77174 - DNA, 25 bp, Homo sapien
ggcagggacgaaaataacatacagt

SEQ ID NO: 77175 - DNA, 25 bp, Homo sapien
ggcagggactttgtttggctttgtg

SEQ ID NO: 77176 - DNA, 25 bp, Homo sapien
ggcagggactttttttggctttgtg

SEQ ID NO: 77177 - DNA, 25 bp, Homo sapien
ggcagggcatagctgcacacattcc

SEQ ID NO: 77178 - DNA, 25 bp, Homo sapien
ggcagggcatagctgcgcacattcc

SEQ ID NO: 77179 - DNA, 25 bp, Homo sapien
ggcagggctggcagtcccaggagtc

SEQ ID NO: 77180 - DNA, 25 bp, Homo sapien
ggcagggctggtagtcccaggagtc

SEQ ID NO: 77181 - DNA, 25 bp, Homo sapien
ggcaggtagagggactctcattctg

SEQ ID NO: 77182 - DNA, 25 bp, Homo sapien
ggcaggtagagggattctcattctg

SEQ ID NO: 77183 - DNA, 25 bp, Homo sapien
ggcaggtcacttgcaaattttctta

SEQ ID NO: 77184 - DNA, 25 bp, Homo sapien
ggcaggtcatttgcaaattttctta

SEQ ID NO: 77185 - DNA, 25 bp, Homo sapien
ggcaggtctgcgatggcggcaaaca

SEQ ID NO: 77186 - DNA, 25 bp, Homo sapien
ggcaggtctgcgatggtggcaaaca

SEQ ID NO: 77187 - DNA, 25 bp, Homo sapien
ggcaggtgcctctgctttgccgtta

SEQ ID NO: 77188 - DNA, 25 bp, Homo sapien
ggcaggtgctccatcaatggtcact

SEQ ID NO: 77189 - DNA, 25 bp, Homo sapien
ggcaggtgctccatcagtggtcact

SEQ ID NO: 77190 - DNA, 25 bp, Homo sapien
ggcaggtgcttctgctttgccgtta

SEQ ID NO: 77191 - DNA, 25 bp, Homo sapien
ggcaggtggaagacattgagacgcc

SEQ ID NO: 77192 - DNA, 25 bp, Homo sapien
ggcaggtggaaggcattgagacgcc

SEQ ID NO: 77193 - DNA, 25 bp, Homo sapien
ggcaggtgtattagacaaacgagac

SEQ ID NO: 77194 - DNA, 25 bp, Homo sapien
ggcaggtgtattagaccaacgagac

SEQ ID NO: 77195 - DNA, 25 bp, Homo sapien
ggcagtagcagtcctgaagaacagt

SEQ ID NO: 77196 - DNA, 25 bp, Homo sapien
ggcagtagcggtcctgaagaacagt

SEQ ID NO: 77197 - DNA, 25 bp, Homo sapien
ggcagtatctggaaacattttttgg

SEQ ID NO: 77198 - DNA, 25 bp, Homo sapien
ggcagtatctggaaacgttttttgg

SEQ ID NO: 77199 - DNA, 25 bp, Homo sapien
ggcagtccagcactctctaacagac

SEQ ID NO: 77200 - DNA, 25 bp, Homo sapien
ggcagtccagcattctctaacagac

SEQ ID NO: 77201 - DNA, 25 bp, Homo sapien
ggcagtccaggtgtggagctcttgt

SEQ ID NO: 77202 - DNA, 25 bp, Homo sapien
ggcagtccatgtgtggagctcttgt

SEQ ID NO: 77203 - DNA, 25 bp, Homo sapien
ggcagtctcgttctctataaaacaa

SEQ ID NO: 77204 - DNA, 25 bp, Homo sapien
ggcagtcttgttctctataaaacaa

SEQ ID NO: 77205 - DNA, 25 bp, Homo sapien
ggcagtgacatgttgaagaaactgg

SEQ ID NO: 77206 - DNA, 25 bp, Homo sapien
ggcagtgacttgttgaagaaactgg

SEQ ID NO: 77207 - DNA, 25 bp, Homo sapien
ggcagtgatataacacaatttgttc

SEQ ID NO: 77208 - DNA, 25 bp, Homo sapien
ggcagtgatataccacaatttgttc

SEQ ID NO: 77209 - DNA, 25 bp, Homo sapien
ggcagtgctcctttcgcgagggcat

SEQ ID NO: 77210 - DNA, 25 bp, Homo sapien
ggcagtgctccttttgcgagggcat

SEQ ID NO: 77211 - DNA, 25 bp, Homo sapien
ggcagtggatactcccgatgttcaa

SEQ ID NO: 77212 - DNA, 25 bp, Homo sapien
ggcagtggatactctcgatgttcaa

SEQ ID NO: 77213 - DNA, 25 bp, Homo sapien
ggcagtggcggactgtaacctgtct

SEQ ID NO: 77214 - DNA, 25 bp, Homo sapien
ggcagtggtggactgtaacctgtct

SEQ ID NO: 77215 - DNA, 25 bp, Homo sapien
ggcagtgtaaacccatgtagactgg

SEQ ID NO: 77216 - DNA, 25 bp, Homo sapien
ggcagtgtaaacccctgtagactgg

SEQ ID NO: 77217 - DNA, 25 bp, Homo sapien
ggcagtgtcacagcacaaagaaact

SEQ ID NO: 77218 - DNA, 25 bp, Homo sapien
ggcagtgtcacggcacaaagaaact

SEQ ID NO: 77219 - DNA, 25 bp, Homo sapien
ggcagtgtccagcaatggataagga

SEQ ID NO: 77220 - DNA, 25 bp, Homo sapien
ggcagtgtccaggaatggataagga

SEQ ID NO: 77221 - DNA, 25 bp, Homo sapien
ggcagttacggatgtatgaaatata

SEQ ID NO: 77222 - DNA, 25 bp, Homo sapien
ggcagttatggatgtatgaaatata

SEQ ID NO: 77223 - DNA, 25 bp, Homo sapien
ggcagttcagctgacattcaaacta

SEQ ID NO: 77224 - DNA, 25 bp, Homo sapien
ggcagttcagctgagattcaaacta

SEQ ID NO: 77225 - DNA, 25 bp, Homo sapien
ggcagttctatagtcttcaccacag

SEQ ID NO: 77226 - DNA, 25 bp, Homo sapien
ggcagttctgtagtcttcaccacag

SEQ ID NO: 77227 - DNA, 25 bp, Homo sapien
ggcagttgatttaaaaaaaaacttg

SEQ ID NO: 77228 - DNA, 25 bp, Homo sapien
ggcagttgattttaaaaaaaacttg

SEQ ID NO: 77229 - DNA, 25 bp, Homo sapien
ggcagtttggattaaagaatcgcaa

SEQ ID NO: 77230 - DNA, 25 bp, Homo sapien
ggcagtttggattagagaatcgcaa

SEQ ID NO: 77231 - DNA, 25 bp, Homo sapien
ggcagtttttcacagcaccttgatg

SEQ ID NO: 77232 - DNA, 25 bp, Homo sapien
ggcagtttttcacggcaccttgatg

SEQ ID NO: 77233 - DNA, 25 bp, Homo sapien
ggcataaagacttgacattctgcac

SEQ ID NO: 77234 - DNA, 25 bp, Homo sapien
ggcataaaggcttgacattctgcac

SEQ ID NO: 77235 - DNA, 25 bp, Homo sapien
ggcataaagtgatccgggtgatgga

SEQ ID NO: 77236 - DNA, 25 bp, Homo sapien
ggcataaagtgatctgggtgatgga

SEQ ID NO: 77237 - DNA, 25 bp, Homo sapien
ggcataagagtctcagtctggatat

SEQ ID NO: 77238 - DNA, 25 bp, Homo sapien
ggcataagagtttcagtctggatat

SEQ ID NO: 77239 - DNA, 25 bp, Homo sapien
ggcatacctagcgtcagattctttt

SEQ ID NO: 77240 - DNA, 25 bp, Homo sapien
ggcatacctagcttcagattctttt

SEQ ID NO: 77241 - DNA, 25 bp, Homo sapien
ggcatacctcaatttatttcacttg

SEQ ID NO: 77242 - DNA, 25 bp, Homo sapien
ggcatacctcattttatttcacttg

SEQ ID NO: 77243 - DNA, 25 bp, Homo sapien
ggcatacgttgcggcaaggatggag

SEQ ID NO: 77244 - DNA, 25 bp, Homo sapien
ggcatacgttgtggcaaggatggag

SEQ ID NO: 77245 - DNA, 25 bp, Homo sapien
ggcatagaataagaggcttgaattc

SEQ ID NO: 77246 - DNA, 25 bp, Homo sapien
ggcatagaccctgcctagcactgga

SEQ ID NO: 77247 - DNA, 25 bp, Homo sapien
ggcatagactaagaggcttgaattc

SEQ ID NO: 77248 - DNA, 25 bp, Homo sapien
ggcatagactctgcctagcactgga

SEQ ID NO: 77249 - DNA, 25 bp, Homo sapien
ggcatagctaccgtgaagggcagca

SEQ ID NO: 77250 - DNA, 25 bp, Homo sapien
ggcatagctactgtgaagggcagca

SEQ ID NO: 77251 - DNA, 25 bp, Homo sapien
ggcatagctgcacacattccacatt

SEQ ID NO: 77252 - DNA, 25 bp, Homo sapien
ggcatagctgcgcacattccacatt

SEQ ID NO: 77253 - DNA, 25 bp, Homo sapien
ggcatagttcacgtgtaattacaag

SEQ ID NO: 77254 - DNA, 25 bp, Homo sapien
ggcatagttcacttgtaattacaag

SEQ ID NO: 77255 - DNA, 25 bp, Homo sapien
ggcatatactcatctgtacaaacaa

SEQ ID NO: 77256 - DNA, 25 bp, Homo sapien
ggcatatactcatgtgtacaaacaa

SEQ ID NO: 77257 - DNA, 25 bp, Homo sapien
ggcatatgaaccatttacttctaaa

SEQ ID NO: 77258 - DNA, 25 bp, Homo sapien
ggcatatgaaccgtttacttctaaa

SEQ ID NO: 77259 - DNA, 25 bp, Homo sapien
ggcatatgccacaagaaaggaacag

SEQ ID NO: 77260 - DNA, 25 bp, Homo sapien
ggcatatgccacaagagaggaacag

SEQ ID NO: 77261 - DNA, 25 bp, Homo sapien
ggcatatgctttattatgtatgcat

SEQ ID NO: 77262 - DNA, 25 bp, Homo sapien
ggcatatgctttgttatgtatgcat

SEQ ID NO: 77263 - DNA, 25 bp, Homo sapien
ggcatatggcttccaatttgagctc

SEQ ID NO: 77264 - DNA, 25 bp, Homo sapien
ggcatatggctttcaatttgagctc

SEQ ID NO: 77265 - DNA, 25 bp, Homo sapien
ggcatcacaaacacagcctatcagc

SEQ ID NO: 77266 - DNA, 25 bp, Homo sapien
ggcatcacaaacgcagcctatcagc

SEQ ID NO: 77267 - DNA, 25 bp, Homo sapien
ggcatcagataccagtaaaagacca

SEQ ID NO: 77268 - DNA, 25 bp, Homo sapien
ggcatcaggtaccagtaaaagacca

SEQ ID NO: 77269 - DNA, 25 bp, Homo sapien
ggcatcagtgctattgtagagttgg

SEQ ID NO: 77270 - DNA, 25 bp, Homo sapien
ggcatcagtgctgttgtagagttgg

SEQ ID NO: 77271 - DNA, 25 bp, Homo sapien
ggcatccaccgggagcttttctccc

SEQ ID NO: 77272 - DNA, 25 bp, Homo sapien
ggcatccactgggagcttttctccc

SEQ ID NO: 77273 - DNA, 25 bp, Homo sapien
ggcatccttcccttacaagctgaat

SEQ ID NO: 77274 - DNA, 25 bp, Homo sapien
ggcatccttcccttaccagctgaat

SEQ ID NO: 77275 - DNA, 25 bp, Homo sapien
ggcatctcactgaagaagatttgtt

SEQ ID NO: 77276 - DNA, 25 bp, Homo sapien
ggcatctcactgaagaggatttgtt

SEQ ID NO: 77277 - DNA, 25 bp, Homo sapien
ggcatctgggaaagattttctcatt

SEQ ID NO: 77278 - DNA, 25 bp, Homo sapien
ggcatctgggagagattttctcatt

SEQ ID NO: 77279 - DNA, 25 bp, Homo sapien
ggcatgagtccaactgaaaaaattg

SEQ ID NO: 77280 - DNA, 25 bp, Homo sapien
ggcatgagtccagctgaaaaaattg

SEQ ID NO: 77281 - DNA, 25 bp, Homo sapien
ggcatgatatatctgtctactcctc

SEQ ID NO: 77282 - DNA, 25 bp, Homo sapien
ggcatgatatatttgtctactcctc

SEQ ID NO: 77283 - DNA, 25 bp, Homo sapien
ggcatgatcttgtggtctgaaccag

SEQ ID NO: 77284 - DNA, 25 bp, Homo sapien
ggcatgatgttgtggtctgaaccag

SEQ ID NO: 77285 - DNA, 25 bp, Homo sapien
ggcatgccagacaaagagaagattc

SEQ ID NO: 77286 - DNA, 25 bp, Homo sapien
ggcatgccagacatagagaagattc

SEQ ID NO: 77287 - DNA, 25 bp, Homo sapien
ggcatgccttatggcaatgtagaag

SEQ ID NO: 77288 - DNA, 25 bp, Homo sapien
ggcatgccttattgcaatgtagaag

SEQ ID NO: 77289 - DNA, 25 bp, Homo sapien
ggcatgctaattgtatgggatcact

SEQ ID NO: 77290 - DNA, 25 bp, Homo sapien
ggcatgctaattgtgtgggatcact

SEQ ID NO: 77291 - DNA, 25 bp, Homo sapien
ggcatgctgatgagctgagatgtaa

SEQ ID NO: 77292 - DNA, 25 bp, Homo sapien
ggcatgctgttgagctgagatgtaa

SEQ ID NO: 77293 - DNA, 25 bp, Homo sapien
ggcatggaatgcttcaggatggcca

SEQ ID NO: 77294 - DNA, 25 bp, Homo sapien
ggcatggaatgctttaggatggcca

SEQ ID NO: 77295 - DNA, 25 bp, Homo sapien
ggcatgggcagaaacttaatgacta

SEQ ID NO: 77296 - DNA, 25 bp, Homo sapien
ggcatgggcagaaccttaatgacta

SEQ ID NO: 77297 - DNA, 25 bp, Homo sapien
ggcatggtcttggaaatctattttg

SEQ ID NO: 77298 - DNA, 25 bp, Homo sapien
ggcatggttgctctcacctgtggtc

SEQ ID NO: 77299 - DNA, 25 bp, Homo sapien
ggcatggttgctctcatctgtggtc

SEQ ID NO: 77300 - DNA, 25 bp, Homo sapien
ggcatggttgtgcttgaatgataga

SEQ ID NO: 77301 - DNA, 25 bp, Homo sapien
ggcatggttgtggttgaatgataga

SEQ ID NO: 77302 - DNA, 25 bp, Homo sapien
ggcatggttttggaaatctattttg

SEQ ID NO: 77303 - DNA, 25 bp, Homo sapien
ggcatgtcatggatgcgtgtacagg

SEQ ID NO: 77304 - DNA, 25 bp, Homo sapien
ggcatgtcatggatgcttgtacagg

SEQ ID NO: 77305 - DNA, 25 bp, Homo sapien
ggcatgtccaaagactcagaaattc

SEQ ID NO: 77306 - DNA, 25 bp, Homo sapien
ggcatgtcgaaaactgagaaaggcc

SEQ ID NO: 77307 - DNA, 25 bp, Homo sapien
ggcatgtcgaaagactcagaaattc

SEQ ID NO: 77308 - DNA, 25 bp, Homo sapien
ggcatgtcgaaagctgagaaaggcc

SEQ ID NO: 77309 - DNA, 25 bp, Homo sapien
ggcatgtgaatatgtccctgaattg

SEQ ID NO: 77310 - DNA, 25 bp, Homo sapien
ggcatgtgaatgtgtccctgaattg

SEQ ID NO: 77311 - DNA, 25 bp, Homo sapien
ggcatgtgataccacacgggactca

SEQ ID NO: 77312 - DNA, 25 bp, Homo sapien
ggcatgtgataccgcacgggactca

SEQ ID NO: 77313 - DNA, 25 bp, Homo sapien
ggcattaaggactaagacaatgttg

SEQ ID NO: 77314 - DNA, 25 bp, Homo sapien
ggcattaaggactgagacaatgttg

SEQ ID NO: 77315 - DNA, 25 bp, Homo sapien
ggcattactaacgtctcctttctga

SEQ ID NO: 77316 - DNA, 25 bp, Homo sapien
ggcattactaatgtctcctttctga

SEQ ID NO: 77317 - DNA, 25 bp, Homo sapien
ggcattagacagattacccacaagg

SEQ ID NO: 77318 - DNA, 25 bp, Homo sapien
ggcattagatagattacccacaagg

SEQ ID NO: 77319 - DNA, 25 bp, Homo sapien
ggcattagtgaaattgcttcctgat

SEQ ID NO: 77320 - DNA, 25 bp, Homo sapien
ggcattagtgacattgcttcctgat

SEQ ID NO: 77321 - DNA, 25 bp, Homo sapien
ggcattccaggctagctctgttaca

SEQ ID NO: 77322 - DNA, 25 bp, Homo sapien
ggcattccaggttagctctgttaca

SEQ ID NO: 77323 - DNA, 25 bp, Homo sapien
ggcattcgcaacctaagcccactct

SEQ ID NO: 77324 - DNA, 25 bp, Homo sapien
ggcattcgcaacttaagcccactct

SEQ ID NO: 77325 - DNA, 25 bp, Homo sapien
ggcattctcaggtagcagcatgggg

SEQ ID NO: 77326 - DNA, 25 bp, Homo sapien
ggcattctcgggtagcagcatgggg

SEQ ID NO: 77327 - DNA, 25 bp, Homo sapien
ggcattctctctgcagattcaccta

SEQ ID NO: 77328 - DNA, 25 bp, Homo sapien
ggcattctctctgcggattcaccta

SEQ ID NO: 77329 - DNA, 25 bp, Homo sapien
ggcattctgagcaggtatacaagaa

SEQ ID NO: 77330 - DNA, 25 bp, Homo sapien
ggcattctgagcgggtatacaagaa

SEQ ID NO: 77331 - DNA, 25 bp, Homo sapien
ggcattgattaccgataaaagtttg

SEQ ID NO: 77332 - DNA, 25 bp, Homo sapien
ggcattgattaccggtaaaagtttg

SEQ ID NO: 77333 - DNA, 25 bp, Homo sapien
ggcattgctttcgcttcattacact

SEQ ID NO: 77334 - DNA, 25 bp, Homo sapien
ggcattgcttttgcttcattacact

SEQ ID NO: 77335 - DNA, 25 bp, Homo sapien
ggcattggaaagtaattaggtcatg

SEQ ID NO: 77336 - DNA, 25 bp, Homo sapien
ggcattggacaaaagacgataatgt

SEQ ID NO: 77337 - DNA, 25 bp, Homo sapien
ggcattggacaaaagatgataatgt

SEQ ID NO: 77338 - DNA, 25 bp, Homo sapien
ggcattgggaagtaattaggtcatg

SEQ ID NO: 77339 - DNA, 25 bp, Homo sapien
ggcattgtcctctatggagttgtgt

SEQ ID NO: 77340 - DNA, 25 bp, Homo sapien
ggcattgtcctctgtggagttgtgt

SEQ ID NO: 77341 - DNA, 25 bp, Homo sapien
ggcattgttctacctttcagtgctc

SEQ ID NO: 77342 - DNA, 25 bp, Homo sapien
ggcattgttttacctttcagtgctc

SEQ ID NO: 77343 - DNA, 25 bp, Homo sapien
ggcatttatatcaggtctcttcaca

SEQ ID NO: 77344 - DNA, 25 bp, Homo sapien
ggcatttatatctggtctcttcaca

SEQ ID NO: 77345 - DNA, 25 bp, Homo sapien
ggcatttatttctcaaagttctgga

SEQ ID NO: 77346 - DNA, 25 bp, Homo sapien
ggcatttatttctgaaagttctgga

SEQ ID NO: 77347 - DNA, 25 bp, Homo sapien
ggcatttcaataaaggaaggtctat

SEQ ID NO: 77348 - DNA, 25 bp, Homo sapien
ggcatttcaatgaaggaaggtctat

SEQ ID NO: 77349 - DNA, 25 bp, Homo sapien
ggcatttccagctgactcacagtgg

SEQ ID NO: 77350 - DNA, 25 bp, Homo sapien
ggcatttccagttgactcacagtgg

SEQ ID NO: 77351 - DNA, 25 bp, Homo sapien
ggcatttcgcccattattcccattc

SEQ ID NO: 77352 - DNA, 25 bp, Homo sapien
ggcatttctcccattattcccattc

SEQ ID NO: 77353 - DNA, 25 bp, Homo sapien
ggcatttgagttttcaatgcctgct

SEQ ID NO: 77354 - DNA, 25 bp, Homo sapien
ggcatttgatgatctagtcactctg

SEQ ID NO: 77355 - DNA, 25 bp, Homo sapien
ggcatttgatggtctagtcactctg

SEQ ID NO: 77356 - DNA, 25 bp, Homo sapien
ggcatttgcagagaaagaacaaagg

SEQ ID NO: 77357 - DNA, 25 bp, Homo sapien
ggcatttgcggagaaagaacaaagg

SEQ ID NO: 77358 - DNA, 25 bp, Homo sapien
ggcatttgcgttttcaatgcctgct

SEQ ID NO: 77359 - DNA, 25 bp, Homo sapien
ggcatttgcttcaaacagcctgcat

SEQ ID NO: 77360 - DNA, 25 bp, Homo sapien
ggcatttgtttcaaacagcctgcat

SEQ ID NO: 77361 - DNA, 25 bp, Homo sapien
ggcattttcttttttttgccaactg

SEQ ID NO: 77362 - DNA, 25 bp, Homo sapien
ggcatttttatacttttgaaaagta

SEQ ID NO: 77363 - DNA, 25 bp, Homo sapien
ggcatttttgtacttttgaaaagta

SEQ ID NO: 77364 - DNA, 25 bp, Homo sapien
ggcatttttttttttttgccaactg

SEQ ID NO: 77365 - DNA, 25 bp, Homo sapien
ggccaaaaagaggtaccgagatttc

SEQ ID NO: 77366 - DNA, 25 bp, Homo sapien
ggccaaaaagaggtactgagatttc

SEQ ID NO: 77367 - DNA, 25 bp, Homo sapien
ggccaaaatatggaccaaaactcag

SEQ ID NO: 77368 - DNA, 25 bp, Homo sapien
ggccaaaatatgggccaaaactcag

SEQ ID NO: 77369 - DNA, 25 bp, Homo sapien
ggccaaaatattaccaatgctactg

SEQ ID NO: 77370 - DNA, 25 bp, Homo sapien
ggccaaaatattaccagtgctactg

SEQ ID NO: 77371 - DNA, 25 bp, Homo sapien
ggccaaagaacacctcatttattat

SEQ ID NO: 77372 - DNA, 25 bp, Homo sapien
ggccaaagaacatctcatttattat

SEQ ID NO: 77373 - DNA, 25 bp, Homo sapien
ggccaaatgtgcagtggggactaaa

SEQ ID NO: 77374 - DNA, 25 bp, Homo sapien
ggccaaatgtgccgtggggactaaa

SEQ ID NO: 77375 - DNA, 25 bp, Homo sapien
ggccaaattgttaaattgcagcttt

SEQ ID NO: 77376 - DNA, 25 bp, Homo sapien
ggccaaattgttaagttgcagcttt

SEQ ID NO: 77377 - DNA, 25 bp, Homo sapien
ggccaaccaaaatctccatatgttt

SEQ ID NO: 77378 - DNA, 25 bp, Homo sapien
ggccaaccgaaatctccatatgttt

SEQ ID NO: 77379 - DNA, 25 bp, Homo sapien
ggccaagaatttctagttctaacaa

SEQ ID NO: 77380 - DNA, 25 bp, Homo sapien
ggccaagactttctagttctaacaa

SEQ ID NO: 77381 - DNA, 25 bp, Homo sapien
ggccaagataaaaaatcccaggccc

SEQ ID NO: 77382 - DNA, 25 bp, Homo sapien
ggccaagataaaagatcccaggccc

SEQ ID NO: 77383 - DNA, 25 bp, Homo sapien
ggccaaggtctaatttttcacacat

SEQ ID NO: 77384 - DNA, 25 bp, Homo sapien
ggccaaggtctagtttttcacacat

SEQ ID NO: 77385 - DNA, 25 bp, Homo sapien
ggccaataacaagcatggagctagg

SEQ ID NO: 77386 - DNA, 25 bp, Homo sapien
ggccaataacaggcatggagctagg

SEQ ID NO: 77387 - DNA, 25 bp, Homo sapien
ggccaatagccatgatgactactgg

SEQ ID NO: 77388 - DNA, 25 bp, Homo sapien
ggccaatagccgtgatgactactgg

SEQ ID NO: 77389 - DNA, 25 bp, Homo sapien
ggccacaagatcagataagtgagtt

SEQ ID NO: 77390 - DNA, 25 bp, Homo sapien
ggccacaaggtcagataagtgagtt

SEQ ID NO: 77391 - DNA, 25 bp, Homo sapien
ggccacatatcgtcatggcagaaca

SEQ ID NO: 77392 - DNA, 25 bp, Homo sapien
ggccacatatcgtcgtggcagaaca

SEQ ID NO: 77393 - DNA, 25 bp, Homo sapien
ggccacattacttatgtagaataac

SEQ ID NO: 77394 - DNA, 25 bp, Homo sapien
ggccacattgaacgggttcatctga

SEQ ID NO: 77395 - DNA, 25 bp, Homo sapien
ggccacattgaatgggttcatctga

SEQ ID NO: 77396 - DNA, 25 bp, Homo sapien
ggccacattgcttatgtagaataac

SEQ ID NO: 77397 - DNA, 25 bp, Homo sapien
ggccaccatcatccatacagagagg

SEQ ID NO: 77398 - DNA, 25 bp, Homo sapien
ggccaccatcattcatacagagagg

SEQ ID NO: 77399 - DNA, 25 bp, Homo sapien
ggccacctggcaggaatccctcttc

SEQ ID NO: 77400 - DNA, 25 bp, Homo sapien
ggccacctgtcaggaatccctcttc

SEQ ID NO: 77401 - DNA, 25 bp, Homo sapien
ggccacgcactatccaagtgatttt

SEQ ID NO: 77402 - DNA, 25 bp, Homo sapien
ggccacgcgctatccaagtgatttt

SEQ ID NO: 77403 - DNA, 25 bp, Homo sapien
ggccactaccttctgagaaacagtt

SEQ ID NO: 77404 - DNA, 25 bp, Homo sapien
ggccactactttctgagaaacagtt

SEQ ID NO: 77405 - DNA, 25 bp, Homo sapien
ggccactctgtcatgcttgaaaagt

SEQ ID NO: 77406 - DNA, 25 bp, Homo sapien
ggccactctgtcattcttgaaaagt

SEQ ID NO: 77407 - DNA, 25 bp, Homo sapien
ggccactggggtttcaatcagttcc

SEQ ID NO: 77408 - DNA, 25 bp, Homo sapien
ggccactggggtttgaatcagttcc

SEQ ID NO: 77409 - DNA, 25 bp, Homo sapien
ggccacttttactctgagcatgaag

SEQ ID NO: 77410 - DNA, 25 bp, Homo sapien
ggccacttttactttgagcatgaag

SEQ ID NO: 77411 - DNA, 25 bp, Homo sapien
ggccagaatggtcctgcacaagttg

SEQ ID NO: 77412 - DNA, 25 bp, Homo sapien
ggccagaatggtcctgtacaagttg

SEQ ID NO: 77413 - DNA, 25 bp, Homo sapien
ggccagactcttcctatgtggggac

SEQ ID NO: 77414 - DNA, 25 bp, Homo sapien
ggccagacttttcctatgtggggac

SEQ ID NO: 77415 - DNA, 25 bp, Homo sapien
ggccagagaaaaatgtgacctaaga

SEQ ID NO: 77416 - DNA, 25 bp, Homo sapien
ggccagagacaaatgtgacctaaga

SEQ ID NO: 77417 - DNA, 25 bp, Homo sapien
ggccagatgatccgtcacaaccaca

SEQ ID NO: 77418 - DNA, 25 bp, Homo sapien
ggccagatgatctgtcacaaccaca

SEQ ID NO: 77419 - DNA, 25 bp, Homo sapien
ggccagatggttttacaatgaaact

SEQ ID NO: 77420 - DNA, 25 bp, Homo sapien
ggccagatggttttacgatgaaact

SEQ ID NO: 77421 - DNA, 25 bp, Homo sapien
ggccagattactagcccgggtgccc

SEQ ID NO: 77422 - DNA, 25 bp, Homo sapien
ggccagattactagcctgggtgccc

SEQ ID NO: 77423 - DNA, 25 bp, Homo sapien
ggccagcaagggaagtgttatacgc

SEQ ID NO: 77424 - DNA, 25 bp, Homo sapien
ggccagcaagggcagtgttatacgc

SEQ ID NO: 77425 - DNA, 25 bp, Homo sapien
ggccagcagctaaccctagtcactg

SEQ ID NO: 77426 - DNA, 25 bp, Homo sapien
ggccagcagctatccctagtcactg

SEQ ID NO: 77427 - DNA, 25 bp, Homo sapien
ggccagctaagctcaatctgggcag

SEQ ID NO: 77428 - DNA, 25 bp, Homo sapien
ggccagctcagctcaatctgggcag

SEQ ID NO: 77429 - DNA, 25 bp, Homo sapien
ggccagcttgtcacctgggactggt

SEQ ID NO: 77430 - DNA, 25 bp, Homo sapien
ggccagcttgtcacgtgggactggt

SEQ ID NO: 77431 - DNA, 25 bp, Homo sapien
ggccagggaagagagcagtaccatg

SEQ ID NO: 77432 - DNA, 25 bp, Homo sapien
ggccagggaagatagcagtaccatg

SEQ ID NO: 77433 - DNA, 25 bp, Homo sapien
ggccagggcttaccttggtacctga

SEQ ID NO: 77434 - DNA, 25 bp, Homo sapien
ggccagggcttagcttggtacctga

SEQ ID NO: 77435 - DNA, 25 bp, Homo sapien
ggccaggttgcaatagtacctagtc

SEQ ID NO: 77436 - DNA, 25 bp, Homo sapien
ggccaggttgcagtagtacctagtc

SEQ ID NO: 77437 - DNA, 25 bp, Homo sapien
ggccagtccatttggtcaactcctc

SEQ ID NO: 77438 - DNA, 25 bp, Homo sapien
ggccagtccatttggttaactcctc

SEQ ID NO: 77439 - DNA, 25 bp, Homo sapien
ggccagtctctccacccagaatgta

SEQ ID NO: 77440 - DNA, 25 bp, Homo sapien
ggccagtctgtccacccagaatgta

SEQ ID NO: 77441 - DNA, 25 bp, Homo sapien
ggccagtgatatacagtagtagaaa

SEQ ID NO: 77442 - DNA, 25 bp, Homo sapien
ggccagtgatatagagtagtagaaa

SEQ ID NO: 77443 - DNA, 25 bp, Homo sapien
ggccagttacagccaatatgaacac

SEQ ID NO: 77444 - DNA, 25 bp, Homo sapien
ggccagttacagccgatatgaacac

SEQ ID NO: 77445 - DNA, 25 bp, Homo sapien
ggccagttgaaaaatgtagtgcgtc

SEQ ID NO: 77446 - DNA, 25 bp, Homo sapien
ggccagttgaataatgtagtgcgtc

SEQ ID NO: 77447 - DNA, 25 bp, Homo sapien
ggccatacccttcatttttgtaatg

SEQ ID NO: 77448 - DNA, 25 bp, Homo sapien
ggccatactcttcatttttgtaatg

SEQ ID NO: 77449 - DNA, 25 bp, Homo sapien
ggccatccagaactaatgcccaaga

SEQ ID NO: 77450 - DNA, 25 bp, Homo sapien
ggccatccggaactaatgcccaaga

SEQ ID NO: 77451 - DNA, 25 bp, Homo sapien
ggccatcctctttaatactgaatta

SEQ ID NO: 77452 - DNA, 25 bp, Homo sapien
ggccatcctctttaatgctgaatta

SEQ ID NO: 77453 - DNA, 25 bp, Homo sapien
ggccatctatccgcagagcttttta

SEQ ID NO: 77454 - DNA, 25 bp, Homo sapien
ggccatctatcggcagagcttttta

SEQ ID NO: 77455 - DNA, 25 bp, Homo sapien
ggccatggcattgtgtatagttgct

SEQ ID NO: 77456 - DNA, 25 bp, Homo sapien
ggccatggcattgtgtgtagttgct

SEQ ID NO: 77457 - DNA, 25 bp, Homo sapien
ggccatgtgtcccgatgttccatag

SEQ ID NO: 77458 - DNA, 25 bp, Homo sapien
ggccatgtgtcctgatgttccatag

SEQ ID NO: 77459 - DNA, 25 bp, Homo sapien
ggccatgttgaggcttccacaacag

SEQ ID NO: 77460 - DNA, 25 bp, Homo sapien
ggccatgttgaggtttccacaacag

SEQ ID NO: 77461 - DNA, 25 bp, Homo sapien
ggccattacgttattgtccagtttt

SEQ ID NO: 77462 - DNA, 25 bp, Homo sapien
ggccattatgttattgtccagtttt

SEQ ID NO: 77463 - DNA, 25 bp, Homo sapien
ggccattgcagtcttttccttggca

SEQ ID NO: 77464 - DNA, 25 bp, Homo sapien
ggccattgcagtgttttccttggca

SEQ ID NO: 77465 - DNA, 25 bp, Homo sapien
ggccatttgacataacaaaaactag

SEQ ID NO: 77466 - DNA, 25 bp, Homo sapien
ggccatttggcataacaaaaactag

SEQ ID NO: 77467 - DNA, 25 bp, Homo sapien
ggccattttactgctacgtctctca

SEQ ID NO: 77468 - DNA, 25 bp, Homo sapien
ggccattttactgctatgtctctca

SEQ ID NO: 77469 - DNA, 25 bp, Homo sapien
ggcccaaaaggcgtcatcagctgtc

SEQ ID NO: 77470 - DNA, 25 bp, Homo sapien
ggcccaaaatgcgtcatcagctgtc

SEQ ID NO: 77471 - DNA, 25 bp, Homo sapien
ggcccaaatggttgaacttcttttt

SEQ ID NO: 77472 - DNA, 25 bp, Homo sapien
ggcccaaatggttgaatttcttttt

SEQ ID NO: 77473 - DNA, 25 bp, Homo sapien
ggcccaacaaaggttcagaaatgtc

SEQ ID NO: 77474 - DNA, 25 bp, Homo sapien
ggcccaacaaagtttcagaaatgtc

SEQ ID NO: 77475 - DNA, 25 bp, Homo sapien
ggcccagaaacatgtaataggccct

SEQ ID NO: 77476 - DNA, 25 bp, Homo sapien
ggcccagaaacatttaataggccct

SEQ ID NO: 77477 - DNA, 25 bp, Homo sapien
ggcccagagctcaccacatctactt

SEQ ID NO: 77478 - DNA, 25 bp, Homo sapien
ggcccagagctcgccacatctactt

SEQ ID NO: 77479 - DNA, 25 bp, Homo sapien
ggcccagatttcgtttctggtgcta

SEQ ID NO: 77480 - DNA, 25 bp, Homo sapien
ggcccagattttgtttctggtgcta

SEQ ID NO: 77481 - DNA, 25 bp, Homo sapien
ggcccaggcgctgaatgggctttgg

SEQ ID NO: 77482 - DNA, 25 bp, Homo sapien
ggcccaggcgctgagtgggctttgg

SEQ ID NO: 77483 - DNA, 25 bp, Homo sapien
ggcccagtcaggtgaaggcaaacac

SEQ ID NO: 77484 - DNA, 25 bp, Homo sapien
ggcccagtcagttgaaggcaaacac

SEQ ID NO: 77485 - DNA, 25 bp, Homo sapien
ggccccagtggacactgaattccag

SEQ ID NO: 77486 - DNA, 25 bp, Homo sapien
ggccccagtggacgctgaattccag

SEQ ID NO: 77487 - DNA, 25 bp, Homo sapien
ggcccccagctgattttacagattt

SEQ ID NO: 77488 - DNA, 25 bp, Homo sapien
ggcccccagctgcttttacagattt

SEQ ID NO: 77489 - DNA, 25 bp, Homo sapien
ggccccggcaccaaatgccaggaac

SEQ ID NO: 77490 - DNA, 25 bp, Homo sapien
ggccccggcaccgaatgccaggaac

SEQ ID NO: 77491 - DNA, 25 bp, Homo sapien
ggcccctggtcctgaaagtgctgag

SEQ ID NO: 77492 - DNA, 25 bp, Homo sapien
ggcccctgttcctgaaagtgctgag

SEQ ID NO: 77493 - DNA, 25 bp, Homo sapien
ggccctaacaaacgagtgctggatt

SEQ ID NO: 77494 - DNA, 25 bp, Homo sapien
ggccctaacaaatgagtgctggatt

SEQ ID NO: 77495 - DNA, 25 bp, Homo sapien
ggccctatctgaaacattctaatga

SEQ ID NO: 77496 - DNA, 25 bp, Homo sapien
ggccctatctgaatcattctaatga

SEQ ID NO: 77497 - DNA, 25 bp, Homo sapien
ggccctcatctcatagctccactag

SEQ ID NO: 77498 - DNA, 25 bp, Homo sapien
ggccctcatctcttagctccactag

SEQ ID NO: 77499 - DNA, 25 bp, Homo sapien
ggccctgttgatggctgtggaagag

SEQ ID NO: 77500 - DNA, 25 bp, Homo sapien
ggccctgttgattgctgtggaagag

SEQ ID NO: 77501 - DNA, 25 bp, Homo sapien
ggcccttaatacttatggaatgaaa

SEQ ID NO: 77502 - DNA, 25 bp, Homo sapien
ggcccttaattttggtttgaaaagc

SEQ ID NO: 77503 - DNA, 25 bp, Homo sapien
ggcccttaattttgttttgaaaagc

SEQ ID NO: 77504 - DNA, 25 bp, Homo sapien
ggcccttactacttatggaatgaaa

SEQ ID NO: 77505 - DNA, 25 bp, Homo sapien
ggcccttccatacgagtccaggctt

SEQ ID NO: 77506 - DNA, 25 bp, Homo sapien
ggcccttccgtacgagtccaggctt

SEQ ID NO: 77507 - DNA, 25 bp, Homo sapien
ggcccttgttccaataaaacgttac

SEQ ID NO: 77508 - DNA, 25 bp, Homo sapien
ggcccttgttccaatagaacgttac

SEQ ID NO: 77509 - DNA, 25 bp, Homo sapien
ggccctttcgtcacctggacttctc

SEQ ID NO: 77510 - DNA, 25 bp, Homo sapien
ggcccttttgtcacctggacttctc

SEQ ID NO: 77511 - DNA, 25 bp, Homo sapien
ggccgacaatcataggcggcctgtt

SEQ ID NO: 77512 - DNA, 25 bp, Homo sapien
ggccgacagtcataggcggcctgtt

SEQ ID NO: 77513 - DNA, 25 bp, Homo sapien
ggccgagatgggtctatcaatggag

SEQ ID NO: 77514 - DNA, 25 bp, Homo sapien
ggccgagatggttctatcaatggag

SEQ ID NO: 77515 - DNA, 25 bp, Homo sapien
ggccgccctgaaacgaatcagagga

SEQ ID NO: 77516 - DNA, 25 bp, Homo sapien
ggccgccctgaaatgaatcagagga

SEQ ID NO: 77517 - DNA, 25 bp, Homo sapien
ggccggtttctgtaatccgggaaga

SEQ ID NO: 77518 - DNA, 25 bp, Homo sapien
ggccggtttttgtaatccgggaaga

SEQ ID NO: 77519 - DNA, 25 bp, Homo sapien
ggccgtccatggtggcagtcagcgc

SEQ ID NO: 77520 - DNA, 25 bp, Homo sapien
ggccgtccgtggtggcagtcagcgc

SEQ ID NO: 77521 - DNA, 25 bp, Homo sapien
ggccgttttcttctggtaggttggt

SEQ ID NO: 77522 - DNA, 25 bp, Homo sapien
ggccgttttcttttggtaggttggt

SEQ ID NO: 77523 - DNA, 25 bp, Homo sapien
ggcctaagtcacttatctgagtcag

SEQ ID NO: 77524 - DNA, 25 bp, Homo sapien
ggcctaagtcacttctctgagtcag

SEQ ID NO: 77525 - DNA, 25 bp, Homo sapien
ggcctaatcctcgttattggcacat

SEQ ID NO: 77526 - DNA, 25 bp, Homo sapien
ggcctaatccttgttattggcacat

SEQ ID NO: 77527 - DNA, 25 bp, Homo sapien
ggcctaattcccacgggtaaacact

SEQ ID NO: 77528 - DNA, 25 bp, Homo sapien
ggcctaattcccatgggtaaacact

SEQ ID NO: 77529 - DNA, 25 bp, Homo sapien
ggcctacacccttcatcacatctgc

SEQ ID NO: 77530 - DNA, 25 bp, Homo sapien
ggcctacacccttcgtcacatctgc

SEQ ID NO: 77531 - DNA, 25 bp, Homo sapien
ggcctacttctgtcccatcccaaat

SEQ ID NO: 77532 - DNA, 25 bp, Homo sapien
ggcctacttctgtcccgtcccaaat

SEQ ID NO: 77533 - DNA, 25 bp, Homo sapien
ggcctcaaatgatacttatgacttt

SEQ ID NO: 77534 - DNA, 25 bp, Homo sapien
ggcctcaaatgatagttatgacttt

SEQ ID NO: 77535 - DNA, 25 bp, Homo sapien
ggcctcaggcaccagggcttcaatg

SEQ ID NO: 77536 - DNA, 25 bp, Homo sapien
ggcctcaggcaccaggtcttcaatg

SEQ ID NO: 77537 - DNA, 25 bp, Homo sapien
ggcctcagttttatggctgcagtat

SEQ ID NO: 77538 - DNA, 25 bp, Homo sapien
ggcctcagttttatggttgcagtat

SEQ ID NO: 77539 - DNA, 25 bp, Homo sapien
ggcctccaaagcctatgcctgaata

SEQ ID NO: 77540 - DNA, 25 bp, Homo sapien
ggcctccaaagcctattcctgaata

SEQ ID NO: 77541 - DNA, 25 bp, Homo sapien
ggcctccaaatcttcaactggaggg

SEQ ID NO: 77542 - DNA, 25 bp, Homo sapien
ggcctccacatcttcaactggaggg

SEQ ID NO: 77543 - DNA, 25 bp, Homo sapien
ggcctcctagattaagacctgcctg

SEQ ID NO: 77544 - DNA, 25 bp, Homo sapien
ggcctcctagattaaggcctgcctg

SEQ ID NO: 77545 - DNA, 25 bp, Homo sapien
ggcctcgatttacctgtggtttccc

SEQ ID NO: 77546 - DNA, 25 bp, Homo sapien
ggcctcgatttacttgtggtttccc

SEQ ID NO: 77547 - DNA, 25 bp, Homo sapien
ggcctcggccgctgagggtctgctt

SEQ ID NO: 77548 - DNA, 25 bp, Homo sapien
ggcctcggctgctgagggtctgctt

SEQ ID NO: 77549 - DNA, 25 bp, Homo sapien
ggcctctacctttccaagtgtatgg

SEQ ID NO: 77550 - DNA, 25 bp, Homo sapien
ggcctctaccttttcaagtgtatgg

SEQ ID NO: 77551 - DNA, 25 bp, Homo sapien
ggcctctagcaattgccaacaaatt

SEQ ID NO: 77552 - DNA, 25 bp, Homo sapien
ggcctctagcagttgccaacaaatt

SEQ ID NO: 77553 - DNA, 25 bp, Homo sapien
ggcctctgaacctatgaattttgga

SEQ ID NO: 77554 - DNA, 25 bp, Homo sapien
ggcctctgaacctgtgaattttgga

SEQ ID NO: 77555 - DNA, 25 bp, Homo sapien
ggcctcttcatgaattgatcgatgc

SEQ ID NO: 77556 - DNA, 25 bp, Homo sapien
ggcctcttcttgaattgatcgatgc

SEQ ID NO: 77557 - DNA, 25 bp, Homo sapien
ggcctgaaacatcgttcatggtgac

SEQ ID NO: 77558 - DNA, 25 bp, Homo sapien
ggcctgaaacatggttcatggtgac

SEQ ID NO: 77559 - DNA, 25 bp, Homo sapien
ggcctgcagtggacgagtctatcat

SEQ ID NO: 77560 - DNA, 25 bp, Homo sapien
ggcctgcagtggaggagtctatcat

SEQ ID NO: 77561 - DNA, 25 bp, Homo sapien
ggcctgctactagttccaattctgt

SEQ ID NO: 77562 - DNA, 25 bp, Homo sapien
ggcctgctattagttccaattctgt

SEQ ID NO: 77563 - DNA, 25 bp, Homo sapien
ggcctgctcccaacgtacctgttgt

SEQ ID NO: 77564 - DNA, 25 bp, Homo sapien
ggcctgctcccaatgtacctgttgt

SEQ ID NO: 77565 - DNA, 25 bp, Homo sapien
ggcctggacattgcattgtttaaaa

SEQ ID NO: 77566 - DNA, 25 bp, Homo sapien
ggcctggacattgtattgtttaaaa

SEQ ID NO: 77567 - DNA, 25 bp, Homo sapien
ggcctggactatacaatccagttta

SEQ ID NO: 77568 - DNA, 25 bp, Homo sapien
ggcctggactatacgatccagttta

SEQ ID NO: 77569 - DNA, 25 bp, Homo sapien
ggcctgggcgccagccaagacttgc

SEQ ID NO: 77570 - DNA, 25 bp, Homo sapien
ggcctgggcgccggccaagacttgc

SEQ ID NO: 77571 - DNA, 25 bp, Homo sapien
ggcctggtcaagaactagaggactt

SEQ ID NO: 77572 - DNA, 25 bp, Homo sapien
ggcctggtcaaggactagaggactt

SEQ ID NO: 77573 - DNA, 25 bp, Homo sapien
ggcctgtactgacactggcccaggt

SEQ ID NO: 77574 - DNA, 25 bp, Homo sapien
ggcctgtactgacgctggcccaggt

SEQ ID NO: 77575 - DNA, 25 bp, Homo sapien
ggcctgtctaggccgcccaaattgc

SEQ ID NO: 77576 - DNA, 25 bp, Homo sapien
ggcctgtctaggctgcccaaattgc

SEQ ID NO: 77577 - DNA, 25 bp, Homo sapien
ggcctgtttccagatcttctctttg

SEQ ID NO: 77578 - DNA, 25 bp, Homo sapien
ggcctgttttcagatcttctctttg

SEQ ID NO: 77579 - DNA, 25 bp, Homo sapien
ggccttatctcaccaagtttcaggg

SEQ ID NO: 77580 - DNA, 25 bp, Homo sapien
ggccttatgtcaccaagtttcaggg

SEQ ID NO: 77581 - DNA, 25 bp, Homo sapien
ggccttattgatacattttgacttt

SEQ ID NO: 77582 - DNA, 25 bp, Homo sapien
ggccttattgatagattttgacttt

SEQ ID NO: 77583 - DNA, 25 bp, Homo sapien
ggccttccataaaagtttgttgaat

SEQ ID NO: 77584 - DNA, 25 bp, Homo sapien
ggccttccatagaagtttgttgaat

SEQ ID NO: 77585 - DNA, 25 bp, Homo sapien
ggccttctccgagccgcaccttcct

SEQ ID NO: 77586 - DNA, 25 bp, Homo sapien
ggccttctccgagctgcaccttcct

SEQ ID NO: 77587 - DNA, 25 bp, Homo sapien
ggccttgataaatactgacaaatag

SEQ ID NO: 77588 - DNA, 25 bp, Homo sapien
ggccttgataaatattgacaaatag

SEQ ID NO: 77589 - DNA, 25 bp, Homo sapien
ggccttggttgaattggatcagact

SEQ ID NO: 77590 - DNA, 25 bp, Homo sapien
ggccttggttgacttggatcagact

SEQ ID NO: 77591 - DNA, 25 bp, Homo sapien
ggccttgtagaacatgttgaagatt

SEQ ID NO: 77592 - DNA, 25 bp, Homo sapien
ggccttgtagaatatgttgaagatt

SEQ ID NO: 77593 - DNA, 25 bp, Homo sapien
ggcctttcatatattgtctatattg

SEQ ID NO: 77594 - DNA, 25 bp, Homo sapien
ggcctttcgtatattgtctatattg

SEQ ID NO: 77595 - DNA, 25 bp, Homo sapien
ggccttttccactggcaacttcaag

SEQ ID NO: 77596 - DNA, 25 bp, Homo sapien
ggccttttgccaggaactgaatgcc

SEQ ID NO: 77597 - DNA, 25 bp, Homo sapien
ggccttttgccaggaattgaatgcc

SEQ ID NO: 77598 - DNA, 25 bp, Homo sapien
ggcctttttcactggcaacttcaag

SEQ ID NO: 77599 - DNA, 25 bp, Homo sapien
ggcgaacgcaaacataataagttgt

SEQ ID NO: 77600 - DNA, 25 bp, Homo sapien
ggcgaacgcaagcataataagttgt

SEQ ID NO: 77601 - DNA, 25 bp, Homo sapien
ggcgaagaggcaaattgcagaatct

SEQ ID NO: 77602 - DNA, 25 bp, Homo sapien
ggcgaagaggcaagttgcagaatct

SEQ ID NO: 77603 - DNA, 25 bp, Homo sapien
ggcgaaggcagacctgccagaagca

SEQ ID NO: 77604 - DNA, 25 bp, Homo sapien
ggcgaaggcagacttgccagaagca

SEQ ID NO: 77605 - DNA, 25 bp, Homo sapien
ggcgaatccgatcatgtggttcctg

SEQ ID NO: 77606 - DNA, 25 bp, Homo sapien
ggcgaatctgatcatgtggttcctg

SEQ ID NO: 77607 - DNA, 25 bp, Homo sapien
ggcgagcaaacgccagcaaggtgga

SEQ ID NO: 77608 - DNA, 25 bp, Homo sapien
ggcgagcaaacgctagcaaggtgga

SEQ ID NO: 77609 - DNA, 25 bp, Homo sapien
ggcgagctatcatactgcattgttt

SEQ ID NO: 77610 - DNA, 25 bp, Homo sapien
ggcgagctatcatgctgcattgttt

SEQ ID NO: 77611 - DNA, 25 bp, Homo sapien
ggcgagctggtgtagagttgacctt

SEQ ID NO: 77612 - DNA, 25 bp, Homo sapien
ggcgagctggtgtggagttgacctt

SEQ ID NO: 77613 - DNA, 25 bp, Homo sapien
ggcgataaacccaagaggaaggggc

SEQ ID NO: 77614 - DNA, 25 bp, Homo sapien
ggcgataaacccgagaggaaggggc

SEQ ID NO: 77615 - DNA, 25 bp, Homo sapien
ggcgatctctacaagtagaagctta

SEQ ID NO: 77616 - DNA, 25 bp, Homo sapien
ggcgatctcttcgcttcctgtaaat

SEQ ID NO: 77617 - DNA, 25 bp, Homo sapien
ggcgatctcttcgctttctgtaaat

SEQ ID NO: 77618 - DNA, 25 bp, Homo sapien
ggcgatctgtacaagtagaagctta

SEQ ID NO: 77619 - DNA, 25 bp, Homo sapien
ggcgccattacaccatatttgaatt

SEQ ID NO: 77620 - DNA, 25 bp, Homo sapien
ggcgccattacgccatatttgaatt

SEQ ID NO: 77621 - DNA, 25 bp, Homo sapien
ggcgcgcatcaccatgcatagctaa

SEQ ID NO: 77622 - DNA, 25 bp, Homo sapien
ggcgcgcatcactatgcatagctaa

SEQ ID NO: 77623 - DNA, 25 bp, Homo sapien
ggcgctgaatgggctttggaggtga

SEQ ID NO: 77624 - DNA, 25 bp, Homo sapien
ggcgctgagtgggctttggaggtga

SEQ ID NO: 77625 - DNA, 25 bp, Homo sapien
ggcgctgttgaatctgagtccccac

SEQ ID NO: 77626 - DNA, 25 bp, Homo sapien
ggcgctgttgactctgagtccccac

SEQ ID NO: 77627 - DNA, 25 bp, Homo sapien
ggcggaagaagatatggacacaaaa

SEQ ID NO: 77628 - DNA, 25 bp, Homo sapien
ggcggaagaagatgtggacacaaaa

SEQ ID NO: 77629 - DNA, 25 bp, Homo sapien
ggcggatccctgaatgccacacttc

SEQ ID NO: 77630 - DNA, 25 bp, Homo sapien
ggcggatccctgagtgccacacttc

SEQ ID NO: 77631 - DNA, 25 bp, Homo sapien
ggcgggcagaaatacttgtctctcc

SEQ ID NO: 77632 - DNA, 25 bp, Homo sapien
ggcgggcaggaatacttgtctctcc

SEQ ID NO: 77633 - DNA, 25 bp, Homo sapien
ggcgggtgatatctgagtgtggcct

SEQ ID NO: 77634 - DNA, 25 bp, Homo sapien
ggcgggtgatatttgagtgtggcct

SEQ ID NO: 77635 - DNA, 25 bp, Homo sapien
ggcggtgccggcccataatattaaa

SEQ ID NO: 77636 - DNA, 25 bp, Homo sapien
ggcggtgccggcccatcatattaaa

SEQ ID NO: 77637 - DNA, 25 bp, Homo sapien
ggcggtggactatgacttataaaac

SEQ ID NO: 77638 - DNA, 25 bp, Homo sapien
ggcggtggattatgacttataaaac

SEQ ID NO: 77639 - DNA, 25 bp, Homo sapien
ggcgtaaaattacctgcaatttgtg

SEQ ID NO: 77640 - DNA, 25 bp, Homo sapien
ggcgtaaaattatctgcaatttgtg

SEQ ID NO: 77641 - DNA, 25 bp, Homo sapien
ggcgtaacatacatactattgatta

SEQ ID NO: 77642 - DNA, 25 bp, Homo sapien
ggcgtaacatatatactattgatta

SEQ ID NO: 77643 - DNA, 25 bp, Homo sapien
ggcgtaagatgcacatattgtagct

SEQ ID NO: 77644 - DNA, 25 bp, Homo sapien
ggcgtaagatgcacatgttgtagct

SEQ ID NO: 77645 - DNA, 25 bp, Homo sapien
ggcgtgacccactgtgcctagtcaa

SEQ ID NO: 77646 - DNA, 25 bp, Homo sapien
ggcgtgacctactgtgcctagtcaa

SEQ ID NO: 77647 - DNA, 25 bp, Homo sapien
ggcgtgcctcttaatgcagtccaga

SEQ ID NO: 77648 - DNA, 25 bp, Homo sapien
ggcgtgcctcttgatgcagtccaga

SEQ ID NO: 77649 - DNA, 25 bp, Homo sapien
ggcgtggagaaaagatgttcctgaa

SEQ ID NO: 77650 - DNA, 25 bp, Homo sapien
ggcgtggagaagagatgttcctgaa

SEQ ID NO: 77651 - DNA, 25 bp, Homo sapien
ggcgttggaatgaaaccatactctg

SEQ ID NO: 77652 - DNA, 25 bp, Homo sapien
ggcgttggaatgaaactatactctg

SEQ ID NO: 77653 - DNA, 25 bp, Homo sapien
ggcgttttattcacatcagttgttt

SEQ ID NO: 77654 - DNA, 25 bp, Homo sapien
ggcgttttattcgcatcagttgttt

SEQ ID NO: 77655 - DNA, 25 bp, Homo sapien
ggctaaaataaacagtcttcattca

SEQ ID NO: 77656 - DNA, 25 bp, Homo sapien
ggctaaaataaatagtcttcattca

SEQ ID NO: 77657 - DNA, 25 bp, Homo sapien
ggctaaagagtatacaagggtgttt

SEQ ID NO: 77658 - DNA, 25 bp, Homo sapien
ggctaaagattatacaagggtgttt

SEQ ID NO: 77659 - DNA, 25 bp, Homo sapien
ggctaacctggttcctaacacgtct

SEQ ID NO: 77660 - DNA, 25 bp, Homo sapien
ggctaacctggtttctaacacgtct

SEQ ID NO: 77661 - DNA, 25 bp, Homo sapien
ggctaagcctctgtttggtattccc

SEQ ID NO: 77662 - DNA, 25 bp, Homo sapien
ggctaagctgttaattgatgtgaac

SEQ ID NO: 77663 - DNA, 25 bp, Homo sapien
ggctaagctgttatttgatgtgaac

SEQ ID NO: 77664 - DNA, 25 bp, Homo sapien
ggctaagcttctgtttggtattccc

SEQ ID NO: 77665 - DNA, 25 bp, Homo sapien
ggctaaggaaaacacgaattccgaa

SEQ ID NO: 77666 - DNA, 25 bp, Homo sapien
ggctaaggaaaacatgaattccgaa

SEQ ID NO: 77667 - DNA, 25 bp, Homo sapien
ggctaagtttctcattcctctggct

SEQ ID NO: 77668 - DNA, 25 bp, Homo sapien
ggctaagtttctcatttctctggct

SEQ ID NO: 77669 - DNA, 25 bp, Homo sapien
ggctaatacagtaaatgcagtgaga

SEQ ID NO: 77670 - DNA, 25 bp, Homo sapien
ggctaatacatgaggtgcattgaga

SEQ ID NO: 77671 - DNA, 25 bp, Homo sapien
ggctaatacctataataacatttct

SEQ ID NO: 77672 - DNA, 25 bp, Homo sapien
ggctaatacgtataataacatttct

SEQ ID NO: 77673 - DNA, 25 bp, Homo sapien
ggctaatatagtaaatgcagtgaga

SEQ ID NO: 77674 - DNA, 25 bp, Homo sapien
ggctaatatatgaggtgcattgaga

SEQ ID NO: 77675 - DNA, 25 bp, Homo sapien
ggctaattctatgaagtcagtcact

SEQ ID NO: 77676 - DNA, 25 bp, Homo sapien
ggctaattctatgaggtcagtcact

SEQ ID NO: 77677 - DNA, 25 bp, Homo sapien
ggctaattgctatatatggttatgt

SEQ ID NO: 77678 - DNA, 25 bp, Homo sapien
ggctaattgctatgtatggttatgt

SEQ ID NO: 77679 - DNA, 25 bp, Homo sapien
ggctacaaggaaagaagagctatcc

SEQ ID NO: 77680 - DNA, 25 bp, Homo sapien
ggctacaaggaacgaagagctatcc

SEQ ID NO: 77681 - DNA, 25 bp, Homo sapien
ggctacagctggaattcttgctatg

SEQ ID NO: 77682 - DNA, 25 bp, Homo sapien
ggctacagctgggattcttgctatg

SEQ ID NO: 77683 - DNA, 25 bp, Homo sapien
ggctacaggatttctgtgtcaaatt

SEQ ID NO: 77684 - DNA, 25 bp, Homo sapien
ggctacaggttcacataggtcagct

SEQ ID NO: 77685 - DNA, 25 bp, Homo sapien
ggctacaggttcacgtaggtcagct

SEQ ID NO: 77686 - DNA, 25 bp, Homo sapien
ggctacagtatttctgtgtcaaatt

SEQ ID NO: 77687 - DNA, 25 bp, Homo sapien
ggctacataagacctagatatgctc

SEQ ID NO: 77688 - DNA, 25 bp, Homo sapien
ggctacatacgacctagatatgctc

SEQ ID NO: 77689 - DNA, 25 bp, Homo sapien
ggctacatatcatctaattctgttt

SEQ ID NO: 77690 - DNA, 25 bp, Homo sapien
ggctacatatcgtctaattctgttt

SEQ ID NO: 77691 - DNA, 25 bp, Homo sapien
ggctacatccagacctggctgctag

SEQ ID NO: 77692 - DNA, 25 bp, Homo sapien
ggctacattcagacctggctgctag

SEQ ID NO: 77693 - DNA, 25 bp, Homo sapien
ggctaccacaacgattaagtaatga

SEQ ID NO: 77694 - DNA, 25 bp, Homo sapien
ggctaccacaaggattaagtaatga

SEQ ID NO: 77695 - DNA, 25 bp, Homo sapien
ggctacctctgggccgtcacccagc

SEQ ID NO: 77696 - DNA, 25 bp, Homo sapien
ggctacctctgggctgtcacccagc

SEQ ID NO: 77697 - DNA, 25 bp, Homo sapien
ggctacgtgttcagctaattgcaaa

SEQ ID NO: 77698 - DNA, 25 bp, Homo sapien
ggctacgtgttcggctaattgcaaa

SEQ ID NO: 77699 - DNA, 25 bp, Homo sapien
ggctagaataaaaacctccatgact

SEQ ID NO: 77700 - DNA, 25 bp, Homo sapien
ggctagaatgaaaacctccatgact

SEQ ID NO: 77701 - DNA, 25 bp, Homo sapien
ggctagaatttacaataatatgttg

SEQ ID NO: 77702 - DNA, 25 bp, Homo sapien
ggctagaatttccaataatatgttg

SEQ ID NO: 77703 - DNA, 25 bp, Homo sapien
ggctagatgggtccaaaagcatgca

SEQ ID NO: 77704 - DNA, 25 bp, Homo sapien
ggctagatgggtccgaaagcatgca

SEQ ID NO: 77705 - DNA, 25 bp, Homo sapien
ggctagcattgcgtctgacatgtaa

SEQ ID NO: 77706 - DNA, 25 bp, Homo sapien
ggctagcattgtgtctgacatgtaa

SEQ ID NO: 77707 - DNA, 25 bp, Homo sapien
ggctaggaactatagtagatactga

SEQ ID NO: 77708 - DNA, 25 bp, Homo sapien
ggctaggaactgtagtagatactga

SEQ ID NO: 77709 - DNA, 25 bp, Homo sapien
ggctagggtaatcacgacaacacaa

SEQ ID NO: 77710 - DNA, 25 bp, Homo sapien
ggctagggtaatcatgacaacacaa

SEQ ID NO: 77711 - DNA, 25 bp, Homo sapien
ggctagtgaaaataataggtctaat

SEQ ID NO: 77712 - DNA, 25 bp, Homo sapien
ggctagtgaaaatgataggtctaat

SEQ ID NO: 77713 - DNA, 25 bp, Homo sapien
ggctataagagaataaattcatgtt

SEQ ID NO: 77714 - DNA, 25 bp, Homo sapien
ggctataagagcataaattcatgtt

SEQ ID NO: 77715 - DNA, 25 bp, Homo sapien
ggctatatggagagtttatttgaac

SEQ ID NO: 77716 - DNA, 25 bp, Homo sapien
ggctatattgagagtttatttgaac

SEQ ID NO: 77717 - DNA, 25 bp, Homo sapien
ggctatgacataattcttggttgcc

SEQ ID NO: 77718 - DNA, 25 bp, Homo sapien
ggctatgacgtaattcttggttgcc

SEQ ID NO: 77719 - DNA, 25 bp, Homo sapien
ggctatgattgacaattaccatgta

SEQ ID NO: 77720 - DNA, 25 bp, Homo sapien
ggctatgattgataattaccatgta

SEQ ID NO: 77721 - DNA, 25 bp, Homo sapien
ggctatgtagacccggttcgcagtc

SEQ ID NO: 77722 - DNA, 25 bp, Homo sapien
ggctatgtagagccggttcgcagtc

SEQ ID NO: 77723 - DNA, 25 bp, Homo sapien
ggctatgtatcacacagtgcaaaca

SEQ ID NO: 77724 - DNA, 25 bp, Homo sapien
ggctatgtatcagacagtgcaaaca

SEQ ID NO: 77725 - DNA, 25 bp, Homo sapien
ggctattatgaataacccatctgtg

SEQ ID NO: 77726 - DNA, 25 bp, Homo sapien
ggctattatgaataacgcatctgtg

SEQ ID NO: 77727 - DNA, 25 bp, Homo sapien
ggctattctcaggcagaaggcacga

SEQ ID NO: 77728 - DNA, 25 bp, Homo sapien
ggctattctcaggcaggaggcacga

SEQ ID NO: 77729 - DNA, 25 bp, Homo sapien
ggctattctctcgggctgcatttat

SEQ ID NO: 77730 - DNA, 25 bp, Homo sapien
ggctattctctctggctgcatttat

SEQ ID NO: 77731 - DNA, 25 bp, Homo sapien
ggctatttcttcgtgtactagtagt

SEQ ID NO: 77732 - DNA, 25 bp, Homo sapien
ggctatttctttgtgtactagtagt

SEQ ID NO: 77733 - DNA, 25 bp, Homo sapien
ggctattttaacagtccaggtgaaa

SEQ ID NO: 77734 - DNA, 25 bp, Homo sapien
ggctattttaatagtccaggtgaaa

SEQ ID NO: 77735 - DNA, 25 bp, Homo sapien
ggctcaaaaaccactgcaccatccc

SEQ ID NO: 77736 - DNA, 25 bp, Homo sapien
ggctcaaaagccactgcaccatccc

SEQ ID NO: 77737 - DNA, 25 bp, Homo sapien
ggctcaaaagtcaagccagtgcctg

SEQ ID NO: 77738 - DNA, 25 bp, Homo sapien
ggctcaaaagtcaatccagtgcctg

SEQ ID NO: 77739 - DNA, 25 bp, Homo sapien
ggctcaatacattactggaaagagt

SEQ ID NO: 77740 - DNA, 25 bp, Homo sapien
ggctcaatccattactggaaagagt

SEQ ID NO: 77741 - DNA, 25 bp, Homo sapien
ggctcaattctgcttttccctcata

SEQ ID NO: 77742 - DNA, 25 bp, Homo sapien
ggctcaattgtgcttttccctcata

SEQ ID NO: 77743 - DNA, 25 bp, Homo sapien
ggctcacatacactattttaatttg

SEQ ID NO: 77744 - DNA, 25 bp, Homo sapien
ggctcacatacattattttaatttg

SEQ ID NO: 77745 - DNA, 25 bp, Homo sapien
ggctcactaactgattgcaaacatc

SEQ ID NO: 77746 - DNA, 25 bp, Homo sapien
ggctcactacactgtcatcacatgt

SEQ ID NO: 77747 - DNA, 25 bp, Homo sapien
ggctcactacactgtcgtcacatgt

SEQ ID NO: 77748 - DNA, 25 bp, Homo sapien
ggctcactctactttcaagatggta

SEQ ID NO: 77749 - DNA, 25 bp, Homo sapien
ggctcactgactgattgcaaacatc

SEQ ID NO: 77750 - DNA, 25 bp, Homo sapien
ggctcactgtactttcaagatggta

SEQ ID NO: 77751 - DNA, 25 bp, Homo sapien
ggctcagacaagttacctaacatct

SEQ ID NO: 77752 - DNA, 25 bp, Homo sapien
ggctcagacaagttacttaacatct

SEQ ID NO: 77753 - DNA, 25 bp, Homo sapien
ggctcagagcttgccaggtagtgag

SEQ ID NO: 77754 - DNA, 25 bp, Homo sapien
ggctcagagcttgtcaggtagtgag

SEQ ID NO: 77755 - DNA, 25 bp, Homo sapien
ggctcagagtttgacacacaatagg

SEQ ID NO: 77756 - DNA, 25 bp, Homo sapien
ggctcagagtttgacatacaatagg

SEQ ID NO: 77757 - DNA, 25 bp, Homo sapien
ggctcagcatgccttaacagaatac

SEQ ID NO: 77758 - DNA, 25 bp, Homo sapien
ggctcagcgtgccttaacagaatac

SEQ ID NO: 77759 - DNA, 25 bp, Homo sapien
ggctcaggatgaaatcgagtctccc

SEQ ID NO: 77760 - DNA, 25 bp, Homo sapien
ggctcaggttgaaatcgagtctccc

SEQ ID NO: 77761 - DNA, 25 bp, Homo sapien
ggctcatcctcatattttctgttgg

SEQ ID NO: 77762 - DNA, 25 bp, Homo sapien
ggctcatcctcgtattttctgttgg

SEQ ID NO: 77763 - DNA, 25 bp, Homo sapien
ggctcatgtggatggccgaggtgcc

SEQ ID NO: 77764 - DNA, 25 bp, Homo sapien
ggctcatgtggatggctgaggtgcc

SEQ ID NO: 77765 - DNA, 25 bp, Homo sapien
ggctcattgctcaacttctctgtgc

SEQ ID NO: 77766 - DNA, 25 bp, Homo sapien
ggctcattgctcagcttctctgtgc

SEQ ID NO: 77767 - DNA, 25 bp, Homo sapien
ggctccaagagagatgaagccacat

SEQ ID NO: 77768 - DNA, 25 bp, Homo sapien
ggctccaatagagatgaagccacat

SEQ ID NO: 77769 - DNA, 25 bp, Homo sapien
ggctccagcgaggttctaaaccaag

SEQ ID NO: 77770 - DNA, 25 bp, Homo sapien
ggctccagcgagtttctaaaccaag

SEQ ID NO: 77771 - DNA, 25 bp, Homo sapien
ggctccaggctgccatacactgagg

SEQ ID NO: 77772 - DNA, 25 bp, Homo sapien
ggctccaggctgtcatacactgagg

SEQ ID NO: 77773 - DNA, 25 bp, Homo sapien
ggctccatttacctctcgtatattg

SEQ ID NO: 77774 - DNA, 25 bp, Homo sapien
ggctccatttacttctcgtatattg

SEQ ID NO: 77775 - DNA, 25 bp, Homo sapien
ggctccctgctcatatttaagagaa

SEQ ID NO: 77776 - DNA, 25 bp, Homo sapien
ggctccctgttcatatttaagagaa

SEQ ID NO: 77777 - DNA, 25 bp, Homo sapien
ggctccgattgtacttctaataagc

SEQ ID NO: 77778 - DNA, 25 bp, Homo sapien
ggctccgattgtatttctaataagc

SEQ ID NO: 77779 - DNA, 25 bp, Homo sapien
ggctccgctacataggcatgcttga

SEQ ID NO: 77780 - DNA, 25 bp, Homo sapien
ggctccgctacgtaggcatgcttga

SEQ ID NO: 77781 - DNA, 25 bp, Homo sapien
ggctccggcatcctattttcctgga

SEQ ID NO: 77782 - DNA, 25 bp, Homo sapien
ggctccggcatcctgttttcctgga

SEQ ID NO: 77783 - DNA, 25 bp, Homo sapien
ggctcctaccagcctgctcagctgt

SEQ ID NO: 77784 - DNA, 25 bp, Homo sapien
ggctcctactagcctgctcagctgt

SEQ ID NO: 77785 - DNA, 25 bp, Homo sapien
ggctcctgagaaaaaattccacaaa

SEQ ID NO: 77786 - DNA, 25 bp, Homo sapien
ggctcctgagaataaattccacaaa

SEQ ID NO: 77787 - DNA, 25 bp, Homo sapien
ggctcgctggcatgttgctggcagg

SEQ ID NO: 77788 - DNA, 25 bp, Homo sapien
ggctcgctggcgtgttgctggcagg

SEQ ID NO: 77789 - DNA, 25 bp, Homo sapien
ggctcggcatcctttaacctgtcat

SEQ ID NO: 77790 - DNA, 25 bp, Homo sapien
ggctcggcgtcctttaacctgtcat

SEQ ID NO: 77791 - DNA, 25 bp, Homo sapien
ggctctagctattattaacagcagt

SEQ ID NO: 77792 - DNA, 25 bp, Homo sapien
ggctctaggtattattaacagcagt

SEQ ID NO: 77793 - DNA, 25 bp, Homo sapien
ggctctatccctctcatttttcagg

SEQ ID NO: 77794 - DNA, 25 bp, Homo sapien
ggctctatccctcttatttttcagg

SEQ ID NO: 77795 - DNA, 25 bp, Homo sapien
ggctctctattctcctttgcttttc

SEQ ID NO: 77796 - DNA, 25 bp, Homo sapien
ggctctctcaattttgaattaaacc

SEQ ID NO: 77797 - DNA, 25 bp, Homo sapien
ggctctcttaattttgaattaaacc

SEQ ID NO: 77798 - DNA, 25 bp, Homo sapien
ggctctcttctaaccatcttattct

SEQ ID NO: 77799 - DNA, 25 bp, Homo sapien
ggctctcttctaactatcttattct

SEQ ID NO: 77800 - DNA, 25 bp, Homo sapien
ggctctcttttctcctttgcttttc

SEQ ID NO: 77801 - DNA, 25 bp, Homo sapien
ggctctgaagagagtgactgatcct

SEQ ID NO: 77802 - DNA, 25 bp, Homo sapien
ggctctgaagagagtggctgatcct

SEQ ID NO: 77803 - DNA, 25 bp, Homo sapien
ggctctgatatagctctcaccaaag

SEQ ID NO: 77804 - DNA, 25 bp, Homo sapien
ggctctgatgtagctctcaccaaag

SEQ ID NO: 77805 - DNA, 25 bp, Homo sapien
ggctctgcaacataaccattcagaa

SEQ ID NO: 77806 - DNA, 25 bp, Homo sapien
ggctctgcaacatatccattcagaa

SEQ ID NO: 77807 - DNA, 25 bp, Homo sapien
ggctctgctgcatataacaagcctg

SEQ ID NO: 77808 - DNA, 25 bp, Homo sapien
ggctctgctgcatgtaacaagcctg

SEQ ID NO: 77809 - DNA, 25 bp, Homo sapien
ggctcttaaaagcgtccacctgtaa

SEQ ID NO: 77810 - DNA, 25 bp, Homo sapien
ggctcttaaaagcttccacctgtaa

SEQ ID NO: 77811 - DNA, 25 bp, Homo sapien
ggctcttcccatggacagtccagtc

SEQ ID NO: 77812 - DNA, 25 bp, Homo sapien
ggctcttcgaaaagattaagtgcat

SEQ ID NO: 77813 - DNA, 25 bp, Homo sapien
ggctcttcgaaaatattaagtgcat

SEQ ID NO: 77814 - DNA, 25 bp, Homo sapien
ggctcttcgcatggacagtccagtc

SEQ ID NO: 77815 - DNA, 25 bp, Homo sapien
ggctcttctgtcataatttggacct

SEQ ID NO: 77816 - DNA, 25 bp, Homo sapien
ggctcttctgtcatgatttggacct

SEQ ID NO: 77817 - DNA, 25 bp, Homo sapien
ggctcttcttacatttgcagtgtgc

SEQ ID NO: 77818 - DNA, 25 bp, Homo sapien
ggctcttcttacattttcagtgtgc

SEQ ID NO: 77819 - DNA, 25 bp, Homo sapien
ggctcttcttttacatgtcatctta

SEQ ID NO: 77820 - DNA, 25 bp, Homo sapien
ggctcttcttttacgtgtcatctta

SEQ ID NO: 77821 - DNA, 25 bp, Homo sapien
ggctcttgacactagagttccagag

SEQ ID NO: 77822 - DNA, 25 bp, Homo sapien
ggctcttggcactagagttccagag

SEQ ID NO: 77823 - DNA, 25 bp, Homo sapien
ggctctttcatgaccgaggctccat

SEQ ID NO: 77824 - DNA, 25 bp, Homo sapien
ggctctttcatgactgaggctccat

SEQ ID NO: 77825 - DNA, 25 bp, Homo sapien
ggctctttctgtttgtcatcactgt

SEQ ID NO: 77826 - DNA, 25 bp, Homo sapien
ggctcttttcaacaactagttctca

SEQ ID NO: 77827 - DNA, 25 bp, Homo sapien
ggctcttttcagcaactagttctca

SEQ ID NO: 77828 - DNA, 25 bp, Homo sapien
ggctcttttctaagtgcatgtgata

SEQ ID NO: 77829 - DNA, 25 bp, Homo sapien
ggctcttttgtaagtgcatgtgata

SEQ ID NO: 77830 - DNA, 25 bp, Homo sapien
ggctctttttgtttgtcatcactgt

SEQ ID NO: 77831 - DNA, 25 bp, Homo sapien
ggctgaaaatacaagatcagggtgc

SEQ ID NO: 77832 - DNA, 25 bp, Homo sapien
ggctgaaagtaagagtggcctcagt

SEQ ID NO: 77833 - DNA, 25 bp, Homo sapien
ggctgaaagtacaagatcagggtgc

SEQ ID NO: 77834 - DNA, 25 bp, Homo sapien
ggctgaaagtaggagtggcctcagt

SEQ ID NO: 77835 - DNA, 25 bp, Homo sapien
ggctgaaagttatcgccaatagcca

SEQ ID NO: 77836 - DNA, 25 bp, Homo sapien
ggctgaaagttattgccaatagcca

SEQ ID NO: 77837 - DNA, 25 bp, Homo sapien
ggctgaactcttagagaggcaggca

SEQ ID NO: 77838 - DNA, 25 bp, Homo sapien
ggctgaactcttggagaggcaggca

SEQ ID NO: 77839 - DNA, 25 bp, Homo sapien
ggctgaactgatatacagtttgtaa

SEQ ID NO: 77840 - DNA, 25 bp, Homo sapien
ggctgaactgatatccagtttgtaa

SEQ ID NO: 77841 - DNA, 25 bp, Homo sapien
ggctgaagcaatacaaaaaggatag

SEQ ID NO: 77842 - DNA, 25 bp, Homo sapien
ggctgaagcaatacgaaaaggatag

SEQ ID NO: 77843 - DNA, 25 bp, Homo sapien
ggctgaagcagtccgcaaggttaac

SEQ ID NO: 77844 - DNA, 25 bp, Homo sapien
ggctgaagcagtgcgcaaggttaac

SEQ ID NO: 77845 - DNA, 25 bp, Homo sapien
ggctgaccctgcctctgaccctttt

SEQ ID NO: 77846 - DNA, 25 bp, Homo sapien
ggctgaccctgcttctgaccctttt

SEQ ID NO: 77847 - DNA, 25 bp, Homo sapien
ggctgagagcacccaaatgttatat

SEQ ID NO: 77848 - DNA, 25 bp, Homo sapien
ggctgagagcacccaagtgttatat

SEQ ID NO: 77849 - DNA, 25 bp, Homo sapien
ggctgagccaatcagattgtctttc

SEQ ID NO: 77850 - DNA, 25 bp, Homo sapien
ggctgagccaatcggattgtctttc

SEQ ID NO: 77851 - DNA, 25 bp, Homo sapien
ggctgagtaaggtcacaggaaaaga

SEQ ID NO: 77852 - DNA, 25 bp, Homo sapien
ggctgagtaaggtcaccggaaaaga

SEQ ID NO: 77853 - DNA, 25 bp, Homo sapien
ggctgatcacactcaatttgtccag

SEQ ID NO: 77854 - DNA, 25 bp, Homo sapien
ggctgatcatactcaatttgtccag

SEQ ID NO: 77855 - DNA, 25 bp, Homo sapien
ggctgatgaaaaattatcttgatgc

SEQ ID NO: 77856 - DNA, 25 bp, Homo sapien
ggctgatgaaacattatcttgatgc

SEQ ID NO: 77857 - DNA, 25 bp, Homo sapien
ggctgatgactaccacatctataat

SEQ ID NO: 77858 - DNA, 25 bp, Homo sapien
ggctgatgactacctcatctataat

SEQ ID NO: 77859 - DNA, 25 bp, Homo sapien
ggctgatgcaggggaaatgcagtcc

SEQ ID NO: 77860 - DNA, 25 bp, Homo sapien
ggctgatgcaggggaagtgcagtcc

SEQ ID NO: 77861 - DNA, 25 bp, Homo sapien
ggctgattattctcaaagcccactg

SEQ ID NO: 77862 - DNA, 25 bp, Homo sapien
ggctgattgttctcaaagcccactg

SEQ ID NO: 77863 - DNA, 25 bp, Homo sapien
ggctgatttgttgcctcttttctcc

SEQ ID NO: 77864 - DNA, 25 bp, Homo sapien
ggctgatttgtttcctcttttctcc

SEQ ID NO: 77865 - DNA, 25 bp, Homo sapien
ggctgcacattgtattcaccttggg

SEQ ID NO: 77866 - DNA, 25 bp, Homo sapien
ggctgcacattgtattgaccttggg

SEQ ID NO: 77867 - DNA, 25 bp, Homo sapien
ggctgcaccgtactttgagatggaa

SEQ ID NO: 77868 - DNA, 25 bp, Homo sapien
ggctgcactgtactttgagatggaa

SEQ ID NO: 77869 - DNA, 25 bp, Homo sapien
ggctgcatcgtcagcttccctactt

SEQ ID NO: 77870 - DNA, 25 bp, Homo sapien
ggctgcatctacttgttggcacagg

SEQ ID NO: 77871 - DNA, 25 bp, Homo sapien
ggctgcatctatttgttggcacagg

SEQ ID NO: 77872 - DNA, 25 bp, Homo sapien
ggctgcattgtcagcttccctactt

SEQ ID NO: 77873 - DNA, 25 bp, Homo sapien
ggctgccacttgcttataaatagat

SEQ ID NO: 77874 - DNA, 25 bp, Homo sapien
ggctgccagaagggcttctccagga

SEQ ID NO: 77875 - DNA, 25 bp, Homo sapien
ggctgccagaagggtttctccagga

SEQ ID NO: 77876 - DNA, 25 bp, Homo sapien
ggctgccagttgcttataaatagat

SEQ ID NO: 77877 - DNA, 25 bp, Homo sapien
ggctgccgacatgggtagtggcctg

SEQ ID NO: 77878 - DNA, 25 bp, Homo sapien
ggctgccgacatgtgtagtggcctg

SEQ ID NO: 77879 - DNA, 25 bp, Homo sapien
ggctgcgccatctgctcctgacatt

SEQ ID NO: 77880 - DNA, 25 bp, Homo sapien
ggctgcgccatctgttcctgacatt

SEQ ID NO: 77881 - DNA, 25 bp, Homo sapien
ggctgctcctgtgctgtcacctgca

SEQ ID NO: 77882 - DNA, 25 bp, Homo sapien
ggctgctcctgtgttgtcacctgca

SEQ ID NO: 77883 - DNA, 25 bp, Homo sapien
ggctgctccttcctcgggctgccta

SEQ ID NO: 77884 - DNA, 25 bp, Homo sapien
ggctgctcctttctcgggctgccta

SEQ ID NO: 77885 - DNA, 25 bp, Homo sapien
ggctgctcgcacgctactacagcag

SEQ ID NO: 77886 - DNA, 25 bp, Homo sapien
ggctgctctcacgctactacagcag

SEQ ID NO: 77887 - DNA, 25 bp, Homo sapien
ggctgctgtaatatcacacactggg

SEQ ID NO: 77888 - DNA, 25 bp, Homo sapien
ggctgctgtaatgtcacacactggg

SEQ ID NO: 77889 - DNA, 25 bp, Homo sapien
ggctgcttccaagtggcatatggac

SEQ ID NO: 77890 - DNA, 25 bp, Homo sapien
ggctgcttccaagttgcatatggac

SEQ ID NO: 77891 - DNA, 25 bp, Homo sapien
ggctggacagacgatttccagggat

SEQ ID NO: 77892 - DNA, 25 bp, Homo sapien
ggctggacagactatttccagggat

SEQ ID NO: 77893 - DNA, 25 bp, Homo sapien
ggctggaccatgctaagcagacagt

SEQ ID NO: 77894 - DNA, 25 bp, Homo sapien
ggctggaccgtgctaagcagacagt

SEQ ID NO: 77895 - DNA, 25 bp, Homo sapien
ggctggagaagacacagggaggatg

SEQ ID NO: 77896 - DNA, 25 bp, Homo sapien
ggctggagaagatacagggaggatg

SEQ ID NO: 77897 - DNA, 25 bp, Homo sapien
ggctggagctacacaccgtcaaatt

SEQ ID NO: 77898 - DNA, 25 bp, Homo sapien
ggctggagctacacactgtcaaatt

SEQ ID NO: 77899 - DNA, 25 bp, Homo sapien
ggctggagtgtaataagcaagagag

SEQ ID NO: 77900 - DNA, 25 bp, Homo sapien
ggctggagtgtaatgagcaagagag

SEQ ID NO: 77901 - DNA, 25 bp, Homo sapien
ggctggcaacagattgtgaacatgc

SEQ ID NO: 77902 - DNA, 25 bp, Homo sapien
ggctggcaacaggttgtgaacatgc

SEQ ID NO: 77903 - DNA, 25 bp, Homo sapien
ggctggcctcacttaggattgcagt

SEQ ID NO: 77904 - DNA, 25 bp, Homo sapien
ggctggcctcagttaggattgcagt

SEQ ID NO: 77905 - DNA, 25 bp, Homo sapien
ggctgggaccggtcatgtgtctgtg

SEQ ID NO: 77906 - DNA, 25 bp, Homo sapien
ggctgggactggtcatgtgtctgtg

SEQ ID NO: 77907 - DNA, 25 bp, Homo sapien
ggctggtcaaactgccacctcaggg

SEQ ID NO: 77908 - DNA, 25 bp, Homo sapien
ggctggtcaaactgccgcctcaggg

SEQ ID NO: 77909 - DNA, 25 bp, Homo sapien
ggctggtcacagtattaagatgtgc

SEQ ID NO: 77910 - DNA, 25 bp, Homo sapien
ggctggtcacagtgttaagatgtgc

SEQ ID NO: 77911 - DNA, 25 bp, Homo sapien
ggctggtcacccaggaaggatggat

SEQ ID NO: 77912 - DNA, 25 bp, Homo sapien
ggctggtcacccgggaaggatggat

SEQ ID NO: 77913 - DNA, 25 bp, Homo sapien
ggctggtccagccaatcagggataa

SEQ ID NO: 77914 - DNA, 25 bp, Homo sapien
ggctggtccagctaatcagggataa

SEQ ID NO: 77915 - DNA, 25 bp, Homo sapien
ggctggtggcaactctggctcccct

SEQ ID NO: 77916 - DNA, 25 bp, Homo sapien
ggctggtggcaattctggctcccct

SEQ ID NO: 77917 - DNA, 25 bp, Homo sapien
ggctggttctgatgctatactattg

SEQ ID NO: 77918 - DNA, 25 bp, Homo sapien
ggctggttctgatggtatactattg

SEQ ID NO: 77919 - DNA, 25 bp, Homo sapien
ggctgtaaatatatagcaatttaat

SEQ ID NO: 77920 - DNA, 25 bp, Homo sapien
ggctgtaagtatatagcaatttaat

SEQ ID NO: 77921 - DNA, 25 bp, Homo sapien
ggctgtaatacagggataataaagt

SEQ ID NO: 77922 - DNA, 25 bp, Homo sapien
ggctgtaatacggggataataaagt

SEQ ID NO: 77923 - DNA, 25 bp, Homo sapien
ggctgtacagggagtagagcagctt

SEQ ID NO: 77924 - DNA, 25 bp, Homo sapien
ggctgtacagggagtatagcagctt

SEQ ID NO: 77925 - DNA, 25 bp, Homo sapien
ggctgtcacctggaacttccaaact

SEQ ID NO: 77926 - DNA, 25 bp, Homo sapien
ggctgtcacctggagcttccaaact

SEQ ID NO: 77927 - DNA, 25 bp, Homo sapien
ggctgtcattcctacaagccagtat

SEQ ID NO: 77928 - DNA, 25 bp, Homo sapien
ggctgtcattcctacaggccagtat

SEQ ID NO: 77929 - DNA, 25 bp, Homo sapien
ggctgtccataattggtaaacatga

SEQ ID NO: 77930 - DNA, 25 bp, Homo sapien
ggctgtccgtaattggtaaacatga

SEQ ID NO: 77931 - DNA, 25 bp, Homo sapien
ggctgtcctgtgtatggtgggctcc

SEQ ID NO: 77932 - DNA, 25 bp, Homo sapien
ggctgtcctgtgtgtggtgggctcc

SEQ ID NO: 77933 - DNA, 25 bp, Homo sapien
ggctgtccttccacggatacctgaa

SEQ ID NO: 77934 - DNA, 25 bp, Homo sapien
ggctgtccttccatggatacctgaa

SEQ ID NO: 77935 - DNA, 25 bp, Homo sapien
ggctgtctaatgtttaggactgtgg

SEQ ID NO: 77936 - DNA, 25 bp, Homo sapien
ggctgtctgatgtttaggactgtgg

SEQ ID NO: 77937 - DNA, 25 bp, Homo sapien
ggctgtgactttcgctgattcaagt

SEQ ID NO: 77938 - DNA, 25 bp, Homo sapien
ggctgtgacttttgctgattcaagt

SEQ ID NO: 77939 - DNA, 25 bp, Homo sapien
ggctgtgcacattactccagaactg

SEQ ID NO: 77940 - DNA, 25 bp, Homo sapien
ggctgtgcacattattccagaactg

SEQ ID NO: 77941 - DNA, 25 bp, Homo sapien
ggctgtgctatgaaacctggaagtc

SEQ ID NO: 77942 - DNA, 25 bp, Homo sapien
ggctgtgctctgaaacctggaagtc

SEQ ID NO: 77943 - DNA, 25 bp, Homo sapien
ggctgtgctttcataagagcaaaat

SEQ ID NO: 77944 - DNA, 25 bp, Homo sapien
ggctgtgcttttataagagcaaaat

SEQ ID NO: 77945 - DNA, 25 bp, Homo sapien
ggctgtgggaaacatgccatgccct

SEQ ID NO: 77946 - DNA, 25 bp, Homo sapien
ggctgtgggaaacgtgccatgccct

SEQ ID NO: 77947 - DNA, 25 bp, Homo sapien
ggctgtgtcctcacagagtgaaagg

SEQ ID NO: 77948 - DNA, 25 bp, Homo sapien
ggctgtgtccttacagagtgaaagg

SEQ ID NO: 77949 - DNA, 25 bp, Homo sapien
ggctgtgtgatctgctttggccaac

SEQ ID NO: 77950 - DNA, 25 bp, Homo sapien
ggctgtgtgatttgctttggccaac

SEQ ID NO: 77951 - DNA, 25 bp, Homo sapien
ggctgttaaaaaaattcacattcat

SEQ ID NO: 77952 - DNA, 25 bp, Homo sapien
ggctgttaaaaaatttcacattcat

SEQ ID NO: 77953 - DNA, 25 bp, Homo sapien
ggctgttagaagaagccatatcatt

SEQ ID NO: 77954 - DNA, 25 bp, Homo sapien
ggctgttataagaagccatatcatt

SEQ ID NO: 77955 - DNA, 25 bp, Homo sapien
ggctgttattttaaatggaagaact

SEQ ID NO: 77956 - DNA, 25 bp, Homo sapien
ggctgttattttaagtggaagaact

SEQ ID NO: 77957 - DNA, 25 bp, Homo sapien
ggctgtttcaggaaagttctcacca

SEQ ID NO: 77958 - DNA, 25 bp, Homo sapien
ggctgtttcagtaaagttctcacca

SEQ ID NO: 77959 - DNA, 25 bp, Homo sapien
ggcttaaaataaccagtccctattg

SEQ ID NO: 77960 - DNA, 25 bp, Homo sapien
ggcttaaaatagccagtccctattg

SEQ ID NO: 77961 - DNA, 25 bp, Homo sapien
ggcttaaatatctctagctaatacc

SEQ ID NO: 77962 - DNA, 25 bp, Homo sapien
ggcttaaatgtctctagctaatacc

SEQ ID NO: 77963 - DNA, 25 bp, Homo sapien
ggcttaagcatatatatgactccca

SEQ ID NO: 77964 - DNA, 25 bp, Homo sapien
ggcttaagcgtatatatgactccca

SEQ ID NO: 77965 - DNA, 25 bp, Homo sapien
ggcttacgtttatccaaaagcatct

SEQ ID NO: 77966 - DNA, 25 bp, Homo sapien
ggcttacgtttattcaaaagcatct

SEQ ID NO: 77967 - DNA, 25 bp, Homo sapien
ggcttactctttcattttactgaaa

SEQ ID NO: 77968 - DNA, 25 bp, Homo sapien
ggcttactctttccttttactgaaa

SEQ ID NO: 77969 - DNA, 25 bp, Homo sapien
ggcttagatttactacaaattatag

SEQ ID NO: 77970 - DNA, 25 bp, Homo sapien
ggcttagatttattacaaattatag

SEQ ID NO: 77971 - DNA, 25 bp, Homo sapien
ggcttagcaatctgcagtttcaccc

SEQ ID NO: 77972 - DNA, 25 bp, Homo sapien
ggcttagcaatctgtagtttcaccc

SEQ ID NO: 77973 - DNA, 25 bp, Homo sapien
ggcttagcaatgcacattaaagttc

SEQ ID NO: 77974 - DNA, 25 bp, Homo sapien
ggcttagcaatgcatattaaagttc

SEQ ID NO: 77975 - DNA, 25 bp, Homo sapien
ggcttagcctcttatttaggagctg

SEQ ID NO: 77976 - DNA, 25 bp, Homo sapien
ggcttagcttcttatttaggagctg

SEQ ID NO: 77977 - DNA, 25 bp, Homo sapien
ggcttaggctcaaaatactaccttt

SEQ ID NO: 77978 - DNA, 25 bp, Homo sapien
ggcttaggttcaaaatactaccttt

SEQ ID NO: 77979 - DNA, 25 bp, Homo sapien
ggcttaggttctagtggtacatgga

SEQ ID NO: 77980 - DNA, 25 bp, Homo sapien
ggcttaggttctggtggtacatgga

SEQ ID NO: 77981 - DNA, 25 bp, Homo sapien
ggcttagtgatatatttccacctct

SEQ ID NO: 77982 - DNA, 25 bp, Homo sapien
ggcttagtgatatctttccacctct

SEQ ID NO: 77983 - DNA, 25 bp, Homo sapien
ggcttatagagcttaacgaaggaat

SEQ ID NO: 77984 - DNA, 25 bp, Homo sapien
ggcttatagagcttaatgaaggaat

SEQ ID NO: 77985 - DNA, 25 bp, Homo sapien
ggcttatctaatacgttgggtggta

SEQ ID NO: 77986 - DNA, 25 bp, Homo sapien
ggcttatctaatgcgttgggtggta

SEQ ID NO: 77987 - DNA, 25 bp, Homo sapien
ggcttatggccacatcattcccgtc

SEQ ID NO: 77988 - DNA, 25 bp, Homo sapien
ggcttatggcggtggactatgactt

SEQ ID NO: 77989 - DNA, 25 bp, Homo sapien
ggcttatggcggtggattatgactt

SEQ ID NO: 77990 - DNA, 25 bp, Homo sapien
ggcttatggtcacatcattcccgtc

SEQ ID NO: 77991 - DNA, 25 bp, Homo sapien
ggcttatgtgacctatgagacagca

SEQ ID NO: 77992 - DNA, 25 bp, Homo sapien
ggcttatgtgacttatgagacagca

SEQ ID NO: 77993 - DNA, 25 bp, Homo sapien
ggcttatttcaccactgtactgaat

SEQ ID NO: 77994 - DNA, 25 bp, Homo sapien
ggcttatttcatcactgtactgaat

SEQ ID NO: 77995 - DNA, 25 bp, Homo sapien
ggcttatttcctcatctgttttggt

SEQ ID NO: 77996 - DNA, 25 bp, Homo sapien
ggcttatttcctcttctgttttggt

SEQ ID NO: 77997 - DNA, 25 bp, Homo sapien
ggcttatttctaaactccttatctg

SEQ ID NO: 77998 - DNA, 25 bp, Homo sapien
ggcttatttttaaactccttatctg

SEQ ID NO: 77999 - DNA, 25 bp, Homo sapien
ggcttatttttccgctcataatgtt

SEQ ID NO: 78000 - DNA, 25 bp, Homo sapien
ggcttatttttctgctcataatgtt

SEQ ID NO: 78001 - DNA, 25 bp, Homo sapien
ggcttcaaacactgacattggtgct

SEQ ID NO: 78002 - DNA, 25 bp, Homo sapien
ggcttcaaacactgacgttggtgct

SEQ ID NO: 78003 - DNA, 25 bp, Homo sapien
ggcttcaaacgtaaatgtccctgaa

SEQ ID NO: 78004 - DNA, 25 bp, Homo sapien
ggcttcaaatgtaaatgtccctgaa

SEQ ID NO: 78005 - DNA, 25 bp, Homo sapien
ggcttcaagacacatttaagagata

SEQ ID NO: 78006 - DNA, 25 bp, Homo sapien
ggcttcaagacagatttaagagata

SEQ ID NO: 78007 - DNA, 25 bp, Homo sapien
ggcttcagaaaggacccaatgtctc

SEQ ID NO: 78008 - DNA, 25 bp, Homo sapien
ggcttcagaaaggatccaatgtctc

SEQ ID NO: 78009 - DNA, 25 bp, Homo sapien
ggcttcatagacatcttggcagcta

SEQ ID NO: 78010 - DNA, 25 bp, Homo sapien
ggcttcattgacatcttggcagcta

SEQ ID NO: 78011 - DNA, 25 bp, Homo sapien
ggcttccactcaacaaggctgactt

SEQ ID NO: 78012 - DNA, 25 bp, Homo sapien
ggcttccactcaccaaggctgactt

SEQ ID NO: 78013 - DNA, 25 bp, Homo sapien
ggcttccatgtgcagaatagattga

SEQ ID NO: 78014 - DNA, 25 bp, Homo sapien
ggcttccatgtggagaatagattga

SEQ ID NO: 78015 - DNA, 25 bp, Homo sapien
ggcttcccattagatcctgacctgc

SEQ ID NO: 78016 - DNA, 25 bp, Homo sapien
ggcttcccattagatcttgacctgc

SEQ ID NO: 78017 - DNA, 25 bp, Homo sapien
ggcttcgatctggctgacttctctt

SEQ ID NO: 78018 - DNA, 25 bp, Homo sapien
ggcttcgatctggctgccttctctt

SEQ ID NO: 78019 - DNA, 25 bp, Homo sapien
ggcttctaattcacccacactgcat

SEQ ID NO: 78020 - DNA, 25 bp, Homo sapien
ggcttctacctatagtatattatct

SEQ ID NO: 78021 - DNA, 25 bp, Homo sapien
ggcttctacctgtagtatattatct

SEQ ID NO: 78022 - DNA, 25 bp, Homo sapien
ggcttctagttcacccacactgcat

SEQ ID NO: 78023 - DNA, 25 bp, Homo sapien
ggcttctatacttgttccctggcca

SEQ ID NO: 78024 - DNA, 25 bp, Homo sapien
ggcttctatacttgtttcctggcca

SEQ ID NO: 78025 - DNA, 25 bp, Homo sapien
ggcttctcagcttcgtcggtgccaa

SEQ ID NO: 78026 - DNA, 25 bp, Homo sapien
ggcttctcagctttgtcggtgccaa

SEQ ID NO: 78027 - DNA, 25 bp, Homo sapien
ggcttctccaggctcaaaaaaacac

SEQ ID NO: 78028 - DNA, 25 bp, Homo sapien
ggcttctccgggctcaaaaaaacac

SEQ ID NO: 78029 - DNA, 25 bp, Homo sapien
ggcttctctatgtgctcaaatgaat

SEQ ID NO: 78030 - DNA, 25 bp, Homo sapien
ggcttctctatgttctcaaatgaat

SEQ ID NO: 78031 - DNA, 25 bp, Homo sapien
ggcttctgaaaggaaggaaagcttt

SEQ ID NO: 78032 - DNA, 25 bp, Homo sapien
ggcttctgaaaggtaggaaagcttt

SEQ ID NO: 78033 - DNA, 25 bp, Homo sapien
ggcttctgagtaccttagcctttct

SEQ ID NO: 78034 - DNA, 25 bp, Homo sapien
ggcttctgagtgccttagcctttct

SEQ ID NO: 78035 - DNA, 25 bp, Homo sapien
ggcttctgatatagcataataccaa

SEQ ID NO: 78036 - DNA, 25 bp, Homo sapien
ggcttctgatatggcataataccaa

SEQ ID NO: 78037 - DNA, 25 bp, Homo sapien
ggcttctgccttactccttctcttt

SEQ ID NO: 78038 - DNA, 25 bp, Homo sapien
ggcttctgccttactctttctcttt

SEQ ID NO: 78039 - DNA, 25 bp, Homo sapien
ggcttcttcctcaaatatgttatga

SEQ ID NO: 78040 - DNA, 25 bp, Homo sapien
ggcttcttcttcaaatatgttatga

SEQ ID NO: 78041 - DNA, 25 bp, Homo sapien
ggcttctttactgggcttcgcagca

SEQ ID NO: 78042 - DNA, 25 bp, Homo sapien
ggcttctttactgtgcttcgcagca

SEQ ID NO: 78043 - DNA, 25 bp, Homo sapien
ggcttctttttcgtagtataataat

SEQ ID NO: 78044 - DNA, 25 bp, Homo sapien
ggcttctttttcttagtataataat

SEQ ID NO: 78045 - DNA, 25 bp, Homo sapien
ggcttgaagtgagtttcagtgatat

SEQ ID NO: 78046 - DNA, 25 bp, Homo sapien
ggcttgaagtgattttcagtgatat

SEQ ID NO: 78047 - DNA, 25 bp, Homo sapien
ggcttgactttaactgggctttttc

SEQ ID NO: 78048 - DNA, 25 bp, Homo sapien
ggcttgactttaattgggctttttc

SEQ ID NO: 78049 - DNA, 25 bp, Homo sapien
ggcttgagtcaaataaccctgattc

SEQ ID NO: 78050 - DNA, 25 bp, Homo sapien
ggcttgagtcaaatcaccctgattc

SEQ ID NO: 78051 - DNA, 25 bp, Homo sapien
ggcttgcactaaaggaatttactct

SEQ ID NO: 78052 - DNA, 25 bp, Homo sapien
ggcttgcactaaaggagtttactct

SEQ ID NO: 78053 - DNA, 25 bp, Homo sapien
ggcttgctcgctcgctctctctcaa

SEQ ID NO: 78054 - DNA, 25 bp, Homo sapien
ggcttgctcgctggctctctctcaa

SEQ ID NO: 78055 - DNA, 25 bp, Homo sapien
ggcttgctgcaggcatgaagagaca

SEQ ID NO: 78056 - DNA, 25 bp, Homo sapien
ggcttgctgcaggcgtgaagagaca

SEQ ID NO: 78057 - DNA, 25 bp, Homo sapien
ggcttggctagatcacagctctgtg

SEQ ID NO: 78058 - DNA, 25 bp, Homo sapien
ggcttggctaggtcacagctctgtg

SEQ ID NO: 78059 - DNA, 25 bp, Homo sapien
ggcttgtgaaatcctagtggccact

SEQ ID NO: 78060 - DNA, 25 bp, Homo sapien
ggcttgtgatatcctagtggccact

SEQ ID NO: 78061 - DNA, 25 bp, Homo sapien
ggcttgtgtctgagctatgagaaat

SEQ ID NO: 78062 - DNA, 25 bp, Homo sapien
ggcttgtgtctgagctgtgagaaat

SEQ ID NO: 78063 - DNA, 25 bp, Homo sapien
ggcttgttagcataagccactgagt

SEQ ID NO: 78064 - DNA, 25 bp, Homo sapien
ggcttgttagcgtaagccactgagt

SEQ ID NO: 78065 - DNA, 25 bp, Homo sapien
ggcttgttatgcccacttttctgcc

SEQ ID NO: 78066 - DNA, 25 bp, Homo sapien
ggcttgttgtgcccacttttctgcc

SEQ ID NO: 78067 - DNA, 25 bp, Homo sapien
ggctttaaaaagattcaaccaaagc

SEQ ID NO: 78068 - DNA, 25 bp, Homo sapien
ggctttaaacagattcaaccaaagc

SEQ ID NO: 78069 - DNA, 25 bp, Homo sapien
ggctttaatggaaaactctttcagt

SEQ ID NO: 78070 - DNA, 25 bp, Homo sapien
ggctttaatggaaatctctttcagt

SEQ ID NO: 78071 - DNA, 25 bp, Homo sapien
ggctttagagaaaaagcgattggtt

SEQ ID NO: 78072 - DNA, 25 bp, Homo sapien
ggctttagagaaaaggcgattggtt

SEQ ID NO: 78073 - DNA, 25 bp, Homo sapien
ggctttagtgcttcaatctaaagag

SEQ ID NO: 78074 - DNA, 25 bp, Homo sapien
ggctttagtgctttaatctaaagag

SEQ ID NO: 78075 - DNA, 25 bp, Homo sapien
ggctttatccaggagatgtaaggtt

SEQ ID NO: 78076 - DNA, 25 bp, Homo sapien
ggctttatccatgagatgtaaggtt

SEQ ID NO: 78077 - DNA, 25 bp, Homo sapien
ggctttccaggtctgccttctttct

SEQ ID NO: 78078 - DNA, 25 bp, Homo sapien
ggctttccatgtctgccttctttct

SEQ ID NO: 78079 - DNA, 25 bp, Homo sapien
ggctttccttccagctgatgaaatt

SEQ ID NO: 78080 - DNA, 25 bp, Homo sapien
ggctttccttccaggtgatgaaatt

SEQ ID NO: 78081 - DNA, 25 bp, Homo sapien
ggctttctacaagaacttcatttta

SEQ ID NO: 78082 - DNA, 25 bp, Homo sapien
ggctttctacaagagcttcatttta

SEQ ID NO: 78083 - DNA, 25 bp, Homo sapien
ggctttctcatcacggcttctatgg

SEQ ID NO: 78084 - DNA, 25 bp, Homo sapien
ggctttctcatcatggcttctatgg

SEQ ID NO: 78085 - DNA, 25 bp, Homo sapien
ggctttctgataacagtgataagaa

SEQ ID NO: 78086 - DNA, 25 bp, Homo sapien
ggctttctgatagcagtgataagaa

SEQ ID NO: 78087 - DNA, 25 bp, Homo sapien
ggctttcttctggtcgaattgggaa

SEQ ID NO: 78088 - DNA, 25 bp, Homo sapien
ggctttcttctggttgaattgggaa

SEQ ID NO: 78089 - DNA, 25 bp, Homo sapien
ggctttgatgatgccaattgctata

SEQ ID NO: 78090 - DNA, 25 bp, Homo sapien
ggctttgatgatgctaattgctata

SEQ ID NO: 78091 - DNA, 25 bp, Homo sapien
ggctttgctgtttcatttatagagc

SEQ ID NO: 78092 - DNA, 25 bp, Homo sapien
ggctttgctgtttcctttatagagc

SEQ ID NO: 78093 - DNA, 25 bp, Homo sapien
ggctttggagtacaaacgatcccat

SEQ ID NO: 78094 - DNA, 25 bp, Homo sapien
ggctttggagtagaaacgatcccat

SEQ ID NO: 78095 - DNA, 25 bp, Homo sapien
ggctttggtctagcgtcctatagag

SEQ ID NO: 78096 - DNA, 25 bp, Homo sapien
ggctttggtctagtgtcctatagag

SEQ ID NO: 78097 - DNA, 25 bp, Homo sapien
ggctttgtatacttccacggtgtta

SEQ ID NO: 78098 - DNA, 25 bp, Homo sapien
ggctttgtgtacttccacggtgtta

SEQ ID NO: 78099 - DNA, 25 bp, Homo sapien
ggcttttcctgaacaatagtgaggt

SEQ ID NO: 78100 - DNA, 25 bp, Homo sapien
ggcttttcttgaacaatagtgaggt

SEQ ID NO: 78101 - DNA, 25 bp, Homo sapien
ggcttttgacacttattgccaaatt

SEQ ID NO: 78102 - DNA, 25 bp, Homo sapien
ggcttttgatacttattgccaaatt

SEQ ID NO: 78103 - DNA, 25 bp, Homo sapien
ggctttttaagatccagattttttc

SEQ ID NO: 78104 - DNA, 25 bp, Homo sapien
ggctttttaagatccatattttttc

SEQ ID NO: 78105 - DNA, 25 bp, Homo sapien
ggcttttttccaagttagtttctga

SEQ ID NO: 78106 - DNA, 25 bp, Homo sapien
ggcttttttccacgttagtttctga

SEQ ID NO: 78107 - DNA, 25 bp, Homo sapien
gggaaaaactgtgtgctcaggagat

SEQ ID NO: 78108 - DNA, 25 bp, Homo sapien
gggaaaaagccagcgatggtgcaac

SEQ ID NO: 78109 - DNA, 25 bp, Homo sapien
gggaaaaagccagggatggtgcaac

SEQ ID NO: 78110 - DNA, 25 bp, Homo sapien
gggaaaaataacagaaccaataact

SEQ ID NO: 78111 - DNA, 25 bp, Homo sapien
gggaaaaataacggaaccaataact

SEQ ID NO: 78112 - DNA, 25 bp, Homo sapien
gggaaaaattgtgtgctcaggagat

SEQ ID NO: 78113 - DNA, 25 bp, Homo sapien
gggaaaacagttgcataaagcagaa

SEQ ID NO: 78114 - DNA, 25 bp, Homo sapien
gggaaaacagttgcgtaaagcagaa

SEQ ID NO: 78115 - DNA, 25 bp, Homo sapien
gggaaaactcccaattgcataagac

SEQ ID NO: 78116 - DNA, 25 bp, Homo sapien
gggaaaactcctaattgcataagac

SEQ ID NO: 78117 - DNA, 25 bp, Homo sapien
gggaaaaggagactacatgaggttt

SEQ ID NO: 78118 - DNA, 25 bp, Homo sapien
gggaaaaggagattacatgaggttt

SEQ ID NO: 78119 - DNA, 25 bp, Homo sapien
gggaaaataagcacgtcctgtgtga

SEQ ID NO: 78120 - DNA, 25 bp, Homo sapien
gggaaaataagcgcgtcctgtgtga

SEQ ID NO: 78121 - DNA, 25 bp, Homo sapien
gggaaaatactataacacaatgata

SEQ ID NO: 78122 - DNA, 25 bp, Homo sapien
gggaaaatactgtaacacaatgata

SEQ ID NO: 78123 - DNA, 25 bp, Homo sapien
gggaaaatatgaagcagccacctta

SEQ ID NO: 78124 - DNA, 25 bp, Homo sapien
gggaaaatatgaggcagccacctta

SEQ ID NO: 78125 - DNA, 25 bp, Homo sapien
gggaaaatatttcaagaccatggtt

SEQ ID NO: 78126 - DNA, 25 bp, Homo sapien
gggaaaatatttccagaccatggtt

SEQ ID NO: 78127 - DNA, 25 bp, Homo sapien
gggaaaatcagccatgaaaaattct

SEQ ID NO: 78128 - DNA, 25 bp, Homo sapien
gggaaaattagccatgaaaaattct

SEQ ID NO: 78129 - DNA, 25 bp, Homo sapien
gggaaaattggcacttatgaaagtg

SEQ ID NO: 78130 - DNA, 25 bp, Homo sapien
gggaaaattggcacttgtgaaagtg

SEQ ID NO: 78131 - DNA, 25 bp, Homo sapien
gggaaacagacaactgttgcattcc

SEQ ID NO: 78132 - DNA, 25 bp, Homo sapien
gggaaacagacaagtgttgcattcc

SEQ ID NO: 78133 - DNA, 25 bp, Homo sapien
gggaaacataagacaatgcctctta

SEQ ID NO: 78134 - DNA, 25 bp, Homo sapien
gggaaacataagataatgcctctta

SEQ ID NO: 78135 - DNA, 25 bp, Homo sapien
gggaaacctcactgcaggaagaaac

SEQ ID NO: 78136 - DNA, 25 bp, Homo sapien
gggaaacctcactgtaggaagaaac

SEQ ID NO: 78137 - DNA, 25 bp, Homo sapien
gggaaactggggtactactatacaa

SEQ ID NO: 78138 - DNA, 25 bp, Homo sapien
gggaaactggggtactgctatacaa

SEQ ID NO: 78139 - DNA, 25 bp, Homo sapien
gggaaagacatattcagcatctgga

SEQ ID NO: 78140 - DNA, 25 bp, Homo sapien
gggaaagagagacacattgagctag

SEQ ID NO: 78141 - DNA, 25 bp, Homo sapien
gggaaagagagacatattgagctag

SEQ ID NO: 78142 - DNA, 25 bp, Homo sapien
gggaaagatatattcagcatctgga

SEQ ID NO: 78143 - DNA, 25 bp, Homo sapien
gggaaaggaagacaaatggatgtaa

SEQ ID NO: 78144 - DNA, 25 bp, Homo sapien
gggaaaggaagagaaatggatgtaa

SEQ ID NO: 78145 - DNA, 25 bp, Homo sapien
gggaaaggtggattgtctgtcactg

SEQ ID NO: 78146 - DNA, 25 bp, Homo sapien
gggaaaggtggattttctgtcactg

SEQ ID NO: 78147 - DNA, 25 bp, Homo sapien
gggaaataaatacccagcataaggc

SEQ ID NO: 78148 - DNA, 25 bp, Homo sapien
gggaaataaataccgagcataaggc

SEQ ID NO: 78149 - DNA, 25 bp, Homo sapien
gggaaataacagatactcatcattg

SEQ ID NO: 78150 - DNA, 25 bp, Homo sapien
gggaaataatagatactcatcattg

SEQ ID NO: 78151 - DNA, 25 bp, Homo sapien
gggaaatattaacaggtcttgcata

SEQ ID NO: 78152 - DNA, 25 bp, Homo sapien
gggaaatattaataggtcttgcata

SEQ ID NO: 78153 - DNA, 25 bp, Homo sapien
gggaaatgaacctgcaggaaaaaca

SEQ ID NO: 78154 - DNA, 25 bp, Homo sapien
gggaaatgaacgtgcaggaaaaaca

SEQ ID NO: 78155 - DNA, 25 bp, Homo sapien
gggaaatgaccatagaaattagcct

SEQ ID NO: 78156 - DNA, 25 bp, Homo sapien
gggaaatgaccgtagaaattagcct

SEQ ID NO: 78157 - DNA, 25 bp, Homo sapien
gggaaatgcaacctattttctgggt

SEQ ID NO: 78158 - DNA, 25 bp, Homo sapien
gggaaatgcaacctcttttctgggt

SEQ ID NO: 78159 - DNA, 25 bp, Homo sapien
gggaaatgcacatcacaaagacata

SEQ ID NO: 78160 - DNA, 25 bp, Homo sapien
gggaaatgcacattacaaagacata

SEQ ID NO: 78161 - DNA, 25 bp, Homo sapien
gggaaatggagaagtgttaatctta

SEQ ID NO: 78162 - DNA, 25 bp, Homo sapien
gggaaatggagtagtgttaatctta

SEQ ID NO: 78163 - DNA, 25 bp, Homo sapien
gggaaatgtcagtaccagtttatga

SEQ ID NO: 78164 - DNA, 25 bp, Homo sapien
gggaaatgtcagtacctgtttatga

SEQ ID NO: 78165 - DNA, 25 bp, Homo sapien
gggaaattaatactagtctaaatag

SEQ ID NO: 78166 - DNA, 25 bp, Homo sapien
gggaaattaatacttgtctaaatag

SEQ ID NO: 78167 - DNA, 25 bp, Homo sapien
gggaaattcaacaggtgaaattagc

SEQ ID NO: 78168 - DNA, 25 bp, Homo sapien
gggaaattcaagaggtgaaattagc

SEQ ID NO: 78169 - DNA, 25 bp, Homo sapien
gggaaattgtagcgccttctaaaaa

SEQ ID NO: 78170 - DNA, 25 bp, Homo sapien
gggaaattgtagtgccttctaaaaa

SEQ ID NO: 78171 - DNA, 25 bp, Homo sapien
gggaacaagcgagacagagcctgtc

SEQ ID NO: 78172 - DNA, 25 bp, Homo sapien
gggaacaagctgactcttggtaagc

SEQ ID NO: 78173 - DNA, 25 bp, Homo sapien
gggaacaagctggctcttggtaagc

SEQ ID NO: 78174 - DNA, 25 bp, Homo sapien
gggaacaagtgagacagagcctgtc

SEQ ID NO: 78175 - DNA, 25 bp, Homo sapien
gggaacacatgatgagctctgagga

SEQ ID NO: 78176 - DNA, 25 bp, Homo sapien
gggaacacgtgatgagctctgagga

SEQ ID NO: 78177 - DNA, 25 bp, Homo sapien
gggaaccacattaaggtatatactc

SEQ ID NO: 78178 - DNA, 25 bp, Homo sapien
gggaaccacgttaaggtatatactc

SEQ ID NO: 78179 - DNA, 25 bp, Homo sapien
gggaaccactgatgctgcagtccag

SEQ ID NO: 78180 - DNA, 25 bp, Homo sapien
gggaaccattgatgctgcagtccag

SEQ ID NO: 78181 - DNA, 25 bp, Homo sapien
gggaactaaatggtaaaataagaac

SEQ ID NO: 78182 - DNA, 25 bp, Homo sapien
gggaactaaattgtaaaataagaac

SEQ ID NO: 78183 - DNA, 25 bp, Homo sapien
gggaactatgtaaattgattgtgaa

SEQ ID NO: 78184 - DNA, 25 bp, Homo sapien
gggaactatttaaattgattgtgaa

SEQ ID NO: 78185 - DNA, 25 bp, Homo sapien
gggaactccaactcagtagccaaac

SEQ ID NO: 78186 - DNA, 25 bp, Homo sapien
gggaactccaactcggtagccaaac

SEQ ID NO: 78187 - DNA, 25 bp, Homo sapien
gggaactgacgagtcttgggtgcaa

SEQ ID NO: 78188 - DNA, 25 bp, Homo sapien
gggaactgatgagtcttgggtgcaa

SEQ ID NO: 78189 - DNA, 25 bp, Homo sapien
gggaactgtctgcaaatagacataa

SEQ ID NO: 78190 - DNA, 25 bp, Homo sapien
gggaactgtctgcacatagacataa

SEQ ID NO: 78191 - DNA, 25 bp, Homo sapien
gggaactgttatggacttcattcta

SEQ ID NO: 78192 - DNA, 25 bp, Homo sapien
gggaactgttatggccttcattcta

SEQ ID NO: 78193 - DNA, 25 bp, Homo sapien
gggaagaaatagcattattggaacc

SEQ ID NO: 78194 - DNA, 25 bp, Homo sapien
gggaagaaatcaacaaaggatgcac

SEQ ID NO: 78195 - DNA, 25 bp, Homo sapien
gggaagaaatcagcaaaggatgcac

SEQ ID NO: 78196 - DNA, 25 bp, Homo sapien
gggaagaagtagcattattggaacc

SEQ ID NO: 78197 - DNA, 25 bp, Homo sapien
gggaagaatttagactcataggggt

SEQ ID NO: 78198 - DNA, 25 bp, Homo sapien
gggaagaatttatactcataggggt

SEQ ID NO: 78199 - DNA, 25 bp, Homo sapien
gggaagacaagtaggactgaaatca

SEQ ID NO: 78200 - DNA, 25 bp, Homo sapien
gggaagacaagtcggactgaaatca

SEQ ID NO: 78201 - DNA, 25 bp, Homo sapien
gggaagacccatcgcatcatcattc

SEQ ID NO: 78202 - DNA, 25 bp, Homo sapien
gggaagacccatggcatcatcattc

SEQ ID NO: 78203 - DNA, 25 bp, Homo sapien
gggaagactcatgtgagttcagagt

SEQ ID NO: 78204 - DNA, 25 bp, Homo sapien
gggaagactcatttgagttcagagt

SEQ ID NO: 78205 - DNA, 25 bp, Homo sapien
gggaagatcatttgagctcagcagt

SEQ ID NO: 78206 - DNA, 25 bp, Homo sapien
gggaagatcgtttgagctcagcagt

SEQ ID NO: 78207 - DNA, 25 bp, Homo sapien
gggaagatgacaataagtaacaatg

SEQ ID NO: 78208 - DNA, 25 bp, Homo sapien
gggaagatgacagtaagtaacaatg

SEQ ID NO: 78209 - DNA, 25 bp, Homo sapien
gggaagcaaataccttcaaggttga

SEQ ID NO: 78210 - DNA, 25 bp, Homo sapien
gggaagcaaatcccttcaaggttga

SEQ ID NO: 78211 - DNA, 25 bp, Homo sapien
gggaagcaagtggacggtctccaac

SEQ ID NO: 78212 - DNA, 25 bp, Homo sapien
gggaagcaagtggatggtctccaac

SEQ ID NO: 78213 - DNA, 25 bp, Homo sapien
gggaagcacgtgagccaatgtttcc

SEQ ID NO: 78214 - DNA, 25 bp, Homo sapien
gggaagcatgtgagccaatgtttcc

SEQ ID NO: 78215 - DNA, 25 bp, Homo sapien
gggaagccaggcataagcagctatg

SEQ ID NO: 78216 - DNA, 25 bp, Homo sapien
gggaagccaggcgtaagcagctatg

SEQ ID NO: 78217 - DNA, 25 bp, Homo sapien
gggaagccattgctgcattttaaat

SEQ ID NO: 78218 - DNA, 25 bp, Homo sapien
gggaagccattggtgcattttaaat

SEQ ID NO: 78219 - DNA, 25 bp, Homo sapien
gggaagctcgtcccattttagttga

SEQ ID NO: 78220 - DNA, 25 bp, Homo sapien
gggaagcttgtcccattttagttga

SEQ ID NO: 78221 - DNA, 25 bp, Homo sapien
gggaaggcagactcatgattattcc

SEQ ID NO: 78222 - DNA, 25 bp, Homo sapien
gggaaggcagactcgtgattattcc

SEQ ID NO: 78223 - DNA, 25 bp, Homo sapien
gggaaggccatgaataacctcttgc

SEQ ID NO: 78224 - DNA, 25 bp, Homo sapien
gggaaggccatgaatagcctcttgc

SEQ ID NO: 78225 - DNA, 25 bp, Homo sapien
gggaaggctagcattgcgtctgaca

SEQ ID NO: 78226 - DNA, 25 bp, Homo sapien
gggaaggctagcattgtgtctgaca

SEQ ID NO: 78227 - DNA, 25 bp, Homo sapien
gggaagggaatgaaccagtgttttc

SEQ ID NO: 78228 - DNA, 25 bp, Homo sapien
gggaagggaatgaaccggtgttttc

SEQ ID NO: 78229 - DNA, 25 bp, Homo sapien
gggaagtagcagcaaacctaatgct

SEQ ID NO: 78230 - DNA, 25 bp, Homo sapien
gggaagtagcagcagacctaatgct

SEQ ID NO: 78231 - DNA, 25 bp, Homo sapien
gggaagtagttgttctcagatgtgg

SEQ ID NO: 78232 - DNA, 25 bp, Homo sapien
gggaagtagttgttttcagatgtgg

SEQ ID NO: 78233 - DNA, 25 bp, Homo sapien
gggaagtcaggccagcagtctgaaa

SEQ ID NO: 78234 - DNA, 25 bp, Homo sapien
gggaagtcaggccggcagtctgaaa

SEQ ID NO: 78235 - DNA, 25 bp, Homo sapien
gggaagtgccttaaagttggactag

SEQ ID NO: 78236 - DNA, 25 bp, Homo sapien
gggaagtgccttgaagttggactag

SEQ ID NO: 78237 - DNA, 25 bp, Homo sapien
gggaagtgggcattatggtctttat

SEQ ID NO: 78238 - DNA, 25 bp, Homo sapien
gggaagtgggcgttatggtctttat

SEQ ID NO: 78239 - DNA, 25 bp, Homo sapien
gggaagtgtctgaacacagcctaca

SEQ ID NO: 78240 - DNA, 25 bp, Homo sapien
gggaagtgtctgaacatagcctaca

SEQ ID NO: 78241 - DNA, 25 bp, Homo sapien
gggaagtgtgtaaaataccaggctg

SEQ ID NO: 78242 - DNA, 25 bp, Homo sapien
gggaagtgtgtaaaatgccaggctg

SEQ ID NO: 78243 - DNA, 25 bp, Homo sapien
gggaataacggcctggctttgtgtc

SEQ ID NO: 78244 - DNA, 25 bp, Homo sapien
gggaataagctcgatgtgaaggctt

SEQ ID NO: 78245 - DNA, 25 bp, Homo sapien
gggaataagctggatgtgaaggctt

SEQ ID NO: 78246 - DNA, 25 bp, Homo sapien
gggaataagggcctggctttgtgtc

SEQ ID NO: 78247 - DNA, 25 bp, Homo sapien
gggaatatcttgagaaaacagggct

SEQ ID NO: 78248 - DNA, 25 bp, Homo sapien
gggaatatcttgagaagacagggct

SEQ ID NO: 78249 - DNA, 25 bp, Homo sapien
gggaatatgaaaaagccacttgggt

SEQ ID NO: 78250 - DNA, 25 bp, Homo sapien
gggaatatgaaaaggccacttgggt

SEQ ID NO: 78251 - DNA, 25 bp, Homo sapien
gggaatccatctctatcgcatggca

SEQ ID NO: 78252 - DNA, 25 bp, Homo sapien
gggaatccatctctattgcatggca

SEQ ID NO: 78253 - DNA, 25 bp, Homo sapien
gggaatctagtcaggactctcagag

SEQ ID NO: 78254 - DNA, 25 bp, Homo sapien
gggaatctattcaggactctcagag

SEQ ID NO: 78255 - DNA, 25 bp, Homo sapien
gggaatctttccaacaaaaaggtga

SEQ ID NO: 78256 - DNA, 25 bp, Homo sapien
gggaatctttctaacaaaaaggtga

SEQ ID NO: 78257 - DNA, 25 bp, Homo sapien
gggaatgaaccagtgttttccattt

SEQ ID NO: 78258 - DNA, 25 bp, Homo sapien
gggaatgaaccggtgttttccattt

SEQ ID NO: 78259 - DNA, 25 bp, Homo sapien
gggaatgatgtgaccataagccaag

SEQ ID NO: 78260 - DNA, 25 bp, Homo sapien
gggaatgatgtggccataagccaag

SEQ ID NO: 78261 - DNA, 25 bp, Homo sapien
gggaatgcaaactgatatagccact

SEQ ID NO: 78262 - DNA, 25 bp, Homo sapien
gggaatgcaaactggtatagccact

SEQ ID NO: 78263 - DNA, 25 bp, Homo sapien
gggaatgccataaacagaagtattt

SEQ ID NO: 78264 - DNA, 25 bp, Homo sapien
gggaatgccgtaaacagaagtattt

SEQ ID NO: 78265 - DNA, 25 bp, Homo sapien
gggaatgtctcacggcgaatcaaat

SEQ ID NO: 78266 - DNA, 25 bp, Homo sapien
gggaatgtctcacggctaatcaaat

SEQ ID NO: 78267 - DNA, 25 bp, Homo sapien
gggaatgttaaacacctcttgatca

SEQ ID NO: 78268 - DNA, 25 bp, Homo sapien
gggaatgttaaagacctcttgatca

SEQ ID NO: 78269 - DNA, 25 bp, Homo sapien
gggaattgggtaaacagttcttagg

SEQ ID NO: 78270 - DNA, 25 bp, Homo sapien
gggaattgggtatacagttcttagg

SEQ ID NO: 78271 - DNA, 25 bp, Homo sapien
gggaattgtgtggaatggaatagag

SEQ ID NO: 78272 - DNA, 25 bp, Homo sapien
gggaattgtgtgtaatggaatagag

SEQ ID NO: 78273 - DNA, 25 bp, Homo sapien
gggaatttgtggattggtcttagtt

SEQ ID NO: 78274 - DNA, 25 bp, Homo sapien
gggaatttgtgggttggtcttagtt

SEQ ID NO: 78275 - DNA, 25 bp, Homo sapien
gggacaagaatatgccttcccagac

SEQ ID NO: 78276 - DNA, 25 bp, Homo sapien
gggacaagaatattccttcccagac

SEQ ID NO: 78277 - DNA, 25 bp, Homo sapien
gggacaatgagggacaggtctgtgc

SEQ ID NO: 78278 - DNA, 25 bp, Homo sapien
gggacaatgcgggacaggtctgtgc

SEQ ID NO: 78279 - DNA, 25 bp, Homo sapien
gggacacaagattatagatgtaagg

SEQ ID NO: 78280 - DNA, 25 bp, Homo sapien
gggacacaatattatagatgtaagg

SEQ ID NO: 78281 - DNA, 25 bp, Homo sapien
gggacacgtactggctttggctttc

SEQ ID NO: 78282 - DNA, 25 bp, Homo sapien
gggacacgtactgtctttggctttc

SEQ ID NO: 78283 - DNA, 25 bp, Homo sapien
gggacactaagaaattcactattca

SEQ ID NO: 78284 - DNA, 25 bp, Homo sapien
gggacactaagaaatttactattca

SEQ ID NO: 78285 - DNA, 25 bp, Homo sapien
gggacactgacagccagacttatac

SEQ ID NO: 78286 - DNA, 25 bp, Homo sapien
gggacactgacggccagacttatac

SEQ ID NO: 78287 - DNA, 25 bp, Homo sapien
gggacaggcttaaataaatgcaaga

SEQ ID NO: 78288 - DNA, 25 bp, Homo sapien
gggacaggcttaaatacatgcaaga

SEQ ID NO: 78289 - DNA, 25 bp, Homo sapien
gggacaggtgtaacaagcattgcca

SEQ ID NO: 78290 - DNA, 25 bp, Homo sapien
gggacaggtgtaaccagcattgcca

SEQ ID NO: 78291 - DNA, 25 bp, Homo sapien
gggacagtcttgaatcaccaatgcc

SEQ ID NO: 78292 - DNA, 25 bp, Homo sapien
gggacagtcttgaatcgccaatgcc

SEQ ID NO: 78293 - DNA, 25 bp, Homo sapien
gggacagttaagaaaatggaagatg

SEQ ID NO: 78294 - DNA, 25 bp, Homo sapien
gggacagttgagaaaatggaagatg

SEQ ID NO: 78295 - DNA, 25 bp, Homo sapien
gggacatagcaagggactcctactg

SEQ ID NO: 78296 - DNA, 25 bp, Homo sapien
gggacatagcaagggattcctactg

SEQ ID NO: 78297 - DNA, 25 bp, Homo sapien
gggacatagtatatatttctgttac

SEQ ID NO: 78298 - DNA, 25 bp, Homo sapien
gggacatagtatgtatttctgttac

SEQ ID NO: 78299 - DNA, 25 bp, Homo sapien
gggacatattggattaactaacata

SEQ ID NO: 78300 - DNA, 25 bp, Homo sapien
gggacatattggcttaactaacata

SEQ ID NO: 78301 - DNA, 25 bp, Homo sapien
gggacatcgaaatctcgacatcccg

SEQ ID NO: 78302 - DNA, 25 bp, Homo sapien
gggacatcggaatctcgacatcccg

SEQ ID NO: 78303 - DNA, 25 bp, Homo sapien
gggacatctgctcactttgggactc

SEQ ID NO: 78304 - DNA, 25 bp, Homo sapien
gggacatctgctcgctttgggactc

SEQ ID NO: 78305 - DNA, 25 bp, Homo sapien
gggacatgatgacgacttagctctc

SEQ ID NO: 78306 - DNA, 25 bp, Homo sapien
gggacatgatgaggacttagctctc

SEQ ID NO: 78307 - DNA, 25 bp, Homo sapien
gggacattctacgactctctaagtg

SEQ ID NO: 78308 - DNA, 25 bp, Homo sapien
gggacattctatgactctctaagtg

SEQ ID NO: 78309 - DNA, 25 bp, Homo sapien
gggacattgaaggagtatgattacc

SEQ ID NO: 78310 - DNA, 25 bp, Homo sapien
gggacattgaaggagtgtgattacc

SEQ ID NO: 78311 - DNA, 25 bp, Homo sapien
gggaccaagtagatctagctttgta

SEQ ID NO: 78312 - DNA, 25 bp, Homo sapien
gggaccaagtaggtctagctttgta

SEQ ID NO: 78313 - DNA, 25 bp, Homo sapien
gggaccaccgggaagctcactgtgg

SEQ ID NO: 78314 - DNA, 25 bp, Homo sapien
gggaccactgggaagctcactgtgg

SEQ ID NO: 78315 - DNA, 25 bp, Homo sapien
gggaccaggagttgtgcagcccatc

SEQ ID NO: 78316 - DNA, 25 bp, Homo sapien
gggaccaggcgttgtgcagcccatc

SEQ ID NO: 78317 - DNA, 25 bp, Homo sapien
gggaccattctttacaggaacagta

SEQ ID NO: 78318 - DNA, 25 bp, Homo sapien
gggaccattctttgcaggaacagta

SEQ ID NO: 78319 - DNA, 25 bp, Homo sapien
gggacccgcatctgtgcaactccat

SEQ ID NO: 78320 - DNA, 25 bp, Homo sapien
gggacccgcatgtgtgcaactccat

SEQ ID NO: 78321 - DNA, 25 bp, Homo sapien
gggacctgttgcgccactgcagttc

SEQ ID NO: 78322 - DNA, 25 bp, Homo sapien
gggacctgttgtgccactgcagttc

SEQ ID NO: 78323 - DNA, 25 bp, Homo sapien
gggacgaacagctctgcttggcttg

SEQ ID NO: 78324 - DNA, 25 bp, Homo sapien
gggacgaacagttctgcttggcttg

SEQ ID NO: 78325 - DNA, 25 bp, Homo sapien
gggacgattctgacttgcgtcctgg

SEQ ID NO: 78326 - DNA, 25 bp, Homo sapien
gggacgattctgatttgcgtcctgg

SEQ ID NO: 78327 - DNA, 25 bp, Homo sapien
gggactcagcaattagtgaaacata

SEQ ID NO: 78328 - DNA, 25 bp, Homo sapien
gggactcagtaattagtgaaacata

SEQ ID NO: 78329 - DNA, 25 bp, Homo sapien
gggactcgagcccagaagatcaggc

SEQ ID NO: 78330 - DNA, 25 bp, Homo sapien
gggactcgagcctagaagatcaggc

SEQ ID NO: 78331 - DNA, 25 bp, Homo sapien
gggactcgagtgcataacatttttt

SEQ ID NO: 78332 - DNA, 25 bp, Homo sapien
gggactcgagtgcatagcatttttt

SEQ ID NO: 78333 - DNA, 25 bp, Homo sapien
gggactgatctcatttatctccaca

SEQ ID NO: 78334 - DNA, 25 bp, Homo sapien
gggactgatctcatttgtctccaca

SEQ ID NO: 78335 - DNA, 25 bp, Homo sapien
gggactggccaccgaactgggaagg

SEQ ID NO: 78336 - DNA, 25 bp, Homo sapien
gggactggccactgaactgggaagg

SEQ ID NO: 78337 - DNA, 25 bp, Homo sapien
gggagaagacgcaatagctctgttt

SEQ ID NO: 78338 - DNA, 25 bp, Homo sapien
gggagaagatgcaatagctctgttt

SEQ ID NO: 78339 - DNA, 25 bp, Homo sapien
gggagaagtcaatgtgaaaaaggag

SEQ ID NO: 78340 - DNA, 25 bp, Homo sapien
gggagaagtcactgtgaaaaaggag

SEQ ID NO: 78341 - DNA, 25 bp, Homo sapien
gggagaatattgtcacacactcatt

SEQ ID NO: 78342 - DNA, 25 bp, Homo sapien
gggagaatattttcacacactcatt

SEQ ID NO: 78343 - DNA, 25 bp, Homo sapien
gggagactaggtgctggatgtgctg

SEQ ID NO: 78344 - DNA, 25 bp, Homo sapien
gggagactaggtgttggatgtgctg

SEQ ID NO: 78345 - DNA, 25 bp, Homo sapien
gggagactggagacgaggtacagtt

SEQ ID NO: 78346 - DNA, 25 bp, Homo sapien
gggagactggagatgaggtacagtt

SEQ ID NO: 78347 - DNA, 25 bp, Homo sapien
gggagagaaagtctgcatacatata

SEQ ID NO: 78348 - DNA, 25 bp, Homo sapien
gggagagaaagtctgcgtacatata

SEQ ID NO: 78349 - DNA, 25 bp, Homo sapien
gggagagataggcttcaatgcaaca

SEQ ID NO: 78350 - DNA, 25 bp, Homo sapien
gggagagatgggcttcaatgcaaca

SEQ ID NO: 78351 - DNA, 25 bp, Homo sapien
gggagagcatcctagccagggggtt

SEQ ID NO: 78352 - DNA, 25 bp, Homo sapien
gggagagcgtcctagccagggggtt

SEQ ID NO: 78353 - DNA, 25 bp, Homo sapien
gggagaggacaaaggtgtaaagtca

SEQ ID NO: 78354 - DNA, 25 bp, Homo sapien
gggagaggacaagggtgtaaagtca

SEQ ID NO: 78355 - DNA, 25 bp, Homo sapien
gggagaggtaaagtgatctctcatg

SEQ ID NO: 78356 - DNA, 25 bp, Homo sapien
gggagaggtgaagtgatctctcatg

SEQ ID NO: 78357 - DNA, 25 bp, Homo sapien
gggagatacttcagagggagaagca

SEQ ID NO: 78358 - DNA, 25 bp, Homo sapien
gggagatataacctgtctgcaaagc

SEQ ID NO: 78359 - DNA, 25 bp, Homo sapien
gggagatataagctgtctgcaaagc

SEQ ID NO: 78360 - DNA, 25 bp, Homo sapien
gggagatatttcagagggagaagca

SEQ ID NO: 78361 - DNA, 25 bp, Homo sapien
gggagatgaatagccacgttttcag

SEQ ID NO: 78362 - DNA, 25 bp, Homo sapien
gggagatgaatagccatgttttcag

SEQ ID NO: 78363 - DNA, 25 bp, Homo sapien
gggagatgacgagtttaattttggc

SEQ ID NO: 78364 - DNA, 25 bp, Homo sapien
gggagatgatgagtttaattttggc

SEQ ID NO: 78365 - DNA, 25 bp, Homo sapien
gggagatggacaattcatcaggcct

SEQ ID NO: 78366 - DNA, 25 bp, Homo sapien
gggagatggacgattcatcaggcct

SEQ ID NO: 78367 - DNA, 25 bp, Homo sapien
gggagatttctccacctttagctgc

SEQ ID NO: 78368 - DNA, 25 bp, Homo sapien
gggagatttctctacctttagctgc

SEQ ID NO: 78369 - DNA, 25 bp, Homo sapien
gggagcaactggccttctacagagt

SEQ ID NO: 78370 - DNA, 25 bp, Homo sapien
gggagcaagtggccttctacagagt

SEQ ID NO: 78371 - DNA, 25 bp, Homo sapien
gggagcaatcatgcatctttgcatc

SEQ ID NO: 78372 - DNA, 25 bp, Homo sapien
gggagcaatcatgcgtctttgcatc

SEQ ID NO: 78373 - DNA, 25 bp, Homo sapien
gggagccaacgggcagtatgacagg

SEQ ID NO: 78374 - DNA, 25 bp, Homo sapien
gggagccaatgggcagtatgacagg

SEQ ID NO: 78375 - DNA, 25 bp, Homo sapien
gggagcctcattcttcctaaatctg

SEQ ID NO: 78376 - DNA, 25 bp, Homo sapien
gggagcctcatttttcctaaatctg

SEQ ID NO: 78377 - DNA, 25 bp, Homo sapien
gggagcgggaataggccagaaagag

SEQ ID NO: 78378 - DNA, 25 bp, Homo sapien
gggagcgggaataggcgagaaagag

SEQ ID NO: 78379 - DNA, 25 bp, Homo sapien
gggagcgtatcctgggttattcatg

SEQ ID NO: 78380 - DNA, 25 bp, Homo sapien
gggagcgtatcgtgggttattcatg

SEQ ID NO: 78381 - DNA, 25 bp, Homo sapien
gggagcgtgctctcgaattgaatgc

SEQ ID NO: 78382 - DNA, 25 bp, Homo sapien
gggagcgtgctctggaattgaatgc

SEQ ID NO: 78383 - DNA, 25 bp, Homo sapien
gggagctcattaactcacaaggtag

SEQ ID NO: 78384 - DNA, 25 bp, Homo sapien
gggagctcattaattcacaaggtag

SEQ ID NO: 78385 - DNA, 25 bp, Homo sapien
gggagctgcaaccaatggtcaaact

SEQ ID NO: 78386 - DNA, 25 bp, Homo sapien
gggagctgcgaccaatggtcaaact

SEQ ID NO: 78387 - DNA, 25 bp, Homo sapien
gggagctgtggacattccttgcact

SEQ ID NO: 78388 - DNA, 25 bp, Homo sapien
gggagctgtggactttccttgcact

SEQ ID NO: 78389 - DNA, 25 bp, Homo sapien
gggagcttctcccacaaagactttc

SEQ ID NO: 78390 - DNA, 25 bp, Homo sapien
gggagcttctcccgcaaagactttc

SEQ ID NO: 78391 - DNA, 25 bp, Homo sapien
gggaggaaatatcgccggccccagt

SEQ ID NO: 78392 - DNA, 25 bp, Homo sapien
gggaggaaatatcgcctgccccagt

SEQ ID NO: 78393 - DNA, 25 bp, Homo sapien
gggaggaaatgacaggtgacctcat

SEQ ID NO: 78394 - DNA, 25 bp, Homo sapien
gggaggaaatggcaggtgacctcat

SEQ ID NO: 78395 - DNA, 25 bp, Homo sapien
gggaggaacagtcacttctggtcct

SEQ ID NO: 78396 - DNA, 25 bp, Homo sapien
gggaggaacagtgacttctggtcct

SEQ ID NO: 78397 - DNA, 25 bp, Homo sapien
gggaggaagctcactttataaaaca

SEQ ID NO: 78398 - DNA, 25 bp, Homo sapien
gggaggaagctcagtttataaaaca

SEQ ID NO: 78399 - DNA, 25 bp, Homo sapien
gggaggaggcttcttattcatgccc

SEQ ID NO: 78400 - DNA, 25 bp, Homo sapien
gggaggagggttcttattcatgccc

SEQ ID NO: 78401 - DNA, 25 bp, Homo sapien
gggaggattaaaaagcactggtcta

SEQ ID NO: 78402 - DNA, 25 bp, Homo sapien
gggaggattaacaagcactggtcta

SEQ ID NO: 78403 - DNA, 25 bp, Homo sapien
gggaggcacacccattccacattgc

SEQ ID NO: 78404 - DNA, 25 bp, Homo sapien
gggaggcacactcattccacattgc

SEQ ID NO: 78405 - DNA, 25 bp, Homo sapien
gggaggcccctggtcctgaaagtgc

SEQ ID NO: 78406 - DNA, 25 bp, Homo sapien
gggaggcccctgttcctgaaagtgc

SEQ ID NO: 78407 - DNA, 25 bp, Homo sapien
gggagggagccaccagcagcatcca

SEQ ID NO: 78408 - DNA, 25 bp, Homo sapien
gggagggagccgccagcagcatcca

SEQ ID NO: 78409 - DNA, 25 bp, Homo sapien
gggagggcagccctgtgcatttttg

SEQ ID NO: 78410 - DNA, 25 bp, Homo sapien
gggagggcagccttgtgcatttttg

SEQ ID NO: 78411 - DNA, 25 bp, Homo sapien
gggaggtccatggatgctatgtgtc

SEQ ID NO: 78412 - DNA, 25 bp, Homo sapien
gggaggtccatggttgctatgtgtc

SEQ ID NO: 78413 - DNA, 25 bp, Homo sapien
gggagtaggaaataagagagatagc

SEQ ID NO: 78414 - DNA, 25 bp, Homo sapien
gggagtaggaaatgagagagatagc

SEQ ID NO: 78415 - DNA, 25 bp, Homo sapien
gggagtcattttagatgtcttgctt

SEQ ID NO: 78416 - DNA, 25 bp, Homo sapien
gggagtcattttagttgtcttgctt

SEQ ID NO: 78417 - DNA, 25 bp, Homo sapien
gggagtcccgggtgcgagaacttca

SEQ ID NO: 78418 - DNA, 25 bp, Homo sapien
gggagtccggggtgcgagaacttca

SEQ ID NO: 78419 - DNA, 25 bp, Homo sapien
gggagtctgctcttaaagctttctg

SEQ ID NO: 78420 - DNA, 25 bp, Homo sapien
gggagtctgctcttaaggctttctg

SEQ ID NO: 78421 - DNA, 25 bp, Homo sapien
gggagtgaacaaataagagaagcag

SEQ ID NO: 78422 - DNA, 25 bp, Homo sapien
gggagtgaacaagtaagagaagcag

SEQ ID NO: 78423 - DNA, 25 bp, Homo sapien
gggagtgataccacaataaacgata

SEQ ID NO: 78424 - DNA, 25 bp, Homo sapien
gggagtgataccacgataaacgata

SEQ ID NO: 78425 - DNA, 25 bp, Homo sapien
gggagtgccgcgaatcagtgtaggg

SEQ ID NO: 78426 - DNA, 25 bp, Homo sapien
gggagtgctgcgaatcagtgtaggg

SEQ ID NO: 78427 - DNA, 25 bp, Homo sapien
gggagtggcatcctgacagctttcc

SEQ ID NO: 78428 - DNA, 25 bp, Homo sapien
gggagtggcatcttgacagctttcc

SEQ ID NO: 78429 - DNA, 25 bp, Homo sapien
gggagtggcttgaattagatggtga

SEQ ID NO: 78430 - DNA, 25 bp, Homo sapien
gggagtggcttgaattggatggtga

SEQ ID NO: 78431 - DNA, 25 bp, Homo sapien
gggagttccagaagaaattacttga

SEQ ID NO: 78432 - DNA, 25 bp, Homo sapien
gggagttccagaagaagttacttga

SEQ ID NO: 78433 - DNA, 25 bp, Homo sapien
gggagttcctcttggtcctccagac

SEQ ID NO: 78434 - DNA, 25 bp, Homo sapien
gggagttcctcttggttctccagac

SEQ ID NO: 78435 - DNA, 25 bp, Homo sapien
gggagttgaggtgtccagccatcaa

SEQ ID NO: 78436 - DNA, 25 bp, Homo sapien
gggagttgaggtgttcagccatcaa

SEQ ID NO: 78437 - DNA, 25 bp, Homo sapien
gggagtttgtttaaataagttagca

SEQ ID NO: 78438 - DNA, 25 bp, Homo sapien
gggagtttgtttcaataagttagca

SEQ ID NO: 78439 - DNA, 25 bp, Homo sapien
gggataaaaggaactgacatttact

SEQ ID NO: 78440 - DNA, 25 bp, Homo sapien
gggataaaaggaactggcatttact

SEQ ID NO: 78441 - DNA, 25 bp, Homo sapien
gggataaatcagttcagatctaata

SEQ ID NO: 78442 - DNA, 25 bp, Homo sapien
gggataaatcagtttagatctaata

SEQ ID NO: 78443 - DNA, 25 bp, Homo sapien
gggataaatgcacacatgtcaaggt

SEQ ID NO: 78444 - DNA, 25 bp, Homo sapien
gggataaatgcacagatgtcaaggt

SEQ ID NO: 78445 - DNA, 25 bp, Homo sapien
gggataatccagctaagcagatacc

SEQ ID NO: 78446 - DNA, 25 bp, Homo sapien
gggataattcagctaagcagatacc

SEQ ID NO: 78447 - DNA, 25 bp, Homo sapien
gggatacagtaaacagggccattga

SEQ ID NO: 78448 - DNA, 25 bp, Homo sapien
gggatacagtaaatagggccattga

SEQ ID NO: 78449 - DNA, 25 bp, Homo sapien
gggatactcaactacttcacatttc

SEQ ID NO: 78450 - DNA, 25 bp, Homo sapien
gggatactcaactgcttcacatttc

SEQ ID NO: 78451 - DNA, 25 bp, Homo sapien
gggatactcagtactttgaagaggc

SEQ ID NO: 78452 - DNA, 25 bp, Homo sapien
gggatactcagtcctttgaagaggc

SEQ ID NO: 78453 - DNA, 25 bp, Homo sapien
gggatagaaaagtaacagttgtccc

SEQ ID NO: 78454 - DNA, 25 bp, Homo sapien
gggatagaaaagttacagttgtccc

SEQ ID NO: 78455 - DNA, 25 bp, Homo sapien
gggataggatccaagttctgagtgt

SEQ ID NO: 78456 - DNA, 25 bp, Homo sapien
gggataggatcccagttctgagtgt

SEQ ID NO: 78457 - DNA, 25 bp, Homo sapien
gggatagtcagatactaggcaagaa

SEQ ID NO: 78458 - DNA, 25 bp, Homo sapien
gggatagtcagatactcggcaagaa

SEQ ID NO: 78459 - DNA, 25 bp, Homo sapien
gggatataggagtaagttctgagca

SEQ ID NO: 78460 - DNA, 25 bp, Homo sapien
gggatataggagtaggttctgagca

SEQ ID NO: 78461 - DNA, 25 bp, Homo sapien
gggatatggctctaagtcagagtaa

SEQ ID NO: 78462 - DNA, 25 bp, Homo sapien
gggatatggctttaagtcagagtaa

SEQ ID NO: 78463 - DNA, 25 bp, Homo sapien
gggatatttttcctcttcactctcc

SEQ ID NO: 78464 - DNA, 25 bp, Homo sapien
gggatattttttctcttcactctcc

SEQ ID NO: 78465 - DNA, 25 bp, Homo sapien
gggatcagaaaaatatttgaagaaa

SEQ ID NO: 78466 - DNA, 25 bp, Homo sapien
gggatcagaaaagtatttgaagaaa

SEQ ID NO: 78467 - DNA, 25 bp, Homo sapien
gggatcagtaatagtaataataata

SEQ ID NO: 78468 - DNA, 25 bp, Homo sapien
gggatcagtaatagtagtaataata

SEQ ID NO: 78469 - DNA, 25 bp, Homo sapien
gggatcatcaaaggagagaaaaaaa

SEQ ID NO: 78470 - DNA, 25 bp, Homo sapien
gggatcattaaaggagagaaaaaaa

SEQ ID NO: 78471 - DNA, 25 bp, Homo sapien
gggatcctggctcagttaatgagaa

SEQ ID NO: 78472 - DNA, 25 bp, Homo sapien
gggatcctggcttagttaatgagaa

SEQ ID NO: 78473 - DNA, 25 bp, Homo sapien
gggatcgcagaaagaaggtggcttg

SEQ ID NO: 78474 - DNA, 25 bp, Homo sapien
gggatcgcggaaagaaggtggcttg

SEQ ID NO: 78475 - DNA, 25 bp, Homo sapien
gggatcgtacggtatgaaaccccct

SEQ ID NO: 78476 - DNA, 25 bp, Homo sapien
gggatcgtatggtatgaaaccccct

SEQ ID NO: 78477 - DNA, 25 bp, Homo sapien
gggatcttaattaggaaaccatatt

SEQ ID NO: 78478 - DNA, 25 bp, Homo sapien
gggatcttaattaggagaccatatt

SEQ ID NO: 78479 - DNA, 25 bp, Homo sapien
gggatctttagccttgaaaactgag

SEQ ID NO: 78480 - DNA, 25 bp, Homo sapien
gggatctttagctttgaaaactgag

SEQ ID NO: 78481 - DNA, 25 bp, Homo sapien
gggatgaaagaatgaatgagtttat

SEQ ID NO: 78482 - DNA, 25 bp, Homo sapien
gggatgaagagtggctagagtttct

SEQ ID NO: 78483 - DNA, 25 bp, Homo sapien
gggatgaagagttgctagagtttct

SEQ ID NO: 78484 - DNA, 25 bp, Homo sapien
gggatgaaggaatgaatgagtttat

SEQ ID NO: 78485 - DNA, 25 bp, Homo sapien
gggatgacaatgcttcctgtctcag

SEQ ID NO: 78486 - DNA, 25 bp, Homo sapien
gggatgacagtgcttcctgtctcag

SEQ ID NO: 78487 - DNA, 25 bp, Homo sapien
gggatgagaaggagttggtgactaa

SEQ ID NO: 78488 - DNA, 25 bp, Homo sapien
gggatgaggaagacggatgcatgac

SEQ ID NO: 78489 - DNA, 25 bp, Homo sapien
gggatgaggaagatggatgcatgac

SEQ ID NO: 78490 - DNA, 25 bp, Homo sapien
gggatgagggaatgctcagtgtgac

SEQ ID NO: 78491 - DNA, 25 bp, Homo sapien
gggatgagggaatgcttagtgtgac

SEQ ID NO: 78492 - DNA, 25 bp, Homo sapien
gggatgagtaggagttggtgactaa

SEQ ID NO: 78493 - DNA, 25 bp, Homo sapien
gggatgagtcaaagatgggcagaaa

SEQ ID NO: 78494 - DNA, 25 bp, Homo sapien
gggatgagtcaaaggtgggcagaaa

SEQ ID NO: 78495 - DNA, 25 bp, Homo sapien
gggatgatgttacccagagcccaga

SEQ ID NO: 78496 - DNA, 25 bp, Homo sapien
gggatgatgttatccagagcccaga

SEQ ID NO: 78497 - DNA, 25 bp, Homo sapien
gggatgcagataaaagttgctgtcc

SEQ ID NO: 78498 - DNA, 25 bp, Homo sapien
gggatgcaggtaaaagttgctgtcc

SEQ ID NO: 78499 - DNA, 25 bp, Homo sapien
gggatgcataataattttccgtgaa

SEQ ID NO: 78500 - DNA, 25 bp, Homo sapien
gggatgcataatgattttccgtgaa

SEQ ID NO: 78501 - DNA, 25 bp, Homo sapien
gggatgccatgtacaccactggatt

SEQ ID NO: 78502 - DNA, 25 bp, Homo sapien
gggatgccatgtataccactggatt

SEQ ID NO: 78503 - DNA, 25 bp, Homo sapien
gggatgcttccaagacaattggctc

SEQ ID NO: 78504 - DNA, 25 bp, Homo sapien
gggatgcttccaaggcaattggctc

SEQ ID NO: 78505 - DNA, 25 bp, Homo sapien
gggatggtggtgccattagtcagga

SEQ ID NO: 78506 - DNA, 25 bp, Homo sapien
gggatggtggtgccgttagtcagga

SEQ ID NO: 78507 - DNA, 25 bp, Homo sapien
gggatggtttccagattcacatgca

SEQ ID NO: 78508 - DNA, 25 bp, Homo sapien
gggatggtttccggattcacatgca

SEQ ID NO: 78509 - DNA, 25 bp, Homo sapien
gggatgtgattgttacagcgggtgg

SEQ ID NO: 78510 - DNA, 25 bp, Homo sapien
gggatgtgattgttactgcgggtgg

SEQ ID NO: 78511 - DNA, 25 bp, Homo sapien
gggatgtgcggctgagtggccaaaa

SEQ ID NO: 78512 - DNA, 25 bp, Homo sapien
gggatgtgtggctgagtggccaaaa

SEQ ID NO: 78513 - DNA, 25 bp, Homo sapien
gggatgttacttgaaagagtttcag

SEQ ID NO: 78514 - DNA, 25 bp, Homo sapien
gggatgttacttggaagagtttcag

SEQ ID NO: 78515 - DNA, 25 bp, Homo sapien
gggattagtttccttactgggagag

SEQ ID NO: 78516 - DNA, 25 bp, Homo sapien
gggattagtttccttattgggagag

SEQ ID NO: 78517 - DNA, 25 bp, Homo sapien
gggattccaggcacatcctaactca

SEQ ID NO: 78518 - DNA, 25 bp, Homo sapien
gggattccaggcacattctaactca

SEQ ID NO: 78519 - DNA, 25 bp, Homo sapien
gggattcctataagcattgtattgg

SEQ ID NO: 78520 - DNA, 25 bp, Homo sapien
gggattcctctaacagatctgggca

SEQ ID NO: 78521 - DNA, 25 bp, Homo sapien
gggattcctgtaacagatctgggca

SEQ ID NO: 78522 - DNA, 25 bp, Homo sapien
gggattcctgtaagcattgtattgg

SEQ ID NO: 78523 - DNA, 25 bp, Homo sapien
gggattctactgtacagcaagttga

SEQ ID NO: 78524 - DNA, 25 bp, Homo sapien
gggattctactgtagagcaagttga

SEQ ID NO: 78525 - DNA, 25 bp, Homo sapien
gggattgaatgggccatactagctg

SEQ ID NO: 78526 - DNA, 25 bp, Homo sapien
gggattgaatgtgccatactagctg

SEQ ID NO: 78527 - DNA, 25 bp, Homo sapien
gggattgactgcatttgtgtgttag

SEQ ID NO: 78528 - DNA, 25 bp, Homo sapien
gggattgattgcatttgtgtgttag

SEQ ID NO: 78529 - DNA, 25 bp, Homo sapien
gggatttaactgaagttgacacaga

SEQ ID NO: 78530 - DNA, 25 bp, Homo sapien
gggatttaattgaagttgacacaga

SEQ ID NO: 78531 - DNA, 25 bp, Homo sapien
gggatttacgaggattatctcattt

SEQ ID NO: 78532 - DNA, 25 bp, Homo sapien
gggatttatgaggattatctcattt

SEQ ID NO: 78533 - DNA, 25 bp, Homo sapien
gggatttcatgctagattccaactt

SEQ ID NO: 78534 - DNA, 25 bp, Homo sapien
gggatttcatgctggattccaactt

SEQ ID NO: 78535 - DNA, 25 bp, Homo sapien
gggatttccgacattcattccacct

SEQ ID NO: 78536 - DNA, 25 bp, Homo sapien
gggatttctgacattcattccacct

SEQ ID NO: 78537 - DNA, 25 bp, Homo sapien
gggatttcttttaaacattggttct

SEQ ID NO: 78538 - DNA, 25 bp, Homo sapien
gggatttcttttaagcattggttct

SEQ ID NO: 78539 - DNA, 25 bp, Homo sapien
gggatttgagaggacaataagtaca

SEQ ID NO: 78540 - DNA, 25 bp, Homo sapien
gggatttgagaggacagtaagtaca

SEQ ID NO: 78541 - DNA, 25 bp, Homo sapien
gggattttgacctgctgttgctgac

SEQ ID NO: 78542 - DNA, 25 bp, Homo sapien
gggattttgacctgttgttgctgac

SEQ ID NO: 78543 - DNA, 25 bp, Homo sapien
gggatttttgaactgcatattttat

SEQ ID NO: 78544 - DNA, 25 bp, Homo sapien
gggatttttgaattgcatattttat

SEQ ID NO: 78545 - DNA, 25 bp, Homo sapien
gggcaaaaaagggcacaaagaaaag

SEQ ID NO: 78546 - DNA, 25 bp, Homo sapien
gggcaaaaaagggcaccaagaaaag

SEQ ID NO: 78547 - DNA, 25 bp, Homo sapien
gggcaaaaacctaccaacacagcca

SEQ ID NO: 78548 - DNA, 25 bp, Homo sapien
gggcaaaaagctaccaacacagcca

SEQ ID NO: 78549 - DNA, 25 bp, Homo sapien
gggcaaaatgttaccacgcctcgac

SEQ ID NO: 78550 - DNA, 25 bp, Homo sapien
gggcaaaatgttaccatgcctcgac

SEQ ID NO: 78551 - DNA, 25 bp, Homo sapien
gggcaaacgattatgagattgattt

SEQ ID NO: 78552 - DNA, 25 bp, Homo sapien
gggcaaacgattttgagattgattt

SEQ ID NO: 78553 - DNA, 25 bp, Homo sapien
gggcaaagaaaatgaaagcaccttt

SEQ ID NO: 78554 - DNA, 25 bp, Homo sapien
gggcaaagaaaattaaagcaccttt

SEQ ID NO: 78555 - DNA, 25 bp, Homo sapien
gggcaaaggaaaaccaaatgaagat

SEQ ID NO: 78556 - DNA, 25 bp, Homo sapien
gggcaaaggaaaagcaaatgaagat

SEQ ID NO: 78557 - DNA, 25 bp, Homo sapien
gggcaaataaacggtttggtttaca

SEQ ID NO: 78558 - DNA, 25 bp, Homo sapien
gggcaaataaatggtttggtttaca

SEQ ID NO: 78559 - DNA, 25 bp, Homo sapien
gggcaaatagcctaccctttctcat

SEQ ID NO: 78560 - DNA, 25 bp, Homo sapien
gggcaaatagcttaccctttctcat

SEQ ID NO: 78561 - DNA, 25 bp, Homo sapien
gggcaaatctgcagataactttgtc

SEQ ID NO: 78562 - DNA, 25 bp, Homo sapien
gggcaaatctgtagataactttgtc

SEQ ID NO: 78563 - DNA, 25 bp, Homo sapien
gggcaacacagtggaacctcatctc

SEQ ID NO: 78564 - DNA, 25 bp, Homo sapien
gggcaacacagtgggacctcatctc

SEQ ID NO: 78565 - DNA, 25 bp, Homo sapien
gggcaaccatgatgttcgtgttgca

SEQ ID NO: 78566 - DNA, 25 bp, Homo sapien
gggcaaccatgatgtttgtgttgca

SEQ ID NO: 78567 - DNA, 25 bp, Homo sapien
gggcaactccggcgtctcaggtggc

SEQ ID NO: 78568 - DNA, 25 bp, Homo sapien
gggcaactctggcgtctcaggtggc

SEQ ID NO: 78569 - DNA, 25 bp, Homo sapien
gggcaactttgcttcccctagagtt

SEQ ID NO: 78570 - DNA, 25 bp, Homo sapien
gggcaactttggttcccctagagtt

SEQ ID NO: 78571 - DNA, 25 bp, Homo sapien
gggcaaggaaagacaatcccaacat

SEQ ID NO: 78572 - DNA, 25 bp, Homo sapien
gggcaaggaaagagaatcccaacat

SEQ ID NO: 78573 - DNA, 25 bp, Homo sapien
gggcaagtcactgaaacgtgggtca

SEQ ID NO: 78574 - DNA, 25 bp, Homo sapien
gggcaagtcactgaaatgtgggtca

SEQ ID NO: 78575 - DNA, 25 bp, Homo sapien
gggcaataacgctcctgtttggcct

SEQ ID NO: 78576 - DNA, 25 bp, Homo sapien
gggcaataatgctcctgtttggcct

SEQ ID NO: 78577 - DNA, 25 bp, Homo sapien
gggcaatttgtggccaccatgagtt

SEQ ID NO: 78578 - DNA, 25 bp, Homo sapien
gggcaatttgtggccatcatgagtt

SEQ ID NO: 78579 - DNA, 25 bp, Homo sapien
gggcacaaaacaaagtcctcccccc

SEQ ID NO: 78580 - DNA, 25 bp, Homo sapien
gggcacaaagcaaagtcctcccccc

SEQ ID NO: 78581 - DNA, 25 bp, Homo sapien
gggcaccagagttggctttcaggct

SEQ ID NO: 78582 - DNA, 25 bp, Homo sapien
gggcaccagagtttgctttcaggct

SEQ ID NO: 78583 - DNA, 25 bp, Homo sapien
gggcacgtcaatgagtggctggcat

SEQ ID NO: 78584 - DNA, 25 bp, Homo sapien
gggcacgtccatgagtggctggcat

SEQ ID NO: 78585 - DNA, 25 bp, Homo sapien
gggcactaagtgagctcttaggatg

SEQ ID NO: 78586 - DNA, 25 bp, Homo sapien
gggcactaagtgagcttttaggatg

SEQ ID NO: 78587 - DNA, 25 bp, Homo sapien
gggcactctgaagacgtaattgtat

SEQ ID NO: 78588 - DNA, 25 bp, Homo sapien
gggcactctgaagatgtaattgtat

SEQ ID NO: 78589 - DNA, 25 bp, Homo sapien
gggcagaaacttaatgactaaaaca

SEQ ID NO: 78590 - DNA, 25 bp, Homo sapien
gggcagaaccttaatgactaaaaca

SEQ ID NO: 78591 - DNA, 25 bp, Homo sapien
gggcagaagcaatgatcttccacat

SEQ ID NO: 78592 - DNA, 25 bp, Homo sapien
gggcagaaggaatgatcttccacat

SEQ ID NO: 78593 - DNA, 25 bp, Homo sapien
gggcagatggcaggaagtaatcttt

SEQ ID NO: 78594 - DNA, 25 bp, Homo sapien
gggcagatggcatgaagtaatcttt

SEQ ID NO: 78595 - DNA, 25 bp, Homo sapien
gggcagccattgtgcacttggatat

SEQ ID NO: 78596 - DNA, 25 bp, Homo sapien
gggcagccctgtgcatttttggacg

SEQ ID NO: 78597 - DNA, 25 bp, Homo sapien
gggcagccgttgtgcacttggatat

SEQ ID NO: 78598 - DNA, 25 bp, Homo sapien
gggcagccttgtgcatttttggacg

SEQ ID NO: 78599 - DNA, 25 bp, Homo sapien
gggcaggacgttctccttctgtaag

SEQ ID NO: 78600 - DNA, 25 bp, Homo sapien
gggcaggactcctctttaagcagag

SEQ ID NO: 78601 - DNA, 25 bp, Homo sapien
gggcaggactcttctttaagcagag

SEQ ID NO: 78602 - DNA, 25 bp, Homo sapien
gggcaggatgttctccttctgtaag

SEQ ID NO: 78603 - DNA, 25 bp, Homo sapien
gggcaggccacacagaatggtctcc

SEQ ID NO: 78604 - DNA, 25 bp, Homo sapien
gggcaggccacagagaatggtctcc

SEQ ID NO: 78605 - DNA, 25 bp, Homo sapien
gggcagggagaatattgtcacacac

SEQ ID NO: 78606 - DNA, 25 bp, Homo sapien
gggcagggagaatattttcacacac

SEQ ID NO: 78607 - DNA, 25 bp, Homo sapien
gggcagggcctctagggtgacacag

SEQ ID NO: 78608 - DNA, 25 bp, Homo sapien
gggcagggcctctaggttgacacag

SEQ ID NO: 78609 - DNA, 25 bp, Homo sapien
gggcagggctggcagtcccaggagt

SEQ ID NO: 78610 - DNA, 25 bp, Homo sapien
gggcagggctggtagtcccaggagt

SEQ ID NO: 78611 - DNA, 25 bp, Homo sapien
gggcagtagtcatattaaaagtgtc

SEQ ID NO: 78612 - DNA, 25 bp, Homo sapien
gggcagtagtcgtattaaaagtgtc

SEQ ID NO: 78613 - DNA, 25 bp, Homo sapien
gggcataacaggaacattaatcaga

SEQ ID NO: 78614 - DNA, 25 bp, Homo sapien
gggcataacgggaacattaatcaga

SEQ ID NO: 78615 - DNA, 25 bp, Homo sapien
gggcataagacattgggagaaagat

SEQ ID NO: 78616 - DNA, 25 bp, Homo sapien
gggcataagaccttgggagaaagat

SEQ ID NO: 78617 - DNA, 25 bp, Homo sapien
gggcataagcaaatgtcaaataatt

SEQ ID NO: 78618 - DNA, 25 bp, Homo sapien
gggcataagcacatgtcaaataatt

SEQ ID NO: 78619 - DNA, 25 bp, Homo sapien
gggcatacgttgcggcaaggatgga

SEQ ID NO: 78620 - DNA, 25 bp, Homo sapien
gggcatacgttgtggcaaggatgga

SEQ ID NO: 78621 - DNA, 25 bp, Homo sapien
gggcatagctaccgtgaagggcagc

SEQ ID NO: 78622 - DNA, 25 bp, Homo sapien
gggcatagctactgtgaagggcagc

SEQ ID NO: 78623 - DNA, 25 bp, Homo sapien
gggcatagctgcacacattccacat

SEQ ID NO: 78624 - DNA, 25 bp, Homo sapien
gggcatagctgcgcacattccacat

SEQ ID NO: 78625 - DNA, 25 bp, Homo sapien
gggcatcacaaacacagcctatcag

SEQ ID NO: 78626 - DNA, 25 bp, Homo sapien
gggcatcacaaacgcagcctatcag

SEQ ID NO: 78627 - DNA, 25 bp, Homo sapien
gggcatcagataccagtaaaagacc

SEQ ID NO: 78628 - DNA, 25 bp, Homo sapien
gggcatcaggccagctgcaaatcgc

SEQ ID NO: 78629 - DNA, 25 bp, Homo sapien
gggcatcaggctagctgcaaatcgc

SEQ ID NO: 78630 - DNA, 25 bp, Homo sapien
gggcatcaggtaccagtaaaagacc

SEQ ID NO: 78631 - DNA, 25 bp, Homo sapien
gggcatctgggaaagattttctcat

SEQ ID NO: 78632 - DNA, 25 bp, Homo sapien
gggcatctgggagagattttctcat

SEQ ID NO: 78633 - DNA, 25 bp, Homo sapien
gggcatgtcttcaatgctctggcag

SEQ ID NO: 78634 - DNA, 25 bp, Homo sapien
gggcatgtctttaatgctctggcag

SEQ ID NO: 78635 - DNA, 25 bp, Homo sapien
gggcattacacttattatccacatg

SEQ ID NO: 78636 - DNA, 25 bp, Homo sapien
gggcattatacttattatccacatg

SEQ ID NO: 78637 - DNA, 25 bp, Homo sapien
gggcattggaaagtaattaggtcat

SEQ ID NO: 78638 - DNA, 25 bp, Homo sapien
gggcattgggaagtaattaggtcat

SEQ ID NO: 78639 - DNA, 25 bp, Homo sapien
gggcatttcaataaaggaaggtcta

SEQ ID NO: 78640 - DNA, 25 bp, Homo sapien
gggcatttcaatgaaggaaggtcta

SEQ ID NO: 78641 - DNA, 25 bp, Homo sapien
gggcatttgagttttcaatgcctgc

SEQ ID NO: 78642 - DNA, 25 bp, Homo sapien
gggcatttgcgttttcaatgcctgc

SEQ ID NO: 78643 - DNA, 25 bp, Homo sapien
gggcattttctcgttggtaggctat

SEQ ID NO: 78644 - DNA, 25 bp, Homo sapien
gggcattttttcgttggtaggctat

SEQ ID NO: 78645 - DNA, 25 bp, Homo sapien
gggccaaaagggtggagaatgtgga

SEQ ID NO: 78646 - DNA, 25 bp, Homo sapien
gggccaaaagggtggataatgtgga

SEQ ID NO: 78647 - DNA, 25 bp, Homo sapien
gggccaagaatttctagttctaaca

SEQ ID NO: 78648 - DNA, 25 bp, Homo sapien
gggccaagactttctagttctaaca

SEQ ID NO: 78649 - DNA, 25 bp, Homo sapien
gggccaaggtctaatttttcacaca

SEQ ID NO: 78650 - DNA, 25 bp, Homo sapien
gggccaaggtctagtttttcacaca

SEQ ID NO: 78651 - DNA, 25 bp, Homo sapien
gggccacattgaacgggttcatctg

SEQ ID NO: 78652 - DNA, 25 bp, Homo sapien
gggccacattgaatgggttcatctg

SEQ ID NO: 78653 - DNA, 25 bp, Homo sapien
gggccacgcactatccaagtgattt

SEQ ID NO: 78654 - DNA, 25 bp, Homo sapien
gggccacgcgctatccaagtgattt

SEQ ID NO: 78655 - DNA, 25 bp, Homo sapien
gggccactcggccttccatgtctgg

SEQ ID NO: 78656 - DNA, 25 bp, Homo sapien
gggccactcgggcttccatgtctgg

SEQ ID NO: 78657 - DNA, 25 bp, Homo sapien
gggccagatgatccgtcacaaccac

SEQ ID NO: 78658 - DNA, 25 bp, Homo sapien
gggccagatgatctgtcacaaccac

SEQ ID NO: 78659 - DNA, 25 bp, Homo sapien
gggccagggagaatgtcgtggatct

SEQ ID NO: 78660 - DNA, 25 bp, Homo sapien
gggccagggagaatgttgtggatct

SEQ ID NO: 78661 - DNA, 25 bp, Homo sapien
gggccagggcttaccttggtacctg

SEQ ID NO: 78662 - DNA, 25 bp, Homo sapien
gggccagggcttagcttggtacctg

SEQ ID NO: 78663 - DNA, 25 bp, Homo sapien
gggccagttagcccacttactccac

SEQ ID NO: 78664 - DNA, 25 bp, Homo sapien
gggccagttagtccacttactccac

SEQ ID NO: 78665 - DNA, 25 bp, Homo sapien
gggccagttgaaaaatgtagtgcgt

SEQ ID NO: 78666 - DNA, 25 bp, Homo sapien
gggccagttgaataatgtagtgcgt

SEQ ID NO: 78667 - DNA, 25 bp, Homo sapien
gggccagtttccgattccttttcct

SEQ ID NO: 78668 - DNA, 25 bp, Homo sapien
gggccagtttctgattccttttcct

SEQ ID NO: 78669 - DNA, 25 bp, Homo sapien
gggccatgactgaacatcagcacta

SEQ ID NO: 78670 - DNA, 25 bp, Homo sapien
gggccatgattgaacatcagcacta

SEQ ID NO: 78671 - DNA, 25 bp, Homo sapien
gggcccacaattttcaatatggtaa

SEQ ID NO: 78672 - DNA, 25 bp, Homo sapien
gggcccacaattttcagtatggtaa

SEQ ID NO: 78673 - DNA, 25 bp, Homo sapien
gggcccagaaggctctaagtggcaa

SEQ ID NO: 78674 - DNA, 25 bp, Homo sapien
gggcccagaaggttctaagtggcaa

SEQ ID NO: 78675 - DNA, 25 bp, Homo sapien
gggccctaacaaacgagtgctggat

SEQ ID NO: 78676 - DNA, 25 bp, Homo sapien
gggccctaacaaatgagtgctggat

SEQ ID NO: 78677 - DNA, 25 bp, Homo sapien
gggccgatctgaaccatggcagaga

SEQ ID NO: 78678 - DNA, 25 bp, Homo sapien
gggccgatgtgaaccatggcagaga

SEQ ID NO: 78679 - DNA, 25 bp, Homo sapien
gggcctaatcctcgttattggcaca

SEQ ID NO: 78680 - DNA, 25 bp, Homo sapien
gggcctaatccttgttattggcaca

SEQ ID NO: 78681 - DNA, 25 bp, Homo sapien
gggcctatgatcaagcctggccaag

SEQ ID NO: 78682 - DNA, 25 bp, Homo sapien
gggcctatggtcaagcctggccaag

SEQ ID NO: 78683 - DNA, 25 bp, Homo sapien
gggcctcccaacatgtggtcttttc

SEQ ID NO: 78684 - DNA, 25 bp, Homo sapien
gggcctcccgacatgtggtcttttc

SEQ ID NO: 78685 - DNA, 25 bp, Homo sapien
gggcctctcagctgccacttaatga

SEQ ID NO: 78686 - DNA, 25 bp, Homo sapien
gggcctctcagctgccgcttaatga

SEQ ID NO: 78687 - DNA, 25 bp, Homo sapien
gggcctgcctgataagtcacaatga

SEQ ID NO: 78688 - DNA, 25 bp, Homo sapien
gggcctgcctggtaagtcacaatga

SEQ ID NO: 78689 - DNA, 25 bp, Homo sapien
gggcctggacattgcattgtttaaa

SEQ ID NO: 78690 - DNA, 25 bp, Homo sapien
gggcctggacattgtattgtttaaa

SEQ ID NO: 78691 - DNA, 25 bp, Homo sapien
gggccttaagggaacattgtttgta

SEQ ID NO: 78692 - DNA, 25 bp, Homo sapien
gggccttaagggaatattgtttgta

SEQ ID NO: 78693 - DNA, 25 bp, Homo sapien
gggccttccataaaagtttgttgaa

SEQ ID NO: 78694 - DNA, 25 bp, Homo sapien
gggccttccatagaagtttgttgaa

SEQ ID NO: 78695 - DNA, 25 bp, Homo sapien
gggccttctctgattctgctcctga

SEQ ID NO: 78696 - DNA, 25 bp, Homo sapien
gggccttctctgtttctgctcctga

SEQ ID NO: 78697 - DNA, 25 bp, Homo sapien
gggcctttcatatattgtctatatt

SEQ ID NO: 78698 - DNA, 25 bp, Homo sapien
gggcctttcgtatattgtctatatt

SEQ ID NO: 78699 - DNA, 25 bp, Homo sapien
gggcgaaggcagacctgccagaagc

SEQ ID NO: 78700 - DNA, 25 bp, Homo sapien
gggcgaaggcagacttgccagaagc

SEQ ID NO: 78701 - DNA, 25 bp, Homo sapien
gggcgagctagtggcacgaagcagg

SEQ ID NO: 78702 - DNA, 25 bp, Homo sapien
gggcgagctagtggcatgaagcagg

SEQ ID NO: 78703 - DNA, 25 bp, Homo sapien
gggcgagggccacaagatcagataa

SEQ ID NO: 78704 - DNA, 25 bp, Homo sapien
gggcgagggccacaaggtcagataa

SEQ ID NO: 78705 - DNA, 25 bp, Homo sapien
gggcgatctctacaagtagaagctt

SEQ ID NO: 78706 - DNA, 25 bp, Homo sapien
gggcgatctgtacaagtagaagctt

SEQ ID NO: 78707 - DNA, 25 bp, Homo sapien
gggcggaagaagatatggacacaaa

SEQ ID NO: 78708 - DNA, 25 bp, Homo sapien
gggcggaagaagatgtggacacaaa

SEQ ID NO: 78709 - DNA, 25 bp, Homo sapien
gggcgggtgatatctgagtgtggcc

SEQ ID NO: 78710 - DNA, 25 bp, Homo sapien
gggcgggtgatatttgagtgtggcc

SEQ ID NO: 78711 - DNA, 25 bp, Homo sapien
gggcgtctgccacacacttgcactc

SEQ ID NO: 78712 - DNA, 25 bp, Homo sapien
gggcgtctgcctcacacttgcactc

SEQ ID NO: 78713 - DNA, 25 bp, Homo sapien
gggcgtgcctcttaatgcagtccag

SEQ ID NO: 78714 - DNA, 25 bp, Homo sapien
gggcgtgcctcttgatgcagtccag

SEQ ID NO: 78715 - DNA, 25 bp, Homo sapien
gggcgtggagaaaagatgttcctga

SEQ ID NO: 78716 - DNA, 25 bp, Homo sapien
gggcgtggagaagagatgttcctga

SEQ ID NO: 78717 - DNA, 25 bp, Homo sapien
gggctaaagtttacatcataaagtg

SEQ ID NO: 78718 - DNA, 25 bp, Homo sapien
gggctaaagtttacgtcataaagtg

SEQ ID NO: 78719 - DNA, 25 bp, Homo sapien
gggctaattgctatatatggttatg

SEQ ID NO: 78720 - DNA, 25 bp, Homo sapien
gggctaattgctatgtatggttatg

SEQ ID NO: 78721 - DNA, 25 bp, Homo sapien
gggctacagctggaattcttgctat

SEQ ID NO: 78722 - DNA, 25 bp, Homo sapien
gggctacagctgggattcttgctat

SEQ ID NO: 78723 - DNA, 25 bp, Homo sapien
gggctacaggatttctgtgtcaaat

SEQ ID NO: 78724 - DNA, 25 bp, Homo sapien
gggctacagtatttctgtgtcaaat

SEQ ID NO: 78725 - DNA, 25 bp, Homo sapien
gggctacatccagacctggctgcta

SEQ ID NO: 78726 - DNA, 25 bp, Homo sapien
gggctacattcagacctggctgcta

SEQ ID NO: 78727 - DNA, 25 bp, Homo sapien
gggctacgtgttcagctaattgcaa

SEQ ID NO: 78728 - DNA, 25 bp, Homo sapien
gggctacgtgttcggctaattgcaa

SEQ ID NO: 78729 - DNA, 25 bp, Homo sapien
gggctataagagaataaattcatgt

SEQ ID NO: 78730 - DNA, 25 bp, Homo sapien
gggctataagagcataaattcatgt

SEQ ID NO: 78731 - DNA, 25 bp, Homo sapien
gggctatcaaagatcacaaacagtg

SEQ ID NO: 78732 - DNA, 25 bp, Homo sapien
gggctatcaaagatcataaacagtg

SEQ ID NO: 78733 - DNA, 25 bp, Homo sapien
gggctatttcttcgtgtactagtag

SEQ ID NO: 78734 - DNA, 25 bp, Homo sapien
gggctatttctttgtgtactagtag

SEQ ID NO: 78735 - DNA, 25 bp, Homo sapien
gggctcaagagaaagtaagaaatct

SEQ ID NO: 78736 - DNA, 25 bp, Homo sapien
gggctcaagaggaagtaagaaatct

SEQ ID NO: 78737 - DNA, 25 bp, Homo sapien
gggctcaataaggtaatggttcaaa

SEQ ID NO: 78738 - DNA, 25 bp, Homo sapien
gggctcaataatgtaatggttcaaa

SEQ ID NO: 78739 - DNA, 25 bp, Homo sapien
gggctcactaactgattgcaaacat

SEQ ID NO: 78740 - DNA, 25 bp, Homo sapien
gggctcactgactgattgcaaacat

SEQ ID NO: 78741 - DNA, 25 bp, Homo sapien
gggctcatcctcatattttctgttg

SEQ ID NO: 78742 - DNA, 25 bp, Homo sapien
gggctcatcctcgtattttctgttg

SEQ ID NO: 78743 - DNA, 25 bp, Homo sapien
gggctcatgacattagcaaagtgta

SEQ ID NO: 78744 - DNA, 25 bp, Homo sapien
gggctcatgacattagtaaagtgta

SEQ ID NO: 78745 - DNA, 25 bp, Homo sapien
gggctcattgctcaacttctctgtg

SEQ ID NO: 78746 - DNA, 25 bp, Homo sapien
gggctcattgctcagcttctctgtg

SEQ ID NO: 78747 - DNA, 25 bp, Homo sapien
gggctccagcgaggttctaaaccaa

SEQ ID NO: 78748 - DNA, 25 bp, Homo sapien
gggctccagcgagtttctaaaccaa

SEQ ID NO: 78749 - DNA, 25 bp, Homo sapien
gggctccatttacctctcgtatatt

SEQ ID NO: 78750 - DNA, 25 bp, Homo sapien
gggctccatttacttctcgtatatt

SEQ ID NO: 78751 - DNA, 25 bp, Homo sapien
gggctcttcgaaaagattaagtgca

SEQ ID NO: 78752 - DNA, 25 bp, Homo sapien
gggctcttcgaaaatattaagtgca

SEQ ID NO: 78753 - DNA, 25 bp, Homo sapien
gggctgaagcagtccgcaaggttaa

SEQ ID NO: 78754 - DNA, 25 bp, Homo sapien
gggctgaagcagtgcgcaaggttaa

SEQ ID NO: 78755 - DNA, 25 bp, Homo sapien
gggctgagccaatcagattgtcttt

SEQ ID NO: 78756 - DNA, 25 bp, Homo sapien
gggctgagccaatcggattgtcttt

SEQ ID NO: 78757 - DNA, 25 bp, Homo sapien
gggctgattattctcaaagcccact

SEQ ID NO: 78758 - DNA, 25 bp, Homo sapien
gggctgattgttctcaaagcccact

SEQ ID NO: 78759 - DNA, 25 bp, Homo sapien
gggctgcacctaacttctgccaacc

SEQ ID NO: 78760 - DNA, 25 bp, Homo sapien
gggctgcatctaacttctgccaacc

SEQ ID NO: 78761 - DNA, 25 bp, Homo sapien
gggctgctgtgtagaactgataata

SEQ ID NO: 78762 - DNA, 25 bp, Homo sapien
gggctgctgtgtagaattgataata

SEQ ID NO: 78763 - DNA, 25 bp, Homo sapien
gggctggacagacgatttccaggga

SEQ ID NO: 78764 - DNA, 25 bp, Homo sapien
gggctggacagactatttccaggga

SEQ ID NO: 78765 - DNA, 25 bp, Homo sapien
gggctggtccagccaatcagggata

SEQ ID NO: 78766 - DNA, 25 bp, Homo sapien
gggctggtccagctaatcagggata

SEQ ID NO: 78767 - DNA, 25 bp, Homo sapien
gggctggtgaagtcataggaacaca

SEQ ID NO: 78768 - DNA, 25 bp, Homo sapien
gggctggtgaagtcatgggaacaca

SEQ ID NO: 78769 - DNA, 25 bp, Homo sapien
gggctgtaaagcagaagtattaatt

SEQ ID NO: 78770 - DNA, 25 bp, Homo sapien
gggctgtaaagcagaattattaatt

SEQ ID NO: 78771 - DNA, 25 bp, Homo sapien
gggctgtcctgtgtatggtgggctc

SEQ ID NO: 78772 - DNA, 25 bp, Homo sapien
gggctgtcctgtgtgtggtgggctc

SEQ ID NO: 78773 - DNA, 25 bp, Homo sapien
gggctgtgctgcagcggtgtgtgtg

SEQ ID NO: 78774 - DNA, 25 bp, Homo sapien
gggctgtgctgcagtggtgtgtgtg

SEQ ID NO: 78775 - DNA, 25 bp, Homo sapien
gggctgtttcaggaaagttctcacc

SEQ ID NO: 78776 - DNA, 25 bp, Homo sapien
gggctgtttcagtaaagttctcacc

SEQ ID NO: 78777 - DNA, 25 bp, Homo sapien
gggcttagatttactacaaattata

SEQ ID NO: 78778 - DNA, 25 bp, Homo sapien
gggcttagatttattacaaattata

SEQ ID NO: 78779 - DNA, 25 bp, Homo sapien
gggcttcagaaagcttctttcagtt

SEQ ID NO: 78780 - DNA, 25 bp, Homo sapien
gggcttcagaaagcttgtttcagtt

SEQ ID NO: 78781 - DNA, 25 bp, Homo sapien
gggcttccaagcattctgattttcc

SEQ ID NO: 78782 - DNA, 25 bp, Homo sapien
gggcttccaagtattctgattttcc

SEQ ID NO: 78783 - DNA, 25 bp, Homo sapien
gggcttccactcaacaaggctgact

SEQ ID NO: 78784 - DNA, 25 bp, Homo sapien
gggcttccactcaccaaggctgact

SEQ ID NO: 78785 - DNA, 25 bp, Homo sapien
gggcttctcagcttcgtcggtgcca

SEQ ID NO: 78786 - DNA, 25 bp, Homo sapien
gggcttctcagctttgtcggtgcca

SEQ ID NO: 78787 - DNA, 25 bp, Homo sapien
gggcttgaaatagatctttctatat

SEQ ID NO: 78788 - DNA, 25 bp, Homo sapien
gggcttgagatagatctttctatat

SEQ ID NO: 78789 - DNA, 25 bp, Homo sapien
gggcttggctagatcacagctctgt

SEQ ID NO: 78790 - DNA, 25 bp, Homo sapien
gggcttggctaggtcacagctctgt

SEQ ID NO: 78791 - DNA, 25 bp, Homo sapien
gggctttggagtacaaacgatccca

SEQ ID NO: 78792 - DNA, 25 bp, Homo sapien
gggctttggagtagaaacgatccca

SEQ ID NO: 78793 - DNA, 25 bp, Homo sapien
gggcttttacttattattacagctt

SEQ ID NO: 78794 - DNA, 25 bp, Homo sapien
gggcttttactttttattacagctt

SEQ ID NO: 78795 - DNA, 25 bp, Homo sapien
ggggaaaaaataagcttcagagtga

SEQ ID NO: 78796 - DNA, 25 bp, Homo sapien
ggggaaaaaatgagcttcagagtga

SEQ ID NO: 78797 - DNA, 25 bp, Homo sapien
ggggaaaataagcacgtcctgtgtg

SEQ ID NO: 78798 - DNA, 25 bp, Homo sapien
ggggaaaataagcgcgtcctgtgtg

SEQ ID NO: 78799 - DNA, 25 bp, Homo sapien
ggggaaacataagacaatgcctctt

SEQ ID NO: 78800 - DNA, 25 bp, Homo sapien
ggggaaacataagataatgcctctt

SEQ ID NO: 78801 - DNA, 25 bp, Homo sapien
ggggaaacatcagaataatcataaa

SEQ ID NO: 78802 - DNA, 25 bp, Homo sapien
ggggaaacatcagaattatcataaa

SEQ ID NO: 78803 - DNA, 25 bp, Homo sapien
ggggaaagtggatggacagaaggat

SEQ ID NO: 78804 - DNA, 25 bp, Homo sapien
ggggaaagtggatggatagaaggat

SEQ ID NO: 78805 - DNA, 25 bp, Homo sapien
ggggaaatgaacctgcaggaaaaac

SEQ ID NO: 78806 - DNA, 25 bp, Homo sapien
ggggaaatgaacgtgcaggaaaaac

SEQ ID NO: 78807 - DNA, 25 bp, Homo sapien
ggggaacagccatgtcttctgaaac

SEQ ID NO: 78808 - DNA, 25 bp, Homo sapien
ggggaacagccgtgtcttctgaaac

SEQ ID NO: 78809 - DNA, 25 bp, Homo sapien
ggggaagaaatagcattattggaac

SEQ ID NO: 78810 - DNA, 25 bp, Homo sapien
ggggaagaagtagcattattggaac

SEQ ID NO: 78811 - DNA, 25 bp, Homo sapien
ggggaagtaccctcggatcactggc

SEQ ID NO: 78812 - DNA, 25 bp, Homo sapien
ggggaagtcccctcggatcactggc

SEQ ID NO: 78813 - DNA, 25 bp, Homo sapien
ggggaataacggcctggctttgtgt

SEQ ID NO: 78814 - DNA, 25 bp, Homo sapien
ggggaataagggcctggctttgtgt

SEQ ID NO: 78815 - DNA, 25 bp, Homo sapien
ggggacaagaatatgccttcccaga

SEQ ID NO: 78816 - DNA, 25 bp, Homo sapien
ggggacaagaatattccttcccaga

SEQ ID NO: 78817 - DNA, 25 bp, Homo sapien
ggggacatgatgacgacttagctct

SEQ ID NO: 78818 - DNA, 25 bp, Homo sapien
ggggacatgatgaggacttagctct

SEQ ID NO: 78819 - DNA, 25 bp, Homo sapien
ggggacatgcggaacactgaaaaca

SEQ ID NO: 78820 - DNA, 25 bp, Homo sapien
ggggacatgcgtaacactgaaaaca

SEQ ID NO: 78821 - DNA, 25 bp, Homo sapien
ggggacattctacgactctctaagt

SEQ ID NO: 78822 - DNA, 25 bp, Homo sapien
ggggacattctatgactctctaagt

SEQ ID NO: 78823 - DNA, 25 bp, Homo sapien
ggggaccacttcaggagcaaaggcc

SEQ ID NO: 78824 - DNA, 25 bp, Homo sapien
ggggaccacttcgggagcaaaggcc

SEQ ID NO: 78825 - DNA, 25 bp, Homo sapien
ggggaccattctttacaggaacagt

SEQ ID NO: 78826 - DNA, 25 bp, Homo sapien
ggggaccattctttgcaggaacagt

SEQ ID NO: 78827 - DNA, 25 bp, Homo sapien
ggggacgaacagctctgcttggctt

SEQ ID NO: 78828 - DNA, 25 bp, Homo sapien
ggggacgaacagttctgcttggctt

SEQ ID NO: 78829 - DNA, 25 bp, Homo sapien
ggggactcgagcccagaagatcagg

SEQ ID NO: 78830 - DNA, 25 bp, Homo sapien
ggggactcgagcctagaagatcagg

SEQ ID NO: 78831 - DNA, 25 bp, Homo sapien
ggggagaaggtgaccactcctcggg

SEQ ID NO: 78832 - DNA, 25 bp, Homo sapien
ggggagaaggtgaccagtcctcggg

SEQ ID NO: 78833 - DNA, 25 bp, Homo sapien
ggggagaagtcaatgtgaaaaagga

SEQ ID NO: 78834 - DNA, 25 bp, Homo sapien
ggggagaagtcactgtgaaaaagga

SEQ ID NO: 78835 - DNA, 25 bp, Homo sapien
ggggagatttctccacctttagctg

SEQ ID NO: 78836 - DNA, 25 bp, Homo sapien
ggggagatttctctacctttagctg

SEQ ID NO: 78837 - DNA, 25 bp, Homo sapien
ggggataatccagctaagcagatac

SEQ ID NO: 78838 - DNA, 25 bp, Homo sapien
ggggataattcagctaagcagatac

SEQ ID NO: 78839 - DNA, 25 bp, Homo sapien
ggggatactaacatgccgtccatag

SEQ ID NO: 78840 - DNA, 25 bp, Homo sapien
ggggatactaacatgctgtccatag

SEQ ID NO: 78841 - DNA, 25 bp, Homo sapien
ggggataggatccaagttctgagtg

SEQ ID NO: 78842 - DNA, 25 bp, Homo sapien
ggggataggatcccagttctgagtg

SEQ ID NO: 78843 - DNA, 25 bp, Homo sapien
ggggatatggctctaagtcagagta

SEQ ID NO: 78844 - DNA, 25 bp, Homo sapien
ggggatatggctttaagtcagagta

SEQ ID NO: 78845 - DNA, 25 bp, Homo sapien
ggggatcagaaaaatatttgaagaa

SEQ ID NO: 78846 - DNA, 25 bp, Homo sapien
ggggatcagaaaagtatttgaagaa

SEQ ID NO: 78847 - DNA, 25 bp, Homo sapien
ggggatgccatgtacaccactggat

SEQ ID NO: 78848 - DNA, 25 bp, Homo sapien
ggggatgccatgtataccactggat

SEQ ID NO: 78849 - DNA, 25 bp, Homo sapien
ggggatgtgcggctgagtggccaaa

SEQ ID NO: 78850 - DNA, 25 bp, Homo sapien
ggggatgtgtggctgagtggccaaa

SEQ ID NO: 78851 - DNA, 25 bp, Homo sapien
ggggattagctctctcaggacattt

SEQ ID NO: 78852 - DNA, 25 bp, Homo sapien
ggggattatctctctcaggacattt

SEQ ID NO: 78853 - DNA, 25 bp, Homo sapien
ggggattgaatgggccatactagct

SEQ ID NO: 78854 - DNA, 25 bp, Homo sapien
ggggattgaatgtgccatactagct

SEQ ID NO: 78855 - DNA, 25 bp, Homo sapien
ggggatttcatgctagattccaact

SEQ ID NO: 78856 - DNA, 25 bp, Homo sapien
ggggatttcatgctggattccaact

SEQ ID NO: 78857 - DNA, 25 bp, Homo sapien
ggggcaaaacaagggtgaaaactag

SEQ ID NO: 78858 - DNA, 25 bp, Homo sapien
ggggcaaaacaagggttaaaactag

SEQ ID NO: 78859 - DNA, 25 bp, Homo sapien
ggggcaaactgattgcatccgatcc

SEQ ID NO: 78860 - DNA, 25 bp, Homo sapien
ggggcaaattgattgcatccgatcc

SEQ ID NO: 78861 - DNA, 25 bp, Homo sapien
ggggcaaggaaagacaatcccaaca

SEQ ID NO: 78862 - DNA, 25 bp, Homo sapien
ggggcaaggaaagagaatcccaaca

SEQ ID NO: 78863 - DNA, 25 bp, Homo sapien
ggggcaagggaactgacgagtcttg

SEQ ID NO: 78864 - DNA, 25 bp, Homo sapien
ggggcaagggaactgatgagtcttg

SEQ ID NO: 78865 - DNA, 25 bp, Homo sapien
ggggcaatagactcaacctcttaat

SEQ ID NO: 78866 - DNA, 25 bp, Homo sapien
ggggcaatagattcaacctcttaat

SEQ ID NO: 78867 - DNA, 25 bp, Homo sapien
ggggcagatggcaggaagtaatctt

SEQ ID NO: 78868 - DNA, 25 bp, Homo sapien
ggggcagatggcatgaagtaatctt

SEQ ID NO: 78869 - DNA, 25 bp, Homo sapien
ggggcaggacgttctccttctgtaa

SEQ ID NO: 78870 - DNA, 25 bp, Homo sapien
ggggcaggatgttctccttctgtaa

SEQ ID NO: 78871 - DNA, 25 bp, Homo sapien
ggggcagtccaggtgtggagctctt

SEQ ID NO: 78872 - DNA, 25 bp, Homo sapien
ggggcagtccatgtgtggagctctt

SEQ ID NO: 78873 - DNA, 25 bp, Homo sapien
ggggcagtgtccagcaatggataag

SEQ ID NO: 78874 - DNA, 25 bp, Homo sapien
ggggcagtgtccaggaatggataag

SEQ ID NO: 78875 - DNA, 25 bp, Homo sapien
ggggcatcgtgaatctccctagtga

SEQ ID NO: 78876 - DNA, 25 bp, Homo sapien
ggggcatcgtgactctccctagtga

SEQ ID NO: 78877 - DNA, 25 bp, Homo sapien
ggggcatgtcttcaatgctctggca

SEQ ID NO: 78878 - DNA, 25 bp, Homo sapien
ggggcatgtctttaatgctctggca

SEQ ID NO: 78879 - DNA, 25 bp, Homo sapien
ggggcctaaaacctagactctgctc

SEQ ID NO: 78880 - DNA, 25 bp, Homo sapien
ggggcctaaaagctagactctgctc

SEQ ID NO: 78881 - DNA, 25 bp, Homo sapien
ggggcctacgcctcagctcttagac

SEQ ID NO: 78882 - DNA, 25 bp, Homo sapien
ggggcctatgcctcagctcttagac

SEQ ID NO: 78883 - DNA, 25 bp, Homo sapien
ggggcctgcctgataagtcacaatg

SEQ ID NO: 78884 - DNA, 25 bp, Homo sapien
ggggcctgcctggtaagtcacaatg

SEQ ID NO: 78885 - DNA, 25 bp, Homo sapien
ggggcctgggcgccagccaagactt

SEQ ID NO: 78886 - DNA, 25 bp, Homo sapien
ggggcctgggcgccggccaagactt

SEQ ID NO: 78887 - DNA, 25 bp, Homo sapien
ggggctcaagagaaagtaagaaatc

SEQ ID NO: 78888 - DNA, 25 bp, Homo sapien
ggggctcaagaggaagtaagaaatc

SEQ ID NO: 78889 - DNA, 25 bp, Homo sapien
ggggctcaataaggtaatggttcaa

SEQ ID NO: 78890 - DNA, 25 bp, Homo sapien
ggggctcaataatgtaatggttcaa

SEQ ID NO: 78891 - DNA, 25 bp, Homo sapien
ggggctcttttctaagtgcatgtga

SEQ ID NO: 78892 - DNA, 25 bp, Homo sapien
ggggctcttttgtaagtgcatgtga

SEQ ID NO: 78893 - DNA, 25 bp, Homo sapien
ggggctgcacctaacttctgccaac

SEQ ID NO: 78894 - DNA, 25 bp, Homo sapien
ggggctgcatctaacttctgccaac

SEQ ID NO: 78895 - DNA, 25 bp, Homo sapien
ggggctggacagacgatttccaggg

SEQ ID NO: 78896 - DNA, 25 bp, Homo sapien
ggggctggacagactatttccaggg

SEQ ID NO: 78897 - DNA, 25 bp, Homo sapien
ggggctgtttcaggaaagttctcac

SEQ ID NO: 78898 - DNA, 25 bp, Homo sapien
ggggctgtttcagtaaagttctcac

SEQ ID NO: 78899 - DNA, 25 bp, Homo sapien
ggggcttagatttactacaaattat

SEQ ID NO: 78900 - DNA, 25 bp, Homo sapien
ggggcttagatttattacaaattat

SEQ ID NO: 78901 - DNA, 25 bp, Homo sapien
ggggctttctttagaatgactgttt

SEQ ID NO: 78902 - DNA, 25 bp, Homo sapien
ggggctttgtttagaatgactgttt

SEQ ID NO: 78903 - DNA, 25 bp, Homo sapien
gggggaacagccatgtcttctgaaa

SEQ ID NO: 78904 - DNA, 25 bp, Homo sapien
gggggaacagccgtgtcttctgaaa

SEQ ID NO: 78905 - DNA, 25 bp, Homo sapien
gggggaagtagttgttctcagatgt

SEQ ID NO: 78906 - DNA, 25 bp, Homo sapien
gggggaagtagttgttttcagatgt

SEQ ID NO: 78907 - DNA, 25 bp, Homo sapien
gggggaatagcattacctgaaacaa

SEQ ID NO: 78908 - DNA, 25 bp, Homo sapien
gggggaatcgcattacctgaaacaa

SEQ ID NO: 78909 - DNA, 25 bp, Homo sapien
gggggaatcgttctggaggctctgg

SEQ ID NO: 78910 - DNA, 25 bp, Homo sapien
gggggaattgtgtggaatggaatag

SEQ ID NO: 78911 - DNA, 25 bp, Homo sapien
gggggaattgtgtgtaatggaatag

SEQ ID NO: 78912 - DNA, 25 bp, Homo sapien
gggggaattgttctggaggctctgg

SEQ ID NO: 78913 - DNA, 25 bp, Homo sapien
gggggagtttgtttaaataagttag

SEQ ID NO: 78914 - DNA, 25 bp, Homo sapien
gggggagtttgtttcaataagttag

SEQ ID NO: 78915 - DNA, 25 bp, Homo sapien
gggggatgcacttgaaataaggatc

SEQ ID NO: 78916 - DNA, 25 bp, Homo sapien
gggggatgcacttgaagtaaggatc

SEQ ID NO: 78917 - DNA, 25 bp, Homo sapien
gggggcctgcagtggacgagtctat

SEQ ID NO: 78918 - DNA, 25 bp, Homo sapien
gggggcctgcagtggaggagtctat

SEQ ID NO: 78919 - DNA, 25 bp, Homo sapien
gggggcctgcctgataagtcacaat

SEQ ID NO: 78920 - DNA, 25 bp, Homo sapien
gggggcctgcctggtaagtcacaat

SEQ ID NO: 78921 - DNA, 25 bp, Homo sapien
gggggccttctctgattctgctcct

SEQ ID NO: 78922 - DNA, 25 bp, Homo sapien
gggggccttctctgtttctgctcct

SEQ ID NO: 78923 - DNA, 25 bp, Homo sapien
gggggctttctttagaatgactgtt

SEQ ID NO: 78924 - DNA, 25 bp, Homo sapien
gggggctttgtttagaatgactgtt

SEQ ID NO: 78925 - DNA, 25 bp, Homo sapien
gggggtacaggcagccatcaatatc

SEQ ID NO: 78926 - DNA, 25 bp, Homo sapien
gggggtacaggtagccatcaatatc

SEQ ID NO: 78927 - DNA, 25 bp, Homo sapien
gggggtagaggtttgcctatgtgat

SEQ ID NO: 78928 - DNA, 25 bp, Homo sapien
gggggtagaggtttgcttatgtgat

SEQ ID NO: 78929 - DNA, 25 bp, Homo sapien
gggggtcagaaacatttggatggaa

SEQ ID NO: 78930 - DNA, 25 bp, Homo sapien
gggggtcagaaatatttggatggaa

SEQ ID NO: 78931 - DNA, 25 bp, Homo sapien
gggggtcctgtgtaactctacatca

SEQ ID NO: 78932 - DNA, 25 bp, Homo sapien
gggggtcctgtgtacctctacatca

SEQ ID NO: 78933 - DNA, 25 bp, Homo sapien
gggggtggcttaatgacatagcagc

SEQ ID NO: 78934 - DNA, 25 bp, Homo sapien
gggggtggtttaatgacatagcagc

SEQ ID NO: 78935 - DNA, 25 bp, Homo sapien
gggggttaaggcttcaacatatgaa

SEQ ID NO: 78936 - DNA, 25 bp, Homo sapien
gggggttaaggcttgaacatatgaa

SEQ ID NO: 78937 - DNA, 25 bp, Homo sapien
ggggtaagagttgactcatcattgg

SEQ ID NO: 78938 - DNA, 25 bp, Homo sapien
ggggtaagagttgagtcatcattgg

SEQ ID NO: 78939 - DNA, 25 bp, Homo sapien
ggggtaagcacgatgaccaccttct

SEQ ID NO: 78940 - DNA, 25 bp, Homo sapien
ggggtaagcacgatgatcaccttct

SEQ ID NO: 78941 - DNA, 25 bp, Homo sapien
ggggtaaggatgtctcatatcagta

SEQ ID NO: 78942 - DNA, 25 bp, Homo sapien
ggggtaaggttgtctcatatcagta

SEQ ID NO: 78943 - DNA, 25 bp, Homo sapien
ggggtactactatacaactgaggca

SEQ ID NO: 78944 - DNA, 25 bp, Homo sapien
ggggtactgctatacaactgaggca

SEQ ID NO: 78945 - DNA, 25 bp, Homo sapien
ggggtagacacaatagcctcaggcc

SEQ ID NO: 78946 - DNA, 25 bp, Homo sapien
ggggtagacacgatagcctcaggcc

SEQ ID NO: 78947 - DNA, 25 bp, Homo sapien
ggggtagtgcaaccaacaatgtttt

SEQ ID NO: 78948 - DNA, 25 bp, Homo sapien
ggggtagtgcaaccaataatgtttt

SEQ ID NO: 78949 - DNA, 25 bp, Homo sapien
ggggtatcaatgagagaagaggctg

SEQ ID NO: 78950 - DNA, 25 bp, Homo sapien
ggggtatcagtgagagaagaggctg

SEQ ID NO: 78951 - DNA, 25 bp, Homo sapien
ggggtcagaaacatttggatggaat

SEQ ID NO: 78952 - DNA, 25 bp, Homo sapien
ggggtcagaaatatttggatggaat

SEQ ID NO: 78953 - DNA, 25 bp, Homo sapien
ggggtcaggagttccgagagacacc

SEQ ID NO: 78954 - DNA, 25 bp, Homo sapien
ggggtcaggagttcggagagacacc

SEQ ID NO: 78955 - DNA, 25 bp, Homo sapien
ggggtcctgtgtaactctacatcag

SEQ ID NO: 78956 - DNA, 25 bp, Homo sapien
ggggtcctgtgtacctctacatcag

SEQ ID NO: 78957 - DNA, 25 bp, Homo sapien
ggggtgacacaaggcatgcagaaac

SEQ ID NO: 78958 - DNA, 25 bp, Homo sapien
ggggtgacacaaggtatgcagaaac

SEQ ID NO: 78959 - DNA, 25 bp, Homo sapien
ggggtgattatagggaacaattaag

SEQ ID NO: 78960 - DNA, 25 bp, Homo sapien
ggggtgattatagggagcaattaag

SEQ ID NO: 78961 - DNA, 25 bp, Homo sapien
ggggtgccagtgaacaagtccccac

SEQ ID NO: 78962 - DNA, 25 bp, Homo sapien
ggggtgccggtgaacaagtccccac

SEQ ID NO: 78963 - DNA, 25 bp, Homo sapien
ggggtggaagacactgaaatgaatt

SEQ ID NO: 78964 - DNA, 25 bp, Homo sapien
ggggtggaagacgctgaaatgaatt

SEQ ID NO: 78965 - DNA, 25 bp, Homo sapien
ggggtggcatgtccaaagactcaga

SEQ ID NO: 78966 - DNA, 25 bp, Homo sapien
ggggtggcatgtcgaaagactcaga

SEQ ID NO: 78967 - DNA, 25 bp, Homo sapien
ggggtggggcaatagactcaacctc

SEQ ID NO: 78968 - DNA, 25 bp, Homo sapien
ggggtggggcaatagattcaacctc

SEQ ID NO: 78969 - DNA, 25 bp, Homo sapien
ggggtgtcataatgtggtcctgata

SEQ ID NO: 78970 - DNA, 25 bp, Homo sapien
ggggtgtcataatttggtcctgata

SEQ ID NO: 78971 - DNA, 25 bp, Homo sapien
ggggtgtgacaatgactgcaaagct

SEQ ID NO: 78972 - DNA, 25 bp, Homo sapien
ggggtgtgagaatgactgcaaagct

SEQ ID NO: 78973 - DNA, 25 bp, Homo sapien
ggggttcgctgaattattcttgttt

SEQ ID NO: 78974 - DNA, 25 bp, Homo sapien
ggggttcgctgagttattcttgttt

SEQ ID NO: 78975 - DNA, 25 bp, Homo sapien
ggggttgaaatgcatgctccccaag

SEQ ID NO: 78976 - DNA, 25 bp, Homo sapien
ggggttgaattgcatgctccccaag

SEQ ID NO: 78977 - DNA, 25 bp, Homo sapien
ggggttgccaataggaaagtggaat

SEQ ID NO: 78978 - DNA, 25 bp, Homo sapien
ggggttgccaataggagagtggaat

SEQ ID NO: 78979 - DNA, 25 bp, Homo sapien
ggggttgccagacacctagtcctgg

SEQ ID NO: 78980 - DNA, 25 bp, Homo sapien
ggggttgcctgacacctagtcctgg

SEQ ID NO: 78981 - DNA, 25 bp, Homo sapien
ggggtttgaactcatctctgaaaat

SEQ ID NO: 78982 - DNA, 25 bp, Homo sapien
ggggtttgagttgagccaggatggg

SEQ ID NO: 78983 - DNA, 25 bp, Homo sapien
ggggtttgatctcatctctgaaaat

SEQ ID NO: 78984 - DNA, 25 bp, Homo sapien
ggggtttgatttgagccaggatggg

SEQ ID NO: 78985 - DNA, 25 bp, Homo sapien
gggtaaaagtcaggcaggttttctt

SEQ ID NO: 78986 - DNA, 25 bp, Homo sapien
gggtaaaagtcagtcaggttttctt

SEQ ID NO: 78987 - DNA, 25 bp, Homo sapien
gggtaaacctaacaagaatcatctt

SEQ ID NO: 78988 - DNA, 25 bp, Homo sapien
gggtaaacttaacaagaatcatctt

SEQ ID NO: 78989 - DNA, 25 bp, Homo sapien
gggtaaagacacaactatggctcac

SEQ ID NO: 78990 - DNA, 25 bp, Homo sapien
gggtaaagacacagctatggctcac

SEQ ID NO: 78991 - DNA, 25 bp, Homo sapien
gggtaaattctgcttcaatgaaagt

SEQ ID NO: 78992 - DNA, 25 bp, Homo sapien
gggtaaattctgcttccatgaaagt

SEQ ID NO: 78993 - DNA, 25 bp, Homo sapien
gggtaacagcattcaccgacagggg

SEQ ID NO: 78994 - DNA, 25 bp, Homo sapien
gggtaacagcattcactgacagggg

SEQ ID NO: 78995 - DNA, 25 bp, Homo sapien
gggtaacatctacggatctgtggag

SEQ ID NO: 78996 - DNA, 25 bp, Homo sapien
gggtaacatctacgtatctgtggag

SEQ ID NO: 78997 - DNA, 25 bp, Homo sapien
gggtaactttaattcttcctacttg

SEQ ID NO: 78998 - DNA, 25 bp, Homo sapien
gggtaactttaatttttcctacttg

SEQ ID NO: 78999 - DNA, 25 bp, Homo sapien
gggtaagagttgactcatcattgga

SEQ ID NO: 79000 - DNA, 25 bp, Homo sapien
gggtaagagttgagtcatcattgga

SEQ ID NO: 79001 - DNA, 25 bp, Homo sapien
gggtaagccacaaggcattgtcatc

SEQ ID NO: 79002 - DNA, 25 bp, Homo sapien
gggtaagccacgaggcattgtcatc

SEQ ID NO: 79003 - DNA, 25 bp, Homo sapien
gggtaaggatgagaaagctgtaaaa

SEQ ID NO: 79004 - DNA, 25 bp, Homo sapien
gggtaaggatgtctcatatcagtat

SEQ ID NO: 79005 - DNA, 25 bp, Homo sapien
gggtaaggctgagaaagctgtaaaa

SEQ ID NO: 79006 - DNA, 25 bp, Homo sapien
gggtaaggttgtctcatatcagtat

SEQ ID NO: 79007 - DNA, 25 bp, Homo sapien
gggtaatcacgacaacacaatattg

SEQ ID NO: 79008 - DNA, 25 bp, Homo sapien
gggtaatcatgacaacacaatattg

SEQ ID NO: 79009 - DNA, 25 bp, Homo sapien
gggtaatctacttctaagccttaag

SEQ ID NO: 79010 - DNA, 25 bp, Homo sapien
gggtaatctgcttctaagccttaag

SEQ ID NO: 79011 - DNA, 25 bp, Homo sapien
gggtacaggcagccatcaatatctt

SEQ ID NO: 79012 - DNA, 25 bp, Homo sapien
gggtacaggtagccatcaatatctt

SEQ ID NO: 79013 - DNA, 25 bp, Homo sapien
gggtaccaatgatcctatatttgtg

SEQ ID NO: 79014 - DNA, 25 bp, Homo sapien
gggtaccaatgattctatatttgtg

SEQ ID NO: 79015 - DNA, 25 bp, Homo sapien
gggtaccttcatcggactcatcaaa

SEQ ID NO: 79016 - DNA, 25 bp, Homo sapien
gggtacctttatcggactcatcaaa

SEQ ID NO: 79017 - DNA, 25 bp, Homo sapien
gggtactagctctgtcataagagtc

SEQ ID NO: 79018 - DNA, 25 bp, Homo sapien
gggtactagctctgtcgtaagagtc

SEQ ID NO: 79019 - DNA, 25 bp, Homo sapien
gggtagaagtataacttgaaagagg

SEQ ID NO: 79020 - DNA, 25 bp, Homo sapien
gggtagaagtattacttgaaagagg

SEQ ID NO: 79021 - DNA, 25 bp, Homo sapien
gggtagacctgacagcaactggaac

SEQ ID NO: 79022 - DNA, 25 bp, Homo sapien
gggtagacctgatagcaactggaac

SEQ ID NO: 79023 - DNA, 25 bp, Homo sapien
gggtagctgcactaaacaatggatt

SEQ ID NO: 79024 - DNA, 25 bp, Homo sapien
gggtagctgcactgaacaatggatt

SEQ ID NO: 79025 - DNA, 25 bp, Homo sapien
gggtaggtaattcaccaggtgttat

SEQ ID NO: 79026 - DNA, 25 bp, Homo sapien
gggtaggtaattcaccgggtgttat

SEQ ID NO: 79027 - DNA, 25 bp, Homo sapien
gggtagtgactttactcggatagag

SEQ ID NO: 79028 - DNA, 25 bp, Homo sapien
gggtagtgactttacttggatagag

SEQ ID NO: 79029 - DNA, 25 bp, Homo sapien
gggtatcaatgagagaagaggctgg

SEQ ID NO: 79030 - DNA, 25 bp, Homo sapien
gggtatcagtgagagaagaggctgg

SEQ ID NO: 79031 - DNA, 25 bp, Homo sapien
gggtatcatcaggtctctcctttgg

SEQ ID NO: 79032 - DNA, 25 bp, Homo sapien
gggtatcatcagttctctcctttgg

SEQ ID NO: 79033 - DNA, 25 bp, Homo sapien
gggtatctaatagaagcatcttagt

SEQ ID NO: 79034 - DNA, 25 bp, Homo sapien
gggtatctgatagaagcatcttagt

SEQ ID NO: 79035 - DNA, 25 bp, Homo sapien
gggtatgttcacgatatcactgatt

SEQ ID NO: 79036 - DNA, 25 bp, Homo sapien
gggtatgttcatgatatcactgatt

SEQ ID NO: 79037 - DNA, 25 bp, Homo sapien
gggtattacggttcacaatgagatt

SEQ ID NO: 79038 - DNA, 25 bp, Homo sapien
gggtattatggttcacaatgagatt

SEQ ID NO: 79039 - DNA, 25 bp, Homo sapien
gggtattattttgatacagattaca

SEQ ID NO: 79040 - DNA, 25 bp, Homo sapien
gggtattattttgatagagattaca

SEQ ID NO: 79041 - DNA, 25 bp, Homo sapien
gggtattgtaatcggagcagggctg

SEQ ID NO: 79042 - DNA, 25 bp, Homo sapien
gggtattgtaattggagcagggctg

SEQ ID NO: 79043 - DNA, 25 bp, Homo sapien
gggtatttactctaggaaatcttat

SEQ ID NO: 79044 - DNA, 25 bp, Homo sapien
gggtatttactcttggaaatcttat

SEQ ID NO: 79045 - DNA, 25 bp, Homo sapien
gggtcactggaaataccctcacaat

SEQ ID NO: 79046 - DNA, 25 bp, Homo sapien
gggtcactggaaattccctcacaat

SEQ ID NO: 79047 - DNA, 25 bp, Homo sapien
gggtcagctttctctcccattctgg

SEQ ID NO: 79048 - DNA, 25 bp, Homo sapien
gggtcagctttgtctcccattctgg

SEQ ID NO: 79049 - DNA, 25 bp, Homo sapien
gggtcaggctgcatgaatcactttc

SEQ ID NO: 79050 - DNA, 25 bp, Homo sapien
gggtcaggctgcgtgaatcactttc

SEQ ID NO: 79051 - DNA, 25 bp, Homo sapien
gggtcatctgccttttctctcctgg

SEQ ID NO: 79052 - DNA, 25 bp, Homo sapien
gggtcatctgcgttttctctcctgg

SEQ ID NO: 79053 - DNA, 25 bp, Homo sapien
gggtcatgggcagagatggtgctta

SEQ ID NO: 79054 - DNA, 25 bp, Homo sapien
gggtcatggtcagagatggtgctta

SEQ ID NO: 79055 - DNA, 25 bp, Homo sapien
gggtcattaaaacgtgattaagtcc

SEQ ID NO: 79056 - DNA, 25 bp, Homo sapien
gggtcattaaaacgtggttaagtcc

SEQ ID NO: 79057 - DNA, 25 bp, Homo sapien
gggtccagcattaaacagctctgag

SEQ ID NO: 79058 - DNA, 25 bp, Homo sapien
gggtccagcattaaccagctctgag

SEQ ID NO: 79059 - DNA, 25 bp, Homo sapien
gggtccagccatgtcatcgaatcgt

SEQ ID NO: 79060 - DNA, 25 bp, Homo sapien
gggtccagccatttcatcgaatcgt

SEQ ID NO: 79061 - DNA, 25 bp, Homo sapien
gggtcctccatccacaggggctgac

SEQ ID NO: 79062 - DNA, 25 bp, Homo sapien
gggtcctctatagcacttactagag

SEQ ID NO: 79063 - DNA, 25 bp, Homo sapien
gggtcctctatccacaggggctgac

SEQ ID NO: 79064 - DNA, 25 bp, Homo sapien
gggtcctctgtagcacttactagag

SEQ ID NO: 79065 - DNA, 25 bp, Homo sapien
gggtcctgaatacactcacttatgc

SEQ ID NO: 79066 - DNA, 25 bp, Homo sapien
gggtcctgaatactctcacttatgc

SEQ ID NO: 79067 - DNA, 25 bp, Homo sapien
gggtcctgtgtaactctacatcaga

SEQ ID NO: 79068 - DNA, 25 bp, Homo sapien
gggtcctgtgtacctctacatcaga

SEQ ID NO: 79069 - DNA, 25 bp, Homo sapien
gggtcgtgattcccagcaataaaaa

SEQ ID NO: 79070 - DNA, 25 bp, Homo sapien
gggtcgtgattccgagcaataaaaa

SEQ ID NO: 79071 - DNA, 25 bp, Homo sapien
gggtctaaattctcctgaaatcctt

SEQ ID NO: 79072 - DNA, 25 bp, Homo sapien
gggtctaaattcttctgaaatcctt

SEQ ID NO: 79073 - DNA, 25 bp, Homo sapien
gggtctacacttttagaaacaaatc

SEQ ID NO: 79074 - DNA, 25 bp, Homo sapien
gggtctacgcttttagaaacaaatc

SEQ ID NO: 79075 - DNA, 25 bp, Homo sapien
gggtctcacataaaccaaaacttac

SEQ ID NO: 79076 - DNA, 25 bp, Homo sapien
gggtctcacataatccaaaacttac

SEQ ID NO: 79077 - DNA, 25 bp, Homo sapien
gggtctccctgctttgcgtcttgtg

SEQ ID NO: 79078 - DNA, 25 bp, Homo sapien
gggtctccctgctttgtgtcttgtg

SEQ ID NO: 79079 - DNA, 25 bp, Homo sapien
gggtctcttgctccctactgccttg

SEQ ID NO: 79080 - DNA, 25 bp, Homo sapien
gggtctcttgctccctcctgccttg

SEQ ID NO: 79081 - DNA, 25 bp, Homo sapien
gggtctgtgtctacacataaaggat

SEQ ID NO: 79082 - DNA, 25 bp, Homo sapien
gggtctgtgtctccacataaaggat

SEQ ID NO: 79083 - DNA, 25 bp, Homo sapien
gggtcttaaacttgctaggataaga

SEQ ID NO: 79084 - DNA, 25 bp, Homo sapien
gggtcttaagcttgctaggataaga

SEQ ID NO: 79085 - DNA, 25 bp, Homo sapien
gggtcttacgagccattgaatccaa

SEQ ID NO: 79086 - DNA, 25 bp, Homo sapien
gggtcttatgagccattgaatccaa

SEQ ID NO: 79087 - DNA, 25 bp, Homo sapien
gggtcttgaatctcatgtaggaaga

SEQ ID NO: 79088 - DNA, 25 bp, Homo sapien
gggtcttgaatctcgtgtaggaaga

SEQ ID NO: 79089 - DNA, 25 bp, Homo sapien
gggtctttcgcgaagcccaatctta

SEQ ID NO: 79090 - DNA, 25 bp, Homo sapien
gggtcttttgcgaagcccaatctta

SEQ ID NO: 79091 - DNA, 25 bp, Homo sapien
gggtgaaaaggacgctatgtgctgg

SEQ ID NO: 79092 - DNA, 25 bp, Homo sapien
gggtgaaaaggatgctatgtgctgg

SEQ ID NO: 79093 - DNA, 25 bp, Homo sapien
gggtgaaagccatgtgctcttcctg

SEQ ID NO: 79094 - DNA, 25 bp, Homo sapien
gggtgaaagccgtgtgctcttcctg

SEQ ID NO: 79095 - DNA, 25 bp, Homo sapien
gggtgaaggacaattattttttaga

SEQ ID NO: 79096 - DNA, 25 bp, Homo sapien
gggtgaaggacgattattttttaga

SEQ ID NO: 79097 - DNA, 25 bp, Homo sapien
gggtgaatagaaatgaagaactgga

SEQ ID NO: 79098 - DNA, 25 bp, Homo sapien
gggtgaatggaaatgaagaactgga

SEQ ID NO: 79099 - DNA, 25 bp, Homo sapien
gggtgacacaaggcatgcagaaacc

SEQ ID NO: 79100 - DNA, 25 bp, Homo sapien
gggtgacacaaggtatgcagaaacc

SEQ ID NO: 79101 - DNA, 25 bp, Homo sapien
gggtgaggcatcctacaagcattgt

SEQ ID NO: 79102 - DNA, 25 bp, Homo sapien
gggtgaggcatcctactagcattgt

SEQ ID NO: 79103 - DNA, 25 bp, Homo sapien
gggtgataagaatgccaattaaatg

SEQ ID NO: 79104 - DNA, 25 bp, Homo sapien
gggtgataagaatgccgattaaatg

SEQ ID NO: 79105 - DNA, 25 bp, Homo sapien
gggtgatagagcagaaccctttttc

SEQ ID NO: 79106 - DNA, 25 bp, Homo sapien
gggtgatagagcggaaccctttttc

SEQ ID NO: 79107 - DNA, 25 bp, Homo sapien
gggtgatatctgagtgtggcctgaa

SEQ ID NO: 79108 - DNA, 25 bp, Homo sapien
gggtgatatttgagtgtggcctgaa

SEQ ID NO: 79109 - DNA, 25 bp, Homo sapien
gggtgatcctgaaggtcatggatgt

SEQ ID NO: 79110 - DNA, 25 bp, Homo sapien
gggtgatcctgatggtcatggatgt

SEQ ID NO: 79111 - DNA, 25 bp, Homo sapien
gggtgattggtacaactttctattc

SEQ ID NO: 79112 - DNA, 25 bp, Homo sapien
gggtgattggtagaactttctattc

SEQ ID NO: 79113 - DNA, 25 bp, Homo sapien
gggtgcaaaagtggcgctttctgct

SEQ ID NO: 79114 - DNA, 25 bp, Homo sapien
gggtgcaaaagtggcgttttctgct

SEQ ID NO: 79115 - DNA, 25 bp, Homo sapien
gggtgcagacgtgtgtaggagcata

SEQ ID NO: 79116 - DNA, 25 bp, Homo sapien
gggtgcagacgtgtgtgggagcata

SEQ ID NO: 79117 - DNA, 25 bp, Homo sapien
gggtggaaagagagaaccctgctca

SEQ ID NO: 79118 - DNA, 25 bp, Homo sapien
gggtggaagaatgaaagaacgactg

SEQ ID NO: 79119 - DNA, 25 bp, Homo sapien
gggtggaagaatgagagaacgactg

SEQ ID NO: 79120 - DNA, 25 bp, Homo sapien
gggtggaagacactgaaatgaattt

SEQ ID NO: 79121 - DNA, 25 bp, Homo sapien
gggtggaagacgctgaaatgaattt

SEQ ID NO: 79122 - DNA, 25 bp, Homo sapien
gggtggaaggagagaaccctgctca

SEQ ID NO: 79123 - DNA, 25 bp, Homo sapien
gggtggatgcgaacatgaaaagcaa

SEQ ID NO: 79124 - DNA, 25 bp, Homo sapien
gggtggatgtgaacatgaaaagcaa

SEQ ID NO: 79125 - DNA, 25 bp, Homo sapien
gggtggcatgtccaaagactcagaa

SEQ ID NO: 79126 - DNA, 25 bp, Homo sapien
gggtggcatgtcgaaagactcagaa

SEQ ID NO: 79127 - DNA, 25 bp, Homo sapien
gggtggggccaagaatttctagttc

SEQ ID NO: 79128 - DNA, 25 bp, Homo sapien
gggtggggccaagactttctagttc

SEQ ID NO: 79129 - DNA, 25 bp, Homo sapien
gggtgggtgtccaaactggtggtgt

SEQ ID NO: 79130 - DNA, 25 bp, Homo sapien
gggtgggtgtccgaactggtggtgt

SEQ ID NO: 79131 - DNA, 25 bp, Homo sapien
gggtggtatggccgtagactagagc

SEQ ID NO: 79132 - DNA, 25 bp, Homo sapien
gggtggtatggctgtagactagagc

SEQ ID NO: 79133 - DNA, 25 bp, Homo sapien
gggtggttgcccagctcattagcca

SEQ ID NO: 79134 - DNA, 25 bp, Homo sapien
gggtggttggccagctcattagcca

SEQ ID NO: 79135 - DNA, 25 bp, Homo sapien
gggtgtaaaaagaaaaaagcatcat

SEQ ID NO: 79136 - DNA, 25 bp, Homo sapien
gggtgtaaaaagataaaagcatcat

SEQ ID NO: 79137 - DNA, 25 bp, Homo sapien
gggtgtaaacagtacctgacaaaat

SEQ ID NO: 79138 - DNA, 25 bp, Homo sapien
gggtgtaaatagtacctgacaaaat

SEQ ID NO: 79139 - DNA, 25 bp, Homo sapien
gggtgtagacagtaaatacacatta

SEQ ID NO: 79140 - DNA, 25 bp, Homo sapien
gggtgtagatagtaaatacacatta

SEQ ID NO: 79141 - DNA, 25 bp, Homo sapien
gggtgtcagccccacagaggagaag

SEQ ID NO: 79142 - DNA, 25 bp, Homo sapien
gggtgtcagccctacagaggagaag

SEQ ID NO: 79143 - DNA, 25 bp, Homo sapien
gggtgtcataatgtggtcctgatac

SEQ ID NO: 79144 - DNA, 25 bp, Homo sapien
gggtgtcataatttggtcctgatac

SEQ ID NO: 79145 - DNA, 25 bp, Homo sapien
gggtgtccaaactggtggtgttagt

SEQ ID NO: 79146 - DNA, 25 bp, Homo sapien
gggtgtccgaactggtggtgttagt

SEQ ID NO: 79147 - DNA, 25 bp, Homo sapien
gggtgtctacttatgctaggtgtcg

SEQ ID NO: 79148 - DNA, 25 bp, Homo sapien
gggtgtctacttttgctaggtgtcg

SEQ ID NO: 79149 - DNA, 25 bp, Homo sapien
gggtgtgacaatgactgcaaagctg

SEQ ID NO: 79150 - DNA, 25 bp, Homo sapien
gggtgtgagaatgactgcaaagctg

SEQ ID NO: 79151 - DNA, 25 bp, Homo sapien
gggtgtgcaacactgggttttgctt

SEQ ID NO: 79152 - DNA, 25 bp, Homo sapien
gggtgtgcaacattgggttttgctt

SEQ ID NO: 79153 - DNA, 25 bp, Homo sapien
gggtgttgtacaaatggtagttctt

SEQ ID NO: 79154 - DNA, 25 bp, Homo sapien
gggtgttgtacacatggtagttctt

SEQ ID NO: 79155 - DNA, 25 bp, Homo sapien
gggtgtttccatatatccaaactca

SEQ ID NO: 79156 - DNA, 25 bp, Homo sapien
gggtgtttccatgtatccaaactca

SEQ ID NO: 79157 - DNA, 25 bp, Homo sapien
gggtgtttgtggagatggatggatc

SEQ ID NO: 79158 - DNA, 25 bp, Homo sapien
gggtgtttgtggcgatggatggatc

SEQ ID NO: 79159 - DNA, 25 bp, Homo sapien
gggttaaatggtgactaatcgtaat

SEQ ID NO: 79160 - DNA, 25 bp, Homo sapien
gggttaaattgtgactaatcgtaat

SEQ ID NO: 79161 - DNA, 25 bp, Homo sapien
gggttaaggcttcaacatatgaaat

SEQ ID NO: 79162 - DNA, 25 bp, Homo sapien
gggttaaggcttgaacatatgaaat

SEQ ID NO: 79163 - DNA, 25 bp, Homo sapien
gggttaaggttttatcatattgtac

SEQ ID NO: 79164 - DNA, 25 bp, Homo sapien
gggttaaggttttgtcatattgtac

SEQ ID NO: 79165 - DNA, 25 bp, Homo sapien
gggttacaatttgtcatcttgataa

SEQ ID NO: 79166 - DNA, 25 bp, Homo sapien
gggttacaatttgttatcttgataa

SEQ ID NO: 79167 - DNA, 25 bp, Homo sapien
gggttaccaacaagagcaaaagaga

SEQ ID NO: 79168 - DNA, 25 bp, Homo sapien
gggttaccaacaggagcaaaagaga

SEQ ID NO: 79169 - DNA, 25 bp, Homo sapien
gggttagaacaaagataataatctg

SEQ ID NO: 79170 - DNA, 25 bp, Homo sapien
gggttagaacagagataataatctg

SEQ ID NO: 79171 - DNA, 25 bp, Homo sapien
gggttagggcatgctgatgagctga

SEQ ID NO: 79172 - DNA, 25 bp, Homo sapien
gggttagggcatgctgttgagctga

SEQ ID NO: 79173 - DNA, 25 bp, Homo sapien
gggttatgaaaagacatcctaactg

SEQ ID NO: 79174 - DNA, 25 bp, Homo sapien
gggttatgaaaatacatcctaactg

SEQ ID NO: 79175 - DNA, 25 bp, Homo sapien
gggttcacaagcatcagaggcagga

SEQ ID NO: 79176 - DNA, 25 bp, Homo sapien
gggttcacaagcgtcagaggcagga

SEQ ID NO: 79177 - DNA, 25 bp, Homo sapien
gggttccatttacaaagacaaagag

SEQ ID NO: 79178 - DNA, 25 bp, Homo sapien
gggttccatttagaaagacaaagag

SEQ ID NO: 79179 - DNA, 25 bp, Homo sapien
gggttcgctgaattattcttgtttg

SEQ ID NO: 79180 - DNA, 25 bp, Homo sapien
gggttcgctgagttattcttgtttg

SEQ ID NO: 79181 - DNA, 25 bp, Homo sapien
gggttctaaaactctaatctctttc

SEQ ID NO: 79182 - DNA, 25 bp, Homo sapien
gggttctaaaactttaatctctttc

SEQ ID NO: 79183 - DNA, 25 bp, Homo sapien
gggttctctaataatacacagagtg

SEQ ID NO: 79184 - DNA, 25 bp, Homo sapien
gggttctctaataatatacagagtg

SEQ ID NO: 79185 - DNA, 25 bp, Homo sapien
gggttctgagacatactggtttcag

SEQ ID NO: 79186 - DNA, 25 bp, Homo sapien
gggttctgagacgtactggtttcag

SEQ ID NO: 79187 - DNA, 25 bp, Homo sapien
gggttctttcgttctgaaacagcta

SEQ ID NO: 79188 - DNA, 25 bp, Homo sapien
gggttctttggttctgaaacagcta

SEQ ID NO: 79189 - DNA, 25 bp, Homo sapien
gggttgaaatgcatgctccccaagg

SEQ ID NO: 79190 - DNA, 25 bp, Homo sapien
gggttgaattgcatgctccccaagg

SEQ ID NO: 79191 - DNA, 25 bp, Homo sapien
gggttgacacagaaatacagaccca

SEQ ID NO: 79192 - DNA, 25 bp, Homo sapien
gggttgacacagaattacagaccca

SEQ ID NO: 79193 - DNA, 25 bp, Homo sapien
gggttgctttgaagtattcttttat

SEQ ID NO: 79194 - DNA, 25 bp, Homo sapien
gggttgctttgcagtattcttttat

SEQ ID NO: 79195 - DNA, 25 bp, Homo sapien
gggttgtttccaagccctttagatg

SEQ ID NO: 79196 - DNA, 25 bp, Homo sapien
gggttgtttccatgccctttagatg

SEQ ID NO: 79197 - DNA, 25 bp, Homo sapien
gggtttagagacagctgattttcat

SEQ ID NO: 79198 - DNA, 25 bp, Homo sapien
gggtttagagatagctgattttcat

SEQ ID NO: 79199 - DNA, 25 bp, Homo sapien
gggtttcaagactaggaccaagaaa

SEQ ID NO: 79200 - DNA, 25 bp, Homo sapien
gggtttcaagattaggaccaagaaa

SEQ ID NO: 79201 - DNA, 25 bp, Homo sapien
gggtttcagttaacggcaactttag

SEQ ID NO: 79202 - DNA, 25 bp, Homo sapien
gggtttcagttaatggcaactttag

SEQ ID NO: 79203 - DNA, 25 bp, Homo sapien
gggtttcatgattaccaagtggcag

SEQ ID NO: 79204 - DNA, 25 bp, Homo sapien
gggtttcatgattagcaagtggcag

SEQ ID NO: 79205 - DNA, 25 bp, Homo sapien
gggtttcattgagcaaatcatcaaa

SEQ ID NO: 79206 - DNA, 25 bp, Homo sapien
gggtttcattgagcaagtcatcaaa

SEQ ID NO: 79207 - DNA, 25 bp, Homo sapien
gggtttcgcgagatactctctctta

SEQ ID NO: 79208 - DNA, 25 bp, Homo sapien
gggtttcgctagatactctctctta

SEQ ID NO: 79209 - DNA, 25 bp, Homo sapien
gggtttctgttcaggatttagctaa

SEQ ID NO: 79210 - DNA, 25 bp, Homo sapien
gggtttctgttcgggatttagctaa

SEQ ID NO: 79211 - DNA, 25 bp, Homo sapien
gggtttgaactcatctctgaaaatc

SEQ ID NO: 79212 - DNA, 25 bp, Homo sapien
gggtttgagaagaaatatgtcggct

SEQ ID NO: 79213 - DNA, 25 bp, Homo sapien
gggtttgagaaggaatatgtcggct

SEQ ID NO: 79214 - DNA, 25 bp, Homo sapien
gggtttgagttgagccaggatggga

SEQ ID NO: 79215 - DNA, 25 bp, Homo sapien
gggtttgatctcatctctgaaaatc

SEQ ID NO: 79216 - DNA, 25 bp, Homo sapien
gggtttgatttgagccaggatggga

SEQ ID NO: 79217 - DNA, 25 bp, Homo sapien
gggtttgcaggcagagaaaaggagt

SEQ ID NO: 79218 - DNA, 25 bp, Homo sapien
gggtttgcaggtagagaaaaggagt

SEQ ID NO: 79219 - DNA, 25 bp, Homo sapien
gggtttgctgaaaattcaggagggg

SEQ ID NO: 79220 - DNA, 25 bp, Homo sapien
gggtttgctgaacattcaggagggg

SEQ ID NO: 79221 - DNA, 25 bp, Homo sapien
gggtttggagtcatgcaaccaattc

SEQ ID NO: 79222 - DNA, 25 bp, Homo sapien
gggtttggagtcgtgcaaccaattc

SEQ ID NO: 79223 - DNA, 25 bp, Homo sapien
gggttttcaactgacagccttctcc

SEQ ID NO: 79224 - DNA, 25 bp, Homo sapien
gggttttcagctgacagccttctcc

SEQ ID NO: 79225 - DNA, 25 bp, Homo sapien
gggttttgactgggattatgactat

SEQ ID NO: 79226 - DNA, 25 bp, Homo sapien
gggttttgattgggattatgactat

SEQ ID NO: 79227 - DNA, 25 bp, Homo sapien
gggttttgctcaatgtagtcacttt

SEQ ID NO: 79228 - DNA, 25 bp, Homo sapien
gggttttgctcagtgtagtcacttt

SEQ ID NO: 79229 - DNA, 25 bp, Homo sapien
ggtaaaaaaaaagaatgtctcatag

SEQ ID NO: 79230 - DNA, 25 bp, Homo sapien
ggtaaaaaaaatgaatgtctcatag

SEQ ID NO: 79231 - DNA, 25 bp, Homo sapien
ggtaaaaaccagttcagagaaattt

SEQ ID NO: 79232 - DNA, 25 bp, Homo sapien
ggtaaaaaccagttgagagaaattt

SEQ ID NO: 79233 - DNA, 25 bp, Homo sapien
ggtaaaaacgagccactcttctccc

SEQ ID NO: 79234 - DNA, 25 bp, Homo sapien
ggtaaaaataataaagttcaaaagc

SEQ ID NO: 79235 - DNA, 25 bp, Homo sapien
ggtaaaaataataaggttcaaaagc

SEQ ID NO: 79236 - DNA, 25 bp, Homo sapien
ggtaaaaatacaattaggcagaact

SEQ ID NO: 79237 - DNA, 25 bp, Homo sapien
ggtaaaaatacagttaggcagaact

SEQ ID NO: 79238 - DNA, 25 bp, Homo sapien
ggtaaaaatgagccactcttctccc

SEQ ID NO: 79239 - DNA, 25 bp, Homo sapien
ggtaaaacatagcatggaagacagg

SEQ ID NO: 79240 - DNA, 25 bp, Homo sapien
ggtaaaacatagtatggaagacagg

SEQ ID NO: 79241 - DNA, 25 bp, Homo sapien
ggtaaaagaagaccagtagaatctt

SEQ ID NO: 79242 - DNA, 25 bp, Homo sapien
ggtaaaagaggaccagtagaatctt

SEQ ID NO: 79243 - DNA, 25 bp, Homo sapien
ggtaaaagtcaggcaggttttcttg

SEQ ID NO: 79244 - DNA, 25 bp, Homo sapien
ggtaaaagtcagtcaggttttcttg

SEQ ID NO: 79245 - DNA, 25 bp, Homo sapien
ggtaaaatgaggacagaaactgtga

SEQ ID NO: 79246 - DNA, 25 bp, Homo sapien
ggtaaaatgagggcagaaactgtga

SEQ ID NO: 79247 - DNA, 25 bp, Homo sapien
ggtaaacaaagggagcatgacatgg

SEQ ID NO: 79248 - DNA, 25 bp, Homo sapien
ggtaaacaaagtgagcatgacatgg

SEQ ID NO: 79249 - DNA, 25 bp, Homo sapien
ggtaaacatacaactgaggtgatgg

SEQ ID NO: 79250 - DNA, 25 bp, Homo sapien
ggtaaacatacagctgaggtgatgg

SEQ ID NO: 79251 - DNA, 25 bp, Homo sapien
ggtaaagaaaggacatgcgagtgag

SEQ ID NO: 79252 - DNA, 25 bp, Homo sapien
ggtaaagaaagggcatgcgagtgag

SEQ ID NO: 79253 - DNA, 25 bp, Homo sapien
ggtaaagaaatcgtaagtgttcaaa

SEQ ID NO: 79254 - DNA, 25 bp, Homo sapien
ggtaaagaagtcgtaagtgttcaaa

SEQ ID NO: 79255 - DNA, 25 bp, Homo sapien
ggtaaagacacaactatggctcacg

SEQ ID NO: 79256 - DNA, 25 bp, Homo sapien
ggtaaagacacagctatggctcacg

SEQ ID NO: 79257 - DNA, 25 bp, Homo sapien
ggtaaagattaaagaggtgaggatg

SEQ ID NO: 79258 - DNA, 25 bp, Homo sapien
ggtaaagattaaagagttgaggatg

SEQ ID NO: 79259 - DNA, 25 bp, Homo sapien
ggtaaatagagtttgcatgtggaat

SEQ ID NO: 79260 - DNA, 25 bp, Homo sapien
ggtaaatatagtttgcatgtggaat

SEQ ID NO: 79261 - DNA, 25 bp, Homo sapien
ggtaaatatgattgtcacctcctga

SEQ ID NO: 79262 - DNA, 25 bp, Homo sapien
ggtaaatatgattgtcgcctcctga

SEQ ID NO: 79263 - DNA, 25 bp, Homo sapien
ggtaaatcctactacggaatggaga

SEQ ID NO: 79264 - DNA, 25 bp, Homo sapien
ggtaaatcctactatggaatggaga

SEQ ID NO: 79265 - DNA, 25 bp, Homo sapien
ggtaaatggttagaaagggaataaa

SEQ ID NO: 79266 - DNA, 25 bp, Homo sapien
ggtaaatggttagaaatggaataaa

SEQ ID NO: 79267 - DNA, 25 bp, Homo sapien
ggtaacaagttacgacaaagcagca

SEQ ID NO: 79268 - DNA, 25 bp, Homo sapien
ggtaacaagttatgacaaagcagca

SEQ ID NO: 79269 - DNA, 25 bp, Homo sapien
ggtaacagcttccttctggaccggg

SEQ ID NO: 79270 - DNA, 25 bp, Homo sapien
ggtaacagcttctttctggaccggg

SEQ ID NO: 79271 - DNA, 25 bp, Homo sapien
ggtaacagtgtctcgttttcccttt

SEQ ID NO: 79272 - DNA, 25 bp, Homo sapien
ggtaacagtgtcttgttttcccttt

SEQ ID NO: 79273 - DNA, 25 bp, Homo sapien
ggtaacatctacggatctgtggagg

SEQ ID NO: 79274 - DNA, 25 bp, Homo sapien
ggtaacatctacgtatctgtggagg

SEQ ID NO: 79275 - DNA, 25 bp, Homo sapien
ggtaacattcactgactctacacta

SEQ ID NO: 79276 - DNA, 25 bp, Homo sapien
ggtaacattcactggctctacacta

SEQ ID NO: 79277 - DNA, 25 bp, Homo sapien
ggtaaccaactatccgaactgtgtt

SEQ ID NO: 79278 - DNA, 25 bp, Homo sapien
ggtaaccagctatccgaactgtgtt

SEQ ID NO: 79279 - DNA, 25 bp, Homo sapien
ggtaactaggggtcatgtcttgaag

SEQ ID NO: 79280 - DNA, 25 bp, Homo sapien
ggtaactaggggtcgtgtcttgaag

SEQ ID NO: 79281 - DNA, 25 bp, Homo sapien
ggtaactgaatcataggaacagact

SEQ ID NO: 79282 - DNA, 25 bp, Homo sapien
ggtaactgaatcatgggaacagact

SEQ ID NO: 79283 - DNA, 25 bp, Homo sapien
ggtaagacatgcctacttctccttt

SEQ ID NO: 79284 - DNA, 25 bp, Homo sapien
ggtaagacgtgcctacttctccttt

SEQ ID NO: 79285 - DNA, 25 bp, Homo sapien
ggtaagagagacttttctaacaata

SEQ ID NO: 79286 - DNA, 25 bp, Homo sapien
ggtaagagatacttttctaacaata

SEQ ID NO: 79287 - DNA, 25 bp, Homo sapien
ggtaagaggtagaggttggaaggat

SEQ ID NO: 79288 - DNA, 25 bp, Homo sapien
ggtaagaggtagagtttggaaggat

SEQ ID NO: 79289 - DNA, 25 bp, Homo sapien
ggtaagagttgactcatcattggag

SEQ ID NO: 79290 - DNA, 25 bp, Homo sapien
ggtaagagttgagtcatcattggag

SEQ ID NO: 79291 - DNA, 25 bp, Homo sapien
ggtaagatgttggactaagtttatg

SEQ ID NO: 79292 - DNA, 25 bp, Homo sapien
ggtaagattacacgaagagttaaag

SEQ ID NO: 79293 - DNA, 25 bp, Homo sapien
ggtaagattacatgaagagttaaag

SEQ ID NO: 79294 - DNA, 25 bp, Homo sapien
ggtaagattcagaaaaaaatgaaga

SEQ ID NO: 79295 - DNA, 25 bp, Homo sapien
ggtaagattcaggaaaaaatgaaga

SEQ ID NO: 79296 - DNA, 25 bp, Homo sapien
ggtaagattttggactaagtttatg

SEQ ID NO: 79297 - DNA, 25 bp, Homo sapien
ggtaagcacgatgaccaccttctta

SEQ ID NO: 79298 - DNA, 25 bp, Homo sapien
ggtaagcacgatgatcaccttctta

SEQ ID NO: 79299 - DNA, 25 bp, Homo sapien
ggtaagtaataagagtcacaaccac

SEQ ID NO: 79300 - DNA, 25 bp, Homo sapien
ggtaagtaataagagtgacaaccac

SEQ ID NO: 79301 - DNA, 25 bp, Homo sapien
ggtaagtcatttcaaattttcacta

SEQ ID NO: 79302 - DNA, 25 bp, Homo sapien
ggtaagtcattttaaattttcacta

SEQ ID NO: 79303 - DNA, 25 bp, Homo sapien
ggtaagtttgaaaaatgtcttaaca

SEQ ID NO: 79304 - DNA, 25 bp, Homo sapien
ggtaagtttgagaaatgtcttaaca

SEQ ID NO: 79305 - DNA, 25 bp, Homo sapien
ggtaataatacctacacccaaagat

SEQ ID NO: 79306 - DNA, 25 bp, Homo sapien
ggtaataatacctatacccaaagat

SEQ ID NO: 79307 - DNA, 25 bp, Homo sapien
ggtaataggaggtgcatctgagtca

SEQ ID NO: 79308 - DNA, 25 bp, Homo sapien
ggtaataggcggtgcatctgagtca

SEQ ID NO: 79309 - DNA, 25 bp, Homo sapien
ggtaatcacgacaacacaatattgg

SEQ ID NO: 79310 - DNA, 25 bp, Homo sapien
ggtaatcatgacaacacaatattgg

SEQ ID NO: 79311 - DNA, 25 bp, Homo sapien
ggtaatgaagaccactgcagtgtgt

SEQ ID NO: 79312 - DNA, 25 bp, Homo sapien
ggtaatgaggaccactgcagtgtgt

SEQ ID NO: 79313 - DNA, 25 bp, Homo sapien
ggtaatgcccattcctggttcatga

SEQ ID NO: 79314 - DNA, 25 bp, Homo sapien
ggtaatgcccattcttggttcatga

SEQ ID NO: 79315 - DNA, 25 bp, Homo sapien
ggtaatggatatgatggttatcttg

SEQ ID NO: 79316 - DNA, 25 bp, Homo sapien
ggtaatggatatgatgtttatcttg

SEQ ID NO: 79317 - DNA, 25 bp, Homo sapien
ggtaattaaagtcatgagagtggac

SEQ ID NO: 79318 - DNA, 25 bp, Homo sapien
ggtaattaaagtgatgagagtggac

SEQ ID NO: 79319 - DNA, 25 bp, Homo sapien
ggtaattcaatgcataacatatttt

SEQ ID NO: 79320 - DNA, 25 bp, Homo sapien
ggtaattcaatgcgtaacatatttt

SEQ ID NO: 79321 - DNA, 25 bp, Homo sapien
ggtaattcaccaggtgttattcttt

SEQ ID NO: 79322 - DNA, 25 bp, Homo sapien
ggtaattcaccgggtgttattcttt

SEQ ID NO: 79323 - DNA, 25 bp, Homo sapien
ggtacaaaaccataatgactgattc

SEQ ID NO: 79324 - DNA, 25 bp, Homo sapien
ggtacaaaatgcctagcaaaatgta

SEQ ID NO: 79325 - DNA, 25 bp, Homo sapien
ggtacaaaatgcctaggaaaatgta

SEQ ID NO: 79326 - DNA, 25 bp, Homo sapien
ggtacaaacaagcccggacagtgaa

SEQ ID NO: 79327 - DNA, 25 bp, Homo sapien
ggtacaaacaagcctggacagtgaa

SEQ ID NO: 79328 - DNA, 25 bp, Homo sapien
ggtacaaatccataatgactgattc

SEQ ID NO: 79329 - DNA, 25 bp, Homo sapien
ggtacaagcctaattggaaaaaagt

SEQ ID NO: 79330 - DNA, 25 bp, Homo sapien
ggtacaagggaacacataaactgag

SEQ ID NO: 79331 - DNA, 25 bp, Homo sapien
ggtacaagggaacatataaactgag

SEQ ID NO: 79332 - DNA, 25 bp, Homo sapien
ggtacaagtctaattggaaaaaagt

SEQ ID NO: 79333 - DNA, 25 bp, Homo sapien
ggtacaagttcttggccttctgtgt

SEQ ID NO: 79334 - DNA, 25 bp, Homo sapien
ggtacaagttcttggcgttctgtgt

SEQ ID NO: 79335 - DNA, 25 bp, Homo sapien
ggtacaatacaaacacataaatcaa

SEQ ID NO: 79336 - DNA, 25 bp, Homo sapien
ggtacaatacagacacataaatcaa

SEQ ID NO: 79337 - DNA, 25 bp, Homo sapien
ggtacaatataacaagaaccactaa

SEQ ID NO: 79338 - DNA, 25 bp, Homo sapien
ggtacaatgtaacaagaaccactaa

SEQ ID NO: 79339 - DNA, 25 bp, Homo sapien
ggtacacatagtagattcatagtac

SEQ ID NO: 79340 - DNA, 25 bp, Homo sapien
ggtacacatagtggattcatagtac

SEQ ID NO: 79341 - DNA, 25 bp, Homo sapien
ggtacagaaagcagagttattcatc

SEQ ID NO: 79342 - DNA, 25 bp, Homo sapien
ggtacagaaggcagagttattcatc

SEQ ID NO: 79343 - DNA, 25 bp, Homo sapien
ggtacaggcagccatcaatatcttc

SEQ ID NO: 79344 - DNA, 25 bp, Homo sapien
ggtacaggcatttcttcttcaagta

SEQ ID NO: 79345 - DNA, 25 bp, Homo sapien
ggtacaggcatttctttttcaagta

SEQ ID NO: 79346 - DNA, 25 bp, Homo sapien
ggtacaggtagccatcaatatcttc

SEQ ID NO: 79347 - DNA, 25 bp, Homo sapien
ggtacatatttaacagaggagttca

SEQ ID NO: 79348 - DNA, 25 bp, Homo sapien
ggtacatatttagcagaggagttca

SEQ ID NO: 79349 - DNA, 25 bp, Homo sapien
ggtacatgctcaaacattcatccag

SEQ ID NO: 79350 - DNA, 25 bp, Homo sapien
ggtacatgctcaagcattcatccag

SEQ ID NO: 79351 - DNA, 25 bp, Homo sapien
ggtacatgtttgctttggctgtctt

SEQ ID NO: 79352 - DNA, 25 bp, Homo sapien
ggtacatgtttgcttttgctgtctt

SEQ ID NO: 79353 - DNA, 25 bp, Homo sapien
ggtacattgcacatggcggtgatca

SEQ ID NO: 79354 - DNA, 25 bp, Homo sapien
ggtacattgcacatggtggtgatca

SEQ ID NO: 79355 - DNA, 25 bp, Homo sapien
ggtacatttgttacaagtaatgggc

SEQ ID NO: 79356 - DNA, 25 bp, Homo sapien
ggtacatttgttgcaagtaatgggc

SEQ ID NO: 79357 - DNA, 25 bp, Homo sapien
ggtaccaatgatcctatatttgtgt

SEQ ID NO: 79358 - DNA, 25 bp, Homo sapien
ggtaccaatgattctatatttgtgt

SEQ ID NO: 79359 - DNA, 25 bp, Homo sapien
ggtacctgggcagatgcaaagagct

SEQ ID NO: 79360 - DNA, 25 bp, Homo sapien
ggtacctgggcaggtgcaaagagct

SEQ ID NO: 79361 - DNA, 25 bp, Homo sapien
ggtaccttcatcggactcatcaaaa

SEQ ID NO: 79362 - DNA, 25 bp, Homo sapien
ggtacctttatcggactcatcaaaa

SEQ ID NO: 79363 - DNA, 25 bp, Homo sapien
ggtacgctgaggacattgagtgatc

SEQ ID NO: 79364 - DNA, 25 bp, Homo sapien
ggtacgctgaggatattgagtgatc

SEQ ID NO: 79365 - DNA, 25 bp, Homo sapien
ggtactaagtgtaacaagtagtgtg

SEQ ID NO: 79366 - DNA, 25 bp, Homo sapien
ggtactaagtgtaacaggtagtgtg

SEQ ID NO: 79367 - DNA, 25 bp, Homo sapien
ggtactacttgactttcaacattat

SEQ ID NO: 79368 - DNA, 25 bp, Homo sapien
ggtactacttgacttttaacattat

SEQ ID NO: 79369 - DNA, 25 bp, Homo sapien
ggtactcacaattcagcatacccag

SEQ ID NO: 79370 - DNA, 25 bp, Homo sapien
ggtactcacaattcagtatacccag

SEQ ID NO: 79371 - DNA, 25 bp, Homo sapien
ggtactctgctctttgtactctagc

SEQ ID NO: 79372 - DNA, 25 bp, Homo sapien
ggtactctgctttttgtactctagc

SEQ ID NO: 79373 - DNA, 25 bp, Homo sapien
ggtacttaggcattaggactttaaa

SEQ ID NO: 79374 - DNA, 25 bp, Homo sapien
ggtacttaggcattgggactttaaa

SEQ ID NO: 79375 - DNA, 25 bp, Homo sapien
ggtacttgcatccaagaggtccagc

SEQ ID NO: 79376 - DNA, 25 bp, Homo sapien
ggtacttgcatcctagaggtccagc

SEQ ID NO: 79377 - DNA, 25 bp, Homo sapien
ggtactttgtatttcaatcattttg

SEQ ID NO: 79378 - DNA, 25 bp, Homo sapien
ggtactttgtattttaatcattttg

SEQ ID NO: 79379 - DNA, 25 bp, Homo sapien
ggtagaacaaatgcagcgaaatgtt

SEQ ID NO: 79380 - DNA, 25 bp, Homo sapien
ggtagaacaaatgcagtgaaatgtt

SEQ ID NO: 79381 - DNA, 25 bp, Homo sapien
ggtagaacatacacatttctcatgc

SEQ ID NO: 79382 - DNA, 25 bp, Homo sapien
ggtagaacatacccatttctcatgc

SEQ ID NO: 79383 - DNA, 25 bp, Homo sapien
ggtagaagacaggaatgctgctata

SEQ ID NO: 79384 - DNA, 25 bp, Homo sapien
ggtagaagacagggatgctgctata

SEQ ID NO: 79385 - DNA, 25 bp, Homo sapien
ggtagaagtataacttgaaagaggc

SEQ ID NO: 79386 - DNA, 25 bp, Homo sapien
ggtagaagtattacttgaaagaggc

SEQ ID NO: 79387 - DNA, 25 bp, Homo sapien
ggtagaattcactaatcgagttggg

SEQ ID NO: 79388 - DNA, 25 bp, Homo sapien
ggtagaattcactaattgagttggg

SEQ ID NO: 79389 - DNA, 25 bp, Homo sapien
ggtagacaaatgcagtatgtgtggt

SEQ ID NO: 79390 - DNA, 25 bp, Homo sapien
ggtagacacaatagcctcaggcctt

SEQ ID NO: 79391 - DNA, 25 bp, Homo sapien
ggtagacacgaaaatgggaaggttt

SEQ ID NO: 79392 - DNA, 25 bp, Homo sapien
ggtagacacgatagcctcaggcctt

SEQ ID NO: 79393 - DNA, 25 bp, Homo sapien
ggtagacactgatgtgttatatgat

SEQ ID NO: 79394 - DNA, 25 bp, Homo sapien
ggtagacatatgcagtatgtgtggt

SEQ ID NO: 79395 - DNA, 25 bp, Homo sapien
ggtagacatgaaaatgggaaggttt

SEQ ID NO: 79396 - DNA, 25 bp, Homo sapien
ggtagacattgatgtgttatatgat

SEQ ID NO: 79397 - DNA, 25 bp, Homo sapien
ggtagacctgacagcaactggaact

SEQ ID NO: 79398 - DNA, 25 bp, Homo sapien
ggtagacctgatagcaactggaact

SEQ ID NO: 79399 - DNA, 25 bp, Homo sapien
ggtagagacagtgcaaccctgctgg

SEQ ID NO: 79400 - DNA, 25 bp, Homo sapien
ggtagagacagtgcgaccctgctgg

SEQ ID NO: 79401 - DNA, 25 bp, Homo sapien
ggtagagagaatgaaaattaaaata

SEQ ID NO: 79402 - DNA, 25 bp, Homo sapien
ggtagagagaatggaaattaaaata

SEQ ID NO: 79403 - DNA, 25 bp, Homo sapien
ggtagagcacagatagaggagcctg

SEQ ID NO: 79404 - DNA, 25 bp, Homo sapien
ggtagagcacagttagaggagcctg

SEQ ID NO: 79405 - DNA, 25 bp, Homo sapien
ggtagaggaaataacatgcctaaaa

SEQ ID NO: 79406 - DNA, 25 bp, Homo sapien
ggtagaggaaataatatgcctaaaa

SEQ ID NO: 79407 - DNA, 25 bp, Homo sapien
ggtagaggtttgcctatgtgattaa

SEQ ID NO: 79408 - DNA, 25 bp, Homo sapien
ggtagaggtttgcttatgtgattaa

SEQ ID NO: 79409 - DNA, 25 bp, Homo sapien
ggtagagtaataaactatgatgcta

SEQ ID NO: 79410 - DNA, 25 bp, Homo sapien
ggtagagtaatgaactatgatgcta

SEQ ID NO: 79411 - DNA, 25 bp, Homo sapien
ggtagataagcctgtgctttcctta

SEQ ID NO: 79412 - DNA, 25 bp, Homo sapien
ggtagataagcctgtgttttcctta

SEQ ID NO: 79413 - DNA, 25 bp, Homo sapien
ggtagattacactgatagattttaa

SEQ ID NO: 79414 - DNA, 25 bp, Homo sapien
ggtagattacattgatagattttaa

SEQ ID NO: 79415 - DNA, 25 bp, Homo sapien
ggtagcacacatccagaaacatcag

SEQ ID NO: 79416 - DNA, 25 bp, Homo sapien
ggtagcacatatccagaaacatcag

SEQ ID NO: 79417 - DNA, 25 bp, Homo sapien
ggtagcacctatatttcgaaggtga

SEQ ID NO: 79418 - DNA, 25 bp, Homo sapien
ggtagcacctatattttgaaggtga

SEQ ID NO: 79419 - DNA, 25 bp, Homo sapien
ggtagccagtgagcaccctaggagg

SEQ ID NO: 79420 - DNA, 25 bp, Homo sapien
ggtagccagtgaggaccctaggagg

SEQ ID NO: 79421 - DNA, 25 bp, Homo sapien
ggtagccgtttacagcccttgttga

SEQ ID NO: 79422 - DNA, 25 bp, Homo sapien
ggtagccgtttatagcccttgttga

SEQ ID NO: 79423 - DNA, 25 bp, Homo sapien
ggtagctaaaattaagcacattttg

SEQ ID NO: 79424 - DNA, 25 bp, Homo sapien
ggtagctataattaagcacattttg

SEQ ID NO: 79425 - DNA, 25 bp, Homo sapien
ggtagctgcactaaacaatggattt

SEQ ID NO: 79426 - DNA, 25 bp, Homo sapien
ggtagctgcactgaacaatggattt

SEQ ID NO: 79427 - DNA, 25 bp, Homo sapien
ggtagctggaatacattggtccaac

SEQ ID NO: 79428 - DNA, 25 bp, Homo sapien
ggtagctggaatccattggtccaac

SEQ ID NO: 79429 - DNA, 25 bp, Homo sapien
ggtagctttgccaactaagacccag

SEQ ID NO: 79430 - DNA, 25 bp, Homo sapien
ggtagctttgccgactaagacccag

SEQ ID NO: 79431 - DNA, 25 bp, Homo sapien
ggtaggaaacctgccgggcaccttc

SEQ ID NO: 79432 - DNA, 25 bp, Homo sapien
ggtaggaaatagcacggtgagtaag

SEQ ID NO: 79433 - DNA, 25 bp, Homo sapien
ggtaggaaatagcatggtgagtaag

SEQ ID NO: 79434 - DNA, 25 bp, Homo sapien
ggtaggaaatctgccgggcaccttc

SEQ ID NO: 79435 - DNA, 25 bp, Homo sapien
ggtaggcctataacaagattcaatt

SEQ ID NO: 79436 - DNA, 25 bp, Homo sapien
ggtaggcctgtaacaagattcaatt

SEQ ID NO: 79437 - DNA, 25 bp, Homo sapien
ggtagggccttgtacgcctgagctc

SEQ ID NO: 79438 - DNA, 25 bp, Homo sapien
ggtagggccttgtatgcctgagctc

SEQ ID NO: 79439 - DNA, 25 bp, Homo sapien
ggtagggctcatcctcatattttct

SEQ ID NO: 79440 - DNA, 25 bp, Homo sapien
ggtagggctcatcctcgtattttct

SEQ ID NO: 79441 - DNA, 25 bp, Homo sapien
ggtagggtagacctgacagcaactg

SEQ ID NO: 79442 - DNA, 25 bp, Homo sapien
ggtagggtagacctgatagcaactg

SEQ ID NO: 79443 - DNA, 25 bp, Homo sapien
ggtaggtaaaaatacaattaggcag

SEQ ID NO: 79444 - DNA, 25 bp, Homo sapien
ggtaggtaaaaatacagttaggcag

SEQ ID NO: 79445 - DNA, 25 bp, Homo sapien
ggtaggtatcttaagtaagtgaagc

SEQ ID NO: 79446 - DNA, 25 bp, Homo sapien
ggtaggtatcttaagtgagtgaagc

SEQ ID NO: 79447 - DNA, 25 bp, Homo sapien
ggtaggtcattaagcagccaatgat

SEQ ID NO: 79448 - DNA, 25 bp, Homo sapien
ggtaggtcgttaagcagccaatgat

SEQ ID NO: 79449 - DNA, 25 bp, Homo sapien
ggtaggtggaccaacgaagagggtg

SEQ ID NO: 79450 - DNA, 25 bp, Homo sapien
ggtaggtggaccagcgaagagggtg

SEQ ID NO: 79451 - DNA, 25 bp, Homo sapien
ggtaggtgtactggaatgctcccat

SEQ ID NO: 79452 - DNA, 25 bp, Homo sapien
ggtaggtgtgctggaatgctcccat

SEQ ID NO: 79453 - DNA, 25 bp, Homo sapien
ggtaggttttcccagccatttcctt

SEQ ID NO: 79454 - DNA, 25 bp, Homo sapien
ggtaggttttcccagcgatttcctt

SEQ ID NO: 79455 - DNA, 25 bp, Homo sapien
ggtagtagactggaattccttttag

SEQ ID NO: 79456 - DNA, 25 bp, Homo sapien
ggtagtagcctggaattccttttag

SEQ ID NO: 79457 - DNA, 25 bp, Homo sapien
ggtagtcaaatctcaccatcaggac

SEQ ID NO: 79458 - DNA, 25 bp, Homo sapien
ggtagtcaacgcactttgttaaatt

SEQ ID NO: 79459 - DNA, 25 bp, Homo sapien
ggtagtcaatgcactttgttaaatt

SEQ ID NO: 79460 - DNA, 25 bp, Homo sapien
ggtagtcacatctcaccatcaggac

SEQ ID NO: 79461 - DNA, 25 bp, Homo sapien
ggtagtcgccttctgatgttgtcag

SEQ ID NO: 79462 - DNA, 25 bp, Homo sapien
ggtagtcgtcttctgatgttgtcag

SEQ ID NO: 79463 - DNA, 25 bp, Homo sapien
ggtagtgcaaccaacaatgtttttg

SEQ ID NO: 79464 - DNA, 25 bp, Homo sapien
ggtagtgcaaccaataatgtttttg

SEQ ID NO: 79465 - DNA, 25 bp, Homo sapien
ggtagtgcagctacggaaggcaatc

SEQ ID NO: 79466 - DNA, 25 bp, Homo sapien
ggtagtgcagctatggaaggcaatc

SEQ ID NO: 79467 - DNA, 25 bp, Homo sapien
ggtagtgttactccaaattgctggc

SEQ ID NO: 79468 - DNA, 25 bp, Homo sapien
ggtagtgttactctaaattgctggc

SEQ ID NO: 79469 - DNA, 25 bp, Homo sapien
ggtagtgtttgccttcgttacatag

SEQ ID NO: 79470 - DNA, 25 bp, Homo sapien
ggtagtgtttgctttcgttacatag

SEQ ID NO: 79471 - DNA, 25 bp, Homo sapien
ggtagtttaacatgcacgtattttg

SEQ ID NO: 79472 - DNA, 25 bp, Homo sapien
ggtagtttaacattcacgtattttg

SEQ ID NO: 79473 - DNA, 25 bp, Homo sapien
ggtagtttcacaaaaagtagatttg

SEQ ID NO: 79474 - DNA, 25 bp, Homo sapien
ggtagtttcacaacaagtagatttg

SEQ ID NO: 79475 - DNA, 25 bp, Homo sapien
ggtataaactccacatgttgttttc

SEQ ID NO: 79476 - DNA, 25 bp, Homo sapien
ggtataaactccacgtgttgttttc

SEQ ID NO: 79477 - DNA, 25 bp, Homo sapien
ggtatacaacatgatgatatggaac

SEQ ID NO: 79478 - DNA, 25 bp, Homo sapien
ggtatacaacatgatgttatggaac

SEQ ID NO: 79479 - DNA, 25 bp, Homo sapien
ggtatagagatgttaaccacttggt

SEQ ID NO: 79480 - DNA, 25 bp, Homo sapien
ggtatagagattttaaccacttggt

SEQ ID NO: 79481 - DNA, 25 bp, Homo sapien
ggtatagtgtaccgtggactcagct

SEQ ID NO: 79482 - DNA, 25 bp, Homo sapien
ggtatagtttaccgtggactcagct

SEQ ID NO: 79483 - DNA, 25 bp, Homo sapien
ggtatatggtggtaagagagctgac

SEQ ID NO: 79484 - DNA, 25 bp, Homo sapien
ggtatatggtggtatgagagctgac

SEQ ID NO: 79485 - DNA, 25 bp, Homo sapien
ggtatatgtatacgttaatctggaa

SEQ ID NO: 79486 - DNA, 25 bp, Homo sapien
ggtatatgtatatgttaatctggaa

SEQ ID NO: 79487 - DNA, 25 bp, Homo sapien
ggtatatgtttgcaatgagcatgct

SEQ ID NO: 79488 - DNA, 25 bp, Homo sapien
ggtatatgtttggaatgagcatgct

SEQ ID NO: 79489 - DNA, 25 bp, Homo sapien
ggtatcaacatattttatcttgcac

SEQ ID NO: 79490 - DNA, 25 bp, Homo sapien
ggtatcaacgtattttatcttgcac

SEQ ID NO: 79491 - DNA, 25 bp, Homo sapien
ggtatcgaagctgaacagcagcagg

SEQ ID NO: 79492 - DNA, 25 bp, Homo sapien
ggtatcgaagctgaacggcagcagg

SEQ ID NO: 79493 - DNA, 25 bp, Homo sapien
ggtatcgtatctctgaatgccgcct

SEQ ID NO: 79494 - DNA, 25 bp, Homo sapien
ggtatcgtatctgtgaatgccgcct

SEQ ID NO: 79495 - DNA, 25 bp, Homo sapien
ggtatcgttcagtcgaggccagttt

SEQ ID NO: 79496 - DNA, 25 bp, Homo sapien
ggtatcgttcagtcgatgccagttt

SEQ ID NO: 79497 - DNA, 25 bp, Homo sapien
ggtatctatttcaactaagcaatgg

SEQ ID NO: 79498 - DNA, 25 bp, Homo sapien
ggtatctatttccactaagcaatgg

SEQ ID NO: 79499 - DNA, 25 bp, Homo sapien
ggtatctcacagcaggcattgccac

SEQ ID NO: 79500 - DNA, 25 bp, Homo sapien
ggtatctcactcttgaaaatgggcc

SEQ ID NO: 79501 - DNA, 25 bp, Homo sapien
ggtatctcattcttgaaaatgggcc

SEQ ID NO: 79502 - DNA, 25 bp, Homo sapien
ggtatctcgcagcaggcattgccac

SEQ ID NO: 79503 - DNA, 25 bp, Homo sapien
ggtatctggtctagcaaaaaatcgg

SEQ ID NO: 79504 - DNA, 25 bp, Homo sapien
ggtatctggtctagcacaaaatcgg

SEQ ID NO: 79505 - DNA, 25 bp, Homo sapien
ggtatcttaagtaagtgaagcaggc

SEQ ID NO: 79506 - DNA, 25 bp, Homo sapien
ggtatcttaagtgagtgaagcaggc

SEQ ID NO: 79507 - DNA, 25 bp, Homo sapien
ggtatgaaaatgtttaacactactg

SEQ ID NO: 79508 - DNA, 25 bp, Homo sapien
ggtatgaaactatcacacgcaggct

SEQ ID NO: 79509 - DNA, 25 bp, Homo sapien
ggtatgaaactgtcacacgcaggct

SEQ ID NO: 79510 - DNA, 25 bp, Homo sapien
ggtatgaatatgtttaacactactg

SEQ ID NO: 79511 - DNA, 25 bp, Homo sapien
ggtatgaatgtcacaacggaaaagg

SEQ ID NO: 79512 - DNA, 25 bp, Homo sapien
ggtatgaatgtcacaagggaaaagg

SEQ ID NO: 79513 - DNA, 25 bp, Homo sapien
ggtatgagtatggaatcaagaaatg

SEQ ID NO: 79514 - DNA, 25 bp, Homo sapien
ggtatgagtatggtatcaagaaatg

SEQ ID NO: 79515 - DNA, 25 bp, Homo sapien
ggtatgatcatagcatcgtgatttt

SEQ ID NO: 79516 - DNA, 25 bp, Homo sapien
ggtatgatcatagcatggtgatttt

SEQ ID NO: 79517 - DNA, 25 bp, Homo sapien
ggtatgcccatcaattcaagcattt

SEQ ID NO: 79518 - DNA, 25 bp, Homo sapien
ggtatgcccatcagttcaagcattt

SEQ ID NO: 79519 - DNA, 25 bp, Homo sapien
ggtatgctctgccaatttgggattt

SEQ ID NO: 79520 - DNA, 25 bp, Homo sapien
ggtatgctctgccattttgggattt

SEQ ID NO: 79521 - DNA, 25 bp, Homo sapien
ggtatgctgggtgactatgtaatct

SEQ ID NO: 79522 - DNA, 25 bp, Homo sapien
ggtatgctgggtgattatgtaatct

SEQ ID NO: 79523 - DNA, 25 bp, Homo sapien
ggtatgcttaaattattgctataag

SEQ ID NO: 79524 - DNA, 25 bp, Homo sapien
ggtatgcttcaattattgctataag

SEQ ID NO: 79525 - DNA, 25 bp, Homo sapien
ggtatggaaaatacgtataaggtcc

SEQ ID NO: 79526 - DNA, 25 bp, Homo sapien
ggtatggaaaatatgtataaggtcc

SEQ ID NO: 79527 - DNA, 25 bp, Homo sapien
ggtatggccgtagactagagctcta

SEQ ID NO: 79528 - DNA, 25 bp, Homo sapien
ggtatggctgtagactagagctcta

SEQ ID NO: 79529 - DNA, 25 bp, Homo sapien
ggtatgtacacattttcccagtgaa

SEQ ID NO: 79530 - DNA, 25 bp, Homo sapien
ggtatgtactcattttcccagtgaa

SEQ ID NO: 79531 - DNA, 25 bp, Homo sapien
ggtatgtcaatattttagatgccaa

SEQ ID NO: 79532 - DNA, 25 bp, Homo sapien
ggtatgtcgatattttagatgccaa

SEQ ID NO: 79533 - DNA, 25 bp, Homo sapien
ggtatgttttatacgtatcctagta

SEQ ID NO: 79534 - DNA, 25 bp, Homo sapien
ggtatgttttatatgtatcctagta

SEQ ID NO: 79535 - DNA, 25 bp, Homo sapien
ggtattacaagtcatgccacagaaa

SEQ ID NO: 79536 - DNA, 25 bp, Homo sapien
ggtattacaagtcgtgccacagaaa

SEQ ID NO: 79537 - DNA, 25 bp, Homo sapien
ggtattatgatctttacactaaagg

SEQ ID NO: 79538 - DNA, 25 bp, Homo sapien
ggtattatgctctttacactaaagg

SEQ ID NO: 79539 - DNA, 25 bp, Homo sapien
ggtattcaccggtgtgaccctagta

SEQ ID NO: 79540 - DNA, 25 bp, Homo sapien
ggtattcactgcagtctcctcagtc

SEQ ID NO: 79541 - DNA, 25 bp, Homo sapien
ggtattcactggtgtgaccctagta

SEQ ID NO: 79542 - DNA, 25 bp, Homo sapien
ggtattcattgcagtctcctcagtc

SEQ ID NO: 79543 - DNA, 25 bp, Homo sapien
ggtattctgaaatcctcaaaacttt

SEQ ID NO: 79544 - DNA, 25 bp, Homo sapien
ggtattctggaatcctcaaaacttt

SEQ ID NO: 79545 - DNA, 25 bp, Homo sapien
ggtattcttacagcagcgctccact

SEQ ID NO: 79546 - DNA, 25 bp, Homo sapien
ggtattcttacagctgcgctccact

SEQ ID NO: 79547 - DNA, 25 bp, Homo sapien
ggtattgatacttgcagatgtttgt

SEQ ID NO: 79548 - DNA, 25 bp, Homo sapien
ggtattgatgcttgcagatgtttgt

SEQ ID NO: 79549 - DNA, 25 bp, Homo sapien
ggtattgtcaggacttggattctag

SEQ ID NO: 79550 - DNA, 25 bp, Homo sapien
ggtattgtcaggatttggattctag

SEQ ID NO: 79551 - DNA, 25 bp, Homo sapien
ggtatttactctaggaaatcttata

SEQ ID NO: 79552 - DNA, 25 bp, Homo sapien
ggtatttactcttggaaatcttata

SEQ ID NO: 79553 - DNA, 25 bp, Homo sapien
ggtatttcgttcattcttagaattc

SEQ ID NO: 79554 - DNA, 25 bp, Homo sapien
ggtatttctttcattcttagaattc

SEQ ID NO: 79555 - DNA, 25 bp, Homo sapien
ggtatttgattaaatgaccacatga

SEQ ID NO: 79556 - DNA, 25 bp, Homo sapien
ggtatttgattaaatggccacatga

SEQ ID NO: 79557 - DNA, 25 bp, Homo sapien
ggtattttgttcttttagcataggc

SEQ ID NO: 79558 - DNA, 25 bp, Homo sapien
ggtatttttttcttttagcataggc

SEQ ID NO: 79559 - DNA, 25 bp, Homo sapien
ggtcaaaagcagaatttaaaagaac

SEQ ID NO: 79560 - DNA, 25 bp, Homo sapien
ggtcaaaagtagaatttaaaagaac

SEQ ID NO: 79561 - DNA, 25 bp, Homo sapien
ggtcaaactgccacctcagggcaaa

SEQ ID NO: 79562 - DNA, 25 bp, Homo sapien
ggtcaaactgccgcctcagggcaaa

SEQ ID NO: 79563 - DNA, 25 bp, Homo sapien
ggtcaaacttttccatagcagctgt

SEQ ID NO: 79564 - DNA, 25 bp, Homo sapien
ggtcaaacttttccgtagcagctgt

SEQ ID NO: 79565 - DNA, 25 bp, Homo sapien
ggtcaaagaggtcactttactttcc

SEQ ID NO: 79566 - DNA, 25 bp, Homo sapien
ggtcaaagaggtcgctttactttcc

SEQ ID NO: 79567 - DNA, 25 bp, Homo sapien
ggtcaaagtatgtctcctcatagct

SEQ ID NO: 79568 - DNA, 25 bp, Homo sapien
ggtcaaagtttgtctcctcatagct

SEQ ID NO: 79569 - DNA, 25 bp, Homo sapien
ggtcaaatccaactggaacccaggt

SEQ ID NO: 79570 - DNA, 25 bp, Homo sapien
ggtcaaatccaattggaacccaggt

SEQ ID NO: 79571 - DNA, 25 bp, Homo sapien
ggtcaaatctcccgggcctacgcag

SEQ ID NO: 79572 - DNA, 25 bp, Homo sapien
ggtcaaatctcccgggtctacgcag

SEQ ID NO: 79573 - DNA, 25 bp, Homo sapien
ggtcaacacatcataaatgatttca

SEQ ID NO: 79574 - DNA, 25 bp, Homo sapien
ggtcaacacctcataaatgatttca

SEQ ID NO: 79575 - DNA, 25 bp, Homo sapien
ggtcaacatgaaagcgttagtatga

SEQ ID NO: 79576 - DNA, 25 bp, Homo sapien
ggtcaacatgaaagtgttagtatga

SEQ ID NO: 79577 - DNA, 25 bp, Homo sapien
ggtcaagcaatattatcctctttta

SEQ ID NO: 79578 - DNA, 25 bp, Homo sapien
ggtcaagcaatgttatcctctttta

SEQ ID NO: 79579 - DNA, 25 bp, Homo sapien
ggtcaagggaaatgatcactcttcc

SEQ ID NO: 79580 - DNA, 25 bp, Homo sapien
ggtcaagggaactgatcactcttcc

SEQ ID NO: 79581 - DNA, 25 bp, Homo sapien
ggtcaagtcctgtctcctataacgt

SEQ ID NO: 79582 - DNA, 25 bp, Homo sapien
ggtcaagtcctttctcctataacgt

SEQ ID NO: 79583 - DNA, 25 bp, Homo sapien
ggtcaatatgatccctgtaaagcat

SEQ ID NO: 79584 - DNA, 25 bp, Homo sapien
ggtcaatatgatcgctgtaaagcat

SEQ ID NO: 79585 - DNA, 25 bp, Homo sapien
ggtcaatatgcatagcaagtcaaca

SEQ ID NO: 79586 - DNA, 25 bp, Homo sapien
ggtcaatatgcgtagcaagtcaaca

SEQ ID NO: 79587 - DNA, 25 bp, Homo sapien
ggtcacaaggagtacacacattggc

SEQ ID NO: 79588 - DNA, 25 bp, Homo sapien
ggtcacaaggattacacacattggc

SEQ ID NO: 79589 - DNA, 25 bp, Homo sapien
ggtcacagaagcagagcatggtatc

SEQ ID NO: 79590 - DNA, 25 bp, Homo sapien
ggtcacagaagcagaggatggtatc

SEQ ID NO: 79591 - DNA, 25 bp, Homo sapien
ggtcacaggataaaaggtcaatata

SEQ ID NO: 79592 - DNA, 25 bp, Homo sapien
ggtcacaggatacaaggtcaatata

SEQ ID NO: 79593 - DNA, 25 bp, Homo sapien
ggtcacaggtccctctgacaaactg

SEQ ID NO: 79594 - DNA, 25 bp, Homo sapien
ggtcacaggtccctttgacaaactg

SEQ ID NO: 79595 - DNA, 25 bp, Homo sapien
ggtcacagtattaagatgtgcattc

SEQ ID NO: 79596 - DNA, 25 bp, Homo sapien
ggtcacagtgttaagatgtgcattc

SEQ ID NO: 79597 - DNA, 25 bp, Homo sapien
ggtcacatgatcaatcctggtcttt

SEQ ID NO: 79598 - DNA, 25 bp, Homo sapien
ggtcacatgatcagtcctggtcttt

SEQ ID NO: 79599 - DNA, 25 bp, Homo sapien
ggtcaccaggaataagttgtgtaag

SEQ ID NO: 79600 - DNA, 25 bp, Homo sapien
ggtcaccaggagtaagttgtgtaag

SEQ ID NO: 79601 - DNA, 25 bp, Homo sapien
ggtcacccaggaaggatggataaat

SEQ ID NO: 79602 - DNA, 25 bp, Homo sapien
ggtcacccgggaaggatggataaat

SEQ ID NO: 79603 - DNA, 25 bp, Homo sapien
ggtcacctgcatttctttgtgagga

SEQ ID NO: 79604 - DNA, 25 bp, Homo sapien
ggtcacctgcatttttttgtgagga

SEQ ID NO: 79605 - DNA, 25 bp, Homo sapien
ggtcacctttcctacctggcaacat

SEQ ID NO: 79606 - DNA, 25 bp, Homo sapien
ggtcacctttcctgcctggcaacat

SEQ ID NO: 79607 - DNA, 25 bp, Homo sapien
ggtcacgtgataccaacaaggtgca

SEQ ID NO: 79608 - DNA, 25 bp, Homo sapien
ggtcacgtgatatcaacaaggtgca

SEQ ID NO: 79609 - DNA, 25 bp, Homo sapien
ggtcactacgagtcttatggacatg

SEQ ID NO: 79610 - DNA, 25 bp, Homo sapien
ggtcactagaaggatgctcaccaaa

SEQ ID NO: 79611 - DNA, 25 bp, Homo sapien
ggtcactagaagtatgctcaccaaa

SEQ ID NO: 79612 - DNA, 25 bp, Homo sapien
ggtcactatgagtcttatggacatg

SEQ ID NO: 79613 - DNA, 25 bp, Homo sapien
ggtcactggaaataccctcacaatc

SEQ ID NO: 79614 - DNA, 25 bp, Homo sapien
ggtcactggaaattccctcacaatc

SEQ ID NO: 79615 - DNA, 25 bp, Homo sapien
ggtcactgggttgttattgcctctc

SEQ ID NO: 79616 - DNA, 25 bp, Homo sapien
ggtcactgtgttgttattgcctctc

SEQ ID NO: 79617 - DNA, 25 bp, Homo sapien
ggtcacttcataagcttcatcaggg

SEQ ID NO: 79618 - DNA, 25 bp, Homo sapien
ggtcacttcatgagcttcatcaggg

SEQ ID NO: 79619 - DNA, 25 bp, Homo sapien
ggtcagaaacctaatttttgtgctg

SEQ ID NO: 79620 - DNA, 25 bp, Homo sapien
ggtcagaaacctagtttttgtgctg

SEQ ID NO: 79621 - DNA, 25 bp, Homo sapien
ggtcagaacccaaggctcaatttta

SEQ ID NO: 79622 - DNA, 25 bp, Homo sapien
ggtcagaacccgaggctcaatttta

SEQ ID NO: 79623 - DNA, 25 bp, Homo sapien
ggtcagaactagatgtagagattca

SEQ ID NO: 79624 - DNA, 25 bp, Homo sapien
ggtcagaagtagatgtagagattca

SEQ ID NO: 79625 - DNA, 25 bp, Homo sapien
ggtcagaatcaatatcatgtatatg

SEQ ID NO: 79626 - DNA, 25 bp, Homo sapien
ggtcagaatgaatatcatgtatatg

SEQ ID NO: 79627 - DNA, 25 bp, Homo sapien
ggtcagaatgtttgctgccctccaa

SEQ ID NO: 79628 - DNA, 25 bp, Homo sapien
ggtcagaatgtttgttgccctccaa

SEQ ID NO: 79629 - DNA, 25 bp, Homo sapien
ggtcagacaagagataaaaagataa

SEQ ID NO: 79630 - DNA, 25 bp, Homo sapien
ggtcagacaagagatagaaagataa

SEQ ID NO: 79631 - DNA, 25 bp, Homo sapien
ggtcagacgccaagtagaaaacctg

SEQ ID NO: 79632 - DNA, 25 bp, Homo sapien
ggtcagacgtcaagtagaaaacctg

SEQ ID NO: 79633 - DNA, 25 bp, Homo sapien
ggtcagactcaagatacgtttgacc

SEQ ID NO: 79634 - DNA, 25 bp, Homo sapien
ggtcagactcaagatatgtttgacc

SEQ ID NO: 79635 - DNA, 25 bp, Homo sapien
ggtcagatctacgtaaacggaatca

SEQ ID NO: 79636 - DNA, 25 bp, Homo sapien
ggtcagatctatgtaaacggaatca

SEQ ID NO: 79637 - DNA, 25 bp, Homo sapien
ggtcagccacaaattagtcattaat

SEQ ID NO: 79638 - DNA, 25 bp, Homo sapien
ggtcagccacaatttagtcattaat

SEQ ID NO: 79639 - DNA, 25 bp, Homo sapien
ggtcagctcagaatggaaaacgcat

SEQ ID NO: 79640 - DNA, 25 bp, Homo sapien
ggtcagctcagagtggaaaacgcat

SEQ ID NO: 79641 - DNA, 25 bp, Homo sapien
ggtcaggagttccgagagacaccca

SEQ ID NO: 79642 - DNA, 25 bp, Homo sapien
ggtcaggagttcggagagacaccca

SEQ ID NO: 79643 - DNA, 25 bp, Homo sapien
ggtcaggtcctcaaacttggtcacc

SEQ ID NO: 79644 - DNA, 25 bp, Homo sapien
ggtcaggtccttaaacttggtcacc

SEQ ID NO: 79645 - DNA, 25 bp, Homo sapien
ggtcaggtctccttaccggcaagtg

SEQ ID NO: 79646 - DNA, 25 bp, Homo sapien
ggtcaggtctccttactggcaagtg

SEQ ID NO: 79647 - DNA, 25 bp, Homo sapien
ggtcagttaagagaagactaaagta

SEQ ID NO: 79648 - DNA, 25 bp, Homo sapien
ggtcagttgagagaagactaaagta

SEQ ID NO: 79649 - DNA, 25 bp, Homo sapien
ggtcagttgttacatatttgtgtat

SEQ ID NO: 79650 - DNA, 25 bp, Homo sapien
ggtcagttgttatatatttgtgtat

SEQ ID NO: 79651 - DNA, 25 bp, Homo sapien
ggtcagtttatggcatactggagta

SEQ ID NO: 79652 - DNA, 25 bp, Homo sapien
ggtcagtttatgtcatactggagta

SEQ ID NO: 79653 - DNA, 25 bp, Homo sapien
ggtcataaaaaagattcaagtaaga

SEQ ID NO: 79654 - DNA, 25 bp, Homo sapien
ggtcataaacaagattcaagtaaga

SEQ ID NO: 79655 - DNA, 25 bp, Homo sapien
ggtcataaggacagaaagtatttgt

SEQ ID NO: 79656 - DNA, 25 bp, Homo sapien
ggtcataaggacagaaggtatttgt

SEQ ID NO: 79657 - DNA, 25 bp, Homo sapien
ggtcatccaaccctgtaagccagca

SEQ ID NO: 79658 - DNA, 25 bp, Homo sapien
ggtcatccaaccctttaagccagca

SEQ ID NO: 79659 - DNA, 25 bp, Homo sapien
ggtcatgggcagagatggtgcttat

SEQ ID NO: 79660 - DNA, 25 bp, Homo sapien
ggtcatggtcagagatggtgcttat

SEQ ID NO: 79661 - DNA, 25 bp, Homo sapien
ggtcatgtatttatggatttgtttc

SEQ ID NO: 79662 - DNA, 25 bp, Homo sapien
ggtcatgtatttgtggatttgtttc

SEQ ID NO: 79663 - DNA, 25 bp, Homo sapien
ggtcatgtgaaatccatagaaccag

SEQ ID NO: 79664 - DNA, 25 bp, Homo sapien
ggtcatgtgaaatcgatagaaccag

SEQ ID NO: 79665 - DNA, 25 bp, Homo sapien
ggtcattatttgaccgtacatgtgt

SEQ ID NO: 79666 - DNA, 25 bp, Homo sapien
ggtcattatttgactgtacatgtgt

SEQ ID NO: 79667 - DNA, 25 bp, Homo sapien
ggtcatttaactaccaggactaatt

SEQ ID NO: 79668 - DNA, 25 bp, Homo sapien
ggtcatttaacttccaggactaatt

SEQ ID NO: 79669 - DNA, 25 bp, Homo sapien
ggtcatttatttctcagcctgatga

SEQ ID NO: 79670 - DNA, 25 bp, Homo sapien
ggtcatttatttgtcagcctgatga

SEQ ID NO: 79671 - DNA, 25 bp, Homo sapien
ggtccaagagcatcttctgtacaat

SEQ ID NO: 79672 - DNA, 25 bp, Homo sapien
ggtccaagagcatcttttgtacaat

SEQ ID NO: 79673 - DNA, 25 bp, Homo sapien
ggtccaagtccaaggtccacatcaa

SEQ ID NO: 79674 - DNA, 25 bp, Homo sapien
ggtccaagtccaaggttcacatcaa

SEQ ID NO: 79675 - DNA, 25 bp, Homo sapien
ggtccacatttctttcactaagtta

SEQ ID NO: 79676 - DNA, 25 bp, Homo sapien
ggtccacatttctttcgctaagtta

SEQ ID NO: 79677 - DNA, 25 bp, Homo sapien
ggtccacctcatatcagatgaacat

SEQ ID NO: 79678 - DNA, 25 bp, Homo sapien
ggtccacctcatgtcagatgaacat

SEQ ID NO: 79679 - DNA, 25 bp, Homo sapien
ggtccactctttacttggaatccca

SEQ ID NO: 79680 - DNA, 25 bp, Homo sapien
ggtccactgtttacttggaatccca

SEQ ID NO: 79681 - DNA, 25 bp, Homo sapien
ggtccagagatactatgtgcaaaat

SEQ ID NO: 79682 - DNA, 25 bp, Homo sapien
ggtccagagatactgtgtgcaaaat

SEQ ID NO: 79683 - DNA, 25 bp, Homo sapien
ggtccagcagacagttgtgcaaaca

SEQ ID NO: 79684 - DNA, 25 bp, Homo sapien
ggtccagcattaaacagctctgagg

SEQ ID NO: 79685 - DNA, 25 bp, Homo sapien
ggtccagcattaaccagctctgagg

SEQ ID NO: 79686 - DNA, 25 bp, Homo sapien
ggtccagccaatcagggataaatcc

SEQ ID NO: 79687 - DNA, 25 bp, Homo sapien
ggtccagccatgtcatcgaatcgtc

SEQ ID NO: 79688 - DNA, 25 bp, Homo sapien
ggtccagccatttcatcgaatcgtc

SEQ ID NO: 79689 - DNA, 25 bp, Homo sapien
ggtccagcggacagttgtgcaaaca

SEQ ID NO: 79690 - DNA, 25 bp, Homo sapien
ggtccagctaatcagggataaatcc

SEQ ID NO: 79691 - DNA, 25 bp, Homo sapien
ggtccaggtcccattttctctacag

SEQ ID NO: 79692 - DNA, 25 bp, Homo sapien
ggtccaggtccccttttctctacag

SEQ ID NO: 79693 - DNA, 25 bp, Homo sapien
ggtccataagtagatcagagtttta

SEQ ID NO: 79694 - DNA, 25 bp, Homo sapien
ggtccataagttttaactaacagat

SEQ ID NO: 79695 - DNA, 25 bp, Homo sapien
ggtccataattagatcagagtttta

SEQ ID NO: 79696 - DNA, 25 bp, Homo sapien
ggtccatatgttttaactaacagat

SEQ ID NO: 79697 - DNA, 25 bp, Homo sapien
ggtcccaagaagccaagaaatgtta

SEQ ID NO: 79698 - DNA, 25 bp, Homo sapien
ggtcccaagaagccgagaaatgtta

SEQ ID NO: 79699 - DNA, 25 bp, Homo sapien
ggtcccacatgcaaattcaaaggga

SEQ ID NO: 79700 - DNA, 25 bp, Homo sapien
ggtcccacgtgcaaattcaaaggga

SEQ ID NO: 79701 - DNA, 25 bp, Homo sapien
ggtcccgaaatggcgactcatgccc

SEQ ID NO: 79702 - DNA, 25 bp, Homo sapien
ggtcccgaaatggtgactcatgccc

SEQ ID NO: 79703 - DNA, 25 bp, Homo sapien
ggtccctgcattctagccactccag

SEQ ID NO: 79704 - DNA, 25 bp, Homo sapien
ggtccctgcgttctagccactccag

SEQ ID NO: 79705 - DNA, 25 bp, Homo sapien
ggtcccttgcagtgcaacatggagc

SEQ ID NO: 79706 - DNA, 25 bp, Homo sapien
ggtcccttgcagtgcagcatggagc

SEQ ID NO: 79707 - DNA, 25 bp, Homo sapien
ggtccggaatggcggaagtaaatcg

SEQ ID NO: 79708 - DNA, 25 bp, Homo sapien
ggtccggaatggtggaagtaaatcg

SEQ ID NO: 79709 - DNA, 25 bp, Homo sapien
ggtcctaactaaacagctccatagt

SEQ ID NO: 79710 - DNA, 25 bp, Homo sapien
ggtcctaactaaacggctccatagt

SEQ ID NO: 79711 - DNA, 25 bp, Homo sapien
ggtcctcatcactagaaacaaaaag

SEQ ID NO: 79712 - DNA, 25 bp, Homo sapien
ggtcctcatcactggaaacaaaaag

SEQ ID NO: 79713 - DNA, 25 bp, Homo sapien
ggtcctccatgatctccacatcctg

SEQ ID NO: 79714 - DNA, 25 bp, Homo sapien
ggtcctccgtgatctccacatcctg

SEQ ID NO: 79715 - DNA, 25 bp, Homo sapien
ggtcctcgcaacttctgagtcactc

SEQ ID NO: 79716 - DNA, 25 bp, Homo sapien
ggtcctcgccacttctgagtcactc

SEQ ID NO: 79717 - DNA, 25 bp, Homo sapien
ggtcctgaatacactcacttatgca

SEQ ID NO: 79718 - DNA, 25 bp, Homo sapien
ggtcctgaatactctcacttatgca

SEQ ID NO: 79719 - DNA, 25 bp, Homo sapien
ggtcctggaaatgtcagactcaaaa

SEQ ID NO: 79720 - DNA, 25 bp, Homo sapien
ggtcctgggaatgtcagactcaaaa

SEQ ID NO: 79721 - DNA, 25 bp, Homo sapien
ggtccttaattcagagactccccaa

SEQ ID NO: 79722 - DNA, 25 bp, Homo sapien
ggtccttagttcagagactccccaa

SEQ ID NO: 79723 - DNA, 25 bp, Homo sapien
ggtccttgaaacatttatcttctgc

SEQ ID NO: 79724 - DNA, 25 bp, Homo sapien
ggtccttgaaacctttatcttctgc

SEQ ID NO: 79725 - DNA, 25 bp, Homo sapien
ggtccttgaagataggataatggat

SEQ ID NO: 79726 - DNA, 25 bp, Homo sapien
ggtccttgaagatgggataatggat

SEQ ID NO: 79727 - DNA, 25 bp, Homo sapien
ggtcctttccaatagagtgagcagt

SEQ ID NO: 79728 - DNA, 25 bp, Homo sapien
ggtcctttccaatggagtgagcagt

SEQ ID NO: 79729 - DNA, 25 bp, Homo sapien
ggtcgcagccttctctgtcttttct

SEQ ID NO: 79730 - DNA, 25 bp, Homo sapien
ggtcgcaggcttctctgtcttttct

SEQ ID NO: 79731 - DNA, 25 bp, Homo sapien
ggtcgcagtgaaccaaaatagggcc

SEQ ID NO: 79732 - DNA, 25 bp, Homo sapien
ggtcgcagtgaaccgaaatagggcc

SEQ ID NO: 79733 - DNA, 25 bp, Homo sapien
ggtcgtgattcccagcaataaaaag

SEQ ID NO: 79734 - DNA, 25 bp, Homo sapien
ggtcgtgattccgagcaataaaaag

SEQ ID NO: 79735 - DNA, 25 bp, Homo sapien
ggtctaaattctcctgaaatccttt

SEQ ID NO: 79736 - DNA, 25 bp, Homo sapien
ggtctaaattcttctgaaatccttt

SEQ ID NO: 79737 - DNA, 25 bp, Homo sapien
ggtctaaggtccagaaggtagtgat

SEQ ID NO: 79738 - DNA, 25 bp, Homo sapien
ggtctaaggtccggaaggtagtgat

SEQ ID NO: 79739 - DNA, 25 bp, Homo sapien
ggtctacaaacactgaatgagcacc

SEQ ID NO: 79740 - DNA, 25 bp, Homo sapien
ggtctacaagcactgaatgagcacc

SEQ ID NO: 79741 - DNA, 25 bp, Homo sapien
ggtctacatgcatgtccgtcagaga

SEQ ID NO: 79742 - DNA, 25 bp, Homo sapien
ggtctacatgcatgtctgtcagaga

SEQ ID NO: 79743 - DNA, 25 bp, Homo sapien
ggtctagcaaaaaatcggatatgtg

SEQ ID NO: 79744 - DNA, 25 bp, Homo sapien
ggtctagcacaaaatcggatatgtg

SEQ ID NO: 79745 - DNA, 25 bp, Homo sapien
ggtctagcaccttttttgaattatg

SEQ ID NO: 79746 - DNA, 25 bp, Homo sapien
ggtctagcatcttttttgaattatg

SEQ ID NO: 79747 - DNA, 25 bp, Homo sapien
ggtctagctctctaaaaaaaaagat

SEQ ID NO: 79748 - DNA, 25 bp, Homo sapien
ggtctagctctctcaaaaaaaagat

SEQ ID NO: 79749 - DNA, 25 bp, Homo sapien
ggtctattttcataactagaagacg

SEQ ID NO: 79750 - DNA, 25 bp, Homo sapien
ggtctattttcgtaactagaagacg

SEQ ID NO: 79751 - DNA, 25 bp, Homo sapien
ggtctcaaagccataattgatattt

SEQ ID NO: 79752 - DNA, 25 bp, Homo sapien
ggtctcaaagccgtaattgatattt

SEQ ID NO: 79753 - DNA, 25 bp, Homo sapien
ggtctcacaaaatgtcagattttct

SEQ ID NO: 79754 - DNA, 25 bp, Homo sapien
ggtctcacataaaccaaaacttaca

SEQ ID NO: 79755 - DNA, 25 bp, Homo sapien
ggtctcacataatccaaaacttaca

SEQ ID NO: 79756 - DNA, 25 bp, Homo sapien
ggtctcacgaaatgtcagattttct

SEQ ID NO: 79757 - DNA, 25 bp, Homo sapien
ggtctcactaactgatatgtcaata

SEQ ID NO: 79758 - DNA, 25 bp, Homo sapien
ggtctcactaattgatatgtcaata

SEQ ID NO: 79759 - DNA, 25 bp, Homo sapien
ggtctcaggataacagatgccctgt

SEQ ID NO: 79760 - DNA, 25 bp, Homo sapien
ggtctcagggtaacagatgccctgt

SEQ ID NO: 79761 - DNA, 25 bp, Homo sapien
ggtctccaacaggatgggcttaact

SEQ ID NO: 79762 - DNA, 25 bp, Homo sapien
ggtctccaataggatgggcttaact

SEQ ID NO: 79763 - DNA, 25 bp, Homo sapien
ggtctccatacatcatcttcactgg

SEQ ID NO: 79764 - DNA, 25 bp, Homo sapien
ggtctccatacctcatcttcactgg

SEQ ID NO: 79765 - DNA, 25 bp, Homo sapien
ggtctccatctctttggtcttgtcc

SEQ ID NO: 79766 - DNA, 25 bp, Homo sapien
ggtctccatctgtttggtcttgtcc

SEQ ID NO: 79767 - DNA, 25 bp, Homo sapien
ggtctccttaccggcaagtgtttgt

SEQ ID NO: 79768 - DNA, 25 bp, Homo sapien
ggtctccttactggcaagtgtttgt

SEQ ID NO: 79769 - DNA, 25 bp, Homo sapien
ggtctctcactcactgccttgaaag

SEQ ID NO: 79770 - DNA, 25 bp, Homo sapien
ggtctctcatatatggctttcattg

SEQ ID NO: 79771 - DNA, 25 bp, Homo sapien
ggtctctcatatatgggtttcattg

SEQ ID NO: 79772 - DNA, 25 bp, Homo sapien
ggtctctcattcactgccttgaaag

SEQ ID NO: 79773 - DNA, 25 bp, Homo sapien
ggtctctttttccatgaaatgcctg

SEQ ID NO: 79774 - DNA, 25 bp, Homo sapien
ggtctctttttccgtgaaatgcctg

SEQ ID NO: 79775 - DNA, 25 bp, Homo sapien
ggtctgaatttgatgacagacttaa

SEQ ID NO: 79776 - DNA, 25 bp, Homo sapien
ggtctgaatttggtgacagacttaa

SEQ ID NO: 79777 - DNA, 25 bp, Homo sapien
ggtctgataaaaagtttgttggatt

SEQ ID NO: 79778 - DNA, 25 bp, Homo sapien
ggtctgataaaacgtttgttggatt

SEQ ID NO: 79779 - DNA, 25 bp, Homo sapien
ggtctgcgatggcggcaaacagcag

SEQ ID NO: 79780 - DNA, 25 bp, Homo sapien
ggtctgcgatggtggcaaacagcag

SEQ ID NO: 79781 - DNA, 25 bp, Homo sapien
ggtctggatttcacagctagtattt

SEQ ID NO: 79782 - DNA, 25 bp, Homo sapien
ggtctggatttcacggctagtattt

SEQ ID NO: 79783 - DNA, 25 bp, Homo sapien
ggtctggggataaagaataagccaa

SEQ ID NO: 79784 - DNA, 25 bp, Homo sapien
ggtctggggatacagaataagccaa

SEQ ID NO: 79785 - DNA, 25 bp, Homo sapien
ggtctgtgtctacacataaaggata

SEQ ID NO: 79786 - DNA, 25 bp, Homo sapien
ggtctgtgtctccacataaaggata

SEQ ID NO: 79787 - DNA, 25 bp, Homo sapien
ggtctgtgtgtacggcaagcatttg

SEQ ID NO: 79788 - DNA, 25 bp, Homo sapien
ggtctgtgtgtacggcgagcatttg

SEQ ID NO: 79789 - DNA, 25 bp, Homo sapien
ggtctgtgtgtatgctttgaactgc

SEQ ID NO: 79790 - DNA, 25 bp, Homo sapien
ggtctgtgtgtattctttgaactgc

SEQ ID NO: 79791 - DNA, 25 bp, Homo sapien
ggtctgttaaaaaatgcctcctttt

SEQ ID NO: 79792 - DNA, 25 bp, Homo sapien
ggtctgttaaaaagtgcctcctttt

SEQ ID NO: 79793 - DNA, 25 bp, Homo sapien
ggtcttagggaaataaatcattgaa

SEQ ID NO: 79794 - DNA, 25 bp, Homo sapien
ggtcttaggtaaataaatcattgaa

SEQ ID NO: 79795 - DNA, 25 bp, Homo sapien
ggtcttcaagacacagtcatcatca

SEQ ID NO: 79796 - DNA, 25 bp, Homo sapien
ggtcttcaagacacggtcatcatca

SEQ ID NO: 79797 - DNA, 25 bp, Homo sapien
ggtcttctctggaattatatcaaaa

SEQ ID NO: 79798 - DNA, 25 bp, Homo sapien
ggtcttctttggaattatatcaaaa

SEQ ID NO: 79799 - DNA, 25 bp, Homo sapien
ggtcttgaatatacttcaaattcag

SEQ ID NO: 79800 - DNA, 25 bp, Homo sapien
ggtcttgaatctcatgtaggaagaa

SEQ ID NO: 79801 - DNA, 25 bp, Homo sapien
ggtcttgaatctcgtgtaggaagaa

SEQ ID NO: 79802 - DNA, 25 bp, Homo sapien
ggtcttgagagtacatggcatttca

SEQ ID NO: 79803 - DNA, 25 bp, Homo sapien
ggtcttgagagtacgtggcatttca

SEQ ID NO: 79804 - DNA, 25 bp, Homo sapien
ggtcttgagtatacttcaaattcag

SEQ ID NO: 79805 - DNA, 25 bp, Homo sapien
ggtcttgttctttctcccagtctga

SEQ ID NO: 79806 - DNA, 25 bp, Homo sapien
ggtcttgttctttttcccagtctga

SEQ ID NO: 79807 - DNA, 25 bp, Homo sapien
ggtctttaatccagccaatgtcatt

SEQ ID NO: 79808 - DNA, 25 bp, Homo sapien
ggtctttaatccagcccatgtcatt

SEQ ID NO: 79809 - DNA, 25 bp, Homo sapien
ggtctttatgctactcattcctaca

SEQ ID NO: 79810 - DNA, 25 bp, Homo sapien
ggtctttatgcttctcattcctaca

SEQ ID NO: 79811 - DNA, 25 bp, Homo sapien
ggtctttccggaggtactttagaaa

SEQ ID NO: 79812 - DNA, 25 bp, Homo sapien
ggtctttctggaggtactttagaaa

SEQ ID NO: 79813 - DNA, 25 bp, Homo sapien
ggtcttttaagcaagcacccgtttt

SEQ ID NO: 79814 - DNA, 25 bp, Homo sapien
ggtcttttaagcaagcgcccgtttt

SEQ ID NO: 79815 - DNA, 25 bp, Homo sapien
ggtctttttttccacaagaacatga

SEQ ID NO: 79816 - DNA, 25 bp, Homo sapien
ggtcttttttttcacaagaacatga

SEQ ID NO: 79817 - DNA, 25 bp, Homo sapien
ggtgaaacagcgttcggtggccact

SEQ ID NO: 79818 - DNA, 25 bp, Homo sapien
ggtgaaacagcgtttggtggccact

SEQ ID NO: 79819 - DNA, 25 bp, Homo sapien
ggtgaaagacgggagttcaggcagg

SEQ ID NO: 79820 - DNA, 25 bp, Homo sapien
ggtgaaagatgggagttcaggcagg

SEQ ID NO: 79821 - DNA, 25 bp, Homo sapien
ggtgaaatcctgagttgactaagag

SEQ ID NO: 79822 - DNA, 25 bp, Homo sapien
ggtgaaatcctgatttgactaagag

SEQ ID NO: 79823 - DNA, 25 bp, Homo sapien
ggtgaaatgactatgggttctgtca

SEQ ID NO: 79824 - DNA, 25 bp, Homo sapien
ggtgaaatgactctgggttctgtca

SEQ ID NO: 79825 - DNA, 25 bp, Homo sapien
ggtgaaatgttacaaaatatagacc

SEQ ID NO: 79826 - DNA, 25 bp, Homo sapien
ggtgaaatgttagaaaatatagacc

SEQ ID NO: 79827 - DNA, 25 bp, Homo sapien
ggtgaacctcgcatattcttacttt

SEQ ID NO: 79828 - DNA, 25 bp, Homo sapien
ggtgaaccttgcatattcttacttt

SEQ ID NO: 79829 - DNA, 25 bp, Homo sapien
ggtgaagactacagtttacacacac

SEQ ID NO: 79830 - DNA, 25 bp, Homo sapien
ggtgaagactacggtttacacacac

SEQ ID NO: 79831 - DNA, 25 bp, Homo sapien
ggtgaagtcataggaacacaaggcc

SEQ ID NO: 79832 - DNA, 25 bp, Homo sapien
ggtgaagtcatgggaacacaaggcc

SEQ ID NO: 79833 - DNA, 25 bp, Homo sapien
ggtgaagttcgaaggatcactcgtg

SEQ ID NO: 79834 - DNA, 25 bp, Homo sapien
ggtgaagttgattccagatgttcag

SEQ ID NO: 79835 - DNA, 25 bp, Homo sapien
ggtgaagttgatttcagatgttcag

SEQ ID NO: 79836 - DNA, 25 bp, Homo sapien
ggtgaagtttgaaggatcactcgtg

SEQ ID NO: 79837 - DNA, 25 bp, Homo sapien
ggtgaatagggacactctccagaga

SEQ ID NO: 79838 - DNA, 25 bp, Homo sapien
ggtgaatagggatactctccagaga

SEQ ID NO: 79839 - DNA, 25 bp, Homo sapien
ggtgaatgttcactggatgaatttt

SEQ ID NO: 79840 - DNA, 25 bp, Homo sapien
ggtgaatgttcactggttgaatttt

SEQ ID NO: 79841 - DNA, 25 bp, Homo sapien
ggtgaattccacagtggccatgctg

SEQ ID NO: 79842 - DNA, 25 bp, Homo sapien
ggtgaattccacggtggccatgctg

SEQ ID NO: 79843 - DNA, 25 bp, Homo sapien
ggtgacaatatgaagatttttaagg

SEQ ID NO: 79844 - DNA, 25 bp, Homo sapien
ggtgacaatatgaggatttttaagg

SEQ ID NO: 79845 - DNA, 25 bp, Homo sapien
ggtgacaatctgagtaggttacatg

SEQ ID NO: 79846 - DNA, 25 bp, Homo sapien
ggtgacaatttgagtaggttacatg

SEQ ID NO: 79847 - DNA, 25 bp, Homo sapien
ggtgacacaaggcatgcagaaaccc

SEQ ID NO: 79848 - DNA, 25 bp, Homo sapien
ggtgacacaaggtatgcagaaaccc

SEQ ID NO: 79849 - DNA, 25 bp, Homo sapien
ggtgacactgatcaccaaatcttga

SEQ ID NO: 79850 - DNA, 25 bp, Homo sapien
ggtgacactgattaccaaatcttga

SEQ ID NO: 79851 - DNA, 25 bp, Homo sapien
ggtgacatattcacagattcttggg

SEQ ID NO: 79852 - DNA, 25 bp, Homo sapien
ggtgacatattcgcagattcttggg

SEQ ID NO: 79853 - DNA, 25 bp, Homo sapien
ggtgacatgtttaaaccccagaaca

SEQ ID NO: 79854 - DNA, 25 bp, Homo sapien
ggtgacatttttaaaccccagaaca

SEQ ID NO: 79855 - DNA, 25 bp, Homo sapien
ggtgaccactcctcgggaatagagt

SEQ ID NO: 79856 - DNA, 25 bp, Homo sapien
ggtgaccaggctttccacattttct

SEQ ID NO: 79857 - DNA, 25 bp, Homo sapien
ggtgaccaggctttccgcattttct

SEQ ID NO: 79858 - DNA, 25 bp, Homo sapien
ggtgaccagtcctcgggaatagagt

SEQ ID NO: 79859 - DNA, 25 bp, Homo sapien
ggtgaccttaagtgagttgctcacc

SEQ ID NO: 79860 - DNA, 25 bp, Homo sapien
ggtgaccttaattgagttgctcacc

SEQ ID NO: 79861 - DNA, 25 bp, Homo sapien
ggtgacgagtgaatggctcaattct

SEQ ID NO: 79862 - DNA, 25 bp, Homo sapien
ggtgacgagtgcatggctcaattct

SEQ ID NO: 79863 - DNA, 25 bp, Homo sapien
ggtgacggcacaaatttccttgtct

SEQ ID NO: 79864 - DNA, 25 bp, Homo sapien
ggtgacggcaccaatttccttgtct

SEQ ID NO: 79865 - DNA, 25 bp, Homo sapien
ggtgacgtgtcattgtgggttcatc

SEQ ID NO: 79866 - DNA, 25 bp, Homo sapien
ggtgacgtgtccttgtgggttcatc

SEQ ID NO: 79867 - DNA, 25 bp, Homo sapien
ggtgactcttctaaactaaattaac

SEQ ID NO: 79868 - DNA, 25 bp, Homo sapien
ggtgactcttctatactaaattaac

SEQ ID NO: 79869 - DNA, 25 bp, Homo sapien
ggtgactgacttcgtttgcagcaga

SEQ ID NO: 79870 - DNA, 25 bp, Homo sapien
ggtgactgactttgtttgcagcaga

SEQ ID NO: 79871 - DNA, 25 bp, Homo sapien
ggtgactgataactacccactctca

SEQ ID NO: 79872 - DNA, 25 bp, Homo sapien
ggtgactgataattacccactctca

SEQ ID NO: 79873 - DNA, 25 bp, Homo sapien
ggtgagactggttactcctccgtgc

SEQ ID NO: 79874 - DNA, 25 bp, Homo sapien
ggtgagactggttattcctccgtgc

SEQ ID NO: 79875 - DNA, 25 bp, Homo sapien
ggtgagaggtgccgtgtgtatatag

SEQ ID NO: 79876 - DNA, 25 bp, Homo sapien
ggtgagaggtgctgtgtgtatatag

SEQ ID NO: 79877 - DNA, 25 bp, Homo sapien
ggtgagataagccacgagtgcagtg

SEQ ID NO: 79878 - DNA, 25 bp, Homo sapien
ggtgagataagccatgagtgcagtg

SEQ ID NO: 79879 - DNA, 25 bp, Homo sapien
ggtgagatattgatgtattagtaga

SEQ ID NO: 79880 - DNA, 25 bp, Homo sapien
ggtgagatattggtgtattagtaga

SEQ ID NO: 79881 - DNA, 25 bp, Homo sapien
ggtgagcccttgctttgcccagtct

SEQ ID NO: 79882 - DNA, 25 bp, Homo sapien
ggtgagcccttgttttgcccagtct

SEQ ID NO: 79883 - DNA, 25 bp, Homo sapien
ggtgagcttcttcaacttgggcccc

SEQ ID NO: 79884 - DNA, 25 bp, Homo sapien
ggtgagcttcttcatcttgggcccc

SEQ ID NO: 79885 - DNA, 25 bp, Homo sapien
ggtgaggaagcactaacacttgttc

SEQ ID NO: 79886 - DNA, 25 bp, Homo sapien
ggtgaggaagcagtaacacttgttc

SEQ ID NO: 79887 - DNA, 25 bp, Homo sapien
ggtgaggcagatgacagtgtccttt

SEQ ID NO: 79888 - DNA, 25 bp, Homo sapien
ggtgaggccaagagaatttcctggc

SEQ ID NO: 79889 - DNA, 25 bp, Homo sapien
ggtgaggccaagaggatttcctggc

SEQ ID NO: 79890 - DNA, 25 bp, Homo sapien
ggtgaggcggatgacagtgtccttt

SEQ ID NO: 79891 - DNA, 25 bp, Homo sapien
ggtgagggccgatctgaaccatggc

SEQ ID NO: 79892 - DNA, 25 bp, Homo sapien
ggtgagggccgatgtgaaccatggc

SEQ ID NO: 79893 - DNA, 25 bp, Homo sapien
ggtgagtagacacagagaaaatctc

SEQ ID NO: 79894 - DNA, 25 bp, Homo sapien
ggtgagtagacgcagagaaaatctc

SEQ ID NO: 79895 - DNA, 25 bp, Homo sapien
ggtgagtccttggccgccggacagg

SEQ ID NO: 79896 - DNA, 25 bp, Homo sapien
ggtgagtccttggctgccggacagg

SEQ ID NO: 79897 - DNA, 25 bp, Homo sapien
ggtgagtgaaatgataggctgccct

SEQ ID NO: 79898 - DNA, 25 bp, Homo sapien
ggtgagtgacactgtccagcacacc

SEQ ID NO: 79899 - DNA, 25 bp, Homo sapien
ggtgagtgatactgtccagcacacc

SEQ ID NO: 79900 - DNA, 25 bp, Homo sapien
ggtgagtggaatgataggctgccct

SEQ ID NO: 79901 - DNA, 25 bp, Homo sapien
ggtgatagaagaaaaagacatatgg

SEQ ID NO: 79902 - DNA, 25 bp, Homo sapien
ggtgatagaaggaaaagacatatgg

SEQ ID NO: 79903 - DNA, 25 bp, Homo sapien
ggtgatagagcagaaccctttttca

SEQ ID NO: 79904 - DNA, 25 bp, Homo sapien
ggtgatagagcggaaccctttttca

SEQ ID NO: 79905 - DNA, 25 bp, Homo sapien
ggtgatagtctgactggaatcccca

SEQ ID NO: 79906 - DNA, 25 bp, Homo sapien
ggtgatagtctgactgtaatcccca

SEQ ID NO: 79907 - DNA, 25 bp, Homo sapien
ggtgatatataggttgacttagctt

SEQ ID NO: 79908 - DNA, 25 bp, Homo sapien
ggtgatatataggttggcttagctt

SEQ ID NO: 79909 - DNA, 25 bp, Homo sapien
ggtgatcacattcccaactgttcca

SEQ ID NO: 79910 - DNA, 25 bp, Homo sapien
ggtgatcatattcccaactgttcca

SEQ ID NO: 79911 - DNA, 25 bp, Homo sapien
ggtgatcctgcggaagagctcccaa

SEQ ID NO: 79912 - DNA, 25 bp, Homo sapien
ggtgatcctgcggatgagctcccaa

SEQ ID NO: 79913 - DNA, 25 bp, Homo sapien
ggtgatctgcaggagaactggtgcc

SEQ ID NO: 79914 - DNA, 25 bp, Homo sapien
ggtgatctgcaggagagctggtgcc

SEQ ID NO: 79915 - DNA, 25 bp, Homo sapien
ggtgatgaactcctgagtgattgcc

SEQ ID NO: 79916 - DNA, 25 bp, Homo sapien
ggtgatgaactcctgattgattgcc

SEQ ID NO: 79917 - DNA, 25 bp, Homo sapien
ggtgatgacataatatatcactcat

SEQ ID NO: 79918 - DNA, 25 bp, Homo sapien
ggtgatgacataatgtatcactcat

SEQ ID NO: 79919 - DNA, 25 bp, Homo sapien
ggtgatggatgatcgaggacagcta

SEQ ID NO: 79920 - DNA, 25 bp, Homo sapien
ggtgatggatgatcgatgacagcta

SEQ ID NO: 79921 - DNA, 25 bp, Homo sapien
ggtgatgggtaaacctaacaagaat

SEQ ID NO: 79922 - DNA, 25 bp, Homo sapien
ggtgatgggtaaacttaacaagaat

SEQ ID NO: 79923 - DNA, 25 bp, Homo sapien
ggtgatgttatgaactgcctttcta

SEQ ID NO: 79924 - DNA, 25 bp, Homo sapien
ggtgatgttatgaattgcctttcta

SEQ ID NO: 79925 - DNA, 25 bp, Homo sapien
ggtgattaaggatcataagattggg

SEQ ID NO: 79926 - DNA, 25 bp, Homo sapien
ggtgattaaggatcatgagattggg

SEQ ID NO: 79927 - DNA, 25 bp, Homo sapien
ggtgattacaattcaacacgagatt

SEQ ID NO: 79928 - DNA, 25 bp, Homo sapien
ggtgattacaattcgacacgagatt

SEQ ID NO: 79929 - DNA, 25 bp, Homo sapien
ggtgattatagggaacaattaagaa

SEQ ID NO: 79930 - DNA, 25 bp, Homo sapien
ggtgattatagggagcaattaagaa

SEQ ID NO: 79931 - DNA, 25 bp, Homo sapien
ggtgattcacacttgggtctccttc

SEQ ID NO: 79932 - DNA, 25 bp, Homo sapien
ggtgattcacacttggttctccttc

SEQ ID NO: 79933 - DNA, 25 bp, Homo sapien
ggtgattgacaaataaacttaatca

SEQ ID NO: 79934 - DNA, 25 bp, Homo sapien
ggtgattgacaagtaaacttaatca

SEQ ID NO: 79935 - DNA, 25 bp, Homo sapien
ggtgattggcatcctgaattttgta

SEQ ID NO: 79936 - DNA, 25 bp, Homo sapien
ggtgattggtacaactttctattct

SEQ ID NO: 79937 - DNA, 25 bp, Homo sapien
ggtgattggtagaactttctattct

SEQ ID NO: 79938 - DNA, 25 bp, Homo sapien
ggtgattggtatcctgaattttgta

SEQ ID NO: 79939 - DNA, 25 bp, Homo sapien
ggtgatttgctatatagatcaacct

SEQ ID NO: 79940 - DNA, 25 bp, Homo sapien
ggtgatttgctgtatagatcaacct

SEQ ID NO: 79941 - DNA, 25 bp, Homo sapien
ggtgatttgttcaatatttcacatt

SEQ ID NO: 79942 - DNA, 25 bp, Homo sapien
ggtgattttaaggcaggaggtcctg

SEQ ID NO: 79943 - DNA, 25 bp, Homo sapien
ggtgattttaatgcaggaggtcctg

SEQ ID NO: 79944 - DNA, 25 bp, Homo sapien
ggtgattttttcaatatttcacatt

SEQ ID NO: 79945 - DNA, 25 bp, Homo sapien
ggtgcaatatcttatacaaagctct

SEQ ID NO: 79946 - DNA, 25 bp, Homo sapien
ggtgcaatgtcttatacaaagctct

SEQ ID NO: 79947 - DNA, 25 bp, Homo sapien
ggtgcacgcacatagccaccagaaa

SEQ ID NO: 79948 - DNA, 25 bp, Homo sapien
ggtgcacgtacatagccaccagaaa

SEQ ID NO: 79949 - DNA, 25 bp, Homo sapien
ggtgcagactcctgagtaaatatta

SEQ ID NO: 79950 - DNA, 25 bp, Homo sapien
ggtgcagactcctgggtaaatatta

SEQ ID NO: 79951 - DNA, 25 bp, Homo sapien
ggtgcataaaaagaacattcataat

SEQ ID NO: 79952 - DNA, 25 bp, Homo sapien
ggtgcataaaaagagcattcataat

SEQ ID NO: 79953 - DNA, 25 bp, Homo sapien
ggtgcataacggactcccttctctg

SEQ ID NO: 79954 - DNA, 25 bp, Homo sapien
ggtgcataatggactcccttctctg

SEQ ID NO: 79955 - DNA, 25 bp, Homo sapien
ggtgcatgccactaaaactggccaa

SEQ ID NO: 79956 - DNA, 25 bp, Homo sapien
ggtgcatgccactaaatctggccaa
